United States Patent 11,492,591 (UNIVERSAL DONOR STEM CELLS AND RELATED METHODS) - sequence listing, part 15

SEQ ID NO: 469388 - DNA, 20 bp, Artificial
  CRISPR gRNA sequence
aaatggagtcatgtccattg

SEQ ID NO: 469389 - DNA, 20 bp, Artificial
  CRISPR gRNA sequence
ttattaaaggatgaaaggct

SEQ ID NO: 469390 - DNA, 20 bp, Artificial
  CRISPR gRNA sequence
tgaatagtatttaatgcagt

SEQ ID NO: 469391 - DNA, 20 bp, Artificial
  CRISPR gRNA sequence
aacaaataccccctaagagg

SEQ ID NO: 469392 - DNA, 20 bp, Artificial
  CRISPR gRNA sequence
cagttttggaaagataaagc

SEQ ID NO: 469393 - DNA, 20 bp, Artificial
  CRISPR gRNA sequence
tccagttgttattcctatca

SEQ ID NO: 469394 - DNA, 20 bp, Artificial
  CRISPR gRNA sequence
acgtgagccaccactcccgg

SEQ ID NO: 469395 - DNA, 20 bp, Artificial
  CRISPR gRNA sequence
gccaaatatcttagagcttc

SEQ ID NO: 469396 - DNA, 20 bp, Artificial
  CRISPR gRNA sequence
ctttaccctgagaagctatg

SEQ ID NO: 469397 - DNA, 20 bp, Artificial
  CRISPR gRNA sequence
gggttccctgtctctcatcc

SEQ ID NO: 469398 - DNA, 20 bp, Artificial
  CRISPR gRNA sequence
ttgttaaaatgaatggagca

SEQ ID NO: 469399 - DNA, 20 bp, Artificial
  CRISPR gRNA sequence
ggtggatagagatgataaag

SEQ ID NO: 469400 - DNA, 20 bp, Artificial
  CRISPR gRNA sequence
ttcccaaactagttttatgt

SEQ ID NO: 469401 - DNA, 20 bp, Artificial
  CRISPR gRNA sequence
cttcccagacaattgcacat

SEQ ID NO: 469402 - DNA, 20 bp, Artificial
  CRISPR gRNA sequence
aatttttattattatttact

SEQ ID NO: 469403 - DNA, 20 bp, Artificial
  CRISPR gRNA sequence
tttattattatttactatag

SEQ ID NO: 469404 - DNA, 20 bp, Artificial
  CRISPR gRNA sequence
tatagaaagaaaataatatt

SEQ ID NO: 469405 - DNA, 20 bp, Artificial
  CRISPR gRNA sequence
aatgccatttaatattatat

SEQ ID NO: 469406 - DNA, 20 bp, Artificial
  CRISPR gRNA sequence
ttagttttaattagagagct

SEQ ID NO: 469407 - DNA, 20 bp, Artificial
  CRISPR gRNA sequence
tctccacaacattcaactca

SEQ ID NO: 469408 - DNA, 20 bp, Artificial
  CRISPR gRNA sequence
catcagctccctactctctt

SEQ ID NO: 469409 - DNA, 20 bp, Artificial
  CRISPR gRNA sequence
gagtctttgctgcatagaga

SEQ ID NO: 469410 - DNA, 20 bp, Artificial
  CRISPR gRNA sequence
tatatatatatatatagtac

SEQ ID NO: 469411 - DNA, 20 bp, Artificial
  CRISPR gRNA sequence
tttgctttcctggaagacaa

SEQ ID NO: 469412 - DNA, 20 bp, Artificial
  CRISPR gRNA sequence
aagaagtaatcaaaaggagt

SEQ ID NO: 469413 - DNA, 20 bp, Artificial
  CRISPR gRNA sequence
gggacattccatactcaatg

SEQ ID NO: 469414 - DNA, 20 bp, Artificial
  CRISPR gRNA sequence
gagagaggttccagcagtct

SEQ ID NO: 469415 - DNA, 20 bp, Artificial
  CRISPR gRNA sequence
atgaaagatacagagaggcc

SEQ ID NO: 469416 - DNA, 20 bp, Artificial
  CRISPR gRNA sequence
agagccatggagttgcagat

SEQ ID NO: 469417 - DNA, 20 bp, Artificial
  CRISPR gRNA sequence
agatgaagaattggggtaag

SEQ ID NO: 469418 - DNA, 20 bp, Artificial
  CRISPR gRNA sequence
ttggggtaagagagaattct

SEQ ID NO: 469419 - DNA, 20 bp, Artificial
  CRISPR gRNA sequence
aaaggttattcctgtgtcac

SEQ ID NO: 469420 - DNA, 20 bp, Artificial
  CRISPR gRNA sequence
gaatgtgagaggatggagga

SEQ ID NO: 469421 - DNA, 20 bp, Artificial
  CRISPR gRNA sequence
tggaggagaagaaaaaggaa

SEQ ID NO: 469422 - DNA, 20 bp, Artificial
  CRISPR gRNA sequence
tagttcaggccaaagctaga

SEQ ID NO: 469423 - DNA, 20 bp, Artificial
  CRISPR gRNA sequence
ttgagagagttcttgcaaaa

SEQ ID NO: 469424 - DNA, 20 bp, Artificial
  CRISPR gRNA sequence
tcatatgcattattgttggg

SEQ ID NO: 469425 - DNA, 20 bp, Artificial
  CRISPR gRNA sequence
agcatatgtttataatggca

SEQ ID NO: 469426 - DNA, 20 bp, Artificial
  CRISPR gRNA sequence
caaacctaagattgatgcaa

SEQ ID NO: 469427 - DNA, 20 bp, Artificial
  CRISPR gRNA sequence
ccatggtttacaggattggg

SEQ ID NO: 469428 - DNA, 20 bp, Artificial
  CRISPR gRNA sequence
attgggaaagaaaacaacag

SEQ ID NO: 469429 - DNA, 20 bp, Artificial
  CRISPR gRNA sequence
aaactaaaaatcctttagcc

SEQ ID NO: 469430 - DNA, 20 bp, Artificial
  CRISPR gRNA sequence
aaatcctttagccccagaaa

SEQ ID NO: 469431 - DNA, 20 bp, Artificial
  CRISPR gRNA sequence
cttctcaggcagcagaacag

SEQ ID NO: 469432 - DNA, 20 bp, Artificial
  CRISPR gRNA sequence
tccccttcagaggcattcct

SEQ ID NO: 469433 - DNA, 20 bp, Artificial
  CRISPR gRNA sequence
tctgcgataatttatctttt

SEQ ID NO: 469434 - DNA, 20 bp, Artificial
  CRISPR gRNA sequence
tttccttgtctcgtaactta

SEQ ID NO: 469435 - DNA, 20 bp, Artificial
  CRISPR gRNA sequence
aaaaaatgaaacagaagagg

SEQ ID NO: 469436 - DNA, 20 bp, Artificial
  CRISPR gRNA sequence
acagaagaggatagaaatca

SEQ ID NO: 469437 - DNA, 20 bp, Artificial
  CRISPR gRNA sequence
atccagaccaaagtgtcaat

SEQ ID NO: 469438 - DNA, 20 bp, Artificial
  CRISPR gRNA sequence
gtacatgggaggctgagaca

SEQ ID NO: 469439 - DNA, 20 bp, Artificial
  CRISPR gRNA sequence
ccaaaccactgccaggagtg

SEQ ID NO: 469440 - DNA, 20 bp, Artificial
  CRISPR gRNA sequence
ttttgagtttgttctgaaat

SEQ ID NO: 469441 - DNA, 20 bp, Artificial
  CRISPR gRNA sequence
ggtaaataactgaaattgat

SEQ ID NO: 469442 - DNA, 20 bp, Artificial
  CRISPR gRNA sequence
tccagtgtttgcacactacc

SEQ ID NO: 469443 - DNA, 20 bp, Artificial
  CRISPR gRNA sequence
aggtgcttttcttcattctg

SEQ ID NO: 469444 - DNA, 20 bp, Artificial
  CRISPR gRNA sequence
taacttgaacataaacagca

SEQ ID NO: 469445 - DNA, 20 bp, Artificial
  CRISPR gRNA sequence
aagaaagtcacttataaaaa

SEQ ID NO: 469446 - DNA, 20 bp, Artificial
  CRISPR gRNA sequence
tttgttttcaccacttcact

SEQ ID NO: 469447 - DNA, 20 bp, Artificial
  CRISPR gRNA sequence
accttttgtgaaggaagtta

SEQ ID NO: 469448 - DNA, 20 bp, Artificial
  CRISPR gRNA sequence
gaagttaaaagaaaaaaaaa

SEQ ID NO: 469449 - DNA, 20 bp, Artificial
  CRISPR gRNA sequence
agctgagattgaaaggaggg

SEQ ID NO: 469450 - DNA, 20 bp, Artificial
  CRISPR gRNA sequence
tgagaggctgtatatggaat

SEQ ID NO: 469451 - DNA, 20 bp, Artificial
  CRISPR gRNA sequence
atatggaatccagaaacaat

SEQ ID NO: 469452 - DNA, 20 bp, Artificial
  CRISPR gRNA sequence
taaagacaaagagtccaatc

SEQ ID NO: 469453 - DNA, 20 bp, Artificial
  CRISPR gRNA sequence
agagacaagagtaggaagcc

SEQ ID NO: 469454 - DNA, 20 bp, Artificial
  CRISPR gRNA sequence
gtgagtaggaaactaagaga

SEQ ID NO: 469455 - DNA, 20 bp, Artificial
  CRISPR gRNA sequence
aagagagtagaaatgttcaa

SEQ ID NO: 469456 - DNA, 20 bp, Artificial
  CRISPR gRNA sequence
tgacccaaatatgggataga

SEQ ID NO: 469457 - DNA, 20 bp, Artificial
  CRISPR gRNA sequence
agaagtagattagttcccat

SEQ ID NO: 469458 - DNA, 20 bp, Artificial
  CRISPR gRNA sequence
attcaatagtatatatcatt

SEQ ID NO: 469459 - DNA, 20 bp, Artificial
  CRISPR gRNA sequence
aattaataatgcaattcttt

SEQ ID NO: 469460 - DNA, 20 bp, Artificial
  CRISPR gRNA sequence
atgttctttaattcatttac

SEQ ID NO: 469461 - DNA, 20 bp, Artificial
  CRISPR gRNA sequence
attttttcatggtgctgctg

SEQ ID NO: 469462 - DNA, 20 bp, Artificial
  CRISPR gRNA sequence
aactaacctaaagcatttta

SEQ ID NO: 469463 - DNA, 20 bp, Artificial
  CRISPR gRNA sequence
gggtcaatttatgagcaaca

SEQ ID NO: 469464 - DNA, 20 bp, Artificial
  CRISPR gRNA sequence
attttggatatttcatataa

SEQ ID NO: 469465 - DNA, 20 bp, Artificial
  CRISPR gRNA sequence
atttgagtatttacctagga

SEQ ID NO: 469466 - DNA, 20 bp, Artificial
  CRISPR gRNA sequence
tatgcttttgtaatcatagc

SEQ ID NO: 469467 - DNA, 20 bp, Artificial
  CRISPR gRNA sequence
aaacactgctaaatccaaga

SEQ ID NO: 469468 - DNA, 20 bp, Artificial
  CRISPR gRNA sequence
tttatccctatgttttctcc

SEQ ID NO: 469469 - DNA, 20 bp, Artificial
  CRISPR gRNA sequence
acatctttcagtccatgaat

SEQ ID NO: 469470 - DNA, 20 bp, Artificial
  CRISPR gRNA sequence
ggattgtttattgctagtgt

SEQ ID NO: 469471 - DNA, 20 bp, Artificial
  CRISPR gRNA sequence
aatagttttaaacaaatttt

SEQ ID NO: 469472 - DNA, 20 bp, Artificial
  CRISPR gRNA sequence
ttcttgcctgtttgctctgg

SEQ ID NO: 469473 - DNA, 20 bp, Artificial
  CRISPR gRNA sequence
agatgaagctctgaatattc

SEQ ID NO: 469474 - DNA, 20 bp, Artificial
  CRISPR gRNA sequence
aagcaccacaaacataactt

SEQ ID NO: 469475 - DNA, 20 bp, Artificial
  CRISPR gRNA sequence
gtaatgaacaaaagtaaaga

SEQ ID NO: 469476 - DNA, 20 bp, Artificial
  CRISPR gRNA sequence
agaagagaaaaatgggaaaa

SEQ ID NO: 469477 - DNA, 20 bp, Artificial
  CRISPR gRNA sequence
ggctttctaacataatcact

SEQ ID NO: 469478 - DNA, 20 bp, Artificial
  CRISPR gRNA sequence
ccctcttcctggaaacatta

SEQ ID NO: 469479 - DNA, 20 bp, Artificial
  CRISPR gRNA sequence
aggaagcactggttcaaaat

SEQ ID NO: 469480 - DNA, 20 bp, Artificial
  CRISPR gRNA sequence
ctagtaattaagccttacta

SEQ ID NO: 469481 - DNA, 20 bp, Artificial
  CRISPR gRNA sequence
tttgtaattctccccaccct

SEQ ID NO: 469482 - DNA, 20 bp, Artificial
  CRISPR gRNA sequence
gtctgttttctgctagtata

SEQ ID NO: 469483 - DNA, 20 bp, Artificial
  CRISPR gRNA sequence
ttgtgctgcattatctcatg

SEQ ID NO: 469484 - DNA, 20 bp, Artificial
  CRISPR gRNA sequence
gcattatctcatggcagaaa

SEQ ID NO: 469485 - DNA, 20 bp, Artificial
  CRISPR gRNA sequence
tggaagggagcacacaagac

SEQ ID NO: 469486 - DNA, 20 bp, Artificial
  CRISPR gRNA sequence
cccaaaagttttaatttatt

SEQ ID NO: 469487 - DNA, 20 bp, Artificial
  CRISPR gRNA sequence
agatattcccattccaaaag

SEQ ID NO: 469488 - DNA, 20 bp, Artificial
  CRISPR gRNA sequence
aagggagaaataggcaaaaa

SEQ ID NO: 469489 - DNA, 20 bp, Artificial
  CRISPR gRNA sequence
aagtaagtccaaaacccaac

SEQ ID NO: 469490 - DNA, 20 bp, Artificial
  CRISPR gRNA sequence
actgtgctggaattcagaga

SEQ ID NO: 469491 - DNA, 20 bp, Artificial
  CRISPR gRNA sequence
agttcttagcaactgtatga

SEQ ID NO: 469492 - DNA, 20 bp, Artificial
  CRISPR gRNA sequence
tagatgtacagtatcataca

SEQ ID NO: 469493 - DNA, 20 bp, Artificial
  CRISPR gRNA sequence
cacatctcatgaatctctgc

SEQ ID NO: 469494 - DNA, 20 bp, Artificial
  CRISPR gRNA sequence
atgaatctctgctcagaata

SEQ ID NO: 469495 - DNA, 20 bp, Artificial
  CRISPR gRNA sequence
tgagtttccaggaatcagag

SEQ ID NO: 469496 - DNA, 20 bp, Artificial
  CRISPR gRNA sequence
tgaggttttcaaaaaaatga

SEQ ID NO: 469497 - DNA, 20 bp, Artificial
  CRISPR gRNA sequence
aaaaagtaagaaggccagag

SEQ ID NO: 469498 - DNA, 20 bp, Artificial
  CRISPR gRNA sequence
atggagcctctaagtctgtg

SEQ ID NO: 469499 - DNA, 20 bp, Artificial
  CRISPR gRNA sequence
gcttgagccaccacacctgg

SEQ ID NO: 469500 - DNA, 20 bp, Artificial
  CRISPR gRNA sequence
tttaccttctagacactttt

SEQ ID NO: 469501 - DNA, 20 bp, Artificial
  CRISPR gRNA sequence
ctactcaagaggctgaggca

SEQ ID NO: 469502 - DNA, 20 bp, Artificial
  CRISPR gRNA sequence
taaactttgcttatccacca

SEQ ID NO: 469503 - DNA, 20 bp, Artificial
  CRISPR gRNA sequence
gcgcaaagtgggttaggggt

SEQ ID NO: 469504 - DNA, 20 bp, Artificial
  CRISPR gRNA sequence
tgtaggcttgcaagcaggca

SEQ ID NO: 469505 - DNA, 20 bp, Artificial
  CRISPR gRNA sequence
taaaataaatacatgcagta

SEQ ID NO: 469506 - DNA, 20 bp, Artificial
  CRISPR gRNA sequence
ctgctcggcagactgaggca

SEQ ID NO: 469507 - DNA, 20 bp, Artificial
  CRISPR gRNA sequence
caaaaaacaaaccaacaaac

SEQ ID NO: 469508 - DNA, 20 bp, Artificial
  CRISPR gRNA sequence
cttgttaagtcactataggt

SEQ ID NO: 469509 - DNA, 20 bp, Artificial
  CRISPR gRNA sequence
ctctatacataaaaatattt

SEQ ID NO: 469510 - DNA, 20 bp, Artificial
  CRISPR gRNA sequence
taaaacaagtaataaaatgg

SEQ ID NO: 469511 - DNA, 20 bp, Artificial
  CRISPR gRNA sequence
caagtaataaaatggccaga

SEQ ID NO: 469512 - DNA, 20 bp, Artificial
  CRISPR gRNA sequence
aaaaaaattaaaatacaaaa

SEQ ID NO: 469513 - DNA, 20 bp, Artificial
  CRISPR gRNA sequence
ttctctgagttaacttgcaa

SEQ ID NO: 469514 - DNA, 20 bp, Artificial
  CRISPR gRNA sequence
gagaccagcctaaccaacat

SEQ ID NO: 469515 - DNA, 20 bp, Artificial
  CRISPR gRNA sequence
ctactcaggaggctgaggca

SEQ ID NO: 469516 - DNA, 20 bp, Artificial
  CRISPR gRNA sequence
gtggttaagttataactacc

SEQ ID NO: 469517 - DNA, 20 bp, Artificial
  CRISPR gRNA sequence
cagctacacagatcagctga

SEQ ID NO: 469518 - DNA, 20 bp, Artificial
  CRISPR gRNA sequence
cagattgccttaacttgagc

SEQ ID NO: 469519 - DNA, 20 bp, Artificial
  CRISPR gRNA sequence
agaaagtgtcagagtttaac

SEQ ID NO: 469520 - DNA, 20 bp, Artificial
  CRISPR gRNA sequence
aaattaaacaaatgattttt

SEQ ID NO: 469521 - DNA, 20 bp, Artificial
  CRISPR gRNA sequence
aaccaggattttagcttcta

SEQ ID NO: 469522 - DNA, 20 bp, Artificial
  CRISPR gRNA sequence
gggaaatcacacggacgaca

SEQ ID NO: 469523 - DNA, 20 bp, Artificial
  CRISPR gRNA sequence
gctcacatacactcacaaaa

SEQ ID NO: 469524 - DNA, 20 bp, Artificial
  CRISPR gRNA sequence
gtgggggagttccacctcat

SEQ ID NO: 469525 - DNA, 20 bp, Artificial
  CRISPR gRNA sequence
cagaagtactaggaatacct

SEQ ID NO: 469526 - DNA, 20 bp, Artificial
  CRISPR gRNA sequence
gaactggaaagtattaatgc

SEQ ID NO: 469527 - DNA, 20 bp, Artificial
  CRISPR gRNA sequence
aaaaaaaagcaaccatgaaa

SEQ ID NO: 469528 - DNA, 20 bp, Artificial
  CRISPR gRNA sequence
taaagcaatttcttctacag

SEQ ID NO: 469529 - DNA, 20 bp, Artificial
  CRISPR gRNA sequence
ttacatttaggagatcacct

SEQ ID NO: 469530 - DNA, 20 bp, Artificial
  CRISPR gRNA sequence
ccatcttaacacgaggaaaa

SEQ ID NO: 469531 - DNA, 20 bp, Artificial
  CRISPR gRNA sequence
agttgaggaaactgggtatt

SEQ ID NO: 469532 - DNA, 20 bp, Artificial
  CRISPR gRNA sequence
atatatctatataatagaga

SEQ ID NO: 469533 - DNA, 20 bp, Artificial
  CRISPR gRNA sequence
tatgtgggagaggaaactct

SEQ ID NO: 469534 - DNA, 20 bp, Artificial
  CRISPR gRNA sequence
aaggcttgccttggtcaaaa

SEQ ID NO: 469535 - DNA, 20 bp, Artificial
  CRISPR gRNA sequence
ctttgtcacagggatttcag

SEQ ID NO: 469536 - DNA, 20 bp, Artificial
  CRISPR gRNA sequence
tgagtgcctctggcatttga

SEQ ID NO: 469537 - DNA, 20 bp, Artificial
  CRISPR gRNA sequence
actaaacaatacttatgtgg

SEQ ID NO: 469538 - DNA, 20 bp, Artificial
  CRISPR gRNA sequence
tgaacatggttatcaagaag

SEQ ID NO: 469539 - DNA, 20 bp, Artificial
  CRISPR gRNA sequence
ggttatcaagaaggcagaaa

SEQ ID NO: 469540 - DNA, 20 bp, Artificial
  CRISPR gRNA sequence
tccataaccatgagagtata

SEQ ID NO: 469541 - DNA, 20 bp, Artificial
  CRISPR gRNA sequence
attgagcttattttgaggta

SEQ ID NO: 469542 - DNA, 20 bp, Artificial
  CRISPR gRNA sequence
aggtaagagaatggagagta

SEQ ID NO: 469543 - DNA, 20 bp, Artificial
  CRISPR gRNA sequence
tgaagaacttctgcacagca

SEQ ID NO: 469544 - DNA, 20 bp, Artificial
  CRISPR gRNA sequence
tcagagcaaaaaggcaacct

SEQ ID NO: 469545 - DNA, 20 bp, Artificial
  CRISPR gRNA sequence
aaaaggcaacctacagaatg

SEQ ID NO: 469546 - DNA, 20 bp, Artificial
  CRISPR gRNA sequence
atctgaaaaaggcctaatat

SEQ ID NO: 469547 - DNA, 20 bp, Artificial
  CRISPR gRNA sequence
ggcctaatatccagaattta

SEQ ID NO: 469548 - DNA, 20 bp, Artificial
  CRISPR gRNA sequence
aagaaacttaaataagttta

SEQ ID NO: 469549 - DNA, 20 bp, Artificial
  CRISPR gRNA sequence
ctactcgggaggctgagtta

SEQ ID NO: 469550 - DNA, 20 bp, Artificial
  CRISPR gRNA sequence
atttatgccaccaacaaaca

SEQ ID NO: 469551 - DNA, 20 bp, Artificial
  CRISPR gRNA sequence
gctcaacatcactgatggtc

SEQ ID NO: 469552 - DNA, 20 bp, Artificial
  CRISPR gRNA sequence
gagataacatctcacgccag

SEQ ID NO: 469553 - DNA, 20 bp, Artificial
  CRISPR gRNA sequence
ataggtgctggcaagtctgt

SEQ ID NO: 469554 - DNA, 20 bp, Artificial
  CRISPR gRNA sequence
ggcaattcctcgatctagaa

SEQ ID NO: 469555 - DNA, 20 bp, Artificial
  CRISPR gRNA sequence
ccatcaatgatagactggaa

SEQ ID NO: 469556 - DNA, 20 bp, Artificial
  CRISPR gRNA sequence
gaatactatgcagccataaa

SEQ ID NO: 469557 - DNA, 20 bp, Artificial
  CRISPR gRNA sequence
ctaagcaaactaacacagga

SEQ ID NO: 469558 - DNA, 20 bp, Artificial
  CRISPR gRNA sequence
tcataagtggaagttgaaaa

SEQ ID NO: 469559 - DNA, 20 bp, Artificial
  CRISPR gRNA sequence
tatcctgttttcctttttta

SEQ ID NO: 469560 - DNA, 20 bp, Artificial
  CRISPR gRNA sequence
tttccttttttagaagaaat

SEQ ID NO: 469561 - DNA, 20 bp, Artificial
  CRISPR gRNA sequence
actaatgaaatgttggacta

SEQ ID NO: 469562 - DNA, 20 bp, Artificial
  CRISPR gRNA sequence
tgcactattctaagtgtttt

SEQ ID NO: 469563 - DNA, 20 bp, Artificial
  CRISPR gRNA sequence
tattctcccatttttttaga

SEQ ID NO: 469564 - DNA, 20 bp, Artificial
  CRISPR gRNA sequence
acacagcttctccaaggaaa

SEQ ID NO: 469565 - DNA, 20 bp, Artificial
  CRISPR gRNA sequence
tggtagtaggacagaggaag

SEQ ID NO: 469566 - DNA, 20 bp, Artificial
  CRISPR gRNA sequence
attcaagaagtcctgtaacc

SEQ ID NO: 469567 - DNA, 20 bp, Artificial
  CRISPR gRNA sequence
aagaacaaatagctgaagcc

SEQ ID NO: 469568 - DNA, 20 bp, Artificial
  CRISPR gRNA sequence
ccactgtattctcaaaagag

SEQ ID NO: 469569 - DNA, 20 bp, Artificial
  CRISPR gRNA sequence
tttttattacttctatcagg

SEQ ID NO: 469570 - DNA, 20 bp, Artificial
  CRISPR gRNA sequence
gcaagtttctctaatttttt

SEQ ID NO: 469571 - DNA, 20 bp, Artificial
  CRISPR gRNA sequence
taaggtatttaatgtggttt

SEQ ID NO: 469572 - DNA, 20 bp, Artificial
  CRISPR gRNA sequence
aaatgctaggttgcacattg

SEQ ID NO: 469573 - DNA, 20 bp, Artificial
  CRISPR gRNA sequence
ttatgtatccttcaaatggg

SEQ ID NO: 469574 - DNA, 20 bp, Artificial
  CRISPR gRNA sequence
tgcttgtagggaataataag

SEQ ID NO: 469575 - DNA, 20 bp, Artificial
  CRISPR gRNA sequence
cttaaaaaacaggttgatgg

SEQ ID NO: 469576 - DNA, 20 bp, Artificial
  CRISPR gRNA sequence
ctactagggacgctgaggca

SEQ ID NO: 469577 - DNA, 20 bp, Artificial
  CRISPR gRNA sequence
taaattgaacccgggaggaa

SEQ ID NO: 469578 - DNA, 20 bp, Artificial
  CRISPR gRNA sequence
ggaagcgactttacaataaa

SEQ ID NO: 469579 - DNA, 20 bp, Artificial
  CRISPR gRNA sequence
ggtggctaaatatcatcttt

SEQ ID NO: 469580 - DNA, 20 bp, Artificial
  CRISPR gRNA sequence
tcctaccatcaacatgtttt

SEQ ID NO: 469581 - DNA, 20 bp, Artificial
  CRISPR gRNA sequence
accgtactaagttcagcaag

SEQ ID NO: 469582 - DNA, 20 bp, Artificial
  CRISPR gRNA sequence
atgttgcctccaagaccccc

SEQ ID NO: 469583 - DNA, 20 bp, Artificial
  CRISPR gRNA sequence
agaccccctgagaaataaaa

SEQ ID NO: 469584 - DNA, 20 bp, Artificial
  CRISPR gRNA sequence
gattttgtgaaaaaaagtga

SEQ ID NO: 469585 - DNA, 20 bp, Artificial
  CRISPR gRNA sequence
gaaatgagcaattaaacttt

SEQ ID NO: 469586 - DNA, 20 bp, Artificial
  CRISPR gRNA sequence
cttcattgggatgtatgcct

SEQ ID NO: 469587 - DNA, 20 bp, Artificial
  CRISPR gRNA sequence
tatgccttgagaataccgat

SEQ ID NO: 469588 - DNA, 20 bp, Artificial
  CRISPR gRNA sequence
tacttggttgtcaattgaac

SEQ ID NO: 469589 - DNA, 20 bp, Artificial
  CRISPR gRNA sequence
cttgccatcaacctgttttt

SEQ ID NO: 469590 - DNA, 20 bp, Artificial
  CRISPR gRNA sequence
ttggctactgcaattttaaa

SEQ ID NO: 469591 - DNA, 20 bp, Artificial
  CRISPR gRNA sequence
gcaacctctatgtaattaaa

SEQ ID NO: 469592 - DNA, 20 bp, Artificial
  CRISPR gRNA sequence
aatatagtgaatcaaattat

SEQ ID NO: 469593 - DNA, 20 bp, Artificial
  CRISPR gRNA sequence
ctactcgggaggccgagaca

SEQ ID NO: 469594 - DNA, 20 bp, Artificial
  CRISPR gRNA sequence
ttgtgtttctctaaaaaatt

SEQ ID NO: 469595 - DNA, 20 bp, Artificial
  CRISPR gRNA sequence
tcaccaacaccatatatgat

SEQ ID NO: 469596 - DNA, 20 bp, Artificial
  CRISPR gRNA sequence
cacctgtattctggctcttt

SEQ ID NO: 469597 - DNA, 20 bp, Artificial
  CRISPR gRNA sequence
gtttcatctttatgtagagt

SEQ ID NO: 469598 - DNA, 20 bp, Artificial
  CRISPR gRNA sequence
tgtagagttcagaattgtta

SEQ ID NO: 469599 - DNA, 20 bp, Artificial
  CRISPR gRNA sequence
ttttctcatctaaaaaaatg

SEQ ID NO: 469600 - DNA, 20 bp, Artificial
  CRISPR gRNA sequence
gaattaattctgtaaaacac

SEQ ID NO: 469601 - DNA, 20 bp, Artificial
  CRISPR gRNA sequence
aaggaaaacaggatacatgt

SEQ ID NO: 469602 - DNA, 20 bp, Artificial
  CRISPR gRNA sequence
cgtgtgcatgtgtctttata

SEQ ID NO: 469603 - DNA, 20 bp, Artificial
  CRISPR gRNA sequence
cagctacttgggaggctgag

SEQ ID NO: 469604 - DNA, 20 bp, Artificial
  CRISPR gRNA sequence
tttatgtcatgaagactttg

SEQ ID NO: 469605 - DNA, 20 bp, Artificial
  CRISPR gRNA sequence
ctactcttatccttggtcac

SEQ ID NO: 469606 - DNA, 20 bp, Artificial
  CRISPR gRNA sequence
caagaaaagctaatagtgct

SEQ ID NO: 469607 - DNA, 20 bp, Artificial
  CRISPR gRNA sequence
tcctctataatattagaaga

SEQ ID NO: 469608 - DNA, 20 bp, Artificial
  CRISPR gRNA sequence
atctcagtgtgatgtctgtg

SEQ ID NO: 469609 - DNA, 20 bp, Artificial
  CRISPR gRNA sequence
agatgtgaggaagtatctgg

SEQ ID NO: 469610 - DNA, 20 bp, Artificial
  CRISPR gRNA sequence
ccttccactgaagtcaatat

SEQ ID NO: 469611 - DNA, 20 bp, Artificial
  CRISPR gRNA sequence
atgttgaccaactaaaacca

SEQ ID NO: 469612 - DNA, 20 bp, Artificial
  CRISPR gRNA sequence
aagaagtcctgaaagcaagc

SEQ ID NO: 469613 - DNA, 20 bp, Artificial
  CRISPR gRNA sequence
ttatgcaccactgctgatcc

SEQ ID NO: 469614 - DNA, 20 bp, Artificial
  CRISPR gRNA sequence
atttccctaaattcatccta

SEQ ID NO: 469615 - DNA, 20 bp, Artificial
  CRISPR gRNA sequence
ttatgtgccaagcatagtgc

SEQ ID NO: 469616 - DNA, 20 bp, Artificial
  CRISPR gRNA sequence
tgtacctgtgggcaagtggc

SEQ ID NO: 469617 - DNA, 20 bp, Artificial
  CRISPR gRNA sequence
ggaaaaagcaatgacaaata

SEQ ID NO: 469618 - DNA, 20 bp, Artificial
  CRISPR gRNA sequence
tgattttagacaaaacaagt

SEQ ID NO: 469619 - DNA, 20 bp, Artificial
  CRISPR gRNA sequence
tagtcatactacactaacaa

SEQ ID NO: 469620 - DNA, 20 bp, Artificial
  CRISPR gRNA sequence
aatgagaaattctaactgta

SEQ ID NO: 469621 - DNA, 20 bp, Artificial
  CRISPR gRNA sequence
taccatatgaaagtaaactt

SEQ ID NO: 469622 - DNA, 20 bp, Artificial
  CRISPR gRNA sequence
gtgtgtgtgtgtttacccag

SEQ ID NO: 469623 - DNA, 20 bp, Artificial
  CRISPR gRNA sequence
caatatcaggtgatatccac

SEQ ID NO: 469624 - DNA, 20 bp, Artificial
  CRISPR gRNA sequence
ccaggtattcctagtacttc

SEQ ID NO: 469625 - DNA, 20 bp, Artificial
  CRISPR gRNA sequence
ctaaaatcctggttgatgtc

SEQ ID NO: 469626 - DNA, 20 bp, Artificial
  CRISPR gRNA sequence
ttgaagtttccataaatttg

SEQ ID NO: 469627 - DNA, 20 bp, Artificial
  CRISPR gRNA sequence
aaacatatggtatttaaaaa

SEQ ID NO: 469628 - DNA, 20 bp, Artificial
  CRISPR gRNA sequence
tgctgtgcaaccagtactac

SEQ ID NO: 469629 - DNA, 20 bp, Artificial
  CRISPR gRNA sequence
agtagcagactagatagaag

SEQ ID NO: 469630 - DNA, 20 bp, Artificial
  CRISPR gRNA sequence
ctgctccagaggctgaggca

SEQ ID NO: 469631 - DNA, 20 bp, Artificial
  CRISPR gRNA sequence
ctactcaggaggctgaggca

SEQ ID NO: 469632 - DNA, 20 bp, Artificial
  CRISPR gRNA sequence
tgtctcaaaaaaaaaaaaaa

SEQ ID NO: 469633 - DNA, 20 bp, Artificial
  CRISPR gRNA sequence
aaaaaaaaaaaaaaaagaaa

SEQ ID NO: 469634 - DNA, 20 bp, Artificial
  CRISPR gRNA sequence
ggaaactgtgacagtgatgt

SEQ ID NO: 469635 - DNA, 20 bp, Artificial
  CRISPR gRNA sequence
gtgacaataatccacatgaa

SEQ ID NO: 469636 - DNA, 20 bp, Artificial
  CRISPR gRNA sequence
gcctgggggttggcttggag

SEQ ID NO: 469637 - DNA, 20 bp, Artificial
  CRISPR gRNA sequence
gcctttcctgattgacccag

SEQ ID NO: 469638 - DNA, 20 bp, Artificial
  CRISPR gRNA sequence
ctttcagcctcttctttgtg

SEQ ID NO: 469639 - DNA, 20 bp, Artificial
  CRISPR gRNA sequence
taaataaacaataataccac

SEQ ID NO: 469640 - DNA, 20 bp, Artificial
  CRISPR gRNA sequence
atgttgttttaaaactaact

SEQ ID NO: 469641 - DNA, 20 bp, Artificial
  CRISPR gRNA sequence
gttacctaaattgtatcttt

SEQ ID NO: 469642 - DNA, 20 bp, Artificial
  CRISPR gRNA sequence
tattatatcagactataact

SEQ ID NO: 469643 - DNA, 20 bp, Artificial
  CRISPR gRNA sequence
tttatacatgaagttcagca

SEQ ID NO: 469644 - DNA, 20 bp, Artificial
  CRISPR gRNA sequence
ctgaaaatatttttatgtat

SEQ ID NO: 469645 - DNA, 20 bp, Artificial
  CRISPR gRNA sequence
tgataaaaattttaaacatg

SEQ ID NO: 469646 - DNA, 20 bp, Artificial
  CRISPR gRNA sequence
tgtcatcagatatgaatgct

SEQ ID NO: 469647 - DNA, 20 bp, Artificial
  CRISPR gRNA sequence
ctacttgggaggctgaggca

SEQ ID NO: 469648 - DNA, 20 bp, Artificial
  CRISPR gRNA sequence
atatgcataattcagaacag

SEQ ID NO: 469649 - DNA, 20 bp, Artificial
  CRISPR gRNA sequence
caagcttgtcagatggacaa

SEQ ID NO: 469650 - DNA, 20 bp, Artificial
  CRISPR gRNA sequence
ccaccggggaggctgaggca

SEQ ID NO: 469651 - DNA, 20 bp, Artificial
  CRISPR gRNA sequence
aaataaattaattaaaaaaa

SEQ ID NO: 469652 - DNA, 20 bp, Artificial
  CRISPR gRNA sequence
catcggttcattcctccatt

SEQ ID NO: 469653 - DNA, 20 bp, Artificial
  CRISPR gRNA sequence
aatgatcattatcctgctga

SEQ ID NO: 469654 - DNA, 20 bp, Artificial
  CRISPR gRNA sequence
agtgatagccctatggctaa

SEQ ID NO: 469655 - DNA, 20 bp, Artificial
  CRISPR gRNA sequence
ggtaatatattgtgatagga

SEQ ID NO: 469656 - DNA, 20 bp, Artificial
  CRISPR gRNA sequence
caatcctttcatcttatttt

SEQ ID NO: 469657 - DNA, 20 bp, Artificial
  CRISPR gRNA sequence
gtggtctccatatcactaag

SEQ ID NO: 469658 - DNA, 20 bp, Artificial
  CRISPR gRNA sequence
gctttcagctcagtaaactg

SEQ ID NO: 469659 - DNA, 20 bp, Artificial
  CRISPR gRNA sequence
tggtatatagtaaattgatt

SEQ ID NO: 469660 - DNA, 20 bp, Artificial
  CRISPR gRNA sequence
aagaccagcctgaccaacat

SEQ ID NO: 469661 - DNA, 20 bp, Artificial
  CRISPR gRNA sequence
ttacccgggaggctgaggca

SEQ ID NO: 469662 - DNA, 20 bp, Artificial
  CRISPR gRNA sequence
aaaaaaaaaaaaaaaaaaaa

SEQ ID NO: 469663 - DNA, 20 bp, Artificial
  CRISPR gRNA sequence
taaaccattattgacttatc

SEQ ID NO: 469664 - DNA, 20 bp, Artificial
  CRISPR gRNA sequence
gtgtgaggaaatagataaaa

SEQ ID NO: 469665 - DNA, 20 bp, Artificial
  CRISPR gRNA sequence
atatttatgctggcaagggt

SEQ ID NO: 469666 - DNA, 20 bp, Artificial
  CRISPR gRNA sequence
ttgttctggatagacatgta

SEQ ID NO: 469667 - DNA, 20 bp, Artificial
  CRISPR gRNA sequence
tgatactgtacatctattca

SEQ ID NO: 469668 - DNA, 20 bp, Artificial
  CRISPR gRNA sequence
gagagacggtagttcaaaac

SEQ ID NO: 469669 - DNA, 20 bp, Artificial
  CRISPR gRNA sequence
gacggtagttcaaaacatag

SEQ ID NO: 469670 - DNA, 20 bp, Artificial
  CRISPR gRNA sequence
caaaacatagaaagaaaggc

SEQ ID NO: 469671 - DNA, 20 bp, Artificial
  CRISPR gRNA sequence
taagaaagaactgtaagagt

SEQ ID NO: 469672 - DNA, 20 bp, Artificial
  CRISPR gRNA sequence
gtggagaaaaaaataattta

SEQ ID NO: 469673 - DNA, 20 bp, Artificial
  CRISPR gRNA sequence
agtgcataactaaaaggaaa

SEQ ID NO: 469674 - DNA, 20 bp, Artificial
  CRISPR gRNA sequence
gtcttaggactttacggaaa

SEQ ID NO: 469675 - DNA, 20 bp, Artificial
  CRISPR gRNA sequence
ataattcaggatatctggtg

SEQ ID NO: 469676 - DNA, 20 bp, Artificial
  CRISPR gRNA sequence
aatttataattaaaagagaa

SEQ ID NO: 469677 - DNA, 20 bp, Artificial
  CRISPR gRNA sequence
ataattaaaagagaagcaga

SEQ ID NO: 469678 - DNA, 20 bp, Artificial
  CRISPR gRNA sequence
aaagtgaaaaggcatgaatg

SEQ ID NO: 469679 - DNA, 20 bp, Artificial
  CRISPR gRNA sequence
tgaagtactattcaagaagt

SEQ ID NO: 469680 - DNA, 20 bp, Artificial
  CRISPR gRNA sequence
caaattgatttcaggggaaa

SEQ ID NO: 469681 - DNA, 20 bp, Artificial
  CRISPR gRNA sequence
cttgctaagtgtgcaggcta

SEQ ID NO: 469682 - DNA, 20 bp, Artificial
  CRISPR gRNA sequence
tgagttttgggggaccaggg

SEQ ID NO: 469683 - DNA, 20 bp, Artificial
  CRISPR gRNA sequence
tcaggtattctgttatacta

SEQ ID NO: 469684 - DNA, 20 bp, Artificial
  CRISPR gRNA sequence
aaatacattctcaagggtgg

SEQ ID NO: 469685 - DNA, 20 bp, Artificial
  CRISPR gRNA sequence
tcaagggtggggagaattac

SEQ ID NO: 469686 - DNA, 20 bp, Artificial
  CRISPR gRNA sequence
cattgatcagttagggtggg

SEQ ID NO: 469687 - DNA, 20 bp, Artificial
  CRISPR gRNA sequence
ctgctagtaaggcttaatta

SEQ ID NO: 469688 - DNA, 20 bp, Artificial
  CRISPR gRNA sequence
tttgtttttatcttttaggg

SEQ ID NO: 469689 - DNA, 20 bp, Artificial
  CRISPR gRNA sequence
tagcaggagatccctttgaa

SEQ ID NO: 469690 - DNA, 20 bp, Artificial
  CRISPR gRNA sequence
cagtttctcaagtgattatg

SEQ ID NO: 469691 - DNA, 20 bp, Artificial
  CRISPR gRNA sequence
tgagtgagatagaggagagt

SEQ ID NO: 469692 - DNA, 20 bp, Artificial
  CRISPR gRNA sequence
ccagagcaaacaggcaagaa

SEQ ID NO: 469693 - DNA, 20 bp, Artificial
  CRISPR gRNA sequence
agaaataaaagatatctaac

SEQ ID NO: 469694 - DNA, 20 bp, Artificial
  CRISPR gRNA sequence
cagatggcatgaacttatgt

SEQ ID NO: 469695 - DNA, 20 bp, Artificial
  CRISPR gRNA sequence
actagcaataaacaatccac

SEQ ID NO: 469696 - DNA, 20 bp, Artificial
  CRISPR gRNA sequence
ataagagttgtacactgaac

SEQ ID NO: 469697 - DNA, 20 bp, Artificial
  CRISPR gRNA sequence
gaacaaagaaagcatggctg

SEQ ID NO: 469698 - DNA, 20 bp, Artificial
  CRISPR gRNA sequence
aagcatggctgaaagaaatt

SEQ ID NO: 469699 - DNA, 20 bp, Artificial
  CRISPR gRNA sequence
aacagctttttgttgctatt

SEQ ID NO: 469700 - DNA, 20 bp, Artificial
  CRISPR gRNA sequence
cacattgagttgcaacagac

SEQ ID NO: 469701 - DNA, 20 bp, Artificial
  CRISPR gRNA sequence
tgacagttaaaaaaaaaaaa

SEQ ID NO: 469702 - DNA, 20 bp, Artificial
  CRISPR gRNA sequence
agacaaagagatcaatgtaa

SEQ ID NO: 469703 - DNA, 20 bp, Artificial
  CRISPR gRNA sequence
atgtaaatagaattgagagt

SEQ ID NO: 469704 - DNA, 20 bp, Artificial
  CRISPR gRNA sequence
accaagattattcagtgggg

SEQ ID NO: 469705 - DNA, 20 bp, Artificial
  CRISPR gRNA sequence
taattggatattcatatgta

SEQ ID NO: 469706 - DNA, 20 bp, Artificial
  CRISPR gRNA sequence
aataaaactctgatttctta

SEQ ID NO: 469707 - DNA, 20 bp, Artificial
  CRISPR gRNA sequence
acttgaatagacatttcatc

SEQ ID NO: 469708 - DNA, 20 bp, Artificial
  CRISPR gRNA sequence
gctcaatgtcattagttact

SEQ ID NO: 469709 - DNA, 20 bp, Artificial
  CRISPR gRNA sequence
acttcacacccatcgaatga

SEQ ID NO: 469710 - DNA, 20 bp, Artificial
  CRISPR gRNA sequence
ctagaataaaaaaaaaaaac

SEQ ID NO: 469711 - DNA, 20 bp, Artificial
  CRISPR gRNA sequence
ataagtgttagcaaggatgt

SEQ ID NO: 469712 - DNA, 20 bp, Artificial
  CRISPR gRNA sequence
gttagcaaggatgtgaagaa

SEQ ID NO: 469713 - DNA, 20 bp, Artificial
  CRISPR gRNA sequence
gaaaccctatccattgctga

SEQ ID NO: 469714 - DNA, 20 bp, Artificial
  CRISPR gRNA sequence
tgtaaaatggtgcagtcact

SEQ ID NO: 469715 - DNA, 20 bp, Artificial
  CRISPR gRNA sequence
ctattcacaatagccaaaag

SEQ ID NO: 469716 - DNA, 20 bp, Artificial
  CRISPR gRNA sequence
aagcattacgctaagtaaaa

SEQ ID NO: 469717 - DNA, 20 bp, Artificial
  CRISPR gRNA sequence
aaataggcaaatccatagag

SEQ ID NO: 469718 - DNA, 20 bp, Artificial
  CRISPR gRNA sequence
ttgccaggggctgaggaaat

SEQ ID NO: 469719 - DNA, 20 bp, Artificial
  CRISPR gRNA sequence
agaagagtgccctttaatta

SEQ ID NO: 469720 - DNA, 20 bp, Artificial
  CRISPR gRNA sequence
acccttaaagttactgggaa

SEQ ID NO: 469721 - DNA, 20 bp, Artificial
  CRISPR gRNA sequence
accctcaattatgaaatata

SEQ ID NO: 469722 - DNA, 20 bp, Artificial
  CRISPR gRNA sequence
atggaatgaacactttctgg

SEQ ID NO: 469723 - DNA, 20 bp, Artificial
  CRISPR gRNA sequence
aaatctgcaaaatattaatt

SEQ ID NO: 469724 - DNA, 20 bp, Artificial
  CRISPR gRNA sequence
gtgaagtatgaagtggtgaa

SEQ ID NO: 469725 - DNA, 20 bp, Artificial
  CRISPR gRNA sequence
tgatcctcatggaaaatccc

SEQ ID NO: 469726 - DNA, 20 bp, Artificial
  CRISPR gRNA sequence
caaaaataacagggagggtc

SEQ ID NO: 469727 - DNA, 20 bp, Artificial
  CRISPR gRNA sequence
gtgaactaagtataaggtga

SEQ ID NO: 469728 - DNA, 20 bp, Artificial
  CRISPR gRNA sequence
ttaaggaccatgcttttcat

SEQ ID NO: 469729 - DNA, 20 bp, Artificial
  CRISPR gRNA sequence
cttgggaaagcactattctc

SEQ ID NO: 469730 - DNA, 20 bp, Artificial
  CRISPR gRNA sequence
aagcactattctcccagaat

SEQ ID NO: 469731 - DNA, 20 bp, Artificial
  CRISPR gRNA sequence
ctactcaggaggctgaagca

SEQ ID NO: 469732 - DNA, 20 bp, Artificial
  CRISPR gRNA sequence
aaaaaaaaaaaaaaaaagaa

SEQ ID NO: 469733 - DNA, 20 bp, Artificial
  CRISPR gRNA sequence
ttttgagtttgttctgaaat

SEQ ID NO: 469734 - DNA, 20 bp, Artificial
  CRISPR gRNA sequence
attaggtttttttggtggtt

SEQ ID NO: 469735 - DNA, 20 bp, Artificial
  CRISPR gRNA sequence
tttgtattagggtatctgtt

SEQ ID NO: 469736 - DNA, 20 bp, Artificial
  CRISPR gRNA sequence
ataacattataatataatta

SEQ ID NO: 469737 - DNA, 20 bp, Artificial
  CRISPR gRNA sequence
gtgagccaccaggccagacc

SEQ ID NO: 469738 - DNA, 20 bp, Artificial
  CRISPR gRNA sequence
tgtatagtgtagggtgttta

SEQ ID NO: 469739 - DNA, 20 bp, Artificial
  CRISPR gRNA sequence
caaggaaaggacattgtgtt

SEQ ID NO: 469740 - DNA, 20 bp, Artificial
  CRISPR gRNA sequence
atgagagttagatactgtaa

SEQ ID NO: 469741 - DNA, 20 bp, Artificial
  CRISPR gRNA sequence
tctgtggaagattaactcta

SEQ ID NO: 469742 - DNA, 20 bp, Artificial
  CRISPR gRNA sequence
aagattaactctatcagaat

SEQ ID NO: 469743 - DNA, 20 bp, Artificial
  CRISPR gRNA sequence
gcagagccacgtctgctcag

SEQ ID NO: 469744 - DNA, 20 bp, Artificial
  CRISPR gRNA sequence
gcatcaatcttaggtttgtg

SEQ ID NO: 469745 - DNA, 20 bp, Artificial
  CRISPR gRNA sequence
actgaagaaccaatgtcccc

SEQ ID NO: 469746 - DNA, 20 bp, Artificial
  CRISPR gRNA sequence
taagtaagagaggaaagcat

SEQ ID NO: 469747 - DNA, 20 bp, Artificial
  CRISPR gRNA sequence
acaccagctacagtgtagct

SEQ ID NO: 469748 - DNA, 20 bp, Artificial
  CRISPR gRNA sequence
cagaaccttctctggattct

SEQ ID NO: 469749 - DNA, 20 bp, Artificial
  CRISPR gRNA sequence
ctggaacctctctcagaact

SEQ ID NO: 469750 - DNA, 20 bp, Artificial
  CRISPR gRNA sequence
gaaggcagtctagatccaag

SEQ ID NO: 469751 - DNA, 20 bp, Artificial
  CRISPR gRNA sequence
aagagagtagggagctgatg

SEQ ID NO: 469752 - DNA, 20 bp, Artificial
  CRISPR gRNA sequence
gtggagatattagaactaaa

SEQ ID NO: 469753 - DNA, 20 bp, Artificial
  CRISPR gRNA sequence
catttcagttgtctagcatt

SEQ ID NO: 469754 - DNA, 20 bp, Artificial
  CRISPR gRNA sequence
aaaactagtttgggaactgt

SEQ ID NO: 469755 - DNA, 20 bp, Artificial
  CRISPR gRNA sequence
aactgtggagaaatcaaagt

SEQ ID NO: 469756 - DNA, 20 bp, Artificial
  CRISPR gRNA sequence
ttaaaaaactgaaatagccc

SEQ ID NO: 469757 - DNA, 20 bp, Artificial
  CRISPR gRNA sequence
gctaataaataactgaagag

SEQ ID NO: 469758 - DNA, 20 bp, Artificial
  CRISPR gRNA sequence
tttggctatatttgaaacgg

SEQ ID NO: 469759 - DNA, 20 bp, Artificial
  CRISPR gRNA sequence
ctactcgggaggctgaggca

SEQ ID NO: 469760 - DNA, 20 bp, Artificial
  CRISPR gRNA sequence
tcaaaaaaaaaaaaaaaaaa

SEQ ID NO: 469761 - DNA, 20 bp, Artificial
  CRISPR gRNA sequence
aaaattcccaagtactgcta

SEQ ID NO: 469762 - DNA, 20 bp, Artificial
  CRISPR gRNA sequence
tttattctaatccatgcctg

SEQ ID NO: 469763 - DNA, 20 bp, Artificial
  CRISPR gRNA sequence
tggaccgaactcaagactgg

SEQ ID NO: 469764 - DNA, 20 bp, Artificial
  CRISPR gRNA sequence
gaaatgtaaaagaagcacca

SEQ ID NO: 469765 - DNA, 20 bp, Artificial
  CRISPR gRNA sequence
tcaaataatatttctcaatt

SEQ ID NO: 469766 - DNA, 20 bp, Artificial
  CRISPR gRNA sequence
tcaatttgagaatttttact

SEQ ID NO: 469767 - DNA, 20 bp, Artificial
  CRISPR gRNA sequence
ataaatgattaaaatttctc

SEQ ID NO: 469768 - DNA, 20 bp, Artificial
  CRISPR gRNA sequence
actggttgacatcatgagta

SEQ ID NO: 469769 - DNA, 20 bp, Artificial
  CRISPR gRNA sequence
ttcaagtcagtcttccaaaa

SEQ ID NO: 469770 - DNA, 20 bp, Artificial
  CRISPR gRNA sequence
aaatttttgctgtgtcagtc

SEQ ID NO: 469771 - DNA, 20 bp, Artificial
  CRISPR gRNA sequence
tggtgtttcttaaatgcaaa

SEQ ID NO: 469772 - DNA, 20 bp, Artificial
  CRISPR gRNA sequence
aaatcattttaggcttgatg

SEQ ID NO: 469773 - DNA, 20 bp, Artificial
  CRISPR gRNA sequence
ataaatggtgcaataaaaat

SEQ ID NO: 469774 - DNA, 20 bp, Artificial
  CRISPR gRNA sequence
ctgaatagtttaaaagttag

SEQ ID NO: 469775 - DNA, 20 bp, Artificial
  CRISPR gRNA sequence
ttaatggaatggaggaaaac

SEQ ID NO: 469776 - DNA, 20 bp, Artificial
  CRISPR gRNA sequence
gttaggtggggtgggtgaca

SEQ ID NO: 469777 - DNA, 20 bp, Artificial
  CRISPR gRNA sequence
gtgacaacagaaatggtgca

SEQ ID NO: 469778 - DNA, 20 bp, Artificial
  CRISPR gRNA sequence
actagagtaaatgggtcatt

SEQ ID NO: 469779 - DNA, 20 bp, Artificial
  CRISPR gRNA sequence
aatatgtgaaattatggagt

SEQ ID NO: 469780 - DNA, 20 bp, Artificial
  CRISPR gRNA sequence
tgttattttgccaattacac

SEQ ID NO: 469781 - DNA, 20 bp, Artificial
  CRISPR gRNA sequence
gcatttgtggacaacttatg

SEQ ID NO: 469782 - DNA, 20 bp, Artificial
  CRISPR gRNA sequence
acttatgtaagaaagacatg

SEQ ID NO: 469783 - DNA, 20 bp, Artificial
  CRISPR gRNA sequence
tgcttgtggtattcttaaaa

SEQ ID NO: 469784 - DNA, 20 bp, Artificial
  CRISPR gRNA sequence
tcattagtttatagagggtt

SEQ ID NO: 469785 - DNA, 20 bp, Artificial
  CRISPR gRNA sequence
gtttatagagggtttgagaa

SEQ ID NO: 469786 - DNA, 20 bp, Artificial
  CRISPR gRNA sequence
cccaaaatgtgtggacatga

SEQ ID NO: 469787 - DNA, 20 bp, Artificial
  CRISPR gRNA sequence
tcacaagcttaaaatttgtg

SEQ ID NO: 469788 - DNA, 20 bp, Artificial
  CRISPR gRNA sequence
acaccattttgaaaaggaat

SEQ ID NO: 469789 - DNA, 20 bp, Artificial
  CRISPR gRNA sequence
gtccacaaatgcagcctggc

SEQ ID NO: 469790 - DNA, 20 bp, Artificial
  CRISPR gRNA sequence
cacccccaaatctaaggagc

SEQ ID NO: 469791 - DNA, 20 bp, Artificial
  CRISPR gRNA sequence
ttaagaaaatctctccacca

SEQ ID NO: 469792 - DNA, 20 bp, Artificial
  CRISPR gRNA sequence
aaaagcaaaaaatatcctat

SEQ ID NO: 469793 - DNA, 20 bp, Artificial
  CRISPR gRNA sequence
ataaagcttagaaaaagttc

SEQ ID NO: 469794 - DNA, 20 bp, Artificial
  CRISPR gRNA sequence
taagaaagaggtgaatttgt

SEQ ID NO: 469795 - DNA, 20 bp, Artificial
  CRISPR gRNA sequence
ttcaaattcctgttaatagc

SEQ ID NO: 469796 - DNA, 20 bp, Artificial
  CRISPR gRNA sequence
tgttaatagcaaaaacgctt

SEQ ID NO: 469797 - DNA, 20 bp, Artificial
  CRISPR gRNA sequence
cagtgcctactgatgctaat

SEQ ID NO: 469798 - DNA, 20 bp, Artificial
  CRISPR gRNA sequence
tacactgtagctggtgttgt

SEQ ID NO: 469799 - DNA, 20 bp, Artificial
  CRISPR gRNA sequence
aggagaagaaaaaggaaaga

SEQ ID NO: 469800 - DNA, 20 bp, Artificial
  CRISPR gRNA sequence
tggtttacaggattgggaaa

SEQ ID NO: 469801 - DNA, 20 bp, Artificial
  CRISPR gRNA sequence
catattcatcacttaagtag

SEQ ID NO: 469802 - DNA, 20 bp, Artificial
  CRISPR gRNA sequence
gcaacccccacttagtgcaa

SEQ ID NO: 469803 - DNA, 20 bp, Artificial
  CRISPR gRNA sequence
gttatttctttaaccaccaa

SEQ ID NO: 469804 - DNA, 20 bp, Artificial
  CRISPR gRNA sequence
acttgattagtttgatcaaa

SEQ ID NO: 469805 - DNA, 20 bp, Artificial
  CRISPR gRNA sequence
tctctatttcagaacaaact

SEQ ID NO: 469806 - DNA, 20 bp, Artificial
  CRISPR gRNA sequence
agggtgtactctcacgtgtc

SEQ ID NO: 469807 - DNA, 20 bp, Artificial
  CRISPR gRNA sequence
agcaaaagaaagtcacttat

SEQ ID NO: 469808 - DNA, 20 bp, Artificial
  CRISPR gRNA sequence
acttcacatactttgttcca

SEQ ID NO: 469809 - DNA, 20 bp, Artificial
  CRISPR gRNA sequence
gcttttgtaatcatagctaa

SEQ ID NO: 469810 - DNA, 20 bp, Artificial
  CRISPR gRNA sequence
aaatgggaaaaagagaaaaa

SEQ ID NO: 469811 - DNA, 20 bp, Artificial
  CRISPR gRNA sequence
attttataatccctaaagtc

SEQ ID NO: 469812 - DNA, 20 bp, Artificial
  CRISPR gRNA sequence
tgattctttccctaaaagat

SEQ ID NO: 469813 - DNA, 20 bp, Artificial
  CRISPR gRNA sequence
ctttccctaaaagataaaaa

SEQ ID NO: 469814 - DNA, 20 bp, Artificial
  CRISPR gRNA sequence
agcattatttggtaattttc

SEQ ID NO: 469815 - DNA, 20 bp, Artificial
  CRISPR gRNA sequence
tgagatccaccccctgcccc

SEQ ID NO: 469816 - DNA, 20 bp, Artificial
  CRISPR gRNA sequence
cttaactccactgcctatcc

SEQ ID NO: 469817 - DNA, 20 bp, Artificial
  CRISPR gRNA sequence
ctcttaaaggttccacctca

SEQ ID NO: 469818 - DNA, 20 bp, Artificial
  CRISPR gRNA sequence
gcattctgcccctggtcccc

SEQ ID NO: 469819 - DNA, 20 bp, Artificial
  CRISPR gRNA sequence
aatttattgcagaatcaatt

SEQ ID NO: 469820 - DNA, 20 bp, Artificial
  CRISPR gRNA sequence
ccaactatgatcatgtaaat

SEQ ID NO: 469821 - DNA, 20 bp, Artificial
  CRISPR gRNA sequence
taacagttcctaagtaagtc

SEQ ID NO: 469822 - DNA, 20 bp, Artificial
  CRISPR gRNA sequence
agtgtaacagagatgatagc

SEQ ID NO: 469823 - DNA, 20 bp, Artificial
  CRISPR gRNA sequence
ctttcactcacatcctactt

SEQ ID NO: 469824 - DNA, 20 bp, Artificial
  CRISPR gRNA sequence
aagtctgtgctagaattata

SEQ ID NO: 469825 - DNA, 20 bp, Artificial
  CRISPR gRNA sequence
aatacatgcagtaaaagaat

SEQ ID NO: 469826 - DNA, 20 bp, Artificial
  CRISPR gRNA sequence
ccccgtctctactaaaaata

SEQ ID NO: 469827 - DNA, 20 bp, Artificial
  CRISPR gRNA sequence
cagagcgagagtccatctca

SEQ ID NO: 469828 - DNA, 20 bp, Artificial
  CRISPR gRNA sequence
caaaccaacaaacaaagaat

SEQ ID NO: 469829 - DNA, 20 bp, Artificial
  CRISPR gRNA sequence
ttcatgtttaaaatttttat

SEQ ID NO: 469830 - DNA, 20 bp, Artificial
  CRISPR gRNA sequence
tttcagaaataatcatgaga

SEQ ID NO: 469831 - DNA, 20 bp, Artificial
  CRISPR gRNA sequence
cttgtgctgaacttcatgta

SEQ ID NO: 469832 - DNA, 20 bp, Artificial
  CRISPR gRNA sequence
aactaataaatggattgtat

SEQ ID NO: 469833 - DNA, 20 bp, Artificial
  CRISPR gRNA sequence
ttattttctaaagttagttt

SEQ ID NO: 469834 - DNA, 20 bp, Artificial
  CRISPR gRNA sequence
tgaagtttacatatatatca

SEQ ID NO: 469835 - DNA, 20 bp, Artificial
  CRISPR gRNA sequence
cagacaaacaacaagcaaac

SEQ ID NO: 469836 - DNA, 20 bp, Artificial
  CRISPR gRNA sequence
aaatcacacggacgacatca

SEQ ID NO: 469837 - DNA, 20 bp, Artificial
  CRISPR gRNA sequence
gtgactattgttactttaag

SEQ ID NO: 469838 - DNA, 20 bp, Artificial
  CRISPR gRNA sequence
attgttctcacgagtacagt

SEQ ID NO: 469839 - DNA, 20 bp, Artificial
  CRISPR gRNA sequence
atttacatatgtctttcctg

SEQ ID NO: 469840 - DNA, 20 bp, Artificial
  CRISPR gRNA sequence
cttaaaaatccccttcttat

SEQ ID NO: 469841 - DNA, 20 bp, Artificial
  CRISPR gRNA sequence
ccagcaaggcttgccttggt

SEQ ID NO: 469842 - DNA, 20 bp, Artificial
  CRISPR gRNA sequence
gtcaaaactagaatattgaa

SEQ ID NO: 469843 - DNA, 20 bp, Artificial
  CRISPR gRNA sequence
cttaaataagtttacaagaa

SEQ ID NO: 469844 - DNA, 20 bp, Artificial
  CRISPR gRNA sequence
atggtcagagaaatgtaaat

SEQ ID NO: 469845 - DNA, 20 bp, Artificial
  CRISPR gRNA sequence
agcaaactaacacaggaaca

SEQ ID NO: 469846 - DNA, 20 bp, Artificial
  CRISPR gRNA sequence
tctcccatttttttagatga

SEQ ID NO: 469847 - DNA, 20 bp, Artificial
  CRISPR gRNA sequence
aaccagagattttatagtca

SEQ ID NO: 469848 - DNA, 20 bp, Artificial
  CRISPR gRNA sequence
acagaggaagcaagaaattt

SEQ ID NO: 469849 - DNA, 20 bp, Artificial
  CRISPR gRNA sequence
cttataaagatactgtgcta

SEQ ID NO: 469850 - DNA, 20 bp, Artificial
  CRISPR gRNA sequence
atggccagtttgtagtagag

SEQ ID NO: 469851 - DNA, 20 bp, Artificial
  CRISPR gRNA sequence
tttattttatttttaacttt

SEQ ID NO: 469852 - DNA, 20 bp, Artificial
  CRISPR gRNA sequence
actattttaaataataatgt

SEQ ID NO: 469853 - DNA, 20 bp, Artificial
  CRISPR gRNA sequence
gaataataagacagaatatt

SEQ ID NO: 469854 - DNA, 20 bp, Artificial
  CRISPR gRNA sequence
tagcttggctgactttctta

SEQ ID NO: 469855 - DNA, 20 bp, Artificial
  CRISPR gRNA sequence
tccagcctgggtgacgagag

SEQ ID NO: 469856 - DNA, 20 bp, Artificial
  CRISPR gRNA sequence
gtctcaaaaaaataaaaaaa

SEQ ID NO: 469857 - DNA, 20 bp, Artificial
  CRISPR gRNA sequence
ctccaagaccccctgagaaa

SEQ ID NO: 469858 - DNA, 20 bp, Artificial
  CRISPR gRNA sequence
cctgcacatatcagtgatgg

SEQ ID NO: 469859 - DNA, 20 bp, Artificial
  CRISPR gRNA sequence
cactgaacattgagtgcagg

SEQ ID NO: 469860 - DNA, 20 bp, Artificial
  CRISPR gRNA sequence
gaaaaacctcaacctggggc

SEQ ID NO: 469861 - DNA, 20 bp, Artificial
  CRISPR gRNA sequence
cagccaacctgacaagaagc

SEQ ID NO: 469862 - DNA, 20 bp, Artificial
  CRISPR gRNA sequence
atagcttggctgactttctt

SEQ ID NO: 469863 - DNA, 20 bp, Artificial
  CRISPR gRNA sequence
gagctgatggctccatttct

SEQ ID NO: 469864 - DNA, 20 bp, Artificial
  CRISPR gRNA sequence
ctctattgtaaagttgacgt

SEQ ID NO: 469865 - DNA, 20 bp, Artificial
  CRISPR gRNA sequence
tattaagtgaattaattctg

SEQ ID NO: 469866 - DNA, 20 bp, Artificial
  CRISPR gRNA sequence
ctttatttcttctaaaaaag

SEQ ID NO: 469867 - DNA, 20 bp, Artificial
  CRISPR gRNA sequence
gtgagactctgtctccaaaa

SEQ ID NO: 469868 - DNA, 20 bp, Artificial
  CRISPR gRNA sequence
gagtgttagatcagtcccag

SEQ ID NO: 469869 - DNA, 20 bp, Artificial
  CRISPR gRNA sequence
ataattacatgttgaccaac

SEQ ID NO: 469870 - DNA, 20 bp, Artificial
  CRISPR gRNA sequence
tccctaaattcatcctatca

SEQ ID NO: 469871 - DNA, 20 bp, Artificial
  CRISPR gRNA sequence
ctagaatgactgattttaga

SEQ ID NO: 469872 - DNA, 20 bp, Artificial
  CRISPR gRNA sequence
ctcatgataatggttataat

SEQ ID NO: 469873 - DNA, 20 bp, Artificial
  CRISPR gRNA sequence
gaccatcctggttaaccggg

SEQ ID NO: 469874 - DNA, 20 bp, Artificial
  CRISPR gRNA sequence
aaaaaaaaaaaaagaaaaaa

SEQ ID NO: 469875 - DNA, 20 bp, Artificial
  CRISPR gRNA sequence
ccattgtctgtattgaattt

SEQ ID NO: 469876 - DNA, 20 bp, Artificial
  CRISPR gRNA sequence
ttttatttgtgtttaaaatt

SEQ ID NO: 469877 - DNA, 20 bp, Artificial
  CRISPR gRNA sequence
aaatttttttaatgttgttt

SEQ ID NO: 469878 - DNA, 20 bp, Artificial
  CRISPR gRNA sequence
ttaaaactaactttagaaaa

SEQ ID NO: 469879 - DNA, 20 bp, Artificial
  CRISPR gRNA sequence
tttttgtattttaatttttt

SEQ ID NO: 469880 - DNA, 20 bp, Artificial
  CRISPR gRNA sequence
atcagatatgaatgcttgag

SEQ ID NO: 469881 - DNA, 20 bp, Artificial
  CRISPR gRNA sequence
tccagcctgggcaacaagag

SEQ ID NO: 469882 - DNA, 20 bp, Artificial
  CRISPR gRNA sequence
ttgaagaaactgaggaccag

SEQ ID NO: 469883 - DNA, 20 bp, Artificial
  CRISPR gRNA sequence
gtctccatatcactaagtca

SEQ ID NO: 469884 - DNA, 20 bp, Artificial
  CRISPR gRNA sequence
ccctttctcttcattttttt

SEQ ID NO: 469885 - DNA, 20 bp, Artificial
  CRISPR gRNA sequence
tgctaagagagacggtagtt

SEQ ID NO: 469886 - DNA, 20 bp, Artificial
  CRISPR gRNA sequence
gaattgattctgcaataaat

SEQ ID NO: 469887 - DNA, 20 bp, Artificial
  CRISPR gRNA sequence
ctacagagccatgagccaaa

SEQ ID NO: 469888 - DNA, 20 bp, Artificial
  CRISPR gRNA sequence
ggtattctgttatactagca

SEQ ID NO: 469889 - DNA, 20 bp, Artificial
  CRISPR gRNA sequence
gctcaatggaacaacatgtg

SEQ ID NO: 469890 - DNA, 20 bp, Artificial
  CRISPR gRNA sequence
gttcacagtttgtttagagg

SEQ ID NO: 469891 - DNA, 20 bp, Artificial
  CRISPR gRNA sequence
cttggggaaaccaagctgaa

SEQ ID NO: 469892 - DNA, 20 bp, Artificial
  CRISPR gRNA sequence
ctaacttagaaaaaaagaag

SEQ ID NO: 469893 - DNA, 20 bp, Artificial
  CRISPR gRNA sequence
aaaattcttaaaaatttgtt

SEQ ID NO: 469894 - DNA, 20 bp, Artificial
  CRISPR gRNA sequence
tgcaacagacccagaattgc

SEQ ID NO: 469895 - DNA, 20 bp, Artificial
  CRISPR gRNA sequence
aaaacaatcttgaaaaagaa

SEQ ID NO: 469896 - DNA, 20 bp, Artificial
  CRISPR gRNA sequence
aagctaagacttccctattt

SEQ ID NO: 469897 - DNA, 20 bp, Artificial
  CRISPR gRNA sequence
agacatttaagtagaagagc

SEQ ID NO: 469898 - DNA, 20 bp, Artificial
  CRISPR gRNA sequence
agtagaagagctaaaactat

SEQ ID NO: 469899 - DNA, 20 bp, Artificial
  CRISPR gRNA sequence
actataaaaactgcattata

SEQ ID NO: 469900 - DNA, 20 bp, Artificial
  CRISPR gRNA sequence
aactgcattatataaaacaa

SEQ ID NO: 469901 - DNA, 20 bp, Artificial
  CRISPR gRNA sequence
aaaactctgatttcttagga

SEQ ID NO: 469902 - DNA, 20 bp, Artificial
  CRISPR gRNA sequence
atgcaaatcaaagtcacagt

SEQ ID NO: 469903 - DNA, 20 bp, Artificial
  CRISPR gRNA sequence
gaatgactagaataaaaaaa

SEQ ID NO: 469904 - DNA, 20 bp, Artificial
  CRISPR gRNA sequence
agttcctcaaaatcaaaaga

SEQ ID NO: 469905 - DNA, 20 bp, Artificial
  CRISPR gRNA sequence
aattaaaatatatgttcaca

SEQ ID NO: 469906 - DNA, 20 bp, Artificial
  CRISPR gRNA sequence
ctagatcgtagtcacgtttg

SEQ ID NO: 469907 - DNA, 20 bp, Artificial
  CRISPR gRNA sequence
atttaaactctgtgtggatt

SEQ ID NO: 469908 - DNA, 20 bp, Artificial
  CRISPR gRNA sequence
tttttctttagtgaagtggt

SEQ ID NO: 469909 - DNA, 20 bp, Artificial
  CRISPR gRNA sequence
aactgtaacccaaaattaaa

SEQ ID NO: 469910 - DNA, 20 bp, Artificial
  CRISPR gRNA sequence
ggcaaagcaaattaacaagc

SEQ ID NO: 469911 - DNA, 20 bp, Artificial
  CRISPR gRNA sequence
gcattctgaagctctctaat

SEQ ID NO: 469912 - DNA, 20 bp, Artificial
  CRISPR gRNA sequence
taaataatttactgtgcaag

SEQ ID NO: 469913 - DNA, 20 bp, Artificial
  CRISPR gRNA sequence
gggctaaatatttcttaaca

SEQ ID NO: 469914 - DNA, 20 bp, Artificial
  CRISPR gRNA sequence
ccaaagctctgatcttaatc

SEQ ID NO: 469915 - DNA, 20 bp, Artificial
  CRISPR gRNA sequence
gtataaagtgcttgcctaat

SEQ ID NO: 469916 - DNA, 20 bp, Artificial
  CRISPR gRNA sequence
caagaacggaaatcgatggg

SEQ ID NO: 469917 - DNA, 20 bp, Artificial
  CRISPR gRNA sequence
atgggcaaaacttgaattta

SEQ ID NO: 469918 - DNA, 20 bp, Artificial
  CRISPR gRNA sequence
aataaataactgaagagtga

SEQ ID NO: 469919 - DNA, 20 bp, Artificial
  CRISPR gRNA sequence
ttttctaagctttatctttc

SEQ ID NO: 469920 - DNA, 20 bp, Artificial
  CRISPR gRNA sequence
ccatggccgtaagtgtcact

SEQ ID NO: 469921 - DNA, 20 bp, Artificial
  CRISPR gRNA sequence
attctaatccatgcctggaa

SEQ ID NO: 469922 - DNA, 20 bp, Artificial
  CRISPR gRNA sequence
cttgaataacaaaatctctc

SEQ ID NO: 469923 - DNA, 20 bp, Artificial
  CRISPR gRNA sequence
tcagttcactacacactctt

SEQ ID NO: 469924 - DNA, 20 bp, Artificial
  CRISPR gRNA sequence
gtgcaattaatggaatggag

SEQ ID NO: 469925 - DNA, 20 bp, Artificial
  CRISPR gRNA sequence
ggggtatatatacaaaaaga

SEQ ID NO: 469926 - DNA, 20 bp, Artificial
  CRISPR gRNA sequence
caatgagaaggtaaagttat

SEQ ID NO: 469927 - DNA, 20 bp, Artificial
  CRISPR gRNA sequence
agcaagttattcgggtcgct

SEQ ID NO: 469928 - DNA, 20 bp, Artificial
  CRISPR gRNA sequence
gcaagttattcgggtcgctt

SEQ ID NO: 469929 - DNA, 20 bp, Artificial
  CRISPR gRNA sequence
ttcgggtcgcttttatgtgt

SEQ ID NO: 469930 - DNA, 20 bp, Artificial
  CRISPR gRNA sequence
gggtcgcttttatgtgtcag

SEQ ID NO: 469931 - DNA, 20 bp, Artificial
  CRISPR gRNA sequence
ttatgtgtcagggggtttaa

SEQ ID NO: 469932 - DNA, 20 bp, Artificial
  CRISPR gRNA sequence
tatgtgtcagggggtttaag

SEQ ID NO: 469933 - DNA, 20 bp, Artificial
  CRISPR gRNA sequence
atgtgtcagggggtttaaga

SEQ ID NO: 469934 - DNA, 20 bp, Artificial
  CRISPR gRNA sequence
tgtgtcagggggtttaagaa

SEQ ID NO: 469935 - DNA, 20 bp, Artificial
  CRISPR gRNA sequence
aagaatcagtattctattca

SEQ ID NO: 469936 - DNA, 20 bp, Artificial
  CRISPR gRNA sequence
agaatcagtattctattcat

SEQ ID NO: 469937 - DNA, 20 bp, Artificial
  CRISPR gRNA sequence
tattcatgtccacacatttt

SEQ ID NO: 469938 - DNA, 20 bp, Artificial
  CRISPR gRNA sequence
ttcatgtccacacattttgg

SEQ ID NO: 469939 - DNA, 20 bp, Artificial
  CRISPR gRNA sequence
atgtccacacattttggggt

SEQ ID NO: 469940 - DNA, 20 bp, Artificial
  CRISPR gRNA sequence
tggggtacaaaatcagatgc

SEQ ID NO: 469941 - DNA, 20 bp, Artificial
  CRISPR gRNA sequence
ggggtacaaaatcagatgcc

SEQ ID NO: 469942 - DNA, 20 bp, Artificial
  CRISPR gRNA sequence
gggtacaaaatcagatgcca

SEQ ID NO: 469943 - DNA, 20 bp, Artificial
  CRISPR gRNA sequence
atttcaaataagttttaata

SEQ ID NO: 469944 - DNA, 20 bp, Artificial
  CRISPR gRNA sequence
caaataagttttaataactt

SEQ ID NO: 469945 - DNA, 20 bp, Artificial
  CRISPR gRNA sequence
aaataagttttaataacttt

SEQ ID NO: 469946 - DNA, 20 bp, Artificial
  CRISPR gRNA sequence
taataactttaccttctcat

SEQ ID NO: 469947 - DNA, 20 bp, Artificial
  CRISPR gRNA sequence
aataactttaccttctcatt

SEQ ID NO: 469948 - DNA, 20 bp, Artificial
  CRISPR gRNA sequence
ataactttaccttctcattg

SEQ ID NO: 469949 - DNA, 20 bp, Artificial
  CRISPR gRNA sequence
taccttctcattgagcacaa

SEQ ID NO: 469950 - DNA, 20 bp, Artificial
  CRISPR gRNA sequence
accttctcattgagcacaat

SEQ ID NO: 469951 - DNA, 20 bp, Artificial
  CRISPR gRNA sequence
ccttctcattgagcacaatc

SEQ ID NO: 469952 - DNA, 20 bp, Artificial
  CRISPR gRNA sequence
ctcattgagcacaatcacaa

SEQ ID NO: 469953 - DNA, 20 bp, Artificial
  CRISPR gRNA sequence
tcattgagcacaatcacaag

SEQ ID NO: 469954 - DNA, 20 bp, Artificial
  CRISPR gRNA sequence
attgagcacaatcacaagct

SEQ ID NO: 469955 - DNA, 20 bp, Artificial
  CRISPR gRNA sequence
agcacaatcacaagcttaaa

SEQ ID NO: 469956 - DNA, 20 bp, Artificial
  CRISPR gRNA sequence
aaaatttgtgaaaaaccatt

SEQ ID NO: 469957 - DNA, 20 bp, Artificial
  CRISPR gRNA sequence
aaatttgtgaaaaaccatta

SEQ ID NO: 469958 - DNA, 20 bp, Artificial
  CRISPR gRNA sequence
gtgaaaaaccattaaattat

SEQ ID NO: 469959 - DNA, 20 bp, Artificial
  CRISPR gRNA sequence
tgaaaaaccattaaattatc

SEQ ID NO: 469960 - DNA, 20 bp, Artificial
  CRISPR gRNA sequence
aattatctacatattctttt

SEQ ID NO: 469961 - DNA, 20 bp, Artificial
  CRISPR gRNA sequence
tctacatattctttttctca

SEQ ID NO: 469962 - DNA, 20 bp, Artificial
  CRISPR gRNA sequence
catattctttttctcaaacc

SEQ ID NO: 469963 - DNA, 20 bp, Artificial
  CRISPR gRNA sequence
tttttctcaaaccctctata

SEQ ID NO: 469964 - DNA, 20 bp, Artificial
  CRISPR gRNA sequence
tttctcaaaccctctataaa

SEQ ID NO: 469965 - DNA, 20 bp, Artificial
  CRISPR gRNA sequence
ttctcaaaccctctataaac

SEQ ID NO: 469966 - DNA, 20 bp, Artificial
  CRISPR gRNA sequence
tctcaaaccctctataaact

SEQ ID NO: 469967 - DNA, 20 bp, Artificial
  CRISPR gRNA sequence
ctcaaaccctctataaacta

SEQ ID NO: 469968 - DNA, 20 bp, Artificial
  CRISPR gRNA sequence
tcaaaccctctataaactaa

SEQ ID NO: 469969 - DNA, 20 bp, Artificial
  CRISPR gRNA sequence
aaaccctctataaactaatg

SEQ ID NO: 469970 - DNA, 20 bp, Artificial
  CRISPR gRNA sequence
tataaactaatgaaataagc

SEQ ID NO: 469971 - DNA, 20 bp, Artificial
  CRISPR gRNA sequence
taaactaatgaaataagcca

SEQ ID NO: 469972 - DNA, 20 bp, Artificial
  CRISPR gRNA sequence
atgaaataagccatgtaaat

SEQ ID NO: 469973 - DNA, 20 bp, Artificial
  CRISPR gRNA sequence
gggaaaatgcatgtatgtct

SEQ ID NO: 469974 - DNA, 20 bp, Artificial
  CRISPR gRNA sequence
ggaaaatgcatgtatgtctc

SEQ ID NO: 469975 - DNA, 20 bp, Artificial
  CRISPR gRNA sequence
tgacaccattttgaaaagga

SEQ ID NO: 469976 - DNA, 20 bp, Artificial
  CRISPR gRNA sequence
acaccattttgaaaaggaat

SEQ ID NO: 469977 - DNA, 20 bp, Artificial
  CRISPR gRNA sequence
tgaaaaggaataaaaacata

SEQ ID NO: 469978 - DNA, 20 bp, Artificial
  CRISPR gRNA sequence
gaaaaggaataaaaacataa

SEQ ID NO: 469979 - DNA, 20 bp, Artificial
  CRISPR gRNA sequence
aaaaggaataaaaacataaa

SEQ ID NO: 469980 - DNA, 20 bp, Artificial
  CRISPR gRNA sequence
gtgattttggcaaacagtac

SEQ ID NO: 469981 - DNA, 20 bp, Artificial
  CRISPR gRNA sequence
tgattttggcaaacagtaca

SEQ ID NO: 469982 - DNA, 20 bp, Artificial
  CRISPR gRNA sequence
tggcaaacagtacaaatata

SEQ ID NO: 469983 - DNA, 20 bp, Artificial
  CRISPR gRNA sequence
ggcaaacagtacaaatatat

SEQ ID NO: 469984 - DNA, 20 bp, Artificial
  CRISPR gRNA sequence
gcaaacagtacaaatatatt

SEQ ID NO: 469985 - DNA, 20 bp, Artificial
  CRISPR gRNA sequence
atacatcttagagatgaaat

SEQ ID NO: 469986 - DNA, 20 bp, Artificial
  CRISPR gRNA sequence
agagatgaaatcattatcag

SEQ ID NO: 469987 - DNA, 20 bp, Artificial
  CRISPR gRNA sequence
gagatgaaatcattatcagc

SEQ ID NO: 469988 - DNA, 20 bp, Artificial
  CRISPR gRNA sequence
tcagcattatctttactata

SEQ ID NO: 469989 - DNA, 20 bp, Artificial
  CRISPR gRNA sequence
tctttactataagacatact

SEQ ID NO: 469990 - DNA, 20 bp, Artificial
  CRISPR gRNA sequence
tactataagacatactaagg

SEQ ID NO: 469991 - DNA, 20 bp, Artificial
  CRISPR gRNA sequence
actataagacatactaagga

SEQ ID NO: 469992 - DNA, 20 bp, Artificial
  CRISPR gRNA sequence
ctataagacatactaaggat

SEQ ID NO: 469993 - DNA, 20 bp, Artificial
  CRISPR gRNA sequence
taagacatactaaggatatt

SEQ ID NO: 469994 - DNA, 20 bp, Artificial
  CRISPR gRNA sequence
aggatattttaaataagaca

SEQ ID NO: 469995 - DNA, 20 bp, Artificial
  CRISPR gRNA sequence
taaataagacagaaatattt

SEQ ID NO: 469996 - DNA, 20 bp, Artificial
  CRISPR gRNA sequence
aaataagacagaaatatttt

SEQ ID NO: 469997 - DNA, 20 bp, Artificial
  CRISPR gRNA sequence
aataagacagaaatattttg

SEQ ID NO: 469998 - DNA, 20 bp, Artificial
  CRISPR gRNA sequence
tgcttttaagtttgagagaa

SEQ ID NO: 469999 - DNA, 20 bp, Artificial
  CRISPR gRNA sequence
gcttttaagtttgagagaat

SEQ ID NO: 470000 - DNA, 20 bp, Artificial
  CRISPR gRNA sequence
cttttaagtttgagagaatc

SEQ ID NO: 470001 - DNA, 20 bp, Artificial
  CRISPR gRNA sequence
ttaagtttgagagaatcatg

SEQ ID NO: 470002 - DNA, 20 bp, Artificial
  CRISPR gRNA sequence
taagtttgagagaatcatga

SEQ ID NO: 470003 - DNA, 20 bp, Artificial
  CRISPR gRNA sequence
aagtttgagagaatcatgaa

SEQ ID NO: 470004 - DNA, 20 bp, Artificial
  CRISPR gRNA sequence
agtttgagagaatcatgaag

SEQ ID NO: 470005 - DNA, 20 bp, Artificial
  CRISPR gRNA sequence
gagagaatcatgaaggaact

SEQ ID NO: 470006 - DNA, 20 bp, Artificial
  CRISPR gRNA sequence
agagaatcatgaaggaactg

SEQ ID NO: 470007 - DNA, 20 bp, Artificial
  CRISPR gRNA sequence
ttcaatttcgtgtgttcatc

SEQ ID NO: 470008 - DNA, 20 bp, Artificial
  CRISPR gRNA sequence
aatttcgtgtgttcatctga

SEQ ID NO: 470009 - DNA, 20 bp, Artificial
  CRISPR gRNA sequence
cgtgtgttcatctgataaga

SEQ ID NO: 470010 - DNA, 20 bp, Artificial
  CRISPR gRNA sequence
gtgtgttcatctgataagag

SEQ ID NO: 470011 - DNA, 20 bp, Artificial
  CRISPR gRNA sequence
atctgataagaggacagcta

SEQ ID NO: 470012 - DNA, 20 bp, Artificial
  CRISPR gRNA sequence
ataagaggacagctaaatgt

SEQ ID NO: 470013 - DNA, 20 bp, Artificial
  CRISPR gRNA sequence
aatgtatcctccccatattt

SEQ ID NO: 470014 - DNA, 20 bp, Artificial
  CRISPR gRNA sequence
cccatatttcctgtttctat

SEQ ID NO: 470015 - DNA, 20 bp, Artificial
  CRISPR gRNA sequence
cctgtttctatttttaagaa

SEQ ID NO: 470016 - DNA, 20 bp, Artificial
  CRISPR gRNA sequence
ctgtttctatttttaagaat

SEQ ID NO: 470017 - DNA, 20 bp, Artificial
  CRISPR gRNA sequence
tttctatttttaagaatacc

SEQ ID NO: 470018 - DNA, 20 bp, Artificial
  CRISPR gRNA sequence
ctatttttaagaataccaca

SEQ ID NO: 470019 - DNA, 20 bp, Artificial
  CRISPR gRNA sequence
tatttttaagaataccacaa

SEQ ID NO: 470020 - DNA, 20 bp, Artificial
  CRISPR gRNA sequence
tttttaagaataccacaagc

SEQ ID NO: 470021 - DNA, 20 bp, Artificial
  CRISPR gRNA sequence
ttaagaataccacaagcagc

SEQ ID NO: 470022 - DNA, 20 bp, Artificial
  CRISPR gRNA sequence
taagaataccacaagcagct

SEQ ID NO: 470023 - DNA, 20 bp, Artificial
  CRISPR gRNA sequence
aagaataccacaagcagcta

SEQ ID NO: 470024 - DNA, 20 bp, Artificial
  CRISPR gRNA sequence
agaataccacaagcagctat

SEQ ID NO: 470025 - DNA, 20 bp, Artificial
  CRISPR gRNA sequence
ttctaacatgtctttcttac

SEQ ID NO: 470026 - DNA, 20 bp, Artificial
  CRISPR gRNA sequence
taacatgtctttcttacata

SEQ ID NO: 470027 - DNA, 20 bp, Artificial
  CRISPR gRNA sequence
acatgtctttcttacataag

SEQ ID NO: 470028 - DNA, 20 bp, Artificial
  CRISPR gRNA sequence
tcttacataagttgtccaca

SEQ ID NO: 470029 - DNA, 20 bp, Artificial
  CRISPR gRNA sequence
cttacataagttgtccacaa

SEQ ID NO: 470030 - DNA, 20 bp, Artificial
  CRISPR gRNA sequence
ttacataagttgtccacaaa

SEQ ID NO: 470031 - DNA, 20 bp, Artificial
  CRISPR gRNA sequence
acataagttgtccacaaatg

SEQ ID NO: 470032 - DNA, 20 bp, Artificial
  CRISPR gRNA sequence
cataagttgtccacaaatgc

SEQ ID NO: 470033 - DNA, 20 bp, Artificial
  CRISPR gRNA sequence
tccacaaatgcagcctggct

SEQ ID NO: 470034 - DNA, 20 bp, Artificial
  CRISPR gRNA sequence
gctaaaacagcctatctcga

SEQ ID NO: 470035 - DNA, 20 bp, Artificial
  CRISPR gRNA sequence
aaacagcctatctcgaattg

SEQ ID NO: 470036 - DNA, 20 bp, Artificial
  CRISPR gRNA sequence
tctcgaattggttgcttgaa

SEQ ID NO: 470037 - DNA, 20 bp, Artificial
  CRISPR gRNA sequence
gaattggttgcttgaaattc

SEQ ID NO: 470038 - DNA, 20 bp, Artificial
  CRISPR gRNA sequence
gttgcttgaaattctaggtg

SEQ ID NO: 470039 - DNA, 20 bp, Artificial
  CRISPR gRNA sequence
cttgaaattctaggtgtaat

SEQ ID NO: 470040 - DNA, 20 bp, Artificial
  CRISPR gRNA sequence
gaaattctaggtgtaattgg

SEQ ID NO: 470041 - DNA, 20 bp, Artificial
  CRISPR gRNA sequence
aaattctaggtgtaattggc

SEQ ID NO: 470042 - DNA, 20 bp, Artificial
  CRISPR gRNA sequence
taggtgtaattggcaaaata

SEQ ID NO: 470043 - DNA, 20 bp, Artificial
  CRISPR gRNA sequence
ggtgtaattggcaaaataac

SEQ ID NO: 470044 - DNA, 20 bp, Artificial
  CRISPR gRNA sequence
gcaaaataacagtgactcaa

SEQ ID NO: 470045 - DNA, 20 bp, Artificial
  CRISPR gRNA sequence
aaaagaatatttgcaccccc

SEQ ID NO: 470046 - DNA, 20 bp, Artificial
  CRISPR gRNA sequence
gcacccccaaatctaaggag

SEQ ID NO: 470047 - DNA, 20 bp, Artificial
  CRISPR gRNA sequence
cacccccaaatctaaggagc

SEQ ID NO: 470048 - DNA, 20 bp, Artificial
  CRISPR gRNA sequence
aggagctaaaacttaatgcc

SEQ ID NO: 470049 - DNA, 20 bp, Artificial
  CRISPR gRNA sequence
aaacttaatgccagtgttac

SEQ ID NO: 470050 - DNA, 20 bp, Artificial
  CRISPR gRNA sequence
aatgccagtgttacttaaga

SEQ ID NO: 470051 - DNA, 20 bp, Artificial
  CRISPR gRNA sequence
atgccagtgttacttaagaa

SEQ ID NO: 470052 - DNA, 20 bp, Artificial
  CRISPR gRNA sequence
cttaagaaaatctctccacc

SEQ ID NO: 470053 - DNA, 20 bp, Artificial
  CRISPR gRNA sequence
aagaaaatctctccaccaca

SEQ ID NO: 470054 - DNA, 20 bp, Artificial
  CRISPR gRNA sequence
agaaaatctctccaccacaa

SEQ ID NO: 470055 - DNA, 20 bp, Artificial
  CRISPR gRNA sequence
tccaccacaaaacctcagtt

SEQ ID NO: 470056 - DNA, 20 bp, Artificial
  CRISPR gRNA sequence
caccacaaaacctcagtttt

SEQ ID NO: 470057 - DNA, 20 bp, Artificial
  CRISPR gRNA sequence
agttttgtctttttgtatat

SEQ ID NO: 470058 - DNA, 20 bp, Artificial
  CRISPR gRNA sequence
tgtctttttgtatatatacc

SEQ ID NO: 470059 - DNA, 20 bp, Artificial
  CRISPR gRNA sequence
gtctttttgtatatataccc

SEQ ID NO: 470060 - DNA, 20 bp, Artificial
  CRISPR gRNA sequence
tctttttgtatatatacccc

SEQ ID NO: 470061 - DNA, 20 bp, Artificial
  CRISPR gRNA sequence
tttgtatatataccccactt

SEQ ID NO: 470062 - DNA, 20 bp, Artificial
  CRISPR gRNA sequence
ttgtatatataccccacttg

SEQ ID NO: 470063 - DNA, 20 bp, Artificial
  CRISPR gRNA sequence
tgtatatataccccacttgt

SEQ ID NO: 470064 - DNA, 20 bp, Artificial
  CRISPR gRNA sequence
gtatatataccccacttgta

SEQ ID NO: 470065 - DNA, 20 bp, Artificial
  CRISPR gRNA sequence
tatatataccccacttgtat

SEQ ID NO: 470066 - DNA, 20 bp, Artificial
  CRISPR gRNA sequence
gtattctaaactccataatt

SEQ ID NO: 470067 - DNA, 20 bp, Artificial
  CRISPR gRNA sequence
tattctaaactccataattt

SEQ ID NO: 470068 - DNA, 20 bp, Artificial
  CRISPR gRNA sequence
taaactccataatttcacat

SEQ ID NO: 470069 - DNA, 20 bp, Artificial
  CRISPR gRNA sequence
aactccataatttcacatat

SEQ ID NO: 470070 - DNA, 20 bp, Artificial
  CRISPR gRNA sequence
cataatttcacatattattt

SEQ ID NO: 470071 - DNA, 20 bp, Artificial
  CRISPR gRNA sequence
cacatattattttctttaat

SEQ ID NO: 470072 - DNA, 20 bp, Artificial
  CRISPR gRNA sequence
acatattattttctttaatg

SEQ ID NO: 470073 - DNA, 20 bp, Artificial
  CRISPR gRNA sequence
ttttctttaatgacccattt

SEQ ID NO: 470074 - DNA, 20 bp, Artificial
  CRISPR gRNA sequence
tctttaatgacccatttact

SEQ ID NO: 470075 - DNA, 20 bp, Artificial
  CRISPR gRNA sequence
ctttaatgacccatttactc

SEQ ID NO: 470076 - DNA, 20 bp, Artificial
  CRISPR gRNA sequence
tttaatgacccatttactct

SEQ ID NO: 470077 - DNA, 20 bp, Artificial
  CRISPR gRNA sequence
taatgacccatttactctag

SEQ ID NO: 470078 - DNA, 20 bp, Artificial
  CRISPR gRNA sequence
aatgacccatttactctagt

SEQ ID NO: 470079 - DNA, 20 bp, Artificial
  CRISPR gRNA sequence
atgacccatttactctagta

SEQ ID NO: 470080 - DNA, 20 bp, Artificial
  CRISPR gRNA sequence
actctagtattttgagcttc

SEQ ID NO: 470081 - DNA, 20 bp, Artificial
  CRISPR gRNA sequence
ctctagtattttgagcttca

SEQ ID NO: 470082 - DNA, 20 bp, Artificial
  CRISPR gRNA sequence
tagtattttgagcttcataa

SEQ ID NO: 470083 - DNA, 20 bp, Artificial
  CRISPR gRNA sequence
gtattttgagcttcataagc

SEQ ID NO: 470084 - DNA, 20 bp, Artificial
  CRISPR gRNA sequence
tgagcttcataagcaaactg

SEQ ID NO: 470085 - DNA, 20 bp, Artificial
  CRISPR gRNA sequence
gagcttcataagcaaactga

SEQ ID NO: 470086 - DNA, 20 bp, Artificial
  CRISPR gRNA sequence
agcttcataagcaaactgaa

SEQ ID NO: 470087 - DNA, 20 bp, Artificial
  CRISPR gRNA sequence
cataagcaaactgaaaatat

SEQ ID NO: 470088 - DNA, 20 bp, Artificial
  CRISPR gRNA sequence
ataagcaaactgaaaatata

SEQ ID NO: 470089 - DNA, 20 bp, Artificial
  CRISPR gRNA sequence
aaaatataatgtcaatttga

SEQ ID NO: 470090 - DNA, 20 bp, Artificial
  CRISPR gRNA sequence
gatcagtttctcgtgcacca

SEQ ID NO: 470091 - DNA, 20 bp, Artificial
  CRISPR gRNA sequence
atcagtttctcgtgcaccat

SEQ ID NO: 470092 - DNA, 20 bp, Artificial
  CRISPR gRNA sequence
ctcgtgcaccatttctgttg

SEQ ID NO: 470093 - DNA, 20 bp, Artificial
  CRISPR gRNA sequence
tcgtgcaccatttctgttgt

SEQ ID NO: 470094 - DNA, 20 bp, Artificial
  CRISPR gRNA sequence
gtgcaccatttctgttgtca

SEQ ID NO: 470095 - DNA, 20 bp, Artificial
  CRISPR gRNA sequence
ctgttgtcacccaccccacc

SEQ ID NO: 470096 - DNA, 20 bp, Artificial
  CRISPR gRNA sequence
tgttgtcacccaccccacct

SEQ ID NO: 470097 - DNA, 20 bp, Artificial
  CRISPR gRNA sequence
ttgtcacccaccccacctaa

SEQ ID NO: 470098 - DNA, 20 bp, Artificial
  CRISPR gRNA sequence
tcacccaccccacctaacac

SEQ ID NO: 470099 - DNA, 20 bp, Artificial
  CRISPR gRNA sequence
acacacacacacacacacac

SEQ ID NO: 470100 - DNA, 20 bp, Artificial
  CRISPR gRNA sequence
ctttgtgcagcagctcagct

SEQ ID NO: 470101 - DNA, 20 bp, Artificial
  CRISPR gRNA sequence
tgtgcagcagctcagctcac

SEQ ID NO: 470102 - DNA, 20 bp, Artificial
  CRISPR gRNA sequence
gtgcagcagctcagctcaca

SEQ ID NO: 470103 - DNA, 20 bp, Artificial
  CRISPR gRNA sequence
tgcagcagctcagctcacat

SEQ ID NO: 470104 - DNA, 20 bp, Artificial
  CRISPR gRNA sequence
agctcacatatttgttgaaa

SEQ ID NO: 470105 - DNA, 20 bp, Artificial
  CRISPR gRNA sequence
acatatttgttgaaatggat

SEQ ID NO: 470106 - DNA, 20 bp, Artificial
  CRISPR gRNA sequence
gttgaaatggattttaacct

SEQ ID NO: 470107 - DNA, 20 bp, Artificial
  CRISPR gRNA sequence
ttgaaatggattttaacctt

SEQ ID NO: 470108 - DNA, 20 bp, Artificial
  CRISPR gRNA sequence
aaatggattttaacctttgc

SEQ ID NO: 470109 - DNA, 20 bp, Artificial
  CRISPR gRNA sequence
taacctttgctatccacttt

SEQ ID NO: 470110 - DNA, 20 bp, Artificial
  CRISPR gRNA sequence
aacctttgctatccactttg

SEQ ID NO: 470111 - DNA, 20 bp, Artificial
  CRISPR gRNA sequence
acctttgctatccactttgt

SEQ ID NO: 470112 - DNA, 20 bp, Artificial
  CRISPR gRNA sequence
tgctatccactttgtatgaa

SEQ ID NO: 470113 - DNA, 20 bp, Artificial
  CRISPR gRNA sequence
gctatccactttgtatgaag

SEQ ID NO: 470114 - DNA, 20 bp, Artificial
  CRISPR gRNA sequence
ctatccactttgtatgaaga

SEQ ID NO: 470115 - DNA, 20 bp, Artificial
  CRISPR gRNA sequence
tccactttgtatgaagacta

SEQ ID NO: 470116 - DNA, 20 bp, Artificial
  CRISPR gRNA sequence
tgtatgaagactattacatt

SEQ ID NO: 470117 - DNA, 20 bp, Artificial
  CRISPR gRNA sequence
gtatgaagactattacatta

SEQ ID NO: 470118 - DNA, 20 bp, Artificial
  CRISPR gRNA sequence
tatgaagactattacattat

SEQ ID NO: 470119 - DNA, 20 bp, Artificial
  CRISPR gRNA sequence
ttacattattcagtagcagc

SEQ ID NO: 470120 - DNA, 20 bp, Artificial
  CRISPR gRNA sequence
cattattcagtagcagcacc

SEQ ID NO: 470121 - DNA, 20 bp, Artificial
  CRISPR gRNA sequence
ttcagtagcagcacctgaga

SEQ ID NO: 470122 - DNA, 20 bp, Artificial
  CRISPR gRNA sequence
agtagcagcacctgagaatt

SEQ ID NO: 470123 - DNA, 20 bp, Artificial
  CRISPR gRNA sequence
agaattcgaatagcctcaaa

SEQ ID NO: 470124 - DNA, 20 bp, Artificial
  CRISPR gRNA sequence
gaatagcctcaaactgttga

SEQ ID NO: 470125 - DNA, 20 bp, Artificial
  CRISPR gRNA sequence
aaactgttgaataaaattat

SEQ ID NO: 470126 - DNA, 20 bp, Artificial
  CRISPR gRNA sequence
ttgaataaaattataggcta

SEQ ID NO: 470127 - DNA, 20 bp, Artificial
  CRISPR gRNA sequence
aataaaattataggctattt

SEQ ID NO: 470128 - DNA, 20 bp, Artificial
  CRISPR gRNA sequence
taggctatttttgaaatagt

SEQ ID NO: 470129 - DNA, 20 bp, Artificial
  CRISPR gRNA sequence
tttttgaaatagtttaactc

SEQ ID NO: 470130 - DNA, 20 bp, Artificial
  CRISPR gRNA sequence
ttgaaatagtttaactcaag

SEQ ID NO: 470131 - DNA, 20 bp, Artificial
  CRISPR gRNA sequence
tgaaatagtttaactcaagt

SEQ ID NO: 470132 - DNA, 20 bp, Artificial
  CRISPR gRNA sequence
gaaatagtttaactcaagta

SEQ ID NO: 470133 - DNA, 20 bp, Artificial
  CRISPR gRNA sequence
aaatagtttaactcaagtac

SEQ ID NO: 470134 - DNA, 20 bp, Artificial
  CRISPR gRNA sequence
aactcaagtactttggaaag

SEQ ID NO: 470135 - DNA, 20 bp, Artificial
  CRISPR gRNA sequence
actcaagtactttggaaagt

SEQ ID NO: 470136 - DNA, 20 bp, Artificial
  CRISPR gRNA sequence
aagtactttggaaagtccaa

SEQ ID NO: 470137 - DNA, 20 bp, Artificial
  CRISPR gRNA sequence
tggaaagtccaaaaatctga

SEQ ID NO: 470138 - DNA, 20 bp, Artificial
  CRISPR gRNA sequence
ggaaagtccaaaaatctgaa

SEQ ID NO: 470139 - DNA, 20 bp, Artificial
  CRISPR gRNA sequence
gaaagtccaaaaatctgaat

SEQ ID NO: 470140 - DNA, 20 bp, Artificial
  CRISPR gRNA sequence
aatccatcttttgctatact

SEQ ID NO: 470141 - DNA, 20 bp, Artificial
  CRISPR gRNA sequence
ttgctatactcttaagtggc

SEQ ID NO: 470142 - DNA, 20 bp, Artificial
  CRISPR gRNA sequence
tgctatactcttaagtggct

SEQ ID NO: 470143 - DNA, 20 bp, Artificial
  CRISPR gRNA sequence
gctatactcttaagtggctg

SEQ ID NO: 470144 - DNA, 20 bp, Artificial
  CRISPR gRNA sequence
ctatactcttaagtggctgc

SEQ ID NO: 470145 - DNA, 20 bp, Artificial
  CRISPR gRNA sequence
tactcttaagtggctgcaac

SEQ ID NO: 470146 - DNA, 20 bp, Artificial
  CRISPR gRNA sequence
ttaagtggctgcaacctcag

SEQ ID NO: 470147 - DNA, 20 bp, Artificial
  CRISPR gRNA sequence
aagtggctgcaacctcagta

SEQ ID NO: 470148 - DNA, 20 bp, Artificial
  CRISPR gRNA sequence
agtggctgcaacctcagtat

SEQ ID NO: 470149 - DNA, 20 bp, Artificial
  CRISPR gRNA sequence
caacctcagtattttaaaat

SEQ ID NO: 470150 - DNA, 20 bp, Artificial
  CRISPR gRNA sequence
agtattttaaaataaatgat

SEQ ID NO: 470151 - DNA, 20 bp, Artificial
  CRISPR gRNA sequence
taaaataaatgattagcaaa

SEQ ID NO: 470152 - DNA, 20 bp, Artificial
  CRISPR gRNA sequence
aaaataaatgattagcaaac

SEQ ID NO: 470153 - DNA, 20 bp, Artificial
  CRISPR gRNA sequence
aaataaatgattagcaaact

SEQ ID NO: 470154 - DNA, 20 bp, Artificial
  CRISPR gRNA sequence
gcaaactaaaatatgtcact

SEQ ID NO: 470155 - DNA, 20 bp, Artificial
  CRISPR gRNA sequence
aaatatgtcactacagatga

SEQ ID NO: 470156 - DNA, 20 bp, Artificial
  CRISPR gRNA sequence
cagatgatttgccctgattc

SEQ ID NO: 470157 - DNA, 20 bp, Artificial
  CRISPR gRNA sequence
gccctgattccttagtaaga

SEQ ID NO: 470158 - DNA, 20 bp, Artificial
  CRISPR gRNA sequence
ccctgattccttagtaagaa

SEQ ID NO: 470159 - DNA, 20 bp, Artificial
  CRISPR gRNA sequence
attccttagtaagaagaaca

SEQ ID NO: 470160 - DNA, 20 bp, Artificial
  CRISPR gRNA sequence
cttagtaagaagaacagcaa

SEQ ID NO: 470161 - DNA, 20 bp, Artificial
  CRISPR gRNA sequence
agtaagaagaacagcaagat

SEQ ID NO: 470162 - DNA, 20 bp, Artificial
  CRISPR gRNA sequence
gtaagaagaacagcaagatg

SEQ ID NO: 470163 - DNA, 20 bp, Artificial
  CRISPR gRNA sequence
acccctacagaccaattaaa

SEQ ID NO: 470164 - DNA, 20 bp, Artificial
  CRISPR gRNA sequence
cagaccaattaaatattctg

SEQ ID NO: 470165 - DNA, 20 bp, Artificial
  CRISPR gRNA sequence
aatattctgggttttcctcc

SEQ ID NO: 470166 - DNA, 20 bp, Artificial
  CRISPR gRNA sequence
tgggttttcctccattccat

SEQ ID NO: 470167 - DNA, 20 bp, Artificial
  CRISPR gRNA sequence
ggttttcctccattccatta

SEQ ID NO: 470168 - DNA, 20 bp, Artificial
  CRISPR gRNA sequence
tcctccattccattaattgc

SEQ ID NO: 470169 - DNA, 20 bp, Artificial
  CRISPR gRNA sequence
cctccattccattaattgca

SEQ ID NO: 470170 - DNA, 20 bp, Artificial
  CRISPR gRNA sequence
ctccattccattaattgcac

SEQ ID NO: 470171 - DNA, 20 bp, Artificial
  CRISPR gRNA sequence
cattccattaattgcacttt

SEQ ID NO: 470172 - DNA, 20 bp, Artificial
  CRISPR gRNA sequence
cattaattgcactttaactt

SEQ ID NO: 470173 - DNA, 20 bp, Artificial
  CRISPR gRNA sequence
attgcactttaacttgctat

SEQ ID NO: 470174 - DNA, 20 bp, Artificial
  CRISPR gRNA sequence
cactttaacttgctatcaag

SEQ ID NO: 470175 - DNA, 20 bp, Artificial
  CRISPR gRNA sequence
taacttgctatcaagtcaag

SEQ ID NO: 470176 - DNA, 20 bp, Artificial
  CRISPR gRNA sequence
aacttgctatcaagtcaagc

SEQ ID NO: 470177 - DNA, 20 bp, Artificial
  CRISPR gRNA sequence
acttgctatcaagtcaagca

SEQ ID NO: 470178 - DNA, 20 bp, Artificial
  CRISPR gRNA sequence
gctatcaagtcaagcatgaa

SEQ ID NO: 470179 - DNA, 20 bp, Artificial
  CRISPR gRNA sequence
ctatcaagtcaagcatgaag

SEQ ID NO: 470180 - DNA, 20 bp, Artificial
  CRISPR gRNA sequence
tcaagtcaagcatgaagcag

SEQ ID NO: 470181 - DNA, 20 bp, Artificial
  CRISPR gRNA sequence
aagctatcttcacttgccca

SEQ ID NO: 470182 - DNA, 20 bp, Artificial
  CRISPR gRNA sequence
agctatcttcacttgcccag

SEQ ID NO: 470183 - DNA, 20 bp, Artificial
  CRISPR gRNA sequence
tcttcacttgcccagtgata

SEQ ID NO: 470184 - DNA, 20 bp, Artificial
  CRISPR gRNA sequence
cacttgcccagtgataccta

SEQ ID NO: 470185 - DNA, 20 bp, Artificial
  CRISPR gRNA sequence
acttgcccagtgatacctat

SEQ ID NO: 470186 - DNA, 20 bp, Artificial
  CRISPR gRNA sequence
gcccagtgatacctattctg

SEQ ID NO: 470187 - DNA, 20 bp, Artificial
  CRISPR gRNA sequence
cccagtgatacctattctga

SEQ ID NO: 470188 - DNA, 20 bp, Artificial
  CRISPR gRNA sequence
ttctgactaacttttaaact

SEQ ID NO: 470189 - DNA, 20 bp, Artificial
  CRISPR gRNA sequence
tgactaacttttaaactatt

SEQ ID NO: 470190 - DNA, 20 bp, Artificial
  CRISPR gRNA sequence
actaacttttaaactattca

SEQ ID NO: 470191 - DNA, 20 bp, Artificial
  CRISPR gRNA sequence
acttttaaactattcagatg

SEQ ID NO: 470192 - DNA, 20 bp, Artificial
  CRISPR gRNA sequence
ttaaactattcagatgccca

SEQ ID NO: 470193 - DNA, 20 bp, Artificial
  CRISPR gRNA sequence
taaactattcagatgcccat

SEQ ID NO: 470194 - DNA, 20 bp, Artificial
  CRISPR gRNA sequence
aaactattcagatgcccata

SEQ ID NO: 470195 - DNA, 20 bp, Artificial
  CRISPR gRNA sequence
aactattcagatgcccataa

SEQ ID NO: 470196 - DNA, 20 bp, Artificial
  CRISPR gRNA sequence
ttcagatgcccataagtata

SEQ ID NO: 470197 - DNA, 20 bp, Artificial
  CRISPR gRNA sequence
agatgcccataagtatatta

SEQ ID NO: 470198 - DNA, 20 bp, Artificial
  CRISPR gRNA sequence
attcagcagcattatgtcac

SEQ ID NO: 470199 - DNA, 20 bp, Artificial
  CRISPR gRNA sequence
agcagcattatgtcacattc

SEQ ID NO: 470200 - DNA, 20 bp, Artificial
  CRISPR gRNA sequence
tgtcacattcctatccatta

SEQ ID NO: 470201 - DNA, 20 bp, Artificial
  CRISPR gRNA sequence
ctatccattagtctatgtga

SEQ ID NO: 470202 - DNA, 20 bp, Artificial
  CRISPR gRNA sequence
tccattagtctatgtgaccc

SEQ ID NO: 470203 - DNA, 20 bp, Artificial
  CRISPR gRNA sequence
gtctatgtgacccagtgagt

SEQ ID NO: 470204 - DNA, 20 bp, Artificial
  CRISPR gRNA sequence
tgtgacccagtgagtctcta

SEQ ID NO: 470205 - DNA, 20 bp, Artificial
  CRISPR gRNA sequence
tactttcctcataaatgtgc

SEQ ID NO: 470206 - DNA, 20 bp, Artificial
  CRISPR gRNA sequence
ctttcctcataaatgtgcta

SEQ ID NO: 470207 - DNA, 20 bp, Artificial
  CRISPR gRNA sequence
tcctcataaatgtgctatac

SEQ ID NO: 470208 - DNA, 20 bp, Artificial
  CRISPR gRNA sequence
cctcataaatgtgctatacg

SEQ ID NO: 470209 - DNA, 20 bp, Artificial
  CRISPR gRNA sequence
ctcataaatgtgctatacgt

SEQ ID NO: 470210 - DNA, 20 bp, Artificial
  CRISPR gRNA sequence
ataaatgtgctatacgttga

SEQ ID NO: 470211 - DNA, 20 bp, Artificial
  CRISPR gRNA sequence
tacgttgactgctccattaa

SEQ ID NO: 470212 - DNA, 20 bp, Artificial
  CRISPR gRNA sequence
actgctccattaatacctat

SEQ ID NO: 470213 - DNA, 20 bp, Artificial
  CRISPR gRNA sequence
ctccattaatacctatattt

SEQ ID NO: 470214 - DNA, 20 bp, Artificial
  CRISPR gRNA sequence
cattaatacctatatttgct

SEQ ID NO: 470215 - DNA, 20 bp, Artificial
  CRISPR gRNA sequence
atacctatatttgcttatca

SEQ ID NO: 470216 - DNA, 20 bp, Artificial
  CRISPR gRNA sequence
tatttgcttatcaatctaac

SEQ ID NO: 470217 - DNA, 20 bp, Artificial
  CRISPR gRNA sequence
gcttatcaatctaacagagt

SEQ ID NO: 470218 - DNA, 20 bp, Artificial
  CRISPR gRNA sequence
cttatcaatctaacagagta

SEQ ID NO: 470219 - DNA, 20 bp, Artificial
  CRISPR gRNA sequence
atcaatctaacagagtagat

SEQ ID NO: 470220 - DNA, 20 bp, Artificial
  CRISPR gRNA sequence
tcaatctaacagagtagata

SEQ ID NO: 470221 - DNA, 20 bp, Artificial
  CRISPR gRNA sequence
acagagtagatataagcatt

SEQ ID NO: 470222 - DNA, 20 bp, Artificial
  CRISPR gRNA sequence
gtttgccaggtatgtggaac

SEQ ID NO: 470223 - DNA, 20 bp, Artificial
  CRISPR gRNA sequence
tttgccaggtatgtggaaca

SEQ ID NO: 470224 - DNA, 20 bp, Artificial
  CRISPR gRNA sequence
gccaggtatgtggaacatct

SEQ ID NO: 470225 - DNA, 20 bp, Artificial
  CRISPR gRNA sequence
ccaggtatgtggaacatcta

SEQ ID NO: 470226 - DNA, 20 bp, Artificial
  CRISPR gRNA sequence
ccctatatccaattggtata

SEQ ID NO: 470227 - DNA, 20 bp, Artificial
  CRISPR gRNA sequence
tatccaattggtatattcta

SEQ ID NO: 470228 - DNA, 20 bp, Artificial
  CRISPR gRNA sequence
gtatattctatatttttatt

SEQ ID NO: 470229 - DNA, 20 bp, Artificial
  CRISPR gRNA sequence
tatatttttattgcaccatt

SEQ ID NO: 470230 - DNA, 20 bp, Artificial
  CRISPR gRNA sequence
tatttttattgcaccattta

SEQ ID NO: 470231 - DNA, 20 bp, Artificial
  CRISPR gRNA sequence
ttattgcaccatttattatt

SEQ ID NO: 470232 - DNA, 20 bp, Artificial
  CRISPR gRNA sequence
tattgcaccatttattattt

SEQ ID NO: 470233 - DNA, 20 bp, Artificial
  CRISPR gRNA sequence
attgcaccatttattatttt

SEQ ID NO: 470234 - DNA, 20 bp, Artificial
  CRISPR gRNA sequence
ttgcaccatttattattttc

SEQ ID NO: 470235 - DNA, 20 bp, Artificial
  CRISPR gRNA sequence
caccatttattattttcatt

SEQ ID NO: 470236 - DNA, 20 bp, Artificial
  CRISPR gRNA sequence
attattttcattttcttaca

SEQ ID NO: 470237 - DNA, 20 bp, Artificial
  CRISPR gRNA sequence
ttattttcattttcttacat

SEQ ID NO: 470238 - DNA, 20 bp, Artificial
  CRISPR gRNA sequence
ttttcattttcttacatcaa

SEQ ID NO: 470239 - DNA, 20 bp, Artificial
  CRISPR gRNA sequence
tcattttcttacatcaagcc

SEQ ID NO: 470240 - DNA, 20 bp, Artificial
  CRISPR gRNA sequence
cattttcttacatcaagcct

SEQ ID NO: 470241 - DNA, 20 bp, Artificial
  CRISPR gRNA sequence
attttcttacatcaagccta

SEQ ID NO: 470242 - DNA, 20 bp, Artificial
  CRISPR gRNA sequence
tcttacatcaagcctaaaat

SEQ ID NO: 470243 - DNA, 20 bp, Artificial
  CRISPR gRNA sequence
cttacatcaagcctaaaatg

SEQ ID NO: 470244 - DNA, 20 bp, Artificial
  CRISPR gRNA sequence
ttacatcaagcctaaaatga

SEQ ID NO: 470245 - DNA, 20 bp, Artificial
  CRISPR gRNA sequence
acatcaagcctaaaatgatt

SEQ ID NO: 470246 - DNA, 20 bp, Artificial
  CRISPR gRNA sequence
catcaagcctaaaatgattt

SEQ ID NO: 470247 - DNA, 20 bp, Artificial
  CRISPR gRNA sequence
aaatgatttctcctttgcat

SEQ ID NO: 470248 - DNA, 20 bp, Artificial
  CRISPR gRNA sequence
ctcctttgcatttaagaaac

SEQ ID NO: 470249 - DNA, 20 bp, Artificial
  CRISPR gRNA sequence
tcctttgcatttaagaaaca

SEQ ID NO: 470250 - DNA, 20 bp, Artificial
  CRISPR gRNA sequence
ctttgcatttaagaaacacc

SEQ ID NO: 470251 - DNA, 20 bp, Artificial
  CRISPR gRNA sequence
tgcatttaagaaacaccatt

SEQ ID NO: 470252 - DNA, 20 bp, Artificial
  CRISPR gRNA sequence
gcatttaagaaacaccattc

SEQ ID NO: 470253 - DNA, 20 bp, Artificial
  CRISPR gRNA sequence
catttaagaaacaccattct

SEQ ID NO: 470254 - DNA, 20 bp, Artificial
  CRISPR gRNA sequence
aagaaacaccattcttagac

SEQ ID NO: 470255 - DNA, 20 bp, Artificial
  CRISPR gRNA sequence
agaaacaccattcttagact

SEQ ID NO: 470256 - DNA, 20 bp, Artificial
  CRISPR gRNA sequence
ttagactgacacagcaaaaa

SEQ ID NO: 470257 - DNA, 20 bp, Artificial
  CRISPR gRNA sequence
agactgacacagcaaaaatt

SEQ ID NO: 470258 - DNA, 20 bp, Artificial
  CRISPR gRNA sequence
gactgacacagcaaaaattt

SEQ ID NO: 470259 - DNA, 20 bp, Artificial
  CRISPR gRNA sequence
acacagcaaaaatttcttat

SEQ ID NO: 470260 - DNA, 20 bp, Artificial
  CRISPR gRNA sequence
cttattttggaagactgact

SEQ ID NO: 470261 - DNA, 20 bp, Artificial
  CRISPR gRNA sequence
ttattttggaagactgactt

SEQ ID NO: 470262 - DNA, 20 bp, Artificial
  CRISPR gRNA sequence
attttggaagactgacttga

SEQ ID NO: 470263 - DNA, 20 bp, Artificial
  CRISPR gRNA sequence
ttttggaagactgacttgaa

SEQ ID NO: 470264 - DNA, 20 bp, Artificial
  CRISPR gRNA sequence
tggaagactgacttgaaata

SEQ ID NO: 470265 - DNA, 20 bp, Artificial
  CRISPR gRNA sequence
ggaagactgacttgaaatat

SEQ ID NO: 470266 - DNA, 20 bp, Artificial
  CRISPR gRNA sequence
gaagactgacttgaaatata

SEQ ID NO: 470267 - DNA, 20 bp, Artificial
  CRISPR gRNA sequence
acttgaaatatacaatcatt

SEQ ID NO: 470268 - DNA, 20 bp, Artificial
  CRISPR gRNA sequence
gaaatatacaatcattactg

SEQ ID NO: 470269 - DNA, 20 bp, Artificial
  CRISPR gRNA sequence
aaatatacaatcattactgt

SEQ ID NO: 470270 - DNA, 20 bp, Artificial
  CRISPR gRNA sequence
ctgtatttatggttggttag

SEQ ID NO: 470271 - DNA, 20 bp, Artificial
  CRISPR gRNA sequence
tatttatggttggttagtca

SEQ ID NO: 470272 - DNA, 20 bp, Artificial
  CRISPR gRNA sequence
atggttggttagtcaaattg

SEQ ID NO: 470273 - DNA, 20 bp, Artificial
  CRISPR gRNA sequence
tggttggttagtcaaattgg

SEQ ID NO: 470274 - DNA, 20 bp, Artificial
  CRISPR gRNA sequence
gttagtcaaattgggacatt

SEQ ID NO: 470275 - DNA, 20 bp, Artificial
  CRISPR gRNA sequence
gtcaaattgggacattttgt

SEQ ID NO: 470276 - DNA, 20 bp, Artificial
  CRISPR gRNA sequence
ggacattttgttttcaagag

SEQ ID NO: 470277 - DNA, 20 bp, Artificial
  CRISPR gRNA sequence
tgttttcaagagtgtgtagt

SEQ ID NO: 470278 - DNA, 20 bp, Artificial
  CRISPR gRNA sequence
gttttcaagagtgtgtagtg

SEQ ID NO: 470279 - DNA, 20 bp, Artificial
  CRISPR gRNA sequence
ttttcaagagtgtgtagtga

SEQ ID NO: 470280 - DNA, 20 bp, Artificial
  CRISPR gRNA sequence
tcaagagtgtgtagtgaact

SEQ ID NO: 470281 - DNA, 20 bp, Artificial
  CRISPR gRNA sequence
caagagtgtgtagtgaactg

SEQ ID NO: 470282 - DNA, 20 bp, Artificial
  CRISPR gRNA sequence
aagagtgtgtagtgaactga

SEQ ID NO: 470283 - DNA, 20 bp, Artificial
  CRISPR gRNA sequence
atgcaggtaacacaaacctc

SEQ ID NO: 470284 - DNA, 20 bp, Artificial
  CRISPR gRNA sequence
ttttccctacaagtctttcc

SEQ ID NO: 470285 - DNA, 20 bp, Artificial
  CRISPR gRNA sequence
ttccctacaagtctttccaa

SEQ ID NO: 470286 - DNA, 20 bp, Artificial
  CRISPR gRNA sequence
tccctacaagtctttccaat

SEQ ID NO: 470287 - DNA, 20 bp, Artificial
  CRISPR gRNA sequence
ccctacaagtctttccaata

SEQ ID NO: 470288 - DNA, 20 bp, Artificial
  CRISPR gRNA sequence
cctacaagtctttccaatag

SEQ ID NO: 470289 - DNA, 20 bp, Artificial
  CRISPR gRNA sequence
caagtctttccaatagcttc

SEQ ID NO: 470290 - DNA, 20 bp, Artificial
  CRISPR gRNA sequence
tccaatagcttcaaaggcaa

SEQ ID NO: 470291 - DNA, 20 bp, Artificial
  CRISPR gRNA sequence
ccaatagcttcaaaggcaag

SEQ ID NO: 470292 - DNA, 20 bp, Artificial
  CRISPR gRNA sequence
caatagcttcaaaggcaaga

SEQ ID NO: 470293 - DNA, 20 bp, Artificial
  CRISPR gRNA sequence
caaaggcaagatcgagtttg

SEQ ID NO: 470294 - DNA, 20 bp, Artificial
  CRISPR gRNA sequence
aaaggcaagatcgagtttgt

SEQ ID NO: 470295 - DNA, 20 bp, Artificial
  CRISPR gRNA sequence
gtatattgggtaaaatgtag

SEQ ID NO: 470296 - DNA, 20 bp, Artificial
  CRISPR gRNA sequence
tatattgggtaaaatgtagc

SEQ ID NO: 470297 - DNA, 20 bp, Artificial
  CRISPR gRNA sequence
ggtaaaatgtagctaagttt

SEQ ID NO: 470298 - DNA, 20 bp, Artificial
  CRISPR gRNA sequence
agtttaaacgttctactatt

SEQ ID NO: 470299 - DNA, 20 bp, Artificial
  CRISPR gRNA sequence
aaacgttctactattctgct

SEQ ID NO: 470300 - DNA, 20 bp, Artificial
  CRISPR gRNA sequence
aacgttctactattctgcta

SEQ ID NO: 470301 - DNA, 20 bp, Artificial
  CRISPR gRNA sequence
tactattctgctactcatga

SEQ ID NO: 470302 - DNA, 20 bp, Artificial
  CRISPR gRNA sequence
ctattctgctactcatgatg

SEQ ID NO: 470303 - DNA, 20 bp, Artificial
  CRISPR gRNA sequence
ttctgctactcatgatgtca

SEQ ID NO: 470304 - DNA, 20 bp, Artificial
  CRISPR gRNA sequence
tgctactcatgatgtcaacc

SEQ ID NO: 470305 - DNA, 20 bp, Artificial
  CRISPR gRNA sequence
ctactcatgatgtcaaccag

SEQ ID NO: 470306 - DNA, 20 bp, Artificial
  CRISPR gRNA sequence
ctcatgatgtcaaccagttt

SEQ ID NO: 470307 - DNA, 20 bp, Artificial
  CRISPR gRNA sequence
atgatgtcaaccagttttgg

SEQ ID NO: 470308 - DNA, 20 bp, Artificial
  CRISPR gRNA sequence
tggagagattttgttattca

SEQ ID NO: 470309 - DNA, 20 bp, Artificial
  CRISPR gRNA sequence
ggagagattttgttattcaa

SEQ ID NO: 470310 - DNA, 20 bp, Artificial
  CRISPR gRNA sequence
gagagattttgttattcaag

SEQ ID NO: 470311 - DNA, 20 bp, Artificial
  CRISPR gRNA sequence
tgttattcaaggctataata

SEQ ID NO: 470312 - DNA, 20 bp, Artificial
  CRISPR gRNA sequence
gttattcaaggctataatat

SEQ ID NO: 470313 - DNA, 20 bp, Artificial
  CRISPR gRNA sequence
ttattcaaggctataatata

SEQ ID NO: 470314 - DNA, 20 bp, Artificial
  CRISPR gRNA sequence
ttcaaggctataatataaaa

SEQ ID NO: 470315 - DNA, 20 bp, Artificial
  CRISPR gRNA sequence
aaggctataatataaaaagc

SEQ ID NO: 470316 - DNA, 20 bp, Artificial
  CRISPR gRNA sequence
taatataaaaagctcccaaa

SEQ ID NO: 470317 - DNA, 20 bp, Artificial
  CRISPR gRNA sequence
ccaaataagtttctgagaga

SEQ ID NO: 470318 - DNA, 20 bp, Artificial
  CRISPR gRNA sequence
ctgagagaaattttaatcat

SEQ ID NO: 470319 - DNA, 20 bp, Artificial
  CRISPR gRNA sequence
tgagagaaattttaatcatt

SEQ ID NO: 470320 - DNA, 20 bp, Artificial
  CRISPR gRNA sequence
agagaaattttaatcattta

SEQ ID NO: 470321 - DNA, 20 bp, Artificial
  CRISPR gRNA sequence
taatcatttatcctatggac

SEQ ID NO: 470322 - DNA, 20 bp, Artificial
  CRISPR gRNA sequence
aatcatttatcctatggacc

SEQ ID NO: 470323 - DNA, 20 bp, Artificial
  CRISPR gRNA sequence
atcatttatcctatggaccc

SEQ ID NO: 470324 - DNA, 20 bp, Artificial
  CRISPR gRNA sequence
atcctatggacccttaagac

SEQ ID NO: 470325 - DNA, 20 bp, Artificial
  CRISPR gRNA sequence
tcctatggacccttaagacc

SEQ ID NO: 470326 - DNA, 20 bp, Artificial
  CRISPR gRNA sequence
tggacccttaagacccaagc

SEQ ID NO: 470327 - DNA, 20 bp, Artificial
  CRISPR gRNA sequence
aagacccaagcactaacatg

SEQ ID NO: 470328 - DNA, 20 bp, Artificial
  CRISPR gRNA sequence
agacccaagcactaacatga

SEQ ID NO: 470329 - DNA, 20 bp, Artificial
  CRISPR gRNA sequence
acatgaacatttctaaagta

SEQ ID NO: 470330 - DNA, 20 bp, Artificial
  CRISPR gRNA sequence
ctaaagtaaaaattctcaaa

SEQ ID NO: 470331 - DNA, 20 bp, Artificial
  CRISPR gRNA sequence
taaagtaaaaattctcaaat

SEQ ID NO: 470332 - DNA, 20 bp, Artificial
  CRISPR gRNA sequence
aagtaaaaattctcaaattg

SEQ ID NO: 470333 - DNA, 20 bp, Artificial
  CRISPR gRNA sequence
tcaaattgagaaatattatt

SEQ ID NO: 470334 - DNA, 20 bp, Artificial
  CRISPR gRNA sequence
aaattgagaaatattatttg

SEQ ID NO: 470335 - DNA, 20 bp, Artificial
  CRISPR gRNA sequence
agaaatattatttgacatcc

SEQ ID NO: 470336 - DNA, 20 bp, Artificial
  CRISPR gRNA sequence
tttgacatcctgttgagccc

SEQ ID NO: 470337 - DNA, 20 bp, Artificial
  CRISPR gRNA sequence
gacatcctgttgagcccaga

SEQ ID NO: 470338 - DNA, 20 bp, Artificial
  CRISPR gRNA sequence
acatcctgttgagcccagac

SEQ ID NO: 470339 - DNA, 20 bp, Artificial
  CRISPR gRNA sequence
ttgagcccagacaatgatgt

SEQ ID NO: 470340 - DNA, 20 bp, Artificial
  CRISPR gRNA sequence
agcccagacaatgatgtcaa

SEQ ID NO: 470341 - DNA, 20 bp, Artificial
  CRISPR gRNA sequence
atcattcaatggtccctgtt

SEQ ID NO: 470342 - DNA, 20 bp, Artificial
  CRISPR gRNA sequence
aatggtccctgttggagtca

SEQ ID NO: 470343 - DNA, 20 bp, Artificial
  CRISPR gRNA sequence
ttggagtcagaaacagactt

SEQ ID NO: 470344 - DNA, 20 bp, Artificial
  CRISPR gRNA sequence
gagtcagaaacagacttaac

SEQ ID NO: 470345 - DNA, 20 bp, Artificial
  CRISPR gRNA sequence
aactcctcacacatatggat

SEQ ID NO: 470346 - DNA, 20 bp, Artificial
  CRISPR gRNA sequence
actcctcacacatatggatg

SEQ ID NO: 470347 - DNA, 20 bp, Artificial
  CRISPR gRNA sequence
ctcacacatatggatgcata

SEQ ID NO: 470348 - DNA, 20 bp, Artificial
  CRISPR gRNA sequence
acacatatggatgcatattc

SEQ ID NO: 470349 - DNA, 20 bp, Artificial
  CRISPR gRNA sequence
tgttggtgcttcttttacat

SEQ ID NO: 470350 - DNA, 20 bp, Artificial
  CRISPR gRNA sequence
ttggtgcttcttttacattt

SEQ ID NO: 470351 - DNA, 20 bp, Artificial
  CRISPR gRNA sequence
gtgcttcttttacatttctt

SEQ ID NO: 470352 - DNA, 20 bp, Artificial
  CRISPR gRNA sequence
cttttacatttcttgccagt

SEQ ID NO: 470353 - DNA, 20 bp, Artificial
  CRISPR gRNA sequence
ttttacatttcttgccagtc

SEQ ID NO: 470354 - DNA, 20 bp, Artificial
  CRISPR gRNA sequence
ttacatttcttgccagtctt

SEQ ID NO: 470355 - DNA, 20 bp, Artificial
  CRISPR gRNA sequence
tacatttcttgccagtcttg

SEQ ID NO: 470356 - DNA, 20 bp, Artificial
  CRISPR gRNA sequence
acatttcttgccagtcttga

SEQ ID NO: 470357 - DNA, 20 bp, Artificial
  CRISPR gRNA sequence
catttcttgccagtcttgag

SEQ ID NO: 470358 - DNA, 20 bp, Artificial
  CRISPR gRNA sequence
cttgccagtcttgagttcgg

SEQ ID NO: 470359 - DNA, 20 bp, Artificial
  CRISPR gRNA sequence
ttgccagtcttgagttcggt

SEQ ID NO: 470360 - DNA, 20 bp, Artificial
  CRISPR gRNA sequence
gccagtcttgagttcggtcc

SEQ ID NO: 470361 - DNA, 20 bp, Artificial
  CRISPR gRNA sequence
ccagtcttgagttcggtcca

SEQ ID NO: 470362 - DNA, 20 bp, Artificial
  CRISPR gRNA sequence
gagttcggtccaatgacaga

SEQ ID NO: 470363 - DNA, 20 bp, Artificial
  CRISPR gRNA sequence
agttcggtccaatgacagaa

SEQ ID NO: 470364 - DNA, 20 bp, Artificial
  CRISPR gRNA sequence
ggtccaatgacagaatggtt

SEQ ID NO: 470365 - DNA, 20 bp, Artificial
  CRISPR gRNA sequence
agggaagcataaacaatgcc

SEQ ID NO: 470366 - DNA, 20 bp, Artificial
  CRISPR gRNA sequence
gtttgttttcttccaggcat

SEQ ID NO: 470367 - DNA, 20 bp, Artificial
  CRISPR gRNA sequence
gttttcttccaggcatggat

SEQ ID NO: 470368 - DNA, 20 bp, Artificial
  CRISPR gRNA sequence
ttttcttccaggcatggatt

SEQ ID NO: 470369 - DNA, 20 bp, Artificial
  CRISPR gRNA sequence
tcttccaggcatggattaga

SEQ ID NO: 470370 - DNA, 20 bp, Artificial
  CRISPR gRNA sequence
cttccaggcatggattagaa

SEQ ID NO: 470371 - DNA, 20 bp, Artificial
  CRISPR gRNA sequence
ttccaggcatggattagaat

SEQ ID NO: 470372 - DNA, 20 bp, Artificial
  CRISPR gRNA sequence
ccaggcatggattagaataa

SEQ ID NO: 470373 - DNA, 20 bp, Artificial
  CRISPR gRNA sequence
caggcatggattagaataaa

SEQ ID NO: 470374 - DNA, 20 bp, Artificial
  CRISPR gRNA sequence
gaataaacttcagacccttc

SEQ ID NO: 470375 - DNA, 20 bp, Artificial
  CRISPR gRNA sequence
cagacccttcctgcatcctg

SEQ ID NO: 470376 - DNA, 20 bp, Artificial
  CRISPR gRNA sequence
agacccttcctgcatcctga

SEQ ID NO: 470377 - DNA, 20 bp, Artificial
  CRISPR gRNA sequence
cctgcatcctgaaacaaagg

SEQ ID NO: 470378 - DNA, 20 bp, Artificial
  CRISPR gRNA sequence
ctgcatcctgaaacaaaggt

SEQ ID NO: 470379 - DNA, 20 bp, Artificial
  CRISPR gRNA sequence
catcctgaaacaaaggtcag

SEQ ID NO: 470380 - DNA, 20 bp, Artificial
  CRISPR gRNA sequence
aaacaaaggtcagggtcatt

SEQ ID NO: 470381 - DNA, 20 bp, Artificial
  CRISPR gRNA sequence
tcataaattccagtttctga

SEQ ID NO: 470382 - DNA, 20 bp, Artificial
  CRISPR gRNA sequence
cagtttctgatagcagtact

SEQ ID NO: 470383 - DNA, 20 bp, Artificial
  CRISPR gRNA sequence
ctgatagcagtacttgggaa

SEQ ID NO: 470384 - DNA, 20 bp, Artificial
  CRISPR gRNA sequence
tgatagcagtacttgggaat

SEQ ID NO: 470385 - DNA, 20 bp, Artificial
  CRISPR gRNA sequence
atagcagtacttgggaattt

SEQ ID NO: 470386 - DNA, 20 bp, Artificial
  CRISPR gRNA sequence
gggaattttgcctggtgctt

SEQ ID NO: 470387 - DNA, 20 bp, Artificial
  CRISPR gRNA sequence
ggaattttgcctggtgcttg

SEQ ID NO: 470388 - DNA, 20 bp, Artificial
  CRISPR gRNA sequence
tgcctggtgcttgcttctgt

SEQ ID NO: 470389 - DNA, 20 bp, Artificial
  CRISPR gRNA sequence
gcctggtgcttgcttctgtt

SEQ ID NO: 470390 - DNA, 20 bp, Artificial
  CRISPR gRNA sequence
cctggtgcttgcttctgttt

SEQ ID NO: 470391 - DNA, 20 bp, Artificial
  CRISPR gRNA sequence
gtgcttgcttctgtttgctc

SEQ ID NO: 470392 - DNA, 20 bp, Artificial
  CRISPR gRNA sequence
gcttctgtttgctcactctt

SEQ ID NO: 470393 - DNA, 20 bp, Artificial
  CRISPR gRNA sequence
cttctgtttgctcactctta

SEQ ID NO: 470394 - DNA, 20 bp, Artificial
  CRISPR gRNA sequence
ctgtttgctcactcttaagg

SEQ ID NO: 470395 - DNA, 20 bp, Artificial
  CRISPR gRNA sequence
tgtttgctcactcttaaggt

SEQ ID NO: 470396 - DNA, 20 bp, Artificial
  CRISPR gRNA sequence
tttgctcactcttaaggtga

SEQ ID NO: 470397 - DNA, 20 bp, Artificial
  CRISPR gRNA sequence
gctcactcttaaggtgagca

SEQ ID NO: 470398 - DNA, 20 bp, Artificial
  CRISPR gRNA sequence
ctcactcttaaggtgagcat

SEQ ID NO: 470399 - DNA, 20 bp, Artificial
  CRISPR gRNA sequence
actcttaaggtgagcatcaa

SEQ ID NO: 470400 - DNA, 20 bp, Artificial
  CRISPR gRNA sequence
ttaaggtgagcatcaaccta

SEQ ID NO: 470401 - DNA, 20 bp, Artificial
  CRISPR gRNA sequence
aaggtgagcatcaacctaca

SEQ ID NO: 470402 - DNA, 20 bp, Artificial
  CRISPR gRNA sequence
aggtgagcatcaacctacaa

SEQ ID NO: 470403 - DNA, 20 bp, Artificial
  CRISPR gRNA sequence
caatagaaaaaaagatggtt

SEQ ID NO: 470404 - DNA, 20 bp, Artificial
  CRISPR gRNA sequence
taagtgacacttacggccat

SEQ ID NO: 470405 - DNA, 20 bp, Artificial
  CRISPR gRNA sequence
aagtgacacttacggccatg

SEQ ID NO: 470406 - DNA, 20 bp, Artificial
  CRISPR gRNA sequence
agtgacacttacggccatgg

SEQ ID NO: 470407 - DNA, 20 bp, Artificial
  CRISPR gRNA sequence
acggccatggtagtgcatat

SEQ ID NO: 470408 - DNA, 20 bp, Artificial
  CRISPR gRNA sequence
cggccatggtagtgcatatt

SEQ ID NO: 470409 - DNA, 20 bp, Artificial
  CRISPR gRNA sequence
attagcaaactatgaatgaa

SEQ ID NO: 470410 - DNA, 20 bp, Artificial
  CRISPR gRNA sequence
gcaaactatgaatgaaaagc

SEQ ID NO: 470411 - DNA, 20 bp, Artificial
  CRISPR gRNA sequence
tgaatgaaaagcttaaatgg

SEQ ID NO: 470412 - DNA, 20 bp, Artificial
  CRISPR gRNA sequence
aaatggagtcatgtccattg

SEQ ID NO: 470413 - DNA, 20 bp, Artificial
  CRISPR gRNA sequence
aatggagtcatgtccattgt

SEQ ID NO: 470414 - DNA, 20 bp, Artificial
  CRISPR gRNA sequence
tgagaaataatctactgttc

SEQ ID NO: 470415 - DNA, 20 bp, Artificial
  CRISPR gRNA sequence
ctgttcctcacatactctgc

SEQ ID NO: 470416 - DNA, 20 bp, Artificial
  CRISPR gRNA sequence
ttcctcacatactctgctga

SEQ ID NO: 470417 - DNA, 20 bp, Artificial
  CRISPR gRNA sequence
ctcacatactctgctgacat

SEQ ID NO: 470418 - DNA, 20 bp, Artificial
  CRISPR gRNA sequence
acatactctgctgacatcta

SEQ ID NO: 470419 - DNA, 20 bp, Artificial
  CRISPR gRNA sequence
tgctgacatctacactttca

SEQ ID NO: 470420 - DNA, 20 bp, Artificial
  CRISPR gRNA sequence
ctgacatctacactttcagc

SEQ ID NO: 470421 - DNA, 20 bp, Artificial
  CRISPR gRNA sequence
acatctacactttcagctaa

SEQ ID NO: 470422 - DNA, 20 bp, Artificial
  CRISPR gRNA sequence
cactttcagctaaatttcaa

SEQ ID NO: 470423 - DNA, 20 bp, Artificial
  CRISPR gRNA sequence
tcagctaaatttcaattatt

SEQ ID NO: 470424 - DNA, 20 bp, Artificial
  CRISPR gRNA sequence
cagctaaatttcaattatta

SEQ ID NO: 470425 - DNA, 20 bp, Artificial
  CRISPR gRNA sequence
agctaaatttcaattattaa

SEQ ID NO: 470426 - DNA, 20 bp, Artificial
  CRISPR gRNA sequence
aatttcaattattaaaggat

SEQ ID NO: 470427 - DNA, 20 bp, Artificial
  CRISPR gRNA sequence
caattattaaaggatgaaag

SEQ ID NO: 470428 - DNA, 20 bp, Artificial
  CRISPR gRNA sequence
aattattaaaggatgaaagg

SEQ ID NO: 470429 - DNA, 20 bp, Artificial
  CRISPR gRNA sequence
ttaaaggatgaaaggcttga

SEQ ID NO: 470430 - DNA, 20 bp, Artificial
  CRISPR gRNA sequence
aaggatgaaaggcttgagaa

SEQ ID NO: 470431 - DNA, 20 bp, Artificial
  CRISPR gRNA sequence
gagaatcactatgtcacccc

SEQ ID NO: 470432 - DNA, 20 bp, Artificial
  CRISPR gRNA sequence
agaatcactatgtcacccct

SEQ ID NO: 470433 - DNA, 20 bp, Artificial
  CRISPR gRNA sequence
tgtcacccctaaatagttat

SEQ ID NO: 470434 - DNA, 20 bp, Artificial
  CRISPR gRNA sequence
aatagttattttgtgcttta

SEQ ID NO: 470435 - DNA, 20 bp, Artificial
  CRISPR gRNA sequence
ttttgtgctttattactggt

SEQ ID NO: 470436 - DNA, 20 bp, Artificial
  CRISPR gRNA sequence
tgtgctttattactggtcac

SEQ ID NO: 470437 - DNA, 20 bp, Artificial
  CRISPR gRNA sequence
gtgctttattactggtcact

SEQ ID NO: 470438 - DNA, 20 bp, Artificial
  CRISPR gRNA sequence
tgctttattactggtcactt

SEQ ID NO: 470439 - DNA, 20 bp, Artificial
  CRISPR gRNA sequence
tattactggtcacttttgag

SEQ ID NO: 470440 - DNA, 20 bp, Artificial
  CRISPR gRNA sequence
attactggtcacttttgagg

SEQ ID NO: 470441 - DNA, 20 bp, Artificial
  CRISPR gRNA sequence
ttactggtcacttttgaggt

SEQ ID NO: 470442 - DNA, 20 bp, Artificial
  CRISPR gRNA sequence
ctggtcacttttgaggtcac

SEQ ID NO: 470443 - DNA, 20 bp, Artificial
  CRISPR gRNA sequence
gtcacttttgaggtcacaga

SEQ ID NO: 470444 - DNA, 20 bp, Artificial
  CRISPR gRNA sequence
ttgaggtcacagaacatttt

SEQ ID NO: 470445 - DNA, 20 bp, Artificial
  CRISPR gRNA sequence
tgaggtcacagaacattttt

SEQ ID NO: 470446 - DNA, 20 bp, Artificial
  CRISPR gRNA sequence
gaggtcacagaacatttttt

SEQ ID NO: 470447 - DNA, 20 bp, Artificial
  CRISPR gRNA sequence
aggtcacagaacatttttta

SEQ ID NO: 470448 - DNA, 20 bp, Artificial
  CRISPR gRNA sequence
tttaatcccccttcaagata

SEQ ID NO: 470449 - DNA, 20 bp, Artificial
  CRISPR gRNA sequence
ttaatcccccttcaagataa

SEQ ID NO: 470450 - DNA, 20 bp, Artificial
  CRISPR gRNA sequence
taatcccccttcaagataaa

SEQ ID NO: 470451 - DNA, 20 bp, Artificial
  CRISPR gRNA sequence
aatcccccttcaagataaaa

SEQ ID NO: 470452 - DNA, 20 bp, Artificial
  CRISPR gRNA sequence
atcccccttcaagataaaaa

SEQ ID NO: 470453 - DNA, 20 bp, Artificial
  CRISPR gRNA sequence
caagataaaaagcatagccc

SEQ ID NO: 470454 - DNA, 20 bp, Artificial
  CRISPR gRNA sequence
aagataaaaagcatagccca

SEQ ID NO: 470455 - DNA, 20 bp, Artificial
  CRISPR gRNA sequence
atggaaaaagcaaaaaatat

SEQ ID NO: 470456 - DNA, 20 bp, Artificial
  CRISPR gRNA sequence
tgaaaacttcaggcagttta

SEQ ID NO: 470457 - DNA, 20 bp, Artificial
  CRISPR gRNA sequence
caggcagtttataacatgat

SEQ ID NO: 470458 - DNA, 20 bp, Artificial
  CRISPR gRNA sequence
aggcagtttataacatgatg

SEQ ID NO: 470459 - DNA, 20 bp, Artificial
  CRISPR gRNA sequence
ataacatgatgaatagtatt

SEQ ID NO: 470460 - DNA, 20 bp, Artificial
  CRISPR gRNA sequence
taacatgatgaatagtattt

SEQ ID NO: 470461 - DNA, 20 bp, Artificial
  CRISPR gRNA sequence
aatgcagtttagaataaaaa

SEQ ID NO: 470462 - DNA, 20 bp, Artificial
  CRISPR gRNA sequence
atgcagtttagaataaaaag

SEQ ID NO: 470463 - DNA, 20 bp, Artificial
  CRISPR gRNA sequence
agaataaaaagattaaggat

SEQ ID NO: 470464 - DNA, 20 bp, Artificial
  CRISPR gRNA sequence
gaataaaaagattaaggata

SEQ ID NO: 470465 - DNA, 20 bp, Artificial
  CRISPR gRNA sequence
aggataaagcagaacaaata

SEQ ID NO: 470466 - DNA, 20 bp, Artificial
  CRISPR gRNA sequence
agagggcagaaacaataaat

SEQ ID NO: 470467 - DNA, 20 bp, Artificial
  CRISPR gRNA sequence
tgagttagccaagatatatt

SEQ ID NO: 470468 - DNA, 20 bp, Artificial
  CRISPR gRNA sequence
gccaagatatattattataa

SEQ ID NO: 470469 - DNA, 20 bp, Artificial
  CRISPR gRNA sequence
ttataatttgagaccttaaa

SEQ ID NO: 470470 - DNA, 20 bp, Artificial
  CRISPR gRNA sequence
taatttgagaccttaaatta

SEQ ID NO: 470471 - DNA, 20 bp, Artificial
  CRISPR gRNA sequence
gagaccttaaattaaaaaat

SEQ ID NO: 470472 - DNA, 20 bp, Artificial
  CRISPR gRNA sequence
agaccttaaattaaaaaatt

SEQ ID NO: 470473 - DNA, 20 bp, Artificial
  CRISPR gRNA sequence
aaattaaaaaattgatgtca

SEQ ID NO: 470474 - DNA, 20 bp, Artificial
  CRISPR gRNA sequence
aattaaaaaattgatgtcag

SEQ ID NO: 470475 - DNA, 20 bp, Artificial
  CRISPR gRNA sequence
aaaaattgatgtcagttttg

SEQ ID NO: 470476 - DNA, 20 bp, Artificial
  CRISPR gRNA sequence
atgtcagttttggaaagata

SEQ ID NO: 470477 - DNA, 20 bp, Artificial
  CRISPR gRNA sequence
tggaaagataaagcttagaa

SEQ ID NO: 470478 - DNA, 20 bp, Artificial
  CRISPR gRNA sequence
ggaaagataaagcttagaaa

SEQ ID NO: 470479 - DNA, 20 bp, Artificial
  CRISPR gRNA sequence
gaaagataaagcttagaaaa

SEQ ID NO: 470480 - DNA, 20 bp, Artificial
  CRISPR gRNA sequence
agaaaaagttccaaaacagt

SEQ ID NO: 470481 - DNA, 20 bp, Artificial
  CRISPR gRNA sequence
gaaaaagttccaaaacagta

SEQ ID NO: 470482 - DNA, 20 bp, Artificial
  CRISPR gRNA sequence
caaaacagtattccagttgt

SEQ ID NO: 470483 - DNA, 20 bp, Artificial
  CRISPR gRNA sequence
cagttgttattcctatcaaa

SEQ ID NO: 470484 - DNA, 20 bp, Artificial
  CRISPR gRNA sequence
ttattcctatcaaaagaaaa

SEQ ID NO: 470485 - DNA, 20 bp, Artificial
  CRISPR gRNA sequence
ttcctatcaaaagaaaattc

SEQ ID NO: 470486 - DNA, 20 bp, Artificial
  CRISPR gRNA sequence
ctatcaaaagaaaattcttc

SEQ ID NO: 470487 - DNA, 20 bp, Artificial
  CRISPR gRNA sequence
tcaaaagaaaattcttcttt

SEQ ID NO: 470488 - DNA, 20 bp, Artificial
  CRISPR gRNA sequence
ttcttttttttttttttttt

SEQ ID NO: 470489 - DNA, 20 bp, Artificial
  CRISPR gRNA sequence
cttttttttttttttttttg

SEQ ID NO: 470490 - DNA, 20 bp, Artificial
  CRISPR gRNA sequence
ttttttttttttttttttga

SEQ ID NO: 470491 - DNA, 20 bp, Artificial
  CRISPR gRNA sequence
ttttttttttttttttgaga

SEQ ID NO: 470492 - DNA, 20 bp, Artificial
  CRISPR gRNA sequence
tttttttttttttttgagac

SEQ ID NO: 470493 - DNA, 20 bp, Artificial
  CRISPR gRNA sequence
ttttttttttttttgagacg

SEQ ID NO: 470494 - DNA, 20 bp, Artificial
  CRISPR gRNA sequence
tttttttttttttgagacgg

SEQ ID NO: 470495 - DNA, 20 bp, Artificial
  CRISPR gRNA sequence
ttttttttttttgagacgga

SEQ ID NO: 470496 - DNA, 20 bp, Artificial
  CRISPR gRNA sequence
tttttttttttgagacggag

SEQ ID NO: 470497 - DNA, 20 bp, Artificial
  CRISPR gRNA sequence
ttttttttttgagacggagt

SEQ ID NO: 470498 - DNA, 20 bp, Artificial
  CRISPR gRNA sequence
tttttttttgagacggagtc

SEQ ID NO: 470499 - DNA, 20 bp, Artificial
  CRISPR gRNA sequence
ttttttttgagacggagtct

SEQ ID NO: 470500 - DNA, 20 bp, Artificial
  CRISPR gRNA sequence
tttttttgagacggagtctt

SEQ ID NO: 470501 - DNA, 20 bp, Artificial
  CRISPR gRNA sequence
ttttttgagacggagtcttg

SEQ ID NO: 470502 - DNA, 20 bp, Artificial
  CRISPR gRNA sequence
tttttgagacggagtcttgc

SEQ ID NO: 470503 - DNA, 20 bp, Artificial
  CRISPR gRNA sequence
ttttgagacggagtcttgcc

SEQ ID NO: 470504 - DNA, 20 bp, Artificial
  CRISPR gRNA sequence
tttgagacggagtcttgcct

SEQ ID NO: 470505 - DNA, 20 bp, Artificial
  CRISPR gRNA sequence
ttgagacggagtcttgccta

SEQ ID NO: 470506 - DNA, 20 bp, Artificial
  CRISPR gRNA sequence
tgagacggagtcttgcctat

SEQ ID NO: 470507 - DNA, 20 bp, Artificial
  CRISPR gRNA sequence
gagacggagtcttgcctata

SEQ ID NO: 470508 - DNA, 20 bp, Artificial
  CRISPR gRNA sequence
agacggagtcttgcctatag

SEQ ID NO: 470509 - DNA, 20 bp, Artificial
  CRISPR gRNA sequence
gcctatagcccaggctggag

SEQ ID NO: 470510 - DNA, 20 bp, Artificial
  CRISPR gRNA sequence
cctatagcccaggctggagt

SEQ ID NO: 470511 - DNA, 20 bp, Artificial
  CRISPR gRNA sequence
tagcccaggctggagtgcag

SEQ ID NO: 470512 - DNA, 20 bp, Artificial
  CRISPR gRNA sequence
gagtgcagtggtgcgatctc

SEQ ID NO: 470513 - DNA, 20 bp, Artificial
  CRISPR gRNA sequence
ggctcaccgcaagctccgcc

SEQ ID NO: 470514 - DNA, 20 bp, Artificial
  CRISPR gRNA sequence
accgcaagctccgcctcccg

SEQ ID NO: 470515 - DNA, 20 bp, Artificial
  CRISPR gRNA sequence
cgcctcccggcttcacgcca

SEQ ID NO: 470516 - DNA, 20 bp, Artificial
  CRISPR gRNA sequence
ccggcttcacgccattctcc

SEQ ID NO: 470517 - DNA, 20 bp, Artificial
  CRISPR gRNA sequence
cacgccattctcctgcctca

SEQ ID NO: 470518 - DNA, 20 bp, Artificial
  CRISPR gRNA sequence
acgccattctcctgcctcag

SEQ ID NO: 470519 - DNA, 20 bp, Artificial
  CRISPR gRNA sequence
tcctgcctcagcctcccgag

SEQ ID NO: 470520 - DNA, 20 bp, Artificial
  CRISPR gRNA sequence
ctgcctcagcctcccgagta

SEQ ID NO: 470521 - DNA, 20 bp, Artificial
  CRISPR gRNA sequence
cctcagcctcccgagtagct

SEQ ID NO: 470522 - DNA, 20 bp, Artificial
  CRISPR gRNA sequence
agcctcccgagtagctggga

SEQ ID NO: 470523 - DNA, 20 bp, Artificial
  CRISPR gRNA sequence
ccgagtagctgggactacag

SEQ ID NO: 470524 - DNA, 20 bp, Artificial
  CRISPR gRNA sequence
ggactacaggcgcccgccac

SEQ ID NO: 470525 - DNA, 20 bp, Artificial
  CRISPR gRNA sequence
caggcgcccgccacctcgcc

SEQ ID NO: 470526 - DNA, 20 bp, Artificial
  CRISPR gRNA sequence
gcccggctaatttttttttg

SEQ ID NO: 470527 - DNA, 20 bp, Artificial
  CRISPR gRNA sequence
atttttttttgtatttttag

SEQ ID NO: 470528 - DNA, 20 bp, Artificial
  CRISPR gRNA sequence
ttttttgtatttttagtaga

SEQ ID NO: 470529 - DNA, 20 bp, Artificial
  CRISPR gRNA sequence
tttttgtatttttagtagag

SEQ ID NO: 470530 - DNA, 20 bp, Artificial
  CRISPR gRNA sequence
ttttgtatttttagtagaga

SEQ ID NO: 470531 - DNA, 20 bp, Artificial
  CRISPR gRNA sequence
tttgtatttttagtagagac

SEQ ID NO: 470532 - DNA, 20 bp, Artificial
  CRISPR gRNA sequence
ttgtatttttagtagagacg

SEQ ID NO: 470533 - DNA, 20 bp, Artificial
  CRISPR gRNA sequence
tgtatttttagtagagacgg

SEQ ID NO: 470534 - DNA, 20 bp, Artificial
  CRISPR gRNA sequence
gtatttttagtagagacggg

SEQ ID NO: 470535 - DNA, 20 bp, Artificial
  CRISPR gRNA sequence
tatttttagtagagacgggg

SEQ ID NO: 470536 - DNA, 20 bp, Artificial
  CRISPR gRNA sequence
ttagtagagacggggtttca

SEQ ID NO: 470537 - DNA, 20 bp, Artificial
  CRISPR gRNA sequence
tagtagagacggggtttcac

SEQ ID NO: 470538 - DNA, 20 bp, Artificial
  CRISPR gRNA sequence
agtagagacggggtttcacc

SEQ ID NO: 470539 - DNA, 20 bp, Artificial
  CRISPR gRNA sequence
gtagagacggggtttcacca

SEQ ID NO: 470540 - DNA, 20 bp, Artificial
  CRISPR gRNA sequence
caccattttagccaggatgg

SEQ ID NO: 470541 - DNA, 20 bp, Artificial
  CRISPR gRNA sequence
accattttagccaggatggt

SEQ ID NO: 470542 - DNA, 20 bp, Artificial
  CRISPR gRNA sequence
tagccaggatggtctcgatc

SEQ ID NO: 470543 - DNA, 20 bp, Artificial
  CRISPR gRNA sequence
agccaggatggtctcgatct

SEQ ID NO: 470544 - DNA, 20 bp, Artificial
  CRISPR gRNA sequence
gccaggatggtctcgatctc

SEQ ID NO: 470545 - DNA, 20 bp, Artificial
  CRISPR gRNA sequence
gatctcctgacctcgtgatc

SEQ ID NO: 470546 - DNA, 20 bp, Artificial
  CRISPR gRNA sequence
ctgacctcgtgatccgcccg

SEQ ID NO: 470547 - DNA, 20 bp, Artificial
  CRISPR gRNA sequence
acctcgtgatccgcccgcct

SEQ ID NO: 470548 - DNA, 20 bp, Artificial
  CRISPR gRNA sequence
gtgatccgcccgcctcggcc

SEQ ID NO: 470549 - DNA, 20 bp, Artificial
  CRISPR gRNA sequence
ggcctcccaaagtgcgagga

SEQ ID NO: 470550 - DNA, 20 bp, Artificial
  CRISPR gRNA sequence
ccaaagtgcgaggattatag

SEQ ID NO: 470551 - DNA, 20 bp, Artificial
  CRISPR gRNA sequence
tagacgtgagccaccactcc

SEQ ID NO: 470552 - DNA, 20 bp, Artificial
  CRISPR gRNA sequence
ccggcaagaaaattcttacc

SEQ ID NO: 470553 - DNA, 20 bp, Artificial
  CRISPR gRNA sequence
ttaccgtttcaaatatagcc

SEQ ID NO: 470554 - DNA, 20 bp, Artificial
  CRISPR gRNA sequence
accgtttcaaatatagccaa

SEQ ID NO: 470555 - DNA, 20 bp, Artificial
  CRISPR gRNA sequence
ccgtttcaaatatagccaaa

SEQ ID NO: 470556 - DNA, 20 bp, Artificial
  CRISPR gRNA sequence
caaatatagccaaatatctt

SEQ ID NO: 470557 - DNA, 20 bp, Artificial
  CRISPR gRNA sequence
aaatatagccaaatatctta

SEQ ID NO: 470558 - DNA, 20 bp, Artificial
  CRISPR gRNA sequence
agagcttctaagaaagaggt

SEQ ID NO: 470559 - DNA, 20 bp, Artificial
  CRISPR gRNA sequence
gagcttctaagaaagaggtg

SEQ ID NO: 470560 - DNA, 20 bp, Artificial
  CRISPR gRNA sequence
ctaagaaagaggtgaatttg

SEQ ID NO: 470561 - DNA, 20 bp, Artificial
  CRISPR gRNA sequence
taagaaagaggtgaatttgt

SEQ ID NO: 470562 - DNA, 20 bp, Artificial
  CRISPR gRNA sequence
agaaagaggtgaatttgtaa

SEQ ID NO: 470563 - DNA, 20 bp, Artificial
  CRISPR gRNA sequence
gtaaaaacaaaaagtaaaat

SEQ ID NO: 470564 - DNA, 20 bp, Artificial
  CRISPR gRNA sequence
taaaaacaaaaagtaaaatt

SEQ ID NO: 470565 - DNA, 20 bp, Artificial
  CRISPR gRNA sequence
gtcctgatgttttctcactc

SEQ ID NO: 470566 - DNA, 20 bp, Artificial
  CRISPR gRNA sequence
atgttttctcactcttcagt

SEQ ID NO: 470567 - DNA, 20 bp, Artificial
  CRISPR gRNA sequence
tctcactcttcagttattta

SEQ ID NO: 470568 - DNA, 20 bp, Artificial
  CRISPR gRNA sequence
ctcactcttcagttatttat

SEQ ID NO: 470569 - DNA, 20 bp, Artificial
  CRISPR gRNA sequence
tcactcttcagttatttatt

SEQ ID NO: 470570 - DNA, 20 bp, Artificial
  CRISPR gRNA sequence
actcttcagttatttattag

SEQ ID NO: 470571 - DNA, 20 bp, Artificial
  CRISPR gRNA sequence
ttcagttatttattagccgc

SEQ ID NO: 470572 - DNA, 20 bp, Artificial
  CRISPR gRNA sequence
cagttatttattagccgctc

SEQ ID NO: 470573 - DNA, 20 bp, Artificial
  CRISPR gRNA sequence
agttatttattagccgctcc

SEQ ID NO: 470574 - DNA, 20 bp, Artificial
  CRISPR gRNA sequence
tttattagccgctcctacct

SEQ ID NO: 470575 - DNA, 20 bp, Artificial
  CRISPR gRNA sequence
attagccgctcctacctata

SEQ ID NO: 470576 - DNA, 20 bp, Artificial
  CRISPR gRNA sequence
ttagccgctcctacctatac

SEQ ID NO: 470577 - DNA, 20 bp, Artificial
  CRISPR gRNA sequence
gccgctcctacctatacaaa

SEQ ID NO: 470578 - DNA, 20 bp, Artificial
  CRISPR gRNA sequence
ctacctatacaaaggttcac

SEQ ID NO: 470579 - DNA, 20 bp, Artificial
  CRISPR gRNA sequence
cctatacaaaggttcacctg

SEQ ID NO: 470580 - DNA, 20 bp, Artificial
  CRISPR gRNA sequence
tacaaaggttcacctgacaa

SEQ ID NO: 470581 - DNA, 20 bp, Artificial
  CRISPR gRNA sequence
acctgacaaagaagatgtgt

SEQ ID NO: 470582 - DNA, 20 bp, Artificial
  CRISPR gRNA sequence
acaaagaagatgtgttcatt

SEQ ID NO: 470583 - DNA, 20 bp, Artificial
  CRISPR gRNA sequence
attctaggggctatttcagt

SEQ ID NO: 470584 - DNA, 20 bp, Artificial
  CRISPR gRNA sequence
taggggctatttcagttttt

SEQ ID NO: 470585 - DNA, 20 bp, Artificial
  CRISPR gRNA sequence
ggggctatttcagtttttta

SEQ ID NO: 470586 - DNA, 20 bp, Artificial
  CRISPR gRNA sequence
tttcagttttttaaattcaa

SEQ ID NO: 470587 - DNA, 20 bp, Artificial
  CRISPR gRNA sequence
cagttttttaaattcaagtt

SEQ ID NO: 470588 - DNA, 20 bp, Artificial
  CRISPR gRNA sequence
agttttttaaattcaagttt

SEQ ID NO: 470589 - DNA, 20 bp, Artificial
  CRISPR gRNA sequence
tttaaattcaagttttgccc

SEQ ID NO: 470590 - DNA, 20 bp, Artificial
  CRISPR gRNA sequence
ttaaattcaagttttgccca

SEQ ID NO: 470591 - DNA, 20 bp, Artificial
  CRISPR gRNA sequence
taaattcaagttttgcccat

SEQ ID NO: 470592 - DNA, 20 bp, Artificial
  CRISPR gRNA sequence
aaattcaagttttgcccatc

SEQ ID NO: 470593 - DNA, 20 bp, Artificial
  CRISPR gRNA sequence
aattcaagttttgcccatcg

SEQ ID NO: 470594 - DNA, 20 bp, Artificial
  CRISPR gRNA sequence
aagttttgcccatcgatttc

SEQ ID NO: 470595 - DNA, 20 bp, Artificial
  CRISPR gRNA sequence
tgcccatcgatttccgttct

SEQ ID NO: 470596 - DNA, 20 bp, Artificial
  CRISPR gRNA sequence
gcccatcgatttccgttctt

SEQ ID NO: 470597 - DNA, 20 bp, Artificial
  CRISPR gRNA sequence
cccatcgatttccgttcttg

SEQ ID NO: 470598 - DNA, 20 bp, Artificial
  CRISPR gRNA sequence
ccgttcttgacatctggcct

SEQ ID NO: 470599 - DNA, 20 bp, Artificial
  CRISPR gRNA sequence
cgttcttgacatctggccta

SEQ ID NO: 470600 - DNA, 20 bp, Artificial
  CRISPR gRNA sequence
ttgacatctggcctaactcc

SEQ ID NO: 470601 - DNA, 20 bp, Artificial
  CRISPR gRNA sequence
gacatctggcctaactcctt

SEQ ID NO: 470602 - DNA, 20 bp, Artificial
  CRISPR gRNA sequence
acatctggcctaactccttt

SEQ ID NO: 470603 - DNA, 20 bp, Artificial
  CRISPR gRNA sequence
gcctaactcctttaaggtat

SEQ ID NO: 470604 - DNA, 20 bp, Artificial
  CRISPR gRNA sequence
actcctttaaggtatcaagt

SEQ ID NO: 470605 - DNA, 20 bp, Artificial
  CRISPR gRNA sequence
ctttaaggtatcaagtccac

SEQ ID NO: 470606 - DNA, 20 bp, Artificial
  CRISPR gRNA sequence
taaggtatcaagtccactgt

SEQ ID NO: 470607 - DNA, 20 bp, Artificial
  CRISPR gRNA sequence
aaggtatcaagtccactgtc

SEQ ID NO: 470608 - DNA, 20 bp, Artificial
  CRISPR gRNA sequence
aggtatcaagtccactgtct

SEQ ID NO: 470609 - DNA, 20 bp, Artificial
  CRISPR gRNA sequence
tctttgaaagtcaacatact

SEQ ID NO: 470610 - DNA, 20 bp, Artificial
  CRISPR gRNA sequence
tgaaagtcaacatactttgt

SEQ ID NO: 470611 - DNA, 20 bp, Artificial
  CRISPR gRNA sequence
gaaagtcaacatactttgtc

SEQ ID NO: 470612 - DNA, 20 bp, Artificial
  CRISPR gRNA sequence
aaagtcaacatactttgtct

SEQ ID NO: 470613 - DNA, 20 bp, Artificial
  CRISPR gRNA sequence
tgtctggtcctttgtcatcc

SEQ ID NO: 470614 - DNA, 20 bp, Artificial
  CRISPR gRNA sequence
gtctggtcctttgtcatcct

SEQ ID NO: 470615 - DNA, 20 bp, Artificial
  CRISPR gRNA sequence
tctggtcctttgtcatcctc

SEQ ID NO: 470616 - DNA, 20 bp, Artificial
  CRISPR gRNA sequence
gtcctttgtcatcctcattg

SEQ ID NO: 470617 - DNA, 20 bp, Artificial
  CRISPR gRNA sequence
tgtcatcctcattgtgatgt

SEQ ID NO: 470618 - DNA, 20 bp, Artificial
  CRISPR gRNA sequence
gtcatcctcattgtgatgtg

SEQ ID NO: 470619 - DNA, 20 bp, Artificial
  CRISPR gRNA sequence
tcatcctcattgtgatgtgt

SEQ ID NO: 470620 - DNA, 20 bp, Artificial
  CRISPR gRNA sequence
attgtgatgtgtgcagtagg

SEQ ID NO: 470621 - DNA, 20 bp, Artificial
  CRISPR gRNA sequence
tgatgtgtgcagtaggatgt

SEQ ID NO: 470622 - DNA, 20 bp, Artificial
  CRISPR gRNA sequence
tggcagatttccttggcaga

SEQ ID NO: 470623 - DNA, 20 bp, Artificial
  CRISPR gRNA sequence
ccttggcagagctctatcat

SEQ ID NO: 470624 - DNA, 20 bp, Artificial
  CRISPR gRNA sequence
cttggcagagctctatcatg

SEQ ID NO: 470625 - DNA, 20 bp, Artificial
  CRISPR gRNA sequence
ggcagagctctatcatgcaa

SEQ ID NO: 470626 - DNA, 20 bp, Artificial
  CRISPR gRNA sequence
gcagagctctatcatgcaag

SEQ ID NO: 470627 - DNA, 20 bp, Artificial
  CRISPR gRNA sequence
tatcatgcaagcatgtctgg

SEQ ID NO: 470628 - DNA, 20 bp, Artificial
  CRISPR gRNA sequence
tcatgcaagcatgtctggct

SEQ ID NO: 470629 - DNA, 20 bp, Artificial
  CRISPR gRNA sequence
gctttaccctgagaagctat

SEQ ID NO: 470630 - DNA, 20 bp, Artificial
  CRISPR gRNA sequence
taccctgagaagctatgtaa

SEQ ID NO: 470631 - DNA, 20 bp, Artificial
  CRISPR gRNA sequence
accctgagaagctatgtaag

SEQ ID NO: 470632 - DNA, 20 bp, Artificial
  CRISPR gRNA sequence
ccctgagaagctatgtaaga

SEQ ID NO: 470633 - DNA, 20 bp, Artificial
  CRISPR gRNA sequence
agaagctatgtaagaattcc

SEQ ID NO: 470634 - DNA, 20 bp, Artificial
  CRISPR gRNA sequence
tgtaagaattcctgatacag

SEQ ID NO: 470635 - DNA, 20 bp, Artificial
  CRISPR gRNA sequence
ctgatacagtgccaccctct

SEQ ID NO: 470636 - DNA, 20 bp, Artificial
  CRISPR gRNA sequence
atacagtgccaccctctgat

SEQ ID NO: 470637 - DNA, 20 bp, Artificial
  CRISPR gRNA sequence
tgatgtggtggctgcccaaa

SEQ ID NO: 470638 - DNA, 20 bp, Artificial
  CRISPR gRNA sequence
atgtggtggctgcccaaaaa

SEQ ID NO: 470639 - DNA, 20 bp, Artificial
  CRISPR gRNA sequence
cccaaaaataacagtaaggc

SEQ ID NO: 470640 - DNA, 20 bp, Artificial
  CRISPR gRNA sequence
agcgactgaaagaggcagag

SEQ ID NO: 470641 - DNA, 20 bp, Artificial
  CRISPR gRNA sequence
aaagaggcagaggctgcttg

SEQ ID NO: 470642 - DNA, 20 bp, Artificial
  CRISPR gRNA sequence
cttggctaagataaaaagta

SEQ ID NO: 470643 - DNA, 20 bp, Artificial
  CRISPR gRNA sequence
ggctaagataaaaagtactc

SEQ ID NO: 470644 - DNA, 20 bp, Artificial
  CRISPR gRNA sequence
gctaagataaaaagtactcc

SEQ ID NO: 470645 - DNA, 20 bp, Artificial
  CRISPR gRNA sequence
agataaaaagtactcccaac

SEQ ID NO: 470646 - DNA, 20 bp, Artificial
  CRISPR gRNA sequence
ccaactccactgaaaagagc

SEQ ID NO: 470647 - DNA, 20 bp, Artificial
  CRISPR gRNA sequence
cactgaaaagagcctggttg

SEQ ID NO: 470648 - DNA, 20 bp, Artificial
  CRISPR gRNA sequence
aaaagagcctggttgaggtc

SEQ ID NO: 470649 - DNA, 20 bp, Artificial
  CRISPR gRNA sequence
gttgaggtcagtaggtggca

SEQ ID NO: 470650 - DNA, 20 bp, Artificial
  CRISPR gRNA sequence
aggtcagtaggtggcacact

SEQ ID NO: 470651 - DNA, 20 bp, Artificial
  CRISPR gRNA sequence
aagaagactgtcaagtgaac

SEQ ID NO: 470652 - DNA, 20 bp, Artificial
  CRISPR gRNA sequence
tcaagtgaactgaaaaatag

SEQ ID NO: 470653 - DNA, 20 bp, Artificial
  CRISPR gRNA sequence
aaaaatagcctttagtcctc

SEQ ID NO: 470654 - DNA, 20 bp, Artificial
  CRISPR gRNA sequence
tagtcctcaatatatcaaca

SEQ ID NO: 470655 - DNA, 20 bp, Artificial
  CRISPR gRNA sequence
agtcctcaatatatcaacaa

SEQ ID NO: 470656 - DNA, 20 bp, Artificial
  CRISPR gRNA sequence
gtcctcaatatatcaacaaa

SEQ ID NO: 470657 - DNA, 20 bp, Artificial
  CRISPR gRNA sequence
aatatatcaacaaagatcct

SEQ ID NO: 470658 - DNA, 20 bp, Artificial
  CRISPR gRNA sequence
tgatacttttcaatctgttt

SEQ ID NO: 470659 - DNA, 20 bp, Artificial
  CRISPR gRNA sequence
ttcaatctgtttaagcctgt

SEQ ID NO: 470660 - DNA, 20 bp, Artificial
  CRISPR gRNA sequence
tcaatctgtttaagcctgtc

SEQ ID NO: 470661 - DNA, 20 bp, Artificial
  CRISPR gRNA sequence
caatctgtttaagcctgtca

SEQ ID NO: 470662 - DNA, 20 bp, Artificial
  CRISPR gRNA sequence
aatctgtttaagcctgtcaa

SEQ ID NO: 470663 - DNA, 20 bp, Artificial
  CRISPR gRNA sequence
tttaagcctgtcaattgggt

SEQ ID NO: 470664 - DNA, 20 bp, Artificial
  CRISPR gRNA sequence
aagcctgtcaattgggttcc

SEQ ID NO: 470665 - DNA, 20 bp, Artificial
  CRISPR gRNA sequence
agcctgtcaattgggttccc

SEQ ID NO: 470666 - DNA, 20 bp, Artificial
  CRISPR gRNA sequence
tcaattgggttccctgtctc

SEQ ID NO: 470667 - DNA, 20 bp, Artificial
  CRISPR gRNA sequence
ggttccctgtctctcatccc

SEQ ID NO: 470668 - DNA, 20 bp, Artificial
  CRISPR gRNA sequence
cctgtctctcatcccaagaa

SEQ ID NO: 470669 - DNA, 20 bp, Artificial
  CRISPR gRNA sequence
tctctcatcccaagaaatgg

SEQ ID NO: 470670 - DNA, 20 bp, Artificial
  CRISPR gRNA sequence
tcatcccaagaaatggctca

SEQ ID NO: 470671 - DNA, 20 bp, Artificial
  CRISPR gRNA sequence
atcccaagaaatggctcatt

SEQ ID NO: 470672 - DNA, 20 bp, Artificial
  CRISPR gRNA sequence
atttccatgaaaaattttgt

SEQ ID NO: 470673 - DNA, 20 bp, Artificial
  CRISPR gRNA sequence
ccatgaaaaattttgttaaa

SEQ ID NO: 470674 - DNA, 20 bp, Artificial
  CRISPR gRNA sequence
catgaaaaattttgttaaaa

SEQ ID NO: 470675 - DNA, 20 bp, Artificial
  CRISPR gRNA sequence
tgttaaaatgaatggagcaa

SEQ ID NO: 470676 - DNA, 20 bp, Artificial
  CRISPR gRNA sequence
gttaaaatgaatggagcaaa

SEQ ID NO: 470677 - DNA, 20 bp, Artificial
  CRISPR gRNA sequence
ttaaaatgaatggagcaaaa

SEQ ID NO: 470678 - DNA, 20 bp, Artificial
  CRISPR gRNA sequence
aaatgaatggagcaaaagaa

SEQ ID NO: 470679 - DNA, 20 bp, Artificial
  CRISPR gRNA sequence
tgcagcacccctgctgtggc

SEQ ID NO: 470680 - DNA, 20 bp, Artificial
  CRISPR gRNA sequence
cagcacccctgctgtggcac

SEQ ID NO: 470681 - DNA, 20 bp, Artificial
  CRISPR gRNA sequence
ctgtggcaccccgtcaaagt

SEQ ID NO: 470682 - DNA, 20 bp, Artificial
  CRISPR gRNA sequence
tggcaccccgtcaaagtggc

SEQ ID NO: 470683 - DNA, 20 bp, Artificial
  CRISPR gRNA sequence
ggtgccacaaggccaatgca

SEQ ID NO: 470684 - DNA, 20 bp, Artificial
  CRISPR gRNA sequence
acattcctatggcaggttac

SEQ ID NO: 470685 - DNA, 20 bp, Artificial
  CRISPR gRNA sequence
cattcctatggcaggttaca

SEQ ID NO: 470686 - DNA, 20 bp, Artificial
  CRISPR gRNA sequence
ctatggcaggttacagtata

SEQ ID NO: 470687 - DNA, 20 bp, Artificial
  CRISPR gRNA sequence
tggcaggttacagtatacaa

SEQ ID NO: 470688 - DNA, 20 bp, Artificial
  CRISPR gRNA sequence
cagtatacaaagcattttaa

SEQ ID NO: 470689 - DNA, 20 bp, Artificial
  CRISPR gRNA sequence
taaaatttgtatttatagta

SEQ ID NO: 470690 - DNA, 20 bp, Artificial
  CRISPR gRNA sequence
aaaatttgtatttatagtat

SEQ ID NO: 470691 - DNA, 20 bp, Artificial
  CRISPR gRNA sequence
aaatttgtatttatagtata

SEQ ID NO: 470692 - DNA, 20 bp, Artificial
  CRISPR gRNA sequence
gtatttatagtatatgttta

SEQ ID NO: 470693 - DNA, 20 bp, Artificial
  CRISPR gRNA sequence
tatttatagtatatgtttag

SEQ ID NO: 470694 - DNA, 20 bp, Artificial
  CRISPR gRNA sequence
atagtatatgtttagatgta

SEQ ID NO: 470695 - DNA, 20 bp, Artificial
  CRISPR gRNA sequence
tagtatatgtttagatgtaa

SEQ ID NO: 470696 - DNA, 20 bp, Artificial
  CRISPR gRNA sequence
agatgtaattcacatgccat

SEQ ID NO: 470697 - DNA, 20 bp, Artificial
  CRISPR gRNA sequence
gatgtaattcacatgccata

SEQ ID NO: 470698 - DNA, 20 bp, Artificial
  CRISPR gRNA sequence
acatgccataaaattcaccc

SEQ ID NO: 470699 - DNA, 20 bp, Artificial
  CRISPR gRNA sequence
acccttttaagtgtacaatt

SEQ ID NO: 470700 - DNA, 20 bp, Artificial
  CRISPR gRNA sequence
ttaagtgtacaattcagtgg

SEQ ID NO: 470701 - DNA, 20 bp, Artificial
  CRISPR gRNA sequence
taagtgtacaattcagtggt

SEQ ID NO: 470702 - DNA, 20 bp, Artificial
  CRISPR gRNA sequence
aagtgtacaattcagtggtt

SEQ ID NO: 470703 - DNA, 20 bp, Artificial
  CRISPR gRNA sequence
agtgtacaattcagtggttt

SEQ ID NO: 470704 - DNA, 20 bp, Artificial
  CRISPR gRNA sequence
agtggtttttattaggcaag

SEQ ID NO: 470705 - DNA, 20 bp, Artificial
  CRISPR gRNA sequence
ttattaggcaagcactttat

SEQ ID NO: 470706 - DNA, 20 bp, Artificial
  CRISPR gRNA sequence
tattaggcaagcactttata

SEQ ID NO: 470707 - DNA, 20 bp, Artificial
  CRISPR gRNA sequence
attaggcaagcactttatac

SEQ ID NO: 470708 - DNA, 20 bp, Artificial
  CRISPR gRNA sequence
ttaggcaagcactttatacc

SEQ ID NO: 470709 - DNA, 20 bp, Artificial
  CRISPR gRNA sequence
ggcaagcactttataccctc

SEQ ID NO: 470710 - DNA, 20 bp, Artificial
  CRISPR gRNA sequence
tataccctcaaaggaccgtt

SEQ ID NO: 470711 - DNA, 20 bp, Artificial
  CRISPR gRNA sequence
ataccctcaaaggaccgttt

SEQ ID NO: 470712 - DNA, 20 bp, Artificial
  CRISPR gRNA sequence
taccctcaaaggaccgtttt

SEQ ID NO: 470713 - DNA, 20 bp, Artificial
  CRISPR gRNA sequence
aaaggaccgttttggattaa

SEQ ID NO: 470714 - DNA, 20 bp, Artificial
  CRISPR gRNA sequence
tggattaagatcagagcttt

SEQ ID NO: 470715 - DNA, 20 bp, Artificial
  CRISPR gRNA sequence
ggattaagatcagagctttg

SEQ ID NO: 470716 - DNA, 20 bp, Artificial
  CRISPR gRNA sequence
gattaagatcagagctttgg

SEQ ID NO: 470717 - DNA, 20 bp, Artificial
  CRISPR gRNA sequence
agatcagagctttggctttt

SEQ ID NO: 470718 - DNA, 20 bp, Artificial
  CRISPR gRNA sequence
tggcttttatatgtacctgt

SEQ ID NO: 470719 - DNA, 20 bp, Artificial
  CRISPR gRNA sequence
ggcttttatatgtacctgtt

SEQ ID NO: 470720 - DNA, 20 bp, Artificial
  CRISPR gRNA sequence
gcttttatatgtacctgtta

SEQ ID NO: 470721 - DNA, 20 bp, Artificial
  CRISPR gRNA sequence
ttatatgtacctgttacatt

SEQ ID NO: 470722 - DNA, 20 bp, Artificial
  CRISPR gRNA sequence
tatatgtacctgttacattt

SEQ ID NO: 470723 - DNA, 20 bp, Artificial
  CRISPR gRNA sequence
atatgtacctgttacatttg

SEQ ID NO: 470724 - DNA, 20 bp, Artificial
  CRISPR gRNA sequence
tatgtacctgttacatttgt

SEQ ID NO: 470725 - DNA, 20 bp, Artificial
  CRISPR gRNA sequence
ttacatttgtaccagttcct

SEQ ID NO: 470726 - DNA, 20 bp, Artificial
  CRISPR gRNA sequence
catttgtaccagttcctttc

SEQ ID NO: 470727 - DNA, 20 bp, Artificial
  CRISPR gRNA sequence
gtaccagttcctttcctgtc

SEQ ID NO: 470728 - DNA, 20 bp, Artificial
  CRISPR gRNA sequence
taccagttcctttcctgtca

SEQ ID NO: 470729 - DNA, 20 bp, Artificial
  CRISPR gRNA sequence
ctttcctgtcatgtttatac

SEQ ID NO: 470730 - DNA, 20 bp, Artificial
  CRISPR gRNA sequence
tcctgtcatgtttataccag

SEQ ID NO: 470731 - DNA, 20 bp, Artificial
  CRISPR gRNA sequence
cctgtcatgtttataccagt

SEQ ID NO: 470732 - DNA, 20 bp, Artificial
  CRISPR gRNA sequence
ctgtcatgtttataccagtt

SEQ ID NO: 470733 - DNA, 20 bp, Artificial
  CRISPR gRNA sequence
tcatgtttataccagttcct

SEQ ID NO: 470734 - DNA, 20 bp, Artificial
  CRISPR gRNA sequence
ataccagttcctttctgtac

SEQ ID NO: 470735 - DNA, 20 bp, Artificial
  CRISPR gRNA sequence
taccagttcctttctgtact

SEQ ID NO: 470736 - DNA, 20 bp, Artificial
  CRISPR gRNA sequence
ctttctgtactttgatttct

SEQ ID NO: 470737 - DNA, 20 bp, Artificial
  CRISPR gRNA sequence
tctgtactttgatttctcca

SEQ ID NO: 470738 - DNA, 20 bp, Artificial
  CRISPR gRNA sequence
ctgtactttgatttctccac

SEQ ID NO: 470739 - DNA, 20 bp, Artificial
  CRISPR gRNA sequence
tgtactttgatttctccaca

SEQ ID NO: 470740 - DNA, 20 bp, Artificial
  CRISPR gRNA sequence
tactttgatttctccacagt

SEQ ID NO: 470741 - DNA, 20 bp, Artificial
  CRISPR gRNA sequence
tgatttctccacagttccca

SEQ ID NO: 470742 - DNA, 20 bp, Artificial
  CRISPR gRNA sequence
gatttctccacagttcccaa

SEQ ID NO: 470743 - DNA, 20 bp, Artificial
  CRISPR gRNA sequence
atttctccacagttcccaaa

SEQ ID NO: 470744 - DNA, 20 bp, Artificial
  CRISPR gRNA sequence
ctccacagttcccaaactag

SEQ ID NO: 470745 - DNA, 20 bp, Artificial
  CRISPR gRNA sequence
tccacagttcccaaactagt

SEQ ID NO: 470746 - DNA, 20 bp, Artificial
  CRISPR gRNA sequence
cacagttcccaaactagttt

SEQ ID NO: 470747 - DNA, 20 bp, Artificial
  CRISPR gRNA sequence
ccaaactagttttatgttaa

SEQ ID NO: 470748 - DNA, 20 bp, Artificial
  CRISPR gRNA sequence
gttttatgttaagaaatatt

SEQ ID NO: 470749 - DNA, 20 bp, Artificial
  CRISPR gRNA sequence
tatgttaagaaatatttagc

SEQ ID NO: 470750 - DNA, 20 bp, Artificial
  CRISPR gRNA sequence
atgttaagaaatatttagcc

SEQ ID NO: 470751 - DNA, 20 bp, Artificial
  CRISPR gRNA sequence
tgttaagaaatatttagccc

SEQ ID NO: 470752 - DNA, 20 bp, Artificial
  CRISPR gRNA sequence
agaaatatttagccccaagg

SEQ ID NO: 470753 - DNA, 20 bp, Artificial
  CRISPR gRNA sequence
agccccaagggtataatatg

SEQ ID NO: 470754 - DNA, 20 bp, Artificial
  CRISPR gRNA sequence
gccccaagggtataatatgg

SEQ ID NO: 470755 - DNA, 20 bp, Artificial
  CRISPR gRNA sequence
ttgattattttctgaaatgc

SEQ ID NO: 470756 - DNA, 20 bp, Artificial
  CRISPR gRNA sequence
tgattattttctgaaatgct

SEQ ID NO: 470757 - DNA, 20 bp, Artificial
  CRISPR gRNA sequence
gattattttctgaaatgcta

SEQ ID NO: 470758 - DNA, 20 bp, Artificial
  CRISPR gRNA sequence
attattttctgaaatgctag

SEQ ID NO: 470759 - DNA, 20 bp, Artificial
  CRISPR gRNA sequence
ttttctgaaatgctagacaa

SEQ ID NO: 470760 - DNA, 20 bp, Artificial
  CRISPR gRNA sequence
tctgaaatgctagacaactg

SEQ ID NO: 470761 - DNA, 20 bp, Artificial
  CRISPR gRNA sequence
ctgaaatgctagacaactga

SEQ ID NO: 470762 - DNA, 20 bp, Artificial
  CRISPR gRNA sequence
tgaaatgctagacaactgaa

SEQ ID NO: 470763 - DNA, 20 bp, Artificial
  CRISPR gRNA sequence
aaatgctagacaactgaaat

SEQ ID NO: 470764 - DNA, 20 bp, Artificial
  CRISPR gRNA sequence
gacaactgaaatggggcaaa

SEQ ID NO: 470765 - DNA, 20 bp, Artificial
  CRISPR gRNA sequence
aaatggggcaaaaatcttca

SEQ ID NO: 470766 - DNA, 20 bp, Artificial
  CRISPR gRNA sequence
caaattcctgttaatagcaa

SEQ ID NO: 470767 - DNA, 20 bp, Artificial
  CRISPR gRNA sequence
aaattcctgttaatagcaaa

SEQ ID NO: 470768 - DNA, 20 bp, Artificial
  CRISPR gRNA sequence
ctgttaatagcaaaaacgct

SEQ ID NO: 470769 - DNA, 20 bp, Artificial
  CRISPR gRNA sequence
ttaatagcaaaaacgcttta

SEQ ID NO: 470770 - DNA, 20 bp, Artificial
  CRISPR gRNA sequence
atagcaaaaacgctttaaaa

SEQ ID NO: 470771 - DNA, 20 bp, Artificial
  CRISPR gRNA sequence
taaaacaaacttcccagaca

SEQ ID NO: 470772 - DNA, 20 bp, Artificial
  CRISPR gRNA sequence
aaaacaaacttcccagacaa

SEQ ID NO: 470773 - DNA, 20 bp, Artificial
  CRISPR gRNA sequence
aaacaaacttcccagacaat

SEQ ID NO: 470774 - DNA, 20 bp, Artificial
  CRISPR gRNA sequence
cccagacaattgcacataca

SEQ ID NO: 470775 - DNA, 20 bp, Artificial
  CRISPR gRNA sequence
ccagacaattgcacatacag

SEQ ID NO: 470776 - DNA, 20 bp, Artificial
  CRISPR gRNA sequence
cacatacagaaaataccctt

SEQ ID NO: 470777 - DNA, 20 bp, Artificial
  CRISPR gRNA sequence
ttgaattaagcttcaaatca

SEQ ID NO: 470778 - DNA, 20 bp, Artificial
  CRISPR gRNA sequence
tgaattaagcttcaaatcat

SEQ ID NO: 470779 - DNA, 20 bp, Artificial
  CRISPR gRNA sequence
gaattaagcttcaaatcata

SEQ ID NO: 470780 - DNA, 20 bp, Artificial
  CRISPR gRNA sequence
aattaagcttcaaatcataa

SEQ ID NO: 470781 - DNA, 20 bp, Artificial
  CRISPR gRNA sequence
agcttcaaatcataatttat

SEQ ID NO: 470782 - DNA, 20 bp, Artificial
  CRISPR gRNA sequence
caaatcataatttatccagc

SEQ ID NO: 470783 - DNA, 20 bp, Artificial
  CRISPR gRNA sequence
aaatcataatttatccagcc

SEQ ID NO: 470784 - DNA, 20 bp, Artificial
  CRISPR gRNA sequence
atccagcctacccaggaaga

SEQ ID NO: 470785 - DNA, 20 bp, Artificial
  CRISPR gRNA sequence
tccagcctacccaggaagaa

SEQ ID NO: 470786 - DNA, 20 bp, Artificial
  CRISPR gRNA sequence
cccaggaagaacaatgtcca

SEQ ID NO: 470787 - DNA, 20 bp, Artificial
  CRISPR gRNA sequence
aaccaacctgggttttactt

SEQ ID NO: 470788 - DNA, 20 bp, Artificial
  CRISPR gRNA sequence
accaacctgggttttacttg

SEQ ID NO: 470789 - DNA, 20 bp, Artificial
  CRISPR gRNA sequence
ggttttacttgcacagtaaa

SEQ ID NO: 470790 - DNA, 20 bp, Artificial
  CRISPR gRNA sequence
tacttgcacagtaaattatt

SEQ ID NO: 470791 - DNA, 20 bp, Artificial
  CRISPR gRNA sequence
acttgcacagtaaattattt

SEQ ID NO: 470792 - DNA, 20 bp, Artificial
  CRISPR gRNA sequence
cttgcacagtaaattattta

SEQ ID NO: 470793 - DNA, 20 bp, Artificial
  CRISPR gRNA sequence
gcacagtaaattatttagat

SEQ ID NO: 470794 - DNA, 20 bp, Artificial
  CRISPR gRNA sequence
cacagtaaattatttagatt

SEQ ID NO: 470795 - DNA, 20 bp, Artificial
  CRISPR gRNA sequence
tttagatttttatcttaaat

SEQ ID NO: 470796 - DNA, 20 bp, Artificial
  CRISPR gRNA sequence
agatttttatcttaaataat

SEQ ID NO: 470797 - DNA, 20 bp, Artificial
  CRISPR gRNA sequence
gatttttatcttaaataatt

SEQ ID NO: 470798 - DNA, 20 bp, Artificial
  CRISPR gRNA sequence
ttatcttaaataatttcata

SEQ ID NO: 470799 - DNA, 20 bp, Artificial
  CRISPR gRNA sequence
tatcttaaataatttcatag

SEQ ID NO: 470800 - DNA, 20 bp, Artificial
  CRISPR gRNA sequence
atcttaaataatttcatagc

SEQ ID NO: 470801 - DNA, 20 bp, Artificial
  CRISPR gRNA sequence
tcttaaataatttcatagct

SEQ ID NO: 470802 - DNA, 20 bp, Artificial
  CRISPR gRNA sequence
aaataatttcatagctccct

SEQ ID NO: 470803 - DNA, 20 bp, Artificial
  CRISPR gRNA sequence
aataatttcatagctccctg

SEQ ID NO: 470804 - DNA, 20 bp, Artificial
  CRISPR gRNA sequence
catagctccctggccttatt

SEQ ID NO: 470805 - DNA, 20 bp, Artificial
  CRISPR gRNA sequence
atagctccctggccttattg

SEQ ID NO: 470806 - DNA, 20 bp, Artificial
  CRISPR gRNA sequence
cctggccttattgtaatcaa

SEQ ID NO: 470807 - DNA, 20 bp, Artificial
  CRISPR gRNA sequence
gccttattgtaatcaagtga

SEQ ID NO: 470808 - DNA, 20 bp, Artificial
  CRISPR gRNA sequence
attgtaatcaagtgaaattt

SEQ ID NO: 470809 - DNA, 20 bp, Artificial
  CRISPR gRNA sequence
ttgtaatcaagtgaaatttt

SEQ ID NO: 470810 - DNA, 20 bp, Artificial
  CRISPR gRNA sequence
taatcaagtgaaatttttat

SEQ ID NO: 470811 - DNA, 20 bp, Artificial
  CRISPR gRNA sequence
ttattattatttactataga

SEQ ID NO: 470812 - DNA, 20 bp, Artificial
  CRISPR gRNA sequence
tattattatttactatagaa

SEQ ID NO: 470813 - DNA, 20 bp, Artificial
  CRISPR gRNA sequence
attattatttactatagaaa

SEQ ID NO: 470814 - DNA, 20 bp, Artificial
  CRISPR gRNA sequence
ttattatttactatagaaag

SEQ ID NO: 470815 - DNA, 20 bp, Artificial
  CRISPR gRNA sequence
ttatttactatagaaagaaa

SEQ ID NO: 470816 - DNA, 20 bp, Artificial
  CRISPR gRNA sequence
tttactatagaaagaaaata

SEQ ID NO: 470817 - DNA, 20 bp, Artificial
  CRISPR gRNA sequence
actatagaaagaaaataata

SEQ ID NO: 470818 - DNA, 20 bp, Artificial
  CRISPR gRNA sequence
ctatagaaagaaaataatat

SEQ ID NO: 470819 - DNA, 20 bp, Artificial
  CRISPR gRNA sequence
tagaaagaaaataatattta

SEQ ID NO: 470820 - DNA, 20 bp, Artificial
  CRISPR gRNA sequence
aagaaaatttccctatttga

SEQ ID NO: 470821 - DNA, 20 bp, Artificial
  CRISPR gRNA sequence
agaaaatttccctatttgag

SEQ ID NO: 470822 - DNA, 20 bp, Artificial
  CRISPR gRNA sequence
ccctatttgagggaacaaag

SEQ ID NO: 470823 - DNA, 20 bp, Artificial
  CRISPR gRNA sequence
cctatttgagggaacaaagc

SEQ ID NO: 470824 - DNA, 20 bp, Artificial
  CRISPR gRNA sequence
tttgagggaacaaagcctta

SEQ ID NO: 470825 - DNA, 20 bp, Artificial
  CRISPR gRNA sequence
gagggaacaaagccttagca

SEQ ID NO: 470826 - DNA, 20 bp, Artificial
  CRISPR gRNA sequence
agggaacaaagccttagcac

SEQ ID NO: 470827 - DNA, 20 bp, Artificial
  CRISPR gRNA sequence
agcaccctacacagtgccta

SEQ ID NO: 470828 - DNA, 20 bp, Artificial
  CRISPR gRNA sequence
gcaccctacacagtgcctac

SEQ ID NO: 470829 - DNA, 20 bp, Artificial
  CRISPR gRNA sequence
cacagtgcctactgatgcta

SEQ ID NO: 470830 - DNA, 20 bp, Artificial
  CRISPR gRNA sequence
ctgatgctaatgaaaactta

SEQ ID NO: 470831 - DNA, 20 bp, Artificial
  CRISPR gRNA sequence
atgctaatgaaaacttaata

SEQ ID NO: 470832 - DNA, 20 bp, Artificial
  CRISPR gRNA sequence
atgaaaacttaatagaagtt

SEQ ID NO: 470833 - DNA, 20 bp, Artificial
  CRISPR gRNA sequence
aatagaagtttgtcaagttg

SEQ ID NO: 470834 - DNA, 20 bp, Artificial
  CRISPR gRNA sequence
atagaagtttgtcaagttga

SEQ ID NO: 470835 - DNA, 20 bp, Artificial
  CRISPR gRNA sequence
gtcaagttgagtgtatttgg

SEQ ID NO: 470836 - DNA, 20 bp, Artificial
  CRISPR gRNA sequence
tcaagttgagtgtatttggt

SEQ ID NO: 470837 - DNA, 20 bp, Artificial
  CRISPR gRNA sequence
agtgtatttggtctggttta

SEQ ID NO: 470838 - DNA, 20 bp, Artificial
  CRISPR gRNA sequence
ggtctggtttaaaattaagc

SEQ ID NO: 470839 - DNA, 20 bp, Artificial
  CRISPR gRNA sequence
gtctggtttaaaattaagca

SEQ ID NO: 470840 - DNA, 20 bp, Artificial
  CRISPR gRNA sequence
gtttaaaattaagcagcttg

SEQ ID NO: 470841 - DNA, 20 bp, Artificial
  CRISPR gRNA sequence
aaaattaagcagcttggtgg

SEQ ID NO: 470842 - DNA, 20 bp, Artificial
  CRISPR gRNA sequence
aaattaagcagcttggtggg

SEQ ID NO: 470843 - DNA, 20 bp, Artificial
  CRISPR gRNA sequence
agcagcttggtggggaatgt

SEQ ID NO: 470844 - DNA, 20 bp, Artificial
  CRISPR gRNA sequence
ggtggggaatgttgaatgcc

SEQ ID NO: 470845 - DNA, 20 bp, Artificial
  CRISPR gRNA sequence
gtggggaatgttgaatgcca

SEQ ID NO: 470846 - DNA, 20 bp, Artificial
  CRISPR gRNA sequence
aatgccatttaatattatat

SEQ ID NO: 470847 - DNA, 20 bp, Artificial
  CRISPR gRNA sequence
aatattatatatagaattat

SEQ ID NO: 470848 - DNA, 20 bp, Artificial
  CRISPR gRNA sequence
atattatatatagaattatt

SEQ ID NO: 470849 - DNA, 20 bp, Artificial
  CRISPR gRNA sequence
tatatagaattattggctgt

SEQ ID NO: 470850 - DNA, 20 bp, Artificial
  CRISPR gRNA sequence
ttggctgtatcgattttgtc

SEQ ID NO: 470851 - DNA, 20 bp, Artificial
  CRISPR gRNA sequence
gctgtatcgattttgtcttt

SEQ ID NO: 470852 - DNA, 20 bp, Artificial
  CRISPR gRNA sequence
tatcgattttgtcttttgtg

SEQ ID NO: 470853 - DNA, 20 bp, Artificial
  CRISPR gRNA sequence
tgtcttttgtggaattttta

SEQ ID NO: 470854 - DNA, 20 bp, Artificial
  CRISPR gRNA sequence
gtcttttgtggaatttttaa

SEQ ID NO: 470855 - DNA, 20 bp, Artificial
  CRISPR gRNA sequence
tcttttgtggaatttttaag

SEQ ID NO: 470856 - DNA, 20 bp, Artificial
  CRISPR gRNA sequence
ttgtggaatttttaagaggg

SEQ ID NO: 470857 - DNA, 20 bp, Artificial
  CRISPR gRNA sequence
tgtggaatttttaagagggt

SEQ ID NO: 470858 - DNA, 20 bp, Artificial
  CRISPR gRNA sequence
gtggaatttttaagagggtt

SEQ ID NO: 470859 - DNA, 20 bp, Artificial
  CRISPR gRNA sequence
tggaatttttaagagggtta

SEQ ID NO: 470860 - DNA, 20 bp, Artificial
  CRISPR gRNA sequence
ttaagagggttactacttct

SEQ ID NO: 470861 - DNA, 20 bp, Artificial
  CRISPR gRNA sequence
taagagggttactacttctt

SEQ ID NO: 470862 - DNA, 20 bp, Artificial
  CRISPR gRNA sequence
aagagggttactacttcttt

SEQ ID NO: 470863 - DNA, 20 bp, Artificial
  CRISPR gRNA sequence
agagggttactacttcttta

SEQ ID NO: 470864 - DNA, 20 bp, Artificial
  CRISPR gRNA sequence
ctacttctttatcactattc

SEQ ID NO: 470865 - DNA, 20 bp, Artificial
  CRISPR gRNA sequence
cttctttatcactattcctc

SEQ ID NO: 470866 - DNA, 20 bp, Artificial
  CRISPR gRNA sequence
ctttatcactattcctcctt

SEQ ID NO: 470867 - DNA, 20 bp, Artificial
  CRISPR gRNA sequence
tttatcactattcctcctta

SEQ ID NO: 470868 - DNA, 20 bp, Artificial
  CRISPR gRNA sequence
tatcactattcctccttatt

SEQ ID NO: 470869 - DNA, 20 bp, Artificial
  CRISPR gRNA sequence
atcactattcctccttattg

SEQ ID NO: 470870 - DNA, 20 bp, Artificial
  CRISPR gRNA sequence
tcactattcctccttattga

SEQ ID NO: 470871 - DNA, 20 bp, Artificial
  CRISPR gRNA sequence
ttcctccttattgaaacaca

SEQ ID NO: 470872 - DNA, 20 bp, Artificial
  CRISPR gRNA sequence
ctccttattgaaacacacac

SEQ ID NO: 470873 - DNA, 20 bp, Artificial
  CRISPR gRNA sequence
cttattgaaacacacacaca

SEQ ID NO: 470874 - DNA, 20 bp, Artificial
  CRISPR gRNA sequence
attgaaacacacacacacat

SEQ ID NO: 470875 - DNA, 20 bp, Artificial
  CRISPR gRNA sequence
ttgaaacacacacacacatc

SEQ ID NO: 470876 - DNA, 20 bp, Artificial
  CRISPR gRNA sequence
aaacacacacacacatcaag

SEQ ID NO: 470877 - DNA, 20 bp, Artificial
  CRISPR gRNA sequence
ctttgcagtatctcatttat

SEQ ID NO: 470878 - DNA, 20 bp, Artificial
  CRISPR gRNA sequence
tgcagtatctcatttatgac

SEQ ID NO: 470879 - DNA, 20 bp, Artificial
  CRISPR gRNA sequence
gcagtatctcatttatgact

SEQ ID NO: 470880 - DNA, 20 bp, Artificial
  CRISPR gRNA sequence
cagtatctcatttatgactg

SEQ ID NO: 470881 - DNA, 20 bp, Artificial
  CRISPR gRNA sequence
atttatgactgtttagtttt

SEQ ID NO: 470882 - DNA, 20 bp, Artificial
  CRISPR gRNA sequence
atgactgtttagttttaatt

SEQ ID NO: 470883 - DNA, 20 bp, Artificial
  CRISPR gRNA sequence
tgactgtttagttttaatta

SEQ ID NO: 470884 - DNA, 20 bp, Artificial
  CRISPR gRNA sequence
tttagttttaattagagagc

SEQ ID NO: 470885 - DNA, 20 bp, Artificial
  CRISPR gRNA sequence
agttttaattagagagcttc

SEQ ID NO: 470886 - DNA, 20 bp, Artificial
  CRISPR gRNA sequence
gttttaattagagagcttca

SEQ ID NO: 470887 - DNA, 20 bp, Artificial
  CRISPR gRNA sequence
taattagagagcttcagaat

SEQ ID NO: 470888 - DNA, 20 bp, Artificial
  CRISPR gRNA sequence
aattagagagcttcagaatg

SEQ ID NO: 470889 - DNA, 20 bp, Artificial
  CRISPR gRNA sequence
attagagagcttcagaatgc

SEQ ID NO: 470890 - DNA, 20 bp, Artificial
  CRISPR gRNA sequence
gagagcttcagaatgctttt

SEQ ID NO: 470891 - DNA, 20 bp, Artificial
  CRISPR gRNA sequence
cagaatgcttttccacaaat

SEQ ID NO: 470892 - DNA, 20 bp, Artificial
  CRISPR gRNA sequence
agaatgcttttccacaaata

SEQ ID NO: 470893 - DNA, 20 bp, Artificial
  CRISPR gRNA sequence
ttccacaaatatattgcctc

SEQ ID NO: 470894 - DNA, 20 bp, Artificial
  CRISPR gRNA sequence
tccacaaatatattgcctca

SEQ ID NO: 470895 - DNA, 20 bp, Artificial
  CRISPR gRNA sequence
ccacaaatatattgcctcat

SEQ ID NO: 470896 - DNA, 20 bp, Artificial
  CRISPR gRNA sequence
cacaaatatattgcctcatc

SEQ ID NO: 470897 - DNA, 20 bp, Artificial
  CRISPR gRNA sequence
cctcatcttgcattcttttt

SEQ ID NO: 470898 - DNA, 20 bp, Artificial
  CRISPR gRNA sequence
atcttgcattcttttttagt

SEQ ID NO: 470899 - DNA, 20 bp, Artificial
  CRISPR gRNA sequence
gcattcttttttagttctaa

SEQ ID NO: 470900 - DNA, 20 bp, Artificial
  CRISPR gRNA sequence
cattcttttttagttctaat

SEQ ID NO: 470901 - DNA, 20 bp, Artificial
  CRISPR gRNA sequence
ttttttagttctaatatctc

SEQ ID NO: 470902 - DNA, 20 bp, Artificial
  CRISPR gRNA sequence
ttttagttctaatatctcca

SEQ ID NO: 470903 - DNA, 20 bp, Artificial
  CRISPR gRNA sequence
tttagttctaatatctccac

SEQ ID NO: 470904 - DNA, 20 bp, Artificial
  CRISPR gRNA sequence
ttagttctaatatctccaca

SEQ ID NO: 470905 - DNA, 20 bp, Artificial
  CRISPR gRNA sequence
tagttctaatatctccacaa

SEQ ID NO: 470906 - DNA, 20 bp, Artificial
  CRISPR gRNA sequence
agttctaatatctccacaac

SEQ ID NO: 470907 - DNA, 20 bp, Artificial
  CRISPR gRNA sequence
gttctaatatctccacaaca

SEQ ID NO: 470908 - DNA, 20 bp, Artificial
  CRISPR gRNA sequence
taatatctccacaacattca

SEQ ID NO: 470909 - DNA, 20 bp, Artificial
  CRISPR gRNA sequence
atatctccacaacattcaac

SEQ ID NO: 470910 - DNA, 20 bp, Artificial
  CRISPR gRNA sequence
cacaacattcaactcaaaag

SEQ ID NO: 470911 - DNA, 20 bp, Artificial
  CRISPR gRNA sequence
aactcaaaagaaaagcctac

SEQ ID NO: 470912 - DNA, 20 bp, Artificial
  CRISPR gRNA sequence
aaaagaaaagcctacattta

SEQ ID NO: 470913 - DNA, 20 bp, Artificial
  CRISPR gRNA sequence
catttacattccaaacctta

SEQ ID NO: 470914 - DNA, 20 bp, Artificial
  CRISPR gRNA sequence
acattccaaaccttatagga

SEQ ID NO: 470915 - DNA, 20 bp, Artificial
  CRISPR gRNA sequence
cattccaaaccttataggaa

SEQ ID NO: 470916 - DNA, 20 bp, Artificial
  CRISPR gRNA sequence
caaaccttataggaaagatt

SEQ ID NO: 470917 - DNA, 20 bp, Artificial
  CRISPR gRNA sequence
ataggaaagattgactccaa

SEQ ID NO: 470918 - DNA, 20 bp, Artificial
  CRISPR gRNA sequence
taggaaagattgactccaaa

SEQ ID NO: 470919 - DNA, 20 bp, Artificial
  CRISPR gRNA sequence
actccaaaattcccttcctt

SEQ ID NO: 470920 - DNA, 20 bp, Artificial
  CRISPR gRNA sequence
caaaattcccttcctttagt

SEQ ID NO: 470921 - DNA, 20 bp, Artificial
  CRISPR gRNA sequence
ccttcctttagtctgagtgg

SEQ ID NO: 470922 - DNA, 20 bp, Artificial
  CRISPR gRNA sequence
cctttagtctgagtggtccc

SEQ ID NO: 470923 - DNA, 20 bp, Artificial
  CRISPR gRNA sequence
ctttagtctgagtggtccct

SEQ ID NO: 470924 - DNA, 20 bp, Artificial
  CRISPR gRNA sequence
tagtctgagtggtcccttcc

SEQ ID NO: 470925 - DNA, 20 bp, Artificial
  CRISPR gRNA sequence
agtctgagtggtcccttcct

SEQ ID NO: 470926 - DNA, 20 bp, Artificial
  CRISPR gRNA sequence
gtctgagtggtcccttcctt

SEQ ID NO: 470927 - DNA, 20 bp, Artificial
  CRISPR gRNA sequence
agtggtcccttccttgatga

SEQ ID NO: 470928 - DNA, 20 bp, Artificial
  CRISPR gRNA sequence
ccttgatgagcccatacaca

SEQ ID NO: 470929 - DNA, 20 bp, Artificial
  CRISPR gRNA sequence
cttgatgagcccatacacat

SEQ ID NO: 470930 - DNA, 20 bp, Artificial
  CRISPR gRNA sequence
gatgagcccatacacattgc

SEQ ID NO: 470931 - DNA, 20 bp, Artificial
  CRISPR gRNA sequence
atgagcccatacacattgcc

SEQ ID NO: 470932 - DNA, 20 bp, Artificial
  CRISPR gRNA sequence
ccagggacctctgtgtaata

SEQ ID NO: 470933 - DNA, 20 bp, Artificial
  CRISPR gRNA sequence
tgtgtaataactaagccaaa

SEQ ID NO: 470934 - DNA, 20 bp, Artificial
  CRISPR gRNA sequence
tgtaataactaagccaaaga

SEQ ID NO: 470935 - DNA, 20 bp, Artificial
  CRISPR gRNA sequence
agccaaagatcatgtctcta

SEQ ID NO: 470936 - DNA, 20 bp, Artificial
  CRISPR gRNA sequence
tattttgctggtgctattta

SEQ ID NO: 470937 - DNA, 20 bp, Artificial
  CRISPR gRNA sequence
ttttgctggtgctatttatg

SEQ ID NO: 470938 - DNA, 20 bp, Artificial
  CRISPR gRNA sequence
tgctggtgctatttatgaag

SEQ ID NO: 470939 - DNA, 20 bp, Artificial
  CRISPR gRNA sequence
gctggtgctatttatgaaga

SEQ ID NO: 470940 - DNA, 20 bp, Artificial
  CRISPR gRNA sequence
ctggtgctatttatgaagat

SEQ ID NO: 470941 - DNA, 20 bp, Artificial
  CRISPR gRNA sequence
gtgctatttatgaagatatc

SEQ ID NO: 470942 - DNA, 20 bp, Artificial
  CRISPR gRNA sequence
tttatgaagatatctaatca

SEQ ID NO: 470943 - DNA, 20 bp, Artificial
  CRISPR gRNA sequence
atgaagatatctaatcattt

SEQ ID NO: 470944 - DNA, 20 bp, Artificial
  CRISPR gRNA sequence
tgaagatatctaatcatttt

SEQ ID NO: 470945 - DNA, 20 bp, Artificial
  CRISPR gRNA sequence
atcattttatgaggttattt

SEQ ID NO: 470946 - DNA, 20 bp, Artificial
  CRISPR gRNA sequence
tatgaggttatttgtgggtt

SEQ ID NO: 470947 - DNA, 20 bp, Artificial
  CRISPR gRNA sequence
atgaggttatttgtgggttc

SEQ ID NO: 470948 - DNA, 20 bp, Artificial
  CRISPR gRNA sequence
tgaggttatttgtgggttca

SEQ ID NO: 470949 - DNA, 20 bp, Artificial
  CRISPR gRNA sequence
tttgtgggttcattctttca

SEQ ID NO: 470950 - DNA, 20 bp, Artificial
  CRISPR gRNA sequence
gtgggttcattctttcatca

SEQ ID NO: 470951 - DNA, 20 bp, Artificial
  CRISPR gRNA sequence
tgggttcattctttcatcag

SEQ ID NO: 470952 - DNA, 20 bp, Artificial
  CRISPR gRNA sequence
attctttcatcagctcccta

SEQ ID NO: 470953 - DNA, 20 bp, Artificial
  CRISPR gRNA sequence
tttcatcagctccctactct

SEQ ID NO: 470954 - DNA, 20 bp, Artificial
  CRISPR gRNA sequence
tcatcagctccctactctct

SEQ ID NO: 470955 - DNA, 20 bp, Artificial
  CRISPR gRNA sequence
catcagctccctactctctt

SEQ ID NO: 470956 - DNA, 20 bp, Artificial
  CRISPR gRNA sequence
atcagctccctactctcttc

SEQ ID NO: 470957 - DNA, 20 bp, Artificial
  CRISPR gRNA sequence
cctactctcttccagaaaga

SEQ ID NO: 470958 - DNA, 20 bp, Artificial
  CRISPR gRNA sequence
ctctcttccagaaagacctt

SEQ ID NO: 470959 - DNA, 20 bp, Artificial
  CRISPR gRNA sequence
tcttccagaaagaccttaag

SEQ ID NO: 470960 - DNA, 20 bp, Artificial
  CRISPR gRNA sequence
ttccagaaagaccttaaggt

SEQ ID NO: 470961 - DNA, 20 bp, Artificial
  CRISPR gRNA sequence
ccagaaagaccttaaggtgt

SEQ ID NO: 470962 - DNA, 20 bp, Artificial
  CRISPR gRNA sequence
cagaaagaccttaaggtgtt

SEQ ID NO: 470963 - DNA, 20 bp, Artificial
  CRISPR gRNA sequence
aaggtgtttacataaaaaat

SEQ ID NO: 470964 - DNA, 20 bp, Artificial
  CRISPR gRNA sequence
aggtgtttacataaaaaata

SEQ ID NO: 470965 - DNA, 20 bp, Artificial
  CRISPR gRNA sequence
acataaaaaataaatgaata

SEQ ID NO: 470966 - DNA, 20 bp, Artificial
  CRISPR gRNA sequence
cataaaaaataaatgaatag

SEQ ID NO: 470967 - DNA, 20 bp, Artificial
  CRISPR gRNA sequence
aagccacataacaggcaaga

SEQ ID NO: 470968 - DNA, 20 bp, Artificial
  CRISPR gRNA sequence
gtatggttcagtctctgact

SEQ ID NO: 470969 - DNA, 20 bp, Artificial
  CRISPR gRNA sequence
tatggttcagtctctgactt

SEQ ID NO: 470970 - DNA, 20 bp, Artificial
  CRISPR gRNA sequence
agtctctgacttttctgtct

SEQ ID NO: 470971 - DNA, 20 bp, Artificial
  CRISPR gRNA sequence
tgacttttctgtcttggatc

SEQ ID NO: 470972 - DNA, 20 bp, Artificial
  CRISPR gRNA sequence
acttttctgtcttggatcta

SEQ ID NO: 470973 - DNA, 20 bp, Artificial
  CRISPR gRNA sequence
ttctgtcttggatctagact

SEQ ID NO: 470974 - DNA, 20 bp, Artificial
  CRISPR gRNA sequence
tctgtcttggatctagactg

SEQ ID NO: 470975 - DNA, 20 bp, Artificial
  CRISPR gRNA sequence
ctgtcttggatctagactgc

SEQ ID NO: 470976 - DNA, 20 bp, Artificial
  CRISPR gRNA sequence
tgtcttggatctagactgcc

SEQ ID NO: 470977 - DNA, 20 bp, Artificial
  CRISPR gRNA sequence
tcttggatctagactgcctt

SEQ ID NO: 470978 - DNA, 20 bp, Artificial
  CRISPR gRNA sequence
ggatctagactgccttccat

SEQ ID NO: 470979 - DNA, 20 bp, Artificial
  CRISPR gRNA sequence
gatctagactgccttccatg

SEQ ID NO: 470980 - DNA, 20 bp, Artificial
  CRISPR gRNA sequence
gactgccttccatgaacttc

SEQ ID NO: 470981 - DNA, 20 bp, Artificial
  CRISPR gRNA sequence
ccttccatgaacttccaaag

SEQ ID NO: 470982 - DNA, 20 bp, Artificial
  CRISPR gRNA sequence
ccatgaacttccaaagaacc

SEQ ID NO: 470983 - DNA, 20 bp, Artificial
  CRISPR gRNA sequence
catgaacttccaaagaacca

SEQ ID NO: 470984 - DNA, 20 bp, Artificial
  CRISPR gRNA sequence
ccaaagaaccacttattacg

SEQ ID NO: 470985 - DNA, 20 bp, Artificial
  CRISPR gRNA sequence
caaagaaccacttattacga

SEQ ID NO: 470986 - DNA, 20 bp, Artificial
  CRISPR gRNA sequence
attacgagacttgttaaccc

SEQ ID NO: 470987 - DNA, 20 bp, Artificial
  CRISPR gRNA sequence
ttacgagacttgttaaccct

SEQ ID NO: 470988 - DNA, 20 bp, Artificial
  CRISPR gRNA sequence
cgagacttgttaaccctaaa

SEQ ID NO: 470989 - DNA, 20 bp, Artificial
  CRISPR gRNA sequence
gttaaccctaaagagtcttt

SEQ ID NO: 470990 - DNA, 20 bp, Artificial
  CRISPR gRNA sequence
ttaaccctaaagagtctttg

SEQ ID NO: 470991 - DNA, 20 bp, Artificial
  CRISPR gRNA sequence
accctaaagagtctttgctg

SEQ ID NO: 470992 - DNA, 20 bp, Artificial
  CRISPR gRNA sequence
aagagtctttgctgcataga

SEQ ID NO: 470993 - DNA, 20 bp, Artificial
  CRISPR gRNA sequence
tgctgcatagagagcagaat

SEQ ID NO: 470994 - DNA, 20 bp, Artificial
  CRISPR gRNA sequence
gctgcatagagagcagaatg

SEQ ID NO: 470995 - DNA, 20 bp, Artificial
  CRISPR gRNA sequence
ctgcatagagagcagaatgc

SEQ ID NO: 470996 - DNA, 20 bp, Artificial
  CRISPR gRNA sequence
catagagagcagaatgcaaa

SEQ ID NO: 470997 - DNA, 20 bp, Artificial
  CRISPR gRNA sequence
acatttttaaaaatgggtct

SEQ ID NO: 470998 - DNA, 20 bp, Artificial
  CRISPR gRNA sequence
ttaaaaatgggtctatgtat

SEQ ID NO: 470999 - DNA, 20 bp, Artificial
  CRISPR gRNA sequence
taaaaatgggtctatgtata

SEQ ID NO: 471000 - DNA, 20 bp, Artificial
  CRISPR gRNA sequence
aaaaatgggtctatgtatat

SEQ ID NO: 471001 - DNA, 20 bp, Artificial
  CRISPR gRNA sequence
aaaatgggtctatgtatata

SEQ ID NO: 471002 - DNA, 20 bp, Artificial
  CRISPR gRNA sequence
tgtatatatatatatatata

SEQ ID NO: 471003 - DNA, 20 bp, Artificial
  CRISPR gRNA sequence
gcacatggtgttatataaat

SEQ ID NO: 471004 - DNA, 20 bp, Artificial
  CRISPR gRNA sequence
tataaattcattgaataaat

SEQ ID NO: 471005 - DNA, 20 bp, Artificial
  CRISPR gRNA sequence
attgaataaataaataaaca

SEQ ID NO: 471006 - DNA, 20 bp, Artificial
  CRISPR gRNA sequence
aataaataaataaacacagt

SEQ ID NO: 471007 - DNA, 20 bp, Artificial
  CRISPR gRNA sequence
catttgtttcaacagctaca

SEQ ID NO: 471008 - DNA, 20 bp, Artificial
  CRISPR gRNA sequence
gtttcaacagctacatcaag

SEQ ID NO: 471009 - DNA, 20 bp, Artificial
  CRISPR gRNA sequence
tttcaacagctacatcaagc

SEQ ID NO: 471010 - DNA, 20 bp, Artificial
  CRISPR gRNA sequence
caacagctacatcaagctta

SEQ ID NO: 471011 - DNA, 20 bp, Artificial
  CRISPR gRNA sequence
aacagctacatcaagcttac

SEQ ID NO: 471012 - DNA, 20 bp, Artificial
  CRISPR gRNA sequence
catcaagcttaccaggttaa

SEQ ID NO: 471013 - DNA, 20 bp, Artificial
  CRISPR gRNA sequence
accaggttaatttcccttcc

SEQ ID NO: 471014 - DNA, 20 bp, Artificial
  CRISPR gRNA sequence
ccaggttaatttcccttcct

SEQ ID NO: 471015 - DNA, 20 bp, Artificial
  CRISPR gRNA sequence
atttcccttcctgctgtgtc

SEQ ID NO: 471016 - DNA, 20 bp, Artificial
  CRISPR gRNA sequence
cccttcctgctgtgtcagag

SEQ ID NO: 471017 - DNA, 20 bp, Artificial
  CRISPR gRNA sequence
ccttcctgctgtgtcagaga

SEQ ID NO: 471018 - DNA, 20 bp, Artificial
  CRISPR gRNA sequence
cctgctgtgtcagagagttc

SEQ ID NO: 471019 - DNA, 20 bp, Artificial
  CRISPR gRNA sequence
ctgctgtgtcagagagttca

SEQ ID NO: 471020 - DNA, 20 bp, Artificial
  CRISPR gRNA sequence
ctgtgtcagagagttcattt

SEQ ID NO: 471021 - DNA, 20 bp, Artificial
  CRISPR gRNA sequence
tgtcagagagttcattttgc

SEQ ID NO: 471022 - DNA, 20 bp, Artificial
  CRISPR gRNA sequence
attttgctttcctggaagac

SEQ ID NO: 471023 - DNA, 20 bp, Artificial
  CRISPR gRNA sequence
tgctttcctggaagacaaaa

SEQ ID NO: 471024 - DNA, 20 bp, Artificial
  CRISPR gRNA sequence
gctttcctggaagacaaaaa

SEQ ID NO: 471025 - DNA, 20 bp, Artificial
  CRISPR gRNA sequence
ctttcctggaagacaaaaag

SEQ ID NO: 471026 - DNA, 20 bp, Artificial
  CRISPR gRNA sequence
tcctggaagacaaaaagaaa

SEQ ID NO: 471027 - DNA, 20 bp, Artificial
  CRISPR gRNA sequence
cctggaagacaaaaagaaaa

SEQ ID NO: 471028 - DNA, 20 bp, Artificial
  CRISPR gRNA sequence
ctggaagacaaaaagaaaaa

SEQ ID NO: 471029 - DNA, 20 bp, Artificial
  CRISPR gRNA sequence
gaagacaaaaagaaaaagaa

SEQ ID NO: 471030 - DNA, 20 bp, Artificial
  CRISPR gRNA sequence
gccacccatgcttatcctgt

SEQ ID NO: 471031 - DNA, 20 bp, Artificial
  CRISPR gRNA sequence
ccacccatgcttatcctgtt

SEQ ID NO: 471032 - DNA, 20 bp, Artificial
  CRISPR gRNA sequence
atcctgttgaatgccaggga

SEQ ID NO: 471033 - DNA, 20 bp, Artificial
  CRISPR gRNA sequence
tcctgttgaatgccagggat

SEQ ID NO: 471034 - DNA, 20 bp, Artificial
  CRISPR gRNA sequence
ttgaatgccagggatagtgt

SEQ ID NO: 471035 - DNA, 20 bp, Artificial
  CRISPR gRNA sequence
aatgccagggatagtgttgt

SEQ ID NO: 471036 - DNA, 20 bp, Artificial
  CRISPR gRNA sequence
ttagttttggcttgttaatt

SEQ ID NO: 471037 - DNA, 20 bp, Artificial
  CRISPR gRNA sequence
gttttggcttgttaatttgc

SEQ ID NO: 471038 - DNA, 20 bp, Artificial
  CRISPR gRNA sequence
tggcttgttaatttgctttg

SEQ ID NO: 471039 - DNA, 20 bp, Artificial
  CRISPR gRNA sequence
ggcttgttaatttgctttgc

SEQ ID NO: 471040 - DNA, 20 bp, Artificial
  CRISPR gRNA sequence
gcttgttaatttgctttgcc

SEQ ID NO: 471041 - DNA, 20 bp, Artificial
  CRISPR gRNA sequence
gttaatttgctttgcctagc

SEQ ID NO: 471042 - DNA, 20 bp, Artificial
  CRISPR gRNA sequence
ttaatttgctttgcctagca

SEQ ID NO: 471043 - DNA, 20 bp, Artificial
  CRISPR gRNA sequence
atttgctttgcctagcacac

SEQ ID NO: 471044 - DNA, 20 bp, Artificial
  CRISPR gRNA sequence
gctttgcctagcacacactt

SEQ ID NO: 471045 - DNA, 20 bp, Artificial
  CRISPR gRNA sequence
ctttgcctagcacacacttg

SEQ ID NO: 471046 - DNA, 20 bp, Artificial
  CRISPR gRNA sequence
tgcctagcacacacttgttt

SEQ ID NO: 471047 - DNA, 20 bp, Artificial
  CRISPR gRNA sequence
gcctagcacacacttgtttg

SEQ ID NO: 471048 - DNA, 20 bp, Artificial
  CRISPR gRNA sequence
cctagcacacacttgtttgt

SEQ ID NO: 471049 - DNA, 20 bp, Artificial
  CRISPR gRNA sequence
gcacacacttgtttgtgata

SEQ ID NO: 471050 - DNA, 20 bp, Artificial
  CRISPR gRNA sequence
gtttgtgataattcacactg

SEQ ID NO: 471051 - DNA, 20 bp, Artificial
  CRISPR gRNA sequence
tttgtgataattcacactga

SEQ ID NO: 471052 - DNA, 20 bp, Artificial
  CRISPR gRNA sequence
gtgataattcacactgacca

SEQ ID NO: 471053 - DNA, 20 bp, Artificial
  CRISPR gRNA sequence
tgataattcacactgaccag

SEQ ID NO: 471054 - DNA, 20 bp, Artificial
  CRISPR gRNA sequence
acactgaccagctctctctc

SEQ ID NO: 471055 - DNA, 20 bp, Artificial
  CRISPR gRNA sequence
accagctctctctctggttc

SEQ ID NO: 471056 - DNA, 20 bp, Artificial
  CRISPR gRNA sequence
tctctctggttcatcacttt

SEQ ID NO: 471057 - DNA, 20 bp, Artificial
  CRISPR gRNA sequence
tctctggttcatcacttttc

SEQ ID NO: 471058 - DNA, 20 bp, Artificial
  CRISPR gRNA sequence
tctggttcatcacttttcag

SEQ ID NO: 471059 - DNA, 20 bp, Artificial
  CRISPR gRNA sequence
tggttcatcacttttcagtc

SEQ ID NO: 471060 - DNA, 20 bp, Artificial
  CRISPR gRNA sequence
gttcatcacttttcagtcca

SEQ ID NO: 471061 - DNA, 20 bp, Artificial
  CRISPR gRNA sequence
atcacttttcagtccacata

SEQ ID NO: 471062 - DNA, 20 bp, Artificial
  CRISPR gRNA sequence
ttcagtccacatagccccat

SEQ ID NO: 471063 - DNA, 20 bp, Artificial
  CRISPR gRNA sequence
tcagtccacatagccccatg

SEQ ID NO: 471064 - DNA, 20 bp, Artificial
  CRISPR gRNA sequence
cagtccacatagccccatgg

SEQ ID NO: 471065 - DNA, 20 bp, Artificial
  CRISPR gRNA sequence
agtccacatagccccatggc

SEQ ID NO: 471066 - DNA, 20 bp, Artificial
  CRISPR gRNA sequence
aaaggaaggggagggatcta

SEQ ID NO: 471067 - DNA, 20 bp, Artificial
  CRISPR gRNA sequence
gtatatcacttggaagagac

SEQ ID NO: 471068 - DNA, 20 bp, Artificial
  CRISPR gRNA sequence
ggaagagactggaagtcctt

SEQ ID NO: 471069 - DNA, 20 bp, Artificial
  CRISPR gRNA sequence
gaagagactggaagtccttg

SEQ ID NO: 471070 - DNA, 20 bp, Artificial
  CRISPR gRNA sequence
gaagtccttgctctggggac

SEQ ID NO: 471071 - DNA, 20 bp, Artificial
  CRISPR gRNA sequence
gctctggggacattccatac

SEQ ID NO: 471072 - DNA, 20 bp, Artificial
  CRISPR gRNA sequence
ctctggggacattccatact

SEQ ID NO: 471073 - DNA, 20 bp, Artificial
  CRISPR gRNA sequence
tggggacattccatactcaa

SEQ ID NO: 471074 - DNA, 20 bp, Artificial
  CRISPR gRNA sequence
gggacattccatactcaatg

SEQ ID NO: 471075 - DNA, 20 bp, Artificial
  CRISPR gRNA sequence
catactcaatgccagaaatg

SEQ ID NO: 471076 - DNA, 20 bp, Artificial
  CRISPR gRNA sequence
aatgccagaaatgctgctgt

SEQ ID NO: 471077 - DNA, 20 bp, Artificial
  CRISPR gRNA sequence
ctgtcctgtcacctatgtag

SEQ ID NO: 471078 - DNA, 20 bp, Artificial
  CRISPR gRNA sequence
tcctgtcacctatgtagcca

SEQ ID NO: 471079 - DNA, 20 bp, Artificial
  CRISPR gRNA sequence
tcacctatgtagccaagatc

SEQ ID NO: 471080 - DNA, 20 bp, Artificial
  CRISPR gRNA sequence
tgtagccaagatctcctact

SEQ ID NO: 471081 - DNA, 20 bp, Artificial
  CRISPR gRNA sequence
ctactacctagttcactttg

SEQ ID NO: 471082 - DNA, 20 bp, Artificial
  CRISPR gRNA sequence
ctacctagttcactttggat

SEQ ID NO: 471083 - DNA, 20 bp, Artificial
  CRISPR gRNA sequence
cctagttcactttggatgtg

SEQ ID NO: 471084 - DNA, 20 bp, Artificial
  CRISPR gRNA sequence
gttcactttggatgtggtaa

SEQ ID NO: 471085 - DNA, 20 bp, Artificial
  CRISPR gRNA sequence
actttggatgtggtaaatca

SEQ ID NO: 471086 - DNA, 20 bp, Artificial
  CRISPR gRNA sequence
tggatgtggtaaatcaaaag

SEQ ID NO: 471087 - DNA, 20 bp, Artificial
  CRISPR gRNA sequence
ggatgtggtaaatcaaaaga

SEQ ID NO: 471088 - DNA, 20 bp, Artificial
  CRISPR gRNA sequence
gatgtggtaaatcaaaagat

SEQ ID NO: 471089 - DNA, 20 bp, Artificial
  CRISPR gRNA sequence
atccctgactccttttctga

SEQ ID NO: 471090 - DNA, 20 bp, Artificial
  CRISPR gRNA sequence
tccctgactccttttctgaa

SEQ ID NO: 471091 - DNA, 20 bp, Artificial
  CRISPR gRNA sequence
actccttttctgaagttctg

SEQ ID NO: 471092 - DNA, 20 bp, Artificial
  CRISPR gRNA sequence
cttttctgaagttctgagag

SEQ ID NO: 471093 - DNA, 20 bp, Artificial
  CRISPR gRNA sequence
ttctgaagttctgagagagg

SEQ ID NO: 471094 - DNA, 20 bp, Artificial
  CRISPR gRNA sequence
tctgaagttctgagagaggt

SEQ ID NO: 471095 - DNA, 20 bp, Artificial
  CRISPR gRNA sequence
ctgaagttctgagagaggtt

SEQ ID NO: 471096 - DNA, 20 bp, Artificial
  CRISPR gRNA sequence
tgaagttctgagagaggttc

SEQ ID NO: 471097 - DNA, 20 bp, Artificial
  CRISPR gRNA sequence
aagttctgagagaggttcca

SEQ ID NO: 471098 - DNA, 20 bp, Artificial
  CRISPR gRNA sequence
tgagagaggttccagcagtc

SEQ ID NO: 471099 - DNA, 20 bp, Artificial
  CRISPR gRNA sequence
agagaggttccagcagtctc

SEQ ID NO: 471100 - DNA, 20 bp, Artificial
  CRISPR gRNA sequence
cagcagtctcaagaaagatg

SEQ ID NO: 471101 - DNA, 20 bp, Artificial
  CRISPR gRNA sequence
aagaaagatgatgaaagata

SEQ ID NO: 471102 - DNA, 20 bp, Artificial
  CRISPR gRNA sequence
cagatgaagaattggggtaa

SEQ ID NO: 471103 - DNA, 20 bp, Artificial
  CRISPR gRNA sequence
gggtaagagagaattcttca

SEQ ID NO: 471104 - DNA, 20 bp, Artificial
  CRISPR gRNA sequence
ttcagaatccagagaaggtt

SEQ ID NO: 471105 - DNA, 20 bp, Artificial
  CRISPR gRNA sequence
cagaatccagagaaggttct

SEQ ID NO: 471106 - DNA, 20 bp, Artificial
  CRISPR gRNA sequence
agaatccagagaaggttctg

SEQ ID NO: 471107 - DNA, 20 bp, Artificial
  CRISPR gRNA sequence
tgaactccagaagttctcac

SEQ ID NO: 471108 - DNA, 20 bp, Artificial
  CRISPR gRNA sequence
aactccagaagttctcactc

SEQ ID NO: 471109 - DNA, 20 bp, Artificial
  CRISPR gRNA sequence
cagaagttctcactccaaaa

SEQ ID NO: 471110 - DNA, 20 bp, Artificial
  CRISPR gRNA sequence
tcactccaaaataccagaag

SEQ ID NO: 471111 - DNA, 20 bp, Artificial
  CRISPR gRNA sequence
actccaaaataccagaagca

SEQ ID NO: 471112 - DNA, 20 bp, Artificial
  CRISPR gRNA sequence
caaaataccagaagcacttt

SEQ ID NO: 471113 - DNA, 20 bp, Artificial
  CRISPR gRNA sequence
ttgcccagtcaaaggttatt

SEQ ID NO: 471114 - DNA, 20 bp, Artificial
  CRISPR gRNA sequence
tgcccagtcaaaggttattc

SEQ ID NO: 471115 - DNA, 20 bp, Artificial
  CRISPR gRNA sequence
gcccagtcaaaggttattcc

SEQ ID NO: 471116 - DNA, 20 bp, Artificial
  CRISPR gRNA sequence
cccagtcaaaggttattcct

SEQ ID NO: 471117 - DNA, 20 bp, Artificial
  CRISPR gRNA sequence
ttcctgtgtcacacagaata

SEQ ID NO: 471118 - DNA, 20 bp, Artificial
  CRISPR gRNA sequence
ctgtgtcacacagaataagt

SEQ ID NO: 471119 - DNA, 20 bp, Artificial
  CRISPR gRNA sequence
tgtcacacagaataagtgtt

SEQ ID NO: 471120 - DNA, 20 bp, Artificial
  CRISPR gRNA sequence
ctctatctagctcagtttct

SEQ ID NO: 471121 - DNA, 20 bp, Artificial
  CRISPR gRNA sequence
tatctagctcagtttctata

SEQ ID NO: 471122 - DNA, 20 bp, Artificial
  CRISPR gRNA sequence
tctagctcagtttctatagc

SEQ ID NO: 471123 - DNA, 20 bp, Artificial
  CRISPR gRNA sequence
gctcagtttctatagctaca

SEQ ID NO: 471124 - DNA, 20 bp, Artificial
  CRISPR gRNA sequence
agtttctatagctacactgt

SEQ ID NO: 471125 - DNA, 20 bp, Artificial
  CRISPR gRNA sequence
ctatagctacactgtagctg

SEQ ID NO: 471126 - DNA, 20 bp, Artificial
  CRISPR gRNA sequence
tatagctacactgtagctgg

SEQ ID NO: 471127 - DNA, 20 bp, Artificial
  CRISPR gRNA sequence
tagctacactgtagctggtg

SEQ ID NO: 471128 - DNA, 20 bp, Artificial
  CRISPR gRNA sequence
cactgtagctggtgttgtga

SEQ ID NO: 471129 - DNA, 20 bp, Artificial
  CRISPR gRNA sequence
tagctggtgttgtgaaaaca

SEQ ID NO: 471130 - DNA, 20 bp, Artificial
  CRISPR gRNA sequence
gtgttgtgaaaacaggaatg

SEQ ID NO: 471131 - DNA, 20 bp, Artificial
  CRISPR gRNA sequence
tgaaaacaggaatgtgagag

SEQ ID NO: 471132 - DNA, 20 bp, Artificial
  CRISPR gRNA sequence
aagtagttcaggccaaagct

SEQ ID NO: 471133 - DNA, 20 bp, Artificial
  CRISPR gRNA sequence
aggccaaagctagatcagaa

SEQ ID NO: 471134 - DNA, 20 bp, Artificial
  CRISPR gRNA sequence
gatcagaattctctatgctt

SEQ ID NO: 471135 - DNA, 20 bp, Artificial
  CRISPR gRNA sequence
tctatgctttcctctcttac

SEQ ID NO: 471136 - DNA, 20 bp, Artificial
  CRISPR gRNA sequence
tatgctttcctctcttactt

SEQ ID NO: 471137 - DNA, 20 bp, Artificial
  CRISPR gRNA sequence
tgctttcctctcttacttaa

SEQ ID NO: 471138 - DNA, 20 bp, Artificial
  CRISPR gRNA sequence
tcctctcttacttaacatat

SEQ ID NO: 471139 - DNA, 20 bp, Artificial
  CRISPR gRNA sequence
cctctcttacttaacatatt

SEQ ID NO: 471140 - DNA, 20 bp, Artificial
  CRISPR gRNA sequence
ctctcttacttaacatattt

SEQ ID NO: 471141 - DNA, 20 bp, Artificial
  CRISPR gRNA sequence
tcttacttaacatatttggt

SEQ ID NO: 471142 - DNA, 20 bp, Artificial
  CRISPR gRNA sequence
ttacttaacatatttggtca

SEQ ID NO: 471143 - DNA, 20 bp, Artificial
  CRISPR gRNA sequence
acttaacatatttggtcatg

SEQ ID NO: 471144 - DNA, 20 bp, Artificial
  CRISPR gRNA sequence
cttaacatatttggtcatga

SEQ ID NO: 471145 - DNA, 20 bp, Artificial
  CRISPR gRNA sequence
aacatatttggtcatgacat

SEQ ID NO: 471146 - DNA, 20 bp, Artificial
  CRISPR gRNA sequence
acatatttggtcatgacatt

SEQ ID NO: 471147 - DNA, 20 bp, Artificial
  CRISPR gRNA sequence
ggtcatgacattgagagagt

SEQ ID NO: 471148 - DNA, 20 bp, Artificial
  CRISPR gRNA sequence
gtcatgacattgagagagtt

SEQ ID NO: 471149 - DNA, 20 bp, Artificial
  CRISPR gRNA sequence
agagagttcttgcaaaagta

SEQ ID NO: 471150 - DNA, 20 bp, Artificial
  CRISPR gRNA sequence
ttgcaaaagtagaaaggaat

SEQ ID NO: 471151 - DNA, 20 bp, Artificial
  CRISPR gRNA sequence
gcaaaagtagaaaggaatta

SEQ ID NO: 471152 - DNA, 20 bp, Artificial
  CRISPR gRNA sequence
caaaagtagaaaggaattat

SEQ ID NO: 471153 - DNA, 20 bp, Artificial
  CRISPR gRNA sequence
ttttcaaaatatcacaccat

SEQ ID NO: 471154 - DNA, 20 bp, Artificial
  CRISPR gRNA sequence
tcaaaatatcacaccattcc

SEQ ID NO: 471155 - DNA, 20 bp, Artificial
  CRISPR gRNA sequence
caaaatatcacaccattccc

SEQ ID NO: 471156 - DNA, 20 bp, Artificial
  CRISPR gRNA sequence
aaaatatcacaccattccca

SEQ ID NO: 471157 - DNA, 20 bp, Artificial
  CRISPR gRNA sequence
ccatcatagccaaacccaca

SEQ ID NO: 471158 - DNA, 20 bp, Artificial
  CRISPR gRNA sequence
ttcatatgcattattgttgg

SEQ ID NO: 471159 - DNA, 20 bp, Artificial
  CRISPR gRNA sequence
tcatatgcattattgttggg

SEQ ID NO: 471160 - DNA, 20 bp, Artificial
  CRISPR gRNA sequence
catatgcattattgttgggt

SEQ ID NO: 471161 - DNA, 20 bp, Artificial
  CRISPR gRNA sequence
atatgcattattgttgggta

SEQ ID NO: 471162 - DNA, 20 bp, Artificial
  CRISPR gRNA sequence
ttgttgggtaagaattcagg

SEQ ID NO: 471163 - DNA, 20 bp, Artificial
  CRISPR gRNA sequence
ttgggtaagaattcaggtca

SEQ ID NO: 471164 - DNA, 20 bp, Artificial
  CRISPR gRNA sequence
ggtaagaattcaggtcaagc

SEQ ID NO: 471165 - DNA, 20 bp, Artificial
  CRISPR gRNA sequence
aggtcaagcatatgtttata

SEQ ID NO: 471166 - DNA, 20 bp, Artificial
  CRISPR gRNA sequence
ataatggcaatagaaaatac

SEQ ID NO: 471167 - DNA, 20 bp, Artificial
  CRISPR gRNA sequence
taatggcaatagaaaataca

SEQ ID NO: 471168 - DNA, 20 bp, Artificial
  CRISPR gRNA sequence
attttctctggggacattgg

SEQ ID NO: 471169 - DNA, 20 bp, Artificial
  CRISPR gRNA sequence
tctctggggacattggttct

SEQ ID NO: 471170 - DNA, 20 bp, Artificial
  CRISPR gRNA sequence
ctctggggacattggttctt

SEQ ID NO: 471171 - DNA, 20 bp, Artificial
  CRISPR gRNA sequence
tctggggacattggttcttc

SEQ ID NO: 471172 - DNA, 20 bp, Artificial
  CRISPR gRNA sequence
tggggacattggttcttcag

SEQ ID NO: 471173 - DNA, 20 bp, Artificial
  CRISPR gRNA sequence
gggacattggttcttcagtt

SEQ ID NO: 471174 - DNA, 20 bp, Artificial
  CRISPR gRNA sequence
gttcttcagttacataaggg

SEQ ID NO: 471175 - DNA, 20 bp, Artificial
  CRISPR gRNA sequence
ttcagttacataagggtgtg

SEQ ID NO: 471176 - DNA, 20 bp, Artificial
  CRISPR gRNA sequence
cagttacataagggtgtgtg

SEQ ID NO: 471177 - DNA, 20 bp, Artificial
  CRISPR gRNA sequence
agttacataagggtgtgtgt

SEQ ID NO: 471178 - DNA, 20 bp, Artificial
  CRISPR gRNA sequence
cataagggtgtgtgtgggat

SEQ ID NO: 471179 - DNA, 20 bp, Artificial
  CRISPR gRNA sequence
gcatgatgtggtgtggctgt

SEQ ID NO: 471180 - DNA, 20 bp, Artificial
  CRISPR gRNA sequence
tgaaaagaggataatacaaa

SEQ ID NO: 471181 - DNA, 20 bp, Artificial
  CRISPR gRNA sequence
gatctgagagattgtttcaa

SEQ ID NO: 471182 - DNA, 20 bp, Artificial
  CRISPR gRNA sequence
atctgagagattgtttcaac

SEQ ID NO: 471183 - DNA, 20 bp, Artificial
  CRISPR gRNA sequence
agagattgtttcaacttcca

SEQ ID NO: 471184 - DNA, 20 bp, Artificial
  CRISPR gRNA sequence
tttcaacttccaatcctgtt

SEQ ID NO: 471185 - DNA, 20 bp, Artificial
  CRISPR gRNA sequence
caacttccaatcctgttaag

SEQ ID NO: 471186 - DNA, 20 bp, Artificial
  CRISPR gRNA sequence
aacttccaatcctgttaagg

SEQ ID NO: 471187 - DNA, 20 bp, Artificial
  CRISPR gRNA sequence
ccaatcctgttaaggtttag

SEQ ID NO: 471188 - DNA, 20 bp, Artificial
  CRISPR gRNA sequence
caatcctgttaaggtttaga

SEQ ID NO: 471189 - DNA, 20 bp, Artificial
  CRISPR gRNA sequence
ttaaggtttagaagagctct

SEQ ID NO: 471190 - DNA, 20 bp, Artificial
  CRISPR gRNA sequence
aggtttagaagagctctttc

SEQ ID NO: 471191 - DNA, 20 bp, Artificial
  CRISPR gRNA sequence
agaagagctctttctcacac

SEQ ID NO: 471192 - DNA, 20 bp, Artificial
  CRISPR gRNA sequence
gaagagctctttctcacaca

SEQ ID NO: 471193 - DNA, 20 bp, Artificial
  CRISPR gRNA sequence
tttctcacacaaacctaaga

SEQ ID NO: 471194 - DNA, 20 bp, Artificial
  CRISPR gRNA sequence
tctcacacaaacctaagatt

SEQ ID NO: 471195 - DNA, 20 bp, Artificial
  CRISPR gRNA sequence
ctcacacaaacctaagattg

SEQ ID NO: 471196 - DNA, 20 bp, Artificial
  CRISPR gRNA sequence
tcacacaaacctaagattga

SEQ ID NO: 471197 - DNA, 20 bp, Artificial
  CRISPR gRNA sequence
acacaaacctaagattgatg

SEQ ID NO: 471198 - DNA, 20 bp, Artificial
  CRISPR gRNA sequence
agattgatgcaaagagaatg

SEQ ID NO: 471199 - DNA, 20 bp, Artificial
  CRISPR gRNA sequence
atgcaaagagaatgatgaag

SEQ ID NO: 471200 - DNA, 20 bp, Artificial
  CRISPR gRNA sequence
agcaatgtgctatgctcgcc

SEQ ID NO: 471201 - DNA, 20 bp, Artificial
  CRISPR gRNA sequence
tgctcgccacaactctagct

SEQ ID NO: 471202 - DNA, 20 bp, Artificial
  CRISPR gRNA sequence
gccacaactctagctggaat

SEQ ID NO: 471203 - DNA, 20 bp, Artificial
  CRISPR gRNA sequence
tagctggaatactgtgcgtg

SEQ ID NO: 471204 - DNA, 20 bp, Artificial
  CRISPR gRNA sequence
gctggaatactgtgcgtggt

SEQ ID NO: 471205 - DNA, 20 bp, Artificial
  CRISPR gRNA sequence
gaatactgtgcgtggtgagc

SEQ ID NO: 471206 - DNA, 20 bp, Artificial
  CRISPR gRNA sequence
tgcgtggtgagcatgcctct

SEQ ID NO: 471207 - DNA, 20 bp, Artificial
  CRISPR gRNA sequence
tcccgtgactcaagggagcc

SEQ ID NO: 471208 - DNA, 20 bp, Artificial
  CRISPR gRNA sequence
ccgtgactcaagggagcccc

SEQ ID NO: 471209 - DNA, 20 bp, Artificial
  CRISPR gRNA sequence
aagggagccccaaccaacct

SEQ ID NO: 471210 - DNA, 20 bp, Artificial
  CRISPR gRNA sequence
tttagctttttagcgcaaat

SEQ ID NO: 471211 - DNA, 20 bp, Artificial
  CRISPR gRNA sequence
agctttttagcgcaaatatg

SEQ ID NO: 471212 - DNA, 20 bp, Artificial
  CRISPR gRNA sequence
gctttttagcgcaaatatga

SEQ ID NO: 471213 - DNA, 20 bp, Artificial
  CRISPR gRNA sequence
tttagcgcaaatatgagttg

SEQ ID NO: 471214 - DNA, 20 bp, Artificial
  CRISPR gRNA sequence
ttagcgcaaatatgagttgt

SEQ ID NO: 471215 - DNA, 20 bp, Artificial
  CRISPR gRNA sequence
tagcgcaaatatgagttgtc

SEQ ID NO: 471216 - DNA, 20 bp, Artificial
  CRISPR gRNA sequence
agcgcaaatatgagttgtct

SEQ ID NO: 471217 - DNA, 20 bp, Artificial
  CRISPR gRNA sequence
gcgcaaatatgagttgtctt

SEQ ID NO: 471218 - DNA, 20 bp, Artificial
  CRISPR gRNA sequence
tcttctaggaaatcattatc

SEQ ID NO: 471219 - DNA, 20 bp, Artificial
  CRISPR gRNA sequence
ctaggaaatcattatccatg

SEQ ID NO: 471220 - DNA, 20 bp, Artificial
  CRISPR gRNA sequence
taggaaatcattatccatgg

SEQ ID NO: 471221 - DNA, 20 bp, Artificial
  CRISPR gRNA sequence
ggaaatcattatccatggtt

SEQ ID NO: 471222 - DNA, 20 bp, Artificial
  CRISPR gRNA sequence
tccatggtttacaggattgg

SEQ ID NO: 471223 - DNA, 20 bp, Artificial
  CRISPR gRNA sequence
acaggattgggaaagaaaac

SEQ ID NO: 471224 - DNA, 20 bp, Artificial
  CRISPR gRNA sequence
caggattgggaaagaaaaca

SEQ ID NO: 471225 - DNA, 20 bp, Artificial
  CRISPR gRNA sequence
ggaaagaaaacaacaggaag

SEQ ID NO: 471226 - DNA, 20 bp, Artificial
  CRISPR gRNA sequence
aaaatcctttagccccagaa

SEQ ID NO: 471227 - DNA, 20 bp, Artificial
  CRISPR gRNA sequence
tagccccagaaataagaatg

SEQ ID NO: 471228 - DNA, 20 bp, Artificial
  CRISPR gRNA sequence
agccccagaaataagaatgg

SEQ ID NO: 471229 - DNA, 20 bp, Artificial
  CRISPR gRNA sequence
gccccagaaataagaatggc

SEQ ID NO: 471230 - DNA, 20 bp, Artificial
  CRISPR gRNA sequence
ggggcagagggaaaatagaa

SEQ ID NO: 471231 - DNA, 20 bp, Artificial
  CRISPR gRNA sequence
ggtgccttctcaggcagcag

SEQ ID NO: 471232 - DNA, 20 bp, Artificial
  CRISPR gRNA sequence
gtgccttctcaggcagcaga

SEQ ID NO: 471233 - DNA, 20 bp, Artificial
  CRISPR gRNA sequence
ctcaggcagcagaacaggca

SEQ ID NO: 471234 - DNA, 20 bp, Artificial
  CRISPR gRNA sequence
tcaggcagcagaacaggcag

SEQ ID NO: 471235 - DNA, 20 bp, Artificial
  CRISPR gRNA sequence
aggcagcagaacaggcagaa

SEQ ID NO: 471236 - DNA, 20 bp, Artificial
  CRISPR gRNA sequence
cttgccatttcgtccttgga

SEQ ID NO: 471237 - DNA, 20 bp, Artificial
  CRISPR gRNA sequence
gccatttcgtccttggaggg

SEQ ID NO: 471238 - DNA, 20 bp, Artificial
  CRISPR gRNA sequence
ccatttcgtccttggagggt

SEQ ID NO: 471239 - DNA, 20 bp, Artificial
  CRISPR gRNA sequence
cgtccttggagggtcgttct

SEQ ID NO: 471240 - DNA, 20 bp, Artificial
  CRISPR gRNA sequence
gtccttggagggtcgttctg

SEQ ID NO: 471241 - DNA, 20 bp, Artificial
  CRISPR gRNA sequence
ggagggtcgttctgaggcac

SEQ ID NO: 471242 - DNA, 20 bp, Artificial
  CRISPR gRNA sequence
gagggtcgttctgaggcact

SEQ ID NO: 471243 - DNA, 20 bp, Artificial
  CRISPR gRNA sequence
tgaggcactttttacatctg

SEQ ID NO: 471244 - DNA, 20 bp, Artificial
  CRISPR gRNA sequence
aggcactttttacatctgga

SEQ ID NO: 471245 - DNA, 20 bp, Artificial
  CRISPR gRNA sequence
tttacatctggaatgttagt

SEQ ID NO: 471246 - DNA, 20 bp, Artificial
  CRISPR gRNA sequence
ttacatctggaatgttagta

SEQ ID NO: 471247 - DNA, 20 bp, Artificial
  CRISPR gRNA sequence
tacatctggaatgttagtaa

SEQ ID NO: 471248 - DNA, 20 bp, Artificial
  CRISPR gRNA sequence
acatctggaatgttagtaaa

SEQ ID NO: 471249 - DNA, 20 bp, Artificial
  CRISPR gRNA sequence
catctggaatgttagtaaat

SEQ ID NO: 471250 - DNA, 20 bp, Artificial
  CRISPR gRNA sequence
gaatgttagtaaatgctaaa

SEQ ID NO: 471251 - DNA, 20 bp, Artificial
  CRISPR gRNA sequence
gtaaatgctaaagagagtta

SEQ ID NO: 471252 - DNA, 20 bp, Artificial
  CRISPR gRNA sequence
aagagagttaggaaatctga

SEQ ID NO: 471253 - DNA, 20 bp, Artificial
  CRISPR gRNA sequence
ggaaatctgagatatattgg

SEQ ID NO: 471254 - DNA, 20 bp, Artificial
  CRISPR gRNA sequence
agatatattgggatcagcgg

SEQ ID NO: 471255 - DNA, 20 bp, Artificial
  CRISPR gRNA sequence
ggatcagcggcacccctctg

SEQ ID NO: 471256 - DNA, 20 bp, Artificial
  CRISPR gRNA sequence
tgcattgtcagaacttgagt

SEQ ID NO: 471257 - DNA, 20 bp, Artificial
  CRISPR gRNA sequence
cattgtcagaacttgagtga

SEQ ID NO: 471258 - DNA, 20 bp, Artificial
  CRISPR gRNA sequence
tcagaacttgagtgaaggag

SEQ ID NO: 471259 - DNA, 20 bp, Artificial
  CRISPR gRNA sequence
gagtgaaggagatttcaggc

SEQ ID NO: 471260 - DNA, 20 bp, Artificial
  CRISPR gRNA sequence
agtgaaggagatttcaggcc

SEQ ID NO: 471261 - DNA, 20 bp, Artificial
  CRISPR gRNA sequence
caggccaatgcctccatttc

SEQ ID NO: 471262 - DNA, 20 bp, Artificial
  CRISPR gRNA sequence
aggccaatgcctccatttcc

SEQ ID NO: 471263 - DNA, 20 bp, Artificial
  CRISPR gRNA sequence
catttccccttcagaggcat

SEQ ID NO: 471264 - DNA, 20 bp, Artificial
  CRISPR gRNA sequence
ccccttcagaggcattcctc

SEQ ID NO: 471265 - DNA, 20 bp, Artificial
  CRISPR gRNA sequence
cccttcagaggcattcctca

SEQ ID NO: 471266 - DNA, 20 bp, Artificial
  CRISPR gRNA sequence
cagaggcattcctcaagaat

SEQ ID NO: 471267 - DNA, 20 bp, Artificial
  CRISPR gRNA sequence
agaggcattcctcaagaatc

SEQ ID NO: 471268 - DNA, 20 bp, Artificial
  CRISPR gRNA sequence
ctcaagaatcccagtgccct

SEQ ID NO: 471269 - DNA, 20 bp, Artificial
  CRISPR gRNA sequence
aagaatcccagtgccctcag

SEQ ID NO: 471270 - DNA, 20 bp, Artificial
  CRISPR gRNA sequence
agccacctcttgctttcttg

SEQ ID NO: 471271 - DNA, 20 bp, Artificial
  CRISPR gRNA sequence
ttgctttcttgctgagcaga

SEQ ID NO: 471272 - DNA, 20 bp, Artificial
  CRISPR gRNA sequence
gctttcttgctgagcagacg

SEQ ID NO: 471273 - DNA, 20 bp, Artificial
  CRISPR gRNA sequence
ctttcttgctgagcagacgt

SEQ ID NO: 471274 - DNA, 20 bp, Artificial
  CRISPR gRNA sequence
tcttgctgagcagacgtggc

SEQ ID NO: 471275 - DNA, 20 bp, Artificial
  CRISPR gRNA sequence
cttgctgagcagacgtggct

SEQ ID NO: 471276 - DNA, 20 bp, Artificial
  CRISPR gRNA sequence
ttgctgagcagacgtggctc

SEQ ID NO: 471277 - DNA, 20 bp, Artificial
  CRISPR gRNA sequence
gctgagcagacgtggctctg

SEQ ID NO: 471278 - DNA, 20 bp, Artificial
  CRISPR gRNA sequence
ctgagcagacgtggctctgc

SEQ ID NO: 471279 - DNA, 20 bp, Artificial
  CRISPR gRNA sequence
agcagacgtggctctgcgat

SEQ ID NO: 471280 - DNA, 20 bp, Artificial
  CRISPR gRNA sequence
tgcgataatttatcttttgc

SEQ ID NO: 471281 - DNA, 20 bp, Artificial
  CRISPR gRNA sequence
cgataatttatcttttgcag

SEQ ID NO: 471282 - DNA, 20 bp, Artificial
  CRISPR gRNA sequence
atcttttgcagaaattcttt

SEQ ID NO: 471283 - DNA, 20 bp, Artificial
  CRISPR gRNA sequence
tcttttgcagaaattcttta

SEQ ID NO: 471284 - DNA, 20 bp, Artificial
  CRISPR gRNA sequence
ttgcagaaattctttattct

SEQ ID NO: 471285 - DNA, 20 bp, Artificial
  CRISPR gRNA sequence
tgcagaaattctttattctg

SEQ ID NO: 471286 - DNA, 20 bp, Artificial
  CRISPR gRNA sequence
gcagaaattctttattctga

SEQ ID NO: 471287 - DNA, 20 bp, Artificial
  CRISPR gRNA sequence
cagaaattctttattctgat

SEQ ID NO: 471288 - DNA, 20 bp, Artificial
  CRISPR gRNA sequence
tttattctgatagagttaat

SEQ ID NO: 471289 - DNA, 20 bp, Artificial
  CRISPR gRNA sequence
tattctgatagagttaatct

SEQ ID NO: 471290 - DNA, 20 bp, Artificial
  CRISPR gRNA sequence
attctgatagagttaatctt

SEQ ID NO: 471291 - DNA, 20 bp, Artificial
  CRISPR gRNA sequence
ttctgatagagttaatcttc

SEQ ID NO: 471292 - DNA, 20 bp, Artificial
  CRISPR gRNA sequence
tgatagagttaatcttccac

SEQ ID NO: 471293 - DNA, 20 bp, Artificial
  CRISPR gRNA sequence
atagagttaatcttccacag

SEQ ID NO: 471294 - DNA, 20 bp, Artificial
  CRISPR gRNA sequence
atcttccacagaacaatctt

SEQ ID NO: 471295 - DNA, 20 bp, Artificial
  CRISPR gRNA sequence
ccacagaacaatcttcatga

SEQ ID NO: 471296 - DNA, 20 bp, Artificial
  CRISPR gRNA sequence
cacagaacaatcttcatgat

SEQ ID NO: 471297 - DNA, 20 bp, Artificial
  CRISPR gRNA sequence
catgataactgtcagaaggt

SEQ ID NO: 471298 - DNA, 20 bp, Artificial
  CRISPR gRNA sequence
atgataactgtcagaaggta

SEQ ID NO: 471299 - DNA, 20 bp, Artificial
  CRISPR gRNA sequence
tcagaaggtacttcattaag

SEQ ID NO: 471300 - DNA, 20 bp, Artificial
  CRISPR gRNA sequence
cattaagcctttctatttac

SEQ ID NO: 471301 - DNA, 20 bp, Artificial
  CRISPR gRNA sequence
attaagcctttctatttaca

SEQ ID NO: 471302 - DNA, 20 bp, Artificial
  CRISPR gRNA sequence
agcctttctatttacagtat

SEQ ID NO: 471303 - DNA, 20 bp, Artificial
  CRISPR gRNA sequence
tctatttacagtatctaact

SEQ ID NO: 471304 - DNA, 20 bp, Artificial
  CRISPR gRNA sequence
ctatttacagtatctaactc

SEQ ID NO: 471305 - DNA, 20 bp, Artificial
  CRISPR gRNA sequence
tatttacagtatctaactct

SEQ ID NO: 471306 - DNA, 20 bp, Artificial
  CRISPR gRNA sequence
tttacagtatctaactctca

SEQ ID NO: 471307 - DNA, 20 bp, Artificial
  CRISPR gRNA sequence
acagtatctaactctcatat

SEQ ID NO: 471308 - DNA, 20 bp, Artificial
  CRISPR gRNA sequence
cagtatctaactctcatatt

SEQ ID NO: 471309 - DNA, 20 bp, Artificial
  CRISPR gRNA sequence
actctcatattcatcactta

SEQ ID NO: 471310 - DNA, 20 bp, Artificial
  CRISPR gRNA sequence
tcatattcatcacttaagta

SEQ ID NO: 471311 - DNA, 20 bp, Artificial
  CRISPR gRNA sequence
atattcatcacttaagtagg

SEQ ID NO: 471312 - DNA, 20 bp, Artificial
  CRISPR gRNA sequence
atcacttaagtaggaaaacc

SEQ ID NO: 471313 - DNA, 20 bp, Artificial
  CRISPR gRNA sequence
aagtaggaaaaccattgtct

SEQ ID NO: 471314 - DNA, 20 bp, Artificial
  CRISPR gRNA sequence
agtaggaaaaccattgtctt

SEQ ID NO: 471315 - DNA, 20 bp, Artificial
  CRISPR gRNA sequence
tctttattttgtcccaagag

SEQ ID NO: 471316 - DNA, 20 bp, Artificial
  CRISPR gRNA sequence
tattttgtcccaagagttgc

SEQ ID NO: 471317 - DNA, 20 bp, Artificial
  CRISPR gRNA sequence
attttgtcccaagagttgct

SEQ ID NO: 471318 - DNA, 20 bp, Artificial
  CRISPR gRNA sequence
ttttgtcccaagagttgctc

SEQ ID NO: 471319 - DNA, 20 bp, Artificial
  CRISPR gRNA sequence
tgtcccaagagttgctccaa

SEQ ID NO: 471320 - DNA, 20 bp, Artificial
  CRISPR gRNA sequence
gtcccaagagttgctccaag

SEQ ID NO: 471321 - DNA, 20 bp, Artificial
  CRISPR gRNA sequence
tcccaagagttgctccaagt

SEQ ID NO: 471322 - DNA, 20 bp, Artificial
  CRISPR gRNA sequence
ctccaagtcagatagctagt

SEQ ID NO: 471323 - DNA, 20 bp, Artificial
  CRISPR gRNA sequence
caagtcagatagctagtgag

SEQ ID NO: 471324 - DNA, 20 bp, Artificial
  CRISPR gRNA sequence
gtgagtggcaatgggaactc

SEQ ID NO: 471325 - DNA, 20 bp, Artificial
  CRISPR gRNA sequence
aagccaacatgtttgtaaca

SEQ ID NO: 471326 - DNA, 20 bp, Artificial
  CRISPR gRNA sequence
gtaacaggaaattcaagttt

SEQ ID NO: 471327 - DNA, 20 bp, Artificial
  CRISPR gRNA sequence
taacaggaaattcaagtttc

SEQ ID NO: 471328 - DNA, 20 bp, Artificial
  CRISPR gRNA sequence
aagtttcttcaacacaatgt

SEQ ID NO: 471329 - DNA, 20 bp, Artificial
  CRISPR gRNA sequence
cttcaacacaatgtcctttc

SEQ ID NO: 471330 - DNA, 20 bp, Artificial
  CRISPR gRNA sequence
ttcaacacaatgtcctttcc

SEQ ID NO: 471331 - DNA, 20 bp, Artificial
  CRISPR gRNA sequence
caacacaatgtcctttcctt

SEQ ID NO: 471332 - DNA, 20 bp, Artificial
  CRISPR gRNA sequence
aacacaatgtcctttccttg

SEQ ID NO: 471333 - DNA, 20 bp, Artificial
  CRISPR gRNA sequence
tccttgtctcgtaacttatc

SEQ ID NO: 471334 - DNA, 20 bp, Artificial
  CRISPR gRNA sequence
ccttgtctcgtaacttatca

SEQ ID NO: 471335 - DNA, 20 bp, Artificial
  CRISPR gRNA sequence
cttgtctcgtaacttatcag

SEQ ID NO: 471336 - DNA, 20 bp, Artificial
  CRISPR gRNA sequence
gtctcgtaacttatcagaat

SEQ ID NO: 471337 - DNA, 20 bp, Artificial
  CRISPR gRNA sequence
tctcgtaacttatcagaatc

SEQ ID NO: 471338 - DNA, 20 bp, Artificial
  CRISPR gRNA sequence
gtaacttatcagaatctcca

SEQ ID NO: 471339 - DNA, 20 bp, Artificial
  CRISPR gRNA sequence
atcagaatctccaaatatca

SEQ ID NO: 471340 - DNA, 20 bp, Artificial
  CRISPR gRNA sequence
tcagaatctccaaatatcaa

SEQ ID NO: 471341 - DNA, 20 bp, Artificial
  CRISPR gRNA sequence
caaatatcaaatacttttga

SEQ ID NO: 471342 - DNA, 20 bp, Artificial
  CRISPR gRNA sequence
ttgatagccttaaaagtgct

SEQ ID NO: 471343 - DNA, 20 bp, Artificial
  CRISPR gRNA sequence
tgatagccttaaaagtgctc

SEQ ID NO: 471344 - DNA, 20 bp, Artificial
  CRISPR gRNA sequence
gatagccttaaaagtgctct

SEQ ID NO: 471345 - DNA, 20 bp, Artificial
  CRISPR gRNA sequence
atagccttaaaagtgctctg

SEQ ID NO: 471346 - DNA, 20 bp, Artificial
  CRISPR gRNA sequence
aaaagtgctctgcatggcac

SEQ ID NO: 471347 - DNA, 20 bp, Artificial
  CRISPR gRNA sequence
aaagtgctctgcatggcaca

SEQ ID NO: 471348 - DNA, 20 bp, Artificial
  CRISPR gRNA sequence
tgcatggcacacagctaatg

SEQ ID NO: 471349 - DNA, 20 bp, Artificial
  CRISPR gRNA sequence
catggcacacagctaatgcg

SEQ ID NO: 471350 - DNA, 20 bp, Artificial
  CRISPR gRNA sequence
atgcgcattactattgatca

SEQ ID NO: 471351 - DNA, 20 bp, Artificial
  CRISPR gRNA sequence
ctattgatcaatgttaatac

SEQ ID NO: 471352 - DNA, 20 bp, Artificial
  CRISPR gRNA sequence
ttgatcaatgttaatacgca

SEQ ID NO: 471353 - DNA, 20 bp, Artificial
  CRISPR gRNA sequence
atcaatgttaatacgcattg

SEQ ID NO: 471354 - DNA, 20 bp, Artificial
  CRISPR gRNA sequence
atacgcattgaggccctgtt

SEQ ID NO: 471355 - DNA, 20 bp, Artificial
  CRISPR gRNA sequence
aggccctgtttgtctgcagt

SEQ ID NO: 471356 - DNA, 20 bp, Artificial
  CRISPR gRNA sequence
tttgtctgcagttgttcaca

SEQ ID NO: 471357 - DNA, 20 bp, Artificial
  CRISPR gRNA sequence
gtctgcagttgttcacagct

SEQ ID NO: 471358 - DNA, 20 bp, Artificial
  CRISPR gRNA sequence
tctgcagttgttcacagctc

SEQ ID NO: 471359 - DNA, 20 bp, Artificial
  CRISPR gRNA sequence
cagttgttcacagctcatta

SEQ ID NO: 471360 - DNA, 20 bp, Artificial
  CRISPR gRNA sequence
ttcacagctcattagcaggt

SEQ ID NO: 471361 - DNA, 20 bp, Artificial
  CRISPR gRNA sequence
acagctcattagcaggttgt

SEQ ID NO: 471362 - DNA, 20 bp, Artificial
  CRISPR gRNA sequence
attagcaggttgtgaaacaa

SEQ ID NO: 471363 - DNA, 20 bp, Artificial
  CRISPR gRNA sequence
gcaggttgtgaaacaattta

SEQ ID NO: 471364 - DNA, 20 bp, Artificial
  CRISPR gRNA sequence
tgaaacaatttagtatgtca

SEQ ID NO: 471365 - DNA, 20 bp, Artificial
  CRISPR gRNA sequence
agtatgtcacaaatagcatt

SEQ ID NO: 471366 - DNA, 20 bp, Artificial
  CRISPR gRNA sequence
gtatgtcacaaatagcattt

SEQ ID NO: 471367 - DNA, 20 bp, Artificial
  CRISPR gRNA sequence
taaaaaatgaaacagaagag

SEQ ID NO: 471368 - DNA, 20 bp, Artificial
  CRISPR gRNA sequence
aaaaaatgaaacagaagagg

SEQ ID NO: 471369 - DNA, 20 bp, Artificial
  CRISPR gRNA sequence
aaaaatgaaacagaagagga

SEQ ID NO: 471370 - DNA, 20 bp, Artificial
  CRISPR gRNA sequence
gagcagtggttctcaagcag

SEQ ID NO: 471371 - DNA, 20 bp, Artificial
  CRISPR gRNA sequence
tcaagcagggaacatgtgtg

SEQ ID NO: 471372 - DNA, 20 bp, Artificial
  CRISPR gRNA sequence
aagcagggaacatgtgtggc

SEQ ID NO: 471373 - DNA, 20 bp, Artificial
  CRISPR gRNA sequence
gagacatttttggctgtaac

SEQ ID NO: 471374 - DNA, 20 bp, Artificial
  CRISPR gRNA sequence
ttggctgtaacaaggtaggg

SEQ ID NO: 471375 - DNA, 20 bp, Artificial
  CRISPR gRNA sequence
tggctgtaacaaggtagggg

SEQ ID NO: 471376 - DNA, 20 bp, Artificial
  CRISPR gRNA sequence
ggctgtaacaaggtaggggg

SEQ ID NO: 471377 - DNA, 20 bp, Artificial
  CRISPR gRNA sequence
gctgtaacaaggtaggggga

SEQ ID NO: 471378 - DNA, 20 bp, Artificial
  CRISPR gRNA sequence
taacaaggtagggggaggga

SEQ ID NO: 471379 - DNA, 20 bp, Artificial
  CRISPR gRNA sequence
gcaaccagtgagtagaagcc

SEQ ID NO: 471380 - DNA, 20 bp, Artificial
  CRISPR gRNA sequence
tgctaaacaccctacactat

SEQ ID NO: 471381 - DNA, 20 bp, Artificial
  CRISPR gRNA sequence
ctaaacaccctacactatac

SEQ ID NO: 471382 - DNA, 20 bp, Artificial
  CRISPR gRNA sequence
aacaccctacactatacagg

SEQ ID NO: 471383 - DNA, 20 bp, Artificial
  CRISPR gRNA sequence
cactatacaggatgcaaccc

SEQ ID NO: 471384 - DNA, 20 bp, Artificial
  CRISPR gRNA sequence
tacaggatgcaacccccact

SEQ ID NO: 471385 - DNA, 20 bp, Artificial
  CRISPR gRNA sequence
agtgcaacaaaacattatcc

SEQ ID NO: 471386 - DNA, 20 bp, Artificial
  CRISPR gRNA sequence
gtgcaacaaaacattatcca

SEQ ID NO: 471387 - DNA, 20 bp, Artificial
  CRISPR gRNA sequence
tccagaccaaagtgtcaatg

SEQ ID NO: 471388 - DNA, 20 bp, Artificial
  CRISPR gRNA sequence
tgtcttatggttaagtatga

SEQ ID NO: 471389 - DNA, 20 bp, Artificial
  CRISPR gRNA sequence
tcttatggttaagtatgacc

SEQ ID NO: 471390 - DNA, 20 bp, Artificial
  CRISPR gRNA sequence
atggttaagtatgaccttat

SEQ ID NO: 471391 - DNA, 20 bp, Artificial
  CRISPR gRNA sequence
tggttaagtatgaccttatg

SEQ ID NO: 471392 - DNA, 20 bp, Artificial
  CRISPR gRNA sequence
agtatgaccttatgaaactt

SEQ ID NO: 471393 - DNA, 20 bp, Artificial
  CRISPR gRNA sequence
atgaaacttttttatatttg

SEQ ID NO: 471394 - DNA, 20 bp, Artificial
  CRISPR gRNA sequence
tgaaacttttttatatttgt

SEQ ID NO: 471395 - DNA, 20 bp, Artificial
  CRISPR gRNA sequence
ttttatatttgtgtgcatta

SEQ ID NO: 471396 - DNA, 20 bp, Artificial
  CRISPR gRNA sequence
tttatatttgtgtgcattat

SEQ ID NO: 471397 - DNA, 20 bp, Artificial
  CRISPR gRNA sequence
ttatatttgtgtgcattatg

SEQ ID NO: 471398 - DNA, 20 bp, Artificial
  CRISPR gRNA sequence
tatatttgtgtgcattatgg

SEQ ID NO: 471399 - DNA, 20 bp, Artificial
  CRISPR gRNA sequence
atatttgtgtgcattatggg

SEQ ID NO: 471400 - DNA, 20 bp, Artificial
  CRISPR gRNA sequence
tatttgtgtgcattatgggt

SEQ ID NO: 471401 - DNA, 20 bp, Artificial
  CRISPR gRNA sequence
gtgtgcattatgggttgtga

SEQ ID NO: 471402 - DNA, 20 bp, Artificial
  CRISPR gRNA sequence
tgtgcattatgggttgtgat

SEQ ID NO: 471403 - DNA, 20 bp, Artificial
  CRISPR gRNA sequence
tgggttgtgatgtaagatct

SEQ ID NO: 471404 - DNA, 20 bp, Artificial
  CRISPR gRNA sequence
tgatgtaagatctggttgtt

SEQ ID NO: 471405 - DNA, 20 bp, Artificial
  CRISPR gRNA sequence
gttgttgttgttgttgttgt

SEQ ID NO: 471406 - DNA, 20 bp, Artificial
  CRISPR gRNA sequence
ttgttgttgttgttgttttt

SEQ ID NO: 471407 - DNA, 20 bp, Artificial
  CRISPR gRNA sequence
ttgttgttgttgtttttttt

SEQ ID NO: 471408 - DNA, 20 bp, Artificial
  CRISPR gRNA sequence
ttgttgttgttttttttaat

SEQ ID NO: 471409 - DNA, 20 bp, Artificial
  CRISPR gRNA sequence
ttgttgttttttttaatttt

SEQ ID NO: 471410 - DNA, 20 bp, Artificial
  CRISPR gRNA sequence
ttgttttttttaattttggg

SEQ ID NO: 471411 - DNA, 20 bp, Artificial
  CRISPR gRNA sequence
ttttttttaattttgggtta

SEQ ID NO: 471412 - DNA, 20 bp, Artificial
  CRISPR gRNA sequence
tttttaattttgggttacag

SEQ ID NO: 471413 - DNA, 20 bp, Artificial
  CRISPR gRNA sequence
ttttaattttgggttacagt

SEQ ID NO: 471414 - DNA, 20 bp, Artificial
  CRISPR gRNA sequence
tttaattttgggttacagtt

SEQ ID NO: 471415 - DNA, 20 bp, Artificial
  CRISPR gRNA sequence
ttaattttgggttacagtta

SEQ ID NO: 471416 - DNA, 20 bp, Artificial
  CRISPR gRNA sequence
taattttgggttacagttaa

SEQ ID NO: 471417 - DNA, 20 bp, Artificial
  CRISPR gRNA sequence
aattttgggttacagttaac

SEQ ID NO: 471418 - DNA, 20 bp, Artificial
  CRISPR gRNA sequence
attttgggttacagttaaca

SEQ ID NO: 471419 - DNA, 20 bp, Artificial
  CRISPR gRNA sequence
tgggttacagttaacacagt

SEQ ID NO: 471420 - DNA, 20 bp, Artificial
  CRISPR gRNA sequence
gggttacagttaacacagta

SEQ ID NO: 471421 - DNA, 20 bp, Artificial
  CRISPR gRNA sequence
ggttacagttaacacagtat

SEQ ID NO: 471422 - DNA, 20 bp, Artificial
  CRISPR gRNA sequence
cagttaacacagtatgaaaa

SEQ ID NO: 471423 - DNA, 20 bp, Artificial
  CRISPR gRNA sequence
acacagtatgaaaaatactg

SEQ ID NO: 471424 - DNA, 20 bp, Artificial
  CRISPR gRNA sequence
gagtaagatattctaaggtc

SEQ ID NO: 471425 - DNA, 20 bp, Artificial
  CRISPR gRNA sequence
taaggtctggcctggtggct

SEQ ID NO: 471426 - DNA, 20 bp, Artificial
  CRISPR gRNA sequence
aggtctggcctggtggctca

SEQ ID NO: 471427 - DNA, 20 bp, Artificial
  CRISPR gRNA sequence
gcctggtggctcacacctgt

SEQ ID NO: 471428 - DNA, 20 bp, Artificial
  CRISPR gRNA sequence
gtggctcacacctgtaatct

SEQ ID NO: 471429 - DNA, 20 bp, Artificial
  CRISPR gRNA sequence
acacctgtaatctcagcact

SEQ ID NO: 471430 - DNA, 20 bp, Artificial
  CRISPR gRNA sequence
taatctcagcactttgggag

SEQ ID NO: 471431 - DNA, 20 bp, Artificial
  CRISPR gRNA sequence
agcactttgggaggccgagg

SEQ ID NO: 471432 - DNA, 20 bp, Artificial
  CRISPR gRNA sequence
tgggaggccgaggtaggcgg

SEQ ID NO: 471433 - DNA, 20 bp, Artificial
  CRISPR gRNA sequence
gggaggccgaggtaggcgga

SEQ ID NO: 471434 - DNA, 20 bp, Artificial
  CRISPR gRNA sequence
ggaggccgaggtaggcggat

SEQ ID NO: 471435 - DNA, 20 bp, Artificial
  CRISPR gRNA sequence
gagatcaggagttcgagacc

SEQ ID NO: 471436 - DNA, 20 bp, Artificial
  CRISPR gRNA sequence
agatcaggagttcgagacca

SEQ ID NO: 471437 - DNA, 20 bp, Artificial
  CRISPR gRNA sequence
gagaccagcatggccaaaat

SEQ ID NO: 471438 - DNA, 20 bp, Artificial
  CRISPR gRNA sequence
tactaaaaatacaaaaatta

SEQ ID NO: 471439 - DNA, 20 bp, Artificial
  CRISPR gRNA sequence
ctaaaaatacaaaaattagc

SEQ ID NO: 471440 - DNA, 20 bp, Artificial
  CRISPR gRNA sequence
aaaatacaaaaattagctgg

SEQ ID NO: 471441 - DNA, 20 bp, Artificial
  CRISPR gRNA sequence
gctgggcgtggtatgcacct

SEQ ID NO: 471442 - DNA, 20 bp, Artificial
  CRISPR gRNA sequence
ggcgtggtatgcacctgtaa

SEQ ID NO: 471443 - DNA, 20 bp, Artificial
  CRISPR gRNA sequence
taatcccaggtacatgggag

SEQ ID NO: 471444 - DNA, 20 bp, Artificial
  CRISPR gRNA sequence
agacaggagaatcgcttgaa

SEQ ID NO: 471445 - DNA, 20 bp, Artificial
  CRISPR gRNA sequence
gaactcggtaggtggagact

SEQ ID NO: 471446 - DNA, 20 bp, Artificial
  CRISPR gRNA sequence
aactcggtaggtggagactt

SEQ ID NO: 471447 - DNA, 20 bp, Artificial
  CRISPR gRNA sequence
ggtaggtggagacttcggtg

SEQ ID NO: 471448 - DNA, 20 bp, Artificial
  CRISPR gRNA sequence
cggtgaaccgagatggtacc

SEQ ID NO: 471449 - DNA, 20 bp, Artificial
  CRISPR gRNA sequence
ggtgaaccgagatggtacca

SEQ ID NO: 471450 - DNA, 20 bp, Artificial
  CRISPR gRNA sequence
cactcagcctgggtgacaga

SEQ ID NO: 471451 - DNA, 20 bp, Artificial
  CRISPR gRNA sequence
agcctgggtgacagagtaag

SEQ ID NO: 471452 - DNA, 20 bp, Artificial
  CRISPR gRNA sequence
ggtgacagagtaagactcca

SEQ ID NO: 471453 - DNA, 20 bp, Artificial
  CRISPR gRNA sequence
catctcaaacaaaaaaaaaa

SEQ ID NO: 471454 - DNA, 20 bp, Artificial
  CRISPR gRNA sequence
aaacaaaaaaaaaattctat

SEQ ID NO: 471455 - DNA, 20 bp, Artificial
  CRISPR gRNA sequence
tattaattatattataatgt

SEQ ID NO: 471456 - DNA, 20 bp, Artificial
  CRISPR gRNA sequence
ttaattatattataatgtta

SEQ ID NO: 471457 - DNA, 20 bp, Artificial
  CRISPR gRNA sequence
attatattataatgttattt

SEQ ID NO: 471458 - DNA, 20 bp, Artificial
  CRISPR gRNA sequence
tattataatgttattttgtt

SEQ ID NO: 471459 - DNA, 20 bp, Artificial
  CRISPR gRNA sequence
taatgttattttgtttggct

SEQ ID NO: 471460 - DNA, 20 bp, Artificial
  CRISPR gRNA sequence
ttttgtttggctagatgctt

SEQ ID NO: 471461 - DNA, 20 bp, Artificial
  CRISPR gRNA sequence
tgtttggctagatgcttagg

SEQ ID NO: 471462 - DNA, 20 bp, Artificial
  CRISPR gRNA sequence
gtttggctagatgcttaggt

SEQ ID NO: 471463 - DNA, 20 bp, Artificial
  CRISPR gRNA sequence
tttggctagatgcttaggtt

SEQ ID NO: 471464 - DNA, 20 bp, Artificial
  CRISPR gRNA sequence
ggctagatgcttaggtttgg

SEQ ID NO: 471465 - DNA, 20 bp, Artificial
  CRISPR gRNA sequence
gctagatgcttaggtttggg

SEQ ID NO: 471466 - DNA, 20 bp, Artificial
  CRISPR gRNA sequence
gatgcttaggtttggggtaa

SEQ ID NO: 471467 - DNA, 20 bp, Artificial
  CRISPR gRNA sequence
aggtttggggtaaaaatgat

SEQ ID NO: 471468 - DNA, 20 bp, Artificial
  CRISPR gRNA sequence
ggtttggggtaaaaatgatt

SEQ ID NO: 471469 - DNA, 20 bp, Artificial
  CRISPR gRNA sequence
ggggtaaaaatgattagagg

SEQ ID NO: 471470 - DNA, 20 bp, Artificial
  CRISPR gRNA sequence
gggtaaaaatgattagaggc

SEQ ID NO: 471471 - DNA, 20 bp, Artificial
  CRISPR gRNA sequence
gaggcaactgaagttgcaca

SEQ ID NO: 471472 - DNA, 20 bp, Artificial
  CRISPR gRNA sequence
aagttgcacaaaaagtggtt

SEQ ID NO: 471473 - DNA, 20 bp, Artificial
  CRISPR gRNA sequence
cacaaaaagtggtttggtta

SEQ ID NO: 471474 - DNA, 20 bp, Artificial
  CRISPR gRNA sequence
ggttattcagagtggtaaca

SEQ ID NO: 471475 - DNA, 20 bp, Artificial
  CRISPR gRNA sequence
gttattcagagtggtaacaa

SEQ ID NO: 471476 - DNA, 20 bp, Artificial
  CRISPR gRNA sequence
ttcagagtggtaacaaatgt

SEQ ID NO: 471477 - DNA, 20 bp, Artificial
  CRISPR gRNA sequence
agagtggtaacaaatgttgt

SEQ ID NO: 471478 - DNA, 20 bp, Artificial
  CRISPR gRNA sequence
tctattgatgttgcagctgc

SEQ ID NO: 471479 - DNA, 20 bp, Artificial
  CRISPR gRNA sequence
ttgatgttgcagctgctgtt

SEQ ID NO: 471480 - DNA, 20 bp, Artificial
  CRISPR gRNA sequence
atgttgcagctgctgtttag

SEQ ID NO: 471481 - DNA, 20 bp, Artificial
  CRISPR gRNA sequence
cagctgctgtttaggttagc

SEQ ID NO: 471482 - DNA, 20 bp, Artificial
  CRISPR gRNA sequence
ctgtttaggttagcgagcag

SEQ ID NO: 471483 - DNA, 20 bp, Artificial
  CRISPR gRNA sequence
tttaggttagcgagcagcca

SEQ ID NO: 471484 - DNA, 20 bp, Artificial
  CRISPR gRNA sequence
aggttagcgagcagccaaac

SEQ ID NO: 471485 - DNA, 20 bp, Artificial
  CRISPR gRNA sequence
ggttagcgagcagccaaacc

SEQ ID NO: 471486 - DNA, 20 bp, Artificial
  CRISPR gRNA sequence
gcgagcagccaaaccactgc

SEQ ID NO: 471487 - DNA, 20 bp, Artificial
  CRISPR gRNA sequence
ccaggagtgccagaaacagc

SEQ ID NO: 471488 - DNA, 20 bp, Artificial
  CRISPR gRNA sequence
cctgggggagggtcttggat

SEQ ID NO: 471489 - DNA, 20 bp, Artificial
  CRISPR gRNA sequence
ggggagggtcttggatagca

SEQ ID NO: 471490 - DNA, 20 bp, Artificial
  CRISPR gRNA sequence
ggatagcaatggggactaag

SEQ ID NO: 471491 - DNA, 20 bp, Artificial
  CRISPR gRNA sequence
gatagcaatggggactaagg

SEQ ID NO: 471492 - DNA, 20 bp, Artificial
  CRISPR gRNA sequence
aggtttctacaacagatacc

SEQ ID NO: 471493 - DNA, 20 bp, Artificial
  CRISPR gRNA sequence
ctacaacagataccctaata

SEQ ID NO: 471494 - DNA, 20 bp, Artificial
  CRISPR gRNA sequence
tacaacagataccctaatac

SEQ ID NO: 471495 - DNA, 20 bp, Artificial
  CRISPR gRNA sequence
caacagataccctaatacaa

SEQ ID NO: 471496 - DNA, 20 bp, Artificial
  CRISPR gRNA sequence
atacaaacagatctgctgga

SEQ ID NO: 471497 - DNA, 20 bp, Artificial
  CRISPR gRNA sequence
ctggatcaagaagatccaac

SEQ ID NO: 471498 - DNA, 20 bp, Artificial
  CRISPR gRNA sequence
gatcaagaagatccaacttc

SEQ ID NO: 471499 - DNA, 20 bp, Artificial
  CRISPR gRNA sequence
ctgttatttctttaaccacc

SEQ ID NO: 471500 - DNA, 20 bp, Artificial
  CRISPR gRNA sequence
tgttatttctttaaccacca

SEQ ID NO: 471501 - DNA, 20 bp, Artificial
  CRISPR gRNA sequence
ttatttctttaaccaccaaa

SEQ ID NO: 471502 - DNA, 20 bp, Artificial
  CRISPR gRNA sequence
tttctttaaccaccaaaaaa

SEQ ID NO: 471503 - DNA, 20 bp, Artificial
  CRISPR gRNA sequence
ctttaaccaccaaaaaaacc

SEQ ID NO: 471504 - DNA, 20 bp, Artificial
  CRISPR gRNA sequence
tttaaccaccaaaaaaacct

SEQ ID NO: 471505 - DNA, 20 bp, Artificial
  CRISPR gRNA sequence
taaccaccaaaaaaacctaa

SEQ ID NO: 471506 - DNA, 20 bp, Artificial
  CRISPR gRNA sequence
aaccaccaaaaaaacctaat

SEQ ID NO: 471507 - DNA, 20 bp, Artificial
  CRISPR gRNA sequence
accaccaaaaaaacctaatt

SEQ ID NO: 471508 - DNA, 20 bp, Artificial
  CRISPR gRNA sequence
atttccttaattttacttga

SEQ ID NO: 471509 - DNA, 20 bp, Artificial
  CRISPR gRNA sequence
ccttaattttacttgattag

SEQ ID NO: 471510 - DNA, 20 bp, Artificial
  CRISPR gRNA sequence
cttaattttacttgattagt

SEQ ID NO: 471511 - DNA, 20 bp, Artificial
  CRISPR gRNA sequence
aattttacttgattagtttg

SEQ ID NO: 471512 - DNA, 20 bp, Artificial
  CRISPR gRNA sequence
attttacttgattagtttga

SEQ ID NO: 471513 - DNA, 20 bp, Artificial
  CRISPR gRNA sequence
tacttgattagtttgatcaa

SEQ ID NO: 471514 - DNA, 20 bp, Artificial
  CRISPR gRNA sequence
acttgattagtttgatcaaa

SEQ ID NO: 471515 - DNA, 20 bp, Artificial
  CRISPR gRNA sequence
cttgattagtttgatcaaat

SEQ ID NO: 471516 - DNA, 20 bp, Artificial
  CRISPR gRNA sequence
gattagtttgatcaaataaa

SEQ ID NO: 471517 - DNA, 20 bp, Artificial
  CRISPR gRNA sequence
attagtttgatcaaataaaa

SEQ ID NO: 471518 - DNA, 20 bp, Artificial
  CRISPR gRNA sequence
gtttgatcaaataaaactaa

SEQ ID NO: 471519 - DNA, 20 bp, Artificial
  CRISPR gRNA sequence
gatcaaataaaactaattca

SEQ ID NO: 471520 - DNA, 20 bp, Artificial
  CRISPR gRNA sequence
atcaaataaaactaattcag

SEQ ID NO: 471521 - DNA, 20 bp, Artificial
  CRISPR gRNA sequence
attcagaacaaactgtttct

SEQ ID NO: 471522 - DNA, 20 bp, Artificial
  CRISPR gRNA sequence
agaacaaactgtttctctat

SEQ ID NO: 471523 - DNA, 20 bp, Artificial
  CRISPR gRNA sequence
tttctctatttcagaacaaa

SEQ ID NO: 471524 - DNA, 20 bp, Artificial
  CRISPR gRNA sequence
ctctatttcagaacaaactc

SEQ ID NO: 471525 - DNA, 20 bp, Artificial
  CRISPR gRNA sequence
tctatttcagaacaaactca

SEQ ID NO: 471526 - DNA, 20 bp, Artificial
  CRISPR gRNA sequence
tatttcagaacaaactcaaa

SEQ ID NO: 471527 - DNA, 20 bp, Artificial
  CRISPR gRNA sequence
tttcagaacaaactcaaaac

SEQ ID NO: 471528 - DNA, 20 bp, Artificial
  CRISPR gRNA sequence
cagaacaaactcaaaactcc

SEQ ID NO: 471529 - DNA, 20 bp, Artificial
  CRISPR gRNA sequence
agaacaaactcaaaactccc

SEQ ID NO: 471530 - DNA, 20 bp, Artificial
  CRISPR gRNA sequence
aaaactccccctaacttatt

SEQ ID NO: 471531 - DNA, 20 bp, Artificial
  CRISPR gRNA sequence
cccctaacttattttgagtt

SEQ ID NO: 471532 - DNA, 20 bp, Artificial
  CRISPR gRNA sequence
acttattttgagtttgttct

SEQ ID NO: 471533 - DNA, 20 bp, Artificial
  CRISPR gRNA sequence
attttgagtttgttctgaaa

SEQ ID NO: 471534 - DNA, 20 bp, Artificial
  CRISPR gRNA sequence
ttttgagtttgttctgaaat

SEQ ID NO: 471535 - DNA, 20 bp, Artificial
  CRISPR gRNA sequence
tgagtttgttctgaaataga

SEQ ID NO: 471536 - DNA, 20 bp, Artificial
  CRISPR gRNA sequence
gagtttgttctgaaatagag

SEQ ID NO: 471537 - DNA, 20 bp, Artificial
  CRISPR gRNA sequence
agtttgttctgaaatagaga

SEQ ID NO: 471538 - DNA, 20 bp, Artificial
  CRISPR gRNA sequence
gttctgaaatagagaaacaa

SEQ ID NO: 471539 - DNA, 20 bp, Artificial
  CRISPR gRNA sequence
ttctgaaatagagaaacaag

SEQ ID NO: 471540 - DNA, 20 bp, Artificial
  CRISPR gRNA sequence
tgaaatagagaaacaaggta

SEQ ID NO: 471541 - DNA, 20 bp, Artificial
  CRISPR gRNA sequence
aaatagagaaacaaggtaaa

SEQ ID NO: 471542 - DNA, 20 bp, Artificial
  CRISPR gRNA sequence
aaattgattgagaaaatgat

SEQ ID NO: 471543 - DNA, 20 bp, Artificial
  CRISPR gRNA sequence
attgagaaaatgatgagggt

SEQ ID NO: 471544 - DNA, 20 bp, Artificial
  CRISPR gRNA sequence
agaaaatgatgagggtgtac

SEQ ID NO: 471545 - DNA, 20 bp, Artificial
  CRISPR gRNA sequence
tcacgtgtccaaaaccagag

SEQ ID NO: 471546 - DNA, 20 bp, Artificial
  CRISPR gRNA sequence
acgtgtccaaaaccagagct

SEQ ID NO: 471547 - DNA, 20 bp, Artificial
  CRISPR gRNA sequence
gccttggggaggattccagt

SEQ ID NO: 471548 - DNA, 20 bp, Artificial
  CRISPR gRNA sequence
ggggaggattccagtgtttg

SEQ ID NO: 471549 - DNA, 20 bp, Artificial
  CRISPR gRNA sequence
gggaggattccagtgtttgc

SEQ ID NO: 471550 - DNA, 20 bp, Artificial
  CRISPR gRNA sequence
cagtgtttgcacactaccag

SEQ ID NO: 471551 - DNA, 20 bp, Artificial
  CRISPR gRNA sequence
gcacactaccagagaatcca

SEQ ID NO: 471552 - DNA, 20 bp, Artificial
  CRISPR gRNA sequence
cacactaccagagaatccaa

SEQ ID NO: 471553 - DNA, 20 bp, Artificial
  CRISPR gRNA sequence
ccagagaatccaacaatcta

SEQ ID NO: 471554 - DNA, 20 bp, Artificial
  CRISPR gRNA sequence
tctcaagatcagtaagcaca

SEQ ID NO: 471555 - DNA, 20 bp, Artificial
  CRISPR gRNA sequence
aagatcagtaagcacaattt

SEQ ID NO: 471556 - DNA, 20 bp, Artificial
  CRISPR gRNA sequence
gtggaacatcaaccccacga

SEQ ID NO: 471557 - DNA, 20 bp, Artificial
  CRISPR gRNA sequence
tggaacatcaaccccacgat

SEQ ID NO: 471558 - DNA, 20 bp, Artificial
  CRISPR gRNA sequence
acacaaagtaaatatctggg

SEQ ID NO: 471559 - DNA, 20 bp, Artificial
  CRISPR gRNA sequence
ggcttattttgaagctcact

SEQ ID NO: 471560 - DNA, 20 bp, Artificial
  CRISPR gRNA sequence
attttgaagctcactgaaag

SEQ ID NO: 471561 - DNA, 20 bp, Artificial
  CRISPR gRNA sequence
ttttgaagctcactgaaaga

SEQ ID NO: 471562 - DNA, 20 bp, Artificial
  CRISPR gRNA sequence
tgaagctcactgaaagactg

SEQ ID NO: 471563 - DNA, 20 bp, Artificial
  CRISPR gRNA sequence
gaagctcactgaaagactgt

SEQ ID NO: 471564 - DNA, 20 bp, Artificial
  CRISPR gRNA sequence
aagctcactgaaagactgta

SEQ ID NO: 471565 - DNA, 20 bp, Artificial
  CRISPR gRNA sequence
actgaaagactgtaaataca

SEQ ID NO: 471566 - DNA, 20 bp, Artificial
  CRISPR gRNA sequence
aaagactgtaaatacaacgc

SEQ ID NO: 471567 - DNA, 20 bp, Artificial
  CRISPR gRNA sequence
taaatacaacgcaatctttg

SEQ ID NO: 471568 - DNA, 20 bp, Artificial
  CRISPR gRNA sequence
tgtctgtctgctttgatcac

SEQ ID NO: 471569 - DNA, 20 bp, Artificial
  CRISPR gRNA sequence
gtctgtctgctttgatcacc

SEQ ID NO: 471570 - DNA, 20 bp, Artificial
  CRISPR gRNA sequence
tctgtctgctttgatcacct

SEQ ID NO: 471571 - DNA, 20 bp, Artificial
  CRISPR gRNA sequence
tctgctttgatcacctcttc

SEQ ID NO: 471572 - DNA, 20 bp, Artificial
  CRISPR gRNA sequence
ctttgatcacctcttcccca

SEQ ID NO: 471573 - DNA, 20 bp, Artificial
  CRISPR gRNA sequence
tgatcacctcttccccattc

SEQ ID NO: 471574 - DNA, 20 bp, Artificial
  CRISPR gRNA sequence
gatcacctcttccccattcc

SEQ ID NO: 471575 - DNA, 20 bp, Artificial
  CRISPR gRNA sequence
atcacctcttccccattcct

SEQ ID NO: 471576 - DNA, 20 bp, Artificial
  CRISPR gRNA sequence
ttccccattccttaagcata

SEQ ID NO: 471577 - DNA, 20 bp, Artificial
  CRISPR gRNA sequence
ccccattccttaagcataag

SEQ ID NO: 471578 - DNA, 20 bp, Artificial
  CRISPR gRNA sequence
cccattccttaagcataagg

SEQ ID NO: 471579 - DNA, 20 bp, Artificial
  CRISPR gRNA sequence
cttaagcataaggacacagt

SEQ ID NO: 471580 - DNA, 20 bp, Artificial
  CRISPR gRNA sequence
aagcataaggacacagtata

SEQ ID NO: 471581 - DNA, 20 bp, Artificial
  CRISPR gRNA sequence
agcataaggacacagtatag

SEQ ID NO: 471582 - DNA, 20 bp, Artificial
  CRISPR gRNA sequence
cacaatgatatctctggcac

SEQ ID NO: 471583 - DNA, 20 bp, Artificial
  CRISPR gRNA sequence
tggcacctggaataagaaga

SEQ ID NO: 471584 - DNA, 20 bp, Artificial
  CRISPR gRNA sequence
gcacctggaataagaagagg

SEQ ID NO: 471585 - DNA, 20 bp, Artificial
  CRISPR gRNA sequence
gaataagaagaggcacattc

SEQ ID NO: 471586 - DNA, 20 bp, Artificial
  CRISPR gRNA sequence
agcaggtgctccaaatcagg

SEQ ID NO: 471587 - DNA, 20 bp, Artificial
  CRISPR gRNA sequence
caaatcagggtggaagccca

SEQ ID NO: 471588 - DNA, 20 bp, Artificial
  CRISPR gRNA sequence
cctgccctctcactccacac

SEQ ID NO: 471589 - DNA, 20 bp, Artificial
  CRISPR gRNA sequence
ctgccctctcactccacacc

SEQ ID NO: 471590 - DNA, 20 bp, Artificial
  CRISPR gRNA sequence
ccctctcactccacacccac

SEQ ID NO: 471591 - DNA, 20 bp, Artificial
  CRISPR gRNA sequence
tcactccacacccactttcc

SEQ ID NO: 471592 - DNA, 20 bp, Artificial
  CRISPR gRNA sequence
actccacacccactttcctg

SEQ ID NO: 471593 - DNA, 20 bp, Artificial
  CRISPR gRNA sequence
cacacccactttcctgccac

SEQ ID NO: 471594 - DNA, 20 bp, Artificial
  CRISPR gRNA sequence
tcctgccacagataatgatc

SEQ ID NO: 471595 - DNA, 20 bp, Artificial
  CRISPR gRNA sequence
cctgccacagataatgatca

SEQ ID NO: 471596 - DNA, 20 bp, Artificial
  CRISPR gRNA sequence
ctgccacagataatgatcac

SEQ ID NO: 471597 - DNA, 20 bp, Artificial
  CRISPR gRNA sequence
ccacagataatgatcacatt

SEQ ID NO: 471598 - DNA, 20 bp, Artificial
  CRISPR gRNA sequence
tggggaagttctttttttct

SEQ ID NO: 471599 - DNA, 20 bp, Artificial
  CRISPR gRNA sequence
ggggaagttctttttttctt

SEQ ID NO: 471600 - DNA, 20 bp, Artificial
  CRISPR gRNA sequence
gggaagttctttttttcttc

SEQ ID NO: 471601 - DNA, 20 bp, Artificial
  CRISPR gRNA sequence
tttttttcttcttctttttt

SEQ ID NO: 471602 - DNA, 20 bp, Artificial
  CRISPR gRNA sequence
tttttcttcttctttttttt

SEQ ID NO: 471603 - DNA, 20 bp, Artificial
  CRISPR gRNA sequence
ttttcttcttcttttttttt

SEQ ID NO: 471604 - DNA, 20 bp, Artificial
  CRISPR gRNA sequence
tttcttcttctttttttttt

SEQ ID NO: 471605 - DNA, 20 bp, Artificial
  CRISPR gRNA sequence
ttcttcttcttttttttttt

SEQ ID NO: 471606 - DNA, 20 bp, Artificial
  CRISPR gRNA sequence
tcttcttctttttttttttt

SEQ ID NO: 471607 - DNA, 20 bp, Artificial
  CRISPR gRNA sequence
cttcttcttttttttttttt

SEQ ID NO: 471608 - DNA, 20 bp, Artificial
  CRISPR gRNA sequence
ttcttctttttttttttttt

SEQ ID NO: 471609 - DNA, 20 bp, Artificial
  CRISPR gRNA sequence
cttctttttttttttttttt

SEQ ID NO: 471610 - DNA, 20 bp, Artificial
  CRISPR gRNA sequence
ttcttttttttttttttttt

SEQ ID NO: 471611 - DNA, 20 bp, Artificial
  CRISPR gRNA sequence
cttttttttttttttttttt

SEQ ID NO: 471612 - DNA, 20 bp, Artificial
  CRISPR gRNA sequence
tttttttttttttttttttt

SEQ ID NO: 471613 - DNA, 20 bp, Artificial
  CRISPR gRNA sequence
tttttttttttttttttttg

SEQ ID NO: 471614 - DNA, 20 bp, Artificial
  CRISPR gRNA sequence
ttttttttttttttttttga

SEQ ID NO: 471615 - DNA, 20 bp, Artificial
  CRISPR gRNA sequence
tttttttttttttttttgag

SEQ ID NO: 471616 - DNA, 20 bp, Artificial
  CRISPR gRNA sequence
ttttttttttttttttgaga

SEQ ID NO: 471617 - DNA, 20 bp, Artificial
  CRISPR gRNA sequence
tttttttttttttttgagat

SEQ ID NO: 471618 - DNA, 20 bp, Artificial
  CRISPR gRNA sequence
ttttttttttttttgagatg

SEQ ID NO: 471619 - DNA, 20 bp, Artificial
  CRISPR gRNA sequence
tttttttttttttgagatgg

SEQ ID NO: 471620 - DNA, 20 bp, Artificial
  CRISPR gRNA sequence
ttttttttttttgagatgga

SEQ ID NO: 471621 - DNA, 20 bp, Artificial
  CRISPR gRNA sequence
tttttttttttgagatggag

SEQ ID NO: 471622 - DNA, 20 bp, Artificial
  CRISPR gRNA sequence
ttttttttttgagatggagt

SEQ ID NO: 471623 - DNA, 20 bp, Artificial
  CRISPR gRNA sequence
tttttttttgagatggagtc

SEQ ID NO: 471624 - DNA, 20 bp, Artificial
  CRISPR gRNA sequence
ttttttttgagatggagtct

SEQ ID NO: 471625 - DNA, 20 bp, Artificial
  CRISPR gRNA sequence
tttttttgagatggagtctc

SEQ ID NO: 471626 - DNA, 20 bp, Artificial
  CRISPR gRNA sequence
ttttttgagatggagtctcg

SEQ ID NO: 471627 - DNA, 20 bp, Artificial
  CRISPR gRNA sequence
tttttgagatggagtctcgc

SEQ ID NO: 471628 - DNA, 20 bp, Artificial
  CRISPR gRNA sequence
ttttgagatggagtctcgct

SEQ ID NO: 471629 - DNA, 20 bp, Artificial
  CRISPR gRNA sequence
tttgagatggagtctcgctc

SEQ ID NO: 471630 - DNA, 20 bp, Artificial
  CRISPR gRNA sequence
ttgagatggagtctcgctct

SEQ ID NO: 471631 - DNA, 20 bp, Artificial
  CRISPR gRNA sequence
tgagatggagtctcgctcta

SEQ ID NO: 471632 - DNA, 20 bp, Artificial
  CRISPR gRNA sequence
gagatggagtctcgctctat

SEQ ID NO: 471633 - DNA, 20 bp, Artificial
  CRISPR gRNA sequence
agatggagtctcgctctatc

SEQ ID NO: 471634 - DNA, 20 bp, Artificial
  CRISPR gRNA sequence
gctctatcacccaggctgga

SEQ ID NO: 471635 - DNA, 20 bp, Artificial
  CRISPR gRNA sequence
tatcacccaggctggagtgc

SEQ ID NO: 471636 - DNA, 20 bp, Artificial
  CRISPR gRNA sequence
tcacccaggctggagtgcag

SEQ ID NO: 471637 - DNA, 20 bp, Artificial
  CRISPR gRNA sequence
gagtgcagtggtgcaatctc

SEQ ID NO: 471638 - DNA, 20 bp, Artificial
  CRISPR gRNA sequence
ggttcactgcagcctccacc

SEQ ID NO: 471639 - DNA, 20 bp, Artificial
  CRISPR gRNA sequence
actgcagcctccacctcctg

SEQ ID NO: 471640 - DNA, 20 bp, Artificial
  CRISPR gRNA sequence
cagcctccacctcctgggtt

SEQ ID NO: 471641 - DNA, 20 bp, Artificial
  CRISPR gRNA sequence
cacctcctgggttcaagtga

SEQ ID NO: 471642 - DNA, 20 bp, Artificial
  CRISPR gRNA sequence
ctgggttcaagtgattctcc

SEQ ID NO: 471643 - DNA, 20 bp, Artificial
  CRISPR gRNA sequence
ggttcaagtgattctcctgc

SEQ ID NO: 471644 - DNA, 20 bp, Artificial
  CRISPR gRNA sequence
aagtgattctcctgcttcag

SEQ ID NO: 471645 - DNA, 20 bp, Artificial
  CRISPR gRNA sequence
tcctgcttcagcctcctgag

SEQ ID NO: 471646 - DNA, 20 bp, Artificial
  CRISPR gRNA sequence
ctgcttcagcctcctgagta

SEQ ID NO: 471647 - DNA, 20 bp, Artificial
  CRISPR gRNA sequence
cttcagcctcctgagtagtt

SEQ ID NO: 471648 - DNA, 20 bp, Artificial
  CRISPR gRNA sequence
cagcctcctgagtagttggg

SEQ ID NO: 471649 - DNA, 20 bp, Artificial
  CRISPR gRNA sequence
agcctcctgagtagttggga

SEQ ID NO: 471650 - DNA, 20 bp, Artificial
  CRISPR gRNA sequence
ctgagtagttgggattacag

SEQ ID NO: 471651 - DNA, 20 bp, Artificial
  CRISPR gRNA sequence
agtagttgggattacaggcg

SEQ ID NO: 471652 - DNA, 20 bp, Artificial
  CRISPR gRNA sequence
ggattacaggcgcctcccac

SEQ ID NO: 471653 - DNA, 20 bp, Artificial
  CRISPR gRNA sequence
caggcgcctcccaccgtgcc

SEQ ID NO: 471654 - DNA, 20 bp, Artificial
  CRISPR gRNA sequence
ccaccgtgcccagtttattt

SEQ ID NO: 471655 - DNA, 20 bp, Artificial
  CRISPR gRNA sequence
attttttgtatttttagtag

SEQ ID NO: 471656 - DNA, 20 bp, Artificial
  CRISPR gRNA sequence
ttttttgtatttttagtaga

SEQ ID NO: 471657 - DNA, 20 bp, Artificial
  CRISPR gRNA sequence
tttgtatttttagtagagat

SEQ ID NO: 471658 - DNA, 20 bp, Artificial
  CRISPR gRNA sequence
ttgtatttttagtagagata

SEQ ID NO: 471659 - DNA, 20 bp, Artificial
  CRISPR gRNA sequence
tgtatttttagtagagatag

SEQ ID NO: 471660 - DNA, 20 bp, Artificial
  CRISPR gRNA sequence
gtatttttagtagagatagg

SEQ ID NO: 471661 - DNA, 20 bp, Artificial
  CRISPR gRNA sequence
tatttttagtagagataggg

SEQ ID NO: 471662 - DNA, 20 bp, Artificial
  CRISPR gRNA sequence
ttagtagagatagggtttca

SEQ ID NO: 471663 - DNA, 20 bp, Artificial
  CRISPR gRNA sequence
tagtagagatagggtttcac

SEQ ID NO: 471664 - DNA, 20 bp, Artificial
  CRISPR gRNA sequence
agtagagatagggtttcacc

SEQ ID NO: 471665 - DNA, 20 bp, Artificial
  CRISPR gRNA sequence
gtagagatagggtttcacca

SEQ ID NO: 471666 - DNA, 20 bp, Artificial
  CRISPR gRNA sequence
caccatgttgaccaggctga

SEQ ID NO: 471667 - DNA, 20 bp, Artificial
  CRISPR gRNA sequence
accatgttgaccaggctgat

SEQ ID NO: 471668 - DNA, 20 bp, Artificial
  CRISPR gRNA sequence
accaggctgatctcaaactc

SEQ ID NO: 471669 - DNA, 20 bp, Artificial
  CRISPR gRNA sequence
atctcaaactcctgacctca

SEQ ID NO: 471670 - DNA, 20 bp, Artificial
  CRISPR gRNA sequence
aaactcctgacctcaagtga

SEQ ID NO: 471671 - DNA, 20 bp, Artificial
  CRISPR gRNA sequence
ctgacctcaagtgatttgtt

SEQ ID NO: 471672 - DNA, 20 bp, Artificial
  CRISPR gRNA sequence
acctcaagtgatttgttcgt

SEQ ID NO: 471673 - DNA, 20 bp, Artificial
  CRISPR gRNA sequence
aagtgatttgttcgtcttgg

SEQ ID NO: 471674 - DNA, 20 bp, Artificial
  CRISPR gRNA sequence
gttcgtcttggcctcccaaa

SEQ ID NO: 471675 - DNA, 20 bp, Artificial
  CRISPR gRNA sequence
ttcgtcttggcctcccaaag

SEQ ID NO: 471676 - DNA, 20 bp, Artificial
  CRISPR gRNA sequence
gtcttggcctcccaaagtgc

SEQ ID NO: 471677 - DNA, 20 bp, Artificial
  CRISPR gRNA sequence
ggcctcccaaagtgctagga

SEQ ID NO: 471678 - DNA, 20 bp, Artificial
  CRISPR gRNA sequence
gcctcccaaagtgctaggat

SEQ ID NO: 471679 - DNA, 20 bp, Artificial
  CRISPR gRNA sequence
ccaaagtgctaggattacag

SEQ ID NO: 471680 - DNA, 20 bp, Artificial
  CRISPR gRNA sequence
ggattacagatgtgagccac

SEQ ID NO: 471681 - DNA, 20 bp, Artificial
  CRISPR gRNA sequence
cagatgtgagccaccacgcc

SEQ ID NO: 471682 - DNA, 20 bp, Artificial
  CRISPR gRNA sequence
ggggaagttcttaatctgaa

SEQ ID NO: 471683 - DNA, 20 bp, Artificial
  CRISPR gRNA sequence
gggaagttcttaatctgaaa

SEQ ID NO: 471684 - DNA, 20 bp, Artificial
  CRISPR gRNA sequence
ttaatctgaaactgaccaag

SEQ ID NO: 471685 - DNA, 20 bp, Artificial
  CRISPR gRNA sequence
aatctgaaactgaccaaggg

SEQ ID NO: 471686 - DNA, 20 bp, Artificial
  CRISPR gRNA sequence
atctgaaactgaccaaggga

SEQ ID NO: 471687 - DNA, 20 bp, Artificial
  CRISPR gRNA sequence
aaactgaccaagggaagttt

SEQ ID NO: 471688 - DNA, 20 bp, Artificial
  CRISPR gRNA sequence
accaagggaagtttgggaag

SEQ ID NO: 471689 - DNA, 20 bp, Artificial
  CRISPR gRNA sequence
gggaagggtgaagtggcagg

SEQ ID NO: 471690 - DNA, 20 bp, Artificial
  CRISPR gRNA sequence
ggaagggtgaagtggcaggc

SEQ ID NO: 471691 - DNA, 20 bp, Artificial
  CRISPR gRNA sequence
caagggctgttccccagctc

SEQ ID NO: 471692 - DNA, 20 bp, Artificial
  CRISPR gRNA sequence
aagggctgttccccagctct

SEQ ID NO: 471693 - DNA, 20 bp, Artificial
  CRISPR gRNA sequence
ttccccagctctgtcaactt

SEQ ID NO: 471694 - DNA, 20 bp, Artificial
  CRISPR gRNA sequence
cccagctctgtcaacttttc

SEQ ID NO: 471695 - DNA, 20 bp, Artificial
  CRISPR gRNA sequence
tgtcaacttttcccctagga

SEQ ID NO: 471696 - DNA, 20 bp, Artificial
  CRISPR gRNA sequence
tcaacttttcccctaggact

SEQ ID NO: 471697 - DNA, 20 bp, Artificial
  CRISPR gRNA sequence
ttcccctaggactttggctt

SEQ ID NO: 471698 - DNA, 20 bp, Artificial
  CRISPR gRNA sequence
tcccctaggactttggcttg

SEQ ID NO: 471699 - DNA, 20 bp, Artificial
  CRISPR gRNA sequence
cccctaggactttggcttgt

SEQ ID NO: 471700 - DNA, 20 bp, Artificial
  CRISPR gRNA sequence
ccctaggactttggcttgtt

SEQ ID NO: 471701 - DNA, 20 bp, Artificial
  CRISPR gRNA sequence
ggactttggcttgttgtgca

SEQ ID NO: 471702 - DNA, 20 bp, Artificial
  CRISPR gRNA sequence
tggcttgttgtgcaaggtgc

SEQ ID NO: 471703 - DNA, 20 bp, Artificial
  CRISPR gRNA sequence
ggcttgttgtgcaaggtgct

SEQ ID NO: 471704 - DNA, 20 bp, Artificial
  CRISPR gRNA sequence
gcttgttgtgcaaggtgctt

SEQ ID NO: 471705 - DNA, 20 bp, Artificial
  CRISPR gRNA sequence
gttgtgcaaggtgcttttct

SEQ ID NO: 471706 - DNA, 20 bp, Artificial
  CRISPR gRNA sequence
ttgtgcaaggtgcttttctt

SEQ ID NO: 471707 - DNA, 20 bp, Artificial
  CRISPR gRNA sequence
tgcaaggtgcttttcttcat

SEQ ID NO: 471708 - DNA, 20 bp, Artificial
  CRISPR gRNA sequence
ttcttcattctgggagaata

SEQ ID NO: 471709 - DNA, 20 bp, Artificial
  CRISPR gRNA sequence
tcttcattctgggagaatag

SEQ ID NO: 471710 - DNA, 20 bp, Artificial
  CRISPR gRNA sequence
cttcattctgggagaatagt

SEQ ID NO: 471711 - DNA, 20 bp, Artificial
  CRISPR gRNA sequence
ttcattctgggagaatagtg

SEQ ID NO: 471712 - DNA, 20 bp, Artificial
  CRISPR gRNA sequence
cattctgggagaatagtgct

SEQ ID NO: 471713 - DNA, 20 bp, Artificial
  CRISPR gRNA sequence
attctgggagaatagtgctt

SEQ ID NO: 471714 - DNA, 20 bp, Artificial
  CRISPR gRNA sequence
tgggagaatagtgctttccc

SEQ ID NO: 471715 - DNA, 20 bp, Artificial
  CRISPR gRNA sequence
ggagaatagtgctttcccaa

SEQ ID NO: 471716 - DNA, 20 bp, Artificial
  CRISPR gRNA sequence
tcccaagagcatccaagccc

SEQ ID NO: 471717 - DNA, 20 bp, Artificial
  CRISPR gRNA sequence
cccaagagcatccaagcccc

SEQ ID NO: 471718 - DNA, 20 bp, Artificial
  CRISPR gRNA sequence
ccaagagcatccaagcccca

SEQ ID NO: 471719 - DNA, 20 bp, Artificial
  CRISPR gRNA sequence
tgtcacagtcctgttcttac

SEQ ID NO: 471720 - DNA, 20 bp, Artificial
  CRISPR gRNA sequence
tcacagtcctgttcttacat

SEQ ID NO: 471721 - DNA, 20 bp, Artificial
  CRISPR gRNA sequence
ttcttacatgaacttttaac

SEQ ID NO: 471722 - DNA, 20 bp, Artificial
  CRISPR gRNA sequence
ttacatgaacttttaacttg

SEQ ID NO: 471723 - DNA, 20 bp, Artificial
  CRISPR gRNA sequence
acatgaacttttaacttgaa

SEQ ID NO: 471724 - DNA, 20 bp, Artificial
  CRISPR gRNA sequence
catgaacttttaacttgaac

SEQ ID NO: 471725 - DNA, 20 bp, Artificial
  CRISPR gRNA sequence
ttaacttgaacataaacagc

SEQ ID NO: 471726 - DNA, 20 bp, Artificial
  CRISPR gRNA sequence
taacttgaacataaacagca

SEQ ID NO: 471727 - DNA, 20 bp, Artificial
  CRISPR gRNA sequence
aacttgaacataaacagcaa

SEQ ID NO: 471728 - DNA, 20 bp, Artificial
  CRISPR gRNA sequence
acttgaacataaacagcaaa

SEQ ID NO: 471729 - DNA, 20 bp, Artificial
  CRISPR gRNA sequence
gaacataaacagcaaaagaa

SEQ ID NO: 471730 - DNA, 20 bp, Artificial
  CRISPR gRNA sequence
aacataaacagcaaaagaaa

SEQ ID NO: 471731 - DNA, 20 bp, Artificial
  CRISPR gRNA sequence
ataaaaacaagaaaatgtcc

SEQ ID NO: 471732 - DNA, 20 bp, Artificial
  CRISPR gRNA sequence
taaaaacaagaaaatgtcca

SEQ ID NO: 471733 - DNA, 20 bp, Artificial
  CRISPR gRNA sequence
cggaaatatatttcacagga

SEQ ID NO: 471734 - DNA, 20 bp, Artificial
  CRISPR gRNA sequence
ggaaatatatttcacaggaa

SEQ ID NO: 471735 - DNA, 20 bp, Artificial
  CRISPR gRNA sequence
cacaggaaaaaataaaatat

SEQ ID NO: 471736 - DNA, 20 bp, Artificial
  CRISPR gRNA sequence
acaggaaaaaataaaatatt

SEQ ID NO: 471737 - DNA, 20 bp, Artificial
  CRISPR gRNA sequence
tttatcagacctccaaaatt

SEQ ID NO: 471738 - DNA, 20 bp, Artificial
  CRISPR gRNA sequence
ttatcagacctccaaaattt

SEQ ID NO: 471739 - DNA, 20 bp, Artificial
  CRISPR gRNA sequence
tatcagacctccaaaatttc

SEQ ID NO: 471740 - DNA, 20 bp, Artificial
  CRISPR gRNA sequence
atcagacctccaaaatttct

SEQ ID NO: 471741 - DNA, 20 bp, Artificial
  CRISPR gRNA sequence
tcagacctccaaaatttctt

SEQ ID NO: 471742 - DNA, 20 bp, Artificial
  CRISPR gRNA sequence
caaaatttctttatgaaaag

SEQ ID NO: 471743 - DNA, 20 bp, Artificial
  CRISPR gRNA sequence
ctttatgaaaagcatggtcc

SEQ ID NO: 471744 - DNA, 20 bp, Artificial
  CRISPR gRNA sequence
tttatgaaaagcatggtcct

SEQ ID NO: 471745 - DNA, 20 bp, Artificial
  CRISPR gRNA sequence
tatgaaaagcatggtcctta

SEQ ID NO: 471746 - DNA, 20 bp, Artificial
  CRISPR gRNA sequence
atgaaaagcatggtccttaa

SEQ ID NO: 471747 - DNA, 20 bp, Artificial
  CRISPR gRNA sequence
tgaaaagcatggtccttaaa

SEQ ID NO: 471748 - DNA, 20 bp, Artificial
  CRISPR gRNA sequence
aaacatatttccaaaatata

SEQ ID NO: 471749 - DNA, 20 bp, Artificial
  CRISPR gRNA sequence
aacatatttccaaaatatat

SEQ ID NO: 471750 - DNA, 20 bp, Artificial
  CRISPR gRNA sequence
ccaaaatatatttttctcct

SEQ ID NO: 471751 - DNA, 20 bp, Artificial
  CRISPR gRNA sequence
caaaatatatttttctcctc

SEQ ID NO: 471752 - DNA, 20 bp, Artificial
  CRISPR gRNA sequence
ttctcctcaccttatactta

SEQ ID NO: 471753 - DNA, 20 bp, Artificial
  CRISPR gRNA sequence
tctcctcaccttatacttag

SEQ ID NO: 471754 - DNA, 20 bp, Artificial
  CRISPR gRNA sequence
ctcctcaccttatacttagt

SEQ ID NO: 471755 - DNA, 20 bp, Artificial
  CRISPR gRNA sequence
tcctcaccttatacttagtt

SEQ ID NO: 471756 - DNA, 20 bp, Artificial
  CRISPR gRNA sequence
ctcaccttatacttagttca

SEQ ID NO: 471757 - DNA, 20 bp, Artificial
  CRISPR gRNA sequence
accttatacttagttcactg

SEQ ID NO: 471758 - DNA, 20 bp, Artificial
  CRISPR gRNA sequence
atacttagttcactgagcac

SEQ ID NO: 471759 - DNA, 20 bp, Artificial
  CRISPR gRNA sequence
tacttagttcactgagcact

SEQ ID NO: 471760 - DNA, 20 bp, Artificial
  CRISPR gRNA sequence
agttcactgagcactttcag

SEQ ID NO: 471761 - DNA, 20 bp, Artificial
  CRISPR gRNA sequence
gttcactgagcactttcagg

SEQ ID NO: 471762 - DNA, 20 bp, Artificial
  CRISPR gRNA sequence
actgagcactttcaggttca

SEQ ID NO: 471763 - DNA, 20 bp, Artificial
  CRISPR gRNA sequence
agcactttcaggttcagaag

SEQ ID NO: 471764 - DNA, 20 bp, Artificial
  CRISPR gRNA sequence
tcaggttcagaaggaaaagg

SEQ ID NO: 471765 - DNA, 20 bp, Artificial
  CRISPR gRNA sequence
caggttcagaaggaaaagga

SEQ ID NO: 471766 - DNA, 20 bp, Artificial
  CRISPR gRNA sequence
aggttcagaaggaaaaggaa

SEQ ID NO: 471767 - DNA, 20 bp, Artificial
  CRISPR gRNA sequence
agaaggaaaaggaatttttc

SEQ ID NO: 471768 - DNA, 20 bp, Artificial
  CRISPR gRNA sequence
ttctttgaccctccctgtta

SEQ ID NO: 471769 - DNA, 20 bp, Artificial
  CRISPR gRNA sequence
tctttgaccctccctgttat

SEQ ID NO: 471770 - DNA, 20 bp, Artificial
  CRISPR gRNA sequence
ctttgaccctccctgttatt

SEQ ID NO: 471771 - DNA, 20 bp, Artificial
  CRISPR gRNA sequence
tttgaccctccctgttattt

SEQ ID NO: 471772 - DNA, 20 bp, Artificial
  CRISPR gRNA sequence
tgaccctccctgttattttt

SEQ ID NO: 471773 - DNA, 20 bp, Artificial
  CRISPR gRNA sequence
gaccctccctgttatttttg

SEQ ID NO: 471774 - DNA, 20 bp, Artificial
  CRISPR gRNA sequence
accctccctgttatttttgt

SEQ ID NO: 471775 - DNA, 20 bp, Artificial
  CRISPR gRNA sequence
cctgttatttttgttttcac

SEQ ID NO: 471776 - DNA, 20 bp, Artificial
  CRISPR gRNA sequence
ttatttttgttttcaccact

SEQ ID NO: 471777 - DNA, 20 bp, Artificial
  CRISPR gRNA sequence
tttttgttttcaccacttca

SEQ ID NO: 471778 - DNA, 20 bp, Artificial
  CRISPR gRNA sequence
ttgttttcaccacttcacta

SEQ ID NO: 471779 - DNA, 20 bp, Artificial
  CRISPR gRNA sequence
tgttttcaccacttcactaa

SEQ ID NO: 471780 - DNA, 20 bp, Artificial
  CRISPR gRNA sequence
gttttcaccacttcactaaa

SEQ ID NO: 471781 - DNA, 20 bp, Artificial
  CRISPR gRNA sequence
ttttcaccacttcactaaag

SEQ ID NO: 471782 - DNA, 20 bp, Artificial
  CRISPR gRNA sequence
tcaccacttcactaaagaaa

SEQ ID NO: 471783 - DNA, 20 bp, Artificial
  CRISPR gRNA sequence
caccacttcactaaagaaaa

SEQ ID NO: 471784 - DNA, 20 bp, Artificial
  CRISPR gRNA sequence
accacttcactaaagaaaaa

SEQ ID NO: 471785 - DNA, 20 bp, Artificial
  CRISPR gRNA sequence
cactaaagaaaaatgcacac

SEQ ID NO: 471786 - DNA, 20 bp, Artificial
  CRISPR gRNA sequence
actaaagaaaaatgcacacc

SEQ ID NO: 471787 - DNA, 20 bp, Artificial
  CRISPR gRNA sequence
aagaaaaatgcacacctaga

SEQ ID NO: 471788 - DNA, 20 bp, Artificial
  CRISPR gRNA sequence
gattaaattagttttaaatc

SEQ ID NO: 471789 - DNA, 20 bp, Artificial
  CRISPR gRNA sequence
aattagttttaaatccacac

SEQ ID NO: 471790 - DNA, 20 bp, Artificial
  CRISPR gRNA sequence
gttttaaatccacacagagt

SEQ ID NO: 471791 - DNA, 20 bp, Artificial
  CRISPR gRNA sequence
taaatccacacagagtttaa

SEQ ID NO: 471792 - DNA, 20 bp, Artificial
  CRISPR gRNA sequence
aaatccacacagagtttaaa

SEQ ID NO: 471793 - DNA, 20 bp, Artificial
  CRISPR gRNA sequence
aatccacacagagtttaaat

SEQ ID NO: 471794 - DNA, 20 bp, Artificial
  CRISPR gRNA sequence
aaattaaagttaattcctaa

SEQ ID NO: 471795 - DNA, 20 bp, Artificial
  CRISPR gRNA sequence
aattaaagttaattcctaaa

SEQ ID NO: 471796 - DNA, 20 bp, Artificial
  CRISPR gRNA sequence
aagttaattcctaaacaatt

SEQ ID NO: 471797 - DNA, 20 bp, Artificial
  CRISPR gRNA sequence
attcctaaacaatttacctt

SEQ ID NO: 471798 - DNA, 20 bp, Artificial
  CRISPR gRNA sequence
ctaaacaatttaccttttgt

SEQ ID NO: 471799 - DNA, 20 bp, Artificial
  CRISPR gRNA sequence
aacaatttaccttttgtgaa

SEQ ID NO: 471800 - DNA, 20 bp, Artificial
  CRISPR gRNA sequence
accttttgtgaaggaagtta

SEQ ID NO: 471801 - DNA, 20 bp, Artificial
  CRISPR gRNA sequence
ccttttgtgaaggaagttaa

SEQ ID NO: 471802 - DNA, 20 bp, Artificial
  CRISPR gRNA sequence
ttgtgaaggaagttaaaaga

SEQ ID NO: 471803 - DNA, 20 bp, Artificial
  CRISPR gRNA sequence
tgtgaaggaagttaaaagaa

SEQ ID NO: 471804 - DNA, 20 bp, Artificial
  CRISPR gRNA sequence
gtgaaggaagttaaaagaaa

SEQ ID NO: 471805 - DNA, 20 bp, Artificial
  CRISPR gRNA sequence
tgaaggaagttaaaagaaaa

SEQ ID NO: 471806 - DNA, 20 bp, Artificial
  CRISPR gRNA sequence
aaagaaaaaaaaaaaagaaa

SEQ ID NO: 471807 - DNA, 20 bp, Artificial
  CRISPR gRNA sequence
cacaaattccagccttccag

SEQ ID NO: 471808 - DNA, 20 bp, Artificial
  CRISPR gRNA sequence
cagccttccaggacattata

SEQ ID NO: 471809 - DNA, 20 bp, Artificial
  CRISPR gRNA sequence
ccaggacattataatctttc

SEQ ID NO: 471810 - DNA, 20 bp, Artificial
  CRISPR gRNA sequence
caggacattataatctttca

SEQ ID NO: 471811 - DNA, 20 bp, Artificial
  CRISPR gRNA sequence
taatctttcatgggacctaa

SEQ ID NO: 471812 - DNA, 20 bp, Artificial
  CRISPR gRNA sequence
tcatgggacctaaaagacat

SEQ ID NO: 471813 - DNA, 20 bp, Artificial
  CRISPR gRNA sequence
catgggacctaaaagacatt

SEQ ID NO: 471814 - DNA, 20 bp, Artificial
  CRISPR gRNA sequence
atgggacctaaaagacattt

SEQ ID NO: 471815 - DNA, 20 bp, Artificial
  CRISPR gRNA sequence
aaagacatttccacacatta

SEQ ID NO: 471816 - DNA, 20 bp, Artificial
  CRISPR gRNA sequence
ccacacattactacagtgaa

SEQ ID NO: 471817 - DNA, 20 bp, Artificial
  CRISPR gRNA sequence
cacacattactacagtgaaa

SEQ ID NO: 471818 - DNA, 20 bp, Artificial
  CRISPR gRNA sequence
ctacagtgaaaggaaatgat

SEQ ID NO: 471819 - DNA, 20 bp, Artificial
  CRISPR gRNA sequence
cagtgaaaggaaatgataaa

SEQ ID NO: 471820 - DNA, 20 bp, Artificial
  CRISPR gRNA sequence
aaatggcataaaaattggta

SEQ ID NO: 471821 - DNA, 20 bp, Artificial
  CRISPR gRNA sequence
aatggcataaaaattggtaa

SEQ ID NO: 471822 - DNA, 20 bp, Artificial
  CRISPR gRNA sequence
gtaaaaaggagtgatccctt

SEQ ID NO: 471823 - DNA, 20 bp, Artificial
  CRISPR gRNA sequence
cccctcaggtgatcatgaaa

SEQ ID NO: 471824 - DNA, 20 bp, Artificial
  CRISPR gRNA sequence
ccctcaggtgatcatgaaaa

SEQ ID NO: 471825 - DNA, 20 bp, Artificial
  CRISPR gRNA sequence
aggtgatcatgaaaagcttc

SEQ ID NO: 471826 - DNA, 20 bp, Artificial
  CRISPR gRNA sequence
ccttaagaacttggaaaatt

SEQ ID NO: 471827 - DNA, 20 bp, Artificial
  CRISPR gRNA sequence
cttaagaacttggaaaatta

SEQ ID NO: 471828 - DNA, 20 bp, Artificial
  CRISPR gRNA sequence
aagaacttggaaaattagct

SEQ ID NO: 471829 - DNA, 20 bp, Artificial
  CRISPR gRNA sequence
agaacttggaaaattagctg

SEQ ID NO: 471830 - DNA, 20 bp, Artificial
  CRISPR gRNA sequence
ggaaaattagctgagattga

SEQ ID NO: 471831 - DNA, 20 bp, Artificial
  CRISPR gRNA sequence
gaaaattagctgagattgaa

SEQ ID NO: 471832 - DNA, 20 bp, Artificial
  CRISPR gRNA sequence
gctgagattgaaaggagggg

SEQ ID NO: 471833 - DNA, 20 bp, Artificial
  CRISPR gRNA sequence
agattgaaaggaggggtaga

SEQ ID NO: 471834 - DNA, 20 bp, Artificial
  CRISPR gRNA sequence
aaaggaggggtagaatttcc

SEQ ID NO: 471835 - DNA, 20 bp, Artificial
  CRISPR gRNA sequence
ccataggtggagacagatga

SEQ ID NO: 471836 - DNA, 20 bp, Artificial
  CRISPR gRNA sequence
cataggtggagacagatgaa

SEQ ID NO: 471837 - DNA, 20 bp, Artificial
  CRISPR gRNA sequence
tacaagtggcaagagcagca

SEQ ID NO: 471838 - DNA, 20 bp, Artificial
  CRISPR gRNA sequence
caagtggcaagagcagcata

SEQ ID NO: 471839 - DNA, 20 bp, Artificial
  CRISPR gRNA sequence
tggcaagtaaggccgtcagg

SEQ ID NO: 471840 - DNA, 20 bp, Artificial
  CRISPR gRNA sequence
caattgagaggctgtatatg

SEQ ID NO: 471841 - DNA, 20 bp, Artificial
  CRISPR gRNA sequence
agaggctgtatatggaatcc

SEQ ID NO: 471842 - DNA, 20 bp, Artificial
  CRISPR gRNA sequence
tatatggaatccagaaacaa

SEQ ID NO: 471843 - DNA, 20 bp, Artificial
  CRISPR gRNA sequence
gaaaggtggtgggatcaaac

SEQ ID NO: 471844 - DNA, 20 bp, Artificial
  CRISPR gRNA sequence
tggaagactttgaatgctgg

SEQ ID NO: 471845 - DNA, 20 bp, Artificial
  CRISPR gRNA sequence
tgaatgctggttaacaaaga

SEQ ID NO: 471846 - DNA, 20 bp, Artificial
  CRISPR gRNA sequence
gaatgctggttaacaaagat

SEQ ID NO: 471847 - DNA, 20 bp, Artificial
  CRISPR gRNA sequence
aatgctggttaacaaagatg

SEQ ID NO: 471848 - DNA, 20 bp, Artificial
  CRISPR gRNA sequence
gttaacaaagatgagcccaa

SEQ ID NO: 471849 - DNA, 20 bp, Artificial
  CRISPR gRNA sequence
acaaagatgagcccaatatt

SEQ ID NO: 471850 - DNA, 20 bp, Artificial
  CRISPR gRNA sequence
tgaccactggggatgctatg

SEQ ID NO: 471851 - DNA, 20 bp, Artificial
  CRISPR gRNA sequence
gggatgctatgcaagagagt

SEQ ID NO: 471852 - DNA, 20 bp, Artificial
  CRISPR gRNA sequence
tgcaagagagtgttgttatg

SEQ ID NO: 471853 - DNA, 20 bp, Artificial
  CRISPR gRNA sequence
ttatgaaggaagtgtatgag

SEQ ID NO: 471854 - DNA, 20 bp, Artificial
  CRISPR gRNA sequence
tgaaggaagtgtatgaggta

SEQ ID NO: 471855 - DNA, 20 bp, Artificial
  CRISPR gRNA sequence
aagtgtatttggctgaaatt

SEQ ID NO: 471856 - DNA, 20 bp, Artificial
  CRISPR gRNA sequence
agtgtatttggctgaaattg

SEQ ID NO: 471857 - DNA, 20 bp, Artificial
  CRISPR gRNA sequence
ggctgaaattgaccaaaatg

SEQ ID NO: 471858 - DNA, 20 bp, Artificial
  CRISPR gRNA sequence
gctgaaattgaccaaaatgg

SEQ ID NO: 471859 - DNA, 20 bp, Artificial
  CRISPR gRNA sequence
aaattgaccaaaatggggaa

SEQ ID NO: 471860 - DNA, 20 bp, Artificial
  CRISPR gRNA sequence
accaaaatggggaaatacta

SEQ ID NO: 471861 - DNA, 20 bp, Artificial
  CRISPR gRNA sequence
aagacaaagagtccaatcat

SEQ ID NO: 471862 - DNA, 20 bp, Artificial
  CRISPR gRNA sequence
attggaattatttagaagga

SEQ ID NO: 471863 - DNA, 20 bp, Artificial
  CRISPR gRNA sequence
gaattatttagaaggaagat

SEQ ID NO: 471864 - DNA, 20 bp, Artificial
  CRISPR gRNA sequence
tttagaaggaagataatgat

SEQ ID NO: 471865 - DNA, 20 bp, Artificial
  CRISPR gRNA sequence
agaaggaagataatgatggt

SEQ ID NO: 471866 - DNA, 20 bp, Artificial
  CRISPR gRNA sequence
gaaggaagataatgatggtg

SEQ ID NO: 471867 - DNA, 20 bp, Artificial
  CRISPR gRNA sequence
atagaagcaattggaggaaa

SEQ ID NO: 471868 - DNA, 20 bp, Artificial
  CRISPR gRNA sequence
tagaagcaattggaggaaac

SEQ ID NO: 471869 - DNA, 20 bp, Artificial
  CRISPR gRNA sequence
gaggaaacacatcacagagt

SEQ ID NO: 471870 - DNA, 20 bp, Artificial
  CRISPR gRNA sequence
tggagagacaagagtaggaa

SEQ ID NO: 471871 - DNA, 20 bp, Artificial
  CRISPR gRNA sequence
tctgggattttccatgagga

SEQ ID NO: 471872 - DNA, 20 bp, Artificial
  CRISPR gRNA sequence
tgggattttccatgaggatc

SEQ ID NO: 471873 - DNA, 20 bp, Artificial
  CRISPR gRNA sequence
ggattttccatgaggatcaa

SEQ ID NO: 471874 - DNA, 20 bp, Artificial
  CRISPR gRNA sequence
tccatgaggatcaagagcat

SEQ ID NO: 471875 - DNA, 20 bp, Artificial
  CRISPR gRNA sequence
ccatgaggatcaagagcatt

SEQ ID NO: 471876 - DNA, 20 bp, Artificial
  CRISPR gRNA sequence
catgaggatcaagagcatta

SEQ ID NO: 471877 - DNA, 20 bp, Artificial
  CRISPR gRNA sequence
attaacaaactgataaggaa

SEQ ID NO: 471878 - DNA, 20 bp, Artificial
  CRISPR gRNA sequence
acaaactgataaggaaggga

SEQ ID NO: 471879 - DNA, 20 bp, Artificial
  CRISPR gRNA sequence
ataaggaagggagtgatagg

SEQ ID NO: 471880 - DNA, 20 bp, Artificial
  CRISPR gRNA sequence
agagagtagaaatgttcaaa

SEQ ID NO: 471881 - DNA, 20 bp, Artificial
  CRISPR gRNA sequence
aaaaagaaactgacaaggcc

SEQ ID NO: 471882 - DNA, 20 bp, Artificial
  CRISPR gRNA sequence
acaaggcccttcatgtctcc

SEQ ID NO: 471883 - DNA, 20 bp, Artificial
  CRISPR gRNA sequence
catgtctcctatttagctct

SEQ ID NO: 471884 - DNA, 20 bp, Artificial
  CRISPR gRNA sequence
atgtctcctatttagctctt

SEQ ID NO: 471885 - DNA, 20 bp, Artificial
  CRISPR gRNA sequence
ctatttagctcttagacttt

SEQ ID NO: 471886 - DNA, 20 bp, Artificial
  CRISPR gRNA sequence
tttagctcttagactttctc

SEQ ID NO: 471887 - DNA, 20 bp, Artificial
  CRISPR gRNA sequence
agctcttagactttctcttt

SEQ ID NO: 471888 - DNA, 20 bp, Artificial
  CRISPR gRNA sequence
gctcttagactttctctttc

SEQ ID NO: 471889 - DNA, 20 bp, Artificial
  CRISPR gRNA sequence
ttagactttctctttcacca

SEQ ID NO: 471890 - DNA, 20 bp, Artificial
  CRISPR gRNA sequence
agactttctctttcaccact

SEQ ID NO: 471891 - DNA, 20 bp, Artificial
  CRISPR gRNA sequence
gactttctctttcaccactt

SEQ ID NO: 471892 - DNA, 20 bp, Artificial
  CRISPR gRNA sequence
tctctttcaccacttcatac

SEQ ID NO: 471893 - DNA, 20 bp, Artificial
  CRISPR gRNA sequence
ctctttcaccacttcatact

SEQ ID NO: 471894 - DNA, 20 bp, Artificial
  CRISPR gRNA sequence
tctttcaccacttcatactt

SEQ ID NO: 471895 - DNA, 20 bp, Artificial
  CRISPR gRNA sequence
tttcaccacttcatacttca

SEQ ID NO: 471896 - DNA, 20 bp, Artificial
  CRISPR gRNA sequence
tcaccacttcatacttcaca

SEQ ID NO: 471897 - DNA, 20 bp, Artificial
  CRISPR gRNA sequence
caccacttcatacttcacat

SEQ ID NO: 471898 - DNA, 20 bp, Artificial
  CRISPR gRNA sequence
accacttcatacttcacata

SEQ ID NO: 471899 - DNA, 20 bp, Artificial
  CRISPR gRNA sequence
catacttcacatactttgtt

SEQ ID NO: 471900 - DNA, 20 bp, Artificial
  CRISPR gRNA sequence
atacttcacatactttgttc

SEQ ID NO: 471901 - DNA, 20 bp, Artificial
  CRISPR gRNA sequence
cacatactttgttccataaa

SEQ ID NO: 471902 - DNA, 20 bp, Artificial
  CRISPR gRNA sequence
acatactttgttccataaaa

SEQ ID NO: 471903 - DNA, 20 bp, Artificial
  CRISPR gRNA sequence
tgttccataaaaccccccaa

SEQ ID NO: 471904 - DNA, 20 bp, Artificial
  CRISPR gRNA sequence
gttccataaaaccccccaag

SEQ ID NO: 471905 - DNA, 20 bp, Artificial
  CRISPR gRNA sequence
ttccataaaaccccccaagg

SEQ ID NO: 471906 - DNA, 20 bp, Artificial
  CRISPR gRNA sequence
cataaaaccccccaaggcac

SEQ ID NO: 471907 - DNA, 20 bp, Artificial
  CRISPR gRNA sequence
aggagggaatgttattccct

SEQ ID NO: 471908 - DNA, 20 bp, Artificial
  CRISPR gRNA sequence
ggagggaatgttattccctt

SEQ ID NO: 471909 - DNA, 20 bp, Artificial
  CRISPR gRNA sequence
ttccctttcccctaaagttg

SEQ ID NO: 471910 - DNA, 20 bp, Artificial
  CRISPR gRNA sequence
cctttcccctaaagttgggt

SEQ ID NO: 471911 - DNA, 20 bp, Artificial
  CRISPR gRNA sequence
tcccctaaagttgggttctt

SEQ ID NO: 471912 - DNA, 20 bp, Artificial
  CRISPR gRNA sequence
cccctaaagttgggttcttt

SEQ ID NO: 471913 - DNA, 20 bp, Artificial
  CRISPR gRNA sequence
ccctaaagttgggttctttc

SEQ ID NO: 471914 - DNA, 20 bp, Artificial
  CRISPR gRNA sequence
aagttgggttctttcctcca

SEQ ID NO: 471915 - DNA, 20 bp, Artificial
  CRISPR gRNA sequence
ggttctttcctccacaaaat

SEQ ID NO: 471916 - DNA, 20 bp, Artificial
  CRISPR gRNA sequence
tttcctccacaaaatagata

SEQ ID NO: 471917 - DNA, 20 bp, Artificial
  CRISPR gRNA sequence
tcctccacaaaatagataga

SEQ ID NO: 471918 - DNA, 20 bp, Artificial
  CRISPR gRNA sequence
cctccacaaaatagatagat

SEQ ID NO: 471919 - DNA, 20 bp, Artificial
  CRISPR gRNA sequence
ctccacaaaatagatagatt

SEQ ID NO: 471920 - DNA, 20 bp, Artificial
  CRISPR gRNA sequence
cacaaaatagatagattgtt

SEQ ID NO: 471921 - DNA, 20 bp, Artificial
  CRISPR gRNA sequence
ttgatcctaatctcagcccc

SEQ ID NO: 471922 - DNA, 20 bp, Artificial
  CRISPR gRNA sequence
atcctaatctcagccccaac

SEQ ID NO: 471923 - DNA, 20 bp, Artificial
  CRISPR gRNA sequence
atctcagccccaacttgatc

SEQ ID NO: 471924 - DNA, 20 bp, Artificial
  CRISPR gRNA sequence
agccccaacttgatccctag

SEQ ID NO: 471925 - DNA, 20 bp, Artificial
  CRISPR gRNA sequence
gatccctagaacaggcacct

SEQ ID NO: 471926 - DNA, 20 bp, Artificial
  CRISPR gRNA sequence
atccctagaacaggcacctt

SEQ ID NO: 471927 - DNA, 20 bp, Artificial
  CRISPR gRNA sequence
gaacaggcacctttatgcac

SEQ ID NO: 471928 - DNA, 20 bp, Artificial
  CRISPR gRNA sequence
tatgcactttacaaactaca

SEQ ID NO: 471929 - DNA, 20 bp, Artificial
  CRISPR gRNA sequence
atgcactttacaaactacag

SEQ ID NO: 471930 - DNA, 20 bp, Artificial
  CRISPR gRNA sequence
tgcactttacaaactacaga

SEQ ID NO: 471931 - DNA, 20 bp, Artificial
  CRISPR gRNA sequence
tacaaactacagattatctt

SEQ ID NO: 471932 - DNA, 20 bp, Artificial
  CRISPR gRNA sequence
acaaactacagattatcttt

SEQ ID NO: 471933 - DNA, 20 bp, Artificial
  CRISPR gRNA sequence
caaactacagattatcttta

SEQ ID NO: 471934 - DNA, 20 bp, Artificial
  CRISPR gRNA sequence
cagattatctttagtcatca

SEQ ID NO: 471935 - DNA, 20 bp, Artificial
  CRISPR gRNA sequence
tctttagtcatcatgaatga

SEQ ID NO: 471936 - DNA, 20 bp, Artificial
  CRISPR gRNA sequence
tagtcatcatgaatgaccca

SEQ ID NO: 471937 - DNA, 20 bp, Artificial
  CRISPR gRNA sequence
agtcatcatgaatgacccaa

SEQ ID NO: 471938 - DNA, 20 bp, Artificial
  CRISPR gRNA sequence
gtcatcatgaatgacccaaa

SEQ ID NO: 471939 - DNA, 20 bp, Artificial
  CRISPR gRNA sequence
caatgctacttttgtgtaac

SEQ ID NO: 471940 - DNA, 20 bp, Artificial
  CRISPR gRNA sequence
cttttgtgtaacagactttt

SEQ ID NO: 471941 - DNA, 20 bp, Artificial
  CRISPR gRNA sequence
ttgtgtaacagacttttgta

SEQ ID NO: 471942 - DNA, 20 bp, Artificial
  CRISPR gRNA sequence
tgtgtaacagacttttgtat

SEQ ID NO: 471943 - DNA, 20 bp, Artificial
  CRISPR gRNA sequence
gtgtaacagacttttgtatc

SEQ ID NO: 471944 - DNA, 20 bp, Artificial
  CRISPR gRNA sequence
tgtaacagacttttgtatca

SEQ ID NO: 471945 - DNA, 20 bp, Artificial
  CRISPR gRNA sequence
ttgtatcacaattaattatt

SEQ ID NO: 471946 - DNA, 20 bp, Artificial
  CRISPR gRNA sequence
tgtatcacaattaattatta

SEQ ID NO: 471947 - DNA, 20 bp, Artificial
  CRISPR gRNA sequence
gtatcacaattaattattaa

SEQ ID NO: 471948 - DNA, 20 bp, Artificial
  CRISPR gRNA sequence
tatcacaattaattattaac

SEQ ID NO: 471949 - DNA, 20 bp, Artificial
  CRISPR gRNA sequence
attattaacttctgaccttt

SEQ ID NO: 471950 - DNA, 20 bp, Artificial
  CRISPR gRNA sequence
ttaacttctgacctttcatc

SEQ ID NO: 471951 - DNA, 20 bp, Artificial
  CRISPR gRNA sequence
acttctgacctttcatctga

SEQ ID NO: 471952 - DNA, 20 bp, Artificial
  CRISPR gRNA sequence
ctgacctttcatctgacctt

SEQ ID NO: 471953 - DNA, 20 bp, Artificial
  CRISPR gRNA sequence
tgacctttcatctgaccttg

SEQ ID NO: 471954 - DNA, 20 bp, Artificial
  CRISPR gRNA sequence
acctttcatctgaccttggc

SEQ ID NO: 471955 - DNA, 20 bp, Artificial
  CRISPR gRNA sequence
tcatctgaccttggctaaat

SEQ ID NO: 471956 - DNA, 20 bp, Artificial
  CRISPR gRNA sequence
catctgaccttggctaaatt

SEQ ID NO: 471957 - DNA, 20 bp, Artificial
  CRISPR gRNA sequence
atctgaccttggctaaattc

SEQ ID NO: 471958 - DNA, 20 bp, Artificial
  CRISPR gRNA sequence
accttggctaaattcatgtc

SEQ ID NO: 471959 - DNA, 20 bp, Artificial
  CRISPR gRNA sequence
ggctaaattcatgtctcgta

SEQ ID NO: 471960 - DNA, 20 bp, Artificial
  CRISPR gRNA sequence
gctaaattcatgtctcgtat

SEQ ID NO: 471961 - DNA, 20 bp, Artificial
  CRISPR gRNA sequence
aattcatgtctcgtatagaa

SEQ ID NO: 471962 - DNA, 20 bp, Artificial
  CRISPR gRNA sequence
atgtctcgtatagaagtaga

SEQ ID NO: 471963 - DNA, 20 bp, Artificial
  CRISPR gRNA sequence
gtatagaagtagattagttc

SEQ ID NO: 471964 - DNA, 20 bp, Artificial
  CRISPR gRNA sequence
gttcccataaagaaagactg

SEQ ID NO: 471965 - DNA, 20 bp, Artificial
  CRISPR gRNA sequence
ccataaagaaagactgaatt

SEQ ID NO: 471966 - DNA, 20 bp, Artificial
  CRISPR gRNA sequence
aattacacaaggcttctctt

SEQ ID NO: 471967 - DNA, 20 bp, Artificial
  CRISPR gRNA sequence
cacaaggcttctcttccaag

SEQ ID NO: 471968 - DNA, 20 bp, Artificial
  CRISPR gRNA sequence
ctcttccaaggaaggtggac

SEQ ID NO: 471969 - DNA, 20 bp, Artificial
  CRISPR gRNA sequence
tcttccaaggaaggtggact

SEQ ID NO: 471970 - DNA, 20 bp, Artificial
  CRISPR gRNA sequence
ttccaaggaaggtggactca

SEQ ID NO: 471971 - DNA, 20 bp, Artificial
  CRISPR gRNA sequence
ccaaggaaggtggactcaat

SEQ ID NO: 471972 - DNA, 20 bp, Artificial
  CRISPR gRNA sequence
caaggaaggtggactcaatg

SEQ ID NO: 471973 - DNA, 20 bp, Artificial
  CRISPR gRNA sequence
aatgcctcaaaatttaattt

SEQ ID NO: 471974 - DNA, 20 bp, Artificial
  CRISPR gRNA sequence
aaaatttaattttattatac

SEQ ID NO: 471975 - DNA, 20 bp, Artificial
  CRISPR gRNA sequence
aattttattatacattatgt

SEQ ID NO: 471976 - DNA, 20 bp, Artificial
  CRISPR gRNA sequence
attttattatacattatgtt

SEQ ID NO: 471977 - DNA, 20 bp, Artificial
  CRISPR gRNA sequence
tattatacattatgttaata

SEQ ID NO: 471978 - DNA, 20 bp, Artificial
  CRISPR gRNA sequence
attatacattatgttaatat

SEQ ID NO: 471979 - DNA, 20 bp, Artificial
  CRISPR gRNA sequence
ttatacattatgttaatata

SEQ ID NO: 471980 - DNA, 20 bp, Artificial
  CRISPR gRNA sequence
tacattatgttaatatatta

SEQ ID NO: 471981 - DNA, 20 bp, Artificial
  CRISPR gRNA sequence
tgttaatatattatataaat

SEQ ID NO: 471982 - DNA, 20 bp, Artificial
  CRISPR gRNA sequence
atatattatataaattagtt

SEQ ID NO: 471983 - DNA, 20 bp, Artificial
  CRISPR gRNA sequence
tataaattagttaatagcac

SEQ ID NO: 471984 - DNA, 20 bp, Artificial
  CRISPR gRNA sequence
gttaatagcacttatttatt

SEQ ID NO: 471985 - DNA, 20 bp, Artificial
  CRISPR gRNA sequence
atagcacttatttattcaat

SEQ ID NO: 471986 - DNA, 20 bp, Artificial
  CRISPR gRNA sequence
atttattcaatagtatatat

SEQ ID NO: 471987 - DNA, 20 bp, Artificial
  CRISPR gRNA sequence
tttattcaatagtatatatc

SEQ ID NO: 471988 - DNA, 20 bp, Artificial
  CRISPR gRNA sequence
attcaatagtatatatcatt

SEQ ID NO: 471989 - DNA, 20 bp, Artificial
  CRISPR gRNA sequence
ttcaatagtatatatcattc

SEQ ID NO: 471990 - DNA, 20 bp, Artificial
  CRISPR gRNA sequence
aatagtatatatcattctag

SEQ ID NO: 471991 - DNA, 20 bp, Artificial
  CRISPR gRNA sequence
tagaattaatattttgcaga

SEQ ID NO: 471992 - DNA, 20 bp, Artificial
  CRISPR gRNA sequence
gaattaatattttgcagatt

SEQ ID NO: 471993 - DNA, 20 bp, Artificial
  CRISPR gRNA sequence
atattttgcagattttcctt

SEQ ID NO: 471994 - DNA, 20 bp, Artificial
  CRISPR gRNA sequence
tgcagattttccttattttt

SEQ ID NO: 471995 - DNA, 20 bp, Artificial
  CRISPR gRNA sequence
gcagattttccttatttttg

SEQ ID NO: 471996 - DNA, 20 bp, Artificial
  CRISPR gRNA sequence
cagattttccttatttttgt

SEQ ID NO: 471997 - DNA, 20 bp, Artificial
  CRISPR gRNA sequence
tccttatttttgtaatttat

SEQ ID NO: 471998 - DNA, 20 bp, Artificial
  CRISPR gRNA sequence
ccttatttttgtaatttatt

SEQ ID NO: 471999 - DNA, 20 bp, Artificial
  CRISPR gRNA sequence
cttatttttgtaatttattt

SEQ ID NO: 472000 - DNA, 20 bp, Artificial
  CRISPR gRNA sequence
atttttgtaatttattttac

SEQ ID NO: 472001 - DNA, 20 bp, Artificial
  CRISPR gRNA sequence
tttttgtaatttattttacc

SEQ ID NO: 472002 - DNA, 20 bp, Artificial
  CRISPR gRNA sequence
ttgtaatttattttacctgt

SEQ ID NO: 472003 - DNA, 20 bp, Artificial
  CRISPR gRNA sequence
tgtaatttattttacctgtt

SEQ ID NO: 472004 - DNA, 20 bp, Artificial
  CRISPR gRNA sequence
gtaatttattttacctgttt

SEQ ID NO: 472005 - DNA, 20 bp, Artificial
  CRISPR gRNA sequence
taatttattttacctgttta

SEQ ID NO: 472006 - DNA, 20 bp, Artificial
  CRISPR gRNA sequence
attttacctgtttaaaaaat

SEQ ID NO: 472007 - DNA, 20 bp, Artificial
  CRISPR gRNA sequence
ttttacctgtttaaaaaata

SEQ ID NO: 472008 - DNA, 20 bp, Artificial
  CRISPR gRNA sequence
tacctgtttaaaaaatagta

SEQ ID NO: 472009 - DNA, 20 bp, Artificial
  CRISPR gRNA sequence
acctgtttaaaaaatagtat

SEQ ID NO: 472010 - DNA, 20 bp, Artificial
  CRISPR gRNA sequence
cctgtttaaaaaatagtatt

SEQ ID NO: 472011 - DNA, 20 bp, Artificial
  CRISPR gRNA sequence
tttaaaaaatagtatttgtt

SEQ ID NO: 472012 - DNA, 20 bp, Artificial
  CRISPR gRNA sequence
aaaaaatagtatttgttaaa

SEQ ID NO: 472013 - DNA, 20 bp, Artificial
  CRISPR gRNA sequence
aaaaatagtatttgttaaaa

SEQ ID NO: 472014 - DNA, 20 bp, Artificial
  CRISPR gRNA sequence
gttaaaaattcaatattttg

SEQ ID NO: 472015 - DNA, 20 bp, Artificial
  CRISPR gRNA sequence
ttaaaaattcaatattttgt

SEQ ID NO: 472016 - DNA, 20 bp, Artificial
  CRISPR gRNA sequence
aaaattcaatattttgtctc

SEQ ID NO: 472017 - DNA, 20 bp, Artificial
  CRISPR gRNA sequence
aatattttgtctcattaatg

SEQ ID NO: 472018 - DNA, 20 bp, Artificial
  CRISPR gRNA sequence
tgtctcattaatgtgaatta

SEQ ID NO: 472019 - DNA, 20 bp, Artificial
  CRISPR gRNA sequence
gtctcattaatgtgaattaa

SEQ ID NO: 472020 - DNA, 20 bp, Artificial
  CRISPR gRNA sequence
tctcattaatgtgaattaat

SEQ ID NO: 472021 - DNA, 20 bp, Artificial
  CRISPR gRNA sequence
attaatgtgaattaataatg

SEQ ID NO: 472022 - DNA, 20 bp, Artificial
  CRISPR gRNA sequence
atgtgaattaataatgcaat

SEQ ID NO: 472023 - DNA, 20 bp, Artificial
  CRISPR gRNA sequence
ataatgcaattctttccaga

SEQ ID NO: 472024 - DNA, 20 bp, Artificial
  CRISPR gRNA sequence
tttccagaaagtgttcattc

SEQ ID NO: 472025 - DNA, 20 bp, Artificial
  CRISPR gRNA sequence
tccagaaagtgttcattcca

SEQ ID NO: 472026 - DNA, 20 bp, Artificial
  CRISPR gRNA sequence
ccagaaagtgttcattccat

SEQ ID NO: 472027 - DNA, 20 bp, Artificial
  CRISPR gRNA sequence
cagaaagtgttcattccata

SEQ ID NO: 472028 - DNA, 20 bp, Artificial
  CRISPR gRNA sequence
attccatacatccttaatat

SEQ ID NO: 472029 - DNA, 20 bp, Artificial
  CRISPR gRNA sequence
catacatccttaatatagcc

SEQ ID NO: 472030 - DNA, 20 bp, Artificial
  CRISPR gRNA sequence
aatatagccttctccaggtt

SEQ ID NO: 472031 - DNA, 20 bp, Artificial
  CRISPR gRNA sequence
atatagccttctccaggttg

SEQ ID NO: 472032 - DNA, 20 bp, Artificial
  CRISPR gRNA sequence
ctccaggttgatgaagacaa

SEQ ID NO: 472033 - DNA, 20 bp, Artificial
  CRISPR gRNA sequence
tccaggttgatgaagacaat

SEQ ID NO: 472034 - DNA, 20 bp, Artificial
  CRISPR gRNA sequence
caggttgatgaagacaattt

SEQ ID NO: 472035 - DNA, 20 bp, Artificial
  CRISPR gRNA sequence
atgaagacaatttttgtgct

SEQ ID NO: 472036 - DNA, 20 bp, Artificial
  CRISPR gRNA sequence
ttgtgctttgcatatactat

SEQ ID NO: 472037 - DNA, 20 bp, Artificial
  CRISPR gRNA sequence
tgtgctttgcatatactatg

SEQ ID NO: 472038 - DNA, 20 bp, Artificial
  CRISPR gRNA sequence
gtgctttgcatatactatgt

SEQ ID NO: 472039 - DNA, 20 bp, Artificial
  CRISPR gRNA sequence
tgctttgcatatactatgtt

SEQ ID NO: 472040 - DNA, 20 bp, Artificial
  CRISPR gRNA sequence
tgcatatactatgttcttta

SEQ ID NO: 472041 - DNA, 20 bp, Artificial
  CRISPR gRNA sequence
gcatatactatgttctttaa

SEQ ID NO: 472042 - DNA, 20 bp, Artificial
  CRISPR gRNA sequence
catatactatgttctttaat

SEQ ID NO: 472043 - DNA, 20 bp, Artificial
  CRISPR gRNA sequence
tgttctttaattcatttaca

SEQ ID NO: 472044 - DNA, 20 bp, Artificial
  CRISPR gRNA sequence
tttaattcatttacaaagaa

SEQ ID NO: 472045 - DNA, 20 bp, Artificial
  CRISPR gRNA sequence
taattcatttacaaagaaat

SEQ ID NO: 472046 - DNA, 20 bp, Artificial
  CRISPR gRNA sequence
aattcatttacaaagaaata

SEQ ID NO: 472047 - DNA, 20 bp, Artificial
  CRISPR gRNA sequence
attcatttacaaagaaatat

SEQ ID NO: 472048 - DNA, 20 bp, Artificial
  CRISPR gRNA sequence
atttacaaagaaatatttag

SEQ ID NO: 472049 - DNA, 20 bp, Artificial
  CRISPR gRNA sequence
acaaagaaatatttagtgag

SEQ ID NO: 472050 - DNA, 20 bp, Artificial
  CRISPR gRNA sequence
caaagaaatatttagtgagc

SEQ ID NO: 472051 - DNA, 20 bp, Artificial
  CRISPR gRNA sequence
agtgagcccctaccatgtgc

SEQ ID NO: 472052 - DNA, 20 bp, Artificial
  CRISPR gRNA sequence
gtgagcccctaccatgtgcc

SEQ ID NO: 472053 - DNA, 20 bp, Artificial
  CRISPR gRNA sequence
ccatgtgccaggtaccctgc

SEQ ID NO: 472054 - DNA, 20 bp, Artificial
  CRISPR gRNA sequence
ccatccatcatacagagcaa

SEQ ID NO: 472055 - DNA, 20 bp, Artificial
  CRISPR gRNA sequence
aagacacagcttccatcctg

SEQ ID NO: 472056 - DNA, 20 bp, Artificial
  CRISPR gRNA sequence
agacacagcttccatcctga

SEQ ID NO: 472057 - DNA, 20 bp, Artificial
  CRISPR gRNA sequence
ccatcctgaagaggtttata

SEQ ID NO: 472058 - DNA, 20 bp, Artificial
  CRISPR gRNA sequence
catcctgaagaggtttataa

SEQ ID NO: 472059 - DNA, 20 bp, Artificial
  CRISPR gRNA sequence
aagaggtttataagccagtg

SEQ ID NO: 472060 - DNA, 20 bp, Artificial
  CRISPR gRNA sequence
ataagccagtgcatggatgg

SEQ ID NO: 472061 - DNA, 20 bp, Artificial
  CRISPR gRNA sequence
taagccagtgcatggatggt

SEQ ID NO: 472062 - DNA, 20 bp, Artificial
  CRISPR gRNA sequence
gcaccgagcttcacgctata

SEQ ID NO: 472063 - DNA, 20 bp, Artificial
  CRISPR gRNA sequence
cacgctatatttgcaaaagc

SEQ ID NO: 472064 - DNA, 20 bp, Artificial
  CRISPR gRNA sequence
acgctatatttgcaaaagca

SEQ ID NO: 472065 - DNA, 20 bp, Artificial
  CRISPR gRNA sequence
tatttgcaaaagcagagtcc

SEQ ID NO: 472066 - DNA, 20 bp, Artificial
  CRISPR gRNA sequence
gcaaaagcagagtccctaac

SEQ ID NO: 472067 - DNA, 20 bp, Artificial
  CRISPR gRNA sequence
caaaagcagagtccctaact

SEQ ID NO: 472068 - DNA, 20 bp, Artificial
  CRISPR gRNA sequence
actctgccatcgatttcttc

SEQ ID NO: 472069 - DNA, 20 bp, Artificial
  CRISPR gRNA sequence
tgccatcgatttcttctata

SEQ ID NO: 472070 - DNA, 20 bp, Artificial
  CRISPR gRNA sequence
ccatcgatttcttctatatt

SEQ ID NO: 472071 - DNA, 20 bp, Artificial
  CRISPR gRNA sequence
cttctatatttcataattga

SEQ ID NO: 472072 - DNA, 20 bp, Artificial
  CRISPR gRNA sequence
ttctatatttcataattgag

SEQ ID NO: 472073 - DNA, 20 bp, Artificial
  CRISPR gRNA sequence
ctatatttcataattgaggg

SEQ ID NO: 472074 - DNA, 20 bp, Artificial
  CRISPR gRNA sequence
tatatttcataattgagggt

SEQ ID NO: 472075 - DNA, 20 bp, Artificial
  CRISPR gRNA sequence
tatttcataattgagggttg

SEQ ID NO: 472076 - DNA, 20 bp, Artificial
  CRISPR gRNA sequence
cataattgagggttgtagct

SEQ ID NO: 472077 - DNA, 20 bp, Artificial
  CRISPR gRNA sequence
ataattgagggttgtagcta

SEQ ID NO: 472078 - DNA, 20 bp, Artificial
  CRISPR gRNA sequence
agggttgtagctactgctaa

SEQ ID NO: 472079 - DNA, 20 bp, Artificial
  CRISPR gRNA sequence
tagctactgctaaactgcta

SEQ ID NO: 472080 - DNA, 20 bp, Artificial
  CRISPR gRNA sequence
ctgctaaactgctatgcatt

SEQ ID NO: 472081 - DNA, 20 bp, Artificial
  CRISPR gRNA sequence
ctaaactgctatgcattttt

SEQ ID NO: 472082 - DNA, 20 bp, Artificial
  CRISPR gRNA sequence
aactgctatgcattttttca

SEQ ID NO: 472083 - DNA, 20 bp, Artificial
  CRISPR gRNA sequence
ctatgcattttttcatggtg

SEQ ID NO: 472084 - DNA, 20 bp, Artificial
  CRISPR gRNA sequence
tgcattttttcatggtgctg

SEQ ID NO: 472085 - DNA, 20 bp, Artificial
  CRISPR gRNA sequence
tttcatggtgctgctgtaag

SEQ ID NO: 472086 - DNA, 20 bp, Artificial
  CRISPR gRNA sequence
ttcatggtgctgctgtaaga

SEQ ID NO: 472087 - DNA, 20 bp, Artificial
  CRISPR gRNA sequence
tcatggtgctgctgtaagaa

SEQ ID NO: 472088 - DNA, 20 bp, Artificial
  CRISPR gRNA sequence
catggtgctgctgtaagaaa

SEQ ID NO: 472089 - DNA, 20 bp, Artificial
  CRISPR gRNA sequence
atggtgctgctgtaagaaat

SEQ ID NO: 472090 - DNA, 20 bp, Artificial
  CRISPR gRNA sequence
ctgtaagaaattttaaacta

SEQ ID NO: 472091 - DNA, 20 bp, Artificial
  CRISPR gRNA sequence
taagaaattttaaactaacc

SEQ ID NO: 472092 - DNA, 20 bp, Artificial
  CRISPR gRNA sequence
taaactaacctaaagcattt

SEQ ID NO: 472093 - DNA, 20 bp, Artificial
  CRISPR gRNA sequence
aaactaacctaaagcatttt

SEQ ID NO: 472094 - DNA, 20 bp, Artificial
  CRISPR gRNA sequence
aactaacctaaagcatttta

SEQ ID NO: 472095 - DNA, 20 bp, Artificial
  CRISPR gRNA sequence
acctaaagcattttaaaaga

SEQ ID NO: 472096 - DNA, 20 bp, Artificial
  CRISPR gRNA sequence
aagcattttaaaagaatttc

SEQ ID NO: 472097 - DNA, 20 bp, Artificial
  CRISPR gRNA sequence
taaaagaatttcaatggatt

SEQ ID NO: 472098 - DNA, 20 bp, Artificial
  CRISPR gRNA sequence
aaaagaatttcaatggattc

SEQ ID NO: 472099 - DNA, 20 bp, Artificial
  CRISPR gRNA sequence
aaagaatttcaatggattcc

SEQ ID NO: 472100 - DNA, 20 bp, Artificial
  CRISPR gRNA sequence
caatggattccttcactggg

SEQ ID NO: 472101 - DNA, 20 bp, Artificial
  CRISPR gRNA sequence
aatggattccttcactgggc

SEQ ID NO: 472102 - DNA, 20 bp, Artificial
  CRISPR gRNA sequence
cttcactgggctactttaag

SEQ ID NO: 472103 - DNA, 20 bp, Artificial
  CRISPR gRNA sequence
cactgggctactttaaggga

SEQ ID NO: 472104 - DNA, 20 bp, Artificial
  CRISPR gRNA sequence
actgggctactttaagggag

SEQ ID NO: 472105 - DNA, 20 bp, Artificial
  CRISPR gRNA sequence
ggctactttaagggagttga

SEQ ID NO: 472106 - DNA, 20 bp, Artificial
  CRISPR gRNA sequence
ctttaagggagttgaaagac

SEQ ID NO: 472107 - DNA, 20 bp, Artificial
  CRISPR gRNA sequence
taagggagttgaaagacact

SEQ ID NO: 472108 - DNA, 20 bp, Artificial
  CRISPR gRNA sequence
aagggagttgaaagacactc

SEQ ID NO: 472109 - DNA, 20 bp, Artificial
  CRISPR gRNA sequence
agggagttgaaagacactca

SEQ ID NO: 472110 - DNA, 20 bp, Artificial
  CRISPR gRNA sequence
aaagacactcaaaagtaagc

SEQ ID NO: 472111 - DNA, 20 bp, Artificial
  CRISPR gRNA sequence
aaaagtaagcatataaagta

SEQ ID NO: 472112 - DNA, 20 bp, Artificial
  CRISPR gRNA sequence
attttaaaaagatcagttgt

SEQ ID NO: 472113 - DNA, 20 bp, Artificial
  CRISPR gRNA sequence
taaaaagatcagttgtaaaa

SEQ ID NO: 472114 - DNA, 20 bp, Artificial
  CRISPR gRNA sequence
aaaaagatcagttgtaaaat

SEQ ID NO: 472115 - DNA, 20 bp, Artificial
  CRISPR gRNA sequence
aaaagatcagttgtaaaatg

SEQ ID NO: 472116 - DNA, 20 bp, Artificial
  CRISPR gRNA sequence
taaaatgtatgcattcaagt

SEQ ID NO: 472117 - DNA, 20 bp, Artificial
  CRISPR gRNA sequence
aagtgaatgatgtccataaa

SEQ ID NO: 472118 - DNA, 20 bp, Artificial
  CRISPR gRNA sequence
aactgtacgaggttgcatcc

SEQ ID NO: 472119 - DNA, 20 bp, Artificial
  CRISPR gRNA sequence
tacgaggttgcatccagagt

SEQ ID NO: 472120 - DNA, 20 bp, Artificial
  CRISPR gRNA sequence
catccagagttcagccatgc

SEQ ID NO: 472121 - DNA, 20 bp, Artificial
  CRISPR gRNA sequence
agccatgctgctattgcaat

SEQ ID NO: 472122 - DNA, 20 bp, Artificial
  CRISPR gRNA sequence
ctattgcaataaccctcttt

SEQ ID NO: 472123 - DNA, 20 bp, Artificial
  CRISPR gRNA sequence
ttgcaataaccctcttttga

SEQ ID NO: 472124 - DNA, 20 bp, Artificial
  CRISPR gRNA sequence
caataaccctcttttgaaat

SEQ ID NO: 472125 - DNA, 20 bp, Artificial
  CRISPR gRNA sequence
ttttgaaatttctccttccc

SEQ ID NO: 472126 - DNA, 20 bp, Artificial
  CRISPR gRNA sequence
ttgaaatttctccttcccag

SEQ ID NO: 472127 - DNA, 20 bp, Artificial
  CRISPR gRNA sequence
tgaaatttctccttcccagt

SEQ ID NO: 472128 - DNA, 20 bp, Artificial
  CRISPR gRNA sequence
gaaatttctccttcccagta

SEQ ID NO: 472129 - DNA, 20 bp, Artificial
  CRISPR gRNA sequence
aaatttctccttcccagtaa

SEQ ID NO: 472130 - DNA, 20 bp, Artificial
  CRISPR gRNA sequence
ctccttcccagtaactttaa

SEQ ID NO: 472131 - DNA, 20 bp, Artificial
  CRISPR gRNA sequence
tccttcccagtaactttaag

SEQ ID NO: 472132 - DNA, 20 bp, Artificial
  CRISPR gRNA sequence
cttcccagtaactttaaggg

SEQ ID NO: 472133 - DNA, 20 bp, Artificial
  CRISPR gRNA sequence
cccagtaactttaagggtca

SEQ ID NO: 472134 - DNA, 20 bp, Artificial
  CRISPR gRNA sequence
ccagtaactttaagggtcaa

SEQ ID NO: 472135 - DNA, 20 bp, Artificial
  CRISPR gRNA sequence
taagggtcaatttatgagca

SEQ ID NO: 472136 - DNA, 20 bp, Artificial
  CRISPR gRNA sequence
aagggtcaatttatgagcaa

SEQ ID NO: 472137 - DNA, 20 bp, Artificial
  CRISPR gRNA sequence
agggtcaatttatgagcaac

SEQ ID NO: 472138 - DNA, 20 bp, Artificial
  CRISPR gRNA sequence
atgagcaacaaaagaaactc

SEQ ID NO: 472139 - DNA, 20 bp, Artificial
  CRISPR gRNA sequence
tgagcaacaaaagaaactcc

SEQ ID NO: 472140 - DNA, 20 bp, Artificial
  CRISPR gRNA sequence
cacattatttcttataatta

SEQ ID NO: 472141 - DNA, 20 bp, Artificial
  CRISPR gRNA sequence
tttcttataattaaagggca

SEQ ID NO: 472142 - DNA, 20 bp, Artificial
  CRISPR gRNA sequence
cttataattaaagggcactc

SEQ ID NO: 472143 - DNA, 20 bp, Artificial
  CRISPR gRNA sequence
ttataattaaagggcactct

SEQ ID NO: 472144 - DNA, 20 bp, Artificial
  CRISPR gRNA sequence
ataattaaagggcactcttc

SEQ ID NO: 472145 - DNA, 20 bp, Artificial
  CRISPR gRNA sequence
taattaaagggcactcttct

SEQ ID NO: 472146 - DNA, 20 bp, Artificial
  CRISPR gRNA sequence
aagggcactcttctttgatc

SEQ ID NO: 472147 - DNA, 20 bp, Artificial
  CRISPR gRNA sequence
ttctttgatccaaatatatt

SEQ ID NO: 472148 - DNA, 20 bp, Artificial
  CRISPR gRNA sequence
ctttgatccaaatatatttt

SEQ ID NO: 472149 - DNA, 20 bp, Artificial
  CRISPR gRNA sequence
tttgatccaaatatattttt

SEQ ID NO: 472150 - DNA, 20 bp, Artificial
  CRISPR gRNA sequence
tgatccaaatatatttttat

SEQ ID NO: 472151 - DNA, 20 bp, Artificial
  CRISPR gRNA sequence
gatccaaatatatttttatt

SEQ ID NO: 472152 - DNA, 20 bp, Artificial
  CRISPR gRNA sequence
atccaaatatatttttattg

SEQ ID NO: 472153 - DNA, 20 bp, Artificial
  CRISPR gRNA sequence
ttattgtggtaaaatacata

SEQ ID NO: 472154 - DNA, 20 bp, Artificial
  CRISPR gRNA sequence
tattgtggtaaaatacatat

SEQ ID NO: 472155 - DNA, 20 bp, Artificial
  CRISPR gRNA sequence
attgtggtaaaatacatata

SEQ ID NO: 472156 - DNA, 20 bp, Artificial
  CRISPR gRNA sequence
ttgtggtaaaatacatataa

SEQ ID NO: 472157 - DNA, 20 bp, Artificial
  CRISPR gRNA sequence
tggtaaaatacatataacat

SEQ ID NO: 472158 - DNA, 20 bp, Artificial
  CRISPR gRNA sequence
ccaatttaatcatttaaaat

SEQ ID NO: 472159 - DNA, 20 bp, Artificial
  CRISPR gRNA sequence
aatcatttaaaatgtacaat

SEQ ID NO: 472160 - DNA, 20 bp, Artificial
  CRISPR gRNA sequence
atcatttaaaatgtacaatt

SEQ ID NO: 472161 - DNA, 20 bp, Artificial
  CRISPR gRNA sequence
aaaatgtacaattaaatggc

SEQ ID NO: 472162 - DNA, 20 bp, Artificial
  CRISPR gRNA sequence
aaatgtacaattaaatggca

SEQ ID NO: 472163 - DNA, 20 bp, Artificial
  CRISPR gRNA sequence
aatggcatgtaagatactca

SEQ ID NO: 472164 - DNA, 20 bp, Artificial
  CRISPR gRNA sequence
acaatgttttgcaaacgtga

SEQ ID NO: 472165 - DNA, 20 bp, Artificial
  CRISPR gRNA sequence
tgcaaacgtgactacgatct

SEQ ID NO: 472166 - DNA, 20 bp, Artificial
  CRISPR gRNA sequence
gcaaacgtgactacgatcta

SEQ ID NO: 472167 - DNA, 20 bp, Artificial
  CRISPR gRNA sequence
caaacgtgactacgatctag

SEQ ID NO: 472168 - DNA, 20 bp, Artificial
  CRISPR gRNA sequence
cgatctagattcagaacata

SEQ ID NO: 472169 - DNA, 20 bp, Artificial
  CRISPR gRNA sequence
gattcagaacatatttatca

SEQ ID NO: 472170 - DNA, 20 bp, Artificial
  CRISPR gRNA sequence
agaacatatttatcacccca

SEQ ID NO: 472171 - DNA, 20 bp, Artificial
  CRISPR gRNA sequence
atcaccccaaaaggaagccc

SEQ ID NO: 472172 - DNA, 20 bp, Artificial
  CRISPR gRNA sequence
tcaccccaaaaggaagccct

SEQ ID NO: 472173 - DNA, 20 bp, Artificial
  CRISPR gRNA sequence
tacctatttagtagtcatgt

SEQ ID NO: 472174 - DNA, 20 bp, Artificial
  CRISPR gRNA sequence
cctatttagtagtcatgtca

SEQ ID NO: 472175 - DNA, 20 bp, Artificial
  CRISPR gRNA sequence
tttagtagtcatgtcacatt

SEQ ID NO: 472176 - DNA, 20 bp, Artificial
  CRISPR gRNA sequence
agtagtcatgtcacattctt

SEQ ID NO: 472177 - DNA, 20 bp, Artificial
  CRISPR gRNA sequence
gtagtcatgtcacattcttt

SEQ ID NO: 472178 - DNA, 20 bp, Artificial
  CRISPR gRNA sequence
tttatttcctcagcccctgg

SEQ ID NO: 472179 - DNA, 20 bp, Artificial
  CRISPR gRNA sequence
tatttcctcagcccctggca

SEQ ID NO: 472180 - DNA, 20 bp, Artificial
  CRISPR gRNA sequence
atttcctcagcccctggcaa

SEQ ID NO: 472181 - DNA, 20 bp, Artificial
  CRISPR gRNA sequence
tttcctcagcccctggcaac

SEQ ID NO: 472182 - DNA, 20 bp, Artificial
  CRISPR gRNA sequence
cctcagcccctggcaaccac

SEQ ID NO: 472183 - DNA, 20 bp, Artificial
  CRISPR gRNA sequence
ctcagcccctggcaaccacc

SEQ ID NO: 472184 - DNA, 20 bp, Artificial
  CRISPR gRNA sequence
agcccctggcaaccaccaag

SEQ ID NO: 472185 - DNA, 20 bp, Artificial
  CRISPR gRNA sequence
gcaaccaccaagctactttc

SEQ ID NO: 472186 - DNA, 20 bp, Artificial
  CRISPR gRNA sequence
ctttctgtctctatggattt

SEQ ID NO: 472187 - DNA, 20 bp, Artificial
  CRISPR gRNA sequence
tctgtctctatggatttgcc

SEQ ID NO: 472188 - DNA, 20 bp, Artificial
  CRISPR gRNA sequence
ctgtctctatggatttgcct

SEQ ID NO: 472189 - DNA, 20 bp, Artificial
  CRISPR gRNA sequence
tgtctctatggatttgccta

SEQ ID NO: 472190 - DNA, 20 bp, Artificial
  CRISPR gRNA sequence
tctctatggatttgcctatt

SEQ ID NO: 472191 - DNA, 20 bp, Artificial
  CRISPR gRNA sequence
tatggatttgcctattttgg

SEQ ID NO: 472192 - DNA, 20 bp, Artificial
  CRISPR gRNA sequence
tggatttgcctattttggat

SEQ ID NO: 472193 - DNA, 20 bp, Artificial
  CRISPR gRNA sequence
gcctattttggatatttcat

SEQ ID NO: 472194 - DNA, 20 bp, Artificial
  CRISPR gRNA sequence
cctattttggatatttcata

SEQ ID NO: 472195 - DNA, 20 bp, Artificial
  CRISPR gRNA sequence
ttttggatatttcatataat

SEQ ID NO: 472196 - DNA, 20 bp, Artificial
  CRISPR gRNA sequence
tggatatttcatataatcag

SEQ ID NO: 472197 - DNA, 20 bp, Artificial
  CRISPR gRNA sequence
ggatatttcatataatcaga

SEQ ID NO: 472198 - DNA, 20 bp, Artificial
  CRISPR gRNA sequence
gatatttcatataatcagaa

SEQ ID NO: 472199 - DNA, 20 bp, Artificial
  CRISPR gRNA sequence
catataatcagaatcacatt

SEQ ID NO: 472200 - DNA, 20 bp, Artificial
  CRISPR gRNA sequence
atataatcagaatcacattg

SEQ ID NO: 472201 - DNA, 20 bp, Artificial
  CRISPR gRNA sequence
tatgtaacctttttcttctt

SEQ ID NO: 472202 - DNA, 20 bp, Artificial
  CRISPR gRNA sequence
tttcttcttttacttagcgt

SEQ ID NO: 472203 - DNA, 20 bp, Artificial
  CRISPR gRNA sequence
ttcttcttttacttagcgta

SEQ ID NO: 472204 - DNA, 20 bp, Artificial
  CRISPR gRNA sequence
tcttcttttacttagcgtaa

SEQ ID NO: 472205 - DNA, 20 bp, Artificial
  CRISPR gRNA sequence
cttcttttacttagcgtaat

SEQ ID NO: 472206 - DNA, 20 bp, Artificial
  CRISPR gRNA sequence
ttcttttacttagcgtaatg

SEQ ID NO: 472207 - DNA, 20 bp, Artificial
  CRISPR gRNA sequence
cttttacttagcgtaatgct

SEQ ID NO: 472208 - DNA, 20 bp, Artificial
  CRISPR gRNA sequence
ttttacttagcgtaatgctt

SEQ ID NO: 472209 - DNA, 20 bp, Artificial
  CRISPR gRNA sequence
ttacttagcgtaatgcttct

SEQ ID NO: 472210 - DNA, 20 bp, Artificial
  CRISPR gRNA sequence
tacttagcgtaatgcttctg

SEQ ID NO: 472211 - DNA, 20 bp, Artificial
  CRISPR gRNA sequence
acttagcgtaatgcttctga

SEQ ID NO: 472212 - DNA, 20 bp, Artificial
  CRISPR gRNA sequence
cttagcgtaatgcttctgag

SEQ ID NO: 472213 - DNA, 20 bp, Artificial
  CRISPR gRNA sequence
agcgtaatgcttctgaggtt

SEQ ID NO: 472214 - DNA, 20 bp, Artificial
  CRISPR gRNA sequence
gcgtaatgcttctgaggttc

SEQ ID NO: 472215 - DNA, 20 bp, Artificial
  CRISPR gRNA sequence
ctgaggttcatcaatgttgt

SEQ ID NO: 472216 - DNA, 20 bp, Artificial
  CRISPR gRNA sequence
tgaggttcatcaatgttgta

SEQ ID NO: 472217 - DNA, 20 bp, Artificial
  CRISPR gRNA sequence
aggttcatcaatgttgtagc

SEQ ID NO: 472218 - DNA, 20 bp, Artificial
  CRISPR gRNA sequence
atcaatgttgtagcatacat

SEQ ID NO: 472219 - DNA, 20 bp, Artificial
  CRISPR gRNA sequence
tagcatacattagtacttca

SEQ ID NO: 472220 - DNA, 20 bp, Artificial
  CRISPR gRNA sequence
gtacttcattccttttcatg

SEQ ID NO: 472221 - DNA, 20 bp, Artificial
  CRISPR gRNA sequence
cattccttttcatgactgaa

SEQ ID NO: 472222 - DNA, 20 bp, Artificial
  CRISPR gRNA sequence
attccttttcatgactgaat

SEQ ID NO: 472223 - DNA, 20 bp, Artificial
  CRISPR gRNA sequence
cttttcatgactgaataata

SEQ ID NO: 472224 - DNA, 20 bp, Artificial
  CRISPR gRNA sequence
ttcatgactgaataatattc

SEQ ID NO: 472225 - DNA, 20 bp, Artificial
  CRISPR gRNA sequence
tcatgactgaataatattcc

SEQ ID NO: 472226 - DNA, 20 bp, Artificial
  CRISPR gRNA sequence
catgactgaataatattccg

SEQ ID NO: 472227 - DNA, 20 bp, Artificial
  CRISPR gRNA sequence
atgactgaataatattccgt

SEQ ID NO: 472228 - DNA, 20 bp, Artificial
  CRISPR gRNA sequence
aataatattccgtgtgtgga

SEQ ID NO: 472229 - DNA, 20 bp, Artificial
  CRISPR gRNA sequence
cgtgtgtggataaactacat

SEQ ID NO: 472230 - DNA, 20 bp, Artificial
  CRISPR gRNA sequence
catttcctttatccattcat

SEQ ID NO: 472231 - DNA, 20 bp, Artificial
  CRISPR gRNA sequence
cctttatccattcatcagct

SEQ ID NO: 472232 - DNA, 20 bp, Artificial
  CRISPR gRNA sequence
ctttatccattcatcagctg

SEQ ID NO: 472233 - DNA, 20 bp, Artificial
  CRISPR gRNA sequence
tatccattcatcagctgaac

SEQ ID NO: 472234 - DNA, 20 bp, Artificial
  CRISPR gRNA sequence
atccattcatcagctgaaca

SEQ ID NO: 472235 - DNA, 20 bp, Artificial
  CRISPR gRNA sequence
tccattcatcagctgaacat

SEQ ID NO: 472236 - DNA, 20 bp, Artificial
  CRISPR gRNA sequence
atcagctgaacatttaggtt

SEQ ID NO: 472237 - DNA, 20 bp, Artificial
  CRISPR gRNA sequence
aacatttaggttgtttctac

SEQ ID NO: 472238 - DNA, 20 bp, Artificial
  CRISPR gRNA sequence
aggttgtttctaccttttgg

SEQ ID NO: 472239 - DNA, 20 bp, Artificial
  CRISPR gRNA sequence
ggttgtttctaccttttggc

SEQ ID NO: 472240 - DNA, 20 bp, Artificial
  CRISPR gRNA sequence
tttctaccttttggctattg

SEQ ID NO: 472241 - DNA, 20 bp, Artificial
  CRISPR gRNA sequence
ctaccttttggctattgtga

SEQ ID NO: 472242 - DNA, 20 bp, Artificial
  CRISPR gRNA sequence
taccttttggctattgtgaa

SEQ ID NO: 472243 - DNA, 20 bp, Artificial
  CRISPR gRNA sequence
ccttttggctattgtgaata

SEQ ID NO: 472244 - DNA, 20 bp, Artificial
  CRISPR gRNA sequence
ttggctattgtgaatagtgc

SEQ ID NO: 472245 - DNA, 20 bp, Artificial
  CRISPR gRNA sequence
tggctattgtgaatagtgct

SEQ ID NO: 472246 - DNA, 20 bp, Artificial
  CRISPR gRNA sequence
ggctattgtgaatagtgctg

SEQ ID NO: 472247 - DNA, 20 bp, Artificial
  CRISPR gRNA sequence
gctattgtgaatagtgctgt

SEQ ID NO: 472248 - DNA, 20 bp, Artificial
  CRISPR gRNA sequence
ttgtgaatagtgctgtgata

SEQ ID NO: 472249 - DNA, 20 bp, Artificial
  CRISPR gRNA sequence
tgaatagtgctgtgataaac

SEQ ID NO: 472250 - DNA, 20 bp, Artificial
  CRISPR gRNA sequence
tgataaacattcaggaacaa

SEQ ID NO: 472251 - DNA, 20 bp, Artificial
  CRISPR gRNA sequence
aggaacaaggttttgtgtga

SEQ ID NO: 472252 - DNA, 20 bp, Artificial
  CRISPR gRNA sequence
tgtgtgaacatatattttaa

SEQ ID NO: 472253 - DNA, 20 bp, Artificial
  CRISPR gRNA sequence
gtgtgaacatatattttaat

SEQ ID NO: 472254 - DNA, 20 bp, Artificial
  CRISPR gRNA sequence
tgtgaacatatattttaatt

SEQ ID NO: 472255 - DNA, 20 bp, Artificial
  CRISPR gRNA sequence
taatttcatttgagtattta

SEQ ID NO: 472256 - DNA, 20 bp, Artificial
  CRISPR gRNA sequence
aatttcatttgagtatttac

SEQ ID NO: 472257 - DNA, 20 bp, Artificial
  CRISPR gRNA sequence
atttcatttgagtatttacc

SEQ ID NO: 472258 - DNA, 20 bp, Artificial
  CRISPR gRNA sequence
catttgagtatttacctagg

SEQ ID NO: 472259 - DNA, 20 bp, Artificial
  CRISPR gRNA sequence
atttgagtatttacctagga

SEQ ID NO: 472260 - DNA, 20 bp, Artificial
  CRISPR gRNA sequence
gagtatttacctaggaatag

SEQ ID NO: 472261 - DNA, 20 bp, Artificial
  CRISPR gRNA sequence
agtatttacctaggaataga

SEQ ID NO: 472262 - DNA, 20 bp, Artificial
  CRISPR gRNA sequence
acctaggaatagaattactg

SEQ ID NO: 472263 - DNA, 20 bp, Artificial
  CRISPR gRNA sequence
cctaggaatagaattactgg

SEQ ID NO: 472264 - DNA, 20 bp, Artificial
  CRISPR gRNA sequence
ggaatagaattactgggtac

SEQ ID NO: 472265 - DNA, 20 bp, Artificial
  CRISPR gRNA sequence
ctgggtactgtgacaagtag

SEQ ID NO: 472266 - DNA, 20 bp, Artificial
  CRISPR gRNA sequence
ggtactgtgacaagtaggtt

SEQ ID NO: 472267 - DNA, 20 bp, Artificial
  CRISPR gRNA sequence
tgacaagtaggttttatctt

SEQ ID NO: 472268 - DNA, 20 bp, Artificial
  CRISPR gRNA sequence
tatcttttgattttgaggaa

SEQ ID NO: 472269 - DNA, 20 bp, Artificial
  CRISPR gRNA sequence
atcttttgattttgaggaac

SEQ ID NO: 472270 - DNA, 20 bp, Artificial
  CRISPR gRNA sequence
tcttttgattttgaggaact

SEQ ID NO: 472271 - DNA, 20 bp, Artificial
  CRISPR gRNA sequence
ttgattttgaggaactgtta

SEQ ID NO: 472272 - DNA, 20 bp, Artificial
  CRISPR gRNA sequence
tgattttgaggaactgttag

SEQ ID NO: 472273 - DNA, 20 bp, Artificial
  CRISPR gRNA sequence
gattttgaggaactgttaga

SEQ ID NO: 472274 - DNA, 20 bp, Artificial
  CRISPR gRNA sequence
attttgaggaactgttagac

SEQ ID NO: 472275 - DNA, 20 bp, Artificial
  CRISPR gRNA sequence
tgaggaactgttagaccact

SEQ ID NO: 472276 - DNA, 20 bp, Artificial
  CRISPR gRNA sequence
gaggaactgttagaccactt

SEQ ID NO: 472277 - DNA, 20 bp, Artificial
  CRISPR gRNA sequence
aggaactgttagaccacttt

SEQ ID NO: 472278 - DNA, 20 bp, Artificial
  CRISPR gRNA sequence
ttagaccactttctaaagtg

SEQ ID NO: 472279 - DNA, 20 bp, Artificial
  CRISPR gRNA sequence
gaccactttctaaagtgact

SEQ ID NO: 472280 - DNA, 20 bp, Artificial
  CRISPR gRNA sequence
tctaaagtgactgcaccatt

SEQ ID NO: 472281 - DNA, 20 bp, Artificial
  CRISPR gRNA sequence
ctaaagtgactgcaccattt

SEQ ID NO: 472282 - DNA, 20 bp, Artificial
  CRISPR gRNA sequence
taaagtgactgcaccatttt

SEQ ID NO: 472283 - DNA, 20 bp, Artificial
  CRISPR gRNA sequence
aagtgactgcaccattttac

SEQ ID NO: 472284 - DNA, 20 bp, Artificial
  CRISPR gRNA sequence
caccattttacattctcctc

SEQ ID NO: 472285 - DNA, 20 bp, Artificial
  CRISPR gRNA sequence
tacattctcctcagcaatgg

SEQ ID NO: 472286 - DNA, 20 bp, Artificial
  CRISPR gRNA sequence
acattctcctcagcaatgga

SEQ ID NO: 472287 - DNA, 20 bp, Artificial
  CRISPR gRNA sequence
cattctcctcagcaatggat

SEQ ID NO: 472288 - DNA, 20 bp, Artificial
  CRISPR gRNA sequence
tcctcagcaatggatagggt

SEQ ID NO: 472289 - DNA, 20 bp, Artificial
  CRISPR gRNA sequence
ctcagcaatggatagggttt

SEQ ID NO: 472290 - DNA, 20 bp, Artificial
  CRISPR gRNA sequence
agcaatggatagggtttcta

SEQ ID NO: 472291 - DNA, 20 bp, Artificial
  CRISPR gRNA sequence
ctatttcttcacatccttgc

SEQ ID NO: 472292 - DNA, 20 bp, Artificial
  CRISPR gRNA sequence
tatttcttcacatccttgct

SEQ ID NO: 472293 - DNA, 20 bp, Artificial
  CRISPR gRNA sequence
tttcttcacatccttgctaa

SEQ ID NO: 472294 - DNA, 20 bp, Artificial
  CRISPR gRNA sequence
cttcacatccttgctaacac

SEQ ID NO: 472295 - DNA, 20 bp, Artificial
  CRISPR gRNA sequence
ttcacatccttgctaacact

SEQ ID NO: 472296 - DNA, 20 bp, Artificial
  CRISPR gRNA sequence
cacatccttgctaacactta

SEQ ID NO: 472297 - DNA, 20 bp, Artificial
  CRISPR gRNA sequence
acatccttgctaacacttat

SEQ ID NO: 472298 - DNA, 20 bp, Artificial
  CRISPR gRNA sequence
gctaacacttattattttct

SEQ ID NO: 472299 - DNA, 20 bp, Artificial
  CRISPR gRNA sequence
ctaacacttattattttctg

SEQ ID NO: 472300 - DNA, 20 bp, Artificial
  CRISPR gRNA sequence
acacttattattttctgtgt

SEQ ID NO: 472301 - DNA, 20 bp, Artificial
  CRISPR gRNA sequence
attattttctgtgttttttt

SEQ ID NO: 472302 - DNA, 20 bp, Artificial
  CRISPR gRNA sequence
ttattttctgtgtttttttt

SEQ ID NO: 472303 - DNA, 20 bp, Artificial
  CRISPR gRNA sequence
ttttctgtgttttttttttt

SEQ ID NO: 472304 - DNA, 20 bp, Artificial
  CRISPR gRNA sequence
tctgtgttttttttttttat

SEQ ID NO: 472305 - DNA, 20 bp, Artificial
  CRISPR gRNA sequence
ctgtgttttttttttttatt

SEQ ID NO: 472306 - DNA, 20 bp, Artificial
  CRISPR gRNA sequence
tgtgttttttttttttattc

SEQ ID NO: 472307 - DNA, 20 bp, Artificial
  CRISPR gRNA sequence
tgttttttttttttattcta

SEQ ID NO: 472308 - DNA, 20 bp, Artificial
  CRISPR gRNA sequence
tttttttttattctagtcat

SEQ ID NO: 472309 - DNA, 20 bp, Artificial
  CRISPR gRNA sequence
ttttttttattctagtcatt

SEQ ID NO: 472310 - DNA, 20 bp, Artificial
  CRISPR gRNA sequence
tttttttattctagtcattc

SEQ ID NO: 472311 - DNA, 20 bp, Artificial
  CRISPR gRNA sequence
ttttttattctagtcattcg

SEQ ID NO: 472312 - DNA, 20 bp, Artificial
  CRISPR gRNA sequence
tttttattctagtcattcga

SEQ ID NO: 472313 - DNA, 20 bp, Artificial
  CRISPR gRNA sequence
ttttattctagtcattcgat

SEQ ID NO: 472314 - DNA, 20 bp, Artificial
  CRISPR gRNA sequence
tttattctagtcattcgatg

SEQ ID NO: 472315 - DNA, 20 bp, Artificial
  CRISPR gRNA sequence
ttattctagtcattcgatgg

SEQ ID NO: 472316 - DNA, 20 bp, Artificial
  CRISPR gRNA sequence
tattctagtcattcgatggg

SEQ ID NO: 472317 - DNA, 20 bp, Artificial
  CRISPR gRNA sequence
attctagtcattcgatgggt

SEQ ID NO: 472318 - DNA, 20 bp, Artificial
  CRISPR gRNA sequence
ttctagtcattcgatgggtg

SEQ ID NO: 472319 - DNA, 20 bp, Artificial
  CRISPR gRNA sequence
tagtcattcgatgggtgtga

SEQ ID NO: 472320 - DNA, 20 bp, Artificial
  CRISPR gRNA sequence
gtcattcgatgggtgtgaag

SEQ ID NO: 472321 - DNA, 20 bp, Artificial
  CRISPR gRNA sequence
gatgggtgtgaagtgggttt

SEQ ID NO: 472322 - DNA, 20 bp, Artificial
  CRISPR gRNA sequence
tcactgtgactttgatttgc

SEQ ID NO: 472323 - DNA, 20 bp, Artificial
  CRISPR gRNA sequence
cactgtgactttgatttgca

SEQ ID NO: 472324 - DNA, 20 bp, Artificial
  CRISPR gRNA sequence
actgtgactttgatttgcat

SEQ ID NO: 472325 - DNA, 20 bp, Artificial
  CRISPR gRNA sequence
tgactttgatttgcatttct

SEQ ID NO: 472326 - DNA, 20 bp, Artificial
  CRISPR gRNA sequence
tgatttgcatttctccagta

SEQ ID NO: 472327 - DNA, 20 bp, Artificial
  CRISPR gRNA sequence
gatttgcatttctccagtaa

SEQ ID NO: 472328 - DNA, 20 bp, Artificial
  CRISPR gRNA sequence
atttgcatttctccagtaac

SEQ ID NO: 472329 - DNA, 20 bp, Artificial
  CRISPR gRNA sequence
gcatttctccagtaactaat

SEQ ID NO: 472330 - DNA, 20 bp, Artificial
  CRISPR gRNA sequence
catttctccagtaactaatg

SEQ ID NO: 472331 - DNA, 20 bp, Artificial
  CRISPR gRNA sequence
ctccagtaactaatgacatt

SEQ ID NO: 472332 - DNA, 20 bp, Artificial
  CRISPR gRNA sequence
tccagtaactaatgacattg

SEQ ID NO: 472333 - DNA, 20 bp, Artificial
  CRISPR gRNA sequence
cagtaactaatgacattgag

SEQ ID NO: 472334 - DNA, 20 bp, Artificial
  CRISPR gRNA sequence
atgacattgagcattttttt

SEQ ID NO: 472335 - DNA, 20 bp, Artificial
  CRISPR gRNA sequence
agcatttttttcatatgttt

SEQ ID NO: 472336 - DNA, 20 bp, Artificial
  CRISPR gRNA sequence
ttttcatatgtttattggcc

SEQ ID NO: 472337 - DNA, 20 bp, Artificial
  CRISPR gRNA sequence
tttcatatgtttattggcca

SEQ ID NO: 472338 - DNA, 20 bp, Artificial
  CRISPR gRNA sequence
ttcatatgtttattggccat

SEQ ID NO: 472339 - DNA, 20 bp, Artificial
  CRISPR gRNA sequence
tcatatgtttattggccatt

SEQ ID NO: 472340 - DNA, 20 bp, Artificial
  CRISPR gRNA sequence
catatgtttattggccattt

SEQ ID NO: 472341 - DNA, 20 bp, Artificial
  CRISPR gRNA sequence
atatgtttattggccatttg

SEQ ID NO: 472342 - DNA, 20 bp, Artificial
  CRISPR gRNA sequence
attggccatttgtatatttt

SEQ ID NO: 472343 - DNA, 20 bp, Artificial
  CRISPR gRNA sequence
ttggccatttgtatattttc

SEQ ID NO: 472344 - DNA, 20 bp, Artificial
  CRISPR gRNA sequence
gccatttgtatattttcttt

SEQ ID NO: 472345 - DNA, 20 bp, Artificial
  CRISPR gRNA sequence
gtatattttctttgatgaaa

SEQ ID NO: 472346 - DNA, 20 bp, Artificial
  CRISPR gRNA sequence
tatattttctttgatgaaat

SEQ ID NO: 472347 - DNA, 20 bp, Artificial
  CRISPR gRNA sequence
tctttgatgaaatgtctatt

SEQ ID NO: 472348 - DNA, 20 bp, Artificial
  CRISPR gRNA sequence
ctttgatgaaatgtctattc

SEQ ID NO: 472349 - DNA, 20 bp, Artificial
  CRISPR gRNA sequence
tttgatgaaatgtctattca

SEQ ID NO: 472350 - DNA, 20 bp, Artificial
  CRISPR gRNA sequence
tgatgaaatgtctattcaag

SEQ ID NO: 472351 - DNA, 20 bp, Artificial
  CRISPR gRNA sequence
gatgaaatgtctattcaagt

SEQ ID NO: 472352 - DNA, 20 bp, Artificial
  CRISPR gRNA sequence
atgaaatgtctattcaagtc

SEQ ID NO: 472353 - DNA, 20 bp, Artificial
  CRISPR gRNA sequence
ttcaagtcctttgctcattt

SEQ ID NO: 472354 - DNA, 20 bp, Artificial
  CRISPR gRNA sequence
aagtcctttgctcattttaa

SEQ ID NO: 472355 - DNA, 20 bp, Artificial
  CRISPR gRNA sequence
tgctcattttaaaattaggt

SEQ ID NO: 472356 - DNA, 20 bp, Artificial
  CRISPR gRNA sequence
gctcattttaaaattaggtt

SEQ ID NO: 472357 - DNA, 20 bp, Artificial
  CRISPR gRNA sequence
ctcattttaaaattaggttg

SEQ ID NO: 472358 - DNA, 20 bp, Artificial
  CRISPR gRNA sequence
attttaaaattaggttgcca

SEQ ID NO: 472359 - DNA, 20 bp, Artificial
  CRISPR gRNA sequence
taaaattaggttgccagtct

SEQ ID NO: 472360 - DNA, 20 bp, Artificial
  CRISPR gRNA sequence
aaaattaggttgccagtcta

SEQ ID NO: 472361 - DNA, 20 bp, Artificial
  CRISPR gRNA sequence
aaattaggttgccagtctat

SEQ ID NO: 472362 - DNA, 20 bp, Artificial
  CRISPR gRNA sequence
ggttgccagtctatttgttg

SEQ ID NO: 472363 - DNA, 20 bp, Artificial
  CRISPR gRNA sequence
ccagtctatttgttgttgaa

SEQ ID NO: 472364 - DNA, 20 bp, Artificial
  CRISPR gRNA sequence
tttgttgttgaattttagta

SEQ ID NO: 472365 - DNA, 20 bp, Artificial
  CRISPR gRNA sequence
gttgttgaattttagtatct

SEQ ID NO: 472366 - DNA, 20 bp, Artificial
  CRISPR gRNA sequence
ttgttgaattttagtatctt

SEQ ID NO: 472367 - DNA, 20 bp, Artificial
  CRISPR gRNA sequence
ttgaattttagtatcttttg

SEQ ID NO: 472368 - DNA, 20 bp, Artificial
  CRISPR gRNA sequence
aattttagtatcttttgatg

SEQ ID NO: 472369 - DNA, 20 bp, Artificial
  CRISPR gRNA sequence
tagtatcttttgatgcacag

SEQ ID NO: 472370 - DNA, 20 bp, Artificial
  CRISPR gRNA sequence
agtatcttttgatgcacaga

SEQ ID NO: 472371 - DNA, 20 bp, Artificial
  CRISPR gRNA sequence
gtatcttttgatgcacagaa

SEQ ID NO: 472372 - DNA, 20 bp, Artificial
  CRISPR gRNA sequence
ttgatgcacagaagtgttta

SEQ ID NO: 472373 - DNA, 20 bp, Artificial
  CRISPR gRNA sequence
tgatgcacagaagtgtttaa

SEQ ID NO: 472374 - DNA, 20 bp, Artificial
  CRISPR gRNA sequence
gatgcacagaagtgtttaat

SEQ ID NO: 472375 - DNA, 20 bp, Artificial
  CRISPR gRNA sequence
atgcacagaagtgtttaatt

SEQ ID NO: 472376 - DNA, 20 bp, Artificial
  CRISPR gRNA sequence
aatttttatgaagtccaatt

SEQ ID NO: 472377 - DNA, 20 bp, Artificial
  CRISPR gRNA sequence
atttttatgaagtccaattt

SEQ ID NO: 472378 - DNA, 20 bp, Artificial
  CRISPR gRNA sequence
ttatgaagtccaatttatct

SEQ ID NO: 472379 - DNA, 20 bp, Artificial
  CRISPR gRNA sequence
tatgaagtccaatttatcta

SEQ ID NO: 472380 - DNA, 20 bp, Artificial
  CRISPR gRNA sequence
atgaagtccaatttatctat

SEQ ID NO: 472381 - DNA, 20 bp, Artificial
  CRISPR gRNA sequence
tgaagtccaatttatctatt

SEQ ID NO: 472382 - DNA, 20 bp, Artificial
  CRISPR gRNA sequence
atctatttttggtgttattg

SEQ ID NO: 472383 - DNA, 20 bp, Artificial
  CRISPR gRNA sequence
tctatttttggtgttattgt

SEQ ID NO: 472384 - DNA, 20 bp, Artificial
  CRISPR gRNA sequence
tttttggtgttattgttgat

SEQ ID NO: 472385 - DNA, 20 bp, Artificial
  CRISPR gRNA sequence
ttggtgttattgttgattat

SEQ ID NO: 472386 - DNA, 20 bp, Artificial
  CRISPR gRNA sequence
tggtgttattgttgattatg

SEQ ID NO: 472387 - DNA, 20 bp, Artificial
  CRISPR gRNA sequence
ggtgttattgttgattatgc

SEQ ID NO: 472388 - DNA, 20 bp, Artificial
  CRISPR gRNA sequence
gtgttattgttgattatgct

SEQ ID NO: 472389 - DNA, 20 bp, Artificial
  CRISPR gRNA sequence
ttgttgattatgcttttgta

SEQ ID NO: 472390 - DNA, 20 bp, Artificial
  CRISPR gRNA sequence
ttgattatgcttttgtaatc

SEQ ID NO: 472391 - DNA, 20 bp, Artificial
  CRISPR gRNA sequence
attatgcttttgtaatcata

SEQ ID NO: 472392 - DNA, 20 bp, Artificial
  CRISPR gRNA sequence
tgcttttgtaatcatagcta

SEQ ID NO: 472393 - DNA, 20 bp, Artificial
  CRISPR gRNA sequence
ttgtaatcatagctaagaaa

SEQ ID NO: 472394 - DNA, 20 bp, Artificial
  CRISPR gRNA sequence
tgtaatcatagctaagaaaa

SEQ ID NO: 472395 - DNA, 20 bp, Artificial
  CRISPR gRNA sequence
gtaatcatagctaagaaaac

SEQ ID NO: 472396 - DNA, 20 bp, Artificial
  CRISPR gRNA sequence
taatcatagctaagaaaaca

SEQ ID NO: 472397 - DNA, 20 bp, Artificial
  CRISPR gRNA sequence
agaaaacactgctaaatcca

SEQ ID NO: 472398 - DNA, 20 bp, Artificial
  CRISPR gRNA sequence
ctaaatccaagatcagaaac

SEQ ID NO: 472399 - DNA, 20 bp, Artificial
  CRISPR gRNA sequence
aatccaagatcagaaacatt

SEQ ID NO: 472400 - DNA, 20 bp, Artificial
  CRISPR gRNA sequence
atccctatgttttctcctaa

SEQ ID NO: 472401 - DNA, 20 bp, Artificial
  CRISPR gRNA sequence
tccctatgttttctcctaag

SEQ ID NO: 472402 - DNA, 20 bp, Artificial
  CRISPR gRNA sequence
tgttttctcctaagaaatca

SEQ ID NO: 472403 - DNA, 20 bp, Artificial
  CRISPR gRNA sequence
tctcctaagaaatcagagtt

SEQ ID NO: 472404 - DNA, 20 bp, Artificial
  CRISPR gRNA sequence
ctcctaagaaatcagagttt

SEQ ID NO: 472405 - DNA, 20 bp, Artificial
  CRISPR gRNA sequence
tcctaagaaatcagagtttt

SEQ ID NO: 472406 - DNA, 20 bp, Artificial
  CRISPR gRNA sequence
ctaagaaatcagagttttat

SEQ ID NO: 472407 - DNA, 20 bp, Artificial
  CRISPR gRNA sequence
agaaatcagagttttattgt

SEQ ID NO: 472408 - DNA, 20 bp, Artificial
  CRISPR gRNA sequence
tattgttttatataatgcag

SEQ ID NO: 472409 - DNA, 20 bp, Artificial
  CRISPR gRNA sequence
attgttttatataatgcagt

SEQ ID NO: 472410 - DNA, 20 bp, Artificial
  CRISPR gRNA sequence
ttgttttatataatgcagtt

SEQ ID NO: 472411 - DNA, 20 bp, Artificial
  CRISPR gRNA sequence
ttttatataatgcagttttt

SEQ ID NO: 472412 - DNA, 20 bp, Artificial
  CRISPR gRNA sequence
tatataatgcagtttttata

SEQ ID NO: 472413 - DNA, 20 bp, Artificial
  CRISPR gRNA sequence
atataatgcagtttttatag

SEQ ID NO: 472414 - DNA, 20 bp, Artificial
  CRISPR gRNA sequence
tataatgcagtttttatagt

SEQ ID NO: 472415 - DNA, 20 bp, Artificial
  CRISPR gRNA sequence
ttatagttttagctcttcta

SEQ ID NO: 472416 - DNA, 20 bp, Artificial
  CRISPR gRNA sequence
tatagttttagctcttctac

SEQ ID NO: 472417 - DNA, 20 bp, Artificial
  CRISPR gRNA sequence
atagttttagctcttctact

SEQ ID NO: 472418 - DNA, 20 bp, Artificial
  CRISPR gRNA sequence
tagttttagctcttctactt

SEQ ID NO: 472419 - DNA, 20 bp, Artificial
  CRISPR gRNA sequence
tagctcttctacttaaatgt

SEQ ID NO: 472420 - DNA, 20 bp, Artificial
  CRISPR gRNA sequence
agctcttctacttaaatgtc

SEQ ID NO: 472421 - DNA, 20 bp, Artificial
  CRISPR gRNA sequence
gctcttctacttaaatgtct

SEQ ID NO: 472422 - DNA, 20 bp, Artificial
  CRISPR gRNA sequence
ttctacttaaatgtctgact

SEQ ID NO: 472423 - DNA, 20 bp, Artificial
  CRISPR gRNA sequence
ctacttaaatgtctgactta

SEQ ID NO: 472424 - DNA, 20 bp, Artificial
  CRISPR gRNA sequence
tacttaaatgtctgacttat

SEQ ID NO: 472425 - DNA, 20 bp, Artificial
  CRISPR gRNA sequence
cttaaatgtctgacttattt

SEQ ID NO: 472426 - DNA, 20 bp, Artificial
  CRISPR gRNA sequence
aaatgtctgacttattttga

SEQ ID NO: 472427 - DNA, 20 bp, Artificial
  CRISPR gRNA sequence
aatgtctgacttattttgat

SEQ ID NO: 472428 - DNA, 20 bp, Artificial
  CRISPR gRNA sequence
acttattttgattgcttaaa

SEQ ID NO: 472429 - DNA, 20 bp, Artificial
  CRISPR gRNA sequence
attttgattgcttaaaatat

SEQ ID NO: 472430 - DNA, 20 bp, Artificial
  CRISPR gRNA sequence
ttttgattgcttaaaatatg

SEQ ID NO: 472431 - DNA, 20 bp, Artificial
  CRISPR gRNA sequence
tgattgcttaaaatatggag

SEQ ID NO: 472432 - DNA, 20 bp, Artificial
  CRISPR gRNA sequence
gattgcttaaaatatggagt

SEQ ID NO: 472433 - DNA, 20 bp, Artificial
  CRISPR gRNA sequence
attgcttaaaatatggagtg

SEQ ID NO: 472434 - DNA, 20 bp, Artificial
  CRISPR gRNA sequence
cttaaaatatggagtgagat

SEQ ID NO: 472435 - DNA, 20 bp, Artificial
  CRISPR gRNA sequence
aaaatatggagtgagatgag

SEQ ID NO: 472436 - DNA, 20 bp, Artificial
  CRISPR gRNA sequence
aaatatggagtgagatgagg

SEQ ID NO: 472437 - DNA, 20 bp, Artificial
  CRISPR gRNA sequence
aaattaattcttttacatat

SEQ ID NO: 472438 - DNA, 20 bp, Artificial
  CRISPR gRNA sequence
attcttttacatatgaatat

SEQ ID NO: 472439 - DNA, 20 bp, Artificial
  CRISPR gRNA sequence
ttttacatatgaatatccaa

SEQ ID NO: 472440 - DNA, 20 bp, Artificial
  CRISPR gRNA sequence
ttacatatgaatatccaatt

SEQ ID NO: 472441 - DNA, 20 bp, Artificial
  CRISPR gRNA sequence
tacatatgaatatccaatta

SEQ ID NO: 472442 - DNA, 20 bp, Artificial
  CRISPR gRNA sequence
acatatgaatatccaattat

SEQ ID NO: 472443 - DNA, 20 bp, Artificial
  CRISPR gRNA sequence
catatgaatatccaattatc

SEQ ID NO: 472444 - DNA, 20 bp, Artificial
  CRISPR gRNA sequence
tcctggcaccatttattgag

SEQ ID NO: 472445 - DNA, 20 bp, Artificial
  CRISPR gRNA sequence
gcaccatttattgagactat

SEQ ID NO: 472446 - DNA, 20 bp, Artificial
  CRISPR gRNA sequence
attgagactattctttcccc

SEQ ID NO: 472447 - DNA, 20 bp, Artificial
  CRISPR gRNA sequence
ttgagactattctttcccca

SEQ ID NO: 472448 - DNA, 20 bp, Artificial
  CRISPR gRNA sequence
agactattctttccccactg

SEQ ID NO: 472449 - DNA, 20 bp, Artificial
  CRISPR gRNA sequence
ttctttccccactgaataat

SEQ ID NO: 472450 - DNA, 20 bp, Artificial
  CRISPR gRNA sequence
tttccccactgaataatctt

SEQ ID NO: 472451 - DNA, 20 bp, Artificial
  CRISPR gRNA sequence
tccccactgaataatcttgg

SEQ ID NO: 472452 - DNA, 20 bp, Artificial
  CRISPR gRNA sequence
ccccactgaataatcttggt

SEQ ID NO: 472453 - DNA, 20 bp, Artificial
  CRISPR gRNA sequence
cccactgaataatcttggta

SEQ ID NO: 472454 - DNA, 20 bp, Artificial
  CRISPR gRNA sequence
aataatcttggtacccttat

SEQ ID NO: 472455 - DNA, 20 bp, Artificial
  CRISPR gRNA sequence
ggtacccttatcaaaaatca

SEQ ID NO: 472456 - DNA, 20 bp, Artificial
  CRISPR gRNA sequence
gtacccttatcaaaaatcaa

SEQ ID NO: 472457 - DNA, 20 bp, Artificial
  CRISPR gRNA sequence
atcaaaaatcaattgactac

SEQ ID NO: 472458 - DNA, 20 bp, Artificial
  CRISPR gRNA sequence
tcaaaaatcaattgactacg

SEQ ID NO: 472459 - DNA, 20 bp, Artificial
  CRISPR gRNA sequence
actacggatgtatggagttt

SEQ ID NO: 472460 - DNA, 20 bp, Artificial
  CRISPR gRNA sequence
cggatgtatggagtttattc

SEQ ID NO: 472461 - DNA, 20 bp, Artificial
  CRISPR gRNA sequence
attctggactctcaattcta

SEQ ID NO: 472462 - DNA, 20 bp, Artificial
  CRISPR gRNA sequence
ttctggactctcaattctat

SEQ ID NO: 472463 - DNA, 20 bp, Artificial
  CRISPR gRNA sequence
tggactctcaattctattta

SEQ ID NO: 472464 - DNA, 20 bp, Artificial
  CRISPR gRNA sequence
gactctcaattctatttaca

SEQ ID NO: 472465 - DNA, 20 bp, Artificial
  CRISPR gRNA sequence
tcaattctatttacattgat

SEQ ID NO: 472466 - DNA, 20 bp, Artificial
  CRISPR gRNA sequence
aattctatttacattgatct

SEQ ID NO: 472467 - DNA, 20 bp, Artificial
  CRISPR gRNA sequence
tatttacattgatctctttg

SEQ ID NO: 472468 - DNA, 20 bp, Artificial
  CRISPR gRNA sequence
tttacattgatctctttgtc

SEQ ID NO: 472469 - DNA, 20 bp, Artificial
  CRISPR gRNA sequence
acattgatctctttgtctat

SEQ ID NO: 472470 - DNA, 20 bp, Artificial
  CRISPR gRNA sequence
cattgatctctttgtctatc

SEQ ID NO: 472471 - DNA, 20 bp, Artificial
  CRISPR gRNA sequence
atctctttgtctatccatga

SEQ ID NO: 472472 - DNA, 20 bp, Artificial
  CRISPR gRNA sequence
tttgtctatccatgacaata

SEQ ID NO: 472473 - DNA, 20 bp, Artificial
  CRISPR gRNA sequence
tgtctatccatgacaatact

SEQ ID NO: 472474 - DNA, 20 bp, Artificial
  CRISPR gRNA sequence
gtctatccatgacaatacta

SEQ ID NO: 472475 - DNA, 20 bp, Artificial
  CRISPR gRNA sequence
tctatccatgacaatactat

SEQ ID NO: 472476 - DNA, 20 bp, Artificial
  CRISPR gRNA sequence
tccatgacaatactattctt

SEQ ID NO: 472477 - DNA, 20 bp, Artificial
  CRISPR gRNA sequence
ttctttttttttttttttaa

SEQ ID NO: 472478 - DNA, 20 bp, Artificial
  CRISPR gRNA sequence
tttttttttttttttaactg

SEQ ID NO: 472479 - DNA, 20 bp, Artificial
  CRISPR gRNA sequence
tttttttttttttaactgtc

SEQ ID NO: 472480 - DNA, 20 bp, Artificial
  CRISPR gRNA sequence
ttttttttttttaactgtca

SEQ ID NO: 472481 - DNA, 20 bp, Artificial
  CRISPR gRNA sequence
tttttttttttaactgtcat

SEQ ID NO: 472482 - DNA, 20 bp, Artificial
  CRISPR gRNA sequence
ttttttttttaactgtcatt

SEQ ID NO: 472483 - DNA, 20 bp, Artificial
  CRISPR gRNA sequence
tttttttttaactgtcattt

SEQ ID NO: 472484 - DNA, 20 bp, Artificial
  CRISPR gRNA sequence
ttttttttaactgtcatttt

SEQ ID NO: 472485 - DNA, 20 bp, Artificial
  CRISPR gRNA sequence
tttttttaactgtcattttg

SEQ ID NO: 472486 - DNA, 20 bp, Artificial
  CRISPR gRNA sequence
ttttttaactgtcattttgt

SEQ ID NO: 472487 - DNA, 20 bp, Artificial
  CRISPR gRNA sequence
tttttaactgtcattttgta

SEQ ID NO: 472488 - DNA, 20 bp, Artificial
  CRISPR gRNA sequence
ttttaactgtcattttgtag

SEQ ID NO: 472489 - DNA, 20 bp, Artificial
  CRISPR gRNA sequence
tttaactgtcattttgtagt

SEQ ID NO: 472490 - DNA, 20 bp, Artificial
  CRISPR gRNA sequence
ttaactgtcattttgtagta

SEQ ID NO: 472491 - DNA, 20 bp, Artificial
  CRISPR gRNA sequence
taactgtcattttgtagtaa

SEQ ID NO: 472492 - DNA, 20 bp, Artificial
  CRISPR gRNA sequence
aactgtcattttgtagtaag

SEQ ID NO: 472493 - DNA, 20 bp, Artificial
  CRISPR gRNA sequence
actgtcattttgtagtaagt

SEQ ID NO: 472494 - DNA, 20 bp, Artificial
  CRISPR gRNA sequence
tcattttgtagtaagttttg

SEQ ID NO: 472495 - DNA, 20 bp, Artificial
  CRISPR gRNA sequence
tgtagtaagttttgaaatag

SEQ ID NO: 472496 - DNA, 20 bp, Artificial
  CRISPR gRNA sequence
gtagtaagttttgaaatagg

SEQ ID NO: 472497 - DNA, 20 bp, Artificial
  CRISPR gRNA sequence
tagtaagttttgaaataggg

SEQ ID NO: 472498 - DNA, 20 bp, Artificial
  CRISPR gRNA sequence
tgaaatagggaagtcttagc

SEQ ID NO: 472499 - DNA, 20 bp, Artificial
  CRISPR gRNA sequence
gaaatagggaagtcttagct

SEQ ID NO: 472500 - DNA, 20 bp, Artificial
  CRISPR gRNA sequence
aaatagggaagtcttagctt

SEQ ID NO: 472501 - DNA, 20 bp, Artificial
  CRISPR gRNA sequence
agcttcagttttgttctttt

SEQ ID NO: 472502 - DNA, 20 bp, Artificial
  CRISPR gRNA sequence
gcttcagttttgttcttttt

SEQ ID NO: 472503 - DNA, 20 bp, Artificial
  CRISPR gRNA sequence
cagttttgttctttttcaag

SEQ ID NO: 472504 - DNA, 20 bp, Artificial
  CRISPR gRNA sequence
agttttgttctttttcaaga

SEQ ID NO: 472505 - DNA, 20 bp, Artificial
  CRISPR gRNA sequence
tgttctttttcaagattgtt

SEQ ID NO: 472506 - DNA, 20 bp, Artificial
  CRISPR gRNA sequence
gttctttttcaagattgttt

SEQ ID NO: 472507 - DNA, 20 bp, Artificial
  CRISPR gRNA sequence
ttctttttcaagattgtttt

SEQ ID NO: 472508 - DNA, 20 bp, Artificial
  CRISPR gRNA sequence
tttttcaagattgttttggc

SEQ ID NO: 472509 - DNA, 20 bp, Artificial
  CRISPR gRNA sequence
tttcaagattgttttggcaa

SEQ ID NO: 472510 - DNA, 20 bp, Artificial
  CRISPR gRNA sequence
ttcaagattgttttggcaat

SEQ ID NO: 472511 - DNA, 20 bp, Artificial
  CRISPR gRNA sequence
tcaagattgttttggcaatt

SEQ ID NO: 472512 - DNA, 20 bp, Artificial
  CRISPR gRNA sequence
caagattgttttggcaattc

SEQ ID NO: 472513 - DNA, 20 bp, Artificial
  CRISPR gRNA sequence
aagattgttttggcaattct

SEQ ID NO: 472514 - DNA, 20 bp, Artificial
  CRISPR gRNA sequence
ttttggcaattctgggtctg

SEQ ID NO: 472515 - DNA, 20 bp, Artificial
  CRISPR gRNA sequence
tggcaattctgggtctgttg

SEQ ID NO: 472516 - DNA, 20 bp, Artificial
  CRISPR gRNA sequence
ggcaattctgggtctgttgc

SEQ ID NO: 472517 - DNA, 20 bp, Artificial
  CRISPR gRNA sequence
gcaattctgggtctgttgca

SEQ ID NO: 472518 - DNA, 20 bp, Artificial
  CRISPR gRNA sequence
tgggtctgttgcaactcaat

SEQ ID NO: 472519 - DNA, 20 bp, Artificial
  CRISPR gRNA sequence
ggtctgttgcaactcaatgt

SEQ ID NO: 472520 - DNA, 20 bp, Artificial
  CRISPR gRNA sequence
ttgcaactcaatgtgaattt

SEQ ID NO: 472521 - DNA, 20 bp, Artificial
  CRISPR gRNA sequence
caactcaatgtgaattttag

SEQ ID NO: 472522 - DNA, 20 bp, Artificial
  CRISPR gRNA sequence
aatgtgaattttaggatcag

SEQ ID NO: 472523 - DNA, 20 bp, Artificial
  CRISPR gRNA sequence
taggatcagcttttttattt

SEQ ID NO: 472524 - DNA, 20 bp, Artificial
  CRISPR gRNA sequence
aggatcagcttttttatttc

SEQ ID NO: 472525 - DNA, 20 bp, Artificial
  CRISPR gRNA sequence
ggatcagcttttttatttct

SEQ ID NO: 472526 - DNA, 20 bp, Artificial
  CRISPR gRNA sequence
ttttatttctgcaatagcaa

SEQ ID NO: 472527 - DNA, 20 bp, Artificial
  CRISPR gRNA sequence
tttatttctgcaatagcaac

SEQ ID NO: 472528 - DNA, 20 bp, Artificial
  CRISPR gRNA sequence
ttatttctgcaatagcaaca

SEQ ID NO: 472529 - DNA, 20 bp, Artificial
  CRISPR gRNA sequence
tatttctgcaatagcaacaa

SEQ ID NO: 472530 - DNA, 20 bp, Artificial
  CRISPR gRNA sequence
atttctgcaatagcaacaaa

SEQ ID NO: 472531 - DNA, 20 bp, Artificial
  CRISPR gRNA sequence
tttctgcaatagcaacaaaa

SEQ ID NO: 472532 - DNA, 20 bp, Artificial
  CRISPR gRNA sequence
ctgcaatagcaacaaaaagc

SEQ ID NO: 472533 - DNA, 20 bp, Artificial
  CRISPR gRNA sequence
tgcaatagcaacaaaaagct

SEQ ID NO: 472534 - DNA, 20 bp, Artificial
  CRISPR gRNA sequence
caatagcaacaaaaagctgt

SEQ ID NO: 472535 - DNA, 20 bp, Artificial
  CRISPR gRNA sequence
ttaggattttagtggaactg

SEQ ID NO: 472536 - DNA, 20 bp, Artificial
  CRISPR gRNA sequence
ggattttagtggaactgcat

SEQ ID NO: 472537 - DNA, 20 bp, Artificial
  CRISPR gRNA sequence
tagtggaactgcattgaatc

SEQ ID NO: 472538 - DNA, 20 bp, Artificial
  CRISPR gRNA sequence
agtggaactgcattgaatct

SEQ ID NO: 472539 - DNA, 20 bp, Artificial
  CRISPR gRNA sequence
gtggaactgcattgaatctg

SEQ ID NO: 472540 - DNA, 20 bp, Artificial
  CRISPR gRNA sequence
cattgaatctgtagatcacc

SEQ ID NO: 472541 - DNA, 20 bp, Artificial
  CRISPR gRNA sequence
aatctgtagatcaccttggg

SEQ ID NO: 472542 - DNA, 20 bp, Artificial
  CRISPR gRNA sequence
tagatcaccttggggaatat

SEQ ID NO: 472543 - DNA, 20 bp, Artificial
  CRISPR gRNA sequence
ggggaatattgctatcttta

SEQ ID NO: 472544 - DNA, 20 bp, Artificial
  CRISPR gRNA sequence
gggaatattgctatctttac

SEQ ID NO: 472545 - DNA, 20 bp, Artificial
  CRISPR gRNA sequence
ctatctttacaatattacat

SEQ ID NO: 472546 - DNA, 20 bp, Artificial
  CRISPR gRNA sequence
tctttacaatattacatctt

SEQ ID NO: 472547 - DNA, 20 bp, Artificial
  CRISPR gRNA sequence
tacaatattacatctttcag

SEQ ID NO: 472548 - DNA, 20 bp, Artificial
  CRISPR gRNA sequence
acaatattacatctttcagt

SEQ ID NO: 472549 - DNA, 20 bp, Artificial
  CRISPR gRNA sequence
caatattacatctttcagtc

SEQ ID NO: 472550 - DNA, 20 bp, Artificial
  CRISPR gRNA sequence
catctttcagtccatgaata

SEQ ID NO: 472551 - DNA, 20 bp, Artificial
  CRISPR gRNA sequence
tcagtccatgaatacagaat

SEQ ID NO: 472552 - DNA, 20 bp, Artificial
  CRISPR gRNA sequence
cagtccatgaatacagaatg

SEQ ID NO: 472553 - DNA, 20 bp, Artificial
  CRISPR gRNA sequence
agtccatgaatacagaatgt

SEQ ID NO: 472554 - DNA, 20 bp, Artificial
  CRISPR gRNA sequence
tgcatttatttacatattct

SEQ ID NO: 472555 - DNA, 20 bp, Artificial
  CRISPR gRNA sequence
gcatttatttacatattctt

SEQ ID NO: 472556 - DNA, 20 bp, Artificial
  CRISPR gRNA sequence
catttatttacatattcttg

SEQ ID NO: 472557 - DNA, 20 bp, Artificial
  CRISPR gRNA sequence
atttacatattcttgaattt

SEQ ID NO: 472558 - DNA, 20 bp, Artificial
  CRISPR gRNA sequence
tttacatattcttgaatttc

SEQ ID NO: 472559 - DNA, 20 bp, Artificial
  CRISPR gRNA sequence
acatattcttgaatttcttt

SEQ ID NO: 472560 - DNA, 20 bp, Artificial
  CRISPR gRNA sequence
catattcttgaatttctttc

SEQ ID NO: 472561 - DNA, 20 bp, Artificial
  CRISPR gRNA sequence
ttgaatttctttcagccatg

SEQ ID NO: 472562 - DNA, 20 bp, Artificial
  CRISPR gRNA sequence
gaatttctttcagccatgct

SEQ ID NO: 472563 - DNA, 20 bp, Artificial
  CRISPR gRNA sequence
aatttctttcagccatgctt

SEQ ID NO: 472564 - DNA, 20 bp, Artificial
  CRISPR gRNA sequence
ctttcagccatgctttcttt

SEQ ID NO: 472565 - DNA, 20 bp, Artificial
  CRISPR gRNA sequence
tttcagccatgctttctttg

SEQ ID NO: 472566 - DNA, 20 bp, Artificial
  CRISPR gRNA sequence
tcagccatgctttctttgtt

SEQ ID NO: 472567 - DNA, 20 bp, Artificial
  CRISPR gRNA sequence
cagccatgctttctttgttc

SEQ ID NO: 472568 - DNA, 20 bp, Artificial
  CRISPR gRNA sequence
agccatgctttctttgttca

SEQ ID NO: 472569 - DNA, 20 bp, Artificial
  CRISPR gRNA sequence
tctttgttcagtgtacaact

SEQ ID NO: 472570 - DNA, 20 bp, Artificial
  CRISPR gRNA sequence
ctttgttcagtgtacaactc

SEQ ID NO: 472571 - DNA, 20 bp, Artificial
  CRISPR gRNA sequence
tttgttcagtgtacaactct

SEQ ID NO: 472572 - DNA, 20 bp, Artificial
  CRISPR gRNA sequence
tgttcagtgtacaactctta

SEQ ID NO: 472573 - DNA, 20 bp, Artificial
  CRISPR gRNA sequence
gttcagtgtacaactcttat

SEQ ID NO: 472574 - DNA, 20 bp, Artificial
  CRISPR gRNA sequence
ttcagtgtacaactcttata

SEQ ID NO: 472575 - DNA, 20 bp, Artificial
  CRISPR gRNA sequence
agtgtacaactcttatacct

SEQ ID NO: 472576 - DNA, 20 bp, Artificial
  CRISPR gRNA sequence
ttatacctctttggttaaat

SEQ ID NO: 472577 - DNA, 20 bp, Artificial
  CRISPR gRNA sequence
atacctctttggttaaattt

SEQ ID NO: 472578 - DNA, 20 bp, Artificial
  CRISPR gRNA sequence
tacctctttggttaaatttg

SEQ ID NO: 472579 - DNA, 20 bp, Artificial
  CRISPR gRNA sequence
tttggttaaatttgtactta

SEQ ID NO: 472580 - DNA, 20 bp, Artificial
  CRISPR gRNA sequence
tggttaaatttgtacttaaa

SEQ ID NO: 472581 - DNA, 20 bp, Artificial
  CRISPR gRNA sequence
ggttaaatttgtacttaaat

SEQ ID NO: 472582 - DNA, 20 bp, Artificial
  CRISPR gRNA sequence
gttaaatttgtacttaaata

SEQ ID NO: 472583 - DNA, 20 bp, Artificial
  CRISPR gRNA sequence
aatttgtacttaaatatttt

SEQ ID NO: 472584 - DNA, 20 bp, Artificial
  CRISPR gRNA sequence
gtacttaaatattttattca

SEQ ID NO: 472585 - DNA, 20 bp, Artificial
  CRISPR gRNA sequence
tacttaaatattttattcat

SEQ ID NO: 472586 - DNA, 20 bp, Artificial
  CRISPR gRNA sequence
aaatattttattcattttga

SEQ ID NO: 472587 - DNA, 20 bp, Artificial
  CRISPR gRNA sequence
aatattttattcattttgat

SEQ ID NO: 472588 - DNA, 20 bp, Artificial
  CRISPR gRNA sequence
tattcattttgatgctattg

SEQ ID NO: 472589 - DNA, 20 bp, Artificial
  CRISPR gRNA sequence
attcattttgatgctattgt

SEQ ID NO: 472590 - DNA, 20 bp, Artificial
  CRISPR gRNA sequence
ttcattttgatgctattgta

SEQ ID NO: 472591 - DNA, 20 bp, Artificial
  CRISPR gRNA sequence
attttgatgctattgtaaat

SEQ ID NO: 472592 - DNA, 20 bp, Artificial
  CRISPR gRNA sequence
tgatgctattgtaaatggaa

SEQ ID NO: 472593 - DNA, 20 bp, Artificial
  CRISPR gRNA sequence
gatgctattgtaaatggaac

SEQ ID NO: 472594 - DNA, 20 bp, Artificial
  CRISPR gRNA sequence
atgctattgtaaatggaact

SEQ ID NO: 472595 - DNA, 20 bp, Artificial
  CRISPR gRNA sequence
ttgtaaatggaactgtttcc

SEQ ID NO: 472596 - DNA, 20 bp, Artificial
  CRISPR gRNA sequence
taaatggaactgtttcctta

SEQ ID NO: 472597 - DNA, 20 bp, Artificial
  CRISPR gRNA sequence
tttccttaattttctttgtg

SEQ ID NO: 472598 - DNA, 20 bp, Artificial
  CRISPR gRNA sequence
ccttaattttctttgtggat

SEQ ID NO: 472599 - DNA, 20 bp, Artificial
  CRISPR gRNA sequence
cttaattttctttgtggatt

SEQ ID NO: 472600 - DNA, 20 bp, Artificial
  CRISPR gRNA sequence
aattttctttgtggattgtt

SEQ ID NO: 472601 - DNA, 20 bp, Artificial
  CRISPR gRNA sequence
attttctttgtggattgttt

SEQ ID NO: 472602 - DNA, 20 bp, Artificial
  CRISPR gRNA sequence
tctttgtggattgtttattg

SEQ ID NO: 472603 - DNA, 20 bp, Artificial
  CRISPR gRNA sequence
ctttgtggattgtttattgc

SEQ ID NO: 472604 - DNA, 20 bp, Artificial
  CRISPR gRNA sequence
tttgtggattgtttattgct

SEQ ID NO: 472605 - DNA, 20 bp, Artificial
  CRISPR gRNA sequence
tgtggattgtttattgctag

SEQ ID NO: 472606 - DNA, 20 bp, Artificial
  CRISPR gRNA sequence
gtggattgtttattgctagt

SEQ ID NO: 472607 - DNA, 20 bp, Artificial
  CRISPR gRNA sequence
tggattgtttattgctagtg

SEQ ID NO: 472608 - DNA, 20 bp, Artificial
  CRISPR gRNA sequence
tttattgctagtgtatagaa

SEQ ID NO: 472609 - DNA, 20 bp, Artificial
  CRISPR gRNA sequence
attgctagtgtatagaaata

SEQ ID NO: 472610 - DNA, 20 bp, Artificial
  CRISPR gRNA sequence
ttgctagtgtatagaaatat

SEQ ID NO: 472611 - DNA, 20 bp, Artificial
  CRISPR gRNA sequence
ctagtgtatagaaatatcac

SEQ ID NO: 472612 - DNA, 20 bp, Artificial
  CRISPR gRNA sequence
gtgtatagaaatatcactga

SEQ ID NO: 472613 - DNA, 20 bp, Artificial
  CRISPR gRNA sequence
atttttgtgtgttgatcctg

SEQ ID NO: 472614 - DNA, 20 bp, Artificial
  CRISPR gRNA sequence
ttgtgtgttgatcctgtatc

SEQ ID NO: 472615 - DNA, 20 bp, Artificial
  CRISPR gRNA sequence
tgtgtgttgatcctgtatca

SEQ ID NO: 472616 - DNA, 20 bp, Artificial
  CRISPR gRNA sequence
gtgtgttgatcctgtatcat

SEQ ID NO: 472617 - DNA, 20 bp, Artificial
  CRISPR gRNA sequence
tgtgttgatcctgtatcatg

SEQ ID NO: 472618 - DNA, 20 bp, Artificial
  CRISPR gRNA sequence
atcctgtatcatgtggaatt

SEQ ID NO: 472619 - DNA, 20 bp, Artificial
  CRISPR gRNA sequence
tatcatgtggaattgctaaa

SEQ ID NO: 472620 - DNA, 20 bp, Artificial
  CRISPR gRNA sequence
ctaaattcatgtattagctt

SEQ ID NO: 472621 - DNA, 20 bp, Artificial
  CRISPR gRNA sequence
aattcatgtattagctttaa

SEQ ID NO: 472622 - DNA, 20 bp, Artificial
  CRISPR gRNA sequence
atgtattagctttaatagtt

SEQ ID NO: 472623 - DNA, 20 bp, Artificial
  CRISPR gRNA sequence
gctttaatagttttaaacaa

SEQ ID NO: 472624 - DNA, 20 bp, Artificial
  CRISPR gRNA sequence
taatagttttaaacaaattt

SEQ ID NO: 472625 - DNA, 20 bp, Artificial
  CRISPR gRNA sequence
aatagttttaaacaaatttt

SEQ ID NO: 472626 - DNA, 20 bp, Artificial
  CRISPR gRNA sequence
atagttttaaacaaattttt

SEQ ID NO: 472627 - DNA, 20 bp, Artificial
  CRISPR gRNA sequence
taaacaaatttttaagaatt

SEQ ID NO: 472628 - DNA, 20 bp, Artificial
  CRISPR gRNA sequence
aaacaaatttttaagaattt

SEQ ID NO: 472629 - DNA, 20 bp, Artificial
  CRISPR gRNA sequence
aacaaatttttaagaatttt

SEQ ID NO: 472630 - DNA, 20 bp, Artificial
  CRISPR gRNA sequence
ttaagaatttttctacacat

SEQ ID NO: 472631 - DNA, 20 bp, Artificial
  CRISPR gRNA sequence
taagaatttttctacacata

SEQ ID NO: 472632 - DNA, 20 bp, Artificial
  CRISPR gRNA sequence
aagaatttttctacacataa

SEQ ID NO: 472633 - DNA, 20 bp, Artificial
  CRISPR gRNA sequence
agaatttttctacacataag

SEQ ID NO: 472634 - DNA, 20 bp, Artificial
  CRISPR gRNA sequence
ttctacacataagttcatgc

SEQ ID NO: 472635 - DNA, 20 bp, Artificial
  CRISPR gRNA sequence
tctacacataagttcatgcc

SEQ ID NO: 472636 - DNA, 20 bp, Artificial
  CRISPR gRNA sequence
ctacacataagttcatgcca

SEQ ID NO: 472637 - DNA, 20 bp, Artificial
  CRISPR gRNA sequence
tacacataagttcatgccat

SEQ ID NO: 472638 - DNA, 20 bp, Artificial
  CRISPR gRNA sequence
cacataagttcatgccatct

SEQ ID NO: 472639 - DNA, 20 bp, Artificial
  CRISPR gRNA sequence
atgccatctgtgaataaagt

SEQ ID NO: 472640 - DNA, 20 bp, Artificial
  CRISPR gRNA sequence
tgaataaagttttacttctt

SEQ ID NO: 472641 - DNA, 20 bp, Artificial
  CRISPR gRNA sequence
tacttctttttttctaagtt

SEQ ID NO: 472642 - DNA, 20 bp, Artificial
  CRISPR gRNA sequence
acttctttttttctaagtta

SEQ ID NO: 472643 - DNA, 20 bp, Artificial
  CRISPR gRNA sequence
cttctttttttctaagttag

SEQ ID NO: 472644 - DNA, 20 bp, Artificial
  CRISPR gRNA sequence
ctttttttctaagttagata

SEQ ID NO: 472645 - DNA, 20 bp, Artificial
  CRISPR gRNA sequence
tttttttctaagttagatat

SEQ ID NO: 472646 - DNA, 20 bp, Artificial
  CRISPR gRNA sequence
tttttctaagttagatatct

SEQ ID NO: 472647 - DNA, 20 bp, Artificial
  CRISPR gRNA sequence
ttttctaagttagatatctt

SEQ ID NO: 472648 - DNA, 20 bp, Artificial
  CRISPR gRNA sequence
tttctaagttagatatcttt

SEQ ID NO: 472649 - DNA, 20 bp, Artificial
  CRISPR gRNA sequence
ttctaagttagatatctttt

SEQ ID NO: 472650 - DNA, 20 bp, Artificial
  CRISPR gRNA sequence
tctaagttagatatctttta

SEQ ID NO: 472651 - DNA, 20 bp, Artificial
  CRISPR gRNA sequence
ctaagttagatatcttttat

SEQ ID NO: 472652 - DNA, 20 bp, Artificial
  CRISPR gRNA sequence
taagttagatatcttttatt

SEQ ID NO: 472653 - DNA, 20 bp, Artificial
  CRISPR gRNA sequence
agttagatatcttttatttc

SEQ ID NO: 472654 - DNA, 20 bp, Artificial
  CRISPR gRNA sequence
gatatcttttatttcttgtt

SEQ ID NO: 472655 - DNA, 20 bp, Artificial
  CRISPR gRNA sequence
ttatttcttgttcttgcctg

SEQ ID NO: 472656 - DNA, 20 bp, Artificial
  CRISPR gRNA sequence
tatttcttgttcttgcctgt

SEQ ID NO: 472657 - DNA, 20 bp, Artificial
  CRISPR gRNA sequence
atttcttgttcttgcctgtt

SEQ ID NO: 472658 - DNA, 20 bp, Artificial
  CRISPR gRNA sequence
tttcttgttcttgcctgttt

SEQ ID NO: 472659 - DNA, 20 bp, Artificial
  CRISPR gRNA sequence
cttgttcttgcctgtttgct

SEQ ID NO: 472660 - DNA, 20 bp, Artificial
  CRISPR gRNA sequence
ttgttcttgcctgtttgctc

SEQ ID NO: 472661 - DNA, 20 bp, Artificial
  CRISPR gRNA sequence
gttcttgcctgtttgctctg

SEQ ID NO: 472662 - DNA, 20 bp, Artificial
  CRISPR gRNA sequence
ttcttgcctgtttgctctgg

SEQ ID NO: 472663 - DNA, 20 bp, Artificial
  CRISPR gRNA sequence
ttgcctgtttgctctggcta

SEQ ID NO: 472664 - DNA, 20 bp, Artificial
  CRISPR gRNA sequence
gcctgtttgctctggctaga

SEQ ID NO: 472665 - DNA, 20 bp, Artificial
  CRISPR gRNA sequence
cctgtttgctctggctagaa

SEQ ID NO: 472666 - DNA, 20 bp, Artificial
  CRISPR gRNA sequence
tttgctctggctagaatttt

SEQ ID NO: 472667 - DNA, 20 bp, Artificial
  CRISPR gRNA sequence
gctctggctagaattttcag

SEQ ID NO: 472668 - DNA, 20 bp, Artificial
  CRISPR gRNA sequence
ctctggctagaattttcagt

SEQ ID NO: 472669 - DNA, 20 bp, Artificial
  CRISPR gRNA sequence
tggctagaattttcagttta

SEQ ID NO: 472670 - DNA, 20 bp, Artificial
  CRISPR gRNA sequence
gctagaattttcagtttaat

SEQ ID NO: 472671 - DNA, 20 bp, Artificial
  CRISPR gRNA sequence
gaattttcagtttaatgtta

SEQ ID NO: 472672 - DNA, 20 bp, Artificial
  CRISPR gRNA sequence
tcagtttaatgttaaatgga

SEQ ID NO: 472673 - DNA, 20 bp, Artificial
  CRISPR gRNA sequence
cagtttaatgttaaatggaa

SEQ ID NO: 472674 - DNA, 20 bp, Artificial
  CRISPR gRNA sequence
agtttaatgttaaatggaaa

SEQ ID NO: 472675 - DNA, 20 bp, Artificial
  CRISPR gRNA sequence
aatgttaaatggaaatggca

SEQ ID NO: 472676 - DNA, 20 bp, Artificial
  CRISPR gRNA sequence
atgttaaatggaaatggcaa

SEQ ID NO: 472677 - DNA, 20 bp, Artificial
  CRISPR gRNA sequence
aatggaaatggcaaaagcaa

SEQ ID NO: 472678 - DNA, 20 bp, Artificial
  CRISPR gRNA sequence
gttcctgttcttagggggaa

SEQ ID NO: 472679 - DNA, 20 bp, Artificial
  CRISPR gRNA sequence
ttcctgttcttagggggaaa

SEQ ID NO: 472680 - DNA, 20 bp, Artificial
  CRISPR gRNA sequence
ctgttcttagggggaaagct

SEQ ID NO: 472681 - DNA, 20 bp, Artificial
  CRISPR gRNA sequence
ttcttagggggaaagctcta

SEQ ID NO: 472682 - DNA, 20 bp, Artificial
  CRISPR gRNA sequence
ttagggggaaagctctaagc

SEQ ID NO: 472683 - DNA, 20 bp, Artificial
  CRISPR gRNA sequence
agggggaaagctctaagcct

SEQ ID NO: 472684 - DNA, 20 bp, Artificial
  CRISPR gRNA sequence
gggggaaagctctaagcctt

SEQ ID NO: 472685 - DNA, 20 bp, Artificial
  CRISPR gRNA sequence
taagcctttcaccattgaat

SEQ ID NO: 472686 - DNA, 20 bp, Artificial
  CRISPR gRNA sequence
agcctttcaccattgaatat

SEQ ID NO: 472687 - DNA, 20 bp, Artificial
  CRISPR gRNA sequence
tcaccattgaatatgatgtt

SEQ ID NO: 472688 - DNA, 20 bp, Artificial
  CRISPR gRNA sequence
caccattgaatatgatgttg

SEQ ID NO: 472689 - DNA, 20 bp, Artificial
  CRISPR gRNA sequence
accattgaatatgatgttgg

SEQ ID NO: 472690 - DNA, 20 bp, Artificial
  CRISPR gRNA sequence
aatatgatgttggctataaa

SEQ ID NO: 472691 - DNA, 20 bp, Artificial
  CRISPR gRNA sequence
gctataaaatttttataaac

SEQ ID NO: 472692 - DNA, 20 bp, Artificial
  CRISPR gRNA sequence
taaaatttttataaaccaag

SEQ ID NO: 472693 - DNA, 20 bp, Artificial
  CRISPR gRNA sequence
ttataaaccaagtatttttt

SEQ ID NO: 472694 - DNA, 20 bp, Artificial
  CRISPR gRNA sequence
tataaaccaagtatttttta

SEQ ID NO: 472695 - DNA, 20 bp, Artificial
  CRISPR gRNA sequence
ataaaccaagtattttttac

SEQ ID NO: 472696 - DNA, 20 bp, Artificial
  CRISPR gRNA sequence
taaaccaagtattttttact

SEQ ID NO: 472697 - DNA, 20 bp, Artificial
  CRISPR gRNA sequence
tttactcttacctactcccc

SEQ ID NO: 472698 - DNA, 20 bp, Artificial
  CRISPR gRNA sequence
ttactcttacctactccccc

SEQ ID NO: 472699 - DNA, 20 bp, Artificial
  CRISPR gRNA sequence
tactcttacctactcccccc

SEQ ID NO: 472700 - DNA, 20 bp, Artificial
  CRISPR gRNA sequence
actcttacctactccccccc

SEQ ID NO: 472701 - DNA, 20 bp, Artificial
  CRISPR gRNA sequence
ctcttacctactccccccct

SEQ ID NO: 472702 - DNA, 20 bp, Artificial
  CRISPR gRNA sequence
ttacctactccccccctatg

SEQ ID NO: 472703 - DNA, 20 bp, Artificial
  CRISPR gRNA sequence
acctactccccccctatgta

SEQ ID NO: 472704 - DNA, 20 bp, Artificial
  CRISPR gRNA sequence
cctactccccccctatgtat

SEQ ID NO: 472705 - DNA, 20 bp, Artificial
  CRISPR gRNA sequence
ctccccccctatgtattttt

SEQ ID NO: 472706 - DNA, 20 bp, Artificial
  CRISPR gRNA sequence
cccccctatgtattttttca

SEQ ID NO: 472707 - DNA, 20 bp, Artificial
  CRISPR gRNA sequence
tgtattttttcatgttttat

SEQ ID NO: 472708 - DNA, 20 bp, Artificial
  CRISPR gRNA sequence
tttcatgttttattcagctt

SEQ ID NO: 472709 - DNA, 20 bp, Artificial
  CRISPR gRNA sequence
ttcatgttttattcagcttg

SEQ ID NO: 472710 - DNA, 20 bp, Artificial
  CRISPR gRNA sequence
tcatgttttattcagcttgg

SEQ ID NO: 472711 - DNA, 20 bp, Artificial
  CRISPR gRNA sequence
catgttttattcagcttggt

SEQ ID NO: 472712 - DNA, 20 bp, Artificial
  CRISPR gRNA sequence
atgttttattcagcttggtt

SEQ ID NO: 472713 - DNA, 20 bp, Artificial
  CRISPR gRNA sequence
tattcagcttggtttcccca

SEQ ID NO: 472714 - DNA, 20 bp, Artificial
  CRISPR gRNA sequence
attcagcttggtttccccaa

SEQ ID NO: 472715 - DNA, 20 bp, Artificial
  CRISPR gRNA sequence
ttcagcttggtttccccaag

SEQ ID NO: 472716 - DNA, 20 bp, Artificial
  CRISPR gRNA sequence
agcttggtttccccaagctt

SEQ ID NO: 472717 - DNA, 20 bp, Artificial
  CRISPR gRNA sequence
ggtttccccaagcttaactt

SEQ ID NO: 472718 - DNA, 20 bp, Artificial
  CRISPR gRNA sequence
gtttccccaagcttaacttc

SEQ ID NO: 472719 - DNA, 20 bp, Artificial
  CRISPR gRNA sequence
ccccaagcttaacttctatc

SEQ ID NO: 472720 - DNA, 20 bp, Artificial
  CRISPR gRNA sequence
cccaagcttaacttctatct

SEQ ID NO: 472721 - DNA, 20 bp, Artificial
  CRISPR gRNA sequence
aacttctatctgtccttcct

SEQ ID NO: 472722 - DNA, 20 bp, Artificial
  CRISPR gRNA sequence
acttctatctgtccttcctc

SEQ ID NO: 472723 - DNA, 20 bp, Artificial
  CRISPR gRNA sequence
ctatctgtccttcctcagtt

SEQ ID NO: 472724 - DNA, 20 bp, Artificial
  CRISPR gRNA sequence
tatctgtccttcctcagttg

SEQ ID NO: 472725 - DNA, 20 bp, Artificial
  CRISPR gRNA sequence
tctgtccttcctcagttgtc

SEQ ID NO: 472726 - DNA, 20 bp, Artificial
  CRISPR gRNA sequence
tccttcctcagttgtcaaag

SEQ ID NO: 472727 - DNA, 20 bp, Artificial
  CRISPR gRNA sequence
cctcagttgtcaaagcatat

SEQ ID NO: 472728 - DNA, 20 bp, Artificial
  CRISPR gRNA sequence
ctcagttgtcaaagcatatt

SEQ ID NO: 472729 - DNA, 20 bp, Artificial
  CRISPR gRNA sequence
agttgtcaaagcatattaaa

SEQ ID NO: 472730 - DNA, 20 bp, Artificial
  CRISPR gRNA sequence
tcaaagcatattaaaggcct

SEQ ID NO: 472731 - DNA, 20 bp, Artificial
  CRISPR gRNA sequence
aaggcctctttcggggaaca

SEQ ID NO: 472732 - DNA, 20 bp, Artificial
  CRISPR gRNA sequence
tttcggggaacagggaagag

SEQ ID NO: 472733 - DNA, 20 bp, Artificial
  CRISPR gRNA sequence
tcggggaacagggaagagag

SEQ ID NO: 472734 - DNA, 20 bp, Artificial
  CRISPR gRNA sequence
cggggaacagggaagagaga

SEQ ID NO: 472735 - DNA, 20 bp, Artificial
  CRISPR gRNA sequence
ggggaacagggaagagagat

SEQ ID NO: 472736 - DNA, 20 bp, Artificial
  CRISPR gRNA sequence
tgaatattcccagaaaatca

SEQ ID NO: 472737 - DNA, 20 bp, Artificial
  CRISPR gRNA sequence
aatattcccagaaaatcact

SEQ ID NO: 472738 - DNA, 20 bp, Artificial
  CRISPR gRNA sequence
ccagaaaatcactaggaagt

SEQ ID NO: 472739 - DNA, 20 bp, Artificial
  CRISPR gRNA sequence
ggaagtcagttagttgtttg

SEQ ID NO: 472740 - DNA, 20 bp, Artificial
  CRISPR gRNA sequence
gttgtttgctgtttttcctc

SEQ ID NO: 472741 - DNA, 20 bp, Artificial
  CRISPR gRNA sequence
tttgctgtttttcctctaaa

SEQ ID NO: 472742 - DNA, 20 bp, Artificial
  CRISPR gRNA sequence
gctgtttttcctctaaacaa

SEQ ID NO: 472743 - DNA, 20 bp, Artificial
  CRISPR gRNA sequence
ctgtttttcctctaaacaaa

SEQ ID NO: 472744 - DNA, 20 bp, Artificial
  CRISPR gRNA sequence
tttttcctctaaacaaactg

SEQ ID NO: 472745 - DNA, 20 bp, Artificial
  CRISPR gRNA sequence
ttcctctaaacaaactgtga

SEQ ID NO: 472746 - DNA, 20 bp, Artificial
  CRISPR gRNA sequence
tcctctaaacaaactgtgaa

SEQ ID NO: 472747 - DNA, 20 bp, Artificial
  CRISPR gRNA sequence
cctctaaacaaactgtgaac

SEQ ID NO: 472748 - DNA, 20 bp, Artificial
  CRISPR gRNA sequence
ctctaaacaaactgtgaact

SEQ ID NO: 472749 - DNA, 20 bp, Artificial
  CRISPR gRNA sequence
taaacaaactgtgaactatt

SEQ ID NO: 472750 - DNA, 20 bp, Artificial
  CRISPR gRNA sequence
aacaaactgtgaactattaa

SEQ ID NO: 472751 - DNA, 20 bp, Artificial
  CRISPR gRNA sequence
tgaactattaagaagtgttt

SEQ ID NO: 472752 - DNA, 20 bp, Artificial
  CRISPR gRNA sequence
ttaagaagtgtttaattgcc

SEQ ID NO: 472753 - DNA, 20 bp, Artificial
  CRISPR gRNA sequence
agaagtgtttaattgcctaa

SEQ ID NO: 472754 - DNA, 20 bp, Artificial
  CRISPR gRNA sequence
aattgcctaagcaccacaaa

SEQ ID NO: 472755 - DNA, 20 bp, Artificial
  CRISPR gRNA sequence
attgcctaagcaccacaaac

SEQ ID NO: 472756 - DNA, 20 bp, Artificial
  CRISPR gRNA sequence
cctaagcaccacaaacataa

SEQ ID NO: 472757 - DNA, 20 bp, Artificial
  CRISPR gRNA sequence
agcaccacaaacataacttc

SEQ ID NO: 472758 - DNA, 20 bp, Artificial
  CRISPR gRNA sequence
caagaaattgtaatgaacaa

SEQ ID NO: 472759 - DNA, 20 bp, Artificial
  CRISPR gRNA sequence
aagaaattgtaatgaacaaa

SEQ ID NO: 472760 - DNA, 20 bp, Artificial
  CRISPR gRNA sequence
taatgaacaaaagtaaagaa

SEQ ID NO: 472761 - DNA, 20 bp, Artificial
  CRISPR gRNA sequence
ttcgcaactataggtattca

SEQ ID NO: 472762 - DNA, 20 bp, Artificial
  CRISPR gRNA sequence
gcaactataggtattcactt

SEQ ID NO: 472763 - DNA, 20 bp, Artificial
  CRISPR gRNA sequence
taggtattcactttataatt

SEQ ID NO: 472764 - DNA, 20 bp, Artificial
  CRISPR gRNA sequence
actttataattttttcaata

SEQ ID NO: 472765 - DNA, 20 bp, Artificial
  CRISPR gRNA sequence
tataattttttcaatatttc

SEQ ID NO: 472766 - DNA, 20 bp, Artificial
  CRISPR gRNA sequence
ataattttttcaatatttca

SEQ ID NO: 472767 - DNA, 20 bp, Artificial
  CRISPR gRNA sequence
taattttttcaatatttcag

SEQ ID NO: 472768 - DNA, 20 bp, Artificial
  CRISPR gRNA sequence
tttcaatatttcagtggtct

SEQ ID NO: 472769 - DNA, 20 bp, Artificial
  CRISPR gRNA sequence
ttcaatatttcagtggtcta

SEQ ID NO: 472770 - DNA, 20 bp, Artificial
  CRISPR gRNA sequence
tcaatatttcagtggtctac

SEQ ID NO: 472771 - DNA, 20 bp, Artificial
  CRISPR gRNA sequence
caatatttcagtggtctact

SEQ ID NO: 472772 - DNA, 20 bp, Artificial
  CRISPR gRNA sequence
aatatttcagtggtctactt

SEQ ID NO: 472773 - DNA, 20 bp, Artificial
  CRISPR gRNA sequence
cagtggtctacttttggact

SEQ ID NO: 472774 - DNA, 20 bp, Artificial
  CRISPR gRNA sequence
agtggtctacttttggactt

SEQ ID NO: 472775 - DNA, 20 bp, Artificial
  CRISPR gRNA sequence
cttttggacttatcaaataa

SEQ ID NO: 472776 - DNA, 20 bp, Artificial
  CRISPR gRNA sequence
ttggacttatcaaataaatt

SEQ ID NO: 472777 - DNA, 20 bp, Artificial
  CRISPR gRNA sequence
tggacttatcaaataaattt

SEQ ID NO: 472778 - DNA, 20 bp, Artificial
  CRISPR gRNA sequence
ggacttatcaaataaatttt

SEQ ID NO: 472779 - DNA, 20 bp, Artificial
  CRISPR gRNA sequence
gacttatcaaataaatttta

SEQ ID NO: 472780 - DNA, 20 bp, Artificial
  CRISPR gRNA sequence
atcaaataaattttataatc

SEQ ID NO: 472781 - DNA, 20 bp, Artificial
  CRISPR gRNA sequence
tcaaataaattttataatcc

SEQ ID NO: 472782 - DNA, 20 bp, Artificial
  CRISPR gRNA sequence
tataatccctaaagtcaaaa

SEQ ID NO: 472783 - DNA, 20 bp, Artificial
  CRISPR gRNA sequence
ataatccctaaagtcaaaaa

SEQ ID NO: 472784 - DNA, 20 bp, Artificial
  CRISPR gRNA sequence
taatccctaaagtcaaaaac

SEQ ID NO: 472785 - DNA, 20 bp, Artificial
  CRISPR gRNA sequence
aagtcaaaaacaataacttt

SEQ ID NO: 472786 - DNA, 20 bp, Artificial
  CRISPR gRNA sequence
ttactatctatttctctact

SEQ ID NO: 472787 - DNA, 20 bp, Artificial
  CRISPR gRNA sequence
tactatctatttctctactc

SEQ ID NO: 472788 - DNA, 20 bp, Artificial
  CRISPR gRNA sequence
actatctatttctctactct

SEQ ID NO: 472789 - DNA, 20 bp, Artificial
  CRISPR gRNA sequence
ctatctatttctctactctc

SEQ ID NO: 472790 - DNA, 20 bp, Artificial
  CRISPR gRNA sequence
tctatttctctactctcctc

SEQ ID NO: 472791 - DNA, 20 bp, Artificial
  CRISPR gRNA sequence
tttctctactctcctctatc

SEQ ID NO: 472792 - DNA, 20 bp, Artificial
  CRISPR gRNA sequence
ctctactctcctctatctca

SEQ ID NO: 472793 - DNA, 20 bp, Artificial
  CRISPR gRNA sequence
tctactctcctctatctcac

SEQ ID NO: 472794 - DNA, 20 bp, Artificial
  CRISPR gRNA sequence
tactctcctctatctcactc

SEQ ID NO: 472795 - DNA, 20 bp, Artificial
  CRISPR gRNA sequence
ctctcctctatctcactcac

SEQ ID NO: 472796 - DNA, 20 bp, Artificial
  CRISPR gRNA sequence
tcctctatctcactcacctc

SEQ ID NO: 472797 - DNA, 20 bp, Artificial
  CRISPR gRNA sequence
ctctatctcactcacctcaa

SEQ ID NO: 472798 - DNA, 20 bp, Artificial
  CRISPR gRNA sequence
tatctcactcacctcaaacg

SEQ ID NO: 472799 - DNA, 20 bp, Artificial
  CRISPR gRNA sequence
tctcactcacctcaaacgca

SEQ ID NO: 472800 - DNA, 20 bp, Artificial
  CRISPR gRNA sequence
actcacctcaaacgcacaca

SEQ ID NO: 472801 - DNA, 20 bp, Artificial
  CRISPR gRNA sequence
acctcaaacgcacacataca

SEQ ID NO: 472802 - DNA, 20 bp, Artificial
  CRISPR gRNA sequence
aaacgcacacatacacacac

SEQ ID NO: 472803 - DNA, 20 bp, Artificial
  CRISPR gRNA sequence
gcacataacaatctgtgagg

SEQ ID NO: 472804 - DNA, 20 bp, Artificial
  CRISPR gRNA sequence
tgaggtgtagcagatttcag

SEQ ID NO: 472805 - DNA, 20 bp, Artificial
  CRISPR gRNA sequence
cagatgtgctataggagttg

SEQ ID NO: 472806 - DNA, 20 bp, Artificial
  CRISPR gRNA sequence
agatgtgctataggagttgg

SEQ ID NO: 472807 - DNA, 20 bp, Artificial
  CRISPR gRNA sequence
taggagttggctttctaaca

SEQ ID NO: 472808 - DNA, 20 bp, Artificial
  CRISPR gRNA sequence
gctttctaacataatcactt

SEQ ID NO: 472809 - DNA, 20 bp, Artificial
  CRISPR gRNA sequence
tctaacataatcacttgaga

SEQ ID NO: 472810 - DNA, 20 bp, Artificial
  CRISPR gRNA sequence
ctaacataatcacttgagaa

SEQ ID NO: 472811 - DNA, 20 bp, Artificial
  CRISPR gRNA sequence
taacataatcacttgagaaa

SEQ ID NO: 472812 - DNA, 20 bp, Artificial
  CRISPR gRNA sequence
acataatcacttgagaaact

SEQ ID NO: 472813 - DNA, 20 bp, Artificial
  CRISPR gRNA sequence
gagaaactgaacccccctct

SEQ ID NO: 472814 - DNA, 20 bp, Artificial
  CRISPR gRNA sequence
agaaactgaacccccctctt

SEQ ID NO: 472815 - DNA, 20 bp, Artificial
  CRISPR gRNA sequence
aacccccctcttcctggaaa

SEQ ID NO: 472816 - DNA, 20 bp, Artificial
  CRISPR gRNA sequence
ttcctggaaacattataaga

SEQ ID NO: 472817 - DNA, 20 bp, Artificial
  CRISPR gRNA sequence
cctggaaacattataagaaa

SEQ ID NO: 472818 - DNA, 20 bp, Artificial
  CRISPR gRNA sequence
ctggaaacattataagaaaa

SEQ ID NO: 472819 - DNA, 20 bp, Artificial
  CRISPR gRNA sequence
gaaacattataagaaaaata

SEQ ID NO: 472820 - DNA, 20 bp, Artificial
  CRISPR gRNA sequence
taagaaaaatatcagatggt

SEQ ID NO: 472821 - DNA, 20 bp, Artificial
  CRISPR gRNA sequence
ggtgttgagaactcacctgt

SEQ ID NO: 472822 - DNA, 20 bp, Artificial
  CRISPR gRNA sequence
agaactcacctgtcacataa

SEQ ID NO: 472823 - DNA, 20 bp, Artificial
  CRISPR gRNA sequence
acctgtcacataaagagttg

SEQ ID NO: 472824 - DNA, 20 bp, Artificial
  CRISPR gRNA sequence
tcacataaagagttgttgag

SEQ ID NO: 472825 - DNA, 20 bp, Artificial
  CRISPR gRNA sequence
ttgagtggctttcaatgaga

SEQ ID NO: 472826 - DNA, 20 bp, Artificial
  CRISPR gRNA sequence
agtggctttcaatgagatta

SEQ ID NO: 472827 - DNA, 20 bp, Artificial
  CRISPR gRNA sequence
tcaatgagattagactgaaa

SEQ ID NO: 472828 - DNA, 20 bp, Artificial
  CRISPR gRNA sequence
caatgagattagactgaaaa

SEQ ID NO: 472829 - DNA, 20 bp, Artificial
  CRISPR gRNA sequence
aatgagattagactgaaaat

SEQ ID NO: 472830 - DNA, 20 bp, Artificial
  CRISPR gRNA sequence
gactgaaaatttgcagaaca

SEQ ID NO: 472831 - DNA, 20 bp, Artificial
  CRISPR gRNA sequence
aaaatttgcagaacagcggt

SEQ ID NO: 472832 - DNA, 20 bp, Artificial
  CRISPR gRNA sequence
gcagaacagcggtatgaccc

SEQ ID NO: 472833 - DNA, 20 bp, Artificial
  CRISPR gRNA sequence
cagaacagcggtatgaccca

SEQ ID NO: 472834 - DNA, 20 bp, Artificial
  CRISPR gRNA sequence
tcattaggaagcactggttc

SEQ ID NO: 472835 - DNA, 20 bp, Artificial
  CRISPR gRNA sequence
ggaagcactggttcaaaatg

SEQ ID NO: 472836 - DNA, 20 bp, Artificial
  CRISPR gRNA sequence
gttcaaaatgtagaatgaaa

SEQ ID NO: 472837 - DNA, 20 bp, Artificial
  CRISPR gRNA sequence
aaaatgtagaatgaaaaatg

SEQ ID NO: 472838 - DNA, 20 bp, Artificial
  CRISPR gRNA sequence
ttctcttccttccaacttgt

SEQ ID NO: 472839 - DNA, 20 bp, Artificial
  CRISPR gRNA sequence
ctcttccttccaacttgttt

SEQ ID NO: 472840 - DNA, 20 bp, Artificial
  CRISPR gRNA sequence
tcttccttccaacttgtttg

SEQ ID NO: 472841 - DNA, 20 bp, Artificial
  CRISPR gRNA sequence
ttccttccaacttgtttgtc

SEQ ID NO: 472842 - DNA, 20 bp, Artificial
  CRISPR gRNA sequence
ccttccaacttgtttgtcta

SEQ ID NO: 472843 - DNA, 20 bp, Artificial
  CRISPR gRNA sequence
cttccaacttgtttgtctat

SEQ ID NO: 472844 - DNA, 20 bp, Artificial
  CRISPR gRNA sequence
ccaacttgtttgtctatctt

SEQ ID NO: 472845 - DNA, 20 bp, Artificial
  CRISPR gRNA sequence
caacttgtttgtctatcttc

SEQ ID NO: 472846 - DNA, 20 bp, Artificial
  CRISPR gRNA sequence
gtttgtctatcttcaagttt

SEQ ID NO: 472847 - DNA, 20 bp, Artificial
  CRISPR gRNA sequence
tttgtctatcttcaagtttt

SEQ ID NO: 472848 - DNA, 20 bp, Artificial
  CRISPR gRNA sequence
gtctatcttcaagttttaca

SEQ ID NO: 472849 - DNA, 20 bp, Artificial
  CRISPR gRNA sequence
tctatcttcaagttttacac

SEQ ID NO: 472850 - DNA, 20 bp, Artificial
  CRISPR gRNA sequence
tcttcaagttttacacatgt

SEQ ID NO: 472851 - DNA, 20 bp, Artificial
  CRISPR gRNA sequence
caagttttacacatgttgtt

SEQ ID NO: 472852 - DNA, 20 bp, Artificial
  CRISPR gRNA sequence
aagttttacacatgttgttc

SEQ ID NO: 472853 - DNA, 20 bp, Artificial
  CRISPR gRNA sequence
tacacatgttgttccattga

SEQ ID NO: 472854 - DNA, 20 bp, Artificial
  CRISPR gRNA sequence
acacatgttgttccattgag

SEQ ID NO: 472855 - DNA, 20 bp, Artificial
  CRISPR gRNA sequence
cacatgttgttccattgagc

SEQ ID NO: 472856 - DNA, 20 bp, Artificial
  CRISPR gRNA sequence
ttccattgagcttgcaccaa

SEQ ID NO: 472857 - DNA, 20 bp, Artificial
  CRISPR gRNA sequence
cattgagcttgcaccaagtc

SEQ ID NO: 472858 - DNA, 20 bp, Artificial
  CRISPR gRNA sequence
agcttgcaccaagtcacatg

SEQ ID NO: 472859 - DNA, 20 bp, Artificial
  CRISPR gRNA sequence
gcaccaagtcacatgaggcc

SEQ ID NO: 472860 - DNA, 20 bp, Artificial
  CRISPR gRNA sequence
caccaagtcacatgaggcct

SEQ ID NO: 472861 - DNA, 20 bp, Artificial
  CRISPR gRNA sequence
ttagcacagtatttcacagg

SEQ ID NO: 472862 - DNA, 20 bp, Artificial
  CRISPR gRNA sequence
gcacagtatttcacagggca

SEQ ID NO: 472863 - DNA, 20 bp, Artificial
  CRISPR gRNA sequence
cacagggcattctagttcaa

SEQ ID NO: 472864 - DNA, 20 bp, Artificial
  CRISPR gRNA sequence
acagggcattctagttcaaa

SEQ ID NO: 472865 - DNA, 20 bp, Artificial
  CRISPR gRNA sequence
tagttcaaagggatctcctg

SEQ ID NO: 472866 - DNA, 20 bp, Artificial
  CRISPR gRNA sequence
gttcaaagggatctcctgct

SEQ ID NO: 472867 - DNA, 20 bp, Artificial
  CRISPR gRNA sequence
aaagggatctcctgctaaga

SEQ ID NO: 472868 - DNA, 20 bp, Artificial
  CRISPR gRNA sequence
ctgctaagatggagtgttca

SEQ ID NO: 472869 - DNA, 20 bp, Artificial
  CRISPR gRNA sequence
ctaagatggagtgttcagat

SEQ ID NO: 472870 - DNA, 20 bp, Artificial
  CRISPR gRNA sequence
agatggagtgttcagattgt

SEQ ID NO: 472871 - DNA, 20 bp, Artificial
  CRISPR gRNA sequence
agattgtctctttatataaa

SEQ ID NO: 472872 - DNA, 20 bp, Artificial
  CRISPR gRNA sequence
tctctttatataaagctgta

SEQ ID NO: 472873 - DNA, 20 bp, Artificial
  CRISPR gRNA sequence
tttatataaagctgtacatc

SEQ ID NO: 472874 - DNA, 20 bp, Artificial
  CRISPR gRNA sequence
tatataaagctgtacatcac

SEQ ID NO: 472875 - DNA, 20 bp, Artificial
  CRISPR gRNA sequence
atataaagctgtacatcaca

SEQ ID NO: 472876 - DNA, 20 bp, Artificial
  CRISPR gRNA sequence
tataaagctgtacatcacat

SEQ ID NO: 472877 - DNA, 20 bp, Artificial
  CRISPR gRNA sequence
tacatcacatgattctttcc

SEQ ID NO: 472878 - DNA, 20 bp, Artificial
  CRISPR gRNA sequence
tttccctaaaagataaaaac

SEQ ID NO: 472879 - DNA, 20 bp, Artificial
  CRISPR gRNA sequence
tccctaaaagataaaaacaa

SEQ ID NO: 472880 - DNA, 20 bp, Artificial
  CRISPR gRNA sequence
ccctaaaagataaaaacaaa

SEQ ID NO: 472881 - DNA, 20 bp, Artificial
  CRISPR gRNA sequence
cctaaaagataaaaacaaaa

SEQ ID NO: 472882 - DNA, 20 bp, Artificial
  CRISPR gRNA sequence
aaagataaaaacaaaactaa

SEQ ID NO: 472883 - DNA, 20 bp, Artificial
  CRISPR gRNA sequence
aaatcaaatatgttcttctg

SEQ ID NO: 472884 - DNA, 20 bp, Artificial
  CRISPR gRNA sequence
ttctggaagtaccatatata

SEQ ID NO: 472885 - DNA, 20 bp, Artificial
  CRISPR gRNA sequence
ctggaagtaccatatatatg

SEQ ID NO: 472886 - DNA, 20 bp, Artificial
  CRISPR gRNA sequence
tggaagtaccatatatatgt

SEQ ID NO: 472887 - DNA, 20 bp, Artificial
  CRISPR gRNA sequence
gaagtaccatatatatgtga

SEQ ID NO: 472888 - DNA, 20 bp, Artificial
  CRISPR gRNA sequence
caatagttctcaagcattat

SEQ ID NO: 472889 - DNA, 20 bp, Artificial
  CRISPR gRNA sequence
aatagttctcaagcattatt

SEQ ID NO: 472890 - DNA, 20 bp, Artificial
  CRISPR gRNA sequence
tcaagcattatttggtaatt

SEQ ID NO: 472891 - DNA, 20 bp, Artificial
  CRISPR gRNA sequence
aagcattatttggtaatttt

SEQ ID NO: 472892 - DNA, 20 bp, Artificial
  CRISPR gRNA sequence
tttggtaattttcaaaaaca

SEQ ID NO: 472893 - DNA, 20 bp, Artificial
  CRISPR gRNA sequence
ggtaattttcaaaaacaacc

SEQ ID NO: 472894 - DNA, 20 bp, Artificial
  CRISPR gRNA sequence
gtaattttcaaaaacaaccc

SEQ ID NO: 472895 - DNA, 20 bp, Artificial
  CRISPR gRNA sequence
tcaaaaacaaccccccaatt

SEQ ID NO: 472896 - DNA, 20 bp, Artificial
  CRISPR gRNA sequence
caaaaacaaccccccaattt

SEQ ID NO: 472897 - DNA, 20 bp, Artificial
  CRISPR gRNA sequence
aaaaacaaccccccaatttc

SEQ ID NO: 472898 - DNA, 20 bp, Artificial
  CRISPR gRNA sequence
ctagtaattaagccttacta

SEQ ID NO: 472899 - DNA, 20 bp, Artificial
  CRISPR gRNA sequence
tagtaattaagccttactag

SEQ ID NO: 472900 - DNA, 20 bp, Artificial
  CRISPR gRNA sequence
gtaattaagccttactagca

SEQ ID NO: 472901 - DNA, 20 bp, Artificial
  CRISPR gRNA sequence
agccttactagcagaatgtc

SEQ ID NO: 472902 - DNA, 20 bp, Artificial
  CRISPR gRNA sequence
actagcagaatgtctcatac

SEQ ID NO: 472903 - DNA, 20 bp, Artificial
  CRISPR gRNA sequence
ctagcagaatgtctcataca

SEQ ID NO: 472904 - DNA, 20 bp, Artificial
  CRISPR gRNA sequence
gcagaatgtctcatacatat

SEQ ID NO: 472905 - DNA, 20 bp, Artificial
  CRISPR gRNA sequence
atacatattaggcatataat

SEQ ID NO: 472906 - DNA, 20 bp, Artificial
  CRISPR gRNA sequence
ggcatataataaatatgttt

SEQ ID NO: 472907 - DNA, 20 bp, Artificial
  CRISPR gRNA sequence
aaaaaatgaaataaatcatt

SEQ ID NO: 472908 - DNA, 20 bp, Artificial
  CRISPR gRNA sequence
aaaaatgaaataaatcattt

SEQ ID NO: 472909 - DNA, 20 bp, Artificial
  CRISPR gRNA sequence
aatcctctgtctgtcaggcc

SEQ ID NO: 472910 - DNA, 20 bp, Artificial
  CRISPR gRNA sequence
atcctctgtctgtcaggcct

SEQ ID NO: 472911 - DNA, 20 bp, Artificial
  CRISPR gRNA sequence
tgtctgtcaggcctttgagc

SEQ ID NO: 472912 - DNA, 20 bp, Artificial
  CRISPR gRNA sequence
tctgtcaggcctttgagccc

SEQ ID NO: 472913 - DNA, 20 bp, Artificial
  CRISPR gRNA sequence
tcaggcctttgagcccaagc

SEQ ID NO: 472914 - DNA, 20 bp, Artificial
  CRISPR gRNA sequence
tgagcccaagctaagccatc

SEQ ID NO: 472915 - DNA, 20 bp, Artificial
  CRISPR gRNA sequence
gagcccaagctaagccatca

SEQ ID NO: 472916 - DNA, 20 bp, Artificial
  CRISPR gRNA sequence
agcccaagctaagccatcat

SEQ ID NO: 472917 - DNA, 20 bp, Artificial
  CRISPR gRNA sequence
agccatcatataccctgtga

SEQ ID NO: 472918 - DNA, 20 bp, Artificial
  CRISPR gRNA sequence
tgacctgcacgtatacatcc

SEQ ID NO: 472919 - DNA, 20 bp, Artificial
  CRISPR gRNA sequence
cacgtatacatccagatggc

SEQ ID NO: 472920 - DNA, 20 bp, Artificial
  CRISPR gRNA sequence
aagcaactgaagatccacaa

SEQ ID NO: 472921 - DNA, 20 bp, Artificial
  CRISPR gRNA sequence
aagatccacaaaagaagtga

SEQ ID NO: 472922 - DNA, 20 bp, Artificial
  CRISPR gRNA sequence
aactgatgacattccaccat

SEQ ID NO: 472923 - DNA, 20 bp, Artificial
  CRISPR gRNA sequence
actgatgacattccaccatt

SEQ ID NO: 472924 - DNA, 20 bp, Artificial
  CRISPR gRNA sequence
atgacattccaccattgtga

SEQ ID NO: 472925 - DNA, 20 bp, Artificial
  CRISPR gRNA sequence
caccattgtgatttgtttct

SEQ ID NO: 472926 - DNA, 20 bp, Artificial
  CRISPR gRNA sequence
tgatttgtttcttccccacc

SEQ ID NO: 472927 - DNA, 20 bp, Artificial
  CRISPR gRNA sequence
gtttcttccccaccctaact

SEQ ID NO: 472928 - DNA, 20 bp, Artificial
  CRISPR gRNA sequence
tttcttccccaccctaactg

SEQ ID NO: 472929 - DNA, 20 bp, Artificial
  CRISPR gRNA sequence
cttccccaccctaactgatc

SEQ ID NO: 472930 - DNA, 20 bp, Artificial
  CRISPR gRNA sequence
ttccccaccctaactgatca

SEQ ID NO: 472931 - DNA, 20 bp, Artificial
  CRISPR gRNA sequence
ccccaccctaactgatcaat

SEQ ID NO: 472932 - DNA, 20 bp, Artificial
  CRISPR gRNA sequence
cccaccctaactgatcaatg

SEQ ID NO: 472933 - DNA, 20 bp, Artificial
  CRISPR gRNA sequence
actgatcaatgtactttgta

SEQ ID NO: 472934 - DNA, 20 bp, Artificial
  CRISPR gRNA sequence
atcaatgtactttgtaatct

SEQ ID NO: 472935 - DNA, 20 bp, Artificial
  CRISPR gRNA sequence
tgtaatctcccccaccctta

SEQ ID NO: 472936 - DNA, 20 bp, Artificial
  CRISPR gRNA sequence
gtaatctcccccacccttaa

SEQ ID NO: 472937 - DNA, 20 bp, Artificial
  CRISPR gRNA sequence
taatctcccccacccttaag

SEQ ID NO: 472938 - DNA, 20 bp, Artificial
  CRISPR gRNA sequence
ccccacccttaagaagtttc

SEQ ID NO: 472939 - DNA, 20 bp, Artificial
  CRISPR gRNA sequence
aagaagtttctttgtaattc

SEQ ID NO: 472940 - DNA, 20 bp, Artificial
  CRISPR gRNA sequence
agaagtttctttgtaattct

SEQ ID NO: 472941 - DNA, 20 bp, Artificial
  CRISPR gRNA sequence
ctttgtaattctccccaccc

SEQ ID NO: 472942 - DNA, 20 bp, Artificial
  CRISPR gRNA sequence
tttgtaattctccccaccct

SEQ ID NO: 472943 - DNA, 20 bp, Artificial
  CRISPR gRNA sequence
tgtaattctccccacccttg

SEQ ID NO: 472944 - DNA, 20 bp, Artificial
  CRISPR gRNA sequence
gtaattctccccacccttga

SEQ ID NO: 472945 - DNA, 20 bp, Artificial
  CRISPR gRNA sequence
taattctccccacccttgag

SEQ ID NO: 472946 - DNA, 20 bp, Artificial
  CRISPR gRNA sequence
tccccacccttgagaatgta

SEQ ID NO: 472947 - DNA, 20 bp, Artificial
  CRISPR gRNA sequence
cccacccttgagaatgtatt

SEQ ID NO: 472948 - DNA, 20 bp, Artificial
  CRISPR gRNA sequence
gagaatgtattttgtgagat

SEQ ID NO: 472949 - DNA, 20 bp, Artificial
  CRISPR gRNA sequence
agaatgtattttgtgagatc

SEQ ID NO: 472950 - DNA, 20 bp, Artificial
  CRISPR gRNA sequence
tgtgagatccaccccctgcc

SEQ ID NO: 472951 - DNA, 20 bp, Artificial
  CRISPR gRNA sequence
gtgagatccaccccctgccc

SEQ ID NO: 472952 - DNA, 20 bp, Artificial
  CRISPR gRNA sequence
tgagatccaccccctgcccc

SEQ ID NO: 472953 - DNA, 20 bp, Artificial
  CRISPR gRNA sequence
cccccaaaacattgctctta

SEQ ID NO: 472954 - DNA, 20 bp, Artificial
  CRISPR gRNA sequence
ctcttaactccactgcctat

SEQ ID NO: 472955 - DNA, 20 bp, Artificial
  CRISPR gRNA sequence
ttaactccactgcctatccc

SEQ ID NO: 472956 - DNA, 20 bp, Artificial
  CRISPR gRNA sequence
aactccactgcctatcccaa

SEQ ID NO: 472957 - DNA, 20 bp, Artificial
  CRISPR gRNA sequence
actccactgcctatcccaaa

SEQ ID NO: 472958 - DNA, 20 bp, Artificial
  CRISPR gRNA sequence
cactgcctatcccaaaacct

SEQ ID NO: 472959 - DNA, 20 bp, Artificial
  CRISPR gRNA sequence
cctatcccaaaacctataag

SEQ ID NO: 472960 - DNA, 20 bp, Artificial
  CRISPR gRNA sequence
tcccaaaacctataagtact

SEQ ID NO: 472961 - DNA, 20 bp, Artificial
  CRISPR gRNA sequence
taagtactaatgataatctc

SEQ ID NO: 472962 - DNA, 20 bp, Artificial
  CRISPR gRNA sequence
atgataatctcaccatcatt

SEQ ID NO: 472963 - DNA, 20 bp, Artificial
  CRISPR gRNA sequence
accatcatttgctgactctc

SEQ ID NO: 472964 - DNA, 20 bp, Artificial
  CRISPR gRNA sequence
gctgactctctttttggact

SEQ ID NO: 472965 - DNA, 20 bp, Artificial
  CRISPR gRNA sequence
ctgactctctttttggactc

SEQ ID NO: 472966 - DNA, 20 bp, Artificial
  CRISPR gRNA sequence
actctctttttggactcagc

SEQ ID NO: 472967 - DNA, 20 bp, Artificial
  CRISPR gRNA sequence
tctttttggactcagcccgc

SEQ ID NO: 472968 - DNA, 20 bp, Artificial
  CRISPR gRNA sequence
tttttggactcagcccgcct

SEQ ID NO: 472969 - DNA, 20 bp, Artificial
  CRISPR gRNA sequence
tttggactcagcccgcctgc

SEQ ID NO: 472970 - DNA, 20 bp, Artificial
  CRISPR gRNA sequence
ttggactcagcccgcctgca

SEQ ID NO: 472971 - DNA, 20 bp, Artificial
  CRISPR gRNA sequence
tggactcagcccgcctgcaa

SEQ ID NO: 472972 - DNA, 20 bp, Artificial
  CRISPR gRNA sequence
ggactcagcccgcctgcaag

SEQ ID NO: 472973 - DNA, 20 bp, Artificial
  CRISPR gRNA sequence
gactcagcccgcctgcaagg

SEQ ID NO: 472974 - DNA, 20 bp, Artificial
  CRISPR gRNA sequence
agcccgcctgcaaggtgaaa

SEQ ID NO: 472975 - DNA, 20 bp, Artificial
  CRISPR gRNA sequence
caaggtgaaataaacagcct

SEQ ID NO: 472976 - DNA, 20 bp, Artificial
  CRISPR gRNA sequence
gttgctcacacaaagcctgt

SEQ ID NO: 472977 - DNA, 20 bp, Artificial
  CRISPR gRNA sequence
ttgctcacacaaagcctgtt

SEQ ID NO: 472978 - DNA, 20 bp, Artificial
  CRISPR gRNA sequence
ctcacacaaagcctgtttgg

SEQ ID NO: 472979 - DNA, 20 bp, Artificial
  CRISPR gRNA sequence
acacaaagcctgtttggtgg

SEQ ID NO: 472980 - DNA, 20 bp, Artificial
  CRISPR gRNA sequence
tttggtggtctctacacacg

SEQ ID NO: 472981 - DNA, 20 bp, Artificial
  CRISPR gRNA sequence
ggtggtctctacacacggac

SEQ ID NO: 472982 - DNA, 20 bp, Artificial
  CRISPR gRNA sequence
gtggtctctacacacggaca

SEQ ID NO: 472983 - DNA, 20 bp, Artificial
  CRISPR gRNA sequence
tacacacggacacatgagac

SEQ ID NO: 472984 - DNA, 20 bp, Artificial
  CRISPR gRNA sequence
cacacggacacatgagacac

SEQ ID NO: 472985 - DNA, 20 bp, Artificial
  CRISPR gRNA sequence
tcttagtctgttttctgcta

SEQ ID NO: 472986 - DNA, 20 bp, Artificial
  CRISPR gRNA sequence
agtctgttttctgctagtat

SEQ ID NO: 472987 - DNA, 20 bp, Artificial
  CRISPR gRNA sequence
gtctgttttctgctagtata

SEQ ID NO: 472988 - DNA, 20 bp, Artificial
  CRISPR gRNA sequence
ttttctgctagtataacaga

SEQ ID NO: 472989 - DNA, 20 bp, Artificial
  CRISPR gRNA sequence
tctgctagtataacagaata

SEQ ID NO: 472990 - DNA, 20 bp, Artificial
  CRISPR gRNA sequence
ctgctagtataacagaatac

SEQ ID NO: 472991 - DNA, 20 bp, Artificial
  CRISPR gRNA sequence
tgctagtataacagaatacc

SEQ ID NO: 472992 - DNA, 20 bp, Artificial
  CRISPR gRNA sequence
ctagtataacagaatacctg

SEQ ID NO: 472993 - DNA, 20 bp, Artificial
  CRISPR gRNA sequence
gtataacagaatacctgaga

SEQ ID NO: 472994 - DNA, 20 bp, Artificial
  CRISPR gRNA sequence
agattggataatttttgaat

SEQ ID NO: 472995 - DNA, 20 bp, Artificial
  CRISPR gRNA sequence
gataatttttgaatcacaga

SEQ ID NO: 472996 - DNA, 20 bp, Artificial
  CRISPR gRNA sequence
ttgaatcacagaagttttat

SEQ ID NO: 472997 - DNA, 20 bp, Artificial
  CRISPR gRNA sequence
tgaatcacagaagttttatt

SEQ ID NO: 472998 - DNA, 20 bp, Artificial
  CRISPR gRNA sequence
gaatcacagaagttttattt

SEQ ID NO: 472999 - DNA, 20 bp, Artificial
  CRISPR gRNA sequence
aatcacagaagttttatttg

SEQ ID NO: 473000 - DNA, 20 bp, Artificial
  CRISPR gRNA sequence
tatttggctcatggctctgt

SEQ ID NO: 473001 - DNA, 20 bp, Artificial
  CRISPR gRNA sequence
atttggctcatggctctgta

SEQ ID NO: 473002 - DNA, 20 bp, Artificial
  CRISPR gRNA sequence
tttggctcatggctctgtag

SEQ ID NO: 473003 - DNA, 20 bp, Artificial
  CRISPR gRNA sequence
ggctcatggctctgtaggct

SEQ ID NO: 473004 - DNA, 20 bp, Artificial
  CRISPR gRNA sequence
gctcatggctctgtaggctg

SEQ ID NO: 473005 - DNA, 20 bp, Artificial
  CRISPR gRNA sequence
atggctctgtaggctgggaa

SEQ ID NO: 473006 - DNA, 20 bp, Artificial
  CRISPR gRNA sequence
tgtaggctgggaagtccaag

SEQ ID NO: 473007 - DNA, 20 bp, Artificial
  CRISPR gRNA sequence
taggctgggaagtccaagag

SEQ ID NO: 473008 - DNA, 20 bp, Artificial
  CRISPR gRNA sequence
ggaagtccaagagcatggtg

SEQ ID NO: 473009 - DNA, 20 bp, Artificial
  CRISPR gRNA sequence
gcaaaggcctttgtgctgca

SEQ ID NO: 473010 - DNA, 20 bp, Artificial
  CRISPR gRNA sequence
tgtgctgcattatctcatgg

SEQ ID NO: 473011 - DNA, 20 bp, Artificial
  CRISPR gRNA sequence
gtgctgcattatctcatggc

SEQ ID NO: 473012 - DNA, 20 bp, Artificial
  CRISPR gRNA sequence
tgctgcattatctcatggca

SEQ ID NO: 473013 - DNA, 20 bp, Artificial
  CRISPR gRNA sequence
cattatctcatggcagaaag

SEQ ID NO: 473014 - DNA, 20 bp, Artificial
  CRISPR gRNA sequence
tctcatggcagaaagcagaa

SEQ ID NO: 473015 - DNA, 20 bp, Artificial
  CRISPR gRNA sequence
atggcagaaagcagaaagtg

SEQ ID NO: 473016 - DNA, 20 bp, Artificial
  CRISPR gRNA sequence
atccttttatcaggtgccta

SEQ ID NO: 473017 - DNA, 20 bp, Artificial
  CRISPR gRNA sequence
tccttttatcaggtgcctac

SEQ ID NO: 473018 - DNA, 20 bp, Artificial
  CRISPR gRNA sequence
ttatcaggtgcctactcccg

SEQ ID NO: 473019 - DNA, 20 bp, Artificial
  CRISPR gRNA sequence
tatcaggtgcctactcccgt

SEQ ID NO: 473020 - DNA, 20 bp, Artificial
  CRISPR gRNA sequence
atcaggtgcctactcccgtg

SEQ ID NO: 473021 - DNA, 20 bp, Artificial
  CRISPR gRNA sequence
tcaggtgcctactcccgtga

SEQ ID NO: 473022 - DNA, 20 bp, Artificial
  CRISPR gRNA sequence
ctcccgtgataacgaatcca

SEQ ID NO: 473023 - DNA, 20 bp, Artificial
  CRISPR gRNA sequence
ccgtgataacgaatccattc

SEQ ID NO: 473024 - DNA, 20 bp, Artificial
  CRISPR gRNA sequence
ctacaataagggcattaata

SEQ ID NO: 473025 - DNA, 20 bp, Artificial
  CRISPR gRNA sequence
caataagggcattaatacat

SEQ ID NO: 473026 - DNA, 20 bp, Artificial
  CRISPR gRNA sequence
atacattcataacctctgat

SEQ ID NO: 473027 - DNA, 20 bp, Artificial
  CRISPR gRNA sequence
ataacctctgatctcttaaa

SEQ ID NO: 473028 - DNA, 20 bp, Artificial
  CRISPR gRNA sequence
tgatctcttaaaggttccac

SEQ ID NO: 473029 - DNA, 20 bp, Artificial
  CRISPR gRNA sequence
atctcttaaaggttccacct

SEQ ID NO: 473030 - DNA, 20 bp, Artificial
  CRISPR gRNA sequence
ttaaaggttccacctcacaa

SEQ ID NO: 473031 - DNA, 20 bp, Artificial
  CRISPR gRNA sequence
aaaggttccacctcacaaaa

SEQ ID NO: 473032 - DNA, 20 bp, Artificial
  CRISPR gRNA sequence
aaggttccacctcacaaaac

SEQ ID NO: 473033 - DNA, 20 bp, Artificial
  CRISPR gRNA sequence
cacctcacaaaactgttaca

SEQ ID NO: 473034 - DNA, 20 bp, Artificial
  CRISPR gRNA sequence
acaaaactgttacaatagca

SEQ ID NO: 473035 - DNA, 20 bp, Artificial
  CRISPR gRNA sequence
ttacaatagcaataaaattt

SEQ ID NO: 473036 - DNA, 20 bp, Artificial
  CRISPR gRNA sequence
caatagcaataaaatttcaa

SEQ ID NO: 473037 - DNA, 20 bp, Artificial
  CRISPR gRNA sequence
caacatgaattttggagggg

SEQ ID NO: 473038 - DNA, 20 bp, Artificial
  CRISPR gRNA sequence
aacatgaattttggaggggg

SEQ ID NO: 473039 - DNA, 20 bp, Artificial
  CRISPR gRNA sequence
tggagggggcattcaaacca

SEQ ID NO: 473040 - DNA, 20 bp, Artificial
  CRISPR gRNA sequence
ggagggggcattcaaaccat

SEQ ID NO: 473041 - DNA, 20 bp, Artificial
  CRISPR gRNA sequence
gagggggcattcaaaccata

SEQ ID NO: 473042 - DNA, 20 bp, Artificial
  CRISPR gRNA sequence
aaaccatagcattctgcccc

SEQ ID NO: 473043 - DNA, 20 bp, Artificial
  CRISPR gRNA sequence
tgcccctggtcccccaaaac

SEQ ID NO: 473044 - DNA, 20 bp, Artificial
  CRISPR gRNA sequence
cccctggtcccccaaaactc

SEQ ID NO: 473045 - DNA, 20 bp, Artificial
  CRISPR gRNA sequence
gtcccccaaaactcatgttc

SEQ ID NO: 473046 - DNA, 20 bp, Artificial
  CRISPR gRNA sequence
atgttcttttcacatacaaa

SEQ ID NO: 473047 - DNA, 20 bp, Artificial
  CRISPR gRNA sequence
ttttcacatacaaaatacat

SEQ ID NO: 473048 - DNA, 20 bp, Artificial
  CRISPR gRNA sequence
ttcacatacaaaatacattc

SEQ ID NO: 473049 - DNA, 20 bp, Artificial
  CRISPR gRNA sequence
tcacatacaaaatacattca

SEQ ID NO: 473050 - DNA, 20 bp, Artificial
  CRISPR gRNA sequence
cacatacaaaatacattcat

SEQ ID NO: 473051 - DNA, 20 bp, Artificial
  CRISPR gRNA sequence
acatacaaaatacattcatt

SEQ ID NO: 473052 - DNA, 20 bp, Artificial
  CRISPR gRNA sequence
attccatctcaatagcccca

SEQ ID NO: 473053 - DNA, 20 bp, Artificial
  CRISPR gRNA sequence
catctcaatagccccaaaag

SEQ ID NO: 473054 - DNA, 20 bp, Artificial
  CRISPR gRNA sequence
aatagccccaaaagttttaa

SEQ ID NO: 473055 - DNA, 20 bp, Artificial
  CRISPR gRNA sequence
taatttattgcagaatcaat

SEQ ID NO: 473056 - DNA, 20 bp, Artificial
  CRISPR gRNA sequence
aatttattgcagaatcaatt

SEQ ID NO: 473057 - DNA, 20 bp, Artificial
  CRISPR gRNA sequence
atttattgcagaatcaattc

SEQ ID NO: 473058 - DNA, 20 bp, Artificial
  CRISPR gRNA sequence
attgcagaatcaattcaaaa

SEQ ID NO: 473059 - DNA, 20 bp, Artificial
  CRISPR gRNA sequence
ttgcagaatcaattcaaaac

SEQ ID NO: 473060 - DNA, 20 bp, Artificial
  CRISPR gRNA sequence
cagaatcaattcaaaacact

SEQ ID NO: 473061 - DNA, 20 bp, Artificial
  CRISPR gRNA sequence
aaaacactaaattcagagtc

SEQ ID NO: 473062 - DNA, 20 bp, Artificial
  CRISPR gRNA sequence
aattcagagtcttatctaaa

SEQ ID NO: 473063 - DNA, 20 bp, Artificial
  CRISPR gRNA sequence
agagtcttatctaaaccaga

SEQ ID NO: 473064 - DNA, 20 bp, Artificial
  CRISPR gRNA sequence
atctaaaccagatatgggta

SEQ ID NO: 473065 - DNA, 20 bp, Artificial
  CRISPR gRNA sequence
tctaaaccagatatgggtaa

SEQ ID NO: 473066 - DNA, 20 bp, Artificial
  CRISPR gRNA sequence
aaccagatatgggtaagatt

SEQ ID NO: 473067 - DNA, 20 bp, Artificial
  CRISPR gRNA sequence
aaggcacgattcattatgaa

SEQ ID NO: 473068 - DNA, 20 bp, Artificial
  CRISPR gRNA sequence
attatgaagcaaattccctc

SEQ ID NO: 473069 - DNA, 20 bp, Artificial
  CRISPR gRNA sequence
tgaagcaaattccctccaac

SEQ ID NO: 473070 - DNA, 20 bp, Artificial
  CRISPR gRNA sequence
cctccaactatgatcatgta

SEQ ID NO: 473071 - DNA, 20 bp, Artificial
  CRISPR gRNA sequence
caactatgatcatgtaaatc

SEQ ID NO: 473072 - DNA, 20 bp, Artificial
  CRISPR gRNA sequence
tgatcatgtaaatcaaaaca

SEQ ID NO: 473073 - DNA, 20 bp, Artificial
  CRISPR gRNA sequence
tctacttccaaaatatagtg

SEQ ID NO: 473074 - DNA, 20 bp, Artificial
  CRISPR gRNA sequence
cttccaaaatatagtggtag

SEQ ID NO: 473075 - DNA, 20 bp, Artificial
  CRISPR gRNA sequence
ccaaaatatagtggtaggac

SEQ ID NO: 473076 - DNA, 20 bp, Artificial
  CRISPR gRNA sequence
caaaatatagtggtaggaca

SEQ ID NO: 473077 - DNA, 20 bp, Artificial
  CRISPR gRNA sequence
ccattccaaaagggagaaat

SEQ ID NO: 473078 - DNA, 20 bp, Artificial
  CRISPR gRNA sequence
caaaagggagaaataggcaa

SEQ ID NO: 473079 - DNA, 20 bp, Artificial
  CRISPR gRNA sequence
ctaagtaagtccaaaaccca

SEQ ID NO: 473080 - DNA, 20 bp, Artificial
  CRISPR gRNA sequence
agtaagtccaaaacccaaca

SEQ ID NO: 473081 - DNA, 20 bp, Artificial
  CRISPR gRNA sequence
ctgggcttggttgatgcttc

SEQ ID NO: 473082 - DNA, 20 bp, Artificial
  CRISPR gRNA sequence
ggcttggttgatgcttcagc

SEQ ID NO: 473083 - DNA, 20 bp, Artificial
  CRISPR gRNA sequence
ggttgatgcttcagcactca

SEQ ID NO: 473084 - DNA, 20 bp, Artificial
  CRISPR gRNA sequence
gttgatgcttcagcactcac

SEQ ID NO: 473085 - DNA, 20 bp, Artificial
  CRISPR gRNA sequence
atgcttcagcactcacaagt

SEQ ID NO: 473086 - DNA, 20 bp, Artificial
  CRISPR gRNA sequence
cagcactcacaagttggaga

SEQ ID NO: 473087 - DNA, 20 bp, Artificial
  CRISPR gRNA sequence
agcactcacaagttggagac

SEQ ID NO: 473088 - DNA, 20 bp, Artificial
  CRISPR gRNA sequence
acaagttggagactcctacc

SEQ ID NO: 473089 - DNA, 20 bp, Artificial
  CRISPR gRNA sequence
gagactcctacctgcagctc

SEQ ID NO: 473090 - DNA, 20 bp, Artificial
  CRISPR gRNA sequence
ctacctgcagctctcccagg

SEQ ID NO: 473091 - DNA, 20 bp, Artificial
  CRISPR gRNA sequence
cctgcagctctcccaggcta

SEQ ID NO: 473092 - DNA, 20 bp, Artificial
  CRISPR gRNA sequence
cagctctcccaggctaatgc

SEQ ID NO: 473093 - DNA, 20 bp, Artificial
  CRISPR gRNA sequence
tcccaggctaatgcttcagg

SEQ ID NO: 473094 - DNA, 20 bp, Artificial
  CRISPR gRNA sequence
ccaggctaatgcttcaggct

SEQ ID NO: 473095 - DNA, 20 bp, Artificial
  CRISPR gRNA sequence
atgcttcaggctaatagctc

SEQ ID NO: 473096 - DNA, 20 bp, Artificial
  CRISPR gRNA sequence
caggctaatagctccacagt

SEQ ID NO: 473097 - DNA, 20 bp, Artificial
  CRISPR gRNA sequence
aggctaatagctccacagtt

SEQ ID NO: 473098 - DNA, 20 bp, Artificial
  CRISPR gRNA sequence
atagctccacagttctgggg

SEQ ID NO: 473099 - DNA, 20 bp, Artificial
  CRISPR gRNA sequence
cacagttctggggtctcagt

SEQ ID NO: 473100 - DNA, 20 bp, Artificial
  CRISPR gRNA sequence
tggggtctcagtggcagtcc

SEQ ID NO: 473101 - DNA, 20 bp, Artificial
  CRISPR gRNA sequence
gggtctcagtggcagtccac

SEQ ID NO: 473102 - DNA, 20 bp, Artificial
  CRISPR gRNA sequence
agtggcagtccactcccatg

SEQ ID NO: 473103 - DNA, 20 bp, Artificial
  CRISPR gRNA sequence
ccatggctctactaggcact

SEQ ID NO: 473104 - DNA, 20 bp, Artificial
  CRISPR gRNA sequence
tactaggcactgacatggga

SEQ ID NO: 473105 - DNA, 20 bp, Artificial
  CRISPR gRNA sequence
ctaggcactgacatgggagt

SEQ ID NO: 473106 - DNA, 20 bp, Artificial
  CRISPR gRNA sequence
ggcactgacatgggagtgga

SEQ ID NO: 473107 - DNA, 20 bp, Artificial
  CRISPR gRNA sequence
acatgggagtggactcttcc

SEQ ID NO: 473108 - DNA, 20 bp, Artificial
  CRISPR gRNA sequence
ttcctgggccctcaggctgt

SEQ ID NO: 473109 - DNA, 20 bp, Artificial
  CRISPR gRNA sequence
cctgggccctcaggctgtcc

SEQ ID NO: 473110 - DNA, 20 bp, Artificial
  CRISPR gRNA sequence
ctgggccctcaggctgtcca

SEQ ID NO: 473111 - DNA, 20 bp, Artificial
  CRISPR gRNA sequence
ggccctcaggctgtccacaa

SEQ ID NO: 473112 - DNA, 20 bp, Artificial
  CRISPR gRNA sequence
aggctgtccacaacatcctt

SEQ ID NO: 473113 - DNA, 20 bp, Artificial
  CRISPR gRNA sequence
tccacaacatcctttgaaat

SEQ ID NO: 473114 - DNA, 20 bp, Artificial
  CRISPR gRNA sequence
tgaaatctacatggaggaag

SEQ ID NO: 473115 - DNA, 20 bp, Artificial
  CRISPR gRNA sequence
gaaatctacatggaggaagt

SEQ ID NO: 473116 - DNA, 20 bp, Artificial
  CRISPR gRNA sequence
aaatctacatggaggaagtt

SEQ ID NO: 473117 - DNA, 20 bp, Artificial
  CRISPR gRNA sequence
catggaggaagttgtgttcc

SEQ ID NO: 473118 - DNA, 20 bp, Artificial
  CRISPR gRNA sequence
tgttccacacctcttgcatt

SEQ ID NO: 473119 - DNA, 20 bp, Artificial
  CRISPR gRNA sequence
cacacctcttgcattctgct

SEQ ID NO: 473120 - DNA, 20 bp, Artificial
  CRISPR gRNA sequence
ttgcattctgctagcctgca

SEQ ID NO: 473121 - DNA, 20 bp, Artificial
  CRISPR gRNA sequence
gcattctgctagcctgcaca

SEQ ID NO: 473122 - DNA, 20 bp, Artificial
  CRISPR gRNA sequence
cattctgctagcctgcacac

SEQ ID NO: 473123 - DNA, 20 bp, Artificial
  CRISPR gRNA sequence
tgctagcctgcacacttagc

SEQ ID NO: 473124 - DNA, 20 bp, Artificial
  CRISPR gRNA sequence
ctagcctgcacacttagcaa

SEQ ID NO: 473125 - DNA, 20 bp, Artificial
  CRISPR gRNA sequence
gcctgcacacttagcaagtg

SEQ ID NO: 473126 - DNA, 20 bp, Artificial
  CRISPR gRNA sequence
cacacttagcaagtgggtgc

SEQ ID NO: 473127 - DNA, 20 bp, Artificial
  CRISPR gRNA sequence
agcaagtgggtgccaccaag

SEQ ID NO: 473128 - DNA, 20 bp, Artificial
  CRISPR gRNA sequence
gcaagtgggtgccaccaagg

SEQ ID NO: 473129 - DNA, 20 bp, Artificial
  CRISPR gRNA sequence
accaattgcaccttatggag

SEQ ID NO: 473130 - DNA, 20 bp, Artificial
  CRISPR gRNA sequence
ccaattgcaccttatggagt

SEQ ID NO: 473131 - DNA, 20 bp, Artificial
  CRISPR gRNA sequence
caccttatggagtggtgggt

SEQ ID NO: 473132 - DNA, 20 bp, Artificial
  CRISPR gRNA sequence
atggagtggtgggttgaact

SEQ ID NO: 473133 - DNA, 20 bp, Artificial
  CRISPR gRNA sequence
tggagtggtgggttgaactg

SEQ ID NO: 473134 - DNA, 20 bp, Artificial
  CRISPR gRNA sequence
aactgcacctgggctcactt

SEQ ID NO: 473135 - DNA, 20 bp, Artificial
  CRISPR gRNA sequence
cacctgggctcacttgagcc

SEQ ID NO: 473136 - DNA, 20 bp, Artificial
  CRISPR gRNA sequence
ggctcacttgagccatggct

SEQ ID NO: 473137 - DNA, 20 bp, Artificial
  CRISPR gRNA sequence
acttgagccatggctggagc

SEQ ID NO: 473138 - DNA, 20 bp, Artificial
  CRISPR gRNA sequence
gagccatggctggagcagct

SEQ ID NO: 473139 - DNA, 20 bp, Artificial
  CRISPR gRNA sequence
agccatggctggagcagcta

SEQ ID NO: 473140 - DNA, 20 bp, Artificial
  CRISPR gRNA sequence
gagcagctaaggagcactgt

SEQ ID NO: 473141 - DNA, 20 bp, Artificial
  CRISPR gRNA sequence
aggagcactgtgctggaatt

SEQ ID NO: 473142 - DNA, 20 bp, Artificial
  CRISPR gRNA sequence
tgctggaattcagagaacag

SEQ ID NO: 473143 - DNA, 20 bp, Artificial
  CRISPR gRNA sequence
gaattcagagaacagaaacc

SEQ ID NO: 473144 - DNA, 20 bp, Artificial
  CRISPR gRNA sequence
agagaacagaaacctgaggc

SEQ ID NO: 473145 - DNA, 20 bp, Artificial
  CRISPR gRNA sequence
aggcagatctgggcagcaag

SEQ ID NO: 473146 - DNA, 20 bp, Artificial
  CRISPR gRNA sequence
ggcagcaagcctgtaaaggg

SEQ ID NO: 473147 - DNA, 20 bp, Artificial
  CRISPR gRNA sequence
taaagggcattctagtttcc

SEQ ID NO: 473148 - DNA, 20 bp, Artificial
  CRISPR gRNA sequence
tagtttcccctgaaatcaat

SEQ ID NO: 473149 - DNA, 20 bp, Artificial
  CRISPR gRNA sequence
gtttcccctgaaatcaattt

SEQ ID NO: 473150 - DNA, 20 bp, Artificial
  CRISPR gRNA sequence
cccctgaaatcaatttgccc

SEQ ID NO: 473151 - DNA, 20 bp, Artificial
  CRISPR gRNA sequence
ccctgaaatcaatttgccct

SEQ ID NO: 473152 - DNA, 20 bp, Artificial
  CRISPR gRNA sequence
aaatcaatttgccctctgag

SEQ ID NO: 473153 - DNA, 20 bp, Artificial
  CRISPR gRNA sequence
gccctctgagctctgagcct

SEQ ID NO: 473154 - DNA, 20 bp, Artificial
  CRISPR gRNA sequence
ccctctgagctctgagccta

SEQ ID NO: 473155 - DNA, 20 bp, Artificial
  CRISPR gRNA sequence
tgagctctgagcctatgatg

SEQ ID NO: 473156 - DNA, 20 bp, Artificial
  CRISPR gRNA sequence
agctctgagcctatgatggg

SEQ ID NO: 473157 - DNA, 20 bp, Artificial
  CRISPR gRNA sequence
tgagcctatgatgggagggg

SEQ ID NO: 473158 - DNA, 20 bp, Artificial
  CRISPR gRNA sequence
agcctatgatgggaggggca

SEQ ID NO: 473159 - DNA, 20 bp, Artificial
  CRISPR gRNA sequence
tgatgggaggggcagcctca

SEQ ID NO: 473160 - DNA, 20 bp, Artificial
  CRISPR gRNA sequence
aaaggctttgaaatgccttc

SEQ ID NO: 473161 - DNA, 20 bp, Artificial
  CRISPR gRNA sequence
tgaaatgccttcagggcctt

SEQ ID NO: 473162 - DNA, 20 bp, Artificial
  CRISPR gRNA sequence
gaaatgccttcagggccttt

SEQ ID NO: 473163 - DNA, 20 bp, Artificial
  CRISPR gRNA sequence
aaatgccttcagggcctttt

SEQ ID NO: 473164 - DNA, 20 bp, Artificial
  CRISPR gRNA sequence
cagggcctttttctcaactt

SEQ ID NO: 473165 - DNA, 20 bp, Artificial
  CRISPR gRNA sequence
agggcctttttctcaacttc

SEQ ID NO: 473166 - DNA, 20 bp, Artificial
  CRISPR gRNA sequence
tttctcaacttcttgaatag

SEQ ID NO: 473167 - DNA, 20 bp, Artificial
  CRISPR gRNA sequence
ttctcaacttcttgaatagt

SEQ ID NO: 473168 - DNA, 20 bp, Artificial
  CRISPR gRNA sequence
tctcaacttcttgaatagta

SEQ ID NO: 473169 - DNA, 20 bp, Artificial
  CRISPR gRNA sequence
ctcaacttcttgaatagtac

SEQ ID NO: 473170 - DNA, 20 bp, Artificial
  CRISPR gRNA sequence
tcaacttcttgaatagtact

SEQ ID NO: 473171 - DNA, 20 bp, Artificial
  CRISPR gRNA sequence
aacttcttgaatagtacttc

SEQ ID NO: 473172 - DNA, 20 bp, Artificial
  CRISPR gRNA sequence
cttgaatagtacttcactcc

SEQ ID NO: 473173 - DNA, 20 bp, Artificial
  CRISPR gRNA sequence
ttgaatagtacttcactccc

SEQ ID NO: 473174 - DNA, 20 bp, Artificial
  CRISPR gRNA sequence
gaatagtacttcactccctt

SEQ ID NO: 473175 - DNA, 20 bp, Artificial
  CRISPR gRNA sequence
aatagtacttcactcccttc

SEQ ID NO: 473176 - DNA, 20 bp, Artificial
  CRISPR gRNA sequence
cactcccttctatccatatt

SEQ ID NO: 473177 - DNA, 20 bp, Artificial
  CRISPR gRNA sequence
actcccttctatccatatta

SEQ ID NO: 473178 - DNA, 20 bp, Artificial
  CRISPR gRNA sequence
ccttctatccatattaatct

SEQ ID NO: 473179 - DNA, 20 bp, Artificial
  CRISPR gRNA sequence
ctatccatattaatctcttt

SEQ ID NO: 473180 - DNA, 20 bp, Artificial
  CRISPR gRNA sequence
tatccatattaatctcttta

SEQ ID NO: 473181 - DNA, 20 bp, Artificial
  CRISPR gRNA sequence
tccatattaatctctttaac

SEQ ID NO: 473182 - DNA, 20 bp, Artificial
  CRISPR gRNA sequence
atctctttaacaatggtcac

SEQ ID NO: 473183 - DNA, 20 bp, Artificial
  CRISPR gRNA sequence
tttaacaatggtcactaggc

SEQ ID NO: 473184 - DNA, 20 bp, Artificial
  CRISPR gRNA sequence
taacaatggtcactaggcca

SEQ ID NO: 473185 - DNA, 20 bp, Artificial
  CRISPR gRNA sequence
aacaatggtcactaggccac

SEQ ID NO: 473186 - DNA, 20 bp, Artificial
  CRISPR gRNA sequence
acaatggtcactaggccaca

SEQ ID NO: 473187 - DNA, 20 bp, Artificial
  CRISPR gRNA sequence
ggccacacccttagtatttt

SEQ ID NO: 473188 - DNA, 20 bp, Artificial
  CRISPR gRNA sequence
agtattttctcccattcatg

SEQ ID NO: 473189 - DNA, 20 bp, Artificial
  CRISPR gRNA sequence
gtattttctcccattcatgc

SEQ ID NO: 473190 - DNA, 20 bp, Artificial
  CRISPR gRNA sequence
tctcccattcatgccttttc

SEQ ID NO: 473191 - DNA, 20 bp, Artificial
  CRISPR gRNA sequence
ctcccattcatgccttttca

SEQ ID NO: 473192 - DNA, 20 bp, Artificial
  CRISPR gRNA sequence
tcccattcatgccttttcac

SEQ ID NO: 473193 - DNA, 20 bp, Artificial
  CRISPR gRNA sequence
ccattcatgccttttcactt

SEQ ID NO: 473194 - DNA, 20 bp, Artificial
  CRISPR gRNA sequence
atgccttttcactttttata

SEQ ID NO: 473195 - DNA, 20 bp, Artificial
  CRISPR gRNA sequence
ttcactttttatatggctag

SEQ ID NO: 473196 - DNA, 20 bp, Artificial
  CRISPR gRNA sequence
tcactttttatatggctagg

SEQ ID NO: 473197 - DNA, 20 bp, Artificial
  CRISPR gRNA sequence
cactttttatatggctaggc

SEQ ID NO: 473198 - DNA, 20 bp, Artificial
  CRISPR gRNA sequence
actttttatatggctaggca

SEQ ID NO: 473199 - DNA, 20 bp, Artificial
  CRISPR gRNA sequence
tttatatggctaggcagtga

SEQ ID NO: 473200 - DNA, 20 bp, Artificial
  CRISPR gRNA sequence
ttatatggctaggcagtgaa

SEQ ID NO: 473201 - DNA, 20 bp, Artificial
  CRISPR gRNA sequence
tatatggctaggcagtgaat

SEQ ID NO: 473202 - DNA, 20 bp, Artificial
  CRISPR gRNA sequence
atatggctaggcagtgaatt

SEQ ID NO: 473203 - DNA, 20 bp, Artificial
  CRISPR gRNA sequence
tatggctaggcagtgaattt

SEQ ID NO: 473204 - DNA, 20 bp, Artificial
  CRISPR gRNA sequence
ggcagtgaattttccaaatc

SEQ ID NO: 473205 - DNA, 20 bp, Artificial
  CRISPR gRNA sequence
tccaaatctttctattctgc

SEQ ID NO: 473206 - DNA, 20 bp, Artificial
  CRISPR gRNA sequence
ccaaatctttctattctgct

SEQ ID NO: 473207 - DNA, 20 bp, Artificial
  CRISPR gRNA sequence
caaatctttctattctgctt

SEQ ID NO: 473208 - DNA, 20 bp, Artificial
  CRISPR gRNA sequence
tctattctgcttctctttta

SEQ ID NO: 473209 - DNA, 20 bp, Artificial
  CRISPR gRNA sequence
ctattctgcttctcttttaa

SEQ ID NO: 473210 - DNA, 20 bp, Artificial
  CRISPR gRNA sequence
tattctgcttctcttttaat

SEQ ID NO: 473211 - DNA, 20 bp, Artificial
  CRISPR gRNA sequence
ttctgcttctcttttaatta

SEQ ID NO: 473212 - DNA, 20 bp, Artificial
  CRISPR gRNA sequence
tgcttctcttttaattataa

SEQ ID NO: 473213 - DNA, 20 bp, Artificial
  CRISPR gRNA sequence
cttctcttttaattataaat

SEQ ID NO: 473214 - DNA, 20 bp, Artificial
  CRISPR gRNA sequence
ctcttttaattataaattcc

SEQ ID NO: 473215 - DNA, 20 bp, Artificial
  CRISPR gRNA sequence
tcttttaattataaattcca

SEQ ID NO: 473216 - DNA, 20 bp, Artificial
  CRISPR gRNA sequence
ttttaattataaattccatt

SEQ ID NO: 473217 - DNA, 20 bp, Artificial
  CRISPR gRNA sequence
ttaattataaattccatttt

SEQ ID NO: 473218 - DNA, 20 bp, Artificial
  CRISPR gRNA sequence
taattataaattccattttt

SEQ ID NO: 473219 - DNA, 20 bp, Artificial
  CRISPR gRNA sequence
aattataaattccattttta

SEQ ID NO: 473220 - DNA, 20 bp, Artificial
  CRISPR gRNA sequence
attataaattccatttttaa

SEQ ID NO: 473221 - DNA, 20 bp, Artificial
  CRISPR gRNA sequence
taaattccatttttaagtca

SEQ ID NO: 473222 - DNA, 20 bp, Artificial
  CRISPR gRNA sequence
catttttaagtcattttttt

SEQ ID NO: 473223 - DNA, 20 bp, Artificial
  CRISPR gRNA sequence
ttaagtcatttttttccctc

SEQ ID NO: 473224 - DNA, 20 bp, Artificial
  CRISPR gRNA sequence
taagtcatttttttccctcc

SEQ ID NO: 473225 - DNA, 20 bp, Artificial
  CRISPR gRNA sequence
aagtcatttttttccctcct

SEQ ID NO: 473226 - DNA, 20 bp, Artificial
  CRISPR gRNA sequence
agtcatttttttccctcctg

SEQ ID NO: 473227 - DNA, 20 bp, Artificial
  CRISPR gRNA sequence
ttttccctcctgcctcttac

SEQ ID NO: 473228 - DNA, 20 bp, Artificial
  CRISPR gRNA sequence
tttccctcctgcctcttact

SEQ ID NO: 473229 - DNA, 20 bp, Artificial
  CRISPR gRNA sequence
ttccctcctgcctcttactg

SEQ ID NO: 473230 - DNA, 20 bp, Artificial
  CRISPR gRNA sequence
tccctcctgcctcttactgt

SEQ ID NO: 473231 - DNA, 20 bp, Artificial
  CRISPR gRNA sequence
ccctcctgcctcttactgta

SEQ ID NO: 473232 - DNA, 20 bp, Artificial
  CRISPR gRNA sequence
cctcctgcctcttactgtat

SEQ ID NO: 473233 - DNA, 20 bp, Artificial
  CRISPR gRNA sequence
ctgcctcttactgtatgcag

SEQ ID NO: 473234 - DNA, 20 bp, Artificial
  CRISPR gRNA sequence
cctcttactgtatgcagtta

SEQ ID NO: 473235 - DNA, 20 bp, Artificial
  CRISPR gRNA sequence
ttactgtatgcagttaaaag

SEQ ID NO: 473236 - DNA, 20 bp, Artificial
  CRISPR gRNA sequence
actgtatgcagttaaaagta

SEQ ID NO: 473237 - DNA, 20 bp, Artificial
  CRISPR gRNA sequence
ctgtatgcagttaaaagtag

SEQ ID NO: 473238 - DNA, 20 bp, Artificial
  CRISPR gRNA sequence
tatgcagttaaaagtagcca

SEQ ID NO: 473239 - DNA, 20 bp, Artificial
  CRISPR gRNA sequence
aaagtagccacacagcagcc

SEQ ID NO: 473240 - DNA, 20 bp, Artificial
  CRISPR gRNA sequence
aatgctttgcggcttagata

SEQ ID NO: 473241 - DNA, 20 bp, Artificial
  CRISPR gRNA sequence
tgcggcttagatatttcttc

SEQ ID NO: 473242 - DNA, 20 bp, Artificial
  CRISPR gRNA sequence
gcggcttagatatttcttcc

SEQ ID NO: 473243 - DNA, 20 bp, Artificial
  CRISPR gRNA sequence
cggcttagatatttcttcca

SEQ ID NO: 473244 - DNA, 20 bp, Artificial
  CRISPR gRNA sequence
agatatttcttccaccagat

SEQ ID NO: 473245 - DNA, 20 bp, Artificial
  CRISPR gRNA sequence
gatatttcttccaccagata

SEQ ID NO: 473246 - DNA, 20 bp, Artificial
  CRISPR gRNA sequence
cttccaccagatatcctgaa

SEQ ID NO: 473247 - DNA, 20 bp, Artificial
  CRISPR gRNA sequence
ttccaccagatatcctgaat

SEQ ID NO: 473248 - DNA, 20 bp, Artificial
  CRISPR gRNA sequence
ccaccagatatcctgaatta

SEQ ID NO: 473249 - DNA, 20 bp, Artificial
  CRISPR gRNA sequence
caccagatatcctgaattat

SEQ ID NO: 473250 - DNA, 20 bp, Artificial
  CRISPR gRNA sequence
aattattgctcttaatttct

SEQ ID NO: 473251 - DNA, 20 bp, Artificial
  CRISPR gRNA sequence
ttgctcttaatttctgcttt

SEQ ID NO: 473252 - DNA, 20 bp, Artificial
  CRISPR gRNA sequence
ctcttaatttctgctttccg

SEQ ID NO: 473253 - DNA, 20 bp, Artificial
  CRISPR gRNA sequence
ttaatttctgctttccgtaa

SEQ ID NO: 473254 - DNA, 20 bp, Artificial
  CRISPR gRNA sequence
aatttctgctttccgtaaag

SEQ ID NO: 473255 - DNA, 20 bp, Artificial
  CRISPR gRNA sequence
atttctgctttccgtaaagt

SEQ ID NO: 473256 - DNA, 20 bp, Artificial
  CRISPR gRNA sequence
ctgctttccgtaaagtccta

SEQ ID NO: 473257 - DNA, 20 bp, Artificial
  CRISPR gRNA sequence
tgctttccgtaaagtcctaa

SEQ ID NO: 473258 - DNA, 20 bp, Artificial
  CRISPR gRNA sequence
ctttccgtaaagtcctaaga

SEQ ID NO: 473259 - DNA, 20 bp, Artificial
  CRISPR gRNA sequence
tccgtaaagtcctaagacat

SEQ ID NO: 473260 - DNA, 20 bp, Artificial
  CRISPR gRNA sequence
ccgtaaagtcctaagacata

SEQ ID NO: 473261 - DNA, 20 bp, Artificial
  CRISPR gRNA sequence
cgtaaagtcctaagacatag

SEQ ID NO: 473262 - DNA, 20 bp, Artificial
  CRISPR gRNA sequence
agacatagatacatttccac

SEQ ID NO: 473263 - DNA, 20 bp, Artificial
  CRISPR gRNA sequence
ccaccaagttcttagcaact

SEQ ID NO: 473264 - DNA, 20 bp, Artificial
  CRISPR gRNA sequence
caccaagttcttagcaactg

SEQ ID NO: 473265 - DNA, 20 bp, Artificial
  CRISPR gRNA sequence
ttagcaactgtatgacaaga

SEQ ID NO: 473266 - DNA, 20 bp, Artificial
  CRISPR gRNA sequence
agcaactgtatgacaagaat

SEQ ID NO: 473267 - DNA, 20 bp, Artificial
  CRISPR gRNA sequence
gcaactgtatgacaagaatg

SEQ ID NO: 473268 - DNA, 20 bp, Artificial
  CRISPR gRNA sequence
tatgacaagaatggccttta

SEQ ID NO: 473269 - DNA, 20 bp, Artificial
  CRISPR gRNA sequence
tactccagtttccaatggct

SEQ ID NO: 473270 - DNA, 20 bp, Artificial
  CRISPR gRNA sequence
actccagtttccaatggctt

SEQ ID NO: 473271 - DNA, 20 bp, Artificial
  CRISPR gRNA sequence
ctccagtttccaatggcttg

SEQ ID NO: 473272 - DNA, 20 bp, Artificial
  CRISPR gRNA sequence
cagtttccaatggcttgttt

SEQ ID NO: 473273 - DNA, 20 bp, Artificial
  CRISPR gRNA sequence
ccaatggcttgtttctcatt

SEQ ID NO: 473274 - DNA, 20 bp, Artificial
  CRISPR gRNA sequence
caatggcttgtttctcattt

SEQ ID NO: 473275 - DNA, 20 bp, Artificial
  CRISPR gRNA sequence
gtttctcatttccttttagt

SEQ ID NO: 473276 - DNA, 20 bp, Artificial
  CRISPR gRNA sequence
tttctcatttccttttagtt

SEQ ID NO: 473277 - DNA, 20 bp, Artificial
  CRISPR gRNA sequence
ctcatttccttttagttatg

SEQ ID NO: 473278 - DNA, 20 bp, Artificial
  CRISPR gRNA sequence
tcatttccttttagttatgc

SEQ ID NO: 473279 - DNA, 20 bp, Artificial
  CRISPR gRNA sequence
atttccttttagttatgcac

SEQ ID NO: 473280 - DNA, 20 bp, Artificial
  CRISPR gRNA sequence
ccttttagttatgcacttgg

SEQ ID NO: 473281 - DNA, 20 bp, Artificial
  CRISPR gRNA sequence
cttttagttatgcacttggt

SEQ ID NO: 473282 - DNA, 20 bp, Artificial
  CRISPR gRNA sequence
ttagttatgcacttggtgtt

SEQ ID NO: 473283 - DNA, 20 bp, Artificial
  CRISPR gRNA sequence
tagttatgcacttggtgttg

SEQ ID NO: 473284 - DNA, 20 bp, Artificial
  CRISPR gRNA sequence
agttatgcacttggtgttga

SEQ ID NO: 473285 - DNA, 20 bp, Artificial
  CRISPR gRNA sequence
gttatgcacttggtgttgat

SEQ ID NO: 473286 - DNA, 20 bp, Artificial
  CRISPR gRNA sequence
tgcacttggtgttgatttgt

SEQ ID NO: 473287 - DNA, 20 bp, Artificial
  CRISPR gRNA sequence
ggtgttgatttgtatttttt

SEQ ID NO: 473288 - DNA, 20 bp, Artificial
  CRISPR gRNA sequence
gtgttgatttgtattttttt

SEQ ID NO: 473289 - DNA, 20 bp, Artificial
  CRISPR gRNA sequence
atttgtatttttttattttc

SEQ ID NO: 473290 - DNA, 20 bp, Artificial
  CRISPR gRNA sequence
gtatttttttattttccagt

SEQ ID NO: 473291 - DNA, 20 bp, Artificial
  CRISPR gRNA sequence
tatttttttattttccagta

SEQ ID NO: 473292 - DNA, 20 bp, Artificial
  CRISPR gRNA sequence
ttttattttccagtaaagtt

SEQ ID NO: 473293 - DNA, 20 bp, Artificial
  CRISPR gRNA sequence
tttattttccagtaaagtta

SEQ ID NO: 473294 - DNA, 20 bp, Artificial
  CRISPR gRNA sequence
ttattttccagtaaagttaa

SEQ ID NO: 473295 - DNA, 20 bp, Artificial
  CRISPR gRNA sequence
tattttccagtaaagttaag

SEQ ID NO: 473296 - DNA, 20 bp, Artificial
  CRISPR gRNA sequence
attttccagtaaagttaagg

SEQ ID NO: 473297 - DNA, 20 bp, Artificial
  CRISPR gRNA sequence
ttttccagtaaagttaaggc

SEQ ID NO: 473298 - DNA, 20 bp, Artificial
  CRISPR gRNA sequence
tccagtaaagttaaggctaa

SEQ ID NO: 473299 - DNA, 20 bp, Artificial
  CRISPR gRNA sequence
ccagtaaagttaaggctaag

SEQ ID NO: 473300 - DNA, 20 bp, Artificial
  CRISPR gRNA sequence
cagtaaagttaaggctaagc

SEQ ID NO: 473301 - DNA, 20 bp, Artificial
  CRISPR gRNA sequence
aggctaagcacgtgatccta

SEQ ID NO: 473302 - DNA, 20 bp, Artificial
  CRISPR gRNA sequence
agcacgtgatcctaaaagta

SEQ ID NO: 473303 - DNA, 20 bp, Artificial
  CRISPR gRNA sequence
aaagtattttcttttaaatt

SEQ ID NO: 473304 - DNA, 20 bp, Artificial
  CRISPR gRNA sequence
tcttttaaattatttttttc

SEQ ID NO: 473305 - DNA, 20 bp, Artificial
  CRISPR gRNA sequence
cttttaaattatttttttct

SEQ ID NO: 473306 - DNA, 20 bp, Artificial
  CRISPR gRNA sequence
ttttaaattatttttttctc

SEQ ID NO: 473307 - DNA, 20 bp, Artificial
  CRISPR gRNA sequence
ttaaattatttttttctcca

SEQ ID NO: 473308 - DNA, 20 bp, Artificial
  CRISPR gRNA sequence
taaattatttttttctccac

SEQ ID NO: 473309 - DNA, 20 bp, Artificial
  CRISPR gRNA sequence
aaattatttttttctccact

SEQ ID NO: 473310 - DNA, 20 bp, Artificial
  CRISPR gRNA sequence
aattatttttttctccactc

SEQ ID NO: 473311 - DNA, 20 bp, Artificial
  CRISPR gRNA sequence
tttttttctccactcttaca

SEQ ID NO: 473312 - DNA, 20 bp, Artificial
  CRISPR gRNA sequence
ttttctccactcttacagtt

SEQ ID NO: 473313 - DNA, 20 bp, Artificial
  CRISPR gRNA sequence
tttctccactcttacagttc

SEQ ID NO: 473314 - DNA, 20 bp, Artificial
  CRISPR gRNA sequence
ttctccactcttacagttct

SEQ ID NO: 473315 - DNA, 20 bp, Artificial
  CRISPR gRNA sequence
tctccactcttacagttctt

SEQ ID NO: 473316 - DNA, 20 bp, Artificial
  CRISPR gRNA sequence
ctccactcttacagttcttt

SEQ ID NO: 473317 - DNA, 20 bp, Artificial
  CRISPR gRNA sequence
tccactcttacagttctttc

SEQ ID NO: 473318 - DNA, 20 bp, Artificial
  CRISPR gRNA sequence
cactcttacagttctttctt

SEQ ID NO: 473319 - DNA, 20 bp, Artificial
  CRISPR gRNA sequence
ttacagttctttcttagcct

SEQ ID NO: 473320 - DNA, 20 bp, Artificial
  CRISPR gRNA sequence
acagttctttcttagccttt

SEQ ID NO: 473321 - DNA, 20 bp, Artificial
  CRISPR gRNA sequence
cagttctttcttagcctttc

SEQ ID NO: 473322 - DNA, 20 bp, Artificial
  CRISPR gRNA sequence
tttcttagcctttctttcta

SEQ ID NO: 473323 - DNA, 20 bp, Artificial
  CRISPR gRNA sequence
tcttagcctttctttctatg

SEQ ID NO: 473324 - DNA, 20 bp, Artificial
  CRISPR gRNA sequence
cttagcctttctttctatgt

SEQ ID NO: 473325 - DNA, 20 bp, Artificial
  CRISPR gRNA sequence
ttagcctttctttctatgtt

SEQ ID NO: 473326 - DNA, 20 bp, Artificial
  CRISPR gRNA sequence
agcctttctttctatgtttt

SEQ ID NO: 473327 - DNA, 20 bp, Artificial
  CRISPR gRNA sequence
gcctttctttctatgttttg

SEQ ID NO: 473328 - DNA, 20 bp, Artificial
  CRISPR gRNA sequence
tctttctatgttttgaacta

SEQ ID NO: 473329 - DNA, 20 bp, Artificial
  CRISPR gRNA sequence
ctttctatgttttgaactac

SEQ ID NO: 473330 - DNA, 20 bp, Artificial
  CRISPR gRNA sequence
tttctatgttttgaactacc

SEQ ID NO: 473331 - DNA, 20 bp, Artificial
  CRISPR gRNA sequence
tctatgttttgaactaccgt

SEQ ID NO: 473332 - DNA, 20 bp, Artificial
  CRISPR gRNA sequence
ctatgttttgaactaccgtc

SEQ ID NO: 473333 - DNA, 20 bp, Artificial
  CRISPR gRNA sequence
tatgttttgaactaccgtct

SEQ ID NO: 473334 - DNA, 20 bp, Artificial
  CRISPR gRNA sequence
tgttttgaactaccgtctct

SEQ ID NO: 473335 - DNA, 20 bp, Artificial
  CRISPR gRNA sequence
tgaactaccgtctctcttag

SEQ ID NO: 473336 - DNA, 20 bp, Artificial
  CRISPR gRNA sequence
gaactaccgtctctcttagc

SEQ ID NO: 473337 - DNA, 20 bp, Artificial
  CRISPR gRNA sequence
aactaccgtctctcttagca

SEQ ID NO: 473338 - DNA, 20 bp, Artificial
  CRISPR gRNA sequence
ccgtctctcttagcaatgtc

SEQ ID NO: 473339 - DNA, 20 bp, Artificial
  CRISPR gRNA sequence
tcttagcaatgtctagttca

SEQ ID NO: 473340 - DNA, 20 bp, Artificial
  CRISPR gRNA sequence
ttagcaatgtctagttcatc

SEQ ID NO: 473341 - DNA, 20 bp, Artificial
  CRISPR gRNA sequence
agcaatgtctagttcatctc

SEQ ID NO: 473342 - DNA, 20 bp, Artificial
  CRISPR gRNA sequence
gcaatgtctagttcatctcc

SEQ ID NO: 473343 - DNA, 20 bp, Artificial
  CRISPR gRNA sequence
gttcatctccttcatttatt

SEQ ID NO: 473344 - DNA, 20 bp, Artificial
  CRISPR gRNA sequence
atctccttcatttatttatt

SEQ ID NO: 473345 - DNA, 20 bp, Artificial
  CRISPR gRNA sequence
cttcatttatttatttcact

SEQ ID NO: 473346 - DNA, 20 bp, Artificial
  CRISPR gRNA sequence
catttatttatttcactcat

SEQ ID NO: 473347 - DNA, 20 bp, Artificial
  CRISPR gRNA sequence
atttatttatttcactcatt

SEQ ID NO: 473348 - DNA, 20 bp, Artificial
  CRISPR gRNA sequence
atttatttcactcattttca

SEQ ID NO: 473349 - DNA, 20 bp, Artificial
  CRISPR gRNA sequence
tttatttcactcattttcat

SEQ ID NO: 473350 - DNA, 20 bp, Artificial
  CRISPR gRNA sequence
atttcactcattttcatgca

SEQ ID NO: 473351 - DNA, 20 bp, Artificial
  CRISPR gRNA sequence
tttcactcattttcatgcat

SEQ ID NO: 473352 - DNA, 20 bp, Artificial
  CRISPR gRNA sequence
cactcattttcatgcattct

SEQ ID NO: 473353 - DNA, 20 bp, Artificial
  CRISPR gRNA sequence
actcattttcatgcattctt

SEQ ID NO: 473354 - DNA, 20 bp, Artificial
  CRISPR gRNA sequence
attttcatgcattcttctga

SEQ ID NO: 473355 - DNA, 20 bp, Artificial
  CRISPR gRNA sequence
tcatgcattcttctgaatag

SEQ ID NO: 473356 - DNA, 20 bp, Artificial
  CRISPR gRNA sequence
catgcattcttctgaataga

SEQ ID NO: 473357 - DNA, 20 bp, Artificial
  CRISPR gRNA sequence
atgcattcttctgaatagat

SEQ ID NO: 473358 - DNA, 20 bp, Artificial
  CRISPR gRNA sequence
ttctgaatagatgtacagta

SEQ ID NO: 473359 - DNA, 20 bp, Artificial
  CRISPR gRNA sequence
ctgaatagatgtacagtatc

SEQ ID NO: 473360 - DNA, 20 bp, Artificial
  CRISPR gRNA sequence
tgaatagatgtacagtatca

SEQ ID NO: 473361 - DNA, 20 bp, Artificial
  CRISPR gRNA sequence
aatagatgtacagtatcata

SEQ ID NO: 473362 - DNA, 20 bp, Artificial
  CRISPR gRNA sequence
gaatgacataagtgtaacag

SEQ ID NO: 473363 - DNA, 20 bp, Artificial
  CRISPR gRNA sequence
tcttttaaatacaaagacag

SEQ ID NO: 473364 - DNA, 20 bp, Artificial
  CRISPR gRNA sequence
ttttaaatacaaagacagct

SEQ ID NO: 473365 - DNA, 20 bp, Artificial
  CRISPR gRNA sequence
ttaaatacaaagacagctaa

SEQ ID NO: 473366 - DNA, 20 bp, Artificial
  CRISPR gRNA sequence
taaatacaaagacagctaaa

SEQ ID NO: 473367 - DNA, 20 bp, Artificial
  CRISPR gRNA sequence
aaatacaaagacagctaaag

SEQ ID NO: 473368 - DNA, 20 bp, Artificial
  CRISPR gRNA sequence
aatacaaagacagctaaagg

SEQ ID NO: 473369 - DNA, 20 bp, Artificial
  CRISPR gRNA sequence
aaggccttgcctgtgatcac

SEQ ID NO: 473370 - DNA, 20 bp, Artificial
  CRISPR gRNA sequence
gcctgtgatcacacagcttg

SEQ ID NO: 473371 - DNA, 20 bp, Artificial
  CRISPR gRNA sequence
cctgtgatcacacagcttgt

SEQ ID NO: 473372 - DNA, 20 bp, Artificial
  CRISPR gRNA sequence
tgatcacacagcttgtcaga

SEQ ID NO: 473373 - DNA, 20 bp, Artificial
  CRISPR gRNA sequence
gtcagatgttgaaccaagga

SEQ ID NO: 473374 - DNA, 20 bp, Artificial
  CRISPR gRNA sequence
tcagatgttgaaccaaggag

SEQ ID NO: 473375 - DNA, 20 bp, Artificial
  CRISPR gRNA sequence
aaccaaggagcaaattttga

SEQ ID NO: 473376 - DNA, 20 bp, Artificial
  CRISPR gRNA sequence
tgaccctgagtttctcatac

SEQ ID NO: 473377 - DNA, 20 bp, Artificial
  CRISPR gRNA sequence
gaccctgagtttctcataca

SEQ ID NO: 473378 - DNA, 20 bp, Artificial
  CRISPR gRNA sequence
accctgagtttctcatacat

SEQ ID NO: 473379 - DNA, 20 bp, Artificial
  CRISPR gRNA sequence
agtttctcatacatgtctat

SEQ ID NO: 473380 - DNA, 20 bp, Artificial
  CRISPR gRNA sequence
ctcatacatgtctatccaga

SEQ ID NO: 473381 - DNA, 20 bp, Artificial
  CRISPR gRNA sequence
tcatacatgtctatccagaa

SEQ ID NO: 473382 - DNA, 20 bp, Artificial
  CRISPR gRNA sequence
atacatgtctatccagaaca

SEQ ID NO: 473383 - DNA, 20 bp, Artificial
  CRISPR gRNA sequence
tccagaacaaggtttcacct

SEQ ID NO: 473384 - DNA, 20 bp, Artificial
  CRISPR gRNA sequence
caccttatttctacaccctt

SEQ ID NO: 473385 - DNA, 20 bp, Artificial
  CRISPR gRNA sequence
accttatttctacacccttg

SEQ ID NO: 473386 - DNA, 20 bp, Artificial
  CRISPR gRNA sequence
atttctacacccttgccagc

SEQ ID NO: 473387 - DNA, 20 bp, Artificial
  CRISPR gRNA sequence
tttctacacccttgccagca

SEQ ID NO: 473388 - DNA, 20 bp, Artificial
  CRISPR gRNA sequence
ctacacccttgccagcataa

SEQ ID NO: 473389 - DNA, 20 bp, Artificial
  CRISPR gRNA sequence
tacacccttgccagcataaa

SEQ ID NO: 473390 - DNA, 20 bp, Artificial
  CRISPR gRNA sequence
cacccttgccagcataaata

SEQ ID NO: 473391 - DNA, 20 bp, Artificial
  CRISPR gRNA sequence
gccagcataaatattctcat

SEQ ID NO: 473392 - DNA, 20 bp, Artificial
  CRISPR gRNA sequence
ccagcataaatattctcatt

SEQ ID NO: 473393 - DNA, 20 bp, Artificial
  CRISPR gRNA sequence
tcattttatctatttcctca

SEQ ID NO: 473394 - DNA, 20 bp, Artificial
  CRISPR gRNA sequence
attttatctatttcctcaca

SEQ ID NO: 473395 - DNA, 20 bp, Artificial
  CRISPR gRNA sequence
tatctatttcctcacaccta

SEQ ID NO: 473396 - DNA, 20 bp, Artificial
  CRISPR gRNA sequence
atctatttcctcacacctaa

SEQ ID NO: 473397 - DNA, 20 bp, Artificial
  CRISPR gRNA sequence
tctatttcctcacacctaat

SEQ ID NO: 473398 - DNA, 20 bp, Artificial
  CRISPR gRNA sequence
tttcctcacacctaatacac

SEQ ID NO: 473399 - DNA, 20 bp, Artificial
  CRISPR gRNA sequence
cctcacacctaatacacctt

SEQ ID NO: 473400 - DNA, 20 bp, Artificial
  CRISPR gRNA sequence
ctcacacctaatacaccttt

SEQ ID NO: 473401 - DNA, 20 bp, Artificial
  CRISPR gRNA sequence
acacctaatacacctttcac

SEQ ID NO: 473402 - DNA, 20 bp, Artificial
  CRISPR gRNA sequence
atacacctttcactcacatc

SEQ ID NO: 473403 - DNA, 20 bp, Artificial
  CRISPR gRNA sequence
tcactcacatcctacttaaa

SEQ ID NO: 473404 - DNA, 20 bp, Artificial
  CRISPR gRNA sequence
cactcacatcctacttaaaa

SEQ ID NO: 473405 - DNA, 20 bp, Artificial
  CRISPR gRNA sequence
actcacatcctacttaaaaa

SEQ ID NO: 473406 - DNA, 20 bp, Artificial
  CRISPR gRNA sequence
acatcctacttaaaaaccct

SEQ ID NO: 473407 - DNA, 20 bp, Artificial
  CRISPR gRNA sequence
cttaaaaacccttcctgctc

SEQ ID NO: 473408 - DNA, 20 bp, Artificial
  CRISPR gRNA sequence
aaaaacccttcctgctcaca

SEQ ID NO: 473409 - DNA, 20 bp, Artificial
  CRISPR gRNA sequence
aaaacccttcctgctcacat

SEQ ID NO: 473410 - DNA, 20 bp, Artificial
  CRISPR gRNA sequence
cctgctcacatctcatgaat

SEQ ID NO: 473411 - DNA, 20 bp, Artificial
  CRISPR gRNA sequence
ctgctcacatctcatgaatc

SEQ ID NO: 473412 - DNA, 20 bp, Artificial
  CRISPR gRNA sequence
ctcacatctcatgaatctct

SEQ ID NO: 473413 - DNA, 20 bp, Artificial
  CRISPR gRNA sequence
acatctcatgaatctctgct

SEQ ID NO: 473414 - DNA, 20 bp, Artificial
  CRISPR gRNA sequence
atgaatctctgctcagaata

SEQ ID NO: 473415 - DNA, 20 bp, Artificial
  CRISPR gRNA sequence
tgctcagaataatagaaacc

SEQ ID NO: 473416 - DNA, 20 bp, Artificial
  CRISPR gRNA sequence
ctcagaataatagaaacctg

SEQ ID NO: 473417 - DNA, 20 bp, Artificial
  CRISPR gRNA sequence
agaataatagaaacctgatt

SEQ ID NO: 473418 - DNA, 20 bp, Artificial
  CRISPR gRNA sequence
attgagtttccaggaatcag

SEQ ID NO: 473419 - DNA, 20 bp, Artificial
  CRISPR gRNA sequence
agtttccaggaatcagagtg

SEQ ID NO: 473420 - DNA, 20 bp, Artificial
  CRISPR gRNA sequence
ccaggaatcagagtgagaaa

SEQ ID NO: 473421 - DNA, 20 bp, Artificial
  CRISPR gRNA sequence
caggaatcagagtgagaaaa

SEQ ID NO: 473422 - DNA, 20 bp, Artificial
  CRISPR gRNA sequence
cagacaacttttagaacctc

SEQ ID NO: 473423 - DNA, 20 bp, Artificial
  CRISPR gRNA sequence
ttagaacctcttaatattta

SEQ ID NO: 473424 - DNA, 20 bp, Artificial
  CRISPR gRNA sequence
tagaacctcttaatatttat

SEQ ID NO: 473425 - DNA, 20 bp, Artificial
  CRISPR gRNA sequence
agaacctcttaatatttatt

SEQ ID NO: 473426 - DNA, 20 bp, Artificial
  CRISPR gRNA sequence
gaacctcttaatatttattt

SEQ ID NO: 473427 - DNA, 20 bp, Artificial
  CRISPR gRNA sequence
ttaatatttatttatttata

SEQ ID NO: 473428 - DNA, 20 bp, Artificial
  CRISPR gRNA sequence
aatatttatttatttataat

SEQ ID NO: 473429 - DNA, 20 bp, Artificial
  CRISPR gRNA sequence
atatttatttatttataatt

SEQ ID NO: 473430 - DNA, 20 bp, Artificial
  CRISPR gRNA sequence
atttatttataattgctttg

SEQ ID NO: 473431 - DNA, 20 bp, Artificial
  CRISPR gRNA sequence
tttatttataattgctttga

SEQ ID NO: 473432 - DNA, 20 bp, Artificial
  CRISPR gRNA sequence
atttataattgctttgagac

SEQ ID NO: 473433 - DNA, 20 bp, Artificial
  CRISPR gRNA sequence
tttataattgctttgagacc

SEQ ID NO: 473434 - DNA, 20 bp, Artificial
  CRISPR gRNA sequence
ataattgctttgagacctca

SEQ ID NO: 473435 - DNA, 20 bp, Artificial
  CRISPR gRNA sequence
taattgctttgagacctcaa

SEQ ID NO: 473436 - DNA, 20 bp, Artificial
  CRISPR gRNA sequence
ctttgagacctcaagcaagt

SEQ ID NO: 473437 - DNA, 20 bp, Artificial
  CRISPR gRNA sequence
tgagacctcaagcaagttca

SEQ ID NO: 473438 - DNA, 20 bp, Artificial
  CRISPR gRNA sequence
gagacctcaagcaagttcac

SEQ ID NO: 473439 - DNA, 20 bp, Artificial
  CRISPR gRNA sequence
agacctcaagcaagttcact

SEQ ID NO: 473440 - DNA, 20 bp, Artificial
  CRISPR gRNA sequence
aagcaagttcactttaagac

SEQ ID NO: 473441 - DNA, 20 bp, Artificial
  CRISPR gRNA sequence
actttaagacttcttaattc

SEQ ID NO: 473442 - DNA, 20 bp, Artificial
  CRISPR gRNA sequence
taagacttcttaattcagtt

SEQ ID NO: 473443 - DNA, 20 bp, Artificial
  CRISPR gRNA sequence
aagacttcttaattcagttg

SEQ ID NO: 473444 - DNA, 20 bp, Artificial
  CRISPR gRNA sequence
agacttcttaattcagttgc

SEQ ID NO: 473445 - DNA, 20 bp, Artificial
  CRISPR gRNA sequence
cttaattcagttgcttccaa

SEQ ID NO: 473446 - DNA, 20 bp, Artificial
  CRISPR gRNA sequence
ttaattcagttgcttccaaa

SEQ ID NO: 473447 - DNA, 20 bp, Artificial
  CRISPR gRNA sequence
aattcagttgcttccaaaag

SEQ ID NO: 473448 - DNA, 20 bp, Artificial
  CRISPR gRNA sequence
attcagttgcttccaaaagt

SEQ ID NO: 473449 - DNA, 20 bp, Artificial
  CRISPR gRNA sequence
agttgcttccaaaagtttag

SEQ ID NO: 473450 - DNA, 20 bp, Artificial
  CRISPR gRNA sequence
cttccaaaagtttagaacta

SEQ ID NO: 473451 - DNA, 20 bp, Artificial
  CRISPR gRNA sequence
ccaaaagtttagaactaaaa

SEQ ID NO: 473452 - DNA, 20 bp, Artificial
  CRISPR gRNA sequence
caaaagtttagaactaaaat

SEQ ID NO: 473453 - DNA, 20 bp, Artificial
  CRISPR gRNA sequence
agaactaaaatgaaaccaaa

SEQ ID NO: 473454 - DNA, 20 bp, Artificial
  CRISPR gRNA sequence
gaactaaaatgaaaccaaac

SEQ ID NO: 473455 - DNA, 20 bp, Artificial
  CRISPR gRNA sequence
aaatgaaaccaaactgaaag

SEQ ID NO: 473456 - DNA, 20 bp, Artificial
  CRISPR gRNA sequence
aaaggtaagttataaggatg

SEQ ID NO: 473457 - DNA, 20 bp, Artificial
  CRISPR gRNA sequence
taaggatgaggttttcaaaa

SEQ ID NO: 473458 - DNA, 20 bp, Artificial
  CRISPR gRNA sequence
tcaaaaaaatgaagagaaag

SEQ ID NO: 473459 - DNA, 20 bp, Artificial
  CRISPR gRNA sequence
caaaaaaatgaagagaaagg

SEQ ID NO: 473460 - DNA, 20 bp, Artificial
  CRISPR gRNA sequence
aaaaaaatgaagagaaaggg

SEQ ID NO: 473461 - DNA, 20 bp, Artificial
  CRISPR gRNA sequence
taccaaaaggaagtgtacct

SEQ ID NO: 473462 - DNA, 20 bp, Artificial
  CRISPR gRNA sequence
accaaaaggaagtgtacctg

SEQ ID NO: 473463 - DNA, 20 bp, Artificial
  CRISPR gRNA sequence
ccaaaaggaagtgtacctga

SEQ ID NO: 473464 - DNA, 20 bp, Artificial
  CRISPR gRNA sequence
aatgtggttagacttaggac

SEQ ID NO: 473465 - DNA, 20 bp, Artificial
  CRISPR gRNA sequence
gacttaggacaaaaaaagta

SEQ ID NO: 473466 - DNA, 20 bp, Artificial
  CRISPR gRNA sequence
aggacaaaaaaagtaagaag

SEQ ID NO: 473467 - DNA, 20 bp, Artificial
  CRISPR gRNA sequence
ggacaaaaaaagtaagaagg

SEQ ID NO: 473468 - DNA, 20 bp, Artificial
  CRISPR gRNA sequence
ttgtttccagaagtccgttc

SEQ ID NO: 473469 - DNA, 20 bp, Artificial
  CRISPR gRNA sequence
gtttccagaagtccgttcct

SEQ ID NO: 473470 - DNA, 20 bp, Artificial
  CRISPR gRNA sequence
tttccagaagtccgttcctc

SEQ ID NO: 473471 - DNA, 20 bp, Artificial
  CRISPR gRNA sequence
ccagaagtccgttcctctcc

SEQ ID NO: 473472 - DNA, 20 bp, Artificial
  CRISPR gRNA sequence
cagaagtccgttcctctccc

SEQ ID NO: 473473 - DNA, 20 bp, Artificial
  CRISPR gRNA sequence
ctctccctgaagttaataga

SEQ ID NO: 473474 - DNA, 20 bp, Artificial
  CRISPR gRNA sequence
tccctgaagttaatagactc

SEQ ID NO: 473475 - DNA, 20 bp, Artificial
  CRISPR gRNA sequence
cctgaagttaatagactccc

SEQ ID NO: 473476 - DNA, 20 bp, Artificial
  CRISPR gRNA sequence
aagttaatagactccctcag

SEQ ID NO: 473477 - DNA, 20 bp, Artificial
  CRISPR gRNA sequence
atagactccctcagcctcct

SEQ ID NO: 473478 - DNA, 20 bp, Artificial
  CRISPR gRNA sequence
cctcagcctcctaacttccc

SEQ ID NO: 473479 - DNA, 20 bp, Artificial
  CRISPR gRNA sequence
agcctcctaacttccctttt

SEQ ID NO: 473480 - DNA, 20 bp, Artificial
  CRISPR gRNA sequence
ctaacttcccttttcatttt

SEQ ID NO: 473481 - DNA, 20 bp, Artificial
  CRISPR gRNA sequence
acttcccttttcattttctt

SEQ ID NO: 473482 - DNA, 20 bp, Artificial
  CRISPR gRNA sequence
cccttttcattttcttggat

SEQ ID NO: 473483 - DNA, 20 bp, Artificial
  CRISPR gRNA sequence
ccttttcattttcttggata

SEQ ID NO: 473484 - DNA, 20 bp, Artificial
  CRISPR gRNA sequence
ttcattttcttggataagtc

SEQ ID NO: 473485 - DNA, 20 bp, Artificial
  CRISPR gRNA sequence
tcattttcttggataagtca

SEQ ID NO: 473486 - DNA, 20 bp, Artificial
  CRISPR gRNA sequence
cattttcttggataagtcaa

SEQ ID NO: 473487 - DNA, 20 bp, Artificial
  CRISPR gRNA sequence
attttcttggataagtcaat

SEQ ID NO: 473488 - DNA, 20 bp, Artificial
  CRISPR gRNA sequence
tcttggataagtcaataatg

SEQ ID NO: 473489 - DNA, 20 bp, Artificial
  CRISPR gRNA sequence
cttggataagtcaataatgg

SEQ ID NO: 473490 - DNA, 20 bp, Artificial
  CRISPR gRNA sequence
ttggataagtcaataatggt

SEQ ID NO: 473491 - DNA, 20 bp, Artificial
  CRISPR gRNA sequence
ggataagtcaataatggttt

SEQ ID NO: 473492 - DNA, 20 bp, Artificial
  CRISPR gRNA sequence
gataagtcaataatggttta

SEQ ID NO: 473493 - DNA, 20 bp, Artificial
  CRISPR gRNA sequence
atggagcctctaagtctgtg

SEQ ID NO: 473494 - DNA, 20 bp, Artificial
  CRISPR gRNA sequence
tggagcctctaagtctgtgc

SEQ ID NO: 473495 - DNA, 20 bp, Artificial
  CRISPR gRNA sequence
taagtctgtgctagaattat

SEQ ID NO: 473496 - DNA, 20 bp, Artificial
  CRISPR gRNA sequence
agtctgtgctagaattataa

SEQ ID NO: 473497 - DNA, 20 bp, Artificial
  CRISPR gRNA sequence
tgctagaattataaaaaaca

SEQ ID NO: 473498 - DNA, 20 bp, Artificial
  CRISPR gRNA sequence
gaattataaaaaacaatgag

SEQ ID NO: 473499 - DNA, 20 bp, Artificial
  CRISPR gRNA sequence
taaaaaacaatgagatggtt

SEQ ID NO: 473500 - DNA, 20 bp, Artificial
  CRISPR gRNA sequence
tagacaaagatcttttaccc

SEQ ID NO: 473501 - DNA, 20 bp, Artificial
  CRISPR gRNA sequence
ttaccctcaaagagtttacc

SEQ ID NO: 473502 - DNA, 20 bp, Artificial
  CRISPR gRNA sequence
taccctcaaagagtttacca

SEQ ID NO: 473503 - DNA, 20 bp, Artificial
  CRISPR gRNA sequence
accctcaaagagtttaccat

SEQ ID NO: 473504 - DNA, 20 bp, Artificial
  CRISPR gRNA sequence
ccctcaaagagtttaccatt

SEQ ID NO: 473505 - DNA, 20 bp, Artificial
  CRISPR gRNA sequence
aaagagtttaccatttaatt

SEQ ID NO: 473506 - DNA, 20 bp, Artificial
  CRISPR gRNA sequence
accatttaattggtaagccc

SEQ ID NO: 473507 - DNA, 20 bp, Artificial
  CRISPR gRNA sequence
ccatttaattggtaagcccc

SEQ ID NO: 473508 - DNA, 20 bp, Artificial
  CRISPR gRNA sequence
aattggtaagccccaggagt

SEQ ID NO: 473509 - DNA, 20 bp, Artificial
  CRISPR gRNA sequence
attggtaagccccaggagta

SEQ ID NO: 473510 - DNA, 20 bp, Artificial
  CRISPR gRNA sequence
gtaagccccaggagtatcta

SEQ ID NO: 473511 - DNA, 20 bp, Artificial
  CRISPR gRNA sequence
acaaagagggcacctttctt

SEQ ID NO: 473512 - DNA, 20 bp, Artificial
  CRISPR gRNA sequence
tctttttttttttttttttt

SEQ ID NO: 473513 - DNA, 20 bp, Artificial
  CRISPR gRNA sequence
cttttttttttttttttttt

SEQ ID NO: 473514 - DNA, 20 bp, Artificial
  CRISPR gRNA sequence
tttttttttttttttttttt

SEQ ID NO: 473515 - DNA, 20 bp, Artificial
  CRISPR gRNA sequence
tttttttttttttttttttt

SEQ ID NO: 473516 - DNA, 20 bp, Artificial
  CRISPR gRNA sequence
tttttttttttttttttttt

SEQ ID NO: 473517 - DNA, 20 bp, Artificial
  CRISPR gRNA sequence
tttttttttttttttttttt

SEQ ID NO: 473518 - DNA, 20 bp, Artificial
  CRISPR gRNA sequence
tttttttttttttttttttg

SEQ ID NO: 473519 - DNA, 20 bp, Artificial
  CRISPR gRNA sequence
ttttttttttttttttttga

SEQ ID NO: 473520 - DNA, 20 bp, Artificial
  CRISPR gRNA sequence
tttttttttttttttttgag

SEQ ID NO: 473521 - DNA, 20 bp, Artificial
  CRISPR gRNA sequence
ttttttttttttttttgaga

SEQ ID NO: 473522 - DNA, 20 bp, Artificial
  CRISPR gRNA sequence
tttttttttttttttgagac

SEQ ID NO: 473523 - DNA, 20 bp, Artificial
  CRISPR gRNA sequence
ttttttttttttttgagaca

SEQ ID NO: 473524 - DNA, 20 bp, Artificial
  CRISPR gRNA sequence
tttttttttttttgagacaa

SEQ ID NO: 473525 - DNA, 20 bp, Artificial
  CRISPR gRNA sequence
ttttttttttttgagacaag

SEQ ID NO: 473526 - DNA, 20 bp, Artificial
  CRISPR gRNA sequence
tttttttttttgagacaaga

SEQ ID NO: 473527 - DNA, 20 bp, Artificial
  CRISPR gRNA sequence
ttttttttttgagacaagag

SEQ ID NO: 473528 - DNA, 20 bp, Artificial
  CRISPR gRNA sequence
tttttttttgagacaagagt

SEQ ID NO: 473529 - DNA, 20 bp, Artificial
  CRISPR gRNA sequence
ttttttttgagacaagagtt

SEQ ID NO: 473530 - DNA, 20 bp, Artificial
  CRISPR gRNA sequence
tttttttgagacaagagttt

SEQ ID NO: 473531 - DNA, 20 bp, Artificial
  CRISPR gRNA sequence
ttttttgagacaagagtttc

SEQ ID NO: 473532 - DNA, 20 bp, Artificial
  CRISPR gRNA sequence
tttttgagacaagagtttca

SEQ ID NO: 473533 - DNA, 20 bp, Artificial
  CRISPR gRNA sequence
ttttgagacaagagtttcac

SEQ ID NO: 473534 - DNA, 20 bp, Artificial
  CRISPR gRNA sequence
tttgagacaagagtttcact

SEQ ID NO: 473535 - DNA, 20 bp, Artificial
  CRISPR gRNA sequence
ttgagacaagagtttcactc

SEQ ID NO: 473536 - DNA, 20 bp, Artificial
  CRISPR gRNA sequence
tgagacaagagtttcactct

SEQ ID NO: 473537 - DNA, 20 bp, Artificial
  CRISPR gRNA sequence
gagacaagagtttcactctt

SEQ ID NO: 473538 - DNA, 20 bp, Artificial
  CRISPR gRNA sequence
agacaagagtttcactcttg

SEQ ID NO: 473539 - DNA, 20 bp, Artificial
  CRISPR gRNA sequence
cactcttgttgcacaggctg

SEQ ID NO: 473540 - DNA, 20 bp, Artificial
  CRISPR gRNA sequence
actcttgttgcacaggctgg

SEQ ID NO: 473541 - DNA, 20 bp, Artificial
  CRISPR gRNA sequence
ttgttgcacaggctggaatg

SEQ ID NO: 473542 - DNA, 20 bp, Artificial
  CRISPR gRNA sequence
gttgcacaggctggaatgca

SEQ ID NO: 473543 - DNA, 20 bp, Artificial
  CRISPR gRNA sequence
ttgcacaggctggaatgcaa

SEQ ID NO: 473544 - DNA, 20 bp, Artificial
  CRISPR gRNA sequence
cacaggctggaatgcaatgg

SEQ ID NO: 473545 - DNA, 20 bp, Artificial
  CRISPR gRNA sequence
gaatgcaatggcatgatctc

SEQ ID NO: 473546 - DNA, 20 bp, Artificial
  CRISPR gRNA sequence
ggctcaccgtaacctctgcc

SEQ ID NO: 473547 - DNA, 20 bp, Artificial
  CRISPR gRNA sequence
accgtaacctctgcctcccg

SEQ ID NO: 473548 - DNA, 20 bp, Artificial
  CRISPR gRNA sequence
tgcctcccgggtttaagcga

SEQ ID NO: 473549 - DNA, 20 bp, Artificial
  CRISPR gRNA sequence
cctcccgggtttaagcgatt

SEQ ID NO: 473550 - DNA, 20 bp, Artificial
  CRISPR gRNA sequence
ccgggtttaagcgattctcc

SEQ ID NO: 473551 - DNA, 20 bp, Artificial
  CRISPR gRNA sequence
aagcgattctcctgcctcag

SEQ ID NO: 473552 - DNA, 20 bp, Artificial
  CRISPR gRNA sequence
agcgattctcctgcctcagc

SEQ ID NO: 473553 - DNA, 20 bp, Artificial
  CRISPR gRNA sequence
tcctgcctcagcctcccggg

SEQ ID NO: 473554 - DNA, 20 bp, Artificial
  CRISPR gRNA sequence
ctgcctcagcctcccgggta

SEQ ID NO: 473555 - DNA, 20 bp, Artificial
  CRISPR gRNA sequence
cctcagcctcccgggtaact

SEQ ID NO: 473556 - DNA, 20 bp, Artificial
  CRISPR gRNA sequence
agcctcccgggtaactggga

SEQ ID NO: 473557 - DNA, 20 bp, Artificial
  CRISPR gRNA sequence
ccgggtaactgggattacag

SEQ ID NO: 473558 - DNA, 20 bp, Artificial
  CRISPR gRNA sequence
ggattacaggcgcccaccac

SEQ ID NO: 473559 - DNA, 20 bp, Artificial
  CRISPR gRNA sequence
caggcgcccaccaccacgcc

SEQ ID NO: 473560 - DNA, 20 bp, Artificial
  CRISPR gRNA sequence
attttgtatttttagtaaag

SEQ ID NO: 473561 - DNA, 20 bp, Artificial
  CRISPR gRNA sequence
tgtatttttagtaaagacgg

SEQ ID NO: 473562 - DNA, 20 bp, Artificial
  CRISPR gRNA sequence
gtatttttagtaaagacggg

SEQ ID NO: 473563 - DNA, 20 bp, Artificial
  CRISPR gRNA sequence
tatttttagtaaagacggga

SEQ ID NO: 473564 - DNA, 20 bp, Artificial
  CRISPR gRNA sequence
ttagtaaagacgggatttct

SEQ ID NO: 473565 - DNA, 20 bp, Artificial
  CRISPR gRNA sequence
tagtaaagacgggatttctt

SEQ ID NO: 473566 - DNA, 20 bp, Artificial
  CRISPR gRNA sequence
agtaaagacgggatttcttt

SEQ ID NO: 473567 - DNA, 20 bp, Artificial
  CRISPR gRNA sequence
gtaaagacgggatttcttta

SEQ ID NO: 473568 - DNA, 20 bp, Artificial
  CRISPR gRNA sequence
ctttatgttggtcaggctgg

SEQ ID NO: 473569 - DNA, 20 bp, Artificial
  CRISPR gRNA sequence
tttatgttggtcaggctggt

SEQ ID NO: 473570 - DNA, 20 bp, Artificial
  CRISPR gRNA sequence
tatgttggtcaggctggtct

SEQ ID NO: 473571 - DNA, 20 bp, Artificial
  CRISPR gRNA sequence
atgttggtcaggctggtctt

SEQ ID NO: 473572 - DNA, 20 bp, Artificial
  CRISPR gRNA sequence
tgttggtcaggctggtcttg

SEQ ID NO: 473573 - DNA, 20 bp, Artificial
  CRISPR gRNA sequence
gtcaggctggtcttgaactc

SEQ ID NO: 473574 - DNA, 20 bp, Artificial
  CRISPR gRNA sequence
gtcttgaactcccaacctga

SEQ ID NO: 473575 - DNA, 20 bp, Artificial
  CRISPR gRNA sequence
gaactcccaacctgaggtga

SEQ ID NO: 473576 - DNA, 20 bp, Artificial
  CRISPR gRNA sequence
aactcccaacctgaggtgat

SEQ ID NO: 473577 - DNA, 20 bp, Artificial
  CRISPR gRNA sequence
ccaacctgaggtgatcagct

SEQ ID NO: 473578 - DNA, 20 bp, Artificial
  CRISPR gRNA sequence
aggtgatcagctcatctcgg

SEQ ID NO: 473579 - DNA, 20 bp, Artificial
  CRISPR gRNA sequence
atctcggcctcccaaagtgc

SEQ ID NO: 473580 - DNA, 20 bp, Artificial
  CRISPR gRNA sequence
ggcctcccaaagtgctggga

SEQ ID NO: 473581 - DNA, 20 bp, Artificial
  CRISPR gRNA sequence
ccaaagtgctgggattacag

SEQ ID NO: 473582 - DNA, 20 bp, Artificial
  CRISPR gRNA sequence
ggattacaggcttgagccac

SEQ ID NO: 473583 - DNA, 20 bp, Artificial
  CRISPR gRNA sequence
caggcttgagccaccacacc

SEQ ID NO: 473584 - DNA, 20 bp, Artificial
  CRISPR gRNA sequence
gagccaccacacctggccag

SEQ ID NO: 473585 - DNA, 20 bp, Artificial
  CRISPR gRNA sequence
agccaccacacctggccaga

SEQ ID NO: 473586 - DNA, 20 bp, Artificial
  CRISPR gRNA sequence
gccagaatcaatttaccttc

SEQ ID NO: 473587 - DNA, 20 bp, Artificial
  CRISPR gRNA sequence
accttctagacacttttcta

SEQ ID NO: 473588 - DNA, 20 bp, Artificial
  CRISPR gRNA sequence
ccttctagacacttttctag

SEQ ID NO: 473589 - DNA, 20 bp, Artificial
  CRISPR gRNA sequence
ctagacacttttctagaatc

SEQ ID NO: 473590 - DNA, 20 bp, Artificial
  CRISPR gRNA sequence
tagacacttttctagaatca

SEQ ID NO: 473591 - DNA, 20 bp, Artificial
  CRISPR gRNA sequence
gacacttttctagaatcaat

SEQ ID NO: 473592 - DNA, 20 bp, Artificial
  CRISPR gRNA sequence
ttctagaatcaatttactat

SEQ ID NO: 473593 - DNA, 20 bp, Artificial
  CRISPR gRNA sequence
tctagaatcaatttactata

SEQ ID NO: 473594 - DNA, 20 bp, Artificial
  CRISPR gRNA sequence
ctagaatcaatttactatat

SEQ ID NO: 473595 - DNA, 20 bp, Artificial
  CRISPR gRNA sequence
tagaatcaatttactatata

SEQ ID NO: 473596 - DNA, 20 bp, Artificial
  CRISPR gRNA sequence
gaatcaatttactatatacc

SEQ ID NO: 473597 - DNA, 20 bp, Artificial
  CRISPR gRNA sequence
actatataccagtctttatt

SEQ ID NO: 473598 - DNA, 20 bp, Artificial
  CRISPR gRNA sequence
ctatataccagtctttattt

SEQ ID NO: 473599 - DNA, 20 bp, Artificial
  CRISPR gRNA sequence
tataccagtctttatttctt

SEQ ID NO: 473600 - DNA, 20 bp, Artificial
  CRISPR gRNA sequence
tatttctttcagtttactga

SEQ ID NO: 473601 - DNA, 20 bp, Artificial
  CRISPR gRNA sequence
atttctttcagtttactgag

SEQ ID NO: 473602 - DNA, 20 bp, Artificial
  CRISPR gRNA sequence
tttctttcagtttactgagc

SEQ ID NO: 473603 - DNA, 20 bp, Artificial
  CRISPR gRNA sequence
ctttcagtttactgagctga

SEQ ID NO: 473604 - DNA, 20 bp, Artificial
  CRISPR gRNA sequence
tttcagtttactgagctgaa

SEQ ID NO: 473605 - DNA, 20 bp, Artificial
  CRISPR gRNA sequence
tcagtttactgagctgaaag

SEQ ID NO: 473606 - DNA, 20 bp, Artificial
  CRISPR gRNA sequence
cagtttactgagctgaaagc

SEQ ID NO: 473607 - DNA, 20 bp, Artificial
  CRISPR gRNA sequence
agtttactgagctgaaagca

SEQ ID NO: 473608 - DNA, 20 bp, Artificial
  CRISPR gRNA sequence
actgagctgaaagcaagcct

SEQ ID NO: 473609 - DNA, 20 bp, Artificial
  CRISPR gRNA sequence
ctgagctgaaagcaagcctt

SEQ ID NO: 473610 - DNA, 20 bp, Artificial
  CRISPR gRNA sequence
agctgaaagcaagccttgag

SEQ ID NO: 473611 - DNA, 20 bp, Artificial
  CRISPR gRNA sequence
aaagcaagccttgagggacg

SEQ ID NO: 473612 - DNA, 20 bp, Artificial
  CRISPR gRNA sequence
gagggacgttgcatgctggt

SEQ ID NO: 473613 - DNA, 20 bp, Artificial
  CRISPR gRNA sequence
agggacgttgcatgctggtt

SEQ ID NO: 473614 - DNA, 20 bp, Artificial
  CRISPR gRNA sequence
catgctggttgttaggaagc

SEQ ID NO: 473615 - DNA, 20 bp, Artificial
  CRISPR gRNA sequence
gttgttaggaagcctaggaa

SEQ ID NO: 473616 - DNA, 20 bp, Artificial
  CRISPR gRNA sequence
ttaggaagcctaggaataaa

SEQ ID NO: 473617 - DNA, 20 bp, Artificial
  CRISPR gRNA sequence
ggaagcctaggaataaatca

SEQ ID NO: 473618 - DNA, 20 bp, Artificial
  CRISPR gRNA sequence
ggaataaatcagataggatg

SEQ ID NO: 473619 - DNA, 20 bp, Artificial
  CRISPR gRNA sequence
catttgtggagcttgccttc

SEQ ID NO: 473620 - DNA, 20 bp, Artificial
  CRISPR gRNA sequence
gtggagcttgccttctaatg

SEQ ID NO: 473621 - DNA, 20 bp, Artificial
  CRISPR gRNA sequence
tggagcttgccttctaatgg

SEQ ID NO: 473622 - DNA, 20 bp, Artificial
  CRISPR gRNA sequence
gccttctaatgggaaataaa

SEQ ID NO: 473623 - DNA, 20 bp, Artificial
  CRISPR gRNA sequence
ccttctaatgggaaataaaa

SEQ ID NO: 473624 - DNA, 20 bp, Artificial
  CRISPR gRNA sequence
ctaatgggaaataaaaatga

SEQ ID NO: 473625 - DNA, 20 bp, Artificial
  CRISPR gRNA sequence
taatgggaaataaaaatgaa

SEQ ID NO: 473626 - DNA, 20 bp, Artificial
  CRISPR gRNA sequence
atgggaaataaaaatgaatg

SEQ ID NO: 473627 - DNA, 20 bp, Artificial
  CRISPR gRNA sequence
ggagagtgttatataacact

SEQ ID NO: 473628 - DNA, 20 bp, Artificial
  CRISPR gRNA sequence
tataacactgtaaagaggta

SEQ ID NO: 473629 - DNA, 20 bp, Artificial
  CRISPR gRNA sequence
taaagaggtacaaacaaggc

SEQ ID NO: 473630 - DNA, 20 bp, Artificial
  CRISPR gRNA sequence
acgcctgtaatcccagcact

SEQ ID NO: 473631 - DNA, 20 bp, Artificial
  CRISPR gRNA sequence
taatcccagcactttgggag

SEQ ID NO: 473632 - DNA, 20 bp, Artificial
  CRISPR gRNA sequence
tgggaggccgagggaggtgg

SEQ ID NO: 473633 - DNA, 20 bp, Artificial
  CRISPR gRNA sequence
gggaggccgagggaggtgga

SEQ ID NO: 473634 - DNA, 20 bp, Artificial
  CRISPR gRNA sequence
ggaggccgagggaggtggat

SEQ ID NO: 473635 - DNA, 20 bp, Artificial
  CRISPR gRNA sequence
aggtcaggagtttaagacca

SEQ ID NO: 473636 - DNA, 20 bp, Artificial
  CRISPR gRNA sequence
aagaccagcctgaccaacat

SEQ ID NO: 473637 - DNA, 20 bp, Artificial
  CRISPR gRNA sequence
agaccagcctgaccaacatg

SEQ ID NO: 473638 - DNA, 20 bp, Artificial
  CRISPR gRNA sequence
accaacatggtgaaacaccg

SEQ ID NO: 473639 - DNA, 20 bp, Artificial
  CRISPR gRNA sequence
tactaaaaatacaaaaatta

SEQ ID NO: 473640 - DNA, 20 bp, Artificial
  CRISPR gRNA sequence
actaaaaatacaaaaattag

SEQ ID NO: 473641 - DNA, 20 bp, Artificial
  CRISPR gRNA sequence
ctaaaaatacaaaaattagc

SEQ ID NO: 473642 - DNA, 20 bp, Artificial
  CRISPR gRNA sequence
aaaatacaaaaattagccag

SEQ ID NO: 473643 - DNA, 20 bp, Artificial
  CRISPR gRNA sequence
gccaggtgtggtggtgcgtg

SEQ ID NO: 473644 - DNA, 20 bp, Artificial
  CRISPR gRNA sequence
taatcccagctactcaagag

SEQ ID NO: 473645 - DNA, 20 bp, Artificial
  CRISPR gRNA sequence
ctcaagaggctgaggcagga

SEQ ID NO: 473646 - DNA, 20 bp, Artificial
  CRISPR gRNA sequence
aagaggctgaggcaggagaa

SEQ ID NO: 473647 - DNA, 20 bp, Artificial
  CRISPR gRNA sequence
aggcaggagaattgcttgaa

SEQ ID NO: 473648 - DNA, 20 bp, Artificial
  CRISPR gRNA sequence
cttgaacccaggaactggag

SEQ ID NO: 473649 - DNA, 20 bp, Artificial
  CRISPR gRNA sequence
gaacccaggaactggaggtt

SEQ ID NO: 473650 - DNA, 20 bp, Artificial
  CRISPR gRNA sequence
aacccaggaactggaggttc

SEQ ID NO: 473651 - DNA, 20 bp, Artificial
  CRISPR gRNA sequence
gaggttccagtgagctgaga

SEQ ID NO: 473652 - DNA, 20 bp, Artificial
  CRISPR gRNA sequence
cagtgagctgagatcatgcc

SEQ ID NO: 473653 - DNA, 20 bp, Artificial
  CRISPR gRNA sequence
agatcatgccactgcactcc

SEQ ID NO: 473654 - DNA, 20 bp, Artificial
  CRISPR gRNA sequence
cactccagcctgggcaacac

SEQ ID NO: 473655 - DNA, 20 bp, Artificial
  CRISPR gRNA sequence
cagcctgggcaacacagtaa

SEQ ID NO: 473656 - DNA, 20 bp, Artificial
  CRISPR gRNA sequence
ggcaacacagtaagactctg

SEQ ID NO: 473657 - DNA, 20 bp, Artificial
  CRISPR gRNA sequence
tgtctcaaaaaaaaaaaaaa

SEQ ID NO: 473658 - DNA, 20 bp, Artificial
  CRISPR gRNA sequence
tctcaaaaaaaaaaaaaaag

SEQ ID NO: 473659 - DNA, 20 bp, Artificial
  CRISPR gRNA sequence
aaaaaaaaaaaaaaagatac

SEQ ID NO: 473660 - DNA, 20 bp, Artificial
  CRISPR gRNA sequence
tgcatgggtctgcagaaggt

SEQ ID NO: 473661 - DNA, 20 bp, Artificial
  CRISPR gRNA sequence
gcatgggtctgcagaaggtt

SEQ ID NO: 473662 - DNA, 20 bp, Artificial
  CRISPR gRNA sequence
catgggtctgcagaaggtta

SEQ ID NO: 473663 - DNA, 20 bp, Artificial
  CRISPR gRNA sequence
cagaaggttaacttcagccg

SEQ ID NO: 473664 - DNA, 20 bp, Artificial
  CRISPR gRNA sequence
acttcagccggggcaaagct

SEQ ID NO: 473665 - DNA, 20 bp, Artificial
  CRISPR gRNA sequence
cagccggggcaaagcttcat

SEQ ID NO: 473666 - DNA, 20 bp, Artificial
  CRISPR gRNA sequence
agccggggcaaagcttcatg

SEQ ID NO: 473667 - DNA, 20 bp, Artificial
  CRISPR gRNA sequence
catggaaaggctatacttga

SEQ ID NO: 473668 - DNA, 20 bp, Artificial
  CRISPR gRNA sequence
atggaaaggctatacttgag

SEQ ID NO: 473669 - DNA, 20 bp, Artificial
  CRISPR gRNA sequence
tacttgagctgaaccttggt

SEQ ID NO: 473670 - DNA, 20 bp, Artificial
  CRISPR gRNA sequence
gagctgaaccttggtgaatg

SEQ ID NO: 473671 - DNA, 20 bp, Artificial
  CRISPR gRNA sequence
agctgaaccttggtgaatga

SEQ ID NO: 473672 - DNA, 20 bp, Artificial
  CRISPR gRNA sequence
aaccttggtgaatgagtagc

SEQ ID NO: 473673 - DNA, 20 bp, Artificial
  CRISPR gRNA sequence
ggtgaatgagtagccctttg

SEQ ID NO: 473674 - DNA, 20 bp, Artificial
  CRISPR gRNA sequence
gtgaatgagtagccctttgg

SEQ ID NO: 473675 - DNA, 20 bp, Artificial
  CRISPR gRNA sequence
tggcaatcagagcagtgcat

SEQ ID NO: 473676 - DNA, 20 bp, Artificial
  CRISPR gRNA sequence
ggcaatcagagcagtgcatg

SEQ ID NO: 473677 - DNA, 20 bp, Artificial
  CRISPR gRNA sequence
gcaatcagagcagtgcatgg

SEQ ID NO: 473678 - DNA, 20 bp, Artificial
  CRISPR gRNA sequence
taagagtgaggaaatggaac

SEQ ID NO: 473679 - DNA, 20 bp, Artificial
  CRISPR gRNA sequence
aagagtgaggaaatggaacg

SEQ ID NO: 473680 - DNA, 20 bp, Artificial
  CRISPR gRNA sequence
agagtgaggaaatggaacgg

SEQ ID NO: 473681 - DNA, 20 bp, Artificial
  CRISPR gRNA sequence
agggaccaggaatctcatga

SEQ ID NO: 473682 - DNA, 20 bp, Artificial
  CRISPR gRNA sequence
gggaccaggaatctcatgat

SEQ ID NO: 473683 - DNA, 20 bp, Artificial
  CRISPR gRNA sequence
atgatagatttagatcattg

SEQ ID NO: 473684 - DNA, 20 bp, Artificial
  CRISPR gRNA sequence
agatcattgatacacaactg

SEQ ID NO: 473685 - DNA, 20 bp, Artificial
  CRISPR gRNA sequence
gatcattgatacacaactgg

SEQ ID NO: 473686 - DNA, 20 bp, Artificial
  CRISPR gRNA sequence
atacacaactggatcatggt

SEQ ID NO: 473687 - DNA, 20 bp, Artificial
  CRISPR gRNA sequence
gatcatggttttctgactta

SEQ ID NO: 473688 - DNA, 20 bp, Artificial
  CRISPR gRNA sequence
tctgacttagtgatatggag

SEQ ID NO: 473689 - DNA, 20 bp, Artificial
  CRISPR gRNA sequence
ctgacttagtgatatggaga

SEQ ID NO: 473690 - DNA, 20 bp, Artificial
  CRISPR gRNA sequence
tgacttagtgatatggagac

SEQ ID NO: 473691 - DNA, 20 bp, Artificial
  CRISPR gRNA sequence
acttagtgatatggagacca

SEQ ID NO: 473692 - DNA, 20 bp, Artificial
  CRISPR gRNA sequence
agtgatatggagaccactgg

SEQ ID NO: 473693 - DNA, 20 bp, Artificial
  CRISPR gRNA sequence
gtgatatggagaccactggt

SEQ ID NO: 473694 - DNA, 20 bp, Artificial
  CRISPR gRNA sequence
gttgtttcagaacaaatgga

SEQ ID NO: 473695 - DNA, 20 bp, Artificial
  CRISPR gRNA sequence
tttcagaacaaatggaataa

SEQ ID NO: 473696 - DNA, 20 bp, Artificial
  CRISPR gRNA sequence
cagaacaaatggaataagca

SEQ ID NO: 473697 - DNA, 20 bp, Artificial
  CRISPR gRNA sequence
agaacaaatggaataagcat

SEQ ID NO: 473698 - DNA, 20 bp, Artificial
  CRISPR gRNA sequence
ggcaggagtttaaactttgc

SEQ ID NO: 473699 - DNA, 20 bp, Artificial
  CRISPR gRNA sequence
aaactttgcttatccaccat

SEQ ID NO: 473700 - DNA, 20 bp, Artificial
  CRISPR gRNA sequence
aactttgcttatccaccatg

SEQ ID NO: 473701 - DNA, 20 bp, Artificial
  CRISPR gRNA sequence
tgcttatccaccatgagaaa

SEQ ID NO: 473702 - DNA, 20 bp, Artificial
  CRISPR gRNA sequence
gcttatccaccatgagaaaa

SEQ ID NO: 473703 - DNA, 20 bp, Artificial
  CRISPR gRNA sequence
cttatccaccatgagaaaat

SEQ ID NO: 473704 - DNA, 20 bp, Artificial
  CRISPR gRNA sequence
atccaccatgagaaaataca

SEQ ID NO: 473705 - DNA, 20 bp, Artificial
  CRISPR gRNA sequence
tccaccatgagaaaatacaa

SEQ ID NO: 473706 - DNA, 20 bp, Artificial
  CRISPR gRNA sequence
attttggggggatatttata

SEQ ID NO: 473707 - DNA, 20 bp, Artificial
  CRISPR gRNA sequence
tggggggatatttataaagg

SEQ ID NO: 473708 - DNA, 20 bp, Artificial
  CRISPR gRNA sequence
ggggggatatttataaaggg

SEQ ID NO: 473709 - DNA, 20 bp, Artificial
  CRISPR gRNA sequence
gggggatatttataaagggc

SEQ ID NO: 473710 - DNA, 20 bp, Artificial
  CRISPR gRNA sequence
ataaagggcacggaaatagc

SEQ ID NO: 473711 - DNA, 20 bp, Artificial
  CRISPR gRNA sequence
taaagggcacggaaatagct

SEQ ID NO: 473712 - DNA, 20 bp, Artificial
  CRISPR gRNA sequence
caaatgagactattcatttg

SEQ ID NO: 473713 - DNA, 20 bp, Artificial
  CRISPR gRNA sequence
ttcatttgaacatgtctgtt

SEQ ID NO: 473714 - DNA, 20 bp, Artificial
  CRISPR gRNA sequence
atttgaacatgtctgtttca

SEQ ID NO: 473715 - DNA, 20 bp, Artificial
  CRISPR gRNA sequence
gaacatgtctgtttcaaatg

SEQ ID NO: 473716 - DNA, 20 bp, Artificial
  CRISPR gRNA sequence
aacatgtctgtttcaaatgc

SEQ ID NO: 473717 - DNA, 20 bp, Artificial
  CRISPR gRNA sequence
tttcaaatgctaacacattg

SEQ ID NO: 473718 - DNA, 20 bp, Artificial
  CRISPR gRNA sequence
caaatgctaacacattgagc

SEQ ID NO: 473719 - DNA, 20 bp, Artificial
  CRISPR gRNA sequence
aaatgctaacacattgagcg

SEQ ID NO: 473720 - DNA, 20 bp, Artificial
  CRISPR gRNA sequence
acacattgagcgaatttgat

SEQ ID NO: 473721 - DNA, 20 bp, Artificial
  CRISPR gRNA sequence
agcgaatttgatagtccccc

SEQ ID NO: 473722 - DNA, 20 bp, Artificial
  CRISPR gRNA sequence
gatagtcccccagttttgct

SEQ ID NO: 473723 - DNA, 20 bp, Artificial
  CRISPR gRNA sequence
atagtcccccagttttgctg

SEQ ID NO: 473724 - DNA, 20 bp, Artificial
  CRISPR gRNA sequence
tgctggtcctcagtttcttc

SEQ ID NO: 473725 - DNA, 20 bp, Artificial
  CRISPR gRNA sequence
gctggtcctcagtttcttca

SEQ ID NO: 473726 - DNA, 20 bp, Artificial
  CRISPR gRNA sequence
ctggtcctcagtttcttcaa

SEQ ID NO: 473727 - DNA, 20 bp, Artificial
  CRISPR gRNA sequence
gtcctcagtttcttcaaaat

SEQ ID NO: 473728 - DNA, 20 bp, Artificial
  CRISPR gRNA sequence
agtttcttcaaaataagatg

SEQ ID NO: 473729 - DNA, 20 bp, Artificial
  CRISPR gRNA sequence
cttcaaaataagatgaaagg

SEQ ID NO: 473730 - DNA, 20 bp, Artificial
  CRISPR gRNA sequence
ttcaaaataagatgaaagga

SEQ ID NO: 473731 - DNA, 20 bp, Artificial
  CRISPR gRNA sequence
caaaataagatgaaaggatt

SEQ ID NO: 473732 - DNA, 20 bp, Artificial
  CRISPR gRNA sequence
aaaataagatgaaaggattg

SEQ ID NO: 473733 - DNA, 20 bp, Artificial
  CRISPR gRNA sequence
aactgtaaaagtaggaaagt

SEQ ID NO: 473734 - DNA, 20 bp, Artificial
  CRISPR gRNA sequence
taaaagtaggaaagttctaa

SEQ ID NO: 473735 - DNA, 20 bp, Artificial
  CRISPR gRNA sequence
taactcaccatcccctgacc

SEQ ID NO: 473736 - DNA, 20 bp, Artificial
  CRISPR gRNA sequence
actcaccatcccctgaccac

SEQ ID NO: 473737 - DNA, 20 bp, Artificial
  CRISPR gRNA sequence
accatcccctgaccacacaa

SEQ ID NO: 473738 - DNA, 20 bp, Artificial
  CRISPR gRNA sequence
accacacaaacacacacaac

SEQ ID NO: 473739 - DNA, 20 bp, Artificial
  CRISPR gRNA sequence
caccttccttaatgtgtgac

SEQ ID NO: 473740 - DNA, 20 bp, Artificial
  CRISPR gRNA sequence
accttccttaatgtgtgact

SEQ ID NO: 473741 - DNA, 20 bp, Artificial
  CRISPR gRNA sequence
ccttaatgtgtgactgaaac

SEQ ID NO: 473742 - DNA, 20 bp, Artificial
  CRISPR gRNA sequence
cttaatgtgtgactgaaact

SEQ ID NO: 473743 - DNA, 20 bp, Artificial
  CRISPR gRNA sequence
aatgtgtgactgaaactacg

SEQ ID NO: 473744 - DNA, 20 bp, Artificial
  CRISPR gRNA sequence
atgtgtgactgaaactacga

SEQ ID NO: 473745 - DNA, 20 bp, Artificial
  CRISPR gRNA sequence
aaactacgaaaccacttcta

SEQ ID NO: 473746 - DNA, 20 bp, Artificial
  CRISPR gRNA sequence
cgaaaccacttctagcctgc

SEQ ID NO: 473747 - DNA, 20 bp, Artificial
  CRISPR gRNA sequence
ctagcctgcaatttctattc

SEQ ID NO: 473748 - DNA, 20 bp, Artificial
  CRISPR gRNA sequence
tagcctgcaatttctattcc

SEQ ID NO: 473749 - DNA, 20 bp, Artificial
  CRISPR gRNA sequence
gcctgcaatttctattccta

SEQ ID NO: 473750 - DNA, 20 bp, Artificial
  CRISPR gRNA sequence
caatttctattcctatcaca

SEQ ID NO: 473751 - DNA, 20 bp, Artificial
  CRISPR gRNA sequence
ctattcctatcacaatatat

SEQ ID NO: 473752 - DNA, 20 bp, Artificial
  CRISPR gRNA sequence
tattcctatcacaatatatt

SEQ ID NO: 473753 - DNA, 20 bp, Artificial
  CRISPR gRNA sequence
ttcctatcacaatatattac

SEQ ID NO: 473754 - DNA, 20 bp, Artificial
  CRISPR gRNA sequence
ctatcacaatatattacctt

SEQ ID NO: 473755 - DNA, 20 bp, Artificial
  CRISPR gRNA sequence
tcacaatatattacctttct

SEQ ID NO: 473756 - DNA, 20 bp, Artificial
  CRISPR gRNA sequence
cctttctatttagccatagg

SEQ ID NO: 473757 - DNA, 20 bp, Artificial
  CRISPR gRNA sequence
tctatttagccatagggcta

SEQ ID NO: 473758 - DNA, 20 bp, Artificial
  CRISPR gRNA sequence
ctatttagccatagggctat

SEQ ID NO: 473759 - DNA, 20 bp, Artificial
  CRISPR gRNA sequence
tatttagccatagggctatc

SEQ ID NO: 473760 - DNA, 20 bp, Artificial
  CRISPR gRNA sequence
tttagccatagggctatcac

SEQ ID NO: 473761 - DNA, 20 bp, Artificial
  CRISPR gRNA sequence
agccatagggctatcacttg

SEQ ID NO: 473762 - DNA, 20 bp, Artificial
  CRISPR gRNA sequence
gccatagggctatcacttga

SEQ ID NO: 473763 - DNA, 20 bp, Artificial
  CRISPR gRNA sequence
tcacttgatgttagtggcac

SEQ ID NO: 473764 - DNA, 20 bp, Artificial
  CRISPR gRNA sequence
gatgttagtggcacaattag

SEQ ID NO: 473765 - DNA, 20 bp, Artificial
  CRISPR gRNA sequence
atgttagtggcacaattaga

SEQ ID NO: 473766 - DNA, 20 bp, Artificial
  CRISPR gRNA sequence
gtggcacaattagacatcac

SEQ ID NO: 473767 - DNA, 20 bp, Artificial
  CRISPR gRNA sequence
gacatcacttcaagttctgt

SEQ ID NO: 473768 - DNA, 20 bp, Artificial
  CRISPR gRNA sequence
caagttctgtcttttgtgac

SEQ ID NO: 473769 - DNA, 20 bp, Artificial
  CRISPR gRNA sequence
aagttctgtcttttgtgact

SEQ ID NO: 473770 - DNA, 20 bp, Artificial
  CRISPR gRNA sequence
tgtcttttgtgactgtatgc

SEQ ID NO: 473771 - DNA, 20 bp, Artificial
  CRISPR gRNA sequence
tcttttgtgactgtatgctc

SEQ ID NO: 473772 - DNA, 20 bp, Artificial
  CRISPR gRNA sequence
ttgtgactgtatgctccgga

SEQ ID NO: 473773 - DNA, 20 bp, Artificial
  CRISPR gRNA sequence
tgtgactgtatgctccggag

SEQ ID NO: 473774 - DNA, 20 bp, Artificial
  CRISPR gRNA sequence
gtgactgtatgctccggagc

SEQ ID NO: 473775 - DNA, 20 bp, Artificial
  CRISPR gRNA sequence
tgactgtatgctccggagca

SEQ ID NO: 473776 - DNA, 20 bp, Artificial
  CRISPR gRNA sequence
tatgctccggagcagtgcgc

SEQ ID NO: 473777 - DNA, 20 bp, Artificial
  CRISPR gRNA sequence
cggagcagtgcgcaaagtgg

SEQ ID NO: 473778 - DNA, 20 bp, Artificial
  CRISPR gRNA sequence
ggggtggagaaaagagctag

SEQ ID NO: 473779 - DNA, 20 bp, Artificial
  CRISPR gRNA sequence
gctttttgtgttggtggcat

SEQ ID NO: 473780 - DNA, 20 bp, Artificial
  CRISPR gRNA sequence
tttgtgttggtggcatcact

SEQ ID NO: 473781 - DNA, 20 bp, Artificial
  CRISPR gRNA sequence
ttgtgttggtggcatcactg

SEQ ID NO: 473782 - DNA, 20 bp, Artificial
  CRISPR gRNA sequence
tgtgttggtggcatcactga

SEQ ID NO: 473783 - DNA, 20 bp, Artificial
  CRISPR gRNA sequence
gtgttggtggcatcactgat

SEQ ID NO: 473784 - DNA, 20 bp, Artificial
  CRISPR gRNA sequence
tgttggtggcatcactgatt

SEQ ID NO: 473785 - DNA, 20 bp, Artificial
  CRISPR gRNA sequence
gtggcatcactgattcacaa

SEQ ID NO: 473786 - DNA, 20 bp, Artificial
  CRISPR gRNA sequence
attcacaataggattatgga

SEQ ID NO: 473787 - DNA, 20 bp, Artificial
  CRISPR gRNA sequence
acaataggattatggaaaca

SEQ ID NO: 473788 - DNA, 20 bp, Artificial
  CRISPR gRNA sequence
tggaaacattgcagttccta

SEQ ID NO: 473789 - DNA, 20 bp, Artificial
  CRISPR gRNA sequence
cagttcctaaatattcttat

SEQ ID NO: 473790 - DNA, 20 bp, Artificial
  CRISPR gRNA sequence
ctaaatattcttatcagcag

SEQ ID NO: 473791 - DNA, 20 bp, Artificial
  CRISPR gRNA sequence
aatattcttatcagcaggat

SEQ ID NO: 473792 - DNA, 20 bp, Artificial
  CRISPR gRNA sequence
ttatcagcaggataatgatc

SEQ ID NO: 473793 - DNA, 20 bp, Artificial
  CRISPR gRNA sequence
atcagcaggataatgatcat

SEQ ID NO: 473794 - DNA, 20 bp, Artificial
  CRISPR gRNA sequence
tcagcaggataatgatcatt

SEQ ID NO: 473795 - DNA, 20 bp, Artificial
  CRISPR gRNA sequence
acaaccacactgactggcac

SEQ ID NO: 473796 - DNA, 20 bp, Artificial
  CRISPR gRNA sequence
actggcacaggaatttttct

SEQ ID NO: 473797 - DNA, 20 bp, Artificial
  CRISPR gRNA sequence
gcacaggaatttttcttgaa

SEQ ID NO: 473798 - DNA, 20 bp, Artificial
  CRISPR gRNA sequence
ttcttgaatggaggaatgaa

SEQ ID NO: 473799 - DNA, 20 bp, Artificial
  CRISPR gRNA sequence
tcttgaatggaggaatgaac

SEQ ID NO: 473800 - DNA, 20 bp, Artificial
  CRISPR gRNA sequence
cttgaatggaggaatgaacc

SEQ ID NO: 473801 - DNA, 20 bp, Artificial
  CRISPR gRNA sequence
ttgaatggaggaatgaaccg

SEQ ID NO: 473802 - DNA, 20 bp, Artificial
  CRISPR gRNA sequence
gaatggaggaatgaaccgat

SEQ ID NO: 473803 - DNA, 20 bp, Artificial
  CRISPR gRNA sequence
aatggaggaatgaaccgatg

SEQ ID NO: 473804 - DNA, 20 bp, Artificial
  CRISPR gRNA sequence
gcaagcaggcattagaaatc

SEQ ID NO: 473805 - DNA, 20 bp, Artificial
  CRISPR gRNA sequence
caagcaggcattagaaatca

SEQ ID NO: 473806 - DNA, 20 bp, Artificial
  CRISPR gRNA sequence
gaaatcaagagtactccctc

SEQ ID NO: 473807 - DNA, 20 bp, Artificial
  CRISPR gRNA sequence
cctctgtgcacaaacaaggt

SEQ ID NO: 473808 - DNA, 20 bp, Artificial
  CRISPR gRNA sequence
tgtgcacaaacaaggtatta

SEQ ID NO: 473809 - DNA, 20 bp, Artificial
  CRISPR gRNA sequence
tgcacaaacaaggtattata

SEQ ID NO: 473810 - DNA, 20 bp, Artificial
  CRISPR gRNA sequence
taatacctcctatctctcag

SEQ ID NO: 473811 - DNA, 20 bp, Artificial
  CRISPR gRNA sequence
ctatctctcagaggctaaca

SEQ ID NO: 473812 - DNA, 20 bp, Artificial
  CRISPR gRNA sequence
tctctcagaggctaacactg

SEQ ID NO: 473813 - DNA, 20 bp, Artificial
  CRISPR gRNA sequence
tcagaggctaacactgatgt

SEQ ID NO: 473814 - DNA, 20 bp, Artificial
  CRISPR gRNA sequence
agaggctaacactgatgttt

SEQ ID NO: 473815 - DNA, 20 bp, Artificial
  CRISPR gRNA sequence
acactgatgtttgtagtgta

SEQ ID NO: 473816 - DNA, 20 bp, Artificial
  CRISPR gRNA sequence
atgtttgtagtgtaaaaatg

SEQ ID NO: 473817 - DNA, 20 bp, Artificial
  CRISPR gRNA sequence
gtagtgtaaaaatgacacac

SEQ ID NO: 473818 - DNA, 20 bp, Artificial
  CRISPR gRNA sequence
tagtgtaaaaatgacacact

SEQ ID NO: 473819 - DNA, 20 bp, Artificial
  CRISPR gRNA sequence
agacaaatagcacaattcta

SEQ ID NO: 473820 - DNA, 20 bp, Artificial
  CRISPR gRNA sequence
tattttttttaattaattta

SEQ ID NO: 473821 - DNA, 20 bp, Artificial
  CRISPR gRNA sequence
ttttttttaattaatttatt

SEQ ID NO: 473822 - DNA, 20 bp, Artificial
  CRISPR gRNA sequence
tttttaattaatttattttt

SEQ ID NO: 473823 - DNA, 20 bp, Artificial
  CRISPR gRNA sequence
ttttaattaatttatttttt

SEQ ID NO: 473824 - DNA, 20 bp, Artificial
  CRISPR gRNA sequence
tttaattaatttattttttt

SEQ ID NO: 473825 - DNA, 20 bp, Artificial
  CRISPR gRNA sequence
ttaattaatttatttttttt

SEQ ID NO: 473826 - DNA, 20 bp, Artificial
  CRISPR gRNA sequence
taattaatttattttttttg

SEQ ID NO: 473827 - DNA, 20 bp, Artificial
  CRISPR gRNA sequence
aattaatttattttttttga

SEQ ID NO: 473828 - DNA, 20 bp, Artificial
  CRISPR gRNA sequence
attaatttattttttttgag

SEQ ID NO: 473829 - DNA, 20 bp, Artificial
  CRISPR gRNA sequence
atttattttttttgagatga

SEQ ID NO: 473830 - DNA, 20 bp, Artificial
  CRISPR gRNA sequence
attttttttgagatgaagtc

SEQ ID NO: 473831 - DNA, 20 bp, Artificial
  CRISPR gRNA sequence
ttttttttgagatgaagtct

SEQ ID NO: 473832 - DNA, 20 bp, Artificial
  CRISPR gRNA sequence
tttttgagatgaagtctcgc

SEQ ID NO: 473833 - DNA, 20 bp, Artificial
  CRISPR gRNA sequence
ttttgagatgaagtctcgct

SEQ ID NO: 473834 - DNA, 20 bp, Artificial
  CRISPR gRNA sequence
tttgagatgaagtctcgctc

SEQ ID NO: 473835 - DNA, 20 bp, Artificial
  CRISPR gRNA sequence
ttgagatgaagtctcgctct

SEQ ID NO: 473836 - DNA, 20 bp, Artificial
  CRISPR gRNA sequence
tgagatgaagtctcgctctt

SEQ ID NO: 473837 - DNA, 20 bp, Artificial
  CRISPR gRNA sequence
gagatgaagtctcgctcttg

SEQ ID NO: 473838 - DNA, 20 bp, Artificial
  CRISPR gRNA sequence
agatgaagtctcgctcttgt

SEQ ID NO: 473839 - DNA, 20 bp, Artificial
  CRISPR gRNA sequence
gctcttgttgcccaggctgg

SEQ ID NO: 473840 - DNA, 20 bp, Artificial
  CRISPR gRNA sequence
ttgttgcccaggctggagta

SEQ ID NO: 473841 - DNA, 20 bp, Artificial
  CRISPR gRNA sequence
gttgcccaggctggagtaca

SEQ ID NO: 473842 - DNA, 20 bp, Artificial
  CRISPR gRNA sequence
ttgcccaggctggagtacag

SEQ ID NO: 473843 - DNA, 20 bp, Artificial
  CRISPR gRNA sequence
cccaggctggagtacagtga

SEQ ID NO: 473844 - DNA, 20 bp, Artificial
  CRISPR gRNA sequence
gagtacagtgatgcaatttc

SEQ ID NO: 473845 - DNA, 20 bp, Artificial
  CRISPR gRNA sequence
cggctcactgcagcctccgc

SEQ ID NO: 473846 - DNA, 20 bp, Artificial
  CRISPR gRNA sequence
ggctcactgcagcctccgcc

SEQ ID NO: 473847 - DNA, 20 bp, Artificial
  CRISPR gRNA sequence
actgcagcctccgcctccca

SEQ ID NO: 473848 - DNA, 20 bp, Artificial
  CRISPR gRNA sequence
cagcctccgcctcccaggtt

SEQ ID NO: 473849 - DNA, 20 bp, Artificial
  CRISPR gRNA sequence
cgcctcccaggttcaagcga

SEQ ID NO: 473850 - DNA, 20 bp, Artificial
  CRISPR gRNA sequence
ccaggttcaagcgattctcc

SEQ ID NO: 473851 - DNA, 20 bp, Artificial
  CRISPR gRNA sequence
aagcgattctcctgcctcag

SEQ ID NO: 473852 - DNA, 20 bp, Artificial
  CRISPR gRNA sequence
tcctgcctcagcctccccgg

SEQ ID NO: 473853 - DNA, 20 bp, Artificial
  CRISPR gRNA sequence
ctgcctcagcctccccggtg

SEQ ID NO: 473854 - DNA, 20 bp, Artificial
  CRISPR gRNA sequence
cctcagcctccccggtggct

SEQ ID NO: 473855 - DNA, 20 bp, Artificial
  CRISPR gRNA sequence
agcctccccggtggctggga

SEQ ID NO: 473856 - DNA, 20 bp, Artificial
  CRISPR gRNA sequence
cccggtggctgggattacag

SEQ ID NO: 473857 - DNA, 20 bp, Artificial
  CRISPR gRNA sequence
ggattacaggcacccacaac

SEQ ID NO: 473858 - DNA, 20 bp, Artificial
  CRISPR gRNA sequence
caggcacccacaaccacgcc

SEQ ID NO: 473859 - DNA, 20 bp, Artificial
  CRISPR gRNA sequence
atttttgtatttttagtagg

SEQ ID NO: 473860 - DNA, 20 bp, Artificial
  CRISPR gRNA sequence
ttgtatttttagtagggacg

SEQ ID NO: 473861 - DNA, 20 bp, Artificial
  CRISPR gRNA sequence
tgtatttttagtagggacgg

SEQ ID NO: 473862 - DNA, 20 bp, Artificial
  CRISPR gRNA sequence
gtatttttagtagggacggg

SEQ ID NO: 473863 - DNA, 20 bp, Artificial
  CRISPR gRNA sequence
tatttttagtagggacgggg

SEQ ID NO: 473864 - DNA, 20 bp, Artificial
  CRISPR gRNA sequence
ttagtagggacggggtttcg

SEQ ID NO: 473865 - DNA, 20 bp, Artificial
  CRISPR gRNA sequence
tagtagggacggggtttcgc

SEQ ID NO: 473866 - DNA, 20 bp, Artificial
  CRISPR gRNA sequence
agtagggacggggtttcgcc

SEQ ID NO: 473867 - DNA, 20 bp, Artificial
  CRISPR gRNA sequence
gtagggacggggtttcgcca

SEQ ID NO: 473868 - DNA, 20 bp, Artificial
  CRISPR gRNA sequence
cgccatgttagccaggctga

SEQ ID NO: 473869 - DNA, 20 bp, Artificial
  CRISPR gRNA sequence
gccatgttagccaggctgat

SEQ ID NO: 473870 - DNA, 20 bp, Artificial
  CRISPR gRNA sequence
gccaggctgatctcgaactc

SEQ ID NO: 473871 - DNA, 20 bp, Artificial
  CRISPR gRNA sequence
atctcgaactcctgacctca

SEQ ID NO: 473872 - DNA, 20 bp, Artificial
  CRISPR gRNA sequence
gaactcctgacctcaggtga

SEQ ID NO: 473873 - DNA, 20 bp, Artificial
  CRISPR gRNA sequence
ctgacctcaggtgatccacc

SEQ ID NO: 473874 - DNA, 20 bp, Artificial
  CRISPR gRNA sequence
acctcaggtgatccacccgc

SEQ ID NO: 473875 - DNA, 20 bp, Artificial
  CRISPR gRNA sequence
aggtgatccacccgcctctg

SEQ ID NO: 473876 - DNA, 20 bp, Artificial
  CRISPR gRNA sequence
tgcctcacaaagtgctggga

SEQ ID NO: 473877 - DNA, 20 bp, Artificial
  CRISPR gRNA sequence
cctcacaaagtgctgggatt

SEQ ID NO: 473878 - DNA, 20 bp, Artificial
  CRISPR gRNA sequence
acaaagtgctgggattacag

SEQ ID NO: 473879 - DNA, 20 bp, Artificial
  CRISPR gRNA sequence
ggattacaggagtgagccac

SEQ ID NO: 473880 - DNA, 20 bp, Artificial
  CRISPR gRNA sequence
caggagtgagccaccggcct

SEQ ID NO: 473881 - DNA, 20 bp, Artificial
  CRISPR gRNA sequence
gccgacaaatagcacaattc

SEQ ID NO: 473882 - DNA, 20 bp, Artificial
  CRISPR gRNA sequence
taattgtccatctgacaagc

SEQ ID NO: 473883 - DNA, 20 bp, Artificial
  CRISPR gRNA sequence
attgtccatctgacaagctt

SEQ ID NO: 473884 - DNA, 20 bp, Artificial
  CRISPR gRNA sequence
tccatctgacaagcttgtta

SEQ ID NO: 473885 - DNA, 20 bp, Artificial
  CRISPR gRNA sequence
acaagcttgttaacacccct

SEQ ID NO: 473886 - DNA, 20 bp, Artificial
  CRISPR gRNA sequence
gttaacaccccttttctgcc

SEQ ID NO: 473887 - DNA, 20 bp, Artificial
  CRISPR gRNA sequence
ttaacaccccttttctgcct

SEQ ID NO: 473888 - DNA, 20 bp, Artificial
  CRISPR gRNA sequence
acaccccttttctgcctgtt

SEQ ID NO: 473889 - DNA, 20 bp, Artificial
  CRISPR gRNA sequence
ttctgcctgttctgaattat

SEQ ID NO: 473890 - DNA, 20 bp, Artificial
  CRISPR gRNA sequence
tctgcctgttctgaattatg

SEQ ID NO: 473891 - DNA, 20 bp, Artificial
  CRISPR gRNA sequence
ctgcctgttctgaattatgc

SEQ ID NO: 473892 - DNA, 20 bp, Artificial
  CRISPR gRNA sequence
tgcctgttctgaattatgca

SEQ ID NO: 473893 - DNA, 20 bp, Artificial
  CRISPR gRNA sequence
cctgttctgaattatgcata

SEQ ID NO: 473894 - DNA, 20 bp, Artificial
  CRISPR gRNA sequence
ttctgaattatgcatatcca

SEQ ID NO: 473895 - DNA, 20 bp, Artificial
  CRISPR gRNA sequence
tgaattatgcatatccatct

SEQ ID NO: 473896 - DNA, 20 bp, Artificial
  CRISPR gRNA sequence
aattatgcatatccatctta

SEQ ID NO: 473897 - DNA, 20 bp, Artificial
  CRISPR gRNA sequence
tgcatatccatcttatgata

SEQ ID NO: 473898 - DNA, 20 bp, Artificial
  CRISPR gRNA sequence
atgatacttaggacacacaa

SEQ ID NO: 473899 - DNA, 20 bp, Artificial
  CRISPR gRNA sequence
tgatacttaggacacacaaa

SEQ ID NO: 473900 - DNA, 20 bp, Artificial
  CRISPR gRNA sequence
aggacacacaaagctatccc

SEQ ID NO: 473901 - DNA, 20 bp, Artificial
  CRISPR gRNA sequence
ggacacacaaagctatcccc

SEQ ID NO: 473902 - DNA, 20 bp, Artificial
  CRISPR gRNA sequence
tcccccaaaagtttgtctta

SEQ ID NO: 473903 - DNA, 20 bp, Artificial
  CRISPR gRNA sequence
gtcttatcaaataaatattt

SEQ ID NO: 473904 - DNA, 20 bp, Artificial
  CRISPR gRNA sequence
tcttatcaaataaatatttc

SEQ ID NO: 473905 - DNA, 20 bp, Artificial
  CRISPR gRNA sequence
atcaaataaatatttcccga

SEQ ID NO: 473906 - DNA, 20 bp, Artificial
  CRISPR gRNA sequence
tcaaataaatatttcccgaa

SEQ ID NO: 473907 - DNA, 20 bp, Artificial
  CRISPR gRNA sequence
cccgaagaggaataactatc

SEQ ID NO: 473908 - DNA, 20 bp, Artificial
  CRISPR gRNA sequence
ccgaagaggaataactatca

SEQ ID NO: 473909 - DNA, 20 bp, Artificial
  CRISPR gRNA sequence
tcacagttgcttttggctgt

SEQ ID NO: 473910 - DNA, 20 bp, Artificial
  CRISPR gRNA sequence
cttttggctgttactcaact

SEQ ID NO: 473911 - DNA, 20 bp, Artificial
  CRISPR gRNA sequence
ttggctgttactcaacttcc

SEQ ID NO: 473912 - DNA, 20 bp, Artificial
  CRISPR gRNA sequence
tggctgttactcaacttcca

SEQ ID NO: 473913 - DNA, 20 bp, Artificial
  CRISPR gRNA sequence
ggctgttactcaacttccaa

SEQ ID NO: 473914 - DNA, 20 bp, Artificial
  CRISPR gRNA sequence
gctgttactcaacttccaat

SEQ ID NO: 473915 - DNA, 20 bp, Artificial
  CRISPR gRNA sequence
ttactcaacttccaattatc

SEQ ID NO: 473916 - DNA, 20 bp, Artificial
  CRISPR gRNA sequence
ctcaacttccaattatcagt

SEQ ID NO: 473917 - DNA, 20 bp, Artificial
  CRISPR gRNA sequence
aacttccaattatcagttat

SEQ ID NO: 473918 - DNA, 20 bp, Artificial
  CRISPR gRNA sequence
ccaattatcagttatttgat

SEQ ID NO: 473919 - DNA, 20 bp, Artificial
  CRISPR gRNA sequence
caattatcagttatttgatt

SEQ ID NO: 473920 - DNA, 20 bp, Artificial
  CRISPR gRNA sequence
tcagttatttgatttcattt

SEQ ID NO: 473921 - DNA, 20 bp, Artificial
  CRISPR gRNA sequence
tttgatttcattttttattt

SEQ ID NO: 473922 - DNA, 20 bp, Artificial
  CRISPR gRNA sequence
gatttcattttttatttatg

SEQ ID NO: 473923 - DNA, 20 bp, Artificial
  CRISPR gRNA sequence
atttcattttttatttatgt

SEQ ID NO: 473924 - DNA, 20 bp, Artificial
  CRISPR gRNA sequence
cattttttatttatgtattt

SEQ ID NO: 473925 - DNA, 20 bp, Artificial
  CRISPR gRNA sequence
attttttatttatgtatttt

SEQ ID NO: 473926 - DNA, 20 bp, Artificial
  CRISPR gRNA sequence
tttatttatgtattttttga

SEQ ID NO: 473927 - DNA, 20 bp, Artificial
  CRISPR gRNA sequence
ttatttatgtattttttgag

SEQ ID NO: 473928 - DNA, 20 bp, Artificial
  CRISPR gRNA sequence
tatttatgtattttttgaga

SEQ ID NO: 473929 - DNA, 20 bp, Artificial
  CRISPR gRNA sequence
atttatgtattttttgagac

SEQ ID NO: 473930 - DNA, 20 bp, Artificial
  CRISPR gRNA sequence
tttatgtattttttgagacg

SEQ ID NO: 473931 - DNA, 20 bp, Artificial
  CRISPR gRNA sequence
atgtattttttgagacggag

SEQ ID NO: 473932 - DNA, 20 bp, Artificial
  CRISPR gRNA sequence
tgtattttttgagacggagt

SEQ ID NO: 473933 - DNA, 20 bp, Artificial
  CRISPR gRNA sequence
tttgagacggagttttgctc

SEQ ID NO: 473934 - DNA, 20 bp, Artificial
  CRISPR gRNA sequence
ttgagacggagttttgctct

SEQ ID NO: 473935 - DNA, 20 bp, Artificial
  CRISPR gRNA sequence
tgagacggagttttgctctt

SEQ ID NO: 473936 - DNA, 20 bp, Artificial
  CRISPR gRNA sequence
gagacggagttttgctcttg

SEQ ID NO: 473937 - DNA, 20 bp, Artificial
  CRISPR gRNA sequence
agacggagttttgctcttgt

SEQ ID NO: 473938 - DNA, 20 bp, Artificial
  CRISPR gRNA sequence
tgctcttgttgcccaggctg

SEQ ID NO: 473939 - DNA, 20 bp, Artificial
  CRISPR gRNA sequence
gctcttgttgcccaggctgg

SEQ ID NO: 473940 - DNA, 20 bp, Artificial
  CRISPR gRNA sequence
ctcttgttgcccaggctgga

SEQ ID NO: 473941 - DNA, 20 bp, Artificial
  CRISPR gRNA sequence
ttgttgcccaggctggagtg

SEQ ID NO: 473942 - DNA, 20 bp, Artificial
  CRISPR gRNA sequence
gttgcccaggctggagtgca

SEQ ID NO: 473943 - DNA, 20 bp, Artificial
  CRISPR gRNA sequence
ttgcccaggctggagtgcaa

SEQ ID NO: 473944 - DNA, 20 bp, Artificial
  CRISPR gRNA sequence
cccaggctggagtgcaatgg

SEQ ID NO: 473945 - DNA, 20 bp, Artificial
  CRISPR gRNA sequence
gagtgcaatggagcgatctc

SEQ ID NO: 473946 - DNA, 20 bp, Artificial
  CRISPR gRNA sequence
ggttcactgcaacctccatc

SEQ ID NO: 473947 - DNA, 20 bp, Artificial
  CRISPR gRNA sequence
actgcaacctccatccccgg

SEQ ID NO: 473948 - DNA, 20 bp, Artificial
  CRISPR gRNA sequence
caacctccatccccgggttc

SEQ ID NO: 473949 - DNA, 20 bp, Artificial
  CRISPR gRNA sequence
catccccgggttcaagcgat

SEQ ID NO: 473950 - DNA, 20 bp, Artificial
  CRISPR gRNA sequence
aagcgattctcctgcctcag

SEQ ID NO: 473951 - DNA, 20 bp, Artificial
  CRISPR gRNA sequence
tcctgcctcagcctcccaag

SEQ ID NO: 473952 - DNA, 20 bp, Artificial
  CRISPR gRNA sequence
ctgcctcagcctcccaagta

SEQ ID NO: 473953 - DNA, 20 bp, Artificial
  CRISPR gRNA sequence
cctcagcctcccaagtagcc

SEQ ID NO: 473954 - DNA, 20 bp, Artificial
  CRISPR gRNA sequence
agcctcccaagtagccggaa

SEQ ID NO: 473955 - DNA, 20 bp, Artificial
  CRISPR gRNA sequence
ccaagtagccggaaccatca

SEQ ID NO: 473956 - DNA, 20 bp, Artificial
  CRISPR gRNA sequence
tttttattcctgctcttatt

SEQ ID NO: 473957 - DNA, 20 bp, Artificial
  CRISPR gRNA sequence
ttattcctgctcttattatc

SEQ ID NO: 473958 - DNA, 20 bp, Artificial
  CRISPR gRNA sequence
tattcctgctcttattatct

SEQ ID NO: 473959 - DNA, 20 bp, Artificial
  CRISPR gRNA sequence
attcctgctcttattatctc

SEQ ID NO: 473960 - DNA, 20 bp, Artificial
  CRISPR gRNA sequence
ttcctgctcttattatctct

SEQ ID NO: 473961 - DNA, 20 bp, Artificial
  CRISPR gRNA sequence
ctgctcttattatctctgct

SEQ ID NO: 473962 - DNA, 20 bp, Artificial
  CRISPR gRNA sequence
ctcttattatctctgctgtt

SEQ ID NO: 473963 - DNA, 20 bp, Artificial
  CRISPR gRNA sequence
ttattatctctgctgttttt

SEQ ID NO: 473964 - DNA, 20 bp, Artificial
  CRISPR gRNA sequence
attatctctgctgtttttct

SEQ ID NO: 473965 - DNA, 20 bp, Artificial
  CRISPR gRNA sequence
ttatctctgctgtttttctc

SEQ ID NO: 473966 - DNA, 20 bp, Artificial
  CRISPR gRNA sequence
tctctgctgtttttctcaag

SEQ ID NO: 473967 - DNA, 20 bp, Artificial
  CRISPR gRNA sequence
tgctgtttttctcaagcatt

SEQ ID NO: 473968 - DNA, 20 bp, Artificial
  CRISPR gRNA sequence
ctgtttttctcaagcattca

SEQ ID NO: 473969 - DNA, 20 bp, Artificial
  CRISPR gRNA sequence
tttttctcaagcattcatat

SEQ ID NO: 473970 - DNA, 20 bp, Artificial
  CRISPR gRNA sequence
ttctcaagcattcatatctg

SEQ ID NO: 473971 - DNA, 20 bp, Artificial
  CRISPR gRNA sequence
tctcaagcattcatatctga

SEQ ID NO: 473972 - DNA, 20 bp, Artificial
  CRISPR gRNA sequence
ctcaagcattcatatctgat

SEQ ID NO: 473973 - DNA, 20 bp, Artificial
  CRISPR gRNA sequence
tcaagcattcatatctgatg

SEQ ID NO: 473974 - DNA, 20 bp, Artificial
  CRISPR gRNA sequence
aagcattcatatctgatgac

SEQ ID NO: 473975 - DNA, 20 bp, Artificial
  CRISPR gRNA sequence
atatctgatgacaggaaatt

SEQ ID NO: 473976 - DNA, 20 bp, Artificial
  CRISPR gRNA sequence
atgacaggaaattttcaatg

SEQ ID NO: 473977 - DNA, 20 bp, Artificial
  CRISPR gRNA sequence
tcaatgctaaaaatgattaa

SEQ ID NO: 473978 - DNA, 20 bp, Artificial
  CRISPR gRNA sequence
caatgctaaaaatgattaaa

SEQ ID NO: 473979 - DNA, 20 bp, Artificial
  CRISPR gRNA sequence
aatgctaaaaatgattaaaa

SEQ ID NO: 473980 - DNA, 20 bp, Artificial
  CRISPR gRNA sequence
aaaatgattaaaataaatac

SEQ ID NO: 473981 - DNA, 20 bp, Artificial
  CRISPR gRNA sequence
aaataaatacatgcagtaaa

SEQ ID NO: 473982 - DNA, 20 bp, Artificial
  CRISPR gRNA sequence
ctggccgggcacggtggctc

SEQ ID NO: 473983 - DNA, 20 bp, Artificial
  CRISPR gRNA sequence
tggccgggcacggtggctca

SEQ ID NO: 473984 - DNA, 20 bp, Artificial
  CRISPR gRNA sequence
gccgggcacggtggctcacg

SEQ ID NO: 473985 - DNA, 20 bp, Artificial
  CRISPR gRNA sequence
acgcctgtggtcccagcact

SEQ ID NO: 473986 - DNA, 20 bp, Artificial
  CRISPR gRNA sequence
tggtcccagcactttgggag

SEQ ID NO: 473987 - DNA, 20 bp, Artificial
  CRISPR gRNA sequence
tgggaggccgaggcgagtgg

SEQ ID NO: 473988 - DNA, 20 bp, Artificial
  CRISPR gRNA sequence
gggaggccgaggcgagtgga

SEQ ID NO: 473989 - DNA, 20 bp, Artificial
  CRISPR gRNA sequence
ggaggccgaggcgagtggat

SEQ ID NO: 473990 - DNA, 20 bp, Artificial
  CRISPR gRNA sequence
acacggtgaaaccccgtctc

SEQ ID NO: 473991 - DNA, 20 bp, Artificial
  CRISPR gRNA sequence
tactaaaaatacaaaacaaa

SEQ ID NO: 473992 - DNA, 20 bp, Artificial
  CRISPR gRNA sequence
ctaaaaatacaaaacaaaaa

SEQ ID NO: 473993 - DNA, 20 bp, Artificial
  CRISPR gRNA sequence
aaaatacaaaacaaaaaatt

SEQ ID NO: 473994 - DNA, 20 bp, Artificial
  CRISPR gRNA sequence
gccgggcgtggtggcgggag

SEQ ID NO: 473995 - DNA, 20 bp, Artificial
  CRISPR gRNA sequence
tagtcccagctgctcggcag

SEQ ID NO: 473996 - DNA, 20 bp, Artificial
  CRISPR gRNA sequence
ctcggcagactgaggcagga

SEQ ID NO: 473997 - DNA, 20 bp, Artificial
  CRISPR gRNA sequence
ggcagactgaggcaggagaa

SEQ ID NO: 473998 - DNA, 20 bp, Artificial
  CRISPR gRNA sequence
aggcaggagaatggcgtgaa

SEQ ID NO: 473999 - DNA, 20 bp, Artificial
  CRISPR gRNA sequence
ccaatgagcctagatcgcgc

SEQ ID NO: 474000 - DNA, 20 bp, Artificial
  CRISPR gRNA sequence
caatgagcctagatcgcgcc

SEQ ID NO: 474001 - DNA, 20 bp, Artificial
  CRISPR gRNA sequence
gatcgcgccactgcactcca

SEQ ID NO: 474002 - DNA, 20 bp, Artificial
  CRISPR gRNA sequence
cactccagcctgggtgacag

SEQ ID NO: 474003 - DNA, 20 bp, Artificial
  CRISPR gRNA sequence
cagcctgggtgacagagcga

SEQ ID NO: 474004 - DNA, 20 bp, Artificial
  CRISPR gRNA sequence
ggtgacagagcgagagtcca

SEQ ID NO: 474005 - DNA, 20 bp, Artificial
  CRISPR gRNA sequence
aaaaaacaaaccaacaaaca

SEQ ID NO: 474006 - DNA, 20 bp, Artificial
  CRISPR gRNA sequence
ctactcccccccaggctctt

SEQ ID NO: 474007 - DNA, 20 bp, Artificial
  CRISPR gRNA sequence
tactcccccccaggctctta

SEQ ID NO: 474008 - DNA, 20 bp, Artificial
  CRISPR gRNA sequence
ctcccccccaggctcttata

SEQ ID NO: 474009 - DNA, 20 bp, Artificial
  CRISPR gRNA sequence
ccccccaggctcttatataa

SEQ ID NO: 474010 - DNA, 20 bp, Artificial
  CRISPR gRNA sequence
ttatataatgaaatatccct

SEQ ID NO: 474011 - DNA, 20 bp, Artificial
  CRISPR gRNA sequence
atataatgaaatatcccttg

SEQ ID NO: 474012 - DNA, 20 bp, Artificial
  CRISPR gRNA sequence
tataatgaaatatcccttgt

SEQ ID NO: 474013 - DNA, 20 bp, Artificial
  CRISPR gRNA sequence
gttaagtcactataggttta

SEQ ID NO: 474014 - DNA, 20 bp, Artificial
  CRISPR gRNA sequence
ttaagtcactataggtttag

SEQ ID NO: 474015 - DNA, 20 bp, Artificial
  CRISPR gRNA sequence
agtcactataggtttagaaa

SEQ ID NO: 474016 - DNA, 20 bp, Artificial
  CRISPR gRNA sequence
taggtttagaaattctttca

SEQ ID NO: 474017 - DNA, 20 bp, Artificial
  CRISPR gRNA sequence
agaaattctttcatgtttaa

SEQ ID NO: 474018 - DNA, 20 bp, Artificial
  CRISPR gRNA sequence
gaaattctttcatgtttaaa

SEQ ID NO: 474019 - DNA, 20 bp, Artificial
  CRISPR gRNA sequence
tttcatgtttaaaattttta

SEQ ID NO: 474020 - DNA, 20 bp, Artificial
  CRISPR gRNA sequence
tcatgtttaaaatttttatc

SEQ ID NO: 474021 - DNA, 20 bp, Artificial
  CRISPR gRNA sequence
catgtttaaaatttttatca

SEQ ID NO: 474022 - DNA, 20 bp, Artificial
  CRISPR gRNA sequence
atgtttaaaatttttatcaa

SEQ ID NO: 474023 - DNA, 20 bp, Artificial
  CRISPR gRNA sequence
aaaatttttatcaaaaccac

SEQ ID NO: 474024 - DNA, 20 bp, Artificial
  CRISPR gRNA sequence
aaatttttatcaaaaccact

SEQ ID NO: 474025 - DNA, 20 bp, Artificial
  CRISPR gRNA sequence
ttatcaaaaccactagtggt

SEQ ID NO: 474026 - DNA, 20 bp, Artificial
  CRISPR gRNA sequence
tatcaaaaccactagtggta

SEQ ID NO: 474027 - DNA, 20 bp, Artificial
  CRISPR gRNA sequence
atcaaaaccactagtggtat

SEQ ID NO: 474028 - DNA, 20 bp, Artificial
  CRISPR gRNA sequence
tcaaaaccactagtggtata

SEQ ID NO: 474029 - DNA, 20 bp, Artificial
  CRISPR gRNA sequence
gtggtatatatattccacga

SEQ ID NO: 474030 - DNA, 20 bp, Artificial
  CRISPR gRNA sequence
cacgatcaggtggtaccgat

SEQ ID NO: 474031 - DNA, 20 bp, Artificial
  CRISPR gRNA sequence
tattttaggtctagagtaca

SEQ ID NO: 474032 - DNA, 20 bp, Artificial
  CRISPR gRNA sequence
attttaggtctagagtacat

SEQ ID NO: 474033 - DNA, 20 bp, Artificial
  CRISPR gRNA sequence
ttttaggtctagagtacatc

SEQ ID NO: 474034 - DNA, 20 bp, Artificial
  CRISPR gRNA sequence
taggtctagagtacatcatt

SEQ ID NO: 474035 - DNA, 20 bp, Artificial
  CRISPR gRNA sequence
aggtctagagtacatcattt

SEQ ID NO: 474036 - DNA, 20 bp, Artificial
  CRISPR gRNA sequence
ggtctagagtacatcatttg

SEQ ID NO: 474037 - DNA, 20 bp, Artificial
  CRISPR gRNA sequence
gagtacatcatttgagcaac

SEQ ID NO: 474038 - DNA, 20 bp, Artificial
  CRISPR gRNA sequence
gagcaacccctttctctata

SEQ ID NO: 474039 - DNA, 20 bp, Artificial
  CRISPR gRNA sequence
agcaacccctttctctatac

SEQ ID NO: 474040 - DNA, 20 bp, Artificial
  CRISPR gRNA sequence
tctctatacataaaaatatt

SEQ ID NO: 474041 - DNA, 20 bp, Artificial
  CRISPR gRNA sequence
ctctatacataaaaatattt

SEQ ID NO: 474042 - DNA, 20 bp, Artificial
  CRISPR gRNA sequence
tctatacataaaaatatttt

SEQ ID NO: 474043 - DNA, 20 bp, Artificial
  CRISPR gRNA sequence
tatacataaaaatattttca

SEQ ID NO: 474044 - DNA, 20 bp, Artificial
  CRISPR gRNA sequence
tacataaaaatattttcaga

SEQ ID NO: 474045 - DNA, 20 bp, Artificial
  CRISPR gRNA sequence
tcagaaataatcatgagata

SEQ ID NO: 474046 - DNA, 20 bp, Artificial
  CRISPR gRNA sequence
cagaaataatcatgagataa

SEQ ID NO: 474047 - DNA, 20 bp, Artificial
  CRISPR gRNA sequence
agaaataatcatgagataaa

SEQ ID NO: 474048 - DNA, 20 bp, Artificial
  CRISPR gRNA sequence
tcttgtgctgaacttcatgt

SEQ ID NO: 474049 - DNA, 20 bp, Artificial
  CRISPR gRNA sequence
cttgtgctgaacttcatgta

SEQ ID NO: 474050 - DNA, 20 bp, Artificial
  CRISPR gRNA sequence
ttgtgctgaacttcatgtat

SEQ ID NO: 474051 - DNA, 20 bp, Artificial
  CRISPR gRNA sequence
gtgctgaacttcatgtataa

SEQ ID NO: 474052 - DNA, 20 bp, Artificial
  CRISPR gRNA sequence
tgctgaacttcatgtataaa

SEQ ID NO: 474053 - DNA, 20 bp, Artificial
  CRISPR gRNA sequence
aacttcatgtataaaaccat

SEQ ID NO: 474054 - DNA, 20 bp, Artificial
  CRISPR gRNA sequence
catgtataaaaccatacaaa

SEQ ID NO: 474055 - DNA, 20 bp, Artificial
  CRISPR gRNA sequence
atgtataaaaccatacaaat

SEQ ID NO: 474056 - DNA, 20 bp, Artificial
  CRISPR gRNA sequence
taaaaaaattaaaatacaaa

SEQ ID NO: 474057 - DNA, 20 bp, Artificial
  CRISPR gRNA sequence
aaaaaaattaaaatacaaaa

SEQ ID NO: 474058 - DNA, 20 bp, Artificial
  CRISPR gRNA sequence
aaaaaattaaaatacaaaaa

SEQ ID NO: 474059 - DNA, 20 bp, Artificial
  CRISPR gRNA sequence
aaatacaaaaaaagaaaaat

SEQ ID NO: 474060 - DNA, 20 bp, Artificial
  CRISPR gRNA sequence
attcaatcatttttatatcc

SEQ ID NO: 474061 - DNA, 20 bp, Artificial
  CRISPR gRNA sequence
ttcaatcatttttatatcca

SEQ ID NO: 474062 - DNA, 20 bp, Artificial
  CRISPR gRNA sequence
aatcatttttatatccacct

SEQ ID NO: 474063 - DNA, 20 bp, Artificial
  CRISPR gRNA sequence
ttatatccacctaaacagta

SEQ ID NO: 474064 - DNA, 20 bp, Artificial
  CRISPR gRNA sequence
tatatccacctaaacagtat

SEQ ID NO: 474065 - DNA, 20 bp, Artificial
  CRISPR gRNA sequence
atatccacctaaacagtatg

SEQ ID NO: 474066 - DNA, 20 bp, Artificial
  CRISPR gRNA sequence
tatccacctaaacagtatga

SEQ ID NO: 474067 - DNA, 20 bp, Artificial
  CRISPR gRNA sequence
aacagtatgaactttgattc

SEQ ID NO: 474068 - DNA, 20 bp, Artificial
  CRISPR gRNA sequence
tgattctttagttatagtct

SEQ ID NO: 474069 - DNA, 20 bp, Artificial
  CRISPR gRNA sequence
gattctttagttatagtctg

SEQ ID NO: 474070 - DNA, 20 bp, Artificial
  CRISPR gRNA sequence
attctttagttatagtctga

SEQ ID NO: 474071 - DNA, 20 bp, Artificial
  CRISPR gRNA sequence
tttagttatagtctgatata

SEQ ID NO: 474072 - DNA, 20 bp, Artificial
  CRISPR gRNA sequence
tagttatagtctgatataat

SEQ ID NO: 474073 - DNA, 20 bp, Artificial
  CRISPR gRNA sequence
agttatagtctgatataata

SEQ ID NO: 474074 - DNA, 20 bp, Artificial
  CRISPR gRNA sequence
gttatagtctgatataatag

SEQ ID NO: 474075 - DNA, 20 bp, Artificial
  CRISPR gRNA sequence
tagtctgatataatagttta

SEQ ID NO: 474076 - DNA, 20 bp, Artificial
  CRISPR gRNA sequence
atataatagtttatgtaaat

SEQ ID NO: 474077 - DNA, 20 bp, Artificial
  CRISPR gRNA sequence
atgtaaatagttgtccaata

SEQ ID NO: 474078 - DNA, 20 bp, Artificial
  CRISPR gRNA sequence
tgtaaatagttgtccaataa

SEQ ID NO: 474079 - DNA, 20 bp, Artificial
  CRISPR gRNA sequence
tccaataactaataaatgga

SEQ ID NO: 474080 - DNA, 20 bp, Artificial
  CRISPR gRNA sequence
ataaatggattgtattaaaa

SEQ ID NO: 474081 - DNA, 20 bp, Artificial
  CRISPR gRNA sequence
tattaaaactgaaattctgc

SEQ ID NO: 474082 - DNA, 20 bp, Artificial
  CRISPR gRNA sequence
aaactgaaattctgcaaaga

SEQ ID NO: 474083 - DNA, 20 bp, Artificial
  CRISPR gRNA sequence
aaattctgcaaagatacaat

SEQ ID NO: 474084 - DNA, 20 bp, Artificial
  CRISPR gRNA sequence
tgcaaagatacaatttaggt

SEQ ID NO: 474085 - DNA, 20 bp, Artificial
  CRISPR gRNA sequence
caaagatacaatttaggtaa

SEQ ID NO: 474086 - DNA, 20 bp, Artificial
  CRISPR gRNA sequence
aggtaactactaaattgtaa

SEQ ID NO: 474087 - DNA, 20 bp, Artificial
  CRISPR gRNA sequence
ggtaactactaaattgtaac

SEQ ID NO: 474088 - DNA, 20 bp, Artificial
  CRISPR gRNA sequence
ctaaattgtaacactaaagt

SEQ ID NO: 474089 - DNA, 20 bp, Artificial
  CRISPR gRNA sequence
aattgtaacactaaagtttt

SEQ ID NO: 474090 - DNA, 20 bp, Artificial
  CRISPR gRNA sequence
taacactaaagttttatttt

SEQ ID NO: 474091 - DNA, 20 bp, Artificial
  CRISPR gRNA sequence
aagttttattttctaaagtt

SEQ ID NO: 474092 - DNA, 20 bp, Artificial
  CRISPR gRNA sequence
tattttctaaagttagtttt

SEQ ID NO: 474093 - DNA, 20 bp, Artificial
  CRISPR gRNA sequence
attttctaaagttagtttta

SEQ ID NO: 474094 - DNA, 20 bp, Artificial
  CRISPR gRNA sequence
ttttctaaagttagttttaa

SEQ ID NO: 474095 - DNA, 20 bp, Artificial
  CRISPR gRNA sequence
tctaaagttagttttaaaac

SEQ ID NO: 474096 - DNA, 20 bp, Artificial
  CRISPR gRNA sequence
ctaaagttagttttaaaaca

SEQ ID NO: 474097 - DNA, 20 bp, Artificial
  CRISPR gRNA sequence
taaagttagttttaaaacaa

SEQ ID NO: 474098 - DNA, 20 bp, Artificial
  CRISPR gRNA sequence
aagttagttttaaaacaaca

SEQ ID NO: 474099 - DNA, 20 bp, Artificial
  CRISPR gRNA sequence
gttttaaaacaacattaaaa

SEQ ID NO: 474100 - DNA, 20 bp, Artificial
  CRISPR gRNA sequence
taaaacaacattaaaaaaat

SEQ ID NO: 474101 - DNA, 20 bp, Artificial
  CRISPR gRNA sequence
aaaacaacattaaaaaaatt

SEQ ID NO: 474102 - DNA, 20 bp, Artificial
  CRISPR gRNA sequence
aaacaacattaaaaaaattt

SEQ ID NO: 474103 - DNA, 20 bp, Artificial
  CRISPR gRNA sequence
aaaaaatttcaattgtaaaa

SEQ ID NO: 474104 - DNA, 20 bp, Artificial
  CRISPR gRNA sequence
caattgtaaaaatattaatc

SEQ ID NO: 474105 - DNA, 20 bp, Artificial
  CRISPR gRNA sequence
aattgtaaaaatattaatca

SEQ ID NO: 474106 - DNA, 20 bp, Artificial
  CRISPR gRNA sequence
taaaaatattaatcaatcta

SEQ ID NO: 474107 - DNA, 20 bp, Artificial
  CRISPR gRNA sequence
atcaatctaacattttatgc

SEQ ID NO: 474108 - DNA, 20 bp, Artificial
  CRISPR gRNA sequence
acattttatgcatgaaataa

SEQ ID NO: 474109 - DNA, 20 bp, Artificial
  CRISPR gRNA sequence
tatgcatgaaataaagttgc

SEQ ID NO: 474110 - DNA, 20 bp, Artificial
  CRISPR gRNA sequence
atgcatgaaataaagttgcc

SEQ ID NO: 474111 - DNA, 20 bp, Artificial
  CRISPR gRNA sequence
tgcatgaaataaagttgcca

SEQ ID NO: 474112 - DNA, 20 bp, Artificial
  CRISPR gRNA sequence
ccaagccgaagattttatat

SEQ ID NO: 474113 - DNA, 20 bp, Artificial
  CRISPR gRNA sequence
tatatatcacagtttgtatc

SEQ ID NO: 474114 - DNA, 20 bp, Artificial
  CRISPR gRNA sequence
atatatcacagtttgtatcc

SEQ ID NO: 474115 - DNA, 20 bp, Artificial
  CRISPR gRNA sequence
tatatcacagtttgtatcct

SEQ ID NO: 474116 - DNA, 20 bp, Artificial
  CRISPR gRNA sequence
gtatccttttcactgtttta

SEQ ID NO: 474117 - DNA, 20 bp, Artificial
  CRISPR gRNA sequence
tatccttttcactgttttaa

SEQ ID NO: 474118 - DNA, 20 bp, Artificial
  CRISPR gRNA sequence
ttcactgttttaaattttaa

SEQ ID NO: 474119 - DNA, 20 bp, Artificial
  CRISPR gRNA sequence
tcactgttttaaattttaaa

SEQ ID NO: 474120 - DNA, 20 bp, Artificial
  CRISPR gRNA sequence
cactgttttaaattttaaac

SEQ ID NO: 474121 - DNA, 20 bp, Artificial
  CRISPR gRNA sequence
actgttttaaattttaaaca

SEQ ID NO: 474122 - DNA, 20 bp, Artificial
  CRISPR gRNA sequence
ttttaaattttaaacacaaa

SEQ ID NO: 474123 - DNA, 20 bp, Artificial
  CRISPR gRNA sequence
taaattttaaacacaaataa

SEQ ID NO: 474124 - DNA, 20 bp, Artificial
  CRISPR gRNA sequence
aaattttaaacacaaataaa

SEQ ID NO: 474125 - DNA, 20 bp, Artificial
  CRISPR gRNA sequence
aattttaaacacaaataaaa

SEQ ID NO: 474126 - DNA, 20 bp, Artificial
  CRISPR gRNA sequence
taaacacaaataaaaattca

SEQ ID NO: 474127 - DNA, 20 bp, Artificial
  CRISPR gRNA sequence
aaacacaaataaaaattcaa

SEQ ID NO: 474128 - DNA, 20 bp, Artificial
  CRISPR gRNA sequence
aacacaaataaaaattcaag

SEQ ID NO: 474129 - DNA, 20 bp, Artificial
  CRISPR gRNA sequence
aagaagtttgcaccaaatga

SEQ ID NO: 474130 - DNA, 20 bp, Artificial
  CRISPR gRNA sequence
gcaccaaatgacaaaaatga

SEQ ID NO: 474131 - DNA, 20 bp, Artificial
  CRISPR gRNA sequence
caccaaatgacaaaaatgaa

SEQ ID NO: 474132 - DNA, 20 bp, Artificial
  CRISPR gRNA sequence
ctgttctgcttctttgtctc

SEQ ID NO: 474133 - DNA, 20 bp, Artificial
  CRISPR gRNA sequence
ttctgcttctttgtctcagc

SEQ ID NO: 474134 - DNA, 20 bp, Artificial
  CRISPR gRNA sequence
tgcttctttgtctcagcatt

SEQ ID NO: 474135 - DNA, 20 bp, Artificial
  CRISPR gRNA sequence
cttctttgtctcagcattct

SEQ ID NO: 474136 - DNA, 20 bp, Artificial
  CRISPR gRNA sequence
ctttgtctcagcattctctg

SEQ ID NO: 474137 - DNA, 20 bp, Artificial
  CRISPR gRNA sequence
tttgtctcagcattctctgt

SEQ ID NO: 474138 - DNA, 20 bp, Artificial
  CRISPR gRNA sequence
tgtctcagcattctctgtgg

SEQ ID NO: 474139 - DNA, 20 bp, Artificial
  CRISPR gRNA sequence
gtctcagcattctctgtggt

SEQ ID NO: 474140 - DNA, 20 bp, Artificial
  CRISPR gRNA sequence
tctcagcattctctgtggta

SEQ ID NO: 474141 - DNA, 20 bp, Artificial
  CRISPR gRNA sequence
agcattctctgtggtattat

SEQ ID NO: 474142 - DNA, 20 bp, Artificial
  CRISPR gRNA sequence
tctgtggtattattgtttat

SEQ ID NO: 474143 - DNA, 20 bp, Artificial
  CRISPR gRNA sequence
tgtggtattattgtttattt

SEQ ID NO: 474144 - DNA, 20 bp, Artificial
  CRISPR gRNA sequence
tggtattattgtttatttaa

SEQ ID NO: 474145 - DNA, 20 bp, Artificial
  CRISPR gRNA sequence
ttgtttatttaaaattgaat

SEQ ID NO: 474146 - DNA, 20 bp, Artificial
  CRISPR gRNA sequence
tttatttaaaattgaatgtt

SEQ ID NO: 474147 - DNA, 20 bp, Artificial
  CRISPR gRNA sequence
atttaaaattgaatgttgaa

SEQ ID NO: 474148 - DNA, 20 bp, Artificial
  CRISPR gRNA sequence
tttaaaattgaatgttgaaa

SEQ ID NO: 474149 - DNA, 20 bp, Artificial
  CRISPR gRNA sequence
aaaattgaatgttgaaaggc

SEQ ID NO: 474150 - DNA, 20 bp, Artificial
  CRISPR gRNA sequence
aaattgaatgttgaaaggct

SEQ ID NO: 474151 - DNA, 20 bp, Artificial
  CRISPR gRNA sequence
aatgttgaaaggctggagta

SEQ ID NO: 474152 - DNA, 20 bp, Artificial
  CRISPR gRNA sequence
aaaggctggagtatgtagta

SEQ ID NO: 474153 - DNA, 20 bp, Artificial
  CRISPR gRNA sequence
gagtatgtagtaccacagag

SEQ ID NO: 474154 - DNA, 20 bp, Artificial
  CRISPR gRNA sequence
ggaggaaactggagtgatcc

SEQ ID NO: 474155 - DNA, 20 bp, Artificial
  CRISPR gRNA sequence
gaggaaactggagtgatcct

SEQ ID NO: 474156 - DNA, 20 bp, Artificial
  CRISPR gRNA sequence
gagtgatcctggactttata

SEQ ID NO: 474157 - DNA, 20 bp, Artificial
  CRISPR gRNA sequence
gactttataaatttgctatc

SEQ ID NO: 474158 - DNA, 20 bp, Artificial
  CRISPR gRNA sequence
tataaatttgctatcaaaat

SEQ ID NO: 474159 - DNA, 20 bp, Artificial
  CRISPR gRNA sequence
ataaatttgctatcaaaatg

SEQ ID NO: 474160 - DNA, 20 bp, Artificial
  CRISPR gRNA sequence
taaatttgctatcaaaatga

SEQ ID NO: 474161 - DNA, 20 bp, Artificial
  CRISPR gRNA sequence
gctatcaaaatgaacacaag

SEQ ID NO: 474162 - DNA, 20 bp, Artificial
  CRISPR gRNA sequence
ctatcaaaatgaacacaagt

SEQ ID NO: 474163 - DNA, 20 bp, Artificial
  CRISPR gRNA sequence
tcaaaatgaacacaagtagc

SEQ ID NO: 474164 - DNA, 20 bp, Artificial
  CRISPR gRNA sequence
aatggtatatgtccaaggcc

SEQ ID NO: 474165 - DNA, 20 bp, Artificial
  CRISPR gRNA sequence
tataactgggaagttctctg

SEQ ID NO: 474166 - DNA, 20 bp, Artificial
  CRISPR gRNA sequence
ggaagttctctgagttaact

SEQ ID NO: 474167 - DNA, 20 bp, Artificial
  CRISPR gRNA sequence
tctgagttaacttgcaagta

SEQ ID NO: 474168 - DNA, 20 bp, Artificial
  CRISPR gRNA sequence
tgagttaacttgcaagtaga

SEQ ID NO: 474169 - DNA, 20 bp, Artificial
  CRISPR gRNA sequence
agttaacttgcaagtagaat

SEQ ID NO: 474170 - DNA, 20 bp, Artificial
  CRISPR gRNA sequence
acttgcaagtagaatgcaat

SEQ ID NO: 474171 - DNA, 20 bp, Artificial
  CRISPR gRNA sequence
gcaagtagaatgcaatgttt

SEQ ID NO: 474172 - DNA, 20 bp, Artificial
  CRISPR gRNA sequence
caagtagaatgcaatgtttg

SEQ ID NO: 474173 - DNA, 20 bp, Artificial
  CRISPR gRNA sequence
gtcaaatgatatatactaca

SEQ ID NO: 474174 - DNA, 20 bp, Artificial
  CRISPR gRNA sequence
tcaaatgatatatactacaa

SEQ ID NO: 474175 - DNA, 20 bp, Artificial
  CRISPR gRNA sequence
caaatgtgctaatttgaagt

SEQ ID NO: 474176 - DNA, 20 bp, Artificial
  CRISPR gRNA sequence
atttgaagtttacatatata

SEQ ID NO: 474177 - DNA, 20 bp, Artificial
  CRISPR gRNA sequence
gaagtttacatatatatcat

SEQ ID NO: 474178 - DNA, 20 bp, Artificial
  CRISPR gRNA sequence
aagtttacatatatatcata

SEQ ID NO: 474179 - DNA, 20 bp, Artificial
  CRISPR gRNA sequence
acatatatatcataaaactc

SEQ ID NO: 474180 - DNA, 20 bp, Artificial
  CRISPR gRNA sequence
catatatatcataaaactca

SEQ ID NO: 474181 - DNA, 20 bp, Artificial
  CRISPR gRNA sequence
aacagtaaccatagtattta

SEQ ID NO: 474182 - DNA, 20 bp, Artificial
  CRISPR gRNA sequence
agaacttagaccaaaaatat

SEQ ID NO: 474183 - DNA, 20 bp, Artificial
  CRISPR gRNA sequence
gaacttagaccaaaaatatt

SEQ ID NO: 474184 - DNA, 20 bp, Artificial
  CRISPR gRNA sequence
agaccaaaaatattttgaag

SEQ ID NO: 474185 - DNA, 20 bp, Artificial
  CRISPR gRNA sequence
gaccaaaaatattttgaagg

SEQ ID NO: 474186 - DNA, 20 bp, Artificial
  CRISPR gRNA sequence
tgaagggtaaatatttcacc

SEQ ID NO: 474187 - DNA, 20 bp, Artificial
  CRISPR gRNA sequence
gaagggtaaatatttcacct

SEQ ID NO: 474188 - DNA, 20 bp, Artificial
  CRISPR gRNA sequence
aagggtaaatatttcacctc

SEQ ID NO: 474189 - DNA, 20 bp, Artificial
  CRISPR gRNA sequence
cacctctgacattgttcatg

SEQ ID NO: 474190 - DNA, 20 bp, Artificial
  CRISPR gRNA sequence
acctctgacattgttcatgt

SEQ ID NO: 474191 - DNA, 20 bp, Artificial
  CRISPR gRNA sequence
tgacattgttcatgtttgct

SEQ ID NO: 474192 - DNA, 20 bp, Artificial
  CRISPR gRNA sequence
acattgttcatgtttgctag

SEQ ID NO: 474193 - DNA, 20 bp, Artificial
  CRISPR gRNA sequence
ttcatgtttgctagtatgtg

SEQ ID NO: 474194 - DNA, 20 bp, Artificial
  CRISPR gRNA sequence
atgtttgctagtatgtggtg

SEQ ID NO: 474195 - DNA, 20 bp, Artificial
  CRISPR gRNA sequence
gctagtatgtggtgataatt

SEQ ID NO: 474196 - DNA, 20 bp, Artificial
  CRISPR gRNA sequence
ctagtatgtggtgataatta

SEQ ID NO: 474197 - DNA, 20 bp, Artificial
  CRISPR gRNA sequence
gtatgtggtgataattaaaa

SEQ ID NO: 474198 - DNA, 20 bp, Artificial
  CRISPR gRNA sequence
aaaggaaaccggccgggcgt

SEQ ID NO: 474199 - DNA, 20 bp, Artificial
  CRISPR gRNA sequence
atgcctgtaatcccagcact

SEQ ID NO: 474200 - DNA, 20 bp, Artificial
  CRISPR gRNA sequence
taatcccagcactttgggag

SEQ ID NO: 474201 - DNA, 20 bp, Artificial
  CRISPR gRNA sequence
tgggaggccagggcgggcgg

SEQ ID NO: 474202 - DNA, 20 bp, Artificial
  CRISPR gRNA sequence
gggaggccagggcgggcgga

SEQ ID NO: 474203 - DNA, 20 bp, Artificial
  CRISPR gRNA sequence
ggaggccagggcgggcggat

SEQ ID NO: 474204 - DNA, 20 bp, Artificial
  CRISPR gRNA sequence
gagaccagcctaaccaacat

SEQ ID NO: 474205 - DNA, 20 bp, Artificial
  CRISPR gRNA sequence
agaccagcctaaccaacatg

SEQ ID NO: 474206 - DNA, 20 bp, Artificial
  CRISPR gRNA sequence
accaacatggagaaaccctg

SEQ ID NO: 474207 - DNA, 20 bp, Artificial
  CRISPR gRNA sequence
tctctattaaaaaatacaaa

SEQ ID NO: 474208 - DNA, 20 bp, Artificial
  CRISPR gRNA sequence
tattaaaaaatacaaaatta

SEQ ID NO: 474209 - DNA, 20 bp, Artificial
  CRISPR gRNA sequence
ttaaaaaatacaaaattagc

SEQ ID NO: 474210 - DNA, 20 bp, Artificial
  CRISPR gRNA sequence
aaaaatacaaaattagctgg

SEQ ID NO: 474211 - DNA, 20 bp, Artificial
  CRISPR gRNA sequence
gctgggtatggtggcgcatg

SEQ ID NO: 474212 - DNA, 20 bp, Artificial
  CRISPR gRNA sequence
ggtatggtggcgcatgcctg

SEQ ID NO: 474213 - DNA, 20 bp, Artificial
  CRISPR gRNA sequence
taatcccagctactcaggag

SEQ ID NO: 474214 - DNA, 20 bp, Artificial
  CRISPR gRNA sequence
ctcaggaggctgaggcagga

SEQ ID NO: 474215 - DNA, 20 bp, Artificial
  CRISPR gRNA sequence
aggaggctgaggcaggagaa

SEQ ID NO: 474216 - DNA, 20 bp, Artificial
  CRISPR gRNA sequence
aggcaggagaatagcttgaa

SEQ ID NO: 474217 - DNA, 20 bp, Artificial
  CRISPR gRNA sequence
gaacccaggaggcggaggtt

SEQ ID NO: 474218 - DNA, 20 bp, Artificial
  CRISPR gRNA sequence
aacccaggaggcggaggttg

SEQ ID NO: 474219 - DNA, 20 bp, Artificial
  CRISPR gRNA sequence
cggtgagctgagatcgtgcc

SEQ ID NO: 474220 - DNA, 20 bp, Artificial
  CRISPR gRNA sequence
agatcgtgccattgcactcc

SEQ ID NO: 474221 - DNA, 20 bp, Artificial
  CRISPR gRNA sequence
cactccagcctgggcaacaa

SEQ ID NO: 474222 - DNA, 20 bp, Artificial
  CRISPR gRNA sequence
cagcctgggcaacaagagcg

SEQ ID NO: 474223 - DNA, 20 bp, Artificial
  CRISPR gRNA sequence
ggcaacaagagcgaaaatct

SEQ ID NO: 474224 - DNA, 20 bp, Artificial
  CRISPR gRNA sequence
tgtcaaaaaaaaaaaaagga

SEQ ID NO: 474225 - DNA, 20 bp, Artificial
  CRISPR gRNA sequence
ttagttgtttttaaattcaa

SEQ ID NO: 474226 - DNA, 20 bp, Artificial
  CRISPR gRNA sequence
tagttgtttttaaattcaat

SEQ ID NO: 474227 - DNA, 20 bp, Artificial
  CRISPR gRNA sequence
agttgtttttaaattcaata

SEQ ID NO: 474228 - DNA, 20 bp, Artificial
  CRISPR gRNA sequence
gttgtttttaaattcaatac

SEQ ID NO: 474229 - DNA, 20 bp, Artificial
  CRISPR gRNA sequence
tttttaaattcaatacagac

SEQ ID NO: 474230 - DNA, 20 bp, Artificial
  CRISPR gRNA sequence
ttaaattcaatacagacaat

SEQ ID NO: 474231 - DNA, 20 bp, Artificial
  CRISPR gRNA sequence
taaattcaatacagacaatg

SEQ ID NO: 474232 - DNA, 20 bp, Artificial
  CRISPR gRNA sequence
aaattcaatacagacaatgg

SEQ ID NO: 474233 - DNA, 20 bp, Artificial
  CRISPR gRNA sequence
aattcaatacagacaatgga

SEQ ID NO: 474234 - DNA, 20 bp, Artificial
  CRISPR gRNA sequence
aatacagacaatggagccac

SEQ ID NO: 474235 - DNA, 20 bp, Artificial
  CRISPR gRNA sequence
gttcacacccaggagtctgg

SEQ ID NO: 474236 - DNA, 20 bp, Artificial
  CRISPR gRNA sequence
ttcacacccaggagtctgga

SEQ ID NO: 474237 - DNA, 20 bp, Artificial
  CRISPR gRNA sequence
acacccaggagtctggatat

SEQ ID NO: 474238 - DNA, 20 bp, Artificial
  CRISPR gRNA sequence
gatatcccactgtccttgac

SEQ ID NO: 474239 - DNA, 20 bp, Artificial
  CRISPR gRNA sequence
tccttgacacattagtaacg

SEQ ID NO: 474240 - DNA, 20 bp, Artificial
  CRISPR gRNA sequence
gacacattagtaacgagaca

SEQ ID NO: 474241 - DNA, 20 bp, Artificial
  CRISPR gRNA sequence
acacattagtaacgagacag

SEQ ID NO: 474242 - DNA, 20 bp, Artificial
  CRISPR gRNA sequence
gtaacgagacagtttctagc

SEQ ID NO: 474243 - DNA, 20 bp, Artificial
  CRISPR gRNA sequence
ctagcacaaagaagaggctg

SEQ ID NO: 474244 - DNA, 20 bp, Artificial
  CRISPR gRNA sequence
tagcacaaagaagaggctga

SEQ ID NO: 474245 - DNA, 20 bp, Artificial
  CRISPR gRNA sequence
gcacaaagaagaggctgaaa

SEQ ID NO: 474246 - DNA, 20 bp, Artificial
  CRISPR gRNA sequence
aaagtcttacaccacttttc

SEQ ID NO: 474247 - DNA, 20 bp, Artificial
  CRISPR gRNA sequence
acaccacttttcaattttgc

SEQ ID NO: 474248 - DNA, 20 bp, Artificial
  CRISPR gRNA sequence
caccacttttcaattttgcc

SEQ ID NO: 474249 - DNA, 20 bp, Artificial
  CRISPR gRNA sequence
ttcaattttgccattagatt

SEQ ID NO: 474250 - DNA, 20 bp, Artificial
  CRISPR gRNA sequence
tcaattttgccattagattt

SEQ ID NO: 474251 - DNA, 20 bp, Artificial
  CRISPR gRNA sequence
caattttgccattagatttt

SEQ ID NO: 474252 - DNA, 20 bp, Artificial
  CRISPR gRNA sequence
aattttgccattagattttt

SEQ ID NO: 474253 - DNA, 20 bp, Artificial
  CRISPR gRNA sequence
tgccattagatttttgttgt

SEQ ID NO: 474254 - DNA, 20 bp, Artificial
  CRISPR gRNA sequence
gccattagatttttgttgta

SEQ ID NO: 474255 - DNA, 20 bp, Artificial
  CRISPR gRNA sequence
ccattagatttttgttgtat

SEQ ID NO: 474256 - DNA, 20 bp, Artificial
  CRISPR gRNA sequence
gatttttgttgtattatttt

SEQ ID NO: 474257 - DNA, 20 bp, Artificial
  CRISPR gRNA sequence
ttgttgtattattttggata

SEQ ID NO: 474258 - DNA, 20 bp, Artificial
  CRISPR gRNA sequence
tgttgtattattttggatat

SEQ ID NO: 474259 - DNA, 20 bp, Artificial
  CRISPR gRNA sequence
gttgtattattttggatatg

SEQ ID NO: 474260 - DNA, 20 bp, Artificial
  CRISPR gRNA sequence
ttgtattattttggatatga

SEQ ID NO: 474261 - DNA, 20 bp, Artificial
  CRISPR gRNA sequence
tattattttggatatgatat

SEQ ID NO: 474262 - DNA, 20 bp, Artificial
  CRISPR gRNA sequence
ttttggatatgatataatct

SEQ ID NO: 474263 - DNA, 20 bp, Artificial
  CRISPR gRNA sequence
tggatatgatataatctctc

SEQ ID NO: 474264 - DNA, 20 bp, Artificial
  CRISPR gRNA sequence
ggatatgatataatctctca

SEQ ID NO: 474265 - DNA, 20 bp, Artificial
  CRISPR gRNA sequence
gatatgatataatctctcag

SEQ ID NO: 474266 - DNA, 20 bp, Artificial
  CRISPR gRNA sequence
tcagagctttcagatccctc

SEQ ID NO: 474267 - DNA, 20 bp, Artificial
  CRISPR gRNA sequence
agagctttcagatccctcaa

SEQ ID NO: 474268 - DNA, 20 bp, Artificial
  CRISPR gRNA sequence
tcagatccctcaagaggaag

SEQ ID NO: 474269 - DNA, 20 bp, Artificial
  CRISPR gRNA sequence
cagatccctcaagaggaaga

SEQ ID NO: 474270 - DNA, 20 bp, Artificial
  CRISPR gRNA sequence
agatccctcaagaggaagac

SEQ ID NO: 474271 - DNA, 20 bp, Artificial
  CRISPR gRNA sequence
aagaggaagacagtctttct

SEQ ID NO: 474272 - DNA, 20 bp, Artificial
  CRISPR gRNA sequence
tctggctgggtcaatcagga

SEQ ID NO: 474273 - DNA, 20 bp, Artificial
  CRISPR gRNA sequence
ctggctgggtcaatcaggaa

SEQ ID NO: 474274 - DNA, 20 bp, Artificial
  CRISPR gRNA sequence
tggctgggtcaatcaggaaa

SEQ ID NO: 474275 - DNA, 20 bp, Artificial
  CRISPR gRNA sequence
gctgggtcaatcaggaaagg

SEQ ID NO: 474276 - DNA, 20 bp, Artificial
  CRISPR gRNA sequence
ggtcaatcaggaaaggcttc

SEQ ID NO: 474277 - DNA, 20 bp, Artificial
  CRISPR gRNA sequence
catgggggaagataaatctc

SEQ ID NO: 474278 - DNA, 20 bp, Artificial
  CRISPR gRNA sequence
atgggggaagataaatctct

SEQ ID NO: 474279 - DNA, 20 bp, Artificial
  CRISPR gRNA sequence
tttcttcctccaagccaacc

SEQ ID NO: 474280 - DNA, 20 bp, Artificial
  CRISPR gRNA sequence
tcttcctccaagccaacccc

SEQ ID NO: 474281 - DNA, 20 bp, Artificial
  CRISPR gRNA sequence
cttcctccaagccaaccccc

SEQ ID NO: 474282 - DNA, 20 bp, Artificial
  CRISPR gRNA sequence
ttcctccaagccaaccccca

SEQ ID NO: 474283 - DNA, 20 bp, Artificial
  CRISPR gRNA sequence
cctccaagccaacccccagg

SEQ ID NO: 474284 - DNA, 20 bp, Artificial
  CRISPR gRNA sequence
ctccaagccaacccccaggc

SEQ ID NO: 474285 - DNA, 20 bp, Artificial
  CRISPR gRNA sequence
caagccaacccccaggcaaa

SEQ ID NO: 474286 - DNA, 20 bp, Artificial
  CRISPR gRNA sequence
ggtcctcctctcattatcac

SEQ ID NO: 474287 - DNA, 20 bp, Artificial
  CRISPR gRNA sequence
gtcctcctctcattatcaca

SEQ ID NO: 474288 - DNA, 20 bp, Artificial
  CRISPR gRNA sequence
ctctcattatcacagtataa

SEQ ID NO: 474289 - DNA, 20 bp, Artificial
  CRISPR gRNA sequence
tcattatcacagtataatac

SEQ ID NO: 474290 - DNA, 20 bp, Artificial
  CRISPR gRNA sequence
attatcacagtataatacca

SEQ ID NO: 474291 - DNA, 20 bp, Artificial
  CRISPR gRNA sequence
tcacagtataataccatcat

SEQ ID NO: 474292 - DNA, 20 bp, Artificial
  CRISPR gRNA sequence
cctaatcacattagccagaa

SEQ ID NO: 474293 - DNA, 20 bp, Artificial
  CRISPR gRNA sequence
atcacattagccagaacctg

SEQ ID NO: 474294 - DNA, 20 bp, Artificial
  CRISPR gRNA sequence
gccagaacctggggagccat

SEQ ID NO: 474295 - DNA, 20 bp, Artificial
  CRISPR gRNA sequence
gggagccatcttagtctcct

SEQ ID NO: 474296 - DNA, 20 bp, Artificial
  CRISPR gRNA sequence
agtctccttccttgtcaccg

SEQ ID NO: 474297 - DNA, 20 bp, Artificial
  CRISPR gRNA sequence
gtctccttccttgtcaccgt

SEQ ID NO: 474298 - DNA, 20 bp, Artificial
  CRISPR gRNA sequence
cttccttgtcaccgtcccat

SEQ ID NO: 474299 - DNA, 20 bp, Artificial
  CRISPR gRNA sequence
ccttgtcaccgtcccattcc

SEQ ID NO: 474300 - DNA, 20 bp, Artificial
  CRISPR gRNA sequence
cttgtcaccgtcccattcca

SEQ ID NO: 474301 - DNA, 20 bp, Artificial
  CRISPR gRNA sequence
gtcaccgtcccattccatca

SEQ ID NO: 474302 - DNA, 20 bp, Artificial
  CRISPR gRNA sequence
tcaccgtcccattccatcag

SEQ ID NO: 474303 - DNA, 20 bp, Artificial
  CRISPR gRNA sequence
catcagccatgaagttcaat

SEQ ID NO: 474304 - DNA, 20 bp, Artificial
  CRISPR gRNA sequence
aattgattcaggatggaaaa

SEQ ID NO: 474305 - DNA, 20 bp, Artificial
  CRISPR gRNA sequence
attcaggatggaaaatgtct

SEQ ID NO: 474306 - DNA, 20 bp, Artificial
  CRISPR gRNA sequence
aggatggaaaatgtcttcca

SEQ ID NO: 474307 - DNA, 20 bp, Artificial
  CRISPR gRNA sequence
ccatatttgtttccatgaca

SEQ ID NO: 474308 - DNA, 20 bp, Artificial
  CRISPR gRNA sequence
catatttgtttccatgacac

SEQ ID NO: 474309 - DNA, 20 bp, Artificial
  CRISPR gRNA sequence
gtttccatgacactgcctta

SEQ ID NO: 474310 - DNA, 20 bp, Artificial
  CRISPR gRNA sequence
tttccatgacactgccttaa

SEQ ID NO: 474311 - DNA, 20 bp, Artificial
  CRISPR gRNA sequence
ccatgacactgccttaattt

SEQ ID NO: 474312 - DNA, 20 bp, Artificial
  CRISPR gRNA sequence
catgacactgccttaatttg

SEQ ID NO: 474313 - DNA, 20 bp, Artificial
  CRISPR gRNA sequence
ccttaatttggatctcattc

SEQ ID NO: 474314 - DNA, 20 bp, Artificial
  CRISPR gRNA sequence
aatttggatctcattctgtt

SEQ ID NO: 474315 - DNA, 20 bp, Artificial
  CRISPR gRNA sequence
atttggatctcattctgttt

SEQ ID NO: 474316 - DNA, 20 bp, Artificial
  CRISPR gRNA sequence
ggatctcattctgtttcatg

SEQ ID NO: 474317 - DNA, 20 bp, Artificial
  CRISPR gRNA sequence
gatctcattctgtttcatgt

SEQ ID NO: 474318 - DNA, 20 bp, Artificial
  CRISPR gRNA sequence
attctgtttcatgtggatta

SEQ ID NO: 474319 - DNA, 20 bp, Artificial
  CRISPR gRNA sequence
tgtttcatgtggattattgt

SEQ ID NO: 474320 - DNA, 20 bp, Artificial
  CRISPR gRNA sequence
tttcatgtggattattgtca

SEQ ID NO: 474321 - DNA, 20 bp, Artificial
  CRISPR gRNA sequence
catgtggattattgtcacag

SEQ ID NO: 474322 - DNA, 20 bp, Artificial
  CRISPR gRNA sequence
atgtggattattgtcacagc

SEQ ID NO: 474323 - DNA, 20 bp, Artificial
  CRISPR gRNA sequence
ttgtcacagcgtaccaaatg

SEQ ID NO: 474324 - DNA, 20 bp, Artificial
  CRISPR gRNA sequence
tcacagcgtaccaaatggtc

SEQ ID NO: 474325 - DNA, 20 bp, Artificial
  CRISPR gRNA sequence
ctacattccaaacttggcct

SEQ ID NO: 474326 - DNA, 20 bp, Artificial
  CRISPR gRNA sequence
tacattccaaacttggcctt

SEQ ID NO: 474327 - DNA, 20 bp, Artificial
  CRISPR gRNA sequence
cattccaaacttggccttgt

SEQ ID NO: 474328 - DNA, 20 bp, Artificial
  CRISPR gRNA sequence
caaacttggccttgtttccc

SEQ ID NO: 474329 - DNA, 20 bp, Artificial
  CRISPR gRNA sequence
ggccttgtttccctccctcc

SEQ ID NO: 474330 - DNA, 20 bp, Artificial
  CRISPR gRNA sequence
gccttgtttccctccctcca

SEQ ID NO: 474331 - DNA, 20 bp, Artificial
  CRISPR gRNA sequence
gtttccctccctccacctca

SEQ ID NO: 474332 - DNA, 20 bp, Artificial
  CRISPR gRNA sequence
tttccctccctccacctcaa

SEQ ID NO: 474333 - DNA, 20 bp, Artificial
  CRISPR gRNA sequence
ccctccctccacctcaattc

SEQ ID NO: 474334 - DNA, 20 bp, Artificial
  CRISPR gRNA sequence
cctccctccacctcaattct

SEQ ID NO: 474335 - DNA, 20 bp, Artificial
  CRISPR gRNA sequence
cctccacctcaattctccac

SEQ ID NO: 474336 - DNA, 20 bp, Artificial
  CRISPR gRNA sequence
cacctcaattctccacatca

SEQ ID NO: 474337 - DNA, 20 bp, Artificial
  CRISPR gRNA sequence
aattctccacatcactgtca

SEQ ID NO: 474338 - DNA, 20 bp, Artificial
  CRISPR gRNA sequence
tccacatcactgtcacagtt

SEQ ID NO: 474339 - DNA, 20 bp, Artificial
  CRISPR gRNA sequence
cacatcactgtcacagtttc

SEQ ID NO: 474340 - DNA, 20 bp, Artificial
  CRISPR gRNA sequence
tcacagtttccgttttcttt

SEQ ID NO: 474341 - DNA, 20 bp, Artificial
  CRISPR gRNA sequence
ccgttttcttttttcttttt

SEQ ID NO: 474342 - DNA, 20 bp, Artificial
  CRISPR gRNA sequence
cgttttcttttttctttttt

SEQ ID NO: 474343 - DNA, 20 bp, Artificial
  CRISPR gRNA sequence
tcttttttcttttttttttt

SEQ ID NO: 474344 - DNA, 20 bp, Artificial
  CRISPR gRNA sequence
cttttttctttttttttttt

SEQ ID NO: 474345 - DNA, 20 bp, Artificial
  CRISPR gRNA sequence
ttttttcttttttttttttt

SEQ ID NO: 474346 - DNA, 20 bp, Artificial
  CRISPR gRNA sequence
ttttcttttttttttttttt

SEQ ID NO: 474347 - DNA, 20 bp, Artificial
  CRISPR gRNA sequence
tttctttttttttttttttt

SEQ ID NO: 474348 - DNA, 20 bp, Artificial
  CRISPR gRNA sequence
ttcttttttttttttttttt

SEQ ID NO: 474349 - DNA, 20 bp, Artificial
  CRISPR gRNA sequence
tctttttttttttttttttg

SEQ ID NO: 474350 - DNA, 20 bp, Artificial
  CRISPR gRNA sequence
ctttttttttttttttttga

SEQ ID NO: 474351 - DNA, 20 bp, Artificial
  CRISPR gRNA sequence
tttttttttttttttttgag

SEQ ID NO: 474352 - DNA, 20 bp, Artificial
  CRISPR gRNA sequence
tttttttttttttttgagac

SEQ ID NO: 474353 - DNA, 20 bp, Artificial
  CRISPR gRNA sequence
ttttttttttttttgagaca

SEQ ID NO: 474354 - DNA, 20 bp, Artificial
  CRISPR gRNA sequence
tttttttttttttgagacag

SEQ ID NO: 474355 - DNA, 20 bp, Artificial
  CRISPR gRNA sequence
ttttttttttttgagacaga

SEQ ID NO: 474356 - DNA, 20 bp, Artificial
  CRISPR gRNA sequence
tttttttttttgagacagag

SEQ ID NO: 474357 - DNA, 20 bp, Artificial
  CRISPR gRNA sequence
ttttttttttgagacagagt

SEQ ID NO: 474358 - DNA, 20 bp, Artificial
  CRISPR gRNA sequence
tttttttttgagacagagtc

SEQ ID NO: 474359 - DNA, 20 bp, Artificial
  CRISPR gRNA sequence
ttttttttgagacagagtct

SEQ ID NO: 474360 - DNA, 20 bp, Artificial
  CRISPR gRNA sequence
tttttttgagacagagtctc

SEQ ID NO: 474361 - DNA, 20 bp, Artificial
  CRISPR gRNA sequence
ttttttgagacagagtctcg

SEQ ID NO: 474362 - DNA, 20 bp, Artificial
  CRISPR gRNA sequence
tttttgagacagagtctcgc

SEQ ID NO: 474363 - DNA, 20 bp, Artificial
  CRISPR gRNA sequence
ttttgagacagagtctcgct

SEQ ID NO: 474364 - DNA, 20 bp, Artificial
  CRISPR gRNA sequence
tttgagacagagtctcgctc

SEQ ID NO: 474365 - DNA, 20 bp, Artificial
  CRISPR gRNA sequence
ttgagacagagtctcgctct

SEQ ID NO: 474366 - DNA, 20 bp, Artificial
  CRISPR gRNA sequence
tgagacagagtctcgctctg

SEQ ID NO: 474367 - DNA, 20 bp, Artificial
  CRISPR gRNA sequence
gagacagagtctcgctctgt

SEQ ID NO: 474368 - DNA, 20 bp, Artificial
  CRISPR gRNA sequence
agacagagtctcgctctgtc

SEQ ID NO: 474369 - DNA, 20 bp, Artificial
  CRISPR gRNA sequence
gctctgtcgcccaggctgga

SEQ ID NO: 474370 - DNA, 20 bp, Artificial
  CRISPR gRNA sequence
tgtcgcccaggctggagtgc

SEQ ID NO: 474371 - DNA, 20 bp, Artificial
  CRISPR gRNA sequence
tcgcccaggctggagtgcag

SEQ ID NO: 474372 - DNA, 20 bp, Artificial
  CRISPR gRNA sequence
gagtgcagtggcgcaatctc

SEQ ID NO: 474373 - DNA, 20 bp, Artificial
  CRISPR gRNA sequence
cgctcactgcaagcctcccg

SEQ ID NO: 474374 - DNA, 20 bp, Artificial
  CRISPR gRNA sequence
actgcaagcctcccgggttc

SEQ ID NO: 474375 - DNA, 20 bp, Artificial
  CRISPR gRNA sequence
caagcctcccgggttcacgc

SEQ ID NO: 474376 - DNA, 20 bp, Artificial
  CRISPR gRNA sequence
ccgggttcacgccattctcc

SEQ ID NO: 474377 - DNA, 20 bp, Artificial
  CRISPR gRNA sequence
acgccattctcctgcctcag

SEQ ID NO: 474378 - DNA, 20 bp, Artificial
  CRISPR gRNA sequence
tcctgcctcagcctcctgag

SEQ ID NO: 474379 - DNA, 20 bp, Artificial
  CRISPR gRNA sequence
ctgcctcagcctcctgagta

SEQ ID NO: 474380 - DNA, 20 bp, Artificial
  CRISPR gRNA sequence
cctcagcctcctgagtagct

SEQ ID NO: 474381 - DNA, 20 bp, Artificial
  CRISPR gRNA sequence
agcctcctgagtagctggga

SEQ ID NO: 474382 - DNA, 20 bp, Artificial
  CRISPR gRNA sequence
ctgagtagctgggactatag

SEQ ID NO: 474383 - DNA, 20 bp, Artificial
  CRISPR gRNA sequence
agtagctgggactataggtg

SEQ ID NO: 474384 - DNA, 20 bp, Artificial
  CRISPR gRNA sequence
ggactataggtgcccaccac

SEQ ID NO: 474385 - DNA, 20 bp, Artificial
  CRISPR gRNA sequence
taggtgcccaccaccacgcc

SEQ ID NO: 474386 - DNA, 20 bp, Artificial
  CRISPR gRNA sequence
attttttgtatttttagtag

SEQ ID NO: 474387 - DNA, 20 bp, Artificial
  CRISPR gRNA sequence
tttgtatttttagtagagac

SEQ ID NO: 474388 - DNA, 20 bp, Artificial
  CRISPR gRNA sequence
ttgtatttttagtagagacg

SEQ ID NO: 474389 - DNA, 20 bp, Artificial
  CRISPR gRNA sequence
tgtatttttagtagagacgg

SEQ ID NO: 474390 - DNA, 20 bp, Artificial
  CRISPR gRNA sequence
gtatttttagtagagacggg

SEQ ID NO: 474391 - DNA, 20 bp, Artificial
  CRISPR gRNA sequence
tatttttagtagagacgggg

SEQ ID NO: 474392 - DNA, 20 bp, Artificial
  CRISPR gRNA sequence
ttagtagagacggggtttta

SEQ ID NO: 474393 - DNA, 20 bp, Artificial
  CRISPR gRNA sequence
tagtagagacggggttttac

SEQ ID NO: 474394 - DNA, 20 bp, Artificial
  CRISPR gRNA sequence
agtagagacggggttttacc

SEQ ID NO: 474395 - DNA, 20 bp, Artificial
  CRISPR gRNA sequence
gtagagacggggttttaccc

SEQ ID NO: 474396 - DNA, 20 bp, Artificial
  CRISPR gRNA sequence
tacccggttaaccaggatgg

SEQ ID NO: 474397 - DNA, 20 bp, Artificial
  CRISPR gRNA sequence
acccggttaaccaggatggt

SEQ ID NO: 474398 - DNA, 20 bp, Artificial
  CRISPR gRNA sequence
cccggttaaccaggatggtc

SEQ ID NO: 474399 - DNA, 20 bp, Artificial
  CRISPR gRNA sequence
accaggatggtctcgatctc

SEQ ID NO: 474400 - DNA, 20 bp, Artificial
  CRISPR gRNA sequence
gatctcctgacctcgtgatc

SEQ ID NO: 474401 - DNA, 20 bp, Artificial
  CRISPR gRNA sequence
ctgacctcgtgatccgcccg

SEQ ID NO: 474402 - DNA, 20 bp, Artificial
  CRISPR gRNA sequence
acctcgtgatccgcccgcct

SEQ ID NO: 474403 - DNA, 20 bp, Artificial
  CRISPR gRNA sequence
gtgatccgcccgcctcgggc

SEQ ID NO: 474404 - DNA, 20 bp, Artificial
  CRISPR gRNA sequence
gggctcccaaagtgctggga

SEQ ID NO: 474405 - DNA, 20 bp, Artificial
  CRISPR gRNA sequence
ccaaagtgctgggattacag

SEQ ID NO: 474406 - DNA, 20 bp, Artificial
  CRISPR gRNA sequence
ggattacaggcgtgagccac

SEQ ID NO: 474407 - DNA, 20 bp, Artificial
  CRISPR gRNA sequence
caggcgtgagccaccgcact

SEQ ID NO: 474408 - DNA, 20 bp, Artificial
  CRISPR gRNA sequence
ggcctagcccagtaagttta

SEQ ID NO: 474409 - DNA, 20 bp, Artificial
  CRISPR gRNA sequence
gcccagtaagtttatgcaaa

SEQ ID NO: 474410 - DNA, 20 bp, Artificial
  CRISPR gRNA sequence
atgcaaacttaccataccct

SEQ ID NO: 474411 - DNA, 20 bp, Artificial
  CRISPR gRNA sequence
tgcaaacttaccataccctc

SEQ ID NO: 474412 - DNA, 20 bp, Artificial
  CRISPR gRNA sequence
accataccctcatatcccca

SEQ ID NO: 474413 - DNA, 20 bp, Artificial
  CRISPR gRNA sequence
ccataccctcatatccccac

SEQ ID NO: 474414 - DNA, 20 bp, Artificial
  CRISPR gRNA sequence
atatccccactccctagcaa

SEQ ID NO: 474415 - DNA, 20 bp, Artificial
  CRISPR gRNA sequence
cctagcaaatgtctgatgct

SEQ ID NO: 474416 - DNA, 20 bp, Artificial
  CRISPR gRNA sequence
gcaaatgtctgatgctattt

SEQ ID NO: 474417 - DNA, 20 bp, Artificial
  CRISPR gRNA sequence
atgctattttgtgtgagatg

SEQ ID NO: 474418 - DNA, 20 bp, Artificial
  CRISPR gRNA sequence
ttttgtgtgagatgcatcac

SEQ ID NO: 474419 - DNA, 20 bp, Artificial
  CRISPR gRNA sequence
tgtgtgagatgcatcactcc

SEQ ID NO: 474420 - DNA, 20 bp, Artificial
  CRISPR gRNA sequence
gtgtgagatgcatcactcct

SEQ ID NO: 474421 - DNA, 20 bp, Artificial
  CRISPR gRNA sequence
tgtgagatgcatcactcctt

SEQ ID NO: 474422 - DNA, 20 bp, Artificial
  CRISPR gRNA sequence
cttttttgttgttgttgttg

SEQ ID NO: 474423 - DNA, 20 bp, Artificial
  CRISPR gRNA sequence
ttttgttgttgttgttgaga

SEQ ID NO: 474424 - DNA, 20 bp, Artificial
  CRISPR gRNA sequence
tttgttgttgttgttgagac

SEQ ID NO: 474425 - DNA, 20 bp, Artificial
  CRISPR gRNA sequence
ttgttgttgttgttgagacg

SEQ ID NO: 474426 - DNA, 20 bp, Artificial
  CRISPR gRNA sequence
tgttgttgttgttgagacgg

SEQ ID NO: 474427 - DNA, 20 bp, Artificial
  CRISPR gRNA sequence
gttgttgttgttgagacgga

SEQ ID NO: 474428 - DNA, 20 bp, Artificial
  CRISPR gRNA sequence
ttgttgttgttgagacggag

SEQ ID NO: 474429 - DNA, 20 bp, Artificial
  CRISPR gRNA sequence
ttgttgttgagacggagtct

SEQ ID NO: 474430 - DNA, 20 bp, Artificial
  CRISPR gRNA sequence
ttgttgagacggagtctcgc

SEQ ID NO: 474431 - DNA, 20 bp, Artificial
  CRISPR gRNA sequence
ttgagacggagtctcgctct

SEQ ID NO: 474432 - DNA, 20 bp, Artificial
  CRISPR gRNA sequence
agacggagtctcgctctgtc

SEQ ID NO: 474433 - DNA, 20 bp, Artificial
  CRISPR gRNA sequence
gctctgtcacccaggctgga

SEQ ID NO: 474434 - DNA, 20 bp, Artificial
  CRISPR gRNA sequence
tgtcacccaggctggagtgc

SEQ ID NO: 474435 - DNA, 20 bp, Artificial
  CRISPR gRNA sequence
tcacccaggctggagtgcag

SEQ ID NO: 474436 - DNA, 20 bp, Artificial
  CRISPR gRNA sequence
gagtgcagtggcgcgatctt

SEQ ID NO: 474437 - DNA, 20 bp, Artificial
  CRISPR gRNA sequence
agctcactgcaacctccacc

SEQ ID NO: 474438 - DNA, 20 bp, Artificial
  CRISPR gRNA sequence
gctcactgcaacctccaccc

SEQ ID NO: 474439 - DNA, 20 bp, Artificial
  CRISPR gRNA sequence
actgcaacctccacccaccg

SEQ ID NO: 474440 - DNA, 20 bp, Artificial
  CRISPR gRNA sequence
caacctccacccaccgggtt

SEQ ID NO: 474441 - DNA, 20 bp, Artificial
  CRISPR gRNA sequence
cacccaccgggttcaagcaa

SEQ ID NO: 474442 - DNA, 20 bp, Artificial
  CRISPR gRNA sequence
aagcaattctgctgcctcag

SEQ ID NO: 474443 - DNA, 20 bp, Artificial
  CRISPR gRNA sequence
tgctgcctcagcctctggag

SEQ ID NO: 474444 - DNA, 20 bp, Artificial
  CRISPR gRNA sequence
ctgcctcagcctctggagca

SEQ ID NO: 474445 - DNA, 20 bp, Artificial
  CRISPR gRNA sequence
cctcagcctctggagcagct

SEQ ID NO: 474446 - DNA, 20 bp, Artificial
  CRISPR gRNA sequence
agcctctggagcagctggga

SEQ ID NO: 474447 - DNA, 20 bp, Artificial
  CRISPR gRNA sequence
tggagcagctgggaatacag

SEQ ID NO: 474448 - DNA, 20 bp, Artificial
  CRISPR gRNA sequence
gagcagctgggaatacaggc

SEQ ID NO: 474449 - DNA, 20 bp, Artificial
  CRISPR gRNA sequence
ggaatacaggcacctgccac

SEQ ID NO: 474450 - DNA, 20 bp, Artificial
  CRISPR gRNA sequence
ccactgcgcccggggaattt

SEQ ID NO: 474451 - DNA, 20 bp, Artificial
  CRISPR gRNA sequence
cgcccggggaatttttatat

SEQ ID NO: 474452 - DNA, 20 bp, Artificial
  CRISPR gRNA sequence
ttatatttttagtagagatg

SEQ ID NO: 474453 - DNA, 20 bp, Artificial
  CRISPR gRNA sequence
tatatttttagtagagatgg

SEQ ID NO: 474454 - DNA, 20 bp, Artificial
  CRISPR gRNA sequence
atatttttagtagagatggg

SEQ ID NO: 474455 - DNA, 20 bp, Artificial
  CRISPR gRNA sequence
tatttttagtagagatgggg

SEQ ID NO: 474456 - DNA, 20 bp, Artificial
  CRISPR gRNA sequence
ttagtagagatggggattca

SEQ ID NO: 474457 - DNA, 20 bp, Artificial
  CRISPR gRNA sequence
tagtagagatggggattcac

SEQ ID NO: 474458 - DNA, 20 bp, Artificial
  CRISPR gRNA sequence
agtagagatggggattcacc

SEQ ID NO: 474459 - DNA, 20 bp, Artificial
  CRISPR gRNA sequence
gtagagatggggattcacca

SEQ ID NO: 474460 - DNA, 20 bp, Artificial
  CRISPR gRNA sequence
accatgttggccaggctggt

SEQ ID NO: 474461 - DNA, 20 bp, Artificial
  CRISPR gRNA sequence
gccaggctggtcttgaactc

SEQ ID NO: 474462 - DNA, 20 bp, Artificial
  CRISPR gRNA sequence
gtcttgaactcctgaccttg

SEQ ID NO: 474463 - DNA, 20 bp, Artificial
  CRISPR gRNA sequence
gaactcctgaccttgtgatc

SEQ ID NO: 474464 - DNA, 20 bp, Artificial
  CRISPR gRNA sequence
aactcctgaccttgtgatcc

SEQ ID NO: 474465 - DNA, 20 bp, Artificial
  CRISPR gRNA sequence
ctgaccttgtgatccacccg

SEQ ID NO: 474466 - DNA, 20 bp, Artificial
  CRISPR gRNA sequence
accttgtgatccacccgcct

SEQ ID NO: 474467 - DNA, 20 bp, Artificial
  CRISPR gRNA sequence
gtgatccacccgccttggcc

SEQ ID NO: 474468 - DNA, 20 bp, Artificial
  CRISPR gRNA sequence
tgatccacccgccttggcct

SEQ ID NO: 474469 - DNA, 20 bp, Artificial
  CRISPR gRNA sequence
ggcctcccaaagtgctagta

SEQ ID NO: 474470 - DNA, 20 bp, Artificial
  CRISPR gRNA sequence
gcctcccaaagtgctagtat

SEQ ID NO: 474471 - DNA, 20 bp, Artificial
  CRISPR gRNA sequence
ccaaagtgctagtattacag

SEQ ID NO: 474472 - DNA, 20 bp, Artificial
  CRISPR gRNA sequence
gtattacaggcatgagccac

SEQ ID NO: 474473 - DNA, 20 bp, Artificial
  CRISPR gRNA sequence
caggcatgagccaccgcacc

SEQ ID NO: 474474 - DNA, 20 bp, Artificial
  CRISPR gRNA sequence
tttataactacatatgtgtt

SEQ ID NO: 474475 - DNA, 20 bp, Artificial
  CRISPR gRNA sequence
tataactacatatgtgttca

SEQ ID NO: 474476 - DNA, 20 bp, Artificial
  CRISPR gRNA sequence
ataactacatatgtgttcat

SEQ ID NO: 474477 - DNA, 20 bp, Artificial
  CRISPR gRNA sequence
taactacatatgtgttcatg

SEQ ID NO: 474478 - DNA, 20 bp, Artificial
  CRISPR gRNA sequence
catatgtgttcatgtttctg

SEQ ID NO: 474479 - DNA, 20 bp, Artificial
  CRISPR gRNA sequence
atgtttctgtcttctatcta

SEQ ID NO: 474480 - DNA, 20 bp, Artificial
  CRISPR gRNA sequence
ctgtcttctatctagtctgc

SEQ ID NO: 474481 - DNA, 20 bp, Artificial
  CRISPR gRNA sequence
tgtcttctatctagtctgct

SEQ ID NO: 474482 - DNA, 20 bp, Artificial
  CRISPR gRNA sequence
tcttctatctagtctgctac

SEQ ID NO: 474483 - DNA, 20 bp, Artificial
  CRISPR gRNA sequence
ctatctagtctgctacttcc

SEQ ID NO: 474484 - DNA, 20 bp, Artificial
  CRISPR gRNA sequence
tatctagtctgctacttcct

SEQ ID NO: 474485 - DNA, 20 bp, Artificial
  CRISPR gRNA sequence
tctagtctgctacttccttg

SEQ ID NO: 474486 - DNA, 20 bp, Artificial
  CRISPR gRNA sequence
gtctgctacttccttgatgg

SEQ ID NO: 474487 - DNA, 20 bp, Artificial
  CRISPR gRNA sequence
ctacttccttgatggtgtgt

SEQ ID NO: 474488 - DNA, 20 bp, Artificial
  CRISPR gRNA sequence
cttccttgatggtgtgttac

SEQ ID NO: 474489 - DNA, 20 bp, Artificial
  CRISPR gRNA sequence
ccttgatggtgtgttacctt

SEQ ID NO: 474490 - DNA, 20 bp, Artificial
  CRISPR gRNA sequence
cttgatggtgtgttaccttt

SEQ ID NO: 474491 - DNA, 20 bp, Artificial
  CRISPR gRNA sequence
gatggtgtgttacctttcta

SEQ ID NO: 474492 - DNA, 20 bp, Artificial
  CRISPR gRNA sequence
atggtgtgttacctttctat

SEQ ID NO: 474493 - DNA, 20 bp, Artificial
  CRISPR gRNA sequence
cctttctatgtagtactggt

SEQ ID NO: 474494 - DNA, 20 bp, Artificial
  CRISPR gRNA sequence
tctatgtagtactggttgca

SEQ ID NO: 474495 - DNA, 20 bp, Artificial
  CRISPR gRNA sequence
ctatgtagtactggttgcac

SEQ ID NO: 474496 - DNA, 20 bp, Artificial
  CRISPR gRNA sequence
tatgtagtactggttgcaca

SEQ ID NO: 474497 - DNA, 20 bp, Artificial
  CRISPR gRNA sequence
tgtagtactggttgcacagc

SEQ ID NO: 474498 - DNA, 20 bp, Artificial
  CRISPR gRNA sequence
gttgcacagcagagacagct

SEQ ID NO: 474499 - DNA, 20 bp, Artificial
  CRISPR gRNA sequence
cacagcagagacagctaagc

SEQ ID NO: 474500 - DNA, 20 bp, Artificial
  CRISPR gRNA sequence
agcccttagagaggtgggct

SEQ ID NO: 474501 - DNA, 20 bp, Artificial
  CRISPR gRNA sequence
agagaggtgggctaaaaggc

SEQ ID NO: 474502 - DNA, 20 bp, Artificial
  CRISPR gRNA sequence
gagaggtgggctaaaaggca

SEQ ID NO: 474503 - DNA, 20 bp, Artificial
  CRISPR gRNA sequence
aaaggcactgaggtgaagaa

SEQ ID NO: 474504 - DNA, 20 bp, Artificial
  CRISPR gRNA sequence
aggtgaagaacatatgcagc

SEQ ID NO: 474505 - DNA, 20 bp, Artificial
  CRISPR gRNA sequence
aacataccttacagtggtta

SEQ ID NO: 474506 - DNA, 20 bp, Artificial
  CRISPR gRNA sequence
acagtggttaagttataact

SEQ ID NO: 474507 - DNA, 20 bp, Artificial
  CRISPR gRNA sequence
cagtggttaagttataacta

SEQ ID NO: 474508 - DNA, 20 bp, Artificial
  CRISPR gRNA sequence
agttataactaccaaagaaa

SEQ ID NO: 474509 - DNA, 20 bp, Artificial
  CRISPR gRNA sequence
taactaccaaagaaaagcta

SEQ ID NO: 474510 - DNA, 20 bp, Artificial
  CRISPR gRNA sequence
ccaaagaaaagctagacttt

SEQ ID NO: 474511 - DNA, 20 bp, Artificial
  CRISPR gRNA sequence
gactttacaagtattcagtt

SEQ ID NO: 474512 - DNA, 20 bp, Artificial
  CRISPR gRNA sequence
tacaagtattcagtttgaaa

SEQ ID NO: 474513 - DNA, 20 bp, Artificial
  CRISPR gRNA sequence
acaagtattcagtttgaaaa

SEQ ID NO: 474514 - DNA, 20 bp, Artificial
  CRISPR gRNA sequence
caagtattcagtttgaaaag

SEQ ID NO: 474515 - DNA, 20 bp, Artificial
  CRISPR gRNA sequence
agtttgaaaaggcctgattt

SEQ ID NO: 474516 - DNA, 20 bp, Artificial
  CRISPR gRNA sequence
gaaaaggcctgatttatgtc

SEQ ID NO: 474517 - DNA, 20 bp, Artificial
  CRISPR gRNA sequence
aaaaggcctgatttatgtcc

SEQ ID NO: 474518 - DNA, 20 bp, Artificial
  CRISPR gRNA sequence
atttatgtccactcaggggt

SEQ ID NO: 474519 - DNA, 20 bp, Artificial
  CRISPR gRNA sequence
atgtccactcaggggtggat

SEQ ID NO: 474520 - DNA, 20 bp, Artificial
  CRISPR gRNA sequence
tgtccactcaggggtggata

SEQ ID NO: 474521 - DNA, 20 bp, Artificial
  CRISPR gRNA sequence
aggggtggatattaaaaata

SEQ ID NO: 474522 - DNA, 20 bp, Artificial
  CRISPR gRNA sequence
aaaatatttaacaagtgaca

SEQ ID NO: 474523 - DNA, 20 bp, Artificial
  CRISPR gRNA sequence
aacaagtgacactccatggc

SEQ ID NO: 474524 - DNA, 20 bp, Artificial
  CRISPR gRNA sequence
acaagtgacactccatggcc

SEQ ID NO: 474525 - DNA, 20 bp, Artificial
  CRISPR gRNA sequence
catggccatccagctacaca

SEQ ID NO: 474526 - DNA, 20 bp, Artificial
  CRISPR gRNA sequence
cacagatcagctgatcagaa

SEQ ID NO: 474527 - DNA, 20 bp, Artificial
  CRISPR gRNA sequence
atcagaaaggagtgccagcc

SEQ ID NO: 474528 - DNA, 20 bp, Artificial
  CRISPR gRNA sequence
tatagtctcgtaactcccag

SEQ ID NO: 474529 - DNA, 20 bp, Artificial
  CRISPR gRNA sequence
gtaactcccagctgagcaag

SEQ ID NO: 474530 - DNA, 20 bp, Artificial
  CRISPR gRNA sequence
ccagctgagcaagtgtagtt

SEQ ID NO: 474531 - DNA, 20 bp, Artificial
  CRISPR gRNA sequence
agcaagtgtagttgctgagc

SEQ ID NO: 474532 - DNA, 20 bp, Artificial
  CRISPR gRNA sequence
ctgagctgaagagagtaggt

SEQ ID NO: 474533 - DNA, 20 bp, Artificial
  CRISPR gRNA sequence
agctgaagagagtaggtaat

SEQ ID NO: 474534 - DNA, 20 bp, Artificial
  CRISPR gRNA sequence
aagagagtaggtaatttttg

SEQ ID NO: 474535 - DNA, 20 bp, Artificial
  CRISPR gRNA sequence
ttgaaaccaatcagccattt

SEQ ID NO: 474536 - DNA, 20 bp, Artificial
  CRISPR gRNA sequence
tgaaaccaatcagccattta

SEQ ID NO: 474537 - DNA, 20 bp, Artificial
  CRISPR gRNA sequence
gaaaccaatcagccatttaa

SEQ ID NO: 474538 - DNA, 20 bp, Artificial
  CRISPR gRNA sequence
aaaccaatcagccatttaaa

SEQ ID NO: 474539 - DNA, 20 bp, Artificial
  CRISPR gRNA sequence
aaaaaaaaagagggttatga

SEQ ID NO: 474540 - DNA, 20 bp, Artificial
  CRISPR gRNA sequence
aaaaaaaagagggttatgat

SEQ ID NO: 474541 - DNA, 20 bp, Artificial
  CRISPR gRNA sequence
tgattatgaatattttataa

SEQ ID NO: 474542 - DNA, 20 bp, Artificial
  CRISPR gRNA sequence
tgaatattttataaaatatc

SEQ ID NO: 474543 - DNA, 20 bp, Artificial
  CRISPR gRNA sequence
tataaaatatcattatttct

SEQ ID NO: 474544 - DNA, 20 bp, Artificial
  CRISPR gRNA sequence
ataaaatatcattatttctt

SEQ ID NO: 474545 - DNA, 20 bp, Artificial
  CRISPR gRNA sequence
taaaatatcattatttctta

SEQ ID NO: 474546 - DNA, 20 bp, Artificial
  CRISPR gRNA sequence
tttcttatttttaaatacca

SEQ ID NO: 474547 - DNA, 20 bp, Artificial
  CRISPR gRNA sequence
cttatttttaaataccatat

SEQ ID NO: 474548 - DNA, 20 bp, Artificial
  CRISPR gRNA sequence
ttatttttaaataccatatg

SEQ ID NO: 474549 - DNA, 20 bp, Artificial
  CRISPR gRNA sequence
atttttaaataccatatgtt

SEQ ID NO: 474550 - DNA, 20 bp, Artificial
  CRISPR gRNA sequence
tttttaaataccatatgttt

SEQ ID NO: 474551 - DNA, 20 bp, Artificial
  CRISPR gRNA sequence
ttaaataccatatgttttga

SEQ ID NO: 474552 - DNA, 20 bp, Artificial
  CRISPR gRNA sequence
taaataccatatgttttgat

SEQ ID NO: 474553 - DNA, 20 bp, Artificial
  CRISPR gRNA sequence
aaataccatatgttttgatt

SEQ ID NO: 474554 - DNA, 20 bp, Artificial
  CRISPR gRNA sequence
aataccatatgttttgatta

SEQ ID NO: 474555 - DNA, 20 bp, Artificial
  CRISPR gRNA sequence
tgattataaccattatcatg

SEQ ID NO: 474556 - DNA, 20 bp, Artificial
  CRISPR gRNA sequence
gattataaccattatcatga

SEQ ID NO: 474557 - DNA, 20 bp, Artificial
  CRISPR gRNA sequence
attataaccattatcatgag

SEQ ID NO: 474558 - DNA, 20 bp, Artificial
  CRISPR gRNA sequence
taaccattatcatgaggaaa

SEQ ID NO: 474559 - DNA, 20 bp, Artificial
  CRISPR gRNA sequence
tcatgaggaaaatctcacct

SEQ ID NO: 474560 - DNA, 20 bp, Artificial
  CRISPR gRNA sequence
acctgagtttcactatgtct

SEQ ID NO: 474561 - DNA, 20 bp, Artificial
  CRISPR gRNA sequence
agtttcactatgtctccatt

SEQ ID NO: 474562 - DNA, 20 bp, Artificial
  CRISPR gRNA sequence
cactatgtctccattgaaaa

SEQ ID NO: 474563 - DNA, 20 bp, Artificial
  CRISPR gRNA sequence
actatgtctccattgaaaaa

SEQ ID NO: 474564 - DNA, 20 bp, Artificial
  CRISPR gRNA sequence
tgtctccattgaaaaattct

SEQ ID NO: 474565 - DNA, 20 bp, Artificial
  CRISPR gRNA sequence
cattgaaaaattcttacaaa

SEQ ID NO: 474566 - DNA, 20 bp, Artificial
  CRISPR gRNA sequence
aaaaattcttacaaatttat

SEQ ID NO: 474567 - DNA, 20 bp, Artificial
  CRISPR gRNA sequence
ttacaaatttatggaaactt

SEQ ID NO: 474568 - DNA, 20 bp, Artificial
  CRISPR gRNA sequence
acaaatttatggaaacttca

SEQ ID NO: 474569 - DNA, 20 bp, Artificial
  CRISPR gRNA sequence
caaatttatggaaacttcaa

SEQ ID NO: 474570 - DNA, 20 bp, Artificial
  CRISPR gRNA sequence
atggaaacttcaaagtggtt

SEQ ID NO: 474571 - DNA, 20 bp, Artificial
  CRISPR gRNA sequence
tggaaacttcaaagtggttg

SEQ ID NO: 474572 - DNA, 20 bp, Artificial
  CRISPR gRNA sequence
caaagtggttgcaaccattc

SEQ ID NO: 474573 - DNA, 20 bp, Artificial
  CRISPR gRNA sequence
aaagtggttgcaaccattca

SEQ ID NO: 474574 - DNA, 20 bp, Artificial
  CRISPR gRNA sequence
caaccattcaaataaatgaa

SEQ ID NO: 474575 - DNA, 20 bp, Artificial
  CRISPR gRNA sequence
aaataaatgaatgactgtaa

SEQ ID NO: 474576 - DNA, 20 bp, Artificial
  CRISPR gRNA sequence
taatgaatgcagattgcctt

SEQ ID NO: 474577 - DNA, 20 bp, Artificial
  CRISPR gRNA sequence
ccttaacttgagctaagaaa

SEQ ID NO: 474578 - DNA, 20 bp, Artificial
  CRISPR gRNA sequence
aacttgagctaagaaagtgt

SEQ ID NO: 474579 - DNA, 20 bp, Artificial
  CRISPR gRNA sequence
acttgagctaagaaagtgtc

SEQ ID NO: 474580 - DNA, 20 bp, Artificial
  CRISPR gRNA sequence
gagctaagaaagtgtcagag

SEQ ID NO: 474581 - DNA, 20 bp, Artificial
  CRISPR gRNA sequence
agctaagaaagtgtcagagt

SEQ ID NO: 474582 - DNA, 20 bp, Artificial
  CRISPR gRNA sequence
agaaagtgtcagagtttaac

SEQ ID NO: 474583 - DNA, 20 bp, Artificial
  CRISPR gRNA sequence
aacatagaaattaaacaaat

SEQ ID NO: 474584 - DNA, 20 bp, Artificial
  CRISPR gRNA sequence
acatagaaattaaacaaatg

SEQ ID NO: 474585 - DNA, 20 bp, Artificial
  CRISPR gRNA sequence
aacaaatgattttttgagaa

SEQ ID NO: 474586 - DNA, 20 bp, Artificial
  CRISPR gRNA sequence
tttgagaaactaaaatgatt

SEQ ID NO: 474587 - DNA, 20 bp, Artificial
  CRISPR gRNA sequence
ttgagaaactaaaatgatta

SEQ ID NO: 474588 - DNA, 20 bp, Artificial
  CRISPR gRNA sequence
tgagaaactaaaatgattac

SEQ ID NO: 474589 - DNA, 20 bp, Artificial
  CRISPR gRNA sequence
gagaaactaaaatgattact

SEQ ID NO: 474590 - DNA, 20 bp, Artificial
  CRISPR gRNA sequence
agaaactaaaatgattacta

SEQ ID NO: 474591 - DNA, 20 bp, Artificial
  CRISPR gRNA sequence
aaatgattactaacggtata

SEQ ID NO: 474592 - DNA, 20 bp, Artificial
  CRISPR gRNA sequence
ctaacggtataataaaccaa

SEQ ID NO: 474593 - DNA, 20 bp, Artificial
  CRISPR gRNA sequence
acggtataataaaccaataa

SEQ ID NO: 474594 - DNA, 20 bp, Artificial
  CRISPR gRNA sequence
tctgtgacatcaaccaggat

SEQ ID NO: 474595 - DNA, 20 bp, Artificial
  CRISPR gRNA sequence
ctgtgacatcaaccaggatt

SEQ ID NO: 474596 - DNA, 20 bp, Artificial
  CRISPR gRNA sequence
tgtgacatcaaccaggattt

SEQ ID NO: 474597 - DNA, 20 bp, Artificial
  CRISPR gRNA sequence
tgacatcaaccaggatttta

SEQ ID NO: 474598 - DNA, 20 bp, Artificial
  CRISPR gRNA sequence
tagcttctatcagaaaatac

SEQ ID NO: 474599 - DNA, 20 bp, Artificial
  CRISPR gRNA sequence
agcttctatcagaaaatact

SEQ ID NO: 474600 - DNA, 20 bp, Artificial
  CRISPR gRNA sequence
gcttctatcagaaaatacta

SEQ ID NO: 474601 - DNA, 20 bp, Artificial
  CRISPR gRNA sequence
ctatcagaaaatactatcac

SEQ ID NO: 474602 - DNA, 20 bp, Artificial
  CRISPR gRNA sequence
tatcagaaaatactatcaca

SEQ ID NO: 474603 - DNA, 20 bp, Artificial
  CRISPR gRNA sequence
tcagaaaatactatcacaga

SEQ ID NO: 474604 - DNA, 20 bp, Artificial
  CRISPR gRNA sequence
tcacagacaaacaacaagca

SEQ ID NO: 474605 - DNA, 20 bp, Artificial
  CRISPR gRNA sequence
cagacgcatgctggggaggc

SEQ ID NO: 474606 - DNA, 20 bp, Artificial
  CRISPR gRNA sequence
agacgcatgctggggaggct

SEQ ID NO: 474607 - DNA, 20 bp, Artificial
  CRISPR gRNA sequence
gggaggctacagaaggaatg

SEQ ID NO: 474608 - DNA, 20 bp, Artificial
  CRISPR gRNA sequence
cagaaggaatgaagtcttta

SEQ ID NO: 474609 - DNA, 20 bp, Artificial
  CRISPR gRNA sequence
tacactcaggagcaaaaagg

SEQ ID NO: 474610 - DNA, 20 bp, Artificial
  CRISPR gRNA sequence
acactcaggagcaaaaaggc

SEQ ID NO: 474611 - DNA, 20 bp, Artificial
  CRISPR gRNA sequence
cactcaggagcaaaaaggca

SEQ ID NO: 474612 - DNA, 20 bp, Artificial
  CRISPR gRNA sequence
aggagcaaaaaggcatccag

SEQ ID NO: 474613 - DNA, 20 bp, Artificial
  CRISPR gRNA sequence
tgccttactttagaaggctg

SEQ ID NO: 474614 - DNA, 20 bp, Artificial
  CRISPR gRNA sequence
ccttactttagaaggctgga

SEQ ID NO: 474615 - DNA, 20 bp, Artificial
  CRISPR gRNA sequence
actttagaaggctggaatgg

SEQ ID NO: 474616 - DNA, 20 bp, Artificial
  CRISPR gRNA sequence
ctttagaaggctggaatggt

SEQ ID NO: 474617 - DNA, 20 bp, Artificial
  CRISPR gRNA sequence
tagaaggctggaatggtaga

SEQ ID NO: 474618 - DNA, 20 bp, Artificial
  CRISPR gRNA sequence
agaaggctggaatggtagag

SEQ ID NO: 474619 - DNA, 20 bp, Artificial
  CRISPR gRNA sequence
gaaggctggaatggtagaga

SEQ ID NO: 474620 - DNA, 20 bp, Artificial
  CRISPR gRNA sequence
gaatggtagagaggagggga

SEQ ID NO: 474621 - DNA, 20 bp, Artificial
  CRISPR gRNA sequence
tctctcaaatcttcccttga

SEQ ID NO: 474622 - DNA, 20 bp, Artificial
  CRISPR gRNA sequence
tcaaatcttcccttgaaatt

SEQ ID NO: 474623 - DNA, 20 bp, Artificial
  CRISPR gRNA sequence
aaatcttcccttgaaattag

SEQ ID NO: 474624 - DNA, 20 bp, Artificial
  CRISPR gRNA sequence
cccttgaaattagagtttag

SEQ ID NO: 474625 - DNA, 20 bp, Artificial
  CRISPR gRNA sequence
ccttgaaattagagtttagg

SEQ ID NO: 474626 - DNA, 20 bp, Artificial
  CRISPR gRNA sequence
gaaattagagtttagggatc

SEQ ID NO: 474627 - DNA, 20 bp, Artificial
  CRISPR gRNA sequence
aaattagagtttagggatcc

SEQ ID NO: 474628 - DNA, 20 bp, Artificial
  CRISPR gRNA sequence
gagtttagggatcccataag

SEQ ID NO: 474629 - DNA, 20 bp, Artificial
  CRISPR gRNA sequence
agggatcccataaggcagtg

SEQ ID NO: 474630 - DNA, 20 bp, Artificial
  CRISPR gRNA sequence
gggatcccataaggcagtgg

SEQ ID NO: 474631 - DNA, 20 bp, Artificial
  CRISPR gRNA sequence
gtacatagtcagggcaaatc

SEQ ID NO: 474632 - DNA, 20 bp, Artificial
  CRISPR gRNA sequence
tacatagtcagggcaaatcc

SEQ ID NO: 474633 - DNA, 20 bp, Artificial
  CRISPR gRNA sequence
caaggatcttgggaggacat

SEQ ID NO: 474634 - DNA, 20 bp, Artificial
  CRISPR gRNA sequence
aaggatcttgggaggacatt

SEQ ID NO: 474635 - DNA, 20 bp, Artificial
  CRISPR gRNA sequence
gggaggacattgacttgcat

SEQ ID NO: 474636 - DNA, 20 bp, Artificial
  CRISPR gRNA sequence
ggaggacattgacttgcata

SEQ ID NO: 474637 - DNA, 20 bp, Artificial
  CRISPR gRNA sequence
acttgcataccttgggaaat

SEQ ID NO: 474638 - DNA, 20 bp, Artificial
  CRISPR gRNA sequence
gcataccttgggaaatcaca

SEQ ID NO: 474639 - DNA, 20 bp, Artificial
  CRISPR gRNA sequence
cataccttgggaaatcacac

SEQ ID NO: 474640 - DNA, 20 bp, Artificial
  CRISPR gRNA sequence
gggaaatcacacggacgaca

SEQ ID NO: 474641 - DNA, 20 bp, Artificial
  CRISPR gRNA sequence
ggaaatcacacggacgacat

SEQ ID NO: 474642 - DNA, 20 bp, Artificial
  CRISPR gRNA sequence
tcccatcataaactagctca

SEQ ID NO: 474643 - DNA, 20 bp, Artificial
  CRISPR gRNA sequence
cccatcataaactagctcac

SEQ ID NO: 474644 - DNA, 20 bp, Artificial
  CRISPR gRNA sequence
ccatcataaactagctcaca

SEQ ID NO: 474645 - DNA, 20 bp, Artificial
  CRISPR gRNA sequence
gctcacatacactcacaaaa

SEQ ID NO: 474646 - DNA, 20 bp, Artificial
  CRISPR gRNA sequence
acatacactcacaaaatcag

SEQ ID NO: 474647 - DNA, 20 bp, Artificial
  CRISPR gRNA sequence
acaaaatcagaaatgtggtg

SEQ ID NO: 474648 - DNA, 20 bp, Artificial
  CRISPR gRNA sequence
gggtgggggagttccacctc

SEQ ID NO: 474649 - DNA, 20 bp, Artificial
  CRISPR gRNA sequence
cacctcatatagaaagtatt

SEQ ID NO: 474650 - DNA, 20 bp, Artificial
  CRISPR gRNA sequence
atatagaaagtattcattta

SEQ ID NO: 474651 - DNA, 20 bp, Artificial
  CRISPR gRNA sequence
atttaatgtattatgtaatg

SEQ ID NO: 474652 - DNA, 20 bp, Artificial
  CRISPR gRNA sequence
aatgtattatgtaatgtcta

SEQ ID NO: 474653 - DNA, 20 bp, Artificial
  CRISPR gRNA sequence
atgtattatgtaatgtctat

SEQ ID NO: 474654 - DNA, 20 bp, Artificial
  CRISPR gRNA sequence
tgtaatgtctattaaaggta

SEQ ID NO: 474655 - DNA, 20 bp, Artificial
  CRISPR gRNA sequence
ttaaaggtattactttaact

SEQ ID NO: 474656 - DNA, 20 bp, Artificial
  CRISPR gRNA sequence
aaggtattactttaactctg

SEQ ID NO: 474657 - DNA, 20 bp, Artificial
  CRISPR gRNA sequence
ctttaactctgtggtaaata

SEQ ID NO: 474658 - DNA, 20 bp, Artificial
  CRISPR gRNA sequence
taactctgtggtaaataaac

SEQ ID NO: 474659 - DNA, 20 bp, Artificial
  CRISPR gRNA sequence
aactctgtggtaaataaacc

SEQ ID NO: 474660 - DNA, 20 bp, Artificial
  CRISPR gRNA sequence
actctgtggtaaataaacca

SEQ ID NO: 474661 - DNA, 20 bp, Artificial
  CRISPR gRNA sequence
tgtggtaaataaaccactcc

SEQ ID NO: 474662 - DNA, 20 bp, Artificial
  CRISPR gRNA sequence
tggtaaataaaccactccat

SEQ ID NO: 474663 - DNA, 20 bp, Artificial
  CRISPR gRNA sequence
cataagtcagatattctcag

SEQ ID NO: 474664 - DNA, 20 bp, Artificial
  CRISPR gRNA sequence
tcagaagtactaggaatacc

SEQ ID NO: 474665 - DNA, 20 bp, Artificial
  CRISPR gRNA sequence
agaagtactaggaatacctg

SEQ ID NO: 474666 - DNA, 20 bp, Artificial
  CRISPR gRNA sequence
ggaatacctggagaaaatta

SEQ ID NO: 474667 - DNA, 20 bp, Artificial
  CRISPR gRNA sequence
gagaaaattaagtaagtatg

SEQ ID NO: 474668 - DNA, 20 bp, Artificial
  CRISPR gRNA sequence
agtaagtatgacacacacaa

SEQ ID NO: 474669 - DNA, 20 bp, Artificial
  CRISPR gRNA sequence
aaatcagagcttcttttgta

SEQ ID NO: 474670 - DNA, 20 bp, Artificial
  CRISPR gRNA sequence
cttttgtaaaagtgactatt

SEQ ID NO: 474671 - DNA, 20 bp, Artificial
  CRISPR gRNA sequence
ttttgtaaaagtgactattg

SEQ ID NO: 474672 - DNA, 20 bp, Artificial
  CRISPR gRNA sequence
ttgtaaaagtgactattgtt

SEQ ID NO: 474673 - DNA, 20 bp, Artificial
  CRISPR gRNA sequence
tgtaaaagtgactattgtta

SEQ ID NO: 474674 - DNA, 20 bp, Artificial
  CRISPR gRNA sequence
gtaaaagtgactattgttac

SEQ ID NO: 474675 - DNA, 20 bp, Artificial
  CRISPR gRNA sequence
taaaagtgactattgttact

SEQ ID NO: 474676 - DNA, 20 bp, Artificial
  CRISPR gRNA sequence
ttgttactttaaggaaaacc

SEQ ID NO: 474677 - DNA, 20 bp, Artificial
  CRISPR gRNA sequence
ttactttaaggaaaaccctg

SEQ ID NO: 474678 - DNA, 20 bp, Artificial
  CRISPR gRNA sequence
ctttaaggaaaaccctgtga

SEQ ID NO: 474679 - DNA, 20 bp, Artificial
  CRISPR gRNA sequence
taaggaaaaccctgtgattg

SEQ ID NO: 474680 - DNA, 20 bp, Artificial
  CRISPR gRNA sequence
aaggaaaaccctgtgattgt

SEQ ID NO: 474681 - DNA, 20 bp, Artificial
  CRISPR gRNA sequence
aggaaaaccctgtgattgtt

SEQ ID NO: 474682 - DNA, 20 bp, Artificial
  CRISPR gRNA sequence
tgattgttctcacgagtaca

SEQ ID NO: 474683 - DNA, 20 bp, Artificial
  CRISPR gRNA sequence
ttctcacgagtacagtgaaa

SEQ ID NO: 474684 - DNA, 20 bp, Artificial
  CRISPR gRNA sequence
tcacgagtacagtgaaaact

SEQ ID NO: 474685 - DNA, 20 bp, Artificial
  CRISPR gRNA sequence
acgagtacagtgaaaactga

SEQ ID NO: 474686 - DNA, 20 bp, Artificial
  CRISPR gRNA sequence
actggccctcagtcccttct

SEQ ID NO: 474687 - DNA, 20 bp, Artificial
  CRISPR gRNA sequence
gccctcagtcccttctgtaa

SEQ ID NO: 474688 - DNA, 20 bp, Artificial
  CRISPR gRNA sequence
agtcccttctgtaaaatgaa

SEQ ID NO: 474689 - DNA, 20 bp, Artificial
  CRISPR gRNA sequence
ctgtaaaatgaaagtttatt

SEQ ID NO: 474690 - DNA, 20 bp, Artificial
  CRISPR gRNA sequence
tgtaaaatgaaagtttattt

SEQ ID NO: 474691 - DNA, 20 bp, Artificial
  CRISPR gRNA sequence
taaaatgaaagtttatttac

SEQ ID NO: 474692 - DNA, 20 bp, Artificial
  CRISPR gRNA sequence
atttacatatgtctttcctg

SEQ ID NO: 474693 - DNA, 20 bp, Artificial
  CRISPR gRNA sequence
tttacatatgtctttcctga

SEQ ID NO: 474694 - DNA, 20 bp, Artificial
  CRISPR gRNA sequence
acatatgtctttcctgaaaa

SEQ ID NO: 474695 - DNA, 20 bp, Artificial
  CRISPR gRNA sequence
catatgtctttcctgaaaaa

SEQ ID NO: 474696 - DNA, 20 bp, Artificial
  CRISPR gRNA sequence
tcctgaaaaacaacactaaa

SEQ ID NO: 474697 - DNA, 20 bp, Artificial
  CRISPR gRNA sequence
cctgaaaaacaacactaaag

SEQ ID NO: 474698 - DNA, 20 bp, Artificial
  CRISPR gRNA sequence
ctgaaaaacaacactaaaga

SEQ ID NO: 474699 - DNA, 20 bp, Artificial
  CRISPR gRNA sequence
aaaaacaacactaaagatac

SEQ ID NO: 474700 - DNA, 20 bp, Artificial
  CRISPR gRNA sequence
aagatacagatcatagacaa

SEQ ID NO: 474701 - DNA, 20 bp, Artificial
  CRISPR gRNA sequence
aacttattctctgtggatat

SEQ ID NO: 474702 - DNA, 20 bp, Artificial
  CRISPR gRNA sequence
acttattctctgtggatatc

SEQ ID NO: 474703 - DNA, 20 bp, Artificial
  CRISPR gRNA sequence
attctctgtggatatcacct

SEQ ID NO: 474704 - DNA, 20 bp, Artificial
  CRISPR gRNA sequence
ttctctgtggatatcacctg

SEQ ID NO: 474705 - DNA, 20 bp, Artificial
  CRISPR gRNA sequence
tctgtggatatcacctgata

SEQ ID NO: 474706 - DNA, 20 bp, Artificial
  CRISPR gRNA sequence
tgtggatatcacctgatatt

SEQ ID NO: 474707 - DNA, 20 bp, Artificial
  CRISPR gRNA sequence
tggatatcacctgatattgc

SEQ ID NO: 474708 - DNA, 20 bp, Artificial
  CRISPR gRNA sequence
atattgctctttagacaaga

SEQ ID NO: 474709 - DNA, 20 bp, Artificial
  CRISPR gRNA sequence
ctctttagacaagaagagcc

SEQ ID NO: 474710 - DNA, 20 bp, Artificial
  CRISPR gRNA sequence
tttagacaagaagagccatt

SEQ ID NO: 474711 - DNA, 20 bp, Artificial
  CRISPR gRNA sequence
tagacaagaagagccatttt

SEQ ID NO: 474712 - DNA, 20 bp, Artificial
  CRISPR gRNA sequence
agacaagaagagccattttc

SEQ ID NO: 474713 - DNA, 20 bp, Artificial
  CRISPR gRNA sequence
gacaagaagagccattttct

SEQ ID NO: 474714 - DNA, 20 bp, Artificial
  CRISPR gRNA sequence
tctccctgggtaaacacaca

SEQ ID NO: 474715 - DNA, 20 bp, Artificial
  CRISPR gRNA sequence
ctccctgggtaaacacacac

SEQ ID NO: 474716 - DNA, 20 bp, Artificial
  CRISPR gRNA sequence
tccctgggtaaacacacaca

SEQ ID NO: 474717 - DNA, 20 bp, Artificial
  CRISPR gRNA sequence
cctgggtaaacacacacaca

SEQ ID NO: 474718 - DNA, 20 bp, Artificial
  CRISPR gRNA sequence
ggtaaacacacacacacaca

SEQ ID NO: 474719 - DNA, 20 bp, Artificial
  CRISPR gRNA sequence
ccttcacaaaaatggaactg

SEQ ID NO: 474720 - DNA, 20 bp, Artificial
  CRISPR gRNA sequence
cttcacaaaaatggaactgg

SEQ ID NO: 474721 - DNA, 20 bp, Artificial
  CRISPR gRNA sequence
cacaaaaatggaactggaaa

SEQ ID NO: 474722 - DNA, 20 bp, Artificial
  CRISPR gRNA sequence
acaaaaatggaactggaaag

SEQ ID NO: 474723 - DNA, 20 bp, Artificial
  CRISPR gRNA sequence
gaaagtattaatgccaagaa

SEQ ID NO: 474724 - DNA, 20 bp, Artificial
  CRISPR gRNA sequence
atgccaagaatacacagggc

SEQ ID NO: 474725 - DNA, 20 bp, Artificial
  CRISPR gRNA sequence
catttatgcccattatttaa

SEQ ID NO: 474726 - DNA, 20 bp, Artificial
  CRISPR gRNA sequence
atgcccattatttaaaaaaa

SEQ ID NO: 474727 - DNA, 20 bp, Artificial
  CRISPR gRNA sequence
tgcccattatttaaaaaaaa

SEQ ID NO: 474728 - DNA, 20 bp, Artificial
  CRISPR gRNA sequence
tttaaaaaaaaaaagcaacc

SEQ ID NO: 474729 - DNA, 20 bp, Artificial
  CRISPR gRNA sequence
aaaaaaaaaaagcaaccatg

SEQ ID NO: 474730 - DNA, 20 bp, Artificial
  CRISPR gRNA sequence
aaaaaaaaaagcaaccatga

SEQ ID NO: 474731 - DNA, 20 bp, Artificial
  CRISPR gRNA sequence
agagcattttcacaatcatc

SEQ ID NO: 474732 - DNA, 20 bp, Artificial
  CRISPR gRNA sequence
tcacaatcatcttttattat

SEQ ID NO: 474733 - DNA, 20 bp, Artificial
  CRISPR gRNA sequence
cacaatcatcttttattatt

SEQ ID NO: 474734 - DNA, 20 bp, Artificial
  CRISPR gRNA sequence
acaatcatcttttattatta

SEQ ID NO: 474735 - DNA, 20 bp, Artificial
  CRISPR gRNA sequence
ttattattatttcctcttaa

SEQ ID NO: 474736 - DNA, 20 bp, Artificial
  CRISPR gRNA sequence
tattattatttcctcttaaa

SEQ ID NO: 474737 - DNA, 20 bp, Artificial
  CRISPR gRNA sequence
attattatttcctcttaaaa

SEQ ID NO: 474738 - DNA, 20 bp, Artificial
  CRISPR gRNA sequence
ttattatttcctcttaaaaa

SEQ ID NO: 474739 - DNA, 20 bp, Artificial
  CRISPR gRNA sequence
ttatttcctcttaaaaatcc

SEQ ID NO: 474740 - DNA, 20 bp, Artificial
  CRISPR gRNA sequence
tttcctcttaaaaatcccct

SEQ ID NO: 474741 - DNA, 20 bp, Artificial
  CRISPR gRNA sequence
cctcttaaaaatccccttct

SEQ ID NO: 474742 - DNA, 20 bp, Artificial
  CRISPR gRNA sequence
ctcttaaaaatccccttctt

SEQ ID NO: 474743 - DNA, 20 bp, Artificial
  CRISPR gRNA sequence
ttaaaaatccccttcttata

SEQ ID NO: 474744 - DNA, 20 bp, Artificial
  CRISPR gRNA sequence
aaaaatccccttcttataaa

SEQ ID NO: 474745 - DNA, 20 bp, Artificial
  CRISPR gRNA sequence
aaaatccccttcttataaaa

SEQ ID NO: 474746 - DNA, 20 bp, Artificial
  CRISPR gRNA sequence
cttataaaaacatatcttct

SEQ ID NO: 474747 - DNA, 20 bp, Artificial
  CRISPR gRNA sequence
ttataaaaacatatcttctt

SEQ ID NO: 474748 - DNA, 20 bp, Artificial
  CRISPR gRNA sequence
ataaaaacatatcttcttat

SEQ ID NO: 474749 - DNA, 20 bp, Artificial
  CRISPR gRNA sequence
taaaaacatatcttcttata

SEQ ID NO: 474750 - DNA, 20 bp, Artificial
  CRISPR gRNA sequence
cttatattcatttatgaaat

SEQ ID NO: 474751 - DNA, 20 bp, Artificial
  CRISPR gRNA sequence
ttatattcatttatgaaatt

SEQ ID NO: 474752 - DNA, 20 bp, Artificial
  CRISPR gRNA sequence
atattcatttatgaaatttt

SEQ ID NO: 474753 - DNA, 20 bp, Artificial
  CRISPR gRNA sequence
tattcatttatgaaattttt

SEQ ID NO: 474754 - DNA, 20 bp, Artificial
  CRISPR gRNA sequence
atttatgaaatttttcttta

SEQ ID NO: 474755 - DNA, 20 bp, Artificial
  CRISPR gRNA sequence
atgaaatttttctttaagtt

SEQ ID NO: 474756 - DNA, 20 bp, Artificial
  CRISPR gRNA sequence
tgaaatttttctttaagttt

SEQ ID NO: 474757 - DNA, 20 bp, Artificial
  CRISPR gRNA sequence
ttctttaagtttactttcat

SEQ ID NO: 474758 - DNA, 20 bp, Artificial
  CRISPR gRNA sequence
tctttaagtttactttcata

SEQ ID NO: 474759 - DNA, 20 bp, Artificial
  CRISPR gRNA sequence
ctttaagtttactttcatat

SEQ ID NO: 474760 - DNA, 20 bp, Artificial
  CRISPR gRNA sequence
tttaagtttactttcatatg

SEQ ID NO: 474761 - DNA, 20 bp, Artificial
  CRISPR gRNA sequence
taagtttactttcatatggt

SEQ ID NO: 474762 - DNA, 20 bp, Artificial
  CRISPR gRNA sequence
aagtttactttcatatggta

SEQ ID NO: 474763 - DNA, 20 bp, Artificial
  CRISPR gRNA sequence
agtttactttcatatggtat

SEQ ID NO: 474764 - DNA, 20 bp, Artificial
  CRISPR gRNA sequence
actttcatatggtattagca

SEQ ID NO: 474765 - DNA, 20 bp, Artificial
  CRISPR gRNA sequence
ctttcatatggtattagcac

SEQ ID NO: 474766 - DNA, 20 bp, Artificial
  CRISPR gRNA sequence
tcatatggtattagcacact

SEQ ID NO: 474767 - DNA, 20 bp, Artificial
  CRISPR gRNA sequence
catatggtattagcacactt

SEQ ID NO: 474768 - DNA, 20 bp, Artificial
  CRISPR gRNA sequence
atatggtattagcacacttt

SEQ ID NO: 474769 - DNA, 20 bp, Artificial
  CRISPR gRNA sequence
gcacactttaaagcaatttc

SEQ ID NO: 474770 - DNA, 20 bp, Artificial
  CRISPR gRNA sequence
taaagcaatttcttctacag

SEQ ID NO: 474771 - DNA, 20 bp, Artificial
  CRISPR gRNA sequence
aaagcaatttcttctacagt

SEQ ID NO: 474772 - DNA, 20 bp, Artificial
  CRISPR gRNA sequence
aagcaatttcttctacagtt

SEQ ID NO: 474773 - DNA, 20 bp, Artificial
  CRISPR gRNA sequence
cttctacagttagaatttct

SEQ ID NO: 474774 - DNA, 20 bp, Artificial
  CRISPR gRNA sequence
ttctacagttagaatttctc

SEQ ID NO: 474775 - DNA, 20 bp, Artificial
  CRISPR gRNA sequence
ctacagttagaatttctcat

SEQ ID NO: 474776 - DNA, 20 bp, Artificial
  CRISPR gRNA sequence
tacagttagaatttctcatt

SEQ ID NO: 474777 - DNA, 20 bp, Artificial
  CRISPR gRNA sequence
cagttagaatttctcattgt

SEQ ID NO: 474778 - DNA, 20 bp, Artificial
  CRISPR gRNA sequence
gaatttctcattgttagtgt

SEQ ID NO: 474779 - DNA, 20 bp, Artificial
  CRISPR gRNA sequence
ctcattgttagtgtagtatg

SEQ ID NO: 474780 - DNA, 20 bp, Artificial
  CRISPR gRNA sequence
tcattgttagtgtagtatga

SEQ ID NO: 474781 - DNA, 20 bp, Artificial
  CRISPR gRNA sequence
attgttagtgtagtatgact

SEQ ID NO: 474782 - DNA, 20 bp, Artificial
  CRISPR gRNA sequence
ttagtgtagtatgactattt

SEQ ID NO: 474783 - DNA, 20 bp, Artificial
  CRISPR gRNA sequence
gtgtagtatgactatttggc

SEQ ID NO: 474784 - DNA, 20 bp, Artificial
  CRISPR gRNA sequence
tttggcaagtaaatttgaag

SEQ ID NO: 474785 - DNA, 20 bp, Artificial
  CRISPR gRNA sequence
ggcaagtaaatttgaagact

SEQ ID NO: 474786 - DNA, 20 bp, Artificial
  CRISPR gRNA sequence
gcaagtaaatttgaagactg

SEQ ID NO: 474787 - DNA, 20 bp, Artificial
  CRISPR gRNA sequence
gaagactgatctcttcaatg

SEQ ID NO: 474788 - DNA, 20 bp, Artificial
  CRISPR gRNA sequence
aagactgatctcttcaatgc

SEQ ID NO: 474789 - DNA, 20 bp, Artificial
  CRISPR gRNA sequence
atctcttcaatgcagttgta

SEQ ID NO: 474790 - DNA, 20 bp, Artificial
  CRISPR gRNA sequence
ttcaatgcagttgtattgag

SEQ ID NO: 474791 - DNA, 20 bp, Artificial
  CRISPR gRNA sequence
caatgcagttgtattgagcc

SEQ ID NO: 474792 - DNA, 20 bp, Artificial
  CRISPR gRNA sequence
aatgcagttgtattgagcca

SEQ ID NO: 474793 - DNA, 20 bp, Artificial
  CRISPR gRNA sequence
tattgagccactgaagactt

SEQ ID NO: 474794 - DNA, 20 bp, Artificial
  CRISPR gRNA sequence
agccactgaagactttaagc

SEQ ID NO: 474795 - DNA, 20 bp, Artificial
  CRISPR gRNA sequence
aagactttaagctctgtatc

SEQ ID NO: 474796 - DNA, 20 bp, Artificial
  CRISPR gRNA sequence
taagctctgtatctcttgat

SEQ ID NO: 474797 - DNA, 20 bp, Artificial
  CRISPR gRNA sequence
aagctctgtatctcttgatt

SEQ ID NO: 474798 - DNA, 20 bp, Artificial
  CRISPR gRNA sequence
agctctgtatctcttgattt

SEQ ID NO: 474799 - DNA, 20 bp, Artificial
  CRISPR gRNA sequence
tgtatctcttgattttatca

SEQ ID NO: 474800 - DNA, 20 bp, Artificial
  CRISPR gRNA sequence
tatctcttgattttatcatg

SEQ ID NO: 474801 - DNA, 20 bp, Artificial
  CRISPR gRNA sequence
ttgattttatcatgtttgaa

SEQ ID NO: 474802 - DNA, 20 bp, Artificial
  CRISPR gRNA sequence
gattttatcatgtttgaaat

SEQ ID NO: 474803 - DNA, 20 bp, Artificial
  CRISPR gRNA sequence
attttatcatgtttgaaata

SEQ ID NO: 474804 - DNA, 20 bp, Artificial
  CRISPR gRNA sequence
tatcatgtttgaaataattc

SEQ ID NO: 474805 - DNA, 20 bp, Artificial
  CRISPR gRNA sequence
atcatgtttgaaataattct

SEQ ID NO: 474806 - DNA, 20 bp, Artificial
  CRISPR gRNA sequence
tcatgtttgaaataattctg

SEQ ID NO: 474807 - DNA, 20 bp, Artificial
  CRISPR gRNA sequence
gaaataattctgaacttgtt

SEQ ID NO: 474808 - DNA, 20 bp, Artificial
  CRISPR gRNA sequence
aaataattctgaacttgttt

SEQ ID NO: 474809 - DNA, 20 bp, Artificial
  CRISPR gRNA sequence
tgaacttgttttgtctaaaa

SEQ ID NO: 474810 - DNA, 20 bp, Artificial
  CRISPR gRNA sequence
aacttgttttgtctaaaatc

SEQ ID NO: 474811 - DNA, 20 bp, Artificial
  CRISPR gRNA sequence
gttttgtctaaaatcagtca

SEQ ID NO: 474812 - DNA, 20 bp, Artificial
  CRISPR gRNA sequence
ttttgtctaaaatcagtcat

SEQ ID NO: 474813 - DNA, 20 bp, Artificial
  CRISPR gRNA sequence
tgtctaaaatcagtcattct

SEQ ID NO: 474814 - DNA, 20 bp, Artificial
  CRISPR gRNA sequence
gtctaaaatcagtcattcta

SEQ ID NO: 474815 - DNA, 20 bp, Artificial
  CRISPR gRNA sequence
tctaaaatcagtcattctag

SEQ ID NO: 474816 - DNA, 20 bp, Artificial
  CRISPR gRNA sequence
aaatcagtcattctagtatt

SEQ ID NO: 474817 - DNA, 20 bp, Artificial
  CRISPR gRNA sequence
tagtatttgtcattgctttt

SEQ ID NO: 474818 - DNA, 20 bp, Artificial
  CRISPR gRNA sequence
gtatttgtcattgctttttc

SEQ ID NO: 474819 - DNA, 20 bp, Artificial
  CRISPR gRNA sequence
gtcattgctttttccgacat

SEQ ID NO: 474820 - DNA, 20 bp, Artificial
  CRISPR gRNA sequence
tcattgctttttccgacatt

SEQ ID NO: 474821 - DNA, 20 bp, Artificial
  CRISPR gRNA sequence
ctttttccgacatttagcaa

SEQ ID NO: 474822 - DNA, 20 bp, Artificial
  CRISPR gRNA sequence
tttccgacatttagcaaagc

SEQ ID NO: 474823 - DNA, 20 bp, Artificial
  CRISPR gRNA sequence
ttccgacatttagcaaagct

SEQ ID NO: 474824 - DNA, 20 bp, Artificial
  CRISPR gRNA sequence
tccgacatttagcaaagctt

SEQ ID NO: 474825 - DNA, 20 bp, Artificial
  CRISPR gRNA sequence
ccgacatttagcaaagctta

SEQ ID NO: 474826 - DNA, 20 bp, Artificial
  CRISPR gRNA sequence
cgacatttagcaaagcttac

SEQ ID NO: 474827 - DNA, 20 bp, Artificial
  CRISPR gRNA sequence
agcaaagcttacaaagtccc

SEQ ID NO: 474828 - DNA, 20 bp, Artificial
  CRISPR gRNA sequence
gcaaagcttacaaagtcccc

SEQ ID NO: 474829 - DNA, 20 bp, Artificial
  CRISPR gRNA sequence
acaaagtccccatgtcattt

SEQ ID NO: 474830 - DNA, 20 bp, Artificial
  CRISPR gRNA sequence
caaagtccccatgtcatttc

SEQ ID NO: 474831 - DNA, 20 bp, Artificial
  CRISPR gRNA sequence
cctctccttgagatatttaa

SEQ ID NO: 474832 - DNA, 20 bp, Artificial
  CRISPR gRNA sequence
ctctccttgagatatttaag

SEQ ID NO: 474833 - DNA, 20 bp, Artificial
  CRISPR gRNA sequence
tccttgagatatttaagagt

SEQ ID NO: 474834 - DNA, 20 bp, Artificial
  CRISPR gRNA sequence
cttgagatatttaagagtag

SEQ ID NO: 474835 - DNA, 20 bp, Artificial
  CRISPR gRNA sequence
gagatatttaagagtagaac

SEQ ID NO: 474836 - DNA, 20 bp, Artificial
  CRISPR gRNA sequence
agatatttaagagtagaaca

SEQ ID NO: 474837 - DNA, 20 bp, Artificial
  CRISPR gRNA sequence
aagagtagaacaagaagaga

SEQ ID NO: 474838 - DNA, 20 bp, Artificial
  CRISPR gRNA sequence
agagtagaacaagaagagaa

SEQ ID NO: 474839 - DNA, 20 bp, Artificial
  CRISPR gRNA sequence
agaggtcatgaggtcagatg

SEQ ID NO: 474840 - DNA, 20 bp, Artificial
  CRISPR gRNA sequence
gaggtcatgaggtcagatgc

SEQ ID NO: 474841 - DNA, 20 bp, Artificial
  CRISPR gRNA sequence
aagttacatttaggagatca

SEQ ID NO: 474842 - DNA, 20 bp, Artificial
  CRISPR gRNA sequence
agttacatttaggagatcac

SEQ ID NO: 474843 - DNA, 20 bp, Artificial
  CRISPR gRNA sequence
catttaggagatcacctcta

SEQ ID NO: 474844 - DNA, 20 bp, Artificial
  CRISPR gRNA sequence
aggagatcacctctagaatc

SEQ ID NO: 474845 - DNA, 20 bp, Artificial
  CRISPR gRNA sequence
ggagatcacctctagaatca

SEQ ID NO: 474846 - DNA, 20 bp, Artificial
  CRISPR gRNA sequence
tagaatcactgctacacatt

SEQ ID NO: 474847 - DNA, 20 bp, Artificial
  CRISPR gRNA sequence
gaatcactgctacacattct

SEQ ID NO: 474848 - DNA, 20 bp, Artificial
  CRISPR gRNA sequence
ctacacattctttgccactt

SEQ ID NO: 474849 - DNA, 20 bp, Artificial
  CRISPR gRNA sequence
cacattctttgccacttgcc

SEQ ID NO: 474850 - DNA, 20 bp, Artificial
  CRISPR gRNA sequence
tttgccacttgcccacaggt

SEQ ID NO: 474851 - DNA, 20 bp, Artificial
  CRISPR gRNA sequence
tgccacttgcccacaggtac

SEQ ID NO: 474852 - DNA, 20 bp, Artificial
  CRISPR gRNA sequence
gccacttgcccacaggtaca

SEQ ID NO: 474853 - DNA, 20 bp, Artificial
  CRISPR gRNA sequence
ccacttgcccacaggtacac

SEQ ID NO: 474854 - DNA, 20 bp, Artificial
  CRISPR gRNA sequence
gcccacaggtacactccacc

SEQ ID NO: 474855 - DNA, 20 bp, Artificial
  CRISPR gRNA sequence
cccacaggtacactccacct

SEQ ID NO: 474856 - DNA, 20 bp, Artificial
  CRISPR gRNA sequence
cacctcacattatctatata

SEQ ID NO: 474857 - DNA, 20 bp, Artificial
  CRISPR gRNA sequence
acattatctatatactgtag

SEQ ID NO: 474858 - DNA, 20 bp, Artificial
  CRISPR gRNA sequence
tctatatactgtagacccaa

SEQ ID NO: 474859 - DNA, 20 bp, Artificial
  CRISPR gRNA sequence
tatactgtagacccaaccta

SEQ ID NO: 474860 - DNA, 20 bp, Artificial
  CRISPR gRNA sequence
tagacccaacctagatccat

SEQ ID NO: 474861 - DNA, 20 bp, Artificial
  CRISPR gRNA sequence
gatccatcttaacacgagga

SEQ ID NO: 474862 - DNA, 20 bp, Artificial
  CRISPR gRNA sequence
aacacgaggaaaaaaagaat

SEQ ID NO: 474863 - DNA, 20 bp, Artificial
  CRISPR gRNA sequence
acacgaggaaaaaaagaata

SEQ ID NO: 474864 - DNA, 20 bp, Artificial
  CRISPR gRNA sequence
atattttcaaagttcttatt

SEQ ID NO: 474865 - DNA, 20 bp, Artificial
  CRISPR gRNA sequence
tcaaagttcttattatgagg

SEQ ID NO: 474866 - DNA, 20 bp, Artificial
  CRISPR gRNA sequence
caaagttcttattatgaggt

SEQ ID NO: 474867 - DNA, 20 bp, Artificial
  CRISPR gRNA sequence
aaagttcttattatgaggta

SEQ ID NO: 474868 - DNA, 20 bp, Artificial
  CRISPR gRNA sequence
ttattatgaggtaggcactt

SEQ ID NO: 474869 - DNA, 20 bp, Artificial
  CRISPR gRNA sequence
attatgaggtaggcactttt

SEQ ID NO: 474870 - DNA, 20 bp, Artificial
  CRISPR gRNA sequence
ttatgaggtaggcactttta

SEQ ID NO: 474871 - DNA, 20 bp, Artificial
  CRISPR gRNA sequence
tgaggtaggcacttttagat

SEQ ID NO: 474872 - DNA, 20 bp, Artificial
  CRISPR gRNA sequence
ttagataccaaacatgtatt

SEQ ID NO: 474873 - DNA, 20 bp, Artificial
  CRISPR gRNA sequence
tagataccaaacatgtattg

SEQ ID NO: 474874 - DNA, 20 bp, Artificial
  CRISPR gRNA sequence
agataccaaacatgtattgt

SEQ ID NO: 474875 - DNA, 20 bp, Artificial
  CRISPR gRNA sequence
gataccaaacatgtattgtt

SEQ ID NO: 474876 - DNA, 20 bp, Artificial
  CRISPR gRNA sequence
tttcatttgaccctcacaat

SEQ ID NO: 474877 - DNA, 20 bp, Artificial
  CRISPR gRNA sequence
catttgaccctcacaatgat

SEQ ID NO: 474878 - DNA, 20 bp, Artificial
  CRISPR gRNA sequence
atttgaccctcacaatgatt

SEQ ID NO: 474879 - DNA, 20 bp, Artificial
  CRISPR gRNA sequence
gaccctcacaatgattttat

SEQ ID NO: 474880 - DNA, 20 bp, Artificial
  CRISPR gRNA sequence
accctcacaatgattttatg

SEQ ID NO: 474881 - DNA, 20 bp, Artificial
  CRISPR gRNA sequence
acaatgattttatgagggaa

SEQ ID NO: 474882 - DNA, 20 bp, Artificial
  CRISPR gRNA sequence
tatgagggaattactattat

SEQ ID NO: 474883 - DNA, 20 bp, Artificial
  CRISPR gRNA sequence
atgagggaattactattatg

SEQ ID NO: 474884 - DNA, 20 bp, Artificial
  CRISPR gRNA sequence
tgagggaattactattatgg

SEQ ID NO: 474885 - DNA, 20 bp, Artificial
  CRISPR gRNA sequence
ctattatggcctttattttt

SEQ ID NO: 474886 - DNA, 20 bp, Artificial
  CRISPR gRNA sequence
ttatggcctttattttttta

SEQ ID NO: 474887 - DNA, 20 bp, Artificial
  CRISPR gRNA sequence
tggcctttatttttttaagt

SEQ ID NO: 474888 - DNA, 20 bp, Artificial
  CRISPR gRNA sequence
tatttttttaagttgaggaa

SEQ ID NO: 474889 - DNA, 20 bp, Artificial
  CRISPR gRNA sequence
atttttttaagttgaggaaa

SEQ ID NO: 474890 - DNA, 20 bp, Artificial
  CRISPR gRNA sequence
tttttttaagttgaggaaac

SEQ ID NO: 474891 - DNA, 20 bp, Artificial
  CRISPR gRNA sequence
ttttaagttgaggaaactgg

SEQ ID NO: 474892 - DNA, 20 bp, Artificial
  CRISPR gRNA sequence
tttaagttgaggaaactggg

SEQ ID NO: 474893 - DNA, 20 bp, Artificial
  CRISPR gRNA sequence
ttaagttgaggaaactgggt

SEQ ID NO: 474894 - DNA, 20 bp, Artificial
  CRISPR gRNA sequence
taagttgaggaaactgggta

SEQ ID NO: 474895 - DNA, 20 bp, Artificial
  CRISPR gRNA sequence
aagttgaggaaactgggtat

SEQ ID NO: 474896 - DNA, 20 bp, Artificial
  CRISPR gRNA sequence
agttgaggaaactgggtatt

SEQ ID NO: 474897 - DNA, 20 bp, Artificial
  CRISPR gRNA sequence
aggaaactgggtattagaga

SEQ ID NO: 474898 - DNA, 20 bp, Artificial
  CRISPR gRNA sequence
ggtattagagaatataagcc

SEQ ID NO: 474899 - DNA, 20 bp, Artificial
  CRISPR gRNA sequence
gagaatataagccacttgcc

SEQ ID NO: 474900 - DNA, 20 bp, Artificial
  CRISPR gRNA sequence
gcccaagatcaccagctggt

SEQ ID NO: 474901 - DNA, 20 bp, Artificial
  CRISPR gRNA sequence
cccaagatcaccagctggta

SEQ ID NO: 474902 - DNA, 20 bp, Artificial
  CRISPR gRNA sequence
gtaggaggaagagtcaaggc

SEQ ID NO: 474903 - DNA, 20 bp, Artificial
  CRISPR gRNA sequence
ggactttaacccaggtgtgg

SEQ ID NO: 474904 - DNA, 20 bp, Artificial
  CRISPR gRNA sequence
taacccaggtgtggctaact

SEQ ID NO: 474905 - DNA, 20 bp, Artificial
  CRISPR gRNA sequence
aacccaggtgtggctaactc

SEQ ID NO: 474906 - DNA, 20 bp, Artificial
  CRISPR gRNA sequence
acccaggtgtggctaactcc

SEQ ID NO: 474907 - DNA, 20 bp, Artificial
  CRISPR gRNA sequence
actccaaagcacaagctctt

SEQ ID NO: 474908 - DNA, 20 bp, Artificial
  CRISPR gRNA sequence
caaagcacaagctcttatcc

SEQ ID NO: 474909 - DNA, 20 bp, Artificial
  CRISPR gRNA sequence
ttatccagtagggttgttgt

SEQ ID NO: 474910 - DNA, 20 bp, Artificial
  CRISPR gRNA sequence
atccagtagggttgttgtga

SEQ ID NO: 474911 - DNA, 20 bp, Artificial
  CRISPR gRNA sequence
tccagtagggttgttgtgaa

SEQ ID NO: 474912 - DNA, 20 bp, Artificial
  CRISPR gRNA sequence
ttgtgaaagcaaatgagaac

SEQ ID NO: 474913 - DNA, 20 bp, Artificial
  CRISPR gRNA sequence
tgaaagcaaatgagaacata

SEQ ID NO: 474914 - DNA, 20 bp, Artificial
  CRISPR gRNA sequence
ttagcactatgcttggcaca

SEQ ID NO: 474915 - DNA, 20 bp, Artificial
  CRISPR gRNA sequence
agcactatgcttggcacata

SEQ ID NO: 474916 - DNA, 20 bp, Artificial
  CRISPR gRNA sequence
gcactatgcttggcacataa

SEQ ID NO: 474917 - DNA, 20 bp, Artificial
  CRISPR gRNA sequence
tgcttggcacataacaacaa

SEQ ID NO: 474918 - DNA, 20 bp, Artificial
  CRISPR gRNA sequence
ggcacataacaacaacataa

SEQ ID NO: 474919 - DNA, 20 bp, Artificial
  CRISPR gRNA sequence
gcacataacaacaacataaa

SEQ ID NO: 474920 - DNA, 20 bp, Artificial
  CRISPR gRNA sequence
ttatgttttctgataggatg

SEQ ID NO: 474921 - DNA, 20 bp, Artificial
  CRISPR gRNA sequence
tgttttctgataggatgaat

SEQ ID NO: 474922 - DNA, 20 bp, Artificial
  CRISPR gRNA sequence
tctgataggatgaatttagg

SEQ ID NO: 474923 - DNA, 20 bp, Artificial
  CRISPR gRNA sequence
ctgataggatgaatttaggg

SEQ ID NO: 474924 - DNA, 20 bp, Artificial
  CRISPR gRNA sequence
tgataggatgaatttaggga

SEQ ID NO: 474925 - DNA, 20 bp, Artificial
  CRISPR gRNA sequence
ataggatgaatttagggaaa

SEQ ID NO: 474926 - DNA, 20 bp, Artificial
  CRISPR gRNA sequence
agggaaatcacacagaagtt

SEQ ID NO: 474927 - DNA, 20 bp, Artificial
  CRISPR gRNA sequence
gggaaatcacacagaagttg

SEQ ID NO: 474928 - DNA, 20 bp, Artificial
  CRISPR gRNA sequence
agtcattgtccagaggtgta

SEQ ID NO: 474929 - DNA, 20 bp, Artificial
  CRISPR gRNA sequence
tccagaggtgtaaagcctat

SEQ ID NO: 474930 - DNA, 20 bp, Artificial
  CRISPR gRNA sequence
tgaatggtaaagacaagatg

SEQ ID NO: 474931 - DNA, 20 bp, Artificial
  CRISPR gRNA sequence
tgctgtgaaaaattaccccc

SEQ ID NO: 474932 - DNA, 20 bp, Artificial
  CRISPR gRNA sequence
ctgtgaaaaattacccccaa

SEQ ID NO: 474933 - DNA, 20 bp, Artificial
  CRISPR gRNA sequence
tgaaaaattacccccaacaa

SEQ ID NO: 474934 - DNA, 20 bp, Artificial
  CRISPR gRNA sequence
cccccaacaaccattctagg

SEQ ID NO: 474935 - DNA, 20 bp, Artificial
  CRISPR gRNA sequence
tagggatcagcagtggtgca

SEQ ID NO: 474936 - DNA, 20 bp, Artificial
  CRISPR gRNA sequence
gggatcagcagtggtgcata

SEQ ID NO: 474937 - DNA, 20 bp, Artificial
  CRISPR gRNA sequence
gtatatacaccaggcaaaaa

SEQ ID NO: 474938 - DNA, 20 bp, Artificial
  CRISPR gRNA sequence
tataatagagagaagaaagg

SEQ ID NO: 474939 - DNA, 20 bp, Artificial
  CRISPR gRNA sequence
ttcttttatgtgggagagga

SEQ ID NO: 474940 - DNA, 20 bp, Artificial
  CRISPR gRNA sequence
cttttatgtgggagaggaaa

SEQ ID NO: 474941 - DNA, 20 bp, Artificial
  CRISPR gRNA sequence
ttttatgtgggagaggaaac

SEQ ID NO: 474942 - DNA, 20 bp, Artificial
  CRISPR gRNA sequence
ttatgtgggagaggaaactc

SEQ ID NO: 474943 - DNA, 20 bp, Artificial
  CRISPR gRNA sequence
tatgtgggagaggaaactct

SEQ ID NO: 474944 - DNA, 20 bp, Artificial
  CRISPR gRNA sequence
atgtgggagaggaaactcta

SEQ ID NO: 474945 - DNA, 20 bp, Artificial
  CRISPR gRNA sequence
tgtgggagaggaaactctac

SEQ ID NO: 474946 - DNA, 20 bp, Artificial
  CRISPR gRNA sequence
tacagaaatatattaaccag

SEQ ID NO: 474947 - DNA, 20 bp, Artificial
  CRISPR gRNA sequence
cagaaatatattaaccagca

SEQ ID NO: 474948 - DNA, 20 bp, Artificial
  CRISPR gRNA sequence
accagcaaggcttgccttgg

SEQ ID NO: 474949 - DNA, 20 bp, Artificial
  CRISPR gRNA sequence
gccttggtcaaaactagaat

SEQ ID NO: 474950 - DNA, 20 bp, Artificial
  CRISPR gRNA sequence
ccttggtcaaaactagaata

SEQ ID NO: 474951 - DNA, 20 bp, Artificial
  CRISPR gRNA sequence
ggtcaaaactagaatattga

SEQ ID NO: 474952 - DNA, 20 bp, Artificial
  CRISPR gRNA sequence
gtcaaaactagaatattgaa

SEQ ID NO: 474953 - DNA, 20 bp, Artificial
  CRISPR gRNA sequence
gaatattgaaaaaaactttg

SEQ ID NO: 474954 - DNA, 20 bp, Artificial
  CRISPR gRNA sequence
aaaaaaactttgtcctttga

SEQ ID NO: 474955 - DNA, 20 bp, Artificial
  CRISPR gRNA sequence
tgtcctttgataattttcta

SEQ ID NO: 474956 - DNA, 20 bp, Artificial
  CRISPR gRNA sequence
gtcctttgataattttctaa

SEQ ID NO: 474957 - DNA, 20 bp, Artificial
  CRISPR gRNA sequence
tcctttgataattttctaag

SEQ ID NO: 474958 - DNA, 20 bp, Artificial
  CRISPR gRNA sequence
tgataattttctaagcttgc

SEQ ID NO: 474959 - DNA, 20 bp, Artificial
  CRISPR gRNA sequence
gataattttctaagcttgct

SEQ ID NO: 474960 - DNA, 20 bp, Artificial
  CRISPR gRNA sequence
ataattttctaagcttgctt

SEQ ID NO: 474961 - DNA, 20 bp, Artificial
  CRISPR gRNA sequence
tctaagcttgctttcaggac

SEQ ID NO: 474962 - DNA, 20 bp, Artificial
  CRISPR gRNA sequence
ctaagcttgctttcaggact

SEQ ID NO: 474963 - DNA, 20 bp, Artificial
  CRISPR gRNA sequence
taagcttgctttcaggactt

SEQ ID NO: 474964 - DNA, 20 bp, Artificial
  CRISPR gRNA sequence
agcttgctttcaggacttct

SEQ ID NO: 474965 - DNA, 20 bp, Artificial
  CRISPR gRNA sequence
gctttcaggacttcttcatt

SEQ ID NO: 474966 - DNA, 20 bp, Artificial
  CRISPR gRNA sequence
ctttcaggacttcttcatta

SEQ ID NO: 474967 - DNA, 20 bp, Artificial
  CRISPR gRNA sequence
tcaggacttcttcattacat

SEQ ID NO: 474968 - DNA, 20 bp, Artificial
  CRISPR gRNA sequence
caggacttcttcattacatc

SEQ ID NO: 474969 - DNA, 20 bp, Artificial
  CRISPR gRNA sequence
aggacttcttcattacatct

SEQ ID NO: 474970 - DNA, 20 bp, Artificial
  CRISPR gRNA sequence
cttcattacatctctgccaa

SEQ ID NO: 474971 - DNA, 20 bp, Artificial
  CRISPR gRNA sequence
ttcattacatctctgccaag

SEQ ID NO: 474972 - DNA, 20 bp, Artificial
  CRISPR gRNA sequence
cattacatctctgccaagtc

SEQ ID NO: 474973 - DNA, 20 bp, Artificial
  CRISPR gRNA sequence
attacatctctgccaagtca

SEQ ID NO: 474974 - DNA, 20 bp, Artificial
  CRISPR gRNA sequence
catctctgccaagtcacaaa

SEQ ID NO: 474975 - DNA, 20 bp, Artificial
  CRISPR gRNA sequence
tgccaagtcacaaatgtccc

SEQ ID NO: 474976 - DNA, 20 bp, Artificial
  CRISPR gRNA sequence
ccaagtcacaaatgtcccct

SEQ ID NO: 474977 - DNA, 20 bp, Artificial
  CRISPR gRNA sequence
gcagatctaccctactggtc

SEQ ID NO: 474978 - DNA, 20 bp, Artificial
  CRISPR gRNA sequence
cagatctaccctactggtca

SEQ ID NO: 474979 - DNA, 20 bp, Artificial
  CRISPR gRNA sequence
ccctactggtcactgacttt

SEQ ID NO: 474980 - DNA, 20 bp, Artificial
  CRISPR gRNA sequence
ctggtcactgactttgcttc

SEQ ID NO: 474981 - DNA, 20 bp, Artificial
  CRISPR gRNA sequence
gtcactgactttgcttctct

SEQ ID NO: 474982 - DNA, 20 bp, Artificial
  CRISPR gRNA sequence
actttgcttctctaggccag

SEQ ID NO: 474983 - DNA, 20 bp, Artificial
  CRISPR gRNA sequence
tgcttctctaggccagagga

SEQ ID NO: 474984 - DNA, 20 bp, Artificial
  CRISPR gRNA sequence
gcttctctaggccagaggat

SEQ ID NO: 474985 - DNA, 20 bp, Artificial
  CRISPR gRNA sequence
cttctctaggccagaggatt

SEQ ID NO: 474986 - DNA, 20 bp, Artificial
  CRISPR gRNA sequence
ctctaggccagaggattcat

SEQ ID NO: 474987 - DNA, 20 bp, Artificial
  CRISPR gRNA sequence
tctaggccagaggattcata

SEQ ID NO: 474988 - DNA, 20 bp, Artificial
  CRISPR gRNA sequence
taggccagaggattcatatg

SEQ ID NO: 474989 - DNA, 20 bp, Artificial
  CRISPR gRNA sequence
ggccagaggattcatatgca

SEQ ID NO: 474990 - DNA, 20 bp, Artificial
  CRISPR gRNA sequence
atatgcattgcactccttag

SEQ ID NO: 474991 - DNA, 20 bp, Artificial
  CRISPR gRNA sequence
cactccttagagccctgtct

SEQ ID NO: 474992 - DNA, 20 bp, Artificial
  CRISPR gRNA sequence
cttagagccctgtctactct

SEQ ID NO: 474993 - DNA, 20 bp, Artificial
  CRISPR gRNA sequence
agagccctgtctactctgtg

SEQ ID NO: 474994 - DNA, 20 bp, Artificial
  CRISPR gRNA sequence
gagccctgtctactctgtgt

SEQ ID NO: 474995 - DNA, 20 bp, Artificial
  CRISPR gRNA sequence
tctactctgtgtaacaagga

SEQ ID NO: 474996 - DNA, 20 bp, Artificial
  CRISPR gRNA sequence
ctctgtgtaacaaggatgag

SEQ ID NO: 474997 - DNA, 20 bp, Artificial
  CRISPR gRNA sequence
tgtgtaacaaggatgagttt

SEQ ID NO: 474998 - DNA, 20 bp, Artificial
  CRISPR gRNA sequence
tgtaacaaggatgagtttct

SEQ ID NO: 474999 - DNA, 20 bp, Artificial
  CRISPR gRNA sequence
ctggtggttttagttggtca

SEQ ID NO: 475000 - DNA, 20 bp, Artificial
  CRISPR gRNA sequence
tggtggttttagttggtcaa

SEQ ID NO: 475001 - DNA, 20 bp, Artificial
  CRISPR gRNA sequence
gtggttttagttggtcaaca

SEQ ID NO: 475002 - DNA, 20 bp, Artificial
  CRISPR gRNA sequence
tagttggtcaacatgtaatt

SEQ ID NO: 475003 - DNA, 20 bp, Artificial
  CRISPR gRNA sequence
agttggtcaacatgtaatta

SEQ ID NO: 475004 - DNA, 20 bp, Artificial
  CRISPR gRNA sequence
gttggtcaacatgtaattat

SEQ ID NO: 475005 - DNA, 20 bp, Artificial
  CRISPR gRNA sequence
gtcaacatgtaattatcgcc

SEQ ID NO: 475006 - DNA, 20 bp, Artificial
  CRISPR gRNA sequence
tcgcccttgaatagtaaaag

SEQ ID NO: 475007 - DNA, 20 bp, Artificial
  CRISPR gRNA sequence
gaatagtaaaagcttctagt

SEQ ID NO: 475008 - DNA, 20 bp, Artificial
  CRISPR gRNA sequence
aatagtaaaagcttctagtc

SEQ ID NO: 475009 - DNA, 20 bp, Artificial
  CRISPR gRNA sequence
ctagtcaacttaatgagtcc

SEQ ID NO: 475010 - DNA, 20 bp, Artificial
  CRISPR gRNA sequence
tagtcaacttaatgagtcct

SEQ ID NO: 475011 - DNA, 20 bp, Artificial
  CRISPR gRNA sequence
gtcaacttaatgagtcctaa

SEQ ID NO: 475012 - DNA, 20 bp, Artificial
  CRISPR gRNA sequence
aatgagtcctaaagaacaat

SEQ ID NO: 475013 - DNA, 20 bp, Artificial
  CRISPR gRNA sequence
atgagtcctaaagaacaatg

SEQ ID NO: 475014 - DNA, 20 bp, Artificial
  CRISPR gRNA sequence
aagaacaatgatttagagag

SEQ ID NO: 475015 - DNA, 20 bp, Artificial
  CRISPR gRNA sequence
agagagactttgattgcctg

SEQ ID NO: 475016 - DNA, 20 bp, Artificial
  CRISPR gRNA sequence
gagagactttgattgcctgt

SEQ ID NO: 475017 - DNA, 20 bp, Artificial
  CRISPR gRNA sequence
tgattgcctgttacacatag

SEQ ID NO: 475018 - DNA, 20 bp, Artificial
  CRISPR gRNA sequence
gattgcctgttacacatagg

SEQ ID NO: 475019 - DNA, 20 bp, Artificial
  CRISPR gRNA sequence
attgcctgttacacataggc

SEQ ID NO: 475020 - DNA, 20 bp, Artificial
  CRISPR gRNA sequence
cctgttacacataggccctg

SEQ ID NO: 475021 - DNA, 20 bp, Artificial
  CRISPR gRNA sequence
ttacacataggccctgtcct

SEQ ID NO: 475022 - DNA, 20 bp, Artificial
  CRISPR gRNA sequence
cacataggccctgtccttca

SEQ ID NO: 475023 - DNA, 20 bp, Artificial
  CRISPR gRNA sequence
tccttcagagaggctaaatt

SEQ ID NO: 475024 - DNA, 20 bp, Artificial
  CRISPR gRNA sequence
cagagaggctaaattttcca

SEQ ID NO: 475025 - DNA, 20 bp, Artificial
  CRISPR gRNA sequence
agagaggctaaattttccac

SEQ ID NO: 475026 - DNA, 20 bp, Artificial
  CRISPR gRNA sequence
aattttccacctttgtcaca

SEQ ID NO: 475027 - DNA, 20 bp, Artificial
  CRISPR gRNA sequence
tccacctttgtcacagggat

SEQ ID NO: 475028 - DNA, 20 bp, Artificial
  CRISPR gRNA sequence
ccacctttgtcacagggatt

SEQ ID NO: 475029 - DNA, 20 bp, Artificial
  CRISPR gRNA sequence
cacctttgtcacagggattt

SEQ ID NO: 475030 - DNA, 20 bp, Artificial
  CRISPR gRNA sequence
tgtcacagggatttcaggaa

SEQ ID NO: 475031 - DNA, 20 bp, Artificial
  CRISPR gRNA sequence
gtcacagggatttcaggaag

SEQ ID NO: 475032 - DNA, 20 bp, Artificial
  CRISPR gRNA sequence
tcacagggatttcaggaaga

SEQ ID NO: 475033 - DNA, 20 bp, Artificial
  CRISPR gRNA sequence
caggaagaaacatagggcag

SEQ ID NO: 475034 - DNA, 20 bp, Artificial
  CRISPR gRNA sequence
aggaagaaacatagggcagc

SEQ ID NO: 475035 - DNA, 20 bp, Artificial
  CRISPR gRNA sequence
agaagctgttgacagtagca

SEQ ID NO: 475036 - DNA, 20 bp, Artificial
  CRISPR gRNA sequence
ttgacagtagcatcagtgag

SEQ ID NO: 475037 - DNA, 20 bp, Artificial
  CRISPR gRNA sequence
acagtagcatcagtgagtgc

SEQ ID NO: 475038 - DNA, 20 bp, Artificial
  CRISPR gRNA sequence
tggcatttgatcagaaacca

SEQ ID NO: 475039 - DNA, 20 bp, Artificial
  CRISPR gRNA sequence
gcatttgatcagaaaccaac

SEQ ID NO: 475040 - DNA, 20 bp, Artificial
  CRISPR gRNA sequence
gatcagaaaccaacatgagt

SEQ ID NO: 475041 - DNA, 20 bp, Artificial
  CRISPR gRNA sequence
atcagaaaccaacatgagta

SEQ ID NO: 475042 - DNA, 20 bp, Artificial
  CRISPR gRNA sequence
ctaaatattgacttcagtgg

SEQ ID NO: 475043 - DNA, 20 bp, Artificial
  CRISPR gRNA sequence
taaatattgacttcagtgga

SEQ ID NO: 475044 - DNA, 20 bp, Artificial
  CRISPR gRNA sequence
aatattgacttcagtggaag

SEQ ID NO: 475045 - DNA, 20 bp, Artificial
  CRISPR gRNA sequence
acttcagtggaaggattgtt

SEQ ID NO: 475046 - DNA, 20 bp, Artificial
  CRISPR gRNA sequence
cagtggaaggattgttactt

SEQ ID NO: 475047 - DNA, 20 bp, Artificial
  CRISPR gRNA sequence
agtggaaggattgttacttg

SEQ ID NO: 475048 - DNA, 20 bp, Artificial
  CRISPR gRNA sequence
ttacttgtgatgttcagatt

SEQ ID NO: 475049 - DNA, 20 bp, Artificial
  CRISPR gRNA sequence
cttgtgatgttcagattaag

SEQ ID NO: 475050 - DNA, 20 bp, Artificial
  CRISPR gRNA sequence
gtgatgttcagattaagtgt

SEQ ID NO: 475051 - DNA, 20 bp, Artificial
  CRISPR gRNA sequence
tgatgttcagattaagtgtg

SEQ ID NO: 475052 - DNA, 20 bp, Artificial
  CRISPR gRNA sequence
agattaagtgtggcttatgt

SEQ ID NO: 475053 - DNA, 20 bp, Artificial
  CRISPR gRNA sequence
agtgtggcttatgtattatg

SEQ ID NO: 475054 - DNA, 20 bp, Artificial
  CRISPR gRNA sequence
atgtattatgattggaaagg

SEQ ID NO: 475055 - DNA, 20 bp, Artificial
  CRISPR gRNA sequence
tgtattatgattggaaaggg

SEQ ID NO: 475056 - DNA, 20 bp, Artificial
  CRISPR gRNA sequence
tgattggaaagggaaagtcc

SEQ ID NO: 475057 - DNA, 20 bp, Artificial
  CRISPR gRNA sequence
gaaagggaaagtccatctct

SEQ ID NO: 475058 - DNA, 20 bp, Artificial
  CRISPR gRNA sequence
tactttcttcccagatactt

SEQ ID NO: 475059 - DNA, 20 bp, Artificial
  CRISPR gRNA sequence
ctttcttcccagatacttcc

SEQ ID NO: 475060 - DNA, 20 bp, Artificial
  CRISPR gRNA sequence
tcttcccagatacttcctca

SEQ ID NO: 475061 - DNA, 20 bp, Artificial
  CRISPR gRNA sequence
cttcccagatacttcctcac

SEQ ID NO: 475062 - DNA, 20 bp, Artificial
  CRISPR gRNA sequence
ttcccagatacttcctcaca

SEQ ID NO: 475063 - DNA, 20 bp, Artificial
  CRISPR gRNA sequence
cccagatacttcctcacatc

SEQ ID NO: 475064 - DNA, 20 bp, Artificial
  CRISPR gRNA sequence
ccagatacttcctcacatct

SEQ ID NO: 475065 - DNA, 20 bp, Artificial
  CRISPR gRNA sequence
cctcacatctctaatacatt

SEQ ID NO: 475066 - DNA, 20 bp, Artificial
  CRISPR gRNA sequence
ctcacatctctaatacattc

SEQ ID NO: 475067 - DNA, 20 bp, Artificial
  CRISPR gRNA sequence
acatctctaatacattctac

SEQ ID NO: 475068 - DNA, 20 bp, Artificial
  CRISPR gRNA sequence
taatacattctaccacagac

SEQ ID NO: 475069 - DNA, 20 bp, Artificial
  CRISPR gRNA sequence
atacattctaccacagacat

SEQ ID NO: 475070 - DNA, 20 bp, Artificial
  CRISPR gRNA sequence
taccacagacatcacactga

SEQ ID NO: 475071 - DNA, 20 bp, Artificial
  CRISPR gRNA sequence
ccacagacatcacactgaga

SEQ ID NO: 475072 - DNA, 20 bp, Artificial
  CRISPR gRNA sequence
agattcactggcattttcaa

SEQ ID NO: 475073 - DNA, 20 bp, Artificial
  CRISPR gRNA sequence
actggcattttcaaagccct

SEQ ID NO: 475074 - DNA, 20 bp, Artificial
  CRISPR gRNA sequence
gcattttcaaagcccttgaa

SEQ ID NO: 475075 - DNA, 20 bp, Artificial
  CRISPR gRNA sequence
tcaaagcccttgaagatact

SEQ ID NO: 475076 - DNA, 20 bp, Artificial
  CRISPR gRNA sequence
caaagcccttgaagatacta

SEQ ID NO: 475077 - DNA, 20 bp, Artificial
  CRISPR gRNA sequence
aaagcccttgaagatactaa

SEQ ID NO: 475078 - DNA, 20 bp, Artificial
  CRISPR gRNA sequence
gaagatactaaacaatactt

SEQ ID NO: 475079 - DNA, 20 bp, Artificial
  CRISPR gRNA sequence
aagatactaaacaatactta

SEQ ID NO: 475080 - DNA, 20 bp, Artificial
  CRISPR gRNA sequence
aacaatacttatgtggacag

SEQ ID NO: 475081 - DNA, 20 bp, Artificial
  CRISPR gRNA sequence
atgtggacagaatctgctaa

SEQ ID NO: 475082 - DNA, 20 bp, Artificial
  CRISPR gRNA sequence
tgtggacagaatctgctaaa

SEQ ID NO: 475083 - DNA, 20 bp, Artificial
  CRISPR gRNA sequence
ctaaatgtcttccaatatta

SEQ ID NO: 475084 - DNA, 20 bp, Artificial
  CRISPR gRNA sequence
aatgtcttccaatattaatt

SEQ ID NO: 475085 - DNA, 20 bp, Artificial
  CRISPR gRNA sequence
ccaatattaattctcatctt

SEQ ID NO: 475086 - DNA, 20 bp, Artificial
  CRISPR gRNA sequence
caatattaattctcatcttc

SEQ ID NO: 475087 - DNA, 20 bp, Artificial
  CRISPR gRNA sequence
attctcatcttctaatatta

SEQ ID NO: 475088 - DNA, 20 bp, Artificial
  CRISPR gRNA sequence
tcatcttctaatattataga

SEQ ID NO: 475089 - DNA, 20 bp, Artificial
  CRISPR gRNA sequence
atcttctaatattatagagg

SEQ ID NO: 475090 - DNA, 20 bp, Artificial
  CRISPR gRNA sequence
ctaatattatagaggaaaat

SEQ ID NO: 475091 - DNA, 20 bp, Artificial
  CRISPR gRNA sequence
taatattatagaggaaaatg

SEQ ID NO: 475092 - DNA, 20 bp, Artificial
  CRISPR gRNA sequence
atattatagaggaaaatgaa

SEQ ID NO: 475093 - DNA, 20 bp, Artificial
  CRISPR gRNA sequence
tagaggaaaatgaagtgggg

SEQ ID NO: 475094 - DNA, 20 bp, Artificial
  CRISPR gRNA sequence
aatgccccagcctcccttgt

SEQ ID NO: 475095 - DNA, 20 bp, Artificial
  CRISPR gRNA sequence
ccttgtagccaaatactgga

SEQ ID NO: 475096 - DNA, 20 bp, Artificial
  CRISPR gRNA sequence
gtagccaaatactggataat

SEQ ID NO: 475097 - DNA, 20 bp, Artificial
  CRISPR gRNA sequence
tagccaaatactggataata

SEQ ID NO: 475098 - DNA, 20 bp, Artificial
  CRISPR gRNA sequence
gataataggccatttgtgat

SEQ ID NO: 475099 - DNA, 20 bp, Artificial
  CRISPR gRNA sequence
gtgatgtgtgtgagttccag

SEQ ID NO: 475100 - DNA, 20 bp, Artificial
  CRISPR gRNA sequence
tgatgtgtgtgagttccagg

SEQ ID NO: 475101 - DNA, 20 bp, Artificial
  CRISPR gRNA sequence
caggttgtgcttataagatg

SEQ ID NO: 475102 - DNA, 20 bp, Artificial
  CRISPR gRNA sequence
tgcttataagatgaacatgg

SEQ ID NO: 475103 - DNA, 20 bp, Artificial
  CRISPR gRNA sequence
ataagatgaacatggttatc

SEQ ID NO: 475104 - DNA, 20 bp, Artificial
  CRISPR gRNA sequence
taagatgaacatggttatca

SEQ ID NO: 475105 - DNA, 20 bp, Artificial
  CRISPR gRNA sequence
tcaagaaggcagaaaaaaga

SEQ ID NO: 475106 - DNA, 20 bp, Artificial
  CRISPR gRNA sequence
aagagctctgccagctaaac

SEQ ID NO: 475107 - DNA, 20 bp, Artificial
  CRISPR gRNA sequence
tgccagctaaacttgatgtt

SEQ ID NO: 475108 - DNA, 20 bp, Artificial
  CRISPR gRNA sequence
ccagctaaacttgatgtttt

SEQ ID NO: 475109 - DNA, 20 bp, Artificial
  CRISPR gRNA sequence
aacttgatgttttcctggga

SEQ ID NO: 475110 - DNA, 20 bp, Artificial
  CRISPR gRNA sequence
gatgttttcctgggactgat

SEQ ID NO: 475111 - DNA, 20 bp, Artificial
  CRISPR gRNA sequence
atgttttcctgggactgatc

SEQ ID NO: 475112 - DNA, 20 bp, Artificial
  CRISPR gRNA sequence
tcctgggactgatctaacac

SEQ ID NO: 475113 - DNA, 20 bp, Artificial
  CRISPR gRNA sequence
cctgggactgatctaacact

SEQ ID NO: 475114 - DNA, 20 bp, Artificial
  CRISPR gRNA sequence
ctgggactgatctaacactc

SEQ ID NO: 475115 - DNA, 20 bp, Artificial
  CRISPR gRNA sequence
ggactgatctaacactcttc

SEQ ID NO: 475116 - DNA, 20 bp, Artificial
  CRISPR gRNA sequence
atctaacactcttctggact

SEQ ID NO: 475117 - DNA, 20 bp, Artificial
  CRISPR gRNA sequence
acactcttctggactctgtt

SEQ ID NO: 475118 - DNA, 20 bp, Artificial
  CRISPR gRNA sequence
ttctggactctgttctaagt

SEQ ID NO: 475119 - DNA, 20 bp, Artificial
  CRISPR gRNA sequence
ctggactctgttctaagtga

SEQ ID NO: 475120 - DNA, 20 bp, Artificial
  CRISPR gRNA sequence
tggactctgttctaagtgaa

SEQ ID NO: 475121 - DNA, 20 bp, Artificial
  CRISPR gRNA sequence
gactctgttctaagtgaatc

SEQ ID NO: 475122 - DNA, 20 bp, Artificial
  CRISPR gRNA sequence
tgttctaagtgaatctcaaa

SEQ ID NO: 475123 - DNA, 20 bp, Artificial
  CRISPR gRNA sequence
ttctaagtgaatctcaaatt

SEQ ID NO: 475124 - DNA, 20 bp, Artificial
  CRISPR gRNA sequence
taagtgaatctcaaattgta

SEQ ID NO: 475125 - DNA, 20 bp, Artificial
  CRISPR gRNA sequence
agtgaatctcaaattgtatg

SEQ ID NO: 475126 - DNA, 20 bp, Artificial
  CRISPR gRNA sequence
aaattgtatgacacctctgc

SEQ ID NO: 475127 - DNA, 20 bp, Artificial
  CRISPR gRNA sequence
tatgacacctctgcatgcat

SEQ ID NO: 475128 - DNA, 20 bp, Artificial
  CRISPR gRNA sequence
tgcatgcatacacacagaca

SEQ ID NO: 475129 - DNA, 20 bp, Artificial
  CRISPR gRNA sequence
catgcatacacacagacaca

SEQ ID NO: 475130 - DNA, 20 bp, Artificial
  CRISPR gRNA sequence
cacacaagccacttcttcca

SEQ ID NO: 475131 - DNA, 20 bp, Artificial
  CRISPR gRNA sequence
cttccattgagataaacatg

SEQ ID NO: 475132 - DNA, 20 bp, Artificial
  CRISPR gRNA sequence
ttccattgagataaacatgt

SEQ ID NO: 475133 - DNA, 20 bp, Artificial
  CRISPR gRNA sequence
ccattgagataaacatgtaa

SEQ ID NO: 475134 - DNA, 20 bp, Artificial
  CRISPR gRNA sequence
cattgagataaacatgtaaa

SEQ ID NO: 475135 - DNA, 20 bp, Artificial
  CRISPR gRNA sequence
agataaacatgtaaatcagg

SEQ ID NO: 475136 - DNA, 20 bp, Artificial
  CRISPR gRNA sequence
agcttattttgaggtaagag

SEQ ID NO: 475137 - DNA, 20 bp, Artificial
  CRISPR gRNA sequence
attttgaggtaagagaatgg

SEQ ID NO: 475138 - DNA, 20 bp, Artificial
  CRISPR gRNA sequence
ttttgaggtaagagaatgga

SEQ ID NO: 475139 - DNA, 20 bp, Artificial
  CRISPR gRNA sequence
tgaggtaagagaatggagag

SEQ ID NO: 475140 - DNA, 20 bp, Artificial
  CRISPR gRNA sequence
gaggtaagagaatggagagt

SEQ ID NO: 475141 - DNA, 20 bp, Artificial
  CRISPR gRNA sequence
aggtaagagaatggagagta

SEQ ID NO: 475142 - DNA, 20 bp, Artificial
  CRISPR gRNA sequence
gaaaagtgaagcaaatcgca

SEQ ID NO: 475143 - DNA, 20 bp, Artificial
  CRISPR gRNA sequence
actgacacaatacaactcaa

SEQ ID NO: 475144 - DNA, 20 bp, Artificial
  CRISPR gRNA sequence
acacaatacaactcaagcgc

SEQ ID NO: 475145 - DNA, 20 bp, Artificial
  CRISPR gRNA sequence
aagcgcatgattctcaagca

SEQ ID NO: 475146 - DNA, 20 bp, Artificial
  CRISPR gRNA sequence
tcaagcactattagcttttc

SEQ ID NO: 475147 - DNA, 20 bp, Artificial
  CRISPR gRNA sequence
aagcactattagcttttctt

SEQ ID NO: 475148 - DNA, 20 bp, Artificial
  CRISPR gRNA sequence
ttagcttttcttggtgacca

SEQ ID NO: 475149 - DNA, 20 bp, Artificial
  CRISPR gRNA sequence
gcttttcttggtgaccaagg

SEQ ID NO: 475150 - DNA, 20 bp, Artificial
  CRISPR gRNA sequence
ttcttggtgaccaaggataa

SEQ ID NO: 475151 - DNA, 20 bp, Artificial
  CRISPR gRNA sequence
tcttggtgaccaaggataag

SEQ ID NO: 475152 - DNA, 20 bp, Artificial
  CRISPR gRNA sequence
cttggtgaccaaggataaga

SEQ ID NO: 475153 - DNA, 20 bp, Artificial
  CRISPR gRNA sequence
ttggtgaccaaggataagag

SEQ ID NO: 475154 - DNA, 20 bp, Artificial
  CRISPR gRNA sequence
ggtgaccaaggataagagta

SEQ ID NO: 475155 - DNA, 20 bp, Artificial
  CRISPR gRNA sequence
gtgaccaaggataagagtag

SEQ ID NO: 475156 - DNA, 20 bp, Artificial
  CRISPR gRNA sequence
ttggcatttttctcacaaag

SEQ ID NO: 475157 - DNA, 20 bp, Artificial
  CRISPR gRNA sequence
tggcatttttctcacaaagt

SEQ ID NO: 475158 - DNA, 20 bp, Artificial
  CRISPR gRNA sequence
ggcatttttctcacaaagtc

SEQ ID NO: 475159 - DNA, 20 bp, Artificial
  CRISPR gRNA sequence
gcatttttctcacaaagtct

SEQ ID NO: 475160 - DNA, 20 bp, Artificial
  CRISPR gRNA sequence
ttctcacaaagtcttcatga

SEQ ID NO: 475161 - DNA, 20 bp, Artificial
  CRISPR gRNA sequence
tctcacaaagtcttcatgac

SEQ ID NO: 475162 - DNA, 20 bp, Artificial
  CRISPR gRNA sequence
ctcacaaagtcttcatgaca

SEQ ID NO: 475163 - DNA, 20 bp, Artificial
  CRISPR gRNA sequence
tcacaaagtcttcatgacat

SEQ ID NO: 475164 - DNA, 20 bp, Artificial
  CRISPR gRNA sequence
acaaagtcttcatgacataa

SEQ ID NO: 475165 - DNA, 20 bp, Artificial
  CRISPR gRNA sequence
catgacataaatgccaaaag

SEQ ID NO: 475166 - DNA, 20 bp, Artificial
  CRISPR gRNA sequence
atgacataaatgccaaaagc

SEQ ID NO: 475167 - DNA, 20 bp, Artificial
  CRISPR gRNA sequence
caacaaactgaagaacttct

SEQ ID NO: 475168 - DNA, 20 bp, Artificial
  CRISPR gRNA sequence
aagaacttctgcacagcaaa

SEQ ID NO: 475169 - DNA, 20 bp, Artificial
  CRISPR gRNA sequence
ctgcacagcaaaagaaactc

SEQ ID NO: 475170 - DNA, 20 bp, Artificial
  CRISPR gRNA sequence
tgcacagcaaaagaaactct

SEQ ID NO: 475171 - DNA, 20 bp, Artificial
  CRISPR gRNA sequence
cacagcaaaagaaactctca

SEQ ID NO: 475172 - DNA, 20 bp, Artificial
  CRISPR gRNA sequence
tcatcagagcaaaaaggcaa

SEQ ID NO: 475173 - DNA, 20 bp, Artificial
  CRISPR gRNA sequence
atcagagcaaaaaggcaacc

SEQ ID NO: 475174 - DNA, 20 bp, Artificial
  CRISPR gRNA sequence
cagaatgggagaaaattttt

SEQ ID NO: 475175 - DNA, 20 bp, Artificial
  CRISPR gRNA sequence
ttgcaatctacccatctgaa

SEQ ID NO: 475176 - DNA, 20 bp, Artificial
  CRISPR gRNA sequence
tgcaatctacccatctgaaa

SEQ ID NO: 475177 - DNA, 20 bp, Artificial
  CRISPR gRNA sequence
gcaatctacccatctgaaaa

SEQ ID NO: 475178 - DNA, 20 bp, Artificial
  CRISPR gRNA sequence
caatctacccatctgaaaaa

SEQ ID NO: 475179 - DNA, 20 bp, Artificial
  CRISPR gRNA sequence
cccatctgaaaaaggcctaa

SEQ ID NO: 475180 - DNA, 20 bp, Artificial
  CRISPR gRNA sequence
aaaaaggcctaatatccaga

SEQ ID NO: 475181 - DNA, 20 bp, Artificial
  CRISPR gRNA sequence
atatccagaatttacaagaa

SEQ ID NO: 475182 - DNA, 20 bp, Artificial
  CRISPR gRNA sequence
acaagaaacttaaataagtt

SEQ ID NO: 475183 - DNA, 20 bp, Artificial
  CRISPR gRNA sequence
caagaaacttaaataagttt

SEQ ID NO: 475184 - DNA, 20 bp, Artificial
  CRISPR gRNA sequence
aaataagtttacaagaaaaa

SEQ ID NO: 475185 - DNA, 20 bp, Artificial
  CRISPR gRNA sequence
aataagtttacaagaaaaaa

SEQ ID NO: 475186 - DNA, 20 bp, Artificial
  CRISPR gRNA sequence
acaagaaaaaaacaaacaac

SEQ ID NO: 475187 - DNA, 20 bp, Artificial
  CRISPR gRNA sequence
caagaaaaaaacaaacaacc

SEQ ID NO: 475188 - DNA, 20 bp, Artificial
  CRISPR gRNA sequence
tctctgtttttttttggaga

SEQ ID NO: 475189 - DNA, 20 bp, Artificial
  CRISPR gRNA sequence
tctgtttttttttggagaca

SEQ ID NO: 475190 - DNA, 20 bp, Artificial
  CRISPR gRNA sequence
tgtttttttttggagacaga

SEQ ID NO: 475191 - DNA, 20 bp, Artificial
  CRISPR gRNA sequence
tttttttttggagacagagt

SEQ ID NO: 475192 - DNA, 20 bp, Artificial
  CRISPR gRNA sequence
ttttttggagacagagtctc

SEQ ID NO: 475193 - DNA, 20 bp, Artificial
  CRISPR gRNA sequence
tttttggagacagagtctca

SEQ ID NO: 475194 - DNA, 20 bp, Artificial
  CRISPR gRNA sequence
ttttggagacagagtctcac

SEQ ID NO: 475195 - DNA, 20 bp, Artificial
  CRISPR gRNA sequence
tttggagacagagtctcact

SEQ ID NO: 475196 - DNA, 20 bp, Artificial
  CRISPR gRNA sequence
ttggagacagagtctcactc

SEQ ID NO: 475197 - DNA, 20 bp, Artificial
  CRISPR gRNA sequence
tggagacagagtctcactct

SEQ ID NO: 475198 - DNA, 20 bp, Artificial
  CRISPR gRNA sequence
ggagacagagtctcactctg

SEQ ID NO: 475199 - DNA, 20 bp, Artificial
  CRISPR gRNA sequence
gagacagagtctcactctgt

SEQ ID NO: 475200 - DNA, 20 bp, Artificial
  CRISPR gRNA sequence
actctgttacccagctggag

SEQ ID NO: 475201 - DNA, 20 bp, Artificial
  CRISPR gRNA sequence
tgttacccagctggagtgca

SEQ ID NO: 475202 - DNA, 20 bp, Artificial
  CRISPR gRNA sequence
ttacccagctggagtgcagt

SEQ ID NO: 475203 - DNA, 20 bp, Artificial
  CRISPR gRNA sequence
cccagctggagtgcagtggt

SEQ ID NO: 475204 - DNA, 20 bp, Artificial
  CRISPR gRNA sequence
gagtgcagtggtgcaacctg

SEQ ID NO: 475205 - DNA, 20 bp, Artificial
  CRISPR gRNA sequence
gctcactgcaacttcagtct

SEQ ID NO: 475206 - DNA, 20 bp, Artificial
  CRISPR gRNA sequence
actgcaacttcagtctcctg

SEQ ID NO: 475207 - DNA, 20 bp, Artificial
  CRISPR gRNA sequence
caacttcagtctcctgggtt

SEQ ID NO: 475208 - DNA, 20 bp, Artificial
  CRISPR gRNA sequence
cagtctcctgggttcaagca

SEQ ID NO: 475209 - DNA, 20 bp, Artificial
  CRISPR gRNA sequence
agtctcctgggttcaagcaa

SEQ ID NO: 475210 - DNA, 20 bp, Artificial
  CRISPR gRNA sequence
ctgggttcaagcaattctgc

SEQ ID NO: 475211 - DNA, 20 bp, Artificial
  CRISPR gRNA sequence
ggttcaagcaattctgcctc

SEQ ID NO: 475212 - DNA, 20 bp, Artificial
  CRISPR gRNA sequence
aagcaattctgcctcagcct

SEQ ID NO: 475213 - DNA, 20 bp, Artificial
  CRISPR gRNA sequence
tgcctcagcctcccaagtag

SEQ ID NO: 475214 - DNA, 20 bp, Artificial
  CRISPR gRNA sequence
cctcagcctcccaagtagct

SEQ ID NO: 475215 - DNA, 20 bp, Artificial
  CRISPR gRNA sequence
agcctcccaagtagctggtc

SEQ ID NO: 475216 - DNA, 20 bp, Artificial
  CRISPR gRNA sequence
ccaagtagctggtcttacag

SEQ ID NO: 475217 - DNA, 20 bp, Artificial
  CRISPR gRNA sequence
gtcttacaggcgtgtcccac

SEQ ID NO: 475218 - DNA, 20 bp, Artificial
  CRISPR gRNA sequence
acaggcgtgtcccaccacgc

SEQ ID NO: 475219 - DNA, 20 bp, Artificial
  CRISPR gRNA sequence
caggcgtgtcccaccacgcc

SEQ ID NO: 475220 - DNA, 20 bp, Artificial
  CRISPR gRNA sequence
atttttgtatttttagtaca

SEQ ID NO: 475221 - DNA, 20 bp, Artificial
  CRISPR gRNA sequence
ttgtatttttagtacagaca

SEQ ID NO: 475222 - DNA, 20 bp, Artificial
  CRISPR gRNA sequence
tgtatttttagtacagacag

SEQ ID NO: 475223 - DNA, 20 bp, Artificial
  CRISPR gRNA sequence
gtatttttagtacagacagg

SEQ ID NO: 475224 - DNA, 20 bp, Artificial
  CRISPR gRNA sequence
tatttttagtacagacaggg

SEQ ID NO: 475225 - DNA, 20 bp, Artificial
  CRISPR gRNA sequence
ttagtacagacagggtttca

SEQ ID NO: 475226 - DNA, 20 bp, Artificial
  CRISPR gRNA sequence
tagtacagacagggtttcac

SEQ ID NO: 475227 - DNA, 20 bp, Artificial
  CRISPR gRNA sequence
agtacagacagggtttcact

SEQ ID NO: 475228 - DNA, 20 bp, Artificial
  CRISPR gRNA sequence
gtacagacagggtttcacta

SEQ ID NO: 475229 - DNA, 20 bp, Artificial
  CRISPR gRNA sequence
cactatgctggccagactgc

SEQ ID NO: 475230 - DNA, 20 bp, Artificial
  CRISPR gRNA sequence
actatgctggccagactgct

SEQ ID NO: 475231 - DNA, 20 bp, Artificial
  CRISPR gRNA sequence
tgctggccagactgctcttg

SEQ ID NO: 475232 - DNA, 20 bp, Artificial
  CRISPR gRNA sequence
gccagactgctcttgaactc

SEQ ID NO: 475233 - DNA, 20 bp, Artificial
  CRISPR gRNA sequence
ctcttgaactcctgacctca

SEQ ID NO: 475234 - DNA, 20 bp, Artificial
  CRISPR gRNA sequence
ttgaactcctgacctcaaat

SEQ ID NO: 475235 - DNA, 20 bp, Artificial
  CRISPR gRNA sequence
gaactcctgacctcaaatga

SEQ ID NO: 475236 - DNA, 20 bp, Artificial
  CRISPR gRNA sequence
aactcctgacctcaaatgac

SEQ ID NO: 475237 - DNA, 20 bp, Artificial
  CRISPR gRNA sequence
ctgacctcaaatgacccgcc

SEQ ID NO: 475238 - DNA, 20 bp, Artificial
  CRISPR gRNA sequence
acctcaaatgacccgccctc

SEQ ID NO: 475239 - DNA, 20 bp, Artificial
  CRISPR gRNA sequence
aaatgacccgccctcctcag

SEQ ID NO: 475240 - DNA, 20 bp, Artificial
  CRISPR gRNA sequence
ctcagcttcctgaagtgctg

SEQ ID NO: 475241 - DNA, 20 bp, Artificial
  CRISPR gRNA sequence
agcttcctgaagtgctggga

SEQ ID NO: 475242 - DNA, 20 bp, Artificial
  CRISPR gRNA sequence
cctgaagtgctgggattaca

SEQ ID NO: 475243 - DNA, 20 bp, Artificial
  CRISPR gRNA sequence
ctgaagtgctgggattacag

SEQ ID NO: 475244 - DNA, 20 bp, Artificial
  CRISPR gRNA sequence
aagtgctgggattacaggcg

SEQ ID NO: 475245 - DNA, 20 bp, Artificial
  CRISPR gRNA sequence
ggattacaggcgagagccac

SEQ ID NO: 475246 - DNA, 20 bp, Artificial
  CRISPR gRNA sequence
caggcgagagccactacacc

SEQ ID NO: 475247 - DNA, 20 bp, Artificial
  CRISPR gRNA sequence
cacccagcctaaacagacac

SEQ ID NO: 475248 - DNA, 20 bp, Artificial
  CRISPR gRNA sequence
aacagacacttctcaaaaga

SEQ ID NO: 475249 - DNA, 20 bp, Artificial
  CRISPR gRNA sequence
ctcaaaagaagacactggct

SEQ ID NO: 475250 - DNA, 20 bp, Artificial
  CRISPR gRNA sequence
tcaaaagaagacactggctg

SEQ ID NO: 475251 - DNA, 20 bp, Artificial
  CRISPR gRNA sequence
aaaagaagacactggctggg

SEQ ID NO: 475252 - DNA, 20 bp, Artificial
  CRISPR gRNA sequence
gctgggcgcggtggctcacg

SEQ ID NO: 475253 - DNA, 20 bp, Artificial
  CRISPR gRNA sequence
ggcgcggtggctcacgcctg

SEQ ID NO: 475254 - DNA, 20 bp, Artificial
  CRISPR gRNA sequence
acgcctgtaatcccagcact

SEQ ID NO: 475255 - DNA, 20 bp, Artificial
  CRISPR gRNA sequence
taatcccagcactttgggag

SEQ ID NO: 475256 - DNA, 20 bp, Artificial
  CRISPR gRNA sequence
tgggaggccgagacaggtgg

SEQ ID NO: 475257 - DNA, 20 bp, Artificial
  CRISPR gRNA sequence
gggaggccgagacaggtgga

SEQ ID NO: 475258 - DNA, 20 bp, Artificial
  CRISPR gRNA sequence
ggaggccgagacaggtggat

SEQ ID NO: 475259 - DNA, 20 bp, Artificial
  CRISPR gRNA sequence
actaacacggtgaaaccttc

SEQ ID NO: 475260 - DNA, 20 bp, Artificial
  CRISPR gRNA sequence
acacggtgaaaccttctgta

SEQ ID NO: 475261 - DNA, 20 bp, Artificial
  CRISPR gRNA sequence
ctgtactaaaaatacaaaaa

SEQ ID NO: 475262 - DNA, 20 bp, Artificial
  CRISPR gRNA sequence
tgtactaaaaatacaaaaaa

SEQ ID NO: 475263 - DNA, 20 bp, Artificial
  CRISPR gRNA sequence
tactaaaaatacaaaaaatt

SEQ ID NO: 475264 - DNA, 20 bp, Artificial
  CRISPR gRNA sequence
aaaatacaaaaaattagcca

SEQ ID NO: 475265 - DNA, 20 bp, Artificial
  CRISPR gRNA sequence
gccaggcgtggtggcagccg

SEQ ID NO: 475266 - DNA, 20 bp, Artificial
  CRISPR gRNA sequence
tagtcccagctactcgggag

SEQ ID NO: 475267 - DNA, 20 bp, Artificial
  CRISPR gRNA sequence
ctcgggaggctgagttagga

SEQ ID NO: 475268 - DNA, 20 bp, Artificial
  CRISPR gRNA sequence
gggaggctgagttaggagaa

SEQ ID NO: 475269 - DNA, 20 bp, Artificial
  CRISPR gRNA sequence
agttaggagaatggcatgag

SEQ ID NO: 475270 - DNA, 20 bp, Artificial
  CRISPR gRNA sequence
ggagaatggcatgagcccgg

SEQ ID NO: 475271 - DNA, 20 bp, Artificial
  CRISPR gRNA sequence
gcagtgagcggagattgcgc

SEQ ID NO: 475272 - DNA, 20 bp, Artificial
  CRISPR gRNA sequence
cagtgagcggagattgcgcc

SEQ ID NO: 475273 - DNA, 20 bp, Artificial
  CRISPR gRNA sequence
cgccactgcactccagcctg

SEQ ID NO: 475274 - DNA, 20 bp, Artificial
  CRISPR gRNA sequence
cactccagcctgggcgacag

SEQ ID NO: 475275 - DNA, 20 bp, Artificial
  CRISPR gRNA sequence
cagcctgggcgacagagcga

SEQ ID NO: 475276 - DNA, 20 bp, Artificial
  CRISPR gRNA sequence
ggcgacagagcgacactcta

SEQ ID NO: 475277 - DNA, 20 bp, Artificial
  CRISPR gRNA sequence
tatctcaaaaaaaaaaagaa

SEQ ID NO: 475278 - DNA, 20 bp, Artificial
  CRISPR gRNA sequence
tctcaaaaaaaaaaagaaga

SEQ ID NO: 475279 - DNA, 20 bp, Artificial
  CRISPR gRNA sequence
aaaaaaaaaaagaagacatt

SEQ ID NO: 475280 - DNA, 20 bp, Artificial
  CRISPR gRNA sequence
atgccaccaacaaacataag

SEQ ID NO: 475281 - DNA, 20 bp, Artificial
  CRISPR gRNA sequence
tgccaccaacaaacataaga

SEQ ID NO: 475282 - DNA, 20 bp, Artificial
  CRISPR gRNA sequence
aacatcactgatggtcagag

SEQ ID NO: 475283 - DNA, 20 bp, Artificial
  CRISPR gRNA sequence
atggtcagagaaatgtaaat

SEQ ID NO: 475284 - DNA, 20 bp, Artificial
  CRISPR gRNA sequence
acgccagtcagaatggtgat

SEQ ID NO: 475285 - DNA, 20 bp, Artificial
  CRISPR gRNA sequence
ttaaaaagtcaggaaacaat

SEQ ID NO: 475286 - DNA, 20 bp, Artificial
  CRISPR gRNA sequence
aaaagtcaggaaacaatagg

SEQ ID NO: 475287 - DNA, 20 bp, Artificial
  CRISPR gRNA sequence
gcaagtctgtggagaattag

SEQ ID NO: 475288 - DNA, 20 bp, Artificial
  CRISPR gRNA sequence
tggagaattaggaatgcttt

SEQ ID NO: 475289 - DNA, 20 bp, Artificial
  CRISPR gRNA sequence
ggaatgcttttacacggttg

SEQ ID NO: 475290 - DNA, 20 bp, Artificial
  CRISPR gRNA sequence
ttacacggttggtgggagtg

SEQ ID NO: 475291 - DNA, 20 bp, Artificial
  CRISPR gRNA sequence
tacacggttggtgggagtgt

SEQ ID NO: 475292 - DNA, 20 bp, Artificial
  CRISPR gRNA sequence
acacggttggtgggagtgta

SEQ ID NO: 475293 - DNA, 20 bp, Artificial
  CRISPR gRNA sequence
cacggttggtgggagtgtaa

SEQ ID NO: 475294 - DNA, 20 bp, Artificial
  CRISPR gRNA sequence
gtgggagtgtaaattagttc

SEQ ID NO: 475295 - DNA, 20 bp, Artificial
  CRISPR gRNA sequence
gttcaaccattgtggaagac

SEQ ID NO: 475296 - DNA, 20 bp, Artificial
  CRISPR gRNA sequence
aaccattgtggaagacagta

SEQ ID NO: 475297 - DNA, 20 bp, Artificial
  CRISPR gRNA sequence
tggaagacagtatggcaatt

SEQ ID NO: 475298 - DNA, 20 bp, Artificial
  CRISPR gRNA sequence
ctcgatctagaaccagaaat

SEQ ID NO: 475299 - DNA, 20 bp, Artificial
  CRISPR gRNA sequence
gatctagaaccagaaatacc

SEQ ID NO: 475300 - DNA, 20 bp, Artificial
  CRISPR gRNA sequence
gaaccagaaataccatttga

SEQ ID NO: 475301 - DNA, 20 bp, Artificial
  CRISPR gRNA sequence
gacccagcaatcccgttact

SEQ ID NO: 475302 - DNA, 20 bp, Artificial
  CRISPR gRNA sequence
acccagcaatcccgttactg

SEQ ID NO: 475303 - DNA, 20 bp, Artificial
  CRISPR gRNA sequence
ctgggtatatactcaaagga

SEQ ID NO: 475304 - DNA, 20 bp, Artificial
  CRISPR gRNA sequence
ggtatatactcaaaggaata

SEQ ID NO: 475305 - DNA, 20 bp, Artificial
  CRISPR gRNA sequence
aaaggaatataaatcattct

SEQ ID NO: 475306 - DNA, 20 bp, Artificial
  CRISPR gRNA sequence
tactataaagacacatgcac

SEQ ID NO: 475307 - DNA, 20 bp, Artificial
  CRISPR gRNA sequence
ctataaagacacatgcacac

SEQ ID NO: 475308 - DNA, 20 bp, Artificial
  CRISPR gRNA sequence
taaagacacatgcacacgta

SEQ ID NO: 475309 - DNA, 20 bp, Artificial
  CRISPR gRNA sequence
attgcagcactatttacaat

SEQ ID NO: 475310 - DNA, 20 bp, Artificial
  CRISPR gRNA sequence
ttgcagcactatttacaata

SEQ ID NO: 475311 - DNA, 20 bp, Artificial
  CRISPR gRNA sequence
cagcactatttacaatagca

SEQ ID NO: 475312 - DNA, 20 bp, Artificial
  CRISPR gRNA sequence
tttacaatagcaaagacacg

SEQ ID NO: 475313 - DNA, 20 bp, Artificial
  CRISPR gRNA sequence
acaatagcaaagacacggaa

SEQ ID NO: 475314 - DNA, 20 bp, Artificial
  CRISPR gRNA sequence
caatagcaaagacacggaac

SEQ ID NO: 475315 - DNA, 20 bp, Artificial
  CRISPR gRNA sequence
gaaaaagaaaatatggtaca

SEQ ID NO: 475316 - DNA, 20 bp, Artificial
  CRISPR gRNA sequence
tgcagccataaaaaagaatg

SEQ ID NO: 475317 - DNA, 20 bp, Artificial
  CRISPR gRNA sequence
tgcagggacatggatgaagc

SEQ ID NO: 475318 - DNA, 20 bp, Artificial
  CRISPR gRNA sequence
gcagggacatggatgaagct

SEQ ID NO: 475319 - DNA, 20 bp, Artificial
  CRISPR gRNA sequence
cagggacatggatgaagctg

SEQ ID NO: 475320 - DNA, 20 bp, Artificial
  CRISPR gRNA sequence
gaagccatcatcctaagcaa

SEQ ID NO: 475321 - DNA, 20 bp, Artificial
  CRISPR gRNA sequence
agcaaactaacacaggaaca

SEQ ID NO: 475322 - DNA, 20 bp, Artificial
  CRISPR gRNA sequence
acacaggaacagaaaaccaa

SEQ ID NO: 475323 - DNA, 20 bp, Artificial
  CRISPR gRNA sequence
catgttctcactcataagtg

SEQ ID NO: 475324 - DNA, 20 bp, Artificial
  CRISPR gRNA sequence
tcactcataagtggaagttg

SEQ ID NO: 475325 - DNA, 20 bp, Artificial
  CRISPR gRNA sequence
actcataagtggaagttgaa

SEQ ID NO: 475326 - DNA, 20 bp, Artificial
  CRISPR gRNA sequence
ataagtggaagttgaaaatg

SEQ ID NO: 475327 - DNA, 20 bp, Artificial
  CRISPR gRNA sequence
aaaatgagaatatatggaca

SEQ ID NO: 475328 - DNA, 20 bp, Artificial
  CRISPR gRNA sequence
ttggggagtagggggagagg

SEQ ID NO: 475329 - DNA, 20 bp, Artificial
  CRISPR gRNA sequence
gggagtagggggagaggaga

SEQ ID NO: 475330 - DNA, 20 bp, Artificial
  CRISPR gRNA sequence
agaggatgggtcaataggtt

SEQ ID NO: 475331 - DNA, 20 bp, Artificial
  CRISPR gRNA sequence
gaggatgggtcaataggtta

SEQ ID NO: 475332 - DNA, 20 bp, Artificial
  CRISPR gRNA sequence
agcaaaccatcatggcacac

SEQ ID NO: 475333 - DNA, 20 bp, Artificial
  CRISPR gRNA sequence
tgtaacaaacctgtacattt

SEQ ID NO: 475334 - DNA, 20 bp, Artificial
  CRISPR gRNA sequence
tacatttctgcacatgtatc

SEQ ID NO: 475335 - DNA, 20 bp, Artificial
  CRISPR gRNA sequence
ctgcacatgtatcctgtttt

SEQ ID NO: 475336 - DNA, 20 bp, Artificial
  CRISPR gRNA sequence
tgcacatgtatcctgttttc

SEQ ID NO: 475337 - DNA, 20 bp, Artificial
  CRISPR gRNA sequence
cacatgtatcctgttttcct

SEQ ID NO: 475338 - DNA, 20 bp, Artificial
  CRISPR gRNA sequence
ttttccttttttagaagaaa

SEQ ID NO: 475339 - DNA, 20 bp, Artificial
  CRISPR gRNA sequence
tccttttttagaagaaataa

SEQ ID NO: 475340 - DNA, 20 bp, Artificial
  CRISPR gRNA sequence
ccttttttagaagaaataaa

SEQ ID NO: 475341 - DNA, 20 bp, Artificial
  CRISPR gRNA sequence
cttttttagaagaaataaag

SEQ ID NO: 475342 - DNA, 20 bp, Artificial
  CRISPR gRNA sequence
ttttagaagaaataaagaaa

SEQ ID NO: 475343 - DNA, 20 bp, Artificial
  CRISPR gRNA sequence
tttagaagaaataaagaaaa

SEQ ID NO: 475344 - DNA, 20 bp, Artificial
  CRISPR gRNA sequence
ttagaagaaataaagaaaaa

SEQ ID NO: 475345 - DNA, 20 bp, Artificial
  CRISPR gRNA sequence
tagaagaaataaagaaaaaa

SEQ ID NO: 475346 - DNA, 20 bp, Artificial
  CRISPR gRNA sequence
agaagaaataaagaaaaaaa

SEQ ID NO: 475347 - DNA, 20 bp, Artificial
  CRISPR gRNA sequence
gaagaaataaagaaaaaaaa

SEQ ID NO: 475348 - DNA, 20 bp, Artificial
  CRISPR gRNA sequence
atagaagacttttgtgaact

SEQ ID NO: 475349 - DNA, 20 bp, Artificial
  CRISPR gRNA sequence
tagaagacttttgtgaactc

SEQ ID NO: 475350 - DNA, 20 bp, Artificial
  CRISPR gRNA sequence
ttgtgaactccaaattttta

SEQ ID NO: 475351 - DNA, 20 bp, Artificial
  CRISPR gRNA sequence
tgtgaactccaaatttttat

SEQ ID NO: 475352 - DNA, 20 bp, Artificial
  CRISPR gRNA sequence
gtgaactccaaatttttatt

SEQ ID NO: 475353 - DNA, 20 bp, Artificial
  CRISPR gRNA sequence
tgaactccaaatttttattt

SEQ ID NO: 475354 - DNA, 20 bp, Artificial
  CRISPR gRNA sequence
caaatttttatttgtggttg

SEQ ID NO: 475355 - DNA, 20 bp, Artificial
  CRISPR gRNA sequence
ttatttgtggttgattccca

SEQ ID NO: 475356 - DNA, 20 bp, Artificial
  CRISPR gRNA sequence
tatttgtggttgattcccaa

SEQ ID NO: 475357 - DNA, 20 bp, Artificial
  CRISPR gRNA sequence
atttgtggttgattcccaat

SEQ ID NO: 475358 - DNA, 20 bp, Artificial
  CRISPR gRNA sequence
tttgtggttgattcccaatt

SEQ ID NO: 475359 - DNA, 20 bp, Artificial
  CRISPR gRNA sequence
gtggttgattcccaattgtc

SEQ ID NO: 475360 - DNA, 20 bp, Artificial
  CRISPR gRNA sequence
tggttgattcccaattgtca

SEQ ID NO: 475361 - DNA, 20 bp, Artificial
  CRISPR gRNA sequence
attcccaattgtcacccaat

SEQ ID NO: 475362 - DNA, 20 bp, Artificial
  CRISPR gRNA sequence
ccaattgtcacccaatgtta

SEQ ID NO: 475363 - DNA, 20 bp, Artificial
  CRISPR gRNA sequence
tcacccaatgttactttaac

SEQ ID NO: 475364 - DNA, 20 bp, Artificial
  CRISPR gRNA sequence
ctttaacaggactattaaac

SEQ ID NO: 475365 - DNA, 20 bp, Artificial
  CRISPR gRNA sequence
taacaggactattaaactaa

SEQ ID NO: 475366 - DNA, 20 bp, Artificial
  CRISPR gRNA sequence
aacaggactattaaactaat

SEQ ID NO: 475367 - DNA, 20 bp, Artificial
  CRISPR gRNA sequence
acaggactattaaactaatg

SEQ ID NO: 475368 - DNA, 20 bp, Artificial
  CRISPR gRNA sequence
ttaaactaatgaaatgttgg

SEQ ID NO: 475369 - DNA, 20 bp, Artificial
  CRISPR gRNA sequence
aactaatgaaatgttggact

SEQ ID NO: 475370 - DNA, 20 bp, Artificial
  CRISPR gRNA sequence
atgaaatgttggactaaaag

SEQ ID NO: 475371 - DNA, 20 bp, Artificial
  CRISPR gRNA sequence
gactaaaagaaaaaaaatta

SEQ ID NO: 475372 - DNA, 20 bp, Artificial
  CRISPR gRNA sequence
aaagaaaaaaaattagctaa

SEQ ID NO: 475373 - DNA, 20 bp, Artificial
  CRISPR gRNA sequence
gctaaatatacacagcactg

SEQ ID NO: 475374 - DNA, 20 bp, Artificial
  CRISPR gRNA sequence
aatatacacagcactgaatg

SEQ ID NO: 475375 - DNA, 20 bp, Artificial
  CRISPR gRNA sequence
aatggcatgccatgcactat

SEQ ID NO: 475376 - DNA, 20 bp, Artificial
  CRISPR gRNA sequence
ttctaagtgttttacagaat

SEQ ID NO: 475377 - DNA, 20 bp, Artificial
  CRISPR gRNA sequence
taagtgttttacagaattaa

SEQ ID NO: 475378 - DNA, 20 bp, Artificial
  CRISPR gRNA sequence
agtgttttacagaattaatt

SEQ ID NO: 475379 - DNA, 20 bp, Artificial
  CRISPR gRNA sequence
tacagaattaattcacttaa

SEQ ID NO: 475380 - DNA, 20 bp, Artificial
  CRISPR gRNA sequence
acagaattaattcacttaat

SEQ ID NO: 475381 - DNA, 20 bp, Artificial
  CRISPR gRNA sequence
cagaattaattcacttaata

SEQ ID NO: 475382 - DNA, 20 bp, Artificial
  CRISPR gRNA sequence
attcacttaatagtcacaac

SEQ ID NO: 475383 - DNA, 20 bp, Artificial
  CRISPR gRNA sequence
acttaatagtcacaacaacc

SEQ ID NO: 475384 - DNA, 20 bp, Artificial
  CRISPR gRNA sequence
aatagtcacaacaaccttat

SEQ ID NO: 475385 - DNA, 20 bp, Artificial
  CRISPR gRNA sequence
atagtcacaacaaccttata

SEQ ID NO: 475386 - DNA, 20 bp, Artificial
  CRISPR gRNA sequence
ataagattattctcccattt

SEQ ID NO: 475387 - DNA, 20 bp, Artificial
  CRISPR gRNA sequence
taagattattctcccatttt

SEQ ID NO: 475388 - DNA, 20 bp, Artificial
  CRISPR gRNA sequence
ttctcccatttttttagatg

SEQ ID NO: 475389 - DNA, 20 bp, Artificial
  CRISPR gRNA sequence
tcccatttttttagatgaga

SEQ ID NO: 475390 - DNA, 20 bp, Artificial
  CRISPR gRNA sequence
ccatttttttagatgagaaa

SEQ ID NO: 475391 - DNA, 20 bp, Artificial
  CRISPR gRNA sequence
ttttagatgagaaaactgag

SEQ ID NO: 475392 - DNA, 20 bp, Artificial
  CRISPR gRNA sequence
tttagatgagaaaactgaga

SEQ ID NO: 475393 - DNA, 20 bp, Artificial
  CRISPR gRNA sequence
ttagatgagaaaactgagaa

SEQ ID NO: 475394 - DNA, 20 bp, Artificial
  CRISPR gRNA sequence
tagatgagaaaactgagaac

SEQ ID NO: 475395 - DNA, 20 bp, Artificial
  CRISPR gRNA sequence
agatgagaaaactgagaacc

SEQ ID NO: 475396 - DNA, 20 bp, Artificial
  CRISPR gRNA sequence
gatgagaaaactgagaacca

SEQ ID NO: 475397 - DNA, 20 bp, Artificial
  CRISPR gRNA sequence
agaaccagagattttatagt

SEQ ID NO: 475398 - DNA, 20 bp, Artificial
  CRISPR gRNA sequence
tatagtcacaaaaccattaa

SEQ ID NO: 475399 - DNA, 20 bp, Artificial
  CRISPR gRNA sequence
atagtcacaaaaccattaaa

SEQ ID NO: 475400 - DNA, 20 bp, Artificial
  CRISPR gRNA sequence
tagtcacaaaaccattaaat

SEQ ID NO: 475401 - DNA, 20 bp, Artificial
  CRISPR gRNA sequence
aatggcagacataggatact

SEQ ID NO: 475402 - DNA, 20 bp, Artificial
  CRISPR gRNA sequence
atccatggagtctggcttta

SEQ ID NO: 475403 - DNA, 20 bp, Artificial
  CRISPR gRNA sequence
gctttagagtccctgatctt

SEQ ID NO: 475404 - DNA, 20 bp, Artificial
  CRISPR gRNA sequence
tagagtccctgatcttagcc

SEQ ID NO: 475405 - DNA, 20 bp, Artificial
  CRISPR gRNA sequence
agagtccctgatcttagcca

SEQ ID NO: 475406 - DNA, 20 bp, Artificial
  CRISPR gRNA sequence
gagtccctgatcttagccac

SEQ ID NO: 475407 - DNA, 20 bp, Artificial
  CRISPR gRNA sequence
atcttagccactataccaca

SEQ ID NO: 475408 - DNA, 20 bp, Artificial
  CRISPR gRNA sequence
agccactataccacacagct

SEQ ID NO: 475409 - DNA, 20 bp, Artificial
  CRISPR gRNA sequence
gccactataccacacagctt

SEQ ID NO: 475410 - DNA, 20 bp, Artificial
  CRISPR gRNA sequence
taccacacagcttctccaag

SEQ ID NO: 475411 - DNA, 20 bp, Artificial
  CRISPR gRNA sequence
ctccaaggaaaaaagaaaat

SEQ ID NO: 475412 - DNA, 20 bp, Artificial
  CRISPR gRNA sequence
tccaaggaaaaaagaaaatg

SEQ ID NO: 475413 - DNA, 20 bp, Artificial
  CRISPR gRNA sequence
caaggaaaaaagaaaatgat

SEQ ID NO: 475414 - DNA, 20 bp, Artificial
  CRISPR gRNA sequence
ttttttggacctgattacaa

SEQ ID NO: 475415 - DNA, 20 bp, Artificial
  CRISPR gRNA sequence
tttggacctgattacaaatg

SEQ ID NO: 475416 - DNA, 20 bp, Artificial
  CRISPR gRNA sequence
ttggacctgattacaaatgc

SEQ ID NO: 475417 - DNA, 20 bp, Artificial
  CRISPR gRNA sequence
tggacctgattacaaatgcc

SEQ ID NO: 475418 - DNA, 20 bp, Artificial
  CRISPR gRNA sequence
ggacctgattacaaatgcct

SEQ ID NO: 475419 - DNA, 20 bp, Artificial
  CRISPR gRNA sequence
gacctgattacaaatgcctg

SEQ ID NO: 475420 - DNA, 20 bp, Artificial
  CRISPR gRNA sequence
attacaaatgcctgtaaata

SEQ ID NO: 475421 - DNA, 20 bp, Artificial
  CRISPR gRNA sequence
caaatgcctgtaaatatttt

SEQ ID NO: 475422 - DNA, 20 bp, Artificial
  CRISPR gRNA sequence
taaatatttttcttttaaca

SEQ ID NO: 475423 - DNA, 20 bp, Artificial
  CRISPR gRNA sequence
ttcttttaacaattctgaac

SEQ ID NO: 475424 - DNA, 20 bp, Artificial
  CRISPR gRNA sequence
tcttttaacaattctgaact

SEQ ID NO: 475425 - DNA, 20 bp, Artificial
  CRISPR gRNA sequence
cttttaacaattctgaactc

SEQ ID NO: 475426 - DNA, 20 bp, Artificial
  CRISPR gRNA sequence
ttttaacaattctgaactct

SEQ ID NO: 475427 - DNA, 20 bp, Artificial
  CRISPR gRNA sequence
ttaacaattctgaactctac

SEQ ID NO: 475428 - DNA, 20 bp, Artificial
  CRISPR gRNA sequence
taacaattctgaactctaca

SEQ ID NO: 475429 - DNA, 20 bp, Artificial
  CRISPR gRNA sequence
aacaattctgaactctacat

SEQ ID NO: 475430 - DNA, 20 bp, Artificial
  CRISPR gRNA sequence
acaattctgaactctacata

SEQ ID NO: 475431 - DNA, 20 bp, Artificial
  CRISPR gRNA sequence
tgaactctacataaagatga

SEQ ID NO: 475432 - DNA, 20 bp, Artificial
  CRISPR gRNA sequence
aactctacataaagatgaaa

SEQ ID NO: 475433 - DNA, 20 bp, Artificial
  CRISPR gRNA sequence
tacataaagatgaaactcac

SEQ ID NO: 475434 - DNA, 20 bp, Artificial
  CRISPR gRNA sequence
cataaagatgaaactcacaa

SEQ ID NO: 475435 - DNA, 20 bp, Artificial
  CRISPR gRNA sequence
acaaataatggaaattaagt

SEQ ID NO: 475436 - DNA, 20 bp, Artificial
  CRISPR gRNA sequence
agtaggaaagtcccaatgag

SEQ ID NO: 475437 - DNA, 20 bp, Artificial
  CRISPR gRNA sequence
tgacgtcaactttacaatag

SEQ ID NO: 475438 - DNA, 20 bp, Artificial
  CRISPR gRNA sequence
gacgtcaactttacaataga

SEQ ID NO: 475439 - DNA, 20 bp, Artificial
  CRISPR gRNA sequence
acgtcaactttacaatagag

SEQ ID NO: 475440 - DNA, 20 bp, Artificial
  CRISPR gRNA sequence
tacaatagaggaaactttgg

SEQ ID NO: 475441 - DNA, 20 bp, Artificial
  CRISPR gRNA sequence
acaatagaggaaactttggt

SEQ ID NO: 475442 - DNA, 20 bp, Artificial
  CRISPR gRNA sequence
caatagaggaaactttggta

SEQ ID NO: 475443 - DNA, 20 bp, Artificial
  CRISPR gRNA sequence
tggtagtaggacagaggaag

SEQ ID NO: 475444 - DNA, 20 bp, Artificial
  CRISPR gRNA sequence
ggtagtaggacagaggaagc

SEQ ID NO: 475445 - DNA, 20 bp, Artificial
  CRISPR gRNA sequence
gtagtaggacagaggaagca

SEQ ID NO: 475446 - DNA, 20 bp, Artificial
  CRISPR gRNA sequence
aaaaacttctctgtgatagg

SEQ ID NO: 475447 - DNA, 20 bp, Artificial
  CRISPR gRNA sequence
aaaacttctctgtgatagga

SEQ ID NO: 475448 - DNA, 20 bp, Artificial
  CRISPR gRNA sequence
ctctgtgataggaaaagtat

SEQ ID NO: 475449 - DNA, 20 bp, Artificial
  CRISPR gRNA sequence
tctgtgataggaaaagtata

SEQ ID NO: 475450 - DNA, 20 bp, Artificial
  CRISPR gRNA sequence
tgtgataggaaaagtatatt

SEQ ID NO: 475451 - DNA, 20 bp, Artificial
  CRISPR gRNA sequence
tgataggaaaagtatattca

SEQ ID NO: 475452 - DNA, 20 bp, Artificial
  CRISPR gRNA sequence
aaggctgcaatgagcacaag

SEQ ID NO: 475453 - DNA, 20 bp, Artificial
  CRISPR gRNA sequence
caatgagcacaaggttaatc

SEQ ID NO: 475454 - DNA, 20 bp, Artificial
  CRISPR gRNA sequence
atcttttcatgctttaattc

SEQ ID NO: 475455 - DNA, 20 bp, Artificial
  CRISPR gRNA sequence
ttcatgctttaattcaagaa

SEQ ID NO: 475456 - DNA, 20 bp, Artificial
  CRISPR gRNA sequence
tcatgctttaattcaagaag

SEQ ID NO: 475457 - DNA, 20 bp, Artificial
  CRISPR gRNA sequence
catgctttaattcaagaagt

SEQ ID NO: 475458 - DNA, 20 bp, Artificial
  CRISPR gRNA sequence
atgctttaattcaagaagtc

SEQ ID NO: 475459 - DNA, 20 bp, Artificial
  CRISPR gRNA sequence
taattcaagaagtcctgtaa

SEQ ID NO: 475460 - DNA, 20 bp, Artificial
  CRISPR gRNA sequence
aattcaagaagtcctgtaac

SEQ ID NO: 475461 - DNA, 20 bp, Artificial
  CRISPR gRNA sequence
attcaagaagtcctgtaacc

SEQ ID NO: 475462 - DNA, 20 bp, Artificial
  CRISPR gRNA sequence
aagaagtcctgtaaccacag

SEQ ID NO: 475463 - DNA, 20 bp, Artificial
  CRISPR gRNA sequence
taaccacagaatgcattcct

SEQ ID NO: 475464 - DNA, 20 bp, Artificial
  CRISPR gRNA sequence
ctaaacatttatttaatata

SEQ ID NO: 475465 - DNA, 20 bp, Artificial
  CRISPR gRNA sequence
aacatttatttaatatatgg

SEQ ID NO: 475466 - DNA, 20 bp, Artificial
  CRISPR gRNA sequence
atttaatatatggcaggcat

SEQ ID NO: 475467 - DNA, 20 bp, Artificial
  CRISPR gRNA sequence
tttaatatatggcaggcatt

SEQ ID NO: 475468 - DNA, 20 bp, Artificial
  CRISPR gRNA sequence
aatatatggcaggcattgtt

SEQ ID NO: 475469 - DNA, 20 bp, Artificial
  CRISPR gRNA sequence
atatatggcaggcattgttg

SEQ ID NO: 475470 - DNA, 20 bp, Artificial
  CRISPR gRNA sequence
ttgtaacaatacataggcac

SEQ ID NO: 475471 - DNA, 20 bp, Artificial
  CRISPR gRNA sequence
taacaatacataggcacttg

SEQ ID NO: 475472 - DNA, 20 bp, Artificial
  CRISPR gRNA sequence
ggcagaagacagagctctat

SEQ ID NO: 475473 - DNA, 20 bp, Artificial
  CRISPR gRNA sequence
gcagaagacagagctctatc

SEQ ID NO: 475474 - DNA, 20 bp, Artificial
  CRISPR gRNA sequence
tatctctagcattcctccat

SEQ ID NO: 475475 - DNA, 20 bp, Artificial
  CRISPR gRNA sequence
tctctagcattcctccatat

SEQ ID NO: 475476 - DNA, 20 bp, Artificial
  CRISPR gRNA sequence
tagcattcctccatatgcac

SEQ ID NO: 475477 - DNA, 20 bp, Artificial
  CRISPR gRNA sequence
gcattcctccatatgcacat

SEQ ID NO: 475478 - DNA, 20 bp, Artificial
  CRISPR gRNA sequence
ctccatatgcacatttcaat

SEQ ID NO: 475479 - DNA, 20 bp, Artificial
  CRISPR gRNA sequence
catatgcacatttcaataag

SEQ ID NO: 475480 - DNA, 20 bp, Artificial
  CRISPR gRNA sequence
caataagaacaaatagctga

SEQ ID NO: 475481 - DNA, 20 bp, Artificial
  CRISPR gRNA sequence
aataagaacaaatagctgaa

SEQ ID NO: 475482 - DNA, 20 bp, Artificial
  CRISPR gRNA sequence
aagccatagaaatatgcctt

SEQ ID NO: 475483 - DNA, 20 bp, Artificial
  CRISPR gRNA sequence
ataaagatactgtgctacaa

SEQ ID NO: 475484 - DNA, 20 bp, Artificial
  CRISPR gRNA sequence
taaagatactgtgctacaaa

SEQ ID NO: 475485 - DNA, 20 bp, Artificial
  CRISPR gRNA sequence
tgctacaaaacctgaacttc

SEQ ID NO: 475486 - DNA, 20 bp, Artificial
  CRISPR gRNA sequence
caaaacctgaacttcaagga

SEQ ID NO: 475487 - DNA, 20 bp, Artificial
  CRISPR gRNA sequence
aacttcaaggaatgatattt

SEQ ID NO: 475488 - DNA, 20 bp, Artificial
  CRISPR gRNA sequence
caaggaatgatattttttga

SEQ ID NO: 475489 - DNA, 20 bp, Artificial
  CRISPR gRNA sequence
aaggaatgatattttttgac

SEQ ID NO: 475490 - DNA, 20 bp, Artificial
  CRISPR gRNA sequence
tttgacccaaagatatggcc

SEQ ID NO: 475491 - DNA, 20 bp, Artificial
  CRISPR gRNA sequence
ttgacccaaagatatggcca

SEQ ID NO: 475492 - DNA, 20 bp, Artificial
  CRISPR gRNA sequence
tgacccaaagatatggccag

SEQ ID NO: 475493 - DNA, 20 bp, Artificial
  CRISPR gRNA sequence
gacccaaagatatggccagt

SEQ ID NO: 475494 - DNA, 20 bp, Artificial
  CRISPR gRNA sequence
acccaaagatatggccagtt

SEQ ID NO: 475495 - DNA, 20 bp, Artificial
  CRISPR gRNA sequence
gtagtagagcaaaacaatct

SEQ ID NO: 475496 - DNA, 20 bp, Artificial
  CRISPR gRNA sequence
tagtagagcaaaacaatctg

SEQ ID NO: 475497 - DNA, 20 bp, Artificial
  CRISPR gRNA sequence
tgtgggatgtggaacacggt

SEQ ID NO: 475498 - DNA, 20 bp, Artificial
  CRISPR gRNA sequence
aaaagctggtccatggacca

SEQ ID NO: 475499 - DNA, 20 bp, Artificial
  CRISPR gRNA sequence
aaagctggtccatggaccat

SEQ ID NO: 475500 - DNA, 20 bp, Artificial
  CRISPR gRNA sequence
gtccatggaccatactggac

SEQ ID NO: 475501 - DNA, 20 bp, Artificial
  CRISPR gRNA sequence
gaccatcataataaagggaa

SEQ ID NO: 475502 - DNA, 20 bp, Artificial
  CRISPR gRNA sequence
accactgtattctcaaaaga

SEQ ID NO: 475503 - DNA, 20 bp, Artificial
  CRISPR gRNA sequence
tattctcaaaagagccagaa

SEQ ID NO: 475504 - DNA, 20 bp, Artificial
  CRISPR gRNA sequence
tcaaaagagccagaatacag

SEQ ID NO: 475505 - DNA, 20 bp, Artificial
  CRISPR gRNA sequence
aaaagagccagaatacaggt

SEQ ID NO: 475506 - DNA, 20 bp, Artificial
  CRISPR gRNA sequence
tcccttactgaaccagacta

SEQ ID NO: 475507 - DNA, 20 bp, Artificial
  CRISPR gRNA sequence
cccttactgaaccagactag

SEQ ID NO: 475508 - DNA, 20 bp, Artificial
  CRISPR gRNA sequence
ccttactgaaccagactagg

SEQ ID NO: 475509 - DNA, 20 bp, Artificial
  CRISPR gRNA sequence
actgaaccagactaggattg

SEQ ID NO: 475510 - DNA, 20 bp, Artificial
  CRISPR gRNA sequence
ctgaaccagactaggattgc

SEQ ID NO: 475511 - DNA, 20 bp, Artificial
  CRISPR gRNA sequence
aaccagactaggattgcttt

SEQ ID NO: 475512 - DNA, 20 bp, Artificial
  CRISPR gRNA sequence
ggattgctttttttaaaaat

SEQ ID NO: 475513 - DNA, 20 bp, Artificial
  CRISPR gRNA sequence
ctttttttaaaaatcacaat

SEQ ID NO: 475514 - DNA, 20 bp, Artificial
  CRISPR gRNA sequence
tttttaaaaatcacaataac

SEQ ID NO: 475515 - DNA, 20 bp, Artificial
  CRISPR gRNA sequence
ttttaaaaatcacaataacc

SEQ ID NO: 475516 - DNA, 20 bp, Artificial
  CRISPR gRNA sequence
tttaaaaatcacaataacca

SEQ ID NO: 475517 - DNA, 20 bp, Artificial
  CRISPR gRNA sequence
ttaaaaatcacaataaccag

SEQ ID NO: 475518 - DNA, 20 bp, Artificial
  CRISPR gRNA sequence
taaaaatcacaataaccagt

SEQ ID NO: 475519 - DNA, 20 bp, Artificial
  CRISPR gRNA sequence
aaaaatcacaataaccagta

SEQ ID NO: 475520 - DNA, 20 bp, Artificial
  CRISPR gRNA sequence
aaaatcacaataaccagtaa

SEQ ID NO: 475521 - DNA, 20 bp, Artificial
  CRISPR gRNA sequence
caactgcctttattctgcat

SEQ ID NO: 475522 - DNA, 20 bp, Artificial
  CRISPR gRNA sequence
cctttattctgcatcatata

SEQ ID NO: 475523 - DNA, 20 bp, Artificial
  CRISPR gRNA sequence
tattctgcatcatatatggt

SEQ ID NO: 475524 - DNA, 20 bp, Artificial
  CRISPR gRNA sequence
attctgcatcatatatggtg

SEQ ID NO: 475525 - DNA, 20 bp, Artificial
  CRISPR gRNA sequence
ttctgcatcatatatggtgt

SEQ ID NO: 475526 - DNA, 20 bp, Artificial
  CRISPR gRNA sequence
tgcatcatatatggtgttgg

SEQ ID NO: 475527 - DNA, 20 bp, Artificial
  CRISPR gRNA sequence
catcatatatggtgttggtg

SEQ ID NO: 475528 - DNA, 20 bp, Artificial
  CRISPR gRNA sequence
gtgatacccagacattaact

SEQ ID NO: 475529 - DNA, 20 bp, Artificial
  CRISPR gRNA sequence
actgcagtgttcctgcctgc

SEQ ID NO: 475530 - DNA, 20 bp, Artificial
  CRISPR gRNA sequence
cagtgttcctgcctgcctaa

SEQ ID NO: 475531 - DNA, 20 bp, Artificial
  CRISPR gRNA sequence
ctgcctgcctaaaagtggaa

SEQ ID NO: 475532 - DNA, 20 bp, Artificial
  CRISPR gRNA sequence
cctgcctaaaagtggaatcc

SEQ ID NO: 475533 - DNA, 20 bp, Artificial
  CRISPR gRNA sequence
cctaaaagtggaatccttgg

SEQ ID NO: 475534 - DNA, 20 bp, Artificial
  CRISPR gRNA sequence
aaagtggaatccttggttga

SEQ ID NO: 475535 - DNA, 20 bp, Artificial
  CRISPR gRNA sequence
ggttgatcctcaactgaact

SEQ ID NO: 475536 - DNA, 20 bp, Artificial
  CRISPR gRNA sequence
gttgatcctcaactgaacta

SEQ ID NO: 475537 - DNA, 20 bp, Artificial
  CRISPR gRNA sequence
atcctcaactgaactagggt

SEQ ID NO: 475538 - DNA, 20 bp, Artificial
  CRISPR gRNA sequence
aactgaactagggtctaggg

SEQ ID NO: 475539 - DNA, 20 bp, Artificial
  CRISPR gRNA sequence
aactagggtctagggcagcc

SEQ ID NO: 475540 - DNA, 20 bp, Artificial
  CRISPR gRNA sequence
gggtctagggcagcctcaga

SEQ ID NO: 475541 - DNA, 20 bp, Artificial
  CRISPR gRNA sequence
gggcagcctcagacaaatgg

SEQ ID NO: 475542 - DNA, 20 bp, Artificial
  CRISPR gRNA sequence
agacaaatggtccaggatga

SEQ ID NO: 475543 - DNA, 20 bp, Artificial
  CRISPR gRNA sequence
ccacttgcagtctagatctt

SEQ ID NO: 475544 - DNA, 20 bp, Artificial
  CRISPR gRNA sequence
cacttgcagtctagatcttg

SEQ ID NO: 475545 - DNA, 20 bp, Artificial
  CRISPR gRNA sequence
gcagtctagatcttgccagc

SEQ ID NO: 475546 - DNA, 20 bp, Artificial
  CRISPR gRNA sequence
cagtctagatcttgccagca

SEQ ID NO: 475547 - DNA, 20 bp, Artificial
  CRISPR gRNA sequence
gatcttgccagcatgatctg

SEQ ID NO: 475548 - DNA, 20 bp, Artificial
  CRISPR gRNA sequence
gccagcatgatctgcccatg

SEQ ID NO: 475549 - DNA, 20 bp, Artificial
  CRISPR gRNA sequence
ccagcatgatctgcccatga

SEQ ID NO: 475550 - DNA, 20 bp, Artificial
  CRISPR gRNA sequence
cccatgaagggaagatattg

SEQ ID NO: 475551 - DNA, 20 bp, Artificial
  CRISPR gRNA sequence
acatttttattacttctatc

SEQ ID NO: 475552 - DNA, 20 bp, Artificial
  CRISPR gRNA sequence
ttattacttctatcaggaca

SEQ ID NO: 475553 - DNA, 20 bp, Artificial
  CRISPR gRNA sequence
tattacttctatcaggacag

SEQ ID NO: 475554 - DNA, 20 bp, Artificial
  CRISPR gRNA sequence
attacttctatcaggacaga

SEQ ID NO: 475555 - DNA, 20 bp, Artificial
  CRISPR gRNA sequence
ttacttctatcaggacagaa

SEQ ID NO: 475556 - DNA, 20 bp, Artificial
  CRISPR gRNA sequence
cttctatcaggacagaaact

SEQ ID NO: 475557 - DNA, 20 bp, Artificial
  CRISPR gRNA sequence
ctatcaggacagaaactgta

SEQ ID NO: 475558 - DNA, 20 bp, Artificial
  CRISPR gRNA sequence
tatcaggacagaaactgtat

SEQ ID NO: 475559 - DNA, 20 bp, Artificial
  CRISPR gRNA sequence
tcaggacagaaactgtatgc

SEQ ID NO: 475560 - DNA, 20 bp, Artificial
  CRISPR gRNA sequence
tatgccacacactgaggggc

SEQ ID NO: 475561 - DNA, 20 bp, Artificial
  CRISPR gRNA sequence
aggggcaagtttctctaatt

SEQ ID NO: 475562 - DNA, 20 bp, Artificial
  CRISPR gRNA sequence
ctctaattttttagagaaac

SEQ ID NO: 475563 - DNA, 20 bp, Artificial
  CRISPR gRNA sequence
tctaattttttagagaaaca

SEQ ID NO: 475564 - DNA, 20 bp, Artificial
  CRISPR gRNA sequence
taattttttagagaaacaca

SEQ ID NO: 475565 - DNA, 20 bp, Artificial
  CRISPR gRNA sequence
attttttagagaaacacaaa

SEQ ID NO: 475566 - DNA, 20 bp, Artificial
  CRISPR gRNA sequence
tttagagaaacacaaaaagt

SEQ ID NO: 475567 - DNA, 20 bp, Artificial
  CRISPR gRNA sequence
ttagagaaacacaaaaagta

SEQ ID NO: 475568 - DNA, 20 bp, Artificial
  CRISPR gRNA sequence
tagagaaacacaaaaagtaa

SEQ ID NO: 475569 - DNA, 20 bp, Artificial
  CRISPR gRNA sequence
agagaaacacaaaaagtaag

SEQ ID NO: 475570 - DNA, 20 bp, Artificial
  CRISPR gRNA sequence
gagaaacacaaaaagtaagc

SEQ ID NO: 475571 - DNA, 20 bp, Artificial
  CRISPR gRNA sequence
ttgtaataaagaaggacctt

SEQ ID NO: 475572 - DNA, 20 bp, Artificial
  CRISPR gRNA sequence
tgtaataaagaaggacctta

SEQ ID NO: 475573 - DNA, 20 bp, Artificial
  CRISPR gRNA sequence
gtaataaagaaggaccttaa

SEQ ID NO: 475574 - DNA, 20 bp, Artificial
  CRISPR gRNA sequence
taataaagaaggaccttaaa

SEQ ID NO: 475575 - DNA, 20 bp, Artificial
  CRISPR gRNA sequence
aaacaggaagtttgtagaga

SEQ ID NO: 475576 - DNA, 20 bp, Artificial
  CRISPR gRNA sequence
aacaggaagtttgtagagaa

SEQ ID NO: 475577 - DNA, 20 bp, Artificial
  CRISPR gRNA sequence
gtagagaacattacattttt

SEQ ID NO: 475578 - DNA, 20 bp, Artificial
  CRISPR gRNA sequence
tagagaacattacatttttt

SEQ ID NO: 475579 - DNA, 20 bp, Artificial
  CRISPR gRNA sequence
cattttttccagccttatta

SEQ ID NO: 475580 - DNA, 20 bp, Artificial
  CRISPR gRNA sequence
tttccagccttattatatat

SEQ ID NO: 475581 - DNA, 20 bp, Artificial
  CRISPR gRNA sequence
ttccagccttattatatatg

SEQ ID NO: 475582 - DNA, 20 bp, Artificial
  CRISPR gRNA sequence
tccagccttattatatatgc

SEQ ID NO: 475583 - DNA, 20 bp, Artificial
  CRISPR gRNA sequence
ccagccttattatatatgca

SEQ ID NO: 475584 - DNA, 20 bp, Artificial
  CRISPR gRNA sequence
cagccttattatatatgcag

SEQ ID NO: 475585 - DNA, 20 bp, Artificial
  CRISPR gRNA sequence
attatatatgcagcctcact

SEQ ID NO: 475586 - DNA, 20 bp, Artificial
  CRISPR gRNA sequence
ttatatatgcagcctcactc

SEQ ID NO: 475587 - DNA, 20 bp, Artificial
  CRISPR gRNA sequence
tatatgcagcctcactccta

SEQ ID NO: 475588 - DNA, 20 bp, Artificial
  CRISPR gRNA sequence
actcctaggaacaaggacac

SEQ ID NO: 475589 - DNA, 20 bp, Artificial
  CRISPR gRNA sequence
ctaggaacaaggacacggat

SEQ ID NO: 475590 - DNA, 20 bp, Artificial
  CRISPR gRNA sequence
ggaacaaggacacggatctc

SEQ ID NO: 475591 - DNA, 20 bp, Artificial
  CRISPR gRNA sequence
acattgctttgaagtagggg

SEQ ID NO: 475592 - DNA, 20 bp, Artificial
  CRISPR gRNA sequence
ctttgaagtagggggaaaaa

SEQ ID NO: 475593 - DNA, 20 bp, Artificial
  CRISPR gRNA sequence
tgaagtagggggaaaaaatc

SEQ ID NO: 475594 - DNA, 20 bp, Artificial
  CRISPR gRNA sequence
gaagtagggggaaaaaatct

SEQ ID NO: 475595 - DNA, 20 bp, Artificial
  CRISPR gRNA sequence
aagtagggggaaaaaatctt

SEQ ID NO: 475596 - DNA, 20 bp, Artificial
  CRISPR gRNA sequence
caaaggctatctttaaacac

SEQ ID NO: 475597 - DNA, 20 bp, Artificial
  CRISPR gRNA sequence
aaaggctatctttaaacact

SEQ ID NO: 475598 - DNA, 20 bp, Artificial
  CRISPR gRNA sequence
tctttaaacactgaaaatgt

SEQ ID NO: 475599 - DNA, 20 bp, Artificial
  CRISPR gRNA sequence
taaacactgaaaatgtatta

SEQ ID NO: 475600 - DNA, 20 bp, Artificial
  CRISPR gRNA sequence
aaacactgaaaatgtattac

SEQ ID NO: 475601 - DNA, 20 bp, Artificial
  CRISPR gRNA sequence
aacactgaaaatgtattact

SEQ ID NO: 475602 - DNA, 20 bp, Artificial
  CRISPR gRNA sequence
aaaatgtattactgtaaaga

SEQ ID NO: 475603 - DNA, 20 bp, Artificial
  CRISPR gRNA sequence
ctgtaaagaactcagcaatt

SEQ ID NO: 475604 - DNA, 20 bp, Artificial
  CRISPR gRNA sequence
taaagaactcagcaattaag

SEQ ID NO: 475605 - DNA, 20 bp, Artificial
  CRISPR gRNA sequence
agcaattaagtaaatcacag

SEQ ID NO: 475606 - DNA, 20 bp, Artificial
  CRISPR gRNA sequence
agtaaatcacaggaaatccc

SEQ ID NO: 475607 - DNA, 20 bp, Artificial
  CRISPR gRNA sequence
aatgtggttttaagaaatgg

SEQ ID NO: 475608 - DNA, 20 bp, Artificial
  CRISPR gRNA sequence
atgtggttttaagaaatgga

SEQ ID NO: 475609 - DNA, 20 bp, Artificial
  CRISPR gRNA sequence
taagaaatggagccatcagc

SEQ ID NO: 475610 - DNA, 20 bp, Artificial
  CRISPR gRNA sequence
aagaaatggagccatcagct

SEQ ID NO: 475611 - DNA, 20 bp, Artificial
  CRISPR gRNA sequence
agaaatggagccatcagctc

SEQ ID NO: 475612 - DNA, 20 bp, Artificial
  CRISPR gRNA sequence
tgcctgggagaacaaatttc

SEQ ID NO: 475613 - DNA, 20 bp, Artificial
  CRISPR gRNA sequence
cctgggagaacaaatttcac

SEQ ID NO: 475614 - DNA, 20 bp, Artificial
  CRISPR gRNA sequence
ggagaacaaatttcaccaaa

SEQ ID NO: 475615 - DNA, 20 bp, Artificial
  CRISPR gRNA sequence
caccaaatgttccttctctt

SEQ ID NO: 475616 - DNA, 20 bp, Artificial
  CRISPR gRNA sequence
accaaatgttccttctctta

SEQ ID NO: 475617 - DNA, 20 bp, Artificial
  CRISPR gRNA sequence
cttctcttaacctatagctt

SEQ ID NO: 475618 - DNA, 20 bp, Artificial
  CRISPR gRNA sequence
ctcttaacctatagctttaa

SEQ ID NO: 475619 - DNA, 20 bp, Artificial
  CRISPR gRNA sequence
tcttaacctatagctttaat

SEQ ID NO: 475620 - DNA, 20 bp, Artificial
  CRISPR gRNA sequence
ttaacctatagctttaattt

SEQ ID NO: 475621 - DNA, 20 bp, Artificial
  CRISPR gRNA sequence
aacctatagctttaatttaa

SEQ ID NO: 475622 - DNA, 20 bp, Artificial
  CRISPR gRNA sequence
acctatagctttaatttaat

SEQ ID NO: 475623 - DNA, 20 bp, Artificial
  CRISPR gRNA sequence
tagctttaatttaatgcaac

SEQ ID NO: 475624 - DNA, 20 bp, Artificial
  CRISPR gRNA sequence
taatttaatgcaactgctgc

SEQ ID NO: 475625 - DNA, 20 bp, Artificial
  CRISPR gRNA sequence
aatttaatgcaactgctgct

SEQ ID NO: 475626 - DNA, 20 bp, Artificial
  CRISPR gRNA sequence
atttaatgcaactgctgctg

SEQ ID NO: 475627 - DNA, 20 bp, Artificial
  CRISPR gRNA sequence
aatgcaactgctgctgcaat

SEQ ID NO: 475628 - DNA, 20 bp, Artificial
  CRISPR gRNA sequence
atgcaactgctgctgcaatc

SEQ ID NO: 475629 - DNA, 20 bp, Artificial
  CRISPR gRNA sequence
ctgctgcaatccattatatc

SEQ ID NO: 475630 - DNA, 20 bp, Artificial
  CRISPR gRNA sequence
ctgcaatccattatatcaac

SEQ ID NO: 475631 - DNA, 20 bp, Artificial
  CRISPR gRNA sequence
caatccattatatcaactgg

SEQ ID NO: 475632 - DNA, 20 bp, Artificial
  CRISPR gRNA sequence
tatcaactggtatatatctg

SEQ ID NO: 475633 - DNA, 20 bp, Artificial
  CRISPR gRNA sequence
gtatatatctgaccagtact

SEQ ID NO: 475634 - DNA, 20 bp, Artificial
  CRISPR gRNA sequence
accagtacttcactcaagtc

SEQ ID NO: 475635 - DNA, 20 bp, Artificial
  CRISPR gRNA sequence
cactcaagtctttccctttt

SEQ ID NO: 475636 - DNA, 20 bp, Artificial
  CRISPR gRNA sequence
actcaagtctttcccttttt

SEQ ID NO: 475637 - DNA, 20 bp, Artificial
  CRISPR gRNA sequence
aagtctttcccttttttttt

SEQ ID NO: 475638 - DNA, 20 bp, Artificial
  CRISPR gRNA sequence
tcccttttttttttgagtgc

SEQ ID NO: 475639 - DNA, 20 bp, Artificial
  CRISPR gRNA sequence
cccttttttttttgagtgca

SEQ ID NO: 475640 - DNA, 20 bp, Artificial
  CRISPR gRNA sequence
ccttttttttttgagtgcag

SEQ ID NO: 475641 - DNA, 20 bp, Artificial
  CRISPR gRNA sequence
ttttttttgagtgcagtggt

SEQ ID NO: 475642 - DNA, 20 bp, Artificial
  CRISPR gRNA sequence
tttttttgagtgcagtggtg

SEQ ID NO: 475643 - DNA, 20 bp, Artificial
  CRISPR gRNA sequence
ttttttgagtgcagtggtgt

SEQ ID NO: 475644 - DNA, 20 bp, Artificial
  CRISPR gRNA sequence
tttttgagtgcagtggtgtg

SEQ ID NO: 475645 - DNA, 20 bp, Artificial
  CRISPR gRNA sequence
ttttgagtgcagtggtgtga

SEQ ID NO: 475646 - DNA, 20 bp, Artificial
  CRISPR gRNA sequence
tttgagtgcagtggtgtgat

SEQ ID NO: 475647 - DNA, 20 bp, Artificial
  CRISPR gRNA sequence
ttgagtgcagtggtgtgatc

SEQ ID NO: 475648 - DNA, 20 bp, Artificial
  CRISPR gRNA sequence
tgagtgcagtggtgtgatct

SEQ ID NO: 475649 - DNA, 20 bp, Artificial
  CRISPR gRNA sequence
gagtgcagtggtgtgatctc

SEQ ID NO: 475650 - DNA, 20 bp, Artificial
  CRISPR gRNA sequence
agtgcagtggtgtgatctca

SEQ ID NO: 475651 - DNA, 20 bp, Artificial
  CRISPR gRNA sequence
agctcactgcaacctctgcc

SEQ ID NO: 475652 - DNA, 20 bp, Artificial
  CRISPR gRNA sequence
actgcaacctctgcctcctg

SEQ ID NO: 475653 - DNA, 20 bp, Artificial
  CRISPR gRNA sequence
caacctctgcctcctgggtt

SEQ ID NO: 475654 - DNA, 20 bp, Artificial
  CRISPR gRNA sequence
tgcctcctgggttcaagcta

SEQ ID NO: 475655 - DNA, 20 bp, Artificial
  CRISPR gRNA sequence
cctcctgggttcaagctatt

SEQ ID NO: 475656 - DNA, 20 bp, Artificial
  CRISPR gRNA sequence
ctgggttcaagctattctcc

SEQ ID NO: 475657 - DNA, 20 bp, Artificial
  CRISPR gRNA sequence
ggttcaagctattctcctgt

SEQ ID NO: 475658 - DNA, 20 bp, Artificial
  CRISPR gRNA sequence
aagctattctcctgtctcgg

SEQ ID NO: 475659 - DNA, 20 bp, Artificial
  CRISPR gRNA sequence
ttctcctgtctcggcctccc

SEQ ID NO: 475660 - DNA, 20 bp, Artificial
  CRISPR gRNA sequence
tcctgtctcggcctcccgag

SEQ ID NO: 475661 - DNA, 20 bp, Artificial
  CRISPR gRNA sequence
ctgtctcggcctcccgagta

SEQ ID NO: 475662 - DNA, 20 bp, Artificial
  CRISPR gRNA sequence
tctcggcctcccgagtagct

SEQ ID NO: 475663 - DNA, 20 bp, Artificial
  CRISPR gRNA sequence
ggcctcccgagtagctggga

SEQ ID NO: 475664 - DNA, 20 bp, Artificial
  CRISPR gRNA sequence
ccgagtagctgggactacag

SEQ ID NO: 475665 - DNA, 20 bp, Artificial
  CRISPR gRNA sequence
ggactacaggcacctcccaa

SEQ ID NO: 475666 - DNA, 20 bp, Artificial
  CRISPR gRNA sequence
caggcacctcccaacacacc

SEQ ID NO: 475667 - DNA, 20 bp, Artificial
  CRISPR gRNA sequence
ccaacacacccagcaaattt

SEQ ID NO: 475668 - DNA, 20 bp, Artificial
  CRISPR gRNA sequence
ttatatttttagtagagacg

SEQ ID NO: 475669 - DNA, 20 bp, Artificial
  CRISPR gRNA sequence
tatatttttagtagagacgg

SEQ ID NO: 475670 - DNA, 20 bp, Artificial
  CRISPR gRNA sequence
atatttttagtagagacggg

SEQ ID NO: 475671 - DNA, 20 bp, Artificial
  CRISPR gRNA sequence
tatttttagtagagacgggg

SEQ ID NO: 475672 - DNA, 20 bp, Artificial
  CRISPR gRNA sequence
ttagtagagacggggtttca

SEQ ID NO: 475673 - DNA, 20 bp, Artificial
  CRISPR gRNA sequence
tagtagagacggggtttcac

SEQ ID NO: 475674 - DNA, 20 bp, Artificial
  CRISPR gRNA sequence
agtagagacggggtttcacc

SEQ ID NO: 475675 - DNA, 20 bp, Artificial
  CRISPR gRNA sequence
gtagagacggggtttcacca

SEQ ID NO: 475676 - DNA, 20 bp, Artificial
  CRISPR gRNA sequence
caccatgttgaccagtctgg

SEQ ID NO: 475677 - DNA, 20 bp, Artificial
  CRISPR gRNA sequence
accatgttgaccagtctggt

SEQ ID NO: 475678 - DNA, 20 bp, Artificial
  CRISPR gRNA sequence
accagtctggtcttaaactc

SEQ ID NO: 475679 - DNA, 20 bp, Artificial
  CRISPR gRNA sequence
gtcttaaactcctgacctca

SEQ ID NO: 475680 - DNA, 20 bp, Artificial
  CRISPR gRNA sequence
aaactcctgacctcaggtga

SEQ ID NO: 475681 - DNA, 20 bp, Artificial
  CRISPR gRNA sequence
aactcctgacctcaggtgat

SEQ ID NO: 475682 - DNA, 20 bp, Artificial
  CRISPR gRNA sequence
ctgacctcaggtgatctgcc

SEQ ID NO: 475683 - DNA, 20 bp, Artificial
  CRISPR gRNA sequence
acctcaggtgatctgcccgt

SEQ ID NO: 475684 - DNA, 20 bp, Artificial
  CRISPR gRNA sequence
aggtgatctgcccgtcttgg

SEQ ID NO: 475685 - DNA, 20 bp, Artificial
  CRISPR gRNA sequence
cccgtcttggcttcccaaag

SEQ ID NO: 475686 - DNA, 20 bp, Artificial
  CRISPR gRNA sequence
ggcttcccaaagtgctgaga

SEQ ID NO: 475687 - DNA, 20 bp, Artificial
  CRISPR gRNA sequence
gcttcccaaagtgctgagac

SEQ ID NO: 475688 - DNA, 20 bp, Artificial
  CRISPR gRNA sequence
cccaaagtgctgagactaaa

SEQ ID NO: 475689 - DNA, 20 bp, Artificial
  CRISPR gRNA sequence
ccaaagtgctgagactaaag

SEQ ID NO: 475690 - DNA, 20 bp, Artificial
  CRISPR gRNA sequence
agactaaaggctagggccat

SEQ ID NO: 475691 - DNA, 20 bp, Artificial
  CRISPR gRNA sequence
aaggctagggccatggctcc

SEQ ID NO: 475692 - DNA, 20 bp, Artificial
  CRISPR gRNA sequence
gggccatggctcccagccat

SEQ ID NO: 475693 - DNA, 20 bp, Artificial
  CRISPR gRNA sequence
ccagccatatttcattttct

SEQ ID NO: 475694 - DNA, 20 bp, Artificial
  CRISPR gRNA sequence
cattttctgaataatttgat

SEQ ID NO: 475695 - DNA, 20 bp, Artificial
  CRISPR gRNA sequence
attttctgaataatttgatt

SEQ ID NO: 475696 - DNA, 20 bp, Artificial
  CRISPR gRNA sequence
tctgaataatttgattcact

SEQ ID NO: 475697 - DNA, 20 bp, Artificial
  CRISPR gRNA sequence
ctgaataatttgattcacta

SEQ ID NO: 475698 - DNA, 20 bp, Artificial
  CRISPR gRNA sequence
tgaataatttgattcactat

SEQ ID NO: 475699 - DNA, 20 bp, Artificial
  CRISPR gRNA sequence
aataatttgattcactatat

SEQ ID NO: 475700 - DNA, 20 bp, Artificial
  CRISPR gRNA sequence
gattcactatattttgggct

SEQ ID NO: 475701 - DNA, 20 bp, Artificial
  CRISPR gRNA sequence
attcactatattttgggcta

SEQ ID NO: 475702 - DNA, 20 bp, Artificial
  CRISPR gRNA sequence
actatattttgggctaaata

SEQ ID NO: 475703 - DNA, 20 bp, Artificial
  CRISPR gRNA sequence
tattttgggctaaatatatt

SEQ ID NO: 475704 - DNA, 20 bp, Artificial
  CRISPR gRNA sequence
tgggctaaatatattgcaaa

SEQ ID NO: 475705 - DNA, 20 bp, Artificial
  CRISPR gRNA sequence
gggctaaatatattgcaaaa

SEQ ID NO: 475706 - DNA, 20 bp, Artificial
  CRISPR gRNA sequence
ggctaaatatattgcaaaat

SEQ ID NO: 475707 - DNA, 20 bp, Artificial
  CRISPR gRNA sequence
aatatattgcaaaatatatt

SEQ ID NO: 475708 - DNA, 20 bp, Artificial
  CRISPR gRNA sequence
caaaatatattgtacttatt

SEQ ID NO: 475709 - DNA, 20 bp, Artificial
  CRISPR gRNA sequence
tacttatttattttattttt

SEQ ID NO: 475710 - DNA, 20 bp, Artificial
  CRISPR gRNA sequence
atttattttatttttaactt

SEQ ID NO: 475711 - DNA, 20 bp, Artificial
  CRISPR gRNA sequence
tttattttatttttaacttt

SEQ ID NO: 475712 - DNA, 20 bp, Artificial
  CRISPR gRNA sequence
attttatttttaactttaaa

SEQ ID NO: 475713 - DNA, 20 bp, Artificial
  CRISPR gRNA sequence
ttttatttttaactttaaaa

SEQ ID NO: 475714 - DNA, 20 bp, Artificial
  CRISPR gRNA sequence
tatttttaactttaaaaact

SEQ ID NO: 475715 - DNA, 20 bp, Artificial
  CRISPR gRNA sequence
atttttaactttaaaaactc

SEQ ID NO: 475716 - DNA, 20 bp, Artificial
  CRISPR gRNA sequence
tttttaactttaaaaactca

SEQ ID NO: 475717 - DNA, 20 bp, Artificial
  CRISPR gRNA sequence
ttaactttaaaaactcaact

SEQ ID NO: 475718 - DNA, 20 bp, Artificial
  CRISPR gRNA sequence
taactttaaaaactcaacta

SEQ ID NO: 475719 - DNA, 20 bp, Artificial
  CRISPR gRNA sequence
aactttaaaaactcaactat

SEQ ID NO: 475720 - DNA, 20 bp, Artificial
  CRISPR gRNA sequence
actttaaaaactcaactatt

SEQ ID NO: 475721 - DNA, 20 bp, Artificial
  CRISPR gRNA sequence
taaaaactcaactattttaa

SEQ ID NO: 475722 - DNA, 20 bp, Artificial
  CRISPR gRNA sequence
aaaaactcaactattttaaa

SEQ ID NO: 475723 - DNA, 20 bp, Artificial
  CRISPR gRNA sequence
aaaactcaactattttaaat

SEQ ID NO: 475724 - DNA, 20 bp, Artificial
  CRISPR gRNA sequence
aactattttaaataataatg

SEQ ID NO: 475725 - DNA, 20 bp, Artificial
  CRISPR gRNA sequence
ttttaaataataatgttaaa

SEQ ID NO: 475726 - DNA, 20 bp, Artificial
  CRISPR gRNA sequence
taaataataatgttaaaaca

SEQ ID NO: 475727 - DNA, 20 bp, Artificial
  CRISPR gRNA sequence
aaataataatgttaaaacat

SEQ ID NO: 475728 - DNA, 20 bp, Artificial
  CRISPR gRNA sequence
aataataatgttaaaacata

SEQ ID NO: 475729 - DNA, 20 bp, Artificial
  CRISPR gRNA sequence
aaacataattctcatttaat

SEQ ID NO: 475730 - DNA, 20 bp, Artificial
  CRISPR gRNA sequence
tcatttaattacatagaggt

SEQ ID NO: 475731 - DNA, 20 bp, Artificial
  CRISPR gRNA sequence
atttaattacatagaggttg

SEQ ID NO: 475732 - DNA, 20 bp, Artificial
  CRISPR gRNA sequence
aattacatagaggttgcatg

SEQ ID NO: 475733 - DNA, 20 bp, Artificial
  CRISPR gRNA sequence
attacatagaggttgcatgg

SEQ ID NO: 475734 - DNA, 20 bp, Artificial
  CRISPR gRNA sequence
catagaggttgcatggtgaa

SEQ ID NO: 475735 - DNA, 20 bp, Artificial
  CRISPR gRNA sequence
catggtgaaaataatttagg

SEQ ID NO: 475736 - DNA, 20 bp, Artificial
  CRISPR gRNA sequence
aggaaaaataccactaacat

SEQ ID NO: 475737 - DNA, 20 bp, Artificial
  CRISPR gRNA sequence
ggaaaaataccactaacatt

SEQ ID NO: 475738 - DNA, 20 bp, Artificial
  CRISPR gRNA sequence
acatttactgagctttaaat

SEQ ID NO: 475739 - DNA, 20 bp, Artificial
  CRISPR gRNA sequence
actgagctttaaatacgtgc

SEQ ID NO: 475740 - DNA, 20 bp, Artificial
  CRISPR gRNA sequence
ctgagctttaaatacgtgca

SEQ ID NO: 475741 - DNA, 20 bp, Artificial
  CRISPR gRNA sequence
agctttaaatacgtgcactt

SEQ ID NO: 475742 - DNA, 20 bp, Artificial
  CRISPR gRNA sequence
taaatacgtgcacttactat

SEQ ID NO: 475743 - DNA, 20 bp, Artificial
  CRISPR gRNA sequence
aaatacgtgcacttactatg

SEQ ID NO: 475744 - DNA, 20 bp, Artificial
  CRISPR gRNA sequence
aatacgtgcacttactatgc

SEQ ID NO: 475745 - DNA, 20 bp, Artificial
  CRISPR gRNA sequence
actatgcgaggcactttacc

SEQ ID NO: 475746 - DNA, 20 bp, Artificial
  CRISPR gRNA sequence
ctatgcgaggcactttaccc

SEQ ID NO: 475747 - DNA, 20 bp, Artificial
  CRISPR gRNA sequence
tgcgaggcactttacccata

SEQ ID NO: 475748 - DNA, 20 bp, Artificial
  CRISPR gRNA sequence
tacccatattattgcatcta

SEQ ID NO: 475749 - DNA, 20 bp, Artificial
  CRISPR gRNA sequence
acccatattattgcatctac

SEQ ID NO: 475750 - DNA, 20 bp, Artificial
  CRISPR gRNA sequence
cccatattattgcatctaca

SEQ ID NO: 475751 - DNA, 20 bp, Artificial
  CRISPR gRNA sequence
ttgcatctacagtcttcaca

SEQ ID NO: 475752 - DNA, 20 bp, Artificial
  CRISPR gRNA sequence
catctacagtcttcacagca

SEQ ID NO: 475753 - DNA, 20 bp, Artificial
  CRISPR gRNA sequence
cagtcttcacagcagcccca

SEQ ID NO: 475754 - DNA, 20 bp, Artificial
  CRISPR gRNA sequence
cacagcagccccataattta

SEQ ID NO: 475755 - DNA, 20 bp, Artificial
  CRISPR gRNA sequence
acagcagccccataatttag

SEQ ID NO: 475756 - DNA, 20 bp, Artificial
  CRISPR gRNA sequence
aggtacaattattacctgta

SEQ ID NO: 475757 - DNA, 20 bp, Artificial
  CRISPR gRNA sequence
ggtacaattattacctgtat

SEQ ID NO: 475758 - DNA, 20 bp, Artificial
  CRISPR gRNA sequence
ttacctgtattgtacaaatg

SEQ ID NO: 475759 - DNA, 20 bp, Artificial
  CRISPR gRNA sequence
cctgtattgtacaaatgagg

SEQ ID NO: 475760 - DNA, 20 bp, Artificial
  CRISPR gRNA sequence
tattgtacaaatgaggaaac

SEQ ID NO: 475761 - DNA, 20 bp, Artificial
  CRISPR gRNA sequence
tacaaatgaggaaactaaag

SEQ ID NO: 475762 - DNA, 20 bp, Artificial
  CRISPR gRNA sequence
aagagaagagaagagactta

SEQ ID NO: 475763 - DNA, 20 bp, Artificial
  CRISPR gRNA sequence
aatcaatgccatacagtaag

SEQ ID NO: 475764 - DNA, 20 bp, Artificial
  CRISPR gRNA sequence
atcaatgccatacagtaagt

SEQ ID NO: 475765 - DNA, 20 bp, Artificial
  CRISPR gRNA sequence
acccagttctaacagccaag

SEQ ID NO: 475766 - DNA, 20 bp, Artificial
  CRISPR gRNA sequence
taacagccaagttcactttt

SEQ ID NO: 475767 - DNA, 20 bp, Artificial
  CRISPR gRNA sequence
acagccaagttcacttttgc

SEQ ID NO: 475768 - DNA, 20 bp, Artificial
  CRISPR gRNA sequence
acttttgcaaatgctaggtt

SEQ ID NO: 475769 - DNA, 20 bp, Artificial
  CRISPR gRNA sequence
ttgcaaatgctaggttgcac

SEQ ID NO: 475770 - DNA, 20 bp, Artificial
  CRISPR gRNA sequence
tgcaaatgctaggttgcaca

SEQ ID NO: 475771 - DNA, 20 bp, Artificial
  CRISPR gRNA sequence
gcaaatgctaggttgcacat

SEQ ID NO: 475772 - DNA, 20 bp, Artificial
  CRISPR gRNA sequence
caaatgctaggttgcacatt

SEQ ID NO: 475773 - DNA, 20 bp, Artificial
  CRISPR gRNA sequence
ggttgcacattgggagaaat

SEQ ID NO: 475774 - DNA, 20 bp, Artificial
  CRISPR gRNA sequence
cacattgggagaaataaagg

SEQ ID NO: 475775 - DNA, 20 bp, Artificial
  CRISPR gRNA sequence
ggagaaataaaggtcttacc

SEQ ID NO: 475776 - DNA, 20 bp, Artificial
  CRISPR gRNA sequence
accccaccatcaatgtggtt

SEQ ID NO: 475777 - DNA, 20 bp, Artificial
  CRISPR gRNA sequence
ccccaccatcaatgtggttt

SEQ ID NO: 475778 - DNA, 20 bp, Artificial
  CRISPR gRNA sequence
agcactgaaactcattgttc

SEQ ID NO: 475779 - DNA, 20 bp, Artificial
  CRISPR gRNA sequence
gcactgaaactcattgttct

SEQ ID NO: 475780 - DNA, 20 bp, Artificial
  CRISPR gRNA sequence
aaactcattgttcttaattt

SEQ ID NO: 475781 - DNA, 20 bp, Artificial
  CRISPR gRNA sequence
attgttcttaatttcataga

SEQ ID NO: 475782 - DNA, 20 bp, Artificial
  CRISPR gRNA sequence
ttcttaatttcatagagagt

SEQ ID NO: 475783 - DNA, 20 bp, Artificial
  CRISPR gRNA sequence
ttaatttcatagagagtagt

SEQ ID NO: 475784 - DNA, 20 bp, Artificial
  CRISPR gRNA sequence
aatttcatagagagtagttt

SEQ ID NO: 475785 - DNA, 20 bp, Artificial
  CRISPR gRNA sequence
atttcatagagagtagttta

SEQ ID NO: 475786 - DNA, 20 bp, Artificial
  CRISPR gRNA sequence
catagagagtagtttatgta

SEQ ID NO: 475787 - DNA, 20 bp, Artificial
  CRISPR gRNA sequence
atagagagtagtttatgtat

SEQ ID NO: 475788 - DNA, 20 bp, Artificial
  CRISPR gRNA sequence
atgtatccttcaaatgggga

SEQ ID NO: 475789 - DNA, 20 bp, Artificial
  CRISPR gRNA sequence
tgtatccttcaaatggggaa

SEQ ID NO: 475790 - DNA, 20 bp, Artificial
  CRISPR gRNA sequence
caaatggggaagaaatctat

SEQ ID NO: 475791 - DNA, 20 bp, Artificial
  CRISPR gRNA sequence
aaatggggaagaaatctatt

SEQ ID NO: 475792 - DNA, 20 bp, Artificial
  CRISPR gRNA sequence
tttaataatatttgactcca

SEQ ID NO: 475793 - DNA, 20 bp, Artificial
  CRISPR gRNA sequence
aataatatttgactccagtt

SEQ ID NO: 475794 - DNA, 20 bp, Artificial
  CRISPR gRNA sequence
ataatatttgactccagttg

SEQ ID NO: 475795 - DNA, 20 bp, Artificial
  CRISPR gRNA sequence
gactccagttgtagctatgt

SEQ ID NO: 475796 - DNA, 20 bp, Artificial
  CRISPR gRNA sequence
actccagttgtagctatgtg

SEQ ID NO: 475797 - DNA, 20 bp, Artificial
  CRISPR gRNA sequence
cagttgtagctatgtgactg

SEQ ID NO: 475798 - DNA, 20 bp, Artificial
  CRISPR gRNA sequence
tagctatgtgactgtaggca

SEQ ID NO: 475799 - DNA, 20 bp, Artificial
  CRISPR gRNA sequence
tgtgactgtaggcatctgat

SEQ ID NO: 475800 - DNA, 20 bp, Artificial
  CRISPR gRNA sequence
taggcatctgatggaaggtg

SEQ ID NO: 475801 - DNA, 20 bp, Artificial
  CRISPR gRNA sequence
atggaaggtggaaaattcag

SEQ ID NO: 475802 - DNA, 20 bp, Artificial
  CRISPR gRNA sequence
agtcaaccatctaagcacct

SEQ ID NO: 475803 - DNA, 20 bp, Artificial
  CRISPR gRNA sequence
agcacctagttgacttaata

SEQ ID NO: 475804 - DNA, 20 bp, Artificial
  CRISPR gRNA sequence
gttgacttaatactagatac

SEQ ID NO: 475805 - DNA, 20 bp, Artificial
  CRISPR gRNA sequence
acttaatactagatacttac

SEQ ID NO: 475806 - DNA, 20 bp, Artificial
  CRISPR gRNA sequence
aatactagatacttacaaac

SEQ ID NO: 475807 - DNA, 20 bp, Artificial
  CRISPR gRNA sequence
atactagatacttacaaaca

SEQ ID NO: 475808 - DNA, 20 bp, Artificial
  CRISPR gRNA sequence
gatacttacaaacataaaga

SEQ ID NO: 475809 - DNA, 20 bp, Artificial
  CRISPR gRNA sequence
acaaacataaagatgtttga

SEQ ID NO: 475810 - DNA, 20 bp, Artificial
  CRISPR gRNA sequence
caaacataaagatgtttgag

SEQ ID NO: 475811 - DNA, 20 bp, Artificial
  CRISPR gRNA sequence
gagtaactaaggactttttt

SEQ ID NO: 475812 - DNA, 20 bp, Artificial
  CRISPR gRNA sequence
agtaactaaggactttttta

SEQ ID NO: 475813 - DNA, 20 bp, Artificial
  CRISPR gRNA sequence
aggacttttttactttgcac

SEQ ID NO: 475814 - DNA, 20 bp, Artificial
  CRISPR gRNA sequence
ttttactttgcacttggttg

SEQ ID NO: 475815 - DNA, 20 bp, Artificial
  CRISPR gRNA sequence
tttactttgcacttggttgt

SEQ ID NO: 475816 - DNA, 20 bp, Artificial
  CRISPR gRNA sequence
ttactttgcacttggttgtg

SEQ ID NO: 475817 - DNA, 20 bp, Artificial
  CRISPR gRNA sequence
tactttgcacttggttgtgt

SEQ ID NO: 475818 - DNA, 20 bp, Artificial
  CRISPR gRNA sequence
actttgcacttggttgtgtg

SEQ ID NO: 475819 - DNA, 20 bp, Artificial
  CRISPR gRNA sequence
ctttgcacttggttgtgtgg

SEQ ID NO: 475820 - DNA, 20 bp, Artificial
  CRISPR gRNA sequence
tgcacttggttgtgtggcat

SEQ ID NO: 475821 - DNA, 20 bp, Artificial
  CRISPR gRNA sequence
gcacttggttgtgtggcatc

SEQ ID NO: 475822 - DNA, 20 bp, Artificial
  CRISPR gRNA sequence
cacttggttgtgtggcatcc

SEQ ID NO: 475823 - DNA, 20 bp, Artificial
  CRISPR gRNA sequence
ggttgtgtggcatcctggca

SEQ ID NO: 475824 - DNA, 20 bp, Artificial
  CRISPR gRNA sequence
gttgtgtggcatcctggcat

SEQ ID NO: 475825 - DNA, 20 bp, Artificial
  CRISPR gRNA sequence
tgtggcatcctggcatcata

SEQ ID NO: 475826 - DNA, 20 bp, Artificial
  CRISPR gRNA sequence
gcatcatagagacatattcc

SEQ ID NO: 475827 - DNA, 20 bp, Artificial
  CRISPR gRNA sequence
caaactacacagtttaaaat

SEQ ID NO: 475828 - DNA, 20 bp, Artificial
  CRISPR gRNA sequence
cacagtttaaaattatagat

SEQ ID NO: 475829 - DNA, 20 bp, Artificial
  CRISPR gRNA sequence
aaaattatagatagactttc

SEQ ID NO: 475830 - DNA, 20 bp, Artificial
  CRISPR gRNA sequence
aaattatagatagactttcc

SEQ ID NO: 475831 - DNA, 20 bp, Artificial
  CRISPR gRNA sequence
tagatagactttccatagaa

SEQ ID NO: 475832 - DNA, 20 bp, Artificial
  CRISPR gRNA sequence
tccatagaacctcagtggcc

SEQ ID NO: 475833 - DNA, 20 bp, Artificial
  CRISPR gRNA sequence
ccatagaacctcagtggcca

SEQ ID NO: 475834 - DNA, 20 bp, Artificial
  CRISPR gRNA sequence
catagaacctcagtggccag

SEQ ID NO: 475835 - DNA, 20 bp, Artificial
  CRISPR gRNA sequence
agtggccagattttctaatt

SEQ ID NO: 475836 - DNA, 20 bp, Artificial
  CRISPR gRNA sequence
tctaatttaaaattgcagta

SEQ ID NO: 475837 - DNA, 20 bp, Artificial
  CRISPR gRNA sequence
ctaatttaaaattgcagtag

SEQ ID NO: 475838 - DNA, 20 bp, Artificial
  CRISPR gRNA sequence
taatttaaaattgcagtagc

SEQ ID NO: 475839 - DNA, 20 bp, Artificial
  CRISPR gRNA sequence
atttaaaattgcagtagcca

SEQ ID NO: 475840 - DNA, 20 bp, Artificial
  CRISPR gRNA sequence
aaaattgcagtagccaaact

SEQ ID NO: 475841 - DNA, 20 bp, Artificial
  CRISPR gRNA sequence
aaattgcagtagccaaactg

SEQ ID NO: 475842 - DNA, 20 bp, Artificial
  CRISPR gRNA sequence
cagtagccaaactgataaat

SEQ ID NO: 475843 - DNA, 20 bp, Artificial
  CRISPR gRNA sequence
ataaatgtgtgcttgtaggg

SEQ ID NO: 475844 - DNA, 20 bp, Artificial
  CRISPR gRNA sequence
gtagggaataataagacaga

SEQ ID NO: 475845 - DNA, 20 bp, Artificial
  CRISPR gRNA sequence
tagggaataataagacagaa

SEQ ID NO: 475846 - DNA, 20 bp, Artificial
  CRISPR gRNA sequence
aaaacctgaaaaatcactgg

SEQ ID NO: 475847 - DNA, 20 bp, Artificial
  CRISPR gRNA sequence
aaacctgaaaaatcactggg

SEQ ID NO: 475848 - DNA, 20 bp, Artificial
  CRISPR gRNA sequence
aaaaatcactgggcatggtg

SEQ ID NO: 475849 - DNA, 20 bp, Artificial
  CRISPR gRNA sequence
ggcatggtggctcatacctg

SEQ ID NO: 475850 - DNA, 20 bp, Artificial
  CRISPR gRNA sequence
atacctgtaatcctagcact

SEQ ID NO: 475851 - DNA, 20 bp, Artificial
  CRISPR gRNA sequence
taatcctagcactttgggag

SEQ ID NO: 475852 - DNA, 20 bp, Artificial
  CRISPR gRNA sequence
gcactttgggaggctgaggc

SEQ ID NO: 475853 - DNA, 20 bp, Artificial
  CRISPR gRNA sequence
tgggaggctgaggcaggtgg

SEQ ID NO: 475854 - DNA, 20 bp, Artificial
  CRISPR gRNA sequence
gggaggctgaggcaggtgga

SEQ ID NO: 475855 - DNA, 20 bp, Artificial
  CRISPR gRNA sequence
ggaggctgaggcaggtggat

SEQ ID NO: 475856 - DNA, 20 bp, Artificial
  CRISPR gRNA sequence
aggcaggtggatcacttgag

SEQ ID NO: 475857 - DNA, 20 bp, Artificial
  CRISPR gRNA sequence
gaggtcaggagctccagacc

SEQ ID NO: 475858 - DNA, 20 bp, Artificial
  CRISPR gRNA sequence
aggtcaggagctccagacca

SEQ ID NO: 475859 - DNA, 20 bp, Artificial
  CRISPR gRNA sequence
cagaccagcctgcccaacat

SEQ ID NO: 475860 - DNA, 20 bp, Artificial
  CRISPR gRNA sequence
cccaacatgcattgcatcca

SEQ ID NO: 475861 - DNA, 20 bp, Artificial
  CRISPR gRNA sequence
catccatagcttggctgact

SEQ ID NO: 475862 - DNA, 20 bp, Artificial
  CRISPR gRNA sequence
ggctgactttcttaaaaaac

SEQ ID NO: 475863 - DNA, 20 bp, Artificial
  CRISPR gRNA sequence
gctgactttcttaaaaaaca

SEQ ID NO: 475864 - DNA, 20 bp, Artificial
  CRISPR gRNA sequence
actttcttaaaaaacaggtt

SEQ ID NO: 475865 - DNA, 20 bp, Artificial
  CRISPR gRNA sequence
tcttaaaaaacaggttgatg

SEQ ID NO: 475866 - DNA, 20 bp, Artificial
  CRISPR gRNA sequence
cttaaaaaacaggttgatgg

SEQ ID NO: 475867 - DNA, 20 bp, Artificial
  CRISPR gRNA sequence
ttaaaaaacaggttgatggc

SEQ ID NO: 475868 - DNA, 20 bp, Artificial
  CRISPR gRNA sequence
aaaaaacaggttgatggcaa

SEQ ID NO: 475869 - DNA, 20 bp, Artificial
  CRISPR gRNA sequence
aaaaacaggttgatggcaag

SEQ ID NO: 475870 - DNA, 20 bp, Artificial
  CRISPR gRNA sequence
atggcaagaaaagagaactg

SEQ ID NO: 475871 - DNA, 20 bp, Artificial
  CRISPR gRNA sequence
agtagatgttataaatagtt

SEQ ID NO: 475872 - DNA, 20 bp, Artificial
  CRISPR gRNA sequence
taaatagttaagtacaaatc

SEQ ID NO: 475873 - DNA, 20 bp, Artificial
  CRISPR gRNA sequence
agtacaaatctatcactact

SEQ ID NO: 475874 - DNA, 20 bp, Artificial
  CRISPR gRNA sequence
tcactacttcttgcgaaaat

SEQ ID NO: 475875 - DNA, 20 bp, Artificial
  CRISPR gRNA sequence
cttcttgcgaaaatgctcag

SEQ ID NO: 475876 - DNA, 20 bp, Artificial
  CRISPR gRNA sequence
cttgcgaaaatgctcaggct

SEQ ID NO: 475877 - DNA, 20 bp, Artificial
  CRISPR gRNA sequence
ttgcgaaaatgctcaggctg

SEQ ID NO: 475878 - DNA, 20 bp, Artificial
  CRISPR gRNA sequence
gcgaaaatgctcaggctgcc

SEQ ID NO: 475879 - DNA, 20 bp, Artificial
  CRISPR gRNA sequence
cgaaaatgctcaggctgcca

SEQ ID NO: 475880 - DNA, 20 bp, Artificial
  CRISPR gRNA sequence
aggctgccacactgatgatg

SEQ ID NO: 475881 - DNA, 20 bp, Artificial
  CRISPR gRNA sequence
ccacactgatgatgaataga

SEQ ID NO: 475882 - DNA, 20 bp, Artificial
  CRISPR gRNA sequence
atgatgaatagatagctcgt

SEQ ID NO: 475883 - DNA, 20 bp, Artificial
  CRISPR gRNA sequence
gttcttcccaaactgagtgc

SEQ ID NO: 475884 - DNA, 20 bp, Artificial
  CRISPR gRNA sequence
ttcccaaactgagtgcagta

SEQ ID NO: 475885 - DNA, 20 bp, Artificial
  CRISPR gRNA sequence
cccaaactgagtgcagtaga

SEQ ID NO: 475886 - DNA, 20 bp, Artificial
  CRISPR gRNA sequence
ccaaactgagtgcagtagag

SEQ ID NO: 475887 - DNA, 20 bp, Artificial
  CRISPR gRNA sequence
agtgcagtagagtgttgcag

SEQ ID NO: 475888 - DNA, 20 bp, Artificial
  CRISPR gRNA sequence
cagtgctcagttgggtagga

SEQ ID NO: 475889 - DNA, 20 bp, Artificial
  CRISPR gRNA sequence
agttgggtaggacagatgtt

SEQ ID NO: 475890 - DNA, 20 bp, Artificial
  CRISPR gRNA sequence
ggtaggacagatgttggata

SEQ ID NO: 475891 - DNA, 20 bp, Artificial
  CRISPR gRNA sequence
gataattggggttatccaac

SEQ ID NO: 475892 - DNA, 20 bp, Artificial
  CRISPR gRNA sequence
gggttatccaacatctctac

SEQ ID NO: 475893 - DNA, 20 bp, Artificial
  CRISPR gRNA sequence
tccaacatctctactaaaaa

SEQ ID NO: 475894 - DNA, 20 bp, Artificial
  CRISPR gRNA sequence
tactaaaaatacaaaaatta

SEQ ID NO: 475895 - DNA, 20 bp, Artificial
  CRISPR gRNA sequence
ctaaaaatacaaaaattagc

SEQ ID NO: 475896 - DNA, 20 bp, Artificial
  CRISPR gRNA sequence
aaaatacaaaaattagctgt

SEQ ID NO: 475897 - DNA, 20 bp, Artificial
  CRISPR gRNA sequence
gctgtgcgtggtggaaggtg

SEQ ID NO: 475898 - DNA, 20 bp, Artificial
  CRISPR gRNA sequence
tgcgtggtggaaggtgcctg

SEQ ID NO: 475899 - DNA, 20 bp, Artificial
  CRISPR gRNA sequence
taatcccagctactagggac

SEQ ID NO: 475900 - DNA, 20 bp, Artificial
  CRISPR gRNA sequence
ctagggacgctgaggcagga

SEQ ID NO: 475901 - DNA, 20 bp, Artificial
  CRISPR gRNA sequence
gggacgctgaggcaggagaa

SEQ ID NO: 475902 - DNA, 20 bp, Artificial
  CRISPR gRNA sequence
aggcaggagaataaattgaa

SEQ ID NO: 475903 - DNA, 20 bp, Artificial
  CRISPR gRNA sequence
aacccgggaggaagaagaat

SEQ ID NO: 475904 - DNA, 20 bp, Artificial
  CRISPR gRNA sequence
aacccgggaggcagaggatg

SEQ ID NO: 475905 - DNA, 20 bp, Artificial
  CRISPR gRNA sequence
cactccagcctgggtgacga

SEQ ID NO: 475906 - DNA, 20 bp, Artificial
  CRISPR gRNA sequence
cagcctgggtgacgagagca

SEQ ID NO: 475907 - DNA, 20 bp, Artificial
  CRISPR gRNA sequence
ggtgacgagagcaaaactct

SEQ ID NO: 475908 - DNA, 20 bp, Artificial
  CRISPR gRNA sequence
ttgtctcaaaaaaataaaaa

SEQ ID NO: 475909 - DNA, 20 bp, Artificial
  CRISPR gRNA sequence
gtctcaaaaaaataaaaaaa

SEQ ID NO: 475910 - DNA, 20 bp, Artificial
  CRISPR gRNA sequence
tctcaaaaaaataaaaaaat

SEQ ID NO: 475911 - DNA, 20 bp, Artificial
  CRISPR gRNA sequence
aaaaaaataaaaaaataaaa

SEQ ID NO: 475912 - DNA, 20 bp, Artificial
  CRISPR gRNA sequence
aaaaatcagaagcttctgat

SEQ ID NO: 475913 - DNA, 20 bp, Artificial
  CRISPR gRNA sequence
ctgatgagccactcataggc

SEQ ID NO: 475914 - DNA, 20 bp, Artificial
  CRISPR gRNA sequence
tgatgagccactcataggct

SEQ ID NO: 475915 - DNA, 20 bp, Artificial
  CRISPR gRNA sequence
atgagccactcataggcttt

SEQ ID NO: 475916 - DNA, 20 bp, Artificial
  CRISPR gRNA sequence
ataggcttttcctcttgata

SEQ ID NO: 475917 - DNA, 20 bp, Artificial
  CRISPR gRNA sequence
ttcctcttgataatatgtgg

SEQ ID NO: 475918 - DNA, 20 bp, Artificial
  CRISPR gRNA sequence
tcctcttgataatatgtggg

SEQ ID NO: 475919 - DNA, 20 bp, Artificial
  CRISPR gRNA sequence
cctcttgataatatgtgggt

SEQ ID NO: 475920 - DNA, 20 bp, Artificial
  CRISPR gRNA sequence
ctcttgataatatgtgggtt

SEQ ID NO: 475921 - DNA, 20 bp, Artificial
  CRISPR gRNA sequence
ttgataatatgtgggttcct

SEQ ID NO: 475922 - DNA, 20 bp, Artificial
  CRISPR gRNA sequence
gataatatgtgggttcctat

SEQ ID NO: 475923 - DNA, 20 bp, Artificial
  CRISPR gRNA sequence
ataatatgtgggttcctatg

SEQ ID NO: 475924 - DNA, 20 bp, Artificial
  CRISPR gRNA sequence
ctatgcaatataaggtagga

SEQ ID NO: 475925 - DNA, 20 bp, Artificial
  CRISPR gRNA sequence
tgcaatataaggtaggaagc

SEQ ID NO: 475926 - DNA, 20 bp, Artificial
  CRISPR gRNA sequence
tacaataaaaaagaaattgc

SEQ ID NO: 475927 - DNA, 20 bp, Artificial
  CRISPR gRNA sequence
acaataaaaaagaaattgcc

SEQ ID NO: 475928 - DNA, 20 bp, Artificial
  CRISPR gRNA sequence
caataaaaaagaaattgcct

SEQ ID NO: 475929 - DNA, 20 bp, Artificial
  CRISPR gRNA sequence
cctttttttttttttttttt

SEQ ID NO: 475930 - DNA, 20 bp, Artificial
  CRISPR gRNA sequence
tttttttttttttttttttt

SEQ ID NO: 475931 - DNA, 20 bp, Artificial
  CRISPR gRNA sequence
tttttttttttttttttttt

SEQ ID NO: 475932 - DNA, 20 bp, Artificial
  CRISPR gRNA sequence
tttttttttttttttttttg

SEQ ID NO: 475933 - DNA, 20 bp, Artificial
  CRISPR gRNA sequence
ttttttttttttttttttgc

SEQ ID NO: 475934 - DNA, 20 bp, Artificial
  CRISPR gRNA sequence
tttttttttttttttttgcc

SEQ ID NO: 475935 - DNA, 20 bp, Artificial
  CRISPR gRNA sequence
ttttttttttttttttgcct

SEQ ID NO: 475936 - DNA, 20 bp, Artificial
  CRISPR gRNA sequence
tttttttttttttttgcctg

SEQ ID NO: 475937 - DNA, 20 bp, Artificial
  CRISPR gRNA sequence
ttttttttttttttgcctgt

SEQ ID NO: 475938 - DNA, 20 bp, Artificial
  CRISPR gRNA sequence
tttttttttttttgcctgta

SEQ ID NO: 475939 - DNA, 20 bp, Artificial
  CRISPR gRNA sequence
ttttttttttttgcctgtat

SEQ ID NO: 475940 - DNA, 20 bp, Artificial
  CRISPR gRNA sequence
tttttttttttgcctgtata

SEQ ID NO: 475941 - DNA, 20 bp, Artificial
  CRISPR gRNA sequence
ttttttttttgcctgtataa

SEQ ID NO: 475942 - DNA, 20 bp, Artificial
  CRISPR gRNA sequence
tttttttttgcctgtataaa

SEQ ID NO: 475943 - DNA, 20 bp, Artificial
  CRISPR gRNA sequence
ttttttttgcctgtataaag

SEQ ID NO: 475944 - DNA, 20 bp, Artificial
  CRISPR gRNA sequence
tttttttgcctgtataaagt

SEQ ID NO: 475945 - DNA, 20 bp, Artificial
  CRISPR gRNA sequence
ttttttgcctgtataaagtc

SEQ ID NO: 475946 - DNA, 20 bp, Artificial
  CRISPR gRNA sequence
tttttgcctgtataaagtct

SEQ ID NO: 475947 - DNA, 20 bp, Artificial
  CRISPR gRNA sequence
ttttgcctgtataaagtctt

SEQ ID NO: 475948 - DNA, 20 bp, Artificial
  CRISPR gRNA sequence
tttgcctgtataaagtcttt

SEQ ID NO: 475949 - DNA, 20 bp, Artificial
  CRISPR gRNA sequence
ttgcctgtataaagtctttg

SEQ ID NO: 475950 - DNA, 20 bp, Artificial
  CRISPR gRNA sequence
tgcctgtataaagtctttgc

SEQ ID NO: 475951 - DNA, 20 bp, Artificial
  CRISPR gRNA sequence
gcctgtataaagtctttgca

SEQ ID NO: 475952 - DNA, 20 bp, Artificial
  CRISPR gRNA sequence
cctgtataaagtctttgcag

SEQ ID NO: 475953 - DNA, 20 bp, Artificial
  CRISPR gRNA sequence
tataaagtctttgcaggggt

SEQ ID NO: 475954 - DNA, 20 bp, Artificial
  CRISPR gRNA sequence
tgcaggggtggctaaatatc

SEQ ID NO: 475955 - DNA, 20 bp, Artificial
  CRISPR gRNA sequence
gcaggggtggctaaatatca

SEQ ID NO: 475956 - DNA, 20 bp, Artificial
  CRISPR gRNA sequence
caggggtggctaaatatcat

SEQ ID NO: 475957 - DNA, 20 bp, Artificial
  CRISPR gRNA sequence
aatatcatctttgcagaatc

SEQ ID NO: 475958 - DNA, 20 bp, Artificial
  CRISPR gRNA sequence
tgcagaatccaacttatttt

SEQ ID NO: 475959 - DNA, 20 bp, Artificial
  CRISPR gRNA sequence
gcagaatccaacttattttc

SEQ ID NO: 475960 - DNA, 20 bp, Artificial
  CRISPR gRNA sequence
cagaatccaacttattttct

SEQ ID NO: 475961 - DNA, 20 bp, Artificial
  CRISPR gRNA sequence
attttctgtgttcaattgac

SEQ ID NO: 475962 - DNA, 20 bp, Artificial
  CRISPR gRNA sequence
ttttctgtgttcaattgaca

SEQ ID NO: 475963 - DNA, 20 bp, Artificial
  CRISPR gRNA sequence
tctgtgttcaattgacaacc

SEQ ID NO: 475964 - DNA, 20 bp, Artificial
  CRISPR gRNA sequence
ctgtgttcaattgacaacca

SEQ ID NO: 475965 - DNA, 20 bp, Artificial
  CRISPR gRNA sequence
tgtgttcaattgacaaccaa

SEQ ID NO: 475966 - DNA, 20 bp, Artificial
  CRISPR gRNA sequence
tgttcaattgacaaccaagt

SEQ ID NO: 475967 - DNA, 20 bp, Artificial
  CRISPR gRNA sequence
aattgacaaccaagtaggaa

SEQ ID NO: 475968 - DNA, 20 bp, Artificial
  CRISPR gRNA sequence
acaaccaagtaggaaccatt

SEQ ID NO: 475969 - DNA, 20 bp, Artificial
  CRISPR gRNA sequence
cctttcaacaaaatagaagc

SEQ ID NO: 475970 - DNA, 20 bp, Artificial
  CRISPR gRNA sequence
tcaacaaaatagaagcaatg

SEQ ID NO: 475971 - DNA, 20 bp, Artificial
  CRISPR gRNA sequence
caacaaaatagaagcaatga

SEQ ID NO: 475972 - DNA, 20 bp, Artificial
  CRISPR gRNA sequence
aacaaaatagaagcaatgac

SEQ ID NO: 475973 - DNA, 20 bp, Artificial
  CRISPR gRNA sequence
tgctcctatattttgtagca

SEQ ID NO: 475974 - DNA, 20 bp, Artificial
  CRISPR gRNA sequence
ctcctatattttgtagcatt

SEQ ID NO: 475975 - DNA, 20 bp, Artificial
  CRISPR gRNA sequence
ctatattttgtagcattttc

SEQ ID NO: 475976 - DNA, 20 bp, Artificial
  CRISPR gRNA sequence
tattttgtagcattttctca

SEQ ID NO: 475977 - DNA, 20 bp, Artificial
  CRISPR gRNA sequence
tgtagcattttctcaatcgg

SEQ ID NO: 475978 - DNA, 20 bp, Artificial
  CRISPR gRNA sequence
gtagcattttctcaatcggt

SEQ ID NO: 475979 - DNA, 20 bp, Artificial
  CRISPR gRNA sequence
tagcattttctcaatcggta

SEQ ID NO: 475980 - DNA, 20 bp, Artificial
  CRISPR gRNA sequence
tctcaatcggtattctcaag

SEQ ID NO: 475981 - DNA, 20 bp, Artificial
  CRISPR gRNA sequence
ctcaatcggtattctcaagg

SEQ ID NO: 475982 - DNA, 20 bp, Artificial
  CRISPR gRNA sequence
tcaatcggtattctcaaggc

SEQ ID NO: 475983 - DNA, 20 bp, Artificial
  CRISPR gRNA sequence
aatcggtattctcaaggcat

SEQ ID NO: 475984 - DNA, 20 bp, Artificial
  CRISPR gRNA sequence
tcaaggcatacatcccaatg

SEQ ID NO: 475985 - DNA, 20 bp, Artificial
  CRISPR gRNA sequence
aaggcatacatcccaatgaa

SEQ ID NO: 475986 - DNA, 20 bp, Artificial
  CRISPR gRNA sequence
tatttagaggtaatattatt

SEQ ID NO: 475987 - DNA, 20 bp, Artificial
  CRISPR gRNA sequence
atttagaggtaatattattt

SEQ ID NO: 475988 - DNA, 20 bp, Artificial
  CRISPR gRNA sequence
tttagaggtaatattatttg

SEQ ID NO: 475989 - DNA, 20 bp, Artificial
  CRISPR gRNA sequence
agaggtaatattatttgagg

SEQ ID NO: 475990 - DNA, 20 bp, Artificial
  CRISPR gRNA sequence
gaggtaatattatttgaggg

SEQ ID NO: 475991 - DNA, 20 bp, Artificial
  CRISPR gRNA sequence
tttgagggtaaccatggaga

SEQ ID NO: 475992 - DNA, 20 bp, Artificial
  CRISPR gRNA sequence
gagggtaaccatggagatat

SEQ ID NO: 475993 - DNA, 20 bp, Artificial
  CRISPR gRNA sequence
agggtaaccatggagatatg

SEQ ID NO: 475994 - DNA, 20 bp, Artificial
  CRISPR gRNA sequence
cgattatccaacaactgtcc

SEQ ID NO: 475995 - DNA, 20 bp, Artificial
  CRISPR gRNA sequence
tccaacaactgtcctaccca

SEQ ID NO: 475996 - DNA, 20 bp, Artificial
  CRISPR gRNA sequence
tcctacccaactgagcactg

SEQ ID NO: 475997 - DNA, 20 bp, Artificial
  CRISPR gRNA sequence
cccaactgagcactgcagca

SEQ ID NO: 475998 - DNA, 20 bp, Artificial
  CRISPR gRNA sequence
agcactgcagcactctactg

SEQ ID NO: 475999 - DNA, 20 bp, Artificial
  CRISPR gRNA sequence
cagcactctactgcactcag

SEQ ID NO: 476000 - DNA, 20 bp, Artificial
  CRISPR gRNA sequence
tactgcactcagtttggaaa

SEQ ID NO: 476001 - DNA, 20 bp, Artificial
  CRISPR gRNA sequence
ctgcactcagtttggaaaga

SEQ ID NO: 476002 - DNA, 20 bp, Artificial
  CRISPR gRNA sequence
cactcagtttggaaagaacg

SEQ ID NO: 476003 - DNA, 20 bp, Artificial
  CRISPR gRNA sequence
agtttggaaagaacgagcta

SEQ ID NO: 476004 - DNA, 20 bp, Artificial
  CRISPR gRNA sequence
ggaaagaacgagctatctat

SEQ ID NO: 476005 - DNA, 20 bp, Artificial
  CRISPR gRNA sequence
gaaagaacgagctatctatt

SEQ ID NO: 476006 - DNA, 20 bp, Artificial
  CRISPR gRNA sequence
tctattcattatcagtatgg

SEQ ID NO: 476007 - DNA, 20 bp, Artificial
  CRISPR gRNA sequence
ttcattatcagtatggcagc

SEQ ID NO: 476008 - DNA, 20 bp, Artificial
  CRISPR gRNA sequence
attatcagtatggcagccag

SEQ ID NO: 476009 - DNA, 20 bp, Artificial
  CRISPR gRNA sequence
tcagtatggcagccagagca

SEQ ID NO: 476010 - DNA, 20 bp, Artificial
  CRISPR gRNA sequence
ttgcaagaagtagtgataga

SEQ ID NO: 476011 - DNA, 20 bp, Artificial
  CRISPR gRNA sequence
tgcaagaagtagtgatagat

SEQ ID NO: 476012 - DNA, 20 bp, Artificial
  CRISPR gRNA sequence
gcaagaagtagtgatagatt

SEQ ID NO: 476013 - DNA, 20 bp, Artificial
  CRISPR gRNA sequence
caagaagtagtgatagattt

SEQ ID NO: 476014 - DNA, 20 bp, Artificial
  CRISPR gRNA sequence
gtacttaactatttataaca

SEQ ID NO: 476015 - DNA, 20 bp, Artificial
  CRISPR gRNA sequence
tacttaactatttataacat

SEQ ID NO: 476016 - DNA, 20 bp, Artificial
  CRISPR gRNA sequence
aactatttataacatctact

SEQ ID NO: 476017 - DNA, 20 bp, Artificial
  CRISPR gRNA sequence
actatttataacatctactc

SEQ ID NO: 476018 - DNA, 20 bp, Artificial
  CRISPR gRNA sequence
tttataacatctactcagtt

SEQ ID NO: 476019 - DNA, 20 bp, Artificial
  CRISPR gRNA sequence
ataacatctactcagttctc

SEQ ID NO: 476020 - DNA, 20 bp, Artificial
  CRISPR gRNA sequence
taacatctactcagttctct

SEQ ID NO: 476021 - DNA, 20 bp, Artificial
  CRISPR gRNA sequence
ctcagttctcttttcctacc

SEQ ID NO: 476022 - DNA, 20 bp, Artificial
  CRISPR gRNA sequence
agttctcttttcctaccatc

SEQ ID NO: 476023 - DNA, 20 bp, Artificial
  CRISPR gRNA sequence
tcttttcctaccatcaacat

SEQ ID NO: 476024 - DNA, 20 bp, Artificial
  CRISPR gRNA sequence
ttttcctaccatcaacatgt

SEQ ID NO: 476025 - DNA, 20 bp, Artificial
  CRISPR gRNA sequence
ttcctaccatcaacatgttt

SEQ ID NO: 476026 - DNA, 20 bp, Artificial
  CRISPR gRNA sequence
tcctaccatcaacatgtttt

SEQ ID NO: 476027 - DNA, 20 bp, Artificial
  CRISPR gRNA sequence
cctaccatcaacatgttttt

SEQ ID NO: 476028 - DNA, 20 bp, Artificial
  CRISPR gRNA sequence
ctaccatcaacatgttttta

SEQ ID NO: 476029 - DNA, 20 bp, Artificial
  CRISPR gRNA sequence
ccatcaacatgtttttaaga

SEQ ID NO: 476030 - DNA, 20 bp, Artificial
  CRISPR gRNA sequence
ttaagaaagtcagccaagct

SEQ ID NO: 476031 - DNA, 20 bp, Artificial
  CRISPR gRNA sequence
taagaaagtcagccaagcta

SEQ ID NO: 476032 - DNA, 20 bp, Artificial
  CRISPR gRNA sequence
aagaaagtcagccaagctat

SEQ ID NO: 476033 - DNA, 20 bp, Artificial
  CRISPR gRNA sequence
agaaagtcagccaagctatt

SEQ ID NO: 476034 - DNA, 20 bp, Artificial
  CRISPR gRNA sequence
ttgatgcgatgcctatgatt

SEQ ID NO: 476035 - DNA, 20 bp, Artificial
  CRISPR gRNA sequence
atgcgatgcctatgattagg

SEQ ID NO: 476036 - DNA, 20 bp, Artificial
  CRISPR gRNA sequence
tgattaggcaggtgaatact

SEQ ID NO: 476037 - DNA, 20 bp, Artificial
  CRISPR gRNA sequence
ggcaggtgaatactatgttc

SEQ ID NO: 476038 - DNA, 20 bp, Artificial
  CRISPR gRNA sequence
tgttctaatttggtttatgc

SEQ ID NO: 476039 - DNA, 20 bp, Artificial
  CRISPR gRNA sequence
taatttggtttatgctctac

SEQ ID NO: 476040 - DNA, 20 bp, Artificial
  CRISPR gRNA sequence
atttggtttatgctctacga

SEQ ID NO: 476041 - DNA, 20 bp, Artificial
  CRISPR gRNA sequence
ggtttatgctctacgatgtc

SEQ ID NO: 476042 - DNA, 20 bp, Artificial
  CRISPR gRNA sequence
gtttatgctctacgatgtct

SEQ ID NO: 476043 - DNA, 20 bp, Artificial
  CRISPR gRNA sequence
atgctctacgatgtcttcgg

SEQ ID NO: 476044 - DNA, 20 bp, Artificial
  CRISPR gRNA sequence
tgctctacgatgtcttcggt

SEQ ID NO: 476045 - DNA, 20 bp, Artificial
  CRISPR gRNA sequence
tacgatgtcttcggtaagca

SEQ ID NO: 476046 - DNA, 20 bp, Artificial
  CRISPR gRNA sequence
cgatgtcttcggtaagcaaa

SEQ ID NO: 476047 - DNA, 20 bp, Artificial
  CRISPR gRNA sequence
cggtaagcaaatgtaacagc

SEQ ID NO: 476048 - DNA, 20 bp, Artificial
  CRISPR gRNA sequence
ggtaagcaaatgtaacagct

SEQ ID NO: 476049 - DNA, 20 bp, Artificial
  CRISPR gRNA sequence
ggtttcatctacgattaccc

SEQ ID NO: 476050 - DNA, 20 bp, Artificial
  CRISPR gRNA sequence
gtttcatctacgattaccca

SEQ ID NO: 476051 - DNA, 20 bp, Artificial
  CRISPR gRNA sequence
catctacgattacccacttc

SEQ ID NO: 476052 - DNA, 20 bp, Artificial
  CRISPR gRNA sequence
atctacgattacccacttcg

SEQ ID NO: 476053 - DNA, 20 bp, Artificial
  CRISPR gRNA sequence
cgattacccacttcgtataa

SEQ ID NO: 476054 - DNA, 20 bp, Artificial
  CRISPR gRNA sequence
cccacttcgtataaacgtta

SEQ ID NO: 476055 - DNA, 20 bp, Artificial
  CRISPR gRNA sequence
cgtataaacgttacaccgta

SEQ ID NO: 476056 - DNA, 20 bp, Artificial
  CRISPR gRNA sequence
gtataaacgttacaccgtac

SEQ ID NO: 476057 - DNA, 20 bp, Artificial
  CRISPR gRNA sequence
caccgtactaagttcagcaa

SEQ ID NO: 476058 - DNA, 20 bp, Artificial
  CRISPR gRNA sequence
agttcagcaagggagaatgt

SEQ ID NO: 476059 - DNA, 20 bp, Artificial
  CRISPR gRNA sequence
agcaagggagaatgttgcct

SEQ ID NO: 476060 - DNA, 20 bp, Artificial
  CRISPR gRNA sequence
cctccaagaccccctgagaa

SEQ ID NO: 476061 - DNA, 20 bp, Artificial
  CRISPR gRNA sequence
caagaccccctgagaaataa

SEQ ID NO: 476062 - DNA, 20 bp, Artificial
  CRISPR gRNA sequence
agaaataaaaccagaaataa

SEQ ID NO: 476063 - DNA, 20 bp, Artificial
  CRISPR gRNA sequence
agcaggtgccttaccatgga

SEQ ID NO: 476064 - DNA, 20 bp, Artificial
  CRISPR gRNA sequence
accatggatgttccagatgt

SEQ ID NO: 476065 - DNA, 20 bp, Artificial
  CRISPR gRNA sequence
ccatggatgttccagatgtc

SEQ ID NO: 476066 - DNA, 20 bp, Artificial
  CRISPR gRNA sequence
cagatgtccagatatgggat

SEQ ID NO: 476067 - DNA, 20 bp, Artificial
  CRISPR gRNA sequence
agaagaagacccaaaataat

SEQ ID NO: 476068 - DNA, 20 bp, Artificial
  CRISPR gRNA sequence
cccagttccaagcatggcag

SEQ ID NO: 476069 - DNA, 20 bp, Artificial
  CRISPR gRNA sequence
ccagttccaagcatggcagg

SEQ ID NO: 476070 - DNA, 20 bp, Artificial
  CRISPR gRNA sequence
caagcatggcaggcaatgtc

SEQ ID NO: 476071 - DNA, 20 bp, Artificial
  CRISPR gRNA sequence
catttcctgcacatatcagt

SEQ ID NO: 476072 - DNA, 20 bp, Artificial
  CRISPR gRNA sequence
atttcctgcacatatcagtg

SEQ ID NO: 476073 - DNA, 20 bp, Artificial
  CRISPR gRNA sequence
cctgcacatatcagtgatgg

SEQ ID NO: 476074 - DNA, 20 bp, Artificial
  CRISPR gRNA sequence
ctgcacatatcagtgatgga

SEQ ID NO: 476075 - DNA, 20 bp, Artificial
  CRISPR gRNA sequence
cacatatcagtgatggaaaa

SEQ ID NO: 476076 - DNA, 20 bp, Artificial
  CRISPR gRNA sequence
ctcaagtagaaggctttgct

SEQ ID NO: 476077 - DNA, 20 bp, Artificial
  CRISPR gRNA sequence
aagtagaaggctttgcttcg

SEQ ID NO: 476078 - DNA, 20 bp, Artificial
  CRISPR gRNA sequence
tgcttcgtcttctgagtgct

SEQ ID NO: 476079 - DNA, 20 bp, Artificial
  CRISPR gRNA sequence
gcttcgtcttctgagtgctg

SEQ ID NO: 476080 - DNA, 20 bp, Artificial
  CRISPR gRNA sequence
cttcgtcttctgagtgctgc

SEQ ID NO: 476081 - DNA, 20 bp, Artificial
  CRISPR gRNA sequence
cgtcttctgagtgctgcaga

SEQ ID NO: 476082 - DNA, 20 bp, Artificial
  CRISPR gRNA sequence
gtcttctgagtgctgcagag

SEQ ID NO: 476083 - DNA, 20 bp, Artificial
  CRISPR gRNA sequence
ctgagtgctgcagagttggg

SEQ ID NO: 476084 - DNA, 20 bp, Artificial
  CRISPR gRNA sequence
tgagtgctgcagagttgggt

SEQ ID NO: 476085 - DNA, 20 bp, Artificial
  CRISPR gRNA sequence
agtgctgcagagttgggtca

SEQ ID NO: 476086 - DNA, 20 bp, Artificial
  CRISPR gRNA sequence
cagagttgggtcagtttacc

SEQ ID NO: 476087 - DNA, 20 bp, Artificial
  CRISPR gRNA sequence
ggtcagtttacctaccccag

SEQ ID NO: 476088 - DNA, 20 bp, Artificial
  CRISPR gRNA sequence
acctaccccagtggcatctg

SEQ ID NO: 476089 - DNA, 20 bp, Artificial
  CRISPR gRNA sequence
cctaccccagtggcatctgt

SEQ ID NO: 476090 - DNA, 20 bp, Artificial
  CRISPR gRNA sequence
ccccagtggcatctgtgaaa

SEQ ID NO: 476091 - DNA, 20 bp, Artificial
  CRISPR gRNA sequence
tgaaataactaaaaaaaaaa

SEQ ID NO: 476092 - DNA, 20 bp, Artificial
  CRISPR gRNA sequence
aaaaaaaaaaaaaaagaaga

SEQ ID NO: 476093 - DNA, 20 bp, Artificial
  CRISPR gRNA sequence
gatgattttgtgaaaaaaag

SEQ ID NO: 476094 - DNA, 20 bp, Artificial
  CRISPR gRNA sequence
tgtgaaaaaaagtgaacaga

SEQ ID NO: 476095 - DNA, 20 bp, Artificial
  CRISPR gRNA sequence
gtgaaaaaaagtgaacagaa

SEQ ID NO: 476096 - DNA, 20 bp, Artificial
  CRISPR gRNA sequence
tgaaaaaaagtgaacagaaa

SEQ ID NO: 476097 - DNA, 20 bp, Artificial
  CRISPR gRNA sequence
tgttctgtggtttttgcttc

SEQ ID NO: 476098 - DNA, 20 bp, Artificial
  CRISPR gRNA sequence
ttctgtggtttttgcttctt

SEQ ID NO: 476099 - DNA, 20 bp, Artificial
  CRISPR gRNA sequence
tgtggtttttgcttcttgtc

SEQ ID NO: 476100 - DNA, 20 bp, Artificial
  CRISPR gRNA sequence
tggtttttgcttcttgtcag

SEQ ID NO: 476101 - DNA, 20 bp, Artificial
  CRISPR gRNA sequence
ttgcttcttgtcaggttggc

SEQ ID NO: 476102 - DNA, 20 bp, Artificial
  CRISPR gRNA sequence
tgcttcttgtcaggttggct

SEQ ID NO: 476103 - DNA, 20 bp, Artificial
  CRISPR gRNA sequence
gcttcttgtcaggttggctg

SEQ ID NO: 476104 - DNA, 20 bp, Artificial
  CRISPR gRNA sequence
cttcttgtcaggttggctgt

SEQ ID NO: 476105 - DNA, 20 bp, Artificial
  CRISPR gRNA sequence
cttgtcaggttggctgttca

SEQ ID NO: 476106 - DNA, 20 bp, Artificial
  CRISPR gRNA sequence
ttgtcaggttggctgttcac

SEQ ID NO: 476107 - DNA, 20 bp, Artificial
  CRISPR gRNA sequence
gtcaggttggctgttcactt

SEQ ID NO: 476108 - DNA, 20 bp, Artificial
  CRISPR gRNA sequence
tcaggttggctgttcacttt

SEQ ID NO: 476109 - DNA, 20 bp, Artificial
  CRISPR gRNA sequence
gctgttcactttcaaacact

SEQ ID NO: 476110 - DNA, 20 bp, Artificial
  CRISPR gRNA sequence
ttcactttcaaacactgtga

SEQ ID NO: 476111 - DNA, 20 bp, Artificial
  CRISPR gRNA sequence
actttcaaacactgtgatct

SEQ ID NO: 476112 - DNA, 20 bp, Artificial
  CRISPR gRNA sequence
tcaaacactgtgatctgcaa

SEQ ID NO: 476113 - DNA, 20 bp, Artificial
  CRISPR gRNA sequence
caaacactgtgatctgcaaa

SEQ ID NO: 476114 - DNA, 20 bp, Artificial
  CRISPR gRNA sequence
aaacactgtgatctgcaaag

SEQ ID NO: 476115 - DNA, 20 bp, Artificial
  CRISPR gRNA sequence
tgatctgcaaagcagctcag

SEQ ID NO: 476116 - DNA, 20 bp, Artificial
  CRISPR gRNA sequence
caaagcagctcagtccttaa

SEQ ID NO: 476117 - DNA, 20 bp, Artificial
  CRISPR gRNA sequence
agtccttaacttctccttcc

SEQ ID NO: 476118 - DNA, 20 bp, Artificial
  CRISPR gRNA sequence
aacttctccttccgctctac

SEQ ID NO: 476119 - DNA, 20 bp, Artificial
  CRISPR gRNA sequence
acttctccttccgctctacc

SEQ ID NO: 476120 - DNA, 20 bp, Artificial
  CRISPR gRNA sequence
ctccttccgctctaccacgt

SEQ ID NO: 476121 - DNA, 20 bp, Artificial
  CRISPR gRNA sequence
tccttccgctctaccacgtt

SEQ ID NO: 476122 - DNA, 20 bp, Artificial
  CRISPR gRNA sequence
cttccgctctaccacgtttt

SEQ ID NO: 476123 - DNA, 20 bp, Artificial
  CRISPR gRNA sequence
ccgctctaccacgtttttgc

SEQ ID NO: 476124 - DNA, 20 bp, Artificial
  CRISPR gRNA sequence
cgctctaccacgtttttgcc

SEQ ID NO: 476125 - DNA, 20 bp, Artificial
  CRISPR gRNA sequence
taccacgtttttgccccagg

SEQ ID NO: 476126 - DNA, 20 bp, Artificial
  CRISPR gRNA sequence
ccacgtttttgccccaggtt

SEQ ID NO: 476127 - DNA, 20 bp, Artificial
  CRISPR gRNA sequence
ttgccccaggttgaggtttt

SEQ ID NO: 476128 - DNA, 20 bp, Artificial
  CRISPR gRNA sequence
tgccccaggttgaggttttt

SEQ ID NO: 476129 - DNA, 20 bp, Artificial
  CRISPR gRNA sequence
gccccaggttgaggtttttc

SEQ ID NO: 476130 - DNA, 20 bp, Artificial
  CRISPR gRNA sequence
ccccaggttgaggtttttcc

SEQ ID NO: 476131 - DNA, 20 bp, Artificial
  CRISPR gRNA sequence
aggtttttcctgcactcaat

SEQ ID NO: 476132 - DNA, 20 bp, Artificial
  CRISPR gRNA sequence
ttcctgcactcaatgttcag

SEQ ID NO: 476133 - DNA, 20 bp, Artificial
  CRISPR gRNA sequence
tcctgcactcaatgttcagt

SEQ ID NO: 476134 - DNA, 20 bp, Artificial
  CRISPR gRNA sequence
cctgcactcaatgttcagtg

SEQ ID NO: 476135 - DNA, 20 bp, Artificial
  CRISPR gRNA sequence
ctgcactcaatgttcagtga

SEQ ID NO: 476136 - DNA, 20 bp, Artificial
  CRISPR gRNA sequence
cactcaatgttcagtgaaat

SEQ ID NO: 476137 - DNA, 20 bp, Artificial
  CRISPR gRNA sequence
aatgttcagtgaaatgagca

SEQ ID NO: 476138 - DNA, 20 bp, Artificial
  CRISPR gRNA sequence
agtgaaatgagcaattaaac

SEQ ID NO: 476139 - DNA, 20 bp, Artificial
  CRISPR gRNA sequence
aactttaaagaaatctgtat

SEQ ID NO: 476140 - DNA, 20 bp, Artificial
  CRISPR gRNA sequence
taaagaaatctgtattgttg

SEQ ID NO: 476141 - DNA, 20 bp, Artificial
  CRISPR gRNA sequence
aaagaaatctgtattgttgc

SEQ ID NO: 476142 - DNA, 20 bp, Artificial
  CRISPR gRNA sequence
aagaaatctgtattgttgca

SEQ ID NO: 476143 - DNA, 20 bp, Artificial
  CRISPR gRNA sequence
tattgttgcagtctttaagt

SEQ ID NO: 476144 - DNA, 20 bp, Artificial
  CRISPR gRNA sequence
ttgcagtctttaagttgaga

SEQ ID NO: 476145 - DNA, 20 bp, Artificial
  CRISPR gRNA sequence
cagtctttaagttgagattt

SEQ ID NO: 476146 - DNA, 20 bp, Artificial
  CRISPR gRNA sequence
taagttgagattttaatcaa

SEQ ID NO: 476147 - DNA, 20 bp, Artificial
  CRISPR gRNA sequence
aagttgagattttaatcaaa

SEQ ID NO: 476148 - DNA, 20 bp, Artificial
  CRISPR gRNA sequence
agttgagattttaatcaaat

SEQ ID NO: 476149 - DNA, 20 bp, Artificial
  CRISPR gRNA sequence
agattttaatcaaattaagg

SEQ ID NO: 476150 - DNA, 20 bp, Artificial
  CRISPR gRNA sequence
taatcaaattaaggtcagga

SEQ ID NO: 476151 - DNA, 20 bp, Artificial
  CRISPR gRNA sequence
aatcaaattaaggtcaggaa

SEQ ID NO: 476152 - DNA, 20 bp, Artificial
  CRISPR gRNA sequence
atcaaattaaggtcaggaaa

SEQ ID NO: 476153 - DNA, 20 bp, Artificial
  CRISPR gRNA sequence
cctgaccttaatttgattaa

SEQ ID NO: 476154 - DNA, 20 bp, Artificial
  CRISPR gRNA sequence
ctgaccttaatttgattaaa

SEQ ID NO: 476155 - DNA, 20 bp, Artificial
  CRISPR gRNA sequence
accttaatttgattaaaatc

SEQ ID NO: 476156 - DNA, 20 bp, Artificial
  CRISPR gRNA sequence
aatttgattaaaatctcaac

SEQ ID NO: 476157 - DNA, 20 bp, Artificial
  CRISPR gRNA sequence
atttgattaaaatctcaact

SEQ ID NO: 476158 - DNA, 20 bp, Artificial
  CRISPR gRNA sequence
gattaaaatctcaacttaaa

SEQ ID NO: 476159 - DNA, 20 bp, Artificial
  CRISPR gRNA sequence
attaaaatctcaacttaaag

SEQ ID NO: 476160 - DNA, 20 bp, Artificial
  CRISPR gRNA sequence
aaatctcaacttaaagactg

SEQ ID NO: 476161 - DNA, 20 bp, Artificial
  CRISPR gRNA sequence
aacttaaagactgcaacaat

SEQ ID NO: 476162 - DNA, 20 bp, Artificial
  CRISPR gRNA sequence
aaagactgcaacaatacaga

SEQ ID NO: 476163 - DNA, 20 bp, Artificial
  CRISPR gRNA sequence
aagactgcaacaatacagat

SEQ ID NO: 476164 - DNA, 20 bp, Artificial
  CRISPR gRNA sequence
caacaatacagatttcttta

SEQ ID NO: 476165 - DNA, 20 bp, Artificial
  CRISPR gRNA sequence
ctttaaagtttaattgctca

SEQ ID NO: 476166 - DNA, 20 bp, Artificial
  CRISPR gRNA sequence
tttaaagtttaattgctcat

SEQ ID NO: 476167 - DNA, 20 bp, Artificial
  CRISPR gRNA sequence
taaagtttaattgctcattt

SEQ ID NO: 476168 - DNA, 20 bp, Artificial
  CRISPR gRNA sequence
aaagtttaattgctcatttc

SEQ ID NO: 476169 - DNA, 20 bp, Artificial
  CRISPR gRNA sequence
aagtttaattgctcatttca

SEQ ID NO: 476170 - DNA, 20 bp, Artificial
  CRISPR gRNA sequence
aattgctcatttcactgaac

SEQ ID NO: 476171 - DNA, 20 bp, Artificial
  CRISPR gRNA sequence
attgctcatttcactgaaca

SEQ ID NO: 476172 - DNA, 20 bp, Artificial
  CRISPR gRNA sequence
ctcatttcactgaacattga

SEQ ID NO: 476173 - DNA, 20 bp, Artificial
  CRISPR gRNA sequence
atttcactgaacattgagtg

SEQ ID NO: 476174 - DNA, 20 bp, Artificial
  CRISPR gRNA sequence
cactgaacattgagtgcagg

SEQ ID NO: 476175 - DNA, 20 bp, Artificial
  CRISPR gRNA sequence
actgaacattgagtgcagga

SEQ ID NO: 476176 - DNA, 20 bp, Artificial
  CRISPR gRNA sequence
aacattgagtgcaggaaaaa

SEQ ID NO: 476177 - DNA, 20 bp, Artificial
  CRISPR gRNA sequence
agtgcaggaaaaacctcaac

SEQ ID NO: 476178 - DNA, 20 bp, Artificial
  CRISPR gRNA sequence
aacctggggcaaaaacgtgg

SEQ ID NO: 476179 - DNA, 20 bp, Artificial
  CRISPR gRNA sequence
gggcaaaaacgtggtagagc

SEQ ID NO: 476180 - DNA, 20 bp, Artificial
  CRISPR gRNA sequence
aggactgagctgctttgcag

SEQ ID NO: 476181 - DNA, 20 bp, Artificial
  CRISPR gRNA sequence
agctgctttgcagatcacag

SEQ ID NO: 476182 - DNA, 20 bp, Artificial
  CRISPR gRNA sequence
ctttgcagatcacagtgttt

SEQ ID NO: 476183 - DNA, 20 bp, Artificial
  CRISPR gRNA sequence
tgcagatcacagtgtttgaa

SEQ ID NO: 476184 - DNA, 20 bp, Artificial
  CRISPR gRNA sequence
gcagatcacagtgtttgaaa

SEQ ID NO: 476185 - DNA, 20 bp, Artificial
  CRISPR gRNA sequence
cagatcacagtgtttgaaag

SEQ ID NO: 476186 - DNA, 20 bp, Artificial
  CRISPR gRNA sequence
gaaagtgaacagccaacctg

SEQ ID NO: 476187 - DNA, 20 bp, Artificial
  CRISPR gRNA sequence
aaagtgaacagccaacctga

SEQ ID NO: 476188 - DNA, 20 bp, Artificial
  CRISPR gRNA sequence
acaagaagcaaaaaccacag

SEQ ID NO: 476189 - DNA, 20 bp, Artificial
  CRISPR gRNA sequence
tctgttcactttttttcaca

SEQ ID NO: 476190 - DNA, 20 bp, Artificial
  CRISPR gRNA sequence
ctgttcactttttttcacaa

SEQ ID NO: 476191 - DNA, 20 bp, Artificial
  CRISPR gRNA sequence
tgttcactttttttcacaaa

SEQ ID NO: 476192 - DNA, 20 bp, Artificial
  CRISPR gRNA sequence
ttcactttttttcacaaaat

SEQ ID NO: 476193 - DNA, 20 bp, Artificial
  CRISPR gRNA sequence
actttttttcacaaaatcat

SEQ ID NO: 476194 - DNA, 20 bp, Artificial
  CRISPR gRNA sequence
tttttcacaaaatcatccag

SEQ ID NO: 476195 - DNA, 20 bp, Artificial
  CRISPR gRNA sequence
ttttcacaaaatcatccagg

SEQ ID NO: 476196 - DNA, 20 bp, Artificial
  CRISPR gRNA sequence
tttcacaaaatcatccaggc

SEQ ID NO: 476197 - DNA, 20 bp, Artificial
  CRISPR gRNA sequence
ttcacaaaatcatccaggct

SEQ ID NO: 476198 - DNA, 20 bp, Artificial
  CRISPR gRNA sequence
tcacaaaatcatccaggctc

SEQ ID NO: 476199 - DNA, 20 bp, Artificial
  CRISPR gRNA sequence
cacaaaatcatccaggctct

SEQ ID NO: 476200 - DNA, 20 bp, Artificial
  CRISPR gRNA sequence
acaaaatcatccaggctctt

SEQ ID NO: 476201 - DNA, 20 bp, Artificial
  CRISPR gRNA sequence
ttcctactctcctctcttac

SEQ ID NO: 476202 - DNA, 20 bp, Artificial
  CRISPR gRNA sequence
cctactctcctctcttacca

SEQ ID NO: 476203 - DNA, 20 bp, Artificial
  CRISPR gRNA sequence
ctactctcctctcttaccac

SEQ ID NO: 476204 - DNA, 20 bp, Artificial
  CRISPR gRNA sequence
ctctcctctcttaccacctc

SEQ ID NO: 476205 - DNA, 20 bp, Artificial
  CRISPR gRNA sequence
tcctctcttaccacctctct

SEQ ID NO: 476206 - DNA, 20 bp, Artificial
  CRISPR gRNA sequence
ctctcttaccacctctctct

SEQ ID NO: 476207 - DNA, 20 bp, Artificial
  CRISPR gRNA sequence
tcttaccacctctctcttct

SEQ ID NO: 476208 - DNA, 20 bp, Artificial
  CRISPR gRNA sequence
ttaccacctctctcttcttt

SEQ ID NO: 476209 - DNA, 20 bp, Artificial
  CRISPR gRNA sequence
accacctctctcttcttttt

SEQ ID NO: 476210 - DNA, 20 bp, Artificial
  CRISPR gRNA sequence
ccacctctctcttctttttt

SEQ ID NO: 476211 - DNA, 20 bp, Artificial
  CRISPR gRNA sequence
tctcttcttttttttttttt

SEQ ID NO: 476212 - DNA, 20 bp, Artificial
  CRISPR gRNA sequence
tcttcttttttttttttttt

SEQ ID NO: 476213 - DNA, 20 bp, Artificial
  CRISPR gRNA sequence
ttctttttttttttttttta

SEQ ID NO: 476214 - DNA, 20 bp, Artificial
  CRISPR gRNA sequence
cttttttttttttttttagt

SEQ ID NO: 476215 - DNA, 20 bp, Artificial
  CRISPR gRNA sequence
ttttttttttttttttagtt

SEQ ID NO: 476216 - DNA, 20 bp, Artificial
  CRISPR gRNA sequence
ttttttttttttttagttat

SEQ ID NO: 476217 - DNA, 20 bp, Artificial
  CRISPR gRNA sequence
tttttttttttttagttatt

SEQ ID NO: 476218 - DNA, 20 bp, Artificial
  CRISPR gRNA sequence
ttttttttttttagttattt

SEQ ID NO: 476219 - DNA, 20 bp, Artificial
  CRISPR gRNA sequence
tttttttttttagttatttc

SEQ ID NO: 476220 - DNA, 20 bp, Artificial
  CRISPR gRNA sequence
ttttttttttagttatttca

SEQ ID NO: 476221 - DNA, 20 bp, Artificial
  CRISPR gRNA sequence
tttttttttagttatttcac

SEQ ID NO: 476222 - DNA, 20 bp, Artificial
  CRISPR gRNA sequence
ttttttttagttatttcaca

SEQ ID NO: 476223 - DNA, 20 bp, Artificial
  CRISPR gRNA sequence
tttttttagttatttcacag

SEQ ID NO: 476224 - DNA, 20 bp, Artificial
  CRISPR gRNA sequence
ttttttagttatttcacaga

SEQ ID NO: 476225 - DNA, 20 bp, Artificial
  CRISPR gRNA sequence
tttttagttatttcacagat

SEQ ID NO: 476226 - DNA, 20 bp, Artificial
  CRISPR gRNA sequence
ttttagttatttcacagatg

SEQ ID NO: 476227 - DNA, 20 bp, Artificial
  CRISPR gRNA sequence
tttagttatttcacagatgc

SEQ ID NO: 476228 - DNA, 20 bp, Artificial
  CRISPR gRNA sequence
ttagttatttcacagatgcc

SEQ ID NO: 476229 - DNA, 20 bp, Artificial
  CRISPR gRNA sequence
tagttatttcacagatgcca

SEQ ID NO: 476230 - DNA, 20 bp, Artificial
  CRISPR gRNA sequence
agttatttcacagatgccac

SEQ ID NO: 476231 - DNA, 20 bp, Artificial
  CRISPR gRNA sequence
gttatttcacagatgccact

SEQ ID NO: 476232 - DNA, 20 bp, Artificial
  CRISPR gRNA sequence
tttcacagatgccactgggg

SEQ ID NO: 476233 - DNA, 20 bp, Artificial
  CRISPR gRNA sequence
cacagatgccactggggtag

SEQ ID NO: 476234 - DNA, 20 bp, Artificial
  CRISPR gRNA sequence
acagatgccactggggtagg

SEQ ID NO: 476235 - DNA, 20 bp, Artificial
  CRISPR gRNA sequence
gggtaggtaaactgacccaa

SEQ ID NO: 476236 - DNA, 20 bp, Artificial
  CRISPR gRNA sequence
acccaactctgcagcactca

SEQ ID NO: 476237 - DNA, 20 bp, Artificial
  CRISPR gRNA sequence
tgcagcactcagaagacgaa

SEQ ID NO: 476238 - DNA, 20 bp, Artificial
  CRISPR gRNA sequence
cagcactcagaagacgaagc

SEQ ID NO: 476239 - DNA, 20 bp, Artificial
  CRISPR gRNA sequence
agaagacgaagcaaagcctt

SEQ ID NO: 476240 - DNA, 20 bp, Artificial
  CRISPR gRNA sequence
ctacttgagcagtttttcca

SEQ ID NO: 476241 - DNA, 20 bp, Artificial
  CRISPR gRNA sequence
tacttgagcagtttttccat

SEQ ID NO: 476242 - DNA, 20 bp, Artificial
  CRISPR gRNA sequence
cttgagcagtttttccatca

SEQ ID NO: 476243 - DNA, 20 bp, Artificial
  CRISPR gRNA sequence
gagcagtttttccatcactg

SEQ ID NO: 476244 - DNA, 20 bp, Artificial
  CRISPR gRNA sequence
agcagtttttccatcactga

SEQ ID NO: 476245 - DNA, 20 bp, Artificial
  CRISPR gRNA sequence
ttccatcactgatatgtgca

SEQ ID NO: 476246 - DNA, 20 bp, Artificial
  CRISPR gRNA sequence
tccatcactgatatgtgcag

SEQ ID NO: 476247 - DNA, 20 bp, Artificial
  CRISPR gRNA sequence
ccatcactgatatgtgcagg

SEQ ID NO: 476248 - DNA, 20 bp, Artificial
  CRISPR gRNA sequence
catcactgatatgtgcagga

SEQ ID NO: 476249 - DNA, 20 bp, Artificial
  CRISPR gRNA sequence
atatgtgcaggaaatgaaga

SEQ ID NO: 476250 - DNA, 20 bp, Artificial
  CRISPR gRNA sequence
cctgccatgcttggaactgg

SEQ ID NO: 476251 - DNA, 20 bp, Artificial
  CRISPR gRNA sequence
ccatgcttggaactgggaaa

SEQ ID NO: 476252 - DNA, 20 bp, Artificial
  CRISPR gRNA sequence
ggaactgggaaattattttg

SEQ ID NO: 476253 - DNA, 20 bp, Artificial
  CRISPR gRNA sequence
gaactgggaaattattttgg

SEQ ID NO: 476254 - DNA, 20 bp, Artificial
  CRISPR gRNA sequence
ggaaattattttgggtcttc

SEQ ID NO: 476255 - DNA, 20 bp, Artificial
  CRISPR gRNA sequence
ttttgggtcttcttcttaat

SEQ ID NO: 476256 - DNA, 20 bp, Artificial
  CRISPR gRNA sequence
tgggtcttcttcttaatccc

SEQ ID NO: 476257 - DNA, 20 bp, Artificial
  CRISPR gRNA sequence
gggtcttcttcttaatccca

SEQ ID NO: 476258 - DNA, 20 bp, Artificial
  CRISPR gRNA sequence
ggtcttcttcttaatcccat

SEQ ID NO: 476259 - DNA, 20 bp, Artificial
  CRISPR gRNA sequence
cttcttaatcccatatctgg

SEQ ID NO: 476260 - DNA, 20 bp, Artificial
  CRISPR gRNA sequence
ttcttaatcccatatctgga

SEQ ID NO: 476261 - DNA, 20 bp, Artificial
  CRISPR gRNA sequence
cttaatcccatatctggaca

SEQ ID NO: 476262 - DNA, 20 bp, Artificial
  CRISPR gRNA sequence
ttaatcccatatctggacat

SEQ ID NO: 476263 - DNA, 20 bp, Artificial
  CRISPR gRNA sequence
aatcccatatctggacatct

SEQ ID NO: 476264 - DNA, 20 bp, Artificial
  CRISPR gRNA sequence
atcccatatctggacatctg

SEQ ID NO: 476265 - DNA, 20 bp, Artificial
  CRISPR gRNA sequence
gacatctggaacatccatgg

SEQ ID NO: 476266 - DNA, 20 bp, Artificial
  CRISPR gRNA sequence
gaacatccatggtaaggcac

SEQ ID NO: 476267 - DNA, 20 bp, Artificial
  CRISPR gRNA sequence
cttaggttatttctggtttt

SEQ ID NO: 476268 - DNA, 20 bp, Artificial
  CRISPR gRNA sequence
aggttatttctggttttatt

SEQ ID NO: 476269 - DNA, 20 bp, Artificial
  CRISPR gRNA sequence
ggttatttctggttttattt

SEQ ID NO: 476270 - DNA, 20 bp, Artificial
  CRISPR gRNA sequence
tttctggttttatttctcag

SEQ ID NO: 476271 - DNA, 20 bp, Artificial
  CRISPR gRNA sequence
ctggttttatttctcagggg

SEQ ID NO: 476272 - DNA, 20 bp, Artificial
  CRISPR gRNA sequence
tggttttatttctcaggggg

SEQ ID NO: 476273 - DNA, 20 bp, Artificial
  CRISPR gRNA sequence
gttttatttctcagggggtc

SEQ ID NO: 476274 - DNA, 20 bp, Artificial
  CRISPR gRNA sequence
tatttctcagggggtcttgg

SEQ ID NO: 476275 - DNA, 20 bp, Artificial
  CRISPR gRNA sequence
atttctcagggggtcttgga

SEQ ID NO: 476276 - DNA, 20 bp, Artificial
  CRISPR gRNA sequence
tttctcagggggtcttggag

SEQ ID NO: 476277 - DNA, 20 bp, Artificial
  CRISPR gRNA sequence
ctcagggggtcttggaggca

SEQ ID NO: 476278 - DNA, 20 bp, Artificial
  CRISPR gRNA sequence
tcagggggtcttggaggcaa

SEQ ID NO: 476279 - DNA, 20 bp, Artificial
  CRISPR gRNA sequence
agggggtcttggaggcaaca

SEQ ID NO: 476280 - DNA, 20 bp, Artificial
  CRISPR gRNA sequence
ggaggcaacattctcccttg

SEQ ID NO: 476281 - DNA, 20 bp, Artificial
  CRISPR gRNA sequence
gaggcaacattctcccttgc

SEQ ID NO: 476282 - DNA, 20 bp, Artificial
  CRISPR gRNA sequence
tcccttgctgaacttagtac

SEQ ID NO: 476283 - DNA, 20 bp, Artificial
  CRISPR gRNA sequence
ccttgctgaacttagtacgg

SEQ ID NO: 476284 - DNA, 20 bp, Artificial
  CRISPR gRNA sequence
gctgaacttagtacggtgta

SEQ ID NO: 476285 - DNA, 20 bp, Artificial
  CRISPR gRNA sequence
ctgaacttagtacggtgtaa

SEQ ID NO: 476286 - DNA, 20 bp, Artificial
  CRISPR gRNA sequence
aacttagtacggtgtaacgt

SEQ ID NO: 476287 - DNA, 20 bp, Artificial
  CRISPR gRNA sequence
agtacggtgtaacgtttata

SEQ ID NO: 476288 - DNA, 20 bp, Artificial
  CRISPR gRNA sequence
gtacggtgtaacgtttatac

SEQ ID NO: 476289 - DNA, 20 bp, Artificial
  CRISPR gRNA sequence
atacgaagtgggtaatcgta

SEQ ID NO: 476290 - DNA, 20 bp, Artificial
  CRISPR gRNA sequence
tacgaagtgggtaatcgtag

SEQ ID NO: 476291 - DNA, 20 bp, Artificial
  CRISPR gRNA sequence
ttacatttgcttaccgaaga

SEQ ID NO: 476292 - DNA, 20 bp, Artificial
  CRISPR gRNA sequence
catttgcttaccgaagacat

SEQ ID NO: 476293 - DNA, 20 bp, Artificial
  CRISPR gRNA sequence
gcttaccgaagacatcgtag

SEQ ID NO: 476294 - DNA, 20 bp, Artificial
  CRISPR gRNA sequence
cttaccgaagacatcgtaga

SEQ ID NO: 476295 - DNA, 20 bp, Artificial
  CRISPR gRNA sequence
accgaagacatcgtagagca

SEQ ID NO: 476296 - DNA, 20 bp, Artificial
  CRISPR gRNA sequence
ccgaagacatcgtagagcat

SEQ ID NO: 476297 - DNA, 20 bp, Artificial
  CRISPR gRNA sequence
gaacatagtattcacctgcc

SEQ ID NO: 476298 - DNA, 20 bp, Artificial
  CRISPR gRNA sequence
acctgcctaatcataggcat

SEQ ID NO: 476299 - DNA, 20 bp, Artificial
  CRISPR gRNA sequence
cctaatcataggcatcgcat

SEQ ID NO: 476300 - DNA, 20 bp, Artificial
  CRISPR gRNA sequence
atcataggcatcgcatcaat

SEQ ID NO: 476301 - DNA, 20 bp, Artificial
  CRISPR gRNA sequence
ggctgactttcttaaaaaca

SEQ ID NO: 476302 - DNA, 20 bp, Artificial
  CRISPR gRNA sequence
gctgactttcttaaaaacat

SEQ ID NO: 476303 - DNA, 20 bp, Artificial
  CRISPR gRNA sequence
actttcttaaaaacatgttg

SEQ ID NO: 476304 - DNA, 20 bp, Artificial
  CRISPR gRNA sequence
tcttaaaaacatgttgatgg

SEQ ID NO: 476305 - DNA, 20 bp, Artificial
  CRISPR gRNA sequence
cttaaaaacatgttgatggt

SEQ ID NO: 476306 - DNA, 20 bp, Artificial
  CRISPR gRNA sequence
ttaaaaacatgttgatggta

SEQ ID NO: 476307 - DNA, 20 bp, Artificial
  CRISPR gRNA sequence
aaaaacatgttgatggtagg

SEQ ID NO: 476308 - DNA, 20 bp, Artificial
  CRISPR gRNA sequence
aaaacatgttgatggtagga

SEQ ID NO: 476309 - DNA, 20 bp, Artificial
  CRISPR gRNA sequence
atggtaggaaaagagaactg

SEQ ID NO: 476310 - DNA, 20 bp, Artificial
  CRISPR gRNA sequence
agtagatgttataaatagtt

SEQ ID NO: 476311 - DNA, 20 bp, Artificial
  CRISPR gRNA sequence
taaatagttaagtacaaatc

SEQ ID NO: 476312 - DNA, 20 bp, Artificial
  CRISPR gRNA sequence
agtacaaatctatcactact

SEQ ID NO: 476313 - DNA, 20 bp, Artificial
  CRISPR gRNA sequence
tcactacttcttgcaaaaat

SEQ ID NO: 476314 - DNA, 20 bp, Artificial
  CRISPR gRNA sequence
cttcttgcaaaaatgctctg

SEQ ID NO: 476315 - DNA, 20 bp, Artificial
  CRISPR gRNA sequence
cttgcaaaaatgctctggct

SEQ ID NO: 476316 - DNA, 20 bp, Artificial
  CRISPR gRNA sequence
ttgcaaaaatgctctggctg

SEQ ID NO: 476317 - DNA, 20 bp, Artificial
  CRISPR gRNA sequence
gcaaaaatgctctggctgcc

SEQ ID NO: 476318 - DNA, 20 bp, Artificial
  CRISPR gRNA sequence
caaaaatgctctggctgcca

SEQ ID NO: 476319 - DNA, 20 bp, Artificial
  CRISPR gRNA sequence
tggctgccatactgataatg

SEQ ID NO: 476320 - DNA, 20 bp, Artificial
  CRISPR gRNA sequence
gctgccatactgataatgaa

SEQ ID NO: 476321 - DNA, 20 bp, Artificial
  CRISPR gRNA sequence
ccatactgataatgaataga

SEQ ID NO: 476322 - DNA, 20 bp, Artificial
  CRISPR gRNA sequence
ataatgaatagatagctcgt

SEQ ID NO: 476323 - DNA, 20 bp, Artificial
  CRISPR gRNA sequence
gttctttccaaactgagtgc

SEQ ID NO: 476324 - DNA, 20 bp, Artificial
  CRISPR gRNA sequence
tttccaaactgagtgcagta

SEQ ID NO: 476325 - DNA, 20 bp, Artificial
  CRISPR gRNA sequence
tccaaactgagtgcagtaga

SEQ ID NO: 476326 - DNA, 20 bp, Artificial
  CRISPR gRNA sequence
ccaaactgagtgcagtagag

SEQ ID NO: 476327 - DNA, 20 bp, Artificial
  CRISPR gRNA sequence
caaactgagtgcagtagagt

SEQ ID NO: 476328 - DNA, 20 bp, Artificial
  CRISPR gRNA sequence
agtgcagtagagtgctgcag

SEQ ID NO: 476329 - DNA, 20 bp, Artificial
  CRISPR gRNA sequence
cagtgctcagttgggtagga

SEQ ID NO: 476330 - DNA, 20 bp, Artificial
  CRISPR gRNA sequence
agttgggtaggacagttgtt

SEQ ID NO: 476331 - DNA, 20 bp, Artificial
  CRISPR gRNA sequence
ggtaggacagttgttggata

SEQ ID NO: 476332 - DNA, 20 bp, Artificial
  CRISPR gRNA sequence
ttggataatcggaattatac

SEQ ID NO: 476333 - DNA, 20 bp, Artificial
  CRISPR gRNA sequence
gataatcggaattatacata

SEQ ID NO: 476334 - DNA, 20 bp, Artificial
  CRISPR gRNA sequence
tacatatctccatggttacc

SEQ ID NO: 476335 - DNA, 20 bp, Artificial
  CRISPR gRNA sequence
catggttaccctcaaataat

SEQ ID NO: 476336 - DNA, 20 bp, Artificial
  CRISPR gRNA sequence
ccctcaaataatattacctc

SEQ ID NO: 476337 - DNA, 20 bp, Artificial
  CRISPR gRNA sequence
aaataatattacctctaaat

SEQ ID NO: 476338 - DNA, 20 bp, Artificial
  CRISPR gRNA sequence
cctctaaataaaatctctat

SEQ ID NO: 476339 - DNA, 20 bp, Artificial
  CRISPR gRNA sequence
taaataaaatctctatactt

SEQ ID NO: 476340 - DNA, 20 bp, Artificial
  CRISPR gRNA sequence
aataaaatctctatacttgc

SEQ ID NO: 476341 - DNA, 20 bp, Artificial
  CRISPR gRNA sequence
tatacttgcttcattgggat

SEQ ID NO: 476342 - DNA, 20 bp, Artificial
  CRISPR gRNA sequence
tacttgcttcattgggatgt

SEQ ID NO: 476343 - DNA, 20 bp, Artificial
  CRISPR gRNA sequence
gcttcattgggatgtatgcc

SEQ ID NO: 476344 - DNA, 20 bp, Artificial
  CRISPR gRNA sequence
cttcattgggatgtatgcct

SEQ ID NO: 476345 - DNA, 20 bp, Artificial
  CRISPR gRNA sequence
cattgggatgtatgccttga

SEQ ID NO: 476346 - DNA, 20 bp, Artificial
  CRISPR gRNA sequence
attgggatgtatgccttgag

SEQ ID NO: 476347 - DNA, 20 bp, Artificial
  CRISPR gRNA sequence
ggatgtatgccttgagaata

SEQ ID NO: 476348 - DNA, 20 bp, Artificial
  CRISPR gRNA sequence
gagaataccgattgagaaaa

SEQ ID NO: 476349 - DNA, 20 bp, Artificial
  CRISPR gRNA sequence
agaataccgattgagaaaat

SEQ ID NO: 476350 - DNA, 20 bp, Artificial
  CRISPR gRNA sequence
agaaaatgctacaaaatata

SEQ ID NO: 476351 - DNA, 20 bp, Artificial
  CRISPR gRNA sequence
caaaatataggagcagaact

SEQ ID NO: 476352 - DNA, 20 bp, Artificial
  CRISPR gRNA sequence
ttcgtcattgcttctatttt

SEQ ID NO: 476353 - DNA, 20 bp, Artificial
  CRISPR gRNA sequence
tcgtcattgcttctattttg

SEQ ID NO: 476354 - DNA, 20 bp, Artificial
  CRISPR gRNA sequence
cgtcattgcttctattttgt

SEQ ID NO: 476355 - DNA, 20 bp, Artificial
  CRISPR gRNA sequence
gtcattgcttctattttgtt

SEQ ID NO: 476356 - DNA, 20 bp, Artificial
  CRISPR gRNA sequence
cttctattttgttgaaaggg

SEQ ID NO: 476357 - DNA, 20 bp, Artificial
  CRISPR gRNA sequence
ctattttgttgaaagggaat

SEQ ID NO: 476358 - DNA, 20 bp, Artificial
  CRISPR gRNA sequence
tattttgttgaaagggaatg

SEQ ID NO: 476359 - DNA, 20 bp, Artificial
  CRISPR gRNA sequence
ttttgttgaaagggaatggt

SEQ ID NO: 476360 - DNA, 20 bp, Artificial
  CRISPR gRNA sequence
tgttgaaagggaatggttcc

SEQ ID NO: 476361 - DNA, 20 bp, Artificial
  CRISPR gRNA sequence
gttgaaagggaatggttcct

SEQ ID NO: 476362 - DNA, 20 bp, Artificial
  CRISPR gRNA sequence
ttgaaagggaatggttccta

SEQ ID NO: 476363 - DNA, 20 bp, Artificial
  CRISPR gRNA sequence
aaagggaatggttcctactt

SEQ ID NO: 476364 - DNA, 20 bp, Artificial
  CRISPR gRNA sequence
ctacttggttgtcaattgaa

SEQ ID NO: 476365 - DNA, 20 bp, Artificial
  CRISPR gRNA sequence
cttggttgtcaattgaacac

SEQ ID NO: 476366 - DNA, 20 bp, Artificial
  CRISPR gRNA sequence
ggttgtcaattgaacacaga

SEQ ID NO: 476367 - DNA, 20 bp, Artificial
  CRISPR gRNA sequence
gttgtcaattgaacacagaa

SEQ ID NO: 476368 - DNA, 20 bp, Artificial
  CRISPR gRNA sequence
tcaattgaacacagaaaata

SEQ ID NO: 476369 - DNA, 20 bp, Artificial
  CRISPR gRNA sequence
aacacagaaaataagttgga

SEQ ID NO: 476370 - DNA, 20 bp, Artificial
  CRISPR gRNA sequence
gattctgcaaagatgatatt

SEQ ID NO: 476371 - DNA, 20 bp, Artificial
  CRISPR gRNA sequence
tgcaaagatgatatttagcc

SEQ ID NO: 476372 - DNA, 20 bp, Artificial
  CRISPR gRNA sequence
caaagatgatatttagccac

SEQ ID NO: 476373 - DNA, 20 bp, Artificial
  CRISPR gRNA sequence
agccacccctgcaaagactt

SEQ ID NO: 476374 - DNA, 20 bp, Artificial
  CRISPR gRNA sequence
gccacccctgcaaagacttt

SEQ ID NO: 476375 - DNA, 20 bp, Artificial
  CRISPR gRNA sequence
caaagactttatacaggcaa

SEQ ID NO: 476376 - DNA, 20 bp, Artificial
  CRISPR gRNA sequence
tatacaggcaaaaaaaaaaa

SEQ ID NO: 476377 - DNA, 20 bp, Artificial
  CRISPR gRNA sequence
atacaggcaaaaaaaaaaaa

SEQ ID NO: 476378 - DNA, 20 bp, Artificial
  CRISPR gRNA sequence
tacaggcaaaaaaaaaaaaa

SEQ ID NO: 476379 - DNA, 20 bp, Artificial
  CRISPR gRNA sequence
cttttttattgtaaagtcgc

SEQ ID NO: 476380 - DNA, 20 bp, Artificial
  CRISPR gRNA sequence
ttttttattgtaaagtcgct

SEQ ID NO: 476381 - DNA, 20 bp, Artificial
  CRISPR gRNA sequence
ttttattgtaaagtcgcttc

SEQ ID NO: 476382 - DNA, 20 bp, Artificial
  CRISPR gRNA sequence
tttattgtaaagtcgcttcc

SEQ ID NO: 476383 - DNA, 20 bp, Artificial
  CRISPR gRNA sequence
ttattgtaaagtcgcttcct

SEQ ID NO: 476384 - DNA, 20 bp, Artificial
  CRISPR gRNA sequence
tattgtaaagtcgcttccta

SEQ ID NO: 476385 - DNA, 20 bp, Artificial
  CRISPR gRNA sequence
attgtaaagtcgcttcctac

SEQ ID NO: 476386 - DNA, 20 bp, Artificial
  CRISPR gRNA sequence
ttgtaaagtcgcttcctacc

SEQ ID NO: 476387 - DNA, 20 bp, Artificial
  CRISPR gRNA sequence
taaagtcgcttcctacctta

SEQ ID NO: 476388 - DNA, 20 bp, Artificial
  CRISPR gRNA sequence
cctaccttatattgcatagg

SEQ ID NO: 476389 - DNA, 20 bp, Artificial
  CRISPR gRNA sequence
ctaccttatattgcatagga

SEQ ID NO: 476390 - DNA, 20 bp, Artificial
  CRISPR gRNA sequence
ccttatattgcataggaacc

SEQ ID NO: 476391 - DNA, 20 bp, Artificial
  CRISPR gRNA sequence
atattgcataggaacccaca

SEQ ID NO: 476392 - DNA, 20 bp, Artificial
  CRISPR gRNA sequence
tattgcataggaacccacat

SEQ ID NO: 476393 - DNA, 20 bp, Artificial
  CRISPR gRNA sequence
cataggaacccacatattat

SEQ ID NO: 476394 - DNA, 20 bp, Artificial
  CRISPR gRNA sequence
tcaagaggaaaagcctatga

SEQ ID NO: 476395 - DNA, 20 bp, Artificial
  CRISPR gRNA sequence
tgagtggctcatcagaagct

SEQ ID NO: 476396 - DNA, 20 bp, Artificial
  CRISPR gRNA sequence
atcagaagcttctgattttt

SEQ ID NO: 476397 - DNA, 20 bp, Artificial
  CRISPR gRNA sequence
ctgatttttcaggttttatt

SEQ ID NO: 476398 - DNA, 20 bp, Artificial
  CRISPR gRNA sequence
tgatttttcaggttttattt

SEQ ID NO: 476399 - DNA, 20 bp, Artificial
  CRISPR gRNA sequence
atttttcaggttttattttt

SEQ ID NO: 476400 - DNA, 20 bp, Artificial
  CRISPR gRNA sequence
ttcaggttttatttttttat

SEQ ID NO: 476401 - DNA, 20 bp, Artificial
  CRISPR gRNA sequence
tcaggttttatttttttatt

SEQ ID NO: 476402 - DNA, 20 bp, Artificial
  CRISPR gRNA sequence
caggttttatttttttattt

SEQ ID NO: 476403 - DNA, 20 bp, Artificial
  CRISPR gRNA sequence
aggttttatttttttatttt

SEQ ID NO: 476404 - DNA, 20 bp, Artificial
  CRISPR gRNA sequence
tatttttttatttttttgag

SEQ ID NO: 476405 - DNA, 20 bp, Artificial
  CRISPR gRNA sequence
atttttttatttttttgaga

SEQ ID NO: 476406 - DNA, 20 bp, Artificial
  CRISPR gRNA sequence
tttttttatttttttgagac

SEQ ID NO: 476407 - DNA, 20 bp, Artificial
  CRISPR gRNA sequence
ttttatttttttgagacaag

SEQ ID NO: 476408 - DNA, 20 bp, Artificial
  CRISPR gRNA sequence
tttatttttttgagacaaga

SEQ ID NO: 476409 - DNA, 20 bp, Artificial
  CRISPR gRNA sequence
ttatttttttgagacaagag

SEQ ID NO: 476410 - DNA, 20 bp, Artificial
  CRISPR gRNA sequence
tatttttttgagacaagagt

SEQ ID NO: 476411 - DNA, 20 bp, Artificial
  CRISPR gRNA sequence
atttttttgagacaagagtt

SEQ ID NO: 476412 - DNA, 20 bp, Artificial
  CRISPR gRNA sequence
tttttttgagacaagagttt

SEQ ID NO: 476413 - DNA, 20 bp, Artificial
  CRISPR gRNA sequence
ttttgagacaagagttttgc

SEQ ID NO: 476414 - DNA, 20 bp, Artificial
  CRISPR gRNA sequence
tttgagacaagagttttgct

SEQ ID NO: 476415 - DNA, 20 bp, Artificial
  CRISPR gRNA sequence
ttgagacaagagttttgctc

SEQ ID NO: 476416 - DNA, 20 bp, Artificial
  CRISPR gRNA sequence
tgagacaagagttttgctct

SEQ ID NO: 476417 - DNA, 20 bp, Artificial
  CRISPR gRNA sequence
gagacaagagttttgctctc

SEQ ID NO: 476418 - DNA, 20 bp, Artificial
  CRISPR gRNA sequence
agacaagagttttgctctcg

SEQ ID NO: 476419 - DNA, 20 bp, Artificial
  CRISPR gRNA sequence
tgctctcgtcacccaggctg

SEQ ID NO: 476420 - DNA, 20 bp, Artificial
  CRISPR gRNA sequence
gctctcgtcacccaggctgg

SEQ ID NO: 476421 - DNA, 20 bp, Artificial
  CRISPR gRNA sequence
ctctcgtcacccaggctgga

SEQ ID NO: 476422 - DNA, 20 bp, Artificial
  CRISPR gRNA sequence
tcgtcacccaggctggagtg

SEQ ID NO: 476423 - DNA, 20 bp, Artificial
  CRISPR gRNA sequence
gtcacccaggctggagtgca

SEQ ID NO: 476424 - DNA, 20 bp, Artificial
  CRISPR gRNA sequence
gagtgcaatggcgtgatccc

SEQ ID NO: 476425 - DNA, 20 bp, Artificial
  CRISPR gRNA sequence
actgcatcctctgcctcccg

SEQ ID NO: 476426 - DNA, 20 bp, Artificial
  CRISPR gRNA sequence
catcctctgcctcccgggtt

SEQ ID NO: 476427 - DNA, 20 bp, Artificial
  CRISPR gRNA sequence
tgcctcccgggttcaatcga

SEQ ID NO: 476428 - DNA, 20 bp, Artificial
  CRISPR gRNA sequence
cctcccgggttcaatcgatt

SEQ ID NO: 476429 - DNA, 20 bp, Artificial
  CRISPR gRNA sequence
ccgggttcaatcgattcttc

SEQ ID NO: 476430 - DNA, 20 bp, Artificial
  CRISPR gRNA sequence
aatcgattcttcttcctccc

SEQ ID NO: 476431 - DNA, 20 bp, Artificial
  CRISPR gRNA sequence
ttcttcctcccgggttcaat

SEQ ID NO: 476432 - DNA, 20 bp, Artificial
  CRISPR gRNA sequence
cttcctcccgggttcaattt

SEQ ID NO: 476433 - DNA, 20 bp, Artificial
  CRISPR gRNA sequence
ttcctcccgggttcaattta

SEQ ID NO: 476434 - DNA, 20 bp, Artificial
  CRISPR gRNA sequence
cctcccgggttcaatttatt

SEQ ID NO: 476435 - DNA, 20 bp, Artificial
  CRISPR gRNA sequence
ctcccgggttcaatttattc

SEQ ID NO: 476436 - DNA, 20 bp, Artificial
  CRISPR gRNA sequence
ccgggttcaatttattctcc

SEQ ID NO: 476437 - DNA, 20 bp, Artificial
  CRISPR gRNA sequence
aatttattctcctgcctcag

SEQ ID NO: 476438 - DNA, 20 bp, Artificial
  CRISPR gRNA sequence
attctcctgcctcagcgtcc

SEQ ID NO: 476439 - DNA, 20 bp, Artificial
  CRISPR gRNA sequence
ttctcctgcctcagcgtccc

SEQ ID NO: 476440 - DNA, 20 bp, Artificial
  CRISPR gRNA sequence
tcctgcctcagcgtccctag

SEQ ID NO: 476441 - DNA, 20 bp, Artificial
  CRISPR gRNA sequence
ctgcctcagcgtccctagta

SEQ ID NO: 476442 - DNA, 20 bp, Artificial
  CRISPR gRNA sequence
cctcagcgtccctagtagct

SEQ ID NO: 476443 - DNA, 20 bp, Artificial
  CRISPR gRNA sequence
agcgtccctagtagctggga

SEQ ID NO: 476444 - DNA, 20 bp, Artificial
  CRISPR gRNA sequence
gtagctgggattacaggcac

SEQ ID NO: 476445 - DNA, 20 bp, Artificial
  CRISPR gRNA sequence
ggattacaggcaccttccac

SEQ ID NO: 476446 - DNA, 20 bp, Artificial
  CRISPR gRNA sequence
caggcaccttccaccacgca

SEQ ID NO: 476447 - DNA, 20 bp, Artificial
  CRISPR gRNA sequence
ccaccacgcacagctaattt

SEQ ID NO: 476448 - DNA, 20 bp, Artificial
  CRISPR gRNA sequence
caccacgcacagctaatttt

SEQ ID NO: 476449 - DNA, 20 bp, Artificial
  CRISPR gRNA sequence
atttttgtatttttagtaga

SEQ ID NO: 476450 - DNA, 20 bp, Artificial
  CRISPR gRNA sequence
ttgtatttttagtagagatg

SEQ ID NO: 476451 - DNA, 20 bp, Artificial
  CRISPR gRNA sequence
tgtatttttagtagagatgt

SEQ ID NO: 476452 - DNA, 20 bp, Artificial
  CRISPR gRNA sequence
gtatttttagtagagatgtt

SEQ ID NO: 476453 - DNA, 20 bp, Artificial
  CRISPR gRNA sequence
tatttttagtagagatgttg

SEQ ID NO: 476454 - DNA, 20 bp, Artificial
  CRISPR gRNA sequence
ttagtagagatgttggataa

SEQ ID NO: 476455 - DNA, 20 bp, Artificial
  CRISPR gRNA sequence
tagtagagatgttggataac

SEQ ID NO: 476456 - DNA, 20 bp, Artificial
  CRISPR gRNA sequence
agtagagatgttggataacc

SEQ ID NO: 476457 - DNA, 20 bp, Artificial
  CRISPR gRNA sequence
gtagagatgttggataaccc

SEQ ID NO: 476458 - DNA, 20 bp, Artificial
  CRISPR gRNA sequence
gataaccccaattatccaac

SEQ ID NO: 476459 - DNA, 20 bp, Artificial
  CRISPR gRNA sequence
tccaacatctgtcctaccca

SEQ ID NO: 476460 - DNA, 20 bp, Artificial
  CRISPR gRNA sequence
tcctacccaactgagcactg

SEQ ID NO: 476461 - DNA, 20 bp, Artificial
  CRISPR gRNA sequence
cccaactgagcactgcaaca

SEQ ID NO: 476462 - DNA, 20 bp, Artificial
  CRISPR gRNA sequence
agcactgcaacactctactg

SEQ ID NO: 476463 - DNA, 20 bp, Artificial
  CRISPR gRNA sequence
caacactctactgcactcag

SEQ ID NO: 476464 - DNA, 20 bp, Artificial
  CRISPR gRNA sequence
tactgcactcagtttgggaa

SEQ ID NO: 476465 - DNA, 20 bp, Artificial
  CRISPR gRNA sequence
ctgcactcagtttgggaaga

SEQ ID NO: 476466 - DNA, 20 bp, Artificial
  CRISPR gRNA sequence
cactcagtttgggaagaacg

SEQ ID NO: 476467 - DNA, 20 bp, Artificial
  CRISPR gRNA sequence
agtttgggaagaacgagcta

SEQ ID NO: 476468 - DNA, 20 bp, Artificial
  CRISPR gRNA sequence
gggaagaacgagctatctat

SEQ ID NO: 476469 - DNA, 20 bp, Artificial
  CRISPR gRNA sequence
ggaagaacgagctatctatt

SEQ ID NO: 476470 - DNA, 20 bp, Artificial
  CRISPR gRNA sequence
tctattcatcatcagtgtgg

SEQ ID NO: 476471 - DNA, 20 bp, Artificial
  CRISPR gRNA sequence
ttcatcatcagtgtggcagc

SEQ ID NO: 476472 - DNA, 20 bp, Artificial
  CRISPR gRNA sequence
atcatcagtgtggcagcctg

SEQ ID NO: 476473 - DNA, 20 bp, Artificial
  CRISPR gRNA sequence
agcattttcgcaagaagtag

SEQ ID NO: 476474 - DNA, 20 bp, Artificial
  CRISPR gRNA sequence
tcgcaagaagtagtgataga

SEQ ID NO: 476475 - DNA, 20 bp, Artificial
  CRISPR gRNA sequence
cgcaagaagtagtgatagat

SEQ ID NO: 476476 - DNA, 20 bp, Artificial
  CRISPR gRNA sequence
gcaagaagtagtgatagatt

SEQ ID NO: 476477 - DNA, 20 bp, Artificial
  CRISPR gRNA sequence
gtacttaactatttataaca

SEQ ID NO: 476478 - DNA, 20 bp, Artificial
  CRISPR gRNA sequence
tacttaactatttataacat

SEQ ID NO: 476479 - DNA, 20 bp, Artificial
  CRISPR gRNA sequence
aactatttataacatctact

SEQ ID NO: 476480 - DNA, 20 bp, Artificial
  CRISPR gRNA sequence
actatttataacatctactc

SEQ ID NO: 476481 - DNA, 20 bp, Artificial
  CRISPR gRNA sequence
tttataacatctactcagtt

SEQ ID NO: 476482 - DNA, 20 bp, Artificial
  CRISPR gRNA sequence
ataacatctactcagttctc

SEQ ID NO: 476483 - DNA, 20 bp, Artificial
  CRISPR gRNA sequence
taacatctactcagttctct

SEQ ID NO: 476484 - DNA, 20 bp, Artificial
  CRISPR gRNA sequence
ctcagttctcttttcttgcc

SEQ ID NO: 476485 - DNA, 20 bp, Artificial
  CRISPR gRNA sequence
agttctcttttcttgccatc

SEQ ID NO: 476486 - DNA, 20 bp, Artificial
  CRISPR gRNA sequence
tcttttcttgccatcaacct

SEQ ID NO: 476487 - DNA, 20 bp, Artificial
  CRISPR gRNA sequence
ttttcttgccatcaacctgt

SEQ ID NO: 476488 - DNA, 20 bp, Artificial
  CRISPR gRNA sequence
ttcttgccatcaacctgttt

SEQ ID NO: 476489 - DNA, 20 bp, Artificial
  CRISPR gRNA sequence
tcttgccatcaacctgtttt

SEQ ID NO: 476490 - DNA, 20 bp, Artificial
  CRISPR gRNA sequence
cttgccatcaacctgttttt

SEQ ID NO: 476491 - DNA, 20 bp, Artificial
  CRISPR gRNA sequence
ttgccatcaacctgtttttt

SEQ ID NO: 476492 - DNA, 20 bp, Artificial
  CRISPR gRNA sequence
gccatcaacctgttttttaa

SEQ ID NO: 476493 - DNA, 20 bp, Artificial
  CRISPR gRNA sequence
ccatcaacctgttttttaag

SEQ ID NO: 476494 - DNA, 20 bp, Artificial
  CRISPR gRNA sequence
ttttttaagaaagtcagcca

SEQ ID NO: 476495 - DNA, 20 bp, Artificial
  CRISPR gRNA sequence
tttaagaaagtcagccaagc

SEQ ID NO: 476496 - DNA, 20 bp, Artificial
  CRISPR gRNA sequence
ttaagaaagtcagccaagct

SEQ ID NO: 476497 - DNA, 20 bp, Artificial
  CRISPR gRNA sequence
taagaaagtcagccaagcta

SEQ ID NO: 476498 - DNA, 20 bp, Artificial
  CRISPR gRNA sequence
aagaaagtcagccaagctat

SEQ ID NO: 476499 - DNA, 20 bp, Artificial
  CRISPR gRNA sequence
agaaagtcagccaagctatg

SEQ ID NO: 476500 - DNA, 20 bp, Artificial
  CRISPR gRNA sequence
tggatgcaatgcatgttggg

SEQ ID NO: 476501 - DNA, 20 bp, Artificial
  CRISPR gRNA sequence
ggcaggctggtctggagctc

SEQ ID NO: 476502 - DNA, 20 bp, Artificial
  CRISPR gRNA sequence
gtctggagctcctgacctca

SEQ ID NO: 476503 - DNA, 20 bp, Artificial
  CRISPR gRNA sequence
gagctcctgacctcaagtga

SEQ ID NO: 476504 - DNA, 20 bp, Artificial
  CRISPR gRNA sequence
ctgacctcaagtgatccacc

SEQ ID NO: 476505 - DNA, 20 bp, Artificial
  CRISPR gRNA sequence
acctcaagtgatccacctgc

SEQ ID NO: 476506 - DNA, 20 bp, Artificial
  CRISPR gRNA sequence
aagtgatccacctgcctcag

SEQ ID NO: 476507 - DNA, 20 bp, Artificial
  CRISPR gRNA sequence
cctcagcctcccaaagtgct

SEQ ID NO: 476508 - DNA, 20 bp, Artificial
  CRISPR gRNA sequence
agcctcccaaagtgctagga

SEQ ID NO: 476509 - DNA, 20 bp, Artificial
  CRISPR gRNA sequence
ccaaagtgctaggattacag

SEQ ID NO: 476510 - DNA, 20 bp, Artificial
  CRISPR gRNA sequence
ggattacaggtatgagccac

SEQ ID NO: 476511 - DNA, 20 bp, Artificial
  CRISPR gRNA sequence
caggtatgagccaccatgcc

SEQ ID NO: 476512 - DNA, 20 bp, Artificial
  CRISPR gRNA sequence
ttcaggttttaaatattctg

SEQ ID NO: 476513 - DNA, 20 bp, Artificial
  CRISPR gRNA sequence
tcaggttttaaatattctgt

SEQ ID NO: 476514 - DNA, 20 bp, Artificial
  CRISPR gRNA sequence
caggttttaaatattctgtc

SEQ ID NO: 476515 - DNA, 20 bp, Artificial
  CRISPR gRNA sequence
aggttttaaatattctgtct

SEQ ID NO: 476516 - DNA, 20 bp, Artificial
  CRISPR gRNA sequence
taaatattctgtcttattat

SEQ ID NO: 476517 - DNA, 20 bp, Artificial
  CRISPR gRNA sequence
aaatattctgtcttattatt

SEQ ID NO: 476518 - DNA, 20 bp, Artificial
  CRISPR gRNA sequence
aatattctgtcttattattc

SEQ ID NO: 476519 - DNA, 20 bp, Artificial
  CRISPR gRNA sequence
tgtcttattattccctacaa

SEQ ID NO: 476520 - DNA, 20 bp, Artificial
  CRISPR gRNA sequence
tcttattattccctacaagc

SEQ ID NO: 476521 - DNA, 20 bp, Artificial
  CRISPR gRNA sequence
attattccctacaagcacac

SEQ ID NO: 476522 - DNA, 20 bp, Artificial
  CRISPR gRNA sequence
ttattccctacaagcacaca

SEQ ID NO: 476523 - DNA, 20 bp, Artificial
  CRISPR gRNA sequence
ttccctacaagcacacattt

SEQ ID NO: 476524 - DNA, 20 bp, Artificial
  CRISPR gRNA sequence
cctacaagcacacatttatc

SEQ ID NO: 476525 - DNA, 20 bp, Artificial
  CRISPR gRNA sequence
caagcacacatttatcagtt

SEQ ID NO: 476526 - DNA, 20 bp, Artificial
  CRISPR gRNA sequence
atcagtttggctactgcaat

SEQ ID NO: 476527 - DNA, 20 bp, Artificial
  CRISPR gRNA sequence
tcagtttggctactgcaatt

SEQ ID NO: 476528 - DNA, 20 bp, Artificial
  CRISPR gRNA sequence
ggctactgcaattttaaatt

SEQ ID NO: 476529 - DNA, 20 bp, Artificial
  CRISPR gRNA sequence
gctactgcaattttaaatta

SEQ ID NO: 476530 - DNA, 20 bp, Artificial
  CRISPR gRNA sequence
ctgcaattttaaattagaaa

SEQ ID NO: 476531 - DNA, 20 bp, Artificial
  CRISPR gRNA sequence
caattttaaattagaaaatc

SEQ ID NO: 476532 - DNA, 20 bp, Artificial
  CRISPR gRNA sequence
taaattagaaaatctggcca

SEQ ID NO: 476533 - DNA, 20 bp, Artificial
  CRISPR gRNA sequence
aaattagaaaatctggccac

SEQ ID NO: 476534 - DNA, 20 bp, Artificial
  CRISPR gRNA sequence
aattagaaaatctggccact

SEQ ID NO: 476535 - DNA, 20 bp, Artificial
  CRISPR gRNA sequence
gaaaatctggccactgaggt

SEQ ID NO: 476536 - DNA, 20 bp, Artificial
  CRISPR gRNA sequence
gccactgaggttctatggaa

SEQ ID NO: 476537 - DNA, 20 bp, Artificial
  CRISPR gRNA sequence
aggttctatggaaagtctat

SEQ ID NO: 476538 - DNA, 20 bp, Artificial
  CRISPR gRNA sequence
tatggaaagtctatctataa

SEQ ID NO: 476539 - DNA, 20 bp, Artificial
  CRISPR gRNA sequence
tggaaagtctatctataatt

SEQ ID NO: 476540 - DNA, 20 bp, Artificial
  CRISPR gRNA sequence
tctataattttaaactgtgt

SEQ ID NO: 476541 - DNA, 20 bp, Artificial
  CRISPR gRNA sequence
taattttaaactgtgtagtt

SEQ ID NO: 476542 - DNA, 20 bp, Artificial
  CRISPR gRNA sequence
taaactgtgtagtttggaat

SEQ ID NO: 476543 - DNA, 20 bp, Artificial
  CRISPR gRNA sequence
aaactgtgtagtttggaata

SEQ ID NO: 476544 - DNA, 20 bp, Artificial
  CRISPR gRNA sequence
aactgtgtagtttggaatat

SEQ ID NO: 476545 - DNA, 20 bp, Artificial
  CRISPR gRNA sequence
tgtagtttggaatatgtctc

SEQ ID NO: 476546 - DNA, 20 bp, Artificial
  CRISPR gRNA sequence
ggaatatgtctctatgatgc

SEQ ID NO: 476547 - DNA, 20 bp, Artificial
  CRISPR gRNA sequence
gaatatgtctctatgatgcc

SEQ ID NO: 476548 - DNA, 20 bp, Artificial
  CRISPR gRNA sequence
tatgatgccaggatgccaca

SEQ ID NO: 476549 - DNA, 20 bp, Artificial
  CRISPR gRNA sequence
tgatgccaggatgccacaca

SEQ ID NO: 476550 - DNA, 20 bp, Artificial
  CRISPR gRNA sequence
agttactcaaacatctttat

SEQ ID NO: 476551 - DNA, 20 bp, Artificial
  CRISPR gRNA sequence
gttactcaaacatctttatg

SEQ ID NO: 476552 - DNA, 20 bp, Artificial
  CRISPR gRNA sequence
ctcaaacatctttatgtttg

SEQ ID NO: 476553 - DNA, 20 bp, Artificial
  CRISPR gRNA sequence
aaacatctttatgtttgtaa

SEQ ID NO: 476554 - DNA, 20 bp, Artificial
  CRISPR gRNA sequence
tatgtttgtaagtatctagt

SEQ ID NO: 476555 - DNA, 20 bp, Artificial
  CRISPR gRNA sequence
atgtttgtaagtatctagta

SEQ ID NO: 476556 - DNA, 20 bp, Artificial
  CRISPR gRNA sequence
tgtttgtaagtatctagtat

SEQ ID NO: 476557 - DNA, 20 bp, Artificial
  CRISPR gRNA sequence
gtaagtatctagtattaagt

SEQ ID NO: 476558 - DNA, 20 bp, Artificial
  CRISPR gRNA sequence
taagtatctagtattaagtc

SEQ ID NO: 476559 - DNA, 20 bp, Artificial
  CRISPR gRNA sequence
gtattaagtcaactaggtgc

SEQ ID NO: 476560 - DNA, 20 bp, Artificial
  CRISPR gRNA sequence
agtcaactaggtgcttagat

SEQ ID NO: 476561 - DNA, 20 bp, Artificial
  CRISPR gRNA sequence
ggtgcttagatggttgactg

SEQ ID NO: 476562 - DNA, 20 bp, Artificial
  CRISPR gRNA sequence
agatggttgactgaattttc

SEQ ID NO: 476563 - DNA, 20 bp, Artificial
  CRISPR gRNA sequence
gatggttgactgaattttcc

SEQ ID NO: 476564 - DNA, 20 bp, Artificial
  CRISPR gRNA sequence
actgaattttccaccttcca

SEQ ID NO: 476565 - DNA, 20 bp, Artificial
  CRISPR gRNA sequence
aattttccaccttccatcag

SEQ ID NO: 476566 - DNA, 20 bp, Artificial
  CRISPR gRNA sequence
tccaccttccatcagatgcc

SEQ ID NO: 476567 - DNA, 20 bp, Artificial
  CRISPR gRNA sequence
ccaccttccatcagatgcct

SEQ ID NO: 476568 - DNA, 20 bp, Artificial
  CRISPR gRNA sequence
caccttccatcagatgccta

SEQ ID NO: 476569 - DNA, 20 bp, Artificial
  CRISPR gRNA sequence
ccatcagatgcctacagtca

SEQ ID NO: 476570 - DNA, 20 bp, Artificial
  CRISPR gRNA sequence
catcagatgcctacagtcac

SEQ ID NO: 476571 - DNA, 20 bp, Artificial
  CRISPR gRNA sequence
cagtcacatagctacaactg

SEQ ID NO: 476572 - DNA, 20 bp, Artificial
  CRISPR gRNA sequence
caactggagtcaaatattat

SEQ ID NO: 476573 - DNA, 20 bp, Artificial
  CRISPR gRNA sequence
gagtcaaatattattaaata

SEQ ID NO: 476574 - DNA, 20 bp, Artificial
  CRISPR gRNA sequence
ttaaatagatttcttcccca

SEQ ID NO: 476575 - DNA, 20 bp, Artificial
  CRISPR gRNA sequence
aatagatttcttccccattt

SEQ ID NO: 476576 - DNA, 20 bp, Artificial
  CRISPR gRNA sequence
cttccccatttgaaggatac

SEQ ID NO: 476577 - DNA, 20 bp, Artificial
  CRISPR gRNA sequence
ttccccatttgaaggataca

SEQ ID NO: 476578 - DNA, 20 bp, Artificial
  CRISPR gRNA sequence
ccccatttgaaggatacata

SEQ ID NO: 476579 - DNA, 20 bp, Artificial
  CRISPR gRNA sequence
cccatttgaaggatacataa

SEQ ID NO: 476580 - DNA, 20 bp, Artificial
  CRISPR gRNA sequence
gaaggatacataaactactc

SEQ ID NO: 476581 - DNA, 20 bp, Artificial
  CRISPR gRNA sequence
aaggatacataaactactct

SEQ ID NO: 476582 - DNA, 20 bp, Artificial
  CRISPR gRNA sequence
ctctctatgaaattaagaac

SEQ ID NO: 476583 - DNA, 20 bp, Artificial
  CRISPR gRNA sequence
tctatgaaattaagaacaat

SEQ ID NO: 476584 - DNA, 20 bp, Artificial
  CRISPR gRNA sequence
tatgaaattaagaacaatga

SEQ ID NO: 476585 - DNA, 20 bp, Artificial
  CRISPR gRNA sequence
tgaaattaagaacaatgagt

SEQ ID NO: 476586 - DNA, 20 bp, Artificial
  CRISPR gRNA sequence
agaacaatgagtttcagtgc

SEQ ID NO: 476587 - DNA, 20 bp, Artificial
  CRISPR gRNA sequence
cagtgctaaaccacattgat

SEQ ID NO: 476588 - DNA, 20 bp, Artificial
  CRISPR gRNA sequence
agtgctaaaccacattgatg

SEQ ID NO: 476589 - DNA, 20 bp, Artificial
  CRISPR gRNA sequence
aaccacattgatggtggggt

SEQ ID NO: 476590 - DNA, 20 bp, Artificial
  CRISPR gRNA sequence
atggtggggtaagaccttta

SEQ ID NO: 476591 - DNA, 20 bp, Artificial
  CRISPR gRNA sequence
tatttctcccaatgtgcaac

SEQ ID NO: 476592 - DNA, 20 bp, Artificial
  CRISPR gRNA sequence
atttctcccaatgtgcaacc

SEQ ID NO: 476593 - DNA, 20 bp, Artificial
  CRISPR gRNA sequence
tttctcccaatgtgcaacct

SEQ ID NO: 476594 - DNA, 20 bp, Artificial
  CRISPR gRNA sequence
ctcccaatgtgcaacctagc

SEQ ID NO: 476595 - DNA, 20 bp, Artificial
  CRISPR gRNA sequence
tcccaatgtgcaacctagca

SEQ ID NO: 476596 - DNA, 20 bp, Artificial
  CRISPR gRNA sequence
ccaatgtgcaacctagcatt

SEQ ID NO: 476597 - DNA, 20 bp, Artificial
  CRISPR gRNA sequence
gcatttgcaaaagtgaactt

SEQ ID NO: 476598 - DNA, 20 bp, Artificial
  CRISPR gRNA sequence
gcaaaagtgaacttggctgt

SEQ ID NO: 476599 - DNA, 20 bp, Artificial
  CRISPR gRNA sequence
caaaagtgaacttggctgtt

SEQ ID NO: 476600 - DNA, 20 bp, Artificial
  CRISPR gRNA sequence
ggctgttagaactgggttaa

SEQ ID NO: 476601 - DNA, 20 bp, Artificial
  CRISPR gRNA sequence
gctgttagaactgggttaat

SEQ ID NO: 476602 - DNA, 20 bp, Artificial
  CRISPR gRNA sequence
ttagaactgggttaatttac

SEQ ID NO: 476603 - DNA, 20 bp, Artificial
  CRISPR gRNA sequence
gaactgggttaatttactgg

SEQ ID NO: 476604 - DNA, 20 bp, Artificial
  CRISPR gRNA sequence
ggttaatttactggctctgc

SEQ ID NO: 476605 - DNA, 20 bp, Artificial
  CRISPR gRNA sequence
atttactggctctgccactt

SEQ ID NO: 476606 - DNA, 20 bp, Artificial
  CRISPR gRNA sequence
actggctctgccacttactg

SEQ ID NO: 476607 - DNA, 20 bp, Artificial
  CRISPR gRNA sequence
ctggctctgccacttactgt

SEQ ID NO: 476608 - DNA, 20 bp, Artificial
  CRISPR gRNA sequence
gctctgccacttactgtatg

SEQ ID NO: 476609 - DNA, 20 bp, Artificial
  CRISPR gRNA sequence
tgccacttactgtatggcat

SEQ ID NO: 476610 - DNA, 20 bp, Artificial
  CRISPR gRNA sequence
ccacttactgtatggcattg

SEQ ID NO: 476611 - DNA, 20 bp, Artificial
  CRISPR gRNA sequence
actgtatggcattgattaag

SEQ ID NO: 476612 - DNA, 20 bp, Artificial
  CRISPR gRNA sequence
ctgtatggcattgattaagt

SEQ ID NO: 476613 - DNA, 20 bp, Artificial
  CRISPR gRNA sequence
tatggcattgattaagtctc

SEQ ID NO: 476614 - DNA, 20 bp, Artificial
  CRISPR gRNA sequence
attaagtctcttctcttctc

SEQ ID NO: 476615 - DNA, 20 bp, Artificial
  CRISPR gRNA sequence
agtctcttctcttctcttta

SEQ ID NO: 476616 - DNA, 20 bp, Artificial
  CRISPR gRNA sequence
ttctcttctctttagtttcc

SEQ ID NO: 476617 - DNA, 20 bp, Artificial
  CRISPR gRNA sequence
ctcttctctttagtttcctc

SEQ ID NO: 476618 - DNA, 20 bp, Artificial
  CRISPR gRNA sequence
tcttctctttagtttcctca

SEQ ID NO: 476619 - DNA, 20 bp, Artificial
  CRISPR gRNA sequence
ttctctttagtttcctcatt

SEQ ID NO: 476620 - DNA, 20 bp, Artificial
  CRISPR gRNA sequence
ctctttagtttcctcatttg

SEQ ID NO: 476621 - DNA, 20 bp, Artificial
  CRISPR gRNA sequence
tctttagtttcctcatttgt

SEQ ID NO: 476622 - DNA, 20 bp, Artificial
  CRISPR gRNA sequence
tttagtttcctcatttgtac

SEQ ID NO: 476623 - DNA, 20 bp, Artificial
  CRISPR gRNA sequence
tagtttcctcatttgtacaa

SEQ ID NO: 476624 - DNA, 20 bp, Artificial
  CRISPR gRNA sequence
agtttcctcatttgtacaat

SEQ ID NO: 476625 - DNA, 20 bp, Artificial
  CRISPR gRNA sequence
gtttcctcatttgtacaata

SEQ ID NO: 476626 - DNA, 20 bp, Artificial
  CRISPR gRNA sequence
cctcatttgtacaatacagg

SEQ ID NO: 476627 - DNA, 20 bp, Artificial
  CRISPR gRNA sequence
ctcatttgtacaatacaggt

SEQ ID NO: 476628 - DNA, 20 bp, Artificial
  CRISPR gRNA sequence
atttgtacaatacaggtaat

SEQ ID NO: 476629 - DNA, 20 bp, Artificial
  CRISPR gRNA sequence
gtacaatacaggtaataatt

SEQ ID NO: 476630 - DNA, 20 bp, Artificial
  CRISPR gRNA sequence
tacaatacaggtaataattg

SEQ ID NO: 476631 - DNA, 20 bp, Artificial
  CRISPR gRNA sequence
tacctaaattatggggctgc

SEQ ID NO: 476632 - DNA, 20 bp, Artificial
  CRISPR gRNA sequence
aattatggggctgctgtgaa

SEQ ID NO: 476633 - DNA, 20 bp, Artificial
  CRISPR gRNA sequence
tggggctgctgtgaagactg

SEQ ID NO: 476634 - DNA, 20 bp, Artificial
  CRISPR gRNA sequence
ctgtgaagactgtagatgca

SEQ ID NO: 476635 - DNA, 20 bp, Artificial
  CRISPR gRNA sequence
tgaagactgtagatgcaata

SEQ ID NO: 476636 - DNA, 20 bp, Artificial
  CRISPR gRNA sequence
tagatgcaataatatgggta

SEQ ID NO: 476637 - DNA, 20 bp, Artificial
  CRISPR gRNA sequence
gcatagtaagtgcacgtatt

SEQ ID NO: 476638 - DNA, 20 bp, Artificial
  CRISPR gRNA sequence
aaagctcagtaaatgttagt

SEQ ID NO: 476639 - DNA, 20 bp, Artificial
  CRISPR gRNA sequence
aagctcagtaaatgttagtg

SEQ ID NO: 476640 - DNA, 20 bp, Artificial
  CRISPR gRNA sequence
agtaaatgttagtggtattt

SEQ ID NO: 476641 - DNA, 20 bp, Artificial
  CRISPR gRNA sequence
gtggtatttttcctaaatta

SEQ ID NO: 476642 - DNA, 20 bp, Artificial
  CRISPR gRNA sequence
ttcctaaattattttcacca

SEQ ID NO: 476643 - DNA, 20 bp, Artificial
  CRISPR gRNA sequence
tcctaaattattttcaccat

SEQ ID NO: 476644 - DNA, 20 bp, Artificial
  CRISPR gRNA sequence
cctaaattattttcaccatg

SEQ ID NO: 476645 - DNA, 20 bp, Artificial
  CRISPR gRNA sequence
ctaaattattttcaccatgc

SEQ ID NO: 476646 - DNA, 20 bp, Artificial
  CRISPR gRNA sequence
aattattttcaccatgcaac

SEQ ID NO: 476647 - DNA, 20 bp, Artificial
  CRISPR gRNA sequence
ttttcaccatgcaacctcta

SEQ ID NO: 476648 - DNA, 20 bp, Artificial
  CRISPR gRNA sequence
tcaccatgcaacctctatgt

SEQ ID NO: 476649 - DNA, 20 bp, Artificial
  CRISPR gRNA sequence
caccatgcaacctctatgta

SEQ ID NO: 476650 - DNA, 20 bp, Artificial
  CRISPR gRNA sequence
accatgcaacctctatgtaa

SEQ ID NO: 476651 - DNA, 20 bp, Artificial
  CRISPR gRNA sequence
tatgtaattaaatgagaatt

SEQ ID NO: 476652 - DNA, 20 bp, Artificial
  CRISPR gRNA sequence
tgtaattaaatgagaattat

SEQ ID NO: 476653 - DNA, 20 bp, Artificial
  CRISPR gRNA sequence
aatgagaattatgttttaac

SEQ ID NO: 476654 - DNA, 20 bp, Artificial
  CRISPR gRNA sequence
tgttttaacattattattta

SEQ ID NO: 476655 - DNA, 20 bp, Artificial
  CRISPR gRNA sequence
taacattattatttaaaata

SEQ ID NO: 476656 - DNA, 20 bp, Artificial
  CRISPR gRNA sequence
aacattattatttaaaatag

SEQ ID NO: 476657 - DNA, 20 bp, Artificial
  CRISPR gRNA sequence
acattattatttaaaatagt

SEQ ID NO: 476658 - DNA, 20 bp, Artificial
  CRISPR gRNA sequence
ttatttaaaatagttgagtt

SEQ ID NO: 476659 - DNA, 20 bp, Artificial
  CRISPR gRNA sequence
tttaaaatagttgagttttt

SEQ ID NO: 476660 - DNA, 20 bp, Artificial
  CRISPR gRNA sequence
aaaatagttgagtttttaaa

SEQ ID NO: 476661 - DNA, 20 bp, Artificial
  CRISPR gRNA sequence
aaatagttgagtttttaaag

SEQ ID NO: 476662 - DNA, 20 bp, Artificial
  CRISPR gRNA sequence
agtttttaaagttaaaaata

SEQ ID NO: 476663 - DNA, 20 bp, Artificial
  CRISPR gRNA sequence
ttaaagttaaaaataaaata

SEQ ID NO: 476664 - DNA, 20 bp, Artificial
  CRISPR gRNA sequence
taaagttaaaaataaaataa

SEQ ID NO: 476665 - DNA, 20 bp, Artificial
  CRISPR gRNA sequence
aaagttaaaaataaaataaa

SEQ ID NO: 476666 - DNA, 20 bp, Artificial
  CRISPR gRNA sequence
aagttaaaaataaaataaat

SEQ ID NO: 476667 - DNA, 20 bp, Artificial
  CRISPR gRNA sequence
aaaataaaataaataagtac

SEQ ID NO: 476668 - DNA, 20 bp, Artificial
  CRISPR gRNA sequence
tgcaatatatttagcccaaa

SEQ ID NO: 476669 - DNA, 20 bp, Artificial
  CRISPR gRNA sequence
gcaatatatttagcccaaaa

SEQ ID NO: 476670 - DNA, 20 bp, Artificial
  CRISPR gRNA sequence
caatatatttagcccaaaat

SEQ ID NO: 476671 - DNA, 20 bp, Artificial
  CRISPR gRNA sequence
agcccaaaatatagtgaatc

SEQ ID NO: 476672 - DNA, 20 bp, Artificial
  CRISPR gRNA sequence
gcccaaaatatagtgaatca

SEQ ID NO: 476673 - DNA, 20 bp, Artificial
  CRISPR gRNA sequence
ttcagaaaatgaaatatggc

SEQ ID NO: 476674 - DNA, 20 bp, Artificial
  CRISPR gRNA sequence
agaaaatgaaatatggctgg

SEQ ID NO: 476675 - DNA, 20 bp, Artificial
  CRISPR gRNA sequence
ggagccatggccctagcctt

SEQ ID NO: 476676 - DNA, 20 bp, Artificial
  CRISPR gRNA sequence
gcctttagtctcagcacttt

SEQ ID NO: 476677 - DNA, 20 bp, Artificial
  CRISPR gRNA sequence
tagtctcagcactttgggaa

SEQ ID NO: 476678 - DNA, 20 bp, Artificial
  CRISPR gRNA sequence
agtctcagcactttgggaag

SEQ ID NO: 476679 - DNA, 20 bp, Artificial
  CRISPR gRNA sequence
gtctcagcactttgggaagc

SEQ ID NO: 476680 - DNA, 20 bp, Artificial
  CRISPR gRNA sequence
agcactttgggaagccaaga

SEQ ID NO: 476681 - DNA, 20 bp, Artificial
  CRISPR gRNA sequence
tgggaagccaagacgggcag

SEQ ID NO: 476682 - DNA, 20 bp, Artificial
  CRISPR gRNA sequence
gggaagccaagacgggcaga

SEQ ID NO: 476683 - DNA, 20 bp, Artificial
  CRISPR gRNA sequence
ggaagccaagacgggcagat

SEQ ID NO: 476684 - DNA, 20 bp, Artificial
  CRISPR gRNA sequence
aggtcaggagtttaagacca

SEQ ID NO: 476685 - DNA, 20 bp, Artificial
  CRISPR gRNA sequence
aagaccagactggtcaacat

SEQ ID NO: 476686 - DNA, 20 bp, Artificial
  CRISPR gRNA sequence
agaccagactggtcaacatg

SEQ ID NO: 476687 - DNA, 20 bp, Artificial
  CRISPR gRNA sequence
gtcaacatggtgaaaccccg

SEQ ID NO: 476688 - DNA, 20 bp, Artificial
  CRISPR gRNA sequence
tactaaaaatataaaaattt

SEQ ID NO: 476689 - DNA, 20 bp, Artificial
  CRISPR gRNA sequence
ctaaaaatataaaaatttgc

SEQ ID NO: 476690 - DNA, 20 bp, Artificial
  CRISPR gRNA sequence
aaaatataaaaatttgctgg

SEQ ID NO: 476691 - DNA, 20 bp, Artificial
  CRISPR gRNA sequence
gctgggtgtgttgggaggtg

SEQ ID NO: 476692 - DNA, 20 bp, Artificial
  CRISPR gRNA sequence
ctgggtgtgttgggaggtgc

SEQ ID NO: 476693 - DNA, 20 bp, Artificial
  CRISPR gRNA sequence
ggtgtgttgggaggtgcctg

SEQ ID NO: 476694 - DNA, 20 bp, Artificial
  CRISPR gRNA sequence
ggaggtgcctgtagtcccag

SEQ ID NO: 476695 - DNA, 20 bp, Artificial
  CRISPR gRNA sequence
tagtcccagctactcgggag

SEQ ID NO: 476696 - DNA, 20 bp, Artificial
  CRISPR gRNA sequence
ctcgggaggccgagacagga

SEQ ID NO: 476697 - DNA, 20 bp, Artificial
  CRISPR gRNA sequence
gggaggccgagacaggagaa

SEQ ID NO: 476698 - DNA, 20 bp, Artificial
  CRISPR gRNA sequence
gaacccaggaggcagaggtt

SEQ ID NO: 476699 - DNA, 20 bp, Artificial
  CRISPR gRNA sequence
aacccaggaggcagaggttg

SEQ ID NO: 476700 - DNA, 20 bp, Artificial
  CRISPR gRNA sequence
cagtgagctgagatcacacc

SEQ ID NO: 476701 - DNA, 20 bp, Artificial
  CRISPR gRNA sequence
agatcacaccactgcactca

SEQ ID NO: 476702 - DNA, 20 bp, Artificial
  CRISPR gRNA sequence
cactcaaaaaaaaaagggaa

SEQ ID NO: 476703 - DNA, 20 bp, Artificial
  CRISPR gRNA sequence
aaaaaaaaaagggaaagact

SEQ ID NO: 476704 - DNA, 20 bp, Artificial
  CRISPR gRNA sequence
gagtgaagtactggtcagat

SEQ ID NO: 476705 - DNA, 20 bp, Artificial
  CRISPR gRNA sequence
agtgaagtactggtcagata

SEQ ID NO: 476706 - DNA, 20 bp, Artificial
  CRISPR gRNA sequence
gtcagatatataccagttga

SEQ ID NO: 476707 - DNA, 20 bp, Artificial
  CRISPR gRNA sequence
atataatggattgcagcagc

SEQ ID NO: 476708 - DNA, 20 bp, Artificial
  CRISPR gRNA sequence
cagcagcagttgcattaaat

SEQ ID NO: 476709 - DNA, 20 bp, Artificial
  CRISPR gRNA sequence
cattaaattaaagctatagg

SEQ ID NO: 476710 - DNA, 20 bp, Artificial
  CRISPR gRNA sequence
aattaaagctataggttaag

SEQ ID NO: 476711 - DNA, 20 bp, Artificial
  CRISPR gRNA sequence
aagctataggttaagagaag

SEQ ID NO: 476712 - DNA, 20 bp, Artificial
  CRISPR gRNA sequence
taggttaagagaaggaacat

SEQ ID NO: 476713 - DNA, 20 bp, Artificial
  CRISPR gRNA sequence
agagaaggaacatttggtga

SEQ ID NO: 476714 - DNA, 20 bp, Artificial
  CRISPR gRNA sequence
ggtgaaatttgttctcccag

SEQ ID NO: 476715 - DNA, 20 bp, Artificial
  CRISPR gRNA sequence
gtgaaatttgttctcccagg

SEQ ID NO: 476716 - DNA, 20 bp, Artificial
  CRISPR gRNA sequence
gttctcccaggcagagctga

SEQ ID NO: 476717 - DNA, 20 bp, Artificial
  CRISPR gRNA sequence
ttctcccaggcagagctgat

SEQ ID NO: 476718 - DNA, 20 bp, Artificial
  CRISPR gRNA sequence
tcccaggcagagctgatggc

SEQ ID NO: 476719 - DNA, 20 bp, Artificial
  CRISPR gRNA sequence
ccaggcagagctgatggctc

SEQ ID NO: 476720 - DNA, 20 bp, Artificial
  CRISPR gRNA sequence
atggctccatttcttaaaac

SEQ ID NO: 476721 - DNA, 20 bp, Artificial
  CRISPR gRNA sequence
catttcttaaaaccacatta

SEQ ID NO: 476722 - DNA, 20 bp, Artificial
  CRISPR gRNA sequence
cttaaaaccacattaaatac

SEQ ID NO: 476723 - DNA, 20 bp, Artificial
  CRISPR gRNA sequence
ttaaaaccacattaaatacc

SEQ ID NO: 476724 - DNA, 20 bp, Artificial
  CRISPR gRNA sequence
aaaaccacattaaatacctt

SEQ ID NO: 476725 - DNA, 20 bp, Artificial
  CRISPR gRNA sequence
aaaccacattaaatacctta

SEQ ID NO: 476726 - DNA, 20 bp, Artificial
  CRISPR gRNA sequence
aataccttatatcttgggga

SEQ ID NO: 476727 - DNA, 20 bp, Artificial
  CRISPR gRNA sequence
atatcttggggatttcctgt

SEQ ID NO: 476728 - DNA, 20 bp, Artificial
  CRISPR gRNA sequence
tatcttggggatttcctgtg

SEQ ID NO: 476729 - DNA, 20 bp, Artificial
  CRISPR gRNA sequence
ggggatttcctgtgatttac

SEQ ID NO: 476730 - DNA, 20 bp, Artificial
  CRISPR gRNA sequence
gggatttcctgtgatttact

SEQ ID NO: 476731 - DNA, 20 bp, Artificial
  CRISPR gRNA sequence
cctgtgatttacttaattgc

SEQ ID NO: 476732 - DNA, 20 bp, Artificial
  CRISPR gRNA sequence
ctgtgatttacttaattgct

SEQ ID NO: 476733 - DNA, 20 bp, Artificial
  CRISPR gRNA sequence
tgatttacttaattgctgag

SEQ ID NO: 476734 - DNA, 20 bp, Artificial
  CRISPR gRNA sequence
acttaattgctgagttcttt

SEQ ID NO: 476735 - DNA, 20 bp, Artificial
  CRISPR gRNA sequence
cttaattgctgagttcttta

SEQ ID NO: 476736 - DNA, 20 bp, Artificial
  CRISPR gRNA sequence
aattgctgagttctttacag

SEQ ID NO: 476737 - DNA, 20 bp, Artificial
  CRISPR gRNA sequence
attgctgagttctttacagt

SEQ ID NO: 476738 - DNA, 20 bp, Artificial
  CRISPR gRNA sequence
ctgagttctttacagtaata

SEQ ID NO: 476739 - DNA, 20 bp, Artificial
  CRISPR gRNA sequence
agttctttacagtaatacat

SEQ ID NO: 476740 - DNA, 20 bp, Artificial
  CRISPR gRNA sequence
tttacagtaatacattttca

SEQ ID NO: 476741 - DNA, 20 bp, Artificial
  CRISPR gRNA sequence
tacagtaatacattttcagt

SEQ ID NO: 476742 - DNA, 20 bp, Artificial
  CRISPR gRNA sequence
acagtaatacattttcagtg

SEQ ID NO: 476743 - DNA, 20 bp, Artificial
  CRISPR gRNA sequence
cagtaatacattttcagtgt

SEQ ID NO: 476744 - DNA, 20 bp, Artificial
  CRISPR gRNA sequence
tcagtgtttaaagatagcct

SEQ ID NO: 476745 - DNA, 20 bp, Artificial
  CRISPR gRNA sequence
cagtgtttaaagatagcctt

SEQ ID NO: 476746 - DNA, 20 bp, Artificial
  CRISPR gRNA sequence
agtgtttaaagatagccttt

SEQ ID NO: 476747 - DNA, 20 bp, Artificial
  CRISPR gRNA sequence
aaagatagcctttgaagatt

SEQ ID NO: 476748 - DNA, 20 bp, Artificial
  CRISPR gRNA sequence
aagatagcctttgaagattt

SEQ ID NO: 476749 - DNA, 20 bp, Artificial
  CRISPR gRNA sequence
tgaagattttttccccctac

SEQ ID NO: 476750 - DNA, 20 bp, Artificial
  CRISPR gRNA sequence
gaagattttttccccctact

SEQ ID NO: 476751 - DNA, 20 bp, Artificial
  CRISPR gRNA sequence
aagattttttccccctactt

SEQ ID NO: 476752 - DNA, 20 bp, Artificial
  CRISPR gRNA sequence
tttccccctacttcaaagca

SEQ ID NO: 476753 - DNA, 20 bp, Artificial
  CRISPR gRNA sequence
ttccccctacttcaaagcaa

SEQ ID NO: 476754 - DNA, 20 bp, Artificial
  CRISPR gRNA sequence
tccccctacttcaaagcaat

SEQ ID NO: 476755 - DNA, 20 bp, Artificial
  CRISPR gRNA sequence
ccccctacttcaaagcaatg

SEQ ID NO: 476756 - DNA, 20 bp, Artificial
  CRISPR gRNA sequence
cccctacttcaaagcaatgt

SEQ ID NO: 476757 - DNA, 20 bp, Artificial
  CRISPR gRNA sequence
cttcaaagcaatgtgagatc

SEQ ID NO: 476758 - DNA, 20 bp, Artificial
  CRISPR gRNA sequence
caaagcaatgtgagatccgt

SEQ ID NO: 476759 - DNA, 20 bp, Artificial
  CRISPR gRNA sequence
aaagcaatgtgagatccgtg

SEQ ID NO: 476760 - DNA, 20 bp, Artificial
  CRISPR gRNA sequence
gttcctaggagtgaggctgc

SEQ ID NO: 476761 - DNA, 20 bp, Artificial
  CRISPR gRNA sequence
ttcctaggagtgaggctgca

SEQ ID NO: 476762 - DNA, 20 bp, Artificial
  CRISPR gRNA sequence
ctaggagtgaggctgcatat

SEQ ID NO: 476763 - DNA, 20 bp, Artificial
  CRISPR gRNA sequence
ggagtgaggctgcatatata

SEQ ID NO: 476764 - DNA, 20 bp, Artificial
  CRISPR gRNA sequence
catatataataaggctggaa

SEQ ID NO: 476765 - DNA, 20 bp, Artificial
  CRISPR gRNA sequence
gaaaaaatgtaatgttctct

SEQ ID NO: 476766 - DNA, 20 bp, Artificial
  CRISPR gRNA sequence
tctacaaacttcctgtttaa

SEQ ID NO: 476767 - DNA, 20 bp, Artificial
  CRISPR gRNA sequence
tacaaacttcctgtttaagg

SEQ ID NO: 476768 - DNA, 20 bp, Artificial
  CRISPR gRNA sequence
caaacttcctgtttaaggtc

SEQ ID NO: 476769 - DNA, 20 bp, Artificial
  CRISPR gRNA sequence
cctgtttaaggtccttcttt

SEQ ID NO: 476770 - DNA, 20 bp, Artificial
  CRISPR gRNA sequence
ctgtttaaggtccttcttta

SEQ ID NO: 476771 - DNA, 20 bp, Artificial
  CRISPR gRNA sequence
tttaaggtccttctttatta

SEQ ID NO: 476772 - DNA, 20 bp, Artificial
  CRISPR gRNA sequence
aaggtccttctttattacaa

SEQ ID NO: 476773 - DNA, 20 bp, Artificial
  CRISPR gRNA sequence
aggtccttctttattacaaa

SEQ ID NO: 476774 - DNA, 20 bp, Artificial
  CRISPR gRNA sequence
ctttattacaaaagtatgct

SEQ ID NO: 476775 - DNA, 20 bp, Artificial
  CRISPR gRNA sequence
tttattacaaaagtatgctt

SEQ ID NO: 476776 - DNA, 20 bp, Artificial
  CRISPR gRNA sequence
tattacaaaagtatgcttgc

SEQ ID NO: 476777 - DNA, 20 bp, Artificial
  CRISPR gRNA sequence
attacaaaagtatgcttgct

SEQ ID NO: 476778 - DNA, 20 bp, Artificial
  CRISPR gRNA sequence
ttacaaaagtatgcttgctt

SEQ ID NO: 476779 - DNA, 20 bp, Artificial
  CRISPR gRNA sequence
caaaagtatgcttgcttact

SEQ ID NO: 476780 - DNA, 20 bp, Artificial
  CRISPR gRNA sequence
gcttactttttgtgtttctc

SEQ ID NO: 476781 - DNA, 20 bp, Artificial
  CRISPR gRNA sequence
cttactttttgtgtttctct

SEQ ID NO: 476782 - DNA, 20 bp, Artificial
  CRISPR gRNA sequence
actttttgtgtttctctaaa

SEQ ID NO: 476783 - DNA, 20 bp, Artificial
  CRISPR gRNA sequence
ctttttgtgtttctctaaaa

SEQ ID NO: 476784 - DNA, 20 bp, Artificial
  CRISPR gRNA sequence
tttgtgtttctctaaaaaat

SEQ ID NO: 476785 - DNA, 20 bp, Artificial
  CRISPR gRNA sequence
ttgtgtttctctaaaaaatt

SEQ ID NO: 476786 - DNA, 20 bp, Artificial
  CRISPR gRNA sequence
tgtgtttctctaaaaaatta

SEQ ID NO: 476787 - DNA, 20 bp, Artificial
  CRISPR gRNA sequence
gtgtttctctaaaaaattag

SEQ ID NO: 476788 - DNA, 20 bp, Artificial
  CRISPR gRNA sequence
tgtttctctaaaaaattaga

SEQ ID NO: 476789 - DNA, 20 bp, Artificial
  CRISPR gRNA sequence
ctctaaaaaattagagaaac

SEQ ID NO: 476790 - DNA, 20 bp, Artificial
  CRISPR gRNA sequence
tctaaaaaattagagaaact

SEQ ID NO: 476791 - DNA, 20 bp, Artificial
  CRISPR gRNA sequence
taaaaaattagagaaacttg

SEQ ID NO: 476792 - DNA, 20 bp, Artificial
  CRISPR gRNA sequence
aaaaattagagaaacttgcc

SEQ ID NO: 476793 - DNA, 20 bp, Artificial
  CRISPR gRNA sequence
gagaaacttgcccctcagtg

SEQ ID NO: 476794 - DNA, 20 bp, Artificial
  CRISPR gRNA sequence
gcccctcagtgtgtggcata

SEQ ID NO: 476795 - DNA, 20 bp, Artificial
  CRISPR gRNA sequence
cccctcagtgtgtggcatac

SEQ ID NO: 476796 - DNA, 20 bp, Artificial
  CRISPR gRNA sequence
agtgtgtggcatacagtttc

SEQ ID NO: 476797 - DNA, 20 bp, Artificial
  CRISPR gRNA sequence
ctgtcctgatagaagtaata

SEQ ID NO: 476798 - DNA, 20 bp, Artificial
  CRISPR gRNA sequence
tgtcctgatagaagtaataa

SEQ ID NO: 476799 - DNA, 20 bp, Artificial
  CRISPR gRNA sequence
tcctgatagaagtaataaaa

SEQ ID NO: 476800 - DNA, 20 bp, Artificial
  CRISPR gRNA sequence
atagaagtaataaaaatgtc

SEQ ID NO: 476801 - DNA, 20 bp, Artificial
  CRISPR gRNA sequence
cccttcatgggcagatcatg

SEQ ID NO: 476802 - DNA, 20 bp, Artificial
  CRISPR gRNA sequence
ccttcatgggcagatcatgc

SEQ ID NO: 476803 - DNA, 20 bp, Artificial
  CRISPR gRNA sequence
catgggcagatcatgctggc

SEQ ID NO: 476804 - DNA, 20 bp, Artificial
  CRISPR gRNA sequence
atgggcagatcatgctggca

SEQ ID NO: 476805 - DNA, 20 bp, Artificial
  CRISPR gRNA sequence
gcaagatctagactgcaagt

SEQ ID NO: 476806 - DNA, 20 bp, Artificial
  CRISPR gRNA sequence
gactgcaagtggaagtgtct

SEQ ID NO: 476807 - DNA, 20 bp, Artificial
  CRISPR gRNA sequence
caagtggaagtgtctctgtc

SEQ ID NO: 476808 - DNA, 20 bp, Artificial
  CRISPR gRNA sequence
tgtccattgcctgccctgtc

SEQ ID NO: 476809 - DNA, 20 bp, Artificial
  CRISPR gRNA sequence
tccattgcctgccctgtcat

SEQ ID NO: 476810 - DNA, 20 bp, Artificial
  CRISPR gRNA sequence
cctgccctgtcatcctggac

SEQ ID NO: 476811 - DNA, 20 bp, Artificial
  CRISPR gRNA sequence
ccctgtcatcctggaccatt

SEQ ID NO: 476812 - DNA, 20 bp, Artificial
  CRISPR gRNA sequence
tcatcctggaccatttgtct

SEQ ID NO: 476813 - DNA, 20 bp, Artificial
  CRISPR gRNA sequence
gaccatttgtctgaggctgc

SEQ ID NO: 476814 - DNA, 20 bp, Artificial
  CRISPR gRNA sequence
gtctgaggctgccctagacc

SEQ ID NO: 476815 - DNA, 20 bp, Artificial
  CRISPR gRNA sequence
tctgaggctgccctagaccc

SEQ ID NO: 476816 - DNA, 20 bp, Artificial
  CRISPR gRNA sequence
aggctgccctagaccctagt

SEQ ID NO: 476817 - DNA, 20 bp, Artificial
  CRISPR gRNA sequence
ccctagaccctagttcagtt

SEQ ID NO: 476818 - DNA, 20 bp, Artificial
  CRISPR gRNA sequence
gaccctagttcagttgagga

SEQ ID NO: 476819 - DNA, 20 bp, Artificial
  CRISPR gRNA sequence
gttcagttgaggatcaacca

SEQ ID NO: 476820 - DNA, 20 bp, Artificial
  CRISPR gRNA sequence
agttgaggatcaaccaagga

SEQ ID NO: 476821 - DNA, 20 bp, Artificial
  CRISPR gRNA sequence
aggatcaaccaaggattcca

SEQ ID NO: 476822 - DNA, 20 bp, Artificial
  CRISPR gRNA sequence
cacttttaggcaggcaggaa

SEQ ID NO: 476823 - DNA, 20 bp, Artificial
  CRISPR gRNA sequence
ttaggcaggcaggaacactg

SEQ ID NO: 476824 - DNA, 20 bp, Artificial
  CRISPR gRNA sequence
taggcaggcaggaacactgc

SEQ ID NO: 476825 - DNA, 20 bp, Artificial
  CRISPR gRNA sequence
aggcaggcaggaacactgca

SEQ ID NO: 476826 - DNA, 20 bp, Artificial
  CRISPR gRNA sequence
ggcaggcaggaacactgcag

SEQ ID NO: 476827 - DNA, 20 bp, Artificial
  CRISPR gRNA sequence
cagttaatgtctgggtatca

SEQ ID NO: 476828 - DNA, 20 bp, Artificial
  CRISPR gRNA sequence
atgtctgggtatcaccaaca

SEQ ID NO: 476829 - DNA, 20 bp, Artificial
  CRISPR gRNA sequence
ggtatcaccaacaccatata

SEQ ID NO: 476830 - DNA, 20 bp, Artificial
  CRISPR gRNA sequence
gaactgtttgattgattact

SEQ ID NO: 476831 - DNA, 20 bp, Artificial
  CRISPR gRNA sequence
tttgattgattactggttat

SEQ ID NO: 476832 - DNA, 20 bp, Artificial
  CRISPR gRNA sequence
gattgattactggttattgt

SEQ ID NO: 476833 - DNA, 20 bp, Artificial
  CRISPR gRNA sequence
attgattactggttattgtg

SEQ ID NO: 476834 - DNA, 20 bp, Artificial
  CRISPR gRNA sequence
attactggttattgtgattt

SEQ ID NO: 476835 - DNA, 20 bp, Artificial
  CRISPR gRNA sequence
ctggttattgtgatttttaa

SEQ ID NO: 476836 - DNA, 20 bp, Artificial
  CRISPR gRNA sequence
gttattgtgatttttaaaaa

SEQ ID NO: 476837 - DNA, 20 bp, Artificial
  CRISPR gRNA sequence
ttgtgatttttaaaaaaagc

SEQ ID NO: 476838 - DNA, 20 bp, Artificial
  CRISPR gRNA sequence
tgatttttaaaaaaagcaat

SEQ ID NO: 476839 - DNA, 20 bp, Artificial
  CRISPR gRNA sequence
ttaaaaaaagcaatcctagt

SEQ ID NO: 476840 - DNA, 20 bp, Artificial
  CRISPR gRNA sequence
taaaaaaagcaatcctagtc

SEQ ID NO: 476841 - DNA, 20 bp, Artificial
  CRISPR gRNA sequence
aaaaaaagcaatcctagtct

SEQ ID NO: 476842 - DNA, 20 bp, Artificial
  CRISPR gRNA sequence
aaaaaagcaatcctagtctg

SEQ ID NO: 476843 - DNA, 20 bp, Artificial
  CRISPR gRNA sequence
gtctggttcagtaagggaaa

SEQ ID NO: 476844 - DNA, 20 bp, Artificial
  CRISPR gRNA sequence
gttcagtaagggaaagacac

SEQ ID NO: 476845 - DNA, 20 bp, Artificial
  CRISPR gRNA sequence
agtaagggaaagacacctgt

SEQ ID NO: 476846 - DNA, 20 bp, Artificial
  CRISPR gRNA sequence
tattctggctcttttgagaa

SEQ ID NO: 476847 - DNA, 20 bp, Artificial
  CRISPR gRNA sequence
tggctcttttgagaatacag

SEQ ID NO: 476848 - DNA, 20 bp, Artificial
  CRISPR gRNA sequence
gctcttttgagaatacagtg

SEQ ID NO: 476849 - DNA, 20 bp, Artificial
  CRISPR gRNA sequence
ttttgagaatacagtggtta

SEQ ID NO: 476850 - DNA, 20 bp, Artificial
  CRISPR gRNA sequence
ttgagaatacagtggttagg

SEQ ID NO: 476851 - DNA, 20 bp, Artificial
  CRISPR gRNA sequence
tgagaatacagtggttaggg

SEQ ID NO: 476852 - DNA, 20 bp, Artificial
  CRISPR gRNA sequence
gagaatacagtggttagggc

SEQ ID NO: 476853 - DNA, 20 bp, Artificial
  CRISPR gRNA sequence
agaatacagtggttagggct

SEQ ID NO: 476854 - DNA, 20 bp, Artificial
  CRISPR gRNA sequence
gggctatgtctccattttgg

SEQ ID NO: 476855 - DNA, 20 bp, Artificial
  CRISPR gRNA sequence
tgtctccattttggtctggc

SEQ ID NO: 476856 - DNA, 20 bp, Artificial
  CRISPR gRNA sequence
cattttggtctggcttgtgt

SEQ ID NO: 476857 - DNA, 20 bp, Artificial
  CRISPR gRNA sequence
tggtctggcttgtgtcattt

SEQ ID NO: 476858 - DNA, 20 bp, Artificial
  CRISPR gRNA sequence
ggtctggcttgtgtcatttt

SEQ ID NO: 476859 - DNA, 20 bp, Artificial
  CRISPR gRNA sequence
gtctggcttgtgtcattttt

SEQ ID NO: 476860 - DNA, 20 bp, Artificial
  CRISPR gRNA sequence
gcttgtgtcatttttttccc

SEQ ID NO: 476861 - DNA, 20 bp, Artificial
  CRISPR gRNA sequence
gtgtcatttttttcccttta

SEQ ID NO: 476862 - DNA, 20 bp, Artificial
  CRISPR gRNA sequence
tgtcatttttttccctttat

SEQ ID NO: 476863 - DNA, 20 bp, Artificial
  CRISPR gRNA sequence
ttttccctttattatgatgg

SEQ ID NO: 476864 - DNA, 20 bp, Artificial
  CRISPR gRNA sequence
tttccctttattatgatggt

SEQ ID NO: 476865 - DNA, 20 bp, Artificial
  CRISPR gRNA sequence
ttccctttattatgatggtc

SEQ ID NO: 476866 - DNA, 20 bp, Artificial
  CRISPR gRNA sequence
tccctttattatgatggtcc

SEQ ID NO: 476867 - DNA, 20 bp, Artificial
  CRISPR gRNA sequence
ccctttattatgatggtcca

SEQ ID NO: 476868 - DNA, 20 bp, Artificial
  CRISPR gRNA sequence
cctttattatgatggtccag

SEQ ID NO: 476869 - DNA, 20 bp, Artificial
  CRISPR gRNA sequence
tattatgatggtccagtatg

SEQ ID NO: 476870 - DNA, 20 bp, Artificial
  CRISPR gRNA sequence
attatgatggtccagtatgg

SEQ ID NO: 476871 - DNA, 20 bp, Artificial
  CRISPR gRNA sequence
ttatgatggtccagtatggt

SEQ ID NO: 476872 - DNA, 20 bp, Artificial
  CRISPR gRNA sequence
tgatggtccagtatggtcca

SEQ ID NO: 476873 - DNA, 20 bp, Artificial
  CRISPR gRNA sequence
ttaaacaccgtgttccacat

SEQ ID NO: 476874 - DNA, 20 bp, Artificial
  CRISPR gRNA sequence
taaacaccgtgttccacatc

SEQ ID NO: 476875 - DNA, 20 bp, Artificial
  CRISPR gRNA sequence
aaacaccgtgttccacatcc

SEQ ID NO: 476876 - DNA, 20 bp, Artificial
  CRISPR gRNA sequence
aacaccgtgttccacatccc

SEQ ID NO: 476877 - DNA, 20 bp, Artificial
  CRISPR gRNA sequence
cacatcccacacagattgtt

SEQ ID NO: 476878 - DNA, 20 bp, Artificial
  CRISPR gRNA sequence
ttttgctctactacaaactg

SEQ ID NO: 476879 - DNA, 20 bp, Artificial
  CRISPR gRNA sequence
tgctctactacaaactggcc

SEQ ID NO: 476880 - DNA, 20 bp, Artificial
  CRISPR gRNA sequence
gctctactacaaactggcca

SEQ ID NO: 476881 - DNA, 20 bp, Artificial
  CRISPR gRNA sequence
ctctactacaaactggccat

SEQ ID NO: 476882 - DNA, 20 bp, Artificial
  CRISPR gRNA sequence
tactacaaactggccatatc

SEQ ID NO: 476883 - DNA, 20 bp, Artificial
  CRISPR gRNA sequence
ctacaaactggccatatctt

SEQ ID NO: 476884 - DNA, 20 bp, Artificial
  CRISPR gRNA sequence
caaactggccatatctttgg

SEQ ID NO: 476885 - DNA, 20 bp, Artificial
  CRISPR gRNA sequence
gccatatctttgggtcaaaa

SEQ ID NO: 476886 - DNA, 20 bp, Artificial
  CRISPR gRNA sequence
tgggtcaaaaaatatcattc

SEQ ID NO: 476887 - DNA, 20 bp, Artificial
  CRISPR gRNA sequence
gggtcaaaaaatatcattcc

SEQ ID NO: 476888 - DNA, 20 bp, Artificial
  CRISPR gRNA sequence
ggtcaaaaaatatcattcct

SEQ ID NO: 476889 - DNA, 20 bp, Artificial
  CRISPR gRNA sequence
cttgaagttcaggttttgta

SEQ ID NO: 476890 - DNA, 20 bp, Artificial
  CRISPR gRNA sequence
gaagttcaggttttgtagca

SEQ ID NO: 476891 - DNA, 20 bp, Artificial
  CRISPR gRNA sequence
aagttcaggttttgtagcac

SEQ ID NO: 476892 - DNA, 20 bp, Artificial
  CRISPR gRNA sequence
aggttttgtagcacagtatc

SEQ ID NO: 476893 - DNA, 20 bp, Artificial
  CRISPR gRNA sequence
tgtagcacagtatctttata

SEQ ID NO: 476894 - DNA, 20 bp, Artificial
  CRISPR gRNA sequence
gtagcacagtatctttataa

SEQ ID NO: 476895 - DNA, 20 bp, Artificial
  CRISPR gRNA sequence
tagcacagtatctttataag

SEQ ID NO: 476896 - DNA, 20 bp, Artificial
  CRISPR gRNA sequence
tataaggcatatttctatgg

SEQ ID NO: 476897 - DNA, 20 bp, Artificial
  CRISPR gRNA sequence
ataaggcatatttctatggc

SEQ ID NO: 476898 - DNA, 20 bp, Artificial
  CRISPR gRNA sequence
taaggcatatttctatggct

SEQ ID NO: 476899 - DNA, 20 bp, Artificial
  CRISPR gRNA sequence
ctatggcttcagctatttgt

SEQ ID NO: 476900 - DNA, 20 bp, Artificial
  CRISPR gRNA sequence
tatggcttcagctatttgtt

SEQ ID NO: 476901 - DNA, 20 bp, Artificial
  CRISPR gRNA sequence
tggcttcagctatttgttct

SEQ ID NO: 476902 - DNA, 20 bp, Artificial
  CRISPR gRNA sequence
cagctatttgttcttattga

SEQ ID NO: 476903 - DNA, 20 bp, Artificial
  CRISPR gRNA sequence
agctatttgttcttattgaa

SEQ ID NO: 476904 - DNA, 20 bp, Artificial
  CRISPR gRNA sequence
tttgttcttattgaaatgtg

SEQ ID NO: 476905 - DNA, 20 bp, Artificial
  CRISPR gRNA sequence
gttcttattgaaatgtgcat

SEQ ID NO: 476906 - DNA, 20 bp, Artificial
  CRISPR gRNA sequence
ttcttattgaaatgtgcata

SEQ ID NO: 476907 - DNA, 20 bp, Artificial
  CRISPR gRNA sequence
ttattgaaatgtgcatatgg

SEQ ID NO: 476908 - DNA, 20 bp, Artificial
  CRISPR gRNA sequence
attgaaatgtgcatatggag

SEQ ID NO: 476909 - DNA, 20 bp, Artificial
  CRISPR gRNA sequence
ttgaaatgtgcatatggagg

SEQ ID NO: 476910 - DNA, 20 bp, Artificial
  CRISPR gRNA sequence
aaatgtgcatatggaggaat

SEQ ID NO: 476911 - DNA, 20 bp, Artificial
  CRISPR gRNA sequence
gagatagagctctgtcttct

SEQ ID NO: 476912 - DNA, 20 bp, Artificial
  CRISPR gRNA sequence
tgtcttctgccaagtgccta

SEQ ID NO: 476913 - DNA, 20 bp, Artificial
  CRISPR gRNA sequence
tcttctgccaagtgcctatg

SEQ ID NO: 476914 - DNA, 20 bp, Artificial
  CRISPR gRNA sequence
ctgccaagtgcctatgtatt

SEQ ID NO: 476915 - DNA, 20 bp, Artificial
  CRISPR gRNA sequence
tgccaagtgcctatgtattg

SEQ ID NO: 476916 - DNA, 20 bp, Artificial
  CRISPR gRNA sequence
ccaagtgcctatgtattgtt

SEQ ID NO: 476917 - DNA, 20 bp, Artificial
  CRISPR gRNA sequence
tgtattgttacaacaatgcc

SEQ ID NO: 476918 - DNA, 20 bp, Artificial
  CRISPR gRNA sequence
ttacaacaatgcctgccata

SEQ ID NO: 476919 - DNA, 20 bp, Artificial
  CRISPR gRNA sequence
caacaatgcctgccatatat

SEQ ID NO: 476920 - DNA, 20 bp, Artificial
  CRISPR gRNA sequence
ccatatattaaataaatgtt

SEQ ID NO: 476921 - DNA, 20 bp, Artificial
  CRISPR gRNA sequence
aataaatgtttaggaatgca

SEQ ID NO: 476922 - DNA, 20 bp, Artificial
  CRISPR gRNA sequence
aggaatgcattctgtggtta

SEQ ID NO: 476923 - DNA, 20 bp, Artificial
  CRISPR gRNA sequence
ggaatgcattctgtggttac

SEQ ID NO: 476924 - DNA, 20 bp, Artificial
  CRISPR gRNA sequence
tgtggttacaggacttcttg

SEQ ID NO: 476925 - DNA, 20 bp, Artificial
  CRISPR gRNA sequence
tggttacaggacttcttgaa

SEQ ID NO: 476926 - DNA, 20 bp, Artificial
  CRISPR gRNA sequence
caggacttcttgaattaaag

SEQ ID NO: 476927 - DNA, 20 bp, Artificial
  CRISPR gRNA sequence
cttgaattaaagcatgaaaa

SEQ ID NO: 476928 - DNA, 20 bp, Artificial
  CRISPR gRNA sequence
ttgaattaaagcatgaaaag

SEQ ID NO: 476929 - DNA, 20 bp, Artificial
  CRISPR gRNA sequence
gaattaaagcatgaaaagat

SEQ ID NO: 476930 - DNA, 20 bp, Artificial
  CRISPR gRNA sequence
aattaaagcatgaaaagatt

SEQ ID NO: 476931 - DNA, 20 bp, Artificial
  CRISPR gRNA sequence
aagcatgaaaagattaacct

SEQ ID NO: 476932 - DNA, 20 bp, Artificial
  CRISPR gRNA sequence
accttgtgctcattgcagcc

SEQ ID NO: 476933 - DNA, 20 bp, Artificial
  CRISPR gRNA sequence
gtgctcattgcagccttgaa

SEQ ID NO: 476934 - DNA, 20 bp, Artificial
  CRISPR gRNA sequence
tgctcattgcagccttgaat

SEQ ID NO: 476935 - DNA, 20 bp, Artificial
  CRISPR gRNA sequence
attgcagccttgaatatact

SEQ ID NO: 476936 - DNA, 20 bp, Artificial
  CRISPR gRNA sequence
cagccttgaatatacttttc

SEQ ID NO: 476937 - DNA, 20 bp, Artificial
  CRISPR gRNA sequence
gaatatacttttcctatcac

SEQ ID NO: 476938 - DNA, 20 bp, Artificial
  CRISPR gRNA sequence
aatatacttttcctatcaca

SEQ ID NO: 476939 - DNA, 20 bp, Artificial
  CRISPR gRNA sequence
ttcctatcacagagaagttt

SEQ ID NO: 476940 - DNA, 20 bp, Artificial
  CRISPR gRNA sequence
tcctatcacagagaagtttt

SEQ ID NO: 476941 - DNA, 20 bp, Artificial
  CRISPR gRNA sequence
cctatcacagagaagttttt

SEQ ID NO: 476942 - DNA, 20 bp, Artificial
  CRISPR gRNA sequence
ctatcacagagaagttttta

SEQ ID NO: 476943 - DNA, 20 bp, Artificial
  CRISPR gRNA sequence
tcacagagaagtttttaaat

SEQ ID NO: 476944 - DNA, 20 bp, Artificial
  CRISPR gRNA sequence
ttaaatttcttgcttcctct

SEQ ID NO: 476945 - DNA, 20 bp, Artificial
  CRISPR gRNA sequence
taaatttcttgcttcctctg

SEQ ID NO: 476946 - DNA, 20 bp, Artificial
  CRISPR gRNA sequence
aaatttcttgcttcctctgt

SEQ ID NO: 476947 - DNA, 20 bp, Artificial
  CRISPR gRNA sequence
aatttcttgcttcctctgtc

SEQ ID NO: 476948 - DNA, 20 bp, Artificial
  CRISPR gRNA sequence
cttgcttcctctgtcctact

SEQ ID NO: 476949 - DNA, 20 bp, Artificial
  CRISPR gRNA sequence
ttgcttcctctgtcctacta

SEQ ID NO: 476950 - DNA, 20 bp, Artificial
  CRISPR gRNA sequence
gcttcctctgtcctactacc

SEQ ID NO: 476951 - DNA, 20 bp, Artificial
  CRISPR gRNA sequence
cttcctctgtcctactacca

SEQ ID NO: 476952 - DNA, 20 bp, Artificial
  CRISPR gRNA sequence
cctctgtcctactaccaaag

SEQ ID NO: 476953 - DNA, 20 bp, Artificial
  CRISPR gRNA sequence
ctctgtcctactaccaaagt

SEQ ID NO: 476954 - DNA, 20 bp, Artificial
  CRISPR gRNA sequence
tgtcctactaccaaagtttc

SEQ ID NO: 476955 - DNA, 20 bp, Artificial
  CRISPR gRNA sequence
tcctactaccaaagtttcct

SEQ ID NO: 476956 - DNA, 20 bp, Artificial
  CRISPR gRNA sequence
ctaccaaagtttcctctatt

SEQ ID NO: 476957 - DNA, 20 bp, Artificial
  CRISPR gRNA sequence
ccaaagtttcctctattgta

SEQ ID NO: 476958 - DNA, 20 bp, Artificial
  CRISPR gRNA sequence
cctctattgtaaagttgacg

SEQ ID NO: 476959 - DNA, 20 bp, Artificial
  CRISPR gRNA sequence
ctctattgtaaagttgacgt

SEQ ID NO: 476960 - DNA, 20 bp, Artificial
  CRISPR gRNA sequence
tattgtaaagttgacgtcaa

SEQ ID NO: 476961 - DNA, 20 bp, Artificial
  CRISPR gRNA sequence
ttgtaaagttgacgtcaaaa

SEQ ID NO: 476962 - DNA, 20 bp, Artificial
  CRISPR gRNA sequence
taaagttgacgtcaaaacta

SEQ ID NO: 476963 - DNA, 20 bp, Artificial
  CRISPR gRNA sequence
acgtcaaaactatttatctt

SEQ ID NO: 476964 - DNA, 20 bp, Artificial
  CRISPR gRNA sequence
tttatcttgcctcattggga

SEQ ID NO: 476965 - DNA, 20 bp, Artificial
  CRISPR gRNA sequence
atcttgcctcattgggactt

SEQ ID NO: 476966 - DNA, 20 bp, Artificial
  CRISPR gRNA sequence
tcttgcctcattgggacttt

SEQ ID NO: 476967 - DNA, 20 bp, Artificial
  CRISPR gRNA sequence
gcctcattgggactttccta

SEQ ID NO: 476968 - DNA, 20 bp, Artificial
  CRISPR gRNA sequence
cctcattgggactttcctac

SEQ ID NO: 476969 - DNA, 20 bp, Artificial
  CRISPR gRNA sequence
attgggactttcctacttaa

SEQ ID NO: 476970 - DNA, 20 bp, Artificial
  CRISPR gRNA sequence
ggactttcctacttaatttc

SEQ ID NO: 476971 - DNA, 20 bp, Artificial
  CRISPR gRNA sequence
tcctacttaatttccattat

SEQ ID NO: 476972 - DNA, 20 bp, Artificial
  CRISPR gRNA sequence
cctacttaatttccattatt

SEQ ID NO: 476973 - DNA, 20 bp, Artificial
  CRISPR gRNA sequence
ctacttaatttccattattt

SEQ ID NO: 476974 - DNA, 20 bp, Artificial
  CRISPR gRNA sequence
cttaatttccattatttgtg

SEQ ID NO: 476975 - DNA, 20 bp, Artificial
  CRISPR gRNA sequence
aatttccattatttgtgagt

SEQ ID NO: 476976 - DNA, 20 bp, Artificial
  CRISPR gRNA sequence
atttccattatttgtgagtt

SEQ ID NO: 476977 - DNA, 20 bp, Artificial
  CRISPR gRNA sequence
ccattatttgtgagtttcat

SEQ ID NO: 476978 - DNA, 20 bp, Artificial
  CRISPR gRNA sequence
cattatttgtgagtttcatc

SEQ ID NO: 476979 - DNA, 20 bp, Artificial
  CRISPR gRNA sequence
tttgtgagtttcatctttat

SEQ ID NO: 476980 - DNA, 20 bp, Artificial
  CRISPR gRNA sequence
gtgagtttcatctttatgta

SEQ ID NO: 476981 - DNA, 20 bp, Artificial
  CRISPR gRNA sequence
tgagtttcatctttatgtag

SEQ ID NO: 476982 - DNA, 20 bp, Artificial
  CRISPR gRNA sequence
catctttatgtagagttcag

SEQ ID NO: 476983 - DNA, 20 bp, Artificial
  CRISPR gRNA sequence
atctttatgtagagttcaga

SEQ ID NO: 476984 - DNA, 20 bp, Artificial
  CRISPR gRNA sequence
tatgtagagttcagaattgt

SEQ ID NO: 476985 - DNA, 20 bp, Artificial
  CRISPR gRNA sequence
atgtagagttcagaattgtt

SEQ ID NO: 476986 - DNA, 20 bp, Artificial
  CRISPR gRNA sequence
tgtagagttcagaattgtta

SEQ ID NO: 476987 - DNA, 20 bp, Artificial
  CRISPR gRNA sequence
agaattgttaaaagaaaaat

SEQ ID NO: 476988 - DNA, 20 bp, Artificial
  CRISPR gRNA sequence
ttaaaagaaaaatatttaca

SEQ ID NO: 476989 - DNA, 20 bp, Artificial
  CRISPR gRNA sequence
aaagaaaaatatttacaggc

SEQ ID NO: 476990 - DNA, 20 bp, Artificial
  CRISPR gRNA sequence
acaggcatttgtaatcaggt

SEQ ID NO: 476991 - DNA, 20 bp, Artificial
  CRISPR gRNA sequence
caggcatttgtaatcaggtc

SEQ ID NO: 476992 - DNA, 20 bp, Artificial
  CRISPR gRNA sequence
gtaatcaggtccaaaaaata

SEQ ID NO: 476993 - DNA, 20 bp, Artificial
  CRISPR gRNA sequence
taatcaggtccaaaaaataa

SEQ ID NO: 476994 - DNA, 20 bp, Artificial
  CRISPR gRNA sequence
tcttttttccttggagaagc

SEQ ID NO: 476995 - DNA, 20 bp, Artificial
  CRISPR gRNA sequence
cttttttccttggagaagct

SEQ ID NO: 476996 - DNA, 20 bp, Artificial
  CRISPR gRNA sequence
ttttttccttggagaagctg

SEQ ID NO: 476997 - DNA, 20 bp, Artificial
  CRISPR gRNA sequence
ttttccttggagaagctgtg

SEQ ID NO: 476998 - DNA, 20 bp, Artificial
  CRISPR gRNA sequence
tttccttggagaagctgtgt

SEQ ID NO: 476999 - DNA, 20 bp, Artificial
  CRISPR gRNA sequence
ttccttggagaagctgtgtg

SEQ ID NO: 477000 - DNA, 20 bp, Artificial
  CRISPR gRNA sequence
tccttggagaagctgtgtgg

SEQ ID NO: 477001 - DNA, 20 bp, Artificial
  CRISPR gRNA sequence
ccttggagaagctgtgtggt

SEQ ID NO: 477002 - DNA, 20 bp, Artificial
  CRISPR gRNA sequence
cttggagaagctgtgtggta

SEQ ID NO: 477003 - DNA, 20 bp, Artificial
  CRISPR gRNA sequence
ggagaagctgtgtggtatag

SEQ ID NO: 477004 - DNA, 20 bp, Artificial
  CRISPR gRNA sequence
gagaagctgtgtggtatagt

SEQ ID NO: 477005 - DNA, 20 bp, Artificial
  CRISPR gRNA sequence
tgtggtatagtggctaagat

SEQ ID NO: 477006 - DNA, 20 bp, Artificial
  CRISPR gRNA sequence
agatcagggactctaaagcc

SEQ ID NO: 477007 - DNA, 20 bp, Artificial
  CRISPR gRNA sequence
taaagccagactccatggat

SEQ ID NO: 477008 - DNA, 20 bp, Artificial
  CRISPR gRNA sequence
aagccagactccatggatta

SEQ ID NO: 477009 - DNA, 20 bp, Artificial
  CRISPR gRNA sequence
catggattagtatcctatgt

SEQ ID NO: 477010 - DNA, 20 bp, Artificial
  CRISPR gRNA sequence
gtatcctatgtctgccattt

SEQ ID NO: 477011 - DNA, 20 bp, Artificial
  CRISPR gRNA sequence
tgtctgccatttaatggttt

SEQ ID NO: 477012 - DNA, 20 bp, Artificial
  CRISPR gRNA sequence
ccatttaatggttttgtgac

SEQ ID NO: 477013 - DNA, 20 bp, Artificial
  CRISPR gRNA sequence
aatggttttgtgactataaa

SEQ ID NO: 477014 - DNA, 20 bp, Artificial
  CRISPR gRNA sequence
atggttttgtgactataaaa

SEQ ID NO: 477015 - DNA, 20 bp, Artificial
  CRISPR gRNA sequence
tgtgactataaaatctctgg

SEQ ID NO: 477016 - DNA, 20 bp, Artificial
  CRISPR gRNA sequence
gtgactataaaatctctggt

SEQ ID NO: 477017 - DNA, 20 bp, Artificial
  CRISPR gRNA sequence
tgactataaaatctctggtt

SEQ ID NO: 477018 - DNA, 20 bp, Artificial
  CRISPR gRNA sequence
taaaatctctggttctcagt

SEQ ID NO: 477019 - DNA, 20 bp, Artificial
  CRISPR gRNA sequence
tggttctcagttttctcatc

SEQ ID NO: 477020 - DNA, 20 bp, Artificial
  CRISPR gRNA sequence
gttctcagttttctcatcta

SEQ ID NO: 477021 - DNA, 20 bp, Artificial
  CRISPR gRNA sequence
tcagttttctcatctaaaaa

SEQ ID NO: 477022 - DNA, 20 bp, Artificial
  CRISPR gRNA sequence
agttttctcatctaaaaaaa

SEQ ID NO: 477023 - DNA, 20 bp, Artificial
  CRISPR gRNA sequence
tctcatctaaaaaaatggga

SEQ ID NO: 477024 - DNA, 20 bp, Artificial
  CRISPR gRNA sequence
ctcatctaaaaaaatgggag

SEQ ID NO: 477025 - DNA, 20 bp, Artificial
  CRISPR gRNA sequence
tcatctaaaaaaatgggaga

SEQ ID NO: 477026 - DNA, 20 bp, Artificial
  CRISPR gRNA sequence
atctaaaaaaatgggagaat

SEQ ID NO: 477027 - DNA, 20 bp, Artificial
  CRISPR gRNA sequence
aaaaaatgggagaataatct

SEQ ID NO: 477028 - DNA, 20 bp, Artificial
  CRISPR gRNA sequence
ataaggttgttgtgactatt

SEQ ID NO: 477029 - DNA, 20 bp, Artificial
  CRISPR gRNA sequence
taaggttgttgtgactatta

SEQ ID NO: 477030 - DNA, 20 bp, Artificial
  CRISPR gRNA sequence
ttgtgactattaagtgaatt

SEQ ID NO: 477031 - DNA, 20 bp, Artificial
  CRISPR gRNA sequence
tgactattaagtgaattaat

SEQ ID NO: 477032 - DNA, 20 bp, Artificial
  CRISPR gRNA sequence
ttaagtgaattaattctgta

SEQ ID NO: 477033 - DNA, 20 bp, Artificial
  CRISPR gRNA sequence
agtgaattaattctgtaaaa

SEQ ID NO: 477034 - DNA, 20 bp, Artificial
  CRISPR gRNA sequence
attctgtaaaacacttagaa

SEQ ID NO: 477035 - DNA, 20 bp, Artificial
  CRISPR gRNA sequence
tgtaaaacacttagaatagt

SEQ ID NO: 477036 - DNA, 20 bp, Artificial
  CRISPR gRNA sequence
taaaacacttagaatagtgc

SEQ ID NO: 477037 - DNA, 20 bp, Artificial
  CRISPR gRNA sequence
agaatagtgcatggcatgcc

SEQ ID NO: 477038 - DNA, 20 bp, Artificial
  CRISPR gRNA sequence
gaatagtgcatggcatgcca

SEQ ID NO: 477039 - DNA, 20 bp, Artificial
  CRISPR gRNA sequence
agtgctgtgtatatttagct

SEQ ID NO: 477040 - DNA, 20 bp, Artificial
  CRISPR gRNA sequence
tgtatatttagctaattttt

SEQ ID NO: 477041 - DNA, 20 bp, Artificial
  CRISPR gRNA sequence
agctaattttttttctttta

SEQ ID NO: 477042 - DNA, 20 bp, Artificial
  CRISPR gRNA sequence
gctaattttttttcttttag

SEQ ID NO: 477043 - DNA, 20 bp, Artificial
  CRISPR gRNA sequence
attttttttcttttagtcca

SEQ ID NO: 477044 - DNA, 20 bp, Artificial
  CRISPR gRNA sequence
tttttcttttagtccaacat

SEQ ID NO: 477045 - DNA, 20 bp, Artificial
  CRISPR gRNA sequence
ttttcttttagtccaacatt

SEQ ID NO: 477046 - DNA, 20 bp, Artificial
  CRISPR gRNA sequence
tttcttttagtccaacattt

SEQ ID NO: 477047 - DNA, 20 bp, Artificial
  CRISPR gRNA sequence
ttcttttagtccaacatttc

SEQ ID NO: 477048 - DNA, 20 bp, Artificial
  CRISPR gRNA sequence
tcttttagtccaacatttca

SEQ ID NO: 477049 - DNA, 20 bp, Artificial
  CRISPR gRNA sequence
cttttagtccaacatttcat

SEQ ID NO: 477050 - DNA, 20 bp, Artificial
  CRISPR gRNA sequence
ttttagtccaacatttcatt

SEQ ID NO: 477051 - DNA, 20 bp, Artificial
  CRISPR gRNA sequence
ttagtccaacatttcattag

SEQ ID NO: 477052 - DNA, 20 bp, Artificial
  CRISPR gRNA sequence
tagtccaacatttcattagt

SEQ ID NO: 477053 - DNA, 20 bp, Artificial
  CRISPR gRNA sequence
agtccaacatttcattagtt

SEQ ID NO: 477054 - DNA, 20 bp, Artificial
  CRISPR gRNA sequence
gtccaacatttcattagttt

SEQ ID NO: 477055 - DNA, 20 bp, Artificial
  CRISPR gRNA sequence
cattagtttaatagtcctgt

SEQ ID NO: 477056 - DNA, 20 bp, Artificial
  CRISPR gRNA sequence
attagtttaatagtcctgtt

SEQ ID NO: 477057 - DNA, 20 bp, Artificial
  CRISPR gRNA sequence
gtttaatagtcctgttaaag

SEQ ID NO: 477058 - DNA, 20 bp, Artificial
  CRISPR gRNA sequence
aatagtcctgttaaagtaac

SEQ ID NO: 477059 - DNA, 20 bp, Artificial
  CRISPR gRNA sequence
atagtcctgttaaagtaaca

SEQ ID NO: 477060 - DNA, 20 bp, Artificial
  CRISPR gRNA sequence
ttaaagtaacattgggtgac

SEQ ID NO: 477061 - DNA, 20 bp, Artificial
  CRISPR gRNA sequence
aagtaacattgggtgacaat

SEQ ID NO: 477062 - DNA, 20 bp, Artificial
  CRISPR gRNA sequence
ggtgacaattgggaatcaac

SEQ ID NO: 477063 - DNA, 20 bp, Artificial
  CRISPR gRNA sequence
ggaatcaaccacaaataaaa

SEQ ID NO: 477064 - DNA, 20 bp, Artificial
  CRISPR gRNA sequence
ggagttcacaaaagtcttct

SEQ ID NO: 477065 - DNA, 20 bp, Artificial
  CRISPR gRNA sequence
gagttcacaaaagtcttcta

SEQ ID NO: 477066 - DNA, 20 bp, Artificial
  CRISPR gRNA sequence
acaaaagtcttctataaatt

SEQ ID NO: 477067 - DNA, 20 bp, Artificial
  CRISPR gRNA sequence
ctataaattactcttgatat

SEQ ID NO: 477068 - DNA, 20 bp, Artificial
  CRISPR gRNA sequence
tataaattactcttgatatt

SEQ ID NO: 477069 - DNA, 20 bp, Artificial
  CRISPR gRNA sequence
taaattactcttgatattat

SEQ ID NO: 477070 - DNA, 20 bp, Artificial
  CRISPR gRNA sequence
ctcttgatattattatctac

SEQ ID NO: 477071 - DNA, 20 bp, Artificial
  CRISPR gRNA sequence
ttgatattattatctactct

SEQ ID NO: 477072 - DNA, 20 bp, Artificial
  CRISPR gRNA sequence
gatattattatctactcttt

SEQ ID NO: 477073 - DNA, 20 bp, Artificial
  CRISPR gRNA sequence
atattattatctactctttt

SEQ ID NO: 477074 - DNA, 20 bp, Artificial
  CRISPR gRNA sequence
ttatctactcttttttttct

SEQ ID NO: 477075 - DNA, 20 bp, Artificial
  CRISPR gRNA sequence
tctactcttttttttcttta

SEQ ID NO: 477076 - DNA, 20 bp, Artificial
  CRISPR gRNA sequence
ctcttttttttctttatttc

SEQ ID NO: 477077 - DNA, 20 bp, Artificial
  CRISPR gRNA sequence
ttttttttctttatttcttc

SEQ ID NO: 477078 - DNA, 20 bp, Artificial
  CRISPR gRNA sequence
ttttttctttatttcttcta

SEQ ID NO: 477079 - DNA, 20 bp, Artificial
  CRISPR gRNA sequence
tttttctttatttcttctaa

SEQ ID NO: 477080 - DNA, 20 bp, Artificial
  CRISPR gRNA sequence
ttttctttatttcttctaaa

SEQ ID NO: 477081 - DNA, 20 bp, Artificial
  CRISPR gRNA sequence
tttctttatttcttctaaaa

SEQ ID NO: 477082 - DNA, 20 bp, Artificial
  CRISPR gRNA sequence
ttctttatttcttctaaaaa

SEQ ID NO: 477083 - DNA, 20 bp, Artificial
  CRISPR gRNA sequence
tctttatttcttctaaaaaa

SEQ ID NO: 477084 - DNA, 20 bp, Artificial
  CRISPR gRNA sequence
ctttatttcttctaaaaaag

SEQ ID NO: 477085 - DNA, 20 bp, Artificial
  CRISPR gRNA sequence
tttatttcttctaaaaaagg

SEQ ID NO: 477086 - DNA, 20 bp, Artificial
  CRISPR gRNA sequence
tatttcttctaaaaaaggaa

SEQ ID NO: 477087 - DNA, 20 bp, Artificial
  CRISPR gRNA sequence
atttcttctaaaaaaggaaa

SEQ ID NO: 477088 - DNA, 20 bp, Artificial
  CRISPR gRNA sequence
tttcttctaaaaaaggaaaa

SEQ ID NO: 477089 - DNA, 20 bp, Artificial
  CRISPR gRNA sequence
cttctaaaaaaggaaaacag

SEQ ID NO: 477090 - DNA, 20 bp, Artificial
  CRISPR gRNA sequence
ttctaaaaaaggaaaacagg

SEQ ID NO: 477091 - DNA, 20 bp, Artificial
  CRISPR gRNA sequence
ctaaaaaaggaaaacaggat

SEQ ID NO: 477092 - DNA, 20 bp, Artificial
  CRISPR gRNA sequence
taaaaaaggaaaacaggata

SEQ ID NO: 477093 - DNA, 20 bp, Artificial
  CRISPR gRNA sequence
aaaaaggaaaacaggataca

SEQ ID NO: 477094 - DNA, 20 bp, Artificial
  CRISPR gRNA sequence
gttacataggtatacgtgtg

SEQ ID NO: 477095 - DNA, 20 bp, Artificial
  CRISPR gRNA sequence
ttacataggtatacgtgtgc

SEQ ID NO: 477096 - DNA, 20 bp, Artificial
  CRISPR gRNA sequence
cataggtatacgtgtgccat

SEQ ID NO: 477097 - DNA, 20 bp, Artificial
  CRISPR gRNA sequence
gcttaacctattgacccatc

SEQ ID NO: 477098 - DNA, 20 bp, Artificial
  CRISPR gRNA sequence
cttaacctattgacccatcc

SEQ ID NO: 477099 - DNA, 20 bp, Artificial
  CRISPR gRNA sequence
aacctattgacccatcctct

SEQ ID NO: 477100 - DNA, 20 bp, Artificial
  CRISPR gRNA sequence
acctattgacccatcctcta

SEQ ID NO: 477101 - DNA, 20 bp, Artificial
  CRISPR gRNA sequence
ttgacccatcctctaagttc

SEQ ID NO: 477102 - DNA, 20 bp, Artificial
  CRISPR gRNA sequence
acccatcctctaagttccct

SEQ ID NO: 477103 - DNA, 20 bp, Artificial
  CRISPR gRNA sequence
taagttccctctcctctccc

SEQ ID NO: 477104 - DNA, 20 bp, Artificial
  CRISPR gRNA sequence
agttccctctcctctccccc

SEQ ID NO: 477105 - DNA, 20 bp, Artificial
  CRISPR gRNA sequence
cctctcctctccccctactc

SEQ ID NO: 477106 - DNA, 20 bp, Artificial
  CRISPR gRNA sequence
tcctctccccctactcccca

SEQ ID NO: 477107 - DNA, 20 bp, Artificial
  CRISPR gRNA sequence
ctctccccctactccccaac

SEQ ID NO: 477108 - DNA, 20 bp, Artificial
  CRISPR gRNA sequence
tccccctactccccaacagg

SEQ ID NO: 477109 - DNA, 20 bp, Artificial
  CRISPR gRNA sequence
cccctactccccaacaggct

SEQ ID NO: 477110 - DNA, 20 bp, Artificial
  CRISPR gRNA sequence
ctccccaacaggctctggtt

SEQ ID NO: 477111 - DNA, 20 bp, Artificial
  CRISPR gRNA sequence
cccaacaggctctggtttgt

SEQ ID NO: 477112 - DNA, 20 bp, Artificial
  CRISPR gRNA sequence
tggtttgtgttattcccctc

SEQ ID NO: 477113 - DNA, 20 bp, Artificial
  CRISPR gRNA sequence
gtttgtgttattcccctctc

SEQ ID NO: 477114 - DNA, 20 bp, Artificial
  CRISPR gRNA sequence
gtgttattcccctctctgtg

SEQ ID NO: 477115 - DNA, 20 bp, Artificial
  CRISPR gRNA sequence
tgttattcccctctctgtgt

SEQ ID NO: 477116 - DNA, 20 bp, Artificial
  CRISPR gRNA sequence
ttcccctctctgtgtccata

SEQ ID NO: 477117 - DNA, 20 bp, Artificial
  CRISPR gRNA sequence
ccctctctgtgtccatatat

SEQ ID NO: 477118 - DNA, 20 bp, Artificial
  CRISPR gRNA sequence
tctgtgtccatatattctca

SEQ ID NO: 477119 - DNA, 20 bp, Artificial
  CRISPR gRNA sequence
tgtgtccatatattctcatt

SEQ ID NO: 477120 - DNA, 20 bp, Artificial
  CRISPR gRNA sequence
tgtccatatattctcatttt

SEQ ID NO: 477121 - DNA, 20 bp, Artificial
  CRISPR gRNA sequence
tcattttcaacttccactta

SEQ ID NO: 477122 - DNA, 20 bp, Artificial
  CRISPR gRNA sequence
attttcaacttccacttatg

SEQ ID NO: 477123 - DNA, 20 bp, Artificial
  CRISPR gRNA sequence
tcaacttccacttatgagtg

SEQ ID NO: 477124 - DNA, 20 bp, Artificial
  CRISPR gRNA sequence
caacttccacttatgagtga

SEQ ID NO: 477125 - DNA, 20 bp, Artificial
  CRISPR gRNA sequence
aacttccacttatgagtgag

SEQ ID NO: 477126 - DNA, 20 bp, Artificial
  CRISPR gRNA sequence
ccacttatgagtgagaacat

SEQ ID NO: 477127 - DNA, 20 bp, Artificial
  CRISPR gRNA sequence
cacttatgagtgagaacatg

SEQ ID NO: 477128 - DNA, 20 bp, Artificial
  CRISPR gRNA sequence
atgagtgagaacatgcagtg

SEQ ID NO: 477129 - DNA, 20 bp, Artificial
  CRISPR gRNA sequence
tgagtgagaacatgcagtgt

SEQ ID NO: 477130 - DNA, 20 bp, Artificial
  CRISPR gRNA sequence
ggttttctgttcctgtgtta

SEQ ID NO: 477131 - DNA, 20 bp, Artificial
  CRISPR gRNA sequence
gttttctgttcctgtgttag

SEQ ID NO: 477132 - DNA, 20 bp, Artificial
  CRISPR gRNA sequence
tctgttcctgtgttagtttg

SEQ ID NO: 477133 - DNA, 20 bp, Artificial
  CRISPR gRNA sequence
ctgttcctgtgttagtttgc

SEQ ID NO: 477134 - DNA, 20 bp, Artificial
  CRISPR gRNA sequence
tgttcctgtgttagtttgct

SEQ ID NO: 477135 - DNA, 20 bp, Artificial
  CRISPR gRNA sequence
ttcctgtgttagtttgctta

SEQ ID NO: 477136 - DNA, 20 bp, Artificial
  CRISPR gRNA sequence
ctgtgttagtttgcttagga

SEQ ID NO: 477137 - DNA, 20 bp, Artificial
  CRISPR gRNA sequence
tgttagtttgcttaggatga

SEQ ID NO: 477138 - DNA, 20 bp, Artificial
  CRISPR gRNA sequence
gtttgcttaggatgatggct

SEQ ID NO: 477139 - DNA, 20 bp, Artificial
  CRISPR gRNA sequence
gcttaggatgatggcttcca

SEQ ID NO: 477140 - DNA, 20 bp, Artificial
  CRISPR gRNA sequence
cttaggatgatggcttccag

SEQ ID NO: 477141 - DNA, 20 bp, Artificial
  CRISPR gRNA sequence
aggatgatggcttccagctt

SEQ ID NO: 477142 - DNA, 20 bp, Artificial
  CRISPR gRNA sequence
ggatgatggcttccagcttc

SEQ ID NO: 477143 - DNA, 20 bp, Artificial
  CRISPR gRNA sequence
ccagcttcatccatgtccct

SEQ ID NO: 477144 - DNA, 20 bp, Artificial
  CRISPR gRNA sequence
cagcttcatccatgtccctg

SEQ ID NO: 477145 - DNA, 20 bp, Artificial
  CRISPR gRNA sequence
catccatgtccctgcaaagg

SEQ ID NO: 477146 - DNA, 20 bp, Artificial
  CRISPR gRNA sequence
atccatgtccctgcaaaggg

SEQ ID NO: 477147 - DNA, 20 bp, Artificial
  CRISPR gRNA sequence
caaagggcatgatctcattc

SEQ ID NO: 477148 - DNA, 20 bp, Artificial
  CRISPR gRNA sequence
attcttttttatggctgcat

SEQ ID NO: 477149 - DNA, 20 bp, Artificial
  CRISPR gRNA sequence
ttttttatggctgcatagta

SEQ ID NO: 477150 - DNA, 20 bp, Artificial
  CRISPR gRNA sequence
ttttatggctgcatagtatt

SEQ ID NO: 477151 - DNA, 20 bp, Artificial
  CRISPR gRNA sequence
tttatggctgcatagtattc

SEQ ID NO: 477152 - DNA, 20 bp, Artificial
  CRISPR gRNA sequence
ttatggctgcatagtattcc

SEQ ID NO: 477153 - DNA, 20 bp, Artificial
  CRISPR gRNA sequence
tatggctgcatagtattcca

SEQ ID NO: 477154 - DNA, 20 bp, Artificial
  CRISPR gRNA sequence
atggctgcatagtattccac

SEQ ID NO: 477155 - DNA, 20 bp, Artificial
  CRISPR gRNA sequence
tggctgcatagtattccacg

SEQ ID NO: 477156 - DNA, 20 bp, Artificial
  CRISPR gRNA sequence
catagtattccacggtgtat

SEQ ID NO: 477157 - DNA, 20 bp, Artificial
  CRISPR gRNA sequence
cacggtgtatatgtaccata

SEQ ID NO: 477158 - DNA, 20 bp, Artificial
  CRISPR gRNA sequence
tctttttccagtctatcatt

SEQ ID NO: 477159 - DNA, 20 bp, Artificial
  CRISPR gRNA sequence
ctttttccagtctatcattg

SEQ ID NO: 477160 - DNA, 20 bp, Artificial
  CRISPR gRNA sequence
tttttccagtctatcattga

SEQ ID NO: 477161 - DNA, 20 bp, Artificial
  CRISPR gRNA sequence
tttccagtctatcattgatg

SEQ ID NO: 477162 - DNA, 20 bp, Artificial
  CRISPR gRNA sequence
ttccagtctatcattgatgg

SEQ ID NO: 477163 - DNA, 20 bp, Artificial
  CRISPR gRNA sequence
tccagtctatcattgatggg

SEQ ID NO: 477164 - DNA, 20 bp, Artificial
  CRISPR gRNA sequence
ccagtctatcattgatgggc

SEQ ID NO: 477165 - DNA, 20 bp, Artificial
  CRISPR gRNA sequence
cagtctatcattgatgggca

SEQ ID NO: 477166 - DNA, 20 bp, Artificial
  CRISPR gRNA sequence
tcattgatgggcatttgggt

SEQ ID NO: 477167 - DNA, 20 bp, Artificial
  CRISPR gRNA sequence
atgggcatttgggttggttc

SEQ ID NO: 477168 - DNA, 20 bp, Artificial
  CRISPR gRNA sequence
gggttggttccgtgtctttg

SEQ ID NO: 477169 - DNA, 20 bp, Artificial
  CRISPR gRNA sequence
ggttggttccgtgtctttgc

SEQ ID NO: 477170 - DNA, 20 bp, Artificial
  CRISPR gRNA sequence
gttccgtgtctttgctattg

SEQ ID NO: 477171 - DNA, 20 bp, Artificial
  CRISPR gRNA sequence
cgtgtctttgctattgtaaa

SEQ ID NO: 477172 - DNA, 20 bp, Artificial
  CRISPR gRNA sequence
tgctattgtaaatagtgctg

SEQ ID NO: 477173 - DNA, 20 bp, Artificial
  CRISPR gRNA sequence
gctattgtaaatagtgctgc

SEQ ID NO: 477174 - DNA, 20 bp, Artificial
  CRISPR gRNA sequence
ctattgtaaatagtgctgca

SEQ ID NO: 477175 - DNA, 20 bp, Artificial
  CRISPR gRNA sequence
ttgtaaatagtgctgcaata

SEQ ID NO: 477176 - DNA, 20 bp, Artificial
  CRISPR gRNA sequence
taaatagtgctgcaataaac

SEQ ID NO: 477177 - DNA, 20 bp, Artificial
  CRISPR gRNA sequence
caataaacatacgtgtgcat

SEQ ID NO: 477178 - DNA, 20 bp, Artificial
  CRISPR gRNA sequence
tatagtagaatgatttatat

SEQ ID NO: 477179 - DNA, 20 bp, Artificial
  CRISPR gRNA sequence
atagtagaatgatttatatt

SEQ ID NO: 477180 - DNA, 20 bp, Artificial
  CRISPR gRNA sequence
tagtagaatgatttatattc

SEQ ID NO: 477181 - DNA, 20 bp, Artificial
  CRISPR gRNA sequence
atattcctttgagtatatac

SEQ ID NO: 477182 - DNA, 20 bp, Artificial
  CRISPR gRNA sequence
tattcctttgagtatatacc

SEQ ID NO: 477183 - DNA, 20 bp, Artificial
  CRISPR gRNA sequence
ctttgagtatatacccagta

SEQ ID NO: 477184 - DNA, 20 bp, Artificial
  CRISPR gRNA sequence
tgagtatatacccagtaacg

SEQ ID NO: 477185 - DNA, 20 bp, Artificial
  CRISPR gRNA sequence
gagtatatacccagtaacgg

SEQ ID NO: 477186 - DNA, 20 bp, Artificial
  CRISPR gRNA sequence
agtatatacccagtaacggg

SEQ ID NO: 477187 - DNA, 20 bp, Artificial
  CRISPR gRNA sequence
ctgggtcaaatggtatttct

SEQ ID NO: 477188 - DNA, 20 bp, Artificial
  CRISPR gRNA sequence
ggtcaaatggtatttctggt

SEQ ID NO: 477189 - DNA, 20 bp, Artificial
  CRISPR gRNA sequence
ctggttctagatcgaggaat

SEQ ID NO: 477190 - DNA, 20 bp, Artificial
  CRISPR gRNA sequence
tggttctagatcgaggaatt

SEQ ID NO: 477191 - DNA, 20 bp, Artificial
  CRISPR gRNA sequence
gttctagatcgaggaattgc

SEQ ID NO: 477192 - DNA, 20 bp, Artificial
  CRISPR gRNA sequence
tagatcgaggaattgccata

SEQ ID NO: 477193 - DNA, 20 bp, Artificial
  CRISPR gRNA sequence
gatcgaggaattgccatact

SEQ ID NO: 477194 - DNA, 20 bp, Artificial
  CRISPR gRNA sequence
ccatactgtcttccacaatg

SEQ ID NO: 477195 - DNA, 20 bp, Artificial
  CRISPR gRNA sequence
tcttccacaatggttgaact

SEQ ID NO: 477196 - DNA, 20 bp, Artificial
  CRISPR gRNA sequence
ccacaatggttgaactaatt

SEQ ID NO: 477197 - DNA, 20 bp, Artificial
  CRISPR gRNA sequence
cacaatggttgaactaattt

SEQ ID NO: 477198 - DNA, 20 bp, Artificial
  CRISPR gRNA sequence
aactaatttacactcccacc

SEQ ID NO: 477199 - DNA, 20 bp, Artificial
  CRISPR gRNA sequence
atttacactcccaccaaccg

SEQ ID NO: 477200 - DNA, 20 bp, Artificial
  CRISPR gRNA sequence
acactcccaccaaccgtgta

SEQ ID NO: 477201 - DNA, 20 bp, Artificial
  CRISPR gRNA sequence
cactcccaccaaccgtgtaa

SEQ ID NO: 477202 - DNA, 20 bp, Artificial
  CRISPR gRNA sequence
ccaccaaccgtgtaaaagca

SEQ ID NO: 477203 - DNA, 20 bp, Artificial
  CRISPR gRNA sequence
ctaattctccacagacttgc

SEQ ID NO: 477204 - DNA, 20 bp, Artificial
  CRISPR gRNA sequence
attctccacagacttgccag

SEQ ID NO: 477205 - DNA, 20 bp, Artificial
  CRISPR gRNA sequence
tccacagacttgccagcacc

SEQ ID NO: 477206 - DNA, 20 bp, Artificial
  CRISPR gRNA sequence
cacagacttgccagcaccta

SEQ ID NO: 477207 - DNA, 20 bp, Artificial
  CRISPR gRNA sequence
gccagcacctattgtttcct

SEQ ID NO: 477208 - DNA, 20 bp, Artificial
  CRISPR gRNA sequence
ccagcacctattgtttcctg

SEQ ID NO: 477209 - DNA, 20 bp, Artificial
  CRISPR gRNA sequence
ttgtttcctgactttttaat

SEQ ID NO: 477210 - DNA, 20 bp, Artificial
  CRISPR gRNA sequence
tttcctgactttttaataat

SEQ ID NO: 477211 - DNA, 20 bp, Artificial
  CRISPR gRNA sequence
cctgactttttaataatcac

SEQ ID NO: 477212 - DNA, 20 bp, Artificial
  CRISPR gRNA sequence
ctgactttttaataatcacc

SEQ ID NO: 477213 - DNA, 20 bp, Artificial
  CRISPR gRNA sequence
actttttaataatcaccatt

SEQ ID NO: 477214 - DNA, 20 bp, Artificial
  CRISPR gRNA sequence
tttaataatcaccattctga

SEQ ID NO: 477215 - DNA, 20 bp, Artificial
  CRISPR gRNA sequence
ttaataatcaccattctgac

SEQ ID NO: 477216 - DNA, 20 bp, Artificial
  CRISPR gRNA sequence
taataatcaccattctgact

SEQ ID NO: 477217 - DNA, 20 bp, Artificial
  CRISPR gRNA sequence
aataatcaccattctgactg

SEQ ID NO: 477218 - DNA, 20 bp, Artificial
  CRISPR gRNA sequence
ataatcaccattctgactgg

SEQ ID NO: 477219 - DNA, 20 bp, Artificial
  CRISPR gRNA sequence
tgactggcgtgagatgttat

SEQ ID NO: 477220 - DNA, 20 bp, Artificial
  CRISPR gRNA sequence
actggcgtgagatgttatct

SEQ ID NO: 477221 - DNA, 20 bp, Artificial
  CRISPR gRNA sequence
gcgtgagatgttatctcctt

SEQ ID NO: 477222 - DNA, 20 bp, Artificial
  CRISPR gRNA sequence
tctccttgtggttttgattt

SEQ ID NO: 477223 - DNA, 20 bp, Artificial
  CRISPR gRNA sequence
cttgtggttttgatttacat

SEQ ID NO: 477224 - DNA, 20 bp, Artificial
  CRISPR gRNA sequence
gtggttttgatttacatttc

SEQ ID NO: 477225 - DNA, 20 bp, Artificial
  CRISPR gRNA sequence
tggttttgatttacatttct

SEQ ID NO: 477226 - DNA, 20 bp, Artificial
  CRISPR gRNA sequence
tgatttacatttctctgacc

SEQ ID NO: 477227 - DNA, 20 bp, Artificial
  CRISPR gRNA sequence
gatttacatttctctgacca

SEQ ID NO: 477228 - DNA, 20 bp, Artificial
  CRISPR gRNA sequence
atttacatttctctgaccat

SEQ ID NO: 477229 - DNA, 20 bp, Artificial
  CRISPR gRNA sequence
acatttctctgaccatcagt

SEQ ID NO: 477230 - DNA, 20 bp, Artificial
  CRISPR gRNA sequence
catttctctgaccatcagtg

SEQ ID NO: 477231 - DNA, 20 bp, Artificial
  CRISPR gRNA sequence
ctctgaccatcagtgatgtt

SEQ ID NO: 477232 - DNA, 20 bp, Artificial
  CRISPR gRNA sequence
tctgaccatcagtgatgttg

SEQ ID NO: 477233 - DNA, 20 bp, Artificial
  CRISPR gRNA sequence
tgaccatcagtgatgttgag

SEQ ID NO: 477234 - DNA, 20 bp, Artificial
  CRISPR gRNA sequence
accatcagtgatgttgagct

SEQ ID NO: 477235 - DNA, 20 bp, Artificial
  CRISPR gRNA sequence
agcttttattcttatgtttg

SEQ ID NO: 477236 - DNA, 20 bp, Artificial
  CRISPR gRNA sequence
ttattcttatgtttgttggt

SEQ ID NO: 477237 - DNA, 20 bp, Artificial
  CRISPR gRNA sequence
tattcttatgtttgttggtg

SEQ ID NO: 477238 - DNA, 20 bp, Artificial
  CRISPR gRNA sequence
attcttatgtttgttggtgg

SEQ ID NO: 477239 - DNA, 20 bp, Artificial
  CRISPR gRNA sequence
ttcttatgtttgttggtggc

SEQ ID NO: 477240 - DNA, 20 bp, Artificial
  CRISPR gRNA sequence
ttatgtttgttggtggcata

SEQ ID NO: 477241 - DNA, 20 bp, Artificial
  CRISPR gRNA sequence
atgtttgttggtggcataaa

SEQ ID NO: 477242 - DNA, 20 bp, Artificial
  CRISPR gRNA sequence
tgtttgttggtggcataaat

SEQ ID NO: 477243 - DNA, 20 bp, Artificial
  CRISPR gRNA sequence
gttggtggcataaatgtctt

SEQ ID NO: 477244 - DNA, 20 bp, Artificial
  CRISPR gRNA sequence
ttggtggcataaatgtcttc

SEQ ID NO: 477245 - DNA, 20 bp, Artificial
  CRISPR gRNA sequence
gtggcataaatgtcttcttt

SEQ ID NO: 477246 - DNA, 20 bp, Artificial
  CRISPR gRNA sequence
ctttttttttttgagataga

SEQ ID NO: 477247 - DNA, 20 bp, Artificial
  CRISPR gRNA sequence
tttttttttttgagatagag

SEQ ID NO: 477248 - DNA, 20 bp, Artificial
  CRISPR gRNA sequence
tttttttttgagatagagtg

SEQ ID NO: 477249 - DNA, 20 bp, Artificial
  CRISPR gRNA sequence
ttttttttgagatagagtgt

SEQ ID NO: 477250 - DNA, 20 bp, Artificial
  CRISPR gRNA sequence
tttttttgagatagagtgtc

SEQ ID NO: 477251 - DNA, 20 bp, Artificial
  CRISPR gRNA sequence
ttttttgagatagagtgtcg

SEQ ID NO: 477252 - DNA, 20 bp, Artificial
  CRISPR gRNA sequence
tttttgagatagagtgtcgc

SEQ ID NO: 477253 - DNA, 20 bp, Artificial
  CRISPR gRNA sequence
ttttgagatagagtgtcgct

SEQ ID NO: 477254 - DNA, 20 bp, Artificial
  CRISPR gRNA sequence
tttgagatagagtgtcgctc

SEQ ID NO: 477255 - DNA, 20 bp, Artificial
  CRISPR gRNA sequence
ttgagatagagtgtcgctct

SEQ ID NO: 477256 - DNA, 20 bp, Artificial
  CRISPR gRNA sequence
tgagatagagtgtcgctctg

SEQ ID NO: 477257 - DNA, 20 bp, Artificial
  CRISPR gRNA sequence
gagatagagtgtcgctctgt

SEQ ID NO: 477258 - DNA, 20 bp, Artificial
  CRISPR gRNA sequence
agatagagtgtcgctctgtc

SEQ ID NO: 477259 - DNA, 20 bp, Artificial
  CRISPR gRNA sequence
tgtcgcccaggctggagtgc

SEQ ID NO: 477260 - DNA, 20 bp, Artificial
  CRISPR gRNA sequence
tcgcccaggctggagtgcag

SEQ ID NO: 477261 - DNA, 20 bp, Artificial
  CRISPR gRNA sequence
gagtgcagtggcgcaatctc

SEQ ID NO: 477262 - DNA, 20 bp, Artificial
  CRISPR gRNA sequence
cgctcactgcaagctctgcc

SEQ ID NO: 477263 - DNA, 20 bp, Artificial
  CRISPR gRNA sequence
actgcaagctctgcctcccg

SEQ ID NO: 477264 - DNA, 20 bp, Artificial
  CRISPR gRNA sequence
caagctctgcctcccgggct

SEQ ID NO: 477265 - DNA, 20 bp, Artificial
  CRISPR gRNA sequence
tgcctcccgggctcatgcca

SEQ ID NO: 477266 - DNA, 20 bp, Artificial
  CRISPR gRNA sequence
cctcccgggctcatgccatt

SEQ ID NO: 477267 - DNA, 20 bp, Artificial
  CRISPR gRNA sequence
ccgggctcatgccattctcc

SEQ ID NO: 477268 - DNA, 20 bp, Artificial
  CRISPR gRNA sequence
atgccattctcctaactcag

SEQ ID NO: 477269 - DNA, 20 bp, Artificial
  CRISPR gRNA sequence
tcctaactcagcctcccgag

SEQ ID NO: 477270 - DNA, 20 bp, Artificial
  CRISPR gRNA sequence
ctaactcagcctcccgagta

SEQ ID NO: 477271 - DNA, 20 bp, Artificial
  CRISPR gRNA sequence
actcagcctcccgagtagct

SEQ ID NO: 477272 - DNA, 20 bp, Artificial
  CRISPR gRNA sequence
agcctcccgagtagctggga

SEQ ID NO: 477273 - DNA, 20 bp, Artificial
  CRISPR gRNA sequence
ccgagtagctgggactacag

SEQ ID NO: 477274 - DNA, 20 bp, Artificial
  CRISPR gRNA sequence
ggactacaggcggctgccac

SEQ ID NO: 477275 - DNA, 20 bp, Artificial
  CRISPR gRNA sequence
caggcggctgccaccacgcc

SEQ ID NO: 477276 - DNA, 20 bp, Artificial
  CRISPR gRNA sequence
ccaccacgcctggctaattt

SEQ ID NO: 477277 - DNA, 20 bp, Artificial
  CRISPR gRNA sequence
gctaattttttgtattttta

SEQ ID NO: 477278 - DNA, 20 bp, Artificial
  CRISPR gRNA sequence
attttttgtatttttagtac

SEQ ID NO: 477279 - DNA, 20 bp, Artificial
  CRISPR gRNA sequence
tttgtatttttagtacagaa

SEQ ID NO: 477280 - DNA, 20 bp, Artificial
  CRISPR gRNA sequence
ttgtatttttagtacagaag

SEQ ID NO: 477281 - DNA, 20 bp, Artificial
  CRISPR gRNA sequence
tgtatttttagtacagaagg

SEQ ID NO: 477282 - DNA, 20 bp, Artificial
  CRISPR gRNA sequence
gtatttttagtacagaaggt

SEQ ID NO: 477283 - DNA, 20 bp, Artificial
  CRISPR gRNA sequence
tatttttagtacagaaggtt

SEQ ID NO: 477284 - DNA, 20 bp, Artificial
  CRISPR gRNA sequence
ttagtacagaaggtttcacc

SEQ ID NO: 477285 - DNA, 20 bp, Artificial
  CRISPR gRNA sequence
tagtacagaaggtttcaccg

SEQ ID NO: 477286 - DNA, 20 bp, Artificial
  CRISPR gRNA sequence
agtacagaaggtttcaccgt

SEQ ID NO: 477287 - DNA, 20 bp, Artificial
  CRISPR gRNA sequence
gtacagaaggtttcaccgtg

SEQ ID NO: 477288 - DNA, 20 bp, Artificial
  CRISPR gRNA sequence
caccgtgttagtcaggatgg

SEQ ID NO: 477289 - DNA, 20 bp, Artificial
  CRISPR gRNA sequence
accgtgttagtcaggatggt

SEQ ID NO: 477290 - DNA, 20 bp, Artificial
  CRISPR gRNA sequence
gtcaggatggtcttgatctc

SEQ ID NO: 477291 - DNA, 20 bp, Artificial
  CRISPR gRNA sequence
gatctcctgacctcatgatc

SEQ ID NO: 477292 - DNA, 20 bp, Artificial
  CRISPR gRNA sequence
atctcctgacctcatgatcc

SEQ ID NO: 477293 - DNA, 20 bp, Artificial
  CRISPR gRNA sequence
ctgacctcatgatccacctg

SEQ ID NO: 477294 - DNA, 20 bp, Artificial
  CRISPR gRNA sequence
acctcatgatccacctgtct

SEQ ID NO: 477295 - DNA, 20 bp, Artificial
  CRISPR gRNA sequence
atgatccacctgtctcggcc

SEQ ID NO: 477296 - DNA, 20 bp, Artificial
  CRISPR gRNA sequence
tctcggcctcccaaagtgct

SEQ ID NO: 477297 - DNA, 20 bp, Artificial
  CRISPR gRNA sequence
ggcctcccaaagtgctggga

SEQ ID NO: 477298 - DNA, 20 bp, Artificial
  CRISPR gRNA sequence
ccaaagtgctgggattacag

SEQ ID NO: 477299 - DNA, 20 bp, Artificial
  CRISPR gRNA sequence
ggattacaggcgtgagccac

SEQ ID NO: 477300 - DNA, 20 bp, Artificial
  CRISPR gRNA sequence
caggcgtgagccaccgcgcc

SEQ ID NO: 477301 - DNA, 20 bp, Artificial
  CRISPR gRNA sequence
cttttgagaagtgtctgttt

SEQ ID NO: 477302 - DNA, 20 bp, Artificial
  CRISPR gRNA sequence
ttttgagaagtgtctgttta

SEQ ID NO: 477303 - DNA, 20 bp, Artificial
  CRISPR gRNA sequence
ttgagaagtgtctgtttagg

SEQ ID NO: 477304 - DNA, 20 bp, Artificial
  CRISPR gRNA sequence
tgagaagtgtctgtttaggc

SEQ ID NO: 477305 - DNA, 20 bp, Artificial
  CRISPR gRNA sequence
gagaagtgtctgtttaggct

SEQ ID NO: 477306 - DNA, 20 bp, Artificial
  CRISPR gRNA sequence
agaagtgtctgtttaggctg

SEQ ID NO: 477307 - DNA, 20 bp, Artificial
  CRISPR gRNA sequence
tttaggctgggtgtagtggc

SEQ ID NO: 477308 - DNA, 20 bp, Artificial
  CRISPR gRNA sequence
aggctgggtgtagtggctct

SEQ ID NO: 477309 - DNA, 20 bp, Artificial
  CRISPR gRNA sequence
ggctgggtgtagtggctctc

SEQ ID NO: 477310 - DNA, 20 bp, Artificial
  CRISPR gRNA sequence
ggtgtagtggctctcgcctg

SEQ ID NO: 477311 - DNA, 20 bp, Artificial
  CRISPR gRNA sequence
tcgcctgtaatcccagcact

SEQ ID NO: 477312 - DNA, 20 bp, Artificial
  CRISPR gRNA sequence
gcctgtaatcccagcacttc

SEQ ID NO: 477313 - DNA, 20 bp, Artificial
  CRISPR gRNA sequence
taatcccagcacttcaggaa

SEQ ID NO: 477314 - DNA, 20 bp, Artificial
  CRISPR gRNA sequence
caggaagctgaggagggcgg

SEQ ID NO: 477315 - DNA, 20 bp, Artificial
  CRISPR gRNA sequence
aggaagctgaggagggcggg

SEQ ID NO: 477316 - DNA, 20 bp, Artificial
  CRISPR gRNA sequence
aggagggcgggtcatttgag

SEQ ID NO: 477317 - DNA, 20 bp, Artificial
  CRISPR gRNA sequence
gaggtcaggagttcaagagc

SEQ ID NO: 477318 - DNA, 20 bp, Artificial
  CRISPR gRNA sequence
aggtcaggagttcaagagca

SEQ ID NO: 477319 - DNA, 20 bp, Artificial
  CRISPR gRNA sequence
aagagcagtctggccagcat

SEQ ID NO: 477320 - DNA, 20 bp, Artificial
  CRISPR gRNA sequence
gccagcatagtgaaaccctg

SEQ ID NO: 477321 - DNA, 20 bp, Artificial
  CRISPR gRNA sequence
tctgtactaaaaatacaaaa

SEQ ID NO: 477322 - DNA, 20 bp, Artificial
  CRISPR gRNA sequence
tactaaaaatacaaaaatta

SEQ ID NO: 477323 - DNA, 20 bp, Artificial
  CRISPR gRNA sequence
aaaatacaaaaattagctgg

SEQ ID NO: 477324 - DNA, 20 bp, Artificial
  CRISPR gRNA sequence
gctgggcgtggtgggacacg

SEQ ID NO: 477325 - DNA, 20 bp, Artificial
  CRISPR gRNA sequence
ggcgtggtgggacacgcctg

SEQ ID NO: 477326 - DNA, 20 bp, Artificial
  CRISPR gRNA sequence
taagaccagctacttgggag

SEQ ID NO: 477327 - DNA, 20 bp, Artificial
  CRISPR gRNA sequence
cttgggaggctgaggcagaa

SEQ ID NO: 477328 - DNA, 20 bp, Artificial
  CRISPR gRNA sequence
gggaggctgaggcagaattg

SEQ ID NO: 477329 - DNA, 20 bp, Artificial
  CRISPR gRNA sequence
ggaggctgaggcagaattgc

SEQ ID NO: 477330 - DNA, 20 bp, Artificial
  CRISPR gRNA sequence
aggcagaattgcttgaaccc

SEQ ID NO: 477331 - DNA, 20 bp, Artificial
  CRISPR gRNA sequence
cttgaacccaggagactgaa

SEQ ID NO: 477332 - DNA, 20 bp, Artificial
  CRISPR gRNA sequence
gaacccaggagactgaagtt

SEQ ID NO: 477333 - DNA, 20 bp, Artificial
  CRISPR gRNA sequence
aacccaggagactgaagttg

SEQ ID NO: 477334 - DNA, 20 bp, Artificial
  CRISPR gRNA sequence
aagttgcagtgagccaggtt

SEQ ID NO: 477335 - DNA, 20 bp, Artificial
  CRISPR gRNA sequence
cagtgagccaggttgcacca

SEQ ID NO: 477336 - DNA, 20 bp, Artificial
  CRISPR gRNA sequence
caccactgcactccagctgg

SEQ ID NO: 477337 - DNA, 20 bp, Artificial
  CRISPR gRNA sequence
cactccagctgggtaacaga

SEQ ID NO: 477338 - DNA, 20 bp, Artificial
  CRISPR gRNA sequence
cagctgggtaacagagtgag

SEQ ID NO: 477339 - DNA, 20 bp, Artificial
  CRISPR gRNA sequence
ggtaacagagtgagactctg

SEQ ID NO: 477340 - DNA, 20 bp, Artificial
  CRISPR gRNA sequence
tgtctccaaaaaaaaacaga

SEQ ID NO: 477341 - DNA, 20 bp, Artificial
  CRISPR gRNA sequence
tctccaaaaaaaaacagaga

SEQ ID NO: 477342 - DNA, 20 bp, Artificial
  CRISPR gRNA sequence
caaaaaaaaacagagagaac

SEQ ID NO: 477343 - DNA, 20 bp, Artificial
  CRISPR gRNA sequence
tgtgttcatatcctttgccc

SEQ ID NO: 477344 - DNA, 20 bp, Artificial
  CRISPR gRNA sequence
atatcctttgcccacttttt

SEQ ID NO: 477345 - DNA, 20 bp, Artificial
  CRISPR gRNA sequence
tgcccactttttgatgcggt

SEQ ID NO: 477346 - DNA, 20 bp, Artificial
  CRISPR gRNA sequence
gcccactttttgatgcggtt

SEQ ID NO: 477347 - DNA, 20 bp, Artificial
  CRISPR gRNA sequence
cccactttttgatgcggttg

SEQ ID NO: 477348 - DNA, 20 bp, Artificial
  CRISPR gRNA sequence
tttgatgcggttgtttgttt

SEQ ID NO: 477349 - DNA, 20 bp, Artificial
  CRISPR gRNA sequence
ttgatgcggttgtttgtttt

SEQ ID NO: 477350 - DNA, 20 bp, Artificial
  CRISPR gRNA sequence
tgatgcggttgtttgttttt

SEQ ID NO: 477351 - DNA, 20 bp, Artificial
  CRISPR gRNA sequence
gatgcggttgtttgtttttt

SEQ ID NO: 477352 - DNA, 20 bp, Artificial
  CRISPR gRNA sequence
atgcggttgtttgttttttt

SEQ ID NO: 477353 - DNA, 20 bp, Artificial
  CRISPR gRNA sequence
tttgtttttttcttgtaaac

SEQ ID NO: 477354 - DNA, 20 bp, Artificial
  CRISPR gRNA sequence
gtttttttcttgtaaactta

SEQ ID NO: 477355 - DNA, 20 bp, Artificial
  CRISPR gRNA sequence
tttttttcttgtaaacttat

SEQ ID NO: 477356 - DNA, 20 bp, Artificial
  CRISPR gRNA sequence
ttttcttgtaaacttattta

SEQ ID NO: 477357 - DNA, 20 bp, Artificial
  CRISPR gRNA sequence
tttcttgtaaacttatttaa

SEQ ID NO: 477358 - DNA, 20 bp, Artificial
  CRISPR gRNA sequence
ttcttgtaaacttatttaag

SEQ ID NO: 477359 - DNA, 20 bp, Artificial
  CRISPR gRNA sequence
tcttgtaaacttatttaagt

SEQ ID NO: 477360 - DNA, 20 bp, Artificial
  CRISPR gRNA sequence
cttgtaaacttatttaagtt

SEQ ID NO: 477361 - DNA, 20 bp, Artificial
  CRISPR gRNA sequence
ttgtaaacttatttaagttt

SEQ ID NO: 477362 - DNA, 20 bp, Artificial
  CRISPR gRNA sequence
gtaaacttatttaagtttct

SEQ ID NO: 477363 - DNA, 20 bp, Artificial
  CRISPR gRNA sequence
taaacttatttaagtttctt

SEQ ID NO: 477364 - DNA, 20 bp, Artificial
  CRISPR gRNA sequence
atttaagtttcttgtaaatt

SEQ ID NO: 477365 - DNA, 20 bp, Artificial
  CRISPR gRNA sequence
tttaagtttcttgtaaattc

SEQ ID NO: 477366 - DNA, 20 bp, Artificial
  CRISPR gRNA sequence
aagtttcttgtaaattctgg

SEQ ID NO: 477367 - DNA, 20 bp, Artificial
  CRISPR gRNA sequence
agtttcttgtaaattctgga

SEQ ID NO: 477368 - DNA, 20 bp, Artificial
  CRISPR gRNA sequence
cttgtaaattctggatatta

SEQ ID NO: 477369 - DNA, 20 bp, Artificial
  CRISPR gRNA sequence
ttgtaaattctggatattag

SEQ ID NO: 477370 - DNA, 20 bp, Artificial
  CRISPR gRNA sequence
gtaaattctggatattaggc

SEQ ID NO: 477371 - DNA, 20 bp, Artificial
  CRISPR gRNA sequence
taaattctggatattaggcc

SEQ ID NO: 477372 - DNA, 20 bp, Artificial
  CRISPR gRNA sequence
tggatattaggcctttttca

SEQ ID NO: 477373 - DNA, 20 bp, Artificial
  CRISPR gRNA sequence
gatattaggcctttttcaga

SEQ ID NO: 477374 - DNA, 20 bp, Artificial
  CRISPR gRNA sequence
ggcctttttcagatgggtag

SEQ ID NO: 477375 - DNA, 20 bp, Artificial
  CRISPR gRNA sequence
tttcagatgggtagattgca

SEQ ID NO: 477376 - DNA, 20 bp, Artificial
  CRISPR gRNA sequence
ttcagatgggtagattgcaa

SEQ ID NO: 477377 - DNA, 20 bp, Artificial
  CRISPR gRNA sequence
tcagatgggtagattgcaaa

SEQ ID NO: 477378 - DNA, 20 bp, Artificial
  CRISPR gRNA sequence
cagatgggtagattgcaaaa

SEQ ID NO: 477379 - DNA, 20 bp, Artificial
  CRISPR gRNA sequence
agatgggtagattgcaaaaa

SEQ ID NO: 477380 - DNA, 20 bp, Artificial
  CRISPR gRNA sequence
caaaaattttctcccattct

SEQ ID NO: 477381 - DNA, 20 bp, Artificial
  CRISPR gRNA sequence
tctcccattctgtaggttgc

SEQ ID NO: 477382 - DNA, 20 bp, Artificial
  CRISPR gRNA sequence
ctcccattctgtaggttgcc

SEQ ID NO: 477383 - DNA, 20 bp, Artificial
  CRISPR gRNA sequence
tcccattctgtaggttgcct

SEQ ID NO: 477384 - DNA, 20 bp, Artificial
  CRISPR gRNA sequence
ccattctgtaggttgccttt

SEQ ID NO: 477385 - DNA, 20 bp, Artificial
  CRISPR gRNA sequence
tgtaggttgcctttttgctc

SEQ ID NO: 477386 - DNA, 20 bp, Artificial
  CRISPR gRNA sequence
taggttgcctttttgctctg

SEQ ID NO: 477387 - DNA, 20 bp, Artificial
  CRISPR gRNA sequence
cctttttgctctgatgagag

SEQ ID NO: 477388 - DNA, 20 bp, Artificial
  CRISPR gRNA sequence
tttgctctgatgagagtttc

SEQ ID NO: 477389 - DNA, 20 bp, Artificial
  CRISPR gRNA sequence
ttgctctgatgagagtttct

SEQ ID NO: 477390 - DNA, 20 bp, Artificial
  CRISPR gRNA sequence
tgctctgatgagagtttctt

SEQ ID NO: 477391 - DNA, 20 bp, Artificial
  CRISPR gRNA sequence
gctctgatgagagtttcttt

SEQ ID NO: 477392 - DNA, 20 bp, Artificial
  CRISPR gRNA sequence
ctctgatgagagtttctttt

SEQ ID NO: 477393 - DNA, 20 bp, Artificial
  CRISPR gRNA sequence
tgatgagagtttcttttgct

SEQ ID NO: 477394 - DNA, 20 bp, Artificial
  CRISPR gRNA sequence
atgagagtttcttttgctgt

SEQ ID NO: 477395 - DNA, 20 bp, Artificial
  CRISPR gRNA sequence
cttttgctgtgcagaagttc

SEQ ID NO: 477396 - DNA, 20 bp, Artificial
  CRISPR gRNA sequence
ttttgctgtgcagaagttct

SEQ ID NO: 477397 - DNA, 20 bp, Artificial
  CRISPR gRNA sequence
ttgctgtgcagaagttcttc

SEQ ID NO: 477398 - DNA, 20 bp, Artificial
  CRISPR gRNA sequence
tgctgtgcagaagttcttca

SEQ ID NO: 477399 - DNA, 20 bp, Artificial
  CRISPR gRNA sequence
gctgtgcagaagttcttcag

SEQ ID NO: 477400 - DNA, 20 bp, Artificial
  CRISPR gRNA sequence
ctgtgcagaagttcttcagt

SEQ ID NO: 477401 - DNA, 20 bp, Artificial
  CRISPR gRNA sequence
tgcagaagttcttcagtttg

SEQ ID NO: 477402 - DNA, 20 bp, Artificial
  CRISPR gRNA sequence
ttcagtttgttgcaattgct

SEQ ID NO: 477403 - DNA, 20 bp, Artificial
  CRISPR gRNA sequence
cagtttgttgcaattgcttt

SEQ ID NO: 477404 - DNA, 20 bp, Artificial
  CRISPR gRNA sequence
agtttgttgcaattgctttt

SEQ ID NO: 477405 - DNA, 20 bp, Artificial
  CRISPR gRNA sequence
gttgcaattgcttttggcat

SEQ ID NO: 477406 - DNA, 20 bp, Artificial
  CRISPR gRNA sequence
ttgcaattgcttttggcatt

SEQ ID NO: 477407 - DNA, 20 bp, Artificial
  CRISPR gRNA sequence
caattgcttttggcatttat

SEQ ID NO: 477408 - DNA, 20 bp, Artificial
  CRISPR gRNA sequence
cttttggcatttatgtcatg

SEQ ID NO: 477409 - DNA, 20 bp, Artificial
  CRISPR gRNA sequence
ttggcatttatgtcatgaag

SEQ ID NO: 477410 - DNA, 20 bp, Artificial
  CRISPR gRNA sequence
tggcatttatgtcatgaaga

SEQ ID NO: 477411 - DNA, 20 bp, Artificial
  CRISPR gRNA sequence
ggcatttatgtcatgaagac

SEQ ID NO: 477412 - DNA, 20 bp, Artificial
  CRISPR gRNA sequence
gcatttatgtcatgaagact

SEQ ID NO: 477413 - DNA, 20 bp, Artificial
  CRISPR gRNA sequence
atgtcatgaagactttgtga

SEQ ID NO: 477414 - DNA, 20 bp, Artificial
  CRISPR gRNA sequence
tgtcatgaagactttgtgag

SEQ ID NO: 477415 - DNA, 20 bp, Artificial
  CRISPR gRNA sequence
tgtgagaaaaatgccaaaag

SEQ ID NO: 477416 - DNA, 20 bp, Artificial
  CRISPR gRNA sequence
gtgagaaaaatgccaaaagc

SEQ ID NO: 477417 - DNA, 20 bp, Artificial
  CRISPR gRNA sequence
tgagaaaaatgccaaaagca

SEQ ID NO: 477418 - DNA, 20 bp, Artificial
  CRISPR gRNA sequence
tctactcttatccttggtca

SEQ ID NO: 477419 - DNA, 20 bp, Artificial
  CRISPR gRNA sequence
ctcttatccttggtcaccaa

SEQ ID NO: 477420 - DNA, 20 bp, Artificial
  CRISPR gRNA sequence
ttatccttggtcaccaagaa

SEQ ID NO: 477421 - DNA, 20 bp, Artificial
  CRISPR gRNA sequence
atccttggtcaccaagaaaa

SEQ ID NO: 477422 - DNA, 20 bp, Artificial
  CRISPR gRNA sequence
tccttggtcaccaagaaaag

SEQ ID NO: 477423 - DNA, 20 bp, Artificial
  CRISPR gRNA sequence
ggtcaccaagaaaagctaat

SEQ ID NO: 477424 - DNA, 20 bp, Artificial
  CRISPR gRNA sequence
gtcaccaagaaaagctaata

SEQ ID NO: 477425 - DNA, 20 bp, Artificial
  CRISPR gRNA sequence
atagtgcttgagaatcatgc

SEQ ID NO: 477426 - DNA, 20 bp, Artificial
  CRISPR gRNA sequence
gagaatcatgcgcttgagtt

SEQ ID NO: 477427 - DNA, 20 bp, Artificial
  CRISPR gRNA sequence
agaatcatgcgcttgagttg

SEQ ID NO: 477428 - DNA, 20 bp, Artificial
  CRISPR gRNA sequence
gagttgtattgtgtcagtga

SEQ ID NO: 477429 - DNA, 20 bp, Artificial
  CRISPR gRNA sequence
agttgtattgtgtcagtgaa

SEQ ID NO: 477430 - DNA, 20 bp, Artificial
  CRISPR gRNA sequence
tattgtgtcagtgaattgta

SEQ ID NO: 477431 - DNA, 20 bp, Artificial
  CRISPR gRNA sequence
tgtcagtgaattgtatcata

SEQ ID NO: 477432 - DNA, 20 bp, Artificial
  CRISPR gRNA sequence
tatcatatgcgatttgcttc

SEQ ID NO: 477433 - DNA, 20 bp, Artificial
  CRISPR gRNA sequence
gcttcacttttctaatactc

SEQ ID NO: 477434 - DNA, 20 bp, Artificial
  CRISPR gRNA sequence
cttcacttttctaatactct

SEQ ID NO: 477435 - DNA, 20 bp, Artificial
  CRISPR gRNA sequence
cacttttctaatactctcca

SEQ ID NO: 477436 - DNA, 20 bp, Artificial
  CRISPR gRNA sequence
acttttctaatactctccat

SEQ ID NO: 477437 - DNA, 20 bp, Artificial
  CRISPR gRNA sequence
ttctaatactctccattctc

SEQ ID NO: 477438 - DNA, 20 bp, Artificial
  CRISPR gRNA sequence
tctaatactctccattctct

SEQ ID NO: 477439 - DNA, 20 bp, Artificial
  CRISPR gRNA sequence
ctaatactctccattctctt

SEQ ID NO: 477440 - DNA, 20 bp, Artificial
  CRISPR gRNA sequence
taatactctccattctctta

SEQ ID NO: 477441 - DNA, 20 bp, Artificial
  CRISPR gRNA sequence
atactctccattctcttacc

SEQ ID NO: 477442 - DNA, 20 bp, Artificial
  CRISPR gRNA sequence
tccattctcttacctcaaaa

SEQ ID NO: 477443 - DNA, 20 bp, Artificial
  CRISPR gRNA sequence
cattctcttacctcaaaata

SEQ ID NO: 477444 - DNA, 20 bp, Artificial
  CRISPR gRNA sequence
tcttacctcaaaataagctc

SEQ ID NO: 477445 - DNA, 20 bp, Artificial
  CRISPR gRNA sequence
ttacctcaaaataagctcaa

SEQ ID NO: 477446 - DNA, 20 bp, Artificial
  CRISPR gRNA sequence
acctcaaaataagctcaata

SEQ ID NO: 477447 - DNA, 20 bp, Artificial
  CRISPR gRNA sequence
cctcaaaataagctcaatat

SEQ ID NO: 477448 - DNA, 20 bp, Artificial
  CRISPR gRNA sequence
aaaataagctcaatattttg

SEQ ID NO: 477449 - DNA, 20 bp, Artificial
  CRISPR gRNA sequence
aatattttgtacctttctgg

SEQ ID NO: 477450 - DNA, 20 bp, Artificial
  CRISPR gRNA sequence
tgtacctttctggtatactc

SEQ ID NO: 477451 - DNA, 20 bp, Artificial
  CRISPR gRNA sequence
gtacctttctggtatactct

SEQ ID NO: 477452 - DNA, 20 bp, Artificial
  CRISPR gRNA sequence
tacctttctggtatactctc

SEQ ID NO: 477453 - DNA, 20 bp, Artificial
  CRISPR gRNA sequence
tctggtatactctcatggtt

SEQ ID NO: 477454 - DNA, 20 bp, Artificial
  CRISPR gRNA sequence
ctggtatactctcatggtta

SEQ ID NO: 477455 - DNA, 20 bp, Artificial
  CRISPR gRNA sequence
tggtatactctcatggttat

SEQ ID NO: 477456 - DNA, 20 bp, Artificial
  CRISPR gRNA sequence
gtatactctcatggttatgg

SEQ ID NO: 477457 - DNA, 20 bp, Artificial
  CRISPR gRNA sequence
tcatggttatggacctgatt

SEQ ID NO: 477458 - DNA, 20 bp, Artificial
  CRISPR gRNA sequence
atggttatggacctgattta

SEQ ID NO: 477459 - DNA, 20 bp, Artificial
  CRISPR gRNA sequence
tggacctgatttacatgttt

SEQ ID NO: 477460 - DNA, 20 bp, Artificial
  CRISPR gRNA sequence
atttacatgtttatctcaat

SEQ ID NO: 477461 - DNA, 20 bp, Artificial
  CRISPR gRNA sequence
acatgtttatctcaatggaa

SEQ ID NO: 477462 - DNA, 20 bp, Artificial
  CRISPR gRNA sequence
catgtttatctcaatggaag

SEQ ID NO: 477463 - DNA, 20 bp, Artificial
  CRISPR gRNA sequence
atctcaatggaagaagtggc

SEQ ID NO: 477464 - DNA, 20 bp, Artificial
  CRISPR gRNA sequence
tctcaatggaagaagtggct

SEQ ID NO: 477465 - DNA, 20 bp, Artificial
  CRISPR gRNA sequence
aatggaagaagtggcttgtg

SEQ ID NO: 477466 - DNA, 20 bp, Artificial
  CRISPR gRNA sequence
gtgtgcagcatgtgtctgtg

SEQ ID NO: 477467 - DNA, 20 bp, Artificial
  CRISPR gRNA sequence
tgtgcagcatgtgtctgtgt

SEQ ID NO: 477468 - DNA, 20 bp, Artificial
  CRISPR gRNA sequence
tgtgtatgcatgcagaggtg

SEQ ID NO: 477469 - DNA, 20 bp, Artificial
  CRISPR gRNA sequence
gagattcacttagaacagag

SEQ ID NO: 477470 - DNA, 20 bp, Artificial
  CRISPR gRNA sequence
agattcacttagaacagagt

SEQ ID NO: 477471 - DNA, 20 bp, Artificial
  CRISPR gRNA sequence
acttagaacagagtccagaa

SEQ ID NO: 477472 - DNA, 20 bp, Artificial
  CRISPR gRNA sequence
agaacagagtccagaagagt

SEQ ID NO: 477473 - DNA, 20 bp, Artificial
  CRISPR gRNA sequence
gaacagagtccagaagagtg

SEQ ID NO: 477474 - DNA, 20 bp, Artificial
  CRISPR gRNA sequence
gatcagtcccaggaaaacat

SEQ ID NO: 477475 - DNA, 20 bp, Artificial
  CRISPR gRNA sequence
agctggcagagctctttaat

SEQ ID NO: 477476 - DNA, 20 bp, Artificial
  CRISPR gRNA sequence
gctggcagagctctttaatt

SEQ ID NO: 477477 - DNA, 20 bp, Artificial
  CRISPR gRNA sequence
gcagagctctttaatttctt

SEQ ID NO: 477478 - DNA, 20 bp, Artificial
  CRISPR gRNA sequence
tttaatttcttttttctgcc

SEQ ID NO: 477479 - DNA, 20 bp, Artificial
  CRISPR gRNA sequence
taatttcttttttctgcctt

SEQ ID NO: 477480 - DNA, 20 bp, Artificial
  CRISPR gRNA sequence
aatttcttttttctgccttc

SEQ ID NO: 477481 - DNA, 20 bp, Artificial
  CRISPR gRNA sequence
atttcttttttctgccttct

SEQ ID NO: 477482 - DNA, 20 bp, Artificial
  CRISPR gRNA sequence
cttttttctgccttcttgat

SEQ ID NO: 477483 - DNA, 20 bp, Artificial
  CRISPR gRNA sequence
ttttttctgccttcttgata

SEQ ID NO: 477484 - DNA, 20 bp, Artificial
  CRISPR gRNA sequence
ttttctgccttcttgataac

SEQ ID NO: 477485 - DNA, 20 bp, Artificial
  CRISPR gRNA sequence
tttctgccttcttgataacc

SEQ ID NO: 477486 - DNA, 20 bp, Artificial
  CRISPR gRNA sequence
ttctgccttcttgataacca

SEQ ID NO: 477487 - DNA, 20 bp, Artificial
  CRISPR gRNA sequence
tctgccttcttgataaccat

SEQ ID NO: 477488 - DNA, 20 bp, Artificial
  CRISPR gRNA sequence
ctgccttcttgataaccatg

SEQ ID NO: 477489 - DNA, 20 bp, Artificial
  CRISPR gRNA sequence
tgccttcttgataaccatgt

SEQ ID NO: 477490 - DNA, 20 bp, Artificial
  CRISPR gRNA sequence
ccttcttgataaccatgttc

SEQ ID NO: 477491 - DNA, 20 bp, Artificial
  CRISPR gRNA sequence
cttgataaccatgttcatct

SEQ ID NO: 477492 - DNA, 20 bp, Artificial
  CRISPR gRNA sequence
ttgataaccatgttcatctt

SEQ ID NO: 477493 - DNA, 20 bp, Artificial
  CRISPR gRNA sequence
gataaccatgttcatcttat

SEQ ID NO: 477494 - DNA, 20 bp, Artificial
  CRISPR gRNA sequence
ataaccatgttcatcttata

SEQ ID NO: 477495 - DNA, 20 bp, Artificial
  CRISPR gRNA sequence
atcttataagcacaacctgg

SEQ ID NO: 477496 - DNA, 20 bp, Artificial
  CRISPR gRNA sequence
ataagcacaacctggaactc

SEQ ID NO: 477497 - DNA, 20 bp, Artificial
  CRISPR gRNA sequence
taagcacaacctggaactca

SEQ ID NO: 477498 - DNA, 20 bp, Artificial
  CRISPR gRNA sequence
gaactcacacacatcacaaa

SEQ ID NO: 477499 - DNA, 20 bp, Artificial
  CRISPR gRNA sequence
acacacatcacaaatggcct

SEQ ID NO: 477500 - DNA, 20 bp, Artificial
  CRISPR gRNA sequence
ttatccagtatttggctaca

SEQ ID NO: 477501 - DNA, 20 bp, Artificial
  CRISPR gRNA sequence
tccagtatttggctacaagg

SEQ ID NO: 477502 - DNA, 20 bp, Artificial
  CRISPR gRNA sequence
ggctacaagggaggctgggg

SEQ ID NO: 477503 - DNA, 20 bp, Artificial
  CRISPR gRNA sequence
gctacaagggaggctggggc

SEQ ID NO: 477504 - DNA, 20 bp, Artificial
  CRISPR gRNA sequence
caagggaggctggggcattg

SEQ ID NO: 477505 - DNA, 20 bp, Artificial
  CRISPR gRNA sequence
gggcattgagatttttatct

SEQ ID NO: 477506 - DNA, 20 bp, Artificial
  CRISPR gRNA sequence
agatttttatctggggggtt

SEQ ID NO: 477507 - DNA, 20 bp, Artificial
  CRISPR gRNA sequence
ttatctggggggttatggcc

SEQ ID NO: 477508 - DNA, 20 bp, Artificial
  CRISPR gRNA sequence
tatctggggggttatggccc

SEQ ID NO: 477509 - DNA, 20 bp, Artificial
  CRISPR gRNA sequence
atctggggggttatggcccc

SEQ ID NO: 477510 - DNA, 20 bp, Artificial
  CRISPR gRNA sequence
tctggggggttatggcccca

SEQ ID NO: 477511 - DNA, 20 bp, Artificial
  CRISPR gRNA sequence
gggggttatggccccacttc

SEQ ID NO: 477512 - DNA, 20 bp, Artificial
  CRISPR gRNA sequence
tggccccacttcattttcct

SEQ ID NO: 477513 - DNA, 20 bp, Artificial
  CRISPR gRNA sequence
cattttcctctataatatta

SEQ ID NO: 477514 - DNA, 20 bp, Artificial
  CRISPR gRNA sequence
attttcctctataatattag

SEQ ID NO: 477515 - DNA, 20 bp, Artificial
  CRISPR gRNA sequence
tcctctataatattagaaga

SEQ ID NO: 477516 - DNA, 20 bp, Artificial
  CRISPR gRNA sequence
cctctataatattagaagat

SEQ ID NO: 477517 - DNA, 20 bp, Artificial
  CRISPR gRNA sequence
ctctataatattagaagatg

SEQ ID NO: 477518 - DNA, 20 bp, Artificial
  CRISPR gRNA sequence
tataatattagaagatgaga

SEQ ID NO: 477519 - DNA, 20 bp, Artificial
  CRISPR gRNA sequence
taatattagaagatgagaat

SEQ ID NO: 477520 - DNA, 20 bp, Artificial
  CRISPR gRNA sequence
gaagatgagaattaatattg

SEQ ID NO: 477521 - DNA, 20 bp, Artificial
  CRISPR gRNA sequence
atattggaagacatttagca

SEQ ID NO: 477522 - DNA, 20 bp, Artificial
  CRISPR gRNA sequence
gaagacatttagcagattct

SEQ ID NO: 477523 - DNA, 20 bp, Artificial
  CRISPR gRNA sequence
agcagattctgtccacataa

SEQ ID NO: 477524 - DNA, 20 bp, Artificial
  CRISPR gRNA sequence
gcagattctgtccacataag

SEQ ID NO: 477525 - DNA, 20 bp, Artificial
  CRISPR gRNA sequence
tgtccacataagtattgttt

SEQ ID NO: 477526 - DNA, 20 bp, Artificial
  CRISPR gRNA sequence
tccacataagtattgtttag

SEQ ID NO: 477527 - DNA, 20 bp, Artificial
  CRISPR gRNA sequence
tttagtatcttcaagggctt

SEQ ID NO: 477528 - DNA, 20 bp, Artificial
  CRISPR gRNA sequence
agtatcttcaagggctttga

SEQ ID NO: 477529 - DNA, 20 bp, Artificial
  CRISPR gRNA sequence
gtatcttcaagggctttgaa

SEQ ID NO: 477530 - DNA, 20 bp, Artificial
  CRISPR gRNA sequence
caagggctttgaaaatgcca

SEQ ID NO: 477531 - DNA, 20 bp, Artificial
  CRISPR gRNA sequence
aagggctttgaaaatgccag

SEQ ID NO: 477532 - DNA, 20 bp, Artificial
  CRISPR gRNA sequence
tgaaaatgccagtgaatctc

SEQ ID NO: 477533 - DNA, 20 bp, Artificial
  CRISPR gRNA sequence
gaaaatgccagtgaatctca

SEQ ID NO: 477534 - DNA, 20 bp, Artificial
  CRISPR gRNA sequence
aaaatgccagtgaatctcag

SEQ ID NO: 477535 - DNA, 20 bp, Artificial
  CRISPR gRNA sequence
agtgtgatgtctgtggtaga

SEQ ID NO: 477536 - DNA, 20 bp, Artificial
  CRISPR gRNA sequence
tggtagaatgtattagagat

SEQ ID NO: 477537 - DNA, 20 bp, Artificial
  CRISPR gRNA sequence
gagatgtgaggaagtatctg

SEQ ID NO: 477538 - DNA, 20 bp, Artificial
  CRISPR gRNA sequence
ggaagaaagtagagatggac

SEQ ID NO: 477539 - DNA, 20 bp, Artificial
  CRISPR gRNA sequence
tccctttccaatcataatac

SEQ ID NO: 477540 - DNA, 20 bp, Artificial
  CRISPR gRNA sequence
ccctttccaatcataataca

SEQ ID NO: 477541 - DNA, 20 bp, Artificial
  CRISPR gRNA sequence
cctttccaatcataatacat

SEQ ID NO: 477542 - DNA, 20 bp, Artificial
  CRISPR gRNA sequence
tccaatcataatacataagc

SEQ ID NO: 477543 - DNA, 20 bp, Artificial
  CRISPR gRNA sequence
ccaatcataatacataagcc

SEQ ID NO: 477544 - DNA, 20 bp, Artificial
  CRISPR gRNA sequence
caatcataatacataagcca

SEQ ID NO: 477545 - DNA, 20 bp, Artificial
  CRISPR gRNA sequence
aatctgaacatcacaagtaa

SEQ ID NO: 477546 - DNA, 20 bp, Artificial
  CRISPR gRNA sequence
atctgaacatcacaagtaac

SEQ ID NO: 477547 - DNA, 20 bp, Artificial
  CRISPR gRNA sequence
aacatcacaagtaacaatcc

SEQ ID NO: 477548 - DNA, 20 bp, Artificial
  CRISPR gRNA sequence
ccactgaagtcaatatttag

SEQ ID NO: 477549 - DNA, 20 bp, Artificial
  CRISPR gRNA sequence
cactgaagtcaatatttaga

SEQ ID NO: 477550 - DNA, 20 bp, Artificial
  CRISPR gRNA sequence
aagtcaatatttagaaatac

SEQ ID NO: 477551 - DNA, 20 bp, Artificial
  CRISPR gRNA sequence
agaaatactcatgttggttt

SEQ ID NO: 477552 - DNA, 20 bp, Artificial
  CRISPR gRNA sequence
gaaatactcatgttggtttc

SEQ ID NO: 477553 - DNA, 20 bp, Artificial
  CRISPR gRNA sequence
atgttggtttctgatcaaat

SEQ ID NO: 477554 - DNA, 20 bp, Artificial
  CRISPR gRNA sequence
gtttctgatcaaatgccaga

SEQ ID NO: 477555 - DNA, 20 bp, Artificial
  CRISPR gRNA sequence
ctgatcaaatgccagaggca

SEQ ID NO: 477556 - DNA, 20 bp, Artificial
  CRISPR gRNA sequence
tgatcaaatgccagaggcac

SEQ ID NO: 477557 - DNA, 20 bp, Artificial
  CRISPR gRNA sequence
atcaaatgccagaggcactc

SEQ ID NO: 477558 - DNA, 20 bp, Artificial
  CRISPR gRNA sequence
actgatgctactgtcaacag

SEQ ID NO: 477559 - DNA, 20 bp, Artificial
  CRISPR gRNA sequence
atgctactgtcaacagcttc

SEQ ID NO: 477560 - DNA, 20 bp, Artificial
  CRISPR gRNA sequence
ctgtcaacagcttctcaggt

SEQ ID NO: 477561 - DNA, 20 bp, Artificial
  CRISPR gRNA sequence
tcaacagcttctcaggtatg

SEQ ID NO: 477562 - DNA, 20 bp, Artificial
  CRISPR gRNA sequence
ctcaggtatgctgtctacat

SEQ ID NO: 477563 - DNA, 20 bp, Artificial
  CRISPR gRNA sequence
tcaggtatgctgtctacatt

SEQ ID NO: 477564 - DNA, 20 bp, Artificial
  CRISPR gRNA sequence
aggtatgctgtctacatttg

SEQ ID NO: 477565 - DNA, 20 bp, Artificial
  CRISPR gRNA sequence
tctacatttgctgccctatg

SEQ ID NO: 477566 - DNA, 20 bp, Artificial
  CRISPR gRNA sequence
catttgctgccctatgtttc

SEQ ID NO: 477567 - DNA, 20 bp, Artificial
  CRISPR gRNA sequence
gctgccctatgtttcttcct

SEQ ID NO: 477568 - DNA, 20 bp, Artificial
  CRISPR gRNA sequence
ctgccctatgtttcttcctg

SEQ ID NO: 477569 - DNA, 20 bp, Artificial
  CRISPR gRNA sequence
ccctatgtttcttcctgaaa

SEQ ID NO: 477570 - DNA, 20 bp, Artificial
  CRISPR gRNA sequence
tgtttcttcctgaaatccct

SEQ ID NO: 477571 - DNA, 20 bp, Artificial
  CRISPR gRNA sequence
cttcctgaaatccctgtgac

SEQ ID NO: 477572 - DNA, 20 bp, Artificial
  CRISPR gRNA sequence
ttcctgaaatccctgtgaca

SEQ ID NO: 477573 - DNA, 20 bp, Artificial
  CRISPR gRNA sequence
cctgaaatccctgtgacaaa

SEQ ID NO: 477574 - DNA, 20 bp, Artificial
  CRISPR gRNA sequence
ctgaaatccctgtgacaaag

SEQ ID NO: 477575 - DNA, 20 bp, Artificial
  CRISPR gRNA sequence
aaatccctgtgacaaaggtg

SEQ ID NO: 477576 - DNA, 20 bp, Artificial
  CRISPR gRNA sequence
tgacaaaggtggaaaattta

SEQ ID NO: 477577 - DNA, 20 bp, Artificial
  CRISPR gRNA sequence
agcctctctgaaggacaggg

SEQ ID NO: 477578 - DNA, 20 bp, Artificial
  CRISPR gRNA sequence
gcctctctgaaggacagggc

SEQ ID NO: 477579 - DNA, 20 bp, Artificial
  CRISPR gRNA sequence
tctgaaggacagggcctatg

SEQ ID NO: 477580 - DNA, 20 bp, Artificial
  CRISPR gRNA sequence
tgaaggacagggcctatgtg

SEQ ID NO: 477581 - DNA, 20 bp, Artificial
  CRISPR gRNA sequence
aaggacagggcctatgtgta

SEQ ID NO: 477582 - DNA, 20 bp, Artificial
  CRISPR gRNA sequence
tgtgtaacaggcaatcaaag

SEQ ID NO: 477583 - DNA, 20 bp, Artificial
  CRISPR gRNA sequence
tctaaatcattgttctttag

SEQ ID NO: 477584 - DNA, 20 bp, Artificial
  CRISPR gRNA sequence
taaatcattgttctttagga

SEQ ID NO: 477585 - DNA, 20 bp, Artificial
  CRISPR gRNA sequence
aatcattgttctttaggact

SEQ ID NO: 477586 - DNA, 20 bp, Artificial
  CRISPR gRNA sequence
ttctttaggactcattaagt

SEQ ID NO: 477587 - DNA, 20 bp, Artificial
  CRISPR gRNA sequence
tttaggactcattaagttga

SEQ ID NO: 477588 - DNA, 20 bp, Artificial
  CRISPR gRNA sequence
taggactcattaagttgact

SEQ ID NO: 477589 - DNA, 20 bp, Artificial
  CRISPR gRNA sequence
aggactcattaagttgacta

SEQ ID NO: 477590 - DNA, 20 bp, Artificial
  CRISPR gRNA sequence
ggactcattaagttgactag

SEQ ID NO: 477591 - DNA, 20 bp, Artificial
  CRISPR gRNA sequence
attaagttgactagaagctt

SEQ ID NO: 477592 - DNA, 20 bp, Artificial
  CRISPR gRNA sequence
agttgactagaagcttttac

SEQ ID NO: 477593 - DNA, 20 bp, Artificial
  CRISPR gRNA sequence
actagaagcttttactattc

SEQ ID NO: 477594 - DNA, 20 bp, Artificial
  CRISPR gRNA sequence
gaagcttttactattcaagg

SEQ ID NO: 477595 - DNA, 20 bp, Artificial
  CRISPR gRNA sequence
ttactattcaagggcgataa

SEQ ID NO: 477596 - DNA, 20 bp, Artificial
  CRISPR gRNA sequence
tactattcaagggcgataat

SEQ ID NO: 477597 - DNA, 20 bp, Artificial
  CRISPR gRNA sequence
actattcaagggcgataatt

SEQ ID NO: 477598 - DNA, 20 bp, Artificial
  CRISPR gRNA sequence
ctattcaagggcgataatta

SEQ ID NO: 477599 - DNA, 20 bp, Artificial
  CRISPR gRNA sequence
ttcaagggcgataattacat

SEQ ID NO: 477600 - DNA, 20 bp, Artificial
  CRISPR gRNA sequence
aagggcgataattacatgtt

SEQ ID NO: 477601 - DNA, 20 bp, Artificial
  CRISPR gRNA sequence
catgttgaccaactaaaacc

SEQ ID NO: 477602 - DNA, 20 bp, Artificial
  CRISPR gRNA sequence
accaactaaaaccaccagaa

SEQ ID NO: 477603 - DNA, 20 bp, Artificial
  CRISPR gRNA sequence
aaaccaccagaaactcatcc

SEQ ID NO: 477604 - DNA, 20 bp, Artificial
  CRISPR gRNA sequence
atccttgttacacagagtag

SEQ ID NO: 477605 - DNA, 20 bp, Artificial
  CRISPR gRNA sequence
gttacacagagtagacaggg

SEQ ID NO: 477606 - DNA, 20 bp, Artificial
  CRISPR gRNA sequence
ttacacagagtagacagggc

SEQ ID NO: 477607 - DNA, 20 bp, Artificial
  CRISPR gRNA sequence
cacagagtagacagggctct

SEQ ID NO: 477608 - DNA, 20 bp, Artificial
  CRISPR gRNA sequence
taaggagtgcaatgcatatg

SEQ ID NO: 477609 - DNA, 20 bp, Artificial
  CRISPR gRNA sequence
aggagtgcaatgcatatgaa

SEQ ID NO: 477610 - DNA, 20 bp, Artificial
  CRISPR gRNA sequence
tggcctagagaagcaaagtc

SEQ ID NO: 477611 - DNA, 20 bp, Artificial
  CRISPR gRNA sequence
gcctagagaagcaaagtcag

SEQ ID NO: 477612 - DNA, 20 bp, Artificial
  CRISPR gRNA sequence
gagaagcaaagtcagtgacc

SEQ ID NO: 477613 - DNA, 20 bp, Artificial
  CRISPR gRNA sequence
caaggggacatttgtgactt

SEQ ID NO: 477614 - DNA, 20 bp, Artificial
  CRISPR gRNA sequence
gtgacttggcagagatgtaa

SEQ ID NO: 477615 - DNA, 20 bp, Artificial
  CRISPR gRNA sequence
tgacttggcagagatgtaat

SEQ ID NO: 477616 - DNA, 20 bp, Artificial
  CRISPR gRNA sequence
ggcagagatgtaatgaagaa

SEQ ID NO: 477617 - DNA, 20 bp, Artificial
  CRISPR gRNA sequence
gcagagatgtaatgaagaag

SEQ ID NO: 477618 - DNA, 20 bp, Artificial
  CRISPR gRNA sequence
aaagcaagcttagaaaatta

SEQ ID NO: 477619 - DNA, 20 bp, Artificial
  CRISPR gRNA sequence
agaaaattatcaaaggacaa

SEQ ID NO: 477620 - DNA, 20 bp, Artificial
  CRISPR gRNA sequence
gaaaattatcaaaggacaaa

SEQ ID NO: 477621 - DNA, 20 bp, Artificial
  CRISPR gRNA sequence
tcaaaggacaaagttttttt

SEQ ID NO: 477622 - DNA, 20 bp, Artificial
  CRISPR gRNA sequence
ttttcaatattctagttttg

SEQ ID NO: 477623 - DNA, 20 bp, Artificial
  CRISPR gRNA sequence
tttcaatattctagttttga

SEQ ID NO: 477624 - DNA, 20 bp, Artificial
  CRISPR gRNA sequence
ttcaatattctagttttgac

SEQ ID NO: 477625 - DNA, 20 bp, Artificial
  CRISPR gRNA sequence
tcaatattctagttttgacc

SEQ ID NO: 477626 - DNA, 20 bp, Artificial
  CRISPR gRNA sequence
caatattctagttttgacca

SEQ ID NO: 477627 - DNA, 20 bp, Artificial
  CRISPR gRNA sequence
aatattctagttttgaccaa

SEQ ID NO: 477628 - DNA, 20 bp, Artificial
  CRISPR gRNA sequence
tagttttgaccaaggcaagc

SEQ ID NO: 477629 - DNA, 20 bp, Artificial
  CRISPR gRNA sequence
gttttgaccaaggcaagcct

SEQ ID NO: 477630 - DNA, 20 bp, Artificial
  CRISPR gRNA sequence
tgaccaaggcaagccttgct

SEQ ID NO: 477631 - DNA, 20 bp, Artificial
  CRISPR gRNA sequence
gaccaaggcaagccttgctg

SEQ ID NO: 477632 - DNA, 20 bp, Artificial
  CRISPR gRNA sequence
accaaggcaagccttgctgg

SEQ ID NO: 477633 - DNA, 20 bp, Artificial
  CRISPR gRNA sequence
gctggttaatatatttctgt

SEQ ID NO: 477634 - DNA, 20 bp, Artificial
  CRISPR gRNA sequence
ctggttaatatatttctgta

SEQ ID NO: 477635 - DNA, 20 bp, Artificial
  CRISPR gRNA sequence
gttaatatatttctgtagag

SEQ ID NO: 477636 - DNA, 20 bp, Artificial
  CRISPR gRNA sequence
atatatttctgtagagtttc

SEQ ID NO: 477637 - DNA, 20 bp, Artificial
  CRISPR gRNA sequence
ctgtagagtttcctctccca

SEQ ID NO: 477638 - DNA, 20 bp, Artificial
  CRISPR gRNA sequence
tgtagagtttcctctcccac

SEQ ID NO: 477639 - DNA, 20 bp, Artificial
  CRISPR gRNA sequence
tagagtttcctctcccacat

SEQ ID NO: 477640 - DNA, 20 bp, Artificial
  CRISPR gRNA sequence
cctctcccacataaaagaag

SEQ ID NO: 477641 - DNA, 20 bp, Artificial
  CRISPR gRNA sequence
ctctcccacataaaagaaga

SEQ ID NO: 477642 - DNA, 20 bp, Artificial
  CRISPR gRNA sequence
tcccacataaaagaagagca

SEQ ID NO: 477643 - DNA, 20 bp, Artificial
  CRISPR gRNA sequence
ccacataaaagaagagcatg

SEQ ID NO: 477644 - DNA, 20 bp, Artificial
  CRISPR gRNA sequence
atattggatgtgctgccttt

SEQ ID NO: 477645 - DNA, 20 bp, Artificial
  CRISPR gRNA sequence
tattggatgtgctgcctttc

SEQ ID NO: 477646 - DNA, 20 bp, Artificial
  CRISPR gRNA sequence
gatgtgctgcctttcttctc

SEQ ID NO: 477647 - DNA, 20 bp, Artificial
  CRISPR gRNA sequence
cctttcttctctctattata

SEQ ID NO: 477648 - DNA, 20 bp, Artificial
  CRISPR gRNA sequence
tcttctctctattatataga

SEQ ID NO: 477649 - DNA, 20 bp, Artificial
  CRISPR gRNA sequence
cttctctctattatatagat

SEQ ID NO: 477650 - DNA, 20 bp, Artificial
  CRISPR gRNA sequence
ttctctctattatatagata

SEQ ID NO: 477651 - DNA, 20 bp, Artificial
  CRISPR gRNA sequence
ctctctattatatagatata

SEQ ID NO: 477652 - DNA, 20 bp, Artificial
  CRISPR gRNA sequence
tctctattatatagatatat

SEQ ID NO: 477653 - DNA, 20 bp, Artificial
  CRISPR gRNA sequence
tctattatatagatatattt

SEQ ID NO: 477654 - DNA, 20 bp, Artificial
  CRISPR gRNA sequence
tattatatagatatattttt

SEQ ID NO: 477655 - DNA, 20 bp, Artificial
  CRISPR gRNA sequence
ttatatagatatatttttgc

SEQ ID NO: 477656 - DNA, 20 bp, Artificial
  CRISPR gRNA sequence
tatagatatatttttgcctg

SEQ ID NO: 477657 - DNA, 20 bp, Artificial
  CRISPR gRNA sequence
ttgcctggtgtatatactag

SEQ ID NO: 477658 - DNA, 20 bp, Artificial
  CRISPR gRNA sequence
tgcctggtgtatatactagt

SEQ ID NO: 477659 - DNA, 20 bp, Artificial
  CRISPR gRNA sequence
gcctggtgtatatactagtt

SEQ ID NO: 477660 - DNA, 20 bp, Artificial
  CRISPR gRNA sequence
cctggtgtatatactagtta

SEQ ID NO: 477661 - DNA, 20 bp, Artificial
  CRISPR gRNA sequence
gtgtatatactagttattat

SEQ ID NO: 477662 - DNA, 20 bp, Artificial
  CRISPR gRNA sequence
gttattatgcaccactgctg

SEQ ID NO: 477663 - DNA, 20 bp, Artificial
  CRISPR gRNA sequence
ttatgcaccactgctgatcc

SEQ ID NO: 477664 - DNA, 20 bp, Artificial
  CRISPR gRNA sequence
tgcaccactgctgatcccta

SEQ ID NO: 477665 - DNA, 20 bp, Artificial
  CRISPR gRNA sequence
ctgatccctagaatggttgt

SEQ ID NO: 477666 - DNA, 20 bp, Artificial
  CRISPR gRNA sequence
atccctagaatggttgttgg

SEQ ID NO: 477667 - DNA, 20 bp, Artificial
  CRISPR gRNA sequence
gaatggttgttgggggtaat

SEQ ID NO: 477668 - DNA, 20 bp, Artificial
  CRISPR gRNA sequence
ttgggggtaatttttcacag

SEQ ID NO: 477669 - DNA, 20 bp, Artificial
  CRISPR gRNA sequence
ggggtaatttttcacagcag

SEQ ID NO: 477670 - DNA, 20 bp, Artificial
  CRISPR gRNA sequence
ttcacagcagagtcttctgt

SEQ ID NO: 477671 - DNA, 20 bp, Artificial
  CRISPR gRNA sequence
tcacagcagagtcttctgtg

SEQ ID NO: 477672 - DNA, 20 bp, Artificial
  CRISPR gRNA sequence
cacagcagagtcttctgtgt

SEQ ID NO: 477673 - DNA, 20 bp, Artificial
  CRISPR gRNA sequence
acagcagagtcttctgtgtt

SEQ ID NO: 477674 - DNA, 20 bp, Artificial
  CRISPR gRNA sequence
ctgtgtttccatcttgtctt

SEQ ID NO: 477675 - DNA, 20 bp, Artificial
  CRISPR gRNA sequence
tgtgtttccatcttgtcttt

SEQ ID NO: 477676 - DNA, 20 bp, Artificial
  CRISPR gRNA sequence
tgtttccatcttgtctttac

SEQ ID NO: 477677 - DNA, 20 bp, Artificial
  CRISPR gRNA sequence
ccatcttgtctttaccattc

SEQ ID NO: 477678 - DNA, 20 bp, Artificial
  CRISPR gRNA sequence
catcttgtctttaccattca

SEQ ID NO: 477679 - DNA, 20 bp, Artificial
  CRISPR gRNA sequence
gtctttaccattcataggct

SEQ ID NO: 477680 - DNA, 20 bp, Artificial
  CRISPR gRNA sequence
tctttaccattcataggctt

SEQ ID NO: 477681 - DNA, 20 bp, Artificial
  CRISPR gRNA sequence
taccattcataggctttaca

SEQ ID NO: 477682 - DNA, 20 bp, Artificial
  CRISPR gRNA sequence
accattcataggctttacac

SEQ ID NO: 477683 - DNA, 20 bp, Artificial
  CRISPR gRNA sequence
ccattcataggctttacacc

SEQ ID NO: 477684 - DNA, 20 bp, Artificial
  CRISPR gRNA sequence
ataggctttacacctctgga

SEQ ID NO: 477685 - DNA, 20 bp, Artificial
  CRISPR gRNA sequence
tacacctctggacaatgact

SEQ ID NO: 477686 - DNA, 20 bp, Artificial
  CRISPR gRNA sequence
acacctctggacaatgactc

SEQ ID NO: 477687 - DNA, 20 bp, Artificial
  CRISPR gRNA sequence
cacctctggacaatgactca

SEQ ID NO: 477688 - DNA, 20 bp, Artificial
  CRISPR gRNA sequence
tggacaatgactcaacttct

SEQ ID NO: 477689 - DNA, 20 bp, Artificial
  CRISPR gRNA sequence
gacaatgactcaacttctgt

SEQ ID NO: 477690 - DNA, 20 bp, Artificial
  CRISPR gRNA sequence
aacttctgtgtgatttccct

SEQ ID NO: 477691 - DNA, 20 bp, Artificial
  CRISPR gRNA sequence
ctgtgtgatttccctaaatt

SEQ ID NO: 477692 - DNA, 20 bp, Artificial
  CRISPR gRNA sequence
tgtgtgatttccctaaattc

SEQ ID NO: 477693 - DNA, 20 bp, Artificial
  CRISPR gRNA sequence
tgtgatttccctaaattcat

SEQ ID NO: 477694 - DNA, 20 bp, Artificial
  CRISPR gRNA sequence
ccctaaattcatcctatcag

SEQ ID NO: 477695 - DNA, 20 bp, Artificial
  CRISPR gRNA sequence
cctaaattcatcctatcaga

SEQ ID NO: 477696 - DNA, 20 bp, Artificial
  CRISPR gRNA sequence
aattcatcctatcagaaaac

SEQ ID NO: 477697 - DNA, 20 bp, Artificial
  CRISPR gRNA sequence
atcctatcagaaaacataat

SEQ ID NO: 477698 - DNA, 20 bp, Artificial
  CRISPR gRNA sequence
tcagaaaacataataatatc

SEQ ID NO: 477699 - DNA, 20 bp, Artificial
  CRISPR gRNA sequence
gtactttatgttgttgttat

SEQ ID NO: 477700 - DNA, 20 bp, Artificial
  CRISPR gRNA sequence
tatgttgttgttatgtgcca

SEQ ID NO: 477701 - DNA, 20 bp, Artificial
  CRISPR gRNA sequence
atgttgttgttatgtgccaa

SEQ ID NO: 477702 - DNA, 20 bp, Artificial
  CRISPR gRNA sequence
tgttgttgttatgtgccaag

SEQ ID NO: 477703 - DNA, 20 bp, Artificial
  CRISPR gRNA sequence
ttgttatgtgccaagcatag

SEQ ID NO: 477704 - DNA, 20 bp, Artificial
  CRISPR gRNA sequence
ttatgtgccaagcatagtgc

SEQ ID NO: 477705 - DNA, 20 bp, Artificial
  CRISPR gRNA sequence
tgtgccaagcatagtgctaa

SEQ ID NO: 477706 - DNA, 20 bp, Artificial
  CRISPR gRNA sequence
agaatatttcctatatgttc

SEQ ID NO: 477707 - DNA, 20 bp, Artificial
  CRISPR gRNA sequence
cctatatgttctcatttgct

SEQ ID NO: 477708 - DNA, 20 bp, Artificial
  CRISPR gRNA sequence
ctatatgttctcatttgctt

SEQ ID NO: 477709 - DNA, 20 bp, Artificial
  CRISPR gRNA sequence
tatgttctcatttgctttca

SEQ ID NO: 477710 - DNA, 20 bp, Artificial
  CRISPR gRNA sequence
tcatttgctttcacaacaac

SEQ ID NO: 477711 - DNA, 20 bp, Artificial
  CRISPR gRNA sequence
atttgctttcacaacaaccc

SEQ ID NO: 477712 - DNA, 20 bp, Artificial
  CRISPR gRNA sequence
gctttcacaacaaccctact

SEQ ID NO: 477713 - DNA, 20 bp, Artificial
  CRISPR gRNA sequence
ctttcacaacaaccctactg

SEQ ID NO: 477714 - DNA, 20 bp, Artificial
  CRISPR gRNA sequence
tcacaacaaccctactggat

SEQ ID NO: 477715 - DNA, 20 bp, Artificial
  CRISPR gRNA sequence
cacaacaaccctactggata

SEQ ID NO: 477716 - DNA, 20 bp, Artificial
  CRISPR gRNA sequence
acaacaaccctactggataa

SEQ ID NO: 477717 - DNA, 20 bp, Artificial
  CRISPR gRNA sequence
ctggataagagcttgtgctt

SEQ ID NO: 477718 - DNA, 20 bp, Artificial
  CRISPR gRNA sequence
gataagagcttgtgctttgg

SEQ ID NO: 477719 - DNA, 20 bp, Artificial
  CRISPR gRNA sequence
gtgctttggagttagccaca

SEQ ID NO: 477720 - DNA, 20 bp, Artificial
  CRISPR gRNA sequence
tgctttggagttagccacac

SEQ ID NO: 477721 - DNA, 20 bp, Artificial
  CRISPR gRNA sequence
tggagttagccacacctggg

SEQ ID NO: 477722 - DNA, 20 bp, Artificial
  CRISPR gRNA sequence
ggagttagccacacctgggt

SEQ ID NO: 477723 - DNA, 20 bp, Artificial
  CRISPR gRNA sequence
gagttagccacacctgggtt

SEQ ID NO: 477724 - DNA, 20 bp, Artificial
  CRISPR gRNA sequence
gccacacctgggttaaagtc

SEQ ID NO: 477725 - DNA, 20 bp, Artificial
  CRISPR gRNA sequence
ggttaaagtcctagccttga

SEQ ID NO: 477726 - DNA, 20 bp, Artificial
  CRISPR gRNA sequence
aagtcctagccttgactctt

SEQ ID NO: 477727 - DNA, 20 bp, Artificial
  CRISPR gRNA sequence
gccttgactcttcctcctac

SEQ ID NO: 477728 - DNA, 20 bp, Artificial
  CRISPR gRNA sequence
gactcttcctcctaccagct

SEQ ID NO: 477729 - DNA, 20 bp, Artificial
  CRISPR gRNA sequence
actcttcctcctaccagctg

SEQ ID NO: 477730 - DNA, 20 bp, Artificial
  CRISPR gRNA sequence
ttcctcctaccagctggtga

SEQ ID NO: 477731 - DNA, 20 bp, Artificial
  CRISPR gRNA sequence
cctcctaccagctggtgatc

SEQ ID NO: 477732 - DNA, 20 bp, Artificial
  CRISPR gRNA sequence
ctcctaccagctggtgatct

SEQ ID NO: 477733 - DNA, 20 bp, Artificial
  CRISPR gRNA sequence
ctaccagctggtgatcttgg

SEQ ID NO: 477734 - DNA, 20 bp, Artificial
  CRISPR gRNA sequence
ccagctggtgatcttgggca

SEQ ID NO: 477735 - DNA, 20 bp, Artificial
  CRISPR gRNA sequence
gtgatcttgggcaagtggct

SEQ ID NO: 477736 - DNA, 20 bp, Artificial
  CRISPR gRNA sequence
gggcaagtggcttatattct

SEQ ID NO: 477737 - DNA, 20 bp, Artificial
  CRISPR gRNA sequence
ggcaagtggcttatattctc

SEQ ID NO: 477738 - DNA, 20 bp, Artificial
  CRISPR gRNA sequence
atattctctaatacccagtt

SEQ ID NO: 477739 - DNA, 20 bp, Artificial
  CRISPR gRNA sequence
tattctctaatacccagttt

SEQ ID NO: 477740 - DNA, 20 bp, Artificial
  CRISPR gRNA sequence
tctaatacccagtttcctca

SEQ ID NO: 477741 - DNA, 20 bp, Artificial
  CRISPR gRNA sequence
taatacccagtttcctcaac

SEQ ID NO: 477742 - DNA, 20 bp, Artificial
  CRISPR gRNA sequence
atacccagtttcctcaactt

SEQ ID NO: 477743 - DNA, 20 bp, Artificial
  CRISPR gRNA sequence
cctcaacttaaaaaaataaa

SEQ ID NO: 477744 - DNA, 20 bp, Artificial
  CRISPR gRNA sequence
ctcaacttaaaaaaataaag

SEQ ID NO: 477745 - DNA, 20 bp, Artificial
  CRISPR gRNA sequence
aacttaaaaaaataaaggcc

SEQ ID NO: 477746 - DNA, 20 bp, Artificial
  CRISPR gRNA sequence
aaaaaaataaaggccataat

SEQ ID NO: 477747 - DNA, 20 bp, Artificial
  CRISPR gRNA sequence
aaaaaataaaggccataata

SEQ ID NO: 477748 - DNA, 20 bp, Artificial
  CRISPR gRNA sequence
cctcataaaatcattgtgag

SEQ ID NO: 477749 - DNA, 20 bp, Artificial
  CRISPR gRNA sequence
ataaaatcattgtgagggtc

SEQ ID NO: 477750 - DNA, 20 bp, Artificial
  CRISPR gRNA sequence
tgagggtcaaatgaaacaat

SEQ ID NO: 477751 - DNA, 20 bp, Artificial
  CRISPR gRNA sequence
ggtatctaaaagtgcctacc

SEQ ID NO: 477752 - DNA, 20 bp, Artificial
  CRISPR gRNA sequence
gtatctaaaagtgcctacct

SEQ ID NO: 477753 - DNA, 20 bp, Artificial
  CRISPR gRNA sequence
aaagtgcctacctcataata

SEQ ID NO: 477754 - DNA, 20 bp, Artificial
  CRISPR gRNA sequence
cctcataataagaactttga

SEQ ID NO: 477755 - DNA, 20 bp, Artificial
  CRISPR gRNA sequence
ataataagaactttgaaaat

SEQ ID NO: 477756 - DNA, 20 bp, Artificial
  CRISPR gRNA sequence
tgaaaatattagtcatattc

SEQ ID NO: 477757 - DNA, 20 bp, Artificial
  CRISPR gRNA sequence
gaaaatattagtcatattct

SEQ ID NO: 477758 - DNA, 20 bp, Artificial
  CRISPR gRNA sequence
aaaatattagtcatattctt

SEQ ID NO: 477759 - DNA, 20 bp, Artificial
  CRISPR gRNA sequence
gtcatattctttttttcctc

SEQ ID NO: 477760 - DNA, 20 bp, Artificial
  CRISPR gRNA sequence
tttttttcctcgtgttaaga

SEQ ID NO: 477761 - DNA, 20 bp, Artificial
  CRISPR gRNA sequence
tttttcctcgtgttaagatg

SEQ ID NO: 477762 - DNA, 20 bp, Artificial
  CRISPR gRNA sequence
ttttcctcgtgttaagatgg

SEQ ID NO: 477763 - DNA, 20 bp, Artificial
  CRISPR gRNA sequence
tttcctcgtgttaagatgga

SEQ ID NO: 477764 - DNA, 20 bp, Artificial
  CRISPR gRNA sequence
ttcctcgtgttaagatggat

SEQ ID NO: 477765 - DNA, 20 bp, Artificial
  CRISPR gRNA sequence
tcctcgtgttaagatggatc

SEQ ID NO: 477766 - DNA, 20 bp, Artificial
  CRISPR gRNA sequence
cctcgtgttaagatggatct

SEQ ID NO: 477767 - DNA, 20 bp, Artificial
  CRISPR gRNA sequence
ctcgtgttaagatggatcta

SEQ ID NO: 477768 - DNA, 20 bp, Artificial
  CRISPR gRNA sequence
gtgttaagatggatctaggt

SEQ ID NO: 477769 - DNA, 20 bp, Artificial
  CRISPR gRNA sequence
agatggatctaggttgggtc

SEQ ID NO: 477770 - DNA, 20 bp, Artificial
  CRISPR gRNA sequence
ggttgggtctacagtatata

SEQ ID NO: 477771 - DNA, 20 bp, Artificial
  CRISPR gRNA sequence
ggtctacagtatatagataa

SEQ ID NO: 477772 - DNA, 20 bp, Artificial
  CRISPR gRNA sequence
cagtatatagataatgtgag

SEQ ID NO: 477773 - DNA, 20 bp, Artificial
  CRISPR gRNA sequence
tgggcaagtggcaaagaatg

SEQ ID NO: 477774 - DNA, 20 bp, Artificial
  CRISPR gRNA sequence
tagaggtgatctcctaaatg

SEQ ID NO: 477775 - DNA, 20 bp, Artificial
  CRISPR gRNA sequence
gaggtgatctcctaaatgta

SEQ ID NO: 477776 - DNA, 20 bp, Artificial
  CRISPR gRNA sequence
ctaaatgtaacttaaacttt

SEQ ID NO: 477777 - DNA, 20 bp, Artificial
  CRISPR gRNA sequence
aatgtaacttaaactttcca

SEQ ID NO: 477778 - DNA, 20 bp, Artificial
  CRISPR gRNA sequence
aaactttccattgggcatct

SEQ ID NO: 477779 - DNA, 20 bp, Artificial
  CRISPR gRNA sequence
aactttccattgggcatctg

SEQ ID NO: 477780 - DNA, 20 bp, Artificial
  CRISPR gRNA sequence
tccattgggcatctgacctc

SEQ ID NO: 477781 - DNA, 20 bp, Artificial
  CRISPR gRNA sequence
ccattgggcatctgacctca

SEQ ID NO: 477782 - DNA, 20 bp, Artificial
  CRISPR gRNA sequence
cattgggcatctgacctcat

SEQ ID NO: 477783 - DNA, 20 bp, Artificial
  CRISPR gRNA sequence
ggcatctgacctcatgacct

SEQ ID NO: 477784 - DNA, 20 bp, Artificial
  CRISPR gRNA sequence
acctcatgacctctaaggtt

SEQ ID NO: 477785 - DNA, 20 bp, Artificial
  CRISPR gRNA sequence
atgacctctaaggttctctt

SEQ ID NO: 477786 - DNA, 20 bp, Artificial
  CRISPR gRNA sequence
taaggttctcttcttgttct

SEQ ID NO: 477787 - DNA, 20 bp, Artificial
  CRISPR gRNA sequence
aggttctcttcttgttctac

SEQ ID NO: 477788 - DNA, 20 bp, Artificial
  CRISPR gRNA sequence
tcttcttgttctactcttaa

SEQ ID NO: 477789 - DNA, 20 bp, Artificial
  CRISPR gRNA sequence
ttcttgttctactcttaaat

SEQ ID NO: 477790 - DNA, 20 bp, Artificial
  CRISPR gRNA sequence
cttgttctactcttaaatat

SEQ ID NO: 477791 - DNA, 20 bp, Artificial
  CRISPR gRNA sequence
ttgttctactcttaaatatc

SEQ ID NO: 477792 - DNA, 20 bp, Artificial
  CRISPR gRNA sequence
gttctactcttaaatatctc

SEQ ID NO: 477793 - DNA, 20 bp, Artificial
  CRISPR gRNA sequence
ttctactcttaaatatctca

SEQ ID NO: 477794 - DNA, 20 bp, Artificial
  CRISPR gRNA sequence
tactcttaaatatctcaagg

SEQ ID NO: 477795 - DNA, 20 bp, Artificial
  CRISPR gRNA sequence
ctcttaaatatctcaaggag

SEQ ID NO: 477796 - DNA, 20 bp, Artificial
  CRISPR gRNA sequence
ttaaatatctcaaggagagg

SEQ ID NO: 477797 - DNA, 20 bp, Artificial
  CRISPR gRNA sequence
aaatatctcaaggagaggaa

SEQ ID NO: 477798 - DNA, 20 bp, Artificial
  CRISPR gRNA sequence
aatatctcaaggagaggaaa

SEQ ID NO: 477799 - DNA, 20 bp, Artificial
  CRISPR gRNA sequence
aaggagaggaaatgacatgg

SEQ ID NO: 477800 - DNA, 20 bp, Artificial
  CRISPR gRNA sequence
tgtaagctttgctaaatgtc

SEQ ID NO: 477801 - DNA, 20 bp, Artificial
  CRISPR gRNA sequence
gtaagctttgctaaatgtcg

SEQ ID NO: 477802 - DNA, 20 bp, Artificial
  CRISPR gRNA sequence
taagctttgctaaatgtcgg

SEQ ID NO: 477803 - DNA, 20 bp, Artificial
  CRISPR gRNA sequence
tgctaaatgtcggaaaaagc

SEQ ID NO: 477804 - DNA, 20 bp, Artificial
  CRISPR gRNA sequence
gctaaatgtcggaaaaagca

SEQ ID NO: 477805 - DNA, 20 bp, Artificial
  CRISPR gRNA sequence
ctaaatgtcggaaaaagcaa

SEQ ID NO: 477806 - DNA, 20 bp, Artificial
  CRISPR gRNA sequence
aatgtcggaaaaagcaatga

SEQ ID NO: 477807 - DNA, 20 bp, Artificial
  CRISPR gRNA sequence
gaatgactgattttagacaa

SEQ ID NO: 477808 - DNA, 20 bp, Artificial
  CRISPR gRNA sequence
attttagacaaaacaagttc

SEQ ID NO: 477809 - DNA, 20 bp, Artificial
  CRISPR gRNA sequence
tagacaaaacaagttcagaa

SEQ ID NO: 477810 - DNA, 20 bp, Artificial
  CRISPR gRNA sequence
agacaaaacaagttcagaat

SEQ ID NO: 477811 - DNA, 20 bp, Artificial
  CRISPR gRNA sequence
gacaaaacaagttcagaatt

SEQ ID NO: 477812 - DNA, 20 bp, Artificial
  CRISPR gRNA sequence
agaattatttcaaacatgat

SEQ ID NO: 477813 - DNA, 20 bp, Artificial
  CRISPR gRNA sequence
tttcaaacatgataaaatca

SEQ ID NO: 477814 - DNA, 20 bp, Artificial
  CRISPR gRNA sequence
caaacatgataaaatcaaga

SEQ ID NO: 477815 - DNA, 20 bp, Artificial
  CRISPR gRNA sequence
aaacatgataaaatcaagag

SEQ ID NO: 477816 - DNA, 20 bp, Artificial
  CRISPR gRNA sequence
aaagtcttcagtggctcaat

SEQ ID NO: 477817 - DNA, 20 bp, Artificial
  CRISPR gRNA sequence
aagtcttcagtggctcaata

SEQ ID NO: 477818 - DNA, 20 bp, Artificial
  CRISPR gRNA sequence
cagtggctcaatacaactgc

SEQ ID NO: 477819 - DNA, 20 bp, Artificial
  CRISPR gRNA sequence
agtggctcaatacaactgca

SEQ ID NO: 477820 - DNA, 20 bp, Artificial
  CRISPR gRNA sequence
aatacaactgcattgaagag

SEQ ID NO: 477821 - DNA, 20 bp, Artificial
  CRISPR gRNA sequence
cattgaagagatcagtcttc

SEQ ID NO: 477822 - DNA, 20 bp, Artificial
  CRISPR gRNA sequence
aagagatcagtcttcaaatt

SEQ ID NO: 477823 - DNA, 20 bp, Artificial
  CRISPR gRNA sequence
caaatttacttgccaaatag

SEQ ID NO: 477824 - DNA, 20 bp, Artificial
  CRISPR gRNA sequence
aaatttacttgccaaatagt

SEQ ID NO: 477825 - DNA, 20 bp, Artificial
  CRISPR gRNA sequence
acttgccaaatagtcatact

SEQ ID NO: 477826 - DNA, 20 bp, Artificial
  CRISPR gRNA sequence
cttgccaaatagtcatacta

SEQ ID NO: 477827 - DNA, 20 bp, Artificial
  CRISPR gRNA sequence
gccaaatagtcatactacac

SEQ ID NO: 477828 - DNA, 20 bp, Artificial
  CRISPR gRNA sequence
ccaaatagtcatactacact

SEQ ID NO: 477829 - DNA, 20 bp, Artificial
  CRISPR gRNA sequence
cactaacaatgagaaattct

SEQ ID NO: 477830 - DNA, 20 bp, Artificial
  CRISPR gRNA sequence
acaatgagaaattctaactg

SEQ ID NO: 477831 - DNA, 20 bp, Artificial
  CRISPR gRNA sequence
taactgtagaagaaattgct

SEQ ID NO: 477832 - DNA, 20 bp, Artificial
  CRISPR gRNA sequence
actgtagaagaaattgcttt

SEQ ID NO: 477833 - DNA, 20 bp, Artificial
  CRISPR gRNA sequence
tagaagaaattgctttaaag

SEQ ID NO: 477834 - DNA, 20 bp, Artificial
  CRISPR gRNA sequence
ctttaaagtgtgctaatacc

SEQ ID NO: 477835 - DNA, 20 bp, Artificial
  CRISPR gRNA sequence
taaagtgtgctaataccata

SEQ ID NO: 477836 - DNA, 20 bp, Artificial
  CRISPR gRNA sequence
aaagtgtgctaataccatat

SEQ ID NO: 477837 - DNA, 20 bp, Artificial
  CRISPR gRNA sequence
aagtgtgctaataccatatg

SEQ ID NO: 477838 - DNA, 20 bp, Artificial
  CRISPR gRNA sequence
ataccatatgaaagtaaact

SEQ ID NO: 477839 - DNA, 20 bp, Artificial
  CRISPR gRNA sequence
aaagaaaaatttcataaatg

SEQ ID NO: 477840 - DNA, 20 bp, Artificial
  CRISPR gRNA sequence
aagaaaaatttcataaatga

SEQ ID NO: 477841 - DNA, 20 bp, Artificial
  CRISPR gRNA sequence
cataaatgaatataagaaga

SEQ ID NO: 477842 - DNA, 20 bp, Artificial
  CRISPR gRNA sequence
ataaatgaatataagaagat

SEQ ID NO: 477843 - DNA, 20 bp, Artificial
  CRISPR gRNA sequence
ttataagaaggggattttta

SEQ ID NO: 477844 - DNA, 20 bp, Artificial
  CRISPR gRNA sequence
tataagaaggggatttttaa

SEQ ID NO: 477845 - DNA, 20 bp, Artificial
  CRISPR gRNA sequence
ataagaaggggatttttaag

SEQ ID NO: 477846 - DNA, 20 bp, Artificial
  CRISPR gRNA sequence
taagaaggggatttttaaga

SEQ ID NO: 477847 - DNA, 20 bp, Artificial
  CRISPR gRNA sequence
ttaagaggaaataataataa

SEQ ID NO: 477848 - DNA, 20 bp, Artificial
  CRISPR gRNA sequence
taagaggaaataataataaa

SEQ ID NO: 477849 - DNA, 20 bp, Artificial
  CRISPR gRNA sequence
aagaggaaataataataaaa

SEQ ID NO: 477850 - DNA, 20 bp, Artificial
  CRISPR gRNA sequence
agaggaaataataataaaag

SEQ ID NO: 477851 - DNA, 20 bp, Artificial
  CRISPR gRNA sequence
tgaaaatgctctcaattttc

SEQ ID NO: 477852 - DNA, 20 bp, Artificial
  CRISPR gRNA sequence
tcaattttcttgtttcatgg

SEQ ID NO: 477853 - DNA, 20 bp, Artificial
  CRISPR gRNA sequence
aattttcttgtttcatggtt

SEQ ID NO: 477854 - DNA, 20 bp, Artificial
  CRISPR gRNA sequence
tcttgtttcatggttgcttt

SEQ ID NO: 477855 - DNA, 20 bp, Artificial
  CRISPR gRNA sequence
cttgtttcatggttgctttt

SEQ ID NO: 477856 - DNA, 20 bp, Artificial
  CRISPR gRNA sequence
ttgtttcatggttgcttttt

SEQ ID NO: 477857 - DNA, 20 bp, Artificial
  CRISPR gRNA sequence
gtttcatggttgcttttttt

SEQ ID NO: 477858 - DNA, 20 bp, Artificial
  CRISPR gRNA sequence
tttcatggttgctttttttt

SEQ ID NO: 477859 - DNA, 20 bp, Artificial
  CRISPR gRNA sequence
catggttgcttttttttttt

SEQ ID NO: 477860 - DNA, 20 bp, Artificial
  CRISPR gRNA sequence
atggttgcttttttttttta

SEQ ID NO: 477861 - DNA, 20 bp, Artificial
  CRISPR gRNA sequence
ctttttttttttaaataatg

SEQ ID NO: 477862 - DNA, 20 bp, Artificial
  CRISPR gRNA sequence
tttttttttaaataatgggc

SEQ ID NO: 477863 - DNA, 20 bp, Artificial
  CRISPR gRNA sequence
ttttttttaaataatgggca

SEQ ID NO: 477864 - DNA, 20 bp, Artificial
  CRISPR gRNA sequence
tttttttaaataatgggcat

SEQ ID NO: 477865 - DNA, 20 bp, Artificial
  CRISPR gRNA sequence
ttttttaaataatgggcata

SEQ ID NO: 477866 - DNA, 20 bp, Artificial
  CRISPR gRNA sequence
tttttaaataatgggcataa

SEQ ID NO: 477867 - DNA, 20 bp, Artificial
  CRISPR gRNA sequence
ttttaaataatgggcataaa

SEQ ID NO: 477868 - DNA, 20 bp, Artificial
  CRISPR gRNA sequence
tttaaataatgggcataaat

SEQ ID NO: 477869 - DNA, 20 bp, Artificial
  CRISPR gRNA sequence
ttaaataatgggcataaatg

SEQ ID NO: 477870 - DNA, 20 bp, Artificial
  CRISPR gRNA sequence
taaataatgggcataaatgt

SEQ ID NO: 477871 - DNA, 20 bp, Artificial
  CRISPR gRNA sequence
aaataatgggcataaatgta

SEQ ID NO: 477872 - DNA, 20 bp, Artificial
  CRISPR gRNA sequence
aataatgggcataaatgtag

SEQ ID NO: 477873 - DNA, 20 bp, Artificial
  CRISPR gRNA sequence
atgccctgtgtattcttggc

SEQ ID NO: 477874 - DNA, 20 bp, Artificial
  CRISPR gRNA sequence
tgccctgtgtattcttggca

SEQ ID NO: 477875 - DNA, 20 bp, Artificial
  CRISPR gRNA sequence
tgtattcttggcattaatac

SEQ ID NO: 477876 - DNA, 20 bp, Artificial
  CRISPR gRNA sequence
ttggcattaatactttccag

SEQ ID NO: 477877 - DNA, 20 bp, Artificial
  CRISPR gRNA sequence
ggcattaatactttccagtt

SEQ ID NO: 477878 - DNA, 20 bp, Artificial
  CRISPR gRNA sequence
gcattaatactttccagttc

SEQ ID NO: 477879 - DNA, 20 bp, Artificial
  CRISPR gRNA sequence
atactttccagttccatttt

SEQ ID NO: 477880 - DNA, 20 bp, Artificial
  CRISPR gRNA sequence
tccagttccatttttgtgaa

SEQ ID NO: 477881 - DNA, 20 bp, Artificial
  CRISPR gRNA sequence
ccagttccatttttgtgaag

SEQ ID NO: 477882 - DNA, 20 bp, Artificial
  CRISPR gRNA sequence
cagttccatttttgtgaagg

SEQ ID NO: 477883 - DNA, 20 bp, Artificial
  CRISPR gRNA sequence
catttttgtgaaggaaattt

SEQ ID NO: 477884 - DNA, 20 bp, Artificial
  CRISPR gRNA sequence
ttgtgaaggaaattttacat

SEQ ID NO: 477885 - DNA, 20 bp, Artificial
  CRISPR gRNA sequence
tgtgaaggaaattttacatt

SEQ ID NO: 477886 - DNA, 20 bp, Artificial
  CRISPR gRNA sequence
gtgaaggaaattttacattg

SEQ ID NO: 477887 - DNA, 20 bp, Artificial
  CRISPR gRNA sequence
tgaaggaaattttacattgt

SEQ ID NO: 477888 - DNA, 20 bp, Artificial
  CRISPR gRNA sequence
tacattgtgtgtgtgtgtgt

SEQ ID NO: 477889 - DNA, 20 bp, Artificial
  CRISPR gRNA sequence
acattgtgtgtgtgtgtgtg

SEQ ID NO: 477890 - DNA, 20 bp, Artificial
  CRISPR gRNA sequence
cattgtgtgtgtgtgtgtgt

SEQ ID NO: 477891 - DNA, 20 bp, Artificial
  CRISPR gRNA sequence
tgtgtgtgtgtgtgtgtgtg

SEQ ID NO: 477892 - DNA, 20 bp, Artificial
  CRISPR gRNA sequence
acccagggagaaaatggctc

SEQ ID NO: 477893 - DNA, 20 bp, Artificial
  CRISPR gRNA sequence
cccagggagaaaatggctct

SEQ ID NO: 477894 - DNA, 20 bp, Artificial
  CRISPR gRNA sequence
ttcttgtctaaagagcaata

SEQ ID NO: 477895 - DNA, 20 bp, Artificial
  CRISPR gRNA sequence
cttgtctaaagagcaatatc

SEQ ID NO: 477896 - DNA, 20 bp, Artificial
  CRISPR gRNA sequence
ttgtctaaagagcaatatca

SEQ ID NO: 477897 - DNA, 20 bp, Artificial
  CRISPR gRNA sequence
gtctaaagagcaatatcagg

SEQ ID NO: 477898 - DNA, 20 bp, Artificial
  CRISPR gRNA sequence
tctaaagagcaatatcaggt

SEQ ID NO: 477899 - DNA, 20 bp, Artificial
  CRISPR gRNA sequence
aagagcaatatcaggtgata

SEQ ID NO: 477900 - DNA, 20 bp, Artificial
  CRISPR gRNA sequence
aatctactattgcatactac

SEQ ID NO: 477901 - DNA, 20 bp, Artificial
  CRISPR gRNA sequence
ctattgcatactacatcctt

SEQ ID NO: 477902 - DNA, 20 bp, Artificial
  CRISPR gRNA sequence
ttgcatactacatccttgtc

SEQ ID NO: 477903 - DNA, 20 bp, Artificial
  CRISPR gRNA sequence
catactacatccttgtctgt

SEQ ID NO: 477904 - DNA, 20 bp, Artificial
  CRISPR gRNA sequence
catccttgtctgtgatctgt

SEQ ID NO: 477905 - DNA, 20 bp, Artificial
  CRISPR gRNA sequence
gtctgtgatctgtattgtct

SEQ ID NO: 477906 - DNA, 20 bp, Artificial
  CRISPR gRNA sequence
tctgtgatctgtattgtcta

SEQ ID NO: 477907 - DNA, 20 bp, Artificial
  CRISPR gRNA sequence
tgatctgtattgtctatgat

SEQ ID NO: 477908 - DNA, 20 bp, Artificial
  CRISPR gRNA sequence
tattgtctatgatctgtatc

SEQ ID NO: 477909 - DNA, 20 bp, Artificial
  CRISPR gRNA sequence
tctatgatctgtatctttag

SEQ ID NO: 477910 - DNA, 20 bp, Artificial
  CRISPR gRNA sequence
tgatctgtatctttagtgtt

SEQ ID NO: 477911 - DNA, 20 bp, Artificial
  CRISPR gRNA sequence
tatctttagtgttgtttttc

SEQ ID NO: 477912 - DNA, 20 bp, Artificial
  CRISPR gRNA sequence
tagtgttgtttttcaggaaa

SEQ ID NO: 477913 - DNA, 20 bp, Artificial
  CRISPR gRNA sequence
agtgttgtttttcaggaaag

SEQ ID NO: 477914 - DNA, 20 bp, Artificial
  CRISPR gRNA sequence
gtgttgtttttcaggaaaga

SEQ ID NO: 477915 - DNA, 20 bp, Artificial
  CRISPR gRNA sequence
tttttcaggaaagacatatg

SEQ ID NO: 477916 - DNA, 20 bp, Artificial
  CRISPR gRNA sequence
ttcaggaaagacatatgtaa

SEQ ID NO: 477917 - DNA, 20 bp, Artificial
  CRISPR gRNA sequence
tcaggaaagacatatgtaaa

SEQ ID NO: 477918 - DNA, 20 bp, Artificial
  CRISPR gRNA sequence
caggaaagacatatgtaaat

SEQ ID NO: 477919 - DNA, 20 bp, Artificial
  CRISPR gRNA sequence
aggaaagacatatgtaaata

SEQ ID NO: 477920 - DNA, 20 bp, Artificial
  CRISPR gRNA sequence
tcattttacagaagggactg

SEQ ID NO: 477921 - DNA, 20 bp, Artificial
  CRISPR gRNA sequence
cattttacagaagggactga

SEQ ID NO: 477922 - DNA, 20 bp, Artificial
  CRISPR gRNA sequence
attttacagaagggactgag

SEQ ID NO: 477923 - DNA, 20 bp, Artificial
  CRISPR gRNA sequence
tacagaagggactgagggcc

SEQ ID NO: 477924 - DNA, 20 bp, Artificial
  CRISPR gRNA sequence
acagaagggactgagggcca

SEQ ID NO: 477925 - DNA, 20 bp, Artificial
  CRISPR gRNA sequence
cagaagggactgagggccag

SEQ ID NO: 477926 - DNA, 20 bp, Artificial
  CRISPR gRNA sequence
agggccagtcagttttcact

SEQ ID NO: 477927 - DNA, 20 bp, Artificial
  CRISPR gRNA sequence
tcactgtactcgtgagaaca

SEQ ID NO: 477928 - DNA, 20 bp, Artificial
  CRISPR gRNA sequence
cactgtactcgtgagaacaa

SEQ ID NO: 477929 - DNA, 20 bp, Artificial
  CRISPR gRNA sequence
actgtactcgtgagaacaat

SEQ ID NO: 477930 - DNA, 20 bp, Artificial
  CRISPR gRNA sequence
tactcgtgagaacaatcaca

SEQ ID NO: 477931 - DNA, 20 bp, Artificial
  CRISPR gRNA sequence
gtgagaacaatcacagggtt

SEQ ID NO: 477932 - DNA, 20 bp, Artificial
  CRISPR gRNA sequence
tccttaaagtaacaatagtc

SEQ ID NO: 477933 - DNA, 20 bp, Artificial
  CRISPR gRNA sequence
ccttaaagtaacaatagtca

SEQ ID NO: 477934 - DNA, 20 bp, Artificial
  CRISPR gRNA sequence
cttaaagtaacaatagtcac

SEQ ID NO: 477935 - DNA, 20 bp, Artificial
  CRISPR gRNA sequence
aaagtaacaatagtcacttt

SEQ ID NO: 477936 - DNA, 20 bp, Artificial
  CRISPR gRNA sequence
aagtaacaatagtcactttt

SEQ ID NO: 477937 - DNA, 20 bp, Artificial
  CRISPR gRNA sequence
ttacaaaagaagctctgatt

SEQ ID NO: 477938 - DNA, 20 bp, Artificial
  CRISPR gRNA sequence
tacaaaagaagctctgattt

SEQ ID NO: 477939 - DNA, 20 bp, Artificial
  CRISPR gRNA sequence
acaaaagaagctctgatttt

SEQ ID NO: 477940 - DNA, 20 bp, Artificial
  CRISPR gRNA sequence
caaaagaagctctgatttta

SEQ ID NO: 477941 - DNA, 20 bp, Artificial
  CRISPR gRNA sequence
tgattttaacatatgtttgt

SEQ ID NO: 477942 - DNA, 20 bp, Artificial
  CRISPR gRNA sequence
attttaacatatgtttgtgt

SEQ ID NO: 477943 - DNA, 20 bp, Artificial
  CRISPR gRNA sequence
taacatatgtttgtgtgtgt

SEQ ID NO: 477944 - DNA, 20 bp, Artificial
  CRISPR gRNA sequence
aacatatgtttgtgtgtgtc

SEQ ID NO: 477945 - DNA, 20 bp, Artificial
  CRISPR gRNA sequence
acatatgtttgtgtgtgtca

SEQ ID NO: 477946 - DNA, 20 bp, Artificial
  CRISPR gRNA sequence
gtgtgtgtcatacttactta

SEQ ID NO: 477947 - DNA, 20 bp, Artificial
  CRISPR gRNA sequence
tgtgtgtcatacttacttaa

SEQ ID NO: 477948 - DNA, 20 bp, Artificial
  CRISPR gRNA sequence
acttaattttctccaggtat

SEQ ID NO: 477949 - DNA, 20 bp, Artificial
  CRISPR gRNA sequence
cttaattttctccaggtatt

SEQ ID NO: 477950 - DNA, 20 bp, Artificial
  CRISPR gRNA sequence
aattttctccaggtattcct

SEQ ID NO: 477951 - DNA, 20 bp, Artificial
  CRISPR gRNA sequence
attttctccaggtattccta

SEQ ID NO: 477952 - DNA, 20 bp, Artificial
  CRISPR gRNA sequence
tctccaggtattcctagtac

SEQ ID NO: 477953 - DNA, 20 bp, Artificial
  CRISPR gRNA sequence
ctccaggtattcctagtact

SEQ ID NO: 477954 - DNA, 20 bp, Artificial
  CRISPR gRNA sequence
tccaggtattcctagtactt

SEQ ID NO: 477955 - DNA, 20 bp, Artificial
  CRISPR gRNA sequence
caggtattcctagtacttct

SEQ ID NO: 477956 - DNA, 20 bp, Artificial
  CRISPR gRNA sequence
ctagtacttctgagaatatc

SEQ ID NO: 477957 - DNA, 20 bp, Artificial
  CRISPR gRNA sequence
gtacttctgagaatatctga

SEQ ID NO: 477958 - DNA, 20 bp, Artificial
  CRISPR gRNA sequence
ctgagaatatctgacttatg

SEQ ID NO: 477959 - DNA, 20 bp, Artificial
  CRISPR gRNA sequence
tgagaatatctgacttatgg

SEQ ID NO: 477960 - DNA, 20 bp, Artificial
  CRISPR gRNA sequence
agaatatctgacttatggag

SEQ ID NO: 477961 - DNA, 20 bp, Artificial
  CRISPR gRNA sequence
acttatggagtggtttattt

SEQ ID NO: 477962 - DNA, 20 bp, Artificial
  CRISPR gRNA sequence
atggagtggtttatttacca

SEQ ID NO: 477963 - DNA, 20 bp, Artificial
  CRISPR gRNA sequence
tggagtggtttatttaccac

SEQ ID NO: 477964 - DNA, 20 bp, Artificial
  CRISPR gRNA sequence
atttaccacagagttaaagt

SEQ ID NO: 477965 - DNA, 20 bp, Artificial
  CRISPR gRNA sequence
tttaccacagagttaaagta

SEQ ID NO: 477966 - DNA, 20 bp, Artificial
  CRISPR gRNA sequence
accacagagttaaagtaata

SEQ ID NO: 477967 - DNA, 20 bp, Artificial
  CRISPR gRNA sequence
ccacagagttaaagtaatac

SEQ ID NO: 477968 - DNA, 20 bp, Artificial
  CRISPR gRNA sequence
aagtaatacctttaatagac

SEQ ID NO: 477969 - DNA, 20 bp, Artificial
  CRISPR gRNA sequence
taatagacattacataatac

SEQ ID NO: 477970 - DNA, 20 bp, Artificial
  CRISPR gRNA sequence
aatagacattacataataca

SEQ ID NO: 477971 - DNA, 20 bp, Artificial
  CRISPR gRNA sequence
atagacattacataatacat

SEQ ID NO: 477972 - DNA, 20 bp, Artificial
  CRISPR gRNA sequence
cataatacattaaatgaata

SEQ ID NO: 477973 - DNA, 20 bp, Artificial
  CRISPR gRNA sequence
aatgaatactttctatatga

SEQ ID NO: 477974 - DNA, 20 bp, Artificial
  CRISPR gRNA sequence
tctatatgaggtggaactcc

SEQ ID NO: 477975 - DNA, 20 bp, Artificial
  CRISPR gRNA sequence
ctatatgaggtggaactccc

SEQ ID NO: 477976 - DNA, 20 bp, Artificial
  CRISPR gRNA sequence
tatatgaggtggaactcccc

SEQ ID NO: 477977 - DNA, 20 bp, Artificial
  CRISPR gRNA sequence
tatgaggtggaactccccca

SEQ ID NO: 477978 - DNA, 20 bp, Artificial
  CRISPR gRNA sequence
ccccaccctaacctcatgtc

SEQ ID NO: 477979 - DNA, 20 bp, Artificial
  CRISPR gRNA sequence
acctcatgtcaccacatttc

SEQ ID NO: 477980 - DNA, 20 bp, Artificial
  CRISPR gRNA sequence
atgtcaccacatttctgatt

SEQ ID NO: 477981 - DNA, 20 bp, Artificial
  CRISPR gRNA sequence
ctgattttgtgagtgtatgt

SEQ ID NO: 477982 - DNA, 20 bp, Artificial
  CRISPR gRNA sequence
tgattttgtgagtgtatgtg

SEQ ID NO: 477983 - DNA, 20 bp, Artificial
  CRISPR gRNA sequence
attttgtgagtgtatgtgag

SEQ ID NO: 477984 - DNA, 20 bp, Artificial
  CRISPR gRNA sequence
tgtgagtgtatgtgagctag

SEQ ID NO: 477985 - DNA, 20 bp, Artificial
  CRISPR gRNA sequence
gtgagtgtatgtgagctagt

SEQ ID NO: 477986 - DNA, 20 bp, Artificial
  CRISPR gRNA sequence
tgagtgtatgtgagctagtt

SEQ ID NO: 477987 - DNA, 20 bp, Artificial
  CRISPR gRNA sequence
gtttatgatgggaaagtatg

SEQ ID NO: 477988 - DNA, 20 bp, Artificial
  CRISPR gRNA sequence
atgatgggaaagtatgctac

SEQ ID NO: 477989 - DNA, 20 bp, Artificial
  CRISPR gRNA sequence
tgatgggaaagtatgctacc

SEQ ID NO: 477990 - DNA, 20 bp, Artificial
  CRISPR gRNA sequence
cctgggttttctgatgtcgt

SEQ ID NO: 477991 - DNA, 20 bp, Artificial
  CRISPR gRNA sequence
ggttttctgatgtcgtccgt

SEQ ID NO: 477992 - DNA, 20 bp, Artificial
  CRISPR gRNA sequence
tctgatgtcgtccgtgtgat

SEQ ID NO: 477993 - DNA, 20 bp, Artificial
  CRISPR gRNA sequence
ctgatgtcgtccgtgtgatt

SEQ ID NO: 477994 - DNA, 20 bp, Artificial
  CRISPR gRNA sequence
tgatgtcgtccgtgtgattt

SEQ ID NO: 477995 - DNA, 20 bp, Artificial
  CRISPR gRNA sequence
atgtcgtccgtgtgatttcc

SEQ ID NO: 477996 - DNA, 20 bp, Artificial
  CRISPR gRNA sequence
cccaaggtatgcaagtcaat

SEQ ID NO: 477997 - DNA, 20 bp, Artificial
  CRISPR gRNA sequence
ccaaggtatgcaagtcaatg

SEQ ID NO: 477998 - DNA, 20 bp, Artificial
  CRISPR gRNA sequence
ccaagatccttgaagtatgg

SEQ ID NO: 477999 - DNA, 20 bp, Artificial
  CRISPR gRNA sequence
gaagtatggttccatggctg

SEQ ID NO: 478000 - DNA, 20 bp, Artificial
  CRISPR gRNA sequence
aagtatggttccatggctgc

SEQ ID NO: 478001 - DNA, 20 bp, Artificial
  CRISPR gRNA sequence
catggctgctattgctgtgt

SEQ ID NO: 478002 - DNA, 20 bp, Artificial
  CRISPR gRNA sequence
ctattgctgtgtgtggattt

SEQ ID NO: 478003 - DNA, 20 bp, Artificial
  CRISPR gRNA sequence
ttgctgtgtgtggatttgcc

SEQ ID NO: 478004 - DNA, 20 bp, Artificial
  CRISPR gRNA sequence
ctgtgtgtggatttgccctg

SEQ ID NO: 478005 - DNA, 20 bp, Artificial
  CRISPR gRNA sequence
tgtgtggatttgccctgact

SEQ ID NO: 478006 - DNA, 20 bp, Artificial
  CRISPR gRNA sequence
gccctgactatgtacaaacc

SEQ ID NO: 478007 - DNA, 20 bp, Artificial
  CRISPR gRNA sequence
ccctgactatgtacaaacca

SEQ ID NO: 478008 - DNA, 20 bp, Artificial
  CRISPR gRNA sequence
actatgtacaaaccactgcc

SEQ ID NO: 478009 - DNA, 20 bp, Artificial
  CRISPR gRNA sequence
tgtacaaaccactgccttat

SEQ ID NO: 478010 - DNA, 20 bp, Artificial
  CRISPR gRNA sequence
ccttatgggatccctaaact

SEQ ID NO: 478011 - DNA, 20 bp, Artificial
  CRISPR gRNA sequence
atgggatccctaaactctaa

SEQ ID NO: 478012 - DNA, 20 bp, Artificial
  CRISPR gRNA sequence
tgggatccctaaactctaat

SEQ ID NO: 478013 - DNA, 20 bp, Artificial
  CRISPR gRNA sequence
aactctaatttcaagggaag

SEQ ID NO: 478014 - DNA, 20 bp, Artificial
  CRISPR gRNA sequence
taatttcaagggaagatttg

SEQ ID NO: 478015 - DNA, 20 bp, Artificial
  CRISPR gRNA sequence
atttcaagggaagatttgag

SEQ ID NO: 478016 - DNA, 20 bp, Artificial
  CRISPR gRNA sequence
caagggaagatttgagagac

SEQ ID NO: 478017 - DNA, 20 bp, Artificial
  CRISPR gRNA sequence
aagggaagatttgagagaca

SEQ ID NO: 478018 - DNA, 20 bp, Artificial
  CRISPR gRNA sequence
gagagacagattatttccct

SEQ ID NO: 478019 - DNA, 20 bp, Artificial
  CRISPR gRNA sequence
agagacagattatttccctt

SEQ ID NO: 478020 - DNA, 20 bp, Artificial
  CRISPR gRNA sequence
tttcccttccctggtggcca

SEQ ID NO: 478021 - DNA, 20 bp, Artificial
  CRISPR gRNA sequence
cccttccctggtggccatca

SEQ ID NO: 478022 - DNA, 20 bp, Artificial
  CRISPR gRNA sequence
ccttccctggtggccatcat

SEQ ID NO: 478023 - DNA, 20 bp, Artificial
  CRISPR gRNA sequence
ccctggtggccatcatctct

SEQ ID NO: 478024 - DNA, 20 bp, Artificial
  CRISPR gRNA sequence
cctggtggccatcatctctc

SEQ ID NO: 478025 - DNA, 20 bp, Artificial
  CRISPR gRNA sequence
gtggccatcatctctcccct

SEQ ID NO: 478026 - DNA, 20 bp, Artificial
  CRISPR gRNA sequence
tcccctcctctctaccattc

SEQ ID NO: 478027 - DNA, 20 bp, Artificial
  CRISPR gRNA sequence
ccctcctctctaccattcca

SEQ ID NO: 478028 - DNA, 20 bp, Artificial
  CRISPR gRNA sequence
ctctctaccattccagcctt

SEQ ID NO: 478029 - DNA, 20 bp, Artificial
  CRISPR gRNA sequence
tctaccattccagccttcta

SEQ ID NO: 478030 - DNA, 20 bp, Artificial
  CRISPR gRNA sequence
taccattccagccttctaaa

SEQ ID NO: 478031 - DNA, 20 bp, Artificial
  CRISPR gRNA sequence
ccattccagccttctaaagt

SEQ ID NO: 478032 - DNA, 20 bp, Artificial
  CRISPR gRNA sequence
cagccttctaaagtaaggca

SEQ ID NO: 478033 - DNA, 20 bp, Artificial
  CRISPR gRNA sequence
ctaaagtaaggcagaacata

SEQ ID NO: 478034 - DNA, 20 bp, Artificial
  CRISPR gRNA sequence
taaagtaaggcagaacatac

SEQ ID NO: 478035 - DNA, 20 bp, Artificial
  CRISPR gRNA sequence
aagtaaggcagaacatacca

SEQ ID NO: 478036 - DNA, 20 bp, Artificial
  CRISPR gRNA sequence
gatgcctttttgctcctgag

SEQ ID NO: 478037 - DNA, 20 bp, Artificial
  CRISPR gRNA sequence
tttgctcctgagtgtaaaga

SEQ ID NO: 478038 - DNA, 20 bp, Artificial
  CRISPR gRNA sequence
ttgctcctgagtgtaaagac

SEQ ID NO: 478039 - DNA, 20 bp, Artificial
  CRISPR gRNA sequence
tgctcctgagtgtaaagact

SEQ ID NO: 478040 - DNA, 20 bp, Artificial
  CRISPR gRNA sequence
gctcctgagtgtaaagactt

SEQ ID NO: 478041 - DNA, 20 bp, Artificial
  CRISPR gRNA sequence
ctcctgagtgtaaagacttc

SEQ ID NO: 478042 - DNA, 20 bp, Artificial
  CRISPR gRNA sequence
ctgagtgtaaagacttcatt

SEQ ID NO: 478043 - DNA, 20 bp, Artificial
  CRISPR gRNA sequence
agtgtaaagacttcattcct

SEQ ID NO: 478044 - DNA, 20 bp, Artificial
  CRISPR gRNA sequence
cattccttctgtagcctccc

SEQ ID NO: 478045 - DNA, 20 bp, Artificial
  CRISPR gRNA sequence
attccttctgtagcctcccc

SEQ ID NO: 478046 - DNA, 20 bp, Artificial
  CRISPR gRNA sequence
cttctgtagcctccccagca

SEQ ID NO: 478047 - DNA, 20 bp, Artificial
  CRISPR gRNA sequence
ctgtagcctccccagcatgc

SEQ ID NO: 478048 - DNA, 20 bp, Artificial
  CRISPR gRNA sequence
tgtagcctccccagcatgcg

SEQ ID NO: 478049 - DNA, 20 bp, Artificial
  CRISPR gRNA sequence
tagcctccccagcatgcgtc

SEQ ID NO: 478050 - DNA, 20 bp, Artificial
  CRISPR gRNA sequence
cccagcatgcgtctgaagtt

SEQ ID NO: 478051 - DNA, 20 bp, Artificial
  CRISPR gRNA sequence
aagttttggtttgcttgttg

SEQ ID NO: 478052 - DNA, 20 bp, Artificial
  CRISPR gRNA sequence
tggtttgcttgttgtttgtc

SEQ ID NO: 478053 - DNA, 20 bp, Artificial
  CRISPR gRNA sequence
ggtttgcttgttgtttgtct

SEQ ID NO: 478054 - DNA, 20 bp, Artificial
  CRISPR gRNA sequence
gtttgcttgttgtttgtctg

SEQ ID NO: 478055 - DNA, 20 bp, Artificial
  CRISPR gRNA sequence
gcttgttgtttgtctgtgat

SEQ ID NO: 478056 - DNA, 20 bp, Artificial
  CRISPR gRNA sequence
cttgttgtttgtctgtgata

SEQ ID NO: 478057 - DNA, 20 bp, Artificial
  CRISPR gRNA sequence
gttgtttgtctgtgatagta

SEQ ID NO: 478058 - DNA, 20 bp, Artificial
  CRISPR gRNA sequence
ttgtttgtctgtgatagtat

SEQ ID NO: 478059 - DNA, 20 bp, Artificial
  CRISPR gRNA sequence
tttgtctgtgatagtatttt

SEQ ID NO: 478060 - DNA, 20 bp, Artificial
  CRISPR gRNA sequence
gtctgtgatagtattttctg

SEQ ID NO: 478061 - DNA, 20 bp, Artificial
  CRISPR gRNA sequence
tctgtgatagtattttctga

SEQ ID NO: 478062 - DNA, 20 bp, Artificial
  CRISPR gRNA sequence
tgatagtattttctgataga

SEQ ID NO: 478063 - DNA, 20 bp, Artificial
  CRISPR gRNA sequence
tctgatagaagctaaaatcc

SEQ ID NO: 478064 - DNA, 20 bp, Artificial
  CRISPR gRNA sequence
ctgatagaagctaaaatcct

SEQ ID NO: 478065 - DNA, 20 bp, Artificial
  CRISPR gRNA sequence
tgatagaagctaaaatcctg

SEQ ID NO: 478066 - DNA, 20 bp, Artificial
  CRISPR gRNA sequence
atagaagctaaaatcctggt

SEQ ID NO: 478067 - DNA, 20 bp, Artificial
  CRISPR gRNA sequence
aaatcctggttgatgtcaca

SEQ ID NO: 478068 - DNA, 20 bp, Artificial
  CRISPR gRNA sequence
gttgatgtcacagaaaatta

SEQ ID NO: 478069 - DNA, 20 bp, Artificial
  CRISPR gRNA sequence
atgtcacagaaaattattgg

SEQ ID NO: 478070 - DNA, 20 bp, Artificial
  CRISPR gRNA sequence
ttggtttattataccgttag

SEQ ID NO: 478071 - DNA, 20 bp, Artificial
  CRISPR gRNA sequence
gtttattataccgttagtaa

SEQ ID NO: 478072 - DNA, 20 bp, Artificial
  CRISPR gRNA sequence
attataccgttagtaatcat

SEQ ID NO: 478073 - DNA, 20 bp, Artificial
  CRISPR gRNA sequence
ttataccgttagtaatcatt

SEQ ID NO: 478074 - DNA, 20 bp, Artificial
  CRISPR gRNA sequence
taccgttagtaatcatttta

SEQ ID NO: 478075 - DNA, 20 bp, Artificial
  CRISPR gRNA sequence
gtaatcattttagtttctca

SEQ ID NO: 478076 - DNA, 20 bp, Artificial
  CRISPR gRNA sequence
tagtttctcaaaaaatcatt

SEQ ID NO: 478077 - DNA, 20 bp, Artificial
  CRISPR gRNA sequence
agtttctcaaaaaatcattt

SEQ ID NO: 478078 - DNA, 20 bp, Artificial
  CRISPR gRNA sequence
gtttctcaaaaaatcatttg

SEQ ID NO: 478079 - DNA, 20 bp, Artificial
  CRISPR gRNA sequence
ctcaaaaaatcatttgttta

SEQ ID NO: 478080 - DNA, 20 bp, Artificial
  CRISPR gRNA sequence
tcaaaaaatcatttgtttaa

SEQ ID NO: 478081 - DNA, 20 bp, Artificial
  CRISPR gRNA sequence
aaaaaatcatttgtttaatt

SEQ ID NO: 478082 - DNA, 20 bp, Artificial
  CRISPR gRNA sequence
gtttaatttctatgttaaac

SEQ ID NO: 478083 - DNA, 20 bp, Artificial
  CRISPR gRNA sequence
tttaatttctatgttaaact

SEQ ID NO: 478084 - DNA, 20 bp, Artificial
  CRISPR gRNA sequence
aatttctatgttaaactctg

SEQ ID NO: 478085 - DNA, 20 bp, Artificial
  CRISPR gRNA sequence
atttctatgttaaactctga

SEQ ID NO: 478086 - DNA, 20 bp, Artificial
  CRISPR gRNA sequence
ctatgttaaactctgacact

SEQ ID NO: 478087 - DNA, 20 bp, Artificial
  CRISPR gRNA sequence
tatgttaaactctgacactt

SEQ ID NO: 478088 - DNA, 20 bp, Artificial
  CRISPR gRNA sequence
tgttaaactctgacactttc

SEQ ID NO: 478089 - DNA, 20 bp, Artificial
  CRISPR gRNA sequence
aactctgacactttcttagc

SEQ ID NO: 478090 - DNA, 20 bp, Artificial
  CRISPR gRNA sequence
tgacactttcttagctcaag

SEQ ID NO: 478091 - DNA, 20 bp, Artificial
  CRISPR gRNA sequence
acactttcttagctcaagtt

SEQ ID NO: 478092 - DNA, 20 bp, Artificial
  CRISPR gRNA sequence
tcttagctcaagttaaggca

SEQ ID NO: 478093 - DNA, 20 bp, Artificial
  CRISPR gRNA sequence
cttagctcaagttaaggcaa

SEQ ID NO: 478094 - DNA, 20 bp, Artificial
  CRISPR gRNA sequence
ttagctcaagttaaggcaat

SEQ ID NO: 478095 - DNA, 20 bp, Artificial
  CRISPR gRNA sequence
agctcaagttaaggcaatct

SEQ ID NO: 478096 - DNA, 20 bp, Artificial
  CRISPR gRNA sequence
gctcaagttaaggcaatctg

SEQ ID NO: 478097 - DNA, 20 bp, Artificial
  CRISPR gRNA sequence
aagttaaggcaatctgcatt

SEQ ID NO: 478098 - DNA, 20 bp, Artificial
  CRISPR gRNA sequence
aggcaatctgcattcattac

SEQ ID NO: 478099 - DNA, 20 bp, Artificial
  CRISPR gRNA sequence
cattcattacagtcattcat

SEQ ID NO: 478100 - DNA, 20 bp, Artificial
  CRISPR gRNA sequence
attacagtcattcatttatt

SEQ ID NO: 478101 - DNA, 20 bp, Artificial
  CRISPR gRNA sequence
cagtcattcatttatttgaa

SEQ ID NO: 478102 - DNA, 20 bp, Artificial
  CRISPR gRNA sequence
atttatttgaatggttgcaa

SEQ ID NO: 478103 - DNA, 20 bp, Artificial
  CRISPR gRNA sequence
atttgaatggttgcaaccac

SEQ ID NO: 478104 - DNA, 20 bp, Artificial
  CRISPR gRNA sequence
tttgaatggttgcaaccact

SEQ ID NO: 478105 - DNA, 20 bp, Artificial
  CRISPR gRNA sequence
gaatggttgcaaccactttg

SEQ ID NO: 478106 - DNA, 20 bp, Artificial
  CRISPR gRNA sequence
aatggttgcaaccactttga

SEQ ID NO: 478107 - DNA, 20 bp, Artificial
  CRISPR gRNA sequence
caaccactttgaagtttcca

SEQ ID NO: 478108 - DNA, 20 bp, Artificial
  CRISPR gRNA sequence
tgaagtttccataaatttgt

SEQ ID NO: 478109 - DNA, 20 bp, Artificial
  CRISPR gRNA sequence
gaagtttccataaatttgta

SEQ ID NO: 478110 - DNA, 20 bp, Artificial
  CRISPR gRNA sequence
aagtttccataaatttgtaa

SEQ ID NO: 478111 - DNA, 20 bp, Artificial
  CRISPR gRNA sequence
ccataaatttgtaagaattt

SEQ ID NO: 478112 - DNA, 20 bp, Artificial
  CRISPR gRNA sequence
cataaatttgtaagaatttt

SEQ ID NO: 478113 - DNA, 20 bp, Artificial
  CRISPR gRNA sequence
gtaagaatttttcaatggag

SEQ ID NO: 478114 - DNA, 20 bp, Artificial
  CRISPR gRNA sequence
taagaatttttcaatggaga

SEQ ID NO: 478115 - DNA, 20 bp, Artificial
  CRISPR gRNA sequence
ttcaatggagacatagtgaa

SEQ ID NO: 478116 - DNA, 20 bp, Artificial
  CRISPR gRNA sequence
tcaatggagacatagtgaaa

SEQ ID NO: 478117 - DNA, 20 bp, Artificial
  CRISPR gRNA sequence
caatggagacatagtgaaac

SEQ ID NO: 478118 - DNA, 20 bp, Artificial
  CRISPR gRNA sequence
aatggagacatagtgaaact

SEQ ID NO: 478119 - DNA, 20 bp, Artificial
  CRISPR gRNA sequence
aggtgagattttcctcatga

SEQ ID NO: 478120 - DNA, 20 bp, Artificial
  CRISPR gRNA sequence
tcctcatgataatggttata

SEQ ID NO: 478121 - DNA, 20 bp, Artificial
  CRISPR gRNA sequence
cctcatgataatggttataa

SEQ ID NO: 478122 - DNA, 20 bp, Artificial
  CRISPR gRNA sequence
ctcatgataatggttataat

SEQ ID NO: 478123 - DNA, 20 bp, Artificial
  CRISPR gRNA sequence
atgataatggttataatcaa

SEQ ID NO: 478124 - DNA, 20 bp, Artificial
  CRISPR gRNA sequence
taatcaaaacatatggtatt

SEQ ID NO: 478125 - DNA, 20 bp, Artificial
  CRISPR gRNA sequence
aaaaataagaaataatgata

SEQ ID NO: 478126 - DNA, 20 bp, Artificial
  CRISPR gRNA sequence
aaaataagaaataatgatat

SEQ ID NO: 478127 - DNA, 20 bp, Artificial
  CRISPR gRNA sequence
tataaaatattcataatcat

SEQ ID NO: 478128 - DNA, 20 bp, Artificial
  CRISPR gRNA sequence
ataaaatattcataatcata

SEQ ID NO: 478129 - DNA, 20 bp, Artificial
  CRISPR gRNA sequence
taaaatattcataatcataa

SEQ ID NO: 478130 - DNA, 20 bp, Artificial
  CRISPR gRNA sequence
ataatcataaccctcttttt

SEQ ID NO: 478131 - DNA, 20 bp, Artificial
  CRISPR gRNA sequence
tttttttttaaatggctgat

SEQ ID NO: 478132 - DNA, 20 bp, Artificial
  CRISPR gRNA sequence
tttttttaaatggctgattg

SEQ ID NO: 478133 - DNA, 20 bp, Artificial
  CRISPR gRNA sequence
ttttttaaatggctgattgg

SEQ ID NO: 478134 - DNA, 20 bp, Artificial
  CRISPR gRNA sequence
tttttaaatggctgattggt

SEQ ID NO: 478135 - DNA, 20 bp, Artificial
  CRISPR gRNA sequence
ttttaaatggctgattggtt

SEQ ID NO: 478136 - DNA, 20 bp, Artificial
  CRISPR gRNA sequence
tttaaatggctgattggttt

SEQ ID NO: 478137 - DNA, 20 bp, Artificial
  CRISPR gRNA sequence
ttaaatggctgattggtttc

SEQ ID NO: 478138 - DNA, 20 bp, Artificial
  CRISPR gRNA sequence
taaatggctgattggtttca

SEQ ID NO: 478139 - DNA, 20 bp, Artificial
  CRISPR gRNA sequence
aaatggctgattggtttcaa

SEQ ID NO: 478140 - DNA, 20 bp, Artificial
  CRISPR gRNA sequence
aatggctgattggtttcaaa

SEQ ID NO: 478141 - DNA, 20 bp, Artificial
  CRISPR gRNA sequence
attggtttcaaaaattacct

SEQ ID NO: 478142 - DNA, 20 bp, Artificial
  CRISPR gRNA sequence
gtttcaaaaattacctactc

SEQ ID NO: 478143 - DNA, 20 bp, Artificial
  CRISPR gRNA sequence
caaaaattacctactctctt

SEQ ID NO: 478144 - DNA, 20 bp, Artificial
  CRISPR gRNA sequence
aaaaattacctactctcttc

SEQ ID NO: 478145 - DNA, 20 bp, Artificial
  CRISPR gRNA sequence
cctactctcttcagctcagc

SEQ ID NO: 478146 - DNA, 20 bp, Artificial
  CRISPR gRNA sequence
ctctcttcagctcagcaact

SEQ ID NO: 478147 - DNA, 20 bp, Artificial
  CRISPR gRNA sequence
tcttcagctcagcaactaca

SEQ ID NO: 478148 - DNA, 20 bp, Artificial
  CRISPR gRNA sequence
ttcagctcagcaactacact

SEQ ID NO: 478149 - DNA, 20 bp, Artificial
  CRISPR gRNA sequence
cagctcagcaactacacttg

SEQ ID NO: 478150 - DNA, 20 bp, Artificial
  CRISPR gRNA sequence
agctcagcaactacacttgc

SEQ ID NO: 478151 - DNA, 20 bp, Artificial
  CRISPR gRNA sequence
agcaactacacttgctcagc

SEQ ID NO: 478152 - DNA, 20 bp, Artificial
  CRISPR gRNA sequence
cacttgctcagctgggagtt

SEQ ID NO: 478153 - DNA, 20 bp, Artificial
  CRISPR gRNA sequence
gctcagctgggagttacgag

SEQ ID NO: 478154 - DNA, 20 bp, Artificial
  CRISPR gRNA sequence
ctcagctgggagttacgaga

SEQ ID NO: 478155 - DNA, 20 bp, Artificial
  CRISPR gRNA sequence
agctgggagttacgagacta

SEQ ID NO: 478156 - DNA, 20 bp, Artificial
  CRISPR gRNA sequence
ggagttacgagactatacag

SEQ ID NO: 478157 - DNA, 20 bp, Artificial
  CRISPR gRNA sequence
cgagactatacagttgtttg

SEQ ID NO: 478158 - DNA, 20 bp, Artificial
  CRISPR gRNA sequence
tacagttgtttgtggctggc

SEQ ID NO: 478159 - DNA, 20 bp, Artificial
  CRISPR gRNA sequence
tttgtggctggcactccttt

SEQ ID NO: 478160 - DNA, 20 bp, Artificial
  CRISPR gRNA sequence
gtggctggcactcctttctg

SEQ ID NO: 478161 - DNA, 20 bp, Artificial
  CRISPR gRNA sequence
tggctggcactcctttctga

SEQ ID NO: 478162 - DNA, 20 bp, Artificial
  CRISPR gRNA sequence
gcactcctttctgatcagct

SEQ ID NO: 478163 - DNA, 20 bp, Artificial
  CRISPR gRNA sequence
ctttctgatcagctgatctg

SEQ ID NO: 478164 - DNA, 20 bp, Artificial
  CRISPR gRNA sequence
tctgatcagctgatctgtgt

SEQ ID NO: 478165 - DNA, 20 bp, Artificial
  CRISPR gRNA sequence
ctgatcagctgatctgtgta

SEQ ID NO: 478166 - DNA, 20 bp, Artificial
  CRISPR gRNA sequence
tgatcagctgatctgtgtag

SEQ ID NO: 478167 - DNA, 20 bp, Artificial
  CRISPR gRNA sequence
atcagctgatctgtgtagct

SEQ ID NO: 478168 - DNA, 20 bp, Artificial
  CRISPR gRNA sequence
atctgtgtagctggatggcc

SEQ ID NO: 478169 - DNA, 20 bp, Artificial
  CRISPR gRNA sequence
tgtagctggatggccatgga

SEQ ID NO: 478170 - DNA, 20 bp, Artificial
  CRISPR gRNA sequence
gatggccatggagtgtcact

SEQ ID NO: 478171 - DNA, 20 bp, Artificial
  CRISPR gRNA sequence
gttaaatatttttaatatcc

SEQ ID NO: 478172 - DNA, 20 bp, Artificial
  CRISPR gRNA sequence
ttaaatatttttaatatcca

SEQ ID NO: 478173 - DNA, 20 bp, Artificial
  CRISPR gRNA sequence
aatatttttaatatccaccc

SEQ ID NO: 478174 - DNA, 20 bp, Artificial
  CRISPR gRNA sequence
ttaatatccacccctgagtg

SEQ ID NO: 478175 - DNA, 20 bp, Artificial
  CRISPR gRNA sequence
taatatccacccctgagtgg

SEQ ID NO: 478176 - DNA, 20 bp, Artificial
  CRISPR gRNA sequence
aatatccacccctgagtgga

SEQ ID NO: 478177 - DNA, 20 bp, Artificial
  CRISPR gRNA sequence
atatccacccctgagtggac

SEQ ID NO: 478178 - DNA, 20 bp, Artificial
  CRISPR gRNA sequence
agtggacataaatcaggcct

SEQ ID NO: 478179 - DNA, 20 bp, Artificial
  CRISPR gRNA sequence
ttcaaactgaatacttgtaa

SEQ ID NO: 478180 - DNA, 20 bp, Artificial
  CRISPR gRNA sequence
tcaaactgaatacttgtaaa

SEQ ID NO: 478181 - DNA, 20 bp, Artificial
  CRISPR gRNA sequence
caaactgaatacttgtaaag

SEQ ID NO: 478182 - DNA, 20 bp, Artificial
  CRISPR gRNA sequence
aaactgaatacttgtaaagt

SEQ ID NO: 478183 - DNA, 20 bp, Artificial
  CRISPR gRNA sequence
aatacttgtaaagtctagct

SEQ ID NO: 478184 - DNA, 20 bp, Artificial
  CRISPR gRNA sequence
gtaaagtctagcttttcttt

SEQ ID NO: 478185 - DNA, 20 bp, Artificial
  CRISPR gRNA sequence
taaagtctagcttttctttg

SEQ ID NO: 478186 - DNA, 20 bp, Artificial
  CRISPR gRNA sequence
gcttttctttggtagttata

SEQ ID NO: 478187 - DNA, 20 bp, Artificial
  CRISPR gRNA sequence
ttctttggtagttataactt

SEQ ID NO: 478188 - DNA, 20 bp, Artificial
  CRISPR gRNA sequence
tctttggtagttataactta

SEQ ID NO: 478189 - DNA, 20 bp, Artificial
  CRISPR gRNA sequence
ctttggtagttataacttaa

SEQ ID NO: 478190 - DNA, 20 bp, Artificial
  CRISPR gRNA sequence
tttggtagttataacttaac

SEQ ID NO: 478191 - DNA, 20 bp, Artificial
  CRISPR gRNA sequence
tggtagttataacttaacca

SEQ ID NO: 478192 - DNA, 20 bp, Artificial
  CRISPR gRNA sequence
ggtagttataacttaaccac

SEQ ID NO: 478193 - DNA, 20 bp, Artificial
  CRISPR gRNA sequence
gtagttataacttaaccact

SEQ ID NO: 478194 - DNA, 20 bp, Artificial
  CRISPR gRNA sequence
taacttaaccactgtaaggt

SEQ ID NO: 478195 - DNA, 20 bp, Artificial
  CRISPR gRNA sequence
aaccactgtaaggtatgttg

SEQ ID NO: 478196 - DNA, 20 bp, Artificial
  CRISPR gRNA sequence
accactgtaaggtatgttga

SEQ ID NO: 478197 - DNA, 20 bp, Artificial
  CRISPR gRNA sequence
taaggtatgttgagctgcat

SEQ ID NO: 478198 - DNA, 20 bp, Artificial
  CRISPR gRNA sequence
agctgcatatgttcttcacc

SEQ ID NO: 478199 - DNA, 20 bp, Artificial
  CRISPR gRNA sequence
catatgttcttcacctcagt

SEQ ID NO: 478200 - DNA, 20 bp, Artificial
  CRISPR gRNA sequence
ttcacctcagtgccttttag

SEQ ID NO: 478201 - DNA, 20 bp, Artificial
  CRISPR gRNA sequence
cacctcagtgccttttagcc

SEQ ID NO: 478202 - DNA, 20 bp, Artificial
  CRISPR gRNA sequence
acctcagtgccttttagccc

SEQ ID NO: 478203 - DNA, 20 bp, Artificial
  CRISPR gRNA sequence
agtgccttttagcccacctc

SEQ ID NO: 478204 - DNA, 20 bp, Artificial
  CRISPR gRNA sequence
ttagcccacctctctaaggg

SEQ ID NO: 478205 - DNA, 20 bp, Artificial
  CRISPR gRNA sequence
tagcccacctctctaagggc

SEQ ID NO: 478206 - DNA, 20 bp, Artificial
  CRISPR gRNA sequence
agcccacctctctaagggct

SEQ ID NO: 478207 - DNA, 20 bp, Artificial
  CRISPR gRNA sequence
gcccacctctctaagggctt

SEQ ID NO: 478208 - DNA, 20 bp, Artificial
  CRISPR gRNA sequence
tctaagggcttagctgtctc

SEQ ID NO: 478209 - DNA, 20 bp, Artificial
  CRISPR gRNA sequence
taagggcttagctgtctctg

SEQ ID NO: 478210 - DNA, 20 bp, Artificial
  CRISPR gRNA sequence
agggcttagctgtctctgct

SEQ ID NO: 478211 - DNA, 20 bp, Artificial
  CRISPR gRNA sequence
agctgtctctgctgtgcaac

SEQ ID NO: 478212 - DNA, 20 bp, Artificial
  CRISPR gRNA sequence
gctgtctctgctgtgcaacc

SEQ ID NO: 478213 - DNA, 20 bp, Artificial
  CRISPR gRNA sequence
tctctgctgtgcaaccagta

SEQ ID NO: 478214 - DNA, 20 bp, Artificial
  CRISPR gRNA sequence
tgctgtgcaaccagtactac

SEQ ID NO: 478215 - DNA, 20 bp, Artificial
  CRISPR gRNA sequence
ctgtgcaaccagtactacat

SEQ ID NO: 478216 - DNA, 20 bp, Artificial
  CRISPR gRNA sequence
tgcaaccagtactacataga

SEQ ID NO: 478217 - DNA, 20 bp, Artificial
  CRISPR gRNA sequence
catagaaaggtaacacacca

SEQ ID NO: 478218 - DNA, 20 bp, Artificial
  CRISPR gRNA sequence
gatagaagacagaaacatga

SEQ ID NO: 478219 - DNA, 20 bp, Artificial
  CRISPR gRNA sequence
taaagagtgatgcatgtcgg

SEQ ID NO: 478220 - DNA, 20 bp, Artificial
  CRISPR gRNA sequence
ggtgcggtggctcatgcctg

SEQ ID NO: 478221 - DNA, 20 bp, Artificial
  CRISPR gRNA sequence
atgcctgtaatactagcact

SEQ ID NO: 478222 - DNA, 20 bp, Artificial
  CRISPR gRNA sequence
taatactagcactttgggag

SEQ ID NO: 478223 - DNA, 20 bp, Artificial
  CRISPR gRNA sequence
gcactttgggaggccaaggc

SEQ ID NO: 478224 - DNA, 20 bp, Artificial
  CRISPR gRNA sequence
tgggaggccaaggcgggtgg

SEQ ID NO: 478225 - DNA, 20 bp, Artificial
  CRISPR gRNA sequence
gggaggccaaggcgggtgga

SEQ ID NO: 478226 - DNA, 20 bp, Artificial
  CRISPR gRNA sequence
ggaggccaaggcgggtggat

SEQ ID NO: 478227 - DNA, 20 bp, Artificial
  CRISPR gRNA sequence
aagaccagcctggccaacat

SEQ ID NO: 478228 - DNA, 20 bp, Artificial
  CRISPR gRNA sequence
gccaacatggtgaatcccca

SEQ ID NO: 478229 - DNA, 20 bp, Artificial
  CRISPR gRNA sequence
tactaaaaatataaaaattc

SEQ ID NO: 478230 - DNA, 20 bp, Artificial
  CRISPR gRNA sequence
ctaaaaatataaaaattccc

SEQ ID NO: 478231 - DNA, 20 bp, Artificial
  CRISPR gRNA sequence
aaaatataaaaattccccgg

SEQ ID NO: 478232 - DNA, 20 bp, Artificial
  CRISPR gRNA sequence
cccgggcgcagtggcaggtg

SEQ ID NO: 478233 - DNA, 20 bp, Artificial
  CRISPR gRNA sequence
tattcccagctgctccagag

SEQ ID NO: 478234 - DNA, 20 bp, Artificial
  CRISPR gRNA sequence
ccagctgctccagaggctga

SEQ ID NO: 478235 - DNA, 20 bp, Artificial
  CRISPR gRNA sequence
ctccagaggctgaggcagca

SEQ ID NO: 478236 - DNA, 20 bp, Artificial
  CRISPR gRNA sequence
cagaggctgaggcagcagaa

SEQ ID NO: 478237 - DNA, 20 bp, Artificial
  CRISPR gRNA sequence
aggcagcagaattgcttgaa

SEQ ID NO: 478238 - DNA, 20 bp, Artificial
  CRISPR gRNA sequence
cttgaacccggtgggtggag

SEQ ID NO: 478239 - DNA, 20 bp, Artificial
  CRISPR gRNA sequence
gaacccggtgggtggaggtt

SEQ ID NO: 478240 - DNA, 20 bp, Artificial
  CRISPR gRNA sequence
aacccggtgggtggaggttg

SEQ ID NO: 478241 - DNA, 20 bp, Artificial
  CRISPR gRNA sequence
cagtgagctaagatcgcgcc

SEQ ID NO: 478242 - DNA, 20 bp, Artificial
  CRISPR gRNA sequence
agatcgcgccactgcactcc

SEQ ID NO: 478243 - DNA, 20 bp, Artificial
  CRISPR gRNA sequence
cactccagcctgggtgacag

SEQ ID NO: 478244 - DNA, 20 bp, Artificial
  CRISPR gRNA sequence
cagcctgggtgacagagcga

SEQ ID NO: 478245 - DNA, 20 bp, Artificial
  CRISPR gRNA sequence
ggtgacagagcgagactccg

SEQ ID NO: 478246 - DNA, 20 bp, Artificial
  CRISPR gRNA sequence
cgtctcaacaacaacaacaa

SEQ ID NO: 478247 - DNA, 20 bp, Artificial
  CRISPR gRNA sequence
aacaacaacaacaaaaaagg

SEQ ID NO: 478248 - DNA, 20 bp, Artificial
  CRISPR gRNA sequence
acacaaaatagcatcagaca

SEQ ID NO: 478249 - DNA, 20 bp, Artificial
  CRISPR gRNA sequence
gctagggagtggggatatga

SEQ ID NO: 478250 - DNA, 20 bp, Artificial
  CRISPR gRNA sequence
ctagggagtggggatatgag

SEQ ID NO: 478251 - DNA, 20 bp, Artificial
  CRISPR gRNA sequence
gggagtggggatatgagggt

SEQ ID NO: 478252 - DNA, 20 bp, Artificial
  CRISPR gRNA sequence
gcataaacttactgggctag

SEQ ID NO: 478253 - DNA, 20 bp, Artificial
  CRISPR gRNA sequence
cataaacttactgggctagg

SEQ ID NO: 478254 - DNA, 20 bp, Artificial
  CRISPR gRNA sequence
actgggctaggcccagtgcg

SEQ ID NO: 478255 - DNA, 20 bp, Artificial
  CRISPR gRNA sequence
ctgggctaggcccagtgcgg

SEQ ID NO: 478256 - DNA, 20 bp, Artificial
  CRISPR gRNA sequence
ggctaggcccagtgcggtgg

SEQ ID NO: 478257 - DNA, 20 bp, Artificial
  CRISPR gRNA sequence
ggcccagtgcggtggctcac

SEQ ID NO: 478258 - DNA, 20 bp, Artificial
  CRISPR gRNA sequence
acgcctgtaatcccagcact

SEQ ID NO: 478259 - DNA, 20 bp, Artificial
  CRISPR gRNA sequence
taatcccagcactttgggag

SEQ ID NO: 478260 - DNA, 20 bp, Artificial
  CRISPR gRNA sequence
tgggagcccgaggcgggcgg

SEQ ID NO: 478261 - DNA, 20 bp, Artificial
  CRISPR gRNA sequence
gggagcccgaggcgggcgga

SEQ ID NO: 478262 - DNA, 20 bp, Artificial
  CRISPR gRNA sequence
ggagcccgaggcgggcggat

SEQ ID NO: 478263 - DNA, 20 bp, Artificial
  CRISPR gRNA sequence
gttaaccgggtaaaaccccg

SEQ ID NO: 478264 - DNA, 20 bp, Artificial
  CRISPR gRNA sequence
accgggtaaaaccccgtctc

SEQ ID NO: 478265 - DNA, 20 bp, Artificial
  CRISPR gRNA sequence
tactaaaaatacaaaaaatt

SEQ ID NO: 478266 - DNA, 20 bp, Artificial
  CRISPR gRNA sequence
ctaaaaatacaaaaaattag

SEQ ID NO: 478267 - DNA, 20 bp, Artificial
  CRISPR gRNA sequence
aaaatacaaaaaattagccg

SEQ ID NO: 478268 - DNA, 20 bp, Artificial
  CRISPR gRNA sequence
gccgggcgtggtggtgggca

SEQ ID NO: 478269 - DNA, 20 bp, Artificial
  CRISPR gRNA sequence
tagtcccagctactcaggag

SEQ ID NO: 478270 - DNA, 20 bp, Artificial
  CRISPR gRNA sequence
ctcaggaggctgaggcagga

SEQ ID NO: 478271 - DNA, 20 bp, Artificial
  CRISPR gRNA sequence
aggaggctgaggcaggagaa

SEQ ID NO: 478272 - DNA, 20 bp, Artificial
  CRISPR gRNA sequence
aggcaggagaatggcgtgaa

SEQ ID NO: 478273 - DNA, 20 bp, Artificial
  CRISPR gRNA sequence
gcagtgagcggagattgcgc

SEQ ID NO: 478274 - DNA, 20 bp, Artificial
  CRISPR gRNA sequence
cagtgagcggagattgcgcc

SEQ ID NO: 478275 - DNA, 20 bp, Artificial
  CRISPR gRNA sequence
cgccactgcactccagcctg

SEQ ID NO: 478276 - DNA, 20 bp, Artificial
  CRISPR gRNA sequence
cactccagcctgggcgacag

SEQ ID NO: 478277 - DNA, 20 bp, Artificial
  CRISPR gRNA sequence
cagcctgggcgacagagcga

SEQ ID NO: 478278 - DNA, 20 bp, Artificial
  CRISPR gRNA sequence
ggcgacagagcgagactctg

SEQ ID NO: 478279 - DNA, 20 bp, Artificial
  CRISPR gRNA sequence
tgtctcaaaaaaaaaaaaaa

SEQ ID NO: 478280 - DNA, 20 bp, Artificial
  CRISPR gRNA sequence
tctcaaaaaaaaaaaaaaaa

SEQ ID NO: 478281 - DNA, 20 bp, Artificial
  CRISPR gRNA sequence
aaaaaaaaaaaaaaaaagaa

SEQ ID NO: 478282 - DNA, 20 bp, Artificial
  CRISPR gRNA sequence
tgacagtgatgtggagaatt

SEQ ID NO: 478283 - DNA, 20 bp, Artificial
  CRISPR gRNA sequence
aggtggagggagggaaacaa

SEQ ID NO: 478284 - DNA, 20 bp, Artificial
  CRISPR gRNA sequence
ggaatgtagaagaccatttg

SEQ ID NO: 478285 - DNA, 20 bp, Artificial
  CRISPR gRNA sequence
gaatgtagaagaccatttgg

SEQ ID NO: 478286 - DNA, 20 bp, Artificial
  CRISPR gRNA sequence
ggtacgctgtgacaataatc

SEQ ID NO: 478287 - DNA, 20 bp, Artificial
  CRISPR gRNA sequence
gtacgctgtgacaataatcc

SEQ ID NO: 478288 - DNA, 20 bp, Artificial
  CRISPR gRNA sequence
tgacaataatccacatgaaa

SEQ ID NO: 478289 - DNA, 20 bp, Artificial
  CRISPR gRNA sequence
aggcagtgtcatggaaacaa

SEQ ID NO: 478290 - DNA, 20 bp, Artificial
  CRISPR gRNA sequence
tccatcctgaatcaattgaa

SEQ ID NO: 478291 - DNA, 20 bp, Artificial
  CRISPR gRNA sequence
ccatcctgaatcaattgaac

SEQ ID NO: 478292 - DNA, 20 bp, Artificial
  CRISPR gRNA sequence
catcctgaatcaattgaact

SEQ ID NO: 478293 - DNA, 20 bp, Artificial
  CRISPR gRNA sequence
aatcaattgaacttcatggc

SEQ ID NO: 478294 - DNA, 20 bp, Artificial
  CRISPR gRNA sequence
aacttcatggctgatggaat

SEQ ID NO: 478295 - DNA, 20 bp, Artificial
  CRISPR gRNA sequence
catggctgatggaatgggac

SEQ ID NO: 478296 - DNA, 20 bp, Artificial
  CRISPR gRNA sequence
atggctgatggaatgggacg

SEQ ID NO: 478297 - DNA, 20 bp, Artificial
  CRISPR gRNA sequence
atggaatgggacggtgacaa

SEQ ID NO: 478298 - DNA, 20 bp, Artificial
  CRISPR gRNA sequence
agatggctccccaggttctg

SEQ ID NO: 478299 - DNA, 20 bp, Artificial
  CRISPR gRNA sequence
cccaggttctggctaatgtg

SEQ ID NO: 478300 - DNA, 20 bp, Artificial
  CRISPR gRNA sequence
tggctaatgtgattaggtag

SEQ ID NO: 478301 - DNA, 20 bp, Artificial
  CRISPR gRNA sequence
gctaatgtgattaggtagat

SEQ ID NO: 478302 - DNA, 20 bp, Artificial
  CRISPR gRNA sequence
atgtgattaggtagatgatg

SEQ ID NO: 478303 - DNA, 20 bp, Artificial
  CRISPR gRNA sequence
ggtagatgatggtattatac

SEQ ID NO: 478304 - DNA, 20 bp, Artificial
  CRISPR gRNA sequence
tactgtgataatgagaggag

SEQ ID NO: 478305 - DNA, 20 bp, Artificial
  CRISPR gRNA sequence
tgataatgagaggaggacca

SEQ ID NO: 478306 - DNA, 20 bp, Artificial
  CRISPR gRNA sequence
gcctgggggttggcttggag

SEQ ID NO: 478307 - DNA, 20 bp, Artificial
  CRISPR gRNA sequence
cctgggggttggcttggagg

SEQ ID NO: 478308 - DNA, 20 bp, Artificial
  CRISPR gRNA sequence
ggggttggcttggaggaaga

SEQ ID NO: 478309 - DNA, 20 bp, Artificial
  CRISPR gRNA sequence
gcttggaggaagaaagagat

SEQ ID NO: 478310 - DNA, 20 bp, Artificial
  CRISPR gRNA sequence
ggaggaagaaagagatttat

SEQ ID NO: 478311 - DNA, 20 bp, Artificial
  CRISPR gRNA sequence
gaggaagaaagagatttatc

SEQ ID NO: 478312 - DNA, 20 bp, Artificial
  CRISPR gRNA sequence
atcttcccccatgaagcctt

SEQ ID NO: 478313 - DNA, 20 bp, Artificial
  CRISPR gRNA sequence
tcttcccccatgaagccttt

SEQ ID NO: 478314 - DNA, 20 bp, Artificial
  CRISPR gRNA sequence
cccccatgaagcctttcctg

SEQ ID NO: 478315 - DNA, 20 bp, Artificial
  CRISPR gRNA sequence
ccccatgaagcctttcctga

SEQ ID NO: 478316 - DNA, 20 bp, Artificial
  CRISPR gRNA sequence
tcctgattgacccagccaga

SEQ ID NO: 478317 - DNA, 20 bp, Artificial
  CRISPR gRNA sequence
cctgattgacccagccagaa

SEQ ID NO: 478318 - DNA, 20 bp, Artificial
  CRISPR gRNA sequence
ctgattgacccagccagaaa

SEQ ID NO: 478319 - DNA, 20 bp, Artificial
  CRISPR gRNA sequence
attgacccagccagaaagac

SEQ ID NO: 478320 - DNA, 20 bp, Artificial
  CRISPR gRNA sequence
acccagccagaaagactgtc

SEQ ID NO: 478321 - DNA, 20 bp, Artificial
  CRISPR gRNA sequence
tcttcctcttgagggatctg

SEQ ID NO: 478322 - DNA, 20 bp, Artificial
  CRISPR gRNA sequence
cctcttgagggatctgaaag

SEQ ID NO: 478323 - DNA, 20 bp, Artificial
  CRISPR gRNA sequence
ctcttgagggatctgaaagc

SEQ ID NO: 478324 - DNA, 20 bp, Artificial
  CRISPR gRNA sequence
ttgagggatctgaaagctct

SEQ ID NO: 478325 - DNA, 20 bp, Artificial
  CRISPR gRNA sequence
gagggatctgaaagctctga

SEQ ID NO: 478326 - DNA, 20 bp, Artificial
  CRISPR gRNA sequence
agggatctgaaagctctgag

SEQ ID NO: 478327 - DNA, 20 bp, Artificial
  CRISPR gRNA sequence
aaagctctgagagattatat

SEQ ID NO: 478328 - DNA, 20 bp, Artificial
  CRISPR gRNA sequence
tgagagattatatcatatcc

SEQ ID NO: 478329 - DNA, 20 bp, Artificial
  CRISPR gRNA sequence
agagattatatcatatccaa

SEQ ID NO: 478330 - DNA, 20 bp, Artificial
  CRISPR gRNA sequence
tatcatatccaaaataatac

SEQ ID NO: 478331 - DNA, 20 bp, Artificial
  CRISPR gRNA sequence
atggcaaaattgaaaagtgg

SEQ ID NO: 478332 - DNA, 20 bp, Artificial
  CRISPR gRNA sequence
aaaagtggtgtaagactttc

SEQ ID NO: 478333 - DNA, 20 bp, Artificial
  CRISPR gRNA sequence
tcagcctcttctttgtgcta

SEQ ID NO: 478334 - DNA, 20 bp, Artificial
  CRISPR gRNA sequence
cagcctcttctttgtgctag

SEQ ID NO: 478335 - DNA, 20 bp, Artificial
  CRISPR gRNA sequence
agcctcttctttgtgctaga

SEQ ID NO: 478336 - DNA, 20 bp, Artificial
  CRISPR gRNA sequence
ttctttgtgctagaaactgt

SEQ ID NO: 478337 - DNA, 20 bp, Artificial
  CRISPR gRNA sequence
ctttgtgctagaaactgtct

SEQ ID NO: 478338 - DNA, 20 bp, Artificial
  CRISPR gRNA sequence
tttgtgctagaaactgtctc

SEQ ID NO: 478339 - DNA, 20 bp, Artificial
  CRISPR gRNA sequence
tgtgctagaaactgtctcgt

SEQ ID NO: 478340 - DNA, 20 bp, Artificial
  CRISPR gRNA sequence
gtgctagaaactgtctcgtt

SEQ ID NO: 478341 - DNA, 20 bp, Artificial
  CRISPR gRNA sequence
tgctagaaactgtctcgtta

SEQ ID NO: 478342 - DNA, 20 bp, Artificial
  CRISPR gRNA sequence
gaaactgtctcgttactaat

SEQ ID NO: 478343 - DNA, 20 bp, Artificial
  CRISPR gRNA sequence
tctcgttactaatgtgtcaa

SEQ ID NO: 478344 - DNA, 20 bp, Artificial
  CRISPR gRNA sequence
gttactaatgtgtcaaggac

SEQ ID NO: 478345 - DNA, 20 bp, Artificial
  CRISPR gRNA sequence
ctaatgtgtcaaggacagtg

SEQ ID NO: 478346 - DNA, 20 bp, Artificial
  CRISPR gRNA sequence
atgtgtcaaggacagtggga

SEQ ID NO: 478347 - DNA, 20 bp, Artificial
  CRISPR gRNA sequence
ctgggtgtgaacaagtggct

SEQ ID NO: 478348 - DNA, 20 bp, Artificial
  CRISPR gRNA sequence
ggtgtgaacaagtggctcca

SEQ ID NO: 478349 - DNA, 20 bp, Artificial
  CRISPR gRNA sequence
cattgtctgtattgaattta

SEQ ID NO: 478350 - DNA, 20 bp, Artificial
  CRISPR gRNA sequence
tctgtattgaatttaaaaac

SEQ ID NO: 478351 - DNA, 20 bp, Artificial
  CRISPR gRNA sequence
tattgaatttaaaaacaact

SEQ ID NO: 478352 - DNA, 20 bp, Artificial
  CRISPR gRNA sequence
aatttaaaaacaactaaaag

SEQ ID NO: 478353 - DNA, 20 bp, Artificial
  CRISPR gRNA sequence
aaaaacaactaaaagttgat

SEQ ID NO: 478354 - DNA, 20 bp, Artificial
  CRISPR gRNA sequence
aaaacaactaaaagttgatt

SEQ ID NO: 478355 - DNA, 20 bp, Artificial
  CRISPR gRNA sequence
aaagttgatttccttttttt

SEQ ID NO: 478356 - DNA, 20 bp, Artificial
  CRISPR gRNA sequence
atttcctttttttttttttg

SEQ ID NO: 478357 - DNA, 20 bp, Artificial
  CRISPR gRNA sequence
cctttttttttttttgacac

SEQ ID NO: 478358 - DNA, 20 bp, Artificial
  CRISPR gRNA sequence
ctttttttttttttgacaca

SEQ ID NO: 478359 - DNA, 20 bp, Artificial
  CRISPR gRNA sequence
tttttttttttgacacagat

SEQ ID NO: 478360 - DNA, 20 bp, Artificial
  CRISPR gRNA sequence
ttttttttttgacacagatt

SEQ ID NO: 478361 - DNA, 20 bp, Artificial
  CRISPR gRNA sequence
tttttttttgacacagattt

SEQ ID NO: 478362 - DNA, 20 bp, Artificial
  CRISPR gRNA sequence
ttttttttgacacagatttt

SEQ ID NO: 478363 - DNA, 20 bp, Artificial
  CRISPR gRNA sequence
tttttttgacacagattttc

SEQ ID NO: 478364 - DNA, 20 bp, Artificial
  CRISPR gRNA sequence
ttttttgacacagattttcg

SEQ ID NO: 478365 - DNA, 20 bp, Artificial
  CRISPR gRNA sequence
tttttgacacagattttcgc

SEQ ID NO: 478366 - DNA, 20 bp, Artificial
  CRISPR gRNA sequence
ttttgacacagattttcgct

SEQ ID NO: 478367 - DNA, 20 bp, Artificial
  CRISPR gRNA sequence
tttgacacagattttcgctc

SEQ ID NO: 478368 - DNA, 20 bp, Artificial
  CRISPR gRNA sequence
ttgacacagattttcgctct

SEQ ID NO: 478369 - DNA, 20 bp, Artificial
  CRISPR gRNA sequence
tgacacagattttcgctctt

SEQ ID NO: 478370 - DNA, 20 bp, Artificial
  CRISPR gRNA sequence
gacacagattttcgctcttg

SEQ ID NO: 478371 - DNA, 20 bp, Artificial
  CRISPR gRNA sequence
acacagattttcgctcttgt

SEQ ID NO: 478372 - DNA, 20 bp, Artificial
  CRISPR gRNA sequence
tcgctcttgttgcccaggct

SEQ ID NO: 478373 - DNA, 20 bp, Artificial
  CRISPR gRNA sequence
cgctcttgttgcccaggctg

SEQ ID NO: 478374 - DNA, 20 bp, Artificial
  CRISPR gRNA sequence
gctcttgttgcccaggctgg

SEQ ID NO: 478375 - DNA, 20 bp, Artificial
  CRISPR gRNA sequence
ttgttgcccaggctggagtg

SEQ ID NO: 478376 - DNA, 20 bp, Artificial
  CRISPR gRNA sequence
gttgcccaggctggagtgca

SEQ ID NO: 478377 - DNA, 20 bp, Artificial
  CRISPR gRNA sequence
ttgcccaggctggagtgcaa

SEQ ID NO: 478378 - DNA, 20 bp, Artificial
  CRISPR gRNA sequence
cccaggctggagtgcaatgg

SEQ ID NO: 478379 - DNA, 20 bp, Artificial
  CRISPR gRNA sequence
gagtgcaatggcacgatctc

SEQ ID NO: 478380 - DNA, 20 bp, Artificial
  CRISPR gRNA sequence
agctcaccgcaacctccgcc

SEQ ID NO: 478381 - DNA, 20 bp, Artificial
  CRISPR gRNA sequence
accgcaacctccgcctcctg

SEQ ID NO: 478382 - DNA, 20 bp, Artificial
  CRISPR gRNA sequence
cgcctcctgggttcaagcta

SEQ ID NO: 478383 - DNA, 20 bp, Artificial
  CRISPR gRNA sequence
ctgggttcaagctattctcc

SEQ ID NO: 478384 - DNA, 20 bp, Artificial
  CRISPR gRNA sequence
ggttcaagctattctcctgc

SEQ ID NO: 478385 - DNA, 20 bp, Artificial
  CRISPR gRNA sequence
aagctattctcctgcctcag

SEQ ID NO: 478386 - DNA, 20 bp, Artificial
  CRISPR gRNA sequence
ttctcctgcctcagcctcct

SEQ ID NO: 478387 - DNA, 20 bp, Artificial
  CRISPR gRNA sequence
tcctgcctcagcctcctgag

SEQ ID NO: 478388 - DNA, 20 bp, Artificial
  CRISPR gRNA sequence
ctgcctcagcctcctgagta

SEQ ID NO: 478389 - DNA, 20 bp, Artificial
  CRISPR gRNA sequence
cctcagcctcctgagtagct

SEQ ID NO: 478390 - DNA, 20 bp, Artificial
  CRISPR gRNA sequence
agcctcctgagtagctggga

SEQ ID NO: 478391 - DNA, 20 bp, Artificial
  CRISPR gRNA sequence
ctgagtagctgggattacag

SEQ ID NO: 478392 - DNA, 20 bp, Artificial
  CRISPR gRNA sequence
agtagctgggattacaggca

SEQ ID NO: 478393 - DNA, 20 bp, Artificial
  CRISPR gRNA sequence
ggattacaggcatgcgccac

SEQ ID NO: 478394 - DNA, 20 bp, Artificial
  CRISPR gRNA sequence
caggcatgcgccaccatacc

SEQ ID NO: 478395 - DNA, 20 bp, Artificial
  CRISPR gRNA sequence
attttgtattttttaataga

SEQ ID NO: 478396 - DNA, 20 bp, Artificial
  CRISPR gRNA sequence
tgtattttttaatagagaca

SEQ ID NO: 478397 - DNA, 20 bp, Artificial
  CRISPR gRNA sequence
gtattttttaatagagacag

SEQ ID NO: 478398 - DNA, 20 bp, Artificial
  CRISPR gRNA sequence
tattttttaatagagacagg

SEQ ID NO: 478399 - DNA, 20 bp, Artificial
  CRISPR gRNA sequence
tttaatagagacagggtttc

SEQ ID NO: 478400 - DNA, 20 bp, Artificial
  CRISPR gRNA sequence
ttaatagagacagggtttct

SEQ ID NO: 478401 - DNA, 20 bp, Artificial
  CRISPR gRNA sequence
taatagagacagggtttctc

SEQ ID NO: 478402 - DNA, 20 bp, Artificial
  CRISPR gRNA sequence
aatagagacagggtttctcc

SEQ ID NO: 478403 - DNA, 20 bp, Artificial
  CRISPR gRNA sequence
atagagacagggtttctcca

SEQ ID NO: 478404 - DNA, 20 bp, Artificial
  CRISPR gRNA sequence
ctccatgttggttaggctgg

SEQ ID NO: 478405 - DNA, 20 bp, Artificial
  CRISPR gRNA sequence
tccatgttggttaggctggt

SEQ ID NO: 478406 - DNA, 20 bp, Artificial
  CRISPR gRNA sequence
catgttggttaggctggtct

SEQ ID NO: 478407 - DNA, 20 bp, Artificial
  CRISPR gRNA sequence
gttaggctggtctcaaactc

SEQ ID NO: 478408 - DNA, 20 bp, Artificial
  CRISPR gRNA sequence
ggctggtctcaaactcccga

SEQ ID NO: 478409 - DNA, 20 bp, Artificial
  CRISPR gRNA sequence
gtctcaaactcccgacctct

SEQ ID NO: 478410 - DNA, 20 bp, Artificial
  CRISPR gRNA sequence
aaactcccgacctctggtga

SEQ ID NO: 478411 - DNA, 20 bp, Artificial
  CRISPR gRNA sequence
ccgacctctggtgatccgcc

SEQ ID NO: 478412 - DNA, 20 bp, Artificial
  CRISPR gRNA sequence
tggtgatccgcccgccctgg

SEQ ID NO: 478413 - DNA, 20 bp, Artificial
  CRISPR gRNA sequence
gtgatccgcccgccctggcc

SEQ ID NO: 478414 - DNA, 20 bp, Artificial
  CRISPR gRNA sequence
gcctcccaaagtgctgggat

SEQ ID NO: 478415 - DNA, 20 bp, Artificial
  CRISPR gRNA sequence
ccaaagtgctgggattacag

SEQ ID NO: 478416 - DNA, 20 bp, Artificial
  CRISPR gRNA sequence
ggattacaggcatgagtcac

SEQ ID NO: 478417 - DNA, 20 bp, Artificial
  CRISPR gRNA sequence
caggcatgagtcaccacgcc

SEQ ID NO: 478418 - DNA, 20 bp, Artificial
  CRISPR gRNA sequence
ccttttaattatcaccacat

SEQ ID NO: 478419 - DNA, 20 bp, Artificial
  CRISPR gRNA sequence
cttttaattatcaccacata

SEQ ID NO: 478420 - DNA, 20 bp, Artificial
  CRISPR gRNA sequence
ttaattatcaccacatacta

SEQ ID NO: 478421 - DNA, 20 bp, Artificial
  CRISPR gRNA sequence
taattatcaccacatactag

SEQ ID NO: 478422 - DNA, 20 bp, Artificial
  CRISPR gRNA sequence
aattatcaccacatactagc

SEQ ID NO: 478423 - DNA, 20 bp, Artificial
  CRISPR gRNA sequence
attatcaccacatactagca

SEQ ID NO: 478424 - DNA, 20 bp, Artificial
  CRISPR gRNA sequence
tcaccacatactagcaaaca

SEQ ID NO: 478425 - DNA, 20 bp, Artificial
  CRISPR gRNA sequence
gcaaacatgaacaatgtcag

SEQ ID NO: 478426 - DNA, 20 bp, Artificial
  CRISPR gRNA sequence
acccttcaaaatatttttgg

SEQ ID NO: 478427 - DNA, 20 bp, Artificial
  CRISPR gRNA sequence
cccttcaaaatatttttggt

SEQ ID NO: 478428 - DNA, 20 bp, Artificial
  CRISPR gRNA sequence
caaaatatttttggtctaag

SEQ ID NO: 478429 - DNA, 20 bp, Artificial
  CRISPR gRNA sequence
aaaatatttttggtctaagt

SEQ ID NO: 478430 - DNA, 20 bp, Artificial
  CRISPR gRNA sequence
ttggtctaagttctaaatac

SEQ ID NO: 478431 - DNA, 20 bp, Artificial
  CRISPR gRNA sequence
tggtctaagttctaaatact

SEQ ID NO: 478432 - DNA, 20 bp, Artificial
  CRISPR gRNA sequence
ggtctaagttctaaatacta

SEQ ID NO: 478433 - DNA, 20 bp, Artificial
  CRISPR gRNA sequence
gtctaagttctaaatactat

SEQ ID NO: 478434 - DNA, 20 bp, Artificial
  CRISPR gRNA sequence
agttctaaatactatggtta

SEQ ID NO: 478435 - DNA, 20 bp, Artificial
  CRISPR gRNA sequence
taaatactatggttactgtt

SEQ ID NO: 478436 - DNA, 20 bp, Artificial
  CRISPR gRNA sequence
aatactatggttactgttga

SEQ ID NO: 478437 - DNA, 20 bp, Artificial
  CRISPR gRNA sequence
tggttactgttgagttttat

SEQ ID NO: 478438 - DNA, 20 bp, Artificial
  CRISPR gRNA sequence
ctgttgagttttatgatata

SEQ ID NO: 478439 - DNA, 20 bp, Artificial
  CRISPR gRNA sequence
ttgagttttatgatatatat

SEQ ID NO: 478440 - DNA, 20 bp, Artificial
  CRISPR gRNA sequence
agttttatgatatatatgta

SEQ ID NO: 478441 - DNA, 20 bp, Artificial
  CRISPR gRNA sequence
tatgatatatatgtaaactt

SEQ ID NO: 478442 - DNA, 20 bp, Artificial
  CRISPR gRNA sequence
atgatatatatgtaaacttc

SEQ ID NO: 478443 - DNA, 20 bp, Artificial
  CRISPR gRNA sequence
tgatatatatgtaaacttca

SEQ ID NO: 478444 - DNA, 20 bp, Artificial
  CRISPR gRNA sequence
caaattagcacatttgtagt

SEQ ID NO: 478445 - DNA, 20 bp, Artificial
  CRISPR gRNA sequence
aaattagcacatttgtagta

SEQ ID NO: 478446 - DNA, 20 bp, Artificial
  CRISPR gRNA sequence
gcacatttgtagtatatatc

SEQ ID NO: 478447 - DNA, 20 bp, Artificial
  CRISPR gRNA sequence
gtagtatatatcatttgaca

SEQ ID NO: 478448 - DNA, 20 bp, Artificial
  CRISPR gRNA sequence
tagtatatatcatttgacaa

SEQ ID NO: 478449 - DNA, 20 bp, Artificial
  CRISPR gRNA sequence
gacaaacattgcattctact

SEQ ID NO: 478450 - DNA, 20 bp, Artificial
  CRISPR gRNA sequence
acaaacattgcattctactt

SEQ ID NO: 478451 - DNA, 20 bp, Artificial
  CRISPR gRNA sequence
cattctacttgcaagttaac

SEQ ID NO: 478452 - DNA, 20 bp, Artificial
  CRISPR gRNA sequence
tacttgcaagttaactcaga

SEQ ID NO: 478453 - DNA, 20 bp, Artificial
  CRISPR gRNA sequence
cttgcaagttaactcagaga

SEQ ID NO: 478454 - DNA, 20 bp, Artificial
  CRISPR gRNA sequence
gcaagttaactcagagaact

SEQ ID NO: 478455 - DNA, 20 bp, Artificial
  CRISPR gRNA sequence
caagttaactcagagaactt

SEQ ID NO: 478456 - DNA, 20 bp, Artificial
  CRISPR gRNA sequence
actcagagaacttcccagtt

SEQ ID NO: 478457 - DNA, 20 bp, Artificial
  CRISPR gRNA sequence
agagaacttcccagttatac

SEQ ID NO: 478458 - DNA, 20 bp, Artificial
  CRISPR gRNA sequence
cccagttatacagctggcct

SEQ ID NO: 478459 - DNA, 20 bp, Artificial
  CRISPR gRNA sequence
ccagttatacagctggcctt

SEQ ID NO: 478460 - DNA, 20 bp, Artificial
  CRISPR gRNA sequence
tacagctggccttggacata

SEQ ID NO: 478461 - DNA, 20 bp, Artificial
  CRISPR gRNA sequence
gccttggacatataccattc

SEQ ID NO: 478462 - DNA, 20 bp, Artificial
  CRISPR gRNA sequence
ggacatataccattcagcta

SEQ ID NO: 478463 - DNA, 20 bp, Artificial
  CRISPR gRNA sequence
gacatataccattcagctac

SEQ ID NO: 478464 - DNA, 20 bp, Artificial
  CRISPR gRNA sequence
agctacttgtgttcattttg

SEQ ID NO: 478465 - DNA, 20 bp, Artificial
  CRISPR gRNA sequence
cttgtgttcattttgatagc

SEQ ID NO: 478466 - DNA, 20 bp, Artificial
  CRISPR gRNA sequence
gtgttcattttgatagcaaa

SEQ ID NO: 478467 - DNA, 20 bp, Artificial
  CRISPR gRNA sequence
tgttcattttgatagcaaat

SEQ ID NO: 478468 - DNA, 20 bp, Artificial
  CRISPR gRNA sequence
attttgatagcaaatttata

SEQ ID NO: 478469 - DNA, 20 bp, Artificial
  CRISPR gRNA sequence
tgatagcaaatttataaagt

SEQ ID NO: 478470 - DNA, 20 bp, Artificial
  CRISPR gRNA sequence
gatagcaaatttataaagtc

SEQ ID NO: 478471 - DNA, 20 bp, Artificial
  CRISPR gRNA sequence
atagcaaatttataaagtcc

SEQ ID NO: 478472 - DNA, 20 bp, Artificial
  CRISPR gRNA sequence
ataaagtccaggatcactcc

SEQ ID NO: 478473 - DNA, 20 bp, Artificial
  CRISPR gRNA sequence
taaagtccaggatcactcca

SEQ ID NO: 478474 - DNA, 20 bp, Artificial
  CRISPR gRNA sequence
cagtttcctccaaggacact

SEQ ID NO: 478475 - DNA, 20 bp, Artificial
  CRISPR gRNA sequence
cctccaaggacactttgtgt

SEQ ID NO: 478476 - DNA, 20 bp, Artificial
  CRISPR gRNA sequence
ctccaaggacactttgtgtc

SEQ ID NO: 478477 - DNA, 20 bp, Artificial
  CRISPR gRNA sequence
caaggacactttgtgtcctc

SEQ ID NO: 478478 - DNA, 20 bp, Artificial
  CRISPR gRNA sequence
tgtgtcctcatctctgtggt

SEQ ID NO: 478479 - DNA, 20 bp, Artificial
  CRISPR gRNA sequence
gtgtcctcatctctgtggta

SEQ ID NO: 478480 - DNA, 20 bp, Artificial
  CRISPR gRNA sequence
tgtcctcatctctgtggtac

SEQ ID NO: 478481 - DNA, 20 bp, Artificial
  CRISPR gRNA sequence
atctctgtggtactacatac

SEQ ID NO: 478482 - DNA, 20 bp, Artificial
  CRISPR gRNA sequence
tgtggtactacatactccag

SEQ ID NO: 478483 - DNA, 20 bp, Artificial
  CRISPR gRNA sequence
tggtactacatactccagcc

SEQ ID NO: 478484 - DNA, 20 bp, Artificial
  CRISPR gRNA sequence
catactccagcctttcaaca

SEQ ID NO: 478485 - DNA, 20 bp, Artificial
  CRISPR gRNA sequence
cagcctttcaacattcaatt

SEQ ID NO: 478486 - DNA, 20 bp, Artificial
  CRISPR gRNA sequence
tcaacattcaattttaaata

SEQ ID NO: 478487 - DNA, 20 bp, Artificial
  CRISPR gRNA sequence
caacattcaattttaaataa

SEQ ID NO: 478488 - DNA, 20 bp, Artificial
  CRISPR gRNA sequence
aacattcaattttaaataaa

SEQ ID NO: 478489 - DNA, 20 bp, Artificial
  CRISPR gRNA sequence
aattttaaataaacaataat

SEQ ID NO: 478490 - DNA, 20 bp, Artificial
  CRISPR gRNA sequence
taaataaacaataataccac

SEQ ID NO: 478491 - DNA, 20 bp, Artificial
  CRISPR gRNA sequence
aaataaacaataataccaca

SEQ ID NO: 478492 - DNA, 20 bp, Artificial
  CRISPR gRNA sequence
aataaacaataataccacag

SEQ ID NO: 478493 - DNA, 20 bp, Artificial
  CRISPR gRNA sequence
agacaaagaagcagaacagg

SEQ ID NO: 478494 - DNA, 20 bp, Artificial
  CRISPR gRNA sequence
tttcatttttgtcatttggt

SEQ ID NO: 478495 - DNA, 20 bp, Artificial
  CRISPR gRNA sequence
catttttgtcatttggtgca

SEQ ID NO: 478496 - DNA, 20 bp, Artificial
  CRISPR gRNA sequence
atttttgtcatttggtgcaa

SEQ ID NO: 478497 - DNA, 20 bp, Artificial
  CRISPR gRNA sequence
ttgtcatttggtgcaaactt

SEQ ID NO: 478498 - DNA, 20 bp, Artificial
  CRISPR gRNA sequence
tgtcatttggtgcaaacttc

SEQ ID NO: 478499 - DNA, 20 bp, Artificial
  CRISPR gRNA sequence
gtcatttggtgcaaacttct

SEQ ID NO: 478500 - DNA, 20 bp, Artificial
  CRISPR gRNA sequence
tcatttggtgcaaacttctt

SEQ ID NO: 478501 - DNA, 20 bp, Artificial
  CRISPR gRNA sequence
ggtgcaaacttcttgaattt

SEQ ID NO: 478502 - DNA, 20 bp, Artificial
  CRISPR gRNA sequence
gtgcaaacttcttgaatttt

SEQ ID NO: 478503 - DNA, 20 bp, Artificial
  CRISPR gRNA sequence
cttgaatttttatttgtgtt

SEQ ID NO: 478504 - DNA, 20 bp, Artificial
  CRISPR gRNA sequence
ttgaatttttatttgtgttt

SEQ ID NO: 478505 - DNA, 20 bp, Artificial
  CRISPR gRNA sequence
gaatttttatttgtgtttaa

SEQ ID NO: 478506 - DNA, 20 bp, Artificial
  CRISPR gRNA sequence
aatttttatttgtgtttaaa

SEQ ID NO: 478507 - DNA, 20 bp, Artificial
  CRISPR gRNA sequence
ttatttgtgtttaaaattta

SEQ ID NO: 478508 - DNA, 20 bp, Artificial
  CRISPR gRNA sequence
tatttgtgtttaaaatttaa

SEQ ID NO: 478509 - DNA, 20 bp, Artificial
  CRISPR gRNA sequence
atttgtgtttaaaatttaaa

SEQ ID NO: 478510 - DNA, 20 bp, Artificial
  CRISPR gRNA sequence
tttgtgtttaaaatttaaaa

SEQ ID NO: 478511 - DNA, 20 bp, Artificial
  CRISPR gRNA sequence
gtgtttaaaatttaaaacag

SEQ ID NO: 478512 - DNA, 20 bp, Artificial
  CRISPR gRNA sequence
tgtttaaaatttaaaacagt

SEQ ID NO: 478513 - DNA, 20 bp, Artificial
  CRISPR gRNA sequence
aaaatttaaaacagtgaaaa

SEQ ID NO: 478514 - DNA, 20 bp, Artificial
  CRISPR gRNA sequence
aaatttaaaacagtgaaaag

SEQ ID NO: 478515 - DNA, 20 bp, Artificial
  CRISPR gRNA sequence
aaaacagtgaaaaggataca

SEQ ID NO: 478516 - DNA, 20 bp, Artificial
  CRISPR gRNA sequence
aaacagtgaaaaggatacaa

SEQ ID NO: 478517 - DNA, 20 bp, Artificial
  CRISPR gRNA sequence
tgatatataaaatcttcggc

SEQ ID NO: 478518 - DNA, 20 bp, Artificial
  CRISPR gRNA sequence
cggcttggcaactttatttc

SEQ ID NO: 478519 - DNA, 20 bp, Artificial
  CRISPR gRNA sequence
ggcttggcaactttatttca

SEQ ID NO: 478520 - DNA, 20 bp, Artificial
  CRISPR gRNA sequence
ggcaactttatttcatgcat

SEQ ID NO: 478521 - DNA, 20 bp, Artificial
  CRISPR gRNA sequence
gcaactttatttcatgcata

SEQ ID NO: 478522 - DNA, 20 bp, Artificial
  CRISPR gRNA sequence
tatttcatgcataaaatgtt

SEQ ID NO: 478523 - DNA, 20 bp, Artificial
  CRISPR gRNA sequence
atttcatgcataaaatgtta

SEQ ID NO: 478524 - DNA, 20 bp, Artificial
  CRISPR gRNA sequence
tttcatgcataaaatgttag

SEQ ID NO: 478525 - DNA, 20 bp, Artificial
  CRISPR gRNA sequence
catgcataaaatgttagatt

SEQ ID NO: 478526 - DNA, 20 bp, Artificial
  CRISPR gRNA sequence
atgcataaaatgttagattg

SEQ ID NO: 478527 - DNA, 20 bp, Artificial
  CRISPR gRNA sequence
gattgattaatatttttaca

SEQ ID NO: 478528 - DNA, 20 bp, Artificial
  CRISPR gRNA sequence
attaatatttttacaattga

SEQ ID NO: 478529 - DNA, 20 bp, Artificial
  CRISPR gRNA sequence
atatttttacaattgaaatt

SEQ ID NO: 478530 - DNA, 20 bp, Artificial
  CRISPR gRNA sequence
ttacaattgaaattttttta

SEQ ID NO: 478531 - DNA, 20 bp, Artificial
  CRISPR gRNA sequence
tacaattgaaatttttttaa

SEQ ID NO: 478532 - DNA, 20 bp, Artificial
  CRISPR gRNA sequence
acaattgaaatttttttaat

SEQ ID NO: 478533 - DNA, 20 bp, Artificial
  CRISPR gRNA sequence
caattgaaatttttttaatg

SEQ ID NO: 478534 - DNA, 20 bp, Artificial
  CRISPR gRNA sequence
aaatttttttaatgttgttt

SEQ ID NO: 478535 - DNA, 20 bp, Artificial
  CRISPR gRNA sequence
ttttaatgttgttttaaaac

SEQ ID NO: 478536 - DNA, 20 bp, Artificial
  CRISPR gRNA sequence
tttaatgttgttttaaaact

SEQ ID NO: 478537 - DNA, 20 bp, Artificial
  CRISPR gRNA sequence
ttaatgttgttttaaaacta

SEQ ID NO: 478538 - DNA, 20 bp, Artificial
  CRISPR gRNA sequence
taatgttgttttaaaactaa

SEQ ID NO: 478539 - DNA, 20 bp, Artificial
  CRISPR gRNA sequence
aatgttgttttaaaactaac

SEQ ID NO: 478540 - DNA, 20 bp, Artificial
  CRISPR gRNA sequence
atgttgttttaaaactaact

SEQ ID NO: 478541 - DNA, 20 bp, Artificial
  CRISPR gRNA sequence
ttttaaaactaactttagaa

SEQ ID NO: 478542 - DNA, 20 bp, Artificial
  CRISPR gRNA sequence
taaaactaactttagaaaat

SEQ ID NO: 478543 - DNA, 20 bp, Artificial
  CRISPR gRNA sequence
aaaactaactttagaaaata

SEQ ID NO: 478544 - DNA, 20 bp, Artificial
  CRISPR gRNA sequence
aaactaactttagaaaataa

SEQ ID NO: 478545 - DNA, 20 bp, Artificial
  CRISPR gRNA sequence
actttagaaaataaaacttt

SEQ ID NO: 478546 - DNA, 20 bp, Artificial
  CRISPR gRNA sequence
tagaaaataaaactttagtg

SEQ ID NO: 478547 - DNA, 20 bp, Artificial
  CRISPR gRNA sequence
agaaaataaaactttagtgt

SEQ ID NO: 478548 - DNA, 20 bp, Artificial
  CRISPR gRNA sequence
gaaaataaaactttagtgtt

SEQ ID NO: 478549 - DNA, 20 bp, Artificial
  CRISPR gRNA sequence
tagtgttacaatttagtagt

SEQ ID NO: 478550 - DNA, 20 bp, Artificial
  CRISPR gRNA sequence
agtgttacaatttagtagtt

SEQ ID NO: 478551 - DNA, 20 bp, Artificial
  CRISPR gRNA sequence
gtgttacaatttagtagtta

SEQ ID NO: 478552 - DNA, 20 bp, Artificial
  CRISPR gRNA sequence
caatttagtagttacctaaa

SEQ ID NO: 478553 - DNA, 20 bp, Artificial
  CRISPR gRNA sequence
agtagttacctaaattgtat

SEQ ID NO: 478554 - DNA, 20 bp, Artificial
  CRISPR gRNA sequence
gtagttacctaaattgtatc

SEQ ID NO: 478555 - DNA, 20 bp, Artificial
  CRISPR gRNA sequence
cctaaattgtatctttgcag

SEQ ID NO: 478556 - DNA, 20 bp, Artificial
  CRISPR gRNA sequence
aattgtatctttgcagaatt

SEQ ID NO: 478557 - DNA, 20 bp, Artificial
  CRISPR gRNA sequence
tatctttgcagaatttcagt

SEQ ID NO: 478558 - DNA, 20 bp, Artificial
  CRISPR gRNA sequence
tgcagaatttcagttttaat

SEQ ID NO: 478559 - DNA, 20 bp, Artificial
  CRISPR gRNA sequence
gcagaatttcagttttaata

SEQ ID NO: 478560 - DNA, 20 bp, Artificial
  CRISPR gRNA sequence
cagaatttcagttttaatac

SEQ ID NO: 478561 - DNA, 20 bp, Artificial
  CRISPR gRNA sequence
cagttttaatacaatccatt

SEQ ID NO: 478562 - DNA, 20 bp, Artificial
  CRISPR gRNA sequence
agttttaatacaatccattt

SEQ ID NO: 478563 - DNA, 20 bp, Artificial
  CRISPR gRNA sequence
taatacaatccatttattag

SEQ ID NO: 478564 - DNA, 20 bp, Artificial
  CRISPR gRNA sequence
aatacaatccatttattagt

SEQ ID NO: 478565 - DNA, 20 bp, Artificial
  CRISPR gRNA sequence
atacaatccatttattagtt

SEQ ID NO: 478566 - DNA, 20 bp, Artificial
  CRISPR gRNA sequence
attagttattggacaactat

SEQ ID NO: 478567 - DNA, 20 bp, Artificial
  CRISPR gRNA sequence
ttagttattggacaactatt

SEQ ID NO: 478568 - DNA, 20 bp, Artificial
  CRISPR gRNA sequence
gttattggacaactatttac

SEQ ID NO: 478569 - DNA, 20 bp, Artificial
  CRISPR gRNA sequence
ttggacaactatttacataa

SEQ ID NO: 478570 - DNA, 20 bp, Artificial
  CRISPR gRNA sequence
gacaactatttacataaact

SEQ ID NO: 478571 - DNA, 20 bp, Artificial
  CRISPR gRNA sequence
tttacataaactattatatc

SEQ ID NO: 478572 - DNA, 20 bp, Artificial
  CRISPR gRNA sequence
acataaactattatatcaga

SEQ ID NO: 478573 - DNA, 20 bp, Artificial
  CRISPR gRNA sequence
cataaactattatatcagac

SEQ ID NO: 478574 - DNA, 20 bp, Artificial
  CRISPR gRNA sequence
ttatatcagactataactaa

SEQ ID NO: 478575 - DNA, 20 bp, Artificial
  CRISPR gRNA sequence
tatcagactataactaaaga

SEQ ID NO: 478576 - DNA, 20 bp, Artificial
  CRISPR gRNA sequence
taactaaagaatcaaagttc

SEQ ID NO: 478577 - DNA, 20 bp, Artificial
  CRISPR gRNA sequence
aagaatcaaagttcatactg

SEQ ID NO: 478578 - DNA, 20 bp, Artificial
  CRISPR gRNA sequence
atactgtttaggtggatata

SEQ ID NO: 478579 - DNA, 20 bp, Artificial
  CRISPR gRNA sequence
tttaggtggatataaaaatg

SEQ ID NO: 478580 - DNA, 20 bp, Artificial
  CRISPR gRNA sequence
aggtggatataaaaatgatt

SEQ ID NO: 478581 - DNA, 20 bp, Artificial
  CRISPR gRNA sequence
ggtggatataaaaatgattg

SEQ ID NO: 478582 - DNA, 20 bp, Artificial
  CRISPR gRNA sequence
aataaatacctgtgcatttt

SEQ ID NO: 478583 - DNA, 20 bp, Artificial
  CRISPR gRNA sequence
tgcatttttctttttttgta

SEQ ID NO: 478584 - DNA, 20 bp, Artificial
  CRISPR gRNA sequence
ttctttttttgtattttaat

SEQ ID NO: 478585 - DNA, 20 bp, Artificial
  CRISPR gRNA sequence
tctttttttgtattttaatt

SEQ ID NO: 478586 - DNA, 20 bp, Artificial
  CRISPR gRNA sequence
ctttttttgtattttaattt

SEQ ID NO: 478587 - DNA, 20 bp, Artificial
  CRISPR gRNA sequence
tttttttgtattttaatttt

SEQ ID NO: 478588 - DNA, 20 bp, Artificial
  CRISPR gRNA sequence
tttttgtattttaatttttt

SEQ ID NO: 478589 - DNA, 20 bp, Artificial
  CRISPR gRNA sequence
ttttgtattttaattttttt

SEQ ID NO: 478590 - DNA, 20 bp, Artificial
  CRISPR gRNA sequence
tttgtattttaattttttta

SEQ ID NO: 478591 - DNA, 20 bp, Artificial
  CRISPR gRNA sequence
ttgtattttaatttttttaa

SEQ ID NO: 478592 - DNA, 20 bp, Artificial
  CRISPR gRNA sequence
tgtattttaatttttttaaa

SEQ ID NO: 478593 - DNA, 20 bp, Artificial
  CRISPR gRNA sequence
gtattttaatttttttaaaa

SEQ ID NO: 478594 - DNA, 20 bp, Artificial
  CRISPR gRNA sequence
tattttaatttttttaaaac

SEQ ID NO: 478595 - DNA, 20 bp, Artificial
  CRISPR gRNA sequence
taatttttttaaaacatttt

SEQ ID NO: 478596 - DNA, 20 bp, Artificial
  CRISPR gRNA sequence
aatttttttaaaacattttt

SEQ ID NO: 478597 - DNA, 20 bp, Artificial
  CRISPR gRNA sequence
atttttttaaaacatttttt

SEQ ID NO: 478598 - DNA, 20 bp, Artificial
  CRISPR gRNA sequence
ttttaaaacattttttcatt

SEQ ID NO: 478599 - DNA, 20 bp, Artificial
  CRISPR gRNA sequence
tttaaaacattttttcattt

SEQ ID NO: 478600 - DNA, 20 bp, Artificial
  CRISPR gRNA sequence
ttaaaacattttttcatttg

SEQ ID NO: 478601 - DNA, 20 bp, Artificial
  CRISPR gRNA sequence
taaaacattttttcatttgt

SEQ ID NO: 478602 - DNA, 20 bp, Artificial
  CRISPR gRNA sequence
aaaacattttttcatttgta

SEQ ID NO: 478603 - DNA, 20 bp, Artificial
  CRISPR gRNA sequence
aaacattttttcatttgtat

SEQ ID NO: 478604 - DNA, 20 bp, Artificial
  CRISPR gRNA sequence
tttcatttgtatggttttat

SEQ ID NO: 478605 - DNA, 20 bp, Artificial
  CRISPR gRNA sequence
ttcatttgtatggttttata

SEQ ID NO: 478606 - DNA, 20 bp, Artificial
  CRISPR gRNA sequence
tcatttgtatggttttatac

SEQ ID NO: 478607 - DNA, 20 bp, Artificial
  CRISPR gRNA sequence
catttgtatggttttataca

SEQ ID NO: 478608 - DNA, 20 bp, Artificial
  CRISPR gRNA sequence
atttgtatggttttatacat

SEQ ID NO: 478609 - DNA, 20 bp, Artificial
  CRISPR gRNA sequence
gtatggttttatacatgaag

SEQ ID NO: 478610 - DNA, 20 bp, Artificial
  CRISPR gRNA sequence
tatggttttatacatgaagt

SEQ ID NO: 478611 - DNA, 20 bp, Artificial
  CRISPR gRNA sequence
tatacatgaagttcagcaca

SEQ ID NO: 478612 - DNA, 20 bp, Artificial
  CRISPR gRNA sequence
atacatgaagttcagcacaa

SEQ ID NO: 478613 - DNA, 20 bp, Artificial
  CRISPR gRNA sequence
tacatgaagttcagcacaag

SEQ ID NO: 478614 - DNA, 20 bp, Artificial
  CRISPR gRNA sequence
agcacaagaaaatattcatt

SEQ ID NO: 478615 - DNA, 20 bp, Artificial
  CRISPR gRNA sequence
attgtctatatttcttttct

SEQ ID NO: 478616 - DNA, 20 bp, Artificial
  CRISPR gRNA sequence
tctatatttcttttctggcc

SEQ ID NO: 478617 - DNA, 20 bp, Artificial
  CRISPR gRNA sequence
tatttcttttctggccattt

SEQ ID NO: 478618 - DNA, 20 bp, Artificial
  CRISPR gRNA sequence
cttttctggccattttatta

SEQ ID NO: 478619 - DNA, 20 bp, Artificial
  CRISPR gRNA sequence
ttttctggccattttattac

SEQ ID NO: 478620 - DNA, 20 bp, Artificial
  CRISPR gRNA sequence
ttctggccattttattactt

SEQ ID NO: 478621 - DNA, 20 bp, Artificial
  CRISPR gRNA sequence
tctggccattttattacttg

SEQ ID NO: 478622 - DNA, 20 bp, Artificial
  CRISPR gRNA sequence
ctggccattttattacttgt

SEQ ID NO: 478623 - DNA, 20 bp, Artificial
  CRISPR gRNA sequence
tggccattttattacttgtt

SEQ ID NO: 478624 - DNA, 20 bp, Artificial
  CRISPR gRNA sequence
gccattttattacttgtttt

SEQ ID NO: 478625 - DNA, 20 bp, Artificial
  CRISPR gRNA sequence
tattacttgttttatctcat

SEQ ID NO: 478626 - DNA, 20 bp, Artificial
  CRISPR gRNA sequence
attacttgttttatctcatg

SEQ ID NO: 478627 - DNA, 20 bp, Artificial
  CRISPR gRNA sequence
ttacttgttttatctcatga

SEQ ID NO: 478628 - DNA, 20 bp, Artificial
  CRISPR gRNA sequence
cttgttttatctcatgatta

SEQ ID NO: 478629 - DNA, 20 bp, Artificial
  CRISPR gRNA sequence
gttttatctcatgattattt

SEQ ID NO: 478630 - DNA, 20 bp, Artificial
  CRISPR gRNA sequence
ttttatctcatgattatttc

SEQ ID NO: 478631 - DNA, 20 bp, Artificial
  CRISPR gRNA sequence
tatctcatgattatttctga

SEQ ID NO: 478632 - DNA, 20 bp, Artificial
  CRISPR gRNA sequence
atctcatgattatttctgaa

SEQ ID NO: 478633 - DNA, 20 bp, Artificial
  CRISPR gRNA sequence
tctcatgattatttctgaaa

SEQ ID NO: 478634 - DNA, 20 bp, Artificial
  CRISPR gRNA sequence
atgattatttctgaaaatat

SEQ ID NO: 478635 - DNA, 20 bp, Artificial
  CRISPR gRNA sequence
tttctgaaaatatttttatg

SEQ ID NO: 478636 - DNA, 20 bp, Artificial
  CRISPR gRNA sequence
ctgaaaatatttttatgtat

SEQ ID NO: 478637 - DNA, 20 bp, Artificial
  CRISPR gRNA sequence
tgaaaatatttttatgtata

SEQ ID NO: 478638 - DNA, 20 bp, Artificial
  CRISPR gRNA sequence
aaaatatttttatgtataga

SEQ ID NO: 478639 - DNA, 20 bp, Artificial
  CRISPR gRNA sequence
ttatgtatagagaaaggggt

SEQ ID NO: 478640 - DNA, 20 bp, Artificial
  CRISPR gRNA sequence
tatgtatagagaaaggggtt

SEQ ID NO: 478641 - DNA, 20 bp, Artificial
  CRISPR gRNA sequence
atgtatagagaaaggggttg

SEQ ID NO: 478642 - DNA, 20 bp, Artificial
  CRISPR gRNA sequence
tgtatagagaaaggggttgc

SEQ ID NO: 478643 - DNA, 20 bp, Artificial
  CRISPR gRNA sequence
ctcaaatgatgtactctaga

SEQ ID NO: 478644 - DNA, 20 bp, Artificial
  CRISPR gRNA sequence
aaatgatgtactctagacct

SEQ ID NO: 478645 - DNA, 20 bp, Artificial
  CRISPR gRNA sequence
tagacctaaaataaaatatc

SEQ ID NO: 478646 - DNA, 20 bp, Artificial
  CRISPR gRNA sequence
gacctaaaataaaatatcat

SEQ ID NO: 478647 - DNA, 20 bp, Artificial
  CRISPR gRNA sequence
aaataaaatatcatcggtac

SEQ ID NO: 478648 - DNA, 20 bp, Artificial
  CRISPR gRNA sequence
atcgtggaatatatatacca

SEQ ID NO: 478649 - DNA, 20 bp, Artificial
  CRISPR gRNA sequence
gtggttttgataaaaatttt

SEQ ID NO: 478650 - DNA, 20 bp, Artificial
  CRISPR gRNA sequence
tgataaaaattttaaacatg

SEQ ID NO: 478651 - DNA, 20 bp, Artificial
  CRISPR gRNA sequence
gataaaaattttaaacatga

SEQ ID NO: 478652 - DNA, 20 bp, Artificial
  CRISPR gRNA sequence
ataaaaattttaaacatgaa

SEQ ID NO: 478653 - DNA, 20 bp, Artificial
  CRISPR gRNA sequence
taaacatgaaagaatttcta

SEQ ID NO: 478654 - DNA, 20 bp, Artificial
  CRISPR gRNA sequence
aaacatgaaagaatttctaa

SEQ ID NO: 478655 - DNA, 20 bp, Artificial
  CRISPR gRNA sequence
aacatgaaagaatttctaaa

SEQ ID NO: 478656 - DNA, 20 bp, Artificial
  CRISPR gRNA sequence
ctaaacctatagtgacttaa

SEQ ID NO: 478657 - DNA, 20 bp, Artificial
  CRISPR gRNA sequence
taaacctatagtgacttaac

SEQ ID NO: 478658 - DNA, 20 bp, Artificial
  CRISPR gRNA sequence
aacctatagtgacttaacaa

SEQ ID NO: 478659 - DNA, 20 bp, Artificial
  CRISPR gRNA sequence
tagtgacttaacaagggata

SEQ ID NO: 478660 - DNA, 20 bp, Artificial
  CRISPR gRNA sequence
aacaagggatatttcattat

SEQ ID NO: 478661 - DNA, 20 bp, Artificial
  CRISPR gRNA sequence
acaagggatatttcattata

SEQ ID NO: 478662 - DNA, 20 bp, Artificial
  CRISPR gRNA sequence
cattatataagagcctgggg

SEQ ID NO: 478663 - DNA, 20 bp, Artificial
  CRISPR gRNA sequence
attatataagagcctggggg

SEQ ID NO: 478664 - DNA, 20 bp, Artificial
  CRISPR gRNA sequence
tataagagcctgggggggag

SEQ ID NO: 478665 - DNA, 20 bp, Artificial
  CRISPR gRNA sequence
ggggggagtagaagttttta

SEQ ID NO: 478666 - DNA, 20 bp, Artificial
  CRISPR gRNA sequence
ttattctttgtttgttggtt

SEQ ID NO: 478667 - DNA, 20 bp, Artificial
  CRISPR gRNA sequence
tattctttgtttgttggttt

SEQ ID NO: 478668 - DNA, 20 bp, Artificial
  CRISPR gRNA sequence
attctttgtttgttggtttg

SEQ ID NO: 478669 - DNA, 20 bp, Artificial
  CRISPR gRNA sequence
ttctttgtttgttggtttgt

SEQ ID NO: 478670 - DNA, 20 bp, Artificial
  CRISPR gRNA sequence
tttgtttgttggtttgtttt

SEQ ID NO: 478671 - DNA, 20 bp, Artificial
  CRISPR gRNA sequence
tgtttgttggtttgtttttt

SEQ ID NO: 478672 - DNA, 20 bp, Artificial
  CRISPR gRNA sequence
gtttgttggtttgttttttg

SEQ ID NO: 478673 - DNA, 20 bp, Artificial
  CRISPR gRNA sequence
tttgttggtttgttttttga

SEQ ID NO: 478674 - DNA, 20 bp, Artificial
  CRISPR gRNA sequence
gttggtttgttttttgagat

SEQ ID NO: 478675 - DNA, 20 bp, Artificial
  CRISPR gRNA sequence
ttggtttgttttttgagatg

SEQ ID NO: 478676 - DNA, 20 bp, Artificial
  CRISPR gRNA sequence
gtttgttttttgagatggac

SEQ ID NO: 478677 - DNA, 20 bp, Artificial
  CRISPR gRNA sequence
gttttttgagatggactctc

SEQ ID NO: 478678 - DNA, 20 bp, Artificial
  CRISPR gRNA sequence
ttttttgagatggactctcg

SEQ ID NO: 478679 - DNA, 20 bp, Artificial
  CRISPR gRNA sequence
tttgagatggactctcgctc

SEQ ID NO: 478680 - DNA, 20 bp, Artificial
  CRISPR gRNA sequence
ttgagatggactctcgctct

SEQ ID NO: 478681 - DNA, 20 bp, Artificial
  CRISPR gRNA sequence
tgagatggactctcgctctg

SEQ ID NO: 478682 - DNA, 20 bp, Artificial
  CRISPR gRNA sequence
gagatggactctcgctctgt

SEQ ID NO: 478683 - DNA, 20 bp, Artificial
  CRISPR gRNA sequence
agatggactctcgctctgtc

SEQ ID NO: 478684 - DNA, 20 bp, Artificial
  CRISPR gRNA sequence
tcgctctgtcacccaggctg

SEQ ID NO: 478685 - DNA, 20 bp, Artificial
  CRISPR gRNA sequence
gctctgtcacccaggctgga

SEQ ID NO: 478686 - DNA, 20 bp, Artificial
  CRISPR gRNA sequence
tgtcacccaggctggagtgc

SEQ ID NO: 478687 - DNA, 20 bp, Artificial
  CRISPR gRNA sequence
tcacccaggctggagtgcag

SEQ ID NO: 478688 - DNA, 20 bp, Artificial
  CRISPR gRNA sequence
gagtgcagtggcgcgatcta

SEQ ID NO: 478689 - DNA, 20 bp, Artificial
  CRISPR gRNA sequence
ggctcattggaagctccgcc

SEQ ID NO: 478690 - DNA, 20 bp, Artificial
  CRISPR gRNA sequence
attggaagctccgcctcgcg

SEQ ID NO: 478691 - DNA, 20 bp, Artificial
  CRISPR gRNA sequence
gaagctccgcctcgcgggtt

SEQ ID NO: 478692 - DNA, 20 bp, Artificial
  CRISPR gRNA sequence
cgcctcgcgggttcacgcca

SEQ ID NO: 478693 - DNA, 20 bp, Artificial
  CRISPR gRNA sequence
gcgggttcacgccattctcc

SEQ ID NO: 478694 - DNA, 20 bp, Artificial
  CRISPR gRNA sequence
acgccattctcctgcctcag

SEQ ID NO: 478695 - DNA, 20 bp, Artificial
  CRISPR gRNA sequence
tcctgcctcagtctgccgag

SEQ ID NO: 478696 - DNA, 20 bp, Artificial
  CRISPR gRNA sequence
ctgcctcagtctgccgagca

SEQ ID NO: 478697 - DNA, 20 bp, Artificial
  CRISPR gRNA sequence
cctcagtctgccgagcagct

SEQ ID NO: 478698 - DNA, 20 bp, Artificial
  CRISPR gRNA sequence
agtctgccgagcagctggga

SEQ ID NO: 478699 - DNA, 20 bp, Artificial
  CRISPR gRNA sequence
ccgagcagctgggactacag

SEQ ID NO: 478700 - DNA, 20 bp, Artificial
  CRISPR gRNA sequence
ggactacaggctcccgccac

SEQ ID NO: 478701 - DNA, 20 bp, Artificial
  CRISPR gRNA sequence
caggctcccgccaccacgcc

SEQ ID NO: 478702 - DNA, 20 bp, Artificial
  CRISPR gRNA sequence
ccgccaccacgcccggctaa

SEQ ID NO: 478703 - DNA, 20 bp, Artificial
  CRISPR gRNA sequence
attttttgttttgtattttt

SEQ ID NO: 478704 - DNA, 20 bp, Artificial
  CRISPR gRNA sequence
tttgttttgtatttttagta

SEQ ID NO: 478705 - DNA, 20 bp, Artificial
  CRISPR gRNA sequence
ttgttttgtatttttagtag

SEQ ID NO: 478706 - DNA, 20 bp, Artificial
  CRISPR gRNA sequence
tgttttgtatttttagtaga

SEQ ID NO: 478707 - DNA, 20 bp, Artificial
  CRISPR gRNA sequence
gttttgtatttttagtagag

SEQ ID NO: 478708 - DNA, 20 bp, Artificial
  CRISPR gRNA sequence
ttttgtatttttagtagaga

SEQ ID NO: 478709 - DNA, 20 bp, Artificial
  CRISPR gRNA sequence
tgtatttttagtagagacgg

SEQ ID NO: 478710 - DNA, 20 bp, Artificial
  CRISPR gRNA sequence
gtatttttagtagagacggg

SEQ ID NO: 478711 - DNA, 20 bp, Artificial
  CRISPR gRNA sequence
tatttttagtagagacgggg

SEQ ID NO: 478712 - DNA, 20 bp, Artificial
  CRISPR gRNA sequence
ttagtagagacggggtttca

SEQ ID NO: 478713 - DNA, 20 bp, Artificial
  CRISPR gRNA sequence
tagtagagacggggtttcac

SEQ ID NO: 478714 - DNA, 20 bp, Artificial
  CRISPR gRNA sequence
agtagagacggggtttcacc

SEQ ID NO: 478715 - DNA, 20 bp, Artificial
  CRISPR gRNA sequence
gtagagacggggtttcaccg

SEQ ID NO: 478716 - DNA, 20 bp, Artificial
  CRISPR gRNA sequence
caccgtgttagccgggatgg

SEQ ID NO: 478717 - DNA, 20 bp, Artificial
  CRISPR gRNA sequence
accgtgttagccgggatggt

SEQ ID NO: 478718 - DNA, 20 bp, Artificial
  CRISPR gRNA sequence
gccgggatggtctctatctc

SEQ ID NO: 478719 - DNA, 20 bp, Artificial
  CRISPR gRNA sequence
tatctcctgacctcgtgatc

SEQ ID NO: 478720 - DNA, 20 bp, Artificial
  CRISPR gRNA sequence
tctcctgacctcgtgatcca

SEQ ID NO: 478721 - DNA, 20 bp, Artificial
  CRISPR gRNA sequence
ctgacctcgtgatccactcg

SEQ ID NO: 478722 - DNA, 20 bp, Artificial
  CRISPR gRNA sequence
acctcgtgatccactcgcct

SEQ ID NO: 478723 - DNA, 20 bp, Artificial
  CRISPR gRNA sequence
gtgatccactcgcctcggcc

SEQ ID NO: 478724 - DNA, 20 bp, Artificial
  CRISPR gRNA sequence
gcctcggcctcccaaagtgc

SEQ ID NO: 478725 - DNA, 20 bp, Artificial
  CRISPR gRNA sequence
ggcctcccaaagtgctggga

SEQ ID NO: 478726 - DNA, 20 bp, Artificial
  CRISPR gRNA sequence
ccaaagtgctgggaccacag

SEQ ID NO: 478727 - DNA, 20 bp, Artificial
  CRISPR gRNA sequence
ggaccacaggcgtgagccac

SEQ ID NO: 478728 - DNA, 20 bp, Artificial
  CRISPR gRNA sequence
ttattcttttactgcatgta

SEQ ID NO: 478729 - DNA, 20 bp, Artificial
  CRISPR gRNA sequence
tattcttttactgcatgtat

SEQ ID NO: 478730 - DNA, 20 bp, Artificial
  CRISPR gRNA sequence
attcttttactgcatgtatt

SEQ ID NO: 478731 - DNA, 20 bp, Artificial
  CRISPR gRNA sequence
ttcttttactgcatgtattt

SEQ ID NO: 478732 - DNA, 20 bp, Artificial
  CRISPR gRNA sequence
ttttactgcatgtatttatt

SEQ ID NO: 478733 - DNA, 20 bp, Artificial
  CRISPR gRNA sequence
ttactgcatgtatttatttt

SEQ ID NO: 478734 - DNA, 20 bp, Artificial
  CRISPR gRNA sequence
tactgcatgtatttatttta

SEQ ID NO: 478735 - DNA, 20 bp, Artificial
  CRISPR gRNA sequence
actgcatgtatttattttaa

SEQ ID NO: 478736 - DNA, 20 bp, Artificial
  CRISPR gRNA sequence
ctgcatgtatttattttaat

SEQ ID NO: 478737 - DNA, 20 bp, Artificial
  CRISPR gRNA sequence
catgtatttattttaatcat

SEQ ID NO: 478738 - DNA, 20 bp, Artificial
  CRISPR gRNA sequence
attttaatcatttttagcat

SEQ ID NO: 478739 - DNA, 20 bp, Artificial
  CRISPR gRNA sequence
ttttaatcatttttagcatt

SEQ ID NO: 478740 - DNA, 20 bp, Artificial
  CRISPR gRNA sequence
taatcatttttagcattgaa

SEQ ID NO: 478741 - DNA, 20 bp, Artificial
  CRISPR gRNA sequence
aatcatttttagcattgaaa

SEQ ID NO: 478742 - DNA, 20 bp, Artificial
  CRISPR gRNA sequence
atcatttttagcattgaaaa

SEQ ID NO: 478743 - DNA, 20 bp, Artificial
  CRISPR gRNA sequence
ttagcattgaaaatttcctg

SEQ ID NO: 478744 - DNA, 20 bp, Artificial
  CRISPR gRNA sequence
tagcattgaaaatttcctgt

SEQ ID NO: 478745 - DNA, 20 bp, Artificial
  CRISPR gRNA sequence
agcattgaaaatttcctgtc

SEQ ID NO: 478746 - DNA, 20 bp, Artificial
  CRISPR gRNA sequence
gcattgaaaatttcctgtca

SEQ ID NO: 478747 - DNA, 20 bp, Artificial
  CRISPR gRNA sequence
aaaatttcctgtcatcagat

SEQ ID NO: 478748 - DNA, 20 bp, Artificial
  CRISPR gRNA sequence
cctgtcatcagatatgaatg

SEQ ID NO: 478749 - DNA, 20 bp, Artificial
  CRISPR gRNA sequence
ctgtcatcagatatgaatgc

SEQ ID NO: 478750 - DNA, 20 bp, Artificial
  CRISPR gRNA sequence
tcatcagatatgaatgcttg

SEQ ID NO: 478751 - DNA, 20 bp, Artificial
  CRISPR gRNA sequence
gagaaaaacagcagagataa

SEQ ID NO: 478752 - DNA, 20 bp, Artificial
  CRISPR gRNA sequence
agaaaaacagcagagataat

SEQ ID NO: 478753 - DNA, 20 bp, Artificial
  CRISPR gRNA sequence
atggttccggctacttggga

SEQ ID NO: 478754 - DNA, 20 bp, Artificial
  CRISPR gRNA sequence
cggctacttgggaggctgag

SEQ ID NO: 478755 - DNA, 20 bp, Artificial
  CRISPR gRNA sequence
cttgggaggctgaggcagga

SEQ ID NO: 478756 - DNA, 20 bp, Artificial
  CRISPR gRNA sequence
gggaggctgaggcaggagaa

SEQ ID NO: 478757 - DNA, 20 bp, Artificial
  CRISPR gRNA sequence
ggaggctgaggcaggagaat

SEQ ID NO: 478758 - DNA, 20 bp, Artificial
  CRISPR gRNA sequence
aggcaggagaatcgcttgaa

SEQ ID NO: 478759 - DNA, 20 bp, Artificial
  CRISPR gRNA sequence
gaacccggggatggaggttg

SEQ ID NO: 478760 - DNA, 20 bp, Artificial
  CRISPR gRNA sequence
aacccggggatggaggttgc

SEQ ID NO: 478761 - DNA, 20 bp, Artificial
  CRISPR gRNA sequence
cagtgaaccgagatcgctcc

SEQ ID NO: 478762 - DNA, 20 bp, Artificial
  CRISPR gRNA sequence
cattgcactccagcctgggc

SEQ ID NO: 478763 - DNA, 20 bp, Artificial
  CRISPR gRNA sequence
cactccagcctgggcaacaa

SEQ ID NO: 478764 - DNA, 20 bp, Artificial
  CRISPR gRNA sequence
cagcctgggcaacaagagca

SEQ ID NO: 478765 - DNA, 20 bp, Artificial
  CRISPR gRNA sequence
ggcaacaagagcaaaactcc

SEQ ID NO: 478766 - DNA, 20 bp, Artificial
  CRISPR gRNA sequence
cgtctcaaaaaatacataaa

SEQ ID NO: 478767 - DNA, 20 bp, Artificial
  CRISPR gRNA sequence
aaaaaatacataaataaaaa

SEQ ID NO: 478768 - DNA, 20 bp, Artificial
  CRISPR gRNA sequence
ataattggaagttgagtaac

SEQ ID NO: 478769 - DNA, 20 bp, Artificial
  CRISPR gRNA sequence
gaagttgagtaacagccaaa

SEQ ID NO: 478770 - DNA, 20 bp, Artificial
  CRISPR gRNA sequence
agtaacagccaaaagcaact

SEQ ID NO: 478771 - DNA, 20 bp, Artificial
  CRISPR gRNA sequence
tgatagttattcctcttcgg

SEQ ID NO: 478772 - DNA, 20 bp, Artificial
  CRISPR gRNA sequence
ttcctcttcgggaaatattt

SEQ ID NO: 478773 - DNA, 20 bp, Artificial
  CRISPR gRNA sequence
ctcttcgggaaatatttatt

SEQ ID NO: 478774 - DNA, 20 bp, Artificial
  CRISPR gRNA sequence
ttcgggaaatatttatttga

SEQ ID NO: 478775 - DNA, 20 bp, Artificial
  CRISPR gRNA sequence
cgggaaatatttatttgata

SEQ ID NO: 478776 - DNA, 20 bp, Artificial
  CRISPR gRNA sequence
gggaaatatttatttgataa

SEQ ID NO: 478777 - DNA, 20 bp, Artificial
  CRISPR gRNA sequence
atttgataagacaaactttt

SEQ ID NO: 478778 - DNA, 20 bp, Artificial
  CRISPR gRNA sequence
tttgataagacaaacttttg

SEQ ID NO: 478779 - DNA, 20 bp, Artificial
  CRISPR gRNA sequence
gataagacaaacttttgggg

SEQ ID NO: 478780 - DNA, 20 bp, Artificial
  CRISPR gRNA sequence
ataagacaaacttttggggg

SEQ ID NO: 478781 - DNA, 20 bp, Artificial
  CRISPR gRNA sequence
ttgggggatagctttgtgtg

SEQ ID NO: 478782 - DNA, 20 bp, Artificial
  CRISPR gRNA sequence
tgggggatagctttgtgtgt

SEQ ID NO: 478783 - DNA, 20 bp, Artificial
  CRISPR gRNA sequence
gggggatagctttgtgtgtc

SEQ ID NO: 478784 - DNA, 20 bp, Artificial
  CRISPR gRNA sequence
ggggatagctttgtgtgtcc

SEQ ID NO: 478785 - DNA, 20 bp, Artificial
  CRISPR gRNA sequence
tgtgtgtcctaagtatcata

SEQ ID NO: 478786 - DNA, 20 bp, Artificial
  CRISPR gRNA sequence
gtgtgtcctaagtatcataa

SEQ ID NO: 478787 - DNA, 20 bp, Artificial
  CRISPR gRNA sequence
tgtgtcctaagtatcataag

SEQ ID NO: 478788 - DNA, 20 bp, Artificial
  CRISPR gRNA sequence
agtatcataagatggatatg

SEQ ID NO: 478789 - DNA, 20 bp, Artificial
  CRISPR gRNA sequence
agaacaggcagaaaaggggt

SEQ ID NO: 478790 - DNA, 20 bp, Artificial
  CRISPR gRNA sequence
acaagcttgtcagatggaca

SEQ ID NO: 478791 - DNA, 20 bp, Artificial
  CRISPR gRNA sequence
gtcagatggacaattagaat

SEQ ID NO: 478792 - DNA, 20 bp, Artificial
  CRISPR gRNA sequence
tcagatggacaattagaatt

SEQ ID NO: 478793 - DNA, 20 bp, Artificial
  CRISPR gRNA sequence
gaattgtgctatttgtcggc

SEQ ID NO: 478794 - DNA, 20 bp, Artificial
  CRISPR gRNA sequence
tgctatttgtcggccaggcc

SEQ ID NO: 478795 - DNA, 20 bp, Artificial
  CRISPR gRNA sequence
tttgtcggccaggccggtgg

SEQ ID NO: 478796 - DNA, 20 bp, Artificial
  CRISPR gRNA sequence
gtcggccaggccggtggctc

SEQ ID NO: 478797 - DNA, 20 bp, Artificial
  CRISPR gRNA sequence
tcggccaggccggtggctca

SEQ ID NO: 478798 - DNA, 20 bp, Artificial
  CRISPR gRNA sequence
actcctgtaatcccagcact

SEQ ID NO: 478799 - DNA, 20 bp, Artificial
  CRISPR gRNA sequence
ctgtaatcccagcactttgt

SEQ ID NO: 478800 - DNA, 20 bp, Artificial
  CRISPR gRNA sequence
taatcccagcactttgtgag

SEQ ID NO: 478801 - DNA, 20 bp, Artificial
  CRISPR gRNA sequence
tgtgaggcagaggcgggtgg

SEQ ID NO: 478802 - DNA, 20 bp, Artificial
  CRISPR gRNA sequence
gtgaggcagaggcgggtgga

SEQ ID NO: 478803 - DNA, 20 bp, Artificial
  CRISPR gRNA sequence
tgaggcagaggcgggtggat

SEQ ID NO: 478804 - DNA, 20 bp, Artificial
  CRISPR gRNA sequence
aggtcaggagttcgagatca

SEQ ID NO: 478805 - DNA, 20 bp, Artificial
  CRISPR gRNA sequence
gagatcagcctggctaacat

SEQ ID NO: 478806 - DNA, 20 bp, Artificial
  CRISPR gRNA sequence
gctaacatggcgaaaccccg

SEQ ID NO: 478807 - DNA, 20 bp, Artificial
  CRISPR gRNA sequence
acatggcgaaaccccgtccc

SEQ ID NO: 478808 - DNA, 20 bp, Artificial
  CRISPR gRNA sequence
ctaaaaatacaaaaattagc

SEQ ID NO: 478809 - DNA, 20 bp, Artificial
  CRISPR gRNA sequence
aaaatacaaaaattagccgg

SEQ ID NO: 478810 - DNA, 20 bp, Artificial
  CRISPR gRNA sequence
gccgggcgtggttgtgggtg

SEQ ID NO: 478811 - DNA, 20 bp, Artificial
  CRISPR gRNA sequence
tgggtgcctgtaatcccagc

SEQ ID NO: 478812 - DNA, 20 bp, Artificial
  CRISPR gRNA sequence
taatcccagccaccggggag

SEQ ID NO: 478813 - DNA, 20 bp, Artificial
  CRISPR gRNA sequence
aggcaggagaatcgcttgaa

SEQ ID NO: 478814 - DNA, 20 bp, Artificial
  CRISPR gRNA sequence
gaacctgggaggcggaggct

SEQ ID NO: 478815 - DNA, 20 bp, Artificial
  CRISPR gRNA sequence
aacctgggaggcggaggctg

SEQ ID NO: 478816 - DNA, 20 bp, Artificial
  CRISPR gRNA sequence
ggaggcggaggctgcagtga

SEQ ID NO: 478817 - DNA, 20 bp, Artificial
  CRISPR gRNA sequence
cagtgagccgaaattgcatc

SEQ ID NO: 478818 - DNA, 20 bp, Artificial
  CRISPR gRNA sequence
catcactgtactccagcctg

SEQ ID NO: 478819 - DNA, 20 bp, Artificial
  CRISPR gRNA sequence
tactccagcctgggcaacaa

SEQ ID NO: 478820 - DNA, 20 bp, Artificial
  CRISPR gRNA sequence
cagcctgggcaacaagagcg

SEQ ID NO: 478821 - DNA, 20 bp, Artificial
  CRISPR gRNA sequence
ggcaacaagagcgagacttc

SEQ ID NO: 478822 - DNA, 20 bp, Artificial
  CRISPR gRNA sequence
catctcaaaaaaaataaatt

SEQ ID NO: 478823 - DNA, 20 bp, Artificial
  CRISPR gRNA sequence
atctcaaaaaaaataaatta

SEQ ID NO: 478824 - DNA, 20 bp, Artificial
  CRISPR gRNA sequence
aaaaaaaataaattaattaa

SEQ ID NO: 478825 - DNA, 20 bp, Artificial
  CRISPR gRNA sequence
attaaaaaaaatagaattgt

SEQ ID NO: 478826 - DNA, 20 bp, Artificial
  CRISPR gRNA sequence
aaaaaaatagaattgtgcta

SEQ ID NO: 478827 - DNA, 20 bp, Artificial
  CRISPR gRNA sequence
tgctatttgtctcagtgtgt

SEQ ID NO: 478828 - DNA, 20 bp, Artificial
  CRISPR gRNA sequence
tttgtctcagtgtgtcattt

SEQ ID NO: 478829 - DNA, 20 bp, Artificial
  CRISPR gRNA sequence
gtctcagtgtgtcattttta

SEQ ID NO: 478830 - DNA, 20 bp, Artificial
  CRISPR gRNA sequence
tctcagtgtgtcatttttac

SEQ ID NO: 478831 - DNA, 20 bp, Artificial
  CRISPR gRNA sequence
agtgtgtcatttttacacta

SEQ ID NO: 478832 - DNA, 20 bp, Artificial
  CRISPR gRNA sequence
ttacactacaaacatcagtg

SEQ ID NO: 478833 - DNA, 20 bp, Artificial
  CRISPR gRNA sequence
tacactacaaacatcagtgt

SEQ ID NO: 478834 - DNA, 20 bp, Artificial
  CRISPR gRNA sequence
acactacaaacatcagtgtt

SEQ ID NO: 478835 - DNA, 20 bp, Artificial
  CRISPR gRNA sequence
cactacaaacatcagtgtta

SEQ ID NO: 478836 - DNA, 20 bp, Artificial
  CRISPR gRNA sequence
caaacatcagtgttagcctc

SEQ ID NO: 478837 - DNA, 20 bp, Artificial
  CRISPR gRNA sequence
gcctctgagagataggaggt

SEQ ID NO: 478838 - DNA, 20 bp, Artificial
  CRISPR gRNA sequence
tgagagataggaggtattat

SEQ ID NO: 478839 - DNA, 20 bp, Artificial
  CRISPR gRNA sequence
agagataggaggtattataa

SEQ ID NO: 478840 - DNA, 20 bp, Artificial
  CRISPR gRNA sequence
taataccttgtttgtgcaca

SEQ ID NO: 478841 - DNA, 20 bp, Artificial
  CRISPR gRNA sequence
gtttgtgcacagagggagta

SEQ ID NO: 478842 - DNA, 20 bp, Artificial
  CRISPR gRNA sequence
tttgtgcacagagggagtac

SEQ ID NO: 478843 - DNA, 20 bp, Artificial
  CRISPR gRNA sequence
gtgcacagagggagtactct

SEQ ID NO: 478844 - DNA, 20 bp, Artificial
  CRISPR gRNA sequence
tgcacagagggagtactctt

SEQ ID NO: 478845 - DNA, 20 bp, Artificial
  CRISPR gRNA sequence
ttgatttctaatgcctgctt

SEQ ID NO: 478846 - DNA, 20 bp, Artificial
  CRISPR gRNA sequence
gatttctaatgcctgcttgc

SEQ ID NO: 478847 - DNA, 20 bp, Artificial
  CRISPR gRNA sequence
atttctaatgcctgcttgca

SEQ ID NO: 478848 - DNA, 20 bp, Artificial
  CRISPR gRNA sequence
ctaatgcctgcttgcaagcc

SEQ ID NO: 478849 - DNA, 20 bp, Artificial
  CRISPR gRNA sequence
taatgcctgcttgcaagcct

SEQ ID NO: 478850 - DNA, 20 bp, Artificial
  CRISPR gRNA sequence
atgcctgcttgcaagcctac

SEQ ID NO: 478851 - DNA, 20 bp, Artificial
  CRISPR gRNA sequence
cttgcaagcctacattcatc

SEQ ID NO: 478852 - DNA, 20 bp, Artificial
  CRISPR gRNA sequence
gcaagcctacattcatcatc

SEQ ID NO: 478853 - DNA, 20 bp, Artificial
  CRISPR gRNA sequence
caagcctacattcatcatcg

SEQ ID NO: 478854 - DNA, 20 bp, Artificial
  CRISPR gRNA sequence
cattcatcatcggttcattc

SEQ ID NO: 478855 - DNA, 20 bp, Artificial
  CRISPR gRNA sequence
atcatcggttcattcctcca

SEQ ID NO: 478856 - DNA, 20 bp, Artificial
  CRISPR gRNA sequence
attcctccattcaagaaaaa

SEQ ID NO: 478857 - DNA, 20 bp, Artificial
  CRISPR gRNA sequence
ctccattcaagaaaaattcc

SEQ ID NO: 478858 - DNA, 20 bp, Artificial
  CRISPR gRNA sequence
cattcaagaaaaattcctgt

SEQ ID NO: 478859 - DNA, 20 bp, Artificial
  CRISPR gRNA sequence
aagaaaaattcctgtgccag

SEQ ID NO: 478860 - DNA, 20 bp, Artificial
  CRISPR gRNA sequence
ctgtgccagtcagtgtggtt

SEQ ID NO: 478861 - DNA, 20 bp, Artificial
  CRISPR gRNA sequence
tgccagtcagtgtggttgtc

SEQ ID NO: 478862 - DNA, 20 bp, Artificial
  CRISPR gRNA sequence
tcaatgatcattatcctgct

SEQ ID NO: 478863 - DNA, 20 bp, Artificial
  CRISPR gRNA sequence
tcctgctgataagaatattt

SEQ ID NO: 478864 - DNA, 20 bp, Artificial
  CRISPR gRNA sequence
ctgataagaatatttaggaa

SEQ ID NO: 478865 - DNA, 20 bp, Artificial
  CRISPR gRNA sequence
ataagaatatttaggaactg

SEQ ID NO: 478866 - DNA, 20 bp, Artificial
  CRISPR gRNA sequence
aggaactgcaatgtttccat

SEQ ID NO: 478867 - DNA, 20 bp, Artificial
  CRISPR gRNA sequence
ggaactgcaatgtttccata

SEQ ID NO: 478868 - DNA, 20 bp, Artificial
  CRISPR gRNA sequence
caatgtttccataatcctat

SEQ ID NO: 478869 - DNA, 20 bp, Artificial
  CRISPR gRNA sequence
ccataatcctattgtgaatc

SEQ ID NO: 478870 - DNA, 20 bp, Artificial
  CRISPR gRNA sequence
cataatcctattgtgaatca

SEQ ID NO: 478871 - DNA, 20 bp, Artificial
  CRISPR gRNA sequence
ttgtgaatcagtgatgccac

SEQ ID NO: 478872 - DNA, 20 bp, Artificial
  CRISPR gRNA sequence
tgaatcagtgatgccaccaa

SEQ ID NO: 478873 - DNA, 20 bp, Artificial
  CRISPR gRNA sequence
gctcttttctccacccctaa

SEQ ID NO: 478874 - DNA, 20 bp, Artificial
  CRISPR gRNA sequence
ttttctccacccctaaccca

SEQ ID NO: 478875 - DNA, 20 bp, Artificial
  CRISPR gRNA sequence
ttctccacccctaacccact

SEQ ID NO: 478876 - DNA, 20 bp, Artificial
  CRISPR gRNA sequence
tctccacccctaacccactt

SEQ ID NO: 478877 - DNA, 20 bp, Artificial
  CRISPR gRNA sequence
ctccacccctaacccacttt

SEQ ID NO: 478878 - DNA, 20 bp, Artificial
  CRISPR gRNA sequence
tccacccctaacccactttg

SEQ ID NO: 478879 - DNA, 20 bp, Artificial
  CRISPR gRNA sequence
cacccctaacccactttgcg

SEQ ID NO: 478880 - DNA, 20 bp, Artificial
  CRISPR gRNA sequence
acccactttgcgcactgctc

SEQ ID NO: 478881 - DNA, 20 bp, Artificial
  CRISPR gRNA sequence
tgcgcactgctccggagcat

SEQ ID NO: 478882 - DNA, 20 bp, Artificial
  CRISPR gRNA sequence
gcgcactgctccggagcata

SEQ ID NO: 478883 - DNA, 20 bp, Artificial
  CRISPR gRNA sequence
cgcactgctccggagcatac

SEQ ID NO: 478884 - DNA, 20 bp, Artificial
  CRISPR gRNA sequence
ctccggagcatacagtcaca

SEQ ID NO: 478885 - DNA, 20 bp, Artificial
  CRISPR gRNA sequence
cggagcatacagtcacaaaa

SEQ ID NO: 478886 - DNA, 20 bp, Artificial
  CRISPR gRNA sequence
gaagtgatgtctaattgtgc

SEQ ID NO: 478887 - DNA, 20 bp, Artificial
  CRISPR gRNA sequence
aagtgatgtctaattgtgcc

SEQ ID NO: 478888 - DNA, 20 bp, Artificial
  CRISPR gRNA sequence
attgtgccactaacatcaag

SEQ ID NO: 478889 - DNA, 20 bp, Artificial
  CRISPR gRNA sequence
tgccactaacatcaagtgat

SEQ ID NO: 478890 - DNA, 20 bp, Artificial
  CRISPR gRNA sequence
acatcaagtgatagccctat

SEQ ID NO: 478891 - DNA, 20 bp, Artificial
  CRISPR gRNA sequence
tggctaaatagaaaggtaat

SEQ ID NO: 478892 - DNA, 20 bp, Artificial
  CRISPR gRNA sequence
aatagaaaggtaatatattg

SEQ ID NO: 478893 - DNA, 20 bp, Artificial
  CRISPR gRNA sequence
tgataggaatagaaattgca

SEQ ID NO: 478894 - DNA, 20 bp, Artificial
  CRISPR gRNA sequence
caggctagaagtggtttcgt

SEQ ID NO: 478895 - DNA, 20 bp, Artificial
  CRISPR gRNA sequence
gaagtggtttcgtagtttca

SEQ ID NO: 478896 - DNA, 20 bp, Artificial
  CRISPR gRNA sequence
cgtagtttcagtcacacatt

SEQ ID NO: 478897 - DNA, 20 bp, Artificial
  CRISPR gRNA sequence
gtagtttcagtcacacatta

SEQ ID NO: 478898 - DNA, 20 bp, Artificial
  CRISPR gRNA sequence
cagtcacacattaaggaagg

SEQ ID NO: 478899 - DNA, 20 bp, Artificial
  CRISPR gRNA sequence
agtcacacattaaggaaggt

SEQ ID NO: 478900 - DNA, 20 bp, Artificial
  CRISPR gRNA sequence
aggaaggtgaagttgtgtgt

SEQ ID NO: 478901 - DNA, 20 bp, Artificial
  CRISPR gRNA sequence
tgtgtgtttgtgtggtcagg

SEQ ID NO: 478902 - DNA, 20 bp, Artificial
  CRISPR gRNA sequence
gtgtggtcaggggatggtga

SEQ ID NO: 478903 - DNA, 20 bp, Artificial
  CRISPR gRNA sequence
tgtggtcaggggatggtgag

SEQ ID NO: 478904 - DNA, 20 bp, Artificial
  CRISPR gRNA sequence
gaactttcctacttttacag

SEQ ID NO: 478905 - DNA, 20 bp, Artificial
  CRISPR gRNA sequence
tcctacttttacagttcaat

SEQ ID NO: 478906 - DNA, 20 bp, Artificial
  CRISPR gRNA sequence
cctacttttacagttcaatc

SEQ ID NO: 478907 - DNA, 20 bp, Artificial
  CRISPR gRNA sequence
ctacttttacagttcaatcc

SEQ ID NO: 478908 - DNA, 20 bp, Artificial
  CRISPR gRNA sequence
cttttacagttcaatccttt

SEQ ID NO: 478909 - DNA, 20 bp, Artificial
  CRISPR gRNA sequence
ttacagttcaatcctttcat

SEQ ID NO: 478910 - DNA, 20 bp, Artificial
  CRISPR gRNA sequence
tacagttcaatcctttcatc

SEQ ID NO: 478911 - DNA, 20 bp, Artificial
  CRISPR gRNA sequence
acagttcaatcctttcatct

SEQ ID NO: 478912 - DNA, 20 bp, Artificial
  CRISPR gRNA sequence
cagttcaatcctttcatctt

SEQ ID NO: 478913 - DNA, 20 bp, Artificial
  CRISPR gRNA sequence
aatcctttcatcttattttg

SEQ ID NO: 478914 - DNA, 20 bp, Artificial
  CRISPR gRNA sequence
tcatcttattttgaagaaac

SEQ ID NO: 478915 - DNA, 20 bp, Artificial
  CRISPR gRNA sequence
catcttattttgaagaaact

SEQ ID NO: 478916 - DNA, 20 bp, Artificial
  CRISPR gRNA sequence
atcttattttgaagaaactg

SEQ ID NO: 478917 - DNA, 20 bp, Artificial
  CRISPR gRNA sequence
attttgaagaaactgaggac

SEQ ID NO: 478918 - DNA, 20 bp, Artificial
  CRISPR gRNA sequence
ttttgaagaaactgaggacc

SEQ ID NO: 478919 - DNA, 20 bp, Artificial
  CRISPR gRNA sequence
tgaagaaactgaggaccagc

SEQ ID NO: 478920 - DNA, 20 bp, Artificial
  CRISPR gRNA sequence
gaagaaactgaggaccagca

SEQ ID NO: 478921 - DNA, 20 bp, Artificial
  CRISPR gRNA sequence
aagaaactgaggaccagcaa

SEQ ID NO: 478922 - DNA, 20 bp, Artificial
  CRISPR gRNA sequence
aggaccagcaaaactggggg

SEQ ID NO: 478923 - DNA, 20 bp, Artificial
  CRISPR gRNA sequence
ggggactatcaaattcgctc

SEQ ID NO: 478924 - DNA, 20 bp, Artificial
  CRISPR gRNA sequence
tcaaattcgctcaatgtgtt

SEQ ID NO: 478925 - DNA, 20 bp, Artificial
  CRISPR gRNA sequence
gctcaatgtgttagcatttg

SEQ ID NO: 478926 - DNA, 20 bp, Artificial
  CRISPR gRNA sequence
aatgtgttagcatttgaaac

SEQ ID NO: 478927 - DNA, 20 bp, Artificial
  CRISPR gRNA sequence
gcatttgaaacagacatgtt

SEQ ID NO: 478928 - DNA, 20 bp, Artificial
  CRISPR gRNA sequence
gaaacagacatgttcaaatg

SEQ ID NO: 478929 - DNA, 20 bp, Artificial
  CRISPR gRNA sequence
aaacagacatgttcaaatga

SEQ ID NO: 478930 - DNA, 20 bp, Artificial
  CRISPR gRNA sequence
aaatgaatagtctcatttgt

SEQ ID NO: 478931 - DNA, 20 bp, Artificial
  CRISPR gRNA sequence
atttgtagctatttccgtgc

SEQ ID NO: 478932 - DNA, 20 bp, Artificial
  CRISPR gRNA sequence
gtagctatttccgtgccctt

SEQ ID NO: 478933 - DNA, 20 bp, Artificial
  CRISPR gRNA sequence
tagctatttccgtgcccttt

SEQ ID NO: 478934 - DNA, 20 bp, Artificial
  CRISPR gRNA sequence
tttccgtgccctttataaat

SEQ ID NO: 478935 - DNA, 20 bp, Artificial
  CRISPR gRNA sequence
ccgtgccctttataaatatc

SEQ ID NO: 478936 - DNA, 20 bp, Artificial
  CRISPR gRNA sequence
cgtgccctttataaatatcc

SEQ ID NO: 478937 - DNA, 20 bp, Artificial
  CRISPR gRNA sequence
tataaatatccccccaaaat

SEQ ID NO: 478938 - DNA, 20 bp, Artificial
  CRISPR gRNA sequence
ataaatatccccccaaaatt

SEQ ID NO: 478939 - DNA, 20 bp, Artificial
  CRISPR gRNA sequence
taaatatccccccaaaatta

SEQ ID NO: 478940 - DNA, 20 bp, Artificial
  CRISPR gRNA sequence
ggcattgtattttctcatgg

SEQ ID NO: 478941 - DNA, 20 bp, Artificial
  CRISPR gRNA sequence
tattttctcatggtggataa

SEQ ID NO: 478942 - DNA, 20 bp, Artificial
  CRISPR gRNA sequence
tctcatggtggataagcaaa

SEQ ID NO: 478943 - DNA, 20 bp, Artificial
  CRISPR gRNA sequence
ctcatggtggataagcaaag

SEQ ID NO: 478944 - DNA, 20 bp, Artificial
  CRISPR gRNA sequence
tcatggtggataagcaaagt

SEQ ID NO: 478945 - DNA, 20 bp, Artificial
  CRISPR gRNA sequence
atggtggataagcaaagttt

SEQ ID NO: 478946 - DNA, 20 bp, Artificial
  CRISPR gRNA sequence
aaactcctgcctaatgctta

SEQ ID NO: 478947 - DNA, 20 bp, Artificial
  CRISPR gRNA sequence
aactcctgcctaatgcttat

SEQ ID NO: 478948 - DNA, 20 bp, Artificial
  CRISPR gRNA sequence
ctgcctaatgcttattccat

SEQ ID NO: 478949 - DNA, 20 bp, Artificial
  CRISPR gRNA sequence
cctaatgcttattccatttg

SEQ ID NO: 478950 - DNA, 20 bp, Artificial
  CRISPR gRNA sequence
atgcttattccatttgttct

SEQ ID NO: 478951 - DNA, 20 bp, Artificial
  CRISPR gRNA sequence
attccatttgttctgaaaca

SEQ ID NO: 478952 - DNA, 20 bp, Artificial
  CRISPR gRNA sequence
ttccatttgttctgaaacaa

SEQ ID NO: 478953 - DNA, 20 bp, Artificial
  CRISPR gRNA sequence
catttgttctgaaacaacca

SEQ ID NO: 478954 - DNA, 20 bp, Artificial
  CRISPR gRNA sequence
gttctgaaacaaccagtggt

SEQ ID NO: 478955 - DNA, 20 bp, Artificial
  CRISPR gRNA sequence
ttctgaaacaaccagtggtc

SEQ ID NO: 478956 - DNA, 20 bp, Artificial
  CRISPR gRNA sequence
tgaaacaaccagtggtctcc

SEQ ID NO: 478957 - DNA, 20 bp, Artificial
  CRISPR gRNA sequence
aaacaaccagtggtctccat

SEQ ID NO: 478958 - DNA, 20 bp, Artificial
  CRISPR gRNA sequence
catatcactaagtcagaaaa

SEQ ID NO: 478959 - DNA, 20 bp, Artificial
  CRISPR gRNA sequence
agtcagaaaaccatgatcca

SEQ ID NO: 478960 - DNA, 20 bp, Artificial
  CRISPR gRNA sequence
tgtatcaatgatctaaatct

SEQ ID NO: 478961 - DNA, 20 bp, Artificial
  CRISPR gRNA sequence
aatctatcatgagattcctg

SEQ ID NO: 478962 - DNA, 20 bp, Artificial
  CRISPR gRNA sequence
tcatgagattcctggtccct

SEQ ID NO: 478963 - DNA, 20 bp, Artificial
  CRISPR gRNA sequence
ctggtccctaagacttttcc

SEQ ID NO: 478964 - DNA, 20 bp, Artificial
  CRISPR gRNA sequence
gtccctaagacttttccgtt

SEQ ID NO: 478965 - DNA, 20 bp, Artificial
  CRISPR gRNA sequence
agacttttccgttccatttc

SEQ ID NO: 478966 - DNA, 20 bp, Artificial
  CRISPR gRNA sequence
ttccgttccatttcctcact

SEQ ID NO: 478967 - DNA, 20 bp, Artificial
  CRISPR gRNA sequence
tccgttccatttcctcactc

SEQ ID NO: 478968 - DNA, 20 bp, Artificial
  CRISPR gRNA sequence
ccgttccatttcctcactct

SEQ ID NO: 478969 - DNA, 20 bp, Artificial
  CRISPR gRNA sequence
cgttccatttcctcactctt

SEQ ID NO: 478970 - DNA, 20 bp, Artificial
  CRISPR gRNA sequence
catttcctcactcttaaaat

SEQ ID NO: 478971 - DNA, 20 bp, Artificial
  CRISPR gRNA sequence
cctcactcttaaaatacctc

SEQ ID NO: 478972 - DNA, 20 bp, Artificial
  CRISPR gRNA sequence
ctcactcttaaaatacctcc

SEQ ID NO: 478973 - DNA, 20 bp, Artificial
  CRISPR gRNA sequence
actcttaaaatacctcctct

SEQ ID NO: 478974 - DNA, 20 bp, Artificial
  CRISPR gRNA sequence
ttaaaatacctcctctgtcc

SEQ ID NO: 478975 - DNA, 20 bp, Artificial
  CRISPR gRNA sequence
aaaatacctcctctgtccca

SEQ ID NO: 478976 - DNA, 20 bp, Artificial
  CRISPR gRNA sequence
aaatacctcctctgtcccat

SEQ ID NO: 478977 - DNA, 20 bp, Artificial
  CRISPR gRNA sequence
ctctgtcccatgcactgctc

SEQ ID NO: 478978 - DNA, 20 bp, Artificial
  CRISPR gRNA sequence
tgtcccatgcactgctctga

SEQ ID NO: 478979 - DNA, 20 bp, Artificial
  CRISPR gRNA sequence
tcccatgcactgctctgatt

SEQ ID NO: 478980 - DNA, 20 bp, Artificial
  CRISPR gRNA sequence
ctctgattgccaaagggcta

SEQ ID NO: 478981 - DNA, 20 bp, Artificial
  CRISPR gRNA sequence
tgattgccaaagggctactc

SEQ ID NO: 478982 - DNA, 20 bp, Artificial
  CRISPR gRNA sequence
attgccaaagggctactcat

SEQ ID NO: 478983 - DNA, 20 bp, Artificial
  CRISPR gRNA sequence
ccaaagggctactcattcac

SEQ ID NO: 478984 - DNA, 20 bp, Artificial
  CRISPR gRNA sequence
ctcattcaccaaggttcagc

SEQ ID NO: 478985 - DNA, 20 bp, Artificial
  CRISPR gRNA sequence
attcaccaaggttcagctca

SEQ ID NO: 478986 - DNA, 20 bp, Artificial
  CRISPR gRNA sequence
accaaggttcagctcaagta

SEQ ID NO: 478987 - DNA, 20 bp, Artificial
  CRISPR gRNA sequence
agctcaagtatagcctttcc

SEQ ID NO: 478988 - DNA, 20 bp, Artificial
  CRISPR gRNA sequence
aagtatagcctttccatgaa

SEQ ID NO: 478989 - DNA, 20 bp, Artificial
  CRISPR gRNA sequence
tccatgaagctttgccccgg

SEQ ID NO: 478990 - DNA, 20 bp, Artificial
  CRISPR gRNA sequence
ccatgaagctttgccccggc

SEQ ID NO: 478991 - DNA, 20 bp, Artificial
  CRISPR gRNA sequence
catgaagctttgccccggct

SEQ ID NO: 478992 - DNA, 20 bp, Artificial
  CRISPR gRNA sequence
tgccccggctgaagttaacc

SEQ ID NO: 478993 - DNA, 20 bp, Artificial
  CRISPR gRNA sequence
gccccggctgaagttaacct

SEQ ID NO: 478994 - DNA, 20 bp, Artificial
  CRISPR gRNA sequence
ccccggctgaagttaacctt

SEQ ID NO: 478995 - DNA, 20 bp, Artificial
  CRISPR gRNA sequence
aagttaaccttctgcagacc

SEQ ID NO: 478996 - DNA, 20 bp, Artificial
  CRISPR gRNA sequence
accttctgcagacccatgca

SEQ ID NO: 478997 - DNA, 20 bp, Artificial
  CRISPR gRNA sequence
ctgcagacccatgcaaagtt

SEQ ID NO: 478998 - DNA, 20 bp, Artificial
  CRISPR gRNA sequence
tgcagacccatgcaaagttg

SEQ ID NO: 478999 - DNA, 20 bp, Artificial
  CRISPR gRNA sequence
cagacccatgcaaagttgtt

SEQ ID NO: 479000 - DNA, 20 bp, Artificial
  CRISPR gRNA sequence
tttgtatctttttttttttt

SEQ ID NO: 479001 - DNA, 20 bp, Artificial
  CRISPR gRNA sequence
gtatcttttttttttttttt

SEQ ID NO: 479002 - DNA, 20 bp, Artificial
  CRISPR gRNA sequence
tatctttttttttttttttg

SEQ ID NO: 479003 - DNA, 20 bp, Artificial
  CRISPR gRNA sequence
tttttttttttttgagacag

SEQ ID NO: 479004 - DNA, 20 bp, Artificial
  CRISPR gRNA sequence
ttttttttttttgagacaga

SEQ ID NO: 479005 - DNA, 20 bp, Artificial
  CRISPR gRNA sequence
tttttttttttgagacagag

SEQ ID NO: 479006 - DNA, 20 bp, Artificial
  CRISPR gRNA sequence
ttttttttttgagacagagt

SEQ ID NO: 479007 - DNA, 20 bp, Artificial
  CRISPR gRNA sequence
tttttttttgagacagagtc

SEQ ID NO: 479008 - DNA, 20 bp, Artificial
  CRISPR gRNA sequence
ttttttttgagacagagtct

SEQ ID NO: 479009 - DNA, 20 bp, Artificial
  CRISPR gRNA sequence
tttttttgagacagagtctt

SEQ ID NO: 479010 - DNA, 20 bp, Artificial
  CRISPR gRNA sequence
ttttttgagacagagtctta

SEQ ID NO: 479011 - DNA, 20 bp, Artificial
  CRISPR gRNA sequence
tttttgagacagagtcttac

SEQ ID NO: 479012 - DNA, 20 bp, Artificial
  CRISPR gRNA sequence
ttttgagacagagtcttact

SEQ ID NO: 479013 - DNA, 20 bp, Artificial
  CRISPR gRNA sequence
tttgagacagagtcttactg

SEQ ID NO: 479014 - DNA, 20 bp, Artificial
  CRISPR gRNA sequence
ttgagacagagtcttactgt

SEQ ID NO: 479015 - DNA, 20 bp, Artificial
  CRISPR gRNA sequence
tgagacagagtcttactgtg

SEQ ID NO: 479016 - DNA, 20 bp, Artificial
  CRISPR gRNA sequence
gagacagagtcttactgtgt

SEQ ID NO: 479017 - DNA, 20 bp, Artificial
  CRISPR gRNA sequence
agacagagtcttactgtgtt

SEQ ID NO: 479018 - DNA, 20 bp, Artificial
  CRISPR gRNA sequence
actgtgttgcccaggctgga

SEQ ID NO: 479019 - DNA, 20 bp, Artificial
  CRISPR gRNA sequence
ctgtgttgcccaggctggag

SEQ ID NO: 479020 - DNA, 20 bp, Artificial
  CRISPR gRNA sequence
tgttgcccaggctggagtgc

SEQ ID NO: 479021 - DNA, 20 bp, Artificial
  CRISPR gRNA sequence
cccaggctggagtgcagtgg

SEQ ID NO: 479022 - DNA, 20 bp, Artificial
  CRISPR gRNA sequence
gagtgcagtggcatgatctc

SEQ ID NO: 479023 - DNA, 20 bp, Artificial
  CRISPR gRNA sequence
agctcactggaacctccagt

SEQ ID NO: 479024 - DNA, 20 bp, Artificial
  CRISPR gRNA sequence
actggaacctccagttcctg

SEQ ID NO: 479025 - DNA, 20 bp, Artificial
  CRISPR gRNA sequence
gaacctccagttcctgggtt

SEQ ID NO: 479026 - DNA, 20 bp, Artificial
  CRISPR gRNA sequence
cagttcctgggttcaagcaa

SEQ ID NO: 479027 - DNA, 20 bp, Artificial
  CRISPR gRNA sequence
ctgggttcaagcaattctcc

SEQ ID NO: 479028 - DNA, 20 bp, Artificial
  CRISPR gRNA sequence
ggttcaagcaattctcctgc

SEQ ID NO: 479029 - DNA, 20 bp, Artificial
  CRISPR gRNA sequence
aagcaattctcctgcctcag

SEQ ID NO: 479030 - DNA, 20 bp, Artificial
  CRISPR gRNA sequence
tcctgcctcagcctcttgag

SEQ ID NO: 479031 - DNA, 20 bp, Artificial
  CRISPR gRNA sequence
ctgcctcagcctcttgagta

SEQ ID NO: 479032 - DNA, 20 bp, Artificial
  CRISPR gRNA sequence
cctcagcctcttgagtagct

SEQ ID NO: 479033 - DNA, 20 bp, Artificial
  CRISPR gRNA sequence
agcctcttgagtagctggga

SEQ ID NO: 479034 - DNA, 20 bp, Artificial
  CRISPR gRNA sequence
ttgagtagctgggattacag

SEQ ID NO: 479035 - DNA, 20 bp, Artificial
  CRISPR gRNA sequence
gagtagctgggattacaggc

SEQ ID NO: 479036 - DNA, 20 bp, Artificial
  CRISPR gRNA sequence
agtagctgggattacaggca

SEQ ID NO: 479037 - DNA, 20 bp, Artificial
  CRISPR gRNA sequence
ggattacaggcacgcaccac

SEQ ID NO: 479038 - DNA, 20 bp, Artificial
  CRISPR gRNA sequence
caggcacgcaccaccacacc

SEQ ID NO: 479039 - DNA, 20 bp, Artificial
  CRISPR gRNA sequence
gctaatttttgtatttttag

SEQ ID NO: 479040 - DNA, 20 bp, Artificial
  CRISPR gRNA sequence
atttttgtatttttagtaaa

SEQ ID NO: 479041 - DNA, 20 bp, Artificial
  CRISPR gRNA sequence
ttgtatttttagtaaagacg

SEQ ID NO: 479042 - DNA, 20 bp, Artificial
  CRISPR gRNA sequence
tgtatttttagtaaagacgg

SEQ ID NO: 479043 - DNA, 20 bp, Artificial
  CRISPR gRNA sequence
gtatttttagtaaagacggt

SEQ ID NO: 479044 - DNA, 20 bp, Artificial
  CRISPR gRNA sequence
tatttttagtaaagacggtg

SEQ ID NO: 479045 - DNA, 20 bp, Artificial
  CRISPR gRNA sequence
ttagtaaagacggtgtttca

SEQ ID NO: 479046 - DNA, 20 bp, Artificial
  CRISPR gRNA sequence
tagtaaagacggtgtttcac

SEQ ID NO: 479047 - DNA, 20 bp, Artificial
  CRISPR gRNA sequence
agtaaagacggtgtttcacc

SEQ ID NO: 479048 - DNA, 20 bp, Artificial
  CRISPR gRNA sequence
gtaaagacggtgtttcacca

SEQ ID NO: 479049 - DNA, 20 bp, Artificial
  CRISPR gRNA sequence
caccatgttggtcaggctgg

SEQ ID NO: 479050 - DNA, 20 bp, Artificial
  CRISPR gRNA sequence
accatgttggtcaggctggt

SEQ ID NO: 479051 - DNA, 20 bp, Artificial
  CRISPR gRNA sequence
gtcaggctggtcttaaactc

SEQ ID NO: 479052 - DNA, 20 bp, Artificial
  CRISPR gRNA sequence
gtcttaaactcctgacctca

SEQ ID NO: 479053 - DNA, 20 bp, Artificial
  CRISPR gRNA sequence
aaactcctgacctcaggtga

SEQ ID NO: 479054 - DNA, 20 bp, Artificial
  CRISPR gRNA sequence
aactcctgacctcaggtgat

SEQ ID NO: 479055 - DNA, 20 bp, Artificial
  CRISPR gRNA sequence
ctgacctcaggtgatccacc

SEQ ID NO: 479056 - DNA, 20 bp, Artificial
  CRISPR gRNA sequence
acctcaggtgatccacctcc

SEQ ID NO: 479057 - DNA, 20 bp, Artificial
  CRISPR gRNA sequence
aggtgatccacctccctcgg

SEQ ID NO: 479058 - DNA, 20 bp, Artificial
  CRISPR gRNA sequence
cctcggcctcccaaagtgct

SEQ ID NO: 479059 - DNA, 20 bp, Artificial
  CRISPR gRNA sequence
ggcctcccaaagtgctggga

SEQ ID NO: 479060 - DNA, 20 bp, Artificial
  CRISPR gRNA sequence
ccaaagtgctgggattacag

SEQ ID NO: 479061 - DNA, 20 bp, Artificial
  CRISPR gRNA sequence
ggattacaggcgtgagccac

SEQ ID NO: 479062 - DNA, 20 bp, Artificial
  CRISPR gRNA sequence
caggcgtgagccaccatgcc

SEQ ID NO: 479063 - DNA, 20 bp, Artificial
  CRISPR gRNA sequence
gtttgtacctctttacagtg

SEQ ID NO: 479064 - DNA, 20 bp, Artificial
  CRISPR gRNA sequence
tttgtacctctttacagtgt

SEQ ID NO: 479065 - DNA, 20 bp, Artificial
  CRISPR gRNA sequence
gtacctctttacagtgttat

SEQ ID NO: 479066 - DNA, 20 bp, Artificial
  CRISPR gRNA sequence
tacctctttacagtgttata

SEQ ID NO: 479067 - DNA, 20 bp, Artificial
  CRISPR gRNA sequence
tttacagtgttatataacac

SEQ ID NO: 479068 - DNA, 20 bp, Artificial
  CRISPR gRNA sequence
tacagtgttatataacactc

SEQ ID NO: 479069 - DNA, 20 bp, Artificial
  CRISPR gRNA sequence
acagtgttatataacactct

SEQ ID NO: 479070 - DNA, 20 bp, Artificial
  CRISPR gRNA sequence
cagtgttatataacactctc

SEQ ID NO: 479071 - DNA, 20 bp, Artificial
  CRISPR gRNA sequence
tataacactctcccaattgc

SEQ ID NO: 479072 - DNA, 20 bp, Artificial
  CRISPR gRNA sequence
tcccaattgccattcatttt

SEQ ID NO: 479073 - DNA, 20 bp, Artificial
  CRISPR gRNA sequence
ccaattgccattcattttta

SEQ ID NO: 479074 - DNA, 20 bp, Artificial
  CRISPR gRNA sequence
ccattcatttttatttccca

SEQ ID NO: 479075 - DNA, 20 bp, Artificial
  CRISPR gRNA sequence
atttttatttcccattagaa

SEQ ID NO: 479076 - DNA, 20 bp, Artificial
  CRISPR gRNA sequence
ttatttcccattagaaggca

SEQ ID NO: 479077 - DNA, 20 bp, Artificial
  CRISPR gRNA sequence
tatttcccattagaaggcaa

SEQ ID NO: 479078 - DNA, 20 bp, Artificial
  CRISPR gRNA sequence
atttcccattagaaggcaag

SEQ ID NO: 479079 - DNA, 20 bp, Artificial
  CRISPR gRNA sequence
tttcccattagaaggcaagc

SEQ ID NO: 479080 - DNA, 20 bp, Artificial
  CRISPR gRNA sequence
cccattagaaggcaagctcc

SEQ ID NO: 479081 - DNA, 20 bp, Artificial
  CRISPR gRNA sequence
ccattagaaggcaagctcca

SEQ ID NO: 479082 - DNA, 20 bp, Artificial
  CRISPR gRNA sequence
gaaggcaagctccacaaatg

SEQ ID NO: 479083 - DNA, 20 bp, Artificial
  CRISPR gRNA sequence
cacaaatgcagacatcctat

SEQ ID NO: 479084 - DNA, 20 bp, Artificial
  CRISPR gRNA sequence
tctgatttattcctaggctt

SEQ ID NO: 479085 - DNA, 20 bp, Artificial
  CRISPR gRNA sequence
atttattcctaggcttccta

SEQ ID NO: 479086 - DNA, 20 bp, Artificial
  CRISPR gRNA sequence
attcctaggcttcctaacaa

SEQ ID NO: 479087 - DNA, 20 bp, Artificial
  CRISPR gRNA sequence
ttcctaggcttcctaacaac

SEQ ID NO: 479088 - DNA, 20 bp, Artificial
  CRISPR gRNA sequence
ctaggcttcctaacaaccag

SEQ ID NO: 479089 - DNA, 20 bp, Artificial
  CRISPR gRNA sequence
ggcttcctaacaaccagcat

SEQ ID NO: 479090 - DNA, 20 bp, Artificial
  CRISPR gRNA sequence
cctaacaaccagcatgcaac

SEQ ID NO: 479091 - DNA, 20 bp, Artificial
  CRISPR gRNA sequence
ctaacaaccagcatgcaacg

SEQ ID NO: 479092 - DNA, 20 bp, Artificial
  CRISPR gRNA sequence
acaaccagcatgcaacgtcc

SEQ ID NO: 479093 - DNA, 20 bp, Artificial
  CRISPR gRNA sequence
aaggcttgctttcagctcag

SEQ ID NO: 479094 - DNA, 20 bp, Artificial
  CRISPR gRNA sequence
gctttcagctcagtaaactg

SEQ ID NO: 479095 - DNA, 20 bp, Artificial
  CRISPR gRNA sequence
ctttcagctcagtaaactga

SEQ ID NO: 479096 - DNA, 20 bp, Artificial
  CRISPR gRNA sequence
tcagctcagtaaactgaaag

SEQ ID NO: 479097 - DNA, 20 bp, Artificial
  CRISPR gRNA sequence
cagctcagtaaactgaaaga

SEQ ID NO: 479098 - DNA, 20 bp, Artificial
  CRISPR gRNA sequence
agctcagtaaactgaaagaa

SEQ ID NO: 479099 - DNA, 20 bp, Artificial
  CRISPR gRNA sequence
agtaaactgaaagaaataaa

SEQ ID NO: 479100 - DNA, 20 bp, Artificial
  CRISPR gRNA sequence
aaagaaataaagactggtat

SEQ ID NO: 479101 - DNA, 20 bp, Artificial
  CRISPR gRNA sequence
gtatatagtaaattgattct

SEQ ID NO: 479102 - DNA, 20 bp, Artificial
  CRISPR gRNA sequence
attctagaaaagtgtctaga

SEQ ID NO: 479103 - DNA, 20 bp, Artificial
  CRISPR gRNA sequence
tagaaaagtgtctagaaggt

SEQ ID NO: 479104 - DNA, 20 bp, Artificial
  CRISPR gRNA sequence
gaaaagtgtctagaaggtaa

SEQ ID NO: 479105 - DNA, 20 bp, Artificial
  CRISPR gRNA sequence
gaaggtaaattgattctggc

SEQ ID NO: 479106 - DNA, 20 bp, Artificial
  CRISPR gRNA sequence
attctggccaggtgtggtgg

SEQ ID NO: 479107 - DNA, 20 bp, Artificial
  CRISPR gRNA sequence
tggccaggtgtggtggctca

SEQ ID NO: 479108 - DNA, 20 bp, Artificial
  CRISPR gRNA sequence
gccaggtgtggtggctcaag

SEQ ID NO: 479109 - DNA, 20 bp, Artificial
  CRISPR gRNA sequence
aagcctgtaatcccagcact

SEQ ID NO: 479110 - DNA, 20 bp, Artificial
  CRISPR gRNA sequence
taatcccagcactttgggag

SEQ ID NO: 479111 - DNA, 20 bp, Artificial
  CRISPR gRNA sequence
tgggaggccgagatgagctg

SEQ ID NO: 479112 - DNA, 20 bp, Artificial
  CRISPR gRNA sequence
gggaggccgagatgagctga

SEQ ID NO: 479113 - DNA, 20 bp, Artificial
  CRISPR gRNA sequence
ggaggccgagatgagctgat

SEQ ID NO: 479114 - DNA, 20 bp, Artificial
  CRISPR gRNA sequence
atcacctcaggttgggagtt

SEQ ID NO: 479115 - DNA, 20 bp, Artificial
  CRISPR gRNA sequence
aggttgggagttcaagacca

SEQ ID NO: 479116 - DNA, 20 bp, Artificial
  CRISPR gRNA sequence
ggagttcaagaccagcctga

SEQ ID NO: 479117 - DNA, 20 bp, Artificial
  CRISPR gRNA sequence
aagaccagcctgaccaacat

SEQ ID NO: 479118 - DNA, 20 bp, Artificial
  CRISPR gRNA sequence
accaacataaagaaatcccg

SEQ ID NO: 479119 - DNA, 20 bp, Artificial
  CRISPR gRNA sequence
tactaaaaatacaaaatcag

SEQ ID NO: 479120 - DNA, 20 bp, Artificial
  CRISPR gRNA sequence
actaaaaatacaaaatcagc

SEQ ID NO: 479121 - DNA, 20 bp, Artificial
  CRISPR gRNA sequence
ctaaaaatacaaaatcagct

SEQ ID NO: 479122 - DNA, 20 bp, Artificial
  CRISPR gRNA sequence
aaaatacaaaatcagctggg

SEQ ID NO: 479123 - DNA, 20 bp, Artificial
  CRISPR gRNA sequence
ggcgtggtggtgggcgcctg

SEQ ID NO: 479124 - DNA, 20 bp, Artificial
  CRISPR gRNA sequence
taatcccagttacccgggag

SEQ ID NO: 479125 - DNA, 20 bp, Artificial
  CRISPR gRNA sequence
cccgggaggctgaggcagga

SEQ ID NO: 479126 - DNA, 20 bp, Artificial
  CRISPR gRNA sequence
aggcaggagaatcgcttaaa

SEQ ID NO: 479127 - DNA, 20 bp, Artificial
  CRISPR gRNA sequence
aaacccgggaggcagaggtt

SEQ ID NO: 479128 - DNA, 20 bp, Artificial
  CRISPR gRNA sequence
aacccgggaggcagaggtta

SEQ ID NO: 479129 - DNA, 20 bp, Artificial
  CRISPR gRNA sequence
cggtgagccgagatcatgcc

SEQ ID NO: 479130 - DNA, 20 bp, Artificial
  CRISPR gRNA sequence
cattccagcctgtgcaacaa

SEQ ID NO: 479131 - DNA, 20 bp, Artificial
  CRISPR gRNA sequence
cagcctgtgcaacaagagtg

SEQ ID NO: 479132 - DNA, 20 bp, Artificial
  CRISPR gRNA sequence
tgcaacaagagtgaaactct

SEQ ID NO: 479133 - DNA, 20 bp, Artificial
  CRISPR gRNA sequence
ttgtctcaaaaaaaaaaaaa

SEQ ID NO: 479134 - DNA, 20 bp, Artificial
  CRISPR gRNA sequence
gtctcaaaaaaaaaaaaaaa

SEQ ID NO: 479135 - DNA, 20 bp, Artificial
  CRISPR gRNA sequence
tctcaaaaaaaaaaaaaaaa

SEQ ID NO: 479136 - DNA, 20 bp, Artificial
  CRISPR gRNA sequence
aaaaaaaaaaaaaaaaaaaa

SEQ ID NO: 479137 - DNA, 20 bp, Artificial
  CRISPR gRNA sequence
tttgttagatactcctgggg

SEQ ID NO: 479138 - DNA, 20 bp, Artificial
  CRISPR gRNA sequence
tgttagatactcctggggct

SEQ ID NO: 479139 - DNA, 20 bp, Artificial
  CRISPR gRNA sequence
gttagatactcctggggctt

SEQ ID NO: 479140 - DNA, 20 bp, Artificial
  CRISPR gRNA sequence
ttagatactcctggggctta

SEQ ID NO: 479141 - DNA, 20 bp, Artificial
  CRISPR gRNA sequence
gatactcctggggcttacca

SEQ ID NO: 479142 - DNA, 20 bp, Artificial
  CRISPR gRNA sequence
ctggggcttaccaattaaat

SEQ ID NO: 479143 - DNA, 20 bp, Artificial
  CRISPR gRNA sequence
gggcttaccaattaaatggt

SEQ ID NO: 479144 - DNA, 20 bp, Artificial
  CRISPR gRNA sequence
accaattaaatggtaaactc

SEQ ID NO: 479145 - DNA, 20 bp, Artificial
  CRISPR gRNA sequence
ccaattaaatggtaaactct

SEQ ID NO: 479146 - DNA, 20 bp, Artificial
  CRISPR gRNA sequence
aatggtaaactctttgaggg

SEQ ID NO: 479147 - DNA, 20 bp, Artificial
  CRISPR gRNA sequence
tttgagggtaaaagatcttt

SEQ ID NO: 479148 - DNA, 20 bp, Artificial
  CRISPR gRNA sequence
tgagggtaaaagatctttgt

SEQ ID NO: 479149 - DNA, 20 bp, Artificial
  CRISPR gRNA sequence
gagggtaaaagatctttgtc

SEQ ID NO: 479150 - DNA, 20 bp, Artificial
  CRISPR gRNA sequence
agggtaaaagatctttgtct

SEQ ID NO: 479151 - DNA, 20 bp, Artificial
  CRISPR gRNA sequence
tgtctataaccatctcattg

SEQ ID NO: 479152 - DNA, 20 bp, Artificial
  CRISPR gRNA sequence
gtctataaccatctcattgt

SEQ ID NO: 479153 - DNA, 20 bp, Artificial
  CRISPR gRNA sequence
tctataaccatctcattgtt

SEQ ID NO: 479154 - DNA, 20 bp, Artificial
  CRISPR gRNA sequence
taaccatctcattgtttttt

SEQ ID NO: 479155 - DNA, 20 bp, Artificial
  CRISPR gRNA sequence
attgttttttataattctag

SEQ ID NO: 479156 - DNA, 20 bp, Artificial
  CRISPR gRNA sequence
ttttttataattctagcaca

SEQ ID NO: 479157 - DNA, 20 bp, Artificial
  CRISPR gRNA sequence
tttataattctagcacagac

SEQ ID NO: 479158 - DNA, 20 bp, Artificial
  CRISPR gRNA sequence
ttataattctagcacagact

SEQ ID NO: 479159 - DNA, 20 bp, Artificial
  CRISPR gRNA sequence
tataattctagcacagactt

SEQ ID NO: 479160 - DNA, 20 bp, Artificial
  CRISPR gRNA sequence
ataattctagcacagactta

SEQ ID NO: 479161 - DNA, 20 bp, Artificial
  CRISPR gRNA sequence
taattctagcacagacttag

SEQ ID NO: 479162 - DNA, 20 bp, Artificial
  CRISPR gRNA sequence
tagcacagacttagaggctc

SEQ ID NO: 479163 - DNA, 20 bp, Artificial
  CRISPR gRNA sequence
gcacagacttagaggctcca

SEQ ID NO: 479164 - DNA, 20 bp, Artificial
  CRISPR gRNA sequence
agaggctccataaaccatta

SEQ ID NO: 479165 - DNA, 20 bp, Artificial
  CRISPR gRNA sequence
gaggctccataaaccattat

SEQ ID NO: 479166 - DNA, 20 bp, Artificial
  CRISPR gRNA sequence
cataaaccattattgactta

SEQ ID NO: 479167 - DNA, 20 bp, Artificial
  CRISPR gRNA sequence
ttgacttatccaagaaaatg

SEQ ID NO: 479168 - DNA, 20 bp, Artificial
  CRISPR gRNA sequence
acttatccaagaaaatgaaa

SEQ ID NO: 479169 - DNA, 20 bp, Artificial
  CRISPR gRNA sequence
atccaagaaaatgaaaaggg

SEQ ID NO: 479170 - DNA, 20 bp, Artificial
  CRISPR gRNA sequence
tccaagaaaatgaaaaggga

SEQ ID NO: 479171 - DNA, 20 bp, Artificial
  CRISPR gRNA sequence
ggaggctgagggagtctatt

SEQ ID NO: 479172 - DNA, 20 bp, Artificial
  CRISPR gRNA sequence
agggagtctattaacttcag

SEQ ID NO: 479173 - DNA, 20 bp, Artificial
  CRISPR gRNA sequence
ttaacttcagggagaggaac

SEQ ID NO: 479174 - DNA, 20 bp, Artificial
  CRISPR gRNA sequence
acttcagggagaggaacgga

SEQ ID NO: 479175 - DNA, 20 bp, Artificial
  CRISPR gRNA sequence
cagggagaggaacggacttc

SEQ ID NO: 479176 - DNA, 20 bp, Artificial
  CRISPR gRNA sequence
agggagaggaacggacttct

SEQ ID NO: 479177 - DNA, 20 bp, Artificial
  CRISPR gRNA sequence
ctggaaacaagagtttcact

SEQ ID NO: 479178 - DNA, 20 bp, Artificial
  CRISPR gRNA sequence
tggaaacaagagtttcactt

SEQ ID NO: 479179 - DNA, 20 bp, Artificial
  CRISPR gRNA sequence
gaaacaagagtttcacttga

SEQ ID NO: 479180 - DNA, 20 bp, Artificial
  CRISPR gRNA sequence
cacttgacctttctgcctct

SEQ ID NO: 479181 - DNA, 20 bp, Artificial
  CRISPR gRNA sequence
acttgacctttctgcctctg

SEQ ID NO: 479182 - DNA, 20 bp, Artificial
  CRISPR gRNA sequence
gacctttctgcctctggcct

SEQ ID NO: 479183 - DNA, 20 bp, Artificial
  CRISPR gRNA sequence
acctttctgcctctggcctt

SEQ ID NO: 479184 - DNA, 20 bp, Artificial
  CRISPR gRNA sequence
tctgcctctggccttcttac

SEQ ID NO: 479185 - DNA, 20 bp, Artificial
  CRISPR gRNA sequence
ctgcctctggccttcttact

SEQ ID NO: 479186 - DNA, 20 bp, Artificial
  CRISPR gRNA sequence
tgcctctggccttcttactt

SEQ ID NO: 479187 - DNA, 20 bp, Artificial
  CRISPR gRNA sequence
cctctggccttcttactttt

SEQ ID NO: 479188 - DNA, 20 bp, Artificial
  CRISPR gRNA sequence
tggccttcttactttttttg

SEQ ID NO: 479189 - DNA, 20 bp, Artificial
  CRISPR gRNA sequence
gccttcttactttttttgtc

SEQ ID NO: 479190 - DNA, 20 bp, Artificial
  CRISPR gRNA sequence
cttactttttttgtcctaag

SEQ ID NO: 479191 - DNA, 20 bp, Artificial
  CRISPR gRNA sequence
ttactttttttgtcctaagt

SEQ ID NO: 479192 - DNA, 20 bp, Artificial
  CRISPR gRNA sequence
actttttttgtcctaagtct

SEQ ID NO: 479193 - DNA, 20 bp, Artificial
  CRISPR gRNA sequence
ctttttttgtcctaagtcta

SEQ ID NO: 479194 - DNA, 20 bp, Artificial
  CRISPR gRNA sequence
tttttgtcctaagtctaacc

SEQ ID NO: 479195 - DNA, 20 bp, Artificial
  CRISPR gRNA sequence
ttttgtcctaagtctaacca

SEQ ID NO: 479196 - DNA, 20 bp, Artificial
  CRISPR gRNA sequence
tttgtcctaagtctaaccac

SEQ ID NO: 479197 - DNA, 20 bp, Artificial
  CRISPR gRNA sequence
ttgtcctaagtctaaccaca

SEQ ID NO: 479198 - DNA, 20 bp, Artificial
  CRISPR gRNA sequence
tgtcctaagtctaaccacat

SEQ ID NO: 479199 - DNA, 20 bp, Artificial
  CRISPR gRNA sequence
gtcctaagtctaaccacatt

SEQ ID NO: 479200 - DNA, 20 bp, Artificial
  CRISPR gRNA sequence
tcctaagtctaaccacattc

SEQ ID NO: 479201 - DNA, 20 bp, Artificial
  CRISPR gRNA sequence
agtctaaccacattcaggta

SEQ ID NO: 479202 - DNA, 20 bp, Artificial
  CRISPR gRNA sequence
accacattcaggtacacttc

SEQ ID NO: 479203 - DNA, 20 bp, Artificial
  CRISPR gRNA sequence
aggtacacttccttttggta

SEQ ID NO: 479204 - DNA, 20 bp, Artificial
  CRISPR gRNA sequence
ccttttggtaaaatatttta

SEQ ID NO: 479205 - DNA, 20 bp, Artificial
  CRISPR gRNA sequence
cttttggtaaaatattttac

SEQ ID NO: 479206 - DNA, 20 bp, Artificial
  CRISPR gRNA sequence
ttggtaaaatattttaccct

SEQ ID NO: 479207 - DNA, 20 bp, Artificial
  CRISPR gRNA sequence
tggtaaaatattttaccctt

SEQ ID NO: 479208 - DNA, 20 bp, Artificial
  CRISPR gRNA sequence
ggtaaaatattttacccttt

SEQ ID NO: 479209 - DNA, 20 bp, Artificial
  CRISPR gRNA sequence
gtaaaatattttaccctttc

SEQ ID NO: 479210 - DNA, 20 bp, Artificial
  CRISPR gRNA sequence
taccctttctcttcattttt

SEQ ID NO: 479211 - DNA, 20 bp, Artificial
  CRISPR gRNA sequence
accctttctcttcatttttt

SEQ ID NO: 479212 - DNA, 20 bp, Artificial
  CRISPR gRNA sequence
ccctttctcttcattttttt

SEQ ID NO: 479213 - DNA, 20 bp, Artificial
  CRISPR gRNA sequence
tctcttcatttttttgaaaa

SEQ ID NO: 479214 - DNA, 20 bp, Artificial
  CRISPR gRNA sequence
ctcttcatttttttgaaaac

SEQ ID NO: 479215 - DNA, 20 bp, Artificial
  CRISPR gRNA sequence
tcttcatttttttgaaaacc

SEQ ID NO: 479216 - DNA, 20 bp, Artificial
  CRISPR gRNA sequence
ttcatttttttgaaaacctc

SEQ ID NO: 479217 - DNA, 20 bp, Artificial
  CRISPR gRNA sequence
catttttttgaaaacctcat

SEQ ID NO: 479218 - DNA, 20 bp, Artificial
  CRISPR gRNA sequence
atttttttgaaaacctcatc

SEQ ID NO: 479219 - DNA, 20 bp, Artificial
  CRISPR gRNA sequence
ttttgaaaacctcatcctta

SEQ ID NO: 479220 - DNA, 20 bp, Artificial
  CRISPR gRNA sequence
tttgaaaacctcatccttat

SEQ ID NO: 479221 - DNA, 20 bp, Artificial
  CRISPR gRNA sequence
ttgaaaacctcatccttata

SEQ ID NO: 479222 - DNA, 20 bp, Artificial
  CRISPR gRNA sequence
tgaaaacctcatccttataa

SEQ ID NO: 479223 - DNA, 20 bp, Artificial
  CRISPR gRNA sequence
gaaaacctcatccttataac

SEQ ID NO: 479224 - DNA, 20 bp, Artificial
  CRISPR gRNA sequence
aaaacctcatccttataact

SEQ ID NO: 479225 - DNA, 20 bp, Artificial
  CRISPR gRNA sequence
atccttataacttacctttc

SEQ ID NO: 479226 - DNA, 20 bp, Artificial
  CRISPR gRNA sequence
ataacttacctttcagtttg

SEQ ID NO: 479227 - DNA, 20 bp, Artificial
  CRISPR gRNA sequence
taacttacctttcagtttgg

SEQ ID NO: 479228 - DNA, 20 bp, Artificial
  CRISPR gRNA sequence
acctttcagtttggtttcat

SEQ ID NO: 479229 - DNA, 20 bp, Artificial
  CRISPR gRNA sequence
cctttcagtttggtttcatt

SEQ ID NO: 479230 - DNA, 20 bp, Artificial
  CRISPR gRNA sequence
tcagtttggtttcattttag

SEQ ID NO: 479231 - DNA, 20 bp, Artificial
  CRISPR gRNA sequence
cagtttggtttcattttagt

SEQ ID NO: 479232 - DNA, 20 bp, Artificial
  CRISPR gRNA sequence
agtttggtttcattttagtt

SEQ ID NO: 479233 - DNA, 20 bp, Artificial
  CRISPR gRNA sequence
ggtttcattttagttctaaa

SEQ ID NO: 479234 - DNA, 20 bp, Artificial
  CRISPR gRNA sequence
gtttcattttagttctaaac

SEQ ID NO: 479235 - DNA, 20 bp, Artificial
  CRISPR gRNA sequence
cattttagttctaaactttt

SEQ ID NO: 479236 - DNA, 20 bp, Artificial
  CRISPR gRNA sequence
attttagttctaaacttttg

SEQ ID NO: 479237 - DNA, 20 bp, Artificial
  CRISPR gRNA sequence
tagttctaaacttttggaag

SEQ ID NO: 479238 - DNA, 20 bp, Artificial
  CRISPR gRNA sequence
agttctaaacttttggaagc

SEQ ID NO: 479239 - DNA, 20 bp, Artificial
  CRISPR gRNA sequence
gttctaaacttttggaagca

SEQ ID NO: 479240 - DNA, 20 bp, Artificial
  CRISPR gRNA sequence
taaacttttggaagcaactg

SEQ ID NO: 479241 - DNA, 20 bp, Artificial
  CRISPR gRNA sequence
aacttttggaagcaactgaa

SEQ ID NO: 479242 - DNA, 20 bp, Artificial
  CRISPR gRNA sequence
ttggaagcaactgaattaag

SEQ ID NO: 479243 - DNA, 20 bp, Artificial
  CRISPR gRNA sequence
tggaagcaactgaattaaga

SEQ ID NO: 479244 - DNA, 20 bp, Artificial
  CRISPR gRNA sequence
ggaagcaactgaattaagaa

SEQ ID NO: 479245 - DNA, 20 bp, Artificial
  CRISPR gRNA sequence
gaagcaactgaattaagaag

SEQ ID NO: 479246 - DNA, 20 bp, Artificial
  CRISPR gRNA sequence
aattaagaagtcttaaagtg

SEQ ID NO: 479247 - DNA, 20 bp, Artificial
  CRISPR gRNA sequence
agaagtcttaaagtgaactt

SEQ ID NO: 479248 - DNA, 20 bp, Artificial
  CRISPR gRNA sequence
aaagtgaacttgcttgaggt

SEQ ID NO: 479249 - DNA, 20 bp, Artificial
  CRISPR gRNA sequence
aagtgaacttgcttgaggtc

SEQ ID NO: 479250 - DNA, 20 bp, Artificial
  CRISPR gRNA sequence
gcttgaggtctcaaagcaat

SEQ ID NO: 479251 - DNA, 20 bp, Artificial
  CRISPR gRNA sequence
cttgaggtctcaaagcaatt

SEQ ID NO: 479252 - DNA, 20 bp, Artificial
  CRISPR gRNA sequence
gaggtctcaaagcaattata

SEQ ID NO: 479253 - DNA, 20 bp, Artificial
  CRISPR gRNA sequence
aggtctcaaagcaattataa

SEQ ID NO: 479254 - DNA, 20 bp, Artificial
  CRISPR gRNA sequence
aaagcaattataaataaata

SEQ ID NO: 479255 - DNA, 20 bp, Artificial
  CRISPR gRNA sequence
taaataaataaatattaaga

SEQ ID NO: 479256 - DNA, 20 bp, Artificial
  CRISPR gRNA sequence
agaggttctaaaagttgtct

SEQ ID NO: 479257 - DNA, 20 bp, Artificial
  CRISPR gRNA sequence
taaaagttgtctgcaggtcc

SEQ ID NO: 479258 - DNA, 20 bp, Artificial
  CRISPR gRNA sequence
aaagttgtctgcaggtcctt

SEQ ID NO: 479259 - DNA, 20 bp, Artificial
  CRISPR gRNA sequence
tctgcaggtcctttttctca

SEQ ID NO: 479260 - DNA, 20 bp, Artificial
  CRISPR gRNA sequence
caggtcctttttctcactct

SEQ ID NO: 479261 - DNA, 20 bp, Artificial
  CRISPR gRNA sequence
tttctcactctgattcctgg

SEQ ID NO: 479262 - DNA, 20 bp, Artificial
  CRISPR gRNA sequence
ttctcactctgattcctgga

SEQ ID NO: 479263 - DNA, 20 bp, Artificial
  CRISPR gRNA sequence
tctcactctgattcctggaa

SEQ ID NO: 479264 - DNA, 20 bp, Artificial
  CRISPR gRNA sequence
ctcactctgattcctggaaa

SEQ ID NO: 479265 - DNA, 20 bp, Artificial
  CRISPR gRNA sequence
tcactctgattcctggaaac

SEQ ID NO: 479266 - DNA, 20 bp, Artificial
  CRISPR gRNA sequence
actctgattcctggaaactc

SEQ ID NO: 479267 - DNA, 20 bp, Artificial
  CRISPR gRNA sequence
tgattcctggaaactcaatc

SEQ ID NO: 479268 - DNA, 20 bp, Artificial
  CRISPR gRNA sequence
attcctggaaactcaatcag

SEQ ID NO: 479269 - DNA, 20 bp, Artificial
  CRISPR gRNA sequence
ctggaaactcaatcaggttt

SEQ ID NO: 479270 - DNA, 20 bp, Artificial
  CRISPR gRNA sequence
gaaactcaatcaggtttcta

SEQ ID NO: 479271 - DNA, 20 bp, Artificial
  CRISPR gRNA sequence
aatcaggtttctattattct

SEQ ID NO: 479272 - DNA, 20 bp, Artificial
  CRISPR gRNA sequence
ctattattctgagcagagat

SEQ ID NO: 479273 - DNA, 20 bp, Artificial
  CRISPR gRNA sequence
tattattctgagcagagatt

SEQ ID NO: 479274 - DNA, 20 bp, Artificial
  CRISPR gRNA sequence
ttattctgagcagagattca

SEQ ID NO: 479275 - DNA, 20 bp, Artificial
  CRISPR gRNA sequence
ttctgagcagagattcatga

SEQ ID NO: 479276 - DNA, 20 bp, Artificial
  CRISPR gRNA sequence
tgagcagagattcatgagat

SEQ ID NO: 479277 - DNA, 20 bp, Artificial
  CRISPR gRNA sequence
agcagagattcatgagatgt

SEQ ID NO: 479278 - DNA, 20 bp, Artificial
  CRISPR gRNA sequence
atgagatgtgagcaggaagg

SEQ ID NO: 479279 - DNA, 20 bp, Artificial
  CRISPR gRNA sequence
ttaagtaggatgtgagtgaa

SEQ ID NO: 479280 - DNA, 20 bp, Artificial
  CRISPR gRNA sequence
taagtaggatgtgagtgaaa

SEQ ID NO: 479281 - DNA, 20 bp, Artificial
  CRISPR gRNA sequence
aagtaggatgtgagtgaaag

SEQ ID NO: 479282 - DNA, 20 bp, Artificial
  CRISPR gRNA sequence
agtaggatgtgagtgaaagg

SEQ ID NO: 479283 - DNA, 20 bp, Artificial
  CRISPR gRNA sequence
ggtgtgaggaaatagataaa

SEQ ID NO: 479284 - DNA, 20 bp, Artificial
  CRISPR gRNA sequence
atgctggcaagggtgtagaa

SEQ ID NO: 479285 - DNA, 20 bp, Artificial
  CRISPR gRNA sequence
tgctggcaagggtgtagaaa

SEQ ID NO: 479286 - DNA, 20 bp, Artificial
  CRISPR gRNA sequence
gcaagggtgtagaaataagg

SEQ ID NO: 479287 - DNA, 20 bp, Artificial
  CRISPR gRNA sequence
gttctggatagacatgtatg

SEQ ID NO: 479288 - DNA, 20 bp, Artificial
  CRISPR gRNA sequence
ttctggatagacatgtatga

SEQ ID NO: 479289 - DNA, 20 bp, Artificial
  CRISPR gRNA sequence
tggatagacatgtatgagaa

SEQ ID NO: 479290 - DNA, 20 bp, Artificial
  CRISPR gRNA sequence
gatagacatgtatgagaaac

SEQ ID NO: 479291 - DNA, 20 bp, Artificial
  CRISPR gRNA sequence
agggtcaaaatttgctcctt

SEQ ID NO: 479292 - DNA, 20 bp, Artificial
  CRISPR gRNA sequence
gctccttggttcaacatctg

SEQ ID NO: 479293 - DNA, 20 bp, Artificial
  CRISPR gRNA sequence
ctccttggttcaacatctga

SEQ ID NO: 479294 - DNA, 20 bp, Artificial
  CRISPR gRNA sequence
cttggttcaacatctgacaa

SEQ ID NO: 479295 - DNA, 20 bp, Artificial
  CRISPR gRNA sequence
ggttcaacatctgacaagct

SEQ ID NO: 479296 - DNA, 20 bp, Artificial
  CRISPR gRNA sequence
gttcaacatctgacaagctg

SEQ ID NO: 479297 - DNA, 20 bp, Artificial
  CRISPR gRNA sequence
aacatctgacaagctgtgtg

SEQ ID NO: 479298 - DNA, 20 bp, Artificial
  CRISPR gRNA sequence
acaagctgtgtgatcacagg

SEQ ID NO: 479299 - DNA, 20 bp, Artificial
  CRISPR gRNA sequence
tgtgatcacaggcaaggcct

SEQ ID NO: 479300 - DNA, 20 bp, Artificial
  CRISPR gRNA sequence
tagctgtctttgtatttaaa

SEQ ID NO: 479301 - DNA, 20 bp, Artificial
  CRISPR gRNA sequence
agctgtctttgtatttaaaa

SEQ ID NO: 479302 - DNA, 20 bp, Artificial
  CRISPR gRNA sequence
gctgtctttgtatttaaaag

SEQ ID NO: 479303 - DNA, 20 bp, Artificial
  CRISPR gRNA sequence
tctttgtatttaaaagagag

SEQ ID NO: 479304 - DNA, 20 bp, Artificial
  CRISPR gRNA sequence
tgtatttaaaagagagtttt

SEQ ID NO: 479305 - DNA, 20 bp, Artificial
  CRISPR gRNA sequence
gtatttaaaagagagttttg

SEQ ID NO: 479306 - DNA, 20 bp, Artificial
  CRISPR gRNA sequence
tatttaaaagagagttttgg

SEQ ID NO: 479307 - DNA, 20 bp, Artificial
  CRISPR gRNA sequence
aaaagagagttttggctatc

SEQ ID NO: 479308 - DNA, 20 bp, Artificial
  CRISPR gRNA sequence
aaagagagttttggctatca

SEQ ID NO: 479309 - DNA, 20 bp, Artificial
  CRISPR gRNA sequence
tggctatcatctctgttaca

SEQ ID NO: 479310 - DNA, 20 bp, Artificial
  CRISPR gRNA sequence
ggctatcatctctgttacac

SEQ ID NO: 479311 - DNA, 20 bp, Artificial
  CRISPR gRNA sequence
gctatcatctctgttacact

SEQ ID NO: 479312 - DNA, 20 bp, Artificial
  CRISPR gRNA sequence
tcatctctgttacacttatg

SEQ ID NO: 479313 - DNA, 20 bp, Artificial
  CRISPR gRNA sequence
tgttacacttatgtcattct

SEQ ID NO: 479314 - DNA, 20 bp, Artificial
  CRISPR gRNA sequence
ttacacttatgtcattctaa

SEQ ID NO: 479315 - DNA, 20 bp, Artificial
  CRISPR gRNA sequence
cacttatgtcattctaatgt

SEQ ID NO: 479316 - DNA, 20 bp, Artificial
  CRISPR gRNA sequence
atgtcattctaatgtatgat

SEQ ID NO: 479317 - DNA, 20 bp, Artificial
  CRISPR gRNA sequence
tgtcattctaatgtatgata

SEQ ID NO: 479318 - DNA, 20 bp, Artificial
  CRISPR gRNA sequence
taatgtatgatactgtacat

SEQ ID NO: 479319 - DNA, 20 bp, Artificial
  CRISPR gRNA sequence
atgtatgatactgtacatct

SEQ ID NO: 479320 - DNA, 20 bp, Artificial
  CRISPR gRNA sequence
tacatctattcagaagaatg

SEQ ID NO: 479321 - DNA, 20 bp, Artificial
  CRISPR gRNA sequence
ttcagaagaatgcatgaaaa

SEQ ID NO: 479322 - DNA, 20 bp, Artificial
  CRISPR gRNA sequence
agaagaatgcatgaaaatga

SEQ ID NO: 479323 - DNA, 20 bp, Artificial
  CRISPR gRNA sequence
gacattgctaagagagacgg

SEQ ID NO: 479324 - DNA, 20 bp, Artificial
  CRISPR gRNA sequence
ctaagagagacggtagttca

SEQ ID NO: 479325 - DNA, 20 bp, Artificial
  CRISPR gRNA sequence
agagagacggtagttcaaaa

SEQ ID NO: 479326 - DNA, 20 bp, Artificial
  CRISPR gRNA sequence
aaaacatagaaagaaaggct

SEQ ID NO: 479327 - DNA, 20 bp, Artificial
  CRISPR gRNA sequence
agaaagaactgtaagagtgg

SEQ ID NO: 479328 - DNA, 20 bp, Artificial
  CRISPR gRNA sequence
taagagtggagaaaaaaata

SEQ ID NO: 479329 - DNA, 20 bp, Artificial
  CRISPR gRNA sequence
aaaagaaaatacttttagga

SEQ ID NO: 479330 - DNA, 20 bp, Artificial
  CRISPR gRNA sequence
aaagaaaatacttttaggat

SEQ ID NO: 479331 - DNA, 20 bp, Artificial
  CRISPR gRNA sequence
ttaggatcacgtgcttagcc

SEQ ID NO: 479332 - DNA, 20 bp, Artificial
  CRISPR gRNA sequence
taggatcacgtgcttagcct

SEQ ID NO: 479333 - DNA, 20 bp, Artificial
  CRISPR gRNA sequence
aggatcacgtgcttagcctt

SEQ ID NO: 479334 - DNA, 20 bp, Artificial
  CRISPR gRNA sequence
ggatcacgtgcttagcctta

SEQ ID NO: 479335 - DNA, 20 bp, Artificial
  CRISPR gRNA sequence
agccttaactttactggaaa

SEQ ID NO: 479336 - DNA, 20 bp, Artificial
  CRISPR gRNA sequence
gccttaactttactggaaaa

SEQ ID NO: 479337 - DNA, 20 bp, Artificial
  CRISPR gRNA sequence
aactttactggaaaataaaa

SEQ ID NO: 479338 - DNA, 20 bp, Artificial
  CRISPR gRNA sequence
actttactggaaaataaaaa

SEQ ID NO: 479339 - DNA, 20 bp, Artificial
  CRISPR gRNA sequence
tactggaaaataaaaaaata

SEQ ID NO: 479340 - DNA, 20 bp, Artificial
  CRISPR gRNA sequence
actggaaaataaaaaaatac

SEQ ID NO: 479341 - DNA, 20 bp, Artificial
  CRISPR gRNA sequence
ctggaaaataaaaaaataca

SEQ ID NO: 479342 - DNA, 20 bp, Artificial
  CRISPR gRNA sequence
gaaaataaaaaaatacaaat

SEQ ID NO: 479343 - DNA, 20 bp, Artificial
  CRISPR gRNA sequence
aaaggaaatgagaaacaagc

SEQ ID NO: 479344 - DNA, 20 bp, Artificial
  CRISPR gRNA sequence
gaaactggagtaaaggccat

SEQ ID NO: 479345 - DNA, 20 bp, Artificial
  CRISPR gRNA sequence
gagtaaaggccattcttgtc

SEQ ID NO: 479346 - DNA, 20 bp, Artificial
  CRISPR gRNA sequence
ttgtcatacagttgctaaga

SEQ ID NO: 479347 - DNA, 20 bp, Artificial
  CRISPR gRNA sequence
gtcatacagttgctaagaac

SEQ ID NO: 479348 - DNA, 20 bp, Artificial
  CRISPR gRNA sequence
tcatacagttgctaagaact

SEQ ID NO: 479349 - DNA, 20 bp, Artificial
  CRISPR gRNA sequence
ctaagaacttggtggaaatg

SEQ ID NO: 479350 - DNA, 20 bp, Artificial
  CRISPR gRNA sequence
agaacttggtggaaatgtat

SEQ ID NO: 479351 - DNA, 20 bp, Artificial
  CRISPR gRNA sequence
ggtggaaatgtatctatgtc

SEQ ID NO: 479352 - DNA, 20 bp, Artificial
  CRISPR gRNA sequence
gtggaaatgtatctatgtct

SEQ ID NO: 479353 - DNA, 20 bp, Artificial
  CRISPR gRNA sequence
tgtcttaggactttacggaa

SEQ ID NO: 479354 - DNA, 20 bp, Artificial
  CRISPR gRNA sequence
aggactttacggaaagcaga

SEQ ID NO: 479355 - DNA, 20 bp, Artificial
  CRISPR gRNA sequence
ggactttacggaaagcagaa

SEQ ID NO: 479356 - DNA, 20 bp, Artificial
  CRISPR gRNA sequence
tacggaaagcagaaattaag

SEQ ID NO: 479357 - DNA, 20 bp, Artificial
  CRISPR gRNA sequence
acggaaagcagaaattaaga

SEQ ID NO: 479358 - DNA, 20 bp, Artificial
  CRISPR gRNA sequence
cggaaagcagaaattaagag

SEQ ID NO: 479359 - DNA, 20 bp, Artificial
  CRISPR gRNA sequence
agagcaataattcaggatat

SEQ ID NO: 479360 - DNA, 20 bp, Artificial
  CRISPR gRNA sequence
aggatatctggtggaagaaa

SEQ ID NO: 479361 - DNA, 20 bp, Artificial
  CRISPR gRNA sequence
gtggaagaaatatctaagcc

SEQ ID NO: 479362 - DNA, 20 bp, Artificial
  CRISPR gRNA sequence
agccgcaaagcatttaggct

SEQ ID NO: 479363 - DNA, 20 bp, Artificial
  CRISPR gRNA sequence
aggctgctgtgtggctactt

SEQ ID NO: 479364 - DNA, 20 bp, Artificial
  CRISPR gRNA sequence
ggctgctgtgtggctacttt

SEQ ID NO: 479365 - DNA, 20 bp, Artificial
  CRISPR gRNA sequence
ctgtgtggctacttttaact

SEQ ID NO: 479366 - DNA, 20 bp, Artificial
  CRISPR gRNA sequence
tgtggctacttttaactgca

SEQ ID NO: 479367 - DNA, 20 bp, Artificial
  CRISPR gRNA sequence
cttttaactgcatacagtaa

SEQ ID NO: 479368 - DNA, 20 bp, Artificial
  CRISPR gRNA sequence
ttaactgcatacagtaagag

SEQ ID NO: 479369 - DNA, 20 bp, Artificial
  CRISPR gRNA sequence
taactgcatacagtaagagg

SEQ ID NO: 479370 - DNA, 20 bp, Artificial
  CRISPR gRNA sequence
aactgcatacagtaagaggc

SEQ ID NO: 479371 - DNA, 20 bp, Artificial
  CRISPR gRNA sequence
actgcatacagtaagaggca

SEQ ID NO: 479372 - DNA, 20 bp, Artificial
  CRISPR gRNA sequence
catacagtaagaggcaggag

SEQ ID NO: 479373 - DNA, 20 bp, Artificial
  CRISPR gRNA sequence
aaaaatggaatttataatta

SEQ ID NO: 479374 - DNA, 20 bp, Artificial
  CRISPR gRNA sequence
aaaatggaatttataattaa

SEQ ID NO: 479375 - DNA, 20 bp, Artificial
  CRISPR gRNA sequence
ataattaaaagagaagcaga

SEQ ID NO: 479376 - DNA, 20 bp, Artificial
  CRISPR gRNA sequence
taattaaaagagaagcagaa

SEQ ID NO: 479377 - DNA, 20 bp, Artificial
  CRISPR gRNA sequence
aaagagaagcagaatagaaa

SEQ ID NO: 479378 - DNA, 20 bp, Artificial
  CRISPR gRNA sequence
ggaaaattcactgcctagcc

SEQ ID NO: 479379 - DNA, 20 bp, Artificial
  CRISPR gRNA sequence
gaaaattcactgcctagcca

SEQ ID NO: 479380 - DNA, 20 bp, Artificial
  CRISPR gRNA sequence
actgcctagccatataaaaa

SEQ ID NO: 479381 - DNA, 20 bp, Artificial
  CRISPR gRNA sequence
cctagccatataaaaagtga

SEQ ID NO: 479382 - DNA, 20 bp, Artificial
  CRISPR gRNA sequence
gccatataaaaagtgaaaag

SEQ ID NO: 479383 - DNA, 20 bp, Artificial
  CRISPR gRNA sequence
agggtgtggcctagtgacca

SEQ ID NO: 479384 - DNA, 20 bp, Artificial
  CRISPR gRNA sequence
gtgaccattgttaaagagat

SEQ ID NO: 479385 - DNA, 20 bp, Artificial
  CRISPR gRNA sequence
ttaaagagattaatatggat

SEQ ID NO: 479386 - DNA, 20 bp, Artificial
  CRISPR gRNA sequence
aagagattaatatggataga

SEQ ID NO: 479387 - DNA, 20 bp, Artificial
  CRISPR gRNA sequence
atatggatagaagggagtga

SEQ ID NO: 479388 - DNA, 20 bp, Artificial
  CRISPR gRNA sequence
ttcaagaagttgagaaaaag

SEQ ID NO: 479389 - DNA, 20 bp, Artificial
  CRISPR gRNA sequence
aagaagttgagaaaaaggcc

SEQ ID NO: 479390 - DNA, 20 bp, Artificial
  CRISPR gRNA sequence
agaaaaaggccctgaaggca

SEQ ID NO: 479391 - DNA, 20 bp, Artificial
  CRISPR gRNA sequence
aaggcatttcaaagcctttg

SEQ ID NO: 479392 - DNA, 20 bp, Artificial
  CRISPR gRNA sequence
caaagcctttgaggctgccc

SEQ ID NO: 479393 - DNA, 20 bp, Artificial
  CRISPR gRNA sequence
aaagcctttgaggctgcccc

SEQ ID NO: 479394 - DNA, 20 bp, Artificial
  CRISPR gRNA sequence
tgaggctgcccctcccatca

SEQ ID NO: 479395 - DNA, 20 bp, Artificial
  CRISPR gRNA sequence
gaggctgcccctcccatcat

SEQ ID NO: 479396 - DNA, 20 bp, Artificial
  CRISPR gRNA sequence
aggctgcccctcccatcata

SEQ ID NO: 479397 - DNA, 20 bp, Artificial
  CRISPR gRNA sequence
cccctcccatcataggctca

SEQ ID NO: 479398 - DNA, 20 bp, Artificial
  CRISPR gRNA sequence
ccatcataggctcagagctc

SEQ ID NO: 479399 - DNA, 20 bp, Artificial
  CRISPR gRNA sequence
agagctcagagggcaaattg

SEQ ID NO: 479400 - DNA, 20 bp, Artificial
  CRISPR gRNA sequence
agagggcaaattgatttcag

SEQ ID NO: 479401 - DNA, 20 bp, Artificial
  CRISPR gRNA sequence
atttcaggggaaactagaat

SEQ ID NO: 479402 - DNA, 20 bp, Artificial
  CRISPR gRNA sequence
caggggaaactagaatgccc

SEQ ID NO: 479403 - DNA, 20 bp, Artificial
  CRISPR gRNA sequence
aggggaaactagaatgccct

SEQ ID NO: 479404 - DNA, 20 bp, Artificial
  CRISPR gRNA sequence
gaatgccctttacaggcttg

SEQ ID NO: 479405 - DNA, 20 bp, Artificial
  CRISPR gRNA sequence
tacaggcttgctgcccagat

SEQ ID NO: 479406 - DNA, 20 bp, Artificial
  CRISPR gRNA sequence
acaggcttgctgcccagatc

SEQ ID NO: 479407 - DNA, 20 bp, Artificial
  CRISPR gRNA sequence
caggcttgctgcccagatct

SEQ ID NO: 479408 - DNA, 20 bp, Artificial
  CRISPR gRNA sequence
gctgcccagatctgcctcag

SEQ ID NO: 479409 - DNA, 20 bp, Artificial
  CRISPR gRNA sequence
ctgcccagatctgcctcagg

SEQ ID NO: 479410 - DNA, 20 bp, Artificial
  CRISPR gRNA sequence
cccagatctgcctcaggttt

SEQ ID NO: 479411 - DNA, 20 bp, Artificial
  CRISPR gRNA sequence
cctcaggtttctgttctctg

SEQ ID NO: 479412 - DNA, 20 bp, Artificial
  CRISPR gRNA sequence
aggtttctgttctctgaatt

SEQ ID NO: 479413 - DNA, 20 bp, Artificial
  CRISPR gRNA sequence
ctgttctctgaattccagca

SEQ ID NO: 479414 - DNA, 20 bp, Artificial
  CRISPR gRNA sequence
tgttctctgaattccagcac

SEQ ID NO: 479415 - DNA, 20 bp, Artificial
  CRISPR gRNA sequence
ttctctgaattccagcacag

SEQ ID NO: 479416 - DNA, 20 bp, Artificial
  CRISPR gRNA sequence
tctgaattccagcacagtgc

SEQ ID NO: 479417 - DNA, 20 bp, Artificial
  CRISPR gRNA sequence
tgaattccagcacagtgctc

SEQ ID NO: 479418 - DNA, 20 bp, Artificial
  CRISPR gRNA sequence
aattccagcacagtgctcct

SEQ ID NO: 479419 - DNA, 20 bp, Artificial
  CRISPR gRNA sequence
cagcacagtgctccttagct

SEQ ID NO: 479420 - DNA, 20 bp, Artificial
  CRISPR gRNA sequence
cttagctgctccagccatgg

SEQ ID NO: 479421 - DNA, 20 bp, Artificial
  CRISPR gRNA sequence
agctgctccagccatggctc

SEQ ID NO: 479422 - DNA, 20 bp, Artificial
  CRISPR gRNA sequence
gctgctccagccatggctca

SEQ ID NO: 479423 - DNA, 20 bp, Artificial
  CRISPR gRNA sequence
ctccagccatggctcaagtg

SEQ ID NO: 479424 - DNA, 20 bp, Artificial
  CRISPR gRNA sequence
cagccatggctcaagtgagc

SEQ ID NO: 479425 - DNA, 20 bp, Artificial
  CRISPR gRNA sequence
aagtgagcccaggtgcagtt

SEQ ID NO: 479426 - DNA, 20 bp, Artificial
  CRISPR gRNA sequence
aacccaccactccataaggt

SEQ ID NO: 479427 - DNA, 20 bp, Artificial
  CRISPR gRNA sequence
cataaggtgcaattggtaag

SEQ ID NO: 479428 - DNA, 20 bp, Artificial
  CRISPR gRNA sequence
gtaagccttggtggcaccca

SEQ ID NO: 479429 - DNA, 20 bp, Artificial
  CRISPR gRNA sequence
ggtggcacccacttgctaag

SEQ ID NO: 479430 - DNA, 20 bp, Artificial
  CRISPR gRNA sequence
gtggcacccacttgctaagt

SEQ ID NO: 479431 - DNA, 20 bp, Artificial
  CRISPR gRNA sequence
gctaagtgtgcaggctagca

SEQ ID NO: 479432 - DNA, 20 bp, Artificial
  CRISPR gRNA sequence
ctaagtgtgcaggctagcag

SEQ ID NO: 479433 - DNA, 20 bp, Artificial
  CRISPR gRNA sequence
agtgtgcaggctagcagaat

SEQ ID NO: 479434 - DNA, 20 bp, Artificial
  CRISPR gRNA sequence
gcagaatgcaagaggtgtgg

SEQ ID NO: 479435 - DNA, 20 bp, Artificial
  CRISPR gRNA sequence
cctccatgtagatttcaaag

SEQ ID NO: 479436 - DNA, 20 bp, Artificial
  CRISPR gRNA sequence
ctccatgtagatttcaaagg

SEQ ID NO: 479437 - DNA, 20 bp, Artificial
  CRISPR gRNA sequence
catgtagatttcaaaggatg

SEQ ID NO: 479438 - DNA, 20 bp, Artificial
  CRISPR gRNA sequence
caaaggatgttgtggacagc

SEQ ID NO: 479439 - DNA, 20 bp, Artificial
  CRISPR gRNA sequence
aaaggatgttgtggacagcc

SEQ ID NO: 479440 - DNA, 20 bp, Artificial
  CRISPR gRNA sequence
tggacagcctgagggcccag

SEQ ID NO: 479441 - DNA, 20 bp, Artificial
  CRISPR gRNA sequence
agggcccaggaagagtccac

SEQ ID NO: 479442 - DNA, 20 bp, Artificial
  CRISPR gRNA sequence
ccatgtcagtgcctagtaga

SEQ ID NO: 479443 - DNA, 20 bp, Artificial
  CRISPR gRNA sequence
gtagagccatgggagtggac

SEQ ID NO: 479444 - DNA, 20 bp, Artificial
  CRISPR gRNA sequence
ccactgagaccccagaactg

SEQ ID NO: 479445 - DNA, 20 bp, Artificial
  CRISPR gRNA sequence
agaccccagaactgtggagc

SEQ ID NO: 479446 - DNA, 20 bp, Artificial
  CRISPR gRNA sequence
tggagctattagcctgaagc

SEQ ID NO: 479447 - DNA, 20 bp, Artificial
  CRISPR gRNA sequence
ttagcctgaagcattagcct

SEQ ID NO: 479448 - DNA, 20 bp, Artificial
  CRISPR gRNA sequence
gcctgaagcattagcctggg

SEQ ID NO: 479449 - DNA, 20 bp, Artificial
  CRISPR gRNA sequence
aagcattagcctgggagagc

SEQ ID NO: 479450 - DNA, 20 bp, Artificial
  CRISPR gRNA sequence
gcctgggagagctgcaggta

SEQ ID NO: 479451 - DNA, 20 bp, Artificial
  CRISPR gRNA sequence
ggagagctgcaggtaggagt

SEQ ID NO: 479452 - DNA, 20 bp, Artificial
  CRISPR gRNA sequence
caggtaggagtctccaactt

SEQ ID NO: 479453 - DNA, 20 bp, Artificial
  CRISPR gRNA sequence
caacttgtgagtgctgaagc

SEQ ID NO: 479454 - DNA, 20 bp, Artificial
  CRISPR gRNA sequence
gtgagtgctgaagcatcaac

SEQ ID NO: 479455 - DNA, 20 bp, Artificial
  CRISPR gRNA sequence
tgagtgctgaagcatcaacc

SEQ ID NO: 479456 - DNA, 20 bp, Artificial
  CRISPR gRNA sequence
aagcatcaaccaagcccagc

SEQ ID NO: 479457 - DNA, 20 bp, Artificial
  CRISPR gRNA sequence
tatttctctgttgggttttg

SEQ ID NO: 479458 - DNA, 20 bp, Artificial
  CRISPR gRNA sequence
atttctctgttgggttttgg

SEQ ID NO: 479459 - DNA, 20 bp, Artificial
  CRISPR gRNA sequence
tttctctgttgggttttgga

SEQ ID NO: 479460 - DNA, 20 bp, Artificial
  CRISPR gRNA sequence
ctctgttgggttttggactt

SEQ ID NO: 479461 - DNA, 20 bp, Artificial
  CRISPR gRNA sequence
tctgttgggttttggactta

SEQ ID NO: 479462 - DNA, 20 bp, Artificial
  CRISPR gRNA sequence
tgttgggttttggacttact

SEQ ID NO: 479463 - DNA, 20 bp, Artificial
  CRISPR gRNA sequence
ttgggttttggacttactta

SEQ ID NO: 479464 - DNA, 20 bp, Artificial
  CRISPR gRNA sequence
ggttttggacttacttagga

SEQ ID NO: 479465 - DNA, 20 bp, Artificial
  CRISPR gRNA sequence
tggacttacttaggaactgt

SEQ ID NO: 479466 - DNA, 20 bp, Artificial
  CRISPR gRNA sequence
ggacttacttaggaactgtt

SEQ ID NO: 479467 - DNA, 20 bp, Artificial
  CRISPR gRNA sequence
gacttacttaggaactgtta

SEQ ID NO: 479468 - DNA, 20 bp, Artificial
  CRISPR gRNA sequence
acttaggaactgttactttc

SEQ ID NO: 479469 - DNA, 20 bp, Artificial
  CRISPR gRNA sequence
cttaggaactgttactttct

SEQ ID NO: 479470 - DNA, 20 bp, Artificial
  CRISPR gRNA sequence
aggaactgttactttctcat

SEQ ID NO: 479471 - DNA, 20 bp, Artificial
  CRISPR gRNA sequence
ggaactgttactttctcatt

SEQ ID NO: 479472 - DNA, 20 bp, Artificial
  CRISPR gRNA sequence
ttactttctcatttttgcct

SEQ ID NO: 479473 - DNA, 20 bp, Artificial
  CRISPR gRNA sequence
ctttctcatttttgcctatt

SEQ ID NO: 479474 - DNA, 20 bp, Artificial
  CRISPR gRNA sequence
tctcatttttgcctatttct

SEQ ID NO: 479475 - DNA, 20 bp, Artificial
  CRISPR gRNA sequence
ctcatttttgcctatttctc

SEQ ID NO: 479476 - DNA, 20 bp, Artificial
  CRISPR gRNA sequence
tcatttttgcctatttctcc

SEQ ID NO: 479477 - DNA, 20 bp, Artificial
  CRISPR gRNA sequence
atttttgcctatttctccct

SEQ ID NO: 479478 - DNA, 20 bp, Artificial
  CRISPR gRNA sequence
ttgcctatttctcccttttg

SEQ ID NO: 479479 - DNA, 20 bp, Artificial
  CRISPR gRNA sequence
tgcctatttctcccttttgg

SEQ ID NO: 479480 - DNA, 20 bp, Artificial
  CRISPR gRNA sequence
gcctatttctcccttttgga

SEQ ID NO: 479481 - DNA, 20 bp, Artificial
  CRISPR gRNA sequence
cctatttctcccttttggaa

SEQ ID NO: 479482 - DNA, 20 bp, Artificial
  CRISPR gRNA sequence
tttctcccttttggaatggg

SEQ ID NO: 479483 - DNA, 20 bp, Artificial
  CRISPR gRNA sequence
ctcccttttggaatgggaat

SEQ ID NO: 479484 - DNA, 20 bp, Artificial
  CRISPR gRNA sequence
tcccttttggaatgggaata

SEQ ID NO: 479485 - DNA, 20 bp, Artificial
  CRISPR gRNA sequence
ccttttggaatgggaatatc

SEQ ID NO: 479486 - DNA, 20 bp, Artificial
  CRISPR gRNA sequence
ttggaatgggaatatctatc

SEQ ID NO: 479487 - DNA, 20 bp, Artificial
  CRISPR gRNA sequence
tggaatgggaatatctatct

SEQ ID NO: 479488 - DNA, 20 bp, Artificial
  CRISPR gRNA sequence
ggaatgggaatatctatctt

SEQ ID NO: 479489 - DNA, 20 bp, Artificial
  CRISPR gRNA sequence
gaatgggaatatctatctta

SEQ ID NO: 479490 - DNA, 20 bp, Artificial
  CRISPR gRNA sequence
tcttatatctgtcctaccac

SEQ ID NO: 479491 - DNA, 20 bp, Artificial
  CRISPR gRNA sequence
atatctgtcctaccactata

SEQ ID NO: 479492 - DNA, 20 bp, Artificial
  CRISPR gRNA sequence
tatctgtcctaccactatat

SEQ ID NO: 479493 - DNA, 20 bp, Artificial
  CRISPR gRNA sequence
tcctaccactatattttgga

SEQ ID NO: 479494 - DNA, 20 bp, Artificial
  CRISPR gRNA sequence
ccactatattttggaagtag

SEQ ID NO: 479495 - DNA, 20 bp, Artificial
  CRISPR gRNA sequence
tattttggaagtagataact

SEQ ID NO: 479496 - DNA, 20 bp, Artificial
  CRISPR gRNA sequence
tggaagtagataacttgttt

SEQ ID NO: 479497 - DNA, 20 bp, Artificial
  CRISPR gRNA sequence
ggaagtagataacttgtttt

SEQ ID NO: 479498 - DNA, 20 bp, Artificial
  CRISPR gRNA sequence
gaagtagataacttgttttg

SEQ ID NO: 479499 - DNA, 20 bp, Artificial
  CRISPR gRNA sequence
gttttgatttacatgatcat

SEQ ID NO: 479500 - DNA, 20 bp, Artificial
  CRISPR gRNA sequence
ttttgatttacatgatcata

SEQ ID NO: 479501 - DNA, 20 bp, Artificial
  CRISPR gRNA sequence
tgatttacatgatcatagtt

SEQ ID NO: 479502 - DNA, 20 bp, Artificial
  CRISPR gRNA sequence
gatttacatgatcatagttg

SEQ ID NO: 479503 - DNA, 20 bp, Artificial
  CRISPR gRNA sequence
atttacatgatcatagttgg

SEQ ID NO: 479504 - DNA, 20 bp, Artificial
  CRISPR gRNA sequence
acatgatcatagttggaggg

SEQ ID NO: 479505 - DNA, 20 bp, Artificial
  CRISPR gRNA sequence
catgatcatagttggaggga

SEQ ID NO: 479506 - DNA, 20 bp, Artificial
  CRISPR gRNA sequence
gagggaatttgcttcataat

SEQ ID NO: 479507 - DNA, 20 bp, Artificial
  CRISPR gRNA sequence
gcttcataatgaatcgtgcc

SEQ ID NO: 479508 - DNA, 20 bp, Artificial
  CRISPR gRNA sequence
cttcataatgaatcgtgcct

SEQ ID NO: 479509 - DNA, 20 bp, Artificial
  CRISPR gRNA sequence
cataatgaatcgtgccttga

SEQ ID NO: 479510 - DNA, 20 bp, Artificial
  CRISPR gRNA sequence
ataatgaatcgtgccttgaa

SEQ ID NO: 479511 - DNA, 20 bp, Artificial
  CRISPR gRNA sequence
gaatcttacccatatctggt

SEQ ID NO: 479512 - DNA, 20 bp, Artificial
  CRISPR gRNA sequence
aatcttacccatatctggtt

SEQ ID NO: 479513 - DNA, 20 bp, Artificial
  CRISPR gRNA sequence
acccatatctggtttagata

SEQ ID NO: 479514 - DNA, 20 bp, Artificial
  CRISPR gRNA sequence
cccatatctggtttagataa

SEQ ID NO: 479515 - DNA, 20 bp, Artificial
  CRISPR gRNA sequence
gtttagataagactctgaat

SEQ ID NO: 479516 - DNA, 20 bp, Artificial
  CRISPR gRNA sequence
agataagactctgaatttag

SEQ ID NO: 479517 - DNA, 20 bp, Artificial
  CRISPR gRNA sequence
gataagactctgaatttagt

SEQ ID NO: 479518 - DNA, 20 bp, Artificial
  CRISPR gRNA sequence
tgaatttagtgttttgaatt

SEQ ID NO: 479519 - DNA, 20 bp, Artificial
  CRISPR gRNA sequence
aatttagtgttttgaattga

SEQ ID NO: 479520 - DNA, 20 bp, Artificial
  CRISPR gRNA sequence
agtgttttgaattgattctg

SEQ ID NO: 479521 - DNA, 20 bp, Artificial
  CRISPR gRNA sequence
gtgttttgaattgattctgc

SEQ ID NO: 479522 - DNA, 20 bp, Artificial
  CRISPR gRNA sequence
tgaattgattctgcaataaa

SEQ ID NO: 479523 - DNA, 20 bp, Artificial
  CRISPR gRNA sequence
gaattgattctgcaataaat

SEQ ID NO: 479524 - DNA, 20 bp, Artificial
  CRISPR gRNA sequence
aattgattctgcaataaatt

SEQ ID NO: 479525 - DNA, 20 bp, Artificial
  CRISPR gRNA sequence
attctgcaataaattaaaac

SEQ ID NO: 479526 - DNA, 20 bp, Artificial
  CRISPR gRNA sequence
tgcaataaattaaaactttt

SEQ ID NO: 479527 - DNA, 20 bp, Artificial
  CRISPR gRNA sequence
caataaattaaaacttttgg

SEQ ID NO: 479528 - DNA, 20 bp, Artificial
  CRISPR gRNA sequence
aaacttttggggctattgag

SEQ ID NO: 479529 - DNA, 20 bp, Artificial
  CRISPR gRNA sequence
ttggggctattgagatggaa

SEQ ID NO: 479530 - DNA, 20 bp, Artificial
  CRISPR gRNA sequence
tggggctattgagatggaat

SEQ ID NO: 479531 - DNA, 20 bp, Artificial
  CRISPR gRNA sequence
ggggctattgagatggaatg

SEQ ID NO: 479532 - DNA, 20 bp, Artificial
  CRISPR gRNA sequence
gggctattgagatggaatga

SEQ ID NO: 479533 - DNA, 20 bp, Artificial
  CRISPR gRNA sequence
ttgagatggaatgaatgtat

SEQ ID NO: 479534 - DNA, 20 bp, Artificial
  CRISPR gRNA sequence
agatggaatgaatgtatttt

SEQ ID NO: 479535 - DNA, 20 bp, Artificial
  CRISPR gRNA sequence
tgtatgtgaaaagaacatga

SEQ ID NO: 479536 - DNA, 20 bp, Artificial
  CRISPR gRNA sequence
gtatgtgaaaagaacatgag

SEQ ID NO: 479537 - DNA, 20 bp, Artificial
  CRISPR gRNA sequence
tatgtgaaaagaacatgagt

SEQ ID NO: 479538 - DNA, 20 bp, Artificial
  CRISPR gRNA sequence
tgggggaccaggggcagaat

SEQ ID NO: 479539 - DNA, 20 bp, Artificial
  CRISPR gRNA sequence
gggggaccaggggcagaatg

SEQ ID NO: 479540 - DNA, 20 bp, Artificial
  CRISPR gRNA sequence
ggggaccaggggcagaatgc

SEQ ID NO: 479541 - DNA, 20 bp, Artificial
  CRISPR gRNA sequence
tggtttgaatgccccctcca

SEQ ID NO: 479542 - DNA, 20 bp, Artificial
  CRISPR gRNA sequence
gaatgccccctccaaaattc

SEQ ID NO: 479543 - DNA, 20 bp, Artificial
  CRISPR gRNA sequence
aatgccccctccaaaattca

SEQ ID NO: 479544 - DNA, 20 bp, Artificial
  CRISPR gRNA sequence
caaaattcatgttgaaattt

SEQ ID NO: 479545 - DNA, 20 bp, Artificial
  CRISPR gRNA sequence
atgttgaaattttattgcta

SEQ ID NO: 479546 - DNA, 20 bp, Artificial
  CRISPR gRNA sequence
aaattttattgctattgtaa

SEQ ID NO: 479547 - DNA, 20 bp, Artificial
  CRISPR gRNA sequence
tattgctattgtaacagttt

SEQ ID NO: 479548 - DNA, 20 bp, Artificial
  CRISPR gRNA sequence
attgctattgtaacagtttt

SEQ ID NO: 479549 - DNA, 20 bp, Artificial
  CRISPR gRNA sequence
ttgctattgtaacagttttg

SEQ ID NO: 479550 - DNA, 20 bp, Artificial
  CRISPR gRNA sequence
ctattgtaacagttttgtga

SEQ ID NO: 479551 - DNA, 20 bp, Artificial
  CRISPR gRNA sequence
ttgtaacagttttgtgaggt

SEQ ID NO: 479552 - DNA, 20 bp, Artificial
  CRISPR gRNA sequence
taacagttttgtgaggtgga

SEQ ID NO: 479553 - DNA, 20 bp, Artificial
  CRISPR gRNA sequence
tgtgaggtggaacctttaag

SEQ ID NO: 479554 - DNA, 20 bp, Artificial
  CRISPR gRNA sequence
gtgaggtggaacctttaaga

SEQ ID NO: 479555 - DNA, 20 bp, Artificial
  CRISPR gRNA sequence
tgaggtggaacctttaagag

SEQ ID NO: 479556 - DNA, 20 bp, Artificial
  CRISPR gRNA sequence
taagagatcagaggttatga

SEQ ID NO: 479557 - DNA, 20 bp, Artificial
  CRISPR gRNA sequence
aagagatcagaggttatgaa

SEQ ID NO: 479558 - DNA, 20 bp, Artificial
  CRISPR gRNA sequence
agagatcagaggttatgaat

SEQ ID NO: 479559 - DNA, 20 bp, Artificial
  CRISPR gRNA sequence
tgaatgtattaatgccctta

SEQ ID NO: 479560 - DNA, 20 bp, Artificial
  CRISPR gRNA sequence
atgcccttattgtaggaatg

SEQ ID NO: 479561 - DNA, 20 bp, Artificial
  CRISPR gRNA sequence
attgtaggaatggattcgtt

SEQ ID NO: 479562 - DNA, 20 bp, Artificial
  CRISPR gRNA sequence
ttgtaggaatggattcgtta

SEQ ID NO: 479563 - DNA, 20 bp, Artificial
  CRISPR gRNA sequence
taggaatggattcgttatca

SEQ ID NO: 479564 - DNA, 20 bp, Artificial
  CRISPR gRNA sequence
gttatcacgggagtaggcac

SEQ ID NO: 479565 - DNA, 20 bp, Artificial
  CRISPR gRNA sequence
tcacgggagtaggcacctga

SEQ ID NO: 479566 - DNA, 20 bp, Artificial
  CRISPR gRNA sequence
ataaaaggataaattttggc

SEQ ID NO: 479567 - DNA, 20 bp, Artificial
  CRISPR gRNA sequence
tggcccccatttttctctgt

SEQ ID NO: 479568 - DNA, 20 bp, Artificial
  CRISPR gRNA sequence
ggcccccatttttctctgtc

SEQ ID NO: 479569 - DNA, 20 bp, Artificial
  CRISPR gRNA sequence
gcccccatttttctctgtct

SEQ ID NO: 479570 - DNA, 20 bp, Artificial
  CRISPR gRNA sequence
ttctctgtcttgtgtgctcc

SEQ ID NO: 479571 - DNA, 20 bp, Artificial
  CRISPR gRNA sequence
tctctgtcttgtgtgctccc

SEQ ID NO: 479572 - DNA, 20 bp, Artificial
  CRISPR gRNA sequence
ctctgtcttgtgtgctccct

SEQ ID NO: 479573 - DNA, 20 bp, Artificial
  CRISPR gRNA sequence
tctgtcttgtgtgctccctt

SEQ ID NO: 479574 - DNA, 20 bp, Artificial
  CRISPR gRNA sequence
tgtcttgtgtgctcccttcc

SEQ ID NO: 479575 - DNA, 20 bp, Artificial
  CRISPR gRNA sequence
tcttgtgtgctcccttccac

SEQ ID NO: 479576 - DNA, 20 bp, Artificial
  CRISPR gRNA sequence
gtgtgctcccttccactttc

SEQ ID NO: 479577 - DNA, 20 bp, Artificial
  CRISPR gRNA sequence
tgtgctcccttccactttct

SEQ ID NO: 479578 - DNA, 20 bp, Artificial
  CRISPR gRNA sequence
ccttccactttctgctttct

SEQ ID NO: 479579 - DNA, 20 bp, Artificial
  CRISPR gRNA sequence
ccactttctgctttctgcca

SEQ ID NO: 479580 - DNA, 20 bp, Artificial
  CRISPR gRNA sequence
cactttctgctttctgccat

SEQ ID NO: 479581 - DNA, 20 bp, Artificial
  CRISPR gRNA sequence
tctgctttctgccatgagat

SEQ ID NO: 479582 - DNA, 20 bp, Artificial
  CRISPR gRNA sequence
ctgctttctgccatgagata

SEQ ID NO: 479583 - DNA, 20 bp, Artificial
  CRISPR gRNA sequence
tgctttctgccatgagataa

SEQ ID NO: 479584 - DNA, 20 bp, Artificial
  CRISPR gRNA sequence
ctttctgccatgagataatg

SEQ ID NO: 479585 - DNA, 20 bp, Artificial
  CRISPR gRNA sequence
tctgccatgagataatgcag

SEQ ID NO: 479586 - DNA, 20 bp, Artificial
  CRISPR gRNA sequence
ctgccatgagataatgcagc

SEQ ID NO: 479587 - DNA, 20 bp, Artificial
  CRISPR gRNA sequence
tgccatgagataatgcagca

SEQ ID NO: 479588 - DNA, 20 bp, Artificial
  CRISPR gRNA sequence
ccatgagataatgcagcaca

SEQ ID NO: 479589 - DNA, 20 bp, Artificial
  CRISPR gRNA sequence
tgctagatgctggcaccatg

SEQ ID NO: 479590 - DNA, 20 bp, Artificial
  CRISPR gRNA sequence
gctagatgctggcaccatgc

SEQ ID NO: 479591 - DNA, 20 bp, Artificial
  CRISPR gRNA sequence
ctagatgctggcaccatgct

SEQ ID NO: 479592 - DNA, 20 bp, Artificial
  CRISPR gRNA sequence
gatgctggcaccatgctctt

SEQ ID NO: 479593 - DNA, 20 bp, Artificial
  CRISPR gRNA sequence
gcaccatgctcttggacttc

SEQ ID NO: 479594 - DNA, 20 bp, Artificial
  CRISPR gRNA sequence
ttggacttcccagcctacag

SEQ ID NO: 479595 - DNA, 20 bp, Artificial
  CRISPR gRNA sequence
ggacttcccagcctacagag

SEQ ID NO: 479596 - DNA, 20 bp, Artificial
  CRISPR gRNA sequence
gacttcccagcctacagagc

SEQ ID NO: 479597 - DNA, 20 bp, Artificial
  CRISPR gRNA sequence
cccagcctacagagccatga

SEQ ID NO: 479598 - DNA, 20 bp, Artificial
  CRISPR gRNA sequence
ccagcctacagagccatgag

SEQ ID NO: 479599 - DNA, 20 bp, Artificial
  CRISPR gRNA sequence
cagagccatgagccaaataa

SEQ ID NO: 479600 - DNA, 20 bp, Artificial
  CRISPR gRNA sequence
ctgtgattcaaaaattatcc

SEQ ID NO: 479601 - DNA, 20 bp, Artificial
  CRISPR gRNA sequence
tgtgattcaaaaattatcca

SEQ ID NO: 479602 - DNA, 20 bp, Artificial
  CRISPR gRNA sequence
tgattcaaaaattatccaat

SEQ ID NO: 479603 - DNA, 20 bp, Artificial
  CRISPR gRNA sequence
aaaaattatccaatctcagg

SEQ ID NO: 479604 - DNA, 20 bp, Artificial
  CRISPR gRNA sequence
tccaatctcaggtattctgt

SEQ ID NO: 479605 - DNA, 20 bp, Artificial
  CRISPR gRNA sequence
aggtattctgttatactagc

SEQ ID NO: 479606 - DNA, 20 bp, Artificial
  CRISPR gRNA sequence
tgttatactagcagaaaaca

SEQ ID NO: 479607 - DNA, 20 bp, Artificial
  CRISPR gRNA sequence
ttatactagcagaaaacaga

SEQ ID NO: 479608 - DNA, 20 bp, Artificial
  CRISPR gRNA sequence
tactagcagaaaacagacta

SEQ ID NO: 479609 - DNA, 20 bp, Artificial
  CRISPR gRNA sequence
gcagaaaacagactaagaca

SEQ ID NO: 479610 - DNA, 20 bp, Artificial
  CRISPR gRNA sequence
agacagtgtctcatgtgtcc

SEQ ID NO: 479611 - DNA, 20 bp, Artificial
  CRISPR gRNA sequence
atgtgtccgtgtgtagagac

SEQ ID NO: 479612 - DNA, 20 bp, Artificial
  CRISPR gRNA sequence
tgtgtgagcaacaaggctgt

SEQ ID NO: 479613 - DNA, 20 bp, Artificial
  CRISPR gRNA sequence
gtgtgagcaacaaggctgtt

SEQ ID NO: 479614 - DNA, 20 bp, Artificial
  CRISPR gRNA sequence
tgtgagcaacaaggctgttt

SEQ ID NO: 479615 - DNA, 20 bp, Artificial
  CRISPR gRNA sequence
tttatttcaccttgcaggcg

SEQ ID NO: 479616 - DNA, 20 bp, Artificial
  CRISPR gRNA sequence
atttcaccttgcaggcgggc

SEQ ID NO: 479617 - DNA, 20 bp, Artificial
  CRISPR gRNA sequence
tttcaccttgcaggcgggct

SEQ ID NO: 479618 - DNA, 20 bp, Artificial
  CRISPR gRNA sequence
caccttgcaggcgggctgag

SEQ ID NO: 479619 - DNA, 20 bp, Artificial
  CRISPR gRNA sequence
accttgcaggcgggctgagt

SEQ ID NO: 479620 - DNA, 20 bp, Artificial
  CRISPR gRNA sequence
gcaggcgggctgagtccaaa

SEQ ID NO: 479621 - DNA, 20 bp, Artificial
  CRISPR gRNA sequence
caggcgggctgagtccaaaa

SEQ ID NO: 479622 - DNA, 20 bp, Artificial
  CRISPR gRNA sequence
agtccaaaaagagagtcagc

SEQ ID NO: 479623 - DNA, 20 bp, Artificial
  CRISPR gRNA sequence
tcattagtacttataggttt

SEQ ID NO: 479624 - DNA, 20 bp, Artificial
  CRISPR gRNA sequence
gtacttataggttttgggat

SEQ ID NO: 479625 - DNA, 20 bp, Artificial
  CRISPR gRNA sequence
ataggttttgggataggcag

SEQ ID NO: 479626 - DNA, 20 bp, Artificial
  CRISPR gRNA sequence
taggttttgggataggcagt

SEQ ID NO: 479627 - DNA, 20 bp, Artificial
  CRISPR gRNA sequence
tgggataggcagtggagtta

SEQ ID NO: 479628 - DNA, 20 bp, Artificial
  CRISPR gRNA sequence
gggataggcagtggagttaa

SEQ ID NO: 479629 - DNA, 20 bp, Artificial
  CRISPR gRNA sequence
ggataggcagtggagttaag

SEQ ID NO: 479630 - DNA, 20 bp, Artificial
  CRISPR gRNA sequence
agagcaatgttttgggggca

SEQ ID NO: 479631 - DNA, 20 bp, Artificial
  CRISPR gRNA sequence
tgggggcagggggtggatct

SEQ ID NO: 479632 - DNA, 20 bp, Artificial
  CRISPR gRNA sequence
gggggcagggggtggatctc

SEQ ID NO: 479633 - DNA, 20 bp, Artificial
  CRISPR gRNA sequence
ggggcagggggtggatctca

SEQ ID NO: 479634 - DNA, 20 bp, Artificial
  CRISPR gRNA sequence
acaaaatacattctcaaggg

SEQ ID NO: 479635 - DNA, 20 bp, Artificial
  CRISPR gRNA sequence
tcaagggtggggagaattac

SEQ ID NO: 479636 - DNA, 20 bp, Artificial
  CRISPR gRNA sequence
aagggtggggagaattacaa

SEQ ID NO: 479637 - DNA, 20 bp, Artificial
  CRISPR gRNA sequence
caaagaaacttcttaagggt

SEQ ID NO: 479638 - DNA, 20 bp, Artificial
  CRISPR gRNA sequence
cttaagggtgggggagatta

SEQ ID NO: 479639 - DNA, 20 bp, Artificial
  CRISPR gRNA sequence
ttaagggtgggggagattac

SEQ ID NO: 479640 - DNA, 20 bp, Artificial
  CRISPR gRNA sequence
aagggtgggggagattacaa

SEQ ID NO: 479641 - DNA, 20 bp, Artificial
  CRISPR gRNA sequence
agggtgggggagattacaaa

SEQ ID NO: 479642 - DNA, 20 bp, Artificial
  CRISPR gRNA sequence
caaagtacattgatcagtta

SEQ ID NO: 479643 - DNA, 20 bp, Artificial
  CRISPR gRNA sequence
atcagttagggtggggaaga

SEQ ID NO: 479644 - DNA, 20 bp, Artificial
  CRISPR gRNA sequence
gggtggggaagaaacaaatc

SEQ ID NO: 479645 - DNA, 20 bp, Artificial
  CRISPR gRNA sequence
aggctattttcacttctttt

SEQ ID NO: 479646 - DNA, 20 bp, Artificial
  CRISPR gRNA sequence
ttttcacttcttttgtggat

SEQ ID NO: 479647 - DNA, 20 bp, Artificial
  CRISPR gRNA sequence
tcacttcttttgtggatctt

SEQ ID NO: 479648 - DNA, 20 bp, Artificial
  CRISPR gRNA sequence
cacttcttttgtggatcttc

SEQ ID NO: 479649 - DNA, 20 bp, Artificial
  CRISPR gRNA sequence
acttcttttgtggatcttca

SEQ ID NO: 479650 - DNA, 20 bp, Artificial
  CRISPR gRNA sequence
cttttgtggatcttcagttg

SEQ ID NO: 479651 - DNA, 20 bp, Artificial
  CRISPR gRNA sequence
ttttgtggatcttcagttgc

SEQ ID NO: 479652 - DNA, 20 bp, Artificial
  CRISPR gRNA sequence
ttgtggatcttcagttgctt

SEQ ID NO: 479653 - DNA, 20 bp, Artificial
  CRISPR gRNA sequence
tgtggatcttcagttgcttc

SEQ ID NO: 479654 - DNA, 20 bp, Artificial
  CRISPR gRNA sequence
gtggatcttcagttgcttca

SEQ ID NO: 479655 - DNA, 20 bp, Artificial
  CRISPR gRNA sequence
tggatcttcagttgcttcag

SEQ ID NO: 479656 - DNA, 20 bp, Artificial
  CRISPR gRNA sequence
cagttgcttcaggccatctg

SEQ ID NO: 479657 - DNA, 20 bp, Artificial
  CRISPR gRNA sequence
agttgcttcaggccatctgg

SEQ ID NO: 479658 - DNA, 20 bp, Artificial
  CRISPR gRNA sequence
cttcaggccatctggatgta

SEQ ID NO: 479659 - DNA, 20 bp, Artificial
  CRISPR gRNA sequence
caggccatctggatgtatac

SEQ ID NO: 479660 - DNA, 20 bp, Artificial
  CRISPR gRNA sequence
aggccatctggatgtatacg

SEQ ID NO: 479661 - DNA, 20 bp, Artificial
  CRISPR gRNA sequence
gatgtatacgtgcaggtcac

SEQ ID NO: 479662 - DNA, 20 bp, Artificial
  CRISPR gRNA sequence
agcttgggctcaaaggcctg

SEQ ID NO: 479663 - DNA, 20 bp, Artificial
  CRISPR gRNA sequence
gcttgggctcaaaggcctga

SEQ ID NO: 479664 - DNA, 20 bp, Artificial
  CRISPR gRNA sequence
gggctcaaaggcctgacaga

SEQ ID NO: 479665 - DNA, 20 bp, Artificial
  CRISPR gRNA sequence
ggctcaaaggcctgacagac

SEQ ID NO: 479666 - DNA, 20 bp, Artificial
  CRISPR gRNA sequence
aaaggcctgacagacagagg

SEQ ID NO: 479667 - DNA, 20 bp, Artificial
  CRISPR gRNA sequence
acagacagaggattaaatga

SEQ ID NO: 479668 - DNA, 20 bp, Artificial
  CRISPR gRNA sequence
aatgatttatttcatttttt

SEQ ID NO: 479669 - DNA, 20 bp, Artificial
  CRISPR gRNA sequence
atttcattttttaaacatat

SEQ ID NO: 479670 - DNA, 20 bp, Artificial
  CRISPR gRNA sequence
tttcattttttaaacatatt

SEQ ID NO: 479671 - DNA, 20 bp, Artificial
  CRISPR gRNA sequence
cattttttaaacatatttat

SEQ ID NO: 479672 - DNA, 20 bp, Artificial
  CRISPR gRNA sequence
attttttaaacatatttatt

SEQ ID NO: 479673 - DNA, 20 bp, Artificial
  CRISPR gRNA sequence
tttaaacatatttattatat

SEQ ID NO: 479674 - DNA, 20 bp, Artificial
  CRISPR gRNA sequence
ttaaacatatttattatatg

SEQ ID NO: 479675 - DNA, 20 bp, Artificial
  CRISPR gRNA sequence
taaacatatttattatatgc

SEQ ID NO: 479676 - DNA, 20 bp, Artificial
  CRISPR gRNA sequence
aaacatatttattatatgcc

SEQ ID NO: 479677 - DNA, 20 bp, Artificial
  CRISPR gRNA sequence
aacatatttattatatgcct

SEQ ID NO: 479678 - DNA, 20 bp, Artificial
  CRISPR gRNA sequence
attatatgcctaatatgtat

SEQ ID NO: 479679 - DNA, 20 bp, Artificial
  CRISPR gRNA sequence
ttatatgcctaatatgtatg

SEQ ID NO: 479680 - DNA, 20 bp, Artificial
  CRISPR gRNA sequence
tatgcctaatatgtatgaga

SEQ ID NO: 479681 - DNA, 20 bp, Artificial
  CRISPR gRNA sequence
atatgtatgagacattctgc

SEQ ID NO: 479682 - DNA, 20 bp, Artificial
  CRISPR gRNA sequence
tgctagtaaggcttaattac

SEQ ID NO: 479683 - DNA, 20 bp, Artificial
  CRISPR gRNA sequence
ctagtaaggcttaattacta

SEQ ID NO: 479684 - DNA, 20 bp, Artificial
  CRISPR gRNA sequence
gtaaggcttaattactagaa

SEQ ID NO: 479685 - DNA, 20 bp, Artificial
  CRISPR gRNA sequence
aattactagaaattgggggg

SEQ ID NO: 479686 - DNA, 20 bp, Artificial
  CRISPR gRNA sequence
attactagaaattggggggt

SEQ ID NO: 479687 - DNA, 20 bp, Artificial
  CRISPR gRNA sequence
ctagaaattggggggttgtt

SEQ ID NO: 479688 - DNA, 20 bp, Artificial
  CRISPR gRNA sequence
gaaattggggggttgttttt

SEQ ID NO: 479689 - DNA, 20 bp, Artificial
  CRISPR gRNA sequence
gggggttgtttttgaaaatt

SEQ ID NO: 479690 - DNA, 20 bp, Artificial
  CRISPR gRNA sequence
tttttgaaaattaccaaata

SEQ ID NO: 479691 - DNA, 20 bp, Artificial
  CRISPR gRNA sequence
ttgaaaattaccaaataatg

SEQ ID NO: 479692 - DNA, 20 bp, Artificial
  CRISPR gRNA sequence
tgaaaattaccaaataatgc

SEQ ID NO: 479693 - DNA, 20 bp, Artificial
  CRISPR gRNA sequence
gaaaattaccaaataatgct

SEQ ID NO: 479694 - DNA, 20 bp, Artificial
  CRISPR gRNA sequence
aaaattaccaaataatgctt

SEQ ID NO: 479695 - DNA, 20 bp, Artificial
  CRISPR gRNA sequence
ccaaataatgcttgagaact

SEQ ID NO: 479696 - DNA, 20 bp, Artificial
  CRISPR gRNA sequence
gagaactattgaagtcacat

SEQ ID NO: 479697 - DNA, 20 bp, Artificial
  CRISPR gRNA sequence
agaactattgaagtcacata

SEQ ID NO: 479698 - DNA, 20 bp, Artificial
  CRISPR gRNA sequence
ttgaagtcacatatatatgg

SEQ ID NO: 479699 - DNA, 20 bp, Artificial
  CRISPR gRNA sequence
aagtcacatatatatggtac

SEQ ID NO: 479700 - DNA, 20 bp, Artificial
  CRISPR gRNA sequence
ccagaagaacatatttgatt

SEQ ID NO: 479701 - DNA, 20 bp, Artificial
  CRISPR gRNA sequence
cagaagaacatatttgattt

SEQ ID NO: 479702 - DNA, 20 bp, Artificial
  CRISPR gRNA sequence
gattttagttttgtttttat

SEQ ID NO: 479703 - DNA, 20 bp, Artificial
  CRISPR gRNA sequence
attttagttttgtttttatc

SEQ ID NO: 479704 - DNA, 20 bp, Artificial
  CRISPR gRNA sequence
tagttttgtttttatctttt

SEQ ID NO: 479705 - DNA, 20 bp, Artificial
  CRISPR gRNA sequence
agttttgtttttatctttta

SEQ ID NO: 479706 - DNA, 20 bp, Artificial
  CRISPR gRNA sequence
gttttgtttttatcttttag

SEQ ID NO: 479707 - DNA, 20 bp, Artificial
  CRISPR gRNA sequence
tgtttttatcttttagggaa

SEQ ID NO: 479708 - DNA, 20 bp, Artificial
  CRISPR gRNA sequence
gtttttatcttttagggaaa

SEQ ID NO: 479709 - DNA, 20 bp, Artificial
  CRISPR gRNA sequence
tttttatcttttagggaaag

SEQ ID NO: 479710 - DNA, 20 bp, Artificial
  CRISPR gRNA sequence
ttatcttttagggaaagaat

SEQ ID NO: 479711 - DNA, 20 bp, Artificial
  CRISPR gRNA sequence
tatcttttagggaaagaatc

SEQ ID NO: 479712 - DNA, 20 bp, Artificial
  CRISPR gRNA sequence
atcttttagggaaagaatca

SEQ ID NO: 479713 - DNA, 20 bp, Artificial
  CRISPR gRNA sequence
tcttttagggaaagaatcat

SEQ ID NO: 479714 - DNA, 20 bp, Artificial
  CRISPR gRNA sequence
ttagggaaagaatcatgtga

SEQ ID NO: 479715 - DNA, 20 bp, Artificial
  CRISPR gRNA sequence
tagggaaagaatcatgtgat

SEQ ID NO: 479716 - DNA, 20 bp, Artificial
  CRISPR gRNA sequence
agggaaagaatcatgtgatg

SEQ ID NO: 479717 - DNA, 20 bp, Artificial
  CRISPR gRNA sequence
gggaaagaatcatgtgatgt

SEQ ID NO: 479718 - DNA, 20 bp, Artificial
  CRISPR gRNA sequence
tatataaagagacaatctga

SEQ ID NO: 479719 - DNA, 20 bp, Artificial
  CRISPR gRNA sequence
atataaagagacaatctgaa

SEQ ID NO: 479720 - DNA, 20 bp, Artificial
  CRISPR gRNA sequence
tataaagagacaatctgaac

SEQ ID NO: 479721 - DNA, 20 bp, Artificial
  CRISPR gRNA sequence
aacactccatcttagcagga

SEQ ID NO: 479722 - DNA, 20 bp, Artificial
  CRISPR gRNA sequence
catcttagcaggagatccct

SEQ ID NO: 479723 - DNA, 20 bp, Artificial
  CRISPR gRNA sequence
agcaggagatccctttgaac

SEQ ID NO: 479724 - DNA, 20 bp, Artificial
  CRISPR gRNA sequence
gcaggagatccctttgaact

SEQ ID NO: 479725 - DNA, 20 bp, Artificial
  CRISPR gRNA sequence
tgaactagaatgccctgtga

SEQ ID NO: 479726 - DNA, 20 bp, Artificial
  CRISPR gRNA sequence
gaactagaatgccctgtgaa

SEQ ID NO: 479727 - DNA, 20 bp, Artificial
  CRISPR gRNA sequence
aactagaatgccctgtgaaa

SEQ ID NO: 479728 - DNA, 20 bp, Artificial
  CRISPR gRNA sequence
gaatgccctgtgaaatactg

SEQ ID NO: 479729 - DNA, 20 bp, Artificial
  CRISPR gRNA sequence
tgaaatactgtgctaacagg

SEQ ID NO: 479730 - DNA, 20 bp, Artificial
  CRISPR gRNA sequence
tgctaacaggcctcatgtga

SEQ ID NO: 479731 - DNA, 20 bp, Artificial
  CRISPR gRNA sequence
acaggcctcatgtgacttgg

SEQ ID NO: 479732 - DNA, 20 bp, Artificial
  CRISPR gRNA sequence
atgtgacttggtgcaagctc

SEQ ID NO: 479733 - DNA, 20 bp, Artificial
  CRISPR gRNA sequence
ggtgcaagctcaatggaaca

SEQ ID NO: 479734 - DNA, 20 bp, Artificial
  CRISPR gRNA sequence
gtgcaagctcaatggaacaa

SEQ ID NO: 479735 - DNA, 20 bp, Artificial
  CRISPR gRNA sequence
aatggaacaacatgtgtaaa

SEQ ID NO: 479736 - DNA, 20 bp, Artificial
  CRISPR gRNA sequence
gaagatagacaaacaagttg

SEQ ID NO: 479737 - DNA, 20 bp, Artificial
  CRISPR gRNA sequence
aagatagacaaacaagttgg

SEQ ID NO: 479738 - DNA, 20 bp, Artificial
  CRISPR gRNA sequence
gaaggaagagaagaacattt

SEQ ID NO: 479739 - DNA, 20 bp, Artificial
  CRISPR gRNA sequence
catttttcattctacatttt

SEQ ID NO: 479740 - DNA, 20 bp, Artificial
  CRISPR gRNA sequence
atttttcattctacattttg

SEQ ID NO: 479741 - DNA, 20 bp, Artificial
  CRISPR gRNA sequence
ttcattctacattttgaacc

SEQ ID NO: 479742 - DNA, 20 bp, Artificial
  CRISPR gRNA sequence
tcattctacattttgaacca

SEQ ID NO: 479743 - DNA, 20 bp, Artificial
  CRISPR gRNA sequence
cattctacattttgaaccag

SEQ ID NO: 479744 - DNA, 20 bp, Artificial
  CRISPR gRNA sequence
attctacattttgaaccagt

SEQ ID NO: 479745 - DNA, 20 bp, Artificial
  CRISPR gRNA sequence
tacattttgaaccagtgctt

SEQ ID NO: 479746 - DNA, 20 bp, Artificial
  CRISPR gRNA sequence
cattttgaaccagtgcttcc

SEQ ID NO: 479747 - DNA, 20 bp, Artificial
  CRISPR gRNA sequence
tgaaccagtgcttcctaatg

SEQ ID NO: 479748 - DNA, 20 bp, Artificial
  CRISPR gRNA sequence
gaaccagtgcttcctaatga

SEQ ID NO: 479749 - DNA, 20 bp, Artificial
  CRISPR gRNA sequence
aaccagtgcttcctaatgac

SEQ ID NO: 479750 - DNA, 20 bp, Artificial
  CRISPR gRNA sequence
cctaatgacaatgggtcata

SEQ ID NO: 479751 - DNA, 20 bp, Artificial
  CRISPR gRNA sequence
ctaatgacaatgggtcatac

SEQ ID NO: 479752 - DNA, 20 bp, Artificial
  CRISPR gRNA sequence
atgacaatgggtcataccgc

SEQ ID NO: 479753 - DNA, 20 bp, Artificial
  CRISPR gRNA sequence
ttctgcaaattttcagtcta

SEQ ID NO: 479754 - DNA, 20 bp, Artificial
  CRISPR gRNA sequence
tgcaaattttcagtctaatc

SEQ ID NO: 479755 - DNA, 20 bp, Artificial
  CRISPR gRNA sequence
caaattttcagtctaatctc

SEQ ID NO: 479756 - DNA, 20 bp, Artificial
  CRISPR gRNA sequence
tcagtctaatctcattgaaa

SEQ ID NO: 479757 - DNA, 20 bp, Artificial
  CRISPR gRNA sequence
cagtctaatctcattgaaag

SEQ ID NO: 479758 - DNA, 20 bp, Artificial
  CRISPR gRNA sequence
agtctaatctcattgaaagc

SEQ ID NO: 479759 - DNA, 20 bp, Artificial
  CRISPR gRNA sequence
atctcattgaaagccactca

SEQ ID NO: 479760 - DNA, 20 bp, Artificial
  CRISPR gRNA sequence
attgaaagccactcaacaac

SEQ ID NO: 479761 - DNA, 20 bp, Artificial
  CRISPR gRNA sequence
aaagccactcaacaactctt

SEQ ID NO: 479762 - DNA, 20 bp, Artificial
  CRISPR gRNA sequence
aacaactctttatgtgacag

SEQ ID NO: 479763 - DNA, 20 bp, Artificial
  CRISPR gRNA sequence
tttatgtgacaggtgagttc

SEQ ID NO: 479764 - DNA, 20 bp, Artificial
  CRISPR gRNA sequence
tatgtgacaggtgagttctc

SEQ ID NO: 479765 - DNA, 20 bp, Artificial
  CRISPR gRNA sequence
atgtgacaggtgagttctca

SEQ ID NO: 479766 - DNA, 20 bp, Artificial
  CRISPR gRNA sequence
tgtgacaggtgagttctcaa

SEQ ID NO: 479767 - DNA, 20 bp, Artificial
  CRISPR gRNA sequence
tcaacacctagaccatctga

SEQ ID NO: 479768 - DNA, 20 bp, Artificial
  CRISPR gRNA sequence
aacacctagaccatctgata

SEQ ID NO: 479769 - DNA, 20 bp, Artificial
  CRISPR gRNA sequence
gaccatctgatatttttctt

SEQ ID NO: 479770 - DNA, 20 bp, Artificial
  CRISPR gRNA sequence
atatttttcttataatgttt

SEQ ID NO: 479771 - DNA, 20 bp, Artificial
  CRISPR gRNA sequence
ttcttataatgtttccagga

SEQ ID NO: 479772 - DNA, 20 bp, Artificial
  CRISPR gRNA sequence
tcttataatgtttccaggaa

SEQ ID NO: 479773 - DNA, 20 bp, Artificial
  CRISPR gRNA sequence
cttataatgtttccaggaag

SEQ ID NO: 479774 - DNA, 20 bp, Artificial
  CRISPR gRNA sequence
ttataatgtttccaggaaga

SEQ ID NO: 479775 - DNA, 20 bp, Artificial
  CRISPR gRNA sequence
ataatgtttccaggaagagg

SEQ ID NO: 479776 - DNA, 20 bp, Artificial
  CRISPR gRNA sequence
taatgtttccaggaagaggg

SEQ ID NO: 479777 - DNA, 20 bp, Artificial
  CRISPR gRNA sequence
ccaggaagaggggggttcag

SEQ ID NO: 479778 - DNA, 20 bp, Artificial
  CRISPR gRNA sequence
caggaagaggggggttcagt

SEQ ID NO: 479779 - DNA, 20 bp, Artificial
  CRISPR gRNA sequence
agtttctcaagtgattatgt

SEQ ID NO: 479780 - DNA, 20 bp, Artificial
  CRISPR gRNA sequence
ctcaagtgattatgttagaa

SEQ ID NO: 479781 - DNA, 20 bp, Artificial
  CRISPR gRNA sequence
tcaagtgattatgttagaaa

SEQ ID NO: 479782 - DNA, 20 bp, Artificial
  CRISPR gRNA sequence
aagtgattatgttagaaagc

SEQ ID NO: 479783 - DNA, 20 bp, Artificial
  CRISPR gRNA sequence
tgttagaaagccaactccta

SEQ ID NO: 479784 - DNA, 20 bp, Artificial
  CRISPR gRNA sequence
gaaagccaactcctatagca

SEQ ID NO: 479785 - DNA, 20 bp, Artificial
  CRISPR gRNA sequence
ctatagcacatctgaaatct

SEQ ID NO: 479786 - DNA, 20 bp, Artificial
  CRISPR gRNA sequence
tagcacatctgaaatctgct

SEQ ID NO: 479787 - DNA, 20 bp, Artificial
  CRISPR gRNA sequence
aaatctgctacacctcacag

SEQ ID NO: 479788 - DNA, 20 bp, Artificial
  CRISPR gRNA sequence
ctacacctcacagattgtta

SEQ ID NO: 479789 - DNA, 20 bp, Artificial
  CRISPR gRNA sequence
cacctcacagattgttatgt

SEQ ID NO: 479790 - DNA, 20 bp, Artificial
  CRISPR gRNA sequence
acagattgttatgtgccagt

SEQ ID NO: 479791 - DNA, 20 bp, Artificial
  CRISPR gRNA sequence
ttatgtgccagtgtgtacat

SEQ ID NO: 479792 - DNA, 20 bp, Artificial
  CRISPR gRNA sequence
tgtgccagtgtgtacatatg

SEQ ID NO: 479793 - DNA, 20 bp, Artificial
  CRISPR gRNA sequence
gaggtgagtgagatagagga

SEQ ID NO: 479794 - DNA, 20 bp, Artificial
  CRISPR gRNA sequence
aggtgagtgagatagaggag

SEQ ID NO: 479795 - DNA, 20 bp, Artificial
  CRISPR gRNA sequence
ttgtttttgactttagggat

SEQ ID NO: 479796 - DNA, 20 bp, Artificial
  CRISPR gRNA sequence
tttttgactttagggattat

SEQ ID NO: 479797 - DNA, 20 bp, Artificial
  CRISPR gRNA sequence
ttgactttagggattataaa

SEQ ID NO: 479798 - DNA, 20 bp, Artificial
  CRISPR gRNA sequence
tgactttagggattataaaa

SEQ ID NO: 479799 - DNA, 20 bp, Artificial
  CRISPR gRNA sequence
gactttagggattataaaat

SEQ ID NO: 479800 - DNA, 20 bp, Artificial
  CRISPR gRNA sequence
actttagggattataaaatt

SEQ ID NO: 479801 - DNA, 20 bp, Artificial
  CRISPR gRNA sequence
tagggattataaaatttatt

SEQ ID NO: 479802 - DNA, 20 bp, Artificial
  CRISPR gRNA sequence
agggattataaaatttattt

SEQ ID NO: 479803 - DNA, 20 bp, Artificial
  CRISPR gRNA sequence
gggattataaaatttatttg

SEQ ID NO: 479804 - DNA, 20 bp, Artificial
  CRISPR gRNA sequence
taaaatttatttgataagtc

SEQ ID NO: 479805 - DNA, 20 bp, Artificial
  CRISPR gRNA sequence
atttgataagtccaaaagta

SEQ ID NO: 479806 - DNA, 20 bp, Artificial
  CRISPR gRNA sequence
tttgataagtccaaaagtag

SEQ ID NO: 479807 - DNA, 20 bp, Artificial
  CRISPR gRNA sequence
gataagtccaaaagtagacc

SEQ ID NO: 479808 - DNA, 20 bp, Artificial
  CRISPR gRNA sequence
ataagtccaaaagtagacca

SEQ ID NO: 479809 - DNA, 20 bp, Artificial
  CRISPR gRNA sequence
aaatattgaaaaaattataa

SEQ ID NO: 479810 - DNA, 20 bp, Artificial
  CRISPR gRNA sequence
aaaaaattataaagtgaata

SEQ ID NO: 479811 - DNA, 20 bp, Artificial
  CRISPR gRNA sequence
taaagtgaatacctatagtt

SEQ ID NO: 479812 - DNA, 20 bp, Artificial
  CRISPR gRNA sequence
tagttgcgaatagctctgtg

SEQ ID NO: 479813 - DNA, 20 bp, Artificial
  CRISPR gRNA sequence
cgaatagctctgtgattgct

SEQ ID NO: 479814 - DNA, 20 bp, Artificial
  CRISPR gRNA sequence
tgtgattgcttgtccttctt

SEQ ID NO: 479815 - DNA, 20 bp, Artificial
  CRISPR gRNA sequence
tgattgcttgtccttctttg

SEQ ID NO: 479816 - DNA, 20 bp, Artificial
  CRISPR gRNA sequence
cttgtccttctttgttgttt

SEQ ID NO: 479817 - DNA, 20 bp, Artificial
  CRISPR gRNA sequence
gtccttctttgttgtttttt

SEQ ID NO: 479818 - DNA, 20 bp, Artificial
  CRISPR gRNA sequence
tccttctttgttgttttttt

SEQ ID NO: 479819 - DNA, 20 bp, Artificial
  CRISPR gRNA sequence
ctttgttgttttttttttct

SEQ ID NO: 479820 - DNA, 20 bp, Artificial
  CRISPR gRNA sequence
tttgttgttttttttttctc

SEQ ID NO: 479821 - DNA, 20 bp, Artificial
  CRISPR gRNA sequence
tgttgttttttttttctctt

SEQ ID NO: 479822 - DNA, 20 bp, Artificial
  CRISPR gRNA sequence
gttgttttttttttctcttt

SEQ ID NO: 479823 - DNA, 20 bp, Artificial
  CRISPR gRNA sequence
ttgttttttttttctctttt

SEQ ID NO: 479824 - DNA, 20 bp, Artificial
  CRISPR gRNA sequence
ttttttttttctctttttcc

SEQ ID NO: 479825 - DNA, 20 bp, Artificial
  CRISPR gRNA sequence
tttttttctctttttcccat

SEQ ID NO: 479826 - DNA, 20 bp, Artificial
  CRISPR gRNA sequence
ttttttctctttttcccatt

SEQ ID NO: 479827 - DNA, 20 bp, Artificial
  CRISPR gRNA sequence
tttttctctttttcccattt

SEQ ID NO: 479828 - DNA, 20 bp, Artificial
  CRISPR gRNA sequence
ttttctctttttcccatttt

SEQ ID NO: 479829 - DNA, 20 bp, Artificial
  CRISPR gRNA sequence
tttctctttttcccattttt

SEQ ID NO: 479830 - DNA, 20 bp, Artificial
  CRISPR gRNA sequence
ttctctttttcccatttttc

SEQ ID NO: 479831 - DNA, 20 bp, Artificial
  CRISPR gRNA sequence
tctctttttcccatttttct

SEQ ID NO: 479832 - DNA, 20 bp, Artificial
  CRISPR gRNA sequence
ctctttttcccatttttctc

SEQ ID NO: 479833 - DNA, 20 bp, Artificial
  CRISPR gRNA sequence
tctttttcccatttttctct

SEQ ID NO: 479834 - DNA, 20 bp, Artificial
  CRISPR gRNA sequence
tttttcccatttttctcttc

SEQ ID NO: 479835 - DNA, 20 bp, Artificial
  CRISPR gRNA sequence
tttcccatttttctcttctt

SEQ ID NO: 479836 - DNA, 20 bp, Artificial
  CRISPR gRNA sequence
ttcccatttttctcttcttt

SEQ ID NO: 479837 - DNA, 20 bp, Artificial
  CRISPR gRNA sequence
tcccatttttctcttcttta

SEQ ID NO: 479838 - DNA, 20 bp, Artificial
  CRISPR gRNA sequence
cccatttttctcttctttac

SEQ ID NO: 479839 - DNA, 20 bp, Artificial
  CRISPR gRNA sequence
ccatttttctcttctttact

SEQ ID NO: 479840 - DNA, 20 bp, Artificial
  CRISPR gRNA sequence
ttctcttctttacttttgtt

SEQ ID NO: 479841 - DNA, 20 bp, Artificial
  CRISPR gRNA sequence
tctcttctttacttttgttc

SEQ ID NO: 479842 - DNA, 20 bp, Artificial
  CRISPR gRNA sequence
ctcttctttacttttgttca

SEQ ID NO: 479843 - DNA, 20 bp, Artificial
  CRISPR gRNA sequence
tcttctttacttttgttcat

SEQ ID NO: 479844 - DNA, 20 bp, Artificial
  CRISPR gRNA sequence
ttctttacttttgttcatta

SEQ ID NO: 479845 - DNA, 20 bp, Artificial
  CRISPR gRNA sequence
ctttacttttgttcattaca

SEQ ID NO: 479846 - DNA, 20 bp, Artificial
  CRISPR gRNA sequence
tttacttttgttcattacaa

SEQ ID NO: 479847 - DNA, 20 bp, Artificial
  CRISPR gRNA sequence
tacttttgttcattacaatt

SEQ ID NO: 479848 - DNA, 20 bp, Artificial
  CRISPR gRNA sequence
acttttgttcattacaattt

SEQ ID NO: 479849 - DNA, 20 bp, Artificial
  CRISPR gRNA sequence
cttttgttcattacaatttc

SEQ ID NO: 479850 - DNA, 20 bp, Artificial
  CRISPR gRNA sequence
ttgttcattacaatttcttg

SEQ ID NO: 479851 - DNA, 20 bp, Artificial
  CRISPR gRNA sequence
tgttcattacaatttcttga

SEQ ID NO: 479852 - DNA, 20 bp, Artificial
  CRISPR gRNA sequence
gttcattacaatttcttgaa

SEQ ID NO: 479853 - DNA, 20 bp, Artificial
  CRISPR gRNA sequence
ttcattacaatttcttgaag

SEQ ID NO: 479854 - DNA, 20 bp, Artificial
  CRISPR gRNA sequence
attacaatttcttgaagtta

SEQ ID NO: 479855 - DNA, 20 bp, Artificial
  CRISPR gRNA sequence
caatttcttgaagttatgtt

SEQ ID NO: 479856 - DNA, 20 bp, Artificial
  CRISPR gRNA sequence
cttgaagttatgtttgtggt

SEQ ID NO: 479857 - DNA, 20 bp, Artificial
  CRISPR gRNA sequence
ttgaagttatgtttgtggtg

SEQ ID NO: 479858 - DNA, 20 bp, Artificial
  CRISPR gRNA sequence
gaagttatgtttgtggtgct

SEQ ID NO: 479859 - DNA, 20 bp, Artificial
  CRISPR gRNA sequence
aagttatgtttgtggtgctt

SEQ ID NO: 479860 - DNA, 20 bp, Artificial
  CRISPR gRNA sequence
tgtttgtggtgcttaggcaa

SEQ ID NO: 479861 - DNA, 20 bp, Artificial
  CRISPR gRNA sequence
gtggtgcttaggcaattaaa

SEQ ID NO: 479862 - DNA, 20 bp, Artificial
  CRISPR gRNA sequence
tggtgcttaggcaattaaac

SEQ ID NO: 479863 - DNA, 20 bp, Artificial
  CRISPR gRNA sequence
aggcaattaaacacttctta

SEQ ID NO: 479864 - DNA, 20 bp, Artificial
  CRISPR gRNA sequence
ggcaattaaacacttcttaa

SEQ ID NO: 479865 - DNA, 20 bp, Artificial
  CRISPR gRNA sequence
aacacttcttaatagttcac

SEQ ID NO: 479866 - DNA, 20 bp, Artificial
  CRISPR gRNA sequence
cttaatagttcacagtttgt

SEQ ID NO: 479867 - DNA, 20 bp, Artificial
  CRISPR gRNA sequence
ttaatagttcacagtttgtt

SEQ ID NO: 479868 - DNA, 20 bp, Artificial
  CRISPR gRNA sequence
aatagttcacagtttgttta

SEQ ID NO: 479869 - DNA, 20 bp, Artificial
  CRISPR gRNA sequence
atagttcacagtttgtttag

SEQ ID NO: 479870 - DNA, 20 bp, Artificial
  CRISPR gRNA sequence
acagtttgtttagaggaaaa

SEQ ID NO: 479871 - DNA, 20 bp, Artificial
  CRISPR gRNA sequence
gtttagaggaaaaacagcaa

SEQ ID NO: 479872 - DNA, 20 bp, Artificial
  CRISPR gRNA sequence
tttagaggaaaaacagcaaa

SEQ ID NO: 479873 - DNA, 20 bp, Artificial
  CRISPR gRNA sequence
agaggaaaaacagcaaacaa

SEQ ID NO: 479874 - DNA, 20 bp, Artificial
  CRISPR gRNA sequence
gaggaaaaacagcaaacaac

SEQ ID NO: 479875 - DNA, 20 bp, Artificial
  CRISPR gRNA sequence
actgacttcctagtgatttt

SEQ ID NO: 479876 - DNA, 20 bp, Artificial
  CRISPR gRNA sequence
acttcctagtgattttctgg

SEQ ID NO: 479877 - DNA, 20 bp, Artificial
  CRISPR gRNA sequence
cctagtgattttctgggaat

SEQ ID NO: 479878 - DNA, 20 bp, Artificial
  CRISPR gRNA sequence
ctagtgattttctgggaata

SEQ ID NO: 479879 - DNA, 20 bp, Artificial
  CRISPR gRNA sequence
gtgattttctgggaatattc

SEQ ID NO: 479880 - DNA, 20 bp, Artificial
  CRISPR gRNA sequence
tctgggaatattcagagctt

SEQ ID NO: 479881 - DNA, 20 bp, Artificial
  CRISPR gRNA sequence
ctgggaatattcagagcttc

SEQ ID NO: 479882 - DNA, 20 bp, Artificial
  CRISPR gRNA sequence
tgggaatattcagagcttca

SEQ ID NO: 479883 - DNA, 20 bp, Artificial
  CRISPR gRNA sequence
ggaatattcagagcttcatc

SEQ ID NO: 479884 - DNA, 20 bp, Artificial
  CRISPR gRNA sequence
agagcttcatctctcttccc

SEQ ID NO: 479885 - DNA, 20 bp, Artificial
  CRISPR gRNA sequence
catctctcttccctgttccc

SEQ ID NO: 479886 - DNA, 20 bp, Artificial
  CRISPR gRNA sequence
atctctcttccctgttcccc

SEQ ID NO: 479887 - DNA, 20 bp, Artificial
  CRISPR gRNA sequence
tcttccctgttccccgaaag

SEQ ID NO: 479888 - DNA, 20 bp, Artificial
  CRISPR gRNA sequence
ttccctgttccccgaaagag

SEQ ID NO: 479889 - DNA, 20 bp, Artificial
  CRISPR gRNA sequence
ccctgttccccgaaagaggc

SEQ ID NO: 479890 - DNA, 20 bp, Artificial
  CRISPR gRNA sequence
cctgttccccgaaagaggcc

SEQ ID NO: 479891 - DNA, 20 bp, Artificial
  CRISPR gRNA sequence
ttccccgaaagaggccttta

SEQ ID NO: 479892 - DNA, 20 bp, Artificial
  CRISPR gRNA sequence
cccgaaagaggcctttaata

SEQ ID NO: 479893 - DNA, 20 bp, Artificial
  CRISPR gRNA sequence
taatatgctttgacaactga

SEQ ID NO: 479894 - DNA, 20 bp, Artificial
  CRISPR gRNA sequence
aatatgctttgacaactgag

SEQ ID NO: 479895 - DNA, 20 bp, Artificial
  CRISPR gRNA sequence
atatgctttgacaactgagg

SEQ ID NO: 479896 - DNA, 20 bp, Artificial
  CRISPR gRNA sequence
tgacaactgaggaaggacag

SEQ ID NO: 479897 - DNA, 20 bp, Artificial
  CRISPR gRNA sequence
gacaactgaggaaggacaga

SEQ ID NO: 479898 - DNA, 20 bp, Artificial
  CRISPR gRNA sequence
acaactgaggaaggacagat

SEQ ID NO: 479899 - DNA, 20 bp, Artificial
  CRISPR gRNA sequence
aggaaggacagatagaagtt

SEQ ID NO: 479900 - DNA, 20 bp, Artificial
  CRISPR gRNA sequence
agcttggggaaaccaagctg

SEQ ID NO: 479901 - DNA, 20 bp, Artificial
  CRISPR gRNA sequence
ggggaaaccaagctgaataa

SEQ ID NO: 479902 - DNA, 20 bp, Artificial
  CRISPR gRNA sequence
gggaaaccaagctgaataaa

SEQ ID NO: 479903 - DNA, 20 bp, Artificial
  CRISPR gRNA sequence
aataaaacatgaaaaaatac

SEQ ID NO: 479904 - DNA, 20 bp, Artificial
  CRISPR gRNA sequence
ggtttataaaaattttatag

SEQ ID NO: 479905 - DNA, 20 bp, Artificial
  CRISPR gRNA sequence
gtttataaaaattttatagc

SEQ ID NO: 479906 - DNA, 20 bp, Artificial
  CRISPR gRNA sequence
ataaaaattttatagccaac

SEQ ID NO: 479907 - DNA, 20 bp, Artificial
  CRISPR gRNA sequence
taaaaattttatagccaaca

SEQ ID NO: 479908 - DNA, 20 bp, Artificial
  CRISPR gRNA sequence
tatagccaacatcatattca

SEQ ID NO: 479909 - DNA, 20 bp, Artificial
  CRISPR gRNA sequence
atagccaacatcatattcaa

SEQ ID NO: 479910 - DNA, 20 bp, Artificial
  CRISPR gRNA sequence
tagccaacatcatattcaat

SEQ ID NO: 479911 - DNA, 20 bp, Artificial
  CRISPR gRNA sequence
aatggtgaaaggcttagagc

SEQ ID NO: 479912 - DNA, 20 bp, Artificial
  CRISPR gRNA sequence
agagctttccccctaagaac

SEQ ID NO: 479913 - DNA, 20 bp, Artificial
  CRISPR gRNA sequence
gagctttccccctaagaaca

SEQ ID NO: 479914 - DNA, 20 bp, Artificial
  CRISPR gRNA sequence
tccccctaagaacaggaaca

SEQ ID NO: 479915 - DNA, 20 bp, Artificial
  CRISPR gRNA sequence
ccccctaagaacaggaacaa

SEQ ID NO: 479916 - DNA, 20 bp, Artificial
  CRISPR gRNA sequence
cccctaagaacaggaacaag

SEQ ID NO: 479917 - DNA, 20 bp, Artificial
  CRISPR gRNA sequence
agaacaggaacaagacatgg

SEQ ID NO: 479918 - DNA, 20 bp, Artificial
  CRISPR gRNA sequence
gcttttgccatttccattta

SEQ ID NO: 479919 - DNA, 20 bp, Artificial
  CRISPR gRNA sequence
cttttgccatttccatttaa

SEQ ID NO: 479920 - DNA, 20 bp, Artificial
  CRISPR gRNA sequence
ttgccatttccatttaacat

SEQ ID NO: 479921 - DNA, 20 bp, Artificial
  CRISPR gRNA sequence
tgccatttccatttaacatt

SEQ ID NO: 479922 - DNA, 20 bp, Artificial
  CRISPR gRNA sequence
gccatttccatttaacatta

SEQ ID NO: 479923 - DNA, 20 bp, Artificial
  CRISPR gRNA sequence
ccatttccatttaacattaa

SEQ ID NO: 479924 - DNA, 20 bp, Artificial
  CRISPR gRNA sequence
ccatttaacattaaactgaa

SEQ ID NO: 479925 - DNA, 20 bp, Artificial
  CRISPR gRNA sequence
catttaacattaaactgaaa

SEQ ID NO: 479926 - DNA, 20 bp, Artificial
  CRISPR gRNA sequence
aacattaaactgaaaattct

SEQ ID NO: 479927 - DNA, 20 bp, Artificial
  CRISPR gRNA sequence
acattaaactgaaaattcta

SEQ ID NO: 479928 - DNA, 20 bp, Artificial
  CRISPR gRNA sequence
aactgaaaattctagccaga

SEQ ID NO: 479929 - DNA, 20 bp, Artificial
  CRISPR gRNA sequence
aaaattctagccagagcaaa

SEQ ID NO: 479930 - DNA, 20 bp, Artificial
  CRISPR gRNA sequence
tagccagagcaaacaggcaa

SEQ ID NO: 479931 - DNA, 20 bp, Artificial
  CRISPR gRNA sequence
gccagagcaaacaggcaaga

SEQ ID NO: 479932 - DNA, 20 bp, Artificial
  CRISPR gRNA sequence
acttagaaaaaaagaagtaa

SEQ ID NO: 479933 - DNA, 20 bp, Artificial
  CRISPR gRNA sequence
agaaaaaaagaagtaaaact

SEQ ID NO: 479934 - DNA, 20 bp, Artificial
  CRISPR gRNA sequence
gaaaaaaagaagtaaaactt

SEQ ID NO: 479935 - DNA, 20 bp, Artificial
  CRISPR gRNA sequence
tattcacagatggcatgaac

SEQ ID NO: 479936 - DNA, 20 bp, Artificial
  CRISPR gRNA sequence
attcacagatggcatgaact

SEQ ID NO: 479937 - DNA, 20 bp, Artificial
  CRISPR gRNA sequence
ttcacagatggcatgaactt

SEQ ID NO: 479938 - DNA, 20 bp, Artificial
  CRISPR gRNA sequence
acagatggcatgaacttatg

SEQ ID NO: 479939 - DNA, 20 bp, Artificial
  CRISPR gRNA sequence
atgtgtagaaaaattcttaa

SEQ ID NO: 479940 - DNA, 20 bp, Artificial
  CRISPR gRNA sequence
tgtgtagaaaaattcttaaa

SEQ ID NO: 479941 - DNA, 20 bp, Artificial
  CRISPR gRNA sequence
ttaaaaatttgtttaaaact

SEQ ID NO: 479942 - DNA, 20 bp, Artificial
  CRISPR gRNA sequence
aaaaatttgtttaaaactat

SEQ ID NO: 479943 - DNA, 20 bp, Artificial
  CRISPR gRNA sequence
aaaatttgtttaaaactatt

SEQ ID NO: 479944 - DNA, 20 bp, Artificial
  CRISPR gRNA sequence
gtttaaaactattaaagcta

SEQ ID NO: 479945 - DNA, 20 bp, Artificial
  CRISPR gRNA sequence
tttaaaactattaaagctaa

SEQ ID NO: 479946 - DNA, 20 bp, Artificial
  CRISPR gRNA sequence
aaaactattaaagctaatac

SEQ ID NO: 479947 - DNA, 20 bp, Artificial
  CRISPR gRNA sequence
aaactattaaagctaataca

SEQ ID NO: 479948 - DNA, 20 bp, Artificial
  CRISPR gRNA sequence
ttaaagctaatacatgaatt

SEQ ID NO: 479949 - DNA, 20 bp, Artificial
  CRISPR gRNA sequence
aagctaatacatgaatttag

SEQ ID NO: 479950 - DNA, 20 bp, Artificial
  CRISPR gRNA sequence
atacatgaatttagcaattc

SEQ ID NO: 479951 - DNA, 20 bp, Artificial
  CRISPR gRNA sequence
agcaattccacatgatacag

SEQ ID NO: 479952 - DNA, 20 bp, Artificial
  CRISPR gRNA sequence
gcaattccacatgatacagg

SEQ ID NO: 479953 - DNA, 20 bp, Artificial
  CRISPR gRNA sequence
cacatgatacaggatcaaca

SEQ ID NO: 479954 - DNA, 20 bp, Artificial
  CRISPR gRNA sequence
ctatacactagcaataaaca

SEQ ID NO: 479955 - DNA, 20 bp, Artificial
  CRISPR gRNA sequence
tatacactagcaataaacaa

SEQ ID NO: 479956 - DNA, 20 bp, Artificial
  CRISPR gRNA sequence
tacactagcaataaacaatc

SEQ ID NO: 479957 - DNA, 20 bp, Artificial
  CRISPR gRNA sequence
gcaataaacaatccacaaag

SEQ ID NO: 479958 - DNA, 20 bp, Artificial
  CRISPR gRNA sequence
aggaaacagttccatttaca

SEQ ID NO: 479959 - DNA, 20 bp, Artificial
  CRISPR gRNA sequence
catttacaatagcatcaaaa

SEQ ID NO: 479960 - DNA, 20 bp, Artificial
  CRISPR gRNA sequence
acaatagcatcaaaatgaat

SEQ ID NO: 479961 - DNA, 20 bp, Artificial
  CRISPR gRNA sequence
caatagcatcaaaatgaata

SEQ ID NO: 479962 - DNA, 20 bp, Artificial
  CRISPR gRNA sequence
aagtacaaatttaaccaaag

SEQ ID NO: 479963 - DNA, 20 bp, Artificial
  CRISPR gRNA sequence
agtacaaatttaaccaaaga

SEQ ID NO: 479964 - DNA, 20 bp, Artificial
  CRISPR gRNA sequence
aaccaaagaggtataagagt

SEQ ID NO: 479965 - DNA, 20 bp, Artificial
  CRISPR gRNA sequence
accaaagaggtataagagtt

SEQ ID NO: 479966 - DNA, 20 bp, Artificial
  CRISPR gRNA sequence
tacactgaacaaagaaagca

SEQ ID NO: 479967 - DNA, 20 bp, Artificial
  CRISPR gRNA sequence
aacaaagaaagcatggctga

SEQ ID NO: 479968 - DNA, 20 bp, Artificial
  CRISPR gRNA sequence
aaagaaattcaagaatatgt

SEQ ID NO: 479969 - DNA, 20 bp, Artificial
  CRISPR gRNA sequence
aagaatatgtaaataaatgc

SEQ ID NO: 479970 - DNA, 20 bp, Artificial
  CRISPR gRNA sequence
tgtattcatggactgaaaga

SEQ ID NO: 479971 - DNA, 20 bp, Artificial
  CRISPR gRNA sequence
tattcatggactgaaagatg

SEQ ID NO: 479972 - DNA, 20 bp, Artificial
  CRISPR gRNA sequence
atggactgaaagatgtaata

SEQ ID NO: 479973 - DNA, 20 bp, Artificial
  CRISPR gRNA sequence
aaagatgtaatattgtaaag

SEQ ID NO: 479974 - DNA, 20 bp, Artificial
  CRISPR gRNA sequence
taaagatagcaatattcccc

SEQ ID NO: 479975 - DNA, 20 bp, Artificial
  CRISPR gRNA sequence
cccaaggtgatctacagatt

SEQ ID NO: 479976 - DNA, 20 bp, Artificial
  CRISPR gRNA sequence
cagattcaatgcagttccac

SEQ ID NO: 479977 - DNA, 20 bp, Artificial
  CRISPR gRNA sequence
aatgcagttccactaaaatc

SEQ ID NO: 479978 - DNA, 20 bp, Artificial
  CRISPR gRNA sequence
cactaaaatcctaacagctt

SEQ ID NO: 479979 - DNA, 20 bp, Artificial
  CRISPR gRNA sequence
aaatcctaacagctttttgt

SEQ ID NO: 479980 - DNA, 20 bp, Artificial
  CRISPR gRNA sequence
acagctttttgttgctattg

SEQ ID NO: 479981 - DNA, 20 bp, Artificial
  CRISPR gRNA sequence
tttgttgctattgcagaaat

SEQ ID NO: 479982 - DNA, 20 bp, Artificial
  CRISPR gRNA sequence
ttgttgctattgcagaaata

SEQ ID NO: 479983 - DNA, 20 bp, Artificial
  CRISPR gRNA sequence
tgttgctattgcagaaataa

SEQ ID NO: 479984 - DNA, 20 bp, Artificial
  CRISPR gRNA sequence
gttgctattgcagaaataaa

SEQ ID NO: 479985 - DNA, 20 bp, Artificial
  CRISPR gRNA sequence
ttgctattgcagaaataaaa

SEQ ID NO: 479986 - DNA, 20 bp, Artificial
  CRISPR gRNA sequence
ctattgcagaaataaaaaag

SEQ ID NO: 479987 - DNA, 20 bp, Artificial
  CRISPR gRNA sequence
ttgcagaaataaaaaagctg

SEQ ID NO: 479988 - DNA, 20 bp, Artificial
  CRISPR gRNA sequence
cagaaataaaaaagctgatc

SEQ ID NO: 479989 - DNA, 20 bp, Artificial
  CRISPR gRNA sequence
atcctaaaattcacattgag

SEQ ID NO: 479990 - DNA, 20 bp, Artificial
  CRISPR gRNA sequence
aaattcacattgagttgcaa

SEQ ID NO: 479991 - DNA, 20 bp, Artificial
  CRISPR gRNA sequence
acattgagttgcaacagacc

SEQ ID NO: 479992 - DNA, 20 bp, Artificial
  CRISPR gRNA sequence
agttgcaacagacccagaat

SEQ ID NO: 479993 - DNA, 20 bp, Artificial
  CRISPR gRNA sequence
caacagacccagaattgcca

SEQ ID NO: 479994 - DNA, 20 bp, Artificial
  CRISPR gRNA sequence
ccaaaacaatcttgaaaaag

SEQ ID NO: 479995 - DNA, 20 bp, Artificial
  CRISPR gRNA sequence
gaaaaagaacaaaactgaag

SEQ ID NO: 479996 - DNA, 20 bp, Artificial
  CRISPR gRNA sequence
aaaaagaacaaaactgaagc

SEQ ID NO: 479997 - DNA, 20 bp, Artificial
  CRISPR gRNA sequence
aagctaagacttccctattt

SEQ ID NO: 479998 - DNA, 20 bp, Artificial
  CRISPR gRNA sequence
agacttccctatttcaaaac

SEQ ID NO: 479999 - DNA, 20 bp, Artificial
  CRISPR gRNA sequence
ccctatttcaaaacttacta

SEQ ID NO: 480000 - DNA, 20 bp, Artificial
  CRISPR gRNA sequence
cctatttcaaaacttactac

SEQ ID NO: 480001 - DNA, 20 bp, Artificial
  CRISPR gRNA sequence
tttcaaaacttactacaaaa

SEQ ID NO: 480002 - DNA, 20 bp, Artificial
  CRISPR gRNA sequence
caaaacttactacaaaatga

SEQ ID NO: 480003 - DNA, 20 bp, Artificial
  CRISPR gRNA sequence
aaaacttactacaaaatgac

SEQ ID NO: 480004 - DNA, 20 bp, Artificial
  CRISPR gRNA sequence
actacaaaatgacagttaaa

SEQ ID NO: 480005 - DNA, 20 bp, Artificial
  CRISPR gRNA sequence
ctacaaaatgacagttaaaa

SEQ ID NO: 480006 - DNA, 20 bp, Artificial
  CRISPR gRNA sequence
caaaatgacagttaaaaaaa

SEQ ID NO: 480007 - DNA, 20 bp, Artificial
  CRISPR gRNA sequence
aaaaaaaaaaaaaagaatag

SEQ ID NO: 480008 - DNA, 20 bp, Artificial
  CRISPR gRNA sequence
tcatggatagacaaagagat

SEQ ID NO: 480009 - DNA, 20 bp, Artificial
  CRISPR gRNA sequence
agagtccagaataaactcca

SEQ ID NO: 480010 - DNA, 20 bp, Artificial
  CRISPR gRNA sequence
catacatccgtagtcaattg

SEQ ID NO: 480011 - DNA, 20 bp, Artificial
  CRISPR gRNA sequence
atttttgataagggtaccaa

SEQ ID NO: 480012 - DNA, 20 bp, Artificial
  CRISPR gRNA sequence
ttgataagggtaccaagatt

SEQ ID NO: 480013 - DNA, 20 bp, Artificial
  CRISPR gRNA sequence
tgataagggtaccaagatta

SEQ ID NO: 480014 - DNA, 20 bp, Artificial
  CRISPR gRNA sequence
gataagggtaccaagattat

SEQ ID NO: 480015 - DNA, 20 bp, Artificial
  CRISPR gRNA sequence
ataagggtaccaagattatt

SEQ ID NO: 480016 - DNA, 20 bp, Artificial
  CRISPR gRNA sequence
ttcagtggggaaagaatagt

SEQ ID NO: 480017 - DNA, 20 bp, Artificial
  CRISPR gRNA sequence
agtggggaaagaatagtctc

SEQ ID NO: 480018 - DNA, 20 bp, Artificial
  CRISPR gRNA sequence
aataaatggtgccaggataa

SEQ ID NO: 480019 - DNA, 20 bp, Artificial
  CRISPR gRNA sequence
gatattcatatgtaaaagaa

SEQ ID NO: 480020 - DNA, 20 bp, Artificial
  CRISPR gRNA sequence
atatgtaaaagaattaattt

SEQ ID NO: 480021 - DNA, 20 bp, Artificial
  CRISPR gRNA sequence
atttgaaccctcatctcact

SEQ ID NO: 480022 - DNA, 20 bp, Artificial
  CRISPR gRNA sequence
gaaccctcatctcactccat

SEQ ID NO: 480023 - DNA, 20 bp, Artificial
  CRISPR gRNA sequence
aaccctcatctcactccata

SEQ ID NO: 480024 - DNA, 20 bp, Artificial
  CRISPR gRNA sequence
atctcactccatattttaag

SEQ ID NO: 480025 - DNA, 20 bp, Artificial
  CRISPR gRNA sequence
actccatattttaagcaatc

SEQ ID NO: 480026 - DNA, 20 bp, Artificial
  CRISPR gRNA sequence
catattttaagcaatcaaaa

SEQ ID NO: 480027 - DNA, 20 bp, Artificial
  CRISPR gRNA sequence
taagcaatcaaaataagtca

SEQ ID NO: 480028 - DNA, 20 bp, Artificial
  CRISPR gRNA sequence
aagcaatcaaaataagtcag

SEQ ID NO: 480029 - DNA, 20 bp, Artificial
  CRISPR gRNA sequence
agcaatcaaaataagtcaga

SEQ ID NO: 480030 - DNA, 20 bp, Artificial
  CRISPR gRNA sequence
aagtagaagagctaaaacta

SEQ ID NO: 480031 - DNA, 20 bp, Artificial
  CRISPR gRNA sequence
agtagaagagctaaaactat

SEQ ID NO: 480032 - DNA, 20 bp, Artificial
  CRISPR gRNA sequence
aaactataaaaactgcatta

SEQ ID NO: 480033 - DNA, 20 bp, Artificial
  CRISPR gRNA sequence
taaaaactgcattatataaa

SEQ ID NO: 480034 - DNA, 20 bp, Artificial
  CRISPR gRNA sequence
cattatataaaacaataaaa

SEQ ID NO: 480035 - DNA, 20 bp, Artificial
  CRISPR gRNA sequence
tataaaacaataaaactctg

SEQ ID NO: 480036 - DNA, 20 bp, Artificial
  CRISPR gRNA sequence
tgatttcttaggagaaaaca

SEQ ID NO: 480037 - DNA, 20 bp, Artificial
  CRISPR gRNA sequence
atttcttaggagaaaacata

SEQ ID NO: 480038 - DNA, 20 bp, Artificial
  CRISPR gRNA sequence
cttaggagaaaacataggga

SEQ ID NO: 480039 - DNA, 20 bp, Artificial
  CRISPR gRNA sequence
ttaggagaaaacatagggat

SEQ ID NO: 480040 - DNA, 20 bp, Artificial
  CRISPR gRNA sequence
aggagaaaacatagggataa

SEQ ID NO: 480041 - DNA, 20 bp, Artificial
  CRISPR gRNA sequence
ggagaaaacatagggataaa

SEQ ID NO: 480042 - DNA, 20 bp, Artificial
  CRISPR gRNA sequence
ctgatcttggatttagcagt

SEQ ID NO: 480043 - DNA, 20 bp, Artificial
  CRISPR gRNA sequence
tgatcttggatttagcagtg

SEQ ID NO: 480044 - DNA, 20 bp, Artificial
  CRISPR gRNA sequence
atcttggatttagcagtgtt

SEQ ID NO: 480045 - DNA, 20 bp, Artificial
  CRISPR gRNA sequence
ggatttagcagtgttttctt

SEQ ID NO: 480046 - DNA, 20 bp, Artificial
  CRISPR gRNA sequence
gatttagcagtgttttctta

SEQ ID NO: 480047 - DNA, 20 bp, Artificial
  CRISPR gRNA sequence
agcagtgttttcttagctat

SEQ ID NO: 480048 - DNA, 20 bp, Artificial
  CRISPR gRNA sequence
gcagtgttttcttagctatg

SEQ ID NO: 480049 - DNA, 20 bp, Artificial
  CRISPR gRNA sequence
tcttagctatgattacaaaa

SEQ ID NO: 480050 - DNA, 20 bp, Artificial
  CRISPR gRNA sequence
cttagctatgattacaaaag

SEQ ID NO: 480051 - DNA, 20 bp, Artificial
  CRISPR gRNA sequence
ttagctatgattacaaaagc

SEQ ID NO: 480052 - DNA, 20 bp, Artificial
  CRISPR gRNA sequence
agctatgattacaaaagcat

SEQ ID NO: 480053 - DNA, 20 bp, Artificial
  CRISPR gRNA sequence
gctatgattacaaaagcata

SEQ ID NO: 480054 - DNA, 20 bp, Artificial
  CRISPR gRNA sequence
tgattacaaaagcataatca

SEQ ID NO: 480055 - DNA, 20 bp, Artificial
  CRISPR gRNA sequence
caaaagcataatcaacaata

SEQ ID NO: 480056 - DNA, 20 bp, Artificial
  CRISPR gRNA sequence
gacttcataaaaattaaaca

SEQ ID NO: 480057 - DNA, 20 bp, Artificial
  CRISPR gRNA sequence
cataaaaattaaacacttct

SEQ ID NO: 480058 - DNA, 20 bp, Artificial
  CRISPR gRNA sequence
ataaaaattaaacacttctg

SEQ ID NO: 480059 - DNA, 20 bp, Artificial
  CRISPR gRNA sequence
aacacttctgtgcatcaaaa

SEQ ID NO: 480060 - DNA, 20 bp, Artificial
  CRISPR gRNA sequence
ctgtgcatcaaaagatacta

SEQ ID NO: 480061 - DNA, 20 bp, Artificial
  CRISPR gRNA sequence
tgtgcatcaaaagatactaa

SEQ ID NO: 480062 - DNA, 20 bp, Artificial
  CRISPR gRNA sequence
tgcatcaaaagatactaaaa

SEQ ID NO: 480063 - DNA, 20 bp, Artificial
  CRISPR gRNA sequence
aaattcaacaacaaatagac

SEQ ID NO: 480064 - DNA, 20 bp, Artificial
  CRISPR gRNA sequence
aacaacaaatagactggcaa

SEQ ID NO: 480065 - DNA, 20 bp, Artificial
  CRISPR gRNA sequence
gcaacctaattttaaaatga

SEQ ID NO: 480066 - DNA, 20 bp, Artificial
  CRISPR gRNA sequence
attttaaaatgagcaaagga

SEQ ID NO: 480067 - DNA, 20 bp, Artificial
  CRISPR gRNA sequence
taaaatgagcaaaggacttg

SEQ ID NO: 480068 - DNA, 20 bp, Artificial
  CRISPR gRNA sequence
aaaatgagcaaaggacttga

SEQ ID NO: 480069 - DNA, 20 bp, Artificial
  CRISPR gRNA sequence
aaatgagcaaaggacttgaa

SEQ ID NO: 480070 - DNA, 20 bp, Artificial
  CRISPR gRNA sequence
gaatagacatttcatcaaag

SEQ ID NO: 480071 - DNA, 20 bp, Artificial
  CRISPR gRNA sequence
aatagacatttcatcaaaga

SEQ ID NO: 480072 - DNA, 20 bp, Artificial
  CRISPR gRNA sequence
catcaaagaaaatatacaaa

SEQ ID NO: 480073 - DNA, 20 bp, Artificial
  CRISPR gRNA sequence
atcaaagaaaatatacaaat

SEQ ID NO: 480074 - DNA, 20 bp, Artificial
  CRISPR gRNA sequence
aatgtcattagttactggag

SEQ ID NO: 480075 - DNA, 20 bp, Artificial
  CRISPR gRNA sequence
gttactggagaaatgcaaat

SEQ ID NO: 480076 - DNA, 20 bp, Artificial
  CRISPR gRNA sequence
ctggagaaatgcaaatcaaa

SEQ ID NO: 480077 - DNA, 20 bp, Artificial
  CRISPR gRNA sequence
gagaaatgcaaatcaaagtc

SEQ ID NO: 480078 - DNA, 20 bp, Artificial
  CRISPR gRNA sequence
cacacccatcgaatgactag

SEQ ID NO: 480079 - DNA, 20 bp, Artificial
  CRISPR gRNA sequence
acacccatcgaatgactaga

SEQ ID NO: 480080 - DNA, 20 bp, Artificial
  CRISPR gRNA sequence
gaataaaaaaaaaaaacaca

SEQ ID NO: 480081 - DNA, 20 bp, Artificial
  CRISPR gRNA sequence
gcaaggatgtgaagaaatag

SEQ ID NO: 480082 - DNA, 20 bp, Artificial
  CRISPR gRNA sequence
tccattgctgaggagaatgt

SEQ ID NO: 480083 - DNA, 20 bp, Artificial
  CRISPR gRNA sequence
ctgaggagaatgtaaaatgg

SEQ ID NO: 480084 - DNA, 20 bp, Artificial
  CRISPR gRNA sequence
aggagaatgtaaaatggtgc

SEQ ID NO: 480085 - DNA, 20 bp, Artificial
  CRISPR gRNA sequence
tagaaagtggtctaacagtt

SEQ ID NO: 480086 - DNA, 20 bp, Artificial
  CRISPR gRNA sequence
agaaagtggtctaacagttc

SEQ ID NO: 480087 - DNA, 20 bp, Artificial
  CRISPR gRNA sequence
gaaagtggtctaacagttcc

SEQ ID NO: 480088 - DNA, 20 bp, Artificial
  CRISPR gRNA sequence
acagttcctcaaaatcaaaa

SEQ ID NO: 480089 - DNA, 20 bp, Artificial
  CRISPR gRNA sequence
ctcaaaatcaaaagataaaa

SEQ ID NO: 480090 - DNA, 20 bp, Artificial
  CRISPR gRNA sequence
aaaatcaaaagataaaacct

SEQ ID NO: 480091 - DNA, 20 bp, Artificial
  CRISPR gRNA sequence
cttgtcacagtacccagtaa

SEQ ID NO: 480092 - DNA, 20 bp, Artificial
  CRISPR gRNA sequence
gtcacagtacccagtaattc

SEQ ID NO: 480093 - DNA, 20 bp, Artificial
  CRISPR gRNA sequence
tcacagtacccagtaattct

SEQ ID NO: 480094 - DNA, 20 bp, Artificial
  CRISPR gRNA sequence
tattcctaggtaaatactca

SEQ ID NO: 480095 - DNA, 20 bp, Artificial
  CRISPR gRNA sequence
ttcctaggtaaatactcaaa

SEQ ID NO: 480096 - DNA, 20 bp, Artificial
  CRISPR gRNA sequence
ctaggtaaatactcaaatga

SEQ ID NO: 480097 - DNA, 20 bp, Artificial
  CRISPR gRNA sequence
ggtaaatactcaaatgaaat

SEQ ID NO: 480098 - DNA, 20 bp, Artificial
  CRISPR gRNA sequence
aaatgaaattaaaatatatg

SEQ ID NO: 480099 - DNA, 20 bp, Artificial
  CRISPR gRNA sequence
aaatatatgttcacacaaaa

SEQ ID NO: 480100 - DNA, 20 bp, Artificial
  CRISPR gRNA sequence
acacaaaaccttgttcctga

SEQ ID NO: 480101 - DNA, 20 bp, Artificial
  CRISPR gRNA sequence
gttcctgaatgtttatcaca

SEQ ID NO: 480102 - DNA, 20 bp, Artificial
  CRISPR gRNA sequence
ttcctgaatgtttatcacag

SEQ ID NO: 480103 - DNA, 20 bp, Artificial
  CRISPR gRNA sequence
ctgaatgtttatcacagcac

SEQ ID NO: 480104 - DNA, 20 bp, Artificial
  CRISPR gRNA sequence
aatgtttatcacagcactat

SEQ ID NO: 480105 - DNA, 20 bp, Artificial
  CRISPR gRNA sequence
atcacagcactattcacaat

SEQ ID NO: 480106 - DNA, 20 bp, Artificial
  CRISPR gRNA sequence
tcacagcactattcacaata

SEQ ID NO: 480107 - DNA, 20 bp, Artificial
  CRISPR gRNA sequence
ttcacaatagccaaaaggta

SEQ ID NO: 480108 - DNA, 20 bp, Artificial
  CRISPR gRNA sequence
acaatagccaaaaggtagaa

SEQ ID NO: 480109 - DNA, 20 bp, Artificial
  CRISPR gRNA sequence
aatgttcagctgatgaatgg

SEQ ID NO: 480110 - DNA, 20 bp, Artificial
  CRISPR gRNA sequence
agctgatgaatggataaagg

SEQ ID NO: 480111 - DNA, 20 bp, Artificial
  CRISPR gRNA sequence
atgaatggataaaggaaatg

SEQ ID NO: 480112 - DNA, 20 bp, Artificial
  CRISPR gRNA sequence
atccacacacggaatattat

SEQ ID NO: 480113 - DNA, 20 bp, Artificial
  CRISPR gRNA sequence
tccacacacggaatattatt

SEQ ID NO: 480114 - DNA, 20 bp, Artificial
  CRISPR gRNA sequence
ttcagtcatgaaaaggaatg

SEQ ID NO: 480115 - DNA, 20 bp, Artificial
  CRISPR gRNA sequence
agtcatgaaaaggaatgaag

SEQ ID NO: 480116 - DNA, 20 bp, Artificial
  CRISPR gRNA sequence
atgtatgctacaacattgat

SEQ ID NO: 480117 - DNA, 20 bp, Artificial
  CRISPR gRNA sequence
caacattgatgaacctcaga

SEQ ID NO: 480118 - DNA, 20 bp, Artificial
  CRISPR gRNA sequence
atgaacctcagaagcattac

SEQ ID NO: 480119 - DNA, 20 bp, Artificial
  CRISPR gRNA sequence
agaagcattacgctaagtaa

SEQ ID NO: 480120 - DNA, 20 bp, Artificial
  CRISPR gRNA sequence
cgctaagtaaaagaagaaaa

SEQ ID NO: 480121 - DNA, 20 bp, Artificial
  CRISPR gRNA sequence
agtaaaagaagaaaaaggtt

SEQ ID NO: 480122 - DNA, 20 bp, Artificial
  CRISPR gRNA sequence
catacaatgtgattctgatt

SEQ ID NO: 480123 - DNA, 20 bp, Artificial
  CRISPR gRNA sequence
tgattatatgaaatatccaa

SEQ ID NO: 480124 - DNA, 20 bp, Artificial
  CRISPR gRNA sequence
attatatgaaatatccaaaa

SEQ ID NO: 480125 - DNA, 20 bp, Artificial
  CRISPR gRNA sequence
tatgaaatatccaaaatagg

SEQ ID NO: 480126 - DNA, 20 bp, Artificial
  CRISPR gRNA sequence
ggtggttgccaggggctgag

SEQ ID NO: 480127 - DNA, 20 bp, Artificial
  CRISPR gRNA sequence
gtggttgccaggggctgagg

SEQ ID NO: 480128 - DNA, 20 bp, Artificial
  CRISPR gRNA sequence
ccaggggctgaggaaataaa

SEQ ID NO: 480129 - DNA, 20 bp, Artificial
  CRISPR gRNA sequence
aggaaataaagaatgtgaca

SEQ ID NO: 480130 - DNA, 20 bp, Artificial
  CRISPR gRNA sequence
ctaaataggtagagggcttc

SEQ ID NO: 480131 - DNA, 20 bp, Artificial
  CRISPR gRNA sequence
aataggtagagggcttcctt

SEQ ID NO: 480132 - DNA, 20 bp, Artificial
  CRISPR gRNA sequence
ccttttggggtgataaatat

SEQ ID NO: 480133 - DNA, 20 bp, Artificial
  CRISPR gRNA sequence
cttttggggtgataaatatg

SEQ ID NO: 480134 - DNA, 20 bp, Artificial
  CRISPR gRNA sequence
ttggggtgataaatatgttc

SEQ ID NO: 480135 - DNA, 20 bp, Artificial
  CRISPR gRNA sequence
tggggtgataaatatgttct

SEQ ID NO: 480136 - DNA, 20 bp, Artificial
  CRISPR gRNA sequence
ggggtgataaatatgttctg

SEQ ID NO: 480137 - DNA, 20 bp, Artificial
  CRISPR gRNA sequence
gggtgataaatatgttctga

SEQ ID NO: 480138 - DNA, 20 bp, Artificial
  CRISPR gRNA sequence
tgaatctagatcgtagtcac

SEQ ID NO: 480139 - DNA, 20 bp, Artificial
  CRISPR gRNA sequence
aatctagatcgtagtcacgt

SEQ ID NO: 480140 - DNA, 20 bp, Artificial
  CRISPR gRNA sequence
gatcgtagtcacgtttgcaa

SEQ ID NO: 480141 - DNA, 20 bp, Artificial
  CRISPR gRNA sequence
gcaaaacattgtgagtatct

SEQ ID NO: 480142 - DNA, 20 bp, Artificial
  CRISPR gRNA sequence
caaaacattgtgagtatctt

SEQ ID NO: 480143 - DNA, 20 bp, Artificial
  CRISPR gRNA sequence
tgagtatcttacatgccatt

SEQ ID NO: 480144 - DNA, 20 bp, Artificial
  CRISPR gRNA sequence
acatgccatttaattgtaca

SEQ ID NO: 480145 - DNA, 20 bp, Artificial
  CRISPR gRNA sequence
catgccatttaattgtacat

SEQ ID NO: 480146 - DNA, 20 bp, Artificial
  CRISPR gRNA sequence
aattgtacattttaaatgat

SEQ ID NO: 480147 - DNA, 20 bp, Artificial
  CRISPR gRNA sequence
attgtacattttaaatgatt

SEQ ID NO: 480148 - DNA, 20 bp, Artificial
  CRISPR gRNA sequence
tacattttaaatgattaaat

SEQ ID NO: 480149 - DNA, 20 bp, Artificial
  CRISPR gRNA sequence
taaatgattaaattggtaac

SEQ ID NO: 480150 - DNA, 20 bp, Artificial
  CRISPR gRNA sequence
aaatgattaaattggtaact

SEQ ID NO: 480151 - DNA, 20 bp, Artificial
  CRISPR gRNA sequence
aatgattaaattggtaactt

SEQ ID NO: 480152 - DNA, 20 bp, Artificial
  CRISPR gRNA sequence
aattggtaacttttatgtta

SEQ ID NO: 480153 - DNA, 20 bp, Artificial
  CRISPR gRNA sequence
gtaacttttatgttatatgt

SEQ ID NO: 480154 - DNA, 20 bp, Artificial
  CRISPR gRNA sequence
ttatgttatatgtattttac

SEQ ID NO: 480155 - DNA, 20 bp, Artificial
  CRISPR gRNA sequence
tatgttatatgtattttacc

SEQ ID NO: 480156 - DNA, 20 bp, Artificial
  CRISPR gRNA sequence
atgttatatgtattttacca

SEQ ID NO: 480157 - DNA, 20 bp, Artificial
  CRISPR gRNA sequence
tgttatatgtattttaccac

SEQ ID NO: 480158 - DNA, 20 bp, Artificial
  CRISPR gRNA sequence
tatgtattttaccacaataa

SEQ ID NO: 480159 - DNA, 20 bp, Artificial
  CRISPR gRNA sequence
taccacaataaaaatatatt

SEQ ID NO: 480160 - DNA, 20 bp, Artificial
  CRISPR gRNA sequence
accacaataaaaatatattt

SEQ ID NO: 480161 - DNA, 20 bp, Artificial
  CRISPR gRNA sequence
ccacaataaaaatatatttg

SEQ ID NO: 480162 - DNA, 20 bp, Artificial
  CRISPR gRNA sequence
ggatcaaagaagagtgccct

SEQ ID NO: 480163 - DNA, 20 bp, Artificial
  CRISPR gRNA sequence
gatcaaagaagagtgccctt

SEQ ID NO: 480164 - DNA, 20 bp, Artificial
  CRISPR gRNA sequence
taattataagaaataatgtg

SEQ ID NO: 480165 - DNA, 20 bp, Artificial
  CRISPR gRNA sequence
aattataagaaataatgtgg

SEQ ID NO: 480166 - DNA, 20 bp, Artificial
  CRISPR gRNA sequence
attataagaaataatgtgga

SEQ ID NO: 480167 - DNA, 20 bp, Artificial
  CRISPR gRNA sequence
taagaaataatgtggagttt

SEQ ID NO: 480168 - DNA, 20 bp, Artificial
  CRISPR gRNA sequence
cttttgttgctcataaattg

SEQ ID NO: 480169 - DNA, 20 bp, Artificial
  CRISPR gRNA sequence
ttttgttgctcataaattga

SEQ ID NO: 480170 - DNA, 20 bp, Artificial
  CRISPR gRNA sequence
ttgttgctcataaattgacc

SEQ ID NO: 480171 - DNA, 20 bp, Artificial
  CRISPR gRNA sequence
tgttgctcataaattgaccc

SEQ ID NO: 480172 - DNA, 20 bp, Artificial
  CRISPR gRNA sequence
gttgctcataaattgaccct

SEQ ID NO: 480173 - DNA, 20 bp, Artificial
  CRISPR gRNA sequence
ttgctcataaattgaccctt

SEQ ID NO: 480174 - DNA, 20 bp, Artificial
  CRISPR gRNA sequence
ctcataaattgacccttaaa

SEQ ID NO: 480175 - DNA, 20 bp, Artificial
  CRISPR gRNA sequence
ataaattgacccttaaagtt

SEQ ID NO: 480176 - DNA, 20 bp, Artificial
  CRISPR gRNA sequence
acccttaaagttactgggaa

SEQ ID NO: 480177 - DNA, 20 bp, Artificial
  CRISPR gRNA sequence
aaagttactgggaaggagaa

SEQ ID NO: 480178 - DNA, 20 bp, Artificial
  CRISPR gRNA sequence
aagttactgggaaggagaaa

SEQ ID NO: 480179 - DNA, 20 bp, Artificial
  CRISPR gRNA sequence
ctgggaaggagaaatttcaa

SEQ ID NO: 480180 - DNA, 20 bp, Artificial
  CRISPR gRNA sequence
ggaaggagaaatttcaaaag

SEQ ID NO: 480181 - DNA, 20 bp, Artificial
  CRISPR gRNA sequence
caaaagagggttattgcaat

SEQ ID NO: 480182 - DNA, 20 bp, Artificial
  CRISPR gRNA sequence
aaaagagggttattgcaata

SEQ ID NO: 480183 - DNA, 20 bp, Artificial
  CRISPR gRNA sequence
ttgcaatagcagcatggctg

SEQ ID NO: 480184 - DNA, 20 bp, Artificial
  CRISPR gRNA sequence
caatagcagcatggctgaac

SEQ ID NO: 480185 - DNA, 20 bp, Artificial
  CRISPR gRNA sequence
aactctggatgcaacctcgt

SEQ ID NO: 480186 - DNA, 20 bp, Artificial
  CRISPR gRNA sequence
tggatgcaacctcgtacagt

SEQ ID NO: 480187 - DNA, 20 bp, Artificial
  CRISPR gRNA sequence
gatgcaacctcgtacagttt

SEQ ID NO: 480188 - DNA, 20 bp, Artificial
  CRISPR gRNA sequence
gtacagtttagttcctttat

SEQ ID NO: 480189 - DNA, 20 bp, Artificial
  CRISPR gRNA sequence
agttcctttatggacatcat

SEQ ID NO: 480190 - DNA, 20 bp, Artificial
  CRISPR gRNA sequence
gttcctttatggacatcatt

SEQ ID NO: 480191 - DNA, 20 bp, Artificial
  CRISPR gRNA sequence
ctttatggacatcattcact

SEQ ID NO: 480192 - DNA, 20 bp, Artificial
  CRISPR gRNA sequence
tatggacatcattcacttga

SEQ ID NO: 480193 - DNA, 20 bp, Artificial
  CRISPR gRNA sequence
atggacatcattcacttgaa

SEQ ID NO: 480194 - DNA, 20 bp, Artificial
  CRISPR gRNA sequence
tggacatcattcacttgaat

SEQ ID NO: 480195 - DNA, 20 bp, Artificial
  CRISPR gRNA sequence
acttgaatgcatacatttta

SEQ ID NO: 480196 - DNA, 20 bp, Artificial
  CRISPR gRNA sequence
gaatgcatacattttacaac

SEQ ID NO: 480197 - DNA, 20 bp, Artificial
  CRISPR gRNA sequence
aatgcatacattttacaact

SEQ ID NO: 480198 - DNA, 20 bp, Artificial
  CRISPR gRNA sequence
tacaactgatctttttaaaa

SEQ ID NO: 480199 - DNA, 20 bp, Artificial
  CRISPR gRNA sequence
acaactgatctttttaaaat

SEQ ID NO: 480200 - DNA, 20 bp, Artificial
  CRISPR gRNA sequence
caactgatctttttaaaatt

SEQ ID NO: 480201 - DNA, 20 bp, Artificial
  CRISPR gRNA sequence
atctttttaaaattaatttg

SEQ ID NO: 480202 - DNA, 20 bp, Artificial
  CRISPR gRNA sequence
tttaaaattaatttgttact

SEQ ID NO: 480203 - DNA, 20 bp, Artificial
  CRISPR gRNA sequence
ttaaaattaatttgttactt

SEQ ID NO: 480204 - DNA, 20 bp, Artificial
  CRISPR gRNA sequence
taaaattaatttgttacttt

SEQ ID NO: 480205 - DNA, 20 bp, Artificial
  CRISPR gRNA sequence
aaaattaatttgttacttta

SEQ ID NO: 480206 - DNA, 20 bp, Artificial
  CRISPR gRNA sequence
aaattaatttgttactttat

SEQ ID NO: 480207 - DNA, 20 bp, Artificial
  CRISPR gRNA sequence
atttgttactttatatgctt

SEQ ID NO: 480208 - DNA, 20 bp, Artificial
  CRISPR gRNA sequence
gttactttatatgcttactt

SEQ ID NO: 480209 - DNA, 20 bp, Artificial
  CRISPR gRNA sequence
ttactttatatgcttacttt

SEQ ID NO: 480210 - DNA, 20 bp, Artificial
  CRISPR gRNA sequence
ctttatatgcttacttttga

SEQ ID NO: 480211 - DNA, 20 bp, Artificial
  CRISPR gRNA sequence
tatatgcttacttttgagtg

SEQ ID NO: 480212 - DNA, 20 bp, Artificial
  CRISPR gRNA sequence
atatgcttacttttgagtgt

SEQ ID NO: 480213 - DNA, 20 bp, Artificial
  CRISPR gRNA sequence
tatgcttacttttgagtgtc

SEQ ID NO: 480214 - DNA, 20 bp, Artificial
  CRISPR gRNA sequence
acttttgagtgtctttcaac

SEQ ID NO: 480215 - DNA, 20 bp, Artificial
  CRISPR gRNA sequence
cttttgagtgtctttcaact

SEQ ID NO: 480216 - DNA, 20 bp, Artificial
  CRISPR gRNA sequence
ttgagtgtctttcaactccc

SEQ ID NO: 480217 - DNA, 20 bp, Artificial
  CRISPR gRNA sequence
tgagtgtctttcaactccct

SEQ ID NO: 480218 - DNA, 20 bp, Artificial
  CRISPR gRNA sequence
gagtgtctttcaactccctt

SEQ ID NO: 480219 - DNA, 20 bp, Artificial
  CRISPR gRNA sequence
agtgtctttcaactccctta

SEQ ID NO: 480220 - DNA, 20 bp, Artificial
  CRISPR gRNA sequence
tcaactcccttaaagtagcc

SEQ ID NO: 480221 - DNA, 20 bp, Artificial
  CRISPR gRNA sequence
caactcccttaaagtagccc

SEQ ID NO: 480222 - DNA, 20 bp, Artificial
  CRISPR gRNA sequence
aactcccttaaagtagccca

SEQ ID NO: 480223 - DNA, 20 bp, Artificial
  CRISPR gRNA sequence
ccttaaagtagcccagtgaa

SEQ ID NO: 480224 - DNA, 20 bp, Artificial
  CRISPR gRNA sequence
aaagtagcccagtgaaggaa

SEQ ID NO: 480225 - DNA, 20 bp, Artificial
  CRISPR gRNA sequence
aagtagcccagtgaaggaat

SEQ ID NO: 480226 - DNA, 20 bp, Artificial
  CRISPR gRNA sequence
aaattcttttaaaatgcttt

SEQ ID NO: 480227 - DNA, 20 bp, Artificial
  CRISPR gRNA sequence
ttttaaaatgctttaggtta

SEQ ID NO: 480228 - DNA, 20 bp, Artificial
  CRISPR gRNA sequence
ttaaaatgctttaggttagt

SEQ ID NO: 480229 - DNA, 20 bp, Artificial
  CRISPR gRNA sequence
taaaatgctttaggttagtt

SEQ ID NO: 480230 - DNA, 20 bp, Artificial
  CRISPR gRNA sequence
aaaatgctttaggttagttt

SEQ ID NO: 480231 - DNA, 20 bp, Artificial
  CRISPR gRNA sequence
aaatgctttaggttagttta

SEQ ID NO: 480232 - DNA, 20 bp, Artificial
  CRISPR gRNA sequence
taggttagtttaaaatttct

SEQ ID NO: 480233 - DNA, 20 bp, Artificial
  CRISPR gRNA sequence
aggttagtttaaaatttctt

SEQ ID NO: 480234 - DNA, 20 bp, Artificial
  CRISPR gRNA sequence
ggttagtttaaaatttctta

SEQ ID NO: 480235 - DNA, 20 bp, Artificial
  CRISPR gRNA sequence
gtttaaaatttcttacagca

SEQ ID NO: 480236 - DNA, 20 bp, Artificial
  CRISPR gRNA sequence
aaaatttcttacagcagcac

SEQ ID NO: 480237 - DNA, 20 bp, Artificial
  CRISPR gRNA sequence
aaatttcttacagcagcacc

SEQ ID NO: 480238 - DNA, 20 bp, Artificial
  CRISPR gRNA sequence
cttacagcagcaccatgaaa

SEQ ID NO: 480239 - DNA, 20 bp, Artificial
  CRISPR gRNA sequence
ttacagcagcaccatgaaaa

SEQ ID NO: 480240 - DNA, 20 bp, Artificial
  CRISPR gRNA sequence
acagcagcaccatgaaaaaa

SEQ ID NO: 480241 - DNA, 20 bp, Artificial
  CRISPR gRNA sequence
cagcagcaccatgaaaaaat

SEQ ID NO: 480242 - DNA, 20 bp, Artificial
  CRISPR gRNA sequence
agcagtagctacaaccctca

SEQ ID NO: 480243 - DNA, 20 bp, Artificial
  CRISPR gRNA sequence
gcagtagctacaaccctcaa

SEQ ID NO: 480244 - DNA, 20 bp, Artificial
  CRISPR gRNA sequence
caaccctcaattatgaaata

SEQ ID NO: 480245 - DNA, 20 bp, Artificial
  CRISPR gRNA sequence
aattatgaaatatagaagaa

SEQ ID NO: 480246 - DNA, 20 bp, Artificial
  CRISPR gRNA sequence
tgaaatatagaagaaatcga

SEQ ID NO: 480247 - DNA, 20 bp, Artificial
  CRISPR gRNA sequence
gggactctgcttttgcaaat

SEQ ID NO: 480248 - DNA, 20 bp, Artificial
  CRISPR gRNA sequence
tgcttttgcaaatatagcgt

SEQ ID NO: 480249 - DNA, 20 bp, Artificial
  CRISPR gRNA sequence
cttttgcaaatatagcgtga

SEQ ID NO: 480250 - DNA, 20 bp, Artificial
  CRISPR gRNA sequence
ttgcaaatatagcgtgaagc

SEQ ID NO: 480251 - DNA, 20 bp, Artificial
  CRISPR gRNA sequence
tgcaaatatagcgtgaagct

SEQ ID NO: 480252 - DNA, 20 bp, Artificial
  CRISPR gRNA sequence
gcaaatatagcgtgaagctc

SEQ ID NO: 480253 - DNA, 20 bp, Artificial
  CRISPR gRNA sequence
caaatatagcgtgaagctcg

SEQ ID NO: 480254 - DNA, 20 bp, Artificial
  CRISPR gRNA sequence
ggtgctagttacttgtgacc

SEQ ID NO: 480255 - DNA, 20 bp, Artificial
  CRISPR gRNA sequence
gttacttgtgaccatccatg

SEQ ID NO: 480256 - DNA, 20 bp, Artificial
  CRISPR gRNA sequence
cttgtgaccatccatgcact

SEQ ID NO: 480257 - DNA, 20 bp, Artificial
  CRISPR gRNA sequence
gtgaccatccatgcactggc

SEQ ID NO: 480258 - DNA, 20 bp, Artificial
  CRISPR gRNA sequence
tgaccatccatgcactggct

SEQ ID NO: 480259 - DNA, 20 bp, Artificial
  CRISPR gRNA sequence
gcttataaacctcttcagga

SEQ ID NO: 480260 - DNA, 20 bp, Artificial
  CRISPR gRNA sequence
ataaacctcttcaggatgga

SEQ ID NO: 480261 - DNA, 20 bp, Artificial
  CRISPR gRNA sequence
taaacctcttcaggatggaa

SEQ ID NO: 480262 - DNA, 20 bp, Artificial
  CRISPR gRNA sequence
ttcaggatggaagctgtgtc

SEQ ID NO: 480263 - DNA, 20 bp, Artificial
  CRISPR gRNA sequence
caggatggaagctgtgtctt

SEQ ID NO: 480264 - DNA, 20 bp, Artificial
  CRISPR gRNA sequence
aggatggaagctgtgtctta

SEQ ID NO: 480265 - DNA, 20 bp, Artificial
  CRISPR gRNA sequence
tgtcttaaacatctttgctc

SEQ ID NO: 480266 - DNA, 20 bp, Artificial
  CRISPR gRNA sequence
aaacatctttgctctgtatg

SEQ ID NO: 480267 - DNA, 20 bp, Artificial
  CRISPR gRNA sequence
aacatctttgctctgtatga

SEQ ID NO: 480268 - DNA, 20 bp, Artificial
  CRISPR gRNA sequence
tgctctgtatgatggatggc

SEQ ID NO: 480269 - DNA, 20 bp, Artificial
  CRISPR gRNA sequence
gctctgtatgatggatggca

SEQ ID NO: 480270 - DNA, 20 bp, Artificial
  CRISPR gRNA sequence
ctctgtatgatggatggcag

SEQ ID NO: 480271 - DNA, 20 bp, Artificial
  CRISPR gRNA sequence
tgtatgatggatggcagggt

SEQ ID NO: 480272 - DNA, 20 bp, Artificial
  CRISPR gRNA sequence
tatgatggatggcagggtac

SEQ ID NO: 480273 - DNA, 20 bp, Artificial
  CRISPR gRNA sequence
gcacatggtaggggctcact

SEQ ID NO: 480274 - DNA, 20 bp, Artificial
  CRISPR gRNA sequence
actaaatatttctttgtaaa

SEQ ID NO: 480275 - DNA, 20 bp, Artificial
  CRISPR gRNA sequence
aatatttctttgtaaatgaa

SEQ ID NO: 480276 - DNA, 20 bp, Artificial
  CRISPR gRNA sequence
ctttgtaaatgaattaaaga

SEQ ID NO: 480277 - DNA, 20 bp, Artificial
  CRISPR gRNA sequence
tttgtaaatgaattaaagaa

SEQ ID NO: 480278 - DNA, 20 bp, Artificial
  CRISPR gRNA sequence
tgtaaatgaattaaagaaca

SEQ ID NO: 480279 - DNA, 20 bp, Artificial
  CRISPR gRNA sequence
gtaaatgaattaaagaacat

SEQ ID NO: 480280 - DNA, 20 bp, Artificial
  CRISPR gRNA sequence
taaatgaattaaagaacata

SEQ ID NO: 480281 - DNA, 20 bp, Artificial
  CRISPR gRNA sequence
aagaacatagtatatgcaaa

SEQ ID NO: 480282 - DNA, 20 bp, Artificial
  CRISPR gRNA sequence
tcttcatcaacctggagaag

SEQ ID NO: 480283 - DNA, 20 bp, Artificial
  CRISPR gRNA sequence
catcaacctggagaaggcta

SEQ ID NO: 480284 - DNA, 20 bp, Artificial
  CRISPR gRNA sequence
atcaacctggagaaggctat

SEQ ID NO: 480285 - DNA, 20 bp, Artificial
  CRISPR gRNA sequence
gagaaggctatattaaggat

SEQ ID NO: 480286 - DNA, 20 bp, Artificial
  CRISPR gRNA sequence
tattaaggatgtatggaatg

SEQ ID NO: 480287 - DNA, 20 bp, Artificial
  CRISPR gRNA sequence
aggatgtatggaatgaacac

SEQ ID NO: 480288 - DNA, 20 bp, Artificial
  CRISPR gRNA sequence
tctggaaagaattgcattat

SEQ ID NO: 480289 - DNA, 20 bp, Artificial
  CRISPR gRNA sequence
ctggaaagaattgcattatt

SEQ ID NO: 480290 - DNA, 20 bp, Artificial
  CRISPR gRNA sequence
tggaaagaattgcattatta

SEQ ID NO: 480291 - DNA, 20 bp, Artificial
  CRISPR gRNA sequence
gaaagaattgcattattaat

SEQ ID NO: 480292 - DNA, 20 bp, Artificial
  CRISPR gRNA sequence
cattattaattcacattaat

SEQ ID NO: 480293 - DNA, 20 bp, Artificial
  CRISPR gRNA sequence
ttaattcacattaatgagac

SEQ ID NO: 480294 - DNA, 20 bp, Artificial
  CRISPR gRNA sequence
attcacattaatgagacaaa

SEQ ID NO: 480295 - DNA, 20 bp, Artificial
  CRISPR gRNA sequence
acattaatgagacaaaatat

SEQ ID NO: 480296 - DNA, 20 bp, Artificial
  CRISPR gRNA sequence
atgagacaaaatattgaatt

SEQ ID NO: 480297 - DNA, 20 bp, Artificial
  CRISPR gRNA sequence
aatttttaacaaatactatt

SEQ ID NO: 480298 - DNA, 20 bp, Artificial
  CRISPR gRNA sequence
ttaacaaatactatttttta

SEQ ID NO: 480299 - DNA, 20 bp, Artificial
  CRISPR gRNA sequence
taacaaatactattttttaa

SEQ ID NO: 480300 - DNA, 20 bp, Artificial
  CRISPR gRNA sequence
aacaaatactattttttaaa

SEQ ID NO: 480301 - DNA, 20 bp, Artificial
  CRISPR gRNA sequence
acaaatactattttttaaac

SEQ ID NO: 480302 - DNA, 20 bp, Artificial
  CRISPR gRNA sequence
ttttttaaacaggtaaaata

SEQ ID NO: 480303 - DNA, 20 bp, Artificial
  CRISPR gRNA sequence
tttaaacaggtaaaataaat

SEQ ID NO: 480304 - DNA, 20 bp, Artificial
  CRISPR gRNA sequence
ttaaacaggtaaaataaatt

SEQ ID NO: 480305 - DNA, 20 bp, Artificial
  CRISPR gRNA sequence
taaacaggtaaaataaatta

SEQ ID NO: 480306 - DNA, 20 bp, Artificial
  CRISPR gRNA sequence
aaacaggtaaaataaattac

SEQ ID NO: 480307 - DNA, 20 bp, Artificial
  CRISPR gRNA sequence
aacaggtaaaataaattaca

SEQ ID NO: 480308 - DNA, 20 bp, Artificial
  CRISPR gRNA sequence
caaaaataaggaaaatctgc

SEQ ID NO: 480309 - DNA, 20 bp, Artificial
  CRISPR gRNA sequence
caaaatattaattctagaat

SEQ ID NO: 480310 - DNA, 20 bp, Artificial
  CRISPR gRNA sequence
attctagaatgatatatact

SEQ ID NO: 480311 - DNA, 20 bp, Artificial
  CRISPR gRNA sequence
tagaatgatatatactattg

SEQ ID NO: 480312 - DNA, 20 bp, Artificial
  CRISPR gRNA sequence
gaatgatatatactattgaa

SEQ ID NO: 480313 - DNA, 20 bp, Artificial
  CRISPR gRNA sequence
ttgaataaataagtgctatt

SEQ ID NO: 480314 - DNA, 20 bp, Artificial
  CRISPR gRNA sequence
aataaataagtgctattaac

SEQ ID NO: 480315 - DNA, 20 bp, Artificial
  CRISPR gRNA sequence
ttaactaatttatataatat

SEQ ID NO: 480316 - DNA, 20 bp, Artificial
  CRISPR gRNA sequence
actaatttatataatatatt

SEQ ID NO: 480317 - DNA, 20 bp, Artificial
  CRISPR gRNA sequence
atttatataatatattaaca

SEQ ID NO: 480318 - DNA, 20 bp, Artificial
  CRISPR gRNA sequence
atataatatattaacataat

SEQ ID NO: 480319 - DNA, 20 bp, Artificial
  CRISPR gRNA sequence
tataatatattaacataatg

SEQ ID NO: 480320 - DNA, 20 bp, Artificial
  CRISPR gRNA sequence
acataatgtataataaaatt

SEQ ID NO: 480321 - DNA, 20 bp, Artificial
  CRISPR gRNA sequence
aattttgaggcattgagtcc

SEQ ID NO: 480322 - DNA, 20 bp, Artificial
  CRISPR gRNA sequence
tgaggcattgagtccacctt

SEQ ID NO: 480323 - DNA, 20 bp, Artificial
  CRISPR gRNA sequence
gaggcattgagtccaccttc

SEQ ID NO: 480324 - DNA, 20 bp, Artificial
  CRISPR gRNA sequence
aggcattgagtccaccttcc

SEQ ID NO: 480325 - DNA, 20 bp, Artificial
  CRISPR gRNA sequence
agtccaccttccttggaaga

SEQ ID NO: 480326 - DNA, 20 bp, Artificial
  CRISPR gRNA sequence
ccttggaagagaagccttgt

SEQ ID NO: 480327 - DNA, 20 bp, Artificial
  CRISPR gRNA sequence
cttggaagagaagccttgtg

SEQ ID NO: 480328 - DNA, 20 bp, Artificial
  CRISPR gRNA sequence
ggaagagaagccttgtgtaa

SEQ ID NO: 480329 - DNA, 20 bp, Artificial
  CRISPR gRNA sequence
gaagagaagccttgtgtaat

SEQ ID NO: 480330 - DNA, 20 bp, Artificial
  CRISPR gRNA sequence
gtgtaattcagtctttcttt

SEQ ID NO: 480331 - DNA, 20 bp, Artificial
  CRISPR gRNA sequence
tgtaattcagtctttcttta

SEQ ID NO: 480332 - DNA, 20 bp, Artificial
  CRISPR gRNA sequence
agtctttctttatgggaact

SEQ ID NO: 480333 - DNA, 20 bp, Artificial
  CRISPR gRNA sequence
tctttatgggaactaatcta

SEQ ID NO: 480334 - DNA, 20 bp, Artificial
  CRISPR gRNA sequence
ctttatgggaactaatctac

SEQ ID NO: 480335 - DNA, 20 bp, Artificial
  CRISPR gRNA sequence
tttatgggaactaatctact

SEQ ID NO: 480336 - DNA, 20 bp, Artificial
  CRISPR gRNA sequence
tatgggaactaatctacttc

SEQ ID NO: 480337 - DNA, 20 bp, Artificial
  CRISPR gRNA sequence
atgggaactaatctacttct

SEQ ID NO: 480338 - DNA, 20 bp, Artificial
  CRISPR gRNA sequence
tgggaactaatctacttcta

SEQ ID NO: 480339 - DNA, 20 bp, Artificial
  CRISPR gRNA sequence
atctacttctatacgagaca

SEQ ID NO: 480340 - DNA, 20 bp, Artificial
  CRISPR gRNA sequence
cttctatacgagacatgaat

SEQ ID NO: 480341 - DNA, 20 bp, Artificial
  CRISPR gRNA sequence
ctatacgagacatgaattta

SEQ ID NO: 480342 - DNA, 20 bp, Artificial
  CRISPR gRNA sequence
tatacgagacatgaatttag

SEQ ID NO: 480343 - DNA, 20 bp, Artificial
  CRISPR gRNA sequence
tacgagacatgaatttagcc

SEQ ID NO: 480344 - DNA, 20 bp, Artificial
  CRISPR gRNA sequence
agccaaggtcagatgaaagg

SEQ ID NO: 480345 - DNA, 20 bp, Artificial
  CRISPR gRNA sequence
gccaaggtcagatgaaaggt

SEQ ID NO: 480346 - DNA, 20 bp, Artificial
  CRISPR gRNA sequence
ataattaattgtgatacaaa

SEQ ID NO: 480347 - DNA, 20 bp, Artificial
  CRISPR gRNA sequence
attgtgatacaaaagtctgt

SEQ ID NO: 480348 - DNA, 20 bp, Artificial
  CRISPR gRNA sequence
tgatacaaaagtctgttaca

SEQ ID NO: 480349 - DNA, 20 bp, Artificial
  CRISPR gRNA sequence
ttacacaaaagtagcattgc

SEQ ID NO: 480350 - DNA, 20 bp, Artificial
  CRISPR gRNA sequence
cacaaaagtagcattgcaat

SEQ ID NO: 480351 - DNA, 20 bp, Artificial
  CRISPR gRNA sequence
caatttctgctctatcccat

SEQ ID NO: 480352 - DNA, 20 bp, Artificial
  CRISPR gRNA sequence
ctgctctatcccatatttgg

SEQ ID NO: 480353 - DNA, 20 bp, Artificial
  CRISPR gRNA sequence
tgctctatcccatatttggg

SEQ ID NO: 480354 - DNA, 20 bp, Artificial
  CRISPR gRNA sequence
ctctatcccatatttgggtc

SEQ ID NO: 480355 - DNA, 20 bp, Artificial
  CRISPR gRNA sequence
tatcccatatttgggtcatt

SEQ ID NO: 480356 - DNA, 20 bp, Artificial
  CRISPR gRNA sequence
tcccatatttgggtcattca

SEQ ID NO: 480357 - DNA, 20 bp, Artificial
  CRISPR gRNA sequence
gggtcattcatgatgactaa

SEQ ID NO: 480358 - DNA, 20 bp, Artificial
  CRISPR gRNA sequence
ggtcattcatgatgactaaa

SEQ ID NO: 480359 - DNA, 20 bp, Artificial
  CRISPR gRNA sequence
atgatgactaaagataatct

SEQ ID NO: 480360 - DNA, 20 bp, Artificial
  CRISPR gRNA sequence
aagataatctgtagtttgta

SEQ ID NO: 480361 - DNA, 20 bp, Artificial
  CRISPR gRNA sequence
tagtttgtaaagtgcataaa

SEQ ID NO: 480362 - DNA, 20 bp, Artificial
  CRISPR gRNA sequence
gtaaagtgcataaaggtgcc

SEQ ID NO: 480363 - DNA, 20 bp, Artificial
  CRISPR gRNA sequence
taaagtgcataaaggtgcct

SEQ ID NO: 480364 - DNA, 20 bp, Artificial
  CRISPR gRNA sequence
ttctagggatcaagttgggg

SEQ ID NO: 480365 - DNA, 20 bp, Artificial
  CRISPR gRNA sequence
tagggatcaagttggggctg

SEQ ID NO: 480366 - DNA, 20 bp, Artificial
  CRISPR gRNA sequence
gggatcaagttggggctgag

SEQ ID NO: 480367 - DNA, 20 bp, Artificial
  CRISPR gRNA sequence
gggctgagattaggatcaac

SEQ ID NO: 480368 - DNA, 20 bp, Artificial
  CRISPR gRNA sequence
agattaggatcaacaatcta

SEQ ID NO: 480369 - DNA, 20 bp, Artificial
  CRISPR gRNA sequence
ggatcaacaatctatctatt

SEQ ID NO: 480370 - DNA, 20 bp, Artificial
  CRISPR gRNA sequence
tctattttgtggaggaaaga

SEQ ID NO: 480371 - DNA, 20 bp, Artificial
  CRISPR gRNA sequence
ttttgtggaggaaagaaccc

SEQ ID NO: 480372 - DNA, 20 bp, Artificial
  CRISPR gRNA sequence
tgtggaggaaagaacccaac

SEQ ID NO: 480373 - DNA, 20 bp, Artificial
  CRISPR gRNA sequence
gtggaggaaagaacccaact

SEQ ID NO: 480374 - DNA, 20 bp, Artificial
  CRISPR gRNA sequence
tggaggaaagaacccaactt

SEQ ID NO: 480375 - DNA, 20 bp, Artificial
  CRISPR gRNA sequence
taggggaaagggaataacat

SEQ ID NO: 480376 - DNA, 20 bp, Artificial
  CRISPR gRNA sequence
aggggaaagggaataacatt

SEQ ID NO: 480377 - DNA, 20 bp, Artificial
  CRISPR gRNA sequence
ggggaaagggaataacattc

SEQ ID NO: 480378 - DNA, 20 bp, Artificial
  CRISPR gRNA sequence
cctcctaaatcctgtgcctt

SEQ ID NO: 480379 - DNA, 20 bp, Artificial
  CRISPR gRNA sequence
ctaaatcctgtgccttgggg

SEQ ID NO: 480380 - DNA, 20 bp, Artificial
  CRISPR gRNA sequence
aatcctgtgccttggggggt

SEQ ID NO: 480381 - DNA, 20 bp, Artificial
  CRISPR gRNA sequence
tgccttggggggttttatgg

SEQ ID NO: 480382 - DNA, 20 bp, Artificial
  CRISPR gRNA sequence
ggggggttttatggaacaaa

SEQ ID NO: 480383 - DNA, 20 bp, Artificial
  CRISPR gRNA sequence
gggggttttatggaacaaag

SEQ ID NO: 480384 - DNA, 20 bp, Artificial
  CRISPR gRNA sequence
tatggaacaaagtatgtgaa

SEQ ID NO: 480385 - DNA, 20 bp, Artificial
  CRISPR gRNA sequence
atggaacaaagtatgtgaag

SEQ ID NO: 480386 - DNA, 20 bp, Artificial
  CRISPR gRNA sequence
tggaacaaagtatgtgaagt

SEQ ID NO: 480387 - DNA, 20 bp, Artificial
  CRISPR gRNA sequence
agagctaaataggagacatg

SEQ ID NO: 480388 - DNA, 20 bp, Artificial
  CRISPR gRNA sequence
aataggagacatgaagggcc

SEQ ID NO: 480389 - DNA, 20 bp, Artificial
  CRISPR gRNA sequence
gtcagtttctttttgaacat

SEQ ID NO: 480390 - DNA, 20 bp, Artificial
  CRISPR gRNA sequence
tcagtttctttttgaacatt

SEQ ID NO: 480391 - DNA, 20 bp, Artificial
  CRISPR gRNA sequence
ctttttgaacatttctactc

SEQ ID NO: 480392 - DNA, 20 bp, Artificial
  CRISPR gRNA sequence
tttttgaacatttctactct

SEQ ID NO: 480393 - DNA, 20 bp, Artificial
  CRISPR gRNA sequence
tttgaacatttctactctct

SEQ ID NO: 480394 - DNA, 20 bp, Artificial
  CRISPR gRNA sequence
ttgaacatttctactctctt

SEQ ID NO: 480395 - DNA, 20 bp, Artificial
  CRISPR gRNA sequence
tgaacatttctactctctta

SEQ ID NO: 480396 - DNA, 20 bp, Artificial
  CRISPR gRNA sequence
gaacatttctactctcttag

SEQ ID NO: 480397 - DNA, 20 bp, Artificial
  CRISPR gRNA sequence
aacatttctactctcttagt

SEQ ID NO: 480398 - DNA, 20 bp, Artificial
  CRISPR gRNA sequence
ctactctcttagtttcctac

SEQ ID NO: 480399 - DNA, 20 bp, Artificial
  CRISPR gRNA sequence
tactctcttagtttcctact

SEQ ID NO: 480400 - DNA, 20 bp, Artificial
  CRISPR gRNA sequence
ctctcttagtttcctactca

SEQ ID NO: 480401 - DNA, 20 bp, Artificial
  CRISPR gRNA sequence
tcttagtttcctactcacct

SEQ ID NO: 480402 - DNA, 20 bp, Artificial
  CRISPR gRNA sequence
ttagtttcctactcacctat

SEQ ID NO: 480403 - DNA, 20 bp, Artificial
  CRISPR gRNA sequence
agtttcctactcacctatcc

SEQ ID NO: 480404 - DNA, 20 bp, Artificial
  CRISPR gRNA sequence
gtttcctactcacctatcct

SEQ ID NO: 480405 - DNA, 20 bp, Artificial
  CRISPR gRNA sequence
cctactcacctatccttcct

SEQ ID NO: 480406 - DNA, 20 bp, Artificial
  CRISPR gRNA sequence
ctactcacctatccttccta

SEQ ID NO: 480407 - DNA, 20 bp, Artificial
  CRISPR gRNA sequence
ctcacctatccttcctatca

SEQ ID NO: 480408 - DNA, 20 bp, Artificial
  CRISPR gRNA sequence
acctatccttcctatcactc

SEQ ID NO: 480409 - DNA, 20 bp, Artificial
  CRISPR gRNA sequence
tccttcctatcactcccttc

SEQ ID NO: 480410 - DNA, 20 bp, Artificial
  CRISPR gRNA sequence
cctatcactcccttccttat

SEQ ID NO: 480411 - DNA, 20 bp, Artificial
  CRISPR gRNA sequence
ctatcactcccttccttatc

SEQ ID NO: 480412 - DNA, 20 bp, Artificial
  CRISPR gRNA sequence
tcactcccttccttatcagt

SEQ ID NO: 480413 - DNA, 20 bp, Artificial
  CRISPR gRNA sequence
ccttccttatcagtttgtta

SEQ ID NO: 480414 - DNA, 20 bp, Artificial
  CRISPR gRNA sequence
ccttatcagtttgttaatta

SEQ ID NO: 480415 - DNA, 20 bp, Artificial
  CRISPR gRNA sequence
cttatcagtttgttaattaa

SEQ ID NO: 480416 - DNA, 20 bp, Artificial
  CRISPR gRNA sequence
atcagtttgttaattaatgc

SEQ ID NO: 480417 - DNA, 20 bp, Artificial
  CRISPR gRNA sequence
tcagtttgttaattaatgct

SEQ ID NO: 480418 - DNA, 20 bp, Artificial
  CRISPR gRNA sequence
gttaattaatgctcttgatc

SEQ ID NO: 480419 - DNA, 20 bp, Artificial
  CRISPR gRNA sequence
ttaattaatgctcttgatcc

SEQ ID NO: 480420 - DNA, 20 bp, Artificial
  CRISPR gRNA sequence
attaatgctcttgatcctca

SEQ ID NO: 480421 - DNA, 20 bp, Artificial
  CRISPR gRNA sequence
atgctcttgatcctcatgga

SEQ ID NO: 480422 - DNA, 20 bp, Artificial
  CRISPR gRNA sequence
ttgatcctcatggaaaatcc

SEQ ID NO: 480423 - DNA, 20 bp, Artificial
  CRISPR gRNA sequence
gatcctcatggaaaatccca

SEQ ID NO: 480424 - DNA, 20 bp, Artificial
  CRISPR gRNA sequence
atcctcatggaaaatcccag

SEQ ID NO: 480425 - DNA, 20 bp, Artificial
  CRISPR gRNA sequence
atggaaaatcccagagaatt

SEQ ID NO: 480426 - DNA, 20 bp, Artificial
  CRISPR gRNA sequence
tctttggcttcctactcttg

SEQ ID NO: 480427 - DNA, 20 bp, Artificial
  CRISPR gRNA sequence
ctttggcttcctactcttgt

SEQ ID NO: 480428 - DNA, 20 bp, Artificial
  CRISPR gRNA sequence
tttggcttcctactcttgtc

SEQ ID NO: 480429 - DNA, 20 bp, Artificial
  CRISPR gRNA sequence
tggcttcctactcttgtctc

SEQ ID NO: 480430 - DNA, 20 bp, Artificial
  CRISPR gRNA sequence
ggcttcctactcttgtctct

SEQ ID NO: 480431 - DNA, 20 bp, Artificial
  CRISPR gRNA sequence
gcttcctactcttgtctctc

SEQ ID NO: 480432 - DNA, 20 bp, Artificial
  CRISPR gRNA sequence
cctactcttgtctctccaca

SEQ ID NO: 480433 - DNA, 20 bp, Artificial
  CRISPR gRNA sequence
ctactcttgtctctccacaa

SEQ ID NO: 480434 - DNA, 20 bp, Artificial
  CRISPR gRNA sequence
ctcttgtctctccacaacat

SEQ ID NO: 480435 - DNA, 20 bp, Artificial
  CRISPR gRNA sequence
ttgtctctccacaacattcc

SEQ ID NO: 480436 - DNA, 20 bp, Artificial
  CRISPR gRNA sequence
gtctctccacaacattccac

SEQ ID NO: 480437 - DNA, 20 bp, Artificial
  CRISPR gRNA sequence
tctctccacaacattccact

SEQ ID NO: 480438 - DNA, 20 bp, Artificial
  CRISPR gRNA sequence
tccacaacattccactctgt

SEQ ID NO: 480439 - DNA, 20 bp, Artificial
  CRISPR gRNA sequence
cacaacattccactctgtga

SEQ ID NO: 480440 - DNA, 20 bp, Artificial
  CRISPR gRNA sequence
cactctgtgatgtgtttcct

SEQ ID NO: 480441 - DNA, 20 bp, Artificial
  CRISPR gRNA sequence
tgtgatgtgtttcctccaat

SEQ ID NO: 480442 - DNA, 20 bp, Artificial
  CRISPR gRNA sequence
tgatgtgtttcctccaattg

SEQ ID NO: 480443 - DNA, 20 bp, Artificial
  CRISPR gRNA sequence
cctccaattgcttctataag

SEQ ID NO: 480444 - DNA, 20 bp, Artificial
  CRISPR gRNA sequence
ctccaattgcttctataagc

SEQ ID NO: 480445 - DNA, 20 bp, Artificial
  CRISPR gRNA sequence
caattgcttctataagcatc

SEQ ID NO: 480446 - DNA, 20 bp, Artificial
  CRISPR gRNA sequence
cttctataagcatctcgcac

SEQ ID NO: 480447 - DNA, 20 bp, Artificial
  CRISPR gRNA sequence
ctataagcatctcgcaccat

SEQ ID NO: 480448 - DNA, 20 bp, Artificial
  CRISPR gRNA sequence
tataagcatctcgcaccatc

SEQ ID NO: 480449 - DNA, 20 bp, Artificial
  CRISPR gRNA sequence
taagcatctcgcaccatcat

SEQ ID NO: 480450 - DNA, 20 bp, Artificial
  CRISPR gRNA sequence
gcaccatcattatcttcctt

SEQ ID NO: 480451 - DNA, 20 bp, Artificial
  CRISPR gRNA sequence
tcttccttctaaataattcc

SEQ ID NO: 480452 - DNA, 20 bp, Artificial
  CRISPR gRNA sequence
ccttctaaataattccaatt

SEQ ID NO: 480453 - DNA, 20 bp, Artificial
  CRISPR gRNA sequence
cttctaaataattccaatta

SEQ ID NO: 480454 - DNA, 20 bp, Artificial
  CRISPR gRNA sequence
ctaaataattccaattaatt

SEQ ID NO: 480455 - DNA, 20 bp, Artificial
  CRISPR gRNA sequence
taaataattccaattaattc

SEQ ID NO: 480456 - DNA, 20 bp, Artificial
  CRISPR gRNA sequence
aataattccaattaattcta

SEQ ID NO: 480457 - DNA, 20 bp, Artificial
  CRISPR gRNA sequence
caattaattctatgattgga

SEQ ID NO: 480458 - DNA, 20 bp, Artificial
  CRISPR gRNA sequence
attctatgattggactcttt

SEQ ID NO: 480459 - DNA, 20 bp, Artificial
  CRISPR gRNA sequence
tatgattggactctttgtct

SEQ ID NO: 480460 - DNA, 20 bp, Artificial
  CRISPR gRNA sequence
tgattggactctttgtcttt

SEQ ID NO: 480461 - DNA, 20 bp, Artificial
  CRISPR gRNA sequence
gactctttgtctttagtatt

SEQ ID NO: 480462 - DNA, 20 bp, Artificial
  CRISPR gRNA sequence
tttgtctttagtatttcccc

SEQ ID NO: 480463 - DNA, 20 bp, Artificial
  CRISPR gRNA sequence
tgtctttagtatttccccat

SEQ ID NO: 480464 - DNA, 20 bp, Artificial
  CRISPR gRNA sequence
gtctttagtatttccccatt

SEQ ID NO: 480465 - DNA, 20 bp, Artificial
  CRISPR gRNA sequence
tctttagtatttccccattt

SEQ ID NO: 480466 - DNA, 20 bp, Artificial
  CRISPR gRNA sequence
tagtatttccccattttggt

SEQ ID NO: 480467 - DNA, 20 bp, Artificial
  CRISPR gRNA sequence
agtatttccccattttggtc

SEQ ID NO: 480468 - DNA, 20 bp, Artificial
  CRISPR gRNA sequence
gtatttccccattttggtca

SEQ ID NO: 480469 - DNA, 20 bp, Artificial
  CRISPR gRNA sequence
ccccattttggtcaatttca

SEQ ID NO: 480470 - DNA, 20 bp, Artificial
  CRISPR gRNA sequence
cccattttggtcaatttcag

SEQ ID NO: 480471 - DNA, 20 bp, Artificial
  CRISPR gRNA sequence
tggtcaatttcagccaaata

SEQ ID NO: 480472 - DNA, 20 bp, Artificial
  CRISPR gRNA sequence
ggtcaatttcagccaaatac

SEQ ID NO: 480473 - DNA, 20 bp, Artificial
  CRISPR gRNA sequence
gtcaatttcagccaaataca

SEQ ID NO: 480474 - DNA, 20 bp, Artificial
  CRISPR gRNA sequence
cagccaaatacacttaaatt

SEQ ID NO: 480475 - DNA, 20 bp, Artificial
  CRISPR gRNA sequence
agccaaatacacttaaatta

SEQ ID NO: 480476 - DNA, 20 bp, Artificial
  CRISPR gRNA sequence
aaattacctcatacacttcc

SEQ ID NO: 480477 - DNA, 20 bp, Artificial
  CRISPR gRNA sequence
aattacctcatacacttcct

SEQ ID NO: 480478 - DNA, 20 bp, Artificial
  CRISPR gRNA sequence
cctcatacacttccttcata

SEQ ID NO: 480479 - DNA, 20 bp, Artificial
  CRISPR gRNA sequence
atacacttccttcataacaa

SEQ ID NO: 480480 - DNA, 20 bp, Artificial
  CRISPR gRNA sequence
ccttcataacaacactctct

SEQ ID NO: 480481 - DNA, 20 bp, Artificial
  CRISPR gRNA sequence
cttcataacaacactctctt

SEQ ID NO: 480482 - DNA, 20 bp, Artificial
  CRISPR gRNA sequence
cataacaacactctcttgca

SEQ ID NO: 480483 - DNA, 20 bp, Artificial
  CRISPR gRNA sequence
ataacaacactctcttgcat

SEQ ID NO: 480484 - DNA, 20 bp, Artificial
  CRISPR gRNA sequence
tcttgcatagcatccccagt

SEQ ID NO: 480485 - DNA, 20 bp, Artificial
  CRISPR gRNA sequence
ttgcatagcatccccagtgg

SEQ ID NO: 480486 - DNA, 20 bp, Artificial
  CRISPR gRNA sequence
gcatagcatccccagtggtc

SEQ ID NO: 480487 - DNA, 20 bp, Artificial
  CRISPR gRNA sequence
catagcatccccagtggtca

SEQ ID NO: 480488 - DNA, 20 bp, Artificial
  CRISPR gRNA sequence
ggctcatctttgttaaccag

SEQ ID NO: 480489 - DNA, 20 bp, Artificial
  CRISPR gRNA sequence
atctttgttaaccagcattc

SEQ ID NO: 480490 - DNA, 20 bp, Artificial
  CRISPR gRNA sequence
tgttaaccagcattcaaagt

SEQ ID NO: 480491 - DNA, 20 bp, Artificial
  CRISPR gRNA sequence
gttaaccagcattcaaagtc

SEQ ID NO: 480492 - DNA, 20 bp, Artificial
  CRISPR gRNA sequence
ttaaccagcattcaaagtct

SEQ ID NO: 480493 - DNA, 20 bp, Artificial
  CRISPR gRNA sequence
accagcattcaaagtcttcc

SEQ ID NO: 480494 - DNA, 20 bp, Artificial
  CRISPR gRNA sequence
aaagtcttccacagtttgat

SEQ ID NO: 480495 - DNA, 20 bp, Artificial
  CRISPR gRNA sequence
ccacagtttgatcccaccac

SEQ ID NO: 480496 - DNA, 20 bp, Artificial
  CRISPR gRNA sequence
cacagtttgatcccaccacc

SEQ ID NO: 480497 - DNA, 20 bp, Artificial
  CRISPR gRNA sequence
gatcccaccacctttctaga

SEQ ID NO: 480498 - DNA, 20 bp, Artificial
  CRISPR gRNA sequence
atcccaccacctttctagat

SEQ ID NO: 480499 - DNA, 20 bp, Artificial
  CRISPR gRNA sequence
tctagattgtttctggattc

SEQ ID NO: 480500 - DNA, 20 bp, Artificial
  CRISPR gRNA sequence
ctagattgtttctggattcc

SEQ ID NO: 480501 - DNA, 20 bp, Artificial
  CRISPR gRNA sequence
tagattgtttctggattcca

SEQ ID NO: 480502 - DNA, 20 bp, Artificial
  CRISPR gRNA sequence
gattgtttctggattccata

SEQ ID NO: 480503 - DNA, 20 bp, Artificial
  CRISPR gRNA sequence
tttctggattccatatacag

SEQ ID NO: 480504 - DNA, 20 bp, Artificial
  CRISPR gRNA sequence
ctggattccatatacagcct

SEQ ID NO: 480505 - DNA, 20 bp, Artificial
  CRISPR gRNA sequence
tggattccatatacagcctc

SEQ ID NO: 480506 - DNA, 20 bp, Artificial
  CRISPR gRNA sequence
gattccatatacagcctctc

SEQ ID NO: 480507 - DNA, 20 bp, Artificial
  CRISPR gRNA sequence
catatacagcctctcaattg

SEQ ID NO: 480508 - DNA, 20 bp, Artificial
  CRISPR gRNA sequence
tcaattgcagcctgacggcc

SEQ ID NO: 480509 - DNA, 20 bp, Artificial
  CRISPR gRNA sequence
aattgcagcctgacggcctt

SEQ ID NO: 480510 - DNA, 20 bp, Artificial
  CRISPR gRNA sequence
cagcctgacggccttacttg

SEQ ID NO: 480511 - DNA, 20 bp, Artificial
  CRISPR gRNA sequence
acggccttacttgccataac

SEQ ID NO: 480512 - DNA, 20 bp, Artificial
  CRISPR gRNA sequence
acttgccataaccacatctc

SEQ ID NO: 480513 - DNA, 20 bp, Artificial
  CRISPR gRNA sequence
cttgccataaccacatctcc

SEQ ID NO: 480514 - DNA, 20 bp, Artificial
  CRISPR gRNA sequence
gccataaccacatctccatc

SEQ ID NO: 480515 - DNA, 20 bp, Artificial
  CRISPR gRNA sequence
ccataaccacatctccatca

SEQ ID NO: 480516 - DNA, 20 bp, Artificial
  CRISPR gRNA sequence
catcattgccctgtgtatgc

SEQ ID NO: 480517 - DNA, 20 bp, Artificial
  CRISPR gRNA sequence
ccctgtgtatgctgctcttg

SEQ ID NO: 480518 - DNA, 20 bp, Artificial
  CRISPR gRNA sequence
tgtatgctgctcttgccact

SEQ ID NO: 480519 - DNA, 20 bp, Artificial
  CRISPR gRNA sequence
ctcttgccacttgtagagca

SEQ ID NO: 480520 - DNA, 20 bp, Artificial
  CRISPR gRNA sequence
ttgccacttgtagagcaccc

SEQ ID NO: 480521 - DNA, 20 bp, Artificial
  CRISPR gRNA sequence
gccacttgtagagcacccat

SEQ ID NO: 480522 - DNA, 20 bp, Artificial
  CRISPR gRNA sequence
ccacttgtagagcacccatt

SEQ ID NO: 480523 - DNA, 20 bp, Artificial
  CRISPR gRNA sequence
gtagagcacccattcatctg

SEQ ID NO: 480524 - DNA, 20 bp, Artificial
  CRISPR gRNA sequence
tagagcacccattcatctgt

SEQ ID NO: 480525 - DNA, 20 bp, Artificial
  CRISPR gRNA sequence
atctgtctccacctatggaa

SEQ ID NO: 480526 - DNA, 20 bp, Artificial
  CRISPR gRNA sequence
tctccacctatggaaattct

SEQ ID NO: 480527 - DNA, 20 bp, Artificial
  CRISPR gRNA sequence
cacctatggaaattctaccc

SEQ ID NO: 480528 - DNA, 20 bp, Artificial
  CRISPR gRNA sequence
tggaaattctacccctcctt

SEQ ID NO: 480529 - DNA, 20 bp, Artificial
  CRISPR gRNA sequence
tacccctcctttcaatctca

SEQ ID NO: 480530 - DNA, 20 bp, Artificial
  CRISPR gRNA sequence
cccctcctttcaatctcagc

SEQ ID NO: 480531 - DNA, 20 bp, Artificial
  CRISPR gRNA sequence
ctttcaatctcagctaattt

SEQ ID NO: 480532 - DNA, 20 bp, Artificial
  CRISPR gRNA sequence
tcaatctcagctaattttcc

SEQ ID NO: 480533 - DNA, 20 bp, Artificial
  CRISPR gRNA sequence
caatctcagctaattttcca

SEQ ID NO: 480534 - DNA, 20 bp, Artificial
  CRISPR gRNA sequence
aatctcagctaattttccaa

SEQ ID NO: 480535 - DNA, 20 bp, Artificial
  CRISPR gRNA sequence
agctaattttccaagttctt

SEQ ID NO: 480536 - DNA, 20 bp, Artificial
  CRISPR gRNA sequence
attttccaagttcttaagga

SEQ ID NO: 480537 - DNA, 20 bp, Artificial
  CRISPR gRNA sequence
tccaagttcttaaggaagct

SEQ ID NO: 480538 - DNA, 20 bp, Artificial
  CRISPR gRNA sequence
ccaagttcttaaggaagctt

SEQ ID NO: 480539 - DNA, 20 bp, Artificial
  CRISPR gRNA sequence
caagttcttaaggaagcttt

SEQ ID NO: 480540 - DNA, 20 bp, Artificial
  CRISPR gRNA sequence
ttaaggaagcttttcatgat

SEQ ID NO: 480541 - DNA, 20 bp, Artificial
  CRISPR gRNA sequence
aaggaagcttttcatgatca

SEQ ID NO: 480542 - DNA, 20 bp, Artificial
  CRISPR gRNA sequence
aggaagcttttcatgatcac

SEQ ID NO: 480543 - DNA, 20 bp, Artificial
  CRISPR gRNA sequence
ttcatgatcacctgagggga

SEQ ID NO: 480544 - DNA, 20 bp, Artificial
  CRISPR gRNA sequence
tcatgatcacctgaggggaa

SEQ ID NO: 480545 - DNA, 20 bp, Artificial
  CRISPR gRNA sequence
catgatcacctgaggggaag

SEQ ID NO: 480546 - DNA, 20 bp, Artificial
  CRISPR gRNA sequence
atgatcacctgaggggaagg

SEQ ID NO: 480547 - DNA, 20 bp, Artificial
  CRISPR gRNA sequence
aggggaagggatcactcctt

SEQ ID NO: 480548 - DNA, 20 bp, Artificial
  CRISPR gRNA sequence
ctttttaccaatttttatgc

SEQ ID NO: 480549 - DNA, 20 bp, Artificial
  CRISPR gRNA sequence
tttaccaatttttatgccat

SEQ ID NO: 480550 - DNA, 20 bp, Artificial
  CRISPR gRNA sequence
ttaccaatttttatgccatt

SEQ ID NO: 480551 - DNA, 20 bp, Artificial
  CRISPR gRNA sequence
taccaatttttatgccattt

SEQ ID NO: 480552 - DNA, 20 bp, Artificial
  CRISPR gRNA sequence
accaatttttatgccattta

SEQ ID NO: 480553 - DNA, 20 bp, Artificial
  CRISPR gRNA sequence
ccaatttttatgccatttaa

SEQ ID NO: 480554 - DNA, 20 bp, Artificial
  CRISPR gRNA sequence
ttatgccatttaagtctgtg

SEQ ID NO: 480555 - DNA, 20 bp, Artificial
  CRISPR gRNA sequence
tatgccatttaagtctgtgc

SEQ ID NO: 480556 - DNA, 20 bp, Artificial
  CRISPR gRNA sequence
atgccatttaagtctgtgcc

SEQ ID NO: 480557 - DNA, 20 bp, Artificial
  CRISPR gRNA sequence
tgccatttaagtctgtgcct

SEQ ID NO: 480558 - DNA, 20 bp, Artificial
  CRISPR gRNA sequence
aagtctgtgcctctcattta

SEQ ID NO: 480559 - DNA, 20 bp, Artificial
  CRISPR gRNA sequence
agtctgtgcctctcatttat

SEQ ID NO: 480560 - DNA, 20 bp, Artificial
  CRISPR gRNA sequence
tgcctctcatttatcatttc

SEQ ID NO: 480561 - DNA, 20 bp, Artificial
  CRISPR gRNA sequence
tcatttatcatttcctttca

SEQ ID NO: 480562 - DNA, 20 bp, Artificial
  CRISPR gRNA sequence
atttatcatttcctttcact

SEQ ID NO: 480563 - DNA, 20 bp, Artificial
  CRISPR gRNA sequence
atcatttcctttcactgtag

SEQ ID NO: 480564 - DNA, 20 bp, Artificial
  CRISPR gRNA sequence
tcatttcctttcactgtagt

SEQ ID NO: 480565 - DNA, 20 bp, Artificial
  CRISPR gRNA sequence
cctttcactgtagtaatgtg

SEQ ID NO: 480566 - DNA, 20 bp, Artificial
  CRISPR gRNA sequence
ctttcactgtagtaatgtgt

SEQ ID NO: 480567 - DNA, 20 bp, Artificial
  CRISPR gRNA sequence
tcactgtagtaatgtgtgga

SEQ ID NO: 480568 - DNA, 20 bp, Artificial
  CRISPR gRNA sequence
cactgtagtaatgtgtggaa

SEQ ID NO: 480569 - DNA, 20 bp, Artificial
  CRISPR gRNA sequence
actgtagtaatgtgtggaaa

SEQ ID NO: 480570 - DNA, 20 bp, Artificial
  CRISPR gRNA sequence
tagtaatgtgtggaaatgtc

SEQ ID NO: 480571 - DNA, 20 bp, Artificial
  CRISPR gRNA sequence
ttaggtcccatgaaagatta

SEQ ID NO: 480572 - DNA, 20 bp, Artificial
  CRISPR gRNA sequence
taggtcccatgaaagattat

SEQ ID NO: 480573 - DNA, 20 bp, Artificial
  CRISPR gRNA sequence
aggtcccatgaaagattata

SEQ ID NO: 480574 - DNA, 20 bp, Artificial
  CRISPR gRNA sequence
ggtcccatgaaagattataa

SEQ ID NO: 480575 - DNA, 20 bp, Artificial
  CRISPR gRNA sequence
taatgtcctggaaggctgga

SEQ ID NO: 480576 - DNA, 20 bp, Artificial
  CRISPR gRNA sequence
gaaggctggaatttgtgtaa

SEQ ID NO: 480577 - DNA, 20 bp, Artificial
  CRISPR gRNA sequence
gaatttgtgtaatatttctt

SEQ ID NO: 480578 - DNA, 20 bp, Artificial
  CRISPR gRNA sequence
gtgtaatatttctttttttt

SEQ ID NO: 480579 - DNA, 20 bp, Artificial
  CRISPR gRNA sequence
tgtaatatttcttttttttt

SEQ ID NO: 480580 - DNA, 20 bp, Artificial
  CRISPR gRNA sequence
cttttttttttttcttttaa

SEQ ID NO: 480581 - DNA, 20 bp, Artificial
  CRISPR gRNA sequence
ttttttttttttcttttaac

SEQ ID NO: 480582 - DNA, 20 bp, Artificial
  CRISPR gRNA sequence
ttttttttttcttttaactt

SEQ ID NO: 480583 - DNA, 20 bp, Artificial
  CRISPR gRNA sequence
tttttttttcttttaacttc

SEQ ID NO: 480584 - DNA, 20 bp, Artificial
  CRISPR gRNA sequence
ttttttttcttttaacttcc

SEQ ID NO: 480585 - DNA, 20 bp, Artificial
  CRISPR gRNA sequence
tttttttcttttaacttcct

SEQ ID NO: 480586 - DNA, 20 bp, Artificial
  CRISPR gRNA sequence
ttttttcttttaacttcctt

SEQ ID NO: 480587 - DNA, 20 bp, Artificial
  CRISPR gRNA sequence
tttttcttttaacttccttc

SEQ ID NO: 480588 - DNA, 20 bp, Artificial
  CRISPR gRNA sequence
ttttcttttaacttccttca

SEQ ID NO: 480589 - DNA, 20 bp, Artificial
  CRISPR gRNA sequence
tttcttttaacttccttcac

SEQ ID NO: 480590 - DNA, 20 bp, Artificial
  CRISPR gRNA sequence
ttcttttaacttccttcaca

SEQ ID NO: 480591 - DNA, 20 bp, Artificial
  CRISPR gRNA sequence
tcttttaacttccttcacaa

SEQ ID NO: 480592 - DNA, 20 bp, Artificial
  CRISPR gRNA sequence
cttttaacttccttcacaaa

SEQ ID NO: 480593 - DNA, 20 bp, Artificial
  CRISPR gRNA sequence
ttttaacttccttcacaaaa

SEQ ID NO: 480594 - DNA, 20 bp, Artificial
  CRISPR gRNA sequence
ttaacttccttcacaaaagg

SEQ ID NO: 480595 - DNA, 20 bp, Artificial
  CRISPR gRNA sequence
taacttccttcacaaaaggt

SEQ ID NO: 480596 - DNA, 20 bp, Artificial
  CRISPR gRNA sequence
aacttccttcacaaaaggta

SEQ ID NO: 480597 - DNA, 20 bp, Artificial
  CRISPR gRNA sequence
acttccttcacaaaaggtaa

SEQ ID NO: 480598 - DNA, 20 bp, Artificial
  CRISPR gRNA sequence
ccttcacaaaaggtaaattg

SEQ ID NO: 480599 - DNA, 20 bp, Artificial
  CRISPR gRNA sequence
cttcacaaaaggtaaattgt

SEQ ID NO: 480600 - DNA, 20 bp, Artificial
  CRISPR gRNA sequence
cacaaaaggtaaattgttta

SEQ ID NO: 480601 - DNA, 20 bp, Artificial
  CRISPR gRNA sequence
acaaaaggtaaattgtttag

SEQ ID NO: 480602 - DNA, 20 bp, Artificial
  CRISPR gRNA sequence
tttaggaattaactttaatt

SEQ ID NO: 480603 - DNA, 20 bp, Artificial
  CRISPR gRNA sequence
aggaattaactttaatttaa

SEQ ID NO: 480604 - DNA, 20 bp, Artificial
  CRISPR gRNA sequence
ggaattaactttaatttaaa

SEQ ID NO: 480605 - DNA, 20 bp, Artificial
  CRISPR gRNA sequence
actttaatttaaactctgtg

SEQ ID NO: 480606 - DNA, 20 bp, Artificial
  CRISPR gRNA sequence
taatttaaactctgtgtgga

SEQ ID NO: 480607 - DNA, 20 bp, Artificial
  CRISPR gRNA sequence
aatttaaactctgtgtggat

SEQ ID NO: 480608 - DNA, 20 bp, Artificial
  CRISPR gRNA sequence
atttaaactctgtgtggatt

SEQ ID NO: 480609 - DNA, 20 bp, Artificial
  CRISPR gRNA sequence
aaactctgtgtggatttaaa

SEQ ID NO: 480610 - DNA, 20 bp, Artificial
  CRISPR gRNA sequence
aactctgtgtggatttaaaa

SEQ ID NO: 480611 - DNA, 20 bp, Artificial
  CRISPR gRNA sequence
tgtgtggatttaaaactaat

SEQ ID NO: 480612 - DNA, 20 bp, Artificial
  CRISPR gRNA sequence
tgtggatttaaaactaattt

SEQ ID NO: 480613 - DNA, 20 bp, Artificial
  CRISPR gRNA sequence
aaaactaatttaatctaggt

SEQ ID NO: 480614 - DNA, 20 bp, Artificial
  CRISPR gRNA sequence
aaactaatttaatctaggtg

SEQ ID NO: 480615 - DNA, 20 bp, Artificial
  CRISPR gRNA sequence
atttaatctaggtgtgcatt

SEQ ID NO: 480616 - DNA, 20 bp, Artificial
  CRISPR gRNA sequence
aatctaggtgtgcatttttc

SEQ ID NO: 480617 - DNA, 20 bp, Artificial
  CRISPR gRNA sequence
atctaggtgtgcatttttct

SEQ ID NO: 480618 - DNA, 20 bp, Artificial
  CRISPR gRNA sequence
ggtgtgcatttttctttagt

SEQ ID NO: 480619 - DNA, 20 bp, Artificial
  CRISPR gRNA sequence
ttctttagtgaagtggtgaa

SEQ ID NO: 480620 - DNA, 20 bp, Artificial
  CRISPR gRNA sequence
tctttagtgaagtggtgaaa

SEQ ID NO: 480621 - DNA, 20 bp, Artificial
  CRISPR gRNA sequence
ctttagtgaagtggtgaaaa

SEQ ID NO: 480622 - DNA, 20 bp, Artificial
  CRISPR gRNA sequence
tttagtgaagtggtgaaaac

SEQ ID NO: 480623 - DNA, 20 bp, Artificial
  CRISPR gRNA sequence
tagtgaagtggtgaaaacaa

SEQ ID NO: 480624 - DNA, 20 bp, Artificial
  CRISPR gRNA sequence
agtgaagtggtgaaaacaaa

SEQ ID NO: 480625 - DNA, 20 bp, Artificial
  CRISPR gRNA sequence
gtgaagtggtgaaaacaaaa

SEQ ID NO: 480626 - DNA, 20 bp, Artificial
  CRISPR gRNA sequence
cttttccttctgaacctgaa

SEQ ID NO: 480627 - DNA, 20 bp, Artificial
  CRISPR gRNA sequence
ttccttctgaacctgaaagt

SEQ ID NO: 480628 - DNA, 20 bp, Artificial
  CRISPR gRNA sequence
tccttctgaacctgaaagtg

SEQ ID NO: 480629 - DNA, 20 bp, Artificial
  CRISPR gRNA sequence
ccttctgaacctgaaagtgc

SEQ ID NO: 480630 - DNA, 20 bp, Artificial
  CRISPR gRNA sequence
cttctgaacctgaaagtgct

SEQ ID NO: 480631 - DNA, 20 bp, Artificial
  CRISPR gRNA sequence
ctgaacctgaaagtgctcag

SEQ ID NO: 480632 - DNA, 20 bp, Artificial
  CRISPR gRNA sequence
tgaacctgaaagtgctcagt

SEQ ID NO: 480633 - DNA, 20 bp, Artificial
  CRISPR gRNA sequence
aacctgaaagtgctcagtga

SEQ ID NO: 480634 - DNA, 20 bp, Artificial
  CRISPR gRNA sequence
aaagtgctcagtgaactaag

SEQ ID NO: 480635 - DNA, 20 bp, Artificial
  CRISPR gRNA sequence
agtgaactaagtataaggtg

SEQ ID NO: 480636 - DNA, 20 bp, Artificial
  CRISPR gRNA sequence
agtataaggtgaggagaaaa

SEQ ID NO: 480637 - DNA, 20 bp, Artificial
  CRISPR gRNA sequence
tggaaatatgtttaaggacc

SEQ ID NO: 480638 - DNA, 20 bp, Artificial
  CRISPR gRNA sequence
ggaaatatgtttaaggacca

SEQ ID NO: 480639 - DNA, 20 bp, Artificial
  CRISPR gRNA sequence
gaaatatgtttaaggaccat

SEQ ID NO: 480640 - DNA, 20 bp, Artificial
  CRISPR gRNA sequence
aaggaccatgcttttcataa

SEQ ID NO: 480641 - DNA, 20 bp, Artificial
  CRISPR gRNA sequence
aggaccatgcttttcataaa

SEQ ID NO: 480642 - DNA, 20 bp, Artificial
  CRISPR gRNA sequence
ttcataaagaaattttggag

SEQ ID NO: 480643 - DNA, 20 bp, Artificial
  CRISPR gRNA sequence
tcataaagaaattttggagg

SEQ ID NO: 480644 - DNA, 20 bp, Artificial
  CRISPR gRNA sequence
cataaagaaattttggaggt

SEQ ID NO: 480645 - DNA, 20 bp, Artificial
  CRISPR gRNA sequence
ataaagaaattttggaggtc

SEQ ID NO: 480646 - DNA, 20 bp, Artificial
  CRISPR gRNA sequence
tggaggtctgataaaaaata

SEQ ID NO: 480647 - DNA, 20 bp, Artificial
  CRISPR gRNA sequence
ggaggtctgataaaaaatat

SEQ ID NO: 480648 - DNA, 20 bp, Artificial
  CRISPR gRNA sequence
gaggtctgataaaaaatatt

SEQ ID NO: 480649 - DNA, 20 bp, Artificial
  CRISPR gRNA sequence
ataaaaaatattttattttt

SEQ ID NO: 480650 - DNA, 20 bp, Artificial
  CRISPR gRNA sequence
tattttttcctgtgaaatat

SEQ ID NO: 480651 - DNA, 20 bp, Artificial
  CRISPR gRNA sequence
attttttcctgtgaaatata

SEQ ID NO: 480652 - DNA, 20 bp, Artificial
  CRISPR gRNA sequence
ttttttcctgtgaaatatat

SEQ ID NO: 480653 - DNA, 20 bp, Artificial
  CRISPR gRNA sequence
tttcctgtgaaatatatttc

SEQ ID NO: 480654 - DNA, 20 bp, Artificial
  CRISPR gRNA sequence
ttcctgtgaaatatatttcc

SEQ ID NO: 480655 - DNA, 20 bp, Artificial
  CRISPR gRNA sequence
tcctgtgaaatatatttccg

SEQ ID NO: 480656 - DNA, 20 bp, Artificial
  CRISPR gRNA sequence
cctgtgaaatatatttccga

SEQ ID NO: 480657 - DNA, 20 bp, Artificial
  CRISPR gRNA sequence
ctgtgaaatatatttccgaa

SEQ ID NO: 480658 - DNA, 20 bp, Artificial
  CRISPR gRNA sequence
tgaaatatatttccgaagtg

SEQ ID NO: 480659 - DNA, 20 bp, Artificial
  CRISPR gRNA sequence
ccgaagtgattttggacatt

SEQ ID NO: 480660 - DNA, 20 bp, Artificial
  CRISPR gRNA sequence
cgaagtgattttggacattt

SEQ ID NO: 480661 - DNA, 20 bp, Artificial
  CRISPR gRNA sequence
tggacattttcttgttttta

SEQ ID NO: 480662 - DNA, 20 bp, Artificial
  CRISPR gRNA sequence
ggacattttcttgtttttat

SEQ ID NO: 480663 - DNA, 20 bp, Artificial
  CRISPR gRNA sequence
gacattttcttgtttttata

SEQ ID NO: 480664 - DNA, 20 bp, Artificial
  CRISPR gRNA sequence
tcttgtttttataagtgact

SEQ ID NO: 480665 - DNA, 20 bp, Artificial
  CRISPR gRNA sequence
cttgtttttataagtgactt

SEQ ID NO: 480666 - DNA, 20 bp, Artificial
  CRISPR gRNA sequence
ttgtttttataagtgacttt

SEQ ID NO: 480667 - DNA, 20 bp, Artificial
  CRISPR gRNA sequence
gtttttataagtgactttct

SEQ ID NO: 480668 - DNA, 20 bp, Artificial
  CRISPR gRNA sequence
tttttataagtgactttctt

SEQ ID NO: 480669 - DNA, 20 bp, Artificial
  CRISPR gRNA sequence
ttataagtgactttcttttg

SEQ ID NO: 480670 - DNA, 20 bp, Artificial
  CRISPR gRNA sequence
tataagtgactttcttttgc

SEQ ID NO: 480671 - DNA, 20 bp, Artificial
  CRISPR gRNA sequence
ataagtgactttcttttgct

SEQ ID NO: 480672 - DNA, 20 bp, Artificial
  CRISPR gRNA sequence
taagtgactttcttttgctg

SEQ ID NO: 480673 - DNA, 20 bp, Artificial
  CRISPR gRNA sequence
tcttttgctgtttatgttca

SEQ ID NO: 480674 - DNA, 20 bp, Artificial
  CRISPR gRNA sequence
cttttgctgtttatgttcaa

SEQ ID NO: 480675 - DNA, 20 bp, Artificial
  CRISPR gRNA sequence
ttttgctgtttatgttcaag

SEQ ID NO: 480676 - DNA, 20 bp, Artificial
  CRISPR gRNA sequence
ttgctgtttatgttcaagtt

SEQ ID NO: 480677 - DNA, 20 bp, Artificial
  CRISPR gRNA sequence
tgctgtttatgttcaagtta

SEQ ID NO: 480678 - DNA, 20 bp, Artificial
  CRISPR gRNA sequence
gctgtttatgttcaagttaa

SEQ ID NO: 480679 - DNA, 20 bp, Artificial
  CRISPR gRNA sequence
ctgtttatgttcaagttaaa

SEQ ID NO: 480680 - DNA, 20 bp, Artificial
  CRISPR gRNA sequence
tttatgttcaagttaaaagt

SEQ ID NO: 480681 - DNA, 20 bp, Artificial
  CRISPR gRNA sequence
atgttcaagttaaaagttca

SEQ ID NO: 480682 - DNA, 20 bp, Artificial
  CRISPR gRNA sequence
tgttcaagttaaaagttcat

SEQ ID NO: 480683 - DNA, 20 bp, Artificial
  CRISPR gRNA sequence
aagttaaaagttcatgtaag

SEQ ID NO: 480684 - DNA, 20 bp, Artificial
  CRISPR gRNA sequence
aaagttcatgtaagaacagg

SEQ ID NO: 480685 - DNA, 20 bp, Artificial
  CRISPR gRNA sequence
atgtaagaacaggactgtga

SEQ ID NO: 480686 - DNA, 20 bp, Artificial
  CRISPR gRNA sequence
tgacagagttggggcttgga

SEQ ID NO: 480687 - DNA, 20 bp, Artificial
  CRISPR gRNA sequence
gggcttggatgctcttggga

SEQ ID NO: 480688 - DNA, 20 bp, Artificial
  CRISPR gRNA sequence
ggatgctcttgggaaagcac

SEQ ID NO: 480689 - DNA, 20 bp, Artificial
  CRISPR gRNA sequence
gatgctcttgggaaagcact

SEQ ID NO: 480690 - DNA, 20 bp, Artificial
  CRISPR gRNA sequence
ttgggaaagcactattctcc

SEQ ID NO: 480691 - DNA, 20 bp, Artificial
  CRISPR gRNA sequence
gggaaagcactattctccca

SEQ ID NO: 480692 - DNA, 20 bp, Artificial
  CRISPR gRNA sequence
ggaaagcactattctcccag

SEQ ID NO: 480693 - DNA, 20 bp, Artificial
  CRISPR gRNA sequence
ttctcccagaatgaagaaaa

SEQ ID NO: 480694 - DNA, 20 bp, Artificial
  CRISPR gRNA sequence
tcccagaatgaagaaaagca

SEQ ID NO: 480695 - DNA, 20 bp, Artificial
  CRISPR gRNA sequence
ccagaatgaagaaaagcacc

SEQ ID NO: 480696 - DNA, 20 bp, Artificial
  CRISPR gRNA sequence
gcacaacaagccaaagtcct

SEQ ID NO: 480697 - DNA, 20 bp, Artificial
  CRISPR gRNA sequence
cacaacaagccaaagtccta

SEQ ID NO: 480698 - DNA, 20 bp, Artificial
  CRISPR gRNA sequence
ggggaaaagttgacagagct

SEQ ID NO: 480699 - DNA, 20 bp, Artificial
  CRISPR gRNA sequence
acagagctggggaacagccc

SEQ ID NO: 480700 - DNA, 20 bp, Artificial
  CRISPR gRNA sequence
gggaacagcccttgaaacat

SEQ ID NO: 480701 - DNA, 20 bp, Artificial
  CRISPR gRNA sequence
gaaacatccattggcctgcc

SEQ ID NO: 480702 - DNA, 20 bp, Artificial
  CRISPR gRNA sequence
aaacatccattggcctgcca

SEQ ID NO: 480703 - DNA, 20 bp, Artificial
  CRISPR gRNA sequence
gcctgccacttcacccttcc

SEQ ID NO: 480704 - DNA, 20 bp, Artificial
  CRISPR gRNA sequence
ccacttcacccttcccaaac

SEQ ID NO: 480705 - DNA, 20 bp, Artificial
  CRISPR gRNA sequence
cacccttcccaaacttccct

SEQ ID NO: 480706 - DNA, 20 bp, Artificial
  CRISPR gRNA sequence
acccttcccaaacttccctt

SEQ ID NO: 480707 - DNA, 20 bp, Artificial
  CRISPR gRNA sequence
cccaaacttcccttggtcag

SEQ ID NO: 480708 - DNA, 20 bp, Artificial
  CRISPR gRNA sequence
ccaaacttcccttggtcagt

SEQ ID NO: 480709 - DNA, 20 bp, Artificial
  CRISPR gRNA sequence
cccttggtcagtttcagatt

SEQ ID NO: 480710 - DNA, 20 bp, Artificial
  CRISPR gRNA sequence
ccttggtcagtttcagatta

SEQ ID NO: 480711 - DNA, 20 bp, Artificial
  CRISPR gRNA sequence
ggtcagtttcagattaagaa

SEQ ID NO: 480712 - DNA, 20 bp, Artificial
  CRISPR gRNA sequence
gtcagtttcagattaagaac

SEQ ID NO: 480713 - DNA, 20 bp, Artificial
  CRISPR gRNA sequence
cagattaagaacttccccaa

SEQ ID NO: 480714 - DNA, 20 bp, Artificial
  CRISPR gRNA sequence
agattaagaacttccccaag

SEQ ID NO: 480715 - DNA, 20 bp, Artificial
  CRISPR gRNA sequence
agaacttccccaaggctggg

SEQ ID NO: 480716 - DNA, 20 bp, Artificial
  CRISPR gRNA sequence
ccccaaggctgggcgtggtg

SEQ ID NO: 480717 - DNA, 20 bp, Artificial
  CRISPR gRNA sequence
cccaaggctgggcgtggtgg

SEQ ID NO: 480718 - DNA, 20 bp, Artificial
  CRISPR gRNA sequence
ggcgtggtggctcacatctg

SEQ ID NO: 480719 - DNA, 20 bp, Artificial
  CRISPR gRNA sequence
acatctgtaatcctagcact

SEQ ID NO: 480720 - DNA, 20 bp, Artificial
  CRISPR gRNA sequence
taatcctagcactttgggag

SEQ ID NO: 480721 - DNA, 20 bp, Artificial
  CRISPR gRNA sequence
gcactttgggaggccaagac

SEQ ID NO: 480722 - DNA, 20 bp, Artificial
  CRISPR gRNA sequence
tgggaggccaagacgaacaa

SEQ ID NO: 480723 - DNA, 20 bp, Artificial
  CRISPR gRNA sequence
gggaggccaagacgaacaaa

SEQ ID NO: 480724 - DNA, 20 bp, Artificial
  CRISPR gRNA sequence
ggaggccaagacgaacaaat

SEQ ID NO: 480725 - DNA, 20 bp, Artificial
  CRISPR gRNA sequence
gaggtcaggagtttgagatc

SEQ ID NO: 480726 - DNA, 20 bp, Artificial
  CRISPR gRNA sequence
aggtcaggagtttgagatca

SEQ ID NO: 480727 - DNA, 20 bp, Artificial
  CRISPR gRNA sequence
gagatcagcctggtcaacat

SEQ ID NO: 480728 - DNA, 20 bp, Artificial
  CRISPR gRNA sequence
agatcagcctggtcaacatg

SEQ ID NO: 480729 - DNA, 20 bp, Artificial
  CRISPR gRNA sequence
gtcaacatggtgaaacccta

SEQ ID NO: 480730 - DNA, 20 bp, Artificial
  CRISPR gRNA sequence
tctctactaaaaatacaaaa

SEQ ID NO: 480731 - DNA, 20 bp, Artificial
  CRISPR gRNA sequence
tactaaaaatacaaaaaata

SEQ ID NO: 480732 - DNA, 20 bp, Artificial
  CRISPR gRNA sequence
ctaaaaatacaaaaaataaa

SEQ ID NO: 480733 - DNA, 20 bp, Artificial
  CRISPR gRNA sequence
aaaatacaaaaaataaactg

SEQ ID NO: 480734 - DNA, 20 bp, Artificial
  CRISPR gRNA sequence
ggcacggtgggaggcgcctg

SEQ ID NO: 480735 - DNA, 20 bp, Artificial
  CRISPR gRNA sequence
taatcccaactactcaggag

SEQ ID NO: 480736 - DNA, 20 bp, Artificial
  CRISPR gRNA sequence
ctcaggaggctgaagcagga

SEQ ID NO: 480737 - DNA, 20 bp, Artificial
  CRISPR gRNA sequence
aggaggctgaagcaggagaa

SEQ ID NO: 480738 - DNA, 20 bp, Artificial
  CRISPR gRNA sequence
aagcaggagaatcacttgaa

SEQ ID NO: 480739 - DNA, 20 bp, Artificial
  CRISPR gRNA sequence
gaacccaggaggtggaggct

SEQ ID NO: 480740 - DNA, 20 bp, Artificial
  CRISPR gRNA sequence
aacccaggaggtggaggctg

SEQ ID NO: 480741 - DNA, 20 bp, Artificial
  CRISPR gRNA sequence
cagtgaaccgagattgcacc

SEQ ID NO: 480742 - DNA, 20 bp, Artificial
  CRISPR gRNA sequence
caccactgcactccagcctg

SEQ ID NO: 480743 - DNA, 20 bp, Artificial
  CRISPR gRNA sequence
cactccagcctgggtgatag

SEQ ID NO: 480744 - DNA, 20 bp, Artificial
  CRISPR gRNA sequence
cagcctgggtgatagagcga

SEQ ID NO: 480745 - DNA, 20 bp, Artificial
  CRISPR gRNA sequence
ggtgatagagcgagactcca

SEQ ID NO: 480746 - DNA, 20 bp, Artificial
  CRISPR gRNA sequence
catctcaaaaaaaaaaaaaa

SEQ ID NO: 480747 - DNA, 20 bp, Artificial
  CRISPR gRNA sequence
aaaaaaaaaaaaaaaaaaaa

SEQ ID NO: 480748 - DNA, 20 bp, Artificial
  CRISPR gRNA sequence
ccccaaaatgtgatcattat

SEQ ID NO: 480749 - DNA, 20 bp, Artificial
  CRISPR gRNA sequence
cccaaaatgtgatcattatc

SEQ ID NO: 480750 - DNA, 20 bp, Artificial
  CRISPR gRNA sequence
tctgtggcaggaaagtgggt

SEQ ID NO: 480751 - DNA, 20 bp, Artificial
  CRISPR gRNA sequence
tggcaggaaagtgggtgtgg

SEQ ID NO: 480752 - DNA, 20 bp, Artificial
  CRISPR gRNA sequence
gtgggcttccaccctgattt

SEQ ID NO: 480753 - DNA, 20 bp, Artificial
  CRISPR gRNA sequence
tgggcttccaccctgatttg

SEQ ID NO: 480754 - DNA, 20 bp, Artificial
  CRISPR gRNA sequence
ccaccctgatttggagcacc

SEQ ID NO: 480755 - DNA, 20 bp, Artificial
  CRISPR gRNA sequence
caccctgatttggagcacct

SEQ ID NO: 480756 - DNA, 20 bp, Artificial
  CRISPR gRNA sequence
atttggagcacctgctgaat

SEQ ID NO: 480757 - DNA, 20 bp, Artificial
  CRISPR gRNA sequence
ggagcacctgctgaatgtgc

SEQ ID NO: 480758 - DNA, 20 bp, Artificial
  CRISPR gRNA sequence
gagcacctgctgaatgtgcc

SEQ ID NO: 480759 - DNA, 20 bp, Artificial
  CRISPR gRNA sequence
ctgaatgtgcctcttcttat

SEQ ID NO: 480760 - DNA, 20 bp, Artificial
  CRISPR gRNA sequence
aatgtgcctcttcttattcc

SEQ ID NO: 480761 - DNA, 20 bp, Artificial
  CRISPR gRNA sequence
ttcttattccaggtgccaga

SEQ ID NO: 480762 - DNA, 20 bp, Artificial
  CRISPR gRNA sequence
cttattccaggtgccagaga

SEQ ID NO: 480763 - DNA, 20 bp, Artificial
  CRISPR gRNA sequence
ttattccaggtgccagagat

SEQ ID NO: 480764 - DNA, 20 bp, Artificial
  CRISPR gRNA sequence
attccaggtgccagagatat

SEQ ID NO: 480765 - DNA, 20 bp, Artificial
  CRISPR gRNA sequence
ttccaggtgccagagatatc

SEQ ID NO: 480766 - DNA, 20 bp, Artificial
  CRISPR gRNA sequence
caggtgccagagatatcatt

SEQ ID NO: 480767 - DNA, 20 bp, Artificial
  CRISPR gRNA sequence
tgcagactatactgtgtcct

SEQ ID NO: 480768 - DNA, 20 bp, Artificial
  CRISPR gRNA sequence
tactgtgtccttatgcttaa

SEQ ID NO: 480769 - DNA, 20 bp, Artificial
  CRISPR gRNA sequence
tgtccttatgcttaaggaat

SEQ ID NO: 480770 - DNA, 20 bp, Artificial
  CRISPR gRNA sequence
atgcttaaggaatggggaag

SEQ ID NO: 480771 - DNA, 20 bp, Artificial
  CRISPR gRNA sequence
tgcttaaggaatggggaaga

SEQ ID NO: 480772 - DNA, 20 bp, Artificial
  CRISPR gRNA sequence
aaggaatggggaagaggtga

SEQ ID NO: 480773 - DNA, 20 bp, Artificial
  CRISPR gRNA sequence
aggaatggggaagaggtgat

SEQ ID NO: 480774 - DNA, 20 bp, Artificial
  CRISPR gRNA sequence
cgttgtatttacagtctttc

SEQ ID NO: 480775 - DNA, 20 bp, Artificial
  CRISPR gRNA sequence
tatttacagtctttcagtga

SEQ ID NO: 480776 - DNA, 20 bp, Artificial
  CRISPR gRNA sequence
acagtctttcagtgagcttc

SEQ ID NO: 480777 - DNA, 20 bp, Artificial
  CRISPR gRNA sequence
cagtctttcagtgagcttca

SEQ ID NO: 480778 - DNA, 20 bp, Artificial
  CRISPR gRNA sequence
tcagtgagcttcaaaataag

SEQ ID NO: 480779 - DNA, 20 bp, Artificial
  CRISPR gRNA sequence
cagtgagcttcaaaataagc

SEQ ID NO: 480780 - DNA, 20 bp, Artificial
  CRISPR gRNA sequence
agtgagcttcaaaataagcc

SEQ ID NO: 480781 - DNA, 20 bp, Artificial
  CRISPR gRNA sequence
caaaataagcccagatattt

SEQ ID NO: 480782 - DNA, 20 bp, Artificial
  CRISPR gRNA sequence
aaaataagcccagatattta

SEQ ID NO: 480783 - DNA, 20 bp, Artificial
  CRISPR gRNA sequence
actttgtgtcaatgatcgtg

SEQ ID NO: 480784 - DNA, 20 bp, Artificial
  CRISPR gRNA sequence
ctttgtgtcaatgatcgtgg

SEQ ID NO: 480785 - DNA, 20 bp, Artificial
  CRISPR gRNA sequence
tgtgtcaatgatcgtggggt

SEQ ID NO: 480786 - DNA, 20 bp, Artificial
  CRISPR gRNA sequence
gtgtcaatgatcgtggggtt

SEQ ID NO: 480787 - DNA, 20 bp, Artificial
  CRISPR gRNA sequence
tgtcaatgatcgtggggttg

SEQ ID NO: 480788 - DNA, 20 bp, Artificial
  CRISPR gRNA sequence
atgttccacaaattgtgctt

SEQ ID NO: 480789 - DNA, 20 bp, Artificial
  CRISPR gRNA sequence
cacaaattgtgcttactgat

SEQ ID NO: 480790 - DNA, 20 bp, Artificial
  CRISPR gRNA sequence
tgcttactgatcttgagata

SEQ ID NO: 480791 - DNA, 20 bp, Artificial
  CRISPR gRNA sequence
actgatcttgagatagattg

SEQ ID NO: 480792 - DNA, 20 bp, Artificial
  CRISPR gRNA sequence
ctgatcttgagatagattgt

SEQ ID NO: 480793 - DNA, 20 bp, Artificial
  CRISPR gRNA sequence
atcttgagatagattgttgg

SEQ ID NO: 480794 - DNA, 20 bp, Artificial
  CRISPR gRNA sequence
gagatagattgttggattct

SEQ ID NO: 480795 - DNA, 20 bp, Artificial
  CRISPR gRNA sequence
agatagattgttggattctc

SEQ ID NO: 480796 - DNA, 20 bp, Artificial
  CRISPR gRNA sequence
ttggattctctggtagtgtg

SEQ ID NO: 480797 - DNA, 20 bp, Artificial
  CRISPR gRNA sequence
gattctctggtagtgtgcaa

SEQ ID NO: 480798 - DNA, 20 bp, Artificial
  CRISPR gRNA sequence
tctggtagtgtgcaaacact

SEQ ID NO: 480799 - DNA, 20 bp, Artificial
  CRISPR gRNA sequence
tggtagtgtgcaaacactgg

SEQ ID NO: 480800 - DNA, 20 bp, Artificial
  CRISPR gRNA sequence
gtagtgtgcaaacactggaa

SEQ ID NO: 480801 - DNA, 20 bp, Artificial
  CRISPR gRNA sequence
gaatcctccccaaggctagc

SEQ ID NO: 480802 - DNA, 20 bp, Artificial
  CRISPR gRNA sequence
cccaaggctagctctggttt

SEQ ID NO: 480803 - DNA, 20 bp, Artificial
  CRISPR gRNA sequence
gctctggttttggacacgtg

SEQ ID NO: 480804 - DNA, 20 bp, Artificial
  CRISPR gRNA sequence
tggttttggacacgtgagag

SEQ ID NO: 480805 - DNA, 20 bp, Artificial
  CRISPR gRNA sequence
gttttggacacgtgagagta

SEQ ID NO: 480806 - DNA, 20 bp, Artificial
  CRISPR gRNA sequence
tggacacgtgagagtacacc

SEQ ID NO: 480807 - DNA, 20 bp, Artificial
  CRISPR gRNA sequence
ggacacgtgagagtacaccc

SEQ ID NO: 480808 - DNA, 20 bp, Artificial
  CRISPR gRNA sequence
gacacgtgagagtacaccct

SEQ ID NO: 480809 - DNA, 20 bp, Artificial
  CRISPR gRNA sequence
atcattttctcaatcaattt

SEQ ID NO: 480810 - DNA, 20 bp, Artificial
  CRISPR gRNA sequence
tctcaatcaatttcagttat

SEQ ID NO: 480811 - DNA, 20 bp, Artificial
  CRISPR gRNA sequence
ctcaatcaatttcagttatt

SEQ ID NO: 480812 - DNA, 20 bp, Artificial
  CRISPR gRNA sequence
tcaatcaatttcagttattt

SEQ ID NO: 480813 - DNA, 20 bp, Artificial
  CRISPR gRNA sequence
aatcaatttcagttatttac

SEQ ID NO: 480814 - DNA, 20 bp, Artificial
  CRISPR gRNA sequence
cagttatttaccttgtttct

SEQ ID NO: 480815 - DNA, 20 bp, Artificial
  CRISPR gRNA sequence
agttatttaccttgtttctc

SEQ ID NO: 480816 - DNA, 20 bp, Artificial
  CRISPR gRNA sequence
tttaccttgtttctctattt

SEQ ID NO: 480817 - DNA, 20 bp, Artificial
  CRISPR gRNA sequence
accttgtttctctatttcag

SEQ ID NO: 480818 - DNA, 20 bp, Artificial
  CRISPR gRNA sequence
ccttgtttctctatttcaga

SEQ ID NO: 480819 - DNA, 20 bp, Artificial
  CRISPR gRNA sequence
gtttctctatttcagaacaa

SEQ ID NO: 480820 - DNA, 20 bp, Artificial
  CRISPR gRNA sequence
tttctctatttcagaacaaa

SEQ ID NO: 480821 - DNA, 20 bp, Artificial
  CRISPR gRNA sequence
ctctatttcagaacaaactc

SEQ ID NO: 480822 - DNA, 20 bp, Artificial
  CRISPR gRNA sequence
tctatttcagaacaaactca

SEQ ID NO: 480823 - DNA, 20 bp, Artificial
  CRISPR gRNA sequence
tatttcagaacaaactcaaa

SEQ ID NO: 480824 - DNA, 20 bp, Artificial
  CRISPR gRNA sequence
tttcagaacaaactcaaaat

SEQ ID NO: 480825 - DNA, 20 bp, Artificial
  CRISPR gRNA sequence
cagaacaaactcaaaataag

SEQ ID NO: 480826 - DNA, 20 bp, Artificial
  CRISPR gRNA sequence
agaacaaactcaaaataagt

SEQ ID NO: 480827 - DNA, 20 bp, Artificial
  CRISPR gRNA sequence
aaaataagttagggggagtt

SEQ ID NO: 480828 - DNA, 20 bp, Artificial
  CRISPR gRNA sequence
gggggagttttgagtttgtt

SEQ ID NO: 480829 - DNA, 20 bp, Artificial
  CRISPR gRNA sequence
tgagtttgttctgaaataga

SEQ ID NO: 480830 - DNA, 20 bp, Artificial
  CRISPR gRNA sequence
gagtttgttctgaaatagag

SEQ ID NO: 480831 - DNA, 20 bp, Artificial
  CRISPR gRNA sequence
agtttgttctgaaatagaga

SEQ ID NO: 480832 - DNA, 20 bp, Artificial
  CRISPR gRNA sequence
gttctgaaatagagaaacag

SEQ ID NO: 480833 - DNA, 20 bp, Artificial
  CRISPR gRNA sequence
ttctgaaatagagaaacagt

SEQ ID NO: 480834 - DNA, 20 bp, Artificial
  CRISPR gRNA sequence
tgaaatagagaaacagtttg

SEQ ID NO: 480835 - DNA, 20 bp, Artificial
  CRISPR gRNA sequence
aaatagagaaacagtttgtt

SEQ ID NO: 480836 - DNA, 20 bp, Artificial
  CRISPR gRNA sequence
gttctgaattagttttattt

SEQ ID NO: 480837 - DNA, 20 bp, Artificial
  CRISPR gRNA sequence
ttctgaattagttttatttg

SEQ ID NO: 480838 - DNA, 20 bp, Artificial
  CRISPR gRNA sequence
tgaattagttttatttgatc

SEQ ID NO: 480839 - DNA, 20 bp, Artificial
  CRISPR gRNA sequence
aattagttttatttgatcaa

SEQ ID NO: 480840 - DNA, 20 bp, Artificial
  CRISPR gRNA sequence
gttttatttgatcaaactaa

SEQ ID NO: 480841 - DNA, 20 bp, Artificial
  CRISPR gRNA sequence
tatttgatcaaactaatcaa

SEQ ID NO: 480842 - DNA, 20 bp, Artificial
  CRISPR gRNA sequence
atttgatcaaactaatcaag

SEQ ID NO: 480843 - DNA, 20 bp, Artificial
  CRISPR gRNA sequence
tttgatcaaactaatcaagt

SEQ ID NO: 480844 - DNA, 20 bp, Artificial
  CRISPR gRNA sequence
gatcaaactaatcaagtaaa

SEQ ID NO: 480845 - DNA, 20 bp, Artificial
  CRISPR gRNA sequence
atcaaactaatcaagtaaaa

SEQ ID NO: 480846 - DNA, 20 bp, Artificial
  CRISPR gRNA sequence
atcaagtaaaattaaggaaa

SEQ ID NO: 480847 - DNA, 20 bp, Artificial
  CRISPR gRNA sequence
aggaaattaggtttttttgg

SEQ ID NO: 480848 - DNA, 20 bp, Artificial
  CRISPR gRNA sequence
ggtttttttggtggttaaag

SEQ ID NO: 480849 - DNA, 20 bp, Artificial
  CRISPR gRNA sequence
ttttggtggttaaagaaata

SEQ ID NO: 480850 - DNA, 20 bp, Artificial
  CRISPR gRNA sequence
tttggtggttaaagaaataa

SEQ ID NO: 480851 - DNA, 20 bp, Artificial
  CRISPR gRNA sequence
ttggtggttaaagaaataac

SEQ ID NO: 480852 - DNA, 20 bp, Artificial
  CRISPR gRNA sequence
tggtggttaaagaaataaca

SEQ ID NO: 480853 - DNA, 20 bp, Artificial
  CRISPR gRNA sequence
ggtggttaaagaaataacag

SEQ ID NO: 480854 - DNA, 20 bp, Artificial
  CRISPR gRNA sequence
gtggttaaagaaataacaga

SEQ ID NO: 480855 - DNA, 20 bp, Artificial
  CRISPR gRNA sequence
aagaaataacagaagttgga

SEQ ID NO: 480856 - DNA, 20 bp, Artificial
  CRISPR gRNA sequence
gatcttcttgatccagcaga

SEQ ID NO: 480857 - DNA, 20 bp, Artificial
  CRISPR gRNA sequence
cttgatccagcagatctgtt

SEQ ID NO: 480858 - DNA, 20 bp, Artificial
  CRISPR gRNA sequence
ttgatccagcagatctgttt

SEQ ID NO: 480859 - DNA, 20 bp, Artificial
  CRISPR gRNA sequence
gatccagcagatctgtttgt

SEQ ID NO: 480860 - DNA, 20 bp, Artificial
  CRISPR gRNA sequence
atccagcagatctgtttgta

SEQ ID NO: 480861 - DNA, 20 bp, Artificial
  CRISPR gRNA sequence
tttgtattagggtatctgtt

SEQ ID NO: 480862 - DNA, 20 bp, Artificial
  CRISPR gRNA sequence
gtattagggtatctgttgta

SEQ ID NO: 480863 - DNA, 20 bp, Artificial
  CRISPR gRNA sequence
tattagggtatctgttgtag

SEQ ID NO: 480864 - DNA, 20 bp, Artificial
  CRISPR gRNA sequence
gggtatctgttgtagaaacc

SEQ ID NO: 480865 - DNA, 20 bp, Artificial
  CRISPR gRNA sequence
ttgtagaaaccttagtcccc

SEQ ID NO: 480866 - DNA, 20 bp, Artificial
  CRISPR gRNA sequence
tagaaaccttagtccccatt

SEQ ID NO: 480867 - DNA, 20 bp, Artificial
  CRISPR gRNA sequence
agtccccattgctatccaag

SEQ ID NO: 480868 - DNA, 20 bp, Artificial
  CRISPR gRNA sequence
gtccccattgctatccaaga

SEQ ID NO: 480869 - DNA, 20 bp, Artificial
  CRISPR gRNA sequence
ctatccaagaccctccccca

SEQ ID NO: 480870 - DNA, 20 bp, Artificial
  CRISPR gRNA sequence
tccaagaccctcccccaggc

SEQ ID NO: 480871 - DNA, 20 bp, Artificial
  CRISPR gRNA sequence
ccccaggcagctgtttctgg

SEQ ID NO: 480872 - DNA, 20 bp, Artificial
  CRISPR gRNA sequence
tttctggcactcctggcagt

SEQ ID NO: 480873 - DNA, 20 bp, Artificial
  CRISPR gRNA sequence
ctggcactcctggcagtggt

SEQ ID NO: 480874 - DNA, 20 bp, Artificial
  CRISPR gRNA sequence
tggcactcctggcagtggtt

SEQ ID NO: 480875 - DNA, 20 bp, Artificial
  CRISPR gRNA sequence
gcactcctggcagtggtttg

SEQ ID NO: 480876 - DNA, 20 bp, Artificial
  CRISPR gRNA sequence
ctggcagtggtttggctgct

SEQ ID NO: 480877 - DNA, 20 bp, Artificial
  CRISPR gRNA sequence
gcagtggtttggctgctcgc

SEQ ID NO: 480878 - DNA, 20 bp, Artificial
  CRISPR gRNA sequence
ggctgctcgctaacctaaac

SEQ ID NO: 480879 - DNA, 20 bp, Artificial
  CRISPR gRNA sequence
gctgctcgctaacctaaaca

SEQ ID NO: 480880 - DNA, 20 bp, Artificial
  CRISPR gRNA sequence
ctcgctaacctaaacagcag

SEQ ID NO: 480881 - DNA, 20 bp, Artificial
  CRISPR gRNA sequence
gctaacctaaacagcagctg

SEQ ID NO: 480882 - DNA, 20 bp, Artificial
  CRISPR gRNA sequence
acctaaacagcagctgcaac

SEQ ID NO: 480883 - DNA, 20 bp, Artificial
  CRISPR gRNA sequence
aacagcagctgcaacatcaa

SEQ ID NO: 480884 - DNA, 20 bp, Artificial
  CRISPR gRNA sequence
caacatcaatagacaacatt

SEQ ID NO: 480885 - DNA, 20 bp, Artificial
  CRISPR gRNA sequence
gttaccactctgaataacca

SEQ ID NO: 480886 - DNA, 20 bp, Artificial
  CRISPR gRNA sequence
ttaccactctgaataaccaa

SEQ ID NO: 480887 - DNA, 20 bp, Artificial
  CRISPR gRNA sequence
ccactctgaataaccaaacc

SEQ ID NO: 480888 - DNA, 20 bp, Artificial
  CRISPR gRNA sequence
tgaataaccaaaccactttt

SEQ ID NO: 480889 - DNA, 20 bp, Artificial
  CRISPR gRNA sequence
aataaccaaaccactttttg

SEQ ID NO: 480890 - DNA, 20 bp, Artificial
  CRISPR gRNA sequence
tttgtgcaacttcagttgcc

SEQ ID NO: 480891 - DNA, 20 bp, Artificial
  CRISPR gRNA sequence
ttgtgcaacttcagttgcct

SEQ ID NO: 480892 - DNA, 20 bp, Artificial
  CRISPR gRNA sequence
tgtgcaacttcagttgcctc

SEQ ID NO: 480893 - DNA, 20 bp, Artificial
  CRISPR gRNA sequence
gtgcaacttcagttgcctct

SEQ ID NO: 480894 - DNA, 20 bp, Artificial
  CRISPR gRNA sequence
tgcaacttcagttgcctcta

SEQ ID NO: 480895 - DNA, 20 bp, Artificial
  CRISPR gRNA sequence
cagttgcctctaatcatttt

SEQ ID NO: 480896 - DNA, 20 bp, Artificial
  CRISPR gRNA sequence
agttgcctctaatcattttt

SEQ ID NO: 480897 - DNA, 20 bp, Artificial
  CRISPR gRNA sequence
cctctaatcatttttacccc

SEQ ID NO: 480898 - DNA, 20 bp, Artificial
  CRISPR gRNA sequence
taatcatttttaccccaaac

SEQ ID NO: 480899 - DNA, 20 bp, Artificial
  CRISPR gRNA sequence
atcatttttaccccaaacct

SEQ ID NO: 480900 - DNA, 20 bp, Artificial
  CRISPR gRNA sequence
ttaccccaaacctaagcatc

SEQ ID NO: 480901 - DNA, 20 bp, Artificial
  CRISPR gRNA sequence
taccccaaacctaagcatct

SEQ ID NO: 480902 - DNA, 20 bp, Artificial
  CRISPR gRNA sequence
accccaaacctaagcatcta

SEQ ID NO: 480903 - DNA, 20 bp, Artificial
  CRISPR gRNA sequence
ccccaaacctaagcatctag

SEQ ID NO: 480904 - DNA, 20 bp, Artificial
  CRISPR gRNA sequence
agcatctagccaaacaaaat

SEQ ID NO: 480905 - DNA, 20 bp, Artificial
  CRISPR gRNA sequence
gccaaacaaaataacattat

SEQ ID NO: 480906 - DNA, 20 bp, Artificial
  CRISPR gRNA sequence
taatataattaatagaattt

SEQ ID NO: 480907 - DNA, 20 bp, Artificial
  CRISPR gRNA sequence
atagaattttttttttgttt

SEQ ID NO: 480908 - DNA, 20 bp, Artificial
  CRISPR gRNA sequence
tttttttgtttgagatggag

SEQ ID NO: 480909 - DNA, 20 bp, Artificial
  CRISPR gRNA sequence
ttttttgtttgagatggagt

SEQ ID NO: 480910 - DNA, 20 bp, Artificial
  CRISPR gRNA sequence
tttttgtttgagatggagtc

SEQ ID NO: 480911 - DNA, 20 bp, Artificial
  CRISPR gRNA sequence
ttttgtttgagatggagtct

SEQ ID NO: 480912 - DNA, 20 bp, Artificial
  CRISPR gRNA sequence
tttgtttgagatggagtctt

SEQ ID NO: 480913 - DNA, 20 bp, Artificial
  CRISPR gRNA sequence
ttgtttgagatggagtctta

SEQ ID NO: 480914 - DNA, 20 bp, Artificial
  CRISPR gRNA sequence
tgtttgagatggagtcttac

SEQ ID NO: 480915 - DNA, 20 bp, Artificial
  CRISPR gRNA sequence
gtttgagatggagtcttact

SEQ ID NO: 480916 - DNA, 20 bp, Artificial
  CRISPR gRNA sequence
tttgagatggagtcttactc

SEQ ID NO: 480917 - DNA, 20 bp, Artificial
  CRISPR gRNA sequence
gagatggagtcttactctgt

SEQ ID NO: 480918 - DNA, 20 bp, Artificial
  CRISPR gRNA sequence
agatggagtcttactctgtc

SEQ ID NO: 480919 - DNA, 20 bp, Artificial
  CRISPR gRNA sequence
actctgtcacccaggctgag

SEQ ID NO: 480920 - DNA, 20 bp, Artificial
  CRISPR gRNA sequence
ctctgtcacccaggctgagt

SEQ ID NO: 480921 - DNA, 20 bp, Artificial
  CRISPR gRNA sequence
tgtcacccaggctgagtgca

SEQ ID NO: 480922 - DNA, 20 bp, Artificial
  CRISPR gRNA sequence
tcacccaggctgagtgcagt

SEQ ID NO: 480923 - DNA, 20 bp, Artificial
  CRISPR gRNA sequence
agtgcagtggtaccatctcg

SEQ ID NO: 480924 - DNA, 20 bp, Artificial
  CRISPR gRNA sequence
ggttcaccgaagtctccacc

SEQ ID NO: 480925 - DNA, 20 bp, Artificial
  CRISPR gRNA sequence
accgaagtctccacctaccg

SEQ ID NO: 480926 - DNA, 20 bp, Artificial
  CRISPR gRNA sequence
cacctaccgagttcaagcga

SEQ ID NO: 480927 - DNA, 20 bp, Artificial
  CRISPR gRNA sequence
ccgagttcaagcgattctcc

SEQ ID NO: 480928 - DNA, 20 bp, Artificial
  CRISPR gRNA sequence
aagcgattctcctgtctcag

SEQ ID NO: 480929 - DNA, 20 bp, Artificial
  CRISPR gRNA sequence
tcctgtctcagcctcccatg

SEQ ID NO: 480930 - DNA, 20 bp, Artificial
  CRISPR gRNA sequence
ctgtctcagcctcccatgta

SEQ ID NO: 480931 - DNA, 20 bp, Artificial
  CRISPR gRNA sequence
tctcagcctcccatgtacct

SEQ ID NO: 480932 - DNA, 20 bp, Artificial
  CRISPR gRNA sequence
agcctcccatgtacctggga

SEQ ID NO: 480933 - DNA, 20 bp, Artificial
  CRISPR gRNA sequence
ccatgtacctgggattacag

SEQ ID NO: 480934 - DNA, 20 bp, Artificial
  CRISPR gRNA sequence
ggattacaggtgcataccac

SEQ ID NO: 480935 - DNA, 20 bp, Artificial
  CRISPR gRNA sequence
caggtgcataccacgcccag

SEQ ID NO: 480936 - DNA, 20 bp, Artificial
  CRISPR gRNA sequence
atttttgtatttttagtaga

SEQ ID NO: 480937 - DNA, 20 bp, Artificial
  CRISPR gRNA sequence
ttgtatttttagtagagacg

SEQ ID NO: 480938 - DNA, 20 bp, Artificial
  CRISPR gRNA sequence
tgtatttttagtagagacgg

SEQ ID NO: 480939 - DNA, 20 bp, Artificial
  CRISPR gRNA sequence
gtatttttagtagagacggg

SEQ ID NO: 480940 - DNA, 20 bp, Artificial
  CRISPR gRNA sequence
tatttttagtagagacgggg

SEQ ID NO: 480941 - DNA, 20 bp, Artificial
  CRISPR gRNA sequence
ttagtagagacggggtttca

SEQ ID NO: 480942 - DNA, 20 bp, Artificial
  CRISPR gRNA sequence
tagtagagacggggtttcac

SEQ ID NO: 480943 - DNA, 20 bp, Artificial
  CRISPR gRNA sequence
agtagagacggggtttcacc

SEQ ID NO: 480944 - DNA, 20 bp, Artificial
  CRISPR gRNA sequence
gtagagacggggtttcacca

SEQ ID NO: 480945 - DNA, 20 bp, Artificial
  CRISPR gRNA sequence
caccattttggccatgctgg

SEQ ID NO: 480946 - DNA, 20 bp, Artificial
  CRISPR gRNA sequence
accattttggccatgctggt

SEQ ID NO: 480947 - DNA, 20 bp, Artificial
  CRISPR gRNA sequence
tggccatgctggtctcgaac

SEQ ID NO: 480948 - DNA, 20 bp, Artificial
  CRISPR gRNA sequence
ggccatgctggtctcgaact

SEQ ID NO: 480949 - DNA, 20 bp, Artificial
  CRISPR gRNA sequence
gccatgctggtctcgaactc

SEQ ID NO: 480950 - DNA, 20 bp, Artificial
  CRISPR gRNA sequence
gtctcgaactcctgatctca

SEQ ID NO: 480951 - DNA, 20 bp, Artificial
  CRISPR gRNA sequence
gaactcctgatctcaagtga

SEQ ID NO: 480952 - DNA, 20 bp, Artificial
  CRISPR gRNA sequence
ctgatctcaagtgatccgcc

SEQ ID NO: 480953 - DNA, 20 bp, Artificial
  CRISPR gRNA sequence
atctcaagtgatccgcctac

SEQ ID NO: 480954 - DNA, 20 bp, Artificial
  CRISPR gRNA sequence
aagtgatccgcctacctcgg

SEQ ID NO: 480955 - DNA, 20 bp, Artificial
  CRISPR gRNA sequence
cctcggcctcccaaagtgct

SEQ ID NO: 480956 - DNA, 20 bp, Artificial
  CRISPR gRNA sequence
ggcctcccaaagtgctgaga

SEQ ID NO: 480957 - DNA, 20 bp, Artificial
  CRISPR gRNA sequence
ccaaagtgctgagattacag

SEQ ID NO: 480958 - DNA, 20 bp, Artificial
  CRISPR gRNA sequence
agattacaggtgtgagccac

SEQ ID NO: 480959 - DNA, 20 bp, Artificial
  CRISPR gRNA sequence
caggtgtgagccaccaggcc

SEQ ID NO: 480960 - DNA, 20 bp, Artificial
  CRISPR gRNA sequence
agaatatcttactccagtat

SEQ ID NO: 480961 - DNA, 20 bp, Artificial
  CRISPR gRNA sequence
gaatatcttactccagtatt

SEQ ID NO: 480962 - DNA, 20 bp, Artificial
  CRISPR gRNA sequence
actccagtatttttcatact

SEQ ID NO: 480963 - DNA, 20 bp, Artificial
  CRISPR gRNA sequence
ctccagtatttttcatactg

SEQ ID NO: 480964 - DNA, 20 bp, Artificial
  CRISPR gRNA sequence
cagtatttttcatactgtgt

SEQ ID NO: 480965 - DNA, 20 bp, Artificial
  CRISPR gRNA sequence
ttcatactgtgttaactgta

SEQ ID NO: 480966 - DNA, 20 bp, Artificial
  CRISPR gRNA sequence
tcatactgtgttaactgtaa

SEQ ID NO: 480967 - DNA, 20 bp, Artificial
  CRISPR gRNA sequence
catactgtgttaactgtaac

SEQ ID NO: 480968 - DNA, 20 bp, Artificial
  CRISPR gRNA sequence
atactgtgttaactgtaacc

SEQ ID NO: 480969 - DNA, 20 bp, Artificial
  CRISPR gRNA sequence
tgttaactgtaacccaaaat

SEQ ID NO: 480970 - DNA, 20 bp, Artificial
  CRISPR gRNA sequence
actgtaacccaaaattaaaa

SEQ ID NO: 480971 - DNA, 20 bp, Artificial
  CRISPR gRNA sequence
taacccaaaattaaaaaaaa

SEQ ID NO: 480972 - DNA, 20 bp, Artificial
  CRISPR gRNA sequence
aaaaaaacaacaacaacaac

SEQ ID NO: 480973 - DNA, 20 bp, Artificial
  CRISPR gRNA sequence
acatcacaacccataatgca

SEQ ID NO: 480974 - DNA, 20 bp, Artificial
  CRISPR gRNA sequence
catcacaacccataatgcac

SEQ ID NO: 480975 - DNA, 20 bp, Artificial
  CRISPR gRNA sequence
cataaggtcatacttaacca

SEQ ID NO: 480976 - DNA, 20 bp, Artificial
  CRISPR gRNA sequence
ataaggtcatacttaaccat

SEQ ID NO: 480977 - DNA, 20 bp, Artificial
  CRISPR gRNA sequence
aaccataagacagagtttct

SEQ ID NO: 480978 - DNA, 20 bp, Artificial
  CRISPR gRNA sequence
accataagacagagtttctc

SEQ ID NO: 480979 - DNA, 20 bp, Artificial
  CRISPR gRNA sequence
ctccattgacactttggtct

SEQ ID NO: 480980 - DNA, 20 bp, Artificial
  CRISPR gRNA sequence
tccattgacactttggtctg

SEQ ID NO: 480981 - DNA, 20 bp, Artificial
  CRISPR gRNA sequence
cattgacactttggtctgga

SEQ ID NO: 480982 - DNA, 20 bp, Artificial
  CRISPR gRNA sequence
acactttggtctggataatg

SEQ ID NO: 480983 - DNA, 20 bp, Artificial
  CRISPR gRNA sequence
tggtctggataatgttttgt

SEQ ID NO: 480984 - DNA, 20 bp, Artificial
  CRISPR gRNA sequence
ggtctggataatgttttgtt

SEQ ID NO: 480985 - DNA, 20 bp, Artificial
  CRISPR gRNA sequence
gtctggataatgttttgttg

SEQ ID NO: 480986 - DNA, 20 bp, Artificial
  CRISPR gRNA sequence
gataatgttttgttgcacta

SEQ ID NO: 480987 - DNA, 20 bp, Artificial
  CRISPR gRNA sequence
tgttgcactaagtgggggtt

SEQ ID NO: 480988 - DNA, 20 bp, Artificial
  CRISPR gRNA sequence
gttgcactaagtgggggttg

SEQ ID NO: 480989 - DNA, 20 bp, Artificial
  CRISPR gRNA sequence
ttgcactaagtgggggttgc

SEQ ID NO: 480990 - DNA, 20 bp, Artificial
  CRISPR gRNA sequence
cactaagtgggggttgcatc

SEQ ID NO: 480991 - DNA, 20 bp, Artificial
  CRISPR gRNA sequence
agtgggggttgcatcctgta

SEQ ID NO: 480992 - DNA, 20 bp, Artificial
  CRISPR gRNA sequence
catcctgtatagtgtagggt

SEQ ID NO: 480993 - DNA, 20 bp, Artificial
  CRISPR gRNA sequence
tatagtgtagggtgtttagc

SEQ ID NO: 480994 - DNA, 20 bp, Artificial
  CRISPR gRNA sequence
agcagaatccccggcttcta

SEQ ID NO: 480995 - DNA, 20 bp, Artificial
  CRISPR gRNA sequence
gcagaatccccggcttctac

SEQ ID NO: 480996 - DNA, 20 bp, Artificial
  CRISPR gRNA sequence
ctactcactggttgccagcc

SEQ ID NO: 480997 - DNA, 20 bp, Artificial
  CRISPR gRNA sequence
tactcactggttgccagcct

SEQ ID NO: 480998 - DNA, 20 bp, Artificial
  CRISPR gRNA sequence
ctcactggttgccagcctcc

SEQ ID NO: 480999 - DNA, 20 bp, Artificial
  CRISPR gRNA sequence
actggttgccagcctccctc

SEQ ID NO: 481000 - DNA, 20 bp, Artificial
  CRISPR gRNA sequence
gttgccagcctccctccccc

SEQ ID NO: 481001 - DNA, 20 bp, Artificial
  CRISPR gRNA sequence
ccagcctccctccccctacc

SEQ ID NO: 481002 - DNA, 20 bp, Artificial
  CRISPR gRNA sequence
cctccccctaccttgttaca

SEQ ID NO: 481003 - DNA, 20 bp, Artificial
  CRISPR gRNA sequence
cccctaccttgttacagcca

SEQ ID NO: 481004 - DNA, 20 bp, Artificial
  CRISPR gRNA sequence
ccttgttacagccaaaaatg

SEQ ID NO: 481005 - DNA, 20 bp, Artificial
  CRISPR gRNA sequence
gttacagccaaaaatgtctc

SEQ ID NO: 481006 - DNA, 20 bp, Artificial
  CRISPR gRNA sequence
ttacagccaaaaatgtctcc

SEQ ID NO: 481007 - DNA, 20 bp, Artificial
  CRISPR gRNA sequence
cagccaaaaatgtctccaga

SEQ ID NO: 481008 - DNA, 20 bp, Artificial
  CRISPR gRNA sequence
cagacattgccacacatgtt

SEQ ID NO: 481009 - DNA, 20 bp, Artificial
  CRISPR gRNA sequence
ccacacatgttccctgcttg

SEQ ID NO: 481010 - DNA, 20 bp, Artificial
  CRISPR gRNA sequence
cctgcttgagaaccactgct

SEQ ID NO: 481011 - DNA, 20 bp, Artificial
  CRISPR gRNA sequence
cttgagaaccactgctctag

SEQ ID NO: 481012 - DNA, 20 bp, Artificial
  CRISPR gRNA sequence
gagaaccactgctctagtgt

SEQ ID NO: 481013 - DNA, 20 bp, Artificial
  CRISPR gRNA sequence
agaaccactgctctagtgtg

SEQ ID NO: 481014 - DNA, 20 bp, Artificial
  CRISPR gRNA sequence
ctctagtgtgtgtgatgcat

SEQ ID NO: 481015 - DNA, 20 bp, Artificial
  CRISPR gRNA sequence
tagtgtgtgtgatgcattct

SEQ ID NO: 481016 - DNA, 20 bp, Artificial
  CRISPR gRNA sequence
gtgtgtgtgatgcattctga

SEQ ID NO: 481017 - DNA, 20 bp, Artificial
  CRISPR gRNA sequence
tgatgatttctatcctcttc

SEQ ID NO: 481018 - DNA, 20 bp, Artificial
  CRISPR gRNA sequence
atgatttctatcctcttctg

SEQ ID NO: 481019 - DNA, 20 bp, Artificial
  CRISPR gRNA sequence
ctatcctcttctgtttcatt

SEQ ID NO: 481020 - DNA, 20 bp, Artificial
  CRISPR gRNA sequence
tatcctcttctgtttcattt

SEQ ID NO: 481021 - DNA, 20 bp, Artificial
  CRISPR gRNA sequence
tcctcttctgtttcattttt

SEQ ID NO: 481022 - DNA, 20 bp, Artificial
  CRISPR gRNA sequence
ttctgtttcattttttaaaa

SEQ ID NO: 481023 - DNA, 20 bp, Artificial
  CRISPR gRNA sequence
ctgtttcattttttaaaatg

SEQ ID NO: 481024 - DNA, 20 bp, Artificial
  CRISPR gRNA sequence
tgtttcattttttaaaatgc

SEQ ID NO: 481025 - DNA, 20 bp, Artificial
  CRISPR gRNA sequence
tttcattttttaaaatgcta

SEQ ID NO: 481026 - DNA, 20 bp, Artificial
  CRISPR gRNA sequence
cattttttaaaatgctattt

SEQ ID NO: 481027 - DNA, 20 bp, Artificial
  CRISPR gRNA sequence
attttttaaaatgctatttg

SEQ ID NO: 481028 - DNA, 20 bp, Artificial
  CRISPR gRNA sequence
tttaaaatgctatttgtgac

SEQ ID NO: 481029 - DNA, 20 bp, Artificial
  CRISPR gRNA sequence
ttaaaatgctatttgtgaca

SEQ ID NO: 481030 - DNA, 20 bp, Artificial
  CRISPR gRNA sequence
taaaatgctatttgtgacat

SEQ ID NO: 481031 - DNA, 20 bp, Artificial
  CRISPR gRNA sequence
aaaatgctatttgtgacata

SEQ ID NO: 481032 - DNA, 20 bp, Artificial
  CRISPR gRNA sequence
aaatgctatttgtgacatac

SEQ ID NO: 481033 - DNA, 20 bp, Artificial
  CRISPR gRNA sequence
tttgtgacatactaaattgt

SEQ ID NO: 481034 - DNA, 20 bp, Artificial
  CRISPR gRNA sequence
gtgacatactaaattgtttc

SEQ ID NO: 481035 - DNA, 20 bp, Artificial
  CRISPR gRNA sequence
tgacatactaaattgtttca

SEQ ID NO: 481036 - DNA, 20 bp, Artificial
  CRISPR gRNA sequence
aattgtttcacaacctgcta

SEQ ID NO: 481037 - DNA, 20 bp, Artificial
  CRISPR gRNA sequence
tttcacaacctgctaatgag

SEQ ID NO: 481038 - DNA, 20 bp, Artificial
  CRISPR gRNA sequence
cacaacctgctaatgagctg

SEQ ID NO: 481039 - DNA, 20 bp, Artificial
  CRISPR gRNA sequence
acaacctgctaatgagctgt

SEQ ID NO: 481040 - DNA, 20 bp, Artificial
  CRISPR gRNA sequence
ctaatgagctgtgaacaact

SEQ ID NO: 481041 - DNA, 20 bp, Artificial
  CRISPR gRNA sequence
atgagctgtgaacaactgca

SEQ ID NO: 481042 - DNA, 20 bp, Artificial
  CRISPR gRNA sequence
tgaacaactgcagacaaaca

SEQ ID NO: 481043 - DNA, 20 bp, Artificial
  CRISPR gRNA sequence
cagacaaacagggcctcaat

SEQ ID NO: 481044 - DNA, 20 bp, Artificial
  CRISPR gRNA sequence
aatgcgtattaacattgatc

SEQ ID NO: 481045 - DNA, 20 bp, Artificial
  CRISPR gRNA sequence
acattgatcaatagtaatgc

SEQ ID NO: 481046 - DNA, 20 bp, Artificial
  CRISPR gRNA sequence
atcaatagtaatgcgcatta

SEQ ID NO: 481047 - DNA, 20 bp, Artificial
  CRISPR gRNA sequence
gctgtgtgccatgcagagca

SEQ ID NO: 481048 - DNA, 20 bp, Artificial
  CRISPR gRNA sequence
tgtgccatgcagagcacttt

SEQ ID NO: 481049 - DNA, 20 bp, Artificial
  CRISPR gRNA sequence
ttaaggctatcaaaagtatt

SEQ ID NO: 481050 - DNA, 20 bp, Artificial
  CRISPR gRNA sequence
taaggctatcaaaagtattt

SEQ ID NO: 481051 - DNA, 20 bp, Artificial
  CRISPR gRNA sequence
aaggctatcaaaagtatttg

SEQ ID NO: 481052 - DNA, 20 bp, Artificial
  CRISPR gRNA sequence
aggctatcaaaagtatttga

SEQ ID NO: 481053 - DNA, 20 bp, Artificial
  CRISPR gRNA sequence
tcaaaagtatttgatatttg

SEQ ID NO: 481054 - DNA, 20 bp, Artificial
  CRISPR gRNA sequence
gatatttggagattctgata

SEQ ID NO: 481055 - DNA, 20 bp, Artificial
  CRISPR gRNA sequence
atatttggagattctgataa

SEQ ID NO: 481056 - DNA, 20 bp, Artificial
  CRISPR gRNA sequence
ggagattctgataagttacg

SEQ ID NO: 481057 - DNA, 20 bp, Artificial
  CRISPR gRNA sequence
gagattctgataagttacga

SEQ ID NO: 481058 - DNA, 20 bp, Artificial
  CRISPR gRNA sequence
tgataagttacgagacaagg

SEQ ID NO: 481059 - DNA, 20 bp, Artificial
  CRISPR gRNA sequence
ataagttacgagacaaggaa

SEQ ID NO: 481060 - DNA, 20 bp, Artificial
  CRISPR gRNA sequence
cgagacaaggaaaggacatt

SEQ ID NO: 481061 - DNA, 20 bp, Artificial
  CRISPR gRNA sequence
tgttgaagaaacttgaattt

SEQ ID NO: 481062 - DNA, 20 bp, Artificial
  CRISPR gRNA sequence
aagaaacttgaatttcctgt

SEQ ID NO: 481063 - DNA, 20 bp, Artificial
  CRISPR gRNA sequence
gaatttcctgttacaaacat

SEQ ID NO: 481064 - DNA, 20 bp, Artificial
  CRISPR gRNA sequence
aatttcctgttacaaacatg

SEQ ID NO: 481065 - DNA, 20 bp, Artificial
  CRISPR gRNA sequence
cctgttacaaacatgttggc

SEQ ID NO: 481066 - DNA, 20 bp, Artificial
  CRISPR gRNA sequence
ctgttacaaacatgttggct

SEQ ID NO: 481067 - DNA, 20 bp, Artificial
  CRISPR gRNA sequence
ttacaaacatgttggcttga

SEQ ID NO: 481068 - DNA, 20 bp, Artificial
  CRISPR gRNA sequence
caaacatgttggcttgagtt

SEQ ID NO: 481069 - DNA, 20 bp, Artificial
  CRISPR gRNA sequence
gcttgagttcccattgccac

SEQ ID NO: 481070 - DNA, 20 bp, Artificial
  CRISPR gRNA sequence
gagttcccattgccactcac

SEQ ID NO: 481071 - DNA, 20 bp, Artificial
  CRISPR gRNA sequence
agttcccattgccactcact

SEQ ID NO: 481072 - DNA, 20 bp, Artificial
  CRISPR gRNA sequence
ccattgccactcactagcta

SEQ ID NO: 481073 - DNA, 20 bp, Artificial
  CRISPR gRNA sequence
ccactcactagctatctgac

SEQ ID NO: 481074 - DNA, 20 bp, Artificial
  CRISPR gRNA sequence
actagctatctgacttggag

SEQ ID NO: 481075 - DNA, 20 bp, Artificial
  CRISPR gRNA sequence
gctatctgacttggagcaac

SEQ ID NO: 481076 - DNA, 20 bp, Artificial
  CRISPR gRNA sequence
tctgacttggagcaactctt

SEQ ID NO: 481077 - DNA, 20 bp, Artificial
  CRISPR gRNA sequence
acttggagcaactcttggga

SEQ ID NO: 481078 - DNA, 20 bp, Artificial
  CRISPR gRNA sequence
ggagcaactcttgggacaaa

SEQ ID NO: 481079 - DNA, 20 bp, Artificial
  CRISPR gRNA sequence
gagcaactcttgggacaaaa

SEQ ID NO: 481080 - DNA, 20 bp, Artificial
  CRISPR gRNA sequence
ttgggacaaaataaagacaa

SEQ ID NO: 481081 - DNA, 20 bp, Artificial
  CRISPR gRNA sequence
gggacaaaataaagacaatg

SEQ ID NO: 481082 - DNA, 20 bp, Artificial
  CRISPR gRNA sequence
ggacaaaataaagacaatgg

SEQ ID NO: 481083 - DNA, 20 bp, Artificial
  CRISPR gRNA sequence
tcctacttaagtgatgaata

SEQ ID NO: 481084 - DNA, 20 bp, Artificial
  CRISPR gRNA sequence
cctacttaagtgatgaatat

SEQ ID NO: 481085 - DNA, 20 bp, Artificial
  CRISPR gRNA sequence
ctacttaagtgatgaatatg

SEQ ID NO: 481086 - DNA, 20 bp, Artificial
  CRISPR gRNA sequence
cttaagtgatgaatatgaga

SEQ ID NO: 481087 - DNA, 20 bp, Artificial
  CRISPR gRNA sequence
aagtgatgaatatgagagtt

SEQ ID NO: 481088 - DNA, 20 bp, Artificial
  CRISPR gRNA sequence
agtgatgaatatgagagtta

SEQ ID NO: 481089 - DNA, 20 bp, Artificial
  CRISPR gRNA sequence
gatactgtaaatagaaaggc

SEQ ID NO: 481090 - DNA, 20 bp, Artificial
  CRISPR gRNA sequence
taaatagaaaggcttaatga

SEQ ID NO: 481091 - DNA, 20 bp, Artificial
  CRISPR gRNA sequence
aatgaagtaccttctgacag

SEQ ID NO: 481092 - DNA, 20 bp, Artificial
  CRISPR gRNA sequence
atgaagtaccttctgacagt

SEQ ID NO: 481093 - DNA, 20 bp, Artificial
  CRISPR gRNA sequence
ctgacagttatcatgaagat

SEQ ID NO: 481094 - DNA, 20 bp, Artificial
  CRISPR gRNA sequence
tgacagttatcatgaagatt

SEQ ID NO: 481095 - DNA, 20 bp, Artificial
  CRISPR gRNA sequence
acagttatcatgaagattgt

SEQ ID NO: 481096 - DNA, 20 bp, Artificial
  CRISPR gRNA sequence
tcatgaagattgttctgtgg

SEQ ID NO: 481097 - DNA, 20 bp, Artificial
  CRISPR gRNA sequence
ttctgtggaagattaactct

SEQ ID NO: 481098 - DNA, 20 bp, Artificial
  CRISPR gRNA sequence
tgtggaagattaactctatc

SEQ ID NO: 481099 - DNA, 20 bp, Artificial
  CRISPR gRNA sequence
tggaagattaactctatcag

SEQ ID NO: 481100 - DNA, 20 bp, Artificial
  CRISPR gRNA sequence
actctatcagaataaagaat

SEQ ID NO: 481101 - DNA, 20 bp, Artificial
  CRISPR gRNA sequence
tatcagaataaagaatttct

SEQ ID NO: 481102 - DNA, 20 bp, Artificial
  CRISPR gRNA sequence
tcagaataaagaatttctgc

SEQ ID NO: 481103 - DNA, 20 bp, Artificial
  CRISPR gRNA sequence
ctgcaaaagataaattatcg

SEQ ID NO: 481104 - DNA, 20 bp, Artificial
  CRISPR gRNA sequence
tgcaaaagataaattatcgc

SEQ ID NO: 481105 - DNA, 20 bp, Artificial
  CRISPR gRNA sequence
caaaagataaattatcgcag

SEQ ID NO: 481106 - DNA, 20 bp, Artificial
  CRISPR gRNA sequence
tcgcagagccacgtctgctc

SEQ ID NO: 481107 - DNA, 20 bp, Artificial
  CRISPR gRNA sequence
ctcagcaagaaagcaagagg

SEQ ID NO: 481108 - DNA, 20 bp, Artificial
  CRISPR gRNA sequence
agcaagaaagcaagaggtgg

SEQ ID NO: 481109 - DNA, 20 bp, Artificial
  CRISPR gRNA sequence
agggcactgggattcttgag

SEQ ID NO: 481110 - DNA, 20 bp, Artificial
  CRISPR gRNA sequence
ggattcttgaggaatgcctc

SEQ ID NO: 481111 - DNA, 20 bp, Artificial
  CRISPR gRNA sequence
ttgaggaatgcctctgaagg

SEQ ID NO: 481112 - DNA, 20 bp, Artificial
  CRISPR gRNA sequence
gaggaatgcctctgaagggg

SEQ ID NO: 481113 - DNA, 20 bp, Artificial
  CRISPR gRNA sequence
aggaatgcctctgaagggga

SEQ ID NO: 481114 - DNA, 20 bp, Artificial
  CRISPR gRNA sequence
tgaaggggaaatggaggcat

SEQ ID NO: 481115 - DNA, 20 bp, Artificial
  CRISPR gRNA sequence
aaggggaaatggaggcattg

SEQ ID NO: 481116 - DNA, 20 bp, Artificial
  CRISPR gRNA sequence
gcctgaaatctccttcactc

SEQ ID NO: 481117 - DNA, 20 bp, Artificial
  CRISPR gRNA sequence
aaatctccttcactcaagtt

SEQ ID NO: 481118 - DNA, 20 bp, Artificial
  CRISPR gRNA sequence
cttcactcaagttctgacaa

SEQ ID NO: 481119 - DNA, 20 bp, Artificial
  CRISPR gRNA sequence
cactcaagttctgacaatgc

SEQ ID NO: 481120 - DNA, 20 bp, Artificial
  CRISPR gRNA sequence
actcaagttctgacaatgca

SEQ ID NO: 481121 - DNA, 20 bp, Artificial
  CRISPR gRNA sequence
aagttctgacaatgcagagg

SEQ ID NO: 481122 - DNA, 20 bp, Artificial
  CRISPR gRNA sequence
tgacaatgcagaggggtgcc

SEQ ID NO: 481123 - DNA, 20 bp, Artificial
  CRISPR gRNA sequence
acaatgcagaggggtgccgc

SEQ ID NO: 481124 - DNA, 20 bp, Artificial
  CRISPR gRNA sequence
atcccaatatatctcagatt

SEQ ID NO: 481125 - DNA, 20 bp, Artificial
  CRISPR gRNA sequence
agatttcctaactctcttta

SEQ ID NO: 481126 - DNA, 20 bp, Artificial
  CRISPR gRNA sequence
cctaactctctttagcattt

SEQ ID NO: 481127 - DNA, 20 bp, Artificial
  CRISPR gRNA sequence
ctaactctctttagcattta

SEQ ID NO: 481128 - DNA, 20 bp, Artificial
  CRISPR gRNA sequence
actctctttagcatttacta

SEQ ID NO: 481129 - DNA, 20 bp, Artificial
  CRISPR gRNA sequence
tctttagcatttactaacat

SEQ ID NO: 481130 - DNA, 20 bp, Artificial
  CRISPR gRNA sequence
tttagcatttactaacattc

SEQ ID NO: 481131 - DNA, 20 bp, Artificial
  CRISPR gRNA sequence
tagcatttactaacattcca

SEQ ID NO: 481132 - DNA, 20 bp, Artificial
  CRISPR gRNA sequence
agcatttactaacattccag

SEQ ID NO: 481133 - DNA, 20 bp, Artificial
  CRISPR gRNA sequence
gcatttactaacattccaga

SEQ ID NO: 481134 - DNA, 20 bp, Artificial
  CRISPR gRNA sequence
actaacattccagatgtaaa

SEQ ID NO: 481135 - DNA, 20 bp, Artificial
  CRISPR gRNA sequence
ctaacattccagatgtaaaa

SEQ ID NO: 481136 - DNA, 20 bp, Artificial
  CRISPR gRNA sequence
acattccagatgtaaaaagt

SEQ ID NO: 481137 - DNA, 20 bp, Artificial
  CRISPR gRNA sequence
cagatgtaaaaagtgcctca

SEQ ID NO: 481138 - DNA, 20 bp, Artificial
  CRISPR gRNA sequence
agaacgaccctccaaggacg

SEQ ID NO: 481139 - DNA, 20 bp, Artificial
  CRISPR gRNA sequence
caaggacgaaatggcaagca

SEQ ID NO: 481140 - DNA, 20 bp, Artificial
  CRISPR gRNA sequence
gctcctgtatcgtttacttc

SEQ ID NO: 481141 - DNA, 20 bp, Artificial
  CRISPR gRNA sequence
ctgtatcgtttacttccttt

SEQ ID NO: 481142 - DNA, 20 bp, Artificial
  CRISPR gRNA sequence
tatcgtttacttcctttggg

SEQ ID NO: 481143 - DNA, 20 bp, Artificial
  CRISPR gRNA sequence
acttcctttggggggattgc

SEQ ID NO: 481144 - DNA, 20 bp, Artificial
  CRISPR gRNA sequence
cttcctttggggggattgcc

SEQ ID NO: 481145 - DNA, 20 bp, Artificial
  CRISPR gRNA sequence
cctttggggggattgcctct

SEQ ID NO: 481146 - DNA, 20 bp, Artificial
  CRISPR gRNA sequence
ctttggggggattgcctcta

SEQ ID NO: 481147 - DNA, 20 bp, Artificial
  CRISPR gRNA sequence
tggggggattgcctctactc

SEQ ID NO: 481148 - DNA, 20 bp, Artificial
  CRISPR gRNA sequence
ggggggattgcctctactca

SEQ ID NO: 481149 - DNA, 20 bp, Artificial
  CRISPR gRNA sequence
gggggattgcctctactcat

SEQ ID NO: 481150 - DNA, 20 bp, Artificial
  CRISPR gRNA sequence
cctctactcatcactacctg

SEQ ID NO: 481151 - DNA, 20 bp, Artificial
  CRISPR gRNA sequence
tactcatcactacctgtttc

SEQ ID NO: 481152 - DNA, 20 bp, Artificial
  CRISPR gRNA sequence
ctcatcactacctgtttctg

SEQ ID NO: 481153 - DNA, 20 bp, Artificial
  CRISPR gRNA sequence
atcactacctgtttctgcct

SEQ ID NO: 481154 - DNA, 20 bp, Artificial
  CRISPR gRNA sequence
cctgtttctgcctgttctgc

SEQ ID NO: 481155 - DNA, 20 bp, Artificial
  CRISPR gRNA sequence
tttctgcctgttctgctgcc

SEQ ID NO: 481156 - DNA, 20 bp, Artificial
  CRISPR gRNA sequence
ctgcctgttctgctgcctga

SEQ ID NO: 481157 - DNA, 20 bp, Artificial
  CRISPR gRNA sequence
tgcctgttctgctgcctgag

SEQ ID NO: 481158 - DNA, 20 bp, Artificial
  CRISPR gRNA sequence
cctgttctgctgcctgagaa

SEQ ID NO: 481159 - DNA, 20 bp, Artificial
  CRISPR gRNA sequence
ttctgctgcctgagaaggca

SEQ ID NO: 481160 - DNA, 20 bp, Artificial
  CRISPR gRNA sequence
tgctgcctgagaaggcacca

SEQ ID NO: 481161 - DNA, 20 bp, Artificial
  CRISPR gRNA sequence
ctgcctgagaaggcaccaag

SEQ ID NO: 481162 - DNA, 20 bp, Artificial
  CRISPR gRNA sequence
cctgagaaggcaccaaggtg

SEQ ID NO: 481163 - DNA, 20 bp, Artificial
  CRISPR gRNA sequence
agaaggcaccaaggtgggtt

SEQ ID NO: 481164 - DNA, 20 bp, Artificial
  CRISPR gRNA sequence
tattttccctctgcccccag

SEQ ID NO: 481165 - DNA, 20 bp, Artificial
  CRISPR gRNA sequence
ttttccctctgcccccagta

SEQ ID NO: 481166 - DNA, 20 bp, Artificial
  CRISPR gRNA sequence
tccctctgcccccagtacca

SEQ ID NO: 481167 - DNA, 20 bp, Artificial
  CRISPR gRNA sequence
ccctctgcccccagtaccac

SEQ ID NO: 481168 - DNA, 20 bp, Artificial
  CRISPR gRNA sequence
cctctgcccccagtaccaca

SEQ ID NO: 481169 - DNA, 20 bp, Artificial
  CRISPR gRNA sequence
tgcccccagtaccacacatt

SEQ ID NO: 481170 - DNA, 20 bp, Artificial
  CRISPR gRNA sequence
cccccagtaccacacatttg

SEQ ID NO: 481171 - DNA, 20 bp, Artificial
  CRISPR gRNA sequence
ggggccattcttatttctgg

SEQ ID NO: 481172 - DNA, 20 bp, Artificial
  CRISPR gRNA sequence
gggccattcttatttctggg

SEQ ID NO: 481173 - DNA, 20 bp, Artificial
  CRISPR gRNA sequence
ttatttctggggctaaagga

SEQ ID NO: 481174 - DNA, 20 bp, Artificial
  CRISPR gRNA sequence
atttctggggctaaaggatt

SEQ ID NO: 481175 - DNA, 20 bp, Artificial
  CRISPR gRNA sequence
tttctggggctaaaggattt

SEQ ID NO: 481176 - DNA, 20 bp, Artificial
  CRISPR gRNA sequence
ctggggctaaaggattttta

SEQ ID NO: 481177 - DNA, 20 bp, Artificial
  CRISPR gRNA sequence
tggggctaaaggatttttag

SEQ ID NO: 481178 - DNA, 20 bp, Artificial
  CRISPR gRNA sequence
gggctaaaggatttttagtt

SEQ ID NO: 481179 - DNA, 20 bp, Artificial
  CRISPR gRNA sequence
aaggatttttagtttcttcc

SEQ ID NO: 481180 - DNA, 20 bp, Artificial
  CRISPR gRNA sequence
ttagtttcttcctgttgttt

SEQ ID NO: 481181 - DNA, 20 bp, Artificial
  CRISPR gRNA sequence
tagtttcttcctgttgtttt

SEQ ID NO: 481182 - DNA, 20 bp, Artificial
  CRISPR gRNA sequence
agtttcttcctgttgttttc

SEQ ID NO: 481183 - DNA, 20 bp, Artificial
  CRISPR gRNA sequence
gtttcttcctgttgttttct

SEQ ID NO: 481184 - DNA, 20 bp, Artificial
  CRISPR gRNA sequence
cttcctgttgttttctttcc

SEQ ID NO: 481185 - DNA, 20 bp, Artificial
  CRISPR gRNA sequence
ttcctgttgttttctttccc

SEQ ID NO: 481186 - DNA, 20 bp, Artificial
  CRISPR gRNA sequence
cctgttgttttctttcccaa

SEQ ID NO: 481187 - DNA, 20 bp, Artificial
  CRISPR gRNA sequence
ctgttgttttctttcccaat

SEQ ID NO: 481188 - DNA, 20 bp, Artificial
  CRISPR gRNA sequence
ttgttttctttcccaatcct

SEQ ID NO: 481189 - DNA, 20 bp, Artificial
  CRISPR gRNA sequence
ttttctttcccaatcctgta

SEQ ID NO: 481190 - DNA, 20 bp, Artificial
  CRISPR gRNA sequence
tctttcccaatcctgtaaac

SEQ ID NO: 481191 - DNA, 20 bp, Artificial
  CRISPR gRNA sequence
ctttcccaatcctgtaaacc

SEQ ID NO: 481192 - DNA, 20 bp, Artificial
  CRISPR gRNA sequence
tttcccaatcctgtaaacca

SEQ ID NO: 481193 - DNA, 20 bp, Artificial
  CRISPR gRNA sequence
tcccaatcctgtaaaccatg

SEQ ID NO: 481194 - DNA, 20 bp, Artificial
  CRISPR gRNA sequence
cccaatcctgtaaaccatgg

SEQ ID NO: 481195 - DNA, 20 bp, Artificial
  CRISPR gRNA sequence
ccaatcctgtaaaccatgga

SEQ ID NO: 481196 - DNA, 20 bp, Artificial
  CRISPR gRNA sequence
taaaccatggataatgattt

SEQ ID NO: 481197 - DNA, 20 bp, Artificial
  CRISPR gRNA sequence
cctagaagacaactcatatt

SEQ ID NO: 481198 - DNA, 20 bp, Artificial
  CRISPR gRNA sequence
ctagaagacaactcatattt

SEQ ID NO: 481199 - DNA, 20 bp, Artificial
  CRISPR gRNA sequence
gaagacaactcatatttgcg

SEQ ID NO: 481200 - DNA, 20 bp, Artificial
  CRISPR gRNA sequence
atatttgcgctaaaaagcta

SEQ ID NO: 481201 - DNA, 20 bp, Artificial
  CRISPR gRNA sequence
gcgctaaaaagctaaatagg

SEQ ID NO: 481202 - DNA, 20 bp, Artificial
  CRISPR gRNA sequence
cgctaaaaagctaaataggt

SEQ ID NO: 481203 - DNA, 20 bp, Artificial
  CRISPR gRNA sequence
aaaagctaaataggttggtt

SEQ ID NO: 481204 - DNA, 20 bp, Artificial
  CRISPR gRNA sequence
aataggttggttggggctcc

SEQ ID NO: 481205 - DNA, 20 bp, Artificial
  CRISPR gRNA sequence
gttggggctcccttgagtca

SEQ ID NO: 481206 - DNA, 20 bp, Artificial
  CRISPR gRNA sequence
gggctcccttgagtcacggg

SEQ ID NO: 481207 - DNA, 20 bp, Artificial
  CRISPR gRNA sequence
ccttgagtcacgggagaggc

SEQ ID NO: 481208 - DNA, 20 bp, Artificial
  CRISPR gRNA sequence
gagtcacgggagaggcatgc

SEQ ID NO: 481209 - DNA, 20 bp, Artificial
  CRISPR gRNA sequence
agtcacgggagaggcatgct

SEQ ID NO: 481210 - DNA, 20 bp, Artificial
  CRISPR gRNA sequence
accacgcacagtattccagc

SEQ ID NO: 481211 - DNA, 20 bp, Artificial
  CRISPR gRNA sequence
cagctagagttgtggcgagc

SEQ ID NO: 481212 - DNA, 20 bp, Artificial
  CRISPR gRNA sequence
gagttgtggcgagcatagca

SEQ ID NO: 481213 - DNA, 20 bp, Artificial
  CRISPR gRNA sequence
tggcgagcatagcacattgc

SEQ ID NO: 481214 - DNA, 20 bp, Artificial
  CRISPR gRNA sequence
ctgagacttcatcattctct

SEQ ID NO: 481215 - DNA, 20 bp, Artificial
  CRISPR gRNA sequence
agacttcatcattctctttg

SEQ ID NO: 481216 - DNA, 20 bp, Artificial
  CRISPR gRNA sequence
catcattctctttgcatcaa

SEQ ID NO: 481217 - DNA, 20 bp, Artificial
  CRISPR gRNA sequence
atcattctctttgcatcaat

SEQ ID NO: 481218 - DNA, 20 bp, Artificial
  CRISPR gRNA sequence
tctttgcatcaatcttaggt

SEQ ID NO: 481219 - DNA, 20 bp, Artificial
  CRISPR gRNA sequence
tttgcatcaatcttaggttt

SEQ ID NO: 481220 - DNA, 20 bp, Artificial
  CRISPR gRNA sequence
tgcatcaatcttaggtttgt

SEQ ID NO: 481221 - DNA, 20 bp, Artificial
  CRISPR gRNA sequence
gcatcaatcttaggtttgtg

SEQ ID NO: 481222 - DNA, 20 bp, Artificial
  CRISPR gRNA sequence
catcaatcttaggtttgtgt

SEQ ID NO: 481223 - DNA, 20 bp, Artificial
  CRISPR gRNA sequence
aggtttgtgtgagaaagagc

SEQ ID NO: 481224 - DNA, 20 bp, Artificial
  CRISPR gRNA sequence
ggtttgtgtgagaaagagct

SEQ ID NO: 481225 - DNA, 20 bp, Artificial
  CRISPR gRNA sequence
gtgtgagaaagagctcttct

SEQ ID NO: 481226 - DNA, 20 bp, Artificial
  CRISPR gRNA sequence
tgtgagaaagagctcttcta

SEQ ID NO: 481227 - DNA, 20 bp, Artificial
  CRISPR gRNA sequence
ttctaaaccttaacaggatt

SEQ ID NO: 481228 - DNA, 20 bp, Artificial
  CRISPR gRNA sequence
ctaaaccttaacaggattgg

SEQ ID NO: 481229 - DNA, 20 bp, Artificial
  CRISPR gRNA sequence
taaaccttaacaggattgga

SEQ ID NO: 481230 - DNA, 20 bp, Artificial
  CRISPR gRNA sequence
aaccttaacaggattggaag

SEQ ID NO: 481231 - DNA, 20 bp, Artificial
  CRISPR gRNA sequence
aacaggattggaagttgaaa

SEQ ID NO: 481232 - DNA, 20 bp, Artificial
  CRISPR gRNA sequence
acaggattggaagttgaaac

SEQ ID NO: 481233 - DNA, 20 bp, Artificial
  CRISPR gRNA sequence
gaagttgaaacaatctctca

SEQ ID NO: 481234 - DNA, 20 bp, Artificial
  CRISPR gRNA sequence
aaacaatctctcagatcaag

SEQ ID NO: 481235 - DNA, 20 bp, Artificial
  CRISPR gRNA sequence
tcagatcaagatatctgctt

SEQ ID NO: 481236 - DNA, 20 bp, Artificial
  CRISPR gRNA sequence
agatcaagatatctgcttta

SEQ ID NO: 481237 - DNA, 20 bp, Artificial
  CRISPR gRNA sequence
ctttattttgtattatcctc

SEQ ID NO: 481238 - DNA, 20 bp, Artificial
  CRISPR gRNA sequence
tattttgtattatcctcttt

SEQ ID NO: 481239 - DNA, 20 bp, Artificial
  CRISPR gRNA sequence
attttgtattatcctctttt

SEQ ID NO: 481240 - DNA, 20 bp, Artificial
  CRISPR gRNA sequence
ttttgtattatcctcttttc

SEQ ID NO: 481241 - DNA, 20 bp, Artificial
  CRISPR gRNA sequence
tgtattatcctcttttcaca

SEQ ID NO: 481242 - DNA, 20 bp, Artificial
  CRISPR gRNA sequence
gtattatcctcttttcacag

SEQ ID NO: 481243 - DNA, 20 bp, Artificial
  CRISPR gRNA sequence
tattatcctcttttcacagc

SEQ ID NO: 481244 - DNA, 20 bp, Artificial
  CRISPR gRNA sequence
tcctcttttcacagccacac

SEQ ID NO: 481245 - DNA, 20 bp, Artificial
  CRISPR gRNA sequence
ttttcacagccacaccacat

SEQ ID NO: 481246 - DNA, 20 bp, Artificial
  CRISPR gRNA sequence
ttcacagccacaccacatca

SEQ ID NO: 481247 - DNA, 20 bp, Artificial
  CRISPR gRNA sequence
tcacagccacaccacatcat

SEQ ID NO: 481248 - DNA, 20 bp, Artificial
  CRISPR gRNA sequence
cacagccacaccacatcatg

SEQ ID NO: 481249 - DNA, 20 bp, Artificial
  CRISPR gRNA sequence
acagccacaccacatcatgc

SEQ ID NO: 481250 - DNA, 20 bp, Artificial
  CRISPR gRNA sequence
atgtaactgaagaaccaatg

SEQ ID NO: 481251 - DNA, 20 bp, Artificial
  CRISPR gRNA sequence
tgtaactgaagaaccaatgt

SEQ ID NO: 481252 - DNA, 20 bp, Artificial
  CRISPR gRNA sequence
aagaaccaatgtccccagag

SEQ ID NO: 481253 - DNA, 20 bp, Artificial
  CRISPR gRNA sequence
atatgtctgtattttctatt

SEQ ID NO: 481254 - DNA, 20 bp, Artificial
  CRISPR gRNA sequence
tattttctattgccattata

SEQ ID NO: 481255 - DNA, 20 bp, Artificial
  CRISPR gRNA sequence
tctattgccattataaacat

SEQ ID NO: 481256 - DNA, 20 bp, Artificial
  CRISPR gRNA sequence
ctattgccattataaacata

SEQ ID NO: 481257 - DNA, 20 bp, Artificial
  CRISPR gRNA sequence
tattgccattataaacatat

SEQ ID NO: 481258 - DNA, 20 bp, Artificial
  CRISPR gRNA sequence
ttgccattataaacatatgc

SEQ ID NO: 481259 - DNA, 20 bp, Artificial
  CRISPR gRNA sequence
ccattataaacatatgcttg

SEQ ID NO: 481260 - DNA, 20 bp, Artificial
  CRISPR gRNA sequence
taaacatatgcttgacctga

SEQ ID NO: 481261 - DNA, 20 bp, Artificial
  CRISPR gRNA sequence
gacctgaattcttacccaac

SEQ ID NO: 481262 - DNA, 20 bp, Artificial
  CRISPR gRNA sequence
acctgaattcttacccaaca

SEQ ID NO: 481263 - DNA, 20 bp, Artificial
  CRISPR gRNA sequence
aattcttacccaacaataat

SEQ ID NO: 481264 - DNA, 20 bp, Artificial
  CRISPR gRNA sequence
ttacccaacaataatgcata

SEQ ID NO: 481265 - DNA, 20 bp, Artificial
  CRISPR gRNA sequence
acccaacaataatgcatatg

SEQ ID NO: 481266 - DNA, 20 bp, Artificial
  CRISPR gRNA sequence
cccaacaataatgcatatga

SEQ ID NO: 481267 - DNA, 20 bp, Artificial
  CRISPR gRNA sequence
ggctatgatgggaatggtgt

SEQ ID NO: 481268 - DNA, 20 bp, Artificial
  CRISPR gRNA sequence
gctatgatgggaatggtgtg

SEQ ID NO: 481269 - DNA, 20 bp, Artificial
  CRISPR gRNA sequence
tgatgggaatggtgtgatat

SEQ ID NO: 481270 - DNA, 20 bp, Artificial
  CRISPR gRNA sequence
tgaaaataattcctttctac

SEQ ID NO: 481271 - DNA, 20 bp, Artificial
  CRISPR gRNA sequence
gaaaataattcctttctact

SEQ ID NO: 481272 - DNA, 20 bp, Artificial
  CRISPR gRNA sequence
aaaataattcctttctactt

SEQ ID NO: 481273 - DNA, 20 bp, Artificial
  CRISPR gRNA sequence
ctttctacttttgcaagaac

SEQ ID NO: 481274 - DNA, 20 bp, Artificial
  CRISPR gRNA sequence
tctacttttgcaagaactct

SEQ ID NO: 481275 - DNA, 20 bp, Artificial
  CRISPR gRNA sequence
ctacttttgcaagaactctc

SEQ ID NO: 481276 - DNA, 20 bp, Artificial
  CRISPR gRNA sequence
tacttttgcaagaactctct

SEQ ID NO: 481277 - DNA, 20 bp, Artificial
  CRISPR gRNA sequence
cttttgcaagaactctctca

SEQ ID NO: 481278 - DNA, 20 bp, Artificial
  CRISPR gRNA sequence
ttgcaagaactctctcaatg

SEQ ID NO: 481279 - DNA, 20 bp, Artificial
  CRISPR gRNA sequence
tgcaagaactctctcaatgt

SEQ ID NO: 481280 - DNA, 20 bp, Artificial
  CRISPR gRNA sequence
gcaagaactctctcaatgtc

SEQ ID NO: 481281 - DNA, 20 bp, Artificial
  CRISPR gRNA sequence
caagaactctctcaatgtca

SEQ ID NO: 481282 - DNA, 20 bp, Artificial
  CRISPR gRNA sequence
tctcaatgtcatgaccaaat

SEQ ID NO: 481283 - DNA, 20 bp, Artificial
  CRISPR gRNA sequence
tcaatgtcatgaccaaatat

SEQ ID NO: 481284 - DNA, 20 bp, Artificial
  CRISPR gRNA sequence
aatgtcatgaccaaatatgt

SEQ ID NO: 481285 - DNA, 20 bp, Artificial
  CRISPR gRNA sequence
agtaagagaggaaagcatag

SEQ ID NO: 481286 - DNA, 20 bp, Artificial
  CRISPR gRNA sequence
tgatctagctttggcctgaa

SEQ ID NO: 481287 - DNA, 20 bp, Artificial
  CRISPR gRNA sequence
atctagctttggcctgaact

SEQ ID NO: 481288 - DNA, 20 bp, Artificial
  CRISPR gRNA sequence
gctttggcctgaactacttc

SEQ ID NO: 481289 - DNA, 20 bp, Artificial
  CRISPR gRNA sequence
tggcctgaactacttcagtt

SEQ ID NO: 481290 - DNA, 20 bp, Artificial
  CRISPR gRNA sequence
ggcctgaactacttcagttt

SEQ ID NO: 481291 - DNA, 20 bp, Artificial
  CRISPR gRNA sequence
gcctgaactacttcagtttt

SEQ ID NO: 481292 - DNA, 20 bp, Artificial
  CRISPR gRNA sequence
aactacttcagttttctctt

SEQ ID NO: 481293 - DNA, 20 bp, Artificial
  CRISPR gRNA sequence
cttcagttttctctttcctt

SEQ ID NO: 481294 - DNA, 20 bp, Artificial
  CRISPR gRNA sequence
cagttttctctttccttttt

SEQ ID NO: 481295 - DNA, 20 bp, Artificial
  CRISPR gRNA sequence
agttttctctttcctttttc

SEQ ID NO: 481296 - DNA, 20 bp, Artificial
  CRISPR gRNA sequence
tctctttcctttttcttctc

SEQ ID NO: 481297 - DNA, 20 bp, Artificial
  CRISPR gRNA sequence
ctctttcctttttcttctcc

SEQ ID NO: 481298 - DNA, 20 bp, Artificial
  CRISPR gRNA sequence
tctttcctttttcttctcct

SEQ ID NO: 481299 - DNA, 20 bp, Artificial
  CRISPR gRNA sequence
tttcctttttcttctcctcc

SEQ ID NO: 481300 - DNA, 20 bp, Artificial
  CRISPR gRNA sequence
tcctttttcttctcctccat

SEQ ID NO: 481301 - DNA, 20 bp, Artificial
  CRISPR gRNA sequence
cctttttcttctcctccatc

SEQ ID NO: 481302 - DNA, 20 bp, Artificial
  CRISPR gRNA sequence
ctttttcttctcctccatcc

SEQ ID NO: 481303 - DNA, 20 bp, Artificial
  CRISPR gRNA sequence
tttcttctcctccatcctct

SEQ ID NO: 481304 - DNA, 20 bp, Artificial
  CRISPR gRNA sequence
ttcttctcctccatcctctc

SEQ ID NO: 481305 - DNA, 20 bp, Artificial
  CRISPR gRNA sequence
tcttctcctccatcctctca

SEQ ID NO: 481306 - DNA, 20 bp, Artificial
  CRISPR gRNA sequence
cttctcctccatcctctcac

SEQ ID NO: 481307 - DNA, 20 bp, Artificial
  CRISPR gRNA sequence
ttctcctccatcctctcaca

SEQ ID NO: 481308 - DNA, 20 bp, Artificial
  CRISPR gRNA sequence
ctcctccatcctctcacatt

SEQ ID NO: 481309 - DNA, 20 bp, Artificial
  CRISPR gRNA sequence
tcctccatcctctcacattc

SEQ ID NO: 481310 - DNA, 20 bp, Artificial
  CRISPR gRNA sequence
ctccatcctctcacattcct

SEQ ID NO: 481311 - DNA, 20 bp, Artificial
  CRISPR gRNA sequence
catcctctcacattcctgtt

SEQ ID NO: 481312 - DNA, 20 bp, Artificial
  CRISPR gRNA sequence
tcacattcctgttttcacaa

SEQ ID NO: 481313 - DNA, 20 bp, Artificial
  CRISPR gRNA sequence
acattcctgttttcacaaca

SEQ ID NO: 481314 - DNA, 20 bp, Artificial
  CRISPR gRNA sequence
ctgttttcacaacaccagct

SEQ ID NO: 481315 - DNA, 20 bp, Artificial
  CRISPR gRNA sequence
ttttcacaacaccagctaca

SEQ ID NO: 481316 - DNA, 20 bp, Artificial
  CRISPR gRNA sequence
tcacaacaccagctacagtg

SEQ ID NO: 481317 - DNA, 20 bp, Artificial
  CRISPR gRNA sequence
cacaacaccagctacagtgt

SEQ ID NO: 481318 - DNA, 20 bp, Artificial
  CRISPR gRNA sequence
acaacaccagctacagtgta

SEQ ID NO: 481319 - DNA, 20 bp, Artificial
  CRISPR gRNA sequence
cagtgtagctatagaaactg

SEQ ID NO: 481320 - DNA, 20 bp, Artificial
  CRISPR gRNA sequence
tagaaactgagctagataga

SEQ ID NO: 481321 - DNA, 20 bp, Artificial
  CRISPR gRNA sequence
agctagatagagcaacactt

SEQ ID NO: 481322 - DNA, 20 bp, Artificial
  CRISPR gRNA sequence
gatagagcaacacttattct

SEQ ID NO: 481323 - DNA, 20 bp, Artificial
  CRISPR gRNA sequence
attctgtgtgacacaggaat

SEQ ID NO: 481324 - DNA, 20 bp, Artificial
  CRISPR gRNA sequence
ttctgtgtgacacaggaata

SEQ ID NO: 481325 - DNA, 20 bp, Artificial
  CRISPR gRNA sequence
tgtgtgacacaggaataacc

SEQ ID NO: 481326 - DNA, 20 bp, Artificial
  CRISPR gRNA sequence
tgtgacacaggaataacctt

SEQ ID NO: 481327 - DNA, 20 bp, Artificial
  CRISPR gRNA sequence
tgactgggcaaaagtgcttc

SEQ ID NO: 481328 - DNA, 20 bp, Artificial
  CRISPR gRNA sequence
gactgggcaaaagtgcttct

SEQ ID NO: 481329 - DNA, 20 bp, Artificial
  CRISPR gRNA sequence
actgggcaaaagtgcttctg

SEQ ID NO: 481330 - DNA, 20 bp, Artificial
  CRISPR gRNA sequence
ggcaaaagtgcttctggtat

SEQ ID NO: 481331 - DNA, 20 bp, Artificial
  CRISPR gRNA sequence
ctggtattttggagtgagaa

SEQ ID NO: 481332 - DNA, 20 bp, Artificial
  CRISPR gRNA sequence
tggtattttggagtgagaac

SEQ ID NO: 481333 - DNA, 20 bp, Artificial
  CRISPR gRNA sequence
gtattttggagtgagaactt

SEQ ID NO: 481334 - DNA, 20 bp, Artificial
  CRISPR gRNA sequence
tggagtgagaacttctggag

SEQ ID NO: 481335 - DNA, 20 bp, Artificial
  CRISPR gRNA sequence
ggagtgagaacttctggagt

SEQ ID NO: 481336 - DNA, 20 bp, Artificial
  CRISPR gRNA sequence
gagtgagaacttctggagtt

SEQ ID NO: 481337 - DNA, 20 bp, Artificial
  CRISPR gRNA sequence
ctggagttcagaaccttctc

SEQ ID NO: 481338 - DNA, 20 bp, Artificial
  CRISPR gRNA sequence
tggagttcagaaccttctct

SEQ ID NO: 481339 - DNA, 20 bp, Artificial
  CRISPR gRNA sequence
gagttcagaaccttctctgg

SEQ ID NO: 481340 - DNA, 20 bp, Artificial
  CRISPR gRNA sequence
agaaccttctctggattctg

SEQ ID NO: 481341 - DNA, 20 bp, Artificial
  CRISPR gRNA sequence
ctctggattctgaagaattc

SEQ ID NO: 481342 - DNA, 20 bp, Artificial
  CRISPR gRNA sequence
tctggattctgaagaattct

SEQ ID NO: 481343 - DNA, 20 bp, Artificial
  CRISPR gRNA sequence
tggattctgaagaattctct

SEQ ID NO: 481344 - DNA, 20 bp, Artificial
  CRISPR gRNA sequence
gattctgaagaattctctct

SEQ ID NO: 481345 - DNA, 20 bp, Artificial
  CRISPR gRNA sequence
tgaagaattctctcttaccc

SEQ ID NO: 481346 - DNA, 20 bp, Artificial
  CRISPR gRNA sequence
aagaattctctcttacccca

SEQ ID NO: 481347 - DNA, 20 bp, Artificial
  CRISPR gRNA sequence
tctcttaccccaattcttca

SEQ ID NO: 481348 - DNA, 20 bp, Artificial
  CRISPR gRNA sequence
tcttaccccaattcttcatc

SEQ ID NO: 481349 - DNA, 20 bp, Artificial
  CRISPR gRNA sequence
ttaccccaattcttcatctg

SEQ ID NO: 481350 - DNA, 20 bp, Artificial
  CRISPR gRNA sequence
accccaattcttcatctgca

SEQ ID NO: 481351 - DNA, 20 bp, Artificial
  CRISPR gRNA sequence
ccccaattcttcatctgcaa

SEQ ID NO: 481352 - DNA, 20 bp, Artificial
  CRISPR gRNA sequence
ttcatctgcaactccatggc

SEQ ID NO: 481353 - DNA, 20 bp, Artificial
  CRISPR gRNA sequence
catctgcaactccatggctc

SEQ ID NO: 481354 - DNA, 20 bp, Artificial
  CRISPR gRNA sequence
atctgcaactccatggctct

SEQ ID NO: 481355 - DNA, 20 bp, Artificial
  CRISPR gRNA sequence
caactccatggctctttcta

SEQ ID NO: 481356 - DNA, 20 bp, Artificial
  CRISPR gRNA sequence
catggctctttctatggcct

SEQ ID NO: 481357 - DNA, 20 bp, Artificial
  CRISPR gRNA sequence
tttctatggcctctctgtat

SEQ ID NO: 481358 - DNA, 20 bp, Artificial
  CRISPR gRNA sequence
tctatggcctctctgtatct

SEQ ID NO: 481359 - DNA, 20 bp, Artificial
  CRISPR gRNA sequence
ctatggcctctctgtatctt

SEQ ID NO: 481360 - DNA, 20 bp, Artificial
  CRISPR gRNA sequence
tatggcctctctgtatcttt

SEQ ID NO: 481361 - DNA, 20 bp, Artificial
  CRISPR gRNA sequence
tggcctctctgtatctttca

SEQ ID NO: 481362 - DNA, 20 bp, Artificial
  CRISPR gRNA sequence
tctgtatctttcatcatctt

SEQ ID NO: 481363 - DNA, 20 bp, Artificial
  CRISPR gRNA sequence
tgtatctttcatcatctttc

SEQ ID NO: 481364 - DNA, 20 bp, Artificial
  CRISPR gRNA sequence
tatctttcatcatctttctt

SEQ ID NO: 481365 - DNA, 20 bp, Artificial
  CRISPR gRNA sequence
tcatcatctttcttgagact

SEQ ID NO: 481366 - DNA, 20 bp, Artificial
  CRISPR gRNA sequence
catcatctttcttgagactg

SEQ ID NO: 481367 - DNA, 20 bp, Artificial
  CRISPR gRNA sequence
atcatctttcttgagactgc

SEQ ID NO: 481368 - DNA, 20 bp, Artificial
  CRISPR gRNA sequence
tcttgagactgctggaacct

SEQ ID NO: 481369 - DNA, 20 bp, Artificial
  CRISPR gRNA sequence
cttgagactgctggaacctc

SEQ ID NO: 481370 - DNA, 20 bp, Artificial
  CRISPR gRNA sequence
ttgagactgctggaacctct

SEQ ID NO: 481371 - DNA, 20 bp, Artificial
  CRISPR gRNA sequence
gagactgctggaacctctct

SEQ ID NO: 481372 - DNA, 20 bp, Artificial
  CRISPR gRNA sequence
agactgctggaacctctctc

SEQ ID NO: 481373 - DNA, 20 bp, Artificial
  CRISPR gRNA sequence
ctggaacctctctcagaact

SEQ ID NO: 481374 - DNA, 20 bp, Artificial
  CRISPR gRNA sequence
gaacctctctcagaacttca

SEQ ID NO: 481375 - DNA, 20 bp, Artificial
  CRISPR gRNA sequence
tctcagaacttcagaaaagg

SEQ ID NO: 481376 - DNA, 20 bp, Artificial
  CRISPR gRNA sequence
tcagaacttcagaaaaggag

SEQ ID NO: 481377 - DNA, 20 bp, Artificial
  CRISPR gRNA sequence
agaacttcagaaaaggagtc

SEQ ID NO: 481378 - DNA, 20 bp, Artificial
  CRISPR gRNA sequence
cagaaaaggagtcagggata

SEQ ID NO: 481379 - DNA, 20 bp, Artificial
  CRISPR gRNA sequence
agaaaaggagtcagggataa

SEQ ID NO: 481380 - DNA, 20 bp, Artificial
  CRISPR gRNA sequence
ttgatttaccacatccaaag

SEQ ID NO: 481381 - DNA, 20 bp, Artificial
  CRISPR gRNA sequence
tgatttaccacatccaaagt

SEQ ID NO: 481382 - DNA, 20 bp, Artificial
  CRISPR gRNA sequence
gatttaccacatccaaagtg

SEQ ID NO: 481383 - DNA, 20 bp, Artificial
  CRISPR gRNA sequence
atttaccacatccaaagtga

SEQ ID NO: 481384 - DNA, 20 bp, Artificial
  CRISPR gRNA sequence
accacatccaaagtgaacta

SEQ ID NO: 481385 - DNA, 20 bp, Artificial
  CRISPR gRNA sequence
ccacatccaaagtgaactag

SEQ ID NO: 481386 - DNA, 20 bp, Artificial
  CRISPR gRNA sequence
ggtagtaggagatcttggct

SEQ ID NO: 481387 - DNA, 20 bp, Artificial
  CRISPR gRNA sequence
ggctacataggtgacaggac

SEQ ID NO: 481388 - DNA, 20 bp, Artificial
  CRISPR gRNA sequence
gctacataggtgacaggaca

SEQ ID NO: 481389 - DNA, 20 bp, Artificial
  CRISPR gRNA sequence
cataggtgacaggacagcag

SEQ ID NO: 481390 - DNA, 20 bp, Artificial
  CRISPR gRNA sequence
ctggcattgagtatggaatg

SEQ ID NO: 481391 - DNA, 20 bp, Artificial
  CRISPR gRNA sequence
tggcattgagtatggaatgt

SEQ ID NO: 481392 - DNA, 20 bp, Artificial
  CRISPR gRNA sequence
gcattgagtatggaatgtcc

SEQ ID NO: 481393 - DNA, 20 bp, Artificial
  CRISPR gRNA sequence
agtatggaatgtccccagag

SEQ ID NO: 481394 - DNA, 20 bp, Artificial
  CRISPR gRNA sequence
ccagtctcttccaagtgata

SEQ ID NO: 481395 - DNA, 20 bp, Artificial
  CRISPR gRNA sequence
cagtctcttccaagtgatat

SEQ ID NO: 481396 - DNA, 20 bp, Artificial
  CRISPR gRNA sequence
ttccaagtgatatactagat

SEQ ID NO: 481397 - DNA, 20 bp, Artificial
  CRISPR gRNA sequence
ccaagtgatatactagatcc

SEQ ID NO: 481398 - DNA, 20 bp, Artificial
  CRISPR gRNA sequence
caagtgatatactagatccc

SEQ ID NO: 481399 - DNA, 20 bp, Artificial
  CRISPR gRNA sequence
gatccctccccttcctttta

SEQ ID NO: 481400 - DNA, 20 bp, Artificial
  CRISPR gRNA sequence
cccttccttttagatatgcc

SEQ ID NO: 481401 - DNA, 20 bp, Artificial
  CRISPR gRNA sequence
ccttttagatatgccatggg

SEQ ID NO: 481402 - DNA, 20 bp, Artificial
  CRISPR gRNA sequence
cttttagatatgccatgggg

SEQ ID NO: 481403 - DNA, 20 bp, Artificial
  CRISPR gRNA sequence
ttagatatgccatggggcta

SEQ ID NO: 481404 - DNA, 20 bp, Artificial
  CRISPR gRNA sequence
tagatatgccatggggctat

SEQ ID NO: 481405 - DNA, 20 bp, Artificial
  CRISPR gRNA sequence
agatatgccatggggctatg

SEQ ID NO: 481406 - DNA, 20 bp, Artificial
  CRISPR gRNA sequence
gatatgccatggggctatgt

SEQ ID NO: 481407 - DNA, 20 bp, Artificial
  CRISPR gRNA sequence
tgtggactgaaaagtgatga

SEQ ID NO: 481408 - DNA, 20 bp, Artificial
  CRISPR gRNA sequence
aaaagtgatgaaccagagag

SEQ ID NO: 481409 - DNA, 20 bp, Artificial
  CRISPR gRNA sequence
gtcagtgtgaattatcacaa

SEQ ID NO: 481410 - DNA, 20 bp, Artificial
  CRISPR gRNA sequence
tcacaaacaagtgtgtgcta

SEQ ID NO: 481411 - DNA, 20 bp, Artificial
  CRISPR gRNA sequence
ggcaaagcaaattaacaagc

SEQ ID NO: 481412 - DNA, 20 bp, Artificial
  CRISPR gRNA sequence
acaagccaaaactaacaaca

SEQ ID NO: 481413 - DNA, 20 bp, Artificial
  CRISPR gRNA sequence
acaacactatccctggcatt

SEQ ID NO: 481414 - DNA, 20 bp, Artificial
  CRISPR gRNA sequence
tccctggcattcaacaggat

SEQ ID NO: 481415 - DNA, 20 bp, Artificial
  CRISPR gRNA sequence
gcattcaacaggataagcat

SEQ ID NO: 481416 - DNA, 20 bp, Artificial
  CRISPR gRNA sequence
aacaggataagcatgggtgg

SEQ ID NO: 481417 - DNA, 20 bp, Artificial
  CRISPR gRNA sequence
acttctgctttctttactcc

SEQ ID NO: 481418 - DNA, 20 bp, Artificial
  CRISPR gRNA sequence
cttctgctttctttactcct

SEQ ID NO: 481419 - DNA, 20 bp, Artificial
  CRISPR gRNA sequence
ctgctttctttactcctttt

SEQ ID NO: 481420 - DNA, 20 bp, Artificial
  CRISPR gRNA sequence
tgctttctttactccttttg

SEQ ID NO: 481421 - DNA, 20 bp, Artificial
  CRISPR gRNA sequence
ctttctttactccttttgat

SEQ ID NO: 481422 - DNA, 20 bp, Artificial
  CRISPR gRNA sequence
tctttactccttttgattac

SEQ ID NO: 481423 - DNA, 20 bp, Artificial
  CRISPR gRNA sequence
ctttactccttttgattact

SEQ ID NO: 481424 - DNA, 20 bp, Artificial
  CRISPR gRNA sequence
tttactccttttgattactt

SEQ ID NO: 481425 - DNA, 20 bp, Artificial
  CRISPR gRNA sequence
tactccttttgattacttct

SEQ ID NO: 481426 - DNA, 20 bp, Artificial
  CRISPR gRNA sequence
actccttttgattacttctt

SEQ ID NO: 481427 - DNA, 20 bp, Artificial
  CRISPR gRNA sequence
ctccttttgattacttcttt

SEQ ID NO: 481428 - DNA, 20 bp, Artificial
  CRISPR gRNA sequence
cttttgattacttctttttc

SEQ ID NO: 481429 - DNA, 20 bp, Artificial
  CRISPR gRNA sequence
ttgattacttctttttcttt

SEQ ID NO: 481430 - DNA, 20 bp, Artificial
  CRISPR gRNA sequence
tgattacttctttttctttt

SEQ ID NO: 481431 - DNA, 20 bp, Artificial
  CRISPR gRNA sequence
gattacttctttttcttttt

SEQ ID NO: 481432 - DNA, 20 bp, Artificial
  CRISPR gRNA sequence
attacttctttttctttttg

SEQ ID NO: 481433 - DNA, 20 bp, Artificial
  CRISPR gRNA sequence
cttctttttctttttgtctt

SEQ ID NO: 481434 - DNA, 20 bp, Artificial
  CRISPR gRNA sequence
ctttttctttttgtcttcca

SEQ ID NO: 481435 - DNA, 20 bp, Artificial
  CRISPR gRNA sequence
tttttctttttgtcttccag

SEQ ID NO: 481436 - DNA, 20 bp, Artificial
  CRISPR gRNA sequence
tttctttttgtcttccagga

SEQ ID NO: 481437 - DNA, 20 bp, Artificial
  CRISPR gRNA sequence
ttctttttgtcttccaggaa

SEQ ID NO: 481438 - DNA, 20 bp, Artificial
  CRISPR gRNA sequence
tctttttgtcttccaggaaa

SEQ ID NO: 481439 - DNA, 20 bp, Artificial
  CRISPR gRNA sequence
ctttttgtcttccaggaaag

SEQ ID NO: 481440 - DNA, 20 bp, Artificial
  CRISPR gRNA sequence
tttttgtcttccaggaaagc

SEQ ID NO: 481441 - DNA, 20 bp, Artificial
  CRISPR gRNA sequence
tttgtcttccaggaaagcaa

SEQ ID NO: 481442 - DNA, 20 bp, Artificial
  CRISPR gRNA sequence
ttgtcttccaggaaagcaaa

SEQ ID NO: 481443 - DNA, 20 bp, Artificial
  CRISPR gRNA sequence
tgtcttccaggaaagcaaaa

SEQ ID NO: 481444 - DNA, 20 bp, Artificial
  CRISPR gRNA sequence
gtcttccaggaaagcaaaat

SEQ ID NO: 481445 - DNA, 20 bp, Artificial
  CRISPR gRNA sequence
tcttccaggaaagcaaaatg

SEQ ID NO: 481446 - DNA, 20 bp, Artificial
  CRISPR gRNA sequence
ccaggaaagcaaaatgaact

SEQ ID NO: 481447 - DNA, 20 bp, Artificial
  CRISPR gRNA sequence
caggaaagcaaaatgaactc

SEQ ID NO: 481448 - DNA, 20 bp, Artificial
  CRISPR gRNA sequence
tctgacacagcaggaaggga

SEQ ID NO: 481449 - DNA, 20 bp, Artificial
  CRISPR gRNA sequence
tgacacagcaggaagggaaa

SEQ ID NO: 481450 - DNA, 20 bp, Artificial
  CRISPR gRNA sequence
acacagcaggaagggaaatt

SEQ ID NO: 481451 - DNA, 20 bp, Artificial
  CRISPR gRNA sequence
acctggtaagcttgatgtag

SEQ ID NO: 481452 - DNA, 20 bp, Artificial
  CRISPR gRNA sequence
gtaagcttgatgtagctgtt

SEQ ID NO: 481453 - DNA, 20 bp, Artificial
  CRISPR gRNA sequence
gatgtagctgttgaaacaaa

SEQ ID NO: 481454 - DNA, 20 bp, Artificial
  CRISPR gRNA sequence
atgtagctgttgaaacaaat

SEQ ID NO: 481455 - DNA, 20 bp, Artificial
  CRISPR gRNA sequence
ttgaaacaaatgcaatttgt

SEQ ID NO: 481456 - DNA, 20 bp, Artificial
  CRISPR gRNA sequence
aaacaaatgcaatttgtgtt

SEQ ID NO: 481457 - DNA, 20 bp, Artificial
  CRISPR gRNA sequence
gtgttatactgtgtttattt

SEQ ID NO: 481458 - DNA, 20 bp, Artificial
  CRISPR gRNA sequence
tgttatactgtgtttattta

SEQ ID NO: 481459 - DNA, 20 bp, Artificial
  CRISPR gRNA sequence
tactgtgtttatttatttat

SEQ ID NO: 481460 - DNA, 20 bp, Artificial
  CRISPR gRNA sequence
tgtttatttatttattcaat

SEQ ID NO: 481461 - DNA, 20 bp, Artificial
  CRISPR gRNA sequence
atttatttattcaatgaatt

SEQ ID NO: 481462 - DNA, 20 bp, Artificial
  CRISPR gRNA sequence
tttatttattcaatgaattt

SEQ ID NO: 481463 - DNA, 20 bp, Artificial
  CRISPR gRNA sequence
atttattcaatgaatttata

SEQ ID NO: 481464 - DNA, 20 bp, Artificial
  CRISPR gRNA sequence
tttattcaatgaatttatat

SEQ ID NO: 481465 - DNA, 20 bp, Artificial
  CRISPR gRNA sequence
attcaatgaatttatataac

SEQ ID NO: 481466 - DNA, 20 bp, Artificial
  CRISPR gRNA sequence
ttcaatgaatttatataaca

SEQ ID NO: 481467 - DNA, 20 bp, Artificial
  CRISPR gRNA sequence
aatgaatttatataacacca

SEQ ID NO: 481468 - DNA, 20 bp, Artificial
  CRISPR gRNA sequence
atataacaccatgtgccagg

SEQ ID NO: 481469 - DNA, 20 bp, Artificial
  CRISPR gRNA sequence
tataacaccatgtgccaggc

SEQ ID NO: 481470 - DNA, 20 bp, Artificial
  CRISPR gRNA sequence
ttctatgtactatatatata

SEQ ID NO: 481471 - DNA, 20 bp, Artificial
  CRISPR gRNA sequence
tatgtactatatatatatat

SEQ ID NO: 481472 - DNA, 20 bp, Artificial
  CRISPR gRNA sequence
tgtactatatatatatatat

SEQ ID NO: 481473 - DNA, 20 bp, Artificial
  CRISPR gRNA sequence
tatatatatatatatatata

SEQ ID NO: 481474 - DNA, 20 bp, Artificial
  CRISPR gRNA sequence
ttaaaaatgtgaattttgca

SEQ ID NO: 481475 - DNA, 20 bp, Artificial
  CRISPR gRNA sequence
taaaaatgtgaattttgcat

SEQ ID NO: 481476 - DNA, 20 bp, Artificial
  CRISPR gRNA sequence
aaaaatgtgaattttgcatt

SEQ ID NO: 481477 - DNA, 20 bp, Artificial
  CRISPR gRNA sequence
aaaatgtgaattttgcattc

SEQ ID NO: 481478 - DNA, 20 bp, Artificial
  CRISPR gRNA sequence
tgcattctgctctctatgca

SEQ ID NO: 481479 - DNA, 20 bp, Artificial
  CRISPR gRNA sequence
gcattctgctctctatgcag

SEQ ID NO: 481480 - DNA, 20 bp, Artificial
  CRISPR gRNA sequence
cattctgctctctatgcagc

SEQ ID NO: 481481 - DNA, 20 bp, Artificial
  CRISPR gRNA sequence
tgctctctatgcagcaaaga

SEQ ID NO: 481482 - DNA, 20 bp, Artificial
  CRISPR gRNA sequence
ctctctatgcagcaaagact

SEQ ID NO: 481483 - DNA, 20 bp, Artificial
  CRISPR gRNA sequence
tctatgcagcaaagactctt

SEQ ID NO: 481484 - DNA, 20 bp, Artificial
  CRISPR gRNA sequence
tatgcagcaaagactcttta

SEQ ID NO: 481485 - DNA, 20 bp, Artificial
  CRISPR gRNA sequence
tgcagcaaagactctttagg

SEQ ID NO: 481486 - DNA, 20 bp, Artificial
  CRISPR gRNA sequence
tttagggttaacaagtctcg

SEQ ID NO: 481487 - DNA, 20 bp, Artificial
  CRISPR gRNA sequence
tagggttaacaagtctcgta

SEQ ID NO: 481488 - DNA, 20 bp, Artificial
  CRISPR gRNA sequence
agggttaacaagtctcgtaa

SEQ ID NO: 481489 - DNA, 20 bp, Artificial
  CRISPR gRNA sequence
gggttaacaagtctcgtaat

SEQ ID NO: 481490 - DNA, 20 bp, Artificial
  CRISPR gRNA sequence
acaagtctcgtaataagtgg

SEQ ID NO: 481491 - DNA, 20 bp, Artificial
  CRISPR gRNA sequence
gtaataagtggttctttgga

SEQ ID NO: 481492 - DNA, 20 bp, Artificial
  CRISPR gRNA sequence
tttggaagttcatggaaggc

SEQ ID NO: 481493 - DNA, 20 bp, Artificial
  CRISPR gRNA sequence
tggaagttcatggaaggcag

SEQ ID NO: 481494 - DNA, 20 bp, Artificial
  CRISPR gRNA sequence
ggaagttcatggaaggcagt

SEQ ID NO: 481495 - DNA, 20 bp, Artificial
  CRISPR gRNA sequence
gaagttcatggaaggcagtc

SEQ ID NO: 481496 - DNA, 20 bp, Artificial
  CRISPR gRNA sequence
atggaaggcagtctagatcc

SEQ ID NO: 481497 - DNA, 20 bp, Artificial
  CRISPR gRNA sequence
gatccaagacagaaaagtca

SEQ ID NO: 481498 - DNA, 20 bp, Artificial
  CRISPR gRNA sequence
aaccatacaaacttgactct

SEQ ID NO: 481499 - DNA, 20 bp, Artificial
  CRISPR gRNA sequence
gactctgctcttgcctgtta

SEQ ID NO: 481500 - DNA, 20 bp, Artificial
  CRISPR gRNA sequence
actctgctcttgcctgttat

SEQ ID NO: 481501 - DNA, 20 bp, Artificial
  CRISPR gRNA sequence
tgctcttgcctgttatgtgg

SEQ ID NO: 481502 - DNA, 20 bp, Artificial
  CRISPR gRNA sequence
ctcttgcctgttatgtggct

SEQ ID NO: 481503 - DNA, 20 bp, Artificial
  CRISPR gRNA sequence
ttgcctgttatgtggcttca

SEQ ID NO: 481504 - DNA, 20 bp, Artificial
  CRISPR gRNA sequence
gcctgttatgtggcttcagg

SEQ ID NO: 481505 - DNA, 20 bp, Artificial
  CRISPR gRNA sequence
cctgttatgtggcttcaggc

SEQ ID NO: 481506 - DNA, 20 bp, Artificial
  CRISPR gRNA sequence
ttatgtggcttcaggctatt

SEQ ID NO: 481507 - DNA, 20 bp, Artificial
  CRISPR gRNA sequence
tgtggcttcaggctattcat

SEQ ID NO: 481508 - DNA, 20 bp, Artificial
  CRISPR gRNA sequence
caggctattcatttattttt

SEQ ID NO: 481509 - DNA, 20 bp, Artificial
  CRISPR gRNA sequence
aggctattcatttatttttt

SEQ ID NO: 481510 - DNA, 20 bp, Artificial
  CRISPR gRNA sequence
ttcatttattttttatgtaa

SEQ ID NO: 481511 - DNA, 20 bp, Artificial
  CRISPR gRNA sequence
atttattttttatgtaaaca

SEQ ID NO: 481512 - DNA, 20 bp, Artificial
  CRISPR gRNA sequence
attttttatgtaaacacctt

SEQ ID NO: 481513 - DNA, 20 bp, Artificial
  CRISPR gRNA sequence
ttttttatgtaaacacctta

SEQ ID NO: 481514 - DNA, 20 bp, Artificial
  CRISPR gRNA sequence
tttatgtaaacaccttaagg

SEQ ID NO: 481515 - DNA, 20 bp, Artificial
  CRISPR gRNA sequence
ttatgtaaacaccttaaggt

SEQ ID NO: 481516 - DNA, 20 bp, Artificial
  CRISPR gRNA sequence
tatgtaaacaccttaaggtc

SEQ ID NO: 481517 - DNA, 20 bp, Artificial
  CRISPR gRNA sequence
atgtaaacaccttaaggtct

SEQ ID NO: 481518 - DNA, 20 bp, Artificial
  CRISPR gRNA sequence
tgtaaacaccttaaggtctt

SEQ ID NO: 481519 - DNA, 20 bp, Artificial
  CRISPR gRNA sequence
aaggtctttctggaagagag

SEQ ID NO: 481520 - DNA, 20 bp, Artificial
  CRISPR gRNA sequence
aggtctttctggaagagagt

SEQ ID NO: 481521 - DNA, 20 bp, Artificial
  CRISPR gRNA sequence
tctggaagagagtagggagc

SEQ ID NO: 481522 - DNA, 20 bp, Artificial
  CRISPR gRNA sequence
ctggaagagagtagggagct

SEQ ID NO: 481523 - DNA, 20 bp, Artificial
  CRISPR gRNA sequence
tggaagagagtagggagctg

SEQ ID NO: 481524 - DNA, 20 bp, Artificial
  CRISPR gRNA sequence
gaagagagtagggagctgat

SEQ ID NO: 481525 - DNA, 20 bp, Artificial
  CRISPR gRNA sequence
atgaaagaatgaacccacaa

SEQ ID NO: 481526 - DNA, 20 bp, Artificial
  CRISPR gRNA sequence
ataaaatgattagatatctt

SEQ ID NO: 481527 - DNA, 20 bp, Artificial
  CRISPR gRNA sequence
gatatcttcataaatagcac

SEQ ID NO: 481528 - DNA, 20 bp, Artificial
  CRISPR gRNA sequence
cataaatagcaccagcaaaa

SEQ ID NO: 481529 - DNA, 20 bp, Artificial
  CRISPR gRNA sequence
ataaatagcaccagcaaaat

SEQ ID NO: 481530 - DNA, 20 bp, Artificial
  CRISPR gRNA sequence
tggcttagttattacacaga

SEQ ID NO: 481531 - DNA, 20 bp, Artificial
  CRISPR gRNA sequence
ggcttagttattacacagag

SEQ ID NO: 481532 - DNA, 20 bp, Artificial
  CRISPR gRNA sequence
gcttagttattacacagagg

SEQ ID NO: 481533 - DNA, 20 bp, Artificial
  CRISPR gRNA sequence
agttattacacagaggtccc

SEQ ID NO: 481534 - DNA, 20 bp, Artificial
  CRISPR gRNA sequence
gttattacacagaggtccct

SEQ ID NO: 481535 - DNA, 20 bp, Artificial
  CRISPR gRNA sequence
ttacacagaggtccctggca

SEQ ID NO: 481536 - DNA, 20 bp, Artificial
  CRISPR gRNA sequence
cacagaggtccctggcaatg

SEQ ID NO: 481537 - DNA, 20 bp, Artificial
  CRISPR gRNA sequence
gcaatgtgtatgggctcatc

SEQ ID NO: 481538 - DNA, 20 bp, Artificial
  CRISPR gRNA sequence
atcaaggaagggaccactca

SEQ ID NO: 481539 - DNA, 20 bp, Artificial
  CRISPR gRNA sequence
agactaaaggaagggaattt

SEQ ID NO: 481540 - DNA, 20 bp, Artificial
  CRISPR gRNA sequence
aaggaagggaattttggagt

SEQ ID NO: 481541 - DNA, 20 bp, Artificial
  CRISPR gRNA sequence
tggagtcaatctttcctata

SEQ ID NO: 481542 - DNA, 20 bp, Artificial
  CRISPR gRNA sequence
ggagtcaatctttcctataa

SEQ ID NO: 481543 - DNA, 20 bp, Artificial
  CRISPR gRNA sequence
gagtcaatctttcctataag

SEQ ID NO: 481544 - DNA, 20 bp, Artificial
  CRISPR gRNA sequence
tcctataaggtttggaatgt

SEQ ID NO: 481545 - DNA, 20 bp, Artificial
  CRISPR gRNA sequence
cctataaggtttggaatgta

SEQ ID NO: 481546 - DNA, 20 bp, Artificial
  CRISPR gRNA sequence
ctataaggtttggaatgtaa

SEQ ID NO: 481547 - DNA, 20 bp, Artificial
  CRISPR gRNA sequence
taaggtttggaatgtaaatg

SEQ ID NO: 481548 - DNA, 20 bp, Artificial
  CRISPR gRNA sequence
ggaatgtaaatgtaggcttt

SEQ ID NO: 481549 - DNA, 20 bp, Artificial
  CRISPR gRNA sequence
gaatgtaaatgtaggctttt

SEQ ID NO: 481550 - DNA, 20 bp, Artificial
  CRISPR gRNA sequence
ttcttttgagttgaatgttg

SEQ ID NO: 481551 - DNA, 20 bp, Artificial
  CRISPR gRNA sequence
tcttttgagttgaatgttgt

SEQ ID NO: 481552 - DNA, 20 bp, Artificial
  CRISPR gRNA sequence
cttttgagttgaatgttgtg

SEQ ID NO: 481553 - DNA, 20 bp, Artificial
  CRISPR gRNA sequence
ttttgagttgaatgttgtgg

SEQ ID NO: 481554 - DNA, 20 bp, Artificial
  CRISPR gRNA sequence
ttgagttgaatgttgtggag

SEQ ID NO: 481555 - DNA, 20 bp, Artificial
  CRISPR gRNA sequence
tgagttgaatgttgtggaga

SEQ ID NO: 481556 - DNA, 20 bp, Artificial
  CRISPR gRNA sequence
gagttgaatgttgtggagat

SEQ ID NO: 481557 - DNA, 20 bp, Artificial
  CRISPR gRNA sequence
agttgaatgttgtggagata

SEQ ID NO: 481558 - DNA, 20 bp, Artificial
  CRISPR gRNA sequence
aatgttgtggagatattaga

SEQ ID NO: 481559 - DNA, 20 bp, Artificial
  CRISPR gRNA sequence
tggagatattagaactaaaa

SEQ ID NO: 481560 - DNA, 20 bp, Artificial
  CRISPR gRNA sequence
gaactaaaaaagaatgcaag

SEQ ID NO: 481561 - DNA, 20 bp, Artificial
  CRISPR gRNA sequence
aaaaagaatgcaagatgagg

SEQ ID NO: 481562 - DNA, 20 bp, Artificial
  CRISPR gRNA sequence
gtggaaaagcattctgaagc

SEQ ID NO: 481563 - DNA, 20 bp, Artificial
  CRISPR gRNA sequence
tggaaaagcattctgaagct

SEQ ID NO: 481564 - DNA, 20 bp, Artificial
  CRISPR gRNA sequence
tgaagctctctaattaaaac

SEQ ID NO: 481565 - DNA, 20 bp, Artificial
  CRISPR gRNA sequence
aagctctctaattaaaacta

SEQ ID NO: 481566 - DNA, 20 bp, Artificial
  CRISPR gRNA sequence
tctaattaaaactaaacagt

SEQ ID NO: 481567 - DNA, 20 bp, Artificial
  CRISPR gRNA sequence
taattaaaactaaacagtca

SEQ ID NO: 481568 - DNA, 20 bp, Artificial
  CRISPR gRNA sequence
attaaaactaaacagtcata

SEQ ID NO: 481569 - DNA, 20 bp, Artificial
  CRISPR gRNA sequence
aaactaaacagtcataaatg

SEQ ID NO: 481570 - DNA, 20 bp, Artificial
  CRISPR gRNA sequence
aacagtcataaatgagatac

SEQ ID NO: 481571 - DNA, 20 bp, Artificial
  CRISPR gRNA sequence
caaaggaacttgatgtgtgt

SEQ ID NO: 481572 - DNA, 20 bp, Artificial
  CRISPR gRNA sequence
gatgtgtgtgtgtgtttcaa

SEQ ID NO: 481573 - DNA, 20 bp, Artificial
  CRISPR gRNA sequence
atgtgtgtgtgtgtttcaat

SEQ ID NO: 481574 - DNA, 20 bp, Artificial
  CRISPR gRNA sequence
caataaggaggaatagtgat

SEQ ID NO: 481575 - DNA, 20 bp, Artificial
  CRISPR gRNA sequence
aataaggaggaatagtgata

SEQ ID NO: 481576 - DNA, 20 bp, Artificial
  CRISPR gRNA sequence
ttaaaaattccacaaaagac

SEQ ID NO: 481577 - DNA, 20 bp, Artificial
  CRISPR gRNA sequence
aaaaattccacaaaagacaa

SEQ ID NO: 481578 - DNA, 20 bp, Artificial
  CRISPR gRNA sequence
aaaattccacaaaagacaaa

SEQ ID NO: 481579 - DNA, 20 bp, Artificial
  CRISPR gRNA sequence
cacaaaagacaaaatcgata

SEQ ID NO: 481580 - DNA, 20 bp, Artificial
  CRISPR gRNA sequence
tatatataatattaaatggc

SEQ ID NO: 481581 - DNA, 20 bp, Artificial
  CRISPR gRNA sequence
tatataatattaaatggcat

SEQ ID NO: 481582 - DNA, 20 bp, Artificial
  CRISPR gRNA sequence
aatggcattcaacattcccc

SEQ ID NO: 481583 - DNA, 20 bp, Artificial
  CRISPR gRNA sequence
aacattccccaccaagctgc

SEQ ID NO: 481584 - DNA, 20 bp, Artificial
  CRISPR gRNA sequence
cccaccaagctgcttaattt

SEQ ID NO: 481585 - DNA, 20 bp, Artificial
  CRISPR gRNA sequence
cttaattttaaaccagacca

SEQ ID NO: 481586 - DNA, 20 bp, Artificial
  CRISPR gRNA sequence
aattttaaaccagaccaaat

SEQ ID NO: 481587 - DNA, 20 bp, Artificial
  CRISPR gRNA sequence
attttaaaccagaccaaata

SEQ ID NO: 481588 - DNA, 20 bp, Artificial
  CRISPR gRNA sequence
taaaccagaccaaatacact

SEQ ID NO: 481589 - DNA, 20 bp, Artificial
  CRISPR gRNA sequence
aaaccagaccaaatacactc

SEQ ID NO: 481590 - DNA, 20 bp, Artificial
  CRISPR gRNA sequence
aaccagaccaaatacactca

SEQ ID NO: 481591 - DNA, 20 bp, Artificial
  CRISPR gRNA sequence
aacttgacaaacttctatta

SEQ ID NO: 481592 - DNA, 20 bp, Artificial
  CRISPR gRNA sequence
gacaaacttctattaagttt

SEQ ID NO: 481593 - DNA, 20 bp, Artificial
  CRISPR gRNA sequence
acaaacttctattaagtttt

SEQ ID NO: 481594 - DNA, 20 bp, Artificial
  CRISPR gRNA sequence
ctattaagttttcattagca

SEQ ID NO: 481595 - DNA, 20 bp, Artificial
  CRISPR gRNA sequence
tattaagttttcattagcat

SEQ ID NO: 481596 - DNA, 20 bp, Artificial
  CRISPR gRNA sequence
ttaagttttcattagcatca

SEQ ID NO: 481597 - DNA, 20 bp, Artificial
  CRISPR gRNA sequence
agttttcattagcatcagta

SEQ ID NO: 481598 - DNA, 20 bp, Artificial
  CRISPR gRNA sequence
tcattagcatcagtaggcac

SEQ ID NO: 481599 - DNA, 20 bp, Artificial
  CRISPR gRNA sequence
cattagcatcagtaggcact

SEQ ID NO: 481600 - DNA, 20 bp, Artificial
  CRISPR gRNA sequence
attagcatcagtaggcactg

SEQ ID NO: 481601 - DNA, 20 bp, Artificial
  CRISPR gRNA sequence
gcatcagtaggcactgtgta

SEQ ID NO: 481602 - DNA, 20 bp, Artificial
  CRISPR gRNA sequence
tgtagggtgctaaggctttg

SEQ ID NO: 481603 - DNA, 20 bp, Artificial
  CRISPR gRNA sequence
aggctttgttccctcaaata

SEQ ID NO: 481604 - DNA, 20 bp, Artificial
  CRISPR gRNA sequence
tgttccctcaaatagggaaa

SEQ ID NO: 481605 - DNA, 20 bp, Artificial
  CRISPR gRNA sequence
gttccctcaaatagggaaat

SEQ ID NO: 481606 - DNA, 20 bp, Artificial
  CRISPR gRNA sequence
ttccctcaaatagggaaatt

SEQ ID NO: 481607 - DNA, 20 bp, Artificial
  CRISPR gRNA sequence
cctcaaatagggaaattttc

SEQ ID NO: 481608 - DNA, 20 bp, Artificial
  CRISPR gRNA sequence
aaatagggaaattttcttaa

SEQ ID NO: 481609 - DNA, 20 bp, Artificial
  CRISPR gRNA sequence
tcttaaatattattttcttt

SEQ ID NO: 481610 - DNA, 20 bp, Artificial
  CRISPR gRNA sequence
cttaaatattattttctttc

SEQ ID NO: 481611 - DNA, 20 bp, Artificial
  CRISPR gRNA sequence
ttaaatattattttctttct

SEQ ID NO: 481612 - DNA, 20 bp, Artificial
  CRISPR gRNA sequence
aaatattattttctttctat

SEQ ID NO: 481613 - DNA, 20 bp, Artificial
  CRISPR gRNA sequence
aatattattttctttctata

SEQ ID NO: 481614 - DNA, 20 bp, Artificial
  CRISPR gRNA sequence
ttttctttctatagtaaata

SEQ ID NO: 481615 - DNA, 20 bp, Artificial
  CRISPR gRNA sequence
tctttctatagtaaataata

SEQ ID NO: 481616 - DNA, 20 bp, Artificial
  CRISPR gRNA sequence
ctttctatagtaaataataa

SEQ ID NO: 481617 - DNA, 20 bp, Artificial
  CRISPR gRNA sequence
tttctatagtaaataataat

SEQ ID NO: 481618 - DNA, 20 bp, Artificial
  CRISPR gRNA sequence
tctatagtaaataataataa

SEQ ID NO: 481619 - DNA, 20 bp, Artificial
  CRISPR gRNA sequence
ctatagtaaataataataaa

SEQ ID NO: 481620 - DNA, 20 bp, Artificial
  CRISPR gRNA sequence
tatagtaaataataataaaa

SEQ ID NO: 481621 - DNA, 20 bp, Artificial
  CRISPR gRNA sequence
tagtaaataataataaaaat

SEQ ID NO: 481622 - DNA, 20 bp, Artificial
  CRISPR gRNA sequence
cacttgattacaataaggcc

SEQ ID NO: 481623 - DNA, 20 bp, Artificial
  CRISPR gRNA sequence
acttgattacaataaggcca

SEQ ID NO: 481624 - DNA, 20 bp, Artificial
  CRISPR gRNA sequence
gattacaataaggccaggga

SEQ ID NO: 481625 - DNA, 20 bp, Artificial
  CRISPR gRNA sequence
attacaataaggccagggag

SEQ ID NO: 481626 - DNA, 20 bp, Artificial
  CRISPR gRNA sequence
caataaggccagggagctat

SEQ ID NO: 481627 - DNA, 20 bp, Artificial
  CRISPR gRNA sequence
tgaaattatttaagataaaa

SEQ ID NO: 481628 - DNA, 20 bp, Artificial
  CRISPR gRNA sequence
tttaagataaaaatctaaat

SEQ ID NO: 481629 - DNA, 20 bp, Artificial
  CRISPR gRNA sequence
aagataaaaatctaaataat

SEQ ID NO: 481630 - DNA, 20 bp, Artificial
  CRISPR gRNA sequence
agataaaaatctaaataatt

SEQ ID NO: 481631 - DNA, 20 bp, Artificial
  CRISPR gRNA sequence
aataatttactgtgcaagta

SEQ ID NO: 481632 - DNA, 20 bp, Artificial
  CRISPR gRNA sequence
actgtgcaagtaaaacccag

SEQ ID NO: 481633 - DNA, 20 bp, Artificial
  CRISPR gRNA sequence
ctgtgcaagtaaaacccagg

SEQ ID NO: 481634 - DNA, 20 bp, Artificial
  CRISPR gRNA sequence
tgcaagtaaaacccaggttg

SEQ ID NO: 481635 - DNA, 20 bp, Artificial
  CRISPR gRNA sequence
gttaagctgtggacattgtt

SEQ ID NO: 481636 - DNA, 20 bp, Artificial
  CRISPR gRNA sequence
agctgtggacattgttcttc

SEQ ID NO: 481637 - DNA, 20 bp, Artificial
  CRISPR gRNA sequence
tggacattgttcttcctggg

SEQ ID NO: 481638 - DNA, 20 bp, Artificial
  CRISPR gRNA sequence
ttcttcctgggtaggctgga

SEQ ID NO: 481639 - DNA, 20 bp, Artificial
  CRISPR gRNA sequence
ttcctgggtaggctggataa

SEQ ID NO: 481640 - DNA, 20 bp, Artificial
  CRISPR gRNA sequence
cctgggtaggctggataaat

SEQ ID NO: 481641 - DNA, 20 bp, Artificial
  CRISPR gRNA sequence
ctgggtaggctggataaatt

SEQ ID NO: 481642 - DNA, 20 bp, Artificial
  CRISPR gRNA sequence
ggtaggctggataaattatg

SEQ ID NO: 481643 - DNA, 20 bp, Artificial
  CRISPR gRNA sequence
gataaattatgatttgaagc

SEQ ID NO: 481644 - DNA, 20 bp, Artificial
  CRISPR gRNA sequence
tgatttgaagcttaattcaa

SEQ ID NO: 481645 - DNA, 20 bp, Artificial
  CRISPR gRNA sequence
gaagcttaattcaaaagggt

SEQ ID NO: 481646 - DNA, 20 bp, Artificial
  CRISPR gRNA sequence
aagcttaattcaaaagggta

SEQ ID NO: 481647 - DNA, 20 bp, Artificial
  CRISPR gRNA sequence
aattcaaaagggtattttct

SEQ ID NO: 481648 - DNA, 20 bp, Artificial
  CRISPR gRNA sequence
attcaaaagggtattttctg

SEQ ID NO: 481649 - DNA, 20 bp, Artificial
  CRISPR gRNA sequence
aaaagggtattttctgtatg

SEQ ID NO: 481650 - DNA, 20 bp, Artificial
  CRISPR gRNA sequence
tctgtatgtgcaattgtctg

SEQ ID NO: 481651 - DNA, 20 bp, Artificial
  CRISPR gRNA sequence
ctgtatgtgcaattgtctgg

SEQ ID NO: 481652 - DNA, 20 bp, Artificial
  CRISPR gRNA sequence
tgtatgtgcaattgtctggg

SEQ ID NO: 481653 - DNA, 20 bp, Artificial
  CRISPR gRNA sequence
tatgtgcaattgtctgggaa

SEQ ID NO: 481654 - DNA, 20 bp, Artificial
  CRISPR gRNA sequence
tctgggaagtttgttttaaa

SEQ ID NO: 481655 - DNA, 20 bp, Artificial
  CRISPR gRNA sequence
ggaagtttgttttaaagcgt

SEQ ID NO: 481656 - DNA, 20 bp, Artificial
  CRISPR gRNA sequence
gttttaaagcgtttttgcta

SEQ ID NO: 481657 - DNA, 20 bp, Artificial
  CRISPR gRNA sequence
ttttaaagcgtttttgctat

SEQ ID NO: 481658 - DNA, 20 bp, Artificial
  CRISPR gRNA sequence
taaagcgtttttgctattaa

SEQ ID NO: 481659 - DNA, 20 bp, Artificial
  CRISPR gRNA sequence
aaagcgtttttgctattaac

SEQ ID NO: 481660 - DNA, 20 bp, Artificial
  CRISPR gRNA sequence
aagcgtttttgctattaaca

SEQ ID NO: 481661 - DNA, 20 bp, Artificial
  CRISPR gRNA sequence
ttgctattaacaggaatttg

SEQ ID NO: 481662 - DNA, 20 bp, Artificial
  CRISPR gRNA sequence
tgctattaacaggaatttga

SEQ ID NO: 481663 - DNA, 20 bp, Artificial
  CRISPR gRNA sequence
gctattaacaggaatttgaa

SEQ ID NO: 481664 - DNA, 20 bp, Artificial
  CRISPR gRNA sequence
ctattaacaggaatttgaag

SEQ ID NO: 481665 - DNA, 20 bp, Artificial
  CRISPR gRNA sequence
ttaacaggaatttgaagatt

SEQ ID NO: 481666 - DNA, 20 bp, Artificial
  CRISPR gRNA sequence
acaggaatttgaagattttt

SEQ ID NO: 481667 - DNA, 20 bp, Artificial
  CRISPR gRNA sequence
gaagatttttgccccatttc

SEQ ID NO: 481668 - DNA, 20 bp, Artificial
  CRISPR gRNA sequence
aagatttttgccccatttca

SEQ ID NO: 481669 - DNA, 20 bp, Artificial
  CRISPR gRNA sequence
ttgccccatttcagttgtct

SEQ ID NO: 481670 - DNA, 20 bp, Artificial
  CRISPR gRNA sequence
tgccccatttcagttgtcta

SEQ ID NO: 481671 - DNA, 20 bp, Artificial
  CRISPR gRNA sequence
gccccatttcagttgtctag

SEQ ID NO: 481672 - DNA, 20 bp, Artificial
  CRISPR gRNA sequence
ccccatttcagttgtctagc

SEQ ID NO: 481673 - DNA, 20 bp, Artificial
  CRISPR gRNA sequence
cagttgtctagcatttcaga

SEQ ID NO: 481674 - DNA, 20 bp, Artificial
  CRISPR gRNA sequence
agttgtctagcatttcagaa

SEQ ID NO: 481675 - DNA, 20 bp, Artificial
  CRISPR gRNA sequence
tctagcatttcagaaaataa

SEQ ID NO: 481676 - DNA, 20 bp, Artificial
  CRISPR gRNA sequence
gcatttcagaaaataatcaa

SEQ ID NO: 481677 - DNA, 20 bp, Artificial
  CRISPR gRNA sequence
cagaaaataatcaaaaggat

SEQ ID NO: 481678 - DNA, 20 bp, Artificial
  CRISPR gRNA sequence
agaaaataatcaaaaggata

SEQ ID NO: 481679 - DNA, 20 bp, Artificial
  CRISPR gRNA sequence
tacccttggggctaaatatt

SEQ ID NO: 481680 - DNA, 20 bp, Artificial
  CRISPR gRNA sequence
ggggctaaatatttcttaac

SEQ ID NO: 481681 - DNA, 20 bp, Artificial
  CRISPR gRNA sequence
gggctaaatatttcttaaca

SEQ ID NO: 481682 - DNA, 20 bp, Artificial
  CRISPR gRNA sequence
aatatttcttaacataaaac

SEQ ID NO: 481683 - DNA, 20 bp, Artificial
  CRISPR gRNA sequence
cttaacataaaactagtttg

SEQ ID NO: 481684 - DNA, 20 bp, Artificial
  CRISPR gRNA sequence
ttaacataaaactagtttgg

SEQ ID NO: 481685 - DNA, 20 bp, Artificial
  CRISPR gRNA sequence
aacataaaactagtttggga

SEQ ID NO: 481686 - DNA, 20 bp, Artificial
  CRISPR gRNA sequence
acataaaactagtttgggaa

SEQ ID NO: 481687 - DNA, 20 bp, Artificial
  CRISPR gRNA sequence
gtttgggaactgtggagaaa

SEQ ID NO: 481688 - DNA, 20 bp, Artificial
  CRISPR gRNA sequence
gggaactgtggagaaatcaa

SEQ ID NO: 481689 - DNA, 20 bp, Artificial
  CRISPR gRNA sequence
ggaactgtggagaaatcaaa

SEQ ID NO: 481690 - DNA, 20 bp, Artificial
  CRISPR gRNA sequence
tggagaaatcaaagtacaga

SEQ ID NO: 481691 - DNA, 20 bp, Artificial
  CRISPR gRNA sequence
gtataaacatgacaggaaag

SEQ ID NO: 481692 - DNA, 20 bp, Artificial
  CRISPR gRNA sequence
gtacaaatgtaacaggtaca

SEQ ID NO: 481693 - DNA, 20 bp, Artificial
  CRISPR gRNA sequence
tgatcttaatccaaaacggt

SEQ ID NO: 481694 - DNA, 20 bp, Artificial
  CRISPR gRNA sequence
atcttaatccaaaacggtcc

SEQ ID NO: 481695 - DNA, 20 bp, Artificial
  CRISPR gRNA sequence
aatccaaaacggtcctttga

SEQ ID NO: 481696 - DNA, 20 bp, Artificial
  CRISPR gRNA sequence
atccaaaacggtcctttgag

SEQ ID NO: 481697 - DNA, 20 bp, Artificial
  CRISPR gRNA sequence
tgagggtataaagtgcttgc

SEQ ID NO: 481698 - DNA, 20 bp, Artificial
  CRISPR gRNA sequence
gagggtataaagtgcttgcc

SEQ ID NO: 481699 - DNA, 20 bp, Artificial
  CRISPR gRNA sequence
agggtataaagtgcttgcct

SEQ ID NO: 481700 - DNA, 20 bp, Artificial
  CRISPR gRNA sequence
gcctaataaaaaccactgaa

SEQ ID NO: 481701 - DNA, 20 bp, Artificial
  CRISPR gRNA sequence
cctaataaaaaccactgaat

SEQ ID NO: 481702 - DNA, 20 bp, Artificial
  CRISPR gRNA sequence
ataaaaaccactgaattgta

SEQ ID NO: 481703 - DNA, 20 bp, Artificial
  CRISPR gRNA sequence
aattgtacacttaaaagggt

SEQ ID NO: 481704 - DNA, 20 bp, Artificial
  CRISPR gRNA sequence
tacacttaaaagggtgaatt

SEQ ID NO: 481705 - DNA, 20 bp, Artificial
  CRISPR gRNA sequence
aaaagggtgaattttatggc

SEQ ID NO: 481706 - DNA, 20 bp, Artificial
  CRISPR gRNA sequence
aaagggtgaattttatggca

SEQ ID NO: 481707 - DNA, 20 bp, Artificial
  CRISPR gRNA sequence
tatggcatgtgaattacatc

SEQ ID NO: 481708 - DNA, 20 bp, Artificial
  CRISPR gRNA sequence
atggcatgtgaattacatct

SEQ ID NO: 481709 - DNA, 20 bp, Artificial
  CRISPR gRNA sequence
tggcatgtgaattacatcta

SEQ ID NO: 481710 - DNA, 20 bp, Artificial
  CRISPR gRNA sequence
catctaaacatatactataa

SEQ ID NO: 481711 - DNA, 20 bp, Artificial
  CRISPR gRNA sequence
aacatatactataaatacaa

SEQ ID NO: 481712 - DNA, 20 bp, Artificial
  CRISPR gRNA sequence
taaatacaaattttaaaatg

SEQ ID NO: 481713 - DNA, 20 bp, Artificial
  CRISPR gRNA sequence
taaaatgctttgtatactgt

SEQ ID NO: 481714 - DNA, 20 bp, Artificial
  CRISPR gRNA sequence
aaaatgctttgtatactgta

SEQ ID NO: 481715 - DNA, 20 bp, Artificial
  CRISPR gRNA sequence
aaatgctttgtatactgtaa

SEQ ID NO: 481716 - DNA, 20 bp, Artificial
  CRISPR gRNA sequence
tgtatactgtaacctgccat

SEQ ID NO: 481717 - DNA, 20 bp, Artificial
  CRISPR gRNA sequence
gtatactgtaacctgccata

SEQ ID NO: 481718 - DNA, 20 bp, Artificial
  CRISPR gRNA sequence
tatactgtaacctgccatag

SEQ ID NO: 481719 - DNA, 20 bp, Artificial
  CRISPR gRNA sequence
taacctgccataggaatgta

SEQ ID NO: 481720 - DNA, 20 bp, Artificial
  CRISPR gRNA sequence
ccataggaatgtaaggtggg

SEQ ID NO: 481721 - DNA, 20 bp, Artificial
  CRISPR gRNA sequence
ctgtttctggctttatcatc

SEQ ID NO: 481722 - DNA, 20 bp, Artificial
  CRISPR gRNA sequence
tttctggctttatcatctct

SEQ ID NO: 481723 - DNA, 20 bp, Artificial
  CRISPR gRNA sequence
ctggctttatcatctctatc

SEQ ID NO: 481724 - DNA, 20 bp, Artificial
  CRISPR gRNA sequence
tggctttatcatctctatcc

SEQ ID NO: 481725 - DNA, 20 bp, Artificial
  CRISPR gRNA sequence
gctttatcatctctatccac

SEQ ID NO: 481726 - DNA, 20 bp, Artificial
  CRISPR gRNA sequence
tatcatctctatccaccaca

SEQ ID NO: 481727 - DNA, 20 bp, Artificial
  CRISPR gRNA sequence
atcatctctatccaccacat

SEQ ID NO: 481728 - DNA, 20 bp, Artificial
  CRISPR gRNA sequence
tcatctctatccaccacatt

SEQ ID NO: 481729 - DNA, 20 bp, Artificial
  CRISPR gRNA sequence
tatccaccacattgtggtgc

SEQ ID NO: 481730 - DNA, 20 bp, Artificial
  CRISPR gRNA sequence
tccaccacattgtggtgcat

SEQ ID NO: 481731 - DNA, 20 bp, Artificial
  CRISPR gRNA sequence
tggtgcattggccttgtggc

SEQ ID NO: 481732 - DNA, 20 bp, Artificial
  CRISPR gRNA sequence
gccttgtggcacccagccac

SEQ ID NO: 481733 - DNA, 20 bp, Artificial
  CRISPR gRNA sequence
gtggcacccagccactttga

SEQ ID NO: 481734 - DNA, 20 bp, Artificial
  CRISPR gRNA sequence
tggcacccagccactttgac

SEQ ID NO: 481735 - DNA, 20 bp, Artificial
  CRISPR gRNA sequence
tgacggggtgccacagcagg

SEQ ID NO: 481736 - DNA, 20 bp, Artificial
  CRISPR gRNA sequence
gacggggtgccacagcaggg

SEQ ID NO: 481737 - DNA, 20 bp, Artificial
  CRISPR gRNA sequence
acggggtgccacagcagggg

SEQ ID NO: 481738 - DNA, 20 bp, Artificial
  CRISPR gRNA sequence
cagagcactatattttcttt

SEQ ID NO: 481739 - DNA, 20 bp, Artificial
  CRISPR gRNA sequence
tattttcttttgctccattc

SEQ ID NO: 481740 - DNA, 20 bp, Artificial
  CRISPR gRNA sequence
tcttttgctccattcatttt

SEQ ID NO: 481741 - DNA, 20 bp, Artificial
  CRISPR gRNA sequence
cttttgctccattcatttta

SEQ ID NO: 481742 - DNA, 20 bp, Artificial
  CRISPR gRNA sequence
ttttgctccattcattttaa

SEQ ID NO: 481743 - DNA, 20 bp, Artificial
  CRISPR gRNA sequence
ttgctccattcattttaaca

SEQ ID NO: 481744 - DNA, 20 bp, Artificial
  CRISPR gRNA sequence
tgctccattcattttaacaa

SEQ ID NO: 481745 - DNA, 20 bp, Artificial
  CRISPR gRNA sequence
gctccattcattttaacaaa

SEQ ID NO: 481746 - DNA, 20 bp, Artificial
  CRISPR gRNA sequence
ctccattcattttaacaaaa

SEQ ID NO: 481747 - DNA, 20 bp, Artificial
  CRISPR gRNA sequence
cattcattttaacaaaattt

SEQ ID NO: 481748 - DNA, 20 bp, Artificial
  CRISPR gRNA sequence
attttaacaaaatttttcat

SEQ ID NO: 481749 - DNA, 20 bp, Artificial
  CRISPR gRNA sequence
taacaaaatttttcatggaa

SEQ ID NO: 481750 - DNA, 20 bp, Artificial
  CRISPR gRNA sequence
aacaaaatttttcatggaaa

SEQ ID NO: 481751 - DNA, 20 bp, Artificial
  CRISPR gRNA sequence
acaaaatttttcatggaaat

SEQ ID NO: 481752 - DNA, 20 bp, Artificial
  CRISPR gRNA sequence
ttcatggaaatgagccattt

SEQ ID NO: 481753 - DNA, 20 bp, Artificial
  CRISPR gRNA sequence
tcatggaaatgagccatttc

SEQ ID NO: 481754 - DNA, 20 bp, Artificial
  CRISPR gRNA sequence
catggaaatgagccatttct

SEQ ID NO: 481755 - DNA, 20 bp, Artificial
  CRISPR gRNA sequence
atggaaatgagccatttctt

SEQ ID NO: 481756 - DNA, 20 bp, Artificial
  CRISPR gRNA sequence
cttgggatgagagacaggga

SEQ ID NO: 481757 - DNA, 20 bp, Artificial
  CRISPR gRNA sequence
ttgggatgagagacagggaa

SEQ ID NO: 481758 - DNA, 20 bp, Artificial
  CRISPR gRNA sequence
gggatgagagacagggaacc

SEQ ID NO: 481759 - DNA, 20 bp, Artificial
  CRISPR gRNA sequence
ggatgagagacagggaaccc

SEQ ID NO: 481760 - DNA, 20 bp, Artificial
  CRISPR gRNA sequence
acaggcttaaacagattgaa

SEQ ID NO: 481761 - DNA, 20 bp, Artificial
  CRISPR gRNA sequence
aaacagattgaaaagtatca

SEQ ID NO: 481762 - DNA, 20 bp, Artificial
  CRISPR gRNA sequence
aacagattgaaaagtatcac

SEQ ID NO: 481763 - DNA, 20 bp, Artificial
  CRISPR gRNA sequence
aaaagtatcacaggatcttt

SEQ ID NO: 481764 - DNA, 20 bp, Artificial
  CRISPR gRNA sequence
tgttgatatattgaggacta

SEQ ID NO: 481765 - DNA, 20 bp, Artificial
  CRISPR gRNA sequence
gttgatatattgaggactaa

SEQ ID NO: 481766 - DNA, 20 bp, Artificial
  CRISPR gRNA sequence
ttgatatattgaggactaaa

SEQ ID NO: 481767 - DNA, 20 bp, Artificial
  CRISPR gRNA sequence
atatattgaggactaaaggc

SEQ ID NO: 481768 - DNA, 20 bp, Artificial
  CRISPR gRNA sequence
aggactaaaggctatttttc

SEQ ID NO: 481769 - DNA, 20 bp, Artificial
  CRISPR gRNA sequence
aaggctatttttcagttcac

SEQ ID NO: 481770 - DNA, 20 bp, Artificial
  CRISPR gRNA sequence
tttttcagttcacttgacag

SEQ ID NO: 481771 - DNA, 20 bp, Artificial
  CRISPR gRNA sequence
ttcagttcacttgacagtct

SEQ ID NO: 481772 - DNA, 20 bp, Artificial
  CRISPR gRNA sequence
tcagttcacttgacagtctt

SEQ ID NO: 481773 - DNA, 20 bp, Artificial
  CRISPR gRNA sequence
cagttcacttgacagtcttc

SEQ ID NO: 481774 - DNA, 20 bp, Artificial
  CRISPR gRNA sequence
agttcacttgacagtcttct

SEQ ID NO: 481775 - DNA, 20 bp, Artificial
  CRISPR gRNA sequence
acttgacagtcttctttagt

SEQ ID NO: 481776 - DNA, 20 bp, Artificial
  CRISPR gRNA sequence
gacagtcttctttagtgtgc

SEQ ID NO: 481777 - DNA, 20 bp, Artificial
  CRISPR gRNA sequence
acagtcttctttagtgtgcc

SEQ ID NO: 481778 - DNA, 20 bp, Artificial
  CRISPR gRNA sequence
ctttagtgtgccacctactg

SEQ ID NO: 481779 - DNA, 20 bp, Artificial
  CRISPR gRNA sequence
tttagtgtgccacctactga

SEQ ID NO: 481780 - DNA, 20 bp, Artificial
  CRISPR gRNA sequence
tagtgtgccacctactgacc

SEQ ID NO: 481781 - DNA, 20 bp, Artificial
  CRISPR gRNA sequence
agtgtgccacctactgacct

SEQ ID NO: 481782 - DNA, 20 bp, Artificial
  CRISPR gRNA sequence
gtgtgccacctactgacctc

SEQ ID NO: 481783 - DNA, 20 bp, Artificial
  CRISPR gRNA sequence
ctgacctcaaccaggctctt

SEQ ID NO: 481784 - DNA, 20 bp, Artificial
  CRISPR gRNA sequence
acctcaaccaggctcttttc

SEQ ID NO: 481785 - DNA, 20 bp, Artificial
  CRISPR gRNA sequence
aaccaggctcttttcagtgg

SEQ ID NO: 481786 - DNA, 20 bp, Artificial
  CRISPR gRNA sequence
ttttcagtggagttgggagt

SEQ ID NO: 481787 - DNA, 20 bp, Artificial
  CRISPR gRNA sequence
ttcagtggagttgggagtac

SEQ ID NO: 481788 - DNA, 20 bp, Artificial
  CRISPR gRNA sequence
tcagtggagttgggagtact

SEQ ID NO: 481789 - DNA, 20 bp, Artificial
  CRISPR gRNA sequence
cagtggagttgggagtactt

SEQ ID NO: 481790 - DNA, 20 bp, Artificial
  CRISPR gRNA sequence
agtggagttgggagtacttt

SEQ ID NO: 481791 - DNA, 20 bp, Artificial
  CRISPR gRNA sequence
ggagtactttttatcttagc

SEQ ID NO: 481792 - DNA, 20 bp, Artificial
  CRISPR gRNA sequence
tttatcttagccaagcagcc

SEQ ID NO: 481793 - DNA, 20 bp, Artificial
  CRISPR gRNA sequence
ttatcttagccaagcagcct

SEQ ID NO: 481794 - DNA, 20 bp, Artificial
  CRISPR gRNA sequence
tatcttagccaagcagcctc

SEQ ID NO: 481795 - DNA, 20 bp, Artificial
  CRISPR gRNA sequence
atcttagccaagcagcctct

SEQ ID NO: 481796 - DNA, 20 bp, Artificial
  CRISPR gRNA sequence
tcttagccaagcagcctctg

SEQ ID NO: 481797 - DNA, 20 bp, Artificial
  CRISPR gRNA sequence
agccaagcagcctctgcctc

SEQ ID NO: 481798 - DNA, 20 bp, Artificial
  CRISPR gRNA sequence
gccaagcagcctctgcctct

SEQ ID NO: 481799 - DNA, 20 bp, Artificial
  CRISPR gRNA sequence
tgcctctttcagtcgctcag

SEQ ID NO: 481800 - DNA, 20 bp, Artificial
  CRISPR gRNA sequence
cctctttcagtcgctcagcc

SEQ ID NO: 481801 - DNA, 20 bp, Artificial
  CRISPR gRNA sequence
tttcagtcgctcagccttac

SEQ ID NO: 481802 - DNA, 20 bp, Artificial
  CRISPR gRNA sequence
tcagtcgctcagccttactg

SEQ ID NO: 481803 - DNA, 20 bp, Artificial
  CRISPR gRNA sequence
cagtcgctcagccttactgt

SEQ ID NO: 481804 - DNA, 20 bp, Artificial
  CRISPR gRNA sequence
agtcgctcagccttactgtt

SEQ ID NO: 481805 - DNA, 20 bp, Artificial
  CRISPR gRNA sequence
agccttactgttatttttgg

SEQ ID NO: 481806 - DNA, 20 bp, Artificial
  CRISPR gRNA sequence
actgttatttttgggcagcc

SEQ ID NO: 481807 - DNA, 20 bp, Artificial
  CRISPR gRNA sequence
ctgttatttttgggcagcca

SEQ ID NO: 481808 - DNA, 20 bp, Artificial
  CRISPR gRNA sequence
ttatttttgggcagccacca

SEQ ID NO: 481809 - DNA, 20 bp, Artificial
  CRISPR gRNA sequence
tttttgggcagccaccacat

SEQ ID NO: 481810 - DNA, 20 bp, Artificial
  CRISPR gRNA sequence
ttgggcagccaccacatcag

SEQ ID NO: 481811 - DNA, 20 bp, Artificial
  CRISPR gRNA sequence
tgggcagccaccacatcaga

SEQ ID NO: 481812 - DNA, 20 bp, Artificial
  CRISPR gRNA sequence
gggcagccaccacatcagag

SEQ ID NO: 481813 - DNA, 20 bp, Artificial
  CRISPR gRNA sequence
ggcagccaccacatcagagg

SEQ ID NO: 481814 - DNA, 20 bp, Artificial
  CRISPR gRNA sequence
tatcaggaattcttacatag

SEQ ID NO: 481815 - DNA, 20 bp, Artificial
  CRISPR gRNA sequence
ttacatagcttctcagggta

SEQ ID NO: 481816 - DNA, 20 bp, Artificial
  CRISPR gRNA sequence
acatagcttctcagggtaaa

SEQ ID NO: 481817 - DNA, 20 bp, Artificial
  CRISPR gRNA sequence
catagcttctcagggtaaag

SEQ ID NO: 481818 - DNA, 20 bp, Artificial
  CRISPR gRNA sequence
ctcagggtaaagccagacat

SEQ ID NO: 481819 - DNA, 20 bp, Artificial
  CRISPR gRNA sequence
tcagggtaaagccagacatg

SEQ ID NO: 481820 - DNA, 20 bp, Artificial
  CRISPR gRNA sequence
agggtaaagccagacatgct

SEQ ID NO: 481821 - DNA, 20 bp, Artificial
  CRISPR gRNA sequence
gcatgatagagctctgccaa

SEQ ID NO: 481822 - DNA, 20 bp, Artificial
  CRISPR gRNA sequence
catgatagagctctgccaag

SEQ ID NO: 481823 - DNA, 20 bp, Artificial
  CRISPR gRNA sequence
tgccaaggaaatctgccata

SEQ ID NO: 481824 - DNA, 20 bp, Artificial
  CRISPR gRNA sequence
ccaaggaaatctgccataga

SEQ ID NO: 481825 - DNA, 20 bp, Artificial
  CRISPR gRNA sequence
ccatagacatcctactgcac

SEQ ID NO: 481826 - DNA, 20 bp, Artificial
  CRISPR gRNA sequence
ctgcacacatcacaatgagg

SEQ ID NO: 481827 - DNA, 20 bp, Artificial
  CRISPR gRNA sequence
cacacatcacaatgaggatg

SEQ ID NO: 481828 - DNA, 20 bp, Artificial
  CRISPR gRNA sequence
actttcaaagacagtggact

SEQ ID NO: 481829 - DNA, 20 bp, Artificial
  CRISPR gRNA sequence
tcaaagacagtggacttgat

SEQ ID NO: 481830 - DNA, 20 bp, Artificial
  CRISPR gRNA sequence
caaagacagtggacttgata

SEQ ID NO: 481831 - DNA, 20 bp, Artificial
  CRISPR gRNA sequence
aaagacagtggacttgatac

SEQ ID NO: 481832 - DNA, 20 bp, Artificial
  CRISPR gRNA sequence
gataccttaaaggagttagg

SEQ ID NO: 481833 - DNA, 20 bp, Artificial
  CRISPR gRNA sequence
ataccttaaaggagttaggc

SEQ ID NO: 481834 - DNA, 20 bp, Artificial
  CRISPR gRNA sequence
aaaggagttaggccagatgt

SEQ ID NO: 481835 - DNA, 20 bp, Artificial
  CRISPR gRNA sequence
aaggagttaggccagatgtc

SEQ ID NO: 481836 - DNA, 20 bp, Artificial
  CRISPR gRNA sequence
ggccagatgtcaagaacgga

SEQ ID NO: 481837 - DNA, 20 bp, Artificial
  CRISPR gRNA sequence
gaatttaaaaaactgaaata

SEQ ID NO: 481838 - DNA, 20 bp, Artificial
  CRISPR gRNA sequence
aatttaaaaaactgaaatag

SEQ ID NO: 481839 - DNA, 20 bp, Artificial
  CRISPR gRNA sequence
aaaaaactgaaatagcccct

SEQ ID NO: 481840 - DNA, 20 bp, Artificial
  CRISPR gRNA sequence
aaaaactgaaatagccccta

SEQ ID NO: 481841 - DNA, 20 bp, Artificial
  CRISPR gRNA sequence
aaatagcccctagaatgaac

SEQ ID NO: 481842 - DNA, 20 bp, Artificial
  CRISPR gRNA sequence
gaatgaacacatcttctttg

SEQ ID NO: 481843 - DNA, 20 bp, Artificial
  CRISPR gRNA sequence
ctttgtcaggtgaacctttg

SEQ ID NO: 481844 - DNA, 20 bp, Artificial
  CRISPR gRNA sequence
tttgtcaggtgaacctttgt

SEQ ID NO: 481845 - DNA, 20 bp, Artificial
  CRISPR gRNA sequence
tgtcaggtgaacctttgtat

SEQ ID NO: 481846 - DNA, 20 bp, Artificial
  CRISPR gRNA sequence
gtcaggtgaacctttgtata

SEQ ID NO: 481847 - DNA, 20 bp, Artificial
  CRISPR gRNA sequence
tcaggtgaacctttgtatag

SEQ ID NO: 481848 - DNA, 20 bp, Artificial
  CRISPR gRNA sequence
tgtataggtaggagcggcta

SEQ ID NO: 481849 - DNA, 20 bp, Artificial
  CRISPR gRNA sequence
gtataggtaggagcggctaa

SEQ ID NO: 481850 - DNA, 20 bp, Artificial
  CRISPR gRNA sequence
tataggtaggagcggctaat

SEQ ID NO: 481851 - DNA, 20 bp, Artificial
  CRISPR gRNA sequence
ataaataactgaagagtgag

SEQ ID NO: 481852 - DNA, 20 bp, Artificial
  CRISPR gRNA sequence
aagagtgagaaaacatcagg

SEQ ID NO: 481853 - DNA, 20 bp, Artificial
  CRISPR gRNA sequence
attttactttttgtttttac

SEQ ID NO: 481854 - DNA, 20 bp, Artificial
  CRISPR gRNA sequence
tactttttgtttttacaaat

SEQ ID NO: 481855 - DNA, 20 bp, Artificial
  CRISPR gRNA sequence
actttttgtttttacaaatt

SEQ ID NO: 481856 - DNA, 20 bp, Artificial
  CRISPR gRNA sequence
ctttttgtttttacaaattc

SEQ ID NO: 481857 - DNA, 20 bp, Artificial
  CRISPR gRNA sequence
tttgtttttacaaattcacc

SEQ ID NO: 481858 - DNA, 20 bp, Artificial
  CRISPR gRNA sequence
ttgtttttacaaattcacct

SEQ ID NO: 481859 - DNA, 20 bp, Artificial
  CRISPR gRNA sequence
tgtttttacaaattcacctc

SEQ ID NO: 481860 - DNA, 20 bp, Artificial
  CRISPR gRNA sequence
gtttttacaaattcacctct

SEQ ID NO: 481861 - DNA, 20 bp, Artificial
  CRISPR gRNA sequence
tttttacaaattcacctctt

SEQ ID NO: 481862 - DNA, 20 bp, Artificial
  CRISPR gRNA sequence
ttacaaattcacctctttct

SEQ ID NO: 481863 - DNA, 20 bp, Artificial
  CRISPR gRNA sequence
tacaaattcacctctttctt

SEQ ID NO: 481864 - DNA, 20 bp, Artificial
  CRISPR gRNA sequence
acaaattcacctctttctta

SEQ ID NO: 481865 - DNA, 20 bp, Artificial
  CRISPR gRNA sequence
caaattcacctctttcttag

SEQ ID NO: 481866 - DNA, 20 bp, Artificial
  CRISPR gRNA sequence
acctctttcttagaagctct

SEQ ID NO: 481867 - DNA, 20 bp, Artificial
  CRISPR gRNA sequence
tttcttagaagctctaagat

SEQ ID NO: 481868 - DNA, 20 bp, Artificial
  CRISPR gRNA sequence
tcttagaagctctaagatat

SEQ ID NO: 481869 - DNA, 20 bp, Artificial
  CRISPR gRNA sequence
cttagaagctctaagatatt

SEQ ID NO: 481870 - DNA, 20 bp, Artificial
  CRISPR gRNA sequence
ttagaagctctaagatattt

SEQ ID NO: 481871 - DNA, 20 bp, Artificial
  CRISPR gRNA sequence
agaagctctaagatatttgg

SEQ ID NO: 481872 - DNA, 20 bp, Artificial
  CRISPR gRNA sequence
gaagctctaagatatttggc

SEQ ID NO: 481873 - DNA, 20 bp, Artificial
  CRISPR gRNA sequence
taagatatttggctatattt

SEQ ID NO: 481874 - DNA, 20 bp, Artificial
  CRISPR gRNA sequence
agatatttggctatatttga

SEQ ID NO: 481875 - DNA, 20 bp, Artificial
  CRISPR gRNA sequence
ggctatatttgaaacggtaa

SEQ ID NO: 481876 - DNA, 20 bp, Artificial
  CRISPR gRNA sequence
gctatatttgaaacggtaag

SEQ ID NO: 481877 - DNA, 20 bp, Artificial
  CRISPR gRNA sequence
tatttgaaacggtaagaatt

SEQ ID NO: 481878 - DNA, 20 bp, Artificial
  CRISPR gRNA sequence
gaaacggtaagaattttctt

SEQ ID NO: 481879 - DNA, 20 bp, Artificial
  CRISPR gRNA sequence
aaacggtaagaattttcttg

SEQ ID NO: 481880 - DNA, 20 bp, Artificial
  CRISPR gRNA sequence
tcttgccgggagtggtggct

SEQ ID NO: 481881 - DNA, 20 bp, Artificial
  CRISPR gRNA sequence
cttgccgggagtggtggctc

SEQ ID NO: 481882 - DNA, 20 bp, Artificial
  CRISPR gRNA sequence
ttgccgggagtggtggctca

SEQ ID NO: 481883 - DNA, 20 bp, Artificial
  CRISPR gRNA sequence
gccgggagtggtggctcacg

SEQ ID NO: 481884 - DNA, 20 bp, Artificial
  CRISPR gRNA sequence
ccgggagtggtggctcacgt

SEQ ID NO: 481885 - DNA, 20 bp, Artificial
  CRISPR gRNA sequence
acgtctataatcctcgcact

SEQ ID NO: 481886 - DNA, 20 bp, Artificial
  CRISPR gRNA sequence
taatcctcgcactttgggag

SEQ ID NO: 481887 - DNA, 20 bp, Artificial
  CRISPR gRNA sequence
gcactttgggaggccgaggc

SEQ ID NO: 481888 - DNA, 20 bp, Artificial
  CRISPR gRNA sequence
tgggaggccgaggcgggcgg

SEQ ID NO: 481889 - DNA, 20 bp, Artificial
  CRISPR gRNA sequence
gggaggccgaggcgggcgga

SEQ ID NO: 481890 - DNA, 20 bp, Artificial
  CRISPR gRNA sequence
ggaggccgaggcgggcggat

SEQ ID NO: 481891 - DNA, 20 bp, Artificial
  CRISPR gRNA sequence
gctaaaatggtgaaaccccg

SEQ ID NO: 481892 - DNA, 20 bp, Artificial
  CRISPR gRNA sequence
aaatggtgaaaccccgtctc

SEQ ID NO: 481893 - DNA, 20 bp, Artificial
  CRISPR gRNA sequence
tactaaaaatacaaaaaaaa

SEQ ID NO: 481894 - DNA, 20 bp, Artificial
  CRISPR gRNA sequence
ctaaaaatacaaaaaaaaat

SEQ ID NO: 481895 - DNA, 20 bp, Artificial
  CRISPR gRNA sequence
aaaatacaaaaaaaaattag

SEQ ID NO: 481896 - DNA, 20 bp, Artificial
  CRISPR gRNA sequence
gccgggcgaggtggcgggcg

SEQ ID NO: 481897 - DNA, 20 bp, Artificial
  CRISPR gRNA sequence
tagtcccagctactcgggag

SEQ ID NO: 481898 - DNA, 20 bp, Artificial
  CRISPR gRNA sequence
ctcgggaggctgaggcagga

SEQ ID NO: 481899 - DNA, 20 bp, Artificial
  CRISPR gRNA sequence
gggaggctgaggcaggagaa

SEQ ID NO: 481900 - DNA, 20 bp, Artificial
  CRISPR gRNA sequence
aggcaggagaatggcgtgaa

SEQ ID NO: 481901 - DNA, 20 bp, Artificial
  CRISPR gRNA sequence
gcggtgagccgagatcgcac

SEQ ID NO: 481902 - DNA, 20 bp, Artificial
  CRISPR gRNA sequence
cggtgagccgagatcgcacc

SEQ ID NO: 481903 - DNA, 20 bp, Artificial
  CRISPR gRNA sequence
cactccagcctgggctatag

SEQ ID NO: 481904 - DNA, 20 bp, Artificial
  CRISPR gRNA sequence
cagcctgggctataggcaag

SEQ ID NO: 481905 - DNA, 20 bp, Artificial
  CRISPR gRNA sequence
ggctataggcaagactccgt

SEQ ID NO: 481906 - DNA, 20 bp, Artificial
  CRISPR gRNA sequence
taggcaagactccgtctcaa

SEQ ID NO: 481907 - DNA, 20 bp, Artificial
  CRISPR gRNA sequence
cgtctcaaaaaaaaaaaaaa

SEQ ID NO: 481908 - DNA, 20 bp, Artificial
  CRISPR gRNA sequence
aaaaaaaaaaaaaaaaaaga

SEQ ID NO: 481909 - DNA, 20 bp, Artificial
  CRISPR gRNA sequence
tcttttgataggaataacaa

SEQ ID NO: 481910 - DNA, 20 bp, Artificial
  CRISPR gRNA sequence
cttttgataggaataacaac

SEQ ID NO: 481911 - DNA, 20 bp, Artificial
  CRISPR gRNA sequence
ttttgataggaataacaact

SEQ ID NO: 481912 - DNA, 20 bp, Artificial
  CRISPR gRNA sequence
ttgataggaataacaactgg

SEQ ID NO: 481913 - DNA, 20 bp, Artificial
  CRISPR gRNA sequence
tgataggaataacaactgga

SEQ ID NO: 481914 - DNA, 20 bp, Artificial
  CRISPR gRNA sequence
gataggaataacaactggaa

SEQ ID NO: 481915 - DNA, 20 bp, Artificial
  CRISPR gRNA sequence
ataggaataacaactggaat

SEQ ID NO: 481916 - DNA, 20 bp, Artificial
  CRISPR gRNA sequence
gaatactgttttggaacttt

SEQ ID NO: 481917 - DNA, 20 bp, Artificial
  CRISPR gRNA sequence
ttttggaactttttctaagc

SEQ ID NO: 481918 - DNA, 20 bp, Artificial
  CRISPR gRNA sequence
tggaactttttctaagcttt

SEQ ID NO: 481919 - DNA, 20 bp, Artificial
  CRISPR gRNA sequence
ggaactttttctaagcttta

SEQ ID NO: 481920 - DNA, 20 bp, Artificial
  CRISPR gRNA sequence
gaactttttctaagctttat

SEQ ID NO: 481921 - DNA, 20 bp, Artificial
  CRISPR gRNA sequence
tttctaagctttatctttcc

SEQ ID NO: 481922 - DNA, 20 bp, Artificial
  CRISPR gRNA sequence
ttctaagctttatctttcca

SEQ ID NO: 481923 - DNA, 20 bp, Artificial
  CRISPR gRNA sequence
tctaagctttatctttccaa

SEQ ID NO: 481924 - DNA, 20 bp, Artificial
  CRISPR gRNA sequence
ctaagctttatctttccaaa

SEQ ID NO: 481925 - DNA, 20 bp, Artificial
  CRISPR gRNA sequence
taagctttatctttccaaaa

SEQ ID NO: 481926 - DNA, 20 bp, Artificial
  CRISPR gRNA sequence
agctttatctttccaaaact

SEQ ID NO: 481927 - DNA, 20 bp, Artificial
  CRISPR gRNA sequence
tatctttccaaaactgacat

SEQ ID NO: 481928 - DNA, 20 bp, Artificial
  CRISPR gRNA sequence
atctttccaaaactgacatc

SEQ ID NO: 481929 - DNA, 20 bp, Artificial
  CRISPR gRNA sequence
tctttccaaaactgacatca

SEQ ID NO: 481930 - DNA, 20 bp, Artificial
  CRISPR gRNA sequence
tccaaaactgacatcaattt

SEQ ID NO: 481931 - DNA, 20 bp, Artificial
  CRISPR gRNA sequence
ccaaaactgacatcaatttt

SEQ ID NO: 481932 - DNA, 20 bp, Artificial
  CRISPR gRNA sequence
caaaactgacatcaattttt

SEQ ID NO: 481933 - DNA, 20 bp, Artificial
  CRISPR gRNA sequence
acatcaattttttaatttaa

SEQ ID NO: 481934 - DNA, 20 bp, Artificial
  CRISPR gRNA sequence
tttaatttaaggtctcaaat

SEQ ID NO: 481935 - DNA, 20 bp, Artificial
  CRISPR gRNA sequence
ttaatttaaggtctcaaatt

SEQ ID NO: 481936 - DNA, 20 bp, Artificial
  CRISPR gRNA sequence
taatttaaggtctcaaatta

SEQ ID NO: 481937 - DNA, 20 bp, Artificial
  CRISPR gRNA sequence
aatttaaggtctcaaattat

SEQ ID NO: 481938 - DNA, 20 bp, Artificial
  CRISPR gRNA sequence
atttaaggtctcaaattata

SEQ ID NO: 481939 - DNA, 20 bp, Artificial
  CRISPR gRNA sequence
aaggtctcaaattataataa

SEQ ID NO: 481940 - DNA, 20 bp, Artificial
  CRISPR gRNA sequence
aggtctcaaattataataat

SEQ ID NO: 481941 - DNA, 20 bp, Artificial
  CRISPR gRNA sequence
aaattataataatatatctt

SEQ ID NO: 481942 - DNA, 20 bp, Artificial
  CRISPR gRNA sequence
taataatatatcttggctaa

SEQ ID NO: 481943 - DNA, 20 bp, Artificial
  CRISPR gRNA sequence
ggctaactcataatatttat

SEQ ID NO: 481944 - DNA, 20 bp, Artificial
  CRISPR gRNA sequence
gctaactcataatatttatt

SEQ ID NO: 481945 - DNA, 20 bp, Artificial
  CRISPR gRNA sequence
actcataatatttattgttt

SEQ ID NO: 481946 - DNA, 20 bp, Artificial
  CRISPR gRNA sequence
ataatatttattgtttctgc

SEQ ID NO: 481947 - DNA, 20 bp, Artificial
  CRISPR gRNA sequence
attgtttctgccctcttagg

SEQ ID NO: 481948 - DNA, 20 bp, Artificial
  CRISPR gRNA sequence
ttgtttctgccctcttaggg

SEQ ID NO: 481949 - DNA, 20 bp, Artificial
  CRISPR gRNA sequence
tttctgccctcttagggggt

SEQ ID NO: 481950 - DNA, 20 bp, Artificial
  CRISPR gRNA sequence
ctgccctcttagggggtatt

SEQ ID NO: 481951 - DNA, 20 bp, Artificial
  CRISPR gRNA sequence
tgccctcttagggggtattt

SEQ ID NO: 481952 - DNA, 20 bp, Artificial
  CRISPR gRNA sequence
ccctcttagggggtatttgt

SEQ ID NO: 481953 - DNA, 20 bp, Artificial
  CRISPR gRNA sequence
ttagggggtatttgttctgc

SEQ ID NO: 481954 - DNA, 20 bp, Artificial
  CRISPR gRNA sequence
agggggtatttgttctgctt

SEQ ID NO: 481955 - DNA, 20 bp, Artificial
  CRISPR gRNA sequence
gggggtatttgttctgcttt

SEQ ID NO: 481956 - DNA, 20 bp, Artificial
  CRISPR gRNA sequence
gttctgctttatccttaatc

SEQ ID NO: 481957 - DNA, 20 bp, Artificial
  CRISPR gRNA sequence
ttctgctttatccttaatct

SEQ ID NO: 481958 - DNA, 20 bp, Artificial
  CRISPR gRNA sequence
tgctttatccttaatctttt

SEQ ID NO: 481959 - DNA, 20 bp, Artificial
  CRISPR gRNA sequence
ctttatccttaatcttttta

SEQ ID NO: 481960 - DNA, 20 bp, Artificial
  CRISPR gRNA sequence
tatccttaatctttttattc

SEQ ID NO: 481961 - DNA, 20 bp, Artificial
  CRISPR gRNA sequence
atccttaatctttttattct

SEQ ID NO: 481962 - DNA, 20 bp, Artificial
  CRISPR gRNA sequence
tccttaatctttttattcta

SEQ ID NO: 481963 - DNA, 20 bp, Artificial
  CRISPR gRNA sequence
aatctttttattctaaactg

SEQ ID NO: 481964 - DNA, 20 bp, Artificial
  CRISPR gRNA sequence
atctttttattctaaactgc

SEQ ID NO: 481965 - DNA, 20 bp, Artificial
  CRISPR gRNA sequence
tttattctaaactgcattaa

SEQ ID NO: 481966 - DNA, 20 bp, Artificial
  CRISPR gRNA sequence
ttattctaaactgcattaaa

SEQ ID NO: 481967 - DNA, 20 bp, Artificial
  CRISPR gRNA sequence
tattctaaactgcattaaat

SEQ ID NO: 481968 - DNA, 20 bp, Artificial
  CRISPR gRNA sequence
attctaaactgcattaaata

SEQ ID NO: 481969 - DNA, 20 bp, Artificial
  CRISPR gRNA sequence
ttctaaactgcattaaatac

SEQ ID NO: 481970 - DNA, 20 bp, Artificial
  CRISPR gRNA sequence
taaactgcattaaatactat

SEQ ID NO: 481971 - DNA, 20 bp, Artificial
  CRISPR gRNA sequence
aactgcattaaatactattc

SEQ ID NO: 481972 - DNA, 20 bp, Artificial
  CRISPR gRNA sequence
cattaaatactattcatcat

SEQ ID NO: 481973 - DNA, 20 bp, Artificial
  CRISPR gRNA sequence
aatactattcatcatgttat

SEQ ID NO: 481974 - DNA, 20 bp, Artificial
  CRISPR gRNA sequence
ttcatcatgttataaactgc

SEQ ID NO: 481975 - DNA, 20 bp, Artificial
  CRISPR gRNA sequence
atcatgttataaactgcctg

SEQ ID NO: 481976 - DNA, 20 bp, Artificial
  CRISPR gRNA sequence
taaactgcctgaagttttca

SEQ ID NO: 481977 - DNA, 20 bp, Artificial
  CRISPR gRNA sequence
cctgaagttttcataggata

SEQ ID NO: 481978 - DNA, 20 bp, Artificial
  CRISPR gRNA sequence
aagttttcataggatatttt

SEQ ID NO: 481979 - DNA, 20 bp, Artificial
  CRISPR gRNA sequence
tcataggatattttttgctt

SEQ ID NO: 481980 - DNA, 20 bp, Artificial
  CRISPR gRNA sequence
cataggatattttttgcttt

SEQ ID NO: 481981 - DNA, 20 bp, Artificial
  CRISPR gRNA sequence
ataggatattttttgctttt

SEQ ID NO: 481982 - DNA, 20 bp, Artificial
  CRISPR gRNA sequence
tttgctttttccatcaattt

SEQ ID NO: 481983 - DNA, 20 bp, Artificial
  CRISPR gRNA sequence
ttgctttttccatcaatttg

SEQ ID NO: 481984 - DNA, 20 bp, Artificial
  CRISPR gRNA sequence
tgctttttccatcaatttgg

SEQ ID NO: 481985 - DNA, 20 bp, Artificial
  CRISPR gRNA sequence
gctttttccatcaatttggg

SEQ ID NO: 481986 - DNA, 20 bp, Artificial
  CRISPR gRNA sequence
ctttttccatcaatttgggc

SEQ ID NO: 481987 - DNA, 20 bp, Artificial
  CRISPR gRNA sequence
tttccatcaatttgggctat

SEQ ID NO: 481988 - DNA, 20 bp, Artificial
  CRISPR gRNA sequence
ttccatcaatttgggctatg

SEQ ID NO: 481989 - DNA, 20 bp, Artificial
  CRISPR gRNA sequence
tccatcaatttgggctatgc

SEQ ID NO: 481990 - DNA, 20 bp, Artificial
  CRISPR gRNA sequence
ccatcaatttgggctatgct

SEQ ID NO: 481991 - DNA, 20 bp, Artificial
  CRISPR gRNA sequence
catcaatttgggctatgctt

SEQ ID NO: 481992 - DNA, 20 bp, Artificial
  CRISPR gRNA sequence
gggctatgctttttatcttg

SEQ ID NO: 481993 - DNA, 20 bp, Artificial
  CRISPR gRNA sequence
ggctatgctttttatcttga

SEQ ID NO: 481994 - DNA, 20 bp, Artificial
  CRISPR gRNA sequence
tgctttttatcttgaagggg

SEQ ID NO: 481995 - DNA, 20 bp, Artificial
  CRISPR gRNA sequence
tttatcttgaagggggatta

SEQ ID NO: 481996 - DNA, 20 bp, Artificial
  CRISPR gRNA sequence
ttatcttgaagggggattaa

SEQ ID NO: 481997 - DNA, 20 bp, Artificial
  CRISPR gRNA sequence
tatcttgaagggggattaaa

SEQ ID NO: 481998 - DNA, 20 bp, Artificial
  CRISPR gRNA sequence
atcttgaagggggattaaaa

SEQ ID NO: 481999 - DNA, 20 bp, Artificial
  CRISPR gRNA sequence
tcttgaagggggattaaaaa

SEQ ID NO: 482000 - DNA, 20 bp, Artificial
  CRISPR gRNA sequence
gaagggggattaaaaaatgt

SEQ ID NO: 482001 - DNA, 20 bp, Artificial
  CRISPR gRNA sequence
aagggggattaaaaaatgtt

SEQ ID NO: 482002 - DNA, 20 bp, Artificial
  CRISPR gRNA sequence
aaaaatgttctgtgacctca

SEQ ID NO: 482003 - DNA, 20 bp, Artificial
  CRISPR gRNA sequence
tgtgacctcaaaagtgacca

SEQ ID NO: 482004 - DNA, 20 bp, Artificial
  CRISPR gRNA sequence
tgacctcaaaagtgaccagt

SEQ ID NO: 482005 - DNA, 20 bp, Artificial
  CRISPR gRNA sequence
aaaagtgaccagtaataaag

SEQ ID NO: 482006 - DNA, 20 bp, Artificial
  CRISPR gRNA sequence
tttaggggtgacatagtgat

SEQ ID NO: 482007 - DNA, 20 bp, Artificial
  CRISPR gRNA sequence
aggggtgacatagtgattct

SEQ ID NO: 482008 - DNA, 20 bp, Artificial
  CRISPR gRNA sequence
ggggtgacatagtgattctc

SEQ ID NO: 482009 - DNA, 20 bp, Artificial
  CRISPR gRNA sequence
tcaagcctttcatcctttaa

SEQ ID NO: 482010 - DNA, 20 bp, Artificial
  CRISPR gRNA sequence
aagcctttcatcctttaata

SEQ ID NO: 482011 - DNA, 20 bp, Artificial
  CRISPR gRNA sequence
tcatcctttaataattgaaa

SEQ ID NO: 482012 - DNA, 20 bp, Artificial
  CRISPR gRNA sequence
catcctttaataattgaaat

SEQ ID NO: 482013 - DNA, 20 bp, Artificial
  CRISPR gRNA sequence
atcctttaataattgaaatt

SEQ ID NO: 482014 - DNA, 20 bp, Artificial
  CRISPR gRNA sequence
taataattgaaatttagctg

SEQ ID NO: 482015 - DNA, 20 bp, Artificial
  CRISPR gRNA sequence
aataattgaaatttagctga

SEQ ID NO: 482016 - DNA, 20 bp, Artificial
  CRISPR gRNA sequence
ataattgaaatttagctgaa

SEQ ID NO: 482017 - DNA, 20 bp, Artificial
  CRISPR gRNA sequence
aaatttagctgaaagtgtag

SEQ ID NO: 482018 - DNA, 20 bp, Artificial
  CRISPR gRNA sequence
agctgaaagtgtagatgtca

SEQ ID NO: 482019 - DNA, 20 bp, Artificial
  CRISPR gRNA sequence
gctgaaagtgtagatgtcag

SEQ ID NO: 482020 - DNA, 20 bp, Artificial
  CRISPR gRNA sequence
aaagtgtagatgtcagcaga

SEQ ID NO: 482021 - DNA, 20 bp, Artificial
  CRISPR gRNA sequence
tttctcacaatggacatgac

SEQ ID NO: 482022 - DNA, 20 bp, Artificial
  CRISPR gRNA sequence
ctcacaatggacatgactcc

SEQ ID NO: 482023 - DNA, 20 bp, Artificial
  CRISPR gRNA sequence
tcacaatggacatgactcca

SEQ ID NO: 482024 - DNA, 20 bp, Artificial
  CRISPR gRNA sequence
acaatggacatgactccatt

SEQ ID NO: 482025 - DNA, 20 bp, Artificial
  CRISPR gRNA sequence
catttaagcttttcattcat

SEQ ID NO: 482026 - DNA, 20 bp, Artificial
  CRISPR gRNA sequence
aagcttttcattcatagttt

SEQ ID NO: 482027 - DNA, 20 bp, Artificial
  CRISPR gRNA sequence
agcttttcattcatagtttg

SEQ ID NO: 482028 - DNA, 20 bp, Artificial
  CRISPR gRNA sequence
ttcattcatagtttgctaat

SEQ ID NO: 482029 - DNA, 20 bp, Artificial
  CRISPR gRNA sequence
tcattcatagtttgctaatg

SEQ ID NO: 482030 - DNA, 20 bp, Artificial
  CRISPR gRNA sequence
cattcatagtttgctaatga

SEQ ID NO: 482031 - DNA, 20 bp, Artificial
  CRISPR gRNA sequence
attcatagtttgctaatgaa

SEQ ID NO: 482032 - DNA, 20 bp, Artificial
  CRISPR gRNA sequence
atagtttgctaatgaatatg

SEQ ID NO: 482033 - DNA, 20 bp, Artificial
  CRISPR gRNA sequence
gctaatgaatatgcactacc

SEQ ID NO: 482034 - DNA, 20 bp, Artificial
  CRISPR gRNA sequence
ctaatgaatatgcactacca

SEQ ID NO: 482035 - DNA, 20 bp, Artificial
  CRISPR gRNA sequence
atgaatatgcactaccatgg

SEQ ID NO: 482036 - DNA, 20 bp, Artificial
  CRISPR gRNA sequence
ccatggccgtaagtgtcact

SEQ ID NO: 482037 - DNA, 20 bp, Artificial
  CRISPR gRNA sequence
aaaaccatctttttttctat

SEQ ID NO: 482038 - DNA, 20 bp, Artificial
  CRISPR gRNA sequence
aaaccatctttttttctatt

SEQ ID NO: 482039 - DNA, 20 bp, Artificial
  CRISPR gRNA sequence
tttttctattgtaggttgat

SEQ ID NO: 482040 - DNA, 20 bp, Artificial
  CRISPR gRNA sequence
ttttctattgtaggttgatg

SEQ ID NO: 482041 - DNA, 20 bp, Artificial
  CRISPR gRNA sequence
tttctattgtaggttgatgc

SEQ ID NO: 482042 - DNA, 20 bp, Artificial
  CRISPR gRNA sequence
ttctattgtaggttgatgct

SEQ ID NO: 482043 - DNA, 20 bp, Artificial
  CRISPR gRNA sequence
tctattgtaggttgatgctc

SEQ ID NO: 482044 - DNA, 20 bp, Artificial
  CRISPR gRNA sequence
ctattgtaggttgatgctca

SEQ ID NO: 482045 - DNA, 20 bp, Artificial
  CRISPR gRNA sequence
tattgtaggttgatgctcac

SEQ ID NO: 482046 - DNA, 20 bp, Artificial
  CRISPR gRNA sequence
ttgtaggttgatgctcacct

SEQ ID NO: 482047 - DNA, 20 bp, Artificial
  CRISPR gRNA sequence
taggttgatgctcaccttaa

SEQ ID NO: 482048 - DNA, 20 bp, Artificial
  CRISPR gRNA sequence
atgctcaccttaagagtgag

SEQ ID NO: 482049 - DNA, 20 bp, Artificial
  CRISPR gRNA sequence
accttaagagtgagcaaaca

SEQ ID NO: 482050 - DNA, 20 bp, Artificial
  CRISPR gRNA sequence
aagagtgagcaaacagaagc

SEQ ID NO: 482051 - DNA, 20 bp, Artificial
  CRISPR gRNA sequence
agagtgagcaaacagaagca

SEQ ID NO: 482052 - DNA, 20 bp, Artificial
  CRISPR gRNA sequence
ccaagtactgctatcagaaa

SEQ ID NO: 482053 - DNA, 20 bp, Artificial
  CRISPR gRNA sequence
ctatcagaaactggaattta

SEQ ID NO: 482054 - DNA, 20 bp, Artificial
  CRISPR gRNA sequence
tcagaaactggaatttatga

SEQ ID NO: 482055 - DNA, 20 bp, Artificial
  CRISPR gRNA sequence
gaatttatgataatgaccct

SEQ ID NO: 482056 - DNA, 20 bp, Artificial
  CRISPR gRNA sequence
atgataatgaccctgacctt

SEQ ID NO: 482057 - DNA, 20 bp, Artificial
  CRISPR gRNA sequence
tgataatgaccctgaccttt

SEQ ID NO: 482058 - DNA, 20 bp, Artificial
  CRISPR gRNA sequence
acctttgtttcaggatgcag

SEQ ID NO: 482059 - DNA, 20 bp, Artificial
  CRISPR gRNA sequence
tgtttcaggatgcaggaagg

SEQ ID NO: 482060 - DNA, 20 bp, Artificial
  CRISPR gRNA sequence
gtttcaggatgcaggaaggg

SEQ ID NO: 482061 - DNA, 20 bp, Artificial
  CRISPR gRNA sequence
tttcaggatgcaggaagggt

SEQ ID NO: 482062 - DNA, 20 bp, Artificial
  CRISPR gRNA sequence
caggatgcaggaagggtctg

SEQ ID NO: 482063 - DNA, 20 bp, Artificial
  CRISPR gRNA sequence
aggatgcaggaagggtctga

SEQ ID NO: 482064 - DNA, 20 bp, Artificial
  CRISPR gRNA sequence
aagtttattctaatccatgc

SEQ ID NO: 482065 - DNA, 20 bp, Artificial
  CRISPR gRNA sequence
attctaatccatgcctggaa

SEQ ID NO: 482066 - DNA, 20 bp, Artificial
  CRISPR gRNA sequence
ttctaatccatgcctggaag

SEQ ID NO: 482067 - DNA, 20 bp, Artificial
  CRISPR gRNA sequence
taatccatgcctggaagaaa

SEQ ID NO: 482068 - DNA, 20 bp, Artificial
  CRISPR gRNA sequence
atccatgcctggaagaaaac

SEQ ID NO: 482069 - DNA, 20 bp, Artificial
  CRISPR gRNA sequence
gaagaaaacaaaccaggcat

SEQ ID NO: 482070 - DNA, 20 bp, Artificial
  CRISPR gRNA sequence
tttatgcttccctgaaccat

SEQ ID NO: 482071 - DNA, 20 bp, Artificial
  CRISPR gRNA sequence
atgcttccctgaaccattct

SEQ ID NO: 482072 - DNA, 20 bp, Artificial
  CRISPR gRNA sequence
tgcttccctgaaccattctg

SEQ ID NO: 482073 - DNA, 20 bp, Artificial
  CRISPR gRNA sequence
ccctgaaccattctgtcatt

SEQ ID NO: 482074 - DNA, 20 bp, Artificial
  CRISPR gRNA sequence
cctgaaccattctgtcattg

SEQ ID NO: 482075 - DNA, 20 bp, Artificial
  CRISPR gRNA sequence
aaccattctgtcattggacc

SEQ ID NO: 482076 - DNA, 20 bp, Artificial
  CRISPR gRNA sequence
tgtcattggaccgaactcaa

SEQ ID NO: 482077 - DNA, 20 bp, Artificial
  CRISPR gRNA sequence
tcattggaccgaactcaaga

SEQ ID NO: 482078 - DNA, 20 bp, Artificial
  CRISPR gRNA sequence
gaccgaactcaagactggca

SEQ ID NO: 482079 - DNA, 20 bp, Artificial
  CRISPR gRNA sequence
aagactggcaagaaatgtaa

SEQ ID NO: 482080 - DNA, 20 bp, Artificial
  CRISPR gRNA sequence
gcaagaaatgtaaaagaagc

SEQ ID NO: 482081 - DNA, 20 bp, Artificial
  CRISPR gRNA sequence
agtctgtttctgactccaac

SEQ ID NO: 482082 - DNA, 20 bp, Artificial
  CRISPR gRNA sequence
tttctgactccaacagggac

SEQ ID NO: 482083 - DNA, 20 bp, Artificial
  CRISPR gRNA sequence
ctgactccaacagggaccat

SEQ ID NO: 482084 - DNA, 20 bp, Artificial
  CRISPR gRNA sequence
tgactccaacagggaccatt

SEQ ID NO: 482085 - DNA, 20 bp, Artificial
  CRISPR gRNA sequence
actccaacagggaccattga

SEQ ID NO: 482086 - DNA, 20 bp, Artificial
  CRISPR gRNA sequence
caacagggaccattgaatga

SEQ ID NO: 482087 - DNA, 20 bp, Artificial
  CRISPR gRNA sequence
aatgatcagcatgttgacat

SEQ ID NO: 482088 - DNA, 20 bp, Artificial
  CRISPR gRNA sequence
acatcattgtctgggctcaa

SEQ ID NO: 482089 - DNA, 20 bp, Artificial
  CRISPR gRNA sequence
tctgggctcaacaggatgtc

SEQ ID NO: 482090 - DNA, 20 bp, Artificial
  CRISPR gRNA sequence
ggctcaacaggatgtcaaat

SEQ ID NO: 482091 - DNA, 20 bp, Artificial
  CRISPR gRNA sequence
aacaggatgtcaaataatat

SEQ ID NO: 482092 - DNA, 20 bp, Artificial
  CRISPR gRNA sequence
ctcaatttgagaatttttac

SEQ ID NO: 482093 - DNA, 20 bp, Artificial
  CRISPR gRNA sequence
tcaatttgagaatttttact

SEQ ID NO: 482094 - DNA, 20 bp, Artificial
  CRISPR gRNA sequence
aatttgagaatttttacttt

SEQ ID NO: 482095 - DNA, 20 bp, Artificial
  CRISPR gRNA sequence
gagaatttttactttagaaa

SEQ ID NO: 482096 - DNA, 20 bp, Artificial
  CRISPR gRNA sequence
agaatttttactttagaaat

SEQ ID NO: 482097 - DNA, 20 bp, Artificial
  CRISPR gRNA sequence
ttactttagaaatgttcatg

SEQ ID NO: 482098 - DNA, 20 bp, Artificial
  CRISPR gRNA sequence
tactttagaaatgttcatgt

SEQ ID NO: 482099 - DNA, 20 bp, Artificial
  CRISPR gRNA sequence
actttagaaatgttcatgtt

SEQ ID NO: 482100 - DNA, 20 bp, Artificial
  CRISPR gRNA sequence
ctttagaaatgttcatgtta

SEQ ID NO: 482101 - DNA, 20 bp, Artificial
  CRISPR gRNA sequence
tagaaatgttcatgttagtg

SEQ ID NO: 482102 - DNA, 20 bp, Artificial
  CRISPR gRNA sequence
agaaatgttcatgttagtgc

SEQ ID NO: 482103 - DNA, 20 bp, Artificial
  CRISPR gRNA sequence
gaaatgttcatgttagtgct

SEQ ID NO: 482104 - DNA, 20 bp, Artificial
  CRISPR gRNA sequence
atgttagtgcttgggtctta

SEQ ID NO: 482105 - DNA, 20 bp, Artificial
  CRISPR gRNA sequence
gtgcttgggtcttaagggtc

SEQ ID NO: 482106 - DNA, 20 bp, Artificial
  CRISPR gRNA sequence
gggtcttaagggtccatagg

SEQ ID NO: 482107 - DNA, 20 bp, Artificial
  CRISPR gRNA sequence
ggtcttaagggtccatagga

SEQ ID NO: 482108 - DNA, 20 bp, Artificial
  CRISPR gRNA sequence
aagggtccataggataaatg

SEQ ID NO: 482109 - DNA, 20 bp, Artificial
  CRISPR gRNA sequence
agggtccataggataaatga

SEQ ID NO: 482110 - DNA, 20 bp, Artificial
  CRISPR gRNA sequence
aaatttctctcagaaactta

SEQ ID NO: 482111 - DNA, 20 bp, Artificial
  CRISPR gRNA sequence
ctctcagaaacttatttggg

SEQ ID NO: 482112 - DNA, 20 bp, Artificial
  CRISPR gRNA sequence
tctcagaaacttatttggga

SEQ ID NO: 482113 - DNA, 20 bp, Artificial
  CRISPR gRNA sequence
tcagaaacttatttgggagc

SEQ ID NO: 482114 - DNA, 20 bp, Artificial
  CRISPR gRNA sequence
agaaacttatttgggagctt

SEQ ID NO: 482115 - DNA, 20 bp, Artificial
  CRISPR gRNA sequence
atttgggagctttttatatt

SEQ ID NO: 482116 - DNA, 20 bp, Artificial
  CRISPR gRNA sequence
tttgggagctttttatatta

SEQ ID NO: 482117 - DNA, 20 bp, Artificial
  CRISPR gRNA sequence
gggagctttttatattatag

SEQ ID NO: 482118 - DNA, 20 bp, Artificial
  CRISPR gRNA sequence
ggagctttttatattatagc

SEQ ID NO: 482119 - DNA, 20 bp, Artificial
  CRISPR gRNA sequence
tttatattatagccttgaat

SEQ ID NO: 482120 - DNA, 20 bp, Artificial
  CRISPR gRNA sequence
ttatattatagccttgaata

SEQ ID NO: 482121 - DNA, 20 bp, Artificial
  CRISPR gRNA sequence
tatattatagccttgaataa

SEQ ID NO: 482122 - DNA, 20 bp, Artificial
  CRISPR gRNA sequence
atattatagccttgaataac

SEQ ID NO: 482123 - DNA, 20 bp, Artificial
  CRISPR gRNA sequence
tattatagccttgaataaca

SEQ ID NO: 482124 - DNA, 20 bp, Artificial
  CRISPR gRNA sequence
tagccttgaataacaaaatc

SEQ ID NO: 482125 - DNA, 20 bp, Artificial
  CRISPR gRNA sequence
gaataacaaaatctctccaa

SEQ ID NO: 482126 - DNA, 20 bp, Artificial
  CRISPR gRNA sequence
aataacaaaatctctccaaa

SEQ ID NO: 482127 - DNA, 20 bp, Artificial
  CRISPR gRNA sequence
tccaaaactggttgacatca

SEQ ID NO: 482128 - DNA, 20 bp, Artificial
  CRISPR gRNA sequence
caaaactggttgacatcatg

SEQ ID NO: 482129 - DNA, 20 bp, Artificial
  CRISPR gRNA sequence
gttgacatcatgagtagcag

SEQ ID NO: 482130 - DNA, 20 bp, Artificial
  CRISPR gRNA sequence
acatcatgagtagcagaata

SEQ ID NO: 482131 - DNA, 20 bp, Artificial
  CRISPR gRNA sequence
aaacttagctacattttacc

SEQ ID NO: 482132 - DNA, 20 bp, Artificial
  CRISPR gRNA sequence
aacttagctacattttaccc

SEQ ID NO: 482133 - DNA, 20 bp, Artificial
  CRISPR gRNA sequence
agctacattttacccaatat

SEQ ID NO: 482134 - DNA, 20 bp, Artificial
  CRISPR gRNA sequence
gctacattttacccaatata

SEQ ID NO: 482135 - DNA, 20 bp, Artificial
  CRISPR gRNA sequence
cattttacccaatatacaaa

SEQ ID NO: 482136 - DNA, 20 bp, Artificial
  CRISPR gRNA sequence
tacccaatatacaaactcga

SEQ ID NO: 482137 - DNA, 20 bp, Artificial
  CRISPR gRNA sequence
acccaatatacaaactcgat

SEQ ID NO: 482138 - DNA, 20 bp, Artificial
  CRISPR gRNA sequence
cccaatatacaaactcgatc

SEQ ID NO: 482139 - DNA, 20 bp, Artificial
  CRISPR gRNA sequence
gatcttgcctttgaagctat

SEQ ID NO: 482140 - DNA, 20 bp, Artificial
  CRISPR gRNA sequence
gcctttgaagctattggaaa

SEQ ID NO: 482141 - DNA, 20 bp, Artificial
  CRISPR gRNA sequence
cctttgaagctattggaaag

SEQ ID NO: 482142 - DNA, 20 bp, Artificial
  CRISPR gRNA sequence
tgaagctattggaaagactt

SEQ ID NO: 482143 - DNA, 20 bp, Artificial
  CRISPR gRNA sequence
gaagctattggaaagacttg

SEQ ID NO: 482144 - DNA, 20 bp, Artificial
  CRISPR gRNA sequence
aagctattggaaagacttgt

SEQ ID NO: 482145 - DNA, 20 bp, Artificial
  CRISPR gRNA sequence
ttggaaagacttgtagggaa

SEQ ID NO: 482146 - DNA, 20 bp, Artificial
  CRISPR gRNA sequence
gaaagacttgtagggaaaag

SEQ ID NO: 482147 - DNA, 20 bp, Artificial
  CRISPR gRNA sequence
gtagggaaaagaggtttgtg

SEQ ID NO: 482148 - DNA, 20 bp, Artificial
  CRISPR gRNA sequence
tagggaaaagaggtttgtgt

SEQ ID NO: 482149 - DNA, 20 bp, Artificial
  CRISPR gRNA sequence
gtgttacctgcatcagttca

SEQ ID NO: 482150 - DNA, 20 bp, Artificial
  CRISPR gRNA sequence
tgttacctgcatcagttcac

SEQ ID NO: 482151 - DNA, 20 bp, Artificial
  CRISPR gRNA sequence
cctgcatcagttcactacac

SEQ ID NO: 482152 - DNA, 20 bp, Artificial
  CRISPR gRNA sequence
catcagttcactacacactc

SEQ ID NO: 482153 - DNA, 20 bp, Artificial
  CRISPR gRNA sequence
actacacactcttgaaaaca

SEQ ID NO: 482154 - DNA, 20 bp, Artificial
  CRISPR gRNA sequence
cacactcttgaaaacaaaat

SEQ ID NO: 482155 - DNA, 20 bp, Artificial
  CRISPR gRNA sequence
ttgaaaacaaaatgtcccaa

SEQ ID NO: 482156 - DNA, 20 bp, Artificial
  CRISPR gRNA sequence
gaaaacaaaatgtcccaatt

SEQ ID NO: 482157 - DNA, 20 bp, Artificial
  CRISPR gRNA sequence
aaaacaaaatgtcccaattt

SEQ ID NO: 482158 - DNA, 20 bp, Artificial
  CRISPR gRNA sequence
gactaaccaaccataaatac

SEQ ID NO: 482159 - DNA, 20 bp, Artificial
  CRISPR gRNA sequence
actaaccaaccataaataca

SEQ ID NO: 482160 - DNA, 20 bp, Artificial
  CRISPR gRNA sequence
accaaccataaatacagtaa

SEQ ID NO: 482161 - DNA, 20 bp, Artificial
  CRISPR gRNA sequence
tatatttcaagtcagtcttc

SEQ ID NO: 482162 - DNA, 20 bp, Artificial
  CRISPR gRNA sequence
caagtcagtcttccaaaata

SEQ ID NO: 482163 - DNA, 20 bp, Artificial
  CRISPR gRNA sequence
aagtcagtcttccaaaataa

SEQ ID NO: 482164 - DNA, 20 bp, Artificial
  CRISPR gRNA sequence
ccaaaataagaaatttttgc

SEQ ID NO: 482165 - DNA, 20 bp, Artificial
  CRISPR gRNA sequence
caaaataagaaatttttgct

SEQ ID NO: 482166 - DNA, 20 bp, Artificial
  CRISPR gRNA sequence
ttgctgtgtcagtctaagaa

SEQ ID NO: 482167 - DNA, 20 bp, Artificial
  CRISPR gRNA sequence
tgctgtgtcagtctaagaat

SEQ ID NO: 482168 - DNA, 20 bp, Artificial
  CRISPR gRNA sequence
gctgtgtcagtctaagaatg

SEQ ID NO: 482169 - DNA, 20 bp, Artificial
  CRISPR gRNA sequence
ctgtgtcagtctaagaatgg

SEQ ID NO: 482170 - DNA, 20 bp, Artificial
  CRISPR gRNA sequence
tgtcagtctaagaatggtgt

SEQ ID NO: 482171 - DNA, 20 bp, Artificial
  CRISPR gRNA sequence
agaatggtgtttcttaaatg

SEQ ID NO: 482172 - DNA, 20 bp, Artificial
  CRISPR gRNA sequence
cttaaatgcaaaggagaaat

SEQ ID NO: 482173 - DNA, 20 bp, Artificial
  CRISPR gRNA sequence
ttaaatgcaaaggagaaatc

SEQ ID NO: 482174 - DNA, 20 bp, Artificial
  CRISPR gRNA sequence
aaatgcaaaggagaaatcat

SEQ ID NO: 482175 - DNA, 20 bp, Artificial
  CRISPR gRNA sequence
aatgcaaaggagaaatcatt

SEQ ID NO: 482176 - DNA, 20 bp, Artificial
  CRISPR gRNA sequence
taggcttgatgtaagaaaat

SEQ ID NO: 482177 - DNA, 20 bp, Artificial
  CRISPR gRNA sequence
aggcttgatgtaagaaaatg

SEQ ID NO: 482178 - DNA, 20 bp, Artificial
  CRISPR gRNA sequence
ggcttgatgtaagaaaatga

SEQ ID NO: 482179 - DNA, 20 bp, Artificial
  CRISPR gRNA sequence
gatgtaagaaaatgaaaata

SEQ ID NO: 482180 - DNA, 20 bp, Artificial
  CRISPR gRNA sequence
atgtaagaaaatgaaaataa

SEQ ID NO: 482181 - DNA, 20 bp, Artificial
  CRISPR gRNA sequence
gatatagggtagatgttcca

SEQ ID NO: 482182 - DNA, 20 bp, Artificial
  CRISPR gRNA sequence
cacatacctggcaaacaaat

SEQ ID NO: 482183 - DNA, 20 bp, Artificial
  CRISPR gRNA sequence
gcaaacaaatgcttatatct

SEQ ID NO: 482184 - DNA, 20 bp, Artificial
  CRISPR gRNA sequence
atatctactctgttagattg

SEQ ID NO: 482185 - DNA, 20 bp, Artificial
  CRISPR gRNA sequence
tatctactctgttagattga

SEQ ID NO: 482186 - DNA, 20 bp, Artificial
  CRISPR gRNA sequence
ctctgttagattgataagca

SEQ ID NO: 482187 - DNA, 20 bp, Artificial
  CRISPR gRNA sequence
tgttagattgataagcaaat

SEQ ID NO: 482188 - DNA, 20 bp, Artificial
  CRISPR gRNA sequence
ttagattgataagcaaatat

SEQ ID NO: 482189 - DNA, 20 bp, Artificial
  CRISPR gRNA sequence
gattgataagcaaatatagg

SEQ ID NO: 482190 - DNA, 20 bp, Artificial
  CRISPR gRNA sequence
ataagcaaatataggtatta

SEQ ID NO: 482191 - DNA, 20 bp, Artificial
  CRISPR gRNA sequence
atggagcagtcaacgtatag

SEQ ID NO: 482192 - DNA, 20 bp, Artificial
  CRISPR gRNA sequence
atgaggaaagtagagactca

SEQ ID NO: 482193 - DNA, 20 bp, Artificial
  CRISPR gRNA sequence
tgaggaaagtagagactcac

SEQ ID NO: 482194 - DNA, 20 bp, Artificial
  CRISPR gRNA sequence
actgggtcacatagactaat

SEQ ID NO: 482195 - DNA, 20 bp, Artificial
  CRISPR gRNA sequence
ggtcacatagactaatggat

SEQ ID NO: 482196 - DNA, 20 bp, Artificial
  CRISPR gRNA sequence
atggataggaatgtgacata

SEQ ID NO: 482197 - DNA, 20 bp, Artificial
  CRISPR gRNA sequence
ctgaattaatatacttatgg

SEQ ID NO: 482198 - DNA, 20 bp, Artificial
  CRISPR gRNA sequence
aattaatatacttatgggca

SEQ ID NO: 482199 - DNA, 20 bp, Artificial
  CRISPR gRNA sequence
atatacttatgggcatctga

SEQ ID NO: 482200 - DNA, 20 bp, Artificial
  CRISPR gRNA sequence
atgggcatctgaatagttta

SEQ ID NO: 482201 - DNA, 20 bp, Artificial
  CRISPR gRNA sequence
tgggcatctgaatagtttaa

SEQ ID NO: 482202 - DNA, 20 bp, Artificial
  CRISPR gRNA sequence
aatagtttaaaagttagtca

SEQ ID NO: 482203 - DNA, 20 bp, Artificial
  CRISPR gRNA sequence
aaaagttagtcagaataggt

SEQ ID NO: 482204 - DNA, 20 bp, Artificial
  CRISPR gRNA sequence
aaagttagtcagaataggta

SEQ ID NO: 482205 - DNA, 20 bp, Artificial
  CRISPR gRNA sequence
gtcagaataggtatcactgg

SEQ ID NO: 482206 - DNA, 20 bp, Artificial
  CRISPR gRNA sequence
ggcaagtgaagatagcttaa

SEQ ID NO: 482207 - DNA, 20 bp, Artificial
  CRISPR gRNA sequence
aaactgcttcatgcttgact

SEQ ID NO: 482208 - DNA, 20 bp, Artificial
  CRISPR gRNA sequence
aactgcttcatgcttgactt

SEQ ID NO: 482209 - DNA, 20 bp, Artificial
  CRISPR gRNA sequence
cttcatgcttgacttgatag

SEQ ID NO: 482210 - DNA, 20 bp, Artificial
  CRISPR gRNA sequence
catgcttgacttgatagcaa

SEQ ID NO: 482211 - DNA, 20 bp, Artificial
  CRISPR gRNA sequence
atgcttgacttgatagcaag

SEQ ID NO: 482212 - DNA, 20 bp, Artificial
  CRISPR gRNA sequence
gacttgatagcaagttaaag

SEQ ID NO: 482213 - DNA, 20 bp, Artificial
  CRISPR gRNA sequence
acttgatagcaagttaaagt

SEQ ID NO: 482214 - DNA, 20 bp, Artificial
  CRISPR gRNA sequence
gatagcaagttaaagtgcaa

SEQ ID NO: 482215 - DNA, 20 bp, Artificial
  CRISPR gRNA sequence
atagcaagttaaagtgcaat

SEQ ID NO: 482216 - DNA, 20 bp, Artificial
  CRISPR gRNA sequence
aagtgcaattaatggaatgg

SEQ ID NO: 482217 - DNA, 20 bp, Artificial
  CRISPR gRNA sequence
atggaatggaggaaaaccca

SEQ ID NO: 482218 - DNA, 20 bp, Artificial
  CRISPR gRNA sequence
aattggtctgtaggggtcaa

SEQ ID NO: 482219 - DNA, 20 bp, Artificial
  CRISPR gRNA sequence
attggtctgtaggggtcaat

SEQ ID NO: 482220 - DNA, 20 bp, Artificial
  CRISPR gRNA sequence
gtctgtaggggtcaatttgc

SEQ ID NO: 482221 - DNA, 20 bp, Artificial
  CRISPR gRNA sequence
taggggtcaatttgctttca

SEQ ID NO: 482222 - DNA, 20 bp, Artificial
  CRISPR gRNA sequence
gctttcattcaccacatctg

SEQ ID NO: 482223 - DNA, 20 bp, Artificial
  CRISPR gRNA sequence
ctttcattcaccacatctgc

SEQ ID NO: 482224 - DNA, 20 bp, Artificial
  CRISPR gRNA sequence
tcattcaccacatctgcatc

SEQ ID NO: 482225 - DNA, 20 bp, Artificial
  CRISPR gRNA sequence
cattcaccacatctgcatct

SEQ ID NO: 482226 - DNA, 20 bp, Artificial
  CRISPR gRNA sequence
attcaccacatctgcatctt

SEQ ID NO: 482227 - DNA, 20 bp, Artificial
  CRISPR gRNA sequence
accacatctgcatcttgctg

SEQ ID NO: 482228 - DNA, 20 bp, Artificial
  CRISPR gRNA sequence
catcttgctgttcttcttac

SEQ ID NO: 482229 - DNA, 20 bp, Artificial
  CRISPR gRNA sequence
gctgttcttcttactaagga

SEQ ID NO: 482230 - DNA, 20 bp, Artificial
  CRISPR gRNA sequence
ctgttcttcttactaaggaa

SEQ ID NO: 482231 - DNA, 20 bp, Artificial
  CRISPR gRNA sequence
ttcttcttactaaggaatca

SEQ ID NO: 482232 - DNA, 20 bp, Artificial
  CRISPR gRNA sequence
ttcttactaaggaatcaggg

SEQ ID NO: 482233 - DNA, 20 bp, Artificial
  CRISPR gRNA sequence
cttactaaggaatcagggca

SEQ ID NO: 482234 - DNA, 20 bp, Artificial
  CRISPR gRNA sequence
ttactaaggaatcagggcaa

SEQ ID NO: 482235 - DNA, 20 bp, Artificial
  CRISPR gRNA sequence
actaaggaatcagggcaaat

SEQ ID NO: 482236 - DNA, 20 bp, Artificial
  CRISPR gRNA sequence
ctaaggaatcagggcaaatc

SEQ ID NO: 482237 - DNA, 20 bp, Artificial
  CRISPR gRNA sequence
aggaatcagggcaaatcatc

SEQ ID NO: 482238 - DNA, 20 bp, Artificial
  CRISPR gRNA sequence
tagtgacatattttagtttg

SEQ ID NO: 482239 - DNA, 20 bp, Artificial
  CRISPR gRNA sequence
tagtttgctaatcatttatt

SEQ ID NO: 482240 - DNA, 20 bp, Artificial
  CRISPR gRNA sequence
agtttgctaatcatttattt

SEQ ID NO: 482241 - DNA, 20 bp, Artificial
  CRISPR gRNA sequence
gtttgctaatcatttatttt

SEQ ID NO: 482242 - DNA, 20 bp, Artificial
  CRISPR gRNA sequence
gctaatcatttattttaaaa

SEQ ID NO: 482243 - DNA, 20 bp, Artificial
  CRISPR gRNA sequence
ctaatcatttattttaaaat

SEQ ID NO: 482244 - DNA, 20 bp, Artificial
  CRISPR gRNA sequence
atcatttattttaaaatact

SEQ ID NO: 482245 - DNA, 20 bp, Artificial
  CRISPR gRNA sequence
attttaaaatactgaggttg

SEQ ID NO: 482246 - DNA, 20 bp, Artificial
  CRISPR gRNA sequence
ttttaaaatactgaggttgc

SEQ ID NO: 482247 - DNA, 20 bp, Artificial
  CRISPR gRNA sequence
taaaatactgaggttgcagc

SEQ ID NO: 482248 - DNA, 20 bp, Artificial
  CRISPR gRNA sequence
aaaatactgaggttgcagcc

SEQ ID NO: 482249 - DNA, 20 bp, Artificial
  CRISPR gRNA sequence
aaatactgaggttgcagcca

SEQ ID NO: 482250 - DNA, 20 bp, Artificial
  CRISPR gRNA sequence
aggttgcagccacttaagag

SEQ ID NO: 482251 - DNA, 20 bp, Artificial
  CRISPR gRNA sequence
cagccacttaagagtatagc

SEQ ID NO: 482252 - DNA, 20 bp, Artificial
  CRISPR gRNA sequence
aagagtatagcaaaagatgg

SEQ ID NO: 482253 - DNA, 20 bp, Artificial
  CRISPR gRNA sequence
agagtatagcaaaagatgga

SEQ ID NO: 482254 - DNA, 20 bp, Artificial
  CRISPR gRNA sequence
agatttttggactttccaaa

SEQ ID NO: 482255 - DNA, 20 bp, Artificial
  CRISPR gRNA sequence
ttggactttccaaagtactt

SEQ ID NO: 482256 - DNA, 20 bp, Artificial
  CRISPR gRNA sequence
tggactttccaaagtacttg

SEQ ID NO: 482257 - DNA, 20 bp, Artificial
  CRISPR gRNA sequence
ggactttccaaagtacttga

SEQ ID NO: 482258 - DNA, 20 bp, Artificial
  CRISPR gRNA sequence
gactttccaaagtacttgag

SEQ ID NO: 482259 - DNA, 20 bp, Artificial
  CRISPR gRNA sequence
tccaaagtacttgagttaaa

SEQ ID NO: 482260 - DNA, 20 bp, Artificial
  CRISPR gRNA sequence
ccaaagtacttgagttaaac

SEQ ID NO: 482261 - DNA, 20 bp, Artificial
  CRISPR gRNA sequence
caaagtacttgagttaaact

SEQ ID NO: 482262 - DNA, 20 bp, Artificial
  CRISPR gRNA sequence
gagttaaactatttcaaaaa

SEQ ID NO: 482263 - DNA, 20 bp, Artificial
  CRISPR gRNA sequence
agttaaactatttcaaaaat

SEQ ID NO: 482264 - DNA, 20 bp, Artificial
  CRISPR gRNA sequence
aactatttcaaaaatagcct

SEQ ID NO: 482265 - DNA, 20 bp, Artificial
  CRISPR gRNA sequence
tttcaaaaatagcctataat

SEQ ID NO: 482266 - DNA, 20 bp, Artificial
  CRISPR gRNA sequence
caaaaatagcctataatttt

SEQ ID NO: 482267 - DNA, 20 bp, Artificial
  CRISPR gRNA sequence
aaaaatagcctataatttta

SEQ ID NO: 482268 - DNA, 20 bp, Artificial
  CRISPR gRNA sequence
taattttattcaacagtttg

SEQ ID NO: 482269 - DNA, 20 bp, Artificial
  CRISPR gRNA sequence
tattcaacagtttgaggcta

SEQ ID NO: 482270 - DNA, 20 bp, Artificial
  CRISPR gRNA sequence
attcaacagtttgaggctat

SEQ ID NO: 482271 - DNA, 20 bp, Artificial
  CRISPR gRNA sequence
ttcaacagtttgaggctatt

SEQ ID NO: 482272 - DNA, 20 bp, Artificial
  CRISPR gRNA sequence
aacagtttgaggctattcga

SEQ ID NO: 482273 - DNA, 20 bp, Artificial
  CRISPR gRNA sequence
gaggctattcgaattctcag

SEQ ID NO: 482274 - DNA, 20 bp, Artificial
  CRISPR gRNA sequence
aggctattcgaattctcagg

SEQ ID NO: 482275 - DNA, 20 bp, Artificial
  CRISPR gRNA sequence
ttcgaattctcaggtgctgc

SEQ ID NO: 482276 - DNA, 20 bp, Artificial
  CRISPR gRNA sequence
gaattctcaggtgctgctac

SEQ ID NO: 482277 - DNA, 20 bp, Artificial
  CRISPR gRNA sequence
tcaggtgctgctactgaata

SEQ ID NO: 482278 - DNA, 20 bp, Artificial
  CRISPR gRNA sequence
aggtgctgctactgaataat

SEQ ID NO: 482279 - DNA, 20 bp, Artificial
  CRISPR gRNA sequence
ctactgaataatgtaatagt

SEQ ID NO: 482280 - DNA, 20 bp, Artificial
  CRISPR gRNA sequence
ctgaataatgtaatagtctt

SEQ ID NO: 482281 - DNA, 20 bp, Artificial
  CRISPR gRNA sequence
aataatgtaatagtcttcat

SEQ ID NO: 482282 - DNA, 20 bp, Artificial
  CRISPR gRNA sequence
catacaaagtggatagcaaa

SEQ ID NO: 482283 - DNA, 20 bp, Artificial
  CRISPR gRNA sequence
atacaaagtggatagcaaag

SEQ ID NO: 482284 - DNA, 20 bp, Artificial
  CRISPR gRNA sequence
aaatccatttcaacaaatat

SEQ ID NO: 482285 - DNA, 20 bp, Artificial
  CRISPR gRNA sequence
caacaaatatgtgagctgag

SEQ ID NO: 482286 - DNA, 20 bp, Artificial
  CRISPR gRNA sequence
aacaaatatgtgagctgagc

SEQ ID NO: 482287 - DNA, 20 bp, Artificial
  CRISPR gRNA sequence
agctgctgcacaaaggaatg

SEQ ID NO: 482288 - DNA, 20 bp, Artificial
  CRISPR gRNA sequence
ctgcacaaaggaatgtgatg

SEQ ID NO: 482289 - DNA, 20 bp, Artificial
  CRISPR gRNA sequence
cacaaaggaatgtgatgtgt

SEQ ID NO: 482290 - DNA, 20 bp, Artificial
  CRISPR gRNA sequence
ggtggggtgggtgacaacag

SEQ ID NO: 482291 - DNA, 20 bp, Artificial
  CRISPR gRNA sequence
atcaaattgacattatattt

SEQ ID NO: 482292 - DNA, 20 bp, Artificial
  CRISPR gRNA sequence
acattatattttcagtttgc

SEQ ID NO: 482293 - DNA, 20 bp, Artificial
  CRISPR gRNA sequence
tattttcagtttgcttatga

SEQ ID NO: 482294 - DNA, 20 bp, Artificial
  CRISPR gRNA sequence
tcagtttgcttatgaagctc

SEQ ID NO: 482295 - DNA, 20 bp, Artificial
  CRISPR gRNA sequence
cagtttgcttatgaagctca

SEQ ID NO: 482296 - DNA, 20 bp, Artificial
  CRISPR gRNA sequence
agtttgcttatgaagctcaa

SEQ ID NO: 482297 - DNA, 20 bp, Artificial
  CRISPR gRNA sequence
gcttatgaagctcaaaatac

SEQ ID NO: 482298 - DNA, 20 bp, Artificial
  CRISPR gRNA sequence
cttatgaagctcaaaatact

SEQ ID NO: 482299 - DNA, 20 bp, Artificial
  CRISPR gRNA sequence
atgaagctcaaaatactaga

SEQ ID NO: 482300 - DNA, 20 bp, Artificial
  CRISPR gRNA sequence
tgaagctcaaaatactagag

SEQ ID NO: 482301 - DNA, 20 bp, Artificial
  CRISPR gRNA sequence
aaaatactagagtaaatggg

SEQ ID NO: 482302 - DNA, 20 bp, Artificial
  CRISPR gRNA sequence
gagtaaatgggtcattaaag

SEQ ID NO: 482303 - DNA, 20 bp, Artificial
  CRISPR gRNA sequence
aagaaaataatatgtgaaat

SEQ ID NO: 482304 - DNA, 20 bp, Artificial
  CRISPR gRNA sequence
tggagtttagaatacaagtg

SEQ ID NO: 482305 - DNA, 20 bp, Artificial
  CRISPR gRNA sequence
agaatacaagtggggtatat

SEQ ID NO: 482306 - DNA, 20 bp, Artificial
  CRISPR gRNA sequence
gaatacaagtggggtatata

SEQ ID NO: 482307 - DNA, 20 bp, Artificial
  CRISPR gRNA sequence
aggttttgtggtggagagat

SEQ ID NO: 482308 - DNA, 20 bp, Artificial
  CRISPR gRNA sequence
tgtggtggagagattttctt

SEQ ID NO: 482309 - DNA, 20 bp, Artificial
  CRISPR gRNA sequence
gtggtggagagattttctta

SEQ ID NO: 482310 - DNA, 20 bp, Artificial
  CRISPR gRNA sequence
tggtggagagattttcttaa

SEQ ID NO: 482311 - DNA, 20 bp, Artificial
  CRISPR gRNA sequence
tcttaagtaacactggcatt

SEQ ID NO: 482312 - DNA, 20 bp, Artificial
  CRISPR gRNA sequence
cttaagtaacactggcatta

SEQ ID NO: 482313 - DNA, 20 bp, Artificial
  CRISPR gRNA sequence
ttaagtaacactggcattaa

SEQ ID NO: 482314 - DNA, 20 bp, Artificial
  CRISPR gRNA sequence
aagtaacactggcattaagt

SEQ ID NO: 482315 - DNA, 20 bp, Artificial
  CRISPR gRNA sequence
agtaacactggcattaagtt

SEQ ID NO: 482316 - DNA, 20 bp, Artificial
  CRISPR gRNA sequence
gcattaagttttagctcctt

SEQ ID NO: 482317 - DNA, 20 bp, Artificial
  CRISPR gRNA sequence
agttttagctccttagattt

SEQ ID NO: 482318 - DNA, 20 bp, Artificial
  CRISPR gRNA sequence
tagctccttagatttggggg

SEQ ID NO: 482319 - DNA, 20 bp, Artificial
  CRISPR gRNA sequence
agctccttagatttgggggt

SEQ ID NO: 482320 - DNA, 20 bp, Artificial
  CRISPR gRNA sequence
gctccttagatttgggggtg

SEQ ID NO: 482321 - DNA, 20 bp, Artificial
  CRISPR gRNA sequence
cttagatttgggggtgcaaa

SEQ ID NO: 482322 - DNA, 20 bp, Artificial
  CRISPR gRNA sequence
agatttgggggtgcaaatat

SEQ ID NO: 482323 - DNA, 20 bp, Artificial
  CRISPR gRNA sequence
gatttgggggtgcaaatatt

SEQ ID NO: 482324 - DNA, 20 bp, Artificial
  CRISPR gRNA sequence
gggggtgcaaatattctttt

SEQ ID NO: 482325 - DNA, 20 bp, Artificial
  CRISPR gRNA sequence
ggggtgcaaatattcttttg

SEQ ID NO: 482326 - DNA, 20 bp, Artificial
  CRISPR gRNA sequence
ttttgagtcactgttatttt

SEQ ID NO: 482327 - DNA, 20 bp, Artificial
  CRISPR gRNA sequence
ttgagtcactgttattttgc

SEQ ID NO: 482328 - DNA, 20 bp, Artificial
  CRISPR gRNA sequence
tgagtcactgttattttgcc

SEQ ID NO: 482329 - DNA, 20 bp, Artificial
  CRISPR gRNA sequence
gagtcactgttattttgcca

SEQ ID NO: 482330 - DNA, 20 bp, Artificial
  CRISPR gRNA sequence
agtcactgttattttgccaa

SEQ ID NO: 482331 - DNA, 20 bp, Artificial
  CRISPR gRNA sequence
ttattttgccaattacacct

SEQ ID NO: 482332 - DNA, 20 bp, Artificial
  CRISPR gRNA sequence
ttttgccaattacacctaga

SEQ ID NO: 482333 - DNA, 20 bp, Artificial
  CRISPR gRNA sequence
tgccaattacacctagaatt

SEQ ID NO: 482334 - DNA, 20 bp, Artificial
  CRISPR gRNA sequence
gccaattacacctagaattt

SEQ ID NO: 482335 - DNA, 20 bp, Artificial
  CRISPR gRNA sequence
ccaattacacctagaatttc

SEQ ID NO: 482336 - DNA, 20 bp, Artificial
  CRISPR gRNA sequence
cacctagaatttcaagcaac

SEQ ID NO: 482337 - DNA, 20 bp, Artificial
  CRISPR gRNA sequence
gaatttcaagcaaccaattc

SEQ ID NO: 482338 - DNA, 20 bp, Artificial
  CRISPR gRNA sequence
caagcaaccaattcgagata

SEQ ID NO: 482339 - DNA, 20 bp, Artificial
  CRISPR gRNA sequence
aagcaaccaattcgagatag

SEQ ID NO: 482340 - DNA, 20 bp, Artificial
  CRISPR gRNA sequence
gagataggctgttttagcca

SEQ ID NO: 482341 - DNA, 20 bp, Artificial
  CRISPR gRNA sequence
ttttagccaggctgcatttg

SEQ ID NO: 482342 - DNA, 20 bp, Artificial
  CRISPR gRNA sequence
tagccaggctgcatttgtgg

SEQ ID NO: 482343 - DNA, 20 bp, Artificial
  CRISPR gRNA sequence
agccaggctgcatttgtgga

SEQ ID NO: 482344 - DNA, 20 bp, Artificial
  CRISPR gRNA sequence
gccaggctgcatttgtggac

SEQ ID NO: 482345 - DNA, 20 bp, Artificial
  CRISPR gRNA sequence
catttgtggacaacttatgt

SEQ ID NO: 482346 - DNA, 20 bp, Artificial
  CRISPR gRNA sequence
gtggacaacttatgtaagaa

SEQ ID NO: 482347 - DNA, 20 bp, Artificial
  CRISPR gRNA sequence
tggacaacttatgtaagaaa

SEQ ID NO: 482348 - DNA, 20 bp, Artificial
  CRISPR gRNA sequence
atgtaagaaagacatgttag

SEQ ID NO: 482349 - DNA, 20 bp, Artificial
  CRISPR gRNA sequence
tgtaagaaagacatgttaga

SEQ ID NO: 482350 - DNA, 20 bp, Artificial
  CRISPR gRNA sequence
gaatagctgcttgtggtatt

SEQ ID NO: 482351 - DNA, 20 bp, Artificial
  CRISPR gRNA sequence
cttgtggtattcttaaaaat

SEQ ID NO: 482352 - DNA, 20 bp, Artificial
  CRISPR gRNA sequence
gtggtattcttaaaaataga

SEQ ID NO: 482353 - DNA, 20 bp, Artificial
  CRISPR gRNA sequence
tggtattcttaaaaatagaa

SEQ ID NO: 482354 - DNA, 20 bp, Artificial
  CRISPR gRNA sequence
ttaaaaatagaaacaggaaa

SEQ ID NO: 482355 - DNA, 20 bp, Artificial
  CRISPR gRNA sequence
aaaaatagaaacaggaaata

SEQ ID NO: 482356 - DNA, 20 bp, Artificial
  CRISPR gRNA sequence
aaaatagaaacaggaaatat

SEQ ID NO: 482357 - DNA, 20 bp, Artificial
  CRISPR gRNA sequence
agctgtcctcttatcagatg

SEQ ID NO: 482358 - DNA, 20 bp, Artificial
  CRISPR gRNA sequence
gctgtcctcttatcagatga

SEQ ID NO: 482359 - DNA, 20 bp, Artificial
  CRISPR gRNA sequence
tcctcttatcagatgaacac

SEQ ID NO: 482360 - DNA, 20 bp, Artificial
  CRISPR gRNA sequence
ttatcagatgaacacacgaa

SEQ ID NO: 482361 - DNA, 20 bp, Artificial
  CRISPR gRNA sequence
atcagatgaacacacgaaat

SEQ ID NO: 482362 - DNA, 20 bp, Artificial
  CRISPR gRNA sequence
tcagatgaacacacgaaatt

SEQ ID NO: 482363 - DNA, 20 bp, Artificial
  CRISPR gRNA sequence
aacagttccttcatgattct

SEQ ID NO: 482364 - DNA, 20 bp, Artificial
  CRISPR gRNA sequence
cttcatgattctctcaaact

SEQ ID NO: 482365 - DNA, 20 bp, Artificial
  CRISPR gRNA sequence
catgattctctcaaacttaa

SEQ ID NO: 482366 - DNA, 20 bp, Artificial
  CRISPR gRNA sequence
atgattctctcaaacttaaa

SEQ ID NO: 482367 - DNA, 20 bp, Artificial
  CRISPR gRNA sequence
tctcaaacttaaaagcaaaa

SEQ ID NO: 482368 - DNA, 20 bp, Artificial
  CRISPR gRNA sequence
tcaaacttaaaagcaaaata

SEQ ID NO: 482369 - DNA, 20 bp, Artificial
  CRISPR gRNA sequence
aaacttaaaagcaaaatatt

SEQ ID NO: 482370 - DNA, 20 bp, Artificial
  CRISPR gRNA sequence
aaaagcaaaatatttctgtc

SEQ ID NO: 482371 - DNA, 20 bp, Artificial
  CRISPR gRNA sequence
aaagcaaaatatttctgtct

SEQ ID NO: 482372 - DNA, 20 bp, Artificial
  CRISPR gRNA sequence
ctgtcttatttaaaatatcc

SEQ ID NO: 482373 - DNA, 20 bp, Artificial
  CRISPR gRNA sequence
tgtcttatttaaaatatcct

SEQ ID NO: 482374 - DNA, 20 bp, Artificial
  CRISPR gRNA sequence
tcttatttaaaatatcctta

SEQ ID NO: 482375 - DNA, 20 bp, Artificial
  CRISPR gRNA sequence
atttaaaatatccttagtat

SEQ ID NO: 482376 - DNA, 20 bp, Artificial
  CRISPR gRNA sequence
tttaaaatatccttagtatg

SEQ ID NO: 482377 - DNA, 20 bp, Artificial
  CRISPR gRNA sequence
aaaatatccttagtatgtct

SEQ ID NO: 482378 - DNA, 20 bp, Artificial
  CRISPR gRNA sequence
aaatatccttagtatgtctt

SEQ ID NO: 482379 - DNA, 20 bp, Artificial
  CRISPR gRNA sequence
agtatgtcttatagtaaaga

SEQ ID NO: 482380 - DNA, 20 bp, Artificial
  CRISPR gRNA sequence
gtatgtcttatagtaaagat

SEQ ID NO: 482381 - DNA, 20 bp, Artificial
  CRISPR gRNA sequence
atagtaaagataatgctgat

SEQ ID NO: 482382 - DNA, 20 bp, Artificial
  CRISPR gRNA sequence
tagtaaagataatgctgata

SEQ ID NO: 482383 - DNA, 20 bp, Artificial
  CRISPR gRNA sequence
ataatgatttcatctctaag

SEQ ID NO: 482384 - DNA, 20 bp, Artificial
  CRISPR gRNA sequence
catctctaagatgtattaat

SEQ ID NO: 482385 - DNA, 20 bp, Artificial
  CRISPR gRNA sequence
atctctaagatgtattaata

SEQ ID NO: 482386 - DNA, 20 bp, Artificial
  CRISPR gRNA sequence
taagatgtattaatatattt

SEQ ID NO: 482387 - DNA, 20 bp, Artificial
  CRISPR gRNA sequence
agatgtattaatatatttgt

SEQ ID NO: 482388 - DNA, 20 bp, Artificial
  CRISPR gRNA sequence
atatatttgtactgtttgcc

SEQ ID NO: 482389 - DNA, 20 bp, Artificial
  CRISPR gRNA sequence
gtactgtttgccaaaatcac

SEQ ID NO: 482390 - DNA, 20 bp, Artificial
  CRISPR gRNA sequence
tactgtttgccaaaatcaca

SEQ ID NO: 482391 - DNA, 20 bp, Artificial
  CRISPR gRNA sequence
tttgccaaaatcacaaatca

SEQ ID NO: 482392 - DNA, 20 bp, Artificial
  CRISPR gRNA sequence
gccaaaatcacaaatcattt

SEQ ID NO: 482393 - DNA, 20 bp, Artificial
  CRISPR gRNA sequence
ccaaaatcacaaatcattta

SEQ ID NO: 482394 - DNA, 20 bp, Artificial
  CRISPR gRNA sequence
atgtttttattccttttcaa

SEQ ID NO: 482395 - DNA, 20 bp, Artificial
  CRISPR gRNA sequence
tgtttttattccttttcaaa

SEQ ID NO: 482396 - DNA, 20 bp, Artificial
  CRISPR gRNA sequence
ttattccttttcaaaatggt

SEQ ID NO: 482397 - DNA, 20 bp, Artificial
  CRISPR gRNA sequence
tattccttttcaaaatggtg

SEQ ID NO: 482398 - DNA, 20 bp, Artificial
  CRISPR gRNA sequence
attccttttcaaaatggtgt

SEQ ID NO: 482399 - DNA, 20 bp, Artificial
  CRISPR gRNA sequence
ttccttttcaaaatggtgtc

SEQ ID NO: 482400 - DNA, 20 bp, Artificial
  CRISPR gRNA sequence
cttttcaaaatggtgtcaga

SEQ ID NO: 482401 - DNA, 20 bp, Artificial
  CRISPR gRNA sequence
ttcaaaatggtgtcagagac

SEQ ID NO: 482402 - DNA, 20 bp, Artificial
  CRISPR gRNA sequence
tcaaaatggtgtcagagaca

SEQ ID NO: 482403 - DNA, 20 bp, Artificial
  CRISPR gRNA sequence
caaaatggtgtcagagacat

SEQ ID NO: 482404 - DNA, 20 bp, Artificial
  CRISPR gRNA sequence
aaaatggtgtcagagacata

SEQ ID NO: 482405 - DNA, 20 bp, Artificial
  CRISPR gRNA sequence
tcccaaatgactctacttca

SEQ ID NO: 482406 - DNA, 20 bp, Artificial
  CRISPR gRNA sequence
cccaaatgactctacttcac

SEQ ID NO: 482407 - DNA, 20 bp, Artificial
  CRISPR gRNA sequence
ccaaatgactctacttcact

SEQ ID NO: 482408 - DNA, 20 bp, Artificial
  CRISPR gRNA sequence
tacttcactattatttacat

SEQ ID NO: 482409 - DNA, 20 bp, Artificial
  CRISPR gRNA sequence
cttcactattatttacatgg

SEQ ID NO: 482410 - DNA, 20 bp, Artificial
  CRISPR gRNA sequence
cactattatttacatggctt

SEQ ID NO: 482411 - DNA, 20 bp, Artificial
  CRISPR gRNA sequence
actattatttacatggctta

SEQ ID NO: 482412 - DNA, 20 bp, Artificial
  CRISPR gRNA sequence
ttatttacatggcttatttc

SEQ ID NO: 482413 - DNA, 20 bp, Artificial
  CRISPR gRNA sequence
tttacatggcttatttcatt

SEQ ID NO: 482414 - DNA, 20 bp, Artificial
  CRISPR gRNA sequence
acatggcttatttcattagt

SEQ ID NO: 482415 - DNA, 20 bp, Artificial
  CRISPR gRNA sequence
catggcttatttcattagtt

SEQ ID NO: 482416 - DNA, 20 bp, Artificial
  CRISPR gRNA sequence
atttcattagtttatagagg

SEQ ID NO: 482417 - DNA, 20 bp, Artificial
  CRISPR gRNA sequence
tttcattagtttatagaggg

SEQ ID NO: 482418 - DNA, 20 bp, Artificial
  CRISPR gRNA sequence
cattagtttatagagggttt

SEQ ID NO: 482419 - DNA, 20 bp, Artificial
  CRISPR gRNA sequence
attagtttatagagggtttg

SEQ ID NO: 482420 - DNA, 20 bp, Artificial
  CRISPR gRNA sequence
gtttatagagggtttgagaa

SEQ ID NO: 482421 - DNA, 20 bp, Artificial
  CRISPR gRNA sequence
atagagggtttgagaaaaag

SEQ ID NO: 482422 - DNA, 20 bp, Artificial
  CRISPR gRNA sequence
tagagggtttgagaaaaaga

SEQ ID NO: 482423 - DNA, 20 bp, Artificial
  CRISPR gRNA sequence
gagaaaaagaatatgtagat

SEQ ID NO: 482424 - DNA, 20 bp, Artificial
  CRISPR gRNA sequence
agaaaaagaatatgtagata

SEQ ID NO: 482425 - DNA, 20 bp, Artificial
  CRISPR gRNA sequence
aatggtttttcacaaatttt

SEQ ID NO: 482426 - DNA, 20 bp, Artificial
  CRISPR gRNA sequence
atggtttttcacaaatttta

SEQ ID NO: 482427 - DNA, 20 bp, Artificial
  CRISPR gRNA sequence
ttcacaaattttaagcttgt

SEQ ID NO: 482428 - DNA, 20 bp, Artificial
  CRISPR gRNA sequence
tcacaaattttaagcttgtg

SEQ ID NO: 482429 - DNA, 20 bp, Artificial
  CRISPR gRNA sequence
cacaaattttaagcttgtga

SEQ ID NO: 482430 - DNA, 20 bp, Artificial
  CRISPR gRNA sequence
acaaattttaagcttgtgat

SEQ ID NO: 482431 - DNA, 20 bp, Artificial
  CRISPR gRNA sequence
taagcttgtgattgtgctca

SEQ ID NO: 482432 - DNA, 20 bp, Artificial
  CRISPR gRNA sequence
aagcttgtgattgtgctcaa

SEQ ID NO: 482433 - DNA, 20 bp, Artificial
  CRISPR gRNA sequence
agcttgtgattgtgctcaat

SEQ ID NO: 482434 - DNA, 20 bp, Artificial
  CRISPR gRNA sequence
gtgattgtgctcaatgagaa

SEQ ID NO: 482435 - DNA, 20 bp, Artificial
  CRISPR gRNA sequence
tgattgtgctcaatgagaag

SEQ ID NO: 482436 - DNA, 20 bp, Artificial
  CRISPR gRNA sequence
tgctcaatgagaaggtaaag

SEQ ID NO: 482437 - DNA, 20 bp, Artificial
  CRISPR gRNA sequence
aatgagaaggtaaagttatt

SEQ ID NO: 482438 - DNA, 20 bp, Artificial
  CRISPR gRNA sequence
ttaaaacttatttgaaatca

SEQ ID NO: 482439 - DNA, 20 bp, Artificial
  CRISPR gRNA sequence
aaacttatttgaaatcaatt

SEQ ID NO: 482440 - DNA, 20 bp, Artificial
  CRISPR gRNA sequence
atttgaaatcaatttggcat

SEQ ID NO: 482441 - DNA, 20 bp, Artificial
  CRISPR gRNA sequence
tttgaaatcaatttggcatc

SEQ ID NO: 482442 - DNA, 20 bp, Artificial
  CRISPR gRNA sequence
gaaatcaatttggcatctga

SEQ ID NO: 482443 - DNA, 20 bp, Artificial
  CRISPR gRNA sequence
aaatcaatttggcatctgat

SEQ ID NO: 482444 - DNA, 20 bp, Artificial
  CRISPR gRNA sequence
ggcatctgattttgtacccc

SEQ ID NO: 482445 - DNA, 20 bp, Artificial
  CRISPR gRNA sequence
gcatctgattttgtacccca

SEQ ID NO: 482446 - DNA, 20 bp, Artificial
  CRISPR gRNA sequence
attttgtaccccaaaatgtg

SEQ ID NO: 482447 - DNA, 20 bp, Artificial
  CRISPR gRNA sequence
tgtaccccaaaatgtgtgga

SEQ ID NO: 482448 - DNA, 20 bp, Artificial
  CRISPR gRNA sequence
gtaccccaaaatgtgtggac

SEQ ID NO: 482449 - DNA, 20 bp, Artificial
  CRISPR gRNA sequence
taccccaaaatgtgtggaca

SEQ ID NO: 482450 - DNA, 20 bp, Artificial
  CRISPR gRNA sequence
attcttaaaccccctgacac

SEQ ID NO: 482451 - DNA, 20 bp, Artificial
  CRISPR gRNA sequence
ttaaaccccctgacacataa

SEQ ID NO: 482452 - DNA, 20 bp, Artificial
  CRISPR gRNA sequence
aaaccccctgacacataaaa

SEQ ID NO: 482453 - DNA, 20 bp, Artificial
  CRISPR gRNA sequence
aaccccctgacacataaaag

SEQ ID NO: 482454 - DNA, 20 bp, Artificial
  CRISPR gRNA sequence
acacataaaagcgacccgaa

SEQ ID NO: 482455 - DNA, 20 bp, Artificial
  CRISPR gRNA sequence
ccaggaagtcagaccctcta

SEQ ID NO: 482456 - DNA, 20 bp, Artificial
  CRISPR gRNA sequence
ggaagtcagaccctctacag

SEQ ID NO: 482457 - DNA, 20 bp, Artificial
  CRISPR gRNA sequence
cctctacagcagtgttcaaa

SEQ ID NO: 482458 - DNA, 20 bp, Artificial
  CRISPR gRNA sequence
aacagacatgtgtttgttga

SEQ ID NO: 482459 - DNA, 20 bp, Artificial
  CRISPR gRNA sequence
tgtgtttgttgatggcccac

SEQ ID NO: 482460 - DNA, 20 bp, Artificial
  CRISPR gRNA sequence
gatggcccacaagtgccctt

SEQ ID NO: 482461 - DNA, 20 bp, Artificial
  CRISPR gRNA sequence
caagtgcccttcggctgcta

SEQ ID NO: 482462 - DNA, 20 bp, Artificial
  CRISPR gRNA sequence
agtgcccttcggctgctata

SEQ ID NO: 482463 - DNA, 20 bp, Artificial
  CRISPR gRNA sequence
tgctatagagaataaaaatg

SEQ ID NO: 482464 - DNA, 20 bp, Artificial
  CRISPR gRNA sequence
gctatagagaataaaaatgc

SEQ ID NO: 482465 - DNA, 20 bp, Artificial
  CRISPR gRNA sequence
ctatagagaataaaaatgca

SEQ ID NO: 482466 - DNA, 20 bp, Artificial
  CRISPR gRNA sequence
gagaataaaaatgcagggta

SEQ ID NO: 482467 - DNA, 20 bp, Artificial
  CRISPR gRNA sequence
gaataaaaatgcagggtatg

SEQ ID NO: 482468 - DNA, 20 bp, Artificial
  CRISPR gRNA sequence
ataaaaatgcagggtatgga

SEQ ID NO: 482469 - DNA, 20 bp, Artificial
  CRISPR gRNA sequence
taaaaatgcagggtatggag

SEQ ID NO: 482470 - DNA, 20 bp, Artificial
  CRISPR gRNA sequence
gaggatacataaatttaatt

SEQ ID NO: 482471 - DNA, 20 bp, Artificial
  CRISPR gRNA sequence
aggatacataaatttaattc

SEQ ID NO: 482472 - DNA, 20 bp, Artificial
  CRISPR gRNA sequence
tacataaatttaattcaggc

SEQ ID NO: 482473 - DNA, 20 bp, Artificial
  CRISPR gRNA sequence
acataaatttaattcaggca

SEQ ID NO: 482474 - DNA, 20 bp, Artificial
  CRISPR gRNA sequence
tttaattcaggcaaggaatt

SEQ ID NO: 482475 - DNA, 20 bp, Artificial
  CRISPR gRNA sequence
tttatatgaaactcctatgt

SEQ ID NO: 482476 - DNA, 20 bp, Artificial
  CRISPR gRNA sequence
tgaaactcctatgttagata

SEQ ID NO: 482477 - DNA, 20 bp, Artificial
  CRISPR gRNA sequence
gaaactcctatgttagatac

SEQ ID NO: 482478 - DNA, 20 bp, Artificial
  CRISPR gRNA sequence
aaactcctatgttagataca

SEQ ID NO: 482479 - DNA, 20 bp, Artificial
  CRISPR gRNA sequence
ctcctatgttagatacaggg

SEQ ID NO: 482480 - DNA, 20 bp, Artificial
  CRISPR gRNA sequence
tcctatgttagatacagggt

SEQ ID NO: 482481 - DNA, 20 bp, Artificial
  CRISPR gRNA sequence
gatacagggtaggaaaattg

SEQ ID NO: 482482 - DNA, 20 bp, Artificial
  CRISPR gRNA sequence
gggtaggaaaattgaagaac

SEQ ID NO: 482483 - DNA, 20 bp, Artificial
  CRISPR gRNA sequence
ggtaggaaaattgaagaacc

SEQ ID NO: 482484 - DNA, 20 bp, Artificial
  CRISPR gRNA sequence
ttgaagaaccaggctttgtg

SEQ ID NO: 482485 - DNA, 20 bp, Artificial
  CRISPR gRNA sequence
ctttgtgcagtatcacctgt

SEQ ID NO: 482486 - DNA, 20 bp, Artificial
  CRISPR gRNA sequence
tttgtgcagtatcacctgtt

SEQ ID NO: 482487 - DNA, 20 bp, Artificial
  CRISPR gRNA sequence
ttgtgcagtatcacctgttg

SEQ ID NO: 482488 - DNA, 20 bp, Artificial
  CRISPR gRNA sequence
tatcacctgttggggtctct

SEQ ID NO: 482489 - DNA, 20 bp, Artificial
  CRISPR gRNA sequence
acctgttggggtctctgagt

SEQ ID NO: 482490 - DNA, 20 bp, Artificial
  CRISPR gRNA sequence
tctctgagtaagtcctctcc

SEQ ID NO: 482491 - DNA, 20 bp, Artificial
  CRISPR gRNA sequence
gttcacccttgtcgctttcc

SEQ ID NO: 482492 - DNA, 20 bp, Artificial
  CRISPR gRNA sequence
ttcacccttgtcgctttcct

SEQ ID NO: 482493 - DNA, 20 bp, Artificial
  CRISPR gRNA sequence
ccttgtcgctttcctgggct

SEQ ID NO: 482494 - DNA, 20 bp, Artificial
  CRISPR gRNA sequence
gtcgctttcctgggctcagc

SEQ ID NO: 482495 - DNA, 20 bp, Artificial
  CRISPR gRNA sequence
cgctttcctgggctcagcca

SEQ ID NO: 482496 - DNA, 20 bp, Artificial
  CRISPR gRNA sequence
cctgggctcagccagagtca

SEQ ID NO: 482497 - DNA, 20 bp, Artificial
  CRISPR gRNA sequence
agtcacagccctgctcccca

SEQ ID NO: 482498 - DNA, 20 bp, Artificial
  CRISPR gRNA sequence
cacagccttgttgaaatgtc

SEQ ID NO: 482499 - DNA, 20 bp, Artificial
  CRISPR gRNA sequence
aaatgtctggcctgacgact

SEQ ID NO: 482500 - DNA, 20 bp, Artificial
  CRISPR gRNA sequence
aatgtctggcctgacgactc

SEQ ID NO: 482501 - DNA, 20 bp, Artificial
  CRISPR gRNA sequence
atgtctggcctgacgactca

SEQ ID NO: 482502 - DNA, 20 bp, Artificial
  CRISPR gRNA sequence
gcctgacgactcagggaacc

SEQ ID NO: 482503 - DNA, 20 bp, Artificial
  CRISPR gRNA sequence
acgactcagggaacccagca

SEQ ID NO: 482504 - DNA, 20 bp, Artificial
  CRISPR gRNA sequence
agggaacccagcatagtgtc

SEQ ID NO: 482505 - DNA, 20 bp, Artificial
  CRISPR gRNA sequence
gattccaactgcctcattct

SEQ ID NO: 482506 - DNA, 20 bp, Artificial
  CRISPR gRNA sequence
actgcctcattctcagccct

SEQ ID NO: 482507 - DNA, 20 bp, Artificial
  CRISPR gRNA sequence
ttctcagccctcagctgcct

SEQ ID NO: 482508 - DNA, 20 bp, Artificial
  CRISPR gRNA sequence
cctcccttcaatgtgcatcc

SEQ ID NO: 482509 - DNA, 20 bp, Artificial
  CRISPR gRNA sequence
ctcccttcaatgtgcatcct

SEQ ID NO: 482510 - DNA, 20 bp, Artificial
  CRISPR gRNA sequence
tcccttcaatgtgcatcctg

SEQ ID NO: 482511 - DNA, 20 bp, Artificial
  CRISPR gRNA sequence
gcatcctggggaacactcat

SEQ ID NO: 482512 - DNA, 20 bp, Artificial
  CRISPR gRNA sequence
catcctggggaacactcatc

SEQ ID NO: 482513 - DNA, 20 bp, Artificial
  CRISPR gRNA sequence
ggggaacactcatcaggact

SEQ ID NO: 482514 - DNA, 20 bp, Artificial
  CRISPR gRNA sequence
atcaggactcagaacttaaa

SEQ ID NO: 482515 - DNA, 20 bp, Artificial
  CRISPR gRNA sequence
ctcagaacttaaatagaaca

SEQ ID NO: 482516 - DNA, 20 bp, Artificial
  CRISPR gRNA sequence
ttaaatagaacatggtttct

SEQ ID NO: 482517 - DNA, 20 bp, Artificial
  CRISPR gRNA sequence
aaatagaacatggtttctga

SEQ ID NO: 482518 - DNA, 20 bp, Artificial
  CRISPR gRNA sequence
aatagaacatggtttctgag

SEQ ID NO: 482519 - DNA, 20 bp, Artificial
  CRISPR gRNA sequence
ttctgagaggcctcttcctc

SEQ ID NO: 482520 - DNA, 20 bp, Artificial
  CRISPR gRNA sequence
tctgagaggcctcttcctct

SEQ ID NO: 482521 - DNA, 20 bp, Artificial
  CRISPR gRNA sequence
gagaggcctcttcctctggg

SEQ ID NO: 482522 - DNA, 20 bp, Artificial
  CRISPR gRNA sequence
tctgggaagccacttctatg

SEQ ID NO: 482523 - DNA, 20 bp, Artificial
  CRISPR gRNA sequence
gggaagccacttctatgaag

SEQ ID NO: 482524 - DNA, 20 bp, Artificial
  CRISPR gRNA sequence
acttctatgaagaagccaaa

SEQ ID NO: 482525 - DNA, 20 bp, Artificial
  CRISPR gRNA sequence
ataaatcaaacatcatacca

SEQ ID NO: 482526 - DNA, 20 bp, Artificial
  CRISPR gRNA sequence
caaacatcataccatggaca

SEQ ID NO: 482527 - DNA, 20 bp, Artificial
  CRISPR gRNA sequence
catcataccatggacaaagc

SEQ ID NO: 482528 - DNA, 20 bp, Artificial
  CRISPR gRNA sequence
caaagctggtctcaacaccc

SEQ ID NO: 482529 - DNA, 20 bp, Artificial
  CRISPR gRNA sequence
ggtctcaacaccccagttat

SEQ ID NO: 482530 - DNA, 20 bp, Artificial
  CRISPR gRNA sequence
gtctcaacaccccagttatc

SEQ ID NO: 482531 - DNA, 20 bp, Artificial
  CRISPR gRNA sequence
caacaccccagttatcaggt

SEQ ID NO: 482532 - DNA, 20 bp, Artificial
  CRISPR gRNA sequence
tatcaggtcagcatgtgctc

SEQ ID NO: 482533 - DNA, 20 bp, Artificial
  CRISPR gRNA sequence
atcaggtcagcatgtgctct

SEQ ID NO: 482534 - DNA, 20 bp, Artificial
  CRISPR gRNA sequence
ctctgggtgatttttctact

SEQ ID NO: 482535 - DNA, 20 bp, Artificial
  CRISPR gRNA sequence
ctgggtgatttttctactta

SEQ ID NO: 482536 - DNA, 20 bp, Artificial
  CRISPR gRNA sequence
gtgatttttctacttagaga

SEQ ID NO: 482537 - DNA, 20 bp, Artificial
  CRISPR gRNA sequence
tgatttttctacttagagat

SEQ ID NO: 482538 - DNA, 20 bp, Artificial
  CRISPR gRNA sequence
tgcaccatctactctccctt

SEQ ID NO: 482539 - DNA, 20 bp, Artificial
  CRISPR gRNA sequence
tcccttcagcccactccccc

SEQ ID NO: 482540 - DNA, 20 bp, Artificial
  CRISPR gRNA sequence
cttcagcccactccccctgg

SEQ ID NO: 482541 - DNA, 20 bp, Artificial
  CRISPR gRNA sequence
cactccccctggtggccaac

SEQ ID NO: 482542 - DNA, 20 bp, Artificial
  CRISPR gRNA sequence
ccccctggtggccaactggc

SEQ ID NO: 482543 - DNA, 20 bp, Artificial
  CRISPR gRNA sequence
ccctggtggccaactggcca

SEQ ID NO: 482544 - DNA, 20 bp, Artificial
  CRISPR gRNA sequence
cctggtggccaactggccag

SEQ ID NO: 482545 - DNA, 20 bp, Artificial
  CRISPR gRNA sequence
tggccaactggccagaggta

SEQ ID NO: 482546 - DNA, 20 bp, Artificial
  CRISPR gRNA sequence
ggccaactggccagaggtaa

SEQ ID NO: 482547 - DNA, 20 bp, Artificial
  CRISPR gRNA sequence
ctggccagaggtaaaggtat

SEQ ID NO: 482548 - DNA, 20 bp, Artificial
  CRISPR gRNA sequence
agaggtaaaggtatgagatg

SEQ ID NO: 482549 - DNA, 20 bp, Artificial
  CRISPR gRNA sequence
gaggtaaaggtatgagatgc

SEQ ID NO: 482550 - DNA, 20 bp, Artificial
  CRISPR gRNA sequence
aggtaaaggtatgagatgca

SEQ ID NO: 482551 - DNA, 20 bp, Artificial
  CRISPR gRNA sequence
gtaaaggtatgagatgcagg

SEQ ID NO: 482552 - DNA, 20 bp, Artificial
  CRISPR gRNA sequence
aggtatgagatgcagggaga

SEQ ID NO: 482553 - DNA, 20 bp, Artificial
  CRISPR gRNA sequence
aaagttttttctctgcaatt

SEQ ID NO: 482554 - DNA, 20 bp, Artificial
  CRISPR gRNA sequence
tttttctctgcaattgagta

SEQ ID NO: 482555 - DNA, 20 bp, Artificial
  CRISPR gRNA sequence
ctctgcaattgagtaaagcc

SEQ ID NO: 482556 - DNA, 20 bp, Artificial
  CRISPR gRNA sequence
tctgcaattgagtaaagccc

SEQ ID NO: 482557 - DNA, 20 bp, Artificial
  CRISPR gRNA sequence
attgagtaaagcccaggccc

SEQ ID NO: 482558 - DNA, 20 bp, Artificial
  CRISPR gRNA sequence
ccctggcccccacccacgtg

SEQ ID NO: 482559 - DNA, 20 bp, Artificial
  CRISPR gRNA sequence
cacccacgtgcagaacctgc

SEQ ID NO: 482560 - DNA, 20 bp, Artificial
  CRISPR gRNA sequence
cacgtgcagaacctgccagc

SEQ ID NO: 482561 - DNA, 20 bp, Artificial
  CRISPR gRNA sequence
agaacctgccagccagttca

SEQ ID NO: 482562 - DNA, 20 bp, Artificial
  CRISPR gRNA sequence
cctgccagccagttcacagc

SEQ ID NO: 482563 - DNA, 20 bp, Artificial
  CRISPR gRNA sequence
ccagccagttcacagccgga

SEQ ID NO: 482564 - DNA, 20 bp, Artificial
  CRISPR gRNA sequence
cagttcacagccggacagtc

SEQ ID NO: 482565 - DNA, 20 bp, Artificial
  CRISPR gRNA sequence
agttcacagccggacagtcc

SEQ ID NO: 482566 - DNA, 20 bp, Artificial
  CRISPR gRNA sequence
agccggacagtccaggcttt

SEQ ID NO: 482567 - DNA, 20 bp, Artificial
  CRISPR gRNA sequence
ccggacagtccaggctttca

SEQ ID NO: 482568 - DNA, 20 bp, Artificial
  CRISPR gRNA sequence
cggacagtccaggctttcag

SEQ ID NO: 482569 - DNA, 20 bp, Artificial
  CRISPR gRNA sequence
gacagtccaggctttcagag

SEQ ID NO: 482570 - DNA, 20 bp, Artificial
  CRISPR gRNA sequence
acagtccaggctttcagagg

SEQ ID NO: 482571 - DNA, 20 bp, Artificial
  CRISPR gRNA sequence
cagtccaggctttcagagga

SEQ ID NO: 482572 - DNA, 20 bp, Artificial
  CRISPR gRNA sequence
gggctgtttcttcttcccct

SEQ ID NO: 482573 - DNA, 20 bp, Artificial
  CRISPR gRNA sequence
atcattccttcctcttgctt

SEQ ID NO: 482574 - DNA, 20 bp, Artificial
  CRISPR gRNA sequence
attccttcctcttgctttgg

SEQ ID NO: 482575 - DNA, 20 bp, Artificial
  CRISPR gRNA sequence
cttcctcttgctttggaaga

SEQ ID NO: 482576 - DNA, 20 bp, Artificial
  CRISPR gRNA sequence
ttcctcttgctttggaagat

SEQ ID NO: 482577 - DNA, 20 bp, Artificial
  CRISPR gRNA sequence
cttgctttggaagatgggcc

SEQ ID NO: 482578 - DNA, 20 bp, Artificial
  CRISPR gRNA sequence
ttgctttggaagatgggcct

SEQ ID NO: 482579 - DNA, 20 bp, Artificial
  CRISPR gRNA sequence
tttggaagatgggcctgggc

SEQ ID NO: 482580 - DNA, 20 bp, Artificial
  CRISPR gRNA sequence
gaagatgggcctgggccggc

SEQ ID NO: 482581 - DNA, 20 bp, Artificial
  CRISPR gRNA sequence
agatgggcctgggccggcga

SEQ ID NO: 482582 - DNA, 20 bp, Artificial
  CRISPR gRNA sequence
ggcctgggccggcgagagtc

SEQ ID NO: 482583 - DNA, 20 bp, Artificial
  CRISPR gRNA sequence
ccggcgagagtctagaaatg

SEQ ID NO: 482584 - DNA, 20 bp, Artificial
  CRISPR gRNA sequence
gtctagaaatgcagtcaacc

SEQ ID NO: 482585 - DNA, 20 bp, Artificial
  CRISPR gRNA sequence
ctagaaatgcagtcaaccca

SEQ ID NO: 482586 - DNA, 20 bp, Artificial
  CRISPR gRNA sequence
agaaatgcagtcaacccaga

SEQ ID NO: 482587 - DNA, 20 bp, Artificial
  CRISPR gRNA sequence
gaaatgcagtcaacccagag

SEQ ID NO: 482588 - DNA, 20 bp, Artificial
  CRISPR gRNA sequence
aaatgcagtcaacccagaga

SEQ ID NO: 482589 - DNA, 20 bp, Artificial
  CRISPR gRNA sequence
aatgcagtcaacccagagag

SEQ ID NO: 482590 - DNA, 20 bp, Artificial
  CRISPR gRNA sequence
tgcagtcaacccagagaggg

SEQ ID NO: 482591 - DNA, 20 bp, Artificial
  CRISPR gRNA sequence
tcaacccagagaggggagaa

SEQ ID NO: 482592 - DNA, 20 bp, Artificial
  CRISPR gRNA sequence
caacccagagaggggagaaa

SEQ ID NO: 482593 - DNA, 20 bp, Artificial
  CRISPR gRNA sequence
gagaggggagaaaaggaaac

SEQ ID NO: 482594 - DNA, 20 bp, Artificial
  CRISPR gRNA sequence
ggagaaaaggaaacaagtga

SEQ ID NO: 482595 - DNA, 20 bp, Artificial
  CRISPR gRNA sequence
acaagtgacagcttgaaaat

SEQ ID NO: 482596 - DNA, 20 bp, Artificial
  CRISPR gRNA sequence
caagtgacagcttgaaaatc

SEQ ID NO: 482597 - DNA, 20 bp, Artificial
  CRISPR gRNA sequence
gtgacagcttgaaaatcagg

SEQ ID NO: 482598 - DNA, 20 bp, Artificial
  CRISPR gRNA sequence
gacagcttgaaaatcaggtg

SEQ ID NO: 482599 - DNA, 20 bp, Artificial
  CRISPR gRNA sequence
acagcttgaaaatcaggtgg

SEQ ID NO: 482600 - DNA, 20 bp, Artificial
  CRISPR gRNA sequence
cagcttgaaaatcaggtgga

SEQ ID NO: 482601 - DNA, 20 bp, Artificial
  CRISPR gRNA sequence
atcacttacataacactttc

SEQ ID NO: 482602 - DNA, 20 bp, Artificial
  CRISPR gRNA sequence
ctttctagattacaaatact

SEQ ID NO: 482603 - DNA, 20 bp, Artificial
  CRISPR gRNA sequence
gattacaaatacttggaatg

SEQ ID NO: 482604 - DNA, 20 bp, Artificial
  CRISPR gRNA sequence
ttcatgtctgatctgtaaat

SEQ ID NO: 482605 - DNA, 20 bp, Artificial
  CRISPR gRNA sequence
atgtctgatctgtaaattgg

SEQ ID NO: 482606 - DNA, 20 bp, Artificial
  CRISPR gRNA sequence
aattggaagatattatttaa

SEQ ID NO: 482607 - DNA, 20 bp, Artificial
  CRISPR gRNA sequence
taacagccttgctcttatca

SEQ ID NO: 482608 - DNA, 20 bp, Artificial
  CRISPR gRNA sequence
cttgctcttatcatggttgt

SEQ ID NO: 482609 - DNA, 20 bp, Artificial
  CRISPR gRNA sequence
atcattttcaaaacaaaata

SEQ ID NO: 482610 - DNA, 20 bp, Artificial
  CRISPR gRNA sequence
ttcaaaacaaaatatagaac

SEQ ID NO: 482611 - DNA, 20 bp, Artificial
  CRISPR gRNA sequence
acaaatttccatatcctctc

SEQ ID NO: 482612 - DNA, 20 bp, Artificial
  CRISPR gRNA sequence
tttccatatcctctccagac

SEQ ID NO: 482613 - DNA, 20 bp, Artificial
  CRISPR gRNA sequence
ttccatatcctctccagact

SEQ ID NO: 482614 - DNA, 20 bp, Artificial
  CRISPR gRNA sequence
ccagactaggaactgttcta

SEQ ID NO: 482615 - DNA, 20 bp, Artificial
  CRISPR gRNA sequence
agactaggaactgttctata

SEQ ID NO: 482616 - DNA, 20 bp, Artificial
  CRISPR gRNA sequence
atccactgtgccaattccca

SEQ ID NO: 482617 - DNA, 20 bp, Artificial
  CRISPR gRNA sequence
cactgtgccaattcccaaag

SEQ ID NO: 482618 - DNA, 20 bp, Artificial
  CRISPR gRNA sequence
caaagcagatgctgatgtgc

SEQ ID NO: 482619 - DNA, 20 bp, Artificial
  CRISPR gRNA sequence
gcagatgctgatgtgcaaga

SEQ ID NO: 482620 - DNA, 20 bp, Artificial
  CRISPR gRNA sequence
cagatgctgatgtgcaagaa

SEQ ID NO: 482621 - DNA, 20 bp, Artificial
  CRISPR gRNA sequence
tgctgatgtgcaagaaaggt

SEQ ID NO: 482622 - DNA, 20 bp, Artificial
  CRISPR gRNA sequence
aagaaaggtgagaattgctg

SEQ ID NO: 482623 - DNA, 20 bp, Artificial
  CRISPR gRNA sequence
gtgagaattgctgcagcaac

SEQ ID NO: 482624 - DNA, 20 bp, Artificial
  CRISPR gRNA sequence
tgagaattgctgcagcaact

SEQ ID NO: 482625 - DNA, 20 bp, Artificial
  CRISPR gRNA sequence
gcaactaggaataaacatca

SEQ ID NO: 482626 - DNA, 20 bp, Artificial
  CRISPR gRNA sequence
gaataaacatcaaagttctc

SEQ ID NO: 482627 - DNA, 20 bp, Artificial
  CRISPR gRNA sequence
caaagttctccagctctttg

SEQ ID NO: 482628 - DNA, 20 bp, Artificial
  CRISPR gRNA sequence
cagctctttgcggctcaatc

SEQ ID NO: 482629 - DNA, 20 bp, Artificial
  CRISPR gRNA sequence
ctctttgcggctcaatcgag

SEQ ID NO: 482630 - DNA, 20 bp, Artificial
  CRISPR gRNA sequence
tctttgcggctcaatcgagc

SEQ ID NO: 482631 - DNA, 20 bp, Artificial
  CRISPR gRNA sequence
ctttgcggctcaatcgagca

SEQ ID NO: 482632 - DNA, 20 bp, Artificial
  CRISPR gRNA sequence
ggctcaatcgagcagggttc

SEQ ID NO: 482633 - DNA, 20 bp, Artificial
  CRISPR gRNA sequence
gctcaatcgagcagggttct

SEQ ID NO: 482634 - DNA, 20 bp, Artificial
  CRISPR gRNA sequence
tcgagcagggttctgggctt

SEQ ID NO: 482635 - DNA, 20 bp, Artificial
  CRISPR gRNA sequence
cgagcagggttctgggcttt

SEQ ID NO: 482636 - DNA, 20 bp, Artificial
  CRISPR gRNA sequence
tgactctttccaatctgcaa

SEQ ID NO: 482637 - DNA, 20 bp, Artificial
  CRISPR gRNA sequence
ctttccaatctgcaaaagaa

SEQ ID NO: 482638 - DNA, 20 bp, Artificial
  CRISPR gRNA sequence
tttccaatctgcaaaagaaa

SEQ ID NO: 482639 - DNA, 20 bp, Artificial
  CRISPR gRNA sequence
tccaatctgcaaaagaaaag

SEQ ID NO: 482640 - DNA, 20 bp, Artificial
  CRISPR gRNA sequence
caaaagaaaaggagaaactt

SEQ ID NO: 482641 - DNA, 20 bp, Artificial
  CRISPR gRNA sequence
gaaacttcagacccttgcac

SEQ ID NO: 482642 - DNA, 20 bp, Artificial
  CRISPR gRNA sequence
aaacttcagacccttgcact

SEQ ID NO: 482643 - DNA, 20 bp, Artificial
  CRISPR gRNA sequence
acttcagacccttgcactgg

SEQ ID NO: 482644 - DNA, 20 bp, Artificial
  CRISPR gRNA sequence
cttcagacccttgcactggg

SEQ ID NO: 482645 - DNA, 20 bp, Artificial
  CRISPR gRNA sequence
ggtccttatcacaatcctgt

SEQ ID NO: 482646 - DNA, 20 bp, Artificial
  CRISPR gRNA sequence
gtccttatcacaatcctgtg

SEQ ID NO: 482647 - DNA, 20 bp, Artificial
  CRISPR gRNA sequence
gacttgccatccccatttta

SEQ ID NO: 482648 - DNA, 20 bp, Artificial
  CRISPR gRNA sequence
ttttacagatttaaaaaatg

SEQ ID NO: 482649 - DNA, 20 bp, Artificial
  CRISPR gRNA sequence
cagatttaaaaaatgaagct

SEQ ID NO: 482650 - DNA, 20 bp, Artificial
  CRISPR gRNA sequence
gatttaaaaaatgaagctca

SEQ ID NO: 482651 - DNA, 20 bp, Artificial
  CRISPR gRNA sequence
gagtgacaaaacaaattact

SEQ ID NO: 482652 - DNA, 20 bp, Artificial
  CRISPR gRNA sequence
agtgacaaaacaaattactc

SEQ ID NO: 482653 - DNA, 20 bp, Artificial
  CRISPR gRNA sequence
aattactcaggatccacgac

SEQ ID NO: 482654 - DNA, 20 bp, Artificial
  CRISPR gRNA sequence
caggatccacgactagtgtg

SEQ ID NO: 482655 - DNA, 20 bp, Artificial
  CRISPR gRNA sequence
tccacgactagtgtgaagtg

SEQ ID NO: 482656 - DNA, 20 bp, Artificial
  CRISPR gRNA sequence
ccacgactagtgtgaagtgc

SEQ ID NO: 482657 - DNA, 20 bp, Artificial
  CRISPR gRNA sequence
acgactagtgtgaagtgcag

SEQ ID NO: 482658 - DNA, 20 bp, Artificial
  CRISPR gRNA sequence
cgactagtgtgaagtgcagg

SEQ ID NO: 482659 - DNA, 20 bp, Artificial
  CRISPR gRNA sequence
gactagtgtgaagtgcagga

SEQ ID NO: 482660 - DNA, 20 bp, Artificial
  CRISPR gRNA sequence
gtgcaggagggacttgaatc

SEQ ID NO: 482661 - DNA, 20 bp, Artificial
  CRISPR gRNA sequence
ggacttgaatctagttcttc

SEQ ID NO: 482662 - DNA, 20 bp, Artificial
  CRISPR gRNA sequence
agttcttctggctccaattc

SEQ ID NO: 482663 - DNA, 20 bp, Artificial
  CRISPR gRNA sequence
atgctttttcatgacctcac

SEQ ID NO: 482664 - DNA, 20 bp, Artificial
  CRISPR gRNA sequence
tcatgacctcacaagctacc

SEQ ID NO: 482665 - DNA, 20 bp, Artificial
  CRISPR gRNA sequence
catgacctcacaagctacct

SEQ ID NO: 482666 - DNA, 20 bp, Artificial
  CRISPR gRNA sequence
acaagctacctgggtctaca

SEQ ID NO: 482667 - DNA, 20 bp, Artificial
  CRISPR gRNA sequence
cacagtgccctctatgaccc

SEQ ID NO: 482668 - DNA, 20 bp, Artificial
  CRISPR gRNA sequence
acagtgccctctatgaccct

SEQ ID NO: 482669 - DNA, 20 bp, Artificial
  CRISPR gRNA sequence
ctctatgaccctgggttgtc

SEQ ID NO: 482670 - DNA, 20 bp, Artificial
  CRISPR gRNA sequence
atgaccctgggttgtccagt

SEQ ID NO: 482671 - DNA, 20 bp, Artificial
  CRISPR gRNA sequence
tgtccagttggctttaatgt

SEQ ID NO: 482672 - DNA, 20 bp, Artificial
  CRISPR gRNA sequence
gtccagttggctttaatgtt

SEQ ID NO: 482673 - DNA, 20 bp, Artificial
  CRISPR gRNA sequence
ttggctttaatgttgggtga

SEQ ID NO: 482674 - DNA, 20 bp, Artificial
  CRISPR gRNA sequence
ttaatgttgggtgatagctg

SEQ ID NO: 482675 - DNA, 20 bp, Artificial
  CRISPR gRNA sequence
ttgggtgatagctgaagtgc

SEQ ID NO: 482676 - DNA, 20 bp, Artificial
  CRISPR gRNA sequence
tgggtgatagctgaagtgcc

SEQ ID NO: 482677 - DNA, 20 bp, Artificial
  CRISPR gRNA sequence
agctgaagtgccaggaattc

SEQ ID NO: 482678 - DNA, 20 bp, Artificial
  CRISPR gRNA sequence
tgaagtgccaggaattccag

SEQ ID NO: 482679 - DNA, 20 bp, Artificial
  CRISPR gRNA sequence
gaagtgccaggaattccagc

SEQ ID NO: 482680 - DNA, 20 bp, Artificial
  CRISPR gRNA sequence
gtgccaggaattccagcagg

SEQ ID NO: 482681 - DNA, 20 bp, Artificial
  CRISPR gRNA sequence
catccctcccttctgaccaa

SEQ ID NO: 482682 - DNA, 20 bp, Artificial
  CRISPR gRNA sequence
ccctcccttctgaccaatgg

SEQ ID NO: 482683 - DNA, 20 bp, Artificial
  CRISPR gRNA sequence
accaatggcagcatctttat

SEQ ID NO: 482684 - DNA, 20 bp, Artificial
  CRISPR gRNA sequence
gcagcatctttattggacca

SEQ ID NO: 482685 - DNA, 20 bp, Artificial
  CRISPR gRNA sequence
cagcatctttattggaccac

SEQ ID NO: 482686 - DNA, 20 bp, Artificial
  CRISPR gRNA sequence
catctttattggaccacagg

SEQ ID NO: 482687 - DNA, 20 bp, Artificial
  CRISPR gRNA sequence
atctttattggaccacaggt

SEQ ID NO: 482688 - DNA, 20 bp, Artificial
  CRISPR gRNA sequence
tctttattggaccacaggtg

SEQ ID NO: 482689 - DNA, 20 bp, Artificial
  CRISPR gRNA sequence
tttattggaccacaggtggg

SEQ ID NO: 482690 - DNA, 20 bp, Artificial
  CRISPR gRNA sequence
ttattggaccacaggtgggg

SEQ ID NO: 482691 - DNA, 20 bp, Artificial
  CRISPR gRNA sequence
ggaccacaggtggggaggct

SEQ ID NO: 482692 - DNA, 20 bp, Artificial
  CRISPR gRNA sequence
gaccacaggtggggaggctc

SEQ ID NO: 482693 - DNA, 20 bp, Artificial
  CRISPR gRNA sequence
caggtggggaggctcaggtg

SEQ ID NO: 482694 - DNA, 20 bp, Artificial
  CRISPR gRNA sequence
gggaggctcaggtgtagtat

SEQ ID NO: 482695 - DNA, 20 bp, Artificial
  CRISPR gRNA sequence
ggaggctcaggtgtagtatg

SEQ ID NO: 482696 - DNA, 20 bp, Artificial
  CRISPR gRNA sequence
caggtgtagtatgaggctaa

SEQ ID NO: 482697 - DNA, 20 bp, Artificial
  CRISPR gRNA sequence
aggtgtagtatgaggctaat

SEQ ID NO: 482698 - DNA, 20 bp, Artificial
  CRISPR gRNA sequence
tgtagtatgaggctaatggg

SEQ ID NO: 482699 - DNA, 20 bp, Artificial
  CRISPR gRNA sequence
agtatgaggctaatgggtag

SEQ ID NO: 482700 - DNA, 20 bp, Artificial
  CRISPR gRNA sequence
gtatgaggctaatgggtagt

SEQ ID NO: 482701 - DNA, 20 bp, Artificial
  CRISPR gRNA sequence
tatgaggctaatgggtagtg

SEQ ID NO: 482702 - DNA, 20 bp, Artificial
  CRISPR gRNA sequence
atgaggctaatgggtagtgg

SEQ ID NO: 482703 - DNA, 20 bp, Artificial
  CRISPR gRNA sequence
gaggctaatgggtagtgggg

SEQ ID NO: 482704 - DNA, 20 bp, Artificial
  CRISPR gRNA sequence
aggctaatgggtagtggggg

SEQ ID NO: 482705 - DNA, 20 bp, Artificial
  CRISPR gRNA sequence
taatgggtagtgggggaggt

SEQ ID NO: 482706 - DNA, 20 bp, Artificial
  CRISPR gRNA sequence
aatgggtagtgggggaggtt

SEQ ID NO: 482707 - DNA, 20 bp, Artificial
  CRISPR gRNA sequence
atgggtagtgggggaggttg

SEQ ID NO: 482708 - DNA, 20 bp, Artificial
  CRISPR gRNA sequence
tgggtagtgggggaggttgg

SEQ ID NO: 482709 - DNA, 20 bp, Artificial
  CRISPR gRNA sequence
ctccatgccttaatttctct

SEQ ID NO: 482710 - DNA, 20 bp, Artificial
  CRISPR gRNA sequence
ttaatttctctgagtataaa

SEQ ID NO: 482711 - DNA, 20 bp, Artificial
  CRISPR gRNA sequence
tttctctgagtataaatgga

SEQ ID NO: 482712 - DNA, 20 bp, Artificial
  CRISPR gRNA sequence
gtataattatacctatcttg

SEQ ID NO: 482713 - DNA, 20 bp, Artificial
  CRISPR gRNA sequence
cctatcttgtagcattctgt

SEQ ID NO: 482714 - DNA, 20 bp, Artificial
  CRISPR gRNA sequence
ctatcttgtagcattctgtg

SEQ ID NO: 482715 - DNA, 20 bp, Artificial
  CRISPR gRNA sequence
taaataaaataatccatgtg

SEQ ID NO: 482716 - DNA, 20 bp, Artificial
  CRISPR gRNA sequence
aataatccatgtgaagacac

SEQ ID NO: 482717 - DNA, 20 bp, Artificial
  CRISPR gRNA sequence
aatccatgtgaagacactgg

SEQ ID NO: 482718 - DNA, 20 bp, Artificial
  CRISPR gRNA sequence
atccatgtgaagacactggc

SEQ ID NO: 482719 - DNA, 20 bp, Artificial
  CRISPR gRNA sequence
cttatccataataaaccccc

SEQ ID NO: 482720 - DNA, 20 bp, Artificial
  CRISPR gRNA sequence
ataaacccccaagaaatgtt

SEQ ID NO: 482721 - DNA, 20 bp, Artificial
  CRISPR gRNA sequence
aatgttgagtccctcctttc

SEQ ID NO: 482722 - DNA, 20 bp, Artificial
  CRISPR gRNA sequence
ccagtccctaaatgctctga

SEQ ID NO: 482723 - DNA, 20 bp, Artificial
  CRISPR gRNA sequence
cagtccctaaatgctctgat

SEQ ID NO: 482724 - DNA, 20 bp, Artificial
  CRISPR gRNA sequence
atgggaatcaattcaaccac

SEQ ID NO: 482725 - DNA, 20 bp, Artificial
  CRISPR gRNA sequence
tgggaatcaattcaaccacc

SEQ ID NO: 482726 - DNA, 20 bp, Artificial
  CRISPR gRNA sequence
atcaattcaaccaccaggct

SEQ ID NO: 482727 - DNA, 20 bp, Artificial
  CRISPR gRNA sequence
aattcaaccaccaggctcag

SEQ ID NO: 482728 - DNA, 20 bp, Artificial
  CRISPR gRNA sequence
gctcagtggtcatctctgaa

SEQ ID NO: 482729 - DNA, 20 bp, Artificial
  CRISPR gRNA sequence
ctgaacagtgttgacccctg

SEQ ID NO: 482730 - DNA, 20 bp, Artificial
  CRISPR gRNA sequence
aacagtgttgacccctgaag

SEQ ID NO: 482731 - DNA, 20 bp, Artificial
  CRISPR gRNA sequence
gttgacccctgaagaagatt

SEQ ID NO: 482732 - DNA, 20 bp, Artificial
  CRISPR gRNA sequence
gattaagctcacctatgtcc

SEQ ID NO: 482733 - DNA, 20 bp, Artificial
  CRISPR gRNA sequence
agctcacctatgtcctggaa

SEQ ID NO: 482734 - DNA, 20 bp, Artificial
  CRISPR gRNA sequence
atgtcctggaatggctccca

SEQ ID NO: 482735 - DNA, 20 bp, Artificial
  CRISPR gRNA sequence
tcccaaagacttgctaattt

SEQ ID NO: 482736 - DNA, 20 bp, Artificial
  CRISPR gRNA sequence
gctaattttagaaaatcatt

SEQ ID NO: 482737 - DNA, 20 bp, Artificial
  CRISPR gRNA sequence
taattttagaaaatcattta

SEQ ID NO: 482738 - DNA, 20 bp, Artificial
  CRISPR gRNA sequence
acccctcctccgaacactct

SEQ ID NO: 482739 - DNA, 20 bp, Artificial
  CRISPR gRNA sequence
ctcctccgaacactcttgga

SEQ ID NO: 482740 - DNA, 20 bp, Artificial
  CRISPR gRNA sequence
tcctccgaacactcttggaa

SEQ ID NO: 482741 - DNA, 20 bp, Artificial
  CRISPR gRNA sequence
ctccgaacactcttggaaag

SEQ ID NO: 482742 - DNA, 20 bp, Artificial
  CRISPR gRNA sequence
ccgaacactcttggaaagga

SEQ ID NO: 482743 - DNA, 20 bp, Artificial
  CRISPR gRNA sequence
tcttggaaaggagagatgtc

SEQ ID NO: 482744 - DNA, 20 bp, Artificial
  CRISPR gRNA sequence
aaggagagatgtccagtttg

SEQ ID NO: 482745 - DNA, 20 bp, Artificial
  CRISPR gRNA sequence
gatgtccagtttgtggccca

SEQ ID NO: 482746 - DNA, 20 bp, Artificial
  CRISPR gRNA sequence
ccagtttgtggcccacagcc

SEQ ID NO: 482747 - DNA, 20 bp, Artificial
  CRISPR gRNA sequence
cagtttgtggcccacagcct

SEQ ID NO: 482748 - DNA, 20 bp, Artificial
  CRISPR gRNA sequence
gtggcccacagcctgggaac

SEQ ID NO: 482749 - DNA, 20 bp, Artificial
  CRISPR gRNA sequence
ccacagcctgggaactagct

SEQ ID NO: 482750 - DNA, 20 bp, Artificial
  CRISPR gRNA sequence
cacagcctgggaactagctc

SEQ ID NO: 482751 - DNA, 20 bp, Artificial
  CRISPR gRNA sequence
acagcctgggaactagctcg

SEQ ID NO: 482752 - DNA, 20 bp, Artificial
  CRISPR gRNA sequence
cctgggaactagctcgggga

SEQ ID NO: 482753 - DNA, 20 bp, Artificial
  CRISPR gRNA sequence
acggccctaatttaaaaccc

SEQ ID NO: 482754 - DNA, 20 bp, Artificial
  CRISPR gRNA sequence
aatttaaaacccaagctgcc

SEQ ID NO: 482755 - DNA, 20 bp, Artificial
  CRISPR gRNA sequence
taaaacccaagctgcccagt

SEQ ID NO: 482756 - DNA, 20 bp, Artificial
  CRISPR gRNA sequence
ctaaacacgcaatatgatct

SEQ ID NO: 482757 - DNA, 20 bp, Artificial
  CRISPR gRNA sequence
taaacacgcaatatgatctt

SEQ ID NO: 482758 - DNA, 20 bp, Artificial
  CRISPR gRNA sequence
cacgcaatatgatcttgggt

SEQ ID NO: 482759 - DNA, 20 bp, Artificial
  CRISPR gRNA sequence
ggtcagaccctcactctcct

SEQ ID NO: 482760 - DNA, 20 bp, Artificial
  CRISPR gRNA sequence
gtcagaccctcactctcctt

SEQ ID NO: 482761 - DNA, 20 bp, Artificial
  CRISPR gRNA sequence
ccctcactctccttgggctt

SEQ ID NO: 482762 - DNA, 20 bp, Artificial
  CRISPR gRNA sequence
gtgtcttcatctctaaaaca

SEQ ID NO: 482763 - DNA, 20 bp, Artificial
  CRISPR gRNA sequence
tctaaaacaaagacttgcat

SEQ ID NO: 482764 - DNA, 20 bp, Artificial
  CRISPR gRNA sequence
aaaacaaagacttgcattag

SEQ ID NO: 482765 - DNA, 20 bp, Artificial
  CRISPR gRNA sequence
tctaaattccctacaactct

SEQ ID NO: 482766 - DNA, 20 bp, Artificial
  CRISPR gRNA sequence
tgtgtgaatgatcttttcct

SEQ ID NO: 482767 - DNA, 20 bp, Artificial
  CRISPR gRNA sequence
ttcctaagtgtaccctttca

SEQ ID NO: 482768 - DNA, 20 bp, Artificial
  CRISPR gRNA sequence
taagtgtaccctttcatggc

SEQ ID NO: 482769 - DNA, 20 bp, Artificial
  CRISPR gRNA sequence
accctttcatggctagattt

SEQ ID NO: 482770 - DNA, 20 bp, Artificial
  CRISPR gRNA sequence
ccctttcatggctagatttc

SEQ ID NO: 482771 - DNA, 20 bp, Artificial
  CRISPR gRNA sequence
cctttcatggctagatttca

SEQ ID NO: 482772 - DNA, 20 bp, Artificial
  CRISPR gRNA sequence
tagatttcagggctatgcaa

SEQ ID NO: 482773 - DNA, 20 bp, Artificial
  CRISPR gRNA sequence
tttcagggctatgcaacaga

SEQ ID NO: 482774 - DNA, 20 bp, Artificial
  CRISPR gRNA sequence
caacagacagtaaacccatt

SEQ ID NO: 482775 - DNA, 20 bp, Artificial
  CRISPR gRNA sequence
aacagacagtaaacccattg

SEQ ID NO: 482776 - DNA, 20 bp, Artificial
  CRISPR gRNA sequence
cagacagtaaacccattgag

SEQ ID NO: 482777 - DNA, 20 bp, Artificial
  CRISPR gRNA sequence
gtaaacccattgaggagttc

SEQ ID NO: 482778 - DNA, 20 bp, Artificial
  CRISPR gRNA sequence
tccagaatcttaccacttca

SEQ ID NO: 482779 - DNA, 20 bp, Artificial
  CRISPR gRNA sequence
gaatcttaccacttcataga

SEQ ID NO: 482780 - DNA, 20 bp, Artificial
  CRISPR gRNA sequence
cttcatagatagtgctattg

SEQ ID NO: 482781 - DNA, 20 bp, Artificial
  CRISPR gRNA sequence
ttcatagatagtgctattga

SEQ ID NO: 482782 - DNA, 20 bp, Artificial
  CRISPR gRNA sequence
atagatagtgctattgaagg

SEQ ID NO: 482783 - DNA, 20 bp, Artificial
  CRISPR gRNA sequence
tagatagtgctattgaagga

SEQ ID NO: 482784 - DNA, 20 bp, Artificial
  CRISPR gRNA sequence
agatagtgctattgaaggaa

SEQ ID NO: 482785 - DNA, 20 bp, Artificial
  CRISPR gRNA sequence
tgctattgaaggaagggctg

SEQ ID NO: 482786 - DNA, 20 bp, Artificial
  CRISPR gRNA sequence
agggctgtggttcctcttcc

SEQ ID NO: 482787 - DNA, 20 bp, Artificial
  CRISPR gRNA sequence
gtggttcctcttcctggatc

SEQ ID NO: 482788 - DNA, 20 bp, Artificial
  CRISPR gRNA sequence
tcctcttcctggatccagac

SEQ ID NO: 482789 - DNA, 20 bp, Artificial
  CRISPR gRNA sequence
ctggatccagactagaaatt

SEQ ID NO: 482790 - DNA, 20 bp, Artificial
  CRISPR gRNA sequence
gatccagactagaaattcag

SEQ ID NO: 482791 - DNA, 20 bp, Artificial
  CRISPR gRNA sequence
atccagactagaaattcaga

SEQ ID NO: 482792 - DNA, 20 bp, Artificial
  CRISPR gRNA sequence
gactagaaattcagaaggta

SEQ ID NO: 482793 - DNA, 20 bp, Artificial
  CRISPR gRNA sequence
ggtaaagaatacttaacttc

SEQ ID NO: 482794 - DNA, 20 bp, Artificial
  CRISPR gRNA sequence
agaatacttaacttcgagat

SEQ ID NO: 482795 - DNA, 20 bp, Artificial
  CRISPR gRNA sequence
ataagtgctctcccactcct

SEQ ID NO: 482796 - DNA, 20 bp, Artificial
  CRISPR gRNA sequence
ctcccactcctaagtgatgt

SEQ ID NO: 482797 - DNA, 20 bp, Artificial
  CRISPR gRNA sequence
cccactcctaagtgatgtga

SEQ ID NO: 482798 - DNA, 20 bp, Artificial
  CRISPR gRNA sequence
ccactcctaagtgatgtgag

SEQ ID NO: 482799 - DNA, 20 bp, Artificial
  CRISPR gRNA sequence
agtgatgtgagaggtcccaa

SEQ ID NO: 482800 - DNA, 20 bp, Artificial
  CRISPR gRNA sequence
tgatgtgagaggtcccaaaa

SEQ ID NO: 482801 - DNA, 20 bp, Artificial
  CRISPR gRNA sequence
gagaggtcccaaaagagact

SEQ ID NO: 482802 - DNA, 20 bp, Artificial
  CRISPR gRNA sequence
agaggtcccaaaagagactc

SEQ ID NO: 482803 - DNA, 20 bp, Artificial
  CRISPR gRNA sequence
gaggtcccaaaagagactca

SEQ ID NO: 482804 - DNA, 20 bp, Artificial
  CRISPR gRNA sequence
cccaaaagagactcagggcc

SEQ ID NO: 482805 - DNA, 20 bp, Artificial
  CRISPR gRNA sequence
tcagggcccagaaaaattct

SEQ ID NO: 482806 - DNA, 20 bp, Artificial
  CRISPR gRNA sequence
cagggcccagaaaaattctg

SEQ ID NO: 482807 - DNA, 20 bp, Artificial
  CRISPR gRNA sequence
gaaaaattctgaggcactct

SEQ ID NO: 482808 - DNA, 20 bp, Artificial
  CRISPR gRNA sequence
aattctgaggcactctcagc

SEQ ID NO: 482809 - DNA, 20 bp, Artificial
  CRISPR gRNA sequence
actctcagccagaaaatgaa

SEQ ID NO: 482810 - DNA, 20 bp, Artificial
  CRISPR gRNA sequence
atgaatagaatctgtcaccc

SEQ ID NO: 482811 - DNA, 20 bp, Artificial
  CRISPR gRNA sequence
tgaatagaatctgtcaccct

SEQ ID NO: 482812 - DNA, 20 bp, Artificial
  CRISPR gRNA sequence
aatagaatctgtcaccctag

SEQ ID NO: 482813 - DNA, 20 bp, Artificial
  CRISPR gRNA sequence
tcaccctaggagcaaaacaa

SEQ ID NO: 482814 - DNA, 20 bp, Artificial
  CRISPR gRNA sequence
gagcaaaacaatggtgttta

SEQ ID NO: 482815 - DNA, 20 bp, Artificial
  CRISPR gRNA sequence
acaatggtgtttatggtctc

SEQ ID NO: 482816 - DNA, 20 bp, Artificial
  CRISPR gRNA sequence
caatggtgtttatggtctcc

SEQ ID NO: 482817 - DNA, 20 bp, Artificial
  CRISPR gRNA sequence
aatggtgtttatggtctcca

SEQ ID NO: 482818 - DNA, 20 bp, Artificial
  CRISPR gRNA sequence
ggtgtttatggtctccaggg

SEQ ID NO: 482819 - DNA, 20 bp, Artificial
  CRISPR gRNA sequence
cagggaagacacaatatata

SEQ ID NO: 482820 - DNA, 20 bp, Artificial
  CRISPR gRNA sequence
tgatatttctgaaccaaaat

SEQ ID NO: 482821 - DNA, 20 bp, Artificial
  CRISPR gRNA sequence
tatatacacacacacattcc

SEQ ID NO: 482822 - DNA, 20 bp, Artificial
  CRISPR gRNA sequence
tatacacacacacattccca

SEQ ID NO: 482823 - DNA, 20 bp, Artificial
  CRISPR gRNA sequence
acacatacacacatatccct

SEQ ID NO: 482824 - DNA, 20 bp, Artificial
  CRISPR gRNA sequence
cacatacacacatatccctc

SEQ ID NO: 482825 - DNA, 20 bp, Artificial
  CRISPR gRNA sequence
cacccttaatgtaaacaatc

SEQ ID NO: 482826 - DNA, 20 bp, Artificial
  CRISPR gRNA sequence
acccttaatgtaaacaatcc

SEQ ID NO: 482827 - DNA, 20 bp, Artificial
  CRISPR gRNA sequence
atataaataattgccaaccc

SEQ ID NO: 482828 - DNA, 20 bp, Artificial
  CRISPR gRNA sequence
tataaataattgccaaccca

SEQ ID NO: 482829 - DNA, 20 bp, Artificial
  CRISPR gRNA sequence
aattgccaacccaaggacac

SEQ ID NO: 482830 - DNA, 20 bp, Artificial
  CRISPR gRNA sequence
aacccaaggacactagaatt

SEQ ID NO: 482831 - DNA, 20 bp, Artificial
  CRISPR gRNA sequence
cccaaggacactagaattca

SEQ ID NO: 482832 - DNA, 20 bp, Artificial
  CRISPR gRNA sequence
ccaaggacactagaattcag

SEQ ID NO: 482833 - DNA, 20 bp, Artificial
  CRISPR gRNA sequence
ctagaattcagaggcacatt

SEQ ID NO: 482834 - DNA, 20 bp, Artificial
  CRISPR gRNA sequence
gaattcagaggcacattcag

SEQ ID NO: 482835 - DNA, 20 bp, Artificial
  CRISPR gRNA sequence
gaggcacattcagtagcata

SEQ ID NO: 482836 - DNA, 20 bp, Artificial
  CRISPR gRNA sequence
ggcacattcagtagcatata

SEQ ID NO: 482837 - DNA, 20 bp, Artificial
  CRISPR gRNA sequence
tatagagtttacatacacca

SEQ ID NO: 482838 - DNA, 20 bp, Artificial
  CRISPR gRNA sequence
agagtttacatacaccaaag

SEQ ID NO: 482839 - DNA, 20 bp, Artificial
  CRISPR gRNA sequence
gagtttacatacaccaaagc

SEQ ID NO: 482840 - DNA, 20 bp, Artificial
  CRISPR gRNA sequence
tacaccaaagcaggtgaaca

SEQ ID NO: 482841 - DNA, 20 bp, Artificial
  CRISPR gRNA sequence
ggtgcctgtgaacatctata

SEQ ID NO: 482842 - DNA, 20 bp, Artificial
  CRISPR gRNA sequence
atctatatggccttatattg

SEQ ID NO: 482843 - DNA, 20 bp, Artificial
  CRISPR gRNA sequence
aaaacaaatctctctcacga

SEQ ID NO: 482844 - DNA, 20 bp, Artificial
  CRISPR gRNA sequence
aaacaaatctctctcacgat

SEQ ID NO: 482845 - DNA, 20 bp, Artificial
  CRISPR gRNA sequence
tctctctcacgatgggatcc

SEQ ID NO: 482846 - DNA, 20 bp, Artificial
  CRISPR gRNA sequence
ctctcacgatgggatccaag

SEQ ID NO: 482847 - DNA, 20 bp, Artificial
  CRISPR gRNA sequence
tctcacgatgggatccaagt

SEQ ID NO: 482848 - DNA, 20 bp, Artificial
  CRISPR gRNA sequence
tgggatccaagtaggttgaa

SEQ ID NO: 482849 - DNA, 20 bp, Artificial
  CRISPR gRNA sequence
aagtaggttgaatggcttat

SEQ ID NO: 482850 - DNA, 20 bp, Artificial
  CRISPR gRNA sequence
taggttgaatggcttattgg

SEQ ID NO: 482851 - DNA, 20 bp, Artificial
  CRISPR gRNA sequence
aggttgaatggcttattgga

SEQ ID NO: 482852 - DNA, 20 bp, Artificial
  CRISPR gRNA sequence
gttgaatggcttattggaag

SEQ ID NO: 482853 - DNA, 20 bp, Artificial
  CRISPR gRNA sequence
ttgaatggcttattggaagg

SEQ ID NO: 482854 - DNA, 20 bp, Artificial
  CRISPR gRNA sequence
ttggaaggaggttgaatgaa

SEQ ID NO: 482855 - DNA, 20 bp, Artificial
  CRISPR gRNA sequence
cctaaaccccttcaaacctg

SEQ ID NO: 482856 - DNA, 20 bp, Artificial
  CRISPR gRNA sequence
cctgtggtccctgacctgca

SEQ ID NO: 482857 - DNA, 20 bp, Artificial
  CRISPR gRNA sequence
ctgacctgcatggacttcca

SEQ ID NO: 482858 - DNA, 20 bp, Artificial
  CRISPR gRNA sequence
catggacttccacagttgtg

SEQ ID NO: 482859 - DNA, 20 bp, Artificial
  CRISPR gRNA sequence
aattcccatactaccatgtt

SEQ ID NO: 482860 - DNA, 20 bp, Artificial
  CRISPR gRNA sequence
attcccatactaccatgtta

SEQ ID NO: 482861 - DNA, 20 bp, Artificial
  CRISPR gRNA sequence
actaccatgttaaggctttc

SEQ ID NO: 482862 - DNA, 20 bp, Artificial
  CRISPR gRNA sequence
ggctttctggcttcacactg

SEQ ID NO: 482863 - DNA, 20 bp, Artificial
  CRISPR gRNA sequence
ctggcttcacactgtggctc

SEQ ID NO: 482864 - DNA, 20 bp, Artificial
  CRISPR gRNA sequence
tcacactgtggctccagcct

SEQ ID NO: 482865 - DNA, 20 bp, Artificial
  CRISPR gRNA sequence
cacactgtggctccagcctt

SEQ ID NO: 482866 - DNA, 20 bp, Artificial
  CRISPR gRNA sequence
cttcccatccccttccatac

SEQ ID NO: 482867 - DNA, 20 bp, Artificial
  CRISPR gRNA sequence
tcccatccccttccatacaa

SEQ ID NO: 482868 - DNA, 20 bp, Artificial
  CRISPR gRNA sequence
aaaacaatgaccatgtgtac

SEQ ID NO: 482869 - DNA, 20 bp, Artificial
  CRISPR gRNA sequence
aaacaatgaccatgtgtacc

SEQ ID NO: 482870 - DNA, 20 bp, Artificial
  CRISPR gRNA sequence
ggatacccaactctgtttcc

SEQ ID NO: 482871 - DNA, 20 bp, Artificial
  CRISPR gRNA sequence
aactctgtttccaagtacac

SEQ ID NO: 482872 - DNA, 20 bp, Artificial
  CRISPR gRNA sequence
ctctgtttccaagtacacaa

SEQ ID NO: 482873 - DNA, 20 bp, Artificial
  CRISPR gRNA sequence
ctgtttccaagtacacaaga

SEQ ID NO: 482874 - DNA, 20 bp, Artificial
  CRISPR gRNA sequence
acacaagagagctacgaact

SEQ ID NO: 482875 - DNA, 20 bp, Artificial
  CRISPR gRNA sequence
agagagctacgaactcagct

SEQ ID NO: 482876 - DNA, 20 bp, Artificial
  CRISPR gRNA sequence
agagctacgaactcagcttg

SEQ ID NO: 482877 - DNA, 20 bp, Artificial
  CRISPR gRNA sequence
gctacgaactcagcttggag

SEQ ID NO: 482878 - DNA, 20 bp, Artificial
  CRISPR gRNA sequence
ctacgaactcagcttggaga

SEQ ID NO: 482879 - DNA, 20 bp, Artificial
  CRISPR gRNA sequence
ctcagcttggagaaggattt

SEQ ID NO: 482880 - DNA, 20 bp, Artificial
  CRISPR gRNA sequence
ggagaaggatttcagtgcaa

SEQ ID NO: 482881 - DNA, 20 bp, Artificial
  CRISPR gRNA sequence
gagaaggatttcagtgcaaa

SEQ ID NO: 482882 - DNA, 20 bp, Artificial
  CRISPR gRNA sequence
aggatttcagtgcaaaagga

SEQ ID NO: 482883 - DNA, 20 bp, Artificial
  CRISPR gRNA sequence
ggatttcagtgcaaaaggat

SEQ ID NO: 482884 - DNA, 20 bp, Artificial
  CRISPR gRNA sequence
tgcaaaaggatgggttgcct

SEQ ID NO: 482885 - DNA, 20 bp, Artificial
  CRISPR gRNA sequence
aaggatgggttgcctcagtc

SEQ ID NO: 482886 - DNA, 20 bp, Artificial
  CRISPR gRNA sequence
ggatgggttgcctcagtcca

SEQ ID NO: 482887 - DNA, 20 bp, Artificial
  CRISPR gRNA sequence
gatgggttgcctcagtccag

SEQ ID NO: 482888 - DNA, 20 bp, Artificial
  CRISPR gRNA sequence
ctcagtccagaggcctccac

SEQ ID NO: 482889 - DNA, 20 bp, Artificial
  CRISPR gRNA sequence
agtccagaggcctccaccag

SEQ ID NO: 482890 - DNA, 20 bp, Artificial
  CRISPR gRNA sequence
gtccagaggcctccaccagc

SEQ ID NO: 482891 - DNA, 20 bp, Artificial
  CRISPR gRNA sequence
tccaccagcaggtgactgac

SEQ ID NO: 482892 - DNA, 20 bp, Artificial
  CRISPR gRNA sequence
ccagcaggtgactgactggc

SEQ ID NO: 482893 - DNA, 20 bp, Artificial
  CRISPR gRNA sequence
cagcaggtgactgactggcc

SEQ ID NO: 482894 - DNA, 20 bp, Artificial
  CRISPR gRNA sequence
gactggccaggacctttctc

SEQ ID NO: 482895 - DNA, 20 bp, Artificial
  CRISPR gRNA sequence
ggacctttctctggtctctg

SEQ ID NO: 482896 - DNA, 20 bp, Artificial
  CRISPR gRNA sequence
gacctttctctggtctctga

SEQ ID NO: 482897 - DNA, 20 bp, Artificial
  CRISPR gRNA sequence
ttctctggtctctgaaggtc

SEQ ID NO: 482898 - DNA, 20 bp, Artificial
  CRISPR gRNA sequence
aggtcaagattgtgtctctc

SEQ ID NO: 482899 - DNA, 20 bp, Artificial
  CRISPR gRNA sequence
agattgtgtctctctagatc

SEQ ID NO: 482900 - DNA, 20 bp, Artificial
  CRISPR gRNA sequence
ctagatccagtctactcctc

SEQ ID NO: 482901 - DNA, 20 bp, Artificial
  CRISPR gRNA sequence
ccagtctactcctccagctc

SEQ ID NO: 482902 - DNA, 20 bp, Artificial
  CRISPR gRNA sequence
cagtctactcctccagctcc

SEQ ID NO: 482903 - DNA, 20 bp, Artificial
  CRISPR gRNA sequence
ccctgccttgcaaacccctc

SEQ ID NO: 482904 - DNA, 20 bp, Artificial
  CRISPR gRNA sequence
ccctccagtatctctcacca

SEQ ID NO: 482905 - DNA, 20 bp, Artificial
  CRISPR gRNA sequence
agtatctctcaccatagcct

SEQ ID NO: 482906 - DNA, 20 bp, Artificial
  CRISPR gRNA sequence
atagcctcagctgacctact

SEQ ID NO: 482907 - DNA, 20 bp, Artificial
  CRISPR gRNA sequence
ctgacctactaagtaccccg

SEQ ID NO: 482908 - DNA, 20 bp, Artificial
  CRISPR gRNA sequence
ccccgtagtctctctgtgca

SEQ ID NO: 482909 - DNA, 20 bp, Artificial
  CRISPR gRNA sequence
tgactgtcctttacctccca

SEQ ID NO: 482910 - DNA, 20 bp, Artificial
  CRISPR gRNA sequence
gaaactcccaaaaactcatc

SEQ ID NO: 482911 - DNA, 20 bp, Artificial
  CRISPR gRNA sequence
catctagtctactgttctct

SEQ ID NO: 482912 - DNA, 20 bp, Artificial
  CRISPR gRNA sequence
agtctactgttctcttagtc

SEQ ID NO: 482913 - DNA, 20 bp, Artificial
  CRISPR gRNA sequence
ctactgttctcttagtctag

SEQ ID NO: 482914 - DNA, 20 bp, Artificial
  CRISPR gRNA sequence
tagaagctgttatttttctc

SEQ ID NO: 482915 - DNA, 20 bp, Artificial
  CRISPR gRNA sequence
agctgttatttttctccaga

SEQ ID NO: 482916 - DNA, 20 bp, Artificial
  CRISPR gRNA sequence
tatttttctccagacagaac

SEQ ID NO: 482917 - DNA, 20 bp, Artificial
  CRISPR gRNA sequence
tttctccagacagaaccagt

SEQ ID NO: 482918 - DNA, 20 bp, Artificial
  CRISPR gRNA sequence
ttctccagacagaaccagta

SEQ ID NO: 482919 - DNA, 20 bp, Artificial
  CRISPR gRNA sequence
accagtaaggcatttctcat

SEQ ID NO: 482920 - DNA, 20 bp, Artificial
  CRISPR gRNA sequence
ggcccattgacatttaaata

SEQ ID NO: 482921 - DNA, 20 bp, Artificial
  CRISPR gRNA sequence
atttaaatacagtcatttaa

SEQ ID NO: 482922 - DNA, 20 bp, Artificial
  CRISPR gRNA sequence
taaatacagtcatttaacag

SEQ ID NO: 482923 - DNA, 20 bp, Artificial
  CRISPR gRNA sequence
gtcatttaacagaagctact

SEQ ID NO: 482924 - DNA, 20 bp, Artificial
  CRISPR gRNA sequence
ctactcagatacacacaata

SEQ ID NO: 482925 - DNA, 20 bp, Artificial
  CRISPR gRNA sequence
cacaataaagaacaacttgc

SEQ ID NO: 482926 - DNA, 20 bp, Artificial
  CRISPR gRNA sequence
acaataaagaacaacttgcc

SEQ ID NO: 482927 - DNA, 20 bp, Artificial
  CRISPR gRNA sequence
acaacaccccaccaccacca

SEQ ID NO: 482928 - DNA, 20 bp, Artificial
  CRISPR gRNA sequence
caacaccccaccaccaccac

SEQ ID NO: 482929 - DNA, 20 bp, Artificial
  CRISPR gRNA sequence
caccccaccaccaccacggg

SEQ ID NO: 482930 - DNA, 20 bp, Artificial
  CRISPR gRNA sequence
ccccaccaccaccacgggaa

SEQ ID NO: 482931 - DNA, 20 bp, Artificial
  CRISPR gRNA sequence
cccaccaccaccacgggaag

SEQ ID NO: 482932 - DNA, 20 bp, Artificial
  CRISPR gRNA sequence
cgggaagaggctcaccttcc

SEQ ID NO: 482933 - DNA, 20 bp, Artificial
  CRISPR gRNA sequence
gaagaggctcaccttcctgg

SEQ ID NO: 482934 - DNA, 20 bp, Artificial
  CRISPR gRNA sequence
aagaggctcaccttcctgga

SEQ ID NO: 482935 - DNA, 20 bp, Artificial
  CRISPR gRNA sequence
taatgaatataatgtatatg

SEQ ID NO: 482936 - DNA, 20 bp, Artificial
  CRISPR gRNA sequence
aatgaatataatgtatatgc

SEQ ID NO: 482937 - DNA, 20 bp, Artificial
  CRISPR gRNA sequence
atatgcaggttcttgtgacg

SEQ ID NO: 482938 - DNA, 20 bp, Artificial
  CRISPR gRNA sequence
tatgcaggttcttgtgacgt

SEQ ID NO: 482939 - DNA, 20 bp, Artificial
  CRISPR gRNA sequence
tgcaggttcttgtgacgtgg

SEQ ID NO: 482940 - DNA, 20 bp, Artificial
  CRISPR gRNA sequence
aggttcttgtgacgtgggag

SEQ ID NO: 482941 - DNA, 20 bp, Artificial
  CRISPR gRNA sequence
ttcttgtgacgtgggagcag

SEQ ID NO: 482942 - DNA, 20 bp, Artificial
  CRISPR gRNA sequence
cgtgggagcagaagactaat

SEQ ID NO: 482943 - DNA, 20 bp, Artificial
  CRISPR gRNA sequence
gggagcagaagactaatgag

SEQ ID NO: 482944 - DNA, 20 bp, Artificial
  CRISPR gRNA sequence
gagcagaagactaatgagaa

SEQ ID NO: 482945 - DNA, 20 bp, Artificial
  CRISPR gRNA sequence
gaagagaaataaaatcattt

SEQ ID NO: 482946 - DNA, 20 bp, Artificial
  CRISPR gRNA sequence
gagaaataaaatcatttcag

SEQ ID NO: 482947 - DNA, 20 bp, Artificial
  CRISPR gRNA sequence
ataaaatcatttcagaagca

SEQ ID NO: 482948 - DNA, 20 bp, Artificial
  CRISPR gRNA sequence
tcatttcagaagcacagatc

SEQ ID NO: 482949 - DNA, 20 bp, Artificial
  CRISPR gRNA sequence
agatccagcacaatcttaca

SEQ ID NO: 482950 - DNA, 20 bp, Artificial
  CRISPR gRNA sequence
gatccagcacaatcttacaa

SEQ ID NO: 482951 - DNA, 20 bp, Artificial
  CRISPR gRNA sequence
ttctcctcctcaaccctgcc

SEQ ID NO: 482952 - DNA, 20 bp, Artificial
  CRISPR gRNA sequence
cctcctcaaccctgcccaga

SEQ ID NO: 482953 - DNA, 20 bp, Artificial
  CRISPR gRNA sequence
cctcaaccctgcccagatgg

SEQ ID NO: 482954 - DNA, 20 bp, Artificial
  CRISPR gRNA sequence
cctgcccagatggaagcttc

SEQ ID NO: 482955 - DNA, 20 bp, Artificial
  CRISPR gRNA sequence
cagatggaagcttcaagtgt

SEQ ID NO: 482956 - DNA, 20 bp, Artificial
  CRISPR gRNA sequence
aagcttcaagtgttagtgaa

SEQ ID NO: 482957 - DNA, 20 bp, Artificial
  CRISPR gRNA sequence
gcttcaagtgttagtgaaaa

SEQ ID NO: 482958 - DNA, 20 bp, Artificial
  CRISPR gRNA sequence
agtgttagtgaaaagagccc

SEQ ID NO: 482959 - DNA, 20 bp, Artificial
  CRISPR gRNA sequence
tagtgaaaagagccctggac

SEQ ID NO: 482960 - DNA, 20 bp, Artificial
  CRISPR gRNA sequence
gaaaagagccctggactagc

SEQ ID NO: 482961 - DNA, 20 bp, Artificial
  CRISPR gRNA sequence
aaaagagccctggactagcc

SEQ ID NO: 482962 - DNA, 20 bp, Artificial
  CRISPR gRNA sequence
aagagccctggactagccag

SEQ ID NO: 482963 - DNA, 20 bp, Artificial
  CRISPR gRNA sequence
agagccctggactagccagg

SEQ ID NO: 482964 - DNA, 20 bp, Artificial
  CRISPR gRNA sequence
ccctggactagccaggaggt

SEQ ID NO: 482965 - DNA, 20 bp, Artificial
  CRISPR gRNA sequence
gccaggaggtcagacaacct

SEQ ID NO: 482966 - DNA, 20 bp, Artificial
  CRISPR gRNA sequence
aggtcagacaacctgagtgc

SEQ ID NO: 482967 - DNA, 20 bp, Artificial
  CRISPR gRNA sequence
tctcgctctgtcattaatga

SEQ ID NO: 482968 - DNA, 20 bp, Artificial
  CRISPR gRNA sequence
aatgaaagcttctatttgtt

SEQ ID NO: 482969 - DNA, 20 bp, Artificial
  CRISPR gRNA sequence
ttttttgtttatttgttttt

SEQ ID NO: 482970 - DNA, 20 bp, Artificial
  CRISPR gRNA sequence
tgtttatttgtttttgagac

SEQ ID NO: 482971 - DNA, 20 bp, Artificial
  CRISPR gRNA sequence
tttatttgtttttgagacaa

SEQ ID NO: 482972 - DNA, 20 bp, Artificial
  CRISPR gRNA sequence
aagagtttcgctctattgcc

SEQ ID NO: 482973 - DNA, 20 bp, Artificial
  CRISPR gRNA sequence
agagtttcgctctattgcct

SEQ ID NO: 482974 - DNA, 20 bp, Artificial
  CRISPR gRNA sequence
tttcgctctattgcctgggc

SEQ ID NO: 482975 - DNA, 20 bp, Artificial
  CRISPR gRNA sequence
tcgctctattgcctgggctg

SEQ ID NO: 482976 - DNA, 20 bp, Artificial
  CRISPR gRNA sequence
ggagtgcaatgtctcgatct

SEQ ID NO: 482977 - DNA, 20 bp, Artificial
  CRISPR gRNA sequence
tcaccgcaacctctgcctcc

SEQ ID NO: 482978 - DNA, 20 bp, Artificial
  CRISPR gRNA sequence
caccgcaacctctgcctcct

SEQ ID NO: 482979 - DNA, 20 bp, Artificial
  CRISPR gRNA sequence
caacctctgcctcctgggtt

SEQ ID NO: 482980 - DNA, 20 bp, Artificial
  CRISPR gRNA sequence
aacctctgcctcctgggttc

SEQ ID NO: 482981 - DNA, 20 bp, Artificial
  CRISPR gRNA sequence
ttcaggcaattctcctgccc

SEQ ID NO: 482982 - DNA, 20 bp, Artificial
  CRISPR gRNA sequence
ttctcctgccccagcctcct

SEQ ID NO: 482983 - DNA, 20 bp, Artificial
  CRISPR gRNA sequence
tcctgccccagcctcctgag

SEQ ID NO: 482984 - DNA, 20 bp, Artificial
  CRISPR gRNA sequence
gccccagcctcctgagtagc

SEQ ID NO: 482985 - DNA, 20 bp, Artificial
  CRISPR gRNA sequence
ccccagcctcctgagtagct

SEQ ID NO: 482986 - DNA, 20 bp, Artificial
  CRISPR gRNA sequence
ctcctgagtagctgggatta

SEQ ID NO: 482987 - DNA, 20 bp, Artificial
  CRISPR gRNA sequence
tcctgagtagctgggattac

SEQ ID NO: 482988 - DNA, 20 bp, Artificial
  CRISPR gRNA sequence
caggtgcctgccatcatgcc

SEQ ID NO: 482989 - DNA, 20 bp, Artificial
  CRISPR gRNA sequence
ccagctaatttttgtatttt

SEQ ID NO: 482990 - DNA, 20 bp, Artificial
  CRISPR gRNA sequence
agctaatttttgtattttta

SEQ ID NO: 482991 - DNA, 20 bp, Artificial
  CRISPR gRNA sequence
aatttttgtatttttagaga

SEQ ID NO: 482992 - DNA, 20 bp, Artificial
  CRISPR gRNA sequence
atttttgtatttttagagac

SEQ ID NO: 482993 - DNA, 20 bp, Artificial
  CRISPR gRNA sequence
tttttgtatttttagagaca

SEQ ID NO: 482994 - DNA, 20 bp, Artificial
  CRISPR gRNA sequence
agagacagggtttcaccatg

SEQ ID NO: 482995 - DNA, 20 bp, Artificial
  CRISPR gRNA sequence
gagacagggtttcaccatgt

SEQ ID NO: 482996 - DNA, 20 bp, Artificial
  CRISPR gRNA sequence
cagggtttcaccatgtgggc

SEQ ID NO: 482997 - DNA, 20 bp, Artificial
  CRISPR gRNA sequence
agggtttcaccatgtgggcc

SEQ ID NO: 482998 - DNA, 20 bp, Artificial
  CRISPR gRNA sequence
tttcaccatgtgggccaggc

SEQ ID NO: 482999 - DNA, 20 bp, Artificial
  CRISPR gRNA sequence
acctcgtgatccgcccgcct

SEQ ID NO: 483000 - DNA, 20 bp, Artificial
  CRISPR gRNA sequence
ccgcccgcctcggcctccca

SEQ ID NO: 483001 - DNA, 20 bp, Artificial
  CRISPR gRNA sequence
gcctcggcctcccaaagtgt

SEQ ID NO: 483002 - DNA, 20 bp, Artificial
  CRISPR gRNA sequence
cctcggcctcccaaagtgtt

SEQ ID NO: 483003 - DNA, 20 bp, Artificial
  CRISPR gRNA sequence
ctcccaaagtgttgggatta

SEQ ID NO: 483004 - DNA, 20 bp, Artificial
  CRISPR gRNA sequence
tcccaaagtgttgggattac

SEQ ID NO: 483005 - DNA, 20 bp, Artificial
  CRISPR gRNA sequence
agtgttgggattacaggcat

SEQ ID NO: 483006 - DNA, 20 bp, Artificial
  CRISPR gRNA sequence
caggcatgagccaccgcgcc

SEQ ID NO: 483007 - DNA, 20 bp, Artificial
  CRISPR gRNA sequence
ttttaacactcctataaaat

SEQ ID NO: 483008 - DNA, 20 bp, Artificial
  CRISPR gRNA sequence
atttgccccatgccacaaat

SEQ ID NO: 483009 - DNA, 20 bp, Artificial
  CRISPR gRNA sequence
tttgccccatgccacaaatg

SEQ ID NO: 483010 - DNA, 20 bp, Artificial
  CRISPR gRNA sequence
tgccacaaatgaggctccaa

SEQ ID NO: 483011 - DNA, 20 bp, Artificial
  CRISPR gRNA sequence
gccacaaatgaggctccaaa

SEQ ID NO: 483012 - DNA, 20 bp, Artificial
  CRISPR gRNA sequence
tgaggctccaaaaggataaa

SEQ ID NO: 483013 - DNA, 20 bp, Artificial
  CRISPR gRNA sequence
tccaaaaggataaatagccc

SEQ ID NO: 483014 - DNA, 20 bp, Artificial
  CRISPR gRNA sequence
aaaggataaatagcccaagt

SEQ ID NO: 483015 - DNA, 20 bp, Artificial
  CRISPR gRNA sequence
aaggataaatagcccaagtc

SEQ ID NO: 483016 - DNA, 20 bp, Artificial
  CRISPR gRNA sequence
gataaatagcccaagtcagg

SEQ ID NO: 483017 - DNA, 20 bp, Artificial
  CRISPR gRNA sequence
caagtcaggcagtgcgtaca

SEQ ID NO: 483018 - DNA, 20 bp, Artificial
  CRISPR gRNA sequence
gtcaggcagtgcgtacacag

SEQ ID NO: 483019 - DNA, 20 bp, Artificial
  CRISPR gRNA sequence
aggcagtgcgtacacagtag

SEQ ID NO: 483020 - DNA, 20 bp, Artificial
  CRISPR gRNA sequence
cagtgcgtacacagtagaag

SEQ ID NO: 483021 - DNA, 20 bp, Artificial
  CRISPR gRNA sequence
tagaagcagaattcaaaccc

SEQ ID NO: 483022 - DNA, 20 bp, Artificial
  CRISPR gRNA sequence
aattcaaacccaagactctc

SEQ ID NO: 483023 - DNA, 20 bp, Artificial
  CRISPR gRNA sequence
attcaaacccaagactctcc

SEQ ID NO: 483024 - DNA, 20 bp, Artificial
  CRISPR gRNA sequence
ttcaaacccaagactctcca

SEQ ID NO: 483025 - DNA, 20 bp, Artificial
  CRISPR gRNA sequence
aacacctcaatgcctccctt

SEQ ID NO: 483026 - DNA, 20 bp, Artificial
  CRISPR gRNA sequence
ggcaacttgcctcccttccc

SEQ ID NO: 483027 - DNA, 20 bp, Artificial
  CRISPR gRNA sequence
cttgcctcccttccctggac

SEQ ID NO: 483028 - DNA, 20 bp, Artificial
  CRISPR gRNA sequence
tcccttccctggactggaac

SEQ ID NO: 483029 - DNA, 20 bp, Artificial
  CRISPR gRNA sequence
cccttccctggactggaacc

SEQ ID NO: 483030 - DNA, 20 bp, Artificial
  CRISPR gRNA sequence
gaaccaggtgtcctctaaat

SEQ ID NO: 483031 - DNA, 20 bp, Artificial
  CRISPR gRNA sequence
aaccaggtgtcctctaaatc

SEQ ID NO: 483032 - DNA, 20 bp, Artificial
  CRISPR gRNA sequence
caggtaaacattctcctttt

SEQ ID NO: 483033 - DNA, 20 bp, Artificial
  CRISPR gRNA sequence
attctccttttaagatgctc

SEQ ID NO: 483034 - DNA, 20 bp, Artificial
  CRISPR gRNA sequence
tctccttttaagatgctcca

SEQ ID NO: 483035 - DNA, 20 bp, Artificial
  CRISPR gRNA sequence
ctccttttaagatgctccag

SEQ ID NO: 483036 - DNA, 20 bp, Artificial
  CRISPR gRNA sequence
ccttttaagatgctccagag

SEQ ID NO: 483037 - DNA, 20 bp, Artificial
  CRISPR gRNA sequence
cttttaagatgctccagagg

SEQ ID NO: 483038 - DNA, 20 bp, Artificial
  CRISPR gRNA sequence
gtcattctcacccaacacca

SEQ ID NO: 483039 - DNA, 20 bp, Artificial
  CRISPR gRNA sequence
ctcacccaacaccatagttt

SEQ ID NO: 483040 - DNA, 20 bp, Artificial
  CRISPR gRNA sequence
tcacccaacaccatagtttg

SEQ ID NO: 483041 - DNA, 20 bp, Artificial
  CRISPR gRNA sequence
cacccaacaccatagtttga

SEQ ID NO: 483042 - DNA, 20 bp, Artificial
  CRISPR gRNA sequence
acccaacaccatagtttgag

SEQ ID NO: 483043 - DNA, 20 bp, Artificial
  CRISPR gRNA sequence
ggacctctttcttgcactga

SEQ ID NO: 483044 - DNA, 20 bp, Artificial
  CRISPR gRNA sequence
ctgatagaaattcctctcat

SEQ ID NO: 483045 - DNA, 20 bp, Artificial
  CRISPR gRNA sequence
gatagaaattcctctcattg

SEQ ID NO: 483046 - DNA, 20 bp, Artificial
  CRISPR gRNA sequence
cctctcattggagttcaatg

SEQ ID NO: 483047 - DNA, 20 bp, Artificial
  CRISPR gRNA sequence
gagttcaatgtggctgaaac

SEQ ID NO: 483048 - DNA, 20 bp, Artificial
  CRISPR gRNA sequence
gttcaatgtggctgaaacta

SEQ ID NO: 483049 - DNA, 20 bp, Artificial
  CRISPR gRNA sequence
tgtggctgaaactagagaac

SEQ ID NO: 483050 - DNA, 20 bp, Artificial
  CRISPR gRNA sequence
ggctgaaactagagaactgg

SEQ ID NO: 483051 - DNA, 20 bp, Artificial
  CRISPR gRNA sequence
atatcaaccgctcttataat

SEQ ID NO: 483052 - DNA, 20 bp, Artificial
  CRISPR gRNA sequence
atcagattttctttgcccca

SEQ ID NO: 483053 - DNA, 20 bp, Artificial
  CRISPR gRNA sequence
attttctttgccccacagct

SEQ ID NO: 483054 - DNA, 20 bp, Artificial
  CRISPR gRNA sequence
acagctcagccaccaaactg

SEQ ID NO: 483055 - DNA, 20 bp, Artificial
  CRISPR gRNA sequence
ctcagccaccaaactgaaga

SEQ ID NO: 483056 - DNA, 20 bp, Artificial
  CRISPR gRNA sequence
ttttttttttctttttttta

SEQ ID NO: 483057 - DNA, 20 bp, Artificial
  CRISPR gRNA sequence
ttttttaaagccatttttat

SEQ ID NO: 483058 - DNA, 20 bp, Artificial
  CRISPR gRNA sequence
ttaaagccatttttatcaga

SEQ ID NO: 483059 - DNA, 20 bp, Artificial
  CRISPR gRNA sequence
atcagaaagtcttttattac

SEQ ID NO: 483060 - DNA, 20 bp, Artificial
  CRISPR gRNA sequence
agtcttttattactggccac

SEQ ID NO: 483061 - DNA, 20 bp, Artificial
  CRISPR gRNA sequence
gtcttttattactggccacc

SEQ ID NO: 483062 - DNA, 20 bp, Artificial
  CRISPR gRNA sequence
cttttattactggccaccag

SEQ ID NO: 483063 - DNA, 20 bp, Artificial
  CRISPR gRNA sequence
ttttattactggccaccagg

SEQ ID NO: 483064 - DNA, 20 bp, Artificial
  CRISPR gRNA sequence
tattactggccaccaggagg

SEQ ID NO: 483065 - DNA, 20 bp, Artificial
  CRISPR gRNA sequence
ccaggaggcagtgtttccct

SEQ ID NO: 483066 - DNA, 20 bp, Artificial
  CRISPR gRNA sequence
caggaggcagtgtttccctt

SEQ ID NO: 483067 - DNA, 20 bp, Artificial
  CRISPR gRNA sequence
ggaggcagtgtttcccttgg

SEQ ID NO: 483068 - DNA, 20 bp, Artificial
  CRISPR gRNA sequence
aggcagtgtttcccttggga

SEQ ID NO: 483069 - DNA, 20 bp, Artificial
  CRISPR gRNA sequence
ttcccttgggagagatgtcc

SEQ ID NO: 483070 - DNA, 20 bp, Artificial
  CRISPR gRNA sequence
ttgggagagatgtcccagcc

SEQ ID NO: 483071 - DNA, 20 bp, Artificial
  CRISPR gRNA sequence
tgggagagatgtcccagcct

SEQ ID NO: 483072 - DNA, 20 bp, Artificial
  CRISPR gRNA sequence
ctgggttatcaatgtcattt

SEQ ID NO: 483073 - DNA, 20 bp, Artificial
  CRISPR gRNA sequence
atcaatgtcattttagccat

SEQ ID NO: 483074 - DNA, 20 bp, Artificial
  CRISPR gRNA sequence
cattttagccatcagtatta

SEQ ID NO: 483075 - DNA, 20 bp, Artificial
  CRISPR gRNA sequence
attttagccatcagtattaa

SEQ ID NO: 483076 - DNA, 20 bp, Artificial
  CRISPR gRNA sequence
agtattaaaggatgcttctc

SEQ ID NO: 483077 - DNA, 20 bp, Artificial
  CRISPR gRNA sequence
aggatgcttctccagtttat

SEQ ID NO: 483078 - DNA, 20 bp, Artificial
  CRISPR gRNA sequence
tgagtgaatttctgtaatcc

SEQ ID NO: 483079 - DNA, 20 bp, Artificial
  CRISPR gRNA sequence
tttctgtaatcccagaatat

SEQ ID NO: 483080 - DNA, 20 bp, Artificial
  CRISPR gRNA sequence
tctgtaatcccagaatataa

SEQ ID NO: 483081 - DNA, 20 bp, Artificial
  CRISPR gRNA sequence
ctgtaatcccagaatataag

SEQ ID NO: 483082 - DNA, 20 bp, Artificial
  CRISPR gRNA sequence
taatcccagaatataagagg

SEQ ID NO: 483083 - DNA, 20 bp, Artificial
  CRISPR gRNA sequence
atcccagaatataagaggtg

SEQ ID NO: 483084 - DNA, 20 bp, Artificial
  CRISPR gRNA sequence
gaatataagaggtggagtat

SEQ ID NO: 483085 - DNA, 20 bp, Artificial
  CRISPR gRNA sequence
aatataagaggtggagtatg

SEQ ID NO: 483086 - DNA, 20 bp, Artificial
  CRISPR gRNA sequence
tataagaggtggagtatgag

SEQ ID NO: 483087 - DNA, 20 bp, Artificial
  CRISPR gRNA sequence
ataagaggtggagtatgagg

SEQ ID NO: 483088 - DNA, 20 bp, Artificial
  CRISPR gRNA sequence
tggagtatgaggaggtgcaa

SEQ ID NO: 483089 - DNA, 20 bp, Artificial
  CRISPR gRNA sequence
gagtatgaggaggtgcaatg

SEQ ID NO: 483090 - DNA, 20 bp, Artificial
  CRISPR gRNA sequence
gaggaggtgcaatggagact

SEQ ID NO: 483091 - DNA, 20 bp, Artificial
  CRISPR gRNA sequence
atggagactcagaaaccctt

SEQ ID NO: 483092 - DNA, 20 bp, Artificial
  CRISPR gRNA sequence
gactcagaaaccctttggct

SEQ ID NO: 483093 - DNA, 20 bp, Artificial
  CRISPR gRNA sequence
ggctcagctctgccactacc

SEQ ID NO: 483094 - DNA, 20 bp, Artificial
  CRISPR gRNA sequence
tctgccactacctagctatg

SEQ ID NO: 483095 - DNA, 20 bp, Artificial
  CRISPR gRNA sequence
ctacctagctatgtagcctt

SEQ ID NO: 483096 - DNA, 20 bp, Artificial
  CRISPR gRNA sequence
gctatgtagccttgagatat

SEQ ID NO: 483097 - DNA, 20 bp, Artificial
  CRISPR gRNA sequence
cttgagatatcagttgacct

SEQ ID NO: 483098 - DNA, 20 bp, Artificial
  CRISPR gRNA sequence
atatcagttgacctgagtct

SEQ ID NO: 483099 - DNA, 20 bp, Artificial
  CRISPR gRNA sequence
tcggtttcctcattgtgata

SEQ ID NO: 483100 - DNA, 20 bp, Artificial
  CRISPR gRNA sequence
cctcattgtgatatggaatg

SEQ ID NO: 483101 - DNA, 20 bp, Artificial
  CRISPR gRNA sequence
tggaatgtagaccacatcta

SEQ ID NO: 483102 - DNA, 20 bp, Artificial
  CRISPR gRNA sequence
gtagaccacatctaaagtat

SEQ ID NO: 483103 - DNA, 20 bp, Artificial
  CRISPR gRNA sequence
agtattagaactattttcat

SEQ ID NO: 483104 - DNA, 20 bp, Artificial
  CRISPR gRNA sequence
gtattagaactattttcatg

SEQ ID NO: 483105 - DNA, 20 bp, Artificial
  CRISPR gRNA sequence
ttttcatgaggctgttatgt

SEQ ID NO: 483106 - DNA, 20 bp, Artificial
  CRISPR gRNA sequence
tgaggctgttatgtgagatt

SEQ ID NO: 483107 - DNA, 20 bp, Artificial
  CRISPR gRNA sequence
gctgttatgtgagatttagt

SEQ ID NO: 483108 - DNA, 20 bp, Artificial
  CRISPR gRNA sequence
tgagatttagtaagaaaata

SEQ ID NO: 483109 - DNA, 20 bp, Artificial
  CRISPR gRNA sequence
atttagtaagaaaatacagc

SEQ ID NO: 483110 - DNA, 20 bp, Artificial
  CRISPR gRNA sequence
tttagtaagaaaatacagct

SEQ ID NO: 483111 - DNA, 20 bp, Artificial
  CRISPR gRNA sequence
taagaaaatacagctgggtg

SEQ ID NO: 483112 - DNA, 20 bp, Artificial
  CRISPR gRNA sequence
gaaaatacagctgggtgcag

SEQ ID NO: 483113 - DNA, 20 bp, Artificial
  CRISPR gRNA sequence
ggtgcagtggtacacacctg

SEQ ID NO: 483114 - DNA, 20 bp, Artificial
  CRISPR gRNA sequence
gtggtacacacctgcagacc

SEQ ID NO: 483115 - DNA, 20 bp, Artificial
  CRISPR gRNA sequence
cacctgcagacctagctacc

SEQ ID NO: 483116 - DNA, 20 bp, Artificial
  CRISPR gRNA sequence
acctgcagacctagctaccc

SEQ ID NO: 483117 - DNA, 20 bp, Artificial
  CRISPR gRNA sequence
ctgcagacctagctacccag

SEQ ID NO: 483118 - DNA, 20 bp, Artificial
  CRISPR gRNA sequence
tgcagacctagctacccagg

SEQ ID NO: 483119 - DNA, 20 bp, Artificial
  CRISPR gRNA sequence
acctagctacccaggaggct

SEQ ID NO: 483120 - DNA, 20 bp, Artificial
  CRISPR gRNA sequence
cctagctacccaggaggctg

SEQ ID NO: 483121 - DNA, 20 bp, Artificial
  CRISPR gRNA sequence
agctacccaggaggctgagg

SEQ ID NO: 483122 - DNA, 20 bp, Artificial
  CRISPR gRNA sequence
gctacccaggaggctgaggt

SEQ ID NO: 483123 - DNA, 20 bp, Artificial
  CRISPR gRNA sequence
tacccaggaggctgaggtgg

SEQ ID NO: 483124 - DNA, 20 bp, Artificial
  CRISPR gRNA sequence
acccaggaggctgaggtggg

SEQ ID NO: 483125 - DNA, 20 bp, Artificial
  CRISPR gRNA sequence
ctgaggtgggaggatcactt

SEQ ID NO: 483126 - DNA, 20 bp, Artificial
  CRISPR gRNA sequence
tgaggtgggaggatcacttg

SEQ ID NO: 483127 - DNA, 20 bp, Artificial
  CRISPR gRNA sequence
gtgggaggatcacttgaggc

SEQ ID NO: 483128 - DNA, 20 bp, Artificial
  CRISPR gRNA sequence
tgggaggatcacttgaggcc

SEQ ID NO: 483129 - DNA, 20 bp, Artificial
  CRISPR gRNA sequence
tcacttgaggccgggaattc

SEQ ID NO: 483130 - DNA, 20 bp, Artificial
  CRISPR gRNA sequence
cacttgaggccgggaattca

SEQ ID NO: 483131 - DNA, 20 bp, Artificial
  CRISPR gRNA sequence
aggccgggaattcaaggctt

SEQ ID NO: 483132 - DNA, 20 bp, Artificial
  CRISPR gRNA sequence
cgggaattcaaggcttcagt

SEQ ID NO: 483133 - DNA, 20 bp, Artificial
  CRISPR gRNA sequence
tatgattctaccattgcact

SEQ ID NO: 483134 - DNA, 20 bp, Artificial
  CRISPR gRNA sequence
ttctaccattgcactcagcc

SEQ ID NO: 483135 - DNA, 20 bp, Artificial
  CRISPR gRNA sequence
taccattgcactcagcctgg

SEQ ID NO: 483136 - DNA, 20 bp, Artificial
  CRISPR gRNA sequence
attgcactcagcctggtaga

SEQ ID NO: 483137 - DNA, 20 bp, Artificial
  CRISPR gRNA sequence
ctcagcctggtagacagaat

SEQ ID NO: 483138 - DNA, 20 bp, Artificial
  CRISPR gRNA sequence
aatgagatcctgtctcataa

SEQ ID NO: 483139 - DNA, 20 bp, Artificial
  CRISPR gRNA sequence
atgagatcctgtctcataac

SEQ ID NO: 483140 - DNA, 20 bp, Artificial
  CRISPR gRNA sequence
aatctcacaaatcaccacta

SEQ ID NO: 483141 - DNA, 20 bp, Artificial
  CRISPR gRNA sequence
cctgttcccaaaaaaaccta

SEQ ID NO: 483142 - DNA, 20 bp, Artificial
  CRISPR gRNA sequence
atggaaataaaaaataaata

SEQ ID NO: 483143 - DNA, 20 bp, Artificial
  CRISPR gRNA sequence
ggaaataaaaaataaataaa

SEQ ID NO: 483144 - DNA, 20 bp, Artificial
  CRISPR gRNA sequence
aaacaataaaattgttttaa

SEQ ID NO: 483145 - DNA, 20 bp, Artificial
  CRISPR gRNA sequence
ataaaattgttttaaaagaa

SEQ ID NO: 483146 - DNA, 20 bp, Artificial
  CRISPR gRNA sequence
tgttttaaaagaaaagaaaa

SEQ ID NO: 483147 - DNA, 20 bp, Artificial
  CRISPR gRNA sequence
agaaaatggacattattgct

SEQ ID NO: 483148 - DNA, 20 bp, Artificial
  CRISPR gRNA sequence
gctaagtcataataaaataa

SEQ ID NO: 483149 - DNA, 20 bp, Artificial
  CRISPR gRNA sequence
taagtcataataaaataaaa

SEQ ID NO: 483150 - DNA, 20 bp, Artificial
  CRISPR gRNA sequence
taaaataaaagagatcaatg

SEQ ID NO: 483151 - DNA, 20 bp, Artificial
  CRISPR gRNA sequence
tttcctgaaaacgaatataa

SEQ ID NO: 483152 - DNA, 20 bp, Artificial
  CRISPR gRNA sequence
ttcctgaaaacgaatataat

SEQ ID NO: 483153 - DNA, 20 bp, Artificial
  CRISPR gRNA sequence
tcctgaaaacgaatataata

SEQ ID NO: 483154 - DNA, 20 bp, Artificial
  CRISPR gRNA sequence
aaaacgaatataatagggaa

SEQ ID NO: 483155 - DNA, 20 bp, Artificial
  CRISPR gRNA sequence
aaacgaatataatagggaat

SEQ ID NO: 483156 - DNA, 20 bp, Artificial
  CRISPR gRNA sequence
aacgaatataatagggaata

SEQ ID NO: 483157 - DNA, 20 bp, Artificial
  CRISPR gRNA sequence
taatagggaatagggataaa

SEQ ID NO: 483158 - DNA, 20 bp, Artificial
  CRISPR gRNA sequence
ggaatagggataaaaagtgc

SEQ ID NO: 483159 - DNA, 20 bp, Artificial
  CRISPR gRNA sequence
gaatagggataaaaagtgca

SEQ ID NO: 483160 - DNA, 20 bp, Artificial
  CRISPR gRNA sequence
aatagggataaaaagtgcaa

SEQ ID NO: 483161 - DNA, 20 bp, Artificial
  CRISPR gRNA sequence
ataaaaagtgcaagggcccc

SEQ ID NO: 483162 - DNA, 20 bp, Artificial
  CRISPR gRNA sequence
agtgcaagggccccaagtat

SEQ ID NO: 483163 - DNA, 20 bp, Artificial
  CRISPR gRNA sequence
gcaagggccccaagtattag

SEQ ID NO: 483164 - DNA, 20 bp, Artificial
  CRISPR gRNA sequence
agggccccaagtattagaag

SEQ ID NO: 483165 - DNA, 20 bp, Artificial
  CRISPR gRNA sequence
gccccaagtattagaagcag

SEQ ID NO: 483166 - DNA, 20 bp, Artificial
  CRISPR gRNA sequence
ccaagtattagaagcagcag

SEQ ID NO: 483167 - DNA, 20 bp, Artificial
  CRISPR gRNA sequence
caagtattagaagcagcagc

SEQ ID NO: 483168 - DNA, 20 bp, Artificial
  CRISPR gRNA sequence
aagtattagaagcagcagca

SEQ ID NO: 483169 - DNA, 20 bp, Artificial
  CRISPR gRNA sequence
attagaagcagcagcagggc

SEQ ID NO: 483170 - DNA, 20 bp, Artificial
  CRISPR gRNA sequence
gaagcagcagcagggcaaga

SEQ ID NO: 483171 - DNA, 20 bp, Artificial
  CRISPR gRNA sequence
gcagcagcagggcaagaaag

SEQ ID NO: 483172 - DNA, 20 bp, Artificial
  CRISPR gRNA sequence
gcagcagggcaagaaagcag

SEQ ID NO: 483173 - DNA, 20 bp, Artificial
  CRISPR gRNA sequence
agggcaagaaagcagaagtt

SEQ ID NO: 483174 - DNA, 20 bp, Artificial
  CRISPR gRNA sequence
cagaagttgagtcccctaac

SEQ ID NO: 483175 - DNA, 20 bp, Artificial
  CRISPR gRNA sequence
agaagttgagtcccctaacc

SEQ ID NO: 483176 - DNA, 20 bp, Artificial
  CRISPR gRNA sequence
taaccaggtttctgctccta

SEQ ID NO: 483177 - DNA, 20 bp, Artificial
  CRISPR gRNA sequence
ctgctcctatagactttatc

SEQ ID NO: 483178 - DNA, 20 bp, Artificial
  CRISPR gRNA sequence
tgctcctatagactttatct

SEQ ID NO: 483179 - DNA, 20 bp, Artificial
  CRISPR gRNA sequence
cctatagactttatctgggc

SEQ ID NO: 483180 - DNA, 20 bp, Artificial
  CRISPR gRNA sequence
atctgggccagaccttctgc

SEQ ID NO: 483181 - DNA, 20 bp, Artificial
  CRISPR gRNA sequence
gccagaccttctgccagaca

SEQ ID NO: 483182 - DNA, 20 bp, Artificial
  CRISPR gRNA sequence
agaccttctgccagacacgg

SEQ ID NO: 483183 - DNA, 20 bp, Artificial
  CRISPR gRNA sequence
ccttctgccagacacggaag

SEQ ID NO: 483184 - DNA, 20 bp, Artificial
  CRISPR gRNA sequence
tctgccagacacggaagaag

SEQ ID NO: 483185 - DNA, 20 bp, Artificial
  CRISPR gRNA sequence
ctgccagacacggaagaaga

SEQ ID NO: 483186 - DNA, 20 bp, Artificial
  CRISPR gRNA sequence
agaagaaggaatgtccacat

SEQ ID NO: 483187 - DNA, 20 bp, Artificial
  CRISPR gRNA sequence
gaagaaggaatgtccacatc

SEQ ID NO: 483188 - DNA, 20 bp, Artificial
  CRISPR gRNA sequence
aatgtccacatcaggcttcc

SEQ ID NO: 483189 - DNA, 20 bp, Artificial
  CRISPR gRNA sequence
tcaggcttcccagctgtgtt

SEQ ID NO: 483190 - DNA, 20 bp, Artificial
  CRISPR gRNA sequence
ccagctgtgttaagatgctc

SEQ ID NO: 483191 - DNA, 20 bp, Artificial
  CRISPR gRNA sequence
taagatgctctagtatcaca

SEQ ID NO: 483192 - DNA, 20 bp, Artificial
  CRISPR gRNA sequence
ataatgtgttaatgcaactg

SEQ ID NO: 483193 - DNA, 20 bp, Artificial
  CRISPR gRNA sequence
gtgttaatgcaactgaagcc

SEQ ID NO: 483194 - DNA, 20 bp, Artificial
  CRISPR gRNA sequence
actgaagccaagctatcttc

SEQ ID NO: 483195 - DNA, 20 bp, Artificial
  CRISPR gRNA sequence
ccaagctatcttctggattc

SEQ ID NO: 483196 - DNA, 20 bp, Artificial
  CRISPR gRNA sequence
agctatcttctggattctag

SEQ ID NO: 483197 - DNA, 20 bp, Artificial
  CRISPR gRNA sequence
ttctggattctagaagcacc

SEQ ID NO: 483198 - DNA, 20 bp, Artificial
  CRISPR gRNA sequence
gatcttattctgccattcaa

SEQ ID NO: 483199 - DNA, 20 bp, Artificial
  CRISPR gRNA sequence
attctgccattcaatggtgt

SEQ ID NO: 483200 - DNA, 20 bp, Artificial
  CRISPR gRNA sequence
ccattcaatggtgtgagttt

SEQ ID NO: 483201 - DNA, 20 bp, Artificial
  CRISPR gRNA sequence
cattcaatggtgtgagtttc

SEQ ID NO: 483202 - DNA, 20 bp, Artificial
  CRISPR gRNA sequence
attcaatggtgtgagtttca

SEQ ID NO: 483203 - DNA, 20 bp, Artificial
  CRISPR gRNA sequence
ttcaatggtgtgagtttcag

SEQ ID NO: 483204 - DNA, 20 bp, Artificial
  CRISPR gRNA sequence
tcaatggtgtgagtttcagg

SEQ ID NO: 483205 - DNA, 20 bp, Artificial
  CRISPR gRNA sequence
caatggtgtgagtttcaggg

SEQ ID NO: 483206 - DNA, 20 bp, Artificial
  CRISPR gRNA sequence
tgtgagtttcaggggggcat

SEQ ID NO: 483207 - DNA, 20 bp, Artificial
  CRISPR gRNA sequence
gtgagtttcaggggggcatt

SEQ ID NO: 483208 - DNA, 20 bp, Artificial
  CRISPR gRNA sequence
aggggggcattaggaaaccc

SEQ ID NO: 483209 - DNA, 20 bp, Artificial
  CRISPR gRNA sequence
gggggcattaggaaacccca

SEQ ID NO: 483210 - DNA, 20 bp, Artificial
  CRISPR gRNA sequence
gcattaggaaaccccagaga

SEQ ID NO: 483211 - DNA, 20 bp, Artificial
  CRISPR gRNA sequence
cattaggaaaccccagagat

SEQ ID NO: 483212 - DNA, 20 bp, Artificial
  CRISPR gRNA sequence
ggaaaccccagagataggta

SEQ ID NO: 483213 - DNA, 20 bp, Artificial
  CRISPR gRNA sequence
ccccagagataggtatggaa

SEQ ID NO: 483214 - DNA, 20 bp, Artificial
  CRISPR gRNA sequence
gagataggtatggaatggac

SEQ ID NO: 483215 - DNA, 20 bp, Artificial
  CRISPR gRNA sequence
gataggtatggaatggacta

SEQ ID NO: 483216 - DNA, 20 bp, Artificial
  CRISPR gRNA sequence
atggaatggactagagaaac

SEQ ID NO: 483217 - DNA, 20 bp, Artificial
  CRISPR gRNA sequence
ggaatggactagagaaactg

SEQ ID NO: 483218 - DNA, 20 bp, Artificial
  CRISPR gRNA sequence
aatggactagagaaactgga

SEQ ID NO: 483219 - DNA, 20 bp, Artificial
  CRISPR gRNA sequence
atggactagagaaactggag

SEQ ID NO: 483220 - DNA, 20 bp, Artificial
  CRISPR gRNA sequence
agagaaactggagaggtacc

SEQ ID NO: 483221 - DNA, 20 bp, Artificial
  CRISPR gRNA sequence
gagaaactggagaggtacct

SEQ ID NO: 483222 - DNA, 20 bp, Artificial
  CRISPR gRNA sequence
actggagaggtacctgggac

SEQ ID NO: 483223 - DNA, 20 bp, Artificial
  CRISPR gRNA sequence
aggtacctgggactggatca

SEQ ID NO: 483224 - DNA, 20 bp, Artificial
  CRISPR gRNA sequence
gtacctgggactggatcata

SEQ ID NO: 483225 - DNA, 20 bp, Artificial
  CRISPR gRNA sequence
cctgggactggatcatagag

SEQ ID NO: 483226 - DNA, 20 bp, Artificial
  CRISPR gRNA sequence
ggactggatcatagagtaga

SEQ ID NO: 483227 - DNA, 20 bp, Artificial
  CRISPR gRNA sequence
gtagatggtgctcccccctc

SEQ ID NO: 483228 - DNA, 20 bp, Artificial
  CRISPR gRNA sequence
tagatggtgctcccccctcc

SEQ ID NO: 483229 - DNA, 20 bp, Artificial
  CRISPR gRNA sequence
ggtgctcccccctccaggaa

SEQ ID NO: 483230 - DNA, 20 bp, Artificial
  CRISPR gRNA sequence
gtctgctcctgctcctgcac

SEQ ID NO: 483231 - DNA, 20 bp, Artificial
  CRISPR gRNA sequence
tcctgctcctgcacaagaaa

SEQ ID NO: 483232 - DNA, 20 bp, Artificial
  CRISPR gRNA sequence
ctgctcctgcacaagaaatg

SEQ ID NO: 483233 - DNA, 20 bp, Artificial
  CRISPR gRNA sequence
tcctgcacaagaaatggaga

SEQ ID NO: 483234 - DNA, 20 bp, Artificial
  CRISPR gRNA sequence
cctgcacaagaaatggagat

SEQ ID NO: 483235 - DNA, 20 bp, Artificial
  CRISPR gRNA sequence
ctgcacaagaaatggagatg

SEQ ID NO: 483236 - DNA, 20 bp, Artificial
  CRISPR gRNA sequence
aaatggagatggggtaacat

SEQ ID NO: 483237 - DNA, 20 bp, Artificial
  CRISPR gRNA sequence
agatggggtaacatgagcga

SEQ ID NO: 483238 - DNA, 20 bp, Artificial
  CRISPR gRNA sequence
gggtaacatgagcgacagtt

SEQ ID NO: 483239 - DNA, 20 bp, Artificial
  CRISPR gRNA sequence
gagcgacagttcggtctgtc

SEQ ID NO: 483240 - DNA, 20 bp, Artificial
  CRISPR gRNA sequence
cagttcggtctgtccagatt

SEQ ID NO: 483241 - DNA, 20 bp, Artificial
  CRISPR gRNA sequence
ggtctgtccagatttagatt

SEQ ID NO: 483242 - DNA, 20 bp, Artificial
  CRISPR gRNA sequence
ctgtccagatttagattgag

SEQ ID NO: 483243 - DNA, 20 bp, Artificial
  CRISPR gRNA sequence
tgtccagatttagattgagt

SEQ ID NO: 483244 - DNA, 20 bp, Artificial
  CRISPR gRNA sequence
gtccagatttagattgagtg

SEQ ID NO: 483245 - DNA, 20 bp, Artificial
  CRISPR gRNA sequence
ttagattgagtggggaaaaa

SEQ ID NO: 483246 - DNA, 20 bp, Artificial
  CRISPR gRNA sequence
gagtggggaaaaacagcaca

SEQ ID NO: 483247 - DNA, 20 bp, Artificial
  CRISPR gRNA sequence
tggggaaaaacagcacaaag

SEQ ID NO: 483248 - DNA, 20 bp, Artificial
  CRISPR gRNA sequence
gggaaaaacagcacaaagaa

SEQ ID NO: 483249 - DNA, 20 bp, Artificial
  CRISPR gRNA sequence
ggaaaaacagcacaaagaag

SEQ ID NO: 483250 - DNA, 20 bp, Artificial
  CRISPR gRNA sequence
gaaaaacagcacaaagaaga

SEQ ID NO: 483251 - DNA, 20 bp, Artificial
  CRISPR gRNA sequence
gcacaaagaagagggctttt

SEQ ID NO: 483252 - DNA, 20 bp, Artificial
  CRISPR gRNA sequence
cacaaagaagagggcttttc

SEQ ID NO: 483253 - DNA, 20 bp, Artificial
  CRISPR gRNA sequence
caaagaagagggcttttcag

SEQ ID NO: 483254 - DNA, 20 bp, Artificial
  CRISPR gRNA sequence
aagagggcttttcaggagac

SEQ ID NO: 483255 - DNA, 20 bp, Artificial
  CRISPR gRNA sequence
agagggcttttcaggagact

SEQ ID NO: 483256 - DNA, 20 bp, Artificial
  CRISPR gRNA sequence
agggcttttcaggagactgg

SEQ ID NO: 483257 - DNA, 20 bp, Artificial
  CRISPR gRNA sequence
gggcttttcaggagactggg

SEQ ID NO: 483258 - DNA, 20 bp, Artificial
  CRISPR gRNA sequence
ggcttttcaggagactggga

SEQ ID NO: 483259 - DNA, 20 bp, Artificial
  CRISPR gRNA sequence
cttttcaggagactgggagg

SEQ ID NO: 483260 - DNA, 20 bp, Artificial
  CRISPR gRNA sequence
ttttcaggagactgggaggg

SEQ ID NO: 483261 - DNA, 20 bp, Artificial
  CRISPR gRNA sequence
tcaggagactgggagggagg

SEQ ID NO: 483262 - DNA, 20 bp, Artificial
  CRISPR gRNA sequence
ggagactgggagggaggtgg

SEQ ID NO: 483263 - DNA, 20 bp, Artificial
  CRISPR gRNA sequence
gagactgggagggaggtggc

SEQ ID NO: 483264 - DNA, 20 bp, Artificial
  CRISPR gRNA sequence
tgggagggaggtggcaggac

SEQ ID NO: 483265 - DNA, 20 bp, Artificial
  CRISPR gRNA sequence
gggagggaggtggcaggact

SEQ ID NO: 483266 - DNA, 20 bp, Artificial
  CRISPR gRNA sequence
ggagggaggtggcaggactg

SEQ ID NO: 483267 - DNA, 20 bp, Artificial
  CRISPR gRNA sequence
agggaggtggcaggactggg

SEQ ID NO: 483268 - DNA, 20 bp, Artificial
  CRISPR gRNA sequence
ggaggtggcaggactgggga

SEQ ID NO: 483269 - DNA, 20 bp, Artificial
  CRISPR gRNA sequence
ggagagtcattgatcctccc

SEQ ID NO: 483270 - DNA, 20 bp, Artificial
  CRISPR gRNA sequence
agtcattgatcctcccaaga

SEQ ID NO: 483271 - DNA, 20 bp, Artificial
  CRISPR gRNA sequence
gtcattgatcctcccaagat

SEQ ID NO: 483272 - DNA, 20 bp, Artificial
  CRISPR gRNA sequence
attgatcctcccaagatggg

SEQ ID NO: 483273 - DNA, 20 bp, Artificial
  CRISPR gRNA sequence
tgatcctcccaagatgggaa

SEQ ID NO: 483274 - DNA, 20 bp, Artificial
  CRISPR gRNA sequence
cctcccaagatgggaagaga

SEQ ID NO: 483275 - DNA, 20 bp, Artificial
  CRISPR gRNA sequence
ctcccaagatgggaagagac

SEQ ID NO: 483276 - DNA, 20 bp, Artificial
  CRISPR gRNA sequence
ccaagatgggaagagacagg

SEQ ID NO: 483277 - DNA, 20 bp, Artificial
  CRISPR gRNA sequence
agatgggaagagacaggaag

SEQ ID NO: 483278 - DNA, 20 bp, Artificial
  CRISPR gRNA sequence
atgggaagagacaggaagaa

SEQ ID NO: 483279 - DNA, 20 bp, Artificial
  CRISPR gRNA sequence
ggaagagacaggaagaagag

SEQ ID NO: 483280 - DNA, 20 bp, Artificial
  CRISPR gRNA sequence
agacaggaagaagagcagtt

SEQ ID NO: 483281 - DNA, 20 bp, Artificial
  CRISPR gRNA sequence
acaggaagaagagcagtttg

SEQ ID NO: 483282 - DNA, 20 bp, Artificial
  CRISPR gRNA sequence
ggaagaagagcagtttggag

SEQ ID NO: 483283 - DNA, 20 bp, Artificial
  CRISPR gRNA sequence
gcagtttggagtggaaccat

SEQ ID NO: 483284 - DNA, 20 bp, Artificial
  CRISPR gRNA sequence
tggagtggaaccattagtat

SEQ ID NO: 483285 - DNA, 20 bp, Artificial
  CRISPR gRNA sequence
ggagtggaaccattagtatc

SEQ ID NO: 483286 - DNA, 20 bp, Artificial
  CRISPR gRNA sequence
agtggaaccattagtatcag

SEQ ID NO: 483287 - DNA, 20 bp, Artificial
  CRISPR gRNA sequence
gaaccattagtatcaggagc

SEQ ID NO: 483288 - DNA, 20 bp, Artificial
  CRISPR gRNA sequence
aaccattagtatcaggagca

SEQ ID NO: 483289 - DNA, 20 bp, Artificial
  CRISPR gRNA sequence
atcaggagcaaggaaccacc

SEQ ID NO: 483290 - DNA, 20 bp, Artificial
  CRISPR gRNA sequence
tcaggagcaaggaaccacct

SEQ ID NO: 483291 - DNA, 20 bp, Artificial
  CRISPR gRNA sequence
gcaaggaaccacctaggtgt

SEQ ID NO: 483292 - DNA, 20 bp, Artificial
  CRISPR gRNA sequence
caaggaaccacctaggtgtg

SEQ ID NO: 483293 - DNA, 20 bp, Artificial
  CRISPR gRNA sequence
aaggaaccacctaggtgtga

SEQ ID NO: 483294 - DNA, 20 bp, Artificial
  CRISPR gRNA sequence
aggaaccacctaggtgtgag

SEQ ID NO: 483295 - DNA, 20 bp, Artificial
  CRISPR gRNA sequence
cacctaggtgtgaggggttc

SEQ ID NO: 483296 - DNA, 20 bp, Artificial
  CRISPR gRNA sequence
ggttccagcaaccctgctca

SEQ ID NO: 483297 - DNA, 20 bp, Artificial
  CRISPR gRNA sequence
ttccagcaaccctgctcaaa

SEQ ID NO: 483298 - DNA, 20 bp, Artificial
  CRISPR gRNA sequence
tgctgtcactttctttcctt

SEQ ID NO: 483299 - DNA, 20 bp, Artificial
  CRISPR gRNA sequence
ctttctttcctttagtaact

SEQ ID NO: 483300 - DNA, 20 bp, Artificial
  CRISPR gRNA sequence
aacttagaaacccttccttg

SEQ ID NO: 483301 - DNA, 20 bp, Artificial
  CRISPR gRNA sequence
cttagaaacccttccttgca

SEQ ID NO: 483302 - DNA, 20 bp, Artificial
  CRISPR gRNA sequence
acccttccttgcagagctct

SEQ ID NO: 483303 - DNA, 20 bp, Artificial
  CRISPR gRNA sequence
cttccttgcagagctctgag

SEQ ID NO: 483304 - DNA, 20 bp, Artificial
  CRISPR gRNA sequence
ttccttgcagagctctgagt

SEQ ID NO: 483305 - DNA, 20 bp, Artificial
  CRISPR gRNA sequence
tccttgcagagctctgagta

SEQ ID NO: 483306 - DNA, 20 bp, Artificial
  CRISPR gRNA sequence
tctgagtagggctgttatct

SEQ ID NO: 483307 - DNA, 20 bp, Artificial
  CRISPR gRNA sequence
ctgttatctgagccttacct

SEQ ID NO: 483308 - DNA, 20 bp, Artificial
  CRISPR gRNA sequence
gttatctgagccttacctca

SEQ ID NO: 483309 - DNA, 20 bp, Artificial
  CRISPR gRNA sequence
tacctcagagcactgaaatt

SEQ ID NO: 483310 - DNA, 20 bp, Artificial
  CRISPR gRNA sequence
tcagagcactgaaattcaga

SEQ ID NO: 483311 - DNA, 20 bp, Artificial
  CRISPR gRNA sequence
cagaaagtttaaacatttca

SEQ ID NO: 483312 - DNA, 20 bp, Artificial
  CRISPR gRNA sequence
aacatttcaaagaccaaaca

SEQ ID NO: 483313 - DNA, 20 bp, Artificial
  CRISPR gRNA sequence
ttcaaagaccaaacacagtt

SEQ ID NO: 483314 - DNA, 20 bp, Artificial
  CRISPR gRNA sequence
aaacacagttaagccctctc

SEQ ID NO: 483315 - DNA, 20 bp, Artificial
  CRISPR gRNA sequence
gccctctctagatcatcttt

SEQ ID NO: 483316 - DNA, 20 bp, Artificial
  CRISPR gRNA sequence
ccctctctagatcatctttg

SEQ ID NO: 483317 - DNA, 20 bp, Artificial
  CRISPR gRNA sequence
gccaccttgcccttgacctc

SEQ ID NO: 483318 - DNA, 20 bp, Artificial
  CRISPR gRNA sequence
ccttgcccttgacctcaagt

SEQ ID NO: 483319 - DNA, 20 bp, Artificial
  CRISPR gRNA sequence
ttgacctcaagtcagcgccc

SEQ ID NO: 483320 - DNA, 20 bp, Artificial
  CRISPR gRNA sequence
tgacctcaagtcagcgccct

SEQ ID NO: 483321 - DNA, 20 bp, Artificial
  CRISPR gRNA sequence
cctcaagtcagcgccctggg

SEQ ID NO: 483322 - DNA, 20 bp, Artificial
  CRISPR gRNA sequence
gtcagcgccctgggcagcta

SEQ ID NO: 483323 - DNA, 20 bp, Artificial
  CRISPR gRNA sequence
gccctgggcagctatagtgc

SEQ ID NO: 483324 - DNA, 20 bp, Artificial
  CRISPR gRNA sequence
ccctgggcagctatagtgct

SEQ ID NO: 483325 - DNA, 20 bp, Artificial
  CRISPR gRNA sequence
ggcagctatagtgctgggtg

SEQ ID NO: 483326 - DNA, 20 bp, Artificial
  CRISPR gRNA sequence
ctgggtgcagccctgaaccc

SEQ ID NO: 483327 - DNA, 20 bp, Artificial
  CRISPR gRNA sequence
tgggtgcagccctgaaccca

SEQ ID NO: 483328 - DNA, 20 bp, Artificial
  CRISPR gRNA sequence
gggtgcagccctgaacccaa

SEQ ID NO: 483329 - DNA, 20 bp, Artificial
  CRISPR gRNA sequence
agccctgaacccaagggcca

SEQ ID NO: 483330 - DNA, 20 bp, Artificial
  CRISPR gRNA sequence
cctgaacccaagggccaaag

SEQ ID NO: 483331 - DNA, 20 bp, Artificial
  CRISPR gRNA sequence
ctgaacccaagggccaaagc

SEQ ID NO: 483332 - DNA, 20 bp, Artificial
  CRISPR gRNA sequence
aacccaagggccaaagcagg

SEQ ID NO: 483333 - DNA, 20 bp, Artificial
  CRISPR gRNA sequence
ccaagggccaaagcaggaag

SEQ ID NO: 483334 - DNA, 20 bp, Artificial
  CRISPR gRNA sequence
aagggccaaagcaggaagca

SEQ ID NO: 483335 - DNA, 20 bp, Artificial
  CRISPR gRNA sequence
cttttcttgttcctacccct

SEQ ID NO: 483336 - DNA, 20 bp, Artificial
  CRISPR gRNA sequence
ttttcttgttcctacccctt

SEQ ID NO: 483337 - DNA, 20 bp, Artificial
  CRISPR gRNA sequence
gttcctaccccttaggaaat

SEQ ID NO: 483338 - DNA, 20 bp, Artificial
  CRISPR gRNA sequence
cctaccccttaggaaatcgg

SEQ ID NO: 483339 - DNA, 20 bp, Artificial
  CRISPR gRNA sequence
accccttaggaaatcggtgg

SEQ ID NO: 483340 - DNA, 20 bp, Artificial
  CRISPR gRNA sequence
cccttaggaaatcggtggtg

SEQ ID NO: 483341 - DNA, 20 bp, Artificial
  CRISPR gRNA sequence
ccttaggaaatcggtggtgg

SEQ ID NO: 483342 - DNA, 20 bp, Artificial
  CRISPR gRNA sequence
gtggaggtatttcatgctgc

SEQ ID NO: 483343 - DNA, 20 bp, Artificial
  CRISPR gRNA sequence
ttcatgctgccggccactga

SEQ ID NO: 483344 - DNA, 20 bp, Artificial
  CRISPR gRNA sequence
ggccactgaaagcatattgc

SEQ ID NO: 483345 - DNA, 20 bp, Artificial
  CRISPR gRNA sequence
ctgaaagcatattgccagtt

SEQ ID NO: 483346 - DNA, 20 bp, Artificial
  CRISPR gRNA sequence
tgaaagcatattgccagttt

SEQ ID NO: 483347 - DNA, 20 bp, Artificial
  CRISPR gRNA sequence
attgccagtttgggttctac

SEQ ID NO: 483348 - DNA, 20 bp, Artificial
  CRISPR gRNA sequence
ttgccagtttgggttctact

SEQ ID NO: 483349 - DNA, 20 bp, Artificial
  CRISPR gRNA sequence
gccagtttgggttctactgg

SEQ ID NO: 483350 - DNA, 20 bp, Artificial
  CRISPR gRNA sequence
gtttgggttctactgggagc

SEQ ID NO: 483351 - DNA, 20 bp, Artificial
  CRISPR gRNA sequence
tgggttctactgggagccag

SEQ ID NO: 483352 - DNA, 20 bp, Artificial
  CRISPR gRNA sequence
ggttctactgggagccagtg

SEQ ID NO: 483353 - DNA, 20 bp, Artificial
  CRISPR gRNA sequence
gttctactgggagccagtgg

SEQ ID NO: 483354 - DNA, 20 bp, Artificial
  CRISPR gRNA sequence
ctactgggagccagtggagg

SEQ ID NO: 483355 - DNA, 20 bp, Artificial
  CRISPR gRNA sequence
ctgggagccagtggaggcag

SEQ ID NO: 483356 - DNA, 20 bp, Artificial
  CRISPR gRNA sequence
tgggagccagtggaggcagc

SEQ ID NO: 483357 - DNA, 20 bp, Artificial
  CRISPR gRNA sequence
gggagccagtggaggcagca

SEQ ID NO: 483358 - DNA, 20 bp, Artificial
  CRISPR gRNA sequence
gtggaggcagcagggttcat

SEQ ID NO: 483359 - DNA, 20 bp, Artificial
  CRISPR gRNA sequence
tggaggcagcagggttcatt

SEQ ID NO: 483360 - DNA, 20 bp, Artificial
  CRISPR gRNA sequence
ggcagcagggttcattaggc

SEQ ID NO: 483361 - DNA, 20 bp, Artificial
  CRISPR gRNA sequence
gcagcagggttcattaggca

SEQ ID NO: 483362 - DNA, 20 bp, Artificial
  CRISPR gRNA sequence
gggttcattaggcaaggtgc

SEQ ID NO: 483363 - DNA, 20 bp, Artificial
  CRISPR gRNA sequence
caaggtgcaagcaaaattcc

SEQ ID NO: 483364 - DNA, 20 bp, Artificial
  CRISPR gRNA sequence
ggtgcaagcaaaattcctgg

SEQ ID NO: 483365 - DNA, 20 bp, Artificial
  CRISPR gRNA sequence
caagcaaaattcctggaagc

SEQ ID NO: 483366 - DNA, 20 bp, Artificial
  CRISPR gRNA sequence
gcaaaattcctggaagcaag

SEQ ID NO: 483367 - DNA, 20 bp, Artificial
  CRISPR gRNA sequence
aaattcctggaagcaagaag

SEQ ID NO: 483368 - DNA, 20 bp, Artificial
  CRISPR gRNA sequence
cctggaagcaagaagaagct

SEQ ID NO: 483369 - DNA, 20 bp, Artificial
  CRISPR gRNA sequence
tggaagcaagaagaagctaa

SEQ ID NO: 483370 - DNA, 20 bp, Artificial
  CRISPR gRNA sequence
aagcaagaagaagctaagag

SEQ ID NO: 483371 - DNA, 20 bp, Artificial
  CRISPR gRNA sequence
caagaagaagctaagagaag

SEQ ID NO: 483372 - DNA, 20 bp, Artificial
  CRISPR gRNA sequence
agaagaagctaagagaagca

SEQ ID NO: 483373 - DNA, 20 bp, Artificial
  CRISPR gRNA sequence
taagagaagcagagaactgt

SEQ ID NO: 483374 - DNA, 20 bp, Artificial
  CRISPR gRNA sequence
agagaactgtcagctgtcct

SEQ ID NO: 483375 - DNA, 20 bp, Artificial
  CRISPR gRNA sequence
agaactgtcagctgtcctta

SEQ ID NO: 483376 - DNA, 20 bp, Artificial
  CRISPR gRNA sequence
gaactgtcagctgtccttag

SEQ ID NO: 483377 - DNA, 20 bp, Artificial
  CRISPR gRNA sequence
tgtcagctgtccttagaggc

SEQ ID NO: 483378 - DNA, 20 bp, Artificial
  CRISPR gRNA sequence
gtcagctgtccttagaggct

SEQ ID NO: 483379 - DNA, 20 bp, Artificial
  CRISPR gRNA sequence
tcagctgtccttagaggctg

SEQ ID NO: 483380 - DNA, 20 bp, Artificial
  CRISPR gRNA sequence
agctgtccttagaggctggg

SEQ ID NO: 483381 - DNA, 20 bp, Artificial
  CRISPR gRNA sequence
ccttagaggctggggagtca

SEQ ID NO: 483382 - DNA, 20 bp, Artificial
  CRISPR gRNA sequence
cttagaggctggggagtcat

SEQ ID NO: 483383 - DNA, 20 bp, Artificial
  CRISPR gRNA sequence
atttgtgttttaaaatactg

SEQ ID NO: 483384 - DNA, 20 bp, Artificial
  CRISPR gRNA sequence
tttgtgttttaaaatactgc

SEQ ID NO: 483385 - DNA, 20 bp, Artificial
  CRISPR gRNA sequence
tgtgttttaaaatactgcag

SEQ ID NO: 483386 - DNA, 20 bp, Artificial
  CRISPR gRNA sequence
tgttgcttttctctcccgtc

SEQ ID NO: 483387 - DNA, 20 bp, Artificial
  CRISPR gRNA sequence
ctcccgtccagacccgtgtg

SEQ ID NO: 483388 - DNA, 20 bp, Artificial
  CRISPR gRNA sequence
agacccgtgtgaagtgtttc

SEQ ID NO: 483389 - DNA, 20 bp, Artificial
  CRISPR gRNA sequence
ccgtgtgaagtgtttctaga

SEQ ID NO: 483390 - DNA, 20 bp, Artificial
  CRISPR gRNA sequence
tgaagtgtttctagaaagat

SEQ ID NO: 483391 - DNA, 20 bp, Artificial
  CRISPR gRNA sequence
aagtgtttctagaaagatta

SEQ ID NO: 483392 - DNA, 20 bp, Artificial
  CRISPR gRNA sequence
gtttctagaaagattagagc

SEQ ID NO: 483393 - DNA, 20 bp, Artificial
  CRISPR gRNA sequence
tttctagaaagattagagct

SEQ ID NO: 483394 - DNA, 20 bp, Artificial
  CRISPR gRNA sequence
aagattagagctgggtctca

SEQ ID NO: 483395 - DNA, 20 bp, Artificial
  CRISPR gRNA sequence
ttagagctgggtctcaaagt

SEQ ID NO: 483396 - DNA, 20 bp, Artificial
  CRISPR gRNA sequence
agtgagaccacatgaaactt

SEQ ID NO: 483397 - DNA, 20 bp, Artificial
  CRISPR gRNA sequence
accacatgaaacttgagatt

SEQ ID NO: 483398 - DNA, 20 bp, Artificial
  CRISPR gRNA sequence
ccacatgaaacttgagattt

SEQ ID NO: 483399 - DNA, 20 bp, Artificial
  CRISPR gRNA sequence
tgagatttaggccttcaaat

SEQ ID NO: 483400 - DNA, 20 bp, Artificial
  CRISPR gRNA sequence
agatttaggccttcaaattg

SEQ ID NO: 483401 - DNA, 20 bp, Artificial
  CRISPR gRNA sequence
ggccttcaaattggagccct

SEQ ID NO: 483402 - DNA, 20 bp, Artificial
  CRISPR gRNA sequence
aaattggagccctgagacaa

SEQ ID NO: 483403 - DNA, 20 bp, Artificial
  CRISPR gRNA sequence
aattggagccctgagacaat

SEQ ID NO: 483404 - DNA, 20 bp, Artificial
  CRISPR gRNA sequence
attggagccctgagacaata

SEQ ID NO: 483405 - DNA, 20 bp, Artificial
  CRISPR gRNA sequence
tggagccctgagacaatagg

SEQ ID NO: 483406 - DNA, 20 bp, Artificial
  CRISPR gRNA sequence
gagccctgagacaataggga

SEQ ID NO: 483407 - DNA, 20 bp, Artificial
  CRISPR gRNA sequence
agccctgagacaatagggag

SEQ ID NO: 483408 - DNA, 20 bp, Artificial
  CRISPR gRNA sequence
ctgagacaatagggagaggc

SEQ ID NO: 483409 - DNA, 20 bp, Artificial
  CRISPR gRNA sequence
gagacaatagggagaggcca

SEQ ID NO: 483410 - DNA, 20 bp, Artificial
  CRISPR gRNA sequence
gacaatagggagaggccaga

SEQ ID NO: 483411 - DNA, 20 bp, Artificial
  CRISPR gRNA sequence
acaatagggagaggccagag

SEQ ID NO: 483412 - DNA, 20 bp, Artificial
  CRISPR gRNA sequence
caatagggagaggccagaga

SEQ ID NO: 483413 - DNA, 20 bp, Artificial
  CRISPR gRNA sequence
gggagaggccagagagggct

SEQ ID NO: 483414 - DNA, 20 bp, Artificial
  CRISPR gRNA sequence
ggagaggccagagagggctg

SEQ ID NO: 483415 - DNA, 20 bp, Artificial
  CRISPR gRNA sequence
aggccagagagggctgaggc

SEQ ID NO: 483416 - DNA, 20 bp, Artificial
  CRISPR gRNA sequence
ggccagagagggctgaggcc

SEQ ID NO: 483417 - DNA, 20 bp, Artificial
  CRISPR gRNA sequence
cagagagggctgaggccagg

SEQ ID NO: 483418 - DNA, 20 bp, Artificial
  CRISPR gRNA sequence
agagagggctgaggccaggc

SEQ ID NO: 483419 - DNA, 20 bp, Artificial
  CRISPR gRNA sequence
gagagggctgaggccaggca

SEQ ID NO: 483420 - DNA, 20 bp, Artificial
  CRISPR gRNA sequence
gagggctgaggccaggcagg

SEQ ID NO: 483421 - DNA, 20 bp, Artificial
  CRISPR gRNA sequence
agggctgaggccaggcaggg

SEQ ID NO: 483422 - DNA, 20 bp, Artificial
  CRISPR gRNA sequence
ggctgaggccaggcagggag

SEQ ID NO: 483423 - DNA, 20 bp, Artificial
  CRISPR gRNA sequence
ccaggcagggaggagctctt

SEQ ID NO: 483424 - DNA, 20 bp, Artificial
  CRISPR gRNA sequence
gcagggaggagctcttgagt

SEQ ID NO: 483425 - DNA, 20 bp, Artificial
  CRISPR gRNA sequence
gggaggagctcttgagtcgg

SEQ ID NO: 483426 - DNA, 20 bp, Artificial
  CRISPR gRNA sequence
aggagctcttgagtcggaag

SEQ ID NO: 483427 - DNA, 20 bp, Artificial
  CRISPR gRNA sequence
gctcttgagtcggaagaagt

SEQ ID NO: 483428 - DNA, 20 bp, Artificial
  CRISPR gRNA sequence
agtcggaagaagtaagctaa

SEQ ID NO: 483429 - DNA, 20 bp, Artificial
  CRISPR gRNA sequence
gtcggaagaagtaagctaat

SEQ ID NO: 483430 - DNA, 20 bp, Artificial
  CRISPR gRNA sequence
gctaataggcctgaatccca

SEQ ID NO: 483431 - DNA, 20 bp, Artificial
  CRISPR gRNA sequence
taataggcctgaatcccaaa

SEQ ID NO: 483432 - DNA, 20 bp, Artificial
  CRISPR gRNA sequence
aataggcctgaatcccaaag

SEQ ID NO: 483433 - DNA, 20 bp, Artificial
  CRISPR gRNA sequence
aaagaggtttcctttgctct

SEQ ID NO: 483434 - DNA, 20 bp, Artificial
  CRISPR gRNA sequence
ctaagttgtttttcctcctg

SEQ ID NO: 483435 - DNA, 20 bp, Artificial
  CRISPR gRNA sequence
tcctgtggtctcctaatctc

SEQ ID NO: 483436 - DNA, 20 bp, Artificial
  CRISPR gRNA sequence
atctcaagtcatcttctttt

SEQ ID NO: 483437 - DNA, 20 bp, Artificial
  CRISPR gRNA sequence
tcatcttctttttggaaaaa

SEQ ID NO: 483438 - DNA, 20 bp, Artificial
  CRISPR gRNA sequence
ttggaaaaatagattatttt

SEQ ID NO: 483439 - DNA, 20 bp, Artificial
  CRISPR gRNA sequence
aaaaatagattatttttagc

SEQ ID NO: 483440 - DNA, 20 bp, Artificial
  CRISPR gRNA sequence
gattatttttagcaagcacc

SEQ ID NO: 483441 - DNA, 20 bp, Artificial
  CRISPR gRNA sequence
attatttttagcaagcaccc

SEQ ID NO: 483442 - DNA, 20 bp, Artificial
  CRISPR gRNA sequence
agcaagcacccgggcatcac

SEQ ID NO: 483443 - DNA, 20 bp, Artificial
  CRISPR gRNA sequence
cacccgggcatcactggctg

SEQ ID NO: 483444 - DNA, 20 bp, Artificial
  CRISPR gRNA sequence
acccgggcatcactggctgt

SEQ ID NO: 483445 - DNA, 20 bp, Artificial
  CRISPR gRNA sequence
cgggcatcactggctgtggg

SEQ ID NO: 483446 - DNA, 20 bp, Artificial
  CRISPR gRNA sequence
tgggtagattcacatgcttt

SEQ ID NO: 483447 - DNA, 20 bp, Artificial
  CRISPR gRNA sequence
gggtagattcacatgctttc

SEQ ID NO: 483448 - DNA, 20 bp, Artificial
  CRISPR gRNA sequence
atgctttcaggaatttgtac

SEQ ID NO: 483449 - DNA, 20 bp, Artificial
  CRISPR gRNA sequence
gctttcaggaatttgtacca

SEQ ID NO: 483450 - DNA, 20 bp, Artificial
  CRISPR gRNA sequence
caggaatttgtaccagagtc

SEQ ID NO: 483451 - DNA, 20 bp, Artificial
  CRISPR gRNA sequence
gaatttgtaccagagtctgg

SEQ ID NO: 483452 - DNA, 20 bp, Artificial
  CRISPR gRNA sequence
tttgtaccagagtctggtag

SEQ ID NO: 483453 - DNA, 20 bp, Artificial
  CRISPR gRNA sequence
taccagagtctggtagcagt

SEQ ID NO: 483454 - DNA, 20 bp, Artificial
  CRISPR gRNA sequence
ccagagtctggtagcagtga

SEQ ID NO: 483455 - DNA, 20 bp, Artificial
  CRISPR gRNA sequence
tggtagcagtgagagaaaca

SEQ ID NO: 483456 - DNA, 20 bp, Artificial
  CRISPR gRNA sequence
ttttattattcacattccaa

SEQ ID NO: 483457 - DNA, 20 bp, Artificial
  CRISPR gRNA sequence
ctttatttttcacattccca

SEQ ID NO: 483458 - DNA, 20 bp, Artificial
  CRISPR gRNA sequence
cacattcccatagccactgc

SEQ ID NO: 483459 - DNA, 20 bp, Artificial
  CRISPR gRNA sequence
acattcccatagccactgct

SEQ ID NO: 483460 - DNA, 20 bp, Artificial
  CRISPR gRNA sequence
cattcccatagccactgctg

SEQ ID NO: 483461 - DNA, 20 bp, Artificial
  CRISPR gRNA sequence
caaaaataaataaataaata

SEQ ID NO: 483462 - DNA, 20 bp, Artificial
  CRISPR gRNA sequence
taaagataaaaataaaaaaa

SEQ ID NO: 483463 - DNA, 20 bp, Artificial
  CRISPR gRNA sequence
aaagataaaaataaaaaaac

SEQ ID NO: 483464 - DNA, 20 bp, Artificial
  CRISPR gRNA sequence
taaaaataaaaaaacaggca

SEQ ID NO: 483465 - DNA, 20 bp, Artificial
  CRISPR gRNA sequence
aaaaataaaaaaacaggcat

SEQ ID NO: 483466 - DNA, 20 bp, Artificial
  CRISPR gRNA sequence
aaaataaaaaaacaggcatg

SEQ ID NO: 483467 - DNA, 20 bp, Artificial
  CRISPR gRNA sequence
aataaaaaaacaggcatggg

SEQ ID NO: 483468 - DNA, 20 bp, Artificial
  CRISPR gRNA sequence
ggcatggggagctgctctaa

SEQ ID NO: 483469 - DNA, 20 bp, Artificial
  CRISPR gRNA sequence
gctctaacagcctctgaacc

SEQ ID NO: 483470 - DNA, 20 bp, Artificial
  CRISPR gRNA sequence
tctaacagcctctgaaccca

SEQ ID NO: 483471 - DNA, 20 bp, Artificial
  CRISPR gRNA sequence
ctaacagcctctgaacccag

SEQ ID NO: 483472 - DNA, 20 bp, Artificial
  CRISPR gRNA sequence
cctctgaacccagaggcatc

SEQ ID NO: 483473 - DNA, 20 bp, Artificial
  CRISPR gRNA sequence
ctctgaacccagaggcatct

SEQ ID NO: 483474 - DNA, 20 bp, Artificial
  CRISPR gRNA sequence
ctgaacccagaggcatctgg

SEQ ID NO: 483475 - DNA, 20 bp, Artificial
  CRISPR gRNA sequence
gaacccagaggcatctggga

SEQ ID NO: 483476 - DNA, 20 bp, Artificial
  CRISPR gRNA sequence
aacccagaggcatctgggag

SEQ ID NO: 483477 - DNA, 20 bp, Artificial
  CRISPR gRNA sequence
aggatgcttgcctgctctgc

SEQ ID NO: 483478 - DNA, 20 bp, Artificial
  CRISPR gRNA sequence
ggatgcttgcctgctctgcg

SEQ ID NO: 483479 - DNA, 20 bp, Artificial
  CRISPR gRNA sequence
gcctgctctgcgaggctgca

SEQ ID NO: 483480 - DNA, 20 bp, Artificial
  CRISPR gRNA sequence
cctgctctgcgaggctgcac

SEQ ID NO: 483481 - DNA, 20 bp, Artificial
  CRISPR gRNA sequence
ctgctctgcgaggctgcaca

SEQ ID NO: 483482 - DNA, 20 bp, Artificial
  CRISPR gRNA sequence
tgcacagggcctcacgtatg

SEQ ID NO: 483483 - DNA, 20 bp, Artificial
  CRISPR gRNA sequence
cagggcctcacgtatgtggc

SEQ ID NO: 483484 - DNA, 20 bp, Artificial
  CRISPR gRNA sequence
cctcacgtatgtggccagca

SEQ ID NO: 483485 - DNA, 20 bp, Artificial
  CRISPR gRNA sequence
cacgtatgtggccagcacgg

SEQ ID NO: 483486 - DNA, 20 bp, Artificial
  CRISPR gRNA sequence
cgtatgtggccagcacggaa

SEQ ID NO: 483487 - DNA, 20 bp, Artificial
  CRISPR gRNA sequence
atgtgcttcctgcgtgctgc

SEQ ID NO: 483488 - DNA, 20 bp, Artificial
  CRISPR gRNA sequence
tgtgcttcctgcgtgctgct

SEQ ID NO: 483489 - DNA, 20 bp, Artificial
  CRISPR gRNA sequence
tgcgtgctgctgggtctcca

SEQ ID NO: 483490 - DNA, 20 bp, Artificial
  CRISPR gRNA sequence
gctgctgggtctccacagca

SEQ ID NO: 483491 - DNA, 20 bp, Artificial
  CRISPR gRNA sequence
gggtctccacagcaaagcgc

SEQ ID NO: 483492 - DNA, 20 bp, Artificial
  CRISPR gRNA sequence
ggtctccacagcaaagcgcc

SEQ ID NO: 483493 - DNA, 20 bp, Artificial
  CRISPR gRNA sequence
gtctccacagcaaagcgcca

SEQ ID NO: 483494 - DNA, 20 bp, Artificial
  CRISPR gRNA sequence
tctccacagcaaagcgccag

SEQ ID NO: 483495 - DNA, 20 bp, Artificial
  CRISPR gRNA sequence
ctccacagcaaagcgccagg

SEQ ID NO: 483496 - DNA, 20 bp, Artificial
  CRISPR gRNA sequence
cacagcaaagcgccaggggg

SEQ ID NO: 483497 - DNA, 20 bp, Artificial
  CRISPR gRNA sequence
agcaaagcgccagggggcag

SEQ ID NO: 483498 - DNA, 20 bp, Artificial
  CRISPR gRNA sequence
aagcgccagggggcagtgga

SEQ ID NO: 483499 - DNA, 20 bp, Artificial
  CRISPR gRNA sequence
cgccagggggcagtggaaag

SEQ ID NO: 483500 - DNA, 20 bp, Artificial
  CRISPR gRNA sequence
gccagggggcagtggaaaga

SEQ ID NO: 483501 - DNA, 20 bp, Artificial
  CRISPR gRNA sequence
caccctgccccacttcctgc

SEQ ID NO: 483502 - DNA, 20 bp, Artificial
  CRISPR gRNA sequence
cctgccccacttcctgccag

SEQ ID NO: 483503 - DNA, 20 bp, Artificial
  CRISPR gRNA sequence
cccacttcctgccagcagtt

SEQ ID NO: 483504 - DNA, 20 bp, Artificial
  CRISPR gRNA sequence
acttcctgccagcagtttgg

SEQ ID NO: 483505 - DNA, 20 bp, Artificial
  CRISPR gRNA sequence
cttcctgccagcagtttggt

SEQ ID NO: 483506 - DNA, 20 bp, Artificial
  CRISPR gRNA sequence
agcagtttggtaggctccat

SEQ ID NO: 483507 - DNA, 20 bp, Artificial
  CRISPR gRNA sequence
cagtttggtaggctccatca

SEQ ID NO: 483508 - DNA, 20 bp, Artificial
  CRISPR gRNA sequence
ctccatcagagcttttcccc

SEQ ID NO: 483509 - DNA, 20 bp, Artificial
  CRISPR gRNA sequence
tccatcagagcttttcccct

SEQ ID NO: 483510 - DNA, 20 bp, Artificial
  CRISPR gRNA sequence
cctgtcaccacatctgccct

SEQ ID NO: 483511 - DNA, 20 bp, Artificial
  CRISPR gRNA sequence
tcaccacatctgccctaagc

SEQ ID NO: 483512 - DNA, 20 bp, Artificial
  CRISPR gRNA sequence
catctgccctaagcgagaca

SEQ ID NO: 483513 - DNA, 20 bp, Artificial
  CRISPR gRNA sequence
ctgccctaagcgagacacag

SEQ ID NO: 483514 - DNA, 20 bp, Artificial
  CRISPR gRNA sequence
ccctaagcgagacacagcag

SEQ ID NO: 483515 - DNA, 20 bp, Artificial
  CRISPR gRNA sequence
cctaagcgagacacagcagt

SEQ ID NO: 483516 - DNA, 20 bp, Artificial
  CRISPR gRNA sequence
ctaagcgagacacagcagtg

SEQ ID NO: 483517 - DNA, 20 bp, Artificial
  CRISPR gRNA sequence
taagcgagacacagcagtgg

SEQ ID NO: 483518 - DNA, 20 bp, Artificial
  CRISPR gRNA sequence
cacagcagtgggggcatctg

SEQ ID NO: 483519 - DNA, 20 bp, Artificial
  CRISPR gRNA sequence
acagcagtgggggcatctgc

SEQ ID NO: 483520 - DNA, 20 bp, Artificial
  CRISPR gRNA sequence
tttcctcctcttctaattct

SEQ ID NO: 483521 - DNA, 20 bp, Artificial
  CRISPR gRNA sequence
ctcttctaattcttggatga

SEQ ID NO: 483522 - DNA, 20 bp, Artificial
  CRISPR gRNA sequence
tcttctaattcttggatgac

SEQ ID NO: 483523 - DNA, 20 bp, Artificial
  CRISPR gRNA sequence
tctaattcttggatgacagg

SEQ ID NO: 483524 - DNA, 20 bp, Artificial
  CRISPR gRNA sequence
taattcttggatgacaggca

SEQ ID NO: 483525 - DNA, 20 bp, Artificial
  CRISPR gRNA sequence
tcttggatgacaggcagagt

SEQ ID NO: 483526 - DNA, 20 bp, Artificial
  CRISPR gRNA sequence
gttggcccctgcctgctgcg

SEQ ID NO: 483527 - DNA, 20 bp, Artificial
  CRISPR gRNA sequence
tggcccctgcctgctgcgaa

SEQ ID NO: 483528 - DNA, 20 bp, Artificial
  CRISPR gRNA sequence
cccctgcctgctgcgaagag

SEQ ID NO: 483529 - DNA, 20 bp, Artificial
  CRISPR gRNA sequence
ccctgcctgctgcgaagagc

SEQ ID NO: 483530 - DNA, 20 bp, Artificial
  CRISPR gRNA sequence
gcctgctgcgaagagcaggc

SEQ ID NO: 483531 - DNA, 20 bp, Artificial
  CRISPR gRNA sequence
ctgctgcgaagagcaggcga

SEQ ID NO: 483532 - DNA, 20 bp, Artificial
  CRISPR gRNA sequence
tgctgcgaagagcaggcgag

SEQ ID NO: 483533 - DNA, 20 bp, Artificial
  CRISPR gRNA sequence
aagagcaggcgagaggctcc

SEQ ID NO: 483534 - DNA, 20 bp, Artificial
  CRISPR gRNA sequence
gagcaggcgagaggctcctg

SEQ ID NO: 483535 - DNA, 20 bp, Artificial
  CRISPR gRNA sequence
agcaggcgagaggctcctgg

SEQ ID NO: 483536 - DNA, 20 bp, Artificial
  CRISPR gRNA sequence
caggcgagaggctcctggag

SEQ ID NO: 483537 - DNA, 20 bp, Artificial
  CRISPR gRNA sequence
ggctcctggaggagcctact

SEQ ID NO: 483538 - DNA, 20 bp, Artificial
  CRISPR gRNA sequence
gctcctggaggagcctactc

SEQ ID NO: 483539 - DNA, 20 bp, Artificial
  CRISPR gRNA sequence
ctggaggagcctactcaggc

SEQ ID NO: 483540 - DNA, 20 bp, Artificial
  CRISPR gRNA sequence
gaggagcctactcaggctgg

SEQ ID NO: 483541 - DNA, 20 bp, Artificial
  CRISPR gRNA sequence
aggagcctactcaggctggt

SEQ ID NO: 483542 - DNA, 20 bp, Artificial
  CRISPR gRNA sequence
caggctggtgggctttgtgc

SEQ ID NO: 483543 - DNA, 20 bp, Artificial
  CRISPR gRNA sequence
aggctggtgggctttgtgcc

SEQ ID NO: 483544 - DNA, 20 bp, Artificial
  CRISPR gRNA sequence
tggtgggctttgtgccaggc

SEQ ID NO: 483545 - DNA, 20 bp, Artificial
  CRISPR gRNA sequence
gccaggctggttactctctc

SEQ ID NO: 483546 - DNA, 20 bp, Artificial
  CRISPR gRNA sequence
ggttactctctctagtacct

SEQ ID NO: 483547 - DNA, 20 bp, Artificial
  CRISPR gRNA sequence
tctagtacctcagccacact

SEQ ID NO: 483548 - DNA, 20 bp, Artificial
  CRISPR gRNA sequence
ctagtacctcagccacactc

SEQ ID NO: 483549 - DNA, 20 bp, Artificial
  CRISPR gRNA sequence
actcaggcctcttcttccaa

SEQ ID NO: 483550 - DNA, 20 bp, Artificial
  CRISPR gRNA sequence
ctcaggcctcttcttccaaa

SEQ ID NO: 483551 - DNA, 20 bp, Artificial
  CRISPR gRNA sequence
cttccaaaaggctgtgaatg

SEQ ID NO: 483552 - DNA, 20 bp, Artificial
  CRISPR gRNA sequence
ggctgtgaatgcagcctatt

SEQ ID NO: 483553 - DNA, 20 bp, Artificial
  CRISPR gRNA sequence
gtgaatgcagcctattgagc

SEQ ID NO: 483554 - DNA, 20 bp, Artificial
  CRISPR gRNA sequence
gctacaaaactattatgctt

SEQ ID NO: 483555 - DNA, 20 bp, Artificial
  CRISPR gRNA sequence
caaaactattatgctttggc

SEQ ID NO: 483556 - DNA, 20 bp, Artificial
  CRISPR gRNA sequence
ctttggctggtcacacttcc

SEQ ID NO: 483557 - DNA, 20 bp, Artificial
  CRISPR gRNA sequence
tcccagcctgtgtcaccatt

SEQ ID NO: 483558 - DNA, 20 bp, Artificial
  CRISPR gRNA sequence
cccagcctgtgtcaccatta

SEQ ID NO: 483559 - DNA, 20 bp, Artificial
  CRISPR gRNA sequence
ccagcctgtgtcaccattaa

SEQ ID NO: 483560 - DNA, 20 bp, Artificial
  CRISPR gRNA sequence
attaagggactcatgaatgt

SEQ ID NO: 483561 - DNA, 20 bp, Artificial
  CRISPR gRNA sequence
gaatgtaagccctgactcat

SEQ ID NO: 483562 - DNA, 20 bp, Artificial
  CRISPR gRNA sequence
aatgtaagccctgactcatt

SEQ ID NO: 483563 - DNA, 20 bp, Artificial
  CRISPR gRNA sequence
agccctgactcattaggaaa

SEQ ID NO: 483564 - DNA, 20 bp, Artificial
  CRISPR gRNA sequence
tcattaggaaaaagaatttg

SEQ ID NO: 483565 - DNA, 20 bp, Artificial
  CRISPR gRNA sequence
taggaaaaagaatttgtggt

SEQ ID NO: 483566 - DNA, 20 bp, Artificial
  CRISPR gRNA sequence
tggtcagacaacaaatacca

SEQ ID NO: 483567 - DNA, 20 bp, Artificial
  CRISPR gRNA sequence
tcagacaacaaataccacag

SEQ ID NO: 483568 - DNA, 20 bp, Artificial
  CRISPR gRNA sequence
tgttgtgctccatcccttct

SEQ ID NO: 483569 - DNA, 20 bp, Artificial
  CRISPR gRNA sequence
tgtgctccatcccttctcag

SEQ ID NO: 483570 - DNA, 20 bp, Artificial
  CRISPR gRNA sequence
gtgctccatcccttctcagc

SEQ ID NO: 483571 - DNA, 20 bp, Artificial
  CRISPR gRNA sequence
agcaggtgcaattctgcacc

SEQ ID NO: 483572 - DNA, 20 bp, Artificial
  CRISPR gRNA sequence
tctgcaccaagatgcccctt

SEQ ID NO: 483573 - DNA, 20 bp, Artificial
  CRISPR gRNA sequence
ttcctcttttcctccatcac

SEQ ID NO: 483574 - DNA, 20 bp, Artificial
  CRISPR gRNA sequence
ttttcctccatcaccagaac

SEQ ID NO: 483575 - DNA, 20 bp, Artificial
  CRISPR gRNA sequence
tttcctccatcaccagaact

SEQ ID NO: 483576 - DNA, 20 bp, Artificial
  CRISPR gRNA sequence
cctccatcaccagaactagg

SEQ ID NO: 483577 - DNA, 20 bp, Artificial
  CRISPR gRNA sequence
ccatcaccagaactaggaag

SEQ ID NO: 483578 - DNA, 20 bp, Artificial
  CRISPR gRNA sequence
catcaccagaactaggaagc

SEQ ID NO: 483579 - DNA, 20 bp, Artificial
  CRISPR gRNA sequence
caccagaactaggaagcagg

SEQ ID NO: 483580 - DNA, 20 bp, Artificial
  CRISPR gRNA sequence
ccagaactaggaagcaggtg

SEQ ID NO: 483581 - DNA, 20 bp, Artificial
  CRISPR gRNA sequence
actaggaagcaggtggagaa

SEQ ID NO: 483582 - DNA, 20 bp, Artificial
  CRISPR gRNA sequence
ggaagcaggtggagaaaaga

SEQ ID NO: 483583 - DNA, 20 bp, Artificial
  CRISPR gRNA sequence
gcaggtggagaaaagataga

SEQ ID NO: 483584 - DNA, 20 bp, Artificial
  CRISPR gRNA sequence
caggtggagaaaagatagat

SEQ ID NO: 483585 - DNA, 20 bp, Artificial
  CRISPR gRNA sequence
aggtggagaaaagatagatg

SEQ ID NO: 483586 - DNA, 20 bp, Artificial
  CRISPR gRNA sequence
tggagaaaagatagatgggg

SEQ ID NO: 483587 - DNA, 20 bp, Artificial
  CRISPR gRNA sequence
ggagaaaagatagatgggga

SEQ ID NO: 483588 - DNA, 20 bp, Artificial
  CRISPR gRNA sequence
gagaaaagatagatggggaa

SEQ ID NO: 483589 - DNA, 20 bp, Artificial
  CRISPR gRNA sequence
aagatagatggggaagggct

SEQ ID NO: 483590 - DNA, 20 bp, Artificial
  CRISPR gRNA sequence
agatagatggggaagggctg

SEQ ID NO: 483591 - DNA, 20 bp, Artificial
  CRISPR gRNA sequence
gatagatggggaagggctga

SEQ ID NO: 483592 - DNA, 20 bp, Artificial
  CRISPR gRNA sequence
agggctgagggtcacatcaa

SEQ ID NO: 483593 - DNA, 20 bp, Artificial
  CRISPR gRNA sequence
gggctgagggtcacatcaaa

SEQ ID NO: 483594 - DNA, 20 bp, Artificial
  CRISPR gRNA sequence
tgagggtcacatcaaaagga

SEQ ID NO: 483595 - DNA, 20 bp, Artificial
  CRISPR gRNA sequence
acatcaaaaggacagtcgtt

SEQ ID NO: 483596 - DNA, 20 bp, Artificial
  CRISPR gRNA sequence
ctctgaataaccatcattga

SEQ ID NO: 483597 - DNA, 20 bp, Artificial
  CRISPR gRNA sequence
ctgaataaccatcattgaaa

SEQ ID NO: 483598 - DNA, 20 bp, Artificial
  CRISPR gRNA sequence
tcattgaaagagcattttcc

SEQ ID NO: 483599 - DNA, 20 bp, Artificial
  CRISPR gRNA sequence
tgaaagagcattttccaagc

SEQ ID NO: 483600 - DNA, 20 bp, Artificial
  CRISPR gRNA sequence
gagcattttccaagccagct

SEQ ID NO: 483601 - DNA, 20 bp, Artificial
  CRISPR gRNA sequence
gcattttccaagccagctga

SEQ ID NO: 483602 - DNA, 20 bp, Artificial
  CRISPR gRNA sequence
attttccaagccagctgaga

SEQ ID NO: 483603 - DNA, 20 bp, Artificial
  CRISPR gRNA sequence
aagccagctgagagagaccc

SEQ ID NO: 483604 - DNA, 20 bp, Artificial
  CRISPR gRNA sequence
ctgagagagaccccagcctc

SEQ ID NO: 483605 - DNA, 20 bp, Artificial
  CRISPR gRNA sequence
tgagagagaccccagcctcc

SEQ ID NO: 483606 - DNA, 20 bp, Artificial
  CRISPR gRNA sequence
atgacatacgtgatttctcc

SEQ ID NO: 483607 - DNA, 20 bp, Artificial
  CRISPR gRNA sequence
acgtgatttctcctggtttt

SEQ ID NO: 483608 - DNA, 20 bp, Artificial
  CRISPR gRNA sequence
gtaaattgtcaaaaattcct

SEQ ID NO: 483609 - DNA, 20 bp, Artificial
  CRISPR gRNA sequence
taaattgtcaaaaattcctt

SEQ ID NO: 483610 - DNA, 20 bp, Artificial
  CRISPR gRNA sequence
tgtcaaaaattccttgggac

SEQ ID NO: 483611 - DNA, 20 bp, Artificial
  CRISPR gRNA sequence
attccttgggactggtctct

SEQ ID NO: 483612 - DNA, 20 bp, Artificial
  CRISPR gRNA sequence
ttccttgggactggtctctg

SEQ ID NO: 483613 - DNA, 20 bp, Artificial
  CRISPR gRNA sequence
tccttgggactggtctctga

SEQ ID NO: 483614 - DNA, 20 bp, Artificial
  CRISPR gRNA sequence
cttgggactggtctctgagg

SEQ ID NO: 483615 - DNA, 20 bp, Artificial
  CRISPR gRNA sequence
ttgggactggtctctgaggg

SEQ ID NO: 483616 - DNA, 20 bp, Artificial
  CRISPR gRNA sequence
ggactggtctctgagggagg

SEQ ID NO: 483617 - DNA, 20 bp, Artificial
  CRISPR gRNA sequence
tctgagggaggaagaaaaca

SEQ ID NO: 483618 - DNA, 20 bp, Artificial
  CRISPR gRNA sequence
tgagggaggaagaaaacaaa

SEQ ID NO: 483619 - DNA, 20 bp, Artificial
  CRISPR gRNA sequence
gggaggaagaaaacaaagag

SEQ ID NO: 483620 - DNA, 20 bp, Artificial
  CRISPR gRNA sequence
gaggaagaaaacaaagagca

SEQ ID NO: 483621 - DNA, 20 bp, Artificial
  CRISPR gRNA sequence
gaaaacaaagagcagagctg

SEQ ID NO: 483622 - DNA, 20 bp, Artificial
  CRISPR gRNA sequence
agcagagctgcagaaacctc

SEQ ID NO: 483623 - DNA, 20 bp, Artificial
  CRISPR gRNA sequence
agagctgcagaaacctccag

SEQ ID NO: 483624 - DNA, 20 bp, Artificial
  CRISPR gRNA sequence
gagctgcagaaacctccaga

SEQ ID NO: 483625 - DNA, 20 bp, Artificial
  CRISPR gRNA sequence
agctgcagaaacctccagaa

SEQ ID NO: 483626 - DNA, 20 bp, Artificial
  CRISPR gRNA sequence
agaagggcttttgcttctaa

SEQ ID NO: 483627 - DNA, 20 bp, Artificial
  CRISPR gRNA sequence
gaagggcttttgcttctaac

SEQ ID NO: 483628 - DNA, 20 bp, Artificial
  CRISPR gRNA sequence
ggtcccacctctaccccaaa

SEQ ID NO: 483629 - DNA, 20 bp, Artificial
  CRISPR gRNA sequence
caaatggccaaaccttaaaa

SEQ ID NO: 483630 - DNA, 20 bp, Artificial
  CRISPR gRNA sequence
aaatggccaaaccttaaaaa

SEQ ID NO: 483631 - DNA, 20 bp, Artificial
  CRISPR gRNA sequence
ccaaaccttaaaaaaggttc

SEQ ID NO: 483632 - DNA, 20 bp, Artificial
  CRISPR gRNA sequence
accttaaaaaaggttctaga

SEQ ID NO: 483633 - DNA, 20 bp, Artificial
  CRISPR gRNA sequence
ccttaaaaaaggttctagaa

SEQ ID NO: 483634 - DNA, 20 bp, Artificial
  CRISPR gRNA sequence
ttaaaaaaggttctagaaag

SEQ ID NO: 483635 - DNA, 20 bp, Artificial
  CRISPR gRNA sequence
taaaaaaggttctagaaagg

SEQ ID NO: 483636 - DNA, 20 bp, Artificial
  CRISPR gRNA sequence
aaaggttctagaaaggaggc

SEQ ID NO: 483637 - DNA, 20 bp, Artificial
  CRISPR gRNA sequence
aggcaagttaatgctcttcc

SEQ ID NO: 483638 - DNA, 20 bp, Artificial
  CRISPR gRNA sequence
ggcaagttaatgctcttccc

SEQ ID NO: 483639 - DNA, 20 bp, Artificial
  CRISPR gRNA sequence
tgctcttcccaggaacccca

SEQ ID NO: 483640 - DNA, 20 bp, Artificial
  CRISPR gRNA sequence
ctcttcccaggaaccccaaa

SEQ ID NO: 483641 - DNA, 20 bp, Artificial
  CRISPR gRNA sequence
cccaggaaccccaaagagca

SEQ ID NO: 483642 - DNA, 20 bp, Artificial
  CRISPR gRNA sequence
caggaaccccaaagagcaca

SEQ ID NO: 483643 - DNA, 20 bp, Artificial
  CRISPR gRNA sequence
aggaaccccaaagagcacag

SEQ ID NO: 483644 - DNA, 20 bp, Artificial
  CRISPR gRNA sequence
aaccccaaagagcacagagg

SEQ ID NO: 483645 - DNA, 20 bp, Artificial
  CRISPR gRNA sequence
tcccacacctcctcccaaac

SEQ ID NO: 483646 - DNA, 20 bp, Artificial
  CRISPR gRNA sequence
cctcccaaaccagctgtcta

SEQ ID NO: 483647 - DNA, 20 bp, Artificial
  CRISPR gRNA sequence
ctcccaaaccagctgtctac

SEQ ID NO: 483648 - DNA, 20 bp, Artificial
  CRISPR gRNA sequence
tcccaaaccagctgtctaca

SEQ ID NO: 483649 - DNA, 20 bp, Artificial
  CRISPR gRNA sequence
ctacagggaaatctgcgcat

SEQ ID NO: 483650 - DNA, 20 bp, Artificial
  CRISPR gRNA sequence
tacagggaaatctgcgcatt

SEQ ID NO: 483651 - DNA, 20 bp, Artificial
  CRISPR gRNA sequence
ggaaatctgcgcattgggat

SEQ ID NO: 483652 - DNA, 20 bp, Artificial
  CRISPR gRNA sequence
aatctgcgcattgggatcag

SEQ ID NO: 483653 - DNA, 20 bp, Artificial
  CRISPR gRNA sequence
atctgcgcattgggatcaga

SEQ ID NO: 483654 - DNA, 20 bp, Artificial
  CRISPR gRNA sequence
tgggatcagaaggcatgaac

SEQ ID NO: 483655 - DNA, 20 bp, Artificial
  CRISPR gRNA sequence
gggatcagaaggcatgaact

SEQ ID NO: 483656 - DNA, 20 bp, Artificial
  CRISPR gRNA sequence
gatcagaaggcatgaactgg

SEQ ID NO: 483657 - DNA, 20 bp, Artificial
  CRISPR gRNA sequence
tcagaaggcatgaactggga

SEQ ID NO: 483658 - DNA, 20 bp, Artificial
  CRISPR gRNA sequence
agaaggcatgaactgggaga

SEQ ID NO: 483659 - DNA, 20 bp, Artificial
  CRISPR gRNA sequence
aaggcatgaactgggagaga

SEQ ID NO: 483660 - DNA, 20 bp, Artificial
  CRISPR gRNA sequence
atgaactgggagagagagcc

SEQ ID NO: 483661 - DNA, 20 bp, Artificial
  CRISPR gRNA sequence
ccacgcacacaaacatacca

SEQ ID NO: 483662 - DNA, 20 bp, Artificial
  CRISPR gRNA sequence
caaacataccaaagctcgtt

SEQ ID NO: 483663 - DNA, 20 bp, Artificial
  CRISPR gRNA sequence
aaacataccaaagctcgttg

SEQ ID NO: 483664 - DNA, 20 bp, Artificial
  CRISPR gRNA sequence
taccaaagctcgttgaggaa

SEQ ID NO: 483665 - DNA, 20 bp, Artificial
  CRISPR gRNA sequence
accaaagctcgttgaggaaa

SEQ ID NO: 483666 - DNA, 20 bp, Artificial
  CRISPR gRNA sequence
caaagctcgttgaggaaaag

SEQ ID NO: 483667 - DNA, 20 bp, Artificial
  CRISPR gRNA sequence
aaaaggagatgctgtgctcc

SEQ ID NO: 483668 - DNA, 20 bp, Artificial
  CRISPR gRNA sequence
tgctcccagacacatcccac

SEQ ID NO: 483669 - DNA, 20 bp, Artificial
  CRISPR gRNA sequence
cagacacatcccactggacg

SEQ ID NO: 483670 - DNA, 20 bp, Artificial
  CRISPR gRNA sequence
agacacatcccactggacgc

SEQ ID NO: 483671 - DNA, 20 bp, Artificial
  CRISPR gRNA sequence
atcccactggacgcaggaca

SEQ ID NO: 483672 - DNA, 20 bp, Artificial
  CRISPR gRNA sequence
ctggacgcaggacaaagtca

SEQ ID NO: 483673 - DNA, 20 bp, Artificial
  CRISPR gRNA sequence
tggacgcaggacaaagtcac

SEQ ID NO: 483674 - DNA, 20 bp, Artificial
  CRISPR gRNA sequence
aggacaaagtcacaggatcc

SEQ ID NO: 483675 - DNA, 20 bp, Artificial
  CRISPR gRNA sequence
ggacaaagtcacaggatcca

SEQ ID NO: 483676 - DNA, 20 bp, Artificial
  CRISPR gRNA sequence
agtcacaggatccaaggcct

SEQ ID NO: 483677 - DNA, 20 bp, Artificial
  CRISPR gRNA sequence
gtcacaggatccaaggcctc

SEQ ID NO: 483678 - DNA, 20 bp, Artificial
  CRISPR gRNA sequence
acaggatccaaggcctcagg

SEQ ID NO: 483679 - DNA, 20 bp, Artificial
  CRISPR gRNA sequence
caggatccaaggcctcaggc

SEQ ID NO: 483680 - DNA, 20 bp, Artificial
  CRISPR gRNA sequence
ggatccaaggcctcaggcag

SEQ ID NO: 483681 - DNA, 20 bp, Artificial
  CRISPR gRNA sequence
tcaggcaggagcaccaccct

SEQ ID NO: 483682 - DNA, 20 bp, Artificial
  CRISPR gRNA sequence
caggcaggagcaccacccta

SEQ ID NO: 483683 - DNA, 20 bp, Artificial
  CRISPR gRNA sequence
tcctctttctcctccacaca

SEQ ID NO: 483684 - DNA, 20 bp, Artificial
  CRISPR gRNA sequence
tctttctcctccacacacag

SEQ ID NO: 483685 - DNA, 20 bp, Artificial
  CRISPR gRNA sequence
ttctcctccacacacagaag

SEQ ID NO: 483686 - DNA, 20 bp, Artificial
  CRISPR gRNA sequence
tctcctccacacacagaagc

SEQ ID NO: 483687 - DNA, 20 bp, Artificial
  CRISPR gRNA sequence
ctccacacacagaagcaggc

SEQ ID NO: 483688 - DNA, 20 bp, Artificial
  CRISPR gRNA sequence
tccacacacagaagcaggca

SEQ ID NO: 483689 - DNA, 20 bp, Artificial
  CRISPR gRNA sequence
ccacacacagaagcaggcaa

SEQ ID NO: 483690 - DNA, 20 bp, Artificial
  CRISPR gRNA sequence
cagaagcaggcaagggtgcc

SEQ ID NO: 483691 - DNA, 20 bp, Artificial
  CRISPR gRNA sequence
agaagcaggcaagggtgcca

SEQ ID NO: 483692 - DNA, 20 bp, Artificial
  CRISPR gRNA sequence
caggcaagggtgccaaggaa

SEQ ID NO: 483693 - DNA, 20 bp, Artificial
  CRISPR gRNA sequence
gtgccaaggaacagtgcgct

SEQ ID NO: 483694 - DNA, 20 bp, Artificial
  CRISPR gRNA sequence
atcacgatgatcaccaaaaa

SEQ ID NO: 483695 - DNA, 20 bp, Artificial
  CRISPR gRNA sequence
acggccaaaatctgaattct

SEQ ID NO: 483696 - DNA, 20 bp, Artificial
  CRISPR gRNA sequence
cggccaaaatctgaattctg

SEQ ID NO: 483697 - DNA, 20 bp, Artificial
  CRISPR gRNA sequence
aatctgaattctgaggaata

SEQ ID NO: 483698 - DNA, 20 bp, Artificial
  CRISPR gRNA sequence
ctgaattctgaggaatacag

SEQ ID NO: 483699 - DNA, 20 bp, Artificial
  CRISPR gRNA sequence
tgaattctgaggaatacaga

SEQ ID NO: 483700 - DNA, 20 bp, Artificial
  CRISPR gRNA sequence
ctgaggaatacagaaggcgt

SEQ ID NO: 483701 - DNA, 20 bp, Artificial
  CRISPR gRNA sequence
atacagaaggcgtgagaact

SEQ ID NO: 483702 - DNA, 20 bp, Artificial
  CRISPR gRNA sequence
aggcgtgagaactgagctgt

SEQ ID NO: 483703 - DNA, 20 bp, Artificial
  CRISPR gRNA sequence
tccttcccacctgcctgctg

SEQ ID NO: 483704 - DNA, 20 bp, Artificial
  CRISPR gRNA sequence
ccttcccacctgcctgctgc

SEQ ID NO: 483705 - DNA, 20 bp, Artificial
  CRISPR gRNA sequence
cttcccacctgcctgctgca

SEQ ID NO: 483706 - DNA, 20 bp, Artificial
  CRISPR gRNA sequence
ttcccacctgcctgctgcag

SEQ ID NO: 483707 - DNA, 20 bp, Artificial
  CRISPR gRNA sequence
acccacttttctctgtgttg

SEQ ID NO: 483708 - DNA, 20 bp, Artificial
  CRISPR gRNA sequence
ggctgattgcctcgtgctct

SEQ ID NO: 483709 - DNA, 20 bp, Artificial
  CRISPR gRNA sequence
cctcgtgctctgagaactca

SEQ ID NO: 483710 - DNA, 20 bp, Artificial
  CRISPR gRNA sequence
tgctctgagaactcacggtc

SEQ ID NO: 483711 - DNA, 20 bp, Artificial
  CRISPR gRNA sequence
gctctgagaactcacggtca

SEQ ID NO: 483712 - DNA, 20 bp, Artificial
  CRISPR gRNA sequence
aggttttctctttgctcatt

SEQ ID NO: 483713 - DNA, 20 bp, Artificial
  CRISPR gRNA sequence
tcatttggttaacctcctct

SEQ ID NO: 483714 - DNA, 20 bp, Artificial
  CRISPR gRNA sequence
aacctcctctgagtgatgcc

SEQ ID NO: 483715 - DNA, 20 bp, Artificial
  CRISPR gRNA sequence
cctcctctgagtgatgccaa

SEQ ID NO: 483716 - DNA, 20 bp, Artificial
  CRISPR gRNA sequence
tctgagtgatgccaagagca

SEQ ID NO: 483717 - DNA, 20 bp, Artificial
  CRISPR gRNA sequence
tgccaagagcatagatatat

SEQ ID NO: 483718 - DNA, 20 bp, Artificial
  CRISPR gRNA sequence
aagagcatagatatatcaga

SEQ ID NO: 483719 - DNA, 20 bp, Artificial
  CRISPR gRNA sequence
agagcatagatatatcagac

SEQ ID NO: 483720 - DNA, 20 bp, Artificial
  CRISPR gRNA sequence
atagatatatcagacaggcc

SEQ ID NO: 483721 - DNA, 20 bp, Artificial
  CRISPR gRNA sequence
ggctcaaattctaaccctgt

SEQ ID NO: 483722 - DNA, 20 bp, Artificial
  CRISPR gRNA sequence
cactatttatttaacctctc

SEQ ID NO: 483723 - DNA, 20 bp, Artificial
  CRISPR gRNA sequence
actatttatttaacctctct

SEQ ID NO: 483724 - DNA, 20 bp, Artificial
  CRISPR gRNA sequence
ttaacctctctgggcctctc

SEQ ID NO: 483725 - DNA, 20 bp, Artificial
  CRISPR gRNA sequence
ctctcaagtcatcttatttt

SEQ ID NO: 483726 - DNA, 20 bp, Artificial
  CRISPR gRNA sequence
tcaagtcatcttatttttgg

SEQ ID NO: 483727 - DNA, 20 bp, Artificial
  CRISPR gRNA sequence
cttatttttggaagatgcct

SEQ ID NO: 483728 - DNA, 20 bp, Artificial
  CRISPR gRNA sequence
tatttttggaagatgcctca

SEQ ID NO: 483729 - DNA, 20 bp, Artificial
  CRISPR gRNA sequence
gaagatgcctcagagcctct

SEQ ID NO: 483730 - DNA, 20 bp, Artificial
  CRISPR gRNA sequence
ttagattttctcacctgtaa

SEQ ID NO: 483731 - DNA, 20 bp, Artificial
  CRISPR gRNA sequence
tagattttctcacctgtaaa

SEQ ID NO: 483732 - DNA, 20 bp, Artificial
  CRISPR gRNA sequence
agattttctcacctgtaaaa

SEQ ID NO: 483733 - DNA, 20 bp, Artificial
  CRISPR gRNA sequence
gattttctcacctgtaaaag

SEQ ID NO: 483734 - DNA, 20 bp, Artificial
  CRISPR gRNA sequence
gggataacgttatctaccta

SEQ ID NO: 483735 - DNA, 20 bp, Artificial
  CRISPR gRNA sequence
ggataacgttatctacctat

SEQ ID NO: 483736 - DNA, 20 bp, Artificial
  CRISPR gRNA sequence
gataacgttatctacctata

SEQ ID NO: 483737 - DNA, 20 bp, Artificial
  CRISPR gRNA sequence
ataacgttatctacctatag

SEQ ID NO: 483738 - DNA, 20 bp, Artificial
  CRISPR gRNA sequence
gttaattacatgatctaata

SEQ ID NO: 483739 - DNA, 20 bp, Artificial
  CRISPR gRNA sequence
tctaatacagttgccctcca

SEQ ID NO: 483740 - DNA, 20 bp, Artificial
  CRISPR gRNA sequence
cagttgccctccaaagtttt

SEQ ID NO: 483741 - DNA, 20 bp, Artificial
  CRISPR gRNA sequence
aagttttgagttccacaatg

SEQ ID NO: 483742 - DNA, 20 bp, Artificial
  CRISPR gRNA sequence
aatgtggattcaatgaattg

SEQ ID NO: 483743 - DNA, 20 bp, Artificial
  CRISPR gRNA sequence
gattcaatgaattgtggatc

SEQ ID NO: 483744 - DNA, 20 bp, Artificial
  CRISPR gRNA sequence
aattgtggatccagaatatt

SEQ ID NO: 483745 - DNA, 20 bp, Artificial
  CRISPR gRNA sequence
attgtggatccagaatattc

SEQ ID NO: 483746 - DNA, 20 bp, Artificial
  CRISPR gRNA sequence
ttgtggatccagaatattca

SEQ ID NO: 483747 - DNA, 20 bp, Artificial
  CRISPR gRNA sequence
atgcatgtgtattgaatatg

SEQ ID NO: 483748 - DNA, 20 bp, Artificial
  CRISPR gRNA sequence
gcatgtgtattgaatatgta

SEQ ID NO: 483749 - DNA, 20 bp, Artificial
  CRISPR gRNA sequence
catgtgtattgaatatgtag

SEQ ID NO: 483750 - DNA, 20 bp, Artificial
  CRISPR gRNA sequence
tcattattccctaaacaata

SEQ ID NO: 483751 - DNA, 20 bp, Artificial
  CRISPR gRNA sequence
cagtataacaactatttaaa

SEQ ID NO: 483752 - DNA, 20 bp, Artificial
  CRISPR gRNA sequence
aaatagcatttacattgtat

SEQ ID NO: 483753 - DNA, 20 bp, Artificial
  CRISPR gRNA sequence
aatagcatttacattgtatc

SEQ ID NO: 483754 - DNA, 20 bp, Artificial
  CRISPR gRNA sequence
atcaggcattataactaatt

SEQ ID NO: 483755 - DNA, 20 bp, Artificial
  CRISPR gRNA sequence
caggcattataactaattta

SEQ ID NO: 483756 - DNA, 20 bp, Artificial
  CRISPR gRNA sequence
aggcattataactaatttag

SEQ ID NO: 483757 - DNA, 20 bp, Artificial
  CRISPR gRNA sequence
aactaatttagaggtgactt

SEQ ID NO: 483758 - DNA, 20 bp, Artificial
  CRISPR gRNA sequence
aatttagaggtgacttaagt

SEQ ID NO: 483759 - DNA, 20 bp, Artificial
  CRISPR gRNA sequence
atttagaggtgacttaagta

SEQ ID NO: 483760 - DNA, 20 bp, Artificial
  CRISPR gRNA sequence
ggtgacttaagtaaggtata

SEQ ID NO: 483761 - DNA, 20 bp, Artificial
  CRISPR gRNA sequence
gacttaagtaaggtatacag

SEQ ID NO: 483762 - DNA, 20 bp, Artificial
  CRISPR gRNA sequence
acttaagtaaggtatacaga

SEQ ID NO: 483763 - DNA, 20 bp, Artificial
  CRISPR gRNA sequence
tatacagaaggatgtgtgca

SEQ ID NO: 483764 - DNA, 20 bp, Artificial
  CRISPR gRNA sequence
atacagaaggatgtgtgcat

SEQ ID NO: 483765 - DNA, 20 bp, Artificial
  CRISPR gRNA sequence
aaaactgcacctgtttatgc

SEQ ID NO: 483766 - DNA, 20 bp, Artificial
  CRISPR gRNA sequence
aaactgcacctgtttatgcc

SEQ ID NO: 483767 - DNA, 20 bp, Artificial
  CRISPR gRNA sequence
aactgcacctgtttatgcca

SEQ ID NO: 483768 - DNA, 20 bp, Artificial
  CRISPR gRNA sequence
gccagggacttaaacattcg

SEQ ID NO: 483769 - DNA, 20 bp, Artificial
  CRISPR gRNA sequence
acttaaacattcgtggatct

SEQ ID NO: 483770 - DNA, 20 bp, Artificial
  CRISPR gRNA sequence
ttcgtggatcttggcatctg

SEQ ID NO: 483771 - DNA, 20 bp, Artificial
  CRISPR gRNA sequence
atcttggcatctgtggttgc

SEQ ID NO: 483772 - DNA, 20 bp, Artificial
  CRISPR gRNA sequence
tcttggcatctgtggttgcg

SEQ ID NO: 483773 - DNA, 20 bp, Artificial
  CRISPR gRNA sequence
tggcatctgtggttgcgagg

SEQ ID NO: 483774 - DNA, 20 bp, Artificial
  CRISPR gRNA sequence
ggcatctgtggttgcgaggt

SEQ ID NO: 483775 - DNA, 20 bp, Artificial
  CRISPR gRNA sequence
tgtggttgcgaggtgggtcc

SEQ ID NO: 483776 - DNA, 20 bp, Artificial
  CRISPR gRNA sequence
gtcctggaactaattcgtca

SEQ ID NO: 483777 - DNA, 20 bp, Artificial
  CRISPR gRNA sequence
actaattcgtcatggatact

SEQ ID NO: 483778 - DNA, 20 bp, Artificial
  CRISPR gRNA sequence
ctaattcgtcatggatactg

SEQ ID NO: 483779 - DNA, 20 bp, Artificial
  CRISPR gRNA sequence
taattcgtcatggatactga

SEQ ID NO: 483780 - DNA, 20 bp, Artificial
  CRISPR gRNA sequence
catggatactgagggacatg

SEQ ID NO: 483781 - DNA, 20 bp, Artificial
  CRISPR gRNA sequence
ctcaaaaaatactcattgta

SEQ ID NO: 483782 - DNA, 20 bp, Artificial
  CRISPR gRNA sequence
tcaaaaaatactcattgtac

SEQ ID NO: 483783 - DNA, 20 bp, Artificial
  CRISPR gRNA sequence
aaaatactcattgtacaggc

SEQ ID NO: 483784 - DNA, 20 bp, Artificial
  CRISPR gRNA sequence
ttccactattccttccttca

SEQ ID NO: 483785 - DNA, 20 bp, Artificial
  CRISPR gRNA sequence
tcatttgaacttctacttaa

SEQ ID NO: 483786 - DNA, 20 bp, Artificial
  CRISPR gRNA sequence
aaagatttgtgtcacacatg

SEQ ID NO: 483787 - DNA, 20 bp, Artificial
  CRISPR gRNA sequence
atgtagcctgatatataatc

SEQ ID NO: 483788 - DNA, 20 bp, Artificial
  CRISPR gRNA sequence
tgatatataatccagccaac

SEQ ID NO: 483789 - DNA, 20 bp, Artificial
  CRISPR gRNA sequence
atatataatccagccaacaa

SEQ ID NO: 483790 - DNA, 20 bp, Artificial
  CRISPR gRNA sequence
tatataatccagccaacaag

SEQ ID NO: 483791 - DNA, 20 bp, Artificial
  CRISPR gRNA sequence
ataatccagccaacaagagg

SEQ ID NO: 483792 - DNA, 20 bp, Artificial
  CRISPR gRNA sequence
taatccagccaacaagagga

SEQ ID NO: 483793 - DNA, 20 bp, Artificial
  CRISPR gRNA sequence
cagccaacaagaggaaggaa

SEQ ID NO: 483794 - DNA, 20 bp, Artificial
  CRISPR gRNA sequence
agccaacaagaggaaggaaa

SEQ ID NO: 483795 - DNA, 20 bp, Artificial
  CRISPR gRNA sequence
aagaggaaggaaaaggaatt

SEQ ID NO: 483796 - DNA, 20 bp, Artificial
  CRISPR gRNA sequence
gaaaaggaattaagtgttcc

SEQ ID NO: 483797 - DNA, 20 bp, Artificial
  CRISPR gRNA sequence
aaaaggaattaagtgttcca

SEQ ID NO: 483798 - DNA, 20 bp, Artificial
  CRISPR gRNA sequence
aaaggaattaagtgttccaa

SEQ ID NO: 483799 - DNA, 20 bp, Artificial
  CRISPR gRNA sequence
taagtgttccaagggctgac

SEQ ID NO: 483800 - DNA, 20 bp, Artificial
  CRISPR gRNA sequence
aagtgttccaagggctgaca

SEQ ID NO: 483801 - DNA, 20 bp, Artificial
  CRISPR gRNA sequence
attatctcatttactcttaa

SEQ ID NO: 483802 - DNA, 20 bp, Artificial
  CRISPR gRNA sequence
actcttaacagcaatcctgt

SEQ ID NO: 483803 - DNA, 20 bp, Artificial
  CRISPR gRNA sequence
ctcttaacagcaatcctgtg

SEQ ID NO: 483804 - DNA, 20 bp, Artificial
  CRISPR gRNA sequence
ttatcacccccattttactc

SEQ ID NO: 483805 - DNA, 20 bp, Artificial
  CRISPR gRNA sequence
tatcacccccattttactca

SEQ ID NO: 483806 - DNA, 20 bp, Artificial
  CRISPR gRNA sequence
atcacccccattttactcaa

SEQ ID NO: 483807 - DNA, 20 bp, Artificial
  CRISPR gRNA sequence
tcacccccattttactcaag

SEQ ID NO: 483808 - DNA, 20 bp, Artificial
  CRISPR gRNA sequence
cacccccattttactcaagg

SEQ ID NO: 483809 - DNA, 20 bp, Artificial
  CRISPR gRNA sequence
acccccattttactcaaggg

SEQ ID NO: 483810 - DNA, 20 bp, Artificial
  CRISPR gRNA sequence
cccattttactcaagggggg

SEQ ID NO: 483811 - DNA, 20 bp, Artificial
  CRISPR gRNA sequence
ctcaaggggggaagaaaatt

SEQ ID NO: 483812 - DNA, 20 bp, Artificial
  CRISPR gRNA sequence
tcaaggggggaagaaaattg

SEQ ID NO: 483813 - DNA, 20 bp, Artificial
  CRISPR gRNA sequence
gggggaagaaaattgaggct

SEQ ID NO: 483814 - DNA, 20 bp, Artificial
  CRISPR gRNA sequence
gggaagaaaattgaggctca

SEQ ID NO: 483815 - DNA, 20 bp, Artificial
  CRISPR gRNA sequence
gaagaaaattgaggctcaga

SEQ ID NO: 483816 - DNA, 20 bp, Artificial
  CRISPR gRNA sequence
aagaaaattgaggctcagag

SEQ ID NO: 483817 - DNA, 20 bp, Artificial
  CRISPR gRNA sequence
agagaggttaatgaatctgc

SEQ ID NO: 483818 - DNA, 20 bp, Artificial
  CRISPR gRNA sequence
agaggttaatgaatctgcca

SEQ ID NO: 483819 - DNA, 20 bp, Artificial
  CRISPR gRNA sequence
aatgaatctgccagagatca

SEQ ID NO: 483820 - DNA, 20 bp, Artificial
  CRISPR gRNA sequence
tgaatctgccagagatcaca

SEQ ID NO: 483821 - DNA, 20 bp, Artificial
  CRISPR gRNA sequence
cttttttttttttttttaaa

SEQ ID NO: 483822 - DNA, 20 bp, Artificial
  CRISPR gRNA sequence
tttttttttttttttaaata

SEQ ID NO: 483823 - DNA, 20 bp, Artificial
  CRISPR gRNA sequence
tttttttttttaaatagaga

SEQ ID NO: 483824 - DNA, 20 bp, Artificial
  CRISPR gRNA sequence
ttttttttttaaatagagat

SEQ ID NO: 483825 - DNA, 20 bp, Artificial
  CRISPR gRNA sequence
tgggattacaccatattgtc

SEQ ID NO: 483826 - DNA, 20 bp, Artificial
  CRISPR gRNA sequence
gggattacaccatattgtcc

SEQ ID NO: 483827 - DNA, 20 bp, Artificial
  CRISPR gRNA sequence
ttacaccatattgtccaggc

SEQ ID NO: 483828 - DNA, 20 bp, Artificial
  CRISPR gRNA sequence
ccaggctggtctcaaacacc

SEQ ID NO: 483829 - DNA, 20 bp, Artificial
  CRISPR gRNA sequence
ggtctcaaacacctggactc

SEQ ID NO: 483830 - DNA, 20 bp, Artificial
  CRISPR gRNA sequence
ctcaagtgatccacctgcct

SEQ ID NO: 483831 - DNA, 20 bp, Artificial
  CRISPR gRNA sequence
ccacctgcctcagcctccca

SEQ ID NO: 483832 - DNA, 20 bp, Artificial
  CRISPR gRNA sequence
gcctcagcctcccaaagtgc

SEQ ID NO: 483833 - DNA, 20 bp, Artificial
  CRISPR gRNA sequence
cctcagcctcccaaagtgct

SEQ ID NO: 483834 - DNA, 20 bp, Artificial
  CRISPR gRNA sequence
agtgctaggattacatgtgt

SEQ ID NO: 483835 - DNA, 20 bp, Artificial
  CRISPR gRNA sequence
agccaccacacctgacctct

SEQ ID NO: 483836 - DNA, 20 bp, Artificial
  CRISPR gRNA sequence
ccaccacacctgacctctaa

SEQ ID NO: 483837 - DNA, 20 bp, Artificial
  CRISPR gRNA sequence
acctgacctctaagagatca

SEQ ID NO: 483838 - DNA, 20 bp, Artificial
  CRISPR gRNA sequence
ctgacctctaagagatcaca

SEQ ID NO: 483839 - DNA, 20 bp, Artificial
  CRISPR gRNA sequence
cacagagcttctgaatgatg

SEQ ID NO: 483840 - DNA, 20 bp, Artificial
  CRISPR gRNA sequence
gagcttctgaatgatgaagc

SEQ ID NO: 483841 - DNA, 20 bp, Artificial
  CRISPR gRNA sequence
gaatgatgaagccagtgtcc

SEQ ID NO: 483842 - DNA, 20 bp, Artificial
  CRISPR gRNA sequence
atgaagccagtgtcctagtt

SEQ ID NO: 483843 - DNA, 20 bp, Artificial
  CRISPR gRNA sequence
aagccagtgtcctagttcag

SEQ ID NO: 483844 - DNA, 20 bp, Artificial
  CRISPR gRNA sequence
tcactgcaacctccgcctcc

SEQ ID NO: 483845 - DNA, 20 bp, Artificial
  CRISPR gRNA sequence
cactgcaacctccgcctcct

SEQ ID NO: 483846 - DNA, 20 bp, Artificial
  CRISPR gRNA sequence
aacctccgcctcctgggttc

SEQ ID NO: 483847 - DNA, 20 bp, Artificial
  CRISPR gRNA sequence
ttcaagcaattctcctgcct

SEQ ID NO: 483848 - DNA, 20 bp, Artificial
  CRISPR gRNA sequence
ttctcctgcctcagcctcct

SEQ ID NO: 483849 - DNA, 20 bp, Artificial
  CRISPR gRNA sequence
tcctgcctcagcctcctgag

SEQ ID NO: 483850 - DNA, 20 bp, Artificial
  CRISPR gRNA sequence
cctcagcctcctgagtagct

SEQ ID NO: 483851 - DNA, 20 bp, Artificial
  CRISPR gRNA sequence
ctcctgagtagctgagatta

SEQ ID NO: 483852 - DNA, 20 bp, Artificial
  CRISPR gRNA sequence
tcctgagtagctgagattac

SEQ ID NO: 483853 - DNA, 20 bp, Artificial
  CRISPR gRNA sequence
caggtgcccgccaacacgcc

SEQ ID NO: 483854 - DNA, 20 bp, Artificial
  CRISPR gRNA sequence
cagctaattttttgtatttt

SEQ ID NO: 483855 - DNA, 20 bp, Artificial
  CRISPR gRNA sequence
ctaattttttgtatttttag

SEQ ID NO: 483856 - DNA, 20 bp, Artificial
  CRISPR gRNA sequence
aattttttgtatttttagta

SEQ ID NO: 483857 - DNA, 20 bp, Artificial
  CRISPR gRNA sequence
ttttgtatttttagtagaga

SEQ ID NO: 483858 - DNA, 20 bp, Artificial
  CRISPR gRNA sequence
tttgtatttttagtagagac

SEQ ID NO: 483859 - DNA, 20 bp, Artificial
  CRISPR gRNA sequence
ttgtatttttagtagagaca

SEQ ID NO: 483860 - DNA, 20 bp, Artificial
  CRISPR gRNA sequence
gagacagggtttcaccatgt

SEQ ID NO: 483861 - DNA, 20 bp, Artificial
  CRISPR gRNA sequence
cagggtttcaccatgttggc

SEQ ID NO: 483862 - DNA, 20 bp, Artificial
  CRISPR gRNA sequence
agggtttcaccatgttggcc

SEQ ID NO: 483863 - DNA, 20 bp, Artificial
  CRISPR gRNA sequence
tttcaccatgttggccaggc

SEQ ID NO: 483864 - DNA, 20 bp, Artificial
  CRISPR gRNA sequence
accttgtgatccacccacct

SEQ ID NO: 483865 - DNA, 20 bp, Artificial
  CRISPR gRNA sequence
ccacccacctcagcctccca

SEQ ID NO: 483866 - DNA, 20 bp, Artificial
  CRISPR gRNA sequence
acctcagcctcccaaagtgc

SEQ ID NO: 483867 - DNA, 20 bp, Artificial
  CRISPR gRNA sequence
cctcagcctcccaaagtgct

SEQ ID NO: 483868 - DNA, 20 bp, Artificial
  CRISPR gRNA sequence
ctcccaaagtgctgggatta

SEQ ID NO: 483869 - DNA, 20 bp, Artificial
  CRISPR gRNA sequence
tcccaaagtgctgggattac

SEQ ID NO: 483870 - DNA, 20 bp, Artificial
  CRISPR gRNA sequence
cccaaagtgctgggattaca

SEQ ID NO: 483871 - DNA, 20 bp, Artificial
  CRISPR gRNA sequence
caaagtgctgggattacagg

SEQ ID NO: 483872 - DNA, 20 bp, Artificial
  CRISPR gRNA sequence
ttacagggagccactgcgcc

SEQ ID NO: 483873 - DNA, 20 bp, Artificial
  CRISPR gRNA sequence
ccactgcgcccggcctgcct

SEQ ID NO: 483874 - DNA, 20 bp, Artificial
  CRISPR gRNA sequence
cttgtttcttttttgtccac

SEQ ID NO: 483875 - DNA, 20 bp, Artificial
  CRISPR gRNA sequence
gtttcttttttgtccacaag

SEQ ID NO: 483876 - DNA, 20 bp, Artificial
  CRISPR gRNA sequence
gttatttttgttgccccatt

SEQ ID NO: 483877 - DNA, 20 bp, Artificial
  CRISPR gRNA sequence
ttgttgccccatttggctat

SEQ ID NO: 483878 - DNA, 20 bp, Artificial
  CRISPR gRNA sequence
gctataagttccttatgaat

SEQ ID NO: 483879 - DNA, 20 bp, Artificial
  CRISPR gRNA sequence
tataagttccttatgaatga

SEQ ID NO: 483880 - DNA, 20 bp, Artificial
  CRISPR gRNA sequence
ccttatgaatgagagctgta

SEQ ID NO: 483881 - DNA, 20 bp, Artificial
  CRISPR gRNA sequence
tcctataatgcccatgctgc

SEQ ID NO: 483882 - DNA, 20 bp, Artificial
  CRISPR gRNA sequence
gcccatgctgctggtacatt

SEQ ID NO: 483883 - DNA, 20 bp, Artificial
  CRISPR gRNA sequence
gtccctgtttatgtaataaa

SEQ ID NO: 483884 - DNA, 20 bp, Artificial
  CRISPR gRNA sequence
gtttatgtaataaaaagttg

SEQ ID NO: 483885 - DNA, 20 bp, Artificial
  CRISPR gRNA sequence
tgtaataaaaagttgtggaa

SEQ ID NO: 483886 - DNA, 20 bp, Artificial
  CRISPR gRNA sequence
aaagttgtggaacggtaact

SEQ ID NO: 483887 - DNA, 20 bp, Artificial
  CRISPR gRNA sequence
aagttgtggaacggtaactc

SEQ ID NO: 483888 - DNA, 20 bp, Artificial
  CRISPR gRNA sequence
acggtaactcaggtaactct

SEQ ID NO: 483889 - DNA, 20 bp, Artificial
  CRISPR gRNA sequence
cggtaactcaggtaactctt

SEQ ID NO: 483890 - DNA, 20 bp, Artificial
  CRISPR gRNA sequence
actcaggtaactcttaggat

SEQ ID NO: 483891 - DNA, 20 bp, Artificial
  CRISPR gRNA sequence
gtaactcttaggatgagcat

SEQ ID NO: 483892 - DNA, 20 bp, Artificial
  CRISPR gRNA sequence
cttaggatgagcataagcaa

SEQ ID NO: 483893 - DNA, 20 bp, Artificial
  CRISPR gRNA sequence
atgagcataagcaacagccc

SEQ ID NO: 483894 - DNA, 20 bp, Artificial
  CRISPR gRNA sequence
caacagcccaagaactcatc

SEQ ID NO: 483895 - DNA, 20 bp, Artificial
  CRISPR gRNA sequence
aacagcccaagaactcatct

SEQ ID NO: 483896 - DNA, 20 bp, Artificial
  CRISPR gRNA sequence
agaactcatctaggtatccc

SEQ ID NO: 483897 - DNA, 20 bp, Artificial
  CRISPR gRNA sequence
gaactcatctaggtatccct

SEQ ID NO: 483898 - DNA, 20 bp, Artificial
  CRISPR gRNA sequence
aactcatctaggtatccctg

SEQ ID NO: 483899 - DNA, 20 bp, Artificial
  CRISPR gRNA sequence
tcatcctgatgctcctgctc

SEQ ID NO: 483900 - DNA, 20 bp, Artificial
  CRISPR gRNA sequence
catcctgatgctcctgctcc

SEQ ID NO: 483901 - DNA, 20 bp, Artificial
  CRISPR gRNA sequence
tgctccaggctactgctgca

SEQ ID NO: 483902 - DNA, 20 bp, Artificial
  CRISPR gRNA sequence
caggctactgctgcacagtg

SEQ ID NO: 483903 - DNA, 20 bp, Artificial
  CRISPR gRNA sequence
tagttacctcttgaactatg

SEQ ID NO: 483904 - DNA, 20 bp, Artificial
  CRISPR gRNA sequence
acctcttgaactatgtggct

SEQ ID NO: 483905 - DNA, 20 bp, Artificial
  CRISPR gRNA sequence
ctcttgaactatgtggcttg

SEQ ID NO: 483906 - DNA, 20 bp, Artificial
  CRISPR gRNA sequence
tgaactatgtggcttggaga

SEQ ID NO: 483907 - DNA, 20 bp, Artificial
  CRISPR gRNA sequence
cttggagaaagttatcactc

SEQ ID NO: 483908 - DNA, 20 bp, Artificial
  CRISPR gRNA sequence
tggagaaagttatcactcaa

SEQ ID NO: 483909 - DNA, 20 bp, Artificial
  CRISPR gRNA sequence
ggagaaagttatcactcaag

SEQ ID NO: 483910 - DNA, 20 bp, Artificial
  CRISPR gRNA sequence
agaaagttatcactcaagag

SEQ ID NO: 483911 - DNA, 20 bp, Artificial
  CRISPR gRNA sequence
aaagttatcactcaagagga

SEQ ID NO: 483912 - DNA, 20 bp, Artificial
  CRISPR gRNA sequence
aagttatcactcaagaggag

SEQ ID NO: 483913 - DNA, 20 bp, Artificial
  CRISPR gRNA sequence
tatcactcaagaggagagga

SEQ ID NO: 483914 - DNA, 20 bp, Artificial
  CRISPR gRNA sequence
aggagaggacagttctccat

SEQ ID NO: 483915 - DNA, 20 bp, Artificial
  CRISPR gRNA sequence
agttctccatcagcctctcc

SEQ ID NO: 483916 - DNA, 20 bp, Artificial
  CRISPR gRNA sequence
gttctccatcagcctctccc

SEQ ID NO: 483917 - DNA, 20 bp, Artificial
  CRISPR gRNA sequence
ctccatcagcctctcccagg

SEQ ID NO: 483918 - DNA, 20 bp, Artificial
  CRISPR gRNA sequence
cccaggaagaaaataatgtt

SEQ ID NO: 483919 - DNA, 20 bp, Artificial
  CRISPR gRNA sequence
ccaggaagaaaataatgttc

SEQ ID NO: 483920 - DNA, 20 bp, Artificial
  CRISPR gRNA sequence
aggaagaaaataatgttcag

SEQ ID NO: 483921 - DNA, 20 bp, Artificial
  CRISPR gRNA sequence
ataatgttcaggagccattt

SEQ ID NO: 483922 - DNA, 20 bp, Artificial
  CRISPR gRNA sequence
taatgttcaggagccatttc

SEQ ID NO: 483923 - DNA, 20 bp, Artificial
  CRISPR gRNA sequence
acaactatgccctccctctg

SEQ ID NO: 483924 - DNA, 20 bp, Artificial
  CRISPR gRNA sequence
actatgccctccctctgcag

SEQ ID NO: 483925 - DNA, 20 bp, Artificial
  CRISPR gRNA sequence
gccctccctctgcagaagaa

SEQ ID NO: 483926 - DNA, 20 bp, Artificial
  CRISPR gRNA sequence
gaagaaaagcttgcatctcc

SEQ ID NO: 483927 - DNA, 20 bp, Artificial
  CRISPR gRNA sequence
gaaaagcttgcatctcccag

SEQ ID NO: 483928 - DNA, 20 bp, Artificial
  CRISPR gRNA sequence
aaaagcttgcatctcccaga

SEQ ID NO: 483929 - DNA, 20 bp, Artificial
  CRISPR gRNA sequence
ttgcatctcccagaaggaaa

SEQ ID NO: 483930 - DNA, 20 bp, Artificial
  CRISPR gRNA sequence
tgcatctcccagaaggaaat

SEQ ID NO: 483931 - DNA, 20 bp, Artificial
  CRISPR gRNA sequence
gcatctcccagaaggaaata

SEQ ID NO: 483932 - DNA, 20 bp, Artificial
  CRISPR gRNA sequence
atagggataacatttttttc

SEQ ID NO: 483933 - DNA, 20 bp, Artificial
  CRISPR gRNA sequence
agggataacatttttttcca

SEQ ID NO: 483934 - DNA, 20 bp, Artificial
  CRISPR gRNA sequence
gataacatttttttccagag

SEQ ID NO: 483935 - DNA, 20 bp, Artificial
  CRISPR gRNA sequence
ataacatttttttccagagt

SEQ ID NO: 483936 - DNA, 20 bp, Artificial
  CRISPR gRNA sequence
catttttttccagagtagga

SEQ ID NO: 483937 - DNA, 20 bp, Artificial
  CRISPR gRNA sequence
atttttttccagagtaggat

SEQ ID NO: 483938 - DNA, 20 bp, Artificial
  CRISPR gRNA sequence
tttccagagtaggataggcc

SEQ ID NO: 483939 - DNA, 20 bp, Artificial
  CRISPR gRNA sequence
gtaggataggcctagcttta

SEQ ID NO: 483940 - DNA, 20 bp, Artificial
  CRISPR gRNA sequence
taggataggcctagctttac

SEQ ID NO: 483941 - DNA, 20 bp, Artificial
  CRISPR gRNA sequence
ctttacaggaactgtgtgcc

SEQ ID NO: 483942 - DNA, 20 bp, Artificial
  CRISPR gRNA sequence
ttacaggaactgtgtgcctg

SEQ ID NO: 483943 - DNA, 20 bp, Artificial
  CRISPR gRNA sequence
tacaggaactgtgtgcctgg

SEQ ID NO: 483944 - DNA, 20 bp, Artificial
  CRISPR gRNA sequence
ggaactgtgtgcctggaggc

SEQ ID NO: 483945 - DNA, 20 bp, Artificial
  CRISPR gRNA sequence
gaactgtgtgcctggaggcc

SEQ ID NO: 483946 - DNA, 20 bp, Artificial
  CRISPR gRNA sequence
aactgtgtgcctggaggcca

SEQ ID NO: 483947 - DNA, 20 bp, Artificial
  CRISPR gRNA sequence
cctggaggccagggctaccc

SEQ ID NO: 483948 - DNA, 20 bp, Artificial
  CRISPR gRNA sequence
ctggaggccagggctaccct

SEQ ID NO: 483949 - DNA, 20 bp, Artificial
  CRISPR gRNA sequence
gaggccagggctaccctggg

SEQ ID NO: 483950 - DNA, 20 bp, Artificial
  CRISPR gRNA sequence
aggccagggctaccctggga

SEQ ID NO: 483951 - DNA, 20 bp, Artificial
  CRISPR gRNA sequence
ggccagggctaccctgggaa

SEQ ID NO: 483952 - DNA, 20 bp, Artificial
  CRISPR gRNA sequence
gctaccctgggaagggctac

SEQ ID NO: 483953 - DNA, 20 bp, Artificial
  CRISPR gRNA sequence
ctaccctgggaagggctaca

SEQ ID NO: 483954 - DNA, 20 bp, Artificial
  CRISPR gRNA sequence
tgggaagggctacaaggcac

SEQ ID NO: 483955 - DNA, 20 bp, Artificial
  CRISPR gRNA sequence
gggaagggctacaaggcact

SEQ ID NO: 483956 - DNA, 20 bp, Artificial
  CRISPR gRNA sequence
gaagggctacaaggcactgg

SEQ ID NO: 483957 - DNA, 20 bp, Artificial
  CRISPR gRNA sequence
agggctacaaggcactggga

SEQ ID NO: 483958 - DNA, 20 bp, Artificial
  CRISPR gRNA sequence
gggctacaaggcactgggag

SEQ ID NO: 483959 - DNA, 20 bp, Artificial
  CRISPR gRNA sequence
gctacaaggcactgggagag

SEQ ID NO: 483960 - DNA, 20 bp, Artificial
  CRISPR gRNA sequence
ctacaaggcactgggagagg

SEQ ID NO: 483961 - DNA, 20 bp, Artificial
  CRISPR gRNA sequence
aggcactgggagaggaggcc

SEQ ID NO: 483962 - DNA, 20 bp, Artificial
  CRISPR gRNA sequence
ggcactgggagaggaggcca

SEQ ID NO: 483963 - DNA, 20 bp, Artificial
  CRISPR gRNA sequence
gcactgggagaggaggccaa

SEQ ID NO: 483964 - DNA, 20 bp, Artificial
  CRISPR gRNA sequence
accacatctgtcttgcacat

SEQ ID NO: 483965 - DNA, 20 bp, Artificial
  CRISPR gRNA sequence
atctgtcttgcacatgagcc

SEQ ID NO: 483966 - DNA, 20 bp, Artificial
  CRISPR gRNA sequence
cttgcacatgagcctggttg

SEQ ID NO: 483967 - DNA, 20 bp, Artificial
  CRISPR gRNA sequence
ttgcacatgagcctggttgc

SEQ ID NO: 483968 - DNA, 20 bp, Artificial
  CRISPR gRNA sequence
tgcacatgagcctggttgcg

SEQ ID NO: 483969 - DNA, 20 bp, Artificial
  CRISPR gRNA sequence
ggttgcggggtccaaacctt

SEQ ID NO: 483970 - DNA, 20 bp, Artificial
  CRISPR gRNA sequence
caaaccttcagcgcttgtta

SEQ ID NO: 483971 - DNA, 20 bp, Artificial
  CRISPR gRNA sequence
cttcagcgcttgttatagcc

SEQ ID NO: 483972 - DNA, 20 bp, Artificial
  CRISPR gRNA sequence
gtgtgttccacttaccctga

SEQ ID NO: 483973 - DNA, 20 bp, Artificial
  CRISPR gRNA sequence
tgtgttccacttaccctgat

SEQ ID NO: 483974 - DNA, 20 bp, Artificial
  CRISPR gRNA sequence
taccctgatgggcattctga

SEQ ID NO: 483975 - DNA, 20 bp, Artificial
  CRISPR gRNA sequence
atgggcattctgacagtcct

SEQ ID NO: 483976 - DNA, 20 bp, Artificial
  CRISPR gRNA sequence
gcattctgacagtcctgagt

SEQ ID NO: 483977 - DNA, 20 bp, Artificial
  CRISPR gRNA sequence
tgacagtcctgagtgagatt

SEQ ID NO: 483978 - DNA, 20 bp, Artificial
  CRISPR gRNA sequence
gacagtcctgagtgagattc

SEQ ID NO: 483979 - DNA, 20 bp, Artificial
  CRISPR gRNA sequence
acagtcctgagtgagattca

SEQ ID NO: 483980 - DNA, 20 bp, Artificial
  CRISPR gRNA sequence
cctgagtgagattcagggtg

SEQ ID NO: 483981 - DNA, 20 bp, Artificial
  CRISPR gRNA sequence
gattcagggtgtggctttcc

SEQ ID NO: 483982 - DNA, 20 bp, Artificial
  CRISPR gRNA sequence
ggtgtggctttcccagctaa

SEQ ID NO: 483983 - DNA, 20 bp, Artificial
  CRISPR gRNA sequence
gtgtggctttcccagctaac

SEQ ID NO: 483984 - DNA, 20 bp, Artificial
  CRISPR gRNA sequence
taacaggattgctgacattg

SEQ ID NO: 483985 - DNA, 20 bp, Artificial
  CRISPR gRNA sequence
aacaggattgctgacattgc

SEQ ID NO: 483986 - DNA, 20 bp, Artificial
  CRISPR gRNA sequence
gacattgcaggtatatgtgt

SEQ ID NO: 483987 - DNA, 20 bp, Artificial
  CRISPR gRNA sequence
ttaatgtcaacctcctcgtc

SEQ ID NO: 483988 - DNA, 20 bp, Artificial
  CRISPR gRNA sequence
taatgtcaacctcctcgtcc

SEQ ID NO: 483989 - DNA, 20 bp, Artificial
  CRISPR gRNA sequence
tgtcaacctcctcgtccagg

SEQ ID NO: 483990 - DNA, 20 bp, Artificial
  CRISPR gRNA sequence
gtcaacctcctcgtccaggt

SEQ ID NO: 483991 - DNA, 20 bp, Artificial
  CRISPR gRNA sequence
acctcctcgtccaggtaggt

SEQ ID NO: 483992 - DNA, 20 bp, Artificial
  CRISPR gRNA sequence
cctcctcgtccaggtaggtg

SEQ ID NO: 483993 - DNA, 20 bp, Artificial
  CRISPR gRNA sequence
aggtgaggttccctgctgtc

SEQ ID NO: 483994 - DNA, 20 bp, Artificial
  CRISPR gRNA sequence
aggttccctgctgtctggat

SEQ ID NO: 483995 - DNA, 20 bp, Artificial
  CRISPR gRNA sequence
cagcttgctccctctgtacc

SEQ ID NO: 483996 - DNA, 20 bp, Artificial
  CRISPR gRNA sequence
tgctccctctgtaccaagca

SEQ ID NO: 483997 - DNA, 20 bp, Artificial
  CRISPR gRNA sequence
gctccctctgtaccaagcat

SEQ ID NO: 483998 - DNA, 20 bp, Artificial
  CRISPR gRNA sequence
ataggacacattgccatccc

SEQ ID NO: 483999 - DNA, 20 bp, Artificial
  CRISPR gRNA sequence
aggacacattgccatccctg

SEQ ID NO: 484000 - DNA, 20 bp, Artificial
  CRISPR gRNA sequence
cattgccatccctggagacc

SEQ ID NO: 484001 - DNA, 20 bp, Artificial
  CRISPR gRNA sequence
gccatccctggagaccaagc

SEQ ID NO: 484002 - DNA, 20 bp, Artificial
  CRISPR gRNA sequence
tccctggagaccaagcaaga

SEQ ID NO: 484003 - DNA, 20 bp, Artificial
  CRISPR gRNA sequence
cctggagaccaagcaagaca

SEQ ID NO: 484004 - DNA, 20 bp, Artificial
  CRISPR gRNA sequence
ccaagcaagacagagccact

SEQ ID NO: 484005 - DNA, 20 bp, Artificial
  CRISPR gRNA sequence
acttggcatctccctctgtc

SEQ ID NO: 484006 - DNA, 20 bp, Artificial
  CRISPR gRNA sequence
cttggcatctccctctgtcc

SEQ ID NO: 484007 - DNA, 20 bp, Artificial
  CRISPR gRNA sequence
aggatcttcccctgcccctg

SEQ ID NO: 484008 - DNA, 20 bp, Artificial
  CRISPR gRNA sequence
ggatcttcccctgcccctgt

SEQ ID NO: 484009 - DNA, 20 bp, Artificial
  CRISPR gRNA sequence
tcttcccctgcccctgtagg

SEQ ID NO: 484010 - DNA, 20 bp, Artificial
  CRISPR gRNA sequence
cttcccctgcccctgtaggc

SEQ ID NO: 484011 - DNA, 20 bp, Artificial
  CRISPR gRNA sequence
ttcccctgcccctgtaggcg

SEQ ID NO: 484012 - DNA, 20 bp, Artificial
  CRISPR gRNA sequence
cggggtttctcaactttatc

SEQ ID NO: 484013 - DNA, 20 bp, Artificial
  CRISPR gRNA sequence
ggtttctcaactttatctgg

SEQ ID NO: 484014 - DNA, 20 bp, Artificial
  CRISPR gRNA sequence
ttctcaactttatctggaag

SEQ ID NO: 484015 - DNA, 20 bp, Artificial
  CRISPR gRNA sequence
ctcaactttatctggaagca

SEQ ID NO: 484016 - DNA, 20 bp, Artificial
  CRISPR gRNA sequence
ctggaagcagagattctgat

SEQ ID NO: 484017 - DNA, 20 bp, Artificial
  CRISPR gRNA sequence
aagcagagattctgatcaga

SEQ ID NO: 484018 - DNA, 20 bp, Artificial
  CRISPR gRNA sequence
agcagagattctgatcagaa

SEQ ID NO: 484019 - DNA, 20 bp, Artificial
  CRISPR gRNA sequence
gattctgatcagaaaggcat

SEQ ID NO: 484020 - DNA, 20 bp, Artificial
  CRISPR gRNA sequence
tcagaaaggcattggaaata

SEQ ID NO: 484021 - DNA, 20 bp, Artificial
  CRISPR gRNA sequence
ggcattggaaatacagaact

SEQ ID NO: 484022 - DNA, 20 bp, Artificial
  CRISPR gRNA sequence
cattggaaatacagaactta

SEQ ID NO: 484023 - DNA, 20 bp, Artificial
  CRISPR gRNA sequence
attggaaatacagaacttag

SEQ ID NO: 484024 - DNA, 20 bp, Artificial
  CRISPR gRNA sequence
atacagaacttagaggccta

SEQ ID NO: 484025 - DNA, 20 bp, Artificial
  CRISPR gRNA sequence
tacagaacttagaggcctat

SEQ ID NO: 484026 - DNA, 20 bp, Artificial
  CRISPR gRNA sequence
acttagaggcctataggaat

SEQ ID NO: 484027 - DNA, 20 bp, Artificial
  CRISPR gRNA sequence
ttagaggcctataggaatca

SEQ ID NO: 484028 - DNA, 20 bp, Artificial
  CRISPR gRNA sequence
agaggcctataggaatcaga

SEQ ID NO: 484029 - DNA, 20 bp, Artificial
  CRISPR gRNA sequence
gaggcctataggaatcagag

SEQ ID NO: 484030 - DNA, 20 bp, Artificial
  CRISPR gRNA sequence
aggcctataggaatcagaga

SEQ ID NO: 484031 - DNA, 20 bp, Artificial
  CRISPR gRNA sequence
cctataggaatcagagaggg

SEQ ID NO: 484032 - DNA, 20 bp, Artificial
  CRISPR gRNA sequence
atcagagagggcagtatgaa

SEQ ID NO: 484033 - DNA, 20 bp, Artificial
  CRISPR gRNA sequence
gagggcagtatgaacagtcc

SEQ ID NO: 484034 - DNA, 20 bp, Artificial
  CRISPR gRNA sequence
gggcagtatgaacagtcctg

SEQ ID NO: 484035 - DNA, 20 bp, Artificial
  CRISPR gRNA sequence
acttaccaaatacaaaaacc

SEQ ID NO: 484036 - DNA, 20 bp, Artificial
  CRISPR gRNA sequence
aaatacaaaaacctggaacg

SEQ ID NO: 484037 - DNA, 20 bp, Artificial
  CRISPR gRNA sequence
cgtggctgtctgaacttttc

SEQ ID NO: 484038 - DNA, 20 bp, Artificial
  CRISPR gRNA sequence
ctgaacttttccagatatac

SEQ ID NO: 484039 - DNA, 20 bp, Artificial
  CRISPR gRNA sequence
ccagatatactggtgacctc

SEQ ID NO: 484040 - DNA, 20 bp, Artificial
  CRISPR gRNA sequence
cagatatactggtgacctcc

SEQ ID NO: 484041 - DNA, 20 bp, Artificial
  CRISPR gRNA sequence
atatactggtgacctccagg

SEQ ID NO: 484042 - DNA, 20 bp, Artificial
  CRISPR gRNA sequence
tactggtgacctccaggcag

SEQ ID NO: 484043 - DNA, 20 bp, Artificial
  CRISPR gRNA sequence
ctggtgacctccaggcagta

SEQ ID NO: 484044 - DNA, 20 bp, Artificial
  CRISPR gRNA sequence
tggtgacctccaggcagtag

SEQ ID NO: 484045 - DNA, 20 bp, Artificial
  CRISPR gRNA sequence
gaggccactgtcctgctgct

SEQ ID NO: 484046 - DNA, 20 bp, Artificial
  CRISPR gRNA sequence
tgctgctgagctgccttgat

SEQ ID NO: 484047 - DNA, 20 bp, Artificial
  CRISPR gRNA sequence
tgctgagctgccttgatgag

SEQ ID NO: 484048 - DNA, 20 bp, Artificial
  CRISPR gRNA sequence
ctgccttgatgagaagactc

SEQ ID NO: 484049 - DNA, 20 bp, Artificial
  CRISPR gRNA sequence
tataaaactgaatctatcat

SEQ ID NO: 484050 - DNA, 20 bp, Artificial
  CRISPR gRNA sequence
aaaactgaatctatcattgg

SEQ ID NO: 484051 - DNA, 20 bp, Artificial
  CRISPR gRNA sequence
gaatctatcattggaagtat

SEQ ID NO: 484052 - DNA, 20 bp, Artificial
  CRISPR gRNA sequence
tctatcattggaagtattgg

SEQ ID NO: 484053 - DNA, 20 bp, Artificial
  CRISPR gRNA sequence
ctatcattggaagtattgga

SEQ ID NO: 484054 - DNA, 20 bp, Artificial
  CRISPR gRNA sequence
attggaagtattggaaggca

SEQ ID NO: 484055 - DNA, 20 bp, Artificial
  CRISPR gRNA sequence
tggaagtattggaaggcaaa

SEQ ID NO: 484056 - DNA, 20 bp, Artificial
  CRISPR gRNA sequence
tgtgatgaaatccattttgt

SEQ ID NO: 484057 - DNA, 20 bp, Artificial
  CRISPR gRNA sequence
gtgatgaaatccattttgtg

SEQ ID NO: 484058 - DNA, 20 bp, Artificial
  CRISPR gRNA sequence
tgatgaaatccattttgtga

SEQ ID NO: 484059 - DNA, 20 bp, Artificial
  CRISPR gRNA sequence
tgaaatccattttgtgaggg

SEQ ID NO: 484060 - DNA, 20 bp, Artificial
  CRISPR gRNA sequence
accttcgtctgtatgctgtt

SEQ ID NO: 484061 - DNA, 20 bp, Artificial
  CRISPR gRNA sequence
atgctgtttggttgtaactg

SEQ ID NO: 484062 - DNA, 20 bp, Artificial
  CRISPR gRNA sequence
gctgtttggttgtaactgaa

SEQ ID NO: 484063 - DNA, 20 bp, Artificial
  CRISPR gRNA sequence
ctgtttggttgtaactgaag

SEQ ID NO: 484064 - DNA, 20 bp, Artificial
  CRISPR gRNA sequence
gtaactgaagaggcactccc

SEQ ID NO: 484065 - DNA, 20 bp, Artificial
  CRISPR gRNA sequence
ctcccgagatgctaaccaca

SEQ ID NO: 484066 - DNA, 20 bp, Artificial
  CRISPR gRNA sequence
cgagatgctaaccacatggt

SEQ ID NO: 484067 - DNA, 20 bp, Artificial
  CRISPR gRNA sequence
ccacatggtcagctgatccc

SEQ ID NO: 484068 - DNA, 20 bp, Artificial
  CRISPR gRNA sequence
tcagctgatccctggcatcc

SEQ ID NO: 484069 - DNA, 20 bp, Artificial
  CRISPR gRNA sequence
cagctgatccctggcatcct

SEQ ID NO: 484070 - DNA, 20 bp, Artificial
  CRISPR gRNA sequence
tgatccctggcatcctagga

SEQ ID NO: 484071 - DNA, 20 bp, Artificial
  CRISPR gRNA sequence
atccctggcatcctaggaaa

SEQ ID NO: 484072 - DNA, 20 bp, Artificial
  CRISPR gRNA sequence
catcctaggaaagagaaccc

SEQ ID NO: 484073 - DNA, 20 bp, Artificial
  CRISPR gRNA sequence
ggaaagagaacccaagctga

SEQ ID NO: 484074 - DNA, 20 bp, Artificial
  CRISPR gRNA sequence
aagagaacccaagctgaaag

SEQ ID NO: 484075 - DNA, 20 bp, Artificial
  CRISPR gRNA sequence
agaacccaagctgaaagtag

SEQ ID NO: 484076 - DNA, 20 bp, Artificial
  CRISPR gRNA sequence
gaacccaagctgaaagtagc

SEQ ID NO: 484077 - DNA, 20 bp, Artificial
  CRISPR gRNA sequence
cccaagctgaaagtagcggg

SEQ ID NO: 484078 - DNA, 20 bp, Artificial
  CRISPR gRNA sequence
caagctgaaagtagcgggaa

SEQ ID NO: 484079 - DNA, 20 bp, Artificial
  CRISPR gRNA sequence
gaaagtagcgggaagagtgt

SEQ ID NO: 484080 - DNA, 20 bp, Artificial
  CRISPR gRNA sequence
aaagtagcgggaagagtgtc

SEQ ID NO: 484081 - DNA, 20 bp, Artificial
  CRISPR gRNA sequence
gcgggaagagtgtcaggcct

SEQ ID NO: 484082 - DNA, 20 bp, Artificial
  CRISPR gRNA sequence
agtgtcaggcctgagcaatg

SEQ ID NO: 484083 - DNA, 20 bp, Artificial
  CRISPR gRNA sequence
gtgtcaggcctgagcaatgt

SEQ ID NO: 484084 - DNA, 20 bp, Artificial
  CRISPR gRNA sequence
tcaggcctgagcaatgtggg

SEQ ID NO: 484085 - DNA, 20 bp, Artificial
  CRISPR gRNA sequence
gcctgagcaatgtgggcagc

SEQ ID NO: 484086 - DNA, 20 bp, Artificial
  CRISPR gRNA sequence
agctggatgtgacttccctt

SEQ ID NO: 484087 - DNA, 20 bp, Artificial
  CRISPR gRNA sequence
gtgacttcccttaagccaat

SEQ ID NO: 484088 - DNA, 20 bp, Artificial
  CRISPR gRNA sequence
tgacttcccttaagccaatt

SEQ ID NO: 484089 - DNA, 20 bp, Artificial
  CRISPR gRNA sequence
cttcccttaagccaattggg

SEQ ID NO: 484090 - DNA, 20 bp, Artificial
  CRISPR gRNA sequence
ttcccttaagccaattgggt

SEQ ID NO: 484091 - DNA, 20 bp, Artificial
  CRISPR gRNA sequence
tcccttaagccaattgggtg

SEQ ID NO: 484092 - DNA, 20 bp, Artificial
  CRISPR gRNA sequence
taagccaattgggtggggat

SEQ ID NO: 484093 - DNA, 20 bp, Artificial
  CRISPR gRNA sequence
aattgggtggggatgagtat

SEQ ID NO: 484094 - DNA, 20 bp, Artificial
  CRISPR gRNA sequence
attgggtggggatgagtatg

SEQ ID NO: 484095 - DNA, 20 bp, Artificial
  CRISPR gRNA sequence
tgggtggggatgagtatgag

SEQ ID NO: 484096 - DNA, 20 bp, Artificial
  CRISPR gRNA sequence
ggggatgagtatgaggagcc

SEQ ID NO: 484097 - DNA, 20 bp, Artificial
  CRISPR gRNA sequence
agtatgaggagcccagaacc

SEQ ID NO: 484098 - DNA, 20 bp, Artificial
  CRISPR gRNA sequence
gtatgaggagcccagaacct

SEQ ID NO: 484099 - DNA, 20 bp, Artificial
  CRISPR gRNA sequence
atgaggagcccagaacctag

SEQ ID NO: 484100 - DNA, 20 bp, Artificial
  CRISPR gRNA sequence
cagaacctaggagcacctta

SEQ ID NO: 484101 - DNA, 20 bp, Artificial
  CRISPR gRNA sequence
atctgcctccccttgtcccc

SEQ ID NO: 484102 - DNA, 20 bp, Artificial
  CRISPR gRNA sequence
gtccccaagctctgtgtccc

SEQ ID NO: 484103 - DNA, 20 bp, Artificial
  CRISPR gRNA sequence
aagctctgtgtccctagtct

SEQ ID NO: 484104 - DNA, 20 bp, Artificial
  CRISPR gRNA sequence
agctctgtgtccctagtctg

SEQ ID NO: 484105 - DNA, 20 bp, Artificial
  CRISPR gRNA sequence
gctctgtgtccctagtctga

SEQ ID NO: 484106 - DNA, 20 bp, Artificial
  CRISPR gRNA sequence
ccctagtctgagggatccca

SEQ ID NO: 484107 - DNA, 20 bp, Artificial
  CRISPR gRNA sequence
tgagggatcccatagaccaa

SEQ ID NO: 484108 - DNA, 20 bp, Artificial
  CRISPR gRNA sequence
agaccaatagctaaaatctt

SEQ ID NO: 484109 - DNA, 20 bp, Artificial
  CRISPR gRNA sequence
cttgagtacttactatgtga

SEQ ID NO: 484110 - DNA, 20 bp, Artificial
  CRISPR gRNA sequence
ttgagtacttactatgtgac

SEQ ID NO: 484111 - DNA, 20 bp, Artificial
  CRISPR gRNA sequence
agtacttactatgtgacagg

SEQ ID NO: 484112 - DNA, 20 bp, Artificial
  CRISPR gRNA sequence
gtacttactatgtgacaggc

SEQ ID NO: 484113 - DNA, 20 bp, Artificial
  CRISPR gRNA sequence
tttatacattttaactattt

SEQ ID NO: 484114 - DNA, 20 bp, Artificial
  CRISPR gRNA sequence
attttaactatttaagttaa

SEQ ID NO: 484115 - DNA, 20 bp, Artificial
  CRISPR gRNA sequence
ttttaactatttaagttaaa

SEQ ID NO: 484116 - DNA, 20 bp, Artificial
  CRISPR gRNA sequence
tttaagttaaaaggtatgat

SEQ ID NO: 484117 - DNA, 20 bp, Artificial
  CRISPR gRNA sequence
taaaaggtatgatgagttaa

SEQ ID NO: 484118 - DNA, 20 bp, Artificial
  CRISPR gRNA sequence
tgatgagttaaaagaatgat

SEQ ID NO: 484119 - DNA, 20 bp, Artificial
  CRISPR gRNA sequence
agaatgatgagcctgaaacc

SEQ ID NO: 484120 - DNA, 20 bp, Artificial
  CRISPR gRNA sequence
tgatgagcctgaaacctagt

SEQ ID NO: 484121 - DNA, 20 bp, Artificial
  CRISPR gRNA sequence
agcctgaaacctagtcagtt

SEQ ID NO: 484122 - DNA, 20 bp, Artificial
  CRISPR gRNA sequence
ttttcttttgttttgttttc

SEQ ID NO: 484123 - DNA, 20 bp, Artificial
  CRISPR gRNA sequence
ttcttttgttttgttttcta

SEQ ID NO: 484124 - DNA, 20 bp, Artificial
  CRISPR gRNA sequence
tttgttttgttttctagaga

SEQ ID NO: 484125 - DNA, 20 bp, Artificial
  CRISPR gRNA sequence
ttgttttgttttctagagac

SEQ ID NO: 484126 - DNA, 20 bp, Artificial
  CRISPR gRNA sequence
tgttttgttttctagagaca

SEQ ID NO: 484127 - DNA, 20 bp, Artificial
  CRISPR gRNA sequence
cagggtctcactctgtcacc

SEQ ID NO: 484128 - DNA, 20 bp, Artificial
  CRISPR gRNA sequence
agggtctcactctgtcaccc

SEQ ID NO: 484129 - DNA, 20 bp, Artificial
  CRISPR gRNA sequence
tctcactctgtcacccaggc

SEQ ID NO: 484130 - DNA, 20 bp, Artificial
  CRISPR gRNA sequence
tcactctgtcacccaggctg

SEQ ID NO: 484131 - DNA, 20 bp, Artificial
  CRISPR gRNA sequence
ctgtcacccaggctggagtg

SEQ ID NO: 484132 - DNA, 20 bp, Artificial
  CRISPR gRNA sequence
tcacccaggctggagtgcag

SEQ ID NO: 484133 - DNA, 20 bp, Artificial
  CRISPR gRNA sequence
ggagtgcagtggcgcaatca

SEQ ID NO: 484134 - DNA, 20 bp, Artificial
  CRISPR gRNA sequence
ggcgcaatcacagctcactg

SEQ ID NO: 484135 - DNA, 20 bp, Artificial
  CRISPR gRNA sequence
tcactgcagccttgaactcc

SEQ ID NO: 484136 - DNA, 20 bp, Artificial
  CRISPR gRNA sequence
cactgcagccttgaactcct

SEQ ID NO: 484137 - DNA, 20 bp, Artificial
  CRISPR gRNA sequence
agccttgaactcctgggctt

SEQ ID NO: 484138 - DNA, 20 bp, Artificial
  CRISPR gRNA sequence
gccttgaactcctgggcttg

SEQ ID NO: 484139 - DNA, 20 bp, Artificial
  CRISPR gRNA sequence
tcctcccatctcaacctccc

SEQ ID NO: 484140 - DNA, 20 bp, Artificial
  CRISPR gRNA sequence
tcccatctcaacctccctag

SEQ ID NO: 484141 - DNA, 20 bp, Artificial
  CRISPR gRNA sequence
atctcaacctccctagtagc

SEQ ID NO: 484142 - DNA, 20 bp, Artificial
  CRISPR gRNA sequence
tctcaacctccctagtagct

SEQ ID NO: 484143 - DNA, 20 bp, Artificial
  CRISPR gRNA sequence
tcaacctccctagtagctgg

SEQ ID NO: 484144 - DNA, 20 bp, Artificial
  CRISPR gRNA sequence
ctccctagtagctgggagca

SEQ ID NO: 484145 - DNA, 20 bp, Artificial
  CRISPR gRNA sequence
tccctagtagctgggagcac

SEQ ID NO: 484146 - DNA, 20 bp, Artificial
  CRISPR gRNA sequence
gtagctgggagcacaggtgc

SEQ ID NO: 484147 - DNA, 20 bp, Artificial
  CRISPR gRNA sequence
tagctgggagcacaggtgct

SEQ ID NO: 484148 - DNA, 20 bp, Artificial
  CRISPR gRNA sequence
agctgggagcacaggtgcta

SEQ ID NO: 484149 - DNA, 20 bp, Artificial
  CRISPR gRNA sequence
ctgggagcacaggtgctagg

SEQ ID NO: 484150 - DNA, 20 bp, Artificial
  CRISPR gRNA sequence
ttatttgtttactctttgta

SEQ ID NO: 484151 - DNA, 20 bp, Artificial
  CRISPR gRNA sequence
ttgtttactctttgtaaaga

SEQ ID NO: 484152 - DNA, 20 bp, Artificial
  CRISPR gRNA sequence
tttactctttgtaaagacag

SEQ ID NO: 484153 - DNA, 20 bp, Artificial
  CRISPR gRNA sequence
tctttgtaaagacagcagtt

SEQ ID NO: 484154 - DNA, 20 bp, Artificial
  CRISPR gRNA sequence
taaagacagcagtttggctt

SEQ ID NO: 484155 - DNA, 20 bp, Artificial
  CRISPR gRNA sequence
aagacagcagtttggcttga

SEQ ID NO: 484156 - DNA, 20 bp, Artificial
  CRISPR gRNA sequence
agacagcagtttggcttgag

SEQ ID NO: 484157 - DNA, 20 bp, Artificial
  CRISPR gRNA sequence
atgctataaataccacatct

SEQ ID NO: 484158 - DNA, 20 bp, Artificial
  CRISPR gRNA sequence
tgctataaataccacatcta

SEQ ID NO: 484159 - DNA, 20 bp, Artificial
  CRISPR gRNA sequence
catctaaggtgactccctcc

SEQ ID NO: 484160 - DNA, 20 bp, Artificial
  CRISPR gRNA sequence
ctaaggtgactccctccaag

SEQ ID NO: 484161 - DNA, 20 bp, Artificial
  CRISPR gRNA sequence
gactccctccaagcagtgct

SEQ ID NO: 484162 - DNA, 20 bp, Artificial
  CRISPR gRNA sequence
actccctccaagcagtgctg

SEQ ID NO: 484163 - DNA, 20 bp, Artificial
  CRISPR gRNA sequence
agtgctgaggcaactactaa

SEQ ID NO: 484164 - DNA, 20 bp, Artificial
  CRISPR gRNA sequence
ctgaggcaactactaatggc

SEQ ID NO: 484165 - DNA, 20 bp, Artificial
  CRISPR gRNA sequence
aggcaactactaatggcaag

SEQ ID NO: 484166 - DNA, 20 bp, Artificial
  CRISPR gRNA sequence
taatggcaagtagtgactgt

SEQ ID NO: 484167 - DNA, 20 bp, Artificial
  CRISPR gRNA sequence
tgactgttggaaattctgaa

SEQ ID NO: 484168 - DNA, 20 bp, Artificial
  CRISPR gRNA sequence
tgttggaaattctgaatggt

SEQ ID NO: 484169 - DNA, 20 bp, Artificial
  CRISPR gRNA sequence
gttggaaattctgaatggtc

SEQ ID NO: 484170 - DNA, 20 bp, Artificial
  CRISPR gRNA sequence
aaattctgaatggtcaggcc

SEQ ID NO: 484171 - DNA, 20 bp, Artificial
  CRISPR gRNA sequence
aattctgaatggtcaggccc

SEQ ID NO: 484172 - DNA, 20 bp, Artificial
  CRISPR gRNA sequence
tctgaatggtcaggcccagg

SEQ ID NO: 484173 - DNA, 20 bp, Artificial
  CRISPR gRNA sequence
cccaggaagactaaccgtcc

SEQ ID NO: 484174 - DNA, 20 bp, Artificial
  CRISPR gRNA sequence
aaccgtccaagctgaactca

SEQ ID NO: 484175 - DNA, 20 bp, Artificial
  CRISPR gRNA sequence
gcccctcaaccatcctctca

SEQ ID NO: 484176 - DNA, 20 bp, Artificial
  CRISPR gRNA sequence
ccctcaaccatcctctcaca

SEQ ID NO: 484177 - DNA, 20 bp, Artificial
  CRISPR gRNA sequence
gaatacataatcctctctcg

SEQ ID NO: 484178 - DNA, 20 bp, Artificial
  CRISPR gRNA sequence
taatcctctctcgtggcact

SEQ ID NO: 484179 - DNA, 20 bp, Artificial
  CRISPR gRNA sequence
tctcgtggcacttggttcat

SEQ ID NO: 484180 - DNA, 20 bp, Artificial
  CRISPR gRNA sequence
gcacttggttcattggattt

SEQ ID NO: 484181 - DNA, 20 bp, Artificial
  CRISPR gRNA sequence
cattacttattgatgtttgc

SEQ ID NO: 484182 - DNA, 20 bp, Artificial
  CRISPR gRNA sequence
attgatgtttgccagttttt

SEQ ID NO: 484183 - DNA, 20 bp, Artificial
  CRISPR gRNA sequence
tttgccagtttttcagtgat

SEQ ID NO: 484184 - DNA, 20 bp, Artificial
  CRISPR gRNA sequence
ccagtttttcagtgatcaga

SEQ ID NO: 484185 - DNA, 20 bp, Artificial
  CRISPR gRNA sequence
tctccacaaaaatttctccc

SEQ ID NO: 484186 - DNA, 20 bp, Artificial
  CRISPR gRNA sequence
aaaaataaaactacacttcc

SEQ ID NO: 484187 - DNA, 20 bp, Artificial
  CRISPR gRNA sequence
aaaataaaactacacttccc

SEQ ID NO: 484188 - DNA, 20 bp, Artificial
  CRISPR gRNA sequence
ataaaactacacttcccagg

SEQ ID NO: 484189 - DNA, 20 bp, Artificial
  CRISPR gRNA sequence
tacacttcccaggcagatcc

SEQ ID NO: 484190 - DNA, 20 bp, Artificial
  CRISPR gRNA sequence
atcccagcacttgcctctca

SEQ ID NO: 484191 - DNA, 20 bp, Artificial
  CRISPR gRNA sequence
cacttgcctctcaaagaatc

SEQ ID NO: 484192 - DNA, 20 bp, Artificial
  CRISPR gRNA sequence
aagatgaaacctaatgaata

SEQ ID NO: 484193 - DNA, 20 bp, Artificial
  CRISPR gRNA sequence
agatgaaacctaatgaatat

SEQ ID NO: 484194 - DNA, 20 bp, Artificial
  CRISPR gRNA sequence
gatgaaacctaatgaatatg

SEQ ID NO: 484195 - DNA, 20 bp, Artificial
  CRISPR gRNA sequence
atgaaacctaatgaatatgg

SEQ ID NO: 484196 - DNA, 20 bp, Artificial
  CRISPR gRNA sequence
aatatgggggtgtgacaacc

SEQ ID NO: 484197 - DNA, 20 bp, Artificial
  CRISPR gRNA sequence
tatgggggtgtgacaaccta

SEQ ID NO: 484198 - DNA, 20 bp, Artificial
  CRISPR gRNA sequence
caacctagagcaattctgtg

SEQ ID NO: 484199 - DNA, 20 bp, Artificial
  CRISPR gRNA sequence
ctagagcaattctgtgcagt

SEQ ID NO: 484200 - DNA, 20 bp, Artificial
  CRISPR gRNA sequence
gtgcagtcagtgtacaaaac

SEQ ID NO: 484201 - DNA, 20 bp, Artificial
  CRISPR gRNA sequence
cagtcagtgtacaaaactgg

SEQ ID NO: 484202 - DNA, 20 bp, Artificial
  CRISPR gRNA sequence
tacaaaactggaagttccta

SEQ ID NO: 484203 - DNA, 20 bp, Artificial
  CRISPR gRNA sequence
gaagttcctacagccatttt

SEQ ID NO: 484204 - DNA, 20 bp, Artificial
  CRISPR gRNA sequence
tacagccatttttagtaata

SEQ ID NO: 484205 - DNA, 20 bp, Artificial
  CRISPR gRNA sequence
tttttagtaataaagctatg

SEQ ID NO: 484206 - DNA, 20 bp, Artificial
  CRISPR gRNA sequence
agtaataaagctatgtggca

SEQ ID NO: 484207 - DNA, 20 bp, Artificial
  CRISPR gRNA sequence
taaagctatgtggcatggcc

SEQ ID NO: 484208 - DNA, 20 bp, Artificial
  CRISPR gRNA sequence
agctatgtggcatggcccag

SEQ ID NO: 484209 - DNA, 20 bp, Artificial
  CRISPR gRNA sequence
gctatgtggcatggcccagc

SEQ ID NO: 484210 - DNA, 20 bp, Artificial
  CRISPR gRNA sequence
gtggcatggcccagcaggtg

SEQ ID NO: 484211 - DNA, 20 bp, Artificial
  CRISPR gRNA sequence
tggcatggcccagcaggtgc

SEQ ID NO: 484212 - DNA, 20 bp, Artificial
  CRISPR gRNA sequence
agcaggtgcaggaaattaaa

SEQ ID NO: 484213 - DNA, 20 bp, Artificial
  CRISPR gRNA sequence
aggaaattaaaaagtctctc

SEQ ID NO: 484214 - DNA, 20 bp, Artificial
  CRISPR gRNA sequence
ggaaattaaaaagtctctct

SEQ ID NO: 484215 - DNA, 20 bp, Artificial
  CRISPR gRNA sequence
attaaaaagtctctctgggt

SEQ ID NO: 484216 - DNA, 20 bp, Artificial
  CRISPR gRNA sequence
aaaagtctctctgggtgagt

SEQ ID NO: 484217 - DNA, 20 bp, Artificial
  CRISPR gRNA sequence
aaagtctctctgggtgagtt

SEQ ID NO: 484218 - DNA, 20 bp, Artificial
  CRISPR gRNA sequence
aagtctctctgggtgagttg

SEQ ID NO: 484219 - DNA, 20 bp, Artificial
  CRISPR gRNA sequence
gtctctctgggtgagttggg

SEQ ID NO: 484220 - DNA, 20 bp, Artificial
  CRISPR gRNA sequence
tctctctgggtgagttgggg

SEQ ID NO: 484221 - DNA, 20 bp, Artificial
  CRISPR gRNA sequence
ctgggtgagttggggaggct

SEQ ID NO: 484222 - DNA, 20 bp, Artificial
  CRISPR gRNA sequence
tgggtgagttggggaggctc

SEQ ID NO: 484223 - DNA, 20 bp, Artificial
  CRISPR gRNA sequence
gggtgagttggggaggctca

SEQ ID NO: 484224 - DNA, 20 bp, Artificial
  CRISPR gRNA sequence
gtgagttggggaggctcagg

SEQ ID NO: 484225 - DNA, 20 bp, Artificial
  CRISPR gRNA sequence
tgagttggggaggctcaggg

SEQ ID NO: 484226 - DNA, 20 bp, Artificial
  CRISPR gRNA sequence
ggggaggctcagggaggatt

SEQ ID NO: 484227 - DNA, 20 bp, Artificial
  CRISPR gRNA sequence
gaggctcagggaggatttgg

SEQ ID NO: 484228 - DNA, 20 bp, Artificial
  CRISPR gRNA sequence
ggctcagggaggatttggaa

SEQ ID NO: 484229 - DNA, 20 bp, Artificial
  CRISPR gRNA sequence
gaggatttggaagagaaaat

SEQ ID NO: 484230 - DNA, 20 bp, Artificial
  CRISPR gRNA sequence
ggatttggaagagaaaataa

SEQ ID NO: 484231 - DNA, 20 bp, Artificial
  CRISPR gRNA sequence
ttggaagagaaaataagaga

SEQ ID NO: 484232 - DNA, 20 bp, Artificial
  CRISPR gRNA sequence
tggaagagaaaataagagat

SEQ ID NO: 484233 - DNA, 20 bp, Artificial
  CRISPR gRNA sequence
ggaagagaaaataagagatg

SEQ ID NO: 484234 - DNA, 20 bp, Artificial
  CRISPR gRNA sequence
aagagaaaataagagatggg

SEQ ID NO: 484235 - DNA, 20 bp, Artificial
  CRISPR gRNA sequence
gagaaaataagagatgggga

SEQ ID NO: 484236 - DNA, 20 bp, Artificial
  CRISPR gRNA sequence
agagatggggagagttttac

SEQ ID NO: 484237 - DNA, 20 bp, Artificial
  CRISPR gRNA sequence
gatggggagagttttacaag

SEQ ID NO: 484238 - DNA, 20 bp, Artificial
  CRISPR gRNA sequence
tacaagtggctccgttaaaa

SEQ ID NO: 484239 - DNA, 20 bp, Artificial
  CRISPR gRNA sequence
caagtggctccgttaaaatg

SEQ ID NO: 484240 - DNA, 20 bp, Artificial
  CRISPR gRNA sequence
aagtggctccgttaaaatgg

SEQ ID NO: 484241 - DNA, 20 bp, Artificial
  CRISPR gRNA sequence
ccgttaaaatggaggctatt

SEQ ID NO: 484242 - DNA, 20 bp, Artificial
  CRISPR gRNA sequence
ttaaaatggaggctattaag

SEQ ID NO: 484243 - DNA, 20 bp, Artificial
  CRISPR gRNA sequence
aaaatggaggctattaagaa

SEQ ID NO: 484244 - DNA, 20 bp, Artificial
  CRISPR gRNA sequence
aatggaggctattaagaaga

SEQ ID NO: 484245 - DNA, 20 bp, Artificial
  CRISPR gRNA sequence
ctattaagaagagagcaatt

SEQ ID NO: 484246 - DNA, 20 bp, Artificial
  CRISPR gRNA sequence
taagaagagagcaattgaga

SEQ ID NO: 484247 - DNA, 20 bp, Artificial
  CRISPR gRNA sequence
agaagagagcaattgagaca

SEQ ID NO: 484248 - DNA, 20 bp, Artificial
  CRISPR gRNA sequence
gaagagagcaattgagacag

SEQ ID NO: 484249 - DNA, 20 bp, Artificial
  CRISPR gRNA sequence
aagagagcaattgagacaga

SEQ ID NO: 484250 - DNA, 20 bp, Artificial
  CRISPR gRNA sequence
agagagcaattgagacagag

SEQ ID NO: 484251 - DNA, 20 bp, Artificial
  CRISPR gRNA sequence
cagaggggtttttatatgtc

SEQ ID NO: 484252 - DNA, 20 bp, Artificial
  CRISPR gRNA sequence
tgtccagtgcattatgaatg

SEQ ID NO: 484253 - DNA, 20 bp, Artificial
  CRISPR gRNA sequence
attatgaatgcagtctctcc

SEQ ID NO: 484254 - DNA, 20 bp, Artificial
  CRISPR gRNA sequence
aatgcagtctctccaagcca

SEQ ID NO: 484255 - DNA, 20 bp, Artificial
  CRISPR gRNA sequence
tccaagccacagcttcaccc

SEQ ID NO: 484256 - DNA, 20 bp, Artificial
  CRISPR gRNA sequence
cttcaccctggcattttctc

SEQ ID NO: 484257 - DNA, 20 bp, Artificial
  CRISPR gRNA sequence
tcaccctggcattttctcaa

SEQ ID NO: 484258 - DNA, 20 bp, Artificial
  CRISPR gRNA sequence
tggcattttctcaagagact

SEQ ID NO: 484259 - DNA, 20 bp, Artificial
  CRISPR gRNA sequence
agagactaagtaaataatta

SEQ ID NO: 484260 - DNA, 20 bp, Artificial
  CRISPR gRNA sequence
gagactaagtaaataattaa

SEQ ID NO: 484261 - DNA, 20 bp, Artificial
  CRISPR gRNA sequence
tctttgatcttgatgctcct

SEQ ID NO: 484262 - DNA, 20 bp, Artificial
  CRISPR gRNA sequence
gctcctaagactaaaacaca

SEQ ID NO: 484263 - DNA, 20 bp, Artificial
  CRISPR gRNA sequence
ctcctaagactaaaacacat

SEQ ID NO: 484264 - DNA, 20 bp, Artificial
  CRISPR gRNA sequence
tatatttatatgacttgtac

SEQ ID NO: 484265 - DNA, 20 bp, Artificial
  CRISPR gRNA sequence
cttgtactggctctgcccat

SEQ ID NO: 484266 - DNA, 20 bp, Artificial
  CRISPR gRNA sequence
tctgcccattagcaaaccaa

SEQ ID NO: 484267 - DNA, 20 bp, Artificial
  CRISPR gRNA sequence
gcaaaccaaaagcttctcaa

SEQ ID NO: 484268 - DNA, 20 bp, Artificial
  CRISPR gRNA sequence
aaccaaaagcttctcaaaag

SEQ ID NO: 484269 - DNA, 20 bp, Artificial
  CRISPR gRNA sequence
ccaaaagcttctcaaaagca

SEQ ID NO: 484270 - DNA, 20 bp, Artificial
  CRISPR gRNA sequence
gtctctgtctcctacgatcc

SEQ ID NO: 484271 - DNA, 20 bp, Artificial
  CRISPR gRNA sequence
acgatcctagcactatttat

SEQ ID NO: 484272 - DNA, 20 bp, Artificial
  CRISPR gRNA sequence
ctagcactatttataagaac

SEQ ID NO: 484273 - DNA, 20 bp, Artificial
  CRISPR gRNA sequence
aacctaccaaatattgcaca

SEQ ID NO: 484274 - DNA, 20 bp, Artificial
  CRISPR gRNA sequence
aaatattgcacaaagaccct

SEQ ID NO: 484275 - DNA, 20 bp, Artificial
  CRISPR gRNA sequence
gcacaaagaccctgagaaca

SEQ ID NO: 484276 - DNA, 20 bp, Artificial
  CRISPR gRNA sequence
cacaaagaccctgagaacaa

SEQ ID NO: 484277 - DNA, 20 bp, Artificial
  CRISPR gRNA sequence
accctgagaacaaaggtgaa

SEQ ID NO: 484278 - DNA, 20 bp, Artificial
  CRISPR gRNA sequence
aaaatcattactaaacctac

SEQ ID NO: 484279 - DNA, 20 bp, Artificial
  CRISPR gRNA sequence
aaatcattactaaacctaca

SEQ ID NO: 484280 - DNA, 20 bp, Artificial
  CRISPR gRNA sequence
atcattactaaacctacaag

SEQ ID NO: 484281 - DNA, 20 bp, Artificial
  CRISPR gRNA sequence
tcattactaaacctacaagg

SEQ ID NO: 484282 - DNA, 20 bp, Artificial
  CRISPR gRNA sequence
tactgtcttcatcaattatt

SEQ ID NO: 484283 - DNA, 20 bp, Artificial
  CRISPR gRNA sequence
tcaattattcagtccttact

SEQ ID NO: 484284 - DNA, 20 bp, Artificial
  CRISPR gRNA sequence
tactgagtcccactgcaatc

SEQ ID NO: 484285 - DNA, 20 bp, Artificial
  CRISPR gRNA sequence
ccactgcaatccagcccctg

SEQ ID NO: 484286 - DNA, 20 bp, Artificial
  CRISPR gRNA sequence
actgcaatccagcccctgaa

SEQ ID NO: 484287 - DNA, 20 bp, Artificial
  CRISPR gRNA sequence
ctgcaatccagcccctgaag

SEQ ID NO: 484288 - DNA, 20 bp, Artificial
  CRISPR gRNA sequence
caatccagcccctgaagagg

SEQ ID NO: 484289 - DNA, 20 bp, Artificial
  CRISPR gRNA sequence
aatccagcccctgaagaggc

SEQ ID NO: 484290 - DNA, 20 bp, Artificial
  CRISPR gRNA sequence
atccagcccctgaagaggca

SEQ ID NO: 484291 - DNA, 20 bp, Artificial
  CRISPR gRNA sequence
ggcagggcctcttcatgtat

SEQ ID NO: 484292 - DNA, 20 bp, Artificial
  CRISPR gRNA sequence
gcagggcctcttcatgtata

SEQ ID NO: 484293 - DNA, 20 bp, Artificial
  CRISPR gRNA sequence
taaggcatgattcctgactc

SEQ ID NO: 484294 - DNA, 20 bp, Artificial
  CRISPR gRNA sequence
aggcatgattcctgactcca

SEQ ID NO: 484295 - DNA, 20 bp, Artificial
  CRISPR gRNA sequence
gcatgattcctgactccaga

SEQ ID NO: 484296 - DNA, 20 bp, Artificial
  CRISPR gRNA sequence
actccagagagtttgtgatc

SEQ ID NO: 484297 - DNA, 20 bp, Artificial
  CRISPR gRNA sequence
gagagtttgtgatctggaaa

SEQ ID NO: 484298 - DNA, 20 bp, Artificial
  CRISPR gRNA sequence
aacagaacactttcattcta

SEQ ID NO: 484299 - DNA, 20 bp, Artificial
  CRISPR gRNA sequence
acagcatccccttaattgtt

SEQ ID NO: 484300 - DNA, 20 bp, Artificial
  CRISPR gRNA sequence
gttgagataaaaaatcatcg

SEQ ID NO: 484301 - DNA, 20 bp, Artificial
  CRISPR gRNA sequence
ttgagataaaaaatcatcga

SEQ ID NO: 484302 - DNA, 20 bp, Artificial
  CRISPR gRNA sequence
ctaattatgtaatgaaaatc

SEQ ID NO: 484303 - DNA, 20 bp, Artificial
  CRISPR gRNA sequence
taattatgtaatgaaaatcc

SEQ ID NO: 484304 - DNA, 20 bp, Artificial
  CRISPR gRNA sequence
atgtaatgaaaatccaggtt

SEQ ID NO: 484305 - DNA, 20 bp, Artificial
  CRISPR gRNA sequence
accaatcctcccactaaaaa

SEQ ID NO: 484306 - DNA, 20 bp, Artificial
  CRISPR gRNA sequence
atcctcccactaaaaatagc

SEQ ID NO: 484307 - DNA, 20 bp, Artificial
  CRISPR gRNA sequence
ctcccactaaaaatagctag

SEQ ID NO: 484308 - DNA, 20 bp, Artificial
  CRISPR gRNA sequence
gaaaaatgaacaacatgtaa

SEQ ID NO: 484309 - DNA, 20 bp, Artificial
  CRISPR gRNA sequence
catgtaaaagcacattgtta

SEQ ID NO: 484310 - DNA, 20 bp, Artificial
  CRISPR gRNA sequence
aagcacattgttaaagttat

SEQ ID NO: 484311 - DNA, 20 bp, Artificial
  CRISPR gRNA sequence
gcacattgttaaagttatca

SEQ ID NO: 484312 - DNA, 20 bp, Artificial
  CRISPR gRNA sequence
acattgttaaagttatcaga

SEQ ID NO: 484313 - DNA, 20 bp, Artificial
  CRISPR gRNA sequence
aagttatcagagagtttata

SEQ ID NO: 484314 - DNA, 20 bp, Artificial
  CRISPR gRNA sequence
ttatcagagagtttataaag

SEQ ID NO: 484315 - DNA, 20 bp, Artificial
  CRISPR gRNA sequence
tataaagcagtgaaaaatta

SEQ ID NO: 484316 - DNA, 20 bp, Artificial
  CRISPR gRNA sequence
ataaagcagtgaaaaattat

SEQ ID NO: 484317 - DNA, 20 bp, Artificial
  CRISPR gRNA sequence
taaagcagtgaaaaattatg

SEQ ID NO: 484318 - DNA, 20 bp, Artificial
  CRISPR gRNA sequence
aaaattatggggccaatatc

SEQ ID NO: 484319 - DNA, 20 bp, Artificial
  CRISPR gRNA sequence
attatggggccaatatctgg

SEQ ID NO: 484320 - DNA, 20 bp, Artificial
  CRISPR gRNA sequence
atggggccaatatctggaag

SEQ ID NO: 484321 - DNA, 20 bp, Artificial
  CRISPR gRNA sequence
tggggccaatatctggaaga

SEQ ID NO: 484322 - DNA, 20 bp, Artificial
  CRISPR gRNA sequence
atatctggaagaaggaaatt

SEQ ID NO: 484323 - DNA, 20 bp, Artificial
  CRISPR gRNA sequence
atctggaagaaggaaattca

SEQ ID NO: 484324 - DNA, 20 bp, Artificial
  CRISPR gRNA sequence
ctggaagaaggaaattcaga

SEQ ID NO: 484325 - DNA, 20 bp, Artificial
  CRISPR gRNA sequence
tggaagaaggaaattcagag

SEQ ID NO: 484326 - DNA, 20 bp, Artificial
  CRISPR gRNA sequence
agaaggaaattcagagaggt

SEQ ID NO: 484327 - DNA, 20 bp, Artificial
  CRISPR gRNA sequence
gaaattcagagaggtgagat

SEQ ID NO: 484328 - DNA, 20 bp, Artificial
  CRISPR gRNA sequence
catttctgactgttgttccc

SEQ ID NO: 484329 - DNA, 20 bp, Artificial
  CRISPR gRNA sequence
tttctgactgttgttccctg

SEQ ID NO: 484330 - DNA, 20 bp, Artificial
  CRISPR gRNA sequence
ttctgactgttgttccctgg

SEQ ID NO: 484331 - DNA, 20 bp, Artificial
  CRISPR gRNA sequence
gcatcttctgattccataaa

SEQ ID NO: 484332 - DNA, 20 bp, Artificial
  CRISPR gRNA sequence
tcttctgattccataaatgg

SEQ ID NO: 484333 - DNA, 20 bp, Artificial
  CRISPR gRNA sequence
attccataaatggcagctaa

SEQ ID NO: 484334 - DNA, 20 bp, Artificial
  CRISPR gRNA sequence
ttccataaatggcagctaaa

SEQ ID NO: 484335 - DNA, 20 bp, Artificial
  CRISPR gRNA sequence
taaatggcagctaaaaggct

SEQ ID NO: 484336 - DNA, 20 bp, Artificial
  CRISPR gRNA sequence
atggcagctaaaaggctgag

SEQ ID NO: 484337 - DNA, 20 bp, Artificial
  CRISPR gRNA sequence
agctaaaaggctgagaagct

SEQ ID NO: 484338 - DNA, 20 bp, Artificial
  CRISPR gRNA sequence
taaaaggctgagaagctgag

SEQ ID NO: 484339 - DNA, 20 bp, Artificial
  CRISPR gRNA sequence
aaaggctgagaagctgagca

SEQ ID NO: 484340 - DNA, 20 bp, Artificial
  CRISPR gRNA sequence
cagagctcacaataaaactc

SEQ ID NO: 484341 - DNA, 20 bp, Artificial
  CRISPR gRNA sequence
agagctcacaataaaactca

SEQ ID NO: 484342 - DNA, 20 bp, Artificial
  CRISPR gRNA sequence
acaataaaactcaaggaact

SEQ ID NO: 484343 - DNA, 20 bp, Artificial
  CRISPR gRNA sequence
aataaaactcaaggaactaa

SEQ ID NO: 484344 - DNA, 20 bp, Artificial
  CRISPR gRNA sequence
caaggaactaagagaacatg

SEQ ID NO: 484345 - DNA, 20 bp, Artificial
  CRISPR gRNA sequence
gaagttcacgtccctcctat

SEQ ID NO: 484346 - DNA, 20 bp, Artificial
  CRISPR gRNA sequence
ttcacgtccctcctattaga

SEQ ID NO: 484347 - DNA, 20 bp, Artificial
  CRISPR gRNA sequence
acgtccctcctattagaaag

SEQ ID NO: 484348 - DNA, 20 bp, Artificial
  CRISPR gRNA sequence
cgtccctcctattagaaagc

SEQ ID NO: 484349 - DNA, 20 bp, Artificial
  CRISPR gRNA sequence
cgggtatacataaaatccat

SEQ ID NO: 484350 - DNA, 20 bp, Artificial
  CRISPR gRNA sequence
acataaaatccatcagtgtt

SEQ ID NO: 484351 - DNA, 20 bp, Artificial
  CRISPR gRNA sequence
cataaaatccatcagtgttg

SEQ ID NO: 484352 - DNA, 20 bp, Artificial
  CRISPR gRNA sequence
aaatccatcagtgttgaggt

SEQ ID NO: 484353 - DNA, 20 bp, Artificial
  CRISPR gRNA sequence
cagtgttgaggttggtacca

SEQ ID NO: 484354 - DNA, 20 bp, Artificial
  CRISPR gRNA sequence
gtgttgaggttggtaccaca

SEQ ID NO: 484355 - DNA, 20 bp, Artificial
  CRISPR gRNA sequence
tgttgaggttggtaccacag

SEQ ID NO: 484356 - DNA, 20 bp, Artificial
  CRISPR gRNA sequence
gttgaggttggtaccacaga

SEQ ID NO: 484357 - DNA, 20 bp, Artificial
  CRISPR gRNA sequence
accacagagggctataccca

SEQ ID NO: 484358 - DNA, 20 bp, Artificial
  CRISPR gRNA sequence
cacagagggctatacccaaa

SEQ ID NO: 484359 - DNA, 20 bp, Artificial
  CRISPR gRNA sequence
gagggctatacccaaagagt

SEQ ID NO: 484360 - DNA, 20 bp, Artificial
  CRISPR gRNA sequence
gggctatacccaaagagtaa

SEQ ID NO: 484361 - DNA, 20 bp, Artificial
  CRISPR gRNA sequence
cccaaagagtaagagtgaac

SEQ ID NO: 484362 - DNA, 20 bp, Artificial
  CRISPR gRNA sequence
aagagtgaacgagaaatgaa

SEQ ID NO: 484363 - DNA, 20 bp, Artificial
  CRISPR gRNA sequence
cgagaaatgaacagccctca

SEQ ID NO: 484364 - DNA, 20 bp, Artificial
  CRISPR gRNA sequence
gagaaatgaacagccctcac

SEQ ID NO: 484365 - DNA, 20 bp, Artificial
  CRISPR gRNA sequence
aacagccctcacaggaactg

SEQ ID NO: 484366 - DNA, 20 bp, Artificial
  CRISPR gRNA sequence
attttgaatcatcacaaccc

SEQ ID NO: 484367 - DNA, 20 bp, Artificial
  CRISPR gRNA sequence
cctggattgaactaatgatc

SEQ ID NO: 484368 - DNA, 20 bp, Artificial
  CRISPR gRNA sequence
aactaatgatctggaatctc

SEQ ID NO: 484369 - DNA, 20 bp, Artificial
  CRISPR gRNA sequence
taatgatctggaatctctgg

SEQ ID NO: 484370 - DNA, 20 bp, Artificial
  CRISPR gRNA sequence
aatctctggtagccctaacc

SEQ ID NO: 484371 - DNA, 20 bp, Artificial
  CRISPR gRNA sequence
gccctaacctggctgccaac

SEQ ID NO: 484372 - DNA, 20 bp, Artificial
  CRISPR gRNA sequence
cctaacctggctgccaacta

SEQ ID NO: 484373 - DNA, 20 bp, Artificial
  CRISPR gRNA sequence
ctaacctggctgccaactag

SEQ ID NO: 484374 - DNA, 20 bp, Artificial
  CRISPR gRNA sequence
tgccaactagaggcaaatat

SEQ ID NO: 484375 - DNA, 20 bp, Artificial
  CRISPR gRNA sequence
aggcaaatataagttatgac

SEQ ID NO: 484376 - DNA, 20 bp, Artificial
  CRISPR gRNA sequence
gcaaatataagttatgacta

SEQ ID NO: 484377 - DNA, 20 bp, Artificial
  CRISPR gRNA sequence
caaatataagttatgactag

SEQ ID NO: 484378 - DNA, 20 bp, Artificial
  CRISPR gRNA sequence
tagaggaaaataacatcaac

SEQ ID NO: 484379 - DNA, 20 bp, Artificial
  CRISPR gRNA sequence
gaggaaaataacatcaacca

SEQ ID NO: 484380 - DNA, 20 bp, Artificial
  CRISPR gRNA sequence
ccagagcattaaattattcc

SEQ ID NO: 484381 - DNA, 20 bp, Artificial
  CRISPR gRNA sequence
tgtttcatacacaatatcca

SEQ ID NO: 484382 - DNA, 20 bp, Artificial
  CRISPR gRNA sequence
catacacaatatccaaagtg

SEQ ID NO: 484383 - DNA, 20 bp, Artificial
  CRISPR gRNA sequence
caatatccaaagtgaagtat

SEQ ID NO: 484384 - DNA, 20 bp, Artificial
  CRISPR gRNA sequence
tccaaagtgaagtataagaa

SEQ ID NO: 484385 - DNA, 20 bp, Artificial
  CRISPR gRNA sequence
ccaaagtgaagtataagaaa

SEQ ID NO: 484386 - DNA, 20 bp, Artificial
  CRISPR gRNA sequence
gaaacatctccaaaaaccaa

SEQ ID NO: 484387 - DNA, 20 bp, Artificial
  CRISPR gRNA sequence
acatctccaaaaaccaacag

SEQ ID NO: 484388 - DNA, 20 bp, Artificial
  CRISPR gRNA sequence
tccaaaaaccaacagaagaa

SEQ ID NO: 484389 - DNA, 20 bp, Artificial
  CRISPR gRNA sequence
caaaaaccaacagaagaata

SEQ ID NO: 484390 - DNA, 20 bp, Artificial
  CRISPR gRNA sequence
caacagaagaatagagacaa

SEQ ID NO: 484391 - DNA, 20 bp, Artificial
  CRISPR gRNA sequence
agacaacagaaaccaacaaa

SEQ ID NO: 484392 - DNA, 20 bp, Artificial
  CRISPR gRNA sequence
gacaacagaaaccaacaaac

SEQ ID NO: 484393 - DNA, 20 bp, Artificial
  CRISPR gRNA sequence
acaacagaaaccaacaaaca

SEQ ID NO: 484394 - DNA, 20 bp, Artificial
  CRISPR gRNA sequence
caaacagggcatctacataa

SEQ ID NO: 484395 - DNA, 20 bp, Artificial
  CRISPR gRNA sequence
aacagggcatctacataata

SEQ ID NO: 484396 - DNA, 20 bp, Artificial
  CRISPR gRNA sequence
catctacataatagagttgt

SEQ ID NO: 484397 - DNA, 20 bp, Artificial
  CRISPR gRNA sequence
gttgtcagtcataaacttta

SEQ ID NO: 484398 - DNA, 20 bp, Artificial
  CRISPR gRNA sequence
taatcatgtctaatatgttc

SEQ ID NO: 484399 - DNA, 20 bp, Artificial
  CRISPR gRNA sequence
aatcatgtctaatatgttca

SEQ ID NO: 484400 - DNA, 20 bp, Artificial
  CRISPR gRNA sequence
tgttcaaggaaataaaacat

SEQ ID NO: 484401 - DNA, 20 bp, Artificial
  CRISPR gRNA sequence
aggaaataaaacataagttt

SEQ ID NO: 484402 - DNA, 20 bp, Artificial
  CRISPR gRNA sequence
aaacataagtttaagaattt

SEQ ID NO: 484403 - DNA, 20 bp, Artificial
  CRISPR gRNA sequence
cataagtttaagaatttcag

SEQ ID NO: 484404 - DNA, 20 bp, Artificial
  CRISPR gRNA sequence
taagtttaagaatttcagca

SEQ ID NO: 484405 - DNA, 20 bp, Artificial
  CRISPR gRNA sequence
taagaatttcagcagagaac

SEQ ID NO: 484406 - DNA, 20 bp, Artificial
  CRISPR gRNA sequence
tcagcagagaactagcgtga

SEQ ID NO: 484407 - DNA, 20 bp, Artificial
  CRISPR gRNA sequence
gtccttgcaatgtgacttta

SEQ ID NO: 484408 - DNA, 20 bp, Artificial
  CRISPR gRNA sequence
ttacagctccttctgttatc

SEQ ID NO: 484409 - DNA, 20 bp, Artificial
  CRISPR gRNA sequence
ctccttctgttatcaagaaa

SEQ ID NO: 484410 - DNA, 20 bp, Artificial
  CRISPR gRNA sequence
tccttctgttatcaagaaat

SEQ ID NO: 484411 - DNA, 20 bp, Artificial
  CRISPR gRNA sequence
ccttctgttatcaagaaatg

SEQ ID NO: 484412 - DNA, 20 bp, Artificial
  CRISPR gRNA sequence
gggttcatttccctgtctct

SEQ ID NO: 484413 - DNA, 20 bp, Artificial
  CRISPR gRNA sequence
atttccctgtctcttggaac

SEQ ID NO: 484414 - DNA, 20 bp, Artificial
  CRISPR gRNA sequence
tttccctgtctcttggaact

SEQ ID NO: 484415 - DNA, 20 bp, Artificial
  CRISPR gRNA sequence
cctgtctcttggaactgggc

SEQ ID NO: 484416 - DNA, 20 bp, Artificial
  CRISPR gRNA sequence
ctggtcttcatgatgaaacg

SEQ ID NO: 484417 - DNA, 20 bp, Artificial
  CRISPR gRNA sequence
cagcaaaaatgatgttctgc

SEQ ID NO: 484418 - DNA, 20 bp, Artificial
  CRISPR gRNA sequence
aatgatgttctgctagttct

SEQ ID NO: 484419 - DNA, 20 bp, Artificial
  CRISPR gRNA sequence
tgttctgctagttctaagcc

SEQ ID NO: 484420 - DNA, 20 bp, Artificial
  CRISPR gRNA sequence
gttctaagcctagatctgaa

SEQ ID NO: 484421 - DNA, 20 bp, Artificial
  CRISPR gRNA sequence
ttctaagcctagatctgaaa

SEQ ID NO: 484422 - DNA, 20 bp, Artificial
  CRISPR gRNA sequence
cacatttctacttgttctct

SEQ ID NO: 484423 - DNA, 20 bp, Artificial
  CRISPR gRNA sequence
tgttctcttggaacctcatc

SEQ ID NO: 484424 - DNA, 20 bp, Artificial
  CRISPR gRNA sequence
catctggctgacctgtgaac

SEQ ID NO: 484425 - DNA, 20 bp, Artificial
  CRISPR gRNA sequence
acctgtgaacaagcctaaaa

SEQ ID NO: 484426 - DNA, 20 bp, Artificial
  CRISPR gRNA sequence
acaagcctaaaatagcctgc

SEQ ID NO: 484427 - DNA, 20 bp, Artificial
  CRISPR gRNA sequence
aagcctaaaatagcctgctg

SEQ ID NO: 484428 - DNA, 20 bp, Artificial
  CRISPR gRNA sequence
aaaatagcctgctggagaat

SEQ ID NO: 484429 - DNA, 20 bp, Artificial
  CRISPR gRNA sequence
gaataagatatcacatgata

SEQ ID NO: 484430 - DNA, 20 bp, Artificial
  CRISPR gRNA sequence
ataagatatcacatgataca

SEQ ID NO: 484431 - DNA, 20 bp, Artificial
  CRISPR gRNA sequence
atatcacatgatacagagat

SEQ ID NO: 484432 - DNA, 20 bp, Artificial
  CRISPR gRNA sequence
gatacagagataagccaaca

SEQ ID NO: 484433 - DNA, 20 bp, Artificial
  CRISPR gRNA sequence
agagataagccaacacagct

SEQ ID NO: 484434 - DNA, 20 bp, Artificial
  CRISPR gRNA sequence
gagataagccaacacagcta

SEQ ID NO: 484435 - DNA, 20 bp, Artificial
  CRISPR gRNA sequence
cagctaaggccattctaaat

SEQ ID NO: 484436 - DNA, 20 bp, Artificial
  CRISPR gRNA sequence
taaggccattctaaatcagc

SEQ ID NO: 484437 - DNA, 20 bp, Artificial
  CRISPR gRNA sequence
cattctaaatcagctagccc

SEQ ID NO: 484438 - DNA, 20 bp, Artificial
  CRISPR gRNA sequence
taaatcagctagccctggcc

SEQ ID NO: 484439 - DNA, 20 bp, Artificial
  CRISPR gRNA sequence
cagctagccctggcctggtg

SEQ ID NO: 484440 - DNA, 20 bp, Artificial
  CRISPR gRNA sequence
ctagccctggcctggtgcgg

SEQ ID NO: 484441 - DNA, 20 bp, Artificial
  CRISPR gRNA sequence
gtggctcatgcccgtaattc

SEQ ID NO: 484442 - DNA, 20 bp, Artificial
  CRISPR gRNA sequence
tgcccgtaattccagcactt

SEQ ID NO: 484443 - DNA, 20 bp, Artificial
  CRISPR gRNA sequence
gcccgtaattccagcacttt

SEQ ID NO: 484444 - DNA, 20 bp, Artificial
  CRISPR gRNA sequence
ccgtaattccagcactttgg

SEQ ID NO: 484445 - DNA, 20 bp, Artificial
  CRISPR gRNA sequence
cgtaattccagcactttggg

SEQ ID NO: 484446 - DNA, 20 bp, Artificial
  CRISPR gRNA sequence
ttccagcactttgggaggcc

SEQ ID NO: 484447 - DNA, 20 bp, Artificial
  CRISPR gRNA sequence
tccagcactttgggaggcca

SEQ ID NO: 484448 - DNA, 20 bp, Artificial
  CRISPR gRNA sequence
gcactttgggaggccaaggc

SEQ ID NO: 484449 - DNA, 20 bp, Artificial
  CRISPR gRNA sequence
ctttgggaggccaaggccgg

SEQ ID NO: 484450 - DNA, 20 bp, Artificial
  CRISPR gRNA sequence
ccaaggccggcagatcactc

SEQ ID NO: 484451 - DNA, 20 bp, Artificial
  CRISPR gRNA sequence
caaggccggcagatcactca

SEQ ID NO: 484452 - DNA, 20 bp, Artificial
  CRISPR gRNA sequence
gccggcagatcactcaaggt

SEQ ID NO: 484453 - DNA, 20 bp, Artificial
  CRISPR gRNA sequence
ccggcagatcactcaaggtc

SEQ ID NO: 484454 - DNA, 20 bp, Artificial
  CRISPR gRNA sequence
ggcagatcactcaaggtcgg

SEQ ID NO: 484455 - DNA, 20 bp, Artificial
  CRISPR gRNA sequence
tcactcaaggtcgggagttc

SEQ ID NO: 484456 - DNA, 20 bp, Artificial
  CRISPR gRNA sequence
tcgggagttcgagaccaccc

SEQ ID NO: 484457 - DNA, 20 bp, Artificial
  CRISPR gRNA sequence
cgagaccaccctggccaaca

SEQ ID NO: 484458 - DNA, 20 bp, Artificial
  CRISPR gRNA sequence
tctactaacgatacaaaaat

SEQ ID NO: 484459 - DNA, 20 bp, Artificial
  CRISPR gRNA sequence
ctaacgatacaaaaattagc

SEQ ID NO: 484460 - DNA, 20 bp, Artificial
  CRISPR gRNA sequence
atacaaaaattagccagaca

SEQ ID NO: 484461 - DNA, 20 bp, Artificial
  CRISPR gRNA sequence
caaaaattagccagacatgg

SEQ ID NO: 484462 - DNA, 20 bp, Artificial
  CRISPR gRNA sequence
gtggcacacacttgtaaccc

SEQ ID NO: 484463 - DNA, 20 bp, Artificial
  CRISPR gRNA sequence
cacttgtaaccccagctact

SEQ ID NO: 484464 - DNA, 20 bp, Artificial
  CRISPR gRNA sequence
acttgtaaccccagctactt

SEQ ID NO: 484465 - DNA, 20 bp, Artificial
  CRISPR gRNA sequence
ttgtaaccccagctacttgg

SEQ ID NO: 484466 - DNA, 20 bp, Artificial
  CRISPR gRNA sequence
ccccagctacttgggagtct

SEQ ID NO: 484467 - DNA, 20 bp, Artificial
  CRISPR gRNA sequence
cccagctacttgggagtctg

SEQ ID NO: 484468 - DNA, 20 bp, Artificial
  CRISPR gRNA sequence
tacttgggagtctgaggcac

SEQ ID NO: 484469 - DNA, 20 bp, Artificial
  CRISPR gRNA sequence
gcacgagaactgcttgaacc

SEQ ID NO: 484470 - DNA, 20 bp, Artificial
  CRISPR gRNA sequence
cacgagaactgcttgaaccc

SEQ ID NO: 484471 - DNA, 20 bp, Artificial
  CRISPR gRNA sequence
cgagaactgcttgaacccgg

SEQ ID NO: 484472 - DNA, 20 bp, Artificial
  CRISPR gRNA sequence
aactgcttgaacccgggaga

SEQ ID NO: 484473 - DNA, 20 bp, Artificial
  CRISPR gRNA sequence
ctgcttgaacccgggagatg

SEQ ID NO: 484474 - DNA, 20 bp, Artificial
  CRISPR gRNA sequence
aacccgggagatggagcttg

SEQ ID NO: 484475 - DNA, 20 bp, Artificial
  CRISPR gRNA sequence
cgggagatggagcttgcagt

SEQ ID NO: 484476 - DNA, 20 bp, Artificial
  CRISPR gRNA sequence
gatggagcttgcagtgagcc

SEQ ID NO: 484477 - DNA, 20 bp, Artificial
  CRISPR gRNA sequence
gatatcatgccactgcactc

SEQ ID NO: 484478 - DNA, 20 bp, Artificial
  CRISPR gRNA sequence
ctgcactctagcctgcatga

SEQ ID NO: 484479 - DNA, 20 bp, Artificial
  CRISPR gRNA sequence
gcactctagcctgcatgaca

SEQ ID NO: 484480 - DNA, 20 bp, Artificial
  CRISPR gRNA sequence
tctagcctgcatgacagagc

SEQ ID NO: 484481 - DNA, 20 bp, Artificial
  CRISPR gRNA sequence
taaaaaataaataaatgaat

SEQ ID NO: 484482 - DNA, 20 bp, Artificial
  CRISPR gRNA sequence
ataaatgaatcagccacccg

SEQ ID NO: 484483 - DNA, 20 bp, Artificial
  CRISPR gRNA sequence
atgaatcagccacccgtggc

SEQ ID NO: 484484 - DNA, 20 bp, Artificial
  CRISPR gRNA sequence
tcagccacccgtggccagtc

SEQ ID NO: 484485 - DNA, 20 bp, Artificial
  CRISPR gRNA sequence
gccacccgtggccagtctgg

SEQ ID NO: 484486 - DNA, 20 bp, Artificial
  CRISPR gRNA sequence
cacacatgcatgactgatgc

SEQ ID NO: 484487 - DNA, 20 bp, Artificial
  CRISPR gRNA sequence
cacatgcatgactgatgcaa

SEQ ID NO: 484488 - DNA, 20 bp, Artificial
  CRISPR gRNA sequence
acatgcatgactgatgcaag

SEQ ID NO: 484489 - DNA, 20 bp, Artificial
  CRISPR gRNA sequence
ctgatgcaagaggaaaccaa

SEQ ID NO: 484490 - DNA, 20 bp, Artificial
  CRISPR gRNA sequence
aggaaaccaaaagaaccacc

SEQ ID NO: 484491 - DNA, 20 bp, Artificial
  CRISPR gRNA sequence
accaaaagaaccacctagct

SEQ ID NO: 484492 - DNA, 20 bp, Artificial
  CRISPR gRNA sequence
aagaaccacctagctgagcc

SEQ ID NO: 484493 - DNA, 20 bp, Artificial
  CRISPR gRNA sequence
gcccagcccaaattgccaac

SEQ ID NO: 484494 - DNA, 20 bp, Artificial
  CRISPR gRNA sequence
cagcccaaattgccaactag

SEQ ID NO: 484495 - DNA, 20 bp, Artificial
  CRISPR gRNA sequence
tagcagaatcactaactaaa

SEQ ID NO: 484496 - DNA, 20 bp, Artificial
  CRISPR gRNA sequence
agcagaatcactaactaaat

SEQ ID NO: 484497 - DNA, 20 bp, Artificial
  CRISPR gRNA sequence
agaatcactaactaaatagg

SEQ ID NO: 484498 - DNA, 20 bp, Artificial
  CRISPR gRNA sequence
aggtagttgttttaaactac

SEQ ID NO: 484499 - DNA, 20 bp, Artificial
  CRISPR gRNA sequence
tgttttaaactactggattt

SEQ ID NO: 484500 - DNA, 20 bp, Artificial
  CRISPR gRNA sequence
ttttaaactactggattttg

SEQ ID NO: 484501 - DNA, 20 bp, Artificial
  CRISPR gRNA sequence
taaactactggattttggag

SEQ ID NO: 484502 - DNA, 20 bp, Artificial
  CRISPR gRNA sequence
aaactactggattttggagt

SEQ ID NO: 484503 - DNA, 20 bp, Artificial
  CRISPR gRNA sequence
ttttggagtaggtcattatg

SEQ ID NO: 484504 - DNA, 20 bp, Artificial
  CRISPR gRNA sequence
agtaggtcattatgcagcaa

SEQ ID NO: 484505 - DNA, 20 bp, Artificial
  CRISPR gRNA sequence
cagcaatagttacctgaaat

SEQ ID NO: 484506 - DNA, 20 bp, Artificial
  CRISPR gRNA sequence
ctgaaattggatttttttta

SEQ ID NO: 484507 - DNA, 20 bp, Artificial
  CRISPR gRNA sequence
aaagaattcaatgaaaatta

SEQ ID NO: 484508 - DNA, 20 bp, Artificial
  CRISPR gRNA sequence
tgtaaaacaaactcaattga

SEQ ID NO: 484509 - DNA, 20 bp, Artificial
  CRISPR gRNA sequence
gtaaaacaaactcaattgaa

SEQ ID NO: 484510 - DNA, 20 bp, Artificial
  CRISPR gRNA sequence
aactcaattgaaaggttaaa

SEQ ID NO: 484511 - DNA, 20 bp, Artificial
  CRISPR gRNA sequence
actcaattgaaaggttaaaa

SEQ ID NO: 484512 - DNA, 20 bp, Artificial
  CRISPR gRNA sequence
gaaaggttaaaaaggccatt

SEQ ID NO: 484513 - DNA, 20 bp, Artificial
  CRISPR gRNA sequence
gccatttagatgccattgaa

SEQ ID NO: 484514 - DNA, 20 bp, Artificial
  CRISPR gRNA sequence
catttagatgccattgaaaa

SEQ ID NO: 484515 - DNA, 20 bp, Artificial
  CRISPR gRNA sequence
gatgccattgaaaagagaat

SEQ ID NO: 484516 - DNA, 20 bp, Artificial
  CRISPR gRNA sequence
gaaaactgttataaaatatc

SEQ ID NO: 484517 - DNA, 20 bp, Artificial
  CRISPR gRNA sequence
aaactgttataaaatatcca

SEQ ID NO: 484518 - DNA, 20 bp, Artificial
  CRISPR gRNA sequence
gttataaaatatccagagtg

SEQ ID NO: 484519 - DNA, 20 bp, Artificial
  CRISPR gRNA sequence
aaaatatccagagtgaagta

SEQ ID NO: 484520 - DNA, 20 bp, Artificial
  CRISPR gRNA sequence
agtgaagtaaagaaaaacaa

SEQ ID NO: 484521 - DNA, 20 bp, Artificial
  CRISPR gRNA sequence
gtgaagtaaagaaaaacaaa

SEQ ID NO: 484522 - DNA, 20 bp, Artificial
  CRISPR gRNA sequence
acaaaaggataaaaatacac

SEQ ID NO: 484523 - DNA, 20 bp, Artificial
  CRISPR gRNA sequence
aaaggataaaaatacacaag

SEQ ID NO: 484524 - DNA, 20 bp, Artificial
  CRISPR gRNA sequence
aaggataaaaatacacaaga

SEQ ID NO: 484525 - DNA, 20 bp, Artificial
  CRISPR gRNA sequence
ggataaaaatacacaagaag

SEQ ID NO: 484526 - DNA, 20 bp, Artificial
  CRISPR gRNA sequence
atacacaagaaggagtgtaa

SEQ ID NO: 484527 - DNA, 20 bp, Artificial
  CRISPR gRNA sequence
aaggagtgtaaaagatattt

SEQ ID NO: 484528 - DNA, 20 bp, Artificial
  CRISPR gRNA sequence
tgtaaaagatatttgagata

SEQ ID NO: 484529 - DNA, 20 bp, Artificial
  CRISPR gRNA sequence
caaaacaaaacccctaaact

SEQ ID NO: 484530 - DNA, 20 bp, Artificial
  CRISPR gRNA sequence
acccctaaactaagtgtaat

SEQ ID NO: 484531 - DNA, 20 bp, Artificial
  CRISPR gRNA sequence
ctaaactaagtgtaattgga

SEQ ID NO: 484532 - DNA, 20 bp, Artificial
  CRISPR gRNA sequence
actaagtgtaattggaaagc

SEQ ID NO: 484533 - DNA, 20 bp, Artificial
  CRISPR gRNA sequence
ctaagtgtaattggaaagca

SEQ ID NO: 484534 - DNA, 20 bp, Artificial
  CRISPR gRNA sequence
aagtgtaattggaaagcaag

SEQ ID NO: 484535 - DNA, 20 bp, Artificial
  CRISPR gRNA sequence
taattggaaagcaaggagac

SEQ ID NO: 484536 - DNA, 20 bp, Artificial
  CRISPR gRNA sequence
attggaaagcaaggagacga

SEQ ID NO: 484537 - DNA, 20 bp, Artificial
  CRISPR gRNA sequence
tggaaagcaaggagacgaga

SEQ ID NO: 484538 - DNA, 20 bp, Artificial
  CRISPR gRNA sequence
ggaaagcaaggagacgagag

SEQ ID NO: 484539 - DNA, 20 bp, Artificial
  CRISPR gRNA sequence
agcaaggagacgagagagga

SEQ ID NO: 484540 - DNA, 20 bp, Artificial
  CRISPR gRNA sequence
caaggagacgagagaggaaa

SEQ ID NO: 484541 - DNA, 20 bp, Artificial
  CRISPR gRNA sequence
aaggagacgagagaggaaag

SEQ ID NO: 484542 - DNA, 20 bp, Artificial
  CRISPR gRNA sequence
cgagagaggaaagaggaact

SEQ ID NO: 484543 - DNA, 20 bp, Artificial
  CRISPR gRNA sequence
aggaaagaggaactaagcaa

SEQ ID NO: 484544 - DNA, 20 bp, Artificial
  CRISPR gRNA sequence
gaaagaggaactaagcaaaa

SEQ ID NO: 484545 - DNA, 20 bp, Artificial
  CRISPR gRNA sequence
gaactaagcaaaagagataa

SEQ ID NO: 484546 - DNA, 20 bp, Artificial
  CRISPR gRNA sequence
aagcaaaagagataaaagat

SEQ ID NO: 484547 - DNA, 20 bp, Artificial
  CRISPR gRNA sequence
gaatttcccaaaactgacaa

SEQ ID NO: 484548 - DNA, 20 bp, Artificial
  CRISPR gRNA sequence
caaaactgacaaaagccatc

SEQ ID NO: 484549 - DNA, 20 bp, Artificial
  CRISPR gRNA sequence
actgacaaaagccatcaaga

SEQ ID NO: 484550 - DNA, 20 bp, Artificial
  CRISPR gRNA sequence
taaaatgtgttacaaacccc

SEQ ID NO: 484551 - DNA, 20 bp, Artificial
  CRISPR gRNA sequence
atgtgttacaaaccccaagc

SEQ ID NO: 484552 - DNA, 20 bp, Artificial
  CRISPR gRNA sequence
caagatcaaaacaaaccgac

SEQ ID NO: 484553 - DNA, 20 bp, Artificial
  CRISPR gRNA sequence
atcaaaacaaaccgacaagc

SEQ ID NO: 484554 - DNA, 20 bp, Artificial
  CRISPR gRNA sequence
tcaaaacaaaccgacaagct

SEQ ID NO: 484555 - DNA, 20 bp, Artificial
  CRISPR gRNA sequence
acaaaccgacaagctgggca

SEQ ID NO: 484556 - DNA, 20 bp, Artificial
  CRISPR gRNA sequence
aaccgacaagctgggcacgg

SEQ ID NO: 484557 - DNA, 20 bp, Artificial
  CRISPR gRNA sequence
gtggctcacgcctgtaatcc

SEQ ID NO: 484558 - DNA, 20 bp, Artificial
  CRISPR gRNA sequence
cgcctgtaatcccagcactt

SEQ ID NO: 484559 - DNA, 20 bp, Artificial
  CRISPR gRNA sequence
gcctgtaatcccagcacttt

SEQ ID NO: 484560 - DNA, 20 bp, Artificial
  CRISPR gRNA sequence
ctgtaatcccagcactttgg

SEQ ID NO: 484561 - DNA, 20 bp, Artificial
  CRISPR gRNA sequence
tgtaatcccagcactttggg

SEQ ID NO: 484562 - DNA, 20 bp, Artificial
  CRISPR gRNA sequence
tcccagcactttgggaggcc

SEQ ID NO: 484563 - DNA, 20 bp, Artificial
  CRISPR gRNA sequence
cccagcactttgggaggccc

SEQ ID NO: 484564 - DNA, 20 bp, Artificial
  CRISPR gRNA sequence
agcactttgggaggcccagg

SEQ ID NO: 484565 - DNA, 20 bp, Artificial
  CRISPR gRNA sequence
ctttgggaggcccaggtgga

SEQ ID NO: 484566 - DNA, 20 bp, Artificial
  CRISPR gRNA sequence
gtggatggatcacctgacgt

SEQ ID NO: 484567 - DNA, 20 bp, Artificial
  CRISPR gRNA sequence
tggatggatcacctgacgtc

SEQ ID NO: 484568 - DNA, 20 bp, Artificial
  CRISPR gRNA sequence
gatggatcacctgacgtcag

SEQ ID NO: 484569 - DNA, 20 bp, Artificial
  CRISPR gRNA sequence
tcacctgacgtcaggagttt

SEQ ID NO: 484570 - DNA, 20 bp, Artificial
  CRISPR gRNA sequence
tgacgtcaggagtttgagac

SEQ ID NO: 484571 - DNA, 20 bp, Artificial
  CRISPR gRNA sequence
tcaggagtttgagaccagcc

SEQ ID NO: 484572 - DNA, 20 bp, Artificial
  CRISPR gRNA sequence
tctgctaaaaatgcaaaaat

SEQ ID NO: 484573 - DNA, 20 bp, Artificial
  CRISPR gRNA sequence
taaaaatgcaaaaattagcc

SEQ ID NO: 484574 - DNA, 20 bp, Artificial
  CRISPR gRNA sequence
atgcaaaaattagccaagta

SEQ ID NO: 484575 - DNA, 20 bp, Artificial
  CRISPR gRNA sequence
caaaaattagccaagtatgg

SEQ ID NO: 484576 - DNA, 20 bp, Artificial
  CRISPR gRNA sequence
gtggtgcacacctgtaatcc

SEQ ID NO: 484577 - DNA, 20 bp, Artificial
  CRISPR gRNA sequence
cacctgtaatcccagctact

SEQ ID NO: 484578 - DNA, 20 bp, Artificial
  CRISPR gRNA sequence
acctgtaatcccagctactt

SEQ ID NO: 484579 - DNA, 20 bp, Artificial
  CRISPR gRNA sequence
ctgtaatcccagctacttgg

SEQ ID NO: 484580 - DNA, 20 bp, Artificial
  CRISPR gRNA sequence
tgtaatcccagctacttggg

SEQ ID NO: 484581 - DNA, 20 bp, Artificial
  CRISPR gRNA sequence
tcccagctacttgggaggct

SEQ ID NO: 484582 - DNA, 20 bp, Artificial
  CRISPR gRNA sequence
cccagctacttgggaggctg

SEQ ID NO: 484583 - DNA, 20 bp, Artificial
  CRISPR gRNA sequence
agctacttgggaggctgagg

SEQ ID NO: 484584 - DNA, 20 bp, Artificial
  CRISPR gRNA sequence
gctacttgggaggctgaggc

SEQ ID NO: 484585 - DNA, 20 bp, Artificial
  CRISPR gRNA sequence
tacttgggaggctgaggcag

SEQ ID NO: 484586 - DNA, 20 bp, Artificial
  CRISPR gRNA sequence
gcaggagaatcacttgaatc

SEQ ID NO: 484587 - DNA, 20 bp, Artificial
  CRISPR gRNA sequence
caggagaatcacttgaatcc

SEQ ID NO: 484588 - DNA, 20 bp, Artificial
  CRISPR gRNA sequence
ggagaatcacttgaatccag

SEQ ID NO: 484589 - DNA, 20 bp, Artificial
  CRISPR gRNA sequence
gagaatcacttgaatccagg

SEQ ID NO: 484590 - DNA, 20 bp, Artificial
  CRISPR gRNA sequence
aatcacttgaatccaggagg

SEQ ID NO: 484591 - DNA, 20 bp, Artificial
  CRISPR gRNA sequence
tcacttgaatccaggaggtg

SEQ ID NO: 484592 - DNA, 20 bp, Artificial
  CRISPR gRNA sequence
cacttgaatccaggaggtgg

SEQ ID NO: 484593 - DNA, 20 bp, Artificial
  CRISPR gRNA sequence
aatccaggaggtggaggttg

SEQ ID NO: 484594 - DNA, 20 bp, Artificial
  CRISPR gRNA sequence
caggaggtggaggttgcagt

SEQ ID NO: 484595 - DNA, 20 bp, Artificial
  CRISPR gRNA sequence
ggtggaggttgcagtgagcc

SEQ ID NO: 484596 - DNA, 20 bp, Artificial
  CRISPR gRNA sequence
cacgccactgcactccaacc

SEQ ID NO: 484597 - DNA, 20 bp, Artificial
  CRISPR gRNA sequence
acgccactgcactccaacct

SEQ ID NO: 484598 - DNA, 20 bp, Artificial
  CRISPR gRNA sequence
tgcactccaacctgggcaac

SEQ ID NO: 484599 - DNA, 20 bp, Artificial
  CRISPR gRNA sequence
cactccaacctgggcaacaa

SEQ ID NO: 484600 - DNA, 20 bp, Artificial
  CRISPR gRNA sequence
ctctgtctcaaaaaaaaaaa

SEQ ID NO: 484601 - DNA, 20 bp, Artificial
  CRISPR gRNA sequence
aaaaacaaaccaatgaacaa

SEQ ID NO: 484602 - DNA, 20 bp, Artificial
  CRISPR gRNA sequence
tcaatacatcaaaaaaatta

SEQ ID NO: 484603 - DNA, 20 bp, Artificial
  CRISPR gRNA sequence
caaaaaaattatggaaacca

SEQ ID NO: 484604 - DNA, 20 bp, Artificial
  CRISPR gRNA sequence
ttatggaaaccaaagataaa

SEQ ID NO: 484605 - DNA, 20 bp, Artificial
  CRISPR gRNA sequence
taaatagaaaaatcgtaaaa

SEQ ID NO: 484606 - DNA, 20 bp, Artificial
  CRISPR gRNA sequence
tagaaaaatcgtaaaatagc

SEQ ID NO: 484607 - DNA, 20 bp, Artificial
  CRISPR gRNA sequence
gaaaaatcgtaaaatagcca

SEQ ID NO: 484608 - DNA, 20 bp, Artificial
  CRISPR gRNA sequence
aaatcgtaaaatagccagag

SEQ ID NO: 484609 - DNA, 20 bp, Artificial
  CRISPR gRNA sequence
aatcgtaaaatagccagagt

SEQ ID NO: 484610 - DNA, 20 bp, Artificial
  CRISPR gRNA sequence
atcgtaaaatagccagagtg

SEQ ID NO: 484611 - DNA, 20 bp, Artificial
  CRISPR gRNA sequence
tcgtaaaatagccagagtgg

SEQ ID NO: 484612 - DNA, 20 bp, Artificial
  CRISPR gRNA sequence
ccttcacaaaacaaacaact

SEQ ID NO: 484613 - DNA, 20 bp, Artificial
  CRISPR gRNA sequence
aaacaacttagctgacattt

SEQ ID NO: 484614 - DNA, 20 bp, Artificial
  CRISPR gRNA sequence
atttcagcaaaaataataaa

SEQ ID NO: 484615 - DNA, 20 bp, Artificial
  CRISPR gRNA sequence
tcagcaaaaataataaaaag

SEQ ID NO: 484616 - DNA, 20 bp, Artificial
  CRISPR gRNA sequence
aaataataaaaagcagatga

SEQ ID NO: 484617 - DNA, 20 bp, Artificial
  CRISPR gRNA sequence
ataaaaagcagatgatggaa

SEQ ID NO: 484618 - DNA, 20 bp, Artificial
  CRISPR gRNA sequence
cttttttttttatttttcca

SEQ ID NO: 484619 - DNA, 20 bp, Artificial
  CRISPR gRNA sequence
ttttttttttatttttccat

SEQ ID NO: 484620 - DNA, 20 bp, Artificial
  CRISPR gRNA sequence
tttatttttccataggttat

SEQ ID NO: 484621 - DNA, 20 bp, Artificial
  CRISPR gRNA sequence
ttatttttccataggttatt

SEQ ID NO: 484622 - DNA, 20 bp, Artificial
  CRISPR gRNA sequence
tatttttccataggttattg

SEQ ID NO: 484623 - DNA, 20 bp, Artificial
  CRISPR gRNA sequence
ttccataggttattggggta

SEQ ID NO: 484624 - DNA, 20 bp, Artificial
  CRISPR gRNA sequence
tccataggttattggggtac

SEQ ID NO: 484625 - DNA, 20 bp, Artificial
  CRISPR gRNA sequence
ataggttattggggtacagg

SEQ ID NO: 484626 - DNA, 20 bp, Artificial
  CRISPR gRNA sequence
attggggtacaggtggtgtt

SEQ ID NO: 484627 - DNA, 20 bp, Artificial
  CRISPR gRNA sequence
tacaggtggtgtttggttac

SEQ ID NO: 484628 - DNA, 20 bp, Artificial
  CRISPR gRNA sequence
caggtggtgtttggttacaa

SEQ ID NO: 484629 - DNA, 20 bp, Artificial
  CRISPR gRNA sequence
tggtgtttggttacaagaga

SEQ ID NO: 484630 - DNA, 20 bp, Artificial
  CRISPR gRNA sequence
ggttacaagagaaagttcat

SEQ ID NO: 484631 - DNA, 20 bp, Artificial
  CRISPR gRNA sequence
ttacaagagaaagttcatta

SEQ ID NO: 484632 - DNA, 20 bp, Artificial
  CRISPR gRNA sequence
tacaagagaaagttcattag

SEQ ID NO: 484633 - DNA, 20 bp, Artificial
  CRISPR gRNA sequence
gttcattagaggtgatttgt

SEQ ID NO: 484634 - DNA, 20 bp, Artificial
  CRISPR gRNA sequence
attagaggtgatttgtgagt

SEQ ID NO: 484635 - DNA, 20 bp, Artificial
  CRISPR gRNA sequence
agtcggtgcacccatcaccc

SEQ ID NO: 484636 - DNA, 20 bp, Artificial
  CRISPR gRNA sequence
cggtgcacccatcacccgag

SEQ ID NO: 484637 - DNA, 20 bp, Artificial
  CRISPR gRNA sequence
tatacactgcactctattta

SEQ ID NO: 484638 - DNA, 20 bp, Artificial
  CRISPR gRNA sequence
cccctcccacttttcctccc

SEQ ID NO: 484639 - DNA, 20 bp, Artificial
  CRISPR gRNA sequence
cttttcctcccaagtcacca

SEQ ID NO: 484640 - DNA, 20 bp, Artificial
  CRISPR gRNA sequence
cttatgcctttgcatcctcg

SEQ ID NO: 484641 - DNA, 20 bp, Artificial
  CRISPR gRNA sequence
gtagcttaactcccacgtat

SEQ ID NO: 484642 - DNA, 20 bp, Artificial
  CRISPR gRNA sequence
cttaactcccacgtatcagt

SEQ ID NO: 484643 - DNA, 20 bp, Artificial
  CRISPR gRNA sequence
cagtgagaacatacgttgtt

SEQ ID NO: 484644 - DNA, 20 bp, Artificial
  CRISPR gRNA sequence
catacgttgtttggttttcc

SEQ ID NO: 484645 - DNA, 20 bp, Artificial
  CRISPR gRNA sequence
atacgttgtttggttttcca

SEQ ID NO: 484646 - DNA, 20 bp, Artificial
  CRISPR gRNA sequence
tccaaggaatgatatattta

SEQ ID NO: 484647 - DNA, 20 bp, Artificial
  CRISPR gRNA sequence
tgatatatttaaagtgctga

SEQ ID NO: 484648 - DNA, 20 bp, Artificial
  CRISPR gRNA sequence
aaagaaaataactgcctatc

SEQ ID NO: 484649 - DNA, 20 bp, Artificial
  CRISPR gRNA sequence
taactgcctatctagaattt

SEQ ID NO: 484650 - DNA, 20 bp, Artificial
  CRISPR gRNA sequence
tctagaatttcggtacttca

SEQ ID NO: 484651 - DNA, 20 bp, Artificial
  CRISPR gRNA sequence
tttcggtacttcaaagatga

SEQ ID NO: 484652 - DNA, 20 bp, Artificial
  CRISPR gRNA sequence
cggtacttcaaagatgaaag

SEQ ID NO: 484653 - DNA, 20 bp, Artificial
  CRISPR gRNA sequence
ttcaaagatgaaagcagatg

SEQ ID NO: 484654 - DNA, 20 bp, Artificial
  CRISPR gRNA sequence
aaagatgaaagcagatgcag

SEQ ID NO: 484655 - DNA, 20 bp, Artificial
  CRISPR gRNA sequence
tgcctgtaatccccgcactt

SEQ ID NO: 484656 - DNA, 20 bp, Artificial
  CRISPR gRNA sequence
gcctgtaatccccgcacttt

SEQ ID NO: 484657 - DNA, 20 bp, Artificial
  CRISPR gRNA sequence
ctgtaatccccgcactttgg

SEQ ID NO: 484658 - DNA, 20 bp, Artificial
  CRISPR gRNA sequence
tgtaatccccgcactttggg

SEQ ID NO: 484659 - DNA, 20 bp, Artificial
  CRISPR gRNA sequence
ccccgcactttgggaggctg

SEQ ID NO: 484660 - DNA, 20 bp, Artificial
  CRISPR gRNA sequence
cgcactttgggaggctgaag

SEQ ID NO: 484661 - DNA, 20 bp, Artificial
  CRISPR gRNA sequence
gcactttgggaggctgaagc

SEQ ID NO: 484662 - DNA, 20 bp, Artificial
  CRISPR gRNA sequence
ggaggctgaagcaggtgaat

SEQ ID NO: 484663 - DNA, 20 bp, Artificial
  CRISPR gRNA sequence
ctgaagcaggtgaatcagtt

SEQ ID NO: 484664 - DNA, 20 bp, Artificial
  CRISPR gRNA sequence
tgaagcaggtgaatcagttg

SEQ ID NO: 484665 - DNA, 20 bp, Artificial
  CRISPR gRNA sequence
gcaggtgaatcagttgaggt

SEQ ID NO: 484666 - DNA, 20 bp, Artificial
  CRISPR gRNA sequence
caggtgaatcagttgaggtc

SEQ ID NO: 484667 - DNA, 20 bp, Artificial
  CRISPR gRNA sequence
ggtgaatcagttgaggtcgg

SEQ ID NO: 484668 - DNA, 20 bp, Artificial
  CRISPR gRNA sequence
aatcagttgaggtcgggagt

SEQ ID NO: 484669 - DNA, 20 bp, Artificial
  CRISPR gRNA sequence
tcagttgaggtcgggagttg

SEQ ID NO: 484670 - DNA, 20 bp, Artificial
  CRISPR gRNA sequence
tgaggtcgggagttggagac

SEQ ID NO: 484671 - DNA, 20 bp, Artificial
  CRISPR gRNA sequence
gaggtcgggagttggagacc

SEQ ID NO: 484672 - DNA, 20 bp, Artificial
  CRISPR gRNA sequence
tcgggagttggagaccaggc

SEQ ID NO: 484673 - DNA, 20 bp, Artificial
  CRISPR gRNA sequence
ggagaccaggctggccaaca

SEQ ID NO: 484674 - DNA, 20 bp, Artificial
  CRISPR gRNA sequence
catctcgactaaaaatacaa

SEQ ID NO: 484675 - DNA, 20 bp, Artificial
  CRISPR gRNA sequence
tcgactaaaaatacaaaagt

SEQ ID NO: 484676 - DNA, 20 bp, Artificial
  CRISPR gRNA sequence
taaaaatacaaaagttagct

SEQ ID NO: 484677 - DNA, 20 bp, Artificial
  CRISPR gRNA sequence
atacaaaagttagctgagcg

SEQ ID NO: 484678 - DNA, 20 bp, Artificial
  CRISPR gRNA sequence
caaaagttagctgagcgtgg

SEQ ID NO: 484679 - DNA, 20 bp, Artificial
  CRISPR gRNA sequence
gtggcacgcgcccataatcc

SEQ ID NO: 484680 - DNA, 20 bp, Artificial
  CRISPR gRNA sequence
cgcccataatcccggctact

SEQ ID NO: 484681 - DNA, 20 bp, Artificial
  CRISPR gRNA sequence
gcccataatcccggctactc

SEQ ID NO: 484682 - DNA, 20 bp, Artificial
  CRISPR gRNA sequence
ccataatcccggctactcag

SEQ ID NO: 484683 - DNA, 20 bp, Artificial
  CRISPR gRNA sequence
cataatcccggctactcagg

SEQ ID NO: 484684 - DNA, 20 bp, Artificial
  CRISPR gRNA sequence
tcccggctactcaggaggct

SEQ ID NO: 484685 - DNA, 20 bp, Artificial
  CRISPR gRNA sequence
cccggctactcaggaggctg

SEQ ID NO: 484686 - DNA, 20 bp, Artificial
  CRISPR gRNA sequence
tactcaggaggctgaggcac

SEQ ID NO: 484687 - DNA, 20 bp, Artificial
  CRISPR gRNA sequence
gcacgagaatcacttgaacc

SEQ ID NO: 484688 - DNA, 20 bp, Artificial
  CRISPR gRNA sequence
cacgagaatcacttgaaccc

SEQ ID NO: 484689 - DNA, 20 bp, Artificial
  CRISPR gRNA sequence
gagaatcacttgaacccagg

SEQ ID NO: 484690 - DNA, 20 bp, Artificial
  CRISPR gRNA sequence
tcacttgaacccaggaagtc

SEQ ID NO: 484691 - DNA, 20 bp, Artificial
  CRISPR gRNA sequence
cacttgaacccaggaagtca

SEQ ID NO: 484692 - DNA, 20 bp, Artificial
  CRISPR gRNA sequence
aacccaggaagtcaaggctg

SEQ ID NO: 484693 - DNA, 20 bp, Artificial
  CRISPR gRNA sequence
caggaagtcaaggctgcagc

SEQ ID NO: 484694 - DNA, 20 bp, Artificial
  CRISPR gRNA sequence
agtcaaggctgcagcgagcc

SEQ ID NO: 484695 - DNA, 20 bp, Artificial
  CRISPR gRNA sequence
aaggctgcagcgagccaaga

SEQ ID NO: 484696 - DNA, 20 bp, Artificial
  CRISPR gRNA sequence
ggtgccactcccctcctgcc

SEQ ID NO: 484697 - DNA, 20 bp, Artificial
  CRISPR gRNA sequence
gtgccactcccctcctgcct

SEQ ID NO: 484698 - DNA, 20 bp, Artificial
  CRISPR gRNA sequence
cccctcctgcctgggtgaca

SEQ ID NO: 484699 - DNA, 20 bp, Artificial
  CRISPR gRNA sequence
tcctgcctgggtgacaaagt

SEQ ID NO: 484700 - DNA, 20 bp, Artificial
  CRISPR gRNA sequence
agtgagactgtctcaaaaaa

SEQ ID NO: 484701 - DNA, 20 bp, Artificial
  CRISPR gRNA sequence
tagtaataattttttaaatg

SEQ ID NO: 484702 - DNA, 20 bp, Artificial
  CRISPR gRNA sequence
ttttaaatgaagctgaaata

SEQ ID NO: 484703 - DNA, 20 bp, Artificial
  CRISPR gRNA sequence
agctgaaataaagacatttt

SEQ ID NO: 484704 - DNA, 20 bp, Artificial
  CRISPR gRNA sequence
tttttagaaaaaattaaaaa

SEQ ID NO: 484705 - DNA, 20 bp, Artificial
  CRISPR gRNA sequence
tagaaaaaattaaaaacgga

SEQ ID NO: 484706 - DNA, 20 bp, Artificial
  CRISPR gRNA sequence
cggaaagaatttgtcacaaa

SEQ ID NO: 484707 - DNA, 20 bp, Artificial
  CRISPR gRNA sequence
ggaaagaatttgtcacaaaa

SEQ ID NO: 484708 - DNA, 20 bp, Artificial
  CRISPR gRNA sequence
atttgtcacaaaaaggcctg

SEQ ID NO: 484709 - DNA, 20 bp, Artificial
  CRISPR gRNA sequence
tcacaaaaaggcctgcagta

SEQ ID NO: 484710 - DNA, 20 bp, Artificial
  CRISPR gRNA sequence
cacaaaaaggcctgcagtaa

SEQ ID NO: 484711 - DNA, 20 bp, Artificial
  CRISPR gRNA sequence
ctgcagtaaaggaaatacca

SEQ ID NO: 484712 - DNA, 20 bp, Artificial
  CRISPR gRNA sequence
tgcagtaaaggaaataccaa

SEQ ID NO: 484713 - DNA, 20 bp, Artificial
  CRISPR gRNA sequence
aaataccaaaggatgttctt

SEQ ID NO: 484714 - DNA, 20 bp, Artificial
  CRISPR gRNA sequence
aaggatgttctttagatata

SEQ ID NO: 484715 - DNA, 20 bp, Artificial
  CRISPR gRNA sequence
ttctttagatataaagaaaa

SEQ ID NO: 484716 - DNA, 20 bp, Artificial
  CRISPR gRNA sequence
atataaagaaaatggaaact

SEQ ID NO: 484717 - DNA, 20 bp, Artificial
  CRISPR gRNA sequence
tataaagaaaatggaaactc

SEQ ID NO: 484718 - DNA, 20 bp, Artificial
  CRISPR gRNA sequence
gaaaatggaaactcaggcac

SEQ ID NO: 484719 - DNA, 20 bp, Artificial
  CRISPR gRNA sequence
aatggaaactcaggcacaag

SEQ ID NO: 484720 - DNA, 20 bp, Artificial
  CRISPR gRNA sequence
gcacaagaagtgaaaaacaa

SEQ ID NO: 484721 - DNA, 20 bp, Artificial
  CRISPR gRNA sequence
gaagtgaaaaacaatagaaa

SEQ ID NO: 484722 - DNA, 20 bp, Artificial
  CRISPR gRNA sequence
gatgtaatttgtgacaataa

SEQ ID NO: 484723 - DNA, 20 bp, Artificial
  CRISPR gRNA sequence
gtaatttgtgacaataaaag

SEQ ID NO: 484724 - DNA, 20 bp, Artificial
  CRISPR gRNA sequence
taatttgtgacaataaaagt

SEQ ID NO: 484725 - DNA, 20 bp, Artificial
  CRISPR gRNA sequence
aatttgtgacaataaaagtg

SEQ ID NO: 484726 - DNA, 20 bp, Artificial
  CRISPR gRNA sequence
atttgtgacaataaaagtgg

SEQ ID NO: 484727 - DNA, 20 bp, Artificial
  CRISPR gRNA sequence
tttgtgacaataaaagtggg

SEQ ID NO: 484728 - DNA, 20 bp, Artificial
  CRISPR gRNA sequence
tgacaataaaagtgggggga

SEQ ID NO: 484729 - DNA, 20 bp, Artificial
  CRISPR gRNA sequence
acaataaaagtggggggata

SEQ ID NO: 484730 - DNA, 20 bp, Artificial
  CRISPR gRNA sequence
agtggggggatagagctgta

SEQ ID NO: 484731 - DNA, 20 bp, Artificial
  CRISPR gRNA sequence
gtggggggatagagctgtat

SEQ ID NO: 484732 - DNA, 20 bp, Artificial
  CRISPR gRNA sequence
ggggggatagagctgtatag

SEQ ID NO: 484733 - DNA, 20 bp, Artificial
  CRISPR gRNA sequence
agctgtataggagttttcta

SEQ ID NO: 484734 - DNA, 20 bp, Artificial
  CRISPR gRNA sequence
taggagttttctatagtatt

SEQ ID NO: 484735 - DNA, 20 bp, Artificial
  CRISPR gRNA sequence
aggagttttctatagtattg

SEQ ID NO: 484736 - DNA, 20 bp, Artificial
  CRISPR gRNA sequence
ctatagtattgaggctgaat

SEQ ID NO: 484737 - DNA, 20 bp, Artificial
  CRISPR gRNA sequence
atcaattcaaactatattgt

SEQ ID NO: 484738 - DNA, 20 bp, Artificial
  CRISPR gRNA sequence
caattcaaactatattgttg

SEQ ID NO: 484739 - DNA, 20 bp, Artificial
  CRISPR gRNA sequence
aattcaaactatattgttgg

SEQ ID NO: 484740 - DNA, 20 bp, Artificial
  CRISPR gRNA sequence
ggtattcattgtaatacctg

SEQ ID NO: 484741 - DNA, 20 bp, Artificial
  CRISPR gRNA sequence
taatacctgtggtaaccatt

SEQ ID NO: 484742 - DNA, 20 bp, Artificial
  CRISPR gRNA sequence
tgagaaaataacaaaatgta

SEQ ID NO: 484743 - DNA, 20 bp, Artificial
  CRISPR gRNA sequence
aataacaaaatgtacagaaa

SEQ ID NO: 484744 - DNA, 20 bp, Artificial
  CRISPR gRNA sequence
aaatgtacagaaaaagaaat

SEQ ID NO: 484745 - DNA, 20 bp, Artificial
  CRISPR gRNA sequence
tgtacagaaaaagaaatgag

SEQ ID NO: 484746 - DNA, 20 bp, Artificial
  CRISPR gRNA sequence
gtacagaaaaagaaatgaga

SEQ ID NO: 484747 - DNA, 20 bp, Artificial
  CRISPR gRNA sequence
tacagaaaaagaaatgagaa

SEQ ID NO: 484748 - DNA, 20 bp, Artificial
  CRISPR gRNA sequence
gaaatgagaagggaatcaaa

SEQ ID NO: 484749 - DNA, 20 bp, Artificial
  CRISPR gRNA sequence
agaagggaatcaaaaagatg

SEQ ID NO: 484750 - DNA, 20 bp, Artificial
  CRISPR gRNA sequence
aaaatatcaattaaatacaa

SEQ ID NO: 484751 - DNA, 20 bp, Artificial
  CRISPR gRNA sequence
atatcaattaaatacaaaag

SEQ ID NO: 484752 - DNA, 20 bp, Artificial
  CRISPR gRNA sequence
tatcaattaaatacaaaaga

SEQ ID NO: 484753 - DNA, 20 bp, Artificial
  CRISPR gRNA sequence
aatacaaaagaaggcaataa

SEQ ID NO: 484754 - DNA, 20 bp, Artificial
  CRISPR gRNA sequence
tacaaaagaaggcaataacg

SEQ ID NO: 484755 - DNA, 20 bp, Artificial
  CRISPR gRNA sequence
acggagaaaatgaacaaaaa

SEQ ID NO: 484756 - DNA, 20 bp, Artificial
  CRISPR gRNA sequence
aaatgaacaaaaaaagacat

SEQ ID NO: 484757 - DNA, 20 bp, Artificial
  CRISPR gRNA sequence
taagatgtataaaaaatata

SEQ ID NO: 484758 - DNA, 20 bp, Artificial
  CRISPR gRNA sequence
gtataaaaaatatacagaaa

SEQ ID NO: 484759 - DNA, 20 bp, Artificial
  CRISPR gRNA sequence
taaaaaatatacagaaatag

SEQ ID NO: 484760 - DNA, 20 bp, Artificial
  CRISPR gRNA sequence
aaaaaatatacagaaataga

SEQ ID NO: 484761 - DNA, 20 bp, Artificial
  CRISPR gRNA sequence
aggaaatgtcatcattataa

SEQ ID NO: 484762 - DNA, 20 bp, Artificial
  CRISPR gRNA sequence
tcattataaaagaaccaatt

SEQ ID NO: 484763 - DNA, 20 bp, Artificial
  CRISPR gRNA sequence
ttataaaagaaccaattaag

SEQ ID NO: 484764 - DNA, 20 bp, Artificial
  CRISPR gRNA sequence
tataaaagaaccaattaagt

SEQ ID NO: 484765 - DNA, 20 bp, Artificial
  CRISPR gRNA sequence
taggaataaacaatcatctt

SEQ ID NO: 484766 - DNA, 20 bp, Artificial
  CRISPR gRNA sequence
tcagtttctatgcatataac

SEQ ID NO: 484767 - DNA, 20 bp, Artificial
  CRISPR gRNA sequence
atatataaaataaaatttga

SEQ ID NO: 484768 - DNA, 20 bp, Artificial
  CRISPR gRNA sequence
ataaaatttgatagaactaa

SEQ ID NO: 484769 - DNA, 20 bp, Artificial
  CRISPR gRNA sequence
taaaatttgatagaactaaa

SEQ ID NO: 484770 - DNA, 20 bp, Artificial
  CRISPR gRNA sequence
aaatttgatagaactaaaag

SEQ ID NO: 484771 - DNA, 20 bp, Artificial
  CRISPR gRNA sequence
tttgatagaactaaaaggag

SEQ ID NO: 484772 - DNA, 20 bp, Artificial
  CRISPR gRNA sequence
gagaagtaaatccacaacta

SEQ ID NO: 484773 - DNA, 20 bp, Artificial
  CRISPR gRNA sequence
agtaaatccacaactatagt

SEQ ID NO: 484774 - DNA, 20 bp, Artificial
  CRISPR gRNA sequence
taaatccacaactatagttg

SEQ ID NO: 484775 - DNA, 20 bp, Artificial
  CRISPR gRNA sequence
aatccacaactatagttgga

SEQ ID NO: 484776 - DNA, 20 bp, Artificial
  CRISPR gRNA sequence
ttttattacatctgtctctc

SEQ ID NO: 484777 - DNA, 20 bp, Artificial
  CRISPR gRNA sequence
tctgtctctctagctgctac

SEQ ID NO: 484778 - DNA, 20 bp, Artificial
  CRISPR gRNA sequence
gtctctctagctgctacaag

SEQ ID NO: 484779 - DNA, 20 bp, Artificial
  CRISPR gRNA sequence
aagcacacaaaaaaatcaat

SEQ ID NO: 484780 - DNA, 20 bp, Artificial
  CRISPR gRNA sequence
agcacacaaaaaaatcaata

SEQ ID NO: 484781 - DNA, 20 bp, Artificial
  CRISPR gRNA sequence
aaaaaaatcaataaggctat

SEQ ID NO: 484782 - DNA, 20 bp, Artificial
  CRISPR gRNA sequence
aataaggctataagaatttg

SEQ ID NO: 484783 - DNA, 20 bp, Artificial
  CRISPR gRNA sequence
aacaattctcctaacaattg

SEQ ID NO: 484784 - DNA, 20 bp, Artificial
  CRISPR gRNA sequence
gcagaatacatattcttttc

SEQ ID NO: 484785 - DNA, 20 bp, Artificial
  CRISPR gRNA sequence
cttttcaagtgcacatgcaa

SEQ ID NO: 484786 - DNA, 20 bp, Artificial
  CRISPR gRNA sequence
tgcacatgcaatagttacca

SEQ ID NO: 484787 - DNA, 20 bp, Artificial
  CRISPR gRNA sequence
catatgctgtgcattaaaac

SEQ ID NO: 484788 - DNA, 20 bp, Artificial
  CRISPR gRNA sequence
cattaaaacaagtgtcaaca

SEQ ID NO: 484789 - DNA, 20 bp, Artificial
  CRISPR gRNA sequence
acaagtgtcaacaaagttca

SEQ ID NO: 484790 - DNA, 20 bp, Artificial
  CRISPR gRNA sequence
tcataccaattatgccctct

SEQ ID NO: 484791 - DNA, 20 bp, Artificial
  CRISPR gRNA sequence
ccaattatgccctctaagca

SEQ ID NO: 484792 - DNA, 20 bp, Artificial
  CRISPR gRNA sequence
attatgccctctaagcacag

SEQ ID NO: 484793 - DNA, 20 bp, Artificial
  CRISPR gRNA sequence
attaaacaaaaaatcaataa

SEQ ID NO: 484794 - DNA, 20 bp, Artificial
  CRISPR gRNA sequence
atcaataacagaaaaataac

SEQ ID NO: 484795 - DNA, 20 bp, Artificial
  CRISPR gRNA sequence
tctctgaatgtttaaaacat

SEQ ID NO: 484796 - DNA, 20 bp, Artificial
  CRISPR gRNA sequence
acatatttctaaaaacccat

SEQ ID NO: 484797 - DNA, 20 bp, Artificial
  CRISPR gRNA sequence
ttctaaaaacccatgagtca

SEQ ID NO: 484798 - DNA, 20 bp, Artificial
  CRISPR gRNA sequence
agaataaatcaaatgaaatt

SEQ ID NO: 484799 - DNA, 20 bp, Artificial
  CRISPR gRNA sequence
gaataaatcaaatgaaattt

SEQ ID NO: 484800 - DNA, 20 bp, Artificial
  CRISPR gRNA sequence
aatgaaatttgggaaatatt

SEQ ID NO: 484801 - DNA, 20 bp, Artificial
  CRISPR gRNA sequence
tgaaatttgggaaatattta

SEQ ID NO: 484802 - DNA, 20 bp, Artificial
  CRISPR gRNA sequence
tttgggaaatatttagagca

SEQ ID NO: 484803 - DNA, 20 bp, Artificial
  CRISPR gRNA sequence
atttagagcaaagtgataat

SEQ ID NO: 484804 - DNA, 20 bp, Artificial
  CRISPR gRNA sequence
tgagtatcaaatgtgcaata

SEQ ID NO: 484805 - DNA, 20 bp, Artificial
  CRISPR gRNA sequence
atcaaatgtgcaatatagct

SEQ ID NO: 484806 - DNA, 20 bp, Artificial
  CRISPR gRNA sequence
tcaaatgtgcaatatagcta

SEQ ID NO: 484807 - DNA, 20 bp, Artificial
  CRISPR gRNA sequence
aatgtgcaatatagctaagg

SEQ ID NO: 484808 - DNA, 20 bp, Artificial
  CRISPR gRNA sequence
aatatagctaaggcagtgtt

SEQ ID NO: 484809 - DNA, 20 bp, Artificial
  CRISPR gRNA sequence
tatagctaaggcagtgttta

SEQ ID NO: 484810 - DNA, 20 bp, Artificial
  CRISPR gRNA sequence
atagctaaggcagtgtttag

SEQ ID NO: 484811 - DNA, 20 bp, Artificial
  CRISPR gRNA sequence
tagctaaggcagtgtttaga

SEQ ID NO: 484812 - DNA, 20 bp, Artificial
  CRISPR gRNA sequence
agtgtttagagggaaattta

SEQ ID NO: 484813 - DNA, 20 bp, Artificial
  CRISPR gRNA sequence
atagctttaaatttgtatat

SEQ ID NO: 484814 - DNA, 20 bp, Artificial
  CRISPR gRNA sequence
tttaaatttgtatattggaa

SEQ ID NO: 484815 - DNA, 20 bp, Artificial
  CRISPR gRNA sequence
aatttgtatattggaaaaga

SEQ ID NO: 484816 - DNA, 20 bp, Artificial
  CRISPR gRNA sequence
tgtatattggaaaagaaaga

SEQ ID NO: 484817 - DNA, 20 bp, Artificial
  CRISPR gRNA sequence
ggaaaagaaagaaagtttgc

SEQ ID NO: 484818 - DNA, 20 bp, Artificial
  CRISPR gRNA sequence
agtttgcaagtcaataatgc

SEQ ID NO: 484819 - DNA, 20 bp, Artificial
  CRISPR gRNA sequence
ataatgcaagattcaatctc

SEQ ID NO: 484820 - DNA, 20 bp, Artificial
  CRISPR gRNA sequence
gattcaatctcaagaaacca

SEQ ID NO: 484821 - DNA, 20 bp, Artificial
  CRISPR gRNA sequence
atctcaagaaaccaaagaaa

SEQ ID NO: 484822 - DNA, 20 bp, Artificial
  CRISPR gRNA sequence
agaaaccaaagaaaaagaaa

SEQ ID NO: 484823 - DNA, 20 bp, Artificial
  CRISPR gRNA sequence
tgatgatgatgatgataatc

SEQ ID NO: 484824 - DNA, 20 bp, Artificial
  CRISPR gRNA sequence
atgatgatgatgataatcca

SEQ ID NO: 484825 - DNA, 20 bp, Artificial
  CRISPR gRNA sequence
tgatgatgataatccagaga

SEQ ID NO: 484826 - DNA, 20 bp, Artificial
  CRISPR gRNA sequence
gatgatgataatccagagaa

SEQ ID NO: 484827 - DNA, 20 bp, Artificial
  CRISPR gRNA sequence
tgatgataatccagagaaag

SEQ ID NO: 484828 - DNA, 20 bp, Artificial
  CRISPR gRNA sequence
gataatccagagaaaggaga

SEQ ID NO: 484829 - DNA, 20 bp, Artificial
  CRISPR gRNA sequence
ataatccagagaaaggagaa

SEQ ID NO: 484830 - DNA, 20 bp, Artificial
  CRISPR gRNA sequence
aatccagagaaaggagaaag

SEQ ID NO: 484831 - DNA, 20 bp, Artificial
  CRISPR gRNA sequence
cagagaaaggagaaaggaga

SEQ ID NO: 484832 - DNA, 20 bp, Artificial
  CRISPR gRNA sequence
agaaaggagaaagtaaatgt

SEQ ID NO: 484833 - DNA, 20 bp, Artificial
  CRISPR gRNA sequence
aaaggagaaagtaaatgtaa

SEQ ID NO: 484834 - DNA, 20 bp, Artificial
  CRISPR gRNA sequence
gctaacttcaataaaataaa

SEQ ID NO: 484835 - DNA, 20 bp, Artificial
  CRISPR gRNA sequence
aataaaaagcaaatacacaa

SEQ ID NO: 484836 - DNA, 20 bp, Artificial
  CRISPR gRNA sequence
taaaaagcaaatacacaata

SEQ ID NO: 484837 - DNA, 20 bp, Artificial
  CRISPR gRNA sequence
aaatacacaatagagaaaat

SEQ ID NO: 484838 - DNA, 20 bp, Artificial
  CRISPR gRNA sequence
cacaatagagaaaattagca

SEQ ID NO: 484839 - DNA, 20 bp, Artificial
  CRISPR gRNA sequence
gagaaaattagcaaagccaa

SEQ ID NO: 484840 - DNA, 20 bp, Artificial
  CRISPR gRNA sequence
aaagtaaattcattaaataa

SEQ ID NO: 484841 - DNA, 20 bp, Artificial
  CRISPR gRNA sequence
agtgttaaaatgtatatacc

SEQ ID NO: 484842 - DNA, 20 bp, Artificial
  CRISPR gRNA sequence
aatgtatatacctggtgctt

SEQ ID NO: 484843 - DNA, 20 bp, Artificial
  CRISPR gRNA sequence
tgtatatacctggtgctttg

SEQ ID NO: 484844 - DNA, 20 bp, Artificial
  CRISPR gRNA sequence
gtatatacctggtgctttgg

SEQ ID NO: 484845 - DNA, 20 bp, Artificial
  CRISPR gRNA sequence
ttggaggtgccttcaccacc

SEQ ID NO: 484846 - DNA, 20 bp, Artificial
  CRISPR gRNA sequence
ggaggtgccttcaccaccta

SEQ ID NO: 484847 - DNA, 20 bp, Artificial
  CRISPR gRNA sequence
gagtctcttgctatcaaccg

SEQ ID NO: 484848 - DNA, 20 bp, Artificial
  CRISPR gRNA sequence
ccccaccatgttcattaata

SEQ ID NO: 484849 - DNA, 20 bp, Artificial
  CRISPR gRNA sequence
caccatgttcattaatatag

SEQ ID NO: 484850 - DNA, 20 bp, Artificial
  CRISPR gRNA sequence
agcagttgaccatgaaccct

SEQ ID NO: 484851 - DNA, 20 bp, Artificial
  CRISPR gRNA sequence
acccttggaccgtgtctcct

SEQ ID NO: 484852 - DNA, 20 bp, Artificial
  CRISPR gRNA sequence
ccttggaccgtgtctccttg

SEQ ID NO: 484853 - DNA, 20 bp, Artificial
  CRISPR gRNA sequence
cttggagctgtttgcacata

SEQ ID NO: 484854 - DNA, 20 bp, Artificial
  CRISPR gRNA sequence
tgtttgcacataaagttcca

SEQ ID NO: 484855 - DNA, 20 bp, Artificial
  CRISPR gRNA sequence
tgcacataaagttccaaaga

SEQ ID NO: 484856 - DNA, 20 bp, Artificial
  CRISPR gRNA sequence
acataaagttccaaagacag

SEQ ID NO: 484857 - DNA, 20 bp, Artificial
  CRISPR gRNA sequence
gcagaaaacatttgtgttct

SEQ ID NO: 484858 - DNA, 20 bp, Artificial
  CRISPR gRNA sequence
aacatttgtgttctgagcac

SEQ ID NO: 484859 - DNA, 20 bp, Artificial
  CRISPR gRNA sequence
catttgtgttctgagcacta

SEQ ID NO: 484860 - DNA, 20 bp, Artificial
  CRISPR gRNA sequence
tttgtgttctgagcactaga

SEQ ID NO: 484861 - DNA, 20 bp, Artificial
  CRISPR gRNA sequence
agcactagagagaaatgatt

SEQ ID NO: 484862 - DNA, 20 bp, Artificial
  CRISPR gRNA sequence
gagagaaatgatttggttac

SEQ ID NO: 484863 - DNA, 20 bp, Artificial
  CRISPR gRNA sequence
gagaaatgatttggttacaa

SEQ ID NO: 484864 - DNA, 20 bp, Artificial
  CRISPR gRNA sequence
tacaagagctcctgctctca

SEQ ID NO: 484865 - DNA, 20 bp, Artificial
  CRISPR gRNA sequence
acaagagctcctgctctcac

SEQ ID NO: 484866 - DNA, 20 bp, Artificial
  CRISPR gRNA sequence
ctgctctcacaggattattg

SEQ ID NO: 484867 - DNA, 20 bp, Artificial
  CRISPR gRNA sequence
ttattgcagaatttatgtgc

SEQ ID NO: 484868 - DNA, 20 bp, Artificial
  CRISPR gRNA sequence
tattgcagaatttatgtgcc

SEQ ID NO: 484869 - DNA, 20 bp, Artificial
  CRISPR gRNA sequence
gttgacatcacacaccataa

SEQ ID NO: 484870 - DNA, 20 bp, Artificial
  CRISPR gRNA sequence
atcacacaccataatggcac

SEQ ID NO: 484871 - DNA, 20 bp, Artificial
  CRISPR gRNA sequence
acacaccataatggcactgg

SEQ ID NO: 484872 - DNA, 20 bp, Artificial
  CRISPR gRNA sequence
accataatggcactggtggc

SEQ ID NO: 484873 - DNA, 20 bp, Artificial
  CRISPR gRNA sequence
actggtggcaagttcatcta

SEQ ID NO: 484874 - DNA, 20 bp, Artificial
  CRISPR gRNA sequence
ctggtggcaagttcatctat

SEQ ID NO: 484875 - DNA, 20 bp, Artificial
  CRISPR gRNA sequence
tggtggcaagttcatctatg

SEQ ID NO: 484876 - DNA, 20 bp, Artificial
  CRISPR gRNA sequence
atctatggggtgaaatttga

SEQ ID NO: 484877 - DNA, 20 bp, Artificial
  CRISPR gRNA sequence
atggggtgaaatttgatggt

SEQ ID NO: 484878 - DNA, 20 bp, Artificial
  CRISPR gRNA sequence
atggtgagaacttcatcctg

SEQ ID NO: 484879 - DNA, 20 bp, Artificial
  CRISPR gRNA sequence
gaacttcatcctgaagcata

SEQ ID NO: 484880 - DNA, 20 bp, Artificial
  CRISPR gRNA sequence
aacttcatcctgaagcatac

SEQ ID NO: 484881 - DNA, 20 bp, Artificial
  CRISPR gRNA sequence
atcctgaagcatacaggtct

SEQ ID NO: 484882 - DNA, 20 bp, Artificial
  CRISPR gRNA sequence
aggtcttggcatcttgtcca

SEQ ID NO: 484883 - DNA, 20 bp, Artificial
  CRISPR gRNA sequence
atcttgtccatggcaaatgc

SEQ ID NO: 484884 - DNA, 20 bp, Artificial
  CRISPR gRNA sequence
aatgctggacccaacacaaa

SEQ ID NO: 484885 - DNA, 20 bp, Artificial
  CRISPR gRNA sequence
gacccaacacaaatagttcc

SEQ ID NO: 484886 - DNA, 20 bp, Artificial
  CRISPR gRNA sequence
agtttttcatctacattgcc

SEQ ID NO: 484887 - DNA, 20 bp, Artificial
  CRISPR gRNA sequence
tctacattgccgagactgaa

SEQ ID NO: 484888 - DNA, 20 bp, Artificial
  CRISPR gRNA sequence
cattgccgagactgaatgga

SEQ ID NO: 484889 - DNA, 20 bp, Artificial
  CRISPR gRNA sequence
gccgagactgaatggatgga

SEQ ID NO: 484890 - DNA, 20 bp, Artificial
  CRISPR gRNA sequence
agactgaatggatggatggc

SEQ ID NO: 484891 - DNA, 20 bp, Artificial
  CRISPR gRNA sequence
atggatggatggcaagcgtg

SEQ ID NO: 484892 - DNA, 20 bp, Artificial
  CRISPR gRNA sequence
gatggcaagcgtgtggtatt

SEQ ID NO: 484893 - DNA, 20 bp, Artificial
  CRISPR gRNA sequence
gcaagcgtgtggtatttggc

SEQ ID NO: 484894 - DNA, 20 bp, Artificial
  CRISPR gRNA sequence
tgtggtatttggcaagttga

SEQ ID NO: 484895 - DNA, 20 bp, Artificial
  CRISPR gRNA sequence
gtggtatttggcaagttgaa

SEQ ID NO: 484896 - DNA, 20 bp, Artificial
  CRISPR gRNA sequence
tggtatttggcaagttgaaa

SEQ ID NO: 484897 - DNA, 20 bp, Artificial
  CRISPR gRNA sequence
ggtatttggcaagttgaaag

SEQ ID NO: 484898 - DNA, 20 bp, Artificial
  CRISPR gRNA sequence
gtatttggcaagttgaaagg

SEQ ID NO: 484899 - DNA, 20 bp, Artificial
  CRISPR gRNA sequence
gaaagggggcatgaatattg

SEQ ID NO: 484900 - DNA, 20 bp, Artificial
  CRISPR gRNA sequence
gggggcatgaatattgcaga

SEQ ID NO: 484901 - DNA, 20 bp, Artificial
  CRISPR gRNA sequence
catgaatattgcagacagca

SEQ ID NO: 484902 - DNA, 20 bp, Artificial
  CRISPR gRNA sequence
tgaatattgcagacagcatg

SEQ ID NO: 484903 - DNA, 20 bp, Artificial
  CRISPR gRNA sequence
gcagacagcatggagccctt

SEQ ID NO: 484904 - DNA, 20 bp, Artificial
  CRISPR gRNA sequence
cagacagcatggagcccttt

SEQ ID NO: 484905 - DNA, 20 bp, Artificial
  CRISPR gRNA sequence
agcatggagccctttgggtc

SEQ ID NO: 484906 - DNA, 20 bp, Artificial
  CRISPR gRNA sequence
gcatggagccctttgggtcc

SEQ ID NO: 484907 - DNA, 20 bp, Artificial
  CRISPR gRNA sequence
gagccctttgggtccaggaa

SEQ ID NO: 484908 - DNA, 20 bp, Artificial
  CRISPR gRNA sequence
cctttgggtccaggaatggc

SEQ ID NO: 484909 - DNA, 20 bp, Artificial
  CRISPR gRNA sequence
gggtccaggaatggcaagac

SEQ ID NO: 484910 - DNA, 20 bp, Artificial
  CRISPR gRNA sequence
ccaggaatggcaagaccagc

SEQ ID NO: 484911 - DNA, 20 bp, Artificial
  CRISPR gRNA sequence
ggaatggcaagaccagcaag

SEQ ID NO: 484912 - DNA, 20 bp, Artificial
  CRISPR gRNA sequence
gcaagaagatcaccattgct

SEQ ID NO: 484913 - DNA, 20 bp, Artificial
  CRISPR gRNA sequence
aagatcaccattgctgagtg

SEQ ID NO: 484914 - DNA, 20 bp, Artificial
  CRISPR gRNA sequence
tctaatctgatataaatcaa

SEQ ID NO: 484915 - DNA, 20 bp, Artificial
  CRISPR gRNA sequence
aaatcaaaagaccctcattt

SEQ ID NO: 484916 - DNA, 20 bp, Artificial
  CRISPR gRNA sequence
atcaaaagaccctcatttca

SEQ ID NO: 484917 - DNA, 20 bp, Artificial
  CRISPR gRNA sequence
aaaagaccctcatttcagag

SEQ ID NO: 484918 - DNA, 20 bp, Artificial
  CRISPR gRNA sequence
tttcagagaagttcctgcct

SEQ ID NO: 484919 - DNA, 20 bp, Artificial
  CRISPR gRNA sequence
gaagttcctgcctcagattc

SEQ ID NO: 484920 - DNA, 20 bp, Artificial
  CRISPR gRNA sequence
agttcctgcctcagattcta

SEQ ID NO: 484921 - DNA, 20 bp, Artificial
  CRISPR gRNA sequence
cctgcctcagattctagaga

SEQ ID NO: 484922 - DNA, 20 bp, Artificial
  CRISPR gRNA sequence
ctagagaaagaaatgctaca

SEQ ID NO: 484923 - DNA, 20 bp, Artificial
  CRISPR gRNA sequence
agagaaagaaatgctacaca

SEQ ID NO: 484924 - DNA, 20 bp, Artificial
  CRISPR gRNA sequence
agaaagaaatgctacacaga

SEQ ID NO: 484925 - DNA, 20 bp, Artificial
  CRISPR gRNA sequence
aaatgctacacagagagacc

SEQ ID NO: 484926 - DNA, 20 bp, Artificial
  CRISPR gRNA sequence
tgctacacagagagaccaag

SEQ ID NO: 484927 - DNA, 20 bp, Artificial
  CRISPR gRNA sequence
gagaccaagaagaatctgaa

SEQ ID NO: 484928 - DNA, 20 bp, Artificial
  CRISPR gRNA sequence
ccaagaagaatctgaacaga

SEQ ID NO: 484929 - DNA, 20 bp, Artificial
  CRISPR gRNA sequence
caagaagaatctgaacagac

SEQ ID NO: 484930 - DNA, 20 bp, Artificial
  CRISPR gRNA sequence
tctgaacagacaggccttgc

SEQ ID NO: 484931 - DNA, 20 bp, Artificial
  CRISPR gRNA sequence
ctgaacagacaggccttgct

SEQ ID NO: 484932 - DNA, 20 bp, Artificial
  CRISPR gRNA sequence
ccttgctgggtttctccact

SEQ ID NO: 484933 - DNA, 20 bp, Artificial
  CRISPR gRNA sequence
ggtttctccactcagcctgt

SEQ ID NO: 484934 - DNA, 20 bp, Artificial
  CRISPR gRNA sequence
ctccactcagcctgttagta

SEQ ID NO: 484935 - DNA, 20 bp, Artificial
  CRISPR gRNA sequence
ggaatcatacccttttcatc

SEQ ID NO: 484936 - DNA, 20 bp, Artificial
  CRISPR gRNA sequence
tcatccagtcacatttctac

SEQ ID NO: 484937 - DNA, 20 bp, Artificial
  CRISPR gRNA sequence
catccagtcacatttctaca

SEQ ID NO: 484938 - DNA, 20 bp, Artificial
  CRISPR gRNA sequence
tcacatttctacaaggttgt

SEQ ID NO: 484939 - DNA, 20 bp, Artificial
  CRISPR gRNA sequence
ggttgttggtcatgcctatg

SEQ ID NO: 484940 - DNA, 20 bp, Artificial
  CRISPR gRNA sequence
ttggtcatgcctatgaagtg

SEQ ID NO: 484941 - DNA, 20 bp, Artificial
  CRISPR gRNA sequence
tgaagtctccataaaaaccc

SEQ ID NO: 484942 - DNA, 20 bp, Artificial
  CRISPR gRNA sequence
aagtctccataaaaacccaa

SEQ ID NO: 484943 - DNA, 20 bp, Artificial
  CRISPR gRNA sequence
agtctccataaaaacccaag

SEQ ID NO: 484944 - DNA, 20 bp, Artificial
  CRISPR gRNA sequence
ccataaaaacccaagaggac

SEQ ID NO: 484945 - DNA, 20 bp, Artificial
  CRISPR gRNA sequence
cataaaaacccaagaggact

SEQ ID NO: 484946 - DNA, 20 bp, Artificial
  CRISPR gRNA sequence
aaacccaagaggactgggct

SEQ ID NO: 484947 - DNA, 20 bp, Artificial
  CRISPR gRNA sequence
acccaagaggactgggcttg

SEQ ID NO: 484948 - DNA, 20 bp, Artificial
  CRISPR gRNA sequence
ccaagaggactgggcttgga

SEQ ID NO: 484949 - DNA, 20 bp, Artificial
  CRISPR gRNA sequence
gactgggcttggagagcctc

SEQ ID NO: 484950 - DNA, 20 bp, Artificial
  CRISPR gRNA sequence
gggcttggagagcctccaga

SEQ ID NO: 484951 - DNA, 20 bp, Artificial
  CRISPR gRNA sequence
ttggagagcctccagatagc

SEQ ID NO: 484952 - DNA, 20 bp, Artificial
  CRISPR gRNA sequence
ggagagcctccagatagctg

SEQ ID NO: 484953 - DNA, 20 bp, Artificial
  CRISPR gRNA sequence
tccagatagctggagattcc

SEQ ID NO: 484954 - DNA, 20 bp, Artificial
  CRISPR gRNA sequence
agctggagattcctggcatg

SEQ ID NO: 484955 - DNA, 20 bp, Artificial
  CRISPR gRNA sequence
ttcctggcatgcagtgtgcc

SEQ ID NO: 484956 - DNA, 20 bp, Artificial
  CRISPR gRNA sequence
tcctggcatgcagtgtgccc

SEQ ID NO: 484957 - DNA, 20 bp, Artificial
  CRISPR gRNA sequence
cctggcatgcagtgtgccca

SEQ ID NO: 484958 - DNA, 20 bp, Artificial
  CRISPR gRNA sequence
ggcatgcagtgtgcccaggg

SEQ ID NO: 484959 - DNA, 20 bp, Artificial
  CRISPR gRNA sequence
gcatgcagtgtgcccaggga

SEQ ID NO: 484960 - DNA, 20 bp, Artificial
  CRISPR gRNA sequence
cagtgtgcccagggaaggca

SEQ ID NO: 484961 - DNA, 20 bp, Artificial
  CRISPR gRNA sequence
tgtgcccagggaaggcatgg

SEQ ID NO: 484962 - DNA, 20 bp, Artificial
  CRISPR gRNA sequence
ctttgtaatatctcttataa

SEQ ID NO: 484963 - DNA, 20 bp, Artificial
  CRISPR gRNA sequence
taatatctcttataatagac

SEQ ID NO: 484964 - DNA, 20 bp, Artificial
  CRISPR gRNA sequence
agcaaacataaatgtttccc

SEQ ID NO: 484965 - DNA, 20 bp, Artificial
  CRISPR gRNA sequence
aatgtttccctggtttatgt

SEQ ID NO: 484966 - DNA, 20 bp, Artificial
  CRISPR gRNA sequence
ctggtttatgtgagccactc

SEQ ID NO: 484967 - DNA, 20 bp, Artificial
  CRISPR gRNA sequence
ccagcaaattaattgaaccc

SEQ ID NO: 484968 - DNA, 20 bp, Artificial
  CRISPR gRNA sequence
cagcaaattaattgaaccca

SEQ ID NO: 484969 - DNA, 20 bp, Artificial
  CRISPR gRNA sequence
gcaaattaattgaacccaag

SEQ ID NO: 484970 - DNA, 20 bp, Artificial
  CRISPR gRNA sequence
caaattaattgaacccaagg

SEQ ID NO: 484971 - DNA, 20 bp, Artificial
  CRISPR gRNA sequence
aaattaattgaacccaagga

SEQ ID NO: 484972 - DNA, 20 bp, Artificial
  CRISPR gRNA sequence
aattaattgaacccaaggag

SEQ ID NO: 484973 - DNA, 20 bp, Artificial
  CRISPR gRNA sequence
attaattgaacccaaggagg

SEQ ID NO: 484974 - DNA, 20 bp, Artificial
  CRISPR gRNA sequence
gaacccaaggagggggttgt

SEQ ID NO: 484975 - DNA, 20 bp, Artificial
  CRISPR gRNA sequence
ggggttgtgagaaccccaac

SEQ ID NO: 484976 - DNA, 20 bp, Artificial
  CRISPR gRNA sequence
gttgtgagaaccccaactgg

SEQ ID NO: 484977 - DNA, 20 bp, Artificial
  CRISPR gRNA sequence
tgagaaccccaactggaagc

SEQ ID NO: 484978 - DNA, 20 bp, Artificial
  CRISPR gRNA sequence
aaccccaactggaagctggt

SEQ ID NO: 484979 - DNA, 20 bp, Artificial
  CRISPR gRNA sequence
actggaagctggttggtccg

SEQ ID NO: 484980 - DNA, 20 bp, Artificial
  CRISPR gRNA sequence
agctggttggtccgaagttc

SEQ ID NO: 484981 - DNA, 20 bp, Artificial
  CRISPR gRNA sequence
ctggttggtccgaagttctg

SEQ ID NO: 484982 - DNA, 20 bp, Artificial
  CRISPR gRNA sequence
tggttggtccgaagttctgg

SEQ ID NO: 484983 - DNA, 20 bp, Artificial
  CRISPR gRNA sequence
ggtccgaagttctggaggcc

SEQ ID NO: 484984 - DNA, 20 bp, Artificial
  CRISPR gRNA sequence
aagttctggaggcccagact

SEQ ID NO: 484985 - DNA, 20 bp, Artificial
  CRISPR gRNA sequence
tggaggcccagacttagaac

SEQ ID NO: 484986 - DNA, 20 bp, Artificial
  CRISPR gRNA sequence
gcccagacttagaactggtg

SEQ ID NO: 484987 - DNA, 20 bp, Artificial
  CRISPR gRNA sequence
cagacttagaactggtgtgg

SEQ ID NO: 484988 - DNA, 20 bp, Artificial
  CRISPR gRNA sequence
gacttagaactggtgtggtg

SEQ ID NO: 484989 - DNA, 20 bp, Artificial
  CRISPR gRNA sequence
acttagaactggtgtggtgg

SEQ ID NO: 484990 - DNA, 20 bp, Artificial
  CRISPR gRNA sequence
cttagaactggtgtggtgga

SEQ ID NO: 484991 - DNA, 20 bp, Artificial
  CRISPR gRNA sequence
ttagaactggtgtggtggag

SEQ ID NO: 484992 - DNA, 20 bp, Artificial
  CRISPR gRNA sequence
gaactggtgtggtggagggg

SEQ ID NO: 484993 - DNA, 20 bp, Artificial
  CRISPR gRNA sequence
gtgtggtggaggggtggtgt

SEQ ID NO: 484994 - DNA, 20 bp, Artificial
  CRISPR gRNA sequence
tgtggtggaggggtggtgtt

SEQ ID NO: 484995 - DNA, 20 bp, Artificial
  CRISPR gRNA sequence
gtggtggaggggtggtgttg

SEQ ID NO: 484996 - DNA, 20 bp, Artificial
  CRISPR gRNA sequence
gaggggtggtgttggggact

SEQ ID NO: 484997 - DNA, 20 bp, Artificial
  CRISPR gRNA sequence
ggtgttggggactgagcccc

SEQ ID NO: 484998 - DNA, 20 bp, Artificial
  CRISPR gRNA sequence
gactgagcccccagcctctg

SEQ ID NO: 484999 - DNA, 20 bp, Artificial
  CRISPR gRNA sequence
ctgtggtctgacactctctc

SEQ ID NO: 485000 - DNA, 20 bp, Artificial
  CRISPR gRNA sequence
ggtctgacactctctccagt

SEQ ID NO: 485001 - DNA, 20 bp, Artificial
  CRISPR gRNA sequence
agttagtgtctgaactgaat

SEQ ID NO: 485002 - DNA, 20 bp, Artificial
  CRISPR gRNA sequence
ttagtgtctgaactgaattg

SEQ ID NO: 485003 - DNA, 20 bp, Artificial
  CRISPR gRNA sequence
gaactgaattggagaacacc

SEQ ID NO: 485004 - DNA, 20 bp, Artificial
  CRISPR gRNA sequence
tgaattggagaacacccagc

SEQ ID NO: 485005 - DNA, 20 bp, Artificial
  CRISPR gRNA sequence
cacccagctggtgtccactg

SEQ ID NO: 485006 - DNA, 20 bp, Artificial
  CRISPR gRNA sequence
ccactgcagaatacattatt

SEQ ID NO: 485007 - DNA, 20 bp, Artificial
  CRISPR gRNA sequence
tacattattcagtttgctgt

SEQ ID NO: 485008 - DNA, 20 bp, Artificial
  CRISPR gRNA sequence
acattattcagtttgctgtg

SEQ ID NO: 485009 - DNA, 20 bp, Artificial
  CRISPR gRNA sequence
attattcagtttgctgtgag

SEQ ID NO: 485010 - DNA, 20 bp, Artificial
  CRISPR gRNA sequence
gaaatccacctccctgcatt

SEQ ID NO: 485011 - DNA, 20 bp, Artificial
  CRISPR gRNA sequence
cacctccctgcatttggtca

SEQ ID NO: 485012 - DNA, 20 bp, Artificial
  CRISPR gRNA sequence
ctccctgcatttggtcacag

SEQ ID NO: 485013 - DNA, 20 bp, Artificial
  CRISPR gRNA sequence
tgattgttattattttgatg

SEQ ID NO: 485014 - DNA, 20 bp, Artificial
  CRISPR gRNA sequence
gattgttattattttgatgt

SEQ ID NO: 485015 - DNA, 20 bp, Artificial
  CRISPR gRNA sequence
ttgttattattttgatgtgg

SEQ ID NO: 485016 - DNA, 20 bp, Artificial
  CRISPR gRNA sequence
ttattattttgatgtgggag

SEQ ID NO: 485017 - DNA, 20 bp, Artificial
  CRISPR gRNA sequence
attattttgatgtgggagca

SEQ ID NO: 485018 - DNA, 20 bp, Artificial
  CRISPR gRNA sequence
ttattttgatgtgggagcag

SEQ ID NO: 485019 - DNA, 20 bp, Artificial
  CRISPR gRNA sequence
gtgggagcagaggaaaaaca

SEQ ID NO: 485020 - DNA, 20 bp, Artificial
  CRISPR gRNA sequence
gagcagaggaaaaacatggt

SEQ ID NO: 485021 - DNA, 20 bp, Artificial
  CRISPR gRNA sequence
gcagaggaaaaacatggttg

SEQ ID NO: 485022 - DNA, 20 bp, Artificial
  CRISPR gRNA sequence
agaggaaaaacatggttgga

SEQ ID NO: 485023 - DNA, 20 bp, Artificial
  CRISPR gRNA sequence
gaggaaaaacatggttggag

SEQ ID NO: 485024 - DNA, 20 bp, Artificial
  CRISPR gRNA sequence
ttttttttttgttttacttt

SEQ ID NO: 485025 - DNA, 20 bp, Artificial
  CRISPR gRNA sequence
ttttgttttactttaagttc

SEQ ID NO: 485026 - DNA, 20 bp, Artificial
  CRISPR gRNA sequence
tttgttttactttaagttct

SEQ ID NO: 485027 - DNA, 20 bp, Artificial
  CRISPR gRNA sequence
taagttctgggatacgtatg

SEQ ID NO: 485028 - DNA, 20 bp, Artificial
  CRISPR gRNA sequence
ggatacgtatgcagaacatg

SEQ ID NO: 485029 - DNA, 20 bp, Artificial
  CRISPR gRNA sequence
gaacatgcagatttgttacg

SEQ ID NO: 485030 - DNA, 20 bp, Artificial
  CRISPR gRNA sequence
aacatgcagatttgttacgt

SEQ ID NO: 485031 - DNA, 20 bp, Artificial
  CRISPR gRNA sequence
acgtaggtatacgtgtgcca

SEQ ID NO: 485032 - DNA, 20 bp, Artificial
  CRISPR gRNA sequence
taggtatacgtgtgccatgg

SEQ ID NO: 485033 - DNA, 20 bp, Artificial
  CRISPR gRNA sequence
gcacctatcaacccatcatc

SEQ ID NO: 485034 - DNA, 20 bp, Artificial
  CRISPR gRNA sequence
cacctatcaacccatcatct

SEQ ID NO: 485035 - DNA, 20 bp, Artificial
  CRISPR gRNA sequence
caacccatcatctaggtttt

SEQ ID NO: 485036 - DNA, 20 bp, Artificial
  CRISPR gRNA sequence
gttttaagccccacatgcat

SEQ ID NO: 485037 - DNA, 20 bp, Artificial
  CRISPR gRNA sequence
ttttaagccccacatgcatt

SEQ ID NO: 485038 - DNA, 20 bp, Artificial
  CRISPR gRNA sequence
ccttgcccctcacccactaa

SEQ ID NO: 485039 - DNA, 20 bp, Artificial
  CRISPR gRNA sequence
cttgcccctcacccactaac

SEQ ID NO: 485040 - DNA, 20 bp, Artificial
  CRISPR gRNA sequence
cctcacccactaacaggccc

SEQ ID NO: 485041 - DNA, 20 bp, Artificial
  CRISPR gRNA sequence
cattgttcaactcccacttt

SEQ ID NO: 485042 - DNA, 20 bp, Artificial
  CRISPR gRNA sequence
gttcaactcccactttgagt

SEQ ID NO: 485043 - DNA, 20 bp, Artificial
  CRISPR gRNA sequence
ccactttgagtgagaacacg

SEQ ID NO: 485044 - DNA, 20 bp, Artificial
  CRISPR gRNA sequence
gagtgagaacacgtggtgtt

SEQ ID NO: 485045 - DNA, 20 bp, Artificial
  CRISPR gRNA sequence
ttggttttctgttcctgtgt

SEQ ID NO: 485046 - DNA, 20 bp, Artificial
  CRISPR gRNA sequence
tgttcctgtgttagtttgct

SEQ ID NO: 485047 - DNA, 20 bp, Artificial
  CRISPR gRNA sequence
tgttagtttgctgagaacga

SEQ ID NO: 485048 - DNA, 20 bp, Artificial
  CRISPR gRNA sequence
ttgctgagaacgatggcttc

SEQ ID NO: 485049 - DNA, 20 bp, Artificial
  CRISPR gRNA sequence
catccatgtccctgcaaact

SEQ ID NO: 485050 - DNA, 20 bp, Artificial
  CRISPR gRNA sequence
atccatgtccctgcaaactc

SEQ ID NO: 485051 - DNA, 20 bp, Artificial
  CRISPR gRNA sequence
tgtccctgcaaactcaggaa

SEQ ID NO: 485052 - DNA, 20 bp, Artificial
  CRISPR gRNA sequence
tgcaaactcaggaacagaaa

SEQ ID NO: 485053 - DNA, 20 bp, Artificial
  CRISPR gRNA sequence
gcaaactcaggaacagaaaa

SEQ ID NO: 485054 - DNA, 20 bp, Artificial
  CRISPR gRNA sequence
tcttttaatcaacattgtac

SEQ ID NO: 485055 - DNA, 20 bp, Artificial
  CRISPR gRNA sequence
ttttaatcaacattgtactg

SEQ ID NO: 485056 - DNA, 20 bp, Artificial
  CRISPR gRNA sequence
tttaatcaacattgtactgg

SEQ ID NO: 485057 - DNA, 20 bp, Artificial
  CRISPR gRNA sequence
caacattgtactggaggtca

SEQ ID NO: 485058 - DNA, 20 bp, Artificial
  CRISPR gRNA sequence
attgtactggaggtcatggc

SEQ ID NO: 485059 - DNA, 20 bp, Artificial
  CRISPR gRNA sequence
catggctagttcaacaaaac

SEQ ID NO: 485060 - DNA, 20 bp, Artificial
  CRISPR gRNA sequence
atggctagttcaacaaaaca

SEQ ID NO: 485061 - DNA, 20 bp, Artificial
  CRISPR gRNA sequence
gttcaacaaaacaaggaaaa

SEQ ID NO: 485062 - DNA, 20 bp, Artificial
  CRISPR gRNA sequence
caaaacaaggaaaatagtca

SEQ ID NO: 485063 - DNA, 20 bp, Artificial
  CRISPR gRNA sequence
aaaacaaggaaaatagtcaa

SEQ ID NO: 485064 - DNA, 20 bp, Artificial
  CRISPR gRNA sequence
aaacaaggaaaatagtcaaa

SEQ ID NO: 485065 - DNA, 20 bp, Artificial
  CRISPR gRNA sequence
tagtcaaagggaataaaaat

SEQ ID NO: 485066 - DNA, 20 bp, Artificial
  CRISPR gRNA sequence
aaaattagaaatgaatatgt

SEQ ID NO: 485067 - DNA, 20 bp, Artificial
  CRISPR gRNA sequence
aaattagaaatgaatatgtg

SEQ ID NO: 485068 - DNA, 20 bp, Artificial
  CRISPR gRNA sequence
tagaaatgaatatgtgaggc

SEQ ID NO: 485069 - DNA, 20 bp, Artificial
  CRISPR gRNA sequence
agaaatgaatatgtgaggct

SEQ ID NO: 485070 - DNA, 20 bp, Artificial
  CRISPR gRNA sequence
tgaatatgtgaggctgggcg

SEQ ID NO: 485071 - DNA, 20 bp, Artificial
  CRISPR gRNA sequence
atatgtgaggctgggcgcag

SEQ ID NO: 485072 - DNA, 20 bp, Artificial
  CRISPR gRNA sequence
gtggctcacgcctgtaatcc

SEQ ID NO: 485073 - DNA, 20 bp, Artificial
  CRISPR gRNA sequence
cgcctgtaatcccagcactt

SEQ ID NO: 485074 - DNA, 20 bp, Artificial
  CRISPR gRNA sequence
gcctgtaatcccagcacttt

SEQ ID NO: 485075 - DNA, 20 bp, Artificial
  CRISPR gRNA sequence
tgtaatcccagcactttggg

SEQ ID NO: 485076 - DNA, 20 bp, Artificial
  CRISPR gRNA sequence
gcactttgggcagctcacct

SEQ ID NO: 485077 - DNA, 20 bp, Artificial
  CRISPR gRNA sequence
cactttgggcagctcacctg

SEQ ID NO: 485078 - DNA, 20 bp, Artificial
  CRISPR gRNA sequence
ttgggcagctcacctgaggt

SEQ ID NO: 485079 - DNA, 20 bp, Artificial
  CRISPR gRNA sequence
tgggcagctcacctgaggtc

SEQ ID NO: 485080 - DNA, 20 bp, Artificial
  CRISPR gRNA sequence
ggcagctcacctgaggtcag

SEQ ID NO: 485081 - DNA, 20 bp, Artificial
  CRISPR gRNA sequence
tcacctgaggtcaggagttc

SEQ ID NO: 485082 - DNA, 20 bp, Artificial
  CRISPR gRNA sequence
tgaggtcaggagttcgagac

SEQ ID NO: 485083 - DNA, 20 bp, Artificial
  CRISPR gRNA sequence
tcaggagttcgagaccagcc

SEQ ID NO: 485084 - DNA, 20 bp, Artificial
  CRISPR gRNA sequence
cgagaccagcctggccaaca

SEQ ID NO: 485085 - DNA, 20 bp, Artificial
  CRISPR gRNA sequence
tctactaaaaatacaaaaat

SEQ ID NO: 485086 - DNA, 20 bp, Artificial
  CRISPR gRNA sequence
ctaaaaatacaaaaattagc

SEQ ID NO: 485087 - DNA, 20 bp, Artificial
  CRISPR gRNA sequence
taaaaatacaaaaattagcc

SEQ ID NO: 485088 - DNA, 20 bp, Artificial
  CRISPR gRNA sequence
aaatacaaaaattagccagg

SEQ ID NO: 485089 - DNA, 20 bp, Artificial
  CRISPR gRNA sequence
aatacaaaaattagccaggc

SEQ ID NO: 485090 - DNA, 20 bp, Artificial
  CRISPR gRNA sequence
acaaaaattagccaggcggg

SEQ ID NO: 485091 - DNA, 20 bp, Artificial
  CRISPR gRNA sequence
aaaattagccaggcgggtgg

SEQ ID NO: 485092 - DNA, 20 bp, Artificial
  CRISPR gRNA sequence
gtggcagtcacctgaaatcc

SEQ ID NO: 485093 - DNA, 20 bp, Artificial
  CRISPR gRNA sequence
cacctgaaatcccagctact

SEQ ID NO: 485094 - DNA, 20 bp, Artificial
  CRISPR gRNA sequence
acctgaaatcccagctactc

SEQ ID NO: 485095 - DNA, 20 bp, Artificial
  CRISPR gRNA sequence
ctgaaatcccagctactcgg

SEQ ID NO: 485096 - DNA, 20 bp, Artificial
  CRISPR gRNA sequence
tgaaatcccagctactcggg

SEQ ID NO: 485097 - DNA, 20 bp, Artificial
  CRISPR gRNA sequence
tcccagctactcgggaggct

SEQ ID NO: 485098 - DNA, 20 bp, Artificial
  CRISPR gRNA sequence
cccagctactcgggaggctg

SEQ ID NO: 485099 - DNA, 20 bp, Artificial
  CRISPR gRNA sequence
agctactcgggaggctgagg

SEQ ID NO: 485100 - DNA, 20 bp, Artificial
  CRISPR gRNA sequence
gctactcgggaggctgaggc

SEQ ID NO: 485101 - DNA, 20 bp, Artificial
  CRISPR gRNA sequence
tactcgggaggctgaggcag

SEQ ID NO: 485102 - DNA, 20 bp, Artificial
  CRISPR gRNA sequence
gcaggagaatcacttgaacc

SEQ ID NO: 485103 - DNA, 20 bp, Artificial
  CRISPR gRNA sequence
caggagaatcacttgaaccc

SEQ ID NO: 485104 - DNA, 20 bp, Artificial
  CRISPR gRNA sequence
gagaatcacttgaacccggg

SEQ ID NO: 485105 - DNA, 20 bp, Artificial
  CRISPR gRNA sequence
aatcacttgaacccgggaag

SEQ ID NO: 485106 - DNA, 20 bp, Artificial
  CRISPR gRNA sequence
tcacttgaacccgggaagcg

SEQ ID NO: 485107 - DNA, 20 bp, Artificial
  CRISPR gRNA sequence
cacttgaacccgggaagcgg

SEQ ID NO: 485108 - DNA, 20 bp, Artificial
  CRISPR gRNA sequence
aacccgggaagcggaggctg

SEQ ID NO: 485109 - DNA, 20 bp, Artificial
  CRISPR gRNA sequence
cgggaagcggaggctgcagt

SEQ ID NO: 485110 - DNA, 20 bp, Artificial
  CRISPR gRNA sequence
agcggaggctgcagtgagcc

SEQ ID NO: 485111 - DNA, 20 bp, Artificial
  CRISPR gRNA sequence
gaggctgcagtgagccaaga

SEQ ID NO: 485112 - DNA, 20 bp, Artificial
  CRISPR gRNA sequence
aagatggcaccattgcactc

SEQ ID NO: 485113 - DNA, 20 bp, Artificial
  CRISPR gRNA sequence
ggcaccattgcactccagcc

SEQ ID NO: 485114 - DNA, 20 bp, Artificial
  CRISPR gRNA sequence
gcaccattgcactccagcct

SEQ ID NO: 485115 - DNA, 20 bp, Artificial
  CRISPR gRNA sequence
tgcactccagcctgggcaac

SEQ ID NO: 485116 - DNA, 20 bp, Artificial
  CRISPR gRNA sequence
cactccagcctgggcaacaa

SEQ ID NO: 485117 - DNA, 20 bp, Artificial
  CRISPR gRNA sequence
aaactatatacctgtgtata

SEQ ID NO: 485118 - DNA, 20 bp, Artificial
  CRISPR gRNA sequence
aactatatacctgtgtatat

SEQ ID NO: 485119 - DNA, 20 bp, Artificial
  CRISPR gRNA sequence
acctgtgtatataggaaacc

SEQ ID NO: 485120 - DNA, 20 bp, Artificial
  CRISPR gRNA sequence
ctgtgtatataggaaaccaa

SEQ ID NO: 485121 - DNA, 20 bp, Artificial
  CRISPR gRNA sequence
tgtgtatataggaaaccaag

SEQ ID NO: 485122 - DNA, 20 bp, Artificial
  CRISPR gRNA sequence
gactatatgaaaaattattt

SEQ ID NO: 485123 - DNA, 20 bp, Artificial
  CRISPR gRNA sequence
tatgaaaaattatttgagtg

SEQ ID NO: 485124 - DNA, 20 bp, Artificial
  CRISPR gRNA sequence
gaaaaattatttgagtgtag

SEQ ID NO: 485125 - DNA, 20 bp, Artificial
  CRISPR gRNA sequence
aattatttgagtgtagaagt

SEQ ID NO: 485126 - DNA, 20 bp, Artificial
  CRISPR gRNA sequence
agtcagttttgcaaaattgc

SEQ ID NO: 485127 - DNA, 20 bp, Artificial
  CRISPR gRNA sequence
tttgcaaaattgctagatat

SEQ ID NO: 485128 - DNA, 20 bp, Artificial
  CRISPR gRNA sequence
ttgcaaaattgctagatata

SEQ ID NO: 485129 - DNA, 20 bp, Artificial
  CRISPR gRNA sequence
tcatttttatttctatatat

SEQ ID NO: 485130 - DNA, 20 bp, Artificial
  CRISPR gRNA sequence
tttctatatattagtacaaa

SEQ ID NO: 485131 - DNA, 20 bp, Artificial
  CRISPR gRNA sequence
tttgaaaacaatactattta

SEQ ID NO: 485132 - DNA, 20 bp, Artificial
  CRISPR gRNA sequence
gaaaacaatactatttacag

SEQ ID NO: 485133 - DNA, 20 bp, Artificial
  CRISPR gRNA sequence
ctatttacagcagcacaaaa

SEQ ID NO: 485134 - DNA, 20 bp, Artificial
  CRISPR gRNA sequence
cacaaaaaagataaaatata

SEQ ID NO: 485135 - DNA, 20 bp, Artificial
  CRISPR gRNA sequence
aaatatatagaaataatttc

SEQ ID NO: 485136 - DNA, 20 bp, Artificial
  CRISPR gRNA sequence
tatatagaaataatttcaag

SEQ ID NO: 485137 - DNA, 20 bp, Artificial
  CRISPR gRNA sequence
aatttcaagaagaaatattt

SEQ ID NO: 485138 - DNA, 20 bp, Artificial
  CRISPR gRNA sequence
ctatacacctattgcaacaa

SEQ ID NO: 485139 - DNA, 20 bp, Artificial
  CRISPR gRNA sequence
tattgcaacaaaagattgct

SEQ ID NO: 485140 - DNA, 20 bp, Artificial
  CRISPR gRNA sequence
agattgctgagaaaaaatta

SEQ ID NO: 485141 - DNA, 20 bp, Artificial
  CRISPR gRNA sequence
attgctgagaaaaaattaaa

SEQ ID NO: 485142 - DNA, 20 bp, Artificial
  CRISPR gRNA sequence
aaattaaagagctaaataaa

SEQ ID NO: 485143 - DNA, 20 bp, Artificial
  CRISPR gRNA sequence
aattaaagagctaaataaac

SEQ ID NO: 485144 - DNA, 20 bp, Artificial
  CRISPR gRNA sequence
ttaaagagctaaataaacag

SEQ ID NO: 485145 - DNA, 20 bp, Artificial
  CRISPR gRNA sequence
ataaacaggagactatacca

SEQ ID NO: 485146 - DNA, 20 bp, Artificial
  CRISPR gRNA sequence
gactataccatggtttttat

SEQ ID NO: 485147 - DNA, 20 bp, Artificial
  CRISPR gRNA sequence
tataccatggtttttattgg

SEQ ID NO: 485148 - DNA, 20 bp, Artificial
  CRISPR gRNA sequence
ttggaagacttaatattgct

SEQ ID NO: 485149 - DNA, 20 bp, Artificial
  CRISPR gRNA sequence
attcttcctaaattaattta

SEQ ID NO: 485150 - DNA, 20 bp, Artificial
  CRISPR gRNA sequence
aaattaatttatagattcaa

SEQ ID NO: 485151 - DNA, 20 bp, Artificial
  CRISPR gRNA sequence
aattccaataaaaattattg

SEQ ID NO: 485152 - DNA, 20 bp, Artificial
  CRISPR gRNA sequence
attccaataaaaattattgc

SEQ ID NO: 485153 - DNA, 20 bp, Artificial
  CRISPR gRNA sequence
attattgcaggttattttta

SEQ ID NO: 485154 - DNA, 20 bp, Artificial
  CRISPR gRNA sequence
ttatttttatagaaattaac

SEQ ID NO: 485155 - DNA, 20 bp, Artificial
  CRISPR gRNA sequence
aaacttatatgaaaatgtaa

SEQ ID NO: 485156 - DNA, 20 bp, Artificial
  CRISPR gRNA sequence
atatgaaaatgtaaaagaca

SEQ ID NO: 485157 - DNA, 20 bp, Artificial
  CRISPR gRNA sequence
aaaatgtaaaagacatagaa

SEQ ID NO: 485158 - DNA, 20 bp, Artificial
  CRISPR gRNA sequence
gtaaaagacatagaatagcc

SEQ ID NO: 485159 - DNA, 20 bp, Artificial
  CRISPR gRNA sequence
taaaagacatagaatagcca

SEQ ID NO: 485160 - DNA, 20 bp, Artificial
  CRISPR gRNA sequence
tagccaaggcaatcttgatg

SEQ ID NO: 485161 - DNA, 20 bp, Artificial
  CRISPR gRNA sequence
ggcaatcttgatgaagaaca

SEQ ID NO: 485162 - DNA, 20 bp, Artificial
  CRISPR gRNA sequence
atcttgatgaagaacaaagc

SEQ ID NO: 485163 - DNA, 20 bp, Artificial
  CRISPR gRNA sequence
ttgatgaagaacaaagctag

SEQ ID NO: 485164 - DNA, 20 bp, Artificial
  CRISPR gRNA sequence
tgatgaagaacaaagctaga

SEQ ID NO: 485165 - DNA, 20 bp, Artificial
  CRISPR gRNA sequence
ggttttcactacctaatatc

SEQ ID NO: 485166 - DNA, 20 bp, Artificial
  CRISPR gRNA sequence
caagatatattgtaaaactt

SEQ ID NO: 485167 - DNA, 20 bp, Artificial
  CRISPR gRNA sequence
attgtaaaacttcagaaatt

SEQ ID NO: 485168 - DNA, 20 bp, Artificial
  CRISPR gRNA sequence
taaaacttcagaaattaaga

SEQ ID NO: 485169 - DNA, 20 bp, Artificial
  CRISPR gRNA sequence
cagaaattaagatagcattc

SEQ ID NO: 485170 - DNA, 20 bp, Artificial
  CRISPR gRNA sequence
agatagcattccagtattgc

SEQ ID NO: 485171 - DNA, 20 bp, Artificial
  CRISPR gRNA sequence
gatagcattccagtattgca

SEQ ID NO: 485172 - DNA, 20 bp, Artificial
  CRISPR gRNA sequence
ccagtattgcaaggattgaa

SEQ ID NO: 485173 - DNA, 20 bp, Artificial
  CRISPR gRNA sequence
gtattgcaaggattgaaaag

SEQ ID NO: 485174 - DNA, 20 bp, Artificial
  CRISPR gRNA sequence
aaggattgaaaagtagtcga

SEQ ID NO: 485175 - DNA, 20 bp, Artificial
  CRISPR gRNA sequence
aagtagtcgatggaatataa

SEQ ID NO: 485176 - DNA, 20 bp, Artificial
  CRISPR gRNA sequence
gtcgatggaatataatagtc

SEQ ID NO: 485177 - DNA, 20 bp, Artificial
  CRISPR gRNA sequence
ggaatataatagtctagaaa

SEQ ID NO: 485178 - DNA, 20 bp, Artificial
  CRISPR gRNA sequence
ctagaaatagaccctgtgtg

SEQ ID NO: 485179 - DNA, 20 bp, Artificial
  CRISPR gRNA sequence
tagaaatagaccctgtgtgt

SEQ ID NO: 485180 - DNA, 20 bp, Artificial
  CRISPR gRNA sequence
aacactaactgtttttcctc

SEQ ID NO: 485181 - DNA, 20 bp, Artificial
  CRISPR gRNA sequence
tcacaccacaacaatcaaca

SEQ ID NO: 485182 - DNA, 20 bp, Artificial
  CRISPR gRNA sequence
caccacaacaatcaacacag

SEQ ID NO: 485183 - DNA, 20 bp, Artificial
  CRISPR gRNA sequence
agacttctgtgaccaacgtg

SEQ ID NO: 485184 - DNA, 20 bp, Artificial
  CRISPR gRNA sequence
gacttctgtgaccaacgtgt

SEQ ID NO: 485185 - DNA, 20 bp, Artificial
  CRISPR gRNA sequence
acttctgtgaccaacgtgtg

SEQ ID NO: 485186 - DNA, 20 bp, Artificial
  CRISPR gRNA sequence
ttctgtgaccaacgtgtggg

SEQ ID NO: 485187 - DNA, 20 bp, Artificial
  CRISPR gRNA sequence
tggggagtttcccacgtgcc

SEQ ID NO: 485188 - DNA, 20 bp, Artificial
  CRISPR gRNA sequence
gagtttcccacgtgccaagc

SEQ ID NO: 485189 - DNA, 20 bp, Artificial
  CRISPR gRNA sequence
ccacgtgccaagcaagcaat

SEQ ID NO: 485190 - DNA, 20 bp, Artificial
  CRISPR gRNA sequence
caagcaagcaatcagctctt

SEQ ID NO: 485191 - DNA, 20 bp, Artificial
  CRISPR gRNA sequence
gcaagcaatcagctcttcag

SEQ ID NO: 485192 - DNA, 20 bp, Artificial
  CRISPR gRNA sequence
gctcttcagtggacaccaac

SEQ ID NO: 485193 - DNA, 20 bp, Artificial
  CRISPR gRNA sequence
caactggatgtcctctaatt

SEQ ID NO: 485194 - DNA, 20 bp, Artificial
  CRISPR gRNA sequence
attctgacactatctacctg

SEQ ID NO: 485195 - DNA, 20 bp, Artificial
  CRISPR gRNA sequence
atctacctgtagatatccac

SEQ ID NO: 485196 - DNA, 20 bp, Artificial
  CRISPR gRNA sequence
atccaccagatgccaactgc

SEQ ID NO: 485197 - DNA, 20 bp, Artificial
  CRISPR gRNA sequence
cagatgccaactgcaagctc

SEQ ID NO: 485198 - DNA, 20 bp, Artificial
  CRISPR gRNA sequence
tacctgcgcttctgaccaac

SEQ ID NO: 485199 - DNA, 20 bp, Artificial
  CRISPR gRNA sequence
ctgaccaactagctataaac

SEQ ID NO: 485200 - DNA, 20 bp, Artificial
  CRISPR gRNA sequence
tgaccaactagctataaact

SEQ ID NO: 485201 - DNA, 20 bp, Artificial
  CRISPR gRNA sequence
gtttcccgttattccctcct

SEQ ID NO: 485202 - DNA, 20 bp, Artificial
  CRISPR gRNA sequence
tttcccgttattccctcctt

SEQ ID NO: 485203 - DNA, 20 bp, Artificial
  CRISPR gRNA sequence
cttgggttcaattaatttgc

SEQ ID NO: 485204 - DNA, 20 bp, Artificial
  CRISPR gRNA sequence
ggttcaattaatttgctaga

SEQ ID NO: 485205 - DNA, 20 bp, Artificial
  CRISPR gRNA sequence
ttaatttgctagatggctca

SEQ ID NO: 485206 - DNA, 20 bp, Artificial
  CRISPR gRNA sequence
gctagatggctcacagaact

SEQ ID NO: 485207 - DNA, 20 bp, Artificial
  CRISPR gRNA sequence
ctagatggctcacagaactc

SEQ ID NO: 485208 - DNA, 20 bp, Artificial
  CRISPR gRNA sequence
tagatggctcacagaactca

SEQ ID NO: 485209 - DNA, 20 bp, Artificial
  CRISPR gRNA sequence
actcagggaaacacattcac

SEQ ID NO: 485210 - DNA, 20 bp, Artificial
  CRISPR gRNA sequence
acattcactggattattata

SEQ ID NO: 485211 - DNA, 20 bp, Artificial
  CRISPR gRNA sequence
cattcactggattattataa

SEQ ID NO: 485212 - DNA, 20 bp, Artificial
  CRISPR gRNA sequence
ttattataaaggttattaca

SEQ ID NO: 485213 - DNA, 20 bp, Artificial
  CRISPR gRNA sequence
tattataaaggttattacaa

SEQ ID NO: 485214 - DNA, 20 bp, Artificial
  CRISPR gRNA sequence
attataaaggttattacaaa

SEQ ID NO: 485215 - DNA, 20 bp, Artificial
  CRISPR gRNA sequence
tattacaaagggtacctatg

SEQ ID NO: 485216 - DNA, 20 bp, Artificial
  CRISPR gRNA sequence
ttacaaagggtacctatgaa

SEQ ID NO: 485217 - DNA, 20 bp, Artificial
  CRISPR gRNA sequence
ggtacctatgaagagatgca

SEQ ID NO: 485218 - DNA, 20 bp, Artificial
  CRISPR gRNA sequence
gtacctatgaagagatgcat

SEQ ID NO: 485219 - DNA, 20 bp, Artificial
  CRISPR gRNA sequence
tatgaagagatgcataggac

SEQ ID NO: 485220 - DNA, 20 bp, Artificial
  CRISPR gRNA sequence
atgaagagatgcataggaca

SEQ ID NO: 485221 - DNA, 20 bp, Artificial
  CRISPR gRNA sequence
gagatgcataggacaaggtg

SEQ ID NO: 485222 - DNA, 20 bp, Artificial
  CRISPR gRNA sequence
agatgcataggacaaggtgt

SEQ ID NO: 485223 - DNA, 20 bp, Artificial
  CRISPR gRNA sequence
gatgcataggacaaggtgta

SEQ ID NO: 485224 - DNA, 20 bp, Artificial
  CRISPR gRNA sequence
atgcataggacaaggtgtag

SEQ ID NO: 485225 - DNA, 20 bp, Artificial
  CRISPR gRNA sequence
cataggacaaggtgtagggg

SEQ ID NO: 485226 - DNA, 20 bp, Artificial
  CRISPR gRNA sequence
ataggacaaggtgtagggga

SEQ ID NO: 485227 - DNA, 20 bp, Artificial
  CRISPR gRNA sequence
taggacaaggtgtaggggaa

SEQ ID NO: 485228 - DNA, 20 bp, Artificial
  CRISPR gRNA sequence
aaggtgtaggggaagggata

SEQ ID NO: 485229 - DNA, 20 bp, Artificial
  CRISPR gRNA sequence
ggtgtaggggaagggataca

SEQ ID NO: 485230 - DNA, 20 bp, Artificial
  CRISPR gRNA sequence
acagagtttccatgccttcc

SEQ ID NO: 485231 - DNA, 20 bp, Artificial
  CRISPR gRNA sequence
cagagtttccatgccttccc

SEQ ID NO: 485232 - DNA, 20 bp, Artificial
  CRISPR gRNA sequence
agagtttccatgccttccca

SEQ ID NO: 485233 - DNA, 20 bp, Artificial
  CRISPR gRNA sequence
tcccagggcgtgccaccctc

SEQ ID NO: 485234 - DNA, 20 bp, Artificial
  CRISPR gRNA sequence
cccagggcgtgccaccctcc

SEQ ID NO: 485235 - DNA, 20 bp, Artificial
  CRISPR gRNA sequence
tccaggaacctccgcatgtt

SEQ ID NO: 485236 - DNA, 20 bp, Artificial
  CRISPR gRNA sequence
gctctctgaaccttgttctt

SEQ ID NO: 485237 - DNA, 20 bp, Artificial
  CRISPR gRNA sequence
ctctctgaaccttgttcttt

SEQ ID NO: 485238 - DNA, 20 bp, Artificial
  CRISPR gRNA sequence
ccttgttctttgggttttta

SEQ ID NO: 485239 - DNA, 20 bp, Artificial
  CRISPR gRNA sequence
ttgttctttgggtttttatg

SEQ ID NO: 485240 - DNA, 20 bp, Artificial
  CRISPR gRNA sequence
tgttctttgggtttttatgg

SEQ ID NO: 485241 - DNA, 20 bp, Artificial
  CRISPR gRNA sequence
tttatggaggcctcaataaa

SEQ ID NO: 485242 - DNA, 20 bp, Artificial
  CRISPR gRNA sequence
ttatggaggcctcaataaat

SEQ ID NO: 485243 - DNA, 20 bp, Artificial
  CRISPR gRNA sequence
aaatgggaatgattgaccac

SEQ ID NO: 485244 - DNA, 20 bp, Artificial
  CRISPR gRNA sequence
aatgattgaccactggccat

SEQ ID NO: 485245 - DNA, 20 bp, Artificial
  CRISPR gRNA sequence
caatccctctccttttcctg

SEQ ID NO: 485246 - DNA, 20 bp, Artificial
  CRISPR gRNA sequence
aatccctctccttttcctga

SEQ ID NO: 485247 - DNA, 20 bp, Artificial
  CRISPR gRNA sequence
cctctccttttcctgaaggt

SEQ ID NO: 485248 - DNA, 20 bp, Artificial
  CRISPR gRNA sequence
ctctccttttcctgaaggtt

SEQ ID NO: 485249 - DNA, 20 bp, Artificial
  CRISPR gRNA sequence
tctccttttcctgaaggttg

SEQ ID NO: 485250 - DNA, 20 bp, Artificial
  CRISPR gRNA sequence
cttttcctgaaggttgggga

SEQ ID NO: 485251 - DNA, 20 bp, Artificial
  CRISPR gRNA sequence
ttttcctgaaggttggggac

SEQ ID NO: 485252 - DNA, 20 bp, Artificial
  CRISPR gRNA sequence
ctgaaggttggggacgggct

SEQ ID NO: 485253 - DNA, 20 bp, Artificial
  CRISPR gRNA sequence
gaaggttggggacgggctca

SEQ ID NO: 485254 - DNA, 20 bp, Artificial
  CRISPR gRNA sequence
ccaatattccaaccctgcct

SEQ ID NO: 485255 - DNA, 20 bp, Artificial
  CRISPR gRNA sequence
caaccctgccttggtctttc

SEQ ID NO: 485256 - DNA, 20 bp, Artificial
  CRISPR gRNA sequence
gccttggtctttctggtgac

SEQ ID NO: 485257 - DNA, 20 bp, Artificial
  CRISPR gRNA sequence
ggtgaccggcccctatcccg

SEQ ID NO: 485258 - DNA, 20 bp, Artificial
  CRISPR gRNA sequence
ccctatcccgaagctgccta

SEQ ID NO: 485259 - DNA, 20 bp, Artificial
  CRISPR gRNA sequence
cctatcccgaagctgcctac

SEQ ID NO: 485260 - DNA, 20 bp, Artificial
  CRISPR gRNA sequence
cgaagctgcctacaggctgc

SEQ ID NO: 485261 - DNA, 20 bp, Artificial
  CRISPR gRNA sequence
gcctacaggctgccagccat

SEQ ID NO: 485262 - DNA, 20 bp, Artificial
  CRISPR gRNA sequence
ccagccatcggtcacctcat

SEQ ID NO: 485263 - DNA, 20 bp, Artificial
  CRISPR gRNA sequence
tcacctcattagcctacaaa

SEQ ID NO: 485264 - DNA, 20 bp, Artificial
  CRISPR gRNA sequence
cctacaaaaagacatcactt

SEQ ID NO: 485265 - DNA, 20 bp, Artificial
  CRISPR gRNA sequence
ttcggaatttctaaaaattt

SEQ ID NO: 485266 - DNA, 20 bp, Artificial
  CRISPR gRNA sequence
tcggaatttctaaaaatttt

SEQ ID NO: 485267 - DNA, 20 bp, Artificial
  CRISPR gRNA sequence
aaattttaggaattgtatgc

SEQ ID NO: 485268 - DNA, 20 bp, Artificial
  CRISPR gRNA sequence
aattttaggaattgtatgcc

SEQ ID NO: 485269 - DNA, 20 bp, Artificial
  CRISPR gRNA sequence
ttaggaattgtatgccagga

SEQ ID NO: 485270 - DNA, 20 bp, Artificial
  CRISPR gRNA sequence
taggaattgtatgccaggaa

SEQ ID NO: 485271 - DNA, 20 bp, Artificial
  CRISPR gRNA sequence
ggaattgtatgccaggaaag

SEQ ID NO: 485272 - DNA, 20 bp, Artificial
  CRISPR gRNA sequence
gaattgtatgccaggaaagg

SEQ ID NO: 485273 - DNA, 20 bp, Artificial
  CRISPR gRNA sequence
tacttgatcttttcaataaa

SEQ ID NO: 485274 - DNA, 20 bp, Artificial
  CRISPR gRNA sequence
tcttttcaataaatggtgct

SEQ ID NO: 485275 - DNA, 20 bp, Artificial
  CRISPR gRNA sequence
ttggtcaaattgatatctat

SEQ ID NO: 485276 - DNA, 20 bp, Artificial
  CRISPR gRNA sequence
tggtcaaattgatatctata

SEQ ID NO: 485277 - DNA, 20 bp, Artificial
  CRISPR gRNA sequence
aatcataaatttaaatatga

SEQ ID NO: 485278 - DNA, 20 bp, Artificial
  CRISPR gRNA sequence
atatgaaagctaaacctata

SEQ ID NO: 485279 - DNA, 20 bp, Artificial
  CRISPR gRNA sequence
agctaaacctataaagcttc

SEQ ID NO: 485280 - DNA, 20 bp, Artificial
  CRISPR gRNA sequence
gctaaacctataaagcttcc

SEQ ID NO: 485281 - DNA, 20 bp, Artificial
  CRISPR gRNA sequence
cctataaagcttccaggaaa

SEQ ID NO: 485282 - DNA, 20 bp, Artificial
  CRISPR gRNA sequence
aagcttccaggaaaaagcac

SEQ ID NO: 485283 - DNA, 20 bp, Artificial
  CRISPR gRNA sequence
gcttccaggaaaaagcacaa

SEQ ID NO: 485284 - DNA, 20 bp, Artificial
  CRISPR gRNA sequence
gagaatatcttctacatctt

SEQ ID NO: 485285 - DNA, 20 bp, Artificial
  CRISPR gRNA sequence
atatcttctacatcttgaga

SEQ ID NO: 485286 - DNA, 20 bp, Artificial
  CRISPR gRNA sequence
tctatttttatgtttatttt

SEQ ID NO: 485287 - DNA, 20 bp, Artificial
  CRISPR gRNA sequence
ttttatgtttattttgagac

SEQ ID NO: 485288 - DNA, 20 bp, Artificial
  CRISPR gRNA sequence
ttattttgagaccagattat

SEQ ID NO: 485289 - DNA, 20 bp, Artificial
  CRISPR gRNA sequence
ttgagaccagattatgagac

SEQ ID NO: 485290 - DNA, 20 bp, Artificial
  CRISPR gRNA sequence
ctggctaatttttgcatttt

SEQ ID NO: 485291 - DNA, 20 bp, Artificial
  CRISPR gRNA sequence
gctaatttttgcatttttgg

SEQ ID NO: 485292 - DNA, 20 bp, Artificial
  CRISPR gRNA sequence
taatttttgcatttttggta

SEQ ID NO: 485293 - DNA, 20 bp, Artificial
  CRISPR gRNA sequence
ttttgcatttttggtagaga

SEQ ID NO: 485294 - DNA, 20 bp, Artificial
  CRISPR gRNA sequence
ttgcatttttggtagagata

SEQ ID NO: 485295 - DNA, 20 bp, Artificial
  CRISPR gRNA sequence
tagagtttcaccatgttgcc

SEQ ID NO: 485296 - DNA, 20 bp, Artificial
  CRISPR gRNA sequence
agagtttcaccatgttgcca

SEQ ID NO: 485297 - DNA, 20 bp, Artificial
  CRISPR gRNA sequence
caaggcttgtcttgaactcc

SEQ ID NO: 485298 - DNA, 20 bp, Artificial
  CRISPR gRNA sequence
aaggcttgtcttgaactcct

SEQ ID NO: 485299 - DNA, 20 bp, Artificial
  CRISPR gRNA sequence
tgtcttgaactcctgggctc

SEQ ID NO: 485300 - DNA, 20 bp, Artificial
  CRISPR gRNA sequence
ctcaagtgatccacccgcct

SEQ ID NO: 485301 - DNA, 20 bp, Artificial
  CRISPR gRNA sequence
ccacccgccttggcctccca

SEQ ID NO: 485302 - DNA, 20 bp, Artificial
  CRISPR gRNA sequence
ccttggcctcccaaagcgct

SEQ ID NO: 485303 - DNA, 20 bp, Artificial
  CRISPR gRNA sequence
ctcccaaagcgctgagatta

SEQ ID NO: 485304 - DNA, 20 bp, Artificial
  CRISPR gRNA sequence
tcccaaagcgctgagattac

SEQ ID NO: 485305 - DNA, 20 bp, Artificial
  CRISPR gRNA sequence
agcgctgagattacaggcat

SEQ ID NO: 485306 - DNA, 20 bp, Artificial
  CRISPR gRNA sequence
caggcatgagccactgcacc

SEQ ID NO: 485307 - DNA, 20 bp, Artificial
  CRISPR gRNA sequence
gacaacaaatgtttctttaa

SEQ ID NO: 485308 - DNA, 20 bp, Artificial
  CRISPR gRNA sequence
acaacaaatgtttctttaac

SEQ ID NO: 485309 - DNA, 20 bp, Artificial
  CRISPR gRNA sequence
aaataaatcactaaccataa

SEQ ID NO: 485310 - DNA, 20 bp, Artificial
  CRISPR gRNA sequence
ataaaagaatattgataaat

SEQ ID NO: 485311 - DNA, 20 bp, Artificial
  CRISPR gRNA sequence
aattggacttcactaaaact

SEQ ID NO: 485312 - DNA, 20 bp, Artificial
  CRISPR gRNA sequence
taaaacttagaacttctgtt

SEQ ID NO: 485313 - DNA, 20 bp, Artificial
  CRISPR gRNA sequence
ttagaacttctgtttggtga

SEQ ID NO: 485314 - DNA, 20 bp, Artificial
  CRISPR gRNA sequence
gtttggtgaaagacaacatt

SEQ ID NO: 485315 - DNA, 20 bp, Artificial
  CRISPR gRNA sequence
ttggtgaaagacaacattga

SEQ ID NO: 485316 - DNA, 20 bp, Artificial
  CRISPR gRNA sequence
ggtgaaagacaacattgaga

SEQ ID NO: 485317 - DNA, 20 bp, Artificial
  CRISPR gRNA sequence
acaacattgagagagtgaaa

SEQ ID NO: 485318 - DNA, 20 bp, Artificial
  CRISPR gRNA sequence
cattgagagagtgaaaaagc

SEQ ID NO: 485319 - DNA, 20 bp, Artificial
  CRISPR gRNA sequence
gagagtgaaaaagcaagcca

SEQ ID NO: 485320 - DNA, 20 bp, Artificial
  CRISPR gRNA sequence
tgaaaaagcaagccaaagac

SEQ ID NO: 485321 - DNA, 20 bp, Artificial
  CRISPR gRNA sequence
gaaaaagcaagccaaagact

SEQ ID NO: 485322 - DNA, 20 bp, Artificial
  CRISPR gRNA sequence
aaaagcaagccaaagactgg

SEQ ID NO: 485323 - DNA, 20 bp, Artificial
  CRISPR gRNA sequence
tgcaatacatacatttgaaa

SEQ ID NO: 485324 - DNA, 20 bp, Artificial
  CRISPR gRNA sequence
gcaatacatacatttgaaaa

SEQ ID NO: 485325 - DNA, 20 bp, Artificial
  CRISPR gRNA sequence
caatacatacatttgaaaaa

SEQ ID NO: 485326 - DNA, 20 bp, Artificial
  CRISPR gRNA sequence
tttgaaaaagggctcatatc

SEQ ID NO: 485327 - DNA, 20 bp, Artificial
  CRISPR gRNA sequence
tgaaaaagggctcatatcca

SEQ ID NO: 485328 - DNA, 20 bp, Artificial
  CRISPR gRNA sequence
gctcatatccagagtatata

SEQ ID NO: 485329 - DNA, 20 bp, Artificial
  CRISPR gRNA sequence
ataaagaattccatcaataa

SEQ ID NO: 485330 - DNA, 20 bp, Artificial
  CRISPR gRNA sequence
taatagactgatgacaataa

SEQ ID NO: 485331 - DNA, 20 bp, Artificial
  CRISPR gRNA sequence
gactgatgacaataatagac

SEQ ID NO: 485332 - DNA, 20 bp, Artificial
  CRISPR gRNA sequence
gatgacaataatgacaaaaa

SEQ ID NO: 485333 - DNA, 20 bp, Artificial
  CRISPR gRNA sequence
aataatgacaaaaaaagcaa

SEQ ID NO: 485334 - DNA, 20 bp, Artificial
  CRISPR gRNA sequence
gacaaaaaaagcaacagact

SEQ ID NO: 485335 - DNA, 20 bp, Artificial
  CRISPR gRNA sequence
acaaaaaaagcaacagactt

SEQ ID NO: 485336 - DNA, 20 bp, Artificial
  CRISPR gRNA sequence
aaaaaagcaacagacttggg

SEQ ID NO: 485337 - DNA, 20 bp, Artificial
  CRISPR gRNA sequence
aaaaagcaacagacttgggc

SEQ ID NO: 485338 - DNA, 20 bp, Artificial
  CRISPR gRNA sequence
acagacttgggcaggcactt

SEQ ID NO: 485339 - DNA, 20 bp, Artificial
  CRISPR gRNA sequence
cagacttgggcaggcacttt

SEQ ID NO: 485340 - DNA, 20 bp, Artificial
  CRISPR gRNA sequence
cttgggcaggcactttagga

SEQ ID NO: 485341 - DNA, 20 bp, Artificial
  CRISPR gRNA sequence
tgggcaggcactttaggaaa

SEQ ID NO: 485342 - DNA, 20 bp, Artificial
  CRISPR gRNA sequence
ttaggaaagagaatatccaa

SEQ ID NO: 485343 - DNA, 20 bp, Artificial
  CRISPR gRNA sequence
agagaatatccaatagccaa

SEQ ID NO: 485344 - DNA, 20 bp, Artificial
  CRISPR gRNA sequence
gagaatatccaatagccaat

SEQ ID NO: 485345 - DNA, 20 bp, Artificial
  CRISPR gRNA sequence
aatagccaataggcatgcat

SEQ ID NO: 485346 - DNA, 20 bp, Artificial
  CRISPR gRNA sequence
atagccaataggcatgcata

SEQ ID NO: 485347 - DNA, 20 bp, Artificial
  CRISPR gRNA sequence
tagccaataggcatgcataa

SEQ ID NO: 485348 - DNA, 20 bp, Artificial
  CRISPR gRNA sequence
ataagggtgcccaacaacat

SEQ ID NO: 485349 - DNA, 20 bp, Artificial
  CRISPR gRNA sequence
tgcccaacaacattagttat

SEQ ID NO: 485350 - DNA, 20 bp, Artificial
  CRISPR gRNA sequence
cccaacaacattagttatca

SEQ ID NO: 485351 - DNA, 20 bp, Artificial
  CRISPR gRNA sequence
attagttatcagagaataat

SEQ ID NO: 485352 - DNA, 20 bp, Artificial
  CRISPR gRNA sequence
atttcacattcccaccaaaa

SEQ ID NO: 485353 - DNA, 20 bp, Artificial
  CRISPR gRNA sequence
accaaaatagctaacattta

SEQ ID NO: 485354 - DNA, 20 bp, Artificial
  CRISPR gRNA sequence
ccaaaatagctaacatttaa

SEQ ID NO: 485355 - DNA, 20 bp, Artificial
  CRISPR gRNA sequence
agctaacatttaaaggtctg

SEQ ID NO: 485356 - DNA, 20 bp, Artificial
  CRISPR gRNA sequence
gctaacatttaaaggtctga

SEQ ID NO: 485357 - DNA, 20 bp, Artificial
  CRISPR gRNA sequence
acatttaaaggtctgaaggc

SEQ ID NO: 485358 - DNA, 20 bp, Artificial
  CRISPR gRNA sequence
catttaaaggtctgaaggct

SEQ ID NO: 485359 - DNA, 20 bp, Artificial
  CRISPR gRNA sequence
aaaggtctgaaggctgggcg

SEQ ID NO: 485360 - DNA, 20 bp, Artificial
  CRISPR gRNA sequence
ggtctgaaggctgggcgaag

SEQ ID NO: 485361 - DNA, 20 bp, Artificial
  CRISPR gRNA sequence
aaggctgggcgaagcggctc

SEQ ID NO: 485362 - DNA, 20 bp, Artificial
  CRISPR gRNA sequence
gcggctcaagcctgtaatcc

SEQ ID NO: 485363 - DNA, 20 bp, Artificial
  CRISPR gRNA sequence
agcctgtaatcccagcactt

SEQ ID NO: 485364 - DNA, 20 bp, Artificial
  CRISPR gRNA sequence
gcctgtaatcccagcacttt

SEQ ID NO: 485365 - DNA, 20 bp, Artificial
  CRISPR gRNA sequence
ctgtaatcccagcactttgg

SEQ ID NO: 485366 - DNA, 20 bp, Artificial
  CRISPR gRNA sequence
tgtaatcccagcactttggg

SEQ ID NO: 485367 - DNA, 20 bp, Artificial
  CRISPR gRNA sequence
tcccagcactttgggaggcc

SEQ ID NO: 485368 - DNA, 20 bp, Artificial
  CRISPR gRNA sequence
cccagcactttgggaggccg

SEQ ID NO: 485369 - DNA, 20 bp, Artificial
  CRISPR gRNA sequence
agcactttgggaggccgagg

SEQ ID NO: 485370 - DNA, 20 bp, Artificial
  CRISPR gRNA sequence
gcactttgggaggccgaggc

SEQ ID NO: 485371 - DNA, 20 bp, Artificial
  CRISPR gRNA sequence
ctttgggaggccgaggcggg

SEQ ID NO: 485372 - DNA, 20 bp, Artificial
  CRISPR gRNA sequence
ccgaggcgggtggatcgctt

SEQ ID NO: 485373 - DNA, 20 bp, Artificial
  CRISPR gRNA sequence
cgaggcgggtggatcgcttg

SEQ ID NO: 485374 - DNA, 20 bp, Artificial
  CRISPR gRNA sequence
gcgggtggatcgcttgaggc

SEQ ID NO: 485375 - DNA, 20 bp, Artificial
  CRISPR gRNA sequence
cgggtggatcgcttgaggcc

SEQ ID NO: 485376 - DNA, 20 bp, Artificial
  CRISPR gRNA sequence
ggtggatcgcttgaggccag

SEQ ID NO: 485377 - DNA, 20 bp, Artificial
  CRISPR gRNA sequence
tcgcttgaggccaggagttc

SEQ ID NO: 485378 - DNA, 20 bp, Artificial
  CRISPR gRNA sequence
cgcttgaggccaggagttcg

SEQ ID NO: 485379 - DNA, 20 bp, Artificial
  CRISPR gRNA sequence
tgaggccaggagttcgaggc

SEQ ID NO: 485380 - DNA, 20 bp, Artificial
  CRISPR gRNA sequence
ccaggagttcgaggccagcc

SEQ ID NO: 485381 - DNA, 20 bp, Artificial
  CRISPR gRNA sequence
cgaggccagcctggccaaca

SEQ ID NO: 485382 - DNA, 20 bp, Artificial
  CRISPR gRNA sequence
tctactaaaaatgcaaaaat

SEQ ID NO: 485383 - DNA, 20 bp, Artificial
  CRISPR gRNA sequence
actaaaaatgcaaaaattag

SEQ ID NO: 485384 - DNA, 20 bp, Artificial
  CRISPR gRNA sequence
taaaaatgcaaaaattagca

SEQ ID NO: 485385 - DNA, 20 bp, Artificial
  CRISPR gRNA sequence
atgcaaaaattagcagagca

SEQ ID NO: 485386 - DNA, 20 bp, Artificial
  CRISPR gRNA sequence
caaaaattagcagagcacgg

SEQ ID NO: 485387 - DNA, 20 bp, Artificial
  CRISPR gRNA sequence
aaattagcagagcacggtgg

SEQ ID NO: 485388 - DNA, 20 bp, Artificial
  CRISPR gRNA sequence
ggtggtggcgcctgtaatac

SEQ ID NO: 485389 - DNA, 20 bp, Artificial
  CRISPR gRNA sequence
cgcctgtaataccagcttct

SEQ ID NO: 485390 - DNA, 20 bp, Artificial
  CRISPR gRNA sequence
gcctgtaataccagcttctt

SEQ ID NO: 485391 - DNA, 20 bp, Artificial
  CRISPR gRNA sequence
ctgtaataccagcttcttgg

SEQ ID NO: 485392 - DNA, 20 bp, Artificial
  CRISPR gRNA sequence
taccagcttcttgggagtct

SEQ ID NO: 485393 - DNA, 20 bp, Artificial
  CRISPR gRNA sequence
accagcttcttgggagtctg

SEQ ID NO: 485394 - DNA, 20 bp, Artificial
  CRISPR gRNA sequence
agcttcttgggagtctgagg

SEQ ID NO: 485395 - DNA, 20 bp, Artificial
  CRISPR gRNA sequence
gcttcttgggagtctgaggc

SEQ ID NO: 485396 - DNA, 20 bp, Artificial
  CRISPR gRNA sequence
ttcttgggagtctgaggcag

SEQ ID NO: 485397 - DNA, 20 bp, Artificial
  CRISPR gRNA sequence
gcaggagaattgcttgaacc

SEQ ID NO: 485398 - DNA, 20 bp, Artificial
  CRISPR gRNA sequence
caggagaattgcttgaaccc

SEQ ID NO: 485399 - DNA, 20 bp, Artificial
  CRISPR gRNA sequence
ggagaattgcttgaacccag

SEQ ID NO: 485400 - DNA, 20 bp, Artificial
  CRISPR gRNA sequence
gagaattgcttgaacccagg

SEQ ID NO: 485401 - DNA, 20 bp, Artificial
  CRISPR gRNA sequence
aattgcttgaacccaggagg

SEQ ID NO: 485402 - DNA, 20 bp, Artificial
  CRISPR gRNA sequence
ttgcttgaacccaggaggca

SEQ ID NO: 485403 - DNA, 20 bp, Artificial
  CRISPR gRNA sequence
tgcttgaacccaggaggcag

SEQ ID NO: 485404 - DNA, 20 bp, Artificial
  CRISPR gRNA sequence
aacccaggaggcagaggttg

SEQ ID NO: 485405 - DNA, 20 bp, Artificial
  CRISPR gRNA sequence
caggaggcagaggttgcagt

SEQ ID NO: 485406 - DNA, 20 bp, Artificial
  CRISPR gRNA sequence
ggcagaggttgcagtgagcc

SEQ ID NO: 485407 - DNA, 20 bp, Artificial
  CRISPR gRNA sequence
aagatcacgccactgtactc

SEQ ID NO: 485408 - DNA, 20 bp, Artificial
  CRISPR gRNA sequence
cacgccactgtactccagcc

SEQ ID NO: 485409 - DNA, 20 bp, Artificial
  CRISPR gRNA sequence
acgccactgtactccagcct

SEQ ID NO: 485410 - DNA, 20 bp, Artificial
  CRISPR gRNA sequence
ctgtactccagcctgggtga

SEQ ID NO: 485411 - DNA, 20 bp, Artificial
  CRISPR gRNA sequence
tccagcctgggtgacagact

SEQ ID NO: 485412 - DNA, 20 bp, Artificial
  CRISPR gRNA sequence
ctgggtgacagactgagact

SEQ ID NO: 485413 - DNA, 20 bp, Artificial
  CRISPR gRNA sequence
taaataaatgtgaaaattcc

SEQ ID NO: 485414 - DNA, 20 bp, Artificial
  CRISPR gRNA sequence
aaataaatgtgaaaattcca

SEQ ID NO: 485415 - DNA, 20 bp, Artificial
  CRISPR gRNA sequence
aataaatgtgaaaattccaa

SEQ ID NO: 485416 - DNA, 20 bp, Artificial
  CRISPR gRNA sequence
gtgaaaattccaagggttga

SEQ ID NO: 485417 - DNA, 20 bp, Artificial
  CRISPR gRNA sequence
gaaaattccaagggttgaca

SEQ ID NO: 485418 - DNA, 20 bp, Artificial
  CRISPR gRNA sequence
attccaagggttgacagaga

SEQ ID NO: 485419 - DNA, 20 bp, Artificial
  CRISPR gRNA sequence
ttccaagggttgacagagat

SEQ ID NO: 485420 - DNA, 20 bp, Artificial
  CRISPR gRNA sequence
ccaagggttgacagagatgg

SEQ ID NO: 485421 - DNA, 20 bp, Artificial
  CRISPR gRNA sequence
tgacagagatgggagcaact

SEQ ID NO: 485422 - DNA, 20 bp, Artificial
  CRISPR gRNA sequence
ctgagattctcatttattgc

SEQ ID NO: 485423 - DNA, 20 bp, Artificial
  CRISPR gRNA sequence
gattctcatttattgctagt

SEQ ID NO: 485424 - DNA, 20 bp, Artificial
  CRISPR gRNA sequence
ttctcatttattgctagtga

SEQ ID NO: 485425 - DNA, 20 bp, Artificial
  CRISPR gRNA sequence
ttgctagtgagagtgtaaat

SEQ ID NO: 485426 - DNA, 20 bp, Artificial
  CRISPR gRNA sequence
gtgagagtgtaaattggtac

SEQ ID NO: 485427 - DNA, 20 bp, Artificial
  CRISPR gRNA sequence
gtaaattggtaccagcactt

SEQ ID NO: 485428 - DNA, 20 bp, Artificial
  CRISPR gRNA sequence
cactttggaaaactatttta

SEQ ID NO: 485429 - DNA, 20 bp, Artificial
  CRISPR gRNA sequence
cttacatataccctttgatc

SEQ ID NO: 485430 - DNA, 20 bp, Artificial
  CRISPR gRNA sequence
acatataccctttgatccag

SEQ ID NO: 485431 - DNA, 20 bp, Artificial
  CRISPR gRNA sequence
atccagaagaatttgtacac

SEQ ID NO: 485432 - DNA, 20 bp, Artificial
  CRISPR gRNA sequence
aatttgtacacaagaaaatc

SEQ ID NO: 485433 - DNA, 20 bp, Artificial
  CRISPR gRNA sequence
atttgtacacaagaaaatct

SEQ ID NO: 485434 - DNA, 20 bp, Artificial
  CRISPR gRNA sequence
gtacacaagaaaatctgggc

SEQ ID NO: 485435 - DNA, 20 bp, Artificial
  CRISPR gRNA sequence
tacacaagaaaatctgggcc

SEQ ID NO: 485436 - DNA, 20 bp, Artificial
  CRISPR gRNA sequence
aagaaaatctgggccaggca

SEQ ID NO: 485437 - DNA, 20 bp, Artificial
  CRISPR gRNA sequence
aaaatctgggccaggcatgg

SEQ ID NO: 485438 - DNA, 20 bp, Artificial
  CRISPR gRNA sequence
gtggctcatgcctgtaatcc

SEQ ID NO: 485439 - DNA, 20 bp, Artificial
  CRISPR gRNA sequence
tgcctgtaatcccagcactt

SEQ ID NO: 485440 - DNA, 20 bp, Artificial
  CRISPR gRNA sequence
gcctgtaatcccagcacttt

SEQ ID NO: 485441 - DNA, 20 bp, Artificial
  CRISPR gRNA sequence
ctgtaatcccagcactttgg

SEQ ID NO: 485442 - DNA, 20 bp, Artificial
  CRISPR gRNA sequence
tgtaatcccagcactttggg

SEQ ID NO: 485443 - DNA, 20 bp, Artificial
  CRISPR gRNA sequence
tcccagcactttgggaggtc

SEQ ID NO: 485444 - DNA, 20 bp, Artificial
  CRISPR gRNA sequence
cccagcactttgggaggtcg

SEQ ID NO: 485445 - DNA, 20 bp, Artificial
  CRISPR gRNA sequence
agcactttgggaggtcgagg

SEQ ID NO: 485446 - DNA, 20 bp, Artificial
  CRISPR gRNA sequence
gcactttgggaggtcgaggc

SEQ ID NO: 485447 - DNA, 20 bp, Artificial
  CRISPR gRNA sequence
ctttgggaggtcgaggcagg

SEQ ID NO: 485448 - DNA, 20 bp, Artificial
  CRISPR gRNA sequence
tcgaggcaggcggatcacct

SEQ ID NO: 485449 - DNA, 20 bp, Artificial
  CRISPR gRNA sequence
cgaggcaggcggatcacctg

SEQ ID NO: 485450 - DNA, 20 bp, Artificial
  CRISPR gRNA sequence
gcaggcggatcacctgaggt

SEQ ID NO: 485451 - DNA, 20 bp, Artificial
  CRISPR gRNA sequence
caggcggatcacctgaggtc

SEQ ID NO: 485452 - DNA, 20 bp, Artificial
  CRISPR gRNA sequence
ggcggatcacctgaggtcag

SEQ ID NO: 485453 - DNA, 20 bp, Artificial
  CRISPR gRNA sequence
tcacctgaggtcaggagttt

SEQ ID NO: 485454 - DNA, 20 bp, Artificial
  CRISPR gRNA sequence
tgaggtcaggagtttgagac

SEQ ID NO: 485455 - DNA, 20 bp, Artificial
  CRISPR gRNA sequence
tcaggagtttgagaccagcc

SEQ ID NO: 485456 - DNA, 20 bp, Artificial
  CRISPR gRNA sequence
tgagaccagcctggccaaca

SEQ ID NO: 485457 - DNA, 20 bp, Artificial
  CRISPR gRNA sequence
tgaaaccccatctcaaaaaa

SEQ ID NO: 485458 - DNA, 20 bp, Artificial
  CRISPR gRNA sequence
tcaaaaaaaagaaaaaaaat

SEQ ID NO: 485459 - DNA, 20 bp, Artificial
  CRISPR gRNA sequence
aaaaaagaaaaaaaattagc

SEQ ID NO: 485460 - DNA, 20 bp, Artificial
  CRISPR gRNA sequence
aaaaagaaaaaaaattagct

SEQ ID NO: 485461 - DNA, 20 bp, Artificial
  CRISPR gRNA sequence
gaaaaaaaattagctgggcg

SEQ ID NO: 485462 - DNA, 20 bp, Artificial
  CRISPR gRNA sequence
aaaaaattagctgggcgtgg

SEQ ID NO: 485463 - DNA, 20 bp, Artificial
  CRISPR gRNA sequence
gcagtgcacacctgtaatcc

SEQ ID NO: 485464 - DNA, 20 bp, Artificial
  CRISPR gRNA sequence
cacctgtaatcccagctact

SEQ ID NO: 485465 - DNA, 20 bp, Artificial
  CRISPR gRNA sequence
ctgtaatcccagctacttgg

SEQ ID NO: 485466 - DNA, 20 bp, Artificial
  CRISPR gRNA sequence
cccagctacttggaagactg

SEQ ID NO: 485467 - DNA, 20 bp, Artificial
  CRISPR gRNA sequence
agctacttggaagactgaag

SEQ ID NO: 485468 - DNA, 20 bp, Artificial
  CRISPR gRNA sequence
gctacttggaagactgaagc

SEQ ID NO: 485469 - DNA, 20 bp, Artificial
  CRISPR gRNA sequence
tacttggaagactgaagcag

SEQ ID NO: 485470 - DNA, 20 bp, Artificial
  CRISPR gRNA sequence
caggagaatcacttaaatct

SEQ ID NO: 485471 - DNA, 20 bp, Artificial
  CRISPR gRNA sequence
ggagaatcacttaaatctga

SEQ ID NO: 485472 - DNA, 20 bp, Artificial
  CRISPR gRNA sequence
gagaatcacttaaatctgag

SEQ ID NO: 485473 - DNA, 20 bp, Artificial
  CRISPR gRNA sequence
aatcacttaaatctgagagg

SEQ ID NO: 485474 - DNA, 20 bp, Artificial
  CRISPR gRNA sequence
tcacttaaatctgagaggcg

SEQ ID NO: 485475 - DNA, 20 bp, Artificial
  CRISPR gRNA sequence
cacttaaatctgagaggcgg

SEQ ID NO: 485476 - DNA, 20 bp, Artificial
  CRISPR gRNA sequence
aatctgagaggcggaggttg

SEQ ID NO: 485477 - DNA, 20 bp, Artificial
  CRISPR gRNA sequence
tgagaggcggaggttgcagt

SEQ ID NO: 485478 - DNA, 20 bp, Artificial
  CRISPR gRNA sequence
ggcggaggttgcagtgagcc

SEQ ID NO: 485479 - DNA, 20 bp, Artificial
  CRISPR gRNA sequence
aagatcatgccattgcactc

SEQ ID NO: 485480 - DNA, 20 bp, Artificial
  CRISPR gRNA sequence
catgccattgcactccagcc

SEQ ID NO: 485481 - DNA, 20 bp, Artificial
  CRISPR gRNA sequence
atgccattgcactccagcct

SEQ ID NO: 485482 - DNA, 20 bp, Artificial
  CRISPR gRNA sequence
tgcactccagcctgggcaac

SEQ ID NO: 485483 - DNA, 20 bp, Artificial
  CRISPR gRNA sequence
cactccagcctgggcaacaa

SEQ ID NO: 485484 - DNA, 20 bp, Artificial
  CRISPR gRNA sequence
gaaactccgtctcaaaaaaa

SEQ ID NO: 485485 - DNA, 20 bp, Artificial
  CRISPR gRNA sequence
tctcaaaaaaaaagaaaatc

SEQ ID NO: 485486 - DNA, 20 bp, Artificial
  CRISPR gRNA sequence
tatccactaaaaatatgtac

SEQ ID NO: 485487 - DNA, 20 bp, Artificial
  CRISPR gRNA sequence
tccactaaaaatatgtacaa

SEQ ID NO: 485488 - DNA, 20 bp, Artificial
  CRISPR gRNA sequence
atgtacaagagtgttaataa

SEQ ID NO: 485489 - DNA, 20 bp, Artificial
  CRISPR gRNA sequence
aagagtgttaataatggctt

SEQ ID NO: 485490 - DNA, 20 bp, Artificial
  CRISPR gRNA sequence
tagtcataataactcaaaat

SEQ ID NO: 485491 - DNA, 20 bp, Artificial
  CRISPR gRNA sequence
acccaaatgtctatcacgat

SEQ ID NO: 485492 - DNA, 20 bp, Artificial
  CRISPR gRNA sequence
aatgtctatcacgattagat

SEQ ID NO: 485493 - DNA, 20 bp, Artificial
  CRISPR gRNA sequence
tgagcaaataaatcgtgtta

SEQ ID NO: 485494 - DNA, 20 bp, Artificial
  CRISPR gRNA sequence
aaatcgtgttatagtcttat

SEQ ID NO: 485495 - DNA, 20 bp, Artificial
  CRISPR gRNA sequence
aatcgtgttatagtcttata

SEQ ID NO: 485496 - DNA, 20 bp, Artificial
  CRISPR gRNA sequence
gtcttataaggaatattaca

SEQ ID NO: 485497 - DNA, 20 bp, Artificial
  CRISPR gRNA sequence
aatattacacagcaatgaaa

SEQ ID NO: 485498 - DNA, 20 bp, Artificial
  CRISPR gRNA sequence
tacacagcaatgaaaaagaa

SEQ ID NO: 485499 - DNA, 20 bp, Artificial
  CRISPR gRNA sequence
aaaagaaaagctacttttcc

SEQ ID NO: 485500 - DNA, 20 bp, Artificial
  CRISPR gRNA sequence
tacttttcctggcaataatg

SEQ ID NO: 485501 - DNA, 20 bp, Artificial
  CRISPR gRNA sequence
tttcctggcaataatgtgga

SEQ ID NO: 485502 - DNA, 20 bp, Artificial
  CRISPR gRNA sequence
atggatctcaccacaatgat

SEQ ID NO: 485503 - DNA, 20 bp, Artificial
  CRISPR gRNA sequence
cacaatgatgagtattaatg

SEQ ID NO: 485504 - DNA, 20 bp, Artificial
  CRISPR gRNA sequence
atgatgagtattaatgaagc

SEQ ID NO: 485505 - DNA, 20 bp, Artificial
  CRISPR gRNA sequence
taatgaagctagactccaaa

SEQ ID NO: 485506 - DNA, 20 bp, Artificial
  CRISPR gRNA sequence
gctagactccaaaaagtaca

SEQ ID NO: 485507 - DNA, 20 bp, Artificial
  CRISPR gRNA sequence
tgaattatttcactgatata

SEQ ID NO: 485508 - DNA, 20 bp, Artificial
  CRISPR gRNA sequence
ctgatataaagtttaaaatc

SEQ ID NO: 485509 - DNA, 20 bp, Artificial
  CRISPR gRNA sequence
aatctggaaaaactaatata

SEQ ID NO: 485510 - DNA, 20 bp, Artificial
  CRISPR gRNA sequence
tggaaaaactaatatatggt

SEQ ID NO: 485511 - DNA, 20 bp, Artificial
  CRISPR gRNA sequence
gaaaaactaatatatggtga

SEQ ID NO: 485512 - DNA, 20 bp, Artificial
  CRISPR gRNA sequence
aaaactaatatatggtgaga

SEQ ID NO: 485513 - DNA, 20 bp, Artificial
  CRISPR gRNA sequence
aaactaatatatggtgagag

SEQ ID NO: 485514 - DNA, 20 bp, Artificial
  CRISPR gRNA sequence
taatatatggtgagagaggt

SEQ ID NO: 485515 - DNA, 20 bp, Artificial
  CRISPR gRNA sequence
ttagaatgtgattacccttg

SEQ ID NO: 485516 - DNA, 20 bp, Artificial
  CRISPR gRNA sequence
tagaatgtgattacccttgc

SEQ ID NO: 485517 - DNA, 20 bp, Artificial
  CRISPR gRNA sequence
gaatgtgattacccttgcag

SEQ ID NO: 485518 - DNA, 20 bp, Artificial
  CRISPR gRNA sequence
aatgtgattacccttgcagg

SEQ ID NO: 485519 - DNA, 20 bp, Artificial
  CRISPR gRNA sequence
atgtgattacccttgcagga

SEQ ID NO: 485520 - DNA, 20 bp, Artificial
  CRISPR gRNA sequence
tgtgattacccttgcaggag

SEQ ID NO: 485521 - DNA, 20 bp, Artificial
  CRISPR gRNA sequence
gtgattacccttgcaggagg

SEQ ID NO: 485522 - DNA, 20 bp, Artificial
  CRISPR gRNA sequence
tgattacccttgcaggaggg

SEQ ID NO: 485523 - DNA, 20 bp, Artificial
  CRISPR gRNA sequence
ggaggggggttatcaacttg

SEQ ID NO: 485524 - DNA, 20 bp, Artificial
  CRISPR gRNA sequence
gaggggggttatcaacttga

SEQ ID NO: 485525 - DNA, 20 bp, Artificial
  CRISPR gRNA sequence
aggggggttatcaacttgaa

SEQ ID NO: 485526 - DNA, 20 bp, Artificial
  CRISPR gRNA sequence
tatcaacttgaagggccaaa

SEQ ID NO: 485527 - DNA, 20 bp, Artificial
  CRISPR gRNA sequence
atcaacttgaagggccaaaa

SEQ ID NO: 485528 - DNA, 20 bp, Artificial
  CRISPR gRNA sequence
aagggccaaaaaggaatgac

SEQ ID NO: 485529 - DNA, 20 bp, Artificial
  CRISPR gRNA sequence
agggccaaaaaggaatgact

SEQ ID NO: 485530 - DNA, 20 bp, Artificial
  CRISPR gRNA sequence
aaaaaggaatgactgggtgc

SEQ ID NO: 485531 - DNA, 20 bp, Artificial
  CRISPR gRNA sequence
aaatgtgttacatcttgatg

SEQ ID NO: 485532 - DNA, 20 bp, Artificial
  CRISPR gRNA sequence
aatgtgttacatcttgatgt

SEQ ID NO: 485533 - DNA, 20 bp, Artificial
  CRISPR gRNA sequence
gtgttacatcttgatgtggg

SEQ ID NO: 485534 - DNA, 20 bp, Artificial
  CRISPR gRNA sequence
atatgtacttacacatataa

SEQ ID NO: 485535 - DNA, 20 bp, Artificial
  CRISPR gRNA sequence
tacacatataaaagttcatc

SEQ ID NO: 485536 - DNA, 20 bp, Artificial
  CRISPR gRNA sequence
tgatttaaattttgtgcaca

SEQ ID NO: 485537 - DNA, 20 bp, Artificial
  CRISPR gRNA sequence
aattttgtgcacacagctgt

SEQ ID NO: 485538 - DNA, 20 bp, Artificial
  CRISPR gRNA sequence
cacagctgtgagttgtatct

SEQ ID NO: 485539 - DNA, 20 bp, Artificial
  CRISPR gRNA sequence
tgagttgtatcttggtaaaa

SEQ ID NO: 485540 - DNA, 20 bp, Artificial
  CRISPR gRNA sequence
gttgtatcttggtaaaaaag

SEQ ID NO: 485541 - DNA, 20 bp, Artificial
  CRISPR gRNA sequence
tcttggtaaaaaagcagaaa

SEQ ID NO: 485542 - DNA, 20 bp, Artificial
  CRISPR gRNA sequence
ttggtaaaaaagcagaaaaa

SEQ ID NO: 485543 - DNA, 20 bp, Artificial
  CRISPR gRNA sequence
aactgttctgactattaact

SEQ ID NO: 485544 - DNA, 20 bp, Artificial
  CRISPR gRNA sequence
actaagatgtactttgataa

SEQ ID NO: 485545 - DNA, 20 bp, Artificial
  CRISPR gRNA sequence
aaaatatgacttgcccattg

SEQ ID NO: 485546 - DNA, 20 bp, Artificial
  CRISPR gRNA sequence
ccattgtggaaacattacca

SEQ ID NO: 485547 - DNA, 20 bp, Artificial
  CRISPR gRNA sequence
tgtggaaacattaccatagc

SEQ ID NO: 485548 - DNA, 20 bp, Artificial
  CRISPR gRNA sequence
taccatagcaagtgaatttg

SEQ ID NO: 485549 - DNA, 20 bp, Artificial
  CRISPR gRNA sequence
gtagatttcctcactcatct

SEQ ID NO: 485550 - DNA, 20 bp, Artificial
  CRISPR gRNA sequence
tctcagctaaacccaactct

SEQ ID NO: 485551 - DNA, 20 bp, Artificial
  CRISPR gRNA sequence
cccaactcttagctaaatat

SEQ ID NO: 485552 - DNA, 20 bp, Artificial
  CRISPR gRNA sequence
ctcttagctaaatatcagaa

SEQ ID NO: 485553 - DNA, 20 bp, Artificial
  CRISPR gRNA sequence
agctaaatatcagaaaagcc

SEQ ID NO: 485554 - DNA, 20 bp, Artificial
  CRISPR gRNA sequence
gctaaatatcagaaaagcct

SEQ ID NO: 485555 - DNA, 20 bp, Artificial
  CRISPR gRNA sequence
taaatatcagaaaagcctgg

SEQ ID NO: 485556 - DNA, 20 bp, Artificial
  CRISPR gRNA sequence
aaatatcagaaaagcctggg

SEQ ID NO: 485557 - DNA, 20 bp, Artificial
  CRISPR gRNA sequence
tatcagaaaagcctgggagg

SEQ ID NO: 485558 - DNA, 20 bp, Artificial
  CRISPR gRNA sequence
atcagaaaagcctgggaggc

SEQ ID NO: 485559 - DNA, 20 bp, Artificial
  CRISPR gRNA sequence
tcagaaaagcctgggaggca

SEQ ID NO: 485560 - DNA, 20 bp, Artificial
  CRISPR gRNA sequence
cagaaaagcctgggaggcag

SEQ ID NO: 485561 - DNA, 20 bp, Artificial
  CRISPR gRNA sequence
agcctgggaggcaggggttg

SEQ ID NO: 485562 - DNA, 20 bp, Artificial
  CRISPR gRNA sequence
tgggaggcaggggttgcagt

SEQ ID NO: 485563 - DNA, 20 bp, Artificial
  CRISPR gRNA sequence
atgactgcaccactgcaccc

SEQ ID NO: 485564 - DNA, 20 bp, Artificial
  CRISPR gRNA sequence
tgcaccactgcaccccagcc

SEQ ID NO: 485565 - DNA, 20 bp, Artificial
  CRISPR gRNA sequence
gcaccactgcaccccagcct

SEQ ID NO: 485566 - DNA, 20 bp, Artificial
  CRISPR gRNA sequence
ctgcaccccagcctgggtga

SEQ ID NO: 485567 - DNA, 20 bp, Artificial
  CRISPR gRNA sequence
gcaccccagcctgggtgaca

SEQ ID NO: 485568 - DNA, 20 bp, Artificial
  CRISPR gRNA sequence
cccagcctgggtgacagagc

SEQ ID NO: 485569 - DNA, 20 bp, Artificial
  CRISPR gRNA sequence
aaaaaaaaaaaaaaaaaaaa

SEQ ID NO: 485570 - DNA, 20 bp, Artificial
  CRISPR gRNA sequence
aaaaaaaaaaaaaagtgaaa

SEQ ID NO: 485571 - DNA, 20 bp, Artificial
  CRISPR gRNA sequence
aaaaaaaaaaaaagtgaaaa

SEQ ID NO: 485572 - DNA, 20 bp, Artificial
  CRISPR gRNA sequence
aaaaaaaaaagtgaaaaagg

SEQ ID NO: 485573 - DNA, 20 bp, Artificial
  CRISPR gRNA sequence
aaaaaagtgaaaaaggaaga

SEQ ID NO: 485574 - DNA, 20 bp, Artificial
  CRISPR gRNA sequence
aaaggaagatagacctaaaa

SEQ ID NO: 485575 - DNA, 20 bp, Artificial
  CRISPR gRNA sequence
cagccaactgaaatgcaata

SEQ ID NO: 485576 - DNA, 20 bp, Artificial
  CRISPR gRNA sequence
atgcaatatggaatgtgcta

SEQ ID NO: 485577 - DNA, 20 bp, Artificial
  CRISPR gRNA sequence
gcaatatggaatgtgctatg

SEQ ID NO: 485578 - DNA, 20 bp, Artificial
  CRISPR gRNA sequence
caatatggaatgtgctatgg

SEQ ID NO: 485579 - DNA, 20 bp, Artificial
  CRISPR gRNA sequence
atgtgctatggaggtgtgcc

SEQ ID NO: 485580 - DNA, 20 bp, Artificial
  CRISPR gRNA sequence
tgtgctatggaggtgtgccc

SEQ ID NO: 485581 - DNA, 20 bp, Artificial
  CRISPR gRNA sequence
gtgctatggaggtgtgccca

SEQ ID NO: 485582 - DNA, 20 bp, Artificial
  CRISPR gRNA sequence
tggaggtgtgcccagggtgt

SEQ ID NO: 485583 - DNA, 20 bp, Artificial
  CRISPR gRNA sequence
ggaggtgtgcccagggtgtg

SEQ ID NO: 485584 - DNA, 20 bp, Artificial
  CRISPR gRNA sequence
gtgtgcccagggtgtgaggc

SEQ ID NO: 485585 - DNA, 20 bp, Artificial
  CRISPR gRNA sequence
ccagggtgtgaggcaagcat

SEQ ID NO: 485586 - DNA, 20 bp, Artificial
  CRISPR gRNA sequence
cagggtgtgaggcaagcata

SEQ ID NO: 485587 - DNA, 20 bp, Artificial
  CRISPR gRNA sequence
gtgtgaggcaagcataagga

SEQ ID NO: 485588 - DNA, 20 bp, Artificial
  CRISPR gRNA sequence
gcatgttttcctctgccctg

SEQ ID NO: 485589 - DNA, 20 bp, Artificial
  CRISPR gRNA sequence
atgttttcctctgccctgca

SEQ ID NO: 485590 - DNA, 20 bp, Artificial
  CRISPR gRNA sequence
tttcctctgccctgcagagt

SEQ ID NO: 485591 - DNA, 20 bp, Artificial
  CRISPR gRNA sequence
ttcctctgccctgcagagtt

SEQ ID NO: 485592 - DNA, 20 bp, Artificial
  CRISPR gRNA sequence
cctctgccctgcagagttag

SEQ ID NO: 485593 - DNA, 20 bp, Artificial
  CRISPR gRNA sequence
ctgccctgcagagttaggag

SEQ ID NO: 485594 - DNA, 20 bp, Artificial
  CRISPR gRNA sequence
cagagttaggagtggctgcc

SEQ ID NO: 485595 - DNA, 20 bp, Artificial
  CRISPR gRNA sequence
gagttaggagtggctgccca

SEQ ID NO: 485596 - DNA, 20 bp, Artificial
  CRISPR gRNA sequence
agttaggagtggctgcccag

SEQ ID NO: 485597 - DNA, 20 bp, Artificial
  CRISPR gRNA sequence
taggagtggctgcccagagg

SEQ ID NO: 485598 - DNA, 20 bp, Artificial
  CRISPR gRNA sequence
gagtggctgcccagaggcgg

SEQ ID NO: 485599 - DNA, 20 bp, Artificial
  CRISPR gRNA sequence
agtggctgcccagaggcggt

SEQ ID NO: 485600 - DNA, 20 bp, Artificial
  CRISPR gRNA sequence
ggctgcccagaggcggtggg

SEQ ID NO: 485601 - DNA, 20 bp, Artificial
  CRISPR gRNA sequence
gctgcccagaggcggtgggt

SEQ ID NO: 485602 - DNA, 20 bp, Artificial
  CRISPR gRNA sequence
tgcccagaggcggtgggtgg

SEQ ID NO: 485603 - DNA, 20 bp, Artificial
  CRISPR gRNA sequence
tgggtgggagctgccattga

SEQ ID NO: 485604 - DNA, 20 bp, Artificial
  CRISPR gRNA sequence
ggagctgccattgaaagaaa

SEQ ID NO: 485605 - DNA, 20 bp, Artificial
  CRISPR gRNA sequence
tgccattgaaagaaaaagcc

SEQ ID NO: 485606 - DNA, 20 bp, Artificial
  CRISPR gRNA sequence
gccattgaaagaaaaagcca

SEQ ID NO: 485607 - DNA, 20 bp, Artificial
  CRISPR gRNA sequence
agaaaaagccaaggcctgcc

SEQ ID NO: 485608 - DNA, 20 bp, Artificial
  CRISPR gRNA sequence
caaggcctgcctggtgtatg

SEQ ID NO: 485609 - DNA, 20 bp, Artificial
  CRISPR gRNA sequence
gcctgcctggtgtatgcaga

SEQ ID NO: 485610 - DNA, 20 bp, Artificial
  CRISPR gRNA sequence
cctgcctggtgtatgcagaa

SEQ ID NO: 485611 - DNA, 20 bp, Artificial
  CRISPR gRNA sequence
ctggtgtatgcagaaaggaa

SEQ ID NO: 485612 - DNA, 20 bp, Artificial
  CRISPR gRNA sequence
tggtgtatgcagaaaggaac

SEQ ID NO: 485613 - DNA, 20 bp, Artificial
  CRISPR gRNA sequence
ggtgtatgcagaaaggaaca

SEQ ID NO: 485614 - DNA, 20 bp, Artificial
  CRISPR gRNA sequence
gtatgcagaaaggaacaggg

SEQ ID NO: 485615 - DNA, 20 bp, Artificial
  CRISPR gRNA sequence
tatgcagaaaggaacaggga

SEQ ID NO: 485616 - DNA, 20 bp, Artificial
  CRISPR gRNA sequence
gcagaaaggaacagggaagg

SEQ ID NO: 485617 - DNA, 20 bp, Artificial
  CRISPR gRNA sequence
cagaaaggaacagggaaggt

SEQ ID NO: 485618 - DNA, 20 bp, Artificial
  CRISPR gRNA sequence
aacagggaaggtgggtatta

SEQ ID NO: 485619 - DNA, 20 bp, Artificial
  CRISPR gRNA sequence
gaaggtgggtattatggacc

SEQ ID NO: 485620 - DNA, 20 bp, Artificial
  CRISPR gRNA sequence
ggtgggtattatggacccag

SEQ ID NO: 485621 - DNA, 20 bp, Artificial
  CRISPR gRNA sequence
gggtattatggacccagcag

SEQ ID NO: 485622 - DNA, 20 bp, Artificial
  CRISPR gRNA sequence
ttatggacccagcagtagca

SEQ ID NO: 485623 - DNA, 20 bp, Artificial
  CRISPR gRNA sequence
gacccagcagtagcatggtt

SEQ ID NO: 485624 - DNA, 20 bp, Artificial
  CRISPR gRNA sequence
acccagcagtagcatggtta

SEQ ID NO: 485625 - DNA, 20 bp, Artificial
  CRISPR gRNA sequence
cccagcagtagcatggttaa

SEQ ID NO: 485626 - DNA, 20 bp, Artificial
  CRISPR gRNA sequence
gggaacacaaaacacacgtg

SEQ ID NO: 485627 - DNA, 20 bp, Artificial
  CRISPR gRNA sequence
caaaacacacgtgtggctta

SEQ ID NO: 485628 - DNA, 20 bp, Artificial
  CRISPR gRNA sequence
aaaacacacgtgtggcttat

SEQ ID NO: 485629 - DNA, 20 bp, Artificial
  CRISPR gRNA sequence
acacgtgtggcttatgggtc

SEQ ID NO: 485630 - DNA, 20 bp, Artificial
  CRISPR gRNA sequence
tgtggcttatgggtctggta

SEQ ID NO: 485631 - DNA, 20 bp, Artificial
  CRISPR gRNA sequence
gcttatgggtctggtaaaga

SEQ ID NO: 485632 - DNA, 20 bp, Artificial
  CRISPR gRNA sequence
ttatgggtctggtaaagatg

SEQ ID NO: 485633 - DNA, 20 bp, Artificial
  CRISPR gRNA sequence
tgggtctggtaaagatggag

SEQ ID NO: 485634 - DNA, 20 bp, Artificial
  CRISPR gRNA sequence
gggtctggtaaagatggagc

SEQ ID NO: 485635 - DNA, 20 bp, Artificial
  CRISPR gRNA sequence
tggtaaagatggagcaggtt

SEQ ID NO: 485636 - DNA, 20 bp, Artificial
  CRISPR gRNA sequence
gtaaagatggagcaggtttg

SEQ ID NO: 485637 - DNA, 20 bp, Artificial
  CRISPR gRNA sequence
gatggagcaggtttggagaa

SEQ ID NO: 485638 - DNA, 20 bp, Artificial
  CRISPR gRNA sequence
atggagcaggtttggagaat

SEQ ID NO: 485639 - DNA, 20 bp, Artificial
  CRISPR gRNA sequence
tggagcaggtttggagaatg

SEQ ID NO: 485640 - DNA, 20 bp, Artificial
  CRISPR gRNA sequence
aggtttggagaatggggtga

SEQ ID NO: 485641 - DNA, 20 bp, Artificial
  CRISPR gRNA sequence
agaatggggtgatggaacat

SEQ ID NO: 485642 - DNA, 20 bp, Artificial
  CRISPR gRNA sequence
tggaacatgagtttaatttt

SEQ ID NO: 485643 - DNA, 20 bp, Artificial
  CRISPR gRNA sequence
ggaacatgagtttaattttc

SEQ ID NO: 485644 - DNA, 20 bp, Artificial
  CRISPR gRNA sequence
gagtttaattttcaggtgtt

SEQ ID NO: 485645 - DNA, 20 bp, Artificial
  CRISPR gRNA sequence
tttaattttcaggtgtttag

SEQ ID NO: 485646 - DNA, 20 bp, Artificial
  CRISPR gRNA sequence
aattttcaggtgtttagtgg

SEQ ID NO: 485647 - DNA, 20 bp, Artificial
  CRISPR gRNA sequence
tttatcttttataaaattgt

SEQ ID NO: 485648 - DNA, 20 bp, Artificial
  CRISPR gRNA sequence
tatcttttataaaattgtga

SEQ ID NO: 485649 - DNA, 20 bp, Artificial
  CRISPR gRNA sequence
atcttttataaaattgtgag

SEQ ID NO: 485650 - DNA, 20 bp, Artificial
  CRISPR gRNA sequence
ttttataaaattgtgagagg

SEQ ID NO: 485651 - DNA, 20 bp, Artificial
  CRISPR gRNA sequence
aaaattgtgagaggtagcac

SEQ ID NO: 485652 - DNA, 20 bp, Artificial
  CRISPR gRNA sequence
agaggtagcacaagtattaa

SEQ ID NO: 485653 - DNA, 20 bp, Artificial
  CRISPR gRNA sequence
gaggtagcacaagtattaaa

SEQ ID NO: 485654 - DNA, 20 bp, Artificial
  CRISPR gRNA sequence
ggtacttaaatataaatata

SEQ ID NO: 485655 - DNA, 20 bp, Artificial
  CRISPR gRNA sequence
taaactcccatataatccac

SEQ ID NO: 485656 - DNA, 20 bp, Artificial
  CRISPR gRNA sequence
actcccatataatccaccag

SEQ ID NO: 485657 - DNA, 20 bp, Artificial
  CRISPR gRNA sequence
catataatccaccagtagat

SEQ ID NO: 485658 - DNA, 20 bp, Artificial
  CRISPR gRNA sequence
tccaccagtagatcagaatg

SEQ ID NO: 485659 - DNA, 20 bp, Artificial
  CRISPR gRNA sequence
caccagtagatcagaatgta

SEQ ID NO: 485660 - DNA, 20 bp, Artificial
  CRISPR gRNA sequence
tcagaatgtagagcgctatg

SEQ ID NO: 485661 - DNA, 20 bp, Artificial
  CRISPR gRNA sequence
gaatgtagagcgctatgtag

SEQ ID NO: 485662 - DNA, 20 bp, Artificial
  CRISPR gRNA sequence
tgtagagcgctatgtagaag

SEQ ID NO: 485663 - DNA, 20 bp, Artificial
  CRISPR gRNA sequence
gtagagcgctatgtagaaga

SEQ ID NO: 485664 - DNA, 20 bp, Artificial
  CRISPR gRNA sequence
tctgctattataaaactgaa

SEQ ID NO: 485665 - DNA, 20 bp, Artificial
  CRISPR gRNA sequence
ctgctattataaaactgaat

SEQ ID NO: 485666 - DNA, 20 bp, Artificial
  CRISPR gRNA sequence
aaaactgaataggaatcaca

SEQ ID NO: 485667 - DNA, 20 bp, Artificial
  CRISPR gRNA sequence
aaactgaataggaatcacac

SEQ ID NO: 485668 - DNA, 20 bp, Artificial
  CRISPR gRNA sequence
ataggaatcacacaggaaaa

SEQ ID NO: 485669 - DNA, 20 bp, Artificial
  CRISPR gRNA sequence
aatcacacaggaaaatggtt

SEQ ID NO: 485670 - DNA, 20 bp, Artificial
  CRISPR gRNA sequence
aaaatggttaagttattgtc

SEQ ID NO: 485671 - DNA, 20 bp, Artificial
  CRISPR gRNA sequence
tttgtttgtttgtttgtttt

SEQ ID NO: 485672 - DNA, 20 bp, Artificial
  CRISPR gRNA sequence
tttgtttgtttgttttaaga

SEQ ID NO: 485673 - DNA, 20 bp, Artificial
  CRISPR gRNA sequence
tgtttgtttgttttaagaca

SEQ ID NO: 485674 - DNA, 20 bp, Artificial
  CRISPR gRNA sequence
cagagtctcgctctgtcacc

SEQ ID NO: 485675 - DNA, 20 bp, Artificial
  CRISPR gRNA sequence
tctcgctctgtcacccagac

SEQ ID NO: 485676 - DNA, 20 bp, Artificial
  CRISPR gRNA sequence
ctgtcacccagactggtgtg

SEQ ID NO: 485677 - DNA, 20 bp, Artificial
  CRISPR gRNA sequence
tcacccagactggtgtgcag

SEQ ID NO: 485678 - DNA, 20 bp, Artificial
  CRISPR gRNA sequence
ggtgtgcagtggcatgatct

SEQ ID NO: 485679 - DNA, 20 bp, Artificial
  CRISPR gRNA sequence
tcactgcaatctctgcctcc

SEQ ID NO: 485680 - DNA, 20 bp, Artificial
  CRISPR gRNA sequence
cactgcaatctctgcctccc

SEQ ID NO: 485681 - DNA, 20 bp, Artificial
  CRISPR gRNA sequence
aatctctgcctcccaggttc

SEQ ID NO: 485682 - DNA, 20 bp, Artificial
  CRISPR gRNA sequence
ttcaagtgattctcctgtct

SEQ ID NO: 485683 - DNA, 20 bp, Artificial
  CRISPR gRNA sequence
ttctcctgtctcagcctcat

SEQ ID NO: 485684 - DNA, 20 bp, Artificial
  CRISPR gRNA sequence
gtctcagcctcatgagtaac

SEQ ID NO: 485685 - DNA, 20 bp, Artificial
  CRISPR gRNA sequence
tctcagcctcatgagtaact

SEQ ID NO: 485686 - DNA, 20 bp, Artificial
  CRISPR gRNA sequence
ctcatgagtaactgggacta

SEQ ID NO: 485687 - DNA, 20 bp, Artificial
  CRISPR gRNA sequence
tcatgagtaactgggactac

SEQ ID NO: 485688 - DNA, 20 bp, Artificial
  CRISPR gRNA sequence
caggtgcctgccaccacccc

SEQ ID NO: 485689 - DNA, 20 bp, Artificial
  CRISPR gRNA sequence
tttttttttttttgtatttt

SEQ ID NO: 485690 - DNA, 20 bp, Artificial
  CRISPR gRNA sequence
ttttttttttgtatttttag

SEQ ID NO: 485691 - DNA, 20 bp, Artificial
  CRISPR gRNA sequence
ttttttttgtatttttagta

SEQ ID NO: 485692 - DNA, 20 bp, Artificial
  CRISPR gRNA sequence
ttttgtatttttagtagaga

SEQ ID NO: 485693 - DNA, 20 bp, Artificial
  CRISPR gRNA sequence
tttgtatttttagtagagac

SEQ ID NO: 485694 - DNA, 20 bp, Artificial
  CRISPR gRNA sequence
ttgtatttttagtagagaca

SEQ ID NO: 485695 - DNA, 20 bp, Artificial
  CRISPR gRNA sequence
gagacagggtttcgccatat

SEQ ID NO: 485696 - DNA, 20 bp, Artificial
  CRISPR gRNA sequence
cagggtttcgccatattggc

SEQ ID NO: 485697 - DNA, 20 bp, Artificial
  CRISPR gRNA sequence
agggtttcgccatattggcc

SEQ ID NO: 485698 - DNA, 20 bp, Artificial
  CRISPR gRNA sequence
tttcgccatattggccaggc

SEQ ID NO: 485699 - DNA, 20 bp, Artificial
  CRISPR gRNA sequence
ggtcttgaactcctgacctc

SEQ ID NO: 485700 - DNA, 20 bp, Artificial
  CRISPR gRNA sequence
ctcaagtaatccacccgtct

SEQ ID NO: 485701 - DNA, 20 bp, Artificial
  CRISPR gRNA sequence
ccacccgtctcagcctccca

SEQ ID NO: 485702 - DNA, 20 bp, Artificial
  CRISPR gRNA sequence
gtctcagcctcccaaagttc

SEQ ID NO: 485703 - DNA, 20 bp, Artificial
  CRISPR gRNA sequence
gcctcccaaagttctggcgt

SEQ ID NO: 485704 - DNA, 20 bp, Artificial
  CRISPR gRNA sequence
ctggcgtgagccaccactcc

SEQ ID NO: 485705 - DNA, 20 bp, Artificial
  CRISPR gRNA sequence
tgagccaccactcccagcca

SEQ ID NO: 485706 - DNA, 20 bp, Artificial
  CRISPR gRNA sequence
catagacttctaaatactta

SEQ ID NO: 485707 - DNA, 20 bp, Artificial
  CRISPR gRNA sequence
agaatgaaatgtgtgatcta

SEQ ID NO: 485708 - DNA, 20 bp, Artificial
  CRISPR gRNA sequence
tcctcatgctatactgcctt

SEQ ID NO: 485709 - DNA, 20 bp, Artificial
  CRISPR gRNA sequence
cctcatgctatactgccttt

SEQ ID NO: 485710 - DNA, 20 bp, Artificial
  CRISPR gRNA sequence
ctcatgctatactgcctttg

SEQ ID NO: 485711 - DNA, 20 bp, Artificial
  CRISPR gRNA sequence
tttggggtctttttaaaaat

SEQ ID NO: 485712 - DNA, 20 bp, Artificial
  CRISPR gRNA sequence
ttggggtctttttaaaaatt

SEQ ID NO: 485713 - DNA, 20 bp, Artificial
  CRISPR gRNA sequence
atttttatgtaatattatat

SEQ ID NO: 485714 - DNA, 20 bp, Artificial
  CRISPR gRNA sequence
ttatattagtttatacattt

SEQ ID NO: 485715 - DNA, 20 bp, Artificial
  CRISPR gRNA sequence
ttagtttatacatttaagac

SEQ ID NO: 485716 - DNA, 20 bp, Artificial
  CRISPR gRNA sequence
ctggtttgtctgcaaataaa

SEQ ID NO: 485717 - DNA, 20 bp, Artificial
  CRISPR gRNA sequence
tggtttgtctgcaaataaaa

SEQ ID NO: 485718 - DNA, 20 bp, Artificial
  CRISPR gRNA sequence
gtttgtctgcaaataaaaag

SEQ ID NO: 485719 - DNA, 20 bp, Artificial
  CRISPR gRNA sequence
gtctgcaaataaaaaggagc

SEQ ID NO: 485720 - DNA, 20 bp, Artificial
  CRISPR gRNA sequence
ctgcaaataaaaaggagcta

SEQ ID NO: 485721 - DNA, 20 bp, Artificial
  CRISPR gRNA sequence
gcaaataaaaaggagctaga

SEQ ID NO: 485722 - DNA, 20 bp, Artificial
  CRISPR gRNA sequence
aaaggagctagagagaacac

SEQ ID NO: 485723 - DNA, 20 bp, Artificial
  CRISPR gRNA sequence
aaggagctagagagaacacc

SEQ ID NO: 485724 - DNA, 20 bp, Artificial
  CRISPR gRNA sequence
tgttgttttgatttttcaac

SEQ ID NO: 485725 - DNA, 20 bp, Artificial
  CRISPR gRNA sequence
tgttttgatttttcaactgg

SEQ ID NO: 485726 - DNA, 20 bp, Artificial
  CRISPR gRNA sequence
gttttgatttttcaactgga

SEQ ID NO: 485727 - DNA, 20 bp, Artificial
  CRISPR gRNA sequence
actggaaggaaactgtacta

SEQ ID NO: 485728 - DNA, 20 bp, Artificial
  CRISPR gRNA sequence
ctggaaggaaactgtactaa

SEQ ID NO: 485729 - DNA, 20 bp, Artificial
  CRISPR gRNA sequence
gaaggaaactgtactaaagg

SEQ ID NO: 485730 - DNA, 20 bp, Artificial
  CRISPR gRNA sequence
aaggaaactgtactaaaggt

SEQ ID NO: 485731 - DNA, 20 bp, Artificial
  CRISPR gRNA sequence
gaaactgtactaaaggtagg

SEQ ID NO: 485732 - DNA, 20 bp, Artificial
  CRISPR gRNA sequence
tactaaaggtaggaagccca

SEQ ID NO: 485733 - DNA, 20 bp, Artificial
  CRISPR gRNA sequence
aaggtaggaagcccacagaa

SEQ ID NO: 485734 - DNA, 20 bp, Artificial
  CRISPR gRNA sequence
aggtaggaagcccacagaaa

SEQ ID NO: 485735 - DNA, 20 bp, Artificial
  CRISPR gRNA sequence
gtaggaagcccacagaaaag

SEQ ID NO: 485736 - DNA, 20 bp, Artificial
  CRISPR gRNA sequence
ggaagcccacagaaaaggag

SEQ ID NO: 485737 - DNA, 20 bp, Artificial
  CRISPR gRNA sequence
ccacagaaaaggagcagctg

SEQ ID NO: 485738 - DNA, 20 bp, Artificial
  CRISPR gRNA sequence
agaaaaggagcagctgaaga

SEQ ID NO: 485739 - DNA, 20 bp, Artificial
  CRISPR gRNA sequence
aggagcagctgaagaaagat

SEQ ID NO: 485740 - DNA, 20 bp, Artificial
  CRISPR gRNA sequence
ggagcagctgaagaaagatg

SEQ ID NO: 485741 - DNA, 20 bp, Artificial
  CRISPR gRNA sequence
gagcagctgaagaaagatga

SEQ ID NO: 485742 - DNA, 20 bp, Artificial
  CRISPR gRNA sequence
aaagatgagggatgtcttca

SEQ ID NO: 485743 - DNA, 20 bp, Artificial
  CRISPR gRNA sequence
atgagggatgtcttcacaga

SEQ ID NO: 485744 - DNA, 20 bp, Artificial
  CRISPR gRNA sequence
agggatgtcttcacagacag

SEQ ID NO: 485745 - DNA, 20 bp, Artificial
  CRISPR gRNA sequence
gggatgtcttcacagacagc

SEQ ID NO: 485746 - DNA, 20 bp, Artificial
  CRISPR gRNA sequence
tcttcacagacagcaggtcc

SEQ ID NO: 485747 - DNA, 20 bp, Artificial
  CRISPR gRNA sequence
cttcacagacagcaggtccc

SEQ ID NO: 485748 - DNA, 20 bp, Artificial
  CRISPR gRNA sequence
aggtcccaggtgacttctga

SEQ ID NO: 485749 - DNA, 20 bp, Artificial
  CRISPR gRNA sequence
tcccaggtgacttctgaaag

SEQ ID NO: 485750 - DNA, 20 bp, Artificial
  CRISPR gRNA sequence
gtgacttctgaaagaagctc

SEQ ID NO: 485751 - DNA, 20 bp, Artificial
  CRISPR gRNA sequence
gaaagaagctctggtgccct

SEQ ID NO: 485752 - DNA, 20 bp, Artificial
  CRISPR gRNA sequence
gctctggtgccctgagcaca

SEQ ID NO: 485753 - DNA, 20 bp, Artificial
  CRISPR gRNA sequence
ctctggtgccctgagcacac

SEQ ID NO: 485754 - DNA, 20 bp, Artificial
  CRISPR gRNA sequence
tctggtgccctgagcacaca

SEQ ID NO: 485755 - DNA, 20 bp, Artificial
  CRISPR gRNA sequence
ctggtgccctgagcacacag

SEQ ID NO: 485756 - DNA, 20 bp, Artificial
  CRISPR gRNA sequence
ggtgccctgagcacacaggg

SEQ ID NO: 485757 - DNA, 20 bp, Artificial
  CRISPR gRNA sequence
ctgagcacacaggggagtat

SEQ ID NO: 485758 - DNA, 20 bp, Artificial
  CRISPR gRNA sequence
cacacaggggagtattggtc

SEQ ID NO: 485759 - DNA, 20 bp, Artificial
  CRISPR gRNA sequence
acacaggggagtattggtca

SEQ ID NO: 485760 - DNA, 20 bp, Artificial
  CRISPR gRNA sequence
aggggagtattggtcaagga

SEQ ID NO: 485761 - DNA, 20 bp, Artificial
  CRISPR gRNA sequence
ggggagtattggtcaaggac

SEQ ID NO: 485762 - DNA, 20 bp, Artificial
  CRISPR gRNA sequence
gggagtattggtcaaggaca

SEQ ID NO: 485763 - DNA, 20 bp, Artificial
  CRISPR gRNA sequence
gtattggtcaaggacagggc

SEQ ID NO: 485764 - DNA, 20 bp, Artificial
  CRISPR gRNA sequence
ggcaagaacactcttgccct

SEQ ID NO: 485765 - DNA, 20 bp, Artificial
  CRISPR gRNA sequence
aagaacactcttgccctcag

SEQ ID NO: 485766 - DNA, 20 bp, Artificial
  CRISPR gRNA sequence
gaacactcttgccctcagca

SEQ ID NO: 485767 - DNA, 20 bp, Artificial
  CRISPR gRNA sequence
aacactcttgccctcagcag

SEQ ID NO: 485768 - DNA, 20 bp, Artificial
  CRISPR gRNA sequence
gccctcagcagaggcaaatg

SEQ ID NO: 485769 - DNA, 20 bp, Artificial
  CRISPR gRNA sequence
gaggcaaatgtggccattta

SEQ ID NO: 485770 - DNA, 20 bp, Artificial
  CRISPR gRNA sequence
aggcaaatgtggccatttac

SEQ ID NO: 485771 - DNA, 20 bp, Artificial
  CRISPR gRNA sequence
gcaaatgtggccatttacag

SEQ ID NO: 485772 - DNA, 20 bp, Artificial
  CRISPR gRNA sequence
aatgtggccatttacaggag

SEQ ID NO: 485773 - DNA, 20 bp, Artificial
  CRISPR gRNA sequence
gccatttacaggagtagatg

SEQ ID NO: 485774 - DNA, 20 bp, Artificial
  CRISPR gRNA sequence
tagatgaagtacattgacac

SEQ ID NO: 485775 - DNA, 20 bp, Artificial
  CRISPR gRNA sequence
gatgaagtacattgacactg

SEQ ID NO: 485776 - DNA, 20 bp, Artificial
  CRISPR gRNA sequence
cattgacactggagacttgt

SEQ ID NO: 485777 - DNA, 20 bp, Artificial
  CRISPR gRNA sequence
gacactggagacttgttggc

SEQ ID NO: 485778 - DNA, 20 bp, Artificial
  CRISPR gRNA sequence
acactggagacttgttggca

SEQ ID NO: 485779 - DNA, 20 bp, Artificial
  CRISPR gRNA sequence
tggagacttgttggcaaggt

SEQ ID NO: 485780 - DNA, 20 bp, Artificial
  CRISPR gRNA sequence
agacttgttggcaaggttgg

SEQ ID NO: 485781 - DNA, 20 bp, Artificial
  CRISPR gRNA sequence
cttgtgcttctgttttctta

SEQ ID NO: 485782 - DNA, 20 bp, Artificial
  CRISPR gRNA sequence
gtgcttctgttttcttaaag

SEQ ID NO: 485783 - DNA, 20 bp, Artificial
  CRISPR gRNA sequence
tgcttctgttttcttaaaga

SEQ ID NO: 485784 - DNA, 20 bp, Artificial
  CRISPR gRNA sequence
cttctgttttcttaaagaag

SEQ ID NO: 485785 - DNA, 20 bp, Artificial
  CRISPR gRNA sequence
ttctgttttcttaaagaagg

SEQ ID NO: 485786 - DNA, 20 bp, Artificial
  CRISPR gRNA sequence
ttcttaaagaaggaggttgt

SEQ ID NO: 485787 - DNA, 20 bp, Artificial
  CRISPR gRNA sequence
agaaggaggttgttggtttg

SEQ ID NO: 485788 - DNA, 20 bp, Artificial
  CRISPR gRNA sequence
aaggaggttgttggtttgtg

SEQ ID NO: 485789 - DNA, 20 bp, Artificial
  CRISPR gRNA sequence
aggaggttgttggtttgtgg

SEQ ID NO: 485790 - DNA, 20 bp, Artificial
  CRISPR gRNA sequence
gttgttggtttgtggaggct

SEQ ID NO: 485791 - DNA, 20 bp, Artificial
  CRISPR gRNA sequence
ttggtttgtggaggctgaga

SEQ ID NO: 485792 - DNA, 20 bp, Artificial
  CRISPR gRNA sequence
gtttgtggaggctgagatag

SEQ ID NO: 485793 - DNA, 20 bp, Artificial
  CRISPR gRNA sequence
tggaggctgagatagtggaa

SEQ ID NO: 485794 - DNA, 20 bp, Artificial
  CRISPR gRNA sequence
ggaggctgagatagtggaac

SEQ ID NO: 485795 - DNA, 20 bp, Artificial
  CRISPR gRNA sequence
gaggctgagatagtggaaca

SEQ ID NO: 485796 - DNA, 20 bp, Artificial
  CRISPR gRNA sequence
atagtggaacagggccttga

SEQ ID NO: 485797 - DNA, 20 bp, Artificial
  CRISPR gRNA sequence
agtggaacagggccttgaaa

SEQ ID NO: 485798 - DNA, 20 bp, Artificial
  CRISPR gRNA sequence
gggccttgaaagagatgacg

SEQ ID NO: 485799 - DNA, 20 bp, Artificial
  CRISPR gRNA sequence
ggccttgaaagagatgacga

SEQ ID NO: 485800 - DNA, 20 bp, Artificial
  CRISPR gRNA sequence
tgaaagagatgacgaaggtg

SEQ ID NO: 485801 - DNA, 20 bp, Artificial
  CRISPR gRNA sequence
tgtggaattctcccaccttt

SEQ ID NO: 485802 - DNA, 20 bp, Artificial
  CRISPR gRNA sequence
gtggaattctcccacctttt

SEQ ID NO: 485803 - DNA, 20 bp, Artificial
  CRISPR gRNA sequence
tggaattctcccaccttttg

SEQ ID NO: 485804 - DNA, 20 bp, Artificial
  CRISPR gRNA sequence
ttctcccaccttttggggaa

SEQ ID NO: 485805 - DNA, 20 bp, Artificial
  CRISPR gRNA sequence
tctcccaccttttggggaac

SEQ ID NO: 485806 - DNA, 20 bp, Artificial
  CRISPR gRNA sequence
tcccaccttttggggaacag

SEQ ID NO: 485807 - DNA, 20 bp, Artificial
  CRISPR gRNA sequence
caccttttggggaacaggag

SEQ ID NO: 485808 - DNA, 20 bp, Artificial
  CRISPR gRNA sequence
ttggggaacaggagaagctg

SEQ ID NO: 485809 - DNA, 20 bp, Artificial
  CRISPR gRNA sequence
tggggaacaggagaagctgt

SEQ ID NO: 485810 - DNA, 20 bp, Artificial
  CRISPR gRNA sequence
gaacaggagaagctgtgggc

SEQ ID NO: 485811 - DNA, 20 bp, Artificial
  CRISPR gRNA sequence
agaagctgtgggccagaaat

SEQ ID NO: 485812 - DNA, 20 bp, Artificial
  CRISPR gRNA sequence
gaagctgtgggccagaaatg

SEQ ID NO: 485813 - DNA, 20 bp, Artificial
  CRISPR gRNA sequence
gggccagaaatgaggattcc

SEQ ID NO: 485814 - DNA, 20 bp, Artificial
  CRISPR gRNA sequence
ggccagaaatgaggattccc

SEQ ID NO: 485815 - DNA, 20 bp, Artificial
  CRISPR gRNA sequence
atgaggattcccaggacact

SEQ ID NO: 485816 - DNA, 20 bp, Artificial
  CRISPR gRNA sequence
gaggattcccaggacactga

SEQ ID NO: 485817 - DNA, 20 bp, Artificial
  CRISPR gRNA sequence
ttcccaggacactgagagtc

SEQ ID NO: 485818 - DNA, 20 bp, Artificial
  CRISPR gRNA sequence
caggacactgagagtccagc

SEQ ID NO: 485819 - DNA, 20 bp, Artificial
  CRISPR gRNA sequence
aggacactgagagtccagct

SEQ ID NO: 485820 - DNA, 20 bp, Artificial
  CRISPR gRNA sequence
ggacactgagagtccagctg

SEQ ID NO: 485821 - DNA, 20 bp, Artificial
  CRISPR gRNA sequence
actgagagtccagctggggt

SEQ ID NO: 485822 - DNA, 20 bp, Artificial
  CRISPR gRNA sequence
tgagagtccagctggggttg

SEQ ID NO: 485823 - DNA, 20 bp, Artificial
  CRISPR gRNA sequence
ggttggagattacgaatctg

SEQ ID NO: 485824 - DNA, 20 bp, Artificial
  CRISPR gRNA sequence
tgttgctgaattttctcctg

SEQ ID NO: 485825 - DNA, 20 bp, Artificial
  CRISPR gRNA sequence
ttttctcctgcagcccccaa

SEQ ID NO: 485826 - DNA, 20 bp, Artificial
  CRISPR gRNA sequence
tcctgcagcccccaacagtc

SEQ ID NO: 485827 - DNA, 20 bp, Artificial
  CRISPR gRNA sequence
cagcccccaacagtccagtg

SEQ ID NO: 485828 - DNA, 20 bp, Artificial
  CRISPR gRNA sequence
agcccccaacagtccagtgt

SEQ ID NO: 485829 - DNA, 20 bp, Artificial
  CRISPR gRNA sequence
ccccaacagtccagtgtggg

SEQ ID NO: 485830 - DNA, 20 bp, Artificial
  CRISPR gRNA sequence
cccaacagtccagtgtggga

SEQ ID NO: 485831 - DNA, 20 bp, Artificial
  CRISPR gRNA sequence
caacagtccagtgtgggaag

SEQ ID NO: 485832 - DNA, 20 bp, Artificial
  CRISPR gRNA sequence
aacagtccagtgtgggaagg

SEQ ID NO: 485833 - DNA, 20 bp, Artificial
  CRISPR gRNA sequence
agtccagtgtgggaaggagg

SEQ ID NO: 485834 - DNA, 20 bp, Artificial
  CRISPR gRNA sequence
cagtgtgggaaggaggaaga

SEQ ID NO: 485835 - DNA, 20 bp, Artificial
  CRISPR gRNA sequence
gtgggaaggaggaagatggt

SEQ ID NO: 485836 - DNA, 20 bp, Artificial
  CRISPR gRNA sequence
aggaggaagatggttggaat

SEQ ID NO: 485837 - DNA, 20 bp, Artificial
  CRISPR gRNA sequence
atggttggaatgagtttcca

SEQ ID NO: 485838 - DNA, 20 bp, Artificial
  CRISPR gRNA sequence
ttggaatgagtttccatgga

SEQ ID NO: 485839 - DNA, 20 bp, Artificial
  CRISPR gRNA sequence
atgagtttccatggacggcc

SEQ ID NO: 485840 - DNA, 20 bp, Artificial
  CRISPR gRNA sequence
agtttccatggacggcctgg

SEQ ID NO: 485841 - DNA, 20 bp, Artificial
  CRISPR gRNA sequence
gtttccatggacggcctgga

SEQ ID NO: 485842 - DNA, 20 bp, Artificial
  CRISPR gRNA sequence
tttccatggacggcctggaa

SEQ ID NO: 485843 - DNA, 20 bp, Artificial
  CRISPR gRNA sequence
ttccatggacggcctggaag

SEQ ID NO: 485844 - DNA, 20 bp, Artificial
  CRISPR gRNA sequence
catggacggcctggaagggg

SEQ ID NO: 485845 - DNA, 20 bp, Artificial
  CRISPR gRNA sequence
atggacggcctggaaggggt

SEQ ID NO: 485846 - DNA, 20 bp, Artificial
  CRISPR gRNA sequence
ggcctggaaggggtgggtgc

SEQ ID NO: 485847 - DNA, 20 bp, Artificial
  CRISPR gRNA sequence
gcctggaaggggtgggtgcc

SEQ ID NO: 485848 - DNA, 20 bp, Artificial
  CRISPR gRNA sequence
cctggaaggggtgggtgcca

SEQ ID NO: 485849 - DNA, 20 bp, Artificial
  CRISPR gRNA sequence
ggaaggggtgggtgccaggg

SEQ ID NO: 485850 - DNA, 20 bp, Artificial
  CRISPR gRNA sequence
gaaggggtgggtgccagggc

SEQ ID NO: 485851 - DNA, 20 bp, Artificial
  CRISPR gRNA sequence
aaggggtgggtgccagggca

SEQ ID NO: 485852 - DNA, 20 bp, Artificial
  CRISPR gRNA sequence
aggggtgggtgccagggcag

SEQ ID NO: 485853 - DNA, 20 bp, Artificial
  CRISPR gRNA sequence
ggtgccagggcaggggtgca

SEQ ID NO: 485854 - DNA, 20 bp, Artificial
  CRISPR gRNA sequence
gccagggcaggggtgcaaag

SEQ ID NO: 485855 - DNA, 20 bp, Artificial
  CRISPR gRNA sequence
gcaggggtgcaaagcagata

SEQ ID NO: 485856 - DNA, 20 bp, Artificial
  CRISPR gRNA sequence
tgcaaagcagatacggtgaa

SEQ ID NO: 485857 - DNA, 20 bp, Artificial
  CRISPR gRNA sequence
gcaaagcagatacggtgaaa

SEQ ID NO: 485858 - DNA, 20 bp, Artificial
  CRISPR gRNA sequence
agcagatacggtgaaaaggc

SEQ ID NO: 485859 - DNA, 20 bp, Artificial
  CRISPR gRNA sequence
agatacggtgaaaaggcaag

SEQ ID NO: 485860 - DNA, 20 bp, Artificial
  CRISPR gRNA sequence
cggtgaaaaggcaagtagac

SEQ ID NO: 485861 - DNA, 20 bp, Artificial
  CRISPR gRNA sequence
agtagacaagtcactatgtc

SEQ ID NO: 485862 - DNA, 20 bp, Artificial
  CRISPR gRNA sequence
gtagacaagtcactatgtcc

SEQ ID NO: 485863 - DNA, 20 bp, Artificial
  CRISPR gRNA sequence
tagacaagtcactatgtcca

SEQ ID NO: 485864 - DNA, 20 bp, Artificial
  CRISPR gRNA sequence
ccagggtattgtgactgata

SEQ ID NO: 485865 - DNA, 20 bp, Artificial
  CRISPR gRNA sequence
ggtattgtgactgatacaga

SEQ ID NO: 485866 - DNA, 20 bp, Artificial
  CRISPR gRNA sequence
tgactgatacagaaagacct

SEQ ID NO: 485867 - DNA, 20 bp, Artificial
  CRISPR gRNA sequence
aaagacctcagtttctgtcc

SEQ ID NO: 485868 - DNA, 20 bp, Artificial
  CRISPR gRNA sequence
agacctcagtttctgtccca

SEQ ID NO: 485869 - DNA, 20 bp, Artificial
  CRISPR gRNA sequence
gacctcagtttctgtcccag

SEQ ID NO: 485870 - DNA, 20 bp, Artificial
  CRISPR gRNA sequence
acctcagtttctgtcccaga

SEQ ID NO: 485871 - DNA, 20 bp, Artificial
  CRISPR gRNA sequence
cctcagtttctgtcccagag

SEQ ID NO: 485872 - DNA, 20 bp, Artificial
  CRISPR gRNA sequence
tcccagaggggtacacacac

SEQ ID NO: 485873 - DNA, 20 bp, Artificial
  CRISPR gRNA sequence
agaggggtacacacaccaga

SEQ ID NO: 485874 - DNA, 20 bp, Artificial
  CRISPR gRNA sequence
gaggggtacacacaccagat

SEQ ID NO: 485875 - DNA, 20 bp, Artificial
  CRISPR gRNA sequence
aggggtacacacaccagata

SEQ ID NO: 485876 - DNA, 20 bp, Artificial
  CRISPR gRNA sequence
ggggtacacacaccagatag

SEQ ID NO: 485877 - DNA, 20 bp, Artificial
  CRISPR gRNA sequence
ggtacacacaccagataggg

SEQ ID NO: 485878 - DNA, 20 bp, Artificial
  CRISPR gRNA sequence
cgaaaacataacttcaacac

SEQ ID NO: 485879 - DNA, 20 bp, Artificial
  CRISPR gRNA sequence
aacacaagttctcacacatt

SEQ ID NO: 485880 - DNA, 20 bp, Artificial
  CRISPR gRNA sequence
caagttctcacacatttagt

SEQ ID NO: 485881 - DNA, 20 bp, Artificial
  CRISPR gRNA sequence
aagttctcacacatttagtg

SEQ ID NO: 485882 - DNA, 20 bp, Artificial
  CRISPR gRNA sequence
ctcacacatttagtgaggca

SEQ ID NO: 485883 - DNA, 20 bp, Artificial
  CRISPR gRNA sequence
cacacatttagtgaggcata

SEQ ID NO: 485884 - DNA, 20 bp, Artificial
  CRISPR gRNA sequence
acacatttagtgaggcatag

SEQ ID NO: 485885 - DNA, 20 bp, Artificial
  CRISPR gRNA sequence
acatttagtgaggcatagag

SEQ ID NO: 485886 - DNA, 20 bp, Artificial
  CRISPR gRNA sequence
catttagtgaggcatagagg

SEQ ID NO: 485887 - DNA, 20 bp, Artificial
  CRISPR gRNA sequence
ggcatagaggaggacccaac

SEQ ID NO: 485888 - DNA, 20 bp, Artificial
  CRISPR gRNA sequence
cccaacaagtgaaaattgtt

SEQ ID NO: 485889 - DNA, 20 bp, Artificial
  CRISPR gRNA sequence
caacaagtgaaaattgttta

SEQ ID NO: 485890 - DNA, 20 bp, Artificial
  CRISPR gRNA sequence
aacaagtgaaaattgtttag

SEQ ID NO: 485891 - DNA, 20 bp, Artificial
  CRISPR gRNA sequence
agtgaaaattgtttagagga

SEQ ID NO: 485892 - DNA, 20 bp, Artificial
  CRISPR gRNA sequence
tgaaaattgtttagaggaaa

SEQ ID NO: 485893 - DNA, 20 bp, Artificial
  CRISPR gRNA sequence
gaaaattgtttagaggaaag

SEQ ID NO: 485894 - DNA, 20 bp, Artificial
  CRISPR gRNA sequence
tgtttagaggaaagaggcca

SEQ ID NO: 485895 - DNA, 20 bp, Artificial
  CRISPR gRNA sequence
agaggaaagaggccacagtc

SEQ ID NO: 485896 - DNA, 20 bp, Artificial
  CRISPR gRNA sequence
gaggaaagaggccacagtcc

SEQ ID NO: 485897 - DNA, 20 bp, Artificial
  CRISPR gRNA sequence
gaaagaggccacagtccagg

SEQ ID NO: 485898 - DNA, 20 bp, Artificial
  CRISPR gRNA sequence
aaagaggccacagtccagga

SEQ ID NO: 485899 - DNA, 20 bp, Artificial
  CRISPR gRNA sequence
ccacagtccaggaaggcccc

SEQ ID NO: 485900 - DNA, 20 bp, Artificial
  CRISPR gRNA sequence
cacagtccaggaaggccccc

SEQ ID NO: 485901 - DNA, 20 bp, Artificial
  CRISPR gRNA sequence
ccactgctgttgctactgct

SEQ ID NO: 485902 - DNA, 20 bp, Artificial
  CRISPR gRNA sequence
ctgctgttgctactgctcag

SEQ ID NO: 485903 - DNA, 20 bp, Artificial
  CRISPR gRNA sequence
ttgctactgctcagcagctt

SEQ ID NO: 485904 - DNA, 20 bp, Artificial
  CRISPR gRNA sequence
tgctactgctcagcagcttt

SEQ ID NO: 485905 - DNA, 20 bp, Artificial
  CRISPR gRNA sequence
gctactgctcagcagctttg

SEQ ID NO: 485906 - DNA, 20 bp, Artificial
  CRISPR gRNA sequence
ctactgctcagcagctttgg

SEQ ID NO: 485907 - DNA, 20 bp, Artificial
  CRISPR gRNA sequence
ctttgggggccaccttcctg

SEQ ID NO: 485908 - DNA, 20 bp, Artificial
  CRISPR gRNA sequence
ggggccaccttcctgtggtt

SEQ ID NO: 485909 - DNA, 20 bp, Artificial
  CRISPR gRNA sequence
caccttcctgtggttaagaa

SEQ ID NO: 485910 - DNA, 20 bp, Artificial
  CRISPR gRNA sequence
tcctgtggttaagaacggat

SEQ ID NO: 485911 - DNA, 20 bp, Artificial
  CRISPR gRNA sequence
cctgtggttaagaacggatg

SEQ ID NO: 485912 - DNA, 20 bp, Artificial
  CRISPR gRNA sequence
taagaacggatgaggtgaac

SEQ ID NO: 485913 - DNA, 20 bp, Artificial
  CRISPR gRNA sequence
aggtgaactagtaactctga

SEQ ID NO: 485914 - DNA, 20 bp, Artificial
  CRISPR gRNA sequence
ggtgaactagtaactctgaa

SEQ ID NO: 485915 - DNA, 20 bp, Artificial
  CRISPR gRNA sequence
gtgaactagtaactctgaaa

SEQ ID NO: 485916 - DNA, 20 bp, Artificial
  CRISPR gRNA sequence
gaactagtaactctgaaagg

SEQ ID NO: 485917 - DNA, 20 bp, Artificial
  CRISPR gRNA sequence
aactagtaactctgaaaggg

SEQ ID NO: 485918 - DNA, 20 bp, Artificial
  CRISPR gRNA sequence
actagtaactctgaaaggga

SEQ ID NO: 485919 - DNA, 20 bp, Artificial
  CRISPR gRNA sequence
agtaactctgaaagggaggg

SEQ ID NO: 485920 - DNA, 20 bp, Artificial
  CRISPR gRNA sequence
taactctgaaagggagggca

SEQ ID NO: 485921 - DNA, 20 bp, Artificial
  CRISPR gRNA sequence
aactctgaaagggagggcag

SEQ ID NO: 485922 - DNA, 20 bp, Artificial
  CRISPR gRNA sequence
actctgaaagggagggcaga

SEQ ID NO: 485923 - DNA, 20 bp, Artificial
  CRISPR gRNA sequence
ctgaaagggagggcagaggg

SEQ ID NO: 485924 - DNA, 20 bp, Artificial
  CRISPR gRNA sequence
gcagatgattaactccactg

SEQ ID NO: 485925 - DNA, 20 bp, Artificial
  CRISPR gRNA sequence
gattaactccactgcagcct

SEQ ID NO: 485926 - DNA, 20 bp, Artificial
  CRISPR gRNA sequence
attaactccactgcagcctc

SEQ ID NO: 485927 - DNA, 20 bp, Artificial
  CRISPR gRNA sequence
aactccactgcagcctcagg

SEQ ID NO: 485928 - DNA, 20 bp, Artificial
  CRISPR gRNA sequence
cactgcagcctcaggaagaa

SEQ ID NO: 485929 - DNA, 20 bp, Artificial
  CRISPR gRNA sequence
ctgcagcctcaggaagaaca

SEQ ID NO: 485930 - DNA, 20 bp, Artificial
  CRISPR gRNA sequence
tgcagcctcaggaagaacag

SEQ ID NO: 485931 - DNA, 20 bp, Artificial
  CRISPR gRNA sequence
gcctcaggaagaacagagga

SEQ ID NO: 485932 - DNA, 20 bp, Artificial
  CRISPR gRNA sequence
aggaagaacagaggatggtc

SEQ ID NO: 485933 - DNA, 20 bp, Artificial
  CRISPR gRNA sequence
ggaagaacagaggatggtca

SEQ ID NO: 485934 - DNA, 20 bp, Artificial
  CRISPR gRNA sequence
aagaacagaggatggtcaag

SEQ ID NO: 485935 - DNA, 20 bp, Artificial
  CRISPR gRNA sequence
cagaggatggtcaaggagac

SEQ ID NO: 485936 - DNA, 20 bp, Artificial
  CRISPR gRNA sequence
gatggtcaaggagacaagta

SEQ ID NO: 485937 - DNA, 20 bp, Artificial
  CRISPR gRNA sequence
tggtcaaggagacaagtaca

SEQ ID NO: 485938 - DNA, 20 bp, Artificial
  CRISPR gRNA sequence
ggtcaaggagacaagtacag

SEQ ID NO: 485939 - DNA, 20 bp, Artificial
  CRISPR gRNA sequence
aaggagacaagtacagagga

SEQ ID NO: 485940 - DNA, 20 bp, Artificial
  CRISPR gRNA sequence
gacaagtacagaggatggtg

SEQ ID NO: 485941 - DNA, 20 bp, Artificial
  CRISPR gRNA sequence
acaagtacagaggatggtga

SEQ ID NO: 485942 - DNA, 20 bp, Artificial
  CRISPR gRNA sequence
aagtacagaggatggtgaag

SEQ ID NO: 485943 - DNA, 20 bp, Artificial
  CRISPR gRNA sequence
gtgaaggagacaatctgatc

SEQ ID NO: 485944 - DNA, 20 bp, Artificial
  CRISPR gRNA sequence
aaggagacaatctgatccag

SEQ ID NO: 485945 - DNA, 20 bp, Artificial
  CRISPR gRNA sequence
agacaatctgatccagcagt

SEQ ID NO: 485946 - DNA, 20 bp, Artificial
  CRISPR gRNA sequence
atccagcagtgagtcccgct

SEQ ID NO: 485947 - DNA, 20 bp, Artificial
  CRISPR gRNA sequence
agtgagtcccgctcagccct

SEQ ID NO: 485948 - DNA, 20 bp, Artificial
  CRISPR gRNA sequence
ctcagccctgagcccatgtg

SEQ ID NO: 485949 - DNA, 20 bp, Artificial
  CRISPR gRNA sequence
cagccctgagcccatgtgca

SEQ ID NO: 485950 - DNA, 20 bp, Artificial
  CRISPR gRNA sequence
gagcccatgtgcagagctct

SEQ ID NO: 485951 - DNA, 20 bp, Artificial
  CRISPR gRNA sequence
ccatgtgcagagctctgagt

SEQ ID NO: 485952 - DNA, 20 bp, Artificial
  CRISPR gRNA sequence
tgcagagctctgagtcagct

SEQ ID NO: 485953 - DNA, 20 bp, Artificial
  CRISPR gRNA sequence
cagctcagcttcctccaacc

SEQ ID NO: 485954 - DNA, 20 bp, Artificial
  CRISPR gRNA sequence
ttcctccaacctggacctgc

SEQ ID NO: 485955 - DNA, 20 bp, Artificial
  CRISPR gRNA sequence
tccaacctggacctgccagt

SEQ ID NO: 485956 - DNA, 20 bp, Artificial
  CRISPR gRNA sequence
caacctggacctgccagtcg

SEQ ID NO: 485957 - DNA, 20 bp, Artificial
  CRISPR gRNA sequence
aacctggacctgccagtcgg

SEQ ID NO: 485958 - DNA, 20 bp, Artificial
  CRISPR gRNA sequence
ctggacctgccagtcggagg

SEQ ID NO: 485959 - DNA, 20 bp, Artificial
  CRISPR gRNA sequence
tggacctgccagtcggagga

SEQ ID NO: 485960 - DNA, 20 bp, Artificial
  CRISPR gRNA sequence
ctgccagtcggaggaaggtg

SEQ ID NO: 485961 - DNA, 20 bp, Artificial
  CRISPR gRNA sequence
tgccagtcggaggaaggtgt

SEQ ID NO: 485962 - DNA, 20 bp, Artificial
  CRISPR gRNA sequence
gccagtcggaggaaggtgtg

SEQ ID NO: 485963 - DNA, 20 bp, Artificial
  CRISPR gRNA sequence
cggaggaaggtgtggggcct

SEQ ID NO: 485964 - DNA, 20 bp, Artificial
  CRISPR gRNA sequence
aggtgtggggcctgagcacc

SEQ ID NO: 485965 - DNA, 20 bp, Artificial
  CRISPR gRNA sequence
ggtgtggggcctgagcacct

SEQ ID NO: 485966 - DNA, 20 bp, Artificial
  CRISPR gRNA sequence
tgtggggcctgagcacctgg

SEQ ID NO: 485967 - DNA, 20 bp, Artificial
  CRISPR gRNA sequence
ggggcctgagcacctgggag

SEQ ID NO: 485968 - DNA, 20 bp, Artificial
  CRISPR gRNA sequence
gggcctgagcacctgggaga

SEQ ID NO: 485969 - DNA, 20 bp, Artificial
  CRISPR gRNA sequence
gcctgagcacctgggagaag

SEQ ID NO: 485970 - DNA, 20 bp, Artificial
  CRISPR gRNA sequence
agcacctgggagaaggagca

SEQ ID NO: 485971 - DNA, 20 bp, Artificial
  CRISPR gRNA sequence
gcacctgggagaaggagcac

SEQ ID NO: 485972 - DNA, 20 bp, Artificial
  CRISPR gRNA sequence
acctgggagaaggagcacgg

SEQ ID NO: 485973 - DNA, 20 bp, Artificial
  CRISPR gRNA sequence
cctgggagaaggagcacggg

SEQ ID NO: 485974 - DNA, 20 bp, Artificial
  CRISPR gRNA sequence
ctgggagaaggagcacggga

SEQ ID NO: 485975 - DNA, 20 bp, Artificial
  CRISPR gRNA sequence
gaaggagcacgggagggtct

SEQ ID NO: 485976 - DNA, 20 bp, Artificial
  CRISPR gRNA sequence
aggagcacgggagggtctca

SEQ ID NO: 485977 - DNA, 20 bp, Artificial
  CRISPR gRNA sequence
gcacgggagggtctcagagc

SEQ ID NO: 485978 - DNA, 20 bp, Artificial
  CRISPR gRNA sequence
cgggagggtctcagagcaag

SEQ ID NO: 485979 - DNA, 20 bp, Artificial
  CRISPR gRNA sequence
agagcaagtggaatttccac

SEQ ID NO: 485980 - DNA, 20 bp, Artificial
  CRISPR gRNA sequence
aatttccaccagccaacaaa

SEQ ID NO: 485981 - DNA, 20 bp, Artificial
  CRISPR gRNA sequence
ccagccaacaaatagatgtt

SEQ ID NO: 485982 - DNA, 20 bp, Artificial
  CRISPR gRNA sequence
cagccaacaaatagatgtta

SEQ ID NO: 485983 - DNA, 20 bp, Artificial
  CRISPR gRNA sequence
aatagatgttaaggttttct

SEQ ID NO: 485984 - DNA, 20 bp, Artificial
  CRISPR gRNA sequence
gatgttaaggttttctcagc

SEQ ID NO: 485985 - DNA, 20 bp, Artificial
  CRISPR gRNA sequence
atgttaaggttttctcagct

SEQ ID NO: 485986 - DNA, 20 bp, Artificial
  CRISPR gRNA sequence
tgttaaggttttctcagcta

SEQ ID NO: 485987 - DNA, 20 bp, Artificial
  CRISPR gRNA sequence
tcagctagggcttgtgctac

SEQ ID NO: 485988 - DNA, 20 bp, Artificial
  CRISPR gRNA sequence
cagctagggcttgtgctacc

SEQ ID NO: 485989 - DNA, 20 bp, Artificial
  CRISPR gRNA sequence
agggcttgtgctaccaggct

SEQ ID NO: 485990 - DNA, 20 bp, Artificial
  CRISPR gRNA sequence
gggcttgtgctaccaggctt

SEQ ID NO: 485991 - DNA, 20 bp, Artificial
  CRISPR gRNA sequence
ggcttgtgctaccaggcttg

SEQ ID NO: 485992 - DNA, 20 bp, Artificial
  CRISPR gRNA sequence
gtgctaccaggcttggggtg

SEQ ID NO: 485993 - DNA, 20 bp, Artificial
  CRISPR gRNA sequence
tgctaccaggcttggggtga

SEQ ID NO: 485994 - DNA, 20 bp, Artificial
  CRISPR gRNA sequence
gcttggggtgaaggcatcaa

SEQ ID NO: 485995 - DNA, 20 bp, Artificial
  CRISPR gRNA sequence
gcatcaaaagatgtacctgc

SEQ ID NO: 485996 - DNA, 20 bp, Artificial
  CRISPR gRNA sequence
catcaaaagatgtacctgct

SEQ ID NO: 485997 - DNA, 20 bp, Artificial
  CRISPR gRNA sequence
atcaaaagatgtacctgctg

SEQ ID NO: 485998 - DNA, 20 bp, Artificial
  CRISPR gRNA sequence
agatgtacctgctggggact

SEQ ID NO: 485999 - DNA, 20 bp, Artificial
  CRISPR gRNA sequence
cctgctggggactaagtgaa

SEQ ID NO: 486000 - DNA, 20 bp, Artificial
  CRISPR gRNA sequence
tgctggggactaagtgaaca

SEQ ID NO: 486001 - DNA, 20 bp, Artificial
  CRISPR gRNA sequence
gggactaagtgaacagagtc

SEQ ID NO: 486002 - DNA, 20 bp, Artificial
  CRISPR gRNA sequence
ctaagtgaacagagtccagt

SEQ ID NO: 486003 - DNA, 20 bp, Artificial
  CRISPR gRNA sequence
agagtccagtgagattccaa

SEQ ID NO: 486004 - DNA, 20 bp, Artificial
  CRISPR gRNA sequence
cagtgagattccaaaagtac

SEQ ID NO: 486005 - DNA, 20 bp, Artificial
  CRISPR gRNA sequence
agtgagattccaaaagtact

SEQ ID NO: 486006 - DNA, 20 bp, Artificial
  CRISPR gRNA sequence
gtgagattccaaaagtactg

SEQ ID NO: 486007 - DNA, 20 bp, Artificial
  CRISPR gRNA sequence
ccaaaagtactggggcaatc

SEQ ID NO: 486008 - DNA, 20 bp, Artificial
  CRISPR gRNA sequence
gtactggggcaatccagctc

SEQ ID NO: 486009 - DNA, 20 bp, Artificial
  CRISPR gRNA sequence
tggggcaatccagctctagt

SEQ ID NO: 486010 - DNA, 20 bp, Artificial
  CRISPR gRNA sequence
ggggcaatccagctctagtc

SEQ ID NO: 486011 - DNA, 20 bp, Artificial
  CRISPR gRNA sequence
gggcaatccagctctagtca

SEQ ID NO: 486012 - DNA, 20 bp, Artificial
  CRISPR gRNA sequence
tctagtcagggcaaaatcat

SEQ ID NO: 486013 - DNA, 20 bp, Artificial
  CRISPR gRNA sequence
gtcagggcaaaatcataaga

SEQ ID NO: 486014 - DNA, 20 bp, Artificial
  CRISPR gRNA sequence
gcaaaatcataagatagata

SEQ ID NO: 486015 - DNA, 20 bp, Artificial
  CRISPR gRNA sequence
aagatagataaagtatccta

SEQ ID NO: 486016 - DNA, 20 bp, Artificial
  CRISPR gRNA sequence
agatagataaagtatcctat

SEQ ID NO: 486017 - DNA, 20 bp, Artificial
  CRISPR gRNA sequence
gatagataaagtatcctata

SEQ ID NO: 486018 - DNA, 20 bp, Artificial
  CRISPR gRNA sequence
tttctttcttcctctctatt

SEQ ID NO: 486019 - DNA, 20 bp, Artificial
  CRISPR gRNA sequence
accatattaactctcttcct

SEQ ID NO: 486020 - DNA, 20 bp, Artificial
  CRISPR gRNA sequence
ccatattaactctcttcctc

SEQ ID NO: 486021 - DNA, 20 bp, Artificial
  CRISPR gRNA sequence
tacctctgtcaaaactcacc

SEQ ID NO: 486022 - DNA, 20 bp, Artificial
  CRISPR gRNA sequence
tgtcaaaactcacctagccc

SEQ ID NO: 486023 - DNA, 20 bp, Artificial
  CRISPR gRNA sequence
ccaagtcccactctttgcat

SEQ ID NO: 486024 - DNA, 20 bp, Artificial
  CRISPR gRNA sequence
tattgtttctccatgataac

SEQ ID NO: 486025 - DNA, 20 bp, Artificial
  CRISPR gRNA sequence
atccaaaccccatgcaaccc

SEQ ID NO: 486026 - DNA, 20 bp, Artificial
  CRISPR gRNA sequence
catgcaaccctggcttttct

SEQ ID NO: 486027 - DNA, 20 bp, Artificial
  CRISPR gRNA sequence
taaactcttatttattcttc

SEQ ID NO: 486028 - DNA, 20 bp, Artificial
  CRISPR gRNA sequence
aaactcttatttattcttca

SEQ ID NO: 486029 - DNA, 20 bp, Artificial
  CRISPR gRNA sequence
tcttatttattcttcaaggc

SEQ ID NO: 486030 - DNA, 20 bp, Artificial
  CRISPR gRNA sequence
attcttcaaggccagttccc

SEQ ID NO: 486031 - DNA, 20 bp, Artificial
  CRISPR gRNA sequence
agttccccagtgttcctacc

SEQ ID NO: 486032 - DNA, 20 bp, Artificial
  CRISPR gRNA sequence
tccccagtgttcctacctag

SEQ ID NO: 486033 - DNA, 20 bp, Artificial
  CRISPR gRNA sequence
ccccagtgttcctacctaga

SEQ ID NO: 486034 - DNA, 20 bp, Artificial
  CRISPR gRNA sequence
agaaggaatcttcatcttct

SEQ ID NO: 486035 - DNA, 20 bp, Artificial
  CRISPR gRNA sequence
tcttgcctgttaatgacaca

SEQ ID NO: 486036 - DNA, 20 bp, Artificial
  CRISPR gRNA sequence
agcatttccatcttccctta

SEQ ID NO: 486037 - DNA, 20 bp, Artificial
  CRISPR gRNA sequence
acccattttcctctgtctga

SEQ ID NO: 486038 - DNA, 20 bp, Artificial
  CRISPR gRNA sequence
cctctgtctgaaagattctt

SEQ ID NO: 486039 - DNA, 20 bp, Artificial
  CRISPR gRNA sequence
ctctgtctgaaagattctta

SEQ ID NO: 486040 - DNA, 20 bp, Artificial
  CRISPR gRNA sequence
tctgtctgaaagattcttaa

SEQ ID NO: 486041 - DNA, 20 bp, Artificial
  CRISPR gRNA sequence
gtctgaaagattcttaaggg

SEQ ID NO: 486042 - DNA, 20 bp, Artificial
  CRISPR gRNA sequence
aaagattcttaagggtagaa

SEQ ID NO: 486043 - DNA, 20 bp, Artificial
  CRISPR gRNA sequence
ttcccccacaaaaccttgca

SEQ ID NO: 486044 - DNA, 20 bp, Artificial
  CRISPR gRNA sequence
acaaaaccttgcatagttct

SEQ ID NO: 486045 - DNA, 20 bp, Artificial
  CRISPR gRNA sequence
aaaaccttgcatagttcttg

SEQ ID NO: 486046 - DNA, 20 bp, Artificial
  CRISPR gRNA sequence
catagttcttggagcataat

SEQ ID NO: 486047 - DNA, 20 bp, Artificial
  CRISPR gRNA sequence
atagttcttggagcataata

SEQ ID NO: 486048 - DNA, 20 bp, Artificial
  CRISPR gRNA sequence
tagttcttggagcataataa

SEQ ID NO: 486049 - DNA, 20 bp, Artificial
  CRISPR gRNA sequence
tcttggagcataataagggc

SEQ ID NO: 486050 - DNA, 20 bp, Artificial
  CRISPR gRNA sequence
cttggagcataataagggct

SEQ ID NO: 486051 - DNA, 20 bp, Artificial
  CRISPR gRNA sequence
ttggagcataataagggctg

SEQ ID NO: 486052 - DNA, 20 bp, Artificial
  CRISPR gRNA sequence
agcataataagggctgggga

SEQ ID NO: 486053 - DNA, 20 bp, Artificial
  CRISPR gRNA sequence
cataataagggctggggaaa

SEQ ID NO: 486054 - DNA, 20 bp, Artificial
  CRISPR gRNA sequence
tggggaaagagtttatgaat

SEQ ID NO: 486055 - DNA, 20 bp, Artificial
  CRISPR gRNA sequence
gtttatgaataagacctcaa

SEQ ID NO: 486056 - DNA, 20 bp, Artificial
  CRISPR gRNA sequence
tgaataagacctcaaaagca

SEQ ID NO: 486057 - DNA, 20 bp, Artificial
  CRISPR gRNA sequence
gaataagacctcaaaagcac

SEQ ID NO: 486058 - DNA, 20 bp, Artificial
  CRISPR gRNA sequence
gacctcaaaagcacaggcaa

SEQ ID NO: 486059 - DNA, 20 bp, Artificial
  CRISPR gRNA sequence
ctcaaaagcacaggcaacag

SEQ ID NO: 486060 - DNA, 20 bp, Artificial
  CRISPR gRNA sequence
acagaagcaaaataaacaaa

SEQ ID NO: 486061 - DNA, 20 bp, Artificial
  CRISPR gRNA sequence
aaaataaacaaatggtatta

SEQ ID NO: 486062 - DNA, 20 bp, Artificial
  CRISPR gRNA sequence
aactaaaaaaaaatcatgta

SEQ ID NO: 486063 - DNA, 20 bp, Artificial
  CRISPR gRNA sequence
aaaaaaaatcatgtacagta

SEQ ID NO: 486064 - DNA, 20 bp, Artificial
  CRISPR gRNA sequence
aaaaaaatcatgtacagtaa

SEQ ID NO: 486065 - DNA, 20 bp, Artificial
  CRISPR gRNA sequence
acagtaaaggaaacaattca

SEQ ID NO: 486066 - DNA, 20 bp, Artificial
  CRISPR gRNA sequence
agtaaaggaaacaattcaca

SEQ ID NO: 486067 - DNA, 20 bp, Artificial
  CRISPR gRNA sequence
gaaacaattcacagagtgaa

SEQ ID NO: 486068 - DNA, 20 bp, Artificial
  CRISPR gRNA sequence
aaacaattcacagagtgaaa

SEQ ID NO: 486069 - DNA, 20 bp, Artificial
  CRISPR gRNA sequence
cagagtgaaaaggcaaccaa

SEQ ID NO: 486070 - DNA, 20 bp, Artificial
  CRISPR gRNA sequence
tgaaaaggcaaccaatagaa

SEQ ID NO: 486071 - DNA, 20 bp, Artificial
  CRISPR gRNA sequence
gaaaaggcaaccaatagaat

SEQ ID NO: 486072 - DNA, 20 bp, Artificial
  CRISPR gRNA sequence
attgcaaactatgaatccta

SEQ ID NO: 486073 - DNA, 20 bp, Artificial
  CRISPR gRNA sequence
ttgcaaactatgaatcctac

SEQ ID NO: 486074 - DNA, 20 bp, Artificial
  CRISPR gRNA sequence
tcctacaggcaactaatatg

SEQ ID NO: 486075 - DNA, 20 bp, Artificial
  CRISPR gRNA sequence
caggcaactaatatgcagaa

SEQ ID NO: 486076 - DNA, 20 bp, Artificial
  CRISPR gRNA sequence
aactaatatgcagaatagac

SEQ ID NO: 486077 - DNA, 20 bp, Artificial
  CRISPR gRNA sequence
aagaaattcaaacgtcacaa

SEQ ID NO: 486078 - DNA, 20 bp, Artificial
  CRISPR gRNA sequence
aacagcaaaatgaacaaccc

SEQ ID NO: 486079 - DNA, 20 bp, Artificial
  CRISPR gRNA sequence
gcaaaatgaacaacccaagc

SEQ ID NO: 486080 - DNA, 20 bp, Artificial
  CRISPR gRNA sequence
caaaatgaacaacccaagca

SEQ ID NO: 486081 - DNA, 20 bp, Artificial
  CRISPR gRNA sequence
aaaatgaacaacccaagcaa

SEQ ID NO: 486082 - DNA, 20 bp, Artificial
  CRISPR gRNA sequence
cctaaaaatgactctattgt

SEQ ID NO: 486083 - DNA, 20 bp, Artificial
  CRISPR gRNA sequence
tctattgtcagaatttcatg

SEQ ID NO: 486084 - DNA, 20 bp, Artificial
  CRISPR gRNA sequence
ctattgtcagaatttcatgc

SEQ ID NO: 486085 - DNA, 20 bp, Artificial
  CRISPR gRNA sequence
cagaatttcatgcaggatac

SEQ ID NO: 486086 - DNA, 20 bp, Artificial
  CRISPR gRNA sequence
gaatttcatgcaggatacca

SEQ ID NO: 486087 - DNA, 20 bp, Artificial
  CRISPR gRNA sequence
gcaggataccagagaaatca

SEQ ID NO: 486088 - DNA, 20 bp, Artificial
  CRISPR gRNA sequence
aggataccagagaaatcaca

SEQ ID NO: 486089 - DNA, 20 bp, Artificial
  CRISPR gRNA sequence
agctgtaattcccttgcctt

SEQ ID NO: 486090 - DNA, 20 bp, Artificial
  CRISPR gRNA sequence
cttgcctttggcctcttgcc

SEQ ID NO: 486091 - DNA, 20 bp, Artificial
  CRISPR gRNA sequence
acaatttaattttccatctg

SEQ ID NO: 486092 - DNA, 20 bp, Artificial
  CRISPR gRNA sequence
attttccatctgcagacctt

SEQ ID NO: 486093 - DNA, 20 bp, Artificial
  CRISPR gRNA sequence
ctgcagaccttcagaaccaa

SEQ ID NO: 486094 - DNA, 20 bp, Artificial
  CRISPR gRNA sequence
agaccttcagaaccaaaagc

SEQ ID NO: 486095 - DNA, 20 bp, Artificial
  CRISPR gRNA sequence
ccttcagaaccaaaagccag

SEQ ID NO: 486096 - DNA, 20 bp, Artificial
  CRISPR gRNA sequence
accaaaagccagtggcccca

SEQ ID NO: 486097 - DNA, 20 bp, Artificial
  CRISPR gRNA sequence
aaaagccagtggccccaaag

SEQ ID NO: 486098 - DNA, 20 bp, Artificial
  CRISPR gRNA sequence
ccagtggccccaaagcagca

SEQ ID NO: 486099 - DNA, 20 bp, Artificial
  CRISPR gRNA sequence
tggaactctcatgcactatt

SEQ ID NO: 486100 - DNA, 20 bp, Artificial
  CRISPR gRNA sequence
actatttggttcaaccactt

SEQ ID NO: 486101 - DNA, 20 bp, Artificial
  CRISPR gRNA sequence
ggttcaaccactttggaaaa

SEQ ID NO: 486102 - DNA, 20 bp, Artificial
  CRISPR gRNA sequence
cactttggaaaacagtttga

SEQ ID NO: 486103 - DNA, 20 bp, Artificial
  CRISPR gRNA sequence
aacagtttgacagcatctgc

SEQ ID NO: 486104 - DNA, 20 bp, Artificial
  CRISPR gRNA sequence
cagtttgacagcatctgcta

SEQ ID NO: 486105 - DNA, 20 bp, Artificial
  CRISPR gRNA sequence
agttacgtacacatactcca

SEQ ID NO: 486106 - DNA, 20 bp, Artificial
  CRISPR gRNA sequence
atactccatggttctgcccc

SEQ ID NO: 486107 - DNA, 20 bp, Artificial
  CRISPR gRNA sequence
actccatggttctgccccta

SEQ ID NO: 486108 - DNA, 20 bp, Artificial
  CRISPR gRNA sequence
gcccctagagatatacccaa

SEQ ID NO: 486109 - DNA, 20 bp, Artificial
  CRISPR gRNA sequence
caacagacatgcatgcacaa

SEQ ID NO: 486110 - DNA, 20 bp, Artificial
  CRISPR gRNA sequence
aacagacatgcatgcacaaa

SEQ ID NO: 486111 - DNA, 20 bp, Artificial
  CRISPR gRNA sequence
catgcacaaaaggctcatca

SEQ ID NO: 486112 - DNA, 20 bp, Artificial
  CRISPR gRNA sequence
tcatcacagcattattataa

SEQ ID NO: 486113 - DNA, 20 bp, Artificial
  CRISPR gRNA sequence
aatagcaaaaacaaaattga

SEQ ID NO: 486114 - DNA, 20 bp, Artificial
  CRISPR gRNA sequence
acaaaattgaaagcaaccca

SEQ ID NO: 486115 - DNA, 20 bp, Artificial
  CRISPR gRNA sequence
caaaattgaaagcaacccaa

SEQ ID NO: 486116 - DNA, 20 bp, Artificial
  CRISPR gRNA sequence
acccaaaggttcatcaataa

SEQ ID NO: 486117 - DNA, 20 bp, Artificial
  CRISPR gRNA sequence
aaggttcatcaataatagaa

SEQ ID NO: 486118 - DNA, 20 bp, Artificial
  CRISPR gRNA sequence
aggttcatcaataatagaaa

SEQ ID NO: 486119 - DNA, 20 bp, Artificial
  CRISPR gRNA sequence
aaggtgaataaactatgata

SEQ ID NO: 486120 - DNA, 20 bp, Artificial
  CRISPR gRNA sequence
tcatgcgataaaatactata

SEQ ID NO: 486121 - DNA, 20 bp, Artificial
  CRISPR gRNA sequence
ataacatacataaatctcat

SEQ ID NO: 486122 - DNA, 20 bp, Artificial
  CRISPR gRNA sequence
cataaatctcataagatgtt

SEQ ID NO: 486123 - DNA, 20 bp, Artificial
  CRISPR gRNA sequence
tctcataagatgttgagcaa

SEQ ID NO: 486124 - DNA, 20 bp, Artificial
  CRISPR gRNA sequence
cataagatgttgagcaaaag

SEQ ID NO: 486125 - DNA, 20 bp, Artificial
  CRISPR gRNA sequence
agatgttgagcaaaagtagt

SEQ ID NO: 486126 - DNA, 20 bp, Artificial
  CRISPR gRNA sequence
gagcaaaagtagtcagacac

SEQ ID NO: 486127 - DNA, 20 bp, Artificial
  CRISPR gRNA sequence
gcaaaagtagtcagacacaa

SEQ ID NO: 486128 - DNA, 20 bp, Artificial
  CRISPR gRNA sequence
accgtttgattccatatata

SEQ ID NO: 486129 - DNA, 20 bp, Artificial
  CRISPR gRNA sequence
acaaaacaaatctgtgatgt

SEQ ID NO: 486130 - DNA, 20 bp, Artificial
  CRISPR gRNA sequence
aaacaaatctgtgatgttag

SEQ ID NO: 486131 - DNA, 20 bp, Artificial
  CRISPR gRNA sequence
aaatctgtgatgttagaagt

SEQ ID NO: 486132 - DNA, 20 bp, Artificial
  CRISPR gRNA sequence
gatgttagaagtcagaattg

SEQ ID NO: 486133 - DNA, 20 bp, Artificial
  CRISPR gRNA sequence
cagaattgtggctatattta

SEQ ID NO: 486134 - DNA, 20 bp, Artificial
  CRISPR gRNA sequence
aattgtggctatatttatgg

SEQ ID NO: 486135 - DNA, 20 bp, Artificial
  CRISPR gRNA sequence
gtggctatatttatggaaga

SEQ ID NO: 486136 - DNA, 20 bp, Artificial
  CRISPR gRNA sequence
ggctatatttatggaagaca

SEQ ID NO: 486137 - DNA, 20 bp, Artificial
  CRISPR gRNA sequence
gctatatttatggaagacag

SEQ ID NO: 486138 - DNA, 20 bp, Artificial
  CRISPR gRNA sequence
atatttatggaagacagagg

SEQ ID NO: 486139 - DNA, 20 bp, Artificial
  CRISPR gRNA sequence
aagacagaggaagtaatgaa

SEQ ID NO: 486140 - DNA, 20 bp, Artificial
  CRISPR gRNA sequence
agacagaggaagtaatgaat

SEQ ID NO: 486141 - DNA, 20 bp, Artificial
  CRISPR gRNA sequence
acagaggaagtaatgaatgg

SEQ ID NO: 486142 - DNA, 20 bp, Artificial
  CRISPR gRNA sequence
agaggaagtaatgaatggga

SEQ ID NO: 486143 - DNA, 20 bp, Artificial
  CRISPR gRNA sequence
aatgaatgggagagaacatg

SEQ ID NO: 486144 - DNA, 20 bp, Artificial
  CRISPR gRNA sequence
gaatgggagagaacatgtgg

SEQ ID NO: 486145 - DNA, 20 bp, Artificial
  CRISPR gRNA sequence
agagaacatgtggtagacac

SEQ ID NO: 486146 - DNA, 20 bp, Artificial
  CRISPR gRNA sequence
agaacatgtggtagacacaa

SEQ ID NO: 486147 - DNA, 20 bp, Artificial
  CRISPR gRNA sequence
agagtgtgttcatttaacaa

SEQ ID NO: 486148 - DNA, 20 bp, Artificial
  CRISPR gRNA sequence
tcatttaacaatagctcatt

SEQ ID NO: 486149 - DNA, 20 bp, Artificial
  CRISPR gRNA sequence
tctgtatgttgcacttcaat

SEQ ID NO: 486150 - DNA, 20 bp, Artificial
  CRISPR gRNA sequence
tgtatgttgcacttcaataa

SEQ ID NO: 486151 - DNA, 20 bp, Artificial
  CRISPR gRNA sequence
tatgttgcacttcaataaga

SEQ ID NO: 486152 - DNA, 20 bp, Artificial
  CRISPR gRNA sequence
atgttgcacttcaataagag

SEQ ID NO: 486153 - DNA, 20 bp, Artificial
  CRISPR gRNA sequence
ataagagaggtttgtctgtg

SEQ ID NO: 486154 - DNA, 20 bp, Artificial
  CRISPR gRNA sequence
aggtttgtctgtgaagacaa

SEQ ID NO: 486155 - DNA, 20 bp, Artificial
  CRISPR gRNA sequence
tgtctgtgaagacaatggcc

SEQ ID NO: 486156 - DNA, 20 bp, Artificial
  CRISPR gRNA sequence
tgtgaagacaatggcctggc

SEQ ID NO: 486157 - DNA, 20 bp, Artificial
  CRISPR gRNA sequence
gtgaagacaatggcctggct

SEQ ID NO: 486158 - DNA, 20 bp, Artificial
  CRISPR gRNA sequence
gacaatggcctggctgggca

SEQ ID NO: 486159 - DNA, 20 bp, Artificial
  CRISPR gRNA sequence
aatggcctggctgggcacag

SEQ ID NO: 486160 - DNA, 20 bp, Artificial
  CRISPR gRNA sequence
gtggcccacatctgtaatcc

SEQ ID NO: 486161 - DNA, 20 bp, Artificial
  CRISPR gRNA sequence
catctgtaatcccagtaatt

SEQ ID NO: 486162 - DNA, 20 bp, Artificial
  CRISPR gRNA sequence
atctgtaatcccagtaattt

SEQ ID NO: 486163 - DNA, 20 bp, Artificial
  CRISPR gRNA sequence
ctgtaatcccagtaatttgg

SEQ ID NO: 486164 - DNA, 20 bp, Artificial
  CRISPR gRNA sequence
tgtaatcccagtaatttggg

SEQ ID NO: 486165 - DNA, 20 bp, Artificial
  CRISPR gRNA sequence
tcccagtaatttgggaggcc

SEQ ID NO: 486166 - DNA, 20 bp, Artificial
  CRISPR gRNA sequence
cccagtaatttgggaggcca

SEQ ID NO: 486167 - DNA, 20 bp, Artificial
  CRISPR gRNA sequence
gtaatttgggaggccaaggc

SEQ ID NO: 486168 - DNA, 20 bp, Artificial
  CRISPR gRNA sequence
aatttgggaggccaaggcaa

SEQ ID NO: 486169 - DNA, 20 bp, Artificial
  CRISPR gRNA sequence
atttgggaggccaaggcaag

SEQ ID NO: 486170 - DNA, 20 bp, Artificial
  CRISPR gRNA sequence
ccaaggcaagaggattgctt

SEQ ID NO: 486171 - DNA, 20 bp, Artificial
  CRISPR gRNA sequence
gcaagaggattgcttgagcc

SEQ ID NO: 486172 - DNA, 20 bp, Artificial
  CRISPR gRNA sequence
caagaggattgcttgagccc

SEQ ID NO: 486173 - DNA, 20 bp, Artificial
  CRISPR gRNA sequence
agaggattgcttgagcccag

SEQ ID NO: 486174 - DNA, 20 bp, Artificial
  CRISPR gRNA sequence
gaggattgcttgagcccagg

SEQ ID NO: 486175 - DNA, 20 bp, Artificial
  CRISPR gRNA sequence
ttgcttgagcccaggaggtc

SEQ ID NO: 486176 - DNA, 20 bp, Artificial
  CRISPR gRNA sequence
tgagcccaggaggtcaagac

SEQ ID NO: 486177 - DNA, 20 bp, Artificial
  CRISPR gRNA sequence
ccaggaggtcaagaccagcc

SEQ ID NO: 486178 - DNA, 20 bp, Artificial
  CRISPR gRNA sequence
caggaggtcaagaccagccc

SEQ ID NO: 486179 - DNA, 20 bp, Artificial
  CRISPR gRNA sequence
gaggtcaagaccagcccagg

SEQ ID NO: 486180 - DNA, 20 bp, Artificial
  CRISPR gRNA sequence
caagaccagcccaggcagca

SEQ ID NO: 486181 - DNA, 20 bp, Artificial
  CRISPR gRNA sequence
tctacacaaaaattaaaaat

SEQ ID NO: 486182 - DNA, 20 bp, Artificial
  CRISPR gRNA sequence
acaaaaattaaaaataagcc

SEQ ID NO: 486183 - DNA, 20 bp, Artificial
  CRISPR gRNA sequence
aattaaaaataagccaagtg

SEQ ID NO: 486184 - DNA, 20 bp, Artificial
  CRISPR gRNA sequence
agtgtggtgatacatgcctg

SEQ ID NO: 486185 - DNA, 20 bp, Artificial
  CRISPR gRNA sequence
gtgatacatgcctgtagtcc

SEQ ID NO: 486186 - DNA, 20 bp, Artificial
  CRISPR gRNA sequence
tgcctgtagtcccagctact

SEQ ID NO: 486187 - DNA, 20 bp, Artificial
  CRISPR gRNA sequence
gcctgtagtcccagctacta

SEQ ID NO: 486188 - DNA, 20 bp, Artificial
  CRISPR gRNA sequence
ctgtagtcccagctactaag

SEQ ID NO: 486189 - DNA, 20 bp, Artificial
  CRISPR gRNA sequence
tgtagtcccagctactaagg

SEQ ID NO: 486190 - DNA, 20 bp, Artificial
  CRISPR gRNA sequence
tcccagctactaaggaggct

SEQ ID NO: 486191 - DNA, 20 bp, Artificial
  CRISPR gRNA sequence
cccagctactaaggaggctg

SEQ ID NO: 486192 - DNA, 20 bp, Artificial
  CRISPR gRNA sequence
agctactaaggaggctgagg

SEQ ID NO: 486193 - DNA, 20 bp, Artificial
  CRISPR gRNA sequence
tactaaggaggctgaggcag

SEQ ID NO: 486194 - DNA, 20 bp, Artificial
  CRISPR gRNA sequence
actaaggaggctgaggcaga

SEQ ID NO: 486195 - DNA, 20 bp, Artificial
  CRISPR gRNA sequence
ctgaggcagaaggattgctt

SEQ ID NO: 486196 - DNA, 20 bp, Artificial
  CRISPR gRNA sequence
gcagaaggattgcttgagcc

SEQ ID NO: 486197 - DNA, 20 bp, Artificial
  CRISPR gRNA sequence
cagaaggattgcttgagccc

SEQ ID NO: 486198 - DNA, 20 bp, Artificial
  CRISPR gRNA sequence
gaaggattgcttgagcccag

SEQ ID NO: 486199 - DNA, 20 bp, Artificial
  CRISPR gRNA sequence
aaggattgcttgagcccagg

SEQ ID NO: 486200 - DNA, 20 bp, Artificial
  CRISPR gRNA sequence
ttgcttgagcccaggaggtc

SEQ ID NO: 486201 - DNA, 20 bp, Artificial
  CRISPR gRNA sequence
tgcttgagcccaggaggtca

SEQ ID NO: 486202 - DNA, 20 bp, Artificial
  CRISPR gRNA sequence
agcccaggaggtcaaggcta

SEQ ID NO: 486203 - DNA, 20 bp, Artificial
  CRISPR gRNA sequence
caggaggtcaaggctacagt

SEQ ID NO: 486204 - DNA, 20 bp, Artificial
  CRISPR gRNA sequence
gtgatcacatcactgcactc

SEQ ID NO: 486205 - DNA, 20 bp, Artificial
  CRISPR gRNA sequence
cacatcactgcactccagcc

SEQ ID NO: 486206 - DNA, 20 bp, Artificial
  CRISPR gRNA sequence
acatcactgcactccagcct

SEQ ID NO: 486207 - DNA, 20 bp, Artificial
  CRISPR gRNA sequence
ctgcactccagcctgggtga

SEQ ID NO: 486208 - DNA, 20 bp, Artificial
  CRISPR gRNA sequence
gcactccagcctgggtgata

SEQ ID NO: 486209 - DNA, 20 bp, Artificial
  CRISPR gRNA sequence
tccagcctgggtgatagagc

SEQ ID NO: 486210 - DNA, 20 bp, Artificial
  CRISPR gRNA sequence
aaaaaattaaaaaaaaaaac

SEQ ID NO: 486211 - DNA, 20 bp, Artificial
  CRISPR gRNA sequence
acatgccctgtctctccttg

SEQ ID NO: 486212 - DNA, 20 bp, Artificial
  CRISPR gRNA sequence
gtctctccttgaagtgattt

SEQ ID NO: 486213 - DNA, 20 bp, Artificial
  CRISPR gRNA sequence
tctccttgaagtgatttcag

SEQ ID NO: 486214 - DNA, 20 bp, Artificial
  CRISPR gRNA sequence
gatttcagtggattcctttc

SEQ ID NO: 486215 - DNA, 20 bp, Artificial
  CRISPR gRNA sequence
tcagtggattcctttctgga

SEQ ID NO: 486216 - DNA, 20 bp, Artificial
  CRISPR gRNA sequence
ttcctttctggatggtgctg

SEQ ID NO: 486217 - DNA, 20 bp, Artificial
  CRISPR gRNA sequence
ttctggatggtgctgtagcc

SEQ ID NO: 486218 - DNA, 20 bp, Artificial
  CRISPR gRNA sequence
tctggatggtgctgtagccc

SEQ ID NO: 486219 - DNA, 20 bp, Artificial
  CRISPR gRNA sequence
ctggatggtgctgtagccca

SEQ ID NO: 486220 - DNA, 20 bp, Artificial
  CRISPR gRNA sequence
tccaatctcttttctgtgtc

SEQ ID NO: 486221 - DNA, 20 bp, Artificial
  CRISPR gRNA sequence
ctttgccattcaccctttgt

SEQ ID NO: 486222 - DNA, 20 bp, Artificial
  CRISPR gRNA sequence
ttgccattcaccctttgttg

SEQ ID NO: 486223 - DNA, 20 bp, Artificial
  CRISPR gRNA sequence
tgccattcaccctttgttgg

SEQ ID NO: 486224 - DNA, 20 bp, Artificial
  CRISPR gRNA sequence
gccattcaccctttgttgga

SEQ ID NO: 486225 - DNA, 20 bp, Artificial
  CRISPR gRNA sequence
ccattcaccctttgttggag

SEQ ID NO: 486226 - DNA, 20 bp, Artificial
  CRISPR gRNA sequence
attcaccctttgttggaggg

SEQ ID NO: 486227 - DNA, 20 bp, Artificial
  CRISPR gRNA sequence
ttcaccctttgttggagggg

SEQ ID NO: 486228 - DNA, 20 bp, Artificial
  CRISPR gRNA sequence
tgttggaggggaggtgcaat

SEQ ID NO: 486229 - DNA, 20 bp, Artificial
  CRISPR gRNA sequence
gttggaggggaggtgcaatg

SEQ ID NO: 486230 - DNA, 20 bp, Artificial
  CRISPR gRNA sequence
ggaggggaggtgcaatgagg

SEQ ID NO: 486231 - DNA, 20 bp, Artificial
  CRISPR gRNA sequence
aggggaggtgcaatgaggaa

SEQ ID NO: 486232 - DNA, 20 bp, Artificial
  CRISPR gRNA sequence
ggaggtgcaatgaggaagag

SEQ ID NO: 486233 - DNA, 20 bp, Artificial
  CRISPR gRNA sequence
aggtgcaatgaggaagagaa

SEQ ID NO: 486234 - DNA, 20 bp, Artificial
  CRISPR gRNA sequence
gagaagagcaaaaacgactc

SEQ ID NO: 486235 - DNA, 20 bp, Artificial
  CRISPR gRNA sequence
aaacgactccagcccttcta

SEQ ID NO: 486236 - DNA, 20 bp, Artificial
  CRISPR gRNA sequence
cagcccttctacagcttgcc

SEQ ID NO: 486237 - DNA, 20 bp, Artificial
  CRISPR gRNA sequence
tctacagcttgcctggatcc

SEQ ID NO: 486238 - DNA, 20 bp, Artificial
  CRISPR gRNA sequence
gcttgcctggatcccagcca

SEQ ID NO: 486239 - DNA, 20 bp, Artificial
  CRISPR gRNA sequence
tgcctggatcccagccaaag

SEQ ID NO: 486240 - DNA, 20 bp, Artificial
  CRISPR gRNA sequence
gatcccagccaaagcagtcg

SEQ ID NO: 486241 - DNA, 20 bp, Artificial
  CRISPR gRNA sequence
ccagccaaagcagtcgcagt

SEQ ID NO: 486242 - DNA, 20 bp, Artificial
  CRISPR gRNA sequence
gcagttagacaccactccct

SEQ ID NO: 486243 - DNA, 20 bp, Artificial
  CRISPR gRNA sequence
gttagacaccactccctgag

SEQ ID NO: 486244 - DNA, 20 bp, Artificial
  CRISPR gRNA sequence
caccactccctgagaagtga

SEQ ID NO: 486245 - DNA, 20 bp, Artificial
  CRISPR gRNA sequence
tccaacacaatctacgcaaa

SEQ ID NO: 486246 - DNA, 20 bp, Artificial
  CRISPR gRNA sequence
acacaatctacgcaaacagc

SEQ ID NO: 486247 - DNA, 20 bp, Artificial
  CRISPR gRNA sequence
cgcaaacagctggcaaccct

SEQ ID NO: 486248 - DNA, 20 bp, Artificial
  CRISPR gRNA sequence
caaacagctggcaacccttg

SEQ ID NO: 486249 - DNA, 20 bp, Artificial
  CRISPR gRNA sequence
aacccttggagctaatctat

SEQ ID NO: 486250 - DNA, 20 bp, Artificial
  CRISPR gRNA sequence
acccttggagctaatctata

SEQ ID NO: 486251 - DNA, 20 bp, Artificial
  CRISPR gRNA sequence
acctgtgcccttttattgtc

SEQ ID NO: 486252 - DNA, 20 bp, Artificial
  CRISPR gRNA sequence
tgtgcccttttattgtccag

SEQ ID NO: 486253 - DNA, 20 bp, Artificial
  CRISPR gRNA sequence
ttgtccagcagatctcaact

SEQ ID NO: 486254 - DNA, 20 bp, Artificial
  CRISPR gRNA sequence
tgtccagcagatctcaactc

SEQ ID NO: 486255 - DNA, 20 bp, Artificial
  CRISPR gRNA sequence
agatctcaactcaggctgta

SEQ ID NO: 486256 - DNA, 20 bp, Artificial
  CRISPR gRNA sequence
aactcaggctgtaaagcatc

SEQ ID NO: 486257 - DNA, 20 bp, Artificial
  CRISPR gRNA sequence
actcaggctgtaaagcatct

SEQ ID NO: 486258 - DNA, 20 bp, Artificial
  CRISPR gRNA sequence
ctcaggctgtaaagcatctg

SEQ ID NO: 486259 - DNA, 20 bp, Artificial
  CRISPR gRNA sequence
gtaaagcatctggggattca

SEQ ID NO: 486260 - DNA, 20 bp, Artificial
  CRISPR gRNA sequence
atctggggattcatagcctc

SEQ ID NO: 486261 - DNA, 20 bp, Artificial
  CRISPR gRNA sequence
cctccagcctgtgtgtcctt

SEQ ID NO: 486262 - DNA, 20 bp, Artificial
  CRISPR gRNA sequence
ctccagcctgtgtgtccttt

SEQ ID NO: 486263 - DNA, 20 bp, Artificial
  CRISPR gRNA sequence
tccagcctgtgtgtcctttg

SEQ ID NO: 486264 - DNA, 20 bp, Artificial
  CRISPR gRNA sequence
tgtgtcctttggggtttcct

SEQ ID NO: 486265 - DNA, 20 bp, Artificial
  CRISPR gRNA sequence
cctttggggtttcctcagaa

SEQ ID NO: 486266 - DNA, 20 bp, Artificial
  CRISPR gRNA sequence
gacaactgaaacctgaattt

SEQ ID NO: 486267 - DNA, 20 bp, Artificial
  CRISPR gRNA sequence
acaactgaaacctgaatttt

SEQ ID NO: 486268 - DNA, 20 bp, Artificial
  CRISPR gRNA sequence
tttgggtctaaaatgaattt

SEQ ID NO: 486269 - DNA, 20 bp, Artificial
  CRISPR gRNA sequence
ttgggtctaaaatgaatttt

SEQ ID NO: 486270 - DNA, 20 bp, Artificial
  CRISPR gRNA sequence
tgggtctaaaatgaatttta

SEQ ID NO: 486271 - DNA, 20 bp, Artificial
  CRISPR gRNA sequence
ctaaaatgaattttagggcc

SEQ ID NO: 486272 - DNA, 20 bp, Artificial
  CRISPR gRNA sequence
taaaatgaattttagggccc

SEQ ID NO: 486273 - DNA, 20 bp, Artificial
  CRISPR gRNA sequence
tagggcccaggcctattccc

SEQ ID NO: 486274 - DNA, 20 bp, Artificial
  CRISPR gRNA sequence
agggcccaggcctattccct

SEQ ID NO: 486275 - DNA, 20 bp, Artificial
  CRISPR gRNA sequence
attccctgggcaatgatttg

SEQ ID NO: 486276 - DNA, 20 bp, Artificial
  CRISPR gRNA sequence
gtctaacccaaaaaacatcc

SEQ ID NO: 486277 - DNA, 20 bp, Artificial
  CRISPR gRNA sequence
tctaacccaaaaaacatccc

SEQ ID NO: 486278 - DNA, 20 bp, Artificial
  CRISPR gRNA sequence
aacatcccaggctgcccgtt

SEQ ID NO: 486279 - DNA, 20 bp, Artificial
  CRISPR gRNA sequence
gttttgaacacctactgcat

SEQ ID NO: 486280 - DNA, 20 bp, Artificial
  CRISPR gRNA sequence
ctactgcattggcactgcac

SEQ ID NO: 486281 - DNA, 20 bp, Artificial
  CRISPR gRNA sequence
tactgcattggcactgcacc

SEQ ID NO: 486282 - DNA, 20 bp, Artificial
  CRISPR gRNA sequence
ccaggcactaatcacaactg

SEQ ID NO: 486283 - DNA, 20 bp, Artificial
  CRISPR gRNA sequence
actaatcacaactgtagtaa

SEQ ID NO: 486284 - DNA, 20 bp, Artificial
  CRISPR gRNA sequence
caactgtagtaacagtgact

SEQ ID NO: 486285 - DNA, 20 bp, Artificial
  CRISPR gRNA sequence
aactgtagtaacagtgactc

SEQ ID NO: 486286 - DNA, 20 bp, Artificial
  CRISPR gRNA sequence
taacagtgactcaggcaatc

SEQ ID NO: 486287 - DNA, 20 bp, Artificial
  CRISPR gRNA sequence
tgactcaggcaatctagcgc

SEQ ID NO: 486288 - DNA, 20 bp, Artificial
  CRISPR gRNA sequence
gcgcaagctctctgaacaaa

SEQ ID NO: 486289 - DNA, 20 bp, Artificial
  CRISPR gRNA sequence
cgcaagctctctgaacaaac

SEQ ID NO: 486290 - DNA, 20 bp, Artificial
  CRISPR gRNA sequence
ctctctgaacaaacgggccc

SEQ ID NO: 486291 - DNA, 20 bp, Artificial
  CRISPR gRNA sequence
acttgccactgaatcctcaa

SEQ ID NO: 486292 - DNA, 20 bp, Artificial
  CRISPR gRNA sequence
cactgaatcctcaatagccc

SEQ ID NO: 486293 - DNA, 20 bp, Artificial
  CRISPR gRNA sequence
aatcctcaatagccctggtt

SEQ ID NO: 486294 - DNA, 20 bp, Artificial
  CRISPR gRNA sequence
tcctcaatagccctggttca

SEQ ID NO: 486295 - DNA, 20 bp, Artificial
  CRISPR gRNA sequence
agagctattcaaaatatatc

SEQ ID NO: 486296 - DNA, 20 bp, Artificial
  CRISPR gRNA sequence
agctattcaaaatatatcca

SEQ ID NO: 486297 - DNA, 20 bp, Artificial
  CRISPR gRNA sequence
attcaaaatatatccagaga

SEQ ID NO: 486298 - DNA, 20 bp, Artificial
  CRISPR gRNA sequence
aaatatatccagagaaagaa

SEQ ID NO: 486299 - DNA, 20 bp, Artificial
  CRISPR gRNA sequence
aatatatccagagaaagaat

SEQ ID NO: 486300 - DNA, 20 bp, Artificial
  CRISPR gRNA sequence
atccagagaaagaatgggaa

SEQ ID NO: 486301 - DNA, 20 bp, Artificial
  CRISPR gRNA sequence
ccagagaaagaatgggaaca

SEQ ID NO: 486302 - DNA, 20 bp, Artificial
  CRISPR gRNA sequence
agagaaagaatgggaacaga

SEQ ID NO: 486303 - DNA, 20 bp, Artificial
  CRISPR gRNA sequence
gagaaagaatgggaacagag

SEQ ID NO: 486304 - DNA, 20 bp, Artificial
  CRISPR gRNA sequence
agaaagaatgggaacagaga

SEQ ID NO: 486305 - DNA, 20 bp, Artificial
  CRISPR gRNA sequence
gaaagaatgggaacagagag

SEQ ID NO: 486306 - DNA, 20 bp, Artificial
  CRISPR gRNA sequence
aaagaatgggaacagagagg

SEQ ID NO: 486307 - DNA, 20 bp, Artificial
  CRISPR gRNA sequence
ggggctgctattgtgaaaat

SEQ ID NO: 486308 - DNA, 20 bp, Artificial
  CRISPR gRNA sequence
tgtgaaaataagtatctact

SEQ ID NO: 486309 - DNA, 20 bp, Artificial
  CRISPR gRNA sequence
gtgaaaataagtatctactg

SEQ ID NO: 486310 - DNA, 20 bp, Artificial
  CRISPR gRNA sequence
tgaaaataagtatctactga

SEQ ID NO: 486311 - DNA, 20 bp, Artificial
  CRISPR gRNA sequence
atctactgagggttgacttg

SEQ ID NO: 486312 - DNA, 20 bp, Artificial
  CRISPR gRNA sequence
tactgagggttgacttgtgg

SEQ ID NO: 486313 - DNA, 20 bp, Artificial
  CRISPR gRNA sequence
actgagggttgacttgtggc

SEQ ID NO: 486314 - DNA, 20 bp, Artificial
  CRISPR gRNA sequence
acttgtggcaggtactgctc

SEQ ID NO: 486315 - DNA, 20 bp, Artificial
  CRISPR gRNA sequence
caggtactgctctagatgtt

SEQ ID NO: 486316 - DNA, 20 bp, Artificial
  CRISPR gRNA sequence
aggtactgctctagatgttg

SEQ ID NO: 486317 - DNA, 20 bp, Artificial
  CRISPR gRNA sequence
gtactgctctagatgttgag

SEQ ID NO: 486318 - DNA, 20 bp, Artificial
  CRISPR gRNA sequence
tctagatgttgaggagacaa

SEQ ID NO: 486319 - DNA, 20 bp, Artificial
  CRISPR gRNA sequence
gatgttgaggagacaacggt

SEQ ID NO: 486320 - DNA, 20 bp, Artificial
  CRISPR gRNA sequence
ggagacaacggtgagcaaaa

SEQ ID NO: 486321 - DNA, 20 bp, Artificial
  CRISPR gRNA sequence
acggtgagcaaaacagacaa

SEQ ID NO: 486322 - DNA, 20 bp, Artificial
  CRISPR gRNA sequence
agcaaaacagacaaaagccc

SEQ ID NO: 486323 - DNA, 20 bp, Artificial
  CRISPR gRNA sequence
cagacaaaagccctggcctc

SEQ ID NO: 486324 - DNA, 20 bp, Artificial
  CRISPR gRNA sequence
agacaaaagccctggcctca

SEQ ID NO: 486325 - DNA, 20 bp, Artificial
  CRISPR gRNA sequence
ccctggcctcaaggatctta

SEQ ID NO: 486326 - DNA, 20 bp, Artificial
  CRISPR gRNA sequence
gcctcaaggatcttacagtc

SEQ ID NO: 486327 - DNA, 20 bp, Artificial
  CRISPR gRNA sequence
cctcaaggatcttacagtct

SEQ ID NO: 486328 - DNA, 20 bp, Artificial
  CRISPR gRNA sequence
ctcaaggatcttacagtcta

SEQ ID NO: 486329 - DNA, 20 bp, Artificial
  CRISPR gRNA sequence
tcaaggatcttacagtctag

SEQ ID NO: 486330 - DNA, 20 bp, Artificial
  CRISPR gRNA sequence
caaggatcttacagtctagg

SEQ ID NO: 486331 - DNA, 20 bp, Artificial
  CRISPR gRNA sequence
tcttacagtctagggggctg

SEQ ID NO: 486332 - DNA, 20 bp, Artificial
  CRISPR gRNA sequence
ttacagtctagggggctgaa

SEQ ID NO: 486333 - DNA, 20 bp, Artificial
  CRISPR gRNA sequence
tacagtctagggggctgaag

SEQ ID NO: 486334 - DNA, 20 bp, Artificial
  CRISPR gRNA sequence
cagtctagggggctgaagag

SEQ ID NO: 486335 - DNA, 20 bp, Artificial
  CRISPR gRNA sequence
tagggggctgaagaggagac

SEQ ID NO: 486336 - DNA, 20 bp, Artificial
  CRISPR gRNA sequence
agggggctgaagaggagact

SEQ ID NO: 486337 - DNA, 20 bp, Artificial
  CRISPR gRNA sequence
ggggctgaagaggagactgg

SEQ ID NO: 486338 - DNA, 20 bp, Artificial
  CRISPR gRNA sequence
ctgaagaggagactgggaga

SEQ ID NO: 486339 - DNA, 20 bp, Artificial
  CRISPR gRNA sequence
agacagaaaatgaaaaacat

SEQ ID NO: 486340 - DNA, 20 bp, Artificial
  CRISPR gRNA sequence
aaatgaaaaacataagtaaa

SEQ ID NO: 486341 - DNA, 20 bp, Artificial
  CRISPR gRNA sequence
aatgaaaaacataagtaaac

SEQ ID NO: 486342 - DNA, 20 bp, Artificial
  CRISPR gRNA sequence
aaaaacataagtaaacagga

SEQ ID NO: 486343 - DNA, 20 bp, Artificial
  CRISPR gRNA sequence
taaacaggatggaacataaa

SEQ ID NO: 486344 - DNA, 20 bp, Artificial
  CRISPR gRNA sequence
aacaggatggaacataaatg

SEQ ID NO: 486345 - DNA, 20 bp, Artificial
  CRISPR gRNA sequence
gatggaacataaatggagat

SEQ ID NO: 486346 - DNA, 20 bp, Artificial
  CRISPR gRNA sequence
atggaacataaatggagatg

SEQ ID NO: 486347 - DNA, 20 bp, Artificial
  CRISPR gRNA sequence
ataaatggagatgaggacta

SEQ ID NO: 486348 - DNA, 20 bp, Artificial
  CRISPR gRNA sequence
aaatggagatgaggactatg

SEQ ID NO: 486349 - DNA, 20 bp, Artificial
  CRISPR gRNA sequence
gaggactatggagaaaaatt

SEQ ID NO: 486350 - DNA, 20 bp, Artificial
  CRISPR gRNA sequence
gactatggagaaaaattaag

SEQ ID NO: 486351 - DNA, 20 bp, Artificial
  CRISPR gRNA sequence
ctatggagaaaaattaagtg

SEQ ID NO: 486352 - DNA, 20 bp, Artificial
  CRISPR gRNA sequence
atggagaaaaattaagtgga

SEQ ID NO: 486353 - DNA, 20 bp, Artificial
  CRISPR gRNA sequence
ggagaaaaattaagtggaga

SEQ ID NO: 486354 - DNA, 20 bp, Artificial
  CRISPR gRNA sequence
agaaaaattaagtggagaga

SEQ ID NO: 486355 - DNA, 20 bp, Artificial
  CRISPR gRNA sequence
aattaagtggagagagagct

SEQ ID NO: 486356 - DNA, 20 bp, Artificial
  CRISPR gRNA sequence
ttaagtggagagagagctaa

SEQ ID NO: 486357 - DNA, 20 bp, Artificial
  CRISPR gRNA sequence
gagagagagctaagagtttg

SEQ ID NO: 486358 - DNA, 20 bp, Artificial
  CRISPR gRNA sequence
agagctaagagtttgcagaa

SEQ ID NO: 486359 - DNA, 20 bp, Artificial
  CRISPR gRNA sequence
gctaagagtttgcagaatgg

SEQ ID NO: 486360 - DNA, 20 bp, Artificial
  CRISPR gRNA sequence
ctaagagtttgcagaatggc

SEQ ID NO: 486361 - DNA, 20 bp, Artificial
  CRISPR gRNA sequence
gaatggcaggctgacatttt

SEQ ID NO: 486362 - DNA, 20 bp, Artificial
  CRISPR gRNA sequence
tggcaggctgacattttcag

SEQ ID NO: 486363 - DNA, 20 bp, Artificial
  CRISPR gRNA sequence
ggcaggctgacattttcagt

SEQ ID NO: 486364 - DNA, 20 bp, Artificial
  CRISPR gRNA sequence
gcaggctgacattttcagtg

SEQ ID NO: 486365 - DNA, 20 bp, Artificial
  CRISPR gRNA sequence
ggctgacattttcagtgggg

SEQ ID NO: 486366 - DNA, 20 bp, Artificial
  CRISPR gRNA sequence
gctgacattttcagtgggga

SEQ ID NO: 486367 - DNA, 20 bp, Artificial
  CRISPR gRNA sequence
gtggggaaggcatcactgaa

SEQ ID NO: 486368 - DNA, 20 bp, Artificial
  CRISPR gRNA sequence
tggggaaggcatcactgaaa

SEQ ID NO: 486369 - DNA, 20 bp, Artificial
  CRISPR gRNA sequence
gggaaggcatcactgaaaag

SEQ ID NO: 486370 - DNA, 20 bp, Artificial
  CRISPR gRNA sequence
ggaaggcatcactgaaaagg

SEQ ID NO: 486371 - DNA, 20 bp, Artificial
  CRISPR gRNA sequence
tcactgaaaaggaggtattt

SEQ ID NO: 486372 - DNA, 20 bp, Artificial
  CRISPR gRNA sequence
aggtatttgagcaaaactct

SEQ ID NO: 486373 - DNA, 20 bp, Artificial
  CRISPR gRNA sequence
ggtatttgagcaaaactctg

SEQ ID NO: 486374 - DNA, 20 bp, Artificial
  CRISPR gRNA sequence
gtatttgagcaaaactctga

SEQ ID NO: 486375 - DNA, 20 bp, Artificial
  CRISPR gRNA sequence
tatttgagcaaaactctgag

SEQ ID NO: 486376 - DNA, 20 bp, Artificial
  CRISPR gRNA sequence
gagcaaaactctgaggggtt

SEQ ID NO: 486377 - DNA, 20 bp, Artificial
  CRISPR gRNA sequence
agcaaaactctgaggggttg

SEQ ID NO: 486378 - DNA, 20 bp, Artificial
  CRISPR gRNA sequence
gcaaaactctgaggggttga

SEQ ID NO: 486379 - DNA, 20 bp, Artificial
  CRISPR gRNA sequence
aaactctgaggggttgaggg

SEQ ID NO: 486380 - DNA, 20 bp, Artificial
  CRISPR gRNA sequence
actctgaggggttgagggaa

SEQ ID NO: 486381 - DNA, 20 bp, Artificial
  CRISPR gRNA sequence
ctctgaggggttgagggaag

SEQ ID NO: 486382 - DNA, 20 bp, Artificial
  CRISPR gRNA sequence
ggttgagggaagaggccatg

SEQ ID NO: 486383 - DNA, 20 bp, Artificial
  CRISPR gRNA sequence
gagggaagaggccatgtagc

SEQ ID NO: 486384 - DNA, 20 bp, Artificial
  CRISPR gRNA sequence
aagaggccatgtagccagca

SEQ ID NO: 486385 - DNA, 20 bp, Artificial
  CRISPR gRNA sequence
agaggccatgtagccagcaa

SEQ ID NO: 486386 - DNA, 20 bp, Artificial
  CRISPR gRNA sequence
aggccatgtagccagcaaag

SEQ ID NO: 486387 - DNA, 20 bp, Artificial
  CRISPR gRNA sequence
ccatgtagccagcaaaggag

SEQ ID NO: 486388 - DNA, 20 bp, Artificial
  CRISPR gRNA sequence
ccagcaaaggagcagcatcc

SEQ ID NO: 486389 - DNA, 20 bp, Artificial
  CRISPR gRNA sequence
cagcaaaggagcagcatccc

SEQ ID NO: 486390 - DNA, 20 bp, Artificial
  CRISPR gRNA sequence
caaaggagcagcatcccagg

SEQ ID NO: 486391 - DNA, 20 bp, Artificial
  CRISPR gRNA sequence
aaggagcagcatcccaggca

SEQ ID NO: 486392 - DNA, 20 bp, Artificial
  CRISPR gRNA sequence
atcccaggcagagaaaactg

SEQ ID NO: 486393 - DNA, 20 bp, Artificial
  CRISPR gRNA sequence
agagaaaactgtggatacaa

SEQ ID NO: 486394 - DNA, 20 bp, Artificial
  CRISPR gRNA sequence
agaaaactgtggatacaaca

SEQ ID NO: 486395 - DNA, 20 bp, Artificial
  CRISPR gRNA sequence
aaaactgtggatacaacaga

SEQ ID NO: 486396 - DNA, 20 bp, Artificial
  CRISPR gRNA sequence
ctgtggatacaacagagagc

SEQ ID NO: 486397 - DNA, 20 bp, Artificial
  CRISPR gRNA sequence
tgtggatacaacagagagcg

SEQ ID NO: 486398 - DNA, 20 bp, Artificial
  CRISPR gRNA sequence
atacaacagagagcgaggtc

SEQ ID NO: 486399 - DNA, 20 bp, Artificial
  CRISPR gRNA sequence
tacaacagagagcgaggtcc

SEQ ID NO: 486400 - DNA, 20 bp, Artificial
  CRISPR gRNA sequence
cagagagcgaggtccaggac

SEQ ID NO: 486401 - DNA, 20 bp, Artificial
  CRISPR gRNA sequence
agagcgaggtccaggaccag

SEQ ID NO: 486402 - DNA, 20 bp, Artificial
  CRISPR gRNA sequence
gagcgaggtccaggaccagc

SEQ ID NO: 486403 - DNA, 20 bp, Artificial
  CRISPR gRNA sequence
tccaggaccagcaggcaaca

SEQ ID NO: 486404 - DNA, 20 bp, Artificial
  CRISPR gRNA sequence
caacatggctgaaatgctgt

SEQ ID NO: 486405 - DNA, 20 bp, Artificial
  CRISPR gRNA sequence
atggctgaaatgctgtgagc

SEQ ID NO: 486406 - DNA, 20 bp, Artificial
  CRISPR gRNA sequence
ggctgaaatgctgtgagcaa

SEQ ID NO: 486407 - DNA, 20 bp, Artificial
  CRISPR gRNA sequence
gctgaaatgctgtgagcaag

SEQ ID NO: 486408 - DNA, 20 bp, Artificial
  CRISPR gRNA sequence
tgaaatgctgtgagcaagag

SEQ ID NO: 486409 - DNA, 20 bp, Artificial
  CRISPR gRNA sequence
aaatgctgtgagcaagagga

SEQ ID NO: 486410 - DNA, 20 bp, Artificial
  CRISPR gRNA sequence
tgtgagcaagaggagagaca

SEQ ID NO: 486411 - DNA, 20 bp, Artificial
  CRISPR gRNA sequence
tgagcaagaggagagacaaa

SEQ ID NO: 486412 - DNA, 20 bp, Artificial
  CRISPR gRNA sequence
gagcaagaggagagacaaag

SEQ ID NO: 486413 - DNA, 20 bp, Artificial
  CRISPR gRNA sequence
gcaagaggagagacaaagag

SEQ ID NO: 486414 - DNA, 20 bp, Artificial
  CRISPR gRNA sequence
agaggagagacaaagaggag

SEQ ID NO: 486415 - DNA, 20 bp, Artificial
  CRISPR gRNA sequence
gaggagagacaaagaggagt

SEQ ID NO: 486416 - DNA, 20 bp, Artificial
  CRISPR gRNA sequence
agacaaagaggagtgggtct

SEQ ID NO: 486417 - DNA, 20 bp, Artificial
  CRISPR gRNA sequence
gaggagtgggtcttggacgc

SEQ ID NO: 486418 - DNA, 20 bp, Artificial
  CRISPR gRNA sequence
aggagtgggtcttggacgcc

SEQ ID NO: 486419 - DNA, 20 bp, Artificial
  CRISPR gRNA sequence
acgcaccattgtaaaatgca

SEQ ID NO: 486420 - DNA, 20 bp, Artificial
  CRISPR gRNA sequence
atggcttttactctgcatga

SEQ ID NO: 486421 - DNA, 20 bp, Artificial
  CRISPR gRNA sequence
gcttttactctgcatgaaag

SEQ ID NO: 486422 - DNA, 20 bp, Artificial
  CRISPR gRNA sequence
tttactctgcatgaaagaag

SEQ ID NO: 486423 - DNA, 20 bp, Artificial
  CRISPR gRNA sequence
tgcatgaaagaagaagtctt

SEQ ID NO: 486424 - DNA, 20 bp, Artificial
  CRISPR gRNA sequence
atgaaagaagaagtctttgg

SEQ ID NO: 486425 - DNA, 20 bp, Artificial
  CRISPR gRNA sequence
ggaagaatttcgcaatgctc

SEQ ID NO: 486426 - DNA, 20 bp, Artificial
  CRISPR gRNA sequence
aagaatttcgcaatgctcaa

SEQ ID NO: 486427 - DNA, 20 bp, Artificial
  CRISPR gRNA sequence
atatgcacatcttacataaa

SEQ ID NO: 486428 - DNA, 20 bp, Artificial
  CRISPR gRNA sequence
agtactcctgttaaattatt

SEQ ID NO: 486429 - DNA, 20 bp, Artificial
  CRISPR gRNA sequence
gttaaattattcagtaaaca

SEQ ID NO: 486430 - DNA, 20 bp, Artificial
  CRISPR gRNA sequence
aaattattcagtaaacaaag

SEQ ID NO: 486431 - DNA, 20 bp, Artificial
  CRISPR gRNA sequence
tgtcatcatatgactcctga

SEQ ID NO: 486432 - DNA, 20 bp, Artificial
  CRISPR gRNA sequence
gtcatcatatgactcctgat

SEQ ID NO: 486433 - DNA, 20 bp, Artificial
  CRISPR gRNA sequence
cctgatgggatgcgctgaaa

SEQ ID NO: 486434 - DNA, 20 bp, Artificial
  CRISPR gRNA sequence
gggatgcgctgaaaaagaca

SEQ ID NO: 486435 - DNA, 20 bp, Artificial
  CRISPR gRNA sequence
aagacacagtatcacttttg

SEQ ID NO: 486436 - DNA, 20 bp, Artificial
  CRISPR gRNA sequence
catataatatctgctgtcaa

SEQ ID NO: 486437 - DNA, 20 bp, Artificial
  CRISPR gRNA sequence
atataatatctgctgtcaat

SEQ ID NO: 486438 - DNA, 20 bp, Artificial
  CRISPR gRNA sequence
atatctgctgtcaatgggca

SEQ ID NO: 486439 - DNA, 20 bp, Artificial
  CRISPR gRNA sequence
cacagaaaaaaattttttta

SEQ ID NO: 486440 - DNA, 20 bp, Artificial
  CRISPR gRNA sequence
aattttaaaaatgcatatga

SEQ ID NO: 486441 - DNA, 20 bp, Artificial
  CRISPR gRNA sequence
ttaaaaatgcatatgatggc

SEQ ID NO: 486442 - DNA, 20 bp, Artificial
  CRISPR gRNA sequence
taaaaatgcatatgatggct

SEQ ID NO: 486443 - DNA, 20 bp, Artificial
  CRISPR gRNA sequence
catatgatggctaggcatga

SEQ ID NO: 486444 - DNA, 20 bp, Artificial
  CRISPR gRNA sequence
ggcatgatggctcacacttg

SEQ ID NO: 486445 - DNA, 20 bp, Artificial
  CRISPR gRNA sequence
cacttgtagtcccaccactt

SEQ ID NO: 486446 - DNA, 20 bp, Artificial
  CRISPR gRNA sequence
acttgtagtcccaccacttt

SEQ ID NO: 486447 - DNA, 20 bp, Artificial
  CRISPR gRNA sequence
ttgtagtcccaccactttgg

SEQ ID NO: 486448 - DNA, 20 bp, Artificial
  CRISPR gRNA sequence
tcccaccactttgggagact

SEQ ID NO: 486449 - DNA, 20 bp, Artificial
  CRISPR gRNA sequence
cccaccactttgggagactg

SEQ ID NO: 486450 - DNA, 20 bp, Artificial
  CRISPR gRNA sequence
accactttgggagactgagg

SEQ ID NO: 486451 - DNA, 20 bp, Artificial
  CRISPR gRNA sequence
ccactttgggagactgaggc

SEQ ID NO: 486452 - DNA, 20 bp, Artificial
  CRISPR gRNA sequence
ctttgggagactgaggcagg

SEQ ID NO: 486453 - DNA, 20 bp, Artificial
  CRISPR gRNA sequence
ctgaggcaggtggatcgcct

SEQ ID NO: 486454 - DNA, 20 bp, Artificial
  CRISPR gRNA sequence
gcaggtggatcgcctgagcc

SEQ ID NO: 486455 - DNA, 20 bp, Artificial
  CRISPR gRNA sequence
caggtggatcgcctgagccc

SEQ ID NO: 486456 - DNA, 20 bp, Artificial
  CRISPR gRNA sequence
ggtggatcgcctgagcccgg

SEQ ID NO: 486457 - DNA, 20 bp, Artificial
  CRISPR gRNA sequence
tcgcctgagcccgggagttc

SEQ ID NO: 486458 - DNA, 20 bp, Artificial
  CRISPR gRNA sequence
ccgggagttcaagaccaccc

SEQ ID NO: 486459 - DNA, 20 bp, Artificial
  CRISPR gRNA sequence
cgggagttcaagaccaccct

SEQ ID NO: 486460 - DNA, 20 bp, Artificial
  CRISPR gRNA sequence
caagaccaccctgggcaaca

SEQ ID NO: 486461 - DNA, 20 bp, Artificial
  CRISPR gRNA sequence
aagaccaccctgggcaacat

SEQ ID NO: 486462 - DNA, 20 bp, Artificial
  CRISPR gRNA sequence
agaccaccctgggcaacatg

SEQ ID NO: 486463 - DNA, 20 bp, Artificial
  CRISPR gRNA sequence
acaaaaaaaaaaaaaaaaat

SEQ ID NO: 486464 - DNA, 20 bp, Artificial
  CRISPR gRNA sequence
aaaaaaaaaaaaaaattagc

SEQ ID NO: 486465 - DNA, 20 bp, Artificial
  CRISPR gRNA sequence
aaaaaaaaaaaaaattagcc

SEQ ID NO: 486466 - DNA, 20 bp, Artificial
  CRISPR gRNA sequence
aaaaaaaaattagccaggca

SEQ ID NO: 486467 - DNA, 20 bp, Artificial
  CRISPR gRNA sequence
aaaaaattagccaggcatgg

SEQ ID NO: 486468 - DNA, 20 bp, Artificial
  CRISPR gRNA sequence
attagccaggcatggtggca

SEQ ID NO: 486469 - DNA, 20 bp, Artificial
  CRISPR gRNA sequence
ggcatggtggcacagacctc

SEQ ID NO: 486470 - DNA, 20 bp, Artificial
  CRISPR gRNA sequence
gtggcacagacctctagttc

SEQ ID NO: 486471 - DNA, 20 bp, Artificial
  CRISPR gRNA sequence
agacctctagttccagctac

SEQ ID NO: 486472 - DNA, 20 bp, Artificial
  CRISPR gRNA sequence
gacctctagttccagctacc

SEQ ID NO: 486473 - DNA, 20 bp, Artificial
  CRISPR gRNA sequence
acctctagttccagctacca

SEQ ID NO: 486474 - DNA, 20 bp, Artificial
  CRISPR gRNA sequence
ctctagttccagctaccagg

SEQ ID NO: 486475 - DNA, 20 bp, Artificial
  CRISPR gRNA sequence
tctagttccagctaccaggg

SEQ ID NO: 486476 - DNA, 20 bp, Artificial
  CRISPR gRNA sequence
ttccagctaccagggaggct

SEQ ID NO: 486477 - DNA, 20 bp, Artificial
  CRISPR gRNA sequence
tccagctaccagggaggctg

SEQ ID NO: 486478 - DNA, 20 bp, Artificial
  CRISPR gRNA sequence
agctaccagggaggctgagg

SEQ ID NO: 486479 - DNA, 20 bp, Artificial
  CRISPR gRNA sequence
gctaccagggaggctgaggt

SEQ ID NO: 486480 - DNA, 20 bp, Artificial
  CRISPR gRNA sequence
taccagggaggctgaggtgg

SEQ ID NO: 486481 - DNA, 20 bp, Artificial
  CRISPR gRNA sequence
accagggaggctgaggtggg

SEQ ID NO: 486482 - DNA, 20 bp, Artificial
  CRISPR gRNA sequence
gggaggctgaggtgggagga

SEQ ID NO: 486483 - DNA, 20 bp, Artificial
  CRISPR gRNA sequence
ctgaggtgggaggatggctt

SEQ ID NO: 486484 - DNA, 20 bp, Artificial
  CRISPR gRNA sequence
ggaggatggcttgagcctgc

SEQ ID NO: 486485 - DNA, 20 bp, Artificial
  CRISPR gRNA sequence
gaggatggcttgagcctgcg

SEQ ID NO: 486486 - DNA, 20 bp, Artificial
  CRISPR gRNA sequence
tggcttgagcctgcgaggtc

SEQ ID NO: 486487 - DNA, 20 bp, Artificial
  CRISPR gRNA sequence
ggcttgagcctgcgaggtcg

SEQ ID NO: 486488 - DNA, 20 bp, Artificial
  CRISPR gRNA sequence
agcctgcgaggtcgaggcta

SEQ ID NO: 486489 - DNA, 20 bp, Artificial
  CRISPR gRNA sequence
tgcgaggtcgaggctacagt

SEQ ID NO: 486490 - DNA, 20 bp, Artificial
  CRISPR gRNA sequence
tcgaggctacagtgagccgt

SEQ ID NO: 486491 - DNA, 20 bp, Artificial
  CRISPR gRNA sequence
gtgagcatgccactgcactc

SEQ ID NO: 486492 - DNA, 20 bp, Artificial
  CRISPR gRNA sequence
catgccactgcactccagtc

SEQ ID NO: 486493 - DNA, 20 bp, Artificial
  CRISPR gRNA sequence
atgccactgcactccagtct

SEQ ID NO: 486494 - DNA, 20 bp, Artificial
  CRISPR gRNA sequence
ctgcactccagtctgggtga

SEQ ID NO: 486495 - DNA, 20 bp, Artificial
  CRISPR gRNA sequence
tccagtctgggtgaaagaac

SEQ ID NO: 486496 - DNA, 20 bp, Artificial
  CRISPR gRNA sequence
cctctcttgaaaaataataa

SEQ ID NO: 486497 - DNA, 20 bp, Artificial
  CRISPR gRNA sequence
ctctcttgaaaaataataat

SEQ ID NO: 486498 - DNA, 20 bp, Artificial
  CRISPR gRNA sequence
cttgaaaaataataataggc

SEQ ID NO: 486499 - DNA, 20 bp, Artificial
  CRISPR gRNA sequence
ttgaaaaataataataggcc

SEQ ID NO: 486500 - DNA, 20 bp, Artificial
  CRISPR gRNA sequence
aaataataataggccgggca

SEQ ID NO: 486501 - DNA, 20 bp, Artificial
  CRISPR gRNA sequence
taataataggccgggcacag

SEQ ID NO: 486502 - DNA, 20 bp, Artificial
  CRISPR gRNA sequence
cgggcacagtggctcacacc

SEQ ID NO: 486503 - DNA, 20 bp, Artificial
  CRISPR gRNA sequence
gtggctcacacctggtatcc

SEQ ID NO: 486504 - DNA, 20 bp, Artificial
  CRISPR gRNA sequence
cctggtatcccagcactttt

SEQ ID NO: 486505 - DNA, 20 bp, Artificial
  CRISPR gRNA sequence
tggtatcccagcacttttga

SEQ ID NO: 486506 - DNA, 20 bp, Artificial
  CRISPR gRNA sequence
ggtatcccagcacttttgag

SEQ ID NO: 486507 - DNA, 20 bp, Artificial
  CRISPR gRNA sequence
atcccagcacttttgagagg

SEQ ID NO: 486508 - DNA, 20 bp, Artificial
  CRISPR gRNA sequence
cccagcacttttgagaggcg

SEQ ID NO: 486509 - DNA, 20 bp, Artificial
  CRISPR gRNA sequence
ccagcacttttgagaggcgg

SEQ ID NO: 486510 - DNA, 20 bp, Artificial
  CRISPR gRNA sequence
gcacttttgagaggcggagg

SEQ ID NO: 486511 - DNA, 20 bp, Artificial
  CRISPR gRNA sequence
cacttttgagaggcggaggt

SEQ ID NO: 486512 - DNA, 20 bp, Artificial
  CRISPR gRNA sequence
ttttgagaggcggaggtggg

SEQ ID NO: 486513 - DNA, 20 bp, Artificial
  CRISPR gRNA sequence
cggaggtgggtggatcactt

SEQ ID NO: 486514 - DNA, 20 bp, Artificial
  CRISPR gRNA sequence
ggaggtgggtggatcacttg

SEQ ID NO: 486515 - DNA, 20 bp, Artificial
  CRISPR gRNA sequence
gtgggtggatcacttgaggt

SEQ ID NO: 486516 - DNA, 20 bp, Artificial
  CRISPR gRNA sequence
tgggtggatcacttgaggtc

SEQ ID NO: 486517 - DNA, 20 bp, Artificial
  CRISPR gRNA sequence
ggtggatcacttgaggtcag

SEQ ID NO: 486518 - DNA, 20 bp, Artificial
  CRISPR gRNA sequence
tcacttgaggtcaggagttt

SEQ ID NO: 486519 - DNA, 20 bp, Artificial
  CRISPR gRNA sequence
tgaggtcaggagtttaagac

SEQ ID NO: 486520 - DNA, 20 bp, Artificial
  CRISPR gRNA sequence
tcaggagtttaagaccagcc

SEQ ID NO: 486521 - DNA, 20 bp, Artificial
  CRISPR gRNA sequence
taagaccagcctggccaaca

SEQ ID NO: 486522 - DNA, 20 bp, Artificial
  CRISPR gRNA sequence
tccaccaaaaatacaaaaat

SEQ ID NO: 486523 - DNA, 20 bp, Artificial
  CRISPR gRNA sequence
ccaaaaatacaaaaattagc

SEQ ID NO: 486524 - DNA, 20 bp, Artificial
  CRISPR gRNA sequence
caaaaatacaaaaattagcc

SEQ ID NO: 486525 - DNA, 20 bp, Artificial
  CRISPR gRNA sequence
atacaaaaattagccaggct

SEQ ID NO: 486526 - DNA, 20 bp, Artificial
  CRISPR gRNA sequence
caaaaattagccaggcttgg

SEQ ID NO: 486527 - DNA, 20 bp, Artificial
  CRISPR gRNA sequence
ggcttggtggcatgcatctg

SEQ ID NO: 486528 - DNA, 20 bp, Artificial
  CRISPR gRNA sequence
gtggcatgcatctgtagtcc

SEQ ID NO: 486529 - DNA, 20 bp, Artificial
  CRISPR gRNA sequence
catctgtagtcccagctact

SEQ ID NO: 486530 - DNA, 20 bp, Artificial
  CRISPR gRNA sequence
atctgtagtcccagctactc

SEQ ID NO: 486531 - DNA, 20 bp, Artificial
  CRISPR gRNA sequence
ctgtagtcccagctactcgg

SEQ ID NO: 486532 - DNA, 20 bp, Artificial
  CRISPR gRNA sequence
tgtagtcccagctactcggg

SEQ ID NO: 486533 - DNA, 20 bp, Artificial
  CRISPR gRNA sequence
tcccagctactcgggaggct

SEQ ID NO: 486534 - DNA, 20 bp, Artificial
  CRISPR gRNA sequence
cccagctactcgggaggctg

SEQ ID NO: 486535 - DNA, 20 bp, Artificial
  CRISPR gRNA sequence
agctactcgggaggctgagg

SEQ ID NO: 486536 - DNA, 20 bp, Artificial
  CRISPR gRNA sequence
gctactcgggaggctgaggc

SEQ ID NO: 486537 - DNA, 20 bp, Artificial
  CRISPR gRNA sequence
gcaggacaatcacttgaacc

SEQ ID NO: 486538 - DNA, 20 bp, Artificial
  CRISPR gRNA sequence
caggacaatcacttgaaccc

SEQ ID NO: 486539 - DNA, 20 bp, Artificial
  CRISPR gRNA sequence
aggacaatcacttgaacccg

SEQ ID NO: 486540 - DNA, 20 bp, Artificial
  CRISPR gRNA sequence
ggacaatcacttgaacccgg

SEQ ID NO: 486541 - DNA, 20 bp, Artificial
  CRISPR gRNA sequence
acaatcacttgaacccgggg

SEQ ID NO: 486542 - DNA, 20 bp, Artificial
  CRISPR gRNA sequence
atcacttgaacccgggggag

SEQ ID NO: 486543 - DNA, 20 bp, Artificial
  CRISPR gRNA sequence
acttgaacccgggggagcag

SEQ ID NO: 486544 - DNA, 20 bp, Artificial
  CRISPR gRNA sequence
acccgggggagcagaagttg

SEQ ID NO: 486545 - DNA, 20 bp, Artificial
  CRISPR gRNA sequence
gggggagcagaagttgcagt

SEQ ID NO: 486546 - DNA, 20 bp, Artificial
  CRISPR gRNA sequence
agcagaagttgcagtgagcc

SEQ ID NO: 486547 - DNA, 20 bp, Artificial
  CRISPR gRNA sequence
aagttgcagtgagccgagat

SEQ ID NO: 486548 - DNA, 20 bp, Artificial
  CRISPR gRNA sequence
gagattggaccactgtactc

SEQ ID NO: 486549 - DNA, 20 bp, Artificial
  CRISPR gRNA sequence
tggaccactgtactccagcc

SEQ ID NO: 486550 - DNA, 20 bp, Artificial
  CRISPR gRNA sequence
ggaccactgtactccagccc

SEQ ID NO: 486551 - DNA, 20 bp, Artificial
  CRISPR gRNA sequence
ctgtactccagcccaggcca

SEQ ID NO: 486552 - DNA, 20 bp, Artificial
  CRISPR gRNA sequence
gtactccagcccaggccaca

SEQ ID NO: 486553 - DNA, 20 bp, Artificial
  CRISPR gRNA sequence
tccagcccaggccacagagc

SEQ ID NO: 486554 - DNA, 20 bp, Artificial
  CRISPR gRNA sequence
tatgataacctgaatcatat

SEQ ID NO: 486555 - DNA, 20 bp, Artificial
  CRISPR gRNA sequence
atgataacctgaatcatatg

SEQ ID NO: 486556 - DNA, 20 bp, Artificial
  CRISPR gRNA sequence
tgataacctgaatcatatga

SEQ ID NO: 486557 - DNA, 20 bp, Artificial
  CRISPR gRNA sequence
tgaatcatatgagggaacat

SEQ ID NO: 486558 - DNA, 20 bp, Artificial
  CRISPR gRNA sequence
gagggaacatcagacaaacc

SEQ ID NO: 486559 - DNA, 20 bp, Artificial
  CRISPR gRNA sequence
acatcagacaaacccagatt

SEQ ID NO: 486560 - DNA, 20 bp, Artificial
  CRISPR gRNA sequence
catcagacaaacccagatta

SEQ ID NO: 486561 - DNA, 20 bp, Artificial
  CRISPR gRNA sequence
ggaaccctctacaaaacaac

SEQ ID NO: 486562 - DNA, 20 bp, Artificial
  CRISPR gRNA sequence
acaactggcttgtcttcttc

SEQ ID NO: 486563 - DNA, 20 bp, Artificial
  CRISPR gRNA sequence
tcaagaatgcaatatcatga

SEQ ID NO: 486564 - DNA, 20 bp, Artificial
  CRISPR gRNA sequence
atgcaatatcatgaaagatg

SEQ ID NO: 486565 - DNA, 20 bp, Artificial
  CRISPR gRNA sequence
aatatcatgaaagatgaaga

SEQ ID NO: 486566 - DNA, 20 bp, Artificial
  CRISPR gRNA sequence
atatcatgaaagatgaagaa

SEQ ID NO: 486567 - DNA, 20 bp, Artificial
  CRISPR gRNA sequence
tgaaagatgaagaaaggtta

SEQ ID NO: 486568 - DNA, 20 bp, Artificial
  CRISPR gRNA sequence
gatgaagaaaggttaaagta

SEQ ID NO: 486569 - DNA, 20 bp, Artificial
  CRISPR gRNA sequence
gaaaggttaaagtatggtca

SEQ ID NO: 486570 - DNA, 20 bp, Artificial
  CRISPR gRNA sequence
tatggtcatagactgaacat

SEQ ID NO: 486571 - DNA, 20 bp, Artificial
  CRISPR gRNA sequence
acatgatcttgattgcatct

SEQ ID NO: 486572 - DNA, 20 bp, Artificial
  CRISPR gRNA sequence
catgatcttgattgcatctt

SEQ ID NO: 486573 - DNA, 20 bp, Artificial
  CRISPR gRNA sequence
atcttgattgcatcttgggt

SEQ ID NO: 486574 - DNA, 20 bp, Artificial
  CRISPR gRNA sequence
gtcagcaaaaaaaaaaaata

SEQ ID NO: 486575 - DNA, 20 bp, Artificial
  CRISPR gRNA sequence
aaaaaaataaagcatattct

SEQ ID NO: 486576 - DNA, 20 bp, Artificial
  CRISPR gRNA sequence
aaaaaataaagcatattctt

SEQ ID NO: 486577 - DNA, 20 bp, Artificial
  CRISPR gRNA sequence
aagcatattcttgggacaat

SEQ ID NO: 486578 - DNA, 20 bp, Artificial
  CRISPR gRNA sequence
caattggtaatatgtgaata

SEQ ID NO: 486579 - DNA, 20 bp, Artificial
  CRISPR gRNA sequence
tggtaatatgtgaatatgga

SEQ ID NO: 486580 - DNA, 20 bp, Artificial
  CRISPR gRNA sequence
aatatggaaagcatatttga

SEQ ID NO: 486581 - DNA, 20 bp, Artificial
  CRISPR gRNA sequence
tgaatttgacaattgtgctg

SEQ ID NO: 486582 - DNA, 20 bp, Artificial
  CRISPR gRNA sequence
caattgtgctgtagtaacat

SEQ ID NO: 486583 - DNA, 20 bp, Artificial
  CRISPR gRNA sequence
catgagaatgtctttgttca

SEQ ID NO: 486584 - DNA, 20 bp, Artificial
  CRISPR gRNA sequence
atgagaatgtctttgttcat

SEQ ID NO: 486585 - DNA, 20 bp, Artificial
  CRISPR gRNA sequence
tgtctttgttcataggatat

SEQ ID NO: 486586 - DNA, 20 bp, Artificial
  CRISPR gRNA sequence
gatataagtgctaaaatatt

SEQ ID NO: 486587 - DNA, 20 bp, Artificial
  CRISPR gRNA sequence
atataagtgctaaaatattt

SEQ ID NO: 486588 - DNA, 20 bp, Artificial
  CRISPR gRNA sequence
ataagtgctaaaatatttag

SEQ ID NO: 486589 - DNA, 20 bp, Artificial
  CRISPR gRNA sequence
gtgctaaaatatttaggagt

SEQ ID NO: 486590 - DNA, 20 bp, Artificial
  CRISPR gRNA sequence
tgctaaaatatttaggagta

SEQ ID NO: 486591 - DNA, 20 bp, Artificial
  CRISPR gRNA sequence
gctaaaatatttaggagtaa

SEQ ID NO: 486592 - DNA, 20 bp, Artificial
  CRISPR gRNA sequence
ctaaaatatttaggagtaag

SEQ ID NO: 486593 - DNA, 20 bp, Artificial
  CRISPR gRNA sequence
taatgtcacaacttgttctc

SEQ ID NO: 486594 - DNA, 20 bp, Artificial
  CRISPR gRNA sequence
tgtcacaacttgttctcaag

SEQ ID NO: 486595 - DNA, 20 bp, Artificial
  CRISPR gRNA sequence
caacttgttctcaagtggtt

SEQ ID NO: 486596 - DNA, 20 bp, Artificial
  CRISPR gRNA sequence
tttatacacacatatacata

SEQ ID NO: 486597 - DNA, 20 bp, Artificial
  CRISPR gRNA sequence
tacacacatatacatacagc

SEQ ID NO: 486598 - DNA, 20 bp, Artificial
  CRISPR gRNA sequence
cacacatatacatacagcta

SEQ ID NO: 486599 - DNA, 20 bp, Artificial
  CRISPR gRNA sequence
catatacatacagctagaga

SEQ ID NO: 486600 - DNA, 20 bp, Artificial
  CRISPR gRNA sequence
tatacatacagctagagaaa

SEQ ID NO: 486601 - DNA, 20 bp, Artificial
  CRISPR gRNA sequence
cagctagagaaagagaaata

SEQ ID NO: 486602 - DNA, 20 bp, Artificial
  CRISPR gRNA sequence
aaatgtgataaaatgttaat

SEQ ID NO: 486603 - DNA, 20 bp, Artificial
  CRISPR gRNA sequence
aaaatgttaattggtgaatc

SEQ ID NO: 486604 - DNA, 20 bp, Artificial
  CRISPR gRNA sequence
taattggtgaatctagatga

SEQ ID NO: 486605 - DNA, 20 bp, Artificial
  CRISPR gRNA sequence
aatctagatgaaagaaattc

SEQ ID NO: 486606 - DNA, 20 bp, Artificial
  CRISPR gRNA sequence
aatcgtttgaactattcttg

SEQ ID NO: 486607 - DNA, 20 bp, Artificial
  CRISPR gRNA sequence
aactattcttgcagcttccc

SEQ ID NO: 486608 - DNA, 20 bp, Artificial
  CRISPR gRNA sequence
cacaattatttcaaactaaa

SEQ ID NO: 486609 - DNA, 20 bp, Artificial
  CRISPR gRNA sequence
actaaaaagcttaaaaatta

SEQ ID NO: 486610 - DNA, 20 bp, Artificial
  CRISPR gRNA sequence
aagcttaaaaattaaagaaa

SEQ ID NO: 486611 - DNA, 20 bp, Artificial
  CRISPR gRNA sequence
gcttaaaaattaaagaaata

SEQ ID NO: 486612 - DNA, 20 bp, Artificial
  CRISPR gRNA sequence
taaaaattaaagaaatagag

SEQ ID NO: 486613 - DNA, 20 bp, Artificial
  CRISPR gRNA sequence
ttaaagaaatagagcagctt

SEQ ID NO: 486614 - DNA, 20 bp, Artificial
  CRISPR gRNA sequence
cagcttcagtcaacttatgc

SEQ ID NO: 486615 - DNA, 20 bp, Artificial
  CRISPR gRNA sequence
agcttcagtcaacttatgcc

SEQ ID NO: 486616 - DNA, 20 bp, Artificial
  CRISPR gRNA sequence
cttatgccaggcctgcccta

SEQ ID NO: 486617 - DNA, 20 bp, Artificial
  CRISPR gRNA sequence
ccaggcctgccctatagaca

SEQ ID NO: 486618 - DNA, 20 bp, Artificial
  CRISPR gRNA sequence
caggcctgccctatagacac

SEQ ID NO: 486619 - DNA, 20 bp, Artificial
  CRISPR gRNA sequence
cctgccctatagacacagga

SEQ ID NO: 486620 - DNA, 20 bp, Artificial
  CRISPR gRNA sequence
tgccctatagacacaggatg

SEQ ID NO: 486621 - DNA, 20 bp, Artificial
  CRISPR gRNA sequence
gccctatagacacaggatgg

SEQ ID NO: 486622 - DNA, 20 bp, Artificial
  CRISPR gRNA sequence
cctatagacacaggatggag

SEQ ID NO: 486623 - DNA, 20 bp, Artificial
  CRISPR gRNA sequence
ctatagacacaggatggagg

SEQ ID NO: 486624 - DNA, 20 bp, Artificial
  CRISPR gRNA sequence
tagacacaggatggaggagg

SEQ ID NO: 486625 - DNA, 20 bp, Artificial
  CRISPR gRNA sequence
acacaggatggaggaggaag

SEQ ID NO: 486626 - DNA, 20 bp, Artificial
  CRISPR gRNA sequence
ggatggaggaggaagcagct

SEQ ID NO: 486627 - DNA, 20 bp, Artificial
  CRISPR gRNA sequence
gatggaggaggaagcagctc

SEQ ID NO: 486628 - DNA, 20 bp, Artificial
  CRISPR gRNA sequence
ggaggaggaagcagctcagg

SEQ ID NO: 486629 - DNA, 20 bp, Artificial
  CRISPR gRNA sequence
gaagcagctcaggaagaccc

SEQ ID NO: 486630 - DNA, 20 bp, Artificial
  CRISPR gRNA sequence
catccctccctgtgcctaac

SEQ ID NO: 486631 - DNA, 20 bp, Artificial
  CRISPR gRNA sequence
gtgcctaacaagtcactcac

SEQ ID NO: 486632 - DNA, 20 bp, Artificial
  CRISPR gRNA sequence
actcaccagcttcaccgtgc

SEQ ID NO: 486633 - DNA, 20 bp, Artificial
  CRISPR gRNA sequence
ctcaccagcttcaccgtgca

SEQ ID NO: 486634 - DNA, 20 bp, Artificial
  CRISPR gRNA sequence
tcaccagcttcaccgtgcaa

SEQ ID NO: 486635 - DNA, 20 bp, Artificial
  CRISPR gRNA sequence
cagcttcaccgtgcaagggc

SEQ ID NO: 486636 - DNA, 20 bp, Artificial
  CRISPR gRNA sequence
tcaccgtgcaagggccggca

SEQ ID NO: 486637 - DNA, 20 bp, Artificial
  CRISPR gRNA sequence
gtgcaagggccggcatagcc

SEQ ID NO: 486638 - DNA, 20 bp, Artificial
  CRISPR gRNA sequence
agggccggcatagccaagcc

SEQ ID NO: 486639 - DNA, 20 bp, Artificial
  CRISPR gRNA sequence
ggcatagccaagcccagcta

SEQ ID NO: 486640 - DNA, 20 bp, Artificial
  CRISPR gRNA sequence
caagcccagctatggtgctg

SEQ ID NO: 486641 - DNA, 20 bp, Artificial
  CRISPR gRNA sequence
cagctatggtgctgaagccc

SEQ ID NO: 486642 - DNA, 20 bp, Artificial
  CRISPR gRNA sequence
agctatggtgctgaagccct

SEQ ID NO: 486643 - DNA, 20 bp, Artificial
  CRISPR gRNA sequence
tggtgctgaagccctgggaa

SEQ ID NO: 486644 - DNA, 20 bp, Artificial
  CRISPR gRNA sequence
ggtgctgaagccctgggaat

SEQ ID NO: 486645 - DNA, 20 bp, Artificial
  CRISPR gRNA sequence
gtgctgaagccctgggaatg

SEQ ID NO: 486646 - DNA, 20 bp, Artificial
  CRISPR gRNA sequence
tgctgaagccctgggaatgg

SEQ ID NO: 486647 - DNA, 20 bp, Artificial
  CRISPR gRNA sequence
tgaagccctgggaatggggg

SEQ ID NO: 486648 - DNA, 20 bp, Artificial
  CRISPR gRNA sequence
aagccctgggaatgggggtg

SEQ ID NO: 486649 - DNA, 20 bp, Artificial
  CRISPR gRNA sequence
agccctgggaatgggggtgg

SEQ ID NO: 486650 - DNA, 20 bp, Artificial
  CRISPR gRNA sequence
gccctgggaatgggggtgga

SEQ ID NO: 486651 - DNA, 20 bp, Artificial
  CRISPR gRNA sequence
cctgggaatgggggtggagg

SEQ ID NO: 486652 - DNA, 20 bp, Artificial
  CRISPR gRNA sequence
gagcattgccctctgtcaca

SEQ ID NO: 486653 - DNA, 20 bp, Artificial
  CRISPR gRNA sequence
agcattgccctctgtcacac

SEQ ID NO: 486654 - DNA, 20 bp, Artificial
  CRISPR gRNA sequence
gtcacacaggctcatgacct

SEQ ID NO: 486655 - DNA, 20 bp, Artificial
  CRISPR gRNA sequence
tcacacaggctcatgacctc

SEQ ID NO: 486656 - DNA, 20 bp, Artificial
  CRISPR gRNA sequence
cacacaggctcatgacctca

SEQ ID NO: 486657 - DNA, 20 bp, Artificial
  CRISPR gRNA sequence
tgacctcagggtcataacct

SEQ ID NO: 486658 - DNA, 20 bp, Artificial
  CRISPR gRNA sequence
ctctgttactctcatcccca

SEQ ID NO: 486659 - DNA, 20 bp, Artificial
  CRISPR gRNA sequence
gttactctcatccccacagc

SEQ ID NO: 486660 - DNA, 20 bp, Artificial
  CRISPR gRNA sequence
ttactctcatccccacagcc

SEQ ID NO: 486661 - DNA, 20 bp, Artificial
  CRISPR gRNA sequence
cagccaggcaccaatcccat

SEQ ID NO: 486662 - DNA, 20 bp, Artificial
  CRISPR gRNA sequence
caatcccatcagtcctcctt

SEQ ID NO: 486663 - DNA, 20 bp, Artificial
  CRISPR gRNA sequence
cagtcctccttcggctgtct

SEQ ID NO: 486664 - DNA, 20 bp, Artificial
  CRISPR gRNA sequence
cggctgtctgagctgcattc

SEQ ID NO: 486665 - DNA, 20 bp, Artificial
  CRISPR gRNA sequence
ggctgtctgagctgcattca

SEQ ID NO: 486666 - DNA, 20 bp, Artificial
  CRISPR gRNA sequence
gagctgcattcaaggatcct

SEQ ID NO: 486667 - DNA, 20 bp, Artificial
  CRISPR gRNA sequence
gcattcaaggatccttagac

SEQ ID NO: 486668 - DNA, 20 bp, Artificial
  CRISPR gRNA sequence
cattcaaggatccttagacc

SEQ ID NO: 486669 - DNA, 20 bp, Artificial
  CRISPR gRNA sequence
ccttagaccaggttccaacc

SEQ ID NO: 486670 - DNA, 20 bp, Artificial
  CRISPR gRNA sequence
tccaacctagctctcctgcc

SEQ ID NO: 486671 - DNA, 20 bp, Artificial
  CRISPR gRNA sequence
agctctcctgcctagaatcc

SEQ ID NO: 486672 - DNA, 20 bp, Artificial
  CRISPR gRNA sequence
gctctcctgcctagaatcct

SEQ ID NO: 486673 - DNA, 20 bp, Artificial
  CRISPR gRNA sequence
tgcctagaatcctgggccac

SEQ ID NO: 486674 - DNA, 20 bp, Artificial
  CRISPR gRNA sequence
gcctagaatcctgggccact

SEQ ID NO: 486675 - DNA, 20 bp, Artificial
  CRISPR gRNA sequence
aggccccccaacccacccac

SEQ ID NO: 486676 - DNA, 20 bp, Artificial
  CRISPR gRNA sequence
gccccccaacccacccacaa

SEQ ID NO: 486677 - DNA, 20 bp, Artificial
  CRISPR gRNA sequence
caacccacccacaagagctg

SEQ ID NO: 486678 - DNA, 20 bp, Artificial
  CRISPR gRNA sequence
aacccacccacaagagctgc

SEQ ID NO: 486679 - DNA, 20 bp, Artificial
  CRISPR gRNA sequence
ttcctcatcatgctctgccc

SEQ ID NO: 486680 - DNA, 20 bp, Artificial
  CRISPR gRNA sequence
tcctcatcatgctctgccct

SEQ ID NO: 486681 - DNA, 20 bp, Artificial
  CRISPR gRNA sequence
cctgcatccttacaaatgtt

SEQ ID NO: 486682 - DNA, 20 bp, Artificial
  CRISPR gRNA sequence
tacaaatgttgagtccacct

SEQ ID NO: 486683 - DNA, 20 bp, Artificial
  CRISPR gRNA sequence
gccttgactgtgtcttcctg

SEQ ID NO: 486684 - DNA, 20 bp, Artificial
  CRISPR gRNA sequence
ccttgactgtgtcttcctga

SEQ ID NO: 486685 - DNA, 20 bp, Artificial
  CRISPR gRNA sequence
tgtgtcttcctgaaggacac

SEQ ID NO: 486686 - DNA, 20 bp, Artificial
  CRISPR gRNA sequence
ctgaaggacacaagaatgct

SEQ ID NO: 486687 - DNA, 20 bp, Artificial
  CRISPR gRNA sequence
tgaaggacacaagaatgctc

SEQ ID NO: 486688 - DNA, 20 bp, Artificial
  CRISPR gRNA sequence
gaaggacacaagaatgctca

SEQ ID NO: 486689 - DNA, 20 bp, Artificial
  CRISPR gRNA sequence
cacaagaatgctcagggact

SEQ ID NO: 486690 - DNA, 20 bp, Artificial
  CRISPR gRNA sequence
agggactcggtaactgaatt

SEQ ID NO: 486691 - DNA, 20 bp, Artificial
  CRISPR gRNA sequence
cggtaactgaattgagtacc

SEQ ID NO: 486692 - DNA, 20 bp, Artificial
  CRISPR gRNA sequence
ggtaactgaattgagtacct

SEQ ID NO: 486693 - DNA, 20 bp, Artificial
  CRISPR gRNA sequence
ctgaattgagtacctgggca

SEQ ID NO: 486694 - DNA, 20 bp, Artificial
  CRISPR gRNA sequence
tgaattgagtacctgggcat

SEQ ID NO: 486695 - DNA, 20 bp, Artificial
  CRISPR gRNA sequence
gcatgggactttattgcata

SEQ ID NO: 486696 - DNA, 20 bp, Artificial
  CRISPR gRNA sequence
catgggactttattgcatat

SEQ ID NO: 486697 - DNA, 20 bp, Artificial
  CRISPR gRNA sequence
atgggactttattgcatatg

SEQ ID NO: 486698 - DNA, 20 bp, Artificial
  CRISPR gRNA sequence
ttgcatatggggcttctacc

SEQ ID NO: 486699 - DNA, 20 bp, Artificial
  CRISPR gRNA sequence
acccacacaacactatgcct

SEQ ID NO: 486700 - DNA, 20 bp, Artificial
  CRISPR gRNA sequence
cagtttcccctctttgtgcc

SEQ ID NO: 486701 - DNA, 20 bp, Artificial
  CRISPR gRNA sequence
gtttcccctctttgtgccca

SEQ ID NO: 486702 - DNA, 20 bp, Artificial
  CRISPR gRNA sequence
ccacgctctccacctccgtg

SEQ ID NO: 486703 - DNA, 20 bp, Artificial
  CRISPR gRNA sequence
ccacctccgtgaagcccctg

SEQ ID NO: 486704 - DNA, 20 bp, Artificial
  CRISPR gRNA sequence
acctccgtgaagcccctgca

SEQ ID NO: 486705 - DNA, 20 bp, Artificial
  CRISPR gRNA sequence
agagtcactgatctaaaatg

SEQ ID NO: 486706 - DNA, 20 bp, Artificial
  CRISPR gRNA sequence
tgatctaaaatgcagaaccc

SEQ ID NO: 486707 - DNA, 20 bp, Artificial
  CRISPR gRNA sequence
ctaaaatgcagaaccctggc

SEQ ID NO: 486708 - DNA, 20 bp, Artificial
  CRISPR gRNA sequence
taaaatgcagaaccctggct

SEQ ID NO: 486709 - DNA, 20 bp, Artificial
  CRISPR gRNA sequence
tgcagaaccctggctgggca

SEQ ID NO: 486710 - DNA, 20 bp, Artificial
  CRISPR gRNA sequence
agaaccctggctgggcatgg

SEQ ID NO: 486711 - DNA, 20 bp, Artificial
  CRISPR gRNA sequence
gtggctcacacctgtaatcc

SEQ ID NO: 486712 - DNA, 20 bp, Artificial
  CRISPR gRNA sequence
cacctgtaatcccagcactt

SEQ ID NO: 486713 - DNA, 20 bp, Artificial
  CRISPR gRNA sequence
tgtaatcccagcactttgga

SEQ ID NO: 486714 - DNA, 20 bp, Artificial
  CRISPR gRNA sequence
gtaatcccagcactttggat

SEQ ID NO: 486715 - DNA, 20 bp, Artificial
  CRISPR gRNA sequence
taatcccagcactttggatg

SEQ ID NO: 486716 - DNA, 20 bp, Artificial
  CRISPR gRNA sequence
aatcccagcactttggatgg

SEQ ID NO: 486717 - DNA, 20 bp, Artificial
  CRISPR gRNA sequence
tcccagcactttggatgggg

SEQ ID NO: 486718 - DNA, 20 bp, Artificial
  CRISPR gRNA sequence
cactttggatgggggagacc

SEQ ID NO: 486719 - DNA, 20 bp, Artificial
  CRISPR gRNA sequence
actttggatgggggagacca

SEQ ID NO: 486720 - DNA, 20 bp, Artificial
  CRISPR gRNA sequence
ttggatgggggagaccaagg

SEQ ID NO: 486721 - DNA, 20 bp, Artificial
  CRISPR gRNA sequence
tggatgggggagaccaaggt

SEQ ID NO: 486722 - DNA, 20 bp, Artificial
  CRISPR gRNA sequence
atgggggagaccaaggtggg

SEQ ID NO: 486723 - DNA, 20 bp, Artificial
  CRISPR gRNA sequence
ccaaggtgggcagatcacct

SEQ ID NO: 486724 - DNA, 20 bp, Artificial
  CRISPR gRNA sequence
caaggtgggcagatcacctg

SEQ ID NO: 486725 - DNA, 20 bp, Artificial
  CRISPR gRNA sequence
gtgggcagatcacctgaggt

SEQ ID NO: 486726 - DNA, 20 bp, Artificial
  CRISPR gRNA sequence
tgggcagatcacctgaggtc

SEQ ID NO: 486727 - DNA, 20 bp, Artificial
  CRISPR gRNA sequence
ggcagatcacctgaggtcag

SEQ ID NO: 486728 - DNA, 20 bp, Artificial
  CRISPR gRNA sequence
tcacctgaggtcaggagttc

SEQ ID NO: 486729 - DNA, 20 bp, Artificial
  CRISPR gRNA sequence
tgaggtcaggagttcaagac

SEQ ID NO: 486730 - DNA, 20 bp, Artificial
  CRISPR gRNA sequence
tcaggagttcaagaccagcc

SEQ ID NO: 486731 - DNA, 20 bp, Artificial
  CRISPR gRNA sequence
caagaccagcctggccaaca

SEQ ID NO: 486732 - DNA, 20 bp, Artificial
  CRISPR gRNA sequence
ctggccaacatggtgaaacc

SEQ ID NO: 486733 - DNA, 20 bp, Artificial
  CRISPR gRNA sequence
tctactaaaaatacaaaaat

SEQ ID NO: 486734 - DNA, 20 bp, Artificial
  CRISPR gRNA sequence
taaaaatacaaaaattagcc

SEQ ID NO: 486735 - DNA, 20 bp, Artificial
  CRISPR gRNA sequence
atacaaaaattagccaagca

SEQ ID NO: 486736 - DNA, 20 bp, Artificial
  CRISPR gRNA sequence
caaaaattagccaagcatgg

SEQ ID NO: 486737 - DNA, 20 bp, Artificial
  CRISPR gRNA sequence
cgtctgtaatttcacctact

SEQ ID NO: 486738 - DNA, 20 bp, Artificial
  CRISPR gRNA sequence
gtctgtaatttcacctactc

SEQ ID NO: 486739 - DNA, 20 bp, Artificial
  CRISPR gRNA sequence
ctgtaatttcacctactcgg

SEQ ID NO: 486740 - DNA, 20 bp, Artificial
  CRISPR gRNA sequence
tgtaatttcacctactcggg

SEQ ID NO: 486741 - DNA, 20 bp, Artificial
  CRISPR gRNA sequence
tttcacctactcgggaggct

SEQ ID NO: 486742 - DNA, 20 bp, Artificial
  CRISPR gRNA sequence
ttcacctactcgggaggctg

SEQ ID NO: 486743 - DNA, 20 bp, Artificial
  CRISPR gRNA sequence
tactcgggaggctgaggcat

SEQ ID NO: 486744 - DNA, 20 bp, Artificial
  CRISPR gRNA sequence
gcatgagaatcacttgaacc

SEQ ID NO: 486745 - DNA, 20 bp, Artificial
  CRISPR gRNA sequence
catgagaatcacttgaaccc

SEQ ID NO: 486746 - DNA, 20 bp, Artificial
  CRISPR gRNA sequence
tgagaatcacttgaacccgg

SEQ ID NO: 486747 - DNA, 20 bp, Artificial
  CRISPR gRNA sequence
gagaatcacttgaacccggg

SEQ ID NO: 486748 - DNA, 20 bp, Artificial
  CRISPR gRNA sequence
aatcacttgaacccgggagg

SEQ ID NO: 486749 - DNA, 20 bp, Artificial
  CRISPR gRNA sequence
tcacttgaacccgggaggca

SEQ ID NO: 486750 - DNA, 20 bp, Artificial
  CRISPR gRNA sequence
aacccgggaggcagagtttg

SEQ ID NO: 486751 - DNA, 20 bp, Artificial
  CRISPR gRNA sequence
cgggaggcagagtttgtagt

SEQ ID NO: 486752 - DNA, 20 bp, Artificial
  CRISPR gRNA sequence
ggcagagtttgtagtgagcc

SEQ ID NO: 486753 - DNA, 20 bp, Artificial
  CRISPR gRNA sequence
aagatcacgccactgcactc

SEQ ID NO: 486754 - DNA, 20 bp, Artificial
  CRISPR gRNA sequence
cacgccactgcactccagcc

SEQ ID NO: 486755 - DNA, 20 bp, Artificial
  CRISPR gRNA sequence
acgccactgcactccagcct

SEQ ID NO: 486756 - DNA, 20 bp, Artificial
  CRISPR gRNA sequence
ctgcactccagcctgggtga

SEQ ID NO: 486757 - DNA, 20 bp, Artificial
  CRISPR gRNA sequence
cactccagcctgggtgacag

SEQ ID NO: 486758 - DNA, 20 bp, Artificial
  CRISPR gRNA sequence
actccagcctgggtgacaga

SEQ ID NO: 486759 - DNA, 20 bp, Artificial
  CRISPR gRNA sequence
tccagcctgggtgacagaag

SEQ ID NO: 486760 - DNA, 20 bp, Artificial
  CRISPR gRNA sequence
taattcaattaaattaaatg

SEQ ID NO: 486761 - DNA, 20 bp, Artificial
  CRISPR gRNA sequence
aattcaattaaattaaatgc

SEQ ID NO: 486762 - DNA, 20 bp, Artificial
  CRISPR gRNA sequence
attaaattaaatgcgggatc

SEQ ID NO: 486763 - DNA, 20 bp, Artificial
  CRISPR gRNA sequence
ttaaattaaatgcgggatcc

SEQ ID NO: 486764 - DNA, 20 bp, Artificial
  CRISPR gRNA sequence
taaatgcgggatccaggttt

SEQ ID NO: 486765 - DNA, 20 bp, Artificial
  CRISPR gRNA sequence
aatgcgggatccaggtttca

SEQ ID NO: 486766 - DNA, 20 bp, Artificial
  CRISPR gRNA sequence
atccaggtttcagagcatcc

SEQ ID NO: 486767 - DNA, 20 bp, Artificial
  CRISPR gRNA sequence
tttcagagcatcctggaccc

SEQ ID NO: 486768 - DNA, 20 bp, Artificial
  CRISPR gRNA sequence
agcatcctggaccccagaac

SEQ ID NO: 486769 - DNA, 20 bp, Artificial
  CRISPR gRNA sequence
catcctggaccccagaactg

SEQ ID NO: 486770 - DNA, 20 bp, Artificial
  CRISPR gRNA sequence
ctggaccccagaactggaga

SEQ ID NO: 486771 - DNA, 20 bp, Artificial
  CRISPR gRNA sequence
ggaccccagaactggagaaa

SEQ ID NO: 486772 - DNA, 20 bp, Artificial
  CRISPR gRNA sequence
gaccccagaactggagaaag

SEQ ID NO: 486773 - DNA, 20 bp, Artificial
  CRISPR gRNA sequence
accccagaactggagaaaga

SEQ ID NO: 486774 - DNA, 20 bp, Artificial
  CRISPR gRNA sequence
ccccagaactggagaaagag

SEQ ID NO: 486775 - DNA, 20 bp, Artificial
  CRISPR gRNA sequence
ccagaactggagaaagaggg

SEQ ID NO: 486776 - DNA, 20 bp, Artificial
  CRISPR gRNA sequence
gaactggagaaagaggggag

SEQ ID NO: 486777 - DNA, 20 bp, Artificial
  CRISPR gRNA sequence
agaaagaggggagcagccct

SEQ ID NO: 486778 - DNA, 20 bp, Artificial
  CRISPR gRNA sequence
agaggggagcagccctcagc

SEQ ID NO: 486779 - DNA, 20 bp, Artificial
  CRISPR gRNA sequence
gaggggagcagccctcagct

SEQ ID NO: 486780 - DNA, 20 bp, Artificial
  CRISPR gRNA sequence
cagccctcagctgggatccc

SEQ ID NO: 486781 - DNA, 20 bp, Artificial
  CRISPR gRNA sequence
agccctcagctgggatcccc

SEQ ID NO: 486782 - DNA, 20 bp, Artificial
  CRISPR gRNA sequence
ccctcagctgggatccccag

SEQ ID NO: 486783 - DNA, 20 bp, Artificial
  CRISPR gRNA sequence
ggatccccaggagtaaatgt

SEQ ID NO: 486784 - DNA, 20 bp, Artificial
  CRISPR gRNA sequence
ccccaggagtaaatgttaga

SEQ ID NO: 486785 - DNA, 20 bp, Artificial
  CRISPR gRNA sequence
atgttagatggctccatgcc

SEQ ID NO: 486786 - DNA, 20 bp, Artificial
  CRISPR gRNA sequence
atggctccatgcctggctga

SEQ ID NO: 486787 - DNA, 20 bp, Artificial
  CRISPR gRNA sequence
ccatgcctggctgacagctt

SEQ ID NO: 486788 - DNA, 20 bp, Artificial
  CRISPR gRNA sequence
catgcctggctgacagcttt

SEQ ID NO: 486789 - DNA, 20 bp, Artificial
  CRISPR gRNA sequence
tgacagctttaggtttgctg

SEQ ID NO: 486790 - DNA, 20 bp, Artificial
  CRISPR gRNA sequence
acagctttaggtttgctgtg

SEQ ID NO: 486791 - DNA, 20 bp, Artificial
  CRISPR gRNA sequence
tgcatgtccctaataatttc

SEQ ID NO: 486792 - DNA, 20 bp, Artificial
  CRISPR gRNA sequence
gcatgtccctaataatttcc

SEQ ID NO: 486793 - DNA, 20 bp, Artificial
  CRISPR gRNA sequence
taataatttccaggctcctg

SEQ ID NO: 486794 - DNA, 20 bp, Artificial
  CRISPR gRNA sequence
ttccaggctcctgtggcatc

SEQ ID NO: 486795 - DNA, 20 bp, Artificial
  CRISPR gRNA sequence
aggctcctgtggcatctgga

SEQ ID NO: 486796 - DNA, 20 bp, Artificial
  CRISPR gRNA sequence
ctgtggcatctggatggctg

SEQ ID NO: 486797 - DNA, 20 bp, Artificial
  CRISPR gRNA sequence
tggcatctggatggctgaag

SEQ ID NO: 486798 - DNA, 20 bp, Artificial
  CRISPR gRNA sequence
atctggatggctgaagaagc

SEQ ID NO: 486799 - DNA, 20 bp, Artificial
  CRISPR gRNA sequence
tctggatggctgaagaagcc

SEQ ID NO: 486800 - DNA, 20 bp, Artificial
  CRISPR gRNA sequence
ctggatggctgaagaagccg

SEQ ID NO: 486801 - DNA, 20 bp, Artificial
  CRISPR gRNA sequence
ggatggctgaagaagccggg

SEQ ID NO: 486802 - DNA, 20 bp, Artificial
  CRISPR gRNA sequence
gctgaagaagccggggagat

SEQ ID NO: 486803 - DNA, 20 bp, Artificial
  CRISPR gRNA sequence
ctgaagaagccggggagatg

SEQ ID NO: 486804 - DNA, 20 bp, Artificial
  CRISPR gRNA sequence
tgaagaagccggggagatga

SEQ ID NO: 486805 - DNA, 20 bp, Artificial
  CRISPR gRNA sequence
agatgagggaccatgccttc

SEQ ID NO: 486806 - DNA, 20 bp, Artificial
  CRISPR gRNA sequence
catgccttccagcttcttcc

SEQ ID NO: 486807 - DNA, 20 bp, Artificial
  CRISPR gRNA sequence
tccagcttcttcctggctgc

SEQ ID NO: 486808 - DNA, 20 bp, Artificial
  CRISPR gRNA sequence
tggcctcgccctcccctccc

SEQ ID NO: 486809 - DNA, 20 bp, Artificial
  CRISPR gRNA sequence
ggcctcgccctcccctccct

SEQ ID NO: 486810 - DNA, 20 bp, Artificial
  CRISPR gRNA sequence
cgccctcccctccctgggct

SEQ ID NO: 486811 - DNA, 20 bp, Artificial
  CRISPR gRNA sequence
tgggctcagctttcctgcct

SEQ ID NO: 486812 - DNA, 20 bp, Artificial
  CRISPR gRNA sequence
gggctcagctttcctgcctc

SEQ ID NO: 486813 - DNA, 20 bp, Artificial
  CRISPR gRNA sequence
ggctcagctttcctgcctca

SEQ ID NO: 486814 - DNA, 20 bp, Artificial
  CRISPR gRNA sequence
gctcagctttcctgcctcag

SEQ ID NO: 486815 - DNA, 20 bp, Artificial
  CRISPR gRNA sequence
gggtccatccatctgtctct

SEQ ID NO: 486816 - DNA, 20 bp, Artificial
  CRISPR gRNA sequence
atccatctgtctctgagctc

SEQ ID NO: 486817 - DNA, 20 bp, Artificial
  CRISPR gRNA sequence
tcgagaaccacccacttcct

SEQ ID NO: 486818 - DNA, 20 bp, Artificial
  CRISPR gRNA sequence
cgagaaccacccacttcctt

SEQ ID NO: 486819 - DNA, 20 bp, Artificial
  CRISPR gRNA sequence
ctcttctctcatgccacaat

SEQ ID NO: 486820 - DNA, 20 bp, Artificial
  CRISPR gRNA sequence
cttctctcatgccacaattg

SEQ ID NO: 486821 - DNA, 20 bp, Artificial
  CRISPR gRNA sequence
ttctctcatgccacaattgg

SEQ ID NO: 486822 - DNA, 20 bp, Artificial
  CRISPR gRNA sequence
tgcaattttcatcatcttta

SEQ ID NO: 486823 - DNA, 20 bp, Artificial
  CRISPR gRNA sequence
gcaattttcatcatctttac

SEQ ID NO: 486824 - DNA, 20 bp, Artificial
  CRISPR gRNA sequence
attttcatcatctttacagg

SEQ ID NO: 486825 - DNA, 20 bp, Artificial
  CRISPR gRNA sequence
tcatcatctttacaggcggc

SEQ ID NO: 486826 - DNA, 20 bp, Artificial
  CRISPR gRNA sequence
tcatctttacaggcggctgg

SEQ ID NO: 486827 - DNA, 20 bp, Artificial
  CRISPR gRNA sequence
catctttacaggcggctgga

SEQ ID NO: 486828 - DNA, 20 bp, Artificial
  CRISPR gRNA sequence
tctttacaggcggctggaag

SEQ ID NO: 486829 - DNA, 20 bp, Artificial
  CRISPR gRNA sequence
ctttacaggcggctggaagg

SEQ ID NO: 486830 - DNA, 20 bp, Artificial
  CRISPR gRNA sequence
aggcttctctctccactaca

SEQ ID NO: 486831 - DNA, 20 bp, Artificial
  CRISPR gRNA sequence
cttctctctccactacacgg

SEQ ID NO: 486832 - DNA, 20 bp, Artificial
  CRISPR gRNA sequence
ttctctctccactacacgga

SEQ ID NO: 486833 - DNA, 20 bp, Artificial
  CRISPR gRNA sequence
tctctctccactacacggaa

SEQ ID NO: 486834 - DNA, 20 bp, Artificial
  CRISPR gRNA sequence
ctacacggaagggtaaattg

SEQ ID NO: 486835 - DNA, 20 bp, Artificial
  CRISPR gRNA sequence
acggaagggtaaattgaagc

SEQ ID NO: 486836 - DNA, 20 bp, Artificial
  CRISPR gRNA sequence
gaagggtaaattgaagccag

SEQ ID NO: 486837 - DNA, 20 bp, Artificial
  CRISPR gRNA sequence
aagggtaaattgaagccagt

SEQ ID NO: 486838 - DNA, 20 bp, Artificial
  CRISPR gRNA sequence
ggtaaattgaagccagtggg

SEQ ID NO: 486839 - DNA, 20 bp, Artificial
  CRISPR gRNA sequence
gtaaattgaagccagtggga

SEQ ID NO: 486840 - DNA, 20 bp, Artificial
  CRISPR gRNA sequence
gggaaggaatctcctcaccc

SEQ ID NO: 486841 - DNA, 20 bp, Artificial
  CRISPR gRNA sequence
tctcctcacccaagacttcc

SEQ ID NO: 486842 - DNA, 20 bp, Artificial
  CRISPR gRNA sequence
cccaagacttcctggattgc

SEQ ID NO: 486843 - DNA, 20 bp, Artificial
  CRISPR gRNA sequence
aagacttcctggattgctgg

SEQ ID NO: 486844 - DNA, 20 bp, Artificial
  CRISPR gRNA sequence
acttcctggattgctggtgg

SEQ ID NO: 486845 - DNA, 20 bp, Artificial
  CRISPR gRNA sequence
cttcctggattgctggtggc

SEQ ID NO: 486846 - DNA, 20 bp, Artificial
  CRISPR gRNA sequence
ttcctggattgctggtggca

SEQ ID NO: 486847 - DNA, 20 bp, Artificial
  CRISPR gRNA sequence
tggattgctggtggcagggc

SEQ ID NO: 486848 - DNA, 20 bp, Artificial
  CRISPR gRNA sequence
agggccagatacccctctca

SEQ ID NO: 486849 - DNA, 20 bp, Artificial
  CRISPR gRNA sequence
tacccctctcacagacctcc

SEQ ID NO: 486850 - DNA, 20 bp, Artificial
  CRISPR gRNA sequence
cagacctcccagtgcactgc

SEQ ID NO: 486851 - DNA, 20 bp, Artificial
  CRISPR gRNA sequence
ccagcctgtcctgtctgatt

SEQ ID NO: 486852 - DNA, 20 bp, Artificial
  CRISPR gRNA sequence
tcctgtctgatttagactgt

SEQ ID NO: 486853 - DNA, 20 bp, Artificial
  CRISPR gRNA sequence
ctgtctgatttagactgtca

SEQ ID NO: 486854 - DNA, 20 bp, Artificial
  CRISPR gRNA sequence
atttagactgtcagagctgt

SEQ ID NO: 486855 - DNA, 20 bp, Artificial
  CRISPR gRNA sequence
tttagactgtcagagctgtc

SEQ ID NO: 486856 - DNA, 20 bp, Artificial
  CRISPR gRNA sequence
tagactgtcagagctgtcag

SEQ ID NO: 486857 - DNA, 20 bp, Artificial
  CRISPR gRNA sequence
cagagctgtcaggagctgct

SEQ ID NO: 486858 - DNA, 20 bp, Artificial
  CRISPR gRNA sequence
gagctgtcaggagctgctcg

SEQ ID NO: 486859 - DNA, 20 bp, Artificial
  CRISPR gRNA sequence
gtcaggagctgctcggagtc

SEQ ID NO: 486860 - DNA, 20 bp, Artificial
  CRISPR gRNA sequence
agctgctcggagtcaagttc

SEQ ID NO: 486861 - DNA, 20 bp, Artificial
  CRISPR gRNA sequence
gttccagatgactgtgtatg

SEQ ID NO: 486862 - DNA, 20 bp, Artificial
  CRISPR gRNA sequence
gatgactgtgtatgtggcac

SEQ ID NO: 486863 - DNA, 20 bp, Artificial
  CRISPR gRNA sequence
gactgtgtatgtggcacaag

SEQ ID NO: 486864 - DNA, 20 bp, Artificial
  CRISPR gRNA sequence
ctgtgtatgtggcacaagca

SEQ ID NO: 486865 - DNA, 20 bp, Artificial
  CRISPR gRNA sequence
tgtgtatgtggcacaagcag

SEQ ID NO: 486866 - DNA, 20 bp, Artificial
  CRISPR gRNA sequence
tgtggcacaagcagaggctc

SEQ ID NO: 486867 - DNA, 20 bp, Artificial
  CRISPR gRNA sequence
gctctggctctgatctccct

SEQ ID NO: 486868 - DNA, 20 bp, Artificial
  CRISPR gRNA sequence
ctctggctctgatctccctg

SEQ ID NO: 486869 - DNA, 20 bp, Artificial
  CRISPR gRNA sequence
tctggctctgatctccctga

SEQ ID NO: 486870 - DNA, 20 bp, Artificial
  CRISPR gRNA sequence
ctggctctgatctccctgag

SEQ ID NO: 486871 - DNA, 20 bp, Artificial
  CRISPR gRNA sequence
tctgatctccctgaggggca

SEQ ID NO: 486872 - DNA, 20 bp, Artificial
  CRISPR gRNA sequence
tccctgaggggcacagctcc

SEQ ID NO: 486873 - DNA, 20 bp, Artificial
  CRISPR gRNA sequence
gtccctccctcgccccacgc

SEQ ID NO: 486874 - DNA, 20 bp, Artificial
  CRISPR gRNA sequence
tccctccctcgccccacgcc

SEQ ID NO: 486875 - DNA, 20 bp, Artificial
  CRISPR gRNA sequence
ctccctcgccccacgccagg

SEQ ID NO: 486876 - DNA, 20 bp, Artificial
  CRISPR gRNA sequence
tccctcgccccacgccaggt

SEQ ID NO: 486877 - DNA, 20 bp, Artificial
  CRISPR gRNA sequence
cctttgccctgatacacctt

SEQ ID NO: 486878 - DNA, 20 bp, Artificial
  CRISPR gRNA sequence
ctttgccctgatacaccttg

SEQ ID NO: 486879 - DNA, 20 bp, Artificial
  CRISPR gRNA sequence
ttgccctgatacaccttgag

SEQ ID NO: 486880 - DNA, 20 bp, Artificial
  CRISPR gRNA sequence
ccctgatacaccttgaggag

SEQ ID NO: 486881 - DNA, 20 bp, Artificial
  CRISPR gRNA sequence
cctgatacaccttgaggagc

SEQ ID NO: 486882 - DNA, 20 bp, Artificial
  CRISPR gRNA sequence
tgatacaccttgaggagcag

SEQ ID NO: 486883 - DNA, 20 bp, Artificial
  CRISPR gRNA sequence
gatacaccttgaggagcagg

SEQ ID NO: 486884 - DNA, 20 bp, Artificial
  CRISPR gRNA sequence
tacaccttgaggagcaggag

SEQ ID NO: 486885 - DNA, 20 bp, Artificial
  CRISPR gRNA sequence
ttgaggagcaggaggagtat

SEQ ID NO: 486886 - DNA, 20 bp, Artificial
  CRISPR gRNA sequence
tgaggagcaggaggagtatg

SEQ ID NO: 486887 - DNA, 20 bp, Artificial
  CRISPR gRNA sequence
gaggagcaggaggagtatga

SEQ ID NO: 486888 - DNA, 20 bp, Artificial
  CRISPR gRNA sequence
atgagggtgaccacttgccc

SEQ ID NO: 486889 - DNA, 20 bp, Artificial
  CRISPR gRNA sequence
cacttgccccagcatttcca

SEQ ID NO: 486890 - DNA, 20 bp, Artificial
  CRISPR gRNA sequence
acttgccccagcatttccac

SEQ ID NO: 486891 - DNA, 20 bp, Artificial
  CRISPR gRNA sequence
gccccagcatttccacagga

SEQ ID NO: 486892 - DNA, 20 bp, Artificial
  CRISPR gRNA sequence
cccagcatttccacaggaca

SEQ ID NO: 486893 - DNA, 20 bp, Artificial
  CRISPR gRNA sequence
ccagcatttccacaggacag

SEQ ID NO: 486894 - DNA, 20 bp, Artificial
  CRISPR gRNA sequence
cagcatttccacaggacaga

SEQ ID NO: 486895 - DNA, 20 bp, Artificial
  CRISPR gRNA sequence
agcatttccacaggacagag

SEQ ID NO: 486896 - DNA, 20 bp, Artificial
  CRISPR gRNA sequence
tttccacaggacagaggggc

SEQ ID NO: 486897 - DNA, 20 bp, Artificial
  CRISPR gRNA sequence
ttccacaggacagaggggcc

SEQ ID NO: 486898 - DNA, 20 bp, Artificial
  CRISPR gRNA sequence
acaggacagaggggccaggc

SEQ ID NO: 486899 - DNA, 20 bp, Artificial
  CRISPR gRNA sequence
ggccagcccctccaccccac

SEQ ID NO: 486900 - DNA, 20 bp, Artificial
  CRISPR gRNA sequence
accagactctctgccgtgca

SEQ ID NO: 486901 - DNA, 20 bp, Artificial
  CRISPR gRNA sequence
ccagactctctgccgtgcac

SEQ ID NO: 486902 - DNA, 20 bp, Artificial
  CRISPR gRNA sequence
ctctctgccgtgcacgggct

SEQ ID NO: 486903 - DNA, 20 bp, Artificial
  CRISPR gRNA sequence
tctgccgtgcacgggctcag

SEQ ID NO: 486904 - DNA, 20 bp, Artificial
  CRISPR gRNA sequence
tgcacgggctcagcagtccc

SEQ ID NO: 486905 - DNA, 20 bp, Artificial
  CRISPR gRNA sequence
cgggctcagcagtccccagt

SEQ ID NO: 486906 - DNA, 20 bp, Artificial
  CRISPR gRNA sequence
ctcagcagtccccagtcagc

SEQ ID NO: 486907 - DNA, 20 bp, Artificial
  CRISPR gRNA sequence
cagcagtccccagtcagcaa

SEQ ID NO: 486908 - DNA, 20 bp, Artificial
  CRISPR gRNA sequence
agcagtccccagtcagcaag

SEQ ID NO: 486909 - DNA, 20 bp, Artificial
  CRISPR gRNA sequence
cccagtcagcaagaggacga

SEQ ID NO: 486910 - DNA, 20 bp, Artificial
  CRISPR gRNA sequence
ccagtcagcaagaggacgat

SEQ ID NO: 486911 - DNA, 20 bp, Artificial
  CRISPR gRNA sequence
cagtcagcaagaggacgatg

SEQ ID NO: 486912 - DNA, 20 bp, Artificial
  CRISPR gRNA sequence
gtcagcaagaggacgatggg

SEQ ID NO: 486913 - DNA, 20 bp, Artificial
  CRISPR gRNA sequence
agcaagaggacgatggggag

SEQ ID NO: 486914 - DNA, 20 bp, Artificial
  CRISPR gRNA sequence
gaactgccttgcaacctgtc

SEQ ID NO: 486915 - DNA, 20 bp, Artificial
  CRISPR gRNA sequence
ccttgcaacctgtccagcca

SEQ ID NO: 486916 - DNA, 20 bp, Artificial
  CRISPR gRNA sequence
ccagccacagtttcctcaat

SEQ ID NO: 486917 - DNA, 20 bp, Artificial
  CRISPR gRNA sequence
agccacagtttcctcaatta

SEQ ID NO: 486918 - DNA, 20 bp, Artificial
  CRISPR gRNA sequence
gccacagtttcctcaattag

SEQ ID NO: 486919 - DNA, 20 bp, Artificial
  CRISPR gRNA sequence
aggctgttaacgcctgctgt

SEQ ID NO: 486920 - DNA, 20 bp, Artificial
  CRISPR gRNA sequence
aacgcctgctgtgagctgac

SEQ ID NO: 486921 - DNA, 20 bp, Artificial
  CRISPR gRNA sequence
acgcctgctgtgagctgaca

SEQ ID NO: 486922 - DNA, 20 bp, Artificial
  CRISPR gRNA sequence
tgtgagctgacaaggccact

SEQ ID NO: 486923 - DNA, 20 bp, Artificial
  CRISPR gRNA sequence
agctgacaaggccactgaga

SEQ ID NO: 486924 - DNA, 20 bp, Artificial
  CRISPR gRNA sequence
caaggccactgagaaagccc

SEQ ID NO: 486925 - DNA, 20 bp, Artificial
  CRISPR gRNA sequence
actgagaaagccccagcgcc

SEQ ID NO: 486926 - DNA, 20 bp, Artificial
  CRISPR gRNA sequence
tgagaaagccccagcgcctg

SEQ ID NO: 486927 - DNA, 20 bp, Artificial
  CRISPR gRNA sequence
aaagccccagcgcctggagc

SEQ ID NO: 486928 - DNA, 20 bp, Artificial
  CRISPR gRNA sequence
agcgcctggagctggtctga

SEQ ID NO: 486929 - DNA, 20 bp, Artificial
  CRISPR gRNA sequence
gctggtctgacagttcccac

SEQ ID NO: 486930 - DNA, 20 bp, Artificial
  CRISPR gRNA sequence
acagttcccacaagccaaac

SEQ ID NO: 486931 - DNA, 20 bp, Artificial
  CRISPR gRNA sequence
tcccacaagccaaactggtg

SEQ ID NO: 486932 - DNA, 20 bp, Artificial
  CRISPR gRNA sequence
aaactggtgaagcttacctc

SEQ ID NO: 486933 - DNA, 20 bp, Artificial
  CRISPR gRNA sequence
ctggtgaagcttacctcaag

SEQ ID NO: 486934 - DNA, 20 bp, Artificial
  CRISPR gRNA sequence
tggtgaagcttacctcaagt

SEQ ID NO: 486935 - DNA, 20 bp, Artificial
  CRISPR gRNA sequence
gtgaagcttacctcaagtgg

SEQ ID NO: 486936 - DNA, 20 bp, Artificial
  CRISPR gRNA sequence
tgaagcttacctcaagtggg

SEQ ID NO: 486937 - DNA, 20 bp, Artificial
  CRISPR gRNA sequence
gaagcttacctcaagtggga

SEQ ID NO: 486938 - DNA, 20 bp, Artificial
  CRISPR gRNA sequence
ctcaagtgggagggtgcttg

SEQ ID NO: 486939 - DNA, 20 bp, Artificial
  CRISPR gRNA sequence
gggagggtgcttgaagttca

SEQ ID NO: 486940 - DNA, 20 bp, Artificial
  CRISPR gRNA sequence
gaagttcacagtgactcaca

SEQ ID NO: 486941 - DNA, 20 bp, Artificial
  CRISPR gRNA sequence
ttcacagtgactcacaaagc

SEQ ID NO: 486942 - DNA, 20 bp, Artificial
  CRISPR gRNA sequence
acgggatgcaattttgaaac

SEQ ID NO: 486943 - DNA, 20 bp, Artificial
  CRISPR gRNA sequence
aattttgaaactggctttgt

SEQ ID NO: 486944 - DNA, 20 bp, Artificial
  CRISPR gRNA sequence
tgtgagtcactgtgaacttc

SEQ ID NO: 486945 - DNA, 20 bp, Artificial
  CRISPR gRNA sequence
cttcaagcaccctcccactt

SEQ ID NO: 486946 - DNA, 20 bp, Artificial
  CRISPR gRNA sequence
ttcaagcaccctcccacttg

SEQ ID NO: 486947 - DNA, 20 bp, Artificial
  CRISPR gRNA sequence
agcaccctcccacttgaggt

SEQ ID NO: 486948 - DNA, 20 bp, Artificial
  CRISPR gRNA sequence
ccacttgaggtaagcttcac

SEQ ID NO: 486949 - DNA, 20 bp, Artificial
  CRISPR gRNA sequence
tgaggtaagcttcaccagtt

SEQ ID NO: 486950 - DNA, 20 bp, Artificial
  CRISPR gRNA sequence
agcttcaccagtttggcttg

SEQ ID NO: 486951 - DNA, 20 bp, Artificial
  CRISPR gRNA sequence
gcttcaccagtttggcttgt

SEQ ID NO: 486952 - DNA, 20 bp, Artificial
  CRISPR gRNA sequence
gtttggcttgtgggaactgt

SEQ ID NO: 486953 - DNA, 20 bp, Artificial
  CRISPR gRNA sequence
gcttgtgggaactgtcagac

SEQ ID NO: 486954 - DNA, 20 bp, Artificial
  CRISPR gRNA sequence
gggaactgtcagaccagctc

SEQ ID NO: 486955 - DNA, 20 bp, Artificial
  CRISPR gRNA sequence
ggaactgtcagaccagctcc

SEQ ID NO: 486956 - DNA, 20 bp, Artificial
  CRISPR gRNA sequence
gtcagaccagctccaggcgc

SEQ ID NO: 486957 - DNA, 20 bp, Artificial
  CRISPR gRNA sequence
tcagaccagctccaggcgct

SEQ ID NO: 486958 - DNA, 20 bp, Artificial
  CRISPR gRNA sequence
cagaccagctccaggcgctg

SEQ ID NO: 486959 - DNA, 20 bp, Artificial
  CRISPR gRNA sequence
tccaggcgctggggctttct

SEQ ID NO: 486960 - DNA, 20 bp, Artificial
  CRISPR gRNA sequence
aggcgctggggctttctcag

SEQ ID NO: 486961 - DNA, 20 bp, Artificial
  CRISPR gRNA sequence
ggctttctcagtggccttgt

SEQ ID NO: 486962 - DNA, 20 bp, Artificial
  CRISPR gRNA sequence
tcagtggccttgtcagctca

SEQ ID NO: 486963 - DNA, 20 bp, Artificial
  CRISPR gRNA sequence
gtggccttgtcagctcacag

SEQ ID NO: 486964 - DNA, 20 bp, Artificial
  CRISPR gRNA sequence
tggccttgtcagctcacagc

SEQ ID NO: 486965 - DNA, 20 bp, Artificial
  CRISPR gRNA sequence
cagctcacagcaggcgttaa

SEQ ID NO: 486966 - DNA, 20 bp, Artificial
  CRISPR gRNA sequence
ggcgttaacagcctctaatt

SEQ ID NO: 486967 - DNA, 20 bp, Artificial
  CRISPR gRNA sequence
gcgttaacagcctctaattg

SEQ ID NO: 486968 - DNA, 20 bp, Artificial
  CRISPR gRNA sequence
gcctctaattgaggaaactg

SEQ ID NO: 486969 - DNA, 20 bp, Artificial
  CRISPR gRNA sequence
ctaattgaggaaactgtggc

SEQ ID NO: 486970 - DNA, 20 bp, Artificial
  CRISPR gRNA sequence
ttgaggaaactgtggctgga

SEQ ID NO: 486971 - DNA, 20 bp, Artificial
  CRISPR gRNA sequence
tgaggaaactgtggctggac

SEQ ID NO: 486972 - DNA, 20 bp, Artificial
  CRISPR gRNA sequence
actgtggctggacaggttgc

SEQ ID NO: 486973 - DNA, 20 bp, Artificial
  CRISPR gRNA sequence
ctgtggctggacaggttgca

SEQ ID NO: 486974 - DNA, 20 bp, Artificial
  CRISPR gRNA sequence
tggctggacaggttgcaagg

SEQ ID NO: 486975 - DNA, 20 bp, Artificial
  CRISPR gRNA sequence
cccatcgtcctcttgctgac

SEQ ID NO: 486976 - DNA, 20 bp, Artificial
  CRISPR gRNA sequence
ccatcgtcctcttgctgact

SEQ ID NO: 486977 - DNA, 20 bp, Artificial
  CRISPR gRNA sequence
catcgtcctcttgctgactg

SEQ ID NO: 486978 - DNA, 20 bp, Artificial
  CRISPR gRNA sequence
cttgctgactggggactgct

SEQ ID NO: 486979 - DNA, 20 bp, Artificial
  CRISPR gRNA sequence
gggactgctgagcccgtgca

SEQ ID NO: 486980 - DNA, 20 bp, Artificial
  CRISPR gRNA sequence
actgctgagcccgtgcacgg

SEQ ID NO: 486981 - DNA, 20 bp, Artificial
  CRISPR gRNA sequence
tgctgagcccgtgcacggca

SEQ ID NO: 486982 - DNA, 20 bp, Artificial
  CRISPR gRNA sequence
ctgagcccgtgcacggcaga

SEQ ID NO: 486983 - DNA, 20 bp, Artificial
  CRISPR gRNA sequence
cccgtgcacggcagagagtc

SEQ ID NO: 486984 - DNA, 20 bp, Artificial
  CRISPR gRNA sequence
gtgcacggcagagagtctgg

SEQ ID NO: 486985 - DNA, 20 bp, Artificial
  CRISPR gRNA sequence
tgcacggcagagagtctggt

SEQ ID NO: 486986 - DNA, 20 bp, Artificial
  CRISPR gRNA sequence
gcacggcagagagtctggtg

SEQ ID NO: 486987 - DNA, 20 bp, Artificial
  CRISPR gRNA sequence
cggcagagagtctggtgggg

SEQ ID NO: 486988 - DNA, 20 bp, Artificial
  CRISPR gRNA sequence
gcagagagtctggtggggtg

SEQ ID NO: 486989 - DNA, 20 bp, Artificial
  CRISPR gRNA sequence
cagagagtctggtggggtgg

SEQ ID NO: 486990 - DNA, 20 bp, Artificial
  CRISPR gRNA sequence
agagagtctggtggggtgga

SEQ ID NO: 486991 - DNA, 20 bp, Artificial
  CRISPR gRNA sequence
gagagtctggtggggtggag

SEQ ID NO: 486992 - DNA, 20 bp, Artificial
  CRISPR gRNA sequence
gtctggtggggtggaggggc

SEQ ID NO: 486993 - DNA, 20 bp, Artificial
  CRISPR gRNA sequence
gtggggtggaggggctggcc

SEQ ID NO: 486994 - DNA, 20 bp, Artificial
  CRISPR gRNA sequence
ggcctggcccctctgtcctg

SEQ ID NO: 486995 - DNA, 20 bp, Artificial
  CRISPR gRNA sequence
cctctgtcctgtggaaatgc

SEQ ID NO: 486996 - DNA, 20 bp, Artificial
  CRISPR gRNA sequence
ctctgtcctgtggaaatgct

SEQ ID NO: 486997 - DNA, 20 bp, Artificial
  CRISPR gRNA sequence
tctgtcctgtggaaatgctg

SEQ ID NO: 486998 - DNA, 20 bp, Artificial
  CRISPR gRNA sequence
tcctgtggaaatgctggggc

SEQ ID NO: 486999 - DNA, 20 bp, Artificial
  CRISPR gRNA sequence
tgtggaaatgctggggcaag

SEQ ID NO: 487000 - DNA, 20 bp, Artificial
  CRISPR gRNA sequence
tcatactcctcctgctcctc

SEQ ID NO: 487001 - DNA, 20 bp, Artificial
  CRISPR gRNA sequence
catactcctcctgctcctca

SEQ ID NO: 487002 - DNA, 20 bp, Artificial
  CRISPR gRNA sequence
tcctgctcctcaaggtgtat

SEQ ID NO: 487003 - DNA, 20 bp, Artificial
  CRISPR gRNA sequence
cctgctcctcaaggtgtatc

SEQ ID NO: 487004 - DNA, 20 bp, Artificial
  CRISPR gRNA sequence
ctgctcctcaaggtgtatca

SEQ ID NO: 487005 - DNA, 20 bp, Artificial
  CRISPR gRNA sequence
cctcaaggtgtatcagggca

SEQ ID NO: 487006 - DNA, 20 bp, Artificial
  CRISPR gRNA sequence
ctcaaggtgtatcagggcaa

SEQ ID NO: 487007 - DNA, 20 bp, Artificial
  CRISPR gRNA sequence
aggtgtatcagggcaaaggt

SEQ ID NO: 487008 - DNA, 20 bp, Artificial
  CRISPR gRNA sequence
ggtgtatcagggcaaaggta

SEQ ID NO: 487009 - DNA, 20 bp, Artificial
  CRISPR gRNA sequence
tgtatcagggcaaaggtaag

SEQ ID NO: 487010 - DNA, 20 bp, Artificial
  CRISPR gRNA sequence
gtatcagggcaaaggtaagg

SEQ ID NO: 487011 - DNA, 20 bp, Artificial
  CRISPR gRNA sequence
aaaggtaaggaggtcctacc

SEQ ID NO: 487012 - DNA, 20 bp, Artificial
  CRISPR gRNA sequence
taaggaggtcctacctggcg

SEQ ID NO: 487013 - DNA, 20 bp, Artificial
  CRISPR gRNA sequence
aaggaggtcctacctggcgt

SEQ ID NO: 487014 - DNA, 20 bp, Artificial
  CRISPR gRNA sequence
aggaggtcctacctggcgtg

SEQ ID NO: 487015 - DNA, 20 bp, Artificial
  CRISPR gRNA sequence
ggtcctacctggcgtggggc

SEQ ID NO: 487016 - DNA, 20 bp, Artificial
  CRISPR gRNA sequence
gtcctacctggcgtggggcg

SEQ ID NO: 487017 - DNA, 20 bp, Artificial
  CRISPR gRNA sequence
tcctacctggcgtggggcga

SEQ ID NO: 487018 - DNA, 20 bp, Artificial
  CRISPR gRNA sequence
ctacctggcgtggggcgagg

SEQ ID NO: 487019 - DNA, 20 bp, Artificial
  CRISPR gRNA sequence
tacctggcgtggggcgaggg

SEQ ID NO: 487020 - DNA, 20 bp, Artificial
  CRISPR gRNA sequence
acctggcgtggggcgaggga

SEQ ID NO: 487021 - DNA, 20 bp, Artificial
  CRISPR gRNA sequence
gcgtggggcgagggagggac

SEQ ID NO: 487022 - DNA, 20 bp, Artificial
  CRISPR gRNA sequence
cgtggggcgagggagggact

SEQ ID NO: 487023 - DNA, 20 bp, Artificial
  CRISPR gRNA sequence
tggggcgagggagggactag

SEQ ID NO: 487024 - DNA, 20 bp, Artificial
  CRISPR gRNA sequence
ggactaggagctgtgcccct

SEQ ID NO: 487025 - DNA, 20 bp, Artificial
  CRISPR gRNA sequence
gactaggagctgtgcccctc

SEQ ID NO: 487026 - DNA, 20 bp, Artificial
  CRISPR gRNA sequence
actaggagctgtgcccctca

SEQ ID NO: 487027 - DNA, 20 bp, Artificial
  CRISPR gRNA sequence
taggagctgtgcccctcagg

SEQ ID NO: 487028 - DNA, 20 bp, Artificial
  CRISPR gRNA sequence
gctgtgcccctcagggagat

SEQ ID NO: 487029 - DNA, 20 bp, Artificial
  CRISPR gRNA sequence
tgtgcccctcagggagatca

SEQ ID NO: 487030 - DNA, 20 bp, Artificial
  CRISPR gRNA sequence
cccctcagggagatcagagc

SEQ ID NO: 487031 - DNA, 20 bp, Artificial
  CRISPR gRNA sequence
cctcagggagatcagagcca

SEQ ID NO: 487032 - DNA, 20 bp, Artificial
  CRISPR gRNA sequence
ctctgcttgtgccacataca

SEQ ID NO: 487033 - DNA, 20 bp, Artificial
  CRISPR gRNA sequence
gtgccacatacacagtcatc

SEQ ID NO: 487034 - DNA, 20 bp, Artificial
  CRISPR gRNA sequence
gtcatctggaacttgactcc

SEQ ID NO: 487035 - DNA, 20 bp, Artificial
  CRISPR gRNA sequence
atctggaacttgactccgag

SEQ ID NO: 487036 - DNA, 20 bp, Artificial
  CRISPR gRNA sequence
tgactccgagcagctcctga

SEQ ID NO: 487037 - DNA, 20 bp, Artificial
  CRISPR gRNA sequence
gcagctcctgacagctctga

SEQ ID NO: 487038 - DNA, 20 bp, Artificial
  CRISPR gRNA sequence
acagctctgacagtctaaat

SEQ ID NO: 487039 - DNA, 20 bp, Artificial
  CRISPR gRNA sequence
ctctgacagtctaaatcaga

SEQ ID NO: 487040 - DNA, 20 bp, Artificial
  CRISPR gRNA sequence
tctgacagtctaaatcagac

SEQ ID NO: 487041 - DNA, 20 bp, Artificial
  CRISPR gRNA sequence
acagtctaaatcagacagga

SEQ ID NO: 487042 - DNA, 20 bp, Artificial
  CRISPR gRNA sequence
cagtctaaatcagacaggac

SEQ ID NO: 487043 - DNA, 20 bp, Artificial
  CRISPR gRNA sequence
ctaaatcagacaggacaggc

SEQ ID NO: 487044 - DNA, 20 bp, Artificial
  CRISPR gRNA sequence
aatcagacaggacaggctgg

SEQ ID NO: 487045 - DNA, 20 bp, Artificial
  CRISPR gRNA sequence
aggacaggctggcagtgcac

SEQ ID NO: 487046 - DNA, 20 bp, Artificial
  CRISPR gRNA sequence
ggacaggctggcagtgcact

SEQ ID NO: 487047 - DNA, 20 bp, Artificial
  CRISPR gRNA sequence
acaggctggcagtgcactgg

SEQ ID NO: 487048 - DNA, 20 bp, Artificial
  CRISPR gRNA sequence
caggctggcagtgcactggg

SEQ ID NO: 487049 - DNA, 20 bp, Artificial
  CRISPR gRNA sequence
cagtgcactgggaggtctgt

SEQ ID NO: 487050 - DNA, 20 bp, Artificial
  CRISPR gRNA sequence
gtgcactgggaggtctgtga

SEQ ID NO: 487051 - DNA, 20 bp, Artificial
  CRISPR gRNA sequence
tgcactgggaggtctgtgag

SEQ ID NO: 487052 - DNA, 20 bp, Artificial
  CRISPR gRNA sequence
gcactgggaggtctgtgaga

SEQ ID NO: 487053 - DNA, 20 bp, Artificial
  CRISPR gRNA sequence
cactgggaggtctgtgagag

SEQ ID NO: 487054 - DNA, 20 bp, Artificial
  CRISPR gRNA sequence
aggtctgtgagaggggtatc

SEQ ID NO: 487055 - DNA, 20 bp, Artificial
  CRISPR gRNA sequence
ggggtatctggccctgccac

SEQ ID NO: 487056 - DNA, 20 bp, Artificial
  CRISPR gRNA sequence
tggccctgccaccagcaatc

SEQ ID NO: 487057 - DNA, 20 bp, Artificial
  CRISPR gRNA sequence
ggccctgccaccagcaatcc

SEQ ID NO: 487058 - DNA, 20 bp, Artificial
  CRISPR gRNA sequence
cctgccaccagcaatccagg

SEQ ID NO: 487059 - DNA, 20 bp, Artificial
  CRISPR gRNA sequence
accagcaatccaggaagtct

SEQ ID NO: 487060 - DNA, 20 bp, Artificial
  CRISPR gRNA sequence
ccagcaatccaggaagtctt

SEQ ID NO: 487061 - DNA, 20 bp, Artificial
  CRISPR gRNA sequence
caatccaggaagtcttgggt

SEQ ID NO: 487062 - DNA, 20 bp, Artificial
  CRISPR gRNA sequence
aatccaggaagtcttgggtg

SEQ ID NO: 487063 - DNA, 20 bp, Artificial
  CRISPR gRNA sequence
tccaggaagtcttgggtgag

SEQ ID NO: 487064 - DNA, 20 bp, Artificial
  CRISPR gRNA sequence
gtgaggagattccttcccac

SEQ ID NO: 487065 - DNA, 20 bp, Artificial
  CRISPR gRNA sequence
cttcaatttacccttccgtg

SEQ ID NO: 487066 - DNA, 20 bp, Artificial
  CRISPR gRNA sequence
caatttacccttccgtgtag

SEQ ID NO: 487067 - DNA, 20 bp, Artificial
  CRISPR gRNA sequence
atttacccttccgtgtagtg

SEQ ID NO: 487068 - DNA, 20 bp, Artificial
  CRISPR gRNA sequence
ttacccttccgtgtagtgga

SEQ ID NO: 487069 - DNA, 20 bp, Artificial
  CRISPR gRNA sequence
acccttccgtgtagtggaga

SEQ ID NO: 487070 - DNA, 20 bp, Artificial
  CRISPR gRNA sequence
cttccgtgtagtggagagag

SEQ ID NO: 487071 - DNA, 20 bp, Artificial
  CRISPR gRNA sequence
tggagagagaagcctccttc

SEQ ID NO: 487072 - DNA, 20 bp, Artificial
  CRISPR gRNA sequence
cctccttccagccgcctgta

SEQ ID NO: 487073 - DNA, 20 bp, Artificial
  CRISPR gRNA sequence
aaaattgcatcctccaattg

SEQ ID NO: 487074 - DNA, 20 bp, Artificial
  CRISPR gRNA sequence
gcatcctccaattgtggcat

SEQ ID NO: 487075 - DNA, 20 bp, Artificial
  CRISPR gRNA sequence
atcctccaattgtggcatga

SEQ ID NO: 487076 - DNA, 20 bp, Artificial
  CRISPR gRNA sequence
ctccaattgtggcatgagag

SEQ ID NO: 487077 - DNA, 20 bp, Artificial
  CRISPR gRNA sequence
ccaattgtggcatgagagaa

SEQ ID NO: 487078 - DNA, 20 bp, Artificial
  CRISPR gRNA sequence
attgtggcatgagagaagag

SEQ ID NO: 487079 - DNA, 20 bp, Artificial
  CRISPR gRNA sequence
gtggcatgagagaagagaag

SEQ ID NO: 487080 - DNA, 20 bp, Artificial
  CRISPR gRNA sequence
gagagaagagaagcagtccc

SEQ ID NO: 487081 - DNA, 20 bp, Artificial
  CRISPR gRNA sequence
agagaagagaagcagtccca

SEQ ID NO: 487082 - DNA, 20 bp, Artificial
  CRISPR gRNA sequence
gaagagaagcagtcccaagg

SEQ ID NO: 487083 - DNA, 20 bp, Artificial
  CRISPR gRNA sequence
gagaagcagtcccaaggaag

SEQ ID NO: 487084 - DNA, 20 bp, Artificial
  CRISPR gRNA sequence
agaagcagtcccaaggaagt

SEQ ID NO: 487085 - DNA, 20 bp, Artificial
  CRISPR gRNA sequence
agcagtcccaaggaagtggg

SEQ ID NO: 487086 - DNA, 20 bp, Artificial
  CRISPR gRNA sequence
caaggaagtgggtggttctc

SEQ ID NO: 487087 - DNA, 20 bp, Artificial
  CRISPR gRNA sequence
aagtgggtggttctcgagct

SEQ ID NO: 487088 - DNA, 20 bp, Artificial
  CRISPR gRNA sequence
gtgggtggttctcgagctca

SEQ ID NO: 487089 - DNA, 20 bp, Artificial
  CRISPR gRNA sequence
gtggttctcgagctcagaga

SEQ ID NO: 487090 - DNA, 20 bp, Artificial
  CRISPR gRNA sequence
ttctcgagctcagagacaga

SEQ ID NO: 487091 - DNA, 20 bp, Artificial
  CRISPR gRNA sequence
cgagctcagagacagatgga

SEQ ID NO: 487092 - DNA, 20 bp, Artificial
  CRISPR gRNA sequence
agacagatggatggacccct

SEQ ID NO: 487093 - DNA, 20 bp, Artificial
  CRISPR gRNA sequence
gacagatggatggacccctg

SEQ ID NO: 487094 - DNA, 20 bp, Artificial
  CRISPR gRNA sequence
agatggatggacccctgagg

SEQ ID NO: 487095 - DNA, 20 bp, Artificial
  CRISPR gRNA sequence
gatggatggacccctgaggc

SEQ ID NO: 487096 - DNA, 20 bp, Artificial
  CRISPR gRNA sequence
gatggacccctgaggcagga

SEQ ID NO: 487097 - DNA, 20 bp, Artificial
  CRISPR gRNA sequence
acccctgaggcaggaaagct

SEQ ID NO: 487098 - DNA, 20 bp, Artificial
  CRISPR gRNA sequence
tgaggcaggaaagctgagcc

SEQ ID NO: 487099 - DNA, 20 bp, Artificial
  CRISPR gRNA sequence
gaggcaggaaagctgagccc

SEQ ID NO: 487100 - DNA, 20 bp, Artificial
  CRISPR gRNA sequence
aggcaggaaagctgagccca

SEQ ID NO: 487101 - DNA, 20 bp, Artificial
  CRISPR gRNA sequence
gcaggaaagctgagcccagg

SEQ ID NO: 487102 - DNA, 20 bp, Artificial
  CRISPR gRNA sequence
caggaaagctgagcccaggg

SEQ ID NO: 487103 - DNA, 20 bp, Artificial
  CRISPR gRNA sequence
aggaaagctgagcccaggga

SEQ ID NO: 487104 - DNA, 20 bp, Artificial
  CRISPR gRNA sequence
ggaaagctgagcccagggag

SEQ ID NO: 487105 - DNA, 20 bp, Artificial
  CRISPR gRNA sequence
aaagctgagcccagggaggg

SEQ ID NO: 487106 - DNA, 20 bp, Artificial
  CRISPR gRNA sequence
aagctgagcccagggagggg

SEQ ID NO: 487107 - DNA, 20 bp, Artificial
  CRISPR gRNA sequence
agctgagcccagggagggga

SEQ ID NO: 487108 - DNA, 20 bp, Artificial
  CRISPR gRNA sequence
gagcccagggaggggagggc

SEQ ID NO: 487109 - DNA, 20 bp, Artificial
  CRISPR gRNA sequence
agcccagggaggggagggcg

SEQ ID NO: 487110 - DNA, 20 bp, Artificial
  CRISPR gRNA sequence
cagggaggggagggcgaggc

SEQ ID NO: 487111 - DNA, 20 bp, Artificial
  CRISPR gRNA sequence
ggaggggagggcgaggccag

SEQ ID NO: 487112 - DNA, 20 bp, Artificial
  CRISPR gRNA sequence
gggagggcgaggccagcagc

SEQ ID NO: 487113 - DNA, 20 bp, Artificial
  CRISPR gRNA sequence
ggagggcgaggccagcagcc

SEQ ID NO: 487114 - DNA, 20 bp, Artificial
  CRISPR gRNA sequence
gggcgaggccagcagccagg

SEQ ID NO: 487115 - DNA, 20 bp, Artificial
  CRISPR gRNA sequence
cgaggccagcagccaggaag

SEQ ID NO: 487116 - DNA, 20 bp, Artificial
  CRISPR gRNA sequence
gccagcagccaggaagaagc

SEQ ID NO: 487117 - DNA, 20 bp, Artificial
  CRISPR gRNA sequence
agcagccaggaagaagctgg

SEQ ID NO: 487118 - DNA, 20 bp, Artificial
  CRISPR gRNA sequence
gcagccaggaagaagctgga

SEQ ID NO: 487119 - DNA, 20 bp, Artificial
  CRISPR gRNA sequence
caggaagaagctggaaggca

SEQ ID NO: 487120 - DNA, 20 bp, Artificial
  CRISPR gRNA sequence
ggcatggtccctcatctccc

SEQ ID NO: 487121 - DNA, 20 bp, Artificial
  CRISPR gRNA sequence
cctcatctccccggcttctt

SEQ ID NO: 487122 - DNA, 20 bp, Artificial
  CRISPR gRNA sequence
ccccggcttcttcagccatc

SEQ ID NO: 487123 - DNA, 20 bp, Artificial
  CRISPR gRNA sequence
cttcagccatccagatgcca

SEQ ID NO: 487124 - DNA, 20 bp, Artificial
  CRISPR gRNA sequence
ttcagccatccagatgccac

SEQ ID NO: 487125 - DNA, 20 bp, Artificial
  CRISPR gRNA sequence
cagccatccagatgccacag

SEQ ID NO: 487126 - DNA, 20 bp, Artificial
  CRISPR gRNA sequence
atccagatgccacaggagcc

SEQ ID NO: 487127 - DNA, 20 bp, Artificial
  CRISPR gRNA sequence
cacaggagcctggaaattat

SEQ ID NO: 487128 - DNA, 20 bp, Artificial
  CRISPR gRNA sequence
acaggagcctggaaattatt

SEQ ID NO: 487129 - DNA, 20 bp, Artificial
  CRISPR gRNA sequence
caggagcctggaaattatta

SEQ ID NO: 487130 - DNA, 20 bp, Artificial
  CRISPR gRNA sequence
tggaaattattagggacatg

SEQ ID NO: 487131 - DNA, 20 bp, Artificial
  CRISPR gRNA sequence
ggaaattattagggacatgc

SEQ ID NO: 487132 - DNA, 20 bp, Artificial
  CRISPR gRNA sequence
gaaattattagggacatgca

SEQ ID NO: 487133 - DNA, 20 bp, Artificial
  CRISPR gRNA sequence
ttattagggacatgcagggt

SEQ ID NO: 487134 - DNA, 20 bp, Artificial
  CRISPR gRNA sequence
tattagggacatgcagggtt

SEQ ID NO: 487135 - DNA, 20 bp, Artificial
  CRISPR gRNA sequence
attagggacatgcagggttg

SEQ ID NO: 487136 - DNA, 20 bp, Artificial
  CRISPR gRNA sequence
agggacatgcagggttgggg

SEQ ID NO: 487137 - DNA, 20 bp, Artificial
  CRISPR gRNA sequence
gacatgcagggttggggcag

SEQ ID NO: 487138 - DNA, 20 bp, Artificial
  CRISPR gRNA sequence
atgcagggttggggcagaag

SEQ ID NO: 487139 - DNA, 20 bp, Artificial
  CRISPR gRNA sequence
tgcagggttggggcagaaga

SEQ ID NO: 487140 - DNA, 20 bp, Artificial
  CRISPR gRNA sequence
cagggttggggcagaagaag

SEQ ID NO: 487141 - DNA, 20 bp, Artificial
  CRISPR gRNA sequence
gcagaagaaggagacaatat

SEQ ID NO: 487142 - DNA, 20 bp, Artificial
  CRISPR gRNA sequence
cagaagaaggagacaatatg

SEQ ID NO: 487143 - DNA, 20 bp, Artificial
  CRISPR gRNA sequence
aagaaggagacaatatgagg

SEQ ID NO: 487144 - DNA, 20 bp, Artificial
  CRISPR gRNA sequence
gacaatatgaggaagctcca

SEQ ID NO: 487145 - DNA, 20 bp, Artificial
  CRISPR gRNA sequence
gaagctccacagcaaaccta

SEQ ID NO: 487146 - DNA, 20 bp, Artificial
  CRISPR gRNA sequence
cacagcaaacctaaagctgt

SEQ ID NO: 487147 - DNA, 20 bp, Artificial
  CRISPR gRNA sequence
gcaaacctaaagctgtcagc

SEQ ID NO: 487148 - DNA, 20 bp, Artificial
  CRISPR gRNA sequence
caaacctaaagctgtcagcc

SEQ ID NO: 487149 - DNA, 20 bp, Artificial
  CRISPR gRNA sequence
ctaaagctgtcagccaggca

SEQ ID NO: 487150 - DNA, 20 bp, Artificial
  CRISPR gRNA sequence
aaagctgtcagccaggcatg

SEQ ID NO: 487151 - DNA, 20 bp, Artificial
  CRISPR gRNA sequence
agccatctaacatttactcc

SEQ ID NO: 487152 - DNA, 20 bp, Artificial
  CRISPR gRNA sequence
gccatctaacatttactcct

SEQ ID NO: 487153 - DNA, 20 bp, Artificial
  CRISPR gRNA sequence
ccatctaacatttactcctg

SEQ ID NO: 487154 - DNA, 20 bp, Artificial
  CRISPR gRNA sequence
acatttactcctggggatcc

SEQ ID NO: 487155 - DNA, 20 bp, Artificial
  CRISPR gRNA sequence
tactcctggggatcccagct

SEQ ID NO: 487156 - DNA, 20 bp, Artificial
  CRISPR gRNA sequence
actcctggggatcccagctg

SEQ ID NO: 487157 - DNA, 20 bp, Artificial
  CRISPR gRNA sequence
ctcctggggatcccagctga

SEQ ID NO: 487158 - DNA, 20 bp, Artificial
  CRISPR gRNA sequence
gggctgctcccctctttctc

SEQ ID NO: 487159 - DNA, 20 bp, Artificial
  CRISPR gRNA sequence
ctcccctctttctccagttc

SEQ ID NO: 487160 - DNA, 20 bp, Artificial
  CRISPR gRNA sequence
tcccctctttctccagttct

SEQ ID NO: 487161 - DNA, 20 bp, Artificial
  CRISPR gRNA sequence
cccctctttctccagttctg

SEQ ID NO: 487162 - DNA, 20 bp, Artificial
  CRISPR gRNA sequence
ctttctccagttctggggtc

SEQ ID NO: 487163 - DNA, 20 bp, Artificial
  CRISPR gRNA sequence
tttctccagttctggggtcc

SEQ ID NO: 487164 - DNA, 20 bp, Artificial
  CRISPR gRNA sequence
gtccaggatgctctgaaacc

SEQ ID NO: 487165 - DNA, 20 bp, Artificial
  CRISPR gRNA sequence
tatttatttatttatttttt

SEQ ID NO: 487166 - DNA, 20 bp, Artificial
  CRISPR gRNA sequence
tatttatttattttttgaga

SEQ ID NO: 487167 - DNA, 20 bp, Artificial
  CRISPR gRNA sequence
tttatttattttttgagaca

SEQ ID NO: 487168 - DNA, 20 bp, Artificial
  CRISPR gRNA sequence
cagagtctccttctgtcacc

SEQ ID NO: 487169 - DNA, 20 bp, Artificial
  CRISPR gRNA sequence
agagtctccttctgtcaccc

SEQ ID NO: 487170 - DNA, 20 bp, Artificial
  CRISPR gRNA sequence
tctccttctgtcacccaggc

SEQ ID NO: 487171 - DNA, 20 bp, Artificial
  CRISPR gRNA sequence
tccttctgtcacccaggctg

SEQ ID NO: 487172 - DNA, 20 bp, Artificial
  CRISPR gRNA sequence
ctgtcacccaggctggagtg

SEQ ID NO: 487173 - DNA, 20 bp, Artificial
  CRISPR gRNA sequence
tcacccaggctggagtgcag

SEQ ID NO: 487174 - DNA, 20 bp, Artificial
  CRISPR gRNA sequence
ggagtgcagtggcgtgatct

SEQ ID NO: 487175 - DNA, 20 bp, Artificial
  CRISPR gRNA sequence
tcactacaaactctgcctcc

SEQ ID NO: 487176 - DNA, 20 bp, Artificial
  CRISPR gRNA sequence
cactacaaactctgcctccc

SEQ ID NO: 487177 - DNA, 20 bp, Artificial
  CRISPR gRNA sequence
aaactctgcctcccgggttc

SEQ ID NO: 487178 - DNA, 20 bp, Artificial
  CRISPR gRNA sequence
ttcaagtgattctcatgcct

SEQ ID NO: 487179 - DNA, 20 bp, Artificial
  CRISPR gRNA sequence
ttctcatgcctcagcctccc

SEQ ID NO: 487180 - DNA, 20 bp, Artificial
  CRISPR gRNA sequence
tcatgcctcagcctcccgag

SEQ ID NO: 487181 - DNA, 20 bp, Artificial
  CRISPR gRNA sequence
catgcctcagcctcccgagt

SEQ ID NO: 487182 - DNA, 20 bp, Artificial
  CRISPR gRNA sequence
ctcccgagtaggtgaaatta

SEQ ID NO: 487183 - DNA, 20 bp, Artificial
  CRISPR gRNA sequence
cagacgtgcgccaccatgct

SEQ ID NO: 487184 - DNA, 20 bp, Artificial
  CRISPR gRNA sequence
ttggctaatttttgtatttt

SEQ ID NO: 487185 - DNA, 20 bp, Artificial
  CRISPR gRNA sequence
gctaatttttgtatttttag

SEQ ID NO: 487186 - DNA, 20 bp, Artificial
  CRISPR gRNA sequence
taatttttgtatttttagta

SEQ ID NO: 487187 - DNA, 20 bp, Artificial
  CRISPR gRNA sequence
tttgtatttttagtagagac

SEQ ID NO: 487188 - DNA, 20 bp, Artificial
  CRISPR gRNA sequence
ttgtatttttagtagagacc

SEQ ID NO: 487189 - DNA, 20 bp, Artificial
  CRISPR gRNA sequence
gagaccaggtttcaccatgt

SEQ ID NO: 487190 - DNA, 20 bp, Artificial
  CRISPR gRNA sequence
ccaggtttcaccatgttggc

SEQ ID NO: 487191 - DNA, 20 bp, Artificial
  CRISPR gRNA sequence
caggtttcaccatgttggcc

SEQ ID NO: 487192 - DNA, 20 bp, Artificial
  CRISPR gRNA sequence
tttcaccatgttggccaggc

SEQ ID NO: 487193 - DNA, 20 bp, Artificial
  CRISPR gRNA sequence
tggtcttgaactcctgacct

SEQ ID NO: 487194 - DNA, 20 bp, Artificial
  CRISPR gRNA sequence
ggtcttgaactcctgacctc

SEQ ID NO: 487195 - DNA, 20 bp, Artificial
  CRISPR gRNA sequence
ctcaggtgatctgcccacct

SEQ ID NO: 487196 - DNA, 20 bp, Artificial
  CRISPR gRNA sequence
accttggtctcccccatcca

SEQ ID NO: 487197 - DNA, 20 bp, Artificial
  CRISPR gRNA sequence
gtctcccccatccaaagtgc

SEQ ID NO: 487198 - DNA, 20 bp, Artificial
  CRISPR gRNA sequence
tctcccccatccaaagtgct

SEQ ID NO: 487199 - DNA, 20 bp, Artificial
  CRISPR gRNA sequence
catccaaagtgctgggatta

SEQ ID NO: 487200 - DNA, 20 bp, Artificial
  CRISPR gRNA sequence
atccaaagtgctgggattac

SEQ ID NO: 487201 - DNA, 20 bp, Artificial
  CRISPR gRNA sequence
agtgctgggattacaggtgt

SEQ ID NO: 487202 - DNA, 20 bp, Artificial
  CRISPR gRNA sequence
caggtgtgagccaccatgcc

SEQ ID NO: 487203 - DNA, 20 bp, Artificial
  CRISPR gRNA sequence
tgtgagccaccatgcccagc

SEQ ID NO: 487204 - DNA, 20 bp, Artificial
  CRISPR gRNA sequence
gtgagccaccatgcccagcc

SEQ ID NO: 487205 - DNA, 20 bp, Artificial
  CRISPR gRNA sequence
tgagccaccatgcccagcca

SEQ ID NO: 487206 - DNA, 20 bp, Artificial
  CRISPR gRNA sequence
ccagccagggttctgcattt

SEQ ID NO: 487207 - DNA, 20 bp, Artificial
  CRISPR gRNA sequence
cagggttctgcattttagat

SEQ ID NO: 487208 - DNA, 20 bp, Artificial
  CRISPR gRNA sequence
attttagatcagtgactctg

SEQ ID NO: 487209 - DNA, 20 bp, Artificial
  CRISPR gRNA sequence
ttttagatcagtgactctgc

SEQ ID NO: 487210 - DNA, 20 bp, Artificial
  CRISPR gRNA sequence
tttagatcagtgactctgca

SEQ ID NO: 487211 - DNA, 20 bp, Artificial
  CRISPR gRNA sequence
ttagatcagtgactctgcag

SEQ ID NO: 487212 - DNA, 20 bp, Artificial
  CRISPR gRNA sequence
gtgactctgcaggggcttca

SEQ ID NO: 487213 - DNA, 20 bp, Artificial
  CRISPR gRNA sequence
gactctgcaggggcttcacg

SEQ ID NO: 487214 - DNA, 20 bp, Artificial
  CRISPR gRNA sequence
actctgcaggggcttcacgg

SEQ ID NO: 487215 - DNA, 20 bp, Artificial
  CRISPR gRNA sequence
ctgcaggggcttcacggagg

SEQ ID NO: 487216 - DNA, 20 bp, Artificial
  CRISPR gRNA sequence
gcaggggcttcacggaggtg

SEQ ID NO: 487217 - DNA, 20 bp, Artificial
  CRISPR gRNA sequence
aggggcttcacggaggtgga

SEQ ID NO: 487218 - DNA, 20 bp, Artificial
  CRISPR gRNA sequence
cttcacggaggtggagagcg

SEQ ID NO: 487219 - DNA, 20 bp, Artificial
  CRISPR gRNA sequence
ggaggtggagagcgtggaat

SEQ ID NO: 487220 - DNA, 20 bp, Artificial
  CRISPR gRNA sequence
aggtggagagcgtggaatta

SEQ ID NO: 487221 - DNA, 20 bp, Artificial
  CRISPR gRNA sequence
ggtggagagcgtggaattag

SEQ ID NO: 487222 - DNA, 20 bp, Artificial
  CRISPR gRNA sequence
tggagagcgtggaattagag

SEQ ID NO: 487223 - DNA, 20 bp, Artificial
  CRISPR gRNA sequence
ggagagcgtggaattagagg

SEQ ID NO: 487224 - DNA, 20 bp, Artificial
  CRISPR gRNA sequence
gagagcgtggaattagagga

SEQ ID NO: 487225 - DNA, 20 bp, Artificial
  CRISPR gRNA sequence
aattagaggagggtacactc

SEQ ID NO: 487226 - DNA, 20 bp, Artificial
  CRISPR gRNA sequence
attagaggagggtacactct

SEQ ID NO: 487227 - DNA, 20 bp, Artificial
  CRISPR gRNA sequence
gagggtacactctgggcaca

SEQ ID NO: 487228 - DNA, 20 bp, Artificial
  CRISPR gRNA sequence
gggtacactctgggcacaaa

SEQ ID NO: 487229 - DNA, 20 bp, Artificial
  CRISPR gRNA sequence
ggtacactctgggcacaaag

SEQ ID NO: 487230 - DNA, 20 bp, Artificial
  CRISPR gRNA sequence
gtacactctgggcacaaaga

SEQ ID NO: 487231 - DNA, 20 bp, Artificial
  CRISPR gRNA sequence
tacactctgggcacaaagag

SEQ ID NO: 487232 - DNA, 20 bp, Artificial
  CRISPR gRNA sequence
gggcacaaagaggggaaact

SEQ ID NO: 487233 - DNA, 20 bp, Artificial
  CRISPR gRNA sequence
ggcacaaagaggggaaactg

SEQ ID NO: 487234 - DNA, 20 bp, Artificial
  CRISPR gRNA sequence
aaagaggggaaactgaggca

SEQ ID NO: 487235 - DNA, 20 bp, Artificial
  CRISPR gRNA sequence
aactgaggcatagtgttgtg

SEQ ID NO: 487236 - DNA, 20 bp, Artificial
  CRISPR gRNA sequence
actgaggcatagtgttgtgt

SEQ ID NO: 487237 - DNA, 20 bp, Artificial
  CRISPR gRNA sequence
ggcatagtgttgtgtgggtt

SEQ ID NO: 487238 - DNA, 20 bp, Artificial
  CRISPR gRNA sequence
gcatagtgttgtgtgggttc

SEQ ID NO: 487239 - DNA, 20 bp, Artificial
  CRISPR gRNA sequence
catagtgttgtgtgggttca

SEQ ID NO: 487240 - DNA, 20 bp, Artificial
  CRISPR gRNA sequence
gtgttgtgtgggttcagggc

SEQ ID NO: 487241 - DNA, 20 bp, Artificial
  CRISPR gRNA sequence
tgttgtgtgggttcagggcc

SEQ ID NO: 487242 - DNA, 20 bp, Artificial
  CRISPR gRNA sequence
tgtgtgggttcagggccagg

SEQ ID NO: 487243 - DNA, 20 bp, Artificial
  CRISPR gRNA sequence
gtgggttcagggccaggtag

SEQ ID NO: 487244 - DNA, 20 bp, Artificial
  CRISPR gRNA sequence
tagaagccccatatgcaata

SEQ ID NO: 487245 - DNA, 20 bp, Artificial
  CRISPR gRNA sequence
atgcaataaagtcccatgcc

SEQ ID NO: 487246 - DNA, 20 bp, Artificial
  CRISPR gRNA sequence
tgcaataaagtcccatgccc

SEQ ID NO: 487247 - DNA, 20 bp, Artificial
  CRISPR gRNA sequence
ccatgcccaggtactcaatt

SEQ ID NO: 487248 - DNA, 20 bp, Artificial
  CRISPR gRNA sequence
aggtactcaattcagttacc

SEQ ID NO: 487249 - DNA, 20 bp, Artificial
  CRISPR gRNA sequence
aattcagttaccgagtccct

SEQ ID NO: 487250 - DNA, 20 bp, Artificial
  CRISPR gRNA sequence
ctgagcattcttgtgtcctt

SEQ ID NO: 487251 - DNA, 20 bp, Artificial
  CRISPR gRNA sequence
tgagcattcttgtgtccttc

SEQ ID NO: 487252 - DNA, 20 bp, Artificial
  CRISPR gRNA sequence
gcattcttgtgtccttcagg

SEQ ID NO: 487253 - DNA, 20 bp, Artificial
  CRISPR gRNA sequence
ttgtgtccttcaggaagaca

SEQ ID NO: 487254 - DNA, 20 bp, Artificial
  CRISPR gRNA sequence
tccttcaggaagacacagtc

SEQ ID NO: 487255 - DNA, 20 bp, Artificial
  CRISPR gRNA sequence
ccttcaggaagacacagtca

SEQ ID NO: 487256 - DNA, 20 bp, Artificial
  CRISPR gRNA sequence
aggaagacacagtcaaggct

SEQ ID NO: 487257 - DNA, 20 bp, Artificial
  CRISPR gRNA sequence
ggaagacacagtcaaggctc

SEQ ID NO: 487258 - DNA, 20 bp, Artificial
  CRISPR gRNA sequence
agacacagtcaaggctcagg

SEQ ID NO: 487259 - DNA, 20 bp, Artificial
  CRISPR gRNA sequence
caggtggactcaacatttgt

SEQ ID NO: 487260 - DNA, 20 bp, Artificial
  CRISPR gRNA sequence
aggtggactcaacatttgta

SEQ ID NO: 487261 - DNA, 20 bp, Artificial
  CRISPR gRNA sequence
actcaacatttgtaaggatg

SEQ ID NO: 487262 - DNA, 20 bp, Artificial
  CRISPR gRNA sequence
ctcaacatttgtaaggatgc

SEQ ID NO: 487263 - DNA, 20 bp, Artificial
  CRISPR gRNA sequence
aacatttgtaaggatgcagg

SEQ ID NO: 487264 - DNA, 20 bp, Artificial
  CRISPR gRNA sequence
ttgtaaggatgcaggcagcc

SEQ ID NO: 487265 - DNA, 20 bp, Artificial
  CRISPR gRNA sequence
tgtaaggatgcaggcagcct

SEQ ID NO: 487266 - DNA, 20 bp, Artificial
  CRISPR gRNA sequence
gtaaggatgcaggcagccta

SEQ ID NO: 487267 - DNA, 20 bp, Artificial
  CRISPR gRNA sequence
aggatgcaggcagcctaggg

SEQ ID NO: 487268 - DNA, 20 bp, Artificial
  CRISPR gRNA sequence
gatgcaggcagcctagggca

SEQ ID NO: 487269 - DNA, 20 bp, Artificial
  CRISPR gRNA sequence
agcctagggcagagcatgat

SEQ ID NO: 487270 - DNA, 20 bp, Artificial
  CRISPR gRNA sequence
gcctagggcagagcatgatg

SEQ ID NO: 487271 - DNA, 20 bp, Artificial
  CRISPR gRNA sequence
gggcagagcatgatgaggaa

SEQ ID NO: 487272 - DNA, 20 bp, Artificial
  CRISPR gRNA sequence
ggcagagcatgatgaggaac

SEQ ID NO: 487273 - DNA, 20 bp, Artificial
  CRISPR gRNA sequence
gcagagcatgatgaggaaca

SEQ ID NO: 487274 - DNA, 20 bp, Artificial
  CRISPR gRNA sequence
agagcatgatgaggaacagg

SEQ ID NO: 487275 - DNA, 20 bp, Artificial
  CRISPR gRNA sequence
gcatgatgaggaacagggag

SEQ ID NO: 487276 - DNA, 20 bp, Artificial
  CRISPR gRNA sequence
catgatgaggaacagggagc

SEQ ID NO: 487277 - DNA, 20 bp, Artificial
  CRISPR gRNA sequence
atgatgaggaacagggagca

SEQ ID NO: 487278 - DNA, 20 bp, Artificial
  CRISPR gRNA sequence
gatgaggaacagggagcagg

SEQ ID NO: 487279 - DNA, 20 bp, Artificial
  CRISPR gRNA sequence
atgaggaacagggagcaggg

SEQ ID NO: 487280 - DNA, 20 bp, Artificial
  CRISPR gRNA sequence
tgaggaacagggagcaggga

SEQ ID NO: 487281 - DNA, 20 bp, Artificial
  CRISPR gRNA sequence
aggaacagggagcagggagg

SEQ ID NO: 487282 - DNA, 20 bp, Artificial
  CRISPR gRNA sequence
ggaacagggagcagggaggg

SEQ ID NO: 487283 - DNA, 20 bp, Artificial
  CRISPR gRNA sequence
aacagggagcagggagggag

SEQ ID NO: 487284 - DNA, 20 bp, Artificial
  CRISPR gRNA sequence
agggagcagggagggaggag

SEQ ID NO: 487285 - DNA, 20 bp, Artificial
  CRISPR gRNA sequence
ggagcagggagggaggagtg

SEQ ID NO: 487286 - DNA, 20 bp, Artificial
  CRISPR gRNA sequence
ggagggaggagtggagcctg

SEQ ID NO: 487287 - DNA, 20 bp, Artificial
  CRISPR gRNA sequence
agtggagcctgcagctcttg

SEQ ID NO: 487288 - DNA, 20 bp, Artificial
  CRISPR gRNA sequence
gtggagcctgcagctcttgt

SEQ ID NO: 487289 - DNA, 20 bp, Artificial
  CRISPR gRNA sequence
gagcctgcagctcttgtggg

SEQ ID NO: 487290 - DNA, 20 bp, Artificial
  CRISPR gRNA sequence
agcctgcagctcttgtgggt

SEQ ID NO: 487291 - DNA, 20 bp, Artificial
  CRISPR gRNA sequence
tgcagctcttgtgggtgggt

SEQ ID NO: 487292 - DNA, 20 bp, Artificial
  CRISPR gRNA sequence
gcagctcttgtgggtgggtt

SEQ ID NO: 487293 - DNA, 20 bp, Artificial
  CRISPR gRNA sequence
cagctcttgtgggtgggttg

SEQ ID NO: 487294 - DNA, 20 bp, Artificial
  CRISPR gRNA sequence
agctcttgtgggtgggttgg

SEQ ID NO: 487295 - DNA, 20 bp, Artificial
  CRISPR gRNA sequence
gctcttgtgggtgggttggg

SEQ ID NO: 487296 - DNA, 20 bp, Artificial
  CRISPR gRNA sequence
tgtgggtgggttggggggcc

SEQ ID NO: 487297 - DNA, 20 bp, Artificial
  CRISPR gRNA sequence
gggtgggttggggggcctag

SEQ ID NO: 487298 - DNA, 20 bp, Artificial
  CRISPR gRNA sequence
ggttggggggcctagtggcc

SEQ ID NO: 487299 - DNA, 20 bp, Artificial
  CRISPR gRNA sequence
gttggggggcctagtggccc

SEQ ID NO: 487300 - DNA, 20 bp, Artificial
  CRISPR gRNA sequence
ggcctagtggcccaggattc

SEQ ID NO: 487301 - DNA, 20 bp, Artificial
  CRISPR gRNA sequence
gcctagtggcccaggattct

SEQ ID NO: 487302 - DNA, 20 bp, Artificial
  CRISPR gRNA sequence
tagtggcccaggattctagg

SEQ ID NO: 487303 - DNA, 20 bp, Artificial
  CRISPR gRNA sequence
agtggcccaggattctaggc

SEQ ID NO: 487304 - DNA, 20 bp, Artificial
  CRISPR gRNA sequence
tggcccaggattctaggcag

SEQ ID NO: 487305 - DNA, 20 bp, Artificial
  CRISPR gRNA sequence
gcccaggattctaggcagga

SEQ ID NO: 487306 - DNA, 20 bp, Artificial
  CRISPR gRNA sequence
aggattctaggcaggagagc

SEQ ID NO: 487307 - DNA, 20 bp, Artificial
  CRISPR gRNA sequence
ggattctaggcaggagagct

SEQ ID NO: 487308 - DNA, 20 bp, Artificial
  CRISPR gRNA sequence
tctaggcaggagagctaggt

SEQ ID NO: 487309 - DNA, 20 bp, Artificial
  CRISPR gRNA sequence
aggagagctaggttggaacc

SEQ ID NO: 487310 - DNA, 20 bp, Artificial
  CRISPR gRNA sequence
gctaggttggaacctggtct

SEQ ID NO: 487311 - DNA, 20 bp, Artificial
  CRISPR gRNA sequence
ctaggttggaacctggtcta

SEQ ID NO: 487312 - DNA, 20 bp, Artificial
  CRISPR gRNA sequence
ggtctaaggatccttgaatg

SEQ ID NO: 487313 - DNA, 20 bp, Artificial
  CRISPR gRNA sequence
aaggatccttgaatgcagct

SEQ ID NO: 487314 - DNA, 20 bp, Artificial
  CRISPR gRNA sequence
atccttgaatgcagctcaga

SEQ ID NO: 487315 - DNA, 20 bp, Artificial
  CRISPR gRNA sequence
gaatgcagctcagacagccg

SEQ ID NO: 487316 - DNA, 20 bp, Artificial
  CRISPR gRNA sequence
aatgcagctcagacagccga

SEQ ID NO: 487317 - DNA, 20 bp, Artificial
  CRISPR gRNA sequence
tgcagctcagacagccgaag

SEQ ID NO: 487318 - DNA, 20 bp, Artificial
  CRISPR gRNA sequence
gcagctcagacagccgaagg

SEQ ID NO: 487319 - DNA, 20 bp, Artificial
  CRISPR gRNA sequence
gacagccgaaggaggactga

SEQ ID NO: 487320 - DNA, 20 bp, Artificial
  CRISPR gRNA sequence
acagccgaaggaggactgat

SEQ ID NO: 487321 - DNA, 20 bp, Artificial
  CRISPR gRNA sequence
cgaaggaggactgatgggat

SEQ ID NO: 487322 - DNA, 20 bp, Artificial
  CRISPR gRNA sequence
ggactgatgggattggtgcc

SEQ ID NO: 487323 - DNA, 20 bp, Artificial
  CRISPR gRNA sequence
atgggattggtgcctggctg

SEQ ID NO: 487324 - DNA, 20 bp, Artificial
  CRISPR gRNA sequence
tgggattggtgcctggctgt

SEQ ID NO: 487325 - DNA, 20 bp, Artificial
  CRISPR gRNA sequence
gggattggtgcctggctgtg

SEQ ID NO: 487326 - DNA, 20 bp, Artificial
  CRISPR gRNA sequence
tggtgcctggctgtggggat

SEQ ID NO: 487327 - DNA, 20 bp, Artificial
  CRISPR gRNA sequence
gtgcctggctgtggggatga

SEQ ID NO: 487328 - DNA, 20 bp, Artificial
  CRISPR gRNA sequence
ggctgtggggatgagagtaa

SEQ ID NO: 487329 - DNA, 20 bp, Artificial
  CRISPR gRNA sequence
ctgtggggatgagagtaaca

SEQ ID NO: 487330 - DNA, 20 bp, Artificial
  CRISPR gRNA sequence
tggggatgagagtaacagag

SEQ ID NO: 487331 - DNA, 20 bp, Artificial
  CRISPR gRNA sequence
atgagagtaacagagaagct

SEQ ID NO: 487332 - DNA, 20 bp, Artificial
  CRISPR gRNA sequence
tgagagtaacagagaagctg

SEQ ID NO: 487333 - DNA, 20 bp, Artificial
  CRISPR gRNA sequence
gaagctgaggttatgaccct

SEQ ID NO: 487334 - DNA, 20 bp, Artificial
  CRISPR gRNA sequence
aagctgaggttatgaccctg

SEQ ID NO: 487335 - DNA, 20 bp, Artificial
  CRISPR gRNA sequence
ggttatgaccctgaggtcat

SEQ ID NO: 487336 - DNA, 20 bp, Artificial
  CRISPR gRNA sequence
gaggtcatgagcctgtgtga

SEQ ID NO: 487337 - DNA, 20 bp, Artificial
  CRISPR gRNA sequence
ggtcatgagcctgtgtgaca

SEQ ID NO: 487338 - DNA, 20 bp, Artificial
  CRISPR gRNA sequence
gtcatgagcctgtgtgacag

SEQ ID NO: 487339 - DNA, 20 bp, Artificial
  CRISPR gRNA sequence
tcatgagcctgtgtgacaga

SEQ ID NO: 487340 - DNA, 20 bp, Artificial
  CRISPR gRNA sequence
gctccctccacccccattcc

SEQ ID NO: 487341 - DNA, 20 bp, Artificial
  CRISPR gRNA sequence
ctccctccacccccattccc

SEQ ID NO: 487342 - DNA, 20 bp, Artificial
  CRISPR gRNA sequence
tccctccacccccattccca

SEQ ID NO: 487343 - DNA, 20 bp, Artificial
  CRISPR gRNA sequence
cacccccattcccagggctt

SEQ ID NO: 487344 - DNA, 20 bp, Artificial
  CRISPR gRNA sequence
ttcccagggcttcagcacca

SEQ ID NO: 487345 - DNA, 20 bp, Artificial
  CRISPR gRNA sequence
cagggcttcagcaccatagc

SEQ ID NO: 487346 - DNA, 20 bp, Artificial
  CRISPR gRNA sequence
agggcttcagcaccatagct

SEQ ID NO: 487347 - DNA, 20 bp, Artificial
  CRISPR gRNA sequence
ttcagcaccatagctgggct

SEQ ID NO: 487348 - DNA, 20 bp, Artificial
  CRISPR gRNA sequence
atagctgggcttggctatgc

SEQ ID NO: 487349 - DNA, 20 bp, Artificial
  CRISPR gRNA sequence
tggctatgccggcccttgca

SEQ ID NO: 487350 - DNA, 20 bp, Artificial
  CRISPR gRNA sequence
atgccggcccttgcacggtg

SEQ ID NO: 487351 - DNA, 20 bp, Artificial
  CRISPR gRNA sequence
cggcccttgcacggtgaagc

SEQ ID NO: 487352 - DNA, 20 bp, Artificial
  CRISPR gRNA sequence
ccttgcacggtgaagctggt

SEQ ID NO: 487353 - DNA, 20 bp, Artificial
  CRISPR gRNA sequence
gaagctggtgagtgacttgt

SEQ ID NO: 487354 - DNA, 20 bp, Artificial
  CRISPR gRNA sequence
aagctggtgagtgacttgtt

SEQ ID NO: 487355 - DNA, 20 bp, Artificial
  CRISPR gRNA sequence
ggtgagtgacttgttaggca

SEQ ID NO: 487356 - DNA, 20 bp, Artificial
  CRISPR gRNA sequence
gtgagtgacttgttaggcac

SEQ ID NO: 487357 - DNA, 20 bp, Artificial
  CRISPR gRNA sequence
tgagtgacttgttaggcaca

SEQ ID NO: 487358 - DNA, 20 bp, Artificial
  CRISPR gRNA sequence
agtgacttgttaggcacagg

SEQ ID NO: 487359 - DNA, 20 bp, Artificial
  CRISPR gRNA sequence
gtgacttgttaggcacaggg

SEQ ID NO: 487360 - DNA, 20 bp, Artificial
  CRISPR gRNA sequence
tgacttgttaggcacaggga

SEQ ID NO: 487361 - DNA, 20 bp, Artificial
  CRISPR gRNA sequence
ttgttaggcacagggaggga

SEQ ID NO: 487362 - DNA, 20 bp, Artificial
  CRISPR gRNA sequence
ggcacagggagggatggact

SEQ ID NO: 487363 - DNA, 20 bp, Artificial
  CRISPR gRNA sequence
gcacagggagggatggactt

SEQ ID NO: 487364 - DNA, 20 bp, Artificial
  CRISPR gRNA sequence
ggatggacttgggtcttcct

SEQ ID NO: 487365 - DNA, 20 bp, Artificial
  CRISPR gRNA sequence
cctcctccatcctgtgtcta

SEQ ID NO: 487366 - DNA, 20 bp, Artificial
  CRISPR gRNA sequence
ctcctccatcctgtgtctat

SEQ ID NO: 487367 - DNA, 20 bp, Artificial
  CRISPR gRNA sequence
tcctccatcctgtgtctata

SEQ ID NO: 487368 - DNA, 20 bp, Artificial
  CRISPR gRNA sequence
tccatcctgtgtctataggg

SEQ ID NO: 487369 - DNA, 20 bp, Artificial
  CRISPR gRNA sequence
ccatcctgtgtctatagggc

SEQ ID NO: 487370 - DNA, 20 bp, Artificial
  CRISPR gRNA sequence
ctgtgtctatagggcaggcc

SEQ ID NO: 487371 - DNA, 20 bp, Artificial
  CRISPR gRNA sequence
ctatagggcaggcctggcat

SEQ ID NO: 487372 - DNA, 20 bp, Artificial
  CRISPR gRNA sequence
ggcctggcataagttgactg

SEQ ID NO: 487373 - DNA, 20 bp, Artificial
  CRISPR gRNA sequence
gctctatttctttaattttt

SEQ ID NO: 487374 - DNA, 20 bp, Artificial
  CRISPR gRNA sequence
tctttaatttttaagctttt

SEQ ID NO: 487375 - DNA, 20 bp, Artificial
  CRISPR gRNA sequence
tttagtttgaaataattgtg

SEQ ID NO: 487376 - DNA, 20 bp, Artificial
  CRISPR gRNA sequence
ttgaaataattgtgaagttc

SEQ ID NO: 487377 - DNA, 20 bp, Artificial
  CRISPR gRNA sequence
tgaaataattgtgaagttcc

SEQ ID NO: 487378 - DNA, 20 bp, Artificial
  CRISPR gRNA sequence
gaaataattgtgaagttcca

SEQ ID NO: 487379 - DNA, 20 bp, Artificial
  CRISPR gRNA sequence
ataattgtgaagttccaggg

SEQ ID NO: 487380 - DNA, 20 bp, Artificial
  CRISPR gRNA sequence
tgaagttccagggaagctgc

SEQ ID NO: 487381 - DNA, 20 bp, Artificial
  CRISPR gRNA sequence
ttccagggaagctgcaagaa

SEQ ID NO: 487382 - DNA, 20 bp, Artificial
  CRISPR gRNA sequence
attcttgaatttctttcatc

SEQ ID NO: 487383 - DNA, 20 bp, Artificial
  CRISPR gRNA sequence
ttactttatttctctttctc

SEQ ID NO: 487384 - DNA, 20 bp, Artificial
  CRISPR gRNA sequence
taatttttgctgaaccactt

SEQ ID NO: 487385 - DNA, 20 bp, Artificial
  CRISPR gRNA sequence
ttgctgaaccacttgagaac

SEQ ID NO: 487386 - DNA, 20 bp, Artificial
  CRISPR gRNA sequence
ccccttactcctaaatattt

SEQ ID NO: 487387 - DNA, 20 bp, Artificial
  CRISPR gRNA sequence
gcacttatatcctatgaaca

SEQ ID NO: 487388 - DNA, 20 bp, Artificial
  CRISPR gRNA sequence
aagacattctcatgttacta

SEQ ID NO: 487389 - DNA, 20 bp, Artificial
  CRISPR gRNA sequence
tacagcacaattgtcaaatt

SEQ ID NO: 487390 - DNA, 20 bp, Artificial
  CRISPR gRNA sequence
cacatattaccaattgtccc

SEQ ID NO: 487391 - DNA, 20 bp, Artificial
  CRISPR gRNA sequence
ttttttttttttgctgaccc

SEQ ID NO: 487392 - DNA, 20 bp, Artificial
  CRISPR gRNA sequence
tgctgacccaagatgcaatc

SEQ ID NO: 487393 - DNA, 20 bp, Artificial
  CRISPR gRNA sequence
tcaagatcatgtattacatt

SEQ ID NO: 487394 - DNA, 20 bp, Artificial
  CRISPR gRNA sequence
gttgttatgtttctcatgtt

SEQ ID NO: 487395 - DNA, 20 bp, Artificial
  CRISPR gRNA sequence
ttcatgatattgcattcttg

SEQ ID NO: 487396 - DNA, 20 bp, Artificial
  CRISPR gRNA sequence
atgatattgcattcttgaag

SEQ ID NO: 487397 - DNA, 20 bp, Artificial
  CRISPR gRNA sequence
attgcattcttgaagaagac

SEQ ID NO: 487398 - DNA, 20 bp, Artificial
  CRISPR gRNA sequence
cattcttgaagaagacaagc

SEQ ID NO: 487399 - DNA, 20 bp, Artificial
  CRISPR gRNA sequence
aagacaagccagttgttttg

SEQ ID NO: 487400 - DNA, 20 bp, Artificial
  CRISPR gRNA sequence
gacaagccagttgttttgta

SEQ ID NO: 487401 - DNA, 20 bp, Artificial
  CRISPR gRNA sequence
acaagccagttgttttgtag

SEQ ID NO: 487402 - DNA, 20 bp, Artificial
  CRISPR gRNA sequence
caagccagttgttttgtaga

SEQ ID NO: 487403 - DNA, 20 bp, Artificial
  CRISPR gRNA sequence
ttgtagagggttccttaatc

SEQ ID NO: 487404 - DNA, 20 bp, Artificial
  CRISPR gRNA sequence
tgtagagggttccttaatct

SEQ ID NO: 487405 - DNA, 20 bp, Artificial
  CRISPR gRNA sequence
tgatgttccctcatatgatt

SEQ ID NO: 487406 - DNA, 20 bp, Artificial
  CRISPR gRNA sequence
gatgttccctcatatgattc

SEQ ID NO: 487407 - DNA, 20 bp, Artificial
  CRISPR gRNA sequence
tcatcattattattattttt

SEQ ID NO: 487408 - DNA, 20 bp, Artificial
  CRISPR gRNA sequence
atcattattattatttttta

SEQ ID NO: 487409 - DNA, 20 bp, Artificial
  CRISPR gRNA sequence
ttattattattttttagaga

SEQ ID NO: 487410 - DNA, 20 bp, Artificial
  CRISPR gRNA sequence
attattattttttagagatg

SEQ ID NO: 487411 - DNA, 20 bp, Artificial
  CRISPR gRNA sequence
agagatggagtctcgctctg

SEQ ID NO: 487412 - DNA, 20 bp, Artificial
  CRISPR gRNA sequence
tggagtctcgctctgtggcc

SEQ ID NO: 487413 - DNA, 20 bp, Artificial
  CRISPR gRNA sequence
ggagtctcgctctgtggcct

SEQ ID NO: 487414 - DNA, 20 bp, Artificial
  CRISPR gRNA sequence
tctcgctctgtggcctgggc

SEQ ID NO: 487415 - DNA, 20 bp, Artificial
  CRISPR gRNA sequence
tcgctctgtggcctgggctg

SEQ ID NO: 487416 - DNA, 20 bp, Artificial
  CRISPR gRNA sequence
ctgtggcctgggctggagta

SEQ ID NO: 487417 - DNA, 20 bp, Artificial
  CRISPR gRNA sequence
tggcctgggctggagtacag

SEQ ID NO: 487418 - DNA, 20 bp, Artificial
  CRISPR gRNA sequence
ggagtacagtggtccaatct

SEQ ID NO: 487419 - DNA, 20 bp, Artificial
  CRISPR gRNA sequence
cactgcaacttctgctcccc

SEQ ID NO: 487420 - DNA, 20 bp, Artificial
  CRISPR gRNA sequence
actgcaacttctgctccccc

SEQ ID NO: 487421 - DNA, 20 bp, Artificial
  CRISPR gRNA sequence
acttctgctcccccgggttc

SEQ ID NO: 487422 - DNA, 20 bp, Artificial
  CRISPR gRNA sequence
ttcaagtgattgtcctgcct

SEQ ID NO: 487423 - DNA, 20 bp, Artificial
  CRISPR gRNA sequence
ttgtcctgcctcagcctccc

SEQ ID NO: 487424 - DNA, 20 bp, Artificial
  CRISPR gRNA sequence
tcctgcctcagcctcccgag

SEQ ID NO: 487425 - DNA, 20 bp, Artificial
  CRISPR gRNA sequence
gcctcagcctcccgagtagc

SEQ ID NO: 487426 - DNA, 20 bp, Artificial
  CRISPR gRNA sequence
cctcagcctcccgagtagct

SEQ ID NO: 487427 - DNA, 20 bp, Artificial
  CRISPR gRNA sequence
ctcccgagtagctgggacta

SEQ ID NO: 487428 - DNA, 20 bp, Artificial
  CRISPR gRNA sequence
gactacagatgcatgccacc

SEQ ID NO: 487429 - DNA, 20 bp, Artificial
  CRISPR gRNA sequence
cagatgcatgccaccaagcc

SEQ ID NO: 487430 - DNA, 20 bp, Artificial
  CRISPR gRNA sequence
ctggctaatttttgtatttt

SEQ ID NO: 487431 - DNA, 20 bp, Artificial
  CRISPR gRNA sequence
gctaatttttgtatttttgg

SEQ ID NO: 487432 - DNA, 20 bp, Artificial
  CRISPR gRNA sequence
taatttttgtatttttggtg

SEQ ID NO: 487433 - DNA, 20 bp, Artificial
  CRISPR gRNA sequence
ttttgtatttttggtggaga

SEQ ID NO: 487434 - DNA, 20 bp, Artificial
  CRISPR gRNA sequence
tttgtatttttggtggagac

SEQ ID NO: 487435 - DNA, 20 bp, Artificial
  CRISPR gRNA sequence
ttgtatttttggtggagaca

SEQ ID NO: 487436 - DNA, 20 bp, Artificial
  CRISPR gRNA sequence
gagacagggtttcaccatgt

SEQ ID NO: 487437 - DNA, 20 bp, Artificial
  CRISPR gRNA sequence
cagggtttcaccatgttggc

SEQ ID NO: 487438 - DNA, 20 bp, Artificial
  CRISPR gRNA sequence
agggtttcaccatgttggcc

SEQ ID NO: 487439 - DNA, 20 bp, Artificial
  CRISPR gRNA sequence
tttcaccatgttggccaggc

SEQ ID NO: 487440 - DNA, 20 bp, Artificial
  CRISPR gRNA sequence
ggtcttaaactcctgacctc

SEQ ID NO: 487441 - DNA, 20 bp, Artificial
  CRISPR gRNA sequence
cacccacctccgcctctcaa

SEQ ID NO: 487442 - DNA, 20 bp, Artificial
  CRISPR gRNA sequence
cctccgcctctcaaaagtgc

SEQ ID NO: 487443 - DNA, 20 bp, Artificial
  CRISPR gRNA sequence
ctccgcctctcaaaagtgct

SEQ ID NO: 487444 - DNA, 20 bp, Artificial
  CRISPR gRNA sequence
tctcaaaagtgctgggatac

SEQ ID NO: 487445 - DNA, 20 bp, Artificial
  CRISPR gRNA sequence
ctcaaaagtgctgggatacc

SEQ ID NO: 487446 - DNA, 20 bp, Artificial
  CRISPR gRNA sequence
agtgctgggataccaggtgt

SEQ ID NO: 487447 - DNA, 20 bp, Artificial
  CRISPR gRNA sequence
caggtgtgagccactgtgcc

SEQ ID NO: 487448 - DNA, 20 bp, Artificial
  CRISPR gRNA sequence
ccggcctattattatttttc

SEQ ID NO: 487449 - DNA, 20 bp, Artificial
  CRISPR gRNA sequence
ggcctattattatttttcaa

SEQ ID NO: 487450 - DNA, 20 bp, Artificial
  CRISPR gRNA sequence
cctattattatttttcaaga

SEQ ID NO: 487451 - DNA, 20 bp, Artificial
  CRISPR gRNA sequence
ctattattatttttcaagag

SEQ ID NO: 487452 - DNA, 20 bp, Artificial
  CRISPR gRNA sequence
ttatttttcaagagaggatc

SEQ ID NO: 487453 - DNA, 20 bp, Artificial
  CRISPR gRNA sequence
gaggatctggttctttcacc

SEQ ID NO: 487454 - DNA, 20 bp, Artificial
  CRISPR gRNA sequence
tctggttctttcacccagac

SEQ ID NO: 487455 - DNA, 20 bp, Artificial
  CRISPR gRNA sequence
tggttctttcacccagactg

SEQ ID NO: 487456 - DNA, 20 bp, Artificial
  CRISPR gRNA sequence
ctttcacccagactggagtg

SEQ ID NO: 487457 - DNA, 20 bp, Artificial
  CRISPR gRNA sequence
tcacccagactggagtgcag

SEQ ID NO: 487458 - DNA, 20 bp, Artificial
  CRISPR gRNA sequence
ggagtgcagtggcatgctca

SEQ ID NO: 487459 - DNA, 20 bp, Artificial
  CRISPR gRNA sequence
ggcatgctcacggctcactg

SEQ ID NO: 487460 - DNA, 20 bp, Artificial
  CRISPR gRNA sequence
tcactgtagcctcgacctcg

SEQ ID NO: 487461 - DNA, 20 bp, Artificial
  CRISPR gRNA sequence
cactgtagcctcgacctcgc

SEQ ID NO: 487462 - DNA, 20 bp, Artificial
  CRISPR gRNA sequence
agcctcgacctcgcaggctc

SEQ ID NO: 487463 - DNA, 20 bp, Artificial
  CRISPR gRNA sequence
ctcaagccatcctcccacct

SEQ ID NO: 487464 - DNA, 20 bp, Artificial
  CRISPR gRNA sequence
tcctcccacctcagcctccc

SEQ ID NO: 487465 - DNA, 20 bp, Artificial
  CRISPR gRNA sequence
tcccacctcagcctccctgg

SEQ ID NO: 487466 - DNA, 20 bp, Artificial
  CRISPR gRNA sequence
acctcagcctccctggtagc

SEQ ID NO: 487467 - DNA, 20 bp, Artificial
  CRISPR gRNA sequence
gcctccctggtagctggaac

SEQ ID NO: 487468 - DNA, 20 bp, Artificial
  CRISPR gRNA sequence
ctccctggtagctggaacta

SEQ ID NO: 487469 - DNA, 20 bp, Artificial
  CRISPR gRNA sequence
tccctggtagctggaactag

SEQ ID NO: 487470 - DNA, 20 bp, Artificial
  CRISPR gRNA sequence
gaggtctgtgccaccatgcc

SEQ ID NO: 487471 - DNA, 20 bp, Artificial
  CRISPR gRNA sequence
aatttttttttttttttttg

SEQ ID NO: 487472 - DNA, 20 bp, Artificial
  CRISPR gRNA sequence
tttttttttttttgtagata

SEQ ID NO: 487473 - DNA, 20 bp, Artificial
  CRISPR gRNA sequence
ttttttttttttgtagatac

SEQ ID NO: 487474 - DNA, 20 bp, Artificial
  CRISPR gRNA sequence
tttttttttttgtagataca

SEQ ID NO: 487475 - DNA, 20 bp, Artificial
  CRISPR gRNA sequence
cagggtttccccatgttgcc

SEQ ID NO: 487476 - DNA, 20 bp, Artificial
  CRISPR gRNA sequence
agggtttccccatgttgccc

SEQ ID NO: 487477 - DNA, 20 bp, Artificial
  CRISPR gRNA sequence
gggtttccccatgttgccca

SEQ ID NO: 487478 - DNA, 20 bp, Artificial
  CRISPR gRNA sequence
tttccccatgttgcccaggg

SEQ ID NO: 487479 - DNA, 20 bp, Artificial
  CRISPR gRNA sequence
ccagggtggtcttgaactcc

SEQ ID NO: 487480 - DNA, 20 bp, Artificial
  CRISPR gRNA sequence
cagggtggtcttgaactccc

SEQ ID NO: 487481 - DNA, 20 bp, Artificial
  CRISPR gRNA sequence
tggtcttgaactcccgggct

SEQ ID NO: 487482 - DNA, 20 bp, Artificial
  CRISPR gRNA sequence
ggtcttgaactcccgggctc

SEQ ID NO: 487483 - DNA, 20 bp, Artificial
  CRISPR gRNA sequence
ctcaggcgatccacctgcct

SEQ ID NO: 487484 - DNA, 20 bp, Artificial
  CRISPR gRNA sequence
ccacctgcctcagtctccca

SEQ ID NO: 487485 - DNA, 20 bp, Artificial
  CRISPR gRNA sequence
cctgcctcagtctcccaaag

SEQ ID NO: 487486 - DNA, 20 bp, Artificial
  CRISPR gRNA sequence
gcctcagtctcccaaagtgg

SEQ ID NO: 487487 - DNA, 20 bp, Artificial
  CRISPR gRNA sequence
cctcagtctcccaaagtggt

SEQ ID NO: 487488 - DNA, 20 bp, Artificial
  CRISPR gRNA sequence
tcccaaagtggtgggactac

SEQ ID NO: 487489 - DNA, 20 bp, Artificial
  CRISPR gRNA sequence
agtggtgggactacaagtgt

SEQ ID NO: 487490 - DNA, 20 bp, Artificial
  CRISPR gRNA sequence
caagtgtgagccatcatgcc

SEQ ID NO: 487491 - DNA, 20 bp, Artificial
  CRISPR gRNA sequence
tttttttctgtgcccattga

SEQ ID NO: 487492 - DNA, 20 bp, Artificial
  CRISPR gRNA sequence
ttttctgtgcccattgacag

SEQ ID NO: 487493 - DNA, 20 bp, Artificial
  CRISPR gRNA sequence
gatattatatgcatttttga

SEQ ID NO: 487494 - DNA, 20 bp, Artificial
  CRISPR gRNA sequence
atattatatgcatttttgac

SEQ ID NO: 487495 - DNA, 20 bp, Artificial
  CRISPR gRNA sequence
ttttgacaggaataccacaa

SEQ ID NO: 487496 - DNA, 20 bp, Artificial
  CRISPR gRNA sequence
aagtgatactgtgtcttttt

SEQ ID NO: 487497 - DNA, 20 bp, Artificial
  CRISPR gRNA sequence
tctttttcagcgcatcccat

SEQ ID NO: 487498 - DNA, 20 bp, Artificial
  CRISPR gRNA sequence
ctttttcagcgcatcccatc

SEQ ID NO: 487499 - DNA, 20 bp, Artificial
  CRISPR gRNA sequence
ttttcagcgcatcccatcag

SEQ ID NO: 487500 - DNA, 20 bp, Artificial
  CRISPR gRNA sequence
catcaggagtcatatgatga

SEQ ID NO: 487501 - DNA, 20 bp, Artificial
  CRISPR gRNA sequence
ttgtttactgaataatttaa

SEQ ID NO: 487502 - DNA, 20 bp, Artificial
  CRISPR gRNA sequence
tgtttactgaataatttaac

SEQ ID NO: 487503 - DNA, 20 bp, Artificial
  CRISPR gRNA sequence
tttactgaataatttaacag

SEQ ID NO: 487504 - DNA, 20 bp, Artificial
  CRISPR gRNA sequence
aacaggagtactatttatgt

SEQ ID NO: 487505 - DNA, 20 bp, Artificial
  CRISPR gRNA sequence
aagatgtgcatataactctt

SEQ ID NO: 487506 - DNA, 20 bp, Artificial
  CRISPR gRNA sequence
agcattgcgaaattcttcca

SEQ ID NO: 487507 - DNA, 20 bp, Artificial
  CRISPR gRNA sequence
caaagacttcttctttcatg

SEQ ID NO: 487508 - DNA, 20 bp, Artificial
  CRISPR gRNA sequence
aagacttcttctttcatgca

SEQ ID NO: 487509 - DNA, 20 bp, Artificial
  CRISPR gRNA sequence
tcttctttcatgcagagtaa

SEQ ID NO: 487510 - DNA, 20 bp, Artificial
  CRISPR gRNA sequence
aaaagccatgcattttacaa

SEQ ID NO: 487511 - DNA, 20 bp, Artificial
  CRISPR gRNA sequence
ttttacaatggtgcgtgacc

SEQ ID NO: 487512 - DNA, 20 bp, Artificial
  CRISPR gRNA sequence
tggtgcgtgacctggcgtcc

SEQ ID NO: 487513 - DNA, 20 bp, Artificial
  CRISPR gRNA sequence
tttgtctctcctcttgctca

SEQ ID NO: 487514 - DNA, 20 bp, Artificial
  CRISPR gRNA sequence
tcctcttgctcacagcattt

SEQ ID NO: 487515 - DNA, 20 bp, Artificial
  CRISPR gRNA sequence
atttcagccatgttgcctgc

SEQ ID NO: 487516 - DNA, 20 bp, Artificial
  CRISPR gRNA sequence
gccatgttgcctgctggtcc

SEQ ID NO: 487517 - DNA, 20 bp, Artificial
  CRISPR gRNA sequence
ctcgctctctgttgtatcca

SEQ ID NO: 487518 - DNA, 20 bp, Artificial
  CRISPR gRNA sequence
tatccacagttttctctgcc

SEQ ID NO: 487519 - DNA, 20 bp, Artificial
  CRISPR gRNA sequence
atccacagttttctctgcct

SEQ ID NO: 487520 - DNA, 20 bp, Artificial
  CRISPR gRNA sequence
ctgggatgctgctcctttgc

SEQ ID NO: 487521 - DNA, 20 bp, Artificial
  CRISPR gRNA sequence
ctgctcctttgctggctaca

SEQ ID NO: 487522 - DNA, 20 bp, Artificial
  CRISPR gRNA sequence
ggcctcttccctcaacccct

SEQ ID NO: 487523 - DNA, 20 bp, Artificial
  CRISPR gRNA sequence
cctcttccctcaacccctca

SEQ ID NO: 487524 - DNA, 20 bp, Artificial
  CRISPR gRNA sequence
ttgctcaaatacctcctttt

SEQ ID NO: 487525 - DNA, 20 bp, Artificial
  CRISPR gRNA sequence
gccttccccactgaaaatgt

SEQ ID NO: 487526 - DNA, 20 bp, Artificial
  CRISPR gRNA sequence
cctgccattctgcaaactct

SEQ ID NO: 487527 - DNA, 20 bp, Artificial
  CRISPR gRNA sequence
ctccacttaatttttctcca

SEQ ID NO: 487528 - DNA, 20 bp, Artificial
  CRISPR gRNA sequence
gtttttcattttctgtctcc

SEQ ID NO: 487529 - DNA, 20 bp, Artificial
  CRISPR gRNA sequence
ctgtctcccagtctcctctt

SEQ ID NO: 487530 - DNA, 20 bp, Artificial
  CRISPR gRNA sequence
cagtctcctcttcagccccc

SEQ ID NO: 487531 - DNA, 20 bp, Artificial
  CRISPR gRNA sequence
tcttcagccccctagactgt

SEQ ID NO: 487532 - DNA, 20 bp, Artificial
  CRISPR gRNA sequence
ccctagactgtaagatcctt

SEQ ID NO: 487533 - DNA, 20 bp, Artificial
  CRISPR gRNA sequence
cctagactgtaagatccttg

SEQ ID NO: 487534 - DNA, 20 bp, Artificial
  CRISPR gRNA sequence
gactgtaagatccttgaggc

SEQ ID NO: 487535 - DNA, 20 bp, Artificial
  CRISPR gRNA sequence
actgtaagatccttgaggcc

SEQ ID NO: 487536 - DNA, 20 bp, Artificial
  CRISPR gRNA sequence
ctgtaagatccttgaggcca

SEQ ID NO: 487537 - DNA, 20 bp, Artificial
  CRISPR gRNA sequence
accgttgtctcctcaacatc

SEQ ID NO: 487538 - DNA, 20 bp, Artificial
  CRISPR gRNA sequence
cgttgtctcctcaacatcta

SEQ ID NO: 487539 - DNA, 20 bp, Artificial
  CRISPR gRNA sequence
tgtctcctcaacatctagag

SEQ ID NO: 487540 - DNA, 20 bp, Artificial
  CRISPR gRNA sequence
tctagagcagtacctgccac

SEQ ID NO: 487541 - DNA, 20 bp, Artificial
  CRISPR gRNA sequence
acctgccacaagtcaaccct

SEQ ID NO: 487542 - DNA, 20 bp, Artificial
  CRISPR gRNA sequence
tgccacaagtcaaccctcag

SEQ ID NO: 487543 - DNA, 20 bp, Artificial
  CRISPR gRNA sequence
gtagatacttattttcacaa

SEQ ID NO: 487544 - DNA, 20 bp, Artificial
  CRISPR gRNA sequence
gatacttattttcacaatag

SEQ ID NO: 487545 - DNA, 20 bp, Artificial
  CRISPR gRNA sequence
ctctgttcccattctttctc

SEQ ID NO: 487546 - DNA, 20 bp, Artificial
  CRISPR gRNA sequence
ttctctggatatattttgaa

SEQ ID NO: 487547 - DNA, 20 bp, Artificial
  CRISPR gRNA sequence
tattttgaatagctctgaac

SEQ ID NO: 487548 - DNA, 20 bp, Artificial
  CRISPR gRNA sequence
attttgaatagctctgaacc

SEQ ID NO: 487549 - DNA, 20 bp, Artificial
  CRISPR gRNA sequence
ttttgaatagctctgaacca

SEQ ID NO: 487550 - DNA, 20 bp, Artificial
  CRISPR gRNA sequence
agctctgaaccagggctatt

SEQ ID NO: 487551 - DNA, 20 bp, Artificial
  CRISPR gRNA sequence
gctctgaaccagggctattg

SEQ ID NO: 487552 - DNA, 20 bp, Artificial
  CRISPR gRNA sequence
aaccagggctattgaggatt

SEQ ID NO: 487553 - DNA, 20 bp, Artificial
  CRISPR gRNA sequence
cagggctattgaggattcag

SEQ ID NO: 487554 - DNA, 20 bp, Artificial
  CRISPR gRNA sequence
gctattgaggattcagtggc

SEQ ID NO: 487555 - DNA, 20 bp, Artificial
  CRISPR gRNA sequence
ttgaggattcagtggcaagt

SEQ ID NO: 487556 - DNA, 20 bp, Artificial
  CRISPR gRNA sequence
gattcagtggcaagtaagtc

SEQ ID NO: 487557 - DNA, 20 bp, Artificial
  CRISPR gRNA sequence
attcagtggcaagtaagtcc

SEQ ID NO: 487558 - DNA, 20 bp, Artificial
  CRISPR gRNA sequence
ttcagtggcaagtaagtcca

SEQ ID NO: 487559 - DNA, 20 bp, Artificial
  CRISPR gRNA sequence
aagtccagggcccgtttgtt

SEQ ID NO: 487560 - DNA, 20 bp, Artificial
  CRISPR gRNA sequence
gtccagggcccgtttgttca

SEQ ID NO: 487561 - DNA, 20 bp, Artificial
  CRISPR gRNA sequence
ccagggcccgtttgttcaga

SEQ ID NO: 487562 - DNA, 20 bp, Artificial
  CRISPR gRNA sequence
tttgttcagagagcttgcgc

SEQ ID NO: 487563 - DNA, 20 bp, Artificial
  CRISPR gRNA sequence
gagcttgcgctagattgcct

SEQ ID NO: 487564 - DNA, 20 bp, Artificial
  CRISPR gRNA sequence
tgcctgagtcactgttacta

SEQ ID NO: 487565 - DNA, 20 bp, Artificial
  CRISPR gRNA sequence
actgttactacagttgtgat

SEQ ID NO: 487566 - DNA, 20 bp, Artificial
  CRISPR gRNA sequence
ctacagttgtgattagtgcc

SEQ ID NO: 487567 - DNA, 20 bp, Artificial
  CRISPR gRNA sequence
gttgtgattagtgcctggtg

SEQ ID NO: 487568 - DNA, 20 bp, Artificial
  CRISPR gRNA sequence
tgcctggtgcagtgccaatg

SEQ ID NO: 487569 - DNA, 20 bp, Artificial
  CRISPR gRNA sequence
ctggtgcagtgccaatgcag

SEQ ID NO: 487570 - DNA, 20 bp, Artificial
  CRISPR gRNA sequence
tggtgcagtgccaatgcagt

SEQ ID NO: 487571 - DNA, 20 bp, Artificial
  CRISPR gRNA sequence
gtgttcaaaacatgtttgtt

SEQ ID NO: 487572 - DNA, 20 bp, Artificial
  CRISPR gRNA sequence
aacatgtttgttgagtgaat

SEQ ID NO: 487573 - DNA, 20 bp, Artificial
  CRISPR gRNA sequence
gtgaataagtgaattatttt

SEQ ID NO: 487574 - DNA, 20 bp, Artificial
  CRISPR gRNA sequence
tgaataagtgaattattttc

SEQ ID NO: 487575 - DNA, 20 bp, Artificial
  CRISPR gRNA sequence
attattttcaggcatcttaa

SEQ ID NO: 487576 - DNA, 20 bp, Artificial
  CRISPR gRNA sequence
ttattttcaggcatcttaac

SEQ ID NO: 487577 - DNA, 20 bp, Artificial
  CRISPR gRNA sequence
ttttcaggcatcttaacggg

SEQ ID NO: 487578 - DNA, 20 bp, Artificial
  CRISPR gRNA sequence
aggcatcttaacgggcagcc

SEQ ID NO: 487579 - DNA, 20 bp, Artificial
  CRISPR gRNA sequence
ggcatcttaacgggcagcct

SEQ ID NO: 487580 - DNA, 20 bp, Artificial
  CRISPR gRNA sequence
gggcagcctgggatgttttt

SEQ ID NO: 487581 - DNA, 20 bp, Artificial
  CRISPR gRNA sequence
ggcagcctgggatgtttttt

SEQ ID NO: 487582 - DNA, 20 bp, Artificial
  CRISPR gRNA sequence
gcctgggatgttttttgggt

SEQ ID NO: 487583 - DNA, 20 bp, Artificial
  CRISPR gRNA sequence
gttttttgggttagacatat

SEQ ID NO: 487584 - DNA, 20 bp, Artificial
  CRISPR gRNA sequence
ttttttgggttagacatatt

SEQ ID NO: 487585 - DNA, 20 bp, Artificial
  CRISPR gRNA sequence
tttgggttagacatattggg

SEQ ID NO: 487586 - DNA, 20 bp, Artificial
  CRISPR gRNA sequence
ttgggttagacatattggga

SEQ ID NO: 487587 - DNA, 20 bp, Artificial
  CRISPR gRNA sequence
gggttagacatattgggaag

SEQ ID NO: 487588 - DNA, 20 bp, Artificial
  CRISPR gRNA sequence
ggttagacatattgggaagg

SEQ ID NO: 487589 - DNA, 20 bp, Artificial
  CRISPR gRNA sequence
gttagacatattgggaagga

SEQ ID NO: 487590 - DNA, 20 bp, Artificial
  CRISPR gRNA sequence
gggatcttcaaatcattgcc

SEQ ID NO: 487591 - DNA, 20 bp, Artificial
  CRISPR gRNA sequence
ggatcttcaaatcattgccc

SEQ ID NO: 487592 - DNA, 20 bp, Artificial
  CRISPR gRNA sequence
gatcttcaaatcattgccca

SEQ ID NO: 487593 - DNA, 20 bp, Artificial
  CRISPR gRNA sequence
tcaaatcattgcccagggaa

SEQ ID NO: 487594 - DNA, 20 bp, Artificial
  CRISPR gRNA sequence
caaatcattgcccagggaat

SEQ ID NO: 487595 - DNA, 20 bp, Artificial
  CRISPR gRNA sequence
cattgcccagggaataggcc

SEQ ID NO: 487596 - DNA, 20 bp, Artificial
  CRISPR gRNA sequence
attgcccagggaataggcct

SEQ ID NO: 487597 - DNA, 20 bp, Artificial
  CRISPR gRNA sequence
ctgggccctaaaattcattt

SEQ ID NO: 487598 - DNA, 20 bp, Artificial
  CRISPR gRNA sequence
ttcattttagacccaaaatt

SEQ ID NO: 487599 - DNA, 20 bp, Artificial
  CRISPR gRNA sequence
tcattttagacccaaaattc

SEQ ID NO: 487600 - DNA, 20 bp, Artificial
  CRISPR gRNA sequence
tagacccaaaattcaggttt

SEQ ID NO: 487601 - DNA, 20 bp, Artificial
  CRISPR gRNA sequence
aggtttcagttgtccgttct

SEQ ID NO: 487602 - DNA, 20 bp, Artificial
  CRISPR gRNA sequence
ggtttcagttgtccgttctg

SEQ ID NO: 487603 - DNA, 20 bp, Artificial
  CRISPR gRNA sequence
tccgttctgaggaaacccca

SEQ ID NO: 487604 - DNA, 20 bp, Artificial
  CRISPR gRNA sequence
ccgttctgaggaaaccccaa

SEQ ID NO: 487605 - DNA, 20 bp, Artificial
  CRISPR gRNA sequence
aggaaaccccaaaggacaca

SEQ ID NO: 487606 - DNA, 20 bp, Artificial
  CRISPR gRNA sequence
ggaaaccccaaaggacacac

SEQ ID NO: 487607 - DNA, 20 bp, Artificial
  CRISPR gRNA sequence
accccaaaggacacacaggc

SEQ ID NO: 487608 - DNA, 20 bp, Artificial
  CRISPR gRNA sequence
cccaaaggacacacaggctg

SEQ ID NO: 487609 - DNA, 20 bp, Artificial
  CRISPR gRNA sequence
ccaaaggacacacaggctgg

SEQ ID NO: 487610 - DNA, 20 bp, Artificial
  CRISPR gRNA sequence
ggctggaggctatgaatccc

SEQ ID NO: 487611 - DNA, 20 bp, Artificial
  CRISPR gRNA sequence
atgaatccccagatgcttta

SEQ ID NO: 487612 - DNA, 20 bp, Artificial
  CRISPR gRNA sequence
ccccagatgctttacagcct

SEQ ID NO: 487613 - DNA, 20 bp, Artificial
  CRISPR gRNA sequence
gatgctttacagcctgagtt

SEQ ID NO: 487614 - DNA, 20 bp, Artificial
  CRISPR gRNA sequence
cagcctgagttgagatctgc

SEQ ID NO: 487615 - DNA, 20 bp, Artificial
  CRISPR gRNA sequence
tgagatctgctggacaataa

SEQ ID NO: 487616 - DNA, 20 bp, Artificial
  CRISPR gRNA sequence
gagatctgctggacaataaa

SEQ ID NO: 487617 - DNA, 20 bp, Artificial
  CRISPR gRNA sequence
agatctgctggacaataaaa

SEQ ID NO: 487618 - DNA, 20 bp, Artificial
  CRISPR gRNA sequence
tgctggacaataaaagggca

SEQ ID NO: 487619 - DNA, 20 bp, Artificial
  CRISPR gRNA sequence
gctggacaataaaagggcac

SEQ ID NO: 487620 - DNA, 20 bp, Artificial
  CRISPR gRNA sequence
agggcacaggtgacacctta

SEQ ID NO: 487621 - DNA, 20 bp, Artificial
  CRISPR gRNA sequence
acaggtgacaccttatagat

SEQ ID NO: 487622 - DNA, 20 bp, Artificial
  CRISPR gRNA sequence
acaccttatagattagctcc

SEQ ID NO: 487623 - DNA, 20 bp, Artificial
  CRISPR gRNA sequence
caccttatagattagctcca

SEQ ID NO: 487624 - DNA, 20 bp, Artificial
  CRISPR gRNA sequence
accttatagattagctccaa

SEQ ID NO: 487625 - DNA, 20 bp, Artificial
  CRISPR gRNA sequence
agattagctccaagggttgc

SEQ ID NO: 487626 - DNA, 20 bp, Artificial
  CRISPR gRNA sequence
agggttgccagctgtttgcg

SEQ ID NO: 487627 - DNA, 20 bp, Artificial
  CRISPR gRNA sequence
gctgtttgcgtagattgtgt

SEQ ID NO: 487628 - DNA, 20 bp, Artificial
  CRISPR gRNA sequence
gtgttggaactgtcacttct

SEQ ID NO: 487629 - DNA, 20 bp, Artificial
  CRISPR gRNA sequence
tgttggaactgtcacttctc

SEQ ID NO: 487630 - DNA, 20 bp, Artificial
  CRISPR gRNA sequence
gttggaactgtcacttctca

SEQ ID NO: 487631 - DNA, 20 bp, Artificial
  CRISPR gRNA sequence
tggaactgtcacttctcagg

SEQ ID NO: 487632 - DNA, 20 bp, Artificial
  CRISPR gRNA sequence
aactgtcacttctcagggag

SEQ ID NO: 487633 - DNA, 20 bp, Artificial
  CRISPR gRNA sequence
gtgtctaactgcgactgctt

SEQ ID NO: 487634 - DNA, 20 bp, Artificial
  CRISPR gRNA sequence
ctaactgcgactgctttggc

SEQ ID NO: 487635 - DNA, 20 bp, Artificial
  CRISPR gRNA sequence
taactgcgactgctttggct

SEQ ID NO: 487636 - DNA, 20 bp, Artificial
  CRISPR gRNA sequence
cgactgctttggctgggatc

SEQ ID NO: 487637 - DNA, 20 bp, Artificial
  CRISPR gRNA sequence
gactgctttggctgggatcc

SEQ ID NO: 487638 - DNA, 20 bp, Artificial
  CRISPR gRNA sequence
gctttggctgggatccaggc

SEQ ID NO: 487639 - DNA, 20 bp, Artificial
  CRISPR gRNA sequence
gctgggatccaggcaagctg

SEQ ID NO: 487640 - DNA, 20 bp, Artificial
  CRISPR gRNA sequence
gggatccaggcaagctgtag

SEQ ID NO: 487641 - DNA, 20 bp, Artificial
  CRISPR gRNA sequence
ggatccaggcaagctgtaga

SEQ ID NO: 487642 - DNA, 20 bp, Artificial
  CRISPR gRNA sequence
gatccaggcaagctgtagaa

SEQ ID NO: 487643 - DNA, 20 bp, Artificial
  CRISPR gRNA sequence
caggcaagctgtagaagggc

SEQ ID NO: 487644 - DNA, 20 bp, Artificial
  CRISPR gRNA sequence
ggcaagctgtagaagggctg

SEQ ID NO: 487645 - DNA, 20 bp, Artificial
  CRISPR gRNA sequence
attgcacctcccctccaaca

SEQ ID NO: 487646 - DNA, 20 bp, Artificial
  CRISPR gRNA sequence
ttgcacctcccctccaacaa

SEQ ID NO: 487647 - DNA, 20 bp, Artificial
  CRISPR gRNA sequence
tgcacctcccctccaacaaa

SEQ ID NO: 487648 - DNA, 20 bp, Artificial
  CRISPR gRNA sequence
cccctccaacaaagggtgaa

SEQ ID NO: 487649 - DNA, 20 bp, Artificial
  CRISPR gRNA sequence
ccaacaaagggtgaatggca

SEQ ID NO: 487650 - DNA, 20 bp, Artificial
  CRISPR gRNA sequence
acaaagggtgaatggcaaag

SEQ ID NO: 487651 - DNA, 20 bp, Artificial
  CRISPR gRNA sequence
agggtgaatggcaaagtagc

SEQ ID NO: 487652 - DNA, 20 bp, Artificial
  CRISPR gRNA sequence
aatggcaaagtagctggaca

SEQ ID NO: 487653 - DNA, 20 bp, Artificial
  CRISPR gRNA sequence
caaagtagctggacacagaa

SEQ ID NO: 487654 - DNA, 20 bp, Artificial
  CRISPR gRNA sequence
aagtagctggacacagaaaa

SEQ ID NO: 487655 - DNA, 20 bp, Artificial
  CRISPR gRNA sequence
gctggacacagaaaagagat

SEQ ID NO: 487656 - DNA, 20 bp, Artificial
  CRISPR gRNA sequence
gattggaattcaatgtaccc

SEQ ID NO: 487657 - DNA, 20 bp, Artificial
  CRISPR gRNA sequence
attggaattcaatgtaccct

SEQ ID NO: 487658 - DNA, 20 bp, Artificial
  CRISPR gRNA sequence
attcaatgtaccctgggcta

SEQ ID NO: 487659 - DNA, 20 bp, Artificial
  CRISPR gRNA sequence
ccctgggctacagcaccatc

SEQ ID NO: 487660 - DNA, 20 bp, Artificial
  CRISPR gRNA sequence
gggctacagcaccatccaga

SEQ ID NO: 487661 - DNA, 20 bp, Artificial
  CRISPR gRNA sequence
ggctacagcaccatccagaa

SEQ ID NO: 487662 - DNA, 20 bp, Artificial
  CRISPR gRNA sequence
gaatccactgaaatcacttc

SEQ ID NO: 487663 - DNA, 20 bp, Artificial
  CRISPR gRNA sequence
aatccactgaaatcacttca

SEQ ID NO: 487664 - DNA, 20 bp, Artificial
  CRISPR gRNA sequence
tccactgaaatcacttcaag

SEQ ID NO: 487665 - DNA, 20 bp, Artificial
  CRISPR gRNA sequence
cactgaaatcacttcaagga

SEQ ID NO: 487666 - DNA, 20 bp, Artificial
  CRISPR gRNA sequence
gaaatcacttcaaggagaga

SEQ ID NO: 487667 - DNA, 20 bp, Artificial
  CRISPR gRNA sequence
aaatcacttcaaggagagac

SEQ ID NO: 487668 - DNA, 20 bp, Artificial
  CRISPR gRNA sequence
aatcacttcaaggagagaca

SEQ ID NO: 487669 - DNA, 20 bp, Artificial
  CRISPR gRNA sequence
atttatttttatttttttgt

SEQ ID NO: 487670 - DNA, 20 bp, Artificial
  CRISPR gRNA sequence
atttttatttttttgtgaga

SEQ ID NO: 487671 - DNA, 20 bp, Artificial
  CRISPR gRNA sequence
tttttatttttttgtgagac

SEQ ID NO: 487672 - DNA, 20 bp, Artificial
  CRISPR gRNA sequence
ttttatttttttgtgagaca

SEQ ID NO: 487673 - DNA, 20 bp, Artificial
  CRISPR gRNA sequence
cagggtcttgctctatcacc

SEQ ID NO: 487674 - DNA, 20 bp, Artificial
  CRISPR gRNA sequence
agggtcttgctctatcaccc

SEQ ID NO: 487675 - DNA, 20 bp, Artificial
  CRISPR gRNA sequence
tcttgctctatcacccaggc

SEQ ID NO: 487676 - DNA, 20 bp, Artificial
  CRISPR gRNA sequence
ttgctctatcacccaggctg

SEQ ID NO: 487677 - DNA, 20 bp, Artificial
  CRISPR gRNA sequence
ctatcacccaggctggagtg

SEQ ID NO: 487678 - DNA, 20 bp, Artificial
  CRISPR gRNA sequence
ggagtgcagtgatgtgatca

SEQ ID NO: 487679 - DNA, 20 bp, Artificial
  CRISPR gRNA sequence
gatgtgatcacagctcactg

SEQ ID NO: 487680 - DNA, 20 bp, Artificial
  CRISPR gRNA sequence
tcactgtagccttgacctcc

SEQ ID NO: 487681 - DNA, 20 bp, Artificial
  CRISPR gRNA sequence
cactgtagccttgacctcct

SEQ ID NO: 487682 - DNA, 20 bp, Artificial
  CRISPR gRNA sequence
agccttgacctcctgggctc

SEQ ID NO: 487683 - DNA, 20 bp, Artificial
  CRISPR gRNA sequence
ctcaagcaatccttctgcct

SEQ ID NO: 487684 - DNA, 20 bp, Artificial
  CRISPR gRNA sequence
tccttctgcctcagcctcct

SEQ ID NO: 487685 - DNA, 20 bp, Artificial
  CRISPR gRNA sequence
ttctgcctcagcctccttag

SEQ ID NO: 487686 - DNA, 20 bp, Artificial
  CRISPR gRNA sequence
gcctcagcctccttagtagc

SEQ ID NO: 487687 - DNA, 20 bp, Artificial
  CRISPR gRNA sequence
cctcagcctccttagtagct

SEQ ID NO: 487688 - DNA, 20 bp, Artificial
  CRISPR gRNA sequence
ctccttagtagctgggacta

SEQ ID NO: 487689 - DNA, 20 bp, Artificial
  CRISPR gRNA sequence
tccttagtagctgggactac

SEQ ID NO: 487690 - DNA, 20 bp, Artificial
  CRISPR gRNA sequence
caggcatgtatcaccacact

SEQ ID NO: 487691 - DNA, 20 bp, Artificial
  CRISPR gRNA sequence
gcttatttttaatttttgtg

SEQ ID NO: 487692 - DNA, 20 bp, Artificial
  CRISPR gRNA sequence
ttatttttaatttttgtgta

SEQ ID NO: 487693 - DNA, 20 bp, Artificial
  CRISPR gRNA sequence
ttttaatttttgtgtagaga

SEQ ID NO: 487694 - DNA, 20 bp, Artificial
  CRISPR gRNA sequence
tttaatttttgtgtagagat

SEQ ID NO: 487695 - DNA, 20 bp, Artificial
  CRISPR gRNA sequence
ttaatttttgtgtagagatg

SEQ ID NO: 487696 - DNA, 20 bp, Artificial
  CRISPR gRNA sequence
tggggttttgctatgctgcc

SEQ ID NO: 487697 - DNA, 20 bp, Artificial
  CRISPR gRNA sequence
ggggttttgctatgctgcct

SEQ ID NO: 487698 - DNA, 20 bp, Artificial
  CRISPR gRNA sequence
ttttgctatgctgcctgggc

SEQ ID NO: 487699 - DNA, 20 bp, Artificial
  CRISPR gRNA sequence
ctgggctggtcttgacctcc

SEQ ID NO: 487700 - DNA, 20 bp, Artificial
  CRISPR gRNA sequence
tgggctggtcttgacctcct

SEQ ID NO: 487701 - DNA, 20 bp, Artificial
  CRISPR gRNA sequence
ggtcttgacctcctgggctc

SEQ ID NO: 487702 - DNA, 20 bp, Artificial
  CRISPR gRNA sequence
ctcaagcaatcctcttgcct

SEQ ID NO: 487703 - DNA, 20 bp, Artificial
  CRISPR gRNA sequence
gccttggcctcccaaattac

SEQ ID NO: 487704 - DNA, 20 bp, Artificial
  CRISPR gRNA sequence
ccttggcctcccaaattact

SEQ ID NO: 487705 - DNA, 20 bp, Artificial
  CRISPR gRNA sequence
ctcccaaattactgggatta

SEQ ID NO: 487706 - DNA, 20 bp, Artificial
  CRISPR gRNA sequence
aattactgggattacagatg

SEQ ID NO: 487707 - DNA, 20 bp, Artificial
  CRISPR gRNA sequence
attactgggattacagatgt

SEQ ID NO: 487708 - DNA, 20 bp, Artificial
  CRISPR gRNA sequence
cagatgtgggccactgtgcc

SEQ ID NO: 487709 - DNA, 20 bp, Artificial
  CRISPR gRNA sequence
tgtgggccactgtgcccagc

SEQ ID NO: 487710 - DNA, 20 bp, Artificial
  CRISPR gRNA sequence
gtgggccactgtgcccagcc

SEQ ID NO: 487711 - DNA, 20 bp, Artificial
  CRISPR gRNA sequence
cagccaggccattgtcttca

SEQ ID NO: 487712 - DNA, 20 bp, Artificial
  CRISPR gRNA sequence
cagacaaacctctcttattg

SEQ ID NO: 487713 - DNA, 20 bp, Artificial
  CRISPR gRNA sequence
tcttattgaagtgcaacata

SEQ ID NO: 487714 - DNA, 20 bp, Artificial
  CRISPR gRNA sequence
ttgaagtgcaacatacagaa

SEQ ID NO: 487715 - DNA, 20 bp, Artificial
  CRISPR gRNA sequence
ttacaaatgtacatctcaat

SEQ ID NO: 487716 - DNA, 20 bp, Artificial
  CRISPR gRNA sequence
tcctctgtcttccataaata

SEQ ID NO: 487717 - DNA, 20 bp, Artificial
  CRISPR gRNA sequence
aattctgacttctaacatca

SEQ ID NO: 487718 - DNA, 20 bp, Artificial
  CRISPR gRNA sequence
atttgttttgtccgtatata

SEQ ID NO: 487719 - DNA, 20 bp, Artificial
  CRISPR gRNA sequence
tccgtatatatggaatcaaa

SEQ ID NO: 487720 - DNA, 20 bp, Artificial
  CRISPR gRNA sequence
acttttgctcaacatcttat

SEQ ID NO: 487721 - DNA, 20 bp, Artificial
  CRISPR gRNA sequence
tttatgtatgttattatttg

SEQ ID NO: 487722 - DNA, 20 bp, Artificial
  CRISPR gRNA sequence
atgtatgttattatttgtag

SEQ ID NO: 487723 - DNA, 20 bp, Artificial
  CRISPR gRNA sequence
tttgtagcagatcattttca

SEQ ID NO: 487724 - DNA, 20 bp, Artificial
  CRISPR gRNA sequence
agatcattttcatggctgta

SEQ ID NO: 487725 - DNA, 20 bp, Artificial
  CRISPR gRNA sequence
tttatcgcatgactatatca

SEQ ID NO: 487726 - DNA, 20 bp, Artificial
  CRISPR gRNA sequence
ttctattattgatgaacctt

SEQ ID NO: 487727 - DNA, 20 bp, Artificial
  CRISPR gRNA sequence
tctattattgatgaaccttt

SEQ ID NO: 487728 - DNA, 20 bp, Artificial
  CRISPR gRNA sequence
tattataataatgctgtgat

SEQ ID NO: 487729 - DNA, 20 bp, Artificial
  CRISPR gRNA sequence
ttttgtgcatgcatgtctgt

SEQ ID NO: 487730 - DNA, 20 bp, Artificial
  CRISPR gRNA sequence
tttgtgcatgcatgtctgtt

SEQ ID NO: 487731 - DNA, 20 bp, Artificial
  CRISPR gRNA sequence
atgtctgttgggtatatctc

SEQ ID NO: 487732 - DNA, 20 bp, Artificial
  CRISPR gRNA sequence
tgtctgttgggtatatctct

SEQ ID NO: 487733 - DNA, 20 bp, Artificial
  CRISPR gRNA sequence
gtctgttgggtatatctcta

SEQ ID NO: 487734 - DNA, 20 bp, Artificial
  CRISPR gRNA sequence
tctgttgggtatatctctag

SEQ ID NO: 487735 - DNA, 20 bp, Artificial
  CRISPR gRNA sequence
gttgggtatatctctagggg

SEQ ID NO: 487736 - DNA, 20 bp, Artificial
  CRISPR gRNA sequence
tatctctaggggcagaacca

SEQ ID NO: 487737 - DNA, 20 bp, Artificial
  CRISPR gRNA sequence
tctctaggggcagaaccatg

SEQ ID NO: 487738 - DNA, 20 bp, Artificial
  CRISPR gRNA sequence
ggagtatgtgtacgtaactc

SEQ ID NO: 487739 - DNA, 20 bp, Artificial
  CRISPR gRNA sequence
gtatgtgtacgtaactctag

SEQ ID NO: 487740 - DNA, 20 bp, Artificial
  CRISPR gRNA sequence
tgctgtcaaactgttttcca

SEQ ID NO: 487741 - DNA, 20 bp, Artificial
  CRISPR gRNA sequence
tgtcaaactgttttccaaag

SEQ ID NO: 487742 - DNA, 20 bp, Artificial
  CRISPR gRNA sequence
tccaaagtggttgaaccaaa

SEQ ID NO: 487743 - DNA, 20 bp, Artificial
  CRISPR gRNA sequence
ggttgaaccaaatagtgcat

SEQ ID NO: 487744 - DNA, 20 bp, Artificial
  CRISPR gRNA sequence
ttgaaccaaatagtgcatga

SEQ ID NO: 487745 - DNA, 20 bp, Artificial
  CRISPR gRNA sequence
atgagagttccatgctgctt

SEQ ID NO: 487746 - DNA, 20 bp, Artificial
  CRISPR gRNA sequence
tgagagttccatgctgcttt

SEQ ID NO: 487747 - DNA, 20 bp, Artificial
  CRISPR gRNA sequence
gagagttccatgctgctttg

SEQ ID NO: 487748 - DNA, 20 bp, Artificial
  CRISPR gRNA sequence
ccatgctgctttggggccac

SEQ ID NO: 487749 - DNA, 20 bp, Artificial
  CRISPR gRNA sequence
gctttggggccactggcttt

SEQ ID NO: 487750 - DNA, 20 bp, Artificial
  CRISPR gRNA sequence
gccactggcttttggttctg

SEQ ID NO: 487751 - DNA, 20 bp, Artificial
  CRISPR gRNA sequence
ccactggcttttggttctga

SEQ ID NO: 487752 - DNA, 20 bp, Artificial
  CRISPR gRNA sequence
cttttggttctgaaggtctg

SEQ ID NO: 487753 - DNA, 20 bp, Artificial
  CRISPR gRNA sequence
tggttctgaaggtctgcaga

SEQ ID NO: 487754 - DNA, 20 bp, Artificial
  CRISPR gRNA sequence
gcagatggaaaattaaattg

SEQ ID NO: 487755 - DNA, 20 bp, Artificial
  CRISPR gRNA sequence
aaaattaaattgtggaaatg

SEQ ID NO: 487756 - DNA, 20 bp, Artificial
  CRISPR gRNA sequence
aattaaattgtggaaatgtg

SEQ ID NO: 487757 - DNA, 20 bp, Artificial
  CRISPR gRNA sequence
aattgtggaaatgtggagct

SEQ ID NO: 487758 - DNA, 20 bp, Artificial
  CRISPR gRNA sequence
gtggaaatgtggagcttggc

SEQ ID NO: 487759 - DNA, 20 bp, Artificial
  CRISPR gRNA sequence
ggaaatgtggagcttggcaa

SEQ ID NO: 487760 - DNA, 20 bp, Artificial
  CRISPR gRNA sequence
gaaatgtggagcttggcaag

SEQ ID NO: 487761 - DNA, 20 bp, Artificial
  CRISPR gRNA sequence
tggagcttggcaagaggcca

SEQ ID NO: 487762 - DNA, 20 bp, Artificial
  CRISPR gRNA sequence
ggagcttggcaagaggccaa

SEQ ID NO: 487763 - DNA, 20 bp, Artificial
  CRISPR gRNA sequence
cttggcaagaggccaaaggc

SEQ ID NO: 487764 - DNA, 20 bp, Artificial
  CRISPR gRNA sequence
ttggcaagaggccaaaggca

SEQ ID NO: 487765 - DNA, 20 bp, Artificial
  CRISPR gRNA sequence
tggcaagaggccaaaggcaa

SEQ ID NO: 487766 - DNA, 20 bp, Artificial
  CRISPR gRNA sequence
ggccaaaggcaagggaatta

SEQ ID NO: 487767 - DNA, 20 bp, Artificial
  CRISPR gRNA sequence
ttacagctctgtgatttctc

SEQ ID NO: 487768 - DNA, 20 bp, Artificial
  CRISPR gRNA sequence
cctgcatgaaattctgacaa

SEQ ID NO: 487769 - DNA, 20 bp, Artificial
  CRISPR gRNA sequence
tgcatgaaattctgacaata

SEQ ID NO: 487770 - DNA, 20 bp, Artificial
  CRISPR gRNA sequence
tctgacaatagagtcatttt

SEQ ID NO: 487771 - DNA, 20 bp, Artificial
  CRISPR gRNA sequence
ctgacaatagagtcattttt

SEQ ID NO: 487772 - DNA, 20 bp, Artificial
  CRISPR gRNA sequence
gacaatagagtcatttttag

SEQ ID NO: 487773 - DNA, 20 bp, Artificial
  CRISPR gRNA sequence
gtcatttttaggagttatgt

SEQ ID NO: 487774 - DNA, 20 bp, Artificial
  CRISPR gRNA sequence
gttgaattaattaatttaaa

SEQ ID NO: 487775 - DNA, 20 bp, Artificial
  CRISPR gRNA sequence
ttaatttaaacggattcatg

SEQ ID NO: 487776 - DNA, 20 bp, Artificial
  CRISPR gRNA sequence
ggattcatgaagcccttgct

SEQ ID NO: 487777 - DNA, 20 bp, Artificial
  CRISPR gRNA sequence
gattcatgaagcccttgctt

SEQ ID NO: 487778 - DNA, 20 bp, Artificial
  CRISPR gRNA sequence
ttcttgtctattctgcatat

SEQ ID NO: 487779 - DNA, 20 bp, Artificial
  CRISPR gRNA sequence
ttctgcatattagttgcctg

SEQ ID NO: 487780 - DNA, 20 bp, Artificial
  CRISPR gRNA sequence
tctgcatattagttgcctgt

SEQ ID NO: 487781 - DNA, 20 bp, Artificial
  CRISPR gRNA sequence
ttagttgcctgtaggattca

SEQ ID NO: 487782 - DNA, 20 bp, Artificial
  CRISPR gRNA sequence
aattttttttcctattctat

SEQ ID NO: 487783 - DNA, 20 bp, Artificial
  CRISPR gRNA sequence
tactgtacatgatttttttt

SEQ ID NO: 487784 - DNA, 20 bp, Artificial
  CRISPR gRNA sequence
cttctgttgcctgtgctttt

SEQ ID NO: 487785 - DNA, 20 bp, Artificial
  CRISPR gRNA sequence
ttctgttgcctgtgcttttg

SEQ ID NO: 487786 - DNA, 20 bp, Artificial
  CRISPR gRNA sequence
ttattcataaactctttccc

SEQ ID NO: 487787 - DNA, 20 bp, Artificial
  CRISPR gRNA sequence
cccagcccttattatgctcc

SEQ ID NO: 487788 - DNA, 20 bp, Artificial
  CRISPR gRNA sequence
ttatgctccaagaactatgc

SEQ ID NO: 487789 - DNA, 20 bp, Artificial
  CRISPR gRNA sequence
tatgctccaagaactatgca

SEQ ID NO: 487790 - DNA, 20 bp, Artificial
  CRISPR gRNA sequence
aagaactatgcaaggttttg

SEQ ID NO: 487791 - DNA, 20 bp, Artificial
  CRISPR gRNA sequence
agaactatgcaaggttttgt

SEQ ID NO: 487792 - DNA, 20 bp, Artificial
  CRISPR gRNA sequence
gaactatgcaaggttttgtg

SEQ ID NO: 487793 - DNA, 20 bp, Artificial
  CRISPR gRNA sequence
aactatgcaaggttttgtgg

SEQ ID NO: 487794 - DNA, 20 bp, Artificial
  CRISPR gRNA sequence
aaggttttgtgggggaaaca

SEQ ID NO: 487795 - DNA, 20 bp, Artificial
  CRISPR gRNA sequence
tgggggaaacaaagatgaaa

SEQ ID NO: 487796 - DNA, 20 bp, Artificial
  CRISPR gRNA sequence
cagatgtctattctaccctt

SEQ ID NO: 487797 - DNA, 20 bp, Artificial
  CRISPR gRNA sequence
ttctacccttaagaatcttt

SEQ ID NO: 487798 - DNA, 20 bp, Artificial
  CRISPR gRNA sequence
acccttaagaatctttcaga

SEQ ID NO: 487799 - DNA, 20 bp, Artificial
  CRISPR gRNA sequence
ccttaagaatctttcagaca

SEQ ID NO: 487800 - DNA, 20 bp, Artificial
  CRISPR gRNA sequence
cttaagaatctttcagacag

SEQ ID NO: 487801 - DNA, 20 bp, Artificial
  CRISPR gRNA sequence
atctttcagacagaggaaaa

SEQ ID NO: 487802 - DNA, 20 bp, Artificial
  CRISPR gRNA sequence
tctttcagacagaggaaaat

SEQ ID NO: 487803 - DNA, 20 bp, Artificial
  CRISPR gRNA sequence
gtatgtataattacaactat

SEQ ID NO: 487804 - DNA, 20 bp, Artificial
  CRISPR gRNA sequence
tatgtataattacaactata

SEQ ID NO: 487805 - DNA, 20 bp, Artificial
  CRISPR gRNA sequence
atgtataattacaactataa

SEQ ID NO: 487806 - DNA, 20 bp, Artificial
  CRISPR gRNA sequence
tataattacaactataaggg

SEQ ID NO: 487807 - DNA, 20 bp, Artificial
  CRISPR gRNA sequence
attacaactataagggaaga

SEQ ID NO: 487808 - DNA, 20 bp, Artificial
  CRISPR gRNA sequence
gaaatgctatgtgtcattaa

SEQ ID NO: 487809 - DNA, 20 bp, Artificial
  CRISPR gRNA sequence
aaatgctatgtgtcattaac

SEQ ID NO: 487810 - DNA, 20 bp, Artificial
  CRISPR gRNA sequence
gctatgtgtcattaacaggc

SEQ ID NO: 487811 - DNA, 20 bp, Artificial
  CRISPR gRNA sequence
attaacaggcaagatacatt

SEQ ID NO: 487812 - DNA, 20 bp, Artificial
  CRISPR gRNA sequence
aagatacatttagaataaaa

SEQ ID NO: 487813 - DNA, 20 bp, Artificial
  CRISPR gRNA sequence
agatacatttagaataaaaa

SEQ ID NO: 487814 - DNA, 20 bp, Artificial
  CRISPR gRNA sequence
atacatttagaataaaaaag

SEQ ID NO: 487815 - DNA, 20 bp, Artificial
  CRISPR gRNA sequence
tttagaataaaaaaggagct

SEQ ID NO: 487816 - DNA, 20 bp, Artificial
  CRISPR gRNA sequence
agaataaaaaaggagctaag

SEQ ID NO: 487817 - DNA, 20 bp, Artificial
  CRISPR gRNA sequence
aaaaaggagctaagaagatg

SEQ ID NO: 487818 - DNA, 20 bp, Artificial
  CRISPR gRNA sequence
aagaagatgaagattccttc

SEQ ID NO: 487819 - DNA, 20 bp, Artificial
  CRISPR gRNA sequence
agaagatgaagattccttct

SEQ ID NO: 487820 - DNA, 20 bp, Artificial
  CRISPR gRNA sequence
agatgaagattccttctagg

SEQ ID NO: 487821 - DNA, 20 bp, Artificial
  CRISPR gRNA sequence
gatgaagattccttctaggt

SEQ ID NO: 487822 - DNA, 20 bp, Artificial
  CRISPR gRNA sequence
ttccttctaggtaggaacac

SEQ ID NO: 487823 - DNA, 20 bp, Artificial
  CRISPR gRNA sequence
tccttctaggtaggaacact

SEQ ID NO: 487824 - DNA, 20 bp, Artificial
  CRISPR gRNA sequence
ccttctaggtaggaacactg

SEQ ID NO: 487825 - DNA, 20 bp, Artificial
  CRISPR gRNA sequence
aggtaggaacactggggaac

SEQ ID NO: 487826 - DNA, 20 bp, Artificial
  CRISPR gRNA sequence
acactggggaactggccttg

SEQ ID NO: 487827 - DNA, 20 bp, Artificial
  CRISPR gRNA sequence
actggccttgaagaataaat

SEQ ID NO: 487828 - DNA, 20 bp, Artificial
  CRISPR gRNA sequence
tggccttgaagaataaataa

SEQ ID NO: 487829 - DNA, 20 bp, Artificial
  CRISPR gRNA sequence
ttgaagaataaataagagtt

SEQ ID NO: 487830 - DNA, 20 bp, Artificial
  CRISPR gRNA sequence
tgaagaataaataagagttt

SEQ ID NO: 487831 - DNA, 20 bp, Artificial
  CRISPR gRNA sequence
aagaataaataagagtttag

SEQ ID NO: 487832 - DNA, 20 bp, Artificial
  CRISPR gRNA sequence
agaataaataagagtttagg

SEQ ID NO: 487833 - DNA, 20 bp, Artificial
  CRISPR gRNA sequence
ataaataagagtttaggagg

SEQ ID NO: 487834 - DNA, 20 bp, Artificial
  CRISPR gRNA sequence
taaataagagtttaggaggt

SEQ ID NO: 487835 - DNA, 20 bp, Artificial
  CRISPR gRNA sequence
gagtttaggaggtaggtaca

SEQ ID NO: 487836 - DNA, 20 bp, Artificial
  CRISPR gRNA sequence
tttaggaggtaggtacaaag

SEQ ID NO: 487837 - DNA, 20 bp, Artificial
  CRISPR gRNA sequence
aggaggtaggtacaaagtag

SEQ ID NO: 487838 - DNA, 20 bp, Artificial
  CRISPR gRNA sequence
ggaggtaggtacaaagtaga

SEQ ID NO: 487839 - DNA, 20 bp, Artificial
  CRISPR gRNA sequence
acaaagtagaaggacaattg

SEQ ID NO: 487840 - DNA, 20 bp, Artificial
  CRISPR gRNA sequence
aagtagaaggacaattgaag

SEQ ID NO: 487841 - DNA, 20 bp, Artificial
  CRISPR gRNA sequence
gtagaaggacaattgaagca

SEQ ID NO: 487842 - DNA, 20 bp, Artificial
  CRISPR gRNA sequence
tagaaggacaattgaagcag

SEQ ID NO: 487843 - DNA, 20 bp, Artificial
  CRISPR gRNA sequence
gacaattgaagcagaggaaa

SEQ ID NO: 487844 - DNA, 20 bp, Artificial
  CRISPR gRNA sequence
ttgaagcagaggaaacagct

SEQ ID NO: 487845 - DNA, 20 bp, Artificial
  CRISPR gRNA sequence
gcagaggaaacagctcagaa

SEQ ID NO: 487846 - DNA, 20 bp, Artificial
  CRISPR gRNA sequence
aggaaacagctcagaaaagc

SEQ ID NO: 487847 - DNA, 20 bp, Artificial
  CRISPR gRNA sequence
ggaaacagctcagaaaagcc

SEQ ID NO: 487848 - DNA, 20 bp, Artificial
  CRISPR gRNA sequence
gaaacagctcagaaaagcca

SEQ ID NO: 487849 - DNA, 20 bp, Artificial
  CRISPR gRNA sequence
tcagaaaagccagggttgca

SEQ ID NO: 487850 - DNA, 20 bp, Artificial
  CRISPR gRNA sequence
cagaaaagccagggttgcat

SEQ ID NO: 487851 - DNA, 20 bp, Artificial
  CRISPR gRNA sequence
agaaaagccagggttgcatg

SEQ ID NO: 487852 - DNA, 20 bp, Artificial
  CRISPR gRNA sequence
agccagggttgcatggggtt

SEQ ID NO: 487853 - DNA, 20 bp, Artificial
  CRISPR gRNA sequence
agggttgcatggggtttgga

SEQ ID NO: 487854 - DNA, 20 bp, Artificial
  CRISPR gRNA sequence
gggttgcatggggtttggat

SEQ ID NO: 487855 - DNA, 20 bp, Artificial
  CRISPR gRNA sequence
catggggtttggatgggaaa

SEQ ID NO: 487856 - DNA, 20 bp, Artificial
  CRISPR gRNA sequence
atggggtttggatgggaaac

SEQ ID NO: 487857 - DNA, 20 bp, Artificial
  CRISPR gRNA sequence
ggtttggatgggaaacagga

SEQ ID NO: 487858 - DNA, 20 bp, Artificial
  CRISPR gRNA sequence
gtttggatgggaaacaggaa

SEQ ID NO: 487859 - DNA, 20 bp, Artificial
  CRISPR gRNA sequence
tttggatgggaaacaggaaa

SEQ ID NO: 487860 - DNA, 20 bp, Artificial
  CRISPR gRNA sequence
tggatgggaaacaggaaagg

SEQ ID NO: 487861 - DNA, 20 bp, Artificial
  CRISPR gRNA sequence
gggagatgcacttgttatca

SEQ ID NO: 487862 - DNA, 20 bp, Artificial
  CRISPR gRNA sequence
gagatgcacttgttatcatg

SEQ ID NO: 487863 - DNA, 20 bp, Artificial
  CRISPR gRNA sequence
ggagaaacaatatcacatat

SEQ ID NO: 487864 - DNA, 20 bp, Artificial
  CRISPR gRNA sequence
atatcacatatgagatgatt

SEQ ID NO: 487865 - DNA, 20 bp, Artificial
  CRISPR gRNA sequence
tgatttggttaactgatgca

SEQ ID NO: 487866 - DNA, 20 bp, Artificial
  CRISPR gRNA sequence
atttggttaactgatgcaaa

SEQ ID NO: 487867 - DNA, 20 bp, Artificial
  CRISPR gRNA sequence
tggttaactgatgcaaagag

SEQ ID NO: 487868 - DNA, 20 bp, Artificial
  CRISPR gRNA sequence
ggttaactgatgcaaagagt

SEQ ID NO: 487869 - DNA, 20 bp, Artificial
  CRISPR gRNA sequence
ctgatgcaaagagtgggact

SEQ ID NO: 487870 - DNA, 20 bp, Artificial
  CRISPR gRNA sequence
tgatgcaaagagtgggactt

SEQ ID NO: 487871 - DNA, 20 bp, Artificial
  CRISPR gRNA sequence
gcaaagagtgggacttgggc

SEQ ID NO: 487872 - DNA, 20 bp, Artificial
  CRISPR gRNA sequence
caaagagtgggacttgggct

SEQ ID NO: 487873 - DNA, 20 bp, Artificial
  CRISPR gRNA sequence
gagtgggacttgggctaggt

SEQ ID NO: 487874 - DNA, 20 bp, Artificial
  CRISPR gRNA sequence
ttgggctaggtgagttttga

SEQ ID NO: 487875 - DNA, 20 bp, Artificial
  CRISPR gRNA sequence
gggctaggtgagttttgaca

SEQ ID NO: 487876 - DNA, 20 bp, Artificial
  CRISPR gRNA sequence
ggctaggtgagttttgacag

SEQ ID NO: 487877 - DNA, 20 bp, Artificial
  CRISPR gRNA sequence
aggtgagttttgacagaggt

SEQ ID NO: 487878 - DNA, 20 bp, Artificial
  CRISPR gRNA sequence
ggtgagttttgacagaggta

SEQ ID NO: 487879 - DNA, 20 bp, Artificial
  CRISPR gRNA sequence
gtgagttttgacagaggtaa

SEQ ID NO: 487880 - DNA, 20 bp, Artificial
  CRISPR gRNA sequence
gagttttgacagaggtaagg

SEQ ID NO: 487881 - DNA, 20 bp, Artificial
  CRISPR gRNA sequence
gtaagggagttgcattgcct

SEQ ID NO: 487882 - DNA, 20 bp, Artificial
  CRISPR gRNA sequence
taagggagttgcattgcctg

SEQ ID NO: 487883 - DNA, 20 bp, Artificial
  CRISPR gRNA sequence
gggagttgcattgcctgagg

SEQ ID NO: 487884 - DNA, 20 bp, Artificial
  CRISPR gRNA sequence
gagttgcattgcctgaggaa

SEQ ID NO: 487885 - DNA, 20 bp, Artificial
  CRISPR gRNA sequence
gttgcattgcctgaggaaga

SEQ ID NO: 487886 - DNA, 20 bp, Artificial
  CRISPR gRNA sequence
cctgaggaagagagttaata

SEQ ID NO: 487887 - DNA, 20 bp, Artificial
  CRISPR gRNA sequence
aggaagagagttaatatggt

SEQ ID NO: 487888 - DNA, 20 bp, Artificial
  CRISPR gRNA sequence
gagttaatatggtcagtatg

SEQ ID NO: 487889 - DNA, 20 bp, Artificial
  CRISPR gRNA sequence
atggtcagtatgaagctaaa

SEQ ID NO: 487890 - DNA, 20 bp, Artificial
  CRISPR gRNA sequence
ggtcagtatgaagctaaata

SEQ ID NO: 487891 - DNA, 20 bp, Artificial
  CRISPR gRNA sequence
tcagtatgaagctaaataga

SEQ ID NO: 487892 - DNA, 20 bp, Artificial
  CRISPR gRNA sequence
cagtatgaagctaaatagag

SEQ ID NO: 487893 - DNA, 20 bp, Artificial
  CRISPR gRNA sequence
tatgaagctaaatagagagg

SEQ ID NO: 487894 - DNA, 20 bp, Artificial
  CRISPR gRNA sequence
aagctaaatagagaggaaga

SEQ ID NO: 487895 - DNA, 20 bp, Artificial
  CRISPR gRNA sequence
aatagagaggaagaaagaaa

SEQ ID NO: 487896 - DNA, 20 bp, Artificial
  CRISPR gRNA sequence
atagagaggaagaaagaaat

SEQ ID NO: 487897 - DNA, 20 bp, Artificial
  CRISPR gRNA sequence
aggaagaaagaaatgggatg

SEQ ID NO: 487898 - DNA, 20 bp, Artificial
  CRISPR gRNA sequence
ggaagaaagaaatgggatgt

SEQ ID NO: 487899 - DNA, 20 bp, Artificial
  CRISPR gRNA sequence
gaaatgggatgtgggcccta

SEQ ID NO: 487900 - DNA, 20 bp, Artificial
  CRISPR gRNA sequence
aaatgggatgtgggccctat

SEQ ID NO: 487901 - DNA, 20 bp, Artificial
  CRISPR gRNA sequence
tcttatgattttgccctgac

SEQ ID NO: 487902 - DNA, 20 bp, Artificial
  CRISPR gRNA sequence
ttatgattttgccctgacta

SEQ ID NO: 487903 - DNA, 20 bp, Artificial
  CRISPR gRNA sequence
gattttgccctgactagagc

SEQ ID NO: 487904 - DNA, 20 bp, Artificial
  CRISPR gRNA sequence
tgactagagctggattgccc

SEQ ID NO: 487905 - DNA, 20 bp, Artificial
  CRISPR gRNA sequence
ctggattgccccagtacttt

SEQ ID NO: 487906 - DNA, 20 bp, Artificial
  CRISPR gRNA sequence
cagtacttttggaatctcac

SEQ ID NO: 487907 - DNA, 20 bp, Artificial
  CRISPR gRNA sequence
ctcactggactctgttcact

SEQ ID NO: 487908 - DNA, 20 bp, Artificial
  CRISPR gRNA sequence
gactctgttcacttagtccc

SEQ ID NO: 487909 - DNA, 20 bp, Artificial
  CRISPR gRNA sequence
tctgttcacttagtccccag

SEQ ID NO: 487910 - DNA, 20 bp, Artificial
  CRISPR gRNA sequence
ctgttcacttagtccccagc

SEQ ID NO: 487911 - DNA, 20 bp, Artificial
  CRISPR gRNA sequence
tcttttgatgccttcacccc

SEQ ID NO: 487912 - DNA, 20 bp, Artificial
  CRISPR gRNA sequence
tgatgccttcaccccaagcc

SEQ ID NO: 487913 - DNA, 20 bp, Artificial
  CRISPR gRNA sequence
tgccttcaccccaagcctgg

SEQ ID NO: 487914 - DNA, 20 bp, Artificial
  CRISPR gRNA sequence
caccccaagcctggtagcac

SEQ ID NO: 487915 - DNA, 20 bp, Artificial
  CRISPR gRNA sequence
aagcctggtagcacaagccc

SEQ ID NO: 487916 - DNA, 20 bp, Artificial
  CRISPR gRNA sequence
tggtagcacaagccctagct

SEQ ID NO: 487917 - DNA, 20 bp, Artificial
  CRISPR gRNA sequence
aaaccttaacatctatttgt

SEQ ID NO: 487918 - DNA, 20 bp, Artificial
  CRISPR gRNA sequence
cttaacatctatttgttggc

SEQ ID NO: 487919 - DNA, 20 bp, Artificial
  CRISPR gRNA sequence
aacatctatttgttggctgg

SEQ ID NO: 487920 - DNA, 20 bp, Artificial
  CRISPR gRNA sequence
gtggaaattccacttgctct

SEQ ID NO: 487921 - DNA, 20 bp, Artificial
  CRISPR gRNA sequence
ccctcccgtgctccttctcc

SEQ ID NO: 487922 - DNA, 20 bp, Artificial
  CRISPR gRNA sequence
cctcccgtgctccttctccc

SEQ ID NO: 487923 - DNA, 20 bp, Artificial
  CRISPR gRNA sequence
tgctccttctcccaggtgct

SEQ ID NO: 487924 - DNA, 20 bp, Artificial
  CRISPR gRNA sequence
gctccttctcccaggtgctc

SEQ ID NO: 487925 - DNA, 20 bp, Artificial
  CRISPR gRNA sequence
gccccacaccttcctccgac

SEQ ID NO: 487926 - DNA, 20 bp, Artificial
  CRISPR gRNA sequence
ccacaccttcctccgactgg

SEQ ID NO: 487927 - DNA, 20 bp, Artificial
  CRISPR gRNA sequence
cacaccttcctccgactggc

SEQ ID NO: 487928 - DNA, 20 bp, Artificial
  CRISPR gRNA sequence
cttcctccgactggcaggtc

SEQ ID NO: 487929 - DNA, 20 bp, Artificial
  CRISPR gRNA sequence
ttcctccgactggcaggtcc

SEQ ID NO: 487930 - DNA, 20 bp, Artificial
  CRISPR gRNA sequence
tccgactggcaggtccaggt

SEQ ID NO: 487931 - DNA, 20 bp, Artificial
  CRISPR gRNA sequence
cgactggcaggtccaggttg

SEQ ID NO: 487932 - DNA, 20 bp, Artificial
  CRISPR gRNA sequence
gactggcaggtccaggttgg

SEQ ID NO: 487933 - DNA, 20 bp, Artificial
  CRISPR gRNA sequence
tggcaggtccaggttggagg

SEQ ID NO: 487934 - DNA, 20 bp, Artificial
  CRISPR gRNA sequence
ggtccaggttggaggaagct

SEQ ID NO: 487935 - DNA, 20 bp, Artificial
  CRISPR gRNA sequence
tggaggaagctgagctgact

SEQ ID NO: 487936 - DNA, 20 bp, Artificial
  CRISPR gRNA sequence
gaggaagctgagctgactca

SEQ ID NO: 487937 - DNA, 20 bp, Artificial
  CRISPR gRNA sequence
ctgactcagagctctgcaca

SEQ ID NO: 487938 - DNA, 20 bp, Artificial
  CRISPR gRNA sequence
tgactcagagctctgcacat

SEQ ID NO: 487939 - DNA, 20 bp, Artificial
  CRISPR gRNA sequence
cagagctctgcacatgggct

SEQ ID NO: 487940 - DNA, 20 bp, Artificial
  CRISPR gRNA sequence
agagctctgcacatgggctc

SEQ ID NO: 487941 - DNA, 20 bp, Artificial
  CRISPR gRNA sequence
gagctctgcacatgggctca

SEQ ID NO: 487942 - DNA, 20 bp, Artificial
  CRISPR gRNA sequence
ctgcacatgggctcagggct

SEQ ID NO: 487943 - DNA, 20 bp, Artificial
  CRISPR gRNA sequence
cacatgggctcagggctgag

SEQ ID NO: 487944 - DNA, 20 bp, Artificial
  CRISPR gRNA sequence
acatgggctcagggctgagc

SEQ ID NO: 487945 - DNA, 20 bp, Artificial
  CRISPR gRNA sequence
ggctgagcgggactcactgc

SEQ ID NO: 487946 - DNA, 20 bp, Artificial
  CRISPR gRNA sequence
agcgggactcactgctggat

SEQ ID NO: 487947 - DNA, 20 bp, Artificial
  CRISPR gRNA sequence
gaccatcctctgttcttcct

SEQ ID NO: 487948 - DNA, 20 bp, Artificial
  CRISPR gRNA sequence
accatcctctgttcttcctg

SEQ ID NO: 487949 - DNA, 20 bp, Artificial
  CRISPR gRNA sequence
ctctgttcttcctgaggctg

SEQ ID NO: 487950 - DNA, 20 bp, Artificial
  CRISPR gRNA sequence
tgttcttcctgaggctgcag

SEQ ID NO: 487951 - DNA, 20 bp, Artificial
  CRISPR gRNA sequence
ttcttcctgaggctgcagtg

SEQ ID NO: 487952 - DNA, 20 bp, Artificial
  CRISPR gRNA sequence
ctgccctctgccctcccttt

SEQ ID NO: 487953 - DNA, 20 bp, Artificial
  CRISPR gRNA sequence
gccctctgccctccctttca

SEQ ID NO: 487954 - DNA, 20 bp, Artificial
  CRISPR gRNA sequence
gccctccctttcagagttac

SEQ ID NO: 487955 - DNA, 20 bp, Artificial
  CRISPR gRNA sequence
acctcatccgttcttaacca

SEQ ID NO: 487956 - DNA, 20 bp, Artificial
  CRISPR gRNA sequence
cctcatccgttcttaaccac

SEQ ID NO: 487957 - DNA, 20 bp, Artificial
  CRISPR gRNA sequence
catccgttcttaaccacagg

SEQ ID NO: 487958 - DNA, 20 bp, Artificial
  CRISPR gRNA sequence
atccgttcttaaccacagga

SEQ ID NO: 487959 - DNA, 20 bp, Artificial
  CRISPR gRNA sequence
cgttcttaaccacaggaagg

SEQ ID NO: 487960 - DNA, 20 bp, Artificial
  CRISPR gRNA sequence
ccacaggaaggtggccccca

SEQ ID NO: 487961 - DNA, 20 bp, Artificial
  CRISPR gRNA sequence
aggtggcccccaaagctgct

SEQ ID NO: 487962 - DNA, 20 bp, Artificial
  CRISPR gRNA sequence
tggcccccaaagctgctgag

SEQ ID NO: 487963 - DNA, 20 bp, Artificial
  CRISPR gRNA sequence
cccccaaagctgctgagcag

SEQ ID NO: 487964 - DNA, 20 bp, Artificial
  CRISPR gRNA sequence
aagctgctgagcagtagcaa

SEQ ID NO: 487965 - DNA, 20 bp, Artificial
  CRISPR gRNA sequence
ctgctgagcagtagcaacag

SEQ ID NO: 487966 - DNA, 20 bp, Artificial
  CRISPR gRNA sequence
ctgagcagtagcaacagcag

SEQ ID NO: 487967 - DNA, 20 bp, Artificial
  CRISPR gRNA sequence
agcagtagcaacagcagtgg

SEQ ID NO: 487968 - DNA, 20 bp, Artificial
  CRISPR gRNA sequence
gcagtagcaacagcagtggc

SEQ ID NO: 487969 - DNA, 20 bp, Artificial
  CRISPR gRNA sequence
cagtagcaacagcagtggca

SEQ ID NO: 487970 - DNA, 20 bp, Artificial
  CRISPR gRNA sequence
agtagcaacagcagtggcag

SEQ ID NO: 487971 - DNA, 20 bp, Artificial
  CRISPR gRNA sequence
caacagcagtggcaggggcc

SEQ ID NO: 487972 - DNA, 20 bp, Artificial
  CRISPR gRNA sequence
aacagcagtggcaggggccc

SEQ ID NO: 487973 - DNA, 20 bp, Artificial
  CRISPR gRNA sequence
acagcagtggcaggggcccg

SEQ ID NO: 487974 - DNA, 20 bp, Artificial
  CRISPR gRNA sequence
cagcagtggcaggggcccgg

SEQ ID NO: 487975 - DNA, 20 bp, Artificial
  CRISPR gRNA sequence
caggggcccgggggccttcc

SEQ ID NO: 487976 - DNA, 20 bp, Artificial
  CRISPR gRNA sequence
ccgggggccttcctggactg

SEQ ID NO: 487977 - DNA, 20 bp, Artificial
  CRISPR gRNA sequence
tctaaacaattttcacttgt

SEQ ID NO: 487978 - DNA, 20 bp, Artificial
  CRISPR gRNA sequence
ctaaacaattttcacttgtt

SEQ ID NO: 487979 - DNA, 20 bp, Artificial
  CRISPR gRNA sequence
ctatgcctcactaaatgtgt

SEQ ID NO: 487980 - DNA, 20 bp, Artificial
  CRISPR gRNA sequence
atgtgtgagaacttgtgttg

SEQ ID NO: 487981 - DNA, 20 bp, Artificial
  CRISPR gRNA sequence
gtgttgaagttatgttttcg

SEQ ID NO: 487982 - DNA, 20 bp, Artificial
  CRISPR gRNA sequence
ttgaagttatgttttcgtag

SEQ ID NO: 487983 - DNA, 20 bp, Artificial
  CRISPR gRNA sequence
agcatttcatctcccctatc

SEQ ID NO: 487984 - DNA, 20 bp, Artificial
  CRISPR gRNA sequence
atctggtgtgtgtacccctc

SEQ ID NO: 487985 - DNA, 20 bp, Artificial
  CRISPR gRNA sequence
tctggtgtgtgtacccctct

SEQ ID NO: 487986 - DNA, 20 bp, Artificial
  CRISPR gRNA sequence
gtgtgtgtacccctctggga

SEQ ID NO: 487987 - DNA, 20 bp, Artificial
  CRISPR gRNA sequence
acccctctgggacagaaact

SEQ ID NO: 487988 - DNA, 20 bp, Artificial
  CRISPR gRNA sequence
cccctctgggacagaaactg

SEQ ID NO: 487989 - DNA, 20 bp, Artificial
  CRISPR gRNA sequence
aaactgaggtctttctgtat

SEQ ID NO: 487990 - DNA, 20 bp, Artificial
  CRISPR gRNA sequence
ctgtatcagtcacaataccc

SEQ ID NO: 487991 - DNA, 20 bp, Artificial
  CRISPR gRNA sequence
cagtcacaataccctggaca

SEQ ID NO: 487992 - DNA, 20 bp, Artificial
  CRISPR gRNA sequence
tctgctttgcacccctgccc

SEQ ID NO: 487993 - DNA, 20 bp, Artificial
  CRISPR gRNA sequence
gccctggcacccaccccttc

SEQ ID NO: 487994 - DNA, 20 bp, Artificial
  CRISPR gRNA sequence
ccctggcacccaccccttcc

SEQ ID NO: 487995 - DNA, 20 bp, Artificial
  CRISPR gRNA sequence
caccccttccaggccgtcca

SEQ ID NO: 487996 - DNA, 20 bp, Artificial
  CRISPR gRNA sequence
catcttcctccttcccacac

SEQ ID NO: 487997 - DNA, 20 bp, Artificial
  CRISPR gRNA sequence
tccttcccacactggactgt

SEQ ID NO: 487998 - DNA, 20 bp, Artificial
  CRISPR gRNA sequence
ccttcccacactggactgtt

SEQ ID NO: 487999 - DNA, 20 bp, Artificial
  CRISPR gRNA sequence
cttcccacactggactgttg

SEQ ID NO: 488000 - DNA, 20 bp, Artificial
  CRISPR gRNA sequence
ttcccacactggactgttgg

SEQ ID NO: 488001 - DNA, 20 bp, Artificial
  CRISPR gRNA sequence
cactggactgttgggggctg

SEQ ID NO: 488002 - DNA, 20 bp, Artificial
  CRISPR gRNA sequence
actggactgttgggggctgc

SEQ ID NO: 488003 - DNA, 20 bp, Artificial
  CRISPR gRNA sequence
tggactgttgggggctgcag

SEQ ID NO: 488004 - DNA, 20 bp, Artificial
  CRISPR gRNA sequence
gggggctgcaggagaaaatt

SEQ ID NO: 488005 - DNA, 20 bp, Artificial
  CRISPR gRNA sequence
caggagaaaattcagcaaca

SEQ ID NO: 488006 - DNA, 20 bp, Artificial
  CRISPR gRNA sequence
ggagaaaattcagcaacaaa

SEQ ID NO: 488007 - DNA, 20 bp, Artificial
  CRISPR gRNA sequence
gaaaattcagcaacaaagag

SEQ ID NO: 488008 - DNA, 20 bp, Artificial
  CRISPR gRNA sequence
tcagcaacaaagagcagcta

SEQ ID NO: 488009 - DNA, 20 bp, Artificial
  CRISPR gRNA sequence
agattcgtaatctccaaccc

SEQ ID NO: 488010 - DNA, 20 bp, Artificial
  CRISPR gRNA sequence
tcgtaatctccaaccccagc

SEQ ID NO: 488011 - DNA, 20 bp, Artificial
  CRISPR gRNA sequence
tccaaccccagctggactct

SEQ ID NO: 488012 - DNA, 20 bp, Artificial
  CRISPR gRNA sequence
cagctggactctcagtgtcc

SEQ ID NO: 488013 - DNA, 20 bp, Artificial
  CRISPR gRNA sequence
agctggactctcagtgtcct

SEQ ID NO: 488014 - DNA, 20 bp, Artificial
  CRISPR gRNA sequence
gtcctgggaatcctcatttc

SEQ ID NO: 488015 - DNA, 20 bp, Artificial
  CRISPR gRNA sequence
gaatcctcatttctggccca

SEQ ID NO: 488016 - DNA, 20 bp, Artificial
  CRISPR gRNA sequence
cagcttctcctgttccccaa

SEQ ID NO: 488017 - DNA, 20 bp, Artificial
  CRISPR gRNA sequence
agcttctcctgttccccaaa

SEQ ID NO: 488018 - DNA, 20 bp, Artificial
  CRISPR gRNA sequence
ttctcctgttccccaaaagg

SEQ ID NO: 488019 - DNA, 20 bp, Artificial
  CRISPR gRNA sequence
tctcctgttccccaaaaggt

SEQ ID NO: 488020 - DNA, 20 bp, Artificial
  CRISPR gRNA sequence
tcctgttccccaaaaggtgg

SEQ ID NO: 488021 - DNA, 20 bp, Artificial
  CRISPR gRNA sequence
acaccttcgtcatctctttc

SEQ ID NO: 488022 - DNA, 20 bp, Artificial
  CRISPR gRNA sequence
caccttcgtcatctctttca

SEQ ID NO: 488023 - DNA, 20 bp, Artificial
  CRISPR gRNA sequence
aaggccctgttccactatct

SEQ ID NO: 488024 - DNA, 20 bp, Artificial
  CRISPR gRNA sequence
aaccaacaacctccttcttt

SEQ ID NO: 488025 - DNA, 20 bp, Artificial
  CRISPR gRNA sequence
aacctccttctttaagaaaa

SEQ ID NO: 488026 - DNA, 20 bp, Artificial
  CRISPR gRNA sequence
ctccttctttaagaaaacag

SEQ ID NO: 488027 - DNA, 20 bp, Artificial
  CRISPR gRNA sequence
ctttaagaaaacagaagcac

SEQ ID NO: 488028 - DNA, 20 bp, Artificial
  CRISPR gRNA sequence
aagaaaacagaagcacaagt

SEQ ID NO: 488029 - DNA, 20 bp, Artificial
  CRISPR gRNA sequence
agaaaacagaagcacaagtt

SEQ ID NO: 488030 - DNA, 20 bp, Artificial
  CRISPR gRNA sequence
gaaaacagaagcacaagtta

SEQ ID NO: 488031 - DNA, 20 bp, Artificial
  CRISPR gRNA sequence
attccaccaaccttgccaac

SEQ ID NO: 488032 - DNA, 20 bp, Artificial
  CRISPR gRNA sequence
caaccttgccaacaagtctc

SEQ ID NO: 488033 - DNA, 20 bp, Artificial
  CRISPR gRNA sequence
acttcatctactcctgtaaa

SEQ ID NO: 488034 - DNA, 20 bp, Artificial
  CRISPR gRNA sequence
tggccacatttgcctctgct

SEQ ID NO: 488035 - DNA, 20 bp, Artificial
  CRISPR gRNA sequence
ggccacatttgcctctgctg

SEQ ID NO: 488036 - DNA, 20 bp, Artificial
  CRISPR gRNA sequence
gccacatttgcctctgctga

SEQ ID NO: 488037 - DNA, 20 bp, Artificial
  CRISPR gRNA sequence
catttgcctctgctgagggc

SEQ ID NO: 488038 - DNA, 20 bp, Artificial
  CRISPR gRNA sequence
tttgcctctgctgagggcaa

SEQ ID NO: 488039 - DNA, 20 bp, Artificial
  CRISPR gRNA sequence
ccaatactcccctgtgtgct

SEQ ID NO: 488040 - DNA, 20 bp, Artificial
  CRISPR gRNA sequence
caatactcccctgtgtgctc

SEQ ID NO: 488041 - DNA, 20 bp, Artificial
  CRISPR gRNA sequence
aatactcccctgtgtgctca

SEQ ID NO: 488042 - DNA, 20 bp, Artificial
  CRISPR gRNA sequence
cccctgtgtgctcagggcac

SEQ ID NO: 488043 - DNA, 20 bp, Artificial
  CRISPR gRNA sequence
cctgtgtgctcagggcacca

SEQ ID NO: 488044 - DNA, 20 bp, Artificial
  CRISPR gRNA sequence
cagggcaccagagcttcttt

SEQ ID NO: 488045 - DNA, 20 bp, Artificial
  CRISPR gRNA sequence
ggcaccagagcttctttcag

SEQ ID NO: 488046 - DNA, 20 bp, Artificial
  CRISPR gRNA sequence
agcttctttcagaagtcacc

SEQ ID NO: 488047 - DNA, 20 bp, Artificial
  CRISPR gRNA sequence
gcttctttcagaagtcacct

SEQ ID NO: 488048 - DNA, 20 bp, Artificial
  CRISPR gRNA sequence
cctgggacctgctgtctgtg

SEQ ID NO: 488049 - DNA, 20 bp, Artificial
  CRISPR gRNA sequence
agacatccctcatctttctt

SEQ ID NO: 488050 - DNA, 20 bp, Artificial
  CRISPR gRNA sequence
cttcagctgctccttttctg

SEQ ID NO: 488051 - DNA, 20 bp, Artificial
  CRISPR gRNA sequence
ttcagctgctccttttctgt

SEQ ID NO: 488052 - DNA, 20 bp, Artificial
  CRISPR gRNA sequence
ttctgtgggcttcctacctt

SEQ ID NO: 488053 - DNA, 20 bp, Artificial
  CRISPR gRNA sequence
tgggcttcctacctttagta

SEQ ID NO: 488054 - DNA, 20 bp, Artificial
  CRISPR gRNA sequence
cctttagtacagtttccttc

SEQ ID NO: 488055 - DNA, 20 bp, Artificial
  CRISPR gRNA sequence
tgaaaaatcaaaacaacacc

SEQ ID NO: 488056 - DNA, 20 bp, Artificial
  CRISPR gRNA sequence
acaacacctggtgttctctc

SEQ ID NO: 488057 - DNA, 20 bp, Artificial
  CRISPR gRNA sequence
ctctagctcctttttatttg

SEQ ID NO: 488058 - DNA, 20 bp, Artificial
  CRISPR gRNA sequence
ctttttatttgcagacaaac

SEQ ID NO: 488059 - DNA, 20 bp, Artificial
  CRISPR gRNA sequence
tacataaaaataaaatataa

SEQ ID NO: 488060 - DNA, 20 bp, Artificial
  CRISPR gRNA sequence
ataacggcctaatttttaaa

SEQ ID NO: 488061 - DNA, 20 bp, Artificial
  CRISPR gRNA sequence
taatttttaaaaagacccca

SEQ ID NO: 488062 - DNA, 20 bp, Artificial
  CRISPR gRNA sequence
aatttttaaaaagaccccaa

SEQ ID NO: 488063 - DNA, 20 bp, Artificial
  CRISPR gRNA sequence
ttttaaaaagaccccaaagg

SEQ ID NO: 488064 - DNA, 20 bp, Artificial
  CRISPR gRNA sequence
aaaagaccccaaaggcagta

SEQ ID NO: 488065 - DNA, 20 bp, Artificial
  CRISPR gRNA sequence
ccccaaaggcagtatagcat

SEQ ID NO: 488066 - DNA, 20 bp, Artificial
  CRISPR gRNA sequence
cccaaaggcagtatagcatg

SEQ ID NO: 488067 - DNA, 20 bp, Artificial
  CRISPR gRNA sequence
gcagtatagcatgaggactg

SEQ ID NO: 488068 - DNA, 20 bp, Artificial
  CRISPR gRNA sequence
gatcacacatttcattcttt

SEQ ID NO: 488069 - DNA, 20 bp, Artificial
  CRISPR gRNA sequence
catttcattctttaagtatt

SEQ ID NO: 488070 - DNA, 20 bp, Artificial
  CRISPR gRNA sequence
ttcattctttaagtatttag

SEQ ID NO: 488071 - DNA, 20 bp, Artificial
  CRISPR gRNA sequence
tttaagtatttagaagtcta

SEQ ID NO: 488072 - DNA, 20 bp, Artificial
  CRISPR gRNA sequence
agtatttagaagtctatggc

SEQ ID NO: 488073 - DNA, 20 bp, Artificial
  CRISPR gRNA sequence
gtatttagaagtctatggct

SEQ ID NO: 488074 - DNA, 20 bp, Artificial
  CRISPR gRNA sequence
atttagaagtctatggctgg

SEQ ID NO: 488075 - DNA, 20 bp, Artificial
  CRISPR gRNA sequence
tagaagtctatggctgggag

SEQ ID NO: 488076 - DNA, 20 bp, Artificial
  CRISPR gRNA sequence
aagtctatggctgggagtgg

SEQ ID NO: 488077 - DNA, 20 bp, Artificial
  CRISPR gRNA sequence
ctgggagtggtggctcacgc

SEQ ID NO: 488078 - DNA, 20 bp, Artificial
  CRISPR gRNA sequence
ggtggctcacgccagaactt

SEQ ID NO: 488079 - DNA, 20 bp, Artificial
  CRISPR gRNA sequence
gtggctcacgccagaacttt

SEQ ID NO: 488080 - DNA, 20 bp, Artificial
  CRISPR gRNA sequence
ggctcacgccagaactttgg

SEQ ID NO: 488081 - DNA, 20 bp, Artificial
  CRISPR gRNA sequence
gctcacgccagaactttggg

SEQ ID NO: 488082 - DNA, 20 bp, Artificial
  CRISPR gRNA sequence
cgccagaactttgggaggct

SEQ ID NO: 488083 - DNA, 20 bp, Artificial
  CRISPR gRNA sequence
agaactttgggaggctgaga

SEQ ID NO: 488084 - DNA, 20 bp, Artificial
  CRISPR gRNA sequence
gaactttgggaggctgagac

SEQ ID NO: 488085 - DNA, 20 bp, Artificial
  CRISPR gRNA sequence
ctttgggaggctgagacggg

SEQ ID NO: 488086 - DNA, 20 bp, Artificial
  CRISPR gRNA sequence
ctgagacgggtggattactt

SEQ ID NO: 488087 - DNA, 20 bp, Artificial
  CRISPR gRNA sequence
tgagacgggtggattacttg

SEQ ID NO: 488088 - DNA, 20 bp, Artificial
  CRISPR gRNA sequence
acgggtggattacttgaggt

SEQ ID NO: 488089 - DNA, 20 bp, Artificial
  CRISPR gRNA sequence
cgggtggattacttgaggtc

SEQ ID NO: 488090 - DNA, 20 bp, Artificial
  CRISPR gRNA sequence
ggtggattacttgaggtcag

SEQ ID NO: 488091 - DNA, 20 bp, Artificial
  CRISPR gRNA sequence
ttacttgaggtcaggagttc

SEQ ID NO: 488092 - DNA, 20 bp, Artificial
  CRISPR gRNA sequence
tgaggtcaggagttcaagac

SEQ ID NO: 488093 - DNA, 20 bp, Artificial
  CRISPR gRNA sequence
tcaggagttcaagaccagcc

SEQ ID NO: 488094 - DNA, 20 bp, Artificial
  CRISPR gRNA sequence
caagaccagcctggccaata

SEQ ID NO: 488095 - DNA, 20 bp, Artificial
  CRISPR gRNA sequence
aaaaatacaaaaaaaaaaaa

SEQ ID NO: 488096 - DNA, 20 bp, Artificial
  CRISPR gRNA sequence
tacaaaaaaaaaaaaaagaa

SEQ ID NO: 488097 - DNA, 20 bp, Artificial
  CRISPR gRNA sequence
aaaaaaaaaaaaagaatagc

SEQ ID NO: 488098 - DNA, 20 bp, Artificial
  CRISPR gRNA sequence
aaaaaaaaaaaagaatagct

SEQ ID NO: 488099 - DNA, 20 bp, Artificial
  CRISPR gRNA sequence
aaaaaaaaaaagaatagctg

SEQ ID NO: 488100 - DNA, 20 bp, Artificial
  CRISPR gRNA sequence
aaaaaaaaaagaatagctgg

SEQ ID NO: 488101 - DNA, 20 bp, Artificial
  CRISPR gRNA sequence
aaaaaaagaatagctggggg

SEQ ID NO: 488102 - DNA, 20 bp, Artificial
  CRISPR gRNA sequence
aaaagaatagctgggggtgg

SEQ ID NO: 488103 - DNA, 20 bp, Artificial
  CRISPR gRNA sequence
agaatagctgggggtggtgg

SEQ ID NO: 488104 - DNA, 20 bp, Artificial
  CRISPR gRNA sequence
gaatagctgggggtggtggc

SEQ ID NO: 488105 - DNA, 20 bp, Artificial
  CRISPR gRNA sequence
ggggtggtggcaggcacctg

SEQ ID NO: 488106 - DNA, 20 bp, Artificial
  CRISPR gRNA sequence
gtggcaggcacctgtagtcc

SEQ ID NO: 488107 - DNA, 20 bp, Artificial
  CRISPR gRNA sequence
ctgtagtcccagttactcat

SEQ ID NO: 488108 - DNA, 20 bp, Artificial
  CRISPR gRNA sequence
tgtagtcccagttactcatg

SEQ ID NO: 488109 - DNA, 20 bp, Artificial
  CRISPR gRNA sequence
tcccagttactcatgaggct

SEQ ID NO: 488110 - DNA, 20 bp, Artificial
  CRISPR gRNA sequence
agttactcatgaggctgaga

SEQ ID NO: 488111 - DNA, 20 bp, Artificial
  CRISPR gRNA sequence
gttactcatgaggctgagac

SEQ ID NO: 488112 - DNA, 20 bp, Artificial
  CRISPR gRNA sequence
tactcatgaggctgagacag

SEQ ID NO: 488113 - DNA, 20 bp, Artificial
  CRISPR gRNA sequence
acaggagaatcacttgaacc

SEQ ID NO: 488114 - DNA, 20 bp, Artificial
  CRISPR gRNA sequence
caggagaatcacttgaacct

SEQ ID NO: 488115 - DNA, 20 bp, Artificial
  CRISPR gRNA sequence
ggagaatcacttgaacctgg

SEQ ID NO: 488116 - DNA, 20 bp, Artificial
  CRISPR gRNA sequence
gagaatcacttgaacctggg

SEQ ID NO: 488117 - DNA, 20 bp, Artificial
  CRISPR gRNA sequence
aatcacttgaacctgggagg

SEQ ID NO: 488118 - DNA, 20 bp, Artificial
  CRISPR gRNA sequence
tcacttgaacctgggaggca

SEQ ID NO: 488119 - DNA, 20 bp, Artificial
  CRISPR gRNA sequence
aacctgggaggcagagattg

SEQ ID NO: 488120 - DNA, 20 bp, Artificial
  CRISPR gRNA sequence
tgggaggcagagattgcagt

SEQ ID NO: 488121 - DNA, 20 bp, Artificial
  CRISPR gRNA sequence
ggcagagattgcagtgagcc

SEQ ID NO: 488122 - DNA, 20 bp, Artificial
  CRISPR gRNA sequence
gagatcatgccactgcacac

SEQ ID NO: 488123 - DNA, 20 bp, Artificial
  CRISPR gRNA sequence
catgccactgcacaccagtc

SEQ ID NO: 488124 - DNA, 20 bp, Artificial
  CRISPR gRNA sequence
atgccactgcacaccagtct

SEQ ID NO: 488125 - DNA, 20 bp, Artificial
  CRISPR gRNA sequence
ctgcacaccagtctgggtga

SEQ ID NO: 488126 - DNA, 20 bp, Artificial
  CRISPR gRNA sequence
gcacaccagtctgggtgaca

SEQ ID NO: 488127 - DNA, 20 bp, Artificial
  CRISPR gRNA sequence
accagtctgggtgacagagc

SEQ ID NO: 488128 - DNA, 20 bp, Artificial
  CRISPR gRNA sequence
ttaaaacaaacaaacaaaca

SEQ ID NO: 488129 - DNA, 20 bp, Artificial
  CRISPR gRNA sequence
aaacaaacaaacaaacaaag

SEQ ID NO: 488130 - DNA, 20 bp, Artificial
  CRISPR gRNA sequence
aacaaacaaacaaagaagtc

SEQ ID NO: 488131 - DNA, 20 bp, Artificial
  CRISPR gRNA sequence
tttcctgtgtgattcctatt

SEQ ID NO: 488132 - DNA, 20 bp, Artificial
  CRISPR gRNA sequence
attcctattcagttttataa

SEQ ID NO: 488133 - DNA, 20 bp, Artificial
  CRISPR gRNA sequence
cctattcagttttataatag

SEQ ID NO: 488134 - DNA, 20 bp, Artificial
  CRISPR gRNA sequence
tattcagttttataatagca

SEQ ID NO: 488135 - DNA, 20 bp, Artificial
  CRISPR gRNA sequence
gagaacaaccttcttctaca

SEQ ID NO: 488136 - DNA, 20 bp, Artificial
  CRISPR gRNA sequence
cgctctacattctgatctac

SEQ ID NO: 488137 - DNA, 20 bp, Artificial
  CRISPR gRNA sequence
tctacattctgatctactgg

SEQ ID NO: 488138 - DNA, 20 bp, Artificial
  CRISPR gRNA sequence
tgatctactggtggattata

SEQ ID NO: 488139 - DNA, 20 bp, Artificial
  CRISPR gRNA sequence
gatctactggtggattatat

SEQ ID NO: 488140 - DNA, 20 bp, Artificial
  CRISPR gRNA sequence
tctactggtggattatatgg

SEQ ID NO: 488141 - DNA, 20 bp, Artificial
  CRISPR gRNA sequence
tacaccgtatatttatattt

SEQ ID NO: 488142 - DNA, 20 bp, Artificial
  CRISPR gRNA sequence
tacctctcacaattttataa

SEQ ID NO: 488143 - DNA, 20 bp, Artificial
  CRISPR gRNA sequence
ttttataaaagataaaaata

SEQ ID NO: 488144 - DNA, 20 bp, Artificial
  CRISPR gRNA sequence
caaacctgctccatctttac

SEQ ID NO: 488145 - DNA, 20 bp, Artificial
  CRISPR gRNA sequence
tccatctttaccagacccat

SEQ ID NO: 488146 - DNA, 20 bp, Artificial
  CRISPR gRNA sequence
tcccttaaccatgctactgc

SEQ ID NO: 488147 - DNA, 20 bp, Artificial
  CRISPR gRNA sequence
cccttaaccatgctactgct

SEQ ID NO: 488148 - DNA, 20 bp, Artificial
  CRISPR gRNA sequence
ctgttcctttctgcatacac

SEQ ID NO: 488149 - DNA, 20 bp, Artificial
  CRISPR gRNA sequence
tgttcctttctgcatacacc

SEQ ID NO: 488150 - DNA, 20 bp, Artificial
  CRISPR gRNA sequence
tcctttctgcatacaccagg

SEQ ID NO: 488151 - DNA, 20 bp, Artificial
  CRISPR gRNA sequence
cctttctgcatacaccaggc

SEQ ID NO: 488152 - DNA, 20 bp, Artificial
  CRISPR gRNA sequence
tgcatacaccaggcaggcct

SEQ ID NO: 488153 - DNA, 20 bp, Artificial
  CRISPR gRNA sequence
gccttggctttttctttcaa

SEQ ID NO: 488154 - DNA, 20 bp, Artificial
  CRISPR gRNA sequence
ttggctttttctttcaatgg

SEQ ID NO: 488155 - DNA, 20 bp, Artificial
  CRISPR gRNA sequence
cagctcccacccaccgcctc

SEQ ID NO: 488156 - DNA, 20 bp, Artificial
  CRISPR gRNA sequence
agctcccacccaccgcctct

SEQ ID NO: 488157 - DNA, 20 bp, Artificial
  CRISPR gRNA sequence
tcccacccaccgcctctggg

SEQ ID NO: 488158 - DNA, 20 bp, Artificial
  CRISPR gRNA sequence
ggcagccactcctaactctg

SEQ ID NO: 488159 - DNA, 20 bp, Artificial
  CRISPR gRNA sequence
gcagccactcctaactctgc

SEQ ID NO: 488160 - DNA, 20 bp, Artificial
  CRISPR gRNA sequence
cagccactcctaactctgca

SEQ ID NO: 488161 - DNA, 20 bp, Artificial
  CRISPR gRNA sequence
ccactcctaactctgcaggg

SEQ ID NO: 488162 - DNA, 20 bp, Artificial
  CRISPR gRNA sequence
actcctaactctgcagggca

SEQ ID NO: 488163 - DNA, 20 bp, Artificial
  CRISPR gRNA sequence
ctcctaactctgcagggcag

SEQ ID NO: 488164 - DNA, 20 bp, Artificial
  CRISPR gRNA sequence
cttatgcttgcctcacaccc

SEQ ID NO: 488165 - DNA, 20 bp, Artificial
  CRISPR gRNA sequence
ttatgcttgcctcacaccct

SEQ ID NO: 488166 - DNA, 20 bp, Artificial
  CRISPR gRNA sequence
acaccctgggcacacctcca

SEQ ID NO: 488167 - DNA, 20 bp, Artificial
  CRISPR gRNA sequence
gcacattccatattgcattt

SEQ ID NO: 488168 - DNA, 20 bp, Artificial
  CRISPR gRNA sequence
attccatattgcatttcagt

SEQ ID NO: 488169 - DNA, 20 bp, Artificial
  CRISPR gRNA sequence
tgcatttcagttggctgttt

SEQ ID NO: 488170 - DNA, 20 bp, Artificial
  CRISPR gRNA sequence
gcatttcagttggctgtttt

SEQ ID NO: 488171 - DNA, 20 bp, Artificial
  CRISPR gRNA sequence
tttttttttttttttttttt

SEQ ID NO: 488172 - DNA, 20 bp, Artificial
  CRISPR gRNA sequence
tttttttttttttttttttt

SEQ ID NO: 488173 - DNA, 20 bp, Artificial
  CRISPR gRNA sequence
tttttttttttttttttagg

SEQ ID NO: 488174 - DNA, 20 bp, Artificial
  CRISPR gRNA sequence
ttttttttttttttttaggc

SEQ ID NO: 488175 - DNA, 20 bp, Artificial
  CRISPR gRNA sequence
tttttttttttttttaggca

SEQ ID NO: 488176 - DNA, 20 bp, Artificial
  CRISPR gRNA sequence
cagggtcttgctctgtcacc

SEQ ID NO: 488177 - DNA, 20 bp, Artificial
  CRISPR gRNA sequence
agggtcttgctctgtcaccc

SEQ ID NO: 488178 - DNA, 20 bp, Artificial
  CRISPR gRNA sequence
tcttgctctgtcacccaggc

SEQ ID NO: 488179 - DNA, 20 bp, Artificial
  CRISPR gRNA sequence
cttgctctgtcacccaggct

SEQ ID NO: 488180 - DNA, 20 bp, Artificial
  CRISPR gRNA sequence
ttgctctgtcacccaggctg

SEQ ID NO: 488181 - DNA, 20 bp, Artificial
  CRISPR gRNA sequence
ctgtcacccaggctggggtg

SEQ ID NO: 488182 - DNA, 20 bp, Artificial
  CRISPR gRNA sequence
tcacccaggctggggtgcag

SEQ ID NO: 488183 - DNA, 20 bp, Artificial
  CRISPR gRNA sequence
caggctggggtgcagtggtg

SEQ ID NO: 488184 - DNA, 20 bp, Artificial
  CRISPR gRNA sequence
ggggtgcagtggtgcagtca

SEQ ID NO: 488185 - DNA, 20 bp, Artificial
  CRISPR gRNA sequence
tcactgcaacccctgcctcc

SEQ ID NO: 488186 - DNA, 20 bp, Artificial
  CRISPR gRNA sequence
cactgcaacccctgcctccc

SEQ ID NO: 488187 - DNA, 20 bp, Artificial
  CRISPR gRNA sequence
tcccaggcttttctgatatt

SEQ ID NO: 488188 - DNA, 20 bp, Artificial
  CRISPR gRNA sequence
ggcttttctgatatttagct

SEQ ID NO: 488189 - DNA, 20 bp, Artificial
  CRISPR gRNA sequence
cttttctgatatttagctaa

SEQ ID NO: 488190 - DNA, 20 bp, Artificial
  CRISPR gRNA sequence
tctgatatttagctaagagt

SEQ ID NO: 488191 - DNA, 20 bp, Artificial
  CRISPR gRNA sequence
ctgatatttagctaagagtt

SEQ ID NO: 488192 - DNA, 20 bp, Artificial
  CRISPR gRNA sequence
atttagctaagagttgggtt

SEQ ID NO: 488193 - DNA, 20 bp, Artificial
  CRISPR gRNA sequence
gctaagagttgggtttagct

SEQ ID NO: 488194 - DNA, 20 bp, Artificial
  CRISPR gRNA sequence
gagttgggtttagctgagat

SEQ ID NO: 488195 - DNA, 20 bp, Artificial
  CRISPR gRNA sequence
tgggtttagctgagatgagt

SEQ ID NO: 488196 - DNA, 20 bp, Artificial
  CRISPR gRNA sequence
gggtttagctgagatgagtg

SEQ ID NO: 488197 - DNA, 20 bp, Artificial
  CRISPR gRNA sequence
atctacaaattcacttgcta

SEQ ID NO: 488198 - DNA, 20 bp, Artificial
  CRISPR gRNA sequence
ctatggtaatgtttccacaa

SEQ ID NO: 488199 - DNA, 20 bp, Artificial
  CRISPR gRNA sequence
tatggtaatgtttccacaat

SEQ ID NO: 488200 - DNA, 20 bp, Artificial
  CRISPR gRNA sequence
gtaatgtttccacaatgggc

SEQ ID NO: 488201 - DNA, 20 bp, Artificial
  CRISPR gRNA sequence
gtcatattttgcttttatca

SEQ ID NO: 488202 - DNA, 20 bp, Artificial
  CRISPR gRNA sequence
gcttttatcaaagtacatct

SEQ ID NO: 488203 - DNA, 20 bp, Artificial
  CRISPR gRNA sequence
tcaaagtacatcttagttaa

SEQ ID NO: 488204 - DNA, 20 bp, Artificial
  CRISPR gRNA sequence
agtacatcttagttaatagt

SEQ ID NO: 488205 - DNA, 20 bp, Artificial
  CRISPR gRNA sequence
atcttagttaatagtcagaa

SEQ ID NO: 488206 - DNA, 20 bp, Artificial
  CRISPR gRNA sequence
agttaatagtcagaacagtt

SEQ ID NO: 488207 - DNA, 20 bp, Artificial
  CRISPR gRNA sequence
aatagtcagaacagttgagt

SEQ ID NO: 488208 - DNA, 20 bp, Artificial
  CRISPR gRNA sequence
tagtcagaacagttgagtga

SEQ ID NO: 488209 - DNA, 20 bp, Artificial
  CRISPR gRNA sequence
agtcagaacagttgagtgag

SEQ ID NO: 488210 - DNA, 20 bp, Artificial
  CRISPR gRNA sequence
cagaacagttgagtgagagg

SEQ ID NO: 488211 - DNA, 20 bp, Artificial
  CRISPR gRNA sequence
tctttttctgcttttttacc

SEQ ID NO: 488212 - DNA, 20 bp, Artificial
  CRISPR gRNA sequence
ttttaccaagatacaactca

SEQ ID NO: 488213 - DNA, 20 bp, Artificial
  CRISPR gRNA sequence
gtgcacaaaatttaaatcaa

SEQ ID NO: 488214 - DNA, 20 bp, Artificial
  CRISPR gRNA sequence
tgatgaacttttatatgtgt

SEQ ID NO: 488215 - DNA, 20 bp, Artificial
  CRISPR gRNA sequence
atatcaaaactacccacatc

SEQ ID NO: 488216 - DNA, 20 bp, Artificial
  CRISPR gRNA sequence
atcaagatgtaacacatttc

SEQ ID NO: 488217 - DNA, 20 bp, Artificial
  CRISPR gRNA sequence
tgtaacacatttctagcacc

SEQ ID NO: 488218 - DNA, 20 bp, Artificial
  CRISPR gRNA sequence
agcacccagtcattcctttt

SEQ ID NO: 488219 - DNA, 20 bp, Artificial
  CRISPR gRNA sequence
tcattcctttttggcccttc

SEQ ID NO: 488220 - DNA, 20 bp, Artificial
  CRISPR gRNA sequence
gttgataacccccctcctgc

SEQ ID NO: 488221 - DNA, 20 bp, Artificial
  CRISPR gRNA sequence
ttgataacccccctcctgca

SEQ ID NO: 488222 - DNA, 20 bp, Artificial
  CRISPR gRNA sequence
tgataacccccctcctgcaa

SEQ ID NO: 488223 - DNA, 20 bp, Artificial
  CRISPR gRNA sequence
taacctctctcaccatatat

SEQ ID NO: 488224 - DNA, 20 bp, Artificial
  CRISPR gRNA sequence
tcaccatatattagtttttc

SEQ ID NO: 488225 - DNA, 20 bp, Artificial
  CRISPR gRNA sequence
ccagattttaaactttatat

SEQ ID NO: 488226 - DNA, 20 bp, Artificial
  CRISPR gRNA sequence
ataattcactatgtactttt

SEQ ID NO: 488227 - DNA, 20 bp, Artificial
  CRISPR gRNA sequence
aattcactatgtactttttg

SEQ ID NO: 488228 - DNA, 20 bp, Artificial
  CRISPR gRNA sequence
actatgtactttttggagtc

SEQ ID NO: 488229 - DNA, 20 bp, Artificial
  CRISPR gRNA sequence
ttcattaatactcatcattg

SEQ ID NO: 488230 - DNA, 20 bp, Artificial
  CRISPR gRNA sequence
ttaatactcatcattgtggt

SEQ ID NO: 488231 - DNA, 20 bp, Artificial
  CRISPR gRNA sequence
agatccatccacattattgc

SEQ ID NO: 488232 - DNA, 20 bp, Artificial
  CRISPR gRNA sequence
gatccatccacattattgcc

SEQ ID NO: 488233 - DNA, 20 bp, Artificial
  CRISPR gRNA sequence
atccacattattgccaggaa

SEQ ID NO: 488234 - DNA, 20 bp, Artificial
  CRISPR gRNA sequence
cacattattgccaggaaaag

SEQ ID NO: 488235 - DNA, 20 bp, Artificial
  CRISPR gRNA sequence
tgctgtgtaatattccttat

SEQ ID NO: 488236 - DNA, 20 bp, Artificial
  CRISPR gRNA sequence
atttgctcatctaatcgtga

SEQ ID NO: 488237 - DNA, 20 bp, Artificial
  CRISPR gRNA sequence
atctaatcgtgatagacatt

SEQ ID NO: 488238 - DNA, 20 bp, Artificial
  CRISPR gRNA sequence
tctaatcgtgatagacattt

SEQ ID NO: 488239 - DNA, 20 bp, Artificial
  CRISPR gRNA sequence
tttgggttttttctcatttt

SEQ ID NO: 488240 - DNA, 20 bp, Artificial
  CRISPR gRNA sequence
attttgagttattatgacta

SEQ ID NO: 488241 - DNA, 20 bp, Artificial
  CRISPR gRNA sequence
aacactcttgtacatatttt

SEQ ID NO: 488242 - DNA, 20 bp, Artificial
  CRISPR gRNA sequence
actcttgtacatatttttag

SEQ ID NO: 488243 - DNA, 20 bp, Artificial
  CRISPR gRNA sequence
tttttagtggatataaacac

SEQ ID NO: 488244 - DNA, 20 bp, Artificial
  CRISPR gRNA sequence
accagattttcttttttttt

SEQ ID NO: 488245 - DNA, 20 bp, Artificial
  CRISPR gRNA sequence
gattttctttttttttgaga

SEQ ID NO: 488246 - DNA, 20 bp, Artificial
  CRISPR gRNA sequence
ttttctttttttttgagacg

SEQ ID NO: 488247 - DNA, 20 bp, Artificial
  CRISPR gRNA sequence
ggagtttcactcttgttgcc

SEQ ID NO: 488248 - DNA, 20 bp, Artificial
  CRISPR gRNA sequence
gagtttcactcttgttgccc

SEQ ID NO: 488249 - DNA, 20 bp, Artificial
  CRISPR gRNA sequence
ttcactcttgttgcccaggc

SEQ ID NO: 488250 - DNA, 20 bp, Artificial
  CRISPR gRNA sequence
cactcttgttgcccaggctg

SEQ ID NO: 488251 - DNA, 20 bp, Artificial
  CRISPR gRNA sequence
ttgcccaggctggagtgcaa

SEQ ID NO: 488252 - DNA, 20 bp, Artificial
  CRISPR gRNA sequence
ggagtgcaatggcatgatct

SEQ ID NO: 488253 - DNA, 20 bp, Artificial
  CRISPR gRNA sequence
tcactgcaacctccgcctct

SEQ ID NO: 488254 - DNA, 20 bp, Artificial
  CRISPR gRNA sequence
aacctccgcctctcagattt

SEQ ID NO: 488255 - DNA, 20 bp, Artificial
  CRISPR gRNA sequence
tttaagtgattctcctgctt

SEQ ID NO: 488256 - DNA, 20 bp, Artificial
  CRISPR gRNA sequence
ttctcctgcttcagtcttcc

SEQ ID NO: 488257 - DNA, 20 bp, Artificial
  CRISPR gRNA sequence
tcctgcttcagtcttccaag

SEQ ID NO: 488258 - DNA, 20 bp, Artificial
  CRISPR gRNA sequence
gcttcagtcttccaagtagc

SEQ ID NO: 488259 - DNA, 20 bp, Artificial
  CRISPR gRNA sequence
cttcagtcttccaagtagct

SEQ ID NO: 488260 - DNA, 20 bp, Artificial
  CRISPR gRNA sequence
cttccaagtagctgggatta

SEQ ID NO: 488261 - DNA, 20 bp, Artificial
  CRISPR gRNA sequence
ttccaagtagctgggattac

SEQ ID NO: 488262 - DNA, 20 bp, Artificial
  CRISPR gRNA sequence
caggtgtgcactgccacgcc

SEQ ID NO: 488263 - DNA, 20 bp, Artificial
  CRISPR gRNA sequence
taattttttttctttttttt

SEQ ID NO: 488264 - DNA, 20 bp, Artificial
  CRISPR gRNA sequence
tttttttcttttttttgaga

SEQ ID NO: 488265 - DNA, 20 bp, Artificial
  CRISPR gRNA sequence
ttttttcttttttttgagat

SEQ ID NO: 488266 - DNA, 20 bp, Artificial
  CRISPR gRNA sequence
tttttcttttttttgagatg

SEQ ID NO: 488267 - DNA, 20 bp, Artificial
  CRISPR gRNA sequence
gagatggggtttcaccatgt

SEQ ID NO: 488268 - DNA, 20 bp, Artificial
  CRISPR gRNA sequence
tggggtttcaccatgttggc

SEQ ID NO: 488269 - DNA, 20 bp, Artificial
  CRISPR gRNA sequence
ggggtttcaccatgttggcc

SEQ ID NO: 488270 - DNA, 20 bp, Artificial
  CRISPR gRNA sequence
tttcaccatgttggccaggc

SEQ ID NO: 488271 - DNA, 20 bp, Artificial
  CRISPR gRNA sequence
tggtctcaaactcctgacct

SEQ ID NO: 488272 - DNA, 20 bp, Artificial
  CRISPR gRNA sequence
ggtctcaaactcctgacctc

SEQ ID NO: 488273 - DNA, 20 bp, Artificial
  CRISPR gRNA sequence
ccgcctgcctcgacctccca

SEQ ID NO: 488274 - DNA, 20 bp, Artificial
  CRISPR gRNA sequence
gcctcgacctcccaaagtgc

SEQ ID NO: 488275 - DNA, 20 bp, Artificial
  CRISPR gRNA sequence
cctcgacctcccaaagtgct

SEQ ID NO: 488276 - DNA, 20 bp, Artificial
  CRISPR gRNA sequence
ctcccaaagtgctgggatta

SEQ ID NO: 488277 - DNA, 20 bp, Artificial
  CRISPR gRNA sequence
tcccaaagtgctgggattac

SEQ ID NO: 488278 - DNA, 20 bp, Artificial
  CRISPR gRNA sequence
agtgctgggattacaggcat

SEQ ID NO: 488279 - DNA, 20 bp, Artificial
  CRISPR gRNA sequence
caggcatgagccaccatgcc

SEQ ID NO: 488280 - DNA, 20 bp, Artificial
  CRISPR gRNA sequence
atgagccaccatgcctggcc

SEQ ID NO: 488281 - DNA, 20 bp, Artificial
  CRISPR gRNA sequence
ttcttgtgtacaaattcttc

SEQ ID NO: 488282 - DNA, 20 bp, Artificial
  CRISPR gRNA sequence
gtacaaattcttctggatca

SEQ ID NO: 488283 - DNA, 20 bp, Artificial
  CRISPR gRNA sequence
tacaaattcttctggatcaa

SEQ ID NO: 488284 - DNA, 20 bp, Artificial
  CRISPR gRNA sequence
acaaattcttctggatcaaa

SEQ ID NO: 488285 - DNA, 20 bp, Artificial
  CRISPR gRNA sequence
ctggatcaaagggtatatgt

SEQ ID NO: 488286 - DNA, 20 bp, Artificial
  CRISPR gRNA sequence
tcaaagggtatatgtaagtt

SEQ ID NO: 488287 - DNA, 20 bp, Artificial
  CRISPR gRNA sequence
ggtatatgtaagtttagttt

SEQ ID NO: 488288 - DNA, 20 bp, Artificial
  CRISPR gRNA sequence
atatgtaagtttagttttag

SEQ ID NO: 488289 - DNA, 20 bp, Artificial
  CRISPR gRNA sequence
ttttagaagataccgtaaaa

SEQ ID NO: 488290 - DNA, 20 bp, Artificial
  CRISPR gRNA sequence
taccgtaaaatagttttcca

SEQ ID NO: 488291 - DNA, 20 bp, Artificial
  CRISPR gRNA sequence
aaaatagttttccaaagtgc

SEQ ID NO: 488292 - DNA, 20 bp, Artificial
  CRISPR gRNA sequence
gtaccaatttacactctcac

SEQ ID NO: 488293 - DNA, 20 bp, Artificial
  CRISPR gRNA sequence
cactctcactagcaataaat

SEQ ID NO: 488294 - DNA, 20 bp, Artificial
  CRISPR gRNA sequence
ctagcaataaatgagaatct

SEQ ID NO: 488295 - DNA, 20 bp, Artificial
  CRISPR gRNA sequence
ctcccatctctgtcaaccct

SEQ ID NO: 488296 - DNA, 20 bp, Artificial
  CRISPR gRNA sequence
atttatttacatttattttc

SEQ ID NO: 488297 - DNA, 20 bp, Artificial
  CRISPR gRNA sequence
ttacatttattttcgagacc

SEQ ID NO: 488298 - DNA, 20 bp, Artificial
  CRISPR gRNA sequence
ttattttcgagaccaagtct

SEQ ID NO: 488299 - DNA, 20 bp, Artificial
  CRISPR gRNA sequence
ccaagtctcagtctgtcacc

SEQ ID NO: 488300 - DNA, 20 bp, Artificial
  CRISPR gRNA sequence
caagtctcagtctgtcaccc

SEQ ID NO: 488301 - DNA, 20 bp, Artificial
  CRISPR gRNA sequence
tctcagtctgtcacccaggc

SEQ ID NO: 488302 - DNA, 20 bp, Artificial
  CRISPR gRNA sequence
tcagtctgtcacccaggctg

SEQ ID NO: 488303 - DNA, 20 bp, Artificial
  CRISPR gRNA sequence
ctgtcacccaggctggagta

SEQ ID NO: 488304 - DNA, 20 bp, Artificial
  CRISPR gRNA sequence
tcacccaggctggagtacag

SEQ ID NO: 488305 - DNA, 20 bp, Artificial
  CRISPR gRNA sequence
ggagtacagtggcgtgatct

SEQ ID NO: 488306 - DNA, 20 bp, Artificial
  CRISPR gRNA sequence
tcactgcaacctctgcctcc

SEQ ID NO: 488307 - DNA, 20 bp, Artificial
  CRISPR gRNA sequence
cactgcaacctctgcctcct

SEQ ID NO: 488308 - DNA, 20 bp, Artificial
  CRISPR gRNA sequence
aacctctgcctcctgggttc

SEQ ID NO: 488309 - DNA, 20 bp, Artificial
  CRISPR gRNA sequence
ttcaagcaattctcctgcct

SEQ ID NO: 488310 - DNA, 20 bp, Artificial
  CRISPR gRNA sequence
ttctcctgcctcagactccc

SEQ ID NO: 488311 - DNA, 20 bp, Artificial
  CRISPR gRNA sequence
tcctgcctcagactcccaag

SEQ ID NO: 488312 - DNA, 20 bp, Artificial
  CRISPR gRNA sequence
gcctcagactcccaagaagc

SEQ ID NO: 488313 - DNA, 20 bp, Artificial
  CRISPR gRNA sequence
ctcccaagaagctggtatta

SEQ ID NO: 488314 - DNA, 20 bp, Artificial
  CRISPR gRNA sequence
tcccaagaagctggtattac

SEQ ID NO: 488315 - DNA, 20 bp, Artificial
  CRISPR gRNA sequence
tctgctaatttttgcatttt

SEQ ID NO: 488316 - DNA, 20 bp, Artificial
  CRISPR gRNA sequence
gctaatttttgcatttttag

SEQ ID NO: 488317 - DNA, 20 bp, Artificial
  CRISPR gRNA sequence
taatttttgcatttttagta

SEQ ID NO: 488318 - DNA, 20 bp, Artificial
  CRISPR gRNA sequence
ttttgcatttttagtagaga

SEQ ID NO: 488319 - DNA, 20 bp, Artificial
  CRISPR gRNA sequence
tttgcatttttagtagagat

SEQ ID NO: 488320 - DNA, 20 bp, Artificial
  CRISPR gRNA sequence
ttgcatttttagtagagatg

SEQ ID NO: 488321 - DNA, 20 bp, Artificial
  CRISPR gRNA sequence
gagatggggtttcaccatgt

SEQ ID NO: 488322 - DNA, 20 bp, Artificial
  CRISPR gRNA sequence
tggggtttcaccatgttggc

SEQ ID NO: 488323 - DNA, 20 bp, Artificial
  CRISPR gRNA sequence
ggggtttcaccatgttggcc

SEQ ID NO: 488324 - DNA, 20 bp, Artificial
  CRISPR gRNA sequence
tttcaccatgttggccaggc

SEQ ID NO: 488325 - DNA, 20 bp, Artificial
  CRISPR gRNA sequence
ccaggctggcctcgaactcc

SEQ ID NO: 488326 - DNA, 20 bp, Artificial
  CRISPR gRNA sequence
ggcctcgaactcctggcctc

SEQ ID NO: 488327 - DNA, 20 bp, Artificial
  CRISPR gRNA sequence
ctcaagcgatccacccgcct

SEQ ID NO: 488328 - DNA, 20 bp, Artificial
  CRISPR gRNA sequence
ccacccgcctcggcctccca

SEQ ID NO: 488329 - DNA, 20 bp, Artificial
  CRISPR gRNA sequence
gcctcggcctcccaaagtgc

SEQ ID NO: 488330 - DNA, 20 bp, Artificial
  CRISPR gRNA sequence
cctcggcctcccaaagtgct

SEQ ID NO: 488331 - DNA, 20 bp, Artificial
  CRISPR gRNA sequence
ctcccaaagtgctgggatta

SEQ ID NO: 488332 - DNA, 20 bp, Artificial
  CRISPR gRNA sequence
tcccaaagtgctgggattac

SEQ ID NO: 488333 - DNA, 20 bp, Artificial
  CRISPR gRNA sequence
agtgctgggattacaggctt

SEQ ID NO: 488334 - DNA, 20 bp, Artificial
  CRISPR gRNA sequence
caggcttgagccgcttcgcc

SEQ ID NO: 488335 - DNA, 20 bp, Artificial
  CRISPR gRNA sequence
gagccgcttcgcccagcctt

SEQ ID NO: 488336 - DNA, 20 bp, Artificial
  CRISPR gRNA sequence
gccttcagacctttaaatgt

SEQ ID NO: 488337 - DNA, 20 bp, Artificial
  CRISPR gRNA sequence
cctttaaatgttagctattt

SEQ ID NO: 488338 - DNA, 20 bp, Artificial
  CRISPR gRNA sequence
ttaaatgttagctattttgg

SEQ ID NO: 488339 - DNA, 20 bp, Artificial
  CRISPR gRNA sequence
taaatgttagctattttggt

SEQ ID NO: 488340 - DNA, 20 bp, Artificial
  CRISPR gRNA sequence
tctctgataactaatgttgt

SEQ ID NO: 488341 - DNA, 20 bp, Artificial
  CRISPR gRNA sequence
ctctgataactaatgttgtt

SEQ ID NO: 488342 - DNA, 20 bp, Artificial
  CRISPR gRNA sequence
gcacccttatgcatgcctat

SEQ ID NO: 488343 - DNA, 20 bp, Artificial
  CRISPR gRNA sequence
tatgcatgcctattggctat

SEQ ID NO: 488344 - DNA, 20 bp, Artificial
  CRISPR gRNA sequence
attggatattctctttccta

SEQ ID NO: 488345 - DNA, 20 bp, Artificial
  CRISPR gRNA sequence
ctttcctaaagtgcctgccc

SEQ ID NO: 488346 - DNA, 20 bp, Artificial
  CRISPR gRNA sequence
ttttttgtcattattgtcat

SEQ ID NO: 488347 - DNA, 20 bp, Artificial
  CRISPR gRNA sequence
atcagtgtattattgatttc

SEQ ID NO: 488348 - DNA, 20 bp, Artificial
  CRISPR gRNA sequence
ttccagtctattattgtcat

SEQ ID NO: 488349 - DNA, 20 bp, Artificial
  CRISPR gRNA sequence
tgtcatcagtctattattga

SEQ ID NO: 488350 - DNA, 20 bp, Artificial
  CRISPR gRNA sequence
atggaattctttatatactc

SEQ ID NO: 488351 - DNA, 20 bp, Artificial
  CRISPR gRNA sequence
tctttatatactctggatat

SEQ ID NO: 488352 - DNA, 20 bp, Artificial
  CRISPR gRNA sequence
gtattgcaaacattttctcc

SEQ ID NO: 488353 - DNA, 20 bp, Artificial
  CRISPR gRNA sequence
aaacattttctcccagtctt

SEQ ID NO: 488354 - DNA, 20 bp, Artificial
  CRISPR gRNA sequence
caatgttgtctttcaccaaa

SEQ ID NO: 488355 - DNA, 20 bp, Artificial
  CRISPR gRNA sequence
tgttgtctttcaccaaacag

SEQ ID NO: 488356 - DNA, 20 bp, Artificial
  CRISPR gRNA sequence
tttcaccaaacagaagttct

SEQ ID NO: 488357 - DNA, 20 bp, Artificial
  CRISPR gRNA sequence
caaacagaagttctaagttt

SEQ ID NO: 488358 - DNA, 20 bp, Artificial
  CRISPR gRNA sequence
agaagttctaagttttagtg

SEQ ID NO: 488359 - DNA, 20 bp, Artificial
  CRISPR gRNA sequence
aatttatcaatattctttta

SEQ ID NO: 488360 - DNA, 20 bp, Artificial
  CRISPR gRNA sequence
tatcaatattcttttatggt

SEQ ID NO: 488361 - DNA, 20 bp, Artificial
  CRISPR gRNA sequence
tgtgtgtgtgtgtcctgtta

SEQ ID NO: 488362 - DNA, 20 bp, Artificial
  CRISPR gRNA sequence
ttaaagaaacatttgttgtc

SEQ ID NO: 488363 - DNA, 20 bp, Artificial
  CRISPR gRNA sequence
taaagaaacatttgttgtct

SEQ ID NO: 488364 - DNA, 20 bp, Artificial
  CRISPR gRNA sequence
aaacatttgttgtctgggtg

SEQ ID NO: 488365 - DNA, 20 bp, Artificial
  CRISPR gRNA sequence
catttgttgtctgggtgcag

SEQ ID NO: 488366 - DNA, 20 bp, Artificial
  CRISPR gRNA sequence
gtggctcatgcctgtaatct

SEQ ID NO: 488367 - DNA, 20 bp, Artificial
  CRISPR gRNA sequence
tgcctgtaatctcagcgctt

SEQ ID NO: 488368 - DNA, 20 bp, Artificial
  CRISPR gRNA sequence
gcctgtaatctcagcgcttt

SEQ ID NO: 488369 - DNA, 20 bp, Artificial
  CRISPR gRNA sequence
ctgtaatctcagcgctttgg

SEQ ID NO: 488370 - DNA, 20 bp, Artificial
  CRISPR gRNA sequence
tgtaatctcagcgctttggg

SEQ ID NO: 488371 - DNA, 20 bp, Artificial
  CRISPR gRNA sequence
tctcagcgctttgggaggcc

SEQ ID NO: 488372 - DNA, 20 bp, Artificial
  CRISPR gRNA sequence
ctcagcgctttgggaggcca

SEQ ID NO: 488373 - DNA, 20 bp, Artificial
  CRISPR gRNA sequence
agcgctttgggaggccaagg

SEQ ID NO: 488374 - DNA, 20 bp, Artificial
  CRISPR gRNA sequence
gcgctttgggaggccaaggc

SEQ ID NO: 488375 - DNA, 20 bp, Artificial
  CRISPR gRNA sequence
ctttgggaggccaaggcggg

SEQ ID NO: 488376 - DNA, 20 bp, Artificial
  CRISPR gRNA sequence
ccaaggcgggtggatcactt

SEQ ID NO: 488377 - DNA, 20 bp, Artificial
  CRISPR gRNA sequence
gcgggtggatcacttgagcc

SEQ ID NO: 488378 - DNA, 20 bp, Artificial
  CRISPR gRNA sequence
cgggtggatcacttgagccc

SEQ ID NO: 488379 - DNA, 20 bp, Artificial
  CRISPR gRNA sequence
ggtggatcacttgagcccag

SEQ ID NO: 488380 - DNA, 20 bp, Artificial
  CRISPR gRNA sequence
tcacttgagcccaggagttc

SEQ ID NO: 488381 - DNA, 20 bp, Artificial
  CRISPR gRNA sequence
tgagcccaggagttcaagac

SEQ ID NO: 488382 - DNA, 20 bp, Artificial
  CRISPR gRNA sequence
caggagttcaagacaagcct

SEQ ID NO: 488383 - DNA, 20 bp, Artificial
  CRISPR gRNA sequence
caagacaagccttggcaaca

SEQ ID NO: 488384 - DNA, 20 bp, Artificial
  CRISPR gRNA sequence
tctaccaaaaatgcaaaaat

SEQ ID NO: 488385 - DNA, 20 bp, Artificial
  CRISPR gRNA sequence
ccaaaaatgcaaaaattagc

SEQ ID NO: 488386 - DNA, 20 bp, Artificial
  CRISPR gRNA sequence
aattagccagtctcataatc

SEQ ID NO: 488387 - DNA, 20 bp, Artificial
  CRISPR gRNA sequence
tctcaaaataaacataaaaa

SEQ ID NO: 488388 - DNA, 20 bp, Artificial
  CRISPR gRNA sequence
attaaaatgtaaaaataaaa

SEQ ID NO: 488389 - DNA, 20 bp, Artificial
  CRISPR gRNA sequence
ttaaaatgtaaaaataaaaa

SEQ ID NO: 488390 - DNA, 20 bp, Artificial
  CRISPR gRNA sequence
aggaaacatttgtctatctc

SEQ ID NO: 488391 - DNA, 20 bp, Artificial
  CRISPR gRNA sequence
catttgtctatctcaagatg

SEQ ID NO: 488392 - DNA, 20 bp, Artificial
  CRISPR gRNA sequence
ttgtctatctcaagatgtag

SEQ ID NO: 488393 - DNA, 20 bp, Artificial
  CRISPR gRNA sequence
tattctcttgtgctttttcc

SEQ ID NO: 488394 - DNA, 20 bp, Artificial
  CRISPR gRNA sequence
tctcttgtgctttttcctgg

SEQ ID NO: 488395 - DNA, 20 bp, Artificial
  CRISPR gRNA sequence
gctttttcctggaagcttta

SEQ ID NO: 488396 - DNA, 20 bp, Artificial
  CRISPR gRNA sequence
ctttttcctggaagctttat

SEQ ID NO: 488397 - DNA, 20 bp, Artificial
  CRISPR gRNA sequence
tcctggaagctttataggtt

SEQ ID NO: 488398 - DNA, 20 bp, Artificial
  CRISPR gRNA sequence
ttaatttttgtatatgatat

SEQ ID NO: 488399 - DNA, 20 bp, Artificial
  CRISPR gRNA sequence
taatttttgtatatgatatg

SEQ ID NO: 488400 - DNA, 20 bp, Artificial
  CRISPR gRNA sequence
aatttttgtatatgatatga

SEQ ID NO: 488401 - DNA, 20 bp, Artificial
  CRISPR gRNA sequence
tttttgtatatgatatgagg

SEQ ID NO: 488402 - DNA, 20 bp, Artificial
  CRISPR gRNA sequence
tatgatatgagggagatatc

SEQ ID NO: 488403 - DNA, 20 bp, Artificial
  CRISPR gRNA sequence
atgatatgagggagatatca

SEQ ID NO: 488404 - DNA, 20 bp, Artificial
  CRISPR gRNA sequence
atcaaggttttttttcctta

SEQ ID NO: 488405 - DNA, 20 bp, Artificial
  CRISPR gRNA sequence
ttatagatatcaatttgacc

SEQ ID NO: 488406 - DNA, 20 bp, Artificial
  CRISPR gRNA sequence
accaagcaccatttattgaa

SEQ ID NO: 488407 - DNA, 20 bp, Artificial
  CRISPR gRNA sequence
caccatttattgaaaagatc

SEQ ID NO: 488408 - DNA, 20 bp, Artificial
  CRISPR gRNA sequence
tgaaaagatcaagtatgtgt

SEQ ID NO: 488409 - DNA, 20 bp, Artificial
  CRISPR gRNA sequence
gatattgtgaaatatatatt

SEQ ID NO: 488410 - DNA, 20 bp, Artificial
  CRISPR gRNA sequence
tggttttcaacctcctttcc

SEQ ID NO: 488411 - DNA, 20 bp, Artificial
  CRISPR gRNA sequence
catacaattcctaaaatttt

SEQ ID NO: 488412 - DNA, 20 bp, Artificial
  CRISPR gRNA sequence
taaaatttttagaaattccg

SEQ ID NO: 488413 - DNA, 20 bp, Artificial
  CRISPR gRNA sequence
tccgaagtgatgtctttttg

SEQ ID NO: 488414 - DNA, 20 bp, Artificial
  CRISPR gRNA sequence
ccgaagtgatgtctttttgt

SEQ ID NO: 488415 - DNA, 20 bp, Artificial
  CRISPR gRNA sequence
atgtctttttgtaggctaat

SEQ ID NO: 488416 - DNA, 20 bp, Artificial
  CRISPR gRNA sequence
tgtctttttgtaggctaatg

SEQ ID NO: 488417 - DNA, 20 bp, Artificial
  CRISPR gRNA sequence
taggctaatgaggtgaccga

SEQ ID NO: 488418 - DNA, 20 bp, Artificial
  CRISPR gRNA sequence
ctaatgaggtgaccgatggc

SEQ ID NO: 488419 - DNA, 20 bp, Artificial
  CRISPR gRNA sequence
atgaggtgaccgatggctgg

SEQ ID NO: 488420 - DNA, 20 bp, Artificial
  CRISPR gRNA sequence
gaccgatggctggcagcctg

SEQ ID NO: 488421 - DNA, 20 bp, Artificial
  CRISPR gRNA sequence
accgatggctggcagcctgt

SEQ ID NO: 488422 - DNA, 20 bp, Artificial
  CRISPR gRNA sequence
gatggctggcagcctgtagg

SEQ ID NO: 488423 - DNA, 20 bp, Artificial
  CRISPR gRNA sequence
tggcagcctgtaggcagctt

SEQ ID NO: 488424 - DNA, 20 bp, Artificial
  CRISPR gRNA sequence
ggcagcctgtaggcagcttc

SEQ ID NO: 488425 - DNA, 20 bp, Artificial
  CRISPR gRNA sequence
gcctgtaggcagcttcggga

SEQ ID NO: 488426 - DNA, 20 bp, Artificial
  CRISPR gRNA sequence
cctgtaggcagcttcgggat

SEQ ID NO: 488427 - DNA, 20 bp, Artificial
  CRISPR gRNA sequence
ctgtaggcagcttcgggata

SEQ ID NO: 488428 - DNA, 20 bp, Artificial
  CRISPR gRNA sequence
tgtaggcagcttcgggatag

SEQ ID NO: 488429 - DNA, 20 bp, Artificial
  CRISPR gRNA sequence
ggcagcttcgggataggggc

SEQ ID NO: 488430 - DNA, 20 bp, Artificial
  CRISPR gRNA sequence
tcgggataggggccggtcac

SEQ ID NO: 488431 - DNA, 20 bp, Artificial
  CRISPR gRNA sequence
gataggggccggtcaccaga

SEQ ID NO: 488432 - DNA, 20 bp, Artificial
  CRISPR gRNA sequence
ggccggtcaccagaaagacc

SEQ ID NO: 488433 - DNA, 20 bp, Artificial
  CRISPR gRNA sequence
gccggtcaccagaaagacca

SEQ ID NO: 488434 - DNA, 20 bp, Artificial
  CRISPR gRNA sequence
ggtcaccagaaagaccaagg

SEQ ID NO: 488435 - DNA, 20 bp, Artificial
  CRISPR gRNA sequence
gtcaccagaaagaccaaggc

SEQ ID NO: 488436 - DNA, 20 bp, Artificial
  CRISPR gRNA sequence
tcaccagaaagaccaaggca

SEQ ID NO: 488437 - DNA, 20 bp, Artificial
  CRISPR gRNA sequence
cagaaagaccaaggcagggt

SEQ ID NO: 488438 - DNA, 20 bp, Artificial
  CRISPR gRNA sequence
ccaaggcagggttggaatat

SEQ ID NO: 488439 - DNA, 20 bp, Artificial
  CRISPR gRNA sequence
gggttggaatattggactct

SEQ ID NO: 488440 - DNA, 20 bp, Artificial
  CRISPR gRNA sequence
ctgagcccgtccccaacctt

SEQ ID NO: 488441 - DNA, 20 bp, Artificial
  CRISPR gRNA sequence
tgagcccgtccccaaccttc

SEQ ID NO: 488442 - DNA, 20 bp, Artificial
  CRISPR gRNA sequence
ccgtccccaaccttcaggaa

SEQ ID NO: 488443 - DNA, 20 bp, Artificial
  CRISPR gRNA sequence
cgtccccaaccttcaggaaa

SEQ ID NO: 488444 - DNA, 20 bp, Artificial
  CRISPR gRNA sequence
tccccaaccttcaggaaaag

SEQ ID NO: 488445 - DNA, 20 bp, Artificial
  CRISPR gRNA sequence
cccaaccttcaggaaaagga

SEQ ID NO: 488446 - DNA, 20 bp, Artificial
  CRISPR gRNA sequence
ccaaccttcaggaaaaggag

SEQ ID NO: 488447 - DNA, 20 bp, Artificial
  CRISPR gRNA sequence
caaccttcaggaaaaggaga

SEQ ID NO: 488448 - DNA, 20 bp, Artificial
  CRISPR gRNA sequence
caggaaaaggagagggattg

SEQ ID NO: 488449 - DNA, 20 bp, Artificial
  CRISPR gRNA sequence
aggaaaaggagagggattga

SEQ ID NO: 488450 - DNA, 20 bp, Artificial
  CRISPR gRNA sequence
aaggagagggattgaaggtt

SEQ ID NO: 488451 - DNA, 20 bp, Artificial
  CRISPR gRNA sequence
aaggttaagttgatcaccga

SEQ ID NO: 488452 - DNA, 20 bp, Artificial
  CRISPR gRNA sequence
ttaagttgatcaccgatggc

SEQ ID NO: 488453 - DNA, 20 bp, Artificial
  CRISPR gRNA sequence
agttgatcaccgatggccag

SEQ ID NO: 488454 - DNA, 20 bp, Artificial
  CRISPR gRNA sequence
gtcaatcattcccatttatt

SEQ ID NO: 488455 - DNA, 20 bp, Artificial
  CRISPR gRNA sequence
tcaatcattcccatttattg

SEQ ID NO: 488456 - DNA, 20 bp, Artificial
  CRISPR gRNA sequence
gaggcctccataaaaaccca

SEQ ID NO: 488457 - DNA, 20 bp, Artificial
  CRISPR gRNA sequence
tccataaaaacccaaagaac

SEQ ID NO: 488458 - DNA, 20 bp, Artificial
  CRISPR gRNA sequence
ccataaaaacccaaagaaca

SEQ ID NO: 488459 - DNA, 20 bp, Artificial
  CRISPR gRNA sequence
aaaacccaaagaacaaggtt

SEQ ID NO: 488460 - DNA, 20 bp, Artificial
  CRISPR gRNA sequence
aacccaaagaacaaggttca

SEQ ID NO: 488461 - DNA, 20 bp, Artificial
  CRISPR gRNA sequence
cccaaagaacaaggttcaga

SEQ ID NO: 488462 - DNA, 20 bp, Artificial
  CRISPR gRNA sequence
ggttcagagagctaaacatg

SEQ ID NO: 488463 - DNA, 20 bp, Artificial
  CRISPR gRNA sequence
ttcagagagctaaacatgcg

SEQ ID NO: 488464 - DNA, 20 bp, Artificial
  CRISPR gRNA sequence
tcagagagctaaacatgcgg

SEQ ID NO: 488465 - DNA, 20 bp, Artificial
  CRISPR gRNA sequence
gctaaacatgcggaggttcc

SEQ ID NO: 488466 - DNA, 20 bp, Artificial
  CRISPR gRNA sequence
taaacatgcggaggttcctg

SEQ ID NO: 488467 - DNA, 20 bp, Artificial
  CRISPR gRNA sequence
aaacatgcggaggttcctgg

SEQ ID NO: 488468 - DNA, 20 bp, Artificial
  CRISPR gRNA sequence
aacatgcggaggttcctgga

SEQ ID NO: 488469 - DNA, 20 bp, Artificial
  CRISPR gRNA sequence
atgcggaggttcctggaggg

SEQ ID NO: 488470 - DNA, 20 bp, Artificial
  CRISPR gRNA sequence
tcctggagggtggcacgccc

SEQ ID NO: 488471 - DNA, 20 bp, Artificial
  CRISPR gRNA sequence
cctggagggtggcacgccct

SEQ ID NO: 488472 - DNA, 20 bp, Artificial
  CRISPR gRNA sequence
ggagggtggcacgccctggg

SEQ ID NO: 488473 - DNA, 20 bp, Artificial
  CRISPR gRNA sequence
gagggtggcacgccctggga

SEQ ID NO: 488474 - DNA, 20 bp, Artificial
  CRISPR gRNA sequence
tggcacgccctgggaaggca

SEQ ID NO: 488475 - DNA, 20 bp, Artificial
  CRISPR gRNA sequence
ttgtcctatgcatctcttca

SEQ ID NO: 488476 - DNA, 20 bp, Artificial
  CRISPR gRNA sequence
tgtcctatgcatctcttcat

SEQ ID NO: 488477 - DNA, 20 bp, Artificial
  CRISPR gRNA sequence
taataacctttataataatc

SEQ ID NO: 488478 - DNA, 20 bp, Artificial
  CRISPR gRNA sequence
tccagtgaatgtgtttccct

SEQ ID NO: 488479 - DNA, 20 bp, Artificial
  CRISPR gRNA sequence
tgtgtttccctgagttctgt

SEQ ID NO: 488480 - DNA, 20 bp, Artificial
  CRISPR gRNA sequence
cctgagttctgtgagccatc

SEQ ID NO: 488481 - DNA, 20 bp, Artificial
  CRISPR gRNA sequence
ctagcaaattaattgaaccc

SEQ ID NO: 488482 - DNA, 20 bp, Artificial
  CRISPR gRNA sequence
tagcaaattaattgaaccca

SEQ ID NO: 488483 - DNA, 20 bp, Artificial
  CRISPR gRNA sequence
gcaaattaattgaacccaag

SEQ ID NO: 488484 - DNA, 20 bp, Artificial
  CRISPR gRNA sequence
caaattaattgaacccaagg

SEQ ID NO: 488485 - DNA, 20 bp, Artificial
  CRISPR gRNA sequence
aaattaattgaacccaagga

SEQ ID NO: 488486 - DNA, 20 bp, Artificial
  CRISPR gRNA sequence
tgaacccaaggagggaataa

SEQ ID NO: 488487 - DNA, 20 bp, Artificial
  CRISPR gRNA sequence
gaacccaaggagggaataac

SEQ ID NO: 488488 - DNA, 20 bp, Artificial
  CRISPR gRNA sequence
ggagggaataacgggaaacc

SEQ ID NO: 488489 - DNA, 20 bp, Artificial
  CRISPR gRNA sequence
ataacgggaaacccagttta

SEQ ID NO: 488490 - DNA, 20 bp, Artificial
  CRISPR gRNA sequence
cgggaaacccagtttatagc

SEQ ID NO: 488491 - DNA, 20 bp, Artificial
  CRISPR gRNA sequence
aaacccagtttatagctagt

SEQ ID NO: 488492 - DNA, 20 bp, Artificial
  CRISPR gRNA sequence
ccagtttatagctagttggt

SEQ ID NO: 488493 - DNA, 20 bp, Artificial
  CRISPR gRNA sequence
gtttatagctagttggtcag

SEQ ID NO: 488494 - DNA, 20 bp, Artificial
  CRISPR gRNA sequence
tagctagttggtcagaagcg

SEQ ID NO: 488495 - DNA, 20 bp, Artificial
  CRISPR gRNA sequence
agctagttggtcagaagcgc

SEQ ID NO: 488496 - DNA, 20 bp, Artificial
  CRISPR gRNA sequence
gaagcgcaggtaaaacaatc

SEQ ID NO: 488497 - DNA, 20 bp, Artificial
  CRISPR gRNA sequence
agcgcaggtaaaacaatctg

SEQ ID NO: 488498 - DNA, 20 bp, Artificial
  CRISPR gRNA sequence
gtaaaacaatctggagcttg

SEQ ID NO: 488499 - DNA, 20 bp, Artificial
  CRISPR gRNA sequence
aacaatctggagcttgcagt

SEQ ID NO: 488500 - DNA, 20 bp, Artificial
  CRISPR gRNA sequence
tggagcttgcagttggcatc

SEQ ID NO: 488501 - DNA, 20 bp, Artificial
  CRISPR gRNA sequence
agcttgcagttggcatctgg

SEQ ID NO: 488502 - DNA, 20 bp, Artificial
  CRISPR gRNA sequence
tggcatctggtggatatcta

SEQ ID NO: 488503 - DNA, 20 bp, Artificial
  CRISPR gRNA sequence
ggcatctggtggatatctac

SEQ ID NO: 488504 - DNA, 20 bp, Artificial
  CRISPR gRNA sequence
atctggtggatatctacagg

SEQ ID NO: 488505 - DNA, 20 bp, Artificial
  CRISPR gRNA sequence
ggtggatatctacaggtaga

SEQ ID NO: 488506 - DNA, 20 bp, Artificial
  CRISPR gRNA sequence
tatctacaggtagatagtgt

SEQ ID NO: 488507 - DNA, 20 bp, Artificial
  CRISPR gRNA sequence
gtgtcagaattgaactgaat

SEQ ID NO: 488508 - DNA, 20 bp, Artificial
  CRISPR gRNA sequence
gtcagaattgaactgaatta

SEQ ID NO: 488509 - DNA, 20 bp, Artificial
  CRISPR gRNA sequence
tcagaattgaactgaattag

SEQ ID NO: 488510 - DNA, 20 bp, Artificial
  CRISPR gRNA sequence
gaactgaattagaggacatc

SEQ ID NO: 488511 - DNA, 20 bp, Artificial
  CRISPR gRNA sequence
tgaattagaggacatccagt

SEQ ID NO: 488512 - DNA, 20 bp, Artificial
  CRISPR gRNA sequence
catccagttggtgtccactg

SEQ ID NO: 488513 - DNA, 20 bp, Artificial
  CRISPR gRNA sequence
tccagttggtgtccactgaa

SEQ ID NO: 488514 - DNA, 20 bp, Artificial
  CRISPR gRNA sequence
tgaagagctgattgcttgct

SEQ ID NO: 488515 - DNA, 20 bp, Artificial
  CRISPR gRNA sequence
ctgattgcttgcttggcacg

SEQ ID NO: 488516 - DNA, 20 bp, Artificial
  CRISPR gRNA sequence
tgattgcttgcttggcacgt

SEQ ID NO: 488517 - DNA, 20 bp, Artificial
  CRISPR gRNA sequence
gtgggaaactccccacacgt

SEQ ID NO: 488518 - DNA, 20 bp, Artificial
  CRISPR gRNA sequence
aactccccacacgttggtca

SEQ ID NO: 488519 - DNA, 20 bp, Artificial
  CRISPR gRNA sequence
tccccacacgttggtcacag

SEQ ID NO: 488520 - DNA, 20 bp, Artificial
  CRISPR gRNA sequence
gtcttctgtgttgattgttg

SEQ ID NO: 488521 - DNA, 20 bp, Artificial
  CRISPR gRNA sequence
tgattgttgtggtgtgaaac

SEQ ID NO: 488522 - DNA, 20 bp, Artificial
  CRISPR gRNA sequence
attgttgtggtgtgaaacca

SEQ ID NO: 488523 - DNA, 20 bp, Artificial
  CRISPR gRNA sequence
ttgttgtggtgtgaaaccag

SEQ ID NO: 488524 - DNA, 20 bp, Artificial
  CRISPR gRNA sequence
gtgtgaaaccagaggaaaaa

SEQ ID NO: 488525 - DNA, 20 bp, Artificial
  CRISPR gRNA sequence
gaaaccagaggaaaaacagt

SEQ ID NO: 488526 - DNA, 20 bp, Artificial
  CRISPR gRNA sequence
gttagtgtttttcccacaca

SEQ ID NO: 488527 - DNA, 20 bp, Artificial
  CRISPR gRNA sequence
ttagtgtttttcccacacac

SEQ ID NO: 488528 - DNA, 20 bp, Artificial
  CRISPR gRNA sequence
tagtgtttttcccacacaca

SEQ ID NO: 488529 - DNA, 20 bp, Artificial
  CRISPR gRNA sequence
ccacacacagggtctatttc

SEQ ID NO: 488530 - DNA, 20 bp, Artificial
  CRISPR gRNA sequence
cttttcaatccttgcaatac

SEQ ID NO: 488531 - DNA, 20 bp, Artificial
  CRISPR gRNA sequence
gaatgctatcttaatttctg

SEQ ID NO: 488532 - DNA, 20 bp, Artificial
  CRISPR gRNA sequence
tttacaatatatcttgatat

SEQ ID NO: 488533 - DNA, 20 bp, Artificial
  CRISPR gRNA sequence
ttacaatatatcttgatatt

SEQ ID NO: 488534 - DNA, 20 bp, Artificial
  CRISPR gRNA sequence
caatatatcttgatattagg

SEQ ID NO: 488535 - DNA, 20 bp, Artificial
  CRISPR gRNA sequence
attaggtagtgaaaaccttc

SEQ ID NO: 488536 - DNA, 20 bp, Artificial
  CRISPR gRNA sequence
ttctagctttgttcttcatc

SEQ ID NO: 488537 - DNA, 20 bp, Artificial
  CRISPR gRNA sequence
gttcttcatcaagattgcct

SEQ ID NO: 488538 - DNA, 20 bp, Artificial
  CRISPR gRNA sequence
tgtcttttacattttcatat

SEQ ID NO: 488539 - DNA, 20 bp, Artificial
  CRISPR gRNA sequence
ttacattttcatataagttt

SEQ ID NO: 488540 - DNA, 20 bp, Artificial
  CRISPR gRNA sequence
taacctgcaataatttttat

SEQ ID NO: 488541 - DNA, 20 bp, Artificial
  CRISPR gRNA sequence
attgaatctataaattaatt

SEQ ID NO: 488542 - DNA, 20 bp, Artificial
  CRISPR gRNA sequence
ttgaatctataaattaattt

SEQ ID NO: 488543 - DNA, 20 bp, Artificial
  CRISPR gRNA sequence
aatctataaattaatttagg

SEQ ID NO: 488544 - DNA, 20 bp, Artificial
  CRISPR gRNA sequence
tttaggaagaattgacatct

SEQ ID NO: 488545 - DNA, 20 bp, Artificial
  CRISPR gRNA sequence
attgacatcttagcaatatt

SEQ ID NO: 488546 - DNA, 20 bp, Artificial
  CRISPR gRNA sequence
aagtcttccaataaaaacca

SEQ ID NO: 488547 - DNA, 20 bp, Artificial
  CRISPR gRNA sequence
ttccaataaaaaccatggta

SEQ ID NO: 488548 - DNA, 20 bp, Artificial
  CRISPR gRNA sequence
ggtatagtctcctgtttatt

SEQ ID NO: 488549 - DNA, 20 bp, Artificial
  CRISPR gRNA sequence
ttagctctttaattttttct

SEQ ID NO: 488550 - DNA, 20 bp, Artificial
  CRISPR gRNA sequence
tcagcaatcttttgttgcaa

SEQ ID NO: 488551 - DNA, 20 bp, Artificial
  CRISPR gRNA sequence
cagcaatcttttgttgcaat

SEQ ID NO: 488552 - DNA, 20 bp, Artificial
  CRISPR gRNA sequence
cttttgttgcaataggtgta

SEQ ID NO: 488553 - DNA, 20 bp, Artificial
  CRISPR gRNA sequence
ttttgttgcaataggtgtat

SEQ ID NO: 488554 - DNA, 20 bp, Artificial
  CRISPR gRNA sequence
cttttttgtgctgctgtaaa

SEQ ID NO: 488555 - DNA, 20 bp, Artificial
  CRISPR gRNA sequence
tatctgtttgtactaatata

SEQ ID NO: 488556 - DNA, 20 bp, Artificial
  CRISPR gRNA sequence
ttgtatattgaccttatatc

SEQ ID NO: 488557 - DNA, 20 bp, Artificial
  CRISPR gRNA sequence
cactcaaataatttttcata

SEQ ID NO: 488558 - DNA, 20 bp, Artificial
  CRISPR gRNA sequence
aatttttcatatagtcctct

SEQ ID NO: 488559 - DNA, 20 bp, Artificial
  CRISPR gRNA sequence
ctcttggtttcctatataca

SEQ ID NO: 488560 - DNA, 20 bp, Artificial
  CRISPR gRNA sequence
tcttggtttcctatatacac

SEQ ID NO: 488561 - DNA, 20 bp, Artificial
  CRISPR gRNA sequence
ttcctatatacacaggtata

SEQ ID NO: 488562 - DNA, 20 bp, Artificial
  CRISPR gRNA sequence
atatagtttgtgaataatga

SEQ ID NO: 488563 - DNA, 20 bp, Artificial
  CRISPR gRNA sequence
cacatattcatttttttttt

SEQ ID NO: 488564 - DNA, 20 bp, Artificial
  CRISPR gRNA sequence
tattcattttttttttgaga

SEQ ID NO: 488565 - DNA, 20 bp, Artificial
  CRISPR gRNA sequence
ttcattttttttttgagatg

SEQ ID NO: 488566 - DNA, 20 bp, Artificial
  CRISPR gRNA sequence
ggagttttgctcttgttgcc

SEQ ID NO: 488567 - DNA, 20 bp, Artificial
  CRISPR gRNA sequence
gagttttgctcttgttgccc

SEQ ID NO: 488568 - DNA, 20 bp, Artificial
  CRISPR gRNA sequence
tttgctcttgttgcccaggc

SEQ ID NO: 488569 - DNA, 20 bp, Artificial
  CRISPR gRNA sequence
tgctcttgttgcccaggctg

SEQ ID NO: 488570 - DNA, 20 bp, Artificial
  CRISPR gRNA sequence
ttgcccaggctggagtgcaa

SEQ ID NO: 488571 - DNA, 20 bp, Artificial
  CRISPR gRNA sequence
ggagtgcaatggtgccatct

SEQ ID NO: 488572 - DNA, 20 bp, Artificial
  CRISPR gRNA sequence
ggtgccatcttggctcactg

SEQ ID NO: 488573 - DNA, 20 bp, Artificial
  CRISPR gRNA sequence
tcactgcagcctccgcttcc

SEQ ID NO: 488574 - DNA, 20 bp, Artificial
  CRISPR gRNA sequence
cactgcagcctccgcttccc

SEQ ID NO: 488575 - DNA, 20 bp, Artificial
  CRISPR gRNA sequence
agcctccgcttcccgggttc

SEQ ID NO: 488576 - DNA, 20 bp, Artificial
  CRISPR gRNA sequence
ttcaagtgattctcctgcct

SEQ ID NO: 488577 - DNA, 20 bp, Artificial
  CRISPR gRNA sequence
ttctcctgcctcagcctccc

SEQ ID NO: 488578 - DNA, 20 bp, Artificial
  CRISPR gRNA sequence
tcctgcctcagcctcccgag

SEQ ID NO: 488579 - DNA, 20 bp, Artificial
  CRISPR gRNA sequence
gcctcagcctcccgagtagc

SEQ ID NO: 488580 - DNA, 20 bp, Artificial
  CRISPR gRNA sequence
cctcagcctcccgagtagct

SEQ ID NO: 488581 - DNA, 20 bp, Artificial
  CRISPR gRNA sequence
ctcccgagtagctgggattt

SEQ ID NO: 488582 - DNA, 20 bp, Artificial
  CRISPR gRNA sequence
tcccgagtagctgggatttc

SEQ ID NO: 488583 - DNA, 20 bp, Artificial
  CRISPR gRNA sequence
tcaggtgactgccacccgcc

SEQ ID NO: 488584 - DNA, 20 bp, Artificial
  CRISPR gRNA sequence
ctggctaatttttgtatttt

SEQ ID NO: 488585 - DNA, 20 bp, Artificial
  CRISPR gRNA sequence
gctaatttttgtatttttag

SEQ ID NO: 488586 - DNA, 20 bp, Artificial
  CRISPR gRNA sequence
taatttttgtatttttagta

SEQ ID NO: 488587 - DNA, 20 bp, Artificial
  CRISPR gRNA sequence
ttttgtatttttagtagaga

SEQ ID NO: 488588 - DNA, 20 bp, Artificial
  CRISPR gRNA sequence
ttgtatttttagtagagatg

SEQ ID NO: 488589 - DNA, 20 bp, Artificial
  CRISPR gRNA sequence
gagatggagtttcactgtgt

SEQ ID NO: 488590 - DNA, 20 bp, Artificial
  CRISPR gRNA sequence
tggagtttcactgtgttggc

SEQ ID NO: 488591 - DNA, 20 bp, Artificial
  CRISPR gRNA sequence
ggagtttcactgtgttggcc

SEQ ID NO: 488592 - DNA, 20 bp, Artificial
  CRISPR gRNA sequence
tttcactgtgttggccaggc

SEQ ID NO: 488593 - DNA, 20 bp, Artificial
  CRISPR gRNA sequence
tggtctcgaactcctgacct

SEQ ID NO: 488594 - DNA, 20 bp, Artificial
  CRISPR gRNA sequence
ggtctcgaactcctgacctc

SEQ ID NO: 488595 - DNA, 20 bp, Artificial
  CRISPR gRNA sequence
tcgaactcctgacctcaggt

SEQ ID NO: 488596 - DNA, 20 bp, Artificial
  CRISPR gRNA sequence
gacctcaggtgagctgccca

SEQ ID NO: 488597 - DNA, 20 bp, Artificial
  CRISPR gRNA sequence
aggtgagctgcccaaagtgc

SEQ ID NO: 488598 - DNA, 20 bp, Artificial
  CRISPR gRNA sequence
ggtgagctgcccaaagtgct

SEQ ID NO: 488599 - DNA, 20 bp, Artificial
  CRISPR gRNA sequence
tgcccaaagtgctgggatta

SEQ ID NO: 488600 - DNA, 20 bp, Artificial
  CRISPR gRNA sequence
gcccaaagtgctgggattac

SEQ ID NO: 488601 - DNA, 20 bp, Artificial
  CRISPR gRNA sequence
agtgctgggattacaggcgt

SEQ ID NO: 488602 - DNA, 20 bp, Artificial
  CRISPR gRNA sequence
caggcgtgagccactgcgcc

SEQ ID NO: 488603 - DNA, 20 bp, Artificial
  CRISPR gRNA sequence
ttttccttgttttgttgaac

SEQ ID NO: 488604 - DNA, 20 bp, Artificial
  CRISPR gRNA sequence
gttgaactagccatgacctc

SEQ ID NO: 488605 - DNA, 20 bp, Artificial
  CRISPR gRNA sequence
tccagtacaatgttgattaa

SEQ ID NO: 488606 - DNA, 20 bp, Artificial
  CRISPR gRNA sequence
cagtacaatgttgattaaaa

SEQ ID NO: 488607 - DNA, 20 bp, Artificial
  CRISPR gRNA sequence
agtacaatgttgattaaaag

SEQ ID NO: 488608 - DNA, 20 bp, Artificial
  CRISPR gRNA sequence
ttgattaaaagaggtaatta

SEQ ID NO: 488609 - DNA, 20 bp, Artificial
  CRISPR gRNA sequence
ggaatcctttttctgttcct

SEQ ID NO: 488610 - DNA, 20 bp, Artificial
  CRISPR gRNA sequence
tttttctgttcctgagtttg

SEQ ID NO: 488611 - DNA, 20 bp, Artificial
  CRISPR gRNA sequence
ttttctgttcctgagtttgc

SEQ ID NO: 488612 - DNA, 20 bp, Artificial
  CRISPR gRNA sequence
tttctgttcctgagtttgca

SEQ ID NO: 488613 - DNA, 20 bp, Artificial
  CRISPR gRNA sequence
ttcctgagtttgcagggaca

SEQ ID NO: 488614 - DNA, 20 bp, Artificial
  CRISPR gRNA sequence
agtttgcagggacatggatg

SEQ ID NO: 488615 - DNA, 20 bp, Artificial
  CRISPR gRNA sequence
tgcagggacatggatgaagc

SEQ ID NO: 488616 - DNA, 20 bp, Artificial
  CRISPR gRNA sequence
agggacatggatgaagctgg

SEQ ID NO: 488617 - DNA, 20 bp, Artificial
  CRISPR gRNA sequence
aagctggaagccatcgttct

SEQ ID NO: 488618 - DNA, 20 bp, Artificial
  CRISPR gRNA sequence
tcgttctcagcaaactaaca

SEQ ID NO: 488619 - DNA, 20 bp, Artificial
  CRISPR gRNA sequence
cgttctcagcaaactaacac

SEQ ID NO: 488620 - DNA, 20 bp, Artificial
  CRISPR gRNA sequence
tcagcaaactaacacaggaa

SEQ ID NO: 488621 - DNA, 20 bp, Artificial
  CRISPR gRNA sequence
acaccacgtgttctcactca

SEQ ID NO: 488622 - DNA, 20 bp, Artificial
  CRISPR gRNA sequence
ccacgtgttctcactcaaag

SEQ ID NO: 488623 - DNA, 20 bp, Artificial
  CRISPR gRNA sequence
cacgtgttctcactcaaagt

SEQ ID NO: 488624 - DNA, 20 bp, Artificial
  CRISPR gRNA sequence
cgtgttctcactcaaagtgg

SEQ ID NO: 488625 - DNA, 20 bp, Artificial
  CRISPR gRNA sequence
caaagtgggagttgaacaat

SEQ ID NO: 488626 - DNA, 20 bp, Artificial
  CRISPR gRNA sequence
agttgaacaatgagaacata

SEQ ID NO: 488627 - DNA, 20 bp, Artificial
  CRISPR gRNA sequence
gttgaacaatgagaacatat

SEQ ID NO: 488628 - DNA, 20 bp, Artificial
  CRISPR gRNA sequence
acaatgagaacatatgggca

SEQ ID NO: 488629 - DNA, 20 bp, Artificial
  CRISPR gRNA sequence
caatgagaacatatgggcac

SEQ ID NO: 488630 - DNA, 20 bp, Artificial
  CRISPR gRNA sequence
aatgagaacatatgggcaca

SEQ ID NO: 488631 - DNA, 20 bp, Artificial
  CRISPR gRNA sequence
agaacatatgggcacaggga

SEQ ID NO: 488632 - DNA, 20 bp, Artificial
  CRISPR gRNA sequence
gaacatatgggcacagggac

SEQ ID NO: 488633 - DNA, 20 bp, Artificial
  CRISPR gRNA sequence
gggacgggaatatcacacac

SEQ ID NO: 488634 - DNA, 20 bp, Artificial
  CRISPR gRNA sequence
ggacgggaatatcacacacc

SEQ ID NO: 488635 - DNA, 20 bp, Artificial
  CRISPR gRNA sequence
gacgggaatatcacacacca

SEQ ID NO: 488636 - DNA, 20 bp, Artificial
  CRISPR gRNA sequence
tatcacacaccagggcctgt

SEQ ID NO: 488637 - DNA, 20 bp, Artificial
  CRISPR gRNA sequence
cacacaccagggcctgttag

SEQ ID NO: 488638 - DNA, 20 bp, Artificial
  CRISPR gRNA sequence
acacaccagggcctgttagt

SEQ ID NO: 488639 - DNA, 20 bp, Artificial
  CRISPR gRNA sequence
accagggcctgttagtgggt

SEQ ID NO: 488640 - DNA, 20 bp, Artificial
  CRISPR gRNA sequence
ccagggcctgttagtgggtg

SEQ ID NO: 488641 - DNA, 20 bp, Artificial
  CRISPR gRNA sequence
cagggcctgttagtgggtga

SEQ ID NO: 488642 - DNA, 20 bp, Artificial
  CRISPR gRNA sequence
agggcctgttagtgggtgag

SEQ ID NO: 488643 - DNA, 20 bp, Artificial
  CRISPR gRNA sequence
cctgttagtgggtgaggggc

SEQ ID NO: 488644 - DNA, 20 bp, Artificial
  CRISPR gRNA sequence
ctgttagtgggtgaggggca

SEQ ID NO: 488645 - DNA, 20 bp, Artificial
  CRISPR gRNA sequence
tgttagtgggtgaggggcaa

SEQ ID NO: 488646 - DNA, 20 bp, Artificial
  CRISPR gRNA sequence
gttagtgggtgaggggcaag

SEQ ID NO: 488647 - DNA, 20 bp, Artificial
  CRISPR gRNA sequence
tagtgggtgaggggcaaggg

SEQ ID NO: 488648 - DNA, 20 bp, Artificial
  CRISPR gRNA sequence
agtgggtgaggggcaagggg

SEQ ID NO: 488649 - DNA, 20 bp, Artificial
  CRISPR gRNA sequence
gtgggtgaggggcaagggga

SEQ ID NO: 488650 - DNA, 20 bp, Artificial
  CRISPR gRNA sequence
gggtgaggggcaaggggagg

SEQ ID NO: 488651 - DNA, 20 bp, Artificial
  CRISPR gRNA sequence
ggtgaggggcaaggggaggg

SEQ ID NO: 488652 - DNA, 20 bp, Artificial
  CRISPR gRNA sequence
gggcaaggggagggaggcat

SEQ ID NO: 488653 - DNA, 20 bp, Artificial
  CRISPR gRNA sequence
ggcaaggggagggaggcatt

SEQ ID NO: 488654 - DNA, 20 bp, Artificial
  CRISPR gRNA sequence
ggacaaatacctaatgcatg

SEQ ID NO: 488655 - DNA, 20 bp, Artificial
  CRISPR gRNA sequence
gacaaatacctaatgcatgt

SEQ ID NO: 488656 - DNA, 20 bp, Artificial
  CRISPR gRNA sequence
acaaatacctaatgcatgtg

SEQ ID NO: 488657 - DNA, 20 bp, Artificial
  CRISPR gRNA sequence
tgcatgtggggcttaaaacc

SEQ ID NO: 488658 - DNA, 20 bp, Artificial
  CRISPR gRNA sequence
ggggcttaaaacctagatga

SEQ ID NO: 488659 - DNA, 20 bp, Artificial
  CRISPR gRNA sequence
gggcttaaaacctagatgat

SEQ ID NO: 488660 - DNA, 20 bp, Artificial
  CRISPR gRNA sequence
aaacctagatgatgggttga

SEQ ID NO: 488661 - DNA, 20 bp, Artificial
  CRISPR gRNA sequence
aacctagatgatgggttgat

SEQ ID NO: 488662 - DNA, 20 bp, Artificial
  CRISPR gRNA sequence
agatgatgggttgataggtg

SEQ ID NO: 488663 - DNA, 20 bp, Artificial
  CRISPR gRNA sequence
ataggtgcagcaaaccacca

SEQ ID NO: 488664 - DNA, 20 bp, Artificial
  CRISPR gRNA sequence
catgttctgcatacgtatcc

SEQ ID NO: 488665 - DNA, 20 bp, Artificial
  CRISPR gRNA sequence
catacgtatcccagaactta

SEQ ID NO: 488666 - DNA, 20 bp, Artificial
  CRISPR gRNA sequence
agtaaaacaaaaaaaaaaaa

SEQ ID NO: 488667 - DNA, 20 bp, Artificial
  CRISPR gRNA sequence
aaacaaaaaaaaaaaaaaga

SEQ ID NO: 488668 - DNA, 20 bp, Artificial
  CRISPR gRNA sequence
acaaaaaaaaaaaaaagaaa

SEQ ID NO: 488669 - DNA, 20 bp, Artificial
  CRISPR gRNA sequence
aaaaaaaaaaaagaaagaga

SEQ ID NO: 488670 - DNA, 20 bp, Artificial
  CRISPR gRNA sequence
aaaaaaaaaaagaaagagat

SEQ ID NO: 488671 - DNA, 20 bp, Artificial
  CRISPR gRNA sequence
aataataacaatcatcaaca

SEQ ID NO: 488672 - DNA, 20 bp, Artificial
  CRISPR gRNA sequence
aataacaatcatcaacatag

SEQ ID NO: 488673 - DNA, 20 bp, Artificial
  CRISPR gRNA sequence
aagacttctgtgaccaaatg

SEQ ID NO: 488674 - DNA, 20 bp, Artificial
  CRISPR gRNA sequence
agacttctgtgaccaaatgc

SEQ ID NO: 488675 - DNA, 20 bp, Artificial
  CRISPR gRNA sequence
gacttctgtgaccaaatgca

SEQ ID NO: 488676 - DNA, 20 bp, Artificial
  CRISPR gRNA sequence
cttctgtgaccaaatgcagg

SEQ ID NO: 488677 - DNA, 20 bp, Artificial
  CRISPR gRNA sequence
ttctgtgaccaaatgcaggg

SEQ ID NO: 488678 - DNA, 20 bp, Artificial
  CRISPR gRNA sequence
tgtgaccaaatgcagggagg

SEQ ID NO: 488679 - DNA, 20 bp, Artificial
  CRISPR gRNA sequence
gggaggtggatttctcctca

SEQ ID NO: 488680 - DNA, 20 bp, Artificial
  CRISPR gRNA sequence
aaactgaataatgtattctg

SEQ ID NO: 488681 - DNA, 20 bp, Artificial
  CRISPR gRNA sequence
ctgaataatgtattctgcag

SEQ ID NO: 488682 - DNA, 20 bp, Artificial
  CRISPR gRNA sequence
atgtattctgcagtggacac

SEQ ID NO: 488683 - DNA, 20 bp, Artificial
  CRISPR gRNA sequence
attctgcagtggacaccagc

SEQ ID NO: 488684 - DNA, 20 bp, Artificial
  CRISPR gRNA sequence
ttctgcagtggacaccagct

SEQ ID NO: 488685 - DNA, 20 bp, Artificial
  CRISPR gRNA sequence
cagctgggtgttctccaatt

SEQ ID NO: 488686 - DNA, 20 bp, Artificial
  CRISPR gRNA sequence
gggtgttctccaattcagtt

SEQ ID NO: 488687 - DNA, 20 bp, Artificial
  CRISPR gRNA sequence
aattcagttcagacactaac

SEQ ID NO: 488688 - DNA, 20 bp, Artificial
  CRISPR gRNA sequence
ttcagttcagacactaactg

SEQ ID NO: 488689 - DNA, 20 bp, Artificial
  CRISPR gRNA sequence
cagttcagacactaactgga

SEQ ID NO: 488690 - DNA, 20 bp, Artificial
  CRISPR gRNA sequence
gttcagacactaactggaga

SEQ ID NO: 488691 - DNA, 20 bp, Artificial
  CRISPR gRNA sequence
acactaactggagagagtgt

SEQ ID NO: 488692 - DNA, 20 bp, Artificial
  CRISPR gRNA sequence
ctggagagagtgtcagacca

SEQ ID NO: 488693 - DNA, 20 bp, Artificial
  CRISPR gRNA sequence
ggagagagtgtcagaccaca

SEQ ID NO: 488694 - DNA, 20 bp, Artificial
  CRISPR gRNA sequence
gagagagtgtcagaccacag

SEQ ID NO: 488695 - DNA, 20 bp, Artificial
  CRISPR gRNA sequence
gagtgtcagaccacagaggc

SEQ ID NO: 488696 - DNA, 20 bp, Artificial
  CRISPR gRNA sequence
agtgtcagaccacagaggct

SEQ ID NO: 488697 - DNA, 20 bp, Artificial
  CRISPR gRNA sequence
gtgtcagaccacagaggctg

SEQ ID NO: 488698 - DNA, 20 bp, Artificial
  CRISPR gRNA sequence
tgtcagaccacagaggctgg

SEQ ID NO: 488699 - DNA, 20 bp, Artificial
  CRISPR gRNA sequence
gaccacagaggctgggggct

SEQ ID NO: 488700 - DNA, 20 bp, Artificial
  CRISPR gRNA sequence
acaccacccctccaccacac

SEQ ID NO: 488701 - DNA, 20 bp, Artificial
  CRISPR gRNA sequence
ccctccaccacaccagttct

SEQ ID NO: 488702 - DNA, 20 bp, Artificial
  CRISPR gRNA sequence
caccacaccagttctaagtc

SEQ ID NO: 488703 - DNA, 20 bp, Artificial
  CRISPR gRNA sequence
accacaccagttctaagtct

SEQ ID NO: 488704 - DNA, 20 bp, Artificial
  CRISPR gRNA sequence
cagttctaagtctgggcctc

SEQ ID NO: 488705 - DNA, 20 bp, Artificial
  CRISPR gRNA sequence
agtctgggcctccagaactt

SEQ ID NO: 488706 - DNA, 20 bp, Artificial
  CRISPR gRNA sequence
ctccagaacttcggaccaac

SEQ ID NO: 488707 - DNA, 20 bp, Artificial
  CRISPR gRNA sequence
acttcggaccaaccagcttc

SEQ ID NO: 488708 - DNA, 20 bp, Artificial
  CRISPR gRNA sequence
cggaccaaccagcttccagt

SEQ ID NO: 488709 - DNA, 20 bp, Artificial
  CRISPR gRNA sequence
ggaccaaccagcttccagtt

SEQ ID NO: 488710 - DNA, 20 bp, Artificial
  CRISPR gRNA sequence
gaccaaccagcttccagttg

SEQ ID NO: 488711 - DNA, 20 bp, Artificial
  CRISPR gRNA sequence
ggttctcacaaccccctcct

SEQ ID NO: 488712 - DNA, 20 bp, Artificial
  CRISPR gRNA sequence
gttctcacaaccccctcctt

SEQ ID NO: 488713 - DNA, 20 bp, Artificial
  CRISPR gRNA sequence
cttgggttcaattaatttgc

SEQ ID NO: 488714 - DNA, 20 bp, Artificial
  CRISPR gRNA sequence
tgggttcaattaatttgctg

SEQ ID NO: 488715 - DNA, 20 bp, Artificial
  CRISPR gRNA sequence
gttcaattaatttgctggag

SEQ ID NO: 488716 - DNA, 20 bp, Artificial
  CRISPR gRNA sequence
ctggagtggctcacataaac

SEQ ID NO: 488717 - DNA, 20 bp, Artificial
  CRISPR gRNA sequence
tggagtggctcacataaacc

SEQ ID NO: 488718 - DNA, 20 bp, Artificial
  CRISPR gRNA sequence
ggagtggctcacataaacca

SEQ ID NO: 488719 - DNA, 20 bp, Artificial
  CRISPR gRNA sequence
agggaaacatttatgtttgc

SEQ ID NO: 488720 - DNA, 20 bp, Artificial
  CRISPR gRNA sequence
tatgtttgctggtctattat

SEQ ID NO: 488721 - DNA, 20 bp, Artificial
  CRISPR gRNA sequence
tgtttgctggtctattataa

SEQ ID NO: 488722 - DNA, 20 bp, Artificial
  CRISPR gRNA sequence
ctattataagagatattaca

SEQ ID NO: 488723 - DNA, 20 bp, Artificial
  CRISPR gRNA sequence
tattataagagatattacaa

SEQ ID NO: 488724 - DNA, 20 bp, Artificial
  CRISPR gRNA sequence
aagagatattacaaaggata

SEQ ID NO: 488725 - DNA, 20 bp, Artificial
  CRISPR gRNA sequence
tattacaaaggatacagatg

SEQ ID NO: 488726 - DNA, 20 bp, Artificial
  CRISPR gRNA sequence
ttacaaaggatacagatgaa

SEQ ID NO: 488727 - DNA, 20 bp, Artificial
  CRISPR gRNA sequence
aaaggatacagatgaagaga

SEQ ID NO: 488728 - DNA, 20 bp, Artificial
  CRISPR gRNA sequence
atacagatgaagagatggca

SEQ ID NO: 488729 - DNA, 20 bp, Artificial
  CRISPR gRNA sequence
tacagatgaagagatggcat

SEQ ID NO: 488730 - DNA, 20 bp, Artificial
  CRISPR gRNA sequence
acagatgaagagatggcata

SEQ ID NO: 488731 - DNA, 20 bp, Artificial
  CRISPR gRNA sequence
atgaagagatggcatagggc

SEQ ID NO: 488732 - DNA, 20 bp, Artificial
  CRISPR gRNA sequence
tgaagagatggcatagggca

SEQ ID NO: 488733 - DNA, 20 bp, Artificial
  CRISPR gRNA sequence
agatggcatagggcaaggta

SEQ ID NO: 488734 - DNA, 20 bp, Artificial
  CRISPR gRNA sequence
gatggcatagggcaaggtat

SEQ ID NO: 488735 - DNA, 20 bp, Artificial
  CRISPR gRNA sequence
atggcatagggcaaggtatg

SEQ ID NO: 488736 - DNA, 20 bp, Artificial
  CRISPR gRNA sequence
tggcatagggcaaggtatgg

SEQ ID NO: 488737 - DNA, 20 bp, Artificial
  CRISPR gRNA sequence
catagggcaaggtatggggg

SEQ ID NO: 488738 - DNA, 20 bp, Artificial
  CRISPR gRNA sequence
atagggcaaggtatggggga

SEQ ID NO: 488739 - DNA, 20 bp, Artificial
  CRISPR gRNA sequence
tagggcaaggtatgggggaa

SEQ ID NO: 488740 - DNA, 20 bp, Artificial
  CRISPR gRNA sequence
ggtatgggggaagggacacg

SEQ ID NO: 488741 - DNA, 20 bp, Artificial
  CRISPR gRNA sequence
cgaagcttccatgccttccc

SEQ ID NO: 488742 - DNA, 20 bp, Artificial
  CRISPR gRNA sequence
gaagcttccatgccttccct

SEQ ID NO: 488743 - DNA, 20 bp, Artificial
  CRISPR gRNA sequence
tccctgggcacactgcatgc

SEQ ID NO: 488744 - DNA, 20 bp, Artificial
  CRISPR gRNA sequence
ccctgggcacactgcatgcc

SEQ ID NO: 488745 - DNA, 20 bp, Artificial
  CRISPR gRNA sequence
cactgcatgccaggaatctc

SEQ ID NO: 488746 - DNA, 20 bp, Artificial
  CRISPR gRNA sequence
gccaggaatctccagctatc

SEQ ID NO: 488747 - DNA, 20 bp, Artificial
  CRISPR gRNA sequence
caggaatctccagctatctg

SEQ ID NO: 488748 - DNA, 20 bp, Artificial
  CRISPR gRNA sequence
aggaatctccagctatctgg

SEQ ID NO: 488749 - DNA, 20 bp, Artificial
  CRISPR gRNA sequence
cagctatctggaggctctcc

SEQ ID NO: 488750 - DNA, 20 bp, Artificial
  CRISPR gRNA sequence
atctggaggctctccaagcc

SEQ ID NO: 488751 - DNA, 20 bp, Artificial
  CRISPR gRNA sequence
ctctccaagcccagtcctct

SEQ ID NO: 488752 - DNA, 20 bp, Artificial
  CRISPR gRNA sequence
tctccaagcccagtcctctt

SEQ ID NO: 488753 - DNA, 20 bp, Artificial
  CRISPR gRNA sequence
ccagtcctcttgggttttta

SEQ ID NO: 488754 - DNA, 20 bp, Artificial
  CRISPR gRNA sequence
agtcctcttgggtttttatg

SEQ ID NO: 488755 - DNA, 20 bp, Artificial
  CRISPR gRNA sequence
tttatggagacttcacttca

SEQ ID NO: 488756 - DNA, 20 bp, Artificial
  CRISPR gRNA sequence
ttatggagacttcacttcat

SEQ ID NO: 488757 - DNA, 20 bp, Artificial
  CRISPR gRNA sequence
aggcatgaccaacaaccttg

SEQ ID NO: 488758 - DNA, 20 bp, Artificial
  CRISPR gRNA sequence
caaccttgtagaaatgtgac

SEQ ID NO: 488759 - DNA, 20 bp, Artificial
  CRISPR gRNA sequence
tagaaatgtgactggatgaa

SEQ ID NO: 488760 - DNA, 20 bp, Artificial
  CRISPR gRNA sequence
agaaatgtgactggatgaaa

SEQ ID NO: 488761 - DNA, 20 bp, Artificial
  CRISPR gRNA sequence
gaaatgtgactggatgaaaa

SEQ ID NO: 488762 - DNA, 20 bp, Artificial
  CRISPR gRNA sequence
agggtatgattccatactaa

SEQ ID NO: 488763 - DNA, 20 bp, Artificial
  CRISPR gRNA sequence
gggtatgattccatactaac

SEQ ID NO: 488764 - DNA, 20 bp, Artificial
  CRISPR gRNA sequence
tgattccatactaacaggct

SEQ ID NO: 488765 - DNA, 20 bp, Artificial
  CRISPR gRNA sequence
ttccatactaacaggctgag

SEQ ID NO: 488766 - DNA, 20 bp, Artificial
  CRISPR gRNA sequence
ccatactaacaggctgagtg

SEQ ID NO: 488767 - DNA, 20 bp, Artificial
  CRISPR gRNA sequence
acaggctgagtggagaaacc

SEQ ID NO: 488768 - DNA, 20 bp, Artificial
  CRISPR gRNA sequence
gctgagtggagaaacccagc

SEQ ID NO: 488769 - DNA, 20 bp, Artificial
  CRISPR gRNA sequence
ctgagtggagaaacccagca

SEQ ID NO: 488770 - DNA, 20 bp, Artificial
  CRISPR gRNA sequence
cccagcaaggcctgtctgtt

SEQ ID NO: 488771 - DNA, 20 bp, Artificial
  CRISPR gRNA sequence
ctgtctgttcagattcttct

SEQ ID NO: 488772 - DNA, 20 bp, Artificial
  CRISPR gRNA sequence
ttcttcttggtctctctgtg

SEQ ID NO: 488773 - DNA, 20 bp, Artificial
  CRISPR gRNA sequence
ctgtgtagcatttctttctc

SEQ ID NO: 488774 - DNA, 20 bp, Artificial
  CRISPR gRNA sequence
catttctttctctagaatct

SEQ ID NO: 488775 - DNA, 20 bp, Artificial
  CRISPR gRNA sequence
atttctttctctagaatctg

SEQ ID NO: 488776 - DNA, 20 bp, Artificial
  CRISPR gRNA sequence
tctttctctagaatctgagg

SEQ ID NO: 488777 - DNA, 20 bp, Artificial
  CRISPR gRNA sequence
ctttctctagaatctgaggc

SEQ ID NO: 488778 - DNA, 20 bp, Artificial
  CRISPR gRNA sequence
ggcaggaacttctctgaaat

SEQ ID NO: 488779 - DNA, 20 bp, Artificial
  CRISPR gRNA sequence
gcaggaacttctctgaaatg

SEQ ID NO: 488780 - DNA, 20 bp, Artificial
  CRISPR gRNA sequence
caggaacttctctgaaatga

SEQ ID NO: 488781 - DNA, 20 bp, Artificial
  CRISPR gRNA sequence
gagggtcttttgatttatat

SEQ ID NO: 488782 - DNA, 20 bp, Artificial
  CRISPR gRNA sequence
tcttttgatttatatcagat

SEQ ID NO: 488783 - DNA, 20 bp, Artificial
  CRISPR gRNA sequence
ttttgatttatatcagatta

SEQ ID NO: 488784 - DNA, 20 bp, Artificial
  CRISPR gRNA sequence
agattagagttgtctacact

SEQ ID NO: 488785 - DNA, 20 bp, Artificial
  CRISPR gRNA sequence
gagttgtctacactcagcaa

SEQ ID NO: 488786 - DNA, 20 bp, Artificial
  CRISPR gRNA sequence
agcaatggtgatcttcttgc

SEQ ID NO: 488787 - DNA, 20 bp, Artificial
  CRISPR gRNA sequence
cttgctggtcttgccattcc

SEQ ID NO: 488788 - DNA, 20 bp, Artificial
  CRISPR gRNA sequence
tcttgccattcctggaccca

SEQ ID NO: 488789 - DNA, 20 bp, Artificial
  CRISPR gRNA sequence
cttgccattcctggacccaa

SEQ ID NO: 488790 - DNA, 20 bp, Artificial
  CRISPR gRNA sequence
ttgccattcctggacccaaa

SEQ ID NO: 488791 - DNA, 20 bp, Artificial
  CRISPR gRNA sequence
acgcttgccatccatccatt

SEQ ID NO: 488792 - DNA, 20 bp, Artificial
  CRISPR gRNA sequence
gccatccatccattcagtct

SEQ ID NO: 488793 - DNA, 20 bp, Artificial
  CRISPR gRNA sequence
tccattcagtctcggcaatg

SEQ ID NO: 488794 - DNA, 20 bp, Artificial
  CRISPR gRNA sequence
cggcaatgtagatgaaaaac

SEQ ID NO: 488795 - DNA, 20 bp, Artificial
  CRISPR gRNA sequence
ggcaatgtagatgaaaaact

SEQ ID NO: 488796 - DNA, 20 bp, Artificial
  CRISPR gRNA sequence
aaactgggaactatttgtgt

SEQ ID NO: 488797 - DNA, 20 bp, Artificial
  CRISPR gRNA sequence
aactgggaactatttgtgtt

SEQ ID NO: 488798 - DNA, 20 bp, Artificial
  CRISPR gRNA sequence
ggaactatttgtgttgggtc

SEQ ID NO: 488799 - DNA, 20 bp, Artificial
  CRISPR gRNA sequence
gttgggtccagcatttgcca

SEQ ID NO: 488800 - DNA, 20 bp, Artificial
  CRISPR gRNA sequence
gtccagcatttgccatggac

SEQ ID NO: 488801 - DNA, 20 bp, Artificial
  CRISPR gRNA sequence
tttgccatggacaagatgcc

SEQ ID NO: 488802 - DNA, 20 bp, Artificial
  CRISPR gRNA sequence
atgccaagacctgtatgctt

SEQ ID NO: 488803 - DNA, 20 bp, Artificial
  CRISPR gRNA sequence
tgccaagacctgtatgcttc

SEQ ID NO: 488804 - DNA, 20 bp, Artificial
  CRISPR gRNA sequence
gacctgtatgcttcaggatg

SEQ ID NO: 488805 - DNA, 20 bp, Artificial
  CRISPR gRNA sequence
caccatcaaatttcacccca

SEQ ID NO: 488806 - DNA, 20 bp, Artificial
  CRISPR gRNA sequence
cccatagatgaacttgccac

SEQ ID NO: 488807 - DNA, 20 bp, Artificial
  CRISPR gRNA sequence
acttgccaccagtgccatta

SEQ ID NO: 488808 - DNA, 20 bp, Artificial
  CRISPR gRNA sequence
ggtgtgtgatgtcaacatcc

SEQ ID NO: 488809 - DNA, 20 bp, Artificial
  CRISPR gRNA sequence
aaattctgcaataatcctgt

SEQ ID NO: 488810 - DNA, 20 bp, Artificial
  CRISPR gRNA sequence
attctgcaataatcctgtga

SEQ ID NO: 488811 - DNA, 20 bp, Artificial
  CRISPR gRNA sequence
ctgcaataatcctgtgagag

SEQ ID NO: 488812 - DNA, 20 bp, Artificial
  CRISPR gRNA sequence
tgcaataatcctgtgagagc

SEQ ID NO: 488813 - DNA, 20 bp, Artificial
  CRISPR gRNA sequence
caataatcctgtgagagcag

SEQ ID NO: 488814 - DNA, 20 bp, Artificial
  CRISPR gRNA sequence
gtaaccaaatcatttctctc

SEQ ID NO: 488815 - DNA, 20 bp, Artificial
  CRISPR gRNA sequence
aatcatttctctctagtgct

SEQ ID NO: 488816 - DNA, 20 bp, Artificial
  CRISPR gRNA sequence
caaatgttttctgctgtctt

SEQ ID NO: 488817 - DNA, 20 bp, Artificial
  CRISPR gRNA sequence
tttggaactttatgtgcaaa

SEQ ID NO: 488818 - DNA, 20 bp, Artificial
  CRISPR gRNA sequence
ctttatgtgcaaacagctcc

SEQ ID NO: 488819 - DNA, 20 bp, Artificial
  CRISPR gRNA sequence
tttatgtgcaaacagctcca

SEQ ID NO: 488820 - DNA, 20 bp, Artificial
  CRISPR gRNA sequence
tatgtgcaaacagctccaag

SEQ ID NO: 488821 - DNA, 20 bp, Artificial
  CRISPR gRNA sequence
caaacagctccaaggagaca

SEQ ID NO: 488822 - DNA, 20 bp, Artificial
  CRISPR gRNA sequence
gctccaaggagacacggtcc

SEQ ID NO: 488823 - DNA, 20 bp, Artificial
  CRISPR gRNA sequence
ctccaaggagacacggtcca

SEQ ID NO: 488824 - DNA, 20 bp, Artificial
  CRISPR gRNA sequence
tccaaggagacacggtccaa

SEQ ID NO: 488825 - DNA, 20 bp, Artificial
  CRISPR gRNA sequence
agacacggtccaagggttca

SEQ ID NO: 488826 - DNA, 20 bp, Artificial
  CRISPR gRNA sequence
aactgctatattaatgaaca

SEQ ID NO: 488827 - DNA, 20 bp, Artificial
  CRISPR gRNA sequence
tgctatattaatgaacatgg

SEQ ID NO: 488828 - DNA, 20 bp, Artificial
  CRISPR gRNA sequence
gctatattaatgaacatggt

SEQ ID NO: 488829 - DNA, 20 bp, Artificial
  CRISPR gRNA sequence
ctatattaatgaacatggtg

SEQ ID NO: 488830 - DNA, 20 bp, Artificial
  CRISPR gRNA sequence
gaacatggtggggttgacta

SEQ ID NO: 488831 - DNA, 20 bp, Artificial
  CRISPR gRNA sequence
gtggggttgactacggttga

SEQ ID NO: 488832 - DNA, 20 bp, Artificial
  CRISPR gRNA sequence
ggttgactacggttgatagc

SEQ ID NO: 488833 - DNA, 20 bp, Artificial
  CRISPR gRNA sequence
ttgactacggttgatagcaa

SEQ ID NO: 488834 - DNA, 20 bp, Artificial
  CRISPR gRNA sequence
cggttgatagcaagagactc

SEQ ID NO: 488835 - DNA, 20 bp, Artificial
  CRISPR gRNA sequence
ggttgatagcaagagactct

SEQ ID NO: 488836 - DNA, 20 bp, Artificial
  CRISPR gRNA sequence
tgatagcaagagactctagg

SEQ ID NO: 488837 - DNA, 20 bp, Artificial
  CRISPR gRNA sequence
gcaagagactctaggtggtg

SEQ ID NO: 488838 - DNA, 20 bp, Artificial
  CRISPR gRNA sequence
caagagactctaggtggtga

SEQ ID NO: 488839 - DNA, 20 bp, Artificial
  CRISPR gRNA sequence
aggtggtgaaggcacctcca

SEQ ID NO: 488840 - DNA, 20 bp, Artificial
  CRISPR gRNA sequence
tgaaggcacctccaaagcac

SEQ ID NO: 488841 - DNA, 20 bp, Artificial
  CRISPR gRNA sequence
gaaggcacctccaaagcacc

SEQ ID NO: 488842 - DNA, 20 bp, Artificial
  CRISPR gRNA sequence
ttatttaatgaatttacttt

SEQ ID NO: 488843 - DNA, 20 bp, Artificial
  CRISPR gRNA sequence
atttgctttttattttattg

SEQ ID NO: 488844 - DNA, 20 bp, Artificial
  CRISPR gRNA sequence
gctttttattttattgaagt

SEQ ID NO: 488845 - DNA, 20 bp, Artificial
  CRISPR gRNA sequence
tttctcctttctcctttctc

SEQ ID NO: 488846 - DNA, 20 bp, Artificial
  CRISPR gRNA sequence
aattactatttctttttctt

SEQ ID NO: 488847 - DNA, 20 bp, Artificial
  CRISPR gRNA sequence
ttctttttctttggtttctt

SEQ ID NO: 488848 - DNA, 20 bp, Artificial
  CRISPR gRNA sequence
ttttccaatatacaaattta

SEQ ID NO: 488849 - DNA, 20 bp, Artificial
  CRISPR gRNA sequence
tttccctctaaacactgcct

SEQ ID NO: 488850 - DNA, 20 bp, Artificial
  CRISPR gRNA sequence
ttgatttattctttgactca

SEQ ID NO: 488851 - DNA, 20 bp, Artificial
  CRISPR gRNA sequence
tgatttattctttgactcat

SEQ ID NO: 488852 - DNA, 20 bp, Artificial
  CRISPR gRNA sequence
ttctttgactcatgggtttt

SEQ ID NO: 488853 - DNA, 20 bp, Artificial
  CRISPR gRNA sequence
tttcttatgttttaaacatt

SEQ ID NO: 488854 - DNA, 20 bp, Artificial
  CRISPR gRNA sequence
tcttatgttttaaacattca

SEQ ID NO: 488855 - DNA, 20 bp, Artificial
  CRISPR gRNA sequence
ttaaacattcagagattttc

SEQ ID NO: 488856 - DNA, 20 bp, Artificial
  CRISPR gRNA sequence
ttgtttaattctactgtgct

SEQ ID NO: 488857 - DNA, 20 bp, Artificial
  CRISPR gRNA sequence
gtttaattctactgtgctta

SEQ ID NO: 488858 - DNA, 20 bp, Artificial
  CRISPR gRNA sequence
tttaattctactgtgcttag

SEQ ID NO: 488859 - DNA, 20 bp, Artificial
  CRISPR gRNA sequence
ttaattctactgtgcttaga

SEQ ID NO: 488860 - DNA, 20 bp, Artificial
  CRISPR gRNA sequence
ctgtgcttagagggcataat

SEQ ID NO: 488861 - DNA, 20 bp, Artificial
  CRISPR gRNA sequence
ttgacacttgttttaatgca

SEQ ID NO: 488862 - DNA, 20 bp, Artificial
  CRISPR gRNA sequence
cacagcatatgataatactt

SEQ ID NO: 488863 - DNA, 20 bp, Artificial
  CRISPR gRNA sequence
ctattgcatgtgcacttgaa

SEQ ID NO: 488864 - DNA, 20 bp, Artificial
  CRISPR gRNA sequence
aatatgtattctgcaattgt

SEQ ID NO: 488865 - DNA, 20 bp, Artificial
  CRISPR gRNA sequence
atatgtattctgcaattgtt

SEQ ID NO: 488866 - DNA, 20 bp, Artificial
  CRISPR gRNA sequence
atgtattctgcaattgttag

SEQ ID NO: 488867 - DNA, 20 bp, Artificial
  CRISPR gRNA sequence
tatataatttatatatatat

SEQ ID NO: 488868 - DNA, 20 bp, Artificial
  CRISPR gRNA sequence
taatgatcttcaaattctta

SEQ ID NO: 488869 - DNA, 20 bp, Artificial
  CRISPR gRNA sequence
atttttttgtgtgcttcttg

SEQ ID NO: 488870 - DNA, 20 bp, Artificial
  CRISPR gRNA sequence
tttttgtgtgcttcttgtag

SEQ ID NO: 488871 - DNA, 20 bp, Artificial
  CRISPR gRNA sequence
tgtgtgcttcttgtagcagc

SEQ ID NO: 488872 - DNA, 20 bp, Artificial
  CRISPR gRNA sequence
tgtgcttcttgtagcagcta

SEQ ID NO: 488873 - DNA, 20 bp, Artificial
  CRISPR gRNA sequence
tgcttcttgtagcagctaga

SEQ ID NO: 488874 - DNA, 20 bp, Artificial
  CRISPR gRNA sequence
tcttgtagcagctagagaga

SEQ ID NO: 488875 - DNA, 20 bp, Artificial
  CRISPR gRNA sequence
gtaataaaactctccaacta

SEQ ID NO: 488876 - DNA, 20 bp, Artificial
  CRISPR gRNA sequence
aaactctccaactatagttg

SEQ ID NO: 488877 - DNA, 20 bp, Artificial
  CRISPR gRNA sequence
tgtggatttacttctccttt

SEQ ID NO: 488878 - DNA, 20 bp, Artificial
  CRISPR gRNA sequence
ttttaaacttgttatatgca

SEQ ID NO: 488879 - DNA, 20 bp, Artificial
  CRISPR gRNA sequence
tgttatatgcatagaaactg

SEQ ID NO: 488880 - DNA, 20 bp, Artificial
  CRISPR gRNA sequence
attgtttattcctacttaat

SEQ ID NO: 488881 - DNA, 20 bp, Artificial
  CRISPR gRNA sequence
acattttgttattttctcaa

SEQ ID NO: 488882 - DNA, 20 bp, Artificial
  CRISPR gRNA sequence
tattttctcaatggttacca

SEQ ID NO: 488883 - DNA, 20 bp, Artificial
  CRISPR gRNA sequence
attttctcaatggttaccac

SEQ ID NO: 488884 - DNA, 20 bp, Artificial
  CRISPR gRNA sequence
aatgaatacctccaacaata

SEQ ID NO: 488885 - DNA, 20 bp, Artificial
  CRISPR gRNA sequence
agtttgaattgatgccaatt

SEQ ID NO: 488886 - DNA, 20 bp, Artificial
  CRISPR gRNA sequence
ccaattcagcctcaatacta

SEQ ID NO: 488887 - DNA, 20 bp, Artificial
  CRISPR gRNA sequence
tactatagaaaactcctata

SEQ ID NO: 488888 - DNA, 20 bp, Artificial
  CRISPR gRNA sequence
gtttttcacttcttgtgcct

SEQ ID NO: 488889 - DNA, 20 bp, Artificial
  CRISPR gRNA sequence
ttccattttctttatatcta

SEQ ID NO: 488890 - DNA, 20 bp, Artificial
  CRISPR gRNA sequence
tatatctaaagaacatcctt

SEQ ID NO: 488891 - DNA, 20 bp, Artificial
  CRISPR gRNA sequence
ctttggtatttcctttactg

SEQ ID NO: 488892 - DNA, 20 bp, Artificial
  CRISPR gRNA sequence
tttggtatttcctttactgc

SEQ ID NO: 488893 - DNA, 20 bp, Artificial
  CRISPR gRNA sequence
ttctaaaaatgtctttattt

SEQ ID NO: 488894 - DNA, 20 bp, Artificial
  CRISPR gRNA sequence
aaaaattattactatttttt

SEQ ID NO: 488895 - DNA, 20 bp, Artificial
  CRISPR gRNA sequence
attattactattttttgaga

SEQ ID NO: 488896 - DNA, 20 bp, Artificial
  CRISPR gRNA sequence
gacagtctcactttgtcacc

SEQ ID NO: 488897 - DNA, 20 bp, Artificial
  CRISPR gRNA sequence
acagtctcactttgtcaccc

SEQ ID NO: 488898 - DNA, 20 bp, Artificial
  CRISPR gRNA sequence
gtctcactttgtcacccagg

SEQ ID NO: 488899 - DNA, 20 bp, Artificial
  CRISPR gRNA sequence
tctcactttgtcacccaggc

SEQ ID NO: 488900 - DNA, 20 bp, Artificial
  CRISPR gRNA sequence
tcactttgtcacccaggcag

SEQ ID NO: 488901 - DNA, 20 bp, Artificial
  CRISPR gRNA sequence
cactttgtcacccaggcagg

SEQ ID NO: 488902 - DNA, 20 bp, Artificial
  CRISPR gRNA sequence
actttgtcacccaggcagga

SEQ ID NO: 488903 - DNA, 20 bp, Artificial
  CRISPR gRNA sequence
ctttgtcacccaggcaggag

SEQ ID NO: 488904 - DNA, 20 bp, Artificial
  CRISPR gRNA sequence
ttgtcacccaggcaggaggg

SEQ ID NO: 488905 - DNA, 20 bp, Artificial
  CRISPR gRNA sequence
tcacccaggcaggaggggag

SEQ ID NO: 488906 - DNA, 20 bp, Artificial
  CRISPR gRNA sequence
ggaggggagtggcaccatct

SEQ ID NO: 488907 - DNA, 20 bp, Artificial
  CRISPR gRNA sequence
ggcaccatcttggctcgctg

SEQ ID NO: 488908 - DNA, 20 bp, Artificial
  CRISPR gRNA sequence
tcgctgcagccttgacttcc

SEQ ID NO: 488909 - DNA, 20 bp, Artificial
  CRISPR gRNA sequence
cgctgcagccttgacttcct

SEQ ID NO: 488910 - DNA, 20 bp, Artificial
  CRISPR gRNA sequence
agccttgacttcctgggttc

SEQ ID NO: 488911 - DNA, 20 bp, Artificial
  CRISPR gRNA sequence
ttcaagtgattctcgtgcct

SEQ ID NO: 488912 - DNA, 20 bp, Artificial
  CRISPR gRNA sequence
ttctcgtgcctcagcctcct

SEQ ID NO: 488913 - DNA, 20 bp, Artificial
  CRISPR gRNA sequence
tcgtgcctcagcctcctgag

SEQ ID NO: 488914 - DNA, 20 bp, Artificial
  CRISPR gRNA sequence
gcctcagcctcctgagtagc

SEQ ID NO: 488915 - DNA, 20 bp, Artificial
  CRISPR gRNA sequence
cctcagcctcctgagtagcc

SEQ ID NO: 488916 - DNA, 20 bp, Artificial
  CRISPR gRNA sequence
ctcctgagtagccgggatta

SEQ ID NO: 488917 - DNA, 20 bp, Artificial
  CRISPR gRNA sequence
tcctgagtagccgggattat

SEQ ID NO: 488918 - DNA, 20 bp, Artificial
  CRISPR gRNA sequence
tgggcgcgtgccaccacgct

SEQ ID NO: 488919 - DNA, 20 bp, Artificial
  CRISPR gRNA sequence
tcagctaacttttgtatttt

SEQ ID NO: 488920 - DNA, 20 bp, Artificial
  CRISPR gRNA sequence
taacttttgtatttttagtc

SEQ ID NO: 488921 - DNA, 20 bp, Artificial
  CRISPR gRNA sequence
ttttgtatttttagtcgaga

SEQ ID NO: 488922 - DNA, 20 bp, Artificial
  CRISPR gRNA sequence
tttgtatttttagtcgagat

SEQ ID NO: 488923 - DNA, 20 bp, Artificial
  CRISPR gRNA sequence
ttgtatttttagtcgagatg

SEQ ID NO: 488924 - DNA, 20 bp, Artificial
  CRISPR gRNA sequence
cgagatggggtttgccatgt

SEQ ID NO: 488925 - DNA, 20 bp, Artificial
  CRISPR gRNA sequence
atggggtttgccatgttggc

SEQ ID NO: 488926 - DNA, 20 bp, Artificial
  CRISPR gRNA sequence
gtttgccatgttggccagcc

SEQ ID NO: 488927 - DNA, 20 bp, Artificial
  CRISPR gRNA sequence
ctcaactgattcacctgctt

SEQ ID NO: 488928 - DNA, 20 bp, Artificial
  CRISPR gRNA sequence
tcacctgcttcagcctccca

SEQ ID NO: 488929 - DNA, 20 bp, Artificial
  CRISPR gRNA sequence
tgcttcagcctcccaaagtg

SEQ ID NO: 488930 - DNA, 20 bp, Artificial
  CRISPR gRNA sequence
gcttcagcctcccaaagtgc

SEQ ID NO: 488931 - DNA, 20 bp, Artificial
  CRISPR gRNA sequence
cttcagcctcccaaagtgcg

SEQ ID NO: 488932 - DNA, 20 bp, Artificial
  CRISPR gRNA sequence
ctcccaaagtgcggggatta

SEQ ID NO: 488933 - DNA, 20 bp, Artificial
  CRISPR gRNA sequence
tcccaaagtgcggggattac

SEQ ID NO: 488934 - DNA, 20 bp, Artificial
  CRISPR gRNA sequence
agtgcggggattacaggcat

SEQ ID NO: 488935 - DNA, 20 bp, Artificial
  CRISPR gRNA sequence
tgcatctgctttcatctttg

SEQ ID NO: 488936 - DNA, 20 bp, Artificial
  CRISPR gRNA sequence
tctttgaagtaccgaaattc

SEQ ID NO: 488937 - DNA, 20 bp, Artificial
  CRISPR gRNA sequence
tgaagtaccgaaattctaga

SEQ ID NO: 488938 - DNA, 20 bp, Artificial
  CRISPR gRNA sequence
gaagtaccgaaattctagat

SEQ ID NO: 488939 - DNA, 20 bp, Artificial
  CRISPR gRNA sequence
gtaccgaaattctagatagg

SEQ ID NO: 488940 - DNA, 20 bp, Artificial
  CRISPR gRNA sequence
gataggcagttattttcttt

SEQ ID NO: 488941 - DNA, 20 bp, Artificial
  CRISPR gRNA sequence
actttaaatatatcattcct

SEQ ID NO: 488942 - DNA, 20 bp, Artificial
  CRISPR gRNA sequence
cgtatgttctcactgatacg

SEQ ID NO: 488943 - DNA, 20 bp, Artificial
  CRISPR gRNA sequence
gtatgttctcactgatacgt

SEQ ID NO: 488944 - DNA, 20 bp, Artificial
  CRISPR gRNA sequence
atgttctcactgatacgtgg

SEQ ID NO: 488945 - DNA, 20 bp, Artificial
  CRISPR gRNA sequence
ctcactgatacgtgggagtt

SEQ ID NO: 488946 - DNA, 20 bp, Artificial
  CRISPR gRNA sequence
atacgtgggagttaagctac

SEQ ID NO: 488947 - DNA, 20 bp, Artificial
  CRISPR gRNA sequence
tacgtgggagttaagctacg

SEQ ID NO: 488948 - DNA, 20 bp, Artificial
  CRISPR gRNA sequence
agttaagctacgaggatgca

SEQ ID NO: 488949 - DNA, 20 bp, Artificial
  CRISPR gRNA sequence
gttaagctacgaggatgcaa

SEQ ID NO: 488950 - DNA, 20 bp, Artificial
  CRISPR gRNA sequence
ctacgaggatgcaaaggcat

SEQ ID NO: 488951 - DNA, 20 bp, Artificial
  CRISPR gRNA sequence
gcaaaggcataagaatgata

SEQ ID NO: 488952 - DNA, 20 bp, Artificial
  CRISPR gRNA sequence
aaggcataagaatgatacag

SEQ ID NO: 488953 - DNA, 20 bp, Artificial
  CRISPR gRNA sequence
aagaatgatacagtggactt

SEQ ID NO: 488954 - DNA, 20 bp, Artificial
  CRISPR gRNA sequence
tacagtggactttggtgact

SEQ ID NO: 488955 - DNA, 20 bp, Artificial
  CRISPR gRNA sequence
acagtggactttggtgactt

SEQ ID NO: 488956 - DNA, 20 bp, Artificial
  CRISPR gRNA sequence
agtggactttggtgacttgg

SEQ ID NO: 488957 - DNA, 20 bp, Artificial
  CRISPR gRNA sequence
gtggactttggtgacttggg

SEQ ID NO: 488958 - DNA, 20 bp, Artificial
  CRISPR gRNA sequence
ctttggtgacttgggaggaa

SEQ ID NO: 488959 - DNA, 20 bp, Artificial
  CRISPR gRNA sequence
tggtgacttgggaggaaaag

SEQ ID NO: 488960 - DNA, 20 bp, Artificial
  CRISPR gRNA sequence
ggtgacttgggaggaaaagt

SEQ ID NO: 488961 - DNA, 20 bp, Artificial
  CRISPR gRNA sequence
tgacttgggaggaaaagtgg

SEQ ID NO: 488962 - DNA, 20 bp, Artificial
  CRISPR gRNA sequence
gacttgggaggaaaagtggg

SEQ ID NO: 488963 - DNA, 20 bp, Artificial
  CRISPR gRNA sequence
acttgggaggaaaagtggga

SEQ ID NO: 488964 - DNA, 20 bp, Artificial
  CRISPR gRNA sequence
cttgggaggaaaagtgggag

SEQ ID NO: 488965 - DNA, 20 bp, Artificial
  CRISPR gRNA sequence
tgggaggaaaagtgggaggg

SEQ ID NO: 488966 - DNA, 20 bp, Artificial
  CRISPR gRNA sequence
aggaaaagtgggaggggagt

SEQ ID NO: 488967 - DNA, 20 bp, Artificial
  CRISPR gRNA sequence
ggaaaagtgggaggggagtg

SEQ ID NO: 488968 - DNA, 20 bp, Artificial
  CRISPR gRNA sequence
gaaaagtgggaggggagtga

SEQ ID NO: 488969 - DNA, 20 bp, Artificial
  CRISPR gRNA sequence
gggaggggagtgagggataa

SEQ ID NO: 488970 - DNA, 20 bp, Artificial
  CRISPR gRNA sequence
gagggataaaagactataaa

SEQ ID NO: 488971 - DNA, 20 bp, Artificial
  CRISPR gRNA sequence
gggataaaagactataaata

SEQ ID NO: 488972 - DNA, 20 bp, Artificial
  CRISPR gRNA sequence
aaaagactataaatagagtg

SEQ ID NO: 488973 - DNA, 20 bp, Artificial
  CRISPR gRNA sequence
agagtgcagtgtatactgct

SEQ ID NO: 488974 - DNA, 20 bp, Artificial
  CRISPR gRNA sequence
gagtgcagtgtatactgctc

SEQ ID NO: 488975 - DNA, 20 bp, Artificial
  CRISPR gRNA sequence
agtgtatactgctcgggtga

SEQ ID NO: 488976 - DNA, 20 bp, Artificial
  CRISPR gRNA sequence
gtgtatactgctcgggtgat

SEQ ID NO: 488977 - DNA, 20 bp, Artificial
  CRISPR gRNA sequence
acctgtaccccaataaccta

SEQ ID NO: 488978 - DNA, 20 bp, Artificial
  CRISPR gRNA sequence
ctatggaaaaataaaaaaaa

SEQ ID NO: 488979 - DNA, 20 bp, Artificial
  CRISPR gRNA sequence
tattatttttgctgaaatgt

SEQ ID NO: 488980 - DNA, 20 bp, Artificial
  CRISPR gRNA sequence
tttttgctgaaatgtcagct

SEQ ID NO: 488981 - DNA, 20 bp, Artificial
  CRISPR gRNA sequence
gctaagttgtttgttttgtg

SEQ ID NO: 488982 - DNA, 20 bp, Artificial
  CRISPR gRNA sequence
ctaagttgtttgttttgtga

SEQ ID NO: 488983 - DNA, 20 bp, Artificial
  CRISPR gRNA sequence
taagttgtttgttttgtgaa

SEQ ID NO: 488984 - DNA, 20 bp, Artificial
  CRISPR gRNA sequence
tttgttttgtgaagggaatt

SEQ ID NO: 488985 - DNA, 20 bp, Artificial
  CRISPR gRNA sequence
aatttagttttcccccactc

SEQ ID NO: 488986 - DNA, 20 bp, Artificial
  CRISPR gRNA sequence
acgatttttctatttatctt

SEQ ID NO: 488987 - DNA, 20 bp, Artificial
  CRISPR gRNA sequence
cataatttttttgatgtatt

SEQ ID NO: 488988 - DNA, 20 bp, Artificial
  CRISPR gRNA sequence
taatttttttgatgtattga

SEQ ID NO: 488989 - DNA, 20 bp, Artificial
  CRISPR gRNA sequence
aatttttttgatgtattgag

SEQ ID NO: 488990 - DNA, 20 bp, Artificial
  CRISPR gRNA sequence
agaggttgtcttttgttcat

SEQ ID NO: 488991 - DNA, 20 bp, Artificial
  CRISPR gRNA sequence
ttttttcttttttttttttt

SEQ ID NO: 488992 - DNA, 20 bp, Artificial
  CRISPR gRNA sequence
ttctttttttttttttgaga

SEQ ID NO: 488993 - DNA, 20 bp, Artificial
  CRISPR gRNA sequence
ctttttttttttttgagaca

SEQ ID NO: 488994 - DNA, 20 bp, Artificial
  CRISPR gRNA sequence
agagtttcactcttgttgcc

SEQ ID NO: 488995 - DNA, 20 bp, Artificial
  CRISPR gRNA sequence
gagtttcactcttgttgccc

SEQ ID NO: 488996 - DNA, 20 bp, Artificial
  CRISPR gRNA sequence
ttcactcttgttgcccaggt

SEQ ID NO: 488997 - DNA, 20 bp, Artificial
  CRISPR gRNA sequence
cactcttgttgcccaggttg

SEQ ID NO: 488998 - DNA, 20 bp, Artificial
  CRISPR gRNA sequence
ttgttgcccaggttggagtg

SEQ ID NO: 488999 - DNA, 20 bp, Artificial
  CRISPR gRNA sequence
ttgcccaggttggagtgcag

SEQ ID NO: 489000 - DNA, 20 bp, Artificial
  CRISPR gRNA sequence
ggagtgcagtggcgtgatct

SEQ ID NO: 489001 - DNA, 20 bp, Artificial
  CRISPR gRNA sequence
tcactgcaacctccacctcc

SEQ ID NO: 489002 - DNA, 20 bp, Artificial
  CRISPR gRNA sequence
aacctccacctcctggattc

SEQ ID NO: 489003 - DNA, 20 bp, Artificial
  CRISPR gRNA sequence
ttcaagtgattctcctgcct

SEQ ID NO: 489004 - DNA, 20 bp, Artificial
  CRISPR gRNA sequence
ttctcctgcctcagcctccc

SEQ ID NO: 489005 - DNA, 20 bp, Artificial
  CRISPR gRNA sequence
tcctgcctcagcctcccaag

SEQ ID NO: 489006 - DNA, 20 bp, Artificial
  CRISPR gRNA sequence
gcctcagcctcccaagtagc

SEQ ID NO: 489007 - DNA, 20 bp, Artificial
  CRISPR gRNA sequence
cctcagcctcccaagtagct

SEQ ID NO: 489008 - DNA, 20 bp, Artificial
  CRISPR gRNA sequence
ctcccaagtagctgggatta

SEQ ID NO: 489009 - DNA, 20 bp, Artificial
  CRISPR gRNA sequence
tcccaagtagctgggattac

SEQ ID NO: 489010 - DNA, 20 bp, Artificial
  CRISPR gRNA sequence
caggtgtgcaccaccatact

SEQ ID NO: 489011 - DNA, 20 bp, Artificial
  CRISPR gRNA sequence
ttggctaatttttgcatttt

SEQ ID NO: 489012 - DNA, 20 bp, Artificial
  CRISPR gRNA sequence
gctaatttttgcatttttag

SEQ ID NO: 489013 - DNA, 20 bp, Artificial
  CRISPR gRNA sequence
taatttttgcatttttagca

SEQ ID NO: 489014 - DNA, 20 bp, Artificial
  CRISPR gRNA sequence
ttttgcatttttagcagaga

SEQ ID NO: 489015 - DNA, 20 bp, Artificial
  CRISPR gRNA sequence
tttgcatttttagcagagat

SEQ ID NO: 489016 - DNA, 20 bp, Artificial
  CRISPR gRNA sequence
gagatgggattttgtcatat

SEQ ID NO: 489017 - DNA, 20 bp, Artificial
  CRISPR gRNA sequence
tgggattttgtcatattggc

SEQ ID NO: 489018 - DNA, 20 bp, Artificial
  CRISPR gRNA sequence
gggattttgtcatattggcc

SEQ ID NO: 489019 - DNA, 20 bp, Artificial
  CRISPR gRNA sequence
ttttgtcatattggccaggc

SEQ ID NO: 489020 - DNA, 20 bp, Artificial
  CRISPR gRNA sequence
tggtctcaaactcctgacgt

SEQ ID NO: 489021 - DNA, 20 bp, Artificial
  CRISPR gRNA sequence
ggtctcaaactcctgacgtc

SEQ ID NO: 489022 - DNA, 20 bp, Artificial
  CRISPR gRNA sequence
cgtcaggtgatccatccacc

SEQ ID NO: 489023 - DNA, 20 bp, Artificial
  CRISPR gRNA sequence
gtcaggtgatccatccacct

SEQ ID NO: 489024 - DNA, 20 bp, Artificial
  CRISPR gRNA sequence
ccatccacctgggcctccca

SEQ ID NO: 489025 - DNA, 20 bp, Artificial
  CRISPR gRNA sequence
acctgggcctcccaaagtgc

SEQ ID NO: 489026 - DNA, 20 bp, Artificial
  CRISPR gRNA sequence
cctgggcctcccaaagtgct

SEQ ID NO: 489027 - DNA, 20 bp, Artificial
  CRISPR gRNA sequence
ctcccaaagtgctgggatta

SEQ ID NO: 489028 - DNA, 20 bp, Artificial
  CRISPR gRNA sequence
tcccaaagtgctgggattac

SEQ ID NO: 489029 - DNA, 20 bp, Artificial
  CRISPR gRNA sequence
agtgctgggattacaggcgt

SEQ ID NO: 489030 - DNA, 20 bp, Artificial
  CRISPR gRNA sequence
caggcgtgagccaccgtgcc

SEQ ID NO: 489031 - DNA, 20 bp, Artificial
  CRISPR gRNA sequence
agccaccgtgcccagcttgt

SEQ ID NO: 489032 - DNA, 20 bp, Artificial
  CRISPR gRNA sequence
cggtttgttttgatcttgct

SEQ ID NO: 489033 - DNA, 20 bp, Artificial
  CRISPR gRNA sequence
ggtttgttttgatcttgctt

SEQ ID NO: 489034 - DNA, 20 bp, Artificial
  CRISPR gRNA sequence
gtttgttttgatcttgcttg

SEQ ID NO: 489035 - DNA, 20 bp, Artificial
  CRISPR gRNA sequence
attttacaaatctatcttga

SEQ ID NO: 489036 - DNA, 20 bp, Artificial
  CRISPR gRNA sequence
tctatcttgatggcttttgt

SEQ ID NO: 489037 - DNA, 20 bp, Artificial
  CRISPR gRNA sequence
ttgatggcttttgtcagttt

SEQ ID NO: 489038 - DNA, 20 bp, Artificial
  CRISPR gRNA sequence
tgatggcttttgtcagtttt

SEQ ID NO: 489039 - DNA, 20 bp, Artificial
  CRISPR gRNA sequence
tatcttttatctcttttgct

SEQ ID NO: 489040 - DNA, 20 bp, Artificial
  CRISPR gRNA sequence
ccttgctttccaattacact

SEQ ID NO: 489041 - DNA, 20 bp, Artificial
  CRISPR gRNA sequence
ctttccaattacacttagtt

SEQ ID NO: 489042 - DNA, 20 bp, Artificial
  CRISPR gRNA sequence
tttccaattacacttagttt

SEQ ID NO: 489043 - DNA, 20 bp, Artificial
  CRISPR gRNA sequence
ttccaattacacttagttta

SEQ ID NO: 489044 - DNA, 20 bp, Artificial
  CRISPR gRNA sequence
tccaattacacttagtttag

SEQ ID NO: 489045 - DNA, 20 bp, Artificial
  CRISPR gRNA sequence
tgtttttctttacttcactc

SEQ ID NO: 489046 - DNA, 20 bp, Artificial
  CRISPR gRNA sequence
tcactctggatattttataa

SEQ ID NO: 489047 - DNA, 20 bp, Artificial
  CRISPR gRNA sequence
ttttctaattctcttttcaa

SEQ ID NO: 489048 - DNA, 20 bp, Artificial
  CRISPR gRNA sequence
tcttttcaatggcatctaaa

SEQ ID NO: 489049 - DNA, 20 bp, Artificial
  CRISPR gRNA sequence
gcctttttaacctttcaatt

SEQ ID NO: 489050 - DNA, 20 bp, Artificial
  CRISPR gRNA sequence
tttcaattgagtttgtttta

SEQ ID NO: 489051 - DNA, 20 bp, Artificial
  CRISPR gRNA sequence
ctttaaaaaaaatccaattt

SEQ ID NO: 489052 - DNA, 20 bp, Artificial
  CRISPR gRNA sequence
tttaaaaaaaatccaatttc

SEQ ID NO: 489053 - DNA, 20 bp, Artificial
  CRISPR gRNA sequence
taatgacctactccaaaatc

SEQ ID NO: 489054 - DNA, 20 bp, Artificial
  CRISPR gRNA sequence
tgacctactccaaaatccag

SEQ ID NO: 489055 - DNA, 20 bp, Artificial
  CRISPR gRNA sequence
gtttaaaacaactacctatt

SEQ ID NO: 489056 - DNA, 20 bp, Artificial
  CRISPR gRNA sequence
aaaacaactacctatttagt

SEQ ID NO: 489057 - DNA, 20 bp, Artificial
  CRISPR gRNA sequence
tatttagttagtgattctgc

SEQ ID NO: 489058 - DNA, 20 bp, Artificial
  CRISPR gRNA sequence
tagttagtgattctgctagt

SEQ ID NO: 489059 - DNA, 20 bp, Artificial
  CRISPR gRNA sequence
gattctgctagttggcaatt

SEQ ID NO: 489060 - DNA, 20 bp, Artificial
  CRISPR gRNA sequence
attctgctagttggcaattt

SEQ ID NO: 489061 - DNA, 20 bp, Artificial
  CRISPR gRNA sequence
tgctagttggcaatttgggc

SEQ ID NO: 489062 - DNA, 20 bp, Artificial
  CRISPR gRNA sequence
gctagttggcaatttgggct

SEQ ID NO: 489063 - DNA, 20 bp, Artificial
  CRISPR gRNA sequence
ttggcaatttgggctgggct

SEQ ID NO: 489064 - DNA, 20 bp, Artificial
  CRISPR gRNA sequence
caatttgggctgggctcagc

SEQ ID NO: 489065 - DNA, 20 bp, Artificial
  CRISPR gRNA sequence
aatttgggctgggctcagct

SEQ ID NO: 489066 - DNA, 20 bp, Artificial
  CRISPR gRNA sequence
ttgggctgggctcagctagg

SEQ ID NO: 489067 - DNA, 20 bp, Artificial
  CRISPR gRNA sequence
gctcagctaggtggttcttt

SEQ ID NO: 489068 - DNA, 20 bp, Artificial
  CRISPR gRNA sequence
cttttggtttcctcttgcat

SEQ ID NO: 489069 - DNA, 20 bp, Artificial
  CRISPR gRNA sequence
ttgcatcagtcatgcatgtg

SEQ ID NO: 489070 - DNA, 20 bp, Artificial
  CRISPR gRNA sequence
atcagtcatgcatgtgtggt

SEQ ID NO: 489071 - DNA, 20 bp, Artificial
  CRISPR gRNA sequence
atgcatgtgtggtcagctgc

SEQ ID NO: 489072 - DNA, 20 bp, Artificial
  CRISPR gRNA sequence
tgtgtggtcagctgccagac

SEQ ID NO: 489073 - DNA, 20 bp, Artificial
  CRISPR gRNA sequence
gtcagctgccagactggcca

SEQ ID NO: 489074 - DNA, 20 bp, Artificial
  CRISPR gRNA sequence
tcagctgccagactggccac

SEQ ID NO: 489075 - DNA, 20 bp, Artificial
  CRISPR gRNA sequence
gctgccagactggccacggg

SEQ ID NO: 489076 - DNA, 20 bp, Artificial
  CRISPR gRNA sequence
tttattttttattgtttttt

SEQ ID NO: 489077 - DNA, 20 bp, Artificial
  CRISPR gRNA sequence
tttttattgttttttgagat

SEQ ID NO: 489078 - DNA, 20 bp, Artificial
  CRISPR gRNA sequence
ttttattgttttttgagatt

SEQ ID NO: 489079 - DNA, 20 bp, Artificial
  CRISPR gRNA sequence
ttaggtcttgctctgtcatg

SEQ ID NO: 489080 - DNA, 20 bp, Artificial
  CRISPR gRNA sequence
taggtcttgctctgtcatgc

SEQ ID NO: 489081 - DNA, 20 bp, Artificial
  CRISPR gRNA sequence
tcttgctctgtcatgcaggc

SEQ ID NO: 489082 - DNA, 20 bp, Artificial
  CRISPR gRNA sequence
ttgctctgtcatgcaggcta

SEQ ID NO: 489083 - DNA, 20 bp, Artificial
  CRISPR gRNA sequence
ctgtcatgcaggctagagtg

SEQ ID NO: 489084 - DNA, 20 bp, Artificial
  CRISPR gRNA sequence
tcatgcaggctagagtgcag

SEQ ID NO: 489085 - DNA, 20 bp, Artificial
  CRISPR gRNA sequence
agtgcagtggcatgatatct

SEQ ID NO: 489086 - DNA, 20 bp, Artificial
  CRISPR gRNA sequence
atgatatctcggctcactgc

SEQ ID NO: 489087 - DNA, 20 bp, Artificial
  CRISPR gRNA sequence
tcactgcaagctccatctcc

SEQ ID NO: 489088 - DNA, 20 bp, Artificial
  CRISPR gRNA sequence
cactgcaagctccatctccc

SEQ ID NO: 489089 - DNA, 20 bp, Artificial
  CRISPR gRNA sequence
aagctccatctcccgggttc

SEQ ID NO: 489090 - DNA, 20 bp, Artificial
  CRISPR gRNA sequence
ctccatctcccgggttcaag

SEQ ID NO: 489091 - DNA, 20 bp, Artificial
  CRISPR gRNA sequence
ttcaagcagttctcgtgcct

SEQ ID NO: 489092 - DNA, 20 bp, Artificial
  CRISPR gRNA sequence
ttctcgtgcctcagactccc

SEQ ID NO: 489093 - DNA, 20 bp, Artificial
  CRISPR gRNA sequence
tcgtgcctcagactcccaag

SEQ ID NO: 489094 - DNA, 20 bp, Artificial
  CRISPR gRNA sequence
gcctcagactcccaagtagc

SEQ ID NO: 489095 - DNA, 20 bp, Artificial
  CRISPR gRNA sequence
cctcagactcccaagtagct

SEQ ID NO: 489096 - DNA, 20 bp, Artificial
  CRISPR gRNA sequence
ctcagactcccaagtagctg

SEQ ID NO: 489097 - DNA, 20 bp, Artificial
  CRISPR gRNA sequence
tcccaagtagctggggttac

SEQ ID NO: 489098 - DNA, 20 bp, Artificial
  CRISPR gRNA sequence
caagtgtgtgccaccatgtc

SEQ ID NO: 489099 - DNA, 20 bp, Artificial
  CRISPR gRNA sequence
ctggctaatttttgtatcgt

SEQ ID NO: 489100 - DNA, 20 bp, Artificial
  CRISPR gRNA sequence
gctaatttttgtatcgttag

SEQ ID NO: 489101 - DNA, 20 bp, Artificial
  CRISPR gRNA sequence
taatttttgtatcgttagta

SEQ ID NO: 489102 - DNA, 20 bp, Artificial
  CRISPR gRNA sequence
tttgtatcgttagtagagac

SEQ ID NO: 489103 - DNA, 20 bp, Artificial
  CRISPR gRNA sequence
ttgtatcgttagtagagacg

SEQ ID NO: 489104 - DNA, 20 bp, Artificial
  CRISPR gRNA sequence
gagacgaggttttaccatgt

SEQ ID NO: 489105 - DNA, 20 bp, Artificial
  CRISPR gRNA sequence
cgaggttttaccatgttggc

SEQ ID NO: 489106 - DNA, 20 bp, Artificial
  CRISPR gRNA sequence
gaggttttaccatgttggcc

SEQ ID NO: 489107 - DNA, 20 bp, Artificial
  CRISPR gRNA sequence
aggttttaccatgttggcca

SEQ ID NO: 489108 - DNA, 20 bp, Artificial
  CRISPR gRNA sequence
ttttaccatgttggccaggg

SEQ ID NO: 489109 - DNA, 20 bp, Artificial
  CRISPR gRNA sequence
ggtctcgaactcccgacctt

SEQ ID NO: 489110 - DNA, 20 bp, Artificial
  CRISPR gRNA sequence
cccgaccttgagtgatctgc

SEQ ID NO: 489111 - DNA, 20 bp, Artificial
  CRISPR gRNA sequence
cttgagtgatctgccggcct

SEQ ID NO: 489112 - DNA, 20 bp, Artificial
  CRISPR gRNA sequence
ctgccggccttggcctccca

SEQ ID NO: 489113 - DNA, 20 bp, Artificial
  CRISPR gRNA sequence
gccttggcctcccaaagtgc

SEQ ID NO: 489114 - DNA, 20 bp, Artificial
  CRISPR gRNA sequence
ctcccaaagtgctggaatta

SEQ ID NO: 489115 - DNA, 20 bp, Artificial
  CRISPR gRNA sequence
tcccaaagtgctggaattac

SEQ ID NO: 489116 - DNA, 20 bp, Artificial
  CRISPR gRNA sequence
agtgctggaattacgggcat

SEQ ID NO: 489117 - DNA, 20 bp, Artificial
  CRISPR gRNA sequence
acgggcatgagccaccgcac

SEQ ID NO: 489118 - DNA, 20 bp, Artificial
  CRISPR gRNA sequence
cgggcatgagccaccgcacc

SEQ ID NO: 489119 - DNA, 20 bp, Artificial
  CRISPR gRNA sequence
catgagccaccgcaccaggc

SEQ ID NO: 489120 - DNA, 20 bp, Artificial
  CRISPR gRNA sequence
atgagccaccgcaccaggcc

SEQ ID NO: 489121 - DNA, 20 bp, Artificial
  CRISPR gRNA sequence
tgagccaccgcaccaggcca

SEQ ID NO: 489122 - DNA, 20 bp, Artificial
  CRISPR gRNA sequence
ccaccgcaccaggccagggc

SEQ ID NO: 489123 - DNA, 20 bp, Artificial
  CRISPR gRNA sequence
caggccagggctagctgatt

SEQ ID NO: 489124 - DNA, 20 bp, Artificial
  CRISPR gRNA sequence
cagggctagctgatttagaa

SEQ ID NO: 489125 - DNA, 20 bp, Artificial
  CRISPR gRNA sequence
tagctgatttagaatggcct

SEQ ID NO: 489126 - DNA, 20 bp, Artificial
  CRISPR gRNA sequence
tagaatggccttagctgtgt

SEQ ID NO: 489127 - DNA, 20 bp, Artificial
  CRISPR gRNA sequence
tcatgtgatatcttattctc

SEQ ID NO: 489128 - DNA, 20 bp, Artificial
  CRISPR gRNA sequence
tgtgatatcttattctccag

SEQ ID NO: 489129 - DNA, 20 bp, Artificial
  CRISPR gRNA sequence
gtgatatcttattctccagc

SEQ ID NO: 489130 - DNA, 20 bp, Artificial
  CRISPR gRNA sequence
tattctccagcaggctattt

SEQ ID NO: 489131 - DNA, 20 bp, Artificial
  CRISPR gRNA sequence
attctccagcaggctatttt

SEQ ID NO: 489132 - DNA, 20 bp, Artificial
  CRISPR gRNA sequence
ggctattttaggcttgttca

SEQ ID NO: 489133 - DNA, 20 bp, Artificial
  CRISPR gRNA sequence
gctattttaggcttgttcac

SEQ ID NO: 489134 - DNA, 20 bp, Artificial
  CRISPR gRNA sequence
ttttaggcttgttcacaggt

SEQ ID NO: 489135 - DNA, 20 bp, Artificial
  CRISPR gRNA sequence
aggcttgttcacaggtcagc

SEQ ID NO: 489136 - DNA, 20 bp, Artificial
  CRISPR gRNA sequence
tgttcacaggtcagccagat

SEQ ID NO: 489137 - DNA, 20 bp, Artificial
  CRISPR gRNA sequence
gttcacaggtcagccagatg

SEQ ID NO: 489138 - DNA, 20 bp, Artificial
  CRISPR gRNA sequence
ggtcagccagatgaggttcc

SEQ ID NO: 489139 - DNA, 20 bp, Artificial
  CRISPR gRNA sequence
tcagccagatgaggttccaa

SEQ ID NO: 489140 - DNA, 20 bp, Artificial
  CRISPR gRNA sequence
agatgaggttccaagagaac

SEQ ID NO: 489141 - DNA, 20 bp, Artificial
  CRISPR gRNA sequence
tgaggttccaagagaacaag

SEQ ID NO: 489142 - DNA, 20 bp, Artificial
  CRISPR gRNA sequence
agaaatgtgcaatgcctttt

SEQ ID NO: 489143 - DNA, 20 bp, Artificial
  CRISPR gRNA sequence
gtgcaatgccttttcagatc

SEQ ID NO: 489144 - DNA, 20 bp, Artificial
  CRISPR gRNA sequence
tgcaatgccttttcagatct

SEQ ID NO: 489145 - DNA, 20 bp, Artificial
  CRISPR gRNA sequence
tgccttttcagatctaggct

SEQ ID NO: 489146 - DNA, 20 bp, Artificial
  CRISPR gRNA sequence
ttcagatctaggcttagaac

SEQ ID NO: 489147 - DNA, 20 bp, Artificial
  CRISPR gRNA sequence
agatctaggcttagaactag

SEQ ID NO: 489148 - DNA, 20 bp, Artificial
  CRISPR gRNA sequence
ttttgctgcgtttcatcatg

SEQ ID NO: 489149 - DNA, 20 bp, Artificial
  CRISPR gRNA sequence
ctgcgtttcatcatgaagac

SEQ ID NO: 489150 - DNA, 20 bp, Artificial
  CRISPR gRNA sequence
tttcatcatgaagaccagcc

SEQ ID NO: 489151 - DNA, 20 bp, Artificial
  CRISPR gRNA sequence
atgaagaccagcccagttcc

SEQ ID NO: 489152 - DNA, 20 bp, Artificial
  CRISPR gRNA sequence
gaagaccagcccagttccaa

SEQ ID NO: 489153 - DNA, 20 bp, Artificial
  CRISPR gRNA sequence
accagcccagttccaagaga

SEQ ID NO: 489154 - DNA, 20 bp, Artificial
  CRISPR gRNA sequence
ccagcccagttccaagagac

SEQ ID NO: 489155 - DNA, 20 bp, Artificial
  CRISPR gRNA sequence
cagcccagttccaagagaca

SEQ ID NO: 489156 - DNA, 20 bp, Artificial
  CRISPR gRNA sequence
tgaaccccatttcttgataa

SEQ ID NO: 489157 - DNA, 20 bp, Artificial
  CRISPR gRNA sequence
accccatttcttgataacag

SEQ ID NO: 489158 - DNA, 20 bp, Artificial
  CRISPR gRNA sequence
ccccatttcttgataacaga

SEQ ID NO: 489159 - DNA, 20 bp, Artificial
  CRISPR gRNA sequence
ccatttcttgataacagaag

SEQ ID NO: 489160 - DNA, 20 bp, Artificial
  CRISPR gRNA sequence
tgataacagaaggagctgta

SEQ ID NO: 489161 - DNA, 20 bp, Artificial
  CRISPR gRNA sequence
gagctgtaaagtcacattgc

SEQ ID NO: 489162 - DNA, 20 bp, Artificial
  CRISPR gRNA sequence
agctgtaaagtcacattgca

SEQ ID NO: 489163 - DNA, 20 bp, Artificial
  CRISPR gRNA sequence
aaagtcacattgcaaggaca

SEQ ID NO: 489164 - DNA, 20 bp, Artificial
  CRISPR gRNA sequence
atttttgcattctatcacgc

SEQ ID NO: 489165 - DNA, 20 bp, Artificial
  CRISPR gRNA sequence
ttttatttccttgaacatat

SEQ ID NO: 489166 - DNA, 20 bp, Artificial
  CRISPR gRNA sequence
tattagacatgattacttta

SEQ ID NO: 489167 - DNA, 20 bp, Artificial
  CRISPR gRNA sequence
tgactgacaactctattatg

SEQ ID NO: 489168 - DNA, 20 bp, Artificial
  CRISPR gRNA sequence
tatgtagatgccctgtttgt

SEQ ID NO: 489169 - DNA, 20 bp, Artificial
  CRISPR gRNA sequence
tgttgtctctattcttctgt

SEQ ID NO: 489170 - DNA, 20 bp, Artificial
  CRISPR gRNA sequence
tctattcttctgttggtttt

SEQ ID NO: 489171 - DNA, 20 bp, Artificial
  CRISPR gRNA sequence
tattcttctgttggtttttg

SEQ ID NO: 489172 - DNA, 20 bp, Artificial
  CRISPR gRNA sequence
ccttttcttatacttcactt

SEQ ID NO: 489173 - DNA, 20 bp, Artificial
  CRISPR gRNA sequence
atattgtgtatgaaacattc

SEQ ID NO: 489174 - DNA, 20 bp, Artificial
  CRISPR gRNA sequence
tattgtgtatgaaacattct

SEQ ID NO: 489175 - DNA, 20 bp, Artificial
  CRISPR gRNA sequence
ctaggaataatttaatgctc

SEQ ID NO: 489176 - DNA, 20 bp, Artificial
  CRISPR gRNA sequence
tggttgatgttattttcctc

SEQ ID NO: 489177 - DNA, 20 bp, Artificial
  CRISPR gRNA sequence
tcataacttatatttgcctc

SEQ ID NO: 489178 - DNA, 20 bp, Artificial
  CRISPR gRNA sequence
aacttatatttgcctctagt

SEQ ID NO: 489179 - DNA, 20 bp, Artificial
  CRISPR gRNA sequence
ttatatttgcctctagttgg

SEQ ID NO: 489180 - DNA, 20 bp, Artificial
  CRISPR gRNA sequence
atttgcctctagttggcagc

SEQ ID NO: 489181 - DNA, 20 bp, Artificial
  CRISPR gRNA sequence
tttgcctctagttggcagcc

SEQ ID NO: 489182 - DNA, 20 bp, Artificial
  CRISPR gRNA sequence
cctctagttggcagccaggt

SEQ ID NO: 489183 - DNA, 20 bp, Artificial
  CRISPR gRNA sequence
ctctagttggcagccaggtt

SEQ ID NO: 489184 - DNA, 20 bp, Artificial
  CRISPR gRNA sequence
tctagttggcagccaggtta

SEQ ID NO: 489185 - DNA, 20 bp, Artificial
  CRISPR gRNA sequence
ggcagccaggttagggctac

SEQ ID NO: 489186 - DNA, 20 bp, Artificial
  CRISPR gRNA sequence
cagccaggttagggctacca

SEQ ID NO: 489187 - DNA, 20 bp, Artificial
  CRISPR gRNA sequence
gttagggctaccagagattc

SEQ ID NO: 489188 - DNA, 20 bp, Artificial
  CRISPR gRNA sequence
taccagagattccagatcat

SEQ ID NO: 489189 - DNA, 20 bp, Artificial
  CRISPR gRNA sequence
tccagatcattagttcaatc

SEQ ID NO: 489190 - DNA, 20 bp, Artificial
  CRISPR gRNA sequence
ccagatcattagttcaatcc

SEQ ID NO: 489191 - DNA, 20 bp, Artificial
  CRISPR gRNA sequence
cagatcattagttcaatcca

SEQ ID NO: 489192 - DNA, 20 bp, Artificial
  CRISPR gRNA sequence
ggttgtgatgattcaaaatt

SEQ ID NO: 489193 - DNA, 20 bp, Artificial
  CRISPR gRNA sequence
gatgattcaaaattgagctt

SEQ ID NO: 489194 - DNA, 20 bp, Artificial
  CRISPR gRNA sequence
aattgagcttcagttcctgt

SEQ ID NO: 489195 - DNA, 20 bp, Artificial
  CRISPR gRNA sequence
attgagcttcagttcctgtg

SEQ ID NO: 489196 - DNA, 20 bp, Artificial
  CRISPR gRNA sequence
ttgagcttcagttcctgtga

SEQ ID NO: 489197 - DNA, 20 bp, Artificial
  CRISPR gRNA sequence
tctcgttcactcttactctt

SEQ ID NO: 489198 - DNA, 20 bp, Artificial
  CRISPR gRNA sequence
ctcgttcactcttactcttt

SEQ ID NO: 489199 - DNA, 20 bp, Artificial
  CRISPR gRNA sequence
tcactcttactctttgggta

SEQ ID NO: 489200 - DNA, 20 bp, Artificial
  CRISPR gRNA sequence
tctttgggtatagccctctg

SEQ ID NO: 489201 - DNA, 20 bp, Artificial
  CRISPR gRNA sequence
ggtaccaacctcaacactga

SEQ ID NO: 489202 - DNA, 20 bp, Artificial
  CRISPR gRNA sequence
tatgtatacccgctttctaa

SEQ ID NO: 489203 - DNA, 20 bp, Artificial
  CRISPR gRNA sequence
atgtatacccgctttctaat

SEQ ID NO: 489204 - DNA, 20 bp, Artificial
  CRISPR gRNA sequence
gtatacccgctttctaatag

SEQ ID NO: 489205 - DNA, 20 bp, Artificial
  CRISPR gRNA sequence
tatacccgctttctaatagg

SEQ ID NO: 489206 - DNA, 20 bp, Artificial
  CRISPR gRNA sequence
atacccgctttctaatagga

SEQ ID NO: 489207 - DNA, 20 bp, Artificial
  CRISPR gRNA sequence
acgtgaacttcatgttctct

SEQ ID NO: 489208 - DNA, 20 bp, Artificial
  CRISPR gRNA sequence
tcatgttctcttagttcctt

SEQ ID NO: 489209 - DNA, 20 bp, Artificial
  CRISPR gRNA sequence
agttccttgagttttattgt

SEQ ID NO: 489210 - DNA, 20 bp, Artificial
  CRISPR gRNA sequence
gttttattgtgagctctgct

SEQ ID NO: 489211 - DNA, 20 bp, Artificial
  CRISPR gRNA sequence
gtgagctctgctcagcttct

SEQ ID NO: 489212 - DNA, 20 bp, Artificial
  CRISPR gRNA sequence
tgctcagcttctcagccttt

SEQ ID NO: 489213 - DNA, 20 bp, Artificial
  CRISPR gRNA sequence
agccttttagctgccattta

SEQ ID NO: 489214 - DNA, 20 bp, Artificial
  CRISPR gRNA sequence
ttagctgccatttatggaat

SEQ ID NO: 489215 - DNA, 20 bp, Artificial
  CRISPR gRNA sequence
gctgccatttatggaatcag

SEQ ID NO: 489216 - DNA, 20 bp, Artificial
  CRISPR gRNA sequence
atggaatcagaagatgcctc

SEQ ID NO: 489217 - DNA, 20 bp, Artificial
  CRISPR gRNA sequence
tggaatcagaagatgcctcc

SEQ ID NO: 489218 - DNA, 20 bp, Artificial
  CRISPR gRNA sequence
ggaatcagaagatgcctcca

SEQ ID NO: 489219 - DNA, 20 bp, Artificial
  CRISPR gRNA sequence
aagatgcctccagggaacaa

SEQ ID NO: 489220 - DNA, 20 bp, Artificial
  CRISPR gRNA sequence
tgcctccagggaacaacagt

SEQ ID NO: 489221 - DNA, 20 bp, Artificial
  CRISPR gRNA sequence
ctctctgaatttccttcttc

SEQ ID NO: 489222 - DNA, 20 bp, Artificial
  CRISPR gRNA sequence
aatttccttcttccagatat

SEQ ID NO: 489223 - DNA, 20 bp, Artificial
  CRISPR gRNA sequence
catgttgttcatttttcttc

SEQ ID NO: 489224 - DNA, 20 bp, Artificial
  CRISPR gRNA sequence
atttttcttctagctatttt

SEQ ID NO: 489225 - DNA, 20 bp, Artificial
  CRISPR gRNA sequence
tttcttctagctatttttag

SEQ ID NO: 489226 - DNA, 20 bp, Artificial
  CRISPR gRNA sequence
ttcttctagctatttttagt

SEQ ID NO: 489227 - DNA, 20 bp, Artificial
  CRISPR gRNA sequence
cttctagctatttttagtgg

SEQ ID NO: 489228 - DNA, 20 bp, Artificial
  CRISPR gRNA sequence
ttctagctatttttagtggg

SEQ ID NO: 489229 - DNA, 20 bp, Artificial
  CRISPR gRNA sequence
gctatttttagtgggaggat

SEQ ID NO: 489230 - DNA, 20 bp, Artificial
  CRISPR gRNA sequence
tttttagtgggaggattggt

SEQ ID NO: 489231 - DNA, 20 bp, Artificial
  CRISPR gRNA sequence
ttggttagcatgtcttaacc

SEQ ID NO: 489232 - DNA, 20 bp, Artificial
  CRISPR gRNA sequence
ctggattttcattacataat

SEQ ID NO: 489233 - DNA, 20 bp, Artificial
  CRISPR gRNA sequence
gattttttatctcaacaatt

SEQ ID NO: 489234 - DNA, 20 bp, Artificial
  CRISPR gRNA sequence
attttttatctcaacaatta

SEQ ID NO: 489235 - DNA, 20 bp, Artificial
  CRISPR gRNA sequence
ttttttatctcaacaattaa

SEQ ID NO: 489236 - DNA, 20 bp, Artificial
  CRISPR gRNA sequence
tttttatctcaacaattaag

SEQ ID NO: 489237 - DNA, 20 bp, Artificial
  CRISPR gRNA sequence
caacaattaaggggatgctg

SEQ ID NO: 489238 - DNA, 20 bp, Artificial
  CRISPR gRNA sequence
aaggggatgctgtagaatga

SEQ ID NO: 489239 - DNA, 20 bp, Artificial
  CRISPR gRNA sequence
gaatgaaagtgttctgtttc

SEQ ID NO: 489240 - DNA, 20 bp, Artificial
  CRISPR gRNA sequence
tttccagatcacaaactctc

SEQ ID NO: 489241 - DNA, 20 bp, Artificial
  CRISPR gRNA sequence
tccagatcacaaactctctg

SEQ ID NO: 489242 - DNA, 20 bp, Artificial
  CRISPR gRNA sequence
gatcacaaactctctggagt

SEQ ID NO: 489243 - DNA, 20 bp, Artificial
  CRISPR gRNA sequence
atcacaaactctctggagtc

SEQ ID NO: 489244 - DNA, 20 bp, Artificial
  CRISPR gRNA sequence
ggaatcatgccttatacatg

SEQ ID NO: 489245 - DNA, 20 bp, Artificial
  CRISPR gRNA sequence
aatcatgccttatacatgaa

SEQ ID NO: 489246 - DNA, 20 bp, Artificial
  CRISPR gRNA sequence
atcatgccttatacatgaag

SEQ ID NO: 489247 - DNA, 20 bp, Artificial
  CRISPR gRNA sequence
atgaagaggccctgcctctt

SEQ ID NO: 489248 - DNA, 20 bp, Artificial
  CRISPR gRNA sequence
tgaagaggccctgcctcttc

SEQ ID NO: 489249 - DNA, 20 bp, Artificial
  CRISPR gRNA sequence
gaagaggccctgcctcttca

SEQ ID NO: 489250 - DNA, 20 bp, Artificial
  CRISPR gRNA sequence
aagaggccctgcctcttcag

SEQ ID NO: 489251 - DNA, 20 bp, Artificial
  CRISPR gRNA sequence
ggccctgcctcttcaggggc

SEQ ID NO: 489252 - DNA, 20 bp, Artificial
  CRISPR gRNA sequence
cctcttcaggggctggattg

SEQ ID NO: 489253 - DNA, 20 bp, Artificial
  CRISPR gRNA sequence
cttcaggggctggattgcag

SEQ ID NO: 489254 - DNA, 20 bp, Artificial
  CRISPR gRNA sequence
ttcaggggctggattgcagt

SEQ ID NO: 489255 - DNA, 20 bp, Artificial
  CRISPR gRNA sequence
ggctggattgcagtgggact

SEQ ID NO: 489256 - DNA, 20 bp, Artificial
  CRISPR gRNA sequence
ggattgcagtgggactcagt

SEQ ID NO: 489257 - DNA, 20 bp, Artificial
  CRISPR gRNA sequence
gattgcagtgggactcagta

SEQ ID NO: 489258 - DNA, 20 bp, Artificial
  CRISPR gRNA sequence
taaggactgaataattgatg

SEQ ID NO: 489259 - DNA, 20 bp, Artificial
  CRISPR gRNA sequence
gactgaataattgatgaaga

SEQ ID NO: 489260 - DNA, 20 bp, Artificial
  CRISPR gRNA sequence
gacagtatatgtcctccttg

SEQ ID NO: 489261 - DNA, 20 bp, Artificial
  CRISPR gRNA sequence
acagtatatgtcctccttgt

SEQ ID NO: 489262 - DNA, 20 bp, Artificial
  CRISPR gRNA sequence
atatgtcctccttgtaggtt

SEQ ID NO: 489263 - DNA, 20 bp, Artificial
  CRISPR gRNA sequence
tttccattcacctttgttct

SEQ ID NO: 489264 - DNA, 20 bp, Artificial
  CRISPR gRNA sequence
ttccattcacctttgttctc

SEQ ID NO: 489265 - DNA, 20 bp, Artificial
  CRISPR gRNA sequence
tccattcacctttgttctca

SEQ ID NO: 489266 - DNA, 20 bp, Artificial
  CRISPR gRNA sequence
cagggtctttgtgcaatatt

SEQ ID NO: 489267 - DNA, 20 bp, Artificial
  CRISPR gRNA sequence
ggtctttgtgcaatatttgg

SEQ ID NO: 489268 - DNA, 20 bp, Artificial
  CRISPR gRNA sequence
gtctttgtgcaatatttggt

SEQ ID NO: 489269 - DNA, 20 bp, Artificial
  CRISPR gRNA sequence
ggttgacttgttcttataaa

SEQ ID NO: 489270 - DNA, 20 bp, Artificial
  CRISPR gRNA sequence
cttgttcttataaatagtgc

SEQ ID NO: 489271 - DNA, 20 bp, Artificial
  CRISPR gRNA sequence
ttgttcttataaatagtgct

SEQ ID NO: 489272 - DNA, 20 bp, Artificial
  CRISPR gRNA sequence
tataaatagtgctaggatcg

SEQ ID NO: 489273 - DNA, 20 bp, Artificial
  CRISPR gRNA sequence
ataaatagtgctaggatcgt

SEQ ID NO: 489274 - DNA, 20 bp, Artificial
  CRISPR gRNA sequence
aaatagtgctaggatcgtag

SEQ ID NO: 489275 - DNA, 20 bp, Artificial
  CRISPR gRNA sequence
agtgctaggatcgtaggaga

SEQ ID NO: 489276 - DNA, 20 bp, Artificial
  CRISPR gRNA sequence
tgctaggatcgtaggagaca

SEQ ID NO: 489277 - DNA, 20 bp, Artificial
  CRISPR gRNA sequence
gatcgtaggagacagagaca

SEQ ID NO: 489278 - DNA, 20 bp, Artificial
  CRISPR gRNA sequence
tcgtaggagacagagacaca

SEQ ID NO: 489279 - DNA, 20 bp, Artificial
  CRISPR gRNA sequence
gacagagacacagagatgca

SEQ ID NO: 489280 - DNA, 20 bp, Artificial
  CRISPR gRNA sequence
agacacagagatgcacagca

SEQ ID NO: 489281 - DNA, 20 bp, Artificial
  CRISPR gRNA sequence
acagcacagtctctgctttt

SEQ ID NO: 489282 - DNA, 20 bp, Artificial
  CRISPR gRNA sequence
gcacagtctctgcttttgag

SEQ ID NO: 489283 - DNA, 20 bp, Artificial
  CRISPR gRNA sequence
ctctgcttttgagaagcttt

SEQ ID NO: 489284 - DNA, 20 bp, Artificial
  CRISPR gRNA sequence
agaagcttttggtttgctaa

SEQ ID NO: 489285 - DNA, 20 bp, Artificial
  CRISPR gRNA sequence
gaagcttttggtttgctaat

SEQ ID NO: 489286 - DNA, 20 bp, Artificial
  CRISPR gRNA sequence
gcttttggtttgctaatggg

SEQ ID NO: 489287 - DNA, 20 bp, Artificial
  CRISPR gRNA sequence
ttttggtttgctaatgggca

SEQ ID NO: 489288 - DNA, 20 bp, Artificial
  CRISPR gRNA sequence
ggtttgctaatgggcagagc

SEQ ID NO: 489289 - DNA, 20 bp, Artificial
  CRISPR gRNA sequence
ctaatgggcagagccagtac

SEQ ID NO: 489290 - DNA, 20 bp, Artificial
  CRISPR gRNA sequence
acaagtcatataaatataaa

SEQ ID NO: 489291 - DNA, 20 bp, Artificial
  CRISPR gRNA sequence
caagtcatataaatataaat

SEQ ID NO: 489292 - DNA, 20 bp, Artificial
  CRISPR gRNA sequence
aaatgggaacctatgtgttt

SEQ ID NO: 489293 - DNA, 20 bp, Artificial
  CRISPR gRNA sequence
gaacctatgtgttttagtct

SEQ ID NO: 489294 - DNA, 20 bp, Artificial
  CRISPR gRNA sequence
aacctatgtgttttagtctt

SEQ ID NO: 489295 - DNA, 20 bp, Artificial
  CRISPR gRNA sequence
cctatgtgttttagtcttag

SEQ ID NO: 489296 - DNA, 20 bp, Artificial
  CRISPR gRNA sequence
gttttagtcttaggagcatc

SEQ ID NO: 489297 - DNA, 20 bp, Artificial
  CRISPR gRNA sequence
tcttaggagcatcaagatca

SEQ ID NO: 489298 - DNA, 20 bp, Artificial
  CRISPR gRNA sequence
aacatatttcatcaaacaaa

SEQ ID NO: 489299 - DNA, 20 bp, Artificial
  CRISPR gRNA sequence
catcaaacaaatagtattac

SEQ ID NO: 489300 - DNA, 20 bp, Artificial
  CRISPR gRNA sequence
aagtcctttaattatttact

SEQ ID NO: 489301 - DNA, 20 bp, Artificial
  CRISPR gRNA sequence
aattatttacttagtctctt

SEQ ID NO: 489302 - DNA, 20 bp, Artificial
  CRISPR gRNA sequence
ttagtctcttgagaaaatgc

SEQ ID NO: 489303 - DNA, 20 bp, Artificial
  CRISPR gRNA sequence
tagtctcttgagaaaatgcc

SEQ ID NO: 489304 - DNA, 20 bp, Artificial
  CRISPR gRNA sequence
agtctcttgagaaaatgcca

SEQ ID NO: 489305 - DNA, 20 bp, Artificial
  CRISPR gRNA sequence
cttgagaaaatgccagggtg

SEQ ID NO: 489306 - DNA, 20 bp, Artificial
  CRISPR gRNA sequence
aaaatgccagggtgaagctg

SEQ ID NO: 489307 - DNA, 20 bp, Artificial
  CRISPR gRNA sequence
gccagggtgaagctgtggct

SEQ ID NO: 489308 - DNA, 20 bp, Artificial
  CRISPR gRNA sequence
cagggtgaagctgtggcttg

SEQ ID NO: 489309 - DNA, 20 bp, Artificial
  CRISPR gRNA sequence
gggtgaagctgtggcttgga

SEQ ID NO: 489310 - DNA, 20 bp, Artificial
  CRISPR gRNA sequence
agactgcattcataatgcac

SEQ ID NO: 489311 - DNA, 20 bp, Artificial
  CRISPR gRNA sequence
ctcaattgctctcttcttaa

SEQ ID NO: 489312 - DNA, 20 bp, Artificial
  CRISPR gRNA sequence
cttaatagcctccattttaa

SEQ ID NO: 489313 - DNA, 20 bp, Artificial
  CRISPR gRNA sequence
taatagcctccattttaacg

SEQ ID NO: 489314 - DNA, 20 bp, Artificial
  CRISPR gRNA sequence
ttctcttccaaatcctccct

SEQ ID NO: 489315 - DNA, 20 bp, Artificial
  CRISPR gRNA sequence
ctgagcctccccaactcacc

SEQ ID NO: 489316 - DNA, 20 bp, Artificial
  CRISPR gRNA sequence
gagcctccccaactcaccca

SEQ ID NO: 489317 - DNA, 20 bp, Artificial
  CRISPR gRNA sequence
gcctccccaactcacccaga

SEQ ID NO: 489318 - DNA, 20 bp, Artificial
  CRISPR gRNA sequence
ttttaatttcctgcacctgc

SEQ ID NO: 489319 - DNA, 20 bp, Artificial
  CRISPR gRNA sequence
tttaatttcctgcacctgct

SEQ ID NO: 489320 - DNA, 20 bp, Artificial
  CRISPR gRNA sequence
acctgctgggccatgccaca

SEQ ID NO: 489321 - DNA, 20 bp, Artificial
  CRISPR gRNA sequence
catagctttattactaaaaa

SEQ ID NO: 489322 - DNA, 20 bp, Artificial
  CRISPR gRNA sequence
tttattactaaaaatggctg

SEQ ID NO: 489323 - DNA, 20 bp, Artificial
  CRISPR gRNA sequence
ttattactaaaaatggctgt

SEQ ID NO: 489324 - DNA, 20 bp, Artificial
  CRISPR gRNA sequence
aaaatggctgtaggaacttc

SEQ ID NO: 489325 - DNA, 20 bp, Artificial
  CRISPR gRNA sequence
agttttgtacactgactgca

SEQ ID NO: 489326 - DNA, 20 bp, Artificial
  CRISPR gRNA sequence
ctgactgcacagaattgctc

SEQ ID NO: 489327 - DNA, 20 bp, Artificial
  CRISPR gRNA sequence
tgactgcacagaattgctct

SEQ ID NO: 489328 - DNA, 20 bp, Artificial
  CRISPR gRNA sequence
tgtcacacccccatattcat

SEQ ID NO: 489329 - DNA, 20 bp, Artificial
  CRISPR gRNA sequence
gtcacacccccatattcatt

SEQ ID NO: 489330 - DNA, 20 bp, Artificial
  CRISPR gRNA sequence
aggtttcatcttgattcttt

SEQ ID NO: 489331 - DNA, 20 bp, Artificial
  CRISPR gRNA sequence
gtttcatcttgattctttga

SEQ ID NO: 489332 - DNA, 20 bp, Artificial
  CRISPR gRNA sequence
tttcatcttgattctttgag

SEQ ID NO: 489333 - DNA, 20 bp, Artificial
  CRISPR gRNA sequence
atcttgattctttgagaggc

SEQ ID NO: 489334 - DNA, 20 bp, Artificial
  CRISPR gRNA sequence
attctttgagaggcaagtgc

SEQ ID NO: 489335 - DNA, 20 bp, Artificial
  CRISPR gRNA sequence
ttctttgagaggcaagtgct

SEQ ID NO: 489336 - DNA, 20 bp, Artificial
  CRISPR gRNA sequence
ggcaagtgctgggatctgcc

SEQ ID NO: 489337 - DNA, 20 bp, Artificial
  CRISPR gRNA sequence
gcaagtgctgggatctgcct

SEQ ID NO: 489338 - DNA, 20 bp, Artificial
  CRISPR gRNA sequence
agtgctgggatctgcctggg

SEQ ID NO: 489339 - DNA, 20 bp, Artificial
  CRISPR gRNA sequence
tgggatctgcctgggaagtg

SEQ ID NO: 489340 - DNA, 20 bp, Artificial
  CRISPR gRNA sequence
ttatttttaaaattgttttc

SEQ ID NO: 489341 - DNA, 20 bp, Artificial
  CRISPR gRNA sequence
tatttttaaaattgttttct

SEQ ID NO: 489342 - DNA, 20 bp, Artificial
  CRISPR gRNA sequence
atttttaaaattgttttcta

SEQ ID NO: 489343 - DNA, 20 bp, Artificial
  CRISPR gRNA sequence
ttttaaaattgttttctagg

SEQ ID NO: 489344 - DNA, 20 bp, Artificial
  CRISPR gRNA sequence
tttctagggagaaatttttg

SEQ ID NO: 489345 - DNA, 20 bp, Artificial
  CRISPR gRNA sequence
tctagggagaaatttttgtg

SEQ ID NO: 489346 - DNA, 20 bp, Artificial
  CRISPR gRNA sequence
ctttctgatcactgaaaaac

SEQ ID NO: 489347 - DNA, 20 bp, Artificial
  CRISPR gRNA sequence
aaaaactggcaaacatcaat

SEQ ID NO: 489348 - DNA, 20 bp, Artificial
  CRISPR gRNA sequence
tgaccaaaatccaatgaacc

SEQ ID NO: 489349 - DNA, 20 bp, Artificial
  CRISPR gRNA sequence
tccaatgaaccaagtgccac

SEQ ID NO: 489350 - DNA, 20 bp, Artificial
  CRISPR gRNA sequence
caatgaaccaagtgccacga

SEQ ID NO: 489351 - DNA, 20 bp, Artificial
  CRISPR gRNA sequence
atgaaccaagtgccacgaga

SEQ ID NO: 489352 - DNA, 20 bp, Artificial
  CRISPR gRNA sequence
tgaaccaagtgccacgagag

SEQ ID NO: 489353 - DNA, 20 bp, Artificial
  CRISPR gRNA sequence
acgagagaggattatgtatt

SEQ ID NO: 489354 - DNA, 20 bp, Artificial
  CRISPR gRNA sequence
gattatgtattcagctctgt

SEQ ID NO: 489355 - DNA, 20 bp, Artificial
  CRISPR gRNA sequence
ttatgtattcagctctgtga

SEQ ID NO: 489356 - DNA, 20 bp, Artificial
  CRISPR gRNA sequence
tatgtattcagctctgtgag

SEQ ID NO: 489357 - DNA, 20 bp, Artificial
  CRISPR gRNA sequence
tattcagctctgtgagagga

SEQ ID NO: 489358 - DNA, 20 bp, Artificial
  CRISPR gRNA sequence
agctctgtgagaggatggtt

SEQ ID NO: 489359 - DNA, 20 bp, Artificial
  CRISPR gRNA sequence
gctctgtgagaggatggttg

SEQ ID NO: 489360 - DNA, 20 bp, Artificial
  CRISPR gRNA sequence
ctctgtgagaggatggttga

SEQ ID NO: 489361 - DNA, 20 bp, Artificial
  CRISPR gRNA sequence
tctgtgagaggatggttgag

SEQ ID NO: 489362 - DNA, 20 bp, Artificial
  CRISPR gRNA sequence
gaggatggttgaggggccat

SEQ ID NO: 489363 - DNA, 20 bp, Artificial
  CRISPR gRNA sequence
tggttgaggggccatgagtt

SEQ ID NO: 489364 - DNA, 20 bp, Artificial
  CRISPR gRNA sequence
gaggggccatgagttcagct

SEQ ID NO: 489365 - DNA, 20 bp, Artificial
  CRISPR gRNA sequence
ggccatgagttcagcttgga

SEQ ID NO: 489366 - DNA, 20 bp, Artificial
  CRISPR gRNA sequence
atgagttcagcttggacggt

SEQ ID NO: 489367 - DNA, 20 bp, Artificial
  CRISPR gRNA sequence
gcttggacggttagtcttcc

SEQ ID NO: 489368 - DNA, 20 bp, Artificial
  CRISPR gRNA sequence
cttggacggttagtcttcct

SEQ ID NO: 489369 - DNA, 20 bp, Artificial
  CRISPR gRNA sequence
tcttcctgggcctgaccatt

SEQ ID NO: 489370 - DNA, 20 bp, Artificial
  CRISPR gRNA sequence
tgaccattcagaatttccaa

SEQ ID NO: 489371 - DNA, 20 bp, Artificial
  CRISPR gRNA sequence
caacagtcactacttgccat

SEQ ID NO: 489372 - DNA, 20 bp, Artificial
  CRISPR gRNA sequence
cagtcactacttgccattag

SEQ ID NO: 489373 - DNA, 20 bp, Artificial
  CRISPR gRNA sequence
cttgccattagtagttgcct

SEQ ID NO: 489374 - DNA, 20 bp, Artificial
  CRISPR gRNA sequence
gtagttgcctcagcactgct

SEQ ID NO: 489375 - DNA, 20 bp, Artificial
  CRISPR gRNA sequence
agttgcctcagcactgcttg

SEQ ID NO: 489376 - DNA, 20 bp, Artificial
  CRISPR gRNA sequence
gttgcctcagcactgcttgg

SEQ ID NO: 489377 - DNA, 20 bp, Artificial
  CRISPR gRNA sequence
ttgcctcagcactgcttgga

SEQ ID NO: 489378 - DNA, 20 bp, Artificial
  CRISPR gRNA sequence
gcctcagcactgcttggagg

SEQ ID NO: 489379 - DNA, 20 bp, Artificial
  CRISPR gRNA sequence
ctgcttggagggagtcacct

SEQ ID NO: 489380 - DNA, 20 bp, Artificial
  CRISPR gRNA sequence
ggagggagtcaccttagatg

SEQ ID NO: 489381 - DNA, 20 bp, Artificial
  CRISPR gRNA sequence
caccttagatgtggtattta

SEQ ID NO: 489382 - DNA, 20 bp, Artificial
  CRISPR gRNA sequence
atgtggtatttatagcatca

SEQ ID NO: 489383 - DNA, 20 bp, Artificial
  CRISPR gRNA sequence
gtatttatagcatcatggtt

SEQ ID NO: 489384 - DNA, 20 bp, Artificial
  CRISPR gRNA sequence
ggttaagaatttatcctctc

SEQ ID NO: 489385 - DNA, 20 bp, Artificial
  CRISPR gRNA sequence
gccaaactgctgtctttaca

SEQ ID NO: 489386 - DNA, 20 bp, Artificial
  CRISPR gRNA sequence
caaactgctgtctttacaaa

SEQ ID NO: 489387 - DNA, 20 bp, Artificial
  CRISPR gRNA sequence
tttacaaagagtaaacaaat

SEQ ID NO: 489388 - DNA, 20 bp, Artificial
  CRISPR gRNA sequence
gagtaaacaaataagctccc

SEQ ID NO: 489389 - DNA, 20 bp, Artificial
  CRISPR gRNA sequence
ctccctagcacctgtgctcc

SEQ ID NO: 489390 - DNA, 20 bp, Artificial
  CRISPR gRNA sequence
gcacctgtgctcccagctac

SEQ ID NO: 489391 - DNA, 20 bp, Artificial
  CRISPR gRNA sequence
cacctgtgctcccagctact

SEQ ID NO: 489392 - DNA, 20 bp, Artificial
  CRISPR gRNA sequence
acctgtgctcccagctacta

SEQ ID NO: 489393 - DNA, 20 bp, Artificial
  CRISPR gRNA sequence
ctgtgctcccagctactagg

SEQ ID NO: 489394 - DNA, 20 bp, Artificial
  CRISPR gRNA sequence
tgtgctcccagctactaggg

SEQ ID NO: 489395 - DNA, 20 bp, Artificial
  CRISPR gRNA sequence
tcccagctactagggaggtt

SEQ ID NO: 489396 - DNA, 20 bp, Artificial
  CRISPR gRNA sequence
agctactagggaggttgaga

SEQ ID NO: 489397 - DNA, 20 bp, Artificial
  CRISPR gRNA sequence
gctactagggaggttgagat

SEQ ID NO: 489398 - DNA, 20 bp, Artificial
  CRISPR gRNA sequence
tactagggaggttgagatgg

SEQ ID NO: 489399 - DNA, 20 bp, Artificial
  CRISPR gRNA sequence
actagggaggttgagatggg

SEQ ID NO: 489400 - DNA, 20 bp, Artificial
  CRISPR gRNA sequence
tgagatgggaggatcacctc

SEQ ID NO: 489401 - DNA, 20 bp, Artificial
  CRISPR gRNA sequence
tgggaggatcacctcaagcc

SEQ ID NO: 489402 - DNA, 20 bp, Artificial
  CRISPR gRNA sequence
gggaggatcacctcaagccc

SEQ ID NO: 489403 - DNA, 20 bp, Artificial
  CRISPR gRNA sequence
gaggatcacctcaagcccag

SEQ ID NO: 489404 - DNA, 20 bp, Artificial
  CRISPR gRNA sequence
cacctcaagcccaggagttc

SEQ ID NO: 489405 - DNA, 20 bp, Artificial
  CRISPR gRNA sequence
acctcaagcccaggagttca

SEQ ID NO: 489406 - DNA, 20 bp, Artificial
  CRISPR gRNA sequence
agcccaggagttcaaggctg

SEQ ID NO: 489407 - DNA, 20 bp, Artificial
  CRISPR gRNA sequence
caggagttcaaggctgcagt

SEQ ID NO: 489408 - DNA, 20 bp, Artificial
  CRISPR gRNA sequence
gtgattgcgccactgcactc

SEQ ID NO: 489409 - DNA, 20 bp, Artificial
  CRISPR gRNA sequence
tgcgccactgcactccagcc

SEQ ID NO: 489410 - DNA, 20 bp, Artificial
  CRISPR gRNA sequence
gcgccactgcactccagcct

SEQ ID NO: 489411 - DNA, 20 bp, Artificial
  CRISPR gRNA sequence
ctgcactccagcctgggtga

SEQ ID NO: 489412 - DNA, 20 bp, Artificial
  CRISPR gRNA sequence
gcactccagcctgggtgaca

SEQ ID NO: 489413 - DNA, 20 bp, Artificial
  CRISPR gRNA sequence
tccagcctgggtgacagagt

SEQ ID NO: 489414 - DNA, 20 bp, Artificial
  CRISPR gRNA sequence
acagagtgagaccctgtctc

SEQ ID NO: 489415 - DNA, 20 bp, Artificial
  CRISPR gRNA sequence
gtctctagaaaacaaaacaa

SEQ ID NO: 489416 - DNA, 20 bp, Artificial
  CRISPR gRNA sequence
aaacataacaccaaactgac

SEQ ID NO: 489417 - DNA, 20 bp, Artificial
  CRISPR gRNA sequence
aacataacaccaaactgact

SEQ ID NO: 489418 - DNA, 20 bp, Artificial
  CRISPR gRNA sequence
acaccaaactgactaggttt

SEQ ID NO: 489419 - DNA, 20 bp, Artificial
  CRISPR gRNA sequence
caccaaactgactaggtttc

SEQ ID NO: 489420 - DNA, 20 bp, Artificial
  CRISPR gRNA sequence
atcataccttttaacttaaa

SEQ ID NO: 489421 - DNA, 20 bp, Artificial
  CRISPR gRNA sequence
ttaaatagttaaaatgtata

SEQ ID NO: 489422 - DNA, 20 bp, Artificial
  CRISPR gRNA sequence
tgtgaaacctgcctgtcaca

SEQ ID NO: 489423 - DNA, 20 bp, Artificial
  CRISPR gRNA sequence
aaacctgcctgtcacatagt

SEQ ID NO: 489424 - DNA, 20 bp, Artificial
  CRISPR gRNA sequence
ctgtcacatagtaagtactc

SEQ ID NO: 489425 - DNA, 20 bp, Artificial
  CRISPR gRNA sequence
atagtaagtactcaagattt

SEQ ID NO: 489426 - DNA, 20 bp, Artificial
  CRISPR gRNA sequence
gtactcaagattttagctat

SEQ ID NO: 489427 - DNA, 20 bp, Artificial
  CRISPR gRNA sequence
agattttagctattggtcta

SEQ ID NO: 489428 - DNA, 20 bp, Artificial
  CRISPR gRNA sequence
gattttagctattggtctat

SEQ ID NO: 489429 - DNA, 20 bp, Artificial
  CRISPR gRNA sequence
tattggtctatgggatccct

SEQ ID NO: 489430 - DNA, 20 bp, Artificial
  CRISPR gRNA sequence
gtctatgggatccctcagac

SEQ ID NO: 489431 - DNA, 20 bp, Artificial
  CRISPR gRNA sequence
tctatgggatccctcagact

SEQ ID NO: 489432 - DNA, 20 bp, Artificial
  CRISPR gRNA sequence
ctatgggatccctcagacta

SEQ ID NO: 489433 - DNA, 20 bp, Artificial
  CRISPR gRNA sequence
gatccctcagactagggaca

SEQ ID NO: 489434 - DNA, 20 bp, Artificial
  CRISPR gRNA sequence
tccctcagactagggacaca

SEQ ID NO: 489435 - DNA, 20 bp, Artificial
  CRISPR gRNA sequence
cagactagggacacagagct

SEQ ID NO: 489436 - DNA, 20 bp, Artificial
  CRISPR gRNA sequence
agactagggacacagagctt

SEQ ID NO: 489437 - DNA, 20 bp, Artificial
  CRISPR gRNA sequence
gactagggacacagagcttg

SEQ ID NO: 489438 - DNA, 20 bp, Artificial
  CRISPR gRNA sequence
gggacacagagcttggggac

SEQ ID NO: 489439 - DNA, 20 bp, Artificial
  CRISPR gRNA sequence
ggacacagagcttggggaca

SEQ ID NO: 489440 - DNA, 20 bp, Artificial
  CRISPR gRNA sequence
gacacagagcttggggacaa

SEQ ID NO: 489441 - DNA, 20 bp, Artificial
  CRISPR gRNA sequence
acacagagcttggggacaag

SEQ ID NO: 489442 - DNA, 20 bp, Artificial
  CRISPR gRNA sequence
acagagcttggggacaaggg

SEQ ID NO: 489443 - DNA, 20 bp, Artificial
  CRISPR gRNA sequence
cagagcttggggacaagggg

SEQ ID NO: 489444 - DNA, 20 bp, Artificial
  CRISPR gRNA sequence
agcttggggacaaggggagg

SEQ ID NO: 489445 - DNA, 20 bp, Artificial
  CRISPR gRNA sequence
tggggacaaggggaggcaga

SEQ ID NO: 489446 - DNA, 20 bp, Artificial
  CRISPR gRNA sequence
gggacaaggggaggcagatg

SEQ ID NO: 489447 - DNA, 20 bp, Artificial
  CRISPR gRNA sequence
ggacaaggggaggcagatgg

SEQ ID NO: 489448 - DNA, 20 bp, Artificial
  CRISPR gRNA sequence
gacaaggggaggcagatgga

SEQ ID NO: 489449 - DNA, 20 bp, Artificial
  CRISPR gRNA sequence
acaaggggaggcagatggag

SEQ ID NO: 489450 - DNA, 20 bp, Artificial
  CRISPR gRNA sequence
agatggaggggatatgcttt

SEQ ID NO: 489451 - DNA, 20 bp, Artificial
  CRISPR gRNA sequence
gatggaggggatatgcttta

SEQ ID NO: 489452 - DNA, 20 bp, Artificial
  CRISPR gRNA sequence
gatatgctttaaggtgctcc

SEQ ID NO: 489453 - DNA, 20 bp, Artificial
  CRISPR gRNA sequence
atatgctttaaggtgctcct

SEQ ID NO: 489454 - DNA, 20 bp, Artificial
  CRISPR gRNA sequence
tttaaggtgctcctaggttc

SEQ ID NO: 489455 - DNA, 20 bp, Artificial
  CRISPR gRNA sequence
ttaaggtgctcctaggttct

SEQ ID NO: 489456 - DNA, 20 bp, Artificial
  CRISPR gRNA sequence
catactcatccccacccaat

SEQ ID NO: 489457 - DNA, 20 bp, Artificial
  CRISPR gRNA sequence
catccccacccaattggctt

SEQ ID NO: 489458 - DNA, 20 bp, Artificial
  CRISPR gRNA sequence
atccccacccaattggctta

SEQ ID NO: 489459 - DNA, 20 bp, Artificial
  CRISPR gRNA sequence
tccccacccaattggcttaa

SEQ ID NO: 489460 - DNA, 20 bp, Artificial
  CRISPR gRNA sequence
ccacccaattggcttaaggg

SEQ ID NO: 489461 - DNA, 20 bp, Artificial
  CRISPR gRNA sequence
ggcttaagggaagtcacatc

SEQ ID NO: 489462 - DNA, 20 bp, Artificial
  CRISPR gRNA sequence
atccagctgcccacattgct

SEQ ID NO: 489463 - DNA, 20 bp, Artificial
  CRISPR gRNA sequence
tccagctgcccacattgctc

SEQ ID NO: 489464 - DNA, 20 bp, Artificial
  CRISPR gRNA sequence
gacactcttcccgctacttt

SEQ ID NO: 489465 - DNA, 20 bp, Artificial
  CRISPR gRNA sequence
tcttcccgctactttcagct

SEQ ID NO: 489466 - DNA, 20 bp, Artificial
  CRISPR gRNA sequence
cttcccgctactttcagctt

SEQ ID NO: 489467 - DNA, 20 bp, Artificial
  CRISPR gRNA sequence
tcagcttgggttctctttcc

SEQ ID NO: 489468 - DNA, 20 bp, Artificial
  CRISPR gRNA sequence
cagcttgggttctctttcct

SEQ ID NO: 489469 - DNA, 20 bp, Artificial
  CRISPR gRNA sequence
ggttctctttcctaggatgc

SEQ ID NO: 489470 - DNA, 20 bp, Artificial
  CRISPR gRNA sequence
gttctctttcctaggatgcc

SEQ ID NO: 489471 - DNA, 20 bp, Artificial
  CRISPR gRNA sequence
ttctctttcctaggatgcca

SEQ ID NO: 489472 - DNA, 20 bp, Artificial
  CRISPR gRNA sequence
tttcctaggatgccagggat

SEQ ID NO: 489473 - DNA, 20 bp, Artificial
  CRISPR gRNA sequence
ccagggatcagctgaccatg

SEQ ID NO: 489474 - DNA, 20 bp, Artificial
  CRISPR gRNA sequence
ggatcagctgaccatgtggt

SEQ ID NO: 489475 - DNA, 20 bp, Artificial
  CRISPR gRNA sequence
tgaccatgtggttagcatct

SEQ ID NO: 489476 - DNA, 20 bp, Artificial
  CRISPR gRNA sequence
gaccatgtggttagcatctc

SEQ ID NO: 489477 - DNA, 20 bp, Artificial
  CRISPR gRNA sequence
ccatgtggttagcatctcgg

SEQ ID NO: 489478 - DNA, 20 bp, Artificial
  CRISPR gRNA sequence
gcatctcgggagtgcctctt

SEQ ID NO: 489479 - DNA, 20 bp, Artificial
  CRISPR gRNA sequence
cctcttcagttacaaccaaa

SEQ ID NO: 489480 - DNA, 20 bp, Artificial
  CRISPR gRNA sequence
agttacaaccaaacagcata

SEQ ID NO: 489481 - DNA, 20 bp, Artificial
  CRISPR gRNA sequence
aaccaaacagcatacagacg

SEQ ID NO: 489482 - DNA, 20 bp, Artificial
  CRISPR gRNA sequence
accaaacagcatacagacga

SEQ ID NO: 489483 - DNA, 20 bp, Artificial
  CRISPR gRNA sequence
agcatacagacgaaggttga

SEQ ID NO: 489484 - DNA, 20 bp, Artificial
  CRISPR gRNA sequence
cgaaggttgacagcattgca

SEQ ID NO: 489485 - DNA, 20 bp, Artificial
  CRISPR gRNA sequence
aggttgacagcattgcatgg

SEQ ID NO: 489486 - DNA, 20 bp, Artificial
  CRISPR gRNA sequence
ttgacagcattgcatggaag

SEQ ID NO: 489487 - DNA, 20 bp, Artificial
  CRISPR gRNA sequence
aagttgctgccctcacaaaa

SEQ ID NO: 489488 - DNA, 20 bp, Artificial
  CRISPR gRNA sequence
atggatttcatcacatattg

SEQ ID NO: 489489 - DNA, 20 bp, Artificial
  CRISPR gRNA sequence
gatttcatcacatattgaag

SEQ ID NO: 489490 - DNA, 20 bp, Artificial
  CRISPR gRNA sequence
atttcatcacatattgaagt

SEQ ID NO: 489491 - DNA, 20 bp, Artificial
  CRISPR gRNA sequence
ttcatcacatattgaagtgg

SEQ ID NO: 489492 - DNA, 20 bp, Artificial
  CRISPR gRNA sequence
cacatattgaagtgggagaa

SEQ ID NO: 489493 - DNA, 20 bp, Artificial
  CRISPR gRNA sequence
ccttccaatacttccaatga

SEQ ID NO: 489494 - DNA, 20 bp, Artificial
  CRISPR gRNA sequence
aatacttccaatgatagatt

SEQ ID NO: 489495 - DNA, 20 bp, Artificial
  CRISPR gRNA sequence
caatgatagattcagtttta

SEQ ID NO: 489496 - DNA, 20 bp, Artificial
  CRISPR gRNA sequence
atagattcagttttatagtc

SEQ ID NO: 489497 - DNA, 20 bp, Artificial
  CRISPR gRNA sequence
agttttatagtcaagaactt

SEQ ID NO: 489498 - DNA, 20 bp, Artificial
  CRISPR gRNA sequence
agaacttgagtcttctcatc

SEQ ID NO: 489499 - DNA, 20 bp, Artificial
  CRISPR gRNA sequence
gaacttgagtcttctcatca

SEQ ID NO: 489500 - DNA, 20 bp, Artificial
  CRISPR gRNA sequence
cttgagtcttctcatcaagg

SEQ ID NO: 489501 - DNA, 20 bp, Artificial
  CRISPR gRNA sequence
gtcttctcatcaaggcagct

SEQ ID NO: 489502 - DNA, 20 bp, Artificial
  CRISPR gRNA sequence
ttctcatcaaggcagctcag

SEQ ID NO: 489503 - DNA, 20 bp, Artificial
  CRISPR gRNA sequence
tcatcaaggcagctcagcag

SEQ ID NO: 489504 - DNA, 20 bp, Artificial
  CRISPR gRNA sequence
catcaaggcagctcagcagc

SEQ ID NO: 489505 - DNA, 20 bp, Artificial
  CRISPR gRNA sequence
aaggcagctcagcagcagga

SEQ ID NO: 489506 - DNA, 20 bp, Artificial
  CRISPR gRNA sequence
gcagctcagcagcaggacag

SEQ ID NO: 489507 - DNA, 20 bp, Artificial
  CRISPR gRNA sequence
ggacagtggcctctactgcc

SEQ ID NO: 489508 - DNA, 20 bp, Artificial
  CRISPR gRNA sequence
acagtggcctctactgcctg

SEQ ID NO: 489509 - DNA, 20 bp, Artificial
  CRISPR gRNA sequence
cagtggcctctactgcctgg

SEQ ID NO: 489510 - DNA, 20 bp, Artificial
  CRISPR gRNA sequence
ctctactgcctggaggtcac

SEQ ID NO: 489511 - DNA, 20 bp, Artificial
  CRISPR gRNA sequence
ctggaggtcaccagtatatc

SEQ ID NO: 489512 - DNA, 20 bp, Artificial
  CRISPR gRNA sequence
ggtcaccagtatatctggaa

SEQ ID NO: 489513 - DNA, 20 bp, Artificial
  CRISPR gRNA sequence
ccagtatatctggaaaagtt

SEQ ID NO: 489514 - DNA, 20 bp, Artificial
  CRISPR gRNA sequence
tatatctggaaaagttcaga

SEQ ID NO: 489515 - DNA, 20 bp, Artificial
  CRISPR gRNA sequence
aagttcagacagccacgttc

SEQ ID NO: 489516 - DNA, 20 bp, Artificial
  CRISPR gRNA sequence
agttcagacagccacgttcc

SEQ ID NO: 489517 - DNA, 20 bp, Artificial
  CRISPR gRNA sequence
acgttccaggtttttgtatt

SEQ ID NO: 489518 - DNA, 20 bp, Artificial
  CRISPR gRNA sequence
tccaggtttttgtatttggt

SEQ ID NO: 489519 - DNA, 20 bp, Artificial
  CRISPR gRNA sequence
ttttgtatttggtaagtctc

SEQ ID NO: 489520 - DNA, 20 bp, Artificial
  CRISPR gRNA sequence
tttgtatttggtaagtctcc

SEQ ID NO: 489521 - DNA, 20 bp, Artificial
  CRISPR gRNA sequence
actgccctctctgattccta

SEQ ID NO: 489522 - DNA, 20 bp, Artificial
  CRISPR gRNA sequence
ctgccctctctgattcctat

SEQ ID NO: 489523 - DNA, 20 bp, Artificial
  CRISPR gRNA sequence
tctgattcctataggcctct

SEQ ID NO: 489524 - DNA, 20 bp, Artificial
  CRISPR gRNA sequence
atttccaatgcctttctgat

SEQ ID NO: 489525 - DNA, 20 bp, Artificial
  CRISPR gRNA sequence
ctgatcagaatctctgcttc

SEQ ID NO: 489526 - DNA, 20 bp, Artificial
  CRISPR gRNA sequence
agaatctctgcttccagata

SEQ ID NO: 489527 - DNA, 20 bp, Artificial
  CRISPR gRNA sequence
ctctgcttccagataaagtt

SEQ ID NO: 489528 - DNA, 20 bp, Artificial
  CRISPR gRNA sequence
aagttgagaaaccccgccta

SEQ ID NO: 489529 - DNA, 20 bp, Artificial
  CRISPR gRNA sequence
agttgagaaaccccgcctac

SEQ ID NO: 489530 - DNA, 20 bp, Artificial
  CRISPR gRNA sequence
gttgagaaaccccgcctaca

SEQ ID NO: 489531 - DNA, 20 bp, Artificial
  CRISPR gRNA sequence
ttgagaaaccccgcctacag

SEQ ID NO: 489532 - DNA, 20 bp, Artificial
  CRISPR gRNA sequence
agaaaccccgcctacagggg

SEQ ID NO: 489533 - DNA, 20 bp, Artificial
  CRISPR gRNA sequence
gaaaccccgcctacaggggc

SEQ ID NO: 489534 - DNA, 20 bp, Artificial
  CRISPR gRNA sequence
aaaccccgcctacaggggca

SEQ ID NO: 489535 - DNA, 20 bp, Artificial
  CRISPR gRNA sequence
aaccccgcctacaggggcag

SEQ ID NO: 489536 - DNA, 20 bp, Artificial
  CRISPR gRNA sequence
cccgcctacaggggcagggg

SEQ ID NO: 489537 - DNA, 20 bp, Artificial
  CRISPR gRNA sequence
acaggggcaggggaagatcc

SEQ ID NO: 489538 - DNA, 20 bp, Artificial
  CRISPR gRNA sequence
gggcaggggaagatcctgga

SEQ ID NO: 489539 - DNA, 20 bp, Artificial
  CRISPR gRNA sequence
gcaggggaagatcctggaca

SEQ ID NO: 489540 - DNA, 20 bp, Artificial
  CRISPR gRNA sequence
caggggaagatcctggacag

SEQ ID NO: 489541 - DNA, 20 bp, Artificial
  CRISPR gRNA sequence
aggggaagatcctggacaga

SEQ ID NO: 489542 - DNA, 20 bp, Artificial
  CRISPR gRNA sequence
gggaagatcctggacagagg

SEQ ID NO: 489543 - DNA, 20 bp, Artificial
  CRISPR gRNA sequence
cctggacagagggagatgcc

SEQ ID NO: 489544 - DNA, 20 bp, Artificial
  CRISPR gRNA sequence
ggacagagggagatgccaag

SEQ ID NO: 489545 - DNA, 20 bp, Artificial
  CRISPR gRNA sequence
ccaagtggctctgtcttgct

SEQ ID NO: 489546 - DNA, 20 bp, Artificial
  CRISPR gRNA sequence
gctctgtcttgcttggtctc

SEQ ID NO: 489547 - DNA, 20 bp, Artificial
  CRISPR gRNA sequence
ctctgtcttgcttggtctcc

SEQ ID NO: 489548 - DNA, 20 bp, Artificial
  CRISPR gRNA sequence
tctgtcttgcttggtctcca

SEQ ID NO: 489549 - DNA, 20 bp, Artificial
  CRISPR gRNA sequence
tcttgcttggtctccaggga

SEQ ID NO: 489550 - DNA, 20 bp, Artificial
  CRISPR gRNA sequence
atggcaatgtgtcctatgct

SEQ ID NO: 489551 - DNA, 20 bp, Artificial
  CRISPR gRNA sequence
aatgtgtcctatgcttggta

SEQ ID NO: 489552 - DNA, 20 bp, Artificial
  CRISPR gRNA sequence
tgtgtcctatgcttggtaca

SEQ ID NO: 489553 - DNA, 20 bp, Artificial
  CRISPR gRNA sequence
gtgtcctatgcttggtacag

SEQ ID NO: 489554 - DNA, 20 bp, Artificial
  CRISPR gRNA sequence
tgtcctatgcttggtacaga

SEQ ID NO: 489555 - DNA, 20 bp, Artificial
  CRISPR gRNA sequence
tcctatgcttggtacagagg

SEQ ID NO: 489556 - DNA, 20 bp, Artificial
  CRISPR gRNA sequence
atgcttggtacagagggagc

SEQ ID NO: 489557 - DNA, 20 bp, Artificial
  CRISPR gRNA sequence
acagagggagcaagctgatc

SEQ ID NO: 489558 - DNA, 20 bp, Artificial
  CRISPR gRNA sequence
agggagcaagctgatccaga

SEQ ID NO: 489559 - DNA, 20 bp, Artificial
  CRISPR gRNA sequence
gagcaagctgatccagacag

SEQ ID NO: 489560 - DNA, 20 bp, Artificial
  CRISPR gRNA sequence
agcaagctgatccagacagc

SEQ ID NO: 489561 - DNA, 20 bp, Artificial
  CRISPR gRNA sequence
gcaagctgatccagacagca

SEQ ID NO: 489562 - DNA, 20 bp, Artificial
  CRISPR gRNA sequence
agcagggaacctcacctacc

SEQ ID NO: 489563 - DNA, 20 bp, Artificial
  CRISPR gRNA sequence
ggaacctcacctacctggac

SEQ ID NO: 489564 - DNA, 20 bp, Artificial
  CRISPR gRNA sequence
gaacctcacctacctggacg

SEQ ID NO: 489565 - DNA, 20 bp, Artificial
  CRISPR gRNA sequence
acctcacctacctggacgag

SEQ ID NO: 489566 - DNA, 20 bp, Artificial
  CRISPR gRNA sequence
cctcacctacctggacgagg

SEQ ID NO: 489567 - DNA, 20 bp, Artificial
  CRISPR gRNA sequence
gacgaggaggttgacattaa

SEQ ID NO: 489568 - DNA, 20 bp, Artificial
  CRISPR gRNA sequence
cacacatatacctgcaatgt

SEQ ID NO: 489569 - DNA, 20 bp, Artificial
  CRISPR gRNA sequence
tgcaatgtcagcaatcctgt

SEQ ID NO: 489570 - DNA, 20 bp, Artificial
  CRISPR gRNA sequence
atgtcagcaatcctgttagc

SEQ ID NO: 489571 - DNA, 20 bp, Artificial
  CRISPR gRNA sequence
tgtcagcaatcctgttagct

SEQ ID NO: 489572 - DNA, 20 bp, Artificial
  CRISPR gRNA sequence
agcaatcctgttagctggga

SEQ ID NO: 489573 - DNA, 20 bp, Artificial
  CRISPR gRNA sequence
gccacaccctgaatctcact

SEQ ID NO: 489574 - DNA, 20 bp, Artificial
  CRISPR gRNA sequence
ccacaccctgaatctcactc

SEQ ID NO: 489575 - DNA, 20 bp, Artificial
  CRISPR gRNA sequence
tgaatctcactcaggactgt

SEQ ID NO: 489576 - DNA, 20 bp, Artificial
  CRISPR gRNA sequence
aggactgtcagaatgcccat

SEQ ID NO: 489577 - DNA, 20 bp, Artificial
  CRISPR gRNA sequence
ggactgtcagaatgcccatc

SEQ ID NO: 489578 - DNA, 20 bp, Artificial
  CRISPR gRNA sequence
gactgtcagaatgcccatca

SEQ ID NO: 489579 - DNA, 20 bp, Artificial
  CRISPR gRNA sequence
gtcagaatgcccatcagggt

SEQ ID NO: 489580 - DNA, 20 bp, Artificial
  CRISPR gRNA sequence
agaatgcccatcagggtaag

SEQ ID NO: 489581 - DNA, 20 bp, Artificial
  CRISPR gRNA sequence
tcagggtaagtggaacacac

SEQ ID NO: 489582 - DNA, 20 bp, Artificial
  CRISPR gRNA sequence
cagggtaagtggaacacact

SEQ ID NO: 489583 - DNA, 20 bp, Artificial
  CRISPR gRNA sequence
ggaacacactgggctataac

SEQ ID NO: 489584 - DNA, 20 bp, Artificial
  CRISPR gRNA sequence
ctgggctataacaagcgctg

SEQ ID NO: 489585 - DNA, 20 bp, Artificial
  CRISPR gRNA sequence
tgggctataacaagcgctga

SEQ ID NO: 489586 - DNA, 20 bp, Artificial
  CRISPR gRNA sequence
tataacaagcgctgaaggtt

SEQ ID NO: 489587 - DNA, 20 bp, Artificial
  CRISPR gRNA sequence
gaaggtttggaccccgcaac

SEQ ID NO: 489588 - DNA, 20 bp, Artificial
  CRISPR gRNA sequence
aaggtttggaccccgcaacc

SEQ ID NO: 489589 - DNA, 20 bp, Artificial
  CRISPR gRNA sequence
ccgcaaccaggctcatgtgc

SEQ ID NO: 489590 - DNA, 20 bp, Artificial
  CRISPR gRNA sequence
aaccaggctcatgtgcaaga

SEQ ID NO: 489591 - DNA, 20 bp, Artificial
  CRISPR gRNA sequence
gctcatgtgcaagacagatg

SEQ ID NO: 489592 - DNA, 20 bp, Artificial
  CRISPR gRNA sequence
gtgcaagacagatgtggtat

SEQ ID NO: 489593 - DNA, 20 bp, Artificial
  CRISPR gRNA sequence
tggtatgagataaaatccct

SEQ ID NO: 489594 - DNA, 20 bp, Artificial
  CRISPR gRNA sequence
aatcccttggcctcctctcc

SEQ ID NO: 489595 - DNA, 20 bp, Artificial
  CRISPR gRNA sequence
cctcctctcccagtgccttg

SEQ ID NO: 489596 - DNA, 20 bp, Artificial
  CRISPR gRNA sequence
cagtgccttgtagcccttcc

SEQ ID NO: 489597 - DNA, 20 bp, Artificial
  CRISPR gRNA sequence
agtgccttgtagcccttccc

SEQ ID NO: 489598 - DNA, 20 bp, Artificial
  CRISPR gRNA sequence
gtgccttgtagcccttccca

SEQ ID NO: 489599 - DNA, 20 bp, Artificial
  CRISPR gRNA sequence
ccttgtagcccttcccaggg

SEQ ID NO: 489600 - DNA, 20 bp, Artificial
  CRISPR gRNA sequence
agcccttcccagggtagccc

SEQ ID NO: 489601 - DNA, 20 bp, Artificial
  CRISPR gRNA sequence
cccagggtagccctggcctc

SEQ ID NO: 489602 - DNA, 20 bp, Artificial
  CRISPR gRNA sequence
ccagggtagccctggcctcc

SEQ ID NO: 489603 - DNA, 20 bp, Artificial
  CRISPR gRNA sequence
agccctggcctccaggcaca

SEQ ID NO: 489604 - DNA, 20 bp, Artificial
  CRISPR gRNA sequence
ccaggcacacagttcctgta

SEQ ID NO: 489605 - DNA, 20 bp, Artificial
  CRISPR gRNA sequence
gcacacagttcctgtaaagc

SEQ ID NO: 489606 - DNA, 20 bp, Artificial
  CRISPR gRNA sequence
cacacagttcctgtaaagct

SEQ ID NO: 489607 - DNA, 20 bp, Artificial
  CRISPR gRNA sequence
aagctaggcctatcctactc

SEQ ID NO: 489608 - DNA, 20 bp, Artificial
  CRISPR gRNA sequence
atgttatccctatttccttc

SEQ ID NO: 489609 - DNA, 20 bp, Artificial
  CRISPR gRNA sequence
tgttatccctatttccttct

SEQ ID NO: 489610 - DNA, 20 bp, Artificial
  CRISPR gRNA sequence
ttatccctatttccttctgg

SEQ ID NO: 489611 - DNA, 20 bp, Artificial
  CRISPR gRNA sequence
tatttccttctgggagatgc

SEQ ID NO: 489612 - DNA, 20 bp, Artificial
  CRISPR gRNA sequence
agatgcaagcttttcttctg

SEQ ID NO: 489613 - DNA, 20 bp, Artificial
  CRISPR gRNA sequence
atgcaagcttttcttctgca

SEQ ID NO: 489614 - DNA, 20 bp, Artificial
  CRISPR gRNA sequence
tgcaagcttttcttctgcag

SEQ ID NO: 489615 - DNA, 20 bp, Artificial
  CRISPR gRNA sequence
gcaagcttttcttctgcaga

SEQ ID NO: 489616 - DNA, 20 bp, Artificial
  CRISPR gRNA sequence
aagcttttcttctgcagagg

SEQ ID NO: 489617 - DNA, 20 bp, Artificial
  CRISPR gRNA sequence
agcttttcttctgcagaggg

SEQ ID NO: 489618 - DNA, 20 bp, Artificial
  CRISPR gRNA sequence
gcttttcttctgcagaggga

SEQ ID NO: 489619 - DNA, 20 bp, Artificial
  CRISPR gRNA sequence
tcttctgcagagggagggca

SEQ ID NO: 489620 - DNA, 20 bp, Artificial
  CRISPR gRNA sequence
agagggagggcatagttgtt

SEQ ID NO: 489621 - DNA, 20 bp, Artificial
  CRISPR gRNA sequence
ggagggcatagttgtttggt

SEQ ID NO: 489622 - DNA, 20 bp, Artificial
  CRISPR gRNA sequence
catagttgtttggtgagtga

SEQ ID NO: 489623 - DNA, 20 bp, Artificial
  CRISPR gRNA sequence
ggtgagtgacagtcctgaaa

SEQ ID NO: 489624 - DNA, 20 bp, Artificial
  CRISPR gRNA sequence
cctgaacattattttcttcc

SEQ ID NO: 489625 - DNA, 20 bp, Artificial
  CRISPR gRNA sequence
ctgaacattattttcttcct

SEQ ID NO: 489626 - DNA, 20 bp, Artificial
  CRISPR gRNA sequence
gaacattattttcttcctgg

SEQ ID NO: 489627 - DNA, 20 bp, Artificial
  CRISPR gRNA sequence
acattattttcttcctggga

SEQ ID NO: 489628 - DNA, 20 bp, Artificial
  CRISPR gRNA sequence
cattattttcttcctgggag

SEQ ID NO: 489629 - DNA, 20 bp, Artificial
  CRISPR gRNA sequence
ttcttcctgggagaggctga

SEQ ID NO: 489630 - DNA, 20 bp, Artificial
  CRISPR gRNA sequence
cttcctgggagaggctgatg

SEQ ID NO: 489631 - DNA, 20 bp, Artificial
  CRISPR gRNA sequence
gagaactgtcctctcctctt

SEQ ID NO: 489632 - DNA, 20 bp, Artificial
  CRISPR gRNA sequence
cttgagtgataactttctcc

SEQ ID NO: 489633 - DNA, 20 bp, Artificial
  CRISPR gRNA sequence
ataactttctccaagccaca

SEQ ID NO: 489634 - DNA, 20 bp, Artificial
  CRISPR gRNA sequence
ttctccaagccacatagttc

SEQ ID NO: 489635 - DNA, 20 bp, Artificial
  CRISPR gRNA sequence
ctccaagccacatagttcaa

SEQ ID NO: 489636 - DNA, 20 bp, Artificial
  CRISPR gRNA sequence
tccaagccacatagttcaag

SEQ ID NO: 489637 - DNA, 20 bp, Artificial
  CRISPR gRNA sequence
caagaggtaactacactgtg

SEQ ID NO: 489638 - DNA, 20 bp, Artificial
  CRISPR gRNA sequence
gaggtaactacactgtgcag

SEQ ID NO: 489639 - DNA, 20 bp, Artificial
  CRISPR gRNA sequence
gtaactacactgtgcagcag

SEQ ID NO: 489640 - DNA, 20 bp, Artificial
  CRISPR gRNA sequence
tacactgtgcagcagtagcc

SEQ ID NO: 489641 - DNA, 20 bp, Artificial
  CRISPR gRNA sequence
cactgtgcagcagtagcctg

SEQ ID NO: 489642 - DNA, 20 bp, Artificial
  CRISPR gRNA sequence
tgtgcagcagtagcctggag

SEQ ID NO: 489643 - DNA, 20 bp, Artificial
  CRISPR gRNA sequence
gtgcagcagtagcctggagc

SEQ ID NO: 489644 - DNA, 20 bp, Artificial
  CRISPR gRNA sequence
gcagcagtagcctggagcag

SEQ ID NO: 489645 - DNA, 20 bp, Artificial
  CRISPR gRNA sequence
gtagcctggagcaggagcat

SEQ ID NO: 489646 - DNA, 20 bp, Artificial
  CRISPR gRNA sequence
tagcctggagcaggagcatc

SEQ ID NO: 489647 - DNA, 20 bp, Artificial
  CRISPR gRNA sequence
caggagcatcaggatgaccc

SEQ ID NO: 489648 - DNA, 20 bp, Artificial
  CRISPR gRNA sequence
aggagcatcaggatgacccc

SEQ ID NO: 489649 - DNA, 20 bp, Artificial
  CRISPR gRNA sequence
ggagcatcaggatgacccca

SEQ ID NO: 489650 - DNA, 20 bp, Artificial
  CRISPR gRNA sequence
aggatgaccccagggatacc

SEQ ID NO: 489651 - DNA, 20 bp, Artificial
  CRISPR gRNA sequence
gaccccagggatacctagat

SEQ ID NO: 489652 - DNA, 20 bp, Artificial
  CRISPR gRNA sequence
gggatacctagatgagttct

SEQ ID NO: 489653 - DNA, 20 bp, Artificial
  CRISPR gRNA sequence
ggatacctagatgagttctt

SEQ ID NO: 489654 - DNA, 20 bp, Artificial
  CRISPR gRNA sequence
ctgttgcttatgctcatcct

SEQ ID NO: 489655 - DNA, 20 bp, Artificial
  CRISPR gRNA sequence
gttgcttatgctcatcctaa

SEQ ID NO: 489656 - DNA, 20 bp, Artificial
  CRISPR gRNA sequence
gctcatcctaagagttacct

SEQ ID NO: 489657 - DNA, 20 bp, Artificial
  CRISPR gRNA sequence
acaactttttattacataaa

SEQ ID NO: 489658 - DNA, 20 bp, Artificial
  CRISPR gRNA sequence
caactttttattacataaac

SEQ ID NO: 489659 - DNA, 20 bp, Artificial
  CRISPR gRNA sequence
aactttttattacataaaca

SEQ ID NO: 489660 - DNA, 20 bp, Artificial
  CRISPR gRNA sequence
taaacagggacttaatgtac

SEQ ID NO: 489661 - DNA, 20 bp, Artificial
  CRISPR gRNA sequence
acagggacttaatgtaccag

SEQ ID NO: 489662 - DNA, 20 bp, Artificial
  CRISPR gRNA sequence
gacttaatgtaccagcagca

SEQ ID NO: 489663 - DNA, 20 bp, Artificial
  CRISPR gRNA sequence
acttaatgtaccagcagcat

SEQ ID NO: 489664 - DNA, 20 bp, Artificial
  CRISPR gRNA sequence
taccagcagcatgggcatta

SEQ ID NO: 489665 - DNA, 20 bp, Artificial
  CRISPR gRNA sequence
accagcagcatgggcattat

SEQ ID NO: 489666 - DNA, 20 bp, Artificial
  CRISPR gRNA sequence
tataggaaaaaaaaaccata

SEQ ID NO: 489667 - DNA, 20 bp, Artificial
  CRISPR gRNA sequence
accatacagctctcattcat

SEQ ID NO: 489668 - DNA, 20 bp, Artificial
  CRISPR gRNA sequence
ccatacagctctcattcata

SEQ ID NO: 489669 - DNA, 20 bp, Artificial
  CRISPR gRNA sequence
tctcattcataaggaactta

SEQ ID NO: 489670 - DNA, 20 bp, Artificial
  CRISPR gRNA sequence
ataaggaacttatagccaaa

SEQ ID NO: 489671 - DNA, 20 bp, Artificial
  CRISPR gRNA sequence
taaggaacttatagccaaat

SEQ ID NO: 489672 - DNA, 20 bp, Artificial
  CRISPR gRNA sequence
aaggaacttatagccaaatg

SEQ ID NO: 489673 - DNA, 20 bp, Artificial
  CRISPR gRNA sequence
gcaacaaaaataactacttg

SEQ ID NO: 489674 - DNA, 20 bp, Artificial
  CRISPR gRNA sequence
ataactacttgtggacaaaa

SEQ ID NO: 489675 - DNA, 20 bp, Artificial
  CRISPR gRNA sequence
cttgtggacaaaaaagaaac

SEQ ID NO: 489676 - DNA, 20 bp, Artificial
  CRISPR gRNA sequence
gacaaaaaagaaacaagact

SEQ ID NO: 489677 - DNA, 20 bp, Artificial
  CRISPR gRNA sequence
acaaaaaagaaacaagactg

SEQ ID NO: 489678 - DNA, 20 bp, Artificial
  CRISPR gRNA sequence
aaaaagaaacaagactgagg

SEQ ID NO: 489679 - DNA, 20 bp, Artificial
  CRISPR gRNA sequence
aaaagaaacaagactgaggc

SEQ ID NO: 489680 - DNA, 20 bp, Artificial
  CRISPR gRNA sequence
gaaacaagactgaggcaggc

SEQ ID NO: 489681 - DNA, 20 bp, Artificial
  CRISPR gRNA sequence
aaacaagactgaggcaggcc

SEQ ID NO: 489682 - DNA, 20 bp, Artificial
  CRISPR gRNA sequence
agactgaggcaggccgggcg

SEQ ID NO: 489683 - DNA, 20 bp, Artificial
  CRISPR gRNA sequence
ctgaggcaggccgggcgcag

SEQ ID NO: 489684 - DNA, 20 bp, Artificial
  CRISPR gRNA sequence
gcagtggctccctgtaatcc

SEQ ID NO: 489685 - DNA, 20 bp, Artificial
  CRISPR gRNA sequence
tccctgtaatcccagcactt

SEQ ID NO: 489686 - DNA, 20 bp, Artificial
  CRISPR gRNA sequence
ccctgtaatcccagcacttt

SEQ ID NO: 489687 - DNA, 20 bp, Artificial
  CRISPR gRNA sequence
ctgtaatcccagcactttgg

SEQ ID NO: 489688 - DNA, 20 bp, Artificial
  CRISPR gRNA sequence
tgtaatcccagcactttggg

SEQ ID NO: 489689 - DNA, 20 bp, Artificial
  CRISPR gRNA sequence
tcccagcactttgggaggct

SEQ ID NO: 489690 - DNA, 20 bp, Artificial
  CRISPR gRNA sequence
cccagcactttgggaggctg

SEQ ID NO: 489691 - DNA, 20 bp, Artificial
  CRISPR gRNA sequence
agcactttgggaggctgagg

SEQ ID NO: 489692 - DNA, 20 bp, Artificial
  CRISPR gRNA sequence
gcactttgggaggctgaggt

SEQ ID NO: 489693 - DNA, 20 bp, Artificial
  CRISPR gRNA sequence
ctttgggaggctgaggtggg

SEQ ID NO: 489694 - DNA, 20 bp, Artificial
  CRISPR gRNA sequence
ggctgaggtgggtggatcac

SEQ ID NO: 489695 - DNA, 20 bp, Artificial
  CRISPR gRNA sequence
gctgaggtgggtggatcaca

SEQ ID NO: 489696 - DNA, 20 bp, Artificial
  CRISPR gRNA sequence
aggtgggtggatcacaaggt

SEQ ID NO: 489697 - DNA, 20 bp, Artificial
  CRISPR gRNA sequence
ggtgggtggatcacaaggtc

SEQ ID NO: 489698 - DNA, 20 bp, Artificial
  CRISPR gRNA sequence
tgggtggatcacaaggtcag

SEQ ID NO: 489699 - DNA, 20 bp, Artificial
  CRISPR gRNA sequence
gatcacaaggtcaggagttt

SEQ ID NO: 489700 - DNA, 20 bp, Artificial
  CRISPR gRNA sequence
caaggtcaggagtttgagac

SEQ ID NO: 489701 - DNA, 20 bp, Artificial
  CRISPR gRNA sequence
tcaggagtttgagaccagcc

SEQ ID NO: 489702 - DNA, 20 bp, Artificial
  CRISPR gRNA sequence
tgagaccagcctggccaaca

SEQ ID NO: 489703 - DNA, 20 bp, Artificial
  CRISPR gRNA sequence
ctactaaaaatacaaaaaat

SEQ ID NO: 489704 - DNA, 20 bp, Artificial
  CRISPR gRNA sequence
taaaaatacaaaaaattagc

SEQ ID NO: 489705 - DNA, 20 bp, Artificial
  CRISPR gRNA sequence
aaaaatacaaaaaattagct

SEQ ID NO: 489706 - DNA, 20 bp, Artificial
  CRISPR gRNA sequence
aaaaaattagctgggcgtgt

SEQ ID NO: 489707 - DNA, 20 bp, Artificial
  CRISPR gRNA sequence
aaattagctgggcgtgttgg

SEQ ID NO: 489708 - DNA, 20 bp, Artificial
  CRISPR gRNA sequence
aattagctgggcgtgttggc

SEQ ID NO: 489709 - DNA, 20 bp, Artificial
  CRISPR gRNA sequence
ttggcgggcacctgtaatct

SEQ ID NO: 489710 - DNA, 20 bp, Artificial
  CRISPR gRNA sequence
cacctgtaatctcagctact

SEQ ID NO: 489711 - DNA, 20 bp, Artificial
  CRISPR gRNA sequence
acctgtaatctcagctactc

SEQ ID NO: 489712 - DNA, 20 bp, Artificial
  CRISPR gRNA sequence
ctgtaatctcagctactcag

SEQ ID NO: 489713 - DNA, 20 bp, Artificial
  CRISPR gRNA sequence
tgtaatctcagctactcagg

SEQ ID NO: 489714 - DNA, 20 bp, Artificial
  CRISPR gRNA sequence
tctcagctactcaggaggct

SEQ ID NO: 489715 - DNA, 20 bp, Artificial
  CRISPR gRNA sequence
ctcagctactcaggaggctg

SEQ ID NO: 489716 - DNA, 20 bp, Artificial
  CRISPR gRNA sequence
agctactcaggaggctgagg

SEQ ID NO: 489717 - DNA, 20 bp, Artificial
  CRISPR gRNA sequence
gctactcaggaggctgaggc

SEQ ID NO: 489718 - DNA, 20 bp, Artificial
  CRISPR gRNA sequence
tactcaggaggctgaggcag

SEQ ID NO: 489719 - DNA, 20 bp, Artificial
  CRISPR gRNA sequence
gcaggagaattgcttgaacc

SEQ ID NO: 489720 - DNA, 20 bp, Artificial
  CRISPR gRNA sequence
caggagaattgcttgaaccc

SEQ ID NO: 489721 - DNA, 20 bp, Artificial
  CRISPR gRNA sequence
ggagaattgcttgaacccag

SEQ ID NO: 489722 - DNA, 20 bp, Artificial
  CRISPR gRNA sequence
gagaattgcttgaacccagg

SEQ ID NO: 489723 - DNA, 20 bp, Artificial
  CRISPR gRNA sequence
aattgcttgaacccaggagg

SEQ ID NO: 489724 - DNA, 20 bp, Artificial
  CRISPR gRNA sequence
ttgcttgaacccaggaggcg

SEQ ID NO: 489725 - DNA, 20 bp, Artificial
  CRISPR gRNA sequence
tgcttgaacccaggaggcgg

SEQ ID NO: 489726 - DNA, 20 bp, Artificial
  CRISPR gRNA sequence
aacccaggaggcggaggttg

SEQ ID NO: 489727 - DNA, 20 bp, Artificial
  CRISPR gRNA sequence
caggaggcggaggttgcagt

SEQ ID NO: 489728 - DNA, 20 bp, Artificial
  CRISPR gRNA sequence
ggcggaggttgcagtgagtc

SEQ ID NO: 489729 - DNA, 20 bp, Artificial
  CRISPR gRNA sequence
tcaagatcatgccactgaac

SEQ ID NO: 489730 - DNA, 20 bp, Artificial
  CRISPR gRNA sequence
caagatcatgccactgaact

SEQ ID NO: 489731 - DNA, 20 bp, Artificial
  CRISPR gRNA sequence
atgccactgaactaggacac

SEQ ID NO: 489732 - DNA, 20 bp, Artificial
  CRISPR gRNA sequence
aggacactggcttcatcatt

SEQ ID NO: 489733 - DNA, 20 bp, Artificial
  CRISPR gRNA sequence
acactggcttcatcattcag

SEQ ID NO: 489734 - DNA, 20 bp, Artificial
  CRISPR gRNA sequence
tcagaagctctgtgatctct

SEQ ID NO: 489735 - DNA, 20 bp, Artificial
  CRISPR gRNA sequence
agaagctctgtgatctctta

SEQ ID NO: 489736 - DNA, 20 bp, Artificial
  CRISPR gRNA sequence
gaagctctgtgatctcttag

SEQ ID NO: 489737 - DNA, 20 bp, Artificial
  CRISPR gRNA sequence
ctctgtgatctcttagaggt

SEQ ID NO: 489738 - DNA, 20 bp, Artificial
  CRISPR gRNA sequence
tctgtgatctcttagaggtc

SEQ ID NO: 489739 - DNA, 20 bp, Artificial
  CRISPR gRNA sequence
gatctcttagaggtcaggtg

SEQ ID NO: 489740 - DNA, 20 bp, Artificial
  CRISPR gRNA sequence
ctcttagaggtcaggtgtgg

SEQ ID NO: 489741 - DNA, 20 bp, Artificial
  CRISPR gRNA sequence
gtggctcacacatgtaatcc

SEQ ID NO: 489742 - DNA, 20 bp, Artificial
  CRISPR gRNA sequence
cacatgtaatcctagcactt

SEQ ID NO: 489743 - DNA, 20 bp, Artificial
  CRISPR gRNA sequence
acatgtaatcctagcacttt

SEQ ID NO: 489744 - DNA, 20 bp, Artificial
  CRISPR gRNA sequence
atgtaatcctagcactttgg

SEQ ID NO: 489745 - DNA, 20 bp, Artificial
  CRISPR gRNA sequence
tgtaatcctagcactttggg

SEQ ID NO: 489746 - DNA, 20 bp, Artificial
  CRISPR gRNA sequence
tcctagcactttgggaggct

SEQ ID NO: 489747 - DNA, 20 bp, Artificial
  CRISPR gRNA sequence
cctagcactttgggaggctg

SEQ ID NO: 489748 - DNA, 20 bp, Artificial
  CRISPR gRNA sequence
agcactttgggaggctgagg

SEQ ID NO: 489749 - DNA, 20 bp, Artificial
  CRISPR gRNA sequence
gcactttgggaggctgaggc

SEQ ID NO: 489750 - DNA, 20 bp, Artificial
  CRISPR gRNA sequence
ctttgggaggctgaggcagg

SEQ ID NO: 489751 - DNA, 20 bp, Artificial
  CRISPR gRNA sequence
ctgaggcaggtggatcactt

SEQ ID NO: 489752 - DNA, 20 bp, Artificial
  CRISPR gRNA sequence
gcaggtggatcacttgagtc

SEQ ID NO: 489753 - DNA, 20 bp, Artificial
  CRISPR gRNA sequence
caggtggatcacttgagtcc

SEQ ID NO: 489754 - DNA, 20 bp, Artificial
  CRISPR gRNA sequence
tcacttgagtccaggtgttt

SEQ ID NO: 489755 - DNA, 20 bp, Artificial
  CRISPR gRNA sequence
tgagtccaggtgtttgagac

SEQ ID NO: 489756 - DNA, 20 bp, Artificial
  CRISPR gRNA sequence
ccaggtgtttgagaccagcc

SEQ ID NO: 489757 - DNA, 20 bp, Artificial
  CRISPR gRNA sequence
tgagaccagcctggacaata

SEQ ID NO: 489758 - DNA, 20 bp, Artificial
  CRISPR gRNA sequence
ctatttaaaaaaaaaaaaaa

SEQ ID NO: 489759 - DNA, 20 bp, Artificial
  CRISPR gRNA sequence
tttaaaaaaaaaaaaaaaag

SEQ ID NO: 489760 - DNA, 20 bp, Artificial
  CRISPR gRNA sequence
aaaagaagctctgtgatctc

SEQ ID NO: 489761 - DNA, 20 bp, Artificial
  CRISPR gRNA sequence
agaagctctgtgatctctgg

SEQ ID NO: 489762 - DNA, 20 bp, Artificial
  CRISPR gRNA sequence
gcagattcattaacctctct

SEQ ID NO: 489763 - DNA, 20 bp, Artificial
  CRISPR gRNA sequence
ctcaattttcttcccccctt

SEQ ID NO: 489764 - DNA, 20 bp, Artificial
  CRISPR gRNA sequence
tcttccccccttgagtaaaa

SEQ ID NO: 489765 - DNA, 20 bp, Artificial
  CRISPR gRNA sequence
cttccccccttgagtaaaat

SEQ ID NO: 489766 - DNA, 20 bp, Artificial
  CRISPR gRNA sequence
ttccccccttgagtaaaatg

SEQ ID NO: 489767 - DNA, 20 bp, Artificial
  CRISPR gRNA sequence
tccccccttgagtaaaatgg

SEQ ID NO: 489768 - DNA, 20 bp, Artificial
  CRISPR gRNA sequence
agtaaaatgggggtgataat

SEQ ID NO: 489769 - DNA, 20 bp, Artificial
  CRISPR gRNA sequence
gggtgataataagtacctca

SEQ ID NO: 489770 - DNA, 20 bp, Artificial
  CRISPR gRNA sequence
ggtgataataagtacctcac

SEQ ID NO: 489771 - DNA, 20 bp, Artificial
  CRISPR gRNA sequence
tacctcacaggattgctgtt

SEQ ID NO: 489772 - DNA, 20 bp, Artificial
  CRISPR gRNA sequence
cctcacaggattgctgttaa

SEQ ID NO: 489773 - DNA, 20 bp, Artificial
  CRISPR gRNA sequence
gattgctgttaagagtaaat

SEQ ID NO: 489774 - DNA, 20 bp, Artificial
  CRISPR gRNA sequence
taaatgagataatgtttgca

SEQ ID NO: 489775 - DNA, 20 bp, Artificial
  CRISPR gRNA sequence
aatgagataatgtttgcaaa

SEQ ID NO: 489776 - DNA, 20 bp, Artificial
  CRISPR gRNA sequence
atgtttgcaaagagccttgt

SEQ ID NO: 489777 - DNA, 20 bp, Artificial
  CRISPR gRNA sequence
caaagagccttgtcagccct

SEQ ID NO: 489778 - DNA, 20 bp, Artificial
  CRISPR gRNA sequence
ttccttttccttcctcttgt

SEQ ID NO: 489779 - DNA, 20 bp, Artificial
  CRISPR gRNA sequence
ttttccttcctcttgttggc

SEQ ID NO: 489780 - DNA, 20 bp, Artificial
  CRISPR gRNA sequence
ttgttggctggattatatat

SEQ ID NO: 489781 - DNA, 20 bp, Artificial
  CRISPR gRNA sequence
tgttggctggattatatatc

SEQ ID NO: 489782 - DNA, 20 bp, Artificial
  CRISPR gRNA sequence
atgtgtgacacaaatctttt

SEQ ID NO: 489783 - DNA, 20 bp, Artificial
  CRISPR gRNA sequence
tgtgacacaaatcttttaag

SEQ ID NO: 489784 - DNA, 20 bp, Artificial
  CRISPR gRNA sequence
gacacaaatcttttaagtag

SEQ ID NO: 489785 - DNA, 20 bp, Artificial
  CRISPR gRNA sequence
ttttaagtagaagttcaaat

SEQ ID NO: 489786 - DNA, 20 bp, Artificial
  CRISPR gRNA sequence
tttaagtagaagttcaaatg

SEQ ID NO: 489787 - DNA, 20 bp, Artificial
  CRISPR gRNA sequence
aagtagaagttcaaatgagg

SEQ ID NO: 489788 - DNA, 20 bp, Artificial
  CRISPR gRNA sequence
gtagaagttcaaatgaggaa

SEQ ID NO: 489789 - DNA, 20 bp, Artificial
  CRISPR gRNA sequence
tcaaatgaggaagagccatg

SEQ ID NO: 489790 - DNA, 20 bp, Artificial
  CRISPR gRNA sequence
caaatgaggaagagccatga

SEQ ID NO: 489791 - DNA, 20 bp, Artificial
  CRISPR gRNA sequence
atgaggaagagccatgaagg

SEQ ID NO: 489792 - DNA, 20 bp, Artificial
  CRISPR gRNA sequence
tgaggaagagccatgaagga

SEQ ID NO: 489793 - DNA, 20 bp, Artificial
  CRISPR gRNA sequence
aagagccatgaaggaaggaa

SEQ ID NO: 489794 - DNA, 20 bp, Artificial
  CRISPR gRNA sequence
agccatgaaggaaggaatag

SEQ ID NO: 489795 - DNA, 20 bp, Artificial
  CRISPR gRNA sequence
tgaaggaaggaatagtggaa

SEQ ID NO: 489796 - DNA, 20 bp, Artificial
  CRISPR gRNA sequence
ggaaggaatagtggaaaagt

SEQ ID NO: 489797 - DNA, 20 bp, Artificial
  CRISPR gRNA sequence
ggaatagtggaaaagtgaga

SEQ ID NO: 489798 - DNA, 20 bp, Artificial
  CRISPR gRNA sequence
ggaaaacttgcctgtacaat

SEQ ID NO: 489799 - DNA, 20 bp, Artificial
  CRISPR gRNA sequence
ctgtacaatgagtatttttt

SEQ ID NO: 489800 - DNA, 20 bp, Artificial
  CRISPR gRNA sequence
tattttttgagttaaaaaca

SEQ ID NO: 489801 - DNA, 20 bp, Artificial
  CRISPR gRNA sequence
attttttgagttaaaaacaa

SEQ ID NO: 489802 - DNA, 20 bp, Artificial
  CRISPR gRNA sequence
ttgagttaaaaacaaaggaa

SEQ ID NO: 489803 - DNA, 20 bp, Artificial
  CRISPR gRNA sequence
ttgttgtgctacatgtccct

SEQ ID NO: 489804 - DNA, 20 bp, Artificial
  CRISPR gRNA sequence
cctcagtatccatgacgaat

SEQ ID NO: 489805 - DNA, 20 bp, Artificial
  CRISPR gRNA sequence
tatccatgacgaattagttc

SEQ ID NO: 489806 - DNA, 20 bp, Artificial
  CRISPR gRNA sequence
atccatgacgaattagttcc

SEQ ID NO: 489807 - DNA, 20 bp, Artificial
  CRISPR gRNA sequence
caggacccacctcgcaacca

SEQ ID NO: 489808 - DNA, 20 bp, Artificial
  CRISPR gRNA sequence
acctcgcaaccacagatgcc

SEQ ID NO: 489809 - DNA, 20 bp, Artificial
  CRISPR gRNA sequence
gccaagatccacgaatgttt

SEQ ID NO: 489810 - DNA, 20 bp, Artificial
  CRISPR gRNA sequence
tccacgaatgtttaagtccc

SEQ ID NO: 489811 - DNA, 20 bp, Artificial
  CRISPR gRNA sequence
gtttaagtccctggcataaa

SEQ ID NO: 489812 - DNA, 20 bp, Artificial
  CRISPR gRNA sequence
tttaagtccctggcataaac

SEQ ID NO: 489813 - DNA, 20 bp, Artificial
  CRISPR gRNA sequence
gtccctggcataaacaggtg

SEQ ID NO: 489814 - DNA, 20 bp, Artificial
  CRISPR gRNA sequence
tccttctgtataccttactt

SEQ ID NO: 489815 - DNA, 20 bp, Artificial
  CRISPR gRNA sequence
tacttaagtcacctctaaat

SEQ ID NO: 489816 - DNA, 20 bp, Artificial
  CRISPR gRNA sequence
caatgtaaatgctatttaaa

SEQ ID NO: 489817 - DNA, 20 bp, Artificial
  CRISPR gRNA sequence
agttgttatactgtattgtt

SEQ ID NO: 489818 - DNA, 20 bp, Artificial
  CRISPR gRNA sequence
gttgttatactgtattgttt

SEQ ID NO: 489819 - DNA, 20 bp, Artificial
  CRISPR gRNA sequence
ttgttatactgtattgttta

SEQ ID NO: 489820 - DNA, 20 bp, Artificial
  CRISPR gRNA sequence
attgtttagggaataatgac

SEQ ID NO: 489821 - DNA, 20 bp, Artificial
  CRISPR gRNA sequence
ttgtttagggaataatgaca

SEQ ID NO: 489822 - DNA, 20 bp, Artificial
  CRISPR gRNA sequence
agggaataatgacaaggaaa

SEQ ID NO: 489823 - DNA, 20 bp, Artificial
  CRISPR gRNA sequence
gggaataatgacaaggaaaa

SEQ ID NO: 489824 - DNA, 20 bp, Artificial
  CRISPR gRNA sequence
ttttttttccctgaatattc

SEQ ID NO: 489825 - DNA, 20 bp, Artificial
  CRISPR gRNA sequence
aattcattgaatccacattg

SEQ ID NO: 489826 - DNA, 20 bp, Artificial
  CRISPR gRNA sequence
cattgtggaactcaaaactt

SEQ ID NO: 489827 - DNA, 20 bp, Artificial
  CRISPR gRNA sequence
ttgtggaactcaaaactttg

SEQ ID NO: 489828 - DNA, 20 bp, Artificial
  CRISPR gRNA sequence
tgtggaactcaaaactttgg

SEQ ID NO: 489829 - DNA, 20 bp, Artificial
  CRISPR gRNA sequence
gtggaactcaaaactttgga

SEQ ID NO: 489830 - DNA, 20 bp, Artificial
  CRISPR gRNA sequence
actttggagggcaactgtat

SEQ ID NO: 489831 - DNA, 20 bp, Artificial
  CRISPR gRNA sequence
gatcatgtaattaaccccta

SEQ ID NO: 489832 - DNA, 20 bp, Artificial
  CRISPR gRNA sequence
atcatgtaattaacccctat

SEQ ID NO: 489833 - DNA, 20 bp, Artificial
  CRISPR gRNA sequence
atgtaattaacccctatagg

SEQ ID NO: 489834 - DNA, 20 bp, Artificial
  CRISPR gRNA sequence
gataacgttatcccctttta

SEQ ID NO: 489835 - DNA, 20 bp, Artificial
  CRISPR gRNA sequence
ataacgttatccccttttac

SEQ ID NO: 489836 - DNA, 20 bp, Artificial
  CRISPR gRNA sequence
cgttatccccttttacaggt

SEQ ID NO: 489837 - DNA, 20 bp, Artificial
  CRISPR gRNA sequence
ttttacaggtgagaaaatct

SEQ ID NO: 489838 - DNA, 20 bp, Artificial
  CRISPR gRNA sequence
ttacaggtgagaaaatctaa

SEQ ID NO: 489839 - DNA, 20 bp, Artificial
  CRISPR gRNA sequence
tacaggtgagaaaatctaag

SEQ ID NO: 489840 - DNA, 20 bp, Artificial
  CRISPR gRNA sequence
gagaaaatctaagaggctct

SEQ ID NO: 489841 - DNA, 20 bp, Artificial
  CRISPR gRNA sequence
agaaaatctaagaggctctg

SEQ ID NO: 489842 - DNA, 20 bp, Artificial
  CRISPR gRNA sequence
ctgaggcatcttccaaaaat

SEQ ID NO: 489843 - DNA, 20 bp, Artificial
  CRISPR gRNA sequence
ttccaaaaataagatgactt

SEQ ID NO: 489844 - DNA, 20 bp, Artificial
  CRISPR gRNA sequence
ccaaaaataagatgacttga

SEQ ID NO: 489845 - DNA, 20 bp, Artificial
  CRISPR gRNA sequence
caaaaataagatgacttgag

SEQ ID NO: 489846 - DNA, 20 bp, Artificial
  CRISPR gRNA sequence
ataagatgacttgagaggcc

SEQ ID NO: 489847 - DNA, 20 bp, Artificial
  CRISPR gRNA sequence
aagatgacttgagaggccca

SEQ ID NO: 489848 - DNA, 20 bp, Artificial
  CRISPR gRNA sequence
gatgacttgagaggcccaga

SEQ ID NO: 489849 - DNA, 20 bp, Artificial
  CRISPR gRNA sequence
atgacttgagaggcccagag

SEQ ID NO: 489850 - DNA, 20 bp, Artificial
  CRISPR gRNA sequence
gcccagagaggttaaataaa

SEQ ID NO: 489851 - DNA, 20 bp, Artificial
  CRISPR gRNA sequence
gagaggttaaataaatagtg

SEQ ID NO: 489852 - DNA, 20 bp, Artificial
  CRISPR gRNA sequence
gaggttaaataaatagtgca

SEQ ID NO: 489853 - DNA, 20 bp, Artificial
  CRISPR gRNA sequence
aataaatagtgcagagctca

SEQ ID NO: 489854 - DNA, 20 bp, Artificial
  CRISPR gRNA sequence
ataaatagtgcagagctcac

SEQ ID NO: 489855 - DNA, 20 bp, Artificial
  CRISPR gRNA sequence
taaatagtgcagagctcaca

SEQ ID NO: 489856 - DNA, 20 bp, Artificial
  CRISPR gRNA sequence
tagtgcagagctcacagggt

SEQ ID NO: 489857 - DNA, 20 bp, Artificial
  CRISPR gRNA sequence
agctcacagggttagaattt

SEQ ID NO: 489858 - DNA, 20 bp, Artificial
  CRISPR gRNA sequence
cacagggttagaatttgagc

SEQ ID NO: 489859 - DNA, 20 bp, Artificial
  CRISPR gRNA sequence
acagggttagaatttgagcc

SEQ ID NO: 489860 - DNA, 20 bp, Artificial
  CRISPR gRNA sequence
gtctgatatatctatgctct

SEQ ID NO: 489861 - DNA, 20 bp, Artificial
  CRISPR gRNA sequence
tctatgctcttggcatcact

SEQ ID NO: 489862 - DNA, 20 bp, Artificial
  CRISPR gRNA sequence
tatgctcttggcatcactca

SEQ ID NO: 489863 - DNA, 20 bp, Artificial
  CRISPR gRNA sequence
atgctcttggcatcactcag

SEQ ID NO: 489864 - DNA, 20 bp, Artificial
  CRISPR gRNA sequence
gctcttggcatcactcagag

SEQ ID NO: 489865 - DNA, 20 bp, Artificial
  CRISPR gRNA sequence
ctcttggcatcactcagagg

SEQ ID NO: 489866 - DNA, 20 bp, Artificial
  CRISPR gRNA sequence
tcagaggaggttaaccaaat

SEQ ID NO: 489867 - DNA, 20 bp, Artificial
  CRISPR gRNA sequence
ggaggttaaccaaatgagca

SEQ ID NO: 489868 - DNA, 20 bp, Artificial
  CRISPR gRNA sequence
aggttaaccaaatgagcaaa

SEQ ID NO: 489869 - DNA, 20 bp, Artificial
  CRISPR gRNA sequence
aaagagaaaaccttgaccgt

SEQ ID NO: 489870 - DNA, 20 bp, Artificial
  CRISPR gRNA sequence
aaaccttgaccgtgagttct

SEQ ID NO: 489871 - DNA, 20 bp, Artificial
  CRISPR gRNA sequence
accttgaccgtgagttctca

SEQ ID NO: 489872 - DNA, 20 bp, Artificial
  CRISPR gRNA sequence
accgtgagttctcagagcac

SEQ ID NO: 489873 - DNA, 20 bp, Artificial
  CRISPR gRNA sequence
ccgtgagttctcagagcacg

SEQ ID NO: 489874 - DNA, 20 bp, Artificial
  CRISPR gRNA sequence
ttctcagagcacgaggcaat

SEQ ID NO: 489875 - DNA, 20 bp, Artificial
  CRISPR gRNA sequence
cgaggcaatcagccacaaca

SEQ ID NO: 489876 - DNA, 20 bp, Artificial
  CRISPR gRNA sequence
aggcaatcagccacaacaca

SEQ ID NO: 489877 - DNA, 20 bp, Artificial
  CRISPR gRNA sequence
atcagccacaacacagagaa

SEQ ID NO: 489878 - DNA, 20 bp, Artificial
  CRISPR gRNA sequence
agccacaacacagagaaaag

SEQ ID NO: 489879 - DNA, 20 bp, Artificial
  CRISPR gRNA sequence
gccacaacacagagaaaagt

SEQ ID NO: 489880 - DNA, 20 bp, Artificial
  CRISPR gRNA sequence
cacagagaaaagtgggtttt

SEQ ID NO: 489881 - DNA, 20 bp, Artificial
  CRISPR gRNA sequence
acagagaaaagtgggttttg

SEQ ID NO: 489882 - DNA, 20 bp, Artificial
  CRISPR gRNA sequence
gagaaaagtgggttttgagg

SEQ ID NO: 489883 - DNA, 20 bp, Artificial
  CRISPR gRNA sequence
gggttttgaggcagcccctg

SEQ ID NO: 489884 - DNA, 20 bp, Artificial
  CRISPR gRNA sequence
ttttgaggcagcccctgcag

SEQ ID NO: 489885 - DNA, 20 bp, Artificial
  CRISPR gRNA sequence
tttgaggcagcccctgcagc

SEQ ID NO: 489886 - DNA, 20 bp, Artificial
  CRISPR gRNA sequence
gaggcagcccctgcagcagg

SEQ ID NO: 489887 - DNA, 20 bp, Artificial
  CRISPR gRNA sequence
aggcagcccctgcagcaggc

SEQ ID NO: 489888 - DNA, 20 bp, Artificial
  CRISPR gRNA sequence
cagcccctgcagcaggcagg

SEQ ID NO: 489889 - DNA, 20 bp, Artificial
  CRISPR gRNA sequence
agcccctgcagcaggcaggt

SEQ ID NO: 489890 - DNA, 20 bp, Artificial
  CRISPR gRNA sequence
ccctgcagcaggcaggtggg

SEQ ID NO: 489891 - DNA, 20 bp, Artificial
  CRISPR gRNA sequence
cctgcagcaggcaggtggga

SEQ ID NO: 489892 - DNA, 20 bp, Artificial
  CRISPR gRNA sequence
gcagcaggcaggtgggaagg

SEQ ID NO: 489893 - DNA, 20 bp, Artificial
  CRISPR gRNA sequence
gcaggcaggtgggaaggaag

SEQ ID NO: 489894 - DNA, 20 bp, Artificial
  CRISPR gRNA sequence
aggcaggtgggaaggaagaa

SEQ ID NO: 489895 - DNA, 20 bp, Artificial
  CRISPR gRNA sequence
gcaggtgggaaggaagaaga

SEQ ID NO: 489896 - DNA, 20 bp, Artificial
  CRISPR gRNA sequence
gtgggaaggaagaagagagc

SEQ ID NO: 489897 - DNA, 20 bp, Artificial
  CRISPR gRNA sequence
ggaagaagagagcgagctga

SEQ ID NO: 489898 - DNA, 20 bp, Artificial
  CRISPR gRNA sequence
aagagagcgagctgacagct

SEQ ID NO: 489899 - DNA, 20 bp, Artificial
  CRISPR gRNA sequence
ctcacgccttctgtattcct

SEQ ID NO: 489900 - DNA, 20 bp, Artificial
  CRISPR gRNA sequence
cttctgtattcctcagaatt

SEQ ID NO: 489901 - DNA, 20 bp, Artificial
  CRISPR gRNA sequence
attcctcagaattcagattt

SEQ ID NO: 489902 - DNA, 20 bp, Artificial
  CRISPR gRNA sequence
attcagattttggccgtttt

SEQ ID NO: 489903 - DNA, 20 bp, Artificial
  CRISPR gRNA sequence
ttggtgatcatcgtgattct

SEQ ID NO: 489904 - DNA, 20 bp, Artificial
  CRISPR gRNA sequence
attctaagcgcactgttcct

SEQ ID NO: 489905 - DNA, 20 bp, Artificial
  CRISPR gRNA sequence
cccttgcctgcttctgtgtg

SEQ ID NO: 489906 - DNA, 20 bp, Artificial
  CRISPR gRNA sequence
cttgcctgcttctgtgtgtg

SEQ ID NO: 489907 - DNA, 20 bp, Artificial
  CRISPR gRNA sequence
ttgcctgcttctgtgtgtgg

SEQ ID NO: 489908 - DNA, 20 bp, Artificial
  CRISPR gRNA sequence
gcctgcttctgtgtgtggag

SEQ ID NO: 489909 - DNA, 20 bp, Artificial
  CRISPR gRNA sequence
gcttctgtgtgtggaggaga

SEQ ID NO: 489910 - DNA, 20 bp, Artificial
  CRISPR gRNA sequence
ttctgtgtgtggaggagaaa

SEQ ID NO: 489911 - DNA, 20 bp, Artificial
  CRISPR gRNA sequence
tctgtgtgtggaggagaaag

SEQ ID NO: 489912 - DNA, 20 bp, Artificial
  CRISPR gRNA sequence
gtgtgtggaggagaaagagg

SEQ ID NO: 489913 - DNA, 20 bp, Artificial
  CRISPR gRNA sequence
tgtgtggaggagaaagagga

SEQ ID NO: 489914 - DNA, 20 bp, Artificial
  CRISPR gRNA sequence
tgtggaggagaaagaggaag

SEQ ID NO: 489915 - DNA, 20 bp, Artificial
  CRISPR gRNA sequence
ggaggagaaagaggaaggag

SEQ ID NO: 489916 - DNA, 20 bp, Artificial
  CRISPR gRNA sequence
ggagaaagaggaaggagaag

SEQ ID NO: 489917 - DNA, 20 bp, Artificial
  CRISPR gRNA sequence
aaagaggaaggagaagcagt

SEQ ID NO: 489918 - DNA, 20 bp, Artificial
  CRISPR gRNA sequence
aagaggaaggagaagcagtc

SEQ ID NO: 489919 - DNA, 20 bp, Artificial
  CRISPR gRNA sequence
ggaaggagaagcagtcaggt

SEQ ID NO: 489920 - DNA, 20 bp, Artificial
  CRISPR gRNA sequence
aggagaagcagtcaggtgag

SEQ ID NO: 489921 - DNA, 20 bp, Artificial
  CRISPR gRNA sequence
agaagcagtcaggtgagtgg

SEQ ID NO: 489922 - DNA, 20 bp, Artificial
  CRISPR gRNA sequence
gaagcagtcaggtgagtgga

SEQ ID NO: 489923 - DNA, 20 bp, Artificial
  CRISPR gRNA sequence
tcaggtgagtggaaggtcct

SEQ ID NO: 489924 - DNA, 20 bp, Artificial
  CRISPR gRNA sequence
caggtgagtggaaggtcctt

SEQ ID NO: 489925 - DNA, 20 bp, Artificial
  CRISPR gRNA sequence
aggtgagtggaaggtcctta

SEQ ID NO: 489926 - DNA, 20 bp, Artificial
  CRISPR gRNA sequence
tgagtggaaggtccttaggg

SEQ ID NO: 489927 - DNA, 20 bp, Artificial
  CRISPR gRNA sequence
ttagggtggtgctcctgcct

SEQ ID NO: 489928 - DNA, 20 bp, Artificial
  CRISPR gRNA sequence
tagggtggtgctcctgcctg

SEQ ID NO: 489929 - DNA, 20 bp, Artificial
  CRISPR gRNA sequence
ggtgctcctgcctgaggcct

SEQ ID NO: 489930 - DNA, 20 bp, Artificial
  CRISPR gRNA sequence
ctgtgactttgtcctgcgtc

SEQ ID NO: 489931 - DNA, 20 bp, Artificial
  CRISPR gRNA sequence
tgactttgtcctgcgtccag

SEQ ID NO: 489932 - DNA, 20 bp, Artificial
  CRISPR gRNA sequence
gactttgtcctgcgtccagt

SEQ ID NO: 489933 - DNA, 20 bp, Artificial
  CRISPR gRNA sequence
tgcgtccagtgggatgtgtc

SEQ ID NO: 489934 - DNA, 20 bp, Artificial
  CRISPR gRNA sequence
gcgtccagtgggatgtgtct

SEQ ID NO: 489935 - DNA, 20 bp, Artificial
  CRISPR gRNA sequence
gtccagtgggatgtgtctgg

SEQ ID NO: 489936 - DNA, 20 bp, Artificial
  CRISPR gRNA sequence
gtgggatgtgtctgggagca

SEQ ID NO: 489937 - DNA, 20 bp, Artificial
  CRISPR gRNA sequence
agcatctccttttcctcaac

SEQ ID NO: 489938 - DNA, 20 bp, Artificial
  CRISPR gRNA sequence
tccttttcctcaacgagctt

SEQ ID NO: 489939 - DNA, 20 bp, Artificial
  CRISPR gRNA sequence
ctttggtatgtttgtgtgcg

SEQ ID NO: 489940 - DNA, 20 bp, Artificial
  CRISPR gRNA sequence
tggtatgtttgtgtgcgtgg

SEQ ID NO: 489941 - DNA, 20 bp, Artificial
  CRISPR gRNA sequence
tatgtttgtgtgcgtggtgg

SEQ ID NO: 489942 - DNA, 20 bp, Artificial
  CRISPR gRNA sequence
atgtttgtgtgcgtggtggc

SEQ ID NO: 489943 - DNA, 20 bp, Artificial
  CRISPR gRNA sequence
tgtttgtgtgcgtggtggcg

SEQ ID NO: 489944 - DNA, 20 bp, Artificial
  CRISPR gRNA sequence
gtttgtgtgcgtggtggcgg

SEQ ID NO: 489945 - DNA, 20 bp, Artificial
  CRISPR gRNA sequence
tttgtgtgcgtggtggcggg

SEQ ID NO: 489946 - DNA, 20 bp, Artificial
  CRISPR gRNA sequence
tgtgcgtggtggcggggggc

SEQ ID NO: 489947 - DNA, 20 bp, Artificial
  CRISPR gRNA sequence
gcgtggtggcggggggcaag

SEQ ID NO: 489948 - DNA, 20 bp, Artificial
  CRISPR gRNA sequence
cgtggtggcggggggcaagc

SEQ ID NO: 489949 - DNA, 20 bp, Artificial
  CRISPR gRNA sequence
gcggggggcaagcaggttgc

SEQ ID NO: 489950 - DNA, 20 bp, Artificial
  CRISPR gRNA sequence
cggggggcaagcaggttgct

SEQ ID NO: 489951 - DNA, 20 bp, Artificial
  CRISPR gRNA sequence
ggttgctaggctctctctcc

SEQ ID NO: 489952 - DNA, 20 bp, Artificial
  CRISPR gRNA sequence
tgccttctgatcccaatgcg

SEQ ID NO: 489953 - DNA, 20 bp, Artificial
  CRISPR gRNA sequence
ccaatgcgcagatttccctg

SEQ ID NO: 489954 - DNA, 20 bp, Artificial
  CRISPR gRNA sequence
tgcgcagatttccctgtaga

SEQ ID NO: 489955 - DNA, 20 bp, Artificial
  CRISPR gRNA sequence
cagatttccctgtagacagc

SEQ ID NO: 489956 - DNA, 20 bp, Artificial
  CRISPR gRNA sequence
ttccctgtagacagctggtt

SEQ ID NO: 489957 - DNA, 20 bp, Artificial
  CRISPR gRNA sequence
tccctgtagacagctggttt

SEQ ID NO: 489958 - DNA, 20 bp, Artificial
  CRISPR gRNA sequence
cctgtagacagctggtttgg

SEQ ID NO: 489959 - DNA, 20 bp, Artificial
  CRISPR gRNA sequence
ctgtagacagctggtttggg

SEQ ID NO: 489960 - DNA, 20 bp, Artificial
  CRISPR gRNA sequence
gtagacagctggtttgggag

SEQ ID NO: 489961 - DNA, 20 bp, Artificial
  CRISPR gRNA sequence
tagacagctggtttgggagg

SEQ ID NO: 489962 - DNA, 20 bp, Artificial
  CRISPR gRNA sequence
agctggtttgggaggaggtg

SEQ ID NO: 489963 - DNA, 20 bp, Artificial
  CRISPR gRNA sequence
gctggtttgggaggaggtgt

SEQ ID NO: 489964 - DNA, 20 bp, Artificial
  CRISPR gRNA sequence
tggtttgggaggaggtgtgg

SEQ ID NO: 489965 - DNA, 20 bp, Artificial
  CRISPR gRNA sequence
ggtttgggaggaggtgtggg

SEQ ID NO: 489966 - DNA, 20 bp, Artificial
  CRISPR gRNA sequence
gtttgggaggaggtgtggga

SEQ ID NO: 489967 - DNA, 20 bp, Artificial
  CRISPR gRNA sequence
tttgggaggaggtgtgggag

SEQ ID NO: 489968 - DNA, 20 bp, Artificial
  CRISPR gRNA sequence
gggaggaggtgtgggagggg

SEQ ID NO: 489969 - DNA, 20 bp, Artificial
  CRISPR gRNA sequence
gaggtgtgggaggggcagtt

SEQ ID NO: 489970 - DNA, 20 bp, Artificial
  CRISPR gRNA sequence
gttgctgcctctgtgctctt

SEQ ID NO: 489971 - DNA, 20 bp, Artificial
  CRISPR gRNA sequence
ttgctgcctctgtgctcttt

SEQ ID NO: 489972 - DNA, 20 bp, Artificial
  CRISPR gRNA sequence
tgctgcctctgtgctctttg

SEQ ID NO: 489973 - DNA, 20 bp, Artificial
  CRISPR gRNA sequence
tctgtgctctttggggttcc

SEQ ID NO: 489974 - DNA, 20 bp, Artificial
  CRISPR gRNA sequence
ctgtgctctttggggttcct

SEQ ID NO: 489975 - DNA, 20 bp, Artificial
  CRISPR gRNA sequence
tgctctttggggttcctggg

SEQ ID NO: 489976 - DNA, 20 bp, Artificial
  CRISPR gRNA sequence
ctctttggggttcctgggaa

SEQ ID NO: 489977 - DNA, 20 bp, Artificial
  CRISPR gRNA sequence
gcattaacttgcctcctttc

SEQ ID NO: 489978 - DNA, 20 bp, Artificial
  CRISPR gRNA sequence
tcctttctagaacctttttt

SEQ ID NO: 489979 - DNA, 20 bp, Artificial
  CRISPR gRNA sequence
cctttctagaacctttttta

SEQ ID NO: 489980 - DNA, 20 bp, Artificial
  CRISPR gRNA sequence
ctagaaccttttttaaggtt

SEQ ID NO: 489981 - DNA, 20 bp, Artificial
  CRISPR gRNA sequence
ttttttaaggtttggccatt

SEQ ID NO: 489982 - DNA, 20 bp, Artificial
  CRISPR gRNA sequence
tttttaaggtttggccattt

SEQ ID NO: 489983 - DNA, 20 bp, Artificial
  CRISPR gRNA sequence
ttttaaggtttggccatttg

SEQ ID NO: 489984 - DNA, 20 bp, Artificial
  CRISPR gRNA sequence
taaggtttggccatttgggg

SEQ ID NO: 489985 - DNA, 20 bp, Artificial
  CRISPR gRNA sequence
aggtttggccatttggggta

SEQ ID NO: 489986 - DNA, 20 bp, Artificial
  CRISPR gRNA sequence
ggtttggccatttggggtag

SEQ ID NO: 489987 - DNA, 20 bp, Artificial
  CRISPR gRNA sequence
ttggccatttggggtagagg

SEQ ID NO: 489988 - DNA, 20 bp, Artificial
  CRISPR gRNA sequence
tggccatttggggtagaggt

SEQ ID NO: 489989 - DNA, 20 bp, Artificial
  CRISPR gRNA sequence
ggggtagaggtgggacctgt

SEQ ID NO: 489990 - DNA, 20 bp, Artificial
  CRISPR gRNA sequence
gtagaggtgggacctgttag

SEQ ID NO: 489991 - DNA, 20 bp, Artificial
  CRISPR gRNA sequence
gtgggacctgttagaagcaa

SEQ ID NO: 489992 - DNA, 20 bp, Artificial
  CRISPR gRNA sequence
gttagaagcaaaagcccttc

SEQ ID NO: 489993 - DNA, 20 bp, Artificial
  CRISPR gRNA sequence
tagaagcaaaagcccttctg

SEQ ID NO: 489994 - DNA, 20 bp, Artificial
  CRISPR gRNA sequence
agaagcaaaagcccttctgg

SEQ ID NO: 489995 - DNA, 20 bp, Artificial
  CRISPR gRNA sequence
agcccttctggaggtttctg

SEQ ID NO: 489996 - DNA, 20 bp, Artificial
  CRISPR gRNA sequence
tctttgttttcttcctccct

SEQ ID NO: 489997 - DNA, 20 bp, Artificial
  CRISPR gRNA sequence
tttgttttcttcctccctca

SEQ ID NO: 489998 - DNA, 20 bp, Artificial
  CRISPR gRNA sequence
tttcttcctccctcagagac

SEQ ID NO: 489999 - DNA, 20 bp, Artificial
  CRISPR gRNA sequence
ctccctcagagaccagtccc

SEQ ID NO: 490000 - DNA, 20 bp, Artificial
  CRISPR gRNA sequence
tccctcagagaccagtccca

SEQ ID NO: 490001 - DNA, 20 bp, Artificial
  CRISPR gRNA sequence
ggaatttttgacaatttacg

SEQ ID NO: 490002 - DNA, 20 bp, Artificial
  CRISPR gRNA sequence
tgacaatttacgaagatgtc

SEQ ID NO: 490003 - DNA, 20 bp, Artificial
  CRISPR gRNA sequence
gacaatttacgaagatgtca

SEQ ID NO: 490004 - DNA, 20 bp, Artificial
  CRISPR gRNA sequence
gatgtcaaggatctgaaaac

SEQ ID NO: 490005 - DNA, 20 bp, Artificial
  CRISPR gRNA sequence
atgtcaaggatctgaaaacc

SEQ ID NO: 490006 - DNA, 20 bp, Artificial
  CRISPR gRNA sequence
gtcaaggatctgaaaaccag

SEQ ID NO: 490007 - DNA, 20 bp, Artificial
  CRISPR gRNA sequence
agaaatcacgtatgtcatcc

SEQ ID NO: 490008 - DNA, 20 bp, Artificial
  CRISPR gRNA sequence
aaatcacgtatgtcatcccg

SEQ ID NO: 490009 - DNA, 20 bp, Artificial
  CRISPR gRNA sequence
aatcacgtatgtcatcccgg

SEQ ID NO: 490010 - DNA, 20 bp, Artificial
  CRISPR gRNA sequence
acgtatgtcatcccggaggc

SEQ ID NO: 490011 - DNA, 20 bp, Artificial
  CRISPR gRNA sequence
cgtatgtcatcccggaggct

SEQ ID NO: 490012 - DNA, 20 bp, Artificial
  CRISPR gRNA sequence
gtatgtcatcccggaggctg

SEQ ID NO: 490013 - DNA, 20 bp, Artificial
  CRISPR gRNA sequence
ccggaggctggggtctctct

SEQ ID NO: 490014 - DNA, 20 bp, Artificial
  CRISPR gRNA sequence
aggctggggtctctctcagc

SEQ ID NO: 490015 - DNA, 20 bp, Artificial
  CRISPR gRNA sequence
ggggtctctctcagctggct

SEQ ID NO: 490016 - DNA, 20 bp, Artificial
  CRISPR gRNA sequence
ggaaaatgctctttcaatga

SEQ ID NO: 490017 - DNA, 20 bp, Artificial
  CRISPR gRNA sequence
ctctttcaatgatggttatt

SEQ ID NO: 490018 - DNA, 20 bp, Artificial
  CRISPR gRNA sequence
ctttcaatgatggttattca

SEQ ID NO: 490019 - DNA, 20 bp, Artificial
  CRISPR gRNA sequence
tcaatgatggttattcagag

SEQ ID NO: 490020 - DNA, 20 bp, Artificial
  CRISPR gRNA sequence
aatgatggttattcagagca

SEQ ID NO: 490021 - DNA, 20 bp, Artificial
  CRISPR gRNA sequence
atgatggttattcagagcag

SEQ ID NO: 490022 - DNA, 20 bp, Artificial
  CRISPR gRNA sequence
tgatggttattcagagcaga

SEQ ID NO: 490023 - DNA, 20 bp, Artificial
  CRISPR gRNA sequence
attcagagcagagggacaaa

SEQ ID NO: 490024 - DNA, 20 bp, Artificial
  CRISPR gRNA sequence
ttcagagcagagggacaaaa

SEQ ID NO: 490025 - DNA, 20 bp, Artificial
  CRISPR gRNA sequence
tgtccttttgatgtgaccct

SEQ ID NO: 490026 - DNA, 20 bp, Artificial
  CRISPR gRNA sequence
tcttttctccacctgcttcc

SEQ ID NO: 490027 - DNA, 20 bp, Artificial
  CRISPR gRNA sequence
ctccacctgcttcctagttc

SEQ ID NO: 490028 - DNA, 20 bp, Artificial
  CRISPR gRNA sequence
ctgcttcctagttctggtga

SEQ ID NO: 490029 - DNA, 20 bp, Artificial
  CRISPR gRNA sequence
gcttcctagttctggtgatg

SEQ ID NO: 490030 - DNA, 20 bp, Artificial
  CRISPR gRNA sequence
cttcctagttctggtgatgg

SEQ ID NO: 490031 - DNA, 20 bp, Artificial
  CRISPR gRNA sequence
tagttctggtgatggaggaa

SEQ ID NO: 490032 - DNA, 20 bp, Artificial
  CRISPR gRNA sequence
gttctggtgatggaggaaaa

SEQ ID NO: 490033 - DNA, 20 bp, Artificial
  CRISPR gRNA sequence
ttctggtgatggaggaaaag

SEQ ID NO: 490034 - DNA, 20 bp, Artificial
  CRISPR gRNA sequence
tggaggaaaagaggaaacaa

SEQ ID NO: 490035 - DNA, 20 bp, Artificial
  CRISPR gRNA sequence
ggaggaaaagaggaaacaaa

SEQ ID NO: 490036 - DNA, 20 bp, Artificial
  CRISPR gRNA sequence
aggaaaagaggaaacaaaag

SEQ ID NO: 490037 - DNA, 20 bp, Artificial
  CRISPR gRNA sequence
aaaagaggaaacaaaaggag

SEQ ID NO: 490038 - DNA, 20 bp, Artificial
  CRISPR gRNA sequence
aagaggaaacaaaaggagca

SEQ ID NO: 490039 - DNA, 20 bp, Artificial
  CRISPR gRNA sequence
agaggaaacaaaaggagcag

SEQ ID NO: 490040 - DNA, 20 bp, Artificial
  CRISPR gRNA sequence
aggaaacaaaaggagcagag

SEQ ID NO: 490041 - DNA, 20 bp, Artificial
  CRISPR gRNA sequence
aaaaggagcagaggagatga

SEQ ID NO: 490042 - DNA, 20 bp, Artificial
  CRISPR gRNA sequence
aaaggagcagaggagatgaa

SEQ ID NO: 490043 - DNA, 20 bp, Artificial
  CRISPR gRNA sequence
aaggagcagaggagatgaaa

SEQ ID NO: 490044 - DNA, 20 bp, Artificial
  CRISPR gRNA sequence
ggagcagaggagatgaaagg

SEQ ID NO: 490045 - DNA, 20 bp, Artificial
  CRISPR gRNA sequence
gagcagaggagatgaaaggg

SEQ ID NO: 490046 - DNA, 20 bp, Artificial
  CRISPR gRNA sequence
aggagatgaaagggaggctg

SEQ ID NO: 490047 - DNA, 20 bp, Artificial
  CRISPR gRNA sequence
ggagatgaaagggaggctga

SEQ ID NO: 490048 - DNA, 20 bp, Artificial
  CRISPR gRNA sequence
gagatgaaagggaggctgaa

SEQ ID NO: 490049 - DNA, 20 bp, Artificial
  CRISPR gRNA sequence
agatgaaagggaggctgaag

SEQ ID NO: 490050 - DNA, 20 bp, Artificial
  CRISPR gRNA sequence
gggaggctgaaggggcatct

SEQ ID NO: 490051 - DNA, 20 bp, Artificial
  CRISPR gRNA sequence
gctgaaggggcatcttggtg

SEQ ID NO: 490052 - DNA, 20 bp, Artificial
  CRISPR gRNA sequence
ggtgcagaattgcacctgct

SEQ ID NO: 490053 - DNA, 20 bp, Artificial
  CRISPR gRNA sequence
gcagaattgcacctgctgag

SEQ ID NO: 490054 - DNA, 20 bp, Artificial
  CRISPR gRNA sequence
cagaattgcacctgctgaga

SEQ ID NO: 490055 - DNA, 20 bp, Artificial
  CRISPR gRNA sequence
agaattgcacctgctgagaa

SEQ ID NO: 490056 - DNA, 20 bp, Artificial
  CRISPR gRNA sequence
ttgcacctgctgagaaggga

SEQ ID NO: 490057 - DNA, 20 bp, Artificial
  CRISPR gRNA sequence
gcacctgctgagaagggatg

SEQ ID NO: 490058 - DNA, 20 bp, Artificial
  CRISPR gRNA sequence
tgagaagggatggagcacaa

SEQ ID NO: 490059 - DNA, 20 bp, Artificial
  CRISPR gRNA sequence
agcacaacagaaatcaatga

SEQ ID NO: 490060 - DNA, 20 bp, Artificial
  CRISPR gRNA sequence
cacaacagaaatcaatgaca

SEQ ID NO: 490061 - DNA, 20 bp, Artificial
  CRISPR gRNA sequence
acaacagaaatcaatgacag

SEQ ID NO: 490062 - DNA, 20 bp, Artificial
  CRISPR gRNA sequence
acagaaatcaatgacagagg

SEQ ID NO: 490063 - DNA, 20 bp, Artificial
  CRISPR gRNA sequence
agaaatcaatgacagaggca

SEQ ID NO: 490064 - DNA, 20 bp, Artificial
  CRISPR gRNA sequence
acagaggcagagtgctgctg

SEQ ID NO: 490065 - DNA, 20 bp, Artificial
  CRISPR gRNA sequence
cacaaattctttttcctaat

SEQ ID NO: 490066 - DNA, 20 bp, Artificial
  CRISPR gRNA sequence
aattctttttcctaatgagt

SEQ ID NO: 490067 - DNA, 20 bp, Artificial
  CRISPR gRNA sequence
attctttttcctaatgagtc

SEQ ID NO: 490068 - DNA, 20 bp, Artificial
  CRISPR gRNA sequence
ttctttttcctaatgagtca

SEQ ID NO: 490069 - DNA, 20 bp, Artificial
  CRISPR gRNA sequence
gagtcagggcttacattcat

SEQ ID NO: 490070 - DNA, 20 bp, Artificial
  CRISPR gRNA sequence
tacattcatgagtcccttaa

SEQ ID NO: 490071 - DNA, 20 bp, Artificial
  CRISPR gRNA sequence
tgagtcccttaatggtgaca

SEQ ID NO: 490072 - DNA, 20 bp, Artificial
  CRISPR gRNA sequence
gagtcccttaatggtgacac

SEQ ID NO: 490073 - DNA, 20 bp, Artificial
  CRISPR gRNA sequence
cccttaatggtgacacaggc

SEQ ID NO: 490074 - DNA, 20 bp, Artificial
  CRISPR gRNA sequence
ccttaatggtgacacaggct

SEQ ID NO: 490075 - DNA, 20 bp, Artificial
  CRISPR gRNA sequence
taatggtgacacaggctggg

SEQ ID NO: 490076 - DNA, 20 bp, Artificial
  CRISPR gRNA sequence
cacaggctgggaagtgtgac

SEQ ID NO: 490077 - DNA, 20 bp, Artificial
  CRISPR gRNA sequence
ctgggaagtgtgaccagcca

SEQ ID NO: 490078 - DNA, 20 bp, Artificial
  CRISPR gRNA sequence
tgtgaccagccaaagcataa

SEQ ID NO: 490079 - DNA, 20 bp, Artificial
  CRISPR gRNA sequence
gccaaagcataatagttttg

SEQ ID NO: 490080 - DNA, 20 bp, Artificial
  CRISPR gRNA sequence
aagcataatagttttgtagc

SEQ ID NO: 490081 - DNA, 20 bp, Artificial
  CRISPR gRNA sequence
tagttttgtagctggctcaa

SEQ ID NO: 490082 - DNA, 20 bp, Artificial
  CRISPR gRNA sequence
agttttgtagctggctcaat

SEQ ID NO: 490083 - DNA, 20 bp, Artificial
  CRISPR gRNA sequence
ggctcaataggctgcattca

SEQ ID NO: 490084 - DNA, 20 bp, Artificial
  CRISPR gRNA sequence
aggctgcattcacagccttt

SEQ ID NO: 490085 - DNA, 20 bp, Artificial
  CRISPR gRNA sequence
ctgcattcacagccttttgg

SEQ ID NO: 490086 - DNA, 20 bp, Artificial
  CRISPR gRNA sequence
cattcacagccttttggaag

SEQ ID NO: 490087 - DNA, 20 bp, Artificial
  CRISPR gRNA sequence
ttcacagccttttggaagaa

SEQ ID NO: 490088 - DNA, 20 bp, Artificial
  CRISPR gRNA sequence
tcacagccttttggaagaag

SEQ ID NO: 490089 - DNA, 20 bp, Artificial
  CRISPR gRNA sequence
ccttttggaagaagaggcct

SEQ ID NO: 490090 - DNA, 20 bp, Artificial
  CRISPR gRNA sequence
tggaagaagaggcctgagtg

SEQ ID NO: 490091 - DNA, 20 bp, Artificial
  CRISPR gRNA sequence
gaagaggcctgagtgtggct

SEQ ID NO: 490092 - DNA, 20 bp, Artificial
  CRISPR gRNA sequence
aagaggcctgagtgtggctg

SEQ ID NO: 490093 - DNA, 20 bp, Artificial
  CRISPR gRNA sequence
cctgagtgtggctgaggtac

SEQ ID NO: 490094 - DNA, 20 bp, Artificial
  CRISPR gRNA sequence
tgagtgtggctgaggtacta

SEQ ID NO: 490095 - DNA, 20 bp, Artificial
  CRISPR gRNA sequence
agtgtggctgaggtactaga

SEQ ID NO: 490096 - DNA, 20 bp, Artificial
  CRISPR gRNA sequence
tgtggctgaggtactagaga

SEQ ID NO: 490097 - DNA, 20 bp, Artificial
  CRISPR gRNA sequence
gaggtactagagagagtaac

SEQ ID NO: 490098 - DNA, 20 bp, Artificial
  CRISPR gRNA sequence
actagagagagtaaccagcc

SEQ ID NO: 490099 - DNA, 20 bp, Artificial
  CRISPR gRNA sequence
agagtaaccagcctggcaca

SEQ ID NO: 490100 - DNA, 20 bp, Artificial
  CRISPR gRNA sequence
cagcctggcacaaagcccac

SEQ ID NO: 490101 - DNA, 20 bp, Artificial
  CRISPR gRNA sequence
ggcacaaagcccaccagcct

SEQ ID NO: 490102 - DNA, 20 bp, Artificial
  CRISPR gRNA sequence
acaaagcccaccagcctgag

SEQ ID NO: 490103 - DNA, 20 bp, Artificial
  CRISPR gRNA sequence
caaagcccaccagcctgagt

SEQ ID NO: 490104 - DNA, 20 bp, Artificial
  CRISPR gRNA sequence
ccagcctgagtaggctcctc

SEQ ID NO: 490105 - DNA, 20 bp, Artificial
  CRISPR gRNA sequence
cagcctgagtaggctcctcc

SEQ ID NO: 490106 - DNA, 20 bp, Artificial
  CRISPR gRNA sequence
gcctgagtaggctcctccag

SEQ ID NO: 490107 - DNA, 20 bp, Artificial
  CRISPR gRNA sequence
agcctctcgcctgctcttcg

SEQ ID NO: 490108 - DNA, 20 bp, Artificial
  CRISPR gRNA sequence
ctctcgcctgctcttcgcag

SEQ ID NO: 490109 - DNA, 20 bp, Artificial
  CRISPR gRNA sequence
tctcgcctgctcttcgcagc

SEQ ID NO: 490110 - DNA, 20 bp, Artificial
  CRISPR gRNA sequence
cgcctgctcttcgcagcagg

SEQ ID NO: 490111 - DNA, 20 bp, Artificial
  CRISPR gRNA sequence
gcctgctcttcgcagcaggc

SEQ ID NO: 490112 - DNA, 20 bp, Artificial
  CRISPR gRNA sequence
cctgctcttcgcagcaggca

SEQ ID NO: 490113 - DNA, 20 bp, Artificial
  CRISPR gRNA sequence
ctgctcttcgcagcaggcag

SEQ ID NO: 490114 - DNA, 20 bp, Artificial
  CRISPR gRNA sequence
gccaactctgcctgtcatcc

SEQ ID NO: 490115 - DNA, 20 bp, Artificial
  CRISPR gRNA sequence
tctgcctgtcatccaagaat

SEQ ID NO: 490116 - DNA, 20 bp, Artificial
  CRISPR gRNA sequence
gcctgtcatccaagaattag

SEQ ID NO: 490117 - DNA, 20 bp, Artificial
  CRISPR gRNA sequence
ctgtcatccaagaattagaa

SEQ ID NO: 490118 - DNA, 20 bp, Artificial
  CRISPR gRNA sequence
tgtcatccaagaattagaag

SEQ ID NO: 490119 - DNA, 20 bp, Artificial
  CRISPR gRNA sequence
tcatccaagaattagaagag

SEQ ID NO: 490120 - DNA, 20 bp, Artificial
  CRISPR gRNA sequence
catccaagaattagaagagg

SEQ ID NO: 490121 - DNA, 20 bp, Artificial
  CRISPR gRNA sequence
attagaagaggaggaaattg

SEQ ID NO: 490122 - DNA, 20 bp, Artificial
  CRISPR gRNA sequence
tagaagaggaggaaattgca

SEQ ID NO: 490123 - DNA, 20 bp, Artificial
  CRISPR gRNA sequence
agaagaggaggaaattgcag

SEQ ID NO: 490124 - DNA, 20 bp, Artificial
  CRISPR gRNA sequence
gaagaggaggaaattgcaga

SEQ ID NO: 490125 - DNA, 20 bp, Artificial
  CRISPR gRNA sequence
aggaaattgcagagggcctg

SEQ ID NO: 490126 - DNA, 20 bp, Artificial
  CRISPR gRNA sequence
ccccactgctgtgtctcgct

SEQ ID NO: 490127 - DNA, 20 bp, Artificial
  CRISPR gRNA sequence
cccactgctgtgtctcgctt

SEQ ID NO: 490128 - DNA, 20 bp, Artificial
  CRISPR gRNA sequence
ccactgctgtgtctcgctta

SEQ ID NO: 490129 - DNA, 20 bp, Artificial
  CRISPR gRNA sequence
ctgctgtgtctcgcttaggg

SEQ ID NO: 490130 - DNA, 20 bp, Artificial
  CRISPR gRNA sequence
tgtctcgcttagggcagatg

SEQ ID NO: 490131 - DNA, 20 bp, Artificial
  CRISPR gRNA sequence
gcttagggcagatgtggtga

SEQ ID NO: 490132 - DNA, 20 bp, Artificial
  CRISPR gRNA sequence
cttagggcagatgtggtgac

SEQ ID NO: 490133 - DNA, 20 bp, Artificial
  CRISPR gRNA sequence
ggcagatgtggtgacaggcc

SEQ ID NO: 490134 - DNA, 20 bp, Artificial
  CRISPR gRNA sequence
gcagatgtggtgacaggccc

SEQ ID NO: 490135 - DNA, 20 bp, Artificial
  CRISPR gRNA sequence
cagatgtggtgacaggccca

SEQ ID NO: 490136 - DNA, 20 bp, Artificial
  CRISPR gRNA sequence
agatgtggtgacaggcccag

SEQ ID NO: 490137 - DNA, 20 bp, Artificial
  CRISPR gRNA sequence
tggtgacaggcccaggggaa

SEQ ID NO: 490138 - DNA, 20 bp, Artificial
  CRISPR gRNA sequence
gcccaggggaaaagctctga

SEQ ID NO: 490139 - DNA, 20 bp, Artificial
  CRISPR gRNA sequence
ccaggggaaaagctctgatg

SEQ ID NO: 490140 - DNA, 20 bp, Artificial
  CRISPR gRNA sequence
gatggagcctaccaaactgc

SEQ ID NO: 490141 - DNA, 20 bp, Artificial
  CRISPR gRNA sequence
ggagcctaccaaactgctgg

SEQ ID NO: 490142 - DNA, 20 bp, Artificial
  CRISPR gRNA sequence
gagcctaccaaactgctggc

SEQ ID NO: 490143 - DNA, 20 bp, Artificial
  CRISPR gRNA sequence
cctaccaaactgctggcagg

SEQ ID NO: 490144 - DNA, 20 bp, Artificial
  CRISPR gRNA sequence
accaaactgctggcaggaag

SEQ ID NO: 490145 - DNA, 20 bp, Artificial
  CRISPR gRNA sequence
ccaaactgctggcaggaagt

SEQ ID NO: 490146 - DNA, 20 bp, Artificial
  CRISPR gRNA sequence
caaactgctggcaggaagtg

SEQ ID NO: 490147 - DNA, 20 bp, Artificial
  CRISPR gRNA sequence
actgctggcaggaagtgggg

SEQ ID NO: 490148 - DNA, 20 bp, Artificial
  CRISPR gRNA sequence
ctgctggcaggaagtggggc

SEQ ID NO: 490149 - DNA, 20 bp, Artificial
  CRISPR gRNA sequence
tgctggcaggaagtggggca

SEQ ID NO: 490150 - DNA, 20 bp, Artificial
  CRISPR gRNA sequence
tggcaggaagtggggcaggg

SEQ ID NO: 490151 - DNA, 20 bp, Artificial
  CRISPR gRNA sequence
ggcaggaagtggggcagggt

SEQ ID NO: 490152 - DNA, 20 bp, Artificial
  CRISPR gRNA sequence
gaagtggggcagggtgggtg

SEQ ID NO: 490153 - DNA, 20 bp, Artificial
  CRISPR gRNA sequence
gtggggcagggtgggtgaag

SEQ ID NO: 490154 - DNA, 20 bp, Artificial
  CRISPR gRNA sequence
tggggcagggtgggtgaagt

SEQ ID NO: 490155 - DNA, 20 bp, Artificial
  CRISPR gRNA sequence
ggggcagggtgggtgaagtg

SEQ ID NO: 490156 - DNA, 20 bp, Artificial
  CRISPR gRNA sequence
gcagggtgggtgaagtgggg

SEQ ID NO: 490157 - DNA, 20 bp, Artificial
  CRISPR gRNA sequence
gggtgggtgaagtggggcgg

SEQ ID NO: 490158 - DNA, 20 bp, Artificial
  CRISPR gRNA sequence
gccttctttccactgccccc

SEQ ID NO: 490159 - DNA, 20 bp, Artificial
  CRISPR gRNA sequence
tgccccctggcgctttgctg

SEQ ID NO: 490160 - DNA, 20 bp, Artificial
  CRISPR gRNA sequence
ccccctggcgctttgctgtg

SEQ ID NO: 490161 - DNA, 20 bp, Artificial
  CRISPR gRNA sequence
ggcgctttgctgtggagacc

SEQ ID NO: 490162 - DNA, 20 bp, Artificial
  CRISPR gRNA sequence
gctttgctgtggagacccag

SEQ ID NO: 490163 - DNA, 20 bp, Artificial
  CRISPR gRNA sequence
tgtggagacccagcagcacg

SEQ ID NO: 490164 - DNA, 20 bp, Artificial
  CRISPR gRNA sequence
gtggagacccagcagcacgc

SEQ ID NO: 490165 - DNA, 20 bp, Artificial
  CRISPR gRNA sequence
gagacccagcagcacgcagg

SEQ ID NO: 490166 - DNA, 20 bp, Artificial
  CRISPR gRNA sequence
cagcacgcaggaagcacatg

SEQ ID NO: 490167 - DNA, 20 bp, Artificial
  CRISPR gRNA sequence
cacgcaggaagcacatgtgg

SEQ ID NO: 490168 - DNA, 20 bp, Artificial
  CRISPR gRNA sequence
acgcaggaagcacatgtggt

SEQ ID NO: 490169 - DNA, 20 bp, Artificial
  CRISPR gRNA sequence
cgcaggaagcacatgtggtg

SEQ ID NO: 490170 - DNA, 20 bp, Artificial
  CRISPR gRNA sequence
gtggtggggctcttccgtgc

SEQ ID NO: 490171 - DNA, 20 bp, Artificial
  CRISPR gRNA sequence
tccgtgctggccacatacgt

SEQ ID NO: 490172 - DNA, 20 bp, Artificial
  CRISPR gRNA sequence
ccgtgctggccacatacgtg

SEQ ID NO: 490173 - DNA, 20 bp, Artificial
  CRISPR gRNA sequence
cacatacgtgaggccctgtg

SEQ ID NO: 490174 - DNA, 20 bp, Artificial
  CRISPR gRNA sequence
tgaggccctgtgcagcctcg

SEQ ID NO: 490175 - DNA, 20 bp, Artificial
  CRISPR gRNA sequence
aggccctgtgcagcctcgca

SEQ ID NO: 490176 - DNA, 20 bp, Artificial
  CRISPR gRNA sequence
ccctgtgcagcctcgcagag

SEQ ID NO: 490177 - DNA, 20 bp, Artificial
  CRISPR gRNA sequence
cctgtgcagcctcgcagagc

SEQ ID NO: 490178 - DNA, 20 bp, Artificial
  CRISPR gRNA sequence
tgcagcctcgcagagcaggc

SEQ ID NO: 490179 - DNA, 20 bp, Artificial
  CRISPR gRNA sequence
agcaggcaagcatcctctcc

SEQ ID NO: 490180 - DNA, 20 bp, Artificial
  CRISPR gRNA sequence
catcctctcccagatgcctc

SEQ ID NO: 490181 - DNA, 20 bp, Artificial
  CRISPR gRNA sequence
atcctctcccagatgcctct

SEQ ID NO: 490182 - DNA, 20 bp, Artificial
  CRISPR gRNA sequence
ctcccagatgcctctgggtt

SEQ ID NO: 490183 - DNA, 20 bp, Artificial
  CRISPR gRNA sequence
cccagatgcctctgggttca

SEQ ID NO: 490184 - DNA, 20 bp, Artificial
  CRISPR gRNA sequence
ccagatgcctctgggttcag

SEQ ID NO: 490185 - DNA, 20 bp, Artificial
  CRISPR gRNA sequence
cctctgggttcagaggctgt

SEQ ID NO: 490186 - DNA, 20 bp, Artificial
  CRISPR gRNA sequence
tctgggttcagaggctgtta

SEQ ID NO: 490187 - DNA, 20 bp, Artificial
  CRISPR gRNA sequence
gggttcagaggctgttagag

SEQ ID NO: 490188 - DNA, 20 bp, Artificial
  CRISPR gRNA sequence
ttatttatttatttttgccc

SEQ ID NO: 490189 - DNA, 20 bp, Artificial
  CRISPR gRNA sequence
tttatttatttttgccccag

SEQ ID NO: 490190 - DNA, 20 bp, Artificial
  CRISPR gRNA sequence
atttatttttgccccagcag

SEQ ID NO: 490191 - DNA, 20 bp, Artificial
  CRISPR gRNA sequence
ttttgccccagcagtggcta

SEQ ID NO: 490192 - DNA, 20 bp, Artificial
  CRISPR gRNA sequence
tttgccccagcagtggctat

SEQ ID NO: 490193 - DNA, 20 bp, Artificial
  CRISPR gRNA sequence
ctatgggaatgtgaaaaata

SEQ ID NO: 490194 - DNA, 20 bp, Artificial
  CRISPR gRNA sequence
tgggaatgtgaaaaataaag

SEQ ID NO: 490195 - DNA, 20 bp, Artificial
  CRISPR gRNA sequence
gaatgtgaaaaataaagcag

SEQ ID NO: 490196 - DNA, 20 bp, Artificial
  CRISPR gRNA sequence
aaaaataaagcagtggctat

SEQ ID NO: 490197 - DNA, 20 bp, Artificial
  CRISPR gRNA sequence
tattggaatgtgaataataa

SEQ ID NO: 490198 - DNA, 20 bp, Artificial
  CRISPR gRNA sequence
attggaatgtgaataataaa

SEQ ID NO: 490199 - DNA, 20 bp, Artificial
  CRISPR gRNA sequence
ttggaatgtgaataataaaa

SEQ ID NO: 490200 - DNA, 20 bp, Artificial
  CRISPR gRNA sequence
tggaatgtgaataataaaag

SEQ ID NO: 490201 - DNA, 20 bp, Artificial
  CRISPR gRNA sequence
tttgtttctctcactgctac

SEQ ID NO: 490202 - DNA, 20 bp, Artificial
  CRISPR gRNA sequence
ctctcactgctaccagactc

SEQ ID NO: 490203 - DNA, 20 bp, Artificial
  CRISPR gRNA sequence
actctggtacaaattcctga

SEQ ID NO: 490204 - DNA, 20 bp, Artificial
  CRISPR gRNA sequence
aaagcatgtgaatctaccca

SEQ ID NO: 490205 - DNA, 20 bp, Artificial
  CRISPR gRNA sequence
catgtgaatctacccacagc

SEQ ID NO: 490206 - DNA, 20 bp, Artificial
  CRISPR gRNA sequence
tacccacagccagtgatgcc

SEQ ID NO: 490207 - DNA, 20 bp, Artificial
  CRISPR gRNA sequence
acccacagccagtgatgccc

SEQ ID NO: 490208 - DNA, 20 bp, Artificial
  CRISPR gRNA sequence
aaataatctatttttccaaa

SEQ ID NO: 490209 - DNA, 20 bp, Artificial
  CRISPR gRNA sequence
taatctatttttccaaaaag

SEQ ID NO: 490210 - DNA, 20 bp, Artificial
  CRISPR gRNA sequence
ttccaaaaagaagatgactt

SEQ ID NO: 490211 - DNA, 20 bp, Artificial
  CRISPR gRNA sequence
aaaagaagatgacttgagat

SEQ ID NO: 490212 - DNA, 20 bp, Artificial
  CRISPR gRNA sequence
aaagaagatgacttgagatt

SEQ ID NO: 490213 - DNA, 20 bp, Artificial
  CRISPR gRNA sequence
agaagatgacttgagattag

SEQ ID NO: 490214 - DNA, 20 bp, Artificial
  CRISPR gRNA sequence
gacttgagattaggagacca

SEQ ID NO: 490215 - DNA, 20 bp, Artificial
  CRISPR gRNA sequence
acttgagattaggagaccac

SEQ ID NO: 490216 - DNA, 20 bp, Artificial
  CRISPR gRNA sequence
ttgagattaggagaccacag

SEQ ID NO: 490217 - DNA, 20 bp, Artificial
  CRISPR gRNA sequence
tgagattaggagaccacagg

SEQ ID NO: 490218 - DNA, 20 bp, Artificial
  CRISPR gRNA sequence
ccacaggaggaaaaacaact

SEQ ID NO: 490219 - DNA, 20 bp, Artificial
  CRISPR gRNA sequence
acaggaggaaaaacaactta

SEQ ID NO: 490220 - DNA, 20 bp, Artificial
  CRISPR gRNA sequence
aggaaaaacaacttagagca

SEQ ID NO: 490221 - DNA, 20 bp, Artificial
  CRISPR gRNA sequence
ggaaaaacaacttagagcaa

SEQ ID NO: 490222 - DNA, 20 bp, Artificial
  CRISPR gRNA sequence
tagagcaaaggaaacctctt

SEQ ID NO: 490223 - DNA, 20 bp, Artificial
  CRISPR gRNA sequence
agagcaaaggaaacctcttt

SEQ ID NO: 490224 - DNA, 20 bp, Artificial
  CRISPR gRNA sequence
aaggaaacctctttgggatt

SEQ ID NO: 490225 - DNA, 20 bp, Artificial
  CRISPR gRNA sequence
aggaaacctctttgggattc

SEQ ID NO: 490226 - DNA, 20 bp, Artificial
  CRISPR gRNA sequence
tctttgggattcaggcctat

SEQ ID NO: 490227 - DNA, 20 bp, Artificial
  CRISPR gRNA sequence
tagcttacttcttccgactc

SEQ ID NO: 490228 - DNA, 20 bp, Artificial
  CRISPR gRNA sequence
gcttacttcttccgactcaa

SEQ ID NO: 490229 - DNA, 20 bp, Artificial
  CRISPR gRNA sequence
ctcaagagctcctccctgcc

SEQ ID NO: 490230 - DNA, 20 bp, Artificial
  CRISPR gRNA sequence
agctcctccctgcctggcct

SEQ ID NO: 490231 - DNA, 20 bp, Artificial
  CRISPR gRNA sequence
tgcctggcctcagccctctc

SEQ ID NO: 490232 - DNA, 20 bp, Artificial
  CRISPR gRNA sequence
ctggcctctccctattgtct

SEQ ID NO: 490233 - DNA, 20 bp, Artificial
  CRISPR gRNA sequence
tggcctctccctattgtctc

SEQ ID NO: 490234 - DNA, 20 bp, Artificial
  CRISPR gRNA sequence
ggcctctccctattgtctca

SEQ ID NO: 490235 - DNA, 20 bp, Artificial
  CRISPR gRNA sequence
tgtctcagggctccaatttg

SEQ ID NO: 490236 - DNA, 20 bp, Artificial
  CRISPR gRNA sequence
gtctcagggctccaatttga

SEQ ID NO: 490237 - DNA, 20 bp, Artificial
  CRISPR gRNA sequence
aatttgaaggcctaaatctc

SEQ ID NO: 490238 - DNA, 20 bp, Artificial
  CRISPR gRNA sequence
cctaaatctcaagtttcatg

SEQ ID NO: 490239 - DNA, 20 bp, Artificial
  CRISPR gRNA sequence
gtttcatgtggtctcacttt

SEQ ID NO: 490240 - DNA, 20 bp, Artificial
  CRISPR gRNA sequence
tgtggtctcactttgagacc

SEQ ID NO: 490241 - DNA, 20 bp, Artificial
  CRISPR gRNA sequence
agacccagctctaatctttc

SEQ ID NO: 490242 - DNA, 20 bp, Artificial
  CRISPR gRNA sequence
ctttctagaaacacttcaca

SEQ ID NO: 490243 - DNA, 20 bp, Artificial
  CRISPR gRNA sequence
tttctagaaacacttcacac

SEQ ID NO: 490244 - DNA, 20 bp, Artificial
  CRISPR gRNA sequence
agaaacacttcacacgggtc

SEQ ID NO: 490245 - DNA, 20 bp, Artificial
  CRISPR gRNA sequence
acacttcacacgggtctgga

SEQ ID NO: 490246 - DNA, 20 bp, Artificial
  CRISPR gRNA sequence
cacttcacacgggtctggac

SEQ ID NO: 490247 - DNA, 20 bp, Artificial
  CRISPR gRNA sequence
cttcacacgggtctggacgg

SEQ ID NO: 490248 - DNA, 20 bp, Artificial
  CRISPR gRNA sequence
tcacacgggtctggacggga

SEQ ID NO: 490249 - DNA, 20 bp, Artificial
  CRISPR gRNA sequence
cgggtctggacgggagagaa

SEQ ID NO: 490250 - DNA, 20 bp, Artificial
  CRISPR gRNA sequence
agaaaagcaacaaactcctg

SEQ ID NO: 490251 - DNA, 20 bp, Artificial
  CRISPR gRNA sequence
agtattttaaaacacaaatg

SEQ ID NO: 490252 - DNA, 20 bp, Artificial
  CRISPR gRNA sequence
aatgaagttattgacattgt

SEQ ID NO: 490253 - DNA, 20 bp, Artificial
  CRISPR gRNA sequence
gtcagatgcccatgactccc

SEQ ID NO: 490254 - DNA, 20 bp, Artificial
  CRISPR gRNA sequence
cccatgactccccagcctct

SEQ ID NO: 490255 - DNA, 20 bp, Artificial
  CRISPR gRNA sequence
ccatgactccccagcctcta

SEQ ID NO: 490256 - DNA, 20 bp, Artificial
  CRISPR gRNA sequence
gactccccagcctctaagga

SEQ ID NO: 490257 - DNA, 20 bp, Artificial
  CRISPR gRNA sequence
cagcctctaaggacagctga

SEQ ID NO: 490258 - DNA, 20 bp, Artificial
  CRISPR gRNA sequence
tgacagttctctgcttctct

SEQ ID NO: 490259 - DNA, 20 bp, Artificial
  CRISPR gRNA sequence
tcttagcttcttcttgcttc

SEQ ID NO: 490260 - DNA, 20 bp, Artificial
  CRISPR gRNA sequence
cttagcttcttcttgcttcc

SEQ ID NO: 490261 - DNA, 20 bp, Artificial
  CRISPR gRNA sequence
atgaaccctgctgcctccac

SEQ ID NO: 490262 - DNA, 20 bp, Artificial
  CRISPR gRNA sequence
ctgctgcctccactggctcc

SEQ ID NO: 490263 - DNA, 20 bp, Artificial
  CRISPR gRNA sequence
ctgcctccactggctcccag

SEQ ID NO: 490264 - DNA, 20 bp, Artificial
  CRISPR gRNA sequence
gctcccagtagaacccaaac

SEQ ID NO: 490265 - DNA, 20 bp, Artificial
  CRISPR gRNA sequence
ccaaactggcaatatgcttt

SEQ ID NO: 490266 - DNA, 20 bp, Artificial
  CRISPR gRNA sequence
aactggcaatatgctttcag

SEQ ID NO: 490267 - DNA, 20 bp, Artificial
  CRISPR gRNA sequence
ggcaatatgctttcagtggc

SEQ ID NO: 490268 - DNA, 20 bp, Artificial
  CRISPR gRNA sequence
aatatgctttcagtggccgg

SEQ ID NO: 490269 - DNA, 20 bp, Artificial
  CRISPR gRNA sequence
acctccaccaccgatttcct

SEQ ID NO: 490270 - DNA, 20 bp, Artificial
  CRISPR gRNA sequence
cctccaccaccgatttccta

SEQ ID NO: 490271 - DNA, 20 bp, Artificial
  CRISPR gRNA sequence
ctccaccaccgatttcctaa

SEQ ID NO: 490272 - DNA, 20 bp, Artificial
  CRISPR gRNA sequence
tccaccaccgatttcctaag

SEQ ID NO: 490273 - DNA, 20 bp, Artificial
  CRISPR gRNA sequence
accaccgatttcctaagggg

SEQ ID NO: 490274 - DNA, 20 bp, Artificial
  CRISPR gRNA sequence
ccaccgatttcctaaggggt

SEQ ID NO: 490275 - DNA, 20 bp, Artificial
  CRISPR gRNA sequence
atttcctaaggggtaggaac

SEQ ID NO: 490276 - DNA, 20 bp, Artificial
  CRISPR gRNA sequence
ctaaggggtaggaacaagaa

SEQ ID NO: 490277 - DNA, 20 bp, Artificial
  CRISPR gRNA sequence
taaggggtaggaacaagaaa

SEQ ID NO: 490278 - DNA, 20 bp, Artificial
  CRISPR gRNA sequence
aaggggtaggaacaagaaaa

SEQ ID NO: 490279 - DNA, 20 bp, Artificial
  CRISPR gRNA sequence
gggtaggaacaagaaaaggg

SEQ ID NO: 490280 - DNA, 20 bp, Artificial
  CRISPR gRNA sequence
taggaacaagaaaagggaag

SEQ ID NO: 490281 - DNA, 20 bp, Artificial
  CRISPR gRNA sequence
aggaacaagaaaagggaagc

SEQ ID NO: 490282 - DNA, 20 bp, Artificial
  CRISPR gRNA sequence
aacaagaaaagggaagcagg

SEQ ID NO: 490283 - DNA, 20 bp, Artificial
  CRISPR gRNA sequence
ggaagctctgcttcctgctt

SEQ ID NO: 490284 - DNA, 20 bp, Artificial
  CRISPR gRNA sequence
ctgcttcctgctttggccct

SEQ ID NO: 490285 - DNA, 20 bp, Artificial
  CRISPR gRNA sequence
tgcttcctgctttggccctt

SEQ ID NO: 490286 - DNA, 20 bp, Artificial
  CRISPR gRNA sequence
cctgctttggcccttgggtt

SEQ ID NO: 490287 - DNA, 20 bp, Artificial
  CRISPR gRNA sequence
ctgctttggcccttgggttc

SEQ ID NO: 490288 - DNA, 20 bp, Artificial
  CRISPR gRNA sequence
tgctttggcccttgggttca

SEQ ID NO: 490289 - DNA, 20 bp, Artificial
  CRISPR gRNA sequence
cttgggttcagggctgcacc

SEQ ID NO: 490290 - DNA, 20 bp, Artificial
  CRISPR gRNA sequence
cagggctgcacccagcacta

SEQ ID NO: 490291 - DNA, 20 bp, Artificial
  CRISPR gRNA sequence
cacccagcactatagctgcc

SEQ ID NO: 490292 - DNA, 20 bp, Artificial
  CRISPR gRNA sequence
acccagcactatagctgccc

SEQ ID NO: 490293 - DNA, 20 bp, Artificial
  CRISPR gRNA sequence
cccagcactatagctgccca

SEQ ID NO: 490294 - DNA, 20 bp, Artificial
  CRISPR gRNA sequence
gctgcccagggcgctgactt

SEQ ID NO: 490295 - DNA, 20 bp, Artificial
  CRISPR gRNA sequence
ctgcccagggcgctgacttg

SEQ ID NO: 490296 - DNA, 20 bp, Artificial
  CRISPR gRNA sequence
cagggcgctgacttgaggtc

SEQ ID NO: 490297 - DNA, 20 bp, Artificial
  CRISPR gRNA sequence
agggcgctgacttgaggtca

SEQ ID NO: 490298 - DNA, 20 bp, Artificial
  CRISPR gRNA sequence
gggcgctgacttgaggtcaa

SEQ ID NO: 490299 - DNA, 20 bp, Artificial
  CRISPR gRNA sequence
gctgacttgaggtcaagggc

SEQ ID NO: 490300 - DNA, 20 bp, Artificial
  CRISPR gRNA sequence
ctgacttgaggtcaagggca

SEQ ID NO: 490301 - DNA, 20 bp, Artificial
  CRISPR gRNA sequence
acttgaggtcaagggcaagg

SEQ ID NO: 490302 - DNA, 20 bp, Artificial
  CRISPR gRNA sequence
tcaagggcaaggtggcctca

SEQ ID NO: 490303 - DNA, 20 bp, Artificial
  CRISPR gRNA sequence
aggtggcctcaaagatgatc

SEQ ID NO: 490304 - DNA, 20 bp, Artificial
  CRISPR gRNA sequence
gtggcctcaaagatgatcta

SEQ ID NO: 490305 - DNA, 20 bp, Artificial
  CRISPR gRNA sequence
ggcctcaaagatgatctaga

SEQ ID NO: 490306 - DNA, 20 bp, Artificial
  CRISPR gRNA sequence
gcctcaaagatgatctagag

SEQ ID NO: 490307 - DNA, 20 bp, Artificial
  CRISPR gRNA sequence
cctcaaagatgatctagaga

SEQ ID NO: 490308 - DNA, 20 bp, Artificial
  CRISPR gRNA sequence
agagagggcttaactgtgtt

SEQ ID NO: 490309 - DNA, 20 bp, Artificial
  CRISPR gRNA sequence
tgtttaaactttctgaattt

SEQ ID NO: 490310 - DNA, 20 bp, Artificial
  CRISPR gRNA sequence
tttctgaatttcagtgctct

SEQ ID NO: 490311 - DNA, 20 bp, Artificial
  CRISPR gRNA sequence
ttctgaatttcagtgctctg

SEQ ID NO: 490312 - DNA, 20 bp, Artificial
  CRISPR gRNA sequence
gaatttcagtgctctgaggt

SEQ ID NO: 490313 - DNA, 20 bp, Artificial
  CRISPR gRNA sequence
aatttcagtgctctgaggta

SEQ ID NO: 490314 - DNA, 20 bp, Artificial
  CRISPR gRNA sequence
cagtgctctgaggtaaggct

SEQ ID NO: 490315 - DNA, 20 bp, Artificial
  CRISPR gRNA sequence
ctgaggtaaggctcagataa

SEQ ID NO: 490316 - DNA, 20 bp, Artificial
  CRISPR gRNA sequence
gctcagataacagccctact

SEQ ID NO: 490317 - DNA, 20 bp, Artificial
  CRISPR gRNA sequence
tcagataacagccctactca

SEQ ID NO: 490318 - DNA, 20 bp, Artificial
  CRISPR gRNA sequence
agccctactcagagctctgc

SEQ ID NO: 490319 - DNA, 20 bp, Artificial
  CRISPR gRNA sequence
gccctactcagagctctgca

SEQ ID NO: 490320 - DNA, 20 bp, Artificial
  CRISPR gRNA sequence
ctactcagagctctgcaagg

SEQ ID NO: 490321 - DNA, 20 bp, Artificial
  CRISPR gRNA sequence
tactcagagctctgcaagga

SEQ ID NO: 490322 - DNA, 20 bp, Artificial
  CRISPR gRNA sequence
actcagagctctgcaaggaa

SEQ ID NO: 490323 - DNA, 20 bp, Artificial
  CRISPR gRNA sequence
ctctgcaaggaagggtttct

SEQ ID NO: 490324 - DNA, 20 bp, Artificial
  CRISPR gRNA sequence
gaagggtttctaagttacta

SEQ ID NO: 490325 - DNA, 20 bp, Artificial
  CRISPR gRNA sequence
aagggtttctaagttactaa

SEQ ID NO: 490326 - DNA, 20 bp, Artificial
  CRISPR gRNA sequence
gtttctaagttactaaagga

SEQ ID NO: 490327 - DNA, 20 bp, Artificial
  CRISPR gRNA sequence
ctaagttactaaaggaaaga

SEQ ID NO: 490328 - DNA, 20 bp, Artificial
  CRISPR gRNA sequence
tactaaaggaaagaaagtga

SEQ ID NO: 490329 - DNA, 20 bp, Artificial
  CRISPR gRNA sequence
aaagtgacagcattctcttt

SEQ ID NO: 490330 - DNA, 20 bp, Artificial
  CRISPR gRNA sequence
gtgacagcattctctttgag

SEQ ID NO: 490331 - DNA, 20 bp, Artificial
  CRISPR gRNA sequence
tgacagcattctctttgagc

SEQ ID NO: 490332 - DNA, 20 bp, Artificial
  CRISPR gRNA sequence
gacagcattctctttgagca

SEQ ID NO: 490333 - DNA, 20 bp, Artificial
  CRISPR gRNA sequence
ttctctttgagcagggttgc

SEQ ID NO: 490334 - DNA, 20 bp, Artificial
  CRISPR gRNA sequence
ttgctggaacccctcacacc

SEQ ID NO: 490335 - DNA, 20 bp, Artificial
  CRISPR gRNA sequence
tgctggaacccctcacacct

SEQ ID NO: 490336 - DNA, 20 bp, Artificial
  CRISPR gRNA sequence
tggaacccctcacacctagg

SEQ ID NO: 490337 - DNA, 20 bp, Artificial
  CRISPR gRNA sequence
ttccttgctcctgatactaa

SEQ ID NO: 490338 - DNA, 20 bp, Artificial
  CRISPR gRNA sequence
cttcctgtctcttcccatct

SEQ ID NO: 490339 - DNA, 20 bp, Artificial
  CRISPR gRNA sequence
ttcctgtctcttcccatctt

SEQ ID NO: 490340 - DNA, 20 bp, Artificial
  CRISPR gRNA sequence
cctgtctcttcccatcttgg

SEQ ID NO: 490341 - DNA, 20 bp, Artificial
  CRISPR gRNA sequence
ctgtctcttcccatcttggg

SEQ ID NO: 490342 - DNA, 20 bp, Artificial
  CRISPR gRNA sequence
ggaggatcaatgactctccc

SEQ ID NO: 490343 - DNA, 20 bp, Artificial
  CRISPR gRNA sequence
cagtcctgccacctccctcc

SEQ ID NO: 490344 - DNA, 20 bp, Artificial
  CRISPR gRNA sequence
ctccctcccagtctcctgaa

SEQ ID NO: 490345 - DNA, 20 bp, Artificial
  CRISPR gRNA sequence
ttccccactcaatctaaatc

SEQ ID NO: 490346 - DNA, 20 bp, Artificial
  CRISPR gRNA sequence
ccactcaatctaaatctgga

SEQ ID NO: 490347 - DNA, 20 bp, Artificial
  CRISPR gRNA sequence
ccccatctccatttcttgtg

SEQ ID NO: 490348 - DNA, 20 bp, Artificial
  CRISPR gRNA sequence
cccatctccatttcttgtgc

SEQ ID NO: 490349 - DNA, 20 bp, Artificial
  CRISPR gRNA sequence
catctccatttcttgtgcag

SEQ ID NO: 490350 - DNA, 20 bp, Artificial
  CRISPR gRNA sequence
ctccatttcttgtgcaggag

SEQ ID NO: 490351 - DNA, 20 bp, Artificial
  CRISPR gRNA sequence
tccatttcttgtgcaggagc

SEQ ID NO: 490352 - DNA, 20 bp, Artificial
  CRISPR gRNA sequence
catttcttgtgcaggagcag

SEQ ID NO: 490353 - DNA, 20 bp, Artificial
  CRISPR gRNA sequence
ttcttgtgcaggagcaggag

SEQ ID NO: 490354 - DNA, 20 bp, Artificial
  CRISPR gRNA sequence
gagcaggagcagacttttcc

SEQ ID NO: 490355 - DNA, 20 bp, Artificial
  CRISPR gRNA sequence
gcaggagcagacttttcctg

SEQ ID NO: 490356 - DNA, 20 bp, Artificial
  CRISPR gRNA sequence
caggagcagacttttcctgg

SEQ ID NO: 490357 - DNA, 20 bp, Artificial
  CRISPR gRNA sequence
aggagcagacttttcctgga

SEQ ID NO: 490358 - DNA, 20 bp, Artificial
  CRISPR gRNA sequence
ggagcagacttttcctggag

SEQ ID NO: 490359 - DNA, 20 bp, Artificial
  CRISPR gRNA sequence
gagcagacttttcctggagg

SEQ ID NO: 490360 - DNA, 20 bp, Artificial
  CRISPR gRNA sequence
agcagacttttcctggaggg

SEQ ID NO: 490361 - DNA, 20 bp, Artificial
  CRISPR gRNA sequence
cagacttttcctggaggggg

SEQ ID NO: 490362 - DNA, 20 bp, Artificial
  CRISPR gRNA sequence
gcaccatctactctatgatc

SEQ ID NO: 490363 - DNA, 20 bp, Artificial
  CRISPR gRNA sequence
tctactctatgatccagtcc

SEQ ID NO: 490364 - DNA, 20 bp, Artificial
  CRISPR gRNA sequence
ctactctatgatccagtccc

SEQ ID NO: 490365 - DNA, 20 bp, Artificial
  CRISPR gRNA sequence
tccagtcccaggtacctctc

SEQ ID NO: 490366 - DNA, 20 bp, Artificial
  CRISPR gRNA sequence
aggtacctctccagtttctc

SEQ ID NO: 490367 - DNA, 20 bp, Artificial
  CRISPR gRNA sequence
gtccattccatacctatctc

SEQ ID NO: 490368 - DNA, 20 bp, Artificial
  CRISPR gRNA sequence
tccattccatacctatctct

SEQ ID NO: 490369 - DNA, 20 bp, Artificial
  CRISPR gRNA sequence
ccattccatacctatctctg

SEQ ID NO: 490370 - DNA, 20 bp, Artificial
  CRISPR gRNA sequence
ctgaaactcacaccattgaa

SEQ ID NO: 490371 - DNA, 20 bp, Artificial
  CRISPR gRNA sequence
aaactcacaccattgaatgg

SEQ ID NO: 490372 - DNA, 20 bp, Artificial
  CRISPR gRNA sequence
acaccattgaatggcagaat

SEQ ID NO: 490373 - DNA, 20 bp, Artificial
  CRISPR gRNA sequence
tgaatggcagaataagatct

SEQ ID NO: 490374 - DNA, 20 bp, Artificial
  CRISPR gRNA sequence
gaataagatcttggtgcttc

SEQ ID NO: 490375 - DNA, 20 bp, Artificial
  CRISPR gRNA sequence
atcttggtgcttctagaatc

SEQ ID NO: 490376 - DNA, 20 bp, Artificial
  CRISPR gRNA sequence
ttggtgcttctagaatccag

SEQ ID NO: 490377 - DNA, 20 bp, Artificial
  CRISPR gRNA sequence
tgcttctagaatccagaaga

SEQ ID NO: 490378 - DNA, 20 bp, Artificial
  CRISPR gRNA sequence
ctagaatccagaagatagct

SEQ ID NO: 490379 - DNA, 20 bp, Artificial
  CRISPR gRNA sequence
tccagaagatagcttggctt

SEQ ID NO: 490380 - DNA, 20 bp, Artificial
  CRISPR gRNA sequence
gcattaacacattatttgaa

SEQ ID NO: 490381 - DNA, 20 bp, Artificial
  CRISPR gRNA sequence
tgaaaagatccgtgtgatac

SEQ ID NO: 490382 - DNA, 20 bp, Artificial
  CRISPR gRNA sequence
aaaagatccgtgtgatacta

SEQ ID NO: 490383 - DNA, 20 bp, Artificial
  CRISPR gRNA sequence
gatactagagcatcttaaca

SEQ ID NO: 490384 - DNA, 20 bp, Artificial
  CRISPR gRNA sequence
ctagagcatcttaacacagc

SEQ ID NO: 490385 - DNA, 20 bp, Artificial
  CRISPR gRNA sequence
tagagcatcttaacacagct

SEQ ID NO: 490386 - DNA, 20 bp, Artificial
  CRISPR gRNA sequence
agcatcttaacacagctggg

SEQ ID NO: 490387 - DNA, 20 bp, Artificial
  CRISPR gRNA sequence
cacagctgggaagcctgatg

SEQ ID NO: 490388 - DNA, 20 bp, Artificial
  CRISPR gRNA sequence
attccttcttcttccgtgtc

SEQ ID NO: 490389 - DNA, 20 bp, Artificial
  CRISPR gRNA sequence
ccttcttcttccgtgtctgg

SEQ ID NO: 490390 - DNA, 20 bp, Artificial
  CRISPR gRNA sequence
tcttcttccgtgtctggcag

SEQ ID NO: 490391 - DNA, 20 bp, Artificial
  CRISPR gRNA sequence
cttcttccgtgtctggcaga

SEQ ID NO: 490392 - DNA, 20 bp, Artificial
  CRISPR gRNA sequence
tccgtgtctggcagaaggtc

SEQ ID NO: 490393 - DNA, 20 bp, Artificial
  CRISPR gRNA sequence
gtctggcagaaggtctggcc

SEQ ID NO: 490394 - DNA, 20 bp, Artificial
  CRISPR gRNA sequence
cagaaggtctggcccagata

SEQ ID NO: 490395 - DNA, 20 bp, Artificial
  CRISPR gRNA sequence
tctggcccagataaagtcta

SEQ ID NO: 490396 - DNA, 20 bp, Artificial
  CRISPR gRNA sequence
ctggcccagataaagtctat

SEQ ID NO: 490397 - DNA, 20 bp, Artificial
  CRISPR gRNA sequence
ggcccagataaagtctatag

SEQ ID NO: 490398 - DNA, 20 bp, Artificial
  CRISPR gRNA sequence
ccagataaagtctataggag

SEQ ID NO: 490399 - DNA, 20 bp, Artificial
  CRISPR gRNA sequence
agtctataggagcagaaacc

SEQ ID NO: 490400 - DNA, 20 bp, Artificial
  CRISPR gRNA sequence
tataggagcagaaacctggt

SEQ ID NO: 490401 - DNA, 20 bp, Artificial
  CRISPR gRNA sequence
ataggagcagaaacctggtt

SEQ ID NO: 490402 - DNA, 20 bp, Artificial
  CRISPR gRNA sequence
taggagcagaaacctggtta

SEQ ID NO: 490403 - DNA, 20 bp, Artificial
  CRISPR gRNA sequence
aggagcagaaacctggttag

SEQ ID NO: 490404 - DNA, 20 bp, Artificial
  CRISPR gRNA sequence
ctgctgctgcttctaatact

SEQ ID NO: 490405 - DNA, 20 bp, Artificial
  CRISPR gRNA sequence
tgctgctgcttctaatactt

SEQ ID NO: 490406 - DNA, 20 bp, Artificial
  CRISPR gRNA sequence
gctgctgcttctaatacttg

SEQ ID NO: 490407 - DNA, 20 bp, Artificial
  CRISPR gRNA sequence
ttccctattatattcgtttt

SEQ ID NO: 490408 - DNA, 20 bp, Artificial
  CRISPR gRNA sequence
tccctattatattcgttttc

SEQ ID NO: 490409 - DNA, 20 bp, Artificial
  CRISPR gRNA sequence
tattatattcgttttcagga

SEQ ID NO: 490410 - DNA, 20 bp, Artificial
  CRISPR gRNA sequence
tcttttattttattatgact

SEQ ID NO: 490411 - DNA, 20 bp, Artificial
  CRISPR gRNA sequence
tttaaaacaattttattgtt

SEQ ID NO: 490412 - DNA, 20 bp, Artificial
  CRISPR gRNA sequence
taaaacaattttattgttta

SEQ ID NO: 490413 - DNA, 20 bp, Artificial
  CRISPR gRNA sequence
acaattttattgtttagaga

SEQ ID NO: 490414 - DNA, 20 bp, Artificial
  CRISPR gRNA sequence
caattttattgtttagagac

SEQ ID NO: 490415 - DNA, 20 bp, Artificial
  CRISPR gRNA sequence
aattttattgtttagagaca

SEQ ID NO: 490416 - DNA, 20 bp, Artificial
  CRISPR gRNA sequence
ttatttattttttatttcca

SEQ ID NO: 490417 - DNA, 20 bp, Artificial
  CRISPR gRNA sequence
tatttattttttatttccat

SEQ ID NO: 490418 - DNA, 20 bp, Artificial
  CRISPR gRNA sequence
tttatttccataggtttttt

SEQ ID NO: 490419 - DNA, 20 bp, Artificial
  CRISPR gRNA sequence
ttatttccataggttttttt

SEQ ID NO: 490420 - DNA, 20 bp, Artificial
  CRISPR gRNA sequence
tccataggtttttttgggaa

SEQ ID NO: 490421 - DNA, 20 bp, Artificial
  CRISPR gRNA sequence
ccataggtttttttgggaac

SEQ ID NO: 490422 - DNA, 20 bp, Artificial
  CRISPR gRNA sequence
taggtttttttgggaacagg

SEQ ID NO: 490423 - DNA, 20 bp, Artificial
  CRISPR gRNA sequence
ttttgggaacaggtggcatt

SEQ ID NO: 490424 - DNA, 20 bp, Artificial
  CRISPR gRNA sequence
caggtggcatttggtgtcat

SEQ ID NO: 490425 - DNA, 20 bp, Artificial
  CRISPR gRNA sequence
tggcatttggtgtcatgagt

SEQ ID NO: 490426 - DNA, 20 bp, Artificial
  CRISPR gRNA sequence
ggtgtcatgagtcagttctt

SEQ ID NO: 490427 - DNA, 20 bp, Artificial
  CRISPR gRNA sequence
gtcatgagtcagttctttag

SEQ ID NO: 490428 - DNA, 20 bp, Artificial
  CRISPR gRNA sequence
gttctttagtggtgatttgt

SEQ ID NO: 490429 - DNA, 20 bp, Artificial
  CRISPR gRNA sequence
gtggtgatttgtgagatttt

SEQ ID NO: 490430 - DNA, 20 bp, Artificial
  CRISPR gRNA sequence
atttttggtatacccgttat

SEQ ID NO: 490431 - DNA, 20 bp, Artificial
  CRISPR gRNA sequence
ttggtatacccgttatgaga

SEQ ID NO: 490432 - DNA, 20 bp, Artificial
  CRISPR gRNA sequence
tggtatacccgttatgagac

SEQ ID NO: 490433 - DNA, 20 bp, Artificial
  CRISPR gRNA sequence
caggatctcattctgtctac

SEQ ID NO: 490434 - DNA, 20 bp, Artificial
  CRISPR gRNA sequence
aggatctcattctgtctacc

SEQ ID NO: 490435 - DNA, 20 bp, Artificial
  CRISPR gRNA sequence
ctcattctgtctaccaggct

SEQ ID NO: 490436 - DNA, 20 bp, Artificial
  CRISPR gRNA sequence
gtctaccaggctgagtgcaa

SEQ ID NO: 490437 - DNA, 20 bp, Artificial
  CRISPR gRNA sequence
taccaggctgagtgcaatgg

SEQ ID NO: 490438 - DNA, 20 bp, Artificial
  CRISPR gRNA sequence
tgagtgcaatggtagaatca

SEQ ID NO: 490439 - DNA, 20 bp, Artificial
  CRISPR gRNA sequence
ggtagaatcatagcttactg

SEQ ID NO: 490440 - DNA, 20 bp, Artificial
  CRISPR gRNA sequence
ttactgaagccttgaattcc

SEQ ID NO: 490441 - DNA, 20 bp, Artificial
  CRISPR gRNA sequence
agccttgaattcccggcctc

SEQ ID NO: 490442 - DNA, 20 bp, Artificial
  CRISPR gRNA sequence
ctcaagtgatcctcccacct

SEQ ID NO: 490443 - DNA, 20 bp, Artificial
  CRISPR gRNA sequence
atcctcccacctcagcctcc

SEQ ID NO: 490444 - DNA, 20 bp, Artificial
  CRISPR gRNA sequence
tcctcccacctcagcctcct

SEQ ID NO: 490445 - DNA, 20 bp, Artificial
  CRISPR gRNA sequence
tcccacctcagcctcctggg

SEQ ID NO: 490446 - DNA, 20 bp, Artificial
  CRISPR gRNA sequence
acctcagcctcctgggtagc

SEQ ID NO: 490447 - DNA, 20 bp, Artificial
  CRISPR gRNA sequence
cctcagcctcctgggtagct

SEQ ID NO: 490448 - DNA, 20 bp, Artificial
  CRISPR gRNA sequence
ctcctgggtagctaggtctg

SEQ ID NO: 490449 - DNA, 20 bp, Artificial
  CRISPR gRNA sequence
tcctgggtagctaggtctgc

SEQ ID NO: 490450 - DNA, 20 bp, Artificial
  CRISPR gRNA sequence
caggtgtgtaccactgcacc

SEQ ID NO: 490451 - DNA, 20 bp, Artificial
  CRISPR gRNA sequence
tcttactaaatctcacataa

SEQ ID NO: 490452 - DNA, 20 bp, Artificial
  CRISPR gRNA sequence
acataacagcctcatgaaaa

SEQ ID NO: 490453 - DNA, 20 bp, Artificial
  CRISPR gRNA sequence
tgaaaatagttctaatactt

SEQ ID NO: 490454 - DNA, 20 bp, Artificial
  CRISPR gRNA sequence
tagttctaatactttagatg

SEQ ID NO: 490455 - DNA, 20 bp, Artificial
  CRISPR gRNA sequence
tctacattccatatcacaat

SEQ ID NO: 490456 - DNA, 20 bp, Artificial
  CRISPR gRNA sequence
ctacattccatatcacaatg

SEQ ID NO: 490457 - DNA, 20 bp, Artificial
  CRISPR gRNA sequence
catatcacaatgaggaaacc

SEQ ID NO: 490458 - DNA, 20 bp, Artificial
  CRISPR gRNA sequence
acaatgaggaaaccgagact

SEQ ID NO: 490459 - DNA, 20 bp, Artificial
  CRISPR gRNA sequence
caatgaggaaaccgagactc

SEQ ID NO: 490460 - DNA, 20 bp, Artificial
  CRISPR gRNA sequence
ctcaggtcaactgatatctc

SEQ ID NO: 490461 - DNA, 20 bp, Artificial
  CRISPR gRNA sequence
tcaggtcaactgatatctca

SEQ ID NO: 490462 - DNA, 20 bp, Artificial
  CRISPR gRNA sequence
actgatatctcaaggctaca

SEQ ID NO: 490463 - DNA, 20 bp, Artificial
  CRISPR gRNA sequence
atatctcaaggctacatagc

SEQ ID NO: 490464 - DNA, 20 bp, Artificial
  CRISPR gRNA sequence
tatctcaaggctacatagct

SEQ ID NO: 490465 - DNA, 20 bp, Artificial
  CRISPR gRNA sequence
ctcaaggctacatagctagg

SEQ ID NO: 490466 - DNA, 20 bp, Artificial
  CRISPR gRNA sequence
aaggctacatagctaggtag

SEQ ID NO: 490467 - DNA, 20 bp, Artificial
  CRISPR gRNA sequence
gctacatagctaggtagtgg

SEQ ID NO: 490468 - DNA, 20 bp, Artificial
  CRISPR gRNA sequence
tacatagctaggtagtggca

SEQ ID NO: 490469 - DNA, 20 bp, Artificial
  CRISPR gRNA sequence
agctaggtagtggcagagct

SEQ ID NO: 490470 - DNA, 20 bp, Artificial
  CRISPR gRNA sequence
gtagtggcagagctgagcca

SEQ ID NO: 490471 - DNA, 20 bp, Artificial
  CRISPR gRNA sequence
tagtggcagagctgagccaa

SEQ ID NO: 490472 - DNA, 20 bp, Artificial
  CRISPR gRNA sequence
agtggcagagctgagccaaa

SEQ ID NO: 490473 - DNA, 20 bp, Artificial
  CRISPR gRNA sequence
agctgagccaaagggtttct

SEQ ID NO: 490474 - DNA, 20 bp, Artificial
  CRISPR gRNA sequence
atactccacctcttatattc

SEQ ID NO: 490475 - DNA, 20 bp, Artificial
  CRISPR gRNA sequence
tactccacctcttatattct

SEQ ID NO: 490476 - DNA, 20 bp, Artificial
  CRISPR gRNA sequence
cctcttatattctgggatta

SEQ ID NO: 490477 - DNA, 20 bp, Artificial
  CRISPR gRNA sequence
acagaaattcactcataaac

SEQ ID NO: 490478 - DNA, 20 bp, Artificial
  CRISPR gRNA sequence
agaaattcactcataaactg

SEQ ID NO: 490479 - DNA, 20 bp, Artificial
  CRISPR gRNA sequence
aattcactcataaactggag

SEQ ID NO: 490480 - DNA, 20 bp, Artificial
  CRISPR gRNA sequence
gaagcatcctttaatactga

SEQ ID NO: 490481 - DNA, 20 bp, Artificial
  CRISPR gRNA sequence
ctaaaatgacattgataacc

SEQ ID NO: 490482 - DNA, 20 bp, Artificial
  CRISPR gRNA sequence
taaaatgacattgataaccc

SEQ ID NO: 490483 - DNA, 20 bp, Artificial
  CRISPR gRNA sequence
atgacattgataacccaggc

SEQ ID NO: 490484 - DNA, 20 bp, Artificial
  CRISPR gRNA sequence
tgacattgataacccaggct

SEQ ID NO: 490485 - DNA, 20 bp, Artificial
  CRISPR gRNA sequence
caggctgggacatctctccc

SEQ ID NO: 490486 - DNA, 20 bp, Artificial
  CRISPR gRNA sequence
aggctgggacatctctccca

SEQ ID NO: 490487 - DNA, 20 bp, Artificial
  CRISPR gRNA sequence
ggctgggacatctctcccaa

SEQ ID NO: 490488 - DNA, 20 bp, Artificial
  CRISPR gRNA sequence
ccaagggaaacactgcctcc

SEQ ID NO: 490489 - DNA, 20 bp, Artificial
  CRISPR gRNA sequence
agggaaacactgcctcctgg

SEQ ID NO: 490490 - DNA, 20 bp, Artificial
  CRISPR gRNA sequence
aaacactgcctcctggtggc

SEQ ID NO: 490491 - DNA, 20 bp, Artificial
  CRISPR gRNA sequence
ctcctggtggccagtaataa

SEQ ID NO: 490492 - DNA, 20 bp, Artificial
  CRISPR gRNA sequence
aaaagactttctgataaaaa

SEQ ID NO: 490493 - DNA, 20 bp, Artificial
  CRISPR gRNA sequence
ataaaaatggctttaaaaaa

SEQ ID NO: 490494 - DNA, 20 bp, Artificial
  CRISPR gRNA sequence
aaaaaaagaaaaaaaaaatt

SEQ ID NO: 490495 - DNA, 20 bp, Artificial
  CRISPR gRNA sequence
aaaaaattgagcaccatctt

SEQ ID NO: 490496 - DNA, 20 bp, Artificial
  CRISPR gRNA sequence
attgagcaccatcttcagtt

SEQ ID NO: 490497 - DNA, 20 bp, Artificial
  CRISPR gRNA sequence
gagcaccatcttcagtttgg

SEQ ID NO: 490498 - DNA, 20 bp, Artificial
  CRISPR gRNA sequence
ccatcttcagtttggtggct

SEQ ID NO: 490499 - DNA, 20 bp, Artificial
  CRISPR gRNA sequence
tcagtttggtggctgagctg

SEQ ID NO: 490500 - DNA, 20 bp, Artificial
  CRISPR gRNA sequence
cagtttggtggctgagctgt

SEQ ID NO: 490501 - DNA, 20 bp, Artificial
  CRISPR gRNA sequence
agtttggtggctgagctgtg

SEQ ID NO: 490502 - DNA, 20 bp, Artificial
  CRISPR gRNA sequence
ggtggctgagctgtggggca

SEQ ID NO: 490503 - DNA, 20 bp, Artificial
  CRISPR gRNA sequence
ggcaaagaaaatctgattat

SEQ ID NO: 490504 - DNA, 20 bp, Artificial
  CRISPR gRNA sequence
caaagaaaatctgattataa

SEQ ID NO: 490505 - DNA, 20 bp, Artificial
  CRISPR gRNA sequence
agaaaatctgattataagag

SEQ ID NO: 490506 - DNA, 20 bp, Artificial
  CRISPR gRNA sequence
taagagcggttgatatctgc

SEQ ID NO: 490507 - DNA, 20 bp, Artificial
  CRISPR gRNA sequence
gttgatatctgccagttctc

SEQ ID NO: 490508 - DNA, 20 bp, Artificial
  CRISPR gRNA sequence
atctgccagttctctagttt

SEQ ID NO: 490509 - DNA, 20 bp, Artificial
  CRISPR gRNA sequence
cagccacattgaactccaat

SEQ ID NO: 490510 - DNA, 20 bp, Artificial
  CRISPR gRNA sequence
gccacattgaactccaatga

SEQ ID NO: 490511 - DNA, 20 bp, Artificial
  CRISPR gRNA sequence
ccacattgaactccaatgag

SEQ ID NO: 490512 - DNA, 20 bp, Artificial
  CRISPR gRNA sequence
ccaatgagaggaatttctat

SEQ ID NO: 490513 - DNA, 20 bp, Artificial
  CRISPR gRNA sequence
agaggaatttctatcagtgc

SEQ ID NO: 490514 - DNA, 20 bp, Artificial
  CRISPR gRNA sequence
gaatttctatcagtgcaaga

SEQ ID NO: 490515 - DNA, 20 bp, Artificial
  CRISPR gRNA sequence
atttctatcagtgcaagaaa

SEQ ID NO: 490516 - DNA, 20 bp, Artificial
  CRISPR gRNA sequence
tttctatcagtgcaagaaag

SEQ ID NO: 490517 - DNA, 20 bp, Artificial
  CRISPR gRNA sequence
aaagaggtcccctcaaacta

SEQ ID NO: 490518 - DNA, 20 bp, Artificial
  CRISPR gRNA sequence
gtcccctcaaactatggtgt

SEQ ID NO: 490519 - DNA, 20 bp, Artificial
  CRISPR gRNA sequence
tcccctcaaactatggtgtt

SEQ ID NO: 490520 - DNA, 20 bp, Artificial
  CRISPR gRNA sequence
ctcaaactatggtgttgggt

SEQ ID NO: 490521 - DNA, 20 bp, Artificial
  CRISPR gRNA sequence
atggtgttgggtgagaatga

SEQ ID NO: 490522 - DNA, 20 bp, Artificial
  CRISPR gRNA sequence
tgagaatgacagtcctcctc

SEQ ID NO: 490523 - DNA, 20 bp, Artificial
  CRISPR gRNA sequence
agaatgacagtcctcctctg

SEQ ID NO: 490524 - DNA, 20 bp, Artificial
  CRISPR gRNA sequence
cctcctctggagcatcttaa

SEQ ID NO: 490525 - DNA, 20 bp, Artificial
  CRISPR gRNA sequence
ctcctctggagcatcttaaa

SEQ ID NO: 490526 - DNA, 20 bp, Artificial
  CRISPR gRNA sequence
cctctggagcatcttaaaag

SEQ ID NO: 490527 - DNA, 20 bp, Artificial
  CRISPR gRNA sequence
aggagaatgtttacctgatt

SEQ ID NO: 490528 - DNA, 20 bp, Artificial
  CRISPR gRNA sequence
gagaatgtttacctgattta

SEQ ID NO: 490529 - DNA, 20 bp, Artificial
  CRISPR gRNA sequence
agaatgtttacctgatttag

SEQ ID NO: 490530 - DNA, 20 bp, Artificial
  CRISPR gRNA sequence
tacctgatttagaggacacc

SEQ ID NO: 490531 - DNA, 20 bp, Artificial
  CRISPR gRNA sequence
atttagaggacacctggttc

SEQ ID NO: 490532 - DNA, 20 bp, Artificial
  CRISPR gRNA sequence
gaggacacctggttccagtc

SEQ ID NO: 490533 - DNA, 20 bp, Artificial
  CRISPR gRNA sequence
aggacacctggttccagtcc

SEQ ID NO: 490534 - DNA, 20 bp, Artificial
  CRISPR gRNA sequence
ggacacctggttccagtcca

SEQ ID NO: 490535 - DNA, 20 bp, Artificial
  CRISPR gRNA sequence
cacctggttccagtccaggg

SEQ ID NO: 490536 - DNA, 20 bp, Artificial
  CRISPR gRNA sequence
acctggttccagtccaggga

SEQ ID NO: 490537 - DNA, 20 bp, Artificial
  CRISPR gRNA sequence
cctggttccagtccagggaa

SEQ ID NO: 490538 - DNA, 20 bp, Artificial
  CRISPR gRNA sequence
tggttccagtccagggaagg

SEQ ID NO: 490539 - DNA, 20 bp, Artificial
  CRISPR gRNA sequence
ggttccagtccagggaaggg

SEQ ID NO: 490540 - DNA, 20 bp, Artificial
  CRISPR gRNA sequence
ccagtccagggaagggaggc

SEQ ID NO: 490541 - DNA, 20 bp, Artificial
  CRISPR gRNA sequence
ggaagggaggcaagttgcca

SEQ ID NO: 490542 - DNA, 20 bp, Artificial
  CRISPR gRNA sequence
gaagggaggcaagttgccaa

SEQ ID NO: 490543 - DNA, 20 bp, Artificial
  CRISPR gRNA sequence
aagggaggcaagttgccaaa

SEQ ID NO: 490544 - DNA, 20 bp, Artificial
  CRISPR gRNA sequence
gggaggcaagttgccaaagg

SEQ ID NO: 490545 - DNA, 20 bp, Artificial
  CRISPR gRNA sequence
ggaggcaagttgccaaaggg

SEQ ID NO: 490546 - DNA, 20 bp, Artificial
  CRISPR gRNA sequence
agttgccaaagggaggcatt

SEQ ID NO: 490547 - DNA, 20 bp, Artificial
  CRISPR gRNA sequence
gttgccaaagggaggcattg

SEQ ID NO: 490548 - DNA, 20 bp, Artificial
  CRISPR gRNA sequence
aagggaggcattgaggtgtt

SEQ ID NO: 490549 - DNA, 20 bp, Artificial
  CRISPR gRNA sequence
agggaggcattgaggtgttg

SEQ ID NO: 490550 - DNA, 20 bp, Artificial
  CRISPR gRNA sequence
aggcattgaggtgttgagga

SEQ ID NO: 490551 - DNA, 20 bp, Artificial
  CRISPR gRNA sequence
gcattgaggtgttgaggaaa

SEQ ID NO: 490552 - DNA, 20 bp, Artificial
  CRISPR gRNA sequence
aggtgttgaggaaagagccc

SEQ ID NO: 490553 - DNA, 20 bp, Artificial
  CRISPR gRNA sequence
gtgttgaggaaagagccctg

SEQ ID NO: 490554 - DNA, 20 bp, Artificial
  CRISPR gRNA sequence
gttgaggaaagagccctgga

SEQ ID NO: 490555 - DNA, 20 bp, Artificial
  CRISPR gRNA sequence
gaaagagccctggagagtct

SEQ ID NO: 490556 - DNA, 20 bp, Artificial
  CRISPR gRNA sequence
aaagagccctggagagtctt

SEQ ID NO: 490557 - DNA, 20 bp, Artificial
  CRISPR gRNA sequence
tgtgtacgcactgcctgact

SEQ ID NO: 490558 - DNA, 20 bp, Artificial
  CRISPR gRNA sequence
gtgtacgcactgcctgactt

SEQ ID NO: 490559 - DNA, 20 bp, Artificial
  CRISPR gRNA sequence
acttgggctatttatccttt

SEQ ID NO: 490560 - DNA, 20 bp, Artificial
  CRISPR gRNA sequence
ttgggctatttatccttttg

SEQ ID NO: 490561 - DNA, 20 bp, Artificial
  CRISPR gRNA sequence
tccttttggagcctcatttg

SEQ ID NO: 490562 - DNA, 20 bp, Artificial
  CRISPR gRNA sequence
ttggagcctcatttgtggca

SEQ ID NO: 490563 - DNA, 20 bp, Artificial
  CRISPR gRNA sequence
tggagcctcatttgtggcat

SEQ ID NO: 490564 - DNA, 20 bp, Artificial
  CRISPR gRNA sequence
ggagcctcatttgtggcatg

SEQ ID NO: 490565 - DNA, 20 bp, Artificial
  CRISPR gRNA sequence
ttatgatcattcttatttta

SEQ ID NO: 490566 - DNA, 20 bp, Artificial
  CRISPR gRNA sequence
tatgatcattcttattttat

SEQ ID NO: 490567 - DNA, 20 bp, Artificial
  CRISPR gRNA sequence
tgatcattcttattttatag

SEQ ID NO: 490568 - DNA, 20 bp, Artificial
  CRISPR gRNA sequence
ttattttataggagtgttaa

SEQ ID NO: 490569 - DNA, 20 bp, Artificial
  CRISPR gRNA sequence
attttataggagtgttaaaa

SEQ ID NO: 490570 - DNA, 20 bp, Artificial
  CRISPR gRNA sequence
tataggagtgttaaaagagt

SEQ ID NO: 490571 - DNA, 20 bp, Artificial
  CRISPR gRNA sequence
taggagtgttaaaagagtta

SEQ ID NO: 490572 - DNA, 20 bp, Artificial
  CRISPR gRNA sequence
gagtgttaaaagagttagag

SEQ ID NO: 490573 - DNA, 20 bp, Artificial
  CRISPR gRNA sequence
gtgttaaaagagttagagaa

SEQ ID NO: 490574 - DNA, 20 bp, Artificial
  CRISPR gRNA sequence
tgttaaaagagttagagaag

SEQ ID NO: 490575 - DNA, 20 bp, Artificial
  CRISPR gRNA sequence
aaaagagttagagaagaggc

SEQ ID NO: 490576 - DNA, 20 bp, Artificial
  CRISPR gRNA sequence
aaagagttagagaagaggcc

SEQ ID NO: 490577 - DNA, 20 bp, Artificial
  CRISPR gRNA sequence
gttagagaagaggccaggcg

SEQ ID NO: 490578 - DNA, 20 bp, Artificial
  CRISPR gRNA sequence
agagaagaggccaggcgcgg

SEQ ID NO: 490579 - DNA, 20 bp, Artificial
  CRISPR gRNA sequence
tgcctgtaatcccaacactt

SEQ ID NO: 490580 - DNA, 20 bp, Artificial
  CRISPR gRNA sequence
gcctgtaatcccaacacttt

SEQ ID NO: 490581 - DNA, 20 bp, Artificial
  CRISPR gRNA sequence
ctgtaatcccaacactttgg

SEQ ID NO: 490582 - DNA, 20 bp, Artificial
  CRISPR gRNA sequence
tgtaatcccaacactttggg

SEQ ID NO: 490583 - DNA, 20 bp, Artificial
  CRISPR gRNA sequence
tcccaacactttgggaggcc

SEQ ID NO: 490584 - DNA, 20 bp, Artificial
  CRISPR gRNA sequence
cccaacactttgggaggccg

SEQ ID NO: 490585 - DNA, 20 bp, Artificial
  CRISPR gRNA sequence
aacactttgggaggccgagg

SEQ ID NO: 490586 - DNA, 20 bp, Artificial
  CRISPR gRNA sequence
acactttgggaggccgaggc

SEQ ID NO: 490587 - DNA, 20 bp, Artificial
  CRISPR gRNA sequence
ctttgggaggccgaggcggg

SEQ ID NO: 490588 - DNA, 20 bp, Artificial
  CRISPR gRNA sequence
ggccgaggcgggcggatcac

SEQ ID NO: 490589 - DNA, 20 bp, Artificial
  CRISPR gRNA sequence
gccgaggcgggcggatcacg

SEQ ID NO: 490590 - DNA, 20 bp, Artificial
  CRISPR gRNA sequence
aggcgggcggatcacgaggt

SEQ ID NO: 490591 - DNA, 20 bp, Artificial
  CRISPR gRNA sequence
ggcgggcggatcacgaggtc

SEQ ID NO: 490592 - DNA, 20 bp, Artificial
  CRISPR gRNA sequence
gcgggcggatcacgaggtca

SEQ ID NO: 490593 - DNA, 20 bp, Artificial
  CRISPR gRNA sequence
cgggcggatcacgaggtcag

SEQ ID NO: 490594 - DNA, 20 bp, Artificial
  CRISPR gRNA sequence
gatcacgaggtcaggggttt

SEQ ID NO: 490595 - DNA, 20 bp, Artificial
  CRISPR gRNA sequence
cgaggtcaggggtttgagac

SEQ ID NO: 490596 - DNA, 20 bp, Artificial
  CRISPR gRNA sequence
tcaggggtttgagaccagcc

SEQ ID NO: 490597 - DNA, 20 bp, Artificial
  CRISPR gRNA sequence
tgagaccagcctggcccaca

SEQ ID NO: 490598 - DNA, 20 bp, Artificial
  CRISPR gRNA sequence
gtctctaaaaatacaaaaat

SEQ ID NO: 490599 - DNA, 20 bp, Artificial
  CRISPR gRNA sequence
ctaaaaatacaaaaattagc

SEQ ID NO: 490600 - DNA, 20 bp, Artificial
  CRISPR gRNA sequence
taaaaatacaaaaattagct

SEQ ID NO: 490601 - DNA, 20 bp, Artificial
  CRISPR gRNA sequence
caaaaattagctgggcatga

SEQ ID NO: 490602 - DNA, 20 bp, Artificial
  CRISPR gRNA sequence
aaattagctgggcatgatgg

SEQ ID NO: 490603 - DNA, 20 bp, Artificial
  CRISPR gRNA sequence
aattagctgggcatgatggc

SEQ ID NO: 490604 - DNA, 20 bp, Artificial
  CRISPR gRNA sequence
atggcaggcacctgtaatcc

SEQ ID NO: 490605 - DNA, 20 bp, Artificial
  CRISPR gRNA sequence
cacctgtaatcccagctact

SEQ ID NO: 490606 - DNA, 20 bp, Artificial
  CRISPR gRNA sequence
acctgtaatcccagctactc

SEQ ID NO: 490607 - DNA, 20 bp, Artificial
  CRISPR gRNA sequence
ctgtaatcccagctactcag

SEQ ID NO: 490608 - DNA, 20 bp, Artificial
  CRISPR gRNA sequence
tgtaatcccagctactcagg

SEQ ID NO: 490609 - DNA, 20 bp, Artificial
  CRISPR gRNA sequence
atcccagctactcaggaggc

SEQ ID NO: 490610 - DNA, 20 bp, Artificial
  CRISPR gRNA sequence
tcccagctactcaggaggct

SEQ ID NO: 490611 - DNA, 20 bp, Artificial
  CRISPR gRNA sequence
cccagctactcaggaggctg

SEQ ID NO: 490612 - DNA, 20 bp, Artificial
  CRISPR gRNA sequence
agctactcaggaggctgggg

SEQ ID NO: 490613 - DNA, 20 bp, Artificial
  CRISPR gRNA sequence
gctactcaggaggctggggc

SEQ ID NO: 490614 - DNA, 20 bp, Artificial
  CRISPR gRNA sequence
tactcaggaggctggggcag

SEQ ID NO: 490615 - DNA, 20 bp, Artificial
  CRISPR gRNA sequence
gcaggagaattgcctgaacc

SEQ ID NO: 490616 - DNA, 20 bp, Artificial
  CRISPR gRNA sequence
caggagaattgcctgaaccc

SEQ ID NO: 490617 - DNA, 20 bp, Artificial
  CRISPR gRNA sequence
ggagaattgcctgaacccag

SEQ ID NO: 490618 - DNA, 20 bp, Artificial
  CRISPR gRNA sequence
gagaattgcctgaacccagg

SEQ ID NO: 490619 - DNA, 20 bp, Artificial
  CRISPR gRNA sequence
aattgcctgaacccaggagg

SEQ ID NO: 490620 - DNA, 20 bp, Artificial
  CRISPR gRNA sequence
ttgcctgaacccaggaggca

SEQ ID NO: 490621 - DNA, 20 bp, Artificial
  CRISPR gRNA sequence
tgcctgaacccaggaggcag

SEQ ID NO: 490622 - DNA, 20 bp, Artificial
  CRISPR gRNA sequence
aacccaggaggcagaggttg

SEQ ID NO: 490623 - DNA, 20 bp, Artificial
  CRISPR gRNA sequence
caggaggcagaggttgcggt

SEQ ID NO: 490624 - DNA, 20 bp, Artificial
  CRISPR gRNA sequence
ggcagaggttgcggtgagcc

SEQ ID NO: 490625 - DNA, 20 bp, Artificial
  CRISPR gRNA sequence
ggttgcggtgagccaagatc

SEQ ID NO: 490626 - DNA, 20 bp, Artificial
  CRISPR gRNA sequence
aagatcgagacattgcactc

SEQ ID NO: 490627 - DNA, 20 bp, Artificial
  CRISPR gRNA sequence
cgagacattgcactccagcc

SEQ ID NO: 490628 - DNA, 20 bp, Artificial
  CRISPR gRNA sequence
gagacattgcactccagccc

SEQ ID NO: 490629 - DNA, 20 bp, Artificial
  CRISPR gRNA sequence
ttgcactccagcccaggcaa

SEQ ID NO: 490630 - DNA, 20 bp, Artificial
  CRISPR gRNA sequence
gcactccagcccaggcaata

SEQ ID NO: 490631 - DNA, 20 bp, Artificial
  CRISPR gRNA sequence
aaaacaaataaacaaaaaaa

SEQ ID NO: 490632 - DNA, 20 bp, Artificial
  CRISPR gRNA sequence
caaataaacaaaaaaacagt

SEQ ID NO: 490633 - DNA, 20 bp, Artificial
  CRISPR gRNA sequence
aataaacaaaaaaacagtta

SEQ ID NO: 490634 - DNA, 20 bp, Artificial
  CRISPR gRNA sequence
ataaacaaaaaaacagttag

SEQ ID NO: 490635 - DNA, 20 bp, Artificial
  CRISPR gRNA sequence
aaacaaaaaaacagttagag

SEQ ID NO: 490636 - DNA, 20 bp, Artificial
  CRISPR gRNA sequence
ttagaggagaatacatgtat

SEQ ID NO: 490637 - DNA, 20 bp, Artificial
  CRISPR gRNA sequence
taagataaatgctcaacaaa

SEQ ID NO: 490638 - DNA, 20 bp, Artificial
  CRISPR gRNA sequence
gataaatgctcaacaaatag

SEQ ID NO: 490639 - DNA, 20 bp, Artificial
  CRISPR gRNA sequence
atagaagctttcattaatga

SEQ ID NO: 490640 - DNA, 20 bp, Artificial
  CRISPR gRNA sequence
agaagctttcattaatgaca

SEQ ID NO: 490641 - DNA, 20 bp, Artificial
  CRISPR gRNA sequence
gctttcattaatgacagagc

SEQ ID NO: 490642 - DNA, 20 bp, Artificial
  CRISPR gRNA sequence
cattaatgacagagcgagac

SEQ ID NO: 490643 - DNA, 20 bp, Artificial
  CRISPR gRNA sequence
gacagagcgagactagcact

SEQ ID NO: 490644 - DNA, 20 bp, Artificial
  CRISPR gRNA sequence
acagagcgagactagcactc

SEQ ID NO: 490645 - DNA, 20 bp, Artificial
  CRISPR gRNA sequence
actcaggttgtctgacctcc

SEQ ID NO: 490646 - DNA, 20 bp, Artificial
  CRISPR gRNA sequence
aggttgtctgacctcctggc

SEQ ID NO: 490647 - DNA, 20 bp, Artificial
  CRISPR gRNA sequence
gtctgacctcctggctagtc

SEQ ID NO: 490648 - DNA, 20 bp, Artificial
  CRISPR gRNA sequence
tctgacctcctggctagtcc

SEQ ID NO: 490649 - DNA, 20 bp, Artificial
  CRISPR gRNA sequence
ctgacctcctggctagtcca

SEQ ID NO: 490650 - DNA, 20 bp, Artificial
  CRISPR gRNA sequence
gctcttttcactaacacttg

SEQ ID NO: 490651 - DNA, 20 bp, Artificial
  CRISPR gRNA sequence
taacacttgaagcttccatc

SEQ ID NO: 490652 - DNA, 20 bp, Artificial
  CRISPR gRNA sequence
aacacttgaagcttccatct

SEQ ID NO: 490653 - DNA, 20 bp, Artificial
  CRISPR gRNA sequence
acttgaagcttccatctggg

SEQ ID NO: 490654 - DNA, 20 bp, Artificial
  CRISPR gRNA sequence
cttgaagcttccatctgggc

SEQ ID NO: 490655 - DNA, 20 bp, Artificial
  CRISPR gRNA sequence
ttgaagcttccatctgggca

SEQ ID NO: 490656 - DNA, 20 bp, Artificial
  CRISPR gRNA sequence
gcttccatctgggcagggtt

SEQ ID NO: 490657 - DNA, 20 bp, Artificial
  CRISPR gRNA sequence
cttccatctgggcagggttg

SEQ ID NO: 490658 - DNA, 20 bp, Artificial
  CRISPR gRNA sequence
tccatctgggcagggttgag

SEQ ID NO: 490659 - DNA, 20 bp, Artificial
  CRISPR gRNA sequence
ccatctgggcagggttgagg

SEQ ID NO: 490660 - DNA, 20 bp, Artificial
  CRISPR gRNA sequence
atctgggcagggttgaggag

SEQ ID NO: 490661 - DNA, 20 bp, Artificial
  CRISPR gRNA sequence
gcagggttgaggaggagaaa

SEQ ID NO: 490662 - DNA, 20 bp, Artificial
  CRISPR gRNA sequence
gggttgaggaggagaaacgg

SEQ ID NO: 490663 - DNA, 20 bp, Artificial
  CRISPR gRNA sequence
gttgaggaggagaaacggaa

SEQ ID NO: 490664 - DNA, 20 bp, Artificial
  CRISPR gRNA sequence
acggaagagataacctttgt

SEQ ID NO: 490665 - DNA, 20 bp, Artificial
  CRISPR gRNA sequence
taacctttgtaagattgtgc

SEQ ID NO: 490666 - DNA, 20 bp, Artificial
  CRISPR gRNA sequence
gattttatttctcttctcat

SEQ ID NO: 490667 - DNA, 20 bp, Artificial
  CRISPR gRNA sequence
gtcttctgctcccacgtcac

SEQ ID NO: 490668 - DNA, 20 bp, Artificial
  CRISPR gRNA sequence
atacattatattcattaatt

SEQ ID NO: 490669 - DNA, 20 bp, Artificial
  CRISPR gRNA sequence
tattcattaattcagccttc

SEQ ID NO: 490670 - DNA, 20 bp, Artificial
  CRISPR gRNA sequence
attcattaattcagccttcc

SEQ ID NO: 490671 - DNA, 20 bp, Artificial
  CRISPR gRNA sequence
cattaattcagccttccagg

SEQ ID NO: 490672 - DNA, 20 bp, Artificial
  CRISPR gRNA sequence
attaattcagccttccagga

SEQ ID NO: 490673 - DNA, 20 bp, Artificial
  CRISPR gRNA sequence
attcagccttccaggaaggt

SEQ ID NO: 490674 - DNA, 20 bp, Artificial
  CRISPR gRNA sequence
ggaaggtgagcctcttcccg

SEQ ID NO: 490675 - DNA, 20 bp, Artificial
  CRISPR gRNA sequence
aggtgagcctcttcccgtgg

SEQ ID NO: 490676 - DNA, 20 bp, Artificial
  CRISPR gRNA sequence
tgagcctcttcccgtggtgg

SEQ ID NO: 490677 - DNA, 20 bp, Artificial
  CRISPR gRNA sequence
gcctcttcccgtggtggtgg

SEQ ID NO: 490678 - DNA, 20 bp, Artificial
  CRISPR gRNA sequence
cctcttcccgtggtggtggt

SEQ ID NO: 490679 - DNA, 20 bp, Artificial
  CRISPR gRNA sequence
ctcttcccgtggtggtggtg

SEQ ID NO: 490680 - DNA, 20 bp, Artificial
  CRISPR gRNA sequence
gtggtggggtgttgttgatg

SEQ ID NO: 490681 - DNA, 20 bp, Artificial
  CRISPR gRNA sequence
gtgtattttgcatgtgtttg

SEQ ID NO: 490682 - DNA, 20 bp, Artificial
  CRISPR gRNA sequence
attttgcatgtgtttgcagt

SEQ ID NO: 490683 - DNA, 20 bp, Artificial
  CRISPR gRNA sequence
tttgcatgtgtttgcagtga

SEQ ID NO: 490684 - DNA, 20 bp, Artificial
  CRISPR gRNA sequence
gagagtgtgtgtgcacatcc

SEQ ID NO: 490685 - DNA, 20 bp, Artificial
  CRISPR gRNA sequence
gtgtgtgtgcacatcctggc

SEQ ID NO: 490686 - DNA, 20 bp, Artificial
  CRISPR gRNA sequence
gttctttattgtgtgtatct

SEQ ID NO: 490687 - DNA, 20 bp, Artificial
  CRISPR gRNA sequence
ctttattgtgtgtatctgag

SEQ ID NO: 490688 - DNA, 20 bp, Artificial
  CRISPR gRNA sequence
tgactgtatttaaatgtcaa

SEQ ID NO: 490689 - DNA, 20 bp, Artificial
  CRISPR gRNA sequence
gactgtatttaaatgtcaat

SEQ ID NO: 490690 - DNA, 20 bp, Artificial
  CRISPR gRNA sequence
ttaaatgtcaatgggccaat

SEQ ID NO: 490691 - DNA, 20 bp, Artificial
  CRISPR gRNA sequence
gccaatgagaaatgccttac

SEQ ID NO: 490692 - DNA, 20 bp, Artificial
  CRISPR gRNA sequence
aatgccttactggttctgtc

SEQ ID NO: 490693 - DNA, 20 bp, Artificial
  CRISPR gRNA sequence
tgccttactggttctgtctg

SEQ ID NO: 490694 - DNA, 20 bp, Artificial
  CRISPR gRNA sequence
ttctgtctggagaaaaataa

SEQ ID NO: 490695 - DNA, 20 bp, Artificial
  CRISPR gRNA sequence
tggagaaaaataacagcttc

SEQ ID NO: 490696 - DNA, 20 bp, Artificial
  CRISPR gRNA sequence
aaaataacagcttctagact

SEQ ID NO: 490697 - DNA, 20 bp, Artificial
  CRISPR gRNA sequence
aataacagcttctagactaa

SEQ ID NO: 490698 - DNA, 20 bp, Artificial
  CRISPR gRNA sequence
cagcttctagactaagagaa

SEQ ID NO: 490699 - DNA, 20 bp, Artificial
  CRISPR gRNA sequence
cttctagactaagagaacag

SEQ ID NO: 490700 - DNA, 20 bp, Artificial
  CRISPR gRNA sequence
agactaagagaacagtagac

SEQ ID NO: 490701 - DNA, 20 bp, Artificial
  CRISPR gRNA sequence
aagagaacagtagactagat

SEQ ID NO: 490702 - DNA, 20 bp, Artificial
  CRISPR gRNA sequence
cagtagactagatgagtttt

SEQ ID NO: 490703 - DNA, 20 bp, Artificial
  CRISPR gRNA sequence
agtagactagatgagttttt

SEQ ID NO: 490704 - DNA, 20 bp, Artificial
  CRISPR gRNA sequence
tagactagatgagtttttgg

SEQ ID NO: 490705 - DNA, 20 bp, Artificial
  CRISPR gRNA sequence
tgagtttttgggagtttctg

SEQ ID NO: 490706 - DNA, 20 bp, Artificial
  CRISPR gRNA sequence
gagtttttgggagtttctgt

SEQ ID NO: 490707 - DNA, 20 bp, Artificial
  CRISPR gRNA sequence
gtttttgggagtttctgtgg

SEQ ID NO: 490708 - DNA, 20 bp, Artificial
  CRISPR gRNA sequence
tttttgggagtttctgtggg

SEQ ID NO: 490709 - DNA, 20 bp, Artificial
  CRISPR gRNA sequence
gggagtttctgtgggaggta

SEQ ID NO: 490710 - DNA, 20 bp, Artificial
  CRISPR gRNA sequence
ggagtttctgtgggaggtaa

SEQ ID NO: 490711 - DNA, 20 bp, Artificial
  CRISPR gRNA sequence
tttctgtgggaggtaaagga

SEQ ID NO: 490712 - DNA, 20 bp, Artificial
  CRISPR gRNA sequence
tgtgggaggtaaaggacagt

SEQ ID NO: 490713 - DNA, 20 bp, Artificial
  CRISPR gRNA sequence
tgggaggtaaaggacagtca

SEQ ID NO: 490714 - DNA, 20 bp, Artificial
  CRISPR gRNA sequence
aggtaaaggacagtcagaga

SEQ ID NO: 490715 - DNA, 20 bp, Artificial
  CRISPR gRNA sequence
aaaggacagtcagagacaga

SEQ ID NO: 490716 - DNA, 20 bp, Artificial
  CRISPR gRNA sequence
aaggacagtcagagacagaa

SEQ ID NO: 490717 - DNA, 20 bp, Artificial
  CRISPR gRNA sequence
ggacagtcagagacagaaag

SEQ ID NO: 490718 - DNA, 20 bp, Artificial
  CRISPR gRNA sequence
gacagtcagagacagaaagg

SEQ ID NO: 490719 - DNA, 20 bp, Artificial
  CRISPR gRNA sequence
cagaaaggaggtgctttgca

SEQ ID NO: 490720 - DNA, 20 bp, Artificial
  CRISPR gRNA sequence
gaaaggaggtgctttgcaca

SEQ ID NO: 490721 - DNA, 20 bp, Artificial
  CRISPR gRNA sequence
aaggaggtgctttgcacaga

SEQ ID NO: 490722 - DNA, 20 bp, Artificial
  CRISPR gRNA sequence
tgctttgcacagagagacta

SEQ ID NO: 490723 - DNA, 20 bp, Artificial
  CRISPR gRNA sequence
gctttgcacagagagactac

SEQ ID NO: 490724 - DNA, 20 bp, Artificial
  CRISPR gRNA sequence
ctttgcacagagagactacg

SEQ ID NO: 490725 - DNA, 20 bp, Artificial
  CRISPR gRNA sequence
cagagagactacggggtact

SEQ ID NO: 490726 - DNA, 20 bp, Artificial
  CRISPR gRNA sequence
agagactacggggtacttag

SEQ ID NO: 490727 - DNA, 20 bp, Artificial
  CRISPR gRNA sequence
gagactacggggtacttagt

SEQ ID NO: 490728 - DNA, 20 bp, Artificial
  CRISPR gRNA sequence
ctacggggtacttagtaggt

SEQ ID NO: 490729 - DNA, 20 bp, Artificial
  CRISPR gRNA sequence
gggtacttagtaggtcagct

SEQ ID NO: 490730 - DNA, 20 bp, Artificial
  CRISPR gRNA sequence
ggtacttagtaggtcagctg

SEQ ID NO: 490731 - DNA, 20 bp, Artificial
  CRISPR gRNA sequence
tagtaggtcagctgaggcta

SEQ ID NO: 490732 - DNA, 20 bp, Artificial
  CRISPR gRNA sequence
aggtcagctgaggctatggt

SEQ ID NO: 490733 - DNA, 20 bp, Artificial
  CRISPR gRNA sequence
gtcagctgaggctatggtga

SEQ ID NO: 490734 - DNA, 20 bp, Artificial
  CRISPR gRNA sequence
gaggctatggtgagagatac

SEQ ID NO: 490735 - DNA, 20 bp, Artificial
  CRISPR gRNA sequence
ggctatggtgagagatactg

SEQ ID NO: 490736 - DNA, 20 bp, Artificial
  CRISPR gRNA sequence
gctatggtgagagatactgg

SEQ ID NO: 490737 - DNA, 20 bp, Artificial
  CRISPR gRNA sequence
ctatggtgagagatactgga

SEQ ID NO: 490738 - DNA, 20 bp, Artificial
  CRISPR gRNA sequence
tatggtgagagatactggag

SEQ ID NO: 490739 - DNA, 20 bp, Artificial
  CRISPR gRNA sequence
gagatactggaggggtttgc

SEQ ID NO: 490740 - DNA, 20 bp, Artificial
  CRISPR gRNA sequence
agatactggaggggtttgca

SEQ ID NO: 490741 - DNA, 20 bp, Artificial
  CRISPR gRNA sequence
tactggaggggtttgcaagg

SEQ ID NO: 490742 - DNA, 20 bp, Artificial
  CRISPR gRNA sequence
actggaggggtttgcaaggc

SEQ ID NO: 490743 - DNA, 20 bp, Artificial
  CRISPR gRNA sequence
ctggaggggtttgcaaggca

SEQ ID NO: 490744 - DNA, 20 bp, Artificial
  CRISPR gRNA sequence
gcaaggcagggcatattgcc

SEQ ID NO: 490745 - DNA, 20 bp, Artificial
  CRISPR gRNA sequence
aaggcagggcatattgcctg

SEQ ID NO: 490746 - DNA, 20 bp, Artificial
  CRISPR gRNA sequence
cagggcatattgcctggagc

SEQ ID NO: 490747 - DNA, 20 bp, Artificial
  CRISPR gRNA sequence
gggcatattgcctggagctg

SEQ ID NO: 490748 - DNA, 20 bp, Artificial
  CRISPR gRNA sequence
ggcatattgcctggagctgg

SEQ ID NO: 490749 - DNA, 20 bp, Artificial
  CRISPR gRNA sequence
catattgcctggagctggag

SEQ ID NO: 490750 - DNA, 20 bp, Artificial
  CRISPR gRNA sequence
attgcctggagctggaggag

SEQ ID NO: 490751 - DNA, 20 bp, Artificial
  CRISPR gRNA sequence
ctggagctggaggagtagac

SEQ ID NO: 490752 - DNA, 20 bp, Artificial
  CRISPR gRNA sequence
ctggaggagtagactggatc

SEQ ID NO: 490753 - DNA, 20 bp, Artificial
  CRISPR gRNA sequence
ggaggagtagactggatcta

SEQ ID NO: 490754 - DNA, 20 bp, Artificial
  CRISPR gRNA sequence
aggagtagactggatctaga

SEQ ID NO: 490755 - DNA, 20 bp, Artificial
  CRISPR gRNA sequence
agagacacaatcttgacctt

SEQ ID NO: 490756 - DNA, 20 bp, Artificial
  CRISPR gRNA sequence
agacacaatcttgaccttca

SEQ ID NO: 490757 - DNA, 20 bp, Artificial
  CRISPR gRNA sequence
caatcttgaccttcagagac

SEQ ID NO: 490758 - DNA, 20 bp, Artificial
  CRISPR gRNA sequence
atcttgaccttcagagacca

SEQ ID NO: 490759 - DNA, 20 bp, Artificial
  CRISPR gRNA sequence
tgaccttcagagaccagaga

SEQ ID NO: 490760 - DNA, 20 bp, Artificial
  CRISPR gRNA sequence
gaccttcagagaccagagaa

SEQ ID NO: 490761 - DNA, 20 bp, Artificial
  CRISPR gRNA sequence
cagagaccagagaaaggtcc

SEQ ID NO: 490762 - DNA, 20 bp, Artificial
  CRISPR gRNA sequence
gaccagagaaaggtcctggc

SEQ ID NO: 490763 - DNA, 20 bp, Artificial
  CRISPR gRNA sequence
agagaaaggtcctggccagt

SEQ ID NO: 490764 - DNA, 20 bp, Artificial
  CRISPR gRNA sequence
ctggccagtcagtcacctgc

SEQ ID NO: 490765 - DNA, 20 bp, Artificial
  CRISPR gRNA sequence
gccagtcagtcacctgctgg

SEQ ID NO: 490766 - DNA, 20 bp, Artificial
  CRISPR gRNA sequence
cagtcagtcacctgctggtg

SEQ ID NO: 490767 - DNA, 20 bp, Artificial
  CRISPR gRNA sequence
agtcagtcacctgctggtgg

SEQ ID NO: 490768 - DNA, 20 bp, Artificial
  CRISPR gRNA sequence
cacctgctggtggaggcctc

SEQ ID NO: 490769 - DNA, 20 bp, Artificial
  CRISPR gRNA sequence
ctggtggaggcctctggact

SEQ ID NO: 490770 - DNA, 20 bp, Artificial
  CRISPR gRNA sequence
tggtggaggcctctggactg

SEQ ID NO: 490771 - DNA, 20 bp, Artificial
  CRISPR gRNA sequence
ttgcactgaaatccttctcc

SEQ ID NO: 490772 - DNA, 20 bp, Artificial
  CRISPR gRNA sequence
ctgaaatccttctccaagct

SEQ ID NO: 490773 - DNA, 20 bp, Artificial
  CRISPR gRNA sequence
ccttctccaagctgagttcg

SEQ ID NO: 490774 - DNA, 20 bp, Artificial
  CRISPR gRNA sequence
tcgtagctctcttgtgtact

SEQ ID NO: 490775 - DNA, 20 bp, Artificial
  CRISPR gRNA sequence
ctctcttgtgtacttggaaa

SEQ ID NO: 490776 - DNA, 20 bp, Artificial
  CRISPR gRNA sequence
ctcttgtgtacttggaaaca

SEQ ID NO: 490777 - DNA, 20 bp, Artificial
  CRISPR gRNA sequence
tgtgtacttggaaacagagt

SEQ ID NO: 490778 - DNA, 20 bp, Artificial
  CRISPR gRNA sequence
gtgtacttggaaacagagtt

SEQ ID NO: 490779 - DNA, 20 bp, Artificial
  CRISPR gRNA sequence
ggaaacagagttgggtatcc

SEQ ID NO: 490780 - DNA, 20 bp, Artificial
  CRISPR gRNA sequence
gttgggtatcctggtacaca

SEQ ID NO: 490781 - DNA, 20 bp, Artificial
  CRISPR gRNA sequence
gtcattgtttttctcttgta

SEQ ID NO: 490782 - DNA, 20 bp, Artificial
  CRISPR gRNA sequence
attgtttttctcttgtatgg

SEQ ID NO: 490783 - DNA, 20 bp, Artificial
  CRISPR gRNA sequence
ttgtttttctcttgtatgga

SEQ ID NO: 490784 - DNA, 20 bp, Artificial
  CRISPR gRNA sequence
tgtttttctcttgtatggaa

SEQ ID NO: 490785 - DNA, 20 bp, Artificial
  CRISPR gRNA sequence
gtttttctcttgtatggaag

SEQ ID NO: 490786 - DNA, 20 bp, Artificial
  CRISPR gRNA sequence
ttctcttgtatggaagggga

SEQ ID NO: 490787 - DNA, 20 bp, Artificial
  CRISPR gRNA sequence
tctcttgtatggaaggggat

SEQ ID NO: 490788 - DNA, 20 bp, Artificial
  CRISPR gRNA sequence
cttgtatggaaggggatggg

SEQ ID NO: 490789 - DNA, 20 bp, Artificial
  CRISPR gRNA sequence
tgtatggaaggggatgggaa

SEQ ID NO: 490790 - DNA, 20 bp, Artificial
  CRISPR gRNA sequence
atggaaggggatgggaagag

SEQ ID NO: 490791 - DNA, 20 bp, Artificial
  CRISPR gRNA sequence
atgggaagagtggtgttccc

SEQ ID NO: 490792 - DNA, 20 bp, Artificial
  CRISPR gRNA sequence
tgggaagagtggtgttccca

SEQ ID NO: 490793 - DNA, 20 bp, Artificial
  CRISPR gRNA sequence
aagagtggtgttcccaaggc

SEQ ID NO: 490794 - DNA, 20 bp, Artificial
  CRISPR gRNA sequence
gagtggtgttcccaaggctg

SEQ ID NO: 490795 - DNA, 20 bp, Artificial
  CRISPR gRNA sequence
tgttcccaaggctggagcca

SEQ ID NO: 490796 - DNA, 20 bp, Artificial
  CRISPR gRNA sequence
aaggctggagccacagtgtg

SEQ ID NO: 490797 - DNA, 20 bp, Artificial
  CRISPR gRNA sequence
ctggagccacagtgtgaagc

SEQ ID NO: 490798 - DNA, 20 bp, Artificial
  CRISPR gRNA sequence
agccacagtgtgaagccaga

SEQ ID NO: 490799 - DNA, 20 bp, Artificial
  CRISPR gRNA sequence
gaagccagaaagccttaaca

SEQ ID NO: 490800 - DNA, 20 bp, Artificial
  CRISPR gRNA sequence
gccagaaagccttaacatgg

SEQ ID NO: 490801 - DNA, 20 bp, Artificial
  CRISPR gRNA sequence
aaagccttaacatggtagta

SEQ ID NO: 490802 - DNA, 20 bp, Artificial
  CRISPR gRNA sequence
aagccttaacatggtagtat

SEQ ID NO: 490803 - DNA, 20 bp, Artificial
  CRISPR gRNA sequence
aacatggtagtatgggaatt

SEQ ID NO: 490804 - DNA, 20 bp, Artificial
  CRISPR gRNA sequence
acatggtagtatgggaattt

SEQ ID NO: 490805 - DNA, 20 bp, Artificial
  CRISPR gRNA sequence
atggtagtatgggaatttgg

SEQ ID NO: 490806 - DNA, 20 bp, Artificial
  CRISPR gRNA sequence
tttgggagtccacacaactg

SEQ ID NO: 490807 - DNA, 20 bp, Artificial
  CRISPR gRNA sequence
gggagtccacacaactgtgg

SEQ ID NO: 490808 - DNA, 20 bp, Artificial
  CRISPR gRNA sequence
cacaactgtggaagtccatg

SEQ ID NO: 490809 - DNA, 20 bp, Artificial
  CRISPR gRNA sequence
acaactgtggaagtccatgc

SEQ ID NO: 490810 - DNA, 20 bp, Artificial
  CRISPR gRNA sequence
ctgtggaagtccatgcaggt

SEQ ID NO: 490811 - DNA, 20 bp, Artificial
  CRISPR gRNA sequence
tgtggaagtccatgcaggtc

SEQ ID NO: 490812 - DNA, 20 bp, Artificial
  CRISPR gRNA sequence
gtggaagtccatgcaggtca

SEQ ID NO: 490813 - DNA, 20 bp, Artificial
  CRISPR gRNA sequence
tccatgcaggtcagggacca

SEQ ID NO: 490814 - DNA, 20 bp, Artificial
  CRISPR gRNA sequence
ccatgcaggtcagggaccac

SEQ ID NO: 490815 - DNA, 20 bp, Artificial
  CRISPR gRNA sequence
ggtcagggaccacaggtttg

SEQ ID NO: 490816 - DNA, 20 bp, Artificial
  CRISPR gRNA sequence
gtcagggaccacaggtttga

SEQ ID NO: 490817 - DNA, 20 bp, Artificial
  CRISPR gRNA sequence
tcagggaccacaggtttgaa

SEQ ID NO: 490818 - DNA, 20 bp, Artificial
  CRISPR gRNA sequence
cagggaccacaggtttgaag

SEQ ID NO: 490819 - DNA, 20 bp, Artificial
  CRISPR gRNA sequence
accacaggtttgaaggggtt

SEQ ID NO: 490820 - DNA, 20 bp, Artificial
  CRISPR gRNA sequence
ccacaggtttgaaggggttt

SEQ ID NO: 490821 - DNA, 20 bp, Artificial
  CRISPR gRNA sequence
aggtttgaaggggtttagga

SEQ ID NO: 490822 - DNA, 20 bp, Artificial
  CRISPR gRNA sequence
aggggtttaggacagatttt

SEQ ID NO: 490823 - DNA, 20 bp, Artificial
  CRISPR gRNA sequence
tcattcaacctccttccaat

SEQ ID NO: 490824 - DNA, 20 bp, Artificial
  CRISPR gRNA sequence
aataagccattcaacctact

SEQ ID NO: 490825 - DNA, 20 bp, Artificial
  CRISPR gRNA sequence
acctacttggatcccatcgt

SEQ ID NO: 490826 - DNA, 20 bp, Artificial
  CRISPR gRNA sequence
ctacttggatcccatcgtga

SEQ ID NO: 490827 - DNA, 20 bp, Artificial
  CRISPR gRNA sequence
acttggatcccatcgtgaga

SEQ ID NO: 490828 - DNA, 20 bp, Artificial
  CRISPR gRNA sequence
ttaattatatgctacaatat

SEQ ID NO: 490829 - DNA, 20 bp, Artificial
  CRISPR gRNA sequence
taattatatgctacaatata

SEQ ID NO: 490830 - DNA, 20 bp, Artificial
  CRISPR gRNA sequence
tgctacaatataaggccata

SEQ ID NO: 490831 - DNA, 20 bp, Artificial
  CRISPR gRNA sequence
taaggccatatagatgttca

SEQ ID NO: 490832 - DNA, 20 bp, Artificial
  CRISPR gRNA sequence
aaggccatatagatgttcac

SEQ ID NO: 490833 - DNA, 20 bp, Artificial
  CRISPR gRNA sequence
ggcaccatgttcacctgctt

SEQ ID NO: 490834 - DNA, 20 bp, Artificial
  CRISPR gRNA sequence
ctgaatgtgcctctgaattc

SEQ ID NO: 490835 - DNA, 20 bp, Artificial
  CRISPR gRNA sequence
cctctgaattctagtgtcct

SEQ ID NO: 490836 - DNA, 20 bp, Artificial
  CRISPR gRNA sequence
ctctgaattctagtgtcctt

SEQ ID NO: 490837 - DNA, 20 bp, Artificial
  CRISPR gRNA sequence
gaattctagtgtccttgggt

SEQ ID NO: 490838 - DNA, 20 bp, Artificial
  CRISPR gRNA sequence
ttggcaattatttatatgcc

SEQ ID NO: 490839 - DNA, 20 bp, Artificial
  CRISPR gRNA sequence
atgcctggattgtttacatt

SEQ ID NO: 490840 - DNA, 20 bp, Artificial
  CRISPR gRNA sequence
tgcctggattgtttacatta

SEQ ID NO: 490841 - DNA, 20 bp, Artificial
  CRISPR gRNA sequence
gcctggattgtttacattaa

SEQ ID NO: 490842 - DNA, 20 bp, Artificial
  CRISPR gRNA sequence
gtgtgtgtatgcatgcgttg

SEQ ID NO: 490843 - DNA, 20 bp, Artificial
  CRISPR gRNA sequence
gtgtgtatgcatgcgttgaa

SEQ ID NO: 490844 - DNA, 20 bp, Artificial
  CRISPR gRNA sequence
gcatgcgttgaagagataca

SEQ ID NO: 490845 - DNA, 20 bp, Artificial
  CRISPR gRNA sequence
cgttgaagagatacatggtt

SEQ ID NO: 490846 - DNA, 20 bp, Artificial
  CRISPR gRNA sequence
gttgaagagatacatggttt

SEQ ID NO: 490847 - DNA, 20 bp, Artificial
  CRISPR gRNA sequence
ttgaagagatacatggtttg

SEQ ID NO: 490848 - DNA, 20 bp, Artificial
  CRISPR gRNA sequence
aagagatacatggtttgggg

SEQ ID NO: 490849 - DNA, 20 bp, Artificial
  CRISPR gRNA sequence
gtttggggcagtatttgcat

SEQ ID NO: 490850 - DNA, 20 bp, Artificial
  CRISPR gRNA sequence
tttggggcagtatttgcatt

SEQ ID NO: 490851 - DNA, 20 bp, Artificial
  CRISPR gRNA sequence
tatttgcattaggattgcct

SEQ ID NO: 490852 - DNA, 20 bp, Artificial
  CRISPR gRNA sequence
atttgcattaggattgcctg

SEQ ID NO: 490853 - DNA, 20 bp, Artificial
  CRISPR gRNA sequence
tttgcattaggattgcctga

SEQ ID NO: 490854 - DNA, 20 bp, Artificial
  CRISPR gRNA sequence
atgtgtatgtgtgtgtgctc

SEQ ID NO: 490855 - DNA, 20 bp, Artificial
  CRISPR gRNA sequence
tgtgtatgtgtgtgtgctct

SEQ ID NO: 490856 - DNA, 20 bp, Artificial
  CRISPR gRNA sequence
cacacacacacatatgtgta

SEQ ID NO: 490857 - DNA, 20 bp, Artificial
  CRISPR gRNA sequence
acacacacacatatgtgtat

SEQ ID NO: 490858 - DNA, 20 bp, Artificial
  CRISPR gRNA sequence
acacatatgtgtatgggttt

SEQ ID NO: 490859 - DNA, 20 bp, Artificial
  CRISPR gRNA sequence
cacatatgtgtatgggtttt

SEQ ID NO: 490860 - DNA, 20 bp, Artificial
  CRISPR gRNA sequence
gtatgggttttaggtgtatg

SEQ ID NO: 490861 - DNA, 20 bp, Artificial
  CRISPR gRNA sequence
tatgggttttaggtgtatgt

SEQ ID NO: 490862 - DNA, 20 bp, Artificial
  CRISPR gRNA sequence
gttttaggtgtatgtgggta

SEQ ID NO: 490863 - DNA, 20 bp, Artificial
  CRISPR gRNA sequence
aggtgtatgtgggtatggaa

SEQ ID NO: 490864 - DNA, 20 bp, Artificial
  CRISPR gRNA sequence
ggaacagcaaattctgattt

SEQ ID NO: 490865 - DNA, 20 bp, Artificial
  CRISPR gRNA sequence
agcaaattctgattttggtt

SEQ ID NO: 490866 - DNA, 20 bp, Artificial
  CRISPR gRNA sequence
ggttcagaaatatcatatta

SEQ ID NO: 490867 - DNA, 20 bp, Artificial
  CRISPR gRNA sequence
gttcagaaatatcatattat

SEQ ID NO: 490868 - DNA, 20 bp, Artificial
  CRISPR gRNA sequence
tgtatatattgtgtcttccc

SEQ ID NO: 490869 - DNA, 20 bp, Artificial
  CRISPR gRNA sequence
tatatattgtgtcttccctg

SEQ ID NO: 490870 - DNA, 20 bp, Artificial
  CRISPR gRNA sequence
aaacaccattgttttgctcc

SEQ ID NO: 490871 - DNA, 20 bp, Artificial
  CRISPR gRNA sequence
aacaccattgttttgctcct

SEQ ID NO: 490872 - DNA, 20 bp, Artificial
  CRISPR gRNA sequence
acaccattgttttgctccta

SEQ ID NO: 490873 - DNA, 20 bp, Artificial
  CRISPR gRNA sequence
ttgttttgctcctagggtga

SEQ ID NO: 490874 - DNA, 20 bp, Artificial
  CRISPR gRNA sequence
gacagattctattcattttc

SEQ ID NO: 490875 - DNA, 20 bp, Artificial
  CRISPR gRNA sequence
attctattcattttctggct

SEQ ID NO: 490876 - DNA, 20 bp, Artificial
  CRISPR gRNA sequence
tctattcattttctggctga

SEQ ID NO: 490877 - DNA, 20 bp, Artificial
  CRISPR gRNA sequence
ttttctggctgagagtgcct

SEQ ID NO: 490878 - DNA, 20 bp, Artificial
  CRISPR gRNA sequence
agagtgcctcagaatttttc

SEQ ID NO: 490879 - DNA, 20 bp, Artificial
  CRISPR gRNA sequence
gagtgcctcagaatttttct

SEQ ID NO: 490880 - DNA, 20 bp, Artificial
  CRISPR gRNA sequence
tcagaatttttctgggccct

SEQ ID NO: 490881 - DNA, 20 bp, Artificial
  CRISPR gRNA sequence
tctgggccctgagtctcttt

SEQ ID NO: 490882 - DNA, 20 bp, Artificial
  CRISPR gRNA sequence
ctgggccctgagtctctttt

SEQ ID NO: 490883 - DNA, 20 bp, Artificial
  CRISPR gRNA sequence
ttgggacctctcacatcact

SEQ ID NO: 490884 - DNA, 20 bp, Artificial
  CRISPR gRNA sequence
tgggacctctcacatcactt

SEQ ID NO: 490885 - DNA, 20 bp, Artificial
  CRISPR gRNA sequence
ggacctctcacatcacttag

SEQ ID NO: 490886 - DNA, 20 bp, Artificial
  CRISPR gRNA sequence
cctctcacatcacttaggag

SEQ ID NO: 490887 - DNA, 20 bp, Artificial
  CRISPR gRNA sequence
ctctcacatcacttaggagt

SEQ ID NO: 490888 - DNA, 20 bp, Artificial
  CRISPR gRNA sequence
ctcacatcacttaggagtgg

SEQ ID NO: 490889 - DNA, 20 bp, Artificial
  CRISPR gRNA sequence
cacatcacttaggagtggga

SEQ ID NO: 490890 - DNA, 20 bp, Artificial
  CRISPR gRNA sequence
gtgggagagcacttatctcg

SEQ ID NO: 490891 - DNA, 20 bp, Artificial
  CRISPR gRNA sequence
agagcacttatctcgaagtt

SEQ ID NO: 490892 - DNA, 20 bp, Artificial
  CRISPR gRNA sequence
ttctttaccttctgaatttc

SEQ ID NO: 490893 - DNA, 20 bp, Artificial
  CRISPR gRNA sequence
taccttctgaatttctagtc

SEQ ID NO: 490894 - DNA, 20 bp, Artificial
  CRISPR gRNA sequence
ctgaatttctagtctggatc

SEQ ID NO: 490895 - DNA, 20 bp, Artificial
  CRISPR gRNA sequence
tgaatttctagtctggatcc

SEQ ID NO: 490896 - DNA, 20 bp, Artificial
  CRISPR gRNA sequence
atttctagtctggatccagg

SEQ ID NO: 490897 - DNA, 20 bp, Artificial
  CRISPR gRNA sequence
ttctagtctggatccaggaa

SEQ ID NO: 490898 - DNA, 20 bp, Artificial
  CRISPR gRNA sequence
tctagtctggatccaggaag

SEQ ID NO: 490899 - DNA, 20 bp, Artificial
  CRISPR gRNA sequence
ggatccaggaagaggaacca

SEQ ID NO: 490900 - DNA, 20 bp, Artificial
  CRISPR gRNA sequence
aaccacagcccttccttcaa

SEQ ID NO: 490901 - DNA, 20 bp, Artificial
  CRISPR gRNA sequence
cttcaatagcactatctatg

SEQ ID NO: 490902 - DNA, 20 bp, Artificial
  CRISPR gRNA sequence
caatagcactatctatgaag

SEQ ID NO: 490903 - DNA, 20 bp, Artificial
  CRISPR gRNA sequence
agcactatctatgaagtggt

SEQ ID NO: 490904 - DNA, 20 bp, Artificial
  CRISPR gRNA sequence
tctatgaagtggtaagattc

SEQ ID NO: 490905 - DNA, 20 bp, Artificial
  CRISPR gRNA sequence
aagattctggaactcctcaa

SEQ ID NO: 490906 - DNA, 20 bp, Artificial
  CRISPR gRNA sequence
agattctggaactcctcaat

SEQ ID NO: 490907 - DNA, 20 bp, Artificial
  CRISPR gRNA sequence
tgggtttactgtctgttgca

SEQ ID NO: 490908 - DNA, 20 bp, Artificial
  CRISPR gRNA sequence
tgttgcatagccctgaaatc

SEQ ID NO: 490909 - DNA, 20 bp, Artificial
  CRISPR gRNA sequence
gccctgaaatctagccatga

SEQ ID NO: 490910 - DNA, 20 bp, Artificial
  CRISPR gRNA sequence
ccctgaaatctagccatgaa

SEQ ID NO: 490911 - DNA, 20 bp, Artificial
  CRISPR gRNA sequence
cctgaaatctagccatgaaa

SEQ ID NO: 490912 - DNA, 20 bp, Artificial
  CRISPR gRNA sequence
tagccatgaaagggtacact

SEQ ID NO: 490913 - DNA, 20 bp, Artificial
  CRISPR gRNA sequence
agccatgaaagggtacactt

SEQ ID NO: 490914 - DNA, 20 bp, Artificial
  CRISPR gRNA sequence
tgaaagggtacacttaggaa

SEQ ID NO: 490915 - DNA, 20 bp, Artificial
  CRISPR gRNA sequence
ttaggaaaagatcattcaca

SEQ ID NO: 490916 - DNA, 20 bp, Artificial
  CRISPR gRNA sequence
aaagatcattcacacagtct

SEQ ID NO: 490917 - DNA, 20 bp, Artificial
  CRISPR gRNA sequence
agatcattcacacagtctca

SEQ ID NO: 490918 - DNA, 20 bp, Artificial
  CRISPR gRNA sequence
ttcacacagtctcagagttg

SEQ ID NO: 490919 - DNA, 20 bp, Artificial
  CRISPR gRNA sequence
tcacacagtctcagagttgt

SEQ ID NO: 490920 - DNA, 20 bp, Artificial
  CRISPR gRNA sequence
cacacagtctcagagttgta

SEQ ID NO: 490921 - DNA, 20 bp, Artificial
  CRISPR gRNA sequence
tctcagagttgtagggaatt

SEQ ID NO: 490922 - DNA, 20 bp, Artificial
  CRISPR gRNA sequence
tcagagttgtagggaattta

SEQ ID NO: 490923 - DNA, 20 bp, Artificial
  CRISPR gRNA sequence
atttagagatcttctaatgc

SEQ ID NO: 490924 - DNA, 20 bp, Artificial
  CRISPR gRNA sequence
tctaatgcaagtctttgttt

SEQ ID NO: 490925 - DNA, 20 bp, Artificial
  CRISPR gRNA sequence
taatgcaagtctttgtttta

SEQ ID NO: 490926 - DNA, 20 bp, Artificial
  CRISPR gRNA sequence
aagtctttgttttagagatg

SEQ ID NO: 490927 - DNA, 20 bp, Artificial
  CRISPR gRNA sequence
ttttagagatgaagacactg

SEQ ID NO: 490928 - DNA, 20 bp, Artificial
  CRISPR gRNA sequence
agatgaagacactgaagccc

SEQ ID NO: 490929 - DNA, 20 bp, Artificial
  CRISPR gRNA sequence
gatgaagacactgaagccca

SEQ ID NO: 490930 - DNA, 20 bp, Artificial
  CRISPR gRNA sequence
tgaagacactgaagcccaag

SEQ ID NO: 490931 - DNA, 20 bp, Artificial
  CRISPR gRNA sequence
aagacactgaagcccaagga

SEQ ID NO: 490932 - DNA, 20 bp, Artificial
  CRISPR gRNA sequence
cactgaagcccaaggagagt

SEQ ID NO: 490933 - DNA, 20 bp, Artificial
  CRISPR gRNA sequence
actgaagcccaaggagagtg

SEQ ID NO: 490934 - DNA, 20 bp, Artificial
  CRISPR gRNA sequence
ctgaagcccaaggagagtga

SEQ ID NO: 490935 - DNA, 20 bp, Artificial
  CRISPR gRNA sequence
ggagagtgagggtctgaccc

SEQ ID NO: 490936 - DNA, 20 bp, Artificial
  CRISPR gRNA sequence
ccaagatcatattgcgtgtt

SEQ ID NO: 490937 - DNA, 20 bp, Artificial
  CRISPR gRNA sequence
tgtttagatatgatacttac

SEQ ID NO: 490938 - DNA, 20 bp, Artificial
  CRISPR gRNA sequence
gtttagatatgatacttact

SEQ ID NO: 490939 - DNA, 20 bp, Artificial
  CRISPR gRNA sequence
tagatatgatacttactggg

SEQ ID NO: 490940 - DNA, 20 bp, Artificial
  CRISPR gRNA sequence
atgatacttactgggcagct

SEQ ID NO: 490941 - DNA, 20 bp, Artificial
  CRISPR gRNA sequence
tgatacttactgggcagctt

SEQ ID NO: 490942 - DNA, 20 bp, Artificial
  CRISPR gRNA sequence
gggcagcttgggttttaaat

SEQ ID NO: 490943 - DNA, 20 bp, Artificial
  CRISPR gRNA sequence
ggcagcttgggttttaaatt

SEQ ID NO: 490944 - DNA, 20 bp, Artificial
  CRISPR gRNA sequence
gcagcttgggttttaaatta

SEQ ID NO: 490945 - DNA, 20 bp, Artificial
  CRISPR gRNA sequence
tttaaattagggccgtcccc

SEQ ID NO: 490946 - DNA, 20 bp, Artificial
  CRISPR gRNA sequence
aattagggccgtccccgagc

SEQ ID NO: 490947 - DNA, 20 bp, Artificial
  CRISPR gRNA sequence
gccgtccccgagctagttcc

SEQ ID NO: 490948 - DNA, 20 bp, Artificial
  CRISPR gRNA sequence
ccgtccccgagctagttccc

SEQ ID NO: 490949 - DNA, 20 bp, Artificial
  CRISPR gRNA sequence
ccgagctagttcccaggctg

SEQ ID NO: 490950 - DNA, 20 bp, Artificial
  CRISPR gRNA sequence
cgagctagttcccaggctgt

SEQ ID NO: 490951 - DNA, 20 bp, Artificial
  CRISPR gRNA sequence
ccaggctgtgggccacaaac

SEQ ID NO: 490952 - DNA, 20 bp, Artificial
  CRISPR gRNA sequence
actggacatctctcctttcc

SEQ ID NO: 490953 - DNA, 20 bp, Artificial
  CRISPR gRNA sequence
tggacatctctcctttccaa

SEQ ID NO: 490954 - DNA, 20 bp, Artificial
  CRISPR gRNA sequence
ctctcctttccaagagtgtt

SEQ ID NO: 490955 - DNA, 20 bp, Artificial
  CRISPR gRNA sequence
ctcctttccaagagtgttcg

SEQ ID NO: 490956 - DNA, 20 bp, Artificial
  CRISPR gRNA sequence
tcctttccaagagtgttcgg

SEQ ID NO: 490957 - DNA, 20 bp, Artificial
  CRISPR gRNA sequence
ctttccaagagtgttcggag

SEQ ID NO: 490958 - DNA, 20 bp, Artificial
  CRISPR gRNA sequence
tttccaagagtgttcggagg

SEQ ID NO: 490959 - DNA, 20 bp, Artificial
  CRISPR gRNA sequence
ttccaagagtgttcggagga

SEQ ID NO: 490960 - DNA, 20 bp, Artificial
  CRISPR gRNA sequence
tccaagagtgttcggaggag

SEQ ID NO: 490961 - DNA, 20 bp, Artificial
  CRISPR gRNA sequence
agagtgttcggaggaggggt

SEQ ID NO: 490962 - DNA, 20 bp, Artificial
  CRISPR gRNA sequence
agtgttcggaggaggggtca

SEQ ID NO: 490963 - DNA, 20 bp, Artificial
  CRISPR gRNA sequence
tgttcggaggaggggtcaga

SEQ ID NO: 490964 - DNA, 20 bp, Artificial
  CRISPR gRNA sequence
gttcggaggaggggtcagag

SEQ ID NO: 490965 - DNA, 20 bp, Artificial
  CRISPR gRNA sequence
ttcggaggaggggtcagaga

SEQ ID NO: 490966 - DNA, 20 bp, Artificial
  CRISPR gRNA sequence
tcggaggaggggtcagagag

SEQ ID NO: 490967 - DNA, 20 bp, Artificial
  CRISPR gRNA sequence
gaggaggggtcagagagggg

SEQ ID NO: 490968 - DNA, 20 bp, Artificial
  CRISPR gRNA sequence
gggtcagagaggggaagata

SEQ ID NO: 490969 - DNA, 20 bp, Artificial
  CRISPR gRNA sequence
ggtcagagaggggaagataa

SEQ ID NO: 490970 - DNA, 20 bp, Artificial
  CRISPR gRNA sequence
tctaaatgattttctaaaat

SEQ ID NO: 490971 - DNA, 20 bp, Artificial
  CRISPR gRNA sequence
aatgattttctaaaattagc

SEQ ID NO: 490972 - DNA, 20 bp, Artificial
  CRISPR gRNA sequence
ttctaaaattagcaagtctt

SEQ ID NO: 490973 - DNA, 20 bp, Artificial
  CRISPR gRNA sequence
tctaaaattagcaagtcttt

SEQ ID NO: 490974 - DNA, 20 bp, Artificial
  CRISPR gRNA sequence
taaaattagcaagtctttgg

SEQ ID NO: 490975 - DNA, 20 bp, Artificial
  CRISPR gRNA sequence
caagtctttgggagccattc

SEQ ID NO: 490976 - DNA, 20 bp, Artificial
  CRISPR gRNA sequence
aagtctttgggagccattcc

SEQ ID NO: 490977 - DNA, 20 bp, Artificial
  CRISPR gRNA sequence
ttgggagccattccaggaca

SEQ ID NO: 490978 - DNA, 20 bp, Artificial
  CRISPR gRNA sequence
tgggagccattccaggacat

SEQ ID NO: 490979 - DNA, 20 bp, Artificial
  CRISPR gRNA sequence
agccattccaggacataggt

SEQ ID NO: 490980 - DNA, 20 bp, Artificial
  CRISPR gRNA sequence
taggtgagcttaatcttctt

SEQ ID NO: 490981 - DNA, 20 bp, Artificial
  CRISPR gRNA sequence
aggtgagcttaatcttcttc

SEQ ID NO: 490982 - DNA, 20 bp, Artificial
  CRISPR gRNA sequence
ggtgagcttaatcttcttca

SEQ ID NO: 490983 - DNA, 20 bp, Artificial
  CRISPR gRNA sequence
gtgagcttaatcttcttcag

SEQ ID NO: 490984 - DNA, 20 bp, Artificial
  CRISPR gRNA sequence
cttcaggggtcaacactgtt

SEQ ID NO: 490985 - DNA, 20 bp, Artificial
  CRISPR gRNA sequence
tcaggggtcaacactgttca

SEQ ID NO: 490986 - DNA, 20 bp, Artificial
  CRISPR gRNA sequence
actgttcagagatgaccact

SEQ ID NO: 490987 - DNA, 20 bp, Artificial
  CRISPR gRNA sequence
tcagagatgaccactgagcc

SEQ ID NO: 490988 - DNA, 20 bp, Artificial
  CRISPR gRNA sequence
gagatgaccactgagcctgg

SEQ ID NO: 490989 - DNA, 20 bp, Artificial
  CRISPR gRNA sequence
gtggttgaattgattcccat

SEQ ID NO: 490990 - DNA, 20 bp, Artificial
  CRISPR gRNA sequence
ggttgaattgattcccatca

SEQ ID NO: 490991 - DNA, 20 bp, Artificial
  CRISPR gRNA sequence
ttgattcccatcagagcatt

SEQ ID NO: 490992 - DNA, 20 bp, Artificial
  CRISPR gRNA sequence
tgattcccatcagagcattt

SEQ ID NO: 490993 - DNA, 20 bp, Artificial
  CRISPR gRNA sequence
gattcccatcagagcattta

SEQ ID NO: 490994 - DNA, 20 bp, Artificial
  CRISPR gRNA sequence
ccatcagagcatttagggac

SEQ ID NO: 490995 - DNA, 20 bp, Artificial
  CRISPR gRNA sequence
cagagcatttagggactgga

SEQ ID NO: 490996 - DNA, 20 bp, Artificial
  CRISPR gRNA sequence
agagcatttagggactggaa

SEQ ID NO: 490997 - DNA, 20 bp, Artificial
  CRISPR gRNA sequence
agcatttagggactggaaag

SEQ ID NO: 490998 - DNA, 20 bp, Artificial
  CRISPR gRNA sequence
gcatttagggactggaaagg

SEQ ID NO: 490999 - DNA, 20 bp, Artificial
  CRISPR gRNA sequence
catttagggactggaaagga

SEQ ID NO: 491000 - DNA, 20 bp, Artificial
  CRISPR gRNA sequence
aggagggactcaacatttct

SEQ ID NO: 491001 - DNA, 20 bp, Artificial
  CRISPR gRNA sequence
ggagggactcaacatttctt

SEQ ID NO: 491002 - DNA, 20 bp, Artificial
  CRISPR gRNA sequence
gagggactcaacatttcttg

SEQ ID NO: 491003 - DNA, 20 bp, Artificial
  CRISPR gRNA sequence
agggactcaacatttcttgg

SEQ ID NO: 491004 - DNA, 20 bp, Artificial
  CRISPR gRNA sequence
catttcttgggggtttatta

SEQ ID NO: 491005 - DNA, 20 bp, Artificial
  CRISPR gRNA sequence
cttgggggtttattatggat

SEQ ID NO: 491006 - DNA, 20 bp, Artificial
  CRISPR gRNA sequence
ttgggggtttattatggata

SEQ ID NO: 491007 - DNA, 20 bp, Artificial
  CRISPR gRNA sequence
ggggtttattatggataagg

SEQ ID NO: 491008 - DNA, 20 bp, Artificial
  CRISPR gRNA sequence
ttatggataaggtagcctgc

SEQ ID NO: 491009 - DNA, 20 bp, Artificial
  CRISPR gRNA sequence
agcctgccagtgtcttcaca

SEQ ID NO: 491010 - DNA, 20 bp, Artificial
  CRISPR gRNA sequence
ttcacatggattattttatt

SEQ ID NO: 491011 - DNA, 20 bp, Artificial
  CRISPR gRNA sequence
attattttatttagtcctca

SEQ ID NO: 491012 - DNA, 20 bp, Artificial
  CRISPR gRNA sequence
tagtcctcacagaatgctac

SEQ ID NO: 491013 - DNA, 20 bp, Artificial
  CRISPR gRNA sequence
cctcacagaatgctacaaga

SEQ ID NO: 491014 - DNA, 20 bp, Artificial
  CRISPR gRNA sequence
ctcacagaatgctacaagat

SEQ ID NO: 491015 - DNA, 20 bp, Artificial
  CRISPR gRNA sequence
ttatactttccatttatact

SEQ ID NO: 491016 - DNA, 20 bp, Artificial
  CRISPR gRNA sequence
atactttccatttatactca

SEQ ID NO: 491017 - DNA, 20 bp, Artificial
  CRISPR gRNA sequence
catttatactcagagaaatt

SEQ ID NO: 491018 - DNA, 20 bp, Artificial
  CRISPR gRNA sequence
atttatactcagagaaatta

SEQ ID NO: 491019 - DNA, 20 bp, Artificial
  CRISPR gRNA sequence
tactcagagaaattaaggca

SEQ ID NO: 491020 - DNA, 20 bp, Artificial
  CRISPR gRNA sequence
ctcagagaaattaaggcatg

SEQ ID NO: 491021 - DNA, 20 bp, Artificial
  CRISPR gRNA sequence
cagagaaattaaggcatgga

SEQ ID NO: 491022 - DNA, 20 bp, Artificial
  CRISPR gRNA sequence
caacctcccccactacccat

SEQ ID NO: 491023 - DNA, 20 bp, Artificial
  CRISPR gRNA sequence
attagcctcatactacacct

SEQ ID NO: 491024 - DNA, 20 bp, Artificial
  CRISPR gRNA sequence
cacctgagcctccccacctg

SEQ ID NO: 491025 - DNA, 20 bp, Artificial
  CRISPR gRNA sequence
tccccacctgtggtccaata

SEQ ID NO: 491026 - DNA, 20 bp, Artificial
  CRISPR gRNA sequence
tccaataaagatgctgccat

SEQ ID NO: 491027 - DNA, 20 bp, Artificial
  CRISPR gRNA sequence
ataaagatgctgccattggt

SEQ ID NO: 491028 - DNA, 20 bp, Artificial
  CRISPR gRNA sequence
aagatgctgccattggtcag

SEQ ID NO: 491029 - DNA, 20 bp, Artificial
  CRISPR gRNA sequence
agatgctgccattggtcaga

SEQ ID NO: 491030 - DNA, 20 bp, Artificial
  CRISPR gRNA sequence
gatgctgccattggtcagaa

SEQ ID NO: 491031 - DNA, 20 bp, Artificial
  CRISPR gRNA sequence
tgctgccattggtcagaagg

SEQ ID NO: 491032 - DNA, 20 bp, Artificial
  CRISPR gRNA sequence
gctgccattggtcagaaggg

SEQ ID NO: 491033 - DNA, 20 bp, Artificial
  CRISPR gRNA sequence
ctgccattggtcagaaggga

SEQ ID NO: 491034 - DNA, 20 bp, Artificial
  CRISPR gRNA sequence
cattggtcagaagggaggga

SEQ ID NO: 491035 - DNA, 20 bp, Artificial
  CRISPR gRNA sequence
attggtcagaagggagggat

SEQ ID NO: 491036 - DNA, 20 bp, Artificial
  CRISPR gRNA sequence
ggtcagaagggagggatggg

SEQ ID NO: 491037 - DNA, 20 bp, Artificial
  CRISPR gRNA sequence
agggatgggtggctgcctgc

SEQ ID NO: 491038 - DNA, 20 bp, Artificial
  CRISPR gRNA sequence
tggctgcctgctggaattcc

SEQ ID NO: 491039 - DNA, 20 bp, Artificial
  CRISPR gRNA sequence
tgctggaattcctggcactt

SEQ ID NO: 491040 - DNA, 20 bp, Artificial
  CRISPR gRNA sequence
tcagctatcacccaacatta

SEQ ID NO: 491041 - DNA, 20 bp, Artificial
  CRISPR gRNA sequence
cacccaacattaaagccaac

SEQ ID NO: 491042 - DNA, 20 bp, Artificial
  CRISPR gRNA sequence
ttaaagccaactggacaacc

SEQ ID NO: 491043 - DNA, 20 bp, Artificial
  CRISPR gRNA sequence
taaagccaactggacaaccc

SEQ ID NO: 491044 - DNA, 20 bp, Artificial
  CRISPR gRNA sequence
aaagccaactggacaaccca

SEQ ID NO: 491045 - DNA, 20 bp, Artificial
  CRISPR gRNA sequence
aactggacaacccagggtca

SEQ ID NO: 491046 - DNA, 20 bp, Artificial
  CRISPR gRNA sequence
ctggacaacccagggtcata

SEQ ID NO: 491047 - DNA, 20 bp, Artificial
  CRISPR gRNA sequence
tggacaacccagggtcatag

SEQ ID NO: 491048 - DNA, 20 bp, Artificial
  CRISPR gRNA sequence
ggacaacccagggtcataga

SEQ ID NO: 491049 - DNA, 20 bp, Artificial
  CRISPR gRNA sequence
gggtcatagagggcactgtg

SEQ ID NO: 491050 - DNA, 20 bp, Artificial
  CRISPR gRNA sequence
tagagggcactgtgtagacc

SEQ ID NO: 491051 - DNA, 20 bp, Artificial
  CRISPR gRNA sequence
agagggcactgtgtagaccc

SEQ ID NO: 491052 - DNA, 20 bp, Artificial
  CRISPR gRNA sequence
gggcactgtgtagacccagg

SEQ ID NO: 491053 - DNA, 20 bp, Artificial
  CRISPR gRNA sequence
tgtagacccaggtagcttgt

SEQ ID NO: 491054 - DNA, 20 bp, Artificial
  CRISPR gRNA sequence
gtagacccaggtagcttgtg

SEQ ID NO: 491055 - DNA, 20 bp, Artificial
  CRISPR gRNA sequence
tagcttgtgaggtcatgaaa

SEQ ID NO: 491056 - DNA, 20 bp, Artificial
  CRISPR gRNA sequence
aggtcatgaaaaagcatatg

SEQ ID NO: 491057 - DNA, 20 bp, Artificial
  CRISPR gRNA sequence
atgaaaaagcatatgtggtt

SEQ ID NO: 491058 - DNA, 20 bp, Artificial
  CRISPR gRNA sequence
gaaaaagcatatgtggttaa

SEQ ID NO: 491059 - DNA, 20 bp, Artificial
  CRISPR gRNA sequence
aaaagcatatgtggttaaga

SEQ ID NO: 491060 - DNA, 20 bp, Artificial
  CRISPR gRNA sequence
atatgtggttaagagagtac

SEQ ID NO: 491061 - DNA, 20 bp, Artificial
  CRISPR gRNA sequence
ggttaagagagtactggaat

SEQ ID NO: 491062 - DNA, 20 bp, Artificial
  CRISPR gRNA sequence
ttaagagagtactggaattg

SEQ ID NO: 491063 - DNA, 20 bp, Artificial
  CRISPR gRNA sequence
gagagtactggaattggagc

SEQ ID NO: 491064 - DNA, 20 bp, Artificial
  CRISPR gRNA sequence
agtactggaattggagccag

SEQ ID NO: 491065 - DNA, 20 bp, Artificial
  CRISPR gRNA sequence
ggaattggagccagaagaac

SEQ ID NO: 491066 - DNA, 20 bp, Artificial
  CRISPR gRNA sequence
gagccagaagaactagattc

SEQ ID NO: 491067 - DNA, 20 bp, Artificial
  CRISPR gRNA sequence
gtccctcctgcacttcacac

SEQ ID NO: 491068 - DNA, 20 bp, Artificial
  CRISPR gRNA sequence
cctgcacttcacactagtcg

SEQ ID NO: 491069 - DNA, 20 bp, Artificial
  CRISPR gRNA sequence
tcacactagtcgtggatcct

SEQ ID NO: 491070 - DNA, 20 bp, Artificial
  CRISPR gRNA sequence
gtaatttgttttgtcactct

SEQ ID NO: 491071 - DNA, 20 bp, Artificial
  CRISPR gRNA sequence
cattttttaaatctgtaaaa

SEQ ID NO: 491072 - DNA, 20 bp, Artificial
  CRISPR gRNA sequence
attttttaaatctgtaaaat

SEQ ID NO: 491073 - DNA, 20 bp, Artificial
  CRISPR gRNA sequence
ttttttaaatctgtaaaatg

SEQ ID NO: 491074 - DNA, 20 bp, Artificial
  CRISPR gRNA sequence
ttaaatctgtaaaatgggga

SEQ ID NO: 491075 - DNA, 20 bp, Artificial
  CRISPR gRNA sequence
atctgtaaaatggggatggc

SEQ ID NO: 491076 - DNA, 20 bp, Artificial
  CRISPR gRNA sequence
ggatggcaagtcatacctca

SEQ ID NO: 491077 - DNA, 20 bp, Artificial
  CRISPR gRNA sequence
gatggcaagtcatacctcac

SEQ ID NO: 491078 - DNA, 20 bp, Artificial
  CRISPR gRNA sequence
atacctcacaggattgtgat

SEQ ID NO: 491079 - DNA, 20 bp, Artificial
  CRISPR gRNA sequence
tacctcacaggattgtgata

SEQ ID NO: 491080 - DNA, 20 bp, Artificial
  CRISPR gRNA sequence
ggattgtgataaggacctcc

SEQ ID NO: 491081 - DNA, 20 bp, Artificial
  CRISPR gRNA sequence
tgataaggacctcccagtgc

SEQ ID NO: 491082 - DNA, 20 bp, Artificial
  CRISPR gRNA sequence
gataaggacctcccagtgca

SEQ ID NO: 491083 - DNA, 20 bp, Artificial
  CRISPR gRNA sequence
ataaggacctcccagtgcaa

SEQ ID NO: 491084 - DNA, 20 bp, Artificial
  CRISPR gRNA sequence
cctcccagtgcaagggtctg

SEQ ID NO: 491085 - DNA, 20 bp, Artificial
  CRISPR gRNA sequence
aagtttctccttttcttttg

SEQ ID NO: 491086 - DNA, 20 bp, Artificial
  CRISPR gRNA sequence
tctccttttcttttgcagat

SEQ ID NO: 491087 - DNA, 20 bp, Artificial
  CRISPR gRNA sequence
cttttcttttgcagattgga

SEQ ID NO: 491088 - DNA, 20 bp, Artificial
  CRISPR gRNA sequence
tttcttttgcagattggaaa

SEQ ID NO: 491089 - DNA, 20 bp, Artificial
  CRISPR gRNA sequence
gattggaaagagtcaaccta

SEQ ID NO: 491090 - DNA, 20 bp, Artificial
  CRISPR gRNA sequence
gaaagagtcaacctaaagcc

SEQ ID NO: 491091 - DNA, 20 bp, Artificial
  CRISPR gRNA sequence
gcccagaaccctgctcgatt

SEQ ID NO: 491092 - DNA, 20 bp, Artificial
  CRISPR gRNA sequence
ccctgctcgattgagccgca

SEQ ID NO: 491093 - DNA, 20 bp, Artificial
  CRISPR gRNA sequence
ctgctcgattgagccgcaaa

SEQ ID NO: 491094 - DNA, 20 bp, Artificial
  CRISPR gRNA sequence
tcgattgagccgcaaagagc

SEQ ID NO: 491095 - DNA, 20 bp, Artificial
  CRISPR gRNA sequence
gattgagccgcaaagagctg

SEQ ID NO: 491096 - DNA, 20 bp, Artificial
  CRISPR gRNA sequence
agaactttgatgtttattcc

SEQ ID NO: 491097 - DNA, 20 bp, Artificial
  CRISPR gRNA sequence
atgtttattcctagttgctg

SEQ ID NO: 491098 - DNA, 20 bp, Artificial
  CRISPR gRNA sequence
ttctcacctttcttgcacat

SEQ ID NO: 491099 - DNA, 20 bp, Artificial
  CRISPR gRNA sequence
ttgcacatcagcatctgctt

SEQ ID NO: 491100 - DNA, 20 bp, Artificial
  CRISPR gRNA sequence
tgcacatcagcatctgcttt

SEQ ID NO: 491101 - DNA, 20 bp, Artificial
  CRISPR gRNA sequence
tcagcatctgctttgggaat

SEQ ID NO: 491102 - DNA, 20 bp, Artificial
  CRISPR gRNA sequence
atctgctttgggaattggca

SEQ ID NO: 491103 - DNA, 20 bp, Artificial
  CRISPR gRNA sequence
tgctttgggaattggcacag

SEQ ID NO: 491104 - DNA, 20 bp, Artificial
  CRISPR gRNA sequence
ggaattggcacagtggatga

SEQ ID NO: 491105 - DNA, 20 bp, Artificial
  CRISPR gRNA sequence
tggcacagtggatgacggca

SEQ ID NO: 491106 - DNA, 20 bp, Artificial
  CRISPR gRNA sequence
ggcacagtggatgacggcac

SEQ ID NO: 491107 - DNA, 20 bp, Artificial
  CRISPR gRNA sequence
cacagtggatgacggcacag

SEQ ID NO: 491108 - DNA, 20 bp, Artificial
  CRISPR gRNA sequence
tgacggcacaggagtctcta

SEQ ID NO: 491109 - DNA, 20 bp, Artificial
  CRISPR gRNA sequence
gcacaggagtctctatagaa

SEQ ID NO: 491110 - DNA, 20 bp, Artificial
  CRISPR gRNA sequence
agtctctatagaacagttcc

SEQ ID NO: 491111 - DNA, 20 bp, Artificial
  CRISPR gRNA sequence
ctatagaacagttcctagtc

SEQ ID NO: 491112 - DNA, 20 bp, Artificial
  CRISPR gRNA sequence
atagaacagttcctagtctg

SEQ ID NO: 491113 - DNA, 20 bp, Artificial
  CRISPR gRNA sequence
agaacagttcctagtctgga

SEQ ID NO: 491114 - DNA, 20 bp, Artificial
  CRISPR gRNA sequence
gaacagttcctagtctggag

SEQ ID NO: 491115 - DNA, 20 bp, Artificial
  CRISPR gRNA sequence
ttcctagtctggagaggata

SEQ ID NO: 491116 - DNA, 20 bp, Artificial
  CRISPR gRNA sequence
tgatgtctaacaaccatgat

SEQ ID NO: 491117 - DNA, 20 bp, Artificial
  CRISPR gRNA sequence
atgtctaacaaccatgataa

SEQ ID NO: 491118 - DNA, 20 bp, Artificial
  CRISPR gRNA sequence
ctaacaaccatgataagagc

SEQ ID NO: 491119 - DNA, 20 bp, Artificial
  CRISPR gRNA sequence
taacaaccatgataagagca

SEQ ID NO: 491120 - DNA, 20 bp, Artificial
  CRISPR gRNA sequence
aaataatatcttccaattta

SEQ ID NO: 491121 - DNA, 20 bp, Artificial
  CRISPR gRNA sequence
atatcttccaatttacagat

SEQ ID NO: 491122 - DNA, 20 bp, Artificial
  CRISPR gRNA sequence
atttacagatcagacatgaa

SEQ ID NO: 491123 - DNA, 20 bp, Artificial
  CRISPR gRNA sequence
tttacagatcagacatgaat

SEQ ID NO: 491124 - DNA, 20 bp, Artificial
  CRISPR gRNA sequence
acagatcagacatgaatggg

SEQ ID NO: 491125 - DNA, 20 bp, Artificial
  CRISPR gRNA sequence
agatcagacatgaatgggtg

SEQ ID NO: 491126 - DNA, 20 bp, Artificial
  CRISPR gRNA sequence
gatcagacatgaatgggtgg

SEQ ID NO: 491127 - DNA, 20 bp, Artificial
  CRISPR gRNA sequence
atcagacatgaatgggtgga

SEQ ID NO: 491128 - DNA, 20 bp, Artificial
  CRISPR gRNA sequence
tcagacatgaatgggtggag

SEQ ID NO: 491129 - DNA, 20 bp, Artificial
  CRISPR gRNA sequence
acatgaatgggtggaggggt

SEQ ID NO: 491130 - DNA, 20 bp, Artificial
  CRISPR gRNA sequence
catgaatgggtggaggggtt

SEQ ID NO: 491131 - DNA, 20 bp, Artificial
  CRISPR gRNA sequence
aggggttaggttgttcacaa

SEQ ID NO: 491132 - DNA, 20 bp, Artificial
  CRISPR gRNA sequence
ggggttaggttgttcacaaa

SEQ ID NO: 491133 - DNA, 20 bp, Artificial
  CRISPR gRNA sequence
ttcacaaaaggccacattcc

SEQ ID NO: 491134 - DNA, 20 bp, Artificial
  CRISPR gRNA sequence
cattccaagtatttgtaatc

SEQ ID NO: 491135 - DNA, 20 bp, Artificial
  CRISPR gRNA sequence
ccaagtatttgtaatctaga

SEQ ID NO: 491136 - DNA, 20 bp, Artificial
  CRISPR gRNA sequence
taatctagaaagtgttatgt

SEQ ID NO: 491137 - DNA, 20 bp, Artificial
  CRISPR gRNA sequence
tgttatgtaagtgatgttat

SEQ ID NO: 491138 - DNA, 20 bp, Artificial
  CRISPR gRNA sequence
taagtgatgttattagcatc

SEQ ID NO: 491139 - DNA, 20 bp, Artificial
  CRISPR gRNA sequence
attccctccacctgattttc

SEQ ID NO: 491140 - DNA, 20 bp, Artificial
  CRISPR gRNA sequence
gtttccttttctcccctctc

SEQ ID NO: 491141 - DNA, 20 bp, Artificial
  CRISPR gRNA sequence
tttccttttctcccctctct

SEQ ID NO: 491142 - DNA, 20 bp, Artificial
  CRISPR gRNA sequence
ctctgggttgactgcatttc

SEQ ID NO: 491143 - DNA, 20 bp, Artificial
  CRISPR gRNA sequence
ctgcatttctagactctcgc

SEQ ID NO: 491144 - DNA, 20 bp, Artificial
  CRISPR gRNA sequence
tttctagactctcgccggcc

SEQ ID NO: 491145 - DNA, 20 bp, Artificial
  CRISPR gRNA sequence
ttctagactctcgccggccc

SEQ ID NO: 491146 - DNA, 20 bp, Artificial
  CRISPR gRNA sequence
cggcccaggcccatcttcca

SEQ ID NO: 491147 - DNA, 20 bp, Artificial
  CRISPR gRNA sequence
ccaggcccatcttccaaagc

SEQ ID NO: 491148 - DNA, 20 bp, Artificial
  CRISPR gRNA sequence
aggcccatcttccaaagcaa

SEQ ID NO: 491149 - DNA, 20 bp, Artificial
  CRISPR gRNA sequence
ggcccatcttccaaagcaag

SEQ ID NO: 491150 - DNA, 20 bp, Artificial
  CRISPR gRNA sequence
ccatcttccaaagcaagagg

SEQ ID NO: 491151 - DNA, 20 bp, Artificial
  CRISPR gRNA sequence
catcttccaaagcaagagga

SEQ ID NO: 491152 - DNA, 20 bp, Artificial
  CRISPR gRNA sequence
gcaagaggaaggaatgataa

SEQ ID NO: 491153 - DNA, 20 bp, Artificial
  CRISPR gRNA sequence
aaggaatgataatggtgact

SEQ ID NO: 491154 - DNA, 20 bp, Artificial
  CRISPR gRNA sequence
aggaatgataatggtgactc

SEQ ID NO: 491155 - DNA, 20 bp, Artificial
  CRISPR gRNA sequence
ggaatgataatggtgactca

SEQ ID NO: 491156 - DNA, 20 bp, Artificial
  CRISPR gRNA sequence
gaatgataatggtgactcag

SEQ ID NO: 491157 - DNA, 20 bp, Artificial
  CRISPR gRNA sequence
tgataatggtgactcagggg

SEQ ID NO: 491158 - DNA, 20 bp, Artificial
  CRISPR gRNA sequence
taatggtgactcaggggaag

SEQ ID NO: 491159 - DNA, 20 bp, Artificial
  CRISPR gRNA sequence
tgactcaggggaagaagaaa

SEQ ID NO: 491160 - DNA, 20 bp, Artificial
  CRISPR gRNA sequence
aagaaacagccctcctctga

SEQ ID NO: 491161 - DNA, 20 bp, Artificial
  CRISPR gRNA sequence
acagccctcctctgaaagcc

SEQ ID NO: 491162 - DNA, 20 bp, Artificial
  CRISPR gRNA sequence
ctctgaaagcctggactgtc

SEQ ID NO: 491163 - DNA, 20 bp, Artificial
  CRISPR gRNA sequence
tggactgtccggctgtgaac

SEQ ID NO: 491164 - DNA, 20 bp, Artificial
  CRISPR gRNA sequence
ctgtccggctgtgaactggc

SEQ ID NO: 491165 - DNA, 20 bp, Artificial
  CRISPR gRNA sequence
tccggctgtgaactggctgg

SEQ ID NO: 491166 - DNA, 20 bp, Artificial
  CRISPR gRNA sequence
ccggctgtgaactggctggc

SEQ ID NO: 491167 - DNA, 20 bp, Artificial
  CRISPR gRNA sequence
tggctggcaggttctgcacg

SEQ ID NO: 491168 - DNA, 20 bp, Artificial
  CRISPR gRNA sequence
ggctggcaggttctgcacgt

SEQ ID NO: 491169 - DNA, 20 bp, Artificial
  CRISPR gRNA sequence
tggcaggttctgcacgtggg

SEQ ID NO: 491170 - DNA, 20 bp, Artificial
  CRISPR gRNA sequence
ggcaggttctgcacgtgggt

SEQ ID NO: 491171 - DNA, 20 bp, Artificial
  CRISPR gRNA sequence
gcaggttctgcacgtgggtg

SEQ ID NO: 491172 - DNA, 20 bp, Artificial
  CRISPR gRNA sequence
caggttctgcacgtgggtgg

SEQ ID NO: 491173 - DNA, 20 bp, Artificial
  CRISPR gRNA sequence
ttctgcacgtgggtgggggc

SEQ ID NO: 491174 - DNA, 20 bp, Artificial
  CRISPR gRNA sequence
tctgcacgtgggtgggggcc

SEQ ID NO: 491175 - DNA, 20 bp, Artificial
  CRISPR gRNA sequence
ctgcacgtgggtgggggcca

SEQ ID NO: 491176 - DNA, 20 bp, Artificial
  CRISPR gRNA sequence
cgtgggtgggggccagggcc

SEQ ID NO: 491177 - DNA, 20 bp, Artificial
  CRISPR gRNA sequence
gtgggtgggggccagggcct

SEQ ID NO: 491178 - DNA, 20 bp, Artificial
  CRISPR gRNA sequence
gcctgggctttactcaattg

SEQ ID NO: 491179 - DNA, 20 bp, Artificial
  CRISPR gRNA sequence
ctgggctttactcaattgca

SEQ ID NO: 491180 - DNA, 20 bp, Artificial
  CRISPR gRNA sequence
gcatctcatacctttacctc

SEQ ID NO: 491181 - DNA, 20 bp, Artificial
  CRISPR gRNA sequence
ctcatacctttacctctggc

SEQ ID NO: 491182 - DNA, 20 bp, Artificial
  CRISPR gRNA sequence
tacctttacctctggccagt

SEQ ID NO: 491183 - DNA, 20 bp, Artificial
  CRISPR gRNA sequence
acctctggccagttggccac

SEQ ID NO: 491184 - DNA, 20 bp, Artificial
  CRISPR gRNA sequence
cctctggccagttggccacc

SEQ ID NO: 491185 - DNA, 20 bp, Artificial
  CRISPR gRNA sequence
ctctggccagttggccacca

SEQ ID NO: 491186 - DNA, 20 bp, Artificial
  CRISPR gRNA sequence
tctggccagttggccaccag

SEQ ID NO: 491187 - DNA, 20 bp, Artificial
  CRISPR gRNA sequence
ctggccagttggccaccagg

SEQ ID NO: 491188 - DNA, 20 bp, Artificial
  CRISPR gRNA sequence
ggccagttggccaccagggg

SEQ ID NO: 491189 - DNA, 20 bp, Artificial
  CRISPR gRNA sequence
cagttggccaccagggggag

SEQ ID NO: 491190 - DNA, 20 bp, Artificial
  CRISPR gRNA sequence
agttggccaccagggggagt

SEQ ID NO: 491191 - DNA, 20 bp, Artificial
  CRISPR gRNA sequence
ccaccagggggagtgggctg

SEQ ID NO: 491192 - DNA, 20 bp, Artificial
  CRISPR gRNA sequence
caccagggggagtgggctga

SEQ ID NO: 491193 - DNA, 20 bp, Artificial
  CRISPR gRNA sequence
accagggggagtgggctgaa

SEQ ID NO: 491194 - DNA, 20 bp, Artificial
  CRISPR gRNA sequence
cagggggagtgggctgaagg

SEQ ID NO: 491195 - DNA, 20 bp, Artificial
  CRISPR gRNA sequence
gggggagtgggctgaaggga

SEQ ID NO: 491196 - DNA, 20 bp, Artificial
  CRISPR gRNA sequence
ggagtgggctgaagggagag

SEQ ID NO: 491197 - DNA, 20 bp, Artificial
  CRISPR gRNA sequence
tgggctgaagggagagtaga

SEQ ID NO: 491198 - DNA, 20 bp, Artificial
  CRISPR gRNA sequence
aagggagagtagatggtgca

SEQ ID NO: 491199 - DNA, 20 bp, Artificial
  CRISPR gRNA sequence
gagagtagatggtgcaaagc

SEQ ID NO: 491200 - DNA, 20 bp, Artificial
  CRISPR gRNA sequence
tgcaaagcaagcccatctct

SEQ ID NO: 491201 - DNA, 20 bp, Artificial
  CRISPR gRNA sequence
aaagcaagcccatctctaag

SEQ ID NO: 491202 - DNA, 20 bp, Artificial
  CRISPR gRNA sequence
ctctaagtagaaaaatcacc

SEQ ID NO: 491203 - DNA, 20 bp, Artificial
  CRISPR gRNA sequence
ctaagtagaaaaatcaccca

SEQ ID NO: 491204 - DNA, 20 bp, Artificial
  CRISPR gRNA sequence
gcacatgctgacctgataac

SEQ ID NO: 491205 - DNA, 20 bp, Artificial
  CRISPR gRNA sequence
cacatgctgacctgataact

SEQ ID NO: 491206 - DNA, 20 bp, Artificial
  CRISPR gRNA sequence
acatgctgacctgataactg

SEQ ID NO: 491207 - DNA, 20 bp, Artificial
  CRISPR gRNA sequence
gacctgataactggggtgtt

SEQ ID NO: 491208 - DNA, 20 bp, Artificial
  CRISPR gRNA sequence
gataactggggtgttgagac

SEQ ID NO: 491209 - DNA, 20 bp, Artificial
  CRISPR gRNA sequence
gttgagaccagctttgtcca

SEQ ID NO: 491210 - DNA, 20 bp, Artificial
  CRISPR gRNA sequence
ggtatgatgtttgatttatg

SEQ ID NO: 491211 - DNA, 20 bp, Artificial
  CRISPR gRNA sequence
gatttatgaagacgcattgt

SEQ ID NO: 491212 - DNA, 20 bp, Artificial
  CRISPR gRNA sequence
cgcattgttagaaatccatt

SEQ ID NO: 491213 - DNA, 20 bp, Artificial
  CRISPR gRNA sequence
aaatccatttggcttcttca

SEQ ID NO: 491214 - DNA, 20 bp, Artificial
  CRISPR gRNA sequence
tccatttggcttcttcatag

SEQ ID NO: 491215 - DNA, 20 bp, Artificial
  CRISPR gRNA sequence
atttggcttcttcatagaag

SEQ ID NO: 491216 - DNA, 20 bp, Artificial
  CRISPR gRNA sequence
tcttcatagaagtggcttcc

SEQ ID NO: 491217 - DNA, 20 bp, Artificial
  CRISPR gRNA sequence
ttcatagaagtggcttccca

SEQ ID NO: 491218 - DNA, 20 bp, Artificial
  CRISPR gRNA sequence
tcatagaagtggcttcccag

SEQ ID NO: 491219 - DNA, 20 bp, Artificial
  CRISPR gRNA sequence
tagaagtggcttcccagagg

SEQ ID NO: 491220 - DNA, 20 bp, Artificial
  CRISPR gRNA sequence
gaagtggcttcccagaggaa

SEQ ID NO: 491221 - DNA, 20 bp, Artificial
  CRISPR gRNA sequence
aagtggcttcccagaggaag

SEQ ID NO: 491222 - DNA, 20 bp, Artificial
  CRISPR gRNA sequence
tcccagaggaagaggcctct

SEQ ID NO: 491223 - DNA, 20 bp, Artificial
  CRISPR gRNA sequence
tcagaaaccatgttctattt

SEQ ID NO: 491224 - DNA, 20 bp, Artificial
  CRISPR gRNA sequence
ccatgttctatttaagttct

SEQ ID NO: 491225 - DNA, 20 bp, Artificial
  CRISPR gRNA sequence
tttaagttctgagtcctgat

SEQ ID NO: 491226 - DNA, 20 bp, Artificial
  CRISPR gRNA sequence
gagtcctgatgagtgttccc

SEQ ID NO: 491227 - DNA, 20 bp, Artificial
  CRISPR gRNA sequence
agtcctgatgagtgttcccc

SEQ ID NO: 491228 - DNA, 20 bp, Artificial
  CRISPR gRNA sequence
gttccccaggatgcacattg

SEQ ID NO: 491229 - DNA, 20 bp, Artificial
  CRISPR gRNA sequence
ttccccaggatgcacattga

SEQ ID NO: 491230 - DNA, 20 bp, Artificial
  CRISPR gRNA sequence
tccccaggatgcacattgaa

SEQ ID NO: 491231 - DNA, 20 bp, Artificial
  CRISPR gRNA sequence
cccaggatgcacattgaagg

SEQ ID NO: 491232 - DNA, 20 bp, Artificial
  CRISPR gRNA sequence
ccaggatgcacattgaaggg

SEQ ID NO: 491233 - DNA, 20 bp, Artificial
  CRISPR gRNA sequence
caggatgcacattgaaggga

SEQ ID NO: 491234 - DNA, 20 bp, Artificial
  CRISPR gRNA sequence
tgcacattgaagggagggct

SEQ ID NO: 491235 - DNA, 20 bp, Artificial
  CRISPR gRNA sequence
gcacattgaagggagggctc

SEQ ID NO: 491236 - DNA, 20 bp, Artificial
  CRISPR gRNA sequence
cattgaagggagggctcagg

SEQ ID NO: 491237 - DNA, 20 bp, Artificial
  CRISPR gRNA sequence
aagggagggctcaggcagct

SEQ ID NO: 491238 - DNA, 20 bp, Artificial
  CRISPR gRNA sequence
agggagggctcaggcagctg

SEQ ID NO: 491239 - DNA, 20 bp, Artificial
  CRISPR gRNA sequence
gggagggctcaggcagctga

SEQ ID NO: 491240 - DNA, 20 bp, Artificial
  CRISPR gRNA sequence
ggctcaggcagctgagggct

SEQ ID NO: 491241 - DNA, 20 bp, Artificial
  CRISPR gRNA sequence
ggcagctgagggctgagaat

SEQ ID NO: 491242 - DNA, 20 bp, Artificial
  CRISPR gRNA sequence
gcagctgagggctgagaatg

SEQ ID NO: 491243 - DNA, 20 bp, Artificial
  CRISPR gRNA sequence
gctgagggctgagaatgagg

SEQ ID NO: 491244 - DNA, 20 bp, Artificial
  CRISPR gRNA sequence
agggctgagaatgaggcagt

SEQ ID NO: 491245 - DNA, 20 bp, Artificial
  CRISPR gRNA sequence
agaatgaggcagttggaatc

SEQ ID NO: 491246 - DNA, 20 bp, Artificial
  CRISPR gRNA sequence
ttggaatctagacactatgc

SEQ ID NO: 491247 - DNA, 20 bp, Artificial
  CRISPR gRNA sequence
tggaatctagacactatgct

SEQ ID NO: 491248 - DNA, 20 bp, Artificial
  CRISPR gRNA sequence
gacactatgctgggttccct

SEQ ID NO: 491249 - DNA, 20 bp, Artificial
  CRISPR gRNA sequence
tgctgggttccctgagtcgt

SEQ ID NO: 491250 - DNA, 20 bp, Artificial
  CRISPR gRNA sequence
gctgggttccctgagtcgtc

SEQ ID NO: 491251 - DNA, 20 bp, Artificial
  CRISPR gRNA sequence
ggttccctgagtcgtcaggc

SEQ ID NO: 491252 - DNA, 20 bp, Artificial
  CRISPR gRNA sequence
gtcaggccagacatttcaac

SEQ ID NO: 491253 - DNA, 20 bp, Artificial
  CRISPR gRNA sequence
tcaggccagacatttcaaca

SEQ ID NO: 491254 - DNA, 20 bp, Artificial
  CRISPR gRNA sequence
cagacatttcaacaaggctg

SEQ ID NO: 491255 - DNA, 20 bp, Artificial
  CRISPR gRNA sequence
agacatttcaacaaggctgt

SEQ ID NO: 491256 - DNA, 20 bp, Artificial
  CRISPR gRNA sequence
gacatttcaacaaggctgtg

SEQ ID NO: 491257 - DNA, 20 bp, Artificial
  CRISPR gRNA sequence
catttcaacaaggctgtggg

SEQ ID NO: 491258 - DNA, 20 bp, Artificial
  CRISPR gRNA sequence
ttcaacaaggctgtggggag

SEQ ID NO: 491259 - DNA, 20 bp, Artificial
  CRISPR gRNA sequence
tcaacaaggctgtggggagc

SEQ ID NO: 491260 - DNA, 20 bp, Artificial
  CRISPR gRNA sequence
caacaaggctgtggggagca

SEQ ID NO: 491261 - DNA, 20 bp, Artificial
  CRISPR gRNA sequence
ggggagcagggctgtgactc

SEQ ID NO: 491262 - DNA, 20 bp, Artificial
  CRISPR gRNA sequence
gcagggctgtgactctggct

SEQ ID NO: 491263 - DNA, 20 bp, Artificial
  CRISPR gRNA sequence
gctgtgactctggctgagcc

SEQ ID NO: 491264 - DNA, 20 bp, Artificial
  CRISPR gRNA sequence
ctgtgactctggctgagccc

SEQ ID NO: 491265 - DNA, 20 bp, Artificial
  CRISPR gRNA sequence
gactctggctgagcccagga

SEQ ID NO: 491266 - DNA, 20 bp, Artificial
  CRISPR gRNA sequence
gctgagcccaggaaagcgac

SEQ ID NO: 491267 - DNA, 20 bp, Artificial
  CRISPR gRNA sequence
ctgagcccaggaaagcgaca

SEQ ID NO: 491268 - DNA, 20 bp, Artificial
  CRISPR gRNA sequence
tgagcccaggaaagcgacaa

SEQ ID NO: 491269 - DNA, 20 bp, Artificial
  CRISPR gRNA sequence
ggaaagcgacaagggtgaac

SEQ ID NO: 491270 - DNA, 20 bp, Artificial
  CRISPR gRNA sequence
gaaagcgacaagggtgaact

SEQ ID NO: 491271 - DNA, 20 bp, Artificial
  CRISPR gRNA sequence
aagcgacaagggtgaactgg

SEQ ID NO: 491272 - DNA, 20 bp, Artificial
  CRISPR gRNA sequence
gcgacaagggtgaactggga

SEQ ID NO: 491273 - DNA, 20 bp, Artificial
  CRISPR gRNA sequence
cgacaagggtgaactgggag

SEQ ID NO: 491274 - DNA, 20 bp, Artificial
  CRISPR gRNA sequence
gaactgggagaggacttact

SEQ ID NO: 491275 - DNA, 20 bp, Artificial
  CRISPR gRNA sequence
actgggagaggacttactca

SEQ ID NO: 491276 - DNA, 20 bp, Artificial
  CRISPR gRNA sequence
gacttactcagagaccccaa

SEQ ID NO: 491277 - DNA, 20 bp, Artificial
  CRISPR gRNA sequence
acttactcagagaccccaac

SEQ ID NO: 491278 - DNA, 20 bp, Artificial
  CRISPR gRNA sequence
ccaacaggtgatactgcaca

SEQ ID NO: 491279 - DNA, 20 bp, Artificial
  CRISPR gRNA sequence
aggtgatactgcacaaagcc

SEQ ID NO: 491280 - DNA, 20 bp, Artificial
  CRISPR gRNA sequence
ttcctaccctgtatctaaca

SEQ ID NO: 491281 - DNA, 20 bp, Artificial
  CRISPR gRNA sequence
tcctaccctgtatctaacat

SEQ ID NO: 491282 - DNA, 20 bp, Artificial
  CRISPR gRNA sequence
ctaccctgtatctaacatag

SEQ ID NO: 491283 - DNA, 20 bp, Artificial
  CRISPR gRNA sequence
cataggagtttcatataaaa

SEQ ID NO: 491284 - DNA, 20 bp, Artificial
  CRISPR gRNA sequence
tataaaacggtgatatcatg

SEQ ID NO: 491285 - DNA, 20 bp, Artificial
  CRISPR gRNA sequence
acggtgatatcatgcagatg

SEQ ID NO: 491286 - DNA, 20 bp, Artificial
  CRISPR gRNA sequence
ccctgcatttttattctcta

SEQ ID NO: 491287 - DNA, 20 bp, Artificial
  CRISPR gRNA sequence
tgcatttttattctctatag

SEQ ID NO: 491288 - DNA, 20 bp, Artificial
  CRISPR gRNA sequence
tttattctctatagcagccg

SEQ ID NO: 491289 - DNA, 20 bp, Artificial
  CRISPR gRNA sequence
ttattctctatagcagccga

SEQ ID NO: 491290 - DNA, 20 bp, Artificial
  CRISPR gRNA sequence
tattctctatagcagccgaa

SEQ ID NO: 491291 - DNA, 20 bp, Artificial
  CRISPR gRNA sequence
tagcagccgaagggcacttg

SEQ ID NO: 491292 - DNA, 20 bp, Artificial
  CRISPR gRNA sequence
agcagccgaagggcacttgt

SEQ ID NO: 491293 - DNA, 20 bp, Artificial
  CRISPR gRNA sequence
tgtctgtttgaacactgctg

SEQ ID NO: 491294 - DNA, 20 bp, Artificial
  CRISPR gRNA sequence
tctgtttgaacactgctgta

SEQ ID NO: 491295 - DNA, 20 bp, Artificial
  CRISPR gRNA sequence
ctgtttgaacactgctgtag

SEQ ID NO: 491296 - DNA, 20 bp, Artificial
  CRISPR gRNA sequence
tgtttgaacactgctgtaga

SEQ ID NO: 491297 - DNA, 20 bp, Artificial
  CRISPR gRNA sequence
ctgtagagggtctgacttcc

SEQ ID NO: 491298 - DNA, 20 bp, Artificial
  CRISPR gRNA sequence
agtgcccttcggctgctata

SEQ ID NO: 491299 - DNA, 20 bp, Artificial
  CRISPR gRNA sequence
tgctatagagaataaaaatg

SEQ ID NO: 491300 - DNA, 20 bp, Artificial
  CRISPR gRNA sequence
ataaaaatgcagggtatgga

SEQ ID NO: 491301 - DNA, 20 bp, Artificial
  CRISPR gRNA sequence
acataaatttaattcaggca

SEQ ID NO: 491302 - DNA, 20 bp, Artificial
  CRISPR gRNA sequence
tgaaactcctatgttagata

SEQ ID NO: 491303 - DNA, 20 bp, Artificial
  CRISPR gRNA sequence
ctttgtgcagtatcacctgt

SEQ ID NO: 491304 - DNA, 20 bp, Artificial
  CRISPR gRNA sequence
agtatcacctgttggggtct

SEQ ID NO: 491305 - DNA, 20 bp, Artificial
  CRISPR gRNA sequence
gtcgctttcctgggctcagc

SEQ ID NO: 491306 - DNA, 20 bp, Artificial
  CRISPR gRNA sequence
cacttctatgaagaagccaa

SEQ ID NO: 491307 - DNA, 20 bp, Artificial
  CRISPR gRNA sequence
ttatcaggtcagcatgtgct

SEQ ID NO: 491308 - DNA, 20 bp, Artificial
  CRISPR gRNA sequence
agaaagttttttctctgcaa

SEQ ID NO: 491309 - DNA, 20 bp, Artificial
  CRISPR gRNA sequence
gagggctgtttcttcttccc

SEQ ID NO: 491310 - DNA, 20 bp, Artificial
  CRISPR gRNA sequence
gaagatgggcctgggccggc

SEQ ID NO: 491311 - DNA, 20 bp, Artificial
  CRISPR gRNA sequence
cagcttgaaaatcaggtgga

SEQ ID NO: 491312 - DNA, 20 bp, Artificial
  CRISPR gRNA sequence
ctttctagattacaaatact

SEQ ID NO: 491313 - DNA, 20 bp, Artificial
  CRISPR gRNA sequence
tgctgatgtgcaagaaaggt

SEQ ID NO: 491314 - DNA, 20 bp, Artificial
  CRISPR gRNA sequence
tgagaattgctgcagcaact

SEQ ID NO: 491315 - DNA, 20 bp, Artificial
  CRISPR gRNA sequence
ctctttgcggctcaatcgag

SEQ ID NO: 491316 - DNA, 20 bp, Artificial
  CRISPR gRNA sequence
cagatttaaaaaatgaagct

SEQ ID NO: 491317 - DNA, 20 bp, Artificial
  CRISPR gRNA sequence
gagtgacaaaacaaattact

SEQ ID NO: 491318 - DNA, 20 bp, Artificial
  CRISPR gRNA sequence
gtgtgaagtgcaggagggac

SEQ ID NO: 491319 - DNA, 20 bp, Artificial
  CRISPR gRNA sequence
ttcatgacctcacaagctac

SEQ ID NO: 491320 - DNA, 20 bp, Artificial
  CRISPR gRNA sequence
acacagtgccctctatgacc

SEQ ID NO: 491321 - DNA, 20 bp, Artificial
  CRISPR gRNA sequence
ttgtccagttggctttaatg

SEQ ID NO: 491322 - DNA, 20 bp, Artificial
  CRISPR gRNA sequence
tgggtgatagctgaagtgcc

SEQ ID NO: 491323 - DNA, 20 bp, Artificial
  CRISPR gRNA sequence
tcaggtgtagtatgaggcta

SEQ ID NO: 491324 - DNA, 20 bp, Artificial
  CRISPR gRNA sequence
atgggtagtgggggaggttg

SEQ ID NO: 491325 - DNA, 20 bp, Artificial
  CRISPR gRNA sequence
ctctccatgccttaatttct

SEQ ID NO: 491326 - DNA, 20 bp, Artificial
  CRISPR gRNA sequence
taataaacccccaagaaatg

SEQ ID NO: 491327 - DNA, 20 bp, Artificial
  CRISPR gRNA sequence
cagtccctaaatgctctgat

SEQ ID NO: 491328 - DNA, 20 bp, Artificial
  CRISPR gRNA sequence
gattaagctcacctatgtcc

SEQ ID NO: 491329 - DNA, 20 bp, Artificial
  CRISPR gRNA sequence
gctaattttagaaaatcatt

SEQ ID NO: 491330 - DNA, 20 bp, Artificial
  CRISPR gRNA sequence
tctaaacacgcaatatgatc

SEQ ID NO: 491331 - DNA, 20 bp, Artificial
  CRISPR gRNA sequence
ccctacaactctgagactgt

SEQ ID NO: 491332 - DNA, 20 bp, Artificial
  CRISPR gRNA sequence
aacagacagtaaacccattg

SEQ ID NO: 491333 - DNA, 20 bp, Artificial
  CRISPR gRNA sequence
gtaaacccattgaggagttc

SEQ ID NO: 491334 - DNA, 20 bp, Artificial
  CRISPR gRNA sequence
aagggctgtggttcctcttc

SEQ ID NO: 491335 - DNA, 20 bp, Artificial
  CRISPR gRNA sequence
gactagaaattcagaaggta

SEQ ID NO: 491336 - DNA, 20 bp, Artificial
  CRISPR gRNA sequence
gaggcactctcagccagaaa

SEQ ID NO: 491337 - DNA, 20 bp, Artificial
  CRISPR gRNA sequence
actctcagccagaaaatgaa

SEQ ID NO: 491338 - DNA, 20 bp, Artificial
  CRISPR gRNA sequence
tgatatttctgaaccaaaat

SEQ ID NO: 491339 - DNA, 20 bp, Artificial
  CRISPR gRNA sequence
aattgccaacccaaggacac

SEQ ID NO: 491340 - DNA, 20 bp, Artificial
  CRISPR gRNA sequence
gaggcacattcagtagcata

SEQ ID NO: 491341 - DNA, 20 bp, Artificial
  CRISPR gRNA sequence
aaaacaaatctctctcacga

SEQ ID NO: 491342 - DNA, 20 bp, Artificial
  CRISPR gRNA sequence
cacgatgggatccaagtagg

SEQ ID NO: 491343 - DNA, 20 bp, Artificial
  CRISPR gRNA sequence
aatggcttattggaaggagg

SEQ ID NO: 491344 - DNA, 20 bp, Artificial
  CRISPR gRNA sequence
aaaacaatgaccatgtgtac

SEQ ID NO: 491345 - DNA, 20 bp, Artificial
  CRISPR gRNA sequence
gctacgaactcagcttggag

SEQ ID NO: 491346 - DNA, 20 bp, Artificial
  CRISPR gRNA sequence
ggagaaggatttcagtgcaa

SEQ ID NO: 491347 - DNA, 20 bp, Artificial
  CRISPR gRNA sequence
aaggatttcagtgcaaaagg

SEQ ID NO: 491348 - DNA, 20 bp, Artificial
  CRISPR gRNA sequence
cacaataaagaacaacttgc

SEQ ID NO: 491349 - DNA, 20 bp, Artificial
  CRISPR gRNA sequence
aggctcaccttcctggaagg

SEQ ID NO: 491350 - DNA, 20 bp, Artificial
  CRISPR gRNA sequence
cttcctggaaggctgaatta

SEQ ID NO: 491351 - DNA, 20 bp, Artificial
  CRISPR gRNA sequence
tagccaggaggtcagacaac

SEQ ID NO: 491352 - DNA, 20 bp, Artificial
  CRISPR gRNA sequence
tgtttatttgtttttgagac

SEQ ID NO: 491353 - DNA, 20 bp, Artificial
  CRISPR gRNA sequence
tttcgctctattgcctgggc

SEQ ID NO: 491354 - DNA, 20 bp, Artificial
  CRISPR gRNA sequence
ctcaccgcaacctctgcctc

SEQ ID NO: 491355 - DNA, 20 bp, Artificial
  CRISPR gRNA sequence
aattctcctgccccagcctc

SEQ ID NO: 491356 - DNA, 20 bp, Artificial
  CRISPR gRNA sequence
gccccagcctcctgagtagc

SEQ ID NO: 491357 - DNA, 20 bp, Artificial
  CRISPR gRNA sequence
aatttttgtatttttagaga

SEQ ID NO: 491358 - DNA, 20 bp, Artificial
  CRISPR gRNA sequence
gcctcggcctcccaaagtgt

SEQ ID NO: 491359 - DNA, 20 bp, Artificial
  CRISPR gRNA sequence
ttttaacactcctataaaat

SEQ ID NO: 491360 - DNA, 20 bp, Artificial
  CRISPR gRNA sequence
tgccacaaatgaggctccaa

SEQ ID NO: 491361 - DNA, 20 bp, Artificial
  CRISPR gRNA sequence
cagtgcgtacacagtagaag

SEQ ID NO: 491362 - DNA, 20 bp, Artificial
  CRISPR gRNA sequence
ctgatagaaattcctctcat

SEQ ID NO: 491363 - DNA, 20 bp, Artificial
  CRISPR gRNA sequence
cttgggagagatgtcccagc

SEQ ID NO: 491364 - DNA, 20 bp, Artificial
  CRISPR gRNA sequence
cattttagccatcagtatta

SEQ ID NO: 491365 - DNA, 20 bp, Artificial
  CRISPR gRNA sequence
aaaggatgcttctccagttt

SEQ ID NO: 491366 - DNA, 20 bp, Artificial
  CRISPR gRNA sequence
gatgcttctccagtttatga

SEQ ID NO: 491367 - DNA, 20 bp, Artificial
  CRISPR gRNA sequence
tgagtgaatttctgtaatcc

SEQ ID NO: 491368 - DNA, 20 bp, Artificial
  CRISPR gRNA sequence
taatcccagaatataagagg

SEQ ID NO: 491369 - DNA, 20 bp, Artificial
  CRISPR gRNA sequence
gccttgagatatcagttgac

SEQ ID NO: 491370 - DNA, 20 bp, Artificial
  CRISPR gRNA sequence
tcggtttcctcattgtgata

SEQ ID NO: 491371 - DNA, 20 bp, Artificial
  CRISPR gRNA sequence
gatttagtaagaaaatacag

SEQ ID NO: 491372 - DNA, 20 bp, Artificial
  CRISPR gRNA sequence
tacccaggaggctgaggtgg

SEQ ID NO: 491373 - DNA, 20 bp, Artificial
  CRISPR gRNA sequence
tgggaggatcacttgaggcc

SEQ ID NO: 491374 - DNA, 20 bp, Artificial
  CRISPR gRNA sequence
attgcactcagcctggtaga

SEQ ID NO: 491375 - DNA, 20 bp, Artificial
  CRISPR gRNA sequence
gaatgagatcctgtctcata

SEQ ID NO: 491376 - DNA, 20 bp, Artificial
  CRISPR gRNA sequence
agattcattctttcctgaaa

SEQ ID NO: 491377 - DNA, 20 bp, Artificial
  CRISPR gRNA sequence
tcctgaaaacgaatataata

SEQ ID NO: 491378 - DNA, 20 bp, Artificial
  CRISPR gRNA sequence
aaacgaatataatagggaat

SEQ ID NO: 491379 - DNA, 20 bp, Artificial
  CRISPR gRNA sequence
gcagggcaagaaagcagaag

SEQ ID NO: 491380 - DNA, 20 bp, Artificial
  CRISPR gRNA sequence
ctgccagacacggaagaaga

SEQ ID NO: 491381 - DNA, 20 bp, Artificial
  CRISPR gRNA sequence
ttaagatgctctagtatcac

SEQ ID NO: 491382 - DNA, 20 bp, Artificial
  CRISPR gRNA sequence
aactgaagccaagctatctt

SEQ ID NO: 491383 - DNA, 20 bp, Artificial
  CRISPR gRNA sequence
ttattctgccattcaatggt

SEQ ID NO: 491384 - DNA, 20 bp, Artificial
  CRISPR gRNA sequence
ggaaaccccagagataggta

SEQ ID NO: 491385 - DNA, 20 bp, Artificial
  CRISPR gRNA sequence
aactggagaggtacctggga

SEQ ID NO: 491386 - DNA, 20 bp, Artificial
  CRISPR gRNA sequence
aggtacctgggactggatca

SEQ ID NO: 491387 - DNA, 20 bp, Artificial
  CRISPR gRNA sequence
tcctgcacaagaaatggaga

SEQ ID NO: 491388 - DNA, 20 bp, Artificial
  CRISPR gRNA sequence
tcggtctgtccagatttaga

SEQ ID NO: 491389 - DNA, 20 bp, Artificial
  CRISPR gRNA sequence
agggaggtggcaggactggg

SEQ ID NO: 491390 - DNA, 20 bp, Artificial
  CRISPR gRNA sequence
agacaggaagaagagcagtt

SEQ ID NO: 491391 - DNA, 20 bp, Artificial
  CRISPR gRNA sequence
caaggaaccacctaggtgtg

SEQ ID NO: 491392 - DNA, 20 bp, Artificial
  CRISPR gRNA sequence
ttccagcaaccctgctcaaa

SEQ ID NO: 491393 - DNA, 20 bp, Artificial
  CRISPR gRNA sequence
aaacccttccttgcagagct

SEQ ID NO: 491394 - DNA, 20 bp, Artificial
  CRISPR gRNA sequence
cgccctgggcagctatagtg

SEQ ID NO: 491395 - DNA, 20 bp, Artificial
  CRISPR gRNA sequence
actgaaagcatattgccagt

SEQ ID NO: 491396 - DNA, 20 bp, Artificial
  CRISPR gRNA sequence
ctgggagccagtggaggcag

SEQ ID NO: 491397 - DNA, 20 bp, Artificial
  CRISPR gRNA sequence
tcagctgtccttagaggctg

SEQ ID NO: 491398 - DNA, 20 bp, Artificial
  CRISPR gRNA sequence
tttgtgttttaaaatactgc

SEQ ID NO: 491399 - DNA, 20 bp, Artificial
  CRISPR gRNA sequence
tgtttctagaaagattagag

SEQ ID NO: 491400 - DNA, 20 bp, Artificial
  CRISPR gRNA sequence
ggccaggcagggaggagctc

SEQ ID NO: 491401 - DNA, 20 bp, Artificial
  CRISPR gRNA sequence
gaagaagtaagctaataggc

SEQ ID NO: 491402 - DNA, 20 bp, Artificial
  CRISPR gRNA sequence
gcacccgggcatcactggct

SEQ ID NO: 491403 - DNA, 20 bp, Artificial
  CRISPR gRNA sequence
gggtagattcacatgctttc

SEQ ID NO: 491404 - DNA, 20 bp, Artificial
  CRISPR gRNA sequence
atgctttcaggaatttgtac

SEQ ID NO: 491405 - DNA, 20 bp, Artificial
  CRISPR gRNA sequence
gaacccagaggcatctggga

SEQ ID NO: 491406 - DNA, 20 bp, Artificial
  CRISPR gRNA sequence
catgtgcttcctgcgtgctg

SEQ ID NO: 491407 - DNA, 20 bp, Artificial
  CRISPR gRNA sequence
atttcctcctcttctaattc

SEQ ID NO: 491408 - DNA, 20 bp, Artificial
  CRISPR gRNA sequence
tctaattcttggatgacagg

SEQ ID NO: 491409 - DNA, 20 bp, Artificial
  CRISPR gRNA sequence
gcctcttcttccaaaaggct

SEQ ID NO: 491410 - DNA, 20 bp, Artificial
  CRISPR gRNA sequence
gtgtcaccattaagggactc

SEQ ID NO: 491411 - DNA, 20 bp, Artificial
  CRISPR gRNA sequence
agccctgactcattaggaaa

SEQ ID NO: 491412 - DNA, 20 bp, Artificial
  CRISPR gRNA sequence
aagatagatggggaagggct

SEQ ID NO: 491413 - DNA, 20 bp, Artificial
  CRISPR gRNA sequence
gtcctttttgtccctctgct

SEQ ID NO: 491414 - DNA, 20 bp, Artificial
  CRISPR gRNA sequence
ctgagagagaccccagcctc

SEQ ID NO: 491415 - DNA, 20 bp, Artificial
  CRISPR gRNA sequence
ctacagggaaatctgcgcat

SEQ ID NO: 491416 - DNA, 20 bp, Artificial
  CRISPR gRNA sequence
ctggacgcaggacaaagtca

SEQ ID NO: 491417 - DNA, 20 bp, Artificial
  CRISPR gRNA sequence
ctccacacacagaagcaggc

SEQ ID NO: 491418 - DNA, 20 bp, Artificial
  CRISPR gRNA sequence
gtgccaaggaacagtgcgct

SEQ ID NO: 491419 - DNA, 20 bp, Artificial
  CRISPR gRNA sequence
tcaccaaaaacggccaaaat

SEQ ID NO: 491420 - DNA, 20 bp, Artificial
  CRISPR gRNA sequence
cggccaaaatctgaattctg

SEQ ID NO: 491421 - DNA, 20 bp, Artificial
  CRISPR gRNA sequence
gctcatttggttaacctcct

SEQ ID NO: 491422 - DNA, 20 bp, Artificial
  CRISPR gRNA sequence
agattttctcacctgtaaaa

SEQ ID NO: 491423 - DNA, 20 bp, Artificial
  CRISPR gRNA sequence
ggataacgttatctacctat

SEQ ID NO: 491424 - DNA, 20 bp, Artificial
  CRISPR gRNA sequence
tacagttgccctccaaagtt

SEQ ID NO: 491425 - DNA, 20 bp, Artificial
  CRISPR gRNA sequence
aaagttttgagttccacaat

SEQ ID NO: 491426 - DNA, 20 bp, Artificial
  CRISPR gRNA sequence
agttccacaatgtggattca

SEQ ID NO: 491427 - DNA, 20 bp, Artificial
  CRISPR gRNA sequence
caatgtggattcaatgaatt

SEQ ID NO: 491428 - DNA, 20 bp, Artificial
  CRISPR gRNA sequence
gattcaatgaattgtggatc

SEQ ID NO: 491429 - DNA, 20 bp, Artificial
  CRISPR gRNA sequence
ggaaaaaaaatgcatgtgta

SEQ ID NO: 491430 - DNA, 20 bp, Artificial
  CRISPR gRNA sequence
gacttaagtaaggtatacag

SEQ ID NO: 491431 - DNA, 20 bp, Artificial
  CRISPR gRNA sequence
tgccagggacttaaacattc

SEQ ID NO: 491432 - DNA, 20 bp, Artificial
  CRISPR gRNA sequence
ttggcatctgtggttgcgag

SEQ ID NO: 491433 - DNA, 20 bp, Artificial
  CRISPR gRNA sequence
ggtcctggaactaattcgtc

SEQ ID NO: 491434 - DNA, 20 bp, Artificial
  CRISPR gRNA sequence
agccaacaagaggaaggaaa

SEQ ID NO: 491435 - DNA, 20 bp, Artificial
  CRISPR gRNA sequence
attgaggctcagagaggtta

SEQ ID NO: 491436 - DNA, 20 bp, Artificial
  CRISPR gRNA sequence
tttttttttttaaatagaga

SEQ ID NO: 491437 - DNA, 20 bp, Artificial
  CRISPR gRNA sequence
gcctcagcctcccaaagtgc

SEQ ID NO: 491438 - DNA, 20 bp, Artificial
  CRISPR gRNA sequence
tctaagagatcacagagctt

SEQ ID NO: 491439 - DNA, 20 bp, Artificial
  CRISPR gRNA sequence
ctcactgcaacctccgcctc

SEQ ID NO: 491440 - DNA, 20 bp, Artificial
  CRISPR gRNA sequence
aattctcctgcctcagcctc

SEQ ID NO: 491441 - DNA, 20 bp, Artificial
  CRISPR gRNA sequence
ttttgtatttttagtagaga

SEQ ID NO: 491442 - DNA, 20 bp, Artificial
  CRISPR gRNA sequence
acctcagcctcccaaagtgc

SEQ ID NO: 491443 - DNA, 20 bp, Artificial
  CRISPR gRNA sequence
catttggctataagttcctt

SEQ ID NO: 491444 - DNA, 20 bp, Artificial
  CRISPR gRNA sequence
acggtaactcaggtaactct

SEQ ID NO: 491445 - DNA, 20 bp, Artificial
  CRISPR gRNA sequence
agaactcatctaggtatccc

SEQ ID NO: 491446 - DNA, 20 bp, Artificial
  CRISPR gRNA sequence
tgcatctcccagaaggaaat

SEQ ID NO: 491447 - DNA, 20 bp, Artificial
  CRISPR gRNA sequence
atagggataacatttttttc

SEQ ID NO: 491448 - DNA, 20 bp, Artificial
  CRISPR gRNA sequence
gataacatttttttccagag

SEQ ID NO: 491449 - DNA, 20 bp, Artificial
  CRISPR gRNA sequence
ggcactgggagaggaggcca

SEQ ID NO: 491450 - DNA, 20 bp, Artificial
  CRISPR gRNA sequence
cttgcacatgagcctggttg

SEQ ID NO: 491451 - DNA, 20 bp, Artificial
  CRISPR gRNA sequence
tgatgggcattctgacagtc

SEQ ID NO: 491452 - DNA, 20 bp, Artificial
  CRISPR gRNA sequence
tgacagtcctgagtgagatt

SEQ ID NO: 491453 - DNA, 20 bp, Artificial
  CRISPR gRNA sequence
ggtgtggctttcccagctaa

SEQ ID NO: 491454 - DNA, 20 bp, Artificial
  CRISPR gRNA sequence
ctgacattgcaggtatatgt

SEQ ID NO: 491455 - DNA, 20 bp, Artificial
  CRISPR gRNA sequence
taggtgaggttccctgctgt

SEQ ID NO: 491456 - DNA, 20 bp, Artificial
  CRISPR gRNA sequence
acttggcatctccctctgtc

SEQ ID NO: 491457 - DNA, 20 bp, Artificial
  CRISPR gRNA sequence
tcttcccctgcccctgtagg

SEQ ID NO: 491458 - DNA, 20 bp, Artificial
  CRISPR gRNA sequence
tacagaacttagaggcctat

SEQ ID NO: 491459 - DNA, 20 bp, Artificial
  CRISPR gRNA sequence
tcaagttcttgactataaaa

SEQ ID NO: 491460 - DNA, 20 bp, Artificial
  CRISPR gRNA sequence
cccaagctgaaagtagcggg

SEQ ID NO: 491461 - DNA, 20 bp, Artificial
  CRISPR gRNA sequence
ggcctgagcaatgtgggcag

SEQ ID NO: 491462 - DNA, 20 bp, Artificial
  CRISPR gRNA sequence
tgtgacttcccttaagccaa

SEQ ID NO: 491463 - DNA, 20 bp, Artificial
  CRISPR gRNA sequence
ttcccttaagccaattgggt

SEQ ID NO: 491464 - DNA, 20 bp, Artificial
  CRISPR gRNA sequence
cttaagccaattgggtgggg

SEQ ID NO: 491465 - DNA, 20 bp, Artificial
  CRISPR gRNA sequence
agctctgtgtccctagtctg

SEQ ID NO: 491466 - DNA, 20 bp, Artificial
  CRISPR gRNA sequence
atagaccaatagctaaaatc

SEQ ID NO: 491467 - DNA, 20 bp, Artificial
  CRISPR gRNA sequence
tatttaagttaaaaggtatg

SEQ ID NO: 491468 - DNA, 20 bp, Artificial
  CRISPR gRNA sequence
taaaaggtatgatgagttaa

SEQ ID NO: 491469 - DNA, 20 bp, Artificial
  CRISPR gRNA sequence
tttgttttgttttctagaga

SEQ ID NO: 491470 - DNA, 20 bp, Artificial
  CRISPR gRNA sequence
tctcactctgtcacccaggc

SEQ ID NO: 491471 - DNA, 20 bp, Artificial
  CRISPR gRNA sequence
aagacagcagtttggcttga

SEQ ID NO: 491472 - DNA, 20 bp, Artificial
  CRISPR gRNA sequence
agtagtgactgttggaaatt

SEQ ID NO: 491473 - DNA, 20 bp, Artificial
  CRISPR gRNA sequence
tcaaccatcctctcacagag

SEQ ID NO: 491474 - DNA, 20 bp, Artificial
  CRISPR gRNA sequence
ctctcgtggcacttggttca

SEQ ID NO: 491475 - DNA, 20 bp, Artificial
  CRISPR gRNA sequence
atcccagcacttgcctctca

SEQ ID NO: 491476 - DNA, 20 bp, Artificial
  CRISPR gRNA sequence
aagaatcaagatgaaaccta

SEQ ID NO: 491477 - DNA, 20 bp, Artificial
  CRISPR gRNA sequence
agatgaaacctaatgaatat

SEQ ID NO: 491478 - DNA, 20 bp, Artificial
  CRISPR gRNA sequence
caggaaattaaaaagtctct

SEQ ID NO: 491479 - DNA, 20 bp, Artificial
  CRISPR gRNA sequence
aaattaaaaagtctctctgg

SEQ ID NO: 491480 - DNA, 20 bp, Artificial
  CRISPR gRNA sequence
gtgagttggggaggctcagg

SEQ ID NO: 491481 - DNA, 20 bp, Artificial
  CRISPR gRNA sequence
aagagaaaataagagatggg

SEQ ID NO: 491482 - DNA, 20 bp, Artificial
  CRISPR gRNA sequence
gaagagagcaattgagacag

SEQ ID NO: 491483 - DNA, 20 bp, Artificial
  CRISPR gRNA sequence
ttttatatgtccagtgcatt

SEQ ID NO: 491484 - DNA, 20 bp, Artificial
  CRISPR gRNA sequence
caaagaccctgagaacaaag

SEQ ID NO: 491485 - DNA, 20 bp, Artificial
  CRISPR gRNA sequence
catcaattattcagtcctta

SEQ ID NO: 491486 - DNA, 20 bp, Artificial
  CRISPR gRNA sequence
aggcatgattcctgactcca

SEQ ID NO: 491487 - DNA, 20 bp, Artificial
  CRISPR gRNA sequence
ttgagataaaaaatcatcga

SEQ ID NO: 491488 - DNA, 20 bp, Artificial
  CRISPR gRNA sequence
gcacattgttaaagttatca

SEQ ID NO: 491489 - DNA, 20 bp, Artificial
  CRISPR gRNA sequence
cacgtccctcctattagaaa

SEQ ID NO: 491490 - DNA, 20 bp, Artificial
  CRISPR gRNA sequence
accacagagggctataccca

SEQ ID NO: 491491 - DNA, 20 bp, Artificial
  CRISPR gRNA sequence
gagggctatacccaaagagt

SEQ ID NO: 491492 - DNA, 20 bp, Artificial
  CRISPR gRNA sequence
acaggaactgaagctcaatt

SEQ ID NO: 491493 - DNA, 20 bp, Artificial
  CRISPR gRNA sequence
aattttgaatcatcacaacc

SEQ ID NO: 491494 - DNA, 20 bp, Artificial
  CRISPR gRNA sequence
cctggattgaactaatgatc

SEQ ID NO: 491495 - DNA, 20 bp, Artificial
  CRISPR gRNA sequence
ccagagcattaaattattcc

SEQ ID NO: 491496 - DNA, 20 bp, Artificial
  CRISPR gRNA sequence
acatctccaaaaaccaacag

SEQ ID NO: 491497 - DNA, 20 bp, Artificial
  CRISPR gRNA sequence
caaacagggcatctacataa

SEQ ID NO: 491498 - DNA, 20 bp, Artificial
  CRISPR gRNA sequence
aggaaataaaacataagttt

SEQ ID NO: 491499 - DNA, 20 bp, Artificial
  CRISPR gRNA sequence
tcagcagagaactagcgtga

SEQ ID NO: 491500 - DNA, 20 bp, Artificial
  CRISPR gRNA sequence
ctccttctgttatcaagaaa

SEQ ID NO: 491501 - DNA, 20 bp, Artificial
  CRISPR gRNA sequence
aagcctaaaatagcctgctg

SEQ ID NO: 491502 - DNA, 20 bp, Artificial
  CRISPR gRNA sequence
ccggcagatcactcaaggtc

SEQ ID NO: 491503 - DNA, 20 bp, Artificial
  CRISPR gRNA sequence
acttgtaaccccagctactt

SEQ ID NO: 491504 - DNA, 20 bp, Artificial
  CRISPR gRNA sequence
aaacaataaaaaataaataa

SEQ ID NO: 491505 - DNA, 20 bp, Artificial
  CRISPR gRNA sequence
cagcccaaattgccaactag

SEQ ID NO: 491506 - DNA, 20 bp, Artificial
  CRISPR gRNA sequence
taggtagttgttttaaacta

SEQ ID NO: 491507 - DNA, 20 bp, Artificial
  CRISPR gRNA sequence
tgttttaaactactggattt

SEQ ID NO: 491508 - DNA, 20 bp, Artificial
  CRISPR gRNA sequence
gcagcaatagttacctgaaa

SEQ ID NO: 491509 - DNA, 20 bp, Artificial
  CRISPR gRNA sequence
ctgaaattggatttttttta

SEQ ID NO: 491510 - DNA, 20 bp, Artificial
  CRISPR gRNA sequence
catttagatgccattgaaaa

SEQ ID NO: 491511 - DNA, 20 bp, Artificial
  CRISPR gRNA sequence
gaaaactgttataaaatatc

SEQ ID NO: 491512 - DNA, 20 bp, Artificial
  CRISPR gRNA sequence
agtgaagtaaagaaaaacaa

SEQ ID NO: 491513 - DNA, 20 bp, Artificial
  CRISPR gRNA sequence
aaggataaaaatacacaaga

SEQ ID NO: 491514 - DNA, 20 bp, Artificial
  CRISPR gRNA sequence
aagcaaaagagataaaagat

SEQ ID NO: 491515 - DNA, 20 bp, Artificial
  CRISPR gRNA sequence
cagcactttgggaggcccag

SEQ ID NO: 491516 - DNA, 20 bp, Artificial
  CRISPR gRNA sequence
actttgggaggcccaggtgg

SEQ ID NO: 491517 - DNA, 20 bp, Artificial
  CRISPR gRNA sequence
tggatggatcacctgacgtc

SEQ ID NO: 491518 - DNA, 20 bp, Artificial
  CRISPR gRNA sequence
tacttgggaggctgaggcag

SEQ ID NO: 491519 - DNA, 20 bp, Artificial
  CRISPR gRNA sequence
ggctgaggcaggagaatcac

SEQ ID NO: 491520 - DNA, 20 bp, Artificial
  CRISPR gRNA sequence
tgcactccaacctgggcaac

SEQ ID NO: 491521 - DNA, 20 bp, Artificial
  CRISPR gRNA sequence
tagaaaaatcgtaaaatagc

SEQ ID NO: 491522 - DNA, 20 bp, Artificial
  CRISPR gRNA sequence
aaataataaaaagcagatga

SEQ ID NO: 491523 - DNA, 20 bp, Artificial
  CRISPR gRNA sequence
tttatttttccataggttat

SEQ ID NO: 491524 - DNA, 20 bp, Artificial
  CRISPR gRNA sequence
aagttcattagaggtgattt

SEQ ID NO: 491525 - DNA, 20 bp, Artificial
  CRISPR gRNA sequence
atacgttgtttggttttcca

SEQ ID NO: 491526 - DNA, 20 bp, Artificial
  CRISPR gRNA sequence
aaagaaaataactgcctatc

SEQ ID NO: 491527 - DNA, 20 bp, Artificial
  CRISPR gRNA sequence
actttgggaggctgaagcag

SEQ ID NO: 491528 - DNA, 20 bp, Artificial
  CRISPR gRNA sequence
caggtgaatcagttgaggtc

SEQ ID NO: 491529 - DNA, 20 bp, Artificial
  CRISPR gRNA sequence
tactcaggaggctgaggcac

SEQ ID NO: 491530 - DNA, 20 bp, Artificial
  CRISPR gRNA sequence
tggtgccactcccctcctgc

SEQ ID NO: 491531 - DNA, 20 bp, Artificial
  CRISPR gRNA sequence
tagaaaaaattaaaaacgga

SEQ ID NO: 491532 - DNA, 20 bp, Artificial
  CRISPR gRNA sequence
ctgcagtaaaggaaatacca

SEQ ID NO: 491533 - DNA, 20 bp, Artificial
  CRISPR gRNA sequence
atttgtgacaataaaagtgg

SEQ ID NO: 491534 - DNA, 20 bp, Artificial
  CRISPR gRNA sequence
gtggggggatagagctgtat

SEQ ID NO: 491535 - DNA, 20 bp, Artificial
  CRISPR gRNA sequence
agttttctatagtattgagg

SEQ ID NO: 491536 - DNA, 20 bp, Artificial
  CRISPR gRNA sequence
tacagaaaaagaaatgagaa

SEQ ID NO: 491537 - DNA, 20 bp, Artificial
  CRISPR gRNA sequence
tataaaagaaccaattaagt

SEQ ID NO: 491538 - DNA, 20 bp, Artificial
  CRISPR gRNA sequence
taaatccacaactatagttg

SEQ ID NO: 491539 - DNA, 20 bp, Artificial
  CRISPR gRNA sequence
aaaaaaatcaataaggctat

SEQ ID NO: 491540 - DNA, 20 bp, Artificial
  CRISPR gRNA sequence
aacaattctcctaacaattg

SEQ ID NO: 491541 - DNA, 20 bp, Artificial
  CRISPR gRNA sequence
attatgccctctaagcacag

SEQ ID NO: 491542 - DNA, 20 bp, Artificial
  CRISPR gRNA sequence
gaaaaataaccagaaaatct

SEQ ID NO: 491543 - DNA, 20 bp, Artificial
  CRISPR gRNA sequence
aaacatatttctaaaaaccc

SEQ ID NO: 491544 - DNA, 20 bp, Artificial
  CRISPR gRNA sequence
ttctaaaaacccatgagtca

SEQ ID NO: 491545 - DNA, 20 bp, Artificial
  CRISPR gRNA sequence
atatttagagcaaagtgata

SEQ ID NO: 491546 - DNA, 20 bp, Artificial
  CRISPR gRNA sequence
ttggaggtgccttcaccacc

SEQ ID NO: 491547 - DNA, 20 bp, Artificial
  CRISPR gRNA sequence
tacaagagctcctgctctca

SEQ ID NO: 491548 - DNA, 20 bp, Artificial
  CRISPR gRNA sequence
ctgctctcacaggattattg

SEQ ID NO: 491549 - DNA, 20 bp, Artificial
  CRISPR gRNA sequence
ttattgcagaatttatgtgc

SEQ ID NO: 491550 - DNA, 20 bp, Artificial
  CRISPR gRNA sequence
actggtggcaagttcatcta

SEQ ID NO: 491551 - DNA, 20 bp, Artificial
  CRISPR gRNA sequence
tttcatctacattgccgaga

SEQ ID NO: 491552 - DNA, 20 bp, Artificial
  CRISPR gRNA sequence
atctacattgccgagactga

SEQ ID NO: 491553 - DNA, 20 bp, Artificial
  CRISPR gRNA sequence
acattgccgagactgaatgg

SEQ ID NO: 491554 - DNA, 20 bp, Artificial
  CRISPR gRNA sequence
ttggcaagttgaaagggggc

SEQ ID NO: 491555 - DNA, 20 bp, Artificial
  CRISPR gRNA sequence
tgcagacagcatggagccct

SEQ ID NO: 491556 - DNA, 20 bp, Artificial
  CRISPR gRNA sequence
gcatggagccctttgggtcc

SEQ ID NO: 491557 - DNA, 20 bp, Artificial
  CRISPR gRNA sequence
cagcaagaagatcaccattg

SEQ ID NO: 491558 - DNA, 20 bp, Artificial
  CRISPR gRNA sequence
tgctacacagagagaccaag

SEQ ID NO: 491559 - DNA, 20 bp, Artificial
  CRISPR gRNA sequence
atctgaacagacaggccttg

SEQ ID NO: 491560 - DNA, 20 bp, Artificial
  CRISPR gRNA sequence
ctccactcagcctgttagta

SEQ ID NO: 491561 - DNA, 20 bp, Artificial
  CRISPR gRNA sequence
aaattaattgaacccaagga

SEQ ID NO: 491562 - DNA, 20 bp, Artificial
  CRISPR gRNA sequence
acttagaactggtgtggtgg

SEQ ID NO: 491563 - DNA, 20 bp, Artificial
  CRISPR gRNA sequence
ctctccagttagtgtctgaa

SEQ ID NO: 491564 - DNA, 20 bp, Artificial
  CRISPR gRNA sequence
cacccagctggtgtccactg

SEQ ID NO: 491565 - DNA, 20 bp, Artificial
  CRISPR gRNA sequence
ttttgttttactttaagttc

SEQ ID NO: 491566 - DNA, 20 bp, Artificial
  CRISPR gRNA sequence
ctcattgttcaactcccact

SEQ ID NO: 491567 - DNA, 20 bp, Artificial
  CRISPR gRNA sequence
tgcaaactcaggaacagaaa

SEQ ID NO: 491568 - DNA, 20 bp, Artificial
  CRISPR gRNA sequence
aaacaaggaaaatagtcaaa

SEQ ID NO: 491569 - DNA, 20 bp, Artificial
  CRISPR gRNA sequence
aaagggaataaaaattagaa

SEQ ID NO: 491570 - DNA, 20 bp, Artificial
  CRISPR gRNA sequence
tgggcagctcacctgaggtc

SEQ ID NO: 491571 - DNA, 20 bp, Artificial
  CRISPR gRNA sequence
aaaatacaaaaattagccag

SEQ ID NO: 491572 - DNA, 20 bp, Artificial
  CRISPR gRNA sequence
tactcgggaggctgaggcag

SEQ ID NO: 491573 - DNA, 20 bp, Artificial
  CRISPR gRNA sequence
aactccatctcaaaaaaaaa

SEQ ID NO: 491574 - DNA, 20 bp, Artificial
  CRISPR gRNA sequence
aggactatatgaaaaattat

SEQ ID NO: 491575 - DNA, 20 bp, Artificial
  CRISPR gRNA sequence
aaattaatttatagattcaa

SEQ ID NO: 491576 - DNA, 20 bp, Artificial
  CRISPR gRNA sequence
atatgaaaatgtaaaagaca

SEQ ID NO: 491577 - DNA, 20 bp, Artificial
  CRISPR gRNA sequence
agatagcattccagtattgc

SEQ ID NO: 491578 - DNA, 20 bp, Artificial
  CRISPR gRNA sequence
aaggattgaaaagtagtcga

SEQ ID NO: 491579 - DNA, 20 bp, Artificial
  CRISPR gRNA sequence
acttctgtgaccaacgtgtg

SEQ ID NO: 491580 - DNA, 20 bp, Artificial
  CRISPR gRNA sequence
agctcttcagtggacaccaa

SEQ ID NO: 491581 - DNA, 20 bp, Artificial
  CRISPR gRNA sequence
tctgaccaactagctataaa

SEQ ID NO: 491582 - DNA, 20 bp, Artificial
  CRISPR gRNA sequence
ggtttcccgttattccctcc

SEQ ID NO: 491583 - DNA, 20 bp, Artificial
  CRISPR gRNA sequence
aactcagggaaacacattca

SEQ ID NO: 491584 - DNA, 20 bp, Artificial
  CRISPR gRNA sequence
ttattataaaggttattaca

SEQ ID NO: 491585 - DNA, 20 bp, Artificial
  CRISPR gRNA sequence
ataggacaaggtgtagggga

SEQ ID NO: 491586 - DNA, 20 bp, Artificial
  CRISPR gRNA sequence
aaggtgtaggggaagggata

SEQ ID NO: 491587 - DNA, 20 bp, Artificial
  CRISPR gRNA sequence
agctctctgaaccttgttct

SEQ ID NO: 491588 - DNA, 20 bp, Artificial
  CRISPR gRNA sequence
ttatggaggcctcaataaat

SEQ ID NO: 491589 - DNA, 20 bp, Artificial
  CRISPR gRNA sequence
ctgaaggttggggacgggct

SEQ ID NO: 491590 - DNA, 20 bp, Artificial
  CRISPR gRNA sequence
cctacaaaaagacatcactt

SEQ ID NO: 491591 - DNA, 20 bp, Artificial
  CRISPR gRNA sequence
tcggaatttctaaaaatttt

SEQ ID NO: 491592 - DNA, 20 bp, Artificial
  CRISPR gRNA sequence
gcttccaggaaaaagcacaa

SEQ ID NO: 491593 - DNA, 20 bp, Artificial
  CRISPR gRNA sequence
ttttgcatttttggtagaga

SEQ ID NO: 491594 - DNA, 20 bp, Artificial
  CRISPR gRNA sequence
aaataaatcactaaccataa

SEQ ID NO: 491595 - DNA, 20 bp, Artificial
  CRISPR gRNA sequence
ttggtgaaagacaacattga

SEQ ID NO: 491596 - DNA, 20 bp, Artificial
  CRISPR gRNA sequence
tttgaaaaagggctcatatc

SEQ ID NO: 491597 - DNA, 20 bp, Artificial
  CRISPR gRNA sequence
gctcatatccagagtatata

SEQ ID NO: 491598 - DNA, 20 bp, Artificial
  CRISPR gRNA sequence
tgggcaggcactttaggaaa

SEQ ID NO: 491599 - DNA, 20 bp, Artificial
  CRISPR gRNA sequence
aatagccaataggcatgcat

SEQ ID NO: 491600 - DNA, 20 bp, Artificial
  CRISPR gRNA sequence
cccaacaacattagttatca

SEQ ID NO: 491601 - DNA, 20 bp, Artificial
  CRISPR gRNA sequence
cagcactttgggaggccgag

SEQ ID NO: 491602 - DNA, 20 bp, Artificial
  CRISPR gRNA sequence
actttgggaggccgaggcgg

SEQ ID NO: 491603 - DNA, 20 bp, Artificial
  CRISPR gRNA sequence
cgggtggatcgcttgaggcc

SEQ ID NO: 491604 - DNA, 20 bp, Artificial
  CRISPR gRNA sequence
gcctgtaataccagcttctt

SEQ ID NO: 491605 - DNA, 20 bp, Artificial
  CRISPR gRNA sequence
ttcttgggagtctgaggcag

SEQ ID NO: 491606 - DNA, 20 bp, Artificial
  CRISPR gRNA sequence
tcacgccactgtactccagc

SEQ ID NO: 491607 - DNA, 20 bp, Artificial
  CRISPR gRNA sequence
taaataaatgtgaaaattcc

SEQ ID NO: 491608 - DNA, 20 bp, Artificial
  CRISPR gRNA sequence
gattctcatttattgctagt

SEQ ID NO: 491609 - DNA, 20 bp, Artificial
  CRISPR gRNA sequence
acatataccctttgatccag

SEQ ID NO: 491610 - DNA, 20 bp, Artificial
  CRISPR gRNA sequence
actttgggaggtcgaggcag

SEQ ID NO: 491611 - DNA, 20 bp, Artificial
  CRISPR gRNA sequence
caggcggatcacctgaggtc

SEQ ID NO: 491612 - DNA, 20 bp, Artificial
  CRISPR gRNA sequence
tacttggaagactgaagcag

SEQ ID NO: 491613 - DNA, 20 bp, Artificial
  CRISPR gRNA sequence
tgcactccagcctgggcaac

SEQ ID NO: 491614 - DNA, 20 bp, Artificial
  CRISPR gRNA sequence
tatccactaaaaatatgtac

SEQ ID NO: 491615 - DNA, 20 bp, Artificial
  CRISPR gRNA sequence
aatcgtgttatagtcttata

SEQ ID NO: 491616 - DNA, 20 bp, Artificial
  CRISPR gRNA sequence
ctacttttcctggcaataat

SEQ ID NO: 491617 - DNA, 20 bp, Artificial
  CRISPR gRNA sequence
ttttcctggcaataatgtgg

SEQ ID NO: 491618 - DNA, 20 bp, Artificial
  CRISPR gRNA sequence
ggatggatctcaccacaatg

SEQ ID NO: 491619 - DNA, 20 bp, Artificial
  CRISPR gRNA sequence
tagactccaaaaagtacata

SEQ ID NO: 491620 - DNA, 20 bp, Artificial
  CRISPR gRNA sequence
taatatatggtgagagaggt

SEQ ID NO: 491621 - DNA, 20 bp, Artificial
  CRISPR gRNA sequence
tgtgattacccttgcaggag

SEQ ID NO: 491622 - DNA, 20 bp, Artificial
  CRISPR gRNA sequence
atcaacttgaagggccaaaa

SEQ ID NO: 491623 - DNA, 20 bp, Artificial
  CRISPR gRNA sequence
gaagggccaaaaaggaatga

SEQ ID NO: 491624 - DNA, 20 bp, Artificial
  CRISPR gRNA sequence
gaaatgtgttacatcttgat

SEQ ID NO: 491625 - DNA, 20 bp, Artificial
  CRISPR gRNA sequence
taaattttgtgcacacagct

SEQ ID NO: 491626 - DNA, 20 bp, Artificial
  CRISPR gRNA sequence
tcttggtaaaaaagcagaaa

SEQ ID NO: 491627 - DNA, 20 bp, Artificial
  CRISPR gRNA sequence
tggaaacattaccatagcaa

SEQ ID NO: 491628 - DNA, 20 bp, Artificial
  CRISPR gRNA sequence
atcagaaaagcctgggaggc

SEQ ID NO: 491629 - DNA, 20 bp, Artificial
  CRISPR gRNA sequence
ctgcaccactgcaccccagc

SEQ ID NO: 491630 - DNA, 20 bp, Artificial
  CRISPR gRNA sequence
cagccaactgaaatgcaata

SEQ ID NO: 491631 - DNA, 20 bp, Artificial
  CRISPR gRNA sequence
atgtgctatggaggtgtgcc

SEQ ID NO: 491632 - DNA, 20 bp, Artificial
  CRISPR gRNA sequence
gcatgttttcctctgccctg

SEQ ID NO: 491633 - DNA, 20 bp, Artificial
  CRISPR gRNA sequence
ttcctctgccctgcagagtt

SEQ ID NO: 491634 - DNA, 20 bp, Artificial
  CRISPR gRNA sequence
ggagtggctgcccagaggcg

SEQ ID NO: 491635 - DNA, 20 bp, Artificial
  CRISPR gRNA sequence
tgcagaaaggaacagggaag

SEQ ID NO: 491636 - DNA, 20 bp, Artificial
  CRISPR gRNA sequence
acaaaacacacgtgtggctt

SEQ ID NO: 491637 - DNA, 20 bp, Artificial
  CRISPR gRNA sequence
gtaaagatggagcaggtttg

SEQ ID NO: 491638 - DNA, 20 bp, Artificial
  CRISPR gRNA sequence
gatggagcaggtttggagaa

SEQ ID NO: 491639 - DNA, 20 bp, Artificial
  CRISPR gRNA sequence
ggagaatggggtgatggaac

SEQ ID NO: 491640 - DNA, 20 bp, Artificial
  CRISPR gRNA sequence
catataatccaccagtagat

SEQ ID NO: 491641 - DNA, 20 bp, Artificial
  CRISPR gRNA sequence
tgttctctgctattataaaa

SEQ ID NO: 491642 - DNA, 20 bp, Artificial
  CRISPR gRNA sequence
ctgctattataaaactgaat

SEQ ID NO: 491643 - DNA, 20 bp, Artificial
  CRISPR gRNA sequence
tttgtttgtttgttttaaga

SEQ ID NO: 491644 - DNA, 20 bp, Artificial
  CRISPR gRNA sequence
gattctcctgtctcagcctc

SEQ ID NO: 491645 - DNA, 20 bp, Artificial
  CRISPR gRNA sequence
ttttgtatttttagtagaga

SEQ ID NO: 491646 - DNA, 20 bp, Artificial
  CRISPR gRNA sequence
catagacttctaaatactta

SEQ ID NO: 491647 - DNA, 20 bp, Artificial
  CRISPR gRNA sequence
tcctcatgctatactgcctt

SEQ ID NO: 491648 - DNA, 20 bp, Artificial
  CRISPR gRNA sequence
ggagcagctgaagaaagatg

SEQ ID NO: 491649 - DNA, 20 bp, Artificial
  CRISPR gRNA sequence
ctggtgccctgagcacacag

SEQ ID NO: 491650 - DNA, 20 bp, Artificial
  CRISPR gRNA sequence
aggcaaatgtggccatttac

SEQ ID NO: 491651 - DNA, 20 bp, Artificial
  CRISPR gRNA sequence
agacttgttggcaaggttgg

SEQ ID NO: 491652 - DNA, 20 bp, Artificial
  CRISPR gRNA sequence
tgaaagagatgacgaaggtg

SEQ ID NO: 491653 - DNA, 20 bp, Artificial
  CRISPR gRNA sequence
agaagctgtgggccagaaat

SEQ ID NO: 491654 - DNA, 20 bp, Artificial
  CRISPR gRNA sequence
atgaggattcccaggacact

SEQ ID NO: 491655 - DNA, 20 bp, Artificial
  CRISPR gRNA sequence
caggacactgagagtccagc

SEQ ID NO: 491656 - DNA, 20 bp, Artificial
  CRISPR gRNA sequence
tccagctggggttggagatt

SEQ ID NO: 491657 - DNA, 20 bp, Artificial
  CRISPR gRNA sequence
tctgtagctgctctttgttg

SEQ ID NO: 491658 - DNA, 20 bp, Artificial
  CRISPR gRNA sequence
gtgggaaggaggaagatggt

SEQ ID NO: 491659 - DNA, 20 bp, Artificial
  CRISPR gRNA sequence
gaaggaggaagatggttgga

SEQ ID NO: 491660 - DNA, 20 bp, Artificial
  CRISPR gRNA sequence
gtttccatggacggcctgga

SEQ ID NO: 491661 - DNA, 20 bp, Artificial
  CRISPR gRNA sequence
ccatggacggcctggaaggg

SEQ ID NO: 491662 - DNA, 20 bp, Artificial
  CRISPR gRNA sequence
gaaggggtgggtgccagggc

SEQ ID NO: 491663 - DNA, 20 bp, Artificial
  CRISPR gRNA sequence
agtagacaagtcactatgtc

SEQ ID NO: 491664 - DNA, 20 bp, Artificial
  CRISPR gRNA sequence
gacctcagtttctgtcccag

SEQ ID NO: 491665 - DNA, 20 bp, Artificial
  CRISPR gRNA sequence
ccaccttcctgtggttaaga

SEQ ID NO: 491666 - DNA, 20 bp, Artificial
  CRISPR gRNA sequence
ctgcagcctcaggaagaaca

SEQ ID NO: 491667 - DNA, 20 bp, Artificial
  CRISPR gRNA sequence
tggtcaaggagacaagtaca

SEQ ID NO: 491668 - DNA, 20 bp, Artificial
  CRISPR gRNA sequence
ggagacaatctgatccagca

SEQ ID NO: 491669 - DNA, 20 bp, Artificial
  CRISPR gRNA sequence
ctgagcccatgtgcagagct

SEQ ID NO: 491670 - DNA, 20 bp, Artificial
  CRISPR gRNA sequence
acctgggagaaggagcacgg

SEQ ID NO: 491671 - DNA, 20 bp, Artificial
  CRISPR gRNA sequence
cgggagggtctcagagcaag

SEQ ID NO: 491672 - DNA, 20 bp, Artificial
  CRISPR gRNA sequence
agggcttgtgctaccaggct

SEQ ID NO: 491673 - DNA, 20 bp, Artificial
  CRISPR gRNA sequence
cctgctggggactaagtgaa

SEQ ID NO: 491674 - DNA, 20 bp, Artificial
  CRISPR gRNA sequence
ccccagtgttcctacctaga

SEQ ID NO: 491675 - DNA, 20 bp, Artificial
  CRISPR gRNA sequence
cctctgtctgaaagattctt

SEQ ID NO: 491676 - DNA, 20 bp, Artificial
  CRISPR gRNA sequence
gtctgaaagattcttaaggg

SEQ ID NO: 491677 - DNA, 20 bp, Artificial
  CRISPR gRNA sequence
agcataataagggctgggga

SEQ ID NO: 491678 - DNA, 20 bp, Artificial
  CRISPR gRNA sequence
aagggctggggaaagagttt

SEQ ID NO: 491679 - DNA, 20 bp, Artificial
  CRISPR gRNA sequence
acagtaaaggaaacaattca

SEQ ID NO: 491680 - DNA, 20 bp, Artificial
  CRISPR gRNA sequence
cagagtgaaaaggcaaccaa

SEQ ID NO: 491681 - DNA, 20 bp, Artificial
  CRISPR gRNA sequence
aggaaaaaaaattgcaaact

SEQ ID NO: 491682 - DNA, 20 bp, Artificial
  CRISPR gRNA sequence
tcctacaggcaactaatatg

SEQ ID NO: 491683 - DNA, 20 bp, Artificial
  CRISPR gRNA sequence
acaacccaagcaagggcttc

SEQ ID NO: 491684 - DNA, 20 bp, Artificial
  CRISPR gRNA sequence
cctaaaaatgactctattgt

SEQ ID NO: 491685 - DNA, 20 bp, Artificial
  CRISPR gRNA sequence
tctattgtcagaatttcatg

SEQ ID NO: 491686 - DNA, 20 bp, Artificial
  CRISPR gRNA sequence
aacagtttgacagcatctgc

SEQ ID NO: 491687 - DNA, 20 bp, Artificial
  CRISPR gRNA sequence
gttcatcaataatagaaaag

SEQ ID NO: 491688 - DNA, 20 bp, Artificial
  CRISPR gRNA sequence
gagcaaaagtagtcagacac

SEQ ID NO: 491689 - DNA, 20 bp, Artificial
  CRISPR gRNA sequence
aaatctgtgatgttagaagt

SEQ ID NO: 491690 - DNA, 20 bp, Artificial
  CRISPR gRNA sequence
tatggaagacagaggaagta

SEQ ID NO: 491691 - DNA, 20 bp, Artificial
  CRISPR gRNA sequence
agagaacatgtggtagacac

SEQ ID NO: 491692 - DNA, 20 bp, Artificial
  CRISPR gRNA sequence
aatttgggaggccaaggcaa

SEQ ID NO: 491693 - DNA, 20 bp, Artificial
  CRISPR gRNA sequence
tactaaggaggctgaggcag

SEQ ID NO: 491694 - DNA, 20 bp, Artificial
  CRISPR gRNA sequence
tcacatcactgcactccagc

SEQ ID NO: 491695 - DNA, 20 bp, Artificial
  CRISPR gRNA sequence
ctctccttgaagtgatttca

SEQ ID NO: 491696 - DNA, 20 bp, Artificial
  CRISPR gRNA sequence
tgatttcagtggattccttt

SEQ ID NO: 491697 - DNA, 20 bp, Artificial
  CRISPR gRNA sequence
ttctggatggtgctgtagcc

SEQ ID NO: 491698 - DNA, 20 bp, Artificial
  CRISPR gRNA sequence
gtgctgtagcccagggtaca

SEQ ID NO: 491699 - DNA, 20 bp, Artificial
  CRISPR gRNA sequence
ccagcccttctacagcttgc

SEQ ID NO: 491700 - DNA, 20 bp, Artificial
  CRISPR gRNA sequence
actcaggctgtaaagcatct

SEQ ID NO: 491701 - DNA, 20 bp, Artificial
  CRISPR gRNA sequence
cctccagcctgtgtgtcctt

SEQ ID NO: 491702 - DNA, 20 bp, Artificial
  CRISPR gRNA sequence
tcagaacggacaactgaaac

SEQ ID NO: 491703 - DNA, 20 bp, Artificial
  CRISPR gRNA sequence
ggacaactgaaacctgaatt

SEQ ID NO: 491704 - DNA, 20 bp, Artificial
  CRISPR gRNA sequence
acctgaattttgggtctaaa

SEQ ID NO: 491705 - DNA, 20 bp, Artificial
  CRISPR gRNA sequence
ggccctggacttacttgcca

SEQ ID NO: 491706 - DNA, 20 bp, Artificial
  CRISPR gRNA sequence
attcaaaatatatccagaga

SEQ ID NO: 491707 - DNA, 20 bp, Artificial
  CRISPR gRNA sequence
tgtgaaaataagtatctact

SEQ ID NO: 491708 - DNA, 20 bp, Artificial
  CRISPR gRNA sequence
cagacaaaagccctggcctc

SEQ ID NO: 491709 - DNA, 20 bp, Artificial
  CRISPR gRNA sequence
aaatgaaaaacataagtaaa

SEQ ID NO: 491710 - DNA, 20 bp, Artificial
  CRISPR gRNA sequence
aattaagtggagagagagct

SEQ ID NO: 491711 - DNA, 20 bp, Artificial
  CRISPR gRNA sequence
gagagagagctaagagtttg

SEQ ID NO: 491712 - DNA, 20 bp, Artificial
  CRISPR gRNA sequence
ggtatttgagcaaaactctg

SEQ ID NO: 491713 - DNA, 20 bp, Artificial
  CRISPR gRNA sequence
catcccaggcagagaaaact

SEQ ID NO: 491714 - DNA, 20 bp, Artificial
  CRISPR gRNA sequence
gagcaagaggagagacaaag

SEQ ID NO: 491715 - DNA, 20 bp, Artificial
  CRISPR gRNA sequence
aagaggagagacaaagagga

SEQ ID NO: 491716 - DNA, 20 bp, Artificial
  CRISPR gRNA sequence
atgaaagaagaagtctttgg

SEQ ID NO: 491717 - DNA, 20 bp, Artificial
  CRISPR gRNA sequence
ggaagaatttcgcaatgctc

SEQ ID NO: 491718 - DNA, 20 bp, Artificial
  CRISPR gRNA sequence
tgtcatcatatgactcctga

SEQ ID NO: 491719 - DNA, 20 bp, Artificial
  CRISPR gRNA sequence
actttgggagactgaggcag

SEQ ID NO: 491720 - DNA, 20 bp, Artificial
  CRISPR gRNA sequence
caggtggatcgcctgagccc

SEQ ID NO: 491721 - DNA, 20 bp, Artificial
  CRISPR gRNA sequence
taccagggaggctgaggtgg

SEQ ID NO: 491722 - DNA, 20 bp, Artificial
  CRISPR gRNA sequence
gcatgccactgcactccagt

SEQ ID NO: 491723 - DNA, 20 bp, Artificial
  CRISPR gRNA sequence
agcacttttgagaggcggag

SEQ ID NO: 491724 - DNA, 20 bp, Artificial
  CRISPR gRNA sequence
cttttgagaggcggaggtgg

SEQ ID NO: 491725 - DNA, 20 bp, Artificial
  CRISPR gRNA sequence
tgggtggatcacttgaggtc

SEQ ID NO: 491726 - DNA, 20 bp, Artificial
  CRISPR gRNA sequence
ataaaaatgcatatgataac

SEQ ID NO: 491727 - DNA, 20 bp, Artificial
  CRISPR gRNA sequence
acaactggcttgtcttcttc

SEQ ID NO: 491728 - DNA, 20 bp, Artificial
  CRISPR gRNA sequence
gaacatgagaaacataacaa

SEQ ID NO: 491729 - DNA, 20 bp, Artificial
  CRISPR gRNA sequence
tacatgatcttgattgcatc

SEQ ID NO: 491730 - DNA, 20 bp, Artificial
  CRISPR gRNA sequence
cttgggacaattggtaatat

SEQ ID NO: 491731 - DNA, 20 bp, Artificial
  CRISPR gRNA sequence
tggtattaatgttaaattta

SEQ ID NO: 491732 - DNA, 20 bp, Artificial
  CRISPR gRNA sequence
caattgtgctgtagtaacat

SEQ ID NO: 491733 - DNA, 20 bp, Artificial
  CRISPR gRNA sequence
catgagaatgtctttgttca

SEQ ID NO: 491734 - DNA, 20 bp, Artificial
  CRISPR gRNA sequence
atataagtgctaaaatattt

SEQ ID NO: 491735 - DNA, 20 bp, Artificial
  CRISPR gRNA sequence
atgtgataaaatgttaattg

SEQ ID NO: 491736 - DNA, 20 bp, Artificial
  CRISPR gRNA sequence
aatctagatgaaagaaattc

SEQ ID NO: 491737 - DNA, 20 bp, Artificial
  CRISPR gRNA sequence
ccaggcctgccctatagaca

SEQ ID NO: 491738 - DNA, 20 bp, Artificial
  CRISPR gRNA sequence
agctatggtgctgaagccct

SEQ ID NO: 491739 - DNA, 20 bp, Artificial
  CRISPR gRNA sequence
ggtgctgaagccctgggaat

SEQ ID NO: 491740 - DNA, 20 bp, Artificial
  CRISPR gRNA sequence
gtcacacaggctcatgacct

SEQ ID NO: 491741 - DNA, 20 bp, Artificial
  CRISPR gRNA sequence
cggctgtctgagctgcattc

SEQ ID NO: 491742 - DNA, 20 bp, Artificial
  CRISPR gRNA sequence
tccaacctagctctcctgcc

SEQ ID NO: 491743 - DNA, 20 bp, Artificial
  CRISPR gRNA sequence
tgcctgcatccttacaaatg

SEQ ID NO: 491744 - DNA, 20 bp, Artificial
  CRISPR gRNA sequence
tgtgtcttcctgaaggacac

SEQ ID NO: 491745 - DNA, 20 bp, Artificial
  CRISPR gRNA sequence
aatgctcagggactcggtaa

SEQ ID NO: 491746 - DNA, 20 bp, Artificial
  CRISPR gRNA sequence
tcagggactcggtaactgaa

SEQ ID NO: 491747 - DNA, 20 bp, Artificial
  CRISPR gRNA sequence
cagtttcccctctttgtgcc

SEQ ID NO: 491748 - DNA, 20 bp, Artificial
  CRISPR gRNA sequence
ccacctccgtgaagcccctg

SEQ ID NO: 491749 - DNA, 20 bp, Artificial
  CRISPR gRNA sequence
acacctgtaatcccagcact

SEQ ID NO: 491750 - DNA, 20 bp, Artificial
  CRISPR gRNA sequence
tgggcagatcacctgaggtc

SEQ ID NO: 491751 - DNA, 20 bp, Artificial
  CRISPR gRNA sequence
tactcgggaggctgaggcat

SEQ ID NO: 491752 - DNA, 20 bp, Artificial
  CRISPR gRNA sequence
aatcacttgaacccgggagg

SEQ ID NO: 491753 - DNA, 20 bp, Artificial
  CRISPR gRNA sequence
tcacgccactgcactccagc

SEQ ID NO: 491754 - DNA, 20 bp, Artificial
  CRISPR gRNA sequence
taattcaattaaattaaatg

SEQ ID NO: 491755 - DNA, 20 bp, Artificial
  CRISPR gRNA sequence
agaggggagcagccctcagc

SEQ ID NO: 491756 - DNA, 20 bp, Artificial
  CRISPR gRNA sequence
agccctcagctgggatcccc

SEQ ID NO: 491757 - DNA, 20 bp, Artificial
  CRISPR gRNA sequence
tttccaggctcctgtggcat

SEQ ID NO: 491758 - DNA, 20 bp, Artificial
  CRISPR gRNA sequence
gggctcagctttcctgcctc

SEQ ID NO: 491759 - DNA, 20 bp, Artificial
  CRISPR gRNA sequence
cttctctcatgccacaattg

SEQ ID NO: 491760 - DNA, 20 bp, Artificial
  CRISPR gRNA sequence
cttctctctccactacacgg

SEQ ID NO: 491761 - DNA, 20 bp, Artificial
  CRISPR gRNA sequence
gtaaattgaagccagtggga

SEQ ID NO: 491762 - DNA, 20 bp, Artificial
  CRISPR gRNA sequence
atctcctcacccaagacttc

SEQ ID NO: 491763 - DNA, 20 bp, Artificial
  CRISPR gRNA sequence
cagagctgtcaggagctgct

SEQ ID NO: 491764 - DNA, 20 bp, Artificial
  CRISPR gRNA sequence
gatacaccttgaggagcagg

SEQ ID NO: 491765 - DNA, 20 bp, Artificial
  CRISPR gRNA sequence
ttgaggagcaggaggagtat

SEQ ID NO: 491766 - DNA, 20 bp, Artificial
  CRISPR gRNA sequence
gtgaagcttacctcaagtgg

SEQ ID NO: 491767 - DNA, 20 bp, Artificial
  CRISPR gRNA sequence
gcaattttgaaactggcttt

SEQ ID NO: 491768 - DNA, 20 bp, Artificial
  CRISPR gRNA sequence
tgctgagcccgtgcacggca

SEQ ID NO: 491769 - DNA, 20 bp, Artificial
  CRISPR gRNA sequence
gtgcacggcagagagtctgg

SEQ ID NO: 491770 - DNA, 20 bp, Artificial
  CRISPR gRNA sequence
tgcactgggaggtctgtgag

SEQ ID NO: 491771 - DNA, 20 bp, Artificial
  CRISPR gRNA sequence
caccagcaatccaggaagtc

SEQ ID NO: 491772 - DNA, 20 bp, Artificial
  CRISPR gRNA sequence
agagaagcagtcccaaggaa

SEQ ID NO: 491773 - DNA, 20 bp, Artificial
  CRISPR gRNA sequence
gttctcgagctcagagacag

SEQ ID NO: 491774 - DNA, 20 bp, Artificial
  CRISPR gRNA sequence
tggaaattattagggacatg

SEQ ID NO: 491775 - DNA, 20 bp, Artificial
  CRISPR gRNA sequence
gccatctaacatttactcct

SEQ ID NO: 491776 - DNA, 20 bp, Artificial
  CRISPR gRNA sequence
ctcccctctttctccagttc

SEQ ID NO: 491777 - DNA, 20 bp, Artificial
  CRISPR gRNA sequence
ctttctccagttctggggtc

SEQ ID NO: 491778 - DNA, 20 bp, Artificial
  CRISPR gRNA sequence
ggtccaggatgctctgaaac

SEQ ID NO: 491779 - DNA, 20 bp, Artificial
  CRISPR gRNA sequence
ggatcccgcatttaatttaa

SEQ ID NO: 491780 - DNA, 20 bp, Artificial
  CRISPR gRNA sequence
tatttatttattttttgaga

SEQ ID NO: 491781 - DNA, 20 bp, Artificial
  CRISPR gRNA sequence
tctccttctgtcacccaggc

SEQ ID NO: 491782 - DNA, 20 bp, Artificial
  CRISPR gRNA sequence
ctcactacaaactctgcctc

SEQ ID NO: 491783 - DNA, 20 bp, Artificial
  CRISPR gRNA sequence
gattctcatgcctcagcctc

SEQ ID NO: 491784 - DNA, 20 bp, Artificial
  CRISPR gRNA sequence
gtctcccccatccaaagtgc

SEQ ID NO: 491785 - DNA, 20 bp, Artificial
  CRISPR gRNA sequence
tgtgagccaccatgcccagc

SEQ ID NO: 491786 - DNA, 20 bp, Artificial
  CRISPR gRNA sequence
cttcacggaggtggagagcg

SEQ ID NO: 491787 - DNA, 20 bp, Artificial
  CRISPR gRNA sequence
tggagagcgtggaattagag

SEQ ID NO: 491788 - DNA, 20 bp, Artificial
  CRISPR gRNA sequence
aaactgaggcatagtgttgt

SEQ ID NO: 491789 - DNA, 20 bp, Artificial
  CRISPR gRNA sequence
ccaggtactcaattcagtta

SEQ ID NO: 491790 - DNA, 20 bp, Artificial
  CRISPR gRNA sequence
caggtggactcaacatttgt

SEQ ID NO: 491791 - DNA, 20 bp, Artificial
  CRISPR gRNA sequence
ggaacagggagcagggaggg

SEQ ID NO: 491792 - DNA, 20 bp, Artificial
  CRISPR gRNA sequence
gagtggagcctgcagctctt

SEQ ID NO: 491793 - DNA, 20 bp, Artificial
  CRISPR gRNA sequence
ggagcctgcagctcttgtgg

SEQ ID NO: 491794 - DNA, 20 bp, Artificial
  CRISPR gRNA sequence
ggttggggggcctagtggcc

SEQ ID NO: 491795 - DNA, 20 bp, Artificial
  CRISPR gRNA sequence
gctaggttggaacctggtct

SEQ ID NO: 491796 - DNA, 20 bp, Artificial
  CRISPR gRNA sequence
ggaacctggtctaaggatcc

SEQ ID NO: 491797 - DNA, 20 bp, Artificial
  CRISPR gRNA sequence
gacagccgaaggaggactga

SEQ ID NO: 491798 - DNA, 20 bp, Artificial
  CRISPR gRNA sequence
tgggattggtgcctggctgt

SEQ ID NO: 491799 - DNA, 20 bp, Artificial
  CRISPR gRNA sequence
tggtgcctggctgtggggat

SEQ ID NO: 491800 - DNA, 20 bp, Artificial
  CRISPR gRNA sequence
gcccttgcacggtgaagctg

SEQ ID NO: 491801 - DNA, 20 bp, Artificial
  CRISPR gRNA sequence
gtgacttgttaggcacaggg

SEQ ID NO: 491802 - DNA, 20 bp, Artificial
  CRISPR gRNA sequence
aggcacagggagggatggac

SEQ ID NO: 491803 - DNA, 20 bp, Artificial
  CRISPR gRNA sequence
tgaagttccagggaagctgc

SEQ ID NO: 491804 - DNA, 20 bp, Artificial
  CRISPR gRNA sequence
aagaatagttcaaacgattc

SEQ ID NO: 491805 - DNA, 20 bp, Artificial
  CRISPR gRNA sequence
cacatattaccaattgtccc

SEQ ID NO: 491806 - DNA, 20 bp, Artificial
  CRISPR gRNA sequence
gacaagccagttgttttgta

SEQ ID NO: 491807 - DNA, 20 bp, Artificial
  CRISPR gRNA sequence
tttgtagagggttccttaat

SEQ ID NO: 491808 - DNA, 20 bp, Artificial
  CRISPR gRNA sequence
ttattattattttttagaga

SEQ ID NO: 491809 - DNA, 20 bp, Artificial
  CRISPR gRNA sequence
tctcgctctgtggcctgggc

SEQ ID NO: 491810 - DNA, 20 bp, Artificial
  CRISPR gRNA sequence
tcactgcaacttctgctccc

SEQ ID NO: 491811 - DNA, 20 bp, Artificial
  CRISPR gRNA sequence
gattgtcctgcctcagcctc

SEQ ID NO: 491812 - DNA, 20 bp, Artificial
  CRISPR gRNA sequence
ttttgtatttttggtggaga

SEQ ID NO: 491813 - DNA, 20 bp, Artificial
  CRISPR gRNA sequence
cctccgcctctcaaaagtgc

SEQ ID NO: 491814 - DNA, 20 bp, Artificial
  CRISPR gRNA sequence
cctattattatttttcaaga

SEQ ID NO: 491815 - DNA, 20 bp, Artificial
  CRISPR gRNA sequence
tctggttctttcacccagac

SEQ ID NO: 491816 - DNA, 20 bp, Artificial
  CRISPR gRNA sequence
tttttttttttttgtagata

SEQ ID NO: 491817 - DNA, 20 bp, Artificial
  CRISPR gRNA sequence
cagggtttccccatgttgcc

SEQ ID NO: 491818 - DNA, 20 bp, Artificial
  CRISPR gRNA sequence
atattatatgcatttttgac

SEQ ID NO: 491819 - DNA, 20 bp, Artificial
  CRISPR gRNA sequence
ctttttcagcgcatcccatc

SEQ ID NO: 491820 - DNA, 20 bp, Artificial
  CRISPR gRNA sequence
ttaaaaaaccactttgttta

SEQ ID NO: 491821 - DNA, 20 bp, Artificial
  CRISPR gRNA sequence
tgtttactgaataatttaac

SEQ ID NO: 491822 - DNA, 20 bp, Artificial
  CRISPR gRNA sequence
caaagacttcttctttcatg

SEQ ID NO: 491823 - DNA, 20 bp, Artificial
  CRISPR gRNA sequence
tatccacagttttctctgcc

SEQ ID NO: 491824 - DNA, 20 bp, Artificial
  CRISPR gRNA sequence
ggcctcttccctcaacccct

SEQ ID NO: 491825 - DNA, 20 bp, Artificial
  CRISPR gRNA sequence
tctctgttcccattctttct

SEQ ID NO: 491826 - DNA, 20 bp, Artificial
  CRISPR gRNA sequence
attctttctctggatatatt

SEQ ID NO: 491827 - DNA, 20 bp, Artificial
  CRISPR gRNA sequence
agctctgaaccagggctatt

SEQ ID NO: 491828 - DNA, 20 bp, Artificial
  CRISPR gRNA sequence
gagagcttgcgctagattgc

SEQ ID NO: 491829 - DNA, 20 bp, Artificial
  CRISPR gRNA sequence
aggtgttcaaaacatgtttg

SEQ ID NO: 491830 - DNA, 20 bp, Artificial
  CRISPR gRNA sequence
gttcaaaacatgtttgttga

SEQ ID NO: 491831 - DNA, 20 bp, Artificial
  CRISPR gRNA sequence
catgtttgttgagtgaataa

SEQ ID NO: 491832 - DNA, 20 bp, Artificial
  CRISPR gRNA sequence
aggcatcttaacgggcagcc

SEQ ID NO: 491833 - DNA, 20 bp, Artificial
  CRISPR gRNA sequence
cgggcagcctgggatgtttt

SEQ ID NO: 491834 - DNA, 20 bp, Artificial
  CRISPR gRNA sequence
ggttagacatattgggaagg

SEQ ID NO: 491835 - DNA, 20 bp, Artificial
  CRISPR gRNA sequence
gatcttcaaatcattgccca

SEQ ID NO: 491836 - DNA, 20 bp, Artificial
  CRISPR gRNA sequence
ggacacacaggctggaggct

SEQ ID NO: 491837 - DNA, 20 bp, Artificial
  CRISPR gRNA sequence
atccccagatgctttacagc

SEQ ID NO: 491838 - DNA, 20 bp, Artificial
  CRISPR gRNA sequence
acaccttatagattagctcc

SEQ ID NO: 491839 - DNA, 20 bp, Artificial
  CRISPR gRNA sequence
gttggaactgtcacttctca

SEQ ID NO: 491840 - DNA, 20 bp, Artificial
  CRISPR gRNA sequence
ctaactgcgactgctttggc

SEQ ID NO: 491841 - DNA, 20 bp, Artificial
  CRISPR gRNA sequence
caggcaagctgtagaagggc

SEQ ID NO: 491842 - DNA, 20 bp, Artificial
  CRISPR gRNA sequence
attgcacctcccctccaaca

SEQ ID NO: 491843 - DNA, 20 bp, Artificial
  CRISPR gRNA sequence
cacctcccctccaacaaagg

SEQ ID NO: 491844 - DNA, 20 bp, Artificial
  CRISPR gRNA sequence
gctggacacagaaaagagat

SEQ ID NO: 491845 - DNA, 20 bp, Artificial
  CRISPR gRNA sequence
ggctacagcaccatccagaa

SEQ ID NO: 491846 - DNA, 20 bp, Artificial
  CRISPR gRNA sequence
atttttatttttttgtgaga

SEQ ID NO: 491847 - DNA, 20 bp, Artificial
  CRISPR gRNA sequence
tcttgctctatcacccaggc

SEQ ID NO: 491848 - DNA, 20 bp, Artificial
  CRISPR gRNA sequence
ttttaatttttgtgtagaga

SEQ ID NO: 491849 - DNA, 20 bp, Artificial
  CRISPR gRNA sequence
gccttggcctcccaaattac

SEQ ID NO: 491850 - DNA, 20 bp, Artificial
  CRISPR gRNA sequence
atttgttttgtccgtatata

SEQ ID NO: 491851 - DNA, 20 bp, Artificial
  CRISPR gRNA sequence
tttctattattgatgaacct

SEQ ID NO: 491852 - DNA, 20 bp, Artificial
  CRISPR gRNA sequence
cttttgtgcatgcatgtctg

SEQ ID NO: 491853 - DNA, 20 bp, Artificial
  CRISPR gRNA sequence
tatctctaggggcagaacca

SEQ ID NO: 491854 - DNA, 20 bp, Artificial
  CRISPR gRNA sequence
ggttgaaccaaatagtgcat

SEQ ID NO: 491855 - DNA, 20 bp, Artificial
  CRISPR gRNA sequence
tggcaagaggccaaaggcaa

SEQ ID NO: 491856 - DNA, 20 bp, Artificial
  CRISPR gRNA sequence
cctgcatgaaattctgacaa

SEQ ID NO: 491857 - DNA, 20 bp, Artificial
  CRISPR gRNA sequence
ctgacaatagagtcattttt

SEQ ID NO: 491858 - DNA, 20 bp, Artificial
  CRISPR gRNA sequence
gagttatgtgagatgcattg

SEQ ID NO: 491859 - DNA, 20 bp, Artificial
  CRISPR gRNA sequence
tgttgaattaattaatttaa

SEQ ID NO: 491860 - DNA, 20 bp, Artificial
  CRISPR gRNA sequence
cggattcatgaagcccttgc

SEQ ID NO: 491861 - DNA, 20 bp, Artificial
  CRISPR gRNA sequence
tcattttgctgttgtgacgt

SEQ ID NO: 491862 - DNA, 20 bp, Artificial
  CRISPR gRNA sequence
ttctgcatattagttgcctg

SEQ ID NO: 491863 - DNA, 20 bp, Artificial
  CRISPR gRNA sequence
attggttgccttttcactct

SEQ ID NO: 491864 - DNA, 20 bp, Artificial
  CRISPR gRNA sequence
cagatgtctattctaccctt

SEQ ID NO: 491865 - DNA, 20 bp, Artificial
  CRISPR gRNA sequence
aatctttcagacagaggaaa

SEQ ID NO: 491866 - DNA, 20 bp, Artificial
  CRISPR gRNA sequence
attaacaggcaagatacatt

SEQ ID NO: 491867 - DNA, 20 bp, Artificial
  CRISPR gRNA sequence
acactggggaactggccttg

SEQ ID NO: 491868 - DNA, 20 bp, Artificial
  CRISPR gRNA sequence
actggccttgaagaataaat

SEQ ID NO: 491869 - DNA, 20 bp, Artificial
  CRISPR gRNA sequence
aggaaacagctcagaaaagc

SEQ ID NO: 491870 - DNA, 20 bp, Artificial
  CRISPR gRNA sequence
tcagaaaagccagggttgca

SEQ ID NO: 491871 - DNA, 20 bp, Artificial
  CRISPR gRNA sequence
aagccagggttgcatggggt

SEQ ID NO: 491872 - DNA, 20 bp, Artificial
  CRISPR gRNA sequence
tgatttggttaactgatgca

SEQ ID NO: 491873 - DNA, 20 bp, Artificial
  CRISPR gRNA sequence
aagagtgggacttgggctag

SEQ ID NO: 491874 - DNA, 20 bp, Artificial
  CRISPR gRNA sequence
gtgagttttgacagaggtaa

SEQ ID NO: 491875 - DNA, 20 bp, Artificial
  CRISPR gRNA sequence
gagttgcattgcctgaggaa

SEQ ID NO: 491876 - DNA, 20 bp, Artificial
  CRISPR gRNA sequence
aatagagaggaagaaagaaa

SEQ ID NO: 491877 - DNA, 20 bp, Artificial
  CRISPR gRNA sequence
gaaatgggatgtgggcccta

SEQ ID NO: 491878 - DNA, 20 bp, Artificial
  CRISPR gRNA sequence
tgattttgccctgactagag

SEQ ID NO: 491879 - DNA, 20 bp, Artificial
  CRISPR gRNA sequence
ctggattgccccagtacttt

SEQ ID NO: 491880 - DNA, 20 bp, Artificial
  CRISPR gRNA sequence
gggctgagcgggactcactg

SEQ ID NO: 491881 - DNA, 20 bp, Artificial
  CRISPR gRNA sequence
tgttcttcctgaggctgcag

SEQ ID NO: 491882 - DNA, 20 bp, Artificial
  CRISPR gRNA sequence
ctgccctctgccctcccttt

SEQ ID NO: 491883 - DNA, 20 bp, Artificial
  CRISPR gRNA sequence
ctctaaacaattttcacttg

SEQ ID NO: 491884 - DNA, 20 bp, Artificial
  CRISPR gRNA sequence
agctggactctcagtgtcct

SEQ ID NO: 491885 - DNA, 20 bp, Artificial
  CRISPR gRNA sequence
tcctgttccccaaaaggtgg

SEQ ID NO: 491886 - DNA, 20 bp, Artificial
  CRISPR gRNA sequence
agaaaacagaagcacaagtt

SEQ ID NO: 491887 - DNA, 20 bp, Artificial
  CRISPR gRNA sequence
catttgcctctgctgagggc

SEQ ID NO: 491888 - DNA, 20 bp, Artificial
  CRISPR gRNA sequence
gtatttagaagtctatggct

SEQ ID NO: 491889 - DNA, 20 bp, Artificial
  CRISPR gRNA sequence
cagaactttgggaggctgag

SEQ ID NO: 491890 - DNA, 20 bp, Artificial
  CRISPR gRNA sequence
actttgggaggctgagacgg

SEQ ID NO: 491891 - DNA, 20 bp, Artificial
  CRISPR gRNA sequence
cgggtggattacttgaggtc

SEQ ID NO: 491892 - DNA, 20 bp, Artificial
  CRISPR gRNA sequence
aaaaatacaaaaaaaaaaaa

SEQ ID NO: 491893 - DNA, 20 bp, Artificial
  CRISPR gRNA sequence
aaaaaaaaaaaagaatagct

SEQ ID NO: 491894 - DNA, 20 bp, Artificial
  CRISPR gRNA sequence
tactcatgaggctgagacag

SEQ ID NO: 491895 - DNA, 20 bp, Artificial
  CRISPR gRNA sequence
tcatgccactgcacaccagt

SEQ ID NO: 491896 - DNA, 20 bp, Artificial
  CRISPR gRNA sequence
ctctacattctgatctactg

SEQ ID NO: 491897 - DNA, 20 bp, Artificial
  CRISPR gRNA sequence
gatctactggtggattatat

SEQ ID NO: 491898 - DNA, 20 bp, Artificial
  CRISPR gRNA sequence
ttcccttaaccatgctactg

SEQ ID NO: 491899 - DNA, 20 bp, Artificial
  CRISPR gRNA sequence
tttttttttttttttttagg

SEQ ID NO: 491900 - DNA, 20 bp, Artificial
  CRISPR gRNA sequence
tcttgctctgtcacccaggc

SEQ ID NO: 491901 - DNA, 20 bp, Artificial
  CRISPR gRNA sequence
ggcttttctgatatttagct

SEQ ID NO: 491902 - DNA, 20 bp, Artificial
  CRISPR gRNA sequence
ttctgatatttagctaagag

SEQ ID NO: 491903 - DNA, 20 bp, Artificial
  CRISPR gRNA sequence
aagagttgggtttagctgag

SEQ ID NO: 491904 - DNA, 20 bp, Artificial
  CRISPR gRNA sequence
ttagttaatagtcagaacag

SEQ ID NO: 491905 - DNA, 20 bp, Artificial
  CRISPR gRNA sequence
gttgataacccccctcctgc

SEQ ID NO: 491906 - DNA, 20 bp, Artificial
  CRISPR gRNA sequence
ataattcactatgtactttt

SEQ ID NO: 491907 - DNA, 20 bp, Artificial
  CRISPR gRNA sequence
catctaatcgtgatagacat

SEQ ID NO: 491908 - DNA, 20 bp, Artificial
  CRISPR gRNA sequence
catttgggttttttctcatt

SEQ ID NO: 491909 - DNA, 20 bp, Artificial
  CRISPR gRNA sequence
cactcttgtacatattttta

SEQ ID NO: 491910 - DNA, 20 bp, Artificial
  CRISPR gRNA sequence
gattttctttttttttgaga

SEQ ID NO: 491911 - DNA, 20 bp, Artificial
  CRISPR gRNA sequence
ttcactcttgttgcccaggc

SEQ ID NO: 491912 - DNA, 20 bp, Artificial
  CRISPR gRNA sequence
gcttcagtcttccaagtagc

SEQ ID NO: 491913 - DNA, 20 bp, Artificial
  CRISPR gRNA sequence
tttttttcttttttttgaga

SEQ ID NO: 491914 - DNA, 20 bp, Artificial
  CRISPR gRNA sequence
gcctcgacctcccaaagtgc

SEQ ID NO: 491915 - DNA, 20 bp, Artificial
  CRISPR gRNA sequence
tttcttgtgtacaaattctt

SEQ ID NO: 491916 - DNA, 20 bp, Artificial
  CRISPR gRNA sequence
gtacaaattcttctggatca

SEQ ID NO: 491917 - DNA, 20 bp, Artificial
  CRISPR gRNA sequence
cactctcactagcaataaat

SEQ ID NO: 491918 - DNA, 20 bp, Artificial
  CRISPR gRNA sequence
ctcccatctctgtcaaccct

SEQ ID NO: 491919 - DNA, 20 bp, Artificial
  CRISPR gRNA sequence
tctcagtctgtcacccaggc

SEQ ID NO: 491920 - DNA, 20 bp, Artificial
  CRISPR gRNA sequence
ctcactgcaacctctgcctc

SEQ ID NO: 491921 - DNA, 20 bp, Artificial
  CRISPR gRNA sequence
ttttgcatttttagtagaga

SEQ ID NO: 491922 - DNA, 20 bp, Artificial
  CRISPR gRNA sequence
gcctcggcctcccaaagtgc

SEQ ID NO: 491923 - DNA, 20 bp, Artificial
  CRISPR gRNA sequence
taaatgttagctattttggt

SEQ ID NO: 491924 - DNA, 20 bp, Artificial
  CRISPR gRNA sequence
ttatgcatgcctattggcta

SEQ ID NO: 491925 - DNA, 20 bp, Artificial
  CRISPR gRNA sequence
tgtcatcagtctattattga

SEQ ID NO: 491926 - DNA, 20 bp, Artificial
  CRISPR gRNA sequence
gatggaattctttatatact

SEQ ID NO: 491927 - DNA, 20 bp, Artificial
  CRISPR gRNA sequence
gttaaagaaacatttgttgt

SEQ ID NO: 491928 - DNA, 20 bp, Artificial
  CRISPR gRNA sequence
cagcgctttgggaggccaag

SEQ ID NO: 491929 - DNA, 20 bp, Artificial
  CRISPR gRNA sequence
gctttgggaggccaaggcgg

SEQ ID NO: 491930 - DNA, 20 bp, Artificial
  CRISPR gRNA sequence
cgggtggatcacttgagccc

SEQ ID NO: 491931 - DNA, 20 bp, Artificial
  CRISPR gRNA sequence
tggcagcctgtaggcagctt

SEQ ID NO: 491932 - DNA, 20 bp, Artificial
  CRISPR gRNA sequence
ggtcaccagaaagaccaagg

SEQ ID NO: 491933 - DNA, 20 bp, Artificial
  CRISPR gRNA sequence
cagaaagaccaaggcagggt

SEQ ID NO: 491934 - DNA, 20 bp, Artificial
  CRISPR gRNA sequence
ccaaccttcaggaaaaggag

SEQ ID NO: 491935 - DNA, 20 bp, Artificial
  CRISPR gRNA sequence
taaacatgcggaggttcctg

SEQ ID NO: 491936 - DNA, 20 bp, Artificial
  CRISPR gRNA sequence
ataacctttataataatcca

SEQ ID NO: 491937 - DNA, 20 bp, Artificial
  CRISPR gRNA sequence
aatccagtgaatgtgtttcc

SEQ ID NO: 491938 - DNA, 20 bp, Artificial
  CRISPR gRNA sequence
aaattaattgaacccaagga

SEQ ID NO: 491939 - DNA, 20 bp, Artificial
  CRISPR gRNA sequence
gagcttgcagttggcatctg

SEQ ID NO: 491940 - DNA, 20 bp, Artificial
  CRISPR gRNA sequence
tatctacaggtagatagtgt

SEQ ID NO: 491941 - DNA, 20 bp, Artificial
  CRISPR gRNA sequence
tagatagtgtcagaattgaa

SEQ ID NO: 491942 - DNA, 20 bp, Artificial
  CRISPR gRNA sequence
gttagtgtttttcccacaca

SEQ ID NO: 491943 - DNA, 20 bp, Artificial
  CRISPR gRNA sequence
cttttcaatccttgcaatac

SEQ ID NO: 491944 - DNA, 20 bp, Artificial
  CRISPR gRNA sequence
ttacattttcatataagttt

SEQ ID NO: 491945 - DNA, 20 bp, Artificial
  CRISPR gRNA sequence
taacctgcaataatttttat

SEQ ID NO: 491946 - DNA, 20 bp, Artificial
  CRISPR gRNA sequence
taatttttattggaattcta

SEQ ID NO: 491947 - DNA, 20 bp, Artificial
  CRISPR gRNA sequence
aatctataaattaatttagg

SEQ ID NO: 491948 - DNA, 20 bp, Artificial
  CRISPR gRNA sequence
tatacacaggtatatagttt

SEQ ID NO: 491949 - DNA, 20 bp, Artificial
  CRISPR gRNA sequence
tattcattttttttttgaga

SEQ ID NO: 491950 - DNA, 20 bp, Artificial
  CRISPR gRNA sequence
tttgctcttgttgcccaggc

SEQ ID NO: 491951 - DNA, 20 bp, Artificial
  CRISPR gRNA sequence
ctcactgcagcctccgcttc

SEQ ID NO: 491952 - DNA, 20 bp, Artificial
  CRISPR gRNA sequence
gattctcctgcctcagcctc

SEQ ID NO: 491953 - DNA, 20 bp, Artificial
  CRISPR gRNA sequence
gcctcagcctcccgagtagc

SEQ ID NO: 491954 - DNA, 20 bp, Artificial
  CRISPR gRNA sequence
ttttgtatttttagtagaga

SEQ ID NO: 491955 - DNA, 20 bp, Artificial
  CRISPR gRNA sequence
aggtgagctgcccaaagtgc

SEQ ID NO: 491956 - DNA, 20 bp, Artificial
  CRISPR gRNA sequence
ttgattaaaagaggtaatta

SEQ ID NO: 491957 - DNA, 20 bp, Artificial
  CRISPR gRNA sequence
atggaatcctttttctgttc

SEQ ID NO: 491958 - DNA, 20 bp, Artificial
  CRISPR gRNA sequence
gttcctgagtttgcagggac

SEQ ID NO: 491959 - DNA, 20 bp, Artificial
  CRISPR gRNA sequence
cacgtgttctcactcaaagt

SEQ ID NO: 491960 - DNA, 20 bp, Artificial
  CRISPR gRNA sequence
gaacatatgggcacagggac

SEQ ID NO: 491961 - DNA, 20 bp, Artificial
  CRISPR gRNA sequence
tcacacaccagggcctgtta

SEQ ID NO: 491962 - DNA, 20 bp, Artificial
  CRISPR gRNA sequence
tggggcttaaaacctagatg

SEQ ID NO: 491963 - DNA, 20 bp, Artificial
  CRISPR gRNA sequence
aaaaaaaaaaaaagaaagag

SEQ ID NO: 491964 - DNA, 20 bp, Artificial
  CRISPR gRNA sequence
agaaagagatgggtacaaat

SEQ ID NO: 491965 - DNA, 20 bp, Artificial
  CRISPR gRNA sequence
ctgtgaccaaatgcagggag

SEQ ID NO: 491966 - DNA, 20 bp, Artificial
  CRISPR gRNA sequence
ggatttctcctcacagcaaa

SEQ ID NO: 491967 - DNA, 20 bp, Artificial
  CRISPR gRNA sequence
tattctgcagtggacaccag

SEQ ID NO: 491968 - DNA, 20 bp, Artificial
  CRISPR gRNA sequence
cagttcagacactaactgga

SEQ ID NO: 491969 - DNA, 20 bp, Artificial
  CRISPR gRNA sequence
cggaccaaccagcttccagt

SEQ ID NO: 491970 - DNA, 20 bp, Artificial
  CRISPR gRNA sequence
gggttctcacaaccccctcc

SEQ ID NO: 491971 - DNA, 20 bp, Artificial
  CRISPR gRNA sequence
cttgggttcaattaatttgc

SEQ ID NO: 491972 - DNA, 20 bp, Artificial
  CRISPR gRNA sequence
ctattataagagatattaca

SEQ ID NO: 491973 - DNA, 20 bp, Artificial
  CRISPR gRNA sequence
ccctgggcacactgcatgcc

SEQ ID NO: 491974 - DNA, 20 bp, Artificial
  CRISPR gRNA sequence
gctctccaagcccagtcctc

SEQ ID NO: 491975 - DNA, 20 bp, Artificial
  CRISPR gRNA sequence
acaaccttgtagaaatgtga

SEQ ID NO: 491976 - DNA, 20 bp, Artificial
  CRISPR gRNA sequence
tagaaatgtgactggatgaa

SEQ ID NO: 491977 - DNA, 20 bp, Artificial
  CRISPR gRNA sequence
tatgattccatactaacagg

SEQ ID NO: 491978 - DNA, 20 bp, Artificial
  CRISPR gRNA sequence
ctgtgtagcatttctttctc

SEQ ID NO: 491979 - DNA, 20 bp, Artificial
  CRISPR gRNA sequence
ggcaggaacttctctgaaat

SEQ ID NO: 491980 - DNA, 20 bp, Artificial
  CRISPR gRNA sequence
tcttttgatttatatcagat

SEQ ID NO: 491981 - DNA, 20 bp, Artificial
  CRISPR gRNA sequence
aaaactgggaactatttgtg

SEQ ID NO: 491982 - DNA, 20 bp, Artificial
  CRISPR gRNA sequence
atgccaagacctgtatgctt

SEQ ID NO: 491983 - DNA, 20 bp, Artificial
  CRISPR gRNA sequence
gctccaaggagacacggtcc

SEQ ID NO: 491984 - DNA, 20 bp, Artificial
  CRISPR gRNA sequence
tgctatattaatgaacatgg

SEQ ID NO: 491985 - DNA, 20 bp, Artificial
  CRISPR gRNA sequence
cattttaacacttttattta

SEQ ID NO: 491986 - DNA, 20 bp, Artificial
  CRISPR gRNA sequence
ctttctcctttctcctttct

SEQ ID NO: 491987 - DNA, 20 bp, Artificial
  CRISPR gRNA sequence
atcatcatcatcatcattat

SEQ ID NO: 491988 - DNA, 20 bp, Artificial
  CRISPR gRNA sequence
ttttctttggtttcttgaga

SEQ ID NO: 491989 - DNA, 20 bp, Artificial
  CRISPR gRNA sequence
tttgatttattctttgactc

SEQ ID NO: 491990 - DNA, 20 bp, Artificial
  CRISPR gRNA sequence
ctattgcatgtgcacttgaa

SEQ ID NO: 491991 - DNA, 20 bp, Artificial
  CRISPR gRNA sequence
atgtattctgcaattgttag

SEQ ID NO: 491992 - DNA, 20 bp, Artificial
  CRISPR gRNA sequence
aaaactctccaactatagtt

SEQ ID NO: 491993 - DNA, 20 bp, Artificial
  CRISPR gRNA sequence
tggttaccacaggtattaca

SEQ ID NO: 491994 - DNA, 20 bp, Artificial
  CRISPR gRNA sequence
aatacctccaacaatatagt

SEQ ID NO: 491995 - DNA, 20 bp, Artificial
  CRISPR gRNA sequence
ttgtttttcacttcttgtgc

SEQ ID NO: 491996 - DNA, 20 bp, Artificial
  CRISPR gRNA sequence
ctttgtcacccaggcaggag

SEQ ID NO: 491997 - DNA, 20 bp, Artificial
  CRISPR gRNA sequence
ctcgctgcagccttgacttc

SEQ ID NO: 491998 - DNA, 20 bp, Artificial
  CRISPR gRNA sequence
gattctcgtgcctcagcctc

SEQ ID NO: 491999 - DNA, 20 bp, Artificial
  CRISPR gRNA sequence
gcctcagcctcctgagtagc

SEQ ID NO: 492000 - DNA, 20 bp, Artificial
  CRISPR gRNA sequence
ttttgtatttttagtcgaga

SEQ ID NO: 492001 - DNA, 20 bp, Artificial
  CRISPR gRNA sequence
gcttcagcctcccaaagtgc

SEQ ID NO: 492002 - DNA, 20 bp, Artificial
  CRISPR gRNA sequence
gtatgttctcactgatacgt

SEQ ID NO: 492003 - DNA, 20 bp, Artificial
  CRISPR gRNA sequence
atacgtgggagttaagctac

SEQ ID NO: 492004 - DNA, 20 bp, Artificial
  CRISPR gRNA sequence
ctacgaggatgcaaaggcat

SEQ ID NO: 492005 - DNA, 20 bp, Artificial
  CRISPR gRNA sequence
cttgggaggaaaagtgggag

SEQ ID NO: 492006 - DNA, 20 bp, Artificial
  CRISPR gRNA sequence
ggaaaagtgggaggggagtg

SEQ ID NO: 492007 - DNA, 20 bp, Artificial
  CRISPR gRNA sequence
gagggataaaagactataaa

SEQ ID NO: 492008 - DNA, 20 bp, Artificial
  CRISPR gRNA sequence
tagagtgcagtgtatactgc

SEQ ID NO: 492009 - DNA, 20 bp, Artificial
  CRISPR gRNA sequence
cagtgtatactgctcgggtg

SEQ ID NO: 492010 - DNA, 20 bp, Artificial
  CRISPR gRNA sequence
taagttgtttgttttgtgaa

SEQ ID NO: 492011 - DNA, 20 bp, Artificial
  CRISPR gRNA sequence
ttctttttttttttttgaga

SEQ ID NO: 492012 - DNA, 20 bp, Artificial
  CRISPR gRNA sequence
ttcactcttgttgcccaggt

SEQ ID NO: 492013 - DNA, 20 bp, Artificial
  CRISPR gRNA sequence
ctcactgcaacctccacctc

SEQ ID NO: 492014 - DNA, 20 bp, Artificial
  CRISPR gRNA sequence
gcctcagcctcccaagtagc

SEQ ID NO: 492015 - DNA, 20 bp, Artificial
  CRISPR gRNA sequence
ttttgcatttttagcagaga

SEQ ID NO: 492016 - DNA, 20 bp, Artificial
  CRISPR gRNA sequence
acctgggcctcccaaagtgc

SEQ ID NO: 492017 - DNA, 20 bp, Artificial
  CRISPR gRNA sequence
cggtttgttttgatcttgct

SEQ ID NO: 492018 - DNA, 20 bp, Artificial
  CRISPR gRNA sequence
tttccaattacacttagttt

SEQ ID NO: 492019 - DNA, 20 bp, Artificial
  CRISPR gRNA sequence
ttgtttttctttacttcact

SEQ ID NO: 492020 - DNA, 20 bp, Artificial
  CRISPR gRNA sequence
tggcctttttaacctttcaa

SEQ ID NO: 492021 - DNA, 20 bp, Artificial
  CRISPR gRNA sequence
ttttatttctgtaattttca

SEQ ID NO: 492022 - DNA, 20 bp, Artificial
  CRISPR gRNA sequence
ggtcagctgccagactggcc

SEQ ID NO: 492023 - DNA, 20 bp, Artificial
  CRISPR gRNA sequence
tcttgctctgtcatgcaggc

SEQ ID NO: 492024 - DNA, 20 bp, Artificial
  CRISPR gRNA sequence
ctcactgcaagctccatctc

SEQ ID NO: 492025 - DNA, 20 bp, Artificial
  CRISPR gRNA sequence
gcctcagactcccaagtagc

SEQ ID NO: 492026 - DNA, 20 bp, Artificial
  CRISPR gRNA sequence
cgaggttttaccatgttggc

SEQ ID NO: 492027 - DNA, 20 bp, Artificial
  CRISPR gRNA sequence
gtggtctcgaactcccgacc

SEQ ID NO: 492028 - DNA, 20 bp, Artificial
  CRISPR gRNA sequence
gccttggcctcccaaagtgc

SEQ ID NO: 492029 - DNA, 20 bp, Artificial
  CRISPR gRNA sequence
caggccagggctagctgatt

SEQ ID NO: 492030 - DNA, 20 bp, Artificial
  CRISPR gRNA sequence
tccttttcttatacttcact

SEQ ID NO: 492031 - DNA, 20 bp, Artificial
  CRISPR gRNA sequence
tattgtgtatgaaacattct

SEQ ID NO: 492032 - DNA, 20 bp, Artificial
  CRISPR gRNA sequence
tccagatcattagttcaatc

SEQ ID NO: 492033 - DNA, 20 bp, Artificial
  CRISPR gRNA sequence
ttctcgttcactcttactct

SEQ ID NO: 492034 - DNA, 20 bp, Artificial
  CRISPR gRNA sequence
tggtaccaacctcaacactg

SEQ ID NO: 492035 - DNA, 20 bp, Artificial
  CRISPR gRNA sequence
cttcatgttctcttagttcc

SEQ ID NO: 492036 - DNA, 20 bp, Artificial
  CRISPR gRNA sequence
agccttttagctgccattta

SEQ ID NO: 492037 - DNA, 20 bp, Artificial
  CRISPR gRNA sequence
gaaatgctgatctcacctct

SEQ ID NO: 492038 - DNA, 20 bp, Artificial
  CRISPR gRNA sequence
cttctagctatttttagtgg

SEQ ID NO: 492039 - DNA, 20 bp, Artificial
  CRISPR gRNA sequence
attggttagcatgtcttaac

SEQ ID NO: 492040 - DNA, 20 bp, Artificial
  CRISPR gRNA sequence
ctggattttcattacataat

SEQ ID NO: 492041 - DNA, 20 bp, Artificial
  CRISPR gRNA sequence
ttttttatctcaacaattaa

SEQ ID NO: 492042 - DNA, 20 bp, Artificial
  CRISPR gRNA sequence
caacaattaaggggatgctg

SEQ ID NO: 492043 - DNA, 20 bp, Artificial
  CRISPR gRNA sequence
tttccagatcacaaactctc

SEQ ID NO: 492044 - DNA, 20 bp, Artificial
  CRISPR gRNA sequence
atcacaaactctctggagtc

SEQ ID NO: 492045 - DNA, 20 bp, Artificial
  CRISPR gRNA sequence
aggccctgcctcttcagggg

SEQ ID NO: 492046 - DNA, 20 bp, Artificial
  CRISPR gRNA sequence
gcagtgggactcagtaagga

SEQ ID NO: 492047 - DNA, 20 bp, Artificial
  CRISPR gRNA sequence
tttccattcacctttgttct

SEQ ID NO: 492048 - DNA, 20 bp, Artificial
  CRISPR gRNA sequence
cttgttcttataaatagtgc

SEQ ID NO: 492049 - DNA, 20 bp, Artificial
  CRISPR gRNA sequence
ttagtctcttgagaaaatgc

SEQ ID NO: 492050 - DNA, 20 bp, Artificial
  CRISPR gRNA sequence
agttttgtacactgactgca

SEQ ID NO: 492051 - DNA, 20 bp, Artificial
  CRISPR gRNA sequence
attctttgagaggcaagtgc

SEQ ID NO: 492052 - DNA, 20 bp, Artificial
  CRISPR gRNA sequence
atgaaccaagtgccacgaga

SEQ ID NO: 492053 - DNA, 20 bp, Artificial
  CRISPR gRNA sequence
ttatgtattcagctctgtga

SEQ ID NO: 492054 - DNA, 20 bp, Artificial
  CRISPR gRNA sequence
gagaggatggttgaggggcc

SEQ ID NO: 492055 - DNA, 20 bp, Artificial
  CRISPR gRNA sequence
tcttcctgggcctgaccatt

SEQ ID NO: 492056 - DNA, 20 bp, Artificial
  CRISPR gRNA sequence
ttgcctcagcactgcttgga

SEQ ID NO: 492057 - DNA, 20 bp, Artificial
  CRISPR gRNA sequence
gtatttatagcatcatggtt

SEQ ID NO: 492058 - DNA, 20 bp, Artificial
  CRISPR gRNA sequence
gccaaactgctgtctttaca

SEQ ID NO: 492059 - DNA, 20 bp, Artificial
  CRISPR gRNA sequence
tactagggaggttgagatgg

SEQ ID NO: 492060 - DNA, 20 bp, Artificial
  CRISPR gRNA sequence
gggaggatcacctcaagccc

SEQ ID NO: 492061 - DNA, 20 bp, Artificial
  CRISPR gRNA sequence
ttgcgccactgcactccagc

SEQ ID NO: 492062 - DNA, 20 bp, Artificial
  CRISPR gRNA sequence
ctgcactccagcctgggtga

SEQ ID NO: 492063 - DNA, 20 bp, Artificial
  CRISPR gRNA sequence
agattttagctattggtcta

SEQ ID NO: 492064 - DNA, 20 bp, Artificial
  CRISPR gRNA sequence
gacaaggggaggcagatgga

SEQ ID NO: 492065 - DNA, 20 bp, Artificial
  CRISPR gRNA sequence
ctcttcccgctactttcagc

SEQ ID NO: 492066 - DNA, 20 bp, Artificial
  CRISPR gRNA sequence
tcagcttgggttctctttcc

SEQ ID NO: 492067 - DNA, 20 bp, Artificial
  CRISPR gRNA sequence
gttctctttcctaggatgcc

SEQ ID NO: 492068 - DNA, 20 bp, Artificial
  CRISPR gRNA sequence
gaccatgtggttagcatctc

SEQ ID NO: 492069 - DNA, 20 bp, Artificial
  CRISPR gRNA sequence
gaagttgctgccctcacaaa

SEQ ID NO: 492070 - DNA, 20 bp, Artificial
  CRISPR gRNA sequence
ttcatcacatattgaagtgg

SEQ ID NO: 492071 - DNA, 20 bp, Artificial
  CRISPR gRNA sequence
tcagttttatagtcaagaac

SEQ ID NO: 492072 - DNA, 20 bp, Artificial
  CRISPR gRNA sequence
atttccaatgcctttctgat

SEQ ID NO: 492073 - DNA, 20 bp, Artificial
  CRISPR gRNA sequence
ctctgtcttgcttggtctcc

SEQ ID NO: 492074 - DNA, 20 bp, Artificial
  CRISPR gRNA sequence
ttagctgggaaagccacacc

SEQ ID NO: 492075 - DNA, 20 bp, Artificial
  CRISPR gRNA sequence
tgaatctcactcaggactgt

SEQ ID NO: 492076 - DNA, 20 bp, Artificial
  CRISPR gRNA sequence
aggactgtcagaatgcccat

SEQ ID NO: 492077 - DNA, 20 bp, Artificial
  CRISPR gRNA sequence
cagtgccttgtagcccttcc

SEQ ID NO: 492078 - DNA, 20 bp, Artificial
  CRISPR gRNA sequence
agggagggcatagttgtttg

SEQ ID NO: 492079 - DNA, 20 bp, Artificial
  CRISPR gRNA sequence
tggagaactgtcctctcctc

SEQ ID NO: 492080 - DNA, 20 bp, Artificial
  CRISPR gRNA sequence
gtagcctggagcaggagcat

SEQ ID NO: 492081 - DNA, 20 bp, Artificial
  CRISPR gRNA sequence
aggagcatcaggatgacccc

SEQ ID NO: 492082 - DNA, 20 bp, Artificial
  CRISPR gRNA sequence
atgaccccagggatacctag

SEQ ID NO: 492083 - DNA, 20 bp, Artificial
  CRISPR gRNA sequence
ctgttgcttatgctcatcct

SEQ ID NO: 492084 - DNA, 20 bp, Artificial
  CRISPR gRNA sequence
atgctcatcctaagagttac

SEQ ID NO: 492085 - DNA, 20 bp, Artificial
  CRISPR gRNA sequence
cagcactttgggaggctgag

SEQ ID NO: 492086 - DNA, 20 bp, Artificial
  CRISPR gRNA sequence
actttgggaggctgaggtgg

SEQ ID NO: 492087 - DNA, 20 bp, Artificial
  CRISPR gRNA sequence
ggtgggtggatcacaaggtc

SEQ ID NO: 492088 - DNA, 20 bp, Artificial
  CRISPR gRNA sequence
tactcaggaggctgaggcag

SEQ ID NO: 492089 - DNA, 20 bp, Artificial
  CRISPR gRNA sequence
cccaggaggcggaggttgca

SEQ ID NO: 492090 - DNA, 20 bp, Artificial
  CRISPR gRNA sequence
actttgggaggctgaggcag

SEQ ID NO: 492091 - DNA, 20 bp, Artificial
  CRISPR gRNA sequence
ggctgaggcaggtggatcac

SEQ ID NO: 492092 - DNA, 20 bp, Artificial
  CRISPR gRNA sequence
gcctcaattttcttcccccc

SEQ ID NO: 492093 - DNA, 20 bp, Artificial
  CRISPR gRNA sequence
cttccccccttgagtaaaat

SEQ ID NO: 492094 - DNA, 20 bp, Artificial
  CRISPR gRNA sequence
gggtgataataagtacctca

SEQ ID NO: 492095 - DNA, 20 bp, Artificial
  CRISPR gRNA sequence
tacctcacaggattgctgtt

SEQ ID NO: 492096 - DNA, 20 bp, Artificial
  CRISPR gRNA sequence
cttttccttcctcttgttgg

SEQ ID NO: 492097 - DNA, 20 bp, Artificial
  CRISPR gRNA sequence
tgaggaagagccatgaagga

SEQ ID NO: 492098 - DNA, 20 bp, Artificial
  CRISPR gRNA sequence
acggaaaacttgcctgtaca

SEQ ID NO: 492099 - DNA, 20 bp, Artificial
  CRISPR gRNA sequence
gcctgtacaatgagtatttt

SEQ ID NO: 492100 - DNA, 20 bp, Artificial
  CRISPR gRNA sequence
attttttgagttaaaaacaa

SEQ ID NO: 492101 - DNA, 20 bp, Artificial
  CRISPR gRNA sequence
tttgagttaaaaacaaagga

SEQ ID NO: 492102 - DNA, 20 bp, Artificial
  CRISPR gRNA sequence
catgtccctcagtatccatg

SEQ ID NO: 492103 - DNA, 20 bp, Artificial
  CRISPR gRNA sequence
aaccacagatgccaagatcc

SEQ ID NO: 492104 - DNA, 20 bp, Artificial
  CRISPR gRNA sequence
ttgttatactgtattgttta

SEQ ID NO: 492105 - DNA, 20 bp, Artificial
  CRISPR gRNA sequence
tacacatgcattttttttcc

SEQ ID NO: 492106 - DNA, 20 bp, Artificial
  CRISPR gRNA sequence
attttttttccctgaatatt

SEQ ID NO: 492107 - DNA, 20 bp, Artificial
  CRISPR gRNA sequence
tattctggatccacaattca

SEQ ID NO: 492108 - DNA, 20 bp, Artificial
  CRISPR gRNA sequence
aataaatagtgcagagctca

SEQ ID NO: 492109 - DNA, 20 bp, Artificial
  CRISPR gRNA sequence
tagtgcagagctcacagggt

SEQ ID NO: 492110 - DNA, 20 bp, Artificial
  CRISPR gRNA sequence
gcaaagagaaaaccttgacc

SEQ ID NO: 492111 - DNA, 20 bp, Artificial
  CRISPR gRNA sequence
cagccacaacacagagaaaa

SEQ ID NO: 492112 - DNA, 20 bp, Artificial
  CRISPR gRNA sequence
ctcacgccttctgtattcct

SEQ ID NO: 492113 - DNA, 20 bp, Artificial
  CRISPR gRNA sequence
gaggaaggagaagcagtcag

SEQ ID NO: 492114 - DNA, 20 bp, Artificial
  CRISPR gRNA sequence
tcaggtgagtggaaggtcct

SEQ ID NO: 492115 - DNA, 20 bp, Artificial
  CRISPR gRNA sequence
tggtgctcctgcctgaggcc

SEQ ID NO: 492116 - DNA, 20 bp, Artificial
  CRISPR gRNA sequence
tgactttgtcctgcgtccag

SEQ ID NO: 492117 - DNA, 20 bp, Artificial
  CRISPR gRNA sequence
gttgctgcctctgtgctctt

SEQ ID NO: 492118 - DNA, 20 bp, Artificial
  CRISPR gRNA sequence
ttttttaaggtttggccatt

SEQ ID NO: 492119 - DNA, 20 bp, Artificial
  CRISPR gRNA sequence
tccctcagagaccagtccca

SEQ ID NO: 492120 - DNA, 20 bp, Artificial
  CRISPR gRNA sequence
tgacaatttacgaagatgtc

SEQ ID NO: 492121 - DNA, 20 bp, Artificial
  CRISPR gRNA sequence
acgtatgtcatcccggaggc

SEQ ID NO: 492122 - DNA, 20 bp, Artificial
  CRISPR gRNA sequence
gctgaaggggcatcttggtg

SEQ ID NO: 492123 - DNA, 20 bp, Artificial
  CRISPR gRNA sequence
cagaattgcacctgctgaga

SEQ ID NO: 492124 - DNA, 20 bp, Artificial
  CRISPR gRNA sequence
acagaaatcaatgacagagg

SEQ ID NO: 492125 - DNA, 20 bp, Artificial
  CRISPR gRNA sequence
accacaaattctttttccta

SEQ ID NO: 492126 - DNA, 20 bp, Artificial
  CRISPR gRNA sequence
atgagtcagggcttacattc

SEQ ID NO: 492127 - DNA, 20 bp, Artificial
  CRISPR gRNA sequence
agccttttggaagaagaggc

SEQ ID NO: 492128 - DNA, 20 bp, Artificial
  CRISPR gRNA sequence
agtgtggctgaggtactaga

SEQ ID NO: 492129 - DNA, 20 bp, Artificial
  CRISPR gRNA sequence
ctggcacaaagcccaccagc

SEQ ID NO: 492130 - DNA, 20 bp, Artificial
  CRISPR gRNA sequence
gccaactctgcctgtcatcc

SEQ ID NO: 492131 - DNA, 20 bp, Artificial
  CRISPR gRNA sequence
actgctggcaggaagtgggg

SEQ ID NO: 492132 - DNA, 20 bp, Artificial
  CRISPR gRNA sequence
ctggcaggaagtggggcagg

SEQ ID NO: 492133 - DNA, 20 bp, Artificial
  CRISPR gRNA sequence
gcatcctctcccagatgcct

SEQ ID NO: 492134 - DNA, 20 bp, Artificial
  CRISPR gRNA sequence
tttgccccagcagtggctat

SEQ ID NO: 492135 - DNA, 20 bp, Artificial
  CRISPR gRNA sequence
aaaaataaagcagtggctat

SEQ ID NO: 492136 - DNA, 20 bp, Artificial
  CRISPR gRNA sequence
aaagcagtggctattggaat

SEQ ID NO: 492137 - DNA, 20 bp, Artificial
  CRISPR gRNA sequence
gtacaaattcctgaaagcat

SEQ ID NO: 492138 - DNA, 20 bp, Artificial
  CRISPR gRNA sequence
ctacccacagccagtgatgc

SEQ ID NO: 492139 - DNA, 20 bp, Artificial
  CRISPR gRNA sequence
tagagcaaaggaaacctctt

SEQ ID NO: 492140 - DNA, 20 bp, Artificial
  CRISPR gRNA sequence
tctttctagaaacacttcac

SEQ ID NO: 492141 - DNA, 20 bp, Artificial
  CRISPR gRNA sequence
cttagcttcttcttgcttcc

SEQ ID NO: 492142 - DNA, 20 bp, Artificial
  CRISPR gRNA sequence
cctccaccaccgatttccta

SEQ ID NO: 492143 - DNA, 20 bp, Artificial
  CRISPR gRNA sequence
tctgcttcctgctttggccc

SEQ ID NO: 492144 - DNA, 20 bp, Artificial
  CRISPR gRNA sequence
ctttgaaatgtttaaacttt

SEQ ID NO: 492145 - DNA, 20 bp, Artificial
  CRISPR gRNA sequence
ctactcagagctctgcaagg

SEQ ID NO: 492146 - DNA, 20 bp, Artificial
  CRISPR gRNA sequence
gtgacagcattctctttgag

SEQ ID NO: 492147 - DNA, 20 bp, Artificial
  CRISPR gRNA sequence
cctgtctcttcccatcttgg

SEQ ID NO: 492148 - DNA, 20 bp, Artificial
  CRISPR gRNA sequence
gtccattccatacctatctc

SEQ ID NO: 492149 - DNA, 20 bp, Artificial
  CRISPR gRNA sequence
cccccctgaaactcacacca

SEQ ID NO: 492150 - DNA, 20 bp, Artificial
  CRISPR gRNA sequence
aaactcacaccattgaatgg

SEQ ID NO: 492151 - DNA, 20 bp, Artificial
  CRISPR gRNA sequence
gaataagatcttggtgcttc

SEQ ID NO: 492152 - DNA, 20 bp, Artificial
  CRISPR gRNA sequence
tattatattcgttttcagga

SEQ ID NO: 492153 - DNA, 20 bp, Artificial
  CRISPR gRNA sequence
atattcgttttcaggaaaga

SEQ ID NO: 492154 - DNA, 20 bp, Artificial
  CRISPR gRNA sequence
acaattttattgtttagaga

SEQ ID NO: 492155 - DNA, 20 bp, Artificial
  CRISPR gRNA sequence
aacaggtggcatttggtgtc

SEQ ID NO: 492156 - DNA, 20 bp, Artificial
  CRISPR gRNA sequence
ttggtatacccgttatgaga

SEQ ID NO: 492157 - DNA, 20 bp, Artificial
  CRISPR gRNA sequence
atctcattctgtctaccagg

SEQ ID NO: 492158 - DNA, 20 bp, Artificial
  CRISPR gRNA sequence
taccaggctgagtgcaatgg

SEQ ID NO: 492159 - DNA, 20 bp, Artificial
  CRISPR gRNA sequence
aatcatagcttactgaagcc

SEQ ID NO: 492160 - DNA, 20 bp, Artificial
  CRISPR gRNA sequence
gatcctcccacctcagcctc

SEQ ID NO: 492161 - DNA, 20 bp, Artificial
  CRISPR gRNA sequence
gtagtggcagagctgagcca

SEQ ID NO: 492162 - DNA, 20 bp, Artificial
  CRISPR gRNA sequence
agagctgagccaaagggttt

SEQ ID NO: 492163 - DNA, 20 bp, Artificial
  CRISPR gRNA sequence
atactccacctcttatattc

SEQ ID NO: 492164 - DNA, 20 bp, Artificial
  CRISPR gRNA sequence
ccacattgaactccaatgag

SEQ ID NO: 492165 - DNA, 20 bp, Artificial
  CRISPR gRNA sequence
ggtcccctcaaactatggtg

SEQ ID NO: 492166 - DNA, 20 bp, Artificial
  CRISPR gRNA sequence
ctcaaactatggtgttgggt

SEQ ID NO: 492167 - DNA, 20 bp, Artificial
  CRISPR gRNA sequence
cctctggagcatcttaaaag

SEQ ID NO: 492168 - DNA, 20 bp, Artificial
  CRISPR gRNA sequence
gtgttgaggaaagagccctg

SEQ ID NO: 492169 - DNA, 20 bp, Artificial
  CRISPR gRNA sequence
ggaaagagccctggagagtc

SEQ ID NO: 492170 - DNA, 20 bp, Artificial
  CRISPR gRNA sequence
agccctggagagtcttgggt

SEQ ID NO: 492171 - DNA, 20 bp, Artificial
  CRISPR gRNA sequence
tatgatcattcttattttat

SEQ ID NO: 492172 - DNA, 20 bp, Artificial
  CRISPR gRNA sequence
ttattttataggagtgttaa

SEQ ID NO: 492173 - DNA, 20 bp, Artificial
  CRISPR gRNA sequence
actttgggaggccgaggcgg

SEQ ID NO: 492174 - DNA, 20 bp, Artificial
  CRISPR gRNA sequence
ggcgggcggatcacgaggtc

SEQ ID NO: 492175 - DNA, 20 bp, Artificial
  CRISPR gRNA sequence
tactcaggaggctggggcag

SEQ ID NO: 492176 - DNA, 20 bp, Artificial
  CRISPR gRNA sequence
aaacaaaaaaacagttagag

SEQ ID NO: 492177 - DNA, 20 bp, Artificial
  CRISPR gRNA sequence
acttgaagcttccatctggg

SEQ ID NO: 492178 - DNA, 20 bp, Artificial
  CRISPR gRNA sequence
ataacctttgtaagattgtg

SEQ ID NO: 492179 - DNA, 20 bp, Artificial
  CRISPR gRNA sequence
gcctcttcccgtggtggtgg

SEQ ID NO: 492180 - DNA, 20 bp, Artificial
  CRISPR gRNA sequence
attttgcatgtgtttgcagt

SEQ ID NO: 492181 - DNA, 20 bp, Artificial
  CRISPR gRNA sequence
ttgttctttattgtgtgtat

SEQ ID NO: 492182 - DNA, 20 bp, Artificial
  CRISPR gRNA sequence
ctaagagaacagtagactag

SEQ ID NO: 492183 - DNA, 20 bp, Artificial
  CRISPR gRNA sequence
agtagactagatgagttttt

SEQ ID NO: 492184 - DNA, 20 bp, Artificial
  CRISPR gRNA sequence
tgctttgcacagagagacta

SEQ ID NO: 492185 - DNA, 20 bp, Artificial
  CRISPR gRNA sequence
gctatggtgagagatactgg

SEQ ID NO: 492186 - DNA, 20 bp, Artificial
  CRISPR gRNA sequence
ggcatattgcctggagctgg

SEQ ID NO: 492187 - DNA, 20 bp, Artificial
  CRISPR gRNA sequence
cctggagctggaggagtaga

SEQ ID NO: 492188 - DNA, 20 bp, Artificial
  CRISPR gRNA sequence
cactgaaatccttctccaag

SEQ ID NO: 492189 - DNA, 20 bp, Artificial
  CRISPR gRNA sequence
ctctcttgtgtacttggaaa

SEQ ID NO: 492190 - DNA, 20 bp, Artificial
  CRISPR gRNA sequence
ttgtgtacttggaaacagag

SEQ ID NO: 492191 - DNA, 20 bp, Artificial
  CRISPR gRNA sequence
tgtttttctcttgtatggaa

SEQ ID NO: 492192 - DNA, 20 bp, Artificial
  CRISPR gRNA sequence
cttgtatggaaggggatggg

SEQ ID NO: 492193 - DNA, 20 bp, Artificial
  CRISPR gRNA sequence
aagccttaacatggtagtat

SEQ ID NO: 492194 - DNA, 20 bp, Artificial
  CRISPR gRNA sequence
acatggtagtatgggaattt

SEQ ID NO: 492195 - DNA, 20 bp, Artificial
  CRISPR gRNA sequence
gtcagggaccacaggtttga

SEQ ID NO: 492196 - DNA, 20 bp, Artificial
  CRISPR gRNA sequence
caataagccattcaacctac

SEQ ID NO: 492197 - DNA, 20 bp, Artificial
  CRISPR gRNA sequence
tatgtaaactctatatgcta

SEQ ID NO: 492198 - DNA, 20 bp, Artificial
  CRISPR gRNA sequence
atatgctactgaatgtgcct

SEQ ID NO: 492199 - DNA, 20 bp, Artificial
  CRISPR gRNA sequence
gcctctgaattctagtgtcc

SEQ ID NO: 492200 - DNA, 20 bp, Artificial
  CRISPR gRNA sequence
gttggcaattatttatatgc

SEQ ID NO: 492201 - DNA, 20 bp, Artificial
  CRISPR gRNA sequence
atgcctggattgtttacatt

SEQ ID NO: 492202 - DNA, 20 bp, Artificial
  CRISPR gRNA sequence
gtttggggcagtatttgcat

SEQ ID NO: 492203 - DNA, 20 bp, Artificial
  CRISPR gRNA sequence
atttgcattaggattgcctg

SEQ ID NO: 492204 - DNA, 20 bp, Artificial
  CRISPR gRNA sequence
tgtgtatgtgtgtgtgctct

SEQ ID NO: 492205 - DNA, 20 bp, Artificial
  CRISPR gRNA sequence
acacacacacacatatgtgt

SEQ ID NO: 492206 - DNA, 20 bp, Artificial
  CRISPR gRNA sequence
tgtatgggttttaggtgtat

SEQ ID NO: 492207 - DNA, 20 bp, Artificial
  CRISPR gRNA sequence
aaacaccattgttttgctcc

SEQ ID NO: 492208 - DNA, 20 bp, Artificial
  CRISPR gRNA sequence
attctattcattttctggct

SEQ ID NO: 492209 - DNA, 20 bp, Artificial
  CRISPR gRNA sequence
ttttctggctgagagtgcct

SEQ ID NO: 492210 - DNA, 20 bp, Artificial
  CRISPR gRNA sequence
cctcagaatttttctgggcc

SEQ ID NO: 492211 - DNA, 20 bp, Artificial
  CRISPR gRNA sequence
tgggacctctcacatcactt

SEQ ID NO: 492212 - DNA, 20 bp, Artificial
  CRISPR gRNA sequence
agttaagtattctttacctt

SEQ ID NO: 492213 - DNA, 20 bp, Artificial
  CRISPR gRNA sequence
ttaccttctgaatttctagt

SEQ ID NO: 492214 - DNA, 20 bp, Artificial
  CRISPR gRNA sequence
taagattctggaactcctca

SEQ ID NO: 492215 - DNA, 20 bp, Artificial
  CRISPR gRNA sequence
gccctgaaatctagccatga

SEQ ID NO: 492216 - DNA, 20 bp, Artificial
  CRISPR gRNA sequence
aaagatcattcacacagtct

SEQ ID NO: 492217 - DNA, 20 bp, Artificial
  CRISPR gRNA sequence
cacacagtctcagagttgta

SEQ ID NO: 492218 - DNA, 20 bp, Artificial
  CRISPR gRNA sequence
tgaagacactgaagcccaag

SEQ ID NO: 492219 - DNA, 20 bp, Artificial
  CRISPR gRNA sequence
cactgaagcccaaggagagt

SEQ ID NO: 492220 - DNA, 20 bp, Artificial
  CRISPR gRNA sequence
tatgatacttactgggcagc

SEQ ID NO: 492221 - DNA, 20 bp, Artificial
  CRISPR gRNA sequence
actggacatctctcctttcc

SEQ ID NO: 492222 - DNA, 20 bp, Artificial
  CRISPR gRNA sequence
tttccaagagtgttcggagg

SEQ ID NO: 492223 - DNA, 20 bp, Artificial
  CRISPR gRNA sequence
aggtgagcttaatcttcttc

SEQ ID NO: 492224 - DNA, 20 bp, Artificial
  CRISPR gRNA sequence
atgaccactgagcctggtgg

SEQ ID NO: 492225 - DNA, 20 bp, Artificial
  CRISPR gRNA sequence
ggagggactcaacatttctt

SEQ ID NO: 492226 - DNA, 20 bp, Artificial
  CRISPR gRNA sequence
acatttcttgggggtttatt

SEQ ID NO: 492227 - DNA, 20 bp, Artificial
  CRISPR gRNA sequence
tagcctgccagtgtcttcac

SEQ ID NO: 492228 - DNA, 20 bp, Artificial
  CRISPR gRNA sequence
attattttatttagtcctca

SEQ ID NO: 492229 - DNA, 20 bp, Artificial
  CRISPR gRNA sequence
gctgccattggtcagaaggg

SEQ ID NO: 492230 - DNA, 20 bp, Artificial
  CRISPR gRNA sequence
ccattggtcagaagggaggg

SEQ ID NO: 492231 - DNA, 20 bp, Artificial
  CRISPR gRNA sequence
agggatgggtggctgcctgc

SEQ ID NO: 492232 - DNA, 20 bp, Artificial
  CRISPR gRNA sequence
ttaaagccaactggacaacc

SEQ ID NO: 492233 - DNA, 20 bp, Artificial
  CRISPR gRNA sequence
gaaaaagcatatgtggttaa

SEQ ID NO: 492234 - DNA, 20 bp, Artificial
  CRISPR gRNA sequence
atatgtggttaagagagtac

SEQ ID NO: 492235 - DNA, 20 bp, Artificial
  CRISPR gRNA sequence
tcctgcacttcacactagtc

SEQ ID NO: 492236 - DNA, 20 bp, Artificial
  CRISPR gRNA sequence
cttcacactagtcgtggatc

SEQ ID NO: 492237 - DNA, 20 bp, Artificial
  CRISPR gRNA sequence
attttttaaatctgtaaaat

SEQ ID NO: 492238 - DNA, 20 bp, Artificial
  CRISPR gRNA sequence
ggatggcaagtcatacctca

SEQ ID NO: 492239 - DNA, 20 bp, Artificial
  CRISPR gRNA sequence
tgataaggacctcccagtgc

SEQ ID NO: 492240 - DNA, 20 bp, Artificial
  CRISPR gRNA sequence
cttttcttttgcagattgga

SEQ ID NO: 492241 - DNA, 20 bp, Artificial
  CRISPR gRNA sequence
tgcacatcagcatctgcttt

SEQ ID NO: 492242 - DNA, 20 bp, Artificial
  CRISPR gRNA sequence
ctgctttgggaattggcaca

SEQ ID NO: 492243 - DNA, 20 bp, Artificial
  CRISPR gRNA sequence
ggcacagtggatgacggcac

SEQ ID NO: 492244 - DNA, 20 bp, Artificial
  CRISPR gRNA sequence
agaacagttcctagtctgga

SEQ ID NO: 492245 - DNA, 20 bp, Artificial
  CRISPR gRNA sequence
ttccaatttacagatcagac

SEQ ID NO: 492246 - DNA, 20 bp, Artificial
  CRISPR gRNA sequence
aatttacagatcagacatga

SEQ ID NO: 492247 - DNA, 20 bp, Artificial
  CRISPR gRNA sequence
gatcagacatgaatgggtgg

SEQ ID NO: 492248 - DNA, 20 bp, Artificial
  CRISPR gRNA sequence
tgtttccttttctcccctct

SEQ ID NO: 492249 - DNA, 20 bp, Artificial
  CRISPR gRNA sequence
catcttccaaagcaagagga

SEQ ID NO: 492250 - DNA, 20 bp, Artificial
  CRISPR gRNA sequence
ctggctggcaggttctgcac

SEQ ID NO: 492251 - DNA, 20 bp, Artificial
  CRISPR gRNA sequence
ctggccagttggccaccagg

SEQ ID NO: 492252 - DNA, 20 bp, Artificial
  CRISPR gRNA sequence
cagggggagtgggctgaagg

SEQ ID NO: 492253 - DNA, 20 bp, Artificial
  CRISPR gRNA sequence
gcacatgctgacctgataac

SEQ ID NO: 492254 - DNA, 20 bp, Artificial
  CRISPR gRNA sequence
aaccatgttctatttaagtt

SEQ ID NO: 492255 - DNA, 20 bp, Artificial
  CRISPR gRNA sequence
tatttaagttctgagtcctg

SEQ ID NO: 492256 - DNA, 20 bp, Artificial
  CRISPR gRNA sequence
gagtcctgatgagtgttccc

SEQ ID NO: 492257 - DNA, 20 bp, Artificial
  CRISPR gRNA sequence
ggctcaggcagctgagggct

SEQ ID NO: 492258 - DNA, 20 bp, Artificial
  CRISPR gRNA sequence
agggctgagaatgaggcagt

SEQ ID NO: 492259 - DNA, 20 bp, Artificial
  CRISPR gRNA sequence
gttggaatctagacactatg

SEQ ID NO: 492260 - DNA, 20 bp, Artificial
  CRISPR gRNA sequence
tagacactatgctgggttcc

SEQ ID NO: 492261 - DNA, 20 bp, Artificial
  CRISPR gRNA sequence
gctgagcccaggaaagcgac

SEQ ID NO: 492262 - DNA, 20 bp, Artificial
  CRISPR gRNA sequence
tcctaccctgtatctaacat

SEQ ID NO: 492263 - DNA, 20 bp, Artificial
  CRISPR gRNA sequence
tgatatcatgcagatgcagt

SEQ ID NO: 492264 - DNA, 20 bp, Artificial
  CRISPR gRNA sequence
atgcagtctgaattccttgc

SEQ ID NO: 492265 - DNA, 20 bp, Artificial
  CRISPR gRNA sequence
tctgtttgaacactgctgta

SEQ ID NO: 492266 - DNA, 20 bp, Artificial
  CRISPR gRNA sequence
acagcagtgttcaaacagac

SEQ ID NO: 492267 - DNA, 20 bp, Artificial
  CRISPR gRNA sequence
agactgcatctgcatgatat

SEQ ID NO: 492268 - DNA, 20 bp, Artificial
  CRISPR gRNA sequence
agggtaggaaaattgaagaa

SEQ ID NO: 492269 - DNA, 20 bp, Artificial
  CRISPR gRNA sequence
gtcctctcccagttcaccct

SEQ ID NO: 492270 - DNA, 20 bp, Artificial
  CRISPR gRNA sequence
tcagggaacccagcatagtg

SEQ ID NO: 492271 - DNA, 20 bp, Artificial
  CRISPR gRNA sequence
gactcagaacttaaatagaa

SEQ ID NO: 492272 - DNA, 20 bp, Artificial
  CRISPR gRNA sequence
ccacttctatgaagaagcca

SEQ ID NO: 492273 - DNA, 20 bp, Artificial
  CRISPR gRNA sequence
atcaggtcagcatgtgctct

SEQ ID NO: 492274 - DNA, 20 bp, Artificial
  CRISPR gRNA sequence
ggtgatttttctacttagag

SEQ ID NO: 492275 - DNA, 20 bp, Artificial
  CRISPR gRNA sequence
atttttctacttagagatgg

SEQ ID NO: 492276 - DNA, 20 bp, Artificial
  CRISPR gRNA sequence
aaaggtatgagatgcaggga

SEQ ID NO: 492277 - DNA, 20 bp, Artificial
  CRISPR gRNA sequence
ccagttcacagccggacagt

SEQ ID NO: 492278 - DNA, 20 bp, Artificial
  CRISPR gRNA sequence
agtccaggctttcagaggag

SEQ ID NO: 492279 - DNA, 20 bp, Artificial
  CRISPR gRNA sequence
tcaccattatcattccttcc

SEQ ID NO: 492280 - DNA, 20 bp, Artificial
  CRISPR gRNA sequence
ggggagaaaaggaaacaagt

SEQ ID NO: 492281 - DNA, 20 bp, Artificial
  CRISPR gRNA sequence
acatcacttacataacactt

SEQ ID NO: 492282 - DNA, 20 bp, Artificial
  CRISPR gRNA sequence
cggctcaatcgagcagggtt

SEQ ID NO: 492283 - DNA, 20 bp, Artificial
  CRISPR gRNA sequence
atgacttgccatccccattt

SEQ ID NO: 492284 - DNA, 20 bp, Artificial
  CRISPR gRNA sequence
tccagtactctcttaaccac

SEQ ID NO: 492285 - DNA, 20 bp, Artificial
  CRISPR gRNA sequence
ctatgaccctgggttgtcca

SEQ ID NO: 492286 - DNA, 20 bp, Artificial
  CRISPR gRNA sequence
tgaacagtgttgacccctga

SEQ ID NO: 492287 - DNA, 20 bp, Artificial
  CRISPR gRNA sequence
actcttggaaaggagagatg

SEQ ID NO: 492288 - DNA, 20 bp, Artificial
  CRISPR gRNA sequence
gggtcagaccctcactctcc

SEQ ID NO: 492289 - DNA, 20 bp, Artificial
  CRISPR gRNA sequence
cctaagtgtaccctttcatg

SEQ ID NO: 492290 - DNA, 20 bp, Artificial
  CRISPR gRNA sequence
tcaccctaggagcaaaacaa

SEQ ID NO: 492291 - DNA, 20 bp, Artificial
  CRISPR gRNA sequence
gaggcacattcagtagcata

SEQ ID NO: 492292 - DNA, 20 bp, Artificial
  CRISPR gRNA sequence
gatgggatccaagtaggttg

SEQ ID NO: 492293 - DNA, 20 bp, Artificial
  CRISPR gRNA sequence
aaattcccatactaccatgt

SEQ ID NO: 492294 - DNA, 20 bp, Artificial
  CRISPR gRNA sequence
atactaccatgttaaggctt

SEQ ID NO: 492295 - DNA, 20 bp, Artificial
  CRISPR gRNA sequence
atgtgtaccaggatacccaa

SEQ ID NO: 492296 - DNA, 20 bp, Artificial
  CRISPR gRNA sequence
gtacacaagagagctacgaa

SEQ ID NO: 492297 - DNA, 20 bp, Artificial
  CRISPR gRNA sequence
agctacgaactcagcttgga

SEQ ID NO: 492298 - DNA, 20 bp, Artificial
  CRISPR gRNA sequence
ctttctctggtctctgaagg

SEQ ID NO: 492299 - DNA, 20 bp, Artificial
  CRISPR gRNA sequence
aatcttacaaaggttatctc

SEQ ID NO: 492300 - DNA, 20 bp, Artificial
  CRISPR gRNA sequence
ctcctcaaccctgcccagat

SEQ ID NO: 492301 - DNA, 20 bp, Artificial
  CRISPR gRNA sequence
agtctcgctctgtcattaat

SEQ ID NO: 492302 - DNA, 20 bp, Artificial
  CRISPR gRNA sequence
ttatacatgtattctcctct

SEQ ID NO: 492303 - DNA, 20 bp, Artificial
  CRISPR gRNA sequence
gtattctcctctaactgttt

SEQ ID NO: 492304 - DNA, 20 bp, Artificial
  CRISPR gRNA sequence
ctctaactgtttttttgttt

SEQ ID NO: 492305 - DNA, 20 bp, Artificial
  CRISPR gRNA sequence
tgtttatttgtttttgagac

SEQ ID NO: 492306 - DNA, 20 bp, Artificial
  CRISPR gRNA sequence
tgccccagcctcctgagtag

SEQ ID NO: 492307 - DNA, 20 bp, Artificial
  CRISPR gRNA sequence
aatttttgtatttttagaga

SEQ ID NO: 492308 - DNA, 20 bp, Artificial
  CRISPR gRNA sequence
cgcctcggcctcccaaagtg

SEQ ID NO: 492309 - DNA, 20 bp, Artificial
  CRISPR gRNA sequence
ctgtcattctcacccaacac

SEQ ID NO: 492310 - DNA, 20 bp, Artificial
  CRISPR gRNA sequence
agatatcaaccgctcttata

SEQ ID NO: 492311 - DNA, 20 bp, Artificial
  CRISPR gRNA sequence
tattactggccaccaggagg

SEQ ID NO: 492312 - DNA, 20 bp, Artificial
  CRISPR gRNA sequence
ttttagccatcagtattaaa

SEQ ID NO: 492313 - DNA, 20 bp, Artificial
  CRISPR gRNA sequence
tcagtattaaaggatgcttc

SEQ ID NO: 492314 - DNA, 20 bp, Artificial
  CRISPR gRNA sequence
agatatcagttgacctgagt

SEQ ID NO: 492315 - DNA, 20 bp, Artificial
  CRISPR gRNA sequence
tattttcatgaggctgttat

SEQ ID NO: 492316 - DNA, 20 bp, Artificial
  CRISPR gRNA sequence
atcacttgaggccgggaatt

SEQ ID NO: 492317 - DNA, 20 bp, Artificial
  CRISPR gRNA sequence
gaattcaaggcttcagtaag

SEQ ID NO: 492318 - DNA, 20 bp, Artificial
  CRISPR gRNA sequence
accctgtctctaaacaataa

SEQ ID NO: 492319 - DNA, 20 bp, Artificial
  CRISPR gRNA sequence
aataaaataaaagagatcaa

SEQ ID NO: 492320 - DNA, 20 bp, Artificial
  CRISPR gRNA sequence
gcagaagttgagtcccctaa

SEQ ID NO: 492321 - DNA, 20 bp, Artificial
  CRISPR gRNA sequence
aagaagaaggaatgtccaca

SEQ ID NO: 492322 - DNA, 20 bp, Artificial
  CRISPR gRNA sequence
caactgaagccaagctatct

SEQ ID NO: 492323 - DNA, 20 bp, Artificial
  CRISPR gRNA sequence
ttattctgccattcaatggt

SEQ ID NO: 492324 - DNA, 20 bp, Artificial
  CRISPR gRNA sequence
atgagcgacagttcggtctg

SEQ ID NO: 492325 - DNA, 20 bp, Artificial
  CRISPR gRNA sequence
gacagttcggtctgtccaga

SEQ ID NO: 492326 - DNA, 20 bp, Artificial
  CRISPR gRNA sequence
gggaaaaacagcacaaagaa

SEQ ID NO: 492327 - DNA, 20 bp, Artificial
  CRISPR gRNA sequence
tgggaagagacaggaagaag

SEQ ID NO: 492328 - DNA, 20 bp, Artificial
  CRISPR gRNA sequence
cctcagagcactgaaattca

SEQ ID NO: 492329 - DNA, 20 bp, Artificial
  CRISPR gRNA sequence
ccaagggccaaagcaggaag

SEQ ID NO: 492330 - DNA, 20 bp, Artificial
  CRISPR gRNA sequence
ccaaagcaggaagcagagct

SEQ ID NO: 492331 - DNA, 20 bp, Artificial
  CRISPR gRNA sequence
ccggccactgaaagcatatt

SEQ ID NO: 492332 - DNA, 20 bp, Artificial
  CRISPR gRNA sequence
gacaatgtcaataacttcat

SEQ ID NO: 492333 - DNA, 20 bp, Artificial
  CRISPR gRNA sequence
tttgtgttttaaaatactgc

SEQ ID NO: 492334 - DNA, 20 bp, Artificial
  CRISPR gRNA sequence
tttaaaatactgcaggagtt

SEQ ID NO: 492335 - DNA, 20 bp, Artificial
  CRISPR gRNA sequence
ctcccgtccagacccgtgtg

SEQ ID NO: 492336 - DNA, 20 bp, Artificial
  CRISPR gRNA sequence
acccgtgtgaagtgtttcta

SEQ ID NO: 492337 - DNA, 20 bp, Artificial
  CRISPR gRNA sequence
aaagtgagaccacatgaaac

SEQ ID NO: 492338 - DNA, 20 bp, Artificial
  CRISPR gRNA sequence
ctaataggcctgaatcccaa

SEQ ID NO: 492339 - DNA, 20 bp, Artificial
  CRISPR gRNA sequence
aagaggtttcctttgctcta

SEQ ID NO: 492340 - DNA, 20 bp, Artificial
  CRISPR gRNA sequence
agtcatcttctttttggaaa

SEQ ID NO: 492341 - DNA, 20 bp, Artificial
  CRISPR gRNA sequence
cccgggcatcactggctgtg

SEQ ID NO: 492342 - DNA, 20 bp, Artificial
  CRISPR gRNA sequence
cactggctgtgggtagattc

SEQ ID NO: 492343 - DNA, 20 bp, Artificial
  CRISPR gRNA sequence
attattcacattccaatagc

SEQ ID NO: 492344 - DNA, 20 bp, Artificial
  CRISPR gRNA sequence
acccagaggcatctgggaga

SEQ ID NO: 492345 - DNA, 20 bp, Artificial
  CRISPR gRNA sequence
gcacggaagagccccaccac

SEQ ID NO: 492346 - DNA, 20 bp, Artificial
  CRISPR gRNA sequence
accctgccccacttcctgcc

SEQ ID NO: 492347 - DNA, 20 bp, Artificial
  CRISPR gRNA sequence
agcagtttggtaggctccat

SEQ ID NO: 492348 - DNA, 20 bp, Artificial
  CRISPR gRNA sequence
ggaggagcctactcaggctg

SEQ ID NO: 492349 - DNA, 20 bp, Artificial
  CRISPR gRNA sequence
ttgagccagctacaaaacta

SEQ ID NO: 492350 - DNA, 20 bp, Artificial
  CRISPR gRNA sequence
cagcagcactctgcctctgt

SEQ ID NO: 492351 - DNA, 20 bp, Artificial
  CRISPR gRNA sequence
cctttcatctcctctgctcc

SEQ ID NO: 492352 - DNA, 20 bp, Artificial
  CRISPR gRNA sequence
cccagcctccgggatgacat

SEQ ID NO: 492353 - DNA, 20 bp, Artificial
  CRISPR gRNA sequence
ggatgacatacgtgatttct

SEQ ID NO: 492354 - DNA, 20 bp, Artificial
  CRISPR gRNA sequence
agagctgcagaaacctccag

SEQ ID NO: 492355 - DNA, 20 bp, Artificial
  CRISPR gRNA sequence
gcagaaacctccagaagggc

SEQ ID NO: 492356 - DNA, 20 bp, Artificial
  CRISPR gRNA sequence
ctgggagagagagcctagca

SEQ ID NO: 492357 - DNA, 20 bp, Artificial
  CRISPR gRNA sequence
taaggaccttccactcacct

SEQ ID NO: 492358 - DNA, 20 bp, Artificial
  CRISPR gRNA sequence
ggcaagggtgccaaggaaca

SEQ ID NO: 492359 - DNA, 20 bp, Artificial
  CRISPR gRNA sequence
cccacttttctctgtgttgt

SEQ ID NO: 492360 - DNA, 20 bp, Artificial
  CRISPR gRNA sequence
gtgctctgagaactcacggt

SEQ ID NO: 492361 - DNA, 20 bp, Artificial
  CRISPR gRNA sequence
tggaagatgcctcagagcct

SEQ ID NO: 492362 - DNA, 20 bp, Artificial
  CRISPR gRNA sequence
gatctaatacagttgccctc

SEQ ID NO: 492363 - DNA, 20 bp, Artificial
  CRISPR gRNA sequence
caaagttttgagttccacaa

SEQ ID NO: 492364 - DNA, 20 bp, Artificial
  CRISPR gRNA sequence
aggttatatgcaaaaactgc

SEQ ID NO: 492365 - DNA, 20 bp, Artificial
  CRISPR gRNA sequence
aatgttacatttatccattc

SEQ ID NO: 492366 - DNA, 20 bp, Artificial
  CRISPR gRNA sequence
aaaaaatactcattgtacag

SEQ ID NO: 492367 - DNA, 20 bp, Artificial
  CRISPR gRNA sequence
cctcatttgaacttctactt

SEQ ID NO: 492368 - DNA, 20 bp, Artificial
  CRISPR gRNA sequence
aatgaatctgccagagatca

SEQ ID NO: 492369 - DNA, 20 bp, Artificial
  CRISPR gRNA sequence
ttttttttttttaaatagag

SEQ ID NO: 492370 - DNA, 20 bp, Artificial
  CRISPR gRNA sequence
tgcctcagcctcccaaagtg

SEQ ID NO: 492371 - DNA, 20 bp, Artificial
  CRISPR gRNA sequence
acctgacctctaagagatca

SEQ ID NO: 492372 - DNA, 20 bp, Artificial
  CRISPR gRNA sequence
tgcctcagcctcctgagtag

SEQ ID NO: 492373 - DNA, 20 bp, Artificial
  CRISPR gRNA sequence
ttttgtatttttagtagaga

SEQ ID NO: 492374 - DNA, 20 bp, Artificial
  CRISPR gRNA sequence
cacctcagcctcccaaagtg

SEQ ID NO: 492375 - DNA, 20 bp, Artificial
  CRISPR gRNA sequence
ctgcgcccggcctgcctcag

SEQ ID NO: 492376 - DNA, 20 bp, Artificial
  CRISPR gRNA sequence
ttccttatgaatgagagctg

SEQ ID NO: 492377 - DNA, 20 bp, Artificial
  CRISPR gRNA sequence
atgctgctggtacattaagt

SEQ ID NO: 492378 - DNA, 20 bp, Artificial
  CRISPR gRNA sequence
tgtagttacctcttgaacta

SEQ ID NO: 492379 - DNA, 20 bp, Artificial
  CRISPR gRNA sequence
atgccctccctctgcagaag

SEQ ID NO: 492380 - DNA, 20 bp, Artificial
  CRISPR gRNA sequence
tttttccagagtaggatagg

SEQ ID NO: 492381 - DNA, 20 bp, Artificial
  CRISPR gRNA sequence
aggcactgggagaggaggcc

SEQ ID NO: 492382 - DNA, 20 bp, Artificial
  CRISPR gRNA sequence
ggttgcggggtccaaacctt

SEQ ID NO: 492383 - DNA, 20 bp, Artificial
  CRISPR gRNA sequence
gggcattctgacagtcctga

SEQ ID NO: 492384 - DNA, 20 bp, Artificial
  CRISPR gRNA sequence
gtcctgagtgagattcaggg

SEQ ID NO: 492385 - DNA, 20 bp, Artificial
  CRISPR gRNA sequence
gggtgtggctttcccagcta

SEQ ID NO: 492386 - DNA, 20 bp, Artificial
  CRISPR gRNA sequence
tgaggttccctgctgtctgg

SEQ ID NO: 492387 - DNA, 20 bp, Artificial
  CRISPR gRNA sequence
tcttcccctgcccctgtagg

SEQ ID NO: 492388 - DNA, 20 bp, Artificial
  CRISPR gRNA sequence
ttctcaactttatctggaag

SEQ ID NO: 492389 - DNA, 20 bp, Artificial
  CRISPR gRNA sequence
gctgtcaaccttcgtctgta

SEQ ID NO: 492390 - DNA, 20 bp, Artificial
  CRISPR gRNA sequence
gagtacttactatgtgacag

SEQ ID NO: 492391 - DNA, 20 bp, Artificial
  CRISPR gRNA sequence
aatgatgagcctgaaaccta

SEQ ID NO: 492392 - DNA, 20 bp, Artificial
  CRISPR gRNA sequence
gaaacctagtcagtttggtg

SEQ ID NO: 492393 - DNA, 20 bp, Artificial
  CRISPR gRNA sequence
tagtcagtttggtgttatgt

SEQ ID NO: 492394 - DNA, 20 bp, Artificial
  CRISPR gRNA sequence
ggtgttatgtttttgttttc

SEQ ID NO: 492395 - DNA, 20 bp, Artificial
  CRISPR gRNA sequence
tatgtttttgttttcttttg

SEQ ID NO: 492396 - DNA, 20 bp, Artificial
  CRISPR gRNA sequence
ctcactgcagccttgaactc

SEQ ID NO: 492397 - DNA, 20 bp, Artificial
  CRISPR gRNA sequence
agctgggagcacaggtgcta

SEQ ID NO: 492398 - DNA, 20 bp, Artificial
  CRISPR gRNA sequence
gcacaggtgctagggagctt

SEQ ID NO: 492399 - DNA, 20 bp, Artificial
  CRISPR gRNA sequence
tgtttactctttgtaaagac

SEQ ID NO: 492400 - DNA, 20 bp, Artificial
  CRISPR gRNA sequence
actctttgtaaagacagcag

SEQ ID NO: 492401 - DNA, 20 bp, Artificial
  CRISPR gRNA sequence
tctctcgtggcacttggttc

SEQ ID NO: 492402 - DNA, 20 bp, Artificial
  CRISPR gRNA sequence
ggattttggtcattacttat

SEQ ID NO: 492403 - DNA, 20 bp, Artificial
  CRISPR gRNA sequence
gtcattacttattgatgttt

SEQ ID NO: 492404 - DNA, 20 bp, Artificial
  CRISPR gRNA sequence
ggtgagttggggaggctcag

SEQ ID NO: 492405 - DNA, 20 bp, Artificial
  CRISPR gRNA sequence
aagagaaaataagagatggg

SEQ ID NO: 492406 - DNA, 20 bp, Artificial
  CRISPR gRNA sequence
gaagagagcaattgagacag

SEQ ID NO: 492407 - DNA, 20 bp, Artificial
  CRISPR gRNA sequence
tgaatgcagtctctccaagc

SEQ ID NO: 492408 - DNA, 20 bp, Artificial
  CRISPR gRNA sequence
attaaaggacttgtaatact

SEQ ID NO: 492409 - DNA, 20 bp, Artificial
  CRISPR gRNA sequence
aatactatttgtttgatgaa

SEQ ID NO: 492410 - DNA, 20 bp, Artificial
  CRISPR gRNA sequence
gctctgcccattagcaaacc

SEQ ID NO: 492411 - DNA, 20 bp, Artificial
  CRISPR gRNA sequence
agggcctcttcatgtataag

SEQ ID NO: 492412 - DNA, 20 bp, Artificial
  CRISPR gRNA sequence
aggcatgattcctgactcca

SEQ ID NO: 492413 - DNA, 20 bp, Artificial
  CRISPR gRNA sequence
gcacattgttaaagttatca

SEQ ID NO: 492414 - DNA, 20 bp, Artificial
  CRISPR gRNA sequence
tgttgttccctggaggcatc

SEQ ID NO: 492415 - DNA, 20 bp, Artificial
  CRISPR gRNA sequence
caattttgaatcatcacaac

SEQ ID NO: 492416 - DNA, 20 bp, Artificial
  CRISPR gRNA sequence
agagcattaaattattccta

SEQ ID NO: 492417 - DNA, 20 bp, Artificial
  CRISPR gRNA sequence
tatgttcaaggaaataaaac

SEQ ID NO: 492418 - DNA, 20 bp, Artificial
  CRISPR gRNA sequence
ttgggagtctgaggcacgag

SEQ ID NO: 492419 - DNA, 20 bp, Artificial
  CRISPR gRNA sequence
aactgcttgaacccgggaga

SEQ ID NO: 492420 - DNA, 20 bp, Artificial
  CRISPR gRNA sequence
gaatcactaactaaataggt

SEQ ID NO: 492421 - DNA, 20 bp, Artificial
  CRISPR gRNA sequence
ataggtagttgttttaaact

SEQ ID NO: 492422 - DNA, 20 bp, Artificial
  CRISPR gRNA sequence
tgcagcaatagttacctgaa

SEQ ID NO: 492423 - DNA, 20 bp, Artificial
  CRISPR gRNA sequence
aaactgacaaaagccatcaa

SEQ ID NO: 492424 - DNA, 20 bp, Artificial
  CRISPR gRNA sequence
tggatggatcacctgacgtc

SEQ ID NO: 492425 - DNA, 20 bp, Artificial
  CRISPR gRNA sequence
ataggttattggggtacagg

SEQ ID NO: 492426 - DNA, 20 bp, Artificial
  CRISPR gRNA sequence
tacaagagaaagttcattag

SEQ ID NO: 492427 - DNA, 20 bp, Artificial
  CRISPR gRNA sequence
ttcttatgcctttgcatcct

SEQ ID NO: 492428 - DNA, 20 bp, Artificial
  CRISPR gRNA sequence
cacgtatcagtgagaacata

SEQ ID NO: 492429 - DNA, 20 bp, Artificial
  CRISPR gRNA sequence
atcagtgagaacatacgttg

SEQ ID NO: 492430 - DNA, 20 bp, Artificial
  CRISPR gRNA sequence
gtggggggatagagctgtat

SEQ ID NO: 492431 - DNA, 20 bp, Artificial
  CRISPR gRNA sequence
agtaggaataaacaatcatc

SEQ ID NO: 492432 - DNA, 20 bp, Artificial
  CRISPR gRNA sequence
cttcagtttctatgcatata

SEQ ID NO: 492433 - DNA, 20 bp, Artificial
  CRISPR gRNA sequence
taaatccacaactatagttg

SEQ ID NO: 492434 - DNA, 20 bp, Artificial
  CRISPR gRNA sequence
aaaataaccagaaaatctct

SEQ ID NO: 492435 - DNA, 20 bp, Artificial
  CRISPR gRNA sequence
aatgtgcaatatagctaagg

SEQ ID NO: 492436 - DNA, 20 bp, Artificial
  CRISPR gRNA sequence
gcagtgtttagagggaaatt

SEQ ID NO: 492437 - DNA, 20 bp, Artificial
  CRISPR gRNA sequence
tttgtatattggaaaagaaa

SEQ ID NO: 492438 - DNA, 20 bp, Artificial
  CRISPR gRNA sequence
aaagtttgcaagtcaataat

SEQ ID NO: 492439 - DNA, 20 bp, Artificial
  CRISPR gRNA sequence
agtgttaaaatgtatatacc

SEQ ID NO: 492440 - DNA, 20 bp, Artificial
  CRISPR gRNA sequence
cttggaccgtgtctccttgg

SEQ ID NO: 492441 - DNA, 20 bp, Artificial
  CRISPR gRNA sequence
gtgttctgagcactagagag

SEQ ID NO: 492442 - DNA, 20 bp, Artificial
  CRISPR gRNA sequence
ttacaagagctcctgctctc

SEQ ID NO: 492443 - DNA, 20 bp, Artificial
  CRISPR gRNA sequence
tggacccaacacaaatagtt

SEQ ID NO: 492444 - DNA, 20 bp, Artificial
  CRISPR gRNA sequence
catttcagagaagttcctgc

SEQ ID NO: 492445 - DNA, 20 bp, Artificial
  CRISPR gRNA sequence
atctgaacagacaggccttg

SEQ ID NO: 492446 - DNA, 20 bp, Artificial
  CRISPR gRNA sequence
tccataaaaacccaagagga

SEQ ID NO: 492447 - DNA, 20 bp, Artificial
  CRISPR gRNA sequence
ttggagagcctccagatagc

SEQ ID NO: 492448 - DNA, 20 bp, Artificial
  CRISPR gRNA sequence
agtgtgcccagggaaggcat

SEQ ID NO: 492449 - DNA, 20 bp, Artificial
  CRISPR gRNA sequence
tataatagaccagcaaacat

SEQ ID NO: 492450 - DNA, 20 bp, Artificial
  CRISPR gRNA sequence
ccagcaaacataaatgtttc

SEQ ID NO: 492451 - DNA, 20 bp, Artificial
  CRISPR gRNA sequence
gtccactgcagaatacatta

SEQ ID NO: 492452 - DNA, 20 bp, Artificial
  CRISPR gRNA sequence
gtcacagaagtcttctatgt

SEQ ID NO: 492453 - DNA, 20 bp, Artificial
  CRISPR gRNA sequence
cagaggaaaaacatggttgg

SEQ ID NO: 492454 - DNA, 20 bp, Artificial
  CRISPR gRNA sequence
catctctttctttttttttt

SEQ ID NO: 492455 - DNA, 20 bp, Artificial
  CRISPR gRNA sequence
tgggatacgtatgcagaaca

SEQ ID NO: 492456 - DNA, 20 bp, Artificial
  CRISPR gRNA sequence
cgtaggtatacgtgtgccat

SEQ ID NO: 492457 - DNA, 20 bp, Artificial
  CRISPR gRNA sequence
tgcacctatcaacccatcat

SEQ ID NO: 492458 - DNA, 20 bp, Artificial
  CRISPR gRNA sequence
ccactttgagtgagaacacg

SEQ ID NO: 492459 - DNA, 20 bp, Artificial
  CRISPR gRNA sequence
ttgagtgagaacacgtggtg

SEQ ID NO: 492460 - DNA, 20 bp, Artificial
  CRISPR gRNA sequence
gtttggttttctgttcctgt

SEQ ID NO: 492461 - DNA, 20 bp, Artificial
  CRISPR gRNA sequence
tgtgttagtttgctgagaac

SEQ ID NO: 492462 - DNA, 20 bp, Artificial
  CRISPR gRNA sequence
gtttgctgagaacgatggct

SEQ ID NO: 492463 - DNA, 20 bp, Artificial
  CRISPR gRNA sequence
ctgcaaactcaggaacagaa

SEQ ID NO: 492464 - DNA, 20 bp, Artificial
  CRISPR gRNA sequence
aaaattatttgagtgtagaa

SEQ ID NO: 492465 - DNA, 20 bp, Artificial
  CRISPR gRNA sequence
acctatacacctattgcaac

SEQ ID NO: 492466 - DNA, 20 bp, Artificial
  CRISPR gRNA sequence
aaataaacaggagactatac

SEQ ID NO: 492467 - DNA, 20 bp, Artificial
  CRISPR gRNA sequence
caattcttcctaaattaatt

SEQ ID NO: 492468 - DNA, 20 bp, Artificial
  CRISPR gRNA sequence
tatttttatagaaattaaca

SEQ ID NO: 492469 - DNA, 20 bp, Artificial
  CRISPR gRNA sequence
cttgatgaagaacaaagcta

SEQ ID NO: 492470 - DNA, 20 bp, Artificial
  CRISPR gRNA sequence
aagatagcattccagtattg

SEQ ID NO: 492471 - DNA, 20 bp, Artificial
  CRISPR gRNA sequence
ctgtgtgtgggaaaaacact

SEQ ID NO: 492472 - DNA, 20 bp, Artificial
  CRISPR gRNA sequence
aaaacactaactgtttttcc

SEQ ID NO: 492473 - DNA, 20 bp, Artificial
  CRISPR gRNA sequence
acttctgtgaccaacgtgtg

SEQ ID NO: 492474 - DNA, 20 bp, Artificial
  CRISPR gRNA sequence
accagatgccaactgcaagc

SEQ ID NO: 492475 - DNA, 20 bp, Artificial
  CRISPR gRNA sequence
gatgccaactgcaagctcca

SEQ ID NO: 492476 - DNA, 20 bp, Artificial
  CRISPR gRNA sequence
caagctccagattgttttac

SEQ ID NO: 492477 - DNA, 20 bp, Artificial
  CRISPR gRNA sequence
tctgaccaactagctataaa

SEQ ID NO: 492478 - DNA, 20 bp, Artificial
  CRISPR gRNA sequence
gaactcagggaaacacattc

SEQ ID NO: 492479 - DNA, 20 bp, Artificial
  CRISPR gRNA sequence
aaggtgtaggggaagggata

SEQ ID NO: 492480 - DNA, 20 bp, Artificial
  CRISPR gRNA sequence
gccaccctccaggaacctcc

SEQ ID NO: 492481 - DNA, 20 bp, Artificial
  CRISPR gRNA sequence
agctctctgaaccttgttct

SEQ ID NO: 492482 - DNA, 20 bp, Artificial
  CRISPR gRNA sequence
atggaggcctcaataaatgg

SEQ ID NO: 492483 - DNA, 20 bp, Artificial
  CRISPR gRNA sequence
tacttgatcttttcaataaa

SEQ ID NO: 492484 - DNA, 20 bp, Artificial
  CRISPR gRNA sequence
aaatatgaaagctaaaccta

SEQ ID NO: 492485 - DNA, 20 bp, Artificial
  CRISPR gRNA sequence
ttctacatcttgagatagac

SEQ ID NO: 492486 - DNA, 20 bp, Artificial
  CRISPR gRNA sequence
ttttacattttaatctattt

SEQ ID NO: 492487 - DNA, 20 bp, Artificial
  CRISPR gRNA sequence
atttttatgtttattttgag

SEQ ID NO: 492488 - DNA, 20 bp, Artificial
  CRISPR gRNA sequence
ttttgcatttttggtagaga

SEQ ID NO: 492489 - DNA, 20 bp, Artificial
  CRISPR gRNA sequence
atagagtttcaccatgttgc

SEQ ID NO: 492490 - DNA, 20 bp, Artificial
  CRISPR gRNA sequence
cgccttggcctcccaaagcg

SEQ ID NO: 492491 - DNA, 20 bp, Artificial
  CRISPR gRNA sequence
agccactgcacccagacaac

SEQ ID NO: 492492 - DNA, 20 bp, Artificial
  CRISPR gRNA sequence
acttcactaaaacttagaac

SEQ ID NO: 492493 - DNA, 20 bp, Artificial
  CRISPR gRNA sequence
gcaagccaaagactgggaga

SEQ ID NO: 492494 - DNA, 20 bp, Artificial
  CRISPR gRNA sequence
acattagttatcagagaata

SEQ ID NO: 492495 - DNA, 20 bp, Artificial
  CRISPR gRNA sequence
ttgggaggccgaggcgggtg

SEQ ID NO: 492496 - DNA, 20 bp, Artificial
  CRISPR gRNA sequence
acggtggtggcgcctgtaat

SEQ ID NO: 492497 - DNA, 20 bp, Artificial
  CRISPR gRNA sequence
ttgggagtctgaggcaggag

SEQ ID NO: 492498 - DNA, 20 bp, Artificial
  CRISPR gRNA sequence
gttgacagagatgggagcaa

SEQ ID NO: 492499 - DNA, 20 bp, Artificial
  CRISPR gRNA sequence
caggcggatcacctgaggtc

SEQ ID NO: 492500 - DNA, 20 bp, Artificial
  CRISPR gRNA sequence
tctcaaaaaaaaagaaaatc

SEQ ID NO: 492501 - DNA, 20 bp, Artificial
  CRISPR gRNA sequence
atatgtacaagagtgttaat

SEQ ID NO: 492502 - DNA, 20 bp, Artificial
  CRISPR gRNA sequence
agaaaaaacccaaatgtcta

SEQ ID NO: 492503 - DNA, 20 bp, Artificial
  CRISPR gRNA sequence
agtgaattatttcactgata

SEQ ID NO: 492504 - DNA, 20 bp, Artificial
  CRISPR gRNA sequence
atatggtgagagaggttaga

SEQ ID NO: 492505 - DNA, 20 bp, Artificial
  CRISPR gRNA sequence
atgtgttacatcttgatgtg

SEQ ID NO: 492506 - DNA, 20 bp, Artificial
  CRISPR gRNA sequence
catataaaagttcatcaagc

SEQ ID NO: 492507 - DNA, 20 bp, Artificial
  CRISPR gRNA sequence
attaccatagcaagtgaatt

SEQ ID NO: 492508 - DNA, 20 bp, Artificial
  CRISPR gRNA sequence
gtgaggcaagcataaggaaa

SEQ ID NO: 492509 - DNA, 20 bp, Artificial
  CRISPR gRNA sequence
aagggaacacaaaacacacg

SEQ ID NO: 492510 - DNA, 20 bp, Artificial
  CRISPR gRNA sequence
atgggtctggtaaagatgga

SEQ ID NO: 492511 - DNA, 20 bp, Artificial
  CRISPR gRNA sequence
ggagaatggggtgatggaac

SEQ ID NO: 492512 - DNA, 20 bp, Artificial
  CRISPR gRNA sequence
ggaacatgagtttaattttc

SEQ ID NO: 492513 - DNA, 20 bp, Artificial
  CRISPR gRNA sequence
ttaattttcaggtgtttagt

SEQ ID NO: 492514 - DNA, 20 bp, Artificial
  CRISPR gRNA sequence
ttaagttattgtctagactt

SEQ ID NO: 492515 - DNA, 20 bp, Artificial
  CRISPR gRNA sequence
gttattgtctagacttcttt

SEQ ID NO: 492516 - DNA, 20 bp, Artificial
  CRISPR gRNA sequence
ttgtctagacttctttgttt

SEQ ID NO: 492517 - DNA, 20 bp, Artificial
  CRISPR gRNA sequence
ctagacttctttgtttgttt

SEQ ID NO: 492518 - DNA, 20 bp, Artificial
  CRISPR gRNA sequence
aatctctgcctcccaggttc

SEQ ID NO: 492519 - DNA, 20 bp, Artificial
  CRISPR gRNA sequence
ttttgtatttttagtagaga

SEQ ID NO: 492520 - DNA, 20 bp, Artificial
  CRISPR gRNA sequence
ttatttttatgtaatattat

SEQ ID NO: 492521 - DNA, 20 bp, Artificial
  CRISPR gRNA sequence
tattagtttatacatttaag

SEQ ID NO: 492522 - DNA, 20 bp, Artificial
  CRISPR gRNA sequence
gagctagagagaacaccagg

SEQ ID NO: 492523 - DNA, 20 bp, Artificial
  CRISPR gRNA sequence
agagagaacaccaggtgttg

SEQ ID NO: 492524 - DNA, 20 bp, Artificial
  CRISPR gRNA sequence
aggttggtggaatccctaac

SEQ ID NO: 492525 - DNA, 20 bp, Artificial
  CRISPR gRNA sequence
gtggaatccctaacttgtgc

SEQ ID NO: 492526 - DNA, 20 bp, Artificial
  CRISPR gRNA sequence
ttttcttaaagaaggaggtt

SEQ ID NO: 492527 - DNA, 20 bp, Artificial
  CRISPR gRNA sequence
gagaagctgtgggccagaaa

SEQ ID NO: 492528 - DNA, 20 bp, Artificial
  CRISPR gRNA sequence
actgagagtccagctggggt

SEQ ID NO: 492529 - DNA, 20 bp, Artificial
  CRISPR gRNA sequence
gaaggaggaagatggttgga

SEQ ID NO: 492530 - DNA, 20 bp, Artificial
  CRISPR gRNA sequence
tgtgactgatacagaaagac

SEQ ID NO: 492531 - DNA, 20 bp, Artificial
  CRISPR gRNA sequence
aggaggacccaacaagtgaa

SEQ ID NO: 492532 - DNA, 20 bp, Artificial
  CRISPR gRNA sequence
cactgctgttgctactgctc

SEQ ID NO: 492533 - DNA, 20 bp, Artificial
  CRISPR gRNA sequence
tgaaagggagggcagagggc

SEQ ID NO: 492534 - DNA, 20 bp, Artificial
  CRISPR gRNA sequence
tgtgcagagctctgagtcag

SEQ ID NO: 492535 - DNA, 20 bp, Artificial
  CRISPR gRNA sequence
accagccaacaaatagatgt

SEQ ID NO: 492536 - DNA, 20 bp, Artificial
  CRISPR gRNA sequence
gatgttaaggttttctcagc

SEQ ID NO: 492537 - DNA, 20 bp, Artificial
  CRISPR gRNA sequence
ctcagctagggcttgtgcta

SEQ ID NO: 492538 - DNA, 20 bp, Artificial
  CRISPR gRNA sequence
gactaagtgaacagagtcca

SEQ ID NO: 492539 - DNA, 20 bp, Artificial
  CRISPR gRNA sequence
catttctttcttcctctcta

SEQ ID NO: 492540 - DNA, 20 bp, Artificial
  CRISPR gRNA sequence
ccaaatcatctcatatgtga

SEQ ID NO: 492541 - DNA, 20 bp, Artificial
  CRISPR gRNA sequence
ataacaagtgcatctccctt

SEQ ID NO: 492542 - DNA, 20 bp, Artificial
  CRISPR gRNA sequence
ccatccaaaccccatgcaac

SEQ ID NO: 492543 - DNA, 20 bp, Artificial
  CRISPR gRNA sequence
atgcaaccctggcttttctg

SEQ ID NO: 492544 - DNA, 20 bp, Artificial
  CRISPR gRNA sequence
tggcttttctgagctgtttc

SEQ ID NO: 492545 - DNA, 20 bp, Artificial
  CRISPR gRNA sequence
atacccattttcctctgtct

SEQ ID NO: 492546 - DNA, 20 bp, Artificial
  CRISPR gRNA sequence
ttcttaagggtagaatagac

SEQ ID NO: 492547 - DNA, 20 bp, Artificial
  CRISPR gRNA sequence
agaatagacatctgtttcat

SEQ ID NO: 492548 - DNA, 20 bp, Artificial
  CRISPR gRNA sequence
agcataataagggctgggga

SEQ ID NO: 492549 - DNA, 20 bp, Artificial
  CRISPR gRNA sequence
gcaaaatgaacaacccaagc

SEQ ID NO: 492550 - DNA, 20 bp, Artificial
  CRISPR gRNA sequence
cccaagcaagggcttcatga

SEQ ID NO: 492551 - DNA, 20 bp, Artificial
  CRISPR gRNA sequence
ttggttcaaccactttggaa

SEQ ID NO: 492552 - DNA, 20 bp, Artificial
  CRISPR gRNA sequence
tagtcagacacaagagtgca

SEQ ID NO: 492553 - DNA, 20 bp, Artificial
  CRISPR gRNA sequence
cagacacaagagtgcatacc

SEQ ID NO: 492554 - DNA, 20 bp, Artificial
  CRISPR gRNA sequence
gtatgttgcacttcaataag

SEQ ID NO: 492555 - DNA, 20 bp, Artificial
  CRISPR gRNA sequence
taatttgggaggccaaggca

SEQ ID NO: 492556 - DNA, 20 bp, Artificial
  CRISPR gRNA sequence
ttgggaggccaaggcaagag

SEQ ID NO: 492557 - DNA, 20 bp, Artificial
  CRISPR gRNA sequence
ctactaaggaggctgaggca

SEQ ID NO: 492558 - DNA, 20 bp, Artificial
  CRISPR gRNA sequence
taaggaggctgaggcagaag

SEQ ID NO: 492559 - DNA, 20 bp, Artificial
  CRISPR gRNA sequence
acatgccctgtctctccttg

SEQ ID NO: 492560 - DNA, 20 bp, Artificial
  CRISPR gRNA sequence
tctctccttgaagtgatttc

SEQ ID NO: 492561 - DNA, 20 bp, Artificial
  CRISPR gRNA sequence
aaaaacgactccagcccttc

SEQ ID NO: 492562 - DNA, 20 bp, Artificial
  CRISPR gRNA sequence
aactcaggctgtaaagcatc

SEQ ID NO: 492563 - DNA, 20 bp, Artificial
  CRISPR gRNA sequence
cctccagcctgtgtgtcctt

SEQ ID NO: 492564 - DNA, 20 bp, Artificial
  CRISPR gRNA sequence
gcccaggcctattccctggg

SEQ ID NO: 492565 - DNA, 20 bp, Artificial
  CRISPR gRNA sequence
ttcacttattcactcaacaa

SEQ ID NO: 492566 - DNA, 20 bp, Artificial
  CRISPR gRNA sequence
aattaagtggagagagagct

SEQ ID NO: 492567 - DNA, 20 bp, Artificial
  CRISPR gRNA sequence
tcacgcaccattgtaaaatg

SEQ ID NO: 492568 - DNA, 20 bp, Artificial
  CRISPR gRNA sequence
ttaaattattcagtaaacaa

SEQ ID NO: 492569 - DNA, 20 bp, Artificial
  CRISPR gRNA sequence
cagggaggctgaggtgggag

SEQ ID NO: 492570 - DNA, 20 bp, Artificial
  CRISPR gRNA sequence
tgggtggatcacttgaggtc

SEQ ID NO: 492571 - DNA, 20 bp, Artificial
  CRISPR gRNA sequence
accaaaaatacaaaaattag

SEQ ID NO: 492572 - DNA, 20 bp, Artificial
  CRISPR gRNA sequence
ggagcagaagttgcagtgag

SEQ ID NO: 492573 - DNA, 20 bp, Artificial
  CRISPR gRNA sequence
atgagggaacatcagacaaa

SEQ ID NO: 492574 - DNA, 20 bp, Artificial
  CRISPR gRNA sequence
aaggaaccctctacaaaaca

SEQ ID NO: 492575 - DNA, 20 bp, Artificial
  CRISPR gRNA sequence
caactgaatgtaatacatga

SEQ ID NO: 492576 - DNA, 20 bp, Artificial
  CRISPR gRNA sequence
ctagatgaaagaaattcaag

SEQ ID NO: 492577 - DNA, 20 bp, Artificial
  CRISPR gRNA sequence
agaatcgtttgaactattct

SEQ ID NO: 492578 - DNA, 20 bp, Artificial
  CRISPR gRNA sequence
ttcacaattatttcaaacta

SEQ ID NO: 492579 - DNA, 20 bp, Artificial
  CRISPR gRNA sequence
cttaaaaattaaagaaatag

SEQ ID NO: 492580 - DNA, 20 bp, Artificial
  CRISPR gRNA sequence
ctgtgcctaacaagtcactc

SEQ ID NO: 492581 - DNA, 20 bp, Artificial
  CRISPR gRNA sequence
catgacctcagggtcataac

SEQ ID NO: 492582 - DNA, 20 bp, Artificial
  CRISPR gRNA sequence
gcatgggactttattgcata

SEQ ID NO: 492583 - DNA, 20 bp, Artificial
  CRISPR gRNA sequence
gaacccacacaacactatgc

SEQ ID NO: 492584 - DNA, 20 bp, Artificial
  CRISPR gRNA sequence
aatcacttgaacccgggagg

SEQ ID NO: 492585 - DNA, 20 bp, Artificial
  CRISPR gRNA sequence
aattaaattaaatgcgggat

SEQ ID NO: 492586 - DNA, 20 bp, Artificial
  CRISPR gRNA sequence
agatggctccatgcctggct

SEQ ID NO: 492587 - DNA, 20 bp, Artificial
  CRISPR gRNA sequence
tccatgcctggctgacagct

SEQ ID NO: 492588 - DNA, 20 bp, Artificial
  CRISPR gRNA sequence
tgacagctttaggtttgctg

SEQ ID NO: 492589 - DNA, 20 bp, Artificial
  CRISPR gRNA sequence
ggagatgagggaccatgcct

SEQ ID NO: 492590 - DNA, 20 bp, Artificial
  CRISPR gRNA sequence
ctcgccctcccctccctggg

SEQ ID NO: 492591 - DNA, 20 bp, Artificial
  CRISPR gRNA sequence
agaaccacccacttccttgg

SEQ ID NO: 492592 - DNA, 20 bp, Artificial
  CRISPR gRNA sequence
atctttacaggcggctggaa

SEQ ID NO: 492593 - DNA, 20 bp, Artificial
  CRISPR gRNA sequence
aatctcctcacccaagactt

SEQ ID NO: 492594 - DNA, 20 bp, Artificial
  CRISPR gRNA sequence
gtgcactgccagcctgtcct

SEQ ID NO: 492595 - DNA, 20 bp, Artificial
  CRISPR gRNA sequence
tgccttgcaacctgtccagc

SEQ ID NO: 492596 - DNA, 20 bp, Artificial
  CRISPR gRNA sequence
gttcccacaagccaaactgg

SEQ ID NO: 492597 - DNA, 20 bp, Artificial
  CRISPR gRNA sequence
gaagcttacctcaagtggga

SEQ ID NO: 492598 - DNA, 20 bp, Artificial
  CRISPR gRNA sequence
agttcacagtgactcacaaa

SEQ ID NO: 492599 - DNA, 20 bp, Artificial
  CRISPR gRNA sequence
caagcaccctcccacttgag

SEQ ID NO: 492600 - DNA, 20 bp, Artificial
  CRISPR gRNA sequence
tcccacttgaggtaagcttc

SEQ ID NO: 492601 - DNA, 20 bp, Artificial
  CRISPR gRNA sequence
cttgaggtaagcttcaccag

SEQ ID NO: 492602 - DNA, 20 bp, Artificial
  CRISPR gRNA sequence
gtcagaccagctccaggcgc

SEQ ID NO: 492603 - DNA, 20 bp, Artificial
  CRISPR gRNA sequence
agggagatcagagccagagc

SEQ ID NO: 492604 - DNA, 20 bp, Artificial
  CRISPR gRNA sequence
aatccaggaagtcttgggtg

SEQ ID NO: 492605 - DNA, 20 bp, Artificial
  CRISPR gRNA sequence
gggtgaggagattccttccc

SEQ ID NO: 492606 - DNA, 20 bp, Artificial
  CRISPR gRNA sequence
aaggcatggtccctcatctc

SEQ ID NO: 492607 - DNA, 20 bp, Artificial
  CRISPR gRNA sequence
aaactctgcctcccgggttc

SEQ ID NO: 492608 - DNA, 20 bp, Artificial
  CRISPR gRNA sequence
gaaattacagacgtgcgcca

SEQ ID NO: 492609 - DNA, 20 bp, Artificial
  CRISPR gRNA sequence
ttttgtatttttagtagaga

SEQ ID NO: 492610 - DNA, 20 bp, Artificial
  CRISPR gRNA sequence
ggtctcccccatccaaagtg

SEQ ID NO: 492611 - DNA, 20 bp, Artificial
  CRISPR gRNA sequence
ttttagatcagtgactctgc

SEQ ID NO: 492612 - DNA, 20 bp, Artificial
  CRISPR gRNA sequence
gggttggggggcctagtggc

SEQ ID NO: 492613 - DNA, 20 bp, Artificial
  CRISPR gRNA sequence
agacagccgaaggaggactg

SEQ ID NO: 492614 - DNA, 20 bp, Artificial
  CRISPR gRNA sequence
gctccctccacccccattcc

SEQ ID NO: 492615 - DNA, 20 bp, Artificial
  CRISPR gRNA sequence
ccagggcttcagcaccatag

SEQ ID NO: 492616 - DNA, 20 bp, Artificial
  CRISPR gRNA sequence
gatggacttgggtcttcctg

SEQ ID NO: 492617 - DNA, 20 bp, Artificial
  CRISPR gRNA sequence
ctgctctatttctttaattt

SEQ ID NO: 492618 - DNA, 20 bp, Artificial
  CRISPR gRNA sequence
tttctttaatttttaagctt

SEQ ID NO: 492619 - DNA, 20 bp, Artificial
  CRISPR gRNA sequence
ggaagctgcaagaatagttc

SEQ ID NO: 492620 - DNA, 20 bp, Artificial
  CRISPR gRNA sequence
cgattcttgaatttctttca

SEQ ID NO: 492621 - DNA, 20 bp, Artificial
  CRISPR gRNA sequence
tttaacattaataccatcaa

SEQ ID NO: 492622 - DNA, 20 bp, Artificial
  CRISPR gRNA sequence
tattaccaattgtcccaaga

SEQ ID NO: 492623 - DNA, 20 bp, Artificial
  CRISPR gRNA sequence
tcatgtattacattcagttg

SEQ ID NO: 492624 - DNA, 20 bp, Artificial
  CRISPR gRNA sequence
attcttgaagaagacaagcc

SEQ ID NO: 492625 - DNA, 20 bp, Artificial
  CRISPR gRNA sequence
tttgtagagggttccttaat

SEQ ID NO: 492626 - DNA, 20 bp, Artificial
  CRISPR gRNA sequence
ggtttgtctgatgttccctc

SEQ ID NO: 492627 - DNA, 20 bp, Artificial
  CRISPR gRNA sequence
acttctgctcccccgggttc

SEQ ID NO: 492628 - DNA, 20 bp, Artificial
  CRISPR gRNA sequence
ttttgtatttttggtggaga

SEQ ID NO: 492629 - DNA, 20 bp, Artificial
  CRISPR gRNA sequence
tttttttttttttgtagata

SEQ ID NO: 492630 - DNA, 20 bp, Artificial
  CRISPR gRNA sequence
cagtgaaatttaaaaaacca

SEQ ID NO: 492631 - DNA, 20 bp, Artificial
  CRISPR gRNA sequence
acctcgctctctgttgtatc

SEQ ID NO: 492632 - DNA, 20 bp, Artificial
  CRISPR gRNA sequence
ggcctcttccctcaacccct

SEQ ID NO: 492633 - DNA, 20 bp, Artificial
  CRISPR gRNA sequence
tcatctccatttatgttcca

SEQ ID NO: 492634 - DNA, 20 bp, Artificial
  CRISPR gRNA sequence
ttatgttccatcctgtttac

SEQ ID NO: 492635 - DNA, 20 bp, Artificial
  CRISPR gRNA sequence
gactgtaagatccttgaggc

SEQ ID NO: 492636 - DNA, 20 bp, Artificial
  CRISPR gRNA sequence
tccttgaggccagggctttt

SEQ ID NO: 492637 - DNA, 20 bp, Artificial
  CRISPR gRNA sequence
tagctctgaaccagggctat

SEQ ID NO: 492638 - DNA, 20 bp, Artificial
  CRISPR gRNA sequence
cagtggcaagtaagtccagg

SEQ ID NO: 492639 - DNA, 20 bp, Artificial
  CRISPR gRNA sequence
gtccagggcccgtttgttca

SEQ ID NO: 492640 - DNA, 20 bp, Artificial
  CRISPR gRNA sequence
cgtttgttcagagagcttgc

SEQ ID NO: 492641 - DNA, 20 bp, Artificial
  CRISPR gRNA sequence
ctgagtcactgttactacag

SEQ ID NO: 492642 - DNA, 20 bp, Artificial
  CRISPR gRNA sequence
caatgcagtaggtgttcaaa

SEQ ID NO: 492643 - DNA, 20 bp, Artificial
  CRISPR gRNA sequence
gcatcttaacgggcagcctg

SEQ ID NO: 492644 - DNA, 20 bp, Artificial
  CRISPR gRNA sequence
attcattttagacccaaaat

SEQ ID NO: 492645 - DNA, 20 bp, Artificial
  CRISPR gRNA sequence
gctggaggctatgaatcccc

SEQ ID NO: 492646 - DNA, 20 bp, Artificial
  CRISPR gRNA sequence
aaagggcacaggtgacacct

SEQ ID NO: 492647 - DNA, 20 bp, Artificial
  CRISPR gRNA sequence
gattagctccaagggttgcc

SEQ ID NO: 492648 - DNA, 20 bp, Artificial
  CRISPR gRNA sequence
caagggttgccagctgtttg

SEQ ID NO: 492649 - DNA, 20 bp, Artificial
  CRISPR gRNA sequence
agggagtggtgtctaactgc

SEQ ID NO: 492650 - DNA, 20 bp, Artificial
  CRISPR gRNA sequence
gcaagctgtagaagggctgg

SEQ ID NO: 492651 - DNA, 20 bp, Artificial
  CRISPR gRNA sequence
caaagtagctggacacagaa

SEQ ID NO: 492652 - DNA, 20 bp, Artificial
  CRISPR gRNA sequence
tcaaggagagacagggcatg

SEQ ID NO: 492653 - DNA, 20 bp, Artificial
  CRISPR gRNA sequence
tacaggcatgtatcaccaca

SEQ ID NO: 492654 - DNA, 20 bp, Artificial
  CRISPR gRNA sequence
ttttaatttttgtgtagaga

SEQ ID NO: 492655 - DNA, 20 bp, Artificial
  CRISPR gRNA sequence
tgccttggcctcccaaatta

SEQ ID NO: 492656 - DNA, 20 bp, Artificial
  CRISPR gRNA sequence
acaattctgacttctaacat

SEQ ID NO: 492657 - DNA, 20 bp, Artificial
  CRISPR gRNA sequence
tctgacttctaacatcacag

SEQ ID NO: 492658 - DNA, 20 bp, Artificial
  CRISPR gRNA sequence
ctacttttgctcaacatctt

SEQ ID NO: 492659 - DNA, 20 bp, Artificial
  CRISPR gRNA sequence
attttatcgcatgactatat

SEQ ID NO: 492660 - DNA, 20 bp, Artificial
  CRISPR gRNA sequence
ctattattgatgaacctttg

SEQ ID NO: 492661 - DNA, 20 bp, Artificial
  CRISPR gRNA sequence
aacctttgggttgctttcaa

SEQ ID NO: 492662 - DNA, 20 bp, Artificial
  CRISPR gRNA sequence
aactctagcagatgctgtca

SEQ ID NO: 492663 - DNA, 20 bp, Artificial
  CRISPR gRNA sequence
aatagtgcatgagagttcca

SEQ ID NO: 492664 - DNA, 20 bp, Artificial
  CRISPR gRNA sequence
ttccatgctgctttggggcc

SEQ ID NO: 492665 - DNA, 20 bp, Artificial
  CRISPR gRNA sequence
aaaattaaattgtggaaatg

SEQ ID NO: 492666 - DNA, 20 bp, Artificial
  CRISPR gRNA sequence
aaggcaagggaattacagct

SEQ ID NO: 492667 - DNA, 20 bp, Artificial
  CRISPR gRNA sequence
ttgttgaattaattaattta

SEQ ID NO: 492668 - DNA, 20 bp, Artificial
  CRISPR gRNA sequence
tttaaacggattcatgaagc

SEQ ID NO: 492669 - DNA, 20 bp, Artificial
  CRISPR gRNA sequence
ggttgttcattttgctgttg

SEQ ID NO: 492670 - DNA, 20 bp, Artificial
  CRISPR gRNA sequence
attctgcatattagttgcct

SEQ ID NO: 492671 - DNA, 20 bp, Artificial
  CRISPR gRNA sequence
tattagttgcctgtaggatt

SEQ ID NO: 492672 - DNA, 20 bp, Artificial
  CRISPR gRNA sequence
ggttgccttttcactctgtg

SEQ ID NO: 492673 - DNA, 20 bp, Artificial
  CRISPR gRNA sequence
tgaattgtttcctttactgt

SEQ ID NO: 492674 - DNA, 20 bp, Artificial
  CRISPR gRNA sequence
tttactgtacatgatttttt

SEQ ID NO: 492675 - DNA, 20 bp, Artificial
  CRISPR gRNA sequence
ttttagtttgctgtaatacc

SEQ ID NO: 492676 - DNA, 20 bp, Artificial
  CRISPR gRNA sequence
gctgtaataccatttgttta

SEQ ID NO: 492677 - DNA, 20 bp, Artificial
  CRISPR gRNA sequence
gtttattttgcttctgttgc

SEQ ID NO: 492678 - DNA, 20 bp, Artificial
  CRISPR gRNA sequence
attatgctccaagaactatg

SEQ ID NO: 492679 - DNA, 20 bp, Artificial
  CRISPR gRNA sequence
taaaaaaggagctaagaaga

SEQ ID NO: 492680 - DNA, 20 bp, Artificial
  CRISPR gRNA sequence
actggccttgaagaataaat

SEQ ID NO: 492681 - DNA, 20 bp, Artificial
  CRISPR gRNA sequence
tcagaaaagccagggttgca

SEQ ID NO: 492682 - DNA, 20 bp, Artificial
  CRISPR gRNA sequence
gagaaacaatatcacatatg

SEQ ID NO: 492683 - DNA, 20 bp, Artificial
  CRISPR gRNA sequence
aagagtgggacttgggctag

SEQ ID NO: 492684 - DNA, 20 bp, Artificial
  CRISPR gRNA sequence
tataggatactttatctatc

SEQ ID NO: 492685 - DNA, 20 bp, Artificial
  CRISPR gRNA sequence
atgattttgccctgactaga

SEQ ID NO: 492686 - DNA, 20 bp, Artificial
  CRISPR gRNA sequence
tgagcgggactcactgctgg

SEQ ID NO: 492687 - DNA, 20 bp, Artificial
  CRISPR gRNA sequence
tgtgagaacttgtgttgaag

SEQ ID NO: 492688 - DNA, 20 bp, Artificial
  CRISPR gRNA sequence
tctacttgccttttcaccgt

SEQ ID NO: 492689 - DNA, 20 bp, Artificial
  CRISPR gRNA sequence
attcagcaacaaagagcagc

SEQ ID NO: 492690 - DNA, 20 bp, Artificial
  CRISPR gRNA sequence
gggaatcctcatttctggcc

SEQ ID NO: 492691 - DNA, 20 bp, Artificial
  CRISPR gRNA sequence
aagaaaacagaagcacaagt

SEQ ID NO: 492692 - DNA, 20 bp, Artificial
  CRISPR gRNA sequence
cccctgtgtgctcagggcac

SEQ ID NO: 492693 - DNA, 20 bp, Artificial
  CRISPR gRNA sequence
tcttcagctgctccttttct

SEQ ID NO: 492694 - DNA, 20 bp, Artificial
  CRISPR gRNA sequence
tgtgggcttcctacctttag

SEQ ID NO: 492695 - DNA, 20 bp, Artificial
  CRISPR gRNA sequence
aactttgggaggctgagacg

SEQ ID NO: 492696 - DNA, 20 bp, Artificial
  CRISPR gRNA sequence
aatcacttgaacctgggagg

SEQ ID NO: 492697 - DNA, 20 bp, Artificial
  CRISPR gRNA sequence
aataacttaaccattttcct

SEQ ID NO: 492698 - DNA, 20 bp, Artificial
  CRISPR gRNA sequence
attttcctgtgtgattccta

SEQ ID NO: 492699 - DNA, 20 bp, Artificial
  CRISPR gRNA sequence
gctctacattctgatctact

SEQ ID NO: 492700 - DNA, 20 bp, Artificial
  CRISPR gRNA sequence
gatctactggtggattatat

SEQ ID NO: 492701 - DNA, 20 bp, Artificial
  CRISPR gRNA sequence
accagacccataagccacac

SEQ ID NO: 492702 - DNA, 20 bp, Artificial
  CRISPR gRNA sequence
tctgcatacaccaggcaggc

SEQ ID NO: 492703 - DNA, 20 bp, Artificial
  CRISPR gRNA sequence
actctgcagggcagaggaaa

SEQ ID NO: 492704 - DNA, 20 bp, Artificial
  CRISPR gRNA sequence
cagaggaaaacatgctttcc

SEQ ID NO: 492705 - DNA, 20 bp, Artificial
  CRISPR gRNA sequence
ttccatattgcatttcagtt

SEQ ID NO: 492706 - DNA, 20 bp, Artificial
  CRISPR gRNA sequence
ctcactgcaacccctgcctc

SEQ ID NO: 492707 - DNA, 20 bp, Artificial
  CRISPR gRNA sequence
ttctgatatttagctaagag

SEQ ID NO: 492708 - DNA, 20 bp, Artificial
  CRISPR gRNA sequence
tacaaattcacttgctatgg

SEQ ID NO: 492709 - DNA, 20 bp, Artificial
  CRISPR gRNA sequence
tccacaatgggcaagtcata

SEQ ID NO: 492710 - DNA, 20 bp, Artificial
  CRISPR gRNA sequence
agaggtagtcattactcttt

SEQ ID NO: 492711 - DNA, 20 bp, Artificial
  CRISPR gRNA sequence
gtgtgcacaaaatttaaatc

SEQ ID NO: 492712 - DNA, 20 bp, Artificial
  CRISPR gRNA sequence
tctaacctctctcaccatat

SEQ ID NO: 492713 - DNA, 20 bp, Artificial
  CRISPR gRNA sequence
tctcaccatatattagtttt

SEQ ID NO: 492714 - DNA, 20 bp, Artificial
  CRISPR gRNA sequence
tcactatgtactttttggag

SEQ ID NO: 492715 - DNA, 20 bp, Artificial
  CRISPR gRNA sequence
tccacattattgccaggaaa

SEQ ID NO: 492716 - DNA, 20 bp, Artificial
  CRISPR gRNA sequence
atattccttataagactata

SEQ ID NO: 492717 - DNA, 20 bp, Artificial
  CRISPR gRNA sequence
catctaatcgtgatagacat

SEQ ID NO: 492718 - DNA, 20 bp, Artificial
  CRISPR gRNA sequence
tatttttagtggatataaac

SEQ ID NO: 492719 - DNA, 20 bp, Artificial
  CRISPR gRNA sequence
gattttctttttttttgaga

SEQ ID NO: 492720 - DNA, 20 bp, Artificial
  CRISPR gRNA sequence
gctcactgcaacctccgcct

SEQ ID NO: 492721 - DNA, 20 bp, Artificial
  CRISPR gRNA sequence
aacctccgcctctcagattt

SEQ ID NO: 492722 - DNA, 20 bp, Artificial
  CRISPR gRNA sequence
ctctcagatttaagtgattc

SEQ ID NO: 492723 - DNA, 20 bp, Artificial
  CRISPR gRNA sequence
tgcttcagtcttccaagtag

SEQ ID NO: 492724 - DNA, 20 bp, Artificial
  CRISPR gRNA sequence
tttttttcttttttttgaga

SEQ ID NO: 492725 - DNA, 20 bp, Artificial
  CRISPR gRNA sequence
tgcctcgacctcccaaagtg

SEQ ID NO: 492726 - DNA, 20 bp, Artificial
  CRISPR gRNA sequence
gcatgagccaccatgcctgg

SEQ ID NO: 492727 - DNA, 20 bp, Artificial
  CRISPR gRNA sequence
ttctggatcaaagggtatat

SEQ ID NO: 492728 - DNA, 20 bp, Artificial
  CRISPR gRNA sequence
gatcaaagggtatatgtaag

SEQ ID NO: 492729 - DNA, 20 bp, Artificial
  CRISPR gRNA sequence
agttttagaagataccgtaa

SEQ ID NO: 492730 - DNA, 20 bp, Artificial
  CRISPR gRNA sequence
ttttgcatttttagtagaga

SEQ ID NO: 492731 - DNA, 20 bp, Artificial
  CRISPR gRNA sequence
cgcctcggcctcccaaagtg

SEQ ID NO: 492732 - DNA, 20 bp, Artificial
  CRISPR gRNA sequence
cctcccaaagtgctgggatt

SEQ ID NO: 492733 - DNA, 20 bp, Artificial
  CRISPR gRNA sequence
gtgctgggattacaggcttg

SEQ ID NO: 492734 - DNA, 20 bp, Artificial
  CRISPR gRNA sequence
ctaaagtgcctgcccaagtc

SEQ ID NO: 492735 - DNA, 20 bp, Artificial
  CRISPR gRNA sequence
cattattgtcatcagtgtat

SEQ ID NO: 492736 - DNA, 20 bp, Artificial
  CRISPR gRNA sequence
gcaaacattttctcccagtc

SEQ ID NO: 492737 - DNA, 20 bp, Artificial
  CRISPR gRNA sequence
acattttctcccagtctttg

SEQ ID NO: 492738 - DNA, 20 bp, Artificial
  CRISPR gRNA sequence
tctttcaccaaacagaagtt

SEQ ID NO: 492739 - DNA, 20 bp, Artificial
  CRISPR gRNA sequence
tatcaatattcttttatggt

SEQ ID NO: 492740 - DNA, 20 bp, Artificial
  CRISPR gRNA sequence
gtggctcatgcctgtaatct

SEQ ID NO: 492741 - DNA, 20 bp, Artificial
  CRISPR gRNA sequence
ggtctcaaaataaacataaa

SEQ ID NO: 492742 - DNA, 20 bp, Artificial
  CRISPR gRNA sequence
aagatgtagaagatattctc

SEQ ID NO: 492743 - DNA, 20 bp, Artificial
  CRISPR gRNA sequence
attctcttgtgctttttcct

SEQ ID NO: 492744 - DNA, 20 bp, Artificial
  CRISPR gRNA sequence
tgctttttcctggaagcttt

SEQ ID NO: 492745 - DNA, 20 bp, Artificial
  CRISPR gRNA sequence
tttcctggaagctttatagg

SEQ ID NO: 492746 - DNA, 20 bp, Artificial
  CRISPR gRNA sequence
tttagctttcatatttaaat

SEQ ID NO: 492747 - DNA, 20 bp, Artificial
  CRISPR gRNA sequence
ctttcatatttaaatttatg

SEQ ID NO: 492748 - DNA, 20 bp, Artificial
  CRISPR gRNA sequence
atatgatatgagggagatat

SEQ ID NO: 492749 - DNA, 20 bp, Artificial
  CRISPR gRNA sequence
attgaaaagatcaagtatgt

SEQ ID NO: 492750 - DNA, 20 bp, Artificial
  CRISPR gRNA sequence
gtgatattgtgaaatatata

SEQ ID NO: 492751 - DNA, 20 bp, Artificial
  CRISPR gRNA sequence
ccgatggctggcagcctgta

SEQ ID NO: 492752 - DNA, 20 bp, Artificial
  CRISPR gRNA sequence
cccaaccttcaggaaaagga

SEQ ID NO: 492753 - DNA, 20 bp, Artificial
  CRISPR gRNA sequence
cctttataataatccagtga

SEQ ID NO: 492754 - DNA, 20 bp, Artificial
  CRISPR gRNA sequence
aaggagggaataacgggaaa

SEQ ID NO: 492755 - DNA, 20 bp, Artificial
  CRISPR gRNA sequence
gaagcgcaggtaaaacaatc

SEQ ID NO: 492756 - DNA, 20 bp, Artificial
  CRISPR gRNA sequence
ccagttggtgtccactgaag

SEQ ID NO: 492757 - DNA, 20 bp, Artificial
  CRISPR gRNA sequence
ttggtgtccactgaagagct

SEQ ID NO: 492758 - DNA, 20 bp, Artificial
  CRISPR gRNA sequence
tgtccactgaagagctgatt

SEQ ID NO: 492759 - DNA, 20 bp, Artificial
  CRISPR gRNA sequence
ttggtcacagaagtcttctg

SEQ ID NO: 492760 - DNA, 20 bp, Artificial
  CRISPR gRNA sequence
gaaaccagaggaaaaacagt

SEQ ID NO: 492761 - DNA, 20 bp, Artificial
  CRISPR gRNA sequence
tggaatgctatcttaatttc

SEQ ID NO: 492762 - DNA, 20 bp, Artificial
  CRISPR gRNA sequence
atattaggtagtgaaaacct

SEQ ID NO: 492763 - DNA, 20 bp, Artificial
  CRISPR gRNA sequence
ccttctagctttgttcttca

SEQ ID NO: 492764 - DNA, 20 bp, Artificial
  CRISPR gRNA sequence
tatgtcttttacattttcat

SEQ ID NO: 492765 - DNA, 20 bp, Artificial
  CRISPR gRNA sequence
ataaaaaccatggtatagtc

SEQ ID NO: 492766 - DNA, 20 bp, Artificial
  CRISPR gRNA sequence
ttttgtgctgctgtaaatag

SEQ ID NO: 492767 - DNA, 20 bp, Artificial
  CRISPR gRNA sequence
gttttcaaaatttcattttt

SEQ ID NO: 492768 - DNA, 20 bp, Artificial
  CRISPR gRNA sequence
gtactaatatatagaaataa

SEQ ID NO: 492769 - DNA, 20 bp, Artificial
  CRISPR gRNA sequence
ataatttttcatatagtcct

SEQ ID NO: 492770 - DNA, 20 bp, Artificial
  CRISPR gRNA sequence
gtttcctatatacacaggta

SEQ ID NO: 492771 - DNA, 20 bp, Artificial
  CRISPR gRNA sequence
gtatatagtttgtgaataat

SEQ ID NO: 492772 - DNA, 20 bp, Artificial
  CRISPR gRNA sequence
tattcattttttttttgaga

SEQ ID NO: 492773 - DNA, 20 bp, Artificial
  CRISPR gRNA sequence
ccatcttggctcactgcagc

SEQ ID NO: 492774 - DNA, 20 bp, Artificial
  CRISPR gRNA sequence
agcctccgcttcccgggttc

SEQ ID NO: 492775 - DNA, 20 bp, Artificial
  CRISPR gRNA sequence
tgcctcagcctcccgagtag

SEQ ID NO: 492776 - DNA, 20 bp, Artificial
  CRISPR gRNA sequence
ttttgtatttttagtagaga

SEQ ID NO: 492777 - DNA, 20 bp, Artificial
  CRISPR gRNA sequence
caggtgagctgcccaaagtg

SEQ ID NO: 492778 - DNA, 20 bp, Artificial
  CRISPR gRNA sequence
ttattccctttgactatttt

SEQ ID NO: 492779 - DNA, 20 bp, Artificial
  CRISPR gRNA sequence
agccatgacctccagtacaa

SEQ ID NO: 492780 - DNA, 20 bp, Artificial
  CRISPR gRNA sequence
atggaatcctttttctgttc

SEQ ID NO: 492781 - DNA, 20 bp, Artificial
  CRISPR gRNA sequence
ggacaaatacctaatgcatg

SEQ ID NO: 492782 - DNA, 20 bp, Artificial
  CRISPR gRNA sequence
aaagagatgggtacaaatgt

SEQ ID NO: 492783 - DNA, 20 bp, Artificial
  CRISPR gRNA sequence
tgggtacaaatgtgaatgtt

SEQ ID NO: 492784 - DNA, 20 bp, Artificial
  CRISPR gRNA sequence
ttttgaacaaacctctccaa

SEQ ID NO: 492785 - DNA, 20 bp, Artificial
  CRISPR gRNA sequence
tctgtgaccaaatgcaggga

SEQ ID NO: 492786 - DNA, 20 bp, Artificial
  CRISPR gRNA sequence
gcctccagaacttcggacca

SEQ ID NO: 492787 - DNA, 20 bp, Artificial
  CRISPR gRNA sequence
cacataaaccagggaaacat

SEQ ID NO: 492788 - DNA, 20 bp, Artificial
  CRISPR gRNA sequence
aaggtatgggggaagggaca

SEQ ID NO: 492789 - DNA, 20 bp, Artificial
  CRISPR gRNA sequence
gctctccaagcccagtcctc

SEQ ID NO: 492790 - DNA, 20 bp, Artificial
  CRISPR gRNA sequence
aatgtgactggatgaaaagg

SEQ ID NO: 492791 - DNA, 20 bp, Artificial
  CRISPR gRNA sequence
aacccagcaaggcctgtctg

SEQ ID NO: 492792 - DNA, 20 bp, Artificial
  CRISPR gRNA sequence
acttctctgaaatgagggtc

SEQ ID NO: 492793 - DNA, 20 bp, Artificial
  CRISPR gRNA sequence
atgagggtcttttgatttat

SEQ ID NO: 492794 - DNA, 20 bp, Artificial
  CRISPR gRNA sequence
ctttcaacttgccaaatacc

SEQ ID NO: 492795 - DNA, 20 bp, Artificial
  CRISPR gRNA sequence
tggacaagatgccaagacct

SEQ ID NO: 492796 - DNA, 20 bp, Artificial
  CRISPR gRNA sequence
ctctctagtgctcagaacac

SEQ ID NO: 492797 - DNA, 20 bp, Artificial
  CRISPR gRNA sequence
ttttatttaatgaatttact

SEQ ID NO: 492798 - DNA, 20 bp, Artificial
  CRISPR gRNA sequence
gctaattttctctattgtgt

SEQ ID NO: 492799 - DNA, 20 bp, Artificial
  CRISPR gRNA sequence
actttctcctttctcctttc

SEQ ID NO: 492800 - DNA, 20 bp, Artificial
  CRISPR gRNA sequence
tgaattactatttctttttc

SEQ ID NO: 492801 - DNA, 20 bp, Artificial
  CRISPR gRNA sequence
atttctttttctttggtttc

SEQ ID NO: 492802 - DNA, 20 bp, Artificial
  CRISPR gRNA sequence
ctaaatatttcccaaatttc

SEQ ID NO: 492803 - DNA, 20 bp, Artificial
  CRISPR gRNA sequence
tttgatttattctttgactc

SEQ ID NO: 492804 - DNA, 20 bp, Artificial
  CRISPR gRNA sequence
tgactcatgggtttttagaa

SEQ ID NO: 492805 - DNA, 20 bp, Artificial
  CRISPR gRNA sequence
ggtttttagaaatatgtttc

SEQ ID NO: 492806 - DNA, 20 bp, Artificial
  CRISPR gRNA sequence
tttcttatgttttaaacatt

SEQ ID NO: 492807 - DNA, 20 bp, Artificial
  CRISPR gRNA sequence
ttttctggttatttttctgt

SEQ ID NO: 492808 - DNA, 20 bp, Artificial
  CRISPR gRNA sequence
ttatttttctgttattgatt

SEQ ID NO: 492809 - DNA, 20 bp, Artificial
  CRISPR gRNA sequence
tgattttttgtttaattcta

SEQ ID NO: 492810 - DNA, 20 bp, Artificial
  CRISPR gRNA sequence
gtgcttagagggcataattg

SEQ ID NO: 492811 - DNA, 20 bp, Artificial
  CRISPR gRNA sequence
atactttgaactttgttgac

SEQ ID NO: 492812 - DNA, 20 bp, Artificial
  CRISPR gRNA sequence
tattctgcaattgttaggag

SEQ ID NO: 492813 - DNA, 20 bp, Artificial
  CRISPR gRNA sequence
tatatataatttatatatat

SEQ ID NO: 492814 - DNA, 20 bp, Artificial
  CRISPR gRNA sequence
tcttcaaattcttatagcct

SEQ ID NO: 492815 - DNA, 20 bp, Artificial
  CRISPR gRNA sequence
atagccttattgattttttt

SEQ ID NO: 492816 - DNA, 20 bp, Artificial
  CRISPR gRNA sequence
taaaactctccaactatagt

SEQ ID NO: 492817 - DNA, 20 bp, Artificial
  CRISPR gRNA sequence
gttatatgcatagaaactga

SEQ ID NO: 492818 - DNA, 20 bp, Artificial
  CRISPR gRNA sequence
tatgcatagaaactgaagat

SEQ ID NO: 492819 - DNA, 20 bp, Artificial
  CRISPR gRNA sequence
gatatttttgtgctgcatct

SEQ ID NO: 492820 - DNA, 20 bp, Artificial
  CRISPR gRNA sequence
acaatgaatacctccaacaa

SEQ ID NO: 492821 - DNA, 20 bp, Artificial
  CRISPR gRNA sequence
cttttattgtcacaaattac

SEQ ID NO: 492822 - DNA, 20 bp, Artificial
  CRISPR gRNA sequence
tcacaaattacatctgtttc

SEQ ID NO: 492823 - DNA, 20 bp, Artificial
  CRISPR gRNA sequence
ttgtttttcacttcttgtgc

SEQ ID NO: 492824 - DNA, 20 bp, Artificial
  CRISPR gRNA sequence
gcctttttgtgacaaattct

SEQ ID NO: 492825 - DNA, 20 bp, Artificial
  CRISPR gRNA sequence
ttttctaaaaatgtctttat

SEQ ID NO: 492826 - DNA, 20 bp, Artificial
  CRISPR gRNA sequence
agccttgacttcctgggttc

SEQ ID NO: 492827 - DNA, 20 bp, Artificial
  CRISPR gRNA sequence
tgcctcagcctcctgagtag

SEQ ID NO: 492828 - DNA, 20 bp, Artificial
  CRISPR gRNA sequence
ttttgtatttttagtcgaga

SEQ ID NO: 492829 - DNA, 20 bp, Artificial
  CRISPR gRNA sequence
ggtctccaactcccgacctc

SEQ ID NO: 492830 - DNA, 20 bp, Artificial
  CRISPR gRNA sequence
ctcccgacctcaactgattc

SEQ ID NO: 492831 - DNA, 20 bp, Artificial
  CRISPR gRNA sequence
tgcttcagcctcccaaagtg

SEQ ID NO: 492832 - DNA, 20 bp, Artificial
  CRISPR gRNA sequence
ttacaggcatgagccactgc

SEQ ID NO: 492833 - DNA, 20 bp, Artificial
  CRISPR gRNA sequence
aaaaaagataccattccatc

SEQ ID NO: 492834 - DNA, 20 bp, Artificial
  CRISPR gRNA sequence
ttttgctgaaatgtcagcta

SEQ ID NO: 492835 - DNA, 20 bp, Artificial
  CRISPR gRNA sequence
gctgaaatgtcagctaagtt

SEQ ID NO: 492836 - DNA, 20 bp, Artificial
  CRISPR gRNA sequence
tgtttgttttgtgaagggaa

SEQ ID NO: 492837 - DNA, 20 bp, Artificial
  CRISPR gRNA sequence
tttcccccactctggctatt

SEQ ID NO: 492838 - DNA, 20 bp, Artificial
  CRISPR gRNA sequence
ttacgatttttctatttatc

SEQ ID NO: 492839 - DNA, 20 bp, Artificial
  CRISPR gRNA sequence
tgagaggttgtcttttgttc

SEQ ID NO: 492840 - DNA, 20 bp, Artificial
  CRISPR gRNA sequence
aggttgtcttttgttcattg

SEQ ID NO: 492841 - DNA, 20 bp, Artificial
  CRISPR gRNA sequence
ttctttttttttttttgaga

SEQ ID NO: 492842 - DNA, 20 bp, Artificial
  CRISPR gRNA sequence
gctcactgcaacctccacct

SEQ ID NO: 492843 - DNA, 20 bp, Artificial
  CRISPR gRNA sequence
aacctccacctcctggattc

SEQ ID NO: 492844 - DNA, 20 bp, Artificial
  CRISPR gRNA sequence
tgcctcagcctcccaagtag

SEQ ID NO: 492845 - DNA, 20 bp, Artificial
  CRISPR gRNA sequence
tttttgcatttttagcagag

SEQ ID NO: 492846 - DNA, 20 bp, Artificial
  CRISPR gRNA sequence
cacctgggcctcccaaagtg

SEQ ID NO: 492847 - DNA, 20 bp, Artificial
  CRISPR gRNA sequence
tacaggcgtgagccaccgtg

SEQ ID NO: 492848 - DNA, 20 bp, Artificial
  CRISPR gRNA sequence
tgagccaccgtgcccagctt

SEQ ID NO: 492849 - DNA, 20 bp, Artificial
  CRISPR gRNA sequence
ccaccgtgcccagcttgtcg

SEQ ID NO: 492850 - DNA, 20 bp, Artificial
  CRISPR gRNA sequence
agcttgtcggtttgttttga

SEQ ID NO: 492851 - DNA, 20 bp, Artificial
  CRISPR gRNA sequence
cggtttgttttgatcttgct

SEQ ID NO: 492852 - DNA, 20 bp, Artificial
  CRISPR gRNA sequence
acattttacaaatctatctt

SEQ ID NO: 492853 - DNA, 20 bp, Artificial
  CRISPR gRNA sequence
aatctatcttgatggctttt

SEQ ID NO: 492854 - DNA, 20 bp, Artificial
  CRISPR gRNA sequence
aaattcttatcttttatctc

SEQ ID NO: 492855 - DNA, 20 bp, Artificial
  CRISPR gRNA sequence
tcctctttcctctctcgtct

SEQ ID NO: 492856 - DNA, 20 bp, Artificial
  CRISPR gRNA sequence
ctccttgctttccaattaca

SEQ ID NO: 492857 - DNA, 20 bp, Artificial
  CRISPR gRNA sequence
tttccaattacacttagttt

SEQ ID NO: 492858 - DNA, 20 bp, Artificial
  CRISPR gRNA sequence
aattacacttagtttagggg

SEQ ID NO: 492859 - DNA, 20 bp, Artificial
  CRISPR gRNA sequence
cacttagtttaggggttttg

SEQ ID NO: 492860 - DNA, 20 bp, Artificial
  CRISPR gRNA sequence
cttcttgtgtatttttatcc

SEQ ID NO: 492861 - DNA, 20 bp, Artificial
  CRISPR gRNA sequence
cttcactctggatattttat

SEQ ID NO: 492862 - DNA, 20 bp, Artificial
  CRISPR gRNA sequence
tggcctttttaacctttcaa

SEQ ID NO: 492863 - DNA, 20 bp, Artificial
  CRISPR gRNA sequence
ctttttaacctttcaattga

SEQ ID NO: 492864 - DNA, 20 bp, Artificial
  CRISPR gRNA sequence
aatgacctactccaaaatcc

SEQ ID NO: 492865 - DNA, 20 bp, Artificial
  CRISPR gRNA sequence
aaaacaactacctatttagt

SEQ ID NO: 492866 - DNA, 20 bp, Artificial
  CRISPR gRNA sequence
gggctcagctaggtggttct

SEQ ID NO: 492867 - DNA, 20 bp, Artificial
  CRISPR gRNA sequence
ctgccagactggccacgggt

SEQ ID NO: 492868 - DNA, 20 bp, Artificial
  CRISPR gRNA sequence
tgattcatttatttattttt

SEQ ID NO: 492869 - DNA, 20 bp, Artificial
  CRISPR gRNA sequence
tatttattttttattgtttt

SEQ ID NO: 492870 - DNA, 20 bp, Artificial
  CRISPR gRNA sequence
ttttgtatcgttagtagaga

SEQ ID NO: 492871 - DNA, 20 bp, Artificial
  CRISPR gRNA sequence
caccgcaccaggccagggct

SEQ ID NO: 492872 - DNA, 20 bp, Artificial
  CRISPR gRNA sequence
tttagaatggccttagctgt

SEQ ID NO: 492873 - DNA, 20 bp, Artificial
  CRISPR gRNA sequence
ttattctccagcaggctatt

SEQ ID NO: 492874 - DNA, 20 bp, Artificial
  CRISPR gRNA sequence
tgtgcaatgccttttcagat

SEQ ID NO: 492875 - DNA, 20 bp, Artificial
  CRISPR gRNA sequence
ctagcagaacatcatttttg

SEQ ID NO: 492876 - DNA, 20 bp, Artificial
  CRISPR gRNA sequence
ctctgctgaaattcttaaac

SEQ ID NO: 492877 - DNA, 20 bp, Artificial
  CRISPR gRNA sequence
tatttccttgaacatattag

SEQ ID NO: 492878 - DNA, 20 bp, Artificial
  CRISPR gRNA sequence
catattagacatgattactt

SEQ ID NO: 492879 - DNA, 20 bp, Artificial
  CRISPR gRNA sequence
acaactctattatgtagatg

SEQ ID NO: 492880 - DNA, 20 bp, Artificial
  CRISPR gRNA sequence
attatgtagatgccctgttt

SEQ ID NO: 492881 - DNA, 20 bp, Artificial
  CRISPR gRNA sequence
tctgttgtctctattcttct

SEQ ID NO: 492882 - DNA, 20 bp, Artificial
  CRISPR gRNA sequence
attcttctgttggtttttgg

SEQ ID NO: 492883 - DNA, 20 bp, Artificial
  CRISPR gRNA sequence
ggcagccaggttagggctac

SEQ ID NO: 492884 - DNA, 20 bp, Artificial
  CRISPR gRNA sequence
attagttcaatccagggttg

SEQ ID NO: 492885 - DNA, 20 bp, Artificial
  CRISPR gRNA sequence
agggttgtgatgattcaaaa

SEQ ID NO: 492886 - DNA, 20 bp, Artificial
  CRISPR gRNA sequence
gtggtaccaacctcaacact

SEQ ID NO: 492887 - DNA, 20 bp, Artificial
  CRISPR gRNA sequence
cactgatggattttatgtat

SEQ ID NO: 492888 - DNA, 20 bp, Artificial
  CRISPR gRNA sequence
cttcatgttctcttagttcc

SEQ ID NO: 492889 - DNA, 20 bp, Artificial
  CRISPR gRNA sequence
gagttttattgtgagctctg

SEQ ID NO: 492890 - DNA, 20 bp, Artificial
  CRISPR gRNA sequence
atattggccccataattttt

SEQ ID NO: 492891 - DNA, 20 bp, Artificial
  CRISPR gRNA sequence
actctctgataactttaaca

SEQ ID NO: 492892 - DNA, 20 bp, Artificial
  CRISPR gRNA sequence
tcttctagctatttttagtg

SEQ ID NO: 492893 - DNA, 20 bp, Artificial
  CRISPR gRNA sequence
gattggttagcatgtcttaa

SEQ ID NO: 492894 - DNA, 20 bp, Artificial
  CRISPR gRNA sequence
ttacataattagaattcctt

SEQ ID NO: 492895 - DNA, 20 bp, Artificial
  CRISPR gRNA sequence
gatgctgtagaatgaaagtg

SEQ ID NO: 492896 - DNA, 20 bp, Artificial
  CRISPR gRNA sequence
gaggccctgcctcttcaggg

SEQ ID NO: 492897 - DNA, 20 bp, Artificial
  CRISPR gRNA sequence
agacagtatatgtcctcctt

SEQ ID NO: 492898 - DNA, 20 bp, Artificial
  CRISPR gRNA sequence
tgtcctccttgtaggtttag

SEQ ID NO: 492899 - DNA, 20 bp, Artificial
  CRISPR gRNA sequence
acagagatgcacagcacagt

SEQ ID NO: 492900 - DNA, 20 bp, Artificial
  CRISPR gRNA sequence
cagcacagtctctgcttttg

SEQ ID NO: 492901 - DNA, 20 bp, Artificial
  CRISPR gRNA sequence
gtctctgcttttgagaagct

SEQ ID NO: 492902 - DNA, 20 bp, Artificial
  CRISPR gRNA sequence
ataaatataaatgggaacct

SEQ ID NO: 492903 - DNA, 20 bp, Artificial
  CRISPR gRNA sequence
agaaaatgccagggtgaagc

SEQ ID NO: 492904 - DNA, 20 bp, Artificial
  CRISPR gRNA sequence
gcacctgctgggccatgcca

SEQ ID NO: 492905 - DNA, 20 bp, Artificial
  CRISPR gRNA sequence
taaaaatggctgtaggaact

SEQ ID NO: 492906 - DNA, 20 bp, Artificial
  CRISPR gRNA sequence
ttgtcacacccccatattca

SEQ ID NO: 492907 - DNA, 20 bp, Artificial
  CRISPR gRNA sequence
cccatattcattaggtttca

SEQ ID NO: 492908 - DNA, 20 bp, Artificial
  CRISPR gRNA sequence
gctgggatctgcctgggaag

SEQ ID NO: 492909 - DNA, 20 bp, Artificial
  CRISPR gRNA sequence
aagtgtagttttatttttaa

SEQ ID NO: 492910 - DNA, 20 bp, Artificial
  CRISPR gRNA sequence
aatgaaccaagtgccacgag

SEQ ID NO: 492911 - DNA, 20 bp, Artificial
  CRISPR gRNA sequence
gatggttgaggggccatgag

SEQ ID NO: 492912 - DNA, 20 bp, Artificial
  CRISPR gRNA sequence
gccattagtagttgcctcag

SEQ ID NO: 492913 - DNA, 20 bp, Artificial
  CRISPR gRNA sequence
gagttcaaggctgcagtgag

SEQ ID NO: 492914 - DNA, 20 bp, Artificial
  CRISPR gRNA sequence
aaaacataacaccaaactga

SEQ ID NO: 492915 - DNA, 20 bp, Artificial
  CRISPR gRNA sequence
gcctgtcacatagtaagtac

SEQ ID NO: 492916 - DNA, 20 bp, Artificial
  CRISPR gRNA sequence
gatccctcagactagggaca

SEQ ID NO: 492917 - DNA, 20 bp, Artificial
  CRISPR gRNA sequence
aggggaggcagatggagggg

SEQ ID NO: 492918 - DNA, 20 bp, Artificial
  CRISPR gRNA sequence
ctcatactcatccccaccca

SEQ ID NO: 492919 - DNA, 20 bp, Artificial
  CRISPR gRNA sequence
ctgacactcttcccgctact

SEQ ID NO: 492920 - DNA, 20 bp, Artificial
  CRISPR gRNA sequence
agaagttgctgccctcacaa

SEQ ID NO: 492921 - DNA, 20 bp, Artificial
  CRISPR gRNA sequence
tgccttccaatacttccaat

SEQ ID NO: 492922 - DNA, 20 bp, Artificial
  CRISPR gRNA sequence
ccaatacttccaatgataga

SEQ ID NO: 492923 - DNA, 20 bp, Artificial
  CRISPR gRNA sequence
aaagttcagacagccacgtt

SEQ ID NO: 492924 - DNA, 20 bp, Artificial
  CRISPR gRNA sequence
aggactgttcatactgccct

SEQ ID NO: 492925 - DNA, 20 bp, Artificial
  CRISPR gRNA sequence
aatgcctttctgatcagaat

SEQ ID NO: 492926 - DNA, 20 bp, Artificial
  CRISPR gRNA sequence
ggagatgccaagtggctctg

SEQ ID NO: 492927 - DNA, 20 bp, Artificial
  CRISPR gRNA sequence
tccagggatggcaatgtgtc

SEQ ID NO: 492928 - DNA, 20 bp, Artificial
  CRISPR gRNA sequence
actgggctataacaagcgct

SEQ ID NO: 492929 - DNA, 20 bp, Artificial
  CRISPR gRNA sequence
cctatttccttctgggagat

SEQ ID NO: 492930 - DNA, 20 bp, Artificial
  CRISPR gRNA sequence
cttctgcagagggagggcat

SEQ ID NO: 492931 - DNA, 20 bp, Artificial
  CRISPR gRNA sequence
acctagatgagttcttgggc

SEQ ID NO: 492932 - DNA, 20 bp, Artificial
  CRISPR gRNA sequence
ggtgggtggatcacaaggtc

SEQ ID NO: 492933 - DNA, 20 bp, Artificial
  CRISPR gRNA sequence
tcaggaggctgaggcaggag

SEQ ID NO: 492934 - DNA, 20 bp, Artificial
  CRISPR gRNA sequence
tcatgccactgaactaggac

SEQ ID NO: 492935 - DNA, 20 bp, Artificial
  CRISPR gRNA sequence
caggtggatcacttgagtcc

SEQ ID NO: 492936 - DNA, 20 bp, Artificial
  CRISPR gRNA sequence
aaagaagctctgtgatctct

SEQ ID NO: 492937 - DNA, 20 bp, Artificial
  CRISPR gRNA sequence
ggggtgataataagtacctc

SEQ ID NO: 492938 - DNA, 20 bp, Artificial
  CRISPR gRNA sequence
gctgttaagagtaaatgaga

SEQ ID NO: 492939 - DNA, 20 bp, Artificial
  CRISPR gRNA sequence
ccttttccttcctcttgttg

SEQ ID NO: 492940 - DNA, 20 bp, Artificial
  CRISPR gRNA sequence
ccacagatgccaagatccac

SEQ ID NO: 492941 - DNA, 20 bp, Artificial
  CRISPR gRNA sequence
aagtccctggcataaacagg

SEQ ID NO: 492942 - DNA, 20 bp, Artificial
  CRISPR gRNA sequence
tttaaatagttgttatactg

SEQ ID NO: 492943 - DNA, 20 bp, Artificial
  CRISPR gRNA sequence
cagccacaacacagagaaaa

SEQ ID NO: 492944 - DNA, 20 bp, Artificial
  CRISPR gRNA sequence
gccttctgtattcctcagaa

SEQ ID NO: 492945 - DNA, 20 bp, Artificial
  CRISPR gRNA sequence
ttcctcagaattcagatttt

SEQ ID NO: 492946 - DNA, 20 bp, Artificial
  CRISPR gRNA sequence
ttggccgtttttggtgatca

SEQ ID NO: 492947 - DNA, 20 bp, Artificial
  CRISPR gRNA sequence
cactgttccttggcaccctt

SEQ ID NO: 492948 - DNA, 20 bp, Artificial
  CRISPR gRNA sequence
acagcatctccttttcctca

SEQ ID NO: 492949 - DNA, 20 bp, Artificial
  CRISPR gRNA sequence
cttttcctcaacgagctttg

SEQ ID NO: 492950 - DNA, 20 bp, Artificial
  CRISPR gRNA sequence
catgccttctgatcccaatg

SEQ ID NO: 492951 - DNA, 20 bp, Artificial
  CRISPR gRNA sequence
cgcagatttccctgtagaca

SEQ ID NO: 492952 - DNA, 20 bp, Artificial
  CRISPR gRNA sequence
ctcctttctagaaccttttt

SEQ ID NO: 492953 - DNA, 20 bp, Artificial
  CRISPR gRNA sequence
ttagaagcaaaagcccttct

SEQ ID NO: 492954 - DNA, 20 bp, Artificial
  CRISPR gRNA sequence
gaggtttctgcagctctgct

SEQ ID NO: 492955 - DNA, 20 bp, Artificial
  CRISPR gRNA sequence
ggaggctggggtctctctca

SEQ ID NO: 492956 - DNA, 20 bp, Artificial
  CRISPR gRNA sequence
tccccatctatcttttctcc

SEQ ID NO: 492957 - DNA, 20 bp, Artificial
  CRISPR gRNA sequence
aattctttttcctaatgagt

SEQ ID NO: 492958 - DNA, 20 bp, Artificial
  CRISPR gRNA sequence
agtgtgaccagccaaagcat

SEQ ID NO: 492959 - DNA, 20 bp, Artificial
  CRISPR gRNA sequence
cagatgcccccactgctgtg

SEQ ID NO: 492960 - DNA, 20 bp, Artificial
  CRISPR gRNA sequence
gccttctttccactgccccc

SEQ ID NO: 492961 - DNA, 20 bp, Artificial
  CRISPR gRNA sequence
ctgttagagcagctccccat

SEQ ID NO: 492962 - DNA, 20 bp, Artificial
  CRISPR gRNA sequence
atgtgaataataaaagggga

SEQ ID NO: 492963 - DNA, 20 bp, Artificial
  CRISPR gRNA sequence
acccacagccagtgatgccc

SEQ ID NO: 492964 - DNA, 20 bp, Artificial
  CRISPR gRNA sequence
ttttccaaaaagaagatgac

SEQ ID NO: 492965 - DNA, 20 bp, Artificial
  CRISPR gRNA sequence
ttagagcaaaggaaacctct

SEQ ID NO: 492966 - DNA, 20 bp, Artificial
  CRISPR gRNA sequence
cctctttgggattcaggcct

SEQ ID NO: 492967 - DNA, 20 bp, Artificial
  CRISPR gRNA sequence
ccaatttgaaggcctaaatc

SEQ ID NO: 492968 - DNA, 20 bp, Artificial
  CRISPR gRNA sequence
tctaaggacagctgacagtt

SEQ ID NO: 492969 - DNA, 20 bp, Artificial
  CRISPR gRNA sequence
gctgacagttctctgcttct

SEQ ID NO: 492970 - DNA, 20 bp, Artificial
  CRISPR gRNA sequence
ctctgcttctcttagcttct

SEQ ID NO: 492971 - DNA, 20 bp, Artificial
  CRISPR gRNA sequence
cttcttcttgcttccaggaa

SEQ ID NO: 492972 - DNA, 20 bp, Artificial
  CRISPR gRNA sequence
cagtagaacccaaactggca

SEQ ID NO: 492973 - DNA, 20 bp, Artificial
  CRISPR gRNA sequence
gcagcatgaaatacctccac

SEQ ID NO: 492974 - DNA, 20 bp, Artificial
  CRISPR gRNA sequence
aagaaaagggaagcaggaag

SEQ ID NO: 492975 - DNA, 20 bp, Artificial
  CRISPR gRNA sequence
gggaagcaggaagctctgct

SEQ ID NO: 492976 - DNA, 20 bp, Artificial
  CRISPR gRNA sequence
ggcctcaaagatgatctaga

SEQ ID NO: 492977 - DNA, 20 bp, Artificial
  CRISPR gRNA sequence
atgatctagagagggcttaa

SEQ ID NO: 492978 - DNA, 20 bp, Artificial
  CRISPR gRNA sequence
ttaactgtgtttggtctttg

SEQ ID NO: 492979 - DNA, 20 bp, Artificial
  CRISPR gRNA sequence
ctactcagagctctgcaagg

SEQ ID NO: 492980 - DNA, 20 bp, Artificial
  CRISPR gRNA sequence
ctgaaaagccctcttctttg

SEQ ID NO: 492981 - DNA, 20 bp, Artificial
  CRISPR gRNA sequence
gatccagtcccaggtacctc

SEQ ID NO: 492982 - DNA, 20 bp, Artificial
  CRISPR gRNA sequence
gtccattccatacctatctc

SEQ ID NO: 492983 - DNA, 20 bp, Artificial
  CRISPR gRNA sequence
tgaatggcagaataagatct

SEQ ID NO: 492984 - DNA, 20 bp, Artificial
  CRISPR gRNA sequence
ggtgcttctagaatccagaa

SEQ ID NO: 492985 - DNA, 20 bp, Artificial
  CRISPR gRNA sequence
ttctagaatccagaagatag

SEQ ID NO: 492986 - DNA, 20 bp, Artificial
  CRISPR gRNA sequence
acctggttaggggactcaac

SEQ ID NO: 492987 - DNA, 20 bp, Artificial
  CRISPR gRNA sequence
cttctgctttcttgccctgc

SEQ ID NO: 492988 - DNA, 20 bp, Artificial
  CRISPR gRNA sequence
ttatccctattccctattat

SEQ ID NO: 492989 - DNA, 20 bp, Artificial
  CRISPR gRNA sequence
cttttcttttaaaacaattt

SEQ ID NO: 492990 - DNA, 20 bp, Artificial
  CRISPR gRNA sequence
tttatttattttttatttcc

SEQ ID NO: 492991 - DNA, 20 bp, Artificial
  CRISPR gRNA sequence
gtcatgagtcagttctttag

SEQ ID NO: 492992 - DNA, 20 bp, Artificial
  CRISPR gRNA sequence
cagttctttagtggtgattt

SEQ ID NO: 492993 - DNA, 20 bp, Artificial
  CRISPR gRNA sequence
gctgagtgcaatggtagaat

SEQ ID NO: 492994 - DNA, 20 bp, Artificial
  CRISPR gRNA sequence
gtagtggcagagctgagcca

SEQ ID NO: 492995 - DNA, 20 bp, Artificial
  CRISPR gRNA sequence
catactccacctcttatatt

SEQ ID NO: 492996 - DNA, 20 bp, Artificial
  CRISPR gRNA sequence
ataaaagactttctgataaa

SEQ ID NO: 492997 - DNA, 20 bp, Artificial
  CRISPR gRNA sequence
aaaaaaaattgagcaccatc

SEQ ID NO: 492998 - DNA, 20 bp, Artificial
  CRISPR gRNA sequence
tgagctgtggggcaaagaaa

SEQ ID NO: 492999 - DNA, 20 bp, Artificial
  CRISPR gRNA sequence
cggttgatatctgccagttc

SEQ ID NO: 493000 - DNA, 20 bp, Artificial
  CRISPR gRNA sequence
tctggagcatcttaaaagga

SEQ ID NO: 493001 - DNA, 20 bp, Artificial
  CRISPR gRNA sequence
atcttaaaaggagaatgttt

SEQ ID NO: 493002 - DNA, 20 bp, Artificial
  CRISPR gRNA sequence
ggaaagagccctggagagtc

SEQ ID NO: 493003 - DNA, 20 bp, Artificial
  CRISPR gRNA sequence
tggagagtcttgggtttgaa

SEQ ID NO: 493004 - DNA, 20 bp, Artificial
  CRISPR gRNA sequence
ggcgggcggatcacgaggtc

SEQ ID NO: 493005 - DNA, 20 bp, Artificial
  CRISPR gRNA sequence
aagataaatgctcaacaaat

SEQ ID NO: 493006 - DNA, 20 bp, Artificial
  CRISPR gRNA sequence
gggctcttttcactaacact

SEQ ID NO: 493007 - DNA, 20 bp, Artificial
  CRISPR gRNA sequence
aaacggaagagataaccttt

SEQ ID NO: 493008 - DNA, 20 bp, Artificial
  CRISPR gRNA sequence
tttgtaagattgtgctggat

SEQ ID NO: 493009 - DNA, 20 bp, Artificial
  CRISPR gRNA sequence
gtgctggatctgtgcttctg

SEQ ID NO: 493010 - DNA, 20 bp, Artificial
  CRISPR gRNA sequence
gatgtagatgtgtattttgc

SEQ ID NO: 493011 - DNA, 20 bp, Artificial
  CRISPR gRNA sequence
ttctttattgtgtgtatctg

SEQ ID NO: 493012 - DNA, 20 bp, Artificial
  CRISPR gRNA sequence
ggttctgtctggagaaaaat

SEQ ID NO: 493013 - DNA, 20 bp, Artificial
  CRISPR gRNA sequence
ctaagagaacagtagactag

SEQ ID NO: 493014 - DNA, 20 bp, Artificial
  CRISPR gRNA sequence
agtagactagatgagttttt

SEQ ID NO: 493015 - DNA, 20 bp, Artificial
  CRISPR gRNA sequence
gacagtcagagacagaaagg

SEQ ID NO: 493016 - DNA, 20 bp, Artificial
  CRISPR gRNA sequence
gctatggtgagagatactgg

SEQ ID NO: 493017 - DNA, 20 bp, Artificial
  CRISPR gRNA sequence
ggtatcctggtacacatggt

SEQ ID NO: 493018 - DNA, 20 bp, Artificial
  CRISPR gRNA sequence
gtccatgcaggtcagggacc

SEQ ID NO: 493019 - DNA, 20 bp, Artificial
  CRISPR gRNA sequence
gtcagggaccacaggtttga

SEQ ID NO: 493020 - DNA, 20 bp, Artificial
  CRISPR gRNA sequence
acaggtttgaaggggtttag

SEQ ID NO: 493021 - DNA, 20 bp, Artificial
  CRISPR gRNA sequence
ctacttggatcccatcgtga

SEQ ID NO: 493022 - DNA, 20 bp, Artificial
  CRISPR gRNA sequence
tggatcccatcgtgagagag

SEQ ID NO: 493023 - DNA, 20 bp, Artificial
  CRISPR gRNA sequence
tgttcacaggcaccatgttc

SEQ ID NO: 493024 - DNA, 20 bp, Artificial
  CRISPR gRNA sequence
ggttggcaattatttatatg

SEQ ID NO: 493025 - DNA, 20 bp, Artificial
  CRISPR gRNA sequence
ggcaattatttatatgcctg

SEQ ID NO: 493026 - DNA, 20 bp, Artificial
  CRISPR gRNA sequence
atgcatgcgttgaagagata

SEQ ID NO: 493027 - DNA, 20 bp, Artificial
  CRISPR gRNA sequence
ggtttggggcagtatttgca

SEQ ID NO: 493028 - DNA, 20 bp, Artificial
  CRISPR gRNA sequence
acacacacacacatatgtgt

SEQ ID NO: 493029 - DNA, 20 bp, Artificial
  CRISPR gRNA sequence
tgtgggtatggaacagcaaa

SEQ ID NO: 493030 - DNA, 20 bp, Artificial
  CRISPR gRNA sequence
tccctggagaccataaacac

SEQ ID NO: 493031 - DNA, 20 bp, Artificial
  CRISPR gRNA sequence
cattgttttgctcctagggt

SEQ ID NO: 493032 - DNA, 20 bp, Artificial
  CRISPR gRNA sequence
atagcactatctatgaagtg

SEQ ID NO: 493033 - DNA, 20 bp, Artificial
  CRISPR gRNA sequence
taagattctggaactcctca

SEQ ID NO: 493034 - DNA, 20 bp, Artificial
  CRISPR gRNA sequence
agagatcttctaatgcaagt

SEQ ID NO: 493035 - DNA, 20 bp, Artificial
  CRISPR gRNA sequence
gtctgacccaagatcatatt

SEQ ID NO: 493036 - DNA, 20 bp, Artificial
  CRISPR gRNA sequence
tttagatatgatacttactg

SEQ ID NO: 493037 - DNA, 20 bp, Artificial
  CRISPR gRNA sequence
tatgatacttactgggcagc

SEQ ID NO: 493038 - DNA, 20 bp, Artificial
  CRISPR gRNA sequence
aggggaagataaaggactct

SEQ ID NO: 493039 - DNA, 20 bp, Artificial
  CRISPR gRNA sequence
ggagccattccaggacatag

SEQ ID NO: 493040 - DNA, 20 bp, Artificial
  CRISPR gRNA sequence
accactgagcctggtggttg

SEQ ID NO: 493041 - DNA, 20 bp, Artificial
  CRISPR gRNA sequence
ggagggactcaacatttctt

SEQ ID NO: 493042 - DNA, 20 bp, Artificial
  CRISPR gRNA sequence
gtagcctgccagtgtcttca

SEQ ID NO: 493043 - DNA, 20 bp, Artificial
  CRISPR gRNA sequence
gagggcactgtgtagaccca

SEQ ID NO: 493044 - DNA, 20 bp, Artificial
  CRISPR gRNA sequence
ctggaattggagccagaaga

SEQ ID NO: 493045 - DNA, 20 bp, Artificial
  CRISPR gRNA sequence
ctagtcgtggatcctgagta

SEQ ID NO: 493046 - DNA, 20 bp, Artificial
  CRISPR gRNA sequence
gagtaatttgttttgtcact

SEQ ID NO: 493047 - DNA, 20 bp, Artificial
  CRISPR gRNA sequence
gggatggcaagtcatacctc

SEQ ID NO: 493048 - DNA, 20 bp, Artificial
  CRISPR gRNA sequence
gacctcccagtgcaagggtc

SEQ ID NO: 493049 - DNA, 20 bp, Artificial
  CRISPR gRNA sequence
tgaagtttctccttttcttt

SEQ ID NO: 493050 - DNA, 20 bp, Artificial
  CRISPR gRNA sequence
aacctaaagcccagaaccct

SEQ ID NO: 493051 - DNA, 20 bp, Artificial
  CRISPR gRNA sequence
cgcaaagagctggagaactt

SEQ ID NO: 493052 - DNA, 20 bp, Artificial
  CRISPR gRNA sequence
cacctttcttgcacatcagc

SEQ ID NO: 493053 - DNA, 20 bp, Artificial
  CRISPR gRNA sequence
aaatttgttcttgttctata

SEQ ID NO: 493054 - DNA, 20 bp, Artificial
  CRISPR gRNA sequence
tgtaagtgatgttattagca

SEQ ID NO: 493055 - DNA, 20 bp, Artificial
  CRISPR gRNA sequence
ttagcatcgagattccctcc

SEQ ID NO: 493056 - DNA, 20 bp, Artificial
  CRISPR gRNA sequence
cacctgattttcaagctgtc

SEQ ID NO: 493057 - DNA, 20 bp, Artificial
  CRISPR gRNA sequence
acgtgggtgggggccagggc

SEQ ID NO: 493058 - DNA, 20 bp, Artificial
  CRISPR gRNA sequence
ctgataactggggtgttgag

SEQ ID NO: 493059 - DNA, 20 bp, Artificial
  CRISPR gRNA sequence
gaccagctttgtccatggta

SEQ ID NO: 493060 - DNA, 20 bp, Artificial
  CRISPR gRNA sequence
agctttgtccatggtatgat

SEQ ID NO: 493061 - DNA, 20 bp, Artificial
  CRISPR gRNA sequence
gacgcattgttagaaatcca

SEQ ID NO: 493062 - DNA, 20 bp, Artificial
  CRISPR gRNA sequence
ccatttggcttcttcataga

SEQ ID NO: 493063 - DNA, 20 bp, Artificial
  CRISPR gRNA sequence
tcctaccctgtatctaacat

SEQ ID NO: 493064 - DNA, 20 bp, Artificial
  CRISPR gRNA sequence
tgggccatcaacaaacacat

SEQ ID NO: 493065 - DNA, 20 bp, Artificial
  CRISPR gRNA sequence
aagtgcccttcggctgctat

SEQ ID NO: 493066 - DNA, 20 bp, Artificial
  CRISPR gRNA sequence
ggtaaaggtatgagatgcag

SEQ ID NO: 493067 - DNA, 20 bp, Artificial
  CRISPR gRNA sequence
gggcctgggccggcgagagt

SEQ ID NO: 493068 - DNA, 20 bp, Artificial
  CRISPR gRNA sequence
atgcagtcaacccagagagg

SEQ ID NO: 493069 - DNA, 20 bp, Artificial
  CRISPR gRNA sequence
ccaaagcagatgctgatgtg

SEQ ID NO: 493070 - DNA, 20 bp, Artificial
  CRISPR gRNA sequence
atgctgatgtgcaagaaagg

SEQ ID NO: 493071 - DNA, 20 bp, Artificial
  CRISPR gRNA sequence
ttgactctttccaatctgca

SEQ ID NO: 493072 - DNA, 20 bp, Artificial
  CRISPR gRNA sequence
ttccaatctgcaaaagaaaa

SEQ ID NO: 493073 - DNA, 20 bp, Artificial
  CRISPR gRNA sequence
ccttatccataataaacccc

SEQ ID NO: 493074 - DNA, 20 bp, Artificial
  CRISPR gRNA sequence
ctcccaaagacttgctaatt

SEQ ID NO: 493075 - DNA, 20 bp, Artificial
  CRISPR gRNA sequence
agtaaacccattgaggagtt

SEQ ID NO: 493076 - DNA, 20 bp, Artificial
  CRISPR gRNA sequence
ttcctcttcctggatccaga

SEQ ID NO: 493077 - DNA, 20 bp, Artificial
  CRISPR gRNA sequence
agactagaaattcagaaggt

SEQ ID NO: 493078 - DNA, 20 bp, Artificial
  CRISPR gRNA sequence
tcccaaaagagactcagggc

SEQ ID NO: 493079 - DNA, 20 bp, Artificial
  CRISPR gRNA sequence
aaattctgaggcactctcag

SEQ ID NO: 493080 - DNA, 20 bp, Artificial
  CRISPR gRNA sequence
cactctcagccagaaaatga

SEQ ID NO: 493081 - DNA, 20 bp, Artificial
  CRISPR gRNA sequence
atgatatttctgaaccaaaa

SEQ ID NO: 493082 - DNA, 20 bp, Artificial
  CRISPR gRNA sequence
taattgccaacccaaggaca

SEQ ID NO: 493083 - DNA, 20 bp, Artificial
  CRISPR gRNA sequence
ttcccatccccttccataca

SEQ ID NO: 493084 - DNA, 20 bp, Artificial
  CRISPR gRNA sequence
ctgactgtcctttacctccc

SEQ ID NO: 493085 - DNA, 20 bp, Artificial
  CRISPR gRNA sequence
ggagcagaagactaatgaga

SEQ ID NO: 493086 - DNA, 20 bp, Artificial
  CRISPR gRNA sequence
cttttaacactcctataaaa

SEQ ID NO: 493087 - DNA, 20 bp, Artificial
  CRISPR gRNA sequence
gcagtgcgtacacagtagaa

SEQ ID NO: 493088 - DNA, 20 bp, Artificial
  CRISPR gRNA sequence
gggacctctttcttgcactg

SEQ ID NO: 493089 - DNA, 20 bp, Artificial
  CRISPR gRNA sequence
tttttttaaagccattttta

SEQ ID NO: 493090 - DNA, 20 bp, Artificial
  CRISPR gRNA sequence
atgagtgaatttctgtaatc

SEQ ID NO: 493091 - DNA, 20 bp, Artificial
  CRISPR gRNA sequence
tgaggaggtgcaatggagac

SEQ ID NO: 493092 - DNA, 20 bp, Artificial
  CRISPR gRNA sequence
ggctgttatgtgagatttag

SEQ ID NO: 493093 - DNA, 20 bp, Artificial
  CRISPR gRNA sequence
cattgcactcagcctggtag

SEQ ID NO: 493094 - DNA, 20 bp, Artificial
  CRISPR gRNA sequence
taaacaataaaattgtttta

SEQ ID NO: 493095 - DNA, 20 bp, Artificial
  CRISPR gRNA sequence
aataaaattgttttaaaaga

SEQ ID NO: 493096 - DNA, 20 bp, Artificial
  CRISPR gRNA sequence
tattagaagcagcagcaggg

SEQ ID NO: 493097 - DNA, 20 bp, Artificial
  CRISPR gRNA sequence
agataggtatggaatggact

SEQ ID NO: 493098 - DNA, 20 bp, Artificial
  CRISPR gRNA sequence
agtctgctcctgctcctgca

SEQ ID NO: 493099 - DNA, 20 bp, Artificial
  CRISPR gRNA sequence
gttccagcaaccctgctcaa

SEQ ID NO: 493100 - DNA, 20 bp, Artificial
  CRISPR gRNA sequence
actttctttcctttagtaac

SEQ ID NO: 493101 - DNA, 20 bp, Artificial
  CRISPR gRNA sequence
ttacctcagagcactgaaat

SEQ ID NO: 493102 - DNA, 20 bp, Artificial
  CRISPR gRNA sequence
cagacccgtgtgaagtgttt

SEQ ID NO: 493103 - DNA, 20 bp, Artificial
  CRISPR gRNA sequence
accagagtctggtagcagtg

SEQ ID NO: 493104 - DNA, 20 bp, Artificial
  CRISPR gRNA sequence
aagccctgactcattaggaa

SEQ ID NO: 493105 - DNA, 20 bp, Artificial
  CRISPR gRNA sequence
accagaactaggaagcaggt

SEQ ID NO: 493106 - DNA, 20 bp, Artificial
  CRISPR gRNA sequence
gggactggtctctgagggag

SEQ ID NO: 493107 - DNA, 20 bp, Artificial
  CRISPR gRNA sequence
agaaaacaaagagcagagct

SEQ ID NO: 493108 - DNA, 20 bp, Artificial
  CRISPR gRNA sequence
gccaaaccttaaaaaaggtt

SEQ ID NO: 493109 - DNA, 20 bp, Artificial
  CRISPR gRNA sequence
ggtgccaaggaacagtgcgc

SEQ ID NO: 493110 - DNA, 20 bp, Artificial
  CRISPR gRNA sequence
ggattcaatgaattgtggat

SEQ ID NO: 493111 - DNA, 20 bp, Artificial
  CRISPR gRNA sequence
ccccattttactcaaggggg

SEQ ID NO: 493112 - DNA, 20 bp, Artificial
  CRISPR gRNA sequence
cctcttgaactatgtggctt

SEQ ID NO: 493113 - DNA, 20 bp, Artificial
  CRISPR gRNA sequence
tctccatcagcctctcccag

SEQ ID NO: 493114 - DNA, 20 bp, Artificial
  CRISPR gRNA sequence
aactatgccctccctctgca

SEQ ID NO: 493115 - DNA, 20 bp, Artificial
  CRISPR gRNA sequence
tctggaagcagagattctga

SEQ ID NO: 493116 - DNA, 20 bp, Artificial
  CRISPR gRNA sequence
ttaaaaggtatgatgagtta

SEQ ID NO: 493117 - DNA, 20 bp, Artificial
  CRISPR gRNA sequence
gtttgccagtttttcagtga

SEQ ID NO: 493118 - DNA, 20 bp, Artificial
  CRISPR gRNA sequence
gtctccacaaaaatttctcc

SEQ ID NO: 493119 - DNA, 20 bp, Artificial
  CRISPR gRNA sequence
gatcccagcacttgcctctc

SEQ ID NO: 493120 - DNA, 20 bp, Artificial
  CRISPR gRNA sequence
aggctcagggaggatttgga

SEQ ID NO: 493121 - DNA, 20 bp, Artificial
  CRISPR gRNA sequence
cctcccactaaaaatagcta

SEQ ID NO: 493122 - DNA, 20 bp, Artificial
  CRISPR gRNA sequence
tgaagttcacgtccctccta

SEQ ID NO: 493123 - DNA, 20 bp, Artificial
  CRISPR gRNA sequence
acccaaagagtaagagtgaa

SEQ ID NO: 493124 - DNA, 20 bp, Artificial
  CRISPR gRNA sequence
accagagcattaaattattc

SEQ ID NO: 493125 - DNA, 20 bp, Artificial
  CRISPR gRNA sequence
acaatatccaaagtgaagta

SEQ ID NO: 493126 - DNA, 20 bp, Artificial
  CRISPR gRNA sequence
aacatctccaaaaaccaaca

SEQ ID NO: 493127 - DNA, 20 bp, Artificial
  CRISPR gRNA sequence
ccaacagaagaatagagaca

SEQ ID NO: 493128 - DNA, 20 bp, Artificial
  CRISPR gRNA sequence
aaggaaataaaacataagtt

SEQ ID NO: 493129 - DNA, 20 bp, Artificial
  CRISPR gRNA sequence
ttcagcagagaactagcgtg

SEQ ID NO: 493130 - DNA, 20 bp, Artificial
  CRISPR gRNA sequence
tttacagctccttctgttat

SEQ ID NO: 493131 - DNA, 20 bp, Artificial
  CRISPR gRNA sequence
caagcctaaaatagcctgct

SEQ ID NO: 493132 - DNA, 20 bp, Artificial
  CRISPR gRNA sequence
ccagcccaaattgccaacta

SEQ ID NO: 493133 - DNA, 20 bp, Artificial
  CRISPR gRNA sequence
cctgaaattggatttttttt

SEQ ID NO: 493134 - DNA, 20 bp, Artificial
  CRISPR gRNA sequence
taaagaattcaatgaaaatt

SEQ ID NO: 493135 - DNA, 20 bp, Artificial
  CRISPR gRNA sequence
ccatttagatgccattgaaa

SEQ ID NO: 493136 - DNA, 20 bp, Artificial
  CRISPR gRNA sequence
agatgccattgaaaagagaa

SEQ ID NO: 493137 - DNA, 20 bp, Artificial
  CRISPR gRNA sequence
taaaatatccagagtgaagt

SEQ ID NO: 493138 - DNA, 20 bp, Artificial
  CRISPR gRNA sequence
taagcaaaagagataaaaga

SEQ ID NO: 493139 - DNA, 20 bp, Artificial
  CRISPR gRNA sequence
ctacttgggaggctgaggca

SEQ ID NO: 493140 - DNA, 20 bp, Artificial
  CRISPR gRNA sequence
actctgtctcaaaaaaaaaa

SEQ ID NO: 493141 - DNA, 20 bp, Artificial
  CRISPR gRNA sequence
attatggaaaccaaagataa

SEQ ID NO: 493142 - DNA, 20 bp, Artificial
  CRISPR gRNA sequence
acaggtggtgtttggttaca

SEQ ID NO: 493143 - DNA, 20 bp, Artificial
  CRISPR gRNA sequence
atgatatatttaaagtgctg

SEQ ID NO: 493144 - DNA, 20 bp, Artificial
  CRISPR gRNA sequence
gaaagaaaataactgcctat

SEQ ID NO: 493145 - DNA, 20 bp, Artificial
  CRISPR gRNA sequence
ctactcaggaggctgaggca

SEQ ID NO: 493146 - DNA, 20 bp, Artificial
  CRISPR gRNA sequence
aagctgaaataaagacattt

SEQ ID NO: 493147 - DNA, 20 bp, Artificial
  CRISPR gRNA sequence
ttagaaaaaattaaaaacgg

SEQ ID NO: 493148 - DNA, 20 bp, Artificial
  CRISPR gRNA sequence
aaaggatgttctttagatat

SEQ ID NO: 493149 - DNA, 20 bp, Artificial
  CRISPR gRNA sequence
ggcacaagaagtgaaaaaca

SEQ ID NO: 493150 - DNA, 20 bp, Artificial
  CRISPR gRNA sequence
gtaatacctgtggtaaccat

SEQ ID NO: 493151 - DNA, 20 bp, Artificial
  CRISPR gRNA sequence
ttgagaaaataacaaaatgt

SEQ ID NO: 493152 - DNA, 20 bp, Artificial
  CRISPR gRNA sequence
aaataacaaaatgtacagaa

SEQ ID NO: 493153 - DNA, 20 bp, Artificial
  CRISPR gRNA sequence
atacaaaagaaggcaataac

SEQ ID NO: 493154 - DNA, 20 bp, Artificial
  CRISPR gRNA sequence
ataagatgtataaaaaatat

SEQ ID NO: 493155 - DNA, 20 bp, Artificial
  CRISPR gRNA sequence
caaaaaaatcaataaggcta

SEQ ID NO: 493156 - DNA, 20 bp, Artificial
  CRISPR gRNA sequence
aaacaattctcctaacaatt

SEQ ID NO: 493157 - DNA, 20 bp, Artificial
  CRISPR gRNA sequence
aattatgccctctaagcaca

SEQ ID NO: 493158 - DNA, 20 bp, Artificial
  CRISPR gRNA sequence
aattaaacaaaaaatcaata

SEQ ID NO: 493159 - DNA, 20 bp, Artificial
  CRISPR gRNA sequence
aatcaataacagaaaaataa

SEQ ID NO: 493160 - DNA, 20 bp, Artificial
  CRISPR gRNA sequence
atctctgaatgtttaaaaca

SEQ ID NO: 493161 - DNA, 20 bp, Artificial
  CRISPR gRNA sequence
tttctaaaaacccatgagtc

SEQ ID NO: 493162 - DNA, 20 bp, Artificial
  CRISPR gRNA sequence
ctttaaatttgtatattgga

SEQ ID NO: 493163 - DNA, 20 bp, Artificial
  CRISPR gRNA sequence
aaatttgtatattggaaaag

SEQ ID NO: 493164 - DNA, 20 bp, Artificial
  CRISPR gRNA sequence
aataatgcaagattcaatct

SEQ ID NO: 493165 - DNA, 20 bp, Artificial
  CRISPR gRNA sequence
agattcaatctcaagaaacc

SEQ ID NO: 493166 - DNA, 20 bp, Artificial
  CRISPR gRNA sequence
aatctcaagaaaccaaagaa

SEQ ID NO: 493167 - DNA, 20 bp, Artificial
  CRISPR gRNA sequence
gatgatgatgatgataatcc

SEQ ID NO: 493168 - DNA, 20 bp, Artificial
  CRISPR gRNA sequence
atgatgataatccagagaaa

SEQ ID NO: 493169 - DNA, 20 bp, Artificial
  CRISPR gRNA sequence
taatccagagaaaggagaaa

SEQ ID NO: 493170 - DNA, 20 bp, Artificial
  CRISPR gRNA sequence
ataaaaagcaaatacacaat

SEQ ID NO: 493171 - DNA, 20 bp, Artificial
  CRISPR gRNA sequence
cacataaagttccaaagaca

SEQ ID NO: 493172 - DNA, 20 bp, Artificial
  CRISPR gRNA sequence
atttgtgttctgagcactag

SEQ ID NO: 493173 - DNA, 20 bp, Artificial
  CRISPR gRNA sequence
cctgctctcacaggattatt

SEQ ID NO: 493174 - DNA, 20 bp, Artificial
  CRISPR gRNA sequence
aagttcctgcctcagattct

SEQ ID NO: 493175 - DNA, 20 bp, Artificial
  CRISPR gRNA sequence
tcctgcctcagattctagag

SEQ ID NO: 493176 - DNA, 20 bp, Artificial
  CRISPR gRNA sequence
atgctacacagagagaccaa

SEQ ID NO: 493177 - DNA, 20 bp, Artificial
  CRISPR gRNA sequence
acacccagctggtgtccact

SEQ ID NO: 493178 - DNA, 20 bp, Artificial
  CRISPR gRNA sequence
cattattcagtttgctgtga

SEQ ID NO: 493179 - DNA, 20 bp, Artificial
  CRISPR gRNA sequence
atgtccctgcaaactcagga

SEQ ID NO: 493180 - DNA, 20 bp, Artificial
  CRISPR gRNA sequence
atagtcaaagggaataaaaa

SEQ ID NO: 493181 - DNA, 20 bp, Artificial
  CRISPR gRNA sequence
ctactcgggaggctgaggca

SEQ ID NO: 493182 - DNA, 20 bp, Artificial
  CRISPR gRNA sequence
gcacaaaaaagataaaatat

SEQ ID NO: 493183 - DNA, 20 bp, Artificial
  CRISPR gRNA sequence
atatatagaaataatttcaa

SEQ ID NO: 493184 - DNA, 20 bp, Artificial
  CRISPR gRNA sequence
ctattgcaacaaaagattgc

SEQ ID NO: 493185 - DNA, 20 bp, Artificial
  CRISPR gRNA sequence
taaattaatttatagattca

SEQ ID NO: 493186 - DNA, 20 bp, Artificial
  CRISPR gRNA sequence
aattattgcaggttattttt

SEQ ID NO: 493187 - DNA, 20 bp, Artificial
  CRISPR gRNA sequence
tatatgaaaatgtaaaagac

SEQ ID NO: 493188 - DNA, 20 bp, Artificial
  CRISPR gRNA sequence
tcaagatatattgtaaaact

SEQ ID NO: 493189 - DNA, 20 bp, Artificial
  CRISPR gRNA sequence
agtcgatggaatataatagt

SEQ ID NO: 493190 - DNA, 20 bp, Artificial
  CRISPR gRNA sequence
agcttccaggaaaaagcaca

SEQ ID NO: 493191 - DNA, 20 bp, Artificial
  CRISPR gRNA sequence
aaaataaatcactaaccata

SEQ ID NO: 493192 - DNA, 20 bp, Artificial
  CRISPR gRNA sequence
aaaaagcaagccaaagactg

SEQ ID NO: 493193 - DNA, 20 bp, Artificial
  CRISPR gRNA sequence
ggctcatatccagagtatat

SEQ ID NO: 493194 - DNA, 20 bp, Artificial
  CRISPR gRNA sequence
ttgggcaggcactttaggaa

SEQ ID NO: 493195 - DNA, 20 bp, Artificial
  CRISPR gRNA sequence
gcccaacaacattagttatc

SEQ ID NO: 493196 - DNA, 20 bp, Artificial
  CRISPR gRNA sequence
cttcttgggagtctgaggca

SEQ ID NO: 493197 - DNA, 20 bp, Artificial
  CRISPR gRNA sequence
tacatataccctttgatcca

SEQ ID NO: 493198 - DNA, 20 bp, Artificial
  CRISPR gRNA sequence
gatccagaagaatttgtaca

SEQ ID NO: 493199 - DNA, 20 bp, Artificial
  CRISPR gRNA sequence
gtgaaaccccatctcaaaaa

SEQ ID NO: 493200 - DNA, 20 bp, Artificial
  CRISPR gRNA sequence
ctacttggaagactgaagca

SEQ ID NO: 493201 - DNA, 20 bp, Artificial
  CRISPR gRNA sequence
tgaaactccgtctcaaaaaa

SEQ ID NO: 493202 - DNA, 20 bp, Artificial
  CRISPR gRNA sequence
ttagtcataataactcaaaa

SEQ ID NO: 493203 - DNA, 20 bp, Artificial
  CRISPR gRNA sequence
gaatattacacagcaatgaa

SEQ ID NO: 493204 - DNA, 20 bp, Artificial
  CRISPR gRNA sequence
ctaatatatggtgagagagg

SEQ ID NO: 493205 - DNA, 20 bp, Artificial
  CRISPR gRNA sequence
caaaaaggaatgactgggtg

SEQ ID NO: 493206 - DNA, 20 bp, Artificial
  CRISPR gRNA sequence
agttgtatcttggtaaaaaa

SEQ ID NO: 493207 - DNA, 20 bp, Artificial
  CRISPR gRNA sequence
acccaactcttagctaaata

SEQ ID NO: 493208 - DNA, 20 bp, Artificial
  CRISPR gRNA sequence
gtgggtgggagctgccattg

SEQ ID NO: 493209 - DNA, 20 bp, Artificial
  CRISPR gRNA sequence
ccaaggcctgcctggtgtat

SEQ ID NO: 493210 - DNA, 20 bp, Artificial
  CRISPR gRNA sequence
ggtaaagatggagcaggttt

SEQ ID NO: 493211 - DNA, 20 bp, Artificial
  CRISPR gRNA sequence
ccatataatccaccagtaga

SEQ ID NO: 493212 - DNA, 20 bp, Artificial
  CRISPR gRNA sequence
ccatagacttctaaatactt

SEQ ID NO: 493213 - DNA, 20 bp, Artificial
  CRISPR gRNA sequence
gtactaaaggtaggaagccc

SEQ ID NO: 493214 - DNA, 20 bp, Artificial
  CRISPR gRNA sequence
cccacagaaaaggagcagct

SEQ ID NO: 493215 - DNA, 20 bp, Artificial
  CRISPR gRNA sequence
ggaacaggagaagctgtggg

SEQ ID NO: 493216 - DNA, 20 bp, Artificial
  CRISPR gRNA sequence
tccagggtattgtgactgat

SEQ ID NO: 493217 - DNA, 20 bp, Artificial
  CRISPR gRNA sequence
tgtctgaaagattcttaagg

SEQ ID NO: 493218 - DNA, 20 bp, Artificial
  CRISPR gRNA sequence
acagagtgaaaaggcaacca

SEQ ID NO: 493219 - DNA, 20 bp, Artificial
  CRISPR gRNA sequence
atcctacaggcaactaatat

SEQ ID NO: 493220 - DNA, 20 bp, Artificial
  CRISPR gRNA sequence
caactaatatgcagaataga

SEQ ID NO: 493221 - DNA, 20 bp, Artificial
  CRISPR gRNA sequence
tcctaaaaatgactctattg

SEQ ID NO: 493222 - DNA, 20 bp, Artificial
  CRISPR gRNA sequence
agaatttcatgcaggatacc

SEQ ID NO: 493223 - DNA, 20 bp, Artificial
  CRISPR gRNA sequence
aacccaaaggttcatcaata

SEQ ID NO: 493224 - DNA, 20 bp, Artificial
  CRISPR gRNA sequence
caaatctgtgatgttagaag

SEQ ID NO: 493225 - DNA, 20 bp, Artificial
  CRISPR gRNA sequence
gagctattcaaaatatatcc

SEQ ID NO: 493226 - DNA, 20 bp, Artificial
  CRISPR gRNA sequence
tattcaaaatatatccagag

SEQ ID NO: 493227 - DNA, 20 bp, Artificial
  CRISPR gRNA sequence
gctgaagaggagactgggag

SEQ ID NO: 493228 - DNA, 20 bp, Artificial
  CRISPR gRNA sequence
taaatggagatgaggactat

SEQ ID NO: 493229 - DNA, 20 bp, Artificial
  CRISPR gRNA sequence
ggagagagagctaagagttt

SEQ ID NO: 493230 - DNA, 20 bp, Artificial
  CRISPR gRNA sequence
aaaggagcagcatcccaggc

SEQ ID NO: 493231 - DNA, 20 bp, Artificial
  CRISPR gRNA sequence
catgaaagaagaagtctttg

SEQ ID NO: 493232 - DNA, 20 bp, Artificial
  CRISPR gRNA sequence
aatatctgctgtcaatgggc

SEQ ID NO: 493233 - DNA, 20 bp, Artificial
  CRISPR gRNA sequence
gcacagaaaaaaattttttt

SEQ ID NO: 493234 - DNA, 20 bp, Artificial
  CRISPR gRNA sequence
aacaactggcttgtcttctt

SEQ ID NO: 493235 - DNA, 20 bp, Artificial
  CRISPR gRNA sequence
aatgcaatatcatgaaagat

SEQ ID NO: 493236 - DNA, 20 bp, Artificial
  CRISPR gRNA sequence
gtatggtcatagactgaaca

SEQ ID NO: 493237 - DNA, 20 bp, Artificial
  CRISPR gRNA sequence
acaattgtgctgtagtaaca

SEQ ID NO: 493238 - DNA, 20 bp, Artificial
  CRISPR gRNA sequence
acacacatatacatacagct

SEQ ID NO: 493239 - DNA, 20 bp, Artificial
  CRISPR gRNA sequence
atatacatacagctagagaa

SEQ ID NO: 493240 - DNA, 20 bp, Artificial
  CRISPR gRNA sequence
ttaattggtgaatctagatg

SEQ ID NO: 493241 - DNA, 20 bp, Artificial
  CRISPR gRNA sequence
gaatctagatgaaagaaatt

SEQ ID NO: 493242 - DNA, 20 bp, Artificial
  CRISPR gRNA sequence
aactaaaaagcttaaaaatt

SEQ ID NO: 493243 - DNA, 20 bp, Artificial
  CRISPR gRNA sequence
ttccaacctagctctcctgc

SEQ ID NO: 493244 - DNA, 20 bp, Artificial
  CRISPR gRNA sequence
ctgtgtcttcctgaaggaca

SEQ ID NO: 493245 - DNA, 20 bp, Artificial
  CRISPR gRNA sequence
ctactcgggaggctgaggca

SEQ ID NO: 493246 - DNA, 20 bp, Artificial
  CRISPR gRNA sequence
gcatcctggaccccagaact

SEQ ID NO: 493247 - DNA, 20 bp, Artificial
  CRISPR gRNA sequence
ctgtgagctgacaaggccac

SEQ ID NO: 493248 - DNA, 20 bp, Artificial
  CRISPR gRNA sequence
gtgaagttccagggaagctg

SEQ ID NO: 493249 - DNA, 20 bp, Artificial
  CRISPR gRNA sequence
tcacatattaccaattgtcc

SEQ ID NO: 493250 - DNA, 20 bp, Artificial
  CRISPR gRNA sequence
gaatggcaaagtagctggac

SEQ ID NO: 493251 - DNA, 20 bp, Artificial
  CRISPR gRNA sequence
accctgggctacagcaccat

SEQ ID NO: 493252 - DNA, 20 bp, Artificial
  CRISPR gRNA sequence
ctcttattgaagtgcaacat

SEQ ID NO: 493253 - DNA, 20 bp, Artificial
  CRISPR gRNA sequence
acagatgtctattctaccct

SEQ ID NO: 493254 - DNA, 20 bp, Artificial
  CRISPR gRNA sequence
cattaacaggcaagatacat

SEQ ID NO: 493255 - DNA, 20 bp, Artificial
  CRISPR gRNA sequence
aacactggggaactggcctt

SEQ ID NO: 493256 - DNA, 20 bp, Artificial
  CRISPR gRNA sequence
attgaagcagaggaaacagc

SEQ ID NO: 493257 - DNA, 20 bp, Artificial
  CRISPR gRNA sequence
ggagatgcacttgttatcat

SEQ ID NO: 493258 - DNA, 20 bp, Artificial
  CRISPR gRNA sequence
gtatgaagctaaatagagag

SEQ ID NO: 493259 - DNA, 20 bp, Artificial
  CRISPR gRNA sequence
gaagctaaatagagaggaag

SEQ ID NO: 493260 - DNA, 20 bp, Artificial
  CRISPR gRNA sequence
ctggtagcacaagccctagc

SEQ ID NO: 493261 - DNA, 20 bp, Artificial
  CRISPR gRNA sequence
ggtgtgtgtacccctctggg

SEQ ID NO: 493262 - DNA, 20 bp, Artificial
  CRISPR gRNA sequence
ctggactgttgggggctgca

SEQ ID NO: 493263 - DNA, 20 bp, Artificial
  CRISPR gRNA sequence
ctcctgttccccaaaaggtg

SEQ ID NO: 493264 - DNA, 20 bp, Artificial
  CRISPR gRNA sequence
aaaccaacaacctccttctt

SEQ ID NO: 493265 - DNA, 20 bp, Artificial
  CRISPR gRNA sequence
taaaaatacaaaaaaaaaaa

SEQ ID NO: 493266 - DNA, 20 bp, Artificial
  CRISPR gRNA sequence
ttactcatgaggctgagaca

SEQ ID NO: 493267 - DNA, 20 bp, Artificial
  CRISPR gRNA sequence
acactctcactagcaataaa

SEQ ID NO: 493268 - DNA, 20 bp, Artificial
  CRISPR gRNA sequence
ttgtgtgtgtgtgtcctgtt

SEQ ID NO: 493269 - DNA, 20 bp, Artificial
  CRISPR gRNA sequence
gcatacaattcctaaaattt

SEQ ID NO: 493270 - DNA, 20 bp, Artificial
  CRISPR gRNA sequence
ttcgggataggggccggtca

SEQ ID NO: 493271 - DNA, 20 bp, Artificial
  CRISPR gRNA sequence
atatctacaggtagatagtg

SEQ ID NO: 493272 - DNA, 20 bp, Artificial
  CRISPR gRNA sequence
tttacattttcatataagtt

SEQ ID NO: 493273 - DNA, 20 bp, Artificial
  CRISPR gRNA sequence
gaatctataaattaatttag

SEQ ID NO: 493274 - DNA, 20 bp, Artificial
  CRISPR gRNA sequence
ttatctgtttgtactaatat

SEQ ID NO: 493275 - DNA, 20 bp, Artificial
  CRISPR gRNA sequence
ctcagcaaactaacacagga

SEQ ID NO: 493276 - DNA, 20 bp, Artificial
  CRISPR gRNA sequence
aagtaaaacaaaaaaaaaaa

SEQ ID NO: 493277 - DNA, 20 bp, Artificial
  CRISPR gRNA sequence
taggcatgaccaacaacctt

SEQ ID NO: 493278 - DNA, 20 bp, Artificial
  CRISPR gRNA sequence
tccatactaacaggctgagt

SEQ ID NO: 493279 - DNA, 20 bp, Artificial
  CRISPR gRNA sequence
tctgtgtagcatttctttct

SEQ ID NO: 493280 - DNA, 20 bp, Artificial
  CRISPR gRNA sequence
attctttgactcatgggttt

SEQ ID NO: 493281 - DNA, 20 bp, Artificial
  CRISPR gRNA sequence
actattgcatgtgcacttga

SEQ ID NO: 493282 - DNA, 20 bp, Artificial
  CRISPR gRNA sequence
tatgtattctgcaattgtta

SEQ ID NO: 493283 - DNA, 20 bp, Artificial
  CRISPR gRNA sequence
attttaaacttgttatatgc

SEQ ID NO: 493284 - DNA, 20 bp, Artificial
  CRISPR gRNA sequence
gccaattcagcctcaatact

SEQ ID NO: 493285 - DNA, 20 bp, Artificial
  CRISPR gRNA sequence
gctacgaggatgcaaaggca

SEQ ID NO: 493286 - DNA, 20 bp, Artificial
  CRISPR gRNA sequence
ccaggccagggctagctgat

SEQ ID NO: 493287 - DNA, 20 bp, Artificial
  CRISPR gRNA sequence
atgaggttccaagagaacaa

SEQ ID NO: 493288 - DNA, 20 bp, Artificial
  CRISPR gRNA sequence
atgcctccagggaacaacag

SEQ ID NO: 493289 - DNA, 20 bp, Artificial
  CRISPR gRNA sequence
cctggattttcattacataa

SEQ ID NO: 493290 - DNA, 20 bp, Artificial
  CRISPR gRNA sequence
tcaacaattaaggggatgct

SEQ ID NO: 493291 - DNA, 20 bp, Artificial
  CRISPR gRNA sequence
gtcttaggagcatcaagatc

SEQ ID NO: 493292 - DNA, 20 bp, Artificial
  CRISPR gRNA sequence
taattatttacttagtctct

SEQ ID NO: 493293 - DNA, 20 bp, Artificial
  CRISPR gRNA sequence
cagttttgtacactgactgc

SEQ ID NO: 493294 - DNA, 20 bp, Artificial
  CRISPR gRNA sequence
tttttaaaattgttttctag

SEQ ID NO: 493295 - DNA, 20 bp, Artificial
  CRISPR gRNA sequence
gtcttcctgggcctgaccat

SEQ ID NO: 493296 - DNA, 20 bp, Artificial
  CRISPR gRNA sequence
ggtatttatagcatcatggt

SEQ ID NO: 493297 - DNA, 20 bp, Artificial
  CRISPR gRNA sequence
gacagagtgagaccctgtct

SEQ ID NO: 493298 - DNA, 20 bp, Artificial
  CRISPR gRNA sequence
tgtctctagaaaacaaaaca

SEQ ID NO: 493299 - DNA, 20 bp, Artificial
  CRISPR gRNA sequence
tttcatcacatattgaagtg

SEQ ID NO: 493300 - DNA, 20 bp, Artificial
  CRISPR gRNA sequence
tatttccaatgcctttctga

SEQ ID NO: 493301 - DNA, 20 bp, Artificial
  CRISPR gRNA sequence
tctctgcttccagataaagt

SEQ ID NO: 493302 - DNA, 20 bp, Artificial
  CRISPR gRNA sequence
ctgaatctcactcaggactg

SEQ ID NO: 493303 - DNA, 20 bp, Artificial
  CRISPR gRNA sequence
aataactacttgtggacaaa

SEQ ID NO: 493304 - DNA, 20 bp, Artificial
  CRISPR gRNA sequence
ctactcaggaggctgaggca

SEQ ID NO: 493305 - DNA, 20 bp, Artificial
  CRISPR gRNA sequence
acgttatccccttttacagg

SEQ ID NO: 493306 - DNA, 20 bp, Artificial
  CRISPR gRNA sequence
atagtgcagagctcacaggg

SEQ ID NO: 493307 - DNA, 20 bp, Artificial
  CRISPR gRNA sequence
gaggttaaccaaatgagcaa

SEQ ID NO: 493308 - DNA, 20 bp, Artificial
  CRISPR gRNA sequence
gaggcaatcagccacaacac

SEQ ID NO: 493309 - DNA, 20 bp, Artificial
  CRISPR gRNA sequence
tctcacgccttctgtattcc

SEQ ID NO: 493310 - DNA, 20 bp, Artificial
  CRISPR gRNA sequence
tgcctgcttctgtgtgtgga

SEQ ID NO: 493311 - DNA, 20 bp, Artificial
  CRISPR gRNA sequence
tgtcaaggatctgaaaacca

SEQ ID NO: 493312 - DNA, 20 bp, Artificial
  CRISPR gRNA sequence
ggctgaaggggcatcttggt

SEQ ID NO: 493313 - DNA, 20 bp, Artificial
  CRISPR gRNA sequence
ctgagaagggatggagcaca

SEQ ID NO: 493314 - DNA, 20 bp, Artificial
  CRISPR gRNA sequence
ggccaactctgcctgtcatc

SEQ ID NO: 493315 - DNA, 20 bp, Artificial
  CRISPR gRNA sequence
gagacccagctctaatcttt

SEQ ID NO: 493316 - DNA, 20 bp, Artificial
  CRISPR gRNA sequence
ttcacacgggtctggacggg

SEQ ID NO: 493317 - DNA, 20 bp, Artificial
  CRISPR gRNA sequence
gatttcctaaggggtaggaa

SEQ ID NO: 493318 - DNA, 20 bp, Artificial
  CRISPR gRNA sequence
ggtttctaagttactaaagg

SEQ ID NO: 493319 - DNA, 20 bp, Artificial
  CRISPR gRNA sequence
gaaactcacaccattgaatg

SEQ ID NO: 493320 - DNA, 20 bp, Artificial
  CRISPR gRNA sequence
agaataagatcttggtgctt

SEQ ID NO: 493321 - DNA, 20 bp, Artificial
  CRISPR gRNA sequence
cccagataaagtctatagga

SEQ ID NO: 493322 - DNA, 20 bp, Artificial
  CRISPR gRNA sequence
ctattatattcgttttcagg

SEQ ID NO: 493323 - DNA, 20 bp, Artificial
  CRISPR gRNA sequence
ctaccaggctgagtgcaatg

SEQ ID NO: 493324 - DNA, 20 bp, Artificial
  CRISPR gRNA sequence
acctcttatattctgggatt

SEQ ID NO: 493325 - DNA, 20 bp, Artificial
  CRISPR gRNA sequence
gataaaaatggctttaaaaa

SEQ ID NO: 493326 - DNA, 20 bp, Artificial
  CRISPR gRNA sequence
tggtggctgagctgtggggc

SEQ ID NO: 493327 - DNA, 20 bp, Artificial
  CRISPR gRNA sequence
gagaggaatttctatcagtg

SEQ ID NO: 493328 - DNA, 20 bp, Artificial
  CRISPR gRNA sequence
cctcaaactatggtgttggg

SEQ ID NO: 493329 - DNA, 20 bp, Artificial
  CRISPR gRNA sequence
tcctctggagcatcttaaaa

SEQ ID NO: 493330 - DNA, 20 bp, Artificial
  CRISPR gRNA sequence
ctactcaggaggctggggca

SEQ ID NO: 493331 - DNA, 20 bp, Artificial
  CRISPR gRNA sequence
taaacaaaaaaacagttaga

SEQ ID NO: 493332 - DNA, 20 bp, Artificial
  CRISPR gRNA sequence
catctgggcagggttgagga

SEQ ID NO: 493333 - DNA, 20 bp, Artificial
  CRISPR gRNA sequence
tttaaatgtcaatgggccaa

SEQ ID NO: 493334 - DNA, 20 bp, Artificial
  CRISPR gRNA sequence
atgccttactggttctgtct

SEQ ID NO: 493335 - DNA, 20 bp, Artificial
  CRISPR gRNA sequence
gaggtaaaggacagtcagag

SEQ ID NO: 493336 - DNA, 20 bp, Artificial
  CRISPR gRNA sequence
aatcttgaccttcagagacc

SEQ ID NO: 493337 - DNA, 20 bp, Artificial
  CRISPR gRNA sequence
gctggagccacagtgtgaag

SEQ ID NO: 493338 - DNA, 20 bp, Artificial
  CRISPR gRNA sequence
cagcaaattctgattttggt

SEQ ID NO: 493339 - DNA, 20 bp, Artificial
  CRISPR gRNA sequence
attttctggctgagagtgcc

SEQ ID NO: 493340 - DNA, 20 bp, Artificial
  CRISPR gRNA sequence
gattattttatttagtcctc

SEQ ID NO: 493341 - DNA, 20 bp, Artificial
  CRISPR gRNA sequence
tatactttccatttatactc

SEQ ID NO: 493342 - DNA, 20 bp, Artificial
  CRISPR gRNA sequence
acattccaagtatttgtaat

SEQ ID NO: 493343 - DNA, 20 bp, Artificial
  CRISPR gRNA sequence
ataatggtgactcaggggaa

SEQ ID NO: 493344 - DNA, 20 bp, Artificial
  CRISPR gRNA sequence
cctgggctttactcaattgc

SEQ ID NO: 493345 - DNA, 20 bp, Artificial
  CRISPR gRNA sequence
caaagcaagcccatctctaa

SEQ ID NO: 493346 - DNA, 20 bp, Artificial
  CRISPR gRNA sequence
tgatttatgaagacgcattg

SEQ ID NO: 493347 - DNA, 20 bp, Artificial
  CRISPR gRNA sequence
ttcccagaggaagaggcctc

SEQ ID NO: 493348 - DNA, 20 bp, Artificial
  CRISPR gRNA sequence
gggctcaggcagctgagggc

SEQ ID NO: 493349 - DNA, 20 bp, Artificial
  CRISPR gRNA sequence
tggttgttagacatcatttt

SEQ ID NO: 493350 - DNA, 20 bp, Artificial
  CRISPR gRNA sequence
aaaaatgaagctcagagtga

SEQ ID NO: 493351 - DNA, 20 bp, Artificial
  CRISPR gRNA sequence
gctcggggacggccctaatt

SEQ ID NO: 493352 - DNA, 20 bp, Artificial
  CRISPR gRNA sequence
ggcttcagtgtcttcatctc

SEQ ID NO: 493353 - DNA, 20 bp, Artificial
  CRISPR gRNA sequence
agaatctgtcaccctaggag

SEQ ID NO: 493354 - DNA, 20 bp, Artificial
  CRISPR gRNA sequence
gttccatacccacatacacc

SEQ ID NO: 493355 - DNA, 20 bp, Artificial
  CRISPR gRNA sequence
ttatattgtagcatataatt

SEQ ID NO: 493356 - DNA, 20 bp, Artificial
  CRISPR gRNA sequence
catccccttccatacaagag

SEQ ID NO: 493357 - DNA, 20 bp, Artificial
  CRISPR gRNA sequence
tacctcccacagaaactccc

SEQ ID NO: 493358 - DNA, 20 bp, Artificial
  CRISPR gRNA sequence
caaatgccacctgttcccaa

SEQ ID NO: 493359 - DNA, 20 bp, Artificial
  CRISPR gRNA sequence
atgcagattcattctttcct

SEQ ID NO: 493360 - DNA, 20 bp, Artificial
  CRISPR gRNA sequence
cagatttagattgagtgggg

SEQ ID NO: 493361 - DNA, 20 bp, Artificial
  CRISPR gRNA sequence
ataaataaagataaaaataa

SEQ ID NO: 493362 - DNA, 20 bp, Artificial
  CRISPR gRNA sequence
gcagcctattgagccagcta

SEQ ID NO: 493363 - DNA, 20 bp, Artificial
  CRISPR gRNA sequence
actggtctctgagggaggaa

SEQ ID NO: 493364 - DNA, 20 bp, Artificial
  CRISPR gRNA sequence
ttagaatcacgatgatcacc

SEQ ID NO: 493365 - DNA, 20 bp, Artificial
  CRISPR gRNA sequence
gcctgctgcaggggctgcct

SEQ ID NO: 493366 - DNA, 20 bp, Artificial
  CRISPR gRNA sequence
tgtgtgcataggttatatgc

SEQ ID NO: 493367 - DNA, 20 bp, Artificial
  CRISPR gRNA sequence
cctggagacttaccaaatac

SEQ ID NO: 493368 - DNA, 20 bp, Artificial
  CRISPR gRNA sequence
aagactcaagttcttgacta

SEQ ID NO: 493369 - DNA, 20 bp, Artificial
  CRISPR gRNA sequence
tccacaaaaatttctcccta

SEQ ID NO: 493370 - DNA, 20 bp, Artificial
  CRISPR gRNA sequence
ctagaaaacaattttaaaaa

SEQ ID NO: 493371 - DNA, 20 bp, Artificial
  CRISPR gRNA sequence
aattctgtgcagtcagtgta

SEQ ID NO: 493372 - DNA, 20 bp, Artificial
  CRISPR gRNA sequence
gatcttgatgctcctaagac

SEQ ID NO: 493373 - DNA, 20 bp, Artificial
  CRISPR gRNA sequence
aagctgagcagagctcacaa

SEQ ID NO: 493374 - DNA, 20 bp, Artificial
  CRISPR gRNA sequence
taagaaaaggaaacatctcc

SEQ ID NO: 493375 - DNA, 20 bp, Artificial
  CRISPR gRNA sequence
gtctaatatgttcaaggaaa

SEQ ID NO: 493376 - DNA, 20 bp, Artificial
  CRISPR gRNA sequence
gaccaccctggccaacatgg

SEQ ID NO: 493377 - DNA, 20 bp, Artificial
  CRISPR gRNA sequence
cagagcaagacctaatctca

SEQ ID NO: 493378 - DNA, 20 bp, Artificial
  CRISPR gRNA sequence
aataaaatgtaaaataactg

SEQ ID NO: 493379 - DNA, 20 bp, Artificial
  CRISPR gRNA sequence
tgccattgaaaagagaatta

SEQ ID NO: 493380 - DNA, 20 bp, Artificial
  CRISPR gRNA sequence
atatccagagtgaagtaaag

SEQ ID NO: 493381 - DNA, 20 bp, Artificial
  CRISPR gRNA sequence
aaagatatttgagatatagc

SEQ ID NO: 493382 - DNA, 20 bp, Artificial
  CRISPR gRNA sequence
tatttgagatatagcaaaaa

SEQ ID NO: 493383 - DNA, 20 bp, Artificial
  CRISPR gRNA sequence
gagatatagcaaaaacaaaa

SEQ ID NO: 493384 - DNA, 20 bp, Artificial
  CRISPR gRNA sequence
gataaaagataagaatttcc

SEQ ID NO: 493385 - DNA, 20 bp, Artificial
  CRISPR gRNA sequence
ttacaaaccccaagcaagat

SEQ ID NO: 493386 - DNA, 20 bp, Artificial
  CRISPR gRNA sequence
ctcaaaaaaaaaaaaagaaa

SEQ ID NO: 493387 - DNA, 20 bp, Artificial
  CRISPR gRNA sequence
gtaaaatagccagagtgggg

SEQ ID NO: 493388 - DNA, 20 bp, Artificial
  CRISPR gRNA sequence
ggaaaactaaattcccttca

SEQ ID NO: 493389 - DNA, 20 bp, Artificial
  CRISPR gRNA sequence
agacatttttagaaaaaatt

SEQ ID NO: 493390 - DNA, 20 bp, Artificial
  CRISPR gRNA sequence
aaactcaggcacaagaagtg

SEQ ID NO: 493391 - DNA, 20 bp, Artificial
  CRISPR gRNA sequence
atatatatataaattatata

SEQ ID NO: 493392 - DNA, 20 bp, Artificial
  CRISPR gRNA sequence
tattatcatatgctgtgcat

SEQ ID NO: 493393 - DNA, 20 bp, Artificial
  CRISPR gRNA sequence
ccagaaaatctctgaatgtt

SEQ ID NO: 493394 - DNA, 20 bp, Artificial
  CRISPR gRNA sequence
aacataagaaacatatttct

SEQ ID NO: 493395 - DNA, 20 bp, Artificial
  CRISPR gRNA sequence
ataaagttccaaagacagca

SEQ ID NO: 493396 - DNA, 20 bp, Artificial
  CRISPR gRNA sequence
ctatgaagtgaagtctccat

SEQ ID NO: 493397 - DNA, 20 bp, Artificial
  CRISPR gRNA sequence
ttttgatgtgggagcagagg

SEQ ID NO: 493398 - DNA, 20 bp, Artificial
  CRISPR gRNA sequence
catggttggagaggtttgtt

SEQ ID NO: 493399 - DNA, 20 bp, Artificial
  CRISPR gRNA sequence
ggaggtcatggctagttcaa

SEQ ID NO: 493400 - DNA, 20 bp, Artificial
  CRISPR gRNA sequence
tccagcctgggcaacaagag

SEQ ID NO: 493401 - DNA, 20 bp, Artificial
  CRISPR gRNA sequence
acagataaaaatgaaatttt

SEQ ID NO: 493402 - DNA, 20 bp, Artificial
  CRISPR gRNA sequence
agaaattaacaagttgattc

SEQ ID NO: 493403 - DNA, 20 bp, Artificial
  CRISPR gRNA sequence
cctaatatcaagatatattg

SEQ ID NO: 493404 - DNA, 20 bp, Artificial
  CRISPR gRNA sequence
aaatagaccctgtgtgtggg

SEQ ID NO: 493405 - DNA, 20 bp, Artificial
  CRISPR gRNA sequence
gtatgccaggaaaggaggtt

SEQ ID NO: 493406 - DNA, 20 bp, Artificial
  CRISPR gRNA sequence
aattgatatctataaggaaa

SEQ ID NO: 493407 - DNA, 20 bp, Artificial
  CRISPR gRNA sequence
atcatatacaaaaattaatt

SEQ ID NO: 493408 - DNA, 20 bp, Artificial
  CRISPR gRNA sequence
attgataaattggacttcac

SEQ ID NO: 493409 - DNA, 20 bp, Artificial
  CRISPR gRNA sequence
aaattggtaccagcactttg

SEQ ID NO: 493410 - DNA, 20 bp, Artificial
  CRISPR gRNA sequence
aactattttacggtatcttc

SEQ ID NO: 493411 - DNA, 20 bp, Artificial
  CRISPR gRNA sequence
cataataactcaaaatgaga

SEQ ID NO: 493412 - DNA, 20 bp, Artificial
  CRISPR gRNA sequence
atataaagtttaaaatctgg

SEQ ID NO: 493413 - DNA, 20 bp, Artificial
  CRISPR gRNA sequence
gtgaaaaaggaagatagacc

SEQ ID NO: 493414 - DNA, 20 bp, Artificial
  CRISPR gRNA sequence
gtagcatggttaagggaaca

SEQ ID NO: 493415 - DNA, 20 bp, Artificial
  CRISPR gRNA sequence
aaggttgttctctgctatta

SEQ ID NO: 493416 - DNA, 20 bp, Artificial
  CRISPR gRNA sequence
gggagatgaaatgctactac

SEQ ID NO: 493417 - DNA, 20 bp, Artificial
  CRISPR gRNA sequence
tgcaactcccttacctctgt

SEQ ID NO: 493418 - DNA, 20 bp, Artificial
  CRISPR gRNA sequence
tttcatctttgtttccccca

SEQ ID NO: 493419 - DNA, 20 bp, Artificial
  CRISPR gRNA sequence
tatttggttcaaccactttg

SEQ ID NO: 493420 - DNA, 20 bp, Artificial
  CRISPR gRNA sequence
cacagcattattataatagc

SEQ ID NO: 493421 - DNA, 20 bp, Artificial
  CRISPR gRNA sequence
tttgattccatatatacgga

SEQ ID NO: 493422 - DNA, 20 bp, Artificial
  CRISPR gRNA sequence
gaccagcccaggcagcatag

SEQ ID NO: 493423 - DNA, 20 bp, Artificial
  CRISPR gRNA sequence
aaaaataaaaaattaaaaaa

SEQ ID NO: 493424 - DNA, 20 bp, Artificial
  CRISPR gRNA sequence
gcaatgaggaagagaagagc

SEQ ID NO: 493425 - DNA, 20 bp, Artificial
  CRISPR gRNA sequence
ttcccaatatgtctaaccca

SEQ ID NO: 493426 - DNA, 20 bp, Artificial
  CRISPR gRNA sequence
gttgaggagacaacggtgag

SEQ ID NO: 493427 - DNA, 20 bp, Artificial
  CRISPR gRNA sequence
agactgggagacagaaaatg

SEQ ID NO: 493428 - DNA, 20 bp, Artificial
  CRISPR gRNA sequence
ctgaaaaggaggtatttgag

SEQ ID NO: 493429 - DNA, 20 bp, Artificial
  CRISPR gRNA sequence
ggagcagcatcccaggcaga

SEQ ID NO: 493430 - DNA, 20 bp, Artificial
  CRISPR gRNA sequence
ccagattaaggaaccctcta

SEQ ID NO: 493431 - DNA, 20 bp, Artificial
  CRISPR gRNA sequence
tatgatgacagtgaaattta

SEQ ID NO: 493432 - DNA, 20 bp, Artificial
  CRISPR gRNA sequence
gtgccaatgcagtaggtgtt

SEQ ID NO: 493433 - DNA, 20 bp, Artificial
  CRISPR gRNA sequence
gtagcacaagccctagctga

SEQ ID NO: 493434 - DNA, 20 bp, Artificial
  CRISPR gRNA sequence
ccaacaacctccttctttaa

SEQ ID NO: 493435 - DNA, 20 bp, Artificial
  CRISPR gRNA sequence
tttccttccagttgaaaaat

SEQ ID NO: 493436 - DNA, 20 bp, Artificial
  CRISPR gRNA sequence
gacagagcgagactctgtct

SEQ ID NO: 493437 - DNA, 20 bp, Artificial
  CRISPR gRNA sequence
cctaactctgcagggcagag

SEQ ID NO: 493438 - DNA, 20 bp, Artificial
  CRISPR gRNA sequence
ttatatgtgtaagtacatat

SEQ ID NO: 493439 - DNA, 20 bp, Artificial
  CRISPR gRNA sequence
ccatttattgaggcctccat

SEQ ID NO: 493440 - DNA, 20 bp, Artificial
  CRISPR gRNA sequence
tagttggtcagaagcgcagg

SEQ ID NO: 493441 - DNA, 20 bp, Artificial
  CRISPR gRNA sequence
ttgtggtgtgaaaccagagg

SEQ ID NO: 493442 - DNA, 20 bp, Artificial
  CRISPR gRNA sequence
atatcttgatattaggtagt

SEQ ID NO: 493443 - DNA, 20 bp, Artificial
  CRISPR gRNA sequence
gcaatattaagtcttccaat

SEQ ID NO: 493444 - DNA, 20 bp, Artificial
  CRISPR gRNA sequence
ccttatatctagcaattttg

SEQ ID NO: 493445 - DNA, 20 bp, Artificial
  CRISPR gRNA sequence
agcaaactaacacaggaaca

SEQ ID NO: 493446 - DNA, 20 bp, Artificial
  CRISPR gRNA sequence
tacctaatgcatgtggggct

SEQ ID NO: 493447 - DNA, 20 bp, Artificial
  CRISPR gRNA sequence
acgtatcccagaacttaaag

SEQ ID NO: 493448 - DNA, 20 bp, Artificial
  CRISPR gRNA sequence
cagtctcggcaatgtagatg

SEQ ID NO: 493449 - DNA, 20 bp, Artificial
  CRISPR gRNA sequence
agctagagagacagatgtaa

SEQ ID NO: 493450 - DNA, 20 bp, Artificial
  CRISPR gRNA sequence
aattcagcctcaatactata

SEQ ID NO: 493451 - DNA, 20 bp, Artificial
  CRISPR gRNA sequence
tttaaatatatcattccttg

SEQ ID NO: 493452 - DNA, 20 bp, Artificial
  CRISPR gRNA sequence
tactccaaaatccagtagtt

SEQ ID NO: 493453 - DNA, 20 bp, Artificial
  CRISPR gRNA sequence
tcataatgcactggacatat

SEQ ID NO: 493454 - DNA, 20 bp, Artificial
  CRISPR gRNA sequence
cattttaacggagccacttg

SEQ ID NO: 493455 - DNA, 20 bp, Artificial
  CRISPR gRNA sequence
tggagactttctgatcactg

SEQ ID NO: 493456 - DNA, 20 bp, Artificial
  CRISPR gRNA sequence
agagtgagaccctgtctcta

SEQ ID NO: 493457 - DNA, 20 bp, Artificial
  CRISPR gRNA sequence
gagaccctgtctctagaaaa

SEQ ID NO: 493458 - DNA, 20 bp, Artificial
  CRISPR gRNA sequence
ctctagaaaacaaaacaaaa

SEQ ID NO: 493459 - DNA, 20 bp, Artificial
  CRISPR gRNA sequence
aaaacaaaacaaaagaaaac

SEQ ID NO: 493460 - DNA, 20 bp, Artificial
  CRISPR gRNA sequence
gcatgggcattataggaaaa

SEQ ID NO: 493461 - DNA, 20 bp, Artificial
  CRISPR gRNA sequence
aatagtggaaaagtgagacg

SEQ ID NO: 493462 - DNA, 20 bp, Artificial
  CRISPR gRNA sequence
caatgagtattttttgagtt

SEQ ID NO: 493463 - DNA, 20 bp, Artificial
  CRISPR gRNA sequence
tgaatccacattgtggaact

SEQ ID NO: 493464 - DNA, 20 bp, Artificial
  CRISPR gRNA sequence
gttaaccaaatgagcaaaga

SEQ ID NO: 493465 - DNA, 20 bp, Artificial
  CRISPR gRNA sequence
tacgaagatgtcaaggatct

SEQ ID NO: 493466 - DNA, 20 bp, Artificial
  CRISPR gRNA sequence
gattaggagaccacaggagg

SEQ ID NO: 493467 - DNA, 20 bp, Artificial
  CRISPR gRNA sequence
aacaaactcctgcagtattt

SEQ ID NO: 493468 - DNA, 20 bp, Artificial
  CRISPR gRNA sequence
atgtccattttcttttcttt

SEQ ID NO: 493469 - DNA, 20 bp, Artificial
  CRISPR gRNA sequence
tagagcgaaactcttgtctc

SEQ ID NO: 493470 - DNA, 20 bp, Artificial
  CRISPR gRNA sequence
tctcaaaaacaaataaacaa

SEQ ID NO: 493471 - DNA, 20 bp, Artificial
  CRISPR gRNA sequence
gctttactcaattgcagaga

SEQ ID NO: 493472 - DNA, 20 bp, Artificial
  CRISPR gRNA sequence
tctaacataggagtttcata

SEQ ID NO: 493473 - DNA, 20 bp, Artificial
  CRISPR gRNA sequence
tacagcagtgttcaaacaga

SEQ ID NO: 493474 - DNA, 20 bp, Artificial
  CRISPR gRNA sequence
cagcagtgttcaaacagaca

SEQ ID NO: 493475 - DNA, 20 bp, Artificial
  CRISPR gRNA sequence
aaacagacatgtgtttgttg

SEQ ID NO: 493476 - DNA, 20 bp, Artificial
  CRISPR gRNA sequence
gttgatggcccacaagtgcc

SEQ ID NO: 493477 - DNA, 20 bp, Artificial
  CRISPR gRNA sequence
ttgatggcccacaagtgccc

SEQ ID NO: 493478 - DNA, 20 bp, Artificial
  CRISPR gRNA sequence
atggcccacaagtgcccttc

SEQ ID NO: 493479 - DNA, 20 bp, Artificial
  CRISPR gRNA sequence
cggctgctatagagaataaa

SEQ ID NO: 493480 - DNA, 20 bp, Artificial
  CRISPR gRNA sequence
ggctgctatagagaataaaa

SEQ ID NO: 493481 - DNA, 20 bp, Artificial
  CRISPR gRNA sequence
ctatagagaataaaaatgca

SEQ ID NO: 493482 - DNA, 20 bp, Artificial
  CRISPR gRNA sequence
tagagaataaaaatgcaggg

SEQ ID NO: 493483 - DNA, 20 bp, Artificial
  CRISPR gRNA sequence
aattcaggcaaggaattcag

SEQ ID NO: 493484 - DNA, 20 bp, Artificial
  CRISPR gRNA sequence
attcaggcaaggaattcaga

SEQ ID NO: 493485 - DNA, 20 bp, Artificial
  CRISPR gRNA sequence
aggcaaggaattcagactgc

SEQ ID NO: 493486 - DNA, 20 bp, Artificial
  CRISPR gRNA sequence
agactgcatctgcatgatat

SEQ ID NO: 493487 - DNA, 20 bp, Artificial
  CRISPR gRNA sequence
catctgcatgatatcaccgt

SEQ ID NO: 493488 - DNA, 20 bp, Artificial
  CRISPR gRNA sequence
catgatatcaccgttttata

SEQ ID NO: 493489 - DNA, 20 bp, Artificial
  CRISPR gRNA sequence
tatatgaaactcctatgtta

SEQ ID NO: 493490 - DNA, 20 bp, Artificial
  CRISPR gRNA sequence
atatgaaactcctatgttag

SEQ ID NO: 493491 - DNA, 20 bp, Artificial
  CRISPR gRNA sequence
tatgaaactcctatgttaga

SEQ ID NO: 493492 - DNA, 20 bp, Artificial
  CRISPR gRNA sequence
ctatgttagatacagggtag

SEQ ID NO: 493493 - DNA, 20 bp, Artificial
  CRISPR gRNA sequence
tgttagatacagggtaggaa

SEQ ID NO: 493494 - DNA, 20 bp, Artificial
  CRISPR gRNA sequence
gatacagggtaggaaaattg

SEQ ID NO: 493495 - DNA, 20 bp, Artificial
  CRISPR gRNA sequence
aagaaccaggctttgtgcag

SEQ ID NO: 493496 - DNA, 20 bp, Artificial
  CRISPR gRNA sequence
tgtgcagtatcacctgttgg

SEQ ID NO: 493497 - DNA, 20 bp, Artificial
  CRISPR gRNA sequence
gtgcagtatcacctgttggg

SEQ ID NO: 493498 - DNA, 20 bp, Artificial
  CRISPR gRNA sequence
tgcagtatcacctgttgggg

SEQ ID NO: 493499 - DNA, 20 bp, Artificial
  CRISPR gRNA sequence
ttggggtctctgagtaagtc

SEQ ID NO: 493500 - DNA, 20 bp, Artificial
  CRISPR gRNA sequence
gggtctctgagtaagtcctc

SEQ ID NO: 493501 - DNA, 20 bp, Artificial
  CRISPR gRNA sequence
tgagtaagtcctctcccagt

SEQ ID NO: 493502 - DNA, 20 bp, Artificial
  CRISPR gRNA sequence
agtaagtcctctcccagttc

SEQ ID NO: 493503 - DNA, 20 bp, Artificial
  CRISPR gRNA sequence
tcccagttcacccttgtcgc

SEQ ID NO: 493504 - DNA, 20 bp, Artificial
  CRISPR gRNA sequence
ccagttcacccttgtcgctt

SEQ ID NO: 493505 - DNA, 20 bp, Artificial
  CRISPR gRNA sequence
acccttgtcgctttcctggg

SEQ ID NO: 493506 - DNA, 20 bp, Artificial
  CRISPR gRNA sequence
gtcgctttcctgggctcagc

SEQ ID NO: 493507 - DNA, 20 bp, Artificial
  CRISPR gRNA sequence
tcgctttcctgggctcagcc

SEQ ID NO: 493508 - DNA, 20 bp, Artificial
  CRISPR gRNA sequence
tcctgggctcagccagagtc

SEQ ID NO: 493509 - DNA, 20 bp, Artificial
  CRISPR gRNA sequence
cctgggctcagccagagtca

SEQ ID NO: 493510 - DNA, 20 bp, Artificial
  CRISPR gRNA sequence
ctgggctcagccagagtcac

SEQ ID NO: 493511 - DNA, 20 bp, Artificial
  CRISPR gRNA sequence
ggctcagccagagtcacagc

SEQ ID NO: 493512 - DNA, 20 bp, Artificial
  CRISPR gRNA sequence
agccagagtcacagccctgc

SEQ ID NO: 493513 - DNA, 20 bp, Artificial
  CRISPR gRNA sequence
ctccccacagccttgttgaa

SEQ ID NO: 493514 - DNA, 20 bp, Artificial
  CRISPR gRNA sequence
cccacagccttgttgaaatg

SEQ ID NO: 493515 - DNA, 20 bp, Artificial
  CRISPR gRNA sequence
gttgaaatgtctggcctgac

SEQ ID NO: 493516 - DNA, 20 bp, Artificial
  CRISPR gRNA sequence
ttgaaatgtctggcctgacg

SEQ ID NO: 493517 - DNA, 20 bp, Artificial
  CRISPR gRNA sequence
aaatgtctggcctgacgact

SEQ ID NO: 493518 - DNA, 20 bp, Artificial
  CRISPR gRNA sequence
gcctgacgactcagggaacc

SEQ ID NO: 493519 - DNA, 20 bp, Artificial
  CRISPR gRNA sequence
acgactcagggaacccagca

SEQ ID NO: 493520 - DNA, 20 bp, Artificial
  CRISPR gRNA sequence
agggaacccagcatagtgtc

SEQ ID NO: 493521 - DNA, 20 bp, Artificial
  CRISPR gRNA sequence
gattccaactgcctcattct

SEQ ID NO: 493522 - DNA, 20 bp, Artificial
  CRISPR gRNA sequence
caactgcctcattctcagcc

SEQ ID NO: 493523 - DNA, 20 bp, Artificial
  CRISPR gRNA sequence
cctcattctcagccctcagc

SEQ ID NO: 493524 - DNA, 20 bp, Artificial
  CRISPR gRNA sequence
attctcagccctcagctgcc

SEQ ID NO: 493525 - DNA, 20 bp, Artificial
  CRISPR gRNA sequence
tcagccctcagctgcctgag

SEQ ID NO: 493526 - DNA, 20 bp, Artificial
  CRISPR gRNA sequence
agccctcagctgcctgagcc

SEQ ID NO: 493527 - DNA, 20 bp, Artificial
  CRISPR gRNA sequence
agctgcctgagccctccctt

SEQ ID NO: 493528 - DNA, 20 bp, Artificial
  CRISPR gRNA sequence
cctgagccctcccttcaatg

SEQ ID NO: 493529 - DNA, 20 bp, Artificial
  CRISPR gRNA sequence
agccctcccttcaatgtgca

SEQ ID NO: 493530 - DNA, 20 bp, Artificial
  CRISPR gRNA sequence
ccttcaatgtgcatcctggg

SEQ ID NO: 493531 - DNA, 20 bp, Artificial
  CRISPR gRNA sequence
caatgtgcatcctggggaac

SEQ ID NO: 493532 - DNA, 20 bp, Artificial
  CRISPR gRNA sequence
aatgtgcatcctggggaaca

SEQ ID NO: 493533 - DNA, 20 bp, Artificial
  CRISPR gRNA sequence
gggaacactcatcaggactc

SEQ ID NO: 493534 - DNA, 20 bp, Artificial
  CRISPR gRNA sequence
atcaggactcagaacttaaa

SEQ ID NO: 493535 - DNA, 20 bp, Artificial
  CRISPR gRNA sequence
agaacttaaatagaacatgg

SEQ ID NO: 493536 - DNA, 20 bp, Artificial
  CRISPR gRNA sequence
aaatagaacatggtttctga

SEQ ID NO: 493537 - DNA, 20 bp, Artificial
  CRISPR gRNA sequence
aatagaacatggtttctgag

SEQ ID NO: 493538 - DNA, 20 bp, Artificial
  CRISPR gRNA sequence
ctgagaggcctcttcctctg

SEQ ID NO: 493539 - DNA, 20 bp, Artificial
  CRISPR gRNA sequence
tgagaggcctcttcctctgg

SEQ ID NO: 493540 - DNA, 20 bp, Artificial
  CRISPR gRNA sequence
agaggcctcttcctctggga

SEQ ID NO: 493541 - DNA, 20 bp, Artificial
  CRISPR gRNA sequence
ttcctctgggaagccacttc

SEQ ID NO: 493542 - DNA, 20 bp, Artificial
  CRISPR gRNA sequence
cctctgggaagccacttcta

SEQ ID NO: 493543 - DNA, 20 bp, Artificial
  CRISPR gRNA sequence
ctctgggaagccacttctat

SEQ ID NO: 493544 - DNA, 20 bp, Artificial
  CRISPR gRNA sequence
tgggaagccacttctatgaa

SEQ ID NO: 493545 - DNA, 20 bp, Artificial
  CRISPR gRNA sequence
ggaagccacttctatgaaga

SEQ ID NO: 493546 - DNA, 20 bp, Artificial
  CRISPR gRNA sequence
ctatgaagaagccaaatgga

SEQ ID NO: 493547 - DNA, 20 bp, Artificial
  CRISPR gRNA sequence
tatgaagaagccaaatggat

SEQ ID NO: 493548 - DNA, 20 bp, Artificial
  CRISPR gRNA sequence
tgaagaagccaaatggattt

SEQ ID NO: 493549 - DNA, 20 bp, Artificial
  CRISPR gRNA sequence
ctaacaatgcgtcttcataa

SEQ ID NO: 493550 - DNA, 20 bp, Artificial
  CRISPR gRNA sequence
taacaatgcgtcttcataaa

SEQ ID NO: 493551 - DNA, 20 bp, Artificial
  CRISPR gRNA sequence
acaatgcgtcttcataaatc

SEQ ID NO: 493552 - DNA, 20 bp, Artificial
  CRISPR gRNA sequence
cataaatcaaacatcatacc

SEQ ID NO: 493553 - DNA, 20 bp, Artificial
  CRISPR gRNA sequence
ataaatcaaacatcatacca

SEQ ID NO: 493554 - DNA, 20 bp, Artificial
  CRISPR gRNA sequence
gtctcaacaccccagttatc

SEQ ID NO: 493555 - DNA, 20 bp, Artificial
  CRISPR gRNA sequence
aacaccccagttatcaggtc

SEQ ID NO: 493556 - DNA, 20 bp, Artificial
  CRISPR gRNA sequence
tcaggtcagcatgtgctctg

SEQ ID NO: 493557 - DNA, 20 bp, Artificial
  CRISPR gRNA sequence
tgggtgatttttctacttag

SEQ ID NO: 493558 - DNA, 20 bp, Artificial
  CRISPR gRNA sequence
ggtgatttttctacttagag

SEQ ID NO: 493559 - DNA, 20 bp, Artificial
  CRISPR gRNA sequence
ttctacttagagatgggctt

SEQ ID NO: 493560 - DNA, 20 bp, Artificial
  CRISPR gRNA sequence
tctacttagagatgggcttg

SEQ ID NO: 493561 - DNA, 20 bp, Artificial
  CRISPR gRNA sequence
ctacttagagatgggcttgc

SEQ ID NO: 493562 - DNA, 20 bp, Artificial
  CRISPR gRNA sequence
tacttagagatgggcttgct

SEQ ID NO: 493563 - DNA, 20 bp, Artificial
  CRISPR gRNA sequence
cttagagatgggcttgcttt

SEQ ID NO: 493564 - DNA, 20 bp, Artificial
  CRISPR gRNA sequence
agagatgggcttgctttgca

SEQ ID NO: 493565 - DNA, 20 bp, Artificial
  CRISPR gRNA sequence
gagatgggcttgctttgcac

SEQ ID NO: 493566 - DNA, 20 bp, Artificial
  CRISPR gRNA sequence
gctttgcaccatctactctc

SEQ ID NO: 493567 - DNA, 20 bp, Artificial
  CRISPR gRNA sequence
ctttgcaccatctactctcc

SEQ ID NO: 493568 - DNA, 20 bp, Artificial
  CRISPR gRNA sequence
tgcaccatctactctccctt

SEQ ID NO: 493569 - DNA, 20 bp, Artificial
  CRISPR gRNA sequence
gcaccatctactctcccttc

SEQ ID NO: 493570 - DNA, 20 bp, Artificial
  CRISPR gRNA sequence
caccatctactctcccttca

SEQ ID NO: 493571 - DNA, 20 bp, Artificial
  CRISPR gRNA sequence
ctctcccttcagcccactcc

SEQ ID NO: 493572 - DNA, 20 bp, Artificial
  CRISPR gRNA sequence
tcccttcagcccactccccc

SEQ ID NO: 493573 - DNA, 20 bp, Artificial
  CRISPR gRNA sequence
ccttcagcccactccccctg

SEQ ID NO: 493574 - DNA, 20 bp, Artificial
  CRISPR gRNA sequence
cagcccactccccctggtgg

SEQ ID NO: 493575 - DNA, 20 bp, Artificial
  CRISPR gRNA sequence
agcccactccccctggtggc

SEQ ID NO: 493576 - DNA, 20 bp, Artificial
  CRISPR gRNA sequence
cccctggtggccaactggcc

SEQ ID NO: 493577 - DNA, 20 bp, Artificial
  CRISPR gRNA sequence
gtggccaactggccagaggt

SEQ ID NO: 493578 - DNA, 20 bp, Artificial
  CRISPR gRNA sequence
gccagaggtaaaggtatgag

SEQ ID NO: 493579 - DNA, 20 bp, Artificial
  CRISPR gRNA sequence
tttctctgcaattgagtaaa

SEQ ID NO: 493580 - DNA, 20 bp, Artificial
  CRISPR gRNA sequence
ttctctgcaattgagtaaag

SEQ ID NO: 493581 - DNA, 20 bp, Artificial
  CRISPR gRNA sequence
tctctgcaattgagtaaagc

SEQ ID NO: 493582 - DNA, 20 bp, Artificial
  CRISPR gRNA sequence
ctctgcaattgagtaaagcc

SEQ ID NO: 493583 - DNA, 20 bp, Artificial
  CRISPR gRNA sequence
tctgcaattgagtaaagccc

SEQ ID NO: 493584 - DNA, 20 bp, Artificial
  CRISPR gRNA sequence
tgcaattgagtaaagcccag

SEQ ID NO: 493585 - DNA, 20 bp, Artificial
  CRISPR gRNA sequence
caattgagtaaagcccaggc

SEQ ID NO: 493586 - DNA, 20 bp, Artificial
  CRISPR gRNA sequence
agtaaagcccaggccctggc

SEQ ID NO: 493587 - DNA, 20 bp, Artificial
  CRISPR gRNA sequence
gcccccacccacgtgcagaa

SEQ ID NO: 493588 - DNA, 20 bp, Artificial
  CRISPR gRNA sequence
ccagccagttcacagccgga

SEQ ID NO: 493589 - DNA, 20 bp, Artificial
  CRISPR gRNA sequence
acagccggacagtccaggct

SEQ ID NO: 493590 - DNA, 20 bp, Artificial
  CRISPR gRNA sequence
tcagaggagggctgtttctt

SEQ ID NO: 493591 - DNA, 20 bp, Artificial
  CRISPR gRNA sequence
cagaggagggctgtttcttc

SEQ ID NO: 493592 - DNA, 20 bp, Artificial
  CRISPR gRNA sequence
agaggagggctgtttcttct

SEQ ID NO: 493593 - DNA, 20 bp, Artificial
  CRISPR gRNA sequence
tttcttcttcccctgagtca

SEQ ID NO: 493594 - DNA, 20 bp, Artificial
  CRISPR gRNA sequence
cttcttcccctgagtcacca

SEQ ID NO: 493595 - DNA, 20 bp, Artificial
  CRISPR gRNA sequence
ttcttcccctgagtcaccat

SEQ ID NO: 493596 - DNA, 20 bp, Artificial
  CRISPR gRNA sequence
cttcccctgagtcaccatta

SEQ ID NO: 493597 - DNA, 20 bp, Artificial
  CRISPR gRNA sequence
ttcccctgagtcaccattat

SEQ ID NO: 493598 - DNA, 20 bp, Artificial
  CRISPR gRNA sequence
cccctgagtcaccattatca

SEQ ID NO: 493599 - DNA, 20 bp, Artificial
  CRISPR gRNA sequence
ccctgagtcaccattatcat

SEQ ID NO: 493600 - DNA, 20 bp, Artificial
  CRISPR gRNA sequence
agtcaccattatcattcctt

SEQ ID NO: 493601 - DNA, 20 bp, Artificial
  CRISPR gRNA sequence
tcattccttcctcttgcttt

SEQ ID NO: 493602 - DNA, 20 bp, Artificial
  CRISPR gRNA sequence
cttcctcttgctttggaaga

SEQ ID NO: 493603 - DNA, 20 bp, Artificial
  CRISPR gRNA sequence
cctcttgctttggaagatgg

SEQ ID NO: 493604 - DNA, 20 bp, Artificial
  CRISPR gRNA sequence
ctcttgctttggaagatggg

SEQ ID NO: 493605 - DNA, 20 bp, Artificial
  CRISPR gRNA sequence
ttgctttggaagatgggcct

SEQ ID NO: 493606 - DNA, 20 bp, Artificial
  CRISPR gRNA sequence
gctttggaagatgggcctgg

SEQ ID NO: 493607 - DNA, 20 bp, Artificial
  CRISPR gRNA sequence
ctttggaagatgggcctggg

SEQ ID NO: 493608 - DNA, 20 bp, Artificial
  CRISPR gRNA sequence
tggaagatgggcctgggccg

SEQ ID NO: 493609 - DNA, 20 bp, Artificial
  CRISPR gRNA sequence
ggaagatgggcctgggccgg

SEQ ID NO: 493610 - DNA, 20 bp, Artificial
  CRISPR gRNA sequence
gaagatgggcctgggccggc

SEQ ID NO: 493611 - DNA, 20 bp, Artificial
  CRISPR gRNA sequence
ggccggcgagagtctagaaa

SEQ ID NO: 493612 - DNA, 20 bp, Artificial
  CRISPR gRNA sequence
gaaatgcagtcaacccagag

SEQ ID NO: 493613 - DNA, 20 bp, Artificial
  CRISPR gRNA sequence
gaaaatcaggtggagggaat

SEQ ID NO: 493614 - DNA, 20 bp, Artificial
  CRISPR gRNA sequence
aaaatcaggtggagggaatc

SEQ ID NO: 493615 - DNA, 20 bp, Artificial
  CRISPR gRNA sequence
gatgctaataacatcactta

SEQ ID NO: 493616 - DNA, 20 bp, Artificial
  CRISPR gRNA sequence
ataacatcacttacataaca

SEQ ID NO: 493617 - DNA, 20 bp, Artificial
  CRISPR gRNA sequence
acataacactttctagatta

SEQ ID NO: 493618 - DNA, 20 bp, Artificial
  CRISPR gRNA sequence
cataacactttctagattac

SEQ ID NO: 493619 - DNA, 20 bp, Artificial
  CRISPR gRNA sequence
tctagattacaaatacttgg

SEQ ID NO: 493620 - DNA, 20 bp, Artificial
  CRISPR gRNA sequence
ctagattacaaatacttgga

SEQ ID NO: 493621 - DNA, 20 bp, Artificial
  CRISPR gRNA sequence
tagattacaaatacttggaa

SEQ ID NO: 493622 - DNA, 20 bp, Artificial
  CRISPR gRNA sequence
gattacaaatacttggaatg

SEQ ID NO: 493623 - DNA, 20 bp, Artificial
  CRISPR gRNA sequence
caaatacttggaatgtggcc

SEQ ID NO: 493624 - DNA, 20 bp, Artificial
  CRISPR gRNA sequence
ggaatgtggccttttgtgaa

SEQ ID NO: 493625 - DNA, 20 bp, Artificial
  CRISPR gRNA sequence
gaatgtggccttttgtgaac

SEQ ID NO: 493626 - DNA, 20 bp, Artificial
  CRISPR gRNA sequence
ttgtgaacaacctaacccct

SEQ ID NO: 493627 - DNA, 20 bp, Artificial
  CRISPR gRNA sequence
tgtgaacaacctaacccctc

SEQ ID NO: 493628 - DNA, 20 bp, Artificial
  CRISPR gRNA sequence
gtgaacaacctaacccctcc

SEQ ID NO: 493629 - DNA, 20 bp, Artificial
  CRISPR gRNA sequence
tgaacaacctaacccctcca

SEQ ID NO: 493630 - DNA, 20 bp, Artificial
  CRISPR gRNA sequence
acccctccacccattcatgt

SEQ ID NO: 493631 - DNA, 20 bp, Artificial
  CRISPR gRNA sequence
cacccattcatgtctgatct

SEQ ID NO: 493632 - DNA, 20 bp, Artificial
  CRISPR gRNA sequence
atgtctgatctgtaaattgg

SEQ ID NO: 493633 - DNA, 20 bp, Artificial
  CRISPR gRNA sequence
atctgtaaattggaagatat

SEQ ID NO: 493634 - DNA, 20 bp, Artificial
  CRISPR gRNA sequence
taaattggaagatattattt

SEQ ID NO: 493635 - DNA, 20 bp, Artificial
  CRISPR gRNA sequence
gaagatattatttaacagcc

SEQ ID NO: 493636 - DNA, 20 bp, Artificial
  CRISPR gRNA sequence
tttaacagccttgctcttat

SEQ ID NO: 493637 - DNA, 20 bp, Artificial
  CRISPR gRNA sequence
aacagccttgctcttatcat

SEQ ID NO: 493638 - DNA, 20 bp, Artificial
  CRISPR gRNA sequence
acagccttgctcttatcatg

SEQ ID NO: 493639 - DNA, 20 bp, Artificial
  CRISPR gRNA sequence
gctcttatcatggttgttag

SEQ ID NO: 493640 - DNA, 20 bp, Artificial
  CRISPR gRNA sequence
ctcttatcatggttgttaga

SEQ ID NO: 493641 - DNA, 20 bp, Artificial
  CRISPR gRNA sequence
ttatcatggttgttagacat

SEQ ID NO: 493642 - DNA, 20 bp, Artificial
  CRISPR gRNA sequence
atcatggttgttagacatca

SEQ ID NO: 493643 - DNA, 20 bp, Artificial
  CRISPR gRNA sequence
tcatggttgttagacatcat

SEQ ID NO: 493644 - DNA, 20 bp, Artificial
  CRISPR gRNA sequence
ttagacatcattttcaaaac

SEQ ID NO: 493645 - DNA, 20 bp, Artificial
  CRISPR gRNA sequence
gacatcattttcaaaacaaa

SEQ ID NO: 493646 - DNA, 20 bp, Artificial
  CRISPR gRNA sequence
tcaaaacaaaatatagaaca

SEQ ID NO: 493647 - DNA, 20 bp, Artificial
  CRISPR gRNA sequence
caaaacaaaatatagaacaa

SEQ ID NO: 493648 - DNA, 20 bp, Artificial
  CRISPR gRNA sequence
aaaacaaaatatagaacaag

SEQ ID NO: 493649 - DNA, 20 bp, Artificial
  CRISPR gRNA sequence
ccatatcctctccagactag

SEQ ID NO: 493650 - DNA, 20 bp, Artificial
  CRISPR gRNA sequence
catatcctctccagactagg

SEQ ID NO: 493651 - DNA, 20 bp, Artificial
  CRISPR gRNA sequence
tccagactaggaactgttct

SEQ ID NO: 493652 - DNA, 20 bp, Artificial
  CRISPR gRNA sequence
cagactaggaactgttctat

SEQ ID NO: 493653 - DNA, 20 bp, Artificial
  CRISPR gRNA sequence
ggaactgttctatagagact

SEQ ID NO: 493654 - DNA, 20 bp, Artificial
  CRISPR gRNA sequence
ttctatagagactcctgtgc

SEQ ID NO: 493655 - DNA, 20 bp, Artificial
  CRISPR gRNA sequence
tatagagactcctgtgccgt

SEQ ID NO: 493656 - DNA, 20 bp, Artificial
  CRISPR gRNA sequence
tagagactcctgtgccgtca

SEQ ID NO: 493657 - DNA, 20 bp, Artificial
  CRISPR gRNA sequence
ctgtgccgtcatccactgtg

SEQ ID NO: 493658 - DNA, 20 bp, Artificial
  CRISPR gRNA sequence
tgccgtcatccactgtgcca

SEQ ID NO: 493659 - DNA, 20 bp, Artificial
  CRISPR gRNA sequence
tgccaattcccaaagcagat

SEQ ID NO: 493660 - DNA, 20 bp, Artificial
  CRISPR gRNA sequence
ccaaagcagatgctgatgtg

SEQ ID NO: 493661 - DNA, 20 bp, Artificial
  CRISPR gRNA sequence
atgtgcaagaaaggtgagaa

SEQ ID NO: 493662 - DNA, 20 bp, Artificial
  CRISPR gRNA sequence
ctgcagcaactaggaataaa

SEQ ID NO: 493663 - DNA, 20 bp, Artificial
  CRISPR gRNA sequence
cagcaactaggaataaacat

SEQ ID NO: 493664 - DNA, 20 bp, Artificial
  CRISPR gRNA sequence
ggaataaacatcaaagttct

SEQ ID NO: 493665 - DNA, 20 bp, Artificial
  CRISPR gRNA sequence
tccagctctttgcggctcaa

SEQ ID NO: 493666 - DNA, 20 bp, Artificial
  CRISPR gRNA sequence
cagctctttgcggctcaatc

SEQ ID NO: 493667 - DNA, 20 bp, Artificial
  CRISPR gRNA sequence
tttgcggctcaatcgagcag

SEQ ID NO: 493668 - DNA, 20 bp, Artificial
  CRISPR gRNA sequence
tgcggctcaatcgagcaggg

SEQ ID NO: 493669 - DNA, 20 bp, Artificial
  CRISPR gRNA sequence
gcggctcaatcgagcagggt

SEQ ID NO: 493670 - DNA, 20 bp, Artificial
  CRISPR gRNA sequence
cggctcaatcgagcagggtt

SEQ ID NO: 493671 - DNA, 20 bp, Artificial
  CRISPR gRNA sequence
aatcgagcagggttctgggc

SEQ ID NO: 493672 - DNA, 20 bp, Artificial
  CRISPR gRNA sequence
tgggctttaggttgactctt

SEQ ID NO: 493673 - DNA, 20 bp, Artificial
  CRISPR gRNA sequence
ggctttaggttgactctttc

SEQ ID NO: 493674 - DNA, 20 bp, Artificial
  CRISPR gRNA sequence
taggttgactctttccaatc

SEQ ID NO: 493675 - DNA, 20 bp, Artificial
  CRISPR gRNA sequence
aggttgactctttccaatct

SEQ ID NO: 493676 - DNA, 20 bp, Artificial
  CRISPR gRNA sequence
ggttgactctttccaatctg

SEQ ID NO: 493677 - DNA, 20 bp, Artificial
  CRISPR gRNA sequence
actctttccaatctgcaaaa

SEQ ID NO: 493678 - DNA, 20 bp, Artificial
  CRISPR gRNA sequence
tttccaatctgcaaaagaaa

SEQ ID NO: 493679 - DNA, 20 bp, Artificial
  CRISPR gRNA sequence
tccaatctgcaaaagaaaag

SEQ ID NO: 493680 - DNA, 20 bp, Artificial
  CRISPR gRNA sequence
ccaatctgcaaaagaaaagg

SEQ ID NO: 493681 - DNA, 20 bp, Artificial
  CRISPR gRNA sequence
caatctgcaaaagaaaagga

SEQ ID NO: 493682 - DNA, 20 bp, Artificial
  CRISPR gRNA sequence
caaaagaaaaggagaaactt

SEQ ID NO: 493683 - DNA, 20 bp, Artificial
  CRISPR gRNA sequence
cagacccttgcactgggagg

SEQ ID NO: 493684 - DNA, 20 bp, Artificial
  CRISPR gRNA sequence
agacccttgcactgggaggt

SEQ ID NO: 493685 - DNA, 20 bp, Artificial
  CRISPR gRNA sequence
gcactgggaggtccttatca

SEQ ID NO: 493686 - DNA, 20 bp, Artificial
  CRISPR gRNA sequence
cactgggaggtccttatcac

SEQ ID NO: 493687 - DNA, 20 bp, Artificial
  CRISPR gRNA sequence
ggaggtccttatcacaatcc

SEQ ID NO: 493688 - DNA, 20 bp, Artificial
  CRISPR gRNA sequence
atcacaatcctgtgaggtat

SEQ ID NO: 493689 - DNA, 20 bp, Artificial
  CRISPR gRNA sequence
tcacaatcctgtgaggtatg

SEQ ID NO: 493690 - DNA, 20 bp, Artificial
  CRISPR gRNA sequence
tgaggtatgacttgccatcc

SEQ ID NO: 493691 - DNA, 20 bp, Artificial
  CRISPR gRNA sequence
gccatccccattttacagat

SEQ ID NO: 493692 - DNA, 20 bp, Artificial
  CRISPR gRNA sequence
ccatccccattttacagatt

SEQ ID NO: 493693 - DNA, 20 bp, Artificial
  CRISPR gRNA sequence
tacagatttaaaaaatgaag

SEQ ID NO: 493694 - DNA, 20 bp, Artificial
  CRISPR gRNA sequence
acagatttaaaaaatgaagc

SEQ ID NO: 493695 - DNA, 20 bp, Artificial
  CRISPR gRNA sequence
cagatttaaaaaatgaagct

SEQ ID NO: 493696 - DNA, 20 bp, Artificial
  CRISPR gRNA sequence
aaaaaatgaagctcagagtg

SEQ ID NO: 493697 - DNA, 20 bp, Artificial
  CRISPR gRNA sequence
aaaaatgaagctcagagtga

SEQ ID NO: 493698 - DNA, 20 bp, Artificial
  CRISPR gRNA sequence
agagtgacaaaacaaattac

SEQ ID NO: 493699 - DNA, 20 bp, Artificial
  CRISPR gRNA sequence
ctcaggatccacgactagtg

SEQ ID NO: 493700 - DNA, 20 bp, Artificial
  CRISPR gRNA sequence
aggatccacgactagtgtga

SEQ ID NO: 493701 - DNA, 20 bp, Artificial
  CRISPR gRNA sequence
gtgtgaagtgcaggagggac

SEQ ID NO: 493702 - DNA, 20 bp, Artificial
  CRISPR gRNA sequence
gaatctagttcttctggctc

SEQ ID NO: 493703 - DNA, 20 bp, Artificial
  CRISPR gRNA sequence
aatctagttcttctggctcc

SEQ ID NO: 493704 - DNA, 20 bp, Artificial
  CRISPR gRNA sequence
gttcttctggctccaattcc

SEQ ID NO: 493705 - DNA, 20 bp, Artificial
  CRISPR gRNA sequence
ttctggctccaattccagta

SEQ ID NO: 493706 - DNA, 20 bp, Artificial
  CRISPR gRNA sequence
ctggctccaattccagtact

SEQ ID NO: 493707 - DNA, 20 bp, Artificial
  CRISPR gRNA sequence
tggctccaattccagtactc

SEQ ID NO: 493708 - DNA, 20 bp, Artificial
  CRISPR gRNA sequence
gctccaattccagtactctc

SEQ ID NO: 493709 - DNA, 20 bp, Artificial
  CRISPR gRNA sequence
caattccagtactctcttaa

SEQ ID NO: 493710 - DNA, 20 bp, Artificial
  CRISPR gRNA sequence
cagtactctcttaaccacat

SEQ ID NO: 493711 - DNA, 20 bp, Artificial
  CRISPR gRNA sequence
tcttaaccacatatgctttt

SEQ ID NO: 493712 - DNA, 20 bp, Artificial
  CRISPR gRNA sequence
ttaaccacatatgctttttc

SEQ ID NO: 493713 - DNA, 20 bp, Artificial
  CRISPR gRNA sequence
aaccacatatgctttttcat

SEQ ID NO: 493714 - DNA, 20 bp, Artificial
  CRISPR gRNA sequence
accacatatgctttttcatg

SEQ ID NO: 493715 - DNA, 20 bp, Artificial
  CRISPR gRNA sequence
tttcatgacctcacaagcta

SEQ ID NO: 493716 - DNA, 20 bp, Artificial
  CRISPR gRNA sequence
ttcatgacctcacaagctac

SEQ ID NO: 493717 - DNA, 20 bp, Artificial
  CRISPR gRNA sequence
tcatgacctcacaagctacc

SEQ ID NO: 493718 - DNA, 20 bp, Artificial
  CRISPR gRNA sequence
catgacctcacaagctacct

SEQ ID NO: 493719 - DNA, 20 bp, Artificial
  CRISPR gRNA sequence
atgacctcacaagctacctg

SEQ ID NO: 493720 - DNA, 20 bp, Artificial
  CRISPR gRNA sequence
acaagctacctgggtctaca

SEQ ID NO: 493721 - DNA, 20 bp, Artificial
  CRISPR gRNA sequence
cctgggtctacacagtgccc

SEQ ID NO: 493722 - DNA, 20 bp, Artificial
  CRISPR gRNA sequence
ggtctacacagtgccctcta

SEQ ID NO: 493723 - DNA, 20 bp, Artificial
  CRISPR gRNA sequence
cacagtgccctctatgaccc

SEQ ID NO: 493724 - DNA, 20 bp, Artificial
  CRISPR gRNA sequence
tatgaccctgggttgtccag

SEQ ID NO: 493725 - DNA, 20 bp, Artificial
  CRISPR gRNA sequence
tgaccctgggttgtccagtt

SEQ ID NO: 493726 - DNA, 20 bp, Artificial
  CRISPR gRNA sequence
ggttgtccagttggctttaa

SEQ ID NO: 493727 - DNA, 20 bp, Artificial
  CRISPR gRNA sequence
tccagttggctttaatgttg

SEQ ID NO: 493728 - DNA, 20 bp, Artificial
  CRISPR gRNA sequence
gctttaatgttgggtgatag

SEQ ID NO: 493729 - DNA, 20 bp, Artificial
  CRISPR gRNA sequence
taatgttgggtgatagctga

SEQ ID NO: 493730 - DNA, 20 bp, Artificial
  CRISPR gRNA sequence
aatgttgggtgatagctgaa

SEQ ID NO: 493731 - DNA, 20 bp, Artificial
  CRISPR gRNA sequence
atgttgggtgatagctgaag

SEQ ID NO: 493732 - DNA, 20 bp, Artificial
  CRISPR gRNA sequence
ggtgatagctgaagtgccag

SEQ ID NO: 493733 - DNA, 20 bp, Artificial
  CRISPR gRNA sequence
aagtgccaggaattccagca

SEQ ID NO: 493734 - DNA, 20 bp, Artificial
  CRISPR gRNA sequence
cagcaggcagccacccatcc

SEQ ID NO: 493735 - DNA, 20 bp, Artificial
  CRISPR gRNA sequence
ccttctgaccaatggcagca

SEQ ID NO: 493736 - DNA, 20 bp, Artificial
  CRISPR gRNA sequence
ctgaccaatggcagcatctt

SEQ ID NO: 493737 - DNA, 20 bp, Artificial
  CRISPR gRNA sequence
tgaccaatggcagcatcttt

SEQ ID NO: 493738 - DNA, 20 bp, Artificial
  CRISPR gRNA sequence
accaatggcagcatctttat

SEQ ID NO: 493739 - DNA, 20 bp, Artificial
  CRISPR gRNA sequence
tattggaccacaggtgggga

SEQ ID NO: 493740 - DNA, 20 bp, Artificial
  CRISPR gRNA sequence
attggaccacaggtggggag

SEQ ID NO: 493741 - DNA, 20 bp, Artificial
  CRISPR gRNA sequence
ttggaccacaggtggggagg

SEQ ID NO: 493742 - DNA, 20 bp, Artificial
  CRISPR gRNA sequence
gaccacaggtggggaggctc

SEQ ID NO: 493743 - DNA, 20 bp, Artificial
  CRISPR gRNA sequence
aggtgtagtatgaggctaat

SEQ ID NO: 493744 - DNA, 20 bp, Artificial
  CRISPR gRNA sequence
atgggtagtgggggaggttg

SEQ ID NO: 493745 - DNA, 20 bp, Artificial
  CRISPR gRNA sequence
ggggatgctctccatgcctt

SEQ ID NO: 493746 - DNA, 20 bp, Artificial
  CRISPR gRNA sequence
tccatgccttaatttctctg

SEQ ID NO: 493747 - DNA, 20 bp, Artificial
  CRISPR gRNA sequence
catgccttaatttctctgag

SEQ ID NO: 493748 - DNA, 20 bp, Artificial
  CRISPR gRNA sequence
aatttctctgagtataaatg

SEQ ID NO: 493749 - DNA, 20 bp, Artificial
  CRISPR gRNA sequence
atttctctgagtataaatgg

SEQ ID NO: 493750 - DNA, 20 bp, Artificial
  CRISPR gRNA sequence
ctctgagtataaatggaaag

SEQ ID NO: 493751 - DNA, 20 bp, Artificial
  CRISPR gRNA sequence
tctgagtataaatggaaagt

SEQ ID NO: 493752 - DNA, 20 bp, Artificial
  CRISPR gRNA sequence
tgagtataaatggaaagtat

SEQ ID NO: 493753 - DNA, 20 bp, Artificial
  CRISPR gRNA sequence
agtataaatggaaagtataa

SEQ ID NO: 493754 - DNA, 20 bp, Artificial
  CRISPR gRNA sequence
tacctatcttgtagcattct

SEQ ID NO: 493755 - DNA, 20 bp, Artificial
  CRISPR gRNA sequence
tcttgtagcattctgtgagg

SEQ ID NO: 493756 - DNA, 20 bp, Artificial
  CRISPR gRNA sequence
gtagcattctgtgaggacta

SEQ ID NO: 493757 - DNA, 20 bp, Artificial
  CRISPR gRNA sequence
tagcattctgtgaggactaa

SEQ ID NO: 493758 - DNA, 20 bp, Artificial
  CRISPR gRNA sequence
tgtgaggactaaataaaata

SEQ ID NO: 493759 - DNA, 20 bp, Artificial
  CRISPR gRNA sequence
tgaggactaaataaaataat

SEQ ID NO: 493760 - DNA, 20 bp, Artificial
  CRISPR gRNA sequence
aataaaataatccatgtgaa

SEQ ID NO: 493761 - DNA, 20 bp, Artificial
  CRISPR gRNA sequence
gcaggctaccttatccataa

SEQ ID NO: 493762 - DNA, 20 bp, Artificial
  CRISPR gRNA sequence
ccttatccataataaacccc

SEQ ID NO: 493763 - DNA, 20 bp, Artificial
  CRISPR gRNA sequence
atccataataaacccccaag

SEQ ID NO: 493764 - DNA, 20 bp, Artificial
  CRISPR gRNA sequence
tccataataaacccccaaga

SEQ ID NO: 493765 - DNA, 20 bp, Artificial
  CRISPR gRNA sequence
agtccctcctttccagtccc

SEQ ID NO: 493766 - DNA, 20 bp, Artificial
  CRISPR gRNA sequence
ctttccagtccctaaatgct

SEQ ID NO: 493767 - DNA, 20 bp, Artificial
  CRISPR gRNA sequence
tccagtccctaaatgctctg

SEQ ID NO: 493768 - DNA, 20 bp, Artificial
  CRISPR gRNA sequence
ccagtccctaaatgctctga

SEQ ID NO: 493769 - DNA, 20 bp, Artificial
  CRISPR gRNA sequence
cagtccctaaatgctctgat

SEQ ID NO: 493770 - DNA, 20 bp, Artificial
  CRISPR gRNA sequence
aatgctctgatgggaatcaa

SEQ ID NO: 493771 - DNA, 20 bp, Artificial
  CRISPR gRNA sequence
tgatgggaatcaattcaacc

SEQ ID NO: 493772 - DNA, 20 bp, Artificial
  CRISPR gRNA sequence
atgggaatcaattcaaccac

SEQ ID NO: 493773 - DNA, 20 bp, Artificial
  CRISPR gRNA sequence
aaccaccaggctcagtggtc

SEQ ID NO: 493774 - DNA, 20 bp, Artificial
  CRISPR gRNA sequence
agtggtcatctctgaacagt

SEQ ID NO: 493775 - DNA, 20 bp, Artificial
  CRISPR gRNA sequence
tgaacagtgttgacccctga

SEQ ID NO: 493776 - DNA, 20 bp, Artificial
  CRISPR gRNA sequence
aacagtgttgacccctgaag

SEQ ID NO: 493777 - DNA, 20 bp, Artificial
  CRISPR gRNA sequence
acccctgaagaagattaagc

SEQ ID NO: 493778 - DNA, 20 bp, Artificial
  CRISPR gRNA sequence
aagaagattaagctcaccta

SEQ ID NO: 493779 - DNA, 20 bp, Artificial
  CRISPR gRNA sequence
agctcacctatgtcctggaa

SEQ ID NO: 493780 - DNA, 20 bp, Artificial
  CRISPR gRNA sequence
acctatgtcctggaatggct

SEQ ID NO: 493781 - DNA, 20 bp, Artificial
  CRISPR gRNA sequence
tgtcctggaatggctcccaa

SEQ ID NO: 493782 - DNA, 20 bp, Artificial
  CRISPR gRNA sequence
gaatggctcccaaagacttg

SEQ ID NO: 493783 - DNA, 20 bp, Artificial
  CRISPR gRNA sequence
ccaaagacttgctaatttta

SEQ ID NO: 493784 - DNA, 20 bp, Artificial
  CRISPR gRNA sequence
gctaattttagaaaatcatt

SEQ ID NO: 493785 - DNA, 20 bp, Artificial
  CRISPR gRNA sequence
ctaattttagaaaatcattt

SEQ ID NO: 493786 - DNA, 20 bp, Artificial
  CRISPR gRNA sequence
attttagaaaatcatttaga

SEQ ID NO: 493787 - DNA, 20 bp, Artificial
  CRISPR gRNA sequence
tagaaaatcatttagagtcc

SEQ ID NO: 493788 - DNA, 20 bp, Artificial
  CRISPR gRNA sequence
agaaaatcatttagagtcct

SEQ ID NO: 493789 - DNA, 20 bp, Artificial
  CRISPR gRNA sequence
gaaaatcatttagagtcctt

SEQ ID NO: 493790 - DNA, 20 bp, Artificial
  CRISPR gRNA sequence
agagtcctttatcttcccct

SEQ ID NO: 493791 - DNA, 20 bp, Artificial
  CRISPR gRNA sequence
gagtcctttatcttcccctc

SEQ ID NO: 493792 - DNA, 20 bp, Artificial
  CRISPR gRNA sequence
tatcttcccctctctgaccc

SEQ ID NO: 493793 - DNA, 20 bp, Artificial
  CRISPR gRNA sequence
atcttcccctctctgacccc

SEQ ID NO: 493794 - DNA, 20 bp, Artificial
  CRISPR gRNA sequence
tcttcccctctctgacccct

SEQ ID NO: 493795 - DNA, 20 bp, Artificial
  CRISPR gRNA sequence
cccctctctgacccctcctc

SEQ ID NO: 493796 - DNA, 20 bp, Artificial
  CRISPR gRNA sequence
ccctctctgacccctcctcc

SEQ ID NO: 493797 - DNA, 20 bp, Artificial
  CRISPR gRNA sequence
tctgacccctcctccgaaca

SEQ ID NO: 493798 - DNA, 20 bp, Artificial
  CRISPR gRNA sequence
tgacccctcctccgaacact

SEQ ID NO: 493799 - DNA, 20 bp, Artificial
  CRISPR gRNA sequence
acccctcctccgaacactct

SEQ ID NO: 493800 - DNA, 20 bp, Artificial
  CRISPR gRNA sequence
ctccgaacactcttggaaag

SEQ ID NO: 493801 - DNA, 20 bp, Artificial
  CRISPR gRNA sequence
cgaacactcttggaaaggag

SEQ ID NO: 493802 - DNA, 20 bp, Artificial
  CRISPR gRNA sequence
ttggaaaggagagatgtcca

SEQ ID NO: 493803 - DNA, 20 bp, Artificial
  CRISPR gRNA sequence
ggaaaggagagatgtccagt

SEQ ID NO: 493804 - DNA, 20 bp, Artificial
  CRISPR gRNA sequence
gaaaggagagatgtccagtt

SEQ ID NO: 493805 - DNA, 20 bp, Artificial
  CRISPR gRNA sequence
gtggcccacagcctgggaac

SEQ ID NO: 493806 - DNA, 20 bp, Artificial
  CRISPR gRNA sequence
tggcccacagcctgggaact

SEQ ID NO: 493807 - DNA, 20 bp, Artificial
  CRISPR gRNA sequence
ggaactagctcggggacggc

SEQ ID NO: 493808 - DNA, 20 bp, Artificial
  CRISPR gRNA sequence
gctcggggacggccctaatt

SEQ ID NO: 493809 - DNA, 20 bp, Artificial
  CRISPR gRNA sequence
ggggacggccctaatttaaa

SEQ ID NO: 493810 - DNA, 20 bp, Artificial
  CRISPR gRNA sequence
atttaaaacccaagctgccc

SEQ ID NO: 493811 - DNA, 20 bp, Artificial
  CRISPR gRNA sequence
aaaacccaagctgcccagta

SEQ ID NO: 493812 - DNA, 20 bp, Artificial
  CRISPR gRNA sequence
aaacccaagctgcccagtaa

SEQ ID NO: 493813 - DNA, 20 bp, Artificial
  CRISPR gRNA sequence
cccagtaagtatcatatcta

SEQ ID NO: 493814 - DNA, 20 bp, Artificial
  CRISPR gRNA sequence
aacacgcaatatgatcttgg

SEQ ID NO: 493815 - DNA, 20 bp, Artificial
  CRISPR gRNA sequence
gggtcagaccctcactctcc

SEQ ID NO: 493816 - DNA, 20 bp, Artificial
  CRISPR gRNA sequence
ggtcagaccctcactctcct

SEQ ID NO: 493817 - DNA, 20 bp, Artificial
  CRISPR gRNA sequence
actctccttgggcttcagtg

SEQ ID NO: 493818 - DNA, 20 bp, Artificial
  CRISPR gRNA sequence
tccttgggcttcagtgtctt

SEQ ID NO: 493819 - DNA, 20 bp, Artificial
  CRISPR gRNA sequence
cttgggcttcagtgtcttca

SEQ ID NO: 493820 - DNA, 20 bp, Artificial
  CRISPR gRNA sequence
gggcttcagtgtcttcatct

SEQ ID NO: 493821 - DNA, 20 bp, Artificial
  CRISPR gRNA sequence
ggcttcagtgtcttcatctc

SEQ ID NO: 493822 - DNA, 20 bp, Artificial
  CRISPR gRNA sequence
cagtgtcttcatctctaaaa

SEQ ID NO: 493823 - DNA, 20 bp, Artificial
  CRISPR gRNA sequence
agtgtcttcatctctaaaac

SEQ ID NO: 493824 - DNA, 20 bp, Artificial
  CRISPR gRNA sequence
catctctaaaacaaagactt

SEQ ID NO: 493825 - DNA, 20 bp, Artificial
  CRISPR gRNA sequence
atctctaaaacaaagacttg

SEQ ID NO: 493826 - DNA, 20 bp, Artificial
  CRISPR gRNA sequence
taaaacaaagacttgcatta

SEQ ID NO: 493827 - DNA, 20 bp, Artificial
  CRISPR gRNA sequence
aaacaaagacttgcattaga

SEQ ID NO: 493828 - DNA, 20 bp, Artificial
  CRISPR gRNA sequence
gcattagaagatctctaaat

SEQ ID NO: 493829 - DNA, 20 bp, Artificial
  CRISPR gRNA sequence
cattagaagatctctaaatt

SEQ ID NO: 493830 - DNA, 20 bp, Artificial
  CRISPR gRNA sequence
gaagatctctaaattcccta

SEQ ID NO: 493831 - DNA, 20 bp, Artificial
  CRISPR gRNA sequence
taaattccctacaactctga

SEQ ID NO: 493832 - DNA, 20 bp, Artificial
  CRISPR gRNA sequence
aattccctacaactctgaga

SEQ ID NO: 493833 - DNA, 20 bp, Artificial
  CRISPR gRNA sequence
cctacaactctgagactgtg

SEQ ID NO: 493834 - DNA, 20 bp, Artificial
  CRISPR gRNA sequence
caactctgagactgtgtgaa

SEQ ID NO: 493835 - DNA, 20 bp, Artificial
  CRISPR gRNA sequence
tgagactgtgtgaatgatct

SEQ ID NO: 493836 - DNA, 20 bp, Artificial
  CRISPR gRNA sequence
agactgtgtgaatgatcttt

SEQ ID NO: 493837 - DNA, 20 bp, Artificial
  CRISPR gRNA sequence
tgtgaatgatcttttcctaa

SEQ ID NO: 493838 - DNA, 20 bp, Artificial
  CRISPR gRNA sequence
ttcctaagtgtaccctttca

SEQ ID NO: 493839 - DNA, 20 bp, Artificial
  CRISPR gRNA sequence
tcctaagtgtaccctttcat

SEQ ID NO: 493840 - DNA, 20 bp, Artificial
  CRISPR gRNA sequence
cctaagtgtaccctttcatg

SEQ ID NO: 493841 - DNA, 20 bp, Artificial
  CRISPR gRNA sequence
ctaagtgtaccctttcatgg

SEQ ID NO: 493842 - DNA, 20 bp, Artificial
  CRISPR gRNA sequence
agtgtaccctttcatggcta

SEQ ID NO: 493843 - DNA, 20 bp, Artificial
  CRISPR gRNA sequence
tcatggctagatttcagggc

SEQ ID NO: 493844 - DNA, 20 bp, Artificial
  CRISPR gRNA sequence
catggctagatttcagggct

SEQ ID NO: 493845 - DNA, 20 bp, Artificial
  CRISPR gRNA sequence
atggctagatttcagggcta

SEQ ID NO: 493846 - DNA, 20 bp, Artificial
  CRISPR gRNA sequence
gatttcagggctatgcaaca

SEQ ID NO: 493847 - DNA, 20 bp, Artificial
  CRISPR gRNA sequence
cagggctatgcaacagacag

SEQ ID NO: 493848 - DNA, 20 bp, Artificial
  CRISPR gRNA sequence
agggctatgcaacagacagt

SEQ ID NO: 493849 - DNA, 20 bp, Artificial
  CRISPR gRNA sequence
tgcaacagacagtaaaccca

SEQ ID NO: 493850 - DNA, 20 bp, Artificial
  CRISPR gRNA sequence
aggagttccagaatcttacc

SEQ ID NO: 493851 - DNA, 20 bp, Artificial
  CRISPR gRNA sequence
cagaatcttaccacttcata

SEQ ID NO: 493852 - DNA, 20 bp, Artificial
  CRISPR gRNA sequence
accacttcatagatagtgct

SEQ ID NO: 493853 - DNA, 20 bp, Artificial
  CRISPR gRNA sequence
ccacttcatagatagtgcta

SEQ ID NO: 493854 - DNA, 20 bp, Artificial
  CRISPR gRNA sequence
catagatagtgctattgaag

SEQ ID NO: 493855 - DNA, 20 bp, Artificial
  CRISPR gRNA sequence
atagatagtgctattgaagg

SEQ ID NO: 493856 - DNA, 20 bp, Artificial
  CRISPR gRNA sequence
ttgaaggaagggctgtggtt

SEQ ID NO: 493857 - DNA, 20 bp, Artificial
  CRISPR gRNA sequence
aaggaagggctgtggttcct

SEQ ID NO: 493858 - DNA, 20 bp, Artificial
  CRISPR gRNA sequence
tggttcctcttcctggatcc

SEQ ID NO: 493859 - DNA, 20 bp, Artificial
  CRISPR gRNA sequence
ctcttcctggatccagacta

SEQ ID NO: 493860 - DNA, 20 bp, Artificial
  CRISPR gRNA sequence
ttcctggatccagactagaa

SEQ ID NO: 493861 - DNA, 20 bp, Artificial
  CRISPR gRNA sequence
cctggatccagactagaaat

SEQ ID NO: 493862 - DNA, 20 bp, Artificial
  CRISPR gRNA sequence
ctggatccagactagaaatt

SEQ ID NO: 493863 - DNA, 20 bp, Artificial
  CRISPR gRNA sequence
gatccagactagaaattcag

SEQ ID NO: 493864 - DNA, 20 bp, Artificial
  CRISPR gRNA sequence
gaaattcagaaggtaaagaa

SEQ ID NO: 493865 - DNA, 20 bp, Artificial
  CRISPR gRNA sequence
agaaggtaaagaatacttaa

SEQ ID NO: 493866 - DNA, 20 bp, Artificial
  CRISPR gRNA sequence
aacttcgagataagtgctct

SEQ ID NO: 493867 - DNA, 20 bp, Artificial
  CRISPR gRNA sequence
acttcgagataagtgctctc

SEQ ID NO: 493868 - DNA, 20 bp, Artificial
  CRISPR gRNA sequence
cgagataagtgctctcccac

SEQ ID NO: 493869 - DNA, 20 bp, Artificial
  CRISPR gRNA sequence
gagataagtgctctcccact

SEQ ID NO: 493870 - DNA, 20 bp, Artificial
  CRISPR gRNA sequence
tcccactcctaagtgatgtg

SEQ ID NO: 493871 - DNA, 20 bp, Artificial
  CRISPR gRNA sequence
ccactcctaagtgatgtgag

SEQ ID NO: 493872 - DNA, 20 bp, Artificial
  CRISPR gRNA sequence
ctaagtgatgtgagaggtcc

SEQ ID NO: 493873 - DNA, 20 bp, Artificial
  CRISPR gRNA sequence
agtgatgtgagaggtcccaa

SEQ ID NO: 493874 - DNA, 20 bp, Artificial
  CRISPR gRNA sequence
agggcccagaaaaattctga

SEQ ID NO: 493875 - DNA, 20 bp, Artificial
  CRISPR gRNA sequence
tgaggcactctcagccagaa

SEQ ID NO: 493876 - DNA, 20 bp, Artificial
  CRISPR gRNA sequence
aggcactctcagccagaaaa

SEQ ID NO: 493877 - DNA, 20 bp, Artificial
  CRISPR gRNA sequence
tcagccagaaaatgaataga

SEQ ID NO: 493878 - DNA, 20 bp, Artificial
  CRISPR gRNA sequence
agccagaaaatgaatagaat

SEQ ID NO: 493879 - DNA, 20 bp, Artificial
  CRISPR gRNA sequence
tcaccctaggagcaaaacaa

SEQ ID NO: 493880 - DNA, 20 bp, Artificial
  CRISPR gRNA sequence
ggagcaaaacaatggtgttt

SEQ ID NO: 493881 - DNA, 20 bp, Artificial
  CRISPR gRNA sequence
atggtctccagggaagacac

SEQ ID NO: 493882 - DNA, 20 bp, Artificial
  CRISPR gRNA sequence
tggtctccagggaagacaca

SEQ ID NO: 493883 - DNA, 20 bp, Artificial
  CRISPR gRNA sequence
cagggaagacacaatatata

SEQ ID NO: 493884 - DNA, 20 bp, Artificial
  CRISPR gRNA sequence
gcctataatatgatatttct

SEQ ID NO: 493885 - DNA, 20 bp, Artificial
  CRISPR gRNA sequence
cctataatatgatatttctg

SEQ ID NO: 493886 - DNA, 20 bp, Artificial
  CRISPR gRNA sequence
taatatgatatttctgaacc

SEQ ID NO: 493887 - DNA, 20 bp, Artificial
  CRISPR gRNA sequence
ctgaaccaaaatcagaattt

SEQ ID NO: 493888 - DNA, 20 bp, Artificial
  CRISPR gRNA sequence
tgaaccaaaatcagaatttg

SEQ ID NO: 493889 - DNA, 20 bp, Artificial
  CRISPR gRNA sequence
aaccaaaatcagaatttgct

SEQ ID NO: 493890 - DNA, 20 bp, Artificial
  CRISPR gRNA sequence
gctgttccatacccacatac

SEQ ID NO: 493891 - DNA, 20 bp, Artificial
  CRISPR gRNA sequence
ctgttccatacccacataca

SEQ ID NO: 493892 - DNA, 20 bp, Artificial
  CRISPR gRNA sequence
ttccatacccacatacacct

SEQ ID NO: 493893 - DNA, 20 bp, Artificial
  CRISPR gRNA sequence
catacccacatacacctaaa

SEQ ID NO: 493894 - DNA, 20 bp, Artificial
  CRISPR gRNA sequence
aaacccatacacatatgtgt

SEQ ID NO: 493895 - DNA, 20 bp, Artificial
  CRISPR gRNA sequence
gtgtatatatatacacacac

SEQ ID NO: 493896 - DNA, 20 bp, Artificial
  CRISPR gRNA sequence
tgtatatatatacacacaca

SEQ ID NO: 493897 - DNA, 20 bp, Artificial
  CRISPR gRNA sequence
ccagagcacacacacataca

SEQ ID NO: 493898 - DNA, 20 bp, Artificial
  CRISPR gRNA sequence
aggcaatcctaatgcaaata

SEQ ID NO: 493899 - DNA, 20 bp, Artificial
  CRISPR gRNA sequence
atgcaaatactgccccaaac

SEQ ID NO: 493900 - DNA, 20 bp, Artificial
  CRISPR gRNA sequence
ccccaaaccatgtatctctt

SEQ ID NO: 493901 - DNA, 20 bp, Artificial
  CRISPR gRNA sequence
ttcaacgcatgcatacacac

SEQ ID NO: 493902 - DNA, 20 bp, Artificial
  CRISPR gRNA sequence
caacgcatgcatacacacac

SEQ ID NO: 493903 - DNA, 20 bp, Artificial
  CRISPR gRNA sequence
aacgcatgcatacacacacc

SEQ ID NO: 493904 - DNA, 20 bp, Artificial
  CRISPR gRNA sequence
aatgtaaacaatccaggcat

SEQ ID NO: 493905 - DNA, 20 bp, Artificial
  CRISPR gRNA sequence
atgtaaacaatccaggcata

SEQ ID NO: 493906 - DNA, 20 bp, Artificial
  CRISPR gRNA sequence
ccaacccaaggacactagaa

SEQ ID NO: 493907 - DNA, 20 bp, Artificial
  CRISPR gRNA sequence
gaattcagaggcacattcag

SEQ ID NO: 493908 - DNA, 20 bp, Artificial
  CRISPR gRNA sequence
agaggcacattcagtagcat

SEQ ID NO: 493909 - DNA, 20 bp, Artificial
  CRISPR gRNA sequence
agtagcatatagagtttaca

SEQ ID NO: 493910 - DNA, 20 bp, Artificial
  CRISPR gRNA sequence
acatacaccaaagcaggtga

SEQ ID NO: 493911 - DNA, 20 bp, Artificial
  CRISPR gRNA sequence
catacaccaaagcaggtgaa

SEQ ID NO: 493912 - DNA, 20 bp, Artificial
  CRISPR gRNA sequence
tgaacatctatatggcctta

SEQ ID NO: 493913 - DNA, 20 bp, Artificial
  CRISPR gRNA sequence
tatggccttatattgtagca

SEQ ID NO: 493914 - DNA, 20 bp, Artificial
  CRISPR gRNA sequence
atattgtagcatataattaa

SEQ ID NO: 493915 - DNA, 20 bp, Artificial
  CRISPR gRNA sequence
tattgtagcatataattaaa

SEQ ID NO: 493916 - DNA, 20 bp, Artificial
  CRISPR gRNA sequence
tagcatataattaaaaacaa

SEQ ID NO: 493917 - DNA, 20 bp, Artificial
  CRISPR gRNA sequence
aaaacaaatctctctcacga

SEQ ID NO: 493918 - DNA, 20 bp, Artificial
  CRISPR gRNA sequence
tctcacgatgggatccaagt

SEQ ID NO: 493919 - DNA, 20 bp, Artificial
  CRISPR gRNA sequence
tcacgatgggatccaagtag

SEQ ID NO: 493920 - DNA, 20 bp, Artificial
  CRISPR gRNA sequence
acgatgggatccaagtaggt

SEQ ID NO: 493921 - DNA, 20 bp, Artificial
  CRISPR gRNA sequence
aatggcttattggaaggagg

SEQ ID NO: 493922 - DNA, 20 bp, Artificial
  CRISPR gRNA sequence
attggaaggaggttgaatga

SEQ ID NO: 493923 - DNA, 20 bp, Artificial
  CRISPR gRNA sequence
ttggaaggaggttgaatgaa

SEQ ID NO: 493924 - DNA, 20 bp, Artificial
  CRISPR gRNA sequence
gaaggaggttgaatgaaaag

SEQ ID NO: 493925 - DNA, 20 bp, Artificial
  CRISPR gRNA sequence
aatgaaaagtctgaaaatct

SEQ ID NO: 493926 - DNA, 20 bp, Artificial
  CRISPR gRNA sequence
aaaatctgtcctaaacccct

SEQ ID NO: 493927 - DNA, 20 bp, Artificial
  CRISPR gRNA sequence
tcctaaaccccttcaaacct

SEQ ID NO: 493928 - DNA, 20 bp, Artificial
  CRISPR gRNA sequence
aaccccttcaaacctgtggt

SEQ ID NO: 493929 - DNA, 20 bp, Artificial
  CRISPR gRNA sequence
caaacctgtggtccctgacc

SEQ ID NO: 493930 - DNA, 20 bp, Artificial
  CRISPR gRNA sequence
aaacctgtggtccctgacct

SEQ ID NO: 493931 - DNA, 20 bp, Artificial
  CRISPR gRNA sequence
tggtccctgacctgcatgga

SEQ ID NO: 493932 - DNA, 20 bp, Artificial
  CRISPR gRNA sequence
acctgcatggacttccacag

SEQ ID NO: 493933 - DNA, 20 bp, Artificial
  CRISPR gRNA sequence
catggacttccacagttgtg

SEQ ID NO: 493934 - DNA, 20 bp, Artificial
  CRISPR gRNA sequence
ccacagttgtgtggactccc

SEQ ID NO: 493935 - DNA, 20 bp, Artificial
  CRISPR gRNA sequence
cacagttgtgtggactccca

SEQ ID NO: 493936 - DNA, 20 bp, Artificial
  CRISPR gRNA sequence
tgtggactcccaaattccca

SEQ ID NO: 493937 - DNA, 20 bp, Artificial
  CRISPR gRNA sequence
ccaaattcccatactaccat

SEQ ID NO: 493938 - DNA, 20 bp, Artificial
  CRISPR gRNA sequence
ccatactaccatgttaaggc

SEQ ID NO: 493939 - DNA, 20 bp, Artificial
  CRISPR gRNA sequence
ccatgttaaggctttctggc

SEQ ID NO: 493940 - DNA, 20 bp, Artificial
  CRISPR gRNA sequence
aggctttctggcttcacact

SEQ ID NO: 493941 - DNA, 20 bp, Artificial
  CRISPR gRNA sequence
tctggcttcacactgtggct

SEQ ID NO: 493942 - DNA, 20 bp, Artificial
  CRISPR gRNA sequence
ctggcttcacactgtggctc

SEQ ID NO: 493943 - DNA, 20 bp, Artificial
  CRISPR gRNA sequence
tggcttcacactgtggctcc

SEQ ID NO: 493944 - DNA, 20 bp, Artificial
  CRISPR gRNA sequence
gcttcacactgtggctccag

SEQ ID NO: 493945 - DNA, 20 bp, Artificial
  CRISPR gRNA sequence
cacactgtggctccagcctt

SEQ ID NO: 493946 - DNA, 20 bp, Artificial
  CRISPR gRNA sequence
acactgtggctccagccttg

SEQ ID NO: 493947 - DNA, 20 bp, Artificial
  CRISPR gRNA sequence
tggctccagccttgggaaca

SEQ ID NO: 493948 - DNA, 20 bp, Artificial
  CRISPR gRNA sequence
cagccttgggaacaccactc

SEQ ID NO: 493949 - DNA, 20 bp, Artificial
  CRISPR gRNA sequence
gggaacaccactcttcccat

SEQ ID NO: 493950 - DNA, 20 bp, Artificial
  CRISPR gRNA sequence
ggaacaccactcttcccatc

SEQ ID NO: 493951 - DNA, 20 bp, Artificial
  CRISPR gRNA sequence
ttcccatccccttccataca

SEQ ID NO: 493952 - DNA, 20 bp, Artificial
  CRISPR gRNA sequence
cccatccccttccatacaag

SEQ ID NO: 493953 - DNA, 20 bp, Artificial
  CRISPR gRNA sequence
ccatccccttccatacaaga

SEQ ID NO: 493954 - DNA, 20 bp, Artificial
  CRISPR gRNA sequence
ccatacaagagaaaaacaat

SEQ ID NO: 493955 - DNA, 20 bp, Artificial
  CRISPR gRNA sequence
catacaagagaaaaacaatg

SEQ ID NO: 493956 - DNA, 20 bp, Artificial
  CRISPR gRNA sequence
tgtttccaagtacacaagag

SEQ ID NO: 493957 - DNA, 20 bp, Artificial
  CRISPR gRNA sequence
tttccaagtacacaagagag

SEQ ID NO: 493958 - DNA, 20 bp, Artificial
  CRISPR gRNA sequence
ccaagtacacaagagagcta

SEQ ID NO: 493959 - DNA, 20 bp, Artificial
  CRISPR gRNA sequence
caagtacacaagagagctac

SEQ ID NO: 493960 - DNA, 20 bp, Artificial
  CRISPR gRNA sequence
cgaactcagcttggagaagg

SEQ ID NO: 493961 - DNA, 20 bp, Artificial
  CRISPR gRNA sequence
agcttggagaaggatttcag

SEQ ID NO: 493962 - DNA, 20 bp, Artificial
  CRISPR gRNA sequence
ggagaaggatttcagtgcaa

SEQ ID NO: 493963 - DNA, 20 bp, Artificial
  CRISPR gRNA sequence
gagaaggatttcagtgcaaa

SEQ ID NO: 493964 - DNA, 20 bp, Artificial
  CRISPR gRNA sequence
cagtgcaaaaggatgggttg

SEQ ID NO: 493965 - DNA, 20 bp, Artificial
  CRISPR gRNA sequence
agtgcaaaaggatgggttgc

SEQ ID NO: 493966 - DNA, 20 bp, Artificial
  CRISPR gRNA sequence
cctcagtccagaggcctcca

SEQ ID NO: 493967 - DNA, 20 bp, Artificial
  CRISPR gRNA sequence
agtccagaggcctccaccag

SEQ ID NO: 493968 - DNA, 20 bp, Artificial
  CRISPR gRNA sequence
caccagcaggtgactgactg

SEQ ID NO: 493969 - DNA, 20 bp, Artificial
  CRISPR gRNA sequence
actggccaggacctttctct

SEQ ID NO: 493970 - DNA, 20 bp, Artificial
  CRISPR gRNA sequence
gccaggacctttctctggtc

SEQ ID NO: 493971 - DNA, 20 bp, Artificial
  CRISPR gRNA sequence
tctctggtctctgaaggtca

SEQ ID NO: 493972 - DNA, 20 bp, Artificial
  CRISPR gRNA sequence
ctctggtctctgaaggtcaa

SEQ ID NO: 493973 - DNA, 20 bp, Artificial
  CRISPR gRNA sequence
tctggtctctgaaggtcaag

SEQ ID NO: 493974 - DNA, 20 bp, Artificial
  CRISPR gRNA sequence
tggtctctgaaggtcaagat

SEQ ID NO: 493975 - DNA, 20 bp, Artificial
  CRISPR gRNA sequence
gtctctgaaggtcaagattg

SEQ ID NO: 493976 - DNA, 20 bp, Artificial
  CRISPR gRNA sequence
tgaaggtcaagattgtgtct

SEQ ID NO: 493977 - DNA, 20 bp, Artificial
  CRISPR gRNA sequence
aaggtcaagattgtgtctct

SEQ ID NO: 493978 - DNA, 20 bp, Artificial
  CRISPR gRNA sequence
tgtctctctagatccagtct

SEQ ID NO: 493979 - DNA, 20 bp, Artificial
  CRISPR gRNA sequence
tctagatccagtctactcct

SEQ ID NO: 493980 - DNA, 20 bp, Artificial
  CRISPR gRNA sequence
tagatccagtctactcctcc

SEQ ID NO: 493981 - DNA, 20 bp, Artificial
  CRISPR gRNA sequence
gatccagtctactcctccag

SEQ ID NO: 493982 - DNA, 20 bp, Artificial
  CRISPR gRNA sequence
ctcctccagctccaggcaat

SEQ ID NO: 493983 - DNA, 20 bp, Artificial
  CRISPR gRNA sequence
ctccagctccaggcaatatg

SEQ ID NO: 493984 - DNA, 20 bp, Artificial
  CRISPR gRNA sequence
cagctccaggcaatatgccc

SEQ ID NO: 493985 - DNA, 20 bp, Artificial
  CRISPR gRNA sequence
caggcaatatgccctgcctt

SEQ ID NO: 493986 - DNA, 20 bp, Artificial
  CRISPR gRNA sequence
ccttgcaaacccctccagta

SEQ ID NO: 493987 - DNA, 20 bp, Artificial
  CRISPR gRNA sequence
gcaaacccctccagtatctc

SEQ ID NO: 493988 - DNA, 20 bp, Artificial
  CRISPR gRNA sequence
caaacccctccagtatctct

SEQ ID NO: 493989 - DNA, 20 bp, Artificial
  CRISPR gRNA sequence
cagtatctctcaccatagcc

SEQ ID NO: 493990 - DNA, 20 bp, Artificial
  CRISPR gRNA sequence
tcaccatagcctcagctgac

SEQ ID NO: 493991 - DNA, 20 bp, Artificial
  CRISPR gRNA sequence
accatagcctcagctgacct

SEQ ID NO: 493992 - DNA, 20 bp, Artificial
  CRISPR gRNA sequence
agctgacctactaagtaccc

SEQ ID NO: 493993 - DNA, 20 bp, Artificial
  CRISPR gRNA sequence
acctactaagtaccccgtag

SEQ ID NO: 493994 - DNA, 20 bp, Artificial
  CRISPR gRNA sequence
ctaagtaccccgtagtctct

SEQ ID NO: 493995 - DNA, 20 bp, Artificial
  CRISPR gRNA sequence
agtaccccgtagtctctctg

SEQ ID NO: 493996 - DNA, 20 bp, Artificial
  CRISPR gRNA sequence
tctgtgcaaagcacctcctt

SEQ ID NO: 493997 - DNA, 20 bp, Artificial
  CRISPR gRNA sequence
tgtgcaaagcacctcctttc

SEQ ID NO: 493998 - DNA, 20 bp, Artificial
  CRISPR gRNA sequence
tgcaaagcacctcctttctg

SEQ ID NO: 493999 - DNA, 20 bp, Artificial
  CRISPR gRNA sequence
ctttctgtctctgactgtcc

SEQ ID NO: 494000 - DNA, 20 bp, Artificial
  CRISPR gRNA sequence
tctgtctctgactgtccttt

SEQ ID NO: 494001 - DNA, 20 bp, Artificial
  CRISPR gRNA sequence
ctgtctctgactgtccttta

SEQ ID NO: 494002 - DNA, 20 bp, Artificial
  CRISPR gRNA sequence
tgtctctgactgtcctttac

SEQ ID NO: 494003 - DNA, 20 bp, Artificial
  CRISPR gRNA sequence
tctctgactgtcctttacct

SEQ ID NO: 494004 - DNA, 20 bp, Artificial
  CRISPR gRNA sequence
tgactgtcctttacctccca

SEQ ID NO: 494005 - DNA, 20 bp, Artificial
  CRISPR gRNA sequence
actgtcctttacctcccaca

SEQ ID NO: 494006 - DNA, 20 bp, Artificial
  CRISPR gRNA sequence
tcctttacctcccacagaaa

SEQ ID NO: 494007 - DNA, 20 bp, Artificial
  CRISPR gRNA sequence
tacctcccacagaaactccc

SEQ ID NO: 494008 - DNA, 20 bp, Artificial
  CRISPR gRNA sequence
acctcccacagaaactccca

SEQ ID NO: 494009 - DNA, 20 bp, Artificial
  CRISPR gRNA sequence
cctcccacagaaactcccaa

SEQ ID NO: 494010 - DNA, 20 bp, Artificial
  CRISPR gRNA sequence
ccacagaaactcccaaaaac

SEQ ID NO: 494011 - DNA, 20 bp, Artificial
  CRISPR gRNA sequence
ccaaaaactcatctagtcta

SEQ ID NO: 494012 - DNA, 20 bp, Artificial
  CRISPR gRNA sequence
atctagtctactgttctctt

SEQ ID NO: 494013 - DNA, 20 bp, Artificial
  CRISPR gRNA sequence
gtctactgttctcttagtct

SEQ ID NO: 494014 - DNA, 20 bp, Artificial
  CRISPR gRNA sequence
ctgttctcttagtctagaag

SEQ ID NO: 494015 - DNA, 20 bp, Artificial
  CRISPR gRNA sequence
ttctcttagtctagaagctg

SEQ ID NO: 494016 - DNA, 20 bp, Artificial
  CRISPR gRNA sequence
tcttagtctagaagctgtta

SEQ ID NO: 494017 - DNA, 20 bp, Artificial
  CRISPR gRNA sequence
ttagtctagaagctgttatt

SEQ ID NO: 494018 - DNA, 20 bp, Artificial
  CRISPR gRNA sequence
agtctagaagctgttatttt

SEQ ID NO: 494019 - DNA, 20 bp, Artificial
  CRISPR gRNA sequence
gtctagaagctgttattttt

SEQ ID NO: 494020 - DNA, 20 bp, Artificial
  CRISPR gRNA sequence
gaagctgttatttttctcca

SEQ ID NO: 494021 - DNA, 20 bp, Artificial
  CRISPR gRNA sequence
ttatttttctccagacagaa

SEQ ID NO: 494022 - DNA, 20 bp, Artificial
  CRISPR gRNA sequence
tttttctccagacagaacca

SEQ ID NO: 494023 - DNA, 20 bp, Artificial
  CRISPR gRNA sequence
ttctccagacagaaccagta

SEQ ID NO: 494024 - DNA, 20 bp, Artificial
  CRISPR gRNA sequence
tctccagacagaaccagtaa

SEQ ID NO: 494025 - DNA, 20 bp, Artificial
  CRISPR gRNA sequence
ctccagacagaaccagtaag

SEQ ID NO: 494026 - DNA, 20 bp, Artificial
  CRISPR gRNA sequence
tccagacagaaccagtaagg

SEQ ID NO: 494027 - DNA, 20 bp, Artificial
  CRISPR gRNA sequence
cagacagaaccagtaaggca

SEQ ID NO: 494028 - DNA, 20 bp, Artificial
  CRISPR gRNA sequence
ctcattggcccattgacatt

SEQ ID NO: 494029 - DNA, 20 bp, Artificial
  CRISPR gRNA sequence
tcattggcccattgacattt

SEQ ID NO: 494030 - DNA, 20 bp, Artificial
  CRISPR gRNA sequence
attggcccattgacatttaa

SEQ ID NO: 494031 - DNA, 20 bp, Artificial
  CRISPR gRNA sequence
gcccattgacatttaaatac

SEQ ID NO: 494032 - DNA, 20 bp, Artificial
  CRISPR gRNA sequence
acatttaaatacagtcattt

SEQ ID NO: 494033 - DNA, 20 bp, Artificial
  CRISPR gRNA sequence
aaatacagtcatttaacaga

SEQ ID NO: 494034 - DNA, 20 bp, Artificial
  CRISPR gRNA sequence
aatacagtcatttaacagaa

SEQ ID NO: 494035 - DNA, 20 bp, Artificial
  CRISPR gRNA sequence
aacagaagctactcagatac

SEQ ID NO: 494036 - DNA, 20 bp, Artificial
  CRISPR gRNA sequence
acagaagctactcagataca

SEQ ID NO: 494037 - DNA, 20 bp, Artificial
  CRISPR gRNA sequence
ctcagatacacacaataaag

SEQ ID NO: 494038 - DNA, 20 bp, Artificial
  CRISPR gRNA sequence
agatacacacaataaagaac

SEQ ID NO: 494039 - DNA, 20 bp, Artificial
  CRISPR gRNA sequence
gccaggatgtgcacacacac

SEQ ID NO: 494040 - DNA, 20 bp, Artificial
  CRISPR gRNA sequence
ccaggatgtgcacacacact

SEQ ID NO: 494041 - DNA, 20 bp, Artificial
  CRISPR gRNA sequence
tcactgcaaacacatgcaaa

SEQ ID NO: 494042 - DNA, 20 bp, Artificial
  CRISPR gRNA sequence
actgcaaacacatgcaaaat

SEQ ID NO: 494043 - DNA, 20 bp, Artificial
  CRISPR gRNA sequence
caaacacatgcaaaatacac

SEQ ID NO: 494044 - DNA, 20 bp, Artificial
  CRISPR gRNA sequence
catcaacaacaccccaccac

SEQ ID NO: 494045 - DNA, 20 bp, Artificial
  CRISPR gRNA sequence
accttcctggaaggctgaat

SEQ ID NO: 494046 - DNA, 20 bp, Artificial
  CRISPR gRNA sequence
cctggaaggctgaattaatg

SEQ ID NO: 494047 - DNA, 20 bp, Artificial
  CRISPR gRNA sequence
ctggaaggctgaattaatga

SEQ ID NO: 494048 - DNA, 20 bp, Artificial
  CRISPR gRNA sequence
gaaggctgaattaatgaata

SEQ ID NO: 494049 - DNA, 20 bp, Artificial
  CRISPR gRNA sequence
aattaatgaatataatgtat

SEQ ID NO: 494050 - DNA, 20 bp, Artificial
  CRISPR gRNA sequence
atgaatataatgtatatgca

SEQ ID NO: 494051 - DNA, 20 bp, Artificial
  CRISPR gRNA sequence
ttgtgacgtgggagcagaag

SEQ ID NO: 494052 - DNA, 20 bp, Artificial
  CRISPR gRNA sequence
gtgacgtgggagcagaagac

SEQ ID NO: 494053 - DNA, 20 bp, Artificial
  CRISPR gRNA sequence
tgacgtgggagcagaagact

SEQ ID NO: 494054 - DNA, 20 bp, Artificial
  CRISPR gRNA sequence
atgagaagagaaataaaatc

SEQ ID NO: 494055 - DNA, 20 bp, Artificial
  CRISPR gRNA sequence
cagaagcacagatccagcac

SEQ ID NO: 494056 - DNA, 20 bp, Artificial
  CRISPR gRNA sequence
agaagcacagatccagcaca

SEQ ID NO: 494057 - DNA, 20 bp, Artificial
  CRISPR gRNA sequence
acaaaggttatctcttccgt

SEQ ID NO: 494058 - DNA, 20 bp, Artificial
  CRISPR gRNA sequence
caaaggttatctcttccgtt

SEQ ID NO: 494059 - DNA, 20 bp, Artificial
  CRISPR gRNA sequence
tctcttccgtttctcctcct

SEQ ID NO: 494060 - DNA, 20 bp, Artificial
  CRISPR gRNA sequence
ttccgtttctcctcctcaac

SEQ ID NO: 494061 - DNA, 20 bp, Artificial
  CRISPR gRNA sequence
ccgtttctcctcctcaaccc

SEQ ID NO: 494062 - DNA, 20 bp, Artificial
  CRISPR gRNA sequence
cgtttctcctcctcaaccct

SEQ ID NO: 494063 - DNA, 20 bp, Artificial
  CRISPR gRNA sequence
ctcctcctcaaccctgccca

SEQ ID NO: 494064 - DNA, 20 bp, Artificial
  CRISPR gRNA sequence
tcctcctcaaccctgcccag

SEQ ID NO: 494065 - DNA, 20 bp, Artificial
  CRISPR gRNA sequence
ctcctcaaccctgcccagat

SEQ ID NO: 494066 - DNA, 20 bp, Artificial
  CRISPR gRNA sequence
ctcaaccctgcccagatgga

SEQ ID NO: 494067 - DNA, 20 bp, Artificial
  CRISPR gRNA sequence
aaccctgcccagatggaagc

SEQ ID NO: 494068 - DNA, 20 bp, Artificial
  CRISPR gRNA sequence
cccagatggaagcttcaagt

SEQ ID NO: 494069 - DNA, 20 bp, Artificial
  CRISPR gRNA sequence
caagtgttagtgaaaagagc

SEQ ID NO: 494070 - DNA, 20 bp, Artificial
  CRISPR gRNA sequence
aagtgttagtgaaaagagcc

SEQ ID NO: 494071 - DNA, 20 bp, Artificial
  CRISPR gRNA sequence
gtgaaaagagccctggacta

SEQ ID NO: 494072 - DNA, 20 bp, Artificial
  CRISPR gRNA sequence
gactagccaggaggtcagac

SEQ ID NO: 494073 - DNA, 20 bp, Artificial
  CRISPR gRNA sequence
gccaggaggtcagacaacct

SEQ ID NO: 494074 - DNA, 20 bp, Artificial
  CRISPR gRNA sequence
agtgctagtctcgctctgtc

SEQ ID NO: 494075 - DNA, 20 bp, Artificial
  CRISPR gRNA sequence
gtctcgctctgtcattaatg

SEQ ID NO: 494076 - DNA, 20 bp, Artificial
  CRISPR gRNA sequence
gctctgtcattaatgaaagc

SEQ ID NO: 494077 - DNA, 20 bp, Artificial
  CRISPR gRNA sequence
tgtcattaatgaaagcttct

SEQ ID NO: 494078 - DNA, 20 bp, Artificial
  CRISPR gRNA sequence
tcattaatgaaagcttctat

SEQ ID NO: 494079 - DNA, 20 bp, Artificial
  CRISPR gRNA sequence
atgaaagcttctatttgttg

SEQ ID NO: 494080 - DNA, 20 bp, Artificial
  CRISPR gRNA sequence
ctatttgttgagcatttatc

SEQ ID NO: 494081 - DNA, 20 bp, Artificial
  CRISPR gRNA sequence
tatttgttgagcatttatct

SEQ ID NO: 494082 - DNA, 20 bp, Artificial
  CRISPR gRNA sequence
tttgttgagcatttatctta

SEQ ID NO: 494083 - DNA, 20 bp, Artificial
  CRISPR gRNA sequence
gttgagcatttatcttatac

SEQ ID NO: 494084 - DNA, 20 bp, Artificial
  CRISPR gRNA sequence
ttgagcatttatcttataca

SEQ ID NO: 494085 - DNA, 20 bp, Artificial
  CRISPR gRNA sequence
agcatttatcttatacatgt

SEQ ID NO: 494086 - DNA, 20 bp, Artificial
  CRISPR gRNA sequence
atcttatacatgtattctcc

SEQ ID NO: 494087 - DNA, 20 bp, Artificial
  CRISPR gRNA sequence
tcttatacatgtattctcct

SEQ ID NO: 494088 - DNA, 20 bp, Artificial
  CRISPR gRNA sequence
atacatgtattctcctctaa

SEQ ID NO: 494089 - DNA, 20 bp, Artificial
  CRISPR gRNA sequence
tacatgtattctcctctaac

SEQ ID NO: 494090 - DNA, 20 bp, Artificial
  CRISPR gRNA sequence
tcctctaactgtttttttgt

SEQ ID NO: 494091 - DNA, 20 bp, Artificial
  CRISPR gRNA sequence
ctctaactgtttttttgttt

SEQ ID NO: 494092 - DNA, 20 bp, Artificial
  CRISPR gRNA sequence
taactgtttttttgtttatt

SEQ ID NO: 494093 - DNA, 20 bp, Artificial
  CRISPR gRNA sequence
actgtttttttgtttatttg

SEQ ID NO: 494094 - DNA, 20 bp, Artificial
  CRISPR gRNA sequence
tttttttgtttatttgtttt

SEQ ID NO: 494095 - DNA, 20 bp, Artificial
  CRISPR gRNA sequence
ttttgtttatttgtttttga

SEQ ID NO: 494096 - DNA, 20 bp, Artificial
  CRISPR gRNA sequence
tttgtttatttgtttttgag

SEQ ID NO: 494097 - DNA, 20 bp, Artificial
  CRISPR gRNA sequence
ttgtttatttgtttttgaga

SEQ ID NO: 494098 - DNA, 20 bp, Artificial
  CRISPR gRNA sequence
tgtttatttgtttttgagac

SEQ ID NO: 494099 - DNA, 20 bp, Artificial
  CRISPR gRNA sequence
gtttatttgtttttgagaca

SEQ ID NO: 494100 - DNA, 20 bp, Artificial
  CRISPR gRNA sequence
tttatttgtttttgagacaa

SEQ ID NO: 494101 - DNA, 20 bp, Artificial
  CRISPR gRNA sequence
atttgtttttgagacaagag

SEQ ID NO: 494102 - DNA, 20 bp, Artificial
  CRISPR gRNA sequence
tttgtttttgagacaagagt

SEQ ID NO: 494103 - DNA, 20 bp, Artificial
  CRISPR gRNA sequence
gtttttgagacaagagtttc

SEQ ID NO: 494104 - DNA, 20 bp, Artificial
  CRISPR gRNA sequence
tttttgagacaagagtttcg

SEQ ID NO: 494105 - DNA, 20 bp, Artificial
  CRISPR gRNA sequence
ttgagacaagagtttcgctc

SEQ ID NO: 494106 - DNA, 20 bp, Artificial
  CRISPR gRNA sequence
tgagacaagagtttcgctct

SEQ ID NO: 494107 - DNA, 20 bp, Artificial
  CRISPR gRNA sequence
gagacaagagtttcgctcta

SEQ ID NO: 494108 - DNA, 20 bp, Artificial
  CRISPR gRNA sequence
agacaagagtttcgctctat

SEQ ID NO: 494109 - DNA, 20 bp, Artificial
  CRISPR gRNA sequence
cgctctattgcctgggctgg

SEQ ID NO: 494110 - DNA, 20 bp, Artificial
  CRISPR gRNA sequence
gctctattgcctgggctgga

SEQ ID NO: 494111 - DNA, 20 bp, Artificial
  CRISPR gRNA sequence
tattgcctgggctggagtgc

SEQ ID NO: 494112 - DNA, 20 bp, Artificial
  CRISPR gRNA sequence
ttgcctgggctggagtgcaa

SEQ ID NO: 494113 - DNA, 20 bp, Artificial
  CRISPR gRNA sequence
cctgggctggagtgcaatgt

SEQ ID NO: 494114 - DNA, 20 bp, Artificial
  CRISPR gRNA sequence
ggctggagtgcaatgtctcg

SEQ ID NO: 494115 - DNA, 20 bp, Artificial
  CRISPR gRNA sequence
gagtgcaatgtctcgatctt

SEQ ID NO: 494116 - DNA, 20 bp, Artificial
  CRISPR gRNA sequence
gatcttggctcaccgcaacc

SEQ ID NO: 494117 - DNA, 20 bp, Artificial
  CRISPR gRNA sequence
ggctcaccgcaacctctgcc

SEQ ID NO: 494118 - DNA, 20 bp, Artificial
  CRISPR gRNA sequence
gctcaccgcaacctctgcct

SEQ ID NO: 494119 - DNA, 20 bp, Artificial
  CRISPR gRNA sequence
accgcaacctctgcctcctg

SEQ ID NO: 494120 - DNA, 20 bp, Artificial
  CRISPR gRNA sequence
tgcctcctgggttcaggcaa

SEQ ID NO: 494121 - DNA, 20 bp, Artificial
  CRISPR gRNA sequence
cctcctgggttcaggcaatt

SEQ ID NO: 494122 - DNA, 20 bp, Artificial
  CRISPR gRNA sequence
ctgggttcaggcaattctcc

SEQ ID NO: 494123 - DNA, 20 bp, Artificial
  CRISPR gRNA sequence
ggttcaggcaattctcctgc

SEQ ID NO: 494124 - DNA, 20 bp, Artificial
  CRISPR gRNA sequence
aggcaattctcctgccccag

SEQ ID NO: 494125 - DNA, 20 bp, Artificial
  CRISPR gRNA sequence
tcctgccccagcctcctgag

SEQ ID NO: 494126 - DNA, 20 bp, Artificial
  CRISPR gRNA sequence
ctgccccagcctcctgagta

SEQ ID NO: 494127 - DNA, 20 bp, Artificial
  CRISPR gRNA sequence
ccccagcctcctgagtagct

SEQ ID NO: 494128 - DNA, 20 bp, Artificial
  CRISPR gRNA sequence
ctgagtagctgggattacag

SEQ ID NO: 494129 - DNA, 20 bp, Artificial
  CRISPR gRNA sequence
agtagctgggattacaggtg

SEQ ID NO: 494130 - DNA, 20 bp, Artificial
  CRISPR gRNA sequence
ggattacaggtgcctgccat

SEQ ID NO: 494131 - DNA, 20 bp, Artificial
  CRISPR gRNA sequence
caggtgcctgccatcatgcc

SEQ ID NO: 494132 - DNA, 20 bp, Artificial
  CRISPR gRNA sequence
ccatcatgcccagctaattt

SEQ ID NO: 494133 - DNA, 20 bp, Artificial
  CRISPR gRNA sequence
atttttgtatttttagagac

SEQ ID NO: 494134 - DNA, 20 bp, Artificial
  CRISPR gRNA sequence
ttgtatttttagagacaggg

SEQ ID NO: 494135 - DNA, 20 bp, Artificial
  CRISPR gRNA sequence
tgtatttttagagacagggt

SEQ ID NO: 494136 - DNA, 20 bp, Artificial
  CRISPR gRNA sequence
gtatttttagagacagggtt

SEQ ID NO: 494137 - DNA, 20 bp, Artificial
  CRISPR gRNA sequence
tatttttagagacagggttt

SEQ ID NO: 494138 - DNA, 20 bp, Artificial
  CRISPR gRNA sequence
ttagagacagggtttcacca

SEQ ID NO: 494139 - DNA, 20 bp, Artificial
  CRISPR gRNA sequence
tagagacagggtttcaccat

SEQ ID NO: 494140 - DNA, 20 bp, Artificial
  CRISPR gRNA sequence
agagacagggtttcaccatg

SEQ ID NO: 494141 - DNA, 20 bp, Artificial
  CRISPR gRNA sequence
gagacagggtttcaccatgt

SEQ ID NO: 494142 - DNA, 20 bp, Artificial
  CRISPR gRNA sequence
caccatgtgggccaggctgg

SEQ ID NO: 494143 - DNA, 20 bp, Artificial
  CRISPR gRNA sequence
accatgtgggccaggctggt

SEQ ID NO: 494144 - DNA, 20 bp, Artificial
  CRISPR gRNA sequence
gtctcaaacccctgacctcg

SEQ ID NO: 494145 - DNA, 20 bp, Artificial
  CRISPR gRNA sequence
aaacccctgacctcgtgatc

SEQ ID NO: 494146 - DNA, 20 bp, Artificial
  CRISPR gRNA sequence
acctcgtgatccgcccgcct

SEQ ID NO: 494147 - DNA, 20 bp, Artificial
  CRISPR gRNA sequence
gtgatccgcccgcctcggcc

SEQ ID NO: 494148 - DNA, 20 bp, Artificial
  CRISPR gRNA sequence
ggcctcccaaagtgttggga

SEQ ID NO: 494149 - DNA, 20 bp, Artificial
  CRISPR gRNA sequence
ccaaagtgttgggattacag

SEQ ID NO: 494150 - DNA, 20 bp, Artificial
  CRISPR gRNA sequence
ggattacaggcatgagccac

SEQ ID NO: 494151 - DNA, 20 bp, Artificial
  CRISPR gRNA sequence
caggcatgagccaccgcgcc

SEQ ID NO: 494152 - DNA, 20 bp, Artificial
  CRISPR gRNA sequence
gcctcttctctaactctttt

SEQ ID NO: 494153 - DNA, 20 bp, Artificial
  CRISPR gRNA sequence
ttctctaactcttttaacac

SEQ ID NO: 494154 - DNA, 20 bp, Artificial
  CRISPR gRNA sequence
ctctaactcttttaacactc

SEQ ID NO: 494155 - DNA, 20 bp, Artificial
  CRISPR gRNA sequence
tctaactcttttaacactcc

SEQ ID NO: 494156 - DNA, 20 bp, Artificial
  CRISPR gRNA sequence
taactcttttaacactccta

SEQ ID NO: 494157 - DNA, 20 bp, Artificial
  CRISPR gRNA sequence
actcttttaacactcctata

SEQ ID NO: 494158 - DNA, 20 bp, Artificial
  CRISPR gRNA sequence
ttttaacactcctataaaat

SEQ ID NO: 494159 - DNA, 20 bp, Artificial
  CRISPR gRNA sequence
ttaacactcctataaaataa

SEQ ID NO: 494160 - DNA, 20 bp, Artificial
  CRISPR gRNA sequence
taacactcctataaaataag

SEQ ID NO: 494161 - DNA, 20 bp, Artificial
  CRISPR gRNA sequence
aacactcctataaaataaga

SEQ ID NO: 494162 - DNA, 20 bp, Artificial
  CRISPR gRNA sequence
acactcctataaaataagaa

SEQ ID NO: 494163 - DNA, 20 bp, Artificial
  CRISPR gRNA sequence
ctataaaataagaatgatca

SEQ ID NO: 494164 - DNA, 20 bp, Artificial
  CRISPR gRNA sequence
taaaataagaatgatcataa

SEQ ID NO: 494165 - DNA, 20 bp, Artificial
  CRISPR gRNA sequence
gccccatgccacaaatgagg

SEQ ID NO: 494166 - DNA, 20 bp, Artificial
  CRISPR gRNA sequence
ccccatgccacaaatgaggc

SEQ ID NO: 494167 - DNA, 20 bp, Artificial
  CRISPR gRNA sequence
caaaaggataaatagcccaa

SEQ ID NO: 494168 - DNA, 20 bp, Artificial
  CRISPR gRNA sequence
aaacccaagactctccaggg

SEQ ID NO: 494169 - DNA, 20 bp, Artificial
  CRISPR gRNA sequence
tccagggctctttcctcaac

SEQ ID NO: 494170 - DNA, 20 bp, Artificial
  CRISPR gRNA sequence
cagggctctttcctcaacac

SEQ ID NO: 494171 - DNA, 20 bp, Artificial
  CRISPR gRNA sequence
tttcctcaacacctcaatgc

SEQ ID NO: 494172 - DNA, 20 bp, Artificial
  CRISPR gRNA sequence
tcctcaacacctcaatgcct

SEQ ID NO: 494173 - DNA, 20 bp, Artificial
  CRISPR gRNA sequence
cctcaacacctcaatgcctc

SEQ ID NO: 494174 - DNA, 20 bp, Artificial
  CRISPR gRNA sequence
ctcaacacctcaatgcctcc

SEQ ID NO: 494175 - DNA, 20 bp, Artificial
  CRISPR gRNA sequence
aacacctcaatgcctccctt

SEQ ID NO: 494176 - DNA, 20 bp, Artificial
  CRISPR gRNA sequence
aatgcctccctttggcaact

SEQ ID NO: 494177 - DNA, 20 bp, Artificial
  CRISPR gRNA sequence
cctttggcaacttgcctccc

SEQ ID NO: 494178 - DNA, 20 bp, Artificial
  CRISPR gRNA sequence
tggcaacttgcctcccttcc

SEQ ID NO: 494179 - DNA, 20 bp, Artificial
  CRISPR gRNA sequence
ggcaacttgcctcccttccc

SEQ ID NO: 494180 - DNA, 20 bp, Artificial
  CRISPR gRNA sequence
gcaacttgcctcccttccct

SEQ ID NO: 494181 - DNA, 20 bp, Artificial
  CRISPR gRNA sequence
gcctcccttccctggactgg

SEQ ID NO: 494182 - DNA, 20 bp, Artificial
  CRISPR gRNA sequence
cctcccttccctggactgga

SEQ ID NO: 494183 - DNA, 20 bp, Artificial
  CRISPR gRNA sequence
ccttccctggactggaacca

SEQ ID NO: 494184 - DNA, 20 bp, Artificial
  CRISPR gRNA sequence
ccctggactggaaccaggtg

SEQ ID NO: 494185 - DNA, 20 bp, Artificial
  CRISPR gRNA sequence
cctggactggaaccaggtgt

SEQ ID NO: 494186 - DNA, 20 bp, Artificial
  CRISPR gRNA sequence
gactggaaccaggtgtcctc

SEQ ID NO: 494187 - DNA, 20 bp, Artificial
  CRISPR gRNA sequence
gaaccaggtgtcctctaaat

SEQ ID NO: 494188 - DNA, 20 bp, Artificial
  CRISPR gRNA sequence
taaatcaggtaaacattctc

SEQ ID NO: 494189 - DNA, 20 bp, Artificial
  CRISPR gRNA sequence
aatcaggtaaacattctcct

SEQ ID NO: 494190 - DNA, 20 bp, Artificial
  CRISPR gRNA sequence
tccttttaagatgctccaga

SEQ ID NO: 494191 - DNA, 20 bp, Artificial
  CRISPR gRNA sequence
cttttaagatgctccagagg

SEQ ID NO: 494192 - DNA, 20 bp, Artificial
  CRISPR gRNA sequence
ttaagatgctccagaggagg

SEQ ID NO: 494193 - DNA, 20 bp, Artificial
  CRISPR gRNA sequence
taagatgctccagaggagga

SEQ ID NO: 494194 - DNA, 20 bp, Artificial
  CRISPR gRNA sequence
aagatgctccagaggaggac

SEQ ID NO: 494195 - DNA, 20 bp, Artificial
  CRISPR gRNA sequence
agatgctccagaggaggact

SEQ ID NO: 494196 - DNA, 20 bp, Artificial
  CRISPR gRNA sequence
cagaggaggactgtcattct

SEQ ID NO: 494197 - DNA, 20 bp, Artificial
  CRISPR gRNA sequence
tcattctcacccaacaccat

SEQ ID NO: 494198 - DNA, 20 bp, Artificial
  CRISPR gRNA sequence
tcacccaacaccatagtttg

SEQ ID NO: 494199 - DNA, 20 bp, Artificial
  CRISPR gRNA sequence
acccaacaccatagtttgag

SEQ ID NO: 494200 - DNA, 20 bp, Artificial
  CRISPR gRNA sequence
gaggggacctctttcttgca

SEQ ID NO: 494201 - DNA, 20 bp, Artificial
  CRISPR gRNA sequence
aggggacctctttcttgcac

SEQ ID NO: 494202 - DNA, 20 bp, Artificial
  CRISPR gRNA sequence
tttcttgcactgatagaaat

SEQ ID NO: 494203 - DNA, 20 bp, Artificial
  CRISPR gRNA sequence
tcttgcactgatagaaattc

SEQ ID NO: 494204 - DNA, 20 bp, Artificial
  CRISPR gRNA sequence
cttgcactgatagaaattcc

SEQ ID NO: 494205 - DNA, 20 bp, Artificial
  CRISPR gRNA sequence
ttgcactgatagaaattcct

SEQ ID NO: 494206 - DNA, 20 bp, Artificial
  CRISPR gRNA sequence
gcactgatagaaattcctct

SEQ ID NO: 494207 - DNA, 20 bp, Artificial
  CRISPR gRNA sequence
cactgatagaaattcctctc

SEQ ID NO: 494208 - DNA, 20 bp, Artificial
  CRISPR gRNA sequence
atagaaattcctctcattgg

SEQ ID NO: 494209 - DNA, 20 bp, Artificial
  CRISPR gRNA sequence
ctctcattggagttcaatgt

SEQ ID NO: 494210 - DNA, 20 bp, Artificial
  CRISPR gRNA sequence
tcattggagttcaatgtggc

SEQ ID NO: 494211 - DNA, 20 bp, Artificial
  CRISPR gRNA sequence
attggagttcaatgtggctg

SEQ ID NO: 494212 - DNA, 20 bp, Artificial
  CRISPR gRNA sequence
gagttcaatgtggctgaaac

SEQ ID NO: 494213 - DNA, 20 bp, Artificial
  CRISPR gRNA sequence
aatgtggctgaaactagaga

SEQ ID NO: 494214 - DNA, 20 bp, Artificial
  CRISPR gRNA sequence
aaactagagaactggcagat

SEQ ID NO: 494215 - DNA, 20 bp, Artificial
  CRISPR gRNA sequence
gagaactggcagatatcaac

SEQ ID NO: 494216 - DNA, 20 bp, Artificial
  CRISPR gRNA sequence
gcagatatcaaccgctctta

SEQ ID NO: 494217 - DNA, 20 bp, Artificial
  CRISPR gRNA sequence
ttataatcagattttctttg

SEQ ID NO: 494218 - DNA, 20 bp, Artificial
  CRISPR gRNA sequence
ataatcagattttctttgcc

SEQ ID NO: 494219 - DNA, 20 bp, Artificial
  CRISPR gRNA sequence
taatcagattttctttgccc

SEQ ID NO: 494220 - DNA, 20 bp, Artificial
  CRISPR gRNA sequence
tctttgccccacagctcagc

SEQ ID NO: 494221 - DNA, 20 bp, Artificial
  CRISPR gRNA sequence
ctttgccccacagctcagcc

SEQ ID NO: 494222 - DNA, 20 bp, Artificial
  CRISPR gRNA sequence
tttgccccacagctcagcca

SEQ ID NO: 494223 - DNA, 20 bp, Artificial
  CRISPR gRNA sequence
tgccccacagctcagccacc

SEQ ID NO: 494224 - DNA, 20 bp, Artificial
  CRISPR gRNA sequence
gccccacagctcagccacca

SEQ ID NO: 494225 - DNA, 20 bp, Artificial
  CRISPR gRNA sequence
ccccacagctcagccaccaa

SEQ ID NO: 494226 - DNA, 20 bp, Artificial
  CRISPR gRNA sequence
agccaccaaactgaagatgg

SEQ ID NO: 494227 - DNA, 20 bp, Artificial
  CRISPR gRNA sequence
aagatggtgctcaatttttt

SEQ ID NO: 494228 - DNA, 20 bp, Artificial
  CRISPR gRNA sequence
aattttttttttcttttttt

SEQ ID NO: 494229 - DNA, 20 bp, Artificial
  CRISPR gRNA sequence
tttttttcttttttttaaag

SEQ ID NO: 494230 - DNA, 20 bp, Artificial
  CRISPR gRNA sequence
ttttttcttttttttaaagc

SEQ ID NO: 494231 - DNA, 20 bp, Artificial
  CRISPR gRNA sequence
tttttcttttttttaaagcc

SEQ ID NO: 494232 - DNA, 20 bp, Artificial
  CRISPR gRNA sequence
ttttcttttttttaaagcca

SEQ ID NO: 494233 - DNA, 20 bp, Artificial
  CRISPR gRNA sequence
tttcttttttttaaagccat

SEQ ID NO: 494234 - DNA, 20 bp, Artificial
  CRISPR gRNA sequence
ttcttttttttaaagccatt

SEQ ID NO: 494235 - DNA, 20 bp, Artificial
  CRISPR gRNA sequence
tcttttttttaaagccattt

SEQ ID NO: 494236 - DNA, 20 bp, Artificial
  CRISPR gRNA sequence
cttttttttaaagccatttt

SEQ ID NO: 494237 - DNA, 20 bp, Artificial
  CRISPR gRNA sequence
ttttttttaaagccattttt

SEQ ID NO: 494238 - DNA, 20 bp, Artificial
  CRISPR gRNA sequence
ttttttaaagccatttttat

SEQ ID NO: 494239 - DNA, 20 bp, Artificial
  CRISPR gRNA sequence
tttttaaagccatttttatc

SEQ ID NO: 494240 - DNA, 20 bp, Artificial
  CRISPR gRNA sequence
ttttaaagccatttttatca

SEQ ID NO: 494241 - DNA, 20 bp, Artificial
  CRISPR gRNA sequence
tttaaagccatttttatcag

SEQ ID NO: 494242 - DNA, 20 bp, Artificial
  CRISPR gRNA sequence
ttaaagccatttttatcaga

SEQ ID NO: 494243 - DNA, 20 bp, Artificial
  CRISPR gRNA sequence
taaagccatttttatcagaa

SEQ ID NO: 494244 - DNA, 20 bp, Artificial
  CRISPR gRNA sequence
aaagccatttttatcagaaa

SEQ ID NO: 494245 - DNA, 20 bp, Artificial
  CRISPR gRNA sequence
aagccatttttatcagaaag

SEQ ID NO: 494246 - DNA, 20 bp, Artificial
  CRISPR gRNA sequence
ttatcagaaagtcttttatt

SEQ ID NO: 494247 - DNA, 20 bp, Artificial
  CRISPR gRNA sequence
tatcagaaagtcttttatta

SEQ ID NO: 494248 - DNA, 20 bp, Artificial
  CRISPR gRNA sequence
atcagaaagtcttttattac

SEQ ID NO: 494249 - DNA, 20 bp, Artificial
  CRISPR gRNA sequence
tcagaaagtcttttattact

SEQ ID NO: 494250 - DNA, 20 bp, Artificial
  CRISPR gRNA sequence
ttattactggccaccaggag

SEQ ID NO: 494251 - DNA, 20 bp, Artificial
  CRISPR gRNA sequence
tattactggccaccaggagg

SEQ ID NO: 494252 - DNA, 20 bp, Artificial
  CRISPR gRNA sequence
attactggccaccaggaggc

SEQ ID NO: 494253 - DNA, 20 bp, Artificial
  CRISPR gRNA sequence
ttactggccaccaggaggca

SEQ ID NO: 494254 - DNA, 20 bp, Artificial
  CRISPR gRNA sequence
ctggccaccaggaggcagtg

SEQ ID NO: 494255 - DNA, 20 bp, Artificial
  CRISPR gRNA sequence
gccaccaggaggcagtgttt

SEQ ID NO: 494256 - DNA, 20 bp, Artificial
  CRISPR gRNA sequence
cccttgggagagatgtccca

SEQ ID NO: 494257 - DNA, 20 bp, Artificial
  CRISPR gRNA sequence
ccttgggagagatgtcccag

SEQ ID NO: 494258 - DNA, 20 bp, Artificial
  CRISPR gRNA sequence
gggagagatgtcccagcctg

SEQ ID NO: 494259 - DNA, 20 bp, Artificial
  CRISPR gRNA sequence
ggagagatgtcccagcctgg

SEQ ID NO: 494260 - DNA, 20 bp, Artificial
  CRISPR gRNA sequence
ggttatcaatgtcattttag

SEQ ID NO: 494261 - DNA, 20 bp, Artificial
  CRISPR gRNA sequence
tcaatgtcattttagccatc

SEQ ID NO: 494262 - DNA, 20 bp, Artificial
  CRISPR gRNA sequence
tagccatcagtattaaagga

SEQ ID NO: 494263 - DNA, 20 bp, Artificial
  CRISPR gRNA sequence
agccatcagtattaaaggat

SEQ ID NO: 494264 - DNA, 20 bp, Artificial
  CRISPR gRNA sequence
gccatcagtattaaaggatg

SEQ ID NO: 494265 - DNA, 20 bp, Artificial
  CRISPR gRNA sequence
aaggatgcttctccagttta

SEQ ID NO: 494266 - DNA, 20 bp, Artificial
  CRISPR gRNA sequence
ctccagtttatgagtgaatt

SEQ ID NO: 494267 - DNA, 20 bp, Artificial
  CRISPR gRNA sequence
tccagtttatgagtgaattt

SEQ ID NO: 494268 - DNA, 20 bp, Artificial
  CRISPR gRNA sequence
cagtttatgagtgaatttct

SEQ ID NO: 494269 - DNA, 20 bp, Artificial
  CRISPR gRNA sequence
atgagtgaatttctgtaatc

SEQ ID NO: 494270 - DNA, 20 bp, Artificial
  CRISPR gRNA sequence
tgagtgaatttctgtaatcc

SEQ ID NO: 494271 - DNA, 20 bp, Artificial
  CRISPR gRNA sequence
ctgtaatcccagaatataag

SEQ ID NO: 494272 - DNA, 20 bp, Artificial
  CRISPR gRNA sequence
tgtaatcccagaatataaga

SEQ ID NO: 494273 - DNA, 20 bp, Artificial
  CRISPR gRNA sequence
taatcccagaatataagagg

SEQ ID NO: 494274 - DNA, 20 bp, Artificial
  CRISPR gRNA sequence
agaaaccctttggctcagct

SEQ ID NO: 494275 - DNA, 20 bp, Artificial
  CRISPR gRNA sequence
tggctcagctctgccactac

SEQ ID NO: 494276 - DNA, 20 bp, Artificial
  CRISPR gRNA sequence
ggctcagctctgccactacc

SEQ ID NO: 494277 - DNA, 20 bp, Artificial
  CRISPR gRNA sequence
gctcagctctgccactacct

SEQ ID NO: 494278 - DNA, 20 bp, Artificial
  CRISPR gRNA sequence
agctctgccactacctagct

SEQ ID NO: 494279 - DNA, 20 bp, Artificial
  CRISPR gRNA sequence
tgccactacctagctatgta

SEQ ID NO: 494280 - DNA, 20 bp, Artificial
  CRISPR gRNA sequence
ccactacctagctatgtagc

SEQ ID NO: 494281 - DNA, 20 bp, Artificial
  CRISPR gRNA sequence
cctagctatgtagccttgag

SEQ ID NO: 494282 - DNA, 20 bp, Artificial
  CRISPR gRNA sequence
gctatgtagccttgagatat

SEQ ID NO: 494283 - DNA, 20 bp, Artificial
  CRISPR gRNA sequence
tgtagccttgagatatcagt

SEQ ID NO: 494284 - DNA, 20 bp, Artificial
  CRISPR gRNA sequence
gagatatcagttgacctgag

SEQ ID NO: 494285 - DNA, 20 bp, Artificial
  CRISPR gRNA sequence
agatatcagttgacctgagt

SEQ ID NO: 494286 - DNA, 20 bp, Artificial
  CRISPR gRNA sequence
acctgagtctcggtttcctc

SEQ ID NO: 494287 - DNA, 20 bp, Artificial
  CRISPR gRNA sequence
agtctcggtttcctcattgt

SEQ ID NO: 494288 - DNA, 20 bp, Artificial
  CRISPR gRNA sequence
ggtttcctcattgtgatatg

SEQ ID NO: 494289 - DNA, 20 bp, Artificial
  CRISPR gRNA sequence
cctcattgtgatatggaatg

SEQ ID NO: 494290 - DNA, 20 bp, Artificial
  CRISPR gRNA sequence
ctcattgtgatatggaatgt

SEQ ID NO: 494291 - DNA, 20 bp, Artificial
  CRISPR gRNA sequence
attgtgatatggaatgtaga

SEQ ID NO: 494292 - DNA, 20 bp, Artificial
  CRISPR gRNA sequence
tgatatggaatgtagaccac

SEQ ID NO: 494293 - DNA, 20 bp, Artificial
  CRISPR gRNA sequence
aagtattagaactattttca

SEQ ID NO: 494294 - DNA, 20 bp, Artificial
  CRISPR gRNA sequence
gaactattttcatgaggctg

SEQ ID NO: 494295 - DNA, 20 bp, Artificial
  CRISPR gRNA sequence
ttttcatgaggctgttatgt

SEQ ID NO: 494296 - DNA, 20 bp, Artificial
  CRISPR gRNA sequence
tcatgaggctgttatgtgag

SEQ ID NO: 494297 - DNA, 20 bp, Artificial
  CRISPR gRNA sequence
catgaggctgttatgtgaga

SEQ ID NO: 494298 - DNA, 20 bp, Artificial
  CRISPR gRNA sequence
atgaggctgttatgtgagat

SEQ ID NO: 494299 - DNA, 20 bp, Artificial
  CRISPR gRNA sequence
ttatgtgagatttagtaaga

SEQ ID NO: 494300 - DNA, 20 bp, Artificial
  CRISPR gRNA sequence
tgtgagatttagtaagaaaa

SEQ ID NO: 494301 - DNA, 20 bp, Artificial
  CRISPR gRNA sequence
agtaagaaaatacagctggg

SEQ ID NO: 494302 - DNA, 20 bp, Artificial
  CRISPR gRNA sequence
gtaagaaaatacagctgggt

SEQ ID NO: 494303 - DNA, 20 bp, Artificial
  CRISPR gRNA sequence
ggtgcagtggtacacacctg

SEQ ID NO: 494304 - DNA, 20 bp, Artificial
  CRISPR gRNA sequence
cagacctagctacccaggag

SEQ ID NO: 494305 - DNA, 20 bp, Artificial
  CRISPR gRNA sequence
gctacccaggaggctgaggt

SEQ ID NO: 494306 - DNA, 20 bp, Artificial
  CRISPR gRNA sequence
cccaggaggctgaggtggga

SEQ ID NO: 494307 - DNA, 20 bp, Artificial
  CRISPR gRNA sequence
aggtgggaggatcacttgag

SEQ ID NO: 494308 - DNA, 20 bp, Artificial
  CRISPR gRNA sequence
gaggccgggaattcaaggct

SEQ ID NO: 494309 - DNA, 20 bp, Artificial
  CRISPR gRNA sequence
aggccgggaattcaaggctt

SEQ ID NO: 494310 - DNA, 20 bp, Artificial
  CRISPR gRNA sequence
aaggcttcagtaagctatga

SEQ ID NO: 494311 - DNA, 20 bp, Artificial
  CRISPR gRNA sequence
cagtaagctatgattctacc

SEQ ID NO: 494312 - DNA, 20 bp, Artificial
  CRISPR gRNA sequence
agtaagctatgattctacca

SEQ ID NO: 494313 - DNA, 20 bp, Artificial
  CRISPR gRNA sequence
tgattctaccattgcactca

SEQ ID NO: 494314 - DNA, 20 bp, Artificial
  CRISPR gRNA sequence
taccattgcactcagcctgg

SEQ ID NO: 494315 - DNA, 20 bp, Artificial
  CRISPR gRNA sequence
ccattgcactcagcctggta

SEQ ID NO: 494316 - DNA, 20 bp, Artificial
  CRISPR gRNA sequence
cactcagcctggtagacaga

SEQ ID NO: 494317 - DNA, 20 bp, Artificial
  CRISPR gRNA sequence
agcctggtagacagaatgag

SEQ ID NO: 494318 - DNA, 20 bp, Artificial
  CRISPR gRNA sequence
gtagacagaatgagatcctg

SEQ ID NO: 494319 - DNA, 20 bp, Artificial
  CRISPR gRNA sequence
tctcataacgggtataccaa

SEQ ID NO: 494320 - DNA, 20 bp, Artificial
  CRISPR gRNA sequence
ataacgggtataccaaaaat

SEQ ID NO: 494321 - DNA, 20 bp, Artificial
  CRISPR gRNA sequence
acaaatcaccactaaagaac

SEQ ID NO: 494322 - DNA, 20 bp, Artificial
  CRISPR gRNA sequence
aagaactgactcatgacacc

SEQ ID NO: 494323 - DNA, 20 bp, Artificial
  CRISPR gRNA sequence
actcatgacaccaaatgcca

SEQ ID NO: 494324 - DNA, 20 bp, Artificial
  CRISPR gRNA sequence
atgacaccaaatgccacctg

SEQ ID NO: 494325 - DNA, 20 bp, Artificial
  CRISPR gRNA sequence
ttcccaaaaaaacctatgga

SEQ ID NO: 494326 - DNA, 20 bp, Artificial
  CRISPR gRNA sequence
ccaaaaaaacctatggaaat

SEQ ID NO: 494327 - DNA, 20 bp, Artificial
  CRISPR gRNA sequence
tggaaataaaaaataaataa

SEQ ID NO: 494328 - DNA, 20 bp, Artificial
  CRISPR gRNA sequence
tctctaaacaataaaattgt

SEQ ID NO: 494329 - DNA, 20 bp, Artificial
  CRISPR gRNA sequence
taaacaataaaattgtttta

SEQ ID NO: 494330 - DNA, 20 bp, Artificial
  CRISPR gRNA sequence
aacaataaaattgttttaaa

SEQ ID NO: 494331 - DNA, 20 bp, Artificial
  CRISPR gRNA sequence
ttttaaaagaaaagaaaatg

SEQ ID NO: 494332 - DNA, 20 bp, Artificial
  CRISPR gRNA sequence
taaaagaaaagaaaatggac

SEQ ID NO: 494333 - DNA, 20 bp, Artificial
  CRISPR gRNA sequence
aaaagaaaagaaaatggaca

SEQ ID NO: 494334 - DNA, 20 bp, Artificial
  CRISPR gRNA sequence
aaagaaaagaaaatggacat

SEQ ID NO: 494335 - DNA, 20 bp, Artificial
  CRISPR gRNA sequence
ttgctaagtcataataaaat

SEQ ID NO: 494336 - DNA, 20 bp, Artificial
  CRISPR gRNA sequence
ctaagtcataataaaataaa

SEQ ID NO: 494337 - DNA, 20 bp, Artificial
  CRISPR gRNA sequence
agtcataataaaataaaaga

SEQ ID NO: 494338 - DNA, 20 bp, Artificial
  CRISPR gRNA sequence
attctttcctgaaaacgaat

SEQ ID NO: 494339 - DNA, 20 bp, Artificial
  CRISPR gRNA sequence
tttcctgaaaacgaatataa

SEQ ID NO: 494340 - DNA, 20 bp, Artificial
  CRISPR gRNA sequence
tcctgaaaacgaatataata

SEQ ID NO: 494341 - DNA, 20 bp, Artificial
  CRISPR gRNA sequence
cctgaaaacgaatataatag

SEQ ID NO: 494342 - DNA, 20 bp, Artificial
  CRISPR gRNA sequence
ctgaaaacgaatataatagg

SEQ ID NO: 494343 - DNA, 20 bp, Artificial
  CRISPR gRNA sequence
aaaacgaatataatagggaa

SEQ ID NO: 494344 - DNA, 20 bp, Artificial
  CRISPR gRNA sequence
gaagcagcagcagggcaaga

SEQ ID NO: 494345 - DNA, 20 bp, Artificial
  CRISPR gRNA sequence
agtcccctaaccaggtttct

SEQ ID NO: 494346 - DNA, 20 bp, Artificial
  CRISPR gRNA sequence
accaggtttctgctcctata

SEQ ID NO: 494347 - DNA, 20 bp, Artificial
  CRISPR gRNA sequence
ctgctcctatagactttatc

SEQ ID NO: 494348 - DNA, 20 bp, Artificial
  CRISPR gRNA sequence
tgctcctatagactttatct

SEQ ID NO: 494349 - DNA, 20 bp, Artificial
  CRISPR gRNA sequence
ctcctatagactttatctgg

SEQ ID NO: 494350 - DNA, 20 bp, Artificial
  CRISPR gRNA sequence
ctatagactttatctgggcc

SEQ ID NO: 494351 - DNA, 20 bp, Artificial
  CRISPR gRNA sequence
tagactttatctgggccaga

SEQ ID NO: 494352 - DNA, 20 bp, Artificial
  CRISPR gRNA sequence
tatctgggccagaccttctg

SEQ ID NO: 494353 - DNA, 20 bp, Artificial
  CRISPR gRNA sequence
atctgggccagaccttctgc

SEQ ID NO: 494354 - DNA, 20 bp, Artificial
  CRISPR gRNA sequence
tctgggccagaccttctgcc

SEQ ID NO: 494355 - DNA, 20 bp, Artificial
  CRISPR gRNA sequence
ggccagaccttctgccagac

SEQ ID NO: 494356 - DNA, 20 bp, Artificial
  CRISPR gRNA sequence
ctgccagacacggaagaaga

SEQ ID NO: 494357 - DNA, 20 bp, Artificial
  CRISPR gRNA sequence
tgccagacacggaagaagaa

SEQ ID NO: 494358 - DNA, 20 bp, Artificial
  CRISPR gRNA sequence
ccagacacggaagaagaagg

SEQ ID NO: 494359 - DNA, 20 bp, Artificial
  CRISPR gRNA sequence
cccagctgtgttaagatgct

SEQ ID NO: 494360 - DNA, 20 bp, Artificial
  CRISPR gRNA sequence
ccagctgtgttaagatgctc

SEQ ID NO: 494361 - DNA, 20 bp, Artificial
  CRISPR gRNA sequence
tgttaagatgctctagtatc

SEQ ID NO: 494362 - DNA, 20 bp, Artificial
  CRISPR gRNA sequence
agatgctctagtatcacacg

SEQ ID NO: 494363 - DNA, 20 bp, Artificial
  CRISPR gRNA sequence
tagtatcacacggatctttt

SEQ ID NO: 494364 - DNA, 20 bp, Artificial
  CRISPR gRNA sequence
gtatcacacggatcttttca

SEQ ID NO: 494365 - DNA, 20 bp, Artificial
  CRISPR gRNA sequence
ttcaaataatgtgttaatgc

SEQ ID NO: 494366 - DNA, 20 bp, Artificial
  CRISPR gRNA sequence
tcaaataatgtgttaatgca

SEQ ID NO: 494367 - DNA, 20 bp, Artificial
  CRISPR gRNA sequence
caaataatgtgttaatgcaa

SEQ ID NO: 494368 - DNA, 20 bp, Artificial
  CRISPR gRNA sequence
aaataatgtgttaatgcaac

SEQ ID NO: 494369 - DNA, 20 bp, Artificial
  CRISPR gRNA sequence
atgcaactgaagccaagcta

SEQ ID NO: 494370 - DNA, 20 bp, Artificial
  CRISPR gRNA sequence
aagccaagctatcttctgga

SEQ ID NO: 494371 - DNA, 20 bp, Artificial
  CRISPR gRNA sequence
tcttctggattctagaagca

SEQ ID NO: 494372 - DNA, 20 bp, Artificial
  CRISPR gRNA sequence
ctggattctagaagcaccaa

SEQ ID NO: 494373 - DNA, 20 bp, Artificial
  CRISPR gRNA sequence
tggattctagaagcaccaag

SEQ ID NO: 494374 - DNA, 20 bp, Artificial
  CRISPR gRNA sequence
gattctagaagcaccaagat

SEQ ID NO: 494375 - DNA, 20 bp, Artificial
  CRISPR gRNA sequence
tagaagcaccaagatcttat

SEQ ID NO: 494376 - DNA, 20 bp, Artificial
  CRISPR gRNA sequence
gaagcaccaagatcttattc

SEQ ID NO: 494377 - DNA, 20 bp, Artificial
  CRISPR gRNA sequence
attctgccattcaatggtgt

SEQ ID NO: 494378 - DNA, 20 bp, Artificial
  CRISPR gRNA sequence
ttctgccattcaatggtgtg

SEQ ID NO: 494379 - DNA, 20 bp, Artificial
  CRISPR gRNA sequence
tgccattcaatggtgtgagt

SEQ ID NO: 494380 - DNA, 20 bp, Artificial
  CRISPR gRNA sequence
ccattcaatggtgtgagttt

SEQ ID NO: 494381 - DNA, 20 bp, Artificial
  CRISPR gRNA sequence
aatggtgtgagtttcagggg

SEQ ID NO: 494382 - DNA, 20 bp, Artificial
  CRISPR gRNA sequence
caggggggcattaggaaacc

SEQ ID NO: 494383 - DNA, 20 bp, Artificial
  CRISPR gRNA sequence
aggggggcattaggaaaccc

SEQ ID NO: 494384 - DNA, 20 bp, Artificial
  CRISPR gRNA sequence
ggaaaccccagagataggta

SEQ ID NO: 494385 - DNA, 20 bp, Artificial
  CRISPR gRNA sequence
gagaaactggagaggtacct

SEQ ID NO: 494386 - DNA, 20 bp, Artificial
  CRISPR gRNA sequence
gagaggtacctgggactgga

SEQ ID NO: 494387 - DNA, 20 bp, Artificial
  CRISPR gRNA sequence
ggactggatcatagagtaga

SEQ ID NO: 494388 - DNA, 20 bp, Artificial
  CRISPR gRNA sequence
gatcatagagtagatggtgc

SEQ ID NO: 494389 - DNA, 20 bp, Artificial
  CRISPR gRNA sequence
ccccctccaggaaaagtctg

SEQ ID NO: 494390 - DNA, 20 bp, Artificial
  CRISPR gRNA sequence
caggaaaagtctgctcctgc

SEQ ID NO: 494391 - DNA, 20 bp, Artificial
  CRISPR gRNA sequence
ctcctgctcctgcacaagaa

SEQ ID NO: 494392 - DNA, 20 bp, Artificial
  CRISPR gRNA sequence
ctgctcctgcacaagaaatg

SEQ ID NO: 494393 - DNA, 20 bp, Artificial
  CRISPR gRNA sequence
ctcctgcacaagaaatggag

SEQ ID NO: 494394 - DNA, 20 bp, Artificial
  CRISPR gRNA sequence
ctgcacaagaaatggagatg

SEQ ID NO: 494395 - DNA, 20 bp, Artificial
  CRISPR gRNA sequence
cacaagaaatggagatgggg

SEQ ID NO: 494396 - DNA, 20 bp, Artificial
  CRISPR gRNA sequence
ggtctgtccagatttagatt

SEQ ID NO: 494397 - DNA, 20 bp, Artificial
  CRISPR gRNA sequence
tccagatttagattgagtgg

SEQ ID NO: 494398 - DNA, 20 bp, Artificial
  CRISPR gRNA sequence
agattgagtggggaaaaaca

SEQ ID NO: 494399 - DNA, 20 bp, Artificial
  CRISPR gRNA sequence
gattgagtggggaaaaacag

SEQ ID NO: 494400 - DNA, 20 bp, Artificial
  CRISPR gRNA sequence
agtggggaaaaacagcacaa

SEQ ID NO: 494401 - DNA, 20 bp, Artificial
  CRISPR gRNA sequence
ttcaggagactgggagggag

SEQ ID NO: 494402 - DNA, 20 bp, Artificial
  CRISPR gRNA sequence
tcaggagactgggagggagg

SEQ ID NO: 494403 - DNA, 20 bp, Artificial
  CRISPR gRNA sequence
caggagactgggagggaggt

SEQ ID NO: 494404 - DNA, 20 bp, Artificial
  CRISPR gRNA sequence
aggagactgggagggaggtg

SEQ ID NO: 494405 - DNA, 20 bp, Artificial
  CRISPR gRNA sequence
ggagggaggtggcaggactg

SEQ ID NO: 494406 - DNA, 20 bp, Artificial
  CRISPR gRNA sequence
gggagagtcattgatcctcc

SEQ ID NO: 494407 - DNA, 20 bp, Artificial
  CRISPR gRNA sequence
atcctcccaagatgggaaga

SEQ ID NO: 494408 - DNA, 20 bp, Artificial
  CRISPR gRNA sequence
ccaagatgggaagagacagg

SEQ ID NO: 494409 - DNA, 20 bp, Artificial
  CRISPR gRNA sequence
ggagtggaaccattagtatc

SEQ ID NO: 494410 - DNA, 20 bp, Artificial
  CRISPR gRNA sequence
gagtggaaccattagtatca

SEQ ID NO: 494411 - DNA, 20 bp, Artificial
  CRISPR gRNA sequence
gtatcaggagcaaggaacca

SEQ ID NO: 494412 - DNA, 20 bp, Artificial
  CRISPR gRNA sequence
ggtgtgaggggttccagcaa

SEQ ID NO: 494413 - DNA, 20 bp, Artificial
  CRISPR gRNA sequence
cagcaaccctgctcaaagag

SEQ ID NO: 494414 - DNA, 20 bp, Artificial
  CRISPR gRNA sequence
ctcaaagagaatgctgtcac

SEQ ID NO: 494415 - DNA, 20 bp, Artificial
  CRISPR gRNA sequence
aaagagaatgctgtcacttt

SEQ ID NO: 494416 - DNA, 20 bp, Artificial
  CRISPR gRNA sequence
tcactttctttcctttagta

SEQ ID NO: 494417 - DNA, 20 bp, Artificial
  CRISPR gRNA sequence
tctttcctttagtaacttag

SEQ ID NO: 494418 - DNA, 20 bp, Artificial
  CRISPR gRNA sequence
ctttcctttagtaacttaga

SEQ ID NO: 494419 - DNA, 20 bp, Artificial
  CRISPR gRNA sequence
tttcctttagtaacttagaa

SEQ ID NO: 494420 - DNA, 20 bp, Artificial
  CRISPR gRNA sequence
tcctttagtaacttagaaac

SEQ ID NO: 494421 - DNA, 20 bp, Artificial
  CRISPR gRNA sequence
cctttagtaacttagaaacc

SEQ ID NO: 494422 - DNA, 20 bp, Artificial
  CRISPR gRNA sequence
ctttagtaacttagaaaccc

SEQ ID NO: 494423 - DNA, 20 bp, Artificial
  CRISPR gRNA sequence
tagtaacttagaaacccttc

SEQ ID NO: 494424 - DNA, 20 bp, Artificial
  CRISPR gRNA sequence
agtaacttagaaacccttcc

SEQ ID NO: 494425 - DNA, 20 bp, Artificial
  CRISPR gRNA sequence
gtaacttagaaacccttcct

SEQ ID NO: 494426 - DNA, 20 bp, Artificial
  CRISPR gRNA sequence
agaaacccttccttgcagag

SEQ ID NO: 494427 - DNA, 20 bp, Artificial
  CRISPR gRNA sequence
gaaacccttccttgcagagc

SEQ ID NO: 494428 - DNA, 20 bp, Artificial
  CRISPR gRNA sequence
ccttgcagagctctgagtag

SEQ ID NO: 494429 - DNA, 20 bp, Artificial
  CRISPR gRNA sequence
cttgcagagctctgagtagg

SEQ ID NO: 494430 - DNA, 20 bp, Artificial
  CRISPR gRNA sequence
gcagagctctgagtagggct

SEQ ID NO: 494431 - DNA, 20 bp, Artificial
  CRISPR gRNA sequence
cagagctctgagtagggctg

SEQ ID NO: 494432 - DNA, 20 bp, Artificial
  CRISPR gRNA sequence
tgagtagggctgttatctga

SEQ ID NO: 494433 - DNA, 20 bp, Artificial
  CRISPR gRNA sequence
agtagggctgttatctgagc

SEQ ID NO: 494434 - DNA, 20 bp, Artificial
  CRISPR gRNA sequence
ttatctgagccttacctcag

SEQ ID NO: 494435 - DNA, 20 bp, Artificial
  CRISPR gRNA sequence
tctgagccttacctcagagc

SEQ ID NO: 494436 - DNA, 20 bp, Artificial
  CRISPR gRNA sequence
agccttacctcagagcactg

SEQ ID NO: 494437 - DNA, 20 bp, Artificial
  CRISPR gRNA sequence
acctcagagcactgaaattc

SEQ ID NO: 494438 - DNA, 20 bp, Artificial
  CRISPR gRNA sequence
cctcagagcactgaaattca

SEQ ID NO: 494439 - DNA, 20 bp, Artificial
  CRISPR gRNA sequence
agagcactgaaattcagaaa

SEQ ID NO: 494440 - DNA, 20 bp, Artificial
  CRISPR gRNA sequence
aaattcagaaagtttaaaca

SEQ ID NO: 494441 - DNA, 20 bp, Artificial
  CRISPR gRNA sequence
agaaagtttaaacatttcaa

SEQ ID NO: 494442 - DNA, 20 bp, Artificial
  CRISPR gRNA sequence
aaacatttcaaagaccaaac

SEQ ID NO: 494443 - DNA, 20 bp, Artificial
  CRISPR gRNA sequence
aacatttcaaagaccaaaca

SEQ ID NO: 494444 - DNA, 20 bp, Artificial
  CRISPR gRNA sequence
caaagaccaaacacagttaa

SEQ ID NO: 494445 - DNA, 20 bp, Artificial
  CRISPR gRNA sequence
aaagaccaaacacagttaag

SEQ ID NO: 494446 - DNA, 20 bp, Artificial
  CRISPR gRNA sequence
agccctctctagatcatctt

SEQ ID NO: 494447 - DNA, 20 bp, Artificial
  CRISPR gRNA sequence
tctagatcatctttgaggcc

SEQ ID NO: 494448 - DNA, 20 bp, Artificial
  CRISPR gRNA sequence
tagatcatctttgaggccac

SEQ ID NO: 494449 - DNA, 20 bp, Artificial
  CRISPR gRNA sequence
gatcatctttgaggccacct

SEQ ID NO: 494450 - DNA, 20 bp, Artificial
  CRISPR gRNA sequence
tgaggccaccttgcccttga

SEQ ID NO: 494451 - DNA, 20 bp, Artificial
  CRISPR gRNA sequence
gaggccaccttgcccttgac

SEQ ID NO: 494452 - DNA, 20 bp, Artificial
  CRISPR gRNA sequence
aggccaccttgcccttgacc

SEQ ID NO: 494453 - DNA, 20 bp, Artificial
  CRISPR gRNA sequence
gcccttgacctcaagtcagc

SEQ ID NO: 494454 - DNA, 20 bp, Artificial
  CRISPR gRNA sequence
cccttgacctcaagtcagcg

SEQ ID NO: 494455 - DNA, 20 bp, Artificial
  CRISPR gRNA sequence
gacctcaagtcagcgccctg

SEQ ID NO: 494456 - DNA, 20 bp, Artificial
  CRISPR gRNA sequence
acctcaagtcagcgccctgg

SEQ ID NO: 494457 - DNA, 20 bp, Artificial
  CRISPR gRNA sequence
aagtcagcgccctgggcagc

SEQ ID NO: 494458 - DNA, 20 bp, Artificial
  CRISPR gRNA sequence
ggcagctatagtgctgggtg

SEQ ID NO: 494459 - DNA, 20 bp, Artificial
  CRISPR gRNA sequence
tagtgctgggtgcagccctg

SEQ ID NO: 494460 - DNA, 20 bp, Artificial
  CRISPR gRNA sequence
ggtgcagccctgaacccaag

SEQ ID NO: 494461 - DNA, 20 bp, Artificial
  CRISPR gRNA sequence
aacccaagggccaaagcagg

SEQ ID NO: 494462 - DNA, 20 bp, Artificial
  CRISPR gRNA sequence
cctgcttcccttttcttgtt

SEQ ID NO: 494463 - DNA, 20 bp, Artificial
  CRISPR gRNA sequence
ctgcttcccttttcttgttc

SEQ ID NO: 494464 - DNA, 20 bp, Artificial
  CRISPR gRNA sequence
cttcccttttcttgttccta

SEQ ID NO: 494465 - DNA, 20 bp, Artificial
  CRISPR gRNA sequence
cccttttcttgttcctaccc

SEQ ID NO: 494466 - DNA, 20 bp, Artificial
  CRISPR gRNA sequence
ccttttcttgttcctacccc

SEQ ID NO: 494467 - DNA, 20 bp, Artificial
  CRISPR gRNA sequence
ttcttgttcctaccccttag

SEQ ID NO: 494468 - DNA, 20 bp, Artificial
  CRISPR gRNA sequence
tcttgttcctaccccttagg

SEQ ID NO: 494469 - DNA, 20 bp, Artificial
  CRISPR gRNA sequence
cttgttcctaccccttagga

SEQ ID NO: 494470 - DNA, 20 bp, Artificial
  CRISPR gRNA sequence
ttgttcctaccccttaggaa

SEQ ID NO: 494471 - DNA, 20 bp, Artificial
  CRISPR gRNA sequence
gttcctaccccttaggaaat

SEQ ID NO: 494472 - DNA, 20 bp, Artificial
  CRISPR gRNA sequence
ttcctaccccttaggaaatc

SEQ ID NO: 494473 - DNA, 20 bp, Artificial
  CRISPR gRNA sequence
ctaccccttaggaaatcggt

SEQ ID NO: 494474 - DNA, 20 bp, Artificial
  CRISPR gRNA sequence
ccccttaggaaatcggtggt

SEQ ID NO: 494475 - DNA, 20 bp, Artificial
  CRISPR gRNA sequence
aggaaatcggtggtggaggt

SEQ ID NO: 494476 - DNA, 20 bp, Artificial
  CRISPR gRNA sequence
ggaaatcggtggtggaggta

SEQ ID NO: 494477 - DNA, 20 bp, Artificial
  CRISPR gRNA sequence
catgctgccggccactgaaa

SEQ ID NO: 494478 - DNA, 20 bp, Artificial
  CRISPR gRNA sequence
atgctgccggccactgaaag

SEQ ID NO: 494479 - DNA, 20 bp, Artificial
  CRISPR gRNA sequence
ccggccactgaaagcatatt

SEQ ID NO: 494480 - DNA, 20 bp, Artificial
  CRISPR gRNA sequence
aaagcatattgccagtttgg

SEQ ID NO: 494481 - DNA, 20 bp, Artificial
  CRISPR gRNA sequence
ccagtttgggttctactggg

SEQ ID NO: 494482 - DNA, 20 bp, Artificial
  CRISPR gRNA sequence
gggttctactgggagccagt

SEQ ID NO: 494483 - DNA, 20 bp, Artificial
  CRISPR gRNA sequence
ggttctactgggagccagtg

SEQ ID NO: 494484 - DNA, 20 bp, Artificial
  CRISPR gRNA sequence
tactgggagccagtggaggc

SEQ ID NO: 494485 - DNA, 20 bp, Artificial
  CRISPR gRNA sequence
ctgggagccagtggaggcag

SEQ ID NO: 494486 - DNA, 20 bp, Artificial
  CRISPR gRNA sequence
ggagccagtggaggcagcag

SEQ ID NO: 494487 - DNA, 20 bp, Artificial
  CRISPR gRNA sequence
attaggcaaggtgcaagcaa

SEQ ID NO: 494488 - DNA, 20 bp, Artificial
  CRISPR gRNA sequence
ggcaaggtgcaagcaaaatt

SEQ ID NO: 494489 - DNA, 20 bp, Artificial
  CRISPR gRNA sequence
ctggaagcaagaagaagcta

SEQ ID NO: 494490 - DNA, 20 bp, Artificial
  CRISPR gRNA sequence
gaagcaagaagaagctaaga

SEQ ID NO: 494491 - DNA, 20 bp, Artificial
  CRISPR gRNA sequence
agagaagcagagaactgtca

SEQ ID NO: 494492 - DNA, 20 bp, Artificial
  CRISPR gRNA sequence
tcagctgtccttagaggctg

SEQ ID NO: 494493 - DNA, 20 bp, Artificial
  CRISPR gRNA sequence
tccttagaggctggggagtc

SEQ ID NO: 494494 - DNA, 20 bp, Artificial
  CRISPR gRNA sequence
agaggctggggagtcatggg

SEQ ID NO: 494495 - DNA, 20 bp, Artificial
  CRISPR gRNA sequence
gaggctggggagtcatgggc

SEQ ID NO: 494496 - DNA, 20 bp, Artificial
  CRISPR gRNA sequence
gggagtcatgggcatctgac

SEQ ID NO: 494497 - DNA, 20 bp, Artificial
  CRISPR gRNA sequence
acaatgtcaataacttcatt

SEQ ID NO: 494498 - DNA, 20 bp, Artificial
  CRISPR gRNA sequence
catttgtgttttaaaatact

SEQ ID NO: 494499 - DNA, 20 bp, Artificial
  CRISPR gRNA sequence
atttgtgttttaaaatactg

SEQ ID NO: 494500 - DNA, 20 bp, Artificial
  CRISPR gRNA sequence
gtgttttaaaatactgcagg

SEQ ID NO: 494501 - DNA, 20 bp, Artificial
  CRISPR gRNA sequence
tgttttaaaatactgcagga

SEQ ID NO: 494502 - DNA, 20 bp, Artificial
  CRISPR gRNA sequence
taaaatactgcaggagtttg

SEQ ID NO: 494503 - DNA, 20 bp, Artificial
  CRISPR gRNA sequence
aaaatactgcaggagtttgt

SEQ ID NO: 494504 - DNA, 20 bp, Artificial
  CRISPR gRNA sequence
aaatactgcaggagtttgtt

SEQ ID NO: 494505 - DNA, 20 bp, Artificial
  CRISPR gRNA sequence
caggagtttgttgcttttct

SEQ ID NO: 494506 - DNA, 20 bp, Artificial
  CRISPR gRNA sequence
gttgcttttctctcccgtcc

SEQ ID NO: 494507 - DNA, 20 bp, Artificial
  CRISPR gRNA sequence
ttgcttttctctcccgtcca

SEQ ID NO: 494508 - DNA, 20 bp, Artificial
  CRISPR gRNA sequence
cttttctctcccgtccagac

SEQ ID NO: 494509 - DNA, 20 bp, Artificial
  CRISPR gRNA sequence
ttctctcccgtccagacccg

SEQ ID NO: 494510 - DNA, 20 bp, Artificial
  CRISPR gRNA sequence
tctctcccgtccagacccgt

SEQ ID NO: 494511 - DNA, 20 bp, Artificial
  CRISPR gRNA sequence
ctctcccgtccagacccgtg

SEQ ID NO: 494512 - DNA, 20 bp, Artificial
  CRISPR gRNA sequence
tctcccgtccagacccgtgt

SEQ ID NO: 494513 - DNA, 20 bp, Artificial
  CRISPR gRNA sequence
tcccgtccagacccgtgtga

SEQ ID NO: 494514 - DNA, 20 bp, Artificial
  CRISPR gRNA sequence
ccgtccagacccgtgtgaag

SEQ ID NO: 494515 - DNA, 20 bp, Artificial
  CRISPR gRNA sequence
ctagaaagattagagctggg

SEQ ID NO: 494516 - DNA, 20 bp, Artificial
  CRISPR gRNA sequence
tagaaagattagagctgggt

SEQ ID NO: 494517 - DNA, 20 bp, Artificial
  CRISPR gRNA sequence
gaaagattagagctgggtct

SEQ ID NO: 494518 - DNA, 20 bp, Artificial
  CRISPR gRNA sequence
gagctgggtctcaaagtgag

SEQ ID NO: 494519 - DNA, 20 bp, Artificial
  CRISPR gRNA sequence
ggtctcaaagtgagaccaca

SEQ ID NO: 494520 - DNA, 20 bp, Artificial
  CRISPR gRNA sequence
aaagtgagaccacatgaaac

SEQ ID NO: 494521 - DNA, 20 bp, Artificial
  CRISPR gRNA sequence
gagatttaggccttcaaatt

SEQ ID NO: 494522 - DNA, 20 bp, Artificial
  CRISPR gRNA sequence
agatttaggccttcaaattg

SEQ ID NO: 494523 - DNA, 20 bp, Artificial
  CRISPR gRNA sequence
aggccttcaaattggagccc

SEQ ID NO: 494524 - DNA, 20 bp, Artificial
  CRISPR gRNA sequence
ggccttcaaattggagccct

SEQ ID NO: 494525 - DNA, 20 bp, Artificial
  CRISPR gRNA sequence
caaattggagccctgagaca

SEQ ID NO: 494526 - DNA, 20 bp, Artificial
  CRISPR gRNA sequence
aaattggagccctgagacaa

SEQ ID NO: 494527 - DNA, 20 bp, Artificial
  CRISPR gRNA sequence
gagccctgagacaataggga

SEQ ID NO: 494528 - DNA, 20 bp, Artificial
  CRISPR gRNA sequence
agacaatagggagaggccag

SEQ ID NO: 494529 - DNA, 20 bp, Artificial
  CRISPR gRNA sequence
aggccaggcagggaggagct

SEQ ID NO: 494530 - DNA, 20 bp, Artificial
  CRISPR gRNA sequence
ttgagtcggaagaagtaagc

SEQ ID NO: 494531 - DNA, 20 bp, Artificial
  CRISPR gRNA sequence
gagtcggaagaagtaagcta

SEQ ID NO: 494532 - DNA, 20 bp, Artificial
  CRISPR gRNA sequence
agtcggaagaagtaagctaa

SEQ ID NO: 494533 - DNA, 20 bp, Artificial
  CRISPR gRNA sequence
ataggcctgaatcccaaaga

SEQ ID NO: 494534 - DNA, 20 bp, Artificial
  CRISPR gRNA sequence
aatcccaaagaggtttcctt

SEQ ID NO: 494535 - DNA, 20 bp, Artificial
  CRISPR gRNA sequence
cctttgctctaagttgtttt

SEQ ID NO: 494536 - DNA, 20 bp, Artificial
  CRISPR gRNA sequence
ctttgctctaagttgttttt

SEQ ID NO: 494537 - DNA, 20 bp, Artificial
  CRISPR gRNA sequence
tgctctaagttgtttttcct

SEQ ID NO: 494538 - DNA, 20 bp, Artificial
  CRISPR gRNA sequence
gctctaagttgtttttcctc

SEQ ID NO: 494539 - DNA, 20 bp, Artificial
  CRISPR gRNA sequence
ctctaagttgtttttcctcc

SEQ ID NO: 494540 - DNA, 20 bp, Artificial
  CRISPR gRNA sequence
taagttgtttttcctcctgt

SEQ ID NO: 494541 - DNA, 20 bp, Artificial
  CRISPR gRNA sequence
agttgtttttcctcctgtgg

SEQ ID NO: 494542 - DNA, 20 bp, Artificial
  CRISPR gRNA sequence
tttttcctcctgtggtctcc

SEQ ID NO: 494543 - DNA, 20 bp, Artificial
  CRISPR gRNA sequence
ttcctcctgtggtctcctaa

SEQ ID NO: 494544 - DNA, 20 bp, Artificial
  CRISPR gRNA sequence
tcctcctgtggtctcctaat

SEQ ID NO: 494545 - DNA, 20 bp, Artificial
  CRISPR gRNA sequence
cctcctgtggtctcctaatc

SEQ ID NO: 494546 - DNA, 20 bp, Artificial
  CRISPR gRNA sequence
ctcctgtggtctcctaatct

SEQ ID NO: 494547 - DNA, 20 bp, Artificial
  CRISPR gRNA sequence
ctgtggtctcctaatctcaa

SEQ ID NO: 494548 - DNA, 20 bp, Artificial
  CRISPR gRNA sequence
tggtctcctaatctcaagtc

SEQ ID NO: 494549 - DNA, 20 bp, Artificial
  CRISPR gRNA sequence
ctaatctcaagtcatcttct

SEQ ID NO: 494550 - DNA, 20 bp, Artificial
  CRISPR gRNA sequence
atctcaagtcatcttctttt

SEQ ID NO: 494551 - DNA, 20 bp, Artificial
  CRISPR gRNA sequence
aagtcatcttctttttggaa

SEQ ID NO: 494552 - DNA, 20 bp, Artificial
  CRISPR gRNA sequence
ctttttggaaaaatagatta

SEQ ID NO: 494553 - DNA, 20 bp, Artificial
  CRISPR gRNA sequence
tttttggaaaaatagattat

SEQ ID NO: 494554 - DNA, 20 bp, Artificial
  CRISPR gRNA sequence
tttggaaaaatagattattt

SEQ ID NO: 494555 - DNA, 20 bp, Artificial
  CRISPR gRNA sequence
ttggaaaaatagattatttt

SEQ ID NO: 494556 - DNA, 20 bp, Artificial
  CRISPR gRNA sequence
tggaaaaatagattattttt

SEQ ID NO: 494557 - DNA, 20 bp, Artificial
  CRISPR gRNA sequence
ggaaaaatagattattttta

SEQ ID NO: 494558 - DNA, 20 bp, Artificial
  CRISPR gRNA sequence
gaaaaatagattatttttag

SEQ ID NO: 494559 - DNA, 20 bp, Artificial
  CRISPR gRNA sequence
tttttagcaagcacccgggc

SEQ ID NO: 494560 - DNA, 20 bp, Artificial
  CRISPR gRNA sequence
ttagcaagcacccgggcatc

SEQ ID NO: 494561 - DNA, 20 bp, Artificial
  CRISPR gRNA sequence
tagcaagcacccgggcatca

SEQ ID NO: 494562 - DNA, 20 bp, Artificial
  CRISPR gRNA sequence
agcaagcacccgggcatcac

SEQ ID NO: 494563 - DNA, 20 bp, Artificial
  CRISPR gRNA sequence
gcaagcacccgggcatcact

SEQ ID NO: 494564 - DNA, 20 bp, Artificial
  CRISPR gRNA sequence
gctgtgggtagattcacatg

SEQ ID NO: 494565 - DNA, 20 bp, Artificial
  CRISPR gRNA sequence
tgggtagattcacatgcttt

SEQ ID NO: 494566 - DNA, 20 bp, Artificial
  CRISPR gRNA sequence
acatgctttcaggaatttgt

SEQ ID NO: 494567 - DNA, 20 bp, Artificial
  CRISPR gRNA sequence
tcaggaatttgtaccagagt

SEQ ID NO: 494568 - DNA, 20 bp, Artificial
  CRISPR gRNA sequence
caggaatttgtaccagagtc

SEQ ID NO: 494569 - DNA, 20 bp, Artificial
  CRISPR gRNA sequence
aggaatttgtaccagagtct

SEQ ID NO: 494570 - DNA, 20 bp, Artificial
  CRISPR gRNA sequence
gtaccagagtctggtagcag

SEQ ID NO: 494571 - DNA, 20 bp, Artificial
  CRISPR gRNA sequence
taccagagtctggtagcagt

SEQ ID NO: 494572 - DNA, 20 bp, Artificial
  CRISPR gRNA sequence
gtagcagtgagagaaacaaa

SEQ ID NO: 494573 - DNA, 20 bp, Artificial
  CRISPR gRNA sequence
ttattattcacattccaata

SEQ ID NO: 494574 - DNA, 20 bp, Artificial
  CRISPR gRNA sequence
tattattcacattccaatag

SEQ ID NO: 494575 - DNA, 20 bp, Artificial
  CRISPR gRNA sequence
attattcacattccaatagc

SEQ ID NO: 494576 - DNA, 20 bp, Artificial
  CRISPR gRNA sequence
ttattcacattccaatagcc

SEQ ID NO: 494577 - DNA, 20 bp, Artificial
  CRISPR gRNA sequence
ttcacattccaatagccact

SEQ ID NO: 494578 - DNA, 20 bp, Artificial
  CRISPR gRNA sequence
acattccaatagccactgct

SEQ ID NO: 494579 - DNA, 20 bp, Artificial
  CRISPR gRNA sequence
caatagccactgctttattt

SEQ ID NO: 494580 - DNA, 20 bp, Artificial
  CRISPR gRNA sequence
ctttatttttcacattccca

SEQ ID NO: 494581 - DNA, 20 bp, Artificial
  CRISPR gRNA sequence
tatttttcacattcccatag

SEQ ID NO: 494582 - DNA, 20 bp, Artificial
  CRISPR gRNA sequence
atttttcacattcccatagc

SEQ ID NO: 494583 - DNA, 20 bp, Artificial
  CRISPR gRNA sequence
tttttcacattcccatagcc

SEQ ID NO: 494584 - DNA, 20 bp, Artificial
  CRISPR gRNA sequence
ttcacattcccatagccact

SEQ ID NO: 494585 - DNA, 20 bp, Artificial
  CRISPR gRNA sequence
tcacattcccatagccactg

SEQ ID NO: 494586 - DNA, 20 bp, Artificial
  CRISPR gRNA sequence
cacattcccatagccactgc

SEQ ID NO: 494587 - DNA, 20 bp, Artificial
  CRISPR gRNA sequence
acattcccatagccactgct

SEQ ID NO: 494588 - DNA, 20 bp, Artificial
  CRISPR gRNA sequence
ccatagccactgctggggca

SEQ ID NO: 494589 - DNA, 20 bp, Artificial
  CRISPR gRNA sequence
ctggggcaaaaataaataaa

SEQ ID NO: 494590 - DNA, 20 bp, Artificial
  CRISPR gRNA sequence
gggcaaaaataaataaataa

SEQ ID NO: 494591 - DNA, 20 bp, Artificial
  CRISPR gRNA sequence
ctctaacagcctctgaaccc

SEQ ID NO: 494592 - DNA, 20 bp, Artificial
  CRISPR gRNA sequence
taacagcctctgaacccaga

SEQ ID NO: 494593 - DNA, 20 bp, Artificial
  CRISPR gRNA sequence
acagcctctgaacccagagg

SEQ ID NO: 494594 - DNA, 20 bp, Artificial
  CRISPR gRNA sequence
tgaacccagaggcatctggg

SEQ ID NO: 494595 - DNA, 20 bp, Artificial
  CRISPR gRNA sequence
aacccagaggcatctgggag

SEQ ID NO: 494596 - DNA, 20 bp, Artificial
  CRISPR gRNA sequence
ggagaggatgcttgcctgct

SEQ ID NO: 494597 - DNA, 20 bp, Artificial
  CRISPR gRNA sequence
gcctgctctgcgaggctgca

SEQ ID NO: 494598 - DNA, 20 bp, Artificial
  CRISPR gRNA sequence
cctgctctgcgaggctgcac

SEQ ID NO: 494599 - DNA, 20 bp, Artificial
  CRISPR gRNA sequence
ctctgcgaggctgcacaggg

SEQ ID NO: 494600 - DNA, 20 bp, Artificial
  CRISPR gRNA sequence
tgcgaggctgcacagggcct

SEQ ID NO: 494601 - DNA, 20 bp, Artificial
  CRISPR gRNA sequence
cgaggctgcacagggcctca

SEQ ID NO: 494602 - DNA, 20 bp, Artificial
  CRISPR gRNA sequence
cacagggcctcacgtatgtg

SEQ ID NO: 494603 - DNA, 20 bp, Artificial
  CRISPR gRNA sequence
acgtatgtggccagcacgga

SEQ ID NO: 494604 - DNA, 20 bp, Artificial
  CRISPR gRNA sequence
cctgcgtgctgctgggtctc

SEQ ID NO: 494605 - DNA, 20 bp, Artificial
  CRISPR gRNA sequence
ctgcgtgctgctgggtctcc

SEQ ID NO: 494606 - DNA, 20 bp, Artificial
  CRISPR gRNA sequence
cgtgctgctgggtctccaca

SEQ ID NO: 494607 - DNA, 20 bp, Artificial
  CRISPR gRNA sequence
ctgggtctccacagcaaagc

SEQ ID NO: 494608 - DNA, 20 bp, Artificial
  CRISPR gRNA sequence
ggtctccacagcaaagcgcc

SEQ ID NO: 494609 - DNA, 20 bp, Artificial
  CRISPR gRNA sequence
cacagcaaagcgccaggggg

SEQ ID NO: 494610 - DNA, 20 bp, Artificial
  CRISPR gRNA sequence
ccgccccacttcacccaccc

SEQ ID NO: 494611 - DNA, 20 bp, Artificial
  CRISPR gRNA sequence
cgccccacttcacccaccct

SEQ ID NO: 494612 - DNA, 20 bp, Artificial
  CRISPR gRNA sequence
cacccaccctgccccacttc

SEQ ID NO: 494613 - DNA, 20 bp, Artificial
  CRISPR gRNA sequence
acccaccctgccccacttcc

SEQ ID NO: 494614 - DNA, 20 bp, Artificial
  CRISPR gRNA sequence
ccccacttcctgccagcagt

SEQ ID NO: 494615 - DNA, 20 bp, Artificial
  CRISPR gRNA sequence
cctgccagcagtttggtagg

SEQ ID NO: 494616 - DNA, 20 bp, Artificial
  CRISPR gRNA sequence
ctgccagcagtttggtaggc

SEQ ID NO: 494617 - DNA, 20 bp, Artificial
  CRISPR gRNA sequence
ccagcagtttggtaggctcc

SEQ ID NO: 494618 - DNA, 20 bp, Artificial
  CRISPR gRNA sequence
ggtaggctccatcagagctt

SEQ ID NO: 494619 - DNA, 20 bp, Artificial
  CRISPR gRNA sequence
gtaggctccatcagagcttt

SEQ ID NO: 494620 - DNA, 20 bp, Artificial
  CRISPR gRNA sequence
catcagagcttttcccctgg

SEQ ID NO: 494621 - DNA, 20 bp, Artificial
  CRISPR gRNA sequence
ttcccctgggcctgtcacca

SEQ ID NO: 494622 - DNA, 20 bp, Artificial
  CRISPR gRNA sequence
tcccctgggcctgtcaccac

SEQ ID NO: 494623 - DNA, 20 bp, Artificial
  CRISPR gRNA sequence
cccctgggcctgtcaccaca

SEQ ID NO: 494624 - DNA, 20 bp, Artificial
  CRISPR gRNA sequence
ccctgggcctgtcaccacat

SEQ ID NO: 494625 - DNA, 20 bp, Artificial
  CRISPR gRNA sequence
ggcctgtcaccacatctgcc

SEQ ID NO: 494626 - DNA, 20 bp, Artificial
  CRISPR gRNA sequence
tcaccacatctgccctaagc

SEQ ID NO: 494627 - DNA, 20 bp, Artificial
  CRISPR gRNA sequence
ccctaagcgagacacagcag

SEQ ID NO: 494628 - DNA, 20 bp, Artificial
  CRISPR gRNA sequence
agcgagacacagcagtgggg

SEQ ID NO: 494629 - DNA, 20 bp, Artificial
  CRISPR gRNA sequence
caggccctctgcaatttcct

SEQ ID NO: 494630 - DNA, 20 bp, Artificial
  CRISPR gRNA sequence
tgcaatttcctcctcttcta

SEQ ID NO: 494631 - DNA, 20 bp, Artificial
  CRISPR gRNA sequence
caatttcctcctcttctaat

SEQ ID NO: 494632 - DNA, 20 bp, Artificial
  CRISPR gRNA sequence
cctcctcttctaattcttgg

SEQ ID NO: 494633 - DNA, 20 bp, Artificial
  CRISPR gRNA sequence
ctcctcttctaattcttgga

SEQ ID NO: 494634 - DNA, 20 bp, Artificial
  CRISPR gRNA sequence
ctcttctaattcttggatga

SEQ ID NO: 494635 - DNA, 20 bp, Artificial
  CRISPR gRNA sequence
ttctaattcttggatgacag

SEQ ID NO: 494636 - DNA, 20 bp, Artificial
  CRISPR gRNA sequence
ctaattcttggatgacaggc

SEQ ID NO: 494637 - DNA, 20 bp, Artificial
  CRISPR gRNA sequence
taattcttggatgacaggca

SEQ ID NO: 494638 - DNA, 20 bp, Artificial
  CRISPR gRNA sequence
attcttggatgacaggcaga

SEQ ID NO: 494639 - DNA, 20 bp, Artificial
  CRISPR gRNA sequence
ttggatgacaggcagagttg

SEQ ID NO: 494640 - DNA, 20 bp, Artificial
  CRISPR gRNA sequence
ggatgacaggcagagttggc

SEQ ID NO: 494641 - DNA, 20 bp, Artificial
  CRISPR gRNA sequence
gatgacaggcagagttggcc

SEQ ID NO: 494642 - DNA, 20 bp, Artificial
  CRISPR gRNA sequence
gcccctgcctgctgcgaaga

SEQ ID NO: 494643 - DNA, 20 bp, Artificial
  CRISPR gRNA sequence
cctgctgcgaagagcaggcg

SEQ ID NO: 494644 - DNA, 20 bp, Artificial
  CRISPR gRNA sequence
ctgcgaagagcaggcgagag

SEQ ID NO: 494645 - DNA, 20 bp, Artificial
  CRISPR gRNA sequence
cgaagagcaggcgagaggct

SEQ ID NO: 494646 - DNA, 20 bp, Artificial
  CRISPR gRNA sequence
ctggaggagcctactcaggc

SEQ ID NO: 494647 - DNA, 20 bp, Artificial
  CRISPR gRNA sequence
gaggagcctactcaggctgg

SEQ ID NO: 494648 - DNA, 20 bp, Artificial
  CRISPR gRNA sequence
ctcaggctggtgggctttgt

SEQ ID NO: 494649 - DNA, 20 bp, Artificial
  CRISPR gRNA sequence
aggctggtgggctttgtgcc

SEQ ID NO: 494650 - DNA, 20 bp, Artificial
  CRISPR gRNA sequence
gtgggctttgtgccaggctg

SEQ ID NO: 494651 - DNA, 20 bp, Artificial
  CRISPR gRNA sequence
tgtgccaggctggttactct

SEQ ID NO: 494652 - DNA, 20 bp, Artificial
  CRISPR gRNA sequence
gtgccaggctggttactctc

SEQ ID NO: 494653 - DNA, 20 bp, Artificial
  CRISPR gRNA sequence
tgccaggctggttactctct

SEQ ID NO: 494654 - DNA, 20 bp, Artificial
  CRISPR gRNA sequence
gttactctctctagtacctc

SEQ ID NO: 494655 - DNA, 20 bp, Artificial
  CRISPR gRNA sequence
ctctctctagtacctcagcc

SEQ ID NO: 494656 - DNA, 20 bp, Artificial
  CRISPR gRNA sequence
tctctagtacctcagccaca

SEQ ID NO: 494657 - DNA, 20 bp, Artificial
  CRISPR gRNA sequence
tctagtacctcagccacact

SEQ ID NO: 494658 - DNA, 20 bp, Artificial
  CRISPR gRNA sequence
tagtacctcagccacactca

SEQ ID NO: 494659 - DNA, 20 bp, Artificial
  CRISPR gRNA sequence
gtacctcagccacactcagg

SEQ ID NO: 494660 - DNA, 20 bp, Artificial
  CRISPR gRNA sequence
agccacactcaggcctcttc

SEQ ID NO: 494661 - DNA, 20 bp, Artificial
  CRISPR gRNA sequence
aggcctcttcttccaaaagg

SEQ ID NO: 494662 - DNA, 20 bp, Artificial
  CRISPR gRNA sequence
ttcttccaaaaggctgtgaa

SEQ ID NO: 494663 - DNA, 20 bp, Artificial
  CRISPR gRNA sequence
cttccaaaaggctgtgaatg

SEQ ID NO: 494664 - DNA, 20 bp, Artificial
  CRISPR gRNA sequence
ttccaaaaggctgtgaatgc

SEQ ID NO: 494665 - DNA, 20 bp, Artificial
  CRISPR gRNA sequence
ccaaaaggctgtgaatgcag

SEQ ID NO: 494666 - DNA, 20 bp, Artificial
  CRISPR gRNA sequence
caaaaggctgtgaatgcagc

SEQ ID NO: 494667 - DNA, 20 bp, Artificial
  CRISPR gRNA sequence
tgaatgcagcctattgagcc

SEQ ID NO: 494668 - DNA, 20 bp, Artificial
  CRISPR gRNA sequence
ttgagccagctacaaaacta

SEQ ID NO: 494669 - DNA, 20 bp, Artificial
  CRISPR gRNA sequence
agccagctacaaaactatta

SEQ ID NO: 494670 - DNA, 20 bp, Artificial
  CRISPR gRNA sequence
caaaactattatgctttggc

SEQ ID NO: 494671 - DNA, 20 bp, Artificial
  CRISPR gRNA sequence
ttatgctttggctggtcaca

SEQ ID NO: 494672 - DNA, 20 bp, Artificial
  CRISPR gRNA sequence
tgctttggctggtcacactt

SEQ ID NO: 494673 - DNA, 20 bp, Artificial
  CRISPR gRNA sequence
tggctggtcacacttcccag

SEQ ID NO: 494674 - DNA, 20 bp, Artificial
  CRISPR gRNA sequence
ggctggtcacacttcccagc

SEQ ID NO: 494675 - DNA, 20 bp, Artificial
  CRISPR gRNA sequence
gctggtcacacttcccagcc

SEQ ID NO: 494676 - DNA, 20 bp, Artificial
  CRISPR gRNA sequence
gtcacacttcccagcctgtg

SEQ ID NO: 494677 - DNA, 20 bp, Artificial
  CRISPR gRNA sequence
cccagcctgtgtcaccatta

SEQ ID NO: 494678 - DNA, 20 bp, Artificial
  CRISPR gRNA sequence
ccagcctgtgtcaccattaa

SEQ ID NO: 494679 - DNA, 20 bp, Artificial
  CRISPR gRNA sequence
tgtcaccattaagggactca

SEQ ID NO: 494680 - DNA, 20 bp, Artificial
  CRISPR gRNA sequence
agggactcatgaatgtaagc

SEQ ID NO: 494681 - DNA, 20 bp, Artificial
  CRISPR gRNA sequence
atgaatgtaagccctgactc

SEQ ID NO: 494682 - DNA, 20 bp, Artificial
  CRISPR gRNA sequence
actcattaggaaaaagaatt

SEQ ID NO: 494683 - DNA, 20 bp, Artificial
  CRISPR gRNA sequence
attaggaaaaagaatttgtg

SEQ ID NO: 494684 - DNA, 20 bp, Artificial
  CRISPR gRNA sequence
ggaaaaagaatttgtggtca

SEQ ID NO: 494685 - DNA, 20 bp, Artificial
  CRISPR gRNA sequence
gtggtcagacaacaaatacc

SEQ ID NO: 494686 - DNA, 20 bp, Artificial
  CRISPR gRNA sequence
tggtcagacaacaaatacca

SEQ ID NO: 494687 - DNA, 20 bp, Artificial
  CRISPR gRNA sequence
tgcctctgtcattgatttct

SEQ ID NO: 494688 - DNA, 20 bp, Artificial
  CRISPR gRNA sequence
cctctgtcattgatttctgt

SEQ ID NO: 494689 - DNA, 20 bp, Artificial
  CRISPR gRNA sequence
tgtcattgatttctgttgtg

SEQ ID NO: 494690 - DNA, 20 bp, Artificial
  CRISPR gRNA sequence
tcattgatttctgttgtgct

SEQ ID NO: 494691 - DNA, 20 bp, Artificial
  CRISPR gRNA sequence
atttctgttgtgctccatcc

SEQ ID NO: 494692 - DNA, 20 bp, Artificial
  CRISPR gRNA sequence
ctgttgtgctccatcccttc

SEQ ID NO: 494693 - DNA, 20 bp, Artificial
  CRISPR gRNA sequence
tgttgtgctccatcccttct

SEQ ID NO: 494694 - DNA, 20 bp, Artificial
  CRISPR gRNA sequence
ttgtgctccatcccttctca

SEQ ID NO: 494695 - DNA, 20 bp, Artificial
  CRISPR gRNA sequence
tgctccatcccttctcagca

SEQ ID NO: 494696 - DNA, 20 bp, Artificial
  CRISPR gRNA sequence
catcccttctcagcaggtgc

SEQ ID NO: 494697 - DNA, 20 bp, Artificial
  CRISPR gRNA sequence
ctcagcaggtgcaattctgc

SEQ ID NO: 494698 - DNA, 20 bp, Artificial
  CRISPR gRNA sequence
tcagcaggtgcaattctgca

SEQ ID NO: 494699 - DNA, 20 bp, Artificial
  CRISPR gRNA sequence
agcaggtgcaattctgcacc

SEQ ID NO: 494700 - DNA, 20 bp, Artificial
  CRISPR gRNA sequence
tgcaccaagatgccccttca

SEQ ID NO: 494701 - DNA, 20 bp, Artificial
  CRISPR gRNA sequence
caccaagatgccccttcagc

SEQ ID NO: 494702 - DNA, 20 bp, Artificial
  CRISPR gRNA sequence
cagcctccctttcatctcct

SEQ ID NO: 494703 - DNA, 20 bp, Artificial
  CRISPR gRNA sequence
agcctccctttcatctcctc

SEQ ID NO: 494704 - DNA, 20 bp, Artificial
  CRISPR gRNA sequence
cctttcatctcctctgctcc

SEQ ID NO: 494705 - DNA, 20 bp, Artificial
  CRISPR gRNA sequence
tcatctcctctgctcctttt

SEQ ID NO: 494706 - DNA, 20 bp, Artificial
  CRISPR gRNA sequence
catctcctctgctccttttg

SEQ ID NO: 494707 - DNA, 20 bp, Artificial
  CRISPR gRNA sequence
atctcctctgctccttttgt

SEQ ID NO: 494708 - DNA, 20 bp, Artificial
  CRISPR gRNA sequence
ctctgctccttttgtttcct

SEQ ID NO: 494709 - DNA, 20 bp, Artificial
  CRISPR gRNA sequence
tgctccttttgtttcctctt

SEQ ID NO: 494710 - DNA, 20 bp, Artificial
  CRISPR gRNA sequence
ctccttttgtttcctctttt

SEQ ID NO: 494711 - DNA, 20 bp, Artificial
  CRISPR gRNA sequence
cttttgtttcctcttttcct

SEQ ID NO: 494712 - DNA, 20 bp, Artificial
  CRISPR gRNA sequence
ttgtttcctcttttcctcca

SEQ ID NO: 494713 - DNA, 20 bp, Artificial
  CRISPR gRNA sequence
tgtttcctcttttcctccat

SEQ ID NO: 494714 - DNA, 20 bp, Artificial
  CRISPR gRNA sequence
gtttcctcttttcctccatc

SEQ ID NO: 494715 - DNA, 20 bp, Artificial
  CRISPR gRNA sequence
tttcctcttttcctccatca

SEQ ID NO: 494716 - DNA, 20 bp, Artificial
  CRISPR gRNA sequence
cctcttttcctccatcacca

SEQ ID NO: 494717 - DNA, 20 bp, Artificial
  CRISPR gRNA sequence
ctcttttcctccatcaccag

SEQ ID NO: 494718 - DNA, 20 bp, Artificial
  CRISPR gRNA sequence
ttttcctccatcaccagaac

SEQ ID NO: 494719 - DNA, 20 bp, Artificial
  CRISPR gRNA sequence
ttcctccatcaccagaacta

SEQ ID NO: 494720 - DNA, 20 bp, Artificial
  CRISPR gRNA sequence
tcctccatcaccagaactag

SEQ ID NO: 494721 - DNA, 20 bp, Artificial
  CRISPR gRNA sequence
cctccatcaccagaactagg

SEQ ID NO: 494722 - DNA, 20 bp, Artificial
  CRISPR gRNA sequence
ctccatcaccagaactagga

SEQ ID NO: 494723 - DNA, 20 bp, Artificial
  CRISPR gRNA sequence
catcaccagaactaggaagc

SEQ ID NO: 494724 - DNA, 20 bp, Artificial
  CRISPR gRNA sequence
ggaagcaggtggagaaaaga

SEQ ID NO: 494725 - DNA, 20 bp, Artificial
  CRISPR gRNA sequence
agggtcacatcaaaaggaca

SEQ ID NO: 494726 - DNA, 20 bp, Artificial
  CRISPR gRNA sequence
agtcctttttgtccctctgc

SEQ ID NO: 494727 - DNA, 20 bp, Artificial
  CRISPR gRNA sequence
tttgtccctctgctctgaat

SEQ ID NO: 494728 - DNA, 20 bp, Artificial
  CRISPR gRNA sequence
ttgtccctctgctctgaata

SEQ ID NO: 494729 - DNA, 20 bp, Artificial
  CRISPR gRNA sequence
tgtccctctgctctgaataa

SEQ ID NO: 494730 - DNA, 20 bp, Artificial
  CRISPR gRNA sequence
gtccctctgctctgaataac

SEQ ID NO: 494731 - DNA, 20 bp, Artificial
  CRISPR gRNA sequence
tccctctgctctgaataacc

SEQ ID NO: 494732 - DNA, 20 bp, Artificial
  CRISPR gRNA sequence
tgctctgaataaccatcatt

SEQ ID NO: 494733 - DNA, 20 bp, Artificial
  CRISPR gRNA sequence
ctctgaataaccatcattga

SEQ ID NO: 494734 - DNA, 20 bp, Artificial
  CRISPR gRNA sequence
tgaataaccatcattgaaag

SEQ ID NO: 494735 - DNA, 20 bp, Artificial
  CRISPR gRNA sequence
aataaccatcattgaaagag

SEQ ID NO: 494736 - DNA, 20 bp, Artificial
  CRISPR gRNA sequence
aaagagcattttccaagcca

SEQ ID NO: 494737 - DNA, 20 bp, Artificial
  CRISPR gRNA sequence
tccaagccagctgagagaga

SEQ ID NO: 494738 - DNA, 20 bp, Artificial
  CRISPR gRNA sequence
ccaagccagctgagagagac

SEQ ID NO: 494739 - DNA, 20 bp, Artificial
  CRISPR gRNA sequence
caagccagctgagagagacc

SEQ ID NO: 494740 - DNA, 20 bp, Artificial
  CRISPR gRNA sequence
agagagaccccagcctccgg

SEQ ID NO: 494741 - DNA, 20 bp, Artificial
  CRISPR gRNA sequence
cgggatgacatacgtgattt

SEQ ID NO: 494742 - DNA, 20 bp, Artificial
  CRISPR gRNA sequence
ctcctggttttcagatcctt

SEQ ID NO: 494743 - DNA, 20 bp, Artificial
  CRISPR gRNA sequence
tcctggttttcagatccttg

SEQ ID NO: 494744 - DNA, 20 bp, Artificial
  CRISPR gRNA sequence
ctggttttcagatccttgac

SEQ ID NO: 494745 - DNA, 20 bp, Artificial
  CRISPR gRNA sequence
gttttcagatccttgacatc

SEQ ID NO: 494746 - DNA, 20 bp, Artificial
  CRISPR gRNA sequence
tcagatccttgacatcttcg

SEQ ID NO: 494747 - DNA, 20 bp, Artificial
  CRISPR gRNA sequence
cagatccttgacatcttcgt

SEQ ID NO: 494748 - DNA, 20 bp, Artificial
  CRISPR gRNA sequence
agatccttgacatcttcgta

SEQ ID NO: 494749 - DNA, 20 bp, Artificial
  CRISPR gRNA sequence
gacatcttcgtaaattgtca

SEQ ID NO: 494750 - DNA, 20 bp, Artificial
  CRISPR gRNA sequence
acatcttcgtaaattgtcaa

SEQ ID NO: 494751 - DNA, 20 bp, Artificial
  CRISPR gRNA sequence
cgtaaattgtcaaaaattcc

SEQ ID NO: 494752 - DNA, 20 bp, Artificial
  CRISPR gRNA sequence
gtaaattgtcaaaaattcct

SEQ ID NO: 494753 - DNA, 20 bp, Artificial
  CRISPR gRNA sequence
tcaaaaattccttgggactg

SEQ ID NO: 494754 - DNA, 20 bp, Artificial
  CRISPR gRNA sequence
cttgggactggtctctgagg

SEQ ID NO: 494755 - DNA, 20 bp, Artificial
  CRISPR gRNA sequence
gggactggtctctgagggag

SEQ ID NO: 494756 - DNA, 20 bp, Artificial
  CRISPR gRNA sequence
ggactggtctctgagggagg

SEQ ID NO: 494757 - DNA, 20 bp, Artificial
  CRISPR gRNA sequence
gtctctgagggaggaagaaa

SEQ ID NO: 494758 - DNA, 20 bp, Artificial
  CRISPR gRNA sequence
tgagggaggaagaaaacaaa

SEQ ID NO: 494759 - DNA, 20 bp, Artificial
  CRISPR gRNA sequence
agggaggaagaaaacaaaga

SEQ ID NO: 494760 - DNA, 20 bp, Artificial
  CRISPR gRNA sequence
cagaaacctccagaagggct

SEQ ID NO: 494761 - DNA, 20 bp, Artificial
  CRISPR gRNA sequence
cagaagggcttttgcttcta

SEQ ID NO: 494762 - DNA, 20 bp, Artificial
  CRISPR gRNA sequence
ttgcttctaacaggtcccac

SEQ ID NO: 494763 - DNA, 20 bp, Artificial
  CRISPR gRNA sequence
tgcttctaacaggtcccacc

SEQ ID NO: 494764 - DNA, 20 bp, Artificial
  CRISPR gRNA sequence
gcttctaacaggtcccacct

SEQ ID NO: 494765 - DNA, 20 bp, Artificial
  CRISPR gRNA sequence
cttctaacaggtcccacctc

SEQ ID NO: 494766 - DNA, 20 bp, Artificial
  CRISPR gRNA sequence
ctaacaggtcccacctctac

SEQ ID NO: 494767 - DNA, 20 bp, Artificial
  CRISPR gRNA sequence
taacaggtcccacctctacc

SEQ ID NO: 494768 - DNA, 20 bp, Artificial
  CRISPR gRNA sequence
acaggtcccacctctacccc

SEQ ID NO: 494769 - DNA, 20 bp, Artificial
  CRISPR gRNA sequence
taccccaaatggccaaacct

SEQ ID NO: 494770 - DNA, 20 bp, Artificial
  CRISPR gRNA sequence
ccccaaatggccaaacctta

SEQ ID NO: 494771 - DNA, 20 bp, Artificial
  CRISPR gRNA sequence
aaaaaaggttctagaaagga

SEQ ID NO: 494772 - DNA, 20 bp, Artificial
  CRISPR gRNA sequence
aaaaaggttctagaaaggag

SEQ ID NO: 494773 - DNA, 20 bp, Artificial
  CRISPR gRNA sequence
tagaaaggaggcaagttaat

SEQ ID NO: 494774 - DNA, 20 bp, Artificial
  CRISPR gRNA sequence
gaaaggaggcaagttaatgc

SEQ ID NO: 494775 - DNA, 20 bp, Artificial
  CRISPR gRNA sequence
atgctcttcccaggaacccc

SEQ ID NO: 494776 - DNA, 20 bp, Artificial
  CRISPR gRNA sequence
ttcccaggaaccccaaagag

SEQ ID NO: 494777 - DNA, 20 bp, Artificial
  CRISPR gRNA sequence
cccaggaaccccaaagagca

SEQ ID NO: 494778 - DNA, 20 bp, Artificial
  CRISPR gRNA sequence
ccaggaaccccaaagagcac

SEQ ID NO: 494779 - DNA, 20 bp, Artificial
  CRISPR gRNA sequence
cccctcccacacctcctccc

SEQ ID NO: 494780 - DNA, 20 bp, Artificial
  CRISPR gRNA sequence
ccacacctcctcccaaacca

SEQ ID NO: 494781 - DNA, 20 bp, Artificial
  CRISPR gRNA sequence
ctcccaaaccagctgtctac

SEQ ID NO: 494782 - DNA, 20 bp, Artificial
  CRISPR gRNA sequence
ccaaaccagctgtctacagg

SEQ ID NO: 494783 - DNA, 20 bp, Artificial
  CRISPR gRNA sequence
tctacagggaaatctgcgca

SEQ ID NO: 494784 - DNA, 20 bp, Artificial
  CRISPR gRNA sequence
cagggaaatctgcgcattgg

SEQ ID NO: 494785 - DNA, 20 bp, Artificial
  CRISPR gRNA sequence
cgcattgggatcagaaggca

SEQ ID NO: 494786 - DNA, 20 bp, Artificial
  CRISPR gRNA sequence
ggatcagaaggcatgaactg

SEQ ID NO: 494787 - DNA, 20 bp, Artificial
  CRISPR gRNA sequence
ggagagagagcctagcaacc

SEQ ID NO: 494788 - DNA, 20 bp, Artificial
  CRISPR gRNA sequence
gcaacctgcttgccccccgc

SEQ ID NO: 494789 - DNA, 20 bp, Artificial
  CRISPR gRNA sequence
cttgccccccgccaccacgc

SEQ ID NO: 494790 - DNA, 20 bp, Artificial
  CRISPR gRNA sequence
gccccccgccaccacgcaca

SEQ ID NO: 494791 - DNA, 20 bp, Artificial
  CRISPR gRNA sequence
ccccccgccaccacgcacac

SEQ ID NO: 494792 - DNA, 20 bp, Artificial
  CRISPR gRNA sequence
gttgaggaaaaggagatgct

SEQ ID NO: 494793 - DNA, 20 bp, Artificial
  CRISPR gRNA sequence
aggaaaaggagatgctgtgc

SEQ ID NO: 494794 - DNA, 20 bp, Artificial
  CRISPR gRNA sequence
tgctcccagacacatcccac

SEQ ID NO: 494795 - DNA, 20 bp, Artificial
  CRISPR gRNA sequence
ccagacacatcccactggac

SEQ ID NO: 494796 - DNA, 20 bp, Artificial
  CRISPR gRNA sequence
gacgcaggacaaagtcacag

SEQ ID NO: 494797 - DNA, 20 bp, Artificial
  CRISPR gRNA sequence
aggcaggagcaccaccctaa

SEQ ID NO: 494798 - DNA, 20 bp, Artificial
  CRISPR gRNA sequence
aggaccttccactcacctga

SEQ ID NO: 494799 - DNA, 20 bp, Artificial
  CRISPR gRNA sequence
ccactcacctgactgcttct

SEQ ID NO: 494800 - DNA, 20 bp, Artificial
  CRISPR gRNA sequence
cactcacctgactgcttctc

SEQ ID NO: 494801 - DNA, 20 bp, Artificial
  CRISPR gRNA sequence
acctgactgcttctccttcc

SEQ ID NO: 494802 - DNA, 20 bp, Artificial
  CRISPR gRNA sequence
actgcttctccttcctcttt

SEQ ID NO: 494803 - DNA, 20 bp, Artificial
  CRISPR gRNA sequence
cttctccttcctctttctcc

SEQ ID NO: 494804 - DNA, 20 bp, Artificial
  CRISPR gRNA sequence
ctccttcctctttctcctcc

SEQ ID NO: 494805 - DNA, 20 bp, Artificial
  CRISPR gRNA sequence
tccttcctctttctcctcca

SEQ ID NO: 494806 - DNA, 20 bp, Artificial
  CRISPR gRNA sequence
cttcctctttctcctccaca

SEQ ID NO: 494807 - DNA, 20 bp, Artificial
  CRISPR gRNA sequence
cctctttctcctccacacac

SEQ ID NO: 494808 - DNA, 20 bp, Artificial
  CRISPR gRNA sequence
ctctttctcctccacacaca

SEQ ID NO: 494809 - DNA, 20 bp, Artificial
  CRISPR gRNA sequence
tttctcctccacacacagaa

SEQ ID NO: 494810 - DNA, 20 bp, Artificial
  CRISPR gRNA sequence
tctcctccacacacagaagc

SEQ ID NO: 494811 - DNA, 20 bp, Artificial
  CRISPR gRNA sequence
ctcctccacacacagaagca

SEQ ID NO: 494812 - DNA, 20 bp, Artificial
  CRISPR gRNA sequence
tcctccacacacagaagcag

SEQ ID NO: 494813 - DNA, 20 bp, Artificial
  CRISPR gRNA sequence
ctccacacacagaagcaggc

SEQ ID NO: 494814 - DNA, 20 bp, Artificial
  CRISPR gRNA sequence
cacacacagaagcaggcaag

SEQ ID NO: 494815 - DNA, 20 bp, Artificial
  CRISPR gRNA sequence
agaatcacgatgatcaccaa

SEQ ID NO: 494816 - DNA, 20 bp, Artificial
  CRISPR gRNA sequence
gaatcacgatgatcaccaaa

SEQ ID NO: 494817 - DNA, 20 bp, Artificial
  CRISPR gRNA sequence
aattctgaggaatacagaag

SEQ ID NO: 494818 - DNA, 20 bp, Artificial
  CRISPR gRNA sequence
tgaggaatacagaaggcgtg

SEQ ID NO: 494819 - DNA, 20 bp, Artificial
  CRISPR gRNA sequence
aggaatacagaaggcgtgag

SEQ ID NO: 494820 - DNA, 20 bp, Artificial
  CRISPR gRNA sequence
agctgtcagctcgctctctt

SEQ ID NO: 494821 - DNA, 20 bp, Artificial
  CRISPR gRNA sequence
tcagctcgctctcttcttcc

SEQ ID NO: 494822 - DNA, 20 bp, Artificial
  CRISPR gRNA sequence
gctctcttcttccttcccac

SEQ ID NO: 494823 - DNA, 20 bp, Artificial
  CRISPR gRNA sequence
tcttcttccttcccacctgc

SEQ ID NO: 494824 - DNA, 20 bp, Artificial
  CRISPR gRNA sequence
ttcttccttcccacctgcct

SEQ ID NO: 494825 - DNA, 20 bp, Artificial
  CRISPR gRNA sequence
cttccttcccacctgcctgc

SEQ ID NO: 494826 - DNA, 20 bp, Artificial
  CRISPR gRNA sequence
ttccttcccacctgcctgct

SEQ ID NO: 494827 - DNA, 20 bp, Artificial
  CRISPR gRNA sequence
ccttcccacctgcctgctgc

SEQ ID NO: 494828 - DNA, 20 bp, Artificial
  CRISPR gRNA sequence
cttcccacctgcctgctgca

SEQ ID NO: 494829 - DNA, 20 bp, Artificial
  CRISPR gRNA sequence
cccacctgcctgctgcaggg

SEQ ID NO: 494830 - DNA, 20 bp, Artificial
  CRISPR gRNA sequence
ccacctgcctgctgcagggg

SEQ ID NO: 494831 - DNA, 20 bp, Artificial
  CRISPR gRNA sequence
cctgctgcaggggctgcctc

SEQ ID NO: 494832 - DNA, 20 bp, Artificial
  CRISPR gRNA sequence
ctgcaggggctgcctcaaaa

SEQ ID NO: 494833 - DNA, 20 bp, Artificial
  CRISPR gRNA sequence
caggggctgcctcaaaaccc

SEQ ID NO: 494834 - DNA, 20 bp, Artificial
  CRISPR gRNA sequence
cctcaaaacccacttttctc

SEQ ID NO: 494835 - DNA, 20 bp, Artificial
  CRISPR gRNA sequence
aaaacccacttttctctgtg

SEQ ID NO: 494836 - DNA, 20 bp, Artificial
  CRISPR gRNA sequence
ttctctgtgttgtggctgat

SEQ ID NO: 494837 - DNA, 20 bp, Artificial
  CRISPR gRNA sequence
tctctgtgttgtggctgatt

SEQ ID NO: 494838 - DNA, 20 bp, Artificial
  CRISPR gRNA sequence
ctctgtgttgtggctgattg

SEQ ID NO: 494839 - DNA, 20 bp, Artificial
  CRISPR gRNA sequence
tctgtgttgtggctgattgc

SEQ ID NO: 494840 - DNA, 20 bp, Artificial
  CRISPR gRNA sequence
tgtgttgtggctgattgcct

SEQ ID NO: 494841 - DNA, 20 bp, Artificial
  CRISPR gRNA sequence
tgttgtggctgattgcctcg

SEQ ID NO: 494842 - DNA, 20 bp, Artificial
  CRISPR gRNA sequence
tggctgattgcctcgtgctc

SEQ ID NO: 494843 - DNA, 20 bp, Artificial
  CRISPR gRNA sequence
attgcctcgtgctctgagaa

SEQ ID NO: 494844 - DNA, 20 bp, Artificial
  CRISPR gRNA sequence
cctcgtgctctgagaactca

SEQ ID NO: 494845 - DNA, 20 bp, Artificial
  CRISPR gRNA sequence
gtgctctgagaactcacggt

SEQ ID NO: 494846 - DNA, 20 bp, Artificial
  CRISPR gRNA sequence
tgagaactcacggtcaaggt

SEQ ID NO: 494847 - DNA, 20 bp, Artificial
  CRISPR gRNA sequence
agaactcacggtcaaggttt

SEQ ID NO: 494848 - DNA, 20 bp, Artificial
  CRISPR gRNA sequence
acggtcaaggttttctcttt

SEQ ID NO: 494849 - DNA, 20 bp, Artificial
  CRISPR gRNA sequence
tctctttgctcatttggtta

SEQ ID NO: 494850 - DNA, 20 bp, Artificial
  CRISPR gRNA sequence
ctctttgctcatttggttaa

SEQ ID NO: 494851 - DNA, 20 bp, Artificial
  CRISPR gRNA sequence
tctttgctcatttggttaac

SEQ ID NO: 494852 - DNA, 20 bp, Artificial
  CRISPR gRNA sequence
tttgctcatttggttaacct

SEQ ID NO: 494853 - DNA, 20 bp, Artificial
  CRISPR gRNA sequence
tgctcatttggttaacctcc

SEQ ID NO: 494854 - DNA, 20 bp, Artificial
  CRISPR gRNA sequence
gctcatttggttaacctcct

SEQ ID NO: 494855 - DNA, 20 bp, Artificial
  CRISPR gRNA sequence
ctcatttggttaacctcctc

SEQ ID NO: 494856 - DNA, 20 bp, Artificial
  CRISPR gRNA sequence
atttggttaacctcctctga

SEQ ID NO: 494857 - DNA, 20 bp, Artificial
  CRISPR gRNA sequence
ggttaacctcctctgagtga

SEQ ID NO: 494858 - DNA, 20 bp, Artificial
  CRISPR gRNA sequence
gttaacctcctctgagtgat

SEQ ID NO: 494859 - DNA, 20 bp, Artificial
  CRISPR gRNA sequence
acctcctctgagtgatgcca

SEQ ID NO: 494860 - DNA, 20 bp, Artificial
  CRISPR gRNA sequence
ctctgagtgatgccaagagc

SEQ ID NO: 494861 - DNA, 20 bp, Artificial
  CRISPR gRNA sequence
tgagtgatgccaagagcata

SEQ ID NO: 494862 - DNA, 20 bp, Artificial
  CRISPR gRNA sequence
agtgatgccaagagcataga

SEQ ID NO: 494863 - DNA, 20 bp, Artificial
  CRISPR gRNA sequence
gctcaaattctaaccctgtg

SEQ ID NO: 494864 - DNA, 20 bp, Artificial
  CRISPR gRNA sequence
aaattctaaccctgtgagct

SEQ ID NO: 494865 - DNA, 20 bp, Artificial
  CRISPR gRNA sequence
taaccctgtgagctctgcac

SEQ ID NO: 494866 - DNA, 20 bp, Artificial
  CRISPR gRNA sequence
accctgtgagctctgcacta

SEQ ID NO: 494867 - DNA, 20 bp, Artificial
  CRISPR gRNA sequence
tgagctctgcactatttatt

SEQ ID NO: 494868 - DNA, 20 bp, Artificial
  CRISPR gRNA sequence
tgcactatttatttaacctc

SEQ ID NO: 494869 - DNA, 20 bp, Artificial
  CRISPR gRNA sequence
cactatttatttaacctctc

SEQ ID NO: 494870 - DNA, 20 bp, Artificial
  CRISPR gRNA sequence
tttatttaacctctctgggc

SEQ ID NO: 494871 - DNA, 20 bp, Artificial
  CRISPR gRNA sequence
atttaacctctctgggcctc

SEQ ID NO: 494872 - DNA, 20 bp, Artificial
  CRISPR gRNA sequence
tttaacctctctgggcctct

SEQ ID NO: 494873 - DNA, 20 bp, Artificial
  CRISPR gRNA sequence
aacctctctgggcctctcaa

SEQ ID NO: 494874 - DNA, 20 bp, Artificial
  CRISPR gRNA sequence
acctctctgggcctctcaag

SEQ ID NO: 494875 - DNA, 20 bp, Artificial
  CRISPR gRNA sequence
tctgggcctctcaagtcatc

SEQ ID NO: 494876 - DNA, 20 bp, Artificial
  CRISPR gRNA sequence
tgggcctctcaagtcatctt

SEQ ID NO: 494877 - DNA, 20 bp, Artificial
  CRISPR gRNA sequence
ggcctctcaagtcatcttat

SEQ ID NO: 494878 - DNA, 20 bp, Artificial
  CRISPR gRNA sequence
tcaagtcatcttatttttgg

SEQ ID NO: 494879 - DNA, 20 bp, Artificial
  CRISPR gRNA sequence
aagtcatcttatttttggaa

SEQ ID NO: 494880 - DNA, 20 bp, Artificial
  CRISPR gRNA sequence
atttttggaagatgcctcag

SEQ ID NO: 494881 - DNA, 20 bp, Artificial
  CRISPR gRNA sequence
tttttggaagatgcctcaga

SEQ ID NO: 494882 - DNA, 20 bp, Artificial
  CRISPR gRNA sequence
ttggaagatgcctcagagcc

SEQ ID NO: 494883 - DNA, 20 bp, Artificial
  CRISPR gRNA sequence
tggaagatgcctcagagcct

SEQ ID NO: 494884 - DNA, 20 bp, Artificial
  CRISPR gRNA sequence
ggaagatgcctcagagcctc

SEQ ID NO: 494885 - DNA, 20 bp, Artificial
  CRISPR gRNA sequence
gaagatgcctcagagcctct

SEQ ID NO: 494886 - DNA, 20 bp, Artificial
  CRISPR gRNA sequence
agagcctcttagattttctc

SEQ ID NO: 494887 - DNA, 20 bp, Artificial
  CRISPR gRNA sequence
ttagattttctcacctgtaa

SEQ ID NO: 494888 - DNA, 20 bp, Artificial
  CRISPR gRNA sequence
agattttctcacctgtaaaa

SEQ ID NO: 494889 - DNA, 20 bp, Artificial
  CRISPR gRNA sequence
gattttctcacctgtaaaag

SEQ ID NO: 494890 - DNA, 20 bp, Artificial
  CRISPR gRNA sequence
tctcacctgtaaaaggggat

SEQ ID NO: 494891 - DNA, 20 bp, Artificial
  CRISPR gRNA sequence
ctcacctgtaaaaggggata

SEQ ID NO: 494892 - DNA, 20 bp, Artificial
  CRISPR gRNA sequence
tcacctgtaaaaggggataa

SEQ ID NO: 494893 - DNA, 20 bp, Artificial
  CRISPR gRNA sequence
acctgtaaaaggggataacg

SEQ ID NO: 494894 - DNA, 20 bp, Artificial
  CRISPR gRNA sequence
taaaaggggataacgttatc

SEQ ID NO: 494895 - DNA, 20 bp, Artificial
  CRISPR gRNA sequence
tctacctataggggttaatt

SEQ ID NO: 494896 - DNA, 20 bp, Artificial
  CRISPR gRNA sequence
cctataggggttaattacat

SEQ ID NO: 494897 - DNA, 20 bp, Artificial
  CRISPR gRNA sequence
taggggttaattacatgatc

SEQ ID NO: 494898 - DNA, 20 bp, Artificial
  CRISPR gRNA sequence
attacatgatctaatacagt

SEQ ID NO: 494899 - DNA, 20 bp, Artificial
  CRISPR gRNA sequence
catgatctaatacagttgcc

SEQ ID NO: 494900 - DNA, 20 bp, Artificial
  CRISPR gRNA sequence
atacagttgccctccaaagt

SEQ ID NO: 494901 - DNA, 20 bp, Artificial
  CRISPR gRNA sequence
ccctccaaagttttgagttc

SEQ ID NO: 494902 - DNA, 20 bp, Artificial
  CRISPR gRNA sequence
caaagttttgagttccacaa

SEQ ID NO: 494903 - DNA, 20 bp, Artificial
  CRISPR gRNA sequence
tgagttccacaatgtggatt

SEQ ID NO: 494904 - DNA, 20 bp, Artificial
  CRISPR gRNA sequence
gagttccacaatgtggattc

SEQ ID NO: 494905 - DNA, 20 bp, Artificial
  CRISPR gRNA sequence
agttccacaatgtggattca

SEQ ID NO: 494906 - DNA, 20 bp, Artificial
  CRISPR gRNA sequence
cacaatgtggattcaatgaa

SEQ ID NO: 494907 - DNA, 20 bp, Artificial
  CRISPR gRNA sequence
aatgaattgtggatccagaa

SEQ ID NO: 494908 - DNA, 20 bp, Artificial
  CRISPR gRNA sequence
tggatccagaatattcaggg

SEQ ID NO: 494909 - DNA, 20 bp, Artificial
  CRISPR gRNA sequence
agggaaaaaaaatgcatgtg

SEQ ID NO: 494910 - DNA, 20 bp, Artificial
  CRISPR gRNA sequence
aatatgtagaggcctttttc

SEQ ID NO: 494911 - DNA, 20 bp, Artificial
  CRISPR gRNA sequence
tttccttgtcattattccct

SEQ ID NO: 494912 - DNA, 20 bp, Artificial
  CRISPR gRNA sequence
ttccttgtcattattcccta

SEQ ID NO: 494913 - DNA, 20 bp, Artificial
  CRISPR gRNA sequence
tccttgtcattattccctaa

SEQ ID NO: 494914 - DNA, 20 bp, Artificial
  CRISPR gRNA sequence
ccttgtcattattccctaaa

SEQ ID NO: 494915 - DNA, 20 bp, Artificial
  CRISPR gRNA sequence
cttgtcattattccctaaac

SEQ ID NO: 494916 - DNA, 20 bp, Artificial
  CRISPR gRNA sequence
gtcattattccctaaacaat

SEQ ID NO: 494917 - DNA, 20 bp, Artificial
  CRISPR gRNA sequence
tcattattccctaaacaata

SEQ ID NO: 494918 - DNA, 20 bp, Artificial
  CRISPR gRNA sequence
ttccctaaacaatacagtat

SEQ ID NO: 494919 - DNA, 20 bp, Artificial
  CRISPR gRNA sequence
cctaaacaatacagtataac

SEQ ID NO: 494920 - DNA, 20 bp, Artificial
  CRISPR gRNA sequence
aacaatacagtataacaact

SEQ ID NO: 494921 - DNA, 20 bp, Artificial
  CRISPR gRNA sequence
tttaaatagcatttacattg

SEQ ID NO: 494922 - DNA, 20 bp, Artificial
  CRISPR gRNA sequence
aaatagcatttacattgtat

SEQ ID NO: 494923 - DNA, 20 bp, Artificial
  CRISPR gRNA sequence
aatagcatttacattgtatc

SEQ ID NO: 494924 - DNA, 20 bp, Artificial
  CRISPR gRNA sequence
acattgtatcaggcattata

SEQ ID NO: 494925 - DNA, 20 bp, Artificial
  CRISPR gRNA sequence
cattgtatcaggcattataa

SEQ ID NO: 494926 - DNA, 20 bp, Artificial
  CRISPR gRNA sequence
tatcaggcattataactaat

SEQ ID NO: 494927 - DNA, 20 bp, Artificial
  CRISPR gRNA sequence
taactaatttagaggtgact

SEQ ID NO: 494928 - DNA, 20 bp, Artificial
  CRISPR gRNA sequence
atttagaggtgacttaagta

SEQ ID NO: 494929 - DNA, 20 bp, Artificial
  CRISPR gRNA sequence
agaggtgacttaagtaaggt

SEQ ID NO: 494930 - DNA, 20 bp, Artificial
  CRISPR gRNA sequence
gaggtgacttaagtaaggta

SEQ ID NO: 494931 - DNA, 20 bp, Artificial
  CRISPR gRNA sequence
aagtaaggtatacagaagga

SEQ ID NO: 494932 - DNA, 20 bp, Artificial
  CRISPR gRNA sequence
agtaaggtatacagaaggat

SEQ ID NO: 494933 - DNA, 20 bp, Artificial
  CRISPR gRNA sequence
tatgcaaaaactgcacctgt

SEQ ID NO: 494934 - DNA, 20 bp, Artificial
  CRISPR gRNA sequence
cacctgtttatgccagggac

SEQ ID NO: 494935 - DNA, 20 bp, Artificial
  CRISPR gRNA sequence
tttatgccagggacttaaac

SEQ ID NO: 494936 - DNA, 20 bp, Artificial
  CRISPR gRNA sequence
atgccagggacttaaacatt

SEQ ID NO: 494937 - DNA, 20 bp, Artificial
  CRISPR gRNA sequence
tgccagggacttaaacattc

SEQ ID NO: 494938 - DNA, 20 bp, Artificial
  CRISPR gRNA sequence
aaacattcgtggatcttggc

SEQ ID NO: 494939 - DNA, 20 bp, Artificial
  CRISPR gRNA sequence
aacattcgtggatcttggca

SEQ ID NO: 494940 - DNA, 20 bp, Artificial
  CRISPR gRNA sequence
gtggatcttggcatctgtgg

SEQ ID NO: 494941 - DNA, 20 bp, Artificial
  CRISPR gRNA sequence
ggcatctgtggttgcgaggt

SEQ ID NO: 494942 - DNA, 20 bp, Artificial
  CRISPR gRNA sequence
gcatctgtggttgcgaggtg

SEQ ID NO: 494943 - DNA, 20 bp, Artificial
  CRISPR gRNA sequence
tggttgcgaggtgggtcctg

SEQ ID NO: 494944 - DNA, 20 bp, Artificial
  CRISPR gRNA sequence
cgaggtgggtcctggaacta

SEQ ID NO: 494945 - DNA, 20 bp, Artificial
  CRISPR gRNA sequence
gaactaattcgtcatggata

SEQ ID NO: 494946 - DNA, 20 bp, Artificial
  CRISPR gRNA sequence
attcgtcatggatactgagg

SEQ ID NO: 494947 - DNA, 20 bp, Artificial
  CRISPR gRNA sequence
gtcatggatactgagggaca

SEQ ID NO: 494948 - DNA, 20 bp, Artificial
  CRISPR gRNA sequence
agggacatgtagcacaacaa

SEQ ID NO: 494949 - DNA, 20 bp, Artificial
  CRISPR gRNA sequence
catttatccattcctttgtt

SEQ ID NO: 494950 - DNA, 20 bp, Artificial
  CRISPR gRNA sequence
atccattcctttgtttttaa

SEQ ID NO: 494951 - DNA, 20 bp, Artificial
  CRISPR gRNA sequence
tccattcctttgtttttaac

SEQ ID NO: 494952 - DNA, 20 bp, Artificial
  CRISPR gRNA sequence
ctttgtttttaactcaaaaa

SEQ ID NO: 494953 - DNA, 20 bp, Artificial
  CRISPR gRNA sequence
tgtttttaactcaaaaaata

SEQ ID NO: 494954 - DNA, 20 bp, Artificial
  CRISPR gRNA sequence
gtttttaactcaaaaaatac

SEQ ID NO: 494955 - DNA, 20 bp, Artificial
  CRISPR gRNA sequence
tttttaactcaaaaaatact

SEQ ID NO: 494956 - DNA, 20 bp, Artificial
  CRISPR gRNA sequence
ttaactcaaaaaatactcat

SEQ ID NO: 494957 - DNA, 20 bp, Artificial
  CRISPR gRNA sequence
taactcaaaaaatactcatt

SEQ ID NO: 494958 - DNA, 20 bp, Artificial
  CRISPR gRNA sequence
aactcaaaaaatactcattg

SEQ ID NO: 494959 - DNA, 20 bp, Artificial
  CRISPR gRNA sequence
actcaaaaaatactcattgt

SEQ ID NO: 494960 - DNA, 20 bp, Artificial
  CRISPR gRNA sequence
aaaaaatactcattgtacag

SEQ ID NO: 494961 - DNA, 20 bp, Artificial
  CRISPR gRNA sequence
attgtacaggcaagttttcc

SEQ ID NO: 494962 - DNA, 20 bp, Artificial
  CRISPR gRNA sequence
tacaggcaagttttccgtct

SEQ ID NO: 494963 - DNA, 20 bp, Artificial
  CRISPR gRNA sequence
tccgtctcacttttccacta

SEQ ID NO: 494964 - DNA, 20 bp, Artificial
  CRISPR gRNA sequence
ccgtctcacttttccactat

SEQ ID NO: 494965 - DNA, 20 bp, Artificial
  CRISPR gRNA sequence
cgtctcacttttccactatt

SEQ ID NO: 494966 - DNA, 20 bp, Artificial
  CRISPR gRNA sequence
acttttccactattccttcc

SEQ ID NO: 494967 - DNA, 20 bp, Artificial
  CRISPR gRNA sequence
ttccactattccttccttca

SEQ ID NO: 494968 - DNA, 20 bp, Artificial
  CRISPR gRNA sequence
tccactattccttccttcat

SEQ ID NO: 494969 - DNA, 20 bp, Artificial
  CRISPR gRNA sequence
ccactattccttccttcatg

SEQ ID NO: 494970 - DNA, 20 bp, Artificial
  CRISPR gRNA sequence
cactattccttccttcatgg

SEQ ID NO: 494971 - DNA, 20 bp, Artificial
  CRISPR gRNA sequence
ttccttccttcatggctctt

SEQ ID NO: 494972 - DNA, 20 bp, Artificial
  CRISPR gRNA sequence
cttccttcatggctcttcct

SEQ ID NO: 494973 - DNA, 20 bp, Artificial
  CRISPR gRNA sequence
ccttcatggctcttcctcat

SEQ ID NO: 494974 - DNA, 20 bp, Artificial
  CRISPR gRNA sequence
cttcatggctcttcctcatt

SEQ ID NO: 494975 - DNA, 20 bp, Artificial
  CRISPR gRNA sequence
catggctcttcctcatttga

SEQ ID NO: 494976 - DNA, 20 bp, Artificial
  CRISPR gRNA sequence
atggctcttcctcatttgaa

SEQ ID NO: 494977 - DNA, 20 bp, Artificial
  CRISPR gRNA sequence
ttcctcatttgaacttctac

SEQ ID NO: 494978 - DNA, 20 bp, Artificial
  CRISPR gRNA sequence
cctcatttgaacttctactt

SEQ ID NO: 494979 - DNA, 20 bp, Artificial
  CRISPR gRNA sequence
ctcatttgaacttctactta

SEQ ID NO: 494980 - DNA, 20 bp, Artificial
  CRISPR gRNA sequence
atttgaacttctacttaaaa

SEQ ID NO: 494981 - DNA, 20 bp, Artificial
  CRISPR gRNA sequence
gaacttctacttaaaagatt

SEQ ID NO: 494982 - DNA, 20 bp, Artificial
  CRISPR gRNA sequence
aacttctacttaaaagattt

SEQ ID NO: 494983 - DNA, 20 bp, Artificial
  CRISPR gRNA sequence
ctacttaaaagatttgtgtc

SEQ ID NO: 494984 - DNA, 20 bp, Artificial
  CRISPR gRNA sequence
tacttaaaagatttgtgtca

SEQ ID NO: 494985 - DNA, 20 bp, Artificial
  CRISPR gRNA sequence
cttaaaagatttgtgtcaca

SEQ ID NO: 494986 - DNA, 20 bp, Artificial
  CRISPR gRNA sequence
aaaagatttgtgtcacacat

SEQ ID NO: 494987 - DNA, 20 bp, Artificial
  CRISPR gRNA sequence
aaagatttgtgtcacacatg

SEQ ID NO: 494988 - DNA, 20 bp, Artificial
  CRISPR gRNA sequence
gtgtcacacatgtagcctga

SEQ ID NO: 494989 - DNA, 20 bp, Artificial
  CRISPR gRNA sequence
tgtcacacatgtagcctgat

SEQ ID NO: 494990 - DNA, 20 bp, Artificial
  CRISPR gRNA sequence
atatataatccagccaacaa

SEQ ID NO: 494991 - DNA, 20 bp, Artificial
  CRISPR gRNA sequence
agtgttccaagggctgacaa

SEQ ID NO: 494992 - DNA, 20 bp, Artificial
  CRISPR gRNA sequence
caagggctgacaaggctctt

SEQ ID NO: 494993 - DNA, 20 bp, Artificial
  CRISPR gRNA sequence
acaaggctctttgcaaacat

SEQ ID NO: 494994 - DNA, 20 bp, Artificial
  CRISPR gRNA sequence
tttgcaaacattatctcatt

SEQ ID NO: 494995 - DNA, 20 bp, Artificial
  CRISPR gRNA sequence
tgcaaacattatctcattta

SEQ ID NO: 494996 - DNA, 20 bp, Artificial
  CRISPR gRNA sequence
gcaaacattatctcatttac

SEQ ID NO: 494997 - DNA, 20 bp, Artificial
  CRISPR gRNA sequence
caaacattatctcatttact

SEQ ID NO: 494998 - DNA, 20 bp, Artificial
  CRISPR gRNA sequence
tctcatttactcttaacagc

SEQ ID NO: 494999 - DNA, 20 bp, Artificial
  CRISPR gRNA sequence
atttactcttaacagcaatc

SEQ ID NO: 495000 - DNA, 20 bp, Artificial
  CRISPR gRNA sequence
actcttaacagcaatcctgt

SEQ ID NO: 495001 - DNA, 20 bp, Artificial
  CRISPR gRNA sequence
ctcttaacagcaatcctgtg

SEQ ID NO: 495002 - DNA, 20 bp, Artificial
  CRISPR gRNA sequence
ttaacagcaatcctgtgagg

SEQ ID NO: 495003 - DNA, 20 bp, Artificial
  CRISPR gRNA sequence
aacagcaatcctgtgaggta

SEQ ID NO: 495004 - DNA, 20 bp, Artificial
  CRISPR gRNA sequence
acagcaatcctgtgaggtac

SEQ ID NO: 495005 - DNA, 20 bp, Artificial
  CRISPR gRNA sequence
tgaggtacttattatcaccc

SEQ ID NO: 495006 - DNA, 20 bp, Artificial
  CRISPR gRNA sequence
attatcacccccattttact

SEQ ID NO: 495007 - DNA, 20 bp, Artificial
  CRISPR gRNA sequence
ttatcacccccattttactc

SEQ ID NO: 495008 - DNA, 20 bp, Artificial
  CRISPR gRNA sequence
tcacccccattttactcaag

SEQ ID NO: 495009 - DNA, 20 bp, Artificial
  CRISPR gRNA sequence
tactcaaggggggaagaaaa

SEQ ID NO: 495010 - DNA, 20 bp, Artificial
  CRISPR gRNA sequence
actcaaggggggaagaaaat

SEQ ID NO: 495011 - DNA, 20 bp, Artificial
  CRISPR gRNA sequence
ctcaaggggggaagaaaatt

SEQ ID NO: 495012 - DNA, 20 bp, Artificial
  CRISPR gRNA sequence
aaggggggaagaaaattgag

SEQ ID NO: 495013 - DNA, 20 bp, Artificial
  CRISPR gRNA sequence
aggctcagagaggttaatga

SEQ ID NO: 495014 - DNA, 20 bp, Artificial
  CRISPR gRNA sequence
agagaggttaatgaatctgc

SEQ ID NO: 495015 - DNA, 20 bp, Artificial
  CRISPR gRNA sequence
atgaatctgccagagatcac

SEQ ID NO: 495016 - DNA, 20 bp, Artificial
  CRISPR gRNA sequence
ccagagatcacagagcttct

SEQ ID NO: 495017 - DNA, 20 bp, Artificial
  CRISPR gRNA sequence
cttttttttttttttttaaa

SEQ ID NO: 495018 - DNA, 20 bp, Artificial
  CRISPR gRNA sequence
ttttttttttttttttaaat

SEQ ID NO: 495019 - DNA, 20 bp, Artificial
  CRISPR gRNA sequence
ttttttttttttttaaatag

SEQ ID NO: 495020 - DNA, 20 bp, Artificial
  CRISPR gRNA sequence
tttttttttttttaaataga

SEQ ID NO: 495021 - DNA, 20 bp, Artificial
  CRISPR gRNA sequence
ttttttttttttaaatagag

SEQ ID NO: 495022 - DNA, 20 bp, Artificial
  CRISPR gRNA sequence
tttttttttttaaatagaga

SEQ ID NO: 495023 - DNA, 20 bp, Artificial
  CRISPR gRNA sequence
ttttttttttaaatagagat

SEQ ID NO: 495024 - DNA, 20 bp, Artificial
  CRISPR gRNA sequence
tttttttttaaatagagatg

SEQ ID NO: 495025 - DNA, 20 bp, Artificial
  CRISPR gRNA sequence
ttttttttaaatagagatgg

SEQ ID NO: 495026 - DNA, 20 bp, Artificial
  CRISPR gRNA sequence
tttttttaaatagagatggg

SEQ ID NO: 495027 - DNA, 20 bp, Artificial
  CRISPR gRNA sequence
ttttttaaatagagatggga

SEQ ID NO: 495028 - DNA, 20 bp, Artificial
  CRISPR gRNA sequence
tttttaaatagagatgggat

SEQ ID NO: 495029 - DNA, 20 bp, Artificial
  CRISPR gRNA sequence
ttttaaatagagatgggatt

SEQ ID NO: 495030 - DNA, 20 bp, Artificial
  CRISPR gRNA sequence
tttaaatagagatgggatta

SEQ ID NO: 495031 - DNA, 20 bp, Artificial
  CRISPR gRNA sequence
ttaaatagagatgggattac

SEQ ID NO: 495032 - DNA, 20 bp, Artificial
  CRISPR gRNA sequence
taaatagagatgggattaca

SEQ ID NO: 495033 - DNA, 20 bp, Artificial
  CRISPR gRNA sequence
aaatagagatgggattacac

SEQ ID NO: 495034 - DNA, 20 bp, Artificial
  CRISPR gRNA sequence
aatagagatgggattacacc

SEQ ID NO: 495035 - DNA, 20 bp, Artificial
  CRISPR gRNA sequence
caccatattgtccaggctgg

SEQ ID NO: 495036 - DNA, 20 bp, Artificial
  CRISPR gRNA sequence
tccaggctggtctcaaacac

SEQ ID NO: 495037 - DNA, 20 bp, Artificial
  CRISPR gRNA sequence
gtctcaaacacctggactca

SEQ ID NO: 495038 - DNA, 20 bp, Artificial
  CRISPR gRNA sequence
aaacacctggactcaagtga

SEQ ID NO: 495039 - DNA, 20 bp, Artificial
  CRISPR gRNA sequence
gactcaagtgatccacctgc

SEQ ID NO: 495040 - DNA, 20 bp, Artificial
  CRISPR gRNA sequence
aagtgatccacctgcctcag

SEQ ID NO: 495041 - DNA, 20 bp, Artificial
  CRISPR gRNA sequence
cctcagcctcccaaagtgct

SEQ ID NO: 495042 - DNA, 20 bp, Artificial
  CRISPR gRNA sequence
agcctcccaaagtgctagga

SEQ ID NO: 495043 - DNA, 20 bp, Artificial
  CRISPR gRNA sequence
ccaaagtgctaggattacat

SEQ ID NO: 495044 - DNA, 20 bp, Artificial
  CRISPR gRNA sequence
ggattacatgtgtgagccac

SEQ ID NO: 495045 - DNA, 20 bp, Artificial
  CRISPR gRNA sequence
catgtgtgagccaccacacc

SEQ ID NO: 495046 - DNA, 20 bp, Artificial
  CRISPR gRNA sequence
acctctaagagatcacagag

SEQ ID NO: 495047 - DNA, 20 bp, Artificial
  CRISPR gRNA sequence
taagagatcacagagcttct

SEQ ID NO: 495048 - DNA, 20 bp, Artificial
  CRISPR gRNA sequence
agagatcacagagcttctga

SEQ ID NO: 495049 - DNA, 20 bp, Artificial
  CRISPR gRNA sequence
ctgaatgatgaagccagtgt

SEQ ID NO: 495050 - DNA, 20 bp, Artificial
  CRISPR gRNA sequence
tgaatgatgaagccagtgtc

SEQ ID NO: 495051 - DNA, 20 bp, Artificial
  CRISPR gRNA sequence
aatgatgaagccagtgtcct

SEQ ID NO: 495052 - DNA, 20 bp, Artificial
  CRISPR gRNA sequence
gttcagtggcatgatcttga

SEQ ID NO: 495053 - DNA, 20 bp, Artificial
  CRISPR gRNA sequence
agtggcatgatcttgactca

SEQ ID NO: 495054 - DNA, 20 bp, Artificial
  CRISPR gRNA sequence
gactcactgcaacctccgcc

SEQ ID NO: 495055 - DNA, 20 bp, Artificial
  CRISPR gRNA sequence
actcactgcaacctccgcct

SEQ ID NO: 495056 - DNA, 20 bp, Artificial
  CRISPR gRNA sequence
actgcaacctccgcctcctg

SEQ ID NO: 495057 - DNA, 20 bp, Artificial
  CRISPR gRNA sequence
caacctccgcctcctgggtt

SEQ ID NO: 495058 - DNA, 20 bp, Artificial
  CRISPR gRNA sequence
cgcctcctgggttcaagcaa

SEQ ID NO: 495059 - DNA, 20 bp, Artificial
  CRISPR gRNA sequence
ctgggttcaagcaattctcc

SEQ ID NO: 495060 - DNA, 20 bp, Artificial
  CRISPR gRNA sequence
ggttcaagcaattctcctgc

SEQ ID NO: 495061 - DNA, 20 bp, Artificial
  CRISPR gRNA sequence
aagcaattctcctgcctcag

SEQ ID NO: 495062 - DNA, 20 bp, Artificial
  CRISPR gRNA sequence
tcctgcctcagcctcctgag

SEQ ID NO: 495063 - DNA, 20 bp, Artificial
  CRISPR gRNA sequence
ctgcctcagcctcctgagta

SEQ ID NO: 495064 - DNA, 20 bp, Artificial
  CRISPR gRNA sequence
cctcagcctcctgagtagct

SEQ ID NO: 495065 - DNA, 20 bp, Artificial
  CRISPR gRNA sequence
agcctcctgagtagctgaga

SEQ ID NO: 495066 - DNA, 20 bp, Artificial
  CRISPR gRNA sequence
ctgagtagctgagattacag

SEQ ID NO: 495067 - DNA, 20 bp, Artificial
  CRISPR gRNA sequence
agtagctgagattacaggtg

SEQ ID NO: 495068 - DNA, 20 bp, Artificial
  CRISPR gRNA sequence
agattacaggtgcccgccaa

SEQ ID NO: 495069 - DNA, 20 bp, Artificial
  CRISPR gRNA sequence
caggtgcccgccaacacgcc

SEQ ID NO: 495070 - DNA, 20 bp, Artificial
  CRISPR gRNA sequence
attttttgtatttttagtag

SEQ ID NO: 495071 - DNA, 20 bp, Artificial
  CRISPR gRNA sequence
tttgtatttttagtagagac

SEQ ID NO: 495072 - DNA, 20 bp, Artificial
  CRISPR gRNA sequence
ttgtatttttagtagagaca

SEQ ID NO: 495073 - DNA, 20 bp, Artificial
  CRISPR gRNA sequence
tgtatttttagtagagacag

SEQ ID NO: 495074 - DNA, 20 bp, Artificial
  CRISPR gRNA sequence
gtatttttagtagagacagg

SEQ ID NO: 495075 - DNA, 20 bp, Artificial
  CRISPR gRNA sequence
tatttttagtagagacaggg

SEQ ID NO: 495076 - DNA, 20 bp, Artificial
  CRISPR gRNA sequence
ttagtagagacagggtttca

SEQ ID NO: 495077 - DNA, 20 bp, Artificial
  CRISPR gRNA sequence
tagtagagacagggtttcac

SEQ ID NO: 495078 - DNA, 20 bp, Artificial
  CRISPR gRNA sequence
agtagagacagggtttcacc

SEQ ID NO: 495079 - DNA, 20 bp, Artificial
  CRISPR gRNA sequence
gtagagacagggtttcacca

SEQ ID NO: 495080 - DNA, 20 bp, Artificial
  CRISPR gRNA sequence
caccatgttggccaggctgg

SEQ ID NO: 495081 - DNA, 20 bp, Artificial
  CRISPR gRNA sequence
accatgttggccaggctggt

SEQ ID NO: 495082 - DNA, 20 bp, Artificial
  CRISPR gRNA sequence
gccaggctggtctcaaactc

SEQ ID NO: 495083 - DNA, 20 bp, Artificial
  CRISPR gRNA sequence
gtctcaaactcctgaccttg

SEQ ID NO: 495084 - DNA, 20 bp, Artificial
  CRISPR gRNA sequence
aaactcctgaccttgtgatc

SEQ ID NO: 495085 - DNA, 20 bp, Artificial
  CRISPR gRNA sequence
ctgaccttgtgatccaccca

SEQ ID NO: 495086 - DNA, 20 bp, Artificial
  CRISPR gRNA sequence
accttgtgatccacccacct

SEQ ID NO: 495087 - DNA, 20 bp, Artificial
  CRISPR gRNA sequence
gtgatccacccacctcagcc

SEQ ID NO: 495088 - DNA, 20 bp, Artificial
  CRISPR gRNA sequence
tgatccacccacctcagcct

SEQ ID NO: 495089 - DNA, 20 bp, Artificial
  CRISPR gRNA sequence
agcctcccaaagtgctggga

SEQ ID NO: 495090 - DNA, 20 bp, Artificial
  CRISPR gRNA sequence
ccaaagtgctgggattacag

SEQ ID NO: 495091 - DNA, 20 bp, Artificial
  CRISPR gRNA sequence
ggattacagggagccactgc

SEQ ID NO: 495092 - DNA, 20 bp, Artificial
  CRISPR gRNA sequence
cagggagccactgcgcccgg

SEQ ID NO: 495093 - DNA, 20 bp, Artificial
  CRISPR gRNA sequence
cgcccggcctgcctcagtct

SEQ ID NO: 495094 - DNA, 20 bp, Artificial
  CRISPR gRNA sequence
cctcagtcttgtttcttttt

SEQ ID NO: 495095 - DNA, 20 bp, Artificial
  CRISPR gRNA sequence
agtcttgtttcttttttgtc

SEQ ID NO: 495096 - DNA, 20 bp, Artificial
  CRISPR gRNA sequence
gtttcttttttgtccacaag

SEQ ID NO: 495097 - DNA, 20 bp, Artificial
  CRISPR gRNA sequence
tttcttttttgtccacaagt

SEQ ID NO: 495098 - DNA, 20 bp, Artificial
  CRISPR gRNA sequence
cttttttgtccacaagtagt

SEQ ID NO: 495099 - DNA, 20 bp, Artificial
  CRISPR gRNA sequence
ttttttgtccacaagtagtt

SEQ ID NO: 495100 - DNA, 20 bp, Artificial
  CRISPR gRNA sequence
ttttgtccacaagtagttat

SEQ ID NO: 495101 - DNA, 20 bp, Artificial
  CRISPR gRNA sequence
tttgtccacaagtagttatt

SEQ ID NO: 495102 - DNA, 20 bp, Artificial
  CRISPR gRNA sequence
ttgtccacaagtagttattt

SEQ ID NO: 495103 - DNA, 20 bp, Artificial
  CRISPR gRNA sequence
tgtccacaagtagttatttt

SEQ ID NO: 495104 - DNA, 20 bp, Artificial
  CRISPR gRNA sequence
gtccacaagtagttattttt

SEQ ID NO: 495105 - DNA, 20 bp, Artificial
  CRISPR gRNA sequence
tccacaagtagttatttttg

SEQ ID NO: 495106 - DNA, 20 bp, Artificial
  CRISPR gRNA sequence
tttttgttgccccatttggc

SEQ ID NO: 495107 - DNA, 20 bp, Artificial
  CRISPR gRNA sequence
ttgttgccccatttggctat

SEQ ID NO: 495108 - DNA, 20 bp, Artificial
  CRISPR gRNA sequence
tgttgccccatttggctata

SEQ ID NO: 495109 - DNA, 20 bp, Artificial
  CRISPR gRNA sequence
gttgccccatttggctataa

SEQ ID NO: 495110 - DNA, 20 bp, Artificial
  CRISPR gRNA sequence
ttgccccatttggctataag

SEQ ID NO: 495111 - DNA, 20 bp, Artificial
  CRISPR gRNA sequence
ccccatttggctataagttc

SEQ ID NO: 495112 - DNA, 20 bp, Artificial
  CRISPR gRNA sequence
ggctataagttccttatgaa

SEQ ID NO: 495113 - DNA, 20 bp, Artificial
  CRISPR gRNA sequence
gctataagttccttatgaat

SEQ ID NO: 495114 - DNA, 20 bp, Artificial
  CRISPR gRNA sequence
taagttccttatgaatgaga

SEQ ID NO: 495115 - DNA, 20 bp, Artificial
  CRISPR gRNA sequence
cttatgaatgagagctgtat

SEQ ID NO: 495116 - DNA, 20 bp, Artificial
  CRISPR gRNA sequence
atgaatgagagctgtatggt

SEQ ID NO: 495117 - DNA, 20 bp, Artificial
  CRISPR gRNA sequence
tgaatgagagctgtatggtt

SEQ ID NO: 495118 - DNA, 20 bp, Artificial
  CRISPR gRNA sequence
tatggtttttttttcctata

SEQ ID NO: 495119 - DNA, 20 bp, Artificial
  CRISPR gRNA sequence
ttttttcctataatgcccat

SEQ ID NO: 495120 - DNA, 20 bp, Artificial
  CRISPR gRNA sequence
tttttcctataatgcccatg

SEQ ID NO: 495121 - DNA, 20 bp, Artificial
  CRISPR gRNA sequence
ttttcctataatgcccatgc

SEQ ID NO: 495122 - DNA, 20 bp, Artificial
  CRISPR gRNA sequence
tttcctataatgcccatgct

SEQ ID NO: 495123 - DNA, 20 bp, Artificial
  CRISPR gRNA sequence
ttcctataatgcccatgctg

SEQ ID NO: 495124 - DNA, 20 bp, Artificial
  CRISPR gRNA sequence
tcctataatgcccatgctgc

SEQ ID NO: 495125 - DNA, 20 bp, Artificial
  CRISPR gRNA sequence
cctataatgcccatgctgct

SEQ ID NO: 495126 - DNA, 20 bp, Artificial
  CRISPR gRNA sequence
ctataatgcccatgctgctg

SEQ ID NO: 495127 - DNA, 20 bp, Artificial
  CRISPR gRNA sequence
taatgcccatgctgctggta

SEQ ID NO: 495128 - DNA, 20 bp, Artificial
  CRISPR gRNA sequence
ctggtacattaagtccctgt

SEQ ID NO: 495129 - DNA, 20 bp, Artificial
  CRISPR gRNA sequence
gtacattaagtccctgttta

SEQ ID NO: 495130 - DNA, 20 bp, Artificial
  CRISPR gRNA sequence
agtccctgtttatgtaataa

SEQ ID NO: 495131 - DNA, 20 bp, Artificial
  CRISPR gRNA sequence
tttatgtaataaaaagttgt

SEQ ID NO: 495132 - DNA, 20 bp, Artificial
  CRISPR gRNA sequence
atgtaataaaaagttgtgga

SEQ ID NO: 495133 - DNA, 20 bp, Artificial
  CRISPR gRNA sequence
tgtaataaaaagttgtggaa

SEQ ID NO: 495134 - DNA, 20 bp, Artificial
  CRISPR gRNA sequence
tggaacggtaactcaggtaa

SEQ ID NO: 495135 - DNA, 20 bp, Artificial
  CRISPR gRNA sequence
aggtaactcttaggatgagc

SEQ ID NO: 495136 - DNA, 20 bp, Artificial
  CRISPR gRNA sequence
ttaggatgagcataagcaac

SEQ ID NO: 495137 - DNA, 20 bp, Artificial
  CRISPR gRNA sequence
aggatgagcataagcaacag

SEQ ID NO: 495138 - DNA, 20 bp, Artificial
  CRISPR gRNA sequence
ggatgagcataagcaacagc

SEQ ID NO: 495139 - DNA, 20 bp, Artificial
  CRISPR gRNA sequence
atctaggtatccctggggtc

SEQ ID NO: 495140 - DNA, 20 bp, Artificial
  CRISPR gRNA sequence
ggtatccctggggtcatcct

SEQ ID NO: 495141 - DNA, 20 bp, Artificial
  CRISPR gRNA sequence
gggtcatcctgatgctcctg

SEQ ID NO: 495142 - DNA, 20 bp, Artificial
  CRISPR gRNA sequence
atgctcctgctccaggctac

SEQ ID NO: 495143 - DNA, 20 bp, Artificial
  CRISPR gRNA sequence
ctgctccaggctactgctgc

SEQ ID NO: 495144 - DNA, 20 bp, Artificial
  CRISPR gRNA sequence
ctccaggctactgctgcaca

SEQ ID NO: 495145 - DNA, 20 bp, Artificial
  CRISPR gRNA sequence
caggctactgctgcacagtg

SEQ ID NO: 495146 - DNA, 20 bp, Artificial
  CRISPR gRNA sequence
ctgctgcacagtgtagttac

SEQ ID NO: 495147 - DNA, 20 bp, Artificial
  CRISPR gRNA sequence
ctgcacagtgtagttacctc

SEQ ID NO: 495148 - DNA, 20 bp, Artificial
  CRISPR gRNA sequence
cacagtgtagttacctcttg

SEQ ID NO: 495149 - DNA, 20 bp, Artificial
  CRISPR gRNA sequence
cctcttgaactatgtggctt

SEQ ID NO: 495150 - DNA, 20 bp, Artificial
  CRISPR gRNA sequence
ttgaactatgtggcttggag

SEQ ID NO: 495151 - DNA, 20 bp, Artificial
  CRISPR gRNA sequence
gaactatgtggcttggagaa

SEQ ID NO: 495152 - DNA, 20 bp, Artificial
  CRISPR gRNA sequence
aactatgtggcttggagaaa

SEQ ID NO: 495153 - DNA, 20 bp, Artificial
  CRISPR gRNA sequence
tgtggcttggagaaagttat

SEQ ID NO: 495154 - DNA, 20 bp, Artificial
  CRISPR gRNA sequence
ggagaaagttatcactcaag

SEQ ID NO: 495155 - DNA, 20 bp, Artificial
  CRISPR gRNA sequence
gagaaagttatcactcaaga

SEQ ID NO: 495156 - DNA, 20 bp, Artificial
  CRISPR gRNA sequence
tcactcaagaggagaggaca

SEQ ID NO: 495157 - DNA, 20 bp, Artificial
  CRISPR gRNA sequence
aagaggagaggacagttctc

SEQ ID NO: 495158 - DNA, 20 bp, Artificial
  CRISPR gRNA sequence
tccatcagcctctcccagga

SEQ ID NO: 495159 - DNA, 20 bp, Artificial
  CRISPR gRNA sequence
catcagcctctcccaggaag

SEQ ID NO: 495160 - DNA, 20 bp, Artificial
  CRISPR gRNA sequence
tcccaggaagaaaataatgt

SEQ ID NO: 495161 - DNA, 20 bp, Artificial
  CRISPR gRNA sequence
ccaggaagaaaataatgttc

SEQ ID NO: 495162 - DNA, 20 bp, Artificial
  CRISPR gRNA sequence
aggagccatttcaggactgt

SEQ ID NO: 495163 - DNA, 20 bp, Artificial
  CRISPR gRNA sequence
caggactgtcactcaccaaa

SEQ ID NO: 495164 - DNA, 20 bp, Artificial
  CRISPR gRNA sequence
aggactgtcactcaccaaac

SEQ ID NO: 495165 - DNA, 20 bp, Artificial
  CRISPR gRNA sequence
tcactcaccaaacaactatg

SEQ ID NO: 495166 - DNA, 20 bp, Artificial
  CRISPR gRNA sequence
accaaacaactatgccctcc

SEQ ID NO: 495167 - DNA, 20 bp, Artificial
  CRISPR gRNA sequence
tgccctccctctgcagaaga

SEQ ID NO: 495168 - DNA, 20 bp, Artificial
  CRISPR gRNA sequence
cctctgcagaagaaaagctt

SEQ ID NO: 495169 - DNA, 20 bp, Artificial
  CRISPR gRNA sequence
tgcagaagaaaagcttgcat

SEQ ID NO: 495170 - DNA, 20 bp, Artificial
  CRISPR gRNA sequence
cagaagaaaagcttgcatct

SEQ ID NO: 495171 - DNA, 20 bp, Artificial
  CRISPR gRNA sequence
gcatctcccagaaggaaata

SEQ ID NO: 495172 - DNA, 20 bp, Artificial
  CRISPR gRNA sequence
catctcccagaaggaaatag

SEQ ID NO: 495173 - DNA, 20 bp, Artificial
  CRISPR gRNA sequence
ccagaaggaaatagggataa

SEQ ID NO: 495174 - DNA, 20 bp, Artificial
  CRISPR gRNA sequence
ttttccagagtaggataggc

SEQ ID NO: 495175 - DNA, 20 bp, Artificial
  CRISPR gRNA sequence
tttccagagtaggataggcc

SEQ ID NO: 495176 - DNA, 20 bp, Artificial
  CRISPR gRNA sequence
ttccagagtaggataggcct

SEQ ID NO: 495177 - DNA, 20 bp, Artificial
  CRISPR gRNA sequence
tccagagtaggataggccta

SEQ ID NO: 495178 - DNA, 20 bp, Artificial
  CRISPR gRNA sequence
ccagagtaggataggcctag

SEQ ID NO: 495179 - DNA, 20 bp, Artificial
  CRISPR gRNA sequence
cagagtaggataggcctagc

SEQ ID NO: 495180 - DNA, 20 bp, Artificial
  CRISPR gRNA sequence
gctttacaggaactgtgtgc

SEQ ID NO: 495181 - DNA, 20 bp, Artificial
  CRISPR gRNA sequence
tacaggaactgtgtgcctgg

SEQ ID NO: 495182 - DNA, 20 bp, Artificial
  CRISPR gRNA sequence
acaggaactgtgtgcctgga

SEQ ID NO: 495183 - DNA, 20 bp, Artificial
  CRISPR gRNA sequence
caggaactgtgtgcctggag

SEQ ID NO: 495184 - DNA, 20 bp, Artificial
  CRISPR gRNA sequence
tgtgcctggaggccagggct

SEQ ID NO: 495185 - DNA, 20 bp, Artificial
  CRISPR gRNA sequence
gaggccagggctaccctggg

SEQ ID NO: 495186 - DNA, 20 bp, Artificial
  CRISPR gRNA sequence
ccctgggaagggctacaagg

SEQ ID NO: 495187 - DNA, 20 bp, Artificial
  CRISPR gRNA sequence
ggaagggctacaaggcactg

SEQ ID NO: 495188 - DNA, 20 bp, Artificial
  CRISPR gRNA sequence
caaggcactgggagaggagg

SEQ ID NO: 495189 - DNA, 20 bp, Artificial
  CRISPR gRNA sequence
ggagaggaggccaagggatt

SEQ ID NO: 495190 - DNA, 20 bp, Artificial
  CRISPR gRNA sequence
tatctcataccacatctgtc

SEQ ID NO: 495191 - DNA, 20 bp, Artificial
  CRISPR gRNA sequence
atctcataccacatctgtct

SEQ ID NO: 495192 - DNA, 20 bp, Artificial
  CRISPR gRNA sequence
tctcataccacatctgtctt

SEQ ID NO: 495193 - DNA, 20 bp, Artificial
  CRISPR gRNA sequence
ataccacatctgtcttgcac

SEQ ID NO: 495194 - DNA, 20 bp, Artificial
  CRISPR gRNA sequence
tcttgcacatgagcctggtt

SEQ ID NO: 495195 - DNA, 20 bp, Artificial
  CRISPR gRNA sequence
gcacatgagcctggttgcgg

SEQ ID NO: 495196 - DNA, 20 bp, Artificial
  CRISPR gRNA sequence
cacatgagcctggttgcggg

SEQ ID NO: 495197 - DNA, 20 bp, Artificial
  CRISPR gRNA sequence
gttgcggggtccaaaccttc

SEQ ID NO: 495198 - DNA, 20 bp, Artificial
  CRISPR gRNA sequence
cggggtccaaaccttcagcg

SEQ ID NO: 495199 - DNA, 20 bp, Artificial
  CRISPR gRNA sequence
cagcgcttgttatagcccag

SEQ ID NO: 495200 - DNA, 20 bp, Artificial
  CRISPR gRNA sequence
agcgcttgttatagcccagt

SEQ ID NO: 495201 - DNA, 20 bp, Artificial
  CRISPR gRNA sequence
gttatagcccagtgtgttcc

SEQ ID NO: 495202 - DNA, 20 bp, Artificial
  CRISPR gRNA sequence
ttatagcccagtgtgttcca

SEQ ID NO: 495203 - DNA, 20 bp, Artificial
  CRISPR gRNA sequence
tagcccagtgtgttccactt

SEQ ID NO: 495204 - DNA, 20 bp, Artificial
  CRISPR gRNA sequence
cacttaccctgatgggcatt

SEQ ID NO: 495205 - DNA, 20 bp, Artificial
  CRISPR gRNA sequence
accctgatgggcattctgac

SEQ ID NO: 495206 - DNA, 20 bp, Artificial
  CRISPR gRNA sequence
ccctgatgggcattctgaca

SEQ ID NO: 495207 - DNA, 20 bp, Artificial
  CRISPR gRNA sequence
atgggcattctgacagtcct

SEQ ID NO: 495208 - DNA, 20 bp, Artificial
  CRISPR gRNA sequence
tgacagtcctgagtgagatt

SEQ ID NO: 495209 - DNA, 20 bp, Artificial
  CRISPR gRNA sequence
acagtcctgagtgagattca

SEQ ID NO: 495210 - DNA, 20 bp, Artificial
  CRISPR gRNA sequence
agtgagattcagggtgtggc

SEQ ID NO: 495211 - DNA, 20 bp, Artificial
  CRISPR gRNA sequence
agggtgtggctttcccagct

SEQ ID NO: 495212 - DNA, 20 bp, Artificial
  CRISPR gRNA sequence
tcccagctaacaggattgct

SEQ ID NO: 495213 - DNA, 20 bp, Artificial
  CRISPR gRNA sequence
cccagctaacaggattgctg

SEQ ID NO: 495214 - DNA, 20 bp, Artificial
  CRISPR gRNA sequence
ccagctaacaggattgctga

SEQ ID NO: 495215 - DNA, 20 bp, Artificial
  CRISPR gRNA sequence
acaggattgctgacattgca

SEQ ID NO: 495216 - DNA, 20 bp, Artificial
  CRISPR gRNA sequence
ctgacattgcaggtatatgt

SEQ ID NO: 495217 - DNA, 20 bp, Artificial
  CRISPR gRNA sequence
acattgcaggtatatgtgtg

SEQ ID NO: 495218 - DNA, 20 bp, Artificial
  CRISPR gRNA sequence
caggtatatgtgtgagtgcc

SEQ ID NO: 495219 - DNA, 20 bp, Artificial
  CRISPR gRNA sequence
atgtcaacctcctcgtccag

SEQ ID NO: 495220 - DNA, 20 bp, Artificial
  CRISPR gRNA sequence
ctcgtccaggtaggtgaggt

SEQ ID NO: 495221 - DNA, 20 bp, Artificial
  CRISPR gRNA sequence
gtccaggtaggtgaggttcc

SEQ ID NO: 495222 - DNA, 20 bp, Artificial
  CRISPR gRNA sequence
cctgctgtctggatcagctt

SEQ ID NO: 495223 - DNA, 20 bp, Artificial
  CRISPR gRNA sequence
ctgtctggatcagcttgctc

SEQ ID NO: 495224 - DNA, 20 bp, Artificial
  CRISPR gRNA sequence
tctggatcagcttgctccct

SEQ ID NO: 495225 - DNA, 20 bp, Artificial
  CRISPR gRNA sequence
gatcagcttgctccctctgt

SEQ ID NO: 495226 - DNA, 20 bp, Artificial
  CRISPR gRNA sequence
gctccctctgtaccaagcat

SEQ ID NO: 495227 - DNA, 20 bp, Artificial
  CRISPR gRNA sequence
ctccctctgtaccaagcata

SEQ ID NO: 495228 - DNA, 20 bp, Artificial
  CRISPR gRNA sequence
cctctgtaccaagcatagga

SEQ ID NO: 495229 - DNA, 20 bp, Artificial
  CRISPR gRNA sequence
tgtaccaagcataggacaca

SEQ ID NO: 495230 - DNA, 20 bp, Artificial
  CRISPR gRNA sequence
taccaagcataggacacatt

SEQ ID NO: 495231 - DNA, 20 bp, Artificial
  CRISPR gRNA sequence
ccatccctggagaccaagca

SEQ ID NO: 495232 - DNA, 20 bp, Artificial
  CRISPR gRNA sequence
gagaccaagcaagacagagc

SEQ ID NO: 495233 - DNA, 20 bp, Artificial
  CRISPR gRNA sequence
ggcatctccctctgtccagg

SEQ ID NO: 495234 - DNA, 20 bp, Artificial
  CRISPR gRNA sequence
gcatctccctctgtccagga

SEQ ID NO: 495235 - DNA, 20 bp, Artificial
  CRISPR gRNA sequence
cctctgtccaggatcttccc

SEQ ID NO: 495236 - DNA, 20 bp, Artificial
  CRISPR gRNA sequence
tgtccaggatcttcccctgc

SEQ ID NO: 495237 - DNA, 20 bp, Artificial
  CRISPR gRNA sequence
tccaggatcttcccctgccc

SEQ ID NO: 495238 - DNA, 20 bp, Artificial
  CRISPR gRNA sequence
cccctgcccctgtaggcggg

SEQ ID NO: 495239 - DNA, 20 bp, Artificial
  CRISPR gRNA sequence
ccctgcccctgtaggcgggg

SEQ ID NO: 495240 - DNA, 20 bp, Artificial
  CRISPR gRNA sequence
cccctgtaggcggggtttct

SEQ ID NO: 495241 - DNA, 20 bp, Artificial
  CRISPR gRNA sequence
taggcggggtttctcaactt

SEQ ID NO: 495242 - DNA, 20 bp, Artificial
  CRISPR gRNA sequence
ctcaactttatctggaagca

SEQ ID NO: 495243 - DNA, 20 bp, Artificial
  CRISPR gRNA sequence
tcaactttatctggaagcag

SEQ ID NO: 495244 - DNA, 20 bp, Artificial
  CRISPR gRNA sequence
aactttatctggaagcagag

SEQ ID NO: 495245 - DNA, 20 bp, Artificial
  CRISPR gRNA sequence
tatctggaagcagagattct

SEQ ID NO: 495246 - DNA, 20 bp, Artificial
  CRISPR gRNA sequence
atctggaagcagagattctg

SEQ ID NO: 495247 - DNA, 20 bp, Artificial
  CRISPR gRNA sequence
tctggaagcagagattctga

SEQ ID NO: 495248 - DNA, 20 bp, Artificial
  CRISPR gRNA sequence
gaagcagagattctgatcag

SEQ ID NO: 495249 - DNA, 20 bp, Artificial
  CRISPR gRNA sequence
tgatcagaaaggcattggaa

SEQ ID NO: 495250 - DNA, 20 bp, Artificial
  CRISPR gRNA sequence
atcagaaaggcattggaaat

SEQ ID NO: 495251 - DNA, 20 bp, Artificial
  CRISPR gRNA sequence
gaaatacagaacttagaggc

SEQ ID NO: 495252 - DNA, 20 bp, Artificial
  CRISPR gRNA sequence
agaggcctataggaatcaga

SEQ ID NO: 495253 - DNA, 20 bp, Artificial
  CRISPR gRNA sequence
gaggcctataggaatcagag

SEQ ID NO: 495254 - DNA, 20 bp, Artificial
  CRISPR gRNA sequence
taggaatcagagagggcagt

SEQ ID NO: 495255 - DNA, 20 bp, Artificial
  CRISPR gRNA sequence
gagacttaccaaatacaaaa

SEQ ID NO: 495256 - DNA, 20 bp, Artificial
  CRISPR gRNA sequence
accaaatacaaaaacctgga

SEQ ID NO: 495257 - DNA, 20 bp, Artificial
  CRISPR gRNA sequence
ccaaatacaaaaacctggaa

SEQ ID NO: 495258 - DNA, 20 bp, Artificial
  CRISPR gRNA sequence
gaacgtggctgtctgaactt

SEQ ID NO: 495259 - DNA, 20 bp, Artificial
  CRISPR gRNA sequence
tctgaacttttccagatata

SEQ ID NO: 495260 - DNA, 20 bp, Artificial
  CRISPR gRNA sequence
aacttttccagatatactgg

SEQ ID NO: 495261 - DNA, 20 bp, Artificial
  CRISPR gRNA sequence
ttccagatatactggtgacc

SEQ ID NO: 495262 - DNA, 20 bp, Artificial
  CRISPR gRNA sequence
tccagatatactggtgacct

SEQ ID NO: 495263 - DNA, 20 bp, Artificial
  CRISPR gRNA sequence
ccagatatactggtgacctc

SEQ ID NO: 495264 - DNA, 20 bp, Artificial
  CRISPR gRNA sequence
cagatatactggtgacctcc

SEQ ID NO: 495265 - DNA, 20 bp, Artificial
  CRISPR gRNA sequence
gtgacctccaggcagtagag

SEQ ID NO: 495266 - DNA, 20 bp, Artificial
  CRISPR gRNA sequence
caggcagtagaggccactgt

SEQ ID NO: 495267 - DNA, 20 bp, Artificial
  CRISPR gRNA sequence
tcctgctgctgagctgcctt

SEQ ID NO: 495268 - DNA, 20 bp, Artificial
  CRISPR gRNA sequence
ctgctgagctgccttgatga

SEQ ID NO: 495269 - DNA, 20 bp, Artificial
  CRISPR gRNA sequence
ctgagctgccttgatgagaa

SEQ ID NO: 495270 - DNA, 20 bp, Artificial
  CRISPR gRNA sequence
agctgccttgatgagaagac

SEQ ID NO: 495271 - DNA, 20 bp, Artificial
  CRISPR gRNA sequence
ccttgatgagaagactcaag

SEQ ID NO: 495272 - DNA, 20 bp, Artificial
  CRISPR gRNA sequence
gatgagaagactcaagttct

SEQ ID NO: 495273 - DNA, 20 bp, Artificial
  CRISPR gRNA sequence
atgagaagactcaagttctt

SEQ ID NO: 495274 - DNA, 20 bp, Artificial
  CRISPR gRNA sequence
aagttcttgactataaaact

SEQ ID NO: 495275 - DNA, 20 bp, Artificial
  CRISPR gRNA sequence
ttgactataaaactgaatct

SEQ ID NO: 495276 - DNA, 20 bp, Artificial
  CRISPR gRNA sequence
gactataaaactgaatctat

SEQ ID NO: 495277 - DNA, 20 bp, Artificial
  CRISPR gRNA sequence
actataaaactgaatctatc

SEQ ID NO: 495278 - DNA, 20 bp, Artificial
  CRISPR gRNA sequence
taaaactgaatctatcattg

SEQ ID NO: 495279 - DNA, 20 bp, Artificial
  CRISPR gRNA sequence
aatctatcattggaagtatt

SEQ ID NO: 495280 - DNA, 20 bp, Artificial
  CRISPR gRNA sequence
tcattggaagtattggaagg

SEQ ID NO: 495281 - DNA, 20 bp, Artificial
  CRISPR gRNA sequence
gaagtattggaaggcaaaga

SEQ ID NO: 495282 - DNA, 20 bp, Artificial
  CRISPR gRNA sequence
gaaggcaaagagccattctc

SEQ ID NO: 495283 - DNA, 20 bp, Artificial
  CRISPR gRNA sequence
tcccacttcaatatgtgatg

SEQ ID NO: 495284 - DNA, 20 bp, Artificial
  CRISPR gRNA sequence
ccacttcaatatgtgatgaa

SEQ ID NO: 495285 - DNA, 20 bp, Artificial
  CRISPR gRNA sequence
caatatgtgatgaaatccat

SEQ ID NO: 495286 - DNA, 20 bp, Artificial
  CRISPR gRNA sequence
aatatgtgatgaaatccatt

SEQ ID NO: 495287 - DNA, 20 bp, Artificial
  CRISPR gRNA sequence
tgtgagggcagcaacttctt

SEQ ID NO: 495288 - DNA, 20 bp, Artificial
  CRISPR gRNA sequence
gtgagggcagcaacttcttc

SEQ ID NO: 495289 - DNA, 20 bp, Artificial
  CRISPR gRNA sequence
tgagggcagcaacttcttcc

SEQ ID NO: 495290 - DNA, 20 bp, Artificial
  CRISPR gRNA sequence
cttccatgcaatgctgtcaa

SEQ ID NO: 495291 - DNA, 20 bp, Artificial
  CRISPR gRNA sequence
ttccatgcaatgctgtcaac

SEQ ID NO: 495292 - DNA, 20 bp, Artificial
  CRISPR gRNA sequence
ccatgcaatgctgtcaacct

SEQ ID NO: 495293 - DNA, 20 bp, Artificial
  CRISPR gRNA sequence
catgcaatgctgtcaacctt

SEQ ID NO: 495294 - DNA, 20 bp, Artificial
  CRISPR gRNA sequence
tcaaccttcgtctgtatgct

SEQ ID NO: 495295 - DNA, 20 bp, Artificial
  CRISPR gRNA sequence
cgtctgtatgctgtttggtt

SEQ ID NO: 495296 - DNA, 20 bp, Artificial
  CRISPR gRNA sequence
gtctgtatgctgtttggttg

SEQ ID NO: 495297 - DNA, 20 bp, Artificial
  CRISPR gRNA sequence
tatgctgtttggttgtaact

SEQ ID NO: 495298 - DNA, 20 bp, Artificial
  CRISPR gRNA sequence
tttggttgtaactgaagagg

SEQ ID NO: 495299 - DNA, 20 bp, Artificial
  CRISPR gRNA sequence
ggttgtaactgaagaggcac

SEQ ID NO: 495300 - DNA, 20 bp, Artificial
  CRISPR gRNA sequence
gttgtaactgaagaggcact

SEQ ID NO: 495301 - DNA, 20 bp, Artificial
  CRISPR gRNA sequence
taactgaagaggcactcccg

SEQ ID NO: 495302 - DNA, 20 bp, Artificial
  CRISPR gRNA sequence
aagaggcactcccgagatgc

SEQ ID NO: 495303 - DNA, 20 bp, Artificial
  CRISPR gRNA sequence
ccgagatgctaaccacatgg

SEQ ID NO: 495304 - DNA, 20 bp, Artificial
  CRISPR gRNA sequence
accacatggtcagctgatcc

SEQ ID NO: 495305 - DNA, 20 bp, Artificial
  CRISPR gRNA sequence
atccctggcatcctaggaaa

SEQ ID NO: 495306 - DNA, 20 bp, Artificial
  CRISPR gRNA sequence
gcatcctaggaaagagaacc

SEQ ID NO: 495307 - DNA, 20 bp, Artificial
  CRISPR gRNA sequence
ggaaagagaacccaagctga

SEQ ID NO: 495308 - DNA, 20 bp, Artificial
  CRISPR gRNA sequence
aaagtagcgggaagagtgtc

SEQ ID NO: 495309 - DNA, 20 bp, Artificial
  CRISPR gRNA sequence
agcaatgtgggcagctggat

SEQ ID NO: 495310 - DNA, 20 bp, Artificial
  CRISPR gRNA sequence
gatgtgacttcccttaagcc

SEQ ID NO: 495311 - DNA, 20 bp, Artificial
  CRISPR gRNA sequence
cccttaagccaattgggtgg

SEQ ID NO: 495312 - DNA, 20 bp, Artificial
  CRISPR gRNA sequence
ccttaagccaattgggtggg

SEQ ID NO: 495313 - DNA, 20 bp, Artificial
  CRISPR gRNA sequence
aagccaattgggtggggatg

SEQ ID NO: 495314 - DNA, 20 bp, Artificial
  CRISPR gRNA sequence
agccaattgggtggggatga

SEQ ID NO: 495315 - DNA, 20 bp, Artificial
  CRISPR gRNA sequence
ggtggggatgagtatgagga

SEQ ID NO: 495316 - DNA, 20 bp, Artificial
  CRISPR gRNA sequence
ggagcaccttaaagcatatc

SEQ ID NO: 495317 - DNA, 20 bp, Artificial
  CRISPR gRNA sequence
aaagcatatcccctccatct

SEQ ID NO: 495318 - DNA, 20 bp, Artificial
  CRISPR gRNA sequence
aagcatatcccctccatctg

SEQ ID NO: 495319 - DNA, 20 bp, Artificial
  CRISPR gRNA sequence
catctgcctccccttgtccc

SEQ ID NO: 495320 - DNA, 20 bp, Artificial
  CRISPR gRNA sequence
cctccccttgtccccaagct

SEQ ID NO: 495321 - DNA, 20 bp, Artificial
  CRISPR gRNA sequence
cccttgtccccaagctctgt

SEQ ID NO: 495322 - DNA, 20 bp, Artificial
  CRISPR gRNA sequence
gtccccaagctctgtgtccc

SEQ ID NO: 495323 - DNA, 20 bp, Artificial
  CRISPR gRNA sequence
tccccaagctctgtgtccct

SEQ ID NO: 495324 - DNA, 20 bp, Artificial
  CRISPR gRNA sequence
tgtgtccctagtctgaggga

SEQ ID NO: 495325 - DNA, 20 bp, Artificial
  CRISPR gRNA sequence
tgtccctagtctgagggatc

SEQ ID NO: 495326 - DNA, 20 bp, Artificial
  CRISPR gRNA sequence
gtctgagggatcccatagac

SEQ ID NO: 495327 - DNA, 20 bp, Artificial
  CRISPR gRNA sequence
agggatcccatagaccaata

SEQ ID NO: 495328 - DNA, 20 bp, Artificial
  CRISPR gRNA sequence
aaatcttgagtacttactat

SEQ ID NO: 495329 - DNA, 20 bp, Artificial
  CRISPR gRNA sequence
gagtacttactatgtgacag

SEQ ID NO: 495330 - DNA, 20 bp, Artificial
  CRISPR gRNA sequence
agtacttactatgtgacagg

SEQ ID NO: 495331 - DNA, 20 bp, Artificial
  CRISPR gRNA sequence
actatgtgacaggcaggttt

SEQ ID NO: 495332 - DNA, 20 bp, Artificial
  CRISPR gRNA sequence
ctatgtgacaggcaggtttc

SEQ ID NO: 495333 - DNA, 20 bp, Artificial
  CRISPR gRNA sequence
tgtgacaggcaggtttcaca

SEQ ID NO: 495334 - DNA, 20 bp, Artificial
  CRISPR gRNA sequence
cacactttatacattttaac

SEQ ID NO: 495335 - DNA, 20 bp, Artificial
  CRISPR gRNA sequence
acactttatacattttaact

SEQ ID NO: 495336 - DNA, 20 bp, Artificial
  CRISPR gRNA sequence
tatacattttaactatttaa

SEQ ID NO: 495337 - DNA, 20 bp, Artificial
  CRISPR gRNA sequence
atacattttaactatttaag

SEQ ID NO: 495338 - DNA, 20 bp, Artificial
  CRISPR gRNA sequence
tacattttaactatttaagt

SEQ ID NO: 495339 - DNA, 20 bp, Artificial
  CRISPR gRNA sequence
taactatttaagttaaaagg

SEQ ID NO: 495340 - DNA, 20 bp, Artificial
  CRISPR gRNA sequence
aactatttaagttaaaaggt

SEQ ID NO: 495341 - DNA, 20 bp, Artificial
  CRISPR gRNA sequence
actatttaagttaaaaggta

SEQ ID NO: 495342 - DNA, 20 bp, Artificial
  CRISPR gRNA sequence
tttaagttaaaaggtatgat

SEQ ID NO: 495343 - DNA, 20 bp, Artificial
  CRISPR gRNA sequence
aagttaaaaggtatgatgag

SEQ ID NO: 495344 - DNA, 20 bp, Artificial
  CRISPR gRNA sequence
agttaaaaggtatgatgagt

SEQ ID NO: 495345 - DNA, 20 bp, Artificial
  CRISPR gRNA sequence
aaaggtatgatgagttaaaa

SEQ ID NO: 495346 - DNA, 20 bp, Artificial
  CRISPR gRNA sequence
aaagaatgatgagcctgaaa

SEQ ID NO: 495347 - DNA, 20 bp, Artificial
  CRISPR gRNA sequence
aaacctagtcagtttggtgt

SEQ ID NO: 495348 - DNA, 20 bp, Artificial
  CRISPR gRNA sequence
gtcagtttggtgttatgttt

SEQ ID NO: 495349 - DNA, 20 bp, Artificial
  CRISPR gRNA sequence
ggtgttatgtttttgttttc

SEQ ID NO: 495350 - DNA, 20 bp, Artificial
  CRISPR gRNA sequence
gtgttatgtttttgttttct

SEQ ID NO: 495351 - DNA, 20 bp, Artificial
  CRISPR gRNA sequence
tgtttttgttttcttttgtt

SEQ ID NO: 495352 - DNA, 20 bp, Artificial
  CRISPR gRNA sequence
ttgttttcttttgttttgtt

SEQ ID NO: 495353 - DNA, 20 bp, Artificial
  CRISPR gRNA sequence
tgttttcttttgttttgttt

SEQ ID NO: 495354 - DNA, 20 bp, Artificial
  CRISPR gRNA sequence
gttttcttttgttttgtttt

SEQ ID NO: 495355 - DNA, 20 bp, Artificial
  CRISPR gRNA sequence
ttttcttttgttttgttttc

SEQ ID NO: 495356 - DNA, 20 bp, Artificial
  CRISPR gRNA sequence
tcttttgttttgttttctag

SEQ ID NO: 495357 - DNA, 20 bp, Artificial
  CRISPR gRNA sequence
cttttgttttgttttctaga

SEQ ID NO: 495358 - DNA, 20 bp, Artificial
  CRISPR gRNA sequence
ttttgttttgttttctagag

SEQ ID NO: 495359 - DNA, 20 bp, Artificial
  CRISPR gRNA sequence
ttgttttgttttctagagac

SEQ ID NO: 495360 - DNA, 20 bp, Artificial
  CRISPR gRNA sequence
tgttttgttttctagagaca

SEQ ID NO: 495361 - DNA, 20 bp, Artificial
  CRISPR gRNA sequence
gttttgttttctagagacag

SEQ ID NO: 495362 - DNA, 20 bp, Artificial
  CRISPR gRNA sequence
ttttgttttctagagacagg

SEQ ID NO: 495363 - DNA, 20 bp, Artificial
  CRISPR gRNA sequence
tgttttctagagacagggtc

SEQ ID NO: 495364 - DNA, 20 bp, Artificial
  CRISPR gRNA sequence
gttttctagagacagggtct

SEQ ID NO: 495365 - DNA, 20 bp, Artificial
  CRISPR gRNA sequence
ttttctagagacagggtctc

SEQ ID NO: 495366 - DNA, 20 bp, Artificial
  CRISPR gRNA sequence
tctagagacagggtctcact

SEQ ID NO: 495367 - DNA, 20 bp, Artificial
  CRISPR gRNA sequence
ctagagacagggtctcactc

SEQ ID NO: 495368 - DNA, 20 bp, Artificial
  CRISPR gRNA sequence
tagagacagggtctcactct

SEQ ID NO: 495369 - DNA, 20 bp, Artificial
  CRISPR gRNA sequence
gagacagggtctcactctgt

SEQ ID NO: 495370 - DNA, 20 bp, Artificial
  CRISPR gRNA sequence
actctgtcacccaggctgga

SEQ ID NO: 495371 - DNA, 20 bp, Artificial
  CRISPR gRNA sequence
tgtcacccaggctggagtgc

SEQ ID NO: 495372 - DNA, 20 bp, Artificial
  CRISPR gRNA sequence
tcacccaggctggagtgcag

SEQ ID NO: 495373 - DNA, 20 bp, Artificial
  CRISPR gRNA sequence
gagtgcagtggcgcaatcac

SEQ ID NO: 495374 - DNA, 20 bp, Artificial
  CRISPR gRNA sequence
actgcagccttgaactcctg

SEQ ID NO: 495375 - DNA, 20 bp, Artificial
  CRISPR gRNA sequence
cagccttgaactcctgggct

SEQ ID NO: 495376 - DNA, 20 bp, Artificial
  CRISPR gRNA sequence
gaactcctgggcttgaggtg

SEQ ID NO: 495377 - DNA, 20 bp, Artificial
  CRISPR gRNA sequence
aactcctgggcttgaggtga

SEQ ID NO: 495378 - DNA, 20 bp, Artificial
  CRISPR gRNA sequence
ctgggcttgaggtgatcctc

SEQ ID NO: 495379 - DNA, 20 bp, Artificial
  CRISPR gRNA sequence
ggcttgaggtgatcctccca

SEQ ID NO: 495380 - DNA, 20 bp, Artificial
  CRISPR gRNA sequence
gaggtgatcctcccatctca

SEQ ID NO: 495381 - DNA, 20 bp, Artificial
  CRISPR gRNA sequence
aggtgatcctcccatctcaa

SEQ ID NO: 495382 - DNA, 20 bp, Artificial
  CRISPR gRNA sequence
ccatctcaacctccctagta

SEQ ID NO: 495383 - DNA, 20 bp, Artificial
  CRISPR gRNA sequence
aacctccctagtagctggga

SEQ ID NO: 495384 - DNA, 20 bp, Artificial
  CRISPR gRNA sequence
cctagtagctgggagcacag

SEQ ID NO: 495385 - DNA, 20 bp, Artificial
  CRISPR gRNA sequence
gtagctgggagcacaggtgc

SEQ ID NO: 495386 - DNA, 20 bp, Artificial
  CRISPR gRNA sequence
ggagcacaggtgctagggag

SEQ ID NO: 495387 - DNA, 20 bp, Artificial
  CRISPR gRNA sequence
gggagcttatttgtttactc

SEQ ID NO: 495388 - DNA, 20 bp, Artificial
  CRISPR gRNA sequence
atttgtttactctttgtaaa

SEQ ID NO: 495389 - DNA, 20 bp, Artificial
  CRISPR gRNA sequence
tttgtttactctttgtaaag

SEQ ID NO: 495390 - DNA, 20 bp, Artificial
  CRISPR gRNA sequence
gtttactctttgtaaagaca

SEQ ID NO: 495391 - DNA, 20 bp, Artificial
  CRISPR gRNA sequence
tttactctttgtaaagacag

SEQ ID NO: 495392 - DNA, 20 bp, Artificial
  CRISPR gRNA sequence
actctttgtaaagacagcag

SEQ ID NO: 495393 - DNA, 20 bp, Artificial
  CRISPR gRNA sequence
ctctttgtaaagacagcagt

SEQ ID NO: 495394 - DNA, 20 bp, Artificial
  CRISPR gRNA sequence
tttgtaaagacagcagtttg

SEQ ID NO: 495395 - DNA, 20 bp, Artificial
  CRISPR gRNA sequence
tgtaaagacagcagtttggc

SEQ ID NO: 495396 - DNA, 20 bp, Artificial
  CRISPR gRNA sequence
gtaaagacagcagtttggct

SEQ ID NO: 495397 - DNA, 20 bp, Artificial
  CRISPR gRNA sequence
taaagacagcagtttggctt

SEQ ID NO: 495398 - DNA, 20 bp, Artificial
  CRISPR gRNA sequence
ggcttgagaggataaattct

SEQ ID NO: 495399 - DNA, 20 bp, Artificial
  CRISPR gRNA sequence
gcttgagaggataaattctt

SEQ ID NO: 495400 - DNA, 20 bp, Artificial
  CRISPR gRNA sequence
gagaggataaattcttaacc

SEQ ID NO: 495401 - DNA, 20 bp, Artificial
  CRISPR gRNA sequence
agaggataaattcttaacca

SEQ ID NO: 495402 - DNA, 20 bp, Artificial
  CRISPR gRNA sequence
ttaaccatgatgctataaat

SEQ ID NO: 495403 - DNA, 20 bp, Artificial
  CRISPR gRNA sequence
aaccatgatgctataaatac

SEQ ID NO: 495404 - DNA, 20 bp, Artificial
  CRISPR gRNA sequence
accatgatgctataaatacc

SEQ ID NO: 495405 - DNA, 20 bp, Artificial
  CRISPR gRNA sequence
taaataccacatctaaggtg

SEQ ID NO: 495406 - DNA, 20 bp, Artificial
  CRISPR gRNA sequence
aggtgactccctccaagcag

SEQ ID NO: 495407 - DNA, 20 bp, Artificial
  CRISPR gRNA sequence
cctccaagcagtgctgaggc

SEQ ID NO: 495408 - DNA, 20 bp, Artificial
  CRISPR gRNA sequence
caagcagtgctgaggcaact

SEQ ID NO: 495409 - DNA, 20 bp, Artificial
  CRISPR gRNA sequence
aggcaactactaatggcaag

SEQ ID NO: 495410 - DNA, 20 bp, Artificial
  CRISPR gRNA sequence
ctaatggcaagtagtgactg

SEQ ID NO: 495411 - DNA, 20 bp, Artificial
  CRISPR gRNA sequence
atggcaagtagtgactgttg

SEQ ID NO: 495412 - DNA, 20 bp, Artificial
  CRISPR gRNA sequence
ttggaaattctgaatggtca

SEQ ID NO: 495413 - DNA, 20 bp, Artificial
  CRISPR gRNA sequence
gaaattctgaatggtcaggc

SEQ ID NO: 495414 - DNA, 20 bp, Artificial
  CRISPR gRNA sequence
tgaatggtcaggcccaggaa

SEQ ID NO: 495415 - DNA, 20 bp, Artificial
  CRISPR gRNA sequence
aatggtcaggcccaggaaga

SEQ ID NO: 495416 - DNA, 20 bp, Artificial
  CRISPR gRNA sequence
accgtccaagctgaactcat

SEQ ID NO: 495417 - DNA, 20 bp, Artificial
  CRISPR gRNA sequence
aactcatggcccctcaacca

SEQ ID NO: 495418 - DNA, 20 bp, Artificial
  CRISPR gRNA sequence
atggcccctcaaccatcctc

SEQ ID NO: 495419 - DNA, 20 bp, Artificial
  CRISPR gRNA sequence
aaccatcctctcacagagct

SEQ ID NO: 495420 - DNA, 20 bp, Artificial
  CRISPR gRNA sequence
tcacagagctgaatacataa

SEQ ID NO: 495421 - DNA, 20 bp, Artificial
  CRISPR gRNA sequence
acagagctgaatacataatc

SEQ ID NO: 495422 - DNA, 20 bp, Artificial
  CRISPR gRNA sequence
aatacataatcctctctcgt

SEQ ID NO: 495423 - DNA, 20 bp, Artificial
  CRISPR gRNA sequence
tctcgtggcacttggttcat

SEQ ID NO: 495424 - DNA, 20 bp, Artificial
  CRISPR gRNA sequence
tcgtggcacttggttcattg

SEQ ID NO: 495425 - DNA, 20 bp, Artificial
  CRISPR gRNA sequence
gtggcacttggttcattgga

SEQ ID NO: 495426 - DNA, 20 bp, Artificial
  CRISPR gRNA sequence
ggttcattggattttggtca

SEQ ID NO: 495427 - DNA, 20 bp, Artificial
  CRISPR gRNA sequence
gttcattggattttggtcat

SEQ ID NO: 495428 - DNA, 20 bp, Artificial
  CRISPR gRNA sequence
attggattttggtcattact

SEQ ID NO: 495429 - DNA, 20 bp, Artificial
  CRISPR gRNA sequence
gattttggtcattacttatt

SEQ ID NO: 495430 - DNA, 20 bp, Artificial
  CRISPR gRNA sequence
tggtcattacttattgatgt

SEQ ID NO: 495431 - DNA, 20 bp, Artificial
  CRISPR gRNA sequence
ggtcattacttattgatgtt

SEQ ID NO: 495432 - DNA, 20 bp, Artificial
  CRISPR gRNA sequence
gtcattacttattgatgttt

SEQ ID NO: 495433 - DNA, 20 bp, Artificial
  CRISPR gRNA sequence
cttattgatgtttgccagtt

SEQ ID NO: 495434 - DNA, 20 bp, Artificial
  CRISPR gRNA sequence
attgatgtttgccagttttt

SEQ ID NO: 495435 - DNA, 20 bp, Artificial
  CRISPR gRNA sequence
ttgatgtttgccagtttttc

SEQ ID NO: 495436 - DNA, 20 bp, Artificial
  CRISPR gRNA sequence
atgtttgccagtttttcagt

SEQ ID NO: 495437 - DNA, 20 bp, Artificial
  CRISPR gRNA sequence
gccagtttttcagtgatcag

SEQ ID NO: 495438 - DNA, 20 bp, Artificial
  CRISPR gRNA sequence
ccagtttttcagtgatcaga

SEQ ID NO: 495439 - DNA, 20 bp, Artificial
  CRISPR gRNA sequence
ttcagtgatcagaaagtctc

SEQ ID NO: 495440 - DNA, 20 bp, Artificial
  CRISPR gRNA sequence
tcagtgatcagaaagtctcc

SEQ ID NO: 495441 - DNA, 20 bp, Artificial
  CRISPR gRNA sequence
cagtgatcagaaagtctcca

SEQ ID NO: 495442 - DNA, 20 bp, Artificial
  CRISPR gRNA sequence
agtgatcagaaagtctccac

SEQ ID NO: 495443 - DNA, 20 bp, Artificial
  CRISPR gRNA sequence
cacaaaaatttctccctaga

SEQ ID NO: 495444 - DNA, 20 bp, Artificial
  CRISPR gRNA sequence
ctccctagaaaacaatttta

SEQ ID NO: 495445 - DNA, 20 bp, Artificial
  CRISPR gRNA sequence
tccctagaaaacaattttaa

SEQ ID NO: 495446 - DNA, 20 bp, Artificial
  CRISPR gRNA sequence
cctagaaaacaattttaaaa

SEQ ID NO: 495447 - DNA, 20 bp, Artificial
  CRISPR gRNA sequence
gaaaacaattttaaaaataa

SEQ ID NO: 495448 - DNA, 20 bp, Artificial
  CRISPR gRNA sequence
taaaaataaaactacacttc

SEQ ID NO: 495449 - DNA, 20 bp, Artificial
  CRISPR gRNA sequence
aaaaataaaactacacttcc

SEQ ID NO: 495450 - DNA, 20 bp, Artificial
  CRISPR gRNA sequence
aaaataaaactacacttccc

SEQ ID NO: 495451 - DNA, 20 bp, Artificial
  CRISPR gRNA sequence
cacttcccaggcagatccca

SEQ ID NO: 495452 - DNA, 20 bp, Artificial
  CRISPR gRNA sequence
cccaggcagatcccagcact

SEQ ID NO: 495453 - DNA, 20 bp, Artificial
  CRISPR gRNA sequence
ccaggcagatcccagcactt

SEQ ID NO: 495454 - DNA, 20 bp, Artificial
  CRISPR gRNA sequence
gcctctcaaagaatcaagat

SEQ ID NO: 495455 - DNA, 20 bp, Artificial
  CRISPR gRNA sequence
cctctcaaagaatcaagatg

SEQ ID NO: 495456 - DNA, 20 bp, Artificial
  CRISPR gRNA sequence
tcaaagaatcaagatgaaac

SEQ ID NO: 495457 - DNA, 20 bp, Artificial
  CRISPR gRNA sequence
aaagaatcaagatgaaacct

SEQ ID NO: 495458 - DNA, 20 bp, Artificial
  CRISPR gRNA sequence
atgaatatgggggtgtgaca

SEQ ID NO: 495459 - DNA, 20 bp, Artificial
  CRISPR gRNA sequence
gagcaattctgtgcagtcag

SEQ ID NO: 495460 - DNA, 20 bp, Artificial
  CRISPR gRNA sequence
tgtgcagtcagtgtacaaaa

SEQ ID NO: 495461 - DNA, 20 bp, Artificial
  CRISPR gRNA sequence
tgcagtcagtgtacaaaact

SEQ ID NO: 495462 - DNA, 20 bp, Artificial
  CRISPR gRNA sequence
gaagttcctacagccatttt

SEQ ID NO: 495463 - DNA, 20 bp, Artificial
  CRISPR gRNA sequence
ctacagccatttttagtaat

SEQ ID NO: 495464 - DNA, 20 bp, Artificial
  CRISPR gRNA sequence
cagccatttttagtaataaa

SEQ ID NO: 495465 - DNA, 20 bp, Artificial
  CRISPR gRNA sequence
ttagtaataaagctatgtgg

SEQ ID NO: 495466 - DNA, 20 bp, Artificial
  CRISPR gRNA sequence
tagtaataaagctatgtggc

SEQ ID NO: 495467 - DNA, 20 bp, Artificial
  CRISPR gRNA sequence
agtaataaagctatgtggca

SEQ ID NO: 495468 - DNA, 20 bp, Artificial
  CRISPR gRNA sequence
gtaataaagctatgtggcat

SEQ ID NO: 495469 - DNA, 20 bp, Artificial
  CRISPR gRNA sequence
tgtggcatggcccagcaggt

SEQ ID NO: 495470 - DNA, 20 bp, Artificial
  CRISPR gRNA sequence
aaaagtctctctgggtgagt

SEQ ID NO: 495471 - DNA, 20 bp, Artificial
  CRISPR gRNA sequence
tctgggtgagttggggaggc

SEQ ID NO: 495472 - DNA, 20 bp, Artificial
  CRISPR gRNA sequence
tgggtgagttggggaggctc

SEQ ID NO: 495473 - DNA, 20 bp, Artificial
  CRISPR gRNA sequence
ggtgagttggggaggctcag

SEQ ID NO: 495474 - DNA, 20 bp, Artificial
  CRISPR gRNA sequence
gggaggctcagggaggattt

SEQ ID NO: 495475 - DNA, 20 bp, Artificial
  CRISPR gRNA sequence
agggaggatttggaagagaa

SEQ ID NO: 495476 - DNA, 20 bp, Artificial
  CRISPR gRNA sequence
ggaagagaaaataagagatg

SEQ ID NO: 495477 - DNA, 20 bp, Artificial
  CRISPR gRNA sequence
gaagagaaaataagagatgg

SEQ ID NO: 495478 - DNA, 20 bp, Artificial
  CRISPR gRNA sequence
tacaagtggctccgttaaaa

SEQ ID NO: 495479 - DNA, 20 bp, Artificial
  CRISPR gRNA sequence
acaagtggctccgttaaaat

SEQ ID NO: 495480 - DNA, 20 bp, Artificial
  CRISPR gRNA sequence
caagtggctccgttaaaatg

SEQ ID NO: 495481 - DNA, 20 bp, Artificial
  CRISPR gRNA sequence
cgttaaaatggaggctatta

SEQ ID NO: 495482 - DNA, 20 bp, Artificial
  CRISPR gRNA sequence
aaatggaggctattaagaag

SEQ ID NO: 495483 - DNA, 20 bp, Artificial
  CRISPR gRNA sequence
ttaagaagagagcaattgag

SEQ ID NO: 495484 - DNA, 20 bp, Artificial
  CRISPR gRNA sequence
agaagagagcaattgagaca

SEQ ID NO: 495485 - DNA, 20 bp, Artificial
  CRISPR gRNA sequence
agacagaggggtttttatat

SEQ ID NO: 495486 - DNA, 20 bp, Artificial
  CRISPR gRNA sequence
ttatatgtccagtgcattat

SEQ ID NO: 495487 - DNA, 20 bp, Artificial
  CRISPR gRNA sequence
tatatgtccagtgcattatg

SEQ ID NO: 495488 - DNA, 20 bp, Artificial
  CRISPR gRNA sequence
atatgtccagtgcattatga

SEQ ID NO: 495489 - DNA, 20 bp, Artificial
  CRISPR gRNA sequence
tatgtccagtgcattatgaa

SEQ ID NO: 495490 - DNA, 20 bp, Artificial
  CRISPR gRNA sequence
tgaatgcagtctctccaagc

SEQ ID NO: 495491 - DNA, 20 bp, Artificial
  CRISPR gRNA sequence
tccaagccacagcttcaccc

SEQ ID NO: 495492 - DNA, 20 bp, Artificial
  CRISPR gRNA sequence
caagccacagcttcaccctg

SEQ ID NO: 495493 - DNA, 20 bp, Artificial
  CRISPR gRNA sequence
caccctggcattttctcaag

SEQ ID NO: 495494 - DNA, 20 bp, Artificial
  CRISPR gRNA sequence
accctggcattttctcaaga

SEQ ID NO: 495495 - DNA, 20 bp, Artificial
  CRISPR gRNA sequence
gcattttctcaagagactaa

SEQ ID NO: 495496 - DNA, 20 bp, Artificial
  CRISPR gRNA sequence
tctcaagagactaagtaaat

SEQ ID NO: 495497 - DNA, 20 bp, Artificial
  CRISPR gRNA sequence
ctcaagagactaagtaaata

SEQ ID NO: 495498 - DNA, 20 bp, Artificial
  CRISPR gRNA sequence
tcaagagactaagtaaataa

SEQ ID NO: 495499 - DNA, 20 bp, Artificial
  CRISPR gRNA sequence
aagagactaagtaaataatt

SEQ ID NO: 495500 - DNA, 20 bp, Artificial
  CRISPR gRNA sequence
agtaaataattaaaggactt

SEQ ID NO: 495501 - DNA, 20 bp, Artificial
  CRISPR gRNA sequence
aaggacttgtaatactattt

SEQ ID NO: 495502 - DNA, 20 bp, Artificial
  CRISPR gRNA sequence
gtaatactatttgtttgatg

SEQ ID NO: 495503 - DNA, 20 bp, Artificial
  CRISPR gRNA sequence
taatactatttgtttgatga

SEQ ID NO: 495504 - DNA, 20 bp, Artificial
  CRISPR gRNA sequence
tttgtttgatgaaatatgtt

SEQ ID NO: 495505 - DNA, 20 bp, Artificial
  CRISPR gRNA sequence
gtttgatgaaatatgtttct

SEQ ID NO: 495506 - DNA, 20 bp, Artificial
  CRISPR gRNA sequence
tttgatgaaatatgtttctt

SEQ ID NO: 495507 - DNA, 20 bp, Artificial
  CRISPR gRNA sequence
gatgaaatatgtttctttga

SEQ ID NO: 495508 - DNA, 20 bp, Artificial
  CRISPR gRNA sequence
atgaaatatgtttctttgat

SEQ ID NO: 495509 - DNA, 20 bp, Artificial
  CRISPR gRNA sequence
ctttgatcttgatgctccta

SEQ ID NO: 495510 - DNA, 20 bp, Artificial
  CRISPR gRNA sequence
tttgatcttgatgctcctaa

SEQ ID NO: 495511 - DNA, 20 bp, Artificial
  CRISPR gRNA sequence
tgatcttgatgctcctaaga

SEQ ID NO: 495512 - DNA, 20 bp, Artificial
  CRISPR gRNA sequence
gatcttgatgctcctaagac

SEQ ID NO: 495513 - DNA, 20 bp, Artificial
  CRISPR gRNA sequence
atcttgatgctcctaagact

SEQ ID NO: 495514 - DNA, 20 bp, Artificial
  CRISPR gRNA sequence
gatgctcctaagactaaaac

SEQ ID NO: 495515 - DNA, 20 bp, Artificial
  CRISPR gRNA sequence
atgctcctaagactaaaaca

SEQ ID NO: 495516 - DNA, 20 bp, Artificial
  CRISPR gRNA sequence
ctaagactaaaacacatagg

SEQ ID NO: 495517 - DNA, 20 bp, Artificial
  CRISPR gRNA sequence
agactaaaacacataggttc

SEQ ID NO: 495518 - DNA, 20 bp, Artificial
  CRISPR gRNA sequence
aaacacataggttcccattt

SEQ ID NO: 495519 - DNA, 20 bp, Artificial
  CRISPR gRNA sequence
ccatttatatttatatgact

SEQ ID NO: 495520 - DNA, 20 bp, Artificial
  CRISPR gRNA sequence
atatttatatgacttgtact

SEQ ID NO: 495521 - DNA, 20 bp, Artificial
  CRISPR gRNA sequence
tatttatatgacttgtactg

SEQ ID NO: 495522 - DNA, 20 bp, Artificial
  CRISPR gRNA sequence
atatgacttgtactggctct

SEQ ID NO: 495523 - DNA, 20 bp, Artificial
  CRISPR gRNA sequence
tatgacttgtactggctctg

SEQ ID NO: 495524 - DNA, 20 bp, Artificial
  CRISPR gRNA sequence
gtactggctctgcccattag

SEQ ID NO: 495525 - DNA, 20 bp, Artificial
  CRISPR gRNA sequence
tactggctctgcccattagc

SEQ ID NO: 495526 - DNA, 20 bp, Artificial
  CRISPR gRNA sequence
gctctgcccattagcaaacc

SEQ ID NO: 495527 - DNA, 20 bp, Artificial
  CRISPR gRNA sequence
tgcccattagcaaaccaaaa

SEQ ID NO: 495528 - DNA, 20 bp, Artificial
  CRISPR gRNA sequence
cccattagcaaaccaaaagc

SEQ ID NO: 495529 - DNA, 20 bp, Artificial
  CRISPR gRNA sequence
gcaaaccaaaagcttctcaa

SEQ ID NO: 495530 - DNA, 20 bp, Artificial
  CRISPR gRNA sequence
ctcaaaagcagagactgtgc

SEQ ID NO: 495531 - DNA, 20 bp, Artificial
  CRISPR gRNA sequence
tcaaaagcagagactgtgct

SEQ ID NO: 495532 - DNA, 20 bp, Artificial
  CRISPR gRNA sequence
aaaagcagagactgtgctgt

SEQ ID NO: 495533 - DNA, 20 bp, Artificial
  CRISPR gRNA sequence
tgctgtgcatctctgtgtct

SEQ ID NO: 495534 - DNA, 20 bp, Artificial
  CRISPR gRNA sequence
tgcatctctgtgtctctgtc

SEQ ID NO: 495535 - DNA, 20 bp, Artificial
  CRISPR gRNA sequence
tgtgtctctgtctcctacga

SEQ ID NO: 495536 - DNA, 20 bp, Artificial
  CRISPR gRNA sequence
tgtctctgtctcctacgatc

SEQ ID NO: 495537 - DNA, 20 bp, Artificial
  CRISPR gRNA sequence
tgtctcctacgatcctagca

SEQ ID NO: 495538 - DNA, 20 bp, Artificial
  CRISPR gRNA sequence
tctcctacgatcctagcact

SEQ ID NO: 495539 - DNA, 20 bp, Artificial
  CRISPR gRNA sequence
ctacgatcctagcactattt

SEQ ID NO: 495540 - DNA, 20 bp, Artificial
  CRISPR gRNA sequence
cgatcctagcactatttata

SEQ ID NO: 495541 - DNA, 20 bp, Artificial
  CRISPR gRNA sequence
gcactatttataagaacaag

SEQ ID NO: 495542 - DNA, 20 bp, Artificial
  CRISPR gRNA sequence
tttataagaacaagtcaacc

SEQ ID NO: 495543 - DNA, 20 bp, Artificial
  CRISPR gRNA sequence
ataagaacaagtcaacctac

SEQ ID NO: 495544 - DNA, 20 bp, Artificial
  CRISPR gRNA sequence
taagaacaagtcaacctacc

SEQ ID NO: 495545 - DNA, 20 bp, Artificial
  CRISPR gRNA sequence
ccaaatattgcacaaagacc

SEQ ID NO: 495546 - DNA, 20 bp, Artificial
  CRISPR gRNA sequence
cacaaagaccctgagaacaa

SEQ ID NO: 495547 - DNA, 20 bp, Artificial
  CRISPR gRNA sequence
agaacaaaggtgaatggaaa

SEQ ID NO: 495548 - DNA, 20 bp, Artificial
  CRISPR gRNA sequence
ctaaacctacaaggaggaca

SEQ ID NO: 495549 - DNA, 20 bp, Artificial
  CRISPR gRNA sequence
aacctacaaggaggacatat

SEQ ID NO: 495550 - DNA, 20 bp, Artificial
  CRISPR gRNA sequence
caaggaggacatatactgtc

SEQ ID NO: 495551 - DNA, 20 bp, Artificial
  CRISPR gRNA sequence
tcttcatcaattattcagtc

SEQ ID NO: 495552 - DNA, 20 bp, Artificial
  CRISPR gRNA sequence
catcaattattcagtcctta

SEQ ID NO: 495553 - DNA, 20 bp, Artificial
  CRISPR gRNA sequence
atcaattattcagtccttac

SEQ ID NO: 495554 - DNA, 20 bp, Artificial
  CRISPR gRNA sequence
ttcagtccttactgagtccc

SEQ ID NO: 495555 - DNA, 20 bp, Artificial
  CRISPR gRNA sequence
agtccttactgagtcccact

SEQ ID NO: 495556 - DNA, 20 bp, Artificial
  CRISPR gRNA sequence
actgagtcccactgcaatcc

SEQ ID NO: 495557 - DNA, 20 bp, Artificial
  CRISPR gRNA sequence
ctgagtcccactgcaatcca

SEQ ID NO: 495558 - DNA, 20 bp, Artificial
  CRISPR gRNA sequence
agtcccactgcaatccagcc

SEQ ID NO: 495559 - DNA, 20 bp, Artificial
  CRISPR gRNA sequence
caatccagcccctgaagagg

SEQ ID NO: 495560 - DNA, 20 bp, Artificial
  CRISPR gRNA sequence
aagaggcagggcctcttcat

SEQ ID NO: 495561 - DNA, 20 bp, Artificial
  CRISPR gRNA sequence
ttcatgtataaggcatgatt

SEQ ID NO: 495562 - DNA, 20 bp, Artificial
  CRISPR gRNA sequence
catgtataaggcatgattcc

SEQ ID NO: 495563 - DNA, 20 bp, Artificial
  CRISPR gRNA sequence
atgtataaggcatgattcct

SEQ ID NO: 495564 - DNA, 20 bp, Artificial
  CRISPR gRNA sequence
ctgactccagagagtttgtg

SEQ ID NO: 495565 - DNA, 20 bp, Artificial
  CRISPR gRNA sequence
actccagagagtttgtgatc

SEQ ID NO: 495566 - DNA, 20 bp, Artificial
  CRISPR gRNA sequence
cagagagtttgtgatctgga

SEQ ID NO: 495567 - DNA, 20 bp, Artificial
  CRISPR gRNA sequence
gtgatctggaaacagaacac

SEQ ID NO: 495568 - DNA, 20 bp, Artificial
  CRISPR gRNA sequence
tgatctggaaacagaacact

SEQ ID NO: 495569 - DNA, 20 bp, Artificial
  CRISPR gRNA sequence
gaaacagaacactttcattc

SEQ ID NO: 495570 - DNA, 20 bp, Artificial
  CRISPR gRNA sequence
tcattctacagcatcccctt

SEQ ID NO: 495571 - DNA, 20 bp, Artificial
  CRISPR gRNA sequence
cattctacagcatcccctta

SEQ ID NO: 495572 - DNA, 20 bp, Artificial
  CRISPR gRNA sequence
attctacagcatccccttaa

SEQ ID NO: 495573 - DNA, 20 bp, Artificial
  CRISPR gRNA sequence
tacagcatccccttaattgt

SEQ ID NO: 495574 - DNA, 20 bp, Artificial
  CRISPR gRNA sequence
cagcatccccttaattgttg

SEQ ID NO: 495575 - DNA, 20 bp, Artificial
  CRISPR gRNA sequence
aattgttgagataaaaaatc

SEQ ID NO: 495576 - DNA, 20 bp, Artificial
  CRISPR gRNA sequence
attgttgagataaaaaatca

SEQ ID NO: 495577 - DNA, 20 bp, Artificial
  CRISPR gRNA sequence
ttgagataaaaaatcatcga

SEQ ID NO: 495578 - DNA, 20 bp, Artificial
  CRISPR gRNA sequence
agataaaaaatcatcgaagg

SEQ ID NO: 495579 - DNA, 20 bp, Artificial
  CRISPR gRNA sequence
taattatgtaatgaaaatcc

SEQ ID NO: 495580 - DNA, 20 bp, Artificial
  CRISPR gRNA sequence
attatgtaatgaaaatccag

SEQ ID NO: 495581 - DNA, 20 bp, Artificial
  CRISPR gRNA sequence
tgtaatgaaaatccaggtta

SEQ ID NO: 495582 - DNA, 20 bp, Artificial
  CRISPR gRNA sequence
agacatgctaaccaatcctc

SEQ ID NO: 495583 - DNA, 20 bp, Artificial
  CRISPR gRNA sequence
accaatcctcccactaaaaa

SEQ ID NO: 495584 - DNA, 20 bp, Artificial
  CRISPR gRNA sequence
ccactaaaaatagctagaag

SEQ ID NO: 495585 - DNA, 20 bp, Artificial
  CRISPR gRNA sequence
aaaatagctagaagaaaaat

SEQ ID NO: 495586 - DNA, 20 bp, Artificial
  CRISPR gRNA sequence
gaagaaaaatgaacaacatg

SEQ ID NO: 495587 - DNA, 20 bp, Artificial
  CRISPR gRNA sequence
ttaaagttatcagagagttt

SEQ ID NO: 495588 - DNA, 20 bp, Artificial
  CRISPR gRNA sequence
aagttatcagagagtttata

SEQ ID NO: 495589 - DNA, 20 bp, Artificial
  CRISPR gRNA sequence
tcagagagtttataaagcag

SEQ ID NO: 495590 - DNA, 20 bp, Artificial
  CRISPR gRNA sequence
ataaagcagtgaaaaattat

SEQ ID NO: 495591 - DNA, 20 bp, Artificial
  CRISPR gRNA sequence
taaagcagtgaaaaattatg

SEQ ID NO: 495592 - DNA, 20 bp, Artificial
  CRISPR gRNA sequence
tggggccaatatctggaaga

SEQ ID NO: 495593 - DNA, 20 bp, Artificial
  CRISPR gRNA sequence
gaagaaggaaattcagagag

SEQ ID NO: 495594 - DNA, 20 bp, Artificial
  CRISPR gRNA sequence
agagaggtgagatcagcatt

SEQ ID NO: 495595 - DNA, 20 bp, Artificial
  CRISPR gRNA sequence
ctgactgttgttccctggag

SEQ ID NO: 495596 - DNA, 20 bp, Artificial
  CRISPR gRNA sequence
tgactgttgttccctggagg

SEQ ID NO: 495597 - DNA, 20 bp, Artificial
  CRISPR gRNA sequence
actgttgttccctggaggca

SEQ ID NO: 495598 - DNA, 20 bp, Artificial
  CRISPR gRNA sequence
ttgttccctggaggcatctt

SEQ ID NO: 495599 - DNA, 20 bp, Artificial
  CRISPR gRNA sequence
ttccctggaggcatcttctg

SEQ ID NO: 495600 - DNA, 20 bp, Artificial
  CRISPR gRNA sequence
cctggaggcatcttctgatt

SEQ ID NO: 495601 - DNA, 20 bp, Artificial
  CRISPR gRNA sequence
gaggcatcttctgattccat

SEQ ID NO: 495602 - DNA, 20 bp, Artificial
  CRISPR gRNA sequence
ctgattccataaatggcagc

SEQ ID NO: 495603 - DNA, 20 bp, Artificial
  CRISPR gRNA sequence
tgattccataaatggcagct

SEQ ID NO: 495604 - DNA, 20 bp, Artificial
  CRISPR gRNA sequence
attccataaatggcagctaa

SEQ ID NO: 495605 - DNA, 20 bp, Artificial
  CRISPR gRNA sequence
cataaatggcagctaaaagg

SEQ ID NO: 495606 - DNA, 20 bp, Artificial
  CRISPR gRNA sequence
aaaggctgagaagctgagca

SEQ ID NO: 495607 - DNA, 20 bp, Artificial
  CRISPR gRNA sequence
agaagctgagcagagctcac

SEQ ID NO: 495608 - DNA, 20 bp, Artificial
  CRISPR gRNA sequence
agcagagctcacaataaaac

SEQ ID NO: 495609 - DNA, 20 bp, Artificial
  CRISPR gRNA sequence
acaataaaactcaaggaact

SEQ ID NO: 495610 - DNA, 20 bp, Artificial
  CRISPR gRNA sequence
aaggaactaagagaacatga

SEQ ID NO: 495611 - DNA, 20 bp, Artificial
  CRISPR gRNA sequence
agagaacatgaagttcacgt

SEQ ID NO: 495612 - DNA, 20 bp, Artificial
  CRISPR gRNA sequence
acgtccctcctattagaaag

SEQ ID NO: 495613 - DNA, 20 bp, Artificial
  CRISPR gRNA sequence
ctattagaaagcgggtatac

SEQ ID NO: 495614 - DNA, 20 bp, Artificial
  CRISPR gRNA sequence
ttagaaagcgggtatacata

SEQ ID NO: 495615 - DNA, 20 bp, Artificial
  CRISPR gRNA sequence
gaaagcgggtatacataaaa

SEQ ID NO: 495616 - DNA, 20 bp, Artificial
  CRISPR gRNA sequence
aggttggtaccacagagggc

SEQ ID NO: 495617 - DNA, 20 bp, Artificial
  CRISPR gRNA sequence
gtaccacagagggctatacc

SEQ ID NO: 495618 - DNA, 20 bp, Artificial
  CRISPR gRNA sequence
tacccaaagagtaagagtga

SEQ ID NO: 495619 - DNA, 20 bp, Artificial
  CRISPR gRNA sequence
acaggaactgaagctcaatt

SEQ ID NO: 495620 - DNA, 20 bp, Artificial
  CRISPR gRNA sequence
aagctcaattttgaatcatc

SEQ ID NO: 495621 - DNA, 20 bp, Artificial
  CRISPR gRNA sequence
aattttgaatcatcacaacc

SEQ ID NO: 495622 - DNA, 20 bp, Artificial
  CRISPR gRNA sequence
tgaatcatcacaaccctgga

SEQ ID NO: 495623 - DNA, 20 bp, Artificial
  CRISPR gRNA sequence
gaatcatcacaaccctggat

SEQ ID NO: 495624 - DNA, 20 bp, Artificial
  CRISPR gRNA sequence
aatcatcacaaccctggatt

SEQ ID NO: 495625 - DNA, 20 bp, Artificial
  CRISPR gRNA sequence
gattgaactaatgatctgga

SEQ ID NO: 495626 - DNA, 20 bp, Artificial
  CRISPR gRNA sequence
aactaatgatctggaatctc

SEQ ID NO: 495627 - DNA, 20 bp, Artificial
  CRISPR gRNA sequence
atgatctggaatctctggta

SEQ ID NO: 495628 - DNA, 20 bp, Artificial
  CRISPR gRNA sequence
gaatctctggtagccctaac

SEQ ID NO: 495629 - DNA, 20 bp, Artificial
  CRISPR gRNA sequence
tggtagccctaacctggctg

SEQ ID NO: 495630 - DNA, 20 bp, Artificial
  CRISPR gRNA sequence
gtagccctaacctggctgcc

SEQ ID NO: 495631 - DNA, 20 bp, Artificial
  CRISPR gRNA sequence
acctggctgccaactagagg

SEQ ID NO: 495632 - DNA, 20 bp, Artificial
  CRISPR gRNA sequence
gctgccaactagaggcaaat

SEQ ID NO: 495633 - DNA, 20 bp, Artificial
  CRISPR gRNA sequence
ccaactagaggcaaatataa

SEQ ID NO: 495634 - DNA, 20 bp, Artificial
  CRISPR gRNA sequence
gaggcaaatataagttatga

SEQ ID NO: 495635 - DNA, 20 bp, Artificial
  CRISPR gRNA sequence
tgactagaggaaaataacat

SEQ ID NO: 495636 - DNA, 20 bp, Artificial
  CRISPR gRNA sequence
gaggaaaataacatcaacca

SEQ ID NO: 495637 - DNA, 20 bp, Artificial
  CRISPR gRNA sequence
aattattcctagaatgtttc

SEQ ID NO: 495638 - DNA, 20 bp, Artificial
  CRISPR gRNA sequence
ttcctagaatgtttcataca

SEQ ID NO: 495639 - DNA, 20 bp, Artificial
  CRISPR gRNA sequence
ctagaatgtttcatacacaa

SEQ ID NO: 495640 - DNA, 20 bp, Artificial
  CRISPR gRNA sequence
gaatgtttcatacacaatat

SEQ ID NO: 495641 - DNA, 20 bp, Artificial
  CRISPR gRNA sequence
catacacaatatccaaagtg

SEQ ID NO: 495642 - DNA, 20 bp, Artificial
  CRISPR gRNA sequence
atacacaatatccaaagtga

SEQ ID NO: 495643 - DNA, 20 bp, Artificial
  CRISPR gRNA sequence
caaaaaccaacagaagaata

SEQ ID NO: 495644 - DNA, 20 bp, Artificial
  CRISPR gRNA sequence
cataatagagttgtcagtca

SEQ ID NO: 495645 - DNA, 20 bp, Artificial
  CRISPR gRNA sequence
tcagtcataaactttaaagt

SEQ ID NO: 495646 - DNA, 20 bp, Artificial
  CRISPR gRNA sequence
taaagtaatcatgtctaata

SEQ ID NO: 495647 - DNA, 20 bp, Artificial
  CRISPR gRNA sequence
aaagtaatcatgtctaatat

SEQ ID NO: 495648 - DNA, 20 bp, Artificial
  CRISPR gRNA sequence
aagtaatcatgtctaatatg

SEQ ID NO: 495649 - DNA, 20 bp, Artificial
  CRISPR gRNA sequence
atatgttcaaggaaataaaa

SEQ ID NO: 495650 - DNA, 20 bp, Artificial
  CRISPR gRNA sequence
aaggaaataaaacataagtt

SEQ ID NO: 495651 - DNA, 20 bp, Artificial
  CRISPR gRNA sequence
aagaatttcagcagagaact

SEQ ID NO: 495652 - DNA, 20 bp, Artificial
  CRISPR gRNA sequence
agaatttcagcagagaacta

SEQ ID NO: 495653 - DNA, 20 bp, Artificial
  CRISPR gRNA sequence
cagcagagaactagcgtgat

SEQ ID NO: 495654 - DNA, 20 bp, Artificial
  CRISPR gRNA sequence
agcagagaactagcgtgata

SEQ ID NO: 495655 - DNA, 20 bp, Artificial
  CRISPR gRNA sequence
gcgtgatagaatgcaaaaat

SEQ ID NO: 495656 - DNA, 20 bp, Artificial
  CRISPR gRNA sequence
gcaatgtgactttacagctc

SEQ ID NO: 495657 - DNA, 20 bp, Artificial
  CRISPR gRNA sequence
caatgtgactttacagctcc

SEQ ID NO: 495658 - DNA, 20 bp, Artificial
  CRISPR gRNA sequence
tacagctccttctgttatca

SEQ ID NO: 495659 - DNA, 20 bp, Artificial
  CRISPR gRNA sequence
acagctccttctgttatcaa

SEQ ID NO: 495660 - DNA, 20 bp, Artificial
  CRISPR gRNA sequence
cagctccttctgttatcaag

SEQ ID NO: 495661 - DNA, 20 bp, Artificial
  CRISPR gRNA sequence
cttctgttatcaagaaatgg

SEQ ID NO: 495662 - DNA, 20 bp, Artificial
  CRISPR gRNA sequence
ctgttatcaagaaatggggt

SEQ ID NO: 495663 - DNA, 20 bp, Artificial
  CRISPR gRNA sequence
tgttatcaagaaatggggtt

SEQ ID NO: 495664 - DNA, 20 bp, Artificial
  CRISPR gRNA sequence
ttatcaagaaatggggttca

SEQ ID NO: 495665 - DNA, 20 bp, Artificial
  CRISPR gRNA sequence
tcaagaaatggggttcattt

SEQ ID NO: 495666 - DNA, 20 bp, Artificial
  CRISPR gRNA sequence
atttccctgtctcttggaac

SEQ ID NO: 495667 - DNA, 20 bp, Artificial
  CRISPR gRNA sequence
ccctgtctcttggaactggg

SEQ ID NO: 495668 - DNA, 20 bp, Artificial
  CRISPR gRNA sequence
cctgtctcttggaactgggc

SEQ ID NO: 495669 - DNA, 20 bp, Artificial
  CRISPR gRNA sequence
tctcttggaactgggctggt

SEQ ID NO: 495670 - DNA, 20 bp, Artificial
  CRISPR gRNA sequence
ttggaactgggctggtcttc

SEQ ID NO: 495671 - DNA, 20 bp, Artificial
  CRISPR gRNA sequence
ggaactgggctggtcttcat

SEQ ID NO: 495672 - DNA, 20 bp, Artificial
  CRISPR gRNA sequence
gaactgggctggtcttcatg

SEQ ID NO: 495673 - DNA, 20 bp, Artificial
  CRISPR gRNA sequence
ggctggtcttcatgatgaaa

SEQ ID NO: 495674 - DNA, 20 bp, Artificial
  CRISPR gRNA sequence
gtcttcatgatgaaacgcag

SEQ ID NO: 495675 - DNA, 20 bp, Artificial
  CRISPR gRNA sequence
catgatgaaacgcagcaaaa

SEQ ID NO: 495676 - DNA, 20 bp, Artificial
  CRISPR gRNA sequence
atgatgaaacgcagcaaaaa

SEQ ID NO: 495677 - DNA, 20 bp, Artificial
  CRISPR gRNA sequence
tgctagttctaagcctagat

SEQ ID NO: 495678 - DNA, 20 bp, Artificial
  CRISPR gRNA sequence
ctagttctaagcctagatct

SEQ ID NO: 495679 - DNA, 20 bp, Artificial
  CRISPR gRNA sequence
gttctaagcctagatctgaa

SEQ ID NO: 495680 - DNA, 20 bp, Artificial
  CRISPR gRNA sequence
taagcctagatctgaaaagg

SEQ ID NO: 495681 - DNA, 20 bp, Artificial
  CRISPR gRNA sequence
agcctagatctgaaaaggca

SEQ ID NO: 495682 - DNA, 20 bp, Artificial
  CRISPR gRNA sequence
gatctgaaaaggcattgcac

SEQ ID NO: 495683 - DNA, 20 bp, Artificial
  CRISPR gRNA sequence
aaaaggcattgcacatttct

SEQ ID NO: 495684 - DNA, 20 bp, Artificial
  CRISPR gRNA sequence
cacatttctacttgttctct

SEQ ID NO: 495685 - DNA, 20 bp, Artificial
  CRISPR gRNA sequence
ctacttgttctcttggaacc

SEQ ID NO: 495686 - DNA, 20 bp, Artificial
  CRISPR gRNA sequence
tacttgttctcttggaacct

SEQ ID NO: 495687 - DNA, 20 bp, Artificial
  CRISPR gRNA sequence
cttgttctcttggaacctca

SEQ ID NO: 495688 - DNA, 20 bp, Artificial
  CRISPR gRNA sequence
gttctcttggaacctcatct

SEQ ID NO: 495689 - DNA, 20 bp, Artificial
  CRISPR gRNA sequence
ttctcttggaacctcatctg

SEQ ID NO: 495690 - DNA, 20 bp, Artificial
  CRISPR gRNA sequence
tcttggaacctcatctggct

SEQ ID NO: 495691 - DNA, 20 bp, Artificial
  CRISPR gRNA sequence
ttggaacctcatctggctga

SEQ ID NO: 495692 - DNA, 20 bp, Artificial
  CRISPR gRNA sequence
ggaacctcatctggctgacc

SEQ ID NO: 495693 - DNA, 20 bp, Artificial
  CRISPR gRNA sequence
gaacctcatctggctgacct

SEQ ID NO: 495694 - DNA, 20 bp, Artificial
  CRISPR gRNA sequence
atctggctgacctgtgaaca

SEQ ID NO: 495695 - DNA, 20 bp, Artificial
  CRISPR gRNA sequence
gctgacctgtgaacaagcct

SEQ ID NO: 495696 - DNA, 20 bp, Artificial
  CRISPR gRNA sequence
acctgtgaacaagcctaaaa

SEQ ID NO: 495697 - DNA, 20 bp, Artificial
  CRISPR gRNA sequence
tgaacaagcctaaaatagcc

SEQ ID NO: 495698 - DNA, 20 bp, Artificial
  CRISPR gRNA sequence
aaatagcctgctggagaata

SEQ ID NO: 495699 - DNA, 20 bp, Artificial
  CRISPR gRNA sequence
ctggagaataagatatcaca

SEQ ID NO: 495700 - DNA, 20 bp, Artificial
  CRISPR gRNA sequence
gagaataagatatcacatga

SEQ ID NO: 495701 - DNA, 20 bp, Artificial
  CRISPR gRNA sequence
aggccattctaaatcagcta

SEQ ID NO: 495702 - DNA, 20 bp, Artificial
  CRISPR gRNA sequence
taaatcagctagccctggcc

SEQ ID NO: 495703 - DNA, 20 bp, Artificial
  CRISPR gRNA sequence
aatcagctagccctggcctg

SEQ ID NO: 495704 - DNA, 20 bp, Artificial
  CRISPR gRNA sequence
gccctggcctggtgcggtgg

SEQ ID NO: 495705 - DNA, 20 bp, Artificial
  CRISPR gRNA sequence
gcctggtgcggtggctcatg

SEQ ID NO: 495706 - DNA, 20 bp, Artificial
  CRISPR gRNA sequence
gtgcggtggctcatgcccgt

SEQ ID NO: 495707 - DNA, 20 bp, Artificial
  CRISPR gRNA sequence
atgcccgtaattccagcact

SEQ ID NO: 495708 - DNA, 20 bp, Artificial
  CRISPR gRNA sequence
cagcactttgggaggccaag

SEQ ID NO: 495709 - DNA, 20 bp, Artificial
  CRISPR gRNA sequence
tgggaggccaaggccggcag

SEQ ID NO: 495710 - DNA, 20 bp, Artificial
  CRISPR gRNA sequence
gggaggccaaggccggcaga

SEQ ID NO: 495711 - DNA, 20 bp, Artificial
  CRISPR gRNA sequence
ggaggccaaggccggcagat

SEQ ID NO: 495712 - DNA, 20 bp, Artificial
  CRISPR gRNA sequence
aaggtcgggagttcgagacc

SEQ ID NO: 495713 - DNA, 20 bp, Artificial
  CRISPR gRNA sequence
gagaccaccctggccaacat

SEQ ID NO: 495714 - DNA, 20 bp, Artificial
  CRISPR gRNA sequence
gccaacatggtaaaacctcg

SEQ ID NO: 495715 - DNA, 20 bp, Artificial
  CRISPR gRNA sequence
gtctctactaacgatacaaa

SEQ ID NO: 495716 - DNA, 20 bp, Artificial
  CRISPR gRNA sequence
tactaacgatacaaaaatta

SEQ ID NO: 495717 - DNA, 20 bp, Artificial
  CRISPR gRNA sequence
ctaacgatacaaaaattagc

SEQ ID NO: 495718 - DNA, 20 bp, Artificial
  CRISPR gRNA sequence
acgatacaaaaattagccag

SEQ ID NO: 495719 - DNA, 20 bp, Artificial
  CRISPR gRNA sequence
gccagacatggtggcacaca

SEQ ID NO: 495720 - DNA, 20 bp, Artificial
  CRISPR gRNA sequence
gtaaccccagctacttggga

SEQ ID NO: 495721 - DNA, 20 bp, Artificial
  CRISPR gRNA sequence
taaccccagctacttgggag

SEQ ID NO: 495722 - DNA, 20 bp, Artificial
  CRISPR gRNA sequence
cttgggagtctgaggcacga

SEQ ID NO: 495723 - DNA, 20 bp, Artificial
  CRISPR gRNA sequence
gggagtctgaggcacgagaa

SEQ ID NO: 495724 - DNA, 20 bp, Artificial
  CRISPR gRNA sequence
ggagtctgaggcacgagaac

SEQ ID NO: 495725 - DNA, 20 bp, Artificial
  CRISPR gRNA sequence
aggcacgagaactgcttgaa

SEQ ID NO: 495726 - DNA, 20 bp, Artificial
  CRISPR gRNA sequence
cttgaacccgggagatggag

SEQ ID NO: 495727 - DNA, 20 bp, Artificial
  CRISPR gRNA sequence
gaacccgggagatggagctt

SEQ ID NO: 495728 - DNA, 20 bp, Artificial
  CRISPR gRNA sequence
aacccgggagatggagcttg

SEQ ID NO: 495729 - DNA, 20 bp, Artificial
  CRISPR gRNA sequence
gcagtgagccgagatatcat

SEQ ID NO: 495730 - DNA, 20 bp, Artificial
  CRISPR gRNA sequence
cagtgagccgagatatcatg

SEQ ID NO: 495731 - DNA, 20 bp, Artificial
  CRISPR gRNA sequence
cactctagcctgcatgacag

SEQ ID NO: 495732 - DNA, 20 bp, Artificial
  CRISPR gRNA sequence
tagcctgcatgacagagcaa

SEQ ID NO: 495733 - DNA, 20 bp, Artificial
  CRISPR gRNA sequence
gcctgcatgacagagcaaga

SEQ ID NO: 495734 - DNA, 20 bp, Artificial
  CRISPR gRNA sequence
catgacagagcaagacctaa

SEQ ID NO: 495735 - DNA, 20 bp, Artificial
  CRISPR gRNA sequence
atctcaaaaaacaataaaaa

SEQ ID NO: 495736 - DNA, 20 bp, Artificial
  CRISPR gRNA sequence
aaaaaacaataaaaaataaa

SEQ ID NO: 495737 - DNA, 20 bp, Artificial
  CRISPR gRNA sequence
gcagctgaccacacatgcat

SEQ ID NO: 495738 - DNA, 20 bp, Artificial
  CRISPR gRNA sequence
accacacatgcatgactgat

SEQ ID NO: 495739 - DNA, 20 bp, Artificial
  CRISPR gRNA sequence
atgcaagaggaaaccaaaag

SEQ ID NO: 495740 - DNA, 20 bp, Artificial
  CRISPR gRNA sequence
gctgagcccagcccaaattg

SEQ ID NO: 495741 - DNA, 20 bp, Artificial
  CRISPR gRNA sequence
agcccagcccaaattgccaa

SEQ ID NO: 495742 - DNA, 20 bp, Artificial
  CRISPR gRNA sequence
ccaactagcagaatcactaa

SEQ ID NO: 495743 - DNA, 20 bp, Artificial
  CRISPR gRNA sequence
gcagaatcactaactaaata

SEQ ID NO: 495744 - DNA, 20 bp, Artificial
  CRISPR gRNA sequence
actaaataggtagttgtttt

SEQ ID NO: 495745 - DNA, 20 bp, Artificial
  CRISPR gRNA sequence
aataggtagttgttttaaac

SEQ ID NO: 495746 - DNA, 20 bp, Artificial
  CRISPR gRNA sequence
ttttaaactactggattttg

SEQ ID NO: 495747 - DNA, 20 bp, Artificial
  CRISPR gRNA sequence
taaactactggattttggag

SEQ ID NO: 495748 - DNA, 20 bp, Artificial
  CRISPR gRNA sequence
aaactactggattttggagt

SEQ ID NO: 495749 - DNA, 20 bp, Artificial
  CRISPR gRNA sequence
aactactggattttggagta

SEQ ID NO: 495750 - DNA, 20 bp, Artificial
  CRISPR gRNA sequence
ctggattttggagtaggtca

SEQ ID NO: 495751 - DNA, 20 bp, Artificial
  CRISPR gRNA sequence
gattttggagtaggtcatta

SEQ ID NO: 495752 - DNA, 20 bp, Artificial
  CRISPR gRNA sequence
tggagtaggtcattatgcag

SEQ ID NO: 495753 - DNA, 20 bp, Artificial
  CRISPR gRNA sequence
ggagtaggtcattatgcagc

SEQ ID NO: 495754 - DNA, 20 bp, Artificial
  CRISPR gRNA sequence
gagtaggtcattatgcagca

SEQ ID NO: 495755 - DNA, 20 bp, Artificial
  CRISPR gRNA sequence
tgcagcaatagttacctgaa

SEQ ID NO: 495756 - DNA, 20 bp, Artificial
  CRISPR gRNA sequence
cctgaaattggatttttttt

SEQ ID NO: 495757 - DNA, 20 bp, Artificial
  CRISPR gRNA sequence
aaattggattttttttaaag

SEQ ID NO: 495758 - DNA, 20 bp, Artificial
  CRISPR gRNA sequence
gattttttttaaagaattca

SEQ ID NO: 495759 - DNA, 20 bp, Artificial
  CRISPR gRNA sequence
tttttaaagaattcaatgaa

SEQ ID NO: 495760 - DNA, 20 bp, Artificial
  CRISPR gRNA sequence
ttttaaagaattcaatgaaa

SEQ ID NO: 495761 - DNA, 20 bp, Artificial
  CRISPR gRNA sequence
tttaaagaattcaatgaaaa

SEQ ID NO: 495762 - DNA, 20 bp, Artificial
  CRISPR gRNA sequence
ttaaagaattcaatgaaaat

SEQ ID NO: 495763 - DNA, 20 bp, Artificial
  CRISPR gRNA sequence
taaagaattcaatgaaaatt

SEQ ID NO: 495764 - DNA, 20 bp, Artificial
  CRISPR gRNA sequence
aaagaattcaatgaaaatta

SEQ ID NO: 495765 - DNA, 20 bp, Artificial
  CRISPR gRNA sequence
aagaattcaatgaaaattac

SEQ ID NO: 495766 - DNA, 20 bp, Artificial
  CRISPR gRNA sequence
aatgaaaattacagaaataa

SEQ ID NO: 495767 - DNA, 20 bp, Artificial
  CRISPR gRNA sequence
cagaaataaaatgtaaaata

SEQ ID NO: 495768 - DNA, 20 bp, Artificial
  CRISPR gRNA sequence
taaaacaaactcaattgaaa

SEQ ID NO: 495769 - DNA, 20 bp, Artificial
  CRISPR gRNA sequence
aattgaaaggttaaaaaggc

SEQ ID NO: 495770 - DNA, 20 bp, Artificial
  CRISPR gRNA sequence
aaaggttaaaaaggccattt

SEQ ID NO: 495771 - DNA, 20 bp, Artificial
  CRISPR gRNA sequence
aaaaggccatttagatgcca

SEQ ID NO: 495772 - DNA, 20 bp, Artificial
  CRISPR gRNA sequence
agatgccattgaaaagagaa

SEQ ID NO: 495773 - DNA, 20 bp, Artificial
  CRISPR gRNA sequence
gatgccattgaaaagagaat

SEQ ID NO: 495774 - DNA, 20 bp, Artificial
  CRISPR gRNA sequence
aaaagagaattagaaaactg

SEQ ID NO: 495775 - DNA, 20 bp, Artificial
  CRISPR gRNA sequence
gaaaactgttataaaatatc

SEQ ID NO: 495776 - DNA, 20 bp, Artificial
  CRISPR gRNA sequence
ttataaaatatccagagtga

SEQ ID NO: 495777 - DNA, 20 bp, Artificial
  CRISPR gRNA sequence
taaaatatccagagtgaagt

SEQ ID NO: 495778 - DNA, 20 bp, Artificial
  CRISPR gRNA sequence
gagatatagcaaaaacaaaa

SEQ ID NO: 495779 - DNA, 20 bp, Artificial
  CRISPR gRNA sequence
agatatagcaaaaacaaaac

SEQ ID NO: 495780 - DNA, 20 bp, Artificial
  CRISPR gRNA sequence
aactaagtgtaattggaaag

SEQ ID NO: 495781 - DNA, 20 bp, Artificial
  CRISPR gRNA sequence
agtgtaattggaaagcaagg

SEQ ID NO: 495782 - DNA, 20 bp, Artificial
  CRISPR gRNA sequence
gaaagcaaggagacgagaga

SEQ ID NO: 495783 - DNA, 20 bp, Artificial
  CRISPR gRNA sequence
agcaaaagagataaaagata

SEQ ID NO: 495784 - DNA, 20 bp, Artificial
  CRISPR gRNA sequence
cccaaaactgacaaaagcca

SEQ ID NO: 495785 - DNA, 20 bp, Artificial
  CRISPR gRNA sequence
ccaaaactgacaaaagccat

SEQ ID NO: 495786 - DNA, 20 bp, Artificial
  CRISPR gRNA sequence
acaaaagccatcaagataga

SEQ ID NO: 495787 - DNA, 20 bp, Artificial
  CRISPR gRNA sequence
gtaaaatgtgttacaaaccc

SEQ ID NO: 495788 - DNA, 20 bp, Artificial
  CRISPR gRNA sequence
taaaatgtgttacaaacccc

SEQ ID NO: 495789 - DNA, 20 bp, Artificial
  CRISPR gRNA sequence
caaaccccaagcaagatcaa

SEQ ID NO: 495790 - DNA, 20 bp, Artificial
  CRISPR gRNA sequence
ggcacggtggctcacgcctg

SEQ ID NO: 495791 - DNA, 20 bp, Artificial
  CRISPR gRNA sequence
acgcctgtaatcccagcact

SEQ ID NO: 495792 - DNA, 20 bp, Artificial
  CRISPR gRNA sequence
taatcccagcactttgggag

SEQ ID NO: 495793 - DNA, 20 bp, Artificial
  CRISPR gRNA sequence
tgggaggcccaggtggatgg

SEQ ID NO: 495794 - DNA, 20 bp, Artificial
  CRISPR gRNA sequence
gggaggcccaggtggatgga

SEQ ID NO: 495795 - DNA, 20 bp, Artificial
  CRISPR gRNA sequence
ggaggcccaggtggatggat

SEQ ID NO: 495796 - DNA, 20 bp, Artificial
  CRISPR gRNA sequence
acgtcaggagtttgagacca

SEQ ID NO: 495797 - DNA, 20 bp, Artificial
  CRISPR gRNA sequence
gagaccagcctggccaatat

SEQ ID NO: 495798 - DNA, 20 bp, Artificial
  CRISPR gRNA sequence
agaccagcctggccaatatg

SEQ ID NO: 495799 - DNA, 20 bp, Artificial
  CRISPR gRNA sequence
gccaatatgacaaaatccca

SEQ ID NO: 495800 - DNA, 20 bp, Artificial
  CRISPR gRNA sequence
tgctaaaaatgcaaaaatta

SEQ ID NO: 495801 - DNA, 20 bp, Artificial
  CRISPR gRNA sequence
ctaaaaatgcaaaaattagc

SEQ ID NO: 495802 - DNA, 20 bp, Artificial
  CRISPR gRNA sequence
aaaatgcaaaaattagccaa

SEQ ID NO: 495803 - DNA, 20 bp, Artificial
  CRISPR gRNA sequence
gccaagtatggtggtgcaca

SEQ ID NO: 495804 - DNA, 20 bp, Artificial
  CRISPR gRNA sequence
taatcccagctacttgggag

SEQ ID NO: 495805 - DNA, 20 bp, Artificial
  CRISPR gRNA sequence
cttgggaggctgaggcagga

SEQ ID NO: 495806 - DNA, 20 bp, Artificial
  CRISPR gRNA sequence
gggaggctgaggcaggagaa

SEQ ID NO: 495807 - DNA, 20 bp, Artificial
  CRISPR gRNA sequence
ggaggctgaggcaggagaat

SEQ ID NO: 495808 - DNA, 20 bp, Artificial
  CRISPR gRNA sequence
aggcaggagaatcacttgaa

SEQ ID NO: 495809 - DNA, 20 bp, Artificial
  CRISPR gRNA sequence
gaatccaggaggtggaggtt

SEQ ID NO: 495810 - DNA, 20 bp, Artificial
  CRISPR gRNA sequence
aatccaggaggtggaggttg

SEQ ID NO: 495811 - DNA, 20 bp, Artificial
  CRISPR gRNA sequence
cagtgagccgagatcacgcc

SEQ ID NO: 495812 - DNA, 20 bp, Artificial
  CRISPR gRNA sequence
cactccaacctgggcaacaa

SEQ ID NO: 495813 - DNA, 20 bp, Artificial
  CRISPR gRNA sequence
caacctgggcaacaagagtg

SEQ ID NO: 495814 - DNA, 20 bp, Artificial
  CRISPR gRNA sequence
ggcaacaagagtgaaactct

SEQ ID NO: 495815 - DNA, 20 bp, Artificial
  CRISPR gRNA sequence
tgtctcaaaaaaaaaaaaag

SEQ ID NO: 495816 - DNA, 20 bp, Artificial
  CRISPR gRNA sequence
tctcaaaaaaaaaaaaagaa

SEQ ID NO: 495817 - DNA, 20 bp, Artificial
  CRISPR gRNA sequence
aaaaaaaaaaaaagaaaaaa

SEQ ID NO: 495818 - DNA, 20 bp, Artificial
  CRISPR gRNA sequence
tcaatacatcaaaaaaatta

SEQ ID NO: 495819 - DNA, 20 bp, Artificial
  CRISPR gRNA sequence
aatacatcaaaaaaattatg

SEQ ID NO: 495820 - DNA, 20 bp, Artificial
  CRISPR gRNA sequence
tggaaaccaaagataaatag

SEQ ID NO: 495821 - DNA, 20 bp, Artificial
  CRISPR gRNA sequence
aattcccttcacaaaacaaa

SEQ ID NO: 495822 - DNA, 20 bp, Artificial
  CRISPR gRNA sequence
ccttcacaaaacaaacaact

SEQ ID NO: 495823 - DNA, 20 bp, Artificial
  CRISPR gRNA sequence
cacaaaacaaacaacttagc

SEQ ID NO: 495824 - DNA, 20 bp, Artificial
  CRISPR gRNA sequence
acaaaacaaacaacttagct

SEQ ID NO: 495825 - DNA, 20 bp, Artificial
  CRISPR gRNA sequence
agctgacatttcagcaaaaa

SEQ ID NO: 495826 - DNA, 20 bp, Artificial
  CRISPR gRNA sequence
gctgacatttcagcaaaaat

SEQ ID NO: 495827 - DNA, 20 bp, Artificial
  CRISPR gRNA sequence
acatttcagcaaaaataata

SEQ ID NO: 495828 - DNA, 20 bp, Artificial
  CRISPR gRNA sequence
cagcaaaaataataaaaagc

SEQ ID NO: 495829 - DNA, 20 bp, Artificial
  CRISPR gRNA sequence
agcaaaaataataaaaagca

SEQ ID NO: 495830 - DNA, 20 bp, Artificial
  CRISPR gRNA sequence
ttttttttatttttccatag

SEQ ID NO: 495831 - DNA, 20 bp, Artificial
  CRISPR gRNA sequence
tttttttatttttccatagg

SEQ ID NO: 495832 - DNA, 20 bp, Artificial
  CRISPR gRNA sequence
ttttttatttttccataggt

SEQ ID NO: 495833 - DNA, 20 bp, Artificial
  CRISPR gRNA sequence
tttttatttttccataggtt

SEQ ID NO: 495834 - DNA, 20 bp, Artificial
  CRISPR gRNA sequence
ttttatttttccataggtta

SEQ ID NO: 495835 - DNA, 20 bp, Artificial
  CRISPR gRNA sequence
tttatttttccataggttat

SEQ ID NO: 495836 - DNA, 20 bp, Artificial
  CRISPR gRNA sequence
ttatttttccataggttatt

SEQ ID NO: 495837 - DNA, 20 bp, Artificial
  CRISPR gRNA sequence
tatttttccataggttattg

SEQ ID NO: 495838 - DNA, 20 bp, Artificial
  CRISPR gRNA sequence
atttttccataggttattgg

SEQ ID NO: 495839 - DNA, 20 bp, Artificial
  CRISPR gRNA sequence
tttttccataggttattggg

SEQ ID NO: 495840 - DNA, 20 bp, Artificial
  CRISPR gRNA sequence
ttccataggttattggggta

SEQ ID NO: 495841 - DNA, 20 bp, Artificial
  CRISPR gRNA sequence
tccataggttattggggtac

SEQ ID NO: 495842 - DNA, 20 bp, Artificial
  CRISPR gRNA sequence
ccataggttattggggtaca

SEQ ID NO: 495843 - DNA, 20 bp, Artificial
  CRISPR gRNA sequence
cataggttattggggtacag

SEQ ID NO: 495844 - DNA, 20 bp, Artificial
  CRISPR gRNA sequence
ttggggtacaggtggtgttt

SEQ ID NO: 495845 - DNA, 20 bp, Artificial
  CRISPR gRNA sequence
gggtacaggtggtgtttggt

SEQ ID NO: 495846 - DNA, 20 bp, Artificial
  CRISPR gRNA sequence
ggttacaagagaaagttcat

SEQ ID NO: 495847 - DNA, 20 bp, Artificial
  CRISPR gRNA sequence
gttacaagagaaagttcatt

SEQ ID NO: 495848 - DNA, 20 bp, Artificial
  CRISPR gRNA sequence
caagagaaagttcattagag

SEQ ID NO: 495849 - DNA, 20 bp, Artificial
  CRISPR gRNA sequence
attagaggtgatttgtgagt

SEQ ID NO: 495850 - DNA, 20 bp, Artificial
  CRISPR gRNA sequence
gaggtgatttgtgagtcggt

SEQ ID NO: 495851 - DNA, 20 bp, Artificial
  CRISPR gRNA sequence
gtgagtcggtgcacccatca

SEQ ID NO: 495852 - DNA, 20 bp, Artificial
  CRISPR gRNA sequence
tgagtcggtgcacccatcac

SEQ ID NO: 495853 - DNA, 20 bp, Artificial
  CRISPR gRNA sequence
cactctatttatagtctttt

SEQ ID NO: 495854 - DNA, 20 bp, Artificial
  CRISPR gRNA sequence
tatttatagtcttttatccc

SEQ ID NO: 495855 - DNA, 20 bp, Artificial
  CRISPR gRNA sequence
tttatagtcttttatccctc

SEQ ID NO: 495856 - DNA, 20 bp, Artificial
  CRISPR gRNA sequence
atagtcttttatccctcact

SEQ ID NO: 495857 - DNA, 20 bp, Artificial
  CRISPR gRNA sequence
tagtcttttatccctcactc

SEQ ID NO: 495858 - DNA, 20 bp, Artificial
  CRISPR gRNA sequence
ttatccctcactcccctccc

SEQ ID NO: 495859 - DNA, 20 bp, Artificial
  CRISPR gRNA sequence
tatccctcactcccctccca

SEQ ID NO: 495860 - DNA, 20 bp, Artificial
  CRISPR gRNA sequence
atccctcactcccctcccac

SEQ ID NO: 495861 - DNA, 20 bp, Artificial
  CRISPR gRNA sequence
tccctcactcccctcccact

SEQ ID NO: 495862 - DNA, 20 bp, Artificial
  CRISPR gRNA sequence
actcccctcccacttttcct

SEQ ID NO: 495863 - DNA, 20 bp, Artificial
  CRISPR gRNA sequence
ccctcccacttttcctccca

SEQ ID NO: 495864 - DNA, 20 bp, Artificial
  CRISPR gRNA sequence
ccacttttcctcccaagtca

SEQ ID NO: 495865 - DNA, 20 bp, Artificial
  CRISPR gRNA sequence
ttcctcccaagtcaccaaag

SEQ ID NO: 495866 - DNA, 20 bp, Artificial
  CRISPR gRNA sequence
tcctcccaagtcaccaaagt

SEQ ID NO: 495867 - DNA, 20 bp, Artificial
  CRISPR gRNA sequence
cctcccaagtcaccaaagtc

SEQ ID NO: 495868 - DNA, 20 bp, Artificial
  CRISPR gRNA sequence
ctcccaagtcaccaaagtcc

SEQ ID NO: 495869 - DNA, 20 bp, Artificial
  CRISPR gRNA sequence
ccaagtcaccaaagtccact

SEQ ID NO: 495870 - DNA, 20 bp, Artificial
  CRISPR gRNA sequence
tatcattcttatgcctttgc

SEQ ID NO: 495871 - DNA, 20 bp, Artificial
  CRISPR gRNA sequence
ttatgcctttgcatcctcgt

SEQ ID NO: 495872 - DNA, 20 bp, Artificial
  CRISPR gRNA sequence
atgcctttgcatcctcgtag

SEQ ID NO: 495873 - DNA, 20 bp, Artificial
  CRISPR gRNA sequence
tgcctttgcatcctcgtagc

SEQ ID NO: 495874 - DNA, 20 bp, Artificial
  CRISPR gRNA sequence
tgcatcctcgtagcttaact

SEQ ID NO: 495875 - DNA, 20 bp, Artificial
  CRISPR gRNA sequence
gcatcctcgtagcttaactc

SEQ ID NO: 495876 - DNA, 20 bp, Artificial
  CRISPR gRNA sequence
catcctcgtagcttaactcc

SEQ ID NO: 495877 - DNA, 20 bp, Artificial
  CRISPR gRNA sequence
gtagcttaactcccacgtat

SEQ ID NO: 495878 - DNA, 20 bp, Artificial
  CRISPR gRNA sequence
aactcccacgtatcagtgag

SEQ ID NO: 495879 - DNA, 20 bp, Artificial
  CRISPR gRNA sequence
actcccacgtatcagtgaga

SEQ ID NO: 495880 - DNA, 20 bp, Artificial
  CRISPR gRNA sequence
ccacgtatcagtgagaacat

SEQ ID NO: 495881 - DNA, 20 bp, Artificial
  CRISPR gRNA sequence
tttggttttccaaggaatga

SEQ ID NO: 495882 - DNA, 20 bp, Artificial
  CRISPR gRNA sequence
ggttttccaaggaatgatat

SEQ ID NO: 495883 - DNA, 20 bp, Artificial
  CRISPR gRNA sequence
gttttccaaggaatgatata

SEQ ID NO: 495884 - DNA, 20 bp, Artificial
  CRISPR gRNA sequence
tccaaggaatgatatattta

SEQ ID NO: 495885 - DNA, 20 bp, Artificial
  CRISPR gRNA sequence
ccaaggaatgatatatttaa

SEQ ID NO: 495886 - DNA, 20 bp, Artificial
  CRISPR gRNA sequence
caaggaatgatatatttaaa

SEQ ID NO: 495887 - DNA, 20 bp, Artificial
  CRISPR gRNA sequence
aaagtgctgaaagaaaataa

SEQ ID NO: 495888 - DNA, 20 bp, Artificial
  CRISPR gRNA sequence
aagtgctgaaagaaaataac

SEQ ID NO: 495889 - DNA, 20 bp, Artificial
  CRISPR gRNA sequence
aaagaaaataactgcctatc

SEQ ID NO: 495890 - DNA, 20 bp, Artificial
  CRISPR gRNA sequence
cctatctagaatttcggtac

SEQ ID NO: 495891 - DNA, 20 bp, Artificial
  CRISPR gRNA sequence
tctagaatttcggtacttca

SEQ ID NO: 495892 - DNA, 20 bp, Artificial
  CRISPR gRNA sequence
gaatttcggtacttcaaaga

SEQ ID NO: 495893 - DNA, 20 bp, Artificial
  CRISPR gRNA sequence
cggtacttcaaagatgaaag

SEQ ID NO: 495894 - DNA, 20 bp, Artificial
  CRISPR gRNA sequence
ggtacttcaaagatgaaagc

SEQ ID NO: 495895 - DNA, 20 bp, Artificial
  CRISPR gRNA sequence
caaagatgaaagcagatgca

SEQ ID NO: 495896 - DNA, 20 bp, Artificial
  CRISPR gRNA sequence
aaagatgaaagcagatgcag

SEQ ID NO: 495897 - DNA, 20 bp, Artificial
  CRISPR gRNA sequence
atgcctgtaatccccgcact

SEQ ID NO: 495898 - DNA, 20 bp, Artificial
  CRISPR gRNA sequence
taatccccgcactttgggag

SEQ ID NO: 495899 - DNA, 20 bp, Artificial
  CRISPR gRNA sequence
tgggaggctgaagcaggtga

SEQ ID NO: 495900 - DNA, 20 bp, Artificial
  CRISPR gRNA sequence
gggaggctgaagcaggtgaa

SEQ ID NO: 495901 - DNA, 20 bp, Artificial
  CRISPR gRNA sequence
ggaggctgaagcaggtgaat

SEQ ID NO: 495902 - DNA, 20 bp, Artificial
  CRISPR gRNA sequence
aagcaggtgaatcagttgag

SEQ ID NO: 495903 - DNA, 20 bp, Artificial
  CRISPR gRNA sequence
aggtcgggagttggagacca

SEQ ID NO: 495904 - DNA, 20 bp, Artificial
  CRISPR gRNA sequence
gagaccaggctggccaacat

SEQ ID NO: 495905 - DNA, 20 bp, Artificial
  CRISPR gRNA sequence
gccaacatggcaaaccccat

SEQ ID NO: 495906 - DNA, 20 bp, Artificial
  CRISPR gRNA sequence
gactaaaaatacaaaagtta

SEQ ID NO: 495907 - DNA, 20 bp, Artificial
  CRISPR gRNA sequence
aaaatacaaaagttagctga

SEQ ID NO: 495908 - DNA, 20 bp, Artificial
  CRISPR gRNA sequence
gctgagcgtggtggcacgcg

SEQ ID NO: 495909 - DNA, 20 bp, Artificial
  CRISPR gRNA sequence
agcgtggtggcacgcgccca

SEQ ID NO: 495910 - DNA, 20 bp, Artificial
  CRISPR gRNA sequence
ctcaggaggctgaggcacga

SEQ ID NO: 495911 - DNA, 20 bp, Artificial
  CRISPR gRNA sequence
aggaggctgaggcacgagaa

SEQ ID NO: 495912 - DNA, 20 bp, Artificial
  CRISPR gRNA sequence
aggcacgagaatcacttgaa

SEQ ID NO: 495913 - DNA, 20 bp, Artificial
  CRISPR gRNA sequence
gaacccaggaagtcaaggct

SEQ ID NO: 495914 - DNA, 20 bp, Artificial
  CRISPR gRNA sequence
aacccaggaagtcaaggctg

SEQ ID NO: 495915 - DNA, 20 bp, Artificial
  CRISPR gRNA sequence
cagcgagccaagatggtgcc

SEQ ID NO: 495916 - DNA, 20 bp, Artificial
  CRISPR gRNA sequence
ccctcctgcctgggtgacaa

SEQ ID NO: 495917 - DNA, 20 bp, Artificial
  CRISPR gRNA sequence
ctgcctgggtgacaaagtga

SEQ ID NO: 495918 - DNA, 20 bp, Artificial
  CRISPR gRNA sequence
cctgggtgacaaagtgagac

SEQ ID NO: 495919 - DNA, 20 bp, Artificial
  CRISPR gRNA sequence
ggtgacaaagtgagactgtc

SEQ ID NO: 495920 - DNA, 20 bp, Artificial
  CRISPR gRNA sequence
tctcaaaaaatagtaataat

SEQ ID NO: 495921 - DNA, 20 bp, Artificial
  CRISPR gRNA sequence
aaaaaatagtaataattttt

SEQ ID NO: 495922 - DNA, 20 bp, Artificial
  CRISPR gRNA sequence
tttaaatgaagctgaaataa

SEQ ID NO: 495923 - DNA, 20 bp, Artificial
  CRISPR gRNA sequence
ttaaatgaagctgaaataaa

SEQ ID NO: 495924 - DNA, 20 bp, Artificial
  CRISPR gRNA sequence
taaatgaagctgaaataaag

SEQ ID NO: 495925 - DNA, 20 bp, Artificial
  CRISPR gRNA sequence
aaatgaagctgaaataaaga

SEQ ID NO: 495926 - DNA, 20 bp, Artificial
  CRISPR gRNA sequence
aatgaagctgaaataaagac

SEQ ID NO: 495927 - DNA, 20 bp, Artificial
  CRISPR gRNA sequence
aaataaagacatttttagaa

SEQ ID NO: 495928 - DNA, 20 bp, Artificial
  CRISPR gRNA sequence
ttagaaaaaattaaaaacgg

SEQ ID NO: 495929 - DNA, 20 bp, Artificial
  CRISPR gRNA sequence
tagaaaaaattaaaaacgga

SEQ ID NO: 495930 - DNA, 20 bp, Artificial
  CRISPR gRNA sequence
agaaaaaattaaaaacggaa

SEQ ID NO: 495931 - DNA, 20 bp, Artificial
  CRISPR gRNA sequence
gaaaaaattaaaaacggaaa

SEQ ID NO: 495932 - DNA, 20 bp, Artificial
  CRISPR gRNA sequence
aaaacggaaagaatttgtca

SEQ ID NO: 495933 - DNA, 20 bp, Artificial
  CRISPR gRNA sequence
gtcacaaaaaggcctgcagt

SEQ ID NO: 495934 - DNA, 20 bp, Artificial
  CRISPR gRNA sequence
tcacaaaaaggcctgcagta

SEQ ID NO: 495935 - DNA, 20 bp, Artificial
  CRISPR gRNA sequence
cagtaaaggaaataccaaag

SEQ ID NO: 495936 - DNA, 20 bp, Artificial
  CRISPR gRNA sequence
tttagatataaagaaaatgg

SEQ ID NO: 495937 - DNA, 20 bp, Artificial
  CRISPR gRNA sequence
tagatataaagaaaatggaa

SEQ ID NO: 495938 - DNA, 20 bp, Artificial
  CRISPR gRNA sequence
agatataaagaaaatggaaa

SEQ ID NO: 495939 - DNA, 20 bp, Artificial
  CRISPR gRNA sequence
gatataaagaaaatggaaac

SEQ ID NO: 495940 - DNA, 20 bp, Artificial
  CRISPR gRNA sequence
aggcacaagaagtgaaaaac

SEQ ID NO: 495941 - DNA, 20 bp, Artificial
  CRISPR gRNA sequence
gtgacaataaaagtgggggg

SEQ ID NO: 495942 - DNA, 20 bp, Artificial
  CRISPR gRNA sequence
tgacaataaaagtgggggga

SEQ ID NO: 495943 - DNA, 20 bp, Artificial
  CRISPR gRNA sequence
tataggagttttctatagta

SEQ ID NO: 495944 - DNA, 20 bp, Artificial
  CRISPR gRNA sequence
tctatagtattgaggctgaa

SEQ ID NO: 495945 - DNA, 20 bp, Artificial
  CRISPR gRNA sequence
ctatagtattgaggctgaat

SEQ ID NO: 495946 - DNA, 20 bp, Artificial
  CRISPR gRNA sequence
tatagtattgaggctgaatt

SEQ ID NO: 495947 - DNA, 20 bp, Artificial
  CRISPR gRNA sequence
tagtattgaggctgaattgg

SEQ ID NO: 495948 - DNA, 20 bp, Artificial
  CRISPR gRNA sequence
aggctgaattggcatcaatt

SEQ ID NO: 495949 - DNA, 20 bp, Artificial
  CRISPR gRNA sequence
aattggcatcaattcaaact

SEQ ID NO: 495950 - DNA, 20 bp, Artificial
  CRISPR gRNA sequence
gcatcaattcaaactatatt

SEQ ID NO: 495951 - DNA, 20 bp, Artificial
  CRISPR gRNA sequence
aaactatattgttggaggta

SEQ ID NO: 495952 - DNA, 20 bp, Artificial
  CRISPR gRNA sequence
tattgttggaggtattcatt

SEQ ID NO: 495953 - DNA, 20 bp, Artificial
  CRISPR gRNA sequence
ttggaggtattcattgtaat

SEQ ID NO: 495954 - DNA, 20 bp, Artificial
  CRISPR gRNA sequence
gaggtattcattgtaatacc

SEQ ID NO: 495955 - DNA, 20 bp, Artificial
  CRISPR gRNA sequence
attgtaatacctgtggtaac

SEQ ID NO: 495956 - DNA, 20 bp, Artificial
  CRISPR gRNA sequence
taatacctgtggtaaccatt

SEQ ID NO: 495957 - DNA, 20 bp, Artificial
  CRISPR gRNA sequence
tggtaaccattgagaaaata

SEQ ID NO: 495958 - DNA, 20 bp, Artificial
  CRISPR gRNA sequence
agaaaataacaaaatgtaca

SEQ ID NO: 495959 - DNA, 20 bp, Artificial
  CRISPR gRNA sequence
aatacaaaagaaggcaataa

SEQ ID NO: 495960 - DNA, 20 bp, Artificial
  CRISPR gRNA sequence
taaaagaaccaattaagtag

SEQ ID NO: 495961 - DNA, 20 bp, Artificial
  CRISPR gRNA sequence
agtaggaataaacaatcatc

SEQ ID NO: 495962 - DNA, 20 bp, Artificial
  CRISPR gRNA sequence
cagtttctatgcatataaca

SEQ ID NO: 495963 - DNA, 20 bp, Artificial
  CRISPR gRNA sequence
agtttctatgcatataacaa

SEQ ID NO: 495964 - DNA, 20 bp, Artificial
  CRISPR gRNA sequence
ctatgcatataacaagttta

SEQ ID NO: 495965 - DNA, 20 bp, Artificial
  CRISPR gRNA sequence
tatgcatataacaagtttaa

SEQ ID NO: 495966 - DNA, 20 bp, Artificial
  CRISPR gRNA sequence
tgcatataacaagtttaaaa

SEQ ID NO: 495967 - DNA, 20 bp, Artificial
  CRISPR gRNA sequence
aaaatatataaaataaaatt

SEQ ID NO: 495968 - DNA, 20 bp, Artificial
  CRISPR gRNA sequence
aaatatataaaataaaattt

SEQ ID NO: 495969 - DNA, 20 bp, Artificial
  CRISPR gRNA sequence
gatagaactaaaaggagaag

SEQ ID NO: 495970 - DNA, 20 bp, Artificial
  CRISPR gRNA sequence
atagaactaaaaggagaagt

SEQ ID NO: 495971 - DNA, 20 bp, Artificial
  CRISPR gRNA sequence
aaaggagaagtaaatccaca

SEQ ID NO: 495972 - DNA, 20 bp, Artificial
  CRISPR gRNA sequence
tagttggagagttttattac

SEQ ID NO: 495973 - DNA, 20 bp, Artificial
  CRISPR gRNA sequence
gagagttttattacatctgt

SEQ ID NO: 495974 - DNA, 20 bp, Artificial
  CRISPR gRNA sequence
tattacatctgtctctctag

SEQ ID NO: 495975 - DNA, 20 bp, Artificial
  CRISPR gRNA sequence
attacatctgtctctctagc

SEQ ID NO: 495976 - DNA, 20 bp, Artificial
  CRISPR gRNA sequence
ttacatctgtctctctagct

SEQ ID NO: 495977 - DNA, 20 bp, Artificial
  CRISPR gRNA sequence
catctgtctctctagctgct

SEQ ID NO: 495978 - DNA, 20 bp, Artificial
  CRISPR gRNA sequence
tctctctagctgctacaaga

SEQ ID NO: 495979 - DNA, 20 bp, Artificial
  CRISPR gRNA sequence
tctagctgctacaagaagca

SEQ ID NO: 495980 - DNA, 20 bp, Artificial
  CRISPR gRNA sequence
tagctgctacaagaagcaca

SEQ ID NO: 495981 - DNA, 20 bp, Artificial
  CRISPR gRNA sequence
gctgctacaagaagcacaca

SEQ ID NO: 495982 - DNA, 20 bp, Artificial
  CRISPR gRNA sequence
ctacaagaagcacacaaaaa

SEQ ID NO: 495983 - DNA, 20 bp, Artificial
  CRISPR gRNA sequence
caagaagcacacaaaaaaat

SEQ ID NO: 495984 - DNA, 20 bp, Artificial
  CRISPR gRNA sequence
taagaatttgaagatcatta

SEQ ID NO: 495985 - DNA, 20 bp, Artificial
  CRISPR gRNA sequence
gaagatcattaaaccaatat

SEQ ID NO: 495986 - DNA, 20 bp, Artificial
  CRISPR gRNA sequence
aagatcattaaaccaatata

SEQ ID NO: 495987 - DNA, 20 bp, Artificial
  CRISPR gRNA sequence
aaccaatatatatataaatt

SEQ ID NO: 495988 - DNA, 20 bp, Artificial
  CRISPR gRNA sequence
tatataaaacaattctccta

SEQ ID NO: 495989 - DNA, 20 bp, Artificial
  CRISPR gRNA sequence
tcctaacaattgcagaatac

SEQ ID NO: 495990 - DNA, 20 bp, Artificial
  CRISPR gRNA sequence
ctaacaattgcagaatacat

SEQ ID NO: 495991 - DNA, 20 bp, Artificial
  CRISPR gRNA sequence
acaattgcagaatacatatt

SEQ ID NO: 495992 - DNA, 20 bp, Artificial
  CRISPR gRNA sequence
cagaatacatattcttttca

SEQ ID NO: 495993 - DNA, 20 bp, Artificial
  CRISPR gRNA sequence
ttttcaagtgcacatgcaat

SEQ ID NO: 495994 - DNA, 20 bp, Artificial
  CRISPR gRNA sequence
ttcaagtgcacatgcaatag

SEQ ID NO: 495995 - DNA, 20 bp, Artificial
  CRISPR gRNA sequence
tcaagtgcacatgcaatagt

SEQ ID NO: 495996 - DNA, 20 bp, Artificial
  CRISPR gRNA sequence
caagtgcacatgcaatagtt

SEQ ID NO: 495997 - DNA, 20 bp, Artificial
  CRISPR gRNA sequence
aagtgcacatgcaatagtta

SEQ ID NO: 495998 - DNA, 20 bp, Artificial
  CRISPR gRNA sequence
ccaaagtattatcatatgct

SEQ ID NO: 495999 - DNA, 20 bp, Artificial
  CRISPR gRNA sequence
tcatatgctgtgcattaaaa

SEQ ID NO: 496000 - DNA, 20 bp, Artificial
  CRISPR gRNA sequence
tgcattaaaacaagtgtcaa

SEQ ID NO: 496001 - DNA, 20 bp, Artificial
  CRISPR gRNA sequence
aaacaagtgtcaacaaagtt

SEQ ID NO: 496002 - DNA, 20 bp, Artificial
  CRISPR gRNA sequence
aaagtattgaaatcatacca

SEQ ID NO: 496003 - DNA, 20 bp, Artificial
  CRISPR gRNA sequence
aaatcataccaattatgccc

SEQ ID NO: 496004 - DNA, 20 bp, Artificial
  CRISPR gRNA sequence
tgccctctaagcacagtaga

SEQ ID NO: 496005 - DNA, 20 bp, Artificial
  CRISPR gRNA sequence
taagcacagtagaattaaac

SEQ ID NO: 496006 - DNA, 20 bp, Artificial
  CRISPR gRNA sequence
agcacagtagaattaaacaa

SEQ ID NO: 496007 - DNA, 20 bp, Artificial
  CRISPR gRNA sequence
aacaaaaaatcaataacaga

SEQ ID NO: 496008 - DNA, 20 bp, Artificial
  CRISPR gRNA sequence
tgaatgtttaaaacataaga

SEQ ID NO: 496009 - DNA, 20 bp, Artificial
  CRISPR gRNA sequence
aatgtttaaaacataagaaa

SEQ ID NO: 496010 - DNA, 20 bp, Artificial
  CRISPR gRNA sequence
aaaacataagaaacatattt

SEQ ID NO: 496011 - DNA, 20 bp, Artificial
  CRISPR gRNA sequence
aaacataagaaacatatttc

SEQ ID NO: 496012 - DNA, 20 bp, Artificial
  CRISPR gRNA sequence
ctaaaaacccatgagtcaaa

SEQ ID NO: 496013 - DNA, 20 bp, Artificial
  CRISPR gRNA sequence
taaaaacccatgagtcaaag

SEQ ID NO: 496014 - DNA, 20 bp, Artificial
  CRISPR gRNA sequence
aaaacccatgagtcaaagaa

SEQ ID NO: 496015 - DNA, 20 bp, Artificial
  CRISPR gRNA sequence
gggaaatatttagagcaaag

SEQ ID NO: 496016 - DNA, 20 bp, Artificial
  CRISPR gRNA sequence
ggaaatatttagagcaaagt

SEQ ID NO: 496017 - DNA, 20 bp, Artificial
  CRISPR gRNA sequence
agagcaaagtgataatgagt

SEQ ID NO: 496018 - DNA, 20 bp, Artificial
  CRISPR gRNA sequence
gagcaaagtgataatgagta

SEQ ID NO: 496019 - DNA, 20 bp, Artificial
  CRISPR gRNA sequence
aggcagtgtttagagggaaa

SEQ ID NO: 496020 - DNA, 20 bp, Artificial
  CRISPR gRNA sequence
agagggaaatttatagcttt

SEQ ID NO: 496021 - DNA, 20 bp, Artificial
  CRISPR gRNA sequence
gagggaaatttatagcttta

SEQ ID NO: 496022 - DNA, 20 bp, Artificial
  CRISPR gRNA sequence
atagctttaaatttgtatat

SEQ ID NO: 496023 - DNA, 20 bp, Artificial
  CRISPR gRNA sequence
tagctttaaatttgtatatt

SEQ ID NO: 496024 - DNA, 20 bp, Artificial
  CRISPR gRNA sequence
taaatttgtatattggaaaa

SEQ ID NO: 496025 - DNA, 20 bp, Artificial
  CRISPR gRNA sequence
aaatttgtatattggaaaag

SEQ ID NO: 496026 - DNA, 20 bp, Artificial
  CRISPR gRNA sequence
aatttgtatattggaaaaga

SEQ ID NO: 496027 - DNA, 20 bp, Artificial
  CRISPR gRNA sequence
gtatattggaaaagaaagaa

SEQ ID NO: 496028 - DNA, 20 bp, Artificial
  CRISPR gRNA sequence
tatattggaaaagaaagaaa

SEQ ID NO: 496029 - DNA, 20 bp, Artificial
  CRISPR gRNA sequence
gaaaagaaagaaagtttgca

SEQ ID NO: 496030 - DNA, 20 bp, Artificial
  CRISPR gRNA sequence
gcaagtcaataatgcaagat

SEQ ID NO: 496031 - DNA, 20 bp, Artificial
  CRISPR gRNA sequence
caagtcaataatgcaagatt

SEQ ID NO: 496032 - DNA, 20 bp, Artificial
  CRISPR gRNA sequence
aatctcaagaaaccaaagaa

SEQ ID NO: 496033 - DNA, 20 bp, Artificial
  CRISPR gRNA sequence
aagaaaccaaagaaaaagaa

SEQ ID NO: 496034 - DNA, 20 bp, Artificial
  CRISPR gRNA sequence
aaataatgatgatgatgatg

SEQ ID NO: 496035 - DNA, 20 bp, Artificial
  CRISPR gRNA sequence
acttcaataaaataaaaagc

SEQ ID NO: 496036 - DNA, 20 bp, Artificial
  CRISPR gRNA sequence
caataaaataaaaagcaaat

SEQ ID NO: 496037 - DNA, 20 bp, Artificial
  CRISPR gRNA sequence
aataaaataaaaagcaaata

SEQ ID NO: 496038 - DNA, 20 bp, Artificial
  CRISPR gRNA sequence
gcaaagccaaaagtaaattc

SEQ ID NO: 496039 - DNA, 20 bp, Artificial
  CRISPR gRNA sequence
attaaataaaagtgttaaaa

SEQ ID NO: 496040 - DNA, 20 bp, Artificial
  CRISPR gRNA sequence
aataaaagtgttaaaatgta

SEQ ID NO: 496041 - DNA, 20 bp, Artificial
  CRISPR gRNA sequence
aaatgtatatacctggtgct

SEQ ID NO: 496042 - DNA, 20 bp, Artificial
  CRISPR gRNA sequence
gtgctttggaggtgccttca

SEQ ID NO: 496043 - DNA, 20 bp, Artificial
  CRISPR gRNA sequence
tggaggtgccttcaccacct

SEQ ID NO: 496044 - DNA, 20 bp, Artificial
  CRISPR gRNA sequence
ggaggtgccttcaccaccta

SEQ ID NO: 496045 - DNA, 20 bp, Artificial
  CRISPR gRNA sequence
gaggtgccttcaccacctag

SEQ ID NO: 496046 - DNA, 20 bp, Artificial
  CRISPR gRNA sequence
caccacctagagtctcttgc

SEQ ID NO: 496047 - DNA, 20 bp, Artificial
  CRISPR gRNA sequence
accacctagagtctcttgct

SEQ ID NO: 496048 - DNA, 20 bp, Artificial
  CRISPR gRNA sequence
gagtctcttgctatcaaccg

SEQ ID NO: 496049 - DNA, 20 bp, Artificial
  CRISPR gRNA sequence
ttgctatcaaccgtagtcaa

SEQ ID NO: 496050 - DNA, 20 bp, Artificial
  CRISPR gRNA sequence
gctatcaaccgtagtcaacc

SEQ ID NO: 496051 - DNA, 20 bp, Artificial
  CRISPR gRNA sequence
ctatcaaccgtagtcaaccc

SEQ ID NO: 496052 - DNA, 20 bp, Artificial
  CRISPR gRNA sequence
tcaaccgtagtcaaccccac

SEQ ID NO: 496053 - DNA, 20 bp, Artificial
  CRISPR gRNA sequence
attaatatagcagttgacca

SEQ ID NO: 496054 - DNA, 20 bp, Artificial
  CRISPR gRNA sequence
atatagcagttgaccatgaa

SEQ ID NO: 496055 - DNA, 20 bp, Artificial
  CRISPR gRNA sequence
accatgaacccttggaccgt

SEQ ID NO: 496056 - DNA, 20 bp, Artificial
  CRISPR gRNA sequence
ggaccgtgtctccttggagc

SEQ ID NO: 496057 - DNA, 20 bp, Artificial
  CRISPR gRNA sequence
gaccgtgtctccttggagct

SEQ ID NO: 496058 - DNA, 20 bp, Artificial
  CRISPR gRNA sequence
cttggagctgtttgcacata

SEQ ID NO: 496059 - DNA, 20 bp, Artificial
  CRISPR gRNA sequence
ggagctgtttgcacataaag

SEQ ID NO: 496060 - DNA, 20 bp, Artificial
  CRISPR gRNA sequence
gagctgtttgcacataaagt

SEQ ID NO: 496061 - DNA, 20 bp, Artificial
  CRISPR gRNA sequence
tttgcacataaagttccaaa

SEQ ID NO: 496062 - DNA, 20 bp, Artificial
  CRISPR gRNA sequence
gcacataaagttccaaagac

SEQ ID NO: 496063 - DNA, 20 bp, Artificial
  CRISPR gRNA sequence
cacataaagttccaaagaca

SEQ ID NO: 496064 - DNA, 20 bp, Artificial
  CRISPR gRNA sequence
caaagacagcagaaaacatt

SEQ ID NO: 496065 - DNA, 20 bp, Artificial
  CRISPR gRNA sequence
gtgttctgagcactagagag

SEQ ID NO: 496066 - DNA, 20 bp, Artificial
  CRISPR gRNA sequence
tgttctgagcactagagaga

SEQ ID NO: 496067 - DNA, 20 bp, Artificial
  CRISPR gRNA sequence
tgagcactagagagaaatga

SEQ ID NO: 496068 - DNA, 20 bp, Artificial
  CRISPR gRNA sequence
agcactagagagaaatgatt

SEQ ID NO: 496069 - DNA, 20 bp, Artificial
  CRISPR gRNA sequence
gagagaaatgatttggttac

SEQ ID NO: 496070 - DNA, 20 bp, Artificial
  CRISPR gRNA sequence
ggttacaagagctcctgctc

SEQ ID NO: 496071 - DNA, 20 bp, Artificial
  CRISPR gRNA sequence
gttacaagagctcctgctct

SEQ ID NO: 496072 - DNA, 20 bp, Artificial
  CRISPR gRNA sequence
caagagctcctgctctcaca

SEQ ID NO: 496073 - DNA, 20 bp, Artificial
  CRISPR gRNA sequence
ctgctctcacaggattattg

SEQ ID NO: 496074 - DNA, 20 bp, Artificial
  CRISPR gRNA sequence
ctctcacaggattattgcag

SEQ ID NO: 496075 - DNA, 20 bp, Artificial
  CRISPR gRNA sequence
tcacaggattattgcagaat

SEQ ID NO: 496076 - DNA, 20 bp, Artificial
  CRISPR gRNA sequence
acaggattattgcagaattt

SEQ ID NO: 496077 - DNA, 20 bp, Artificial
  CRISPR gRNA sequence
ttgcagaatttatgtgccag

SEQ ID NO: 496078 - DNA, 20 bp, Artificial
  CRISPR gRNA sequence
cagaatttatgtgccaggat

SEQ ID NO: 496079 - DNA, 20 bp, Artificial
  CRISPR gRNA sequence
atgtgccaggatgttgacat

SEQ ID NO: 496080 - DNA, 20 bp, Artificial
  CRISPR gRNA sequence
tgtgccaggatgttgacatc

SEQ ID NO: 496081 - DNA, 20 bp, Artificial
  CRISPR gRNA sequence
acatcacacaccataatggc

SEQ ID NO: 496082 - DNA, 20 bp, Artificial
  CRISPR gRNA sequence
gtggcaagttcatctatggg

SEQ ID NO: 496083 - DNA, 20 bp, Artificial
  CRISPR gRNA sequence
atctatggggtgaaatttga

SEQ ID NO: 496084 - DNA, 20 bp, Artificial
  CRISPR gRNA sequence
tggggtgaaatttgatggtg

SEQ ID NO: 496085 - DNA, 20 bp, Artificial
  CRISPR gRNA sequence
gatggtgagaacttcatcct

SEQ ID NO: 496086 - DNA, 20 bp, Artificial
  CRISPR gRNA sequence
atggtgagaacttcatcctg

SEQ ID NO: 496087 - DNA, 20 bp, Artificial
  CRISPR gRNA sequence
catcctgaagcatacaggtc

SEQ ID NO: 496088 - DNA, 20 bp, Artificial
  CRISPR gRNA sequence
atcctgaagcatacaggtct

SEQ ID NO: 496089 - DNA, 20 bp, Artificial
  CRISPR gRNA sequence
aagcatacaggtcttggcat

SEQ ID NO: 496090 - DNA, 20 bp, Artificial
  CRISPR gRNA sequence
ggcatcttgtccatggcaaa

SEQ ID NO: 496091 - DNA, 20 bp, Artificial
  CRISPR gRNA sequence
gcatcttgtccatggcaaat

SEQ ID NO: 496092 - DNA, 20 bp, Artificial
  CRISPR gRNA sequence
gtccatggcaaatgctggac

SEQ ID NO: 496093 - DNA, 20 bp, Artificial
  CRISPR gRNA sequence
tccatggcaaatgctggacc

SEQ ID NO: 496094 - DNA, 20 bp, Artificial
  CRISPR gRNA sequence
gacccaacacaaatagttcc

SEQ ID NO: 496095 - DNA, 20 bp, Artificial
  CRISPR gRNA sequence
ccagtttttcatctacattg

SEQ ID NO: 496096 - DNA, 20 bp, Artificial
  CRISPR gRNA sequence
ttcatctacattgccgagac

SEQ ID NO: 496097 - DNA, 20 bp, Artificial
  CRISPR gRNA sequence
tcatctacattgccgagact

SEQ ID NO: 496098 - DNA, 20 bp, Artificial
  CRISPR gRNA sequence
catctacattgccgagactg

SEQ ID NO: 496099 - DNA, 20 bp, Artificial
  CRISPR gRNA sequence
atctacattgccgagactga

SEQ ID NO: 496100 - DNA, 20 bp, Artificial
  CRISPR gRNA sequence
cattgccgagactgaatgga

SEQ ID NO: 496101 - DNA, 20 bp, Artificial
  CRISPR gRNA sequence
ccgagactgaatggatggat

SEQ ID NO: 496102 - DNA, 20 bp, Artificial
  CRISPR gRNA sequence
aatggatggatggcaagcgt

SEQ ID NO: 496103 - DNA, 20 bp, Artificial
  CRISPR gRNA sequence
ggcaagttgaaagggggcat

SEQ ID NO: 496104 - DNA, 20 bp, Artificial
  CRISPR gRNA sequence
gcaagttgaaagggggcatg

SEQ ID NO: 496105 - DNA, 20 bp, Artificial
  CRISPR gRNA sequence
aaagggggcatgaatattgc

SEQ ID NO: 496106 - DNA, 20 bp, Artificial
  CRISPR gRNA sequence
cagacagcatggagcccttt

SEQ ID NO: 496107 - DNA, 20 bp, Artificial
  CRISPR gRNA sequence
tgggtccaggaatggcaaga

SEQ ID NO: 496108 - DNA, 20 bp, Artificial
  CRISPR gRNA sequence
gggtccaggaatggcaagac

SEQ ID NO: 496109 - DNA, 20 bp, Artificial
  CRISPR gRNA sequence
ggtccaggaatggcaagacc

SEQ ID NO: 496110 - DNA, 20 bp, Artificial
  CRISPR gRNA sequence
ctgagtgtagacaactctaa

SEQ ID NO: 496111 - DNA, 20 bp, Artificial
  CRISPR gRNA sequence
agtgtagacaactctaatct

SEQ ID NO: 496112 - DNA, 20 bp, Artificial
  CRISPR gRNA sequence
taatctgatataaatcaaaa

SEQ ID NO: 496113 - DNA, 20 bp, Artificial
  CRISPR gRNA sequence
atctgatataaatcaaaaga

SEQ ID NO: 496114 - DNA, 20 bp, Artificial
  CRISPR gRNA sequence
atataaatcaaaagaccctc

SEQ ID NO: 496115 - DNA, 20 bp, Artificial
  CRISPR gRNA sequence
atttcagagaagttcctgcc

SEQ ID NO: 496116 - DNA, 20 bp, Artificial
  CRISPR gRNA sequence
cagagaagttcctgcctcag

SEQ ID NO: 496117 - DNA, 20 bp, Artificial
  CRISPR gRNA sequence
agagaagttcctgcctcaga

SEQ ID NO: 496118 - DNA, 20 bp, Artificial
  CRISPR gRNA sequence
ctgcctcagattctagagaa

SEQ ID NO: 496119 - DNA, 20 bp, Artificial
  CRISPR gRNA sequence
cctcagattctagagaaaga

SEQ ID NO: 496120 - DNA, 20 bp, Artificial
  CRISPR gRNA sequence
agattctagagaaagaaatg

SEQ ID NO: 496121 - DNA, 20 bp, Artificial
  CRISPR gRNA sequence
tagagaaagaaatgctacac

SEQ ID NO: 496122 - DNA, 20 bp, Artificial
  CRISPR gRNA sequence
gagaaagaaatgctacacag

SEQ ID NO: 496123 - DNA, 20 bp, Artificial
  CRISPR gRNA sequence
cacagagagaccaagaagaa

SEQ ID NO: 496124 - DNA, 20 bp, Artificial
  CRISPR gRNA sequence
aacagacaggccttgctggg

SEQ ID NO: 496125 - DNA, 20 bp, Artificial
  CRISPR gRNA sequence
gctgggtttctccactcagc

SEQ ID NO: 496126 - DNA, 20 bp, Artificial
  CRISPR gRNA sequence
ctgggtttctccactcagcc

SEQ ID NO: 496127 - DNA, 20 bp, Artificial
  CRISPR gRNA sequence
ggtttctccactcagcctgt

SEQ ID NO: 496128 - DNA, 20 bp, Artificial
  CRISPR gRNA sequence
ctccactcagcctgttagta

SEQ ID NO: 496129 - DNA, 20 bp, Artificial
  CRISPR gRNA sequence
tccactcagcctgttagtat

SEQ ID NO: 496130 - DNA, 20 bp, Artificial
  CRISPR gRNA sequence
cactcagcctgttagtatgg

SEQ ID NO: 496131 - DNA, 20 bp, Artificial
  CRISPR gRNA sequence
agcctgttagtatggaatca

SEQ ID NO: 496132 - DNA, 20 bp, Artificial
  CRISPR gRNA sequence
ttagtatggaatcataccct

SEQ ID NO: 496133 - DNA, 20 bp, Artificial
  CRISPR gRNA sequence
gtatggaatcataccctttt

SEQ ID NO: 496134 - DNA, 20 bp, Artificial
  CRISPR gRNA sequence
ttcatccagtcacatttcta

SEQ ID NO: 496135 - DNA, 20 bp, Artificial
  CRISPR gRNA sequence
tcatccagtcacatttctac

SEQ ID NO: 496136 - DNA, 20 bp, Artificial
  CRISPR gRNA sequence
catccagtcacatttctaca

SEQ ID NO: 496137 - DNA, 20 bp, Artificial
  CRISPR gRNA sequence
atccagtcacatttctacaa

SEQ ID NO: 496138 - DNA, 20 bp, Artificial
  CRISPR gRNA sequence
ctacaaggttgttggtcatg

SEQ ID NO: 496139 - DNA, 20 bp, Artificial
  CRISPR gRNA sequence
tacaaggttgttggtcatgc

SEQ ID NO: 496140 - DNA, 20 bp, Artificial
  CRISPR gRNA sequence
caaggttgttggtcatgcct

SEQ ID NO: 496141 - DNA, 20 bp, Artificial
  CRISPR gRNA sequence
ttggtcatgcctatgaagtg

SEQ ID NO: 496142 - DNA, 20 bp, Artificial
  CRISPR gRNA sequence
gtcatgcctatgaagtgaag

SEQ ID NO: 496143 - DNA, 20 bp, Artificial
  CRISPR gRNA sequence
tgaagtgaagtctccataaa

SEQ ID NO: 496144 - DNA, 20 bp, Artificial
  CRISPR gRNA sequence
cataaaaacccaagaggact

SEQ ID NO: 496145 - DNA, 20 bp, Artificial
  CRISPR gRNA sequence
ggcttggagagcctccagat

SEQ ID NO: 496146 - DNA, 20 bp, Artificial
  CRISPR gRNA sequence
ggagagcctccagatagctg

SEQ ID NO: 496147 - DNA, 20 bp, Artificial
  CRISPR gRNA sequence
gagagcctccagatagctgg

SEQ ID NO: 496148 - DNA, 20 bp, Artificial
  CRISPR gRNA sequence
cagatagctggagattcctg

SEQ ID NO: 496149 - DNA, 20 bp, Artificial
  CRISPR gRNA sequence
gagattcctggcatgcagtg

SEQ ID NO: 496150 - DNA, 20 bp, Artificial
  CRISPR gRNA sequence
ctggcatgcagtgtgcccag

SEQ ID NO: 496151 - DNA, 20 bp, Artificial
  CRISPR gRNA sequence
gcatgcagtgtgcccaggga

SEQ ID NO: 496152 - DNA, 20 bp, Artificial
  CRISPR gRNA sequence
cgtgtcccttcccccatacc

SEQ ID NO: 496153 - DNA, 20 bp, Artificial
  CRISPR gRNA sequence
gtgtcccttcccccatacct

SEQ ID NO: 496154 - DNA, 20 bp, Artificial
  CRISPR gRNA sequence
cccccataccttgccctatg

SEQ ID NO: 496155 - DNA, 20 bp, Artificial
  CRISPR gRNA sequence
ccccataccttgccctatgc

SEQ ID NO: 496156 - DNA, 20 bp, Artificial
  CRISPR gRNA sequence
gccctatgccatctcttcat

SEQ ID NO: 496157 - DNA, 20 bp, Artificial
  CRISPR gRNA sequence
ccctatgccatctcttcatc

SEQ ID NO: 496158 - DNA, 20 bp, Artificial
  CRISPR gRNA sequence
tgccatctcttcatctgtat

SEQ ID NO: 496159 - DNA, 20 bp, Artificial
  CRISPR gRNA sequence
ttcatctgtatcctttgtaa

SEQ ID NO: 496160 - DNA, 20 bp, Artificial
  CRISPR gRNA sequence
catctgtatcctttgtaata

SEQ ID NO: 496161 - DNA, 20 bp, Artificial
  CRISPR gRNA sequence
atctgtatcctttgtaatat

SEQ ID NO: 496162 - DNA, 20 bp, Artificial
  CRISPR gRNA sequence
tatcctttgtaatatctctt

SEQ ID NO: 496163 - DNA, 20 bp, Artificial
  CRISPR gRNA sequence
tgtaatatctcttataatag

SEQ ID NO: 496164 - DNA, 20 bp, Artificial
  CRISPR gRNA sequence
gtaatatctcttataataga

SEQ ID NO: 496165 - DNA, 20 bp, Artificial
  CRISPR gRNA sequence
taatatctcttataatagac

SEQ ID NO: 496166 - DNA, 20 bp, Artificial
  CRISPR gRNA sequence
ttataatagaccagcaaaca

SEQ ID NO: 496167 - DNA, 20 bp, Artificial
  CRISPR gRNA sequence
ataatagaccagcaaacata

SEQ ID NO: 496168 - DNA, 20 bp, Artificial
  CRISPR gRNA sequence
taatagaccagcaaacataa

SEQ ID NO: 496169 - DNA, 20 bp, Artificial
  CRISPR gRNA sequence
ccctggtttatgtgagccac

SEQ ID NO: 496170 - DNA, 20 bp, Artificial
  CRISPR gRNA sequence
cctggtttatgtgagccact

SEQ ID NO: 496171 - DNA, 20 bp, Artificial
  CRISPR gRNA sequence
gtttatgtgagccactccag

SEQ ID NO: 496172 - DNA, 20 bp, Artificial
  CRISPR gRNA sequence
atgtgagccactccagcaaa

SEQ ID NO: 496173 - DNA, 20 bp, Artificial
  CRISPR gRNA sequence
tgtgagccactccagcaaat

SEQ ID NO: 496174 - DNA, 20 bp, Artificial
  CRISPR gRNA sequence
cagcaaattaattgaaccca

SEQ ID NO: 496175 - DNA, 20 bp, Artificial
  CRISPR gRNA sequence
attgaacccaaggagggggt

SEQ ID NO: 496176 - DNA, 20 bp, Artificial
  CRISPR gRNA sequence
aacccaaggagggggttgtg

SEQ ID NO: 496177 - DNA, 20 bp, Artificial
  CRISPR gRNA sequence
tgagaaccccaactggaagc

SEQ ID NO: 496178 - DNA, 20 bp, Artificial
  CRISPR gRNA sequence
gaagctggttggtccgaagt

SEQ ID NO: 496179 - DNA, 20 bp, Artificial
  CRISPR gRNA sequence
gttggtccgaagttctggag

SEQ ID NO: 496180 - DNA, 20 bp, Artificial
  CRISPR gRNA sequence
gtccgaagttctggaggccc

SEQ ID NO: 496181 - DNA, 20 bp, Artificial
  CRISPR gRNA sequence
tggaggcccagacttagaac

SEQ ID NO: 496182 - DNA, 20 bp, Artificial
  CRISPR gRNA sequence
gaggcccagacttagaactg

SEQ ID NO: 496183 - DNA, 20 bp, Artificial
  CRISPR gRNA sequence
agaactggtgtggtggaggg

SEQ ID NO: 496184 - DNA, 20 bp, Artificial
  CRISPR gRNA sequence
gaactggtgtggtggagggg

SEQ ID NO: 496185 - DNA, 20 bp, Artificial
  CRISPR gRNA sequence
gtgtggtggaggggtggtgt

SEQ ID NO: 496186 - DNA, 20 bp, Artificial
  CRISPR gRNA sequence
gggactgagcccccagcctc

SEQ ID NO: 496187 - DNA, 20 bp, Artificial
  CRISPR gRNA sequence
agcccccagcctctgtggtc

SEQ ID NO: 496188 - DNA, 20 bp, Artificial
  CRISPR gRNA sequence
tgtggtctgacactctctcc

SEQ ID NO: 496189 - DNA, 20 bp, Artificial
  CRISPR gRNA sequence
tggtctgacactctctccag

SEQ ID NO: 496190 - DNA, 20 bp, Artificial
  CRISPR gRNA sequence
acactctctccagttagtgt

SEQ ID NO: 496191 - DNA, 20 bp, Artificial
  CRISPR gRNA sequence
tctccagttagtgtctgaac

SEQ ID NO: 496192 - DNA, 20 bp, Artificial
  CRISPR gRNA sequence
tccagttagtgtctgaactg

SEQ ID NO: 496193 - DNA, 20 bp, Artificial
  CRISPR gRNA sequence
cagttagtgtctgaactgaa

SEQ ID NO: 496194 - DNA, 20 bp, Artificial
  CRISPR gRNA sequence
gtgtctgaactgaattggag

SEQ ID NO: 496195 - DNA, 20 bp, Artificial
  CRISPR gRNA sequence
aactgaattggagaacaccc

SEQ ID NO: 496196 - DNA, 20 bp, Artificial
  CRISPR gRNA sequence
aattggagaacacccagctg

SEQ ID NO: 496197 - DNA, 20 bp, Artificial
  CRISPR gRNA sequence
gagaacacccagctggtgtc

SEQ ID NO: 496198 - DNA, 20 bp, Artificial
  CRISPR gRNA sequence
gtgtccactgcagaatacat

SEQ ID NO: 496199 - DNA, 20 bp, Artificial
  CRISPR gRNA sequence
cagaatacattattcagttt

SEQ ID NO: 496200 - DNA, 20 bp, Artificial
  CRISPR gRNA sequence
ttcagtttgctgtgaggaga

SEQ ID NO: 496201 - DNA, 20 bp, Artificial
  CRISPR gRNA sequence
agtttgctgtgaggagaaat

SEQ ID NO: 496202 - DNA, 20 bp, Artificial
  CRISPR gRNA sequence
gctgtgaggagaaatccacc

SEQ ID NO: 496203 - DNA, 20 bp, Artificial
  CRISPR gRNA sequence
ctgtgaggagaaatccacct

SEQ ID NO: 496204 - DNA, 20 bp, Artificial
  CRISPR gRNA sequence
tgaggagaaatccacctccc

SEQ ID NO: 496205 - DNA, 20 bp, Artificial
  CRISPR gRNA sequence
cctgcatttggtcacagaag

SEQ ID NO: 496206 - DNA, 20 bp, Artificial
  CRISPR gRNA sequence
catttggtcacagaagtctt

SEQ ID NO: 496207 - DNA, 20 bp, Artificial
  CRISPR gRNA sequence
ggtcacagaagtcttctatg

SEQ ID NO: 496208 - DNA, 20 bp, Artificial
  CRISPR gRNA sequence
gtcacagaagtcttctatgt

SEQ ID NO: 496209 - DNA, 20 bp, Artificial
  CRISPR gRNA sequence
ctatgttgatgattgttatt

SEQ ID NO: 496210 - DNA, 20 bp, Artificial
  CRISPR gRNA sequence
tatgttgatgattgttatta

SEQ ID NO: 496211 - DNA, 20 bp, Artificial
  CRISPR gRNA sequence
tgttgatgattgttattatt

SEQ ID NO: 496212 - DNA, 20 bp, Artificial
  CRISPR gRNA sequence
atgattgttattattttgat

SEQ ID NO: 496213 - DNA, 20 bp, Artificial
  CRISPR gRNA sequence
ttattattttgatgtgggag

SEQ ID NO: 496214 - DNA, 20 bp, Artificial
  CRISPR gRNA sequence
ttattttgatgtgggagcag

SEQ ID NO: 496215 - DNA, 20 bp, Artificial
  CRISPR gRNA sequence
ttttgatgtgggagcagagg

SEQ ID NO: 496216 - DNA, 20 bp, Artificial
  CRISPR gRNA sequence
tgatgtgggagcagaggaaa

SEQ ID NO: 496217 - DNA, 20 bp, Artificial
  CRISPR gRNA sequence
gatgtgggagcagaggaaaa

SEQ ID NO: 496218 - DNA, 20 bp, Artificial
  CRISPR gRNA sequence
atgtgggagcagaggaaaaa

SEQ ID NO: 496219 - DNA, 20 bp, Artificial
  CRISPR gRNA sequence
gagaggtttgttcaaaacaa

SEQ ID NO: 496220 - DNA, 20 bp, Artificial
  CRISPR gRNA sequence
gttcaaaacaacaaacattc

SEQ ID NO: 496221 - DNA, 20 bp, Artificial
  CRISPR gRNA sequence
ttcaaaacaacaaacattca

SEQ ID NO: 496222 - DNA, 20 bp, Artificial
  CRISPR gRNA sequence
aaaacaacaaacattcacat

SEQ ID NO: 496223 - DNA, 20 bp, Artificial
  CRISPR gRNA sequence
acatttgtacccatctcttt

SEQ ID NO: 496224 - DNA, 20 bp, Artificial
  CRISPR gRNA sequence
gtacccatctctttcttttt

SEQ ID NO: 496225 - DNA, 20 bp, Artificial
  CRISPR gRNA sequence
tacccatctctttctttttt

SEQ ID NO: 496226 - DNA, 20 bp, Artificial
  CRISPR gRNA sequence
tttcttttttttttttttgt

SEQ ID NO: 496227 - DNA, 20 bp, Artificial
  CRISPR gRNA sequence
tcttttttttttttttgttt

SEQ ID NO: 496228 - DNA, 20 bp, Artificial
  CRISPR gRNA sequence
cttttttttttttttgtttt

SEQ ID NO: 496229 - DNA, 20 bp, Artificial
  CRISPR gRNA sequence
ttttttttttttttgtttta

SEQ ID NO: 496230 - DNA, 20 bp, Artificial
  CRISPR gRNA sequence
ttttttttttttgttttact

SEQ ID NO: 496231 - DNA, 20 bp, Artificial
  CRISPR gRNA sequence
tttttttttttgttttactt

SEQ ID NO: 496232 - DNA, 20 bp, Artificial
  CRISPR gRNA sequence
ttttttttttgttttacttt

SEQ ID NO: 496233 - DNA, 20 bp, Artificial
  CRISPR gRNA sequence
tttttttttgttttacttta

SEQ ID NO: 496234 - DNA, 20 bp, Artificial
  CRISPR gRNA sequence
ttttttttgttttactttaa

SEQ ID NO: 496235 - DNA, 20 bp, Artificial
  CRISPR gRNA sequence
tttttttgttttactttaag

SEQ ID NO: 496236 - DNA, 20 bp, Artificial
  CRISPR gRNA sequence
ttttttgttttactttaagt

SEQ ID NO: 496237 - DNA, 20 bp, Artificial
  CRISPR gRNA sequence
tttttgttttactttaagtt

SEQ ID NO: 496238 - DNA, 20 bp, Artificial
  CRISPR gRNA sequence
ttttgttttactttaagttc

SEQ ID NO: 496239 - DNA, 20 bp, Artificial
  CRISPR gRNA sequence
tttgttttactttaagttct

SEQ ID NO: 496240 - DNA, 20 bp, Artificial
  CRISPR gRNA sequence
ttgttttactttaagttctg

SEQ ID NO: 496241 - DNA, 20 bp, Artificial
  CRISPR gRNA sequence
tgttttactttaagttctgg

SEQ ID NO: 496242 - DNA, 20 bp, Artificial
  CRISPR gRNA sequence
gttttactttaagttctggg

SEQ ID NO: 496243 - DNA, 20 bp, Artificial
  CRISPR gRNA sequence
ttttactttaagttctggga

SEQ ID NO: 496244 - DNA, 20 bp, Artificial
  CRISPR gRNA sequence
tactttaagttctgggatac

SEQ ID NO: 496245 - DNA, 20 bp, Artificial
  CRISPR gRNA sequence
actttaagttctgggatacg

SEQ ID NO: 496246 - DNA, 20 bp, Artificial
  CRISPR gRNA sequence
ctttaagttctgggatacgt

SEQ ID NO: 496247 - DNA, 20 bp, Artificial
  CRISPR gRNA sequence
taagttctgggatacgtatg

SEQ ID NO: 496248 - DNA, 20 bp, Artificial
  CRISPR gRNA sequence
aagttctgggatacgtatgc

SEQ ID NO: 496249 - DNA, 20 bp, Artificial
  CRISPR gRNA sequence
agttctgggatacgtatgca

SEQ ID NO: 496250 - DNA, 20 bp, Artificial
  CRISPR gRNA sequence
tgggatacgtatgcagaaca

SEQ ID NO: 496251 - DNA, 20 bp, Artificial
  CRISPR gRNA sequence
ggatacgtatgcagaacatg

SEQ ID NO: 496252 - DNA, 20 bp, Artificial
  CRISPR gRNA sequence
gttacgtaggtatacgtgtg

SEQ ID NO: 496253 - DNA, 20 bp, Artificial
  CRISPR gRNA sequence
ttacgtaggtatacgtgtgc

SEQ ID NO: 496254 - DNA, 20 bp, Artificial
  CRISPR gRNA sequence
cgtaggtatacgtgtgccat

SEQ ID NO: 496255 - DNA, 20 bp, Artificial
  CRISPR gRNA sequence
gctgcacctatcaacccatc

SEQ ID NO: 496256 - DNA, 20 bp, Artificial
  CRISPR gRNA sequence
ctgcacctatcaacccatca

SEQ ID NO: 496257 - DNA, 20 bp, Artificial
  CRISPR gRNA sequence
cacctatcaacccatcatct

SEQ ID NO: 496258 - DNA, 20 bp, Artificial
  CRISPR gRNA sequence
tcaacccatcatctaggttt

SEQ ID NO: 496259 - DNA, 20 bp, Artificial
  CRISPR gRNA sequence
ggttttaagccccacatgca

SEQ ID NO: 496260 - DNA, 20 bp, Artificial
  CRISPR gRNA sequence
taagccccacatgcattagg

SEQ ID NO: 496261 - DNA, 20 bp, Artificial
  CRISPR gRNA sequence
aagccccacatgcattaggt

SEQ ID NO: 496262 - DNA, 20 bp, Artificial
  CRISPR gRNA sequence
agccccacatgcattaggta

SEQ ID NO: 496263 - DNA, 20 bp, Artificial
  CRISPR gRNA sequence
ggtatttgtcctaatgcctc

SEQ ID NO: 496264 - DNA, 20 bp, Artificial
  CRISPR gRNA sequence
gtcctaatgcctccctcccc

SEQ ID NO: 496265 - DNA, 20 bp, Artificial
  CRISPR gRNA sequence
tcctaatgcctccctcccct

SEQ ID NO: 496266 - DNA, 20 bp, Artificial
  CRISPR gRNA sequence
atgcctccctccccttgccc

SEQ ID NO: 496267 - DNA, 20 bp, Artificial
  CRISPR gRNA sequence
cctccccttgcccctcaccc

SEQ ID NO: 496268 - DNA, 20 bp, Artificial
  CRISPR gRNA sequence
cccttgcccctcacccacta

SEQ ID NO: 496269 - DNA, 20 bp, Artificial
  CRISPR gRNA sequence
gcccctcacccactaacagg

SEQ ID NO: 496270 - DNA, 20 bp, Artificial
  CRISPR gRNA sequence
cccctcacccactaacaggc

SEQ ID NO: 496271 - DNA, 20 bp, Artificial
  CRISPR gRNA sequence
acccactaacaggccctggt

SEQ ID NO: 496272 - DNA, 20 bp, Artificial
  CRISPR gRNA sequence
acaggccctggtgtgtgata

SEQ ID NO: 496273 - DNA, 20 bp, Artificial
  CRISPR gRNA sequence
gtgtgtgatattcccgtccc

SEQ ID NO: 496274 - DNA, 20 bp, Artificial
  CRISPR gRNA sequence
ccgtccctgtgcccatatgt

SEQ ID NO: 496275 - DNA, 20 bp, Artificial
  CRISPR gRNA sequence
tgcccatatgttctcattgt

SEQ ID NO: 496276 - DNA, 20 bp, Artificial
  CRISPR gRNA sequence
tcattgttcaactcccactt

SEQ ID NO: 496277 - DNA, 20 bp, Artificial
  CRISPR gRNA sequence
attgttcaactcccactttg

SEQ ID NO: 496278 - DNA, 20 bp, Artificial
  CRISPR gRNA sequence
ttcaactcccactttgagtg

SEQ ID NO: 496279 - DNA, 20 bp, Artificial
  CRISPR gRNA sequence
aactcccactttgagtgaga

SEQ ID NO: 496280 - DNA, 20 bp, Artificial
  CRISPR gRNA sequence
ccactttgagtgagaacacg

SEQ ID NO: 496281 - DNA, 20 bp, Artificial
  CRISPR gRNA sequence
tgagtgagaacacgtggtgt

SEQ ID NO: 496282 - DNA, 20 bp, Artificial
  CRISPR gRNA sequence
gagtgagaacacgtggtgtt

SEQ ID NO: 496283 - DNA, 20 bp, Artificial
  CRISPR gRNA sequence
agtgagaacacgtggtgttt

SEQ ID NO: 496284 - DNA, 20 bp, Artificial
  CRISPR gRNA sequence
ggttttctgttcctgtgtta

SEQ ID NO: 496285 - DNA, 20 bp, Artificial
  CRISPR gRNA sequence
gttttctgttcctgtgttag

SEQ ID NO: 496286 - DNA, 20 bp, Artificial
  CRISPR gRNA sequence
tctgttcctgtgttagtttg

SEQ ID NO: 496287 - DNA, 20 bp, Artificial
  CRISPR gRNA sequence
ctgttcctgtgttagtttgc

SEQ ID NO: 496288 - DNA, 20 bp, Artificial
  CRISPR gRNA sequence
tgttcctgtgttagtttgct

SEQ ID NO: 496289 - DNA, 20 bp, Artificial
  CRISPR gRNA sequence
ttcctgtgttagtttgctga

SEQ ID NO: 496290 - DNA, 20 bp, Artificial
  CRISPR gRNA sequence
ctgtgttagtttgctgagaa

SEQ ID NO: 496291 - DNA, 20 bp, Artificial
  CRISPR gRNA sequence
tgttagtttgctgagaacga

SEQ ID NO: 496292 - DNA, 20 bp, Artificial
  CRISPR gRNA sequence
gtttgctgagaacgatggct

SEQ ID NO: 496293 - DNA, 20 bp, Artificial
  CRISPR gRNA sequence
gctgagaacgatggcttcca

SEQ ID NO: 496294 - DNA, 20 bp, Artificial
  CRISPR gRNA sequence
ctgagaacgatggcttccag

SEQ ID NO: 496295 - DNA, 20 bp, Artificial
  CRISPR gRNA sequence
agaacgatggcttccagctt

SEQ ID NO: 496296 - DNA, 20 bp, Artificial
  CRISPR gRNA sequence
ccagcttcatccatgtccct

SEQ ID NO: 496297 - DNA, 20 bp, Artificial
  CRISPR gRNA sequence
cagcttcatccatgtccctg

SEQ ID NO: 496298 - DNA, 20 bp, Artificial
  CRISPR gRNA sequence
catccatgtccctgcaaact

SEQ ID NO: 496299 - DNA, 20 bp, Artificial
  CRISPR gRNA sequence
atccatgtccctgcaaactc

SEQ ID NO: 496300 - DNA, 20 bp, Artificial
  CRISPR gRNA sequence
caaactcaggaacagaaaaa

SEQ ID NO: 496301 - DNA, 20 bp, Artificial
  CRISPR gRNA sequence
aggaacagaaaaaggattcc

SEQ ID NO: 496302 - DNA, 20 bp, Artificial
  CRISPR gRNA sequence
cataattacctcttttaatc

SEQ ID NO: 496303 - DNA, 20 bp, Artificial
  CRISPR gRNA sequence
cctcttttaatcaacattgt

SEQ ID NO: 496304 - DNA, 20 bp, Artificial
  CRISPR gRNA sequence
ttttaatcaacattgtactg

SEQ ID NO: 496305 - DNA, 20 bp, Artificial
  CRISPR gRNA sequence
ttaatcaacattgtactgga

SEQ ID NO: 496306 - DNA, 20 bp, Artificial
  CRISPR gRNA sequence
taatcaacattgtactggag

SEQ ID NO: 496307 - DNA, 20 bp, Artificial
  CRISPR gRNA sequence
aatcaacattgtactggagg

SEQ ID NO: 496308 - DNA, 20 bp, Artificial
  CRISPR gRNA sequence
atcaacattgtactggaggt

SEQ ID NO: 496309 - DNA, 20 bp, Artificial
  CRISPR gRNA sequence
tactggaggtcatggctagt

SEQ ID NO: 496310 - DNA, 20 bp, Artificial
  CRISPR gRNA sequence
gaggtcatggctagttcaac

SEQ ID NO: 496311 - DNA, 20 bp, Artificial
  CRISPR gRNA sequence
gttcaacaaaacaaggaaaa

SEQ ID NO: 496312 - DNA, 20 bp, Artificial
  CRISPR gRNA sequence
aacaaaacaaggaaaatagt

SEQ ID NO: 496313 - DNA, 20 bp, Artificial
  CRISPR gRNA sequence
gaaatgaatatgtgaggctg

SEQ ID NO: 496314 - DNA, 20 bp, Artificial
  CRISPR gRNA sequence
ggcgcagtggctcacgcctg

SEQ ID NO: 496315 - DNA, 20 bp, Artificial
  CRISPR gRNA sequence
acgcctgtaatcccagcact

SEQ ID NO: 496316 - DNA, 20 bp, Artificial
  CRISPR gRNA sequence
taatcccagcactttgggca

SEQ ID NO: 496317 - DNA, 20 bp, Artificial
  CRISPR gRNA sequence
tgggcagctcacctgaggtc

SEQ ID NO: 496318 - DNA, 20 bp, Artificial
  CRISPR gRNA sequence
gggcagctcacctgaggtca

SEQ ID NO: 496319 - DNA, 20 bp, Artificial
  CRISPR gRNA sequence
ggcagctcacctgaggtcag

SEQ ID NO: 496320 - DNA, 20 bp, Artificial
  CRISPR gRNA sequence
acctgaggtcaggagttcga

SEQ ID NO: 496321 - DNA, 20 bp, Artificial
  CRISPR gRNA sequence
aggtcaggagttcgagacca

SEQ ID NO: 496322 - DNA, 20 bp, Artificial
  CRISPR gRNA sequence
gagaccagcctggccaacac

SEQ ID NO: 496323 - DNA, 20 bp, Artificial
  CRISPR gRNA sequence
gccaacacagtgaaactcca

SEQ ID NO: 496324 - DNA, 20 bp, Artificial
  CRISPR gRNA sequence
catctctactaaaaatacaa

SEQ ID NO: 496325 - DNA, 20 bp, Artificial
  CRISPR gRNA sequence
tactaaaaatacaaaaatta

SEQ ID NO: 496326 - DNA, 20 bp, Artificial
  CRISPR gRNA sequence
ctaaaaatacaaaaattagc

SEQ ID NO: 496327 - DNA, 20 bp, Artificial
  CRISPR gRNA sequence
aaaatacaaaaattagccag

SEQ ID NO: 496328 - DNA, 20 bp, Artificial
  CRISPR gRNA sequence
gccaggcgggtggcagtcac

SEQ ID NO: 496329 - DNA, 20 bp, Artificial
  CRISPR gRNA sequence
aaatcccagctactcgggag

SEQ ID NO: 496330 - DNA, 20 bp, Artificial
  CRISPR gRNA sequence
ctcgggaggctgaggcagga

SEQ ID NO: 496331 - DNA, 20 bp, Artificial
  CRISPR gRNA sequence
gggaggctgaggcaggagaa

SEQ ID NO: 496332 - DNA, 20 bp, Artificial
  CRISPR gRNA sequence
aggcaggagaatcacttgaa

SEQ ID NO: 496333 - DNA, 20 bp, Artificial
  CRISPR gRNA sequence
gaacccgggaagcggaggct

SEQ ID NO: 496334 - DNA, 20 bp, Artificial
  CRISPR gRNA sequence
aacccgggaagcggaggctg

SEQ ID NO: 496335 - DNA, 20 bp, Artificial
  CRISPR gRNA sequence
cagtgagccaagatggcacc

SEQ ID NO: 496336 - DNA, 20 bp, Artificial
  CRISPR gRNA sequence
cactccagcctgggcaacaa

SEQ ID NO: 496337 - DNA, 20 bp, Artificial
  CRISPR gRNA sequence
cagcctgggcaacaagagca

SEQ ID NO: 496338 - DNA, 20 bp, Artificial
  CRISPR gRNA sequence
ggcaacaagagcaaaactcc

SEQ ID NO: 496339 - DNA, 20 bp, Artificial
  CRISPR gRNA sequence
catctcaaaaaaaaaatgaa

SEQ ID NO: 496340 - DNA, 20 bp, Artificial
  CRISPR gRNA sequence
aaaaaaaaaatgaatatgtg

SEQ ID NO: 496341 - DNA, 20 bp, Artificial
  CRISPR gRNA sequence
tcattattcacaaactatat

SEQ ID NO: 496342 - DNA, 20 bp, Artificial
  CRISPR gRNA sequence
ttcacaaactatatacctgt

SEQ ID NO: 496343 - DNA, 20 bp, Artificial
  CRISPR gRNA sequence
acaaactatatacctgtgta

SEQ ID NO: 496344 - DNA, 20 bp, Artificial
  CRISPR gRNA sequence
tatacctgtgtatataggaa

SEQ ID NO: 496345 - DNA, 20 bp, Artificial
  CRISPR gRNA sequence
tgtatataggaaaccaagag

SEQ ID NO: 496346 - DNA, 20 bp, Artificial
  CRISPR gRNA sequence
tatgaaaaattatttgagtg

SEQ ID NO: 496347 - DNA, 20 bp, Artificial
  CRISPR gRNA sequence
tttgagtgtagaagtcagtt

SEQ ID NO: 496348 - DNA, 20 bp, Artificial
  CRISPR gRNA sequence
gagtgtagaagtcagttttg

SEQ ID NO: 496349 - DNA, 20 bp, Artificial
  CRISPR gRNA sequence
agtgtagaagtcagttttgc

SEQ ID NO: 496350 - DNA, 20 bp, Artificial
  CRISPR gRNA sequence
tgcaaaattgctagatataa

SEQ ID NO: 496351 - DNA, 20 bp, Artificial
  CRISPR gRNA sequence
gcaaaattgctagatataag

SEQ ID NO: 496352 - DNA, 20 bp, Artificial
  CRISPR gRNA sequence
caaaattgctagatataagg

SEQ ID NO: 496353 - DNA, 20 bp, Artificial
  CRISPR gRNA sequence
ctagatataaggtcaatata

SEQ ID NO: 496354 - DNA, 20 bp, Artificial
  CRISPR gRNA sequence
gatataaggtcaatatacaa

SEQ ID NO: 496355 - DNA, 20 bp, Artificial
  CRISPR gRNA sequence
ttatttctatatattagtac

SEQ ID NO: 496356 - DNA, 20 bp, Artificial
  CRISPR gRNA sequence
tatttctatatattagtaca

SEQ ID NO: 496357 - DNA, 20 bp, Artificial
  CRISPR gRNA sequence
atttctatatattagtacaa

SEQ ID NO: 496358 - DNA, 20 bp, Artificial
  CRISPR gRNA sequence
tttctatatattagtacaaa

SEQ ID NO: 496359 - DNA, 20 bp, Artificial
  CRISPR gRNA sequence
ctatatattagtacaaacag

SEQ ID NO: 496360 - DNA, 20 bp, Artificial
  CRISPR gRNA sequence
tatatattagtacaaacaga

SEQ ID NO: 496361 - DNA, 20 bp, Artificial
  CRISPR gRNA sequence
tatattagtacaaacagata

SEQ ID NO: 496362 - DNA, 20 bp, Artificial
  CRISPR gRNA sequence
gtacaaacagataaaaatga

SEQ ID NO: 496363 - DNA, 20 bp, Artificial
  CRISPR gRNA sequence
tgaaaacaatactatttaca

SEQ ID NO: 496364 - DNA, 20 bp, Artificial
  CRISPR gRNA sequence
gaaaacaatactatttacag

SEQ ID NO: 496365 - DNA, 20 bp, Artificial
  CRISPR gRNA sequence
aaaacaatactatttacagc

SEQ ID NO: 496366 - DNA, 20 bp, Artificial
  CRISPR gRNA sequence
tttacagcagcacaaaaaag

SEQ ID NO: 496367 - DNA, 20 bp, Artificial
  CRISPR gRNA sequence
acagcagcacaaaaaagata

SEQ ID NO: 496368 - DNA, 20 bp, Artificial
  CRISPR gRNA sequence
cagcagcacaaaaaagataa

SEQ ID NO: 496369 - DNA, 20 bp, Artificial
  CRISPR gRNA sequence
caagaagaaatatttaagac

SEQ ID NO: 496370 - DNA, 20 bp, Artificial
  CRISPR gRNA sequence
aagaagaaatatttaagacc

SEQ ID NO: 496371 - DNA, 20 bp, Artificial
  CRISPR gRNA sequence
aagacctatacacctattgc

SEQ ID NO: 496372 - DNA, 20 bp, Artificial
  CRISPR gRNA sequence
agacctatacacctattgca

SEQ ID NO: 496373 - DNA, 20 bp, Artificial
  CRISPR gRNA sequence
tacacctattgcaacaaaag

SEQ ID NO: 496374 - DNA, 20 bp, Artificial
  CRISPR gRNA sequence
ttgcaacaaaagattgctga

SEQ ID NO: 496375 - DNA, 20 bp, Artificial
  CRISPR gRNA sequence
caacaaaagattgctgagaa

SEQ ID NO: 496376 - DNA, 20 bp, Artificial
  CRISPR gRNA sequence
ctgagaaaaaattaaagagc

SEQ ID NO: 496377 - DNA, 20 bp, Artificial
  CRISPR gRNA sequence
agaaaaaattaaagagctaa

SEQ ID NO: 496378 - DNA, 20 bp, Artificial
  CRISPR gRNA sequence
aagagctaaataaacaggag

SEQ ID NO: 496379 - DNA, 20 bp, Artificial
  CRISPR gRNA sequence
aataaacaggagactatacc

SEQ ID NO: 496380 - DNA, 20 bp, Artificial
  CRISPR gRNA sequence
taccatggtttttattggaa

SEQ ID NO: 496381 - DNA, 20 bp, Artificial
  CRISPR gRNA sequence
ttattggaagacttaatatt

SEQ ID NO: 496382 - DNA, 20 bp, Artificial
  CRISPR gRNA sequence
tattggaagacttaatattg

SEQ ID NO: 496383 - DNA, 20 bp, Artificial
  CRISPR gRNA sequence
attggaagacttaatattgc

SEQ ID NO: 496384 - DNA, 20 bp, Artificial
  CRISPR gRNA sequence
ttggaagacttaatattgct

SEQ ID NO: 496385 - DNA, 20 bp, Artificial
  CRISPR gRNA sequence
gaagacttaatattgctaag

SEQ ID NO: 496386 - DNA, 20 bp, Artificial
  CRISPR gRNA sequence
aatattgctaagatgtcaat

SEQ ID NO: 496387 - DNA, 20 bp, Artificial
  CRISPR gRNA sequence
atattgctaagatgtcaatt

SEQ ID NO: 496388 - DNA, 20 bp, Artificial
  CRISPR gRNA sequence
ctaagatgtcaattcttcct

SEQ ID NO: 496389 - DNA, 20 bp, Artificial
  CRISPR gRNA sequence
agatgtcaattcttcctaaa

SEQ ID NO: 496390 - DNA, 20 bp, Artificial
  CRISPR gRNA sequence
ttcctaaattaatttataga

SEQ ID NO: 496391 - DNA, 20 bp, Artificial
  CRISPR gRNA sequence
cctaaattaatttatagatt

SEQ ID NO: 496392 - DNA, 20 bp, Artificial
  CRISPR gRNA sequence
ctaaattaatttatagattc

SEQ ID NO: 496393 - DNA, 20 bp, Artificial
  CRISPR gRNA sequence
aattaatttatagattcaat

SEQ ID NO: 496394 - DNA, 20 bp, Artificial
  CRISPR gRNA sequence
atttatagattcaatagaat

SEQ ID NO: 496395 - DNA, 20 bp, Artificial
  CRISPR gRNA sequence
atagattcaatagaattcca

SEQ ID NO: 496396 - DNA, 20 bp, Artificial
  CRISPR gRNA sequence
tagattcaatagaattccaa

SEQ ID NO: 496397 - DNA, 20 bp, Artificial
  CRISPR gRNA sequence
aatagaattccaataaaaat

SEQ ID NO: 496398 - DNA, 20 bp, Artificial
  CRISPR gRNA sequence
caataaaaattattgcaggt

SEQ ID NO: 496399 - DNA, 20 bp, Artificial
  CRISPR gRNA sequence
ttgcaggttatttttataga

SEQ ID NO: 496400 - DNA, 20 bp, Artificial
  CRISPR gRNA sequence
caggttatttttatagaaat

SEQ ID NO: 496401 - DNA, 20 bp, Artificial
  CRISPR gRNA sequence
tttttatagaaattaacaag

SEQ ID NO: 496402 - DNA, 20 bp, Artificial
  CRISPR gRNA sequence
ttatagaaattaacaagttg

SEQ ID NO: 496403 - DNA, 20 bp, Artificial
  CRISPR gRNA sequence
tatagaaattaacaagttga

SEQ ID NO: 496404 - DNA, 20 bp, Artificial
  CRISPR gRNA sequence
atagaaattaacaagttgat

SEQ ID NO: 496405 - DNA, 20 bp, Artificial
  CRISPR gRNA sequence
tagaaattaacaagttgatt

SEQ ID NO: 496406 - DNA, 20 bp, Artificial
  CRISPR gRNA sequence
acaagttgattctaaaactt

SEQ ID NO: 496407 - DNA, 20 bp, Artificial
  CRISPR gRNA sequence
attctaaaacttatatgaaa

SEQ ID NO: 496408 - DNA, 20 bp, Artificial
  CRISPR gRNA sequence
taaaacttatatgaaaatgt

SEQ ID NO: 496409 - DNA, 20 bp, Artificial
  CRISPR gRNA sequence
aaacttatatgaaaatgtaa

SEQ ID NO: 496410 - DNA, 20 bp, Artificial
  CRISPR gRNA sequence
atatgaaaatgtaaaagaca

SEQ ID NO: 496411 - DNA, 20 bp, Artificial
  CRISPR gRNA sequence
tatgaaaatgtaaaagacat

SEQ ID NO: 496412 - DNA, 20 bp, Artificial
  CRISPR gRNA sequence
gatgaagaacaaagctagaa

SEQ ID NO: 496413 - DNA, 20 bp, Artificial
  CRISPR gRNA sequence
atgaagaacaaagctagaag

SEQ ID NO: 496414 - DNA, 20 bp, Artificial
  CRISPR gRNA sequence
gaaggttttcactacctaat

SEQ ID NO: 496415 - DNA, 20 bp, Artificial
  CRISPR gRNA sequence
tcactacctaatatcaagat

SEQ ID NO: 496416 - DNA, 20 bp, Artificial
  CRISPR gRNA sequence
cactacctaatatcaagata

SEQ ID NO: 496417 - DNA, 20 bp, Artificial
  CRISPR gRNA sequence
actacctaatatcaagatat

SEQ ID NO: 496418 - DNA, 20 bp, Artificial
  CRISPR gRNA sequence
cctaatatcaagatatattg

SEQ ID NO: 496419 - DNA, 20 bp, Artificial
  CRISPR gRNA sequence
atatcaagatatattgtaaa

SEQ ID NO: 496420 - DNA, 20 bp, Artificial
  CRISPR gRNA sequence
taaaacttcagaaattaaga

SEQ ID NO: 496421 - DNA, 20 bp, Artificial
  CRISPR gRNA sequence
cagaaattaagatagcattc

SEQ ID NO: 496422 - DNA, 20 bp, Artificial
  CRISPR gRNA sequence
agaaattaagatagcattcc

SEQ ID NO: 496423 - DNA, 20 bp, Artificial
  CRISPR gRNA sequence
agatagcattccagtattgc

SEQ ID NO: 496424 - DNA, 20 bp, Artificial
  CRISPR gRNA sequence
cagtattgcaaggattgaaa

SEQ ID NO: 496425 - DNA, 20 bp, Artificial
  CRISPR gRNA sequence
caaggattgaaaagtagtcg

SEQ ID NO: 496426 - DNA, 20 bp, Artificial
  CRISPR gRNA sequence
aaaagtagtcgatggaatat

SEQ ID NO: 496427 - DNA, 20 bp, Artificial
  CRISPR gRNA sequence
gaaatagaccctgtgtgtgg

SEQ ID NO: 496428 - DNA, 20 bp, Artificial
  CRISPR gRNA sequence
tgtgtgggaaaaacactaac

SEQ ID NO: 496429 - DNA, 20 bp, Artificial
  CRISPR gRNA sequence
actgtttttcctctggtttc

SEQ ID NO: 496430 - DNA, 20 bp, Artificial
  CRISPR gRNA sequence
tttttcctctggtttcacac

SEQ ID NO: 496431 - DNA, 20 bp, Artificial
  CRISPR gRNA sequence
ttcctctggtttcacaccac

SEQ ID NO: 496432 - DNA, 20 bp, Artificial
  CRISPR gRNA sequence
tcctctggtttcacaccaca

SEQ ID NO: 496433 - DNA, 20 bp, Artificial
  CRISPR gRNA sequence
cctctggtttcacaccacaa

SEQ ID NO: 496434 - DNA, 20 bp, Artificial
  CRISPR gRNA sequence
ctctggtttcacaccacaac

SEQ ID NO: 496435 - DNA, 20 bp, Artificial
  CRISPR gRNA sequence
tggtttcacaccacaacaat

SEQ ID NO: 496436 - DNA, 20 bp, Artificial
  CRISPR gRNA sequence
gtttcacaccacaacaatca

SEQ ID NO: 496437 - DNA, 20 bp, Artificial
  CRISPR gRNA sequence
cacaccacaacaatcaacac

SEQ ID NO: 496438 - DNA, 20 bp, Artificial
  CRISPR gRNA sequence
acaccacaacaatcaacaca

SEQ ID NO: 496439 - DNA, 20 bp, Artificial
  CRISPR gRNA sequence
ctgtgaccaacgtgtgggga

SEQ ID NO: 496440 - DNA, 20 bp, Artificial
  CRISPR gRNA sequence
tgtgaccaacgtgtggggag

SEQ ID NO: 496441 - DNA, 20 bp, Artificial
  CRISPR gRNA sequence
tgaccaacgtgtggggagtt

SEQ ID NO: 496442 - DNA, 20 bp, Artificial
  CRISPR gRNA sequence
cccacgtgccaagcaagcaa

SEQ ID NO: 496443 - DNA, 20 bp, Artificial
  CRISPR gRNA sequence
ccacgtgccaagcaagcaat

SEQ ID NO: 496444 - DNA, 20 bp, Artificial
  CRISPR gRNA sequence
ttcagtggacaccaactgga

SEQ ID NO: 496445 - DNA, 20 bp, Artificial
  CRISPR gRNA sequence
cagtggacaccaactggatg

SEQ ID NO: 496446 - DNA, 20 bp, Artificial
  CRISPR gRNA sequence
agtggacaccaactggatgt

SEQ ID NO: 496447 - DNA, 20 bp, Artificial
  CRISPR gRNA sequence
gatgtcctctaattcagttc

SEQ ID NO: 496448 - DNA, 20 bp, Artificial
  CRISPR gRNA sequence
taattcagttcaattctgac

SEQ ID NO: 496449 - DNA, 20 bp, Artificial
  CRISPR gRNA sequence
attcagttcaattctgacac

SEQ ID NO: 496450 - DNA, 20 bp, Artificial
  CRISPR gRNA sequence
agttcaattctgacactatc

SEQ ID NO: 496451 - DNA, 20 bp, Artificial
  CRISPR gRNA sequence
aattctgacactatctacct

SEQ ID NO: 496452 - DNA, 20 bp, Artificial
  CRISPR gRNA sequence
tgacactatctacctgtaga

SEQ ID NO: 496453 - DNA, 20 bp, Artificial
  CRISPR gRNA sequence
acactatctacctgtagata

SEQ ID NO: 496454 - DNA, 20 bp, Artificial
  CRISPR gRNA sequence
tctacctgtagatatccacc

SEQ ID NO: 496455 - DNA, 20 bp, Artificial
  CRISPR gRNA sequence
cctgtagatatccaccagat

SEQ ID NO: 496456 - DNA, 20 bp, Artificial
  CRISPR gRNA sequence
tagatatccaccagatgcca

SEQ ID NO: 496457 - DNA, 20 bp, Artificial
  CRISPR gRNA sequence
caagctccagattgttttac

SEQ ID NO: 496458 - DNA, 20 bp, Artificial
  CRISPR gRNA sequence
cagattgttttacctgcgct

SEQ ID NO: 496459 - DNA, 20 bp, Artificial
  CRISPR gRNA sequence
ttttacctgcgcttctgacc

SEQ ID NO: 496460 - DNA, 20 bp, Artificial
  CRISPR gRNA sequence
tacctgcgcttctgaccaac

SEQ ID NO: 496461 - DNA, 20 bp, Artificial
  CRISPR gRNA sequence
acctgcgcttctgaccaact

SEQ ID NO: 496462 - DNA, 20 bp, Artificial
  CRISPR gRNA sequence
cctgcgcttctgaccaacta

SEQ ID NO: 496463 - DNA, 20 bp, Artificial
  CRISPR gRNA sequence
cgcttctgaccaactagcta

SEQ ID NO: 496464 - DNA, 20 bp, Artificial
  CRISPR gRNA sequence
ctgaccaactagctataaac

SEQ ID NO: 496465 - DNA, 20 bp, Artificial
  CRISPR gRNA sequence
tgaccaactagctataaact

SEQ ID NO: 496466 - DNA, 20 bp, Artificial
  CRISPR gRNA sequence
accaactagctataaactgg

SEQ ID NO: 496467 - DNA, 20 bp, Artificial
  CRISPR gRNA sequence
gctataaactgggtttcccg

SEQ ID NO: 496468 - DNA, 20 bp, Artificial
  CRISPR gRNA sequence
taaactgggtttcccgttat

SEQ ID NO: 496469 - DNA, 20 bp, Artificial
  CRISPR gRNA sequence
ggtttcccgttattccctcc

SEQ ID NO: 496470 - DNA, 20 bp, Artificial
  CRISPR gRNA sequence
cccgttattccctccttggg

SEQ ID NO: 496471 - DNA, 20 bp, Artificial
  CRISPR gRNA sequence
ccgttattccctccttgggt

SEQ ID NO: 496472 - DNA, 20 bp, Artificial
  CRISPR gRNA sequence
ttccctccttgggttcaatt

SEQ ID NO: 496473 - DNA, 20 bp, Artificial
  CRISPR gRNA sequence
cctccttgggttcaattaat

SEQ ID NO: 496474 - DNA, 20 bp, Artificial
  CRISPR gRNA sequence
cttgggttcaattaatttgc

SEQ ID NO: 496475 - DNA, 20 bp, Artificial
  CRISPR gRNA sequence
gggttcaattaatttgctag

SEQ ID NO: 496476 - DNA, 20 bp, Artificial
  CRISPR gRNA sequence
ggttcaattaatttgctaga

SEQ ID NO: 496477 - DNA, 20 bp, Artificial
  CRISPR gRNA sequence
aattaatttgctagatggct

SEQ ID NO: 496478 - DNA, 20 bp, Artificial
  CRISPR gRNA sequence
atttgctagatggctcacag

SEQ ID NO: 496479 - DNA, 20 bp, Artificial
  CRISPR gRNA sequence
gctagatggctcacagaact

SEQ ID NO: 496480 - DNA, 20 bp, Artificial
  CRISPR gRNA sequence
ctagatggctcacagaactc

SEQ ID NO: 496481 - DNA, 20 bp, Artificial
  CRISPR gRNA sequence
gatggctcacagaactcagg

SEQ ID NO: 496482 - DNA, 20 bp, Artificial
  CRISPR gRNA sequence
acagaactcagggaaacaca

SEQ ID NO: 496483 - DNA, 20 bp, Artificial
  CRISPR gRNA sequence
agggaaacacattcactgga

SEQ ID NO: 496484 - DNA, 20 bp, Artificial
  CRISPR gRNA sequence
actggattattataaaggtt

SEQ ID NO: 496485 - DNA, 20 bp, Artificial
  CRISPR gRNA sequence
gattattataaaggttatta

SEQ ID NO: 496486 - DNA, 20 bp, Artificial
  CRISPR gRNA sequence
ttataaaggttattacaaag

SEQ ID NO: 496487 - DNA, 20 bp, Artificial
  CRISPR gRNA sequence
taaaggttattacaaagggt

SEQ ID NO: 496488 - DNA, 20 bp, Artificial
  CRISPR gRNA sequence
ttacaaagggtacctatgaa

SEQ ID NO: 496489 - DNA, 20 bp, Artificial
  CRISPR gRNA sequence
caaagggtacctatgaagag

SEQ ID NO: 496490 - DNA, 20 bp, Artificial
  CRISPR gRNA sequence
tgaagagatgcataggacaa

SEQ ID NO: 496491 - DNA, 20 bp, Artificial
  CRISPR gRNA sequence
ccatgccttcccagggcgtg

SEQ ID NO: 496492 - DNA, 20 bp, Artificial
  CRISPR gRNA sequence
catgccttcccagggcgtgc

SEQ ID NO: 496493 - DNA, 20 bp, Artificial
  CRISPR gRNA sequence
cccagggcgtgccaccctcc

SEQ ID NO: 496494 - DNA, 20 bp, Artificial
  CRISPR gRNA sequence
ccagggcgtgccaccctcca

SEQ ID NO: 496495 - DNA, 20 bp, Artificial
  CRISPR gRNA sequence
caggaacctccgcatgttta

SEQ ID NO: 496496 - DNA, 20 bp, Artificial
  CRISPR gRNA sequence
cgcatgtttagctctctgaa

SEQ ID NO: 496497 - DNA, 20 bp, Artificial
  CRISPR gRNA sequence
agctctctgaaccttgttct

SEQ ID NO: 496498 - DNA, 20 bp, Artificial
  CRISPR gRNA sequence
gctctctgaaccttgttctt

SEQ ID NO: 496499 - DNA, 20 bp, Artificial
  CRISPR gRNA sequence
tctgaaccttgttctttggg

SEQ ID NO: 496500 - DNA, 20 bp, Artificial
  CRISPR gRNA sequence
tgaaccttgttctttgggtt

SEQ ID NO: 496501 - DNA, 20 bp, Artificial
  CRISPR gRNA sequence
aaccttgttctttgggtttt

SEQ ID NO: 496502 - DNA, 20 bp, Artificial
  CRISPR gRNA sequence
gttctttgggtttttatgga

SEQ ID NO: 496503 - DNA, 20 bp, Artificial
  CRISPR gRNA sequence
ttctttgggtttttatggag

SEQ ID NO: 496504 - DNA, 20 bp, Artificial
  CRISPR gRNA sequence
tttgggtttttatggaggcc

SEQ ID NO: 496505 - DNA, 20 bp, Artificial
  CRISPR gRNA sequence
tgggtttttatggaggcctc

SEQ ID NO: 496506 - DNA, 20 bp, Artificial
  CRISPR gRNA sequence
gggtttttatggaggcctca

SEQ ID NO: 496507 - DNA, 20 bp, Artificial
  CRISPR gRNA sequence
ggtttttatggaggcctcaa

SEQ ID NO: 496508 - DNA, 20 bp, Artificial
  CRISPR gRNA sequence
ttatggaggcctcaataaat

SEQ ID NO: 496509 - DNA, 20 bp, Artificial
  CRISPR gRNA sequence
tatggaggcctcaataaatg

SEQ ID NO: 496510 - DNA, 20 bp, Artificial
  CRISPR gRNA sequence
atggaggcctcaataaatgg

SEQ ID NO: 496511 - DNA, 20 bp, Artificial
  CRISPR gRNA sequence
tggaggcctcaataaatggg

SEQ ID NO: 496512 - DNA, 20 bp, Artificial
  CRISPR gRNA sequence
aataaatgggaatgattgac

SEQ ID NO: 496513 - DNA, 20 bp, Artificial
  CRISPR gRNA sequence
accactggccatcggtgatc

SEQ ID NO: 496514 - DNA, 20 bp, Artificial
  CRISPR gRNA sequence
gccatcggtgatcaacttaa

SEQ ID NO: 496515 - DNA, 20 bp, Artificial
  CRISPR gRNA sequence
aaccttcaatccctctcctt

SEQ ID NO: 496516 - DNA, 20 bp, Artificial
  CRISPR gRNA sequence
accttcaatccctctccttt

SEQ ID NO: 496517 - DNA, 20 bp, Artificial
  CRISPR gRNA sequence
caatccctctccttttcctg

SEQ ID NO: 496518 - DNA, 20 bp, Artificial
  CRISPR gRNA sequence
aatccctctccttttcctga

SEQ ID NO: 496519 - DNA, 20 bp, Artificial
  CRISPR gRNA sequence
tccttttcctgaaggttggg

SEQ ID NO: 496520 - DNA, 20 bp, Artificial
  CRISPR gRNA sequence
cttttcctgaaggttgggga

SEQ ID NO: 496521 - DNA, 20 bp, Artificial
  CRISPR gRNA sequence
ttcctgaaggttggggacgg

SEQ ID NO: 496522 - DNA, 20 bp, Artificial
  CRISPR gRNA sequence
tcctgaaggttggggacggg

SEQ ID NO: 496523 - DNA, 20 bp, Artificial
  CRISPR gRNA sequence
cctgaaggttggggacgggc

SEQ ID NO: 496524 - DNA, 20 bp, Artificial
  CRISPR gRNA sequence
ctgaaggttggggacgggct

SEQ ID NO: 496525 - DNA, 20 bp, Artificial
  CRISPR gRNA sequence
aaggttggggacgggctcag

SEQ ID NO: 496526 - DNA, 20 bp, Artificial
  CRISPR gRNA sequence
gggacgggctcagagtccaa

SEQ ID NO: 496527 - DNA, 20 bp, Artificial
  CRISPR gRNA sequence
agagtccaatattccaaccc

SEQ ID NO: 496528 - DNA, 20 bp, Artificial
  CRISPR gRNA sequence
caaccctgccttggtctttc

SEQ ID NO: 496529 - DNA, 20 bp, Artificial
  CRISPR gRNA sequence
ccttggtctttctggtgacc

SEQ ID NO: 496530 - DNA, 20 bp, Artificial
  CRISPR gRNA sequence
ggtctttctggtgaccggcc

SEQ ID NO: 496531 - DNA, 20 bp, Artificial
  CRISPR gRNA sequence
gtctttctggtgaccggccc

SEQ ID NO: 496532 - DNA, 20 bp, Artificial
  CRISPR gRNA sequence
tctggtgaccggcccctatc

SEQ ID NO: 496533 - DNA, 20 bp, Artificial
  CRISPR gRNA sequence
ctggtgaccggcccctatcc

SEQ ID NO: 496534 - DNA, 20 bp, Artificial
  CRISPR gRNA sequence
tggtgaccggcccctatccc

SEQ ID NO: 496535 - DNA, 20 bp, Artificial
  CRISPR gRNA sequence
gtgaccggcccctatcccga

SEQ ID NO: 496536 - DNA, 20 bp, Artificial
  CRISPR gRNA sequence
tcccgaagctgcctacaggc

SEQ ID NO: 496537 - DNA, 20 bp, Artificial
  CRISPR gRNA sequence
cctacaggctgccagccatc

SEQ ID NO: 496538 - DNA, 20 bp, Artificial
  CRISPR gRNA sequence
caggctgccagccatcggtc

SEQ ID NO: 496539 - DNA, 20 bp, Artificial
  CRISPR gRNA sequence
ccagccatcggtcacctcat

SEQ ID NO: 496540 - DNA, 20 bp, Artificial
  CRISPR gRNA sequence
attagcctacaaaaagacat

SEQ ID NO: 496541 - DNA, 20 bp, Artificial
  CRISPR gRNA sequence
gcctacaaaaagacatcact

SEQ ID NO: 496542 - DNA, 20 bp, Artificial
  CRISPR gRNA sequence
caaaaagacatcacttcgga

SEQ ID NO: 496543 - DNA, 20 bp, Artificial
  CRISPR gRNA sequence
cggaatttctaaaaatttta

SEQ ID NO: 496544 - DNA, 20 bp, Artificial
  CRISPR gRNA sequence
ggaatttctaaaaattttag

SEQ ID NO: 496545 - DNA, 20 bp, Artificial
  CRISPR gRNA sequence
ctaaaaattttaggaattgt

SEQ ID NO: 496546 - DNA, 20 bp, Artificial
  CRISPR gRNA sequence
taaaaattttaggaattgta

SEQ ID NO: 496547 - DNA, 20 bp, Artificial
  CRISPR gRNA sequence
aaaattttaggaattgtatg

SEQ ID NO: 496548 - DNA, 20 bp, Artificial
  CRISPR gRNA sequence
taggaattgtatgccaggaa

SEQ ID NO: 496549 - DNA, 20 bp, Artificial
  CRISPR gRNA sequence
aggaattgtatgccaggaaa

SEQ ID NO: 496550 - DNA, 20 bp, Artificial
  CRISPR gRNA sequence
ggaattgtatgccaggaaag

SEQ ID NO: 496551 - DNA, 20 bp, Artificial
  CRISPR gRNA sequence
tatgccaggaaaggaggttg

SEQ ID NO: 496552 - DNA, 20 bp, Artificial
  CRISPR gRNA sequence
aaaaccaaatatatatttca

SEQ ID NO: 496553 - DNA, 20 bp, Artificial
  CRISPR gRNA sequence
cacaatatcacacaaaccaa

SEQ ID NO: 496554 - DNA, 20 bp, Artificial
  CRISPR gRNA sequence
acaatatcacacaaaccaac

SEQ ID NO: 496555 - DNA, 20 bp, Artificial
  CRISPR gRNA sequence
gatcttttcaataaatggtg

SEQ ID NO: 496556 - DNA, 20 bp, Artificial
  CRISPR gRNA sequence
atcttttcaataaatggtgc

SEQ ID NO: 496557 - DNA, 20 bp, Artificial
  CRISPR gRNA sequence
ttcaataaatggtgcttggt

SEQ ID NO: 496558 - DNA, 20 bp, Artificial
  CRISPR gRNA sequence
tcaataaatggtgcttggtc

SEQ ID NO: 496559 - DNA, 20 bp, Artificial
  CRISPR gRNA sequence
caataaatggtgcttggtca

SEQ ID NO: 496560 - DNA, 20 bp, Artificial
  CRISPR gRNA sequence
aataaatggtgcttggtcaa

SEQ ID NO: 496561 - DNA, 20 bp, Artificial
  CRISPR gRNA sequence
ggtcaaattgatatctataa

SEQ ID NO: 496562 - DNA, 20 bp, Artificial
  CRISPR gRNA sequence
gtcaaattgatatctataag

SEQ ID NO: 496563 - DNA, 20 bp, Artificial
  CRISPR gRNA sequence
atatctataaggaaaaaaaa

SEQ ID NO: 496564 - DNA, 20 bp, Artificial
  CRISPR gRNA sequence
taaggaaaaaaaaccttgat

SEQ ID NO: 496565 - DNA, 20 bp, Artificial
  CRISPR gRNA sequence
gatatctccctcatatcata

SEQ ID NO: 496566 - DNA, 20 bp, Artificial
  CRISPR gRNA sequence
atatctccctcatatcatat

SEQ ID NO: 496567 - DNA, 20 bp, Artificial
  CRISPR gRNA sequence
cctcatatcatatacaaaaa

SEQ ID NO: 496568 - DNA, 20 bp, Artificial
  CRISPR gRNA sequence
atatcatatacaaaaattaa

SEQ ID NO: 496569 - DNA, 20 bp, Artificial
  CRISPR gRNA sequence
atttaaaacaaatcataaat

SEQ ID NO: 496570 - DNA, 20 bp, Artificial
  CRISPR gRNA sequence
aaaacaaatcataaatttaa

SEQ ID NO: 496571 - DNA, 20 bp, Artificial
  CRISPR gRNA sequence
aaacaaatcataaatttaaa

SEQ ID NO: 496572 - DNA, 20 bp, Artificial
  CRISPR gRNA sequence
aaatatgaaagctaaaccta

SEQ ID NO: 496573 - DNA, 20 bp, Artificial
  CRISPR gRNA sequence
aatatgaaagctaaacctat

SEQ ID NO: 496574 - DNA, 20 bp, Artificial
  CRISPR gRNA sequence
aacctataaagcttccagga

SEQ ID NO: 496575 - DNA, 20 bp, Artificial
  CRISPR gRNA sequence
taaagcttccaggaaaaagc

SEQ ID NO: 496576 - DNA, 20 bp, Artificial
  CRISPR gRNA sequence
ccaggaaaaagcacaagaga

SEQ ID NO: 496577 - DNA, 20 bp, Artificial
  CRISPR gRNA sequence
caggaaaaagcacaagagaa

SEQ ID NO: 496578 - DNA, 20 bp, Artificial
  CRISPR gRNA sequence
ctacatcttgagatagacaa

SEQ ID NO: 496579 - DNA, 20 bp, Artificial
  CRISPR gRNA sequence
tacatcttgagatagacaaa

SEQ ID NO: 496580 - DNA, 20 bp, Artificial
  CRISPR gRNA sequence
catcttgagatagacaaatg

SEQ ID NO: 496581 - DNA, 20 bp, Artificial
  CRISPR gRNA sequence
gagatagacaaatgtttcct

SEQ ID NO: 496582 - DNA, 20 bp, Artificial
  CRISPR gRNA sequence
agatagacaaatgtttcctt

SEQ ID NO: 496583 - DNA, 20 bp, Artificial
  CRISPR gRNA sequence
ccttttttatttttacattt

SEQ ID NO: 496584 - DNA, 20 bp, Artificial
  CRISPR gRNA sequence
cttttttatttttacatttt

SEQ ID NO: 496585 - DNA, 20 bp, Artificial
  CRISPR gRNA sequence
ttttatttttacattttaat

SEQ ID NO: 496586 - DNA, 20 bp, Artificial
  CRISPR gRNA sequence
tttatttttacattttaatc

SEQ ID NO: 496587 - DNA, 20 bp, Artificial
  CRISPR gRNA sequence
ttatttttacattttaatct

SEQ ID NO: 496588 - DNA, 20 bp, Artificial
  CRISPR gRNA sequence
tatttttacattttaatcta

SEQ ID NO: 496589 - DNA, 20 bp, Artificial
  CRISPR gRNA sequence
atttttacattttaatctat

SEQ ID NO: 496590 - DNA, 20 bp, Artificial
  CRISPR gRNA sequence
tttttacattttaatctatt

SEQ ID NO: 496591 - DNA, 20 bp, Artificial
  CRISPR gRNA sequence
ttacattttaatctattttt

SEQ ID NO: 496592 - DNA, 20 bp, Artificial
  CRISPR gRNA sequence
tacattttaatctattttta

SEQ ID NO: 496593 - DNA, 20 bp, Artificial
  CRISPR gRNA sequence
acattttaatctatttttat

SEQ ID NO: 496594 - DNA, 20 bp, Artificial
  CRISPR gRNA sequence
cattttaatctatttttatg

SEQ ID NO: 496595 - DNA, 20 bp, Artificial
  CRISPR gRNA sequence
taatctatttttatgtttat

SEQ ID NO: 496596 - DNA, 20 bp, Artificial
  CRISPR gRNA sequence
aatctatttttatgtttatt

SEQ ID NO: 496597 - DNA, 20 bp, Artificial
  CRISPR gRNA sequence
atctatttttatgtttattt

SEQ ID NO: 496598 - DNA, 20 bp, Artificial
  CRISPR gRNA sequence
tttttatgtttattttgaga

SEQ ID NO: 496599 - DNA, 20 bp, Artificial
  CRISPR gRNA sequence
ttatgtttattttgagacca

SEQ ID NO: 496600 - DNA, 20 bp, Artificial
  CRISPR gRNA sequence
tatgtttattttgagaccag

SEQ ID NO: 496601 - DNA, 20 bp, Artificial
  CRISPR gRNA sequence
atgtttattttgagaccaga

SEQ ID NO: 496602 - DNA, 20 bp, Artificial
  CRISPR gRNA sequence
tgtttattttgagaccagat

SEQ ID NO: 496603 - DNA, 20 bp, Artificial
  CRISPR gRNA sequence
attttgagaccagattatga

SEQ ID NO: 496604 - DNA, 20 bp, Artificial
  CRISPR gRNA sequence
ttttgagaccagattatgag

SEQ ID NO: 496605 - DNA, 20 bp, Artificial
  CRISPR gRNA sequence
tgagaccagattatgagact

SEQ ID NO: 496606 - DNA, 20 bp, Artificial
  CRISPR gRNA sequence
gagaccagattatgagactg

SEQ ID NO: 496607 - DNA, 20 bp, Artificial
  CRISPR gRNA sequence
agaccagattatgagactgg

SEQ ID NO: 496608 - DNA, 20 bp, Artificial
  CRISPR gRNA sequence
tgagactggctaatttttgc

SEQ ID NO: 496609 - DNA, 20 bp, Artificial
  CRISPR gRNA sequence
gctaatttttgcatttttgg

SEQ ID NO: 496610 - DNA, 20 bp, Artificial
  CRISPR gRNA sequence
atttttgcatttttggtaga

SEQ ID NO: 496611 - DNA, 20 bp, Artificial
  CRISPR gRNA sequence
ttgcatttttggtagagata

SEQ ID NO: 496612 - DNA, 20 bp, Artificial
  CRISPR gRNA sequence
tgcatttttggtagagatag

SEQ ID NO: 496613 - DNA, 20 bp, Artificial
  CRISPR gRNA sequence
gcatttttggtagagataga

SEQ ID NO: 496614 - DNA, 20 bp, Artificial
  CRISPR gRNA sequence
catttttggtagagatagag

SEQ ID NO: 496615 - DNA, 20 bp, Artificial
  CRISPR gRNA sequence
ttggtagagatagagtttca

SEQ ID NO: 496616 - DNA, 20 bp, Artificial
  CRISPR gRNA sequence
tggtagagatagagtttcac

SEQ ID NO: 496617 - DNA, 20 bp, Artificial
  CRISPR gRNA sequence
ggtagagatagagtttcacc

SEQ ID NO: 496618 - DNA, 20 bp, Artificial
  CRISPR gRNA sequence
gtagagatagagtttcacca

SEQ ID NO: 496619 - DNA, 20 bp, Artificial
  CRISPR gRNA sequence
caccatgttgccaaggcttg

SEQ ID NO: 496620 - DNA, 20 bp, Artificial
  CRISPR gRNA sequence
accatgttgccaaggcttgt

SEQ ID NO: 496621 - DNA, 20 bp, Artificial
  CRISPR gRNA sequence
ccaaggcttgtcttgaactc

SEQ ID NO: 496622 - DNA, 20 bp, Artificial
  CRISPR gRNA sequence
gtcttgaactcctgggctca

SEQ ID NO: 496623 - DNA, 20 bp, Artificial
  CRISPR gRNA sequence
tcttgaactcctgggctcaa

SEQ ID NO: 496624 - DNA, 20 bp, Artificial
  CRISPR gRNA sequence
gaactcctgggctcaagtga

SEQ ID NO: 496625 - DNA, 20 bp, Artificial
  CRISPR gRNA sequence
aactcctgggctcaagtgat

SEQ ID NO: 496626 - DNA, 20 bp, Artificial
  CRISPR gRNA sequence
ctgggctcaagtgatccacc

SEQ ID NO: 496627 - DNA, 20 bp, Artificial
  CRISPR gRNA sequence
ggctcaagtgatccacccgc

SEQ ID NO: 496628 - DNA, 20 bp, Artificial
  CRISPR gRNA sequence
aagtgatccacccgccttgg

SEQ ID NO: 496629 - DNA, 20 bp, Artificial
  CRISPR gRNA sequence
ggcctcccaaagcgctgaga

SEQ ID NO: 496630 - DNA, 20 bp, Artificial
  CRISPR gRNA sequence
gcctcccaaagcgctgagat

SEQ ID NO: 496631 - DNA, 20 bp, Artificial
  CRISPR gRNA sequence
ccaaagcgctgagattacag

SEQ ID NO: 496632 - DNA, 20 bp, Artificial
  CRISPR gRNA sequence
agattacaggcatgagccac

SEQ ID NO: 496633 - DNA, 20 bp, Artificial
  CRISPR gRNA sequence
caggcatgagccactgcacc

SEQ ID NO: 496634 - DNA, 20 bp, Artificial
  CRISPR gRNA sequence
cacccagacaacaaatgttt

SEQ ID NO: 496635 - DNA, 20 bp, Artificial
  CRISPR gRNA sequence
ctttaacaggacacacacac

SEQ ID NO: 496636 - DNA, 20 bp, Artificial
  CRISPR gRNA sequence
tttaacaggacacacacaca

SEQ ID NO: 496637 - DNA, 20 bp, Artificial
  CRISPR gRNA sequence
taacaggacacacacacaca

SEQ ID NO: 496638 - DNA, 20 bp, Artificial
  CRISPR gRNA sequence
aacaggacacacacacacaa

SEQ ID NO: 496639 - DNA, 20 bp, Artificial
  CRISPR gRNA sequence
acaggacacacacacacaaa

SEQ ID NO: 496640 - DNA, 20 bp, Artificial
  CRISPR gRNA sequence
accataaaagaatattgata

SEQ ID NO: 496641 - DNA, 20 bp, Artificial
  CRISPR gRNA sequence
ataaattggacttcactaaa

SEQ ID NO: 496642 - DNA, 20 bp, Artificial
  CRISPR gRNA sequence
gacttcactaaaacttagaa

SEQ ID NO: 496643 - DNA, 20 bp, Artificial
  CRISPR gRNA sequence
cactaaaacttagaacttct

SEQ ID NO: 496644 - DNA, 20 bp, Artificial
  CRISPR gRNA sequence
actaaaacttagaacttctg

SEQ ID NO: 496645 - DNA, 20 bp, Artificial
  CRISPR gRNA sequence
aaacttagaacttctgtttg

SEQ ID NO: 496646 - DNA, 20 bp, Artificial
  CRISPR gRNA sequence
agaacttctgtttggtgaaa

SEQ ID NO: 496647 - DNA, 20 bp, Artificial
  CRISPR gRNA sequence
gaacttctgtttggtgaaag

SEQ ID NO: 496648 - DNA, 20 bp, Artificial
  CRISPR gRNA sequence
ctgtttggtgaaagacaaca

SEQ ID NO: 496649 - DNA, 20 bp, Artificial
  CRISPR gRNA sequence
tgtttggtgaaagacaacat

SEQ ID NO: 496650 - DNA, 20 bp, Artificial
  CRISPR gRNA sequence
tttggtgaaagacaacattg

SEQ ID NO: 496651 - DNA, 20 bp, Artificial
  CRISPR gRNA sequence
ggtgaaagacaacattgaga

SEQ ID NO: 496652 - DNA, 20 bp, Artificial
  CRISPR gRNA sequence
gtgaaagacaacattgagag

SEQ ID NO: 496653 - DNA, 20 bp, Artificial
  CRISPR gRNA sequence
agagagtgaaaaagcaagcc

SEQ ID NO: 496654 - DNA, 20 bp, Artificial
  CRISPR gRNA sequence
ggagaaaatgtttgcaatac

SEQ ID NO: 496655 - DNA, 20 bp, Artificial
  CRISPR gRNA sequence
gcaatacatacatttgaaaa

SEQ ID NO: 496656 - DNA, 20 bp, Artificial
  CRISPR gRNA sequence
caatacatacatttgaaaaa

SEQ ID NO: 496657 - DNA, 20 bp, Artificial
  CRISPR gRNA sequence
gaaaaagggctcatatccag

SEQ ID NO: 496658 - DNA, 20 bp, Artificial
  CRISPR gRNA sequence
aaaaagggctcatatccaga

SEQ ID NO: 496659 - DNA, 20 bp, Artificial
  CRISPR gRNA sequence
atatccagagtatataaaga

SEQ ID NO: 496660 - DNA, 20 bp, Artificial
  CRISPR gRNA sequence
catcaataatagactgatga

SEQ ID NO: 496661 - DNA, 20 bp, Artificial
  CRISPR gRNA sequence
atgacaataatagactggaa

SEQ ID NO: 496662 - DNA, 20 bp, Artificial
  CRISPR gRNA sequence
gaaatcaataatacactgat

SEQ ID NO: 496663 - DNA, 20 bp, Artificial
  CRISPR gRNA sequence
atgacaataatgacaaaaaa

SEQ ID NO: 496664 - DNA, 20 bp, Artificial
  CRISPR gRNA sequence
gggcaggcactttaggaaag

SEQ ID NO: 496665 - DNA, 20 bp, Artificial
  CRISPR gRNA sequence
ggcaggcactttaggaaaga

SEQ ID NO: 496666 - DNA, 20 bp, Artificial
  CRISPR gRNA sequence
taggaaagagaatatccaat

SEQ ID NO: 496667 - DNA, 20 bp, Artificial
  CRISPR gRNA sequence
aggaaagagaatatccaata

SEQ ID NO: 496668 - DNA, 20 bp, Artificial
  CRISPR gRNA sequence
ggaaagagaatatccaatag

SEQ ID NO: 496669 - DNA, 20 bp, Artificial
  CRISPR gRNA sequence
gttatcagagaataatgaga

SEQ ID NO: 496670 - DNA, 20 bp, Artificial
  CRISPR gRNA sequence
tcagagaataatgagatttc

SEQ ID NO: 496671 - DNA, 20 bp, Artificial
  CRISPR gRNA sequence
cacattcccaccaaaatagc

SEQ ID NO: 496672 - DNA, 20 bp, Artificial
  CRISPR gRNA sequence
acattcccaccaaaatagct

SEQ ID NO: 496673 - DNA, 20 bp, Artificial
  CRISPR gRNA sequence
ccaccaaaatagctaacatt

SEQ ID NO: 496674 - DNA, 20 bp, Artificial
  CRISPR gRNA sequence
acatttaaaggtctgaaggc

SEQ ID NO: 496675 - DNA, 20 bp, Artificial
  CRISPR gRNA sequence
aaaggtctgaaggctgggcg

SEQ ID NO: 496676 - DNA, 20 bp, Artificial
  CRISPR gRNA sequence
aaggtctgaaggctgggcga

SEQ ID NO: 496677 - DNA, 20 bp, Artificial
  CRISPR gRNA sequence
aaggctgggcgaagcggctc

SEQ ID NO: 496678 - DNA, 20 bp, Artificial
  CRISPR gRNA sequence
ggcgaagcggctcaagcctg

SEQ ID NO: 496679 - DNA, 20 bp, Artificial
  CRISPR gRNA sequence
aagcctgtaatcccagcact

SEQ ID NO: 496680 - DNA, 20 bp, Artificial
  CRISPR gRNA sequence
taatcccagcactttgggag

SEQ ID NO: 496681 - DNA, 20 bp, Artificial
  CRISPR gRNA sequence
tgggaggccgaggcgggtgg

SEQ ID NO: 496682 - DNA, 20 bp, Artificial
  CRISPR gRNA sequence
gggaggccgaggcgggtgga

SEQ ID NO: 496683 - DNA, 20 bp, Artificial
  CRISPR gRNA sequence
ggaggccgaggcgggtggat

SEQ ID NO: 496684 - DNA, 20 bp, Artificial
  CRISPR gRNA sequence
gaggccaggagttcgaggcc

SEQ ID NO: 496685 - DNA, 20 bp, Artificial
  CRISPR gRNA sequence
aggccaggagttcgaggcca

SEQ ID NO: 496686 - DNA, 20 bp, Artificial
  CRISPR gRNA sequence
gaggccagcctggccaacat

SEQ ID NO: 496687 - DNA, 20 bp, Artificial
  CRISPR gRNA sequence
gccaacatggtgaaacccca

SEQ ID NO: 496688 - DNA, 20 bp, Artificial
  CRISPR gRNA sequence
tactaaaaatgcaaaaatta

SEQ ID NO: 496689 - DNA, 20 bp, Artificial
  CRISPR gRNA sequence
ctaaaaatgcaaaaattagc

SEQ ID NO: 496690 - DNA, 20 bp, Artificial
  CRISPR gRNA sequence
aaaatgcaaaaattagcaga

SEQ ID NO: 496691 - DNA, 20 bp, Artificial
  CRISPR gRNA sequence
gcagagcacggtggtggcgc

SEQ ID NO: 496692 - DNA, 20 bp, Artificial
  CRISPR gRNA sequence
taataccagcttcttgggag

SEQ ID NO: 496693 - DNA, 20 bp, Artificial
  CRISPR gRNA sequence
cttgggagtctgaggcagga

SEQ ID NO: 496694 - DNA, 20 bp, Artificial
  CRISPR gRNA sequence
ttgggagtctgaggcaggag

SEQ ID NO: 496695 - DNA, 20 bp, Artificial
  CRISPR gRNA sequence
gggagtctgaggcaggagaa

SEQ ID NO: 496696 - DNA, 20 bp, Artificial
  CRISPR gRNA sequence
ggagtctgaggcaggagaat

SEQ ID NO: 496697 - DNA, 20 bp, Artificial
  CRISPR gRNA sequence
aggcaggagaattgcttgaa

SEQ ID NO: 496698 - DNA, 20 bp, Artificial
  CRISPR gRNA sequence
cttgaacccaggaggcagag

SEQ ID NO: 496699 - DNA, 20 bp, Artificial
  CRISPR gRNA sequence
gaacccaggaggcagaggtt

SEQ ID NO: 496700 - DNA, 20 bp, Artificial
  CRISPR gRNA sequence
aacccaggaggcagaggttg

SEQ ID NO: 496701 - DNA, 20 bp, Artificial
  CRISPR gRNA sequence
cagtgagccaagatcacgcc

SEQ ID NO: 496702 - DNA, 20 bp, Artificial
  CRISPR gRNA sequence
tactccagcctgggtgacag

SEQ ID NO: 496703 - DNA, 20 bp, Artificial
  CRISPR gRNA sequence
cagcctgggtgacagactga

SEQ ID NO: 496704 - DNA, 20 bp, Artificial
  CRISPR gRNA sequence
ggtgacagactgagacttgg

SEQ ID NO: 496705 - DNA, 20 bp, Artificial
  CRISPR gRNA sequence
agacttggtctcgaaaataa

SEQ ID NO: 496706 - DNA, 20 bp, Artificial
  CRISPR gRNA sequence
ggtctcgaaaataaatgtaa

SEQ ID NO: 496707 - DNA, 20 bp, Artificial
  CRISPR gRNA sequence
gtctcgaaaataaatgtaaa

SEQ ID NO: 496708 - DNA, 20 bp, Artificial
  CRISPR gRNA sequence
gaaaataaatgtaaataaat

SEQ ID NO: 496709 - DNA, 20 bp, Artificial
  CRISPR gRNA sequence
caagggttgacagagatggg

SEQ ID NO: 496710 - DNA, 20 bp, Artificial
  CRISPR gRNA sequence
acagagatgggagcaactga

SEQ ID NO: 496711 - DNA, 20 bp, Artificial
  CRISPR gRNA sequence
agattctcatttattgctag

SEQ ID NO: 496712 - DNA, 20 bp, Artificial
  CRISPR gRNA sequence
tcatttattgctagtgagag

SEQ ID NO: 496713 - DNA, 20 bp, Artificial
  CRISPR gRNA sequence
atttattgctagtgagagtg

SEQ ID NO: 496714 - DNA, 20 bp, Artificial
  CRISPR gRNA sequence
attgctagtgagagtgtaaa

SEQ ID NO: 496715 - DNA, 20 bp, Artificial
  CRISPR gRNA sequence
ttgctagtgagagtgtaaat

SEQ ID NO: 496716 - DNA, 20 bp, Artificial
  CRISPR gRNA sequence
ctagtgagagtgtaaattgg

SEQ ID NO: 496717 - DNA, 20 bp, Artificial
  CRISPR gRNA sequence
gtgagagtgtaaattggtac

SEQ ID NO: 496718 - DNA, 20 bp, Artificial
  CRISPR gRNA sequence
gtaccagcactttggaaaac

SEQ ID NO: 496719 - DNA, 20 bp, Artificial
  CRISPR gRNA sequence
tggaaaactattttacggta

SEQ ID NO: 496720 - DNA, 20 bp, Artificial
  CRISPR gRNA sequence
ggaaaactattttacggtat

SEQ ID NO: 496721 - DNA, 20 bp, Artificial
  CRISPR gRNA sequence
gaaaactattttacggtatc

SEQ ID NO: 496722 - DNA, 20 bp, Artificial
  CRISPR gRNA sequence
ttttacggtatcttctaaaa

SEQ ID NO: 496723 - DNA, 20 bp, Artificial
  CRISPR gRNA sequence
tacggtatcttctaaaacta

SEQ ID NO: 496724 - DNA, 20 bp, Artificial
  CRISPR gRNA sequence
acggtatcttctaaaactaa

SEQ ID NO: 496725 - DNA, 20 bp, Artificial
  CRISPR gRNA sequence
cggtatcttctaaaactaaa

SEQ ID NO: 496726 - DNA, 20 bp, Artificial
  CRISPR gRNA sequence
ctaaaactaaacttacatat

SEQ ID NO: 496727 - DNA, 20 bp, Artificial
  CRISPR gRNA sequence
taaaactaaacttacatata

SEQ ID NO: 496728 - DNA, 20 bp, Artificial
  CRISPR gRNA sequence
aaactaaacttacatatacc

SEQ ID NO: 496729 - DNA, 20 bp, Artificial
  CRISPR gRNA sequence
aacttacatataccctttga

SEQ ID NO: 496730 - DNA, 20 bp, Artificial
  CRISPR gRNA sequence
acatataccctttgatccag

SEQ ID NO: 496731 - DNA, 20 bp, Artificial
  CRISPR gRNA sequence
catataccctttgatccaga

SEQ ID NO: 496732 - DNA, 20 bp, Artificial
  CRISPR gRNA sequence
tgatccagaagaatttgtac

SEQ ID NO: 496733 - DNA, 20 bp, Artificial
  CRISPR gRNA sequence
gatccagaagaatttgtaca

SEQ ID NO: 496734 - DNA, 20 bp, Artificial
  CRISPR gRNA sequence
atccagaagaatttgtacac

SEQ ID NO: 496735 - DNA, 20 bp, Artificial
  CRISPR gRNA sequence
gtacacaagaaaatctgggc

SEQ ID NO: 496736 - DNA, 20 bp, Artificial
  CRISPR gRNA sequence
tacacaagaaaatctgggcc

SEQ ID NO: 496737 - DNA, 20 bp, Artificial
  CRISPR gRNA sequence
ggccaggcatggtggctcat

SEQ ID NO: 496738 - DNA, 20 bp, Artificial
  CRISPR gRNA sequence
atgcctgtaatcccagcact

SEQ ID NO: 496739 - DNA, 20 bp, Artificial
  CRISPR gRNA sequence
taatcccagcactttgggag

SEQ ID NO: 496740 - DNA, 20 bp, Artificial
  CRISPR gRNA sequence
tgggaggtcgaggcaggcgg

SEQ ID NO: 496741 - DNA, 20 bp, Artificial
  CRISPR gRNA sequence
gggaggtcgaggcaggcgga

SEQ ID NO: 496742 - DNA, 20 bp, Artificial
  CRISPR gRNA sequence
ggaggtcgaggcaggcggat

SEQ ID NO: 496743 - DNA, 20 bp, Artificial
  CRISPR gRNA sequence
aggtcaggagtttgagacca

SEQ ID NO: 496744 - DNA, 20 bp, Artificial
  CRISPR gRNA sequence
gagaccagcctggccaacat

SEQ ID NO: 496745 - DNA, 20 bp, Artificial
  CRISPR gRNA sequence
agaccagcctggccaacatg

SEQ ID NO: 496746 - DNA, 20 bp, Artificial
  CRISPR gRNA sequence
gccaacatggtgaaacccca

SEQ ID NO: 496747 - DNA, 20 bp, Artificial
  CRISPR gRNA sequence
aaaaaaaagaaaaaaaatta

SEQ ID NO: 496748 - DNA, 20 bp, Artificial
  CRISPR gRNA sequence
gctgggcgtggcagtgcaca

SEQ ID NO: 496749 - DNA, 20 bp, Artificial
  CRISPR gRNA sequence
ggcgtggcagtgcacacctg

SEQ ID NO: 496750 - DNA, 20 bp, Artificial
  CRISPR gRNA sequence
taatcccagctacttggaag

SEQ ID NO: 496751 - DNA, 20 bp, Artificial
  CRISPR gRNA sequence
cttggaagactgaagcagga

SEQ ID NO: 496752 - DNA, 20 bp, Artificial
  CRISPR gRNA sequence
ggaagactgaagcaggagaa

SEQ ID NO: 496753 - DNA, 20 bp, Artificial
  CRISPR gRNA sequence
gaagactgaagcaggagaat

SEQ ID NO: 496754 - DNA, 20 bp, Artificial
  CRISPR gRNA sequence
aagcaggagaatcacttaaa

SEQ ID NO: 496755 - DNA, 20 bp, Artificial
  CRISPR gRNA sequence
aaatctgagaggcggaggtt

SEQ ID NO: 496756 - DNA, 20 bp, Artificial
  CRISPR gRNA sequence
aatctgagaggcggaggttg

SEQ ID NO: 496757 - DNA, 20 bp, Artificial
  CRISPR gRNA sequence
agaggcggaggttgcagtga

SEQ ID NO: 496758 - DNA, 20 bp, Artificial
  CRISPR gRNA sequence
cagtgagccaagatcatgcc

SEQ ID NO: 496759 - DNA, 20 bp, Artificial
  CRISPR gRNA sequence
cactccagcctgggcaacaa

SEQ ID NO: 496760 - DNA, 20 bp, Artificial
  CRISPR gRNA sequence
cagcctgggcaacaagagtg

SEQ ID NO: 496761 - DNA, 20 bp, Artificial
  CRISPR gRNA sequence
ggcaacaagagtgaaactcc

SEQ ID NO: 496762 - DNA, 20 bp, Artificial
  CRISPR gRNA sequence
cgtctcaaaaaaaaagaaaa

SEQ ID NO: 496763 - DNA, 20 bp, Artificial
  CRISPR gRNA sequence
aaaaaaaaagaaaatctggt

SEQ ID NO: 496764 - DNA, 20 bp, Artificial
  CRISPR gRNA sequence
gtgtttatatccactaaaaa

SEQ ID NO: 496765 - DNA, 20 bp, Artificial
  CRISPR gRNA sequence
atatccactaaaaatatgta

SEQ ID NO: 496766 - DNA, 20 bp, Artificial
  CRISPR gRNA sequence
tatccactaaaaatatgtac

SEQ ID NO: 496767 - DNA, 20 bp, Artificial
  CRISPR gRNA sequence
aaaatatgtacaagagtgtt

SEQ ID NO: 496768 - DNA, 20 bp, Artificial
  CRISPR gRNA sequence
ataatggctttagtcataat

SEQ ID NO: 496769 - DNA, 20 bp, Artificial
  CRISPR gRNA sequence
tagtcataataactcaaaat

SEQ ID NO: 496770 - DNA, 20 bp, Artificial
  CRISPR gRNA sequence
agtcataataactcaaaatg

SEQ ID NO: 496771 - DNA, 20 bp, Artificial
  CRISPR gRNA sequence
gtcataataactcaaaatga

SEQ ID NO: 496772 - DNA, 20 bp, Artificial
  CRISPR gRNA sequence
aaaatgagaaaaaacccaaa

SEQ ID NO: 496773 - DNA, 20 bp, Artificial
  CRISPR gRNA sequence
tcacgattagatgagcaaat

SEQ ID NO: 496774 - DNA, 20 bp, Artificial
  CRISPR gRNA sequence
gatgagcaaataaatcgtgt

SEQ ID NO: 496775 - DNA, 20 bp, Artificial
  CRISPR gRNA sequence
tagtcttataaggaatatta

SEQ ID NO: 496776 - DNA, 20 bp, Artificial
  CRISPR gRNA sequence
ataaggaatattacacagca

SEQ ID NO: 496777 - DNA, 20 bp, Artificial
  CRISPR gRNA sequence
taaggaatattacacagcaa

SEQ ID NO: 496778 - DNA, 20 bp, Artificial
  CRISPR gRNA sequence
cacagcaatgaaaaagaaaa

SEQ ID NO: 496779 - DNA, 20 bp, Artificial
  CRISPR gRNA sequence
cttttcctggcaataatgtg

SEQ ID NO: 496780 - DNA, 20 bp, Artificial
  CRISPR gRNA sequence
ttcctggcaataatgtggat

SEQ ID NO: 496781 - DNA, 20 bp, Artificial
  CRISPR gRNA sequence
tcctggcaataatgtggatg

SEQ ID NO: 496782 - DNA, 20 bp, Artificial
  CRISPR gRNA sequence
cctggcaataatgtggatgg

SEQ ID NO: 496783 - DNA, 20 bp, Artificial
  CRISPR gRNA sequence
ctggcaataatgtggatgga

SEQ ID NO: 496784 - DNA, 20 bp, Artificial
  CRISPR gRNA sequence
gcaataatgtggatggatct

SEQ ID NO: 496785 - DNA, 20 bp, Artificial
  CRISPR gRNA sequence
accacaatgatgagtattaa

SEQ ID NO: 496786 - DNA, 20 bp, Artificial
  CRISPR gRNA sequence
atgaagctagactccaaaaa

SEQ ID NO: 496787 - DNA, 20 bp, Artificial
  CRISPR gRNA sequence
gactccaaaaagtacatagt

SEQ ID NO: 496788 - DNA, 20 bp, Artificial
  CRISPR gRNA sequence
caaaaagtacatagtgaatt

SEQ ID NO: 496789 - DNA, 20 bp, Artificial
  CRISPR gRNA sequence
tttcactgatataaagttta

SEQ ID NO: 496790 - DNA, 20 bp, Artificial
  CRISPR gRNA sequence
cactgatataaagtttaaaa

SEQ ID NO: 496791 - DNA, 20 bp, Artificial
  CRISPR gRNA sequence
actgatataaagtttaaaat

SEQ ID NO: 496792 - DNA, 20 bp, Artificial
  CRISPR gRNA sequence
atataaagtttaaaatctgg

SEQ ID NO: 496793 - DNA, 20 bp, Artificial
  CRISPR gRNA sequence
aaaatctggaaaaactaata

SEQ ID NO: 496794 - DNA, 20 bp, Artificial
  CRISPR gRNA sequence
aaatctggaaaaactaatat

SEQ ID NO: 496795 - DNA, 20 bp, Artificial
  CRISPR gRNA sequence
gaaaaactaatatatggtga

SEQ ID NO: 496796 - DNA, 20 bp, Artificial
  CRISPR gRNA sequence
atatatggtgagagaggtta

SEQ ID NO: 496797 - DNA, 20 bp, Artificial
  CRISPR gRNA sequence
gaatgtgattacccttgcag

SEQ ID NO: 496798 - DNA, 20 bp, Artificial
  CRISPR gRNA sequence
cccttgcaggaggggggtta

SEQ ID NO: 496799 - DNA, 20 bp, Artificial
  CRISPR gRNA sequence
gcaggaggggggttatcaac

SEQ ID NO: 496800 - DNA, 20 bp, Artificial
  CRISPR gRNA sequence
caggaggggggttatcaact

SEQ ID NO: 496801 - DNA, 20 bp, Artificial
  CRISPR gRNA sequence
tcaacttgaagggccaaaaa

SEQ ID NO: 496802 - DNA, 20 bp, Artificial
  CRISPR gRNA sequence
gaagggccaaaaaggaatga

SEQ ID NO: 496803 - DNA, 20 bp, Artificial
  CRISPR gRNA sequence
aagggccaaaaaggaatgac

SEQ ID NO: 496804 - DNA, 20 bp, Artificial
  CRISPR gRNA sequence
ggtgctagaaatgtgttaca

SEQ ID NO: 496805 - DNA, 20 bp, Artificial
  CRISPR gRNA sequence
gaaatgtgttacatcttgat

SEQ ID NO: 496806 - DNA, 20 bp, Artificial
  CRISPR gRNA sequence
catcttgatgtgggtagttt

SEQ ID NO: 496807 - DNA, 20 bp, Artificial
  CRISPR gRNA sequence
gatgtgggtagttttgatat

SEQ ID NO: 496808 - DNA, 20 bp, Artificial
  CRISPR gRNA sequence
atgtgggtagttttgatatg

SEQ ID NO: 496809 - DNA, 20 bp, Artificial
  CRISPR gRNA sequence
tgatatgtacttacacatat

SEQ ID NO: 496810 - DNA, 20 bp, Artificial
  CRISPR gRNA sequence
gatatgtacttacacatata

SEQ ID NO: 496811 - DNA, 20 bp, Artificial
  CRISPR gRNA sequence
atatgtacttacacatataa

SEQ ID NO: 496812 - DNA, 20 bp, Artificial
  CRISPR gRNA sequence
acacatataaaagttcatca

SEQ ID NO: 496813 - DNA, 20 bp, Artificial
  CRISPR gRNA sequence
cacatataaaagttcatcaa

SEQ ID NO: 496814 - DNA, 20 bp, Artificial
  CRISPR gRNA sequence
atcaagctgttgatttaaat

SEQ ID NO: 496815 - DNA, 20 bp, Artificial
  CRISPR gRNA sequence
ttgatttaaattttgtgcac

SEQ ID NO: 496816 - DNA, 20 bp, Artificial
  CRISPR gRNA sequence
atttaaattttgtgcacaca

SEQ ID NO: 496817 - DNA, 20 bp, Artificial
  CRISPR gRNA sequence
aaattttgtgcacacagctg

SEQ ID NO: 496818 - DNA, 20 bp, Artificial
  CRISPR gRNA sequence
aattttgtgcacacagctgt

SEQ ID NO: 496819 - DNA, 20 bp, Artificial
  CRISPR gRNA sequence
tgtgcacacagctgtgagtt

SEQ ID NO: 496820 - DNA, 20 bp, Artificial
  CRISPR gRNA sequence
gtgcacacagctgtgagttg

SEQ ID NO: 496821 - DNA, 20 bp, Artificial
  CRISPR gRNA sequence
tgcacacagctgtgagttgt

SEQ ID NO: 496822 - DNA, 20 bp, Artificial
  CRISPR gRNA sequence
tgagttgtatcttggtaaaa

SEQ ID NO: 496823 - DNA, 20 bp, Artificial
  CRISPR gRNA sequence
tatcttggtaaaaaagcaga

SEQ ID NO: 496824 - DNA, 20 bp, Artificial
  CRISPR gRNA sequence
ggtaaaaaagcagaaaaaga

SEQ ID NO: 496825 - DNA, 20 bp, Artificial
  CRISPR gRNA sequence
gtaaaaaagcagaaaaagag

SEQ ID NO: 496826 - DNA, 20 bp, Artificial
  CRISPR gRNA sequence
cctctcactcaactgttctg

SEQ ID NO: 496827 - DNA, 20 bp, Artificial
  CRISPR gRNA sequence
tcactcaactgttctgacta

SEQ ID NO: 496828 - DNA, 20 bp, Artificial
  CRISPR gRNA sequence
actcaactgttctgactatt

SEQ ID NO: 496829 - DNA, 20 bp, Artificial
  CRISPR gRNA sequence
aactgttctgactattaact

SEQ ID NO: 496830 - DNA, 20 bp, Artificial
  CRISPR gRNA sequence
ttctgactattaactaagat

SEQ ID NO: 496831 - DNA, 20 bp, Artificial
  CRISPR gRNA sequence
tgactattaactaagatgta

SEQ ID NO: 496832 - DNA, 20 bp, Artificial
  CRISPR gRNA sequence
actattaactaagatgtact

SEQ ID NO: 496833 - DNA, 20 bp, Artificial
  CRISPR gRNA sequence
ttaactaagatgtactttga

SEQ ID NO: 496834 - DNA, 20 bp, Artificial
  CRISPR gRNA sequence
actaagatgtactttgataa

SEQ ID NO: 496835 - DNA, 20 bp, Artificial
  CRISPR gRNA sequence
agatgtactttgataaaagc

SEQ ID NO: 496836 - DNA, 20 bp, Artificial
  CRISPR gRNA sequence
tgataaaagcaaaatatgac

SEQ ID NO: 496837 - DNA, 20 bp, Artificial
  CRISPR gRNA sequence
gataaaagcaaaatatgact

SEQ ID NO: 496838 - DNA, 20 bp, Artificial
  CRISPR gRNA sequence
ataaaagcaaaatatgactt

SEQ ID NO: 496839 - DNA, 20 bp, Artificial
  CRISPR gRNA sequence
gcccattgtggaaacattac

SEQ ID NO: 496840 - DNA, 20 bp, Artificial
  CRISPR gRNA sequence
cccattgtggaaacattacc

SEQ ID NO: 496841 - DNA, 20 bp, Artificial
  CRISPR gRNA sequence
tggaaacattaccatagcaa

SEQ ID NO: 496842 - DNA, 20 bp, Artificial
  CRISPR gRNA sequence
ccatagcaagtgaatttgta

SEQ ID NO: 496843 - DNA, 20 bp, Artificial
  CRISPR gRNA sequence
gtagatttcctcactcatct

SEQ ID NO: 496844 - DNA, 20 bp, Artificial
  CRISPR gRNA sequence
tagatttcctcactcatctc

SEQ ID NO: 496845 - DNA, 20 bp, Artificial
  CRISPR gRNA sequence
cctcactcatctcagctaaa

SEQ ID NO: 496846 - DNA, 20 bp, Artificial
  CRISPR gRNA sequence
ctcactcatctcagctaaac

SEQ ID NO: 496847 - DNA, 20 bp, Artificial
  CRISPR gRNA sequence
actcatctcagctaaaccca

SEQ ID NO: 496848 - DNA, 20 bp, Artificial
  CRISPR gRNA sequence
atctcagctaaacccaactc

SEQ ID NO: 496849 - DNA, 20 bp, Artificial
  CRISPR gRNA sequence
agctaaacccaactcttagc

SEQ ID NO: 496850 - DNA, 20 bp, Artificial
  CRISPR gRNA sequence
aacccaactcttagctaaat

SEQ ID NO: 496851 - DNA, 20 bp, Artificial
  CRISPR gRNA sequence
ttagctaaatatcagaaaag

SEQ ID NO: 496852 - DNA, 20 bp, Artificial
  CRISPR gRNA sequence
agctaaatatcagaaaagcc

SEQ ID NO: 496853 - DNA, 20 bp, Artificial
  CRISPR gRNA sequence
gctaaatatcagaaaagcct

SEQ ID NO: 496854 - DNA, 20 bp, Artificial
  CRISPR gRNA sequence
aatatcagaaaagcctggga

SEQ ID NO: 496855 - DNA, 20 bp, Artificial
  CRISPR gRNA sequence
ggaggcaggggttgcagtga

SEQ ID NO: 496856 - DNA, 20 bp, Artificial
  CRISPR gRNA sequence
cagtgagccatgactgcacc

SEQ ID NO: 496857 - DNA, 20 bp, Artificial
  CRISPR gRNA sequence
caccactgcaccccagcctg

SEQ ID NO: 496858 - DNA, 20 bp, Artificial
  CRISPR gRNA sequence
caccccagcctgggtgacag

SEQ ID NO: 496859 - DNA, 20 bp, Artificial
  CRISPR gRNA sequence
ggtgacagagcaagaccctg

SEQ ID NO: 496860 - DNA, 20 bp, Artificial
  CRISPR gRNA sequence
cctaaaaaaaaaaaaaaaaa

SEQ ID NO: 496861 - DNA, 20 bp, Artificial
  CRISPR gRNA sequence
aaaaaaaaaaaaaaaaaaaa

SEQ ID NO: 496862 - DNA, 20 bp, Artificial
  CRISPR gRNA sequence
aaacagccaactgaaatgca

SEQ ID NO: 496863 - DNA, 20 bp, Artificial
  CRISPR gRNA sequence
aaatgcaatatggaatgtgc

SEQ ID NO: 496864 - DNA, 20 bp, Artificial
  CRISPR gRNA sequence
tggaggtgtgcccagggtgt

SEQ ID NO: 496865 - DNA, 20 bp, Artificial
  CRISPR gRNA sequence
tcctctgccctgcagagtta

SEQ ID NO: 496866 - DNA, 20 bp, Artificial
  CRISPR gRNA sequence
cctctgccctgcagagttag

SEQ ID NO: 496867 - DNA, 20 bp, Artificial
  CRISPR gRNA sequence
ctctgccctgcagagttagg

SEQ ID NO: 496868 - DNA, 20 bp, Artificial
  CRISPR gRNA sequence
tgccctgcagagttaggagt

SEQ ID NO: 496869 - DNA, 20 bp, Artificial
  CRISPR gRNA sequence
ccctgcagagttaggagtgg

SEQ ID NO: 496870 - DNA, 20 bp, Artificial
  CRISPR gRNA sequence
cagagttaggagtggctgcc

SEQ ID NO: 496871 - DNA, 20 bp, Artificial
  CRISPR gRNA sequence
ggagtggctgcccagaggcg

SEQ ID NO: 496872 - DNA, 20 bp, Artificial
  CRISPR gRNA sequence
cccagaggcggtgggtggga

SEQ ID NO: 496873 - DNA, 20 bp, Artificial
  CRISPR gRNA sequence
ccattgaaagaaaaagccaa

SEQ ID NO: 496874 - DNA, 20 bp, Artificial
  CRISPR gRNA sequence
aaagaaaaagccaaggcctg

SEQ ID NO: 496875 - DNA, 20 bp, Artificial
  CRISPR gRNA sequence
cctggtgtatgcagaaagga

SEQ ID NO: 496876 - DNA, 20 bp, Artificial
  CRISPR gRNA sequence
gtgtatgcagaaaggaacag

SEQ ID NO: 496877 - DNA, 20 bp, Artificial
  CRISPR gRNA sequence
tggacccagcagtagcatgg

SEQ ID NO: 496878 - DNA, 20 bp, Artificial
  CRISPR gRNA sequence
agggaacacaaaacacacgt

SEQ ID NO: 496879 - DNA, 20 bp, Artificial
  CRISPR gRNA sequence
atgggtctggtaaagatgga

SEQ ID NO: 496880 - DNA, 20 bp, Artificial
  CRISPR gRNA sequence
tgggtctggtaaagatggag

SEQ ID NO: 496881 - DNA, 20 bp, Artificial
  CRISPR gRNA sequence
gtaaagatggagcaggtttg

SEQ ID NO: 496882 - DNA, 20 bp, Artificial
  CRISPR gRNA sequence
ggagaatggggtgatggaac

SEQ ID NO: 496883 - DNA, 20 bp, Artificial
  CRISPR gRNA sequence
gagaatggggtgatggaaca

SEQ ID NO: 496884 - DNA, 20 bp, Artificial
  CRISPR gRNA sequence
aattttcaggtgtttagtgg

SEQ ID NO: 496885 - DNA, 20 bp, Artificial
  CRISPR gRNA sequence
attttcaggtgtttagtggt

SEQ ID NO: 496886 - DNA, 20 bp, Artificial
  CRISPR gRNA sequence
tcaggtgtttagtggtggtt

SEQ ID NO: 496887 - DNA, 20 bp, Artificial
  CRISPR gRNA sequence
caggtgtttagtggtggttt

SEQ ID NO: 496888 - DNA, 20 bp, Artificial
  CRISPR gRNA sequence
aggtgtttagtggtggtttc

SEQ ID NO: 496889 - DNA, 20 bp, Artificial
  CRISPR gRNA sequence
agtggtggtttcactttatt

SEQ ID NO: 496890 - DNA, 20 bp, Artificial
  CRISPR gRNA sequence
gtggtggtttcactttattt

SEQ ID NO: 496891 - DNA, 20 bp, Artificial
  CRISPR gRNA sequence
cactttatttttatctttta

SEQ ID NO: 496892 - DNA, 20 bp, Artificial
  CRISPR gRNA sequence
actttatttttatcttttat

SEQ ID NO: 496893 - DNA, 20 bp, Artificial
  CRISPR gRNA sequence
tatttttatcttttataaaa

SEQ ID NO: 496894 - DNA, 20 bp, Artificial
  CRISPR gRNA sequence
atttttatcttttataaaat

SEQ ID NO: 496895 - DNA, 20 bp, Artificial
  CRISPR gRNA sequence
tttttatcttttataaaatt

SEQ ID NO: 496896 - DNA, 20 bp, Artificial
  CRISPR gRNA sequence
ttatcttttataaaattgtg

SEQ ID NO: 496897 - DNA, 20 bp, Artificial
  CRISPR gRNA sequence
tatcttttataaaattgtga

SEQ ID NO: 496898 - DNA, 20 bp, Artificial
  CRISPR gRNA sequence
atcttttataaaattgtgag

SEQ ID NO: 496899 - DNA, 20 bp, Artificial
  CRISPR gRNA sequence
tcttttataaaattgtgaga

SEQ ID NO: 496900 - DNA, 20 bp, Artificial
  CRISPR gRNA sequence
ttataaaattgtgagaggta

SEQ ID NO: 496901 - DNA, 20 bp, Artificial
  CRISPR gRNA sequence
tataaaattgtgagaggtag

SEQ ID NO: 496902 - DNA, 20 bp, Artificial
  CRISPR gRNA sequence
ataaaattgtgagaggtagc

SEQ ID NO: 496903 - DNA, 20 bp, Artificial
  CRISPR gRNA sequence
taaaattgtgagaggtagca

SEQ ID NO: 496904 - DNA, 20 bp, Artificial
  CRISPR gRNA sequence
tgagaggtagcacaagtatt

SEQ ID NO: 496905 - DNA, 20 bp, Artificial
  CRISPR gRNA sequence
aaaggtacttaaatataaat

SEQ ID NO: 496906 - DNA, 20 bp, Artificial
  CRISPR gRNA sequence
aaatataaatatacggtgta

SEQ ID NO: 496907 - DNA, 20 bp, Artificial
  CRISPR gRNA sequence
aatataaatatacggtgtaa

SEQ ID NO: 496908 - DNA, 20 bp, Artificial
  CRISPR gRNA sequence
ccatataatccaccagtaga

SEQ ID NO: 496909 - DNA, 20 bp, Artificial
  CRISPR gRNA sequence
tgtagaagaaggttgttctc

SEQ ID NO: 496910 - DNA, 20 bp, Artificial
  CRISPR gRNA sequence
ttctctgctattataaaact

SEQ ID NO: 496911 - DNA, 20 bp, Artificial
  CRISPR gRNA sequence
tctgctattataaaactgaa

SEQ ID NO: 496912 - DNA, 20 bp, Artificial
  CRISPR gRNA sequence
tgctattataaaactgaata

SEQ ID NO: 496913 - DNA, 20 bp, Artificial
  CRISPR gRNA sequence
ctattataaaactgaatagg

SEQ ID NO: 496914 - DNA, 20 bp, Artificial
  CRISPR gRNA sequence
ttataaaactgaataggaat

SEQ ID NO: 496915 - DNA, 20 bp, Artificial
  CRISPR gRNA sequence
taaaactgaataggaatcac

SEQ ID NO: 496916 - DNA, 20 bp, Artificial
  CRISPR gRNA sequence
aataggaatcacacaggaaa

SEQ ID NO: 496917 - DNA, 20 bp, Artificial
  CRISPR gRNA sequence
agttattgtctagacttctt

SEQ ID NO: 496918 - DNA, 20 bp, Artificial
  CRISPR gRNA sequence
ttgtctagacttctttgttt

SEQ ID NO: 496919 - DNA, 20 bp, Artificial
  CRISPR gRNA sequence
tctagacttctttgtttgtt

SEQ ID NO: 496920 - DNA, 20 bp, Artificial
  CRISPR gRNA sequence
gacttctttgtttgtttgtt

SEQ ID NO: 496921 - DNA, 20 bp, Artificial
  CRISPR gRNA sequence
ctttgtttgtttgtttgttt

SEQ ID NO: 496922 - DNA, 20 bp, Artificial
  CRISPR gRNA sequence
tttgtttgtttgtttgtttt

SEQ ID NO: 496923 - DNA, 20 bp, Artificial
  CRISPR gRNA sequence
tgtttgtttgtttgttttaa

SEQ ID NO: 496924 - DNA, 20 bp, Artificial
  CRISPR gRNA sequence
gtttgtttgtttgttttaag

SEQ ID NO: 496925 - DNA, 20 bp, Artificial
  CRISPR gRNA sequence
tttgtttgtttgttttaaga

SEQ ID NO: 496926 - DNA, 20 bp, Artificial
  CRISPR gRNA sequence
gtttgtttgttttaagacag

SEQ ID NO: 496927 - DNA, 20 bp, Artificial
  CRISPR gRNA sequence
tttgtttgttttaagacaga

SEQ ID NO: 496928 - DNA, 20 bp, Artificial
  CRISPR gRNA sequence
gtttgttttaagacagagtc

SEQ ID NO: 496929 - DNA, 20 bp, Artificial
  CRISPR gRNA sequence
tttgttttaagacagagtct

SEQ ID NO: 496930 - DNA, 20 bp, Artificial
  CRISPR gRNA sequence
gttttaagacagagtctcgc

SEQ ID NO: 496931 - DNA, 20 bp, Artificial
  CRISPR gRNA sequence
ttttaagacagagtctcgct

SEQ ID NO: 496932 - DNA, 20 bp, Artificial
  CRISPR gRNA sequence
taagacagagtctcgctctg

SEQ ID NO: 496933 - DNA, 20 bp, Artificial
  CRISPR gRNA sequence
aagacagagtctcgctctgt

SEQ ID NO: 496934 - DNA, 20 bp, Artificial
  CRISPR gRNA sequence
agacagagtctcgctctgtc

SEQ ID NO: 496935 - DNA, 20 bp, Artificial
  CRISPR gRNA sequence
gctctgtcacccagactggt

SEQ ID NO: 496936 - DNA, 20 bp, Artificial
  CRISPR gRNA sequence
tgtcacccagactggtgtgc

SEQ ID NO: 496937 - DNA, 20 bp, Artificial
  CRISPR gRNA sequence
tcacccagactggtgtgcag

SEQ ID NO: 496938 - DNA, 20 bp, Artificial
  CRISPR gRNA sequence
gtgtgcagtggcatgatctc

SEQ ID NO: 496939 - DNA, 20 bp, Artificial
  CRISPR gRNA sequence
ggctcactgcaatctctgcc

SEQ ID NO: 496940 - DNA, 20 bp, Artificial
  CRISPR gRNA sequence
actgcaatctctgcctccca

SEQ ID NO: 496941 - DNA, 20 bp, Artificial
  CRISPR gRNA sequence
caatctctgcctcccaggtt

SEQ ID NO: 496942 - DNA, 20 bp, Artificial
  CRISPR gRNA sequence
tgcctcccaggttcaagtga

SEQ ID NO: 496943 - DNA, 20 bp, Artificial
  CRISPR gRNA sequence
cctcccaggttcaagtgatt

SEQ ID NO: 496944 - DNA, 20 bp, Artificial
  CRISPR gRNA sequence
ccaggttcaagtgattctcc

SEQ ID NO: 496945 - DNA, 20 bp, Artificial
  CRISPR gRNA sequence
aagtgattctcctgtctcag

SEQ ID NO: 496946 - DNA, 20 bp, Artificial
  CRISPR gRNA sequence
tcctgtctcagcctcatgag

SEQ ID NO: 496947 - DNA, 20 bp, Artificial
  CRISPR gRNA sequence
ctgtctcagcctcatgagta

SEQ ID NO: 496948 - DNA, 20 bp, Artificial
  CRISPR gRNA sequence
tctcagcctcatgagtaact

SEQ ID NO: 496949 - DNA, 20 bp, Artificial
  CRISPR gRNA sequence
agcctcatgagtaactggga

SEQ ID NO: 496950 - DNA, 20 bp, Artificial
  CRISPR gRNA sequence
atgagtaactgggactacag

SEQ ID NO: 496951 - DNA, 20 bp, Artificial
  CRISPR gRNA sequence
ggactacaggtgcctgccac

SEQ ID NO: 496952 - DNA, 20 bp, Artificial
  CRISPR gRNA sequence
caggtgcctgccaccacccc

SEQ ID NO: 496953 - DNA, 20 bp, Artificial
  CRISPR gRNA sequence
ccaccacccccagctattct

SEQ ID NO: 496954 - DNA, 20 bp, Artificial
  CRISPR gRNA sequence
ttcttttttttttttttgta

SEQ ID NO: 496955 - DNA, 20 bp, Artificial
  CRISPR gRNA sequence
ttttttttttttttgtattt

SEQ ID NO: 496956 - DNA, 20 bp, Artificial
  CRISPR gRNA sequence
ttttttttttttgtattttt

SEQ ID NO: 496957 - DNA, 20 bp, Artificial
  CRISPR gRNA sequence
tttttttttttgtattttta

SEQ ID NO: 496958 - DNA, 20 bp, Artificial
  CRISPR gRNA sequence
ttttttttttgtatttttag

SEQ ID NO: 496959 - DNA, 20 bp, Artificial
  CRISPR gRNA sequence
tttttttttgtatttttagt

SEQ ID NO: 496960 - DNA, 20 bp, Artificial
  CRISPR gRNA sequence
ttttttttgtatttttagta

SEQ ID NO: 496961 - DNA, 20 bp, Artificial
  CRISPR gRNA sequence
tttttttgtatttttagtag

SEQ ID NO: 496962 - DNA, 20 bp, Artificial
  CRISPR gRNA sequence
ttttttgtatttttagtaga

SEQ ID NO: 496963 - DNA, 20 bp, Artificial
  CRISPR gRNA sequence
tttttgtatttttagtagag

SEQ ID NO: 496964 - DNA, 20 bp, Artificial
  CRISPR gRNA sequence
ttttgtatttttagtagaga

SEQ ID NO: 496965 - DNA, 20 bp, Artificial
  CRISPR gRNA sequence
tttgtatttttagtagagac

SEQ ID NO: 496966 - DNA, 20 bp, Artificial
  CRISPR gRNA sequence
ttgtatttttagtagagaca

SEQ ID NO: 496967 - DNA, 20 bp, Artificial
  CRISPR gRNA sequence
tgtatttttagtagagacag

SEQ ID NO: 496968 - DNA, 20 bp, Artificial
  CRISPR gRNA sequence
gtatttttagtagagacagg

SEQ ID NO: 496969 - DNA, 20 bp, Artificial
  CRISPR gRNA sequence
tatttttagtagagacaggg

SEQ ID NO: 496970 - DNA, 20 bp, Artificial
  CRISPR gRNA sequence
ttagtagagacagggtttcg

SEQ ID NO: 496971 - DNA, 20 bp, Artificial
  CRISPR gRNA sequence
tagtagagacagggtttcgc

SEQ ID NO: 496972 - DNA, 20 bp, Artificial
  CRISPR gRNA sequence
agtagagacagggtttcgcc

SEQ ID NO: 496973 - DNA, 20 bp, Artificial
  CRISPR gRNA sequence
gtagagacagggtttcgcca

SEQ ID NO: 496974 - DNA, 20 bp, Artificial
  CRISPR gRNA sequence
cgccatattggccaggctgg

SEQ ID NO: 496975 - DNA, 20 bp, Artificial
  CRISPR gRNA sequence
gccatattggccaggctggt

SEQ ID NO: 496976 - DNA, 20 bp, Artificial
  CRISPR gRNA sequence
gccaggctggtcttgaactc

SEQ ID NO: 496977 - DNA, 20 bp, Artificial
  CRISPR gRNA sequence
gtcttgaactcctgacctca

SEQ ID NO: 496978 - DNA, 20 bp, Artificial
  CRISPR gRNA sequence
gaactcctgacctcaagtaa

SEQ ID NO: 496979 - DNA, 20 bp, Artificial
  CRISPR gRNA sequence
aactcctgacctcaagtaat

SEQ ID NO: 496980 - DNA, 20 bp, Artificial
  CRISPR gRNA sequence
ctgacctcaagtaatccacc

SEQ ID NO: 496981 - DNA, 20 bp, Artificial
  CRISPR gRNA sequence
acctcaagtaatccacccgt

SEQ ID NO: 496982 - DNA, 20 bp, Artificial
  CRISPR gRNA sequence
aagtaatccacccgtctcag

SEQ ID NO: 496983 - DNA, 20 bp, Artificial
  CRISPR gRNA sequence
agcctcccaaagttctggcg

SEQ ID NO: 496984 - DNA, 20 bp, Artificial
  CRISPR gRNA sequence
ccaaagttctggcgtgagcc

SEQ ID NO: 496985 - DNA, 20 bp, Artificial
  CRISPR gRNA sequence
tggcgtgagccaccactccc

SEQ ID NO: 496986 - DNA, 20 bp, Artificial
  CRISPR gRNA sequence
gcgtgagccaccactcccag

SEQ ID NO: 496987 - DNA, 20 bp, Artificial
  CRISPR gRNA sequence
ccagccatagacttctaaat

SEQ ID NO: 496988 - DNA, 20 bp, Artificial
  CRISPR gRNA sequence
ctaaatacttaaagaatgaa

SEQ ID NO: 496989 - DNA, 20 bp, Artificial
  CRISPR gRNA sequence
taaatacttaaagaatgaaa

SEQ ID NO: 496990 - DNA, 20 bp, Artificial
  CRISPR gRNA sequence
aatacttaaagaatgaaatg

SEQ ID NO: 496991 - DNA, 20 bp, Artificial
  CRISPR gRNA sequence
aaagaatgaaatgtgtgatc

SEQ ID NO: 496992 - DNA, 20 bp, Artificial
  CRISPR gRNA sequence
aagaatgaaatgtgtgatct

SEQ ID NO: 496993 - DNA, 20 bp, Artificial
  CRISPR gRNA sequence
cagtcctcatgctatactgc

SEQ ID NO: 496994 - DNA, 20 bp, Artificial
  CRISPR gRNA sequence
atgctatactgcctttgggg

SEQ ID NO: 496995 - DNA, 20 bp, Artificial
  CRISPR gRNA sequence
tactgcctttggggtctttt

SEQ ID NO: 496996 - DNA, 20 bp, Artificial
  CRISPR gRNA sequence
cctttggggtctttttaaaa

SEQ ID NO: 496997 - DNA, 20 bp, Artificial
  CRISPR gRNA sequence
tggggtctttttaaaaatta

SEQ ID NO: 496998 - DNA, 20 bp, Artificial
  CRISPR gRNA sequence
ggggtctttttaaaaattag

SEQ ID NO: 496999 - DNA, 20 bp, Artificial
  CRISPR gRNA sequence
gggtctttttaaaaattagg

SEQ ID NO: 497000 - DNA, 20 bp, Artificial
  CRISPR gRNA sequence
tttaaaaattaggccgttat

SEQ ID NO: 497001 - DNA, 20 bp, Artificial
  CRISPR gRNA sequence
ttaaaaattaggccgttata

SEQ ID NO: 497002 - DNA, 20 bp, Artificial
  CRISPR gRNA sequence
taaaaattaggccgttatat

SEQ ID NO: 497003 - DNA, 20 bp, Artificial
  CRISPR gRNA sequence
aaaaattaggccgttatatt

SEQ ID NO: 497004 - DNA, 20 bp, Artificial
  CRISPR gRNA sequence
aaaattaggccgttatattt

SEQ ID NO: 497005 - DNA, 20 bp, Artificial
  CRISPR gRNA sequence
ggccgttatattttattttt

SEQ ID NO: 497006 - DNA, 20 bp, Artificial
  CRISPR gRNA sequence
tattttatttttatgtaata

SEQ ID NO: 497007 - DNA, 20 bp, Artificial
  CRISPR gRNA sequence
tatttttatgtaatattata

SEQ ID NO: 497008 - DNA, 20 bp, Artificial
  CRISPR gRNA sequence
atttttatgtaatattatat

SEQ ID NO: 497009 - DNA, 20 bp, Artificial
  CRISPR gRNA sequence
tttttatgtaatattatatt

SEQ ID NO: 497010 - DNA, 20 bp, Artificial
  CRISPR gRNA sequence
ttatgtaatattatattagt

SEQ ID NO: 497011 - DNA, 20 bp, Artificial
  CRISPR gRNA sequence
tatgtaatattatattagtt

SEQ ID NO: 497012 - DNA, 20 bp, Artificial
  CRISPR gRNA sequence
atgtaatattatattagttt

SEQ ID NO: 497013 - DNA, 20 bp, Artificial
  CRISPR gRNA sequence
tgtaatattatattagttta

SEQ ID NO: 497014 - DNA, 20 bp, Artificial
  CRISPR gRNA sequence
tattagtttatacatttaag

SEQ ID NO: 497015 - DNA, 20 bp, Artificial
  CRISPR gRNA sequence
gtttatacatttaagactgg

SEQ ID NO: 497016 - DNA, 20 bp, Artificial
  CRISPR gRNA sequence
atacatttaagactggtttg

SEQ ID NO: 497017 - DNA, 20 bp, Artificial
  CRISPR gRNA sequence
tacatttaagactggtttgt

SEQ ID NO: 497018 - DNA, 20 bp, Artificial
  CRISPR gRNA sequence
aagactggtttgtctgcaaa

SEQ ID NO: 497019 - DNA, 20 bp, Artificial
  CRISPR gRNA sequence
agactggtttgtctgcaaat

SEQ ID NO: 497020 - DNA, 20 bp, Artificial
  CRISPR gRNA sequence
gtttgtctgcaaataaaaag

SEQ ID NO: 497021 - DNA, 20 bp, Artificial
  CRISPR gRNA sequence
gtctgcaaataaaaaggagc

SEQ ID NO: 497022 - DNA, 20 bp, Artificial
  CRISPR gRNA sequence
tctgcaaataaaaaggagct

SEQ ID NO: 497023 - DNA, 20 bp, Artificial
  CRISPR gRNA sequence
caaataaaaaggagctagag

SEQ ID NO: 497024 - DNA, 20 bp, Artificial
  CRISPR gRNA sequence
gagagaacaccaggtgttgt

SEQ ID NO: 497025 - DNA, 20 bp, Artificial
  CRISPR gRNA sequence
ttttgatttttcaactggaa

SEQ ID NO: 497026 - DNA, 20 bp, Artificial
  CRISPR gRNA sequence
tgatttttcaactggaagga

SEQ ID NO: 497027 - DNA, 20 bp, Artificial
  CRISPR gRNA sequence
gatttttcaactggaaggaa

SEQ ID NO: 497028 - DNA, 20 bp, Artificial
  CRISPR gRNA sequence
atttttcaactggaaggaaa

SEQ ID NO: 497029 - DNA, 20 bp, Artificial
  CRISPR gRNA sequence
ttcaactggaaggaaactgt

SEQ ID NO: 497030 - DNA, 20 bp, Artificial
  CRISPR gRNA sequence
tcaactggaaggaaactgta

SEQ ID NO: 497031 - DNA, 20 bp, Artificial
  CRISPR gRNA sequence
caactggaaggaaactgtac

SEQ ID NO: 497032 - DNA, 20 bp, Artificial
  CRISPR gRNA sequence
aactggaaggaaactgtact

SEQ ID NO: 497033 - DNA, 20 bp, Artificial
  CRISPR gRNA sequence
gaaggaaactgtactaaagg

SEQ ID NO: 497034 - DNA, 20 bp, Artificial
  CRISPR gRNA sequence
tactaaaggtaggaagccca

SEQ ID NO: 497035 - DNA, 20 bp, Artificial
  CRISPR gRNA sequence
aaggtaggaagcccacagaa

SEQ ID NO: 497036 - DNA, 20 bp, Artificial
  CRISPR gRNA sequence
aagaaagatgagggatgtct

SEQ ID NO: 497037 - DNA, 20 bp, Artificial
  CRISPR gRNA sequence
cacagacagcaggtcccagg

SEQ ID NO: 497038 - DNA, 20 bp, Artificial
  CRISPR gRNA sequence
acagacagcaggtcccaggt

SEQ ID NO: 497039 - DNA, 20 bp, Artificial
  CRISPR gRNA sequence
ctgaaagaagctctggtgcc

SEQ ID NO: 497040 - DNA, 20 bp, Artificial
  CRISPR gRNA sequence
tgaaagaagctctggtgccc

SEQ ID NO: 497041 - DNA, 20 bp, Artificial
  CRISPR gRNA sequence
aaagaagctctggtgccctg

SEQ ID NO: 497042 - DNA, 20 bp, Artificial
  CRISPR gRNA sequence
tggtgccctgagcacacagg

SEQ ID NO: 497043 - DNA, 20 bp, Artificial
  CRISPR gRNA sequence
gtgccctgagcacacagggg

SEQ ID NO: 497044 - DNA, 20 bp, Artificial
  CRISPR gRNA sequence
agcacacaggggagtattgg

SEQ ID NO: 497045 - DNA, 20 bp, Artificial
  CRISPR gRNA sequence
gtcaaggacagggcaagaac

SEQ ID NO: 497046 - DNA, 20 bp, Artificial
  CRISPR gRNA sequence
ttgccctcagcagaggcaaa

SEQ ID NO: 497047 - DNA, 20 bp, Artificial
  CRISPR gRNA sequence
gccctcagcagaggcaaatg

SEQ ID NO: 497048 - DNA, 20 bp, Artificial
  CRISPR gRNA sequence
ccctcagcagaggcaaatgt

SEQ ID NO: 497049 - DNA, 20 bp, Artificial
  CRISPR gRNA sequence
agcagaggcaaatgtggcca

SEQ ID NO: 497050 - DNA, 20 bp, Artificial
  CRISPR gRNA sequence
acaggagtagatgaagtaca

SEQ ID NO: 497051 - DNA, 20 bp, Artificial
  CRISPR gRNA sequence
caggagtagatgaagtacat

SEQ ID NO: 497052 - DNA, 20 bp, Artificial
  CRISPR gRNA sequence
acactggagacttgttggca

SEQ ID NO: 497053 - DNA, 20 bp, Artificial
  CRISPR gRNA sequence
gagacttgttggcaaggttg

SEQ ID NO: 497054 - DNA, 20 bp, Artificial
  CRISPR gRNA sequence
gttggcaaggttggtggaat

SEQ ID NO: 497055 - DNA, 20 bp, Artificial
  CRISPR gRNA sequence
ttggcaaggttggtggaatc

SEQ ID NO: 497056 - DNA, 20 bp, Artificial
  CRISPR gRNA sequence
gcaaggttggtggaatccct

SEQ ID NO: 497057 - DNA, 20 bp, Artificial
  CRISPR gRNA sequence
gtggaatccctaacttgtgc

SEQ ID NO: 497058 - DNA, 20 bp, Artificial
  CRISPR gRNA sequence
acttgtgcttctgttttctt

SEQ ID NO: 497059 - DNA, 20 bp, Artificial
  CRISPR gRNA sequence
gtgcttctgttttcttaaag

SEQ ID NO: 497060 - DNA, 20 bp, Artificial
  CRISPR gRNA sequence
tgcttctgttttcttaaaga

SEQ ID NO: 497061 - DNA, 20 bp, Artificial
  CRISPR gRNA sequence
ctgttttcttaaagaaggag

SEQ ID NO: 497062 - DNA, 20 bp, Artificial
  CRISPR gRNA sequence
tgttttcttaaagaaggagg

SEQ ID NO: 497063 - DNA, 20 bp, Artificial
  CRISPR gRNA sequence
ttttcttaaagaaggaggtt

SEQ ID NO: 497064 - DNA, 20 bp, Artificial
  CRISPR gRNA sequence
tcttaaagaaggaggttgtt

SEQ ID NO: 497065 - DNA, 20 bp, Artificial
  CRISPR gRNA sequence
cttaaagaaggaggttgttg

SEQ ID NO: 497066 - DNA, 20 bp, Artificial
  CRISPR gRNA sequence
ttaaagaaggaggttgttgg

SEQ ID NO: 497067 - DNA, 20 bp, Artificial
  CRISPR gRNA sequence
aaagaaggaggttgttggtt

SEQ ID NO: 497068 - DNA, 20 bp, Artificial
  CRISPR gRNA sequence
aagaaggaggttgttggttt

SEQ ID NO: 497069 - DNA, 20 bp, Artificial
  CRISPR gRNA sequence
ttggtttgtggaggctgaga

SEQ ID NO: 497070 - DNA, 20 bp, Artificial
  CRISPR gRNA sequence
gtttgtggaggctgagatag

SEQ ID NO: 497071 - DNA, 20 bp, Artificial
  CRISPR gRNA sequence
gtggaggctgagatagtgga

SEQ ID NO: 497072 - DNA, 20 bp, Artificial
  CRISPR gRNA sequence
tggaggctgagatagtggaa

SEQ ID NO: 497073 - DNA, 20 bp, Artificial
  CRISPR gRNA sequence
agatagtggaacagggcctt

SEQ ID NO: 497074 - DNA, 20 bp, Artificial
  CRISPR gRNA sequence
gaaagagatgacgaaggtgt

SEQ ID NO: 497075 - DNA, 20 bp, Artificial
  CRISPR gRNA sequence
aaagagatgacgaaggtgtg

SEQ ID NO: 497076 - DNA, 20 bp, Artificial
  CRISPR gRNA sequence
tcccaccttttggggaacag

SEQ ID NO: 497077 - DNA, 20 bp, Artificial
  CRISPR gRNA sequence
ccaccttttggggaacagga

SEQ ID NO: 497078 - DNA, 20 bp, Artificial
  CRISPR gRNA sequence
ttggggaacaggagaagctg

SEQ ID NO: 497079 - DNA, 20 bp, Artificial
  CRISPR gRNA sequence
tggggaacaggagaagctgt

SEQ ID NO: 497080 - DNA, 20 bp, Artificial
  CRISPR gRNA sequence
ggggaacaggagaagctgtg

SEQ ID NO: 497081 - DNA, 20 bp, Artificial
  CRISPR gRNA sequence
gggaacaggagaagctgtgg

SEQ ID NO: 497082 - DNA, 20 bp, Artificial
  CRISPR gRNA sequence
tgggccagaaatgaggattc

SEQ ID NO: 497083 - DNA, 20 bp, Artificial
  CRISPR gRNA sequence
ccaggacactgagagtccag

SEQ ID NO: 497084 - DNA, 20 bp, Artificial
  CRISPR gRNA sequence
agagtccagctggggttgga

SEQ ID NO: 497085 - DNA, 20 bp, Artificial
  CRISPR gRNA sequence
gggttggagattacgaatct

SEQ ID NO: 497086 - DNA, 20 bp, Artificial
  CRISPR gRNA sequence
gagattacgaatctgtagct

SEQ ID NO: 497087 - DNA, 20 bp, Artificial
  CRISPR gRNA sequence
cgaatctgtagctgctcttt

SEQ ID NO: 497088 - DNA, 20 bp, Artificial
  CRISPR gRNA sequence
tagctgctctttgttgctga

SEQ ID NO: 497089 - DNA, 20 bp, Artificial
  CRISPR gRNA sequence
ctctttgttgctgaattttc

SEQ ID NO: 497090 - DNA, 20 bp, Artificial
  CRISPR gRNA sequence
tttgttgctgaattttctcc

SEQ ID NO: 497091 - DNA, 20 bp, Artificial
  CRISPR gRNA sequence
tgttgctgaattttctcctg

SEQ ID NO: 497092 - DNA, 20 bp, Artificial
  CRISPR gRNA sequence
gttgctgaattttctcctgc

SEQ ID NO: 497093 - DNA, 20 bp, Artificial
  CRISPR gRNA sequence
ttgctgaattttctcctgca

SEQ ID NO: 497094 - DNA, 20 bp, Artificial
  CRISPR gRNA sequence
ctgaattttctcctgcagcc

SEQ ID NO: 497095 - DNA, 20 bp, Artificial
  CRISPR gRNA sequence
aattttctcctgcagccccc

SEQ ID NO: 497096 - DNA, 20 bp, Artificial
  CRISPR gRNA sequence
tctcctgcagcccccaacag

SEQ ID NO: 497097 - DNA, 20 bp, Artificial
  CRISPR gRNA sequence
ctcctgcagcccccaacagt

SEQ ID NO: 497098 - DNA, 20 bp, Artificial
  CRISPR gRNA sequence
tcctgcagcccccaacagtc

SEQ ID NO: 497099 - DNA, 20 bp, Artificial
  CRISPR gRNA sequence
ctgcagcccccaacagtcca

SEQ ID NO: 497100 - DNA, 20 bp, Artificial
  CRISPR gRNA sequence
cagcccccaacagtccagtg

SEQ ID NO: 497101 - DNA, 20 bp, Artificial
  CRISPR gRNA sequence
gaatgagtttccatggacgg

SEQ ID NO: 497102 - DNA, 20 bp, Artificial
  CRISPR gRNA sequence
ccatggacggcctggaaggg

SEQ ID NO: 497103 - DNA, 20 bp, Artificial
  CRISPR gRNA sequence
catggacggcctggaagggg

SEQ ID NO: 497104 - DNA, 20 bp, Artificial
  CRISPR gRNA sequence
gaaggggtgggtgccagggc

SEQ ID NO: 497105 - DNA, 20 bp, Artificial
  CRISPR gRNA sequence
tgtccagggtattgtgactg

SEQ ID NO: 497106 - DNA, 20 bp, Artificial
  CRISPR gRNA sequence
tgactgatacagaaagacct

SEQ ID NO: 497107 - DNA, 20 bp, Artificial
  CRISPR gRNA sequence
atacagaaagacctcagttt

SEQ ID NO: 497108 - DNA, 20 bp, Artificial
  CRISPR gRNA sequence
agtttctgtcccagaggggt

SEQ ID NO: 497109 - DNA, 20 bp, Artificial
  CRISPR gRNA sequence
ctgtcccagaggggtacaca

SEQ ID NO: 497110 - DNA, 20 bp, Artificial
  CRISPR gRNA sequence
tgtcccagaggggtacacac

SEQ ID NO: 497111 - DNA, 20 bp, Artificial
  CRISPR gRNA sequence
tcccagaggggtacacacac

SEQ ID NO: 497112 - DNA, 20 bp, Artificial
  CRISPR gRNA sequence
ctacgaaaacataacttcaa

SEQ ID NO: 497113 - DNA, 20 bp, Artificial
  CRISPR gRNA sequence
cgaaaacataacttcaacac

SEQ ID NO: 497114 - DNA, 20 bp, Artificial
  CRISPR gRNA sequence
caacacaagttctcacacat

SEQ ID NO: 497115 - DNA, 20 bp, Artificial
  CRISPR gRNA sequence
aacacaagttctcacacatt

SEQ ID NO: 497116 - DNA, 20 bp, Artificial
  CRISPR gRNA sequence
tcacacatttagtgaggcat

SEQ ID NO: 497117 - DNA, 20 bp, Artificial
  CRISPR gRNA sequence
acacatttagtgaggcatag

SEQ ID NO: 497118 - DNA, 20 bp, Artificial
  CRISPR gRNA sequence
agtgaggcatagaggaggac

SEQ ID NO: 497119 - DNA, 20 bp, Artificial
  CRISPR gRNA sequence
gtgaggcatagaggaggacc

SEQ ID NO: 497120 - DNA, 20 bp, Artificial
  CRISPR gRNA sequence
tttagaggaaagaggccaca

SEQ ID NO: 497121 - DNA, 20 bp, Artificial
  CRISPR gRNA sequence
agaggaaagaggccacagtc

SEQ ID NO: 497122 - DNA, 20 bp, Artificial
  CRISPR gRNA sequence
gaggaaagaggccacagtcc

SEQ ID NO: 497123 - DNA, 20 bp, Artificial
  CRISPR gRNA sequence
ccactgctgttgctactgct

SEQ ID NO: 497124 - DNA, 20 bp, Artificial
  CRISPR gRNA sequence
ctgttgctactgctcagcag

SEQ ID NO: 497125 - DNA, 20 bp, Artificial
  CRISPR gRNA sequence
ttgctactgctcagcagctt

SEQ ID NO: 497126 - DNA, 20 bp, Artificial
  CRISPR gRNA sequence
ctactgctcagcagctttgg

SEQ ID NO: 497127 - DNA, 20 bp, Artificial
  CRISPR gRNA sequence
ctgctcagcagctttggggg

SEQ ID NO: 497128 - DNA, 20 bp, Artificial
  CRISPR gRNA sequence
ctcagcagctttgggggcca

SEQ ID NO: 497129 - DNA, 20 bp, Artificial
  CRISPR gRNA sequence
agcagctttgggggccacct

SEQ ID NO: 497130 - DNA, 20 bp, Artificial
  CRISPR gRNA sequence
tgggggccaccttcctgtgg

SEQ ID NO: 497131 - DNA, 20 bp, Artificial
  CRISPR gRNA sequence
gggggccaccttcctgtggt

SEQ ID NO: 497132 - DNA, 20 bp, Artificial
  CRISPR gRNA sequence
ggggccaccttcctgtggtt

SEQ ID NO: 497133 - DNA, 20 bp, Artificial
  CRISPR gRNA sequence
cctgtggttaagaacggatg

SEQ ID NO: 497134 - DNA, 20 bp, Artificial
  CRISPR gRNA sequence
ctgtggttaagaacggatga

SEQ ID NO: 497135 - DNA, 20 bp, Artificial
  CRISPR gRNA sequence
tggttaagaacggatgaggt

SEQ ID NO: 497136 - DNA, 20 bp, Artificial
  CRISPR gRNA sequence
agaacggatgaggtgaacta

SEQ ID NO: 497137 - DNA, 20 bp, Artificial
  CRISPR gRNA sequence
gtaactctgaaagggagggc

SEQ ID NO: 497138 - DNA, 20 bp, Artificial
  CRISPR gRNA sequence
tgaaagggagggcagagggc

SEQ ID NO: 497139 - DNA, 20 bp, Artificial
  CRISPR gRNA sequence
aaagggagggcagagggcag

SEQ ID NO: 497140 - DNA, 20 bp, Artificial
  CRISPR gRNA sequence
actccactgcagcctcagga

SEQ ID NO: 497141 - DNA, 20 bp, Artificial
  CRISPR gRNA sequence
cactgcagcctcaggaagaa

SEQ ID NO: 497142 - DNA, 20 bp, Artificial
  CRISPR gRNA sequence
cagcctcaggaagaacagag

SEQ ID NO: 497143 - DNA, 20 bp, Artificial
  CRISPR gRNA sequence
aggaagaacagaggatggtc

SEQ ID NO: 497144 - DNA, 20 bp, Artificial
  CRISPR gRNA sequence
atccagcagtgagtcccgct

SEQ ID NO: 497145 - DNA, 20 bp, Artificial
  CRISPR gRNA sequence
agccctgagcccatgtgcag

SEQ ID NO: 497146 - DNA, 20 bp, Artificial
  CRISPR gRNA sequence
agcccatgtgcagagctctg

SEQ ID NO: 497147 - DNA, 20 bp, Artificial
  CRISPR gRNA sequence
tgagtcagctcagcttcctc

SEQ ID NO: 497148 - DNA, 20 bp, Artificial
  CRISPR gRNA sequence
agtcagctcagcttcctcca

SEQ ID NO: 497149 - DNA, 20 bp, Artificial
  CRISPR gRNA sequence
agcttcctccaacctggacc

SEQ ID NO: 497150 - DNA, 20 bp, Artificial
  CRISPR gRNA sequence
cctccaacctggacctgcca

SEQ ID NO: 497151 - DNA, 20 bp, Artificial
  CRISPR gRNA sequence
ctccaacctggacctgccag

SEQ ID NO: 497152 - DNA, 20 bp, Artificial
  CRISPR gRNA sequence
caacctggacctgccagtcg

SEQ ID NO: 497153 - DNA, 20 bp, Artificial
  CRISPR gRNA sequence
gacctgccagtcggaggaag

SEQ ID NO: 497154 - DNA, 20 bp, Artificial
  CRISPR gRNA sequence
ccagtcggaggaaggtgtgg

SEQ ID NO: 497155 - DNA, 20 bp, Artificial
  CRISPR gRNA sequence
agcacctgggagaaggagca

SEQ ID NO: 497156 - DNA, 20 bp, Artificial
  CRISPR gRNA sequence
ggagaaggagcacgggaggg

SEQ ID NO: 497157 - DNA, 20 bp, Artificial
  CRISPR gRNA sequence
agagcaagtggaatttccac

SEQ ID NO: 497158 - DNA, 20 bp, Artificial
  CRISPR gRNA sequence
ccaccagccaacaaatagat

SEQ ID NO: 497159 - DNA, 20 bp, Artificial
  CRISPR gRNA sequence
caccagccaacaaatagatg

SEQ ID NO: 497160 - DNA, 20 bp, Artificial
  CRISPR gRNA sequence
aggttttctcagctagggct

SEQ ID NO: 497161 - DNA, 20 bp, Artificial
  CRISPR gRNA sequence
tctcagctagggcttgtgct

SEQ ID NO: 497162 - DNA, 20 bp, Artificial
  CRISPR gRNA sequence
ctcagctagggcttgtgcta

SEQ ID NO: 497163 - DNA, 20 bp, Artificial
  CRISPR gRNA sequence
tcagctagggcttgtgctac

SEQ ID NO: 497164 - DNA, 20 bp, Artificial
  CRISPR gRNA sequence
agctagggcttgtgctacca

SEQ ID NO: 497165 - DNA, 20 bp, Artificial
  CRISPR gRNA sequence
gggcttgtgctaccaggctt

SEQ ID NO: 497166 - DNA, 20 bp, Artificial
  CRISPR gRNA sequence
gtgctaccaggcttggggtg

SEQ ID NO: 497167 - DNA, 20 bp, Artificial
  CRISPR gRNA sequence
tgctaccaggcttggggtga

SEQ ID NO: 497168 - DNA, 20 bp, Artificial
  CRISPR gRNA sequence
ccaggcttggggtgaaggca

SEQ ID NO: 497169 - DNA, 20 bp, Artificial
  CRISPR gRNA sequence
ggggtgaaggcatcaaaaga

SEQ ID NO: 497170 - DNA, 20 bp, Artificial
  CRISPR gRNA sequence
gggtgaaggcatcaaaagat

SEQ ID NO: 497171 - DNA, 20 bp, Artificial
  CRISPR gRNA sequence
ctggggactaagtgaacaga

SEQ ID NO: 497172 - DNA, 20 bp, Artificial
  CRISPR gRNA sequence
gggactaagtgaacagagtc

SEQ ID NO: 497173 - DNA, 20 bp, Artificial
  CRISPR gRNA sequence
agtgaacagagtccagtgag

SEQ ID NO: 497174 - DNA, 20 bp, Artificial
  CRISPR gRNA sequence
caaaagtactggggcaatcc

SEQ ID NO: 497175 - DNA, 20 bp, Artificial
  CRISPR gRNA sequence
gggcaatccagctctagtca

SEQ ID NO: 497176 - DNA, 20 bp, Artificial
  CRISPR gRNA sequence
tagtcagggcaaaatcataa

SEQ ID NO: 497177 - DNA, 20 bp, Artificial
  CRISPR gRNA sequence
gtcagggcaaaatcataaga

SEQ ID NO: 497178 - DNA, 20 bp, Artificial
  CRISPR gRNA sequence
tagggcccacatcccatttc

SEQ ID NO: 497179 - DNA, 20 bp, Artificial
  CRISPR gRNA sequence
ctttcttcctctctatttag

SEQ ID NO: 497180 - DNA, 20 bp, Artificial
  CRISPR gRNA sequence
tttcttcctctctatttagc

SEQ ID NO: 497181 - DNA, 20 bp, Artificial
  CRISPR gRNA sequence
tcttcctctctatttagctt

SEQ ID NO: 497182 - DNA, 20 bp, Artificial
  CRISPR gRNA sequence
cttcctctctatttagcttc

SEQ ID NO: 497183 - DNA, 20 bp, Artificial
  CRISPR gRNA sequence
ttcctctctatttagcttca

SEQ ID NO: 497184 - DNA, 20 bp, Artificial
  CRISPR gRNA sequence
cctctctatttagcttcata

SEQ ID NO: 497185 - DNA, 20 bp, Artificial
  CRISPR gRNA sequence
ctctctatttagcttcatac

SEQ ID NO: 497186 - DNA, 20 bp, Artificial
  CRISPR gRNA sequence
tctatttagcttcatactga

SEQ ID NO: 497187 - DNA, 20 bp, Artificial
  CRISPR gRNA sequence
tatttagcttcatactgacc

SEQ ID NO: 497188 - DNA, 20 bp, Artificial
  CRISPR gRNA sequence
tttagcttcatactgaccat

SEQ ID NO: 497189 - DNA, 20 bp, Artificial
  CRISPR gRNA sequence
agcttcatactgaccatatt

SEQ ID NO: 497190 - DNA, 20 bp, Artificial
  CRISPR gRNA sequence
gcttcatactgaccatatta

SEQ ID NO: 497191 - DNA, 20 bp, Artificial
  CRISPR gRNA sequence
catactgaccatattaactc

SEQ ID NO: 497192 - DNA, 20 bp, Artificial
  CRISPR gRNA sequence
atactgaccatattaactct

SEQ ID NO: 497193 - DNA, 20 bp, Artificial
  CRISPR gRNA sequence
accatattaactctcttcct

SEQ ID NO: 497194 - DNA, 20 bp, Artificial
  CRISPR gRNA sequence
actctcttcctcaggcaatg

SEQ ID NO: 497195 - DNA, 20 bp, Artificial
  CRISPR gRNA sequence
tcttcctcaggcaatgcaac

SEQ ID NO: 497196 - DNA, 20 bp, Artificial
  CRISPR gRNA sequence
ttcctcaggcaatgcaactc

SEQ ID NO: 497197 - DNA, 20 bp, Artificial
  CRISPR gRNA sequence
cctcaggcaatgcaactccc

SEQ ID NO: 497198 - DNA, 20 bp, Artificial
  CRISPR gRNA sequence
ctcaggcaatgcaactccct

SEQ ID NO: 497199 - DNA, 20 bp, Artificial
  CRISPR gRNA sequence
aggcaatgcaactcccttac

SEQ ID NO: 497200 - DNA, 20 bp, Artificial
  CRISPR gRNA sequence
ccttacctctgtcaaaactc

SEQ ID NO: 497201 - DNA, 20 bp, Artificial
  CRISPR gRNA sequence
acctctgtcaaaactcacct

SEQ ID NO: 497202 - DNA, 20 bp, Artificial
  CRISPR gRNA sequence
cctctgtcaaaactcaccta

SEQ ID NO: 497203 - DNA, 20 bp, Artificial
  CRISPR gRNA sequence
tgtcaaaactcacctagccc

SEQ ID NO: 497204 - DNA, 20 bp, Artificial
  CRISPR gRNA sequence
tcaaaactcacctagcccaa

SEQ ID NO: 497205 - DNA, 20 bp, Artificial
  CRISPR gRNA sequence
acctagcccaagtcccactc

SEQ ID NO: 497206 - DNA, 20 bp, Artificial
  CRISPR gRNA sequence
gcccaagtcccactctttgc

SEQ ID NO: 497207 - DNA, 20 bp, Artificial
  CRISPR gRNA sequence
tttgcatcagttaaccaaat

SEQ ID NO: 497208 - DNA, 20 bp, Artificial
  CRISPR gRNA sequence
tgcatcagttaaccaaatca

SEQ ID NO: 497209 - DNA, 20 bp, Artificial
  CRISPR gRNA sequence
gcatcagttaaccaaatcat

SEQ ID NO: 497210 - DNA, 20 bp, Artificial
  CRISPR gRNA sequence
catcagttaaccaaatcatc

SEQ ID NO: 497211 - DNA, 20 bp, Artificial
  CRISPR gRNA sequence
accaaatcatctcatatgtg

SEQ ID NO: 497212 - DNA, 20 bp, Artificial
  CRISPR gRNA sequence
atatgtgatattgtttctcc

SEQ ID NO: 497213 - DNA, 20 bp, Artificial
  CRISPR gRNA sequence
tttctccatgataacaagtg

SEQ ID NO: 497214 - DNA, 20 bp, Artificial
  CRISPR gRNA sequence
ctccatgataacaagtgcat

SEQ ID NO: 497215 - DNA, 20 bp, Artificial
  CRISPR gRNA sequence
tccatgataacaagtgcatc

SEQ ID NO: 497216 - DNA, 20 bp, Artificial
  CRISPR gRNA sequence
catgataacaagtgcatctc

SEQ ID NO: 497217 - DNA, 20 bp, Artificial
  CRISPR gRNA sequence
cctttcctgtttcccatcca

SEQ ID NO: 497218 - DNA, 20 bp, Artificial
  CRISPR gRNA sequence
tcctgtttcccatccaaacc

SEQ ID NO: 497219 - DNA, 20 bp, Artificial
  CRISPR gRNA sequence
cctgtttcccatccaaaccc

SEQ ID NO: 497220 - DNA, 20 bp, Artificial
  CRISPR gRNA sequence
ctgtttcccatccaaacccc

SEQ ID NO: 497221 - DNA, 20 bp, Artificial
  CRISPR gRNA sequence
tttcccatccaaaccccatg

SEQ ID NO: 497222 - DNA, 20 bp, Artificial
  CRISPR gRNA sequence
cccatccaaaccccatgcaa

SEQ ID NO: 497223 - DNA, 20 bp, Artificial
  CRISPR gRNA sequence
ccatccaaaccccatgcaac

SEQ ID NO: 497224 - DNA, 20 bp, Artificial
  CRISPR gRNA sequence
gcttttctgagctgtttcct

SEQ ID NO: 497225 - DNA, 20 bp, Artificial
  CRISPR gRNA sequence
ttctgagctgtttcctctgc

SEQ ID NO: 497226 - DNA, 20 bp, Artificial
  CRISPR gRNA sequence
tctgagctgtttcctctgct

SEQ ID NO: 497227 - DNA, 20 bp, Artificial
  CRISPR gRNA sequence
ctgagctgtttcctctgctt

SEQ ID NO: 497228 - DNA, 20 bp, Artificial
  CRISPR gRNA sequence
tgagctgtttcctctgcttc

SEQ ID NO: 497229 - DNA, 20 bp, Artificial
  CRISPR gRNA sequence
agctgtttcctctgcttcaa

SEQ ID NO: 497230 - DNA, 20 bp, Artificial
  CRISPR gRNA sequence
tttcctctgcttcaattgtc

SEQ ID NO: 497231 - DNA, 20 bp, Artificial
  CRISPR gRNA sequence
cctctgcttcaattgtcctt

SEQ ID NO: 497232 - DNA, 20 bp, Artificial
  CRISPR gRNA sequence
ctctgcttcaattgtccttc

SEQ ID NO: 497233 - DNA, 20 bp, Artificial
  CRISPR gRNA sequence
tgcttcaattgtccttctac

SEQ ID NO: 497234 - DNA, 20 bp, Artificial
  CRISPR gRNA sequence
cttcaattgtccttctactt

SEQ ID NO: 497235 - DNA, 20 bp, Artificial
  CRISPR gRNA sequence
caattgtccttctactttgt

SEQ ID NO: 497236 - DNA, 20 bp, Artificial
  CRISPR gRNA sequence
aattgtccttctactttgta

SEQ ID NO: 497237 - DNA, 20 bp, Artificial
  CRISPR gRNA sequence
tccttctactttgtacctac

SEQ ID NO: 497238 - DNA, 20 bp, Artificial
  CRISPR gRNA sequence
ctactttgtacctacctcct

SEQ ID NO: 497239 - DNA, 20 bp, Artificial
  CRISPR gRNA sequence
tactttgtacctacctccta

SEQ ID NO: 497240 - DNA, 20 bp, Artificial
  CRISPR gRNA sequence
ctttgtacctacctcctaaa

SEQ ID NO: 497241 - DNA, 20 bp, Artificial
  CRISPR gRNA sequence
tgtacctacctcctaaactc

SEQ ID NO: 497242 - DNA, 20 bp, Artificial
  CRISPR gRNA sequence
gtacctacctcctaaactct

SEQ ID NO: 497243 - DNA, 20 bp, Artificial
  CRISPR gRNA sequence
tacctacctcctaaactctt

SEQ ID NO: 497244 - DNA, 20 bp, Artificial
  CRISPR gRNA sequence
cctcctaaactcttatttat

SEQ ID NO: 497245 - DNA, 20 bp, Artificial
  CRISPR gRNA sequence
ctaaactcttatttattctt

SEQ ID NO: 497246 - DNA, 20 bp, Artificial
  CRISPR gRNA sequence
aactcttatttattcttcaa

SEQ ID NO: 497247 - DNA, 20 bp, Artificial
  CRISPR gRNA sequence
ttatttattcttcaaggcca

SEQ ID NO: 497248 - DNA, 20 bp, Artificial
  CRISPR gRNA sequence
atttattcttcaaggccagt

SEQ ID NO: 497249 - DNA, 20 bp, Artificial
  CRISPR gRNA sequence
tttattcttcaaggccagtt

SEQ ID NO: 497250 - DNA, 20 bp, Artificial
  CRISPR gRNA sequence
attcttcaaggccagttccc

SEQ ID NO: 497251 - DNA, 20 bp, Artificial
  CRISPR gRNA sequence
ttcttcaaggccagttcccc

SEQ ID NO: 497252 - DNA, 20 bp, Artificial
  CRISPR gRNA sequence
ttcaaggccagttccccagt

SEQ ID NO: 497253 - DNA, 20 bp, Artificial
  CRISPR gRNA sequence
caaggccagttccccagtgt

SEQ ID NO: 497254 - DNA, 20 bp, Artificial
  CRISPR gRNA sequence
aaggccagttccccagtgtt

SEQ ID NO: 497255 - DNA, 20 bp, Artificial
  CRISPR gRNA sequence
cccagtgttcctacctagaa

SEQ ID NO: 497256 - DNA, 20 bp, Artificial
  CRISPR gRNA sequence
ctacctagaaggaatcttca

SEQ ID NO: 497257 - DNA, 20 bp, Artificial
  CRISPR gRNA sequence
cctagaaggaatcttcatct

SEQ ID NO: 497258 - DNA, 20 bp, Artificial
  CRISPR gRNA sequence
gaaggaatcttcatcttctt

SEQ ID NO: 497259 - DNA, 20 bp, Artificial
  CRISPR gRNA sequence
catcttcttagctccttttt

SEQ ID NO: 497260 - DNA, 20 bp, Artificial
  CRISPR gRNA sequence
atcttcttagctcctttttt

SEQ ID NO: 497261 - DNA, 20 bp, Artificial
  CRISPR gRNA sequence
cttagctccttttttattct

SEQ ID NO: 497262 - DNA, 20 bp, Artificial
  CRISPR gRNA sequence
ttagctccttttttattcta

SEQ ID NO: 497263 - DNA, 20 bp, Artificial
  CRISPR gRNA sequence
agctccttttttattctaaa

SEQ ID NO: 497264 - DNA, 20 bp, Artificial
  CRISPR gRNA sequence
gctccttttttattctaaat

SEQ ID NO: 497265 - DNA, 20 bp, Artificial
  CRISPR gRNA sequence
cttttttattctaaatgtat

SEQ ID NO: 497266 - DNA, 20 bp, Artificial
  CRISPR gRNA sequence
ttttattctaaatgtatctt

SEQ ID NO: 497267 - DNA, 20 bp, Artificial
  CRISPR gRNA sequence
tttattctaaatgtatcttg

SEQ ID NO: 497268 - DNA, 20 bp, Artificial
  CRISPR gRNA sequence
ttattctaaatgtatcttgc

SEQ ID NO: 497269 - DNA, 20 bp, Artificial
  CRISPR gRNA sequence
tattctaaatgtatcttgcc

SEQ ID NO: 497270 - DNA, 20 bp, Artificial
  CRISPR gRNA sequence
attctaaatgtatcttgcct

SEQ ID NO: 497271 - DNA, 20 bp, Artificial
  CRISPR gRNA sequence
ttctaaatgtatcttgcctg

SEQ ID NO: 497272 - DNA, 20 bp, Artificial
  CRISPR gRNA sequence
taaatgtatcttgcctgtta

SEQ ID NO: 497273 - DNA, 20 bp, Artificial
  CRISPR gRNA sequence
aatgtatcttgcctgttaat

SEQ ID NO: 497274 - DNA, 20 bp, Artificial
  CRISPR gRNA sequence
gcctgttaatgacacatagc

SEQ ID NO: 497275 - DNA, 20 bp, Artificial
  CRISPR gRNA sequence
cctgttaatgacacatagca

SEQ ID NO: 497276 - DNA, 20 bp, Artificial
  CRISPR gRNA sequence
ttaatgacacatagcatttc

SEQ ID NO: 497277 - DNA, 20 bp, Artificial
  CRISPR gRNA sequence
atgacacatagcatttccat

SEQ ID NO: 497278 - DNA, 20 bp, Artificial
  CRISPR gRNA sequence
ccatcttcccttatagttgt

SEQ ID NO: 497279 - DNA, 20 bp, Artificial
  CRISPR gRNA sequence
catcttcccttatagttgta

SEQ ID NO: 497280 - DNA, 20 bp, Artificial
  CRISPR gRNA sequence
cccttatagttgtaattata

SEQ ID NO: 497281 - DNA, 20 bp, Artificial
  CRISPR gRNA sequence
ccttatagttgtaattatac

SEQ ID NO: 497282 - DNA, 20 bp, Artificial
  CRISPR gRNA sequence
atagttgtaattatacatac

SEQ ID NO: 497283 - DNA, 20 bp, Artificial
  CRISPR gRNA sequence
tagttgtaattatacatacc

SEQ ID NO: 497284 - DNA, 20 bp, Artificial
  CRISPR gRNA sequence
taattatacatacccatttt

SEQ ID NO: 497285 - DNA, 20 bp, Artificial
  CRISPR gRNA sequence
tacatacccattttcctctg

SEQ ID NO: 497286 - DNA, 20 bp, Artificial
  CRISPR gRNA sequence
tcctctgtctgaaagattct

SEQ ID NO: 497287 - DNA, 20 bp, Artificial
  CRISPR gRNA sequence
cctctgtctgaaagattctt

SEQ ID NO: 497288 - DNA, 20 bp, Artificial
  CRISPR gRNA sequence
ctctgtctgaaagattctta

SEQ ID NO: 497289 - DNA, 20 bp, Artificial
  CRISPR gRNA sequence
tgtctgaaagattcttaagg

SEQ ID NO: 497290 - DNA, 20 bp, Artificial
  CRISPR gRNA sequence
tctgaaagattcttaagggt

SEQ ID NO: 497291 - DNA, 20 bp, Artificial
  CRISPR gRNA sequence
aaagattcttaagggtagaa

SEQ ID NO: 497292 - DNA, 20 bp, Artificial
  CRISPR gRNA sequence
ttaagggtagaatagacatc

SEQ ID NO: 497293 - DNA, 20 bp, Artificial
  CRISPR gRNA sequence
aagggtagaatagacatctg

SEQ ID NO: 497294 - DNA, 20 bp, Artificial
  CRISPR gRNA sequence
agggtagaatagacatctgt

SEQ ID NO: 497295 - DNA, 20 bp, Artificial
  CRISPR gRNA sequence
tttcatctttgtttccccca

SEQ ID NO: 497296 - DNA, 20 bp, Artificial
  CRISPR gRNA sequence
catctttgtttcccccacaa

SEQ ID NO: 497297 - DNA, 20 bp, Artificial
  CRISPR gRNA sequence
atctttgtttcccccacaaa

SEQ ID NO: 497298 - DNA, 20 bp, Artificial
  CRISPR gRNA sequence
tgtttcccccacaaaacctt

SEQ ID NO: 497299 - DNA, 20 bp, Artificial
  CRISPR gRNA sequence
gtttcccccacaaaaccttg

SEQ ID NO: 497300 - DNA, 20 bp, Artificial
  CRISPR gRNA sequence
tttcccccacaaaaccttgc

SEQ ID NO: 497301 - DNA, 20 bp, Artificial
  CRISPR gRNA sequence
cccccacaaaaccttgcata

SEQ ID NO: 497302 - DNA, 20 bp, Artificial
  CRISPR gRNA sequence
ccccacaaaaccttgcatag

SEQ ID NO: 497303 - DNA, 20 bp, Artificial
  CRISPR gRNA sequence
gcatagttcttggagcataa

SEQ ID NO: 497304 - DNA, 20 bp, Artificial
  CRISPR gRNA sequence
catagttcttggagcataat

SEQ ID NO: 497305 - DNA, 20 bp, Artificial
  CRISPR gRNA sequence
ttggagcataataagggctg

SEQ ID NO: 497306 - DNA, 20 bp, Artificial
  CRISPR gRNA sequence
ggagcataataagggctggg

SEQ ID NO: 497307 - DNA, 20 bp, Artificial
  CRISPR gRNA sequence
gagcataataagggctgggg

SEQ ID NO: 497308 - DNA, 20 bp, Artificial
  CRISPR gRNA sequence
gggaaagagtttatgaataa

SEQ ID NO: 497309 - DNA, 20 bp, Artificial
  CRISPR gRNA sequence
atgaataagacctcaaaagc

SEQ ID NO: 497310 - DNA, 20 bp, Artificial
  CRISPR gRNA sequence
tgaataagacctcaaaagca

SEQ ID NO: 497311 - DNA, 20 bp, Artificial
  CRISPR gRNA sequence
aaaagcacaggcaacagaag

SEQ ID NO: 497312 - DNA, 20 bp, Artificial
  CRISPR gRNA sequence
cagcaaactaaaaaaaaatc

SEQ ID NO: 497313 - DNA, 20 bp, Artificial
  CRISPR gRNA sequence
aaaaaaaatcatgtacagta

SEQ ID NO: 497314 - DNA, 20 bp, Artificial
  CRISPR gRNA sequence
acagagtgaaaaggcaacca

SEQ ID NO: 497315 - DNA, 20 bp, Artificial
  CRISPR gRNA sequence
caaactatgaatcctacagg

SEQ ID NO: 497316 - DNA, 20 bp, Artificial
  CRISPR gRNA sequence
tgaatcctacaggcaactaa

SEQ ID NO: 497317 - DNA, 20 bp, Artificial
  CRISPR gRNA sequence
caggcaactaatatgcagaa

SEQ ID NO: 497318 - DNA, 20 bp, Artificial
  CRISPR gRNA sequence
atatgcagaatagacaagaa

SEQ ID NO: 497319 - DNA, 20 bp, Artificial
  CRISPR gRNA sequence
aaacgtcacaacagcaaaat

SEQ ID NO: 497320 - DNA, 20 bp, Artificial
  CRISPR gRNA sequence
catgaatccgtttaaattaa

SEQ ID NO: 497321 - DNA, 20 bp, Artificial
  CRISPR gRNA sequence
atgaatccgtttaaattaat

SEQ ID NO: 497322 - DNA, 20 bp, Artificial
  CRISPR gRNA sequence
aaattaattaattcaacaat

SEQ ID NO: 497323 - DNA, 20 bp, Artificial
  CRISPR gRNA sequence
aattaattaattcaacaatg

SEQ ID NO: 497324 - DNA, 20 bp, Artificial
  CRISPR gRNA sequence
attaattcaacaatgcatct

SEQ ID NO: 497325 - DNA, 20 bp, Artificial
  CRISPR gRNA sequence
attcaacaatgcatctcaca

SEQ ID NO: 497326 - DNA, 20 bp, Artificial
  CRISPR gRNA sequence
aacaatgcatctcacataac

SEQ ID NO: 497327 - DNA, 20 bp, Artificial
  CRISPR gRNA sequence
acataactcctaaaaatgac

SEQ ID NO: 497328 - DNA, 20 bp, Artificial
  CRISPR gRNA sequence
ctaaaaatgactctattgtc

SEQ ID NO: 497329 - DNA, 20 bp, Artificial
  CRISPR gRNA sequence
aaaatgactctattgtcaga

SEQ ID NO: 497330 - DNA, 20 bp, Artificial
  CRISPR gRNA sequence
tattgtcagaatttcatgca

SEQ ID NO: 497331 - DNA, 20 bp, Artificial
  CRISPR gRNA sequence
ttgtcagaatttcatgcagg

SEQ ID NO: 497332 - DNA, 20 bp, Artificial
  CRISPR gRNA sequence
tcagaatttcatgcaggata

SEQ ID NO: 497333 - DNA, 20 bp, Artificial
  CRISPR gRNA sequence
catgcaggataccagagaaa

SEQ ID NO: 497334 - DNA, 20 bp, Artificial
  CRISPR gRNA sequence
atgcaggataccagagaaat

SEQ ID NO: 497335 - DNA, 20 bp, Artificial
  CRISPR gRNA sequence
taattcccttgcctttggcc

SEQ ID NO: 497336 - DNA, 20 bp, Artificial
  CRISPR gRNA sequence
ccttgcctttggcctcttgc

SEQ ID NO: 497337 - DNA, 20 bp, Artificial
  CRISPR gRNA sequence
gcctttggcctcttgccaag

SEQ ID NO: 497338 - DNA, 20 bp, Artificial
  CRISPR gRNA sequence
cctttggcctcttgccaagc

SEQ ID NO: 497339 - DNA, 20 bp, Artificial
  CRISPR gRNA sequence
tggcctcttgccaagctcca

SEQ ID NO: 497340 - DNA, 20 bp, Artificial
  CRISPR gRNA sequence
ggcctcttgccaagctccac

SEQ ID NO: 497341 - DNA, 20 bp, Artificial
  CRISPR gRNA sequence
gcctcttgccaagctccaca

SEQ ID NO: 497342 - DNA, 20 bp, Artificial
  CRISPR gRNA sequence
ttgccaagctccacatttcc

SEQ ID NO: 497343 - DNA, 20 bp, Artificial
  CRISPR gRNA sequence
gccaagctccacatttccac

SEQ ID NO: 497344 - DNA, 20 bp, Artificial
  CRISPR gRNA sequence
ccaagctccacatttccaca

SEQ ID NO: 497345 - DNA, 20 bp, Artificial
  CRISPR gRNA sequence
cacatttccacaatttaatt

SEQ ID NO: 497346 - DNA, 20 bp, Artificial
  CRISPR gRNA sequence
ccacaatttaattttccatc

SEQ ID NO: 497347 - DNA, 20 bp, Artificial
  CRISPR gRNA sequence
cacaatttaattttccatct

SEQ ID NO: 497348 - DNA, 20 bp, Artificial
  CRISPR gRNA sequence
aattttccatctgcagacct

SEQ ID NO: 497349 - DNA, 20 bp, Artificial
  CRISPR gRNA sequence
attttccatctgcagacctt

SEQ ID NO: 497350 - DNA, 20 bp, Artificial
  CRISPR gRNA sequence
tccatctgcagaccttcaga

SEQ ID NO: 497351 - DNA, 20 bp, Artificial
  CRISPR gRNA sequence
ccatctgcagaccttcagaa

SEQ ID NO: 497352 - DNA, 20 bp, Artificial
  CRISPR gRNA sequence
catctgcagaccttcagaac

SEQ ID NO: 497353 - DNA, 20 bp, Artificial
  CRISPR gRNA sequence
cagaccttcagaaccaaaag

SEQ ID NO: 497354 - DNA, 20 bp, Artificial
  CRISPR gRNA sequence
cagaaccaaaagccagtggc

SEQ ID NO: 497355 - DNA, 20 bp, Artificial
  CRISPR gRNA sequence
agaaccaaaagccagtggcc

SEQ ID NO: 497356 - DNA, 20 bp, Artificial
  CRISPR gRNA sequence
tcatgcactatttggttcaa

SEQ ID NO: 497357 - DNA, 20 bp, Artificial
  CRISPR gRNA sequence
atgcactatttggttcaacc

SEQ ID NO: 497358 - DNA, 20 bp, Artificial
  CRISPR gRNA sequence
tttggttcaaccactttgga

SEQ ID NO: 497359 - DNA, 20 bp, Artificial
  CRISPR gRNA sequence
ggttcaaccactttggaaaa

SEQ ID NO: 497360 - DNA, 20 bp, Artificial
  CRISPR gRNA sequence
gttcaaccactttggaaaac

SEQ ID NO: 497361 - DNA, 20 bp, Artificial
  CRISPR gRNA sequence
aaccactttggaaaacagtt

SEQ ID NO: 497362 - DNA, 20 bp, Artificial
  CRISPR gRNA sequence
tggaaaacagtttgacagca

SEQ ID NO: 497363 - DNA, 20 bp, Artificial
  CRISPR gRNA sequence
ggaaaacagtttgacagcat

SEQ ID NO: 497364 - DNA, 20 bp, Artificial
  CRISPR gRNA sequence
gaaaacagtttgacagcatc

SEQ ID NO: 497365 - DNA, 20 bp, Artificial
  CRISPR gRNA sequence
gacagcatctgctagagtta

SEQ ID NO: 497366 - DNA, 20 bp, Artificial
  CRISPR gRNA sequence
acagcatctgctagagttac

SEQ ID NO: 497367 - DNA, 20 bp, Artificial
  CRISPR gRNA sequence
ctagagttacgtacacatac

SEQ ID NO: 497368 - DNA, 20 bp, Artificial
  CRISPR gRNA sequence
gagttacgtacacatactcc

SEQ ID NO: 497369 - DNA, 20 bp, Artificial
  CRISPR gRNA sequence
cgtacacatactccatggtt

SEQ ID NO: 497370 - DNA, 20 bp, Artificial
  CRISPR gRNA sequence
catggttctgcccctagaga

SEQ ID NO: 497371 - DNA, 20 bp, Artificial
  CRISPR gRNA sequence
tgcccctagagatataccca

SEQ ID NO: 497372 - DNA, 20 bp, Artificial
  CRISPR gRNA sequence
cccctagagatatacccaac

SEQ ID NO: 497373 - DNA, 20 bp, Artificial
  CRISPR gRNA sequence
gagatatacccaacagacat

SEQ ID NO: 497374 - DNA, 20 bp, Artificial
  CRISPR gRNA sequence
atcacagcattattataata

SEQ ID NO: 497375 - DNA, 20 bp, Artificial
  CRISPR gRNA sequence
ttataatagcaaaaacaaaa

SEQ ID NO: 497376 - DNA, 20 bp, Artificial
  CRISPR gRNA sequence
taatagcaaaaacaaaattg

SEQ ID NO: 497377 - DNA, 20 bp, Artificial
  CRISPR gRNA sequence
aaagcaacccaaaggttcat

SEQ ID NO: 497378 - DNA, 20 bp, Artificial
  CRISPR gRNA sequence
atcaataatagaaaaggtga

SEQ ID NO: 497379 - DNA, 20 bp, Artificial
  CRISPR gRNA sequence
tgatatagtcatgcgataaa

SEQ ID NO: 497380 - DNA, 20 bp, Artificial
  CRISPR gRNA sequence
tacagccatgaaaatgatct

SEQ ID NO: 497381 - DNA, 20 bp, Artificial
  CRISPR gRNA sequence
ctacaaataataacatacat

SEQ ID NO: 497382 - DNA, 20 bp, Artificial
  CRISPR gRNA sequence
caaataataacatacataaa

SEQ ID NO: 497383 - DNA, 20 bp, Artificial
  CRISPR gRNA sequence
ataagatgttgagcaaaagt

SEQ ID NO: 497384 - DNA, 20 bp, Artificial
  CRISPR gRNA sequence
agcaaaagtagtcagacaca

SEQ ID NO: 497385 - DNA, 20 bp, Artificial
  CRISPR gRNA sequence
gattccatatatacggacaa

SEQ ID NO: 497386 - DNA, 20 bp, Artificial
  CRISPR gRNA sequence
attccatatatacggacaaa

SEQ ID NO: 497387 - DNA, 20 bp, Artificial
  CRISPR gRNA sequence
catatatacggacaaaacaa

SEQ ID NO: 497388 - DNA, 20 bp, Artificial
  CRISPR gRNA sequence
tgatgttagaagtcagaatt

SEQ ID NO: 497389 - DNA, 20 bp, Artificial
  CRISPR gRNA sequence
gaagtcagaattgtggctat

SEQ ID NO: 497390 - DNA, 20 bp, Artificial
  CRISPR gRNA sequence
tggctatatttatggaagac

SEQ ID NO: 497391 - DNA, 20 bp, Artificial
  CRISPR gRNA sequence
tatttatggaagacagagga

SEQ ID NO: 497392 - DNA, 20 bp, Artificial
  CRISPR gRNA sequence
atggaagacagaggaagtaa

SEQ ID NO: 497393 - DNA, 20 bp, Artificial
  CRISPR gRNA sequence
tggaagacagaggaagtaat

SEQ ID NO: 497394 - DNA, 20 bp, Artificial
  CRISPR gRNA sequence
atttaacaatagctcattga

SEQ ID NO: 497395 - DNA, 20 bp, Artificial
  CRISPR gRNA sequence
aacaatagctcattgagatg

SEQ ID NO: 497396 - DNA, 20 bp, Artificial
  CRISPR gRNA sequence
acaatagctcattgagatgt

SEQ ID NO: 497397 - DNA, 20 bp, Artificial
  CRISPR gRNA sequence
attgagatgtacatttgtaa

SEQ ID NO: 497398 - DNA, 20 bp, Artificial
  CRISPR gRNA sequence
agatgtacatttgtaatttt

SEQ ID NO: 497399 - DNA, 20 bp, Artificial
  CRISPR gRNA sequence
gtaattttgtgtacttttct

SEQ ID NO: 497400 - DNA, 20 bp, Artificial
  CRISPR gRNA sequence
taattttgtgtacttttctg

SEQ ID NO: 497401 - DNA, 20 bp, Artificial
  CRISPR gRNA sequence
tgtgtacttttctgtatgtt

SEQ ID NO: 497402 - DNA, 20 bp, Artificial
  CRISPR gRNA sequence
gtgtacttttctgtatgttg

SEQ ID NO: 497403 - DNA, 20 bp, Artificial
  CRISPR gRNA sequence
tgtacttttctgtatgttgc

SEQ ID NO: 497404 - DNA, 20 bp, Artificial
  CRISPR gRNA sequence
ttctgtatgttgcacttcaa

SEQ ID NO: 497405 - DNA, 20 bp, Artificial
  CRISPR gRNA sequence
tctgtatgttgcacttcaat

SEQ ID NO: 497406 - DNA, 20 bp, Artificial
  CRISPR gRNA sequence
ctgtatgttgcacttcaata

SEQ ID NO: 497407 - DNA, 20 bp, Artificial
  CRISPR gRNA sequence
tgtatgttgcacttcaataa

SEQ ID NO: 497408 - DNA, 20 bp, Artificial
  CRISPR gRNA sequence
tatgttgcacttcaataaga

SEQ ID NO: 497409 - DNA, 20 bp, Artificial
  CRISPR gRNA sequence
cacttcaataagagaggttt

SEQ ID NO: 497410 - DNA, 20 bp, Artificial
  CRISPR gRNA sequence
caataagagaggtttgtctg

SEQ ID NO: 497411 - DNA, 20 bp, Artificial
  CRISPR gRNA sequence
aataagagaggtttgtctgt

SEQ ID NO: 497412 - DNA, 20 bp, Artificial
  CRISPR gRNA sequence
gtctgtgaagacaatggcct

SEQ ID NO: 497413 - DNA, 20 bp, Artificial
  CRISPR gRNA sequence
tctgtgaagacaatggcctg

SEQ ID NO: 497414 - DNA, 20 bp, Artificial
  CRISPR gRNA sequence
tgaagacaatggcctggctg

SEQ ID NO: 497415 - DNA, 20 bp, Artificial
  CRISPR gRNA sequence
gctgggcacagtggcccaca

SEQ ID NO: 497416 - DNA, 20 bp, Artificial
  CRISPR gRNA sequence
ggcacagtggcccacatctg

SEQ ID NO: 497417 - DNA, 20 bp, Artificial
  CRISPR gRNA sequence
taatcccagtaatttgggag

SEQ ID NO: 497418 - DNA, 20 bp, Artificial
  CRISPR gRNA sequence
gggaggccaaggcaagagga

SEQ ID NO: 497419 - DNA, 20 bp, Artificial
  CRISPR gRNA sequence
ggaggccaaggcaagaggat

SEQ ID NO: 497420 - DNA, 20 bp, Artificial
  CRISPR gRNA sequence
cttgagcccaggaggtcaag

SEQ ID NO: 497421 - DNA, 20 bp, Artificial
  CRISPR gRNA sequence
gagcccaggaggtcaagacc

SEQ ID NO: 497422 - DNA, 20 bp, Artificial
  CRISPR gRNA sequence
agcccaggaggtcaagacca

SEQ ID NO: 497423 - DNA, 20 bp, Artificial
  CRISPR gRNA sequence
tacacaaaaattaaaaataa

SEQ ID NO: 497424 - DNA, 20 bp, Artificial
  CRISPR gRNA sequence
cacaaaaattaaaaataagc

SEQ ID NO: 497425 - DNA, 20 bp, Artificial
  CRISPR gRNA sequence
aaaataagccaagtgtggtg

SEQ ID NO: 497426 - DNA, 20 bp, Artificial
  CRISPR gRNA sequence
tagtcccagctactaaggag

SEQ ID NO: 497427 - DNA, 20 bp, Artificial
  CRISPR gRNA sequence
ctaaggaggctgaggcagaa

SEQ ID NO: 497428 - DNA, 20 bp, Artificial
  CRISPR gRNA sequence
aggaggctgaggcagaagga

SEQ ID NO: 497429 - DNA, 20 bp, Artificial
  CRISPR gRNA sequence
aggcagaaggattgcttgag

SEQ ID NO: 497430 - DNA, 20 bp, Artificial
  CRISPR gRNA sequence
cttgagcccaggaggtcaag

SEQ ID NO: 497431 - DNA, 20 bp, Artificial
  CRISPR gRNA sequence
gagcccaggaggtcaaggct

SEQ ID NO: 497432 - DNA, 20 bp, Artificial
  CRISPR gRNA sequence
agcccaggaggtcaaggcta

SEQ ID NO: 497433 - DNA, 20 bp, Artificial
  CRISPR gRNA sequence
cagtgagctgtgatcacatc

SEQ ID NO: 497434 - DNA, 20 bp, Artificial
  CRISPR gRNA sequence
tgatcacatcactgcactcc

SEQ ID NO: 497435 - DNA, 20 bp, Artificial
  CRISPR gRNA sequence
cactccagcctgggtgatag

SEQ ID NO: 497436 - DNA, 20 bp, Artificial
  CRISPR gRNA sequence
cagcctgggtgatagagcaa

SEQ ID NO: 497437 - DNA, 20 bp, Artificial
  CRISPR gRNA sequence
ggtgatagagcaagaccctg

SEQ ID NO: 497438 - DNA, 20 bp, Artificial
  CRISPR gRNA sequence
tctcacaaaaaaataaaaat

SEQ ID NO: 497439 - DNA, 20 bp, Artificial
  CRISPR gRNA sequence
acaaaaaaataaaaataaat

SEQ ID NO: 497440 - DNA, 20 bp, Artificial
  CRISPR gRNA sequence
aaaaaaaaaacaagacatgc

SEQ ID NO: 497441 - DNA, 20 bp, Artificial
  CRISPR gRNA sequence
tctctccttgaagtgatttc

SEQ ID NO: 497442 - DNA, 20 bp, Artificial
  CRISPR gRNA sequence
tccttgaagtgatttcagtg

SEQ ID NO: 497443 - DNA, 20 bp, Artificial
  CRISPR gRNA sequence
cttgaagtgatttcagtgga

SEQ ID NO: 497444 - DNA, 20 bp, Artificial
  CRISPR gRNA sequence
gaagtgatttcagtggattc

SEQ ID NO: 497445 - DNA, 20 bp, Artificial
  CRISPR gRNA sequence
aagtgatttcagtggattcc

SEQ ID NO: 497446 - DNA, 20 bp, Artificial
  CRISPR gRNA sequence
cagtggattcctttctggat

SEQ ID NO: 497447 - DNA, 20 bp, Artificial
  CRISPR gRNA sequence
agtggattcctttctggatg

SEQ ID NO: 497448 - DNA, 20 bp, Artificial
  CRISPR gRNA sequence
ctttctggatggtgctgtag

SEQ ID NO: 497449 - DNA, 20 bp, Artificial
  CRISPR gRNA sequence
tctggatggtgctgtagccc

SEQ ID NO: 497450 - DNA, 20 bp, Artificial
  CRISPR gRNA sequence
ctggatggtgctgtagccca

SEQ ID NO: 497451 - DNA, 20 bp, Artificial
  CRISPR gRNA sequence
tggatggtgctgtagcccag

SEQ ID NO: 497452 - DNA, 20 bp, Artificial
  CRISPR gRNA sequence
gatggtgctgtagcccaggg

SEQ ID NO: 497453 - DNA, 20 bp, Artificial
  CRISPR gRNA sequence
tagcccagggtacattgaat

SEQ ID NO: 497454 - DNA, 20 bp, Artificial
  CRISPR gRNA sequence
aattccaatctcttttctgt

SEQ ID NO: 497455 - DNA, 20 bp, Artificial
  CRISPR gRNA sequence
caatctcttttctgtgtcca

SEQ ID NO: 497456 - DNA, 20 bp, Artificial
  CRISPR gRNA sequence
ttttctgtgtccagctactt

SEQ ID NO: 497457 - DNA, 20 bp, Artificial
  CRISPR gRNA sequence
ttctgtgtccagctactttg

SEQ ID NO: 497458 - DNA, 20 bp, Artificial
  CRISPR gRNA sequence
tctgtgtccagctactttgc

SEQ ID NO: 497459 - DNA, 20 bp, Artificial
  CRISPR gRNA sequence
ctgtgtccagctactttgcc

SEQ ID NO: 497460 - DNA, 20 bp, Artificial
  CRISPR gRNA sequence
tgtgtccagctactttgcca

SEQ ID NO: 497461 - DNA, 20 bp, Artificial
  CRISPR gRNA sequence
tgtccagctactttgccatt

SEQ ID NO: 497462 - DNA, 20 bp, Artificial
  CRISPR gRNA sequence
ctttgccattcaccctttgt

SEQ ID NO: 497463 - DNA, 20 bp, Artificial
  CRISPR gRNA sequence
tgccattcaccctttgttgg

SEQ ID NO: 497464 - DNA, 20 bp, Artificial
  CRISPR gRNA sequence
gccattcaccctttgttgga

SEQ ID NO: 497465 - DNA, 20 bp, Artificial
  CRISPR gRNA sequence
ccattcaccctttgttggag

SEQ ID NO: 497466 - DNA, 20 bp, Artificial
  CRISPR gRNA sequence
accctttgttggaggggagg

SEQ ID NO: 497467 - DNA, 20 bp, Artificial
  CRISPR gRNA sequence
tgttggaggggaggtgcaat

SEQ ID NO: 497468 - DNA, 20 bp, Artificial
  CRISPR gRNA sequence
gttggaggggaggtgcaatg

SEQ ID NO: 497469 - DNA, 20 bp, Artificial
  CRISPR gRNA sequence
ttggaggggaggtgcaatga

SEQ ID NO: 497470 - DNA, 20 bp, Artificial
  CRISPR gRNA sequence
gaggggaggtgcaatgagga

SEQ ID NO: 497471 - DNA, 20 bp, Artificial
  CRISPR gRNA sequence
cagcccttctacagcttgcc

SEQ ID NO: 497472 - DNA, 20 bp, Artificial
  CRISPR gRNA sequence
ctacagcttgcctggatccc

SEQ ID NO: 497473 - DNA, 20 bp, Artificial
  CRISPR gRNA sequence
tacagcttgcctggatccca

SEQ ID NO: 497474 - DNA, 20 bp, Artificial
  CRISPR gRNA sequence
cagcttgcctggatcccagc

SEQ ID NO: 497475 - DNA, 20 bp, Artificial
  CRISPR gRNA sequence
gcctggatcccagccaaagc

SEQ ID NO: 497476 - DNA, 20 bp, Artificial
  CRISPR gRNA sequence
cctggatcccagccaaagca

SEQ ID NO: 497477 - DNA, 20 bp, Artificial
  CRISPR gRNA sequence
gatcccagccaaagcagtcg

SEQ ID NO: 497478 - DNA, 20 bp, Artificial
  CRISPR gRNA sequence
gacaccactccctgagaagt

SEQ ID NO: 497479 - DNA, 20 bp, Artificial
  CRISPR gRNA sequence
cctgagaagtgacagttcca

SEQ ID NO: 497480 - DNA, 20 bp, Artificial
  CRISPR gRNA sequence
agaagtgacagttccaacac

SEQ ID NO: 497481 - DNA, 20 bp, Artificial
  CRISPR gRNA sequence
caacacaatctacgcaaaca

SEQ ID NO: 497482 - DNA, 20 bp, Artificial
  CRISPR gRNA sequence
cgcaaacagctggcaaccct

SEQ ID NO: 497483 - DNA, 20 bp, Artificial
  CRISPR gRNA sequence
gcaacccttggagctaatct

SEQ ID NO: 497484 - DNA, 20 bp, Artificial
  CRISPR gRNA sequence
ggagctaatctataaggtgt

SEQ ID NO: 497485 - DNA, 20 bp, Artificial
  CRISPR gRNA sequence
gagctaatctataaggtgtc

SEQ ID NO: 497486 - DNA, 20 bp, Artificial
  CRISPR gRNA sequence
atctataaggtgtcacctgt

SEQ ID NO: 497487 - DNA, 20 bp, Artificial
  CRISPR gRNA sequence
taaggtgtcacctgtgccct

SEQ ID NO: 497488 - DNA, 20 bp, Artificial
  CRISPR gRNA sequence
tgcccttttattgtccagca

SEQ ID NO: 497489 - DNA, 20 bp, Artificial
  CRISPR gRNA sequence
ttattgtccagcagatctca

SEQ ID NO: 497490 - DNA, 20 bp, Artificial
  CRISPR gRNA sequence
tattgtccagcagatctcaa

SEQ ID NO: 497491 - DNA, 20 bp, Artificial
  CRISPR gRNA sequence
attgtccagcagatctcaac

SEQ ID NO: 497492 - DNA, 20 bp, Artificial
  CRISPR gRNA sequence
ttgtccagcagatctcaact

SEQ ID NO: 497493 - DNA, 20 bp, Artificial
  CRISPR gRNA sequence
tccagcagatctcaactcag

SEQ ID NO: 497494 - DNA, 20 bp, Artificial
  CRISPR gRNA sequence
aactcaggctgtaaagcatc

SEQ ID NO: 497495 - DNA, 20 bp, Artificial
  CRISPR gRNA sequence
aggctgtaaagcatctgggg

SEQ ID NO: 497496 - DNA, 20 bp, Artificial
  CRISPR gRNA sequence
taaagcatctggggattcat

SEQ ID NO: 497497 - DNA, 20 bp, Artificial
  CRISPR gRNA sequence
gggattcatagcctccagcc

SEQ ID NO: 497498 - DNA, 20 bp, Artificial
  CRISPR gRNA sequence
atagcctccagcctgtgtgt

SEQ ID NO: 497499 - DNA, 20 bp, Artificial
  CRISPR gRNA sequence
cagcctgtgtgtcctttggg

SEQ ID NO: 497500 - DNA, 20 bp, Artificial
  CRISPR gRNA sequence
tgtgtcctttggggtttcct

SEQ ID NO: 497501 - DNA, 20 bp, Artificial
  CRISPR gRNA sequence
tggggtttcctcagaacgga

SEQ ID NO: 497502 - DNA, 20 bp, Artificial
  CRISPR gRNA sequence
ggggtttcctcagaacggac

SEQ ID NO: 497503 - DNA, 20 bp, Artificial
  CRISPR gRNA sequence
gggtttcctcagaacggaca

SEQ ID NO: 497504 - DNA, 20 bp, Artificial
  CRISPR gRNA sequence
cctcagaacggacaactgaa

SEQ ID NO: 497505 - DNA, 20 bp, Artificial
  CRISPR gRNA sequence
ctcagaacggacaactgaaa

SEQ ID NO: 497506 - DNA, 20 bp, Artificial
  CRISPR gRNA sequence
agaacggacaactgaaacct

SEQ ID NO: 497507 - DNA, 20 bp, Artificial
  CRISPR gRNA sequence
aaacctgaattttgggtcta

SEQ ID NO: 497508 - DNA, 20 bp, Artificial
  CRISPR gRNA sequence
aattttgggtctaaaatgaa

SEQ ID NO: 497509 - DNA, 20 bp, Artificial
  CRISPR gRNA sequence
tgggtctaaaatgaatttta

SEQ ID NO: 497510 - DNA, 20 bp, Artificial
  CRISPR gRNA sequence
gggtctaaaatgaattttag

SEQ ID NO: 497511 - DNA, 20 bp, Artificial
  CRISPR gRNA sequence
ggtctaaaatgaattttagg

SEQ ID NO: 497512 - DNA, 20 bp, Artificial
  CRISPR gRNA sequence
aaatgaattttagggcccag

SEQ ID NO: 497513 - DNA, 20 bp, Artificial
  CRISPR gRNA sequence
tagggcccaggcctattccc

SEQ ID NO: 497514 - DNA, 20 bp, Artificial
  CRISPR gRNA sequence
agggcccaggcctattccct

SEQ ID NO: 497515 - DNA, 20 bp, Artificial
  CRISPR gRNA sequence
gggcccaggcctattccctg

SEQ ID NO: 497516 - DNA, 20 bp, Artificial
  CRISPR gRNA sequence
ttccctgggcaatgatttga

SEQ ID NO: 497517 - DNA, 20 bp, Artificial
  CRISPR gRNA sequence
cctgggcaatgatttgaaga

SEQ ID NO: 497518 - DNA, 20 bp, Artificial
  CRISPR gRNA sequence
ggcaatgatttgaagatccc

SEQ ID NO: 497519 - DNA, 20 bp, Artificial
  CRISPR gRNA sequence
gaagatccctccttcccaat

SEQ ID NO: 497520 - DNA, 20 bp, Artificial
  CRISPR gRNA sequence
aagatccctccttcccaata

SEQ ID NO: 497521 - DNA, 20 bp, Artificial
  CRISPR gRNA sequence
cttcccaatatgtctaaccc

SEQ ID NO: 497522 - DNA, 20 bp, Artificial
  CRISPR gRNA sequence
cccaatatgtctaacccaaa

SEQ ID NO: 497523 - DNA, 20 bp, Artificial
  CRISPR gRNA sequence
ccaatatgtctaacccaaaa

SEQ ID NO: 497524 - DNA, 20 bp, Artificial
  CRISPR gRNA sequence
acccaaaaaacatcccaggc

SEQ ID NO: 497525 - DNA, 20 bp, Artificial
  CRISPR gRNA sequence
cccgttaagatgcctgaaaa

SEQ ID NO: 497526 - DNA, 20 bp, Artificial
  CRISPR gRNA sequence
agatgcctgaaaataattca

SEQ ID NO: 497527 - DNA, 20 bp, Artificial
  CRISPR gRNA sequence
aaaataattcacttattcac

SEQ ID NO: 497528 - DNA, 20 bp, Artificial
  CRISPR gRNA sequence
acttattcactcaacaaaca

SEQ ID NO: 497529 - DNA, 20 bp, Artificial
  CRISPR gRNA sequence
attcactcaacaaacatgtt

SEQ ID NO: 497530 - DNA, 20 bp, Artificial
  CRISPR gRNA sequence
ttcactcaacaaacatgttt

SEQ ID NO: 497531 - DNA, 20 bp, Artificial
  CRISPR gRNA sequence
actcaacaaacatgttttga

SEQ ID NO: 497532 - DNA, 20 bp, Artificial
  CRISPR gRNA sequence
aacaaacatgttttgaacac

SEQ ID NO: 497533 - DNA, 20 bp, Artificial
  CRISPR gRNA sequence
tgaacacctactgcattggc

SEQ ID NO: 497534 - DNA, 20 bp, Artificial
  CRISPR gRNA sequence
gaacacctactgcattggca

SEQ ID NO: 497535 - DNA, 20 bp, Artificial
  CRISPR gRNA sequence
aacacctactgcattggcac

SEQ ID NO: 497536 - DNA, 20 bp, Artificial
  CRISPR gRNA sequence
ctgcattggcactgcaccag

SEQ ID NO: 497537 - DNA, 20 bp, Artificial
  CRISPR gRNA sequence
cattggcactgcaccaggca

SEQ ID NO: 497538 - DNA, 20 bp, Artificial
  CRISPR gRNA sequence
gcactgcaccaggcactaat

SEQ ID NO: 497539 - DNA, 20 bp, Artificial
  CRISPR gRNA sequence
caccaggcactaatcacaac

SEQ ID NO: 497540 - DNA, 20 bp, Artificial
  CRISPR gRNA sequence
atcacaactgtagtaacagt

SEQ ID NO: 497541 - DNA, 20 bp, Artificial
  CRISPR gRNA sequence
tagtaacagtgactcaggca

SEQ ID NO: 497542 - DNA, 20 bp, Artificial
  CRISPR gRNA sequence
aggcaatctagcgcaagctc

SEQ ID NO: 497543 - DNA, 20 bp, Artificial
  CRISPR gRNA sequence
gcgcaagctctctgaacaaa

SEQ ID NO: 497544 - DNA, 20 bp, Artificial
  CRISPR gRNA sequence
tctgaacaaacgggccctgg

SEQ ID NO: 497545 - DNA, 20 bp, Artificial
  CRISPR gRNA sequence
tgaacaaacgggccctggac

SEQ ID NO: 497546 - DNA, 20 bp, Artificial
  CRISPR gRNA sequence
aacaaacgggccctggactt

SEQ ID NO: 497547 - DNA, 20 bp, Artificial
  CRISPR gRNA sequence
gacttacttgccactgaatc

SEQ ID NO: 497548 - DNA, 20 bp, Artificial
  CRISPR gRNA sequence
acttgccactgaatcctcaa

SEQ ID NO: 497549 - DNA, 20 bp, Artificial
  CRISPR gRNA sequence
cttgccactgaatcctcaat

SEQ ID NO: 497550 - DNA, 20 bp, Artificial
  CRISPR gRNA sequence
gccactgaatcctcaatagc

SEQ ID NO: 497551 - DNA, 20 bp, Artificial
  CRISPR gRNA sequence
ccactgaatcctcaatagcc

SEQ ID NO: 497552 - DNA, 20 bp, Artificial
  CRISPR gRNA sequence
aatcctcaatagccctggtt

SEQ ID NO: 497553 - DNA, 20 bp, Artificial
  CRISPR gRNA sequence
aatagccctggttcagagct

SEQ ID NO: 497554 - DNA, 20 bp, Artificial
  CRISPR gRNA sequence
gttcagagctattcaaaata

SEQ ID NO: 497555 - DNA, 20 bp, Artificial
  CRISPR gRNA sequence
agagctattcaaaatatatc

SEQ ID NO: 497556 - DNA, 20 bp, Artificial
  CRISPR gRNA sequence
ttcaaaatatatccagagaa

SEQ ID NO: 497557 - DNA, 20 bp, Artificial
  CRISPR gRNA sequence
aaaatatatccagagaaaga

SEQ ID NO: 497558 - DNA, 20 bp, Artificial
  CRISPR gRNA sequence
ctattgtgaaaataagtatc

SEQ ID NO: 497559 - DNA, 20 bp, Artificial
  CRISPR gRNA sequence
ttgtgaaaataagtatctac

SEQ ID NO: 497560 - DNA, 20 bp, Artificial
  CRISPR gRNA sequence
tgaaaataagtatctactga

SEQ ID NO: 497561 - DNA, 20 bp, Artificial
  CRISPR gRNA sequence
ctgagggttgacttgtggca

SEQ ID NO: 497562 - DNA, 20 bp, Artificial
  CRISPR gRNA sequence
agggttgacttgtggcaggt

SEQ ID NO: 497563 - DNA, 20 bp, Artificial
  CRISPR gRNA sequence
acttgtggcaggtactgctc

SEQ ID NO: 497564 - DNA, 20 bp, Artificial
  CRISPR gRNA sequence
gtggcaggtactgctctaga

SEQ ID NO: 497565 - DNA, 20 bp, Artificial
  CRISPR gRNA sequence
tggcaggtactgctctagat

SEQ ID NO: 497566 - DNA, 20 bp, Artificial
  CRISPR gRNA sequence
ctctagatgttgaggagaca

SEQ ID NO: 497567 - DNA, 20 bp, Artificial
  CRISPR gRNA sequence
tagatgttgaggagacaacg

SEQ ID NO: 497568 - DNA, 20 bp, Artificial
  CRISPR gRNA sequence
gatgttgaggagacaacggt

SEQ ID NO: 497569 - DNA, 20 bp, Artificial
  CRISPR gRNA sequence
aggagacaacggtgagcaaa

SEQ ID NO: 497570 - DNA, 20 bp, Artificial
  CRISPR gRNA sequence
gcctcaaggatcttacagtc

SEQ ID NO: 497571 - DNA, 20 bp, Artificial
  CRISPR gRNA sequence
aaggatcttacagtctaggg

SEQ ID NO: 497572 - DNA, 20 bp, Artificial
  CRISPR gRNA sequence
acagtctagggggctgaaga

SEQ ID NO: 497573 - DNA, 20 bp, Artificial
  CRISPR gRNA sequence
cagtctagggggctgaagag

SEQ ID NO: 497574 - DNA, 20 bp, Artificial
  CRISPR gRNA sequence
gggggctgaagaggagactg

SEQ ID NO: 497575 - DNA, 20 bp, Artificial
  CRISPR gRNA sequence
aagaggagactgggagacag

SEQ ID NO: 497576 - DNA, 20 bp, Artificial
  CRISPR gRNA sequence
ggagacagaaaatgaaaaac

SEQ ID NO: 497577 - DNA, 20 bp, Artificial
  CRISPR gRNA sequence
tggagaaaaattaagtggag

SEQ ID NO: 497578 - DNA, 20 bp, Artificial
  CRISPR gRNA sequence
agtggagagagagctaagag

SEQ ID NO: 497579 - DNA, 20 bp, Artificial
  CRISPR gRNA sequence
agagtttgcagaatggcagg

SEQ ID NO: 497580 - DNA, 20 bp, Artificial
  CRISPR gRNA sequence
gcagaatggcaggctgacat

SEQ ID NO: 497581 - DNA, 20 bp, Artificial
  CRISPR gRNA sequence
cagaatggcaggctgacatt

SEQ ID NO: 497582 - DNA, 20 bp, Artificial
  CRISPR gRNA sequence
acattttcagtggggaaggc

SEQ ID NO: 497583 - DNA, 20 bp, Artificial
  CRISPR gRNA sequence
tcagtggggaaggcatcact

SEQ ID NO: 497584 - DNA, 20 bp, Artificial
  CRISPR gRNA sequence
cagtggggaaggcatcactg

SEQ ID NO: 497585 - DNA, 20 bp, Artificial
  CRISPR gRNA sequence
agtggggaaggcatcactga

SEQ ID NO: 497586 - DNA, 20 bp, Artificial
  CRISPR gRNA sequence
aaaaggaggtatttgagcaa

SEQ ID NO: 497587 - DNA, 20 bp, Artificial
  CRISPR gRNA sequence
gagcaaaactctgaggggtt

SEQ ID NO: 497588 - DNA, 20 bp, Artificial
  CRISPR gRNA sequence
agcaaaactctgaggggttg

SEQ ID NO: 497589 - DNA, 20 bp, Artificial
  CRISPR gRNA sequence
tgaggggttgagggaagagg

SEQ ID NO: 497590 - DNA, 20 bp, Artificial
  CRISPR gRNA sequence
aggggttgagggaagaggcc

SEQ ID NO: 497591 - DNA, 20 bp, Artificial
  CRISPR gRNA sequence
agggaagaggccatgtagcc

SEQ ID NO: 497592 - DNA, 20 bp, Artificial
  CRISPR gRNA sequence
tggatacaacagagagcgag

SEQ ID NO: 497593 - DNA, 20 bp, Artificial
  CRISPR gRNA sequence
aaatgctgtgagcaagagga

SEQ ID NO: 497594 - DNA, 20 bp, Artificial
  CRISPR gRNA sequence
tgagcaagaggagagacaaa

SEQ ID NO: 497595 - DNA, 20 bp, Artificial
  CRISPR gRNA sequence
ggacgccaggtcacgcacca

SEQ ID NO: 497596 - DNA, 20 bp, Artificial
  CRISPR gRNA sequence
gacgccaggtcacgcaccat

SEQ ID NO: 497597 - DNA, 20 bp, Artificial
  CRISPR gRNA sequence
taaaatgcatggcttttact

SEQ ID NO: 497598 - DNA, 20 bp, Artificial
  CRISPR gRNA sequence
ttactctgcatgaaagaaga

SEQ ID NO: 497599 - DNA, 20 bp, Artificial
  CRISPR gRNA sequence
tactctgcatgaaagaagaa

SEQ ID NO: 497600 - DNA, 20 bp, Artificial
  CRISPR gRNA sequence
actctgcatgaaagaagaag

SEQ ID NO: 497601 - DNA, 20 bp, Artificial
  CRISPR gRNA sequence
ctctgcatgaaagaagaagt

SEQ ID NO: 497602 - DNA, 20 bp, Artificial
  CRISPR gRNA sequence
tgcatgaaagaagaagtctt

SEQ ID NO: 497603 - DNA, 20 bp, Artificial
  CRISPR gRNA sequence
catgaaagaagaagtctttg

SEQ ID NO: 497604 - DNA, 20 bp, Artificial
  CRISPR gRNA sequence
tggaagaatttcgcaatgct

SEQ ID NO: 497605 - DNA, 20 bp, Artificial
  CRISPR gRNA sequence
ggaagaatttcgcaatgctc

SEQ ID NO: 497606 - DNA, 20 bp, Artificial
  CRISPR gRNA sequence
gaagaatttcgcaatgctca

SEQ ID NO: 497607 - DNA, 20 bp, Artificial
  CRISPR gRNA sequence
cgcaatgctcaagagttata

SEQ ID NO: 497608 - DNA, 20 bp, Artificial
  CRISPR gRNA sequence
gcaatgctcaagagttatat

SEQ ID NO: 497609 - DNA, 20 bp, Artificial
  CRISPR gRNA sequence
aagagttatatgcacatctt

SEQ ID NO: 497610 - DNA, 20 bp, Artificial
  CRISPR gRNA sequence
tatgcacatcttacataaat

SEQ ID NO: 497611 - DNA, 20 bp, Artificial
  CRISPR gRNA sequence
acataaatagtactcctgtt

SEQ ID NO: 497612 - DNA, 20 bp, Artificial
  CRISPR gRNA sequence
cataaatagtactcctgtta

SEQ ID NO: 497613 - DNA, 20 bp, Artificial
  CRISPR gRNA sequence
ctgttaaattattcagtaaa

SEQ ID NO: 497614 - DNA, 20 bp, Artificial
  CRISPR gRNA sequence
ttaaattattcagtaaacaa

SEQ ID NO: 497615 - DNA, 20 bp, Artificial
  CRISPR gRNA sequence
aattattcagtaaacaaagt

SEQ ID NO: 497616 - DNA, 20 bp, Artificial
  CRISPR gRNA sequence
ttcagtaaacaaagtggttt

SEQ ID NO: 497617 - DNA, 20 bp, Artificial
  CRISPR gRNA sequence
agtaaacaaagtggtttttt

SEQ ID NO: 497618 - DNA, 20 bp, Artificial
  CRISPR gRNA sequence
tttaaatttcactgtcatca

SEQ ID NO: 497619 - DNA, 20 bp, Artificial
  CRISPR gRNA sequence
ttaaatttcactgtcatcat

SEQ ID NO: 497620 - DNA, 20 bp, Artificial
  CRISPR gRNA sequence
taaatttcactgtcatcata

SEQ ID NO: 497621 - DNA, 20 bp, Artificial
  CRISPR gRNA sequence
aaatttcactgtcatcatat

SEQ ID NO: 497622 - DNA, 20 bp, Artificial
  CRISPR gRNA sequence
aatttcactgtcatcatatg

SEQ ID NO: 497623 - DNA, 20 bp, Artificial
  CRISPR gRNA sequence
cactgtcatcatatgactcc

SEQ ID NO: 497624 - DNA, 20 bp, Artificial
  CRISPR gRNA sequence
actgtcatcatatgactcct

SEQ ID NO: 497625 - DNA, 20 bp, Artificial
  CRISPR gRNA sequence
tcatcatatgactcctgatg

SEQ ID NO: 497626 - DNA, 20 bp, Artificial
  CRISPR gRNA sequence
ctgatgggatgcgctgaaaa

SEQ ID NO: 497627 - DNA, 20 bp, Artificial
  CRISPR gRNA sequence
atgggatgcgctgaaaaaga

SEQ ID NO: 497628 - DNA, 20 bp, Artificial
  CRISPR gRNA sequence
aaaaagacacagtatcactt

SEQ ID NO: 497629 - DNA, 20 bp, Artificial
  CRISPR gRNA sequence
ttgtggtattcctgtcaaaa

SEQ ID NO: 497630 - DNA, 20 bp, Artificial
  CRISPR gRNA sequence
tgtggtattcctgtcaaaaa

SEQ ID NO: 497631 - DNA, 20 bp, Artificial
  CRISPR gRNA sequence
gtggtattcctgtcaaaaat

SEQ ID NO: 497632 - DNA, 20 bp, Artificial
  CRISPR gRNA sequence
tggtattcctgtcaaaaatg

SEQ ID NO: 497633 - DNA, 20 bp, Artificial
  CRISPR gRNA sequence
ctgtcaaaaatgcatataat

SEQ ID NO: 497634 - DNA, 20 bp, Artificial
  CRISPR gRNA sequence
tcaaaaatgcatataatatc

SEQ ID NO: 497635 - DNA, 20 bp, Artificial
  CRISPR gRNA sequence
ctgtcaatgggcacagaaaa

SEQ ID NO: 497636 - DNA, 20 bp, Artificial
  CRISPR gRNA sequence
tcaatgggcacagaaaaaaa

SEQ ID NO: 497637 - DNA, 20 bp, Artificial
  CRISPR gRNA sequence
ttttaaagaaaaaataattt

SEQ ID NO: 497638 - DNA, 20 bp, Artificial
  CRISPR gRNA sequence
tttaaagaaaaaataatttt

SEQ ID NO: 497639 - DNA, 20 bp, Artificial
  CRISPR gRNA sequence
ttaaagaaaaaataatttta

SEQ ID NO: 497640 - DNA, 20 bp, Artificial
  CRISPR gRNA sequence
taaagaaaaaataattttaa

SEQ ID NO: 497641 - DNA, 20 bp, Artificial
  CRISPR gRNA sequence
aaagaaaaaataattttaaa

SEQ ID NO: 497642 - DNA, 20 bp, Artificial
  CRISPR gRNA sequence
aagaaaaaataattttaaaa

SEQ ID NO: 497643 - DNA, 20 bp, Artificial
  CRISPR gRNA sequence
taaaaatgcatatgatggct

SEQ ID NO: 497644 - DNA, 20 bp, Artificial
  CRISPR gRNA sequence
aaaaatgcatatgatggcta

SEQ ID NO: 497645 - DNA, 20 bp, Artificial
  CRISPR gRNA sequence
aaaatgcatatgatggctag

SEQ ID NO: 497646 - DNA, 20 bp, Artificial
  CRISPR gRNA sequence
ggcatgatggctcacacttg

SEQ ID NO: 497647 - DNA, 20 bp, Artificial
  CRISPR gRNA sequence
acacttgtagtcccaccact

SEQ ID NO: 497648 - DNA, 20 bp, Artificial
  CRISPR gRNA sequence
gtagtcccaccactttggga

SEQ ID NO: 497649 - DNA, 20 bp, Artificial
  CRISPR gRNA sequence
tagtcccaccactttgggag

SEQ ID NO: 497650 - DNA, 20 bp, Artificial
  CRISPR gRNA sequence
tgggagactgaggcaggtgg

SEQ ID NO: 497651 - DNA, 20 bp, Artificial
  CRISPR gRNA sequence
gggagactgaggcaggtgga

SEQ ID NO: 497652 - DNA, 20 bp, Artificial
  CRISPR gRNA sequence
ggagactgaggcaggtggat

SEQ ID NO: 497653 - DNA, 20 bp, Artificial
  CRISPR gRNA sequence
aggcaggtggatcgcctgag

SEQ ID NO: 497654 - DNA, 20 bp, Artificial
  CRISPR gRNA sequence
agcccgggagttcaagacca

SEQ ID NO: 497655 - DNA, 20 bp, Artificial
  CRISPR gRNA sequence
aagaccaccctgggcaacat

SEQ ID NO: 497656 - DNA, 20 bp, Artificial
  CRISPR gRNA sequence
ggcaacatggggaaaccctg

SEQ ID NO: 497657 - DNA, 20 bp, Artificial
  CRISPR gRNA sequence
tatctacaaaaaaaaaaaaa

SEQ ID NO: 497658 - DNA, 20 bp, Artificial
  CRISPR gRNA sequence
caaaaaaaaaaaaaaaaatt

SEQ ID NO: 497659 - DNA, 20 bp, Artificial
  CRISPR gRNA sequence
gccaggcatggtggcacaga

SEQ ID NO: 497660 - DNA, 20 bp, Artificial
  CRISPR gRNA sequence
tagttccagctaccagggag

SEQ ID NO: 497661 - DNA, 20 bp, Artificial
  CRISPR gRNA sequence
gttccagctaccagggaggc

SEQ ID NO: 497662 - DNA, 20 bp, Artificial
  CRISPR gRNA sequence
cagctaccagggaggctgag

SEQ ID NO: 497663 - DNA, 20 bp, Artificial
  CRISPR gRNA sequence
ccagggaggctgaggtggga

SEQ ID NO: 497664 - DNA, 20 bp, Artificial
  CRISPR gRNA sequence
aggtgggaggatggcttgag

SEQ ID NO: 497665 - DNA, 20 bp, Artificial
  CRISPR gRNA sequence
gagcctgcgaggtcgaggct

SEQ ID NO: 497666 - DNA, 20 bp, Artificial
  CRISPR gRNA sequence
agcctgcgaggtcgaggcta

SEQ ID NO: 497667 - DNA, 20 bp, Artificial
  CRISPR gRNA sequence
cgaggtcgaggctacagtga

SEQ ID NO: 497668 - DNA, 20 bp, Artificial
  CRISPR gRNA sequence
cagtgagccgtgagcatgcc

SEQ ID NO: 497669 - DNA, 20 bp, Artificial
  CRISPR gRNA sequence
cactccagtctgggtgaaag

SEQ ID NO: 497670 - DNA, 20 bp, Artificial
  CRISPR gRNA sequence
cagtctgggtgaaagaacca

SEQ ID NO: 497671 - DNA, 20 bp, Artificial
  CRISPR gRNA sequence
ggtgaaagaaccagatcctc

SEQ ID NO: 497672 - DNA, 20 bp, Artificial
  CRISPR gRNA sequence
tcttgaaaaataataatagg

SEQ ID NO: 497673 - DNA, 20 bp, Artificial
  CRISPR gRNA sequence
ttgaaaaataataataggcc

SEQ ID NO: 497674 - DNA, 20 bp, Artificial
  CRISPR gRNA sequence
gaaaaataataataggccgg

SEQ ID NO: 497675 - DNA, 20 bp, Artificial
  CRISPR gRNA sequence
aaaaataataataggccggg

SEQ ID NO: 497676 - DNA, 20 bp, Artificial
  CRISPR gRNA sequence
acacctggtatcccagcact

SEQ ID NO: 497677 - DNA, 20 bp, Artificial
  CRISPR gRNA sequence
gtatcccagcacttttgaga

SEQ ID NO: 497678 - DNA, 20 bp, Artificial
  CRISPR gRNA sequence
ttgagaggcggaggtgggtg

SEQ ID NO: 497679 - DNA, 20 bp, Artificial
  CRISPR gRNA sequence
tgagaggcggaggtgggtgg

SEQ ID NO: 497680 - DNA, 20 bp, Artificial
  CRISPR gRNA sequence
gagaggcggaggtgggtgga

SEQ ID NO: 497681 - DNA, 20 bp, Artificial
  CRISPR gRNA sequence
agaggcggaggtgggtggat

SEQ ID NO: 497682 - DNA, 20 bp, Artificial
  CRISPR gRNA sequence
gaggtcaggagtttaagacc

SEQ ID NO: 497683 - DNA, 20 bp, Artificial
  CRISPR gRNA sequence
aggtcaggagtttaagacca

SEQ ID NO: 497684 - DNA, 20 bp, Artificial
  CRISPR gRNA sequence
aagaccagcctggccaacat

SEQ ID NO: 497685 - DNA, 20 bp, Artificial
  CRISPR gRNA sequence
agaccagcctggccaacatg

SEQ ID NO: 497686 - DNA, 20 bp, Artificial
  CRISPR gRNA sequence
gccaacatggtgaaaccctg

SEQ ID NO: 497687 - DNA, 20 bp, Artificial
  CRISPR gRNA sequence
tctccaccaaaaatacaaaa

SEQ ID NO: 497688 - DNA, 20 bp, Artificial
  CRISPR gRNA sequence
caccaaaaatacaaaaatta

SEQ ID NO: 497689 - DNA, 20 bp, Artificial
  CRISPR gRNA sequence
gccaggcttggtggcatgca

SEQ ID NO: 497690 - DNA, 20 bp, Artificial
  CRISPR gRNA sequence
ggtggcatgcatctgtagtc

SEQ ID NO: 497691 - DNA, 20 bp, Artificial
  CRISPR gRNA sequence
gtggcatgcatctgtagtcc

SEQ ID NO: 497692 - DNA, 20 bp, Artificial
  CRISPR gRNA sequence
tagtcccagctactcgggag

SEQ ID NO: 497693 - DNA, 20 bp, Artificial
  CRISPR gRNA sequence
ctcgggaggctgaggcagga

SEQ ID NO: 497694 - DNA, 20 bp, Artificial
  CRISPR gRNA sequence
gggaggctgaggcaggacaa

SEQ ID NO: 497695 - DNA, 20 bp, Artificial
  CRISPR gRNA sequence
aggcaggacaatcacttgaa

SEQ ID NO: 497696 - DNA, 20 bp, Artificial
  CRISPR gRNA sequence
gaacccgggggagcagaagt

SEQ ID NO: 497697 - DNA, 20 bp, Artificial
  CRISPR gRNA sequence
aacccgggggagcagaagtt

SEQ ID NO: 497698 - DNA, 20 bp, Artificial
  CRISPR gRNA sequence
cagtgagccgagattggacc

SEQ ID NO: 497699 - DNA, 20 bp, Artificial
  CRISPR gRNA sequence
gaccactgtactccagccca

SEQ ID NO: 497700 - DNA, 20 bp, Artificial
  CRISPR gRNA sequence
tactccagcccaggccacag

SEQ ID NO: 497701 - DNA, 20 bp, Artificial
  CRISPR gRNA sequence
cagcccaggccacagagcga

SEQ ID NO: 497702 - DNA, 20 bp, Artificial
  CRISPR gRNA sequence
catctctaaaaaataataat

SEQ ID NO: 497703 - DNA, 20 bp, Artificial
  CRISPR gRNA sequence
taaaaaataataataatgat

SEQ ID NO: 497704 - DNA, 20 bp, Artificial
  CRISPR gRNA sequence
aaaaataataataatgatga

SEQ ID NO: 497705 - DNA, 20 bp, Artificial
  CRISPR gRNA sequence
aatcatatgagggaacatca

SEQ ID NO: 497706 - DNA, 20 bp, Artificial
  CRISPR gRNA sequence
aggaaccctctacaaaacaa

SEQ ID NO: 497707 - DNA, 20 bp, Artificial
  CRISPR gRNA sequence
tacaaaacaactggcttgtc

SEQ ID NO: 497708 - DNA, 20 bp, Artificial
  CRISPR gRNA sequence
caaaacaactggcttgtctt

SEQ ID NO: 497709 - DNA, 20 bp, Artificial
  CRISPR gRNA sequence
gcttgtcttcttcaagaatg

SEQ ID NO: 497710 - DNA, 20 bp, Artificial
  CRISPR gRNA sequence
gtcttcttcaagaatgcaat

SEQ ID NO: 497711 - DNA, 20 bp, Artificial
  CRISPR gRNA sequence
tcttcttcaagaatgcaata

SEQ ID NO: 497712 - DNA, 20 bp, Artificial
  CRISPR gRNA sequence
cttcaagaatgcaatatcat

SEQ ID NO: 497713 - DNA, 20 bp, Artificial
  CRISPR gRNA sequence
ttcaagaatgcaatatcatg

SEQ ID NO: 497714 - DNA, 20 bp, Artificial
  CRISPR gRNA sequence
caagaatgcaatatcatgaa

SEQ ID NO: 497715 - DNA, 20 bp, Artificial
  CRISPR gRNA sequence
aagaatgcaatatcatgaaa

SEQ ID NO: 497716 - DNA, 20 bp, Artificial
  CRISPR gRNA sequence
aagtatggtcatagactgaa

SEQ ID NO: 497717 - DNA, 20 bp, Artificial
  CRISPR gRNA sequence
aacatgagaaacataacaac

SEQ ID NO: 497718 - DNA, 20 bp, Artificial
  CRISPR gRNA sequence
aatgtaatacatgatcttga

SEQ ID NO: 497719 - DNA, 20 bp, Artificial
  CRISPR gRNA sequence
gattgcatcttgggtcagca

SEQ ID NO: 497720 - DNA, 20 bp, Artificial
  CRISPR gRNA sequence
attgcatcttgggtcagcaa

SEQ ID NO: 497721 - DNA, 20 bp, Artificial
  CRISPR gRNA sequence
catcttgggtcagcaaaaaa

SEQ ID NO: 497722 - DNA, 20 bp, Artificial
  CRISPR gRNA sequence
gggtcagcaaaaaaaaaaaa

SEQ ID NO: 497723 - DNA, 20 bp, Artificial
  CRISPR gRNA sequence
ggtcagcaaaaaaaaaaaat

SEQ ID NO: 497724 - DNA, 20 bp, Artificial
  CRISPR gRNA sequence
ttgggacaattggtaatatg

SEQ ID NO: 497725 - DNA, 20 bp, Artificial
  CRISPR gRNA sequence
gggacaattggtaatatgtg

SEQ ID NO: 497726 - DNA, 20 bp, Artificial
  CRISPR gRNA sequence
ggacaattggtaatatgtga

SEQ ID NO: 497727 - DNA, 20 bp, Artificial
  CRISPR gRNA sequence
gtaatatgtgaatatggaaa

SEQ ID NO: 497728 - DNA, 20 bp, Artificial
  CRISPR gRNA sequence
gatggtattaatgttaaatt

SEQ ID NO: 497729 - DNA, 20 bp, Artificial
  CRISPR gRNA sequence
atggtattaatgttaaattt

SEQ ID NO: 497730 - DNA, 20 bp, Artificial
  CRISPR gRNA sequence
atgttaaatttactgaattt

SEQ ID NO: 497731 - DNA, 20 bp, Artificial
  CRISPR gRNA sequence
aatttactgaatttgacaat

SEQ ID NO: 497732 - DNA, 20 bp, Artificial
  CRISPR gRNA sequence
actgaatttgacaattgtgc

SEQ ID NO: 497733 - DNA, 20 bp, Artificial
  CRISPR gRNA sequence
ctgaatttgacaattgtgct

SEQ ID NO: 497734 - DNA, 20 bp, Artificial
  CRISPR gRNA sequence
aatttgacaattgtgctgta

SEQ ID NO: 497735 - DNA, 20 bp, Artificial
  CRISPR gRNA sequence
gacaattgtgctgtagtaac

SEQ ID NO: 497736 - DNA, 20 bp, Artificial
  CRISPR gRNA sequence
acaattgtgctgtagtaaca

SEQ ID NO: 497737 - DNA, 20 bp, Artificial
  CRISPR gRNA sequence
tgctgtagtaacatgagaat

SEQ ID NO: 497738 - DNA, 20 bp, Artificial
  CRISPR gRNA sequence
tagtaacatgagaatgtctt

SEQ ID NO: 497739 - DNA, 20 bp, Artificial
  CRISPR gRNA sequence
tgttcataggatataagtgc

SEQ ID NO: 497740 - DNA, 20 bp, Artificial
  CRISPR gRNA sequence
gttcataggatataagtgct

SEQ ID NO: 497741 - DNA, 20 bp, Artificial
  CRISPR gRNA sequence
ttcataggatataagtgcta

SEQ ID NO: 497742 - DNA, 20 bp, Artificial
  CRISPR gRNA sequence
ataggatataagtgctaaaa

SEQ ID NO: 497743 - DNA, 20 bp, Artificial
  CRISPR gRNA sequence
aaatatttaggagtaagggg

SEQ ID NO: 497744 - DNA, 20 bp, Artificial
  CRISPR gRNA sequence
aggagtaaggggacataatg

SEQ ID NO: 497745 - DNA, 20 bp, Artificial
  CRISPR gRNA sequence
ggagtaaggggacataatgt

SEQ ID NO: 497746 - DNA, 20 bp, Artificial
  CRISPR gRNA sequence
gttctcaagtggttcagcaa

SEQ ID NO: 497747 - DNA, 20 bp, Artificial
  CRISPR gRNA sequence
ttctcaagtggttcagcaaa

SEQ ID NO: 497748 - DNA, 20 bp, Artificial
  CRISPR gRNA sequence
tcaagtggttcagcaaaaat

SEQ ID NO: 497749 - DNA, 20 bp, Artificial
  CRISPR gRNA sequence
aagtggttcagcaaaaatta

SEQ ID NO: 497750 - DNA, 20 bp, Artificial
  CRISPR gRNA sequence
agcaaaaattattgtacatt

SEQ ID NO: 497751 - DNA, 20 bp, Artificial
  CRISPR gRNA sequence
ttgtacatttatacacacat

SEQ ID NO: 497752 - DNA, 20 bp, Artificial
  CRISPR gRNA sequence
tacatttatacacacatata

SEQ ID NO: 497753 - DNA, 20 bp, Artificial
  CRISPR gRNA sequence
atacacacatatacatacag

SEQ ID NO: 497754 - DNA, 20 bp, Artificial
  CRISPR gRNA sequence
tacacacatatacatacagc

SEQ ID NO: 497755 - DNA, 20 bp, Artificial
  CRISPR gRNA sequence
gagaaagagaaataaagtaa

SEQ ID NO: 497756 - DNA, 20 bp, Artificial
  CRISPR gRNA sequence
attggtgaatctagatgaaa

SEQ ID NO: 497757 - DNA, 20 bp, Artificial
  CRISPR gRNA sequence
gtgaatctagatgaaagaaa

SEQ ID NO: 497758 - DNA, 20 bp, Artificial
  CRISPR gRNA sequence
gatgaaagaaattcaagaat

SEQ ID NO: 497759 - DNA, 20 bp, Artificial
  CRISPR gRNA sequence
aagaatcgtttgaactattc

SEQ ID NO: 497760 - DNA, 20 bp, Artificial
  CRISPR gRNA sequence
gaactattcttgcagcttcc

SEQ ID NO: 497761 - DNA, 20 bp, Artificial
  CRISPR gRNA sequence
aactattcttgcagcttccc

SEQ ID NO: 497762 - DNA, 20 bp, Artificial
  CRISPR gRNA sequence
ttcttgcagcttccctggaa

SEQ ID NO: 497763 - DNA, 20 bp, Artificial
  CRISPR gRNA sequence
ttgcagcttccctggaactt

SEQ ID NO: 497764 - DNA, 20 bp, Artificial
  CRISPR gRNA sequence
gcagcttccctggaacttca

SEQ ID NO: 497765 - DNA, 20 bp, Artificial
  CRISPR gRNA sequence
cagcttccctggaacttcac

SEQ ID NO: 497766 - DNA, 20 bp, Artificial
  CRISPR gRNA sequence
ccctggaacttcacaattat

SEQ ID NO: 497767 - DNA, 20 bp, Artificial
  CRISPR gRNA sequence
cctggaacttcacaattatt

SEQ ID NO: 497768 - DNA, 20 bp, Artificial
  CRISPR gRNA sequence
gaacttcacaattatttcaa

SEQ ID NO: 497769 - DNA, 20 bp, Artificial
  CRISPR gRNA sequence
cacaattatttcaaactaaa

SEQ ID NO: 497770 - DNA, 20 bp, Artificial
  CRISPR gRNA sequence
acaattatttcaaactaaaa

SEQ ID NO: 497771 - DNA, 20 bp, Artificial
  CRISPR gRNA sequence
tttcaaactaaaaagcttaa

SEQ ID NO: 497772 - DNA, 20 bp, Artificial
  CRISPR gRNA sequence
caaactaaaaagcttaaaaa

SEQ ID NO: 497773 - DNA, 20 bp, Artificial
  CRISPR gRNA sequence
aaactaaaaagcttaaaaat

SEQ ID NO: 497774 - DNA, 20 bp, Artificial
  CRISPR gRNA sequence
aaaagcttaaaaattaaaga

SEQ ID NO: 497775 - DNA, 20 bp, Artificial
  CRISPR gRNA sequence
aaaaattaaagaaatagagc

SEQ ID NO: 497776 - DNA, 20 bp, Artificial
  CRISPR gRNA sequence
aaaattaaagaaatagagca

SEQ ID NO: 497777 - DNA, 20 bp, Artificial
  CRISPR gRNA sequence
aagaaatagagcagcttcag

SEQ ID NO: 497778 - DNA, 20 bp, Artificial
  CRISPR gRNA sequence
cagtcaacttatgccaggcc

SEQ ID NO: 497779 - DNA, 20 bp, Artificial
  CRISPR gRNA sequence
agtcaacttatgccaggcct

SEQ ID NO: 497780 - DNA, 20 bp, Artificial
  CRISPR gRNA sequence
atgccaggcctgccctatag

SEQ ID NO: 497781 - DNA, 20 bp, Artificial
  CRISPR gRNA sequence
tgccaggcctgccctataga

SEQ ID NO: 497782 - DNA, 20 bp, Artificial
  CRISPR gRNA sequence
ccctatagacacaggatgga

SEQ ID NO: 497783 - DNA, 20 bp, Artificial
  CRISPR gRNA sequence
tagacacaggatggaggagg

SEQ ID NO: 497784 - DNA, 20 bp, Artificial
  CRISPR gRNA sequence
aggaagacccaagtccatcc

SEQ ID NO: 497785 - DNA, 20 bp, Artificial
  CRISPR gRNA sequence
cctgtgcctaacaagtcact

SEQ ID NO: 497786 - DNA, 20 bp, Artificial
  CRISPR gRNA sequence
tgcctaacaagtcactcacc

SEQ ID NO: 497787 - DNA, 20 bp, Artificial
  CRISPR gRNA sequence
acaagtcactcaccagcttc

SEQ ID NO: 497788 - DNA, 20 bp, Artificial
  CRISPR gRNA sequence
accagcttcaccgtgcaagg

SEQ ID NO: 497789 - DNA, 20 bp, Artificial
  CRISPR gRNA sequence
caccgtgcaagggccggcat

SEQ ID NO: 497790 - DNA, 20 bp, Artificial
  CRISPR gRNA sequence
accgtgcaagggccggcata

SEQ ID NO: 497791 - DNA, 20 bp, Artificial
  CRISPR gRNA sequence
tggtgctgaagccctgggaa

SEQ ID NO: 497792 - DNA, 20 bp, Artificial
  CRISPR gRNA sequence
aagccctgggaatgggggtg

SEQ ID NO: 497793 - DNA, 20 bp, Artificial
  CRISPR gRNA sequence
ggaatgggggtggagggagc

SEQ ID NO: 497794 - DNA, 20 bp, Artificial
  CRISPR gRNA sequence
ccctctgtcacacaggctca

SEQ ID NO: 497795 - DNA, 20 bp, Artificial
  CRISPR gRNA sequence
tgtcacacaggctcatgacc

SEQ ID NO: 497796 - DNA, 20 bp, Artificial
  CRISPR gRNA sequence
tcacacaggctcatgacctc

SEQ ID NO: 497797 - DNA, 20 bp, Artificial
  CRISPR gRNA sequence
atgacctcagggtcataacc

SEQ ID NO: 497798 - DNA, 20 bp, Artificial
  CRISPR gRNA sequence
agggtcataacctcagcttc

SEQ ID NO: 497799 - DNA, 20 bp, Artificial
  CRISPR gRNA sequence
agcttctctgttactctcat

SEQ ID NO: 497800 - DNA, 20 bp, Artificial
  CRISPR gRNA sequence
ctctgttactctcatcccca

SEQ ID NO: 497801 - DNA, 20 bp, Artificial
  CRISPR gRNA sequence
tctgttactctcatccccac

SEQ ID NO: 497802 - DNA, 20 bp, Artificial
  CRISPR gRNA sequence
tgttactctcatccccacag

SEQ ID NO: 497803 - DNA, 20 bp, Artificial
  CRISPR gRNA sequence
ttactctcatccccacagcc

SEQ ID NO: 497804 - DNA, 20 bp, Artificial
  CRISPR gRNA sequence
ctctcatccccacagccagg

SEQ ID NO: 497805 - DNA, 20 bp, Artificial
  CRISPR gRNA sequence
tcatccccacagccaggcac

SEQ ID NO: 497806 - DNA, 20 bp, Artificial
  CRISPR gRNA sequence
atccccacagccaggcacca

SEQ ID NO: 497807 - DNA, 20 bp, Artificial
  CRISPR gRNA sequence
cttcggctgtctgagctgca

SEQ ID NO: 497808 - DNA, 20 bp, Artificial
  CRISPR gRNA sequence
cggctgtctgagctgcattc

SEQ ID NO: 497809 - DNA, 20 bp, Artificial
  CRISPR gRNA sequence
ggctgtctgagctgcattca

SEQ ID NO: 497810 - DNA, 20 bp, Artificial
  CRISPR gRNA sequence
tctgagctgcattcaaggat

SEQ ID NO: 497811 - DNA, 20 bp, Artificial
  CRISPR gRNA sequence
agctgcattcaaggatcctt

SEQ ID NO: 497812 - DNA, 20 bp, Artificial
  CRISPR gRNA sequence
cattcaaggatccttagacc

SEQ ID NO: 497813 - DNA, 20 bp, Artificial
  CRISPR gRNA sequence
aaggatccttagaccaggtt

SEQ ID NO: 497814 - DNA, 20 bp, Artificial
  CRISPR gRNA sequence
agaccaggttccaacctagc

SEQ ID NO: 497815 - DNA, 20 bp, Artificial
  CRISPR gRNA sequence
gaccaggttccaacctagct

SEQ ID NO: 497816 - DNA, 20 bp, Artificial
  CRISPR gRNA sequence
caacctagctctcctgccta

SEQ ID NO: 497817 - DNA, 20 bp, Artificial
  CRISPR gRNA sequence
gctctcctgcctagaatcct

SEQ ID NO: 497818 - DNA, 20 bp, Artificial
  CRISPR gRNA sequence
tcctgcctagaatcctgggc

SEQ ID NO: 497819 - DNA, 20 bp, Artificial
  CRISPR gRNA sequence
ctgcctagaatcctgggcca

SEQ ID NO: 497820 - DNA, 20 bp, Artificial
  CRISPR gRNA sequence
cctagaatcctgggccacta

SEQ ID NO: 497821 - DNA, 20 bp, Artificial
  CRISPR gRNA sequence
gaatcctgggccactaggcc

SEQ ID NO: 497822 - DNA, 20 bp, Artificial
  CRISPR gRNA sequence
ggccactaggccccccaacc

SEQ ID NO: 497823 - DNA, 20 bp, Artificial
  CRISPR gRNA sequence
ggccccccaacccacccaca

SEQ ID NO: 497824 - DNA, 20 bp, Artificial
  CRISPR gRNA sequence
caggctccactcctccctcc

SEQ ID NO: 497825 - DNA, 20 bp, Artificial
  CRISPR gRNA sequence
cactcctccctccctgctcc

SEQ ID NO: 497826 - DNA, 20 bp, Artificial
  CRISPR gRNA sequence
ctccctccctgctccctgtt

SEQ ID NO: 497827 - DNA, 20 bp, Artificial
  CRISPR gRNA sequence
cctccctgctccctgttcct

SEQ ID NO: 497828 - DNA, 20 bp, Artificial
  CRISPR gRNA sequence
cctgctccctgttcctcatc

SEQ ID NO: 497829 - DNA, 20 bp, Artificial
  CRISPR gRNA sequence
ctccctgttcctcatcatgc

SEQ ID NO: 497830 - DNA, 20 bp, Artificial
  CRISPR gRNA sequence
cctgttcctcatcatgctct

SEQ ID NO: 497831 - DNA, 20 bp, Artificial
  CRISPR gRNA sequence
ttcctcatcatgctctgccc

SEQ ID NO: 497832 - DNA, 20 bp, Artificial
  CRISPR gRNA sequence
ctcatcatgctctgccctag

SEQ ID NO: 497833 - DNA, 20 bp, Artificial
  CRISPR gRNA sequence
atcatgctctgccctaggct

SEQ ID NO: 497834 - DNA, 20 bp, Artificial
  CRISPR gRNA sequence
tgccctaggctgcctgcatc

SEQ ID NO: 497835 - DNA, 20 bp, Artificial
  CRISPR gRNA sequence
ccctaggctgcctgcatcct

SEQ ID NO: 497836 - DNA, 20 bp, Artificial
  CRISPR gRNA sequence
ggctgcctgcatccttacaa

SEQ ID NO: 497837 - DNA, 20 bp, Artificial
  CRISPR gRNA sequence
cctgcatccttacaaatgtt

SEQ ID NO: 497838 - DNA, 20 bp, Artificial
  CRISPR gRNA sequence
catccttacaaatgttgagt

SEQ ID NO: 497839 - DNA, 20 bp, Artificial
  CRISPR gRNA sequence
acaaatgttgagtccacctg

SEQ ID NO: 497840 - DNA, 20 bp, Artificial
  CRISPR gRNA sequence
caaatgttgagtccacctga

SEQ ID NO: 497841 - DNA, 20 bp, Artificial
  CRISPR gRNA sequence
agtccacctgagccttgact

SEQ ID NO: 497842 - DNA, 20 bp, Artificial
  CRISPR gRNA sequence
agccttgactgtgtcttcct

SEQ ID NO: 497843 - DNA, 20 bp, Artificial
  CRISPR gRNA sequence
gactgtgtcttcctgaagga

SEQ ID NO: 497844 - DNA, 20 bp, Artificial
  CRISPR gRNA sequence
actgtgtcttcctgaaggac

SEQ ID NO: 497845 - DNA, 20 bp, Artificial
  CRISPR gRNA sequence
tgtcttcctgaaggacacaa

SEQ ID NO: 497846 - DNA, 20 bp, Artificial
  CRISPR gRNA sequence
cctgaaggacacaagaatgc

SEQ ID NO: 497847 - DNA, 20 bp, Artificial
  CRISPR gRNA sequence
ctgaaggacacaagaatgct

SEQ ID NO: 497848 - DNA, 20 bp, Artificial
  CRISPR gRNA sequence
aaggacacaagaatgctcag

SEQ ID NO: 497849 - DNA, 20 bp, Artificial
  CRISPR gRNA sequence
agggactcggtaactgaatt

SEQ ID NO: 497850 - DNA, 20 bp, Artificial
  CRISPR gRNA sequence
ggtaactgaattgagtacct

SEQ ID NO: 497851 - DNA, 20 bp, Artificial
  CRISPR gRNA sequence
aattgagtacctgggcatgg

SEQ ID NO: 497852 - DNA, 20 bp, Artificial
  CRISPR gRNA sequence
agtacctgggcatgggactt

SEQ ID NO: 497853 - DNA, 20 bp, Artificial
  CRISPR gRNA sequence
ggcatgggactttattgcat

SEQ ID NO: 497854 - DNA, 20 bp, Artificial
  CRISPR gRNA sequence
tattgcatatggggcttcta

SEQ ID NO: 497855 - DNA, 20 bp, Artificial
  CRISPR gRNA sequence
attgcatatggggcttctac

SEQ ID NO: 497856 - DNA, 20 bp, Artificial
  CRISPR gRNA sequence
ttgcatatggggcttctacc

SEQ ID NO: 497857 - DNA, 20 bp, Artificial
  CRISPR gRNA sequence
catatggggcttctacctgg

SEQ ID NO: 497858 - DNA, 20 bp, Artificial
  CRISPR gRNA sequence
ctacctggccctgaacccac

SEQ ID NO: 497859 - DNA, 20 bp, Artificial
  CRISPR gRNA sequence
tacctggccctgaacccaca

SEQ ID NO: 497860 - DNA, 20 bp, Artificial
  CRISPR gRNA sequence
cctggccctgaacccacaca

SEQ ID NO: 497861 - DNA, 20 bp, Artificial
  CRISPR gRNA sequence
gccctgaacccacacaacac

SEQ ID NO: 497862 - DNA, 20 bp, Artificial
  CRISPR gRNA sequence
aacccacacaacactatgcc

SEQ ID NO: 497863 - DNA, 20 bp, Artificial
  CRISPR gRNA sequence
tgcctcagtttcccctcttt

SEQ ID NO: 497864 - DNA, 20 bp, Artificial
  CRISPR gRNA sequence
agtttcccctctttgtgccc

SEQ ID NO: 497865 - DNA, 20 bp, Artificial
  CRISPR gRNA sequence
cccctctttgtgcccagagt

SEQ ID NO: 497866 - DNA, 20 bp, Artificial
  CRISPR gRNA sequence
ccctctttgtgcccagagtg

SEQ ID NO: 497867 - DNA, 20 bp, Artificial
  CRISPR gRNA sequence
tttgtgcccagagtgtaccc

SEQ ID NO: 497868 - DNA, 20 bp, Artificial
  CRISPR gRNA sequence
tgtgcccagagtgtaccctc

SEQ ID NO: 497869 - DNA, 20 bp, Artificial
  CRISPR gRNA sequence
gtgcccagagtgtaccctcc

SEQ ID NO: 497870 - DNA, 20 bp, Artificial
  CRISPR gRNA sequence
tgcccagagtgtaccctcct

SEQ ID NO: 497871 - DNA, 20 bp, Artificial
  CRISPR gRNA sequence
ctctaattccacgctctcca

SEQ ID NO: 497872 - DNA, 20 bp, Artificial
  CRISPR gRNA sequence
taattccacgctctccacct

SEQ ID NO: 497873 - DNA, 20 bp, Artificial
  CRISPR gRNA sequence
attccacgctctccacctcc

SEQ ID NO: 497874 - DNA, 20 bp, Artificial
  CRISPR gRNA sequence
cacgctctccacctccgtga

SEQ ID NO: 497875 - DNA, 20 bp, Artificial
  CRISPR gRNA sequence
tccacctccgtgaagcccct

SEQ ID NO: 497876 - DNA, 20 bp, Artificial
  CRISPR gRNA sequence
cacctccgtgaagcccctgc

SEQ ID NO: 497877 - DNA, 20 bp, Artificial
  CRISPR gRNA sequence
cgtgaagcccctgcagagtc

SEQ ID NO: 497878 - DNA, 20 bp, Artificial
  CRISPR gRNA sequence
cagagtcactgatctaaaat

SEQ ID NO: 497879 - DNA, 20 bp, Artificial
  CRISPR gRNA sequence
atctaaaatgcagaaccctg

SEQ ID NO: 497880 - DNA, 20 bp, Artificial
  CRISPR gRNA sequence
aaatgcagaaccctggctgg

SEQ ID NO: 497881 - DNA, 20 bp, Artificial
  CRISPR gRNA sequence
gctgggcatggtggctcaca

SEQ ID NO: 497882 - DNA, 20 bp, Artificial
  CRISPR gRNA sequence
ggcatggtggctcacacctg

SEQ ID NO: 497883 - DNA, 20 bp, Artificial
  CRISPR gRNA sequence
acacctgtaatcccagcact

SEQ ID NO: 497884 - DNA, 20 bp, Artificial
  CRISPR gRNA sequence
taatcccagcactttggatg

SEQ ID NO: 497885 - DNA, 20 bp, Artificial
  CRISPR gRNA sequence
tggatgggggagaccaaggt

SEQ ID NO: 497886 - DNA, 20 bp, Artificial
  CRISPR gRNA sequence
ggatgggggagaccaaggtg

SEQ ID NO: 497887 - DNA, 20 bp, Artificial
  CRISPR gRNA sequence
gatgggggagaccaaggtgg

SEQ ID NO: 497888 - DNA, 20 bp, Artificial
  CRISPR gRNA sequence
aggtcaggagttcaagacca

SEQ ID NO: 497889 - DNA, 20 bp, Artificial
  CRISPR gRNA sequence
aagaccagcctggccaacat

SEQ ID NO: 497890 - DNA, 20 bp, Artificial
  CRISPR gRNA sequence
gccaacatggtgaaacctgg

SEQ ID NO: 497891 - DNA, 20 bp, Artificial
  CRISPR gRNA sequence
gtctctactaaaaatacaaa

SEQ ID NO: 497892 - DNA, 20 bp, Artificial
  CRISPR gRNA sequence
tactaaaaatacaaaaatta

SEQ ID NO: 497893 - DNA, 20 bp, Artificial
  CRISPR gRNA sequence
ctaaaaatacaaaaattagc

SEQ ID NO: 497894 - DNA, 20 bp, Artificial
  CRISPR gRNA sequence
aaaatacaaaaattagccaa

SEQ ID NO: 497895 - DNA, 20 bp, Artificial
  CRISPR gRNA sequence
gccaagcatggtggcgcacg

SEQ ID NO: 497896 - DNA, 20 bp, Artificial
  CRISPR gRNA sequence
taatttcacctactcgggag

SEQ ID NO: 497897 - DNA, 20 bp, Artificial
  CRISPR gRNA sequence
cacctactcgggaggctgag

SEQ ID NO: 497898 - DNA, 20 bp, Artificial
  CRISPR gRNA sequence
acctactcgggaggctgagg

SEQ ID NO: 497899 - DNA, 20 bp, Artificial
  CRISPR gRNA sequence
ctcgggaggctgaggcatga

SEQ ID NO: 497900 - DNA, 20 bp, Artificial
  CRISPR gRNA sequence
gggaggctgaggcatgagaa

SEQ ID NO: 497901 - DNA, 20 bp, Artificial
  CRISPR gRNA sequence
aggcatgagaatcacttgaa

SEQ ID NO: 497902 - DNA, 20 bp, Artificial
  CRISPR gRNA sequence
gaacccgggaggcagagttt

SEQ ID NO: 497903 - DNA, 20 bp, Artificial
  CRISPR gRNA sequence
aacccgggaggcagagtttg

SEQ ID NO: 497904 - DNA, 20 bp, Artificial
  CRISPR gRNA sequence
gtagtgagccaagatcacgc

SEQ ID NO: 497905 - DNA, 20 bp, Artificial
  CRISPR gRNA sequence
tagtgagccaagatcacgcc

SEQ ID NO: 497906 - DNA, 20 bp, Artificial
  CRISPR gRNA sequence
cactccagcctgggtgacag

SEQ ID NO: 497907 - DNA, 20 bp, Artificial
  CRISPR gRNA sequence
cagcctgggtgacagaagga

SEQ ID NO: 497908 - DNA, 20 bp, Artificial
  CRISPR gRNA sequence
ggtgacagaaggagactctg

SEQ ID NO: 497909 - DNA, 20 bp, Artificial
  CRISPR gRNA sequence
tgtctcaaaaaataaataaa

SEQ ID NO: 497910 - DNA, 20 bp, Artificial
  CRISPR gRNA sequence
tctcaaaaaataaataaata

SEQ ID NO: 497911 - DNA, 20 bp, Artificial
  CRISPR gRNA sequence
aaaaaataaataaataaata

SEQ ID NO: 497912 - DNA, 20 bp, Artificial
  CRISPR gRNA sequence
aaaatgaaataaataaatta

SEQ ID NO: 497913 - DNA, 20 bp, Artificial
  CRISPR gRNA sequence
attcaattaaattaaatgcg

SEQ ID NO: 497914 - DNA, 20 bp, Artificial
  CRISPR gRNA sequence
aattaaattaaatgcgggat

SEQ ID NO: 497915 - DNA, 20 bp, Artificial
  CRISPR gRNA sequence
aattaaatgcgggatccagg

SEQ ID NO: 497916 - DNA, 20 bp, Artificial
  CRISPR gRNA sequence
aatgcgggatccaggtttca

SEQ ID NO: 497917 - DNA, 20 bp, Artificial
  CRISPR gRNA sequence
cagagcatcctggaccccag

SEQ ID NO: 497918 - DNA, 20 bp, Artificial
  CRISPR gRNA sequence
agagcatcctggaccccaga

SEQ ID NO: 497919 - DNA, 20 bp, Artificial
  CRISPR gRNA sequence
gaccccagaactggagaaag

SEQ ID NO: 497920 - DNA, 20 bp, Artificial
  CRISPR gRNA sequence
gagaaagaggggagcagccc

SEQ ID NO: 497921 - DNA, 20 bp, Artificial
  CRISPR gRNA sequence
agctgggatccccaggagta

SEQ ID NO: 497922 - DNA, 20 bp, Artificial
  CRISPR gRNA sequence
ggatccccaggagtaaatgt

SEQ ID NO: 497923 - DNA, 20 bp, Artificial
  CRISPR gRNA sequence
gatggctccatgcctggctg

SEQ ID NO: 497924 - DNA, 20 bp, Artificial
  CRISPR gRNA sequence
catgcctggctgacagcttt

SEQ ID NO: 497925 - DNA, 20 bp, Artificial
  CRISPR gRNA sequence
gctgacagctttaggtttgc

SEQ ID NO: 497926 - DNA, 20 bp, Artificial
  CRISPR gRNA sequence
acagctttaggtttgctgtg

SEQ ID NO: 497927 - DNA, 20 bp, Artificial
  CRISPR gRNA sequence
taggtttgctgtggagcttc

SEQ ID NO: 497928 - DNA, 20 bp, Artificial
  CRISPR gRNA sequence
aggtttgctgtggagcttcc

SEQ ID NO: 497929 - DNA, 20 bp, Artificial
  CRISPR gRNA sequence
ggtttgctgtggagcttcct

SEQ ID NO: 497930 - DNA, 20 bp, Artificial
  CRISPR gRNA sequence
gctgtggagcttcctcatat

SEQ ID NO: 497931 - DNA, 20 bp, Artificial
  CRISPR gRNA sequence
ctgtggagcttcctcatatt

SEQ ID NO: 497932 - DNA, 20 bp, Artificial
  CRISPR gRNA sequence
tggagcttcctcatattgtc

SEQ ID NO: 497933 - DNA, 20 bp, Artificial
  CRISPR gRNA sequence
cctcatattgtctccttctt

SEQ ID NO: 497934 - DNA, 20 bp, Artificial
  CRISPR gRNA sequence
ctcatattgtctccttcttc

SEQ ID NO: 497935 - DNA, 20 bp, Artificial
  CRISPR gRNA sequence
atattgtctccttcttctgc

SEQ ID NO: 497936 - DNA, 20 bp, Artificial
  CRISPR gRNA sequence
tctccttcttctgccccaac

SEQ ID NO: 497937 - DNA, 20 bp, Artificial
  CRISPR gRNA sequence
cttcttctgccccaaccctg

SEQ ID NO: 497938 - DNA, 20 bp, Artificial
  CRISPR gRNA sequence
cttctgccccaaccctgcat

SEQ ID NO: 497939 - DNA, 20 bp, Artificial
  CRISPR gRNA sequence
ttctgccccaaccctgcatg

SEQ ID NO: 497940 - DNA, 20 bp, Artificial
  CRISPR gRNA sequence
ctgccccaaccctgcatgtc

SEQ ID NO: 497941 - DNA, 20 bp, Artificial
  CRISPR gRNA sequence
tgccccaaccctgcatgtcc

SEQ ID NO: 497942 - DNA, 20 bp, Artificial
  CRISPR gRNA sequence
ccccaaccctgcatgtccct

SEQ ID NO: 497943 - DNA, 20 bp, Artificial
  CRISPR gRNA sequence
catgtccctaataatttcca

SEQ ID NO: 497944 - DNA, 20 bp, Artificial
  CRISPR gRNA sequence
ataatttccaggctcctgtg

SEQ ID NO: 497945 - DNA, 20 bp, Artificial
  CRISPR gRNA sequence
ccaggctcctgtggcatctg

SEQ ID NO: 497946 - DNA, 20 bp, Artificial
  CRISPR gRNA sequence
caggctcctgtggcatctgg

SEQ ID NO: 497947 - DNA, 20 bp, Artificial
  CRISPR gRNA sequence
ctgtggcatctggatggctg

SEQ ID NO: 497948 - DNA, 20 bp, Artificial
  CRISPR gRNA sequence
tggcatctggatggctgaag

SEQ ID NO: 497949 - DNA, 20 bp, Artificial
  CRISPR gRNA sequence
gatggctgaagaagccgggg

SEQ ID NO: 497950 - DNA, 20 bp, Artificial
  CRISPR gRNA sequence
aagaagccggggagatgagg

SEQ ID NO: 497951 - DNA, 20 bp, Artificial
  CRISPR gRNA sequence
ccagcttcttcctggctgct

SEQ ID NO: 497952 - DNA, 20 bp, Artificial
  CRISPR gRNA sequence
cagcttcttcctggctgctg

SEQ ID NO: 497953 - DNA, 20 bp, Artificial
  CRISPR gRNA sequence
cttcctggctgctggcctcg

SEQ ID NO: 497954 - DNA, 20 bp, Artificial
  CRISPR gRNA sequence
ttcctggctgctggcctcgc

SEQ ID NO: 497955 - DNA, 20 bp, Artificial
  CRISPR gRNA sequence
cctggctgctggcctcgccc

SEQ ID NO: 497956 - DNA, 20 bp, Artificial
  CRISPR gRNA sequence
ctggctgctggcctcgccct

SEQ ID NO: 497957 - DNA, 20 bp, Artificial
  CRISPR gRNA sequence
gctgctggcctcgccctccc

SEQ ID NO: 497958 - DNA, 20 bp, Artificial
  CRISPR gRNA sequence
ctggcctcgccctcccctcc

SEQ ID NO: 497959 - DNA, 20 bp, Artificial
  CRISPR gRNA sequence
gcctcgccctcccctccctg

SEQ ID NO: 497960 - DNA, 20 bp, Artificial
  CRISPR gRNA sequence
gccctcccctccctgggctc

SEQ ID NO: 497961 - DNA, 20 bp, Artificial
  CRISPR gRNA sequence
ccctccctgggctcagcttt

SEQ ID NO: 497962 - DNA, 20 bp, Artificial
  CRISPR gRNA sequence
cctgggctcagctttcctgc

SEQ ID NO: 497963 - DNA, 20 bp, Artificial
  CRISPR gRNA sequence
ggctcagctttcctgcctca

SEQ ID NO: 497964 - DNA, 20 bp, Artificial
  CRISPR gRNA sequence
agctttcctgcctcaggggt

SEQ ID NO: 497965 - DNA, 20 bp, Artificial
  CRISPR gRNA sequence
tcctgcctcaggggtccatc

SEQ ID NO: 497966 - DNA, 20 bp, Artificial
  CRISPR gRNA sequence
cctgcctcaggggtccatcc

SEQ ID NO: 497967 - DNA, 20 bp, Artificial
  CRISPR gRNA sequence
ctgcctcaggggtccatcca

SEQ ID NO: 497968 - DNA, 20 bp, Artificial
  CRISPR gRNA sequence
cctcaggggtccatccatct

SEQ ID NO: 497969 - DNA, 20 bp, Artificial
  CRISPR gRNA sequence
aggggtccatccatctgtct

SEQ ID NO: 497970 - DNA, 20 bp, Artificial
  CRISPR gRNA sequence
tctctgagctcgagaaccac

SEQ ID NO: 497971 - DNA, 20 bp, Artificial
  CRISPR gRNA sequence
tgagctcgagaaccacccac

SEQ ID NO: 497972 - DNA, 20 bp, Artificial
  CRISPR gRNA sequence
agctcgagaaccacccactt

SEQ ID NO: 497973 - DNA, 20 bp, Artificial
  CRISPR gRNA sequence
gagaaccacccacttccttg

SEQ ID NO: 497974 - DNA, 20 bp, Artificial
  CRISPR gRNA sequence
ccttgggactgcttctcttc

SEQ ID NO: 497975 - DNA, 20 bp, Artificial
  CRISPR gRNA sequence
cttgggactgcttctcttct

SEQ ID NO: 497976 - DNA, 20 bp, Artificial
  CRISPR gRNA sequence
gggactgcttctcttctctc

SEQ ID NO: 497977 - DNA, 20 bp, Artificial
  CRISPR gRNA sequence
ggactgcttctcttctctca

SEQ ID NO: 497978 - DNA, 20 bp, Artificial
  CRISPR gRNA sequence
cttctcttctctcatgccac

SEQ ID NO: 497979 - DNA, 20 bp, Artificial
  CRISPR gRNA sequence
ctcttctctcatgccacaat

SEQ ID NO: 497980 - DNA, 20 bp, Artificial
  CRISPR gRNA sequence
tcttctctcatgccacaatt

SEQ ID NO: 497981 - DNA, 20 bp, Artificial
  CRISPR gRNA sequence
ttctctcatgccacaattgg

SEQ ID NO: 497982 - DNA, 20 bp, Artificial
  CRISPR gRNA sequence
ctctcatgccacaattggag

SEQ ID NO: 497983 - DNA, 20 bp, Artificial
  CRISPR gRNA sequence
tctcatgccacaattggagg

SEQ ID NO: 497984 - DNA, 20 bp, Artificial
  CRISPR gRNA sequence
tcatgccacaattggaggat

SEQ ID NO: 497985 - DNA, 20 bp, Artificial
  CRISPR gRNA sequence
atgccacaattggaggatgc

SEQ ID NO: 497986 - DNA, 20 bp, Artificial
  CRISPR gRNA sequence
gaggatgcaattttcatcat

SEQ ID NO: 497987 - DNA, 20 bp, Artificial
  CRISPR gRNA sequence
tcatcatctttacaggcggc

SEQ ID NO: 497988 - DNA, 20 bp, Artificial
  CRISPR gRNA sequence
catcatctttacaggcggct

SEQ ID NO: 497989 - DNA, 20 bp, Artificial
  CRISPR gRNA sequence
atcatctttacaggcggctg

SEQ ID NO: 497990 - DNA, 20 bp, Artificial
  CRISPR gRNA sequence
tacaggcggctggaaggagg

SEQ ID NO: 497991 - DNA, 20 bp, Artificial
  CRISPR gRNA sequence
acaggcggctggaaggaggc

SEQ ID NO: 497992 - DNA, 20 bp, Artificial
  CRISPR gRNA sequence
caggcggctggaaggaggct

SEQ ID NO: 497993 - DNA, 20 bp, Artificial
  CRISPR gRNA sequence
gaaggaggcttctctctcca

SEQ ID NO: 497994 - DNA, 20 bp, Artificial
  CRISPR gRNA sequence
ctctctccactacacggaag

SEQ ID NO: 497995 - DNA, 20 bp, Artificial
  CRISPR gRNA sequence
tctctccactacacggaagg

SEQ ID NO: 497996 - DNA, 20 bp, Artificial
  CRISPR gRNA sequence
tctccactacacggaagggt

SEQ ID NO: 497997 - DNA, 20 bp, Artificial
  CRISPR gRNA sequence
tccactacacggaagggtaa

SEQ ID NO: 497998 - DNA, 20 bp, Artificial
  CRISPR gRNA sequence
cactacacggaagggtaaat

SEQ ID NO: 497999 - DNA, 20 bp, Artificial
  CRISPR gRNA sequence
cacggaagggtaaattgaag

SEQ ID NO: 498000 - DNA, 20 bp, Artificial
  CRISPR gRNA sequence
aagccagtgggaaggaatct

SEQ ID NO: 498001 - DNA, 20 bp, Artificial
  CRISPR gRNA sequence
ctcacccaagacttcctgga

SEQ ID NO: 498002 - DNA, 20 bp, Artificial
  CRISPR gRNA sequence
acccaagacttcctggattg

SEQ ID NO: 498003 - DNA, 20 bp, Artificial
  CRISPR gRNA sequence
cctggattgctggtggcagg

SEQ ID NO: 498004 - DNA, 20 bp, Artificial
  CRISPR gRNA sequence
ctggattgctggtggcaggg

SEQ ID NO: 498005 - DNA, 20 bp, Artificial
  CRISPR gRNA sequence
gattgctggtggcagggcca

SEQ ID NO: 498006 - DNA, 20 bp, Artificial
  CRISPR gRNA sequence
ctggtggcagggccagatac

SEQ ID NO: 498007 - DNA, 20 bp, Artificial
  CRISPR gRNA sequence
gtggcagggccagatacccc

SEQ ID NO: 498008 - DNA, 20 bp, Artificial
  CRISPR gRNA sequence
tcacagacctcccagtgcac

SEQ ID NO: 498009 - DNA, 20 bp, Artificial
  CRISPR gRNA sequence
acagacctcccagtgcactg

SEQ ID NO: 498010 - DNA, 20 bp, Artificial
  CRISPR gRNA sequence
ccagtgcactgccagcctgt

SEQ ID NO: 498011 - DNA, 20 bp, Artificial
  CRISPR gRNA sequence
ccagcctgtcctgtctgatt

SEQ ID NO: 498012 - DNA, 20 bp, Artificial
  CRISPR gRNA sequence
tcctgtctgatttagactgt

SEQ ID NO: 498013 - DNA, 20 bp, Artificial
  CRISPR gRNA sequence
tctgatttagactgtcagag

SEQ ID NO: 498014 - DNA, 20 bp, Artificial
  CRISPR gRNA sequence
atttagactgtcagagctgt

SEQ ID NO: 498015 - DNA, 20 bp, Artificial
  CRISPR gRNA sequence
agactgtcagagctgtcagg

SEQ ID NO: 498016 - DNA, 20 bp, Artificial
  CRISPR gRNA sequence
gactgtcagagctgtcagga

SEQ ID NO: 498017 - DNA, 20 bp, Artificial
  CRISPR gRNA sequence
tcagagctgtcaggagctgc

SEQ ID NO: 498018 - DNA, 20 bp, Artificial
  CRISPR gRNA sequence
tcaggagctgctcggagtca

SEQ ID NO: 498019 - DNA, 20 bp, Artificial
  CRISPR gRNA sequence
ctcggagtcaagttccagat

SEQ ID NO: 498020 - DNA, 20 bp, Artificial
  CRISPR gRNA sequence
ggagtcaagttccagatgac

SEQ ID NO: 498021 - DNA, 20 bp, Artificial
  CRISPR gRNA sequence
cagatgactgtgtatgtggc

SEQ ID NO: 498022 - DNA, 20 bp, Artificial
  CRISPR gRNA sequence
tgtatgtggcacaagcagag

SEQ ID NO: 498023 - DNA, 20 bp, Artificial
  CRISPR gRNA sequence
tggctctgatctccctgagg

SEQ ID NO: 498024 - DNA, 20 bp, Artificial
  CRISPR gRNA sequence
gctctgatctccctgagggg

SEQ ID NO: 498025 - DNA, 20 bp, Artificial
  CRISPR gRNA sequence
tgatctccctgaggggcaca

SEQ ID NO: 498026 - DNA, 20 bp, Artificial
  CRISPR gRNA sequence
atctccctgaggggcacagc

SEQ ID NO: 498027 - DNA, 20 bp, Artificial
  CRISPR gRNA sequence
cctgaggggcacagctccta

SEQ ID NO: 498028 - DNA, 20 bp, Artificial
  CRISPR gRNA sequence
aggggcacagctcctagtcc

SEQ ID NO: 498029 - DNA, 20 bp, Artificial
  CRISPR gRNA sequence
ctagtccctccctcgcccca

SEQ ID NO: 498030 - DNA, 20 bp, Artificial
  CRISPR gRNA sequence
gtccctccctcgccccacgc

SEQ ID NO: 498031 - DNA, 20 bp, Artificial
  CRISPR gRNA sequence
cctcgccccacgccaggtag

SEQ ID NO: 498032 - DNA, 20 bp, Artificial
  CRISPR gRNA sequence
gccccacgccaggtaggacc

SEQ ID NO: 498033 - DNA, 20 bp, Artificial
  CRISPR gRNA sequence
cttacctttgccctgataca

SEQ ID NO: 498034 - DNA, 20 bp, Artificial
  CRISPR gRNA sequence
acctttgccctgatacacct

SEQ ID NO: 498035 - DNA, 20 bp, Artificial
  CRISPR gRNA sequence
cctttgccctgatacacctt

SEQ ID NO: 498036 - DNA, 20 bp, Artificial
  CRISPR gRNA sequence
tgccctgatacaccttgagg

SEQ ID NO: 498037 - DNA, 20 bp, Artificial
  CRISPR gRNA sequence
gccctgatacaccttgagga

SEQ ID NO: 498038 - DNA, 20 bp, Artificial
  CRISPR gRNA sequence
ccctgatacaccttgaggag

SEQ ID NO: 498039 - DNA, 20 bp, Artificial
  CRISPR gRNA sequence
atacaccttgaggagcagga

SEQ ID NO: 498040 - DNA, 20 bp, Artificial
  CRISPR gRNA sequence
gaggagcaggaggagtatga

SEQ ID NO: 498041 - DNA, 20 bp, Artificial
  CRISPR gRNA sequence
aggagcaggaggagtatgag

SEQ ID NO: 498042 - DNA, 20 bp, Artificial
  CRISPR gRNA sequence
gccccagcatttccacagga

SEQ ID NO: 498043 - DNA, 20 bp, Artificial
  CRISPR gRNA sequence
ccccagcatttccacaggac

SEQ ID NO: 498044 - DNA, 20 bp, Artificial
  CRISPR gRNA sequence
ccacaggacagaggggccag

SEQ ID NO: 498045 - DNA, 20 bp, Artificial
  CRISPR gRNA sequence
cacaggacagaggggccagg

SEQ ID NO: 498046 - DNA, 20 bp, Artificial
  CRISPR gRNA sequence
caccccaccagactctctgc

SEQ ID NO: 498047 - DNA, 20 bp, Artificial
  CRISPR gRNA sequence
tctgccgtgcacgggctcag

SEQ ID NO: 498048 - DNA, 20 bp, Artificial
  CRISPR gRNA sequence
tgccgtgcacgggctcagca

SEQ ID NO: 498049 - DNA, 20 bp, Artificial
  CRISPR gRNA sequence
ccgtgcacgggctcagcagt

SEQ ID NO: 498050 - DNA, 20 bp, Artificial
  CRISPR gRNA sequence
agcagtccccagtcagcaag

SEQ ID NO: 498051 - DNA, 20 bp, Artificial
  CRISPR gRNA sequence
ccttgcaacctgtccagcca

SEQ ID NO: 498052 - DNA, 20 bp, Artificial
  CRISPR gRNA sequence
gcaacctgtccagccacagt

SEQ ID NO: 498053 - DNA, 20 bp, Artificial
  CRISPR gRNA sequence
caacctgtccagccacagtt

SEQ ID NO: 498054 - DNA, 20 bp, Artificial
  CRISPR gRNA sequence
tccagccacagtttcctcaa

SEQ ID NO: 498055 - DNA, 20 bp, Artificial
  CRISPR gRNA sequence
cctcaattagaggctgttaa

SEQ ID NO: 498056 - DNA, 20 bp, Artificial
  CRISPR gRNA sequence
ctcaattagaggctgttaac

SEQ ID NO: 498057 - DNA, 20 bp, Artificial
  CRISPR gRNA sequence
aattagaggctgttaacgcc

SEQ ID NO: 498058 - DNA, 20 bp, Artificial
  CRISPR gRNA sequence
gaggctgttaacgcctgctg

SEQ ID NO: 498059 - DNA, 20 bp, Artificial
  CRISPR gRNA sequence
ttaacgcctgctgtgagctg

SEQ ID NO: 498060 - DNA, 20 bp, Artificial
  CRISPR gRNA sequence
acgcctgctgtgagctgaca

SEQ ID NO: 498061 - DNA, 20 bp, Artificial
  CRISPR gRNA sequence
ctgtgagctgacaaggccac

SEQ ID NO: 498062 - DNA, 20 bp, Artificial
  CRISPR gRNA sequence
tgagctgacaaggccactga

SEQ ID NO: 498063 - DNA, 20 bp, Artificial
  CRISPR gRNA sequence
acaaggccactgagaaagcc

SEQ ID NO: 498064 - DNA, 20 bp, Artificial
  CRISPR gRNA sequence
agaaagccccagcgcctgga

SEQ ID NO: 498065 - DNA, 20 bp, Artificial
  CRISPR gRNA sequence
gagctggtctgacagttccc

SEQ ID NO: 498066 - DNA, 20 bp, Artificial
  CRISPR gRNA sequence
gtctgacagttcccacaagc

SEQ ID NO: 498067 - DNA, 20 bp, Artificial
  CRISPR gRNA sequence
acagttcccacaagccaaac

SEQ ID NO: 498068 - DNA, 20 bp, Artificial
  CRISPR gRNA sequence
ccacaagccaaactggtgaa

SEQ ID NO: 498069 - DNA, 20 bp, Artificial
  CRISPR gRNA sequence
gtgaagcttacctcaagtgg

SEQ ID NO: 498070 - DNA, 20 bp, Artificial
  CRISPR gRNA sequence
acctcaagtgggagggtgct

SEQ ID NO: 498071 - DNA, 20 bp, Artificial
  CRISPR gRNA sequence
cctcaagtgggagggtgctt

SEQ ID NO: 498072 - DNA, 20 bp, Artificial
  CRISPR gRNA sequence
aagtgggagggtgcttgaag

SEQ ID NO: 498073 - DNA, 20 bp, Artificial
  CRISPR gRNA sequence
gaagttcacagtgactcaca

SEQ ID NO: 498074 - DNA, 20 bp, Artificial
  CRISPR gRNA sequence
aagttcacagtgactcacaa

SEQ ID NO: 498075 - DNA, 20 bp, Artificial
  CRISPR gRNA sequence
acagtgactcacaaagccag

SEQ ID NO: 498076 - DNA, 20 bp, Artificial
  CRISPR gRNA sequence
acaaagccagtttcaaaatt

SEQ ID NO: 498077 - DNA, 20 bp, Artificial
  CRISPR gRNA sequence
tgaaactggctttgtgagtc

SEQ ID NO: 498078 - DNA, 20 bp, Artificial
  CRISPR gRNA sequence
gaaactggctttgtgagtca

SEQ ID NO: 498079 - DNA, 20 bp, Artificial
  CRISPR gRNA sequence
aaactggctttgtgagtcac

SEQ ID NO: 498080 - DNA, 20 bp, Artificial
  CRISPR gRNA sequence
gctttgtgagtcactgtgaa

SEQ ID NO: 498081 - DNA, 20 bp, Artificial
  CRISPR gRNA sequence
tgtgagtcactgtgaacttc

SEQ ID NO: 498082 - DNA, 20 bp, Artificial
  CRISPR gRNA sequence
gtgagtcactgtgaacttca

SEQ ID NO: 498083 - DNA, 20 bp, Artificial
  CRISPR gRNA sequence
tgagtcactgtgaacttcaa

SEQ ID NO: 498084 - DNA, 20 bp, Artificial
  CRISPR gRNA sequence
tgaacttcaagcaccctccc

SEQ ID NO: 498085 - DNA, 20 bp, Artificial
  CRISPR gRNA sequence
caagcaccctcccacttgag

SEQ ID NO: 498086 - DNA, 20 bp, Artificial
  CRISPR gRNA sequence
aagcaccctcccacttgagg

SEQ ID NO: 498087 - DNA, 20 bp, Artificial
  CRISPR gRNA sequence
ccacttgaggtaagcttcac

SEQ ID NO: 498088 - DNA, 20 bp, Artificial
  CRISPR gRNA sequence
gaggtaagcttcaccagttt

SEQ ID NO: 498089 - DNA, 20 bp, Artificial
  CRISPR gRNA sequence
aggtaagcttcaccagtttg

SEQ ID NO: 498090 - DNA, 20 bp, Artificial
  CRISPR gRNA sequence
caccagtttggcttgtggga

SEQ ID NO: 498091 - DNA, 20 bp, Artificial
  CRISPR gRNA sequence
accagtttggcttgtgggaa

SEQ ID NO: 498092 - DNA, 20 bp, Artificial
  CRISPR gRNA sequence
ggcttgtgggaactgtcaga

SEQ ID NO: 498093 - DNA, 20 bp, Artificial
  CRISPR gRNA sequence
gcttgtgggaactgtcagac

SEQ ID NO: 498094 - DNA, 20 bp, Artificial
  CRISPR gRNA sequence
gtgggaactgtcagaccagc

SEQ ID NO: 498095 - DNA, 20 bp, Artificial
  CRISPR gRNA sequence
tgggaactgtcagaccagct

SEQ ID NO: 498096 - DNA, 20 bp, Artificial
  CRISPR gRNA sequence
tcagaccagctccaggcgct

SEQ ID NO: 498097 - DNA, 20 bp, Artificial
  CRISPR gRNA sequence
caggcgctggggctttctca

SEQ ID NO: 498098 - DNA, 20 bp, Artificial
  CRISPR gRNA sequence
gggctttctcagtggccttg

SEQ ID NO: 498099 - DNA, 20 bp, Artificial
  CRISPR gRNA sequence
tctcagtggccttgtcagct

SEQ ID NO: 498100 - DNA, 20 bp, Artificial
  CRISPR gRNA sequence
ctcagtggccttgtcagctc

SEQ ID NO: 498101 - DNA, 20 bp, Artificial
  CRISPR gRNA sequence
tcagtggccttgtcagctca

SEQ ID NO: 498102 - DNA, 20 bp, Artificial
  CRISPR gRNA sequence
agtggccttgtcagctcaca

SEQ ID NO: 498103 - DNA, 20 bp, Artificial
  CRISPR gRNA sequence
gtcagctcacagcaggcgtt

SEQ ID NO: 498104 - DNA, 20 bp, Artificial
  CRISPR gRNA sequence
tcagctcacagcaggcgtta

SEQ ID NO: 498105 - DNA, 20 bp, Artificial
  CRISPR gRNA sequence
acagcaggcgttaacagcct

SEQ ID NO: 498106 - DNA, 20 bp, Artificial
  CRISPR gRNA sequence
acagcctctaattgaggaaa

SEQ ID NO: 498107 - DNA, 20 bp, Artificial
  CRISPR gRNA sequence
taattgaggaaactgtggct

SEQ ID NO: 498108 - DNA, 20 bp, Artificial
  CRISPR gRNA sequence
attgaggaaactgtggctgg

SEQ ID NO: 498109 - DNA, 20 bp, Artificial
  CRISPR gRNA sequence
aggaaactgtggctggacag

SEQ ID NO: 498110 - DNA, 20 bp, Artificial
  CRISPR gRNA sequence
tggctggacaggttgcaagg

SEQ ID NO: 498111 - DNA, 20 bp, Artificial
  CRISPR gRNA sequence
gacaggttgcaaggcagttc

SEQ ID NO: 498112 - DNA, 20 bp, Artificial
  CRISPR gRNA sequence
caaggcagttctgctcccca

SEQ ID NO: 498113 - DNA, 20 bp, Artificial
  CRISPR gRNA sequence
tgctccccatcgtcctcttg

SEQ ID NO: 498114 - DNA, 20 bp, Artificial
  CRISPR gRNA sequence
ctccccatcgtcctcttgct

SEQ ID NO: 498115 - DNA, 20 bp, Artificial
  CRISPR gRNA sequence
cccatcgtcctcttgctgac

SEQ ID NO: 498116 - DNA, 20 bp, Artificial
  CRISPR gRNA sequence
ttgctgactggggactgctg

SEQ ID NO: 498117 - DNA, 20 bp, Artificial
  CRISPR gRNA sequence
gctgactggggactgctgag

SEQ ID NO: 498118 - DNA, 20 bp, Artificial
  CRISPR gRNA sequence
ctgactggggactgctgagc

SEQ ID NO: 498119 - DNA, 20 bp, Artificial
  CRISPR gRNA sequence
actggggactgctgagcccg

SEQ ID NO: 498120 - DNA, 20 bp, Artificial
  CRISPR gRNA sequence
gggactgctgagcccgtgca

SEQ ID NO: 498121 - DNA, 20 bp, Artificial
  CRISPR gRNA sequence
ctgagcccgtgcacggcaga

SEQ ID NO: 498122 - DNA, 20 bp, Artificial
  CRISPR gRNA sequence
agcccgtgcacggcagagag

SEQ ID NO: 498123 - DNA, 20 bp, Artificial
  CRISPR gRNA sequence
gtggggtggaggggctggcc

SEQ ID NO: 498124 - DNA, 20 bp, Artificial
  CRISPR gRNA sequence
gcctggcccctctgtcctgt

SEQ ID NO: 498125 - DNA, 20 bp, Artificial
  CRISPR gRNA sequence
gcccctctgtcctgtggaaa

SEQ ID NO: 498126 - DNA, 20 bp, Artificial
  CRISPR gRNA sequence
tgtcctgtggaaatgctggg

SEQ ID NO: 498127 - DNA, 20 bp, Artificial
  CRISPR gRNA sequence
tcctgtggaaatgctggggc

SEQ ID NO: 498128 - DNA, 20 bp, Artificial
  CRISPR gRNA sequence
tggaaatgctggggcaagtg

SEQ ID NO: 498129 - DNA, 20 bp, Artificial
  CRISPR gRNA sequence
gggcaagtggtcaccctcat

SEQ ID NO: 498130 - DNA, 20 bp, Artificial
  CRISPR gRNA sequence
atactcctcctgctcctcaa

SEQ ID NO: 498131 - DNA, 20 bp, Artificial
  CRISPR gRNA sequence
ctcctgctcctcaaggtgta

SEQ ID NO: 498132 - DNA, 20 bp, Artificial
  CRISPR gRNA sequence
ctgctcctcaaggtgtatca

SEQ ID NO: 498133 - DNA, 20 bp, Artificial
  CRISPR gRNA sequence
ctcctcaaggtgtatcaggg

SEQ ID NO: 498134 - DNA, 20 bp, Artificial
  CRISPR gRNA sequence
ctcaaggtgtatcagggcaa

SEQ ID NO: 498135 - DNA, 20 bp, Artificial
  CRISPR gRNA sequence
aaggtgtatcagggcaaagg

SEQ ID NO: 498136 - DNA, 20 bp, Artificial
  CRISPR gRNA sequence
cctggcgtggggcgagggag

SEQ ID NO: 498137 - DNA, 20 bp, Artificial
  CRISPR gRNA sequence
gcgtggggcgagggagggac

SEQ ID NO: 498138 - DNA, 20 bp, Artificial
  CRISPR gRNA sequence
ggagctgtgcccctcaggga

SEQ ID NO: 498139 - DNA, 20 bp, Artificial
  CRISPR gRNA sequence
tgcccctcagggagatcaga

SEQ ID NO: 498140 - DNA, 20 bp, Artificial
  CRISPR gRNA sequence
agggagatcagagccagagc

SEQ ID NO: 498141 - DNA, 20 bp, Artificial
  CRISPR gRNA sequence
tgcttgtgccacatacacag

SEQ ID NO: 498142 - DNA, 20 bp, Artificial
  CRISPR gRNA sequence
cttgtgccacatacacagtc

SEQ ID NO: 498143 - DNA, 20 bp, Artificial
  CRISPR gRNA sequence
gtgccacatacacagtcatc

SEQ ID NO: 498144 - DNA, 20 bp, Artificial
  CRISPR gRNA sequence
tgccacatacacagtcatct

SEQ ID NO: 498145 - DNA, 20 bp, Artificial
  CRISPR gRNA sequence
gaacttgactccgagcagct

SEQ ID NO: 498146 - DNA, 20 bp, Artificial
  CRISPR gRNA sequence
gactccgagcagctcctgac

SEQ ID NO: 498147 - DNA, 20 bp, Artificial
  CRISPR gRNA sequence
actccgagcagctcctgaca

SEQ ID NO: 498148 - DNA, 20 bp, Artificial
  CRISPR gRNA sequence
cgagcagctcctgacagctc

SEQ ID NO: 498149 - DNA, 20 bp, Artificial
  CRISPR gRNA sequence
ctgacagctctgacagtcta

SEQ ID NO: 498150 - DNA, 20 bp, Artificial
  CRISPR gRNA sequence
acagctctgacagtctaaat

SEQ ID NO: 498151 - DNA, 20 bp, Artificial
  CRISPR gRNA sequence
tgacagtctaaatcagacag

SEQ ID NO: 498152 - DNA, 20 bp, Artificial
  CRISPR gRNA sequence
acagtctaaatcagacagga

SEQ ID NO: 498153 - DNA, 20 bp, Artificial
  CRISPR gRNA sequence
aatcagacaggacaggctgg

SEQ ID NO: 498154 - DNA, 20 bp, Artificial
  CRISPR gRNA sequence
gcagtgcactgggaggtctg

SEQ ID NO: 498155 - DNA, 20 bp, Artificial
  CRISPR gRNA sequence
ggaggtctgtgagaggggta

SEQ ID NO: 498156 - DNA, 20 bp, Artificial
  CRISPR gRNA sequence
tgagaggggtatctggccct

SEQ ID NO: 498157 - DNA, 20 bp, Artificial
  CRISPR gRNA sequence
gccctgccaccagcaatcca

SEQ ID NO: 498158 - DNA, 20 bp, Artificial
  CRISPR gRNA sequence
ccaccagcaatccaggaagt

SEQ ID NO: 498159 - DNA, 20 bp, Artificial
  CRISPR gRNA sequence
gggtgaggagattccttccc

SEQ ID NO: 498160 - DNA, 20 bp, Artificial
  CRISPR gRNA sequence
ggtgaggagattccttccca

SEQ ID NO: 498161 - DNA, 20 bp, Artificial
  CRISPR gRNA sequence
cttcccactggcttcaattt

SEQ ID NO: 498162 - DNA, 20 bp, Artificial
  CRISPR gRNA sequence
cccactggcttcaatttacc

SEQ ID NO: 498163 - DNA, 20 bp, Artificial
  CRISPR gRNA sequence
ccactggcttcaatttaccc

SEQ ID NO: 498164 - DNA, 20 bp, Artificial
  CRISPR gRNA sequence
gcttcaatttacccttccgt

SEQ ID NO: 498165 - DNA, 20 bp, Artificial
  CRISPR gRNA sequence
caatttacccttccgtgtag

SEQ ID NO: 498166 - DNA, 20 bp, Artificial
  CRISPR gRNA sequence
aatttacccttccgtgtagt

SEQ ID NO: 498167 - DNA, 20 bp, Artificial
  CRISPR gRNA sequence
acccttccgtgtagtggaga

SEQ ID NO: 498168 - DNA, 20 bp, Artificial
  CRISPR gRNA sequence
cccttccgtgtagtggagag

SEQ ID NO: 498169 - DNA, 20 bp, Artificial
  CRISPR gRNA sequence
ccgtgtagtggagagagaag

SEQ ID NO: 498170 - DNA, 20 bp, Artificial
  CRISPR gRNA sequence
cgtgtagtggagagagaagc

SEQ ID NO: 498171 - DNA, 20 bp, Artificial
  CRISPR gRNA sequence
cttccagccgcctgtaaaga

SEQ ID NO: 498172 - DNA, 20 bp, Artificial
  CRISPR gRNA sequence
ccagccgcctgtaaagatga

SEQ ID NO: 498173 - DNA, 20 bp, Artificial
  CRISPR gRNA sequence
cagccgcctgtaaagatgat

SEQ ID NO: 498174 - DNA, 20 bp, Artificial
  CRISPR gRNA sequence
taaagatgatgaaaattgca

SEQ ID NO: 498175 - DNA, 20 bp, Artificial
  CRISPR gRNA sequence
catcctccaattgtggcatg

SEQ ID NO: 498176 - DNA, 20 bp, Artificial
  CRISPR gRNA sequence
caattgtggcatgagagaag

SEQ ID NO: 498177 - DNA, 20 bp, Artificial
  CRISPR gRNA sequence
tggcatgagagaagagaagc

SEQ ID NO: 498178 - DNA, 20 bp, Artificial
  CRISPR gRNA sequence
tcgagctcagagacagatgg

SEQ ID NO: 498179 - DNA, 20 bp, Artificial
  CRISPR gRNA sequence
gagctcagagacagatggat

SEQ ID NO: 498180 - DNA, 20 bp, Artificial
  CRISPR gRNA sequence
agagacagatggatggaccc

SEQ ID NO: 498181 - DNA, 20 bp, Artificial
  CRISPR gRNA sequence
aggcaggaaagctgagccca

SEQ ID NO: 498182 - DNA, 20 bp, Artificial
  CRISPR gRNA sequence
agcccagggaggggagggcg

SEQ ID NO: 498183 - DNA, 20 bp, Artificial
  CRISPR gRNA sequence
gaaggcatggtccctcatct

SEQ ID NO: 498184 - DNA, 20 bp, Artificial
  CRISPR gRNA sequence
atctccccggcttcttcagc

SEQ ID NO: 498185 - DNA, 20 bp, Artificial
  CRISPR gRNA sequence
cccggcttcttcagccatcc

SEQ ID NO: 498186 - DNA, 20 bp, Artificial
  CRISPR gRNA sequence
cttcagccatccagatgcca

SEQ ID NO: 498187 - DNA, 20 bp, Artificial
  CRISPR gRNA sequence
ttcagccatccagatgccac

SEQ ID NO: 498188 - DNA, 20 bp, Artificial
  CRISPR gRNA sequence
cagccatccagatgccacag

SEQ ID NO: 498189 - DNA, 20 bp, Artificial
  CRISPR gRNA sequence
agccatccagatgccacagg

SEQ ID NO: 498190 - DNA, 20 bp, Artificial
  CRISPR gRNA sequence
gaaattattagggacatgca

SEQ ID NO: 498191 - DNA, 20 bp, Artificial
  CRISPR gRNA sequence
ttagggacatgcagggttgg

SEQ ID NO: 498192 - DNA, 20 bp, Artificial
  CRISPR gRNA sequence
gggacatgcagggttggggc

SEQ ID NO: 498193 - DNA, 20 bp, Artificial
  CRISPR gRNA sequence
gggcagaagaaggagacaat

SEQ ID NO: 498194 - DNA, 20 bp, Artificial
  CRISPR gRNA sequence
cacagcaaacctaaagctgt

SEQ ID NO: 498195 - DNA, 20 bp, Artificial
  CRISPR gRNA sequence
aagctgtcagccaggcatgg

SEQ ID NO: 498196 - DNA, 20 bp, Artificial
  CRISPR gRNA sequence
tcagccaggcatggagccat

SEQ ID NO: 498197 - DNA, 20 bp, Artificial
  CRISPR gRNA sequence
acatttactcctggggatcc

SEQ ID NO: 498198 - DNA, 20 bp, Artificial
  CRISPR gRNA sequence
actcctggggatcccagctg

SEQ ID NO: 498199 - DNA, 20 bp, Artificial
  CRISPR gRNA sequence
ctcctggggatcccagctga

SEQ ID NO: 498200 - DNA, 20 bp, Artificial
  CRISPR gRNA sequence
ctggggatcccagctgaggg

SEQ ID NO: 498201 - DNA, 20 bp, Artificial
  CRISPR gRNA sequence
gggatcccagctgagggctg

SEQ ID NO: 498202 - DNA, 20 bp, Artificial
  CRISPR gRNA sequence
agggctgctcccctctttct

SEQ ID NO: 498203 - DNA, 20 bp, Artificial
  CRISPR gRNA sequence
ctcccctctttctccagttc

SEQ ID NO: 498204 - DNA, 20 bp, Artificial
  CRISPR gRNA sequence
ccctctttctccagttctgg

SEQ ID NO: 498205 - DNA, 20 bp, Artificial
  CRISPR gRNA sequence
tttctccagttctggggtcc

SEQ ID NO: 498206 - DNA, 20 bp, Artificial
  CRISPR gRNA sequence
tctccagttctggggtccag

SEQ ID NO: 498207 - DNA, 20 bp, Artificial
  CRISPR gRNA sequence
ctccagttctggggtccagg

SEQ ID NO: 498208 - DNA, 20 bp, Artificial
  CRISPR gRNA sequence
tccagttctggggtccagga

SEQ ID NO: 498209 - DNA, 20 bp, Artificial
  CRISPR gRNA sequence
cagttctggggtccaggatg

SEQ ID NO: 498210 - DNA, 20 bp, Artificial
  CRISPR gRNA sequence
tggggtccaggatgctctga

SEQ ID NO: 498211 - DNA, 20 bp, Artificial
  CRISPR gRNA sequence
gggtccaggatgctctgaaa

SEQ ID NO: 498212 - DNA, 20 bp, Artificial
  CRISPR gRNA sequence
tgaaacctggatcccgcatt

SEQ ID NO: 498213 - DNA, 20 bp, Artificial
  CRISPR gRNA sequence
aaacctggatcccgcattta

SEQ ID NO: 498214 - DNA, 20 bp, Artificial
  CRISPR gRNA sequence
gatcccgcatttaatttaat

SEQ ID NO: 498215 - DNA, 20 bp, Artificial
  CRISPR gRNA sequence
aatttaattgaattaattta

SEQ ID NO: 498216 - DNA, 20 bp, Artificial
  CRISPR gRNA sequence
atttaattgaattaatttat

SEQ ID NO: 498217 - DNA, 20 bp, Artificial
  CRISPR gRNA sequence
aattgaattaatttatttat

SEQ ID NO: 498218 - DNA, 20 bp, Artificial
  CRISPR gRNA sequence
attgaattaatttatttatt

SEQ ID NO: 498219 - DNA, 20 bp, Artificial
  CRISPR gRNA sequence
aattaatttatttatttcat

SEQ ID NO: 498220 - DNA, 20 bp, Artificial
  CRISPR gRNA sequence
atttatttatttcattttta

SEQ ID NO: 498221 - DNA, 20 bp, Artificial
  CRISPR gRNA sequence
atttatttcatttttaattt

SEQ ID NO: 498222 - DNA, 20 bp, Artificial
  CRISPR gRNA sequence
tttatttcatttttaatttt

SEQ ID NO: 498223 - DNA, 20 bp, Artificial
  CRISPR gRNA sequence
atttcatttttaatttttat

SEQ ID NO: 498224 - DNA, 20 bp, Artificial
  CRISPR gRNA sequence
tttcatttttaatttttatt

SEQ ID NO: 498225 - DNA, 20 bp, Artificial
  CRISPR gRNA sequence
catttttaatttttatttat

SEQ ID NO: 498226 - DNA, 20 bp, Artificial
  CRISPR gRNA sequence
atttttaatttttatttatt

SEQ ID NO: 498227 - DNA, 20 bp, Artificial
  CRISPR gRNA sequence
ttaatttttatttatttatt

SEQ ID NO: 498228 - DNA, 20 bp, Artificial
  CRISPR gRNA sequence
taatttttatttatttattt

SEQ ID NO: 498229 - DNA, 20 bp, Artificial
  CRISPR gRNA sequence
aatttttatttatttattta

SEQ ID NO: 498230 - DNA, 20 bp, Artificial
  CRISPR gRNA sequence
atttttatttatttatttat

SEQ ID NO: 498231 - DNA, 20 bp, Artificial
  CRISPR gRNA sequence
ttatttatttatttattttt

SEQ ID NO: 498232 - DNA, 20 bp, Artificial
  CRISPR gRNA sequence
tatttatttatttatttttt

SEQ ID NO: 498233 - DNA, 20 bp, Artificial
  CRISPR gRNA sequence
atttatttatttattttttg

SEQ ID NO: 498234 - DNA, 20 bp, Artificial
  CRISPR gRNA sequence
tttatttatttattttttga

SEQ ID NO: 498235 - DNA, 20 bp, Artificial
  CRISPR gRNA sequence
atttatttattttttgagac

SEQ ID NO: 498236 - DNA, 20 bp, Artificial
  CRISPR gRNA sequence
tttatttattttttgagaca

SEQ ID NO: 498237 - DNA, 20 bp, Artificial
  CRISPR gRNA sequence
atttattttttgagacagag

SEQ ID NO: 498238 - DNA, 20 bp, Artificial
  CRISPR gRNA sequence
tttattttttgagacagagt

SEQ ID NO: 498239 - DNA, 20 bp, Artificial
  CRISPR gRNA sequence
attttttgagacagagtctc

SEQ ID NO: 498240 - DNA, 20 bp, Artificial
  CRISPR gRNA sequence
ttttttgagacagagtctcc

SEQ ID NO: 498241 - DNA, 20 bp, Artificial
  CRISPR gRNA sequence
tttgagacagagtctccttc

SEQ ID NO: 498242 - DNA, 20 bp, Artificial
  CRISPR gRNA sequence
ttgagacagagtctccttct

SEQ ID NO: 498243 - DNA, 20 bp, Artificial
  CRISPR gRNA sequence
tgagacagagtctccttctg

SEQ ID NO: 498244 - DNA, 20 bp, Artificial
  CRISPR gRNA sequence
gagacagagtctccttctgt

SEQ ID NO: 498245 - DNA, 20 bp, Artificial
  CRISPR gRNA sequence
agacagagtctccttctgtc

SEQ ID NO: 498246 - DNA, 20 bp, Artificial
  CRISPR gRNA sequence
cttctgtcacccaggctgga

SEQ ID NO: 498247 - DNA, 20 bp, Artificial
  CRISPR gRNA sequence
ctgtcacccaggctggagtg

SEQ ID NO: 498248 - DNA, 20 bp, Artificial
  CRISPR gRNA sequence
tgtcacccaggctggagtgc

SEQ ID NO: 498249 - DNA, 20 bp, Artificial
  CRISPR gRNA sequence
tcacccaggctggagtgcag

SEQ ID NO: 498250 - DNA, 20 bp, Artificial
  CRISPR gRNA sequence
gagtgcagtggcgtgatctt

SEQ ID NO: 498251 - DNA, 20 bp, Artificial
  CRISPR gRNA sequence
ggctcactacaaactctgcc

SEQ ID NO: 498252 - DNA, 20 bp, Artificial
  CRISPR gRNA sequence
gctcactacaaactctgcct

SEQ ID NO: 498253 - DNA, 20 bp, Artificial
  CRISPR gRNA sequence
actacaaactctgcctcccg

SEQ ID NO: 498254 - DNA, 20 bp, Artificial
  CRISPR gRNA sequence
caaactctgcctcccgggtt

SEQ ID NO: 498255 - DNA, 20 bp, Artificial
  CRISPR gRNA sequence
tgcctcccgggttcaagtga

SEQ ID NO: 498256 - DNA, 20 bp, Artificial
  CRISPR gRNA sequence
cctcccgggttcaagtgatt

SEQ ID NO: 498257 - DNA, 20 bp, Artificial
  CRISPR gRNA sequence
ccgggttcaagtgattctca

SEQ ID NO: 498258 - DNA, 20 bp, Artificial
  CRISPR gRNA sequence
aagtgattctcatgcctcag

SEQ ID NO: 498259 - DNA, 20 bp, Artificial
  CRISPR gRNA sequence
tcatgcctcagcctcccgag

SEQ ID NO: 498260 - DNA, 20 bp, Artificial
  CRISPR gRNA sequence
atgcctcagcctcccgagta

SEQ ID NO: 498261 - DNA, 20 bp, Artificial
  CRISPR gRNA sequence
agcctcccgagtaggtgaaa

SEQ ID NO: 498262 - DNA, 20 bp, Artificial
  CRISPR gRNA sequence
ccgagtaggtgaaattacag

SEQ ID NO: 498263 - DNA, 20 bp, Artificial
  CRISPR gRNA sequence
cagacgtgcgccaccatgct

SEQ ID NO: 498264 - DNA, 20 bp, Artificial
  CRISPR gRNA sequence
ggctaatttttgtattttta

SEQ ID NO: 498265 - DNA, 20 bp, Artificial
  CRISPR gRNA sequence
gctaatttttgtatttttag

SEQ ID NO: 498266 - DNA, 20 bp, Artificial
  CRISPR gRNA sequence
atttttgtatttttagtaga

SEQ ID NO: 498267 - DNA, 20 bp, Artificial
  CRISPR gRNA sequence
ttgtatttttagtagagacc

SEQ ID NO: 498268 - DNA, 20 bp, Artificial
  CRISPR gRNA sequence
tgtatttttagtagagacca

SEQ ID NO: 498269 - DNA, 20 bp, Artificial
  CRISPR gRNA sequence
gtatttttagtagagaccag

SEQ ID NO: 498270 - DNA, 20 bp, Artificial
  CRISPR gRNA sequence
tatttttagtagagaccagg

SEQ ID NO: 498271 - DNA, 20 bp, Artificial
  CRISPR gRNA sequence
ttagtagagaccaggtttca

SEQ ID NO: 498272 - DNA, 20 bp, Artificial
  CRISPR gRNA sequence
tagtagagaccaggtttcac

SEQ ID NO: 498273 - DNA, 20 bp, Artificial
  CRISPR gRNA sequence
agtagagaccaggtttcacc

SEQ ID NO: 498274 - DNA, 20 bp, Artificial
  CRISPR gRNA sequence
gtagagaccaggtttcacca

SEQ ID NO: 498275 - DNA, 20 bp, Artificial
  CRISPR gRNA sequence
caccatgttggccaggctgg

SEQ ID NO: 498276 - DNA, 20 bp, Artificial
  CRISPR gRNA sequence
accatgttggccaggctggt

SEQ ID NO: 498277 - DNA, 20 bp, Artificial
  CRISPR gRNA sequence
gccaggctggtcttgaactc

SEQ ID NO: 498278 - DNA, 20 bp, Artificial
  CRISPR gRNA sequence
gtcttgaactcctgacctca

SEQ ID NO: 498279 - DNA, 20 bp, Artificial
  CRISPR gRNA sequence
gaactcctgacctcaggtga

SEQ ID NO: 498280 - DNA, 20 bp, Artificial
  CRISPR gRNA sequence
aactcctgacctcaggtgat

SEQ ID NO: 498281 - DNA, 20 bp, Artificial
  CRISPR gRNA sequence
ctgacctcaggtgatctgcc

SEQ ID NO: 498282 - DNA, 20 bp, Artificial
  CRISPR gRNA sequence
acctcaggtgatctgcccac

SEQ ID NO: 498283 - DNA, 20 bp, Artificial
  CRISPR gRNA sequence
aggtgatctgcccaccttgg

SEQ ID NO: 498284 - DNA, 20 bp, Artificial
  CRISPR gRNA sequence
cccaccttggtctcccccat

SEQ ID NO: 498285 - DNA, 20 bp, Artificial
  CRISPR gRNA sequence
ggtctcccccatccaaagtg

SEQ ID NO: 498286 - DNA, 20 bp, Artificial
  CRISPR gRNA sequence
gtctcccccatccaaagtgc

SEQ ID NO: 498287 - DNA, 20 bp, Artificial
  CRISPR gRNA sequence
ccccatccaaagtgctggga

SEQ ID NO: 498288 - DNA, 20 bp, Artificial
  CRISPR gRNA sequence
ggattacaggtgtgagccac

SEQ ID NO: 498289 - DNA, 20 bp, Artificial
  CRISPR gRNA sequence
caggtgtgagccaccatgcc

SEQ ID NO: 498290 - DNA, 20 bp, Artificial
  CRISPR gRNA sequence
tgcattttagatcagtgact

SEQ ID NO: 498291 - DNA, 20 bp, Artificial
  CRISPR gRNA sequence
cattttagatcagtgactct

SEQ ID NO: 498292 - DNA, 20 bp, Artificial
  CRISPR gRNA sequence
tagatcagtgactctgcagg

SEQ ID NO: 498293 - DNA, 20 bp, Artificial
  CRISPR gRNA sequence
agatcagtgactctgcaggg

SEQ ID NO: 498294 - DNA, 20 bp, Artificial
  CRISPR gRNA sequence
gatcagtgactctgcagggg

SEQ ID NO: 498295 - DNA, 20 bp, Artificial
  CRISPR gRNA sequence
tgcaggggcttcacggaggt

SEQ ID NO: 498296 - DNA, 20 bp, Artificial
  CRISPR gRNA sequence
caggggcttcacggaggtgg

SEQ ID NO: 498297 - DNA, 20 bp, Artificial
  CRISPR gRNA sequence
cacggaggtggagagcgtgg

SEQ ID NO: 498298 - DNA, 20 bp, Artificial
  CRISPR gRNA sequence
acggaggtggagagcgtgga

SEQ ID NO: 498299 - DNA, 20 bp, Artificial
  CRISPR gRNA sequence
gaggagggtacactctgggc

SEQ ID NO: 498300 - DNA, 20 bp, Artificial
  CRISPR gRNA sequence
tgggcacaaagaggggaaac

SEQ ID NO: 498301 - DNA, 20 bp, Artificial
  CRISPR gRNA sequence
ggcacaaagaggggaaactg

SEQ ID NO: 498302 - DNA, 20 bp, Artificial
  CRISPR gRNA sequence
aggcatagtgttgtgtgggt

SEQ ID NO: 498303 - DNA, 20 bp, Artificial
  CRISPR gRNA sequence
tgtgggttcagggccaggta

SEQ ID NO: 498304 - DNA, 20 bp, Artificial
  CRISPR gRNA sequence
agggccaggtagaagcccca

SEQ ID NO: 498305 - DNA, 20 bp, Artificial
  CRISPR gRNA sequence
aattcagttaccgagtccct

SEQ ID NO: 498306 - DNA, 20 bp, Artificial
  CRISPR gRNA sequence
agttaccgagtccctgagca

SEQ ID NO: 498307 - DNA, 20 bp, Artificial
  CRISPR gRNA sequence
ccgagtccctgagcattctt

SEQ ID NO: 498308 - DNA, 20 bp, Artificial
  CRISPR gRNA sequence
agcattcttgtgtccttcag

SEQ ID NO: 498309 - DNA, 20 bp, Artificial
  CRISPR gRNA sequence
ttgtgtccttcaggaagaca

SEQ ID NO: 498310 - DNA, 20 bp, Artificial
  CRISPR gRNA sequence
gtgtccttcaggaagacaca

SEQ ID NO: 498311 - DNA, 20 bp, Artificial
  CRISPR gRNA sequence
tgtccttcaggaagacacag

SEQ ID NO: 498312 - DNA, 20 bp, Artificial
  CRISPR gRNA sequence
caggaagacacagtcaaggc

SEQ ID NO: 498313 - DNA, 20 bp, Artificial
  CRISPR gRNA sequence
aggaagacacagtcaaggct

SEQ ID NO: 498314 - DNA, 20 bp, Artificial
  CRISPR gRNA sequence
aggtggactcaacatttgta

SEQ ID NO: 498315 - DNA, 20 bp, Artificial
  CRISPR gRNA sequence
aacatttgtaaggatgcagg

SEQ ID NO: 498316 - DNA, 20 bp, Artificial
  CRISPR gRNA sequence
gtaaggatgcaggcagccta

SEQ ID NO: 498317 - DNA, 20 bp, Artificial
  CRISPR gRNA sequence
taaggatgcaggcagcctag

SEQ ID NO: 498318 - DNA, 20 bp, Artificial
  CRISPR gRNA sequence
gggcagagcatgatgaggaa

SEQ ID NO: 498319 - DNA, 20 bp, Artificial
  CRISPR gRNA sequence
cagctcttgtgggtgggttg

SEQ ID NO: 498320 - DNA, 20 bp, Artificial
  CRISPR gRNA sequence
ttgtgggtgggttggggggc

SEQ ID NO: 498321 - DNA, 20 bp, Artificial
  CRISPR gRNA sequence
gtgggtgggttggggggcct

SEQ ID NO: 498322 - DNA, 20 bp, Artificial
  CRISPR gRNA sequence
tgggtgggttggggggccta

SEQ ID NO: 498323 - DNA, 20 bp, Artificial
  CRISPR gRNA sequence
gggggcctagtggcccagga

SEQ ID NO: 498324 - DNA, 20 bp, Artificial
  CRISPR gRNA sequence
gtggcccaggattctaggca

SEQ ID NO: 498325 - DNA, 20 bp, Artificial
  CRISPR gRNA sequence
taggcaggagagctaggttg

SEQ ID NO: 498326 - DNA, 20 bp, Artificial
  CRISPR gRNA sequence
ggcaggagagctaggttgga

SEQ ID NO: 498327 - DNA, 20 bp, Artificial
  CRISPR gRNA sequence
ggttggaacctggtctaagg

SEQ ID NO: 498328 - DNA, 20 bp, Artificial
  CRISPR gRNA sequence
gaacctggtctaaggatcct

SEQ ID NO: 498329 - DNA, 20 bp, Artificial
  CRISPR gRNA sequence
gtctaaggatccttgaatgc

SEQ ID NO: 498330 - DNA, 20 bp, Artificial
  CRISPR gRNA sequence
aggatccttgaatgcagctc

SEQ ID NO: 498331 - DNA, 20 bp, Artificial
  CRISPR gRNA sequence
gaatgcagctcagacagccg

SEQ ID NO: 498332 - DNA, 20 bp, Artificial
  CRISPR gRNA sequence
aatgcagctcagacagccga

SEQ ID NO: 498333 - DNA, 20 bp, Artificial
  CRISPR gRNA sequence
agacagccgaaggaggactg

SEQ ID NO: 498334 - DNA, 20 bp, Artificial
  CRISPR gRNA sequence
atgggattggtgcctggctg

SEQ ID NO: 498335 - DNA, 20 bp, Artificial
  CRISPR gRNA sequence
gtgcctggctgtggggatga

SEQ ID NO: 498336 - DNA, 20 bp, Artificial
  CRISPR gRNA sequence
gctgtggggatgagagtaac

SEQ ID NO: 498337 - DNA, 20 bp, Artificial
  CRISPR gRNA sequence
tggggatgagagtaacagag

SEQ ID NO: 498338 - DNA, 20 bp, Artificial
  CRISPR gRNA sequence
aggttatgaccctgaggtca

SEQ ID NO: 498339 - DNA, 20 bp, Artificial
  CRISPR gRNA sequence
tgaccctgaggtcatgagcc

SEQ ID NO: 498340 - DNA, 20 bp, Artificial
  CRISPR gRNA sequence
aggtcatgagcctgtgtgac

SEQ ID NO: 498341 - DNA, 20 bp, Artificial
  CRISPR gRNA sequence
tgtgacagagggcaatgctc

SEQ ID NO: 498342 - DNA, 20 bp, Artificial
  CRISPR gRNA sequence
cctccacccccattcccagg

SEQ ID NO: 498343 - DNA, 20 bp, Artificial
  CRISPR gRNA sequence
cacccccattcccagggctt

SEQ ID NO: 498344 - DNA, 20 bp, Artificial
  CRISPR gRNA sequence
ccagggcttcagcaccatag

SEQ ID NO: 498345 - DNA, 20 bp, Artificial
  CRISPR gRNA sequence
cagcaccatagctgggcttg

SEQ ID NO: 498346 - DNA, 20 bp, Artificial
  CRISPR gRNA sequence
agcaccatagctgggcttgg

SEQ ID NO: 498347 - DNA, 20 bp, Artificial
  CRISPR gRNA sequence
ggcttggctatgccggccct

SEQ ID NO: 498348 - DNA, 20 bp, Artificial
  CRISPR gRNA sequence
ggctatgccggcccttgcac

SEQ ID NO: 498349 - DNA, 20 bp, Artificial
  CRISPR gRNA sequence
gctatgccggcccttgcacg

SEQ ID NO: 498350 - DNA, 20 bp, Artificial
  CRISPR gRNA sequence
tgccggcccttgcacggtga

SEQ ID NO: 498351 - DNA, 20 bp, Artificial
  CRISPR gRNA sequence
gcacggtgaagctggtgagt

SEQ ID NO: 498352 - DNA, 20 bp, Artificial
  CRISPR gRNA sequence
cacggtgaagctggtgagtg

SEQ ID NO: 498353 - DNA, 20 bp, Artificial
  CRISPR gRNA sequence
gtgagtgacttgttaggcac

SEQ ID NO: 498354 - DNA, 20 bp, Artificial
  CRISPR gRNA sequence
gttaggcacagggagggatg

SEQ ID NO: 498355 - DNA, 20 bp, Artificial
  CRISPR gRNA sequence
ttaggcacagggagggatgg

SEQ ID NO: 498356 - DNA, 20 bp, Artificial
  CRISPR gRNA sequence
ggcacagggagggatggact

SEQ ID NO: 498357 - DNA, 20 bp, Artificial
  CRISPR gRNA sequence
gggtcttcctgagctgcttc

SEQ ID NO: 498358 - DNA, 20 bp, Artificial
  CRISPR gRNA sequence
ggtcttcctgagctgcttcc

SEQ ID NO: 498359 - DNA, 20 bp, Artificial
  CRISPR gRNA sequence
cctgagctgcttcctcctcc

SEQ ID NO: 498360 - DNA, 20 bp, Artificial
  CRISPR gRNA sequence
ctgagctgcttcctcctcca

SEQ ID NO: 498361 - DNA, 20 bp, Artificial
  CRISPR gRNA sequence
agctgcttcctcctccatcc

SEQ ID NO: 498362 - DNA, 20 bp, Artificial
  CRISPR gRNA sequence
cttcctcctccatcctgtgt

SEQ ID NO: 498363 - DNA, 20 bp, Artificial
  CRISPR gRNA sequence
cctcctccatcctgtgtcta

SEQ ID NO: 498364 - DNA, 20 bp, Artificial
  CRISPR gRNA sequence
ctcctccatcctgtgtctat

SEQ ID NO: 498365 - DNA, 20 bp, Artificial
  CRISPR gRNA sequence
ctccatcctgtgtctatagg

SEQ ID NO: 498366 - DNA, 20 bp, Artificial
  CRISPR gRNA sequence
catcctgtgtctatagggca

SEQ ID NO: 498367 - DNA, 20 bp, Artificial
  CRISPR gRNA sequence
tgtctatagggcaggcctgg

SEQ ID NO: 498368 - DNA, 20 bp, Artificial
  CRISPR gRNA sequence
tagggcaggcctggcataag

SEQ ID NO: 498369 - DNA, 20 bp, Artificial
  CRISPR gRNA sequence
gcataagttgactgaagctg

SEQ ID NO: 498370 - DNA, 20 bp, Artificial
  CRISPR gRNA sequence
actgaagctgctctatttct

SEQ ID NO: 498371 - DNA, 20 bp, Artificial
  CRISPR gRNA sequence
aagctgctctatttctttaa

SEQ ID NO: 498372 - DNA, 20 bp, Artificial
  CRISPR gRNA sequence
ctctatttctttaattttta

SEQ ID NO: 498373 - DNA, 20 bp, Artificial
  CRISPR gRNA sequence
tatttctttaatttttaagc

SEQ ID NO: 498374 - DNA, 20 bp, Artificial
  CRISPR gRNA sequence
tttctttaatttttaagctt

SEQ ID NO: 498375 - DNA, 20 bp, Artificial
  CRISPR gRNA sequence
ctttaatttttaagcttttt

SEQ ID NO: 498376 - DNA, 20 bp, Artificial
  CRISPR gRNA sequence
tttaatttttaagcttttta

SEQ ID NO: 498377 - DNA, 20 bp, Artificial
  CRISPR gRNA sequence
taatttttaagctttttagt

SEQ ID NO: 498378 - DNA, 20 bp, Artificial
  CRISPR gRNA sequence
aatttttaagctttttagtt

SEQ ID NO: 498379 - DNA, 20 bp, Artificial
  CRISPR gRNA sequence
atttttaagctttttagttt

SEQ ID NO: 498380 - DNA, 20 bp, Artificial
  CRISPR gRNA sequence
ttaagctttttagtttgaaa

SEQ ID NO: 498381 - DNA, 20 bp, Artificial
  CRISPR gRNA sequence
taagctttttagtttgaaat

SEQ ID NO: 498382 - DNA, 20 bp, Artificial
  CRISPR gRNA sequence
aagctttttagtttgaaata

SEQ ID NO: 498383 - DNA, 20 bp, Artificial
  CRISPR gRNA sequence
agctttttagtttgaaataa

SEQ ID NO: 498384 - DNA, 20 bp, Artificial
  CRISPR gRNA sequence
tttagtttgaaataattgtg

SEQ ID NO: 498385 - DNA, 20 bp, Artificial
  CRISPR gRNA sequence
ttagtttgaaataattgtga

SEQ ID NO: 498386 - DNA, 20 bp, Artificial
  CRISPR gRNA sequence
tagtttgaaataattgtgaa

SEQ ID NO: 498387 - DNA, 20 bp, Artificial
  CRISPR gRNA sequence
agtttgaaataattgtgaag

SEQ ID NO: 498388 - DNA, 20 bp, Artificial
  CRISPR gRNA sequence
gtttgaaataattgtgaagt

SEQ ID NO: 498389 - DNA, 20 bp, Artificial
  CRISPR gRNA sequence
gaaataattgtgaagttcca

SEQ ID NO: 498390 - DNA, 20 bp, Artificial
  CRISPR gRNA sequence
aaataattgtgaagttccag

SEQ ID NO: 498391 - DNA, 20 bp, Artificial
  CRISPR gRNA sequence
tgaagttccagggaagctgc

SEQ ID NO: 498392 - DNA, 20 bp, Artificial
  CRISPR gRNA sequence
cagggaagctgcaagaatag

SEQ ID NO: 498393 - DNA, 20 bp, Artificial
  CRISPR gRNA sequence
caagaatagttcaaacgatt

SEQ ID NO: 498394 - DNA, 20 bp, Artificial
  CRISPR gRNA sequence
aaacgattcttgaatttctt

SEQ ID NO: 498395 - DNA, 20 bp, Artificial
  CRISPR gRNA sequence
ttgaatttctttcatctaga

SEQ ID NO: 498396 - DNA, 20 bp, Artificial
  CRISPR gRNA sequence
gaatttctttcatctagatt

SEQ ID NO: 498397 - DNA, 20 bp, Artificial
  CRISPR gRNA sequence
aatttctttcatctagattc

SEQ ID NO: 498398 - DNA, 20 bp, Artificial
  CRISPR gRNA sequence
ctttcatctagattcaccaa

SEQ ID NO: 498399 - DNA, 20 bp, Artificial
  CRISPR gRNA sequence
tttcatctagattcaccaat

SEQ ID NO: 498400 - DNA, 20 bp, Artificial
  CRISPR gRNA sequence
tcatctagattcaccaatta

SEQ ID NO: 498401 - DNA, 20 bp, Artificial
  CRISPR gRNA sequence
catctagattcaccaattaa

SEQ ID NO: 498402 - DNA, 20 bp, Artificial
  CRISPR gRNA sequence
atctagattcaccaattaac

SEQ ID NO: 498403 - DNA, 20 bp, Artificial
  CRISPR gRNA sequence
gattcaccaattaacatttt

SEQ ID NO: 498404 - DNA, 20 bp, Artificial
  CRISPR gRNA sequence
accaattaacattttatcac

SEQ ID NO: 498405 - DNA, 20 bp, Artificial
  CRISPR gRNA sequence
acattttatcacatttactt

SEQ ID NO: 498406 - DNA, 20 bp, Artificial
  CRISPR gRNA sequence
tatcacatttactttatttc

SEQ ID NO: 498407 - DNA, 20 bp, Artificial
  CRISPR gRNA sequence
atcacatttactttatttct

SEQ ID NO: 498408 - DNA, 20 bp, Artificial
  CRISPR gRNA sequence
tcacatttactttatttctc

SEQ ID NO: 498409 - DNA, 20 bp, Artificial
  CRISPR gRNA sequence
actttatttctctttctcta

SEQ ID NO: 498410 - DNA, 20 bp, Artificial
  CRISPR gRNA sequence
ctttatttctctttctctag

SEQ ID NO: 498411 - DNA, 20 bp, Artificial
  CRISPR gRNA sequence
tatttctctttctctagctg

SEQ ID NO: 498412 - DNA, 20 bp, Artificial
  CRISPR gRNA sequence
atttctctttctctagctgt

SEQ ID NO: 498413 - DNA, 20 bp, Artificial
  CRISPR gRNA sequence
tttctctttctctagctgta

SEQ ID NO: 498414 - DNA, 20 bp, Artificial
  CRISPR gRNA sequence
ctctttctctagctgtatgt

SEQ ID NO: 498415 - DNA, 20 bp, Artificial
  CRISPR gRNA sequence
tctttctctagctgtatgta

SEQ ID NO: 498416 - DNA, 20 bp, Artificial
  CRISPR gRNA sequence
tttctctagctgtatgtata

SEQ ID NO: 498417 - DNA, 20 bp, Artificial
  CRISPR gRNA sequence
tctctagctgtatgtatatg

SEQ ID NO: 498418 - DNA, 20 bp, Artificial
  CRISPR gRNA sequence
ctctagctgtatgtatatgt

SEQ ID NO: 498419 - DNA, 20 bp, Artificial
  CRISPR gRNA sequence
tctagctgtatgtatatgtg

SEQ ID NO: 498420 - DNA, 20 bp, Artificial
  CRISPR gRNA sequence
tagctgtatgtatatgtgtg

SEQ ID NO: 498421 - DNA, 20 bp, Artificial
  CRISPR gRNA sequence
gctgtatgtatatgtgtgta

SEQ ID NO: 498422 - DNA, 20 bp, Artificial
  CRISPR gRNA sequence
tatgtatatgtgtgtataaa

SEQ ID NO: 498423 - DNA, 20 bp, Artificial
  CRISPR gRNA sequence
ttgctgaaccacttgagaac

SEQ ID NO: 498424 - DNA, 20 bp, Artificial
  CRISPR gRNA sequence
tgctgaaccacttgagaaca

SEQ ID NO: 498425 - DNA, 20 bp, Artificial
  CRISPR gRNA sequence
gctgaaccacttgagaacaa

SEQ ID NO: 498426 - DNA, 20 bp, Artificial
  CRISPR gRNA sequence
ctgaaccacttgagaacaag

SEQ ID NO: 498427 - DNA, 20 bp, Artificial
  CRISPR gRNA sequence
aaccacttgagaacaagttg

SEQ ID NO: 498428 - DNA, 20 bp, Artificial
  CRISPR gRNA sequence
gagaacaagttgtgacatta

SEQ ID NO: 498429 - DNA, 20 bp, Artificial
  CRISPR gRNA sequence
agaacaagttgtgacattat

SEQ ID NO: 498430 - DNA, 20 bp, Artificial
  CRISPR gRNA sequence
tgacattatgtccccttact

SEQ ID NO: 498431 - DNA, 20 bp, Artificial
  CRISPR gRNA sequence
tgtccccttactcctaaata

SEQ ID NO: 498432 - DNA, 20 bp, Artificial
  CRISPR gRNA sequence
actcctaaatattttagcac

SEQ ID NO: 498433 - DNA, 20 bp, Artificial
  CRISPR gRNA sequence
ctcctaaatattttagcact

SEQ ID NO: 498434 - DNA, 20 bp, Artificial
  CRISPR gRNA sequence
ctaaatattttagcacttat

SEQ ID NO: 498435 - DNA, 20 bp, Artificial
  CRISPR gRNA sequence
aatattttagcacttatatc

SEQ ID NO: 498436 - DNA, 20 bp, Artificial
  CRISPR gRNA sequence
tagcacttatatcctatgaa

SEQ ID NO: 498437 - DNA, 20 bp, Artificial
  CRISPR gRNA sequence
agcacttatatcctatgaac

SEQ ID NO: 498438 - DNA, 20 bp, Artificial
  CRISPR gRNA sequence
gcacttatatcctatgaaca

SEQ ID NO: 498439 - DNA, 20 bp, Artificial
  CRISPR gRNA sequence
atatcctatgaacaaagaca

SEQ ID NO: 498440 - DNA, 20 bp, Artificial
  CRISPR gRNA sequence
tatcctatgaacaaagacat

SEQ ID NO: 498441 - DNA, 20 bp, Artificial
  CRISPR gRNA sequence
tgaacaaagacattctcatg

SEQ ID NO: 498442 - DNA, 20 bp, Artificial
  CRISPR gRNA sequence
tcatgttactacagcacaat

SEQ ID NO: 498443 - DNA, 20 bp, Artificial
  CRISPR gRNA sequence
atgttactacagcacaattg

SEQ ID NO: 498444 - DNA, 20 bp, Artificial
  CRISPR gRNA sequence
ctacagcacaattgtcaaat

SEQ ID NO: 498445 - DNA, 20 bp, Artificial
  CRISPR gRNA sequence
cagcacaattgtcaaattca

SEQ ID NO: 498446 - DNA, 20 bp, Artificial
  CRISPR gRNA sequence
tcaaattcagtaaatttaac

SEQ ID NO: 498447 - DNA, 20 bp, Artificial
  CRISPR gRNA sequence
agtaaatttaacattaatac

SEQ ID NO: 498448 - DNA, 20 bp, Artificial
  CRISPR gRNA sequence
aacattaataccatcaaata

SEQ ID NO: 498449 - DNA, 20 bp, Artificial
  CRISPR gRNA sequence
acattaataccatcaaatat

SEQ ID NO: 498450 - DNA, 20 bp, Artificial
  CRISPR gRNA sequence
ataccatcaaatatgctttc

SEQ ID NO: 498451 - DNA, 20 bp, Artificial
  CRISPR gRNA sequence
tccatattcacatattacca

SEQ ID NO: 498452 - DNA, 20 bp, Artificial
  CRISPR gRNA sequence
ccatattcacatattaccaa

SEQ ID NO: 498453 - DNA, 20 bp, Artificial
  CRISPR gRNA sequence
catattcacatattaccaat

SEQ ID NO: 498454 - DNA, 20 bp, Artificial
  CRISPR gRNA sequence
acatattaccaattgtccca

SEQ ID NO: 498455 - DNA, 20 bp, Artificial
  CRISPR gRNA sequence
ccaattgtcccaagaatatg

SEQ ID NO: 498456 - DNA, 20 bp, Artificial
  CRISPR gRNA sequence
tcccaagaatatgctttatt

SEQ ID NO: 498457 - DNA, 20 bp, Artificial
  CRISPR gRNA sequence
tattttttttttttgctgac

SEQ ID NO: 498458 - DNA, 20 bp, Artificial
  CRISPR gRNA sequence
attttttttttttgctgacc

SEQ ID NO: 498459 - DNA, 20 bp, Artificial
  CRISPR gRNA sequence
ttttttttttttgctgaccc

SEQ ID NO: 498460 - DNA, 20 bp, Artificial
  CRISPR gRNA sequence
tttttttttgctgacccaag

SEQ ID NO: 498461 - DNA, 20 bp, Artificial
  CRISPR gRNA sequence
ttttttttgctgacccaaga

SEQ ID NO: 498462 - DNA, 20 bp, Artificial
  CRISPR gRNA sequence
tttttttgctgacccaagat

SEQ ID NO: 498463 - DNA, 20 bp, Artificial
  CRISPR gRNA sequence
ttttttgctgacccaagatg

SEQ ID NO: 498464 - DNA, 20 bp, Artificial
  CRISPR gRNA sequence
tttttgctgacccaagatgc

SEQ ID NO: 498465 - DNA, 20 bp, Artificial
  CRISPR gRNA sequence
ttttgctgacccaagatgca

SEQ ID NO: 498466 - DNA, 20 bp, Artificial
  CRISPR gRNA sequence
tttgctgacccaagatgcaa

SEQ ID NO: 498467 - DNA, 20 bp, Artificial
  CRISPR gRNA sequence
ttgctgacccaagatgcaat

SEQ ID NO: 498468 - DNA, 20 bp, Artificial
  CRISPR gRNA sequence
tgctgacccaagatgcaatc

SEQ ID NO: 498469 - DNA, 20 bp, Artificial
  CRISPR gRNA sequence
gctgacccaagatgcaatca

SEQ ID NO: 498470 - DNA, 20 bp, Artificial
  CRISPR gRNA sequence
ctgacccaagatgcaatcaa

SEQ ID NO: 498471 - DNA, 20 bp, Artificial
  CRISPR gRNA sequence
acccaagatgcaatcaagat

SEQ ID NO: 498472 - DNA, 20 bp, Artificial
  CRISPR gRNA sequence
cattcagttgttatgtttct

SEQ ID NO: 498473 - DNA, 20 bp, Artificial
  CRISPR gRNA sequence
agttgttatgtttctcatgt

SEQ ID NO: 498474 - DNA, 20 bp, Artificial
  CRISPR gRNA sequence
ttatgtttctcatgttcagt

SEQ ID NO: 498475 - DNA, 20 bp, Artificial
  CRISPR gRNA sequence
tgtttctcatgttcagtcta

SEQ ID NO: 498476 - DNA, 20 bp, Artificial
  CRISPR gRNA sequence
ctcatgttcagtctatgacc

SEQ ID NO: 498477 - DNA, 20 bp, Artificial
  CRISPR gRNA sequence
tcatgttcagtctatgacca

SEQ ID NO: 498478 - DNA, 20 bp, Artificial
  CRISPR gRNA sequence
atgttcagtctatgaccata

SEQ ID NO: 498479 - DNA, 20 bp, Artificial
  CRISPR gRNA sequence
agtctatgaccatactttaa

SEQ ID NO: 498480 - DNA, 20 bp, Artificial
  CRISPR gRNA sequence
tgaccatactttaacctttc

SEQ ID NO: 498481 - DNA, 20 bp, Artificial
  CRISPR gRNA sequence
taacctttcttcatctttca

SEQ ID NO: 498482 - DNA, 20 bp, Artificial
  CRISPR gRNA sequence
aacctttcttcatctttcat

SEQ ID NO: 498483 - DNA, 20 bp, Artificial
  CRISPR gRNA sequence
acctttcttcatctttcatg

SEQ ID NO: 498484 - DNA, 20 bp, Artificial
  CRISPR gRNA sequence
tcttcatctttcatgatatt

SEQ ID NO: 498485 - DNA, 20 bp, Artificial
  CRISPR gRNA sequence
cttcatctttcatgatattg

SEQ ID NO: 498486 - DNA, 20 bp, Artificial
  CRISPR gRNA sequence
ttcatctttcatgatattgc

SEQ ID NO: 498487 - DNA, 20 bp, Artificial
  CRISPR gRNA sequence
catctttcatgatattgcat

SEQ ID NO: 498488 - DNA, 20 bp, Artificial
  CRISPR gRNA sequence
atctttcatgatattgcatt

SEQ ID NO: 498489 - DNA, 20 bp, Artificial
  CRISPR gRNA sequence
tcatgatattgcattcttga

SEQ ID NO: 498490 - DNA, 20 bp, Artificial
  CRISPR gRNA sequence
catgatattgcattcttgaa

SEQ ID NO: 498491 - DNA, 20 bp, Artificial
  CRISPR gRNA sequence
atgatattgcattcttgaag

SEQ ID NO: 498492 - DNA, 20 bp, Artificial
  CRISPR gRNA sequence
cattcttgaagaagacaagc

SEQ ID NO: 498493 - DNA, 20 bp, Artificial
  CRISPR gRNA sequence
ttgaagaagacaagccagtt

SEQ ID NO: 498494 - DNA, 20 bp, Artificial
  CRISPR gRNA sequence
gaagaagacaagccagttgt

SEQ ID NO: 498495 - DNA, 20 bp, Artificial
  CRISPR gRNA sequence
aagaagacaagccagttgtt

SEQ ID NO: 498496 - DNA, 20 bp, Artificial
  CRISPR gRNA sequence
ttttgtagagggttccttaa

SEQ ID NO: 498497 - DNA, 20 bp, Artificial
  CRISPR gRNA sequence
tgtagagggttccttaatct

SEQ ID NO: 498498 - DNA, 20 bp, Artificial
  CRISPR gRNA sequence
gtagagggttccttaatctg

SEQ ID NO: 498499 - DNA, 20 bp, Artificial
  CRISPR gRNA sequence
tagagggttccttaatctgg

SEQ ID NO: 498500 - DNA, 20 bp, Artificial
  CRISPR gRNA sequence
cttaatctgggtttgtctga

SEQ ID NO: 498501 - DNA, 20 bp, Artificial
  CRISPR gRNA sequence
aatctgggtttgtctgatgt

SEQ ID NO: 498502 - DNA, 20 bp, Artificial
  CRISPR gRNA sequence
atctgggtttgtctgatgtt

SEQ ID NO: 498503 - DNA, 20 bp, Artificial
  CRISPR gRNA sequence
ggtttgtctgatgttccctc

SEQ ID NO: 498504 - DNA, 20 bp, Artificial
  CRISPR gRNA sequence
gtctgatgttccctcatatg

SEQ ID NO: 498505 - DNA, 20 bp, Artificial
  CRISPR gRNA sequence
tctgatgttccctcatatga

SEQ ID NO: 498506 - DNA, 20 bp, Artificial
  CRISPR gRNA sequence
atgttccctcatatgattca

SEQ ID NO: 498507 - DNA, 20 bp, Artificial
  CRISPR gRNA sequence
cctcatatgattcaggttat

SEQ ID NO: 498508 - DNA, 20 bp, Artificial
  CRISPR gRNA sequence
atatgattcaggttatcata

SEQ ID NO: 498509 - DNA, 20 bp, Artificial
  CRISPR gRNA sequence
aggttatcatatgcattttt

SEQ ID NO: 498510 - DNA, 20 bp, Artificial
  CRISPR gRNA sequence
tcatatgcatttttatttat

SEQ ID NO: 498511 - DNA, 20 bp, Artificial
  CRISPR gRNA sequence
ttatttattttatatcatca

SEQ ID NO: 498512 - DNA, 20 bp, Artificial
  CRISPR gRNA sequence
tatttattttatatcatcat

SEQ ID NO: 498513 - DNA, 20 bp, Artificial
  CRISPR gRNA sequence
atttattttatatcatcatt

SEQ ID NO: 498514 - DNA, 20 bp, Artificial
  CRISPR gRNA sequence
tttattttatatcatcatta

SEQ ID NO: 498515 - DNA, 20 bp, Artificial
  CRISPR gRNA sequence
attttatatcatcattatta

SEQ ID NO: 498516 - DNA, 20 bp, Artificial
  CRISPR gRNA sequence
ttttatatcatcattattat

SEQ ID NO: 498517 - DNA, 20 bp, Artificial
  CRISPR gRNA sequence
tatatcatcattattattat

SEQ ID NO: 498518 - DNA, 20 bp, Artificial
  CRISPR gRNA sequence
atatcatcattattattatt

SEQ ID NO: 498519 - DNA, 20 bp, Artificial
  CRISPR gRNA sequence
tatcatcattattattattt

SEQ ID NO: 498520 - DNA, 20 bp, Artificial
  CRISPR gRNA sequence
ttattattttttagagatgg

SEQ ID NO: 498521 - DNA, 20 bp, Artificial
  CRISPR gRNA sequence
ttattttttagagatggagt

SEQ ID NO: 498522 - DNA, 20 bp, Artificial
  CRISPR gRNA sequence
ttttttagagatggagtctc

SEQ ID NO: 498523 - DNA, 20 bp, Artificial
  CRISPR gRNA sequence
tttagagatggagtctcgct

SEQ ID NO: 498524 - DNA, 20 bp, Artificial
  CRISPR gRNA sequence
ttagagatggagtctcgctc

SEQ ID NO: 498525 - DNA, 20 bp, Artificial
  CRISPR gRNA sequence
tagagatggagtctcgctct

SEQ ID NO: 498526 - DNA, 20 bp, Artificial
  CRISPR gRNA sequence
agagatggagtctcgctctg

SEQ ID NO: 498527 - DNA, 20 bp, Artificial
  CRISPR gRNA sequence
gagatggagtctcgctctgt

SEQ ID NO: 498528 - DNA, 20 bp, Artificial
  CRISPR gRNA sequence
gctctgtggcctgggctgga

SEQ ID NO: 498529 - DNA, 20 bp, Artificial
  CRISPR gRNA sequence
tgtggcctgggctggagtac

SEQ ID NO: 498530 - DNA, 20 bp, Artificial
  CRISPR gRNA sequence
tggcctgggctggagtacag

SEQ ID NO: 498531 - DNA, 20 bp, Artificial
  CRISPR gRNA sequence
ggctggagtacagtggtcca

SEQ ID NO: 498532 - DNA, 20 bp, Artificial
  CRISPR gRNA sequence
gagtacagtggtccaatctc

SEQ ID NO: 498533 - DNA, 20 bp, Artificial
  CRISPR gRNA sequence
ggctcactgcaacttctgct

SEQ ID NO: 498534 - DNA, 20 bp, Artificial
  CRISPR gRNA sequence
actgcaacttctgctccccc

SEQ ID NO: 498535 - DNA, 20 bp, Artificial
  CRISPR gRNA sequence
caacttctgctcccccgggt

SEQ ID NO: 498536 - DNA, 20 bp, Artificial
  CRISPR gRNA sequence
ctgctcccccgggttcaagt

SEQ ID NO: 498537 - DNA, 20 bp, Artificial
  CRISPR gRNA sequence
tgctcccccgggttcaagtg

SEQ ID NO: 498538 - DNA, 20 bp, Artificial
  CRISPR gRNA sequence
ctcccccgggttcaagtgat

SEQ ID NO: 498539 - DNA, 20 bp, Artificial
  CRISPR gRNA sequence
ccccgggttcaagtgattgt

SEQ ID NO: 498540 - DNA, 20 bp, Artificial
  CRISPR gRNA sequence
aagtgattgtcctgcctcag

SEQ ID NO: 498541 - DNA, 20 bp, Artificial
  CRISPR gRNA sequence
tcctgcctcagcctcccgag

SEQ ID NO: 498542 - DNA, 20 bp, Artificial
  CRISPR gRNA sequence
cctcagcctcccgagtagct

SEQ ID NO: 498543 - DNA, 20 bp, Artificial
  CRISPR gRNA sequence
agcctcccgagtagctggga

SEQ ID NO: 498544 - DNA, 20 bp, Artificial
  CRISPR gRNA sequence
ccgagtagctgggactacag

SEQ ID NO: 498545 - DNA, 20 bp, Artificial
  CRISPR gRNA sequence
ggactacagatgcatgccac

SEQ ID NO: 498546 - DNA, 20 bp, Artificial
  CRISPR gRNA sequence
cagatgcatgccaccaagcc

SEQ ID NO: 498547 - DNA, 20 bp, Artificial
  CRISPR gRNA sequence
gctaatttttgtatttttgg

SEQ ID NO: 498548 - DNA, 20 bp, Artificial
  CRISPR gRNA sequence
atttttgtatttttggtgga

SEQ ID NO: 498549 - DNA, 20 bp, Artificial
  CRISPR gRNA sequence
ttgtatttttggtggagaca

SEQ ID NO: 498550 - DNA, 20 bp, Artificial
  CRISPR gRNA sequence
tgtatttttggtggagacag

SEQ ID NO: 498551 - DNA, 20 bp, Artificial
  CRISPR gRNA sequence
gtatttttggtggagacagg

SEQ ID NO: 498552 - DNA, 20 bp, Artificial
  CRISPR gRNA sequence
tatttttggtggagacaggg

SEQ ID NO: 498553 - DNA, 20 bp, Artificial
  CRISPR gRNA sequence
ttggtggagacagggtttca

SEQ ID NO: 498554 - DNA, 20 bp, Artificial
  CRISPR gRNA sequence
tggtggagacagggtttcac

SEQ ID NO: 498555 - DNA, 20 bp, Artificial
  CRISPR gRNA sequence
ggtggagacagggtttcacc

SEQ ID NO: 498556 - DNA, 20 bp, Artificial
  CRISPR gRNA sequence
gtggagacagggtttcacca

SEQ ID NO: 498557 - DNA, 20 bp, Artificial
  CRISPR gRNA sequence
caccatgttggccaggctgg

SEQ ID NO: 498558 - DNA, 20 bp, Artificial
  CRISPR gRNA sequence
accatgttggccaggctggt

SEQ ID NO: 498559 - DNA, 20 bp, Artificial
  CRISPR gRNA sequence
gccaggctggtcttaaactc

SEQ ID NO: 498560 - DNA, 20 bp, Artificial
  CRISPR gRNA sequence
gtcttaaactcctgacctca

SEQ ID NO: 498561 - DNA, 20 bp, Artificial
  CRISPR gRNA sequence
aaactcctgacctcaagtga

SEQ ID NO: 498562 - DNA, 20 bp, Artificial
  CRISPR gRNA sequence
aactcctgacctcaagtgat

SEQ ID NO: 498563 - DNA, 20 bp, Artificial
  CRISPR gRNA sequence
ctgacctcaagtgatccacc

SEQ ID NO: 498564 - DNA, 20 bp, Artificial
  CRISPR gRNA sequence
acctcaagtgatccacccac

SEQ ID NO: 498565 - DNA, 20 bp, Artificial
  CRISPR gRNA sequence
aagtgatccacccacctccg

SEQ ID NO: 498566 - DNA, 20 bp, Artificial
  CRISPR gRNA sequence
cgcctctcaaaagtgctggg

SEQ ID NO: 498567 - DNA, 20 bp, Artificial
  CRISPR gRNA sequence
tcaaaagtgctgggatacca

SEQ ID NO: 498568 - DNA, 20 bp, Artificial
  CRISPR gRNA sequence
aaaagtgctgggataccagg

SEQ ID NO: 498569 - DNA, 20 bp, Artificial
  CRISPR gRNA sequence
ggataccaggtgtgagccac

SEQ ID NO: 498570 - DNA, 20 bp, Artificial
  CRISPR gRNA sequence
tgcccggcctattattattt

SEQ ID NO: 498571 - DNA, 20 bp, Artificial
  CRISPR gRNA sequence
ttattatttttcaagagagg

SEQ ID NO: 498572 - DNA, 20 bp, Artificial
  CRISPR gRNA sequence
ttatttttcaagagaggatc

SEQ ID NO: 498573 - DNA, 20 bp, Artificial
  CRISPR gRNA sequence
tttttcaagagaggatctgg

SEQ ID NO: 498574 - DNA, 20 bp, Artificial
  CRISPR gRNA sequence
ttcaagagaggatctggttc

SEQ ID NO: 498575 - DNA, 20 bp, Artificial
  CRISPR gRNA sequence
tcaagagaggatctggttct

SEQ ID NO: 498576 - DNA, 20 bp, Artificial
  CRISPR gRNA sequence
caagagaggatctggttctt

SEQ ID NO: 498577 - DNA, 20 bp, Artificial
  CRISPR gRNA sequence
aagagaggatctggttcttt

SEQ ID NO: 498578 - DNA, 20 bp, Artificial
  CRISPR gRNA sequence
gttctttcacccagactgga

SEQ ID NO: 498579 - DNA, 20 bp, Artificial
  CRISPR gRNA sequence
tttcacccagactggagtgc

SEQ ID NO: 498580 - DNA, 20 bp, Artificial
  CRISPR gRNA sequence
tcacccagactggagtgcag

SEQ ID NO: 498581 - DNA, 20 bp, Artificial
  CRISPR gRNA sequence
cacccagactggagtgcagt

SEQ ID NO: 498582 - DNA, 20 bp, Artificial
  CRISPR gRNA sequence
acccagactggagtgcagtg

SEQ ID NO: 498583 - DNA, 20 bp, Artificial
  CRISPR gRNA sequence
gagtgcagtggcatgctcac

SEQ ID NO: 498584 - DNA, 20 bp, Artificial
  CRISPR gRNA sequence
acggctcactgtagcctcga

SEQ ID NO: 498585 - DNA, 20 bp, Artificial
  CRISPR gRNA sequence
actgtagcctcgacctcgca

SEQ ID NO: 498586 - DNA, 20 bp, Artificial
  CRISPR gRNA sequence
tagcctcgacctcgcaggct

SEQ ID NO: 498587 - DNA, 20 bp, Artificial
  CRISPR gRNA sequence
gacctcgcaggctcaagcca

SEQ ID NO: 498588 - DNA, 20 bp, Artificial
  CRISPR gRNA sequence
gcaggctcaagccatcctcc

SEQ ID NO: 498589 - DNA, 20 bp, Artificial
  CRISPR gRNA sequence
aagccatcctcccacctcag

SEQ ID NO: 498590 - DNA, 20 bp, Artificial
  CRISPR gRNA sequence
ccacctcagcctccctggta

SEQ ID NO: 498591 - DNA, 20 bp, Artificial
  CRISPR gRNA sequence
agcctccctggtagctggaa

SEQ ID NO: 498592 - DNA, 20 bp, Artificial
  CRISPR gRNA sequence
cctggtagctggaactagag

SEQ ID NO: 498593 - DNA, 20 bp, Artificial
  CRISPR gRNA sequence
gtagctggaactagaggtct

SEQ ID NO: 498594 - DNA, 20 bp, Artificial
  CRISPR gRNA sequence
gaactagaggtctgtgccac

SEQ ID NO: 498595 - DNA, 20 bp, Artificial
  CRISPR gRNA sequence
gaggtctgtgccaccatgcc

SEQ ID NO: 498596 - DNA, 20 bp, Artificial
  CRISPR gRNA sequence
tgccaccatgcctggctaat

SEQ ID NO: 498597 - DNA, 20 bp, Artificial
  CRISPR gRNA sequence
gctaattttttttttttttt

SEQ ID NO: 498598 - DNA, 20 bp, Artificial
  CRISPR gRNA sequence
atttttttttttttttttgt

SEQ ID NO: 498599 - DNA, 20 bp, Artificial
  CRISPR gRNA sequence
ttttttttttttttgtagat

SEQ ID NO: 498600 - DNA, 20 bp, Artificial
  CRISPR gRNA sequence
tttttttttttttgtagata

SEQ ID NO: 498601 - DNA, 20 bp, Artificial
  CRISPR gRNA sequence
ttttttttttttgtagatac

SEQ ID NO: 498602 - DNA, 20 bp, Artificial
  CRISPR gRNA sequence
tttttttttttgtagataca

SEQ ID NO: 498603 - DNA, 20 bp, Artificial
  CRISPR gRNA sequence
ttttttttttgtagatacag

SEQ ID NO: 498604 - DNA, 20 bp, Artificial
  CRISPR gRNA sequence
tttttttttgtagatacagg

SEQ ID NO: 498605 - DNA, 20 bp, Artificial
  CRISPR gRNA sequence
ttttttttgtagatacaggg

SEQ ID NO: 498606 - DNA, 20 bp, Artificial
  CRISPR gRNA sequence
tttttttgtagatacagggt

SEQ ID NO: 498607 - DNA, 20 bp, Artificial
  CRISPR gRNA sequence
ttttttgtagatacagggtt

SEQ ID NO: 498608 - DNA, 20 bp, Artificial
  CRISPR gRNA sequence
tttttgtagatacagggttt

SEQ ID NO: 498609 - DNA, 20 bp, Artificial
  CRISPR gRNA sequence
ttttgtagatacagggtttc

SEQ ID NO: 498610 - DNA, 20 bp, Artificial
  CRISPR gRNA sequence
tttgtagatacagggtttcc

SEQ ID NO: 498611 - DNA, 20 bp, Artificial
  CRISPR gRNA sequence
ttgtagatacagggtttccc

SEQ ID NO: 498612 - DNA, 20 bp, Artificial
  CRISPR gRNA sequence
tgtagatacagggtttcccc

SEQ ID NO: 498613 - DNA, 20 bp, Artificial
  CRISPR gRNA sequence
gtagatacagggtttcccca

SEQ ID NO: 498614 - DNA, 20 bp, Artificial
  CRISPR gRNA sequence
tagatacagggtttccccat

SEQ ID NO: 498615 - DNA, 20 bp, Artificial
  CRISPR gRNA sequence
ccccatgttgcccagggtgg

SEQ ID NO: 498616 - DNA, 20 bp, Artificial
  CRISPR gRNA sequence
cccatgttgcccagggtggt

SEQ ID NO: 498617 - DNA, 20 bp, Artificial
  CRISPR gRNA sequence
cccagggtggtcttgaactc

SEQ ID NO: 498618 - DNA, 20 bp, Artificial
  CRISPR gRNA sequence
gaactcccgggctcaggcga

SEQ ID NO: 498619 - DNA, 20 bp, Artificial
  CRISPR gRNA sequence
aactcccgggctcaggcgat

SEQ ID NO: 498620 - DNA, 20 bp, Artificial
  CRISPR gRNA sequence
ccgggctcaggcgatccacc

SEQ ID NO: 498621 - DNA, 20 bp, Artificial
  CRISPR gRNA sequence
aggcgatccacctgcctcag

SEQ ID NO: 498622 - DNA, 20 bp, Artificial
  CRISPR gRNA sequence
cctcagtctcccaaagtggt

SEQ ID NO: 498623 - DNA, 20 bp, Artificial
  CRISPR gRNA sequence
agtctcccaaagtggtggga

SEQ ID NO: 498624 - DNA, 20 bp, Artificial
  CRISPR gRNA sequence
ccaaagtggtgggactacaa

SEQ ID NO: 498625 - DNA, 20 bp, Artificial
  CRISPR gRNA sequence
caagtgtgagccatcatgcc

SEQ ID NO: 498626 - DNA, 20 bp, Artificial
  CRISPR gRNA sequence
gccatcatatgcatttttaa

SEQ ID NO: 498627 - DNA, 20 bp, Artificial
  CRISPR gRNA sequence
ttaaaattattttttcttta

SEQ ID NO: 498628 - DNA, 20 bp, Artificial
  CRISPR gRNA sequence
taaaattattttttctttaa

SEQ ID NO: 498629 - DNA, 20 bp, Artificial
  CRISPR gRNA sequence
aaaattattttttctttaaa

SEQ ID NO: 498630 - DNA, 20 bp, Artificial
  CRISPR gRNA sequence
aaattattttttctttaaaa

SEQ ID NO: 498631 - DNA, 20 bp, Artificial
  CRISPR gRNA sequence
ttttttctttaaaaaaattt

SEQ ID NO: 498632 - DNA, 20 bp, Artificial
  CRISPR gRNA sequence
tttctttaaaaaaatttttt

SEQ ID NO: 498633 - DNA, 20 bp, Artificial
  CRISPR gRNA sequence
ttctttaaaaaaattttttt

SEQ ID NO: 498634 - DNA, 20 bp, Artificial
  CRISPR gRNA sequence
tctttaaaaaaatttttttc

SEQ ID NO: 498635 - DNA, 20 bp, Artificial
  CRISPR gRNA sequence
ctttaaaaaaatttttttct

SEQ ID NO: 498636 - DNA, 20 bp, Artificial
  CRISPR gRNA sequence
tttaaaaaaatttttttctg

SEQ ID NO: 498637 - DNA, 20 bp, Artificial
  CRISPR gRNA sequence
taaaaaaatttttttctgtg

SEQ ID NO: 498638 - DNA, 20 bp, Artificial
  CRISPR gRNA sequence
aaaaaaatttttttctgtgc

SEQ ID NO: 498639 - DNA, 20 bp, Artificial
  CRISPR gRNA sequence
aaaaaatttttttctgtgcc

SEQ ID NO: 498640 - DNA, 20 bp, Artificial
  CRISPR gRNA sequence
ttttctgtgcccattgacag

SEQ ID NO: 498641 - DNA, 20 bp, Artificial
  CRISPR gRNA sequence
tttctgtgcccattgacagc

SEQ ID NO: 498642 - DNA, 20 bp, Artificial
  CRISPR gRNA sequence
ttctgtgcccattgacagca

SEQ ID NO: 498643 - DNA, 20 bp, Artificial
  CRISPR gRNA sequence
tctgtgcccattgacagcag

SEQ ID NO: 498644 - DNA, 20 bp, Artificial
  CRISPR gRNA sequence
ctgtgcccattgacagcaga

SEQ ID NO: 498645 - DNA, 20 bp, Artificial
  CRISPR gRNA sequence
tgtgcccattgacagcagat

SEQ ID NO: 498646 - DNA, 20 bp, Artificial
  CRISPR gRNA sequence
tgcccattgacagcagatat

SEQ ID NO: 498647 - DNA, 20 bp, Artificial
  CRISPR gRNA sequence
acagcagatattatatgcat

SEQ ID NO: 498648 - DNA, 20 bp, Artificial
  CRISPR gRNA sequence
tatgcatttttgacaggaat

SEQ ID NO: 498649 - DNA, 20 bp, Artificial
  CRISPR gRNA sequence
ttgacaggaataccacaaaa

SEQ ID NO: 498650 - DNA, 20 bp, Artificial
  CRISPR gRNA sequence
tgacaggaataccacaaaag

SEQ ID NO: 498651 - DNA, 20 bp, Artificial
  CRISPR gRNA sequence
gacaggaataccacaaaagt

SEQ ID NO: 498652 - DNA, 20 bp, Artificial
  CRISPR gRNA sequence
acaggaataccacaaaagtg

SEQ ID NO: 498653 - DNA, 20 bp, Artificial
  CRISPR gRNA sequence
tgtctttttcagcgcatccc

SEQ ID NO: 498654 - DNA, 20 bp, Artificial
  CRISPR gRNA sequence
tttcagcgcatcccatcagg

SEQ ID NO: 498655 - DNA, 20 bp, Artificial
  CRISPR gRNA sequence
ttcagcgcatcccatcagga

SEQ ID NO: 498656 - DNA, 20 bp, Artificial
  CRISPR gRNA sequence
tcagcgcatcccatcaggag

SEQ ID NO: 498657 - DNA, 20 bp, Artificial
  CRISPR gRNA sequence
cagcgcatcccatcaggagt

SEQ ID NO: 498658 - DNA, 20 bp, Artificial
  CRISPR gRNA sequence
agcgcatcccatcaggagtc

SEQ ID NO: 498659 - DNA, 20 bp, Artificial
  CRISPR gRNA sequence
aaaaaaccactttgtttact

SEQ ID NO: 498660 - DNA, 20 bp, Artificial
  CRISPR gRNA sequence
aaaaaccactttgtttactg

SEQ ID NO: 498661 - DNA, 20 bp, Artificial
  CRISPR gRNA sequence
tgtttactgaataatttaac

SEQ ID NO: 498662 - DNA, 20 bp, Artificial
  CRISPR gRNA sequence
gtttactgaataatttaaca

SEQ ID NO: 498663 - DNA, 20 bp, Artificial
  CRISPR gRNA sequence
tttactgaataatttaacag

SEQ ID NO: 498664 - DNA, 20 bp, Artificial
  CRISPR gRNA sequence
actgaataatttaacaggag

SEQ ID NO: 498665 - DNA, 20 bp, Artificial
  CRISPR gRNA sequence
ctgaataatttaacaggagt

SEQ ID NO: 498666 - DNA, 20 bp, Artificial
  CRISPR gRNA sequence
aataatttaacaggagtact

SEQ ID NO: 498667 - DNA, 20 bp, Artificial
  CRISPR gRNA sequence
aacaggagtactatttatgt

SEQ ID NO: 498668 - DNA, 20 bp, Artificial
  CRISPR gRNA sequence
acaggagtactatttatgta

SEQ ID NO: 498669 - DNA, 20 bp, Artificial
  CRISPR gRNA sequence
tttatgtaagatgtgcatat

SEQ ID NO: 498670 - DNA, 20 bp, Artificial
  CRISPR gRNA sequence
atgtaagatgtgcatataac

SEQ ID NO: 498671 - DNA, 20 bp, Artificial
  CRISPR gRNA sequence
tgtaagatgtgcatataact

SEQ ID NO: 498672 - DNA, 20 bp, Artificial
  CRISPR gRNA sequence
ttgagcattgcgaaattctt

SEQ ID NO: 498673 - DNA, 20 bp, Artificial
  CRISPR gRNA sequence
gagcattgcgaaattcttcc

SEQ ID NO: 498674 - DNA, 20 bp, Artificial
  CRISPR gRNA sequence
agcattgcgaaattcttcca

SEQ ID NO: 498675 - DNA, 20 bp, Artificial
  CRISPR gRNA sequence
cgaaattcttccaaagactt

SEQ ID NO: 498676 - DNA, 20 bp, Artificial
  CRISPR gRNA sequence
ttccaaagacttcttctttc

SEQ ID NO: 498677 - DNA, 20 bp, Artificial
  CRISPR gRNA sequence
ccaaagacttcttctttcat

SEQ ID NO: 498678 - DNA, 20 bp, Artificial
  CRISPR gRNA sequence
caaagacttcttctttcatg

SEQ ID NO: 498679 - DNA, 20 bp, Artificial
  CRISPR gRNA sequence
cttctttcatgcagagtaaa

SEQ ID NO: 498680 - DNA, 20 bp, Artificial
  CRISPR gRNA sequence
ttctttcatgcagagtaaaa

SEQ ID NO: 498681 - DNA, 20 bp, Artificial
  CRISPR gRNA sequence
ctttcatgcagagtaaaagc

SEQ ID NO: 498682 - DNA, 20 bp, Artificial
  CRISPR gRNA sequence
tttcatgcagagtaaaagcc

SEQ ID NO: 498683 - DNA, 20 bp, Artificial
  CRISPR gRNA sequence
tcatgcagagtaaaagccat

SEQ ID NO: 498684 - DNA, 20 bp, Artificial
  CRISPR gRNA sequence
catgcagagtaaaagccatg

SEQ ID NO: 498685 - DNA, 20 bp, Artificial
  CRISPR gRNA sequence
atgcagagtaaaagccatgc

SEQ ID NO: 498686 - DNA, 20 bp, Artificial
  CRISPR gRNA sequence
tacaatggtgcgtgacctgg

SEQ ID NO: 498687 - DNA, 20 bp, Artificial
  CRISPR gRNA sequence
acaatggtgcgtgacctggc

SEQ ID NO: 498688 - DNA, 20 bp, Artificial
  CRISPR gRNA sequence
caatggtgcgtgacctggcg

SEQ ID NO: 498689 - DNA, 20 bp, Artificial
  CRISPR gRNA sequence
gcgtccaagacccactcctc

SEQ ID NO: 498690 - DNA, 20 bp, Artificial
  CRISPR gRNA sequence
ctctttgtctctcctcttgc

SEQ ID NO: 498691 - DNA, 20 bp, Artificial
  CRISPR gRNA sequence
tttgtctctcctcttgctca

SEQ ID NO: 498692 - DNA, 20 bp, Artificial
  CRISPR gRNA sequence
tgtctctcctcttgctcaca

SEQ ID NO: 498693 - DNA, 20 bp, Artificial
  CRISPR gRNA sequence
gtctctcctcttgctcacag

SEQ ID NO: 498694 - DNA, 20 bp, Artificial
  CRISPR gRNA sequence
tctctcctcttgctcacagc

SEQ ID NO: 498695 - DNA, 20 bp, Artificial
  CRISPR gRNA sequence
tcctcttgctcacagcattt

SEQ ID NO: 498696 - DNA, 20 bp, Artificial
  CRISPR gRNA sequence
ctcttgctcacagcatttca

SEQ ID NO: 498697 - DNA, 20 bp, Artificial
  CRISPR gRNA sequence
ttgctcacagcatttcagcc

SEQ ID NO: 498698 - DNA, 20 bp, Artificial
  CRISPR gRNA sequence
gctcacagcatttcagccat

SEQ ID NO: 498699 - DNA, 20 bp, Artificial
  CRISPR gRNA sequence
ctcacagcatttcagccatg

SEQ ID NO: 498700 - DNA, 20 bp, Artificial
  CRISPR gRNA sequence
acagcatttcagccatgttg

SEQ ID NO: 498701 - DNA, 20 bp, Artificial
  CRISPR gRNA sequence
cagccatgttgcctgctggt

SEQ ID NO: 498702 - DNA, 20 bp, Artificial
  CRISPR gRNA sequence
agccatgttgcctgctggtc

SEQ ID NO: 498703 - DNA, 20 bp, Artificial
  CRISPR gRNA sequence
cctgctggtcctggacctcg

SEQ ID NO: 498704 - DNA, 20 bp, Artificial
  CRISPR gRNA sequence
ctggtcctggacctcgctct

SEQ ID NO: 498705 - DNA, 20 bp, Artificial
  CRISPR gRNA sequence
gtcctggacctcgctctctg

SEQ ID NO: 498706 - DNA, 20 bp, Artificial
  CRISPR gRNA sequence
gacctcgctctctgttgtat

SEQ ID NO: 498707 - DNA, 20 bp, Artificial
  CRISPR gRNA sequence
gctctctgttgtatccacag

SEQ ID NO: 498708 - DNA, 20 bp, Artificial
  CRISPR gRNA sequence
tctgttgtatccacagtttt

SEQ ID NO: 498709 - DNA, 20 bp, Artificial
  CRISPR gRNA sequence
tgttgtatccacagttttct

SEQ ID NO: 498710 - DNA, 20 bp, Artificial
  CRISPR gRNA sequence
ttgtatccacagttttctct

SEQ ID NO: 498711 - DNA, 20 bp, Artificial
  CRISPR gRNA sequence
tatccacagttttctctgcc

SEQ ID NO: 498712 - DNA, 20 bp, Artificial
  CRISPR gRNA sequence
tctctgcctgggatgctgct

SEQ ID NO: 498713 - DNA, 20 bp, Artificial
  CRISPR gRNA sequence
ctctgcctgggatgctgctc

SEQ ID NO: 498714 - DNA, 20 bp, Artificial
  CRISPR gRNA sequence
tctgcctgggatgctgctcc

SEQ ID NO: 498715 - DNA, 20 bp, Artificial
  CRISPR gRNA sequence
tgcctgggatgctgctcctt

SEQ ID NO: 498716 - DNA, 20 bp, Artificial
  CRISPR gRNA sequence
cctgggatgctgctcctttg

SEQ ID NO: 498717 - DNA, 20 bp, Artificial
  CRISPR gRNA sequence
ggatgctgctcctttgctgg

SEQ ID NO: 498718 - DNA, 20 bp, Artificial
  CRISPR gRNA sequence
ctcctttgctggctacatgg

SEQ ID NO: 498719 - DNA, 20 bp, Artificial
  CRISPR gRNA sequence
ctttgctggctacatggcct

SEQ ID NO: 498720 - DNA, 20 bp, Artificial
  CRISPR gRNA sequence
tgctggctacatggcctctt

SEQ ID NO: 498721 - DNA, 20 bp, Artificial
  CRISPR gRNA sequence
gctggctacatggcctcttc

SEQ ID NO: 498722 - DNA, 20 bp, Artificial
  CRISPR gRNA sequence
ctggctacatggcctcttcc

SEQ ID NO: 498723 - DNA, 20 bp, Artificial
  CRISPR gRNA sequence
gctacatggcctcttccctc

SEQ ID NO: 498724 - DNA, 20 bp, Artificial
  CRISPR gRNA sequence
catggcctcttccctcaacc

SEQ ID NO: 498725 - DNA, 20 bp, Artificial
  CRISPR gRNA sequence
ttccctcaacccctcagagt

SEQ ID NO: 498726 - DNA, 20 bp, Artificial
  CRISPR gRNA sequence
ccctcaacccctcagagttt

SEQ ID NO: 498727 - DNA, 20 bp, Artificial
  CRISPR gRNA sequence
cctcaacccctcagagtttt

SEQ ID NO: 498728 - DNA, 20 bp, Artificial
  CRISPR gRNA sequence
aacccctcagagttttgctc

SEQ ID NO: 498729 - DNA, 20 bp, Artificial
  CRISPR gRNA sequence
agagttttgctcaaatacct

SEQ ID NO: 498730 - DNA, 20 bp, Artificial
  CRISPR gRNA sequence
tgctcaaatacctccttttc

SEQ ID NO: 498731 - DNA, 20 bp, Artificial
  CRISPR gRNA sequence
gctcaaatacctccttttca

SEQ ID NO: 498732 - DNA, 20 bp, Artificial
  CRISPR gRNA sequence
ctcaaatacctccttttcag

SEQ ID NO: 498733 - DNA, 20 bp, Artificial
  CRISPR gRNA sequence
aaatacctccttttcagtga

SEQ ID NO: 498734 - DNA, 20 bp, Artificial
  CRISPR gRNA sequence
cttttcagtgatgccttccc

SEQ ID NO: 498735 - DNA, 20 bp, Artificial
  CRISPR gRNA sequence
ttcagtgatgccttccccac

SEQ ID NO: 498736 - DNA, 20 bp, Artificial
  CRISPR gRNA sequence
tcagtgatgccttccccact

SEQ ID NO: 498737 - DNA, 20 bp, Artificial
  CRISPR gRNA sequence
cagtgatgccttccccactg

SEQ ID NO: 498738 - DNA, 20 bp, Artificial
  CRISPR gRNA sequence
agtgatgccttccccactga

SEQ ID NO: 498739 - DNA, 20 bp, Artificial
  CRISPR gRNA sequence
ccccactgaaaatgtcagcc

SEQ ID NO: 498740 - DNA, 20 bp, Artificial
  CRISPR gRNA sequence
cccactgaaaatgtcagcct

SEQ ID NO: 498741 - DNA, 20 bp, Artificial
  CRISPR gRNA sequence
aaaatgtcagcctgccattc

SEQ ID NO: 498742 - DNA, 20 bp, Artificial
  CRISPR gRNA sequence
ccattctgcaaactcttagc

SEQ ID NO: 498743 - DNA, 20 bp, Artificial
  CRISPR gRNA sequence
tgcaaactcttagctctctc

SEQ ID NO: 498744 - DNA, 20 bp, Artificial
  CRISPR gRNA sequence
caaactcttagctctctctc

SEQ ID NO: 498745 - DNA, 20 bp, Artificial
  CRISPR gRNA sequence
ttagctctctctccacttaa

SEQ ID NO: 498746 - DNA, 20 bp, Artificial
  CRISPR gRNA sequence
agctctctctccacttaatt

SEQ ID NO: 498747 - DNA, 20 bp, Artificial
  CRISPR gRNA sequence
gctctctctccacttaattt

SEQ ID NO: 498748 - DNA, 20 bp, Artificial
  CRISPR gRNA sequence
tctctccacttaatttttct

SEQ ID NO: 498749 - DNA, 20 bp, Artificial
  CRISPR gRNA sequence
tctccacttaatttttctcc

SEQ ID NO: 498750 - DNA, 20 bp, Artificial
  CRISPR gRNA sequence
tccacttaatttttctccat

SEQ ID NO: 498751 - DNA, 20 bp, Artificial
  CRISPR gRNA sequence
cacttaatttttctccatag

SEQ ID NO: 498752 - DNA, 20 bp, Artificial
  CRISPR gRNA sequence
aatttttctccatagtcctc

SEQ ID NO: 498753 - DNA, 20 bp, Artificial
  CRISPR gRNA sequence
atttttctccatagtcctca

SEQ ID NO: 498754 - DNA, 20 bp, Artificial
  CRISPR gRNA sequence
ttctccatagtcctcatctc

SEQ ID NO: 498755 - DNA, 20 bp, Artificial
  CRISPR gRNA sequence
tctccatagtcctcatctcc

SEQ ID NO: 498756 - DNA, 20 bp, Artificial
  CRISPR gRNA sequence
ctccatagtcctcatctcca

SEQ ID NO: 498757 - DNA, 20 bp, Artificial
  CRISPR gRNA sequence
tccatagtcctcatctccat

SEQ ID NO: 498758 - DNA, 20 bp, Artificial
  CRISPR gRNA sequence
catagtcctcatctccattt

SEQ ID NO: 498759 - DNA, 20 bp, Artificial
  CRISPR gRNA sequence
atctccatttatgttccatc

SEQ ID NO: 498760 - DNA, 20 bp, Artificial
  CRISPR gRNA sequence
catttatgttccatcctgtt

SEQ ID NO: 498761 - DNA, 20 bp, Artificial
  CRISPR gRNA sequence
atgttccatcctgtttactt

SEQ ID NO: 498762 - DNA, 20 bp, Artificial
  CRISPR gRNA sequence
tgttccatcctgtttactta

SEQ ID NO: 498763 - DNA, 20 bp, Artificial
  CRISPR gRNA sequence
catcctgtttacttatgttt

SEQ ID NO: 498764 - DNA, 20 bp, Artificial
  CRISPR gRNA sequence
tttacttatgtttttcattt

SEQ ID NO: 498765 - DNA, 20 bp, Artificial
  CRISPR gRNA sequence
acttatgtttttcattttct

SEQ ID NO: 498766 - DNA, 20 bp, Artificial
  CRISPR gRNA sequence
cttatgtttttcattttctg

SEQ ID NO: 498767 - DNA, 20 bp, Artificial
  CRISPR gRNA sequence
atgtttttcattttctgtct

SEQ ID NO: 498768 - DNA, 20 bp, Artificial
  CRISPR gRNA sequence
tgtttttcattttctgtctc

SEQ ID NO: 498769 - DNA, 20 bp, Artificial
  CRISPR gRNA sequence
ttcattttctgtctcccagt

SEQ ID NO: 498770 - DNA, 20 bp, Artificial
  CRISPR gRNA sequence
tcattttctgtctcccagtc

SEQ ID NO: 498771 - DNA, 20 bp, Artificial
  CRISPR gRNA sequence
cattttctgtctcccagtct

SEQ ID NO: 498772 - DNA, 20 bp, Artificial
  CRISPR gRNA sequence
attttctgtctcccagtctc

SEQ ID NO: 498773 - DNA, 20 bp, Artificial
  CRISPR gRNA sequence
tctgtctcccagtctcctct

SEQ ID NO: 498774 - DNA, 20 bp, Artificial
  CRISPR gRNA sequence
ctgtctcccagtctcctctt

SEQ ID NO: 498775 - DNA, 20 bp, Artificial
  CRISPR gRNA sequence
tgtctcccagtctcctcttc

SEQ ID NO: 498776 - DNA, 20 bp, Artificial
  CRISPR gRNA sequence
tctcccagtctcctcttcag

SEQ ID NO: 498777 - DNA, 20 bp, Artificial
  CRISPR gRNA sequence
ccagtctcctcttcagcccc

SEQ ID NO: 498778 - DNA, 20 bp, Artificial
  CRISPR gRNA sequence
ctcttcagccccctagactg

SEQ ID NO: 498779 - DNA, 20 bp, Artificial
  CRISPR gRNA sequence
ttcagccccctagactgtaa

SEQ ID NO: 498780 - DNA, 20 bp, Artificial
  CRISPR gRNA sequence
cagccccctagactgtaaga

SEQ ID NO: 498781 - DNA, 20 bp, Artificial
  CRISPR gRNA sequence
agccccctagactgtaagat

SEQ ID NO: 498782 - DNA, 20 bp, Artificial
  CRISPR gRNA sequence
gactgtaagatccttgaggc

SEQ ID NO: 498783 - DNA, 20 bp, Artificial
  CRISPR gRNA sequence
taagatccttgaggccaggg

SEQ ID NO: 498784 - DNA, 20 bp, Artificial
  CRISPR gRNA sequence
gaggccagggcttttgtctg

SEQ ID NO: 498785 - DNA, 20 bp, Artificial
  CRISPR gRNA sequence
aggccagggcttttgtctgt

SEQ ID NO: 498786 - DNA, 20 bp, Artificial
  CRISPR gRNA sequence
ttgtctgttttgctcaccgt

SEQ ID NO: 498787 - DNA, 20 bp, Artificial
  CRISPR gRNA sequence
tgtctgttttgctcaccgtt

SEQ ID NO: 498788 - DNA, 20 bp, Artificial
  CRISPR gRNA sequence
gtctgttttgctcaccgttg

SEQ ID NO: 498789 - DNA, 20 bp, Artificial
  CRISPR gRNA sequence
tctgttttgctcaccgttgt

SEQ ID NO: 498790 - DNA, 20 bp, Artificial
  CRISPR gRNA sequence
ttttgctcaccgttgtctcc

SEQ ID NO: 498791 - DNA, 20 bp, Artificial
  CRISPR gRNA sequence
tgctcaccgttgtctcctca

SEQ ID NO: 498792 - DNA, 20 bp, Artificial
  CRISPR gRNA sequence
gctcaccgttgtctcctcaa

SEQ ID NO: 498793 - DNA, 20 bp, Artificial
  CRISPR gRNA sequence
ctcaccgttgtctcctcaac

SEQ ID NO: 498794 - DNA, 20 bp, Artificial
  CRISPR gRNA sequence
accgttgtctcctcaacatc

SEQ ID NO: 498795 - DNA, 20 bp, Artificial
  CRISPR gRNA sequence
tctcctcaacatctagagca

SEQ ID NO: 498796 - DNA, 20 bp, Artificial
  CRISPR gRNA sequence
ctcaacatctagagcagtac

SEQ ID NO: 498797 - DNA, 20 bp, Artificial
  CRISPR gRNA sequence
aacatctagagcagtacctg

SEQ ID NO: 498798 - DNA, 20 bp, Artificial
  CRISPR gRNA sequence
gagcagtacctgccacaagt

SEQ ID NO: 498799 - DNA, 20 bp, Artificial
  CRISPR gRNA sequence
ccacaagtcaaccctcagta

SEQ ID NO: 498800 - DNA, 20 bp, Artificial
  CRISPR gRNA sequence
agtagatacttattttcaca

SEQ ID NO: 498801 - DNA, 20 bp, Artificial
  CRISPR gRNA sequence
attttcacaatagcagcccc

SEQ ID NO: 498802 - DNA, 20 bp, Artificial
  CRISPR gRNA sequence
ttttcacaatagcagccccc

SEQ ID NO: 498803 - DNA, 20 bp, Artificial
  CRISPR gRNA sequence
tcacaatagcagccccctct

SEQ ID NO: 498804 - DNA, 20 bp, Artificial
  CRISPR gRNA sequence
cacaatagcagccccctctc

SEQ ID NO: 498805 - DNA, 20 bp, Artificial
  CRISPR gRNA sequence
acaatagcagccccctctct

SEQ ID NO: 498806 - DNA, 20 bp, Artificial
  CRISPR gRNA sequence
tctgttcccattctttctct

SEQ ID NO: 498807 - DNA, 20 bp, Artificial
  CRISPR gRNA sequence
tgttcccattctttctctgg

SEQ ID NO: 498808 - DNA, 20 bp, Artificial
  CRISPR gRNA sequence
ttcccattctttctctggat

SEQ ID NO: 498809 - DNA, 20 bp, Artificial
  CRISPR gRNA sequence
ccattctttctctggatata

SEQ ID NO: 498810 - DNA, 20 bp, Artificial
  CRISPR gRNA sequence
tttctctggatatattttga

SEQ ID NO: 498811 - DNA, 20 bp, Artificial
  CRISPR gRNA sequence
tctctggatatattttgaat

SEQ ID NO: 498812 - DNA, 20 bp, Artificial
  CRISPR gRNA sequence
ctctggatatattttgaata

SEQ ID NO: 498813 - DNA, 20 bp, Artificial
  CRISPR gRNA sequence
tctggatatattttgaatag

SEQ ID NO: 498814 - DNA, 20 bp, Artificial
  CRISPR gRNA sequence
tggatatattttgaatagct

SEQ ID NO: 498815 - DNA, 20 bp, Artificial
  CRISPR gRNA sequence
gatatattttgaatagctct

SEQ ID NO: 498816 - DNA, 20 bp, Artificial
  CRISPR gRNA sequence
tgaatagctctgaaccaggg

SEQ ID NO: 498817 - DNA, 20 bp, Artificial
  CRISPR gRNA sequence
gaatagctctgaaccagggc

SEQ ID NO: 498818 - DNA, 20 bp, Artificial
  CRISPR gRNA sequence
aatagctctgaaccagggct

SEQ ID NO: 498819 - DNA, 20 bp, Artificial
  CRISPR gRNA sequence
tgaaccagggctattgagga

SEQ ID NO: 498820 - DNA, 20 bp, Artificial
  CRISPR gRNA sequence
aaccagggctattgaggatt

SEQ ID NO: 498821 - DNA, 20 bp, Artificial
  CRISPR gRNA sequence
ttgaggattcagtggcaagt

SEQ ID NO: 498822 - DNA, 20 bp, Artificial
  CRISPR gRNA sequence
aggattcagtggcaagtaag

SEQ ID NO: 498823 - DNA, 20 bp, Artificial
  CRISPR gRNA sequence
agtggcaagtaagtccaggg

SEQ ID NO: 498824 - DNA, 20 bp, Artificial
  CRISPR gRNA sequence
gttcagagagcttgcgctag

SEQ ID NO: 498825 - DNA, 20 bp, Artificial
  CRISPR gRNA sequence
ttcagagagcttgcgctaga

SEQ ID NO: 498826 - DNA, 20 bp, Artificial
  CRISPR gRNA sequence
agagagcttgcgctagattg

SEQ ID NO: 498827 - DNA, 20 bp, Artificial
  CRISPR gRNA sequence
gcgctagattgcctgagtca

SEQ ID NO: 498828 - DNA, 20 bp, Artificial
  CRISPR gRNA sequence
cgctagattgcctgagtcac

SEQ ID NO: 498829 - DNA, 20 bp, Artificial
  CRISPR gRNA sequence
gattgcctgagtcactgtta

SEQ ID NO: 498830 - DNA, 20 bp, Artificial
  CRISPR gRNA sequence
cctgagtcactgttactaca

SEQ ID NO: 498831 - DNA, 20 bp, Artificial
  CRISPR gRNA sequence
agtcactgttactacagttg

SEQ ID NO: 498832 - DNA, 20 bp, Artificial
  CRISPR gRNA sequence
ttactacagttgtgattagt

SEQ ID NO: 498833 - DNA, 20 bp, Artificial
  CRISPR gRNA sequence
ctacagttgtgattagtgcc

SEQ ID NO: 498834 - DNA, 20 bp, Artificial
  CRISPR gRNA sequence
cagttgtgattagtgcctgg

SEQ ID NO: 498835 - DNA, 20 bp, Artificial
  CRISPR gRNA sequence
tgattagtgcctggtgcagt

SEQ ID NO: 498836 - DNA, 20 bp, Artificial
  CRISPR gRNA sequence
gtgcctggtgcagtgccaat

SEQ ID NO: 498837 - DNA, 20 bp, Artificial
  CRISPR gRNA sequence
gtgcagtgccaatgcagtag

SEQ ID NO: 498838 - DNA, 20 bp, Artificial
  CRISPR gRNA sequence
aaaacatgtttgttgagtga

SEQ ID NO: 498839 - DNA, 20 bp, Artificial
  CRISPR gRNA sequence
gttgagtgaataagtgaatt

SEQ ID NO: 498840 - DNA, 20 bp, Artificial
  CRISPR gRNA sequence
ttgagtgaataagtgaatta

SEQ ID NO: 498841 - DNA, 20 bp, Artificial
  CRISPR gRNA sequence
agtgaataagtgaattattt

SEQ ID NO: 498842 - DNA, 20 bp, Artificial
  CRISPR gRNA sequence
ttttcaggcatcttaacggg

SEQ ID NO: 498843 - DNA, 20 bp, Artificial
  CRISPR gRNA sequence
tcaggcatcttaacgggcag

SEQ ID NO: 498844 - DNA, 20 bp, Artificial
  CRISPR gRNA sequence
caggcatcttaacgggcagc

SEQ ID NO: 498845 - DNA, 20 bp, Artificial
  CRISPR gRNA sequence
aggcatcttaacgggcagcc

SEQ ID NO: 498846 - DNA, 20 bp, Artificial
  CRISPR gRNA sequence
aacgggcagcctgggatgtt

SEQ ID NO: 498847 - DNA, 20 bp, Artificial
  CRISPR gRNA sequence
acgggcagcctgggatgttt

SEQ ID NO: 498848 - DNA, 20 bp, Artificial
  CRISPR gRNA sequence
ggatgttttttgggttagac

SEQ ID NO: 498849 - DNA, 20 bp, Artificial
  CRISPR gRNA sequence
tttgggttagacatattggg

SEQ ID NO: 498850 - DNA, 20 bp, Artificial
  CRISPR gRNA sequence
ttgggttagacatattggga

SEQ ID NO: 498851 - DNA, 20 bp, Artificial
  CRISPR gRNA sequence
tgggttagacatattgggaa

SEQ ID NO: 498852 - DNA, 20 bp, Artificial
  CRISPR gRNA sequence
gggttagacatattgggaag

SEQ ID NO: 498853 - DNA, 20 bp, Artificial
  CRISPR gRNA sequence
ggttagacatattgggaagg

SEQ ID NO: 498854 - DNA, 20 bp, Artificial
  CRISPR gRNA sequence
gacatattgggaaggaggga

SEQ ID NO: 498855 - DNA, 20 bp, Artificial
  CRISPR gRNA sequence
ggaaggagggatcttcaaat

SEQ ID NO: 498856 - DNA, 20 bp, Artificial
  CRISPR gRNA sequence
caaatcattgcccagggaat

SEQ ID NO: 498857 - DNA, 20 bp, Artificial
  CRISPR gRNA sequence
aaatcattgcccagggaata

SEQ ID NO: 498858 - DNA, 20 bp, Artificial
  CRISPR gRNA sequence
cccagggaataggcctgggc

SEQ ID NO: 498859 - DNA, 20 bp, Artificial
  CRISPR gRNA sequence
ggccctaaaattcattttag

SEQ ID NO: 498860 - DNA, 20 bp, Artificial
  CRISPR gRNA sequence
aaattcattttagacccaaa

SEQ ID NO: 498861 - DNA, 20 bp, Artificial
  CRISPR gRNA sequence
attttagacccaaaattcag

SEQ ID NO: 498862 - DNA, 20 bp, Artificial
  CRISPR gRNA sequence
tagacccaaaattcaggttt

SEQ ID NO: 498863 - DNA, 20 bp, Artificial
  CRISPR gRNA sequence
agacccaaaattcaggtttc

SEQ ID NO: 498864 - DNA, 20 bp, Artificial
  CRISPR gRNA sequence
gacccaaaattcaggtttca

SEQ ID NO: 498865 - DNA, 20 bp, Artificial
  CRISPR gRNA sequence
aggtttcagttgtccgttct

SEQ ID NO: 498866 - DNA, 20 bp, Artificial
  CRISPR gRNA sequence
cagttgtccgttctgaggaa

SEQ ID NO: 498867 - DNA, 20 bp, Artificial
  CRISPR gRNA sequence
agttgtccgttctgaggaaa

SEQ ID NO: 498868 - DNA, 20 bp, Artificial
  CRISPR gRNA sequence
tccgttctgaggaaacccca

SEQ ID NO: 498869 - DNA, 20 bp, Artificial
  CRISPR gRNA sequence
tgaggaaaccccaaaggaca

SEQ ID NO: 498870 - DNA, 20 bp, Artificial
  CRISPR gRNA sequence
aggaaaccccaaaggacaca

SEQ ID NO: 498871 - DNA, 20 bp, Artificial
  CRISPR gRNA sequence
gaggctatgaatccccagat

SEQ ID NO: 498872 - DNA, 20 bp, Artificial
  CRISPR gRNA sequence
tgaatccccagatgctttac

SEQ ID NO: 498873 - DNA, 20 bp, Artificial
  CRISPR gRNA sequence
tacagcctgagttgagatct

SEQ ID NO: 498874 - DNA, 20 bp, Artificial
  CRISPR gRNA sequence
acagcctgagttgagatctg

SEQ ID NO: 498875 - DNA, 20 bp, Artificial
  CRISPR gRNA sequence
cagcctgagttgagatctgc

SEQ ID NO: 498876 - DNA, 20 bp, Artificial
  CRISPR gRNA sequence
agttgagatctgctggacaa

SEQ ID NO: 498877 - DNA, 20 bp, Artificial
  CRISPR gRNA sequence
agatctgctggacaataaaa

SEQ ID NO: 498878 - DNA, 20 bp, Artificial
  CRISPR gRNA sequence
ctggacaataaaagggcaca

SEQ ID NO: 498879 - DNA, 20 bp, Artificial
  CRISPR gRNA sequence
gacaataaaagggcacaggt

SEQ ID NO: 498880 - DNA, 20 bp, Artificial
  CRISPR gRNA sequence
atagattagctccaagggtt

SEQ ID NO: 498881 - DNA, 20 bp, Artificial
  CRISPR gRNA sequence
tagattagctccaagggttg

SEQ ID NO: 498882 - DNA, 20 bp, Artificial
  CRISPR gRNA sequence
gctccaagggttgccagctg

SEQ ID NO: 498883 - DNA, 20 bp, Artificial
  CRISPR gRNA sequence
caagggttgccagctgtttg

SEQ ID NO: 498884 - DNA, 20 bp, Artificial
  CRISPR gRNA sequence
ccagctgtttgcgtagattg

SEQ ID NO: 498885 - DNA, 20 bp, Artificial
  CRISPR gRNA sequence
tttgcgtagattgtgttgga

SEQ ID NO: 498886 - DNA, 20 bp, Artificial
  CRISPR gRNA sequence
gcgtagattgtgttggaact

SEQ ID NO: 498887 - DNA, 20 bp, Artificial
  CRISPR gRNA sequence
cgtagattgtgttggaactg

SEQ ID NO: 498888 - DNA, 20 bp, Artificial
  CRISPR gRNA sequence
tgttggaactgtcacttctc

SEQ ID NO: 498889 - DNA, 20 bp, Artificial
  CRISPR gRNA sequence
gaactgtcacttctcaggga

SEQ ID NO: 498890 - DNA, 20 bp, Artificial
  CRISPR gRNA sequence
tcacttctcagggagtggtg

SEQ ID NO: 498891 - DNA, 20 bp, Artificial
  CRISPR gRNA sequence
ctcagggagtggtgtctaac

SEQ ID NO: 498892 - DNA, 20 bp, Artificial
  CRISPR gRNA sequence
tcagggagtggtgtctaact

SEQ ID NO: 498893 - DNA, 20 bp, Artificial
  CRISPR gRNA sequence
agggagtggtgtctaactgc

SEQ ID NO: 498894 - DNA, 20 bp, Artificial
  CRISPR gRNA sequence
actgcgactgctttggctgg

SEQ ID NO: 498895 - DNA, 20 bp, Artificial
  CRISPR gRNA sequence
cgactgctttggctgggatc

SEQ ID NO: 498896 - DNA, 20 bp, Artificial
  CRISPR gRNA sequence
ctttggctgggatccaggca

SEQ ID NO: 498897 - DNA, 20 bp, Artificial
  CRISPR gRNA sequence
tggctgggatccaggcaagc

SEQ ID NO: 498898 - DNA, 20 bp, Artificial
  CRISPR gRNA sequence
ggctgggatccaggcaagct

SEQ ID NO: 498899 - DNA, 20 bp, Artificial
  CRISPR gRNA sequence
gctgggatccaggcaagctg

SEQ ID NO: 498900 - DNA, 20 bp, Artificial
  CRISPR gRNA sequence
ggatccaggcaagctgtaga

SEQ ID NO: 498901 - DNA, 20 bp, Artificial
  CRISPR gRNA sequence
tagaagggctggagtcgttt

SEQ ID NO: 498902 - DNA, 20 bp, Artificial
  CRISPR gRNA sequence
gagtcgtttttgctcttctc

SEQ ID NO: 498903 - DNA, 20 bp, Artificial
  CRISPR gRNA sequence
ttgctcttctcttcctcatt

SEQ ID NO: 498904 - DNA, 20 bp, Artificial
  CRISPR gRNA sequence
tgctcttctcttcctcattg

SEQ ID NO: 498905 - DNA, 20 bp, Artificial
  CRISPR gRNA sequence
gctcttctcttcctcattgc

SEQ ID NO: 498906 - DNA, 20 bp, Artificial
  CRISPR gRNA sequence
ctcttctcttcctcattgca

SEQ ID NO: 498907 - DNA, 20 bp, Artificial
  CRISPR gRNA sequence
ttctcttcctcattgcacct

SEQ ID NO: 498908 - DNA, 20 bp, Artificial
  CRISPR gRNA sequence
ctcttcctcattgcacctcc

SEQ ID NO: 498909 - DNA, 20 bp, Artificial
  CRISPR gRNA sequence
tcttcctcattgcacctccc

SEQ ID NO: 498910 - DNA, 20 bp, Artificial
  CRISPR gRNA sequence
ttcctcattgcacctcccct

SEQ ID NO: 498911 - DNA, 20 bp, Artificial
  CRISPR gRNA sequence
cctcattgcacctcccctcc

SEQ ID NO: 498912 - DNA, 20 bp, Artificial
  CRISPR gRNA sequence
ctcattgcacctcccctcca

SEQ ID NO: 498913 - DNA, 20 bp, Artificial
  CRISPR gRNA sequence
attgcacctcccctccaaca

SEQ ID NO: 498914 - DNA, 20 bp, Artificial
  CRISPR gRNA sequence
cacctcccctccaacaaagg

SEQ ID NO: 498915 - DNA, 20 bp, Artificial
  CRISPR gRNA sequence
ccctccaacaaagggtgaat

SEQ ID NO: 498916 - DNA, 20 bp, Artificial
  CRISPR gRNA sequence
caacaaagggtgaatggcaa

SEQ ID NO: 498917 - DNA, 20 bp, Artificial
  CRISPR gRNA sequence
gacacagaaaagagattgga

SEQ ID NO: 498918 - DNA, 20 bp, Artificial
  CRISPR gRNA sequence
gaattcaatgtaccctgggc

SEQ ID NO: 498919 - DNA, 20 bp, Artificial
  CRISPR gRNA sequence
aatgtaccctgggctacagc

SEQ ID NO: 498920 - DNA, 20 bp, Artificial
  CRISPR gRNA sequence
ggctacagcaccatccagaa

SEQ ID NO: 498921 - DNA, 20 bp, Artificial
  CRISPR gRNA sequence
cagcaccatccagaaaggaa

SEQ ID NO: 498922 - DNA, 20 bp, Artificial
  CRISPR gRNA sequence
aaatcacttcaaggagagac

SEQ ID NO: 498923 - DNA, 20 bp, Artificial
  CRISPR gRNA sequence
caaggagagacagggcatgt

SEQ ID NO: 498924 - DNA, 20 bp, Artificial
  CRISPR gRNA sequence
aaggagagacagggcatgtc

SEQ ID NO: 498925 - DNA, 20 bp, Artificial
  CRISPR gRNA sequence
gtttttttttttaatttttt

SEQ ID NO: 498926 - DNA, 20 bp, Artificial
  CRISPR gRNA sequence
tttttttttttaatttttta

SEQ ID NO: 498927 - DNA, 20 bp, Artificial
  CRISPR gRNA sequence
ttttttttaattttttattt

SEQ ID NO: 498928 - DNA, 20 bp, Artificial
  CRISPR gRNA sequence
tttttttaattttttatttt

SEQ ID NO: 498929 - DNA, 20 bp, Artificial
  CRISPR gRNA sequence
ttttttaattttttattttt

SEQ ID NO: 498930 - DNA, 20 bp, Artificial
  CRISPR gRNA sequence
tttttaattttttattttta

SEQ ID NO: 498931 - DNA, 20 bp, Artificial
  CRISPR gRNA sequence
ttttaattttttatttttat

SEQ ID NO: 498932 - DNA, 20 bp, Artificial
  CRISPR gRNA sequence
tttaattttttatttttatt

SEQ ID NO: 498933 - DNA, 20 bp, Artificial
  CRISPR gRNA sequence
ttaattttttatttttattt

SEQ ID NO: 498934 - DNA, 20 bp, Artificial
  CRISPR gRNA sequence
taattttttatttttattta

SEQ ID NO: 498935 - DNA, 20 bp, Artificial
  CRISPR gRNA sequence
aattttttatttttatttat

SEQ ID NO: 498936 - DNA, 20 bp, Artificial
  CRISPR gRNA sequence
attttttatttttatttatt

SEQ ID NO: 498937 - DNA, 20 bp, Artificial
  CRISPR gRNA sequence
tttatttttatttatttatt

SEQ ID NO: 498938 - DNA, 20 bp, Artificial
  CRISPR gRNA sequence
ttatttttatttatttattt

SEQ ID NO: 498939 - DNA, 20 bp, Artificial
  CRISPR gRNA sequence
tatttttatttatttatttt

SEQ ID NO: 498940 - DNA, 20 bp, Artificial
  CRISPR gRNA sequence
atttttatttatttattttt

SEQ ID NO: 498941 - DNA, 20 bp, Artificial
  CRISPR gRNA sequence
tttttatttatttattttta

SEQ ID NO: 498942 - DNA, 20 bp, Artificial
  CRISPR gRNA sequence
ttatttatttatttttattt

SEQ ID NO: 498943 - DNA, 20 bp, Artificial
  CRISPR gRNA sequence
tatttatttatttttatttt

SEQ ID NO: 498944 - DNA, 20 bp, Artificial
  CRISPR gRNA sequence
atttatttatttttattttt

SEQ ID NO: 498945 - DNA, 20 bp, Artificial
  CRISPR gRNA sequence
tttatttatttttatttttt

SEQ ID NO: 498946 - DNA, 20 bp, Artificial
  CRISPR gRNA sequence
atttatttttatttttttgt

SEQ ID NO: 498947 - DNA, 20 bp, Artificial
  CRISPR gRNA sequence
tttatttttatttttttgtg

SEQ ID NO: 498948 - DNA, 20 bp, Artificial
  CRISPR gRNA sequence
atttttatttttttgtgaga

SEQ ID NO: 498949 - DNA, 20 bp, Artificial
  CRISPR gRNA sequence
tttttatttttttgtgagac

SEQ ID NO: 498950 - DNA, 20 bp, Artificial
  CRISPR gRNA sequence
ttatttttttgtgagacagg

SEQ ID NO: 498951 - DNA, 20 bp, Artificial
  CRISPR gRNA sequence
tatttttttgtgagacaggg

SEQ ID NO: 498952 - DNA, 20 bp, Artificial
  CRISPR gRNA sequence
atttttttgtgagacagggt

SEQ ID NO: 498953 - DNA, 20 bp, Artificial
  CRISPR gRNA sequence
tttttttgtgagacagggtc

SEQ ID NO: 498954 - DNA, 20 bp, Artificial
  CRISPR gRNA sequence
ttttgtgagacagggtcttg

SEQ ID NO: 498955 - DNA, 20 bp, Artificial
  CRISPR gRNA sequence
tttgtgagacagggtcttgc

SEQ ID NO: 498956 - DNA, 20 bp, Artificial
  CRISPR gRNA sequence
ttgtgagacagggtcttgct

SEQ ID NO: 498957 - DNA, 20 bp, Artificial
  CRISPR gRNA sequence
tgtgagacagggtcttgctc

SEQ ID NO: 498958 - DNA, 20 bp, Artificial
  CRISPR gRNA sequence
gtgagacagggtcttgctct

SEQ ID NO: 498959 - DNA, 20 bp, Artificial
  CRISPR gRNA sequence
tgagacagggtcttgctcta

SEQ ID NO: 498960 - DNA, 20 bp, Artificial
  CRISPR gRNA sequence
gctctatcacccaggctgga

SEQ ID NO: 498961 - DNA, 20 bp, Artificial
  CRISPR gRNA sequence
ctctatcacccaggctggag

SEQ ID NO: 498962 - DNA, 20 bp, Artificial
  CRISPR gRNA sequence
tatcacccaggctggagtgc

SEQ ID NO: 498963 - DNA, 20 bp, Artificial
  CRISPR gRNA sequence
tcacccaggctggagtgcag

SEQ ID NO: 498964 - DNA, 20 bp, Artificial
  CRISPR gRNA sequence
gagtgcagtgatgtgatcac

SEQ ID NO: 498965 - DNA, 20 bp, Artificial
  CRISPR gRNA sequence
actgtagccttgacctcctg

SEQ ID NO: 498966 - DNA, 20 bp, Artificial
  CRISPR gRNA sequence
tagccttgacctcctgggct

SEQ ID NO: 498967 - DNA, 20 bp, Artificial
  CRISPR gRNA sequence
gacctcctgggctcaagcaa

SEQ ID NO: 498968 - DNA, 20 bp, Artificial
  CRISPR gRNA sequence
acctcctgggctcaagcaat

SEQ ID NO: 498969 - DNA, 20 bp, Artificial
  CRISPR gRNA sequence
ctgggctcaagcaatccttc

SEQ ID NO: 498970 - DNA, 20 bp, Artificial
  CRISPR gRNA sequence
ggctcaagcaatccttctgc

SEQ ID NO: 498971 - DNA, 20 bp, Artificial
  CRISPR gRNA sequence
aagcaatccttctgcctcag

SEQ ID NO: 498972 - DNA, 20 bp, Artificial
  CRISPR gRNA sequence
ctgcctcagcctccttagta

SEQ ID NO: 498973 - DNA, 20 bp, Artificial
  CRISPR gRNA sequence
tgcctcagcctccttagtag

SEQ ID NO: 498974 - DNA, 20 bp, Artificial
  CRISPR gRNA sequence
cctcagcctccttagtagct

SEQ ID NO: 498975 - DNA, 20 bp, Artificial
  CRISPR gRNA sequence
agcctccttagtagctggga

SEQ ID NO: 498976 - DNA, 20 bp, Artificial
  CRISPR gRNA sequence
cttagtagctgggactacag

SEQ ID NO: 498977 - DNA, 20 bp, Artificial
  CRISPR gRNA sequence
agtagctgggactacaggca

SEQ ID NO: 498978 - DNA, 20 bp, Artificial
  CRISPR gRNA sequence
gtagctgggactacaggcat

SEQ ID NO: 498979 - DNA, 20 bp, Artificial
  CRISPR gRNA sequence
ggactacaggcatgtatcac

SEQ ID NO: 498980 - DNA, 20 bp, Artificial
  CRISPR gRNA sequence
caggcatgtatcaccacact

SEQ ID NO: 498981 - DNA, 20 bp, Artificial
  CRISPR gRNA sequence
ggcttatttttaatttttgt

SEQ ID NO: 498982 - DNA, 20 bp, Artificial
  CRISPR gRNA sequence
gcttatttttaatttttgtg

SEQ ID NO: 498983 - DNA, 20 bp, Artificial
  CRISPR gRNA sequence
atttttaatttttgtgtaga

SEQ ID NO: 498984 - DNA, 20 bp, Artificial
  CRISPR gRNA sequence
tttttaatttttgtgtagag

SEQ ID NO: 498985 - DNA, 20 bp, Artificial
  CRISPR gRNA sequence
ttaatttttgtgtagagatg

SEQ ID NO: 498986 - DNA, 20 bp, Artificial
  CRISPR gRNA sequence
taatttttgtgtagagatgg

SEQ ID NO: 498987 - DNA, 20 bp, Artificial
  CRISPR gRNA sequence
aatttttgtgtagagatggg

SEQ ID NO: 498988 - DNA, 20 bp, Artificial
  CRISPR gRNA sequence
atttttgtgtagagatgggg

SEQ ID NO: 498989 - DNA, 20 bp, Artificial
  CRISPR gRNA sequence
ttgtgtagagatggggtttt

SEQ ID NO: 498990 - DNA, 20 bp, Artificial
  CRISPR gRNA sequence
tgtgtagagatggggttttg

SEQ ID NO: 498991 - DNA, 20 bp, Artificial
  CRISPR gRNA sequence
gtgtagagatggggttttgc

SEQ ID NO: 498992 - DNA, 20 bp, Artificial
  CRISPR gRNA sequence
tgtagagatggggttttgct

SEQ ID NO: 498993 - DNA, 20 bp, Artificial
  CRISPR gRNA sequence
tgctatgctgcctgggctgg

SEQ ID NO: 498994 - DNA, 20 bp, Artificial
  CRISPR gRNA sequence
gctatgctgcctgggctggt

SEQ ID NO: 498995 - DNA, 20 bp, Artificial
  CRISPR gRNA sequence
ctatgctgcctgggctggtc

SEQ ID NO: 498996 - DNA, 20 bp, Artificial
  CRISPR gRNA sequence
tgctgcctgggctggtcttg

SEQ ID NO: 498997 - DNA, 20 bp, Artificial
  CRISPR gRNA sequence
cctgggctggtcttgacctc

SEQ ID NO: 498998 - DNA, 20 bp, Artificial
  CRISPR gRNA sequence
ggctggtcttgacctcctgg

SEQ ID NO: 498999 - DNA, 20 bp, Artificial
  CRISPR gRNA sequence
gtcttgacctcctgggctca

SEQ ID NO: 499000 - DNA, 20 bp, Artificial
  CRISPR gRNA sequence
gacctcctgggctcaagcaa

SEQ ID NO: 499001 - DNA, 20 bp, Artificial
  CRISPR gRNA sequence
acctcctgggctcaagcaat

SEQ ID NO: 499002 - DNA, 20 bp, Artificial
  CRISPR gRNA sequence
ctgggctcaagcaatcctct

SEQ ID NO: 499003 - DNA, 20 bp, Artificial
  CRISPR gRNA sequence
ggctcaagcaatcctcttgc

SEQ ID NO: 499004 - DNA, 20 bp, Artificial
  CRISPR gRNA sequence
aagcaatcctcttgccttgg

SEQ ID NO: 499005 - DNA, 20 bp, Artificial
  CRISPR gRNA sequence
ttgccttggcctcccaaatt

SEQ ID NO: 499006 - DNA, 20 bp, Artificial
  CRISPR gRNA sequence
gccttggcctcccaaattac

SEQ ID NO: 499007 - DNA, 20 bp, Artificial
  CRISPR gRNA sequence
ccttggcctcccaaattact

SEQ ID NO: 499008 - DNA, 20 bp, Artificial
  CRISPR gRNA sequence
ggcctcccaaattactggga

SEQ ID NO: 499009 - DNA, 20 bp, Artificial
  CRISPR gRNA sequence
gcctcccaaattactgggat

SEQ ID NO: 499010 - DNA, 20 bp, Artificial
  CRISPR gRNA sequence
ccaaattactgggattacag

SEQ ID NO: 499011 - DNA, 20 bp, Artificial
  CRISPR gRNA sequence
ctgggattacagatgtgggc

SEQ ID NO: 499012 - DNA, 20 bp, Artificial
  CRISPR gRNA sequence
ggattacagatgtgggccac

SEQ ID NO: 499013 - DNA, 20 bp, Artificial
  CRISPR gRNA sequence
cagatgtgggccactgtgcc

SEQ ID NO: 499014 - DNA, 20 bp, Artificial
  CRISPR gRNA sequence
tgcccagccaggccattgtc

SEQ ID NO: 499015 - DNA, 20 bp, Artificial
  CRISPR gRNA sequence
tcttcacagacaaacctctc

SEQ ID NO: 499016 - DNA, 20 bp, Artificial
  CRISPR gRNA sequence
cacagacaaacctctcttat

SEQ ID NO: 499017 - DNA, 20 bp, Artificial
  CRISPR gRNA sequence
acagacaaacctctcttatt

SEQ ID NO: 499018 - DNA, 20 bp, Artificial
  CRISPR gRNA sequence
tcttattgaagtgcaacata

SEQ ID NO: 499019 - DNA, 20 bp, Artificial
  CRISPR gRNA sequence
ttattgaagtgcaacataca

SEQ ID NO: 499020 - DNA, 20 bp, Artificial
  CRISPR gRNA sequence
attgaagtgcaacatacaga

SEQ ID NO: 499021 - DNA, 20 bp, Artificial
  CRISPR gRNA sequence
ttgaagtgcaacatacagaa

SEQ ID NO: 499022 - DNA, 20 bp, Artificial
  CRISPR gRNA sequence
aagtgcaacatacagaaaag

SEQ ID NO: 499023 - DNA, 20 bp, Artificial
  CRISPR gRNA sequence
caaatgtacatctcaatgag

SEQ ID NO: 499024 - DNA, 20 bp, Artificial
  CRISPR gRNA sequence
aatgagctattgttaaatga

SEQ ID NO: 499025 - DNA, 20 bp, Artificial
  CRISPR gRNA sequence
ttgttaaatgaacacactct

SEQ ID NO: 499026 - DNA, 20 bp, Artificial
  CRISPR gRNA sequence
ttaaatgaacacactcttgt

SEQ ID NO: 499027 - DNA, 20 bp, Artificial
  CRISPR gRNA sequence
aatgaacacactcttgtgtc

SEQ ID NO: 499028 - DNA, 20 bp, Artificial
  CRISPR gRNA sequence
ttgtgtctaccacatgttct

SEQ ID NO: 499029 - DNA, 20 bp, Artificial
  CRISPR gRNA sequence
gtgtctaccacatgttctct

SEQ ID NO: 499030 - DNA, 20 bp, Artificial
  CRISPR gRNA sequence
tgtctaccacatgttctctc

SEQ ID NO: 499031 - DNA, 20 bp, Artificial
  CRISPR gRNA sequence
ccacatgttctctcccattc

SEQ ID NO: 499032 - DNA, 20 bp, Artificial
  CRISPR gRNA sequence
tctcccattcattacttcct

SEQ ID NO: 499033 - DNA, 20 bp, Artificial
  CRISPR gRNA sequence
tcccattcattacttcctct

SEQ ID NO: 499034 - DNA, 20 bp, Artificial
  CRISPR gRNA sequence
ccattcattacttcctctgt

SEQ ID NO: 499035 - DNA, 20 bp, Artificial
  CRISPR gRNA sequence
attacttcctctgtcttcca

SEQ ID NO: 499036 - DNA, 20 bp, Artificial
  CRISPR gRNA sequence
cttcctctgtcttccataaa

SEQ ID NO: 499037 - DNA, 20 bp, Artificial
  CRISPR gRNA sequence
cctctgtcttccataaatat

SEQ ID NO: 499038 - DNA, 20 bp, Artificial
  CRISPR gRNA sequence
ctctgtcttccataaatata

SEQ ID NO: 499039 - DNA, 20 bp, Artificial
  CRISPR gRNA sequence
tgtcttccataaatatagcc

SEQ ID NO: 499040 - DNA, 20 bp, Artificial
  CRISPR gRNA sequence
tcttccataaatatagccac

SEQ ID NO: 499041 - DNA, 20 bp, Artificial
  CRISPR gRNA sequence
ccataaatatagccacaatt

SEQ ID NO: 499042 - DNA, 20 bp, Artificial
  CRISPR gRNA sequence
cataaatatagccacaattc

SEQ ID NO: 499043 - DNA, 20 bp, Artificial
  CRISPR gRNA sequence
tgacttctaacatcacagat

SEQ ID NO: 499044 - DNA, 20 bp, Artificial
  CRISPR gRNA sequence
acttctaacatcacagattt

SEQ ID NO: 499045 - DNA, 20 bp, Artificial
  CRISPR gRNA sequence
ctaacatcacagatttgttt

SEQ ID NO: 499046 - DNA, 20 bp, Artificial
  CRISPR gRNA sequence
taacatcacagatttgtttt

SEQ ID NO: 499047 - DNA, 20 bp, Artificial
  CRISPR gRNA sequence
acatcacagatttgttttgt

SEQ ID NO: 499048 - DNA, 20 bp, Artificial
  CRISPR gRNA sequence
gttttgtccgtatatatgga

SEQ ID NO: 499049 - DNA, 20 bp, Artificial
  CRISPR gRNA sequence
ttttgtccgtatatatggaa

SEQ ID NO: 499050 - DNA, 20 bp, Artificial
  CRISPR gRNA sequence
tgtccgtatatatggaatca

SEQ ID NO: 499051 - DNA, 20 bp, Artificial
  CRISPR gRNA sequence
gtccgtatatatggaatcaa

SEQ ID NO: 499052 - DNA, 20 bp, Artificial
  CRISPR gRNA sequence
tccgtatatatggaatcaaa

SEQ ID NO: 499053 - DNA, 20 bp, Artificial
  CRISPR gRNA sequence
ttgtgtctgactacttttgc

SEQ ID NO: 499054 - DNA, 20 bp, Artificial
  CRISPR gRNA sequence
gtgtctgactacttttgctc

SEQ ID NO: 499055 - DNA, 20 bp, Artificial
  CRISPR gRNA sequence
tgtctgactacttttgctca

SEQ ID NO: 499056 - DNA, 20 bp, Artificial
  CRISPR gRNA sequence
actacttttgctcaacatct

SEQ ID NO: 499057 - DNA, 20 bp, Artificial
  CRISPR gRNA sequence
cttttgctcaacatcttatg

SEQ ID NO: 499058 - DNA, 20 bp, Artificial
  CRISPR gRNA sequence
ttgctcaacatcttatgaga

SEQ ID NO: 499059 - DNA, 20 bp, Artificial
  CRISPR gRNA sequence
tgctcaacatcttatgagat

SEQ ID NO: 499060 - DNA, 20 bp, Artificial
  CRISPR gRNA sequence
gctcaacatcttatgagatt

SEQ ID NO: 499061 - DNA, 20 bp, Artificial
  CRISPR gRNA sequence
ctcaacatcttatgagattt

SEQ ID NO: 499062 - DNA, 20 bp, Artificial
  CRISPR gRNA sequence
aacatcttatgagatttatg

SEQ ID NO: 499063 - DNA, 20 bp, Artificial
  CRISPR gRNA sequence
atgagatttatgtatgttat

SEQ ID NO: 499064 - DNA, 20 bp, Artificial
  CRISPR gRNA sequence
tgagatttatgtatgttatt

SEQ ID NO: 499065 - DNA, 20 bp, Artificial
  CRISPR gRNA sequence
atgtatgttattatttgtag

SEQ ID NO: 499066 - DNA, 20 bp, Artificial
  CRISPR gRNA sequence
tgtatgttattatttgtagc

SEQ ID NO: 499067 - DNA, 20 bp, Artificial
  CRISPR gRNA sequence
ttatttgtagcagatcattt

SEQ ID NO: 499068 - DNA, 20 bp, Artificial
  CRISPR gRNA sequence
tttgtagcagatcattttca

SEQ ID NO: 499069 - DNA, 20 bp, Artificial
  CRISPR gRNA sequence
gtagcagatcattttcatgg

SEQ ID NO: 499070 - DNA, 20 bp, Artificial
  CRISPR gRNA sequence
tagcagatcattttcatggc

SEQ ID NO: 499071 - DNA, 20 bp, Artificial
  CRISPR gRNA sequence
tcatggctgtatagtatttt

SEQ ID NO: 499072 - DNA, 20 bp, Artificial
  CRISPR gRNA sequence
catggctgtatagtatttta

SEQ ID NO: 499073 - DNA, 20 bp, Artificial
  CRISPR gRNA sequence
atggctgtatagtattttat

SEQ ID NO: 499074 - DNA, 20 bp, Artificial
  CRISPR gRNA sequence
tatagtattttatcgcatga

SEQ ID NO: 499075 - DNA, 20 bp, Artificial
  CRISPR gRNA sequence
tatcgcatgactatatcata

SEQ ID NO: 499076 - DNA, 20 bp, Artificial
  CRISPR gRNA sequence
atcgcatgactatatcatag

SEQ ID NO: 499077 - DNA, 20 bp, Artificial
  CRISPR gRNA sequence
tcgcatgactatatcatagt

SEQ ID NO: 499078 - DNA, 20 bp, Artificial
  CRISPR gRNA sequence
tatcatagtttattcacctt

SEQ ID NO: 499079 - DNA, 20 bp, Artificial
  CRISPR gRNA sequence
attcaccttttctattattg

SEQ ID NO: 499080 - DNA, 20 bp, Artificial
  CRISPR gRNA sequence
ttcaccttttctattattga

SEQ ID NO: 499081 - DNA, 20 bp, Artificial
  CRISPR gRNA sequence
accttttctattattgatga

SEQ ID NO: 499082 - DNA, 20 bp, Artificial
  CRISPR gRNA sequence
ttctattattgatgaacctt

SEQ ID NO: 499083 - DNA, 20 bp, Artificial
  CRISPR gRNA sequence
tctattattgatgaaccttt

SEQ ID NO: 499084 - DNA, 20 bp, Artificial
  CRISPR gRNA sequence
ctattattgatgaacctttg

SEQ ID NO: 499085 - DNA, 20 bp, Artificial
  CRISPR gRNA sequence
tattattgatgaacctttgg

SEQ ID NO: 499086 - DNA, 20 bp, Artificial
  CRISPR gRNA sequence
ttattgatgaacctttgggt

SEQ ID NO: 499087 - DNA, 20 bp, Artificial
  CRISPR gRNA sequence
ttgatgaacctttgggttgc

SEQ ID NO: 499088 - DNA, 20 bp, Artificial
  CRISPR gRNA sequence
atgaacctttgggttgcttt

SEQ ID NO: 499089 - DNA, 20 bp, Artificial
  CRISPR gRNA sequence
tgggttgctttcaattttgt

SEQ ID NO: 499090 - DNA, 20 bp, Artificial
  CRISPR gRNA sequence
gggttgctttcaattttgtt

SEQ ID NO: 499091 - DNA, 20 bp, Artificial
  CRISPR gRNA sequence
ggttgctttcaattttgttt

SEQ ID NO: 499092 - DNA, 20 bp, Artificial
  CRISPR gRNA sequence
ctttcaattttgtttttgct

SEQ ID NO: 499093 - DNA, 20 bp, Artificial
  CRISPR gRNA sequence
tcaattttgtttttgctatt

SEQ ID NO: 499094 - DNA, 20 bp, Artificial
  CRISPR gRNA sequence
caattttgtttttgctatta

SEQ ID NO: 499095 - DNA, 20 bp, Artificial
  CRISPR gRNA sequence
aattttgtttttgctattat

SEQ ID NO: 499096 - DNA, 20 bp, Artificial
  CRISPR gRNA sequence
tgtttttgctattataataa

SEQ ID NO: 499097 - DNA, 20 bp, Artificial
  CRISPR gRNA sequence
gtttttgctattataataat

SEQ ID NO: 499098 - DNA, 20 bp, Artificial
  CRISPR gRNA sequence
tttttgctattataataatg

SEQ ID NO: 499099 - DNA, 20 bp, Artificial
  CRISPR gRNA sequence
ttgctattataataatgctg

SEQ ID NO: 499100 - DNA, 20 bp, Artificial
  CRISPR gRNA sequence
tgctattataataatgctgt

SEQ ID NO: 499101 - DNA, 20 bp, Artificial
  CRISPR gRNA sequence
gctattataataatgctgtg

SEQ ID NO: 499102 - DNA, 20 bp, Artificial
  CRISPR gRNA sequence
ctattataataatgctgtga

SEQ ID NO: 499103 - DNA, 20 bp, Artificial
  CRISPR gRNA sequence
ttataataatgctgtgatga

SEQ ID NO: 499104 - DNA, 20 bp, Artificial
  CRISPR gRNA sequence
taataatgctgtgatgagcc

SEQ ID NO: 499105 - DNA, 20 bp, Artificial
  CRISPR gRNA sequence
tgatgagccttttgtgcatg

SEQ ID NO: 499106 - DNA, 20 bp, Artificial
  CRISPR gRNA sequence
ttgtgcatgcatgtctgttg

SEQ ID NO: 499107 - DNA, 20 bp, Artificial
  CRISPR gRNA sequence
tgtgcatgcatgtctgttgg

SEQ ID NO: 499108 - DNA, 20 bp, Artificial
  CRISPR gRNA sequence
gtgcatgcatgtctgttggg

SEQ ID NO: 499109 - DNA, 20 bp, Artificial
  CRISPR gRNA sequence
tgcatgcatgtctgttgggt

SEQ ID NO: 499110 - DNA, 20 bp, Artificial
  CRISPR gRNA sequence
ttgggtatatctctaggggc

SEQ ID NO: 499111 - DNA, 20 bp, Artificial
  CRISPR gRNA sequence
ggtatatctctaggggcaga

SEQ ID NO: 499112 - DNA, 20 bp, Artificial
  CRISPR gRNA sequence
taggggcagaaccatggagt

SEQ ID NO: 499113 - DNA, 20 bp, Artificial
  CRISPR gRNA sequence
ggggcagaaccatggagtat

SEQ ID NO: 499114 - DNA, 20 bp, Artificial
  CRISPR gRNA sequence
tagcagatgctgtcaaactg

SEQ ID NO: 499115 - DNA, 20 bp, Artificial
  CRISPR gRNA sequence
gcagatgctgtcaaactgtt

SEQ ID NO: 499116 - DNA, 20 bp, Artificial
  CRISPR gRNA sequence
tcaaactgttttccaaagtg

SEQ ID NO: 499117 - DNA, 20 bp, Artificial
  CRISPR gRNA sequence
ttttccaaagtggttgaacc

SEQ ID NO: 499118 - DNA, 20 bp, Artificial
  CRISPR gRNA sequence
tccaaagtggttgaaccaaa

SEQ ID NO: 499119 - DNA, 20 bp, Artificial
  CRISPR gRNA sequence
ccaaagtggttgaaccaaat

SEQ ID NO: 499120 - DNA, 20 bp, Artificial
  CRISPR gRNA sequence
caaagtggttgaaccaaata

SEQ ID NO: 499121 - DNA, 20 bp, Artificial
  CRISPR gRNA sequence
aaccaaatagtgcatgagag

SEQ ID NO: 499122 - DNA, 20 bp, Artificial
  CRISPR gRNA sequence
catgctgctttggggccact

SEQ ID NO: 499123 - DNA, 20 bp, Artificial
  CRISPR gRNA sequence
ctttggggccactggctttt

SEQ ID NO: 499124 - DNA, 20 bp, Artificial
  CRISPR gRNA sequence
tggggccactggcttttggt

SEQ ID NO: 499125 - DNA, 20 bp, Artificial
  CRISPR gRNA sequence
ggggccactggcttttggtt

SEQ ID NO: 499126 - DNA, 20 bp, Artificial
  CRISPR gRNA sequence
gggccactggcttttggttc

SEQ ID NO: 499127 - DNA, 20 bp, Artificial
  CRISPR gRNA sequence
gcttttggttctgaaggtct

SEQ ID NO: 499128 - DNA, 20 bp, Artificial
  CRISPR gRNA sequence
ttggttctgaaggtctgcag

SEQ ID NO: 499129 - DNA, 20 bp, Artificial
  CRISPR gRNA sequence
tggttctgaaggtctgcaga

SEQ ID NO: 499130 - DNA, 20 bp, Artificial
  CRISPR gRNA sequence
ggttctgaaggtctgcagat

SEQ ID NO: 499131 - DNA, 20 bp, Artificial
  CRISPR gRNA sequence
gttctgaaggtctgcagatg

SEQ ID NO: 499132 - DNA, 20 bp, Artificial
  CRISPR gRNA sequence
tgaaggtctgcagatggaaa

SEQ ID NO: 499133 - DNA, 20 bp, Artificial
  CRISPR gRNA sequence
aaggtctgcagatggaaaat

SEQ ID NO: 499134 - DNA, 20 bp, Artificial
  CRISPR gRNA sequence
cagatggaaaattaaattgt

SEQ ID NO: 499135 - DNA, 20 bp, Artificial
  CRISPR gRNA sequence
aattgtggaaatgtggagct

SEQ ID NO: 499136 - DNA, 20 bp, Artificial
  CRISPR gRNA sequence
tggaaatgtggagcttggca

SEQ ID NO: 499137 - DNA, 20 bp, Artificial
  CRISPR gRNA sequence
ggcaagaggccaaaggcaag

SEQ ID NO: 499138 - DNA, 20 bp, Artificial
  CRISPR gRNA sequence
gcaagaggccaaaggcaagg

SEQ ID NO: 499139 - DNA, 20 bp, Artificial
  CRISPR gRNA sequence
cagctctgtgatttctctgg

SEQ ID NO: 499140 - DNA, 20 bp, Artificial
  CRISPR gRNA sequence
tgtgatttctctggtatcct

SEQ ID NO: 499141 - DNA, 20 bp, Artificial
  CRISPR gRNA sequence
tgatttctctggtatcctgc

SEQ ID NO: 499142 - DNA, 20 bp, Artificial
  CRISPR gRNA sequence
ctctggtatcctgcatgaaa

SEQ ID NO: 499143 - DNA, 20 bp, Artificial
  CRISPR gRNA sequence
tctggtatcctgcatgaaat

SEQ ID NO: 499144 - DNA, 20 bp, Artificial
  CRISPR gRNA sequence
tggtatcctgcatgaaattc

SEQ ID NO: 499145 - DNA, 20 bp, Artificial
  CRISPR gRNA sequence
gtatcctgcatgaaattctg

SEQ ID NO: 499146 - DNA, 20 bp, Artificial
  CRISPR gRNA sequence
catgaaattctgacaataga

SEQ ID NO: 499147 - DNA, 20 bp, Artificial
  CRISPR gRNA sequence
tgacaatagagtcattttta

SEQ ID NO: 499148 - DNA, 20 bp, Artificial
  CRISPR gRNA sequence
acaatagagtcatttttagg

SEQ ID NO: 499149 - DNA, 20 bp, Artificial
  CRISPR gRNA sequence
ttaggagttatgtgagatgc

SEQ ID NO: 499150 - DNA, 20 bp, Artificial
  CRISPR gRNA sequence
taggagttatgtgagatgca

SEQ ID NO: 499151 - DNA, 20 bp, Artificial
  CRISPR gRNA sequence
aggagttatgtgagatgcat

SEQ ID NO: 499152 - DNA, 20 bp, Artificial
  CRISPR gRNA sequence
ggagttatgtgagatgcatt

SEQ ID NO: 499153 - DNA, 20 bp, Artificial
  CRISPR gRNA sequence
tgtgagatgcattgttgaat

SEQ ID NO: 499154 - DNA, 20 bp, Artificial
  CRISPR gRNA sequence
ttgaattaattaatttaaac

SEQ ID NO: 499155 - DNA, 20 bp, Artificial
  CRISPR gRNA sequence
aattaattaatttaaacgga

SEQ ID NO: 499156 - DNA, 20 bp, Artificial
  CRISPR gRNA sequence
attaatttaaacggattcat

SEQ ID NO: 499157 - DNA, 20 bp, Artificial
  CRISPR gRNA sequence
atttaaacggattcatgaag

SEQ ID NO: 499158 - DNA, 20 bp, Artificial
  CRISPR gRNA sequence
aaacggattcatgaagccct

SEQ ID NO: 499159 - DNA, 20 bp, Artificial
  CRISPR gRNA sequence
aacggattcatgaagccctt

SEQ ID NO: 499160 - DNA, 20 bp, Artificial
  CRISPR gRNA sequence
atgaagcccttgcttgggtt

SEQ ID NO: 499161 - DNA, 20 bp, Artificial
  CRISPR gRNA sequence
gcttgggttgttcattttgc

SEQ ID NO: 499162 - DNA, 20 bp, Artificial
  CRISPR gRNA sequence
cttgggttgttcattttgct

SEQ ID NO: 499163 - DNA, 20 bp, Artificial
  CRISPR gRNA sequence
gggttgttcattttgctgtt

SEQ ID NO: 499164 - DNA, 20 bp, Artificial
  CRISPR gRNA sequence
ggttgttcattttgctgttg

SEQ ID NO: 499165 - DNA, 20 bp, Artificial
  CRISPR gRNA sequence
ttcattttgctgttgtgacg

SEQ ID NO: 499166 - DNA, 20 bp, Artificial
  CRISPR gRNA sequence
attttgctgttgtgacgttt

SEQ ID NO: 499167 - DNA, 20 bp, Artificial
  CRISPR gRNA sequence
tgctgttgtgacgtttgaat

SEQ ID NO: 499168 - DNA, 20 bp, Artificial
  CRISPR gRNA sequence
gctgttgtgacgtttgaatt

SEQ ID NO: 499169 - DNA, 20 bp, Artificial
  CRISPR gRNA sequence
ctgttgtgacgtttgaattt

SEQ ID NO: 499170 - DNA, 20 bp, Artificial
  CRISPR gRNA sequence
ttgtgacgtttgaatttctt

SEQ ID NO: 499171 - DNA, 20 bp, Artificial
  CRISPR gRNA sequence
tgacgtttgaatttcttgtc

SEQ ID NO: 499172 - DNA, 20 bp, Artificial
  CRISPR gRNA sequence
gaatttcttgtctattctgc

SEQ ID NO: 499173 - DNA, 20 bp, Artificial
  CRISPR gRNA sequence
aatttcttgtctattctgca

SEQ ID NO: 499174 - DNA, 20 bp, Artificial
  CRISPR gRNA sequence
cttgtctattctgcatatta

SEQ ID NO: 499175 - DNA, 20 bp, Artificial
  CRISPR gRNA sequence
ttgtctattctgcatattag

SEQ ID NO: 499176 - DNA, 20 bp, Artificial
  CRISPR gRNA sequence
gtctattctgcatattagtt

SEQ ID NO: 499177 - DNA, 20 bp, Artificial
  CRISPR gRNA sequence
tctattctgcatattagttg

SEQ ID NO: 499178 - DNA, 20 bp, Artificial
  CRISPR gRNA sequence
ttctgcatattagttgcctg

SEQ ID NO: 499179 - DNA, 20 bp, Artificial
  CRISPR gRNA sequence
tgcatattagttgcctgtag

SEQ ID NO: 499180 - DNA, 20 bp, Artificial
  CRISPR gRNA sequence
catattagttgcctgtagga

SEQ ID NO: 499181 - DNA, 20 bp, Artificial
  CRISPR gRNA sequence
gttgcctgtaggattcatag

SEQ ID NO: 499182 - DNA, 20 bp, Artificial
  CRISPR gRNA sequence
cctgtaggattcatagtttg

SEQ ID NO: 499183 - DNA, 20 bp, Artificial
  CRISPR gRNA sequence
taggattcatagtttgcaat

SEQ ID NO: 499184 - DNA, 20 bp, Artificial
  CRISPR gRNA sequence
atagtttgcaattttttttc

SEQ ID NO: 499185 - DNA, 20 bp, Artificial
  CRISPR gRNA sequence
gcaattttttttcctattct

SEQ ID NO: 499186 - DNA, 20 bp, Artificial
  CRISPR gRNA sequence
caattttttttcctattcta

SEQ ID NO: 499187 - DNA, 20 bp, Artificial
  CRISPR gRNA sequence
tttttcctattctattggtt

SEQ ID NO: 499188 - DNA, 20 bp, Artificial
  CRISPR gRNA sequence
ttttcctattctattggttg

SEQ ID NO: 499189 - DNA, 20 bp, Artificial
  CRISPR gRNA sequence
tttcctattctattggttgc

SEQ ID NO: 499190 - DNA, 20 bp, Artificial
  CRISPR gRNA sequence
ttcctattctattggttgcc

SEQ ID NO: 499191 - DNA, 20 bp, Artificial
  CRISPR gRNA sequence
tcctattctattggttgcct

SEQ ID NO: 499192 - DNA, 20 bp, Artificial
  CRISPR gRNA sequence
cctattctattggttgcctt

SEQ ID NO: 499193 - DNA, 20 bp, Artificial
  CRISPR gRNA sequence
ctattctattggttgccttt

SEQ ID NO: 499194 - DNA, 20 bp, Artificial
  CRISPR gRNA sequence
ttctattggttgccttttca

SEQ ID NO: 499195 - DNA, 20 bp, Artificial
  CRISPR gRNA sequence
tattggttgccttttcactc

SEQ ID NO: 499196 - DNA, 20 bp, Artificial
  CRISPR gRNA sequence
ttggttgccttttcactctg

SEQ ID NO: 499197 - DNA, 20 bp, Artificial
  CRISPR gRNA sequence
gttgccttttcactctgtga

SEQ ID NO: 499198 - DNA, 20 bp, Artificial
  CRISPR gRNA sequence
ccttttcactctgtgaattg

SEQ ID NO: 499199 - DNA, 20 bp, Artificial
  CRISPR gRNA sequence
ttcactctgtgaattgtttc

SEQ ID NO: 499200 - DNA, 20 bp, Artificial
  CRISPR gRNA sequence
tcactctgtgaattgtttcc

SEQ ID NO: 499201 - DNA, 20 bp, Artificial
  CRISPR gRNA sequence
cactctgtgaattgtttcct

SEQ ID NO: 499202 - DNA, 20 bp, Artificial
  CRISPR gRNA sequence
actctgtgaattgtttcctt

SEQ ID NO: 499203 - DNA, 20 bp, Artificial
  CRISPR gRNA sequence
tgtgaattgtttcctttact

SEQ ID NO: 499204 - DNA, 20 bp, Artificial
  CRISPR gRNA sequence
tgaattgtttcctttactgt

SEQ ID NO: 499205 - DNA, 20 bp, Artificial
  CRISPR gRNA sequence
tttcctttactgtacatgat

SEQ ID NO: 499206 - DNA, 20 bp, Artificial
  CRISPR gRNA sequence
cctttactgtacatgatttt

SEQ ID NO: 499207 - DNA, 20 bp, Artificial
  CRISPR gRNA sequence
ctttactgtacatgattttt

SEQ ID NO: 499208 - DNA, 20 bp, Artificial
  CRISPR gRNA sequence
tactgtacatgatttttttt

SEQ ID NO: 499209 - DNA, 20 bp, Artificial
  CRISPR gRNA sequence
actgtacatgattttttttt

SEQ ID NO: 499210 - DNA, 20 bp, Artificial
  CRISPR gRNA sequence
ctgtacatgattttttttta

SEQ ID NO: 499211 - DNA, 20 bp, Artificial
  CRISPR gRNA sequence
tacatgatttttttttagtt

SEQ ID NO: 499212 - DNA, 20 bp, Artificial
  CRISPR gRNA sequence
ttttttagtttgctgtaata

SEQ ID NO: 499213 - DNA, 20 bp, Artificial
  CRISPR gRNA sequence
tttttagtttgctgtaatac

SEQ ID NO: 499214 - DNA, 20 bp, Artificial
  CRISPR gRNA sequence
ttttagtttgctgtaatacc

SEQ ID NO: 499215 - DNA, 20 bp, Artificial
  CRISPR gRNA sequence
tttagtttgctgtaatacca

SEQ ID NO: 499216 - DNA, 20 bp, Artificial
  CRISPR gRNA sequence
ttagtttgctgtaataccat

SEQ ID NO: 499217 - DNA, 20 bp, Artificial
  CRISPR gRNA sequence
tagtttgctgtaataccatt

SEQ ID NO: 499218 - DNA, 20 bp, Artificial
  CRISPR gRNA sequence
agtttgctgtaataccattt

SEQ ID NO: 499219 - DNA, 20 bp, Artificial
  CRISPR gRNA sequence
gtttgctgtaataccatttg

SEQ ID NO: 499220 - DNA, 20 bp, Artificial
  CRISPR gRNA sequence
gctgtaataccatttgttta

SEQ ID NO: 499221 - DNA, 20 bp, Artificial
  CRISPR gRNA sequence
ctgtaataccatttgtttat

SEQ ID NO: 499222 - DNA, 20 bp, Artificial
  CRISPR gRNA sequence
taataccatttgtttatttt

SEQ ID NO: 499223 - DNA, 20 bp, Artificial
  CRISPR gRNA sequence
gtttattttgcttctgttgc

SEQ ID NO: 499224 - DNA, 20 bp, Artificial
  CRISPR gRNA sequence
tttattttgcttctgttgcc

SEQ ID NO: 499225 - DNA, 20 bp, Artificial
  CRISPR gRNA sequence
attttgcttctgttgcctgt

SEQ ID NO: 499226 - DNA, 20 bp, Artificial
  CRISPR gRNA sequence
ttttgcttctgttgcctgtg

SEQ ID NO: 499227 - DNA, 20 bp, Artificial
  CRISPR gRNA sequence
tgcttctgttgcctgtgctt

SEQ ID NO: 499228 - DNA, 20 bp, Artificial
  CRISPR gRNA sequence
gcttctgttgcctgtgcttt

SEQ ID NO: 499229 - DNA, 20 bp, Artificial
  CRISPR gRNA sequence
cttctgttgcctgtgctttt

SEQ ID NO: 499230 - DNA, 20 bp, Artificial
  CRISPR gRNA sequence
ctgttgcctgtgcttttgag

SEQ ID NO: 499231 - DNA, 20 bp, Artificial
  CRISPR gRNA sequence
tgttgcctgtgcttttgagg

SEQ ID NO: 499232 - DNA, 20 bp, Artificial
  CRISPR gRNA sequence
ttgcctgtgcttttgaggtc

SEQ ID NO: 499233 - DNA, 20 bp, Artificial
  CRISPR gRNA sequence
cctgtgcttttgaggtctta

SEQ ID NO: 499234 - DNA, 20 bp, Artificial
  CRISPR gRNA sequence
tgcttttgaggtcttattca

SEQ ID NO: 499235 - DNA, 20 bp, Artificial
  CRISPR gRNA sequence
ttgaggtcttattcataaac

SEQ ID NO: 499236 - DNA, 20 bp, Artificial
  CRISPR gRNA sequence
tgaggtcttattcataaact

SEQ ID NO: 499237 - DNA, 20 bp, Artificial
  CRISPR gRNA sequence
gaggtcttattcataaactc

SEQ ID NO: 499238 - DNA, 20 bp, Artificial
  CRISPR gRNA sequence
aggtcttattcataaactct

SEQ ID NO: 499239 - DNA, 20 bp, Artificial
  CRISPR gRNA sequence
attcataaactctttcccca

SEQ ID NO: 499240 - DNA, 20 bp, Artificial
  CRISPR gRNA sequence
ttcataaactctttccccag

SEQ ID NO: 499241 - DNA, 20 bp, Artificial
  CRISPR gRNA sequence
ataaactctttccccagccc

SEQ ID NO: 499242 - DNA, 20 bp, Artificial
  CRISPR gRNA sequence
tttccccagcccttattatg

SEQ ID NO: 499243 - DNA, 20 bp, Artificial
  CRISPR gRNA sequence
tccccagcccttattatgct

SEQ ID NO: 499244 - DNA, 20 bp, Artificial
  CRISPR gRNA sequence
ccccagcccttattatgctc

SEQ ID NO: 499245 - DNA, 20 bp, Artificial
  CRISPR gRNA sequence
cccagcccttattatgctcc

SEQ ID NO: 499246 - DNA, 20 bp, Artificial
  CRISPR gRNA sequence
attatgctccaagaactatg

SEQ ID NO: 499247 - DNA, 20 bp, Artificial
  CRISPR gRNA sequence
ttatgctccaagaactatgc

SEQ ID NO: 499248 - DNA, 20 bp, Artificial
  CRISPR gRNA sequence
tgctccaagaactatgcaag

SEQ ID NO: 499249 - DNA, 20 bp, Artificial
  CRISPR gRNA sequence
caagaactatgcaaggtttt

SEQ ID NO: 499250 - DNA, 20 bp, Artificial
  CRISPR gRNA sequence
tgcaaggttttgtgggggaa

SEQ ID NO: 499251 - DNA, 20 bp, Artificial
  CRISPR gRNA sequence
tgtgggggaaacaaagatga

SEQ ID NO: 499252 - DNA, 20 bp, Artificial
  CRISPR gRNA sequence
gtgggggaaacaaagatgaa

SEQ ID NO: 499253 - DNA, 20 bp, Artificial
  CRISPR gRNA sequence
tgggggaaacaaagatgaaa

SEQ ID NO: 499254 - DNA, 20 bp, Artificial
  CRISPR gRNA sequence
ttctacccttaagaatcttt

SEQ ID NO: 499255 - DNA, 20 bp, Artificial
  CRISPR gRNA sequence
tacccttaagaatctttcag

SEQ ID NO: 499256 - DNA, 20 bp, Artificial
  CRISPR gRNA sequence
cccttaagaatctttcagac

SEQ ID NO: 499257 - DNA, 20 bp, Artificial
  CRISPR gRNA sequence
aagaatctttcagacagagg

SEQ ID NO: 499258 - DNA, 20 bp, Artificial
  CRISPR gRNA sequence
agaatctttcagacagagga

SEQ ID NO: 499259 - DNA, 20 bp, Artificial
  CRISPR gRNA sequence
tcagacagaggaaaatgggt

SEQ ID NO: 499260 - DNA, 20 bp, Artificial
  CRISPR gRNA sequence
cagacagaggaaaatgggta

SEQ ID NO: 499261 - DNA, 20 bp, Artificial
  CRISPR gRNA sequence
agacagaggaaaatgggtat

SEQ ID NO: 499262 - DNA, 20 bp, Artificial
  CRISPR gRNA sequence
caactataagggaagatgga

SEQ ID NO: 499263 - DNA, 20 bp, Artificial
  CRISPR gRNA sequence
taagggaagatggaaatgct

SEQ ID NO: 499264 - DNA, 20 bp, Artificial
  CRISPR gRNA sequence
tgtgtcattaacaggcaaga

SEQ ID NO: 499265 - DNA, 20 bp, Artificial
  CRISPR gRNA sequence
acaggcaagatacatttaga

SEQ ID NO: 499266 - DNA, 20 bp, Artificial
  CRISPR gRNA sequence
agaataaaaaaggagctaag

SEQ ID NO: 499267 - DNA, 20 bp, Artificial
  CRISPR gRNA sequence
gaataaaaaaggagctaaga

SEQ ID NO: 499268 - DNA, 20 bp, Artificial
  CRISPR gRNA sequence
agaagatgaagattccttct

SEQ ID NO: 499269 - DNA, 20 bp, Artificial
  CRISPR gRNA sequence
cttctaggtaggaacactgg

SEQ ID NO: 499270 - DNA, 20 bp, Artificial
  CRISPR gRNA sequence
ctaggtaggaacactgggga

SEQ ID NO: 499271 - DNA, 20 bp, Artificial
  CRISPR gRNA sequence
taggtaggaacactggggaa

SEQ ID NO: 499272 - DNA, 20 bp, Artificial
  CRISPR gRNA sequence
ggtaggaacactggggaact

SEQ ID NO: 499273 - DNA, 20 bp, Artificial
  CRISPR gRNA sequence
gggaactggccttgaagaat

SEQ ID NO: 499274 - DNA, 20 bp, Artificial
  CRISPR gRNA sequence
gccttgaagaataaataaga

SEQ ID NO: 499275 - DNA, 20 bp, Artificial
  CRISPR gRNA sequence
gaagaataaataagagttta

SEQ ID NO: 499276 - DNA, 20 bp, Artificial
  CRISPR gRNA sequence
aagaataaataagagtttag

SEQ ID NO: 499277 - DNA, 20 bp, Artificial
  CRISPR gRNA sequence
aggaggtaggtacaaagtag

SEQ ID NO: 499278 - DNA, 20 bp, Artificial
  CRISPR gRNA sequence
ggaggtaggtacaaagtaga

SEQ ID NO: 499279 - DNA, 20 bp, Artificial
  CRISPR gRNA sequence
aagcagaggaaacagctcag

SEQ ID NO: 499280 - DNA, 20 bp, Artificial
  CRISPR gRNA sequence
agaaaagccagggttgcatg

SEQ ID NO: 499281 - DNA, 20 bp, Artificial
  CRISPR gRNA sequence
catggggtttggatgggaaa

SEQ ID NO: 499282 - DNA, 20 bp, Artificial
  CRISPR gRNA sequence
ggatgggaaacaggaaaggg

SEQ ID NO: 499283 - DNA, 20 bp, Artificial
  CRISPR gRNA sequence
gatgggaaacaggaaaggga

SEQ ID NO: 499284 - DNA, 20 bp, Artificial
  CRISPR gRNA sequence
gttatcatggagaaacaata

SEQ ID NO: 499285 - DNA, 20 bp, Artificial
  CRISPR gRNA sequence
ttatcatggagaaacaatat

SEQ ID NO: 499286 - DNA, 20 bp, Artificial
  CRISPR gRNA sequence
tcatggagaaacaatatcac

SEQ ID NO: 499287 - DNA, 20 bp, Artificial
  CRISPR gRNA sequence
ggttaactgatgcaaagagt

SEQ ID NO: 499288 - DNA, 20 bp, Artificial
  CRISPR gRNA sequence
gttaactgatgcaaagagtg

SEQ ID NO: 499289 - DNA, 20 bp, Artificial
  CRISPR gRNA sequence
actgatgcaaagagtgggac

SEQ ID NO: 499290 - DNA, 20 bp, Artificial
  CRISPR gRNA sequence
atgcaaagagtgggacttgg

SEQ ID NO: 499291 - DNA, 20 bp, Artificial
  CRISPR gRNA sequence
gggctaggtgagttttgaca

SEQ ID NO: 499292 - DNA, 20 bp, Artificial
  CRISPR gRNA sequence
ggctaggtgagttttgacag

SEQ ID NO: 499293 - DNA, 20 bp, Artificial
  CRISPR gRNA sequence
ggtgagttttgacagaggta

SEQ ID NO: 499294 - DNA, 20 bp, Artificial
  CRISPR gRNA sequence
tgacagaggtaagggagttg

SEQ ID NO: 499295 - DNA, 20 bp, Artificial
  CRISPR gRNA sequence
gacagaggtaagggagttgc

SEQ ID NO: 499296 - DNA, 20 bp, Artificial
  CRISPR gRNA sequence
acagaggtaagggagttgca

SEQ ID NO: 499297 - DNA, 20 bp, Artificial
  CRISPR gRNA sequence
cattgcctgaggaagagagt

SEQ ID NO: 499298 - DNA, 20 bp, Artificial
  CRISPR gRNA sequence
cctgaggaagagagttaata

SEQ ID NO: 499299 - DNA, 20 bp, Artificial
  CRISPR gRNA sequence
aggaagagagttaatatggt

SEQ ID NO: 499300 - DNA, 20 bp, Artificial
  CRISPR gRNA sequence
atatggtcagtatgaagcta

SEQ ID NO: 499301 - DNA, 20 bp, Artificial
  CRISPR gRNA sequence
aatagagaggaagaaagaaa

SEQ ID NO: 499302 - DNA, 20 bp, Artificial
  CRISPR gRNA sequence
taggatactttatctatctt

SEQ ID NO: 499303 - DNA, 20 bp, Artificial
  CRISPR gRNA sequence
tatctatcttatgattttgc

SEQ ID NO: 499304 - DNA, 20 bp, Artificial
  CRISPR gRNA sequence
atctatcttatgattttgcc

SEQ ID NO: 499305 - DNA, 20 bp, Artificial
  CRISPR gRNA sequence
tctatcttatgattttgccc

SEQ ID NO: 499306 - DNA, 20 bp, Artificial
  CRISPR gRNA sequence
tcttatgattttgccctgac

SEQ ID NO: 499307 - DNA, 20 bp, Artificial
  CRISPR gRNA sequence
atgattttgccctgactaga

SEQ ID NO: 499308 - DNA, 20 bp, Artificial
  CRISPR gRNA sequence
tgattttgccctgactagag

SEQ ID NO: 499309 - DNA, 20 bp, Artificial
  CRISPR gRNA sequence
tgccctgactagagctggat

SEQ ID NO: 499310 - DNA, 20 bp, Artificial
  CRISPR gRNA sequence
gccctgactagagctggatt

SEQ ID NO: 499311 - DNA, 20 bp, Artificial
  CRISPR gRNA sequence
ccctgactagagctggattg

SEQ ID NO: 499312 - DNA, 20 bp, Artificial
  CRISPR gRNA sequence
actagagctggattgcccca

SEQ ID NO: 499313 - DNA, 20 bp, Artificial
  CRISPR gRNA sequence
gagctggattgccccagtac

SEQ ID NO: 499314 - DNA, 20 bp, Artificial
  CRISPR gRNA sequence
gattgccccagtacttttgg

SEQ ID NO: 499315 - DNA, 20 bp, Artificial
  CRISPR gRNA sequence
ccccagtacttttggaatct

SEQ ID NO: 499316 - DNA, 20 bp, Artificial
  CRISPR gRNA sequence
ttggaatctcactggactct

SEQ ID NO: 499317 - DNA, 20 bp, Artificial
  CRISPR gRNA sequence
tggaatctcactggactctg

SEQ ID NO: 499318 - DNA, 20 bp, Artificial
  CRISPR gRNA sequence
ggaatctcactggactctgt

SEQ ID NO: 499319 - DNA, 20 bp, Artificial
  CRISPR gRNA sequence
gaatctcactggactctgtt

SEQ ID NO: 499320 - DNA, 20 bp, Artificial
  CRISPR gRNA sequence
actggactctgttcacttag

SEQ ID NO: 499321 - DNA, 20 bp, Artificial
  CRISPR gRNA sequence
gactctgttcacttagtccc

SEQ ID NO: 499322 - DNA, 20 bp, Artificial
  CRISPR gRNA sequence
tgttcacttagtccccagca

SEQ ID NO: 499323 - DNA, 20 bp, Artificial
  CRISPR gRNA sequence
ttcacttagtccccagcagg

SEQ ID NO: 499324 - DNA, 20 bp, Artificial
  CRISPR gRNA sequence
acttagtccccagcaggtac

SEQ ID NO: 499325 - DNA, 20 bp, Artificial
  CRISPR gRNA sequence
agtccccagcaggtacatct

SEQ ID NO: 499326 - DNA, 20 bp, Artificial
  CRISPR gRNA sequence
gtccccagcaggtacatctt

SEQ ID NO: 499327 - DNA, 20 bp, Artificial
  CRISPR gRNA sequence
ttgatgccttcaccccaagc

SEQ ID NO: 499328 - DNA, 20 bp, Artificial
  CRISPR gRNA sequence
tgatgccttcaccccaagcc

SEQ ID NO: 499329 - DNA, 20 bp, Artificial
  CRISPR gRNA sequence
gatgccttcaccccaagcct

SEQ ID NO: 499330 - DNA, 20 bp, Artificial
  CRISPR gRNA sequence
atgccttcaccccaagcctg

SEQ ID NO: 499331 - DNA, 20 bp, Artificial
  CRISPR gRNA sequence
caccccaagcctggtagcac

SEQ ID NO: 499332 - DNA, 20 bp, Artificial
  CRISPR gRNA sequence
accccaagcctggtagcaca

SEQ ID NO: 499333 - DNA, 20 bp, Artificial
  CRISPR gRNA sequence
gtagcacaagccctagctga

SEQ ID NO: 499334 - DNA, 20 bp, Artificial
  CRISPR gRNA sequence
gctgagaaaaccttaacatc

SEQ ID NO: 499335 - DNA, 20 bp, Artificial
  CRISPR gRNA sequence
agaaaaccttaacatctatt

SEQ ID NO: 499336 - DNA, 20 bp, Artificial
  CRISPR gRNA sequence
aacatctatttgttggctgg

SEQ ID NO: 499337 - DNA, 20 bp, Artificial
  CRISPR gRNA sequence
acatctatttgttggctggt

SEQ ID NO: 499338 - DNA, 20 bp, Artificial
  CRISPR gRNA sequence
tttgttggctggtggaaatt

SEQ ID NO: 499339 - DNA, 20 bp, Artificial
  CRISPR gRNA sequence
gttggctggtggaaattcca

SEQ ID NO: 499340 - DNA, 20 bp, Artificial
  CRISPR gRNA sequence
ttggctggtggaaattccac

SEQ ID NO: 499341 - DNA, 20 bp, Artificial
  CRISPR gRNA sequence
gctggtggaaattccacttg

SEQ ID NO: 499342 - DNA, 20 bp, Artificial
  CRISPR gRNA sequence
gtggaaattccacttgctct

SEQ ID NO: 499343 - DNA, 20 bp, Artificial
  CRISPR gRNA sequence
cacttgctctgagaccctcc

SEQ ID NO: 499344 - DNA, 20 bp, Artificial
  CRISPR gRNA sequence
gctctgagaccctcccgtgc

SEQ ID NO: 499345 - DNA, 20 bp, Artificial
  CRISPR gRNA sequence
ctctgagaccctcccgtgct

SEQ ID NO: 499346 - DNA, 20 bp, Artificial
  CRISPR gRNA sequence
tgagaccctcccgtgctcct

SEQ ID NO: 499347 - DNA, 20 bp, Artificial
  CRISPR gRNA sequence
agaccctcccgtgctccttc

SEQ ID NO: 499348 - DNA, 20 bp, Artificial
  CRISPR gRNA sequence
ccgtgctccttctcccaggt

SEQ ID NO: 499349 - DNA, 20 bp, Artificial
  CRISPR gRNA sequence
cttctcccaggtgctcaggc

SEQ ID NO: 499350 - DNA, 20 bp, Artificial
  CRISPR gRNA sequence
ctcccaggtgctcaggcccc

SEQ ID NO: 499351 - DNA, 20 bp, Artificial
  CRISPR gRNA sequence
tcccaggtgctcaggcccca

SEQ ID NO: 499352 - DNA, 20 bp, Artificial
  CRISPR gRNA sequence
ccaggtgctcaggccccaca

SEQ ID NO: 499353 - DNA, 20 bp, Artificial
  CRISPR gRNA sequence
aggccccacaccttcctccg

SEQ ID NO: 499354 - DNA, 20 bp, Artificial
  CRISPR gRNA sequence
cctccgactggcaggtccag

SEQ ID NO: 499355 - DNA, 20 bp, Artificial
  CRISPR gRNA sequence
ctccgactggcaggtccagg

SEQ ID NO: 499356 - DNA, 20 bp, Artificial
  CRISPR gRNA sequence
cgactggcaggtccaggttg

SEQ ID NO: 499357 - DNA, 20 bp, Artificial
  CRISPR gRNA sequence
gcaggtccaggttggaggaa

SEQ ID NO: 499358 - DNA, 20 bp, Artificial
  CRISPR gRNA sequence
gaggaagctgagctgactca

SEQ ID NO: 499359 - DNA, 20 bp, Artificial
  CRISPR gRNA sequence
agctgactcagagctctgca

SEQ ID NO: 499360 - DNA, 20 bp, Artificial
  CRISPR gRNA sequence
actcagagctctgcacatgg

SEQ ID NO: 499361 - DNA, 20 bp, Artificial
  CRISPR gRNA sequence
agagctctgcacatgggctc

SEQ ID NO: 499362 - DNA, 20 bp, Artificial
  CRISPR gRNA sequence
tgcacatgggctcagggctg

SEQ ID NO: 499363 - DNA, 20 bp, Artificial
  CRISPR gRNA sequence
cacatgggctcagggctgag

SEQ ID NO: 499364 - DNA, 20 bp, Artificial
  CRISPR gRNA sequence
agggctgagcgggactcact

SEQ ID NO: 499365 - DNA, 20 bp, Artificial
  CRISPR gRNA sequence
agcgggactcactgctggat

SEQ ID NO: 499366 - DNA, 20 bp, Artificial
  CRISPR gRNA sequence
actgctggatcagattgtct

SEQ ID NO: 499367 - DNA, 20 bp, Artificial
  CRISPR gRNA sequence
ctggatcagattgtctcctt

SEQ ID NO: 499368 - DNA, 20 bp, Artificial
  CRISPR gRNA sequence
gatcagattgtctccttcac

SEQ ID NO: 499369 - DNA, 20 bp, Artificial
  CRISPR gRNA sequence
tctccttcaccatcctctgt

SEQ ID NO: 499370 - DNA, 20 bp, Artificial
  CRISPR gRNA sequence
cttcaccatcctctgtactt

SEQ ID NO: 499371 - DNA, 20 bp, Artificial
  CRISPR gRNA sequence
caccatcctctgtacttgtc

SEQ ID NO: 499372 - DNA, 20 bp, Artificial
  CRISPR gRNA sequence
accatcctctgtacttgtct

SEQ ID NO: 499373 - DNA, 20 bp, Artificial
  CRISPR gRNA sequence
tgtacttgtctccttgacca

SEQ ID NO: 499374 - DNA, 20 bp, Artificial
  CRISPR gRNA sequence
tacttgtctccttgaccatc

SEQ ID NO: 499375 - DNA, 20 bp, Artificial
  CRISPR gRNA sequence
gtctccttgaccatcctctg

SEQ ID NO: 499376 - DNA, 20 bp, Artificial
  CRISPR gRNA sequence
tctccttgaccatcctctgt

SEQ ID NO: 499377 - DNA, 20 bp, Artificial
  CRISPR gRNA sequence
cttgaccatcctctgttctt

SEQ ID NO: 499378 - DNA, 20 bp, Artificial
  CRISPR gRNA sequence
gaccatcctctgttcttcct

SEQ ID NO: 499379 - DNA, 20 bp, Artificial
  CRISPR gRNA sequence
accatcctctgttcttcctg

SEQ ID NO: 499380 - DNA, 20 bp, Artificial
  CRISPR gRNA sequence
tgttcttcctgaggctgcag

SEQ ID NO: 499381 - DNA, 20 bp, Artificial
  CRISPR gRNA sequence
ttcttcctgaggctgcagtg

SEQ ID NO: 499382 - DNA, 20 bp, Artificial
  CRISPR gRNA sequence
ttcctgaggctgcagtggag

SEQ ID NO: 499383 - DNA, 20 bp, Artificial
  CRISPR gRNA sequence
cctgaggctgcagtggagtt

SEQ ID NO: 499384 - DNA, 20 bp, Artificial
  CRISPR gRNA sequence
ctgaggctgcagtggagtta

SEQ ID NO: 499385 - DNA, 20 bp, Artificial
  CRISPR gRNA sequence
aggctgcagtggagttaatc

SEQ ID NO: 499386 - DNA, 20 bp, Artificial
  CRISPR gRNA sequence
cagtggagttaatcatctgc

SEQ ID NO: 499387 - DNA, 20 bp, Artificial
  CRISPR gRNA sequence
atcatctgccctctgccctc

SEQ ID NO: 499388 - DNA, 20 bp, Artificial
  CRISPR gRNA sequence
ccctctgccctccctttcag

SEQ ID NO: 499389 - DNA, 20 bp, Artificial
  CRISPR gRNA sequence
tgccctccctttcagagtta

SEQ ID NO: 499390 - DNA, 20 bp, Artificial
  CRISPR gRNA sequence
ccctccctttcagagttact

SEQ ID NO: 499391 - DNA, 20 bp, Artificial
  CRISPR gRNA sequence
cctttcagagttactagttc

SEQ ID NO: 499392 - DNA, 20 bp, Artificial
  CRISPR gRNA sequence
tcagagttactagttcacct

SEQ ID NO: 499393 - DNA, 20 bp, Artificial
  CRISPR gRNA sequence
cagagttactagttcacctc

SEQ ID NO: 499394 - DNA, 20 bp, Artificial
  CRISPR gRNA sequence
agagttactagttcacctca

SEQ ID NO: 499395 - DNA, 20 bp, Artificial
  CRISPR gRNA sequence
ctagttcacctcatccgttc

SEQ ID NO: 499396 - DNA, 20 bp, Artificial
  CRISPR gRNA sequence
gttcacctcatccgttctta

SEQ ID NO: 499397 - DNA, 20 bp, Artificial
  CRISPR gRNA sequence
acctcatccgttcttaacca

SEQ ID NO: 499398 - DNA, 20 bp, Artificial
  CRISPR gRNA sequence
atccgttcttaaccacagga

SEQ ID NO: 499399 - DNA, 20 bp, Artificial
  CRISPR gRNA sequence
ttaaccacaggaaggtggcc

SEQ ID NO: 499400 - DNA, 20 bp, Artificial
  CRISPR gRNA sequence
aaccacaggaaggtggcccc

SEQ ID NO: 499401 - DNA, 20 bp, Artificial
  CRISPR gRNA sequence
accacaggaaggtggccccc

SEQ ID NO: 499402 - DNA, 20 bp, Artificial
  CRISPR gRNA sequence
ctgagcagtagcaacagcag

SEQ ID NO: 499403 - DNA, 20 bp, Artificial
  CRISPR gRNA sequence
agcagtagcaacagcagtgg

SEQ ID NO: 499404 - DNA, 20 bp, Artificial
  CRISPR gRNA sequence
cctggactgtggcctctttc

SEQ ID NO: 499405 - DNA, 20 bp, Artificial
  CRISPR gRNA sequence
ctggactgtggcctctttcc

SEQ ID NO: 499406 - DNA, 20 bp, Artificial
  CRISPR gRNA sequence
gactgtggcctctttcctct

SEQ ID NO: 499407 - DNA, 20 bp, Artificial
  CRISPR gRNA sequence
tggcctctttcctctaaaca

SEQ ID NO: 499408 - DNA, 20 bp, Artificial
  CRISPR gRNA sequence
tttcctctaaacaattttca

SEQ ID NO: 499409 - DNA, 20 bp, Artificial
  CRISPR gRNA sequence
tcctctaaacaattttcact

SEQ ID NO: 499410 - DNA, 20 bp, Artificial
  CRISPR gRNA sequence
cctctaaacaattttcactt

SEQ ID NO: 499411 - DNA, 20 bp, Artificial
  CRISPR gRNA sequence
ctctaaacaattttcacttg

SEQ ID NO: 499412 - DNA, 20 bp, Artificial
  CRISPR gRNA sequence
taaacaattttcacttgttg

SEQ ID NO: 499413 - DNA, 20 bp, Artificial
  CRISPR gRNA sequence
aacaattttcacttgttggg

SEQ ID NO: 499414 - DNA, 20 bp, Artificial
  CRISPR gRNA sequence
tcacttgttgggtcctcctc

SEQ ID NO: 499415 - DNA, 20 bp, Artificial
  CRISPR gRNA sequence
cacttgttgggtcctcctct

SEQ ID NO: 499416 - DNA, 20 bp, Artificial
  CRISPR gRNA sequence
acttgttgggtcctcctcta

SEQ ID NO: 499417 - DNA, 20 bp, Artificial
  CRISPR gRNA sequence
gttgggtcctcctctatgcc

SEQ ID NO: 499418 - DNA, 20 bp, Artificial
  CRISPR gRNA sequence
ttgggtcctcctctatgcct

SEQ ID NO: 499419 - DNA, 20 bp, Artificial
  CRISPR gRNA sequence
ggtcctcctctatgcctcac

SEQ ID NO: 499420 - DNA, 20 bp, Artificial
  CRISPR gRNA sequence
ctctatgcctcactaaatgt

SEQ ID NO: 499421 - DNA, 20 bp, Artificial
  CRISPR gRNA sequence
tatgcctcactaaatgtgtg

SEQ ID NO: 499422 - DNA, 20 bp, Artificial
  CRISPR gRNA sequence
tgcctcactaaatgtgtgag

SEQ ID NO: 499423 - DNA, 20 bp, Artificial
  CRISPR gRNA sequence
actaaatgtgtgagaacttg

SEQ ID NO: 499424 - DNA, 20 bp, Artificial
  CRISPR gRNA sequence
aatgtgtgagaacttgtgtt

SEQ ID NO: 499425 - DNA, 20 bp, Artificial
  CRISPR gRNA sequence
gtgttgaagttatgttttcg

SEQ ID NO: 499426 - DNA, 20 bp, Artificial
  CRISPR gRNA sequence
tgttgaagttatgttttcgt

SEQ ID NO: 499427 - DNA, 20 bp, Artificial
  CRISPR gRNA sequence
aagttatgttttcgtagtag

SEQ ID NO: 499428 - DNA, 20 bp, Artificial
  CRISPR gRNA sequence
tgttttcgtagtagcatttc

SEQ ID NO: 499429 - DNA, 20 bp, Artificial
  CRISPR gRNA sequence
tcgtagtagcatttcatctc

SEQ ID NO: 499430 - DNA, 20 bp, Artificial
  CRISPR gRNA sequence
cgtagtagcatttcatctcc

SEQ ID NO: 499431 - DNA, 20 bp, Artificial
  CRISPR gRNA sequence
gtagtagcatttcatctccc

SEQ ID NO: 499432 - DNA, 20 bp, Artificial
  CRISPR gRNA sequence
catctcccctatctggtgtg

SEQ ID NO: 499433 - DNA, 20 bp, Artificial
  CRISPR gRNA sequence
atctcccctatctggtgtgt

SEQ ID NO: 499434 - DNA, 20 bp, Artificial
  CRISPR gRNA sequence
ccctatctggtgtgtgtacc

SEQ ID NO: 499435 - DNA, 20 bp, Artificial
  CRISPR gRNA sequence
tctggtgtgtgtacccctct

SEQ ID NO: 499436 - DNA, 20 bp, Artificial
  CRISPR gRNA sequence
gtgtgtgtacccctctggga

SEQ ID NO: 499437 - DNA, 20 bp, Artificial
  CRISPR gRNA sequence
tgggacagaaactgaggtct

SEQ ID NO: 499438 - DNA, 20 bp, Artificial
  CRISPR gRNA sequence
ggacagaaactgaggtcttt

SEQ ID NO: 499439 - DNA, 20 bp, Artificial
  CRISPR gRNA sequence
aggtctttctgtatcagtca

SEQ ID NO: 499440 - DNA, 20 bp, Artificial
  CRISPR gRNA sequence
tctgtatcagtcacaatacc

SEQ ID NO: 499441 - DNA, 20 bp, Artificial
  CRISPR gRNA sequence
ctgtatcagtcacaataccc

SEQ ID NO: 499442 - DNA, 20 bp, Artificial
  CRISPR gRNA sequence
tgtatcagtcacaataccct

SEQ ID NO: 499443 - DNA, 20 bp, Artificial
  CRISPR gRNA sequence
tatcagtcacaataccctgg

SEQ ID NO: 499444 - DNA, 20 bp, Artificial
  CRISPR gRNA sequence
gacatagtgacttgtctact

SEQ ID NO: 499445 - DNA, 20 bp, Artificial
  CRISPR gRNA sequence
gtctacttgccttttcaccg

SEQ ID NO: 499446 - DNA, 20 bp, Artificial
  CRISPR gRNA sequence
tctacttgccttttcaccgt

SEQ ID NO: 499447 - DNA, 20 bp, Artificial
  CRISPR gRNA sequence
cttgccttttcaccgtatct

SEQ ID NO: 499448 - DNA, 20 bp, Artificial
  CRISPR gRNA sequence
gccttttcaccgtatctgct

SEQ ID NO: 499449 - DNA, 20 bp, Artificial
  CRISPR gRNA sequence
ccttttcaccgtatctgctt

SEQ ID NO: 499450 - DNA, 20 bp, Artificial
  CRISPR gRNA sequence
ttcaccgtatctgctttgca

SEQ ID NO: 499451 - DNA, 20 bp, Artificial
  CRISPR gRNA sequence
tcaccgtatctgctttgcac

SEQ ID NO: 499452 - DNA, 20 bp, Artificial
  CRISPR gRNA sequence
caccgtatctgctttgcacc

SEQ ID NO: 499453 - DNA, 20 bp, Artificial
  CRISPR gRNA sequence
accgtatctgctttgcaccc

SEQ ID NO: 499454 - DNA, 20 bp, Artificial
  CRISPR gRNA sequence
ctttgcacccctgccctggc

SEQ ID NO: 499455 - DNA, 20 bp, Artificial
  CRISPR gRNA sequence
tgcacccctgccctggcacc

SEQ ID NO: 499456 - DNA, 20 bp, Artificial
  CRISPR gRNA sequence
gcacccctgccctggcaccc

SEQ ID NO: 499457 - DNA, 20 bp, Artificial
  CRISPR gRNA sequence
cacccctgccctggcaccca

SEQ ID NO: 499458 - DNA, 20 bp, Artificial
  CRISPR gRNA sequence
ccctggcacccaccccttcc

SEQ ID NO: 499459 - DNA, 20 bp, Artificial
  CRISPR gRNA sequence
gcacccaccccttccaggcc

SEQ ID NO: 499460 - DNA, 20 bp, Artificial
  CRISPR gRNA sequence
ccaggccgtccatggaaact

SEQ ID NO: 499461 - DNA, 20 bp, Artificial
  CRISPR gRNA sequence
caggccgtccatggaaactc

SEQ ID NO: 499462 - DNA, 20 bp, Artificial
  CRISPR gRNA sequence
attccaaccatcttcctcct

SEQ ID NO: 499463 - DNA, 20 bp, Artificial
  CRISPR gRNA sequence
caaccatcttcctccttccc

SEQ ID NO: 499464 - DNA, 20 bp, Artificial
  CRISPR gRNA sequence
cctccttcccacactggact

SEQ ID NO: 499465 - DNA, 20 bp, Artificial
  CRISPR gRNA sequence
ctccttcccacactggactg

SEQ ID NO: 499466 - DNA, 20 bp, Artificial
  CRISPR gRNA sequence
cttcccacactggactgttg

SEQ ID NO: 499467 - DNA, 20 bp, Artificial
  CRISPR gRNA sequence
cccacactggactgttgggg

SEQ ID NO: 499468 - DNA, 20 bp, Artificial
  CRISPR gRNA sequence
ccacactggactgttggggg

SEQ ID NO: 499469 - DNA, 20 bp, Artificial
  CRISPR gRNA sequence
gactgttgggggctgcagga

SEQ ID NO: 499470 - DNA, 20 bp, Artificial
  CRISPR gRNA sequence
ttgggggctgcaggagaaaa

SEQ ID NO: 499471 - DNA, 20 bp, Artificial
  CRISPR gRNA sequence
ggggctgcaggagaaaattc

SEQ ID NO: 499472 - DNA, 20 bp, Artificial
  CRISPR gRNA sequence
caggagaaaattcagcaaca

SEQ ID NO: 499473 - DNA, 20 bp, Artificial
  CRISPR gRNA sequence
agcaacaaagagcagctaca

SEQ ID NO: 499474 - DNA, 20 bp, Artificial
  CRISPR gRNA sequence
cagattcgtaatctccaacc

SEQ ID NO: 499475 - DNA, 20 bp, Artificial
  CRISPR gRNA sequence
gtaatctccaaccccagctg

SEQ ID NO: 499476 - DNA, 20 bp, Artificial
  CRISPR gRNA sequence
caaccccagctggactctca

SEQ ID NO: 499477 - DNA, 20 bp, Artificial
  CRISPR gRNA sequence
gactctcagtgtcctgggaa

SEQ ID NO: 499478 - DNA, 20 bp, Artificial
  CRISPR gRNA sequence
tcagtgtcctgggaatcctc

SEQ ID NO: 499479 - DNA, 20 bp, Artificial
  CRISPR gRNA sequence
agtgtcctgggaatcctcat

SEQ ID NO: 499480 - DNA, 20 bp, Artificial
  CRISPR gRNA sequence
ggaatcctcatttctggccc

SEQ ID NO: 499481 - DNA, 20 bp, Artificial
  CRISPR gRNA sequence
atttctggcccacagcttct

SEQ ID NO: 499482 - DNA, 20 bp, Artificial
  CRISPR gRNA sequence
ctggcccacagcttctcctg

SEQ ID NO: 499483 - DNA, 20 bp, Artificial
  CRISPR gRNA sequence
tggcccacagcttctcctgt

SEQ ID NO: 499484 - DNA, 20 bp, Artificial
  CRISPR gRNA sequence
gcccacagcttctcctgttc

SEQ ID NO: 499485 - DNA, 20 bp, Artificial
  CRISPR gRNA sequence
ctcctgttccccaaaaggtg

SEQ ID NO: 499486 - DNA, 20 bp, Artificial
  CRISPR gRNA sequence
tcctgttccccaaaaggtgg

SEQ ID NO: 499487 - DNA, 20 bp, Artificial
  CRISPR gRNA sequence
ctgttccccaaaaggtggga

SEQ ID NO: 499488 - DNA, 20 bp, Artificial
  CRISPR gRNA sequence
ttccccaaaaggtgggagaa

SEQ ID NO: 499489 - DNA, 20 bp, Artificial
  CRISPR gRNA sequence
cccaaaaggtgggagaattc

SEQ ID NO: 499490 - DNA, 20 bp, Artificial
  CRISPR gRNA sequence
cacaccttcgtcatctcttt

SEQ ID NO: 499491 - DNA, 20 bp, Artificial
  CRISPR gRNA sequence
cgtcatctctttcaaggccc

SEQ ID NO: 499492 - DNA, 20 bp, Artificial
  CRISPR gRNA sequence
gtcatctctttcaaggccct

SEQ ID NO: 499493 - DNA, 20 bp, Artificial
  CRISPR gRNA sequence
tttcaaggccctgttccact

SEQ ID NO: 499494 - DNA, 20 bp, Artificial
  CRISPR gRNA sequence
tcaaggccctgttccactat

SEQ ID NO: 499495 - DNA, 20 bp, Artificial
  CRISPR gRNA sequence
caaggccctgttccactatc

SEQ ID NO: 499496 - DNA, 20 bp, Artificial
  CRISPR gRNA sequence
aaggccctgttccactatct

SEQ ID NO: 499497 - DNA, 20 bp, Artificial
  CRISPR gRNA sequence
ttccactatctcagcctcca

SEQ ID NO: 499498 - DNA, 20 bp, Artificial
  CRISPR gRNA sequence
cactatctcagcctccacaa

SEQ ID NO: 499499 - DNA, 20 bp, Artificial
  CRISPR gRNA sequence
tctcagcctccacaaaccaa

SEQ ID NO: 499500 - DNA, 20 bp, Artificial
  CRISPR gRNA sequence
agcctccacaaaccaacaac

SEQ ID NO: 499501 - DNA, 20 bp, Artificial
  CRISPR gRNA sequence
cacaaaccaacaacctcctt

SEQ ID NO: 499502 - DNA, 20 bp, Artificial
  CRISPR gRNA sequence
cttctttaagaaaacagaag

SEQ ID NO: 499503 - DNA, 20 bp, Artificial
  CRISPR gRNA sequence
ctttaagaaaacagaagcac

SEQ ID NO: 499504 - DNA, 20 bp, Artificial
  CRISPR gRNA sequence
tttaagaaaacagaagcaca

SEQ ID NO: 499505 - DNA, 20 bp, Artificial
  CRISPR gRNA sequence
taagaaaacagaagcacaag

SEQ ID NO: 499506 - DNA, 20 bp, Artificial
  CRISPR gRNA sequence
aagaaaacagaagcacaagt

SEQ ID NO: 499507 - DNA, 20 bp, Artificial
  CRISPR gRNA sequence
agaaaacagaagcacaagtt

SEQ ID NO: 499508 - DNA, 20 bp, Artificial
  CRISPR gRNA sequence
gggattccaccaaccttgcc

SEQ ID NO: 499509 - DNA, 20 bp, Artificial
  CRISPR gRNA sequence
caccaaccttgccaacaagt

SEQ ID NO: 499510 - DNA, 20 bp, Artificial
  CRISPR gRNA sequence
gccaacaagtctccagtgtc

SEQ ID NO: 499511 - DNA, 20 bp, Artificial
  CRISPR gRNA sequence
ccaacaagtctccagtgtca

SEQ ID NO: 499512 - DNA, 20 bp, Artificial
  CRISPR gRNA sequence
cagtgtcaatgtacttcatc

SEQ ID NO: 499513 - DNA, 20 bp, Artificial
  CRISPR gRNA sequence
catctactcctgtaaatggc

SEQ ID NO: 499514 - DNA, 20 bp, Artificial
  CRISPR gRNA sequence
atctactcctgtaaatggcc

SEQ ID NO: 499515 - DNA, 20 bp, Artificial
  CRISPR gRNA sequence
ctcctgtaaatggccacatt

SEQ ID NO: 499516 - DNA, 20 bp, Artificial
  CRISPR gRNA sequence
ctgtaaatggccacatttgc

SEQ ID NO: 499517 - DNA, 20 bp, Artificial
  CRISPR gRNA sequence
taaatggccacatttgcctc

SEQ ID NO: 499518 - DNA, 20 bp, Artificial
  CRISPR gRNA sequence
gcctctgctgagggcaagag

SEQ ID NO: 499519 - DNA, 20 bp, Artificial
  CRISPR gRNA sequence
cctctgctgagggcaagagt

SEQ ID NO: 499520 - DNA, 20 bp, Artificial
  CRISPR gRNA sequence
tgctgagggcaagagtgttc

SEQ ID NO: 499521 - DNA, 20 bp, Artificial
  CRISPR gRNA sequence
ctgagggcaagagtgttctt

SEQ ID NO: 499522 - DNA, 20 bp, Artificial
  CRISPR gRNA sequence
agggcaagagtgttcttgcc

SEQ ID NO: 499523 - DNA, 20 bp, Artificial
  CRISPR gRNA sequence
ttgccctgtccttgaccaat

SEQ ID NO: 499524 - DNA, 20 bp, Artificial
  CRISPR gRNA sequence
gccctgtccttgaccaatac

SEQ ID NO: 499525 - DNA, 20 bp, Artificial
  CRISPR gRNA sequence
ccctgtccttgaccaatact

SEQ ID NO: 499526 - DNA, 20 bp, Artificial
  CRISPR gRNA sequence
tccttgaccaatactcccct

SEQ ID NO: 499527 - DNA, 20 bp, Artificial
  CRISPR gRNA sequence
gaccaatactcccctgtgtg

SEQ ID NO: 499528 - DNA, 20 bp, Artificial
  CRISPR gRNA sequence
accaatactcccctgtgtgc

SEQ ID NO: 499529 - DNA, 20 bp, Artificial
  CRISPR gRNA sequence
ccctgtgtgctcagggcacc

SEQ ID NO: 499530 - DNA, 20 bp, Artificial
  CRISPR gRNA sequence
tgtgctcagggcaccagagc

SEQ ID NO: 499531 - DNA, 20 bp, Artificial
  CRISPR gRNA sequence
agggcaccagagcttctttc

SEQ ID NO: 499532 - DNA, 20 bp, Artificial
  CRISPR gRNA sequence
ctttcagaagtcacctggga

SEQ ID NO: 499533 - DNA, 20 bp, Artificial
  CRISPR gRNA sequence
tttcagaagtcacctgggac

SEQ ID NO: 499534 - DNA, 20 bp, Artificial
  CRISPR gRNA sequence
tcagaagtcacctgggacct

SEQ ID NO: 499535 - DNA, 20 bp, Artificial
  CRISPR gRNA sequence
cagaagtcacctgggacctg

SEQ ID NO: 499536 - DNA, 20 bp, Artificial
  CRISPR gRNA sequence
agaagtcacctgggacctgc

SEQ ID NO: 499537 - DNA, 20 bp, Artificial
  CRISPR gRNA sequence
ggacctgctgtctgtgaaga

SEQ ID NO: 499538 - DNA, 20 bp, Artificial
  CRISPR gRNA sequence
ctgtctgtgaagacatccct

SEQ ID NO: 499539 - DNA, 20 bp, Artificial
  CRISPR gRNA sequence
tctgtgaagacatccctcat

SEQ ID NO: 499540 - DNA, 20 bp, Artificial
  CRISPR gRNA sequence
tgaagacatccctcatcttt

SEQ ID NO: 499541 - DNA, 20 bp, Artificial
  CRISPR gRNA sequence
atctttcttcagctgctcct

SEQ ID NO: 499542 - DNA, 20 bp, Artificial
  CRISPR gRNA sequence
tcttcagctgctccttttct

SEQ ID NO: 499543 - DNA, 20 bp, Artificial
  CRISPR gRNA sequence
cttcagctgctccttttctg

SEQ ID NO: 499544 - DNA, 20 bp, Artificial
  CRISPR gRNA sequence
ttcagctgctccttttctgt

SEQ ID NO: 499545 - DNA, 20 bp, Artificial
  CRISPR gRNA sequence
cagctgctccttttctgtgg

SEQ ID NO: 499546 - DNA, 20 bp, Artificial
  CRISPR gRNA sequence
agctgctccttttctgtggg

SEQ ID NO: 499547 - DNA, 20 bp, Artificial
  CRISPR gRNA sequence
ctccttttctgtgggcttcc

SEQ ID NO: 499548 - DNA, 20 bp, Artificial
  CRISPR gRNA sequence
cttttctgtgggcttcctac

SEQ ID NO: 499549 - DNA, 20 bp, Artificial
  CRISPR gRNA sequence
ttctgtgggcttcctacctt

SEQ ID NO: 499550 - DNA, 20 bp, Artificial
  CRISPR gRNA sequence
tctgtgggcttcctaccttt

SEQ ID NO: 499551 - DNA, 20 bp, Artificial
  CRISPR gRNA sequence
ctgtgggcttcctaccttta

SEQ ID NO: 499552 - DNA, 20 bp, Artificial
  CRISPR gRNA sequence
tgtgggcttcctacctttag

SEQ ID NO: 499553 - DNA, 20 bp, Artificial
  CRISPR gRNA sequence
tgggcttcctacctttagta

SEQ ID NO: 499554 - DNA, 20 bp, Artificial
  CRISPR gRNA sequence
cctacctttagtacagtttc

SEQ ID NO: 499555 - DNA, 20 bp, Artificial
  CRISPR gRNA sequence
ctacctttagtacagtttcc

SEQ ID NO: 499556 - DNA, 20 bp, Artificial
  CRISPR gRNA sequence
cctttagtacagtttccttc

SEQ ID NO: 499557 - DNA, 20 bp, Artificial
  CRISPR gRNA sequence
tagtacagtttccttccagt

SEQ ID NO: 499558 - DNA, 20 bp, Artificial
  CRISPR gRNA sequence
agtacagtttccttccagtt

SEQ ID NO: 499559 - DNA, 20 bp, Artificial
  CRISPR gRNA sequence
gtacagtttccttccagttg

SEQ ID NO: 499560 - DNA, 20 bp, Artificial
  CRISPR gRNA sequence
ccttccagttgaaaaatcaa

SEQ ID NO: 499561 - DNA, 20 bp, Artificial
  CRISPR gRNA sequence
cttccagttgaaaaatcaaa

SEQ ID NO: 499562 - DNA, 20 bp, Artificial
  CRISPR gRNA sequence
ccagttgaaaaatcaaaaca

SEQ ID NO: 499563 - DNA, 20 bp, Artificial
  CRISPR gRNA sequence
cagttgaaaaatcaaaacaa

SEQ ID NO: 499564 - DNA, 20 bp, Artificial
  CRISPR gRNA sequence
aaaaatcaaaacaacacctg

SEQ ID NO: 499565 - DNA, 20 bp, Artificial
  CRISPR gRNA sequence
gtgttctctctagctccttt

SEQ ID NO: 499566 - DNA, 20 bp, Artificial
  CRISPR gRNA sequence
tctctagctcctttttattt

SEQ ID NO: 499567 - DNA, 20 bp, Artificial
  CRISPR gRNA sequence
tctagctcctttttatttgc

SEQ ID NO: 499568 - DNA, 20 bp, Artificial
  CRISPR gRNA sequence
tagctcctttttatttgcag

SEQ ID NO: 499569 - DNA, 20 bp, Artificial
  CRISPR gRNA sequence
gctcctttttatttgcagac

SEQ ID NO: 499570 - DNA, 20 bp, Artificial
  CRISPR gRNA sequence
ctttttatttgcagacaaac

SEQ ID NO: 499571 - DNA, 20 bp, Artificial
  CRISPR gRNA sequence
tttatttgcagacaaaccag

SEQ ID NO: 499572 - DNA, 20 bp, Artificial
  CRISPR gRNA sequence
ttatttgcagacaaaccagt

SEQ ID NO: 499573 - DNA, 20 bp, Artificial
  CRISPR gRNA sequence
tatttgcagacaaaccagtc

SEQ ID NO: 499574 - DNA, 20 bp, Artificial
  CRISPR gRNA sequence
atttgcagacaaaccagtct

SEQ ID NO: 499575 - DNA, 20 bp, Artificial
  CRISPR gRNA sequence
tttgcagacaaaccagtctt

SEQ ID NO: 499576 - DNA, 20 bp, Artificial
  CRISPR gRNA sequence
gcagacaaaccagtcttaaa

SEQ ID NO: 499577 - DNA, 20 bp, Artificial
  CRISPR gRNA sequence
cagacaaaccagtcttaaat

SEQ ID NO: 499578 - DNA, 20 bp, Artificial
  CRISPR gRNA sequence
aaatgtataaactaatataa

SEQ ID NO: 499579 - DNA, 20 bp, Artificial
  CRISPR gRNA sequence
aatgtataaactaatataat

SEQ ID NO: 499580 - DNA, 20 bp, Artificial
  CRISPR gRNA sequence
atataatattacataaaaat

SEQ ID NO: 499581 - DNA, 20 bp, Artificial
  CRISPR gRNA sequence
cataaaaataaaatataacg

SEQ ID NO: 499582 - DNA, 20 bp, Artificial
  CRISPR gRNA sequence
atttttaaaaagaccccaaa

SEQ ID NO: 499583 - DNA, 20 bp, Artificial
  CRISPR gRNA sequence
ttaaaaagaccccaaaggca

SEQ ID NO: 499584 - DNA, 20 bp, Artificial
  CRISPR gRNA sequence
taaaaagaccccaaaggcag

SEQ ID NO: 499585 - DNA, 20 bp, Artificial
  CRISPR gRNA sequence
aaaaagaccccaaaggcagt

SEQ ID NO: 499586 - DNA, 20 bp, Artificial
  CRISPR gRNA sequence
aaaagaccccaaaggcagta

SEQ ID NO: 499587 - DNA, 20 bp, Artificial
  CRISPR gRNA sequence
tagatcacacatttcattct

SEQ ID NO: 499588 - DNA, 20 bp, Artificial
  CRISPR gRNA sequence
cattctttaagtatttagaa

SEQ ID NO: 499589 - DNA, 20 bp, Artificial
  CRISPR gRNA sequence
attctttaagtatttagaag

SEQ ID NO: 499590 - DNA, 20 bp, Artificial
  CRISPR gRNA sequence
tttaagtatttagaagtcta

SEQ ID NO: 499591 - DNA, 20 bp, Artificial
  CRISPR gRNA sequence
taagtatttagaagtctatg

SEQ ID NO: 499592 - DNA, 20 bp, Artificial
  CRISPR gRNA sequence
aagtatttagaagtctatgg

SEQ ID NO: 499593 - DNA, 20 bp, Artificial
  CRISPR gRNA sequence
agtatttagaagtctatggc

SEQ ID NO: 499594 - DNA, 20 bp, Artificial
  CRISPR gRNA sequence
agaagtctatggctgggagt

SEQ ID NO: 499595 - DNA, 20 bp, Artificial
  CRISPR gRNA sequence
gaagtctatggctgggagtg

SEQ ID NO: 499596 - DNA, 20 bp, Artificial
  CRISPR gRNA sequence
tggctgggagtggtggctca

SEQ ID NO: 499597 - DNA, 20 bp, Artificial
  CRISPR gRNA sequence
ggagtggtggctcacgccag

SEQ ID NO: 499598 - DNA, 20 bp, Artificial
  CRISPR gRNA sequence
acgccagaactttgggaggc

SEQ ID NO: 499599 - DNA, 20 bp, Artificial
  CRISPR gRNA sequence
tgggaggctgagacgggtgg

SEQ ID NO: 499600 - DNA, 20 bp, Artificial
  CRISPR gRNA sequence
gggaggctgagacgggtgga

SEQ ID NO: 499601 - DNA, 20 bp, Artificial
  CRISPR gRNA sequence
ggaggctgagacgggtggat

SEQ ID NO: 499602 - DNA, 20 bp, Artificial
  CRISPR gRNA sequence
agacgggtggattacttgag

SEQ ID NO: 499603 - DNA, 20 bp, Artificial
  CRISPR gRNA sequence
cttgaggtcaggagttcaag

SEQ ID NO: 499604 - DNA, 20 bp, Artificial
  CRISPR gRNA sequence
gaggtcaggagttcaagacc

SEQ ID NO: 499605 - DNA, 20 bp, Artificial
  CRISPR gRNA sequence
aggtcaggagttcaagacca

SEQ ID NO: 499606 - DNA, 20 bp, Artificial
  CRISPR gRNA sequence
aagaccagcctggccaatat

SEQ ID NO: 499607 - DNA, 20 bp, Artificial
  CRISPR gRNA sequence
gccaatatggcgaaaccctg

SEQ ID NO: 499608 - DNA, 20 bp, Artificial
  CRISPR gRNA sequence
tctctactaaaaatacaaaa

SEQ ID NO: 499609 - DNA, 20 bp, Artificial
  CRISPR gRNA sequence
tactaaaaatacaaaaaaaa

SEQ ID NO: 499610 - DNA, 20 bp, Artificial
  CRISPR gRNA sequence
ctaaaaatacaaaaaaaaaa

SEQ ID NO: 499611 - DNA, 20 bp, Artificial
  CRISPR gRNA sequence
aaaatacaaaaaaaaaaaaa

SEQ ID NO: 499612 - DNA, 20 bp, Artificial
  CRISPR gRNA sequence
ggggtggtggcaggcacctg

SEQ ID NO: 499613 - DNA, 20 bp, Artificial
  CRISPR gRNA sequence
tagtcccagttactcatgag

SEQ ID NO: 499614 - DNA, 20 bp, Artificial
  CRISPR gRNA sequence
ctcatgaggctgagacagga

SEQ ID NO: 499615 - DNA, 20 bp, Artificial
  CRISPR gRNA sequence
atgaggctgagacaggagaa

SEQ ID NO: 499616 - DNA, 20 bp, Artificial
  CRISPR gRNA sequence
agacaggagaatcacttgaa

SEQ ID NO: 499617 - DNA, 20 bp, Artificial
  CRISPR gRNA sequence
gaacctgggaggcagagatt

SEQ ID NO: 499618 - DNA, 20 bp, Artificial
  CRISPR gRNA sequence
aacctgggaggcagagattg

SEQ ID NO: 499619 - DNA, 20 bp, Artificial
  CRISPR gRNA sequence
ggaggcagagattgcagtga

SEQ ID NO: 499620 - DNA, 20 bp, Artificial
  CRISPR gRNA sequence
cagtgagccgagatcatgcc

SEQ ID NO: 499621 - DNA, 20 bp, Artificial
  CRISPR gRNA sequence
cacaccagtctgggtgacag

SEQ ID NO: 499622 - DNA, 20 bp, Artificial
  CRISPR gRNA sequence
ggtgacagagcgagactctg

SEQ ID NO: 499623 - DNA, 20 bp, Artificial
  CRISPR gRNA sequence
tgtcttaaaacaaacaaaca

SEQ ID NO: 499624 - DNA, 20 bp, Artificial
  CRISPR gRNA sequence
tcttaaaacaaacaaacaaa

SEQ ID NO: 499625 - DNA, 20 bp, Artificial
  CRISPR gRNA sequence
aaaacaaacaaacaaacaaa

SEQ ID NO: 499626 - DNA, 20 bp, Artificial
  CRISPR gRNA sequence
aaacaaacaaacaaacaaag

SEQ ID NO: 499627 - DNA, 20 bp, Artificial
  CRISPR gRNA sequence
gacaataacttaaccatttt

SEQ ID NO: 499628 - DNA, 20 bp, Artificial
  CRISPR gRNA sequence
aaccattttcctgtgtgatt

SEQ ID NO: 499629 - DNA, 20 bp, Artificial
  CRISPR gRNA sequence
accattttcctgtgtgattc

SEQ ID NO: 499630 - DNA, 20 bp, Artificial
  CRISPR gRNA sequence
tcctgtgtgattcctattca

SEQ ID NO: 499631 - DNA, 20 bp, Artificial
  CRISPR gRNA sequence
cctgtgtgattcctattcag

SEQ ID NO: 499632 - DNA, 20 bp, Artificial
  CRISPR gRNA sequence
ctgtgtgattcctattcagt

SEQ ID NO: 499633 - DNA, 20 bp, Artificial
  CRISPR gRNA sequence
tgtgattcctattcagtttt

SEQ ID NO: 499634 - DNA, 20 bp, Artificial
  CRISPR gRNA sequence
ctattcagttttataatagc

SEQ ID NO: 499635 - DNA, 20 bp, Artificial
  CRISPR gRNA sequence
ttcagttttataatagcaga

SEQ ID NO: 499636 - DNA, 20 bp, Artificial
  CRISPR gRNA sequence
agttttataatagcagagaa

SEQ ID NO: 499637 - DNA, 20 bp, Artificial
  CRISPR gRNA sequence
tataatagcagagaacaacc

SEQ ID NO: 499638 - DNA, 20 bp, Artificial
  CRISPR gRNA sequence
ataatagcagagaacaacct

SEQ ID NO: 499639 - DNA, 20 bp, Artificial
  CRISPR gRNA sequence
taatagcagagaacaacctt

SEQ ID NO: 499640 - DNA, 20 bp, Artificial
  CRISPR gRNA sequence
cttctacatagcgctctaca

SEQ ID NO: 499641 - DNA, 20 bp, Artificial
  CRISPR gRNA sequence
ttctacatagcgctctacat

SEQ ID NO: 499642 - DNA, 20 bp, Artificial
  CRISPR gRNA sequence
ctacatagcgctctacattc

SEQ ID NO: 499643 - DNA, 20 bp, Artificial
  CRISPR gRNA sequence
tacatagcgctctacattct

SEQ ID NO: 499644 - DNA, 20 bp, Artificial
  CRISPR gRNA sequence
catagcgctctacattctga

SEQ ID NO: 499645 - DNA, 20 bp, Artificial
  CRISPR gRNA sequence
tacattctgatctactggtg

SEQ ID NO: 499646 - DNA, 20 bp, Artificial
  CRISPR gRNA sequence
cattctgatctactggtgga

SEQ ID NO: 499647 - DNA, 20 bp, Artificial
  CRISPR gRNA sequence
tgatctactggtggattata

SEQ ID NO: 499648 - DNA, 20 bp, Artificial
  CRISPR gRNA sequence
atctactggtggattatatg

SEQ ID NO: 499649 - DNA, 20 bp, Artificial
  CRISPR gRNA sequence
ctggtggattatatgggagt

SEQ ID NO: 499650 - DNA, 20 bp, Artificial
  CRISPR gRNA sequence
gtggattatatgggagttta

SEQ ID NO: 499651 - DNA, 20 bp, Artificial
  CRISPR gRNA sequence
tatgggagtttacgttattt

SEQ ID NO: 499652 - DNA, 20 bp, Artificial
  CRISPR gRNA sequence
acgttatttttcattacacc

SEQ ID NO: 499653 - DNA, 20 bp, Artificial
  CRISPR gRNA sequence
cgttatttttcattacaccg

SEQ ID NO: 499654 - DNA, 20 bp, Artificial
  CRISPR gRNA sequence
tttttcattacaccgtatat

SEQ ID NO: 499655 - DNA, 20 bp, Artificial
  CRISPR gRNA sequence
ttcattacaccgtatattta

SEQ ID NO: 499656 - DNA, 20 bp, Artificial
  CRISPR gRNA sequence
tcattacaccgtatatttat

SEQ ID NO: 499657 - DNA, 20 bp, Artificial
  CRISPR gRNA sequence
cattacaccgtatatttata

SEQ ID NO: 499658 - DNA, 20 bp, Artificial
  CRISPR gRNA sequence
attacaccgtatatttatat

SEQ ID NO: 499659 - DNA, 20 bp, Artificial
  CRISPR gRNA sequence
caccgtatatttatatttaa

SEQ ID NO: 499660 - DNA, 20 bp, Artificial
  CRISPR gRNA sequence
atatttaagtaccttttaat

SEQ ID NO: 499661 - DNA, 20 bp, Artificial
  CRISPR gRNA sequence
tatttaagtaccttttaata

SEQ ID NO: 499662 - DNA, 20 bp, Artificial
  CRISPR gRNA sequence
aagtaccttttaatacttgt

SEQ ID NO: 499663 - DNA, 20 bp, Artificial
  CRISPR gRNA sequence
agtaccttttaatacttgtg

SEQ ID NO: 499664 - DNA, 20 bp, Artificial
  CRISPR gRNA sequence
ttaatacttgtgctacctct

SEQ ID NO: 499665 - DNA, 20 bp, Artificial
  CRISPR gRNA sequence
taatacttgtgctacctctc

SEQ ID NO: 499666 - DNA, 20 bp, Artificial
  CRISPR gRNA sequence
aatacttgtgctacctctca

SEQ ID NO: 499667 - DNA, 20 bp, Artificial
  CRISPR gRNA sequence
atacttgtgctacctctcac

SEQ ID NO: 499668 - DNA, 20 bp, Artificial
  CRISPR gRNA sequence
gtgctacctctcacaatttt

SEQ ID NO: 499669 - DNA, 20 bp, Artificial
  CRISPR gRNA sequence
tgctacctctcacaatttta

SEQ ID NO: 499670 - DNA, 20 bp, Artificial
  CRISPR gRNA sequence
cctctcacaattttataaaa

SEQ ID NO: 499671 - DNA, 20 bp, Artificial
  CRISPR gRNA sequence
tcacaattttataaaagata

SEQ ID NO: 499672 - DNA, 20 bp, Artificial
  CRISPR gRNA sequence
acaattttataaaagataaa

SEQ ID NO: 499673 - DNA, 20 bp, Artificial
  CRISPR gRNA sequence
tataaaagataaaaataaag

SEQ ID NO: 499674 - DNA, 20 bp, Artificial
  CRISPR gRNA sequence
ataaaagataaaaataaagt

SEQ ID NO: 499675 - DNA, 20 bp, Artificial
  CRISPR gRNA sequence
taaaagataaaaataaagtg

SEQ ID NO: 499676 - DNA, 20 bp, Artificial
  CRISPR gRNA sequence
aacacctgaaaattaaactc

SEQ ID NO: 499677 - DNA, 20 bp, Artificial
  CRISPR gRNA sequence
aaaattaaactcatgttcca

SEQ ID NO: 499678 - DNA, 20 bp, Artificial
  CRISPR gRNA sequence
aactcatgttccatcacccc

SEQ ID NO: 499679 - DNA, 20 bp, Artificial
  CRISPR gRNA sequence
atgttccatcaccccattct

SEQ ID NO: 499680 - DNA, 20 bp, Artificial
  CRISPR gRNA sequence
catcaccccattctccaaac

SEQ ID NO: 499681 - DNA, 20 bp, Artificial
  CRISPR gRNA sequence
tccaaacctgctccatcttt

SEQ ID NO: 499682 - DNA, 20 bp, Artificial
  CRISPR gRNA sequence
caaacctgctccatctttac

SEQ ID NO: 499683 - DNA, 20 bp, Artificial
  CRISPR gRNA sequence
ctccatctttaccagaccca

SEQ ID NO: 499684 - DNA, 20 bp, Artificial
  CRISPR gRNA sequence
catctttaccagacccataa

SEQ ID NO: 499685 - DNA, 20 bp, Artificial
  CRISPR gRNA sequence
taccagacccataagccaca

SEQ ID NO: 499686 - DNA, 20 bp, Artificial
  CRISPR gRNA sequence
accagacccataagccacac

SEQ ID NO: 499687 - DNA, 20 bp, Artificial
  CRISPR gRNA sequence
ccagacccataagccacacg

SEQ ID NO: 499688 - DNA, 20 bp, Artificial
  CRISPR gRNA sequence
tgtgttcccttaaccatgct

SEQ ID NO: 499689 - DNA, 20 bp, Artificial
  CRISPR gRNA sequence
gtgttcccttaaccatgcta

SEQ ID NO: 499690 - DNA, 20 bp, Artificial
  CRISPR gRNA sequence
tgttcccttaaccatgctac

SEQ ID NO: 499691 - DNA, 20 bp, Artificial
  CRISPR gRNA sequence
ccttaaccatgctactgctg

SEQ ID NO: 499692 - DNA, 20 bp, Artificial
  CRISPR gRNA sequence
aaccatgctactgctgggtc

SEQ ID NO: 499693 - DNA, 20 bp, Artificial
  CRISPR gRNA sequence
accatgctactgctgggtcc

SEQ ID NO: 499694 - DNA, 20 bp, Artificial
  CRISPR gRNA sequence
ctgctgggtccataataccc

SEQ ID NO: 499695 - DNA, 20 bp, Artificial
  CRISPR gRNA sequence
ctgggtccataatacccacc

SEQ ID NO: 499696 - DNA, 20 bp, Artificial
  CRISPR gRNA sequence
ggtccataatacccaccttc

SEQ ID NO: 499697 - DNA, 20 bp, Artificial
  CRISPR gRNA sequence
ccctgttcctttctgcatac

SEQ ID NO: 499698 - DNA, 20 bp, Artificial
  CRISPR gRNA sequence
cctgttcctttctgcataca

SEQ ID NO: 499699 - DNA, 20 bp, Artificial
  CRISPR gRNA sequence
ttcctttctgcatacaccag

SEQ ID NO: 499700 - DNA, 20 bp, Artificial
  CRISPR gRNA sequence
ctttctgcatacaccaggca

SEQ ID NO: 499701 - DNA, 20 bp, Artificial
  CRISPR gRNA sequence
tctgcatacaccaggcaggc

SEQ ID NO: 499702 - DNA, 20 bp, Artificial
  CRISPR gRNA sequence
ctgcatacaccaggcaggcc

SEQ ID NO: 499703 - DNA, 20 bp, Artificial
  CRISPR gRNA sequence
tgcatacaccaggcaggcct

SEQ ID NO: 499704 - DNA, 20 bp, Artificial
  CRISPR gRNA sequence
catacaccaggcaggccttg

SEQ ID NO: 499705 - DNA, 20 bp, Artificial
  CRISPR gRNA sequence
ggctttttctttcaatggca

SEQ ID NO: 499706 - DNA, 20 bp, Artificial
  CRISPR gRNA sequence
gctttttctttcaatggcag

SEQ ID NO: 499707 - DNA, 20 bp, Artificial
  CRISPR gRNA sequence
tttctttcaatggcagctcc

SEQ ID NO: 499708 - DNA, 20 bp, Artificial
  CRISPR gRNA sequence
ttctttcaatggcagctccc

SEQ ID NO: 499709 - DNA, 20 bp, Artificial
  CRISPR gRNA sequence
tctttcaatggcagctccca

SEQ ID NO: 499710 - DNA, 20 bp, Artificial
  CRISPR gRNA sequence
ctttcaatggcagctcccac

SEQ ID NO: 499711 - DNA, 20 bp, Artificial
  CRISPR gRNA sequence
tttcaatggcagctcccacc

SEQ ID NO: 499712 - DNA, 20 bp, Artificial
  CRISPR gRNA sequence
tcaatggcagctcccaccca

SEQ ID NO: 499713 - DNA, 20 bp, Artificial
  CRISPR gRNA sequence
caatggcagctcccacccac

SEQ ID NO: 499714 - DNA, 20 bp, Artificial
  CRISPR gRNA sequence
aatggcagctcccacccacc

SEQ ID NO: 499715 - DNA, 20 bp, Artificial
  CRISPR gRNA sequence
ccacccaccgcctctgggca

SEQ ID NO: 499716 - DNA, 20 bp, Artificial
  CRISPR gRNA sequence
tgggcagccactcctaactc

SEQ ID NO: 499717 - DNA, 20 bp, Artificial
  CRISPR gRNA sequence
ggcagccactcctaactctg

SEQ ID NO: 499718 - DNA, 20 bp, Artificial
  CRISPR gRNA sequence
ctaactctgcagggcagagg

SEQ ID NO: 499719 - DNA, 20 bp, Artificial
  CRISPR gRNA sequence
actctgcagggcagaggaaa

SEQ ID NO: 499720 - DNA, 20 bp, Artificial
  CRISPR gRNA sequence
tgcagggcagaggaaaacat

SEQ ID NO: 499721 - DNA, 20 bp, Artificial
  CRISPR gRNA sequence
cagggcagaggaaaacatgc

SEQ ID NO: 499722 - DNA, 20 bp, Artificial
  CRISPR gRNA sequence
tccttatgcttgcctcacac

SEQ ID NO: 499723 - DNA, 20 bp, Artificial
  CRISPR gRNA sequence
ccttatgcttgcctcacacc

SEQ ID NO: 499724 - DNA, 20 bp, Artificial
  CRISPR gRNA sequence
cttatgcttgcctcacaccc

SEQ ID NO: 499725 - DNA, 20 bp, Artificial
  CRISPR gRNA sequence
atgcttgcctcacaccctgg

SEQ ID NO: 499726 - DNA, 20 bp, Artificial
  CRISPR gRNA sequence
tgcttgcctcacaccctggg

SEQ ID NO: 499727 - DNA, 20 bp, Artificial
  CRISPR gRNA sequence
gcctcacaccctgggcacac

SEQ ID NO: 499728 - DNA, 20 bp, Artificial
  CRISPR gRNA sequence
cctcacaccctgggcacacc

SEQ ID NO: 499729 - DNA, 20 bp, Artificial
  CRISPR gRNA sequence
acaccctgggcacacctcca

SEQ ID NO: 499730 - DNA, 20 bp, Artificial
  CRISPR gRNA sequence
ggcacacctccatagcacat

SEQ ID NO: 499731 - DNA, 20 bp, Artificial
  CRISPR gRNA sequence
catagcacattccatattgc

SEQ ID NO: 499732 - DNA, 20 bp, Artificial
  CRISPR gRNA sequence
catattgcatttcagttggc

SEQ ID NO: 499733 - DNA, 20 bp, Artificial
  CRISPR gRNA sequence
catttcagttggctgtttta

SEQ ID NO: 499734 - DNA, 20 bp, Artificial
  CRISPR gRNA sequence
cagttggctgttttaggtct

SEQ ID NO: 499735 - DNA, 20 bp, Artificial
  CRISPR gRNA sequence
agttggctgttttaggtcta

SEQ ID NO: 499736 - DNA, 20 bp, Artificial
  CRISPR gRNA sequence
gctgttttaggtctatcttc

SEQ ID NO: 499737 - DNA, 20 bp, Artificial
  CRISPR gRNA sequence
ttttaggtctatcttccttt

SEQ ID NO: 499738 - DNA, 20 bp, Artificial
  CRISPR gRNA sequence
taggtctatcttcctttttc

SEQ ID NO: 499739 - DNA, 20 bp, Artificial
  CRISPR gRNA sequence
aggtctatcttcctttttca

SEQ ID NO: 499740 - DNA, 20 bp, Artificial
  CRISPR gRNA sequence
ggtctatcttcctttttcac

SEQ ID NO: 499741 - DNA, 20 bp, Artificial
  CRISPR gRNA sequence
tcttcctttttcactttttt

SEQ ID NO: 499742 - DNA, 20 bp, Artificial
  CRISPR gRNA sequence
cctttttcactttttttttt

SEQ ID NO: 499743 - DNA, 20 bp, Artificial
  CRISPR gRNA sequence
ctttttcacttttttttttt

SEQ ID NO: 499744 - DNA, 20 bp, Artificial
  CRISPR gRNA sequence
tttcactttttttttttttt

SEQ ID NO: 499745 - DNA, 20 bp, Artificial
  CRISPR gRNA sequence
ttcacttttttttttttttt

SEQ ID NO: 499746 - DNA, 20 bp, Artificial
  CRISPR gRNA sequence
tcactttttttttttttttt

SEQ ID NO: 499747 - DNA, 20 bp, Artificial
  CRISPR gRNA sequence
cacttttttttttttttttt

SEQ ID NO: 499748 - DNA, 20 bp, Artificial
  CRISPR gRNA sequence
actttttttttttttttttt

SEQ ID NO: 499749 - DNA, 20 bp, Artificial
  CRISPR gRNA sequence
tttttttttttttttttttt

SEQ ID NO: 499750 - DNA, 20 bp, Artificial
  CRISPR gRNA sequence
tttttttttttttttttttt

SEQ ID NO: 499751 - DNA, 20 bp, Artificial
  CRISPR gRNA sequence
tttttttttttttttttttt

SEQ ID NO: 499752 - DNA, 20 bp, Artificial
  CRISPR gRNA sequence
tttttttttttttttttttt

SEQ ID NO: 499753 - DNA, 20 bp, Artificial
  CRISPR gRNA sequence
tttttttttttttttttttt

SEQ ID NO: 499754 - DNA, 20 bp, Artificial
  CRISPR gRNA sequence
ttttttttttttttttttta

SEQ ID NO: 499755 - DNA, 20 bp, Artificial
  CRISPR gRNA sequence
ttttttttttttttttttag

SEQ ID NO: 499756 - DNA, 20 bp, Artificial
  CRISPR gRNA sequence
tttttttttttttttttagg

SEQ ID NO: 499757 - DNA, 20 bp, Artificial
  CRISPR gRNA sequence
ttttttttttttttttaggc

SEQ ID NO: 499758 - DNA, 20 bp, Artificial
  CRISPR gRNA sequence
tttttttttttttttaggca

SEQ ID NO: 499759 - DNA, 20 bp, Artificial
  CRISPR gRNA sequence
ttttttttttttttaggcag

SEQ ID NO: 499760 - DNA, 20 bp, Artificial
  CRISPR gRNA sequence
tttttttttttttaggcagg

SEQ ID NO: 499761 - DNA, 20 bp, Artificial
  CRISPR gRNA sequence
ttttttttttttaggcaggg

SEQ ID NO: 499762 - DNA, 20 bp, Artificial
  CRISPR gRNA sequence
tttttttttttaggcagggt

SEQ ID NO: 499763 - DNA, 20 bp, Artificial
  CRISPR gRNA sequence
ttttttttttaggcagggtc

SEQ ID NO: 499764 - DNA, 20 bp, Artificial
  CRISPR gRNA sequence
tttttttttaggcagggtct

SEQ ID NO: 499765 - DNA, 20 bp, Artificial
  CRISPR gRNA sequence
ttttttttaggcagggtctt

SEQ ID NO: 499766 - DNA, 20 bp, Artificial
  CRISPR gRNA sequence
tttttttaggcagggtcttg

SEQ ID NO: 499767 - DNA, 20 bp, Artificial
  CRISPR gRNA sequence
ttttttaggcagggtcttgc

SEQ ID NO: 499768 - DNA, 20 bp, Artificial
  CRISPR gRNA sequence
tttttaggcagggtcttgct

SEQ ID NO: 499769 - DNA, 20 bp, Artificial
  CRISPR gRNA sequence
ttttaggcagggtcttgctc

SEQ ID NO: 499770 - DNA, 20 bp, Artificial
  CRISPR gRNA sequence
tttaggcagggtcttgctct

SEQ ID NO: 499771 - DNA, 20 bp, Artificial
  CRISPR gRNA sequence
ttaggcagggtcttgctctg

SEQ ID NO: 499772 - DNA, 20 bp, Artificial
  CRISPR gRNA sequence
taggcagggtcttgctctgt

SEQ ID NO: 499773 - DNA, 20 bp, Artificial
  CRISPR gRNA sequence
aggcagggtcttgctctgtc

SEQ ID NO: 499774 - DNA, 20 bp, Artificial
  CRISPR gRNA sequence
ggcagggtcttgctctgtca

SEQ ID NO: 499775 - DNA, 20 bp, Artificial
  CRISPR gRNA sequence
gctctgtcacccaggctggg

SEQ ID NO: 499776 - DNA, 20 bp, Artificial
  CRISPR gRNA sequence
ctctgtcacccaggctgggg

SEQ ID NO: 499777 - DNA, 20 bp, Artificial
  CRISPR gRNA sequence
tgtcacccaggctggggtgc

SEQ ID NO: 499778 - DNA, 20 bp, Artificial
  CRISPR gRNA sequence
tcacccaggctggggtgcag

SEQ ID NO: 499779 - DNA, 20 bp, Artificial
  CRISPR gRNA sequence
gggtgcagtggtgcagtcat

SEQ ID NO: 499780 - DNA, 20 bp, Artificial
  CRISPR gRNA sequence
actgcaacccctgcctccca

SEQ ID NO: 499781 - DNA, 20 bp, Artificial
  CRISPR gRNA sequence
caacccctgcctcccaggct

SEQ ID NO: 499782 - DNA, 20 bp, Artificial
  CRISPR gRNA sequence
cctcccaggcttttctgata

SEQ ID NO: 499783 - DNA, 20 bp, Artificial
  CRISPR gRNA sequence
ccaggcttttctgatattta

SEQ ID NO: 499784 - DNA, 20 bp, Artificial
  CRISPR gRNA sequence
ttctgatatttagctaagag

SEQ ID NO: 499785 - DNA, 20 bp, Artificial
  CRISPR gRNA sequence
tctgatatttagctaagagt

SEQ ID NO: 499786 - DNA, 20 bp, Artificial
  CRISPR gRNA sequence
ctgatatttagctaagagtt

SEQ ID NO: 499787 - DNA, 20 bp, Artificial
  CRISPR gRNA sequence
tgatatttagctaagagttg

SEQ ID NO: 499788 - DNA, 20 bp, Artificial
  CRISPR gRNA sequence
atatttagctaagagttggg

SEQ ID NO: 499789 - DNA, 20 bp, Artificial
  CRISPR gRNA sequence
agctaagagttgggtttagc

SEQ ID NO: 499790 - DNA, 20 bp, Artificial
  CRISPR gRNA sequence
gctaagagttgggtttagct

SEQ ID NO: 499791 - DNA, 20 bp, Artificial
  CRISPR gRNA sequence
agagttgggtttagctgaga

SEQ ID NO: 499792 - DNA, 20 bp, Artificial
  CRISPR gRNA sequence
ggtttagctgagatgagtga

SEQ ID NO: 499793 - DNA, 20 bp, Artificial
  CRISPR gRNA sequence
agctgagatgagtgaggaaa

SEQ ID NO: 499794 - DNA, 20 bp, Artificial
  CRISPR gRNA sequence
gctgagatgagtgaggaaat

SEQ ID NO: 499795 - DNA, 20 bp, Artificial
  CRISPR gRNA sequence
agatgagtgaggaaatctac

SEQ ID NO: 499796 - DNA, 20 bp, Artificial
  CRISPR gRNA sequence
caaattcacttgctatggta

SEQ ID NO: 499797 - DNA, 20 bp, Artificial
  CRISPR gRNA sequence
acttgctatggtaatgtttc

SEQ ID NO: 499798 - DNA, 20 bp, Artificial
  CRISPR gRNA sequence
gctatggtaatgtttccaca

SEQ ID NO: 499799 - DNA, 20 bp, Artificial
  CRISPR gRNA sequence
ctatggtaatgtttccacaa

SEQ ID NO: 499800 - DNA, 20 bp, Artificial
  CRISPR gRNA sequence
tggtaatgtttccacaatgg

SEQ ID NO: 499801 - DNA, 20 bp, Artificial
  CRISPR gRNA sequence
ccacaatgggcaagtcatat

SEQ ID NO: 499802 - DNA, 20 bp, Artificial
  CRISPR gRNA sequence
cacaatgggcaagtcatatt

SEQ ID NO: 499803 - DNA, 20 bp, Artificial
  CRISPR gRNA sequence
tgcttttatcaaagtacatc

SEQ ID NO: 499804 - DNA, 20 bp, Artificial
  CRISPR gRNA sequence
gcttttatcaaagtacatct

SEQ ID NO: 499805 - DNA, 20 bp, Artificial
  CRISPR gRNA sequence
cttttatcaaagtacatctt

SEQ ID NO: 499806 - DNA, 20 bp, Artificial
  CRISPR gRNA sequence
ttatcaaagtacatcttagt

SEQ ID NO: 499807 - DNA, 20 bp, Artificial
  CRISPR gRNA sequence
tatcaaagtacatcttagtt

SEQ ID NO: 499808 - DNA, 20 bp, Artificial
  CRISPR gRNA sequence
atcaaagtacatcttagtta

SEQ ID NO: 499809 - DNA, 20 bp, Artificial
  CRISPR gRNA sequence
tcaaagtacatcttagttaa

SEQ ID NO: 499810 - DNA, 20 bp, Artificial
  CRISPR gRNA sequence
agttaatagtcagaacagtt

SEQ ID NO: 499811 - DNA, 20 bp, Artificial
  CRISPR gRNA sequence
gttaatagtcagaacagttg

SEQ ID NO: 499812 - DNA, 20 bp, Artificial
  CRISPR gRNA sequence
atagtcagaacagttgagtg

SEQ ID NO: 499813 - DNA, 20 bp, Artificial
  CRISPR gRNA sequence
agtgagaggtagtcattact

SEQ ID NO: 499814 - DNA, 20 bp, Artificial
  CRISPR gRNA sequence
ctctttttctgcttttttac

SEQ ID NO: 499815 - DNA, 20 bp, Artificial
  CRISPR gRNA sequence
tttttctgcttttttaccaa

SEQ ID NO: 499816 - DNA, 20 bp, Artificial
  CRISPR gRNA sequence
tttctgcttttttaccaaga

SEQ ID NO: 499817 - DNA, 20 bp, Artificial
  CRISPR gRNA sequence
ttctgcttttttaccaagat

SEQ ID NO: 499818 - DNA, 20 bp, Artificial
  CRISPR gRNA sequence
tctgcttttttaccaagata

SEQ ID NO: 499819 - DNA, 20 bp, Artificial
  CRISPR gRNA sequence
ctgcttttttaccaagatac

SEQ ID NO: 499820 - DNA, 20 bp, Artificial
  CRISPR gRNA sequence
tgcttttttaccaagataca

SEQ ID NO: 499821 - DNA, 20 bp, Artificial
  CRISPR gRNA sequence
cttttttaccaagatacaac

SEQ ID NO: 499822 - DNA, 20 bp, Artificial
  CRISPR gRNA sequence
ttttaccaagatacaactca

SEQ ID NO: 499823 - DNA, 20 bp, Artificial
  CRISPR gRNA sequence
tttaccaagatacaactcac

SEQ ID NO: 499824 - DNA, 20 bp, Artificial
  CRISPR gRNA sequence
ttaccaagatacaactcaca

SEQ ID NO: 499825 - DNA, 20 bp, Artificial
  CRISPR gRNA sequence
taccaagatacaactcacag

SEQ ID NO: 499826 - DNA, 20 bp, Artificial
  CRISPR gRNA sequence
accaagatacaactcacagc

SEQ ID NO: 499827 - DNA, 20 bp, Artificial
  CRISPR gRNA sequence
ccaagatacaactcacagct

SEQ ID NO: 499828 - DNA, 20 bp, Artificial
  CRISPR gRNA sequence
acagctgtgtgcacaaaatt

SEQ ID NO: 499829 - DNA, 20 bp, Artificial
  CRISPR gRNA sequence
tgtgcacaaaatttaaatca

SEQ ID NO: 499830 - DNA, 20 bp, Artificial
  CRISPR gRNA sequence
aaatcaacagcttgatgaac

SEQ ID NO: 499831 - DNA, 20 bp, Artificial
  CRISPR gRNA sequence
aatcaacagcttgatgaact

SEQ ID NO: 499832 - DNA, 20 bp, Artificial
  CRISPR gRNA sequence
gatgaacttttatatgtgta

SEQ ID NO: 499833 - DNA, 20 bp, Artificial
  CRISPR gRNA sequence
atgaacttttatatgtgtaa

SEQ ID NO: 499834 - DNA, 20 bp, Artificial
  CRISPR gRNA sequence
ttatatgtgtaagtacatat

SEQ ID NO: 499835 - DNA, 20 bp, Artificial
  CRISPR gRNA sequence
tatatgtgtaagtacatatc

SEQ ID NO: 499836 - DNA, 20 bp, Artificial
  CRISPR gRNA sequence
atatgtgtaagtacatatca

SEQ ID NO: 499837 - DNA, 20 bp, Artificial
  CRISPR gRNA sequence
tatgtgtaagtacatatcaa

SEQ ID NO: 499838 - DNA, 20 bp, Artificial
  CRISPR gRNA sequence
cccacatcaagatgtaacac

SEQ ID NO: 499839 - DNA, 20 bp, Artificial
  CRISPR gRNA sequence
ctagcacccagtcattcctt

SEQ ID NO: 499840 - DNA, 20 bp, Artificial
  CRISPR gRNA sequence
tagcacccagtcattccttt

SEQ ID NO: 499841 - DNA, 20 bp, Artificial
  CRISPR gRNA sequence
gcacccagtcattccttttt

SEQ ID NO: 499842 - DNA, 20 bp, Artificial
  CRISPR gRNA sequence
ctttttggcccttcaagttg

SEQ ID NO: 499843 - DNA, 20 bp, Artificial
  CRISPR gRNA sequence
tttggcccttcaagttgata

SEQ ID NO: 499844 - DNA, 20 bp, Artificial
  CRISPR gRNA sequence
ttggcccttcaagttgataa

SEQ ID NO: 499845 - DNA, 20 bp, Artificial
  CRISPR gRNA sequence
tggcccttcaagttgataac

SEQ ID NO: 499846 - DNA, 20 bp, Artificial
  CRISPR gRNA sequence
ggcccttcaagttgataacc

SEQ ID NO: 499847 - DNA, 20 bp, Artificial
  CRISPR gRNA sequence
gcccttcaagttgataaccc

SEQ ID NO: 499848 - DNA, 20 bp, Artificial
  CRISPR gRNA sequence
caagttgataacccccctcc

SEQ ID NO: 499849 - DNA, 20 bp, Artificial
  CRISPR gRNA sequence
aagttgataacccccctcct

SEQ ID NO: 499850 - DNA, 20 bp, Artificial
  CRISPR gRNA sequence
ataacccccctcctgcaagg

SEQ ID NO: 499851 - DNA, 20 bp, Artificial
  CRISPR gRNA sequence
ctgcaagggtaatcacattc

SEQ ID NO: 499852 - DNA, 20 bp, Artificial
  CRISPR gRNA sequence
caagggtaatcacattctaa

SEQ ID NO: 499853 - DNA, 20 bp, Artificial
  CRISPR gRNA sequence
taacctctctcaccatatat

SEQ ID NO: 499854 - DNA, 20 bp, Artificial
  CRISPR gRNA sequence
acctctctcaccatatatta

SEQ ID NO: 499855 - DNA, 20 bp, Artificial
  CRISPR gRNA sequence
tctcaccatatattagtttt

SEQ ID NO: 499856 - DNA, 20 bp, Artificial
  CRISPR gRNA sequence
tcaccatatattagtttttc

SEQ ID NO: 499857 - DNA, 20 bp, Artificial
  CRISPR gRNA sequence
accatatattagtttttcca

SEQ ID NO: 499858 - DNA, 20 bp, Artificial
  CRISPR gRNA sequence
gtttttccagattttaaact

SEQ ID NO: 499859 - DNA, 20 bp, Artificial
  CRISPR gRNA sequence
ttccagattttaaactttat

SEQ ID NO: 499860 - DNA, 20 bp, Artificial
  CRISPR gRNA sequence
tccagattttaaactttata

SEQ ID NO: 499861 - DNA, 20 bp, Artificial
  CRISPR gRNA sequence
ccagattttaaactttatat

SEQ ID NO: 499862 - DNA, 20 bp, Artificial
  CRISPR gRNA sequence
cagattttaaactttatatc

SEQ ID NO: 499863 - DNA, 20 bp, Artificial
  CRISPR gRNA sequence
taaactttatatcagtgaaa

SEQ ID NO: 499864 - DNA, 20 bp, Artificial
  CRISPR gRNA sequence
aaactttatatcagtgaaat

SEQ ID NO: 499865 - DNA, 20 bp, Artificial
  CRISPR gRNA sequence
aactttatatcagtgaaata

SEQ ID NO: 499866 - DNA, 20 bp, Artificial
  CRISPR gRNA sequence
tatatcagtgaaataattca

SEQ ID NO: 499867 - DNA, 20 bp, Artificial
  CRISPR gRNA sequence
atatcagtgaaataattcac

SEQ ID NO: 499868 - DNA, 20 bp, Artificial
  CRISPR gRNA sequence
tatcagtgaaataattcact

SEQ ID NO: 499869 - DNA, 20 bp, Artificial
  CRISPR gRNA sequence
actatgtactttttggagtc

SEQ ID NO: 499870 - DNA, 20 bp, Artificial
  CRISPR gRNA sequence
tgtactttttggagtctagc

SEQ ID NO: 499871 - DNA, 20 bp, Artificial
  CRISPR gRNA sequence
tttggagtctagcttcatta

SEQ ID NO: 499872 - DNA, 20 bp, Artificial
  CRISPR gRNA sequence
ttggagtctagcttcattaa

SEQ ID NO: 499873 - DNA, 20 bp, Artificial
  CRISPR gRNA sequence
tggagtctagcttcattaat

SEQ ID NO: 499874 - DNA, 20 bp, Artificial
  CRISPR gRNA sequence
ggagtctagcttcattaata

SEQ ID NO: 499875 - DNA, 20 bp, Artificial
  CRISPR gRNA sequence
gagtctagcttcattaatac

SEQ ID NO: 499876 - DNA, 20 bp, Artificial
  CRISPR gRNA sequence
gcttcattaatactcatcat

SEQ ID NO: 499877 - DNA, 20 bp, Artificial
  CRISPR gRNA sequence
cattaatactcatcattgtg

SEQ ID NO: 499878 - DNA, 20 bp, Artificial
  CRISPR gRNA sequence
attaatactcatcattgtgg

SEQ ID NO: 499879 - DNA, 20 bp, Artificial
  CRISPR gRNA sequence
atactcatcattgtggtgag

SEQ ID NO: 499880 - DNA, 20 bp, Artificial
  CRISPR gRNA sequence
atcattgtggtgagatccat

SEQ ID NO: 499881 - DNA, 20 bp, Artificial
  CRISPR gRNA sequence
tggtgagatccatccacatt

SEQ ID NO: 499882 - DNA, 20 bp, Artificial
  CRISPR gRNA sequence
ttgccaggaaaagtagcttt

SEQ ID NO: 499883 - DNA, 20 bp, Artificial
  CRISPR gRNA sequence
ccaggaaaagtagcttttct

SEQ ID NO: 499884 - DNA, 20 bp, Artificial
  CRISPR gRNA sequence
ttctttttcattgctgtgta

SEQ ID NO: 499885 - DNA, 20 bp, Artificial
  CRISPR gRNA sequence
tctttttcattgctgtgtaa

SEQ ID NO: 499886 - DNA, 20 bp, Artificial
  CRISPR gRNA sequence
ctttttcattgctgtgtaat

SEQ ID NO: 499887 - DNA, 20 bp, Artificial
  CRISPR gRNA sequence
tttttcattgctgtgtaata

SEQ ID NO: 499888 - DNA, 20 bp, Artificial
  CRISPR gRNA sequence
tttcattgctgtgtaatatt

SEQ ID NO: 499889 - DNA, 20 bp, Artificial
  CRISPR gRNA sequence
ttcattgctgtgtaatattc

SEQ ID NO: 499890 - DNA, 20 bp, Artificial
  CRISPR gRNA sequence
tcattgctgtgtaatattcc

SEQ ID NO: 499891 - DNA, 20 bp, Artificial
  CRISPR gRNA sequence
cattgctgtgtaatattcct

SEQ ID NO: 499892 - DNA, 20 bp, Artificial
  CRISPR gRNA sequence
attgctgtgtaatattcctt

SEQ ID NO: 499893 - DNA, 20 bp, Artificial
  CRISPR gRNA sequence
ctgtgtaatattccttataa

SEQ ID NO: 499894 - DNA, 20 bp, Artificial
  CRISPR gRNA sequence
tgtaatattccttataagac

SEQ ID NO: 499895 - DNA, 20 bp, Artificial
  CRISPR gRNA sequence
cttataagactataacacga

SEQ ID NO: 499896 - DNA, 20 bp, Artificial
  CRISPR gRNA sequence
ataagactataacacgattt

SEQ ID NO: 499897 - DNA, 20 bp, Artificial
  CRISPR gRNA sequence
taagactataacacgattta

SEQ ID NO: 499898 - DNA, 20 bp, Artificial
  CRISPR gRNA sequence
taacacgatttatttgctca

SEQ ID NO: 499899 - DNA, 20 bp, Artificial
  CRISPR gRNA sequence
atttgctcatctaatcgtga

SEQ ID NO: 499900 - DNA, 20 bp, Artificial
  CRISPR gRNA sequence
tttgctcatctaatcgtgat

SEQ ID NO: 499901 - DNA, 20 bp, Artificial
  CRISPR gRNA sequence
gctcatctaatcgtgataga

SEQ ID NO: 499902 - DNA, 20 bp, Artificial
  CRISPR gRNA sequence
ctcatctaatcgtgatagac

SEQ ID NO: 499903 - DNA, 20 bp, Artificial
  CRISPR gRNA sequence
atctaatcgtgatagacatt

SEQ ID NO: 499904 - DNA, 20 bp, Artificial
  CRISPR gRNA sequence
atcgtgatagacatttgggt

SEQ ID NO: 499905 - DNA, 20 bp, Artificial
  CRISPR gRNA sequence
gggttttttctcattttgag

SEQ ID NO: 499906 - DNA, 20 bp, Artificial
  CRISPR gRNA sequence
ggttttttctcattttgagt

SEQ ID NO: 499907 - DNA, 20 bp, Artificial
  CRISPR gRNA sequence
tttctcattttgagttatta

SEQ ID NO: 499908 - DNA, 20 bp, Artificial
  CRISPR gRNA sequence
ttctcattttgagttattat

SEQ ID NO: 499909 - DNA, 20 bp, Artificial
  CRISPR gRNA sequence
tctcattttgagttattatg

SEQ ID NO: 499910 - DNA, 20 bp, Artificial
  CRISPR gRNA sequence
ctcattttgagttattatga

SEQ ID NO: 499911 - DNA, 20 bp, Artificial
  CRISPR gRNA sequence
tcattttgagttattatgac

SEQ ID NO: 499912 - DNA, 20 bp, Artificial
  CRISPR gRNA sequence
attttgagttattatgacta

SEQ ID NO: 499913 - DNA, 20 bp, Artificial
  CRISPR gRNA sequence
tgagttattatgactaaagc

SEQ ID NO: 499914 - DNA, 20 bp, Artificial
  CRISPR gRNA sequence
gagttattatgactaaagcc

SEQ ID NO: 499915 - DNA, 20 bp, Artificial
  CRISPR gRNA sequence
agttattatgactaaagcca

SEQ ID NO: 499916 - DNA, 20 bp, Artificial
  CRISPR gRNA sequence
ttatgactaaagccattatt

SEQ ID NO: 499917 - DNA, 20 bp, Artificial
  CRISPR gRNA sequence
tgactaaagccattattaac

SEQ ID NO: 499918 - DNA, 20 bp, Artificial
  CRISPR gRNA sequence
aagccattattaacactctt

SEQ ID NO: 499919 - DNA, 20 bp, Artificial
  CRISPR gRNA sequence
ttaacactcttgtacatatt

SEQ ID NO: 499920 - DNA, 20 bp, Artificial
  CRISPR gRNA sequence
acactcttgtacatattttt

SEQ ID NO: 499921 - DNA, 20 bp, Artificial
  CRISPR gRNA sequence
ttgtacatatttttagtgga

SEQ ID NO: 499922 - DNA, 20 bp, Artificial
  CRISPR gRNA sequence
gtacatatttttagtggata

SEQ ID NO: 499923 - DNA, 20 bp, Artificial
  CRISPR gRNA sequence
tacatatttttagtggatat

SEQ ID NO: 499924 - DNA, 20 bp, Artificial
  CRISPR gRNA sequence
ttagtggatataaacaccag

SEQ ID NO: 499925 - DNA, 20 bp, Artificial
  CRISPR gRNA sequence
tagtggatataaacaccaga

SEQ ID NO: 499926 - DNA, 20 bp, Artificial
  CRISPR gRNA sequence
agtggatataaacaccagat

SEQ ID NO: 499927 - DNA, 20 bp, Artificial
  CRISPR gRNA sequence
gtggatataaacaccagatt

SEQ ID NO: 499928 - DNA, 20 bp, Artificial
  CRISPR gRNA sequence
tctttttttttgagacggag

SEQ ID NO: 499929 - DNA, 20 bp, Artificial
  CRISPR gRNA sequence
ctttttttttgagacggagt

SEQ ID NO: 499930 - DNA, 20 bp, Artificial
  CRISPR gRNA sequence
tttttttttgagacggagtt

SEQ ID NO: 499931 - DNA, 20 bp, Artificial
  CRISPR gRNA sequence
tttttttgagacggagtttc

SEQ ID NO: 499932 - DNA, 20 bp, Artificial
  CRISPR gRNA sequence
ttttttgagacggagtttca

SEQ ID NO: 499933 - DNA, 20 bp, Artificial
  CRISPR gRNA sequence
tttttgagacggagtttcac

SEQ ID NO: 499934 - DNA, 20 bp, Artificial
  CRISPR gRNA sequence
ttttgagacggagtttcact

SEQ ID NO: 499935 - DNA, 20 bp, Artificial
  CRISPR gRNA sequence
tttgagacggagtttcactc

SEQ ID NO: 499936 - DNA, 20 bp, Artificial
  CRISPR gRNA sequence
ttgagacggagtttcactct

SEQ ID NO: 499937 - DNA, 20 bp, Artificial
  CRISPR gRNA sequence
tgagacggagtttcactctt

SEQ ID NO: 499938 - DNA, 20 bp, Artificial
  CRISPR gRNA sequence
gagacggagtttcactcttg

SEQ ID NO: 499939 - DNA, 20 bp, Artificial
  CRISPR gRNA sequence
agacggagtttcactcttgt

SEQ ID NO: 499940 - DNA, 20 bp, Artificial
  CRISPR gRNA sequence
cactcttgttgcccaggctg

SEQ ID NO: 499941 - DNA, 20 bp, Artificial
  CRISPR gRNA sequence
actcttgttgcccaggctgg

SEQ ID NO: 499942 - DNA, 20 bp, Artificial
  CRISPR gRNA sequence
ttgttgcccaggctggagtg

SEQ ID NO: 499943 - DNA, 20 bp, Artificial
  CRISPR gRNA sequence
gttgcccaggctggagtgca

SEQ ID NO: 499944 - DNA, 20 bp, Artificial
  CRISPR gRNA sequence
ttgcccaggctggagtgcaa

SEQ ID NO: 499945 - DNA, 20 bp, Artificial
  CRISPR gRNA sequence
cccaggctggagtgcaatgg

SEQ ID NO: 499946 - DNA, 20 bp, Artificial
  CRISPR gRNA sequence
gagtgcaatggcatgatctt

SEQ ID NO: 499947 - DNA, 20 bp, Artificial
  CRISPR gRNA sequence
ggctcactgcaacctccgcc

SEQ ID NO: 499948 - DNA, 20 bp, Artificial
  CRISPR gRNA sequence
gctcactgcaacctccgcct

SEQ ID NO: 499949 - DNA, 20 bp, Artificial
  CRISPR gRNA sequence
actgcaacctccgcctctca

SEQ ID NO: 499950 - DNA, 20 bp, Artificial
  CRISPR gRNA sequence
caacctccgcctctcagatt

SEQ ID NO: 499951 - DNA, 20 bp, Artificial
  CRISPR gRNA sequence
cgcctctcagatttaagtga

SEQ ID NO: 499952 - DNA, 20 bp, Artificial
  CRISPR gRNA sequence
tcagatttaagtgattctcc

SEQ ID NO: 499953 - DNA, 20 bp, Artificial
  CRISPR gRNA sequence
agatttaagtgattctcctg

SEQ ID NO: 499954 - DNA, 20 bp, Artificial
  CRISPR gRNA sequence
aagtgattctcctgcttcag

SEQ ID NO: 499955 - DNA, 20 bp, Artificial
  CRISPR gRNA sequence
agtgattctcctgcttcagt

SEQ ID NO: 499956 - DNA, 20 bp, Artificial
  CRISPR gRNA sequence
tcctgcttcagtcttccaag

SEQ ID NO: 499957 - DNA, 20 bp, Artificial
  CRISPR gRNA sequence
ctgcttcagtcttccaagta

SEQ ID NO: 499958 - DNA, 20 bp, Artificial
  CRISPR gRNA sequence
cttcagtcttccaagtagct

SEQ ID NO: 499959 - DNA, 20 bp, Artificial
  CRISPR gRNA sequence
cagtcttccaagtagctggg

SEQ ID NO: 499960 - DNA, 20 bp, Artificial
  CRISPR gRNA sequence
agtcttccaagtagctggga

SEQ ID NO: 499961 - DNA, 20 bp, Artificial
  CRISPR gRNA sequence
ccaagtagctgggattacag

SEQ ID NO: 499962 - DNA, 20 bp, Artificial
  CRISPR gRNA sequence
caagtagctgggattacagg

SEQ ID NO: 499963 - DNA, 20 bp, Artificial
  CRISPR gRNA sequence
ggattacaggtgtgcactgc

SEQ ID NO: 499964 - DNA, 20 bp, Artificial
  CRISPR gRNA sequence
caggtgtgcactgccacgcc

SEQ ID NO: 499965 - DNA, 20 bp, Artificial
  CRISPR gRNA sequence
ccacgcccagctaatttttt

SEQ ID NO: 499966 - DNA, 20 bp, Artificial
  CRISPR gRNA sequence
attttttttcttttttttga

SEQ ID NO: 499967 - DNA, 20 bp, Artificial
  CRISPR gRNA sequence
tttttcttttttttgagatg

SEQ ID NO: 499968 - DNA, 20 bp, Artificial
  CRISPR gRNA sequence
ttttcttttttttgagatgg

SEQ ID NO: 499969 - DNA, 20 bp, Artificial
  CRISPR gRNA sequence
tttcttttttttgagatggg

SEQ ID NO: 499970 - DNA, 20 bp, Artificial
  CRISPR gRNA sequence
ttcttttttttgagatgggg

SEQ ID NO: 499971 - DNA, 20 bp, Artificial
  CRISPR gRNA sequence
tcttttttttgagatggggt

SEQ ID NO: 499972 - DNA, 20 bp, Artificial
  CRISPR gRNA sequence
cttttttttgagatggggtt

SEQ ID NO: 499973 - DNA, 20 bp, Artificial
  CRISPR gRNA sequence
ttttttttgagatggggttt

SEQ ID NO: 499974 - DNA, 20 bp, Artificial
  CRISPR gRNA sequence
ttttttgagatggggtttca

SEQ ID NO: 499975 - DNA, 20 bp, Artificial
  CRISPR gRNA sequence
tttttgagatggggtttcac

SEQ ID NO: 499976 - DNA, 20 bp, Artificial
  CRISPR gRNA sequence
ttttgagatggggtttcacc

SEQ ID NO: 499977 - DNA, 20 bp, Artificial
  CRISPR gRNA sequence
tttgagatggggtttcacca

SEQ ID NO: 499978 - DNA, 20 bp, Artificial
  CRISPR gRNA sequence
ttgagatggggtttcaccat

SEQ ID NO: 499979 - DNA, 20 bp, Artificial
  CRISPR gRNA sequence
tgagatggggtttcaccatg

SEQ ID NO: 499980 - DNA, 20 bp, Artificial
  CRISPR gRNA sequence
gagatggggtttcaccatgt

SEQ ID NO: 499981 - DNA, 20 bp, Artificial
  CRISPR gRNA sequence
agatggggtttcaccatgtt

SEQ ID NO: 499982 - DNA, 20 bp, Artificial
  CRISPR gRNA sequence
caccatgttggccaggctgg

SEQ ID NO: 499983 - DNA, 20 bp, Artificial
  CRISPR gRNA sequence
accatgttggccaggctggt

SEQ ID NO: 499984 - DNA, 20 bp, Artificial
  CRISPR gRNA sequence
gccaggctggtctcaaactc

SEQ ID NO: 499985 - DNA, 20 bp, Artificial
  CRISPR gRNA sequence
gtctcaaactcctgacctca

SEQ ID NO: 499986 - DNA, 20 bp, Artificial
  CRISPR gRNA sequence
aaactcctgacctcaggtga

SEQ ID NO: 499987 - DNA, 20 bp, Artificial
  CRISPR gRNA sequence
ctgacctcaggtgatccgcc

SEQ ID NO: 499988 - DNA, 20 bp, Artificial
  CRISPR gRNA sequence
acctcaggtgatccgcctgc

SEQ ID NO: 499989 - DNA, 20 bp, Artificial
  CRISPR gRNA sequence
aggtgatccgcctgcctcga

SEQ ID NO: 499990 - DNA, 20 bp, Artificial
  CRISPR gRNA sequence
cctcgacctcccaaagtgct

SEQ ID NO: 499991 - DNA, 20 bp, Artificial
  CRISPR gRNA sequence
gacctcccaaagtgctggga

SEQ ID NO: 499992 - DNA, 20 bp, Artificial
  CRISPR gRNA sequence
ccaaagtgctgggattacag

SEQ ID NO: 499993 - DNA, 20 bp, Artificial
  CRISPR gRNA sequence
ggattacaggcatgagccac

SEQ ID NO: 499994 - DNA, 20 bp, Artificial
  CRISPR gRNA sequence
caggcatgagccaccatgcc

SEQ ID NO: 499995 - DNA, 20 bp, Artificial
  CRISPR gRNA sequence
gcccagattttcttgtgtac

SEQ ID NO: 499996 - DNA, 20 bp, Artificial
  CRISPR gRNA sequence
tcttgtgtacaaattcttct

SEQ ID NO: 499997 - DNA, 20 bp, Artificial
  CRISPR gRNA sequence
cttgtgtacaaattcttctg

SEQ ID NO: 499998 - DNA, 20 bp, Artificial
  CRISPR gRNA sequence
ttgtgtacaaattcttctgg

SEQ ID NO: 499999 - DNA, 20 bp, Artificial
  CRISPR gRNA sequence
gtgtacaaattcttctggat

SEQ ID NO: 500000 - DNA, 20 bp, Artificial
  CRISPR gRNA sequence
tgtacaaattcttctggatc

SEQ ID NO: 500001 - DNA, 20 bp, Artificial
  CRISPR gRNA sequence
ttctggatcaaagggtatat

SEQ ID NO: 500002 - DNA, 20 bp, Artificial
  CRISPR gRNA sequence
ctggatcaaagggtatatgt

SEQ ID NO: 500003 - DNA, 20 bp, Artificial
  CRISPR gRNA sequence
tggatcaaagggtatatgta

SEQ ID NO: 500004 - DNA, 20 bp, Artificial
  CRISPR gRNA sequence
gatcaaagggtatatgtaag

SEQ ID NO: 500005 - DNA, 20 bp, Artificial
  CRISPR gRNA sequence
agttttagaagataccgtaa

SEQ ID NO: 500006 - DNA, 20 bp, Artificial
  CRISPR gRNA sequence
gttttagaagataccgtaaa

SEQ ID NO: 500007 - DNA, 20 bp, Artificial
  CRISPR gRNA sequence
tagaagataccgtaaaatag

SEQ ID NO: 500008 - DNA, 20 bp, Artificial
  CRISPR gRNA sequence
agaagataccgtaaaatagt

SEQ ID NO: 500009 - DNA, 20 bp, Artificial
  CRISPR gRNA sequence
gaagataccgtaaaatagtt

SEQ ID NO: 500010 - DNA, 20 bp, Artificial
  CRISPR gRNA sequence
tccaaagtgctggtaccaat

SEQ ID NO: 500011 - DNA, 20 bp, Artificial
  CRISPR gRNA sequence
ccaaagtgctggtaccaatt

SEQ ID NO: 500012 - DNA, 20 bp, Artificial
  CRISPR gRNA sequence
caaagtgctggtaccaattt

SEQ ID NO: 500013 - DNA, 20 bp, Artificial
  CRISPR gRNA sequence
gtaccaatttacactctcac

SEQ ID NO: 500014 - DNA, 20 bp, Artificial
  CRISPR gRNA sequence
acactctcactagcaataaa

SEQ ID NO: 500015 - DNA, 20 bp, Artificial
  CRISPR gRNA sequence
cactctcactagcaataaat

SEQ ID NO: 500016 - DNA, 20 bp, Artificial
  CRISPR gRNA sequence
tcactagcaataaatgagaa

SEQ ID NO: 500017 - DNA, 20 bp, Artificial
  CRISPR gRNA sequence
actagcaataaatgagaatc

SEQ ID NO: 500018 - DNA, 20 bp, Artificial
  CRISPR gRNA sequence
gcaataaatgagaatctcag

SEQ ID NO: 500019 - DNA, 20 bp, Artificial
  CRISPR gRNA sequence
agttgctcccatctctgtca

SEQ ID NO: 500020 - DNA, 20 bp, Artificial
  CRISPR gRNA sequence
ctcccatctctgtcaaccct

SEQ ID NO: 500021 - DNA, 20 bp, Artificial
  CRISPR gRNA sequence
ccatctctgtcaacccttgg

SEQ ID NO: 500022 - DNA, 20 bp, Artificial
  CRISPR gRNA sequence
tgtcaacccttggaattttc

SEQ ID NO: 500023 - DNA, 20 bp, Artificial
  CRISPR gRNA sequence
tcaacccttggaattttcac

SEQ ID NO: 500024 - DNA, 20 bp, Artificial
  CRISPR gRNA sequence
ggaattttcacatttattta

SEQ ID NO: 500025 - DNA, 20 bp, Artificial
  CRISPR gRNA sequence
gaattttcacatttatttat

SEQ ID NO: 500026 - DNA, 20 bp, Artificial
  CRISPR gRNA sequence
tcacatttatttatttacat

SEQ ID NO: 500027 - DNA, 20 bp, Artificial
  CRISPR gRNA sequence
cacatttatttatttacatt

SEQ ID NO: 500028 - DNA, 20 bp, Artificial
  CRISPR gRNA sequence
acatttatttatttacattt

SEQ ID NO: 500029 - DNA, 20 bp, Artificial
  CRISPR gRNA sequence
atttatttacatttattttc

SEQ ID NO: 500030 - DNA, 20 bp, Artificial
  CRISPR gRNA sequence
tttatttacatttattttcg

SEQ ID NO: 500031 - DNA, 20 bp, Artificial
  CRISPR gRNA sequence
atttacatttattttcgaga

SEQ ID NO: 500032 - DNA, 20 bp, Artificial
  CRISPR gRNA sequence
tttacatttattttcgagac

SEQ ID NO: 500033 - DNA, 20 bp, Artificial
  CRISPR gRNA sequence
acatttattttcgagaccaa

SEQ ID NO: 500034 - DNA, 20 bp, Artificial
  CRISPR gRNA sequence
catttattttcgagaccaag

SEQ ID NO: 500035 - DNA, 20 bp, Artificial
  CRISPR gRNA sequence
attttcgagaccaagtctca

SEQ ID NO: 500036 - DNA, 20 bp, Artificial
  CRISPR gRNA sequence
ttttcgagaccaagtctcag

SEQ ID NO: 500037 - DNA, 20 bp, Artificial
  CRISPR gRNA sequence
tcgagaccaagtctcagtct

SEQ ID NO: 500038 - DNA, 20 bp, Artificial
  CRISPR gRNA sequence
cgagaccaagtctcagtctg

SEQ ID NO: 500039 - DNA, 20 bp, Artificial
  CRISPR gRNA sequence
gagaccaagtctcagtctgt

SEQ ID NO: 500040 - DNA, 20 bp, Artificial
  CRISPR gRNA sequence
agtctgtcacccaggctgga

SEQ ID NO: 500041 - DNA, 20 bp, Artificial
  CRISPR gRNA sequence
tcacccaggctggagtacag

SEQ ID NO: 500042 - DNA, 20 bp, Artificial
  CRISPR gRNA sequence
gagtacagtggcgtgatctt

SEQ ID NO: 500043 - DNA, 20 bp, Artificial
  CRISPR gRNA sequence
ggctcactgcaacctctgcc

SEQ ID NO: 500044 - DNA, 20 bp, Artificial
  CRISPR gRNA sequence
gctcactgcaacctctgcct

SEQ ID NO: 500045 - DNA, 20 bp, Artificial
  CRISPR gRNA sequence
actgcaacctctgcctcctg

SEQ ID NO: 500046 - DNA, 20 bp, Artificial
  CRISPR gRNA sequence
caacctctgcctcctgggtt

SEQ ID NO: 500047 - DNA, 20 bp, Artificial
  CRISPR gRNA sequence
tgcctcctgggttcaagcaa

SEQ ID NO: 500048 - DNA, 20 bp, Artificial
  CRISPR gRNA sequence
cctcctgggttcaagcaatt

SEQ ID NO: 500049 - DNA, 20 bp, Artificial
  CRISPR gRNA sequence
ctgggttcaagcaattctcc

SEQ ID NO: 500050 - DNA, 20 bp, Artificial
  CRISPR gRNA sequence
ggttcaagcaattctcctgc

SEQ ID NO: 500051 - DNA, 20 bp, Artificial
  CRISPR gRNA sequence
aagcaattctcctgcctcag

SEQ ID NO: 500052 - DNA, 20 bp, Artificial
  CRISPR gRNA sequence
tcctgcctcagactcccaag

SEQ ID NO: 500053 - DNA, 20 bp, Artificial
  CRISPR gRNA sequence
ctgcctcagactcccaagaa

SEQ ID NO: 500054 - DNA, 20 bp, Artificial
  CRISPR gRNA sequence
cctcagactcccaagaagct

SEQ ID NO: 500055 - DNA, 20 bp, Artificial
  CRISPR gRNA sequence
agactcccaagaagctggta

SEQ ID NO: 500056 - DNA, 20 bp, Artificial
  CRISPR gRNA sequence
ccaagaagctggtattacag

SEQ ID NO: 500057 - DNA, 20 bp, Artificial
  CRISPR gRNA sequence
gtattacaggcgccaccacc

SEQ ID NO: 500058 - DNA, 20 bp, Artificial
  CRISPR gRNA sequence
caggcgccaccaccgtgctc

SEQ ID NO: 500059 - DNA, 20 bp, Artificial
  CRISPR gRNA sequence
tgctaatttttgcattttta

SEQ ID NO: 500060 - DNA, 20 bp, Artificial
  CRISPR gRNA sequence
ctaatttttgcatttttagt

SEQ ID NO: 500061 - DNA, 20 bp, Artificial
  CRISPR gRNA sequence
atttttgcatttttagtaga

SEQ ID NO: 500062 - DNA, 20 bp, Artificial
  CRISPR gRNA sequence
ttgcatttttagtagagatg

SEQ ID NO: 500063 - DNA, 20 bp, Artificial
  CRISPR gRNA sequence
tgcatttttagtagagatgg

SEQ ID NO: 500064 - DNA, 20 bp, Artificial
  CRISPR gRNA sequence
gcatttttagtagagatggg

SEQ ID NO: 500065 - DNA, 20 bp, Artificial
  CRISPR gRNA sequence
catttttagtagagatgggg

SEQ ID NO: 500066 - DNA, 20 bp, Artificial
  CRISPR gRNA sequence
ttagtagagatggggtttca

SEQ ID NO: 500067 - DNA, 20 bp, Artificial
  CRISPR gRNA sequence
tagtagagatggggtttcac

SEQ ID NO: 500068 - DNA, 20 bp, Artificial
  CRISPR gRNA sequence
agtagagatggggtttcacc

SEQ ID NO: 500069 - DNA, 20 bp, Artificial
  CRISPR gRNA sequence
gtagagatggggtttcacca

SEQ ID NO: 500070 - DNA, 20 bp, Artificial
  CRISPR gRNA sequence
caccatgttggccaggctgg

SEQ ID NO: 500071 - DNA, 20 bp, Artificial
  CRISPR gRNA sequence
accatgttggccaggctggc

SEQ ID NO: 500072 - DNA, 20 bp, Artificial
  CRISPR gRNA sequence
gccaggctggcctcgaactc

SEQ ID NO: 500073 - DNA, 20 bp, Artificial
  CRISPR gRNA sequence
gcctcgaactcctggcctca

SEQ ID NO: 500074 - DNA, 20 bp, Artificial
  CRISPR gRNA sequence
gaactcctggcctcaagcga

SEQ ID NO: 500075 - DNA, 20 bp, Artificial
  CRISPR gRNA sequence
ctggcctcaagcgatccacc

SEQ ID NO: 500076 - DNA, 20 bp, Artificial
  CRISPR gRNA sequence
gcctcaagcgatccacccgc

SEQ ID NO: 500077 - DNA, 20 bp, Artificial
  CRISPR gRNA sequence
aagcgatccacccgcctcgg

SEQ ID NO: 500078 - DNA, 20 bp, Artificial
  CRISPR gRNA sequence
ggcctcccaaagtgctggga

SEQ ID NO: 500079 - DNA, 20 bp, Artificial
  CRISPR gRNA sequence
ccaaagtgctgggattacag

SEQ ID NO: 500080 - DNA, 20 bp, Artificial
  CRISPR gRNA sequence
ggattacaggcttgagccgc

SEQ ID NO: 500081 - DNA, 20 bp, Artificial
  CRISPR gRNA sequence
caggcttgagccgcttcgcc

SEQ ID NO: 500082 - DNA, 20 bp, Artificial
  CRISPR gRNA sequence
gagccgcttcgcccagcctt

SEQ ID NO: 500083 - DNA, 20 bp, Artificial
  CRISPR gRNA sequence
agccgcttcgcccagccttc

SEQ ID NO: 500084 - DNA, 20 bp, Artificial
  CRISPR gRNA sequence
cgcccagccttcagaccttt

SEQ ID NO: 500085 - DNA, 20 bp, Artificial
  CRISPR gRNA sequence
gcccagccttcagaccttta

SEQ ID NO: 500086 - DNA, 20 bp, Artificial
  CRISPR gRNA sequence
cagacctttaaatgttagct

SEQ ID NO: 500087 - DNA, 20 bp, Artificial
  CRISPR gRNA sequence
agacctttaaatgttagcta

SEQ ID NO: 500088 - DNA, 20 bp, Artificial
  CRISPR gRNA sequence
taaatgttagctattttggt

SEQ ID NO: 500089 - DNA, 20 bp, Artificial
  CRISPR gRNA sequence
aaatgttagctattttggtg

SEQ ID NO: 500090 - DNA, 20 bp, Artificial
  CRISPR gRNA sequence
aatgttagctattttggtgg

SEQ ID NO: 500091 - DNA, 20 bp, Artificial
  CRISPR gRNA sequence
gctattttggtgggaatgtg

SEQ ID NO: 500092 - DNA, 20 bp, Artificial
  CRISPR gRNA sequence
ttttggtgggaatgtgaaat

SEQ ID NO: 500093 - DNA, 20 bp, Artificial
  CRISPR gRNA sequence
tggtgggaatgtgaaatctc

SEQ ID NO: 500094 - DNA, 20 bp, Artificial
  CRISPR gRNA sequence
ggtgggaatgtgaaatctca

SEQ ID NO: 500095 - DNA, 20 bp, Artificial
  CRISPR gRNA sequence
gtgggaatgtgaaatctcat

SEQ ID NO: 500096 - DNA, 20 bp, Artificial
  CRISPR gRNA sequence
attattctctgataactaat

SEQ ID NO: 500097 - DNA, 20 bp, Artificial
  CRISPR gRNA sequence
ttctctgataactaatgttg

SEQ ID NO: 500098 - DNA, 20 bp, Artificial
  CRISPR gRNA sequence
tctgataactaatgttgttg

SEQ ID NO: 500099 - DNA, 20 bp, Artificial
  CRISPR gRNA sequence
tgataactaatgttgttggg

SEQ ID NO: 500100 - DNA, 20 bp, Artificial
  CRISPR gRNA sequence
ataactaatgttgttgggca

SEQ ID NO: 500101 - DNA, 20 bp, Artificial
  CRISPR gRNA sequence
atgttgttgggcacccttat

SEQ ID NO: 500102 - DNA, 20 bp, Artificial
  CRISPR gRNA sequence
ttgggcacccttatgcatgc

SEQ ID NO: 500103 - DNA, 20 bp, Artificial
  CRISPR gRNA sequence
ggcacccttatgcatgccta

SEQ ID NO: 500104 - DNA, 20 bp, Artificial
  CRISPR gRNA sequence
atgcatgcctattggctatt

SEQ ID NO: 500105 - DNA, 20 bp, Artificial
  CRISPR gRNA sequence
tgcatgcctattggctattg

SEQ ID NO: 500106 - DNA, 20 bp, Artificial
  CRISPR gRNA sequence
ttggctattggatattctct

SEQ ID NO: 500107 - DNA, 20 bp, Artificial
  CRISPR gRNA sequence
gctattggatattctctttc

SEQ ID NO: 500108 - DNA, 20 bp, Artificial
  CRISPR gRNA sequence
ttggatattctctttcctaa

SEQ ID NO: 500109 - DNA, 20 bp, Artificial
  CRISPR gRNA sequence
gatattctctttcctaaagt

SEQ ID NO: 500110 - DNA, 20 bp, Artificial
  CRISPR gRNA sequence
tctttcctaaagtgcctgcc

SEQ ID NO: 500111 - DNA, 20 bp, Artificial
  CRISPR gRNA sequence
tttcctaaagtgcctgccca

SEQ ID NO: 500112 - DNA, 20 bp, Artificial
  CRISPR gRNA sequence
tcctaaagtgcctgcccaag

SEQ ID NO: 500113 - DNA, 20 bp, Artificial
  CRISPR gRNA sequence
cctaaagtgcctgcccaagt

SEQ ID NO: 500114 - DNA, 20 bp, Artificial
  CRISPR gRNA sequence
ctaaagtgcctgcccaagtc

SEQ ID NO: 500115 - DNA, 20 bp, Artificial
  CRISPR gRNA sequence
aagtgcctgcccaagtctgt

SEQ ID NO: 500116 - DNA, 20 bp, Artificial
  CRISPR gRNA sequence
cccaagtctgttgctttttt

SEQ ID NO: 500117 - DNA, 20 bp, Artificial
  CRISPR gRNA sequence
ttgctttttttgtcattatt

SEQ ID NO: 500118 - DNA, 20 bp, Artificial
  CRISPR gRNA sequence
ctttttttgtcattattgtc

SEQ ID NO: 500119 - DNA, 20 bp, Artificial
  CRISPR gRNA sequence
tttttgtcattattgtcatc

SEQ ID NO: 500120 - DNA, 20 bp, Artificial
  CRISPR gRNA sequence
ttttgtcattattgtcatca

SEQ ID NO: 500121 - DNA, 20 bp, Artificial
  CRISPR gRNA sequence
tttgtcattattgtcatcag

SEQ ID NO: 500122 - DNA, 20 bp, Artificial
  CRISPR gRNA sequence
ttgtcattattgtcatcagt

SEQ ID NO: 500123 - DNA, 20 bp, Artificial
  CRISPR gRNA sequence
tgtcattattgtcatcagtg

SEQ ID NO: 500124 - DNA, 20 bp, Artificial
  CRISPR gRNA sequence
gtcattattgtcatcagtgt

SEQ ID NO: 500125 - DNA, 20 bp, Artificial
  CRISPR gRNA sequence
tcattattgtcatcagtgta

SEQ ID NO: 500126 - DNA, 20 bp, Artificial
  CRISPR gRNA sequence
ttgtcatcagtgtattattg

SEQ ID NO: 500127 - DNA, 20 bp, Artificial
  CRISPR gRNA sequence
tcatcagtgtattattgatt

SEQ ID NO: 500128 - DNA, 20 bp, Artificial
  CRISPR gRNA sequence
ttgatttccagtctattatt

SEQ ID NO: 500129 - DNA, 20 bp, Artificial
  CRISPR gRNA sequence
atttccagtctattattgtc

SEQ ID NO: 500130 - DNA, 20 bp, Artificial
  CRISPR gRNA sequence
ccagtctattattgtcatca

SEQ ID NO: 500131 - DNA, 20 bp, Artificial
  CRISPR gRNA sequence
cagtctattattgtcatcag

SEQ ID NO: 500132 - DNA, 20 bp, Artificial
  CRISPR gRNA sequence
ttattgtcatcagtctatta

SEQ ID NO: 500133 - DNA, 20 bp, Artificial
  CRISPR gRNA sequence
ttgtcatcagtctattattg

SEQ ID NO: 500134 - DNA, 20 bp, Artificial
  CRISPR gRNA sequence
tcatcagtctattattgatg

SEQ ID NO: 500135 - DNA, 20 bp, Artificial
  CRISPR gRNA sequence
ttattgatggaattctttat

SEQ ID NO: 500136 - DNA, 20 bp, Artificial
  CRISPR gRNA sequence
ttgatggaattctttatata

SEQ ID NO: 500137 - DNA, 20 bp, Artificial
  CRISPR gRNA sequence
atggaattctttatatactc

SEQ ID NO: 500138 - DNA, 20 bp, Artificial
  CRISPR gRNA sequence
tttatatactctggatatga

SEQ ID NO: 500139 - DNA, 20 bp, Artificial
  CRISPR gRNA sequence
tatatactctggatatgagc

SEQ ID NO: 500140 - DNA, 20 bp, Artificial
  CRISPR gRNA sequence
atatactctggatatgagcc

SEQ ID NO: 500141 - DNA, 20 bp, Artificial
  CRISPR gRNA sequence
tatactctggatatgagccc

SEQ ID NO: 500142 - DNA, 20 bp, Artificial
  CRISPR gRNA sequence
tggatatgagccctttttca

SEQ ID NO: 500143 - DNA, 20 bp, Artificial
  CRISPR gRNA sequence
gatatgagccctttttcaaa

SEQ ID NO: 500144 - DNA, 20 bp, Artificial
  CRISPR gRNA sequence
tttcaaatgtatgtattgca

SEQ ID NO: 500145 - DNA, 20 bp, Artificial
  CRISPR gRNA sequence
ttcaaatgtatgtattgcaa

SEQ ID NO: 500146 - DNA, 20 bp, Artificial
  CRISPR gRNA sequence
tcaaatgtatgtattgcaaa

SEQ ID NO: 500147 - DNA, 20 bp, Artificial
  CRISPR gRNA sequence
caaatgtatgtattgcaaac

SEQ ID NO: 500148 - DNA, 20 bp, Artificial
  CRISPR gRNA sequence
aaatgtatgtattgcaaaca

SEQ ID NO: 500149 - DNA, 20 bp, Artificial
  CRISPR gRNA sequence
caaacattttctcccagtct

SEQ ID NO: 500150 - DNA, 20 bp, Artificial
  CRISPR gRNA sequence
tctcccagtctttggcttgc

SEQ ID NO: 500151 - DNA, 20 bp, Artificial
  CRISPR gRNA sequence
ctcccagtctttggcttgct

SEQ ID NO: 500152 - DNA, 20 bp, Artificial
  CRISPR gRNA sequence
tcccagtctttggcttgctt

SEQ ID NO: 500153 - DNA, 20 bp, Artificial
  CRISPR gRNA sequence
ccagtctttggcttgctttt

SEQ ID NO: 500154 - DNA, 20 bp, Artificial
  CRISPR gRNA sequence
tggcttgctttttcactctc

SEQ ID NO: 500155 - DNA, 20 bp, Artificial
  CRISPR gRNA sequence
ggcttgctttttcactctct

SEQ ID NO: 500156 - DNA, 20 bp, Artificial
  CRISPR gRNA sequence
gcttgctttttcactctctc

SEQ ID NO: 500157 - DNA, 20 bp, Artificial
  CRISPR gRNA sequence
gctttttcactctctcaatg

SEQ ID NO: 500158 - DNA, 20 bp, Artificial
  CRISPR gRNA sequence
ctttttcactctctcaatgt

SEQ ID NO: 500159 - DNA, 20 bp, Artificial
  CRISPR gRNA sequence
tttcactctctcaatgttgt

SEQ ID NO: 500160 - DNA, 20 bp, Artificial
  CRISPR gRNA sequence
ttcactctctcaatgttgtc

SEQ ID NO: 500161 - DNA, 20 bp, Artificial
  CRISPR gRNA sequence
tcactctctcaatgttgtct

SEQ ID NO: 500162 - DNA, 20 bp, Artificial
  CRISPR gRNA sequence
cactctctcaatgttgtctt

SEQ ID NO: 500163 - DNA, 20 bp, Artificial
  CRISPR gRNA sequence
actctctcaatgttgtcttt

SEQ ID NO: 500164 - DNA, 20 bp, Artificial
  CRISPR gRNA sequence
tctcaatgttgtctttcacc

SEQ ID NO: 500165 - DNA, 20 bp, Artificial
  CRISPR gRNA sequence
tcaatgttgtctttcaccaa

SEQ ID NO: 500166 - DNA, 20 bp, Artificial
  CRISPR gRNA sequence
aatgttgtctttcaccaaac

SEQ ID NO: 500167 - DNA, 20 bp, Artificial
  CRISPR gRNA sequence
tctttcaccaaacagaagtt

SEQ ID NO: 500168 - DNA, 20 bp, Artificial
  CRISPR gRNA sequence
tcaccaaacagaagttctaa

SEQ ID NO: 500169 - DNA, 20 bp, Artificial
  CRISPR gRNA sequence
caccaaacagaagttctaag

SEQ ID NO: 500170 - DNA, 20 bp, Artificial
  CRISPR gRNA sequence
accaaacagaagttctaagt

SEQ ID NO: 500171 - DNA, 20 bp, Artificial
  CRISPR gRNA sequence
taagttttagtgaagtccaa

SEQ ID NO: 500172 - DNA, 20 bp, Artificial
  CRISPR gRNA sequence
agttttagtgaagtccaatt

SEQ ID NO: 500173 - DNA, 20 bp, Artificial
  CRISPR gRNA sequence
tagtgaagtccaatttatca

SEQ ID NO: 500174 - DNA, 20 bp, Artificial
  CRISPR gRNA sequence
agtgaagtccaatttatcaa

SEQ ID NO: 500175 - DNA, 20 bp, Artificial
  CRISPR gRNA sequence
gtgaagtccaatttatcaat

SEQ ID NO: 500176 - DNA, 20 bp, Artificial
  CRISPR gRNA sequence
atcaatattcttttatggtt

SEQ ID NO: 500177 - DNA, 20 bp, Artificial
  CRISPR gRNA sequence
tcaatattcttttatggtta

SEQ ID NO: 500178 - DNA, 20 bp, Artificial
  CRISPR gRNA sequence
ttttatggttagtgatttat

SEQ ID NO: 500179 - DNA, 20 bp, Artificial
  CRISPR gRNA sequence
ttatggttagtgatttattt

SEQ ID NO: 500180 - DNA, 20 bp, Artificial
  CRISPR gRNA sequence
tatggttagtgatttatttt

SEQ ID NO: 500181 - DNA, 20 bp, Artificial
  CRISPR gRNA sequence
atggttagtgatttattttt

SEQ ID NO: 500182 - DNA, 20 bp, Artificial
  CRISPR gRNA sequence
tggttagtgatttatttttg

SEQ ID NO: 500183 - DNA, 20 bp, Artificial
  CRISPR gRNA sequence
gtgatttatttttgtgtgtg

SEQ ID NO: 500184 - DNA, 20 bp, Artificial
  CRISPR gRNA sequence
atttttgtgtgtgtgtgtcc

SEQ ID NO: 500185 - DNA, 20 bp, Artificial
  CRISPR gRNA sequence
tttttgtgtgtgtgtgtcct

SEQ ID NO: 500186 - DNA, 20 bp, Artificial
  CRISPR gRNA sequence
ttgtgtgtgtgtgtcctgtt

SEQ ID NO: 500187 - DNA, 20 bp, Artificial
  CRISPR gRNA sequence
tgtgtgtgtgtgtcctgtta

SEQ ID NO: 500188 - DNA, 20 bp, Artificial
  CRISPR gRNA sequence
gtgtgtgtgtgtcctgttaa

SEQ ID NO: 500189 - DNA, 20 bp, Artificial
  CRISPR gRNA sequence
tgtgtgtgtgtcctgttaaa

SEQ ID NO: 500190 - DNA, 20 bp, Artificial
  CRISPR gRNA sequence
ttaaagaaacatttgttgtc

SEQ ID NO: 500191 - DNA, 20 bp, Artificial
  CRISPR gRNA sequence
aagaaacatttgttgtctgg

SEQ ID NO: 500192 - DNA, 20 bp, Artificial
  CRISPR gRNA sequence
gttgtctgggtgcagtggct

SEQ ID NO: 500193 - DNA, 20 bp, Artificial
  CRISPR gRNA sequence
ttgtctgggtgcagtggctc

SEQ ID NO: 500194 - DNA, 20 bp, Artificial
  CRISPR gRNA sequence
tctgggtgcagtggctcatg

SEQ ID NO: 500195 - DNA, 20 bp, Artificial
  CRISPR gRNA sequence
ggtgcagtggctcatgcctg

SEQ ID NO: 500196 - DNA, 20 bp, Artificial
  CRISPR gRNA sequence
atgcctgtaatctcagcgct

SEQ ID NO: 500197 - DNA, 20 bp, Artificial
  CRISPR gRNA sequence
taatctcagcgctttgggag

SEQ ID NO: 500198 - DNA, 20 bp, Artificial
  CRISPR gRNA sequence
agcgctttgggaggccaagg

SEQ ID NO: 500199 - DNA, 20 bp, Artificial
  CRISPR gRNA sequence
tgggaggccaaggcgggtgg

SEQ ID NO: 500200 - DNA, 20 bp, Artificial
  CRISPR gRNA sequence
gggaggccaaggcgggtgga

SEQ ID NO: 500201 - DNA, 20 bp, Artificial
  CRISPR gRNA sequence
ggaggccaaggcgggtggat

SEQ ID NO: 500202 - DNA, 20 bp, Artificial
  CRISPR gRNA sequence
gagcccaggagttcaagaca

SEQ ID NO: 500203 - DNA, 20 bp, Artificial
  CRISPR gRNA sequence
agcccaggagttcaagacaa

SEQ ID NO: 500204 - DNA, 20 bp, Artificial
  CRISPR gRNA sequence
aagacaagccttggcaacat

SEQ ID NO: 500205 - DNA, 20 bp, Artificial
  CRISPR gRNA sequence
ggcaacatggtgaaactcta

SEQ ID NO: 500206 - DNA, 20 bp, Artificial
  CRISPR gRNA sequence
gcaacatggtgaaactctat

SEQ ID NO: 500207 - DNA, 20 bp, Artificial
  CRISPR gRNA sequence
tatctctaccaaaaatgcaa

SEQ ID NO: 500208 - DNA, 20 bp, Artificial
  CRISPR gRNA sequence
tctctaccaaaaatgcaaaa

SEQ ID NO: 500209 - DNA, 20 bp, Artificial
  CRISPR gRNA sequence
taccaaaaatgcaaaaatta

SEQ ID NO: 500210 - DNA, 20 bp, Artificial
  CRISPR gRNA sequence
ccaaaaatgcaaaaattagc

SEQ ID NO: 500211 - DNA, 20 bp, Artificial
  CRISPR gRNA sequence
gccagtctcataatctggtc

SEQ ID NO: 500212 - DNA, 20 bp, Artificial
  CRISPR gRNA sequence
ataatctggtctcaaaataa

SEQ ID NO: 500213 - DNA, 20 bp, Artificial
  CRISPR gRNA sequence
gtctcaaaataaacataaaa

SEQ ID NO: 500214 - DNA, 20 bp, Artificial
  CRISPR gRNA sequence
aaaataaacataaaaataga

SEQ ID NO: 500215 - DNA, 20 bp, Artificial
  CRISPR gRNA sequence
aaatgtaaaaataaaaaagg

SEQ ID NO: 500216 - DNA, 20 bp, Artificial
  CRISPR gRNA sequence
gtctatctcaagatgtagaa

SEQ ID NO: 500217 - DNA, 20 bp, Artificial
  CRISPR gRNA sequence
tctatctcaagatgtagaag

SEQ ID NO: 500218 - DNA, 20 bp, Artificial
  CRISPR gRNA sequence
tctcaagatgtagaagatat

SEQ ID NO: 500219 - DNA, 20 bp, Artificial
  CRISPR gRNA sequence
aagatgtagaagatattctc

SEQ ID NO: 500220 - DNA, 20 bp, Artificial
  CRISPR gRNA sequence
tcttgtgctttttcctggaa

SEQ ID NO: 500221 - DNA, 20 bp, Artificial
  CRISPR gRNA sequence
ttgtgctttttcctggaagc

SEQ ID NO: 500222 - DNA, 20 bp, Artificial
  CRISPR gRNA sequence
gtgctttttcctggaagctt

SEQ ID NO: 500223 - DNA, 20 bp, Artificial
  CRISPR gRNA sequence
tgctttttcctggaagcttt

SEQ ID NO: 500224 - DNA, 20 bp, Artificial
  CRISPR gRNA sequence
tttcctggaagctttatagg

SEQ ID NO: 500225 - DNA, 20 bp, Artificial
  CRISPR gRNA sequence
ttcctggaagctttataggt

SEQ ID NO: 500226 - DNA, 20 bp, Artificial
  CRISPR gRNA sequence
tcctggaagctttataggtt

SEQ ID NO: 500227 - DNA, 20 bp, Artificial
  CRISPR gRNA sequence
cctggaagctttataggttt

SEQ ID NO: 500228 - DNA, 20 bp, Artificial
  CRISPR gRNA sequence
ctggaagctttataggttta

SEQ ID NO: 500229 - DNA, 20 bp, Artificial
  CRISPR gRNA sequence
gaagctttataggtttagct

SEQ ID NO: 500230 - DNA, 20 bp, Artificial
  CRISPR gRNA sequence
tataggtttagctttcatat

SEQ ID NO: 500231 - DNA, 20 bp, Artificial
  CRISPR gRNA sequence
ataggtttagctttcatatt

SEQ ID NO: 500232 - DNA, 20 bp, Artificial
  CRISPR gRNA sequence
taggtttagctttcatattt

SEQ ID NO: 500233 - DNA, 20 bp, Artificial
  CRISPR gRNA sequence
agctttcatatttaaattta

SEQ ID NO: 500234 - DNA, 20 bp, Artificial
  CRISPR gRNA sequence
gctttcatatttaaatttat

SEQ ID NO: 500235 - DNA, 20 bp, Artificial
  CRISPR gRNA sequence
tcatatttaaatttatgatt

SEQ ID NO: 500236 - DNA, 20 bp, Artificial
  CRISPR gRNA sequence
catatttaaatttatgattt

SEQ ID NO: 500237 - DNA, 20 bp, Artificial
  CRISPR gRNA sequence
atatttaaatttatgatttg

SEQ ID NO: 500238 - DNA, 20 bp, Artificial
  CRISPR gRNA sequence
aaatttatgatttgttttaa

SEQ ID NO: 500239 - DNA, 20 bp, Artificial
  CRISPR gRNA sequence
aatttatgatttgttttaaa

SEQ ID NO: 500240 - DNA, 20 bp, Artificial
  CRISPR gRNA sequence
atgatttgttttaaattaat

SEQ ID NO: 500241 - DNA, 20 bp, Artificial
  CRISPR gRNA sequence
tgatttgttttaaattaatt

SEQ ID NO: 500242 - DNA, 20 bp, Artificial
  CRISPR gRNA sequence
gttttaaattaatttttgta

SEQ ID NO: 500243 - DNA, 20 bp, Artificial
  CRISPR gRNA sequence
ttttaaattaatttttgtat

SEQ ID NO: 500244 - DNA, 20 bp, Artificial
  CRISPR gRNA sequence
taaattaatttttgtatatg

SEQ ID NO: 500245 - DNA, 20 bp, Artificial
  CRISPR gRNA sequence
aaattaatttttgtatatga

SEQ ID NO: 500246 - DNA, 20 bp, Artificial
  CRISPR gRNA sequence
aattaatttttgtatatgat

SEQ ID NO: 500247 - DNA, 20 bp, Artificial
  CRISPR gRNA sequence
atttttgtatatgatatgag

SEQ ID NO: 500248 - DNA, 20 bp, Artificial
  CRISPR gRNA sequence
ttgtatatgatatgagggag

SEQ ID NO: 500249 - DNA, 20 bp, Artificial
  CRISPR gRNA sequence
tgtatatgatatgagggaga

SEQ ID NO: 500250 - DNA, 20 bp, Artificial
  CRISPR gRNA sequence
gtatatgatatgagggagat

SEQ ID NO: 500251 - DNA, 20 bp, Artificial
  CRISPR gRNA sequence
tatatgatatgagggagata

SEQ ID NO: 500252 - DNA, 20 bp, Artificial
  CRISPR gRNA sequence
tttttccttatagatatcaa

SEQ ID NO: 500253 - DNA, 20 bp, Artificial
  CRISPR gRNA sequence
ttttccttatagatatcaat

SEQ ID NO: 500254 - DNA, 20 bp, Artificial
  CRISPR gRNA sequence
tttccttatagatatcaatt

SEQ ID NO: 500255 - DNA, 20 bp, Artificial
  CRISPR gRNA sequence
ttccttatagatatcaattt

SEQ ID NO: 500256 - DNA, 20 bp, Artificial
  CRISPR gRNA sequence
tccttatagatatcaatttg

SEQ ID NO: 500257 - DNA, 20 bp, Artificial
  CRISPR gRNA sequence
ccttatagatatcaatttga

SEQ ID NO: 500258 - DNA, 20 bp, Artificial
  CRISPR gRNA sequence
cttatagatatcaatttgac

SEQ ID NO: 500259 - DNA, 20 bp, Artificial
  CRISPR gRNA sequence
atagatatcaatttgaccaa

SEQ ID NO: 500260 - DNA, 20 bp, Artificial
  CRISPR gRNA sequence
tagatatcaatttgaccaag

SEQ ID NO: 500261 - DNA, 20 bp, Artificial
  CRISPR gRNA sequence
gaccaagcaccatttattga

SEQ ID NO: 500262 - DNA, 20 bp, Artificial
  CRISPR gRNA sequence
accaagcaccatttattgaa

SEQ ID NO: 500263 - DNA, 20 bp, Artificial
  CRISPR gRNA sequence
attgaaaagatcaagtatgt

SEQ ID NO: 500264 - DNA, 20 bp, Artificial
  CRISPR gRNA sequence
ttgaaaagatcaagtatgtg

SEQ ID NO: 500265 - DNA, 20 bp, Artificial
  CRISPR gRNA sequence
aaaagatcaagtatgtgttg

SEQ ID NO: 500266 - DNA, 20 bp, Artificial
  CRISPR gRNA sequence
gtttgtgtgatattgtgaaa

SEQ ID NO: 500267 - DNA, 20 bp, Artificial
  CRISPR gRNA sequence
gtgtgatattgtgaaatata

SEQ ID NO: 500268 - DNA, 20 bp, Artificial
  CRISPR gRNA sequence
tgtgatattgtgaaatatat

SEQ ID NO: 500269 - DNA, 20 bp, Artificial
  CRISPR gRNA sequence
tgaaatatatatttggtttt

SEQ ID NO: 500270 - DNA, 20 bp, Artificial
  CRISPR gRNA sequence
ggttttcaacctcctttcct

SEQ ID NO: 500271 - DNA, 20 bp, Artificial
  CRISPR gRNA sequence
gttttcaacctcctttcctg

SEQ ID NO: 500272 - DNA, 20 bp, Artificial
  CRISPR gRNA sequence
tcaacctcctttcctggcat

SEQ ID NO: 500273 - DNA, 20 bp, Artificial
  CRISPR gRNA sequence
caacctcctttcctggcata

SEQ ID NO: 500274 - DNA, 20 bp, Artificial
  CRISPR gRNA sequence
aacctcctttcctggcatac

SEQ ID NO: 500275 - DNA, 20 bp, Artificial
  CRISPR gRNA sequence
ctttcctggcatacaattcc

SEQ ID NO: 500276 - DNA, 20 bp, Artificial
  CRISPR gRNA sequence
tcctggcatacaattcctaa

SEQ ID NO: 500277 - DNA, 20 bp, Artificial
  CRISPR gRNA sequence
cctggcatacaattcctaaa

SEQ ID NO: 500278 - DNA, 20 bp, Artificial
  CRISPR gRNA sequence
ctggcatacaattcctaaaa

SEQ ID NO: 500279 - DNA, 20 bp, Artificial
  CRISPR gRNA sequence
gcatacaattcctaaaattt

SEQ ID NO: 500280 - DNA, 20 bp, Artificial
  CRISPR gRNA sequence
ctaaaatttttagaaattcc

SEQ ID NO: 500281 - DNA, 20 bp, Artificial
  CRISPR gRNA sequence
aaatttttagaaattccgaa

SEQ ID NO: 500282 - DNA, 20 bp, Artificial
  CRISPR gRNA sequence
ttagaaattccgaagtgatg

SEQ ID NO: 500283 - DNA, 20 bp, Artificial
  CRISPR gRNA sequence
tagaaattccgaagtgatgt

SEQ ID NO: 500284 - DNA, 20 bp, Artificial
  CRISPR gRNA sequence
agaaattccgaagtgatgtc

SEQ ID NO: 500285 - DNA, 20 bp, Artificial
  CRISPR gRNA sequence
gaaattccgaagtgatgtct

SEQ ID NO: 500286 - DNA, 20 bp, Artificial
  CRISPR gRNA sequence
cgaagtgatgtctttttgta

SEQ ID NO: 500287 - DNA, 20 bp, Artificial
  CRISPR gRNA sequence
tttgtaggctaatgaggtga

SEQ ID NO: 500288 - DNA, 20 bp, Artificial
  CRISPR gRNA sequence
ttgtaggctaatgaggtgac

SEQ ID NO: 500289 - DNA, 20 bp, Artificial
  CRISPR gRNA sequence
tgtaggctaatgaggtgacc

SEQ ID NO: 500290 - DNA, 20 bp, Artificial
  CRISPR gRNA sequence
gtaggctaatgaggtgaccg

SEQ ID NO: 500291 - DNA, 20 bp, Artificial
  CRISPR gRNA sequence
taggctaatgaggtgaccga

SEQ ID NO: 500292 - DNA, 20 bp, Artificial
  CRISPR gRNA sequence
atgaggtgaccgatggctgg

SEQ ID NO: 500293 - DNA, 20 bp, Artificial
  CRISPR gRNA sequence
gcagcctgtaggcagcttcg

SEQ ID NO: 500294 - DNA, 20 bp, Artificial
  CRISPR gRNA sequence
taggcagcttcgggataggg

SEQ ID NO: 500295 - DNA, 20 bp, Artificial
  CRISPR gRNA sequence
cgggataggggccggtcacc

SEQ ID NO: 500296 - DNA, 20 bp, Artificial
  CRISPR gRNA sequence
gggataggggccggtcacca

SEQ ID NO: 500297 - DNA, 20 bp, Artificial
  CRISPR gRNA sequence
gaatattggactctgagccc

SEQ ID NO: 500298 - DNA, 20 bp, Artificial
  CRISPR gRNA sequence
gactctgagcccgtccccaa

SEQ ID NO: 500299 - DNA, 20 bp, Artificial
  CRISPR gRNA sequence
tgagcccgtccccaaccttc

SEQ ID NO: 500300 - DNA, 20 bp, Artificial
  CRISPR gRNA sequence
agcccgtccccaaccttcag

SEQ ID NO: 500301 - DNA, 20 bp, Artificial
  CRISPR gRNA sequence
caggaaaaggagagggattg

SEQ ID NO: 500302 - DNA, 20 bp, Artificial
  CRISPR gRNA sequence
aggaaaaggagagggattga

SEQ ID NO: 500303 - DNA, 20 bp, Artificial
  CRISPR gRNA sequence
aaggttaagttgatcaccga

SEQ ID NO: 500304 - DNA, 20 bp, Artificial
  CRISPR gRNA sequence
agttgatcaccgatggccag

SEQ ID NO: 500305 - DNA, 20 bp, Artificial
  CRISPR gRNA sequence
atcaccgatggccagtggtc

SEQ ID NO: 500306 - DNA, 20 bp, Artificial
  CRISPR gRNA sequence
ccatttattgaggcctccat

SEQ ID NO: 500307 - DNA, 20 bp, Artificial
  CRISPR gRNA sequence
attgaggcctccataaaaac

SEQ ID NO: 500308 - DNA, 20 bp, Artificial
  CRISPR gRNA sequence
ttgaggcctccataaaaacc

SEQ ID NO: 500309 - DNA, 20 bp, Artificial
  CRISPR gRNA sequence
aggcctccataaaaacccaa

SEQ ID NO: 500310 - DNA, 20 bp, Artificial
  CRISPR gRNA sequence
cataaaaacccaaagaacaa

SEQ ID NO: 500311 - DNA, 20 bp, Artificial
  CRISPR gRNA sequence
agagagctaaacatgcggag

SEQ ID NO: 500312 - DNA, 20 bp, Artificial
  CRISPR gRNA sequence
aacatgcggaggttcctgga

SEQ ID NO: 500313 - DNA, 20 bp, Artificial
  CRISPR gRNA sequence
ctggagggtggcacgccctg

SEQ ID NO: 500314 - DNA, 20 bp, Artificial
  CRISPR gRNA sequence
gagggtggcacgccctggga

SEQ ID NO: 500315 - DNA, 20 bp, Artificial
  CRISPR gRNA sequence
ggaaggcatggaaactctgt

SEQ ID NO: 500316 - DNA, 20 bp, Artificial
  CRISPR gRNA sequence
tgtatcccttcccctacacc

SEQ ID NO: 500317 - DNA, 20 bp, Artificial
  CRISPR gRNA sequence
tatcccttcccctacacctt

SEQ ID NO: 500318 - DNA, 20 bp, Artificial
  CRISPR gRNA sequence
cccctacaccttgtcctatg

SEQ ID NO: 500319 - DNA, 20 bp, Artificial
  CRISPR gRNA sequence
ccctacaccttgtcctatgc

SEQ ID NO: 500320 - DNA, 20 bp, Artificial
  CRISPR gRNA sequence
caccttgtcctatgcatctc

SEQ ID NO: 500321 - DNA, 20 bp, Artificial
  CRISPR gRNA sequence
gtcctatgcatctcttcata

SEQ ID NO: 500322 - DNA, 20 bp, Artificial
  CRISPR gRNA sequence
tcctatgcatctcttcatag

SEQ ID NO: 500323 - DNA, 20 bp, Artificial
  CRISPR gRNA sequence
tgcatctcttcataggtacc

SEQ ID NO: 500324 - DNA, 20 bp, Artificial
  CRISPR gRNA sequence
ttcataggtaccctttgtaa

SEQ ID NO: 500325 - DNA, 20 bp, Artificial
  CRISPR gRNA sequence
cataggtaccctttgtaata

SEQ ID NO: 500326 - DNA, 20 bp, Artificial
  CRISPR gRNA sequence
ataggtaccctttgtaataa

SEQ ID NO: 500327 - DNA, 20 bp, Artificial
  CRISPR gRNA sequence
tgtaataacctttataataa

SEQ ID NO: 500328 - DNA, 20 bp, Artificial
  CRISPR gRNA sequence
gtaataacctttataataat

SEQ ID NO: 500329 - DNA, 20 bp, Artificial
  CRISPR gRNA sequence
taataacctttataataatc

SEQ ID NO: 500330 - DNA, 20 bp, Artificial
  CRISPR gRNA sequence
tataataatccagtgaatgt

SEQ ID NO: 500331 - DNA, 20 bp, Artificial
  CRISPR gRNA sequence
ataataatccagtgaatgtg

SEQ ID NO: 500332 - DNA, 20 bp, Artificial
  CRISPR gRNA sequence
taataatccagtgaatgtgt

SEQ ID NO: 500333 - DNA, 20 bp, Artificial
  CRISPR gRNA sequence
ccctgagttctgtgagccat

SEQ ID NO: 500334 - DNA, 20 bp, Artificial
  CRISPR gRNA sequence
cctgagttctgtgagccatc

SEQ ID NO: 500335 - DNA, 20 bp, Artificial
  CRISPR gRNA sequence
agttctgtgagccatctagc

SEQ ID NO: 500336 - DNA, 20 bp, Artificial
  CRISPR gRNA sequence
tgtgagccatctagcaaatt

SEQ ID NO: 500337 - DNA, 20 bp, Artificial
  CRISPR gRNA sequence
tgagccatctagcaaattaa

SEQ ID NO: 500338 - DNA, 20 bp, Artificial
  CRISPR gRNA sequence
gcaaattaattgaacccaag

SEQ ID NO: 500339 - DNA, 20 bp, Artificial
  CRISPR gRNA sequence
attgaacccaaggagggaat

SEQ ID NO: 500340 - DNA, 20 bp, Artificial
  CRISPR gRNA sequence
aacccaaggagggaataacg

SEQ ID NO: 500341 - DNA, 20 bp, Artificial
  CRISPR gRNA sequence
atagctagttggtcagaagc

SEQ ID NO: 500342 - DNA, 20 bp, Artificial
  CRISPR gRNA sequence
tagctagttggtcagaagcg

SEQ ID NO: 500343 - DNA, 20 bp, Artificial
  CRISPR gRNA sequence
gttggtcagaagcgcaggta

SEQ ID NO: 500344 - DNA, 20 bp, Artificial
  CRISPR gRNA sequence
gtcagaagcgcaggtaaaac

SEQ ID NO: 500345 - DNA, 20 bp, Artificial
  CRISPR gRNA sequence
gagcttgcagttggcatctg

SEQ ID NO: 500346 - DNA, 20 bp, Artificial
  CRISPR gRNA sequence
gcagttggcatctggtggat

SEQ ID NO: 500347 - DNA, 20 bp, Artificial
  CRISPR gRNA sequence
cagttggcatctggtggata

SEQ ID NO: 500348 - DNA, 20 bp, Artificial
  CRISPR gRNA sequence
gcatctggtggatatctaca

SEQ ID NO: 500349 - DNA, 20 bp, Artificial
  CRISPR gRNA sequence
gtggatatctacaggtagat

SEQ ID NO: 500350 - DNA, 20 bp, Artificial
  CRISPR gRNA sequence
caggtagatagtgtcagaat

SEQ ID NO: 500351 - DNA, 20 bp, Artificial
  CRISPR gRNA sequence
aactgaattagaggacatcc

SEQ ID NO: 500352 - DNA, 20 bp, Artificial
  CRISPR gRNA sequence
aattagaggacatccagttg

SEQ ID NO: 500353 - DNA, 20 bp, Artificial
  CRISPR gRNA sequence
gaggacatccagttggtgtc

SEQ ID NO: 500354 - DNA, 20 bp, Artificial
  CRISPR gRNA sequence
gtgtccactgaagagctgat

SEQ ID NO: 500355 - DNA, 20 bp, Artificial
  CRISPR gRNA sequence
aagagctgattgcttgcttg

SEQ ID NO: 500356 - DNA, 20 bp, Artificial
  CRISPR gRNA sequence
attgcttgcttggcacgtgg

SEQ ID NO: 500357 - DNA, 20 bp, Artificial
  CRISPR gRNA sequence
cttgcttggcacgtgggaaa

SEQ ID NO: 500358 - DNA, 20 bp, Artificial
  CRISPR gRNA sequence
gcttggcacgtgggaaactc

SEQ ID NO: 500359 - DNA, 20 bp, Artificial
  CRISPR gRNA sequence
cttggcacgtgggaaactcc

SEQ ID NO: 500360 - DNA, 20 bp, Artificial
  CRISPR gRNA sequence
ggcacgtgggaaactcccca

SEQ ID NO: 500361 - DNA, 20 bp, Artificial
  CRISPR gRNA sequence
gcacgtgggaaactccccac

SEQ ID NO: 500362 - DNA, 20 bp, Artificial
  CRISPR gRNA sequence
cccacacgttggtcacagaa

SEQ ID NO: 500363 - DNA, 20 bp, Artificial
  CRISPR gRNA sequence
gtcacagaagtcttctgtgt

SEQ ID NO: 500364 - DNA, 20 bp, Artificial
  CRISPR gRNA sequence
ctgtgttgattgttgtggtg

SEQ ID NO: 500365 - DNA, 20 bp, Artificial
  CRISPR gRNA sequence
tgtgttgattgttgtggtgt

SEQ ID NO: 500366 - DNA, 20 bp, Artificial
  CRISPR gRNA sequence
tgttgattgttgtggtgtga

SEQ ID NO: 500367 - DNA, 20 bp, Artificial
  CRISPR gRNA sequence
attgttgtggtgtgaaacca

SEQ ID NO: 500368 - DNA, 20 bp, Artificial
  CRISPR gRNA sequence
ttgtggtgtgaaaccagagg

SEQ ID NO: 500369 - DNA, 20 bp, Artificial
  CRISPR gRNA sequence
tggtgtgaaaccagaggaaa

SEQ ID NO: 500370 - DNA, 20 bp, Artificial
  CRISPR gRNA sequence
gtgtttttcccacacacagg

SEQ ID NO: 500371 - DNA, 20 bp, Artificial
  CRISPR gRNA sequence
ttcccacacacagggtctat

SEQ ID NO: 500372 - DNA, 20 bp, Artificial
  CRISPR gRNA sequence
tcccacacacagggtctatt

SEQ ID NO: 500373 - DNA, 20 bp, Artificial
  CRISPR gRNA sequence
cccacacacagggtctattt

SEQ ID NO: 500374 - DNA, 20 bp, Artificial
  CRISPR gRNA sequence
ccacacacagggtctatttc

SEQ ID NO: 500375 - DNA, 20 bp, Artificial
  CRISPR gRNA sequence
tttctagactattatattcc

SEQ ID NO: 500376 - DNA, 20 bp, Artificial
  CRISPR gRNA sequence
ctagactattatattccatc

SEQ ID NO: 500377 - DNA, 20 bp, Artificial
  CRISPR gRNA sequence
tagactattatattccatcg

SEQ ID NO: 500378 - DNA, 20 bp, Artificial
  CRISPR gRNA sequence
gactattatattccatcgac

SEQ ID NO: 500379 - DNA, 20 bp, Artificial
  CRISPR gRNA sequence
ttatattccatcgactactt

SEQ ID NO: 500380 - DNA, 20 bp, Artificial
  CRISPR gRNA sequence
tattccatcgactacttttc

SEQ ID NO: 500381 - DNA, 20 bp, Artificial
  CRISPR gRNA sequence
catcgactacttttcaatcc

SEQ ID NO: 500382 - DNA, 20 bp, Artificial
  CRISPR gRNA sequence
cttttcaatccttgcaatac

SEQ ID NO: 500383 - DNA, 20 bp, Artificial
  CRISPR gRNA sequence
ttcaatccttgcaatactgg

SEQ ID NO: 500384 - DNA, 20 bp, Artificial
  CRISPR gRNA sequence
tcaatccttgcaatactgga

SEQ ID NO: 500385 - DNA, 20 bp, Artificial
  CRISPR gRNA sequence
caatccttgcaatactggaa

SEQ ID NO: 500386 - DNA, 20 bp, Artificial
  CRISPR gRNA sequence
aatccttgcaatactggaat

SEQ ID NO: 500387 - DNA, 20 bp, Artificial
  CRISPR gRNA sequence
gcaatactggaatgctatct

SEQ ID NO: 500388 - DNA, 20 bp, Artificial
  CRISPR gRNA sequence
caatactggaatgctatctt

SEQ ID NO: 500389 - DNA, 20 bp, Artificial
  CRISPR gRNA sequence
gaatgctatcttaatttctg

SEQ ID NO: 500390 - DNA, 20 bp, Artificial
  CRISPR gRNA sequence
tcttaatttctgaagtttta

SEQ ID NO: 500391 - DNA, 20 bp, Artificial
  CRISPR gRNA sequence
aatttctgaagttttacaat

SEQ ID NO: 500392 - DNA, 20 bp, Artificial
  CRISPR gRNA sequence
atttctgaagttttacaata

SEQ ID NO: 500393 - DNA, 20 bp, Artificial
  CRISPR gRNA sequence
ctgaagttttacaatatatc

SEQ ID NO: 500394 - DNA, 20 bp, Artificial
  CRISPR gRNA sequence
tgaagttttacaatatatct

SEQ ID NO: 500395 - DNA, 20 bp, Artificial
  CRISPR gRNA sequence
aagttttacaatatatcttg

SEQ ID NO: 500396 - DNA, 20 bp, Artificial
  CRISPR gRNA sequence
tacaatatatcttgatatta

SEQ ID NO: 500397 - DNA, 20 bp, Artificial
  CRISPR gRNA sequence
acaatatatcttgatattag

SEQ ID NO: 500398 - DNA, 20 bp, Artificial
  CRISPR gRNA sequence
caatatatcttgatattagg

SEQ ID NO: 500399 - DNA, 20 bp, Artificial
  CRISPR gRNA sequence
gatattaggtagtgaaaacc

SEQ ID NO: 500400 - DNA, 20 bp, Artificial
  CRISPR gRNA sequence
atattaggtagtgaaaacct

SEQ ID NO: 500401 - DNA, 20 bp, Artificial
  CRISPR gRNA sequence
ggtagtgaaaaccttctagc

SEQ ID NO: 500402 - DNA, 20 bp, Artificial
  CRISPR gRNA sequence
ctagctttgttcttcatcaa

SEQ ID NO: 500403 - DNA, 20 bp, Artificial
  CRISPR gRNA sequence
tagctttgttcttcatcaag

SEQ ID NO: 500404 - DNA, 20 bp, Artificial
  CRISPR gRNA sequence
gctttgttcttcatcaagat

SEQ ID NO: 500405 - DNA, 20 bp, Artificial
  CRISPR gRNA sequence
tgttcttcatcaagattgcc

SEQ ID NO: 500406 - DNA, 20 bp, Artificial
  CRISPR gRNA sequence
gttcttcatcaagattgcct

SEQ ID NO: 500407 - DNA, 20 bp, Artificial
  CRISPR gRNA sequence
ttcttcatcaagattgcctt

SEQ ID NO: 500408 - DNA, 20 bp, Artificial
  CRISPR gRNA sequence
ttcatcaagattgccttggc

SEQ ID NO: 500409 - DNA, 20 bp, Artificial
  CRISPR gRNA sequence
catcaagattgccttggcta

SEQ ID NO: 500410 - DNA, 20 bp, Artificial
  CRISPR gRNA sequence
atcaagattgccttggctat

SEQ ID NO: 500411 - DNA, 20 bp, Artificial
  CRISPR gRNA sequence
ccttggctattctatgtctt

SEQ ID NO: 500412 - DNA, 20 bp, Artificial
  CRISPR gRNA sequence
ggctattctatgtcttttac

SEQ ID NO: 500413 - DNA, 20 bp, Artificial
  CRISPR gRNA sequence
gctattctatgtcttttaca

SEQ ID NO: 500414 - DNA, 20 bp, Artificial
  CRISPR gRNA sequence
ttctatgtcttttacatttt

SEQ ID NO: 500415 - DNA, 20 bp, Artificial
  CRISPR gRNA sequence
tatgtcttttacattttcat

SEQ ID NO: 500416 - DNA, 20 bp, Artificial
  CRISPR gRNA sequence
tgtcttttacattttcatat

SEQ ID NO: 500417 - DNA, 20 bp, Artificial
  CRISPR gRNA sequence
ttacattttcatataagttt

SEQ ID NO: 500418 - DNA, 20 bp, Artificial
  CRISPR gRNA sequence
tacattttcatataagtttt

SEQ ID NO: 500419 - DNA, 20 bp, Artificial
  CRISPR gRNA sequence
acattttcatataagtttta

SEQ ID NO: 500420 - DNA, 20 bp, Artificial
  CRISPR gRNA sequence
cattttcatataagttttag

SEQ ID NO: 500421 - DNA, 20 bp, Artificial
  CRISPR gRNA sequence
tcatataagttttagaatca

SEQ ID NO: 500422 - DNA, 20 bp, Artificial
  CRISPR gRNA sequence
catataagttttagaatcaa

SEQ ID NO: 500423 - DNA, 20 bp, Artificial
  CRISPR gRNA sequence
atataagttttagaatcaac

SEQ ID NO: 500424 - DNA, 20 bp, Artificial
  CRISPR gRNA sequence
tagaatcaacttgttaattt

SEQ ID NO: 500425 - DNA, 20 bp, Artificial
  CRISPR gRNA sequence
agaatcaacttgttaatttc

SEQ ID NO: 500426 - DNA, 20 bp, Artificial
  CRISPR gRNA sequence
gaatcaacttgttaatttct

SEQ ID NO: 500427 - DNA, 20 bp, Artificial
  CRISPR gRNA sequence
gttaatttctataaaaataa

SEQ ID NO: 500428 - DNA, 20 bp, Artificial
  CRISPR gRNA sequence
ttaatttctataaaaataac

SEQ ID NO: 500429 - DNA, 20 bp, Artificial
  CRISPR gRNA sequence
atttctataaaaataacctg

SEQ ID NO: 500430 - DNA, 20 bp, Artificial
  CRISPR gRNA sequence
ctataaaaataacctgcaat

SEQ ID NO: 500431 - DNA, 20 bp, Artificial
  CRISPR gRNA sequence
tataaaaataacctgcaata

SEQ ID NO: 500432 - DNA, 20 bp, Artificial
  CRISPR gRNA sequence
taaaaataacctgcaataat

SEQ ID NO: 500433 - DNA, 20 bp, Artificial
  CRISPR gRNA sequence
caataatttttattggaatt

SEQ ID NO: 500434 - DNA, 20 bp, Artificial
  CRISPR gRNA sequence
ttattggaattctattgaat

SEQ ID NO: 500435 - DNA, 20 bp, Artificial
  CRISPR gRNA sequence
tattggaattctattgaatc

SEQ ID NO: 500436 - DNA, 20 bp, Artificial
  CRISPR gRNA sequence
attggaattctattgaatct

SEQ ID NO: 500437 - DNA, 20 bp, Artificial
  CRISPR gRNA sequence
ttggaattctattgaatcta

SEQ ID NO: 500438 - DNA, 20 bp, Artificial
  CRISPR gRNA sequence
gaattctattgaatctataa

SEQ ID NO: 500439 - DNA, 20 bp, Artificial
  CRISPR gRNA sequence
tattgaatctataaattaat

SEQ ID NO: 500440 - DNA, 20 bp, Artificial
  CRISPR gRNA sequence
ttgaatctataaattaattt

SEQ ID NO: 500441 - DNA, 20 bp, Artificial
  CRISPR gRNA sequence
aatctataaattaatttagg

SEQ ID NO: 500442 - DNA, 20 bp, Artificial
  CRISPR gRNA sequence
taaattaatttaggaagaat

SEQ ID NO: 500443 - DNA, 20 bp, Artificial
  CRISPR gRNA sequence
atttaggaagaattgacatc

SEQ ID NO: 500444 - DNA, 20 bp, Artificial
  CRISPR gRNA sequence
aggaagaattgacatcttag

SEQ ID NO: 500445 - DNA, 20 bp, Artificial
  CRISPR gRNA sequence
ggaagaattgacatcttagc

SEQ ID NO: 500446 - DNA, 20 bp, Artificial
  CRISPR gRNA sequence
acatcttagcaatattaagt

SEQ ID NO: 500447 - DNA, 20 bp, Artificial
  CRISPR gRNA sequence
agcaatattaagtcttccaa

SEQ ID NO: 500448 - DNA, 20 bp, Artificial
  CRISPR gRNA sequence
gcaatattaagtcttccaat

SEQ ID NO: 500449 - DNA, 20 bp, Artificial
  CRISPR gRNA sequence
agtcttccaataaaaaccat

SEQ ID NO: 500450 - DNA, 20 bp, Artificial
  CRISPR gRNA sequence
ccaataaaaaccatggtata

SEQ ID NO: 500451 - DNA, 20 bp, Artificial
  CRISPR gRNA sequence
caataaaaaccatggtatag

SEQ ID NO: 500452 - DNA, 20 bp, Artificial
  CRISPR gRNA sequence
ctgtttatttagctctttaa

SEQ ID NO: 500453 - DNA, 20 bp, Artificial
  CRISPR gRNA sequence
tttatttagctctttaattt

SEQ ID NO: 500454 - DNA, 20 bp, Artificial
  CRISPR gRNA sequence
atttagctctttaatttttt

SEQ ID NO: 500455 - DNA, 20 bp, Artificial
  CRISPR gRNA sequence
tttagctctttaattttttc

SEQ ID NO: 500456 - DNA, 20 bp, Artificial
  CRISPR gRNA sequence
agctctttaattttttctca

SEQ ID NO: 500457 - DNA, 20 bp, Artificial
  CRISPR gRNA sequence
gctctttaattttttctcag

SEQ ID NO: 500458 - DNA, 20 bp, Artificial
  CRISPR gRNA sequence
tttaattttttctcagcaat

SEQ ID NO: 500459 - DNA, 20 bp, Artificial
  CRISPR gRNA sequence
taattttttctcagcaatct

SEQ ID NO: 500460 - DNA, 20 bp, Artificial
  CRISPR gRNA sequence
aattttttctcagcaatctt

SEQ ID NO: 500461 - DNA, 20 bp, Artificial
  CRISPR gRNA sequence
attttttctcagcaatcttt

SEQ ID NO: 500462 - DNA, 20 bp, Artificial
  CRISPR gRNA sequence
tttctcagcaatcttttgtt

SEQ ID NO: 500463 - DNA, 20 bp, Artificial
  CRISPR gRNA sequence
ttctcagcaatcttttgttg

SEQ ID NO: 500464 - DNA, 20 bp, Artificial
  CRISPR gRNA sequence
tctcagcaatcttttgttgc

SEQ ID NO: 500465 - DNA, 20 bp, Artificial
  CRISPR gRNA sequence
ctcagcaatcttttgttgca

SEQ ID NO: 500466 - DNA, 20 bp, Artificial
  CRISPR gRNA sequence
tcagcaatcttttgttgcaa

SEQ ID NO: 500467 - DNA, 20 bp, Artificial
  CRISPR gRNA sequence
agcaatcttttgttgcaata

SEQ ID NO: 500468 - DNA, 20 bp, Artificial
  CRISPR gRNA sequence
ttgttgcaataggtgtatag

SEQ ID NO: 500469 - DNA, 20 bp, Artificial
  CRISPR gRNA sequence
tgttgcaataggtgtatagg

SEQ ID NO: 500470 - DNA, 20 bp, Artificial
  CRISPR gRNA sequence
gttgcaataggtgtataggt

SEQ ID NO: 500471 - DNA, 20 bp, Artificial
  CRISPR gRNA sequence
ttgcaataggtgtataggtc

SEQ ID NO: 500472 - DNA, 20 bp, Artificial
  CRISPR gRNA sequence
caataggtgtataggtctta

SEQ ID NO: 500473 - DNA, 20 bp, Artificial
  CRISPR gRNA sequence
aaatatttcttcttgaaatt

SEQ ID NO: 500474 - DNA, 20 bp, Artificial
  CRISPR gRNA sequence
aatatttcttcttgaaatta

SEQ ID NO: 500475 - DNA, 20 bp, Artificial
  CRISPR gRNA sequence
cttcttgaaattatttctat

SEQ ID NO: 500476 - DNA, 20 bp, Artificial
  CRISPR gRNA sequence
ttcttgaaattatttctata

SEQ ID NO: 500477 - DNA, 20 bp, Artificial
  CRISPR gRNA sequence
cttgaaattatttctatata

SEQ ID NO: 500478 - DNA, 20 bp, Artificial
  CRISPR gRNA sequence
ttgaaattatttctatatat

SEQ ID NO: 500479 - DNA, 20 bp, Artificial
  CRISPR gRNA sequence
gaaattatttctatatattt

SEQ ID NO: 500480 - DNA, 20 bp, Artificial
  CRISPR gRNA sequence
aaattatttctatatatttt

SEQ ID NO: 500481 - DNA, 20 bp, Artificial
  CRISPR gRNA sequence
tttctatatattttatcttt

SEQ ID NO: 500482 - DNA, 20 bp, Artificial
  CRISPR gRNA sequence
ctatatattttatctttttt

SEQ ID NO: 500483 - DNA, 20 bp, Artificial
  CRISPR gRNA sequence
tatatattttatcttttttg

SEQ ID NO: 500484 - DNA, 20 bp, Artificial
  CRISPR gRNA sequence
tatattttatcttttttgtg

SEQ ID NO: 500485 - DNA, 20 bp, Artificial
  CRISPR gRNA sequence
tatcttttttgtgctgctgt

SEQ ID NO: 500486 - DNA, 20 bp, Artificial
  CRISPR gRNA sequence
atcttttttgtgctgctgta

SEQ ID NO: 500487 - DNA, 20 bp, Artificial
  CRISPR gRNA sequence
tcttttttgtgctgctgtaa

SEQ ID NO: 500488 - DNA, 20 bp, Artificial
  CRISPR gRNA sequence
ttttgtgctgctgtaaatag

SEQ ID NO: 500489 - DNA, 20 bp, Artificial
  CRISPR gRNA sequence
tttgtgctgctgtaaatagt

SEQ ID NO: 500490 - DNA, 20 bp, Artificial
  CRISPR gRNA sequence
ttgtgctgctgtaaatagta

SEQ ID NO: 500491 - DNA, 20 bp, Artificial
  CRISPR gRNA sequence
tgtgctgctgtaaatagtat

SEQ ID NO: 500492 - DNA, 20 bp, Artificial
  CRISPR gRNA sequence
gtgctgctgtaaatagtatt

SEQ ID NO: 500493 - DNA, 20 bp, Artificial
  CRISPR gRNA sequence
tgctgctgtaaatagtattg

SEQ ID NO: 500494 - DNA, 20 bp, Artificial
  CRISPR gRNA sequence
ctgtaaatagtattgttttc

SEQ ID NO: 500495 - DNA, 20 bp, Artificial
  CRISPR gRNA sequence
taaatagtattgttttcaaa

SEQ ID NO: 500496 - DNA, 20 bp, Artificial
  CRISPR gRNA sequence
ttttcaaaatttcattttta

SEQ ID NO: 500497 - DNA, 20 bp, Artificial
  CRISPR gRNA sequence
tcaaaatttcatttttatct

SEQ ID NO: 500498 - DNA, 20 bp, Artificial
  CRISPR gRNA sequence
caaaatttcatttttatctg

SEQ ID NO: 500499 - DNA, 20 bp, Artificial
  CRISPR gRNA sequence
aaaatttcatttttatctgt

SEQ ID NO: 500500 - DNA, 20 bp, Artificial
  CRISPR gRNA sequence
catttttatctgtttgtact

SEQ ID NO: 500501 - DNA, 20 bp, Artificial
  CRISPR gRNA sequence
atttttatctgtttgtacta

SEQ ID NO: 500502 - DNA, 20 bp, Artificial
  CRISPR gRNA sequence
ttatctgtttgtactaatat

SEQ ID NO: 500503 - DNA, 20 bp, Artificial
  CRISPR gRNA sequence
tatctgtttgtactaatata

SEQ ID NO: 500504 - DNA, 20 bp, Artificial
  CRISPR gRNA sequence
atctgtttgtactaatatat

SEQ ID NO: 500505 - DNA, 20 bp, Artificial
  CRISPR gRNA sequence
tctgtttgtactaatatata

SEQ ID NO: 500506 - DNA, 20 bp, Artificial
  CRISPR gRNA sequence
tttgtactaatatatagaaa

SEQ ID NO: 500507 - DNA, 20 bp, Artificial
  CRISPR gRNA sequence
gtactaatatatagaaataa

SEQ ID NO: 500508 - DNA, 20 bp, Artificial
  CRISPR gRNA sequence
tactaatatatagaaataaa

SEQ ID NO: 500509 - DNA, 20 bp, Artificial
  CRISPR gRNA sequence
atatatagaaataaaaatga

SEQ ID NO: 500510 - DNA, 20 bp, Artificial
  CRISPR gRNA sequence
ttgtatattgaccttatatc

SEQ ID NO: 500511 - DNA, 20 bp, Artificial
  CRISPR gRNA sequence
tgtatattgaccttatatct

SEQ ID NO: 500512 - DNA, 20 bp, Artificial
  CRISPR gRNA sequence
gtatattgaccttatatcta

SEQ ID NO: 500513 - DNA, 20 bp, Artificial
  CRISPR gRNA sequence
tatattgaccttatatctag

SEQ ID NO: 500514 - DNA, 20 bp, Artificial
  CRISPR gRNA sequence
accttatatctagcaatttt

SEQ ID NO: 500515 - DNA, 20 bp, Artificial
  CRISPR gRNA sequence
atatctagcaattttgcaaa

SEQ ID NO: 500516 - DNA, 20 bp, Artificial
  CRISPR gRNA sequence
tatctagcaattttgcaaaa

SEQ ID NO: 500517 - DNA, 20 bp, Artificial
  CRISPR gRNA sequence
gcaattttgcaaaactgact

SEQ ID NO: 500518 - DNA, 20 bp, Artificial
  CRISPR gRNA sequence
tgcaaaactgacttctacac

SEQ ID NO: 500519 - DNA, 20 bp, Artificial
  CRISPR gRNA sequence
gcaaaactgacttctacact

SEQ ID NO: 500520 - DNA, 20 bp, Artificial
  CRISPR gRNA sequence
caaaactgacttctacactc

SEQ ID NO: 500521 - DNA, 20 bp, Artificial
  CRISPR gRNA sequence
acttctacactcaaataatt

SEQ ID NO: 500522 - DNA, 20 bp, Artificial
  CRISPR gRNA sequence
ctacactcaaataatttttc

SEQ ID NO: 500523 - DNA, 20 bp, Artificial
  CRISPR gRNA sequence
tacactcaaataatttttca

SEQ ID NO: 500524 - DNA, 20 bp, Artificial
  CRISPR gRNA sequence
cactcaaataatttttcata

SEQ ID NO: 500525 - DNA, 20 bp, Artificial
  CRISPR gRNA sequence
aaataatttttcatatagtc

SEQ ID NO: 500526 - DNA, 20 bp, Artificial
  CRISPR gRNA sequence
ttcatatagtcctcttggtt

SEQ ID NO: 500527 - DNA, 20 bp, Artificial
  CRISPR gRNA sequence
tcatatagtcctcttggttt

SEQ ID NO: 500528 - DNA, 20 bp, Artificial
  CRISPR gRNA sequence
catatagtcctcttggtttc

SEQ ID NO: 500529 - DNA, 20 bp, Artificial
  CRISPR gRNA sequence
atatagtcctcttggtttcc

SEQ ID NO: 500530 - DNA, 20 bp, Artificial
  CRISPR gRNA sequence
ttggtttcctatatacacag

SEQ ID NO: 500531 - DNA, 20 bp, Artificial
  CRISPR gRNA sequence
ggtttcctatatacacaggt

SEQ ID NO: 500532 - DNA, 20 bp, Artificial
  CRISPR gRNA sequence
gtttcctatatacacaggta

SEQ ID NO: 500533 - DNA, 20 bp, Artificial
  CRISPR gRNA sequence
cctatatacacaggtatata

SEQ ID NO: 500534 - DNA, 20 bp, Artificial
  CRISPR gRNA sequence
ctatatacacaggtatatag

SEQ ID NO: 500535 - DNA, 20 bp, Artificial
  CRISPR gRNA sequence
tatacacaggtatatagttt

SEQ ID NO: 500536 - DNA, 20 bp, Artificial
  CRISPR gRNA sequence
gtgaataatgacagtttcac

SEQ ID NO: 500537 - DNA, 20 bp, Artificial
  CRISPR gRNA sequence
tgaataatgacagtttcaca

SEQ ID NO: 500538 - DNA, 20 bp, Artificial
  CRISPR gRNA sequence
cacatattcatttttttttt

SEQ ID NO: 500539 - DNA, 20 bp, Artificial
  CRISPR gRNA sequence
acatattcattttttttttg

SEQ ID NO: 500540 - DNA, 20 bp, Artificial
  CRISPR gRNA sequence
attttttttttgagatggag

SEQ ID NO: 500541 - DNA, 20 bp, Artificial
  CRISPR gRNA sequence
tttttttgagatggagtttt

SEQ ID NO: 500542 - DNA, 20 bp, Artificial
  CRISPR gRNA sequence
ttttttgagatggagttttg

SEQ ID NO: 500543 - DNA, 20 bp, Artificial
  CRISPR gRNA sequence
tttttgagatggagttttgc

SEQ ID NO: 500544 - DNA, 20 bp, Artificial
  CRISPR gRNA sequence
ttttgagatggagttttgct

SEQ ID NO: 500545 - DNA, 20 bp, Artificial
  CRISPR gRNA sequence
tttgagatggagttttgctc

SEQ ID NO: 500546 - DNA, 20 bp, Artificial
  CRISPR gRNA sequence
ttgagatggagttttgctct

SEQ ID NO: 500547 - DNA, 20 bp, Artificial
  CRISPR gRNA sequence
tgagatggagttttgctctt

SEQ ID NO: 500548 - DNA, 20 bp, Artificial
  CRISPR gRNA sequence
gagatggagttttgctcttg

SEQ ID NO: 500549 - DNA, 20 bp, Artificial
  CRISPR gRNA sequence
agatggagttttgctcttgt

SEQ ID NO: 500550 - DNA, 20 bp, Artificial
  CRISPR gRNA sequence
tgctcttgttgcccaggctg

SEQ ID NO: 500551 - DNA, 20 bp, Artificial
  CRISPR gRNA sequence
gctcttgttgcccaggctgg

SEQ ID NO: 500552 - DNA, 20 bp, Artificial
  CRISPR gRNA sequence
ctcttgttgcccaggctgga

SEQ ID NO: 500553 - DNA, 20 bp, Artificial
  CRISPR gRNA sequence
ttgttgcccaggctggagtg

SEQ ID NO: 500554 - DNA, 20 bp, Artificial
  CRISPR gRNA sequence
gttgcccaggctggagtgca

SEQ ID NO: 500555 - DNA, 20 bp, Artificial
  CRISPR gRNA sequence
ttgcccaggctggagtgcaa

SEQ ID NO: 500556 - DNA, 20 bp, Artificial
  CRISPR gRNA sequence
cccaggctggagtgcaatgg

SEQ ID NO: 500557 - DNA, 20 bp, Artificial
  CRISPR gRNA sequence
gagtgcaatggtgccatctt

SEQ ID NO: 500558 - DNA, 20 bp, Artificial
  CRISPR gRNA sequence
ggctcactgcagcctccgct

SEQ ID NO: 500559 - DNA, 20 bp, Artificial
  CRISPR gRNA sequence
gctcactgcagcctccgctt

SEQ ID NO: 500560 - DNA, 20 bp, Artificial
  CRISPR gRNA sequence
actgcagcctccgcttcccg

SEQ ID NO: 500561 - DNA, 20 bp, Artificial
  CRISPR gRNA sequence
cagcctccgcttcccgggtt

SEQ ID NO: 500562 - DNA, 20 bp, Artificial
  CRISPR gRNA sequence
cgcttcccgggttcaagtga

SEQ ID NO: 500563 - DNA, 20 bp, Artificial
  CRISPR gRNA sequence
cccgggttcaagtgattctc

SEQ ID NO: 500564 - DNA, 20 bp, Artificial
  CRISPR gRNA sequence
ccgggttcaagtgattctcc

SEQ ID NO: 500565 - DNA, 20 bp, Artificial
  CRISPR gRNA sequence
aagtgattctcctgcctcag

SEQ ID NO: 500566 - DNA, 20 bp, Artificial
  CRISPR gRNA sequence
tcctgcctcagcctcccgag

SEQ ID NO: 500567 - DNA, 20 bp, Artificial
  CRISPR gRNA sequence
ctgcctcagcctcccgagta

SEQ ID NO: 500568 - DNA, 20 bp, Artificial
  CRISPR gRNA sequence
cctcagcctcccgagtagct

SEQ ID NO: 500569 - DNA, 20 bp, Artificial
  CRISPR gRNA sequence
agcctcccgagtagctggga

SEQ ID NO: 500570 - DNA, 20 bp, Artificial
  CRISPR gRNA sequence
ccgagtagctgggatttcag

SEQ ID NO: 500571 - DNA, 20 bp, Artificial
  CRISPR gRNA sequence
ggatttcaggtgactgccac

SEQ ID NO: 500572 - DNA, 20 bp, Artificial
  CRISPR gRNA sequence
caggtgactgccacccgcct

SEQ ID NO: 500573 - DNA, 20 bp, Artificial
  CRISPR gRNA sequence
aggtgactgccacccgcctg

SEQ ID NO: 500574 - DNA, 20 bp, Artificial
  CRISPR gRNA sequence
ccacccgcctggctaatttt

SEQ ID NO: 500575 - DNA, 20 bp, Artificial
  CRISPR gRNA sequence
gctaatttttgtatttttag

SEQ ID NO: 500576 - DNA, 20 bp, Artificial
  CRISPR gRNA sequence
atttttgtatttttagtaga

SEQ ID NO: 500577 - DNA, 20 bp, Artificial
  CRISPR gRNA sequence
ttgtatttttagtagagatg

SEQ ID NO: 500578 - DNA, 20 bp, Artificial
  CRISPR gRNA sequence
tgtatttttagtagagatgg

SEQ ID NO: 500579 - DNA, 20 bp, Artificial
  CRISPR gRNA sequence
gtatttttagtagagatgga

SEQ ID NO: 500580 - DNA, 20 bp, Artificial
  CRISPR gRNA sequence
tatttttagtagagatggag

SEQ ID NO: 500581 - DNA, 20 bp, Artificial
  CRISPR gRNA sequence
ttagtagagatggagtttca

SEQ ID NO: 500582 - DNA, 20 bp, Artificial
  CRISPR gRNA sequence
tagtagagatggagtttcac

SEQ ID NO: 500583 - DNA, 20 bp, Artificial
  CRISPR gRNA sequence
agtagagatggagtttcact

SEQ ID NO: 500584 - DNA, 20 bp, Artificial
  CRISPR gRNA sequence
gtagagatggagtttcactg

SEQ ID NO: 500585 - DNA, 20 bp, Artificial
  CRISPR gRNA sequence
cactgtgttggccaggctgg

SEQ ID NO: 500586 - DNA, 20 bp, Artificial
  CRISPR gRNA sequence
actgtgttggccaggctggt

SEQ ID NO: 500587 - DNA, 20 bp, Artificial
  CRISPR gRNA sequence
tgttggccaggctggtctcg

SEQ ID NO: 500588 - DNA, 20 bp, Artificial
  CRISPR gRNA sequence
gccaggctggtctcgaactc

SEQ ID NO: 500589 - DNA, 20 bp, Artificial
  CRISPR gRNA sequence
gtctcgaactcctgacctca

SEQ ID NO: 500590 - DNA, 20 bp, Artificial
  CRISPR gRNA sequence
gaactcctgacctcaggtga

SEQ ID NO: 500591 - DNA, 20 bp, Artificial
  CRISPR gRNA sequence
ctgacctcaggtgagctgcc

SEQ ID NO: 500592 - DNA, 20 bp, Artificial
  CRISPR gRNA sequence
acctcaggtgagctgcccaa

SEQ ID NO: 500593 - DNA, 20 bp, Artificial
  CRISPR gRNA sequence
aggtgagctgcccaaagtgc

SEQ ID NO: 500594 - DNA, 20 bp, Artificial
  CRISPR gRNA sequence
cccaaagtgctgggattaca

SEQ ID NO: 500595 - DNA, 20 bp, Artificial
  CRISPR gRNA sequence
ggattacaggcgtgagccac

SEQ ID NO: 500596 - DNA, 20 bp, Artificial
  CRISPR gRNA sequence
caggcgtgagccactgcgcc

SEQ ID NO: 500597 - DNA, 20 bp, Artificial
  CRISPR gRNA sequence
cgcccagcctcacatattca

SEQ ID NO: 500598 - DNA, 20 bp, Artificial
  CRISPR gRNA sequence
acatattcatttctaatttt

SEQ ID NO: 500599 - DNA, 20 bp, Artificial
  CRISPR gRNA sequence
atttctaatttttattccct

SEQ ID NO: 500600 - DNA, 20 bp, Artificial
  CRISPR gRNA sequence
ctaatttttattccctttga

SEQ ID NO: 500601 - DNA, 20 bp, Artificial
  CRISPR gRNA sequence
taatttttattccctttgac

SEQ ID NO: 500602 - DNA, 20 bp, Artificial
  CRISPR gRNA sequence
atttttattccctttgacta

SEQ ID NO: 500603 - DNA, 20 bp, Artificial
  CRISPR gRNA sequence
ttattccctttgactatttt

SEQ ID NO: 500604 - DNA, 20 bp, Artificial
  CRISPR gRNA sequence
tattccctttgactattttc

SEQ ID NO: 500605 - DNA, 20 bp, Artificial
  CRISPR gRNA sequence
attccctttgactattttcc

SEQ ID NO: 500606 - DNA, 20 bp, Artificial
  CRISPR gRNA sequence
ttccctttgactattttcct

SEQ ID NO: 500607 - DNA, 20 bp, Artificial
  CRISPR gRNA sequence
cctttgactattttccttgt

SEQ ID NO: 500608 - DNA, 20 bp, Artificial
  CRISPR gRNA sequence
tgactattttccttgttttg

SEQ ID NO: 500609 - DNA, 20 bp, Artificial
  CRISPR gRNA sequence
gactattttccttgttttgt

SEQ ID NO: 500610 - DNA, 20 bp, Artificial
  CRISPR gRNA sequence
actattttccttgttttgtt

SEQ ID NO: 500611 - DNA, 20 bp, Artificial
  CRISPR gRNA sequence
ttttccttgttttgttgaac

SEQ ID NO: 500612 - DNA, 20 bp, Artificial
  CRISPR gRNA sequence
tccttgttttgttgaactag

SEQ ID NO: 500613 - DNA, 20 bp, Artificial
  CRISPR gRNA sequence
ccttgttttgttgaactagc

SEQ ID NO: 500614 - DNA, 20 bp, Artificial
  CRISPR gRNA sequence
cttgttttgttgaactagcc

SEQ ID NO: 500615 - DNA, 20 bp, Artificial
  CRISPR gRNA sequence
gttttgttgaactagccatg

SEQ ID NO: 500616 - DNA, 20 bp, Artificial
  CRISPR gRNA sequence
ttttgttgaactagccatga

SEQ ID NO: 500617 - DNA, 20 bp, Artificial
  CRISPR gRNA sequence
tgttgaactagccatgacct

SEQ ID NO: 500618 - DNA, 20 bp, Artificial
  CRISPR gRNA sequence
gttgaactagccatgacctc

SEQ ID NO: 500619 - DNA, 20 bp, Artificial
  CRISPR gRNA sequence
ttgaactagccatgacctcc

SEQ ID NO: 500620 - DNA, 20 bp, Artificial
  CRISPR gRNA sequence
aactagccatgacctccagt

SEQ ID NO: 500621 - DNA, 20 bp, Artificial
  CRISPR gRNA sequence
gccatgacctccagtacaat

SEQ ID NO: 500622 - DNA, 20 bp, Artificial
  CRISPR gRNA sequence
cagtacaatgttgattaaaa

SEQ ID NO: 500623 - DNA, 20 bp, Artificial
  CRISPR gRNA sequence
attaaaagaggtaattatgg

SEQ ID NO: 500624 - DNA, 20 bp, Artificial
  CRISPR gRNA sequence
aaagaggtaattatggaatc

SEQ ID NO: 500625 - DNA, 20 bp, Artificial
  CRISPR gRNA sequence
tggaatcctttttctgttcc

SEQ ID NO: 500626 - DNA, 20 bp, Artificial
  CRISPR gRNA sequence
tttctgttcctgagtttgca

SEQ ID NO: 500627 - DNA, 20 bp, Artificial
  CRISPR gRNA sequence
ttctgttcctgagtttgcag

SEQ ID NO: 500628 - DNA, 20 bp, Artificial
  CRISPR gRNA sequence
tctgttcctgagtttgcagg

SEQ ID NO: 500629 - DNA, 20 bp, Artificial
  CRISPR gRNA sequence
ctgttcctgagtttgcaggg

SEQ ID NO: 500630 - DNA, 20 bp, Artificial
  CRISPR gRNA sequence
tgttcctgagtttgcaggga

SEQ ID NO: 500631 - DNA, 20 bp, Artificial
  CRISPR gRNA sequence
ttcctgagtttgcagggaca

SEQ ID NO: 500632 - DNA, 20 bp, Artificial
  CRISPR gRNA sequence
ctgagtttgcagggacatgg

SEQ ID NO: 500633 - DNA, 20 bp, Artificial
  CRISPR gRNA sequence
agtttgcagggacatggatg

SEQ ID NO: 500634 - DNA, 20 bp, Artificial
  CRISPR gRNA sequence
gcagggacatggatgaagct

SEQ ID NO: 500635 - DNA, 20 bp, Artificial
  CRISPR gRNA sequence
cagggacatggatgaagctg

SEQ ID NO: 500636 - DNA, 20 bp, Artificial
  CRISPR gRNA sequence
gaagccatcgttctcagcaa

SEQ ID NO: 500637 - DNA, 20 bp, Artificial
  CRISPR gRNA sequence
tcagcaaactaacacaggaa

SEQ ID NO: 500638 - DNA, 20 bp, Artificial
  CRISPR gRNA sequence
agcaaactaacacaggaaca

SEQ ID NO: 500639 - DNA, 20 bp, Artificial
  CRISPR gRNA sequence
acacaggaacagaaaaccaa

SEQ ID NO: 500640 - DNA, 20 bp, Artificial
  CRISPR gRNA sequence
tcactcaaagtgggagttga

SEQ ID NO: 500641 - DNA, 20 bp, Artificial
  CRISPR gRNA sequence
actcaaagtgggagttgaac

SEQ ID NO: 500642 - DNA, 20 bp, Artificial
  CRISPR gRNA sequence
aaagtgggagttgaacaatg

SEQ ID NO: 500643 - DNA, 20 bp, Artificial
  CRISPR gRNA sequence
aacaatgagaacatatgggc

SEQ ID NO: 500644 - DNA, 20 bp, Artificial
  CRISPR gRNA sequence
ttagtgggtgaggggcaagg

SEQ ID NO: 500645 - DNA, 20 bp, Artificial
  CRISPR gRNA sequence
gtgggtgaggggcaagggga

SEQ ID NO: 500646 - DNA, 20 bp, Artificial
  CRISPR gRNA sequence
ggacaaatacctaatgcatg

SEQ ID NO: 500647 - DNA, 20 bp, Artificial
  CRISPR gRNA sequence
atgcatgtggggcttaaaac

SEQ ID NO: 500648 - DNA, 20 bp, Artificial
  CRISPR gRNA sequence
aaaacctagatgatgggttg

SEQ ID NO: 500649 - DNA, 20 bp, Artificial
  CRISPR gRNA sequence
aaacctagatgatgggttga

SEQ ID NO: 500650 - DNA, 20 bp, Artificial
  CRISPR gRNA sequence
gatgatgggttgataggtgc

SEQ ID NO: 500651 - DNA, 20 bp, Artificial
  CRISPR gRNA sequence
ataggtgcagcaaaccacca

SEQ ID NO: 500652 - DNA, 20 bp, Artificial
  CRISPR gRNA sequence
cgtaacaaatctgcatgttc

SEQ ID NO: 500653 - DNA, 20 bp, Artificial
  CRISPR gRNA sequence
catgttctgcatacgtatcc

SEQ ID NO: 500654 - DNA, 20 bp, Artificial
  CRISPR gRNA sequence
tgcatacgtatcccagaact

SEQ ID NO: 500655 - DNA, 20 bp, Artificial
  CRISPR gRNA sequence
catacgtatcccagaactta

SEQ ID NO: 500656 - DNA, 20 bp, Artificial
  CRISPR gRNA sequence
aaagtaaaacaaaaaaaaaa

SEQ ID NO: 500657 - DNA, 20 bp, Artificial
  CRISPR gRNA sequence
aagtaaaacaaaaaaaaaaa

SEQ ID NO: 500658 - DNA, 20 bp, Artificial
  CRISPR gRNA sequence
gttgttttgaacaaacctct

SEQ ID NO: 500659 - DNA, 20 bp, Artificial
  CRISPR gRNA sequence
ttgttttgaacaaacctctc

SEQ ID NO: 500660 - DNA, 20 bp, Artificial
  CRISPR gRNA sequence
ttttgaacaaacctctccaa

SEQ ID NO: 500661 - DNA, 20 bp, Artificial
  CRISPR gRNA sequence
tgaacaaacctctccaacca

SEQ ID NO: 500662 - DNA, 20 bp, Artificial
  CRISPR gRNA sequence
gaacaaacctctccaaccat

SEQ ID NO: 500663 - DNA, 20 bp, Artificial
  CRISPR gRNA sequence
aacaaacctctccaaccatg

SEQ ID NO: 500664 - DNA, 20 bp, Artificial
  CRISPR gRNA sequence
tccaaccatgtttttcctct

SEQ ID NO: 500665 - DNA, 20 bp, Artificial
  CRISPR gRNA sequence
caaccatgtttttcctctgc

SEQ ID NO: 500666 - DNA, 20 bp, Artificial
  CRISPR gRNA sequence
ttcctctgctcccacatcaa

SEQ ID NO: 500667 - DNA, 20 bp, Artificial
  CRISPR gRNA sequence
tcctctgctcccacatcaaa

SEQ ID NO: 500668 - DNA, 20 bp, Artificial
  CRISPR gRNA sequence
cctctgctcccacatcaaaa

SEQ ID NO: 500669 - DNA, 20 bp, Artificial
  CRISPR gRNA sequence
ctctgctcccacatcaaaat

SEQ ID NO: 500670 - DNA, 20 bp, Artificial
  CRISPR gRNA sequence
tgctcccacatcaaaataat

SEQ ID NO: 500671 - DNA, 20 bp, Artificial
  CRISPR gRNA sequence
ctcccacatcaaaataataa

SEQ ID NO: 500672 - DNA, 20 bp, Artificial
  CRISPR gRNA sequence
ccacatcaaaataataacaa

SEQ ID NO: 500673 - DNA, 20 bp, Artificial
  CRISPR gRNA sequence
ctgtgaccaaatgcagggag

SEQ ID NO: 500674 - DNA, 20 bp, Artificial
  CRISPR gRNA sequence
tgtgaccaaatgcagggagg

SEQ ID NO: 500675 - DNA, 20 bp, Artificial
  CRISPR gRNA sequence
tgaccaaatgcagggaggtg

SEQ ID NO: 500676 - DNA, 20 bp, Artificial
  CRISPR gRNA sequence
ctcctcacagcaaactgaat

SEQ ID NO: 500677 - DNA, 20 bp, Artificial
  CRISPR gRNA sequence
tcctcacagcaaactgaata

SEQ ID NO: 500678 - DNA, 20 bp, Artificial
  CRISPR gRNA sequence
ctcacagcaaactgaataat

SEQ ID NO: 500679 - DNA, 20 bp, Artificial
  CRISPR gRNA sequence
acagcaaactgaataatgta

SEQ ID NO: 500680 - DNA, 20 bp, Artificial
  CRISPR gRNA sequence
aataatgtattctgcagtgg

SEQ ID NO: 500681 - DNA, 20 bp, Artificial
  CRISPR gRNA sequence
tgcagtggacaccagctggg

SEQ ID NO: 500682 - DNA, 20 bp, Artificial
  CRISPR gRNA sequence
cagtggacaccagctgggtg

SEQ ID NO: 500683 - DNA, 20 bp, Artificial
  CRISPR gRNA sequence
ggtgttctccaattcagttc

SEQ ID NO: 500684 - DNA, 20 bp, Artificial
  CRISPR gRNA sequence
tccaattcagttcagacact

SEQ ID NO: 500685 - DNA, 20 bp, Artificial
  CRISPR gRNA sequence
caattcagttcagacactaa

SEQ ID NO: 500686 - DNA, 20 bp, Artificial
  CRISPR gRNA sequence
agttcagacactaactggag

SEQ ID NO: 500687 - DNA, 20 bp, Artificial
  CRISPR gRNA sequence
agacactaactggagagagt

SEQ ID NO: 500688 - DNA, 20 bp, Artificial
  CRISPR gRNA sequence
actggagagagtgtcagacc

SEQ ID NO: 500689 - DNA, 20 bp, Artificial
  CRISPR gRNA sequence
gagagagtgtcagaccacag

SEQ ID NO: 500690 - DNA, 20 bp, Artificial
  CRISPR gRNA sequence
ggggctcagtccccaacacc

SEQ ID NO: 500691 - DNA, 20 bp, Artificial
  CRISPR gRNA sequence
agtccccaacaccacccctc

SEQ ID NO: 500692 - DNA, 20 bp, Artificial
  CRISPR gRNA sequence
caccacaccagttctaagtc

SEQ ID NO: 500693 - DNA, 20 bp, Artificial
  CRISPR gRNA sequence
taagtctgggcctccagaac

SEQ ID NO: 500694 - DNA, 20 bp, Artificial
  CRISPR gRNA sequence
agtctgggcctccagaactt

SEQ ID NO: 500695 - DNA, 20 bp, Artificial
  CRISPR gRNA sequence
ggcctccagaacttcggacc

SEQ ID NO: 500696 - DNA, 20 bp, Artificial
  CRISPR gRNA sequence
cagaacttcggaccaaccag

SEQ ID NO: 500697 - DNA, 20 bp, Artificial
  CRISPR gRNA sequence
cggaccaaccagcttccagt

SEQ ID NO: 500698 - DNA, 20 bp, Artificial
  CRISPR gRNA sequence
ggaccaaccagcttccagtt

SEQ ID NO: 500699 - DNA, 20 bp, Artificial
  CRISPR gRNA sequence
ccagttggggttctcacaac

SEQ ID NO: 500700 - DNA, 20 bp, Artificial
  CRISPR gRNA sequence
cagttggggttctcacaacc

SEQ ID NO: 500701 - DNA, 20 bp, Artificial
  CRISPR gRNA sequence
gggttctcacaaccccctcc

SEQ ID NO: 500702 - DNA, 20 bp, Artificial
  CRISPR gRNA sequence
tcacaaccccctccttgggt

SEQ ID NO: 500703 - DNA, 20 bp, Artificial
  CRISPR gRNA sequence
acaaccccctccttgggttc

SEQ ID NO: 500704 - DNA, 20 bp, Artificial
  CRISPR gRNA sequence
cttgggttcaattaatttgc

SEQ ID NO: 500705 - DNA, 20 bp, Artificial
  CRISPR gRNA sequence
gggttcaattaatttgctgg

SEQ ID NO: 500706 - DNA, 20 bp, Artificial
  CRISPR gRNA sequence
ggttcaattaatttgctgga

SEQ ID NO: 500707 - DNA, 20 bp, Artificial
  CRISPR gRNA sequence
aattaatttgctggagtggc

SEQ ID NO: 500708 - DNA, 20 bp, Artificial
  CRISPR gRNA sequence
atttgctggagtggctcaca

SEQ ID NO: 500709 - DNA, 20 bp, Artificial
  CRISPR gRNA sequence
gctggagtggctcacataaa

SEQ ID NO: 500710 - DNA, 20 bp, Artificial
  CRISPR gRNA sequence
ctggagtggctcacataaac

SEQ ID NO: 500711 - DNA, 20 bp, Artificial
  CRISPR gRNA sequence
gagtggctcacataaaccag

SEQ ID NO: 500712 - DNA, 20 bp, Artificial
  CRISPR gRNA sequence
acataaaccagggaaacatt

SEQ ID NO: 500713 - DNA, 20 bp, Artificial
  CRISPR gRNA sequence
atgtttgctggtctattata

SEQ ID NO: 500714 - DNA, 20 bp, Artificial
  CRISPR gRNA sequence
tgtttgctggtctattataa

SEQ ID NO: 500715 - DNA, 20 bp, Artificial
  CRISPR gRNA sequence
gctggtctattataagagat

SEQ ID NO: 500716 - DNA, 20 bp, Artificial
  CRISPR gRNA sequence
ctggtctattataagagata

SEQ ID NO: 500717 - DNA, 20 bp, Artificial
  CRISPR gRNA sequence
gtctattataagagatatta

SEQ ID NO: 500718 - DNA, 20 bp, Artificial
  CRISPR gRNA sequence
ttataagagatattacaaag

SEQ ID NO: 500719 - DNA, 20 bp, Artificial
  CRISPR gRNA sequence
taagagatattacaaaggat

SEQ ID NO: 500720 - DNA, 20 bp, Artificial
  CRISPR gRNA sequence
caaaggatacagatgaagag

SEQ ID NO: 500721 - DNA, 20 bp, Artificial
  CRISPR gRNA sequence
ccatgccttccctgggcaca

SEQ ID NO: 500722 - DNA, 20 bp, Artificial
  CRISPR gRNA sequence
catgccttccctgggcacac

SEQ ID NO: 500723 - DNA, 20 bp, Artificial
  CRISPR gRNA sequence
ccctgggcacactgcatgcc

SEQ ID NO: 500724 - DNA, 20 bp, Artificial
  CRISPR gRNA sequence
cctgggcacactgcatgcca

SEQ ID NO: 500725 - DNA, 20 bp, Artificial
  CRISPR gRNA sequence
ggcacactgcatgccaggaa

SEQ ID NO: 500726 - DNA, 20 bp, Artificial
  CRISPR gRNA sequence
catgccaggaatctccagct

SEQ ID NO: 500727 - DNA, 20 bp, Artificial
  CRISPR gRNA sequence
cagctatctggaggctctcc

SEQ ID NO: 500728 - DNA, 20 bp, Artificial
  CRISPR gRNA sequence
tctggaggctctccaagccc

SEQ ID NO: 500729 - DNA, 20 bp, Artificial
  CRISPR gRNA sequence
gaggctctccaagcccagtc

SEQ ID NO: 500730 - DNA, 20 bp, Artificial
  CRISPR gRNA sequence
tccaagcccagtcctcttgg

SEQ ID NO: 500731 - DNA, 20 bp, Artificial
  CRISPR gRNA sequence
caagcccagtcctcttgggt

SEQ ID NO: 500732 - DNA, 20 bp, Artificial
  CRISPR gRNA sequence
ttgggtttttatggagactt

SEQ ID NO: 500733 - DNA, 20 bp, Artificial
  CRISPR gRNA sequence
gggtttttatggagacttca

SEQ ID NO: 500734 - DNA, 20 bp, Artificial
  CRISPR gRNA sequence
ggtttttatggagacttcac

SEQ ID NO: 500735 - DNA, 20 bp, Artificial
  CRISPR gRNA sequence
ttatggagacttcacttcat

SEQ ID NO: 500736 - DNA, 20 bp, Artificial
  CRISPR gRNA sequence
tatggagacttcacttcata

SEQ ID NO: 500737 - DNA, 20 bp, Artificial
  CRISPR gRNA sequence
atggagacttcacttcatag

SEQ ID NO: 500738 - DNA, 20 bp, Artificial
  CRISPR gRNA sequence
tggagacttcacttcatagg

SEQ ID NO: 500739 - DNA, 20 bp, Artificial
  CRISPR gRNA sequence
cacttcataggcatgaccaa

SEQ ID NO: 500740 - DNA, 20 bp, Artificial
  CRISPR gRNA sequence
acttcataggcatgaccaac

SEQ ID NO: 500741 - DNA, 20 bp, Artificial
  CRISPR gRNA sequence
cataggcatgaccaacaacc

SEQ ID NO: 500742 - DNA, 20 bp, Artificial
  CRISPR gRNA sequence
ataggcatgaccaacaacct

SEQ ID NO: 500743 - DNA, 20 bp, Artificial
  CRISPR gRNA sequence
gtagaaatgtgactggatga

SEQ ID NO: 500744 - DNA, 20 bp, Artificial
  CRISPR gRNA sequence
tagaaatgtgactggatgaa

SEQ ID NO: 500745 - DNA, 20 bp, Artificial
  CRISPR gRNA sequence
gatgaaaagggtatgattcc

SEQ ID NO: 500746 - DNA, 20 bp, Artificial
  CRISPR gRNA sequence
catactaacaggctgagtgg

SEQ ID NO: 500747 - DNA, 20 bp, Artificial
  CRISPR gRNA sequence
acaggctgagtggagaaacc

SEQ ID NO: 500748 - DNA, 20 bp, Artificial
  CRISPR gRNA sequence
agtggagaaacccagcaagg

SEQ ID NO: 500749 - DNA, 20 bp, Artificial
  CRISPR gRNA sequence
tctgttcagattcttcttgg

SEQ ID NO: 500750 - DNA, 20 bp, Artificial
  CRISPR gRNA sequence
ttcagattcttcttggtctc

SEQ ID NO: 500751 - DNA, 20 bp, Artificial
  CRISPR gRNA sequence
agattcttcttggtctctct

SEQ ID NO: 500752 - DNA, 20 bp, Artificial
  CRISPR gRNA sequence
ttcttggtctctctgtgtag

SEQ ID NO: 500753 - DNA, 20 bp, Artificial
  CRISPR gRNA sequence
cttggtctctctgtgtagca

SEQ ID NO: 500754 - DNA, 20 bp, Artificial
  CRISPR gRNA sequence
ttggtctctctgtgtagcat

SEQ ID NO: 500755 - DNA, 20 bp, Artificial
  CRISPR gRNA sequence
ggtctctctgtgtagcattt

SEQ ID NO: 500756 - DNA, 20 bp, Artificial
  CRISPR gRNA sequence
gtctctctgtgtagcatttc

SEQ ID NO: 500757 - DNA, 20 bp, Artificial
  CRISPR gRNA sequence
tctgtgtagcatttctttct

SEQ ID NO: 500758 - DNA, 20 bp, Artificial
  CRISPR gRNA sequence
tgtgtagcatttctttctct

SEQ ID NO: 500759 - DNA, 20 bp, Artificial
  CRISPR gRNA sequence
tgtagcatttctttctctag

SEQ ID NO: 500760 - DNA, 20 bp, Artificial
  CRISPR gRNA sequence
ctttctctagaatctgaggc

SEQ ID NO: 500761 - DNA, 20 bp, Artificial
  CRISPR gRNA sequence
tttctctagaatctgaggca

SEQ ID NO: 500762 - DNA, 20 bp, Artificial
  CRISPR gRNA sequence
tctctagaatctgaggcagg

SEQ ID NO: 500763 - DNA, 20 bp, Artificial
  CRISPR gRNA sequence
ctctagaatctgaggcagga

SEQ ID NO: 500764 - DNA, 20 bp, Artificial
  CRISPR gRNA sequence
tctagaatctgaggcaggaa

SEQ ID NO: 500765 - DNA, 20 bp, Artificial
  CRISPR gRNA sequence
tagaatctgaggcaggaact

SEQ ID NO: 500766 - DNA, 20 bp, Artificial
  CRISPR gRNA sequence
gaatctgaggcaggaacttc

SEQ ID NO: 500767 - DNA, 20 bp, Artificial
  CRISPR gRNA sequence
aggcaggaacttctctgaaa

SEQ ID NO: 500768 - DNA, 20 bp, Artificial
  CRISPR gRNA sequence
ctctgaaatgagggtctttt

SEQ ID NO: 500769 - DNA, 20 bp, Artificial
  CRISPR gRNA sequence
tctgaaatgagggtcttttg

SEQ ID NO: 500770 - DNA, 20 bp, Artificial
  CRISPR gRNA sequence
tgaaatgagggtcttttgat

SEQ ID NO: 500771 - DNA, 20 bp, Artificial
  CRISPR gRNA sequence
aaatgagggtcttttgattt

SEQ ID NO: 500772 - DNA, 20 bp, Artificial
  CRISPR gRNA sequence
ttgatttatatcagattaga

SEQ ID NO: 500773 - DNA, 20 bp, Artificial
  CRISPR gRNA sequence
tgatttatatcagattagag

SEQ ID NO: 500774 - DNA, 20 bp, Artificial
  CRISPR gRNA sequence
gatttatatcagattagagt

SEQ ID NO: 500775 - DNA, 20 bp, Artificial
  CRISPR gRNA sequence
atttatatcagattagagtt

SEQ ID NO: 500776 - DNA, 20 bp, Artificial
  CRISPR gRNA sequence
atatcagattagagttgtct

SEQ ID NO: 500777 - DNA, 20 bp, Artificial
  CRISPR gRNA sequence
tatcagattagagttgtcta

SEQ ID NO: 500778 - DNA, 20 bp, Artificial
  CRISPR gRNA sequence
gagttgtctacactcagcaa

SEQ ID NO: 500779 - DNA, 20 bp, Artificial
  CRISPR gRNA sequence
tctacactcagcaatggtga

SEQ ID NO: 500780 - DNA, 20 bp, Artificial
  CRISPR gRNA sequence
cactcagcaatggtgatctt

SEQ ID NO: 500781 - DNA, 20 bp, Artificial
  CRISPR gRNA sequence
agcaatggtgatcttcttgc

SEQ ID NO: 500782 - DNA, 20 bp, Artificial
  CRISPR gRNA sequence
cttgctggtcttgccattcc

SEQ ID NO: 500783 - DNA, 20 bp, Artificial
  CRISPR gRNA sequence
ttgctggtcttgccattcct

SEQ ID NO: 500784 - DNA, 20 bp, Artificial
  CRISPR gRNA sequence
gctggtcttgccattcctgg

SEQ ID NO: 500785 - DNA, 20 bp, Artificial
  CRISPR gRNA sequence
ctggtcttgccattcctgga

SEQ ID NO: 500786 - DNA, 20 bp, Artificial
  CRISPR gRNA sequence
gtcttgccattcctggaccc

SEQ ID NO: 500787 - DNA, 20 bp, Artificial
  CRISPR gRNA sequence
gccattcctggacccaaagg

SEQ ID NO: 500788 - DNA, 20 bp, Artificial
  CRISPR gRNA sequence
ccattcctggacccaaaggg

SEQ ID NO: 500789 - DNA, 20 bp, Artificial
  CRISPR gRNA sequence
ctggacccaaagggctccat

SEQ ID NO: 500790 - DNA, 20 bp, Artificial
  CRISPR gRNA sequence
gacccaaagggctccatgct

SEQ ID NO: 500791 - DNA, 20 bp, Artificial
  CRISPR gRNA sequence
catgctgtctgcaatattca

SEQ ID NO: 500792 - DNA, 20 bp, Artificial
  CRISPR gRNA sequence
tctgcaatattcatgccccc

SEQ ID NO: 500793 - DNA, 20 bp, Artificial
  CRISPR gRNA sequence
caatattcatgccccctttc

SEQ ID NO: 500794 - DNA, 20 bp, Artificial
  CRISPR gRNA sequence
atgccccctttcaacttgcc

SEQ ID NO: 500795 - DNA, 20 bp, Artificial
  CRISPR gRNA sequence
tcaacttgccaaataccaca

SEQ ID NO: 500796 - DNA, 20 bp, Artificial
  CRISPR gRNA sequence
caacttgccaaataccacac

SEQ ID NO: 500797 - DNA, 20 bp, Artificial
  CRISPR gRNA sequence
aacttgccaaataccacacg

SEQ ID NO: 500798 - DNA, 20 bp, Artificial
  CRISPR gRNA sequence
gccaaataccacacgcttgc

SEQ ID NO: 500799 - DNA, 20 bp, Artificial
  CRISPR gRNA sequence
ccaaataccacacgcttgcc

SEQ ID NO: 500800 - DNA, 20 bp, Artificial
  CRISPR gRNA sequence
gccatccatccattcagtct

SEQ ID NO: 500801 - DNA, 20 bp, Artificial
  CRISPR gRNA sequence
ccatccatccattcagtctc

SEQ ID NO: 500802 - DNA, 20 bp, Artificial
  CRISPR gRNA sequence
agtctcggcaatgtagatga

SEQ ID NO: 500803 - DNA, 20 bp, Artificial
  CRISPR gRNA sequence
ggcaatgtagatgaaaaact

SEQ ID NO: 500804 - DNA, 20 bp, Artificial
  CRISPR gRNA sequence
ggaactatttgtgttgggtc

SEQ ID NO: 500805 - DNA, 20 bp, Artificial
  CRISPR gRNA sequence
tttgtgttgggtccagcatt

SEQ ID NO: 500806 - DNA, 20 bp, Artificial
  CRISPR gRNA sequence
gtgttgggtccagcatttgc

SEQ ID NO: 500807 - DNA, 20 bp, Artificial
  CRISPR gRNA sequence
tgttgggtccagcatttgcc

SEQ ID NO: 500808 - DNA, 20 bp, Artificial
  CRISPR gRNA sequence
ggtccagcatttgccatgga

SEQ ID NO: 500809 - DNA, 20 bp, Artificial
  CRISPR gRNA sequence
gccatggacaagatgccaag

SEQ ID NO: 500810 - DNA, 20 bp, Artificial
  CRISPR gRNA sequence
ccatggacaagatgccaaga

SEQ ID NO: 500811 - DNA, 20 bp, Artificial
  CRISPR gRNA sequence
tatgcttcaggatgaagttc

SEQ ID NO: 500812 - DNA, 20 bp, Artificial
  CRISPR gRNA sequence
caggatgaagttctcaccat

SEQ ID NO: 500813 - DNA, 20 bp, Artificial
  CRISPR gRNA sequence
aggatgaagttctcaccatc

SEQ ID NO: 500814 - DNA, 20 bp, Artificial
  CRISPR gRNA sequence
tcaccatcaaatttcacccc

SEQ ID NO: 500815 - DNA, 20 bp, Artificial
  CRISPR gRNA sequence
accatcaaatttcaccccat

SEQ ID NO: 500816 - DNA, 20 bp, Artificial
  CRISPR gRNA sequence
caccccatagatgaacttgc

SEQ ID NO: 500817 - DNA, 20 bp, Artificial
  CRISPR gRNA sequence
accccatagatgaacttgcc

SEQ ID NO: 500818 - DNA, 20 bp, Artificial
  CRISPR gRNA sequence
gccaccagtgccattatggt

SEQ ID NO: 500819 - DNA, 20 bp, Artificial
  CRISPR gRNA sequence
ccaccagtgccattatggtg

SEQ ID NO: 500820 - DNA, 20 bp, Artificial
  CRISPR gRNA sequence
tggtgtgtgatgtcaacatc

SEQ ID NO: 500821 - DNA, 20 bp, Artificial
  CRISPR gRNA sequence
gcacataaattctgcaataa

SEQ ID NO: 500822 - DNA, 20 bp, Artificial
  CRISPR gRNA sequence
tgcaataatcctgtgagagc

SEQ ID NO: 500823 - DNA, 20 bp, Artificial
  CRISPR gRNA sequence
caataatcctgtgagagcag

SEQ ID NO: 500824 - DNA, 20 bp, Artificial
  CRISPR gRNA sequence
tgagagcaggagctcttgta

SEQ ID NO: 500825 - DNA, 20 bp, Artificial
  CRISPR gRNA sequence
ttgtaaccaaatcatttctc

SEQ ID NO: 500826 - DNA, 20 bp, Artificial
  CRISPR gRNA sequence
gtaaccaaatcatttctctc

SEQ ID NO: 500827 - DNA, 20 bp, Artificial
  CRISPR gRNA sequence
taaccaaatcatttctctct

SEQ ID NO: 500828 - DNA, 20 bp, Artificial
  CRISPR gRNA sequence
ctctctagtgctcagaacac

SEQ ID NO: 500829 - DNA, 20 bp, Artificial
  CRISPR gRNA sequence
tctctagtgctcagaacaca

SEQ ID NO: 500830 - DNA, 20 bp, Artificial
  CRISPR gRNA sequence
tctagtgctcagaacacaaa

SEQ ID NO: 500831 - DNA, 20 bp, Artificial
  CRISPR gRNA sequence
tagtgctcagaacacaaatg

SEQ ID NO: 500832 - DNA, 20 bp, Artificial
  CRISPR gRNA sequence
gtgctcagaacacaaatgtt

SEQ ID NO: 500833 - DNA, 20 bp, Artificial
  CRISPR gRNA sequence
agaacacaaatgttttctgc

SEQ ID NO: 500834 - DNA, 20 bp, Artificial
  CRISPR gRNA sequence
tctgctgtctttggaacttt

SEQ ID NO: 500835 - DNA, 20 bp, Artificial
  CRISPR gRNA sequence
ctgctgtctttggaacttta

SEQ ID NO: 500836 - DNA, 20 bp, Artificial
  CRISPR gRNA sequence
tgctgtctttggaactttat

SEQ ID NO: 500837 - DNA, 20 bp, Artificial
  CRISPR gRNA sequence
ctgtctttggaactttatgt

SEQ ID NO: 500838 - DNA, 20 bp, Artificial
  CRISPR gRNA sequence
tctttggaactttatgtgca

SEQ ID NO: 500839 - DNA, 20 bp, Artificial
  CRISPR gRNA sequence
tggaactttatgtgcaaaca

SEQ ID NO: 500840 - DNA, 20 bp, Artificial
  CRISPR gRNA sequence
ggaactttatgtgcaaacag

SEQ ID NO: 500841 - DNA, 20 bp, Artificial
  CRISPR gRNA sequence
gaactttatgtgcaaacagc

SEQ ID NO: 500842 - DNA, 20 bp, Artificial
  CRISPR gRNA sequence
tatgtgcaaacagctccaag

SEQ ID NO: 500843 - DNA, 20 bp, Artificial
  CRISPR gRNA sequence
atgtgcaaacagctccaagg

SEQ ID NO: 500844 - DNA, 20 bp, Artificial
  CRISPR gRNA sequence
tgtgcaaacagctccaagga

SEQ ID NO: 500845 - DNA, 20 bp, Artificial
  CRISPR gRNA sequence
caaggagacacggtccaagg

SEQ ID NO: 500846 - DNA, 20 bp, Artificial
  CRISPR gRNA sequence
atggtcaactgctatattaa

SEQ ID NO: 500847 - DNA, 20 bp, Artificial
  CRISPR gRNA sequence
ctatattaatgaacatggtg

SEQ ID NO: 500848 - DNA, 20 bp, Artificial
  CRISPR gRNA sequence
tattaatgaacatggtgggg

SEQ ID NO: 500849 - DNA, 20 bp, Artificial
  CRISPR gRNA sequence
atgaacatggtggggttgac

SEQ ID NO: 500850 - DNA, 20 bp, Artificial
  CRISPR gRNA sequence
actacggttgatagcaagag

SEQ ID NO: 500851 - DNA, 20 bp, Artificial
  CRISPR gRNA sequence
cggttgatagcaagagactc

SEQ ID NO: 500852 - DNA, 20 bp, Artificial
  CRISPR gRNA sequence
atagcaagagactctaggtg

SEQ ID NO: 500853 - DNA, 20 bp, Artificial
  CRISPR gRNA sequence
taggtggtgaaggcacctcc

SEQ ID NO: 500854 - DNA, 20 bp, Artificial
  CRISPR gRNA sequence
ggtggtgaaggcacctccaa

SEQ ID NO: 500855 - DNA, 20 bp, Artificial
  CRISPR gRNA sequence
caaagcaccaggtatataca

SEQ ID NO: 500856 - DNA, 20 bp, Artificial
  CRISPR gRNA sequence
taacacttttatttaatgaa

SEQ ID NO: 500857 - DNA, 20 bp, Artificial
  CRISPR gRNA sequence
aacacttttatttaatgaat

SEQ ID NO: 500858 - DNA, 20 bp, Artificial
  CRISPR gRNA sequence
acacttttatttaatgaatt

SEQ ID NO: 500859 - DNA, 20 bp, Artificial
  CRISPR gRNA sequence
ttatttaatgaatttacttt

SEQ ID NO: 500860 - DNA, 20 bp, Artificial
  CRISPR gRNA sequence
tatttaatgaatttactttt

SEQ ID NO: 500861 - DNA, 20 bp, Artificial
  CRISPR gRNA sequence
atttaatgaatttacttttg

SEQ ID NO: 500862 - DNA, 20 bp, Artificial
  CRISPR gRNA sequence
tttaatgaatttacttttgg

SEQ ID NO: 500863 - DNA, 20 bp, Artificial
  CRISPR gRNA sequence
aatgaatttacttttggctt

SEQ ID NO: 500864 - DNA, 20 bp, Artificial
  CRISPR gRNA sequence
atgaatttacttttggcttt

SEQ ID NO: 500865 - DNA, 20 bp, Artificial
  CRISPR gRNA sequence
acttttggctttgctaattt

SEQ ID NO: 500866 - DNA, 20 bp, Artificial
  CRISPR gRNA sequence
cttttggctttgctaatttt

SEQ ID NO: 500867 - DNA, 20 bp, Artificial
  CRISPR gRNA sequence
ttggctttgctaattttctc

SEQ ID NO: 500868 - DNA, 20 bp, Artificial
  CRISPR gRNA sequence
tggctttgctaattttctct

SEQ ID NO: 500869 - DNA, 20 bp, Artificial
  CRISPR gRNA sequence
ggctttgctaattttctcta

SEQ ID NO: 500870 - DNA, 20 bp, Artificial
  CRISPR gRNA sequence
gctttgctaattttctctat

SEQ ID NO: 500871 - DNA, 20 bp, Artificial
  CRISPR gRNA sequence
tgctaattttctctattgtg

SEQ ID NO: 500872 - DNA, 20 bp, Artificial
  CRISPR gRNA sequence
gctaattttctctattgtgt

SEQ ID NO: 500873 - DNA, 20 bp, Artificial
  CRISPR gRNA sequence
ctaattttctctattgtgta

SEQ ID NO: 500874 - DNA, 20 bp, Artificial
  CRISPR gRNA sequence
attttctctattgtgtattt

SEQ ID NO: 500875 - DNA, 20 bp, Artificial
  CRISPR gRNA sequence
tctctattgtgtatttgctt

SEQ ID NO: 500876 - DNA, 20 bp, Artificial
  CRISPR gRNA sequence
ctctattgtgtatttgcttt

SEQ ID NO: 500877 - DNA, 20 bp, Artificial
  CRISPR gRNA sequence
tctattgtgtatttgctttt

SEQ ID NO: 500878 - DNA, 20 bp, Artificial
  CRISPR gRNA sequence
tattgtgtatttgcttttta

SEQ ID NO: 500879 - DNA, 20 bp, Artificial
  CRISPR gRNA sequence
ttgtgtatttgctttttatt

SEQ ID NO: 500880 - DNA, 20 bp, Artificial
  CRISPR gRNA sequence
tgtatttgctttttatttta

SEQ ID NO: 500881 - DNA, 20 bp, Artificial
  CRISPR gRNA sequence
gctttttattttattgaagt

SEQ ID NO: 500882 - DNA, 20 bp, Artificial
  CRISPR gRNA sequence
ctttttattttattgaagtt

SEQ ID NO: 500883 - DNA, 20 bp, Artificial
  CRISPR gRNA sequence
tttattttattgaagttagc

SEQ ID NO: 500884 - DNA, 20 bp, Artificial
  CRISPR gRNA sequence
ttattttattgaagttagct

SEQ ID NO: 500885 - DNA, 20 bp, Artificial
  CRISPR gRNA sequence
tattttattgaagttagctc

SEQ ID NO: 500886 - DNA, 20 bp, Artificial
  CRISPR gRNA sequence
attttattgaagttagctct

SEQ ID NO: 500887 - DNA, 20 bp, Artificial
  CRISPR gRNA sequence
ttttattgaagttagctctt

SEQ ID NO: 500888 - DNA, 20 bp, Artificial
  CRISPR gRNA sequence
tattgaagttagctcttaca

SEQ ID NO: 500889 - DNA, 20 bp, Artificial
  CRISPR gRNA sequence
attgaagttagctcttacat

SEQ ID NO: 500890 - DNA, 20 bp, Artificial
  CRISPR gRNA sequence
ttgaagttagctcttacatt

SEQ ID NO: 500891 - DNA, 20 bp, Artificial
  CRISPR gRNA sequence
aagttagctcttacatttac

SEQ ID NO: 500892 - DNA, 20 bp, Artificial
  CRISPR gRNA sequence
gctcttacatttactttctc

SEQ ID NO: 500893 - DNA, 20 bp, Artificial
  CRISPR gRNA sequence
ttacatttactttctccttt

SEQ ID NO: 500894 - DNA, 20 bp, Artificial
  CRISPR gRNA sequence
acatttactttctcctttct

SEQ ID NO: 500895 - DNA, 20 bp, Artificial
  CRISPR gRNA sequence
catttactttctcctttctc

SEQ ID NO: 500896 - DNA, 20 bp, Artificial
  CRISPR gRNA sequence
actttctcctttctcctttc

SEQ ID NO: 500897 - DNA, 20 bp, Artificial
  CRISPR gRNA sequence
ctttctcctttctcctttct

SEQ ID NO: 500898 - DNA, 20 bp, Artificial
  CRISPR gRNA sequence
tctcctttctcctttctctg

SEQ ID NO: 500899 - DNA, 20 bp, Artificial
  CRISPR gRNA sequence
ctcctttctcctttctctgg

SEQ ID NO: 500900 - DNA, 20 bp, Artificial
  CRISPR gRNA sequence
tcctttctcctttctctgga

SEQ ID NO: 500901 - DNA, 20 bp, Artificial
  CRISPR gRNA sequence
ctttctcctttctctggatt

SEQ ID NO: 500902 - DNA, 20 bp, Artificial
  CRISPR gRNA sequence
tctcctttctctggattatc

SEQ ID NO: 500903 - DNA, 20 bp, Artificial
  CRISPR gRNA sequence
ctcctttctctggattatca

SEQ ID NO: 500904 - DNA, 20 bp, Artificial
  CRISPR gRNA sequence
tcctttctctggattatcat

SEQ ID NO: 500905 - DNA, 20 bp, Artificial
  CRISPR gRNA sequence
ctttctctggattatcatca

SEQ ID NO: 500906 - DNA, 20 bp, Artificial
  CRISPR gRNA sequence
tctctggattatcatcatca

SEQ ID NO: 500907 - DNA, 20 bp, Artificial
  CRISPR gRNA sequence
ctctggattatcatcatcat

SEQ ID NO: 500908 - DNA, 20 bp, Artificial
  CRISPR gRNA sequence
tctggattatcatcatcatc

SEQ ID NO: 500909 - DNA, 20 bp, Artificial
  CRISPR gRNA sequence
tggattatcatcatcatcat

SEQ ID NO: 500910 - DNA, 20 bp, Artificial
  CRISPR gRNA sequence
gattatcatcatcatcatca

SEQ ID NO: 500911 - DNA, 20 bp, Artificial
  CRISPR gRNA sequence
tcatcatcatcatcattatt

SEQ ID NO: 500912 - DNA, 20 bp, Artificial
  CRISPR gRNA sequence
tttgaattactatttctttt

SEQ ID NO: 500913 - DNA, 20 bp, Artificial
  CRISPR gRNA sequence
gaattactatttctttttct

SEQ ID NO: 500914 - DNA, 20 bp, Artificial
  CRISPR gRNA sequence
aattactatttctttttctt

SEQ ID NO: 500915 - DNA, 20 bp, Artificial
  CRISPR gRNA sequence
ctatttctttttctttggtt

SEQ ID NO: 500916 - DNA, 20 bp, Artificial
  CRISPR gRNA sequence
tttctttttctttggtttct

SEQ ID NO: 500917 - DNA, 20 bp, Artificial
  CRISPR gRNA sequence
ctttttctttggtttcttga

SEQ ID NO: 500918 - DNA, 20 bp, Artificial
  CRISPR gRNA sequence
tttttctttggtttcttgag

SEQ ID NO: 500919 - DNA, 20 bp, Artificial
  CRISPR gRNA sequence
tttctttggtttcttgagat

SEQ ID NO: 500920 - DNA, 20 bp, Artificial
  CRISPR gRNA sequence
ttctttggtttcttgagatt

SEQ ID NO: 500921 - DNA, 20 bp, Artificial
  CRISPR gRNA sequence
tctttggtttcttgagattg

SEQ ID NO: 500922 - DNA, 20 bp, Artificial
  CRISPR gRNA sequence
ctttggtttcttgagattga

SEQ ID NO: 500923 - DNA, 20 bp, Artificial
  CRISPR gRNA sequence
tttggtttcttgagattgaa

SEQ ID NO: 500924 - DNA, 20 bp, Artificial
  CRISPR gRNA sequence
tggtttcttgagattgaatc

SEQ ID NO: 500925 - DNA, 20 bp, Artificial
  CRISPR gRNA sequence
ggtttcttgagattgaatct

SEQ ID NO: 500926 - DNA, 20 bp, Artificial
  CRISPR gRNA sequence
gtttcttgagattgaatctt

SEQ ID NO: 500927 - DNA, 20 bp, Artificial
  CRISPR gRNA sequence
cttgagattgaatcttgcat

SEQ ID NO: 500928 - DNA, 20 bp, Artificial
  CRISPR gRNA sequence
ttgagattgaatcttgcatt

SEQ ID NO: 500929 - DNA, 20 bp, Artificial
  CRISPR gRNA sequence
gagattgaatcttgcattat

SEQ ID NO: 500930 - DNA, 20 bp, Artificial
  CRISPR gRNA sequence
agattgaatcttgcattatt

SEQ ID NO: 500931 - DNA, 20 bp, Artificial
  CRISPR gRNA sequence
aatcttgcattattgacttg

SEQ ID NO: 500932 - DNA, 20 bp, Artificial
  CRISPR gRNA sequence
gcattattgacttgcaaact

SEQ ID NO: 500933 - DNA, 20 bp, Artificial
  CRISPR gRNA sequence
cattattgacttgcaaactt

SEQ ID NO: 500934 - DNA, 20 bp, Artificial
  CRISPR gRNA sequence
ttgacttgcaaactttcttt

SEQ ID NO: 500935 - DNA, 20 bp, Artificial
  CRISPR gRNA sequence
acttgcaaactttctttctt

SEQ ID NO: 500936 - DNA, 20 bp, Artificial
  CRISPR gRNA sequence
gcaaactttctttcttttcc

SEQ ID NO: 500937 - DNA, 20 bp, Artificial
  CRISPR gRNA sequence
caaactttctttcttttcca

SEQ ID NO: 500938 - DNA, 20 bp, Artificial
  CRISPR gRNA sequence
tctttcttttccaatataca

SEQ ID NO: 500939 - DNA, 20 bp, Artificial
  CRISPR gRNA sequence
ctttcttttccaatatacaa

SEQ ID NO: 500940 - DNA, 20 bp, Artificial
  CRISPR gRNA sequence
tttcttttccaatatacaaa

SEQ ID NO: 500941 - DNA, 20 bp, Artificial
  CRISPR gRNA sequence
tcttttccaatatacaaatt

SEQ ID NO: 500942 - DNA, 20 bp, Artificial
  CRISPR gRNA sequence
cttttccaatatacaaattt

SEQ ID NO: 500943 - DNA, 20 bp, Artificial
  CRISPR gRNA sequence
ttttccaatatacaaattta

SEQ ID NO: 500944 - DNA, 20 bp, Artificial
  CRISPR gRNA sequence
ttccaatatacaaatttaaa

SEQ ID NO: 500945 - DNA, 20 bp, Artificial
  CRISPR gRNA sequence
tccaatatacaaatttaaag

SEQ ID NO: 500946 - DNA, 20 bp, Artificial
  CRISPR gRNA sequence
ccaatatacaaatttaaagc

SEQ ID NO: 500947 - DNA, 20 bp, Artificial
  CRISPR gRNA sequence
caatatacaaatttaaagct

SEQ ID NO: 500948 - DNA, 20 bp, Artificial
  CRISPR gRNA sequence
aaagctataaatttccctct

SEQ ID NO: 500949 - DNA, 20 bp, Artificial
  CRISPR gRNA sequence
aagctataaatttccctcta

SEQ ID NO: 500950 - DNA, 20 bp, Artificial
  CRISPR gRNA sequence
taaatttccctctaaacact

SEQ ID NO: 500951 - DNA, 20 bp, Artificial
  CRISPR gRNA sequence
ccctctaaacactgccttag

SEQ ID NO: 500952 - DNA, 20 bp, Artificial
  CRISPR gRNA sequence
cctctaaacactgccttagc

SEQ ID NO: 500953 - DNA, 20 bp, Artificial
  CRISPR gRNA sequence
taaacactgccttagctata

SEQ ID NO: 500954 - DNA, 20 bp, Artificial
  CRISPR gRNA sequence
aacactgccttagctatatt

SEQ ID NO: 500955 - DNA, 20 bp, Artificial
  CRISPR gRNA sequence
ccttagctatattgcacatt

SEQ ID NO: 500956 - DNA, 20 bp, Artificial
  CRISPR gRNA sequence
agctatattgcacatttgat

SEQ ID NO: 500957 - DNA, 20 bp, Artificial
  CRISPR gRNA sequence
gctatattgcacatttgata

SEQ ID NO: 500958 - DNA, 20 bp, Artificial
  CRISPR gRNA sequence
tattgcacatttgatactca

SEQ ID NO: 500959 - DNA, 20 bp, Artificial
  CRISPR gRNA sequence
cacatttgatactcattatc

SEQ ID NO: 500960 - DNA, 20 bp, Artificial
  CRISPR gRNA sequence
gatactcattatcactttgc

SEQ ID NO: 500961 - DNA, 20 bp, Artificial
  CRISPR gRNA sequence
atactcattatcactttgct

SEQ ID NO: 500962 - DNA, 20 bp, Artificial
  CRISPR gRNA sequence
attatcactttgctctaaat

SEQ ID NO: 500963 - DNA, 20 bp, Artificial
  CRISPR gRNA sequence
tcactttgctctaaatattt

SEQ ID NO: 500964 - DNA, 20 bp, Artificial
  CRISPR gRNA sequence
tgctctaaatatttcccaaa

SEQ ID NO: 500965 - DNA, 20 bp, Artificial
  CRISPR gRNA sequence
gctctaaatatttcccaaat

SEQ ID NO: 500966 - DNA, 20 bp, Artificial
  CRISPR gRNA sequence
ctctaaatatttcccaaatt

SEQ ID NO: 500967 - DNA, 20 bp, Artificial
  CRISPR gRNA sequence
taaatatttcccaaatttca

SEQ ID NO: 500968 - DNA, 20 bp, Artificial
  CRISPR gRNA sequence
aatatttcccaaatttcatt

SEQ ID NO: 500969 - DNA, 20 bp, Artificial
  CRISPR gRNA sequence
cccaaatttcatttgattta

SEQ ID NO: 500970 - DNA, 20 bp, Artificial
  CRISPR gRNA sequence
ccaaatttcatttgatttat

SEQ ID NO: 500971 - DNA, 20 bp, Artificial
  CRISPR gRNA sequence
catttgatttattctttgac

SEQ ID NO: 500972 - DNA, 20 bp, Artificial
  CRISPR gRNA sequence
atttgatttattctttgact

SEQ ID NO: 500973 - DNA, 20 bp, Artificial
  CRISPR gRNA sequence
gatttattctttgactcatg

SEQ ID NO: 500974 - DNA, 20 bp, Artificial
  CRISPR gRNA sequence
atttattctttgactcatgg

SEQ ID NO: 500975 - DNA, 20 bp, Artificial
  CRISPR gRNA sequence
attctttgactcatgggttt

SEQ ID NO: 500976 - DNA, 20 bp, Artificial
  CRISPR gRNA sequence
ttctttgactcatgggtttt

SEQ ID NO: 500977 - DNA, 20 bp, Artificial
  CRISPR gRNA sequence
tttgactcatgggtttttag

SEQ ID NO: 500978 - DNA, 20 bp, Artificial
  CRISPR gRNA sequence
tgactcatgggtttttagaa

SEQ ID NO: 500979 - DNA, 20 bp, Artificial
  CRISPR gRNA sequence
gactcatgggtttttagaaa

SEQ ID NO: 500980 - DNA, 20 bp, Artificial
  CRISPR gRNA sequence
actcatgggtttttagaaat

SEQ ID NO: 500981 - DNA, 20 bp, Artificial
  CRISPR gRNA sequence
atgggtttttagaaatatgt

SEQ ID NO: 500982 - DNA, 20 bp, Artificial
  CRISPR gRNA sequence
ttagaaatatgtttcttatg

SEQ ID NO: 500983 - DNA, 20 bp, Artificial
  CRISPR gRNA sequence
tagaaatatgtttcttatgt

SEQ ID NO: 500984 - DNA, 20 bp, Artificial
  CRISPR gRNA sequence
agaaatatgtttcttatgtt

SEQ ID NO: 500985 - DNA, 20 bp, Artificial
  CRISPR gRNA sequence
gaaatatgtttcttatgttt

SEQ ID NO: 500986 - DNA, 20 bp, Artificial
  CRISPR gRNA sequence
cttatgttttaaacattcag

SEQ ID NO: 500987 - DNA, 20 bp, Artificial
  CRISPR gRNA sequence
ttatgttttaaacattcaga

SEQ ID NO: 500988 - DNA, 20 bp, Artificial
  CRISPR gRNA sequence
atgttttaaacattcagaga

SEQ ID NO: 500989 - DNA, 20 bp, Artificial
  CRISPR gRNA sequence
tgttttaaacattcagagat

SEQ ID NO: 500990 - DNA, 20 bp, Artificial
  CRISPR gRNA sequence
taaacattcagagattttct

SEQ ID NO: 500991 - DNA, 20 bp, Artificial
  CRISPR gRNA sequence
aaacattcagagattttctg

SEQ ID NO: 500992 - DNA, 20 bp, Artificial
  CRISPR gRNA sequence
aacattcagagattttctgg

SEQ ID NO: 500993 - DNA, 20 bp, Artificial
  CRISPR gRNA sequence
agagattttctggttatttt

SEQ ID NO: 500994 - DNA, 20 bp, Artificial
  CRISPR gRNA sequence
tctggttatttttctgttat

SEQ ID NO: 500995 - DNA, 20 bp, Artificial
  CRISPR gRNA sequence
ctggttatttttctgttatt

SEQ ID NO: 500996 - DNA, 20 bp, Artificial
  CRISPR gRNA sequence
tggttatttttctgttattg

SEQ ID NO: 500997 - DNA, 20 bp, Artificial
  CRISPR gRNA sequence
gttatttttctgttattgat

SEQ ID NO: 500998 - DNA, 20 bp, Artificial
  CRISPR gRNA sequence
tttttctgttattgattttt

SEQ ID NO: 500999 - DNA, 20 bp, Artificial
  CRISPR gRNA sequence
ttctgttattgattttttgt

SEQ ID NO: 501000 - DNA, 20 bp, Artificial
  CRISPR gRNA sequence
tctgttattgattttttgtt

SEQ ID NO: 501001 - DNA, 20 bp, Artificial
  CRISPR gRNA sequence
ctgttattgattttttgttt

SEQ ID NO: 501002 - DNA, 20 bp, Artificial
  CRISPR gRNA sequence
tgttattgattttttgttta

SEQ ID NO: 501003 - DNA, 20 bp, Artificial
  CRISPR gRNA sequence
ttattgattttttgtttaat

SEQ ID NO: 501004 - DNA, 20 bp, Artificial
  CRISPR gRNA sequence
ttgattttttgtttaattct

SEQ ID NO: 501005 - DNA, 20 bp, Artificial
  CRISPR gRNA sequence
attttttgtttaattctact

SEQ ID NO: 501006 - DNA, 20 bp, Artificial
  CRISPR gRNA sequence
tttgtttaattctactgtgc

SEQ ID NO: 501007 - DNA, 20 bp, Artificial
  CRISPR gRNA sequence
ttgtttaattctactgtgct

SEQ ID NO: 501008 - DNA, 20 bp, Artificial
  CRISPR gRNA sequence
tgtttaattctactgtgctt

SEQ ID NO: 501009 - DNA, 20 bp, Artificial
  CRISPR gRNA sequence
gtttaattctactgtgctta

SEQ ID NO: 501010 - DNA, 20 bp, Artificial
  CRISPR gRNA sequence
tttaattctactgtgcttag

SEQ ID NO: 501011 - DNA, 20 bp, Artificial
  CRISPR gRNA sequence
aattctactgtgcttagagg

SEQ ID NO: 501012 - DNA, 20 bp, Artificial
  CRISPR gRNA sequence
attctactgtgcttagaggg

SEQ ID NO: 501013 - DNA, 20 bp, Artificial
  CRISPR gRNA sequence
tactgtgcttagagggcata

SEQ ID NO: 501014 - DNA, 20 bp, Artificial
  CRISPR gRNA sequence
ctgtgcttagagggcataat

SEQ ID NO: 501015 - DNA, 20 bp, Artificial
  CRISPR gRNA sequence
tgcttagagggcataattgg

SEQ ID NO: 501016 - DNA, 20 bp, Artificial
  CRISPR gRNA sequence
agagggcataattggtatga

SEQ ID NO: 501017 - DNA, 20 bp, Artificial
  CRISPR gRNA sequence
gagggcataattggtatgat

SEQ ID NO: 501018 - DNA, 20 bp, Artificial
  CRISPR gRNA sequence
gtatgatttcaatactttga

SEQ ID NO: 501019 - DNA, 20 bp, Artificial
  CRISPR gRNA sequence
caatactttgaactttgttg

SEQ ID NO: 501020 - DNA, 20 bp, Artificial
  CRISPR gRNA sequence
aatactttgaactttgttga

SEQ ID NO: 501021 - DNA, 20 bp, Artificial
  CRISPR gRNA sequence
tgaactttgttgacacttgt

SEQ ID NO: 501022 - DNA, 20 bp, Artificial
  CRISPR gRNA sequence
gaactttgttgacacttgtt

SEQ ID NO: 501023 - DNA, 20 bp, Artificial
  CRISPR gRNA sequence
aactttgttgacacttgttt

SEQ ID NO: 501024 - DNA, 20 bp, Artificial
  CRISPR gRNA sequence
tgttgacacttgttttaatg

SEQ ID NO: 501025 - DNA, 20 bp, Artificial
  CRISPR gRNA sequence
gttgacacttgttttaatgc

SEQ ID NO: 501026 - DNA, 20 bp, Artificial
  CRISPR gRNA sequence
ttgacacttgttttaatgca

SEQ ID NO: 501027 - DNA, 20 bp, Artificial
  CRISPR gRNA sequence
acacttgttttaatgcacag

SEQ ID NO: 501028 - DNA, 20 bp, Artificial
  CRISPR gRNA sequence
gttttaatgcacagcatatg

SEQ ID NO: 501029 - DNA, 20 bp, Artificial
  CRISPR gRNA sequence
ttttaatgcacagcatatga

SEQ ID NO: 501030 - DNA, 20 bp, Artificial
  CRISPR gRNA sequence
taatgcacagcatatgataa

SEQ ID NO: 501031 - DNA, 20 bp, Artificial
  CRISPR gRNA sequence
aatgcacagcatatgataat

SEQ ID NO: 501032 - DNA, 20 bp, Artificial
  CRISPR gRNA sequence
atgcacagcatatgataata

SEQ ID NO: 501033 - DNA, 20 bp, Artificial
  CRISPR gRNA sequence
tggtaactattgcatgtgca

SEQ ID NO: 501034 - DNA, 20 bp, Artificial
  CRISPR gRNA sequence
ggtaactattgcatgtgcac

SEQ ID NO: 501035 - DNA, 20 bp, Artificial
  CRISPR gRNA sequence
gtaactattgcatgtgcact

SEQ ID NO: 501036 - DNA, 20 bp, Artificial
  CRISPR gRNA sequence
ttgcatgtgcacttgaaaag

SEQ ID NO: 501037 - DNA, 20 bp, Artificial
  CRISPR gRNA sequence
catgtgcacttgaaaagaat

SEQ ID NO: 501038 - DNA, 20 bp, Artificial
  CRISPR gRNA sequence
gaaaagaatatgtattctgc

SEQ ID NO: 501039 - DNA, 20 bp, Artificial
  CRISPR gRNA sequence
aaaagaatatgtattctgca

SEQ ID NO: 501040 - DNA, 20 bp, Artificial
  CRISPR gRNA sequence
tgcaattgttaggagaattg

SEQ ID NO: 501041 - DNA, 20 bp, Artificial
  CRISPR gRNA sequence
caattgttaggagaattgtt

SEQ ID NO: 501042 - DNA, 20 bp, Artificial
  CRISPR gRNA sequence
ttaggagaattgttttatat

SEQ ID NO: 501043 - DNA, 20 bp, Artificial
  CRISPR gRNA sequence
ggagaattgttttatatata

SEQ ID NO: 501044 - DNA, 20 bp, Artificial
  CRISPR gRNA sequence
ttttatatataatttatata

SEQ ID NO: 501045 - DNA, 20 bp, Artificial
  CRISPR gRNA sequence
tatatataatttatatatat

SEQ ID NO: 501046 - DNA, 20 bp, Artificial
  CRISPR gRNA sequence
atatataatttatatatata

SEQ ID NO: 501047 - DNA, 20 bp, Artificial
  CRISPR gRNA sequence
tatataatttatatatatat

SEQ ID NO: 501048 - DNA, 20 bp, Artificial
  CRISPR gRNA sequence
atatatatattggtttaatg

SEQ ID NO: 501049 - DNA, 20 bp, Artificial
  CRISPR gRNA sequence
tatatatattggtttaatga

SEQ ID NO: 501050 - DNA, 20 bp, Artificial
  CRISPR gRNA sequence
gtttaatgatcttcaaattc

SEQ ID NO: 501051 - DNA, 20 bp, Artificial
  CRISPR gRNA sequence
aatgatcttcaaattcttat

SEQ ID NO: 501052 - DNA, 20 bp, Artificial
  CRISPR gRNA sequence
atgatcttcaaattcttata

SEQ ID NO: 501053 - DNA, 20 bp, Artificial
  CRISPR gRNA sequence
caaattcttatagccttatt

SEQ ID NO: 501054 - DNA, 20 bp, Artificial
  CRISPR gRNA sequence
aaattcttatagccttattg

SEQ ID NO: 501055 - DNA, 20 bp, Artificial
  CRISPR gRNA sequence
ttatagccttattgattttt

SEQ ID NO: 501056 - DNA, 20 bp, Artificial
  CRISPR gRNA sequence
atagccttattgattttttt

SEQ ID NO: 501057 - DNA, 20 bp, Artificial
  CRISPR gRNA sequence
tagccttattgatttttttg

SEQ ID NO: 501058 - DNA, 20 bp, Artificial
  CRISPR gRNA sequence
attgatttttttgtgtgctt

SEQ ID NO: 501059 - DNA, 20 bp, Artificial
  CRISPR gRNA sequence
ttgatttttttgtgtgcttc

SEQ ID NO: 501060 - DNA, 20 bp, Artificial
  CRISPR gRNA sequence
atttttttgtgtgcttcttg

SEQ ID NO: 501061 - DNA, 20 bp, Artificial
  CRISPR gRNA sequence
ttttgtgtgcttcttgtagc

SEQ ID NO: 501062 - DNA, 20 bp, Artificial
  CRISPR gRNA sequence
tttgtgtgcttcttgtagca

SEQ ID NO: 501063 - DNA, 20 bp, Artificial
  CRISPR gRNA sequence
ttgtgtgcttcttgtagcag

SEQ ID NO: 501064 - DNA, 20 bp, Artificial
  CRISPR gRNA sequence
tgtgtgcttcttgtagcagc

SEQ ID NO: 501065 - DNA, 20 bp, Artificial
  CRISPR gRNA sequence
gtgtgcttcttgtagcagct

SEQ ID NO: 501066 - DNA, 20 bp, Artificial
  CRISPR gRNA sequence
tgtgcttcttgtagcagcta

SEQ ID NO: 501067 - DNA, 20 bp, Artificial
  CRISPR gRNA sequence
cttgtagcagctagagagac

SEQ ID NO: 501068 - DNA, 20 bp, Artificial
  CRISPR gRNA sequence
ttgtagcagctagagagaca

SEQ ID NO: 501069 - DNA, 20 bp, Artificial
  CRISPR gRNA sequence
gtagcagctagagagacaga

SEQ ID NO: 501070 - DNA, 20 bp, Artificial
  CRISPR gRNA sequence
tagcagctagagagacagat

SEQ ID NO: 501071 - DNA, 20 bp, Artificial
  CRISPR gRNA sequence
gagagacagatgtaataaaa

SEQ ID NO: 501072 - DNA, 20 bp, Artificial
  CRISPR gRNA sequence
tccaactatagttgtggatt

SEQ ID NO: 501073 - DNA, 20 bp, Artificial
  CRISPR gRNA sequence
caactatagttgtggattta

SEQ ID NO: 501074 - DNA, 20 bp, Artificial
  CRISPR gRNA sequence
tagttgtggatttacttctc

SEQ ID NO: 501075 - DNA, 20 bp, Artificial
  CRISPR gRNA sequence
tggatttacttctcctttta

SEQ ID NO: 501076 - DNA, 20 bp, Artificial
  CRISPR gRNA sequence
acttctccttttagttctat

SEQ ID NO: 501077 - DNA, 20 bp, Artificial
  CRISPR gRNA sequence
cttctccttttagttctatc

SEQ ID NO: 501078 - DNA, 20 bp, Artificial
  CRISPR gRNA sequence
ctccttttagttctatcaaa

SEQ ID NO: 501079 - DNA, 20 bp, Artificial
  CRISPR gRNA sequence
tccttttagttctatcaaat

SEQ ID NO: 501080 - DNA, 20 bp, Artificial
  CRISPR gRNA sequence
cttttagttctatcaaattt

SEQ ID NO: 501081 - DNA, 20 bp, Artificial
  CRISPR gRNA sequence
ttagttctatcaaattttat

SEQ ID NO: 501082 - DNA, 20 bp, Artificial
  CRISPR gRNA sequence
tagttctatcaaattttatt

SEQ ID NO: 501083 - DNA, 20 bp, Artificial
  CRISPR gRNA sequence
agttctatcaaattttattt

SEQ ID NO: 501084 - DNA, 20 bp, Artificial
  CRISPR gRNA sequence
gttctatcaaattttatttt

SEQ ID NO: 501085 - DNA, 20 bp, Artificial
  CRISPR gRNA sequence
tatcaaattttattttatat

SEQ ID NO: 501086 - DNA, 20 bp, Artificial
  CRISPR gRNA sequence
tcaaattttattttatatat

SEQ ID NO: 501087 - DNA, 20 bp, Artificial
  CRISPR gRNA sequence
tattttatatattttaaact

SEQ ID NO: 501088 - DNA, 20 bp, Artificial
  CRISPR gRNA sequence
attttatatattttaaactt

SEQ ID NO: 501089 - DNA, 20 bp, Artificial
  CRISPR gRNA sequence
ttttatatattttaaacttg

SEQ ID NO: 501090 - DNA, 20 bp, Artificial
  CRISPR gRNA sequence
tatatattttaaacttgtta

SEQ ID NO: 501091 - DNA, 20 bp, Artificial
  CRISPR gRNA sequence
atatattttaaacttgttat

SEQ ID NO: 501092 - DNA, 20 bp, Artificial
  CRISPR gRNA sequence
tatattttaaacttgttata

SEQ ID NO: 501093 - DNA, 20 bp, Artificial
  CRISPR gRNA sequence
taaacttgttatatgcatag

SEQ ID NO: 501094 - DNA, 20 bp, Artificial
  CRISPR gRNA sequence
aaacttgttatatgcataga

SEQ ID NO: 501095 - DNA, 20 bp, Artificial
  CRISPR gRNA sequence
aacttgttatatgcatagaa

SEQ ID NO: 501096 - DNA, 20 bp, Artificial
  CRISPR gRNA sequence
gttatatgcatagaaactga

SEQ ID NO: 501097 - DNA, 20 bp, Artificial
  CRISPR gRNA sequence
ttatatgcatagaaactgaa

SEQ ID NO: 501098 - DNA, 20 bp, Artificial
  CRISPR gRNA sequence
tatgcatagaaactgaagat

SEQ ID NO: 501099 - DNA, 20 bp, Artificial
  CRISPR gRNA sequence
aagatgattgtttattccta

SEQ ID NO: 501100 - DNA, 20 bp, Artificial
  CRISPR gRNA sequence
tttattcctacttaattggt

SEQ ID NO: 501101 - DNA, 20 bp, Artificial
  CRISPR gRNA sequence
attcctacttaattggttct

SEQ ID NO: 501102 - DNA, 20 bp, Artificial
  CRISPR gRNA sequence
ttcctacttaattggttctt

SEQ ID NO: 501103 - DNA, 20 bp, Artificial
  CRISPR gRNA sequence
ctacttaattggttctttta

SEQ ID NO: 501104 - DNA, 20 bp, Artificial
  CRISPR gRNA sequence
cttaattggttcttttataa

SEQ ID NO: 501105 - DNA, 20 bp, Artificial
  CRISPR gRNA sequence
aattggttcttttataatga

SEQ ID NO: 501106 - DNA, 20 bp, Artificial
  CRISPR gRNA sequence
attggttcttttataatgat

SEQ ID NO: 501107 - DNA, 20 bp, Artificial
  CRISPR gRNA sequence
gttcttttataatgatgaca

SEQ ID NO: 501108 - DNA, 20 bp, Artificial
  CRISPR gRNA sequence
ttttataatgatgacatttc

SEQ ID NO: 501109 - DNA, 20 bp, Artificial
  CRISPR gRNA sequence
ttataatgatgacatttcct

SEQ ID NO: 501110 - DNA, 20 bp, Artificial
  CRISPR gRNA sequence
tataatgatgacatttcctt

SEQ ID NO: 501111 - DNA, 20 bp, Artificial
  CRISPR gRNA sequence
ataatgatgacatttccttc

SEQ ID NO: 501112 - DNA, 20 bp, Artificial
  CRISPR gRNA sequence
taatgatgacatttccttct

SEQ ID NO: 501113 - DNA, 20 bp, Artificial
  CRISPR gRNA sequence
ccttctatttctgtatattt

SEQ ID NO: 501114 - DNA, 20 bp, Artificial
  CRISPR gRNA sequence
cttctatttctgtatatttt

SEQ ID NO: 501115 - DNA, 20 bp, Artificial
  CRISPR gRNA sequence
ctatttctgtatatttttta

SEQ ID NO: 501116 - DNA, 20 bp, Artificial
  CRISPR gRNA sequence
tatttctgtatattttttat

SEQ ID NO: 501117 - DNA, 20 bp, Artificial
  CRISPR gRNA sequence
tttctgtatattttttatac

SEQ ID NO: 501118 - DNA, 20 bp, Artificial
  CRISPR gRNA sequence
ctgtatattttttatacatc

SEQ ID NO: 501119 - DNA, 20 bp, Artificial
  CRISPR gRNA sequence
tgtatattttttatacatct

SEQ ID NO: 501120 - DNA, 20 bp, Artificial
  CRISPR gRNA sequence
tatattttttatacatctta

SEQ ID NO: 501121 - DNA, 20 bp, Artificial
  CRISPR gRNA sequence
tttatacatcttatgtcttt

SEQ ID NO: 501122 - DNA, 20 bp, Artificial
  CRISPR gRNA sequence
ttatacatcttatgtctttt

SEQ ID NO: 501123 - DNA, 20 bp, Artificial
  CRISPR gRNA sequence
tatacatcttatgtcttttt

SEQ ID NO: 501124 - DNA, 20 bp, Artificial
  CRISPR gRNA sequence
atacatcttatgtctttttt

SEQ ID NO: 501125 - DNA, 20 bp, Artificial
  CRISPR gRNA sequence
tacatcttatgtcttttttt

SEQ ID NO: 501126 - DNA, 20 bp, Artificial
  CRISPR gRNA sequence
atgtctttttttgttcattt

SEQ ID NO: 501127 - DNA, 20 bp, Artificial
  CRISPR gRNA sequence
tgtctttttttgttcatttt

SEQ ID NO: 501128 - DNA, 20 bp, Artificial
  CRISPR gRNA sequence
tttttgttcattttctccgt

SEQ ID NO: 501129 - DNA, 20 bp, Artificial
  CRISPR gRNA sequence
ttttgttcattttctccgtt

SEQ ID NO: 501130 - DNA, 20 bp, Artificial
  CRISPR gRNA sequence
tttgttcattttctccgtta

SEQ ID NO: 501131 - DNA, 20 bp, Artificial
  CRISPR gRNA sequence
ttgttcattttctccgttat

SEQ ID NO: 501132 - DNA, 20 bp, Artificial
  CRISPR gRNA sequence
tgttcattttctccgttatt

SEQ ID NO: 501133 - DNA, 20 bp, Artificial
  CRISPR gRNA sequence
gttcattttctccgttattg

SEQ ID NO: 501134 - DNA, 20 bp, Artificial
  CRISPR gRNA sequence
ttcattttctccgttattgc

SEQ ID NO: 501135 - DNA, 20 bp, Artificial
  CRISPR gRNA sequence
attttctccgttattgcctt

SEQ ID NO: 501136 - DNA, 20 bp, Artificial
  CRISPR gRNA sequence
tctccgttattgccttcttt

SEQ ID NO: 501137 - DNA, 20 bp, Artificial
  CRISPR gRNA sequence
ctccgttattgccttctttt

SEQ ID NO: 501138 - DNA, 20 bp, Artificial
  CRISPR gRNA sequence
tccgttattgccttcttttg

SEQ ID NO: 501139 - DNA, 20 bp, Artificial
  CRISPR gRNA sequence
cgttattgccttcttttgta

SEQ ID NO: 501140 - DNA, 20 bp, Artificial
  CRISPR gRNA sequence
ttgccttcttttgtatttaa

SEQ ID NO: 501141 - DNA, 20 bp, Artificial
  CRISPR gRNA sequence
ccttcttttgtatttaattg

SEQ ID NO: 501142 - DNA, 20 bp, Artificial
  CRISPR gRNA sequence
cttttgtatttaattgatat

SEQ ID NO: 501143 - DNA, 20 bp, Artificial
  CRISPR gRNA sequence
ttttgtatttaattgatatt

SEQ ID NO: 501144 - DNA, 20 bp, Artificial
  CRISPR gRNA sequence
ttgtatttaattgatatttt

SEQ ID NO: 501145 - DNA, 20 bp, Artificial
  CRISPR gRNA sequence
tgtatttaattgatattttt

SEQ ID NO: 501146 - DNA, 20 bp, Artificial
  CRISPR gRNA sequence
gtatttaattgatatttttg

SEQ ID NO: 501147 - DNA, 20 bp, Artificial
  CRISPR gRNA sequence
tatttaattgatatttttgt

SEQ ID NO: 501148 - DNA, 20 bp, Artificial
  CRISPR gRNA sequence
aattgatatttttgtgctgc

SEQ ID NO: 501149 - DNA, 20 bp, Artificial
  CRISPR gRNA sequence
attgatatttttgtgctgca

SEQ ID NO: 501150 - DNA, 20 bp, Artificial
  CRISPR gRNA sequence
atatttttgtgctgcatctt

SEQ ID NO: 501151 - DNA, 20 bp, Artificial
  CRISPR gRNA sequence
ttgtgctgcatctttttgat

SEQ ID NO: 501152 - DNA, 20 bp, Artificial
  CRISPR gRNA sequence
tgtgctgcatctttttgatt

SEQ ID NO: 501153 - DNA, 20 bp, Artificial
  CRISPR gRNA sequence
gtgctgcatctttttgattc

SEQ ID NO: 501154 - DNA, 20 bp, Artificial
  CRISPR gRNA sequence
tgctgcatctttttgattcc

SEQ ID NO: 501155 - DNA, 20 bp, Artificial
  CRISPR gRNA sequence
catctttttgattcccttct

SEQ ID NO: 501156 - DNA, 20 bp, Artificial
  CRISPR gRNA sequence
tttgattcccttctcatttc

SEQ ID NO: 501157 - DNA, 20 bp, Artificial
  CRISPR gRNA sequence
ttgattcccttctcatttct

SEQ ID NO: 501158 - DNA, 20 bp, Artificial
  CRISPR gRNA sequence
tgattcccttctcatttctt

SEQ ID NO: 501159 - DNA, 20 bp, Artificial
  CRISPR gRNA sequence
gattcccttctcatttcttt

SEQ ID NO: 501160 - DNA, 20 bp, Artificial
  CRISPR gRNA sequence
attcccttctcatttctttt

SEQ ID NO: 501161 - DNA, 20 bp, Artificial
  CRISPR gRNA sequence
ccttctcatttctttttctg

SEQ ID NO: 501162 - DNA, 20 bp, Artificial
  CRISPR gRNA sequence
ctcatttctttttctgtaca

SEQ ID NO: 501163 - DNA, 20 bp, Artificial
  CRISPR gRNA sequence
tcatttctttttctgtacat

SEQ ID NO: 501164 - DNA, 20 bp, Artificial
  CRISPR gRNA sequence
atttctttttctgtacattt

SEQ ID NO: 501165 - DNA, 20 bp, Artificial
  CRISPR gRNA sequence
ctttttctgtacattttgtt

SEQ ID NO: 501166 - DNA, 20 bp, Artificial
  CRISPR gRNA sequence
tttttctgtacattttgtta

SEQ ID NO: 501167 - DNA, 20 bp, Artificial
  CRISPR gRNA sequence
tttctgtacattttgttatt

SEQ ID NO: 501168 - DNA, 20 bp, Artificial
  CRISPR gRNA sequence
ttctgtacattttgttattt

SEQ ID NO: 501169 - DNA, 20 bp, Artificial
  CRISPR gRNA sequence
tctgtacattttgttatttt

SEQ ID NO: 501170 - DNA, 20 bp, Artificial
  CRISPR gRNA sequence
ctgtacattttgttattttc

SEQ ID NO: 501171 - DNA, 20 bp, Artificial
  CRISPR gRNA sequence
tgtacattttgttattttct

SEQ ID NO: 501172 - DNA, 20 bp, Artificial
  CRISPR gRNA sequence
tacattttgttattttctca

SEQ ID NO: 501173 - DNA, 20 bp, Artificial
  CRISPR gRNA sequence
tgttattttctcaatggtta

SEQ ID NO: 501174 - DNA, 20 bp, Artificial
  CRISPR gRNA sequence
gttattttctcaatggttac

SEQ ID NO: 501175 - DNA, 20 bp, Artificial
  CRISPR gRNA sequence
ttattttctcaatggttacc

SEQ ID NO: 501176 - DNA, 20 bp, Artificial
  CRISPR gRNA sequence
ttttctcaatggttaccaca

SEQ ID NO: 501177 - DNA, 20 bp, Artificial
  CRISPR gRNA sequence
tctcaatggttaccacaggt

SEQ ID NO: 501178 - DNA, 20 bp, Artificial
  CRISPR gRNA sequence
ctcaatggttaccacaggta

SEQ ID NO: 501179 - DNA, 20 bp, Artificial
  CRISPR gRNA sequence
tcaatggttaccacaggtat

SEQ ID NO: 501180 - DNA, 20 bp, Artificial
  CRISPR gRNA sequence
aatggttaccacaggtatta

SEQ ID NO: 501181 - DNA, 20 bp, Artificial
  CRISPR gRNA sequence
ccacaggtattacaatgaat

SEQ ID NO: 501182 - DNA, 20 bp, Artificial
  CRISPR gRNA sequence
caatgaatacctccaacaat

SEQ ID NO: 501183 - DNA, 20 bp, Artificial
  CRISPR gRNA sequence
caacaatatagtttgaattg

SEQ ID NO: 501184 - DNA, 20 bp, Artificial
  CRISPR gRNA sequence
gaattgatgccaattcagcc

SEQ ID NO: 501185 - DNA, 20 bp, Artificial
  CRISPR gRNA sequence
aattgatgccaattcagcct

SEQ ID NO: 501186 - DNA, 20 bp, Artificial
  CRISPR gRNA sequence
atgccaattcagcctcaata

SEQ ID NO: 501187 - DNA, 20 bp, Artificial
  CRISPR gRNA sequence
agcctcaatactatagaaaa

SEQ ID NO: 501188 - DNA, 20 bp, Artificial
  CRISPR gRNA sequence
aatactatagaaaactccta

SEQ ID NO: 501189 - DNA, 20 bp, Artificial
  CRISPR gRNA sequence
tagaaaactcctatacagct

SEQ ID NO: 501190 - DNA, 20 bp, Artificial
  CRISPR gRNA sequence
ctatacagctctatcccccc

SEQ ID NO: 501191 - DNA, 20 bp, Artificial
  CRISPR gRNA sequence
tacagctctatccccccact

SEQ ID NO: 501192 - DNA, 20 bp, Artificial
  CRISPR gRNA sequence
tatccccccacttttattgt

SEQ ID NO: 501193 - DNA, 20 bp, Artificial
  CRISPR gRNA sequence
tccccccacttttattgtca

SEQ ID NO: 501194 - DNA, 20 bp, Artificial
  CRISPR gRNA sequence
ttattgtcacaaattacatc

SEQ ID NO: 501195 - DNA, 20 bp, Artificial
  CRISPR gRNA sequence
tattgtcacaaattacatct

SEQ ID NO: 501196 - DNA, 20 bp, Artificial
  CRISPR gRNA sequence
attgtcacaaattacatctg

SEQ ID NO: 501197 - DNA, 20 bp, Artificial
  CRISPR gRNA sequence
ttgtcacaaattacatctgt

SEQ ID NO: 501198 - DNA, 20 bp, Artificial
  CRISPR gRNA sequence
tcacaaattacatctgtttc

SEQ ID NO: 501199 - DNA, 20 bp, Artificial
  CRISPR gRNA sequence
catctgtttctattgttttt

SEQ ID NO: 501200 - DNA, 20 bp, Artificial
  CRISPR gRNA sequence
tttctattgtttttcacttc

SEQ ID NO: 501201 - DNA, 20 bp, Artificial
  CRISPR gRNA sequence
ctattgtttttcacttcttg

SEQ ID NO: 501202 - DNA, 20 bp, Artificial
  CRISPR gRNA sequence
tattgtttttcacttcttgt

SEQ ID NO: 501203 - DNA, 20 bp, Artificial
  CRISPR gRNA sequence
ttgtttttcacttcttgtgc

SEQ ID NO: 501204 - DNA, 20 bp, Artificial
  CRISPR gRNA sequence
tttttcacttcttgtgcctg

SEQ ID NO: 501205 - DNA, 20 bp, Artificial
  CRISPR gRNA sequence
ttcacttcttgtgcctgagt

SEQ ID NO: 501206 - DNA, 20 bp, Artificial
  CRISPR gRNA sequence
tcacttcttgtgcctgagtt

SEQ ID NO: 501207 - DNA, 20 bp, Artificial
  CRISPR gRNA sequence
cacttcttgtgcctgagttt

SEQ ID NO: 501208 - DNA, 20 bp, Artificial
  CRISPR gRNA sequence
acttcttgtgcctgagtttc

SEQ ID NO: 501209 - DNA, 20 bp, Artificial
  CRISPR gRNA sequence
cttgtgcctgagtttccatt

SEQ ID NO: 501210 - DNA, 20 bp, Artificial
  CRISPR gRNA sequence
ttgtgcctgagtttccattt

SEQ ID NO: 501211 - DNA, 20 bp, Artificial
  CRISPR gRNA sequence
gtgcctgagtttccattttc

SEQ ID NO: 501212 - DNA, 20 bp, Artificial
  CRISPR gRNA sequence
tgcctgagtttccattttct

SEQ ID NO: 501213 - DNA, 20 bp, Artificial
  CRISPR gRNA sequence
agtttccattttctttatat

SEQ ID NO: 501214 - DNA, 20 bp, Artificial
  CRISPR gRNA sequence
ccattttctttatatctaaa

SEQ ID NO: 501215 - DNA, 20 bp, Artificial
  CRISPR gRNA sequence
cattttctttatatctaaag

SEQ ID NO: 501216 - DNA, 20 bp, Artificial
  CRISPR gRNA sequence
tctttatatctaaagaacat

SEQ ID NO: 501217 - DNA, 20 bp, Artificial
  CRISPR gRNA sequence
ctttatatctaaagaacatc

SEQ ID NO: 501218 - DNA, 20 bp, Artificial
  CRISPR gRNA sequence
tttatatctaaagaacatcc

SEQ ID NO: 501219 - DNA, 20 bp, Artificial
  CRISPR gRNA sequence
tatatctaaagaacatcctt

SEQ ID NO: 501220 - DNA, 20 bp, Artificial
  CRISPR gRNA sequence
atatctaaagaacatccttt

SEQ ID NO: 501221 - DNA, 20 bp, Artificial
  CRISPR gRNA sequence
tatctaaagaacatcctttg

SEQ ID NO: 501222 - DNA, 20 bp, Artificial
  CRISPR gRNA sequence
aagaacatcctttggtattt

SEQ ID NO: 501223 - DNA, 20 bp, Artificial
  CRISPR gRNA sequence
tggtatttcctttactgcag

SEQ ID NO: 501224 - DNA, 20 bp, Artificial
  CRISPR gRNA sequence
ggtatttcctttactgcagg

SEQ ID NO: 501225 - DNA, 20 bp, Artificial
  CRISPR gRNA sequence
gtatttcctttactgcaggc

SEQ ID NO: 501226 - DNA, 20 bp, Artificial
  CRISPR gRNA sequence
cctttactgcaggccttttt

SEQ ID NO: 501227 - DNA, 20 bp, Artificial
  CRISPR gRNA sequence
ctttactgcaggcctttttg

SEQ ID NO: 501228 - DNA, 20 bp, Artificial
  CRISPR gRNA sequence
tactgcaggcctttttgtga

SEQ ID NO: 501229 - DNA, 20 bp, Artificial
  CRISPR gRNA sequence
actgcaggcctttttgtgac

SEQ ID NO: 501230 - DNA, 20 bp, Artificial
  CRISPR gRNA sequence
ctgcaggcctttttgtgaca

SEQ ID NO: 501231 - DNA, 20 bp, Artificial
  CRISPR gRNA sequence
caggcctttttgtgacaaat

SEQ ID NO: 501232 - DNA, 20 bp, Artificial
  CRISPR gRNA sequence
tttgtgacaaattctttccg

SEQ ID NO: 501233 - DNA, 20 bp, Artificial
  CRISPR gRNA sequence
ttgtgacaaattctttccgt

SEQ ID NO: 501234 - DNA, 20 bp, Artificial
  CRISPR gRNA sequence
tgtgacaaattctttccgtt

SEQ ID NO: 501235 - DNA, 20 bp, Artificial
  CRISPR gRNA sequence
gtgacaaattctttccgttt

SEQ ID NO: 501236 - DNA, 20 bp, Artificial
  CRISPR gRNA sequence
tgacaaattctttccgtttt

SEQ ID NO: 501237 - DNA, 20 bp, Artificial
  CRISPR gRNA sequence
tttccgtttttaattttttc

SEQ ID NO: 501238 - DNA, 20 bp, Artificial
  CRISPR gRNA sequence
tccgtttttaattttttcta

SEQ ID NO: 501239 - DNA, 20 bp, Artificial
  CRISPR gRNA sequence
ccgtttttaattttttctaa

SEQ ID NO: 501240 - DNA, 20 bp, Artificial
  CRISPR gRNA sequence
cgtttttaattttttctaaa

SEQ ID NO: 501241 - DNA, 20 bp, Artificial
  CRISPR gRNA sequence
ttaattttttctaaaaatgt

SEQ ID NO: 501242 - DNA, 20 bp, Artificial
  CRISPR gRNA sequence
taattttttctaaaaatgtc

SEQ ID NO: 501243 - DNA, 20 bp, Artificial
  CRISPR gRNA sequence
aattttttctaaaaatgtct

SEQ ID NO: 501244 - DNA, 20 bp, Artificial
  CRISPR gRNA sequence
attttttctaaaaatgtctt

SEQ ID NO: 501245 - DNA, 20 bp, Artificial
  CRISPR gRNA sequence
tttctaaaaatgtctttatt

SEQ ID NO: 501246 - DNA, 20 bp, Artificial
  CRISPR gRNA sequence
ttctaaaaatgtctttattt

SEQ ID NO: 501247 - DNA, 20 bp, Artificial
  CRISPR gRNA sequence
tctaaaaatgtctttatttc

SEQ ID NO: 501248 - DNA, 20 bp, Artificial
  CRISPR gRNA sequence
ctaaaaatgtctttatttca

SEQ ID NO: 501249 - DNA, 20 bp, Artificial
  CRISPR gRNA sequence
taaaaatgtctttatttcag

SEQ ID NO: 501250 - DNA, 20 bp, Artificial
  CRISPR gRNA sequence
aaaatgtctttatttcagct

SEQ ID NO: 501251 - DNA, 20 bp, Artificial
  CRISPR gRNA sequence
tatttcagcttcatttaaaa

SEQ ID NO: 501252 - DNA, 20 bp, Artificial
  CRISPR gRNA sequence
atttcagcttcatttaaaaa

SEQ ID NO: 501253 - DNA, 20 bp, Artificial
  CRISPR gRNA sequence
tttcagcttcatttaaaaaa

SEQ ID NO: 501254 - DNA, 20 bp, Artificial
  CRISPR gRNA sequence
cagcttcatttaaaaaatta

SEQ ID NO: 501255 - DNA, 20 bp, Artificial
  CRISPR gRNA sequence
agcttcatttaaaaaattat

SEQ ID NO: 501256 - DNA, 20 bp, Artificial
  CRISPR gRNA sequence
catttaaaaaattattacta

SEQ ID NO: 501257 - DNA, 20 bp, Artificial
  CRISPR gRNA sequence
atttaaaaaattattactat

SEQ ID NO: 501258 - DNA, 20 bp, Artificial
  CRISPR gRNA sequence
aaaaaattattactattttt

SEQ ID NO: 501259 - DNA, 20 bp, Artificial
  CRISPR gRNA sequence
aaaaattattactatttttt

SEQ ID NO: 501260 - DNA, 20 bp, Artificial
  CRISPR gRNA sequence
ttactattttttgagacagt

SEQ ID NO: 501261 - DNA, 20 bp, Artificial
  CRISPR gRNA sequence
ctattttttgagacagtctc

SEQ ID NO: 501262 - DNA, 20 bp, Artificial
  CRISPR gRNA sequence
ttttttgagacagtctcact

SEQ ID NO: 501263 - DNA, 20 bp, Artificial
  CRISPR gRNA sequence
tttgagacagtctcactttg

SEQ ID NO: 501264 - DNA, 20 bp, Artificial
  CRISPR gRNA sequence
ttgagacagtctcactttgt

SEQ ID NO: 501265 - DNA, 20 bp, Artificial
  CRISPR gRNA sequence
tgagacagtctcactttgtc

SEQ ID NO: 501266 - DNA, 20 bp, Artificial
  CRISPR gRNA sequence
gagacagtctcactttgtca

SEQ ID NO: 501267 - DNA, 20 bp, Artificial
  CRISPR gRNA sequence
agacagtctcactttgtcac

SEQ ID NO: 501268 - DNA, 20 bp, Artificial
  CRISPR gRNA sequence
actttgtcacccaggcagga

SEQ ID NO: 501269 - DNA, 20 bp, Artificial
  CRISPR gRNA sequence
tgtcacccaggcaggagggg

SEQ ID NO: 501270 - DNA, 20 bp, Artificial
  CRISPR gRNA sequence
gtcacccaggcaggagggga

SEQ ID NO: 501271 - DNA, 20 bp, Artificial
  CRISPR gRNA sequence
tcacccaggcaggaggggag

SEQ ID NO: 501272 - DNA, 20 bp, Artificial
  CRISPR gRNA sequence
ggctcgctgcagccttgact

SEQ ID NO: 501273 - DNA, 20 bp, Artificial
  CRISPR gRNA sequence
gctcgctgcagccttgactt

SEQ ID NO: 501274 - DNA, 20 bp, Artificial
  CRISPR gRNA sequence
gctgcagccttgacttcctg

SEQ ID NO: 501275 - DNA, 20 bp, Artificial
  CRISPR gRNA sequence
cagccttgacttcctgggtt

SEQ ID NO: 501276 - DNA, 20 bp, Artificial
  CRISPR gRNA sequence
gacttcctgggttcaagtga

SEQ ID NO: 501277 - DNA, 20 bp, Artificial
  CRISPR gRNA sequence
acttcctgggttcaagtgat

SEQ ID NO: 501278 - DNA, 20 bp, Artificial
  CRISPR gRNA sequence
cctgggttcaagtgattctc

SEQ ID NO: 501279 - DNA, 20 bp, Artificial
  CRISPR gRNA sequence
ctgggttcaagtgattctcg

SEQ ID NO: 501280 - DNA, 20 bp, Artificial
  CRISPR gRNA sequence
ggttcaagtgattctcgtgc

SEQ ID NO: 501281 - DNA, 20 bp, Artificial
  CRISPR gRNA sequence
aagtgattctcgtgcctcag

SEQ ID NO: 501282 - DNA, 20 bp, Artificial
  CRISPR gRNA sequence
tcgtgcctcagcctcctgag

SEQ ID NO: 501283 - DNA, 20 bp, Artificial
  CRISPR gRNA sequence
gtgcctcagcctcctgagta

SEQ ID NO: 501284 - DNA, 20 bp, Artificial
  CRISPR gRNA sequence
agcctcctgagtagccggga

SEQ ID NO: 501285 - DNA, 20 bp, Artificial
  CRISPR gRNA sequence
ctgagtagccgggattatgg

SEQ ID NO: 501286 - DNA, 20 bp, Artificial
  CRISPR gRNA sequence
agtagccgggattatgggcg

SEQ ID NO: 501287 - DNA, 20 bp, Artificial
  CRISPR gRNA sequence
tgggcgcgtgccaccacgct

SEQ ID NO: 501288 - DNA, 20 bp, Artificial
  CRISPR gRNA sequence
agctaacttttgtattttta

SEQ ID NO: 501289 - DNA, 20 bp, Artificial
  CRISPR gRNA sequence
acttttgtatttttagtcga

SEQ ID NO: 501290 - DNA, 20 bp, Artificial
  CRISPR gRNA sequence
ttgtatttttagtcgagatg

SEQ ID NO: 501291 - DNA, 20 bp, Artificial
  CRISPR gRNA sequence
tgtatttttagtcgagatgg

SEQ ID NO: 501292 - DNA, 20 bp, Artificial
  CRISPR gRNA sequence
gtatttttagtcgagatggg

SEQ ID NO: 501293 - DNA, 20 bp, Artificial
  CRISPR gRNA sequence
tatttttagtcgagatgggg

SEQ ID NO: 501294 - DNA, 20 bp, Artificial
  CRISPR gRNA sequence
ttagtcgagatggggtttgc

SEQ ID NO: 501295 - DNA, 20 bp, Artificial
  CRISPR gRNA sequence
tagtcgagatggggtttgcc

SEQ ID NO: 501296 - DNA, 20 bp, Artificial
  CRISPR gRNA sequence
agtcgagatggggtttgcca

SEQ ID NO: 501297 - DNA, 20 bp, Artificial
  CRISPR gRNA sequence
gtcgagatggggtttgccat

SEQ ID NO: 501298 - DNA, 20 bp, Artificial
  CRISPR gRNA sequence
gccatgttggccagcctggt

SEQ ID NO: 501299 - DNA, 20 bp, Artificial
  CRISPR gRNA sequence
ccatgttggccagcctggtc

SEQ ID NO: 501300 - DNA, 20 bp, Artificial
  CRISPR gRNA sequence
gccagcctggtctccaactc

SEQ ID NO: 501301 - DNA, 20 bp, Artificial
  CRISPR gRNA sequence
gtctccaactcccgacctca

SEQ ID NO: 501302 - DNA, 20 bp, Artificial
  CRISPR gRNA sequence
caactcccgacctcaactga

SEQ ID NO: 501303 - DNA, 20 bp, Artificial
  CRISPR gRNA sequence
ccgacctcaactgattcacc

SEQ ID NO: 501304 - DNA, 20 bp, Artificial
  CRISPR gRNA sequence
aactgattcacctgcttcag

SEQ ID NO: 501305 - DNA, 20 bp, Artificial
  CRISPR gRNA sequence
attcacctgcttcagcctcc

SEQ ID NO: 501306 - DNA, 20 bp, Artificial
  CRISPR gRNA sequence
acctgcttcagcctcccaaa

SEQ ID NO: 501307 - DNA, 20 bp, Artificial
  CRISPR gRNA sequence
cttcagcctcccaaagtgcg

SEQ ID NO: 501308 - DNA, 20 bp, Artificial
  CRISPR gRNA sequence
cagcctcccaaagtgcgggg

SEQ ID NO: 501309 - DNA, 20 bp, Artificial
  CRISPR gRNA sequence
agcctcccaaagtgcgggga

SEQ ID NO: 501310 - DNA, 20 bp, Artificial
  CRISPR gRNA sequence
ccaaagtgcggggattacag

SEQ ID NO: 501311 - DNA, 20 bp, Artificial
  CRISPR gRNA sequence
caggcatgagccactgcatc

SEQ ID NO: 501312 - DNA, 20 bp, Artificial
  CRISPR gRNA sequence
catctgctttcatctttgaa

SEQ ID NO: 501313 - DNA, 20 bp, Artificial
  CRISPR gRNA sequence
ctttcatctttgaagtaccg

SEQ ID NO: 501314 - DNA, 20 bp, Artificial
  CRISPR gRNA sequence
tcatctttgaagtaccgaaa

SEQ ID NO: 501315 - DNA, 20 bp, Artificial
  CRISPR gRNA sequence
catctttgaagtaccgaaat

SEQ ID NO: 501316 - DNA, 20 bp, Artificial
  CRISPR gRNA sequence
atctttgaagtaccgaaatt

SEQ ID NO: 501317 - DNA, 20 bp, Artificial
  CRISPR gRNA sequence
tgaagtaccgaaattctaga

SEQ ID NO: 501318 - DNA, 20 bp, Artificial
  CRISPR gRNA sequence
gaagtaccgaaattctagat

SEQ ID NO: 501319 - DNA, 20 bp, Artificial
  CRISPR gRNA sequence
aagtaccgaaattctagata

SEQ ID NO: 501320 - DNA, 20 bp, Artificial
  CRISPR gRNA sequence
tagataggcagttattttct

SEQ ID NO: 501321 - DNA, 20 bp, Artificial
  CRISPR gRNA sequence
gataggcagttattttcttt

SEQ ID NO: 501322 - DNA, 20 bp, Artificial
  CRISPR gRNA sequence
ttttctttcagcactttaaa

SEQ ID NO: 501323 - DNA, 20 bp, Artificial
  CRISPR gRNA sequence
tctttcagcactttaaatat

SEQ ID NO: 501324 - DNA, 20 bp, Artificial
  CRISPR gRNA sequence
ctttcagcactttaaatata

SEQ ID NO: 501325 - DNA, 20 bp, Artificial
  CRISPR gRNA sequence
tttcagcactttaaatatat

SEQ ID NO: 501326 - DNA, 20 bp, Artificial
  CRISPR gRNA sequence
tcagcactttaaatatatca

SEQ ID NO: 501327 - DNA, 20 bp, Artificial
  CRISPR gRNA sequence
cagcactttaaatatatcat

SEQ ID NO: 501328 - DNA, 20 bp, Artificial
  CRISPR gRNA sequence
agcactttaaatatatcatt

SEQ ID NO: 501329 - DNA, 20 bp, Artificial
  CRISPR gRNA sequence
taaatatatcattccttgga

SEQ ID NO: 501330 - DNA, 20 bp, Artificial
  CRISPR gRNA sequence
aaatatatcattccttggaa

SEQ ID NO: 501331 - DNA, 20 bp, Artificial
  CRISPR gRNA sequence
aatatatcattccttggaaa

SEQ ID NO: 501332 - DNA, 20 bp, Artificial
  CRISPR gRNA sequence
cttggaaaaccaaacaacgt

SEQ ID NO: 501333 - DNA, 20 bp, Artificial
  CRISPR gRNA sequence
ggaaaaccaaacaacgtatg

SEQ ID NO: 501334 - DNA, 20 bp, Artificial
  CRISPR gRNA sequence
gaaaaccaaacaacgtatgt

SEQ ID NO: 501335 - DNA, 20 bp, Artificial
  CRISPR gRNA sequence
tcactgatacgtgggagtta

SEQ ID NO: 501336 - DNA, 20 bp, Artificial
  CRISPR gRNA sequence
actgatacgtgggagttaag

SEQ ID NO: 501337 - DNA, 20 bp, Artificial
  CRISPR gRNA sequence
atacgtgggagttaagctac

SEQ ID NO: 501338 - DNA, 20 bp, Artificial
  CRISPR gRNA sequence
agctacgaggatgcaaaggc

SEQ ID NO: 501339 - DNA, 20 bp, Artificial
  CRISPR gRNA sequence
cgaggatgcaaaggcataag

SEQ ID NO: 501340 - DNA, 20 bp, Artificial
  CRISPR gRNA sequence
tggtgacttgggaggaaaag

SEQ ID NO: 501341 - DNA, 20 bp, Artificial
  CRISPR gRNA sequence
ggtgacttgggaggaaaagt

SEQ ID NO: 501342 - DNA, 20 bp, Artificial
  CRISPR gRNA sequence
gtgacttgggaggaaaagtg

SEQ ID NO: 501343 - DNA, 20 bp, Artificial
  CRISPR gRNA sequence
gggaggaaaagtgggagggg

SEQ ID NO: 501344 - DNA, 20 bp, Artificial
  CRISPR gRNA sequence
ggaggaaaagtgggagggga

SEQ ID NO: 501345 - DNA, 20 bp, Artificial
  CRISPR gRNA sequence
taaatagagtgcagtgtata

SEQ ID NO: 501346 - DNA, 20 bp, Artificial
  CRISPR gRNA sequence
ctcgggtgatgggtgcaccg

SEQ ID NO: 501347 - DNA, 20 bp, Artificial
  CRISPR gRNA sequence
gggtgatgggtgcaccgact

SEQ ID NO: 501348 - DNA, 20 bp, Artificial
  CRISPR gRNA sequence
acaaatcacctctaatgaac

SEQ ID NO: 501349 - DNA, 20 bp, Artificial
  CRISPR gRNA sequence
taatgaactttctcttgtaa

SEQ ID NO: 501350 - DNA, 20 bp, Artificial
  CRISPR gRNA sequence
atgaactttctcttgtaacc

SEQ ID NO: 501351 - DNA, 20 bp, Artificial
  CRISPR gRNA sequence
tctcttgtaaccaaacacca

SEQ ID NO: 501352 - DNA, 20 bp, Artificial
  CRISPR gRNA sequence
ctcttgtaaccaaacaccac

SEQ ID NO: 501353 - DNA, 20 bp, Artificial
  CRISPR gRNA sequence
tcttgtaaccaaacaccacc

SEQ ID NO: 501354 - DNA, 20 bp, Artificial
  CRISPR gRNA sequence
ttgtaaccaaacaccacctg

SEQ ID NO: 501355 - DNA, 20 bp, Artificial
  CRISPR gRNA sequence
gtaaccaaacaccacctgta

SEQ ID NO: 501356 - DNA, 20 bp, Artificial
  CRISPR gRNA sequence
taaccaaacaccacctgtac

SEQ ID NO: 501357 - DNA, 20 bp, Artificial
  CRISPR gRNA sequence
taccccaataacctatggaa

SEQ ID NO: 501358 - DNA, 20 bp, Artificial
  CRISPR gRNA sequence
tggaaaaataaaaaaaaaag

SEQ ID NO: 501359 - DNA, 20 bp, Artificial
  CRISPR gRNA sequence
catcatctgctttttattat

SEQ ID NO: 501360 - DNA, 20 bp, Artificial
  CRISPR gRNA sequence
ctttttattatttttgctga

SEQ ID NO: 501361 - DNA, 20 bp, Artificial
  CRISPR gRNA sequence
tttattatttttgctgaaat

SEQ ID NO: 501362 - DNA, 20 bp, Artificial
  CRISPR gRNA sequence
ttattatttttgctgaaatg

SEQ ID NO: 501363 - DNA, 20 bp, Artificial
  CRISPR gRNA sequence
tattatttttgctgaaatgt

SEQ ID NO: 501364 - DNA, 20 bp, Artificial
  CRISPR gRNA sequence
attatttttgctgaaatgtc

SEQ ID NO: 501365 - DNA, 20 bp, Artificial
  CRISPR gRNA sequence
ttatttttgctgaaatgtca

SEQ ID NO: 501366 - DNA, 20 bp, Artificial
  CRISPR gRNA sequence
tttttgctgaaatgtcagct

SEQ ID NO: 501367 - DNA, 20 bp, Artificial
  CRISPR gRNA sequence
ttgctgaaatgtcagctaag

SEQ ID NO: 501368 - DNA, 20 bp, Artificial
  CRISPR gRNA sequence
tgctgaaatgtcagctaagt

SEQ ID NO: 501369 - DNA, 20 bp, Artificial
  CRISPR gRNA sequence
gctgaaatgtcagctaagtt

SEQ ID NO: 501370 - DNA, 20 bp, Artificial
  CRISPR gRNA sequence
ctgaaatgtcagctaagttg

SEQ ID NO: 501371 - DNA, 20 bp, Artificial
  CRISPR gRNA sequence
aaatgtcagctaagttgttt

SEQ ID NO: 501372 - DNA, 20 bp, Artificial
  CRISPR gRNA sequence
agttgtttgttttgtgaagg

SEQ ID NO: 501373 - DNA, 20 bp, Artificial
  CRISPR gRNA sequence
tttgttttgtgaagggaatt

SEQ ID NO: 501374 - DNA, 20 bp, Artificial
  CRISPR gRNA sequence
gttttgtgaagggaatttag

SEQ ID NO: 501375 - DNA, 20 bp, Artificial
  CRISPR gRNA sequence
ttttgtgaagggaatttagt

SEQ ID NO: 501376 - DNA, 20 bp, Artificial
  CRISPR gRNA sequence
tgtgaagggaatttagtttt

SEQ ID NO: 501377 - DNA, 20 bp, Artificial
  CRISPR gRNA sequence
gtgaagggaatttagttttc

SEQ ID NO: 501378 - DNA, 20 bp, Artificial
  CRISPR gRNA sequence
tgaagggaatttagttttcc

SEQ ID NO: 501379 - DNA, 20 bp, Artificial
  CRISPR gRNA sequence
agttttcccccactctggct

SEQ ID NO: 501380 - DNA, 20 bp, Artificial
  CRISPR gRNA sequence
gttttcccccactctggcta

SEQ ID NO: 501381 - DNA, 20 bp, Artificial
  CRISPR gRNA sequence
tcccccactctggctatttt

SEQ ID NO: 501382 - DNA, 20 bp, Artificial
  CRISPR gRNA sequence
cccccactctggctatttta

SEQ ID NO: 501383 - DNA, 20 bp, Artificial
  CRISPR gRNA sequence
ccccactctggctattttac

SEQ ID NO: 501384 - DNA, 20 bp, Artificial
  CRISPR gRNA sequence
tggctattttacgatttttc

SEQ ID NO: 501385 - DNA, 20 bp, Artificial
  CRISPR gRNA sequence
gctattttacgatttttcta

SEQ ID NO: 501386 - DNA, 20 bp, Artificial
  CRISPR gRNA sequence
ttttacgatttttctattta

SEQ ID NO: 501387 - DNA, 20 bp, Artificial
  CRISPR gRNA sequence
tacgatttttctatttatct

SEQ ID NO: 501388 - DNA, 20 bp, Artificial
  CRISPR gRNA sequence
acgatttttctatttatctt

SEQ ID NO: 501389 - DNA, 20 bp, Artificial
  CRISPR gRNA sequence
cgatttttctatttatcttt

SEQ ID NO: 501390 - DNA, 20 bp, Artificial
  CRISPR gRNA sequence
ttctatttatctttggtttc

SEQ ID NO: 501391 - DNA, 20 bp, Artificial
  CRISPR gRNA sequence
tctatttatctttggtttcc

SEQ ID NO: 501392 - DNA, 20 bp, Artificial
  CRISPR gRNA sequence
ctatttatctttggtttcca

SEQ ID NO: 501393 - DNA, 20 bp, Artificial
  CRISPR gRNA sequence
tatttatctttggtttccat

SEQ ID NO: 501394 - DNA, 20 bp, Artificial
  CRISPR gRNA sequence
tttatctttggtttccataa

SEQ ID NO: 501395 - DNA, 20 bp, Artificial
  CRISPR gRNA sequence
atctttggtttccataattt

SEQ ID NO: 501396 - DNA, 20 bp, Artificial
  CRISPR gRNA sequence
tctttggtttccataatttt

SEQ ID NO: 501397 - DNA, 20 bp, Artificial
  CRISPR gRNA sequence
tggtttccataatttttttg

SEQ ID NO: 501398 - DNA, 20 bp, Artificial
  CRISPR gRNA sequence
ggtttccataatttttttga

SEQ ID NO: 501399 - DNA, 20 bp, Artificial
  CRISPR gRNA sequence
gtttccataatttttttgat

SEQ ID NO: 501400 - DNA, 20 bp, Artificial
  CRISPR gRNA sequence
ccataatttttttgatgtat

SEQ ID NO: 501401 - DNA, 20 bp, Artificial
  CRISPR gRNA sequence
cataatttttttgatgtatt

SEQ ID NO: 501402 - DNA, 20 bp, Artificial
  CRISPR gRNA sequence
ttttgatgtattgagaggtt

SEQ ID NO: 501403 - DNA, 20 bp, Artificial
  CRISPR gRNA sequence
tttgatgtattgagaggttg

SEQ ID NO: 501404 - DNA, 20 bp, Artificial
  CRISPR gRNA sequence
ttgatgtattgagaggttgt

SEQ ID NO: 501405 - DNA, 20 bp, Artificial
  CRISPR gRNA sequence
tgatgtattgagaggttgtc

SEQ ID NO: 501406 - DNA, 20 bp, Artificial
  CRISPR gRNA sequence
gatgtattgagaggttgtct

SEQ ID NO: 501407 - DNA, 20 bp, Artificial
  CRISPR gRNA sequence
atgtattgagaggttgtctt

SEQ ID NO: 501408 - DNA, 20 bp, Artificial
  CRISPR gRNA sequence
agaggttgtcttttgttcat

SEQ ID NO: 501409 - DNA, 20 bp, Artificial
  CRISPR gRNA sequence
tcttttgttcattggtttgt

SEQ ID NO: 501410 - DNA, 20 bp, Artificial
  CRISPR gRNA sequence
ttgttcattggtttgttttt

SEQ ID NO: 501411 - DNA, 20 bp, Artificial
  CRISPR gRNA sequence
tgttcattggtttgtttttt

SEQ ID NO: 501412 - DNA, 20 bp, Artificial
  CRISPR gRNA sequence
gttcattggtttgttttttt

SEQ ID NO: 501413 - DNA, 20 bp, Artificial
  CRISPR gRNA sequence
ttcattggtttgtttttttt

SEQ ID NO: 501414 - DNA, 20 bp, Artificial
  CRISPR gRNA sequence
attggtttgttttttttctt

SEQ ID NO: 501415 - DNA, 20 bp, Artificial
  CRISPR gRNA sequence
gtttgttttttttctttttt

SEQ ID NO: 501416 - DNA, 20 bp, Artificial
  CRISPR gRNA sequence
gttttttttctttttttttt

SEQ ID NO: 501417 - DNA, 20 bp, Artificial
  CRISPR gRNA sequence
ttttttttcttttttttttt

SEQ ID NO: 501418 - DNA, 20 bp, Artificial
  CRISPR gRNA sequence
tttttctttttttttttttg

SEQ ID NO: 501419 - DNA, 20 bp, Artificial
  CRISPR gRNA sequence
ttttctttttttttttttga

SEQ ID NO: 501420 - DNA, 20 bp, Artificial
  CRISPR gRNA sequence
tttctttttttttttttgag

SEQ ID NO: 501421 - DNA, 20 bp, Artificial
  CRISPR gRNA sequence
ttctttttttttttttgaga

SEQ ID NO: 501422 - DNA, 20 bp, Artificial
  CRISPR gRNA sequence
tctttttttttttttgagac

SEQ ID NO: 501423 - DNA, 20 bp, Artificial
  CRISPR gRNA sequence
ctttttttttttttgagaca

SEQ ID NO: 501424 - DNA, 20 bp, Artificial
  CRISPR gRNA sequence
tttttttttttttgagacag

SEQ ID NO: 501425 - DNA, 20 bp, Artificial
  CRISPR gRNA sequence
tttttttttttgagacagag

SEQ ID NO: 501426 - DNA, 20 bp, Artificial
  CRISPR gRNA sequence
ttttttttttgagacagagt

SEQ ID NO: 501427 - DNA, 20 bp, Artificial
  CRISPR gRNA sequence
tttttttttgagacagagtt

SEQ ID NO: 501428 - DNA, 20 bp, Artificial
  CRISPR gRNA sequence
ttttttttgagacagagttt

SEQ ID NO: 501429 - DNA, 20 bp, Artificial
  CRISPR gRNA sequence
tttttttgagacagagtttc

SEQ ID NO: 501430 - DNA, 20 bp, Artificial
  CRISPR gRNA sequence
ttttttgagacagagtttca

SEQ ID NO: 501431 - DNA, 20 bp, Artificial
  CRISPR gRNA sequence
tttttgagacagagtttcac

SEQ ID NO: 501432 - DNA, 20 bp, Artificial
  CRISPR gRNA sequence
ttttgagacagagtttcact

SEQ ID NO: 501433 - DNA, 20 bp, Artificial
  CRISPR gRNA sequence
tttgagacagagtttcactc

SEQ ID NO: 501434 - DNA, 20 bp, Artificial
  CRISPR gRNA sequence
ttgagacagagtttcactct

SEQ ID NO: 501435 - DNA, 20 bp, Artificial
  CRISPR gRNA sequence
tgagacagagtttcactctt

SEQ ID NO: 501436 - DNA, 20 bp, Artificial
  CRISPR gRNA sequence
gagacagagtttcactcttg

SEQ ID NO: 501437 - DNA, 20 bp, Artificial
  CRISPR gRNA sequence
agacagagtttcactcttgt

SEQ ID NO: 501438 - DNA, 20 bp, Artificial
  CRISPR gRNA sequence
cactcttgttgcccaggttg

SEQ ID NO: 501439 - DNA, 20 bp, Artificial
  CRISPR gRNA sequence
actcttgttgcccaggttgg

SEQ ID NO: 501440 - DNA, 20 bp, Artificial
  CRISPR gRNA sequence
ttgttgcccaggttggagtg

SEQ ID NO: 501441 - DNA, 20 bp, Artificial
  CRISPR gRNA sequence
gttgcccaggttggagtgca

SEQ ID NO: 501442 - DNA, 20 bp, Artificial
  CRISPR gRNA sequence
ttgcccaggttggagtgcag

SEQ ID NO: 501443 - DNA, 20 bp, Artificial
  CRISPR gRNA sequence
cccaggttggagtgcagtgg

SEQ ID NO: 501444 - DNA, 20 bp, Artificial
  CRISPR gRNA sequence
gagtgcagtggcgtgatctc

SEQ ID NO: 501445 - DNA, 20 bp, Artificial
  CRISPR gRNA sequence
ggctcactgcaacctccacc

SEQ ID NO: 501446 - DNA, 20 bp, Artificial
  CRISPR gRNA sequence
actgcaacctccacctcctg

SEQ ID NO: 501447 - DNA, 20 bp, Artificial
  CRISPR gRNA sequence
caacctccacctcctggatt

SEQ ID NO: 501448 - DNA, 20 bp, Artificial
  CRISPR gRNA sequence
cacctcctggattcaagtga

SEQ ID NO: 501449 - DNA, 20 bp, Artificial
  CRISPR gRNA sequence
ctggattcaagtgattctcc

SEQ ID NO: 501450 - DNA, 20 bp, Artificial
  CRISPR gRNA sequence
gattcaagtgattctcctgc

SEQ ID NO: 501451 - DNA, 20 bp, Artificial
  CRISPR gRNA sequence
aagtgattctcctgcctcag

SEQ ID NO: 501452 - DNA, 20 bp, Artificial
  CRISPR gRNA sequence
tcctgcctcagcctcccaag

SEQ ID NO: 501453 - DNA, 20 bp, Artificial
  CRISPR gRNA sequence
ctgcctcagcctcccaagta

SEQ ID NO: 501454 - DNA, 20 bp, Artificial
  CRISPR gRNA sequence
cctcagcctcccaagtagct

SEQ ID NO: 501455 - DNA, 20 bp, Artificial
  CRISPR gRNA sequence
agcctcccaagtagctggga

SEQ ID NO: 501456 - DNA, 20 bp, Artificial
  CRISPR gRNA sequence
ccaagtagctgggattacag

SEQ ID NO: 501457 - DNA, 20 bp, Artificial
  CRISPR gRNA sequence
ggattacaggtgtgcaccac

SEQ ID NO: 501458 - DNA, 20 bp, Artificial
  CRISPR gRNA sequence
caggtgtgcaccaccatact

SEQ ID NO: 501459 - DNA, 20 bp, Artificial
  CRISPR gRNA sequence
ggctaatttttgcattttta

SEQ ID NO: 501460 - DNA, 20 bp, Artificial
  CRISPR gRNA sequence
gctaatttttgcatttttag

SEQ ID NO: 501461 - DNA, 20 bp, Artificial
  CRISPR gRNA sequence
atttttgcatttttagcaga

SEQ ID NO: 501462 - DNA, 20 bp, Artificial
  CRISPR gRNA sequence
ttgcatttttagcagagatg

SEQ ID NO: 501463 - DNA, 20 bp, Artificial
  CRISPR gRNA sequence
tgcatttttagcagagatgg

SEQ ID NO: 501464 - DNA, 20 bp, Artificial
  CRISPR gRNA sequence
gcatttttagcagagatggg

SEQ ID NO: 501465 - DNA, 20 bp, Artificial
  CRISPR gRNA sequence
catttttagcagagatggga

SEQ ID NO: 501466 - DNA, 20 bp, Artificial
  CRISPR gRNA sequence
ttagcagagatgggattttg

SEQ ID NO: 501467 - DNA, 20 bp, Artificial
  CRISPR gRNA sequence
tagcagagatgggattttgt

SEQ ID NO: 501468 - DNA, 20 bp, Artificial
  CRISPR gRNA sequence
agcagagatgggattttgtc

SEQ ID NO: 501469 - DNA, 20 bp, Artificial
  CRISPR gRNA sequence
gcagagatgggattttgtca

SEQ ID NO: 501470 - DNA, 20 bp, Artificial
  CRISPR gRNA sequence
tgtcatattggccaggctgg

SEQ ID NO: 501471 - DNA, 20 bp, Artificial
  CRISPR gRNA sequence
gtcatattggccaggctggt

SEQ ID NO: 501472 - DNA, 20 bp, Artificial
  CRISPR gRNA sequence
tcatattggccaggctggtc

SEQ ID NO: 501473 - DNA, 20 bp, Artificial
  CRISPR gRNA sequence
gccaggctggtctcaaactc

SEQ ID NO: 501474 - DNA, 20 bp, Artificial
  CRISPR gRNA sequence
gtctcaaactcctgacgtca

SEQ ID NO: 501475 - DNA, 20 bp, Artificial
  CRISPR gRNA sequence
aaactcctgacgtcaggtga

SEQ ID NO: 501476 - DNA, 20 bp, Artificial
  CRISPR gRNA sequence
ctgacgtcaggtgatccatc

SEQ ID NO: 501477 - DNA, 20 bp, Artificial
  CRISPR gRNA sequence
acgtcaggtgatccatccac

SEQ ID NO: 501478 - DNA, 20 bp, Artificial
  CRISPR gRNA sequence
ggcctcccaaagtgctggga

SEQ ID NO: 501479 - DNA, 20 bp, Artificial
  CRISPR gRNA sequence
ccaaagtgctgggattacag

SEQ ID NO: 501480 - DNA, 20 bp, Artificial
  CRISPR gRNA sequence
ggattacaggcgtgagccac

SEQ ID NO: 501481 - DNA, 20 bp, Artificial
  CRISPR gRNA sequence
caggcgtgagccaccgtgcc

SEQ ID NO: 501482 - DNA, 20 bp, Artificial
  CRISPR gRNA sequence
gtcggtttgttttgatcttg

SEQ ID NO: 501483 - DNA, 20 bp, Artificial
  CRISPR gRNA sequence
tcggtttgttttgatcttgc

SEQ ID NO: 501484 - DNA, 20 bp, Artificial
  CRISPR gRNA sequence
gttttgatcttgcttggggt

SEQ ID NO: 501485 - DNA, 20 bp, Artificial
  CRISPR gRNA sequence
ttttgatcttgcttggggtt

SEQ ID NO: 501486 - DNA, 20 bp, Artificial
  CRISPR gRNA sequence
tgatcttgcttggggtttgt

SEQ ID NO: 501487 - DNA, 20 bp, Artificial
  CRISPR gRNA sequence
gatcttgcttggggtttgta

SEQ ID NO: 501488 - DNA, 20 bp, Artificial
  CRISPR gRNA sequence
atcttgcttggggtttgtaa

SEQ ID NO: 501489 - DNA, 20 bp, Artificial
  CRISPR gRNA sequence
gcttggggtttgtaacacat

SEQ ID NO: 501490 - DNA, 20 bp, Artificial
  CRISPR gRNA sequence
cttggggtttgtaacacatt

SEQ ID NO: 501491 - DNA, 20 bp, Artificial
  CRISPR gRNA sequence
ggggtttgtaacacatttta

SEQ ID NO: 501492 - DNA, 20 bp, Artificial
  CRISPR gRNA sequence
gggtttgtaacacattttac

SEQ ID NO: 501493 - DNA, 20 bp, Artificial
  CRISPR gRNA sequence
gtaacacattttacaaatct

SEQ ID NO: 501494 - DNA, 20 bp, Artificial
  CRISPR gRNA sequence
taacacattttacaaatcta

SEQ ID NO: 501495 - DNA, 20 bp, Artificial
  CRISPR gRNA sequence
tacaaatctatcttgatggc

SEQ ID NO: 501496 - DNA, 20 bp, Artificial
  CRISPR gRNA sequence
acaaatctatcttgatggct

SEQ ID NO: 501497 - DNA, 20 bp, Artificial
  CRISPR gRNA sequence
caaatctatcttgatggctt

SEQ ID NO: 501498 - DNA, 20 bp, Artificial
  CRISPR gRNA sequence
tcttgatggcttttgtcagt

SEQ ID NO: 501499 - DNA, 20 bp, Artificial
  CRISPR gRNA sequence
gatggcttttgtcagttttg

SEQ ID NO: 501500 - DNA, 20 bp, Artificial
  CRISPR gRNA sequence
atggcttttgtcagttttgg

SEQ ID NO: 501501 - DNA, 20 bp, Artificial
  CRISPR gRNA sequence
ttgtcagttttgggaaattc

SEQ ID NO: 501502 - DNA, 20 bp, Artificial
  CRISPR gRNA sequence
tgtcagttttgggaaattct

SEQ ID NO: 501503 - DNA, 20 bp, Artificial
  CRISPR gRNA sequence
gtcagttttgggaaattctt

SEQ ID NO: 501504 - DNA, 20 bp, Artificial
  CRISPR gRNA sequence
tcagttttgggaaattctta

SEQ ID NO: 501505 - DNA, 20 bp, Artificial
  CRISPR gRNA sequence
tgggaaattcttatctttta

SEQ ID NO: 501506 - DNA, 20 bp, Artificial
  CRISPR gRNA sequence
gggaaattcttatcttttat

SEQ ID NO: 501507 - DNA, 20 bp, Artificial
  CRISPR gRNA sequence
ggaaattcttatcttttatc

SEQ ID NO: 501508 - DNA, 20 bp, Artificial
  CRISPR gRNA sequence
ttatcttttatctcttttgc

SEQ ID NO: 501509 - DNA, 20 bp, Artificial
  CRISPR gRNA sequence
atcttttatctcttttgctt

SEQ ID NO: 501510 - DNA, 20 bp, Artificial
  CRISPR gRNA sequence
tcttttatctcttttgctta

SEQ ID NO: 501511 - DNA, 20 bp, Artificial
  CRISPR gRNA sequence
ttatctcttttgcttagttc

SEQ ID NO: 501512 - DNA, 20 bp, Artificial
  CRISPR gRNA sequence
tatctcttttgcttagttcc

SEQ ID NO: 501513 - DNA, 20 bp, Artificial
  CRISPR gRNA sequence
atctcttttgcttagttcct

SEQ ID NO: 501514 - DNA, 20 bp, Artificial
  CRISPR gRNA sequence
tctcttttgcttagttcctc

SEQ ID NO: 501515 - DNA, 20 bp, Artificial
  CRISPR gRNA sequence
ttttgcttagttcctctttc

SEQ ID NO: 501516 - DNA, 20 bp, Artificial
  CRISPR gRNA sequence
ttgcttagttcctctttcct

SEQ ID NO: 501517 - DNA, 20 bp, Artificial
  CRISPR gRNA sequence
tgcttagttcctctttcctc

SEQ ID NO: 501518 - DNA, 20 bp, Artificial
  CRISPR gRNA sequence
gcttagttcctctttcctct

SEQ ID NO: 501519 - DNA, 20 bp, Artificial
  CRISPR gRNA sequence
cttagttcctctttcctctc

SEQ ID NO: 501520 - DNA, 20 bp, Artificial
  CRISPR gRNA sequence
agttcctctttcctctctcg

SEQ ID NO: 501521 - DNA, 20 bp, Artificial
  CRISPR gRNA sequence
gttcctctttcctctctcgt

SEQ ID NO: 501522 - DNA, 20 bp, Artificial
  CRISPR gRNA sequence
ctctttcctctctcgtctcc

SEQ ID NO: 501523 - DNA, 20 bp, Artificial
  CRISPR gRNA sequence
tttcctctctcgtctccttg

SEQ ID NO: 501524 - DNA, 20 bp, Artificial
  CRISPR gRNA sequence
tcctctctcgtctccttgct

SEQ ID NO: 501525 - DNA, 20 bp, Artificial
  CRISPR gRNA sequence
cctctctcgtctccttgctt

SEQ ID NO: 501526 - DNA, 20 bp, Artificial
  CRISPR gRNA sequence
ctctctcgtctccttgcttt

SEQ ID NO: 501527 - DNA, 20 bp, Artificial
  CRISPR gRNA sequence
tctcgtctccttgctttcca

SEQ ID NO: 501528 - DNA, 20 bp, Artificial
  CRISPR gRNA sequence
tcgtctccttgctttccaat

SEQ ID NO: 501529 - DNA, 20 bp, Artificial
  CRISPR gRNA sequence
gtctccttgctttccaatta

SEQ ID NO: 501530 - DNA, 20 bp, Artificial
  CRISPR gRNA sequence
cttgctttccaattacactt

SEQ ID NO: 501531 - DNA, 20 bp, Artificial
  CRISPR gRNA sequence
gctttccaattacacttagt

SEQ ID NO: 501532 - DNA, 20 bp, Artificial
  CRISPR gRNA sequence
ctttccaattacacttagtt

SEQ ID NO: 501533 - DNA, 20 bp, Artificial
  CRISPR gRNA sequence
tccaattacacttagtttag

SEQ ID NO: 501534 - DNA, 20 bp, Artificial
  CRISPR gRNA sequence
ccaattacacttagtttagg

SEQ ID NO: 501535 - DNA, 20 bp, Artificial
  CRISPR gRNA sequence
caattacacttagtttaggg

SEQ ID NO: 501536 - DNA, 20 bp, Artificial
  CRISPR gRNA sequence
cacttagtttaggggttttg

SEQ ID NO: 501537 - DNA, 20 bp, Artificial
  CRISPR gRNA sequence
agtttaggggttttgttttg

SEQ ID NO: 501538 - DNA, 20 bp, Artificial
  CRISPR gRNA sequence
gtttaggggttttgttttgt

SEQ ID NO: 501539 - DNA, 20 bp, Artificial
  CRISPR gRNA sequence
aggggttttgttttgttttt

SEQ ID NO: 501540 - DNA, 20 bp, Artificial
  CRISPR gRNA sequence
ggggttttgttttgtttttg

SEQ ID NO: 501541 - DNA, 20 bp, Artificial
  CRISPR gRNA sequence
tgttttgtttttgctatatc

SEQ ID NO: 501542 - DNA, 20 bp, Artificial
  CRISPR gRNA sequence
gttttgtttttgctatatct

SEQ ID NO: 501543 - DNA, 20 bp, Artificial
  CRISPR gRNA sequence
ttttgtttttgctatatctc

SEQ ID NO: 501544 - DNA, 20 bp, Artificial
  CRISPR gRNA sequence
tgtttttgctatatctcaaa

SEQ ID NO: 501545 - DNA, 20 bp, Artificial
  CRISPR gRNA sequence
gtttttgctatatctcaaat

SEQ ID NO: 501546 - DNA, 20 bp, Artificial
  CRISPR gRNA sequence
tttttgctatatctcaaata

SEQ ID NO: 501547 - DNA, 20 bp, Artificial
  CRISPR gRNA sequence
ttgctatatctcaaatatct

SEQ ID NO: 501548 - DNA, 20 bp, Artificial
  CRISPR gRNA sequence
tgctatatctcaaatatctt

SEQ ID NO: 501549 - DNA, 20 bp, Artificial
  CRISPR gRNA sequence
gctatatctcaaatatcttt

SEQ ID NO: 501550 - DNA, 20 bp, Artificial
  CRISPR gRNA sequence
ctatatctcaaatatctttt

SEQ ID NO: 501551 - DNA, 20 bp, Artificial
  CRISPR gRNA sequence
tatctcaaatatcttttaca

SEQ ID NO: 501552 - DNA, 20 bp, Artificial
  CRISPR gRNA sequence
aaatatcttttacactcctt

SEQ ID NO: 501553 - DNA, 20 bp, Artificial
  CRISPR gRNA sequence
ttacactccttcttgtgtat

SEQ ID NO: 501554 - DNA, 20 bp, Artificial
  CRISPR gRNA sequence
tacactccttcttgtgtatt

SEQ ID NO: 501555 - DNA, 20 bp, Artificial
  CRISPR gRNA sequence
acactccttcttgtgtattt

SEQ ID NO: 501556 - DNA, 20 bp, Artificial
  CRISPR gRNA sequence
cactccttcttgtgtatttt

SEQ ID NO: 501557 - DNA, 20 bp, Artificial
  CRISPR gRNA sequence
cttcttgtgtatttttatcc

SEQ ID NO: 501558 - DNA, 20 bp, Artificial
  CRISPR gRNA sequence
cttgtgtatttttatccttt

SEQ ID NO: 501559 - DNA, 20 bp, Artificial
  CRISPR gRNA sequence
ttgtgtatttttatcctttt

SEQ ID NO: 501560 - DNA, 20 bp, Artificial
  CRISPR gRNA sequence
gtgtatttttatccttttgt

SEQ ID NO: 501561 - DNA, 20 bp, Artificial
  CRISPR gRNA sequence
tgtatttttatccttttgtt

SEQ ID NO: 501562 - DNA, 20 bp, Artificial
  CRISPR gRNA sequence
ttatccttttgtttttcttt

SEQ ID NO: 501563 - DNA, 20 bp, Artificial
  CRISPR gRNA sequence
tatccttttgtttttcttta

SEQ ID NO: 501564 - DNA, 20 bp, Artificial
  CRISPR gRNA sequence
atccttttgtttttctttac

SEQ ID NO: 501565 - DNA, 20 bp, Artificial
  CRISPR gRNA sequence
tccttttgtttttctttact

SEQ ID NO: 501566 - DNA, 20 bp, Artificial
  CRISPR gRNA sequence
ttgtttttctttacttcact

SEQ ID NO: 501567 - DNA, 20 bp, Artificial
  CRISPR gRNA sequence
tgtttttctttacttcactc

SEQ ID NO: 501568 - DNA, 20 bp, Artificial
  CRISPR gRNA sequence
gtttttctttacttcactct

SEQ ID NO: 501569 - DNA, 20 bp, Artificial
  CRISPR gRNA sequence
tttttctttacttcactctg

SEQ ID NO: 501570 - DNA, 20 bp, Artificial
  CRISPR gRNA sequence
ttctttacttcactctggat

SEQ ID NO: 501571 - DNA, 20 bp, Artificial
  CRISPR gRNA sequence
tctttacttcactctggata

SEQ ID NO: 501572 - DNA, 20 bp, Artificial
  CRISPR gRNA sequence
ctttacttcactctggatat

SEQ ID NO: 501573 - DNA, 20 bp, Artificial
  CRISPR gRNA sequence
tttacttcactctggatatt

SEQ ID NO: 501574 - DNA, 20 bp, Artificial
  CRISPR gRNA sequence
tacttcactctggatatttt

SEQ ID NO: 501575 - DNA, 20 bp, Artificial
  CRISPR gRNA sequence
acttcactctggatatttta

SEQ ID NO: 501576 - DNA, 20 bp, Artificial
  CRISPR gRNA sequence
cttcactctggatattttat

SEQ ID NO: 501577 - DNA, 20 bp, Artificial
  CRISPR gRNA sequence
cactctggatattttataac

SEQ ID NO: 501578 - DNA, 20 bp, Artificial
  CRISPR gRNA sequence
actctggatattttataaca

SEQ ID NO: 501579 - DNA, 20 bp, Artificial
  CRISPR gRNA sequence
tggatattttataacagttt

SEQ ID NO: 501580 - DNA, 20 bp, Artificial
  CRISPR gRNA sequence
gatattttataacagttttc

SEQ ID NO: 501581 - DNA, 20 bp, Artificial
  CRISPR gRNA sequence
tataacagttttctaattct

SEQ ID NO: 501582 - DNA, 20 bp, Artificial
  CRISPR gRNA sequence
ataacagttttctaattctc

SEQ ID NO: 501583 - DNA, 20 bp, Artificial
  CRISPR gRNA sequence
taacagttttctaattctct

SEQ ID NO: 501584 - DNA, 20 bp, Artificial
  CRISPR gRNA sequence
tctaattctcttttcaatgg

SEQ ID NO: 501585 - DNA, 20 bp, Artificial
  CRISPR gRNA sequence
ctaattctcttttcaatggc

SEQ ID NO: 501586 - DNA, 20 bp, Artificial
  CRISPR gRNA sequence
taattctcttttcaatggca

SEQ ID NO: 501587 - DNA, 20 bp, Artificial
  CRISPR gRNA sequence
attctcttttcaatggcatc

SEQ ID NO: 501588 - DNA, 20 bp, Artificial
  CRISPR gRNA sequence
tcttttcaatggcatctaaa

SEQ ID NO: 501589 - DNA, 20 bp, Artificial
  CRISPR gRNA sequence
ttttcaatggcatctaaatg

SEQ ID NO: 501590 - DNA, 20 bp, Artificial
  CRISPR gRNA sequence
ttcaatggcatctaaatggc

SEQ ID NO: 501591 - DNA, 20 bp, Artificial
  CRISPR gRNA sequence
tcaatggcatctaaatggcc

SEQ ID NO: 501592 - DNA, 20 bp, Artificial
  CRISPR gRNA sequence
caatggcatctaaatggcct

SEQ ID NO: 501593 - DNA, 20 bp, Artificial
  CRISPR gRNA sequence
aatggcatctaaatggcctt

SEQ ID NO: 501594 - DNA, 20 bp, Artificial
  CRISPR gRNA sequence
aatggcctttttaacctttc

SEQ ID NO: 501595 - DNA, 20 bp, Artificial
  CRISPR gRNA sequence
tttaacctttcaattgagtt

SEQ ID NO: 501596 - DNA, 20 bp, Artificial
  CRISPR gRNA sequence
ttaacctttcaattgagttt

SEQ ID NO: 501597 - DNA, 20 bp, Artificial
  CRISPR gRNA sequence
taacctttcaattgagtttg

SEQ ID NO: 501598 - DNA, 20 bp, Artificial
  CRISPR gRNA sequence
aacctttcaattgagtttgt

SEQ ID NO: 501599 - DNA, 20 bp, Artificial
  CRISPR gRNA sequence
acctttcaattgagtttgtt

SEQ ID NO: 501600 - DNA, 20 bp, Artificial
  CRISPR gRNA sequence
tcaattgagtttgttttaca

SEQ ID NO: 501601 - DNA, 20 bp, Artificial
  CRISPR gRNA sequence
caattgagtttgttttacag

SEQ ID NO: 501602 - DNA, 20 bp, Artificial
  CRISPR gRNA sequence
aattgagtttgttttacagt

SEQ ID NO: 501603 - DNA, 20 bp, Artificial
  CRISPR gRNA sequence
agtttgttttacagttattt

SEQ ID NO: 501604 - DNA, 20 bp, Artificial
  CRISPR gRNA sequence
gttttacagttattttacat

SEQ ID NO: 501605 - DNA, 20 bp, Artificial
  CRISPR gRNA sequence
ttttacagttattttacatt

SEQ ID NO: 501606 - DNA, 20 bp, Artificial
  CRISPR gRNA sequence
tacagttattttacatttta

SEQ ID NO: 501607 - DNA, 20 bp, Artificial
  CRISPR gRNA sequence
acagttattttacattttat

SEQ ID NO: 501608 - DNA, 20 bp, Artificial
  CRISPR gRNA sequence
cagttattttacattttatt

SEQ ID NO: 501609 - DNA, 20 bp, Artificial
  CRISPR gRNA sequence
ttttacattttatttctgta

SEQ ID NO: 501610 - DNA, 20 bp, Artificial
  CRISPR gRNA sequence
tacattttatttctgtaatt

SEQ ID NO: 501611 - DNA, 20 bp, Artificial
  CRISPR gRNA sequence
acattttatttctgtaattt

SEQ ID NO: 501612 - DNA, 20 bp, Artificial
  CRISPR gRNA sequence
cattttatttctgtaatttt

SEQ ID NO: 501613 - DNA, 20 bp, Artificial
  CRISPR gRNA sequence
tatttctgtaattttcattg

SEQ ID NO: 501614 - DNA, 20 bp, Artificial
  CRISPR gRNA sequence
atttctgtaattttcattga

SEQ ID NO: 501615 - DNA, 20 bp, Artificial
  CRISPR gRNA sequence
tttctgtaattttcattgaa

SEQ ID NO: 501616 - DNA, 20 bp, Artificial
  CRISPR gRNA sequence
ctgtaattttcattgaattc

SEQ ID NO: 501617 - DNA, 20 bp, Artificial
  CRISPR gRNA sequence
tgtaattttcattgaattct

SEQ ID NO: 501618 - DNA, 20 bp, Artificial
  CRISPR gRNA sequence
taattttcattgaattcttt

SEQ ID NO: 501619 - DNA, 20 bp, Artificial
  CRISPR gRNA sequence
tcattgaattctttaaaaaa

SEQ ID NO: 501620 - DNA, 20 bp, Artificial
  CRISPR gRNA sequence
cattgaattctttaaaaaaa

SEQ ID NO: 501621 - DNA, 20 bp, Artificial
  CRISPR gRNA sequence
attgaattctttaaaaaaaa

SEQ ID NO: 501622 - DNA, 20 bp, Artificial
  CRISPR gRNA sequence
aattctttaaaaaaaatcca

SEQ ID NO: 501623 - DNA, 20 bp, Artificial
  CRISPR gRNA sequence
tttaaaaaaaatccaatttc

SEQ ID NO: 501624 - DNA, 20 bp, Artificial
  CRISPR gRNA sequence
taaaaaaaatccaatttcag

SEQ ID NO: 501625 - DNA, 20 bp, Artificial
  CRISPR gRNA sequence
aaaaaaaatccaatttcagg

SEQ ID NO: 501626 - DNA, 20 bp, Artificial
  CRISPR gRNA sequence
aaaaaaatccaatttcaggt

SEQ ID NO: 501627 - DNA, 20 bp, Artificial
  CRISPR gRNA sequence
caggtaactattgctgcata

SEQ ID NO: 501628 - DNA, 20 bp, Artificial
  CRISPR gRNA sequence
aggtaactattgctgcataa

SEQ ID NO: 501629 - DNA, 20 bp, Artificial
  CRISPR gRNA sequence
ttgctgcataatgacctact

SEQ ID NO: 501630 - DNA, 20 bp, Artificial
  CRISPR gRNA sequence
ctgcataatgacctactcca

SEQ ID NO: 501631 - DNA, 20 bp, Artificial
  CRISPR gRNA sequence
cataatgacctactccaaaa

SEQ ID NO: 501632 - DNA, 20 bp, Artificial
  CRISPR gRNA sequence
ctccaaaatccagtagttta

SEQ ID NO: 501633 - DNA, 20 bp, Artificial
  CRISPR gRNA sequence
caaaatccagtagtttaaaa

SEQ ID NO: 501634 - DNA, 20 bp, Artificial
  CRISPR gRNA sequence
aaaacaactacctatttagt

SEQ ID NO: 501635 - DNA, 20 bp, Artificial
  CRISPR gRNA sequence
aaacaactacctatttagtt

SEQ ID NO: 501636 - DNA, 20 bp, Artificial
  CRISPR gRNA sequence
cctatttagttagtgattct

SEQ ID NO: 501637 - DNA, 20 bp, Artificial
  CRISPR gRNA sequence
tttagttagtgattctgcta

SEQ ID NO: 501638 - DNA, 20 bp, Artificial
  CRISPR gRNA sequence
agttagtgattctgctagtt

SEQ ID NO: 501639 - DNA, 20 bp, Artificial
  CRISPR gRNA sequence
gttagtgattctgctagttg

SEQ ID NO: 501640 - DNA, 20 bp, Artificial
  CRISPR gRNA sequence
gtgattctgctagttggcaa

SEQ ID NO: 501641 - DNA, 20 bp, Artificial
  CRISPR gRNA sequence
tgctagttggcaatttgggc

SEQ ID NO: 501642 - DNA, 20 bp, Artificial
  CRISPR gRNA sequence
ctagttggcaatttgggctg

SEQ ID NO: 501643 - DNA, 20 bp, Artificial
  CRISPR gRNA sequence
gttggcaatttgggctgggc

SEQ ID NO: 501644 - DNA, 20 bp, Artificial
  CRISPR gRNA sequence
gcaatttgggctgggctcag

SEQ ID NO: 501645 - DNA, 20 bp, Artificial
  CRISPR gRNA sequence
gggctgggctcagctaggtg

SEQ ID NO: 501646 - DNA, 20 bp, Artificial
  CRISPR gRNA sequence
ggctgggctcagctaggtgg

SEQ ID NO: 501647 - DNA, 20 bp, Artificial
  CRISPR gRNA sequence
ggctcagctaggtggttctt

SEQ ID NO: 501648 - DNA, 20 bp, Artificial
  CRISPR gRNA sequence
agctaggtggttcttttggt

SEQ ID NO: 501649 - DNA, 20 bp, Artificial
  CRISPR gRNA sequence
ggtggttcttttggtttcct

SEQ ID NO: 501650 - DNA, 20 bp, Artificial
  CRISPR gRNA sequence
ttttggtttcctcttgcatc

SEQ ID NO: 501651 - DNA, 20 bp, Artificial
  CRISPR gRNA sequence
ttggtttcctcttgcatcag

SEQ ID NO: 501652 - DNA, 20 bp, Artificial
  CRISPR gRNA sequence
tggtttcctcttgcatcagt

SEQ ID NO: 501653 - DNA, 20 bp, Artificial
  CRISPR gRNA sequence
ggtttcctcttgcatcagtc

SEQ ID NO: 501654 - DNA, 20 bp, Artificial
  CRISPR gRNA sequence
gtttcctcttgcatcagtca

SEQ ID NO: 501655 - DNA, 20 bp, Artificial
  CRISPR gRNA sequence
cctcttgcatcagtcatgca

SEQ ID NO: 501656 - DNA, 20 bp, Artificial
  CRISPR gRNA sequence
ctcttgcatcagtcatgcat

SEQ ID NO: 501657 - DNA, 20 bp, Artificial
  CRISPR gRNA sequence
ttgcatcagtcatgcatgtg

SEQ ID NO: 501658 - DNA, 20 bp, Artificial
  CRISPR gRNA sequence
gcatcagtcatgcatgtgtg

SEQ ID NO: 501659 - DNA, 20 bp, Artificial
  CRISPR gRNA sequence
catcagtcatgcatgtgtgg

SEQ ID NO: 501660 - DNA, 20 bp, Artificial
  CRISPR gRNA sequence
ccagactggccacgggtggc

SEQ ID NO: 501661 - DNA, 20 bp, Artificial
  CRISPR gRNA sequence
gccacgggtggctgattcat

SEQ ID NO: 501662 - DNA, 20 bp, Artificial
  CRISPR gRNA sequence
attcatttatttatttttta

SEQ ID NO: 501663 - DNA, 20 bp, Artificial
  CRISPR gRNA sequence
atttatttattttttattgt

SEQ ID NO: 501664 - DNA, 20 bp, Artificial
  CRISPR gRNA sequence
atttattttttattgttttt

SEQ ID NO: 501665 - DNA, 20 bp, Artificial
  CRISPR gRNA sequence
tttattttttattgtttttt

SEQ ID NO: 501666 - DNA, 20 bp, Artificial
  CRISPR gRNA sequence
attttttattgttttttgag

SEQ ID NO: 501667 - DNA, 20 bp, Artificial
  CRISPR gRNA sequence
ttttttattgttttttgaga

SEQ ID NO: 501668 - DNA, 20 bp, Artificial
  CRISPR gRNA sequence
tttattgttttttgagatta

SEQ ID NO: 501669 - DNA, 20 bp, Artificial
  CRISPR gRNA sequence
ttattgttttttgagattag

SEQ ID NO: 501670 - DNA, 20 bp, Artificial
  CRISPR gRNA sequence
tattgttttttgagattagg

SEQ ID NO: 501671 - DNA, 20 bp, Artificial
  CRISPR gRNA sequence
attgttttttgagattaggt

SEQ ID NO: 501672 - DNA, 20 bp, Artificial
  CRISPR gRNA sequence
ttgttttttgagattaggtc

SEQ ID NO: 501673 - DNA, 20 bp, Artificial
  CRISPR gRNA sequence
ttttttgagattaggtcttg

SEQ ID NO: 501674 - DNA, 20 bp, Artificial
  CRISPR gRNA sequence
tttgagattaggtcttgctc

SEQ ID NO: 501675 - DNA, 20 bp, Artificial
  CRISPR gRNA sequence
ttgagattaggtcttgctct

SEQ ID NO: 501676 - DNA, 20 bp, Artificial
  CRISPR gRNA sequence
tgagattaggtcttgctctg

SEQ ID NO: 501677 - DNA, 20 bp, Artificial
  CRISPR gRNA sequence
gagattaggtcttgctctgt

SEQ ID NO: 501678 - DNA, 20 bp, Artificial
  CRISPR gRNA sequence
agattaggtcttgctctgtc

SEQ ID NO: 501679 - DNA, 20 bp, Artificial
  CRISPR gRNA sequence
ggtcttgctctgtcatgcag

SEQ ID NO: 501680 - DNA, 20 bp, Artificial
  CRISPR gRNA sequence
gctctgtcatgcaggctaga

SEQ ID NO: 501681 - DNA, 20 bp, Artificial
  CRISPR gRNA sequence
ctctgtcatgcaggctagag

SEQ ID NO: 501682 - DNA, 20 bp, Artificial
  CRISPR gRNA sequence
tgtcatgcaggctagagtgc

SEQ ID NO: 501683 - DNA, 20 bp, Artificial
  CRISPR gRNA sequence
tcatgcaggctagagtgcag

SEQ ID NO: 501684 - DNA, 20 bp, Artificial
  CRISPR gRNA sequence
gagtgcagtggcatgatatc

SEQ ID NO: 501685 - DNA, 20 bp, Artificial
  CRISPR gRNA sequence
ggctcactgcaagctccatc

SEQ ID NO: 501686 - DNA, 20 bp, Artificial
  CRISPR gRNA sequence
actgcaagctccatctcccg

SEQ ID NO: 501687 - DNA, 20 bp, Artificial
  CRISPR gRNA sequence
caagctccatctcccgggtt

SEQ ID NO: 501688 - DNA, 20 bp, Artificial
  CRISPR gRNA sequence
catctcccgggttcaagcag

SEQ ID NO: 501689 - DNA, 20 bp, Artificial
  CRISPR gRNA sequence
ccgggttcaagcagttctcg

SEQ ID NO: 501690 - DNA, 20 bp, Artificial
  CRISPR gRNA sequence
aagcagttctcgtgcctcag

SEQ ID NO: 501691 - DNA, 20 bp, Artificial
  CRISPR gRNA sequence
tcgtgcctcagactcccaag

SEQ ID NO: 501692 - DNA, 20 bp, Artificial
  CRISPR gRNA sequence
gtgcctcagactcccaagta

SEQ ID NO: 501693 - DNA, 20 bp, Artificial
  CRISPR gRNA sequence
agactcccaagtagctgggg

SEQ ID NO: 501694 - DNA, 20 bp, Artificial
  CRISPR gRNA sequence
ccaagtagctggggttacaa

SEQ ID NO: 501695 - DNA, 20 bp, Artificial
  CRISPR gRNA sequence
gggttacaagtgtgtgccac

SEQ ID NO: 501696 - DNA, 20 bp, Artificial
  CRISPR gRNA sequence
caagtgtgtgccaccatgtc

SEQ ID NO: 501697 - DNA, 20 bp, Artificial
  CRISPR gRNA sequence
gctaatttttgtatcgttag

SEQ ID NO: 501698 - DNA, 20 bp, Artificial
  CRISPR gRNA sequence
atttttgtatcgttagtaga

SEQ ID NO: 501699 - DNA, 20 bp, Artificial
  CRISPR gRNA sequence
ttgtatcgttagtagagacg

SEQ ID NO: 501700 - DNA, 20 bp, Artificial
  CRISPR gRNA sequence
tgtatcgttagtagagacga

SEQ ID NO: 501701 - DNA, 20 bp, Artificial
  CRISPR gRNA sequence
gtatcgttagtagagacgag

SEQ ID NO: 501702 - DNA, 20 bp, Artificial
  CRISPR gRNA sequence
tatcgttagtagagacgagg

SEQ ID NO: 501703 - DNA, 20 bp, Artificial
  CRISPR gRNA sequence
gtagagacgaggttttacca

SEQ ID NO: 501704 - DNA, 20 bp, Artificial
  CRISPR gRNA sequence
taccatgttggccagggtgg

SEQ ID NO: 501705 - DNA, 20 bp, Artificial
  CRISPR gRNA sequence
accatgttggccagggtggt

SEQ ID NO: 501706 - DNA, 20 bp, Artificial
  CRISPR gRNA sequence
ccatgttggccagggtggtc

SEQ ID NO: 501707 - DNA, 20 bp, Artificial
  CRISPR gRNA sequence
gccagggtggtctcgaactc

SEQ ID NO: 501708 - DNA, 20 bp, Artificial
  CRISPR gRNA sequence
gaactcccgaccttgagtga

SEQ ID NO: 501709 - DNA, 20 bp, Artificial
  CRISPR gRNA sequence
ccgaccttgagtgatctgcc

SEQ ID NO: 501710 - DNA, 20 bp, Artificial
  CRISPR gRNA sequence
gagtgatctgccggccttgg

SEQ ID NO: 501711 - DNA, 20 bp, Artificial
  CRISPR gRNA sequence
agtgatctgccggccttggc

SEQ ID NO: 501712 - DNA, 20 bp, Artificial
  CRISPR gRNA sequence
ccggccttggcctcccaaag

SEQ ID NO: 501713 - DNA, 20 bp, Artificial
  CRISPR gRNA sequence
ggcctcccaaagtgctggaa

SEQ ID NO: 501714 - DNA, 20 bp, Artificial
  CRISPR gRNA sequence
gcctcccaaagtgctggaat

SEQ ID NO: 501715 - DNA, 20 bp, Artificial
  CRISPR gRNA sequence
ccaaagtgctggaattacgg

SEQ ID NO: 501716 - DNA, 20 bp, Artificial
  CRISPR gRNA sequence
gaattacgggcatgagccac

SEQ ID NO: 501717 - DNA, 20 bp, Artificial
  CRISPR gRNA sequence
cgggcatgagccaccgcacc

SEQ ID NO: 501718 - DNA, 20 bp, Artificial
  CRISPR gRNA sequence
gctgatttagaatggcctta

SEQ ID NO: 501719 - DNA, 20 bp, Artificial
  CRISPR gRNA sequence
atttagaatggccttagctg

SEQ ID NO: 501720 - DNA, 20 bp, Artificial
  CRISPR gRNA sequence
agaatggccttagctgtgtt

SEQ ID NO: 501721 - DNA, 20 bp, Artificial
  CRISPR gRNA sequence
gaatggccttagctgtgttg

SEQ ID NO: 501722 - DNA, 20 bp, Artificial
  CRISPR gRNA sequence
agctgtgttggcttatctct

SEQ ID NO: 501723 - DNA, 20 bp, Artificial
  CRISPR gRNA sequence
gctgtgttggcttatctctg

SEQ ID NO: 501724 - DNA, 20 bp, Artificial
  CRISPR gRNA sequence
tgttggcttatctctgtatc

SEQ ID NO: 501725 - DNA, 20 bp, Artificial
  CRISPR gRNA sequence
gcttatctctgtatcatgtg

SEQ ID NO: 501726 - DNA, 20 bp, Artificial
  CRISPR gRNA sequence
atctctgtatcatgtgatat

SEQ ID NO: 501727 - DNA, 20 bp, Artificial
  CRISPR gRNA sequence
tctctgtatcatgtgatatc

SEQ ID NO: 501728 - DNA, 20 bp, Artificial
  CRISPR gRNA sequence
tgtatcatgtgatatcttat

SEQ ID NO: 501729 - DNA, 20 bp, Artificial
  CRISPR gRNA sequence
tatcatgtgatatcttattc

SEQ ID NO: 501730 - DNA, 20 bp, Artificial
  CRISPR gRNA sequence
attctccagcaggctatttt

SEQ ID NO: 501731 - DNA, 20 bp, Artificial
  CRISPR gRNA sequence
ttctccagcaggctatttta

SEQ ID NO: 501732 - DNA, 20 bp, Artificial
  CRISPR gRNA sequence
tccagcaggctattttaggc

SEQ ID NO: 501733 - DNA, 20 bp, Artificial
  CRISPR gRNA sequence
cagcaggctattttaggctt

SEQ ID NO: 501734 - DNA, 20 bp, Artificial
  CRISPR gRNA sequence
ttttaggcttgttcacaggt

SEQ ID NO: 501735 - DNA, 20 bp, Artificial
  CRISPR gRNA sequence
taggcttgttcacaggtcag

SEQ ID NO: 501736 - DNA, 20 bp, Artificial
  CRISPR gRNA sequence
aggcttgttcacaggtcagc

SEQ ID NO: 501737 - DNA, 20 bp, Artificial
  CRISPR gRNA sequence
ggcttgttcacaggtcagcc

SEQ ID NO: 501738 - DNA, 20 bp, Artificial
  CRISPR gRNA sequence
gttcacaggtcagccagatg

SEQ ID NO: 501739 - DNA, 20 bp, Artificial
  CRISPR gRNA sequence
ttcacaggtcagccagatga

SEQ ID NO: 501740 - DNA, 20 bp, Artificial
  CRISPR gRNA sequence
acaggtcagccagatgaggt

SEQ ID NO: 501741 - DNA, 20 bp, Artificial
  CRISPR gRNA sequence
caagagaacaagtagaaatg

SEQ ID NO: 501742 - DNA, 20 bp, Artificial
  CRISPR gRNA sequence
ttcagatctaggcttagaac

SEQ ID NO: 501743 - DNA, 20 bp, Artificial
  CRISPR gRNA sequence
tcagatctaggcttagaact

SEQ ID NO: 501744 - DNA, 20 bp, Artificial
  CRISPR gRNA sequence
cagatctaggcttagaacta

SEQ ID NO: 501745 - DNA, 20 bp, Artificial
  CRISPR gRNA sequence
agatctaggcttagaactag

SEQ ID NO: 501746 - DNA, 20 bp, Artificial
  CRISPR gRNA sequence
ggcttagaactagcagaaca

SEQ ID NO: 501747 - DNA, 20 bp, Artificial
  CRISPR gRNA sequence
agaactagcagaacatcatt

SEQ ID NO: 501748 - DNA, 20 bp, Artificial
  CRISPR gRNA sequence
gaactagcagaacatcattt

SEQ ID NO: 501749 - DNA, 20 bp, Artificial
  CRISPR gRNA sequence
gcagaacatcatttttgctg

SEQ ID NO: 501750 - DNA, 20 bp, Artificial
  CRISPR gRNA sequence
ttgctgcgtttcatcatgaa

SEQ ID NO: 501751 - DNA, 20 bp, Artificial
  CRISPR gRNA sequence
tgctgcgtttcatcatgaag

SEQ ID NO: 501752 - DNA, 20 bp, Artificial
  CRISPR gRNA sequence
gctgcgtttcatcatgaaga

SEQ ID NO: 501753 - DNA, 20 bp, Artificial
  CRISPR gRNA sequence
ctgcgtttcatcatgaagac

SEQ ID NO: 501754 - DNA, 20 bp, Artificial
  CRISPR gRNA sequence
cgtttcatcatgaagaccag

SEQ ID NO: 501755 - DNA, 20 bp, Artificial
  CRISPR gRNA sequence
catcatgaagaccagcccag

SEQ ID NO: 501756 - DNA, 20 bp, Artificial
  CRISPR gRNA sequence
atcatgaagaccagcccagt

SEQ ID NO: 501757 - DNA, 20 bp, Artificial
  CRISPR gRNA sequence
caagagacagggaaatgaac

SEQ ID NO: 501758 - DNA, 20 bp, Artificial
  CRISPR gRNA sequence
cttgataacagaaggagctg

SEQ ID NO: 501759 - DNA, 20 bp, Artificial
  CRISPR gRNA sequence
ttgataacagaaggagctgt

SEQ ID NO: 501760 - DNA, 20 bp, Artificial
  CRISPR gRNA sequence
gataacagaaggagctgtaa

SEQ ID NO: 501761 - DNA, 20 bp, Artificial
  CRISPR gRNA sequence
ataacagaaggagctgtaaa

SEQ ID NO: 501762 - DNA, 20 bp, Artificial
  CRISPR gRNA sequence
taaagtcacattgcaaggac

SEQ ID NO: 501763 - DNA, 20 bp, Artificial
  CRISPR gRNA sequence
caaggacatggtatttttgc

SEQ ID NO: 501764 - DNA, 20 bp, Artificial
  CRISPR gRNA sequence
ttgcattctatcacgctagt

SEQ ID NO: 501765 - DNA, 20 bp, Artificial
  CRISPR gRNA sequence
tgcattctatcacgctagtt

SEQ ID NO: 501766 - DNA, 20 bp, Artificial
  CRISPR gRNA sequence
gcattctatcacgctagttc

SEQ ID NO: 501767 - DNA, 20 bp, Artificial
  CRISPR gRNA sequence
cattctatcacgctagttct

SEQ ID NO: 501768 - DNA, 20 bp, Artificial
  CRISPR gRNA sequence
tatcacgctagttctctgct

SEQ ID NO: 501769 - DNA, 20 bp, Artificial
  CRISPR gRNA sequence
tcacgctagttctctgctga

SEQ ID NO: 501770 - DNA, 20 bp, Artificial
  CRISPR gRNA sequence
gttctctgctgaaattctta

SEQ ID NO: 501771 - DNA, 20 bp, Artificial
  CRISPR gRNA sequence
tctgctgaaattcttaaact

SEQ ID NO: 501772 - DNA, 20 bp, Artificial
  CRISPR gRNA sequence
tgctgaaattcttaaactta

SEQ ID NO: 501773 - DNA, 20 bp, Artificial
  CRISPR gRNA sequence
ctgaaattcttaaacttatg

SEQ ID NO: 501774 - DNA, 20 bp, Artificial
  CRISPR gRNA sequence
aaattcttaaacttatgttt

SEQ ID NO: 501775 - DNA, 20 bp, Artificial
  CRISPR gRNA sequence
ttaaacttatgttttatttc

SEQ ID NO: 501776 - DNA, 20 bp, Artificial
  CRISPR gRNA sequence
aaacttatgttttatttcct

SEQ ID NO: 501777 - DNA, 20 bp, Artificial
  CRISPR gRNA sequence
aacttatgttttatttcctt

SEQ ID NO: 501778 - DNA, 20 bp, Artificial
  CRISPR gRNA sequence
atgttttatttccttgaaca

SEQ ID NO: 501779 - DNA, 20 bp, Artificial
  CRISPR gRNA sequence
tgttttatttccttgaacat

SEQ ID NO: 501780 - DNA, 20 bp, Artificial
  CRISPR gRNA sequence
tatttccttgaacatattag

SEQ ID NO: 501781 - DNA, 20 bp, Artificial
  CRISPR gRNA sequence
atttccttgaacatattaga

SEQ ID NO: 501782 - DNA, 20 bp, Artificial
  CRISPR gRNA sequence
tttccttgaacatattagac

SEQ ID NO: 501783 - DNA, 20 bp, Artificial
  CRISPR gRNA sequence
ccttgaacatattagacatg

SEQ ID NO: 501784 - DNA, 20 bp, Artificial
  CRISPR gRNA sequence
cttgaacatattagacatga

SEQ ID NO: 501785 - DNA, 20 bp, Artificial
  CRISPR gRNA sequence
gaacatattagacatgatta

SEQ ID NO: 501786 - DNA, 20 bp, Artificial
  CRISPR gRNA sequence
aacatattagacatgattac

SEQ ID NO: 501787 - DNA, 20 bp, Artificial
  CRISPR gRNA sequence
gacatgattactttaaagtt

SEQ ID NO: 501788 - DNA, 20 bp, Artificial
  CRISPR gRNA sequence
ctttaaagtttatgactgac

SEQ ID NO: 501789 - DNA, 20 bp, Artificial
  CRISPR gRNA sequence
taaagtttatgactgacaac

SEQ ID NO: 501790 - DNA, 20 bp, Artificial
  CRISPR gRNA sequence
aaagtttatgactgacaact

SEQ ID NO: 501791 - DNA, 20 bp, Artificial
  CRISPR gRNA sequence
aagtttatgactgacaactc

SEQ ID NO: 501792 - DNA, 20 bp, Artificial
  CRISPR gRNA sequence
atgactgacaactctattat

SEQ ID NO: 501793 - DNA, 20 bp, Artificial
  CRISPR gRNA sequence
tgactgacaactctattatg

SEQ ID NO: 501794 - DNA, 20 bp, Artificial
  CRISPR gRNA sequence
acaactctattatgtagatg

SEQ ID NO: 501795 - DNA, 20 bp, Artificial
  CRISPR gRNA sequence
tattatgtagatgccctgtt

SEQ ID NO: 501796 - DNA, 20 bp, Artificial
  CRISPR gRNA sequence
ttatgtagatgccctgtttg

SEQ ID NO: 501797 - DNA, 20 bp, Artificial
  CRISPR gRNA sequence
tgtagatgccctgtttgttg

SEQ ID NO: 501798 - DNA, 20 bp, Artificial
  CRISPR gRNA sequence
tttgttggtttctgttgtct

SEQ ID NO: 501799 - DNA, 20 bp, Artificial
  CRISPR gRNA sequence
gttggtttctgttgtctcta

SEQ ID NO: 501800 - DNA, 20 bp, Artificial
  CRISPR gRNA sequence
ttggtttctgttgtctctat

SEQ ID NO: 501801 - DNA, 20 bp, Artificial
  CRISPR gRNA sequence
gtttctgttgtctctattct

SEQ ID NO: 501802 - DNA, 20 bp, Artificial
  CRISPR gRNA sequence
ctgttgtctctattcttctg

SEQ ID NO: 501803 - DNA, 20 bp, Artificial
  CRISPR gRNA sequence
tgttgtctctattcttctgt

SEQ ID NO: 501804 - DNA, 20 bp, Artificial
  CRISPR gRNA sequence
ttgtctctattcttctgttg

SEQ ID NO: 501805 - DNA, 20 bp, Artificial
  CRISPR gRNA sequence
tctctattcttctgttggtt

SEQ ID NO: 501806 - DNA, 20 bp, Artificial
  CRISPR gRNA sequence
tattcttctgttggtttttg

SEQ ID NO: 501807 - DNA, 20 bp, Artificial
  CRISPR gRNA sequence
ttcttctgttggtttttgga

SEQ ID NO: 501808 - DNA, 20 bp, Artificial
  CRISPR gRNA sequence
ttctgttggtttttggagat

SEQ ID NO: 501809 - DNA, 20 bp, Artificial
  CRISPR gRNA sequence
ctgttggtttttggagatgt

SEQ ID NO: 501810 - DNA, 20 bp, Artificial
  CRISPR gRNA sequence
tgttggtttttggagatgtt

SEQ ID NO: 501811 - DNA, 20 bp, Artificial
  CRISPR gRNA sequence
ttggtttttggagatgtttc

SEQ ID NO: 501812 - DNA, 20 bp, Artificial
  CRISPR gRNA sequence
gtttttggagatgtttcctt

SEQ ID NO: 501813 - DNA, 20 bp, Artificial
  CRISPR gRNA sequence
ttggagatgtttccttttct

SEQ ID NO: 501814 - DNA, 20 bp, Artificial
  CRISPR gRNA sequence
tggagatgtttccttttctt

SEQ ID NO: 501815 - DNA, 20 bp, Artificial
  CRISPR gRNA sequence
ggagatgtttccttttctta

SEQ ID NO: 501816 - DNA, 20 bp, Artificial
  CRISPR gRNA sequence
gagatgtttccttttcttat

SEQ ID NO: 501817 - DNA, 20 bp, Artificial
  CRISPR gRNA sequence
ccttttcttatacttcactt

SEQ ID NO: 501818 - DNA, 20 bp, Artificial
  CRISPR gRNA sequence
cttttcttatacttcacttt

SEQ ID NO: 501819 - DNA, 20 bp, Artificial
  CRISPR gRNA sequence
ttcttatacttcactttgga

SEQ ID NO: 501820 - DNA, 20 bp, Artificial
  CRISPR gRNA sequence
tcttatacttcactttggat

SEQ ID NO: 501821 - DNA, 20 bp, Artificial
  CRISPR gRNA sequence
cttatacttcactttggata

SEQ ID NO: 501822 - DNA, 20 bp, Artificial
  CRISPR gRNA sequence
ttatacttcactttggatat

SEQ ID NO: 501823 - DNA, 20 bp, Artificial
  CRISPR gRNA sequence
atacttcactttggatattg

SEQ ID NO: 501824 - DNA, 20 bp, Artificial
  CRISPR gRNA sequence
tacttcactttggatattgt

SEQ ID NO: 501825 - DNA, 20 bp, Artificial
  CRISPR gRNA sequence
cactttggatattgtgtatg

SEQ ID NO: 501826 - DNA, 20 bp, Artificial
  CRISPR gRNA sequence
actttggatattgtgtatga

SEQ ID NO: 501827 - DNA, 20 bp, Artificial
  CRISPR gRNA sequence
tggatattgtgtatgaaaca

SEQ ID NO: 501828 - DNA, 20 bp, Artificial
  CRISPR gRNA sequence
ggatattgtgtatgaaacat

SEQ ID NO: 501829 - DNA, 20 bp, Artificial
  CRISPR gRNA sequence
gatattgtgtatgaaacatt

SEQ ID NO: 501830 - DNA, 20 bp, Artificial
  CRISPR gRNA sequence
tgtatgaaacattctaggaa

SEQ ID NO: 501831 - DNA, 20 bp, Artificial
  CRISPR gRNA sequence
taggaataatttaatgctct

SEQ ID NO: 501832 - DNA, 20 bp, Artificial
  CRISPR gRNA sequence
ggaataatttaatgctctgg

SEQ ID NO: 501833 - DNA, 20 bp, Artificial
  CRISPR gRNA sequence
aatgctctggttgatgttat

SEQ ID NO: 501834 - DNA, 20 bp, Artificial
  CRISPR gRNA sequence
atgctctggttgatgttatt

SEQ ID NO: 501835 - DNA, 20 bp, Artificial
  CRISPR gRNA sequence
tggttgatgttattttcctc

SEQ ID NO: 501836 - DNA, 20 bp, Artificial
  CRISPR gRNA sequence
gttgatgttattttcctcta

SEQ ID NO: 501837 - DNA, 20 bp, Artificial
  CRISPR gRNA sequence
atgttattttcctctagtca

SEQ ID NO: 501838 - DNA, 20 bp, Artificial
  CRISPR gRNA sequence
ttttcctctagtcataactt

SEQ ID NO: 501839 - DNA, 20 bp, Artificial
  CRISPR gRNA sequence
tcctctagtcataacttata

SEQ ID NO: 501840 - DNA, 20 bp, Artificial
  CRISPR gRNA sequence
cctctagtcataacttatat

SEQ ID NO: 501841 - DNA, 20 bp, Artificial
  CRISPR gRNA sequence
ctctagtcataacttatatt

SEQ ID NO: 501842 - DNA, 20 bp, Artificial
  CRISPR gRNA sequence
tagtcataacttatatttgc

SEQ ID NO: 501843 - DNA, 20 bp, Artificial
  CRISPR gRNA sequence
gtcataacttatatttgcct

SEQ ID NO: 501844 - DNA, 20 bp, Artificial
  CRISPR gRNA sequence
atatttgcctctagttggca

SEQ ID NO: 501845 - DNA, 20 bp, Artificial
  CRISPR gRNA sequence
tatttgcctctagttggcag

SEQ ID NO: 501846 - DNA, 20 bp, Artificial
  CRISPR gRNA sequence
gcctctagttggcagccagg

SEQ ID NO: 501847 - DNA, 20 bp, Artificial
  CRISPR gRNA sequence
cctctagttggcagccaggt

SEQ ID NO: 501848 - DNA, 20 bp, Artificial
  CRISPR gRNA sequence
tagttggcagccaggttagg

SEQ ID NO: 501849 - DNA, 20 bp, Artificial
  CRISPR gRNA sequence
gttggcagccaggttagggc

SEQ ID NO: 501850 - DNA, 20 bp, Artificial
  CRISPR gRNA sequence
gcagccaggttagggctacc

SEQ ID NO: 501851 - DNA, 20 bp, Artificial
  CRISPR gRNA sequence
gggctaccagagattccaga

SEQ ID NO: 501852 - DNA, 20 bp, Artificial
  CRISPR gRNA sequence
ccagagattccagatcatta

SEQ ID NO: 501853 - DNA, 20 bp, Artificial
  CRISPR gRNA sequence
cagatcattagttcaatcca

SEQ ID NO: 501854 - DNA, 20 bp, Artificial
  CRISPR gRNA sequence
gttcaatccagggttgtgat

SEQ ID NO: 501855 - DNA, 20 bp, Artificial
  CRISPR gRNA sequence
aatccagggttgtgatgatt

SEQ ID NO: 501856 - DNA, 20 bp, Artificial
  CRISPR gRNA sequence
tgatgattcaaaattgagct

SEQ ID NO: 501857 - DNA, 20 bp, Artificial
  CRISPR gRNA sequence
aaaattgagcttcagttcct

SEQ ID NO: 501858 - DNA, 20 bp, Artificial
  CRISPR gRNA sequence
agcttcagttcctgtgaggg

SEQ ID NO: 501859 - DNA, 20 bp, Artificial
  CRISPR gRNA sequence
cagttcctgtgagggctgtt

SEQ ID NO: 501860 - DNA, 20 bp, Artificial
  CRISPR gRNA sequence
agttcctgtgagggctgttc

SEQ ID NO: 501861 - DNA, 20 bp, Artificial
  CRISPR gRNA sequence
ctgtgagggctgttcatttc

SEQ ID NO: 501862 - DNA, 20 bp, Artificial
  CRISPR gRNA sequence
tgagggctgttcatttctcg

SEQ ID NO: 501863 - DNA, 20 bp, Artificial
  CRISPR gRNA sequence
ttcatttctcgttcactctt

SEQ ID NO: 501864 - DNA, 20 bp, Artificial
  CRISPR gRNA sequence
atttctcgttcactcttact

SEQ ID NO: 501865 - DNA, 20 bp, Artificial
  CRISPR gRNA sequence
ctcgttcactcttactcttt

SEQ ID NO: 501866 - DNA, 20 bp, Artificial
  CRISPR gRNA sequence
tcgttcactcttactctttg

SEQ ID NO: 501867 - DNA, 20 bp, Artificial
  CRISPR gRNA sequence
gttcactcttactctttggg

SEQ ID NO: 501868 - DNA, 20 bp, Artificial
  CRISPR gRNA sequence
actcttactctttgggtata

SEQ ID NO: 501869 - DNA, 20 bp, Artificial
  CRISPR gRNA sequence
ttactctttgggtatagccc

SEQ ID NO: 501870 - DNA, 20 bp, Artificial
  CRISPR gRNA sequence
actctttgggtatagccctc

SEQ ID NO: 501871 - DNA, 20 bp, Artificial
  CRISPR gRNA sequence
ctctttgggtatagccctct

SEQ ID NO: 501872 - DNA, 20 bp, Artificial
  CRISPR gRNA sequence
tttgggtatagccctctgtg

SEQ ID NO: 501873 - DNA, 20 bp, Artificial
  CRISPR gRNA sequence
tgggtatagccctctgtggt

SEQ ID NO: 501874 - DNA, 20 bp, Artificial
  CRISPR gRNA sequence
gggtatagccctctgtggta

SEQ ID NO: 501875 - DNA, 20 bp, Artificial
  CRISPR gRNA sequence
ggtatagccctctgtggtac

SEQ ID NO: 501876 - DNA, 20 bp, Artificial
  CRISPR gRNA sequence
tgtggtaccaacctcaacac

SEQ ID NO: 501877 - DNA, 20 bp, Artificial
  CRISPR gRNA sequence
tggtaccaacctcaacactg

SEQ ID NO: 501878 - DNA, 20 bp, Artificial
  CRISPR gRNA sequence
aacactgatggattttatgt

SEQ ID NO: 501879 - DNA, 20 bp, Artificial
  CRISPR gRNA sequence
atggattttatgtatacccg

SEQ ID NO: 501880 - DNA, 20 bp, Artificial
  CRISPR gRNA sequence
tatgtatacccgctttctaa

SEQ ID NO: 501881 - DNA, 20 bp, Artificial
  CRISPR gRNA sequence
atgtatacccgctttctaat

SEQ ID NO: 501882 - DNA, 20 bp, Artificial
  CRISPR gRNA sequence
tgtatacccgctttctaata

SEQ ID NO: 501883 - DNA, 20 bp, Artificial
  CRISPR gRNA sequence
tctaataggagggacgtgaa

SEQ ID NO: 501884 - DNA, 20 bp, Artificial
  CRISPR gRNA sequence
ctaataggagggacgtgaac

SEQ ID NO: 501885 - DNA, 20 bp, Artificial
  CRISPR gRNA sequence
taataggagggacgtgaact

SEQ ID NO: 501886 - DNA, 20 bp, Artificial
  CRISPR gRNA sequence
ataggagggacgtgaacttc

SEQ ID NO: 501887 - DNA, 20 bp, Artificial
  CRISPR gRNA sequence
catgttctcttagttccttg

SEQ ID NO: 501888 - DNA, 20 bp, Artificial
  CRISPR gRNA sequence
atgttctcttagttccttga

SEQ ID NO: 501889 - DNA, 20 bp, Artificial
  CRISPR gRNA sequence
tcttagttccttgagtttta

SEQ ID NO: 501890 - DNA, 20 bp, Artificial
  CRISPR gRNA sequence
ttagttccttgagttttatt

SEQ ID NO: 501891 - DNA, 20 bp, Artificial
  CRISPR gRNA sequence
agttccttgagttttattgt

SEQ ID NO: 501892 - DNA, 20 bp, Artificial
  CRISPR gRNA sequence
gttccttgagttttattgtg

SEQ ID NO: 501893 - DNA, 20 bp, Artificial
  CRISPR gRNA sequence
cttgagttttattgtgagct

SEQ ID NO: 501894 - DNA, 20 bp, Artificial
  CRISPR gRNA sequence
gagttttattgtgagctctg

SEQ ID NO: 501895 - DNA, 20 bp, Artificial
  CRISPR gRNA sequence
agttttattgtgagctctgc

SEQ ID NO: 501896 - DNA, 20 bp, Artificial
  CRISPR gRNA sequence
tattgtgagctctgctcagc

SEQ ID NO: 501897 - DNA, 20 bp, Artificial
  CRISPR gRNA sequence
attgtgagctctgctcagct

SEQ ID NO: 501898 - DNA, 20 bp, Artificial
  CRISPR gRNA sequence
ttgtgagctctgctcagctt

SEQ ID NO: 501899 - DNA, 20 bp, Artificial
  CRISPR gRNA sequence
tgagctctgctcagcttctc

SEQ ID NO: 501900 - DNA, 20 bp, Artificial
  CRISPR gRNA sequence
tgctcagcttctcagccttt

SEQ ID NO: 501901 - DNA, 20 bp, Artificial
  CRISPR gRNA sequence
ctcagcttctcagcctttta

SEQ ID NO: 501902 - DNA, 20 bp, Artificial
  CRISPR gRNA sequence
agcttctcagccttttagct

SEQ ID NO: 501903 - DNA, 20 bp, Artificial
  CRISPR gRNA sequence
ctcagccttttagctgccat

SEQ ID NO: 501904 - DNA, 20 bp, Artificial
  CRISPR gRNA sequence
tcagccttttagctgccatt

SEQ ID NO: 501905 - DNA, 20 bp, Artificial
  CRISPR gRNA sequence
agccttttagctgccattta

SEQ ID NO: 501906 - DNA, 20 bp, Artificial
  CRISPR gRNA sequence
ttagctgccatttatggaat

SEQ ID NO: 501907 - DNA, 20 bp, Artificial
  CRISPR gRNA sequence
tagctgccatttatggaatc

SEQ ID NO: 501908 - DNA, 20 bp, Artificial
  CRISPR gRNA sequence
agctgccatttatggaatca

SEQ ID NO: 501909 - DNA, 20 bp, Artificial
  CRISPR gRNA sequence
gctgccatttatggaatcag

SEQ ID NO: 501910 - DNA, 20 bp, Artificial
  CRISPR gRNA sequence
ccatttatggaatcagaaga

SEQ ID NO: 501911 - DNA, 20 bp, Artificial
  CRISPR gRNA sequence
atggaatcagaagatgcctc

SEQ ID NO: 501912 - DNA, 20 bp, Artificial
  CRISPR gRNA sequence
tggaatcagaagatgcctcc

SEQ ID NO: 501913 - DNA, 20 bp, Artificial
  CRISPR gRNA sequence
cagggaacaacagtcagaaa

SEQ ID NO: 501914 - DNA, 20 bp, Artificial
  CRISPR gRNA sequence
atctcacctctctgaatttc

SEQ ID NO: 501915 - DNA, 20 bp, Artificial
  CRISPR gRNA sequence
acctctctgaatttccttct

SEQ ID NO: 501916 - DNA, 20 bp, Artificial
  CRISPR gRNA sequence
tctgaatttccttcttccag

SEQ ID NO: 501917 - DNA, 20 bp, Artificial
  CRISPR gRNA sequence
tgaatttccttcttccagat

SEQ ID NO: 501918 - DNA, 20 bp, Artificial
  CRISPR gRNA sequence
aatttccttcttccagatat

SEQ ID NO: 501919 - DNA, 20 bp, Artificial
  CRISPR gRNA sequence
ccttcttccagatattggcc

SEQ ID NO: 501920 - DNA, 20 bp, Artificial
  CRISPR gRNA sequence
cttcttccagatattggccc

SEQ ID NO: 501921 - DNA, 20 bp, Artificial
  CRISPR gRNA sequence
cttccagatattggccccat

SEQ ID NO: 501922 - DNA, 20 bp, Artificial
  CRISPR gRNA sequence
ttccagatattggccccata

SEQ ID NO: 501923 - DNA, 20 bp, Artificial
  CRISPR gRNA sequence
ccagatattggccccataat

SEQ ID NO: 501924 - DNA, 20 bp, Artificial
  CRISPR gRNA sequence
cagatattggccccataatt

SEQ ID NO: 501925 - DNA, 20 bp, Artificial
  CRISPR gRNA sequence
gccccataatttttcactgc

SEQ ID NO: 501926 - DNA, 20 bp, Artificial
  CRISPR gRNA sequence
ttcactgctttataaactct

SEQ ID NO: 501927 - DNA, 20 bp, Artificial
  CRISPR gRNA sequence
tcactgctttataaactctc

SEQ ID NO: 501928 - DNA, 20 bp, Artificial
  CRISPR gRNA sequence
cactgctttataaactctct

SEQ ID NO: 501929 - DNA, 20 bp, Artificial
  CRISPR gRNA sequence
actgctttataaactctctg

SEQ ID NO: 501930 - DNA, 20 bp, Artificial
  CRISPR gRNA sequence
ctttataaactctctgataa

SEQ ID NO: 501931 - DNA, 20 bp, Artificial
  CRISPR gRNA sequence
tataaactctctgataactt

SEQ ID NO: 501932 - DNA, 20 bp, Artificial
  CRISPR gRNA sequence
ataaactctctgataacttt

SEQ ID NO: 501933 - DNA, 20 bp, Artificial
  CRISPR gRNA sequence
taaactctctgataacttta

SEQ ID NO: 501934 - DNA, 20 bp, Artificial
  CRISPR gRNA sequence
tctgataactttaacaatgt

SEQ ID NO: 501935 - DNA, 20 bp, Artificial
  CRISPR gRNA sequence
tgataactttaacaatgtgc

SEQ ID NO: 501936 - DNA, 20 bp, Artificial
  CRISPR gRNA sequence
ataactttaacaatgtgctt

SEQ ID NO: 501937 - DNA, 20 bp, Artificial
  CRISPR gRNA sequence
taacaatgtgcttttacatg

SEQ ID NO: 501938 - DNA, 20 bp, Artificial
  CRISPR gRNA sequence
aacaatgtgcttttacatgt

SEQ ID NO: 501939 - DNA, 20 bp, Artificial
  CRISPR gRNA sequence
acaatgtgcttttacatgtt

SEQ ID NO: 501940 - DNA, 20 bp, Artificial
  CRISPR gRNA sequence
ttacatgttgttcatttttc

SEQ ID NO: 501941 - DNA, 20 bp, Artificial
  CRISPR gRNA sequence
tacatgttgttcatttttct

SEQ ID NO: 501942 - DNA, 20 bp, Artificial
  CRISPR gRNA sequence
acatgttgttcatttttctt

SEQ ID NO: 501943 - DNA, 20 bp, Artificial
  CRISPR gRNA sequence
catgttgttcatttttcttc

SEQ ID NO: 501944 - DNA, 20 bp, Artificial
  CRISPR gRNA sequence
ttcatttttcttctagctat

SEQ ID NO: 501945 - DNA, 20 bp, Artificial
  CRISPR gRNA sequence
atttttcttctagctatttt

SEQ ID NO: 501946 - DNA, 20 bp, Artificial
  CRISPR gRNA sequence
ttcttctagctatttttagt

SEQ ID NO: 501947 - DNA, 20 bp, Artificial
  CRISPR gRNA sequence
tcttctagctatttttagtg

SEQ ID NO: 501948 - DNA, 20 bp, Artificial
  CRISPR gRNA sequence
cttctagctatttttagtgg

SEQ ID NO: 501949 - DNA, 20 bp, Artificial
  CRISPR gRNA sequence
ttctagctatttttagtggg

SEQ ID NO: 501950 - DNA, 20 bp, Artificial
  CRISPR gRNA sequence
ctagctatttttagtgggag

SEQ ID NO: 501951 - DNA, 20 bp, Artificial
  CRISPR gRNA sequence
tagctatttttagtgggagg

SEQ ID NO: 501952 - DNA, 20 bp, Artificial
  CRISPR gRNA sequence
gctatttttagtgggaggat

SEQ ID NO: 501953 - DNA, 20 bp, Artificial
  CRISPR gRNA sequence
tttttagtgggaggattggt

SEQ ID NO: 501954 - DNA, 20 bp, Artificial
  CRISPR gRNA sequence
ttagtgggaggattggttag

SEQ ID NO: 501955 - DNA, 20 bp, Artificial
  CRISPR gRNA sequence
tagtgggaggattggttagc

SEQ ID NO: 501956 - DNA, 20 bp, Artificial
  CRISPR gRNA sequence
agtgggaggattggttagca

SEQ ID NO: 501957 - DNA, 20 bp, Artificial
  CRISPR gRNA sequence
gtgggaggattggttagcat

SEQ ID NO: 501958 - DNA, 20 bp, Artificial
  CRISPR gRNA sequence
gttagcatgtcttaacctgg

SEQ ID NO: 501959 - DNA, 20 bp, Artificial
  CRISPR gRNA sequence
gcatgtcttaacctggattt

SEQ ID NO: 501960 - DNA, 20 bp, Artificial
  CRISPR gRNA sequence
aacctggattttcattacat

SEQ ID NO: 501961 - DNA, 20 bp, Artificial
  CRISPR gRNA sequence
acctggattttcattacata

SEQ ID NO: 501962 - DNA, 20 bp, Artificial
  CRISPR gRNA sequence
gattttcattacataattag

SEQ ID NO: 501963 - DNA, 20 bp, Artificial
  CRISPR gRNA sequence
tcattacataattagaattc

SEQ ID NO: 501964 - DNA, 20 bp, Artificial
  CRISPR gRNA sequence
cattacataattagaattcc

SEQ ID NO: 501965 - DNA, 20 bp, Artificial
  CRISPR gRNA sequence
attacataattagaattcct

SEQ ID NO: 501966 - DNA, 20 bp, Artificial
  CRISPR gRNA sequence
cataattagaattccttcga

SEQ ID NO: 501967 - DNA, 20 bp, Artificial
  CRISPR gRNA sequence
gaattccttcgatgattttt

SEQ ID NO: 501968 - DNA, 20 bp, Artificial
  CRISPR gRNA sequence
cttcgatgattttttatctc

SEQ ID NO: 501969 - DNA, 20 bp, Artificial
  CRISPR gRNA sequence
cgatgattttttatctcaac

SEQ ID NO: 501970 - DNA, 20 bp, Artificial
  CRISPR gRNA sequence
gatgattttttatctcaaca

SEQ ID NO: 501971 - DNA, 20 bp, Artificial
  CRISPR gRNA sequence
tttatctcaacaattaaggg

SEQ ID NO: 501972 - DNA, 20 bp, Artificial
  CRISPR gRNA sequence
ttatctcaacaattaagggg

SEQ ID NO: 501973 - DNA, 20 bp, Artificial
  CRISPR gRNA sequence
tatctcaacaattaagggga

SEQ ID NO: 501974 - DNA, 20 bp, Artificial
  CRISPR gRNA sequence
atctcaacaattaaggggat

SEQ ID NO: 501975 - DNA, 20 bp, Artificial
  CRISPR gRNA sequence
tctcaacaattaaggggatg

SEQ ID NO: 501976 - DNA, 20 bp, Artificial
  CRISPR gRNA sequence
aacaattaaggggatgctgt

SEQ ID NO: 501977 - DNA, 20 bp, Artificial
  CRISPR gRNA sequence
aggggatgctgtagaatgaa

SEQ ID NO: 501978 - DNA, 20 bp, Artificial
  CRISPR gRNA sequence
tagaatgaaagtgttctgtt

SEQ ID NO: 501979 - DNA, 20 bp, Artificial
  CRISPR gRNA sequence
tgtttccagatcacaaactc

SEQ ID NO: 501980 - DNA, 20 bp, Artificial
  CRISPR gRNA sequence
tttccagatcacaaactctc

SEQ ID NO: 501981 - DNA, 20 bp, Artificial
  CRISPR gRNA sequence
ccagatcacaaactctctgg

SEQ ID NO: 501982 - DNA, 20 bp, Artificial
  CRISPR gRNA sequence
cagatcacaaactctctgga

SEQ ID NO: 501983 - DNA, 20 bp, Artificial
  CRISPR gRNA sequence
tctggagtcaggaatcatgc

SEQ ID NO: 501984 - DNA, 20 bp, Artificial
  CRISPR gRNA sequence
tggagtcaggaatcatgcct

SEQ ID NO: 501985 - DNA, 20 bp, Artificial
  CRISPR gRNA sequence
gagtcaggaatcatgcctta

SEQ ID NO: 501986 - DNA, 20 bp, Artificial
  CRISPR gRNA sequence
atacatgaagaggccctgcc

SEQ ID NO: 501987 - DNA, 20 bp, Artificial
  CRISPR gRNA sequence
tacatgaagaggccctgcct

SEQ ID NO: 501988 - DNA, 20 bp, Artificial
  CRISPR gRNA sequence
cctcttcaggggctggattg

SEQ ID NO: 501989 - DNA, 20 bp, Artificial
  CRISPR gRNA sequence
ttcaggggctggattgcagt

SEQ ID NO: 501990 - DNA, 20 bp, Artificial
  CRISPR gRNA sequence
caggggctggattgcagtgg

SEQ ID NO: 501991 - DNA, 20 bp, Artificial
  CRISPR gRNA sequence
aggggctggattgcagtggg

SEQ ID NO: 501992 - DNA, 20 bp, Artificial
  CRISPR gRNA sequence
gattgcagtgggactcagta

SEQ ID NO: 501993 - DNA, 20 bp, Artificial
  CRISPR gRNA sequence
cagtgggactcagtaaggac

SEQ ID NO: 501994 - DNA, 20 bp, Artificial
  CRISPR gRNA sequence
agtaaggactgaataattga

SEQ ID NO: 501995 - DNA, 20 bp, Artificial
  CRISPR gRNA sequence
aataattgatgaagacagta

SEQ ID NO: 501996 - DNA, 20 bp, Artificial
  CRISPR gRNA sequence
atgaagacagtatatgtcct

SEQ ID NO: 501997 - DNA, 20 bp, Artificial
  CRISPR gRNA sequence
cttgtaggtttagtaatgat

SEQ ID NO: 501998 - DNA, 20 bp, Artificial
  CRISPR gRNA sequence
gtaggtttagtaatgatttt

SEQ ID NO: 501999 - DNA, 20 bp, Artificial
  CRISPR gRNA sequence
taggtttagtaatgattttt

SEQ ID NO: 502000 - DNA, 20 bp, Artificial
  CRISPR gRNA sequence
agtaatgattttttccattc

SEQ ID NO: 502001 - DNA, 20 bp, Artificial
  CRISPR gRNA sequence
gtaatgattttttccattca

SEQ ID NO: 502002 - DNA, 20 bp, Artificial
  CRISPR gRNA sequence
tttccattcacctttgttct

SEQ ID NO: 502003 - DNA, 20 bp, Artificial
  CRISPR gRNA sequence
ttccattcacctttgttctc

SEQ ID NO: 502004 - DNA, 20 bp, Artificial
  CRISPR gRNA sequence
tccattcacctttgttctca

SEQ ID NO: 502005 - DNA, 20 bp, Artificial
  CRISPR gRNA sequence
ccattcacctttgttctcag

SEQ ID NO: 502006 - DNA, 20 bp, Artificial
  CRISPR gRNA sequence
cattcacctttgttctcagg

SEQ ID NO: 502007 - DNA, 20 bp, Artificial
  CRISPR gRNA sequence
acctttgttctcagggtctt

SEQ ID NO: 502008 - DNA, 20 bp, Artificial
  CRISPR gRNA sequence
tgttctcagggtctttgtgc

SEQ ID NO: 502009 - DNA, 20 bp, Artificial
  CRISPR gRNA sequence
gttctcagggtctttgtgca

SEQ ID NO: 502010 - DNA, 20 bp, Artificial
  CRISPR gRNA sequence
ttctcagggtctttgtgcaa

SEQ ID NO: 502011 - DNA, 20 bp, Artificial
  CRISPR gRNA sequence
tcagggtctttgtgcaatat

SEQ ID NO: 502012 - DNA, 20 bp, Artificial
  CRISPR gRNA sequence
agggtctttgtgcaatattt

SEQ ID NO: 502013 - DNA, 20 bp, Artificial
  CRISPR gRNA sequence
tgtgcaatatttggtaggtt

SEQ ID NO: 502014 - DNA, 20 bp, Artificial
  CRISPR gRNA sequence
gtgcaatatttggtaggttg

SEQ ID NO: 502015 - DNA, 20 bp, Artificial
  CRISPR gRNA sequence
tgcaatatttggtaggttga

SEQ ID NO: 502016 - DNA, 20 bp, Artificial
  CRISPR gRNA sequence
ggtaggttgacttgttctta

SEQ ID NO: 502017 - DNA, 20 bp, Artificial
  CRISPR gRNA sequence
gtaggttgacttgttcttat

SEQ ID NO: 502018 - DNA, 20 bp, Artificial
  CRISPR gRNA sequence
acttgttcttataaatagtg

SEQ ID NO: 502019 - DNA, 20 bp, Artificial
  CRISPR gRNA sequence
gttcttataaatagtgctag

SEQ ID NO: 502020 - DNA, 20 bp, Artificial
  CRISPR gRNA sequence
ttcttataaatagtgctagg

SEQ ID NO: 502021 - DNA, 20 bp, Artificial
  CRISPR gRNA sequence
ttataaatagtgctaggatc

SEQ ID NO: 502022 - DNA, 20 bp, Artificial
  CRISPR gRNA sequence
ataaatagtgctaggatcgt

SEQ ID NO: 502023 - DNA, 20 bp, Artificial
  CRISPR gRNA sequence
taaatagtgctaggatcgta

SEQ ID NO: 502024 - DNA, 20 bp, Artificial
  CRISPR gRNA sequence
ggatcgtaggagacagagac

SEQ ID NO: 502025 - DNA, 20 bp, Artificial
  CRISPR gRNA sequence
tgcttttgagaagcttttgg

SEQ ID NO: 502026 - DNA, 20 bp, Artificial
  CRISPR gRNA sequence
cttttgagaagcttttggtt

SEQ ID NO: 502027 - DNA, 20 bp, Artificial
  CRISPR gRNA sequence
ttgagaagcttttggtttgc

SEQ ID NO: 502028 - DNA, 20 bp, Artificial
  CRISPR gRNA sequence
tgagaagcttttggtttgct

SEQ ID NO: 502029 - DNA, 20 bp, Artificial
  CRISPR gRNA sequence
gagaagcttttggtttgcta

SEQ ID NO: 502030 - DNA, 20 bp, Artificial
  CRISPR gRNA sequence
agaagcttttggtttgctaa

SEQ ID NO: 502031 - DNA, 20 bp, Artificial
  CRISPR gRNA sequence
ttggtttgctaatgggcaga

SEQ ID NO: 502032 - DNA, 20 bp, Artificial
  CRISPR gRNA sequence
tggtttgctaatgggcagag

SEQ ID NO: 502033 - DNA, 20 bp, Artificial
  CRISPR gRNA sequence
ggtttgctaatgggcagagc

SEQ ID NO: 502034 - DNA, 20 bp, Artificial
  CRISPR gRNA sequence
gtttgctaatgggcagagcc

SEQ ID NO: 502035 - DNA, 20 bp, Artificial
  CRISPR gRNA sequence
gctaatgggcagagccagta

SEQ ID NO: 502036 - DNA, 20 bp, Artificial
  CRISPR gRNA sequence
ctaatgggcagagccagtac

SEQ ID NO: 502037 - DNA, 20 bp, Artificial
  CRISPR gRNA sequence
atgggcagagccagtacaag

SEQ ID NO: 502038 - DNA, 20 bp, Artificial
  CRISPR gRNA sequence
tgtgttttagtcttaggagc

SEQ ID NO: 502039 - DNA, 20 bp, Artificial
  CRISPR gRNA sequence
tagtcttaggagcatcaaga

SEQ ID NO: 502040 - DNA, 20 bp, Artificial
  CRISPR gRNA sequence
agtcttaggagcatcaagat

SEQ ID NO: 502041 - DNA, 20 bp, Artificial
  CRISPR gRNA sequence
gtcttaggagcatcaagatc

SEQ ID NO: 502042 - DNA, 20 bp, Artificial
  CRISPR gRNA sequence
aggagcatcaagatcaaaga

SEQ ID NO: 502043 - DNA, 20 bp, Artificial
  CRISPR gRNA sequence
ggagcatcaagatcaaagaa

SEQ ID NO: 502044 - DNA, 20 bp, Artificial
  CRISPR gRNA sequence
catcaaacaaatagtattac

SEQ ID NO: 502045 - DNA, 20 bp, Artificial
  CRISPR gRNA sequence
atcaaacaaatagtattaca

SEQ ID NO: 502046 - DNA, 20 bp, Artificial
  CRISPR gRNA sequence
caagtcctttaattatttac

SEQ ID NO: 502047 - DNA, 20 bp, Artificial
  CRISPR gRNA sequence
taattatttacttagtctct

SEQ ID NO: 502048 - DNA, 20 bp, Artificial
  CRISPR gRNA sequence
aattatttacttagtctctt

SEQ ID NO: 502049 - DNA, 20 bp, Artificial
  CRISPR gRNA sequence
attatttacttagtctcttg

SEQ ID NO: 502050 - DNA, 20 bp, Artificial
  CRISPR gRNA sequence
tttacttagtctcttgagaa

SEQ ID NO: 502051 - DNA, 20 bp, Artificial
  CRISPR gRNA sequence
acttagtctcttgagaaaat

SEQ ID NO: 502052 - DNA, 20 bp, Artificial
  CRISPR gRNA sequence
cttagtctcttgagaaaatg

SEQ ID NO: 502053 - DNA, 20 bp, Artificial
  CRISPR gRNA sequence
agtctcttgagaaaatgcca

SEQ ID NO: 502054 - DNA, 20 bp, Artificial
  CRISPR gRNA sequence
gtctcttgagaaaatgccag

SEQ ID NO: 502055 - DNA, 20 bp, Artificial
  CRISPR gRNA sequence
ttgagaaaatgccagggtga

SEQ ID NO: 502056 - DNA, 20 bp, Artificial
  CRISPR gRNA sequence
gagaaaatgccagggtgaag

SEQ ID NO: 502057 - DNA, 20 bp, Artificial
  CRISPR gRNA sequence
agaaaatgccagggtgaagc

SEQ ID NO: 502058 - DNA, 20 bp, Artificial
  CRISPR gRNA sequence
tggcttggagagactgcatt

SEQ ID NO: 502059 - DNA, 20 bp, Artificial
  CRISPR gRNA sequence
ggagagactgcattcataat

SEQ ID NO: 502060 - DNA, 20 bp, Artificial
  CRISPR gRNA sequence
gagagactgcattcataatg

SEQ ID NO: 502061 - DNA, 20 bp, Artificial
  CRISPR gRNA sequence
cattcataatgcactggaca

SEQ ID NO: 502062 - DNA, 20 bp, Artificial
  CRISPR gRNA sequence
ataatgcactggacatataa

SEQ ID NO: 502063 - DNA, 20 bp, Artificial
  CRISPR gRNA sequence
gacatataaaaacccctctg

SEQ ID NO: 502064 - DNA, 20 bp, Artificial
  CRISPR gRNA sequence
tgtctcaattgctctcttct

SEQ ID NO: 502065 - DNA, 20 bp, Artificial
  CRISPR gRNA sequence
tctcaattgctctcttctta

SEQ ID NO: 502066 - DNA, 20 bp, Artificial
  CRISPR gRNA sequence
aattgctctcttcttaatag

SEQ ID NO: 502067 - DNA, 20 bp, Artificial
  CRISPR gRNA sequence
ctctcttcttaatagcctcc

SEQ ID NO: 502068 - DNA, 20 bp, Artificial
  CRISPR gRNA sequence
tcttcttaatagcctccatt

SEQ ID NO: 502069 - DNA, 20 bp, Artificial
  CRISPR gRNA sequence
ttcttaatagcctccatttt

SEQ ID NO: 502070 - DNA, 20 bp, Artificial
  CRISPR gRNA sequence
cttaatagcctccattttaa

SEQ ID NO: 502071 - DNA, 20 bp, Artificial
  CRISPR gRNA sequence
ttaatagcctccattttaac

SEQ ID NO: 502072 - DNA, 20 bp, Artificial
  CRISPR gRNA sequence
aatagcctccattttaacgg

SEQ ID NO: 502073 - DNA, 20 bp, Artificial
  CRISPR gRNA sequence
atagcctccattttaacgga

SEQ ID NO: 502074 - DNA, 20 bp, Artificial
  CRISPR gRNA sequence
cattttaacggagccacttg

SEQ ID NO: 502075 - DNA, 20 bp, Artificial
  CRISPR gRNA sequence
taacggagccacttgtaaaa

SEQ ID NO: 502076 - DNA, 20 bp, Artificial
  CRISPR gRNA sequence
aacggagccacttgtaaaac

SEQ ID NO: 502077 - DNA, 20 bp, Artificial
  CRISPR gRNA sequence
acggagccacttgtaaaact

SEQ ID NO: 502078 - DNA, 20 bp, Artificial
  CRISPR gRNA sequence
gtaaaactctccccatctct

SEQ ID NO: 502079 - DNA, 20 bp, Artificial
  CRISPR gRNA sequence
taaaactctccccatctctt

SEQ ID NO: 502080 - DNA, 20 bp, Artificial
  CRISPR gRNA sequence
tccccatctcttattttctc

SEQ ID NO: 502081 - DNA, 20 bp, Artificial
  CRISPR gRNA sequence
cccatctcttattttctctt

SEQ ID NO: 502082 - DNA, 20 bp, Artificial
  CRISPR gRNA sequence
ttattttctcttccaaatcc

SEQ ID NO: 502083 - DNA, 20 bp, Artificial
  CRISPR gRNA sequence
attttctcttccaaatcctc

SEQ ID NO: 502084 - DNA, 20 bp, Artificial
  CRISPR gRNA sequence
ttttctcttccaaatcctcc

SEQ ID NO: 502085 - DNA, 20 bp, Artificial
  CRISPR gRNA sequence
tctcttccaaatcctccctg

SEQ ID NO: 502086 - DNA, 20 bp, Artificial
  CRISPR gRNA sequence
ctcttccaaatcctccctga

SEQ ID NO: 502087 - DNA, 20 bp, Artificial
  CRISPR gRNA sequence
tcttccaaatcctccctgag

SEQ ID NO: 502088 - DNA, 20 bp, Artificial
  CRISPR gRNA sequence
ttccaaatcctccctgagcc

SEQ ID NO: 502089 - DNA, 20 bp, Artificial
  CRISPR gRNA sequence
ccaaatcctccctgagcctc

SEQ ID NO: 502090 - DNA, 20 bp, Artificial
  CRISPR gRNA sequence
caaatcctccctgagcctcc

SEQ ID NO: 502091 - DNA, 20 bp, Artificial
  CRISPR gRNA sequence
cctgagcctccccaactcac

SEQ ID NO: 502092 - DNA, 20 bp, Artificial
  CRISPR gRNA sequence
agcctccccaactcacccag

SEQ ID NO: 502093 - DNA, 20 bp, Artificial
  CRISPR gRNA sequence
cccaactcacccagagagac

SEQ ID NO: 502094 - DNA, 20 bp, Artificial
  CRISPR gRNA sequence
acccagagagactttttaat

SEQ ID NO: 502095 - DNA, 20 bp, Artificial
  CRISPR gRNA sequence
tttaatttcctgcacctgct

SEQ ID NO: 502096 - DNA, 20 bp, Artificial
  CRISPR gRNA sequence
ttaatttcctgcacctgctg

SEQ ID NO: 502097 - DNA, 20 bp, Artificial
  CRISPR gRNA sequence
taatttcctgcacctgctgg

SEQ ID NO: 502098 - DNA, 20 bp, Artificial
  CRISPR gRNA sequence
aatttcctgcacctgctggg

SEQ ID NO: 502099 - DNA, 20 bp, Artificial
  CRISPR gRNA sequence
atttcctgcacctgctgggc

SEQ ID NO: 502100 - DNA, 20 bp, Artificial
  CRISPR gRNA sequence
cctgcacctgctgggccatg

SEQ ID NO: 502101 - DNA, 20 bp, Artificial
  CRISPR gRNA sequence
ctgcacctgctgggccatgc

SEQ ID NO: 502102 - DNA, 20 bp, Artificial
  CRISPR gRNA sequence
cacctgctgggccatgccac

SEQ ID NO: 502103 - DNA, 20 bp, Artificial
  CRISPR gRNA sequence
ctgggccatgccacatagct

SEQ ID NO: 502104 - DNA, 20 bp, Artificial
  CRISPR gRNA sequence
ggccatgccacatagcttta

SEQ ID NO: 502105 - DNA, 20 bp, Artificial
  CRISPR gRNA sequence
tattactaaaaatggctgta

SEQ ID NO: 502106 - DNA, 20 bp, Artificial
  CRISPR gRNA sequence
attactaaaaatggctgtag

SEQ ID NO: 502107 - DNA, 20 bp, Artificial
  CRISPR gRNA sequence
ttactaaaaatggctgtagg

SEQ ID NO: 502108 - DNA, 20 bp, Artificial
  CRISPR gRNA sequence
ctaaaaatggctgtaggaac

SEQ ID NO: 502109 - DNA, 20 bp, Artificial
  CRISPR gRNA sequence
aaaatggctgtaggaacttc

SEQ ID NO: 502110 - DNA, 20 bp, Artificial
  CRISPR gRNA sequence
taggaacttccagttttgta

SEQ ID NO: 502111 - DNA, 20 bp, Artificial
  CRISPR gRNA sequence
ccagttttgtacactgactg

SEQ ID NO: 502112 - DNA, 20 bp, Artificial
  CRISPR gRNA sequence
cagttttgtacactgactgc

SEQ ID NO: 502113 - DNA, 20 bp, Artificial
  CRISPR gRNA sequence
tgtacactgactgcacagaa

SEQ ID NO: 502114 - DNA, 20 bp, Artificial
  CRISPR gRNA sequence
gtacactgactgcacagaat

SEQ ID NO: 502115 - DNA, 20 bp, Artificial
  CRISPR gRNA sequence
tacactgactgcacagaatt

SEQ ID NO: 502116 - DNA, 20 bp, Artificial
  CRISPR gRNA sequence
actgcacagaattgctctag

SEQ ID NO: 502117 - DNA, 20 bp, Artificial
  CRISPR gRNA sequence
cacagaattgctctaggttg

SEQ ID NO: 502118 - DNA, 20 bp, Artificial
  CRISPR gRNA sequence
ctctaggttgtcacaccccc

SEQ ID NO: 502119 - DNA, 20 bp, Artificial
  CRISPR gRNA sequence
taggttgtcacacccccata

SEQ ID NO: 502120 - DNA, 20 bp, Artificial
  CRISPR gRNA sequence
ggttgtcacacccccatatt

SEQ ID NO: 502121 - DNA, 20 bp, Artificial
  CRISPR gRNA sequence
tcacacccccatattcatta

SEQ ID NO: 502122 - DNA, 20 bp, Artificial
  CRISPR gRNA sequence
attaggtttcatcttgattc

SEQ ID NO: 502123 - DNA, 20 bp, Artificial
  CRISPR gRNA sequence
ggtttcatcttgattctttg

SEQ ID NO: 502124 - DNA, 20 bp, Artificial
  CRISPR gRNA sequence
catcttgattctttgagagg

SEQ ID NO: 502125 - DNA, 20 bp, Artificial
  CRISPR gRNA sequence
atcttgattctttgagaggc

SEQ ID NO: 502126 - DNA, 20 bp, Artificial
  CRISPR gRNA sequence
gattctttgagaggcaagtg

SEQ ID NO: 502127 - DNA, 20 bp, Artificial
  CRISPR gRNA sequence
attctttgagaggcaagtgc

SEQ ID NO: 502128 - DNA, 20 bp, Artificial
  CRISPR gRNA sequence
tttgagaggcaagtgctggg

SEQ ID NO: 502129 - DNA, 20 bp, Artificial
  CRISPR gRNA sequence
tgagaggcaagtgctgggat

SEQ ID NO: 502130 - DNA, 20 bp, Artificial
  CRISPR gRNA sequence
gagaggcaagtgctgggatc

SEQ ID NO: 502131 - DNA, 20 bp, Artificial
  CRISPR gRNA sequence
agaggcaagtgctgggatct

SEQ ID NO: 502132 - DNA, 20 bp, Artificial
  CRISPR gRNA sequence
ggatctgcctgggaagtgta

SEQ ID NO: 502133 - DNA, 20 bp, Artificial
  CRISPR gRNA sequence
cctgggaagtgtagttttat

SEQ ID NO: 502134 - DNA, 20 bp, Artificial
  CRISPR gRNA sequence
ggaagtgtagttttattttt

SEQ ID NO: 502135 - DNA, 20 bp, Artificial
  CRISPR gRNA sequence
tatttttaaaattgttttct

SEQ ID NO: 502136 - DNA, 20 bp, Artificial
  CRISPR gRNA sequence
atttttaaaattgttttcta

SEQ ID NO: 502137 - DNA, 20 bp, Artificial
  CRISPR gRNA sequence
tttttaaaattgttttctag

SEQ ID NO: 502138 - DNA, 20 bp, Artificial
  CRISPR gRNA sequence
ttaaaattgttttctaggga

SEQ ID NO: 502139 - DNA, 20 bp, Artificial
  CRISPR gRNA sequence
taaaattgttttctagggag

SEQ ID NO: 502140 - DNA, 20 bp, Artificial
  CRISPR gRNA sequence
aaaattgttttctagggaga

SEQ ID NO: 502141 - DNA, 20 bp, Artificial
  CRISPR gRNA sequence
aaattgttttctagggagaa

SEQ ID NO: 502142 - DNA, 20 bp, Artificial
  CRISPR gRNA sequence
ttttctagggagaaattttt

SEQ ID NO: 502143 - DNA, 20 bp, Artificial
  CRISPR gRNA sequence
tctagggagaaatttttgtg

SEQ ID NO: 502144 - DNA, 20 bp, Artificial
  CRISPR gRNA sequence
ctagggagaaatttttgtgg

SEQ ID NO: 502145 - DNA, 20 bp, Artificial
  CRISPR gRNA sequence
tagggagaaatttttgtgga

SEQ ID NO: 502146 - DNA, 20 bp, Artificial
  CRISPR gRNA sequence
gggagaaatttttgtggaga

SEQ ID NO: 502147 - DNA, 20 bp, Artificial
  CRISPR gRNA sequence
ttgtggagactttctgatca

SEQ ID NO: 502148 - DNA, 20 bp, Artificial
  CRISPR gRNA sequence
tgtggagactttctgatcac

SEQ ID NO: 502149 - DNA, 20 bp, Artificial
  CRISPR gRNA sequence
gtggagactttctgatcact

SEQ ID NO: 502150 - DNA, 20 bp, Artificial
  CRISPR gRNA sequence
tggagactttctgatcactg

SEQ ID NO: 502151 - DNA, 20 bp, Artificial
  CRISPR gRNA sequence
tctgatcactgaaaaactgg

SEQ ID NO: 502152 - DNA, 20 bp, Artificial
  CRISPR gRNA sequence
ctgatcactgaaaaactggc

SEQ ID NO: 502153 - DNA, 20 bp, Artificial
  CRISPR gRNA sequence
tgatcactgaaaaactggca

SEQ ID NO: 502154 - DNA, 20 bp, Artificial
  CRISPR gRNA sequence
atcactgaaaaactggcaaa

SEQ ID NO: 502155 - DNA, 20 bp, Artificial
  CRISPR gRNA sequence
aaaaactggcaaacatcaat

SEQ ID NO: 502156 - DNA, 20 bp, Artificial
  CRISPR gRNA sequence
gcaaacatcaataagtaatg

SEQ ID NO: 502157 - DNA, 20 bp, Artificial
  CRISPR gRNA sequence
tgtattcagctctgtgagag

SEQ ID NO: 502158 - DNA, 20 bp, Artificial
  CRISPR gRNA sequence
agctctgtgagaggatggtt

SEQ ID NO: 502159 - DNA, 20 bp, Artificial
  CRISPR gRNA sequence
tgtgagaggatggttgaggg

SEQ ID NO: 502160 - DNA, 20 bp, Artificial
  CRISPR gRNA sequence
tgagaggatggttgaggggc

SEQ ID NO: 502161 - DNA, 20 bp, Artificial
  CRISPR gRNA sequence
aggggccatgagttcagctt

SEQ ID NO: 502162 - DNA, 20 bp, Artificial
  CRISPR gRNA sequence
agcttggacggttagtcttc

SEQ ID NO: 502163 - DNA, 20 bp, Artificial
  CRISPR gRNA sequence
ggacggttagtcttcctggg

SEQ ID NO: 502164 - DNA, 20 bp, Artificial
  CRISPR gRNA sequence
gacggttagtcttcctgggc

SEQ ID NO: 502165 - DNA, 20 bp, Artificial
  CRISPR gRNA sequence
gtcttcctgggcctgaccat

SEQ ID NO: 502166 - DNA, 20 bp, Artificial
  CRISPR gRNA sequence
cctgggcctgaccattcaga

SEQ ID NO: 502167 - DNA, 20 bp, Artificial
  CRISPR gRNA sequence
ctgggcctgaccattcagaa

SEQ ID NO: 502168 - DNA, 20 bp, Artificial
  CRISPR gRNA sequence
ggcctgaccattcagaattt

SEQ ID NO: 502169 - DNA, 20 bp, Artificial
  CRISPR gRNA sequence
accattcagaatttccaaca

SEQ ID NO: 502170 - DNA, 20 bp, Artificial
  CRISPR gRNA sequence
agaatttccaacagtcacta

SEQ ID NO: 502171 - DNA, 20 bp, Artificial
  CRISPR gRNA sequence
ccaacagtcactacttgcca

SEQ ID NO: 502172 - DNA, 20 bp, Artificial
  CRISPR gRNA sequence
caacagtcactacttgccat

SEQ ID NO: 502173 - DNA, 20 bp, Artificial
  CRISPR gRNA sequence
cttgccattagtagttgcct

SEQ ID NO: 502174 - DNA, 20 bp, Artificial
  CRISPR gRNA sequence
gccattagtagttgcctcag

SEQ ID NO: 502175 - DNA, 20 bp, Artificial
  CRISPR gRNA sequence
ccattagtagttgcctcagc

SEQ ID NO: 502176 - DNA, 20 bp, Artificial
  CRISPR gRNA sequence
gtagttgcctcagcactgct

SEQ ID NO: 502177 - DNA, 20 bp, Artificial
  CRISPR gRNA sequence
cctcagcactgcttggaggg

SEQ ID NO: 502178 - DNA, 20 bp, Artificial
  CRISPR gRNA sequence
agcactgcttggagggagtc

SEQ ID NO: 502179 - DNA, 20 bp, Artificial
  CRISPR gRNA sequence
cttggagggagtcaccttag

SEQ ID NO: 502180 - DNA, 20 bp, Artificial
  CRISPR gRNA sequence
ggagggagtcaccttagatg

SEQ ID NO: 502181 - DNA, 20 bp, Artificial
  CRISPR gRNA sequence
gagggagtcaccttagatgt

SEQ ID NO: 502182 - DNA, 20 bp, Artificial
  CRISPR gRNA sequence
agatgtggtatttatagcat

SEQ ID NO: 502183 - DNA, 20 bp, Artificial
  CRISPR gRNA sequence
gatgtggtatttatagcatc

SEQ ID NO: 502184 - DNA, 20 bp, Artificial
  CRISPR gRNA sequence
atagcatcatggttaagaat

SEQ ID NO: 502185 - DNA, 20 bp, Artificial
  CRISPR gRNA sequence
tagcatcatggttaagaatt

SEQ ID NO: 502186 - DNA, 20 bp, Artificial
  CRISPR gRNA sequence
agaatttatcctctcaagcc

SEQ ID NO: 502187 - DNA, 20 bp, Artificial
  CRISPR gRNA sequence
atcctctcaagccaaactgc

SEQ ID NO: 502188 - DNA, 20 bp, Artificial
  CRISPR gRNA sequence
tcctctcaagccaaactgct

SEQ ID NO: 502189 - DNA, 20 bp, Artificial
  CRISPR gRNA sequence
tcaagccaaactgctgtctt

SEQ ID NO: 502190 - DNA, 20 bp, Artificial
  CRISPR gRNA sequence
aagccaaactgctgtcttta

SEQ ID NO: 502191 - DNA, 20 bp, Artificial
  CRISPR gRNA sequence
ctgtctttacaaagagtaaa

SEQ ID NO: 502192 - DNA, 20 bp, Artificial
  CRISPR gRNA sequence
tctttacaaagagtaaacaa

SEQ ID NO: 502193 - DNA, 20 bp, Artificial
  CRISPR gRNA sequence
tacaaagagtaaacaaataa

SEQ ID NO: 502194 - DNA, 20 bp, Artificial
  CRISPR gRNA sequence
acaaagagtaaacaaataag

SEQ ID NO: 502195 - DNA, 20 bp, Artificial
  CRISPR gRNA sequence
caaagagtaaacaaataagc

SEQ ID NO: 502196 - DNA, 20 bp, Artificial
  CRISPR gRNA sequence
cctagcacctgtgctcccag

SEQ ID NO: 502197 - DNA, 20 bp, Artificial
  CRISPR gRNA sequence
gcacctgtgctcccagctac

SEQ ID NO: 502198 - DNA, 20 bp, Artificial
  CRISPR gRNA sequence
tgctcccagctactagggag

SEQ ID NO: 502199 - DNA, 20 bp, Artificial
  CRISPR gRNA sequence
ccagctactagggaggttga

SEQ ID NO: 502200 - DNA, 20 bp, Artificial
  CRISPR gRNA sequence
ctagggaggttgagatggga

SEQ ID NO: 502201 - DNA, 20 bp, Artificial
  CRISPR gRNA sequence
gggaggttgagatgggagga

SEQ ID NO: 502202 - DNA, 20 bp, Artificial
  CRISPR gRNA sequence
agatgggaggatcacctcaa

SEQ ID NO: 502203 - DNA, 20 bp, Artificial
  CRISPR gRNA sequence
aagcccaggagttcaaggct

SEQ ID NO: 502204 - DNA, 20 bp, Artificial
  CRISPR gRNA sequence
aaggctgcagtgagctgtga

SEQ ID NO: 502205 - DNA, 20 bp, Artificial
  CRISPR gRNA sequence
cagtgagctgtgattgcgcc

SEQ ID NO: 502206 - DNA, 20 bp, Artificial
  CRISPR gRNA sequence
tgattgcgccactgcactcc

SEQ ID NO: 502207 - DNA, 20 bp, Artificial
  CRISPR gRNA sequence
cgccactgcactccagcctg

SEQ ID NO: 502208 - DNA, 20 bp, Artificial
  CRISPR gRNA sequence
cactccagcctgggtgacag

SEQ ID NO: 502209 - DNA, 20 bp, Artificial
  CRISPR gRNA sequence
cagcctgggtgacagagtga

SEQ ID NO: 502210 - DNA, 20 bp, Artificial
  CRISPR gRNA sequence
ggtgacagagtgagaccctg

SEQ ID NO: 502211 - DNA, 20 bp, Artificial
  CRISPR gRNA sequence
tctctagaaaacaaaacaaa

SEQ ID NO: 502212 - DNA, 20 bp, Artificial
  CRISPR gRNA sequence
tagaaaacaaaacaaaagaa

SEQ ID NO: 502213 - DNA, 20 bp, Artificial
  CRISPR gRNA sequence
gaaaacaaaacaaaagaaaa

SEQ ID NO: 502214 - DNA, 20 bp, Artificial
  CRISPR gRNA sequence
actaggtttcaggctcatca

SEQ ID NO: 502215 - DNA, 20 bp, Artificial
  CRISPR gRNA sequence
ggtttcaggctcatcattct

SEQ ID NO: 502216 - DNA, 20 bp, Artificial
  CRISPR gRNA sequence
caggctcatcattcttttaa

SEQ ID NO: 502217 - DNA, 20 bp, Artificial
  CRISPR gRNA sequence
aggctcatcattcttttaac

SEQ ID NO: 502218 - DNA, 20 bp, Artificial
  CRISPR gRNA sequence
atcattcttttaactcatca

SEQ ID NO: 502219 - DNA, 20 bp, Artificial
  CRISPR gRNA sequence
ttttaactcatcataccttt

SEQ ID NO: 502220 - DNA, 20 bp, Artificial
  CRISPR gRNA sequence
ttaactcatcatacctttta

SEQ ID NO: 502221 - DNA, 20 bp, Artificial
  CRISPR gRNA sequence
taactcatcataccttttaa

SEQ ID NO: 502222 - DNA, 20 bp, Artificial
  CRISPR gRNA sequence
aactcatcataccttttaac

SEQ ID NO: 502223 - DNA, 20 bp, Artificial
  CRISPR gRNA sequence
actcatcataccttttaact

SEQ ID NO: 502224 - DNA, 20 bp, Artificial
  CRISPR gRNA sequence
atcataccttttaacttaaa

SEQ ID NO: 502225 - DNA, 20 bp, Artificial
  CRISPR gRNA sequence
ttaacttaaatagttaaaat

SEQ ID NO: 502226 - DNA, 20 bp, Artificial
  CRISPR gRNA sequence
taacttaaatagttaaaatg

SEQ ID NO: 502227 - DNA, 20 bp, Artificial
  CRISPR gRNA sequence
aacttaaatagttaaaatgt

SEQ ID NO: 502228 - DNA, 20 bp, Artificial
  CRISPR gRNA sequence
acttaaatagttaaaatgta

SEQ ID NO: 502229 - DNA, 20 bp, Artificial
  CRISPR gRNA sequence
aaatagttaaaatgtataaa

SEQ ID NO: 502230 - DNA, 20 bp, Artificial
  CRISPR gRNA sequence
aatagttaaaatgtataaag

SEQ ID NO: 502231 - DNA, 20 bp, Artificial
  CRISPR gRNA sequence
aaatgtataaagtgtgaaac

SEQ ID NO: 502232 - DNA, 20 bp, Artificial
  CRISPR gRNA sequence
cctgtcacatagtaagtact

SEQ ID NO: 502233 - DNA, 20 bp, Artificial
  CRISPR gRNA sequence
tcacatagtaagtactcaag

SEQ ID NO: 502234 - DNA, 20 bp, Artificial
  CRISPR gRNA sequence
aagattttagctattggtct

SEQ ID NO: 502235 - DNA, 20 bp, Artificial
  CRISPR gRNA sequence
tagctattggtctatgggat

SEQ ID NO: 502236 - DNA, 20 bp, Artificial
  CRISPR gRNA sequence
agctattggtctatgggatc

SEQ ID NO: 502237 - DNA, 20 bp, Artificial
  CRISPR gRNA sequence
gctattggtctatgggatcc

SEQ ID NO: 502238 - DNA, 20 bp, Artificial
  CRISPR gRNA sequence
ttggtctatgggatccctca

SEQ ID NO: 502239 - DNA, 20 bp, Artificial
  CRISPR gRNA sequence
gtctatgggatccctcagac

SEQ ID NO: 502240 - DNA, 20 bp, Artificial
  CRISPR gRNA sequence
tgggatccctcagactaggg

SEQ ID NO: 502241 - DNA, 20 bp, Artificial
  CRISPR gRNA sequence
agactagggacacagagctt

SEQ ID NO: 502242 - DNA, 20 bp, Artificial
  CRISPR gRNA sequence
gggacacagagcttggggac

SEQ ID NO: 502243 - DNA, 20 bp, Artificial
  CRISPR gRNA sequence
ggggacaaggggaggcagat

SEQ ID NO: 502244 - DNA, 20 bp, Artificial
  CRISPR gRNA sequence
gggacaaggggaggcagatg

SEQ ID NO: 502245 - DNA, 20 bp, Artificial
  CRISPR gRNA sequence
taaggtgctcctaggttctg

SEQ ID NO: 502246 - DNA, 20 bp, Artificial
  CRISPR gRNA sequence
aaggtgctcctaggttctgg

SEQ ID NO: 502247 - DNA, 20 bp, Artificial
  CRISPR gRNA sequence
aggtgctcctaggttctggg

SEQ ID NO: 502248 - DNA, 20 bp, Artificial
  CRISPR gRNA sequence
ctaggttctgggctcctcat

SEQ ID NO: 502249 - DNA, 20 bp, Artificial
  CRISPR gRNA sequence
ggttctgggctcctcatact

SEQ ID NO: 502250 - DNA, 20 bp, Artificial
  CRISPR gRNA sequence
tgggctcctcatactcatcc

SEQ ID NO: 502251 - DNA, 20 bp, Artificial
  CRISPR gRNA sequence
ggctcctcatactcatcccc

SEQ ID NO: 502252 - DNA, 20 bp, Artificial
  CRISPR gRNA sequence
ctcatactcatccccaccca

SEQ ID NO: 502253 - DNA, 20 bp, Artificial
  CRISPR gRNA sequence
atactcatccccacccaatt

SEQ ID NO: 502254 - DNA, 20 bp, Artificial
  CRISPR gRNA sequence
atccccacccaattggctta

SEQ ID NO: 502255 - DNA, 20 bp, Artificial
  CRISPR gRNA sequence
gcttaagggaagtcacatcc

SEQ ID NO: 502256 - DNA, 20 bp, Artificial
  CRISPR gRNA sequence
aagggaagtcacatccagct

SEQ ID NO: 502257 - DNA, 20 bp, Artificial
  CRISPR gRNA sequence
agggaagtcacatccagctg

SEQ ID NO: 502258 - DNA, 20 bp, Artificial
  CRISPR gRNA sequence
cccacattgctcaggcctga

SEQ ID NO: 502259 - DNA, 20 bp, Artificial
  CRISPR gRNA sequence
ctcaggcctgacactcttcc

SEQ ID NO: 502260 - DNA, 20 bp, Artificial
  CRISPR gRNA sequence
aggcctgacactcttcccgc

SEQ ID NO: 502261 - DNA, 20 bp, Artificial
  CRISPR gRNA sequence
acactcttcccgctactttc

SEQ ID NO: 502262 - DNA, 20 bp, Artificial
  CRISPR gRNA sequence
ttcccgctactttcagcttg

SEQ ID NO: 502263 - DNA, 20 bp, Artificial
  CRISPR gRNA sequence
cccgctactttcagcttggg

SEQ ID NO: 502264 - DNA, 20 bp, Artificial
  CRISPR gRNA sequence
ccgctactttcagcttgggt

SEQ ID NO: 502265 - DNA, 20 bp, Artificial
  CRISPR gRNA sequence
ctttcagcttgggttctctt

SEQ ID NO: 502266 - DNA, 20 bp, Artificial
  CRISPR gRNA sequence
tcagcttgggttctctttcc

SEQ ID NO: 502267 - DNA, 20 bp, Artificial
  CRISPR gRNA sequence
cagcttgggttctctttcct

SEQ ID NO: 502268 - DNA, 20 bp, Artificial
  CRISPR gRNA sequence
agcttgggttctctttccta

SEQ ID NO: 502269 - DNA, 20 bp, Artificial
  CRISPR gRNA sequence
gggttctctttcctaggatg

SEQ ID NO: 502270 - DNA, 20 bp, Artificial
  CRISPR gRNA sequence
ggttctctttcctaggatgc

SEQ ID NO: 502271 - DNA, 20 bp, Artificial
  CRISPR gRNA sequence
tctttcctaggatgccaggg

SEQ ID NO: 502272 - DNA, 20 bp, Artificial
  CRISPR gRNA sequence
tttcctaggatgccagggat

SEQ ID NO: 502273 - DNA, 20 bp, Artificial
  CRISPR gRNA sequence
tcctaggatgccagggatca

SEQ ID NO: 502274 - DNA, 20 bp, Artificial
  CRISPR gRNA sequence
cctaggatgccagggatcag

SEQ ID NO: 502275 - DNA, 20 bp, Artificial
  CRISPR gRNA sequence
ctaggatgccagggatcagc

SEQ ID NO: 502276 - DNA, 20 bp, Artificial
  CRISPR gRNA sequence
ggatgccagggatcagctga

SEQ ID NO: 502277 - DNA, 20 bp, Artificial
  CRISPR gRNA sequence
accatgtggttagcatctcg

SEQ ID NO: 502278 - DNA, 20 bp, Artificial
  CRISPR gRNA sequence
gcatctcgggagtgcctctt

SEQ ID NO: 502279 - DNA, 20 bp, Artificial
  CRISPR gRNA sequence
gggagtgcctcttcagttac

SEQ ID NO: 502280 - DNA, 20 bp, Artificial
  CRISPR gRNA sequence
ttcagttacaaccaaacagc

SEQ ID NO: 502281 - DNA, 20 bp, Artificial
  CRISPR gRNA sequence
cagttacaaccaaacagcat

SEQ ID NO: 502282 - DNA, 20 bp, Artificial
  CRISPR gRNA sequence
agttacaaccaaacagcata

SEQ ID NO: 502283 - DNA, 20 bp, Artificial
  CRISPR gRNA sequence
caaccaaacagcatacagac

SEQ ID NO: 502284 - DNA, 20 bp, Artificial
  CRISPR gRNA sequence
acagcattgcatggaagaag

SEQ ID NO: 502285 - DNA, 20 bp, Artificial
  CRISPR gRNA sequence
catggaagaagttgctgccc

SEQ ID NO: 502286 - DNA, 20 bp, Artificial
  CRISPR gRNA sequence
ctgccctcacaaaatggatt

SEQ ID NO: 502287 - DNA, 20 bp, Artificial
  CRISPR gRNA sequence
ccctcacaaaatggatttca

SEQ ID NO: 502288 - DNA, 20 bp, Artificial
  CRISPR gRNA sequence
acaaaatggatttcatcaca

SEQ ID NO: 502289 - DNA, 20 bp, Artificial
  CRISPR gRNA sequence
catcacatattgaagtggga

SEQ ID NO: 502290 - DNA, 20 bp, Artificial
  CRISPR gRNA sequence
atcacatattgaagtgggag

SEQ ID NO: 502291 - DNA, 20 bp, Artificial
  CRISPR gRNA sequence
aagtgggagaatggctcttt

SEQ ID NO: 502292 - DNA, 20 bp, Artificial
  CRISPR gRNA sequence
tttgccttccaatacttcca

SEQ ID NO: 502293 - DNA, 20 bp, Artificial
  CRISPR gRNA sequence
tgccttccaatacttccaat

SEQ ID NO: 502294 - DNA, 20 bp, Artificial
  CRISPR gRNA sequence
gccttccaatacttccaatg

SEQ ID NO: 502295 - DNA, 20 bp, Artificial
  CRISPR gRNA sequence
ccttccaatacttccaatga

SEQ ID NO: 502296 - DNA, 20 bp, Artificial
  CRISPR gRNA sequence
ccaatacttccaatgataga

SEQ ID NO: 502297 - DNA, 20 bp, Artificial
  CRISPR gRNA sequence
caatacttccaatgatagat

SEQ ID NO: 502298 - DNA, 20 bp, Artificial
  CRISPR gRNA sequence
ccaatgatagattcagtttt

SEQ ID NO: 502299 - DNA, 20 bp, Artificial
  CRISPR gRNA sequence
caatgatagattcagtttta

SEQ ID NO: 502300 - DNA, 20 bp, Artificial
  CRISPR gRNA sequence
agttttatagtcaagaactt

SEQ ID NO: 502301 - DNA, 20 bp, Artificial
  CRISPR gRNA sequence
tatagtcaagaacttgagtc

SEQ ID NO: 502302 - DNA, 20 bp, Artificial
  CRISPR gRNA sequence
atagtcaagaacttgagtct

SEQ ID NO: 502303 - DNA, 20 bp, Artificial
  CRISPR gRNA sequence
tagtcaagaacttgagtctt

SEQ ID NO: 502304 - DNA, 20 bp, Artificial
  CRISPR gRNA sequence
gagtcttctcatcaaggcag

SEQ ID NO: 502305 - DNA, 20 bp, Artificial
  CRISPR gRNA sequence
agtcttctcatcaaggcagc

SEQ ID NO: 502306 - DNA, 20 bp, Artificial
  CRISPR gRNA sequence
ctcatcaaggcagctcagca

SEQ ID NO: 502307 - DNA, 20 bp, Artificial
  CRISPR gRNA sequence
tcatcaaggcagctcagcag

SEQ ID NO: 502308 - DNA, 20 bp, Artificial
  CRISPR gRNA sequence
atcaaggcagctcagcagca

SEQ ID NO: 502309 - DNA, 20 bp, Artificial
  CRISPR gRNA sequence
agcagcaggacagtggcctc

SEQ ID NO: 502310 - DNA, 20 bp, Artificial
  CRISPR gRNA sequence
tactgcctggaggtcaccag

SEQ ID NO: 502311 - DNA, 20 bp, Artificial
  CRISPR gRNA sequence
ctgcctggaggtcaccagta

SEQ ID NO: 502312 - DNA, 20 bp, Artificial
  CRISPR gRNA sequence
cctggaggtcaccagtatat

SEQ ID NO: 502313 - DNA, 20 bp, Artificial
  CRISPR gRNA sequence
gaggtcaccagtatatctgg

SEQ ID NO: 502314 - DNA, 20 bp, Artificial
  CRISPR gRNA sequence
gaaaagttcagacagccacg

SEQ ID NO: 502315 - DNA, 20 bp, Artificial
  CRISPR gRNA sequence
agacagccacgttccaggtt

SEQ ID NO: 502316 - DNA, 20 bp, Artificial
  CRISPR gRNA sequence
caggtttttgtatttggtaa

SEQ ID NO: 502317 - DNA, 20 bp, Artificial
  CRISPR gRNA sequence
ttgtatttggtaagtctcca

SEQ ID NO: 502318 - DNA, 20 bp, Artificial
  CRISPR gRNA sequence
tgtatttggtaagtctccag

SEQ ID NO: 502319 - DNA, 20 bp, Artificial
  CRISPR gRNA sequence
gtatttggtaagtctccagg

SEQ ID NO: 502320 - DNA, 20 bp, Artificial
  CRISPR gRNA sequence
tatttggtaagtctccagga

SEQ ID NO: 502321 - DNA, 20 bp, Artificial
  CRISPR gRNA sequence
ggtaagtctccaggactgtt

SEQ ID NO: 502322 - DNA, 20 bp, Artificial
  CRISPR gRNA sequence
gtaagtctccaggactgttc

SEQ ID NO: 502323 - DNA, 20 bp, Artificial
  CRISPR gRNA sequence
caggactgttcatactgccc

SEQ ID NO: 502324 - DNA, 20 bp, Artificial
  CRISPR gRNA sequence
ttcatactgccctctctgat

SEQ ID NO: 502325 - DNA, 20 bp, Artificial
  CRISPR gRNA sequence
atactgccctctctgattcc

SEQ ID NO: 502326 - DNA, 20 bp, Artificial
  CRISPR gRNA sequence
ccctctctgattcctatagg

SEQ ID NO: 502327 - DNA, 20 bp, Artificial
  CRISPR gRNA sequence
tctgattcctataggcctct

SEQ ID NO: 502328 - DNA, 20 bp, Artificial
  CRISPR gRNA sequence
tgattcctataggcctctaa

SEQ ID NO: 502329 - DNA, 20 bp, Artificial
  CRISPR gRNA sequence
attcctataggcctctaagt

SEQ ID NO: 502330 - DNA, 20 bp, Artificial
  CRISPR gRNA sequence
ctataggcctctaagttctg

SEQ ID NO: 502331 - DNA, 20 bp, Artificial
  CRISPR gRNA sequence
taggcctctaagttctgtat

SEQ ID NO: 502332 - DNA, 20 bp, Artificial
  CRISPR gRNA sequence
taagttctgtatttccaatg

SEQ ID NO: 502333 - DNA, 20 bp, Artificial
  CRISPR gRNA sequence
agttctgtatttccaatgcc

SEQ ID NO: 502334 - DNA, 20 bp, Artificial
  CRISPR gRNA sequence
tgtatttccaatgcctttct

SEQ ID NO: 502335 - DNA, 20 bp, Artificial
  CRISPR gRNA sequence
tatttccaatgcctttctga

SEQ ID NO: 502336 - DNA, 20 bp, Artificial
  CRISPR gRNA sequence
ccaatgcctttctgatcaga

SEQ ID NO: 502337 - DNA, 20 bp, Artificial
  CRISPR gRNA sequence
caatgcctttctgatcagaa

SEQ ID NO: 502338 - DNA, 20 bp, Artificial
  CRISPR gRNA sequence
tctgatcagaatctctgctt

SEQ ID NO: 502339 - DNA, 20 bp, Artificial
  CRISPR gRNA sequence
ctgatcagaatctctgcttc

SEQ ID NO: 502340 - DNA, 20 bp, Artificial
  CRISPR gRNA sequence
tgatcagaatctctgcttcc

SEQ ID NO: 502341 - DNA, 20 bp, Artificial
  CRISPR gRNA sequence
atcagaatctctgcttccag

SEQ ID NO: 502342 - DNA, 20 bp, Artificial
  CRISPR gRNA sequence
tgcttccagataaagttgag

SEQ ID NO: 502343 - DNA, 20 bp, Artificial
  CRISPR gRNA sequence
cttccagataaagttgagaa

SEQ ID NO: 502344 - DNA, 20 bp, Artificial
  CRISPR gRNA sequence
ccagataaagttgagaaacc

SEQ ID NO: 502345 - DNA, 20 bp, Artificial
  CRISPR gRNA sequence
cagataaagttgagaaaccc

SEQ ID NO: 502346 - DNA, 20 bp, Artificial
  CRISPR gRNA sequence
agaaaccccgcctacagggg

SEQ ID NO: 502347 - DNA, 20 bp, Artificial
  CRISPR gRNA sequence
caggggcaggggaagatcct

SEQ ID NO: 502348 - DNA, 20 bp, Artificial
  CRISPR gRNA sequence
gacagagggagatgccaagt

SEQ ID NO: 502349 - DNA, 20 bp, Artificial
  CRISPR gRNA sequence
tgtcttgcttggtctccagg

SEQ ID NO: 502350 - DNA, 20 bp, Artificial
  CRISPR gRNA sequence
tcttgcttggtctccaggga

SEQ ID NO: 502351 - DNA, 20 bp, Artificial
  CRISPR gRNA sequence
gcttggtctccagggatggc

SEQ ID NO: 502352 - DNA, 20 bp, Artificial
  CRISPR gRNA sequence
cttggtctccagggatggca

SEQ ID NO: 502353 - DNA, 20 bp, Artificial
  CRISPR gRNA sequence
ggtctccagggatggcaatg

SEQ ID NO: 502354 - DNA, 20 bp, Artificial
  CRISPR gRNA sequence
gtctccagggatggcaatgt

SEQ ID NO: 502355 - DNA, 20 bp, Artificial
  CRISPR gRNA sequence
cagggatggcaatgtgtcct

SEQ ID NO: 502356 - DNA, 20 bp, Artificial
  CRISPR gRNA sequence
tgcttggtacagagggagca

SEQ ID NO: 502357 - DNA, 20 bp, Artificial
  CRISPR gRNA sequence
ggtacagagggagcaagctg

SEQ ID NO: 502358 - DNA, 20 bp, Artificial
  CRISPR gRNA sequence
gtacagagggagcaagctga

SEQ ID NO: 502359 - DNA, 20 bp, Artificial
  CRISPR gRNA sequence
atccagacagcagggaacct

SEQ ID NO: 502360 - DNA, 20 bp, Artificial
  CRISPR gRNA sequence
acctacctggacgaggaggt

SEQ ID NO: 502361 - DNA, 20 bp, Artificial
  CRISPR gRNA sequence
cctggacgaggaggttgaca

SEQ ID NO: 502362 - DNA, 20 bp, Artificial
  CRISPR gRNA sequence
gacgaggaggttgacattaa

SEQ ID NO: 502363 - DNA, 20 bp, Artificial
  CRISPR gRNA sequence
acattaatggcactcacaca

SEQ ID NO: 502364 - DNA, 20 bp, Artificial
  CRISPR gRNA sequence
atggcactcacacatatacc

SEQ ID NO: 502365 - DNA, 20 bp, Artificial
  CRISPR gRNA sequence
acacatatacctgcaatgtc

SEQ ID NO: 502366 - DNA, 20 bp, Artificial
  CRISPR gRNA sequence
caatgtcagcaatcctgtta

SEQ ID NO: 502367 - DNA, 20 bp, Artificial
  CRISPR gRNA sequence
ttagctgggaaagccacacc

SEQ ID NO: 502368 - DNA, 20 bp, Artificial
  CRISPR gRNA sequence
gctgggaaagccacaccctg

SEQ ID NO: 502369 - DNA, 20 bp, Artificial
  CRISPR gRNA sequence
ggaaagccacaccctgaatc

SEQ ID NO: 502370 - DNA, 20 bp, Artificial
  CRISPR gRNA sequence
aatctcactcaggactgtca

SEQ ID NO: 502371 - DNA, 20 bp, Artificial
  CRISPR gRNA sequence
actcaggactgtcagaatgc

SEQ ID NO: 502372 - DNA, 20 bp, Artificial
  CRISPR gRNA sequence
aggactgtcagaatgcccat

SEQ ID NO: 502373 - DNA, 20 bp, Artificial
  CRISPR gRNA sequence
tcagaatgcccatcagggta

SEQ ID NO: 502374 - DNA, 20 bp, Artificial
  CRISPR gRNA sequence
ggctataacaagcgctgaag

SEQ ID NO: 502375 - DNA, 20 bp, Artificial
  CRISPR gRNA sequence
taacaagcgctgaaggtttg

SEQ ID NO: 502376 - DNA, 20 bp, Artificial
  CRISPR gRNA sequence
aaggtttggaccccgcaacc

SEQ ID NO: 502377 - DNA, 20 bp, Artificial
  CRISPR gRNA sequence
ggaccccgcaaccaggctca

SEQ ID NO: 502378 - DNA, 20 bp, Artificial
  CRISPR gRNA sequence
gaccccgcaaccaggctcat

SEQ ID NO: 502379 - DNA, 20 bp, Artificial
  CRISPR gRNA sequence
atgtgcaagacagatgtggt

SEQ ID NO: 502380 - DNA, 20 bp, Artificial
  CRISPR gRNA sequence
ggcctcctctcccagtgcct

SEQ ID NO: 502381 - DNA, 20 bp, Artificial
  CRISPR gRNA sequence
gcctcctctcccagtgcctt

SEQ ID NO: 502382 - DNA, 20 bp, Artificial
  CRISPR gRNA sequence
ctctcccagtgccttgtagc

SEQ ID NO: 502383 - DNA, 20 bp, Artificial
  CRISPR gRNA sequence
tcccagtgccttgtagccct

SEQ ID NO: 502384 - DNA, 20 bp, Artificial
  CRISPR gRNA sequence
ccagtgccttgtagcccttc

SEQ ID NO: 502385 - DNA, 20 bp, Artificial
  CRISPR gRNA sequence
gtagcccttcccagggtagc

SEQ ID NO: 502386 - DNA, 20 bp, Artificial
  CRISPR gRNA sequence
tagcccttcccagggtagcc

SEQ ID NO: 502387 - DNA, 20 bp, Artificial
  CRISPR gRNA sequence
cccagggtagccctggcctc

SEQ ID NO: 502388 - DNA, 20 bp, Artificial
  CRISPR gRNA sequence
ccagggtagccctggcctcc

SEQ ID NO: 502389 - DNA, 20 bp, Artificial
  CRISPR gRNA sequence
gcctccaggcacacagttcc

SEQ ID NO: 502390 - DNA, 20 bp, Artificial
  CRISPR gRNA sequence
caggcacacagttcctgtaa

SEQ ID NO: 502391 - DNA, 20 bp, Artificial
  CRISPR gRNA sequence
ctgtaaagctaggcctatcc

SEQ ID NO: 502392 - DNA, 20 bp, Artificial
  CRISPR gRNA sequence
taaagctaggcctatcctac

SEQ ID NO: 502393 - DNA, 20 bp, Artificial
  CRISPR gRNA sequence
ggcctatcctactctggaaa

SEQ ID NO: 502394 - DNA, 20 bp, Artificial
  CRISPR gRNA sequence
tcctactctggaaaaaaatg

SEQ ID NO: 502395 - DNA, 20 bp, Artificial
  CRISPR gRNA sequence
ctctggaaaaaaatgttatc

SEQ ID NO: 502396 - DNA, 20 bp, Artificial
  CRISPR gRNA sequence
tggaaaaaaatgttatccct

SEQ ID NO: 502397 - DNA, 20 bp, Artificial
  CRISPR gRNA sequence
gaaaaaaatgttatccctat

SEQ ID NO: 502398 - DNA, 20 bp, Artificial
  CRISPR gRNA sequence
tccctatttccttctgggag

SEQ ID NO: 502399 - DNA, 20 bp, Artificial
  CRISPR gRNA sequence
tttccttctgggagatgcaa

SEQ ID NO: 502400 - DNA, 20 bp, Artificial
  CRISPR gRNA sequence
ccttctgggagatgcaagct

SEQ ID NO: 502401 - DNA, 20 bp, Artificial
  CRISPR gRNA sequence
cttctgggagatgcaagctt

SEQ ID NO: 502402 - DNA, 20 bp, Artificial
  CRISPR gRNA sequence
ctgggagatgcaagcttttc

SEQ ID NO: 502403 - DNA, 20 bp, Artificial
  CRISPR gRNA sequence
tgggagatgcaagcttttct

SEQ ID NO: 502404 - DNA, 20 bp, Artificial
  CRISPR gRNA sequence
ggagatgcaagcttttcttc

SEQ ID NO: 502405 - DNA, 20 bp, Artificial
  CRISPR gRNA sequence
ttcttctgcagagggagggc

SEQ ID NO: 502406 - DNA, 20 bp, Artificial
  CRISPR gRNA sequence
tcttctgcagagggagggca

SEQ ID NO: 502407 - DNA, 20 bp, Artificial
  CRISPR gRNA sequence
cttctgcagagggagggcat

SEQ ID NO: 502408 - DNA, 20 bp, Artificial
  CRISPR gRNA sequence
ttctgcagagggagggcata

SEQ ID NO: 502409 - DNA, 20 bp, Artificial
  CRISPR gRNA sequence
ctgcagagggagggcatagt

SEQ ID NO: 502410 - DNA, 20 bp, Artificial
  CRISPR gRNA sequence
tgcagagggagggcatagtt

SEQ ID NO: 502411 - DNA, 20 bp, Artificial
  CRISPR gRNA sequence
cagagggagggcatagttgt

SEQ ID NO: 502412 - DNA, 20 bp, Artificial
  CRISPR gRNA sequence
tttggtgagtgacagtcctg

SEQ ID NO: 502413 - DNA, 20 bp, Artificial
  CRISPR gRNA sequence
ggtgagtgacagtcctgaaa

SEQ ID NO: 502414 - DNA, 20 bp, Artificial
  CRISPR gRNA sequence
gtgagtgacagtcctgaaat

SEQ ID NO: 502415 - DNA, 20 bp, Artificial
  CRISPR gRNA sequence
aaatggctcctgaacattat

SEQ ID NO: 502416 - DNA, 20 bp, Artificial
  CRISPR gRNA sequence
ctgaacattattttcttcct

SEQ ID NO: 502417 - DNA, 20 bp, Artificial
  CRISPR gRNA sequence
aacattattttcttcctggg

SEQ ID NO: 502418 - DNA, 20 bp, Artificial
  CRISPR gRNA sequence
ttttcttcctgggagaggct

SEQ ID NO: 502419 - DNA, 20 bp, Artificial
  CRISPR gRNA sequence
tcttcctgggagaggctgat

SEQ ID NO: 502420 - DNA, 20 bp, Artificial
  CRISPR gRNA sequence
cttcctgggagaggctgatg

SEQ ID NO: 502421 - DNA, 20 bp, Artificial
  CRISPR gRNA sequence
ttcctgggagaggctgatgg

SEQ ID NO: 502422 - DNA, 20 bp, Artificial
  CRISPR gRNA sequence
cctgggagaggctgatggag

SEQ ID NO: 502423 - DNA, 20 bp, Artificial
  CRISPR gRNA sequence
ctgggagaggctgatggaga

SEQ ID NO: 502424 - DNA, 20 bp, Artificial
  CRISPR gRNA sequence
ggagaggctgatggagaact

SEQ ID NO: 502425 - DNA, 20 bp, Artificial
  CRISPR gRNA sequence
atggagaactgtcctctcct

SEQ ID NO: 502426 - DNA, 20 bp, Artificial
  CRISPR gRNA sequence
tcctctcctcttgagtgata

SEQ ID NO: 502427 - DNA, 20 bp, Artificial
  CRISPR gRNA sequence
tcctcttgagtgataacttt

SEQ ID NO: 502428 - DNA, 20 bp, Artificial
  CRISPR gRNA sequence
ctcttgagtgataactttct

SEQ ID NO: 502429 - DNA, 20 bp, Artificial
  CRISPR gRNA sequence
ttgagtgataactttctcca

SEQ ID NO: 502430 - DNA, 20 bp, Artificial
  CRISPR gRNA sequence
gagtgataactttctccaag

SEQ ID NO: 502431 - DNA, 20 bp, Artificial
  CRISPR gRNA sequence
agtgataactttctccaagc

SEQ ID NO: 502432 - DNA, 20 bp, Artificial
  CRISPR gRNA sequence
tctccaagccacatagttca

SEQ ID NO: 502433 - DNA, 20 bp, Artificial
  CRISPR gRNA sequence
ctccaagccacatagttcaa

SEQ ID NO: 502434 - DNA, 20 bp, Artificial
  CRISPR gRNA sequence
tccaagccacatagttcaag

SEQ ID NO: 502435 - DNA, 20 bp, Artificial
  CRISPR gRNA sequence
caagccacatagttcaagag

SEQ ID NO: 502436 - DNA, 20 bp, Artificial
  CRISPR gRNA sequence
aagaggtaactacactgtgc

SEQ ID NO: 502437 - DNA, 20 bp, Artificial
  CRISPR gRNA sequence
cactgtgcagcagtagcctg

SEQ ID NO: 502438 - DNA, 20 bp, Artificial
  CRISPR gRNA sequence
tgcagcagtagcctggagca

SEQ ID NO: 502439 - DNA, 20 bp, Artificial
  CRISPR gRNA sequence
gagcaggagcatcaggatga

SEQ ID NO: 502440 - DNA, 20 bp, Artificial
  CRISPR gRNA sequence
gatgagttcttgggctgttg

SEQ ID NO: 502441 - DNA, 20 bp, Artificial
  CRISPR gRNA sequence
ttgggctgttgcttatgctc

SEQ ID NO: 502442 - DNA, 20 bp, Artificial
  CRISPR gRNA sequence
gggctgttgcttatgctcat

SEQ ID NO: 502443 - DNA, 20 bp, Artificial
  CRISPR gRNA sequence
ggctgttgcttatgctcatc

SEQ ID NO: 502444 - DNA, 20 bp, Artificial
  CRISPR gRNA sequence
ttgcttatgctcatcctaag

SEQ ID NO: 502445 - DNA, 20 bp, Artificial
  CRISPR gRNA sequence
cttatgctcatcctaagagt

SEQ ID NO: 502446 - DNA, 20 bp, Artificial
  CRISPR gRNA sequence
atgctcatcctaagagttac

SEQ ID NO: 502447 - DNA, 20 bp, Artificial
  CRISPR gRNA sequence
tgctcatcctaagagttacc

SEQ ID NO: 502448 - DNA, 20 bp, Artificial
  CRISPR gRNA sequence
atcctaagagttacctgagt

SEQ ID NO: 502449 - DNA, 20 bp, Artificial
  CRISPR gRNA sequence
agagttacctgagttaccgt

SEQ ID NO: 502450 - DNA, 20 bp, Artificial
  CRISPR gRNA sequence
cctgagttaccgttccacaa

SEQ ID NO: 502451 - DNA, 20 bp, Artificial
  CRISPR gRNA sequence
agttaccgttccacaacttt

SEQ ID NO: 502452 - DNA, 20 bp, Artificial
  CRISPR gRNA sequence
ccgttccacaactttttatt

SEQ ID NO: 502453 - DNA, 20 bp, Artificial
  CRISPR gRNA sequence
cacaactttttattacataa

SEQ ID NO: 502454 - DNA, 20 bp, Artificial
  CRISPR gRNA sequence
tttattacataaacagggac

SEQ ID NO: 502455 - DNA, 20 bp, Artificial
  CRISPR gRNA sequence
ttattacataaacagggact

SEQ ID NO: 502456 - DNA, 20 bp, Artificial
  CRISPR gRNA sequence
tattacataaacagggactt

SEQ ID NO: 502457 - DNA, 20 bp, Artificial
  CRISPR gRNA sequence
attacataaacagggactta

SEQ ID NO: 502458 - DNA, 20 bp, Artificial
  CRISPR gRNA sequence
ttacataaacagggacttaa

SEQ ID NO: 502459 - DNA, 20 bp, Artificial
  CRISPR gRNA sequence
cataaacagggacttaatgt

SEQ ID NO: 502460 - DNA, 20 bp, Artificial
  CRISPR gRNA sequence
aatgtaccagcagcatgggc

SEQ ID NO: 502461 - DNA, 20 bp, Artificial
  CRISPR gRNA sequence
atgtaccagcagcatgggca

SEQ ID NO: 502462 - DNA, 20 bp, Artificial
  CRISPR gRNA sequence
taggaaaaaaaaaccataca

SEQ ID NO: 502463 - DNA, 20 bp, Artificial
  CRISPR gRNA sequence
tcattcataaggaacttata

SEQ ID NO: 502464 - DNA, 20 bp, Artificial
  CRISPR gRNA sequence
attcataaggaacttatagc

SEQ ID NO: 502465 - DNA, 20 bp, Artificial
  CRISPR gRNA sequence
ataaggaacttatagccaaa

SEQ ID NO: 502466 - DNA, 20 bp, Artificial
  CRISPR gRNA sequence
atagccaaatggggcaacaa

SEQ ID NO: 502467 - DNA, 20 bp, Artificial
  CRISPR gRNA sequence
tagccaaatggggcaacaaa

SEQ ID NO: 502468 - DNA, 20 bp, Artificial
  CRISPR gRNA sequence
cttgtggacaaaaaagaaac

SEQ ID NO: 502469 - DNA, 20 bp, Artificial
  CRISPR gRNA sequence
gtggacaaaaaagaaacaag

SEQ ID NO: 502470 - DNA, 20 bp, Artificial
  CRISPR gRNA sequence
tggacaaaaaagaaacaaga

SEQ ID NO: 502471 - DNA, 20 bp, Artificial
  CRISPR gRNA sequence
aggcaggccgggcgcagtgg

SEQ ID NO: 502472 - DNA, 20 bp, Artificial
  CRISPR gRNA sequence
cctgtaatcccagcactttg

SEQ ID NO: 502473 - DNA, 20 bp, Artificial
  CRISPR gRNA sequence
taatcccagcactttgggag

SEQ ID NO: 502474 - DNA, 20 bp, Artificial
  CRISPR gRNA sequence
tgggaggctgaggtgggtgg

SEQ ID NO: 502475 - DNA, 20 bp, Artificial
  CRISPR gRNA sequence
gggaggctgaggtgggtgga

SEQ ID NO: 502476 - DNA, 20 bp, Artificial
  CRISPR gRNA sequence
ggaggctgaggtgggtggat

SEQ ID NO: 502477 - DNA, 20 bp, Artificial
  CRISPR gRNA sequence
aggtgggtggatcacaaggt

SEQ ID NO: 502478 - DNA, 20 bp, Artificial
  CRISPR gRNA sequence
gagaccagcctggccaacat

SEQ ID NO: 502479 - DNA, 20 bp, Artificial
  CRISPR gRNA sequence
agaccagcctggccaacatg

SEQ ID NO: 502480 - DNA, 20 bp, Artificial
  CRISPR gRNA sequence
gccaacatggtgaaaccctg

SEQ ID NO: 502481 - DNA, 20 bp, Artificial
  CRISPR gRNA sequence
tctctactaaaaatacaaaa

SEQ ID NO: 502482 - DNA, 20 bp, Artificial
  CRISPR gRNA sequence
tactaaaaatacaaaaaatt

SEQ ID NO: 502483 - DNA, 20 bp, Artificial
  CRISPR gRNA sequence
ctaaaaatacaaaaaattag

SEQ ID NO: 502484 - DNA, 20 bp, Artificial
  CRISPR gRNA sequence
aaaatacaaaaaattagctg

SEQ ID NO: 502485 - DNA, 20 bp, Artificial
  CRISPR gRNA sequence
gctgggcgtgttggcgggca

SEQ ID NO: 502486 - DNA, 20 bp, Artificial
  CRISPR gRNA sequence
ggcgtgttggcgggcacctg

SEQ ID NO: 502487 - DNA, 20 bp, Artificial
  CRISPR gRNA sequence
gcgggcacctgtaatctcag

SEQ ID NO: 502488 - DNA, 20 bp, Artificial
  CRISPR gRNA sequence
taatctcagctactcaggag

SEQ ID NO: 502489 - DNA, 20 bp, Artificial
  CRISPR gRNA sequence
agctactcaggaggctgagg

SEQ ID NO: 502490 - DNA, 20 bp, Artificial
  CRISPR gRNA sequence
ctcaggaggctgaggcagga

SEQ ID NO: 502491 - DNA, 20 bp, Artificial
  CRISPR gRNA sequence
aggaggctgaggcaggagaa

SEQ ID NO: 502492 - DNA, 20 bp, Artificial
  CRISPR gRNA sequence
aggcaggagaattgcttgaa

SEQ ID NO: 502493 - DNA, 20 bp, Artificial
  CRISPR gRNA sequence
cttgaacccaggaggcggag

SEQ ID NO: 502494 - DNA, 20 bp, Artificial
  CRISPR gRNA sequence
gaacccaggaggcggaggtt

SEQ ID NO: 502495 - DNA, 20 bp, Artificial
  CRISPR gRNA sequence
aacccaggaggcggaggttg

SEQ ID NO: 502496 - DNA, 20 bp, Artificial
  CRISPR gRNA sequence
cagtgagtcaagatcatgcc

SEQ ID NO: 502497 - DNA, 20 bp, Artificial
  CRISPR gRNA sequence
aactaggacactggcttcat

SEQ ID NO: 502498 - DNA, 20 bp, Artificial
  CRISPR gRNA sequence
ggacactggcttcatcattc

SEQ ID NO: 502499 - DNA, 20 bp, Artificial
  CRISPR gRNA sequence
gcttcatcattcagaagctc

SEQ ID NO: 502500 - DNA, 20 bp, Artificial
  CRISPR gRNA sequence
catcattcagaagctctgtg

SEQ ID NO: 502501 - DNA, 20 bp, Artificial
  CRISPR gRNA sequence
atcattcagaagctctgtga

SEQ ID NO: 502502 - DNA, 20 bp, Artificial
  CRISPR gRNA sequence
agaagctctgtgatctctta

SEQ ID NO: 502503 - DNA, 20 bp, Artificial
  CRISPR gRNA sequence
tgtgatctcttagaggtcag

SEQ ID NO: 502504 - DNA, 20 bp, Artificial
  CRISPR gRNA sequence
tgatctcttagaggtcaggt

SEQ ID NO: 502505 - DNA, 20 bp, Artificial
  CRISPR gRNA sequence
ttagaggtcaggtgtggtgg

SEQ ID NO: 502506 - DNA, 20 bp, Artificial
  CRISPR gRNA sequence
agaggtcaggtgtggtggct

SEQ ID NO: 502507 - DNA, 20 bp, Artificial
  CRISPR gRNA sequence
gaggtcaggtgtggtggctc

SEQ ID NO: 502508 - DNA, 20 bp, Artificial
  CRISPR gRNA sequence
acacatgtaatcctagcact

SEQ ID NO: 502509 - DNA, 20 bp, Artificial
  CRISPR gRNA sequence
gcactttgggaggctgaggc

SEQ ID NO: 502510 - DNA, 20 bp, Artificial
  CRISPR gRNA sequence
tgggaggctgaggcaggtgg

SEQ ID NO: 502511 - DNA, 20 bp, Artificial
  CRISPR gRNA sequence
gggaggctgaggcaggtgga

SEQ ID NO: 502512 - DNA, 20 bp, Artificial
  CRISPR gRNA sequence
ggaggctgaggcaggtggat

SEQ ID NO: 502513 - DNA, 20 bp, Artificial
  CRISPR gRNA sequence
aggcaggtggatcacttgag

SEQ ID NO: 502514 - DNA, 20 bp, Artificial
  CRISPR gRNA sequence
gagtccaggtgtttgagacc

SEQ ID NO: 502515 - DNA, 20 bp, Artificial
  CRISPR gRNA sequence
agtccaggtgtttgagacca

SEQ ID NO: 502516 - DNA, 20 bp, Artificial
  CRISPR gRNA sequence
gagaccagcctggacaatat

SEQ ID NO: 502517 - DNA, 20 bp, Artificial
  CRISPR gRNA sequence
agaccagcctggacaatatg

SEQ ID NO: 502518 - DNA, 20 bp, Artificial
  CRISPR gRNA sequence
gacaatatggtgtaatccca

SEQ ID NO: 502519 - DNA, 20 bp, Artificial
  CRISPR gRNA sequence
tatttaaaaaaaaaaaaaaa

SEQ ID NO: 502520 - DNA, 20 bp, Artificial
  CRISPR gRNA sequence
tttaaaaaaaaaaaaaaaag

SEQ ID NO: 502521 - DNA, 20 bp, Artificial
  CRISPR gRNA sequence
aaaaaaaaaaaaaaaagaag

SEQ ID NO: 502522 - DNA, 20 bp, Artificial
  CRISPR gRNA sequence
aaaaaaaaaaaaaaagaagc

SEQ ID NO: 502523 - DNA, 20 bp, Artificial
  CRISPR gRNA sequence
tgtgatctctggcagattca

SEQ ID NO: 502524 - DNA, 20 bp, Artificial
  CRISPR gRNA sequence
tgatctctggcagattcatt

SEQ ID NO: 502525 - DNA, 20 bp, Artificial
  CRISPR gRNA sequence
tggcagattcattaacctct

SEQ ID NO: 502526 - DNA, 20 bp, Artificial
  CRISPR gRNA sequence
gcagattcattaacctctct

SEQ ID NO: 502527 - DNA, 20 bp, Artificial
  CRISPR gRNA sequence
attaacctctctgagcctca

SEQ ID NO: 502528 - DNA, 20 bp, Artificial
  CRISPR gRNA sequence
acctctctgagcctcaattt

SEQ ID NO: 502529 - DNA, 20 bp, Artificial
  CRISPR gRNA sequence
tctgagcctcaattttcttc

SEQ ID NO: 502530 - DNA, 20 bp, Artificial
  CRISPR gRNA sequence
tgagcctcaattttcttccc

SEQ ID NO: 502531 - DNA, 20 bp, Artificial
  CRISPR gRNA sequence
agcctcaattttcttccccc

SEQ ID NO: 502532 - DNA, 20 bp, Artificial
  CRISPR gRNA sequence
aattttcttccccccttgag

SEQ ID NO: 502533 - DNA, 20 bp, Artificial
  CRISPR gRNA sequence
tcttccccccttgagtaaaa

SEQ ID NO: 502534 - DNA, 20 bp, Artificial
  CRISPR gRNA sequence
cttccccccttgagtaaaat

SEQ ID NO: 502535 - DNA, 20 bp, Artificial
  CRISPR gRNA sequence
ttccccccttgagtaaaatg

SEQ ID NO: 502536 - DNA, 20 bp, Artificial
  CRISPR gRNA sequence
ccccccttgagtaaaatggg

SEQ ID NO: 502537 - DNA, 20 bp, Artificial
  CRISPR gRNA sequence
cccccttgagtaaaatgggg

SEQ ID NO: 502538 - DNA, 20 bp, Artificial
  CRISPR gRNA sequence
gagtaaaatgggggtgataa

SEQ ID NO: 502539 - DNA, 20 bp, Artificial
  CRISPR gRNA sequence
agtaaaatgggggtgataat

SEQ ID NO: 502540 - DNA, 20 bp, Artificial
  CRISPR gRNA sequence
acaggattgctgttaagagt

SEQ ID NO: 502541 - DNA, 20 bp, Artificial
  CRISPR gRNA sequence
ctgttaagagtaaatgagat

SEQ ID NO: 502542 - DNA, 20 bp, Artificial
  CRISPR gRNA sequence
ttaagagtaaatgagataat

SEQ ID NO: 502543 - DNA, 20 bp, Artificial
  CRISPR gRNA sequence
agagtaaatgagataatgtt

SEQ ID NO: 502544 - DNA, 20 bp, Artificial
  CRISPR gRNA sequence
gcaaagagccttgtcagccc

SEQ ID NO: 502545 - DNA, 20 bp, Artificial
  CRISPR gRNA sequence
caaagagccttgtcagccct

SEQ ID NO: 502546 - DNA, 20 bp, Artificial
  CRISPR gRNA sequence
gtcagcccttggaacactta

SEQ ID NO: 502547 - DNA, 20 bp, Artificial
  CRISPR gRNA sequence
tcagcccttggaacacttaa

SEQ ID NO: 502548 - DNA, 20 bp, Artificial
  CRISPR gRNA sequence
ggaacacttaattccttttc

SEQ ID NO: 502549 - DNA, 20 bp, Artificial
  CRISPR gRNA sequence
gaacacttaattccttttcc

SEQ ID NO: 502550 - DNA, 20 bp, Artificial
  CRISPR gRNA sequence
aattccttttccttcctctt

SEQ ID NO: 502551 - DNA, 20 bp, Artificial
  CRISPR gRNA sequence
attccttttccttcctcttg

SEQ ID NO: 502552 - DNA, 20 bp, Artificial
  CRISPR gRNA sequence
cttttccttcctcttgttgg

SEQ ID NO: 502553 - DNA, 20 bp, Artificial
  CRISPR gRNA sequence
ttccttcctcttgttggctg

SEQ ID NO: 502554 - DNA, 20 bp, Artificial
  CRISPR gRNA sequence
tccttcctcttgttggctgg

SEQ ID NO: 502555 - DNA, 20 bp, Artificial
  CRISPR gRNA sequence
ccttcctcttgttggctgga

SEQ ID NO: 502556 - DNA, 20 bp, Artificial
  CRISPR gRNA sequence
cttcctcttgttggctggat

SEQ ID NO: 502557 - DNA, 20 bp, Artificial
  CRISPR gRNA sequence
cctcttgttggctggattat

SEQ ID NO: 502558 - DNA, 20 bp, Artificial
  CRISPR gRNA sequence
ctcttgttggctggattata

SEQ ID NO: 502559 - DNA, 20 bp, Artificial
  CRISPR gRNA sequence
ttgttggctggattatatat

SEQ ID NO: 502560 - DNA, 20 bp, Artificial
  CRISPR gRNA sequence
gttggctggattatatatca

SEQ ID NO: 502561 - DNA, 20 bp, Artificial
  CRISPR gRNA sequence
ttggctggattatatatcag

SEQ ID NO: 502562 - DNA, 20 bp, Artificial
  CRISPR gRNA sequence
gctggattatatatcaggct

SEQ ID NO: 502563 - DNA, 20 bp, Artificial
  CRISPR gRNA sequence
gattatatatcaggctacat

SEQ ID NO: 502564 - DNA, 20 bp, Artificial
  CRISPR gRNA sequence
tatatcaggctacatgtgtg

SEQ ID NO: 502565 - DNA, 20 bp, Artificial
  CRISPR gRNA sequence
catgtgtgacacaaatcttt

SEQ ID NO: 502566 - DNA, 20 bp, Artificial
  CRISPR gRNA sequence
ttaagtagaagttcaaatga

SEQ ID NO: 502567 - DNA, 20 bp, Artificial
  CRISPR gRNA sequence
taagtagaagttcaaatgag

SEQ ID NO: 502568 - DNA, 20 bp, Artificial
  CRISPR gRNA sequence
aagtagaagttcaaatgagg

SEQ ID NO: 502569 - DNA, 20 bp, Artificial
  CRISPR gRNA sequence
agtagaagttcaaatgagga

SEQ ID NO: 502570 - DNA, 20 bp, Artificial
  CRISPR gRNA sequence
aaatgaggaagagccatgaa

SEQ ID NO: 502571 - DNA, 20 bp, Artificial
  CRISPR gRNA sequence
gcctgtacaatgagtatttt

SEQ ID NO: 502572 - DNA, 20 bp, Artificial
  CRISPR gRNA sequence
cctgtacaatgagtattttt

SEQ ID NO: 502573 - DNA, 20 bp, Artificial
  CRISPR gRNA sequence
tacaatgagtattttttgag

SEQ ID NO: 502574 - DNA, 20 bp, Artificial
  CRISPR gRNA sequence
tttgagttaaaaacaaagga

SEQ ID NO: 502575 - DNA, 20 bp, Artificial
  CRISPR gRNA sequence
ttgagttaaaaacaaaggaa

SEQ ID NO: 502576 - DNA, 20 bp, Artificial
  CRISPR gRNA sequence
tgagttaaaaacaaaggaat

SEQ ID NO: 502577 - DNA, 20 bp, Artificial
  CRISPR gRNA sequence
gagttaaaaacaaaggaatg

SEQ ID NO: 502578 - DNA, 20 bp, Artificial
  CRISPR gRNA sequence
agttaaaaacaaaggaatgg

SEQ ID NO: 502579 - DNA, 20 bp, Artificial
  CRISPR gRNA sequence
aaaacaaaggaatggataaa

SEQ ID NO: 502580 - DNA, 20 bp, Artificial
  CRISPR gRNA sequence
gttgtgctacatgtccctca

SEQ ID NO: 502581 - DNA, 20 bp, Artificial
  CRISPR gRNA sequence
ttgtgctacatgtccctcag

SEQ ID NO: 502582 - DNA, 20 bp, Artificial
  CRISPR gRNA sequence
tgctacatgtccctcagtat

SEQ ID NO: 502583 - DNA, 20 bp, Artificial
  CRISPR gRNA sequence
catgtccctcagtatccatg

SEQ ID NO: 502584 - DNA, 20 bp, Artificial
  CRISPR gRNA sequence
agtatccatgacgaattagt

SEQ ID NO: 502585 - DNA, 20 bp, Artificial
  CRISPR gRNA sequence
gttccaggacccacctcgca

SEQ ID NO: 502586 - DNA, 20 bp, Artificial
  CRISPR gRNA sequence
caggacccacctcgcaacca

SEQ ID NO: 502587 - DNA, 20 bp, Artificial
  CRISPR gRNA sequence
gcaaccacagatgccaagat

SEQ ID NO: 502588 - DNA, 20 bp, Artificial
  CRISPR gRNA sequence
aagtccctggcataaacagg

SEQ ID NO: 502589 - DNA, 20 bp, Artificial
  CRISPR gRNA sequence
agtccctggcataaacaggt

SEQ ID NO: 502590 - DNA, 20 bp, Artificial
  CRISPR gRNA sequence
gcataaacaggtgcagtttt

SEQ ID NO: 502591 - DNA, 20 bp, Artificial
  CRISPR gRNA sequence
ttgcatataacctatgcaca

SEQ ID NO: 502592 - DNA, 20 bp, Artificial
  CRISPR gRNA sequence
tgcatataacctatgcacac

SEQ ID NO: 502593 - DNA, 20 bp, Artificial
  CRISPR gRNA sequence
gcatataacctatgcacaca

SEQ ID NO: 502594 - DNA, 20 bp, Artificial
  CRISPR gRNA sequence
catataacctatgcacacat

SEQ ID NO: 502595 - DNA, 20 bp, Artificial
  CRISPR gRNA sequence
tgcacacatccttctgtata

SEQ ID NO: 502596 - DNA, 20 bp, Artificial
  CRISPR gRNA sequence
ctgtataccttacttaagtc

SEQ ID NO: 502597 - DNA, 20 bp, Artificial
  CRISPR gRNA sequence
tgtataccttacttaagtca

SEQ ID NO: 502598 - DNA, 20 bp, Artificial
  CRISPR gRNA sequence
tataccttacttaagtcacc

SEQ ID NO: 502599 - DNA, 20 bp, Artificial
  CRISPR gRNA sequence
acttaagtcacctctaaatt

SEQ ID NO: 502600 - DNA, 20 bp, Artificial
  CRISPR gRNA sequence
cttaagtcacctctaaatta

SEQ ID NO: 502601 - DNA, 20 bp, Artificial
  CRISPR gRNA sequence
aagtcacctctaaattagtt

SEQ ID NO: 502602 - DNA, 20 bp, Artificial
  CRISPR gRNA sequence
agtcacctctaaattagtta

SEQ ID NO: 502603 - DNA, 20 bp, Artificial
  CRISPR gRNA sequence
taaattagttataatgcctg

SEQ ID NO: 502604 - DNA, 20 bp, Artificial
  CRISPR gRNA sequence
aattagttataatgcctgat

SEQ ID NO: 502605 - DNA, 20 bp, Artificial
  CRISPR gRNA sequence
gttataatgcctgatacaat

SEQ ID NO: 502606 - DNA, 20 bp, Artificial
  CRISPR gRNA sequence
taatgcctgatacaatgtaa

SEQ ID NO: 502607 - DNA, 20 bp, Artificial
  CRISPR gRNA sequence
atacaatgtaaatgctattt

SEQ ID NO: 502608 - DNA, 20 bp, Artificial
  CRISPR gRNA sequence
tttaaatagttgttatactg

SEQ ID NO: 502609 - DNA, 20 bp, Artificial
  CRISPR gRNA sequence
aaatagttgttatactgtat

SEQ ID NO: 502610 - DNA, 20 bp, Artificial
  CRISPR gRNA sequence
aatagttgttatactgtatt

SEQ ID NO: 502611 - DNA, 20 bp, Artificial
  CRISPR gRNA sequence
ttatactgtattgtttaggg

SEQ ID NO: 502612 - DNA, 20 bp, Artificial
  CRISPR gRNA sequence
tactgtattgtttagggaat

SEQ ID NO: 502613 - DNA, 20 bp, Artificial
  CRISPR gRNA sequence
tattgtttagggaataatga

SEQ ID NO: 502614 - DNA, 20 bp, Artificial
  CRISPR gRNA sequence
tttagggaataatgacaagg

SEQ ID NO: 502615 - DNA, 20 bp, Artificial
  CRISPR gRNA sequence
agggaataatgacaaggaaa

SEQ ID NO: 502616 - DNA, 20 bp, Artificial
  CRISPR gRNA sequence
gggaataatgacaaggaaaa

SEQ ID NO: 502617 - DNA, 20 bp, Artificial
  CRISPR gRNA sequence
tacatattcaatacacatgc

SEQ ID NO: 502618 - DNA, 20 bp, Artificial
  CRISPR gRNA sequence
catattcaatacacatgcat

SEQ ID NO: 502619 - DNA, 20 bp, Artificial
  CRISPR gRNA sequence
aatacacatgcatttttttt

SEQ ID NO: 502620 - DNA, 20 bp, Artificial
  CRISPR gRNA sequence
tttttccctgaatattctgg

SEQ ID NO: 502621 - DNA, 20 bp, Artificial
  CRISPR gRNA sequence
ttttccctgaatattctgga

SEQ ID NO: 502622 - DNA, 20 bp, Artificial
  CRISPR gRNA sequence
tttccctgaatattctggat

SEQ ID NO: 502623 - DNA, 20 bp, Artificial
  CRISPR gRNA sequence
ttccctgaatattctggatc

SEQ ID NO: 502624 - DNA, 20 bp, Artificial
  CRISPR gRNA sequence
tccctgaatattctggatcc

SEQ ID NO: 502625 - DNA, 20 bp, Artificial
  CRISPR gRNA sequence
ccctgaatattctggatcca

SEQ ID NO: 502626 - DNA, 20 bp, Artificial
  CRISPR gRNA sequence
cctgaatattctggatccac

SEQ ID NO: 502627 - DNA, 20 bp, Artificial
  CRISPR gRNA sequence
aatattctggatccacaatt

SEQ ID NO: 502628 - DNA, 20 bp, Artificial
  CRISPR gRNA sequence
tggatccacaattcattgaa

SEQ ID NO: 502629 - DNA, 20 bp, Artificial
  CRISPR gRNA sequence
gatccacaattcattgaatc

SEQ ID NO: 502630 - DNA, 20 bp, Artificial
  CRISPR gRNA sequence
attgaatccacattgtggaa

SEQ ID NO: 502631 - DNA, 20 bp, Artificial
  CRISPR gRNA sequence
aatccacattgtggaactca

SEQ ID NO: 502632 - DNA, 20 bp, Artificial
  CRISPR gRNA sequence
tggaactcaaaactttggag

SEQ ID NO: 502633 - DNA, 20 bp, Artificial
  CRISPR gRNA sequence
aaaactttggagggcaactg

SEQ ID NO: 502634 - DNA, 20 bp, Artificial
  CRISPR gRNA sequence
tggagggcaactgtattaga

SEQ ID NO: 502635 - DNA, 20 bp, Artificial
  CRISPR gRNA sequence
ggagggcaactgtattagat

SEQ ID NO: 502636 - DNA, 20 bp, Artificial
  CRISPR gRNA sequence
gagggcaactgtattagatc

SEQ ID NO: 502637 - DNA, 20 bp, Artificial
  CRISPR gRNA sequence
tattagatcatgtaattaac

SEQ ID NO: 502638 - DNA, 20 bp, Artificial
  CRISPR gRNA sequence
gatcatgtaattaaccccta

SEQ ID NO: 502639 - DNA, 20 bp, Artificial
  CRISPR gRNA sequence
acccctataggtagataacg

SEQ ID NO: 502640 - DNA, 20 bp, Artificial
  CRISPR gRNA sequence
taggtagataacgttatccc

SEQ ID NO: 502641 - DNA, 20 bp, Artificial
  CRISPR gRNA sequence
tccccttttacaggtgagaa

SEQ ID NO: 502642 - DNA, 20 bp, Artificial
  CRISPR gRNA sequence
ttacaggtgagaaaatctaa

SEQ ID NO: 502643 - DNA, 20 bp, Artificial
  CRISPR gRNA sequence
tacaggtgagaaaatctaag

SEQ ID NO: 502644 - DNA, 20 bp, Artificial
  CRISPR gRNA sequence
acaggtgagaaaatctaaga

SEQ ID NO: 502645 - DNA, 20 bp, Artificial
  CRISPR gRNA sequence
caggtgagaaaatctaagag

SEQ ID NO: 502646 - DNA, 20 bp, Artificial
  CRISPR gRNA sequence
agaggctctgaggcatcttc

SEQ ID NO: 502647 - DNA, 20 bp, Artificial
  CRISPR gRNA sequence
tgaggcatcttccaaaaata

SEQ ID NO: 502648 - DNA, 20 bp, Artificial
  CRISPR gRNA sequence
aggcatcttccaaaaataag

SEQ ID NO: 502649 - DNA, 20 bp, Artificial
  CRISPR gRNA sequence
ccaaaaataagatgacttga

SEQ ID NO: 502650 - DNA, 20 bp, Artificial
  CRISPR gRNA sequence
caaaaataagatgacttgag

SEQ ID NO: 502651 - DNA, 20 bp, Artificial
  CRISPR gRNA sequence
gagaggcccagagaggttaa

SEQ ID NO: 502652 - DNA, 20 bp, Artificial
  CRISPR gRNA sequence
agaggcccagagaggttaaa

SEQ ID NO: 502653 - DNA, 20 bp, Artificial
  CRISPR gRNA sequence
aataaatagtgcagagctca

SEQ ID NO: 502654 - DNA, 20 bp, Artificial
  CRISPR gRNA sequence
acagggttagaatttgagcc

SEQ ID NO: 502655 - DNA, 20 bp, Artificial
  CRISPR gRNA sequence
gaatttgagccaggcctgtc

SEQ ID NO: 502656 - DNA, 20 bp, Artificial
  CRISPR gRNA sequence
gagccaggcctgtctgatat

SEQ ID NO: 502657 - DNA, 20 bp, Artificial
  CRISPR gRNA sequence
agccaggcctgtctgatata

SEQ ID NO: 502658 - DNA, 20 bp, Artificial
  CRISPR gRNA sequence
tctgatatatctatgctctt

SEQ ID NO: 502659 - DNA, 20 bp, Artificial
  CRISPR gRNA sequence
atatatctatgctcttggca

SEQ ID NO: 502660 - DNA, 20 bp, Artificial
  CRISPR gRNA sequence
tgctcttggcatcactcaga

SEQ ID NO: 502661 - DNA, 20 bp, Artificial
  CRISPR gRNA sequence
ttggcatcactcagaggagg

SEQ ID NO: 502662 - DNA, 20 bp, Artificial
  CRISPR gRNA sequence
ggcatcactcagaggaggtt

SEQ ID NO: 502663 - DNA, 20 bp, Artificial
  CRISPR gRNA sequence
gcatcactcagaggaggtta

SEQ ID NO: 502664 - DNA, 20 bp, Artificial
  CRISPR gRNA sequence
agaggaggttaaccaaatga

SEQ ID NO: 502665 - DNA, 20 bp, Artificial
  CRISPR gRNA sequence
accaaatgagcaaagagaaa

SEQ ID NO: 502666 - DNA, 20 bp, Artificial
  CRISPR gRNA sequence
gaccgtgagttctcagagca

SEQ ID NO: 502667 - DNA, 20 bp, Artificial
  CRISPR gRNA sequence
accgtgagttctcagagcac

SEQ ID NO: 502668 - DNA, 20 bp, Artificial
  CRISPR gRNA sequence
tcagagcacgaggcaatcag

SEQ ID NO: 502669 - DNA, 20 bp, Artificial
  CRISPR gRNA sequence
agagcacgaggcaatcagcc

SEQ ID NO: 502670 - DNA, 20 bp, Artificial
  CRISPR gRNA sequence
tgaggcagcccctgcagcag

SEQ ID NO: 502671 - DNA, 20 bp, Artificial
  CRISPR gRNA sequence
gaggcagcccctgcagcagg

SEQ ID NO: 502672 - DNA, 20 bp, Artificial
  CRISPR gRNA sequence
aggcagcccctgcagcaggc

SEQ ID NO: 502673 - DNA, 20 bp, Artificial
  CRISPR gRNA sequence
cagcaggcaggtgggaagga

SEQ ID NO: 502674 - DNA, 20 bp, Artificial
  CRISPR gRNA sequence
acagctcagttctcacgcct

SEQ ID NO: 502675 - DNA, 20 bp, Artificial
  CRISPR gRNA sequence
agttctcacgccttctgtat

SEQ ID NO: 502676 - DNA, 20 bp, Artificial
  CRISPR gRNA sequence
tcacgccttctgtattcctc

SEQ ID NO: 502677 - DNA, 20 bp, Artificial
  CRISPR gRNA sequence
acgccttctgtattcctcag

SEQ ID NO: 502678 - DNA, 20 bp, Artificial
  CRISPR gRNA sequence
ctgtattcctcagaattcag

SEQ ID NO: 502679 - DNA, 20 bp, Artificial
  CRISPR gRNA sequence
tgtattcctcagaattcaga

SEQ ID NO: 502680 - DNA, 20 bp, Artificial
  CRISPR gRNA sequence
tattcctcagaattcagatt

SEQ ID NO: 502681 - DNA, 20 bp, Artificial
  CRISPR gRNA sequence
ctcagaattcagattttggc

SEQ ID NO: 502682 - DNA, 20 bp, Artificial
  CRISPR gRNA sequence
agaattcagattttggccgt

SEQ ID NO: 502683 - DNA, 20 bp, Artificial
  CRISPR gRNA sequence
agattttggccgtttttggt

SEQ ID NO: 502684 - DNA, 20 bp, Artificial
  CRISPR gRNA sequence
tggccgtttttggtgatcat

SEQ ID NO: 502685 - DNA, 20 bp, Artificial
  CRISPR gRNA sequence
ggccgtttttggtgatcatc

SEQ ID NO: 502686 - DNA, 20 bp, Artificial
  CRISPR gRNA sequence
gccgtttttggtgatcatcg

SEQ ID NO: 502687 - DNA, 20 bp, Artificial
  CRISPR gRNA sequence
ttggtgatcatcgtgattct

SEQ ID NO: 502688 - DNA, 20 bp, Artificial
  CRISPR gRNA sequence
tggtgatcatcgtgattcta

SEQ ID NO: 502689 - DNA, 20 bp, Artificial
  CRISPR gRNA sequence
ggtgatcatcgtgattctaa

SEQ ID NO: 502690 - DNA, 20 bp, Artificial
  CRISPR gRNA sequence
gtgatcatcgtgattctaag

SEQ ID NO: 502691 - DNA, 20 bp, Artificial
  CRISPR gRNA sequence
taagcgcactgttccttggc

SEQ ID NO: 502692 - DNA, 20 bp, Artificial
  CRISPR gRNA sequence
agcgcactgttccttggcac

SEQ ID NO: 502693 - DNA, 20 bp, Artificial
  CRISPR gRNA sequence
ttccttggcacccttgcctg

SEQ ID NO: 502694 - DNA, 20 bp, Artificial
  CRISPR gRNA sequence
cttggcacccttgcctgctt

SEQ ID NO: 502695 - DNA, 20 bp, Artificial
  CRISPR gRNA sequence
ggcacccttgcctgcttctg

SEQ ID NO: 502696 - DNA, 20 bp, Artificial
  CRISPR gRNA sequence
gcacccttgcctgcttctgt

SEQ ID NO: 502697 - DNA, 20 bp, Artificial
  CRISPR gRNA sequence
gcctgcttctgtgtgtggag

SEQ ID NO: 502698 - DNA, 20 bp, Artificial
  CRISPR gRNA sequence
cctgcttctgtgtgtggagg

SEQ ID NO: 502699 - DNA, 20 bp, Artificial
  CRISPR gRNA sequence
cttctgtgtgtggaggagaa

SEQ ID NO: 502700 - DNA, 20 bp, Artificial
  CRISPR gRNA sequence
ctgtgtgtggaggagaaaga

SEQ ID NO: 502701 - DNA, 20 bp, Artificial
  CRISPR gRNA sequence
tgtgtgtggaggagaaagag

SEQ ID NO: 502702 - DNA, 20 bp, Artificial
  CRISPR gRNA sequence
tgtgtggaggagaaagagga

SEQ ID NO: 502703 - DNA, 20 bp, Artificial
  CRISPR gRNA sequence
agggtggtgctcctgcctga

SEQ ID NO: 502704 - DNA, 20 bp, Artificial
  CRISPR gRNA sequence
gggtggtgctcctgcctgag

SEQ ID NO: 502705 - DNA, 20 bp, Artificial
  CRISPR gRNA sequence
ctgcctgaggccttggatcc

SEQ ID NO: 502706 - DNA, 20 bp, Artificial
  CRISPR gRNA sequence
cctgaggccttggatcctgt

SEQ ID NO: 502707 - DNA, 20 bp, Artificial
  CRISPR gRNA sequence
aggccttggatcctgtgact

SEQ ID NO: 502708 - DNA, 20 bp, Artificial
  CRISPR gRNA sequence
ggatcctgtgactttgtcct

SEQ ID NO: 502709 - DNA, 20 bp, Artificial
  CRISPR gRNA sequence
gatcctgtgactttgtcctg

SEQ ID NO: 502710 - DNA, 20 bp, Artificial
  CRISPR gRNA sequence
tgactttgtcctgcgtccag

SEQ ID NO: 502711 - DNA, 20 bp, Artificial
  CRISPR gRNA sequence
tgtcctgcgtccagtgggat

SEQ ID NO: 502712 - DNA, 20 bp, Artificial
  CRISPR gRNA sequence
gtcctgcgtccagtgggatg

SEQ ID NO: 502713 - DNA, 20 bp, Artificial
  CRISPR gRNA sequence
tcctgcgtccagtgggatgt

SEQ ID NO: 502714 - DNA, 20 bp, Artificial
  CRISPR gRNA sequence
cgtccagtgggatgtgtctg

SEQ ID NO: 502715 - DNA, 20 bp, Artificial
  CRISPR gRNA sequence
ggagcacagcatctcctttt

SEQ ID NO: 502716 - DNA, 20 bp, Artificial
  CRISPR gRNA sequence
cttttcctcaacgagctttg

SEQ ID NO: 502717 - DNA, 20 bp, Artificial
  CRISPR gRNA sequence
ttcctcaacgagctttggta

SEQ ID NO: 502718 - DNA, 20 bp, Artificial
  CRISPR gRNA sequence
tcctcaacgagctttggtat

SEQ ID NO: 502719 - DNA, 20 bp, Artificial
  CRISPR gRNA sequence
cctcaacgagctttggtatg

SEQ ID NO: 502720 - DNA, 20 bp, Artificial
  CRISPR gRNA sequence
ctcaacgagctttggtatgt

SEQ ID NO: 502721 - DNA, 20 bp, Artificial
  CRISPR gRNA sequence
aacgagctttggtatgtttg

SEQ ID NO: 502722 - DNA, 20 bp, Artificial
  CRISPR gRNA sequence
tggtatgtttgtgtgcgtgg

SEQ ID NO: 502723 - DNA, 20 bp, Artificial
  CRISPR gRNA sequence
ggtatgtttgtgtgcgtggt

SEQ ID NO: 502724 - DNA, 20 bp, Artificial
  CRISPR gRNA sequence
gtatgtttgtgtgcgtggtg

SEQ ID NO: 502725 - DNA, 20 bp, Artificial
  CRISPR gRNA sequence
gtgtgcgtggtggcgggggg

SEQ ID NO: 502726 - DNA, 20 bp, Artificial
  CRISPR gRNA sequence
tgtgcgtggtggcggggggc

SEQ ID NO: 502727 - DNA, 20 bp, Artificial
  CRISPR gRNA sequence
ctaggctctctctcccagtt

SEQ ID NO: 502728 - DNA, 20 bp, Artificial
  CRISPR gRNA sequence
ggctctctctcccagttcat

SEQ ID NO: 502729 - DNA, 20 bp, Artificial
  CRISPR gRNA sequence
tctctcccagttcatgcctt

SEQ ID NO: 502730 - DNA, 20 bp, Artificial
  CRISPR gRNA sequence
tctcccagttcatgccttct

SEQ ID NO: 502731 - DNA, 20 bp, Artificial
  CRISPR gRNA sequence
tcccagttcatgccttctga

SEQ ID NO: 502732 - DNA, 20 bp, Artificial
  CRISPR gRNA sequence
ccagttcatgccttctgatc

SEQ ID NO: 502733 - DNA, 20 bp, Artificial
  CRISPR gRNA sequence
atgccttctgatcccaatgc

SEQ ID NO: 502734 - DNA, 20 bp, Artificial
  CRISPR gRNA sequence
ctgatcccaatgcgcagatt

SEQ ID NO: 502735 - DNA, 20 bp, Artificial
  CRISPR gRNA sequence
tgatcccaatgcgcagattt

SEQ ID NO: 502736 - DNA, 20 bp, Artificial
  CRISPR gRNA sequence
atcccaatgcgcagatttcc

SEQ ID NO: 502737 - DNA, 20 bp, Artificial
  CRISPR gRNA sequence
ccctgtagacagctggtttg

SEQ ID NO: 502738 - DNA, 20 bp, Artificial
  CRISPR gRNA sequence
cctgtagacagctggtttgg

SEQ ID NO: 502739 - DNA, 20 bp, Artificial
  CRISPR gRNA sequence
tagacagctggtttgggagg

SEQ ID NO: 502740 - DNA, 20 bp, Artificial
  CRISPR gRNA sequence
gtttgggaggaggtgtggga

SEQ ID NO: 502741 - DNA, 20 bp, Artificial
  CRISPR gRNA sequence
gggaggaggtgtgggagggg

SEQ ID NO: 502742 - DNA, 20 bp, Artificial
  CRISPR gRNA sequence
ggaggaggtgtgggaggggc

SEQ ID NO: 502743 - DNA, 20 bp, Artificial
  CRISPR gRNA sequence
ggttgctgcctctgtgctct

SEQ ID NO: 502744 - DNA, 20 bp, Artificial
  CRISPR gRNA sequence
ctgcctctgtgctctttggg

SEQ ID NO: 502745 - DNA, 20 bp, Artificial
  CRISPR gRNA sequence
cctctgtgctctttggggtt

SEQ ID NO: 502746 - DNA, 20 bp, Artificial
  CRISPR gRNA sequence
tgtgctctttggggttcctg

SEQ ID NO: 502747 - DNA, 20 bp, Artificial
  CRISPR gRNA sequence
tgctctttggggttcctggg

SEQ ID NO: 502748 - DNA, 20 bp, Artificial
  CRISPR gRNA sequence
tttggggttcctgggaagag

SEQ ID NO: 502749 - DNA, 20 bp, Artificial
  CRISPR gRNA sequence
tggggttcctgggaagagca

SEQ ID NO: 502750 - DNA, 20 bp, Artificial
  CRISPR gRNA sequence
ggggttcctgggaagagcat

SEQ ID NO: 502751 - DNA, 20 bp, Artificial
  CRISPR gRNA sequence
gggttcctgggaagagcatt

SEQ ID NO: 502752 - DNA, 20 bp, Artificial
  CRISPR gRNA sequence
ctgggaagagcattaacttg

SEQ ID NO: 502753 - DNA, 20 bp, Artificial
  CRISPR gRNA sequence
ggaagagcattaacttgcct

SEQ ID NO: 502754 - DNA, 20 bp, Artificial
  CRISPR gRNA sequence
acttgcctcctttctagaac

SEQ ID NO: 502755 - DNA, 20 bp, Artificial
  CRISPR gRNA sequence
gcctcctttctagaaccttt

SEQ ID NO: 502756 - DNA, 20 bp, Artificial
  CRISPR gRNA sequence
cctcctttctagaacctttt

SEQ ID NO: 502757 - DNA, 20 bp, Artificial
  CRISPR gRNA sequence
ctttctagaaccttttttaa

SEQ ID NO: 502758 - DNA, 20 bp, Artificial
  CRISPR gRNA sequence
tctagaaccttttttaaggt

SEQ ID NO: 502759 - DNA, 20 bp, Artificial
  CRISPR gRNA sequence
ctagaaccttttttaaggtt

SEQ ID NO: 502760 - DNA, 20 bp, Artificial
  CRISPR gRNA sequence
tagaaccttttttaaggttt

SEQ ID NO: 502761 - DNA, 20 bp, Artificial
  CRISPR gRNA sequence
gaaccttttttaaggtttgg

SEQ ID NO: 502762 - DNA, 20 bp, Artificial
  CRISPR gRNA sequence
ttttaaggtttggccatttg

SEQ ID NO: 502763 - DNA, 20 bp, Artificial
  CRISPR gRNA sequence
tttaaggtttggccatttgg

SEQ ID NO: 502764 - DNA, 20 bp, Artificial
  CRISPR gRNA sequence
ttaaggtttggccatttggg

SEQ ID NO: 502765 - DNA, 20 bp, Artificial
  CRISPR gRNA sequence
taaggtttggccatttgggg

SEQ ID NO: 502766 - DNA, 20 bp, Artificial
  CRISPR gRNA sequence
aaggtttggccatttggggt

SEQ ID NO: 502767 - DNA, 20 bp, Artificial
  CRISPR gRNA sequence
aggtttggccatttggggta

SEQ ID NO: 502768 - DNA, 20 bp, Artificial
  CRISPR gRNA sequence
ggccatttggggtagaggtg

SEQ ID NO: 502769 - DNA, 20 bp, Artificial
  CRISPR gRNA sequence
gccatttggggtagaggtgg

SEQ ID NO: 502770 - DNA, 20 bp, Artificial
  CRISPR gRNA sequence
ggggtagaggtgggacctgt

SEQ ID NO: 502771 - DNA, 20 bp, Artificial
  CRISPR gRNA sequence
gggtagaggtgggacctgtt

SEQ ID NO: 502772 - DNA, 20 bp, Artificial
  CRISPR gRNA sequence
ttagaagcaaaagcccttct

SEQ ID NO: 502773 - DNA, 20 bp, Artificial
  CRISPR gRNA sequence
gaagcaaaagcccttctgga

SEQ ID NO: 502774 - DNA, 20 bp, Artificial
  CRISPR gRNA sequence
ctggaggtttctgcagctct

SEQ ID NO: 502775 - DNA, 20 bp, Artificial
  CRISPR gRNA sequence
tggaggtttctgcagctctg

SEQ ID NO: 502776 - DNA, 20 bp, Artificial
  CRISPR gRNA sequence
gaggtttctgcagctctgct

SEQ ID NO: 502777 - DNA, 20 bp, Artificial
  CRISPR gRNA sequence
ctgcagctctgctctttgtt

SEQ ID NO: 502778 - DNA, 20 bp, Artificial
  CRISPR gRNA sequence
tgcagctctgctctttgttt

SEQ ID NO: 502779 - DNA, 20 bp, Artificial
  CRISPR gRNA sequence
cagctctgctctttgttttc

SEQ ID NO: 502780 - DNA, 20 bp, Artificial
  CRISPR gRNA sequence
tgctctttgttttcttcctc

SEQ ID NO: 502781 - DNA, 20 bp, Artificial
  CRISPR gRNA sequence
ctctttgttttcttcctccc

SEQ ID NO: 502782 - DNA, 20 bp, Artificial
  CRISPR gRNA sequence
tttgttttcttcctccctca

SEQ ID NO: 502783 - DNA, 20 bp, Artificial
  CRISPR gRNA sequence
tgttttcttcctccctcaga

SEQ ID NO: 502784 - DNA, 20 bp, Artificial
  CRISPR gRNA sequence
gttttcttcctccctcagag

SEQ ID NO: 502785 - DNA, 20 bp, Artificial
  CRISPR gRNA sequence
ttttcttcctccctcagaga

SEQ ID NO: 502786 - DNA, 20 bp, Artificial
  CRISPR gRNA sequence
tcttcctccctcagagacca

SEQ ID NO: 502787 - DNA, 20 bp, Artificial
  CRISPR gRNA sequence
cttcctccctcagagaccag

SEQ ID NO: 502788 - DNA, 20 bp, Artificial
  CRISPR gRNA sequence
ttcctccctcagagaccagt

SEQ ID NO: 502789 - DNA, 20 bp, Artificial
  CRISPR gRNA sequence
cctccctcagagaccagtcc

SEQ ID NO: 502790 - DNA, 20 bp, Artificial
  CRISPR gRNA sequence
ctccctcagagaccagtccc

SEQ ID NO: 502791 - DNA, 20 bp, Artificial
  CRISPR gRNA sequence
cctcagagaccagtcccaag

SEQ ID NO: 502792 - DNA, 20 bp, Artificial
  CRISPR gRNA sequence
agagaccagtcccaaggaat

SEQ ID NO: 502793 - DNA, 20 bp, Artificial
  CRISPR gRNA sequence
ttgacaatttacgaagatgt

SEQ ID NO: 502794 - DNA, 20 bp, Artificial
  CRISPR gRNA sequence
tgacaatttacgaagatgtc

SEQ ID NO: 502795 - DNA, 20 bp, Artificial
  CRISPR gRNA sequence
gacaatttacgaagatgtca

SEQ ID NO: 502796 - DNA, 20 bp, Artificial
  CRISPR gRNA sequence
acaatttacgaagatgtcaa

SEQ ID NO: 502797 - DNA, 20 bp, Artificial
  CRISPR gRNA sequence
acgaagatgtcaaggatctg

SEQ ID NO: 502798 - DNA, 20 bp, Artificial
  CRISPR gRNA sequence
cgaagatgtcaaggatctga

SEQ ID NO: 502799 - DNA, 20 bp, Artificial
  CRISPR gRNA sequence
aaaaccaggagaaatcacgt

SEQ ID NO: 502800 - DNA, 20 bp, Artificial
  CRISPR gRNA sequence
gggtctctctcagctggctt

SEQ ID NO: 502801 - DNA, 20 bp, Artificial
  CRISPR gRNA sequence
tctcagctggcttggaaaat

SEQ ID NO: 502802 - DNA, 20 bp, Artificial
  CRISPR gRNA sequence
tcagctggcttggaaaatgc

SEQ ID NO: 502803 - DNA, 20 bp, Artificial
  CRISPR gRNA sequence
agctggcttggaaaatgctc

SEQ ID NO: 502804 - DNA, 20 bp, Artificial
  CRISPR gRNA sequence
gcttggaaaatgctctttca

SEQ ID NO: 502805 - DNA, 20 bp, Artificial
  CRISPR gRNA sequence
ggaaaatgctctttcaatga

SEQ ID NO: 502806 - DNA, 20 bp, Artificial
  CRISPR gRNA sequence
gaaaatgctctttcaatgat

SEQ ID NO: 502807 - DNA, 20 bp, Artificial
  CRISPR gRNA sequence
tttcaatgatggttattcag

SEQ ID NO: 502808 - DNA, 20 bp, Artificial
  CRISPR gRNA sequence
tcaatgatggttattcagag

SEQ ID NO: 502809 - DNA, 20 bp, Artificial
  CRISPR gRNA sequence
caatgatggttattcagagc

SEQ ID NO: 502810 - DNA, 20 bp, Artificial
  CRISPR gRNA sequence
aatgatggttattcagagca

SEQ ID NO: 502811 - DNA, 20 bp, Artificial
  CRISPR gRNA sequence
ttcagagcagagggacaaaa

SEQ ID NO: 502812 - DNA, 20 bp, Artificial
  CRISPR gRNA sequence
agagcagagggacaaaaagg

SEQ ID NO: 502813 - DNA, 20 bp, Artificial
  CRISPR gRNA sequence
aacgactgtccttttgatgt

SEQ ID NO: 502814 - DNA, 20 bp, Artificial
  CRISPR gRNA sequence
tccttttgatgtgaccctca

SEQ ID NO: 502815 - DNA, 20 bp, Artificial
  CRISPR gRNA sequence
ttgatgtgaccctcagccct

SEQ ID NO: 502816 - DNA, 20 bp, Artificial
  CRISPR gRNA sequence
tgatgtgaccctcagccctt

SEQ ID NO: 502817 - DNA, 20 bp, Artificial
  CRISPR gRNA sequence
gatgtgaccctcagcccttc

SEQ ID NO: 502818 - DNA, 20 bp, Artificial
  CRISPR gRNA sequence
atgtgaccctcagcccttcc

SEQ ID NO: 502819 - DNA, 20 bp, Artificial
  CRISPR gRNA sequence
agcccttccccatctatctt

SEQ ID NO: 502820 - DNA, 20 bp, Artificial
  CRISPR gRNA sequence
ccccatctatcttttctcca

SEQ ID NO: 502821 - DNA, 20 bp, Artificial
  CRISPR gRNA sequence
cccatctatcttttctccac

SEQ ID NO: 502822 - DNA, 20 bp, Artificial
  CRISPR gRNA sequence
tcttttctccacctgcttcc

SEQ ID NO: 502823 - DNA, 20 bp, Artificial
  CRISPR gRNA sequence
ttctccacctgcttcctagt

SEQ ID NO: 502824 - DNA, 20 bp, Artificial
  CRISPR gRNA sequence
tctccacctgcttcctagtt

SEQ ID NO: 502825 - DNA, 20 bp, Artificial
  CRISPR gRNA sequence
ctccacctgcttcctagttc

SEQ ID NO: 502826 - DNA, 20 bp, Artificial
  CRISPR gRNA sequence
tccacctgcttcctagttct

SEQ ID NO: 502827 - DNA, 20 bp, Artificial
  CRISPR gRNA sequence
cacctgcttcctagttctgg

SEQ ID NO: 502828 - DNA, 20 bp, Artificial
  CRISPR gRNA sequence
cttcctagttctggtgatgg

SEQ ID NO: 502829 - DNA, 20 bp, Artificial
  CRISPR gRNA sequence
cctagttctggtgatggagg

SEQ ID NO: 502830 - DNA, 20 bp, Artificial
  CRISPR gRNA sequence
ctagttctggtgatggagga

SEQ ID NO: 502831 - DNA, 20 bp, Artificial
  CRISPR gRNA sequence
gttctggtgatggaggaaaa

SEQ ID NO: 502832 - DNA, 20 bp, Artificial
  CRISPR gRNA sequence
tggtgatggaggaaaagagg

SEQ ID NO: 502833 - DNA, 20 bp, Artificial
  CRISPR gRNA sequence
gtgatggaggaaaagaggaa

SEQ ID NO: 502834 - DNA, 20 bp, Artificial
  CRISPR gRNA sequence
aaggggcatcttggtgcaga

SEQ ID NO: 502835 - DNA, 20 bp, Artificial
  CRISPR gRNA sequence
ggtgcagaattgcacctgct

SEQ ID NO: 502836 - DNA, 20 bp, Artificial
  CRISPR gRNA sequence
gtgcagaattgcacctgctg

SEQ ID NO: 502837 - DNA, 20 bp, Artificial
  CRISPR gRNA sequence
cacctgctgagaagggatgg

SEQ ID NO: 502838 - DNA, 20 bp, Artificial
  CRISPR gRNA sequence
ctgagaagggatggagcaca

SEQ ID NO: 502839 - DNA, 20 bp, Artificial
  CRISPR gRNA sequence
agaagggatggagcacaaca

SEQ ID NO: 502840 - DNA, 20 bp, Artificial
  CRISPR gRNA sequence
ctgtggtatttgttgtctga

SEQ ID NO: 502841 - DNA, 20 bp, Artificial
  CRISPR gRNA sequence
tggtatttgttgtctgacca

SEQ ID NO: 502842 - DNA, 20 bp, Artificial
  CRISPR gRNA sequence
gttgtctgaccacaaattct

SEQ ID NO: 502843 - DNA, 20 bp, Artificial
  CRISPR gRNA sequence
ttgtctgaccacaaattctt

SEQ ID NO: 502844 - DNA, 20 bp, Artificial
  CRISPR gRNA sequence
tctgaccacaaattcttttt

SEQ ID NO: 502845 - DNA, 20 bp, Artificial
  CRISPR gRNA sequence
accacaaattctttttccta

SEQ ID NO: 502846 - DNA, 20 bp, Artificial
  CRISPR gRNA sequence
tttttcctaatgagtcaggg

SEQ ID NO: 502847 - DNA, 20 bp, Artificial
  CRISPR gRNA sequence
tttcctaatgagtcagggct

SEQ ID NO: 502848 - DNA, 20 bp, Artificial
  CRISPR gRNA sequence
ttcctaatgagtcagggctt

SEQ ID NO: 502849 - DNA, 20 bp, Artificial
  CRISPR gRNA sequence
tcctaatgagtcagggctta

SEQ ID NO: 502850 - DNA, 20 bp, Artificial
  CRISPR gRNA sequence
cctaatgagtcagggcttac

SEQ ID NO: 502851 - DNA, 20 bp, Artificial
  CRISPR gRNA sequence
ctaatgagtcagggcttaca

SEQ ID NO: 502852 - DNA, 20 bp, Artificial
  CRISPR gRNA sequence
atgagtcagggcttacattc

SEQ ID NO: 502853 - DNA, 20 bp, Artificial
  CRISPR gRNA sequence
acattcatgagtcccttaat

SEQ ID NO: 502854 - DNA, 20 bp, Artificial
  CRISPR gRNA sequence
cattcatgagtcccttaatg

SEQ ID NO: 502855 - DNA, 20 bp, Artificial
  CRISPR gRNA sequence
atgagtcccttaatggtgac

SEQ ID NO: 502856 - DNA, 20 bp, Artificial
  CRISPR gRNA sequence
aatggtgacacaggctggga

SEQ ID NO: 502857 - DNA, 20 bp, Artificial
  CRISPR gRNA sequence
atggtgacacaggctgggaa

SEQ ID NO: 502858 - DNA, 20 bp, Artificial
  CRISPR gRNA sequence
ggaagtgtgaccagccaaag

SEQ ID NO: 502859 - DNA, 20 bp, Artificial
  CRISPR gRNA sequence
tgtagctggctcaataggct

SEQ ID NO: 502860 - DNA, 20 bp, Artificial
  CRISPR gRNA sequence
gtagctggctcaataggctg

SEQ ID NO: 502861 - DNA, 20 bp, Artificial
  CRISPR gRNA sequence
tagctggctcaataggctgc

SEQ ID NO: 502862 - DNA, 20 bp, Artificial
  CRISPR gRNA sequence
gctcaataggctgcattcac

SEQ ID NO: 502863 - DNA, 20 bp, Artificial
  CRISPR gRNA sequence
aataggctgcattcacagcc

SEQ ID NO: 502864 - DNA, 20 bp, Artificial
  CRISPR gRNA sequence
cattcacagccttttggaag

SEQ ID NO: 502865 - DNA, 20 bp, Artificial
  CRISPR gRNA sequence
acagccttttggaagaagag

SEQ ID NO: 502866 - DNA, 20 bp, Artificial
  CRISPR gRNA sequence
ttggaagaagaggcctgagt

SEQ ID NO: 502867 - DNA, 20 bp, Artificial
  CRISPR gRNA sequence
tggaagaagaggcctgagtg

SEQ ID NO: 502868 - DNA, 20 bp, Artificial
  CRISPR gRNA sequence
ggaagaagaggcctgagtgt

SEQ ID NO: 502869 - DNA, 20 bp, Artificial
  CRISPR gRNA sequence
gaagaagaggcctgagtgtg

SEQ ID NO: 502870 - DNA, 20 bp, Artificial
  CRISPR gRNA sequence
agtgtggctgaggtactaga

SEQ ID NO: 502871 - DNA, 20 bp, Artificial
  CRISPR gRNA sequence
aggtactagagagagtaacc

SEQ ID NO: 502872 - DNA, 20 bp, Artificial
  CRISPR gRNA sequence
gagagagtaaccagcctggc

SEQ ID NO: 502873 - DNA, 20 bp, Artificial
  CRISPR gRNA sequence
gcacaaagcccaccagcctg

SEQ ID NO: 502874 - DNA, 20 bp, Artificial
  CRISPR gRNA sequence
agtaggctcctccaggagcc

SEQ ID NO: 502875 - DNA, 20 bp, Artificial
  CRISPR gRNA sequence
ctccaggagcctctcgcctg

SEQ ID NO: 502876 - DNA, 20 bp, Artificial
  CRISPR gRNA sequence
caggagcctctcgcctgctc

SEQ ID NO: 502877 - DNA, 20 bp, Artificial
  CRISPR gRNA sequence
tcgcctgctcttcgcagcag

SEQ ID NO: 502878 - DNA, 20 bp, Artificial
  CRISPR gRNA sequence
gcctgctcttcgcagcaggc

SEQ ID NO: 502879 - DNA, 20 bp, Artificial
  CRISPR gRNA sequence
ctcttcgcagcaggcagggg

SEQ ID NO: 502880 - DNA, 20 bp, Artificial
  CRISPR gRNA sequence
ttcgcagcaggcaggggcca

SEQ ID NO: 502881 - DNA, 20 bp, Artificial
  CRISPR gRNA sequence
cgcagcaggcaggggccaac

SEQ ID NO: 502882 - DNA, 20 bp, Artificial
  CRISPR gRNA sequence
gcagcaggcaggggccaact

SEQ ID NO: 502883 - DNA, 20 bp, Artificial
  CRISPR gRNA sequence
tgcctgtcatccaagaatta

SEQ ID NO: 502884 - DNA, 20 bp, Artificial
  CRISPR gRNA sequence
cctgtcatccaagaattaga

SEQ ID NO: 502885 - DNA, 20 bp, Artificial
  CRISPR gRNA sequence
tcatccaagaattagaagag

SEQ ID NO: 502886 - DNA, 20 bp, Artificial
  CRISPR gRNA sequence
gaagaggaggaaattgcaga

SEQ ID NO: 502887 - DNA, 20 bp, Artificial
  CRISPR gRNA sequence
cagagggcctgcagatgccc

SEQ ID NO: 502888 - DNA, 20 bp, Artificial
  CRISPR gRNA sequence
cagatgcccccactgctgtg

SEQ ID NO: 502889 - DNA, 20 bp, Artificial
  CRISPR gRNA sequence
ctgtgtctcgcttagggcag

SEQ ID NO: 502890 - DNA, 20 bp, Artificial
  CRISPR gRNA sequence
tgtctcgcttagggcagatg

SEQ ID NO: 502891 - DNA, 20 bp, Artificial
  CRISPR gRNA sequence
gcttagggcagatgtggtga

SEQ ID NO: 502892 - DNA, 20 bp, Artificial
  CRISPR gRNA sequence
agggcagatgtggtgacagg

SEQ ID NO: 502893 - DNA, 20 bp, Artificial
  CRISPR gRNA sequence
gggcagatgtggtgacaggc

SEQ ID NO: 502894 - DNA, 20 bp, Artificial
  CRISPR gRNA sequence
tgatggagcctaccaaactg

SEQ ID NO: 502895 - DNA, 20 bp, Artificial
  CRISPR gRNA sequence
atggagcctaccaaactgct

SEQ ID NO: 502896 - DNA, 20 bp, Artificial
  CRISPR gRNA sequence
ccaaactgctggcaggaagt

SEQ ID NO: 502897 - DNA, 20 bp, Artificial
  CRISPR gRNA sequence
ctggcaggaagtggggcagg

SEQ ID NO: 502898 - DNA, 20 bp, Artificial
  CRISPR gRNA sequence
gcaggaagtggggcagggtg

SEQ ID NO: 502899 - DNA, 20 bp, Artificial
  CRISPR gRNA sequence
ctttccactgccccctggcg

SEQ ID NO: 502900 - DNA, 20 bp, Artificial
  CRISPR gRNA sequence
tttccactgccccctggcgc

SEQ ID NO: 502901 - DNA, 20 bp, Artificial
  CRISPR gRNA sequence
tccactgccccctggcgctt

SEQ ID NO: 502902 - DNA, 20 bp, Artificial
  CRISPR gRNA sequence
ccactgccccctggcgcttt

SEQ ID NO: 502903 - DNA, 20 bp, Artificial
  CRISPR gRNA sequence
cactgccccctggcgctttg

SEQ ID NO: 502904 - DNA, 20 bp, Artificial
  CRISPR gRNA sequence
ccccctggcgctttgctgtg

SEQ ID NO: 502905 - DNA, 20 bp, Artificial
  CRISPR gRNA sequence
gcgctttgctgtggagaccc

SEQ ID NO: 502906 - DNA, 20 bp, Artificial
  CRISPR gRNA sequence
tgctgtggagacccagcagc

SEQ ID NO: 502907 - DNA, 20 bp, Artificial
  CRISPR gRNA sequence
gctgtggagacccagcagca

SEQ ID NO: 502908 - DNA, 20 bp, Artificial
  CRISPR gRNA sequence
ctgtggagacccagcagcac

SEQ ID NO: 502909 - DNA, 20 bp, Artificial
  CRISPR gRNA sequence
tggagacccagcagcacgca

SEQ ID NO: 502910 - DNA, 20 bp, Artificial
  CRISPR gRNA sequence
ttccgtgctggccacatacg

SEQ ID NO: 502911 - DNA, 20 bp, Artificial
  CRISPR gRNA sequence
ccgtgctggccacatacgtg

SEQ ID NO: 502912 - DNA, 20 bp, Artificial
  CRISPR gRNA sequence
cgtgctggccacatacgtga

SEQ ID NO: 502913 - DNA, 20 bp, Artificial
  CRISPR gRNA sequence
gccacatacgtgaggccctg

SEQ ID NO: 502914 - DNA, 20 bp, Artificial
  CRISPR gRNA sequence
tgcagcctcgcagagcaggc

SEQ ID NO: 502915 - DNA, 20 bp, Artificial
  CRISPR gRNA sequence
gcagagcaggcaagcatcct

SEQ ID NO: 502916 - DNA, 20 bp, Artificial
  CRISPR gRNA sequence
tcccagatgcctctgggttc

SEQ ID NO: 502917 - DNA, 20 bp, Artificial
  CRISPR gRNA sequence
ccagatgcctctgggttcag

SEQ ID NO: 502918 - DNA, 20 bp, Artificial
  CRISPR gRNA sequence
tgggttcagaggctgttaga

SEQ ID NO: 502919 - DNA, 20 bp, Artificial
  CRISPR gRNA sequence
ggttcagaggctgttagagc

SEQ ID NO: 502920 - DNA, 20 bp, Artificial
  CRISPR gRNA sequence
agaggctgttagagcagctc

SEQ ID NO: 502921 - DNA, 20 bp, Artificial
  CRISPR gRNA sequence
ttagagcagctccccatgcc

SEQ ID NO: 502922 - DNA, 20 bp, Artificial
  CRISPR gRNA sequence
gagcagctccccatgcctgt

SEQ ID NO: 502923 - DNA, 20 bp, Artificial
  CRISPR gRNA sequence
cccatgcctgtttttttatt

SEQ ID NO: 502924 - DNA, 20 bp, Artificial
  CRISPR gRNA sequence
tttttttatttttatcttta

SEQ ID NO: 502925 - DNA, 20 bp, Artificial
  CRISPR gRNA sequence
ttttatttttatctttattt

SEQ ID NO: 502926 - DNA, 20 bp, Artificial
  CRISPR gRNA sequence
tttatttttatctttattta

SEQ ID NO: 502927 - DNA, 20 bp, Artificial
  CRISPR gRNA sequence
ttatttttatctttatttat

SEQ ID NO: 502928 - DNA, 20 bp, Artificial
  CRISPR gRNA sequence
tatttttatctttatttatt

SEQ ID NO: 502929 - DNA, 20 bp, Artificial
  CRISPR gRNA sequence
atttttatctttatttattt

SEQ ID NO: 502930 - DNA, 20 bp, Artificial
  CRISPR gRNA sequence
tttttatctttatttattta

SEQ ID NO: 502931 - DNA, 20 bp, Artificial
  CRISPR gRNA sequence
ttatctttatttatttattt

SEQ ID NO: 502932 - DNA, 20 bp, Artificial
  CRISPR gRNA sequence
tatctttatttatttattta

SEQ ID NO: 502933 - DNA, 20 bp, Artificial
  CRISPR gRNA sequence
atctttatttatttatttat

SEQ ID NO: 502934 - DNA, 20 bp, Artificial
  CRISPR gRNA sequence
tctttatttatttatttatt

SEQ ID NO: 502935 - DNA, 20 bp, Artificial
  CRISPR gRNA sequence
tatttatttatttatttttg

SEQ ID NO: 502936 - DNA, 20 bp, Artificial
  CRISPR gRNA sequence
atttatttatttatttttgc

SEQ ID NO: 502937 - DNA, 20 bp, Artificial
  CRISPR gRNA sequence
tttatttatttatttttgcc

SEQ ID NO: 502938 - DNA, 20 bp, Artificial
  CRISPR gRNA sequence
atttatttatttttgcccca

SEQ ID NO: 502939 - DNA, 20 bp, Artificial
  CRISPR gRNA sequence
tttatttatttttgccccag

SEQ ID NO: 502940 - DNA, 20 bp, Artificial
  CRISPR gRNA sequence
atttatttttgccccagcag

SEQ ID NO: 502941 - DNA, 20 bp, Artificial
  CRISPR gRNA sequence
tttatttttgccccagcagt

SEQ ID NO: 502942 - DNA, 20 bp, Artificial
  CRISPR gRNA sequence
atttttgccccagcagtggc

SEQ ID NO: 502943 - DNA, 20 bp, Artificial
  CRISPR gRNA sequence
tttttgccccagcagtggct

SEQ ID NO: 502944 - DNA, 20 bp, Artificial
  CRISPR gRNA sequence
ttgccccagcagtggctatg

SEQ ID NO: 502945 - DNA, 20 bp, Artificial
  CRISPR gRNA sequence
tgccccagcagtggctatgg

SEQ ID NO: 502946 - DNA, 20 bp, Artificial
  CRISPR gRNA sequence
gccccagcagtggctatggg

SEQ ID NO: 502947 - DNA, 20 bp, Artificial
  CRISPR gRNA sequence
ccccagcagtggctatggga

SEQ ID NO: 502948 - DNA, 20 bp, Artificial
  CRISPR gRNA sequence
tgggaatgtgaaaaataaag

SEQ ID NO: 502949 - DNA, 20 bp, Artificial
  CRISPR gRNA sequence
ttggaatgtgaataataaaa

SEQ ID NO: 502950 - DNA, 20 bp, Artificial
  CRISPR gRNA sequence
gaatgtgaataataaaaggg

SEQ ID NO: 502951 - DNA, 20 bp, Artificial
  CRISPR gRNA sequence
tgtttctctcactgctacca

SEQ ID NO: 502952 - DNA, 20 bp, Artificial
  CRISPR gRNA sequence
gtttctctcactgctaccag

SEQ ID NO: 502953 - DNA, 20 bp, Artificial
  CRISPR gRNA sequence
tttctctcactgctaccaga

SEQ ID NO: 502954 - DNA, 20 bp, Artificial
  CRISPR gRNA sequence
ctctcactgctaccagactc

SEQ ID NO: 502955 - DNA, 20 bp, Artificial
  CRISPR gRNA sequence
tctcactgctaccagactct

SEQ ID NO: 502956 - DNA, 20 bp, Artificial
  CRISPR gRNA sequence
tcactgctaccagactctgg

SEQ ID NO: 502957 - DNA, 20 bp, Artificial
  CRISPR gRNA sequence
actgctaccagactctggta

SEQ ID NO: 502958 - DNA, 20 bp, Artificial
  CRISPR gRNA sequence
ctaccagactctggtacaaa

SEQ ID NO: 502959 - DNA, 20 bp, Artificial
  CRISPR gRNA sequence
ccagactctggtacaaattc

SEQ ID NO: 502960 - DNA, 20 bp, Artificial
  CRISPR gRNA sequence
tggtacaaattcctgaaagc

SEQ ID NO: 502961 - DNA, 20 bp, Artificial
  CRISPR gRNA sequence
gtacaaattcctgaaagcat

SEQ ID NO: 502962 - DNA, 20 bp, Artificial
  CRISPR gRNA sequence
ctgaaagcatgtgaatctac

SEQ ID NO: 502963 - DNA, 20 bp, Artificial
  CRISPR gRNA sequence
aaagcatgtgaatctaccca

SEQ ID NO: 502964 - DNA, 20 bp, Artificial
  CRISPR gRNA sequence
cccacagccagtgatgcccg

SEQ ID NO: 502965 - DNA, 20 bp, Artificial
  CRISPR gRNA sequence
gctaaaaataatctattttt

SEQ ID NO: 502966 - DNA, 20 bp, Artificial
  CRISPR gRNA sequence
ctaaaaataatctatttttc

SEQ ID NO: 502967 - DNA, 20 bp, Artificial
  CRISPR gRNA sequence
aaaataatctatttttccaa

SEQ ID NO: 502968 - DNA, 20 bp, Artificial
  CRISPR gRNA sequence
tttttccaaaaagaagatga

SEQ ID NO: 502969 - DNA, 20 bp, Artificial
  CRISPR gRNA sequence
ttccaaaaagaagatgactt

SEQ ID NO: 502970 - DNA, 20 bp, Artificial
  CRISPR gRNA sequence
tccaaaaagaagatgacttg

SEQ ID NO: 502971 - DNA, 20 bp, Artificial
  CRISPR gRNA sequence
ccaaaaagaagatgacttga

SEQ ID NO: 502972 - DNA, 20 bp, Artificial
  CRISPR gRNA sequence
caaaaagaagatgacttgag

SEQ ID NO: 502973 - DNA, 20 bp, Artificial
  CRISPR gRNA sequence
gagattaggagaccacagga

SEQ ID NO: 502974 - DNA, 20 bp, Artificial
  CRISPR gRNA sequence
agattaggagaccacaggag

SEQ ID NO: 502975 - DNA, 20 bp, Artificial
  CRISPR gRNA sequence
ggagaccacaggaggaaaaa

SEQ ID NO: 502976 - DNA, 20 bp, Artificial
  CRISPR gRNA sequence
agagcaaaggaaacctcttt

SEQ ID NO: 502977 - DNA, 20 bp, Artificial
  CRISPR gRNA sequence
gagcaaaggaaacctctttg

SEQ ID NO: 502978 - DNA, 20 bp, Artificial
  CRISPR gRNA sequence
tttgggattcaggcctatta

SEQ ID NO: 502979 - DNA, 20 bp, Artificial
  CRISPR gRNA sequence
tgggattcaggcctattagc

SEQ ID NO: 502980 - DNA, 20 bp, Artificial
  CRISPR gRNA sequence
gggattcaggcctattagct

SEQ ID NO: 502981 - DNA, 20 bp, Artificial
  CRISPR gRNA sequence
ggattcaggcctattagctt

SEQ ID NO: 502982 - DNA, 20 bp, Artificial
  CRISPR gRNA sequence
aggcctattagcttacttct

SEQ ID NO: 502983 - DNA, 20 bp, Artificial
  CRISPR gRNA sequence
ttagcttacttcttccgact

SEQ ID NO: 502984 - DNA, 20 bp, Artificial
  CRISPR gRNA sequence
gcttacttcttccgactcaa

SEQ ID NO: 502985 - DNA, 20 bp, Artificial
  CRISPR gRNA sequence
acttcttccgactcaagagc

SEQ ID NO: 502986 - DNA, 20 bp, Artificial
  CRISPR gRNA sequence
cttcttccgactcaagagct

SEQ ID NO: 502987 - DNA, 20 bp, Artificial
  CRISPR gRNA sequence
cttccgactcaagagctcct

SEQ ID NO: 502988 - DNA, 20 bp, Artificial
  CRISPR gRNA sequence
ttccgactcaagagctcctc

SEQ ID NO: 502989 - DNA, 20 bp, Artificial
  CRISPR gRNA sequence
ccgactcaagagctcctccc

SEQ ID NO: 502990 - DNA, 20 bp, Artificial
  CRISPR gRNA sequence
cgactcaagagctcctccct

SEQ ID NO: 502991 - DNA, 20 bp, Artificial
  CRISPR gRNA sequence
aagagctcctccctgcctgg

SEQ ID NO: 502992 - DNA, 20 bp, Artificial
  CRISPR gRNA sequence
ctccctgcctggcctcagcc

SEQ ID NO: 502993 - DNA, 20 bp, Artificial
  CRISPR gRNA sequence
cctgcctggcctcagccctc

SEQ ID NO: 502994 - DNA, 20 bp, Artificial
  CRISPR gRNA sequence
cctggcctcagccctctctg

SEQ ID NO: 502995 - DNA, 20 bp, Artificial
  CRISPR gRNA sequence
gcctcagccctctctggcct

SEQ ID NO: 502996 - DNA, 20 bp, Artificial
  CRISPR gRNA sequence
agccctctctggcctctccc

SEQ ID NO: 502997 - DNA, 20 bp, Artificial
  CRISPR gRNA sequence
tctggcctctccctattgtc

SEQ ID NO: 502998 - DNA, 20 bp, Artificial
  CRISPR gRNA sequence
tggcctctccctattgtctc

SEQ ID NO: 502999 - DNA, 20 bp, Artificial
  CRISPR gRNA sequence
gcctctccctattgtctcag

SEQ ID NO: 503000 - DNA, 20 bp, Artificial
  CRISPR gRNA sequence
tccctattgtctcagggctc

SEQ ID NO: 503001 - DNA, 20 bp, Artificial
  CRISPR gRNA sequence
cctattgtctcagggctcca

SEQ ID NO: 503002 - DNA, 20 bp, Artificial
  CRISPR gRNA sequence
ttgtctcagggctccaattt

SEQ ID NO: 503003 - DNA, 20 bp, Artificial
  CRISPR gRNA sequence
tctcagggctccaatttgaa

SEQ ID NO: 503004 - DNA, 20 bp, Artificial
  CRISPR gRNA sequence
agggctccaatttgaaggcc

SEQ ID NO: 503005 - DNA, 20 bp, Artificial
  CRISPR gRNA sequence
caatttgaaggcctaaatct

SEQ ID NO: 503006 - DNA, 20 bp, Artificial
  CRISPR gRNA sequence
gaaggcctaaatctcaagtt

SEQ ID NO: 503007 - DNA, 20 bp, Artificial
  CRISPR gRNA sequence
aaggcctaaatctcaagttt

SEQ ID NO: 503008 - DNA, 20 bp, Artificial
  CRISPR gRNA sequence
aatctcaagtttcatgtggt

SEQ ID NO: 503009 - DNA, 20 bp, Artificial
  CRISPR gRNA sequence
aagtttcatgtggtctcact

SEQ ID NO: 503010 - DNA, 20 bp, Artificial
  CRISPR gRNA sequence
catgtggtctcactttgaga

SEQ ID NO: 503011 - DNA, 20 bp, Artificial
  CRISPR gRNA sequence
atgtggtctcactttgagac

SEQ ID NO: 503012 - DNA, 20 bp, Artificial
  CRISPR gRNA sequence
actttgagacccagctctaa

SEQ ID NO: 503013 - DNA, 20 bp, Artificial
  CRISPR gRNA sequence
tgagacccagctctaatctt

SEQ ID NO: 503014 - DNA, 20 bp, Artificial
  CRISPR gRNA sequence
gagacccagctctaatcttt

SEQ ID NO: 503015 - DNA, 20 bp, Artificial
  CRISPR gRNA sequence
agacccagctctaatctttc

SEQ ID NO: 503016 - DNA, 20 bp, Artificial
  CRISPR gRNA sequence
taatctttctagaaacactt

SEQ ID NO: 503017 - DNA, 20 bp, Artificial
  CRISPR gRNA sequence
atctttctagaaacacttca

SEQ ID NO: 503018 - DNA, 20 bp, Artificial
  CRISPR gRNA sequence
tctagaaacacttcacacgg

SEQ ID NO: 503019 - DNA, 20 bp, Artificial
  CRISPR gRNA sequence
ctagaaacacttcacacggg

SEQ ID NO: 503020 - DNA, 20 bp, Artificial
  CRISPR gRNA sequence
tagaaacacttcacacgggt

SEQ ID NO: 503021 - DNA, 20 bp, Artificial
  CRISPR gRNA sequence
gaaacacttcacacgggtct

SEQ ID NO: 503022 - DNA, 20 bp, Artificial
  CRISPR gRNA sequence
cacacgggtctggacgggag

SEQ ID NO: 503023 - DNA, 20 bp, Artificial
  CRISPR gRNA sequence
acacgggtctggacgggaga

SEQ ID NO: 503024 - DNA, 20 bp, Artificial
  CRISPR gRNA sequence
gacgggagagaaaagcaaca

SEQ ID NO: 503025 - DNA, 20 bp, Artificial
  CRISPR gRNA sequence
ctgcagtattttaaaacaca

SEQ ID NO: 503026 - DNA, 20 bp, Artificial
  CRISPR gRNA sequence
cagtattttaaaacacaaat

SEQ ID NO: 503027 - DNA, 20 bp, Artificial
  CRISPR gRNA sequence
taaaacacaaatgaagttat

SEQ ID NO: 503028 - DNA, 20 bp, Artificial
  CRISPR gRNA sequence
aaaacacaaatgaagttatt

SEQ ID NO: 503029 - DNA, 20 bp, Artificial
  CRISPR gRNA sequence
aaacacaaatgaagttattg

SEQ ID NO: 503030 - DNA, 20 bp, Artificial
  CRISPR gRNA sequence
ttgacattgtcagatgccca

SEQ ID NO: 503031 - DNA, 20 bp, Artificial
  CRISPR gRNA sequence
acattgtcagatgcccatga

SEQ ID NO: 503032 - DNA, 20 bp, Artificial
  CRISPR gRNA sequence
tcagatgcccatgactcccc

SEQ ID NO: 503033 - DNA, 20 bp, Artificial
  CRISPR gRNA sequence
cccagcctctaaggacagct

SEQ ID NO: 503034 - DNA, 20 bp, Artificial
  CRISPR gRNA sequence
taaggacagctgacagttct

SEQ ID NO: 503035 - DNA, 20 bp, Artificial
  CRISPR gRNA sequence
aggacagctgacagttctct

SEQ ID NO: 503036 - DNA, 20 bp, Artificial
  CRISPR gRNA sequence
acagttctctgcttctctta

SEQ ID NO: 503037 - DNA, 20 bp, Artificial
  CRISPR gRNA sequence
tctgcttctcttagcttctt

SEQ ID NO: 503038 - DNA, 20 bp, Artificial
  CRISPR gRNA sequence
tgcttctcttagcttcttct

SEQ ID NO: 503039 - DNA, 20 bp, Artificial
  CRISPR gRNA sequence
cttctcttagcttcttcttg

SEQ ID NO: 503040 - DNA, 20 bp, Artificial
  CRISPR gRNA sequence
ctcttagcttcttcttgctt

SEQ ID NO: 503041 - DNA, 20 bp, Artificial
  CRISPR gRNA sequence
tcttagcttcttcttgcttc

SEQ ID NO: 503042 - DNA, 20 bp, Artificial
  CRISPR gRNA sequence
ttagcttcttcttgcttcca

SEQ ID NO: 503043 - DNA, 20 bp, Artificial
  CRISPR gRNA sequence
agcttcttcttgcttccagg

SEQ ID NO: 503044 - DNA, 20 bp, Artificial
  CRISPR gRNA sequence
gcttcttcttgcttccagga

SEQ ID NO: 503045 - DNA, 20 bp, Artificial
  CRISPR gRNA sequence
cttcttgcttccaggaattt

SEQ ID NO: 503046 - DNA, 20 bp, Artificial
  CRISPR gRNA sequence
ttcttgcttccaggaatttt

SEQ ID NO: 503047 - DNA, 20 bp, Artificial
  CRISPR gRNA sequence
cttgcttccaggaattttgc

SEQ ID NO: 503048 - DNA, 20 bp, Artificial
  CRISPR gRNA sequence
ttgcttccaggaattttgct

SEQ ID NO: 503049 - DNA, 20 bp, Artificial
  CRISPR gRNA sequence
gcttccaggaattttgcttg

SEQ ID NO: 503050 - DNA, 20 bp, Artificial
  CRISPR gRNA sequence
cttccaggaattttgcttgc

SEQ ID NO: 503051 - DNA, 20 bp, Artificial
  CRISPR gRNA sequence
ccaggaattttgcttgcacc

SEQ ID NO: 503052 - DNA, 20 bp, Artificial
  CRISPR gRNA sequence
caggaattttgcttgcacct

SEQ ID NO: 503053 - DNA, 20 bp, Artificial
  CRISPR gRNA sequence
tgcttgcaccttgcctaatg

SEQ ID NO: 503054 - DNA, 20 bp, Artificial
  CRISPR gRNA sequence
gcttgcaccttgcctaatga

SEQ ID NO: 503055 - DNA, 20 bp, Artificial
  CRISPR gRNA sequence
cttgcaccttgcctaatgaa

SEQ ID NO: 503056 - DNA, 20 bp, Artificial
  CRISPR gRNA sequence
gcaccttgcctaatgaaccc

SEQ ID NO: 503057 - DNA, 20 bp, Artificial
  CRISPR gRNA sequence
caccttgcctaatgaaccct

SEQ ID NO: 503058 - DNA, 20 bp, Artificial
  CRISPR gRNA sequence
gcctaatgaaccctgctgcc

SEQ ID NO: 503059 - DNA, 20 bp, Artificial
  CRISPR gRNA sequence
cctaatgaaccctgctgcct

SEQ ID NO: 503060 - DNA, 20 bp, Artificial
  CRISPR gRNA sequence
atgaaccctgctgcctccac

SEQ ID NO: 503061 - DNA, 20 bp, Artificial
  CRISPR gRNA sequence
ctgcctccactggctcccag

SEQ ID NO: 503062 - DNA, 20 bp, Artificial
  CRISPR gRNA sequence
cctccactggctcccagtag

SEQ ID NO: 503063 - DNA, 20 bp, Artificial
  CRISPR gRNA sequence
cactggctcccagtagaacc

SEQ ID NO: 503064 - DNA, 20 bp, Artificial
  CRISPR gRNA sequence
gctcccagtagaacccaaac

SEQ ID NO: 503065 - DNA, 20 bp, Artificial
  CRISPR gRNA sequence
ccagtagaacccaaactggc

SEQ ID NO: 503066 - DNA, 20 bp, Artificial
  CRISPR gRNA sequence
gcaatatgctttcagtggcc

SEQ ID NO: 503067 - DNA, 20 bp, Artificial
  CRISPR gRNA sequence
tcagtggccggcagcatgaa

SEQ ID NO: 503068 - DNA, 20 bp, Artificial
  CRISPR gRNA sequence
cagtggccggcagcatgaaa

SEQ ID NO: 503069 - DNA, 20 bp, Artificial
  CRISPR gRNA sequence
agtggccggcagcatgaaat

SEQ ID NO: 503070 - DNA, 20 bp, Artificial
  CRISPR gRNA sequence
caccaccgatttcctaaggg

SEQ ID NO: 503071 - DNA, 20 bp, Artificial
  CRISPR gRNA sequence
cctaaggggtaggaacaaga

SEQ ID NO: 503072 - DNA, 20 bp, Artificial
  CRISPR gRNA sequence
ctaaggggtaggaacaagaa

SEQ ID NO: 503073 - DNA, 20 bp, Artificial
  CRISPR gRNA sequence
aggggtaggaacaagaaaag

SEQ ID NO: 503074 - DNA, 20 bp, Artificial
  CRISPR gRNA sequence
tgcttcctgctttggccctt

SEQ ID NO: 503075 - DNA, 20 bp, Artificial
  CRISPR gRNA sequence
cttcctgctttggcccttgg

SEQ ID NO: 503076 - DNA, 20 bp, Artificial
  CRISPR gRNA sequence
cctgctttggcccttgggtt

SEQ ID NO: 503077 - DNA, 20 bp, Artificial
  CRISPR gRNA sequence
ctgctttggcccttgggttc

SEQ ID NO: 503078 - DNA, 20 bp, Artificial
  CRISPR gRNA sequence
ctttggcccttgggttcagg

SEQ ID NO: 503079 - DNA, 20 bp, Artificial
  CRISPR gRNA sequence
tggcccttgggttcagggct

SEQ ID NO: 503080 - DNA, 20 bp, Artificial
  CRISPR gRNA sequence
ggcccttgggttcagggctg

SEQ ID NO: 503081 - DNA, 20 bp, Artificial
  CRISPR gRNA sequence
gcccttgggttcagggctgc

SEQ ID NO: 503082 - DNA, 20 bp, Artificial
  CRISPR gRNA sequence
gggttcagggctgcacccag

SEQ ID NO: 503083 - DNA, 20 bp, Artificial
  CRISPR gRNA sequence
ggttcagggctgcacccagc

SEQ ID NO: 503084 - DNA, 20 bp, Artificial
  CRISPR gRNA sequence
agggctgcacccagcactat

SEQ ID NO: 503085 - DNA, 20 bp, Artificial
  CRISPR gRNA sequence
cacccagcactatagctgcc

SEQ ID NO: 503086 - DNA, 20 bp, Artificial
  CRISPR gRNA sequence
tagctgcccagggcgctgac

SEQ ID NO: 503087 - DNA, 20 bp, Artificial
  CRISPR gRNA sequence
cccagggcgctgacttgagg

SEQ ID NO: 503088 - DNA, 20 bp, Artificial
  CRISPR gRNA sequence
acttgaggtcaagggcaagg

SEQ ID NO: 503089 - DNA, 20 bp, Artificial
  CRISPR gRNA sequence
gaggtcaagggcaaggtggc

SEQ ID NO: 503090 - DNA, 20 bp, Artificial
  CRISPR gRNA sequence
aggtcaagggcaaggtggcc

SEQ ID NO: 503091 - DNA, 20 bp, Artificial
  CRISPR gRNA sequence
aaagatgatctagagagggc

SEQ ID NO: 503092 - DNA, 20 bp, Artificial
  CRISPR gRNA sequence
gagagggcttaactgtgttt

SEQ ID NO: 503093 - DNA, 20 bp, Artificial
  CRISPR gRNA sequence
aactgtgtttggtctttgaa

SEQ ID NO: 503094 - DNA, 20 bp, Artificial
  CRISPR gRNA sequence
actgtgtttggtctttgaaa

SEQ ID NO: 503095 - DNA, 20 bp, Artificial
  CRISPR gRNA sequence
tgtttggtctttgaaatgtt

SEQ ID NO: 503096 - DNA, 20 bp, Artificial
  CRISPR gRNA sequence
ggtctttgaaatgtttaaac

SEQ ID NO: 503097 - DNA, 20 bp, Artificial
  CRISPR gRNA sequence
gtctttgaaatgtttaaact

SEQ ID NO: 503098 - DNA, 20 bp, Artificial
  CRISPR gRNA sequence
tgaaatgtttaaactttctg

SEQ ID NO: 503099 - DNA, 20 bp, Artificial
  CRISPR gRNA sequence
gaaatgtttaaactttctga

SEQ ID NO: 503100 - DNA, 20 bp, Artificial
  CRISPR gRNA sequence
aaatgtttaaactttctgaa

SEQ ID NO: 503101 - DNA, 20 bp, Artificial
  CRISPR gRNA sequence
aaactttctgaatttcagtg

SEQ ID NO: 503102 - DNA, 20 bp, Artificial
  CRISPR gRNA sequence
aactttctgaatttcagtgc

SEQ ID NO: 503103 - DNA, 20 bp, Artificial
  CRISPR gRNA sequence
tctgaatttcagtgctctga

SEQ ID NO: 503104 - DNA, 20 bp, Artificial
  CRISPR gRNA sequence
ctgaatttcagtgctctgag

SEQ ID NO: 503105 - DNA, 20 bp, Artificial
  CRISPR gRNA sequence
tgaatttcagtgctctgagg

SEQ ID NO: 503106 - DNA, 20 bp, Artificial
  CRISPR gRNA sequence
aatttcagtgctctgaggta

SEQ ID NO: 503107 - DNA, 20 bp, Artificial
  CRISPR gRNA sequence
cagtgctctgaggtaaggct

SEQ ID NO: 503108 - DNA, 20 bp, Artificial
  CRISPR gRNA sequence
agtgctctgaggtaaggctc

SEQ ID NO: 503109 - DNA, 20 bp, Artificial
  CRISPR gRNA sequence
tgaggtaaggctcagataac

SEQ ID NO: 503110 - DNA, 20 bp, Artificial
  CRISPR gRNA sequence
aggtaaggctcagataacag

SEQ ID NO: 503111 - DNA, 20 bp, Artificial
  CRISPR gRNA sequence
agataacagccctactcaga

SEQ ID NO: 503112 - DNA, 20 bp, Artificial
  CRISPR gRNA sequence
ctcagagctctgcaaggaag

SEQ ID NO: 503113 - DNA, 20 bp, Artificial
  CRISPR gRNA sequence
agagctctgcaaggaagggt

SEQ ID NO: 503114 - DNA, 20 bp, Artificial
  CRISPR gRNA sequence
tgcaaggaagggtttctaag

SEQ ID NO: 503115 - DNA, 20 bp, Artificial
  CRISPR gRNA sequence
caaggaagggtttctaagtt

SEQ ID NO: 503116 - DNA, 20 bp, Artificial
  CRISPR gRNA sequence
ctaagttactaaaggaaaga

SEQ ID NO: 503117 - DNA, 20 bp, Artificial
  CRISPR gRNA sequence
taagttactaaaggaaagaa

SEQ ID NO: 503118 - DNA, 20 bp, Artificial
  CRISPR gRNA sequence
agttactaaaggaaagaaag

SEQ ID NO: 503119 - DNA, 20 bp, Artificial
  CRISPR gRNA sequence
ctaaaggaaagaaagtgaca

SEQ ID NO: 503120 - DNA, 20 bp, Artificial
  CRISPR gRNA sequence
aaggaaagaaagtgacagca

SEQ ID NO: 503121 - DNA, 20 bp, Artificial
  CRISPR gRNA sequence
tctttgagcagggttgctgg

SEQ ID NO: 503122 - DNA, 20 bp, Artificial
  CRISPR gRNA sequence
tttgagcagggttgctggaa

SEQ ID NO: 503123 - DNA, 20 bp, Artificial
  CRISPR gRNA sequence
tgagcagggttgctggaacc

SEQ ID NO: 503124 - DNA, 20 bp, Artificial
  CRISPR gRNA sequence
gagcagggttgctggaaccc

SEQ ID NO: 503125 - DNA, 20 bp, Artificial
  CRISPR gRNA sequence
agcagggttgctggaacccc

SEQ ID NO: 503126 - DNA, 20 bp, Artificial
  CRISPR gRNA sequence
ctggaacccctcacacctag

SEQ ID NO: 503127 - DNA, 20 bp, Artificial
  CRISPR gRNA sequence
gaacccctcacacctaggtg

SEQ ID NO: 503128 - DNA, 20 bp, Artificial
  CRISPR gRNA sequence
acacctaggtggttccttgc

SEQ ID NO: 503129 - DNA, 20 bp, Artificial
  CRISPR gRNA sequence
ggtggttccttgctcctgat

SEQ ID NO: 503130 - DNA, 20 bp, Artificial
  CRISPR gRNA sequence
cttgctcctgatactaatgg

SEQ ID NO: 503131 - DNA, 20 bp, Artificial
  CRISPR gRNA sequence
gctcctgatactaatggttc

SEQ ID NO: 503132 - DNA, 20 bp, Artificial
  CRISPR gRNA sequence
ctcctgatactaatggttcc

SEQ ID NO: 503133 - DNA, 20 bp, Artificial
  CRISPR gRNA sequence
ctgatactaatggttccact

SEQ ID NO: 503134 - DNA, 20 bp, Artificial
  CRISPR gRNA sequence
atactaatggttccactcca

SEQ ID NO: 503135 - DNA, 20 bp, Artificial
  CRISPR gRNA sequence
atggttccactccaaactgc

SEQ ID NO: 503136 - DNA, 20 bp, Artificial
  CRISPR gRNA sequence
cactccaaactgctcttctt

SEQ ID NO: 503137 - DNA, 20 bp, Artificial
  CRISPR gRNA sequence
caaactgctcttcttcctgt

SEQ ID NO: 503138 - DNA, 20 bp, Artificial
  CRISPR gRNA sequence
ctcttcttcctgtctcttcc

SEQ ID NO: 503139 - DNA, 20 bp, Artificial
  CRISPR gRNA sequence
ttcttcctgtctcttcccat

SEQ ID NO: 503140 - DNA, 20 bp, Artificial
  CRISPR gRNA sequence
cttcctgtctcttcccatct

SEQ ID NO: 503141 - DNA, 20 bp, Artificial
  CRISPR gRNA sequence
ttcctgtctcttcccatctt

SEQ ID NO: 503142 - DNA, 20 bp, Artificial
  CRISPR gRNA sequence
cctgtctcttcccatcttgg

SEQ ID NO: 503143 - DNA, 20 bp, Artificial
  CRISPR gRNA sequence
ctgtctcttcccatcttggg

SEQ ID NO: 503144 - DNA, 20 bp, Artificial
  CRISPR gRNA sequence
tctcttcccatcttgggagg

SEQ ID NO: 503145 - DNA, 20 bp, Artificial
  CRISPR gRNA sequence
ttcccatcttgggaggatca

SEQ ID NO: 503146 - DNA, 20 bp, Artificial
  CRISPR gRNA sequence
cccatcttgggaggatcaat

SEQ ID NO: 503147 - DNA, 20 bp, Artificial
  CRISPR gRNA sequence
ccatcttgggaggatcaatg

SEQ ID NO: 503148 - DNA, 20 bp, Artificial
  CRISPR gRNA sequence
gggaggatcaatgactctcc

SEQ ID NO: 503149 - DNA, 20 bp, Artificial
  CRISPR gRNA sequence
ggaggatcaatgactctccc

SEQ ID NO: 503150 - DNA, 20 bp, Artificial
  CRISPR gRNA sequence
tccccagtcctgccacctcc

SEQ ID NO: 503151 - DNA, 20 bp, Artificial
  CRISPR gRNA sequence
cccagtcctgccacctccct

SEQ ID NO: 503152 - DNA, 20 bp, Artificial
  CRISPR gRNA sequence
ccacctccctcccagtctcc

SEQ ID NO: 503153 - DNA, 20 bp, Artificial
  CRISPR gRNA sequence
cctcccagtctcctgaaaag

SEQ ID NO: 503154 - DNA, 20 bp, Artificial
  CRISPR gRNA sequence
ccagtctcctgaaaagccct

SEQ ID NO: 503155 - DNA, 20 bp, Artificial
  CRISPR gRNA sequence
ctgaaaagccctcttctttg

SEQ ID NO: 503156 - DNA, 20 bp, Artificial
  CRISPR gRNA sequence
aaaagccctcttctttgtgc

SEQ ID NO: 503157 - DNA, 20 bp, Artificial
  CRISPR gRNA sequence
ttctttgtgctgtttttccc

SEQ ID NO: 503158 - DNA, 20 bp, Artificial
  CRISPR gRNA sequence
ctttgtgctgtttttcccca

SEQ ID NO: 503159 - DNA, 20 bp, Artificial
  CRISPR gRNA sequence
tttgtgctgtttttccccac

SEQ ID NO: 503160 - DNA, 20 bp, Artificial
  CRISPR gRNA sequence
tgtgctgtttttccccactc

SEQ ID NO: 503161 - DNA, 20 bp, Artificial
  CRISPR gRNA sequence
gtgctgtttttccccactca

SEQ ID NO: 503162 - DNA, 20 bp, Artificial
  CRISPR gRNA sequence
tgctgtttttccccactcaa

SEQ ID NO: 503163 - DNA, 20 bp, Artificial
  CRISPR gRNA sequence
tttttccccactcaatctaa

SEQ ID NO: 503164 - DNA, 20 bp, Artificial
  CRISPR gRNA sequence
ttccccactcaatctaaatc

SEQ ID NO: 503165 - DNA, 20 bp, Artificial
  CRISPR gRNA sequence
tccccactcaatctaaatct

SEQ ID NO: 503166 - DNA, 20 bp, Artificial
  CRISPR gRNA sequence
ccccactcaatctaaatctg

SEQ ID NO: 503167 - DNA, 20 bp, Artificial
  CRISPR gRNA sequence
cccactcaatctaaatctgg

SEQ ID NO: 503168 - DNA, 20 bp, Artificial
  CRISPR gRNA sequence
aatctaaatctggacagacc

SEQ ID NO: 503169 - DNA, 20 bp, Artificial
  CRISPR gRNA sequence
aatctggacagaccgaactg

SEQ ID NO: 503170 - DNA, 20 bp, Artificial
  CRISPR gRNA sequence
gacagaccgaactgtcgctc

SEQ ID NO: 503171 - DNA, 20 bp, Artificial
  CRISPR gRNA sequence
tcgctcatgttaccccatct

SEQ ID NO: 503172 - DNA, 20 bp, Artificial
  CRISPR gRNA sequence
atgttaccccatctccattt

SEQ ID NO: 503173 - DNA, 20 bp, Artificial
  CRISPR gRNA sequence
ccccatctccatttcttgtg

SEQ ID NO: 503174 - DNA, 20 bp, Artificial
  CRISPR gRNA sequence
catttcttgtgcaggagcag

SEQ ID NO: 503175 - DNA, 20 bp, Artificial
  CRISPR gRNA sequence
cttgtgcaggagcaggagca

SEQ ID NO: 503176 - DNA, 20 bp, Artificial
  CRISPR gRNA sequence
ttgtgcaggagcaggagcag

SEQ ID NO: 503177 - DNA, 20 bp, Artificial
  CRISPR gRNA sequence
gtgcaggagcaggagcagac

SEQ ID NO: 503178 - DNA, 20 bp, Artificial
  CRISPR gRNA sequence
tgcaggagcaggagcagact

SEQ ID NO: 503179 - DNA, 20 bp, Artificial
  CRISPR gRNA sequence
ttcctggaggggggagcacc

SEQ ID NO: 503180 - DNA, 20 bp, Artificial
  CRISPR gRNA sequence
tcctggaggggggagcacca

SEQ ID NO: 503181 - DNA, 20 bp, Artificial
  CRISPR gRNA sequence
cctggaggggggagcaccat

SEQ ID NO: 503182 - DNA, 20 bp, Artificial
  CRISPR gRNA sequence
ctggaggggggagcaccatc

SEQ ID NO: 503183 - DNA, 20 bp, Artificial
  CRISPR gRNA sequence
gaggggggagcaccatctac

SEQ ID NO: 503184 - DNA, 20 bp, Artificial
  CRISPR gRNA sequence
ctctatgatccagtcccagg

SEQ ID NO: 503185 - DNA, 20 bp, Artificial
  CRISPR gRNA sequence
tatgatccagtcccaggtac

SEQ ID NO: 503186 - DNA, 20 bp, Artificial
  CRISPR gRNA sequence
tgatccagtcccaggtacct

SEQ ID NO: 503187 - DNA, 20 bp, Artificial
  CRISPR gRNA sequence
tccagtttctctagtccatt

SEQ ID NO: 503188 - DNA, 20 bp, Artificial
  CRISPR gRNA sequence
cagtttctctagtccattcc

SEQ ID NO: 503189 - DNA, 20 bp, Artificial
  CRISPR gRNA sequence
ctctagtccattccatacct

SEQ ID NO: 503190 - DNA, 20 bp, Artificial
  CRISPR gRNA sequence
tctagtccattccataccta

SEQ ID NO: 503191 - DNA, 20 bp, Artificial
  CRISPR gRNA sequence
tagtccattccatacctatc

SEQ ID NO: 503192 - DNA, 20 bp, Artificial
  CRISPR gRNA sequence
gtccattccatacctatctc

SEQ ID NO: 503193 - DNA, 20 bp, Artificial
  CRISPR gRNA sequence
catacctatctctggggttt

SEQ ID NO: 503194 - DNA, 20 bp, Artificial
  CRISPR gRNA sequence
tctctggggtttcctaatgc

SEQ ID NO: 503195 - DNA, 20 bp, Artificial
  CRISPR gRNA sequence
tggggtttcctaatgccccc

SEQ ID NO: 503196 - DNA, 20 bp, Artificial
  CRISPR gRNA sequence
gggtttcctaatgcccccct

SEQ ID NO: 503197 - DNA, 20 bp, Artificial
  CRISPR gRNA sequence
cctaatgcccccctgaaact

SEQ ID NO: 503198 - DNA, 20 bp, Artificial
  CRISPR gRNA sequence
ctaatgcccccctgaaactc

SEQ ID NO: 503199 - DNA, 20 bp, Artificial
  CRISPR gRNA sequence
atgcccccctgaaactcaca

SEQ ID NO: 503200 - DNA, 20 bp, Artificial
  CRISPR gRNA sequence
aaactcacaccattgaatgg

SEQ ID NO: 503201 - DNA, 20 bp, Artificial
  CRISPR gRNA sequence
acaccattgaatggcagaat

SEQ ID NO: 503202 - DNA, 20 bp, Artificial
  CRISPR gRNA sequence
aatggcagaataagatcttg

SEQ ID NO: 503203 - DNA, 20 bp, Artificial
  CRISPR gRNA sequence
ggtgcttctagaatccagaa

SEQ ID NO: 503204 - DNA, 20 bp, Artificial
  CRISPR gRNA sequence
gtgcttctagaatccagaag

SEQ ID NO: 503205 - DNA, 20 bp, Artificial
  CRISPR gRNA sequence
ctagaatccagaagatagct

SEQ ID NO: 503206 - DNA, 20 bp, Artificial
  CRISPR gRNA sequence
tagaatccagaagatagctt

SEQ ID NO: 503207 - DNA, 20 bp, Artificial
  CRISPR gRNA sequence
gaatccagaagatagcttgg

SEQ ID NO: 503208 - DNA, 20 bp, Artificial
  CRISPR gRNA sequence
ggcttcagttgcattaacac

SEQ ID NO: 503209 - DNA, 20 bp, Artificial
  CRISPR gRNA sequence
gcttcagttgcattaacaca

SEQ ID NO: 503210 - DNA, 20 bp, Artificial
  CRISPR gRNA sequence
cagttgcattaacacattat

SEQ ID NO: 503211 - DNA, 20 bp, Artificial
  CRISPR gRNA sequence
agttgcattaacacattatt

SEQ ID NO: 503212 - DNA, 20 bp, Artificial
  CRISPR gRNA sequence
cattaacacattatttgaaa

SEQ ID NO: 503213 - DNA, 20 bp, Artificial
  CRISPR gRNA sequence
acacattatttgaaaagatc

SEQ ID NO: 503214 - DNA, 20 bp, Artificial
  CRISPR gRNA sequence
tttgaaaagatccgtgtgat

SEQ ID NO: 503215 - DNA, 20 bp, Artificial
  CRISPR gRNA sequence
gaaaagatccgtgtgatact

SEQ ID NO: 503216 - DNA, 20 bp, Artificial
  CRISPR gRNA sequence
aaaagatccgtgtgatacta

SEQ ID NO: 503217 - DNA, 20 bp, Artificial
  CRISPR gRNA sequence
gagcatcttaacacagctgg

SEQ ID NO: 503218 - DNA, 20 bp, Artificial
  CRISPR gRNA sequence
aacacagctgggaagcctga

SEQ ID NO: 503219 - DNA, 20 bp, Artificial
  CRISPR gRNA sequence
acacagctgggaagcctgat

SEQ ID NO: 503220 - DNA, 20 bp, Artificial
  CRISPR gRNA sequence
ggaagcctgatgtggacatt

SEQ ID NO: 503221 - DNA, 20 bp, Artificial
  CRISPR gRNA sequence
atgtggacattccttcttct

SEQ ID NO: 503222 - DNA, 20 bp, Artificial
  CRISPR gRNA sequence
cttcttcttccgtgtctggc

SEQ ID NO: 503223 - DNA, 20 bp, Artificial
  CRISPR gRNA sequence
cttcttccgtgtctggcaga

SEQ ID NO: 503224 - DNA, 20 bp, Artificial
  CRISPR gRNA sequence
ttcttccgtgtctggcagaa

SEQ ID NO: 503225 - DNA, 20 bp, Artificial
  CRISPR gRNA sequence
cttccgtgtctggcagaagg

SEQ ID NO: 503226 - DNA, 20 bp, Artificial
  CRISPR gRNA sequence
ttccgtgtctggcagaaggt

SEQ ID NO: 503227 - DNA, 20 bp, Artificial
  CRISPR gRNA sequence
ccgtgtctggcagaaggtct

SEQ ID NO: 503228 - DNA, 20 bp, Artificial
  CRISPR gRNA sequence
cgtgtctggcagaaggtctg

SEQ ID NO: 503229 - DNA, 20 bp, Artificial
  CRISPR gRNA sequence
gcagaaggtctggcccagat

SEQ ID NO: 503230 - DNA, 20 bp, Artificial
  CRISPR gRNA sequence
gcccagataaagtctatagg

SEQ ID NO: 503231 - DNA, 20 bp, Artificial
  CRISPR gRNA sequence
taggagcagaaacctggtta

SEQ ID NO: 503232 - DNA, 20 bp, Artificial
  CRISPR gRNA sequence
gttaggggactcaacttctg

SEQ ID NO: 503233 - DNA, 20 bp, Artificial
  CRISPR gRNA sequence
ggggactcaacttctgcttt

SEQ ID NO: 503234 - DNA, 20 bp, Artificial
  CRISPR gRNA sequence
aacttctgctttcttgccct

SEQ ID NO: 503235 - DNA, 20 bp, Artificial
  CRISPR gRNA sequence
ctgctttcttgccctgctgc

SEQ ID NO: 503236 - DNA, 20 bp, Artificial
  CRISPR gRNA sequence
tgctttcttgccctgctgct

SEQ ID NO: 503237 - DNA, 20 bp, Artificial
  CRISPR gRNA sequence
ctttcttgccctgctgctgc

SEQ ID NO: 503238 - DNA, 20 bp, Artificial
  CRISPR gRNA sequence
tcttgccctgctgctgcttc

SEQ ID NO: 503239 - DNA, 20 bp, Artificial
  CRISPR gRNA sequence
cttgccctgctgctgcttct

SEQ ID NO: 503240 - DNA, 20 bp, Artificial
  CRISPR gRNA sequence
ttgccctgctgctgcttcta

SEQ ID NO: 503241 - DNA, 20 bp, Artificial
  CRISPR gRNA sequence
gccctgctgctgcttctaat

SEQ ID NO: 503242 - DNA, 20 bp, Artificial
  CRISPR gRNA sequence
ccctgctgctgcttctaata

SEQ ID NO: 503243 - DNA, 20 bp, Artificial
  CRISPR gRNA sequence
ctgctgcttctaatacttgg

SEQ ID NO: 503244 - DNA, 20 bp, Artificial
  CRISPR gRNA sequence
ctgcttctaatacttggggc

SEQ ID NO: 503245 - DNA, 20 bp, Artificial
  CRISPR gRNA sequence
cttctaatacttggggccct

SEQ ID NO: 503246 - DNA, 20 bp, Artificial
  CRISPR gRNA sequence
ctaatacttggggcccttgc

SEQ ID NO: 503247 - DNA, 20 bp, Artificial
  CRISPR gRNA sequence
taatacttggggcccttgca

SEQ ID NO: 503248 - DNA, 20 bp, Artificial
  CRISPR gRNA sequence
atacttggggcccttgcact

SEQ ID NO: 503249 - DNA, 20 bp, Artificial
  CRISPR gRNA sequence
ggggcccttgcactttttat

SEQ ID NO: 503250 - DNA, 20 bp, Artificial
  CRISPR gRNA sequence
gggcccttgcactttttatc

SEQ ID NO: 503251 - DNA, 20 bp, Artificial
  CRISPR gRNA sequence
gcactttttatccctattcc

SEQ ID NO: 503252 - DNA, 20 bp, Artificial
  CRISPR gRNA sequence
cactttttatccctattccc

SEQ ID NO: 503253 - DNA, 20 bp, Artificial
  CRISPR gRNA sequence
tttatccctattccctatta

SEQ ID NO: 503254 - DNA, 20 bp, Artificial
  CRISPR gRNA sequence
ttatccctattccctattat

SEQ ID NO: 503255 - DNA, 20 bp, Artificial
  CRISPR gRNA sequence
tatccctattccctattata

SEQ ID NO: 503256 - DNA, 20 bp, Artificial
  CRISPR gRNA sequence
atccctattccctattatat

SEQ ID NO: 503257 - DNA, 20 bp, Artificial
  CRISPR gRNA sequence
tccctattccctattatatt

SEQ ID NO: 503258 - DNA, 20 bp, Artificial
  CRISPR gRNA sequence
ttccctattatattcgtttt

SEQ ID NO: 503259 - DNA, 20 bp, Artificial
  CRISPR gRNA sequence
cctattatattcgttttcag

SEQ ID NO: 503260 - DNA, 20 bp, Artificial
  CRISPR gRNA sequence
ttatattcgttttcaggaaa

SEQ ID NO: 503261 - DNA, 20 bp, Artificial
  CRISPR gRNA sequence
tattcgttttcaggaaagaa

SEQ ID NO: 503262 - DNA, 20 bp, Artificial
  CRISPR gRNA sequence
gttttcaggaaagaatgaat

SEQ ID NO: 503263 - DNA, 20 bp, Artificial
  CRISPR gRNA sequence
tcaggaaagaatgaatctgc

SEQ ID NO: 503264 - DNA, 20 bp, Artificial
  CRISPR gRNA sequence
caggaaagaatgaatctgca

SEQ ID NO: 503265 - DNA, 20 bp, Artificial
  CRISPR gRNA sequence
aggaaagaatgaatctgcat

SEQ ID NO: 503266 - DNA, 20 bp, Artificial
  CRISPR gRNA sequence
cattgatctcttttatttta

SEQ ID NO: 503267 - DNA, 20 bp, Artificial
  CRISPR gRNA sequence
atctcttttattttattatg

SEQ ID NO: 503268 - DNA, 20 bp, Artificial
  CRISPR gRNA sequence
ttttattttattatgactta

SEQ ID NO: 503269 - DNA, 20 bp, Artificial
  CRISPR gRNA sequence
ttattttattatgacttagc

SEQ ID NO: 503270 - DNA, 20 bp, Artificial
  CRISPR gRNA sequence
tattttattatgacttagca

SEQ ID NO: 503271 - DNA, 20 bp, Artificial
  CRISPR gRNA sequence
attttattatgacttagcaa

SEQ ID NO: 503272 - DNA, 20 bp, Artificial
  CRISPR gRNA sequence
ttttattatgacttagcaat

SEQ ID NO: 503273 - DNA, 20 bp, Artificial
  CRISPR gRNA sequence
tattatgacttagcaataat

SEQ ID NO: 503274 - DNA, 20 bp, Artificial
  CRISPR gRNA sequence
attatgacttagcaataatg

SEQ ID NO: 503275 - DNA, 20 bp, Artificial
  CRISPR gRNA sequence
ttatgacttagcaataatgt

SEQ ID NO: 503276 - DNA, 20 bp, Artificial
  CRISPR gRNA sequence
tgacttagcaataatgtcca

SEQ ID NO: 503277 - DNA, 20 bp, Artificial
  CRISPR gRNA sequence
agcaataatgtccattttct

SEQ ID NO: 503278 - DNA, 20 bp, Artificial
  CRISPR gRNA sequence
gcaataatgtccattttctt

SEQ ID NO: 503279 - DNA, 20 bp, Artificial
  CRISPR gRNA sequence
tcttttcttttaaaacaatt

SEQ ID NO: 503280 - DNA, 20 bp, Artificial
  CRISPR gRNA sequence
cttttcttttaaaacaattt

SEQ ID NO: 503281 - DNA, 20 bp, Artificial
  CRISPR gRNA sequence
ttttcttttaaaacaatttt

SEQ ID NO: 503282 - DNA, 20 bp, Artificial
  CRISPR gRNA sequence
ttcttttaaaacaattttat

SEQ ID NO: 503283 - DNA, 20 bp, Artificial
  CRISPR gRNA sequence
tcttttaaaacaattttatt

SEQ ID NO: 503284 - DNA, 20 bp, Artificial
  CRISPR gRNA sequence
cttttaaaacaattttattg

SEQ ID NO: 503285 - DNA, 20 bp, Artificial
  CRISPR gRNA sequence
ttttaaaacaattttattgt

SEQ ID NO: 503286 - DNA, 20 bp, Artificial
  CRISPR gRNA sequence
ttaaaacaattttattgttt

SEQ ID NO: 503287 - DNA, 20 bp, Artificial
  CRISPR gRNA sequence
taaaacaattttattgttta

SEQ ID NO: 503288 - DNA, 20 bp, Artificial
  CRISPR gRNA sequence
aaaacaattttattgtttag

SEQ ID NO: 503289 - DNA, 20 bp, Artificial
  CRISPR gRNA sequence
aaacaattttattgtttaga

SEQ ID NO: 503290 - DNA, 20 bp, Artificial
  CRISPR gRNA sequence
tattgtttagagacagggtc

SEQ ID NO: 503291 - DNA, 20 bp, Artificial
  CRISPR gRNA sequence
attgtttagagacagggtct

SEQ ID NO: 503292 - DNA, 20 bp, Artificial
  CRISPR gRNA sequence
ttgtttagagacagggtctc

SEQ ID NO: 503293 - DNA, 20 bp, Artificial
  CRISPR gRNA sequence
tttagagacagggtctcttt

SEQ ID NO: 503294 - DNA, 20 bp, Artificial
  CRISPR gRNA sequence
agagacagggtctctttatt

SEQ ID NO: 503295 - DNA, 20 bp, Artificial
  CRISPR gRNA sequence
gagacagggtctctttattt

SEQ ID NO: 503296 - DNA, 20 bp, Artificial
  CRISPR gRNA sequence
tttatttattttttatttcc

SEQ ID NO: 503297 - DNA, 20 bp, Artificial
  CRISPR gRNA sequence
tatttattttttatttccat

SEQ ID NO: 503298 - DNA, 20 bp, Artificial
  CRISPR gRNA sequence
atttattttttatttccata

SEQ ID NO: 503299 - DNA, 20 bp, Artificial
  CRISPR gRNA sequence
tttattttttatttccatag

SEQ ID NO: 503300 - DNA, 20 bp, Artificial
  CRISPR gRNA sequence
attttttatttccataggtt

SEQ ID NO: 503301 - DNA, 20 bp, Artificial
  CRISPR gRNA sequence
ttttttatttccataggttt

SEQ ID NO: 503302 - DNA, 20 bp, Artificial
  CRISPR gRNA sequence
tttatttccataggtttttt

SEQ ID NO: 503303 - DNA, 20 bp, Artificial
  CRISPR gRNA sequence
ttatttccataggttttttt

SEQ ID NO: 503304 - DNA, 20 bp, Artificial
  CRISPR gRNA sequence
tatttccataggtttttttg

SEQ ID NO: 503305 - DNA, 20 bp, Artificial
  CRISPR gRNA sequence
atttccataggtttttttgg

SEQ ID NO: 503306 - DNA, 20 bp, Artificial
  CRISPR gRNA sequence
tttccataggtttttttggg

SEQ ID NO: 503307 - DNA, 20 bp, Artificial
  CRISPR gRNA sequence
ccataggtttttttgggaac

SEQ ID NO: 503308 - DNA, 20 bp, Artificial
  CRISPR gRNA sequence
cataggtttttttgggaaca

SEQ ID NO: 503309 - DNA, 20 bp, Artificial
  CRISPR gRNA sequence
ttttgggaacaggtggcatt

SEQ ID NO: 503310 - DNA, 20 bp, Artificial
  CRISPR gRNA sequence
tttgggaacaggtggcattt

SEQ ID NO: 503311 - DNA, 20 bp, Artificial
  CRISPR gRNA sequence
ttgggaacaggtggcatttg

SEQ ID NO: 503312 - DNA, 20 bp, Artificial
  CRISPR gRNA sequence
tgggaacaggtggcatttgg

SEQ ID NO: 503313 - DNA, 20 bp, Artificial
  CRISPR gRNA sequence
gggaacaggtggcatttggt

SEQ ID NO: 503314 - DNA, 20 bp, Artificial
  CRISPR gRNA sequence
ggaacaggtggcatttggtg

SEQ ID NO: 503315 - DNA, 20 bp, Artificial
  CRISPR gRNA sequence
ggtgtcatgagtcagttctt

SEQ ID NO: 503316 - DNA, 20 bp, Artificial
  CRISPR gRNA sequence
gtgtcatgagtcagttcttt

SEQ ID NO: 503317 - DNA, 20 bp, Artificial
  CRISPR gRNA sequence
tttagtggtgatttgtgaga

SEQ ID NO: 503318 - DNA, 20 bp, Artificial
  CRISPR gRNA sequence
tagtggtgatttgtgagatt

SEQ ID NO: 503319 - DNA, 20 bp, Artificial
  CRISPR gRNA sequence
agtggtgatttgtgagattt

SEQ ID NO: 503320 - DNA, 20 bp, Artificial
  CRISPR gRNA sequence
gtggtgatttgtgagatttt

SEQ ID NO: 503321 - DNA, 20 bp, Artificial
  CRISPR gRNA sequence
gtgagatttttggtataccc

SEQ ID NO: 503322 - DNA, 20 bp, Artificial
  CRISPR gRNA sequence
tgagatttttggtatacccg

SEQ ID NO: 503323 - DNA, 20 bp, Artificial
  CRISPR gRNA sequence
ttggtatacccgttatgaga

SEQ ID NO: 503324 - DNA, 20 bp, Artificial
  CRISPR gRNA sequence
tggtatacccgttatgagac

SEQ ID NO: 503325 - DNA, 20 bp, Artificial
  CRISPR gRNA sequence
ggtatacccgttatgagaca

SEQ ID NO: 503326 - DNA, 20 bp, Artificial
  CRISPR gRNA sequence
gtatacccgttatgagacag

SEQ ID NO: 503327 - DNA, 20 bp, Artificial
  CRISPR gRNA sequence
tgagacaggatctcattctg

SEQ ID NO: 503328 - DNA, 20 bp, Artificial
  CRISPR gRNA sequence
attctgtctaccaggctgag

SEQ ID NO: 503329 - DNA, 20 bp, Artificial
  CRISPR gRNA sequence
tgtctaccaggctgagtgca

SEQ ID NO: 503330 - DNA, 20 bp, Artificial
  CRISPR gRNA sequence
tctaccaggctgagtgcaat

SEQ ID NO: 503331 - DNA, 20 bp, Artificial
  CRISPR gRNA sequence
ccaggctgagtgcaatggta

SEQ ID NO: 503332 - DNA, 20 bp, Artificial
  CRISPR gRNA sequence
agtgcaatggtagaatcata

SEQ ID NO: 503333 - DNA, 20 bp, Artificial
  CRISPR gRNA sequence
actgaagccttgaattcccg

SEQ ID NO: 503334 - DNA, 20 bp, Artificial
  CRISPR gRNA sequence
ctgaagccttgaattcccgg

SEQ ID NO: 503335 - DNA, 20 bp, Artificial
  CRISPR gRNA sequence
aagccttgaattcccggcct

SEQ ID NO: 503336 - DNA, 20 bp, Artificial
  CRISPR gRNA sequence
gaattcccggcctcaagtga

SEQ ID NO: 503337 - DNA, 20 bp, Artificial
  CRISPR gRNA sequence
aattcccggcctcaagtgat

SEQ ID NO: 503338 - DNA, 20 bp, Artificial
  CRISPR gRNA sequence
ccggcctcaagtgatcctcc

SEQ ID NO: 503339 - DNA, 20 bp, Artificial
  CRISPR gRNA sequence
aagtgatcctcccacctcag

SEQ ID NO: 503340 - DNA, 20 bp, Artificial
  CRISPR gRNA sequence
ccacctcagcctcctgggta

SEQ ID NO: 503341 - DNA, 20 bp, Artificial
  CRISPR gRNA sequence
agcctcctgggtagctaggt

SEQ ID NO: 503342 - DNA, 20 bp, Artificial
  CRISPR gRNA sequence
ctgggtagctaggtctgcag

SEQ ID NO: 503343 - DNA, 20 bp, Artificial
  CRISPR gRNA sequence
ggtagctaggtctgcaggtg
